United States Patent 11,421,016 (CANCER NEOEPITOPES) - sequence listing, part 7

SEQ ID NO: 277319 - protein, 9 aa, Homo Sapiens
KEVEYQMTS

SEQ ID NO: 277320 - protein, 9 aa, Homo Sapiens
GKKDREKDK

SEQ ID NO: 277321 - protein, 9 aa, Homo Sapiens
LAAMAYDQA

SEQ ID NO: 277322 - protein, 9 aa, Homo Sapiens
EDGDPNAEA

SEQ ID NO: 277323 - protein, 9 aa, Homo Sapiens
ILLSIFEEE

SEQ ID NO: 277324 - protein, 9 aa, Homo Sapiens
METNTEPFQ

SEQ ID NO: 277325 - protein, 9 aa, Homo Sapiens
TVEWRLRGP

SEQ ID NO: 277326 - protein, 9 aa, Homo Sapiens
AIIQGAKLI

SEQ ID NO: 277327 - protein, 9 aa, Homo Sapiens
IIFNLADTH

SEQ ID NO: 277328 - protein, 9 aa, Homo Sapiens
GEGSAEASG

SEQ ID NO: 277329 - protein, 9 aa, Homo Sapiens
SFKMTTGHT

SEQ ID NO: 277330 - protein, 9 aa, Homo Sapiens
GSKYLKDVQ

SEQ ID NO: 277331 - protein, 9 aa, Homo Sapiens
KEQVTQNVL

SEQ ID NO: 277332 - protein, 9 aa, Homo Sapiens
ALSHSDRCW

SEQ ID NO: 277333 - protein, 9 aa, Homo Sapiens
IYTDEAAAE

SEQ ID NO: 277334 - protein, 9 aa, Homo Sapiens
WIHELPVGC

SEQ ID NO: 277335 - protein, 9 aa, Homo Sapiens
TNSKVTGKD

SEQ ID NO: 277336 - protein, 9 aa, Homo Sapiens
KGVGTRHRA

SEQ ID NO: 277337 - protein, 9 aa, Homo Sapiens
AKDHPKIAN

SEQ ID NO: 277338 - protein, 9 aa, Homo Sapiens
SLGKITDYG

SEQ ID NO: 277339 - protein, 9 aa, Homo Sapiens
IRIFCWFNL

SEQ ID NO: 277340 - protein, 9 aa, Homo Sapiens
LMVDLHEQV

SEQ ID NO: 277341 - protein, 9 aa, Homo Sapiens
GKHKRGETK

SEQ ID NO: 277342 - protein, 9 aa, Homo Sapiens
LAPQNLPST

SEQ ID NO: 277343 - protein, 9 aa, Homo Sapiens
NQLYDTQVI

SEQ ID NO: 277344 - protein, 9 aa, Homo Sapiens
ELFLKNLKL

SEQ ID NO: 277345 - protein, 9 aa, Homo Sapiens
ADANVEGLG

SEQ ID NO: 277346 - protein, 9 aa, Homo Sapiens
RLREITENL

SEQ ID NO: 277347 - protein, 9 aa, Homo Sapiens
EEAIRISLE

SEQ ID NO: 277348 - protein, 9 aa, Homo Sapiens
KNVISLQLD

SEQ ID NO: 277349 - protein, 9 aa, Homo Sapiens
EVKAALKSA

SEQ ID NO: 277350 - protein, 9 aa, Homo Sapiens
EYHMDDGSP

SEQ ID NO: 277351 - protein, 9 aa, Homo Sapiens
VCHPKYIYA

SEQ ID NO: 277352 - protein, 9 aa, Homo Sapiens
VSCVLSSDL

SEQ ID NO: 277353 - protein, 9 aa, Homo Sapiens
RDTFKGLKH

SEQ ID NO: 277354 - protein, 9 aa, Homo Sapiens
EPGDQTALK

SEQ ID NO: 277355 - protein, 9 aa, Homo Sapiens
LEDHIKRKD

SEQ ID NO: 277356 - protein, 9 aa, Homo Sapiens
NYLHERSEN

SEQ ID NO: 277357 - protein, 9 aa, Homo Sapiens
KDLIKCMLR

SEQ ID NO: 277358 - protein, 9 aa, Homo Sapiens
RQRQLQQQQ

SEQ ID NO: 277359 - protein, 9 aa, Homo Sapiens
SVKNVIAET

SEQ ID NO: 277360 - protein, 9 aa, Homo Sapiens
PSDSGYSYD

SEQ ID NO: 277361 - protein, 9 aa, Homo Sapiens
GYLCTDKSN

SEQ ID NO: 277362 - protein, 9 aa, Homo Sapiens
VSITKDYEL

SEQ ID NO: 277363 - protein, 9 aa, Homo Sapiens
VMKERDNRR

SEQ ID NO: 277364 - protein, 9 aa, Homo Sapiens
PLSTTAVWH

SEQ ID NO: 277365 - protein, 9 aa, Homo Sapiens
QALQKALEP

SEQ ID NO: 277366 - protein, 9 aa, Homo Sapiens
TEYIDGLES

SEQ ID NO: 277367 - protein, 9 aa, Homo Sapiens
AMAAAKSKY

SEQ ID NO: 277368 - protein, 9 aa, Homo Sapiens
HSCSYDSVI

SEQ ID NO: 277369 - protein, 9 aa, Homo Sapiens
TAVGSSEKI

SEQ ID NO: 277370 - protein, 9 aa, Homo Sapiens
EGDESVREL

SEQ ID NO: 277371 - protein, 9 aa, Homo Sapiens
TMIRYFTLN

SEQ ID NO: 277372 - protein, 9 aa, Homo Sapiens
AQRRRSSTQ

SEQ ID NO: 277373 - protein, 9 aa, Homo Sapiens
AQTFLSEIQ

SEQ ID NO: 277374 - protein, 9 aa, Homo Sapiens
YPLWEAFEL

SEQ ID NO: 277375 - protein, 9 aa, Homo Sapiens
GLPTGEVLE

SEQ ID NO: 277376 - protein, 9 aa, Homo Sapiens
TGHLPVEPN

SEQ ID NO: 277377 - protein, 9 aa, Homo Sapiens
NRTAENQSK

SEQ ID NO: 277378 - protein, 9 aa, Homo Sapiens
GEFSSSRAG

SEQ ID NO: 277379 - protein, 9 aa, Homo Sapiens
TPAPSRTAY

SEQ ID NO: 277380 - protein, 9 aa, Homo Sapiens
EGEGGSGAS

SEQ ID NO: 277381 - protein, 9 aa, Homo Sapiens
TNKNSLLGM

SEQ ID NO: 277382 - protein, 9 aa, Homo Sapiens
SVAMSHGNK

SEQ ID NO: 277383 - protein, 9 aa, Homo Sapiens
LPVVIIIDN

SEQ ID NO: 277384 - protein, 9 aa, Homo Sapiens
KAYRWLSDL

SEQ ID NO: 277385 - protein, 9 aa, Homo Sapiens
YGFNEPKQS

SEQ ID NO: 277386 - protein, 9 aa, Homo Sapiens
NKLETICYL

SEQ ID NO: 277387 - protein, 9 aa, Homo Sapiens
FAAFCYMLP

SEQ ID NO: 277388 - protein, 9 aa, Homo Sapiens
GSPGQSIGI

SEQ ID NO: 277389 - protein, 9 aa, Homo Sapiens
RAQRLKLLC

SEQ ID NO: 277390 - protein, 9 aa, Homo Sapiens
SIELENVFI

SEQ ID NO: 277391 - protein, 9 aa, Homo Sapiens
ASAWNLYLP

SEQ ID NO: 277392 - protein, 9 aa, Homo Sapiens
KKNLLEGEV

SEQ ID NO: 277393 - protein, 9 aa, Homo Sapiens
HPDVISYLT

SEQ ID NO: 277394 - protein, 9 aa, Homo Sapiens
AAIFQSLTK

SEQ ID NO: 277395 - protein, 9 aa, Homo Sapiens
IAHRRSEEL

SEQ ID NO: 277396 - protein, 9 aa, Homo Sapiens
LENLQTLNV

SEQ ID NO: 277397 - protein, 9 aa, Homo Sapiens
KVRPVLLKC

SEQ ID NO: 277398 - protein, 9 aa, Homo Sapiens
GSQRRCPLG

SEQ ID NO: 277399 - protein, 9 aa, Homo Sapiens
LYLANNHIK

SEQ ID NO: 277400 - protein, 9 aa, Homo Sapiens
IVKSIEIAK

SEQ ID NO: 277401 - protein, 9 aa, Homo Sapiens
IGEKTFSFR

SEQ ID NO: 277402 - protein, 9 aa, Homo Sapiens
TFLIVCYLK

SEQ ID NO: 277403 - protein, 9 aa, Homo Sapiens
ELCGATRRG

SEQ ID NO: 277404 - protein, 9 aa, Homo Sapiens
QFIFQTDTR

SEQ ID NO: 277405 - protein, 9 aa, Homo Sapiens
KAIRVDLVM

SEQ ID NO: 277406 - protein, 9 aa, Homo Sapiens
EHQVIGYRA

SEQ ID NO: 277407 - protein, 9 aa, Homo Sapiens
VRHCVNMLF

SEQ ID NO: 277408 - protein, 9 aa, Homo Sapiens
NFPEENNDT

SEQ ID NO: 277409 - protein, 9 aa, Homo Sapiens
FQICGYRVL

SEQ ID NO: 277410 - protein, 9 aa, Homo Sapiens
NIRYLIQFL

SEQ ID NO: 277411 - protein, 9 aa, Homo Sapiens
TVFTLLAIA

SEQ ID NO: 277412 - protein, 9 aa, Homo Sapiens
YGIPEHETF

SEQ ID NO: 277413 - protein, 9 aa, Homo Sapiens
VLEFVCEAI

SEQ ID NO: 277414 - protein, 9 aa, Homo Sapiens
VIQIELDHE

SEQ ID NO: 277415 - protein, 9 aa, Homo Sapiens
SFVPSAWRS

SEQ ID NO: 277416 - protein, 9 aa, Homo Sapiens
KLTPKGACA

SEQ ID NO: 277417 - protein, 9 aa, Homo Sapiens
EEAANEDKS

SEQ ID NO: 277418 - protein, 9 aa, Homo Sapiens
SLQKQNTMK

SEQ ID NO: 277419 - protein, 9 aa, Homo Sapiens
RVAVEAPVR

SEQ ID NO: 277420 - protein, 9 aa, Homo Sapiens
TLKRLSTLT

SEQ ID NO: 277421 - protein, 9 aa, Homo Sapiens
AWKACCHPP

SEQ ID NO: 277422 - protein, 9 aa, Homo Sapiens
AVQLQCGYA

SEQ ID NO: 277423 - protein, 9 aa, Homo Sapiens
KPLYWTMIQ

SEQ ID NO: 277424 - protein, 9 aa, Homo Sapiens
LQHLSQLLP

SEQ ID NO: 277425 - protein, 9 aa, Homo Sapiens
FRAVDSSAP

SEQ ID NO: 277426 - protein, 9 aa, Homo Sapiens
SKALPTLSA

SEQ ID NO: 277427 - protein, 9 aa, Homo Sapiens
YRQHRDAKE

SEQ ID NO: 277428 - protein, 9 aa, Homo Sapiens
PYFYEESET

SEQ ID NO: 277429 - protein, 9 aa, Homo Sapiens
LCYEGKSTP

SEQ ID NO: 277430 - protein, 9 aa, Homo Sapiens
KAVSEHLPY

SEQ ID NO: 277431 - protein, 9 aa, Homo Sapiens
PEMLNSCSS

SEQ ID NO: 277432 - protein, 9 aa, Homo Sapiens
KTGSLNAYL

SEQ ID NO: 277433 - protein, 9 aa, Homo Sapiens
EYHEGCTWG

SEQ ID NO: 277434 - protein, 9 aa, Homo Sapiens
TTTMCIYVS

SEQ ID NO: 277435 - protein, 9 aa, Homo Sapiens
KPHDILGIP

SEQ ID NO: 277436 - protein, 9 aa, Homo Sapiens
KRSQCKEIM

SEQ ID NO: 277437 - protein, 9 aa, Homo Sapiens
GILGSTIRT

SEQ ID NO: 277438 - protein, 9 aa, Homo Sapiens
ISRSGKTLG

SEQ ID NO: 277439 - protein, 9 aa, Homo Sapiens
EWSCQLPCE

SEQ ID NO: 277440 - protein, 9 aa, Homo Sapiens
SKPEVEFTT

SEQ ID NO: 277441 - protein, 9 aa, Homo Sapiens
QWHEKTLAV

SEQ ID NO: 277442 - protein, 9 aa, Homo Sapiens
PISKIEQWL

SEQ ID NO: 277443 - protein, 9 aa, Homo Sapiens
ARKLIKKKR

SEQ ID NO: 277444 - protein, 9 aa, Homo Sapiens
YFSSEGHLR

SEQ ID NO: 277445 - protein, 9 aa, Homo Sapiens
DKEQKANET

SEQ ID NO: 277446 - protein, 9 aa, Homo Sapiens
LETSSSEDM

SEQ ID NO: 277447 - protein, 9 aa, Homo Sapiens
LGQDARWLG

SEQ ID NO: 277448 - protein, 9 aa, Homo Sapiens
AEFKCEEYI

SEQ ID NO: 277449 - protein, 9 aa, Homo Sapiens
CSEITKNID

SEQ ID NO: 277450 - protein, 9 aa, Homo Sapiens
GDYDNSAFM

SEQ ID NO: 277451 - protein, 9 aa, Homo Sapiens
QESLRRQVP

SEQ ID NO: 277452 - protein, 9 aa, Homo Sapiens
LIIHFLVIF

SEQ ID NO: 277453 - protein, 9 aa, Homo Sapiens
YGFKHIFIT

SEQ ID NO: 277454 - protein, 9 aa, Homo Sapiens
IVWISFIPT

SEQ ID NO: 277455 - protein, 9 aa, Homo Sapiens
NSSVSTLSP

SEQ ID NO: 277456 - protein, 9 aa, Homo Sapiens
PVFEKVLKS

SEQ ID NO: 277457 - protein, 9 aa, Homo Sapiens
HPGFNALDQ

SEQ ID NO: 277458 - protein, 9 aa, Homo Sapiens
MGNSFGSTP

SEQ ID NO: 277459 - protein, 9 aa, Homo Sapiens
LRKIIGVVS

SEQ ID NO: 277460 - protein, 9 aa, Homo Sapiens
LLEQQNKVL

SEQ ID NO: 277461 - protein, 9 aa, Homo Sapiens
KFRQIVLAV

SEQ ID NO: 277462 - protein, 9 aa, Homo Sapiens
AGHEGSWFY

SEQ ID NO: 277463 - protein, 9 aa, Homo Sapiens
ADERILELE

SEQ ID NO: 277464 - protein, 9 aa, Homo Sapiens
FDVLKNHLV

SEQ ID NO: 277465 - protein, 9 aa, Homo Sapiens
SEKVGGQKM

SEQ ID NO: 277466 - protein, 9 aa, Homo Sapiens
QNIRCLEKQ

SEQ ID NO: 277467 - protein, 9 aa, Homo Sapiens
SAQEIDETN

SEQ ID NO: 277468 - protein, 9 aa, Homo Sapiens
HFRPISASK

SEQ ID NO: 277469 - protein, 9 aa, Homo Sapiens
FMFLLVGDL

SEQ ID NO: 277470 - protein, 9 aa, Homo Sapiens
SKVPLTPST

SEQ ID NO: 277471 - protein, 9 aa, Homo Sapiens
CVNGVGTQN

SEQ ID NO: 277472 - protein, 9 aa, Homo Sapiens
ARGEDYDKV

SEQ ID NO: 277473 - protein, 9 aa, Homo Sapiens
SPSTGDDDY

SEQ ID NO: 277474 - protein, 9 aa, Homo Sapiens
AFVYFEQLA

SEQ ID NO: 277475 - protein, 9 aa, Homo Sapiens
ESVFKAIHK

SEQ ID NO: 277476 - protein, 9 aa, Homo Sapiens
FRSQMLAMH

SEQ ID NO: 277477 - protein, 9 aa, Homo Sapiens
HVPNNLFFF

SEQ ID NO: 277478 - protein, 9 aa, Homo Sapiens
LHKHRITHT

SEQ ID NO: 277479 - protein, 9 aa, Homo Sapiens
ATVLIPPHA

SEQ ID NO: 277480 - protein, 9 aa, Homo Sapiens
GDLPSDSGL

SEQ ID NO: 277481 - protein, 9 aa, Homo Sapiens
NAEHAETDV

SEQ ID NO: 277482 - protein, 9 aa, Homo Sapiens
PQFQWSVCR

SEQ ID NO: 277483 - protein, 9 aa, Homo Sapiens
KLSLDFVLK

SEQ ID NO: 277484 - protein, 9 aa, Homo Sapiens
WCASPVVVV

SEQ ID NO: 277485 - protein, 9 aa, Homo Sapiens
TKLEHILLF

SEQ ID NO: 277486 - protein, 9 aa, Homo Sapiens
QRSHFQHVK

SEQ ID NO: 277487 - protein, 9 aa, Homo Sapiens
GTQICAYFG

SEQ ID NO: 277488 - protein, 9 aa, Homo Sapiens
RLYLAVLSN

SEQ ID NO: 277489 - protein, 9 aa, Homo Sapiens
NSVNPTMSI

SEQ ID NO: 277490 - protein, 9 aa, Homo Sapiens
DKQSGKNRG

SEQ ID NO: 277491 - protein, 9 aa, Homo Sapiens
KRKTKTTVE

SEQ ID NO: 277492 - protein, 9 aa, Homo Sapiens
DFAESDQFM

SEQ ID NO: 277493 - protein, 9 aa, Homo Sapiens
NVSNRFQLG

SEQ ID NO: 277494 - protein, 9 aa, Homo Sapiens
IKPHVRPIM

SEQ ID NO: 277495 - protein, 9 aa, Homo Sapiens
LLNAKLQQQ

SEQ ID NO: 277496 - protein, 9 aa, Homo Sapiens
VTVRRDIAP

SEQ ID NO: 277497 - protein, 9 aa, Homo Sapiens
YVHRDLAAC

SEQ ID NO: 277498 - protein, 9 aa, Homo Sapiens
MAFLTSKNC

SEQ ID NO: 277499 - protein, 9 aa, Homo Sapiens
YELGRLFRL

SEQ ID NO: 277500 - protein, 9 aa, Homo Sapiens
VTHTLDSLQ

SEQ ID NO: 277501 - protein, 9 aa, Homo Sapiens
KPLDEGYGM

SEQ ID NO: 277502 - protein, 9 aa, Homo Sapiens
IIRFYHDGK

SEQ ID NO: 277503 - protein, 9 aa, Homo Sapiens
VVVTDGEII

SEQ ID NO: 277504 - protein, 9 aa, Homo Sapiens
LILNYNLLS

SEQ ID NO: 277505 - protein, 9 aa, Homo Sapiens
EDRARWQER

SEQ ID NO: 277506 - protein, 9 aa, Homo Sapiens
TRKAQAGAR

SEQ ID NO: 277507 - protein, 9 aa, Homo Sapiens
DYLATSIDP

SEQ ID NO: 277508 - protein, 9 aa, Homo Sapiens
DEGRQKVAE

SEQ ID NO: 277509 - protein, 9 aa, Homo Sapiens
TMSQFKMDT

SEQ ID NO: 277510 - protein, 9 aa, Homo Sapiens
AEKDRKFVI

SEQ ID NO: 277511 - protein, 9 aa, Homo Sapiens
RVCSGKAPP

SEQ ID NO: 277512 - protein, 9 aa, Homo Sapiens
KNIDVKGSE

SEQ ID NO: 277513 - protein, 9 aa, Homo Sapiens
WIFEELLTC

SEQ ID NO: 277514 - protein, 9 aa, Homo Sapiens
SKKEIKQLE

SEQ ID NO: 277515 - protein, 9 aa, Homo Sapiens
GGKLSAVLR

SEQ ID NO: 277516 - protein, 9 aa, Homo Sapiens
IDNIKWEKT

SEQ ID NO: 277517 - protein, 9 aa, Homo Sapiens
QSVVGMLTI

SEQ ID NO: 277518 - protein, 9 aa, Homo Sapiens
ADHKLQRYA

SEQ ID NO: 277519 - protein, 9 aa, Homo Sapiens
RNCAQSNQY

SEQ ID NO: 277520 - protein, 9 aa, Homo Sapiens
GFLDCLLKL

SEQ ID NO: 277521 - protein, 9 aa, Homo Sapiens
FLKPSKVEE

SEQ ID NO: 277522 - protein, 9 aa, Homo Sapiens
NSTWDAKQG

SEQ ID NO: 277523 - protein, 9 aa, Homo Sapiens
LQTPISEGR

SEQ ID NO: 277524 - protein, 9 aa, Homo Sapiens
QLPFVIFLL

SEQ ID NO: 277525 - protein, 9 aa, Homo Sapiens
ELNSTQRVV

SEQ ID NO: 277526 - protein, 9 aa, Homo Sapiens
PLQEVPLCY

SEQ ID NO: 277527 - protein, 9 aa, Homo Sapiens
LQIIGFAAE

SEQ ID NO: 277528 - protein, 9 aa, Homo Sapiens
LNRRSALEK

SEQ ID NO: 277529 - protein, 9 aa, Homo Sapiens
RTLEGCISV

SEQ ID NO: 277530 - protein, 9 aa, Homo Sapiens
SASFLWPLL

SEQ ID NO: 277531 - protein, 9 aa, Homo Sapiens
CYFPPSWIA

SEQ ID NO: 277532 - protein, 9 aa, Homo Sapiens
DTRLPVTKI

SEQ ID NO: 277533 - protein, 9 aa, Homo Sapiens
TFSHLRYFL

SEQ ID NO: 277534 - protein, 9 aa, Homo Sapiens
ARSSPATLQ

SEQ ID NO: 277535 - protein, 9 aa, Homo Sapiens
KASRVCIDS

SEQ ID NO: 277536 - protein, 9 aa, Homo Sapiens
SLPTELGGC

SEQ ID NO: 277537 - protein, 9 aa, Homo Sapiens
IINTNKLSA

SEQ ID NO: 277538 - protein, 9 aa, Homo Sapiens
KVLKLTRNI

SEQ ID NO: 277539 - protein, 9 aa, Homo Sapiens
DVNYLILEG

SEQ ID NO: 277540 - protein, 9 aa, Homo Sapiens
RLENQNILI

SEQ ID NO: 277541 - protein, 9 aa, Homo Sapiens
IKAIHADKQ

SEQ ID NO: 277542 - protein, 9 aa, Homo Sapiens
SILPAGFKP

SEQ ID NO: 277543 - protein, 9 aa, Homo Sapiens
KWPNAYFRQ

SEQ ID NO: 277544 - protein, 9 aa, Homo Sapiens
SYKDSWDFE

SEQ ID NO: 277545 - protein, 9 aa, Homo Sapiens
AFVQLLASV

SEQ ID NO: 277546 - protein, 9 aa, Homo Sapiens
LRFTRENSE

SEQ ID NO: 277547 - protein, 9 aa, Homo Sapiens
LLSNKKSIS

SEQ ID NO: 277548 - protein, 9 aa, Homo Sapiens
ALGFVKLPR

SEQ ID NO: 277549 - protein, 9 aa, Homo Sapiens
KGEIGLPGF

SEQ ID NO: 277550 - protein, 9 aa, Homo Sapiens
VLETSSSED

SEQ ID NO: 277551 - protein, 9 aa, Homo Sapiens
SDLLIHQKV

SEQ ID NO: 277552 - protein, 9 aa, Homo Sapiens
FSKKCHLIV

SEQ ID NO: 277553 - protein, 9 aa, Homo Sapiens
RHASYHIGA

SEQ ID NO: 277554 - protein, 9 aa, Homo Sapiens
DDKPHDILG

SEQ ID NO: 277555 - protein, 9 aa, Homo Sapiens
RKILPPVKR

SEQ ID NO: 277556 - protein, 9 aa, Homo Sapiens
EGEEPRSDL

SEQ ID NO: 277557 - protein, 9 aa, Homo Sapiens
LIQQLEKVL

SEQ ID NO: 277558 - protein, 9 aa, Homo Sapiens
LTSETGSYN

SEQ ID NO: 277559 - protein, 9 aa, Homo Sapiens
WKTNHVTIP

SEQ ID NO: 277560 - protein, 9 aa, Homo Sapiens
VDNENYARH

SEQ ID NO: 277561 - protein, 9 aa, Homo Sapiens
SLRNFPSAK

SEQ ID NO: 277562 - protein, 9 aa, Homo Sapiens
SVPLKIEYI

SEQ ID NO: 277563 - protein, 9 aa, Homo Sapiens
KTRKEEWDK

SEQ ID NO: 277564 - protein, 9 aa, Homo Sapiens
EVLESEKVP

SEQ ID NO: 277565 - protein, 9 aa, Homo Sapiens
YSVHICGMN

SEQ ID NO: 277566 - protein, 9 aa, Homo Sapiens
IDDEEEDYE

SEQ ID NO: 277567 - protein, 9 aa, Homo Sapiens
VNTINPGAH

SEQ ID NO: 277568 - protein, 9 aa, Homo Sapiens
LTENYHNYS

SEQ ID NO: 277569 - protein, 9 aa, Homo Sapiens
KYMTGKEDN

SEQ ID NO: 277570 - protein, 9 aa, Homo Sapiens
LVLGLHFIG

SEQ ID NO: 277571 - protein, 9 aa, Homo Sapiens
SFQNKIISN

SEQ ID NO: 277572 - protein, 9 aa, Homo Sapiens
VQVNTFALA

SEQ ID NO: 277573 - protein, 9 aa, Homo Sapiens
SIFRDVNNH

SEQ ID NO: 277574 - protein, 9 aa, Homo Sapiens
GINIDIEQD

SEQ ID NO: 277575 - protein, 9 aa, Homo Sapiens
KEVKAALKS

SEQ ID NO: 277576 - protein, 9 aa, Homo Sapiens
FETMSLYDL

SEQ ID NO: 277577 - protein, 9 aa, Homo Sapiens
ILEVEKSSR

SEQ ID NO: 277578 - protein, 9 aa, Homo Sapiens
LTSRRPHLP

SEQ ID NO: 277579 - protein, 9 aa, Homo Sapiens
EKSLYIIRA

SEQ ID NO: 277580 - protein, 9 aa, Homo Sapiens
HQVHADDLL

SEQ ID NO: 277581 - protein, 9 aa, Homo Sapiens
VLDCLPLGQ

SEQ ID NO: 277582 - protein, 9 aa, Homo Sapiens
KWYNHSSLQ

SEQ ID NO: 277583 - protein, 9 aa, Homo Sapiens
EDKFQWLGG

SEQ ID NO: 277584 - protein, 9 aa, Homo Sapiens
RQSIALSPR

SEQ ID NO: 277585 - protein, 9 aa, Homo Sapiens
FTKYCKTWQ

SEQ ID NO: 277586 - protein, 9 aa, Homo Sapiens
TVHRINNTT

SEQ ID NO: 277587 - protein, 9 aa, Homo Sapiens
SQNNLYRYV

SEQ ID NO: 277588 - protein, 9 aa, Homo Sapiens
PITICSLSH

SEQ ID NO: 277589 - protein, 9 aa, Homo Sapiens
ISSGSEREE

SEQ ID NO: 277590 - protein, 9 aa, Homo Sapiens
PRAPSFLAL

SEQ ID NO: 277591 - protein, 9 aa, Homo Sapiens
KNQEDLLRE

SEQ ID NO: 277592 - protein, 9 aa, Homo Sapiens
ARLPIHMFR

SEQ ID NO: 277593 - protein, 9 aa, Homo Sapiens
NDALFQYNG

SEQ ID NO: 277594 - protein, 9 aa, Homo Sapiens
EGPSGPCVL

SEQ ID NO: 277595 - protein, 9 aa, Homo Sapiens
DGSTSIGKW

SEQ ID NO: 277596 - protein, 9 aa, Homo Sapiens
FITWCRVQK

SEQ ID NO: 277597 - protein, 9 aa, Homo Sapiens
RGKLENDGS

SEQ ID NO: 277598 - protein, 9 aa, Homo Sapiens
EQEKMLQEK

SEQ ID NO: 277599 - protein, 9 aa, Homo Sapiens
LPSPHKAVT

SEQ ID NO: 277600 - protein, 9 aa, Homo Sapiens
DCKVVNVLA

SEQ ID NO: 277601 - protein, 9 aa, Homo Sapiens
YVGEVVLAL

SEQ ID NO: 277602 - protein, 9 aa, Homo Sapiens
SVGFFFHIF

SEQ ID NO: 277603 - protein, 9 aa, Homo Sapiens
AVNMFQKHN

SEQ ID NO: 277604 - protein, 9 aa, Homo Sapiens
YNTIFLFFK

SEQ ID NO: 277605 - protein, 9 aa, Homo Sapiens
RNLDKALSY

SEQ ID NO: 277606 - protein, 9 aa, Homo Sapiens
DEFLGICHS

SEQ ID NO: 277607 - protein, 9 aa, Homo Sapiens
KWQEEEKKK

SEQ ID NO: 277608 - protein, 9 aa, Homo Sapiens
ERELYKARC

SEQ ID NO: 277609 - protein, 9 aa, Homo Sapiens
TFKHIHEIS

SEQ ID NO: 277610 - protein, 9 aa, Homo Sapiens
LMMHRINKL

SEQ ID NO: 277611 - protein, 9 aa, Homo Sapiens
SIKFVSNLK

SEQ ID NO: 277612 - protein, 9 aa, Homo Sapiens
SCVLGLIWG

SEQ ID NO: 277613 - protein, 9 aa, Homo Sapiens
RVIHDWADG

SEQ ID NO: 277614 - protein, 9 aa, Homo Sapiens
DLEAQTGAG

SEQ ID NO: 277615 - protein, 9 aa, Homo Sapiens
QPPPRIKNF

SEQ ID NO: 277616 - protein, 9 aa, Homo Sapiens
GFLDRYDPN

SEQ ID NO: 277617 - protein, 9 aa, Homo Sapiens
SVYKNASFQ

SEQ ID NO: 277618 - protein, 9 aa, Homo Sapiens
FNTDLQLWQ

SEQ ID NO: 277619 - protein, 9 aa, Homo Sapiens
ELFERYHAL

SEQ ID NO: 277620 - protein, 9 aa, Homo Sapiens
TLPNIALQG

SEQ ID NO: 277621 - protein, 9 aa, Homo Sapiens
HLALYSNPS

SEQ ID NO: 277622 - protein, 9 aa, Homo Sapiens
ITFCNAKVP

SEQ ID NO: 277623 - protein, 9 aa, Homo Sapiens
MDKPLFPLV

SEQ ID NO: 277624 - protein, 9 aa, Homo Sapiens
KPLYNWLLI

SEQ ID NO: 277625 - protein, 9 aa, Homo Sapiens
RHSLEYSLQ

SEQ ID NO: 277626 - protein, 9 aa, Homo Sapiens
TCVQFANPS

SEQ ID NO: 277627 - protein, 9 aa, Homo Sapiens
DDAQVLEYL

SEQ ID NO: 277628 - protein, 9 aa, Homo Sapiens
LTSQGKKPA

SEQ ID NO: 277629 - protein, 9 aa, Homo Sapiens
GMSEFPNTC

SEQ ID NO: 277630 - protein, 9 aa, Homo Sapiens
TFNKTLNIR

SEQ ID NO: 277631 - protein, 9 aa, Homo Sapiens
YHRGGYKPV

SEQ ID NO: 277632 - protein, 9 aa, Homo Sapiens
PNQQSTVLR

SEQ ID NO: 277633 - protein, 9 aa, Homo Sapiens
IVPTDIKTE

SEQ ID NO: 277634 - protein, 9 aa, Homo Sapiens
IGSAIVAVI

SEQ ID NO: 277635 - protein, 9 aa, Homo Sapiens
KQLNKSMKG

SEQ ID NO: 277636 - protein, 9 aa, Homo Sapiens
IPGMNMGPG

SEQ ID NO: 277637 - protein, 9 aa, Homo Sapiens
MHSKHFENS

SEQ ID NO: 277638 - protein, 9 aa, Homo Sapiens
IGGVPWDIT

SEQ ID NO: 277639 - protein, 9 aa, Homo Sapiens
IILEKVAAT

SEQ ID NO: 277640 - protein, 9 aa, Homo Sapiens
SAEHSQGLE

SEQ ID NO: 277641 - protein, 9 aa, Homo Sapiens
WFQLESNKE

SEQ ID NO: 277642 - protein, 9 aa, Homo Sapiens
LRSALEDSY

SEQ ID NO: 277643 - protein, 9 aa, Homo Sapiens
IIAIVVTVL

SEQ ID NO: 277644 - protein, 9 aa, Homo Sapiens
EQLKVNHEA

SEQ ID NO: 277645 - protein, 9 aa, Homo Sapiens
WLLGTTHAE

SEQ ID NO: 277646 - protein, 9 aa, Homo Sapiens
YVQRVNINL

SEQ ID NO: 277647 - protein, 9 aa, Homo Sapiens
SNKQRASKV

SEQ ID NO: 277648 - protein, 9 aa, Homo Sapiens
INAVAASLQ

SEQ ID NO: 277649 - protein, 9 aa, Homo Sapiens
SFQDCYFET

SEQ ID NO: 277650 - protein, 9 aa, Homo Sapiens
ESHDEPEER

SEQ ID NO: 277651 - protein, 9 aa, Homo Sapiens
ADVTPITQG

SEQ ID NO: 277652 - protein, 9 aa, Homo Sapiens
NIYIDKNKE

SEQ ID NO: 277653 - protein, 9 aa, Homo Sapiens
GKEEQRARY

SEQ ID NO: 277654 - protein, 9 aa, Homo Sapiens
HLEIHGAML

SEQ ID NO: 277655 - protein, 9 aa, Homo Sapiens
VHSGDVTLV

SEQ ID NO: 277656 - protein, 9 aa, Homo Sapiens
KDPINAGLK

SEQ ID NO: 277657 - protein, 9 aa, Homo Sapiens
NEDDAKAAK

SEQ ID NO: 277658 - protein, 9 aa, Homo Sapiens
LQVNSDTQL

SEQ ID NO: 277659 - protein, 9 aa, Homo Sapiens
GLWTWRYQE

SEQ ID NO: 277660 - protein, 9 aa, Homo Sapiens
LTGAALTLT

SEQ ID NO: 277661 - protein, 9 aa, Homo Sapiens
HVTGENFFK

SEQ ID NO: 277662 - protein, 9 aa, Homo Sapiens
ITKNNDLVC

SEQ ID NO: 277663 - protein, 9 aa, Homo Sapiens
SKALTFYRK

SEQ ID NO: 277664 - protein, 9 aa, Homo Sapiens
FRPRPHQQP

SEQ ID NO: 277665 - protein, 9 aa, Homo Sapiens
YILTSNRVA

SEQ ID NO: 277666 - protein, 9 aa, Homo Sapiens
LYDMNRWLN

SEQ ID NO: 277667 - protein, 9 aa, Homo Sapiens
AAYAPGARL

SEQ ID NO: 277668 - protein, 9 aa, Homo Sapiens
HFAHWLAFG

SEQ ID NO: 277669 - protein, 9 aa, Homo Sapiens
VVCCLVPCF

SEQ ID NO: 277670 - protein, 9 aa, Homo Sapiens
TTDISTDKE

SEQ ID NO: 277671 - protein, 9 aa, Homo Sapiens
SKDGETSLV

SEQ ID NO: 277672 - protein, 9 aa, Homo Sapiens
QKRVPQLIF

SEQ ID NO: 277673 - protein, 9 aa, Homo Sapiens
GRDKFKRLP

SEQ ID NO: 277674 - protein, 9 aa, Homo Sapiens
ITKNERLWL

SEQ ID NO: 277675 - protein, 9 aa, Homo Sapiens
TYLYFFLGT

SEQ ID NO: 277676 - protein, 9 aa, Homo Sapiens
QTICAGGKP

SEQ ID NO: 277677 - protein, 9 aa, Homo Sapiens
CMYIIAVVG

SEQ ID NO: 277678 - protein, 9 aa, Homo Sapiens
MQINEAKIA

SEQ ID NO: 277679 - protein, 9 aa, Homo Sapiens
KDLEQQDCG

SEQ ID NO: 277680 - protein, 9 aa, Homo Sapiens
SNAFPFYSS

SEQ ID NO: 277681 - protein, 9 aa, Homo Sapiens
VTVMGNISI

SEQ ID NO: 277682 - protein, 9 aa, Homo Sapiens
TFLAIRWHD

SEQ ID NO: 277683 - protein, 9 aa, Homo Sapiens
KEKPKIGDA

SEQ ID NO: 277684 - protein, 9 aa, Homo Sapiens
ISLSTRFGT

SEQ ID NO: 277685 - protein, 9 aa, Homo Sapiens
FGGSACFTL

SEQ ID NO: 277686 - protein, 9 aa, Homo Sapiens
DFLPIPQFF

SEQ ID NO: 277687 - protein, 9 aa, Homo Sapiens
KNKNKWYKS

SEQ ID NO: 277688 - protein, 9 aa, Homo Sapiens
KNNSKERPT

SEQ ID NO: 277689 - protein, 9 aa, Homo Sapiens
APKFIIYLL

SEQ ID NO: 277690 - protein, 9 aa, Homo Sapiens
STEANTGNM

SEQ ID NO: 277691 - protein, 9 aa, Homo Sapiens
ILTTSIQNH

SEQ ID NO: 277692 - protein, 9 aa, Homo Sapiens
YRGVKEVTW

SEQ ID NO: 277693 - protein, 9 aa, Homo Sapiens
YVKPANKQE

SEQ ID NO: 277694 - protein, 9 aa, Homo Sapiens
DEKRFEESD

SEQ ID NO: 277695 - protein, 9 aa, Homo Sapiens
SDCPDPQAY

SEQ ID NO: 277696 - protein, 9 aa, Homo Sapiens
NLEVPPGRG

SEQ ID NO: 277697 - protein, 9 aa, Homo Sapiens
LFCNPSMRK

SEQ ID NO: 277698 - protein, 9 aa, Homo Sapiens
RLARERELY

SEQ ID NO: 277699 - protein, 9 aa, Homo Sapiens
KRQEKNWLD

SEQ ID NO: 277700 - protein, 9 aa, Homo Sapiens
RFQELDIRL

SEQ ID NO: 277701 - protein, 9 aa, Homo Sapiens
SLSNKDRGL

SEQ ID NO: 277702 - protein, 9 aa, Homo Sapiens
LLSRLGQMG

SEQ ID NO: 277703 - protein, 9 aa, Homo Sapiens
SAELKNAVS

SEQ ID NO: 277704 - protein, 9 aa, Homo Sapiens
PIFPIIRFC

SEQ ID NO: 277705 - protein, 9 aa, Homo Sapiens
VELTMLYSV

SEQ ID NO: 277706 - protein, 9 aa, Homo Sapiens
NKTNRGRRS

SEQ ID NO: 277707 - protein, 9 aa, Homo Sapiens
VNEFQRKMR

SEQ ID NO: 277708 - protein, 9 aa, Homo Sapiens
LADTDLRMT

SEQ ID NO: 277709 - protein, 9 aa, Homo Sapiens
WTQGKNTEV

SEQ ID NO: 277710 - protein, 9 aa, Homo Sapiens
NVTIKEGLH

SEQ ID NO: 277711 - protein, 9 aa, Homo Sapiens
GIMHCKAGQ

SEQ ID NO: 277712 - protein, 9 aa, Homo Sapiens
HPSAGKLAM

SEQ ID NO: 277713 - protein, 9 aa, Homo Sapiens
VKKEKTEKL

SEQ ID NO: 277714 - protein, 9 aa, Homo Sapiens
YFAAEHLYD

SEQ ID NO: 277715 - protein, 9 aa, Homo Sapiens
SKSVAISVA

SEQ ID NO: 277716 - protein, 9 aa, Homo Sapiens
NGLFVAFYV

SEQ ID NO: 277717 - protein, 9 aa, Homo Sapiens
YVKNAIDTD

SEQ ID NO: 277718 - protein, 9 aa, Homo Sapiens
SGADSGTLA

SEQ ID NO: 277719 - protein, 9 aa, Homo Sapiens
VFLVMYVVT

SEQ ID NO: 277720 - protein, 9 aa, Homo Sapiens
PYMCRECEQ

SEQ ID NO: 277721 - protein, 9 aa, Homo Sapiens
HPDEVGKRW

SEQ ID NO: 277722 - protein, 9 aa, Homo Sapiens
EFLPEEYIK

SEQ ID NO: 277723 - protein, 9 aa, Homo Sapiens
LQDMERKAN

SEQ ID NO: 277724 - protein, 9 aa, Homo Sapiens
SDPSHLAYI

SEQ ID NO: 277725 - protein, 9 aa, Homo Sapiens
SGSKLLEIF

SEQ ID NO: 277726 - protein, 9 aa, Homo Sapiens
DRKDKTTFE

SEQ ID NO: 277727 - protein, 9 aa, Homo Sapiens
SSGSSKDLS

SEQ ID NO: 277728 - protein, 9 aa, Homo Sapiens
ISASLFIRF

SEQ ID NO: 277729 - protein, 9 aa, Homo Sapiens
VATTDPITN

SEQ ID NO: 277730 - protein, 9 aa, Homo Sapiens
SAFKFNQDL

SEQ ID NO: 277731 - protein, 9 aa, Homo Sapiens
DPDFVERRL

SEQ ID NO: 277732 - protein, 9 aa, Homo Sapiens
WIDDEEFFI

SEQ ID NO: 277733 - protein, 9 aa, Homo Sapiens
AFRSASTFK

SEQ ID NO: 277734 - protein, 9 aa, Homo Sapiens
FTKNTKKNS

SEQ ID NO: 277735 - protein, 9 aa, Homo Sapiens
LGTYNKLTK

SEQ ID NO: 277736 - protein, 9 aa, Homo Sapiens
TPIFGGQPL

SEQ ID NO: 277737 - protein, 9 aa, Homo Sapiens
LKVNHEALE

SEQ ID NO: 277738 - protein, 9 aa, Homo Sapiens
RKQEEERKW

SEQ ID NO: 277739 - protein, 9 aa, Homo Sapiens
QNPVSARCS

SEQ ID NO: 277740 - protein, 9 aa, Homo Sapiens
RVALVNDSS

SEQ ID NO: 277741 - protein, 9 aa, Homo Sapiens
FHTGISVLS

SEQ ID NO: 277742 - protein, 9 aa, Homo Sapiens
PLSSDYPVK

SEQ ID NO: 277743 - protein, 9 aa, Homo Sapiens
KKYKWMVCK

SEQ ID NO: 277744 - protein, 9 aa, Homo Sapiens
KVGFLDHLA

SEQ ID NO: 277745 - protein, 9 aa, Homo Sapiens
QSSDNKFGA

SEQ ID NO: 277746 - protein, 9 aa, Homo Sapiens
KDMYTPLSA

SEQ ID NO: 277747 - protein, 9 aa, Homo Sapiens
NWLNFTVIT

SEQ ID NO: 277748 - protein, 9 aa, Homo Sapiens
LPLVPVQVK

SEQ ID NO: 277749 - protein, 9 aa, Homo Sapiens
CTFINDVDC

SEQ ID NO: 277750 - protein, 9 aa, Homo Sapiens
PPVCPMSGV

SEQ ID NO: 277751 - protein, 9 aa, Homo Sapiens
DHAKAAAAK

SEQ ID NO: 277752 - protein, 9 aa, Homo Sapiens
LAVHYCHQK

SEQ ID NO: 277753 - protein, 9 aa, Homo Sapiens
GRKSNIHKS

SEQ ID NO: 277754 - protein, 9 aa, Homo Sapiens
ALHVPQDGA

SEQ ID NO: 277755 - protein, 9 aa, Homo Sapiens
TMNILVICV

SEQ ID NO: 277756 - protein, 9 aa, Homo Sapiens
DYIPENAGD

SEQ ID NO: 277757 - protein, 9 aa, Homo Sapiens
CCEFLTGQI

SEQ ID NO: 277758 - protein, 9 aa, Homo Sapiens
AREKRAFMG

SEQ ID NO: 277759 - protein, 9 aa, Homo Sapiens
KLKSWWATT

SEQ ID NO: 277760 - protein, 9 aa, Homo Sapiens
HINYYLQVS

SEQ ID NO: 277761 - protein, 9 aa, Homo Sapiens
SFKSTKSAT

SEQ ID NO: 277762 - protein, 9 aa, Homo Sapiens
CMCRNLQNS

SEQ ID NO: 277763 - protein, 9 aa, Homo Sapiens
VIKECSITL

SEQ ID NO: 277764 - protein, 9 aa, Homo Sapiens
FRAVLGKVK

SEQ ID NO: 277765 - protein, 9 aa, Homo Sapiens
ACALKKAST

SEQ ID NO: 277766 - protein, 9 aa, Homo Sapiens
AAPRGQFGI

SEQ ID NO: 277767 - protein, 9 aa, Homo Sapiens
LHAMARYPH

SEQ ID NO: 277768 - protein, 9 aa, Homo Sapiens
EVNEFQRKM

SEQ ID NO: 277769 - protein, 9 aa, Homo Sapiens
VSPRYTQSR

SEQ ID NO: 277770 - protein, 9 aa, Homo Sapiens
TCYLELESY

SEQ ID NO: 277771 - protein, 9 aa, Homo Sapiens
KARHQHDGD

SEQ ID NO: 277772 - protein, 9 aa, Homo Sapiens
WNLSSACGI

SEQ ID NO: 277773 - protein, 9 aa, Homo Sapiens
LLDIQVDNL

SEQ ID NO: 277774 - protein, 9 aa, Homo Sapiens
VSSCYRQKK

SEQ ID NO: 277775 - protein, 9 aa, Homo Sapiens
SHHMTKRKR

SEQ ID NO: 277776 - protein, 9 aa, Homo Sapiens
DPSAIKVEV

SEQ ID NO: 277777 - protein, 9 aa, Homo Sapiens
QISEHVFLG

SEQ ID NO: 277778 - protein, 9 aa, Homo Sapiens
EMEMKELLS

SEQ ID NO: 277779 - protein, 9 aa, Homo Sapiens
SEGPSGPCV

SEQ ID NO: 277780 - protein, 9 aa, Homo Sapiens
QDRHCNVTP

SEQ ID NO: 277781 - protein, 9 aa, Homo Sapiens
KIFNGIPEW

SEQ ID NO: 277782 - protein, 9 aa, Homo Sapiens
LAIFQALLQ

SEQ ID NO: 277783 - protein, 9 aa, Homo Sapiens
GYSKNGANC

SEQ ID NO: 277784 - protein, 9 aa, Homo Sapiens
YWRNSLPPI

SEQ ID NO: 277785 - protein, 9 aa, Homo Sapiens
MKKVWLPSK

SEQ ID NO: 277786 - protein, 9 aa, Homo Sapiens
HLSKTHGTS

SEQ ID NO: 277787 - protein, 9 aa, Homo Sapiens
KKLLKNLIG

SEQ ID NO: 277788 - protein, 9 aa, Homo Sapiens
DLRMTFTTM

SEQ ID NO: 277789 - protein, 9 aa, Homo Sapiens
YKFWKHLVY

SEQ ID NO: 277790 - protein, 9 aa, Homo Sapiens
EGQKGMGLI

SEQ ID NO: 277791 - protein, 9 aa, Homo Sapiens
RHIIQWLEA

SEQ ID NO: 277792 - protein, 9 aa, Homo Sapiens
DVTYEKHNN

SEQ ID NO: 277793 - protein, 9 aa, Homo Sapiens
LQRITVADQ

SEQ ID NO: 277794 - protein, 9 aa, Homo Sapiens
KMHQTQMKG

SEQ ID NO: 277795 - protein, 9 aa, Homo Sapiens
LNLERHRRI

SEQ ID NO: 277796 - protein, 9 aa, Homo Sapiens
HSAVVHELQ

SEQ ID NO: 277797 - protein, 9 aa, Homo Sapiens
TKTNQIYRI

SEQ ID NO: 277798 - protein, 9 aa, Homo Sapiens
RVGHISKKH

SEQ ID NO: 277799 - protein, 9 aa, Homo Sapiens
SAILLSYYT

SEQ ID NO: 277800 - protein, 9 aa, Homo Sapiens
KKHKKICLR

SEQ ID NO: 277801 - protein, 9 aa, Homo Sapiens
QINKKIEKA

SEQ ID NO: 277802 - protein, 9 aa, Homo Sapiens
VLLFWKTFF

SEQ ID NO: 277803 - protein, 9 aa, Homo Sapiens
KEHFRGLEE

SEQ ID NO: 277804 - protein, 9 aa, Homo Sapiens
QDLDPWKSA

SEQ ID NO: 277805 - protein, 9 aa, Homo Sapiens
FPGEIGKPG

SEQ ID NO: 277806 - protein, 9 aa, Homo Sapiens
LECEVYLEY

SEQ ID NO: 277807 - protein, 9 aa, Homo Sapiens
IIGVVGGTL

SEQ ID NO: 277808 - protein, 9 aa, Homo Sapiens
QTVIRRGPI

SEQ ID NO: 277809 - protein, 9 aa, Homo Sapiens
PEEAHCFIP

SEQ ID NO: 277810 - protein, 9 aa, Homo Sapiens
MEDYGAEKE

SEQ ID NO: 277811 - protein, 9 aa, Homo Sapiens
DAEDEGEDK

SEQ ID NO: 277812 - protein, 9 aa, Homo Sapiens
VQNFEHLNS

SEQ ID NO: 277813 - protein, 9 aa, Homo Sapiens
QKKKAMLQG

SEQ ID NO: 277814 - protein, 9 aa, Homo Sapiens
LGPEEEGAG

SEQ ID NO: 277815 - protein, 9 aa, Homo Sapiens
PHNERENFR

SEQ ID NO: 277816 - protein, 9 aa, Homo Sapiens
PGSLAVSDF

SEQ ID NO: 277817 - protein, 9 aa, Homo Sapiens
KNFGEYMDD

SEQ ID NO: 277818 - protein, 9 aa, Homo Sapiens
GLCAIVGVS

SEQ ID NO: 277819 - protein, 9 aa, Homo Sapiens
IKEAQKSQA

SEQ ID NO: 277820 - protein, 9 aa, Homo Sapiens
PISGLQATV

SEQ ID NO: 277821 - protein, 9 aa, Homo Sapiens
EYVIEPLER

SEQ ID NO: 277822 - protein, 9 aa, Homo Sapiens
RLKVELSDS

SEQ ID NO: 277823 - protein, 9 aa, Homo Sapiens
MLPPANSLD

SEQ ID NO: 277824 - protein, 9 aa, Homo Sapiens
RQVMEGDRL

SEQ ID NO: 277825 - protein, 9 aa, Homo Sapiens
NYAVTVVLY

SEQ ID NO: 277826 - protein, 9 aa, Homo Sapiens
DDRLLGEKL

SEQ ID NO: 277827 - protein, 9 aa, Homo Sapiens
LHVIGGTDK

SEQ ID NO: 277828 - protein, 9 aa, Homo Sapiens
LGNQEPGDQ

SEQ ID NO: 277829 - protein, 9 aa, Homo Sapiens
TSIQNHVSS

SEQ ID NO: 277830 - protein, 9 aa, Homo Sapiens
RVASSYLGM

SEQ ID NO: 277831 - protein, 9 aa, Homo Sapiens
KKNHDISND

SEQ ID NO: 277832 - protein, 9 aa, Homo Sapiens
DGVTQTPKF

SEQ ID NO: 277833 - protein, 9 aa, Homo Sapiens
SLSRSFENL

SEQ ID NO: 277834 - protein, 9 aa, Homo Sapiens
DSDKTNELW

SEQ ID NO: 277835 - protein, 9 aa, Homo Sapiens
LVTKDILKL

SEQ ID NO: 277836 - protein, 9 aa, Homo Sapiens
EKYMELSFA

SEQ ID NO: 277837 - protein, 9 aa, Homo Sapiens
SGSIEVVKQ

SEQ ID NO: 277838 - protein, 9 aa, Homo Sapiens
HDNRVFTDS

SEQ ID NO: 277839 - protein, 9 aa, Homo Sapiens
PLKLFLRYR

SEQ ID NO: 277840 - protein, 9 aa, Homo Sapiens
SLSTPPLPS

SEQ ID NO: 277841 - protein, 9 aa, Homo Sapiens
TGAGRGGAS

SEQ ID NO: 277842 - protein, 9 aa, Homo Sapiens
ISPTVTTWS

SEQ ID NO: 277843 - protein, 9 aa, Homo Sapiens
GYRGSGGVQ

SEQ ID NO: 277844 - protein, 9 aa, Homo Sapiens
SGSTKEIFR

SEQ ID NO: 277845 - protein, 9 aa, Homo Sapiens
NHLIKHVQT

SEQ ID NO: 277846 - protein, 9 aa, Homo Sapiens
TYMDAQLFN

SEQ ID NO: 277847 - protein, 9 aa, Homo Sapiens
DKRMPAKEV

SEQ ID NO: 277848 - protein, 9 aa, Homo Sapiens
SGSKVLVHL

SEQ ID NO: 277849 - protein, 9 aa, Homo Sapiens
RYKATMNIL

SEQ ID NO: 277850 - protein, 9 aa, Homo Sapiens
PHFISAFEA

SEQ ID NO: 277851 - protein, 9 aa, Homo Sapiens
WALLAKEGK

SEQ ID NO: 277852 - protein, 9 aa, Homo Sapiens
CGDHPSKGC

SEQ ID NO: 277853 - protein, 9 aa, Homo Sapiens
EDNCEEEAG

SEQ ID NO: 277854 - protein, 9 aa, Homo Sapiens
TFINDVDCY

SEQ ID NO: 277855 - protein, 9 aa, Homo Sapiens
QVGADTTPY

SEQ ID NO: 277856 - protein, 9 aa, Homo Sapiens
SDDEKFMLL

SEQ ID NO: 277857 - protein, 9 aa, Homo Sapiens
ASQKNVKAK

SEQ ID NO: 277858 - protein, 9 aa, Homo Sapiens
HAALKMDLL

SEQ ID NO: 277859 - protein, 9 aa, Homo Sapiens
HLHEVYENT

SEQ ID NO: 277860 - protein, 9 aa, Homo Sapiens
EDVPAWESC

SEQ ID NO: 277861 - protein, 9 aa, Homo Sapiens
LVKPTVTII

SEQ ID NO: 277862 - protein, 9 aa, Homo Sapiens
RVKPLPFPC

SEQ ID NO: 277863 - protein, 9 aa, Homo Sapiens
TLYGKEKVN

SEQ ID NO: 277864 - protein, 9 aa, Homo Sapiens
NVFFKEIEG

SEQ ID NO: 277865 - protein, 9 aa, Homo Sapiens
HGWPWVTLS

SEQ ID NO: 277866 - protein, 9 aa, Homo Sapiens
NAMYLNNVA

SEQ ID NO: 277867 - protein, 9 aa, Homo Sapiens
ISNNVTLLY

SEQ ID NO: 277868 - protein, 9 aa, Homo Sapiens
FRPSVEVCI

SEQ ID NO: 277869 - protein, 9 aa, Homo Sapiens
ASIREEPLT

SEQ ID NO: 277870 - protein, 9 aa, Homo Sapiens
KLSETISTL

SEQ ID NO: 277871 - protein, 9 aa, Homo Sapiens
NFRPQNELI

SEQ ID NO: 277872 - protein, 9 aa, Homo Sapiens
ILGSIRICV

SEQ ID NO: 277873 - protein, 9 aa, Homo Sapiens
LSFQKCIEQ

SEQ ID NO: 277874 - protein, 9 aa, Homo Sapiens
GILEGIGIF

SEQ ID NO: 277875 - protein, 9 aa, Homo Sapiens
QPHSCIFSA

SEQ ID NO: 277876 - protein, 9 aa, Homo Sapiens
SNGYYTKCK

SEQ ID NO: 277877 - protein, 9 aa, Homo Sapiens
AFRRLRALC

SEQ ID NO: 277878 - protein, 9 aa, Homo Sapiens
AEEGYFTCR

SEQ ID NO: 277879 - protein, 9 aa, Homo Sapiens
FHQCKDNED

SEQ ID NO: 277880 - protein, 9 aa, Homo Sapiens
LYLTENKYS

SEQ ID NO: 277881 - protein, 9 aa, Homo Sapiens
SLYIILKTL

SEQ ID NO: 277882 - protein, 9 aa, Homo Sapiens
YAALSGLED

SEQ ID NO: 277883 - protein, 9 aa, Homo Sapiens
ERECGNYLF

SEQ ID NO: 277884 - protein, 9 aa, Homo Sapiens
HELIKLSWL

SEQ ID NO: 277885 - protein, 9 aa, Homo Sapiens
YRAAHDKEE

SEQ ID NO: 277886 - protein, 9 aa, Homo Sapiens
PFWTIKLKE

SEQ ID NO: 277887 - protein, 9 aa, Homo Sapiens
DSDFLSKCD

SEQ ID NO: 277888 - protein, 9 aa, Homo Sapiens
LKALGITEM

SEQ ID NO: 277889 - protein, 9 aa, Homo Sapiens
CPFSWIRHF

SEQ ID NO: 277890 - protein, 9 aa, Homo Sapiens
FTLIQAVCC

SEQ ID NO: 277891 - protein, 9 aa, Homo Sapiens
RVASKIHGD

SEQ ID NO: 277892 - protein, 9 aa, Homo Sapiens
KAFSHTSYL

SEQ ID NO: 277893 - protein, 9 aa, Homo Sapiens
AAEFREVIK

SEQ ID NO: 277894 - protein, 9 aa, Homo Sapiens
HKGPKKVSS

SEQ ID NO: 277895 - protein, 9 aa, Homo Sapiens
RIAIAVVGA

SEQ ID NO: 277896 - protein, 9 aa, Homo Sapiens
TPLPPGWVT

SEQ ID NO: 277897 - protein, 9 aa, Homo Sapiens
KGELYRQNR

SEQ ID NO: 277898 - protein, 9 aa, Homo Sapiens
ARANNTFYE

SEQ ID NO: 277899 - protein, 9 aa, Homo Sapiens
FLPIFFGTS

SEQ ID NO: 277900 - protein, 9 aa, Homo Sapiens
KVRDGMELV

SEQ ID NO: 277901 - protein, 9 aa, Homo Sapiens
LMNAQLQLE

SEQ ID NO: 277902 - protein, 9 aa, Homo Sapiens
MDKRLQEME

SEQ ID NO: 277903 - protein, 9 aa, Homo Sapiens
RFKSMSPQE

SEQ ID NO: 277904 - protein, 9 aa, Homo Sapiens
VCCALLMSE

SEQ ID NO: 277905 - protein, 9 aa, Homo Sapiens
AMRGSIHAR

SEQ ID NO: 277906 - protein, 9 aa, Homo Sapiens
SVEVFLPVF

SEQ ID NO: 277907 - protein, 9 aa, Homo Sapiens
AVKTRKCSL

SEQ ID NO: 277908 - protein, 9 aa, Homo Sapiens
DSNDSSSEV

SEQ ID NO: 277909 - protein, 9 aa, Homo Sapiens
VSCDACLNG

SEQ ID NO: 277910 - protein, 9 aa, Homo Sapiens
ECENWLEQQ

SEQ ID NO: 277911 - protein, 9 aa, Homo Sapiens
IINKCCEDI

SEQ ID NO: 277912 - protein, 9 aa, Homo Sapiens
AALIILNSE

SEQ ID NO: 277913 - protein, 9 aa, Homo Sapiens
KPMNELDTV

SEQ ID NO: 277914 - protein, 9 aa, Homo Sapiens
QTIHIVYDI

SEQ ID NO: 277915 - protein, 9 aa, Homo Sapiens
MKSRAPPLH

SEQ ID NO: 277916 - protein, 9 aa, Homo Sapiens
NHEALEILS

SEQ ID NO: 277917 - protein, 9 aa, Homo Sapiens
PPVVVNGKE

SEQ ID NO: 277918 - protein, 9 aa, Homo Sapiens
KGGVTDISA

SEQ ID NO: 277919 - protein, 9 aa, Homo Sapiens
TLDNSRSIL

SEQ ID NO: 277920 - protein, 9 aa, Homo Sapiens
QTSLTIPLP

SEQ ID NO: 277921 - protein, 9 aa, Homo Sapiens
SKKKPPVEN

SEQ ID NO: 277922 - protein, 9 aa, Homo Sapiens
ANKGRELWK

SEQ ID NO: 277923 - protein, 9 aa, Homo Sapiens
MVAHVCNPR

SEQ ID NO: 277924 - protein, 9 aa, Homo Sapiens
EDLFNLCSR

SEQ ID NO: 277925 - protein, 9 aa, Homo Sapiens
YECGECGKY

SEQ ID NO: 277926 - protein, 9 aa, Homo Sapiens
KERQSTYNL

SEQ ID NO: 277927 - protein, 9 aa, Homo Sapiens
EKAIEVECI

SEQ ID NO: 277928 - protein, 9 aa, Homo Sapiens
DIGRCAIKV

SEQ ID NO: 277929 - protein, 9 aa, Homo Sapiens
RRLPEDYGV

SEQ ID NO: 277930 - protein, 9 aa, Homo Sapiens
QDTPLVESY

SEQ ID NO: 277931 - protein, 9 aa, Homo Sapiens
KCSLKSLEH

SEQ ID NO: 277932 - protein, 9 aa, Homo Sapiens
RQGYIHKLI

SEQ ID NO: 277933 - protein, 9 aa, Homo Sapiens
RKKRERHLE

SEQ ID NO: 277934 - protein, 9 aa, Homo Sapiens
GCTWAAALI

SEQ ID NO: 277935 - protein, 9 aa, Homo Sapiens
EVLFQRDSL

SEQ ID NO: 277936 - protein, 9 aa, Homo Sapiens
DPKPPASFK

SEQ ID NO: 277937 - protein, 9 aa, Homo Sapiens
IDVKGICKS

SEQ ID NO: 277938 - protein, 9 aa, Homo Sapiens
YSLEYLNNK

SEQ ID NO: 277939 - protein, 9 aa, Homo Sapiens
VIHATWRGY

SEQ ID NO: 277940 - protein, 9 aa, Homo Sapiens
ATPKVKEQN

SEQ ID NO: 277941 - protein, 9 aa, Homo Sapiens
PIDLAQNFG

SEQ ID NO: 277942 - protein, 9 aa, Homo Sapiens
IKITDFGMR

SEQ ID NO: 277943 - protein, 9 aa, Homo Sapiens
NNLENFQLV

SEQ ID NO: 277944 - protein, 9 aa, Homo Sapiens
CDDIRSLCD

SEQ ID NO: 277945 - protein, 9 aa, Homo Sapiens
DQGCLHPGD

SEQ ID NO: 277946 - protein, 9 aa, Homo Sapiens
GKTFRLNYQ

SEQ ID NO: 277947 - protein, 9 aa, Homo Sapiens
GDKPYACEE

SEQ ID NO: 277948 - protein, 9 aa, Homo Sapiens
KLAKAVNYH

SEQ ID NO: 277949 - protein, 9 aa, Homo Sapiens
NGDSKPELT

SEQ ID NO: 277950 - protein, 9 aa, Homo Sapiens
PGSHKASFL

SEQ ID NO: 277951 - protein, 9 aa, Homo Sapiens
ALYKDVMLD

SEQ ID NO: 277952 - protein, 9 aa, Homo Sapiens
RIDENWYEG

SEQ ID NO: 277953 - protein, 9 aa, Homo Sapiens
LPKYKLANY

SEQ ID NO: 277954 - protein, 9 aa, Homo Sapiens
YYQANERVN

SEQ ID NO: 277955 - protein, 9 aa, Homo Sapiens
VETVTYRNV

SEQ ID NO: 277956 - protein, 9 aa, Homo Sapiens
CPYLWSADT

SEQ ID NO: 277957 - protein, 9 aa, Homo Sapiens
RANDMLPKN

SEQ ID NO: 277958 - protein, 9 aa, Homo Sapiens
PEITYQLRN

SEQ ID NO: 277959 - protein, 9 aa, Homo Sapiens
RNPGCPNYE

SEQ ID NO: 277960 - protein, 9 aa, Homo Sapiens
LEIECMEEK

SEQ ID NO: 277961 - protein, 9 aa, Homo Sapiens
DGSCRWDPG

SEQ ID NO: 277962 - protein, 9 aa, Homo Sapiens
SLCLRYAAA

SEQ ID NO: 277963 - protein, 9 aa, Homo Sapiens
GIFYGSVAN

SEQ ID NO: 277964 - protein, 9 aa, Homo Sapiens
TILKESISY

SEQ ID NO: 277965 - protein, 9 aa, Homo Sapiens
MLQNNPSLG

SEQ ID NO: 277966 - protein, 9 aa, Homo Sapiens
FLEDVYIQY

SEQ ID NO: 277967 - protein, 9 aa, Homo Sapiens
NLWGSISAS

SEQ ID NO: 277968 - protein, 9 aa, Homo Sapiens
SSLYIILKT

SEQ ID NO: 277969 - protein, 9 aa, Homo Sapiens
METLSHERL

SEQ ID NO: 277970 - protein, 9 aa, Homo Sapiens
YIFHQVTID

SEQ ID NO: 277971 - protein, 9 aa, Homo Sapiens
LSCIKTLNN

SEQ ID NO: 277972 - protein, 9 aa, Homo Sapiens
LKLTSNELD

SEQ ID NO: 277973 - protein, 9 aa, Homo Sapiens
MQCEVKYEK

SEQ ID NO: 277974 - protein, 9 aa, Homo Sapiens
FDIYAIVGT

SEQ ID NO: 277975 - protein, 9 aa, Homo Sapiens
PRSAMRGCA

SEQ ID NO: 277976 - protein, 9 aa, Homo Sapiens
KSKKQDPDA

SEQ ID NO: 277977 - protein, 9 aa, Homo Sapiens
IITESMENG

SEQ ID NO: 277978 - protein, 9 aa, Homo Sapiens
VKMATDISR

SEQ ID NO: 277979 - protein, 9 aa, Homo Sapiens
LILFHTGIS

SEQ ID NO: 277980 - protein, 9 aa, Homo Sapiens
GVLISHSNV

SEQ ID NO: 277981 - protein, 9 aa, Homo Sapiens
LRVVQNFEH

SEQ ID NO: 277982 - protein, 9 aa, Homo Sapiens
SPEGFKKSY

SEQ ID NO: 277983 - protein, 9 aa, Homo Sapiens
YIVSSQKIW

SEQ ID NO: 277984 - protein, 9 aa, Homo Sapiens
QAQVHLQKV

SEQ ID NO: 277985 - protein, 9 aa, Homo Sapiens
KGYGFSDPL

SEQ ID NO: 277986 - protein, 9 aa, Homo Sapiens
IGYWVLQVI

SEQ ID NO: 277987 - protein, 9 aa, Homo Sapiens
CEERSSFEI

SEQ ID NO: 277988 - protein, 9 aa, Homo Sapiens
LIDKKKHDC

SEQ ID NO: 277989 - protein, 9 aa, Homo Sapiens
KQQMDIENP

SEQ ID NO: 277990 - protein, 9 aa, Homo Sapiens
ETRLFKLLM

SEQ ID NO: 277991 - protein, 9 aa, Homo Sapiens
VHLSVNQEI

SEQ ID NO: 277992 - protein, 9 aa, Homo Sapiens
DHFVCDFSP

SEQ ID NO: 277993 - protein, 9 aa, Homo Sapiens
CKLGSANGV

SEQ ID NO: 277994 - protein, 9 aa, Homo Sapiens
SLTRHAAVH

SEQ ID NO: 277995 - protein, 9 aa, Homo Sapiens
VVVDYRGRA

SEQ ID NO: 277996 - protein, 9 aa, Homo Sapiens
HQHPQTRVE

SEQ ID NO: 277997 - protein, 9 aa, Homo Sapiens
HQNIHIRER

SEQ ID NO: 277998 - protein, 9 aa, Homo Sapiens
ISGYPEIDK

SEQ ID NO: 277999 - protein, 9 aa, Homo Sapiens
LFQKTLRLC

SEQ ID NO: 278000 - protein, 9 aa, Homo Sapiens
YVDPSGGDH

SEQ ID NO: 278001 - protein, 9 aa, Homo Sapiens
FVPYLYSTF

SEQ ID NO: 278002 - protein, 9 aa, Homo Sapiens
YFNDITETC

SEQ ID NO: 278003 - protein, 9 aa, Homo Sapiens
KQGTSSTIE

SEQ ID NO: 278004 - protein, 9 aa, Homo Sapiens
VGNRIDKEN

SEQ ID NO: 278005 - protein, 9 aa, Homo Sapiens
RVRLCFVEL

SEQ ID NO: 278006 - protein, 9 aa, Homo Sapiens
ANETILALK

SEQ ID NO: 278007 - protein, 9 aa, Homo Sapiens
AFAHRIPPS

SEQ ID NO: 278008 - protein, 9 aa, Homo Sapiens
GAWAEVAEV

SEQ ID NO: 278009 - protein, 9 aa, Homo Sapiens
SVGQWEDEG

SEQ ID NO: 278010 - protein, 9 aa, Homo Sapiens
EPSIYRSLA

SEQ ID NO: 278011 - protein, 9 aa, Homo Sapiens
LVGLEDGTL

SEQ ID NO: 278012 - protein, 9 aa, Homo Sapiens
KRRRVKGDK

SEQ ID NO: 278013 - protein, 9 aa, Homo Sapiens
ATTDLRQKC

SEQ ID NO: 278014 - protein, 9 aa, Homo Sapiens
AGFSGPVRS

SEQ ID NO: 278015 - protein, 9 aa, Homo Sapiens
GPCVLSSPR

SEQ ID NO: 278016 - protein, 9 aa, Homo Sapiens
GSVVINAQN

SEQ ID NO: 278017 - protein, 9 aa, Homo Sapiens
TGVNFTGTT

SEQ ID NO: 278018 - protein, 9 aa, Homo Sapiens
YFMISHSLG

SEQ ID NO: 278019 - protein, 9 aa, Homo Sapiens
DSEKGNLYK

SEQ ID NO: 278020 - protein, 9 aa, Homo Sapiens
RTRMMEILS

SEQ ID NO: 278021 - protein, 9 aa, Homo Sapiens
CLAAEEQQK

SEQ ID NO: 278022 - protein, 9 aa, Homo Sapiens
QFKSFPEIY

SEQ ID NO: 278023 - protein, 9 aa, Homo Sapiens
GVDHVPSSR

SEQ ID NO: 278024 - protein, 9 aa, Homo Sapiens
PQVCLTTSD

SEQ ID NO: 278025 - protein, 9 aa, Homo Sapiens
GLLRALLGE

SEQ ID NO: 278026 - protein, 9 aa, Homo Sapiens
GKYFSSEGH

SEQ ID NO: 278027 - protein, 9 aa, Homo Sapiens
LLTQIDLDD

SEQ ID NO: 278028 - protein, 9 aa, Homo Sapiens
VFDIDDAQV

SEQ ID NO: 278029 - protein, 9 aa, Homo Sapiens
PLTKKEKNV

SEQ ID NO: 278030 - protein, 9 aa, Homo Sapiens
PDTRFSMEG

SEQ ID NO: 278031 - protein, 9 aa, Homo Sapiens
ATQTMNVTG

SEQ ID NO: 278032 - protein, 9 aa, Homo Sapiens
LGNNSRRQS

SEQ ID NO: 278033 - protein, 9 aa, Homo Sapiens
HGSLGKLTG

SEQ ID NO: 278034 - protein, 9 aa, Homo Sapiens
HFEEDVHKL

SEQ ID NO: 278035 - protein, 9 aa, Homo Sapiens
VVRSQHQQM

SEQ ID NO: 278036 - protein, 9 aa, Homo Sapiens
LKCSQTMGH

SEQ ID NO: 278037 - protein, 9 aa, Homo Sapiens
ADEKRFEES

SEQ ID NO: 278038 - protein, 9 aa, Homo Sapiens
MSYSVRRKG

SEQ ID NO: 278039 - protein, 9 aa, Homo Sapiens
FQEDHGSWM

SEQ ID NO: 278040 - protein, 9 aa, Homo Sapiens
CKECDKTLK

SEQ ID NO: 278041 - protein, 9 aa, Homo Sapiens
PKGACIGRN

SEQ ID NO: 278042 - protein, 9 aa, Homo Sapiens
PDNLSEEKC

SEQ ID NO: 278043 - protein, 9 aa, Homo Sapiens
DCCGNIMQT

SEQ ID NO: 278044 - protein, 9 aa, Homo Sapiens
TSFKNTLYD

SEQ ID NO: 278045 - protein, 9 aa, Homo Sapiens
REKSPTFSE

SEQ ID NO: 278046 - protein, 9 aa, Homo Sapiens
YSHLTQHKV

SEQ ID NO: 278047 - protein, 9 aa, Homo Sapiens
TPPVAPVMP

SEQ ID NO: 278048 - protein, 9 aa, Homo Sapiens
TFTGIYTSE

SEQ ID NO: 278049 - protein, 9 aa, Homo Sapiens
ALSRPGTRT

SEQ ID NO: 278050 - protein, 9 aa, Homo Sapiens
CVRHCVNML

SEQ ID NO: 278051 - protein, 9 aa, Homo Sapiens
LKRLSTLTK

SEQ ID NO: 278052 - protein, 9 aa, Homo Sapiens
LQSQDETEQ

SEQ ID NO: 278053 - protein, 9 aa, Homo Sapiens
LLTIVTRDK

SEQ ID NO: 278054 - protein, 9 aa, Homo Sapiens
AVICNHHQA

SEQ ID NO: 278055 - protein, 9 aa, Homo Sapiens
LEPTLKNAI

SEQ ID NO: 278056 - protein, 9 aa, Homo Sapiens
KISFQEFLT

SEQ ID NO: 278057 - protein, 9 aa, Homo Sapiens
RASLERVSA

SEQ ID NO: 278058 - protein, 9 aa, Homo Sapiens
QFKMDTYAK

SEQ ID NO: 278059 - protein, 9 aa, Homo Sapiens
LSFYLLYFV

SEQ ID NO: 278060 - protein, 9 aa, Homo Sapiens
VWLRSKFGT

SEQ ID NO: 278061 - protein, 9 aa, Homo Sapiens
GRRKDMLAE

SEQ ID NO: 278062 - protein, 9 aa, Homo Sapiens
NVLPKQNKI

SEQ ID NO: 278063 - protein, 9 aa, Homo Sapiens
SLIQASGLG

SEQ ID NO: 278064 - protein, 9 aa, Homo Sapiens
ETAHHWISI

SEQ ID NO: 278065 - protein, 9 aa, Homo Sapiens
TVTFSYEKS

SEQ ID NO: 278066 - protein, 9 aa, Homo Sapiens
CFNSYHSSL

SEQ ID NO: 278067 - protein, 9 aa, Homo Sapiens
AIDFVLWCD

SEQ ID NO: 278068 - protein, 9 aa, Homo Sapiens
GVKWYNHSS

SEQ ID NO: 278069 - protein, 9 aa, Homo Sapiens
MLSNIISEK

SEQ ID NO: 278070 - protein, 9 aa, Homo Sapiens
QEPGDQTAL

SEQ ID NO: 278071 - protein, 9 aa, Homo Sapiens
ARLHVCQNI

SEQ ID NO: 278072 - protein, 9 aa, Homo Sapiens
VICNHHQAF

SEQ ID NO: 278073 - protein, 9 aa, Homo Sapiens
VNNFILKVW

SEQ ID NO: 278074 - protein, 9 aa, Homo Sapiens
TVSLSSSRH

SEQ ID NO: 278075 - protein, 9 aa, Homo Sapiens
VAFEWKTKV

SEQ ID NO: 278076 - protein, 9 aa, Homo Sapiens
YVKMSTFDI

SEQ ID NO: 278077 - protein, 9 aa, Homo Sapiens
CAAGYFHNL

SEQ ID NO: 278078 - protein, 9 aa, Homo Sapiens
SQDTQTLKR

SEQ ID NO: 278079 - protein, 9 aa, Homo Sapiens
AGGQFRPKV

SEQ ID NO: 278080 - protein, 9 aa, Homo Sapiens
EMQKTMTSL

SEQ ID NO: 278081 - protein, 9 aa, Homo Sapiens
EACKAVQET

SEQ ID NO: 278082 - protein, 9 aa, Homo Sapiens
MISGNCRQR

SEQ ID NO: 278083 - protein, 9 aa, Homo Sapiens
ARCPRWLCA

SEQ ID NO: 278084 - protein, 9 aa, Homo Sapiens
TMHELEYLV

SEQ ID NO: 278085 - protein, 9 aa, Homo Sapiens
LGDSSASSL

SEQ ID NO: 278086 - protein, 9 aa, Homo Sapiens
VNTFALASH

SEQ ID NO: 278087 - protein, 9 aa, Homo Sapiens
YLRMPRQSM

SEQ ID NO: 278088 - protein, 9 aa, Homo Sapiens
PFVDDNEVY

SEQ ID NO: 278089 - protein, 9 aa, Homo Sapiens
VIIHAPNLP

SEQ ID NO: 278090 - protein, 9 aa, Homo Sapiens
KYLEDVTAE

SEQ ID NO: 278091 - protein, 9 aa, Homo Sapiens
SLPTTITLA

SEQ ID NO: 278092 - protein, 9 aa, Homo Sapiens
QGDQDKTDQ

SEQ ID NO: 278093 - protein, 9 aa, Homo Sapiens
ILISKAGTE

SEQ ID NO: 278094 - protein, 9 aa, Homo Sapiens
HGIIRFYHD

SEQ ID NO: 278095 - protein, 9 aa, Homo Sapiens
SAILDQKSN

SEQ ID NO: 278096 - protein, 9 aa, Homo Sapiens
LMGAMRGSI

SEQ ID NO: 278097 - protein, 9 aa, Homo Sapiens
IAQASHLFD

SEQ ID NO: 278098 - protein, 9 aa, Homo Sapiens
KISDPNLFK

SEQ ID NO: 278099 - protein, 9 aa, Homo Sapiens
DLEKQLSEL

SEQ ID NO: 278100 - protein, 9 aa, Homo Sapiens
YVSVVLQLH

SEQ ID NO: 278101 - protein, 9 aa, Homo Sapiens
SDEDYIYMN

SEQ ID NO: 278102 - protein, 9 aa, Homo Sapiens
IEICYTVVV

SEQ ID NO: 278103 - protein, 9 aa, Homo Sapiens
SKEMVYSLF

SEQ ID NO: 278104 - protein, 9 aa, Homo Sapiens
MWNYMQLKQ

SEQ ID NO: 278105 - protein, 9 aa, Homo Sapiens
KGFKDKLSS

SEQ ID NO: 278106 - protein, 9 aa, Homo Sapiens
DLRQKSPEV

SEQ ID NO: 278107 - protein, 9 aa, Homo Sapiens
TAIKHVKAA

SEQ ID NO: 278108 - protein, 9 aa, Homo Sapiens
VTKLQHFNS

SEQ ID NO: 278109 - protein, 9 aa, Homo Sapiens
IDQVSYSAD

SEQ ID NO: 278110 - protein, 9 aa, Homo Sapiens
DRYLTSSKI

SEQ ID NO: 278111 - protein, 9 aa, Homo Sapiens
SPGSLCLRY

SEQ ID NO: 278112 - protein, 9 aa, Homo Sapiens
ECIKAESAE

SEQ ID NO: 278113 - protein, 9 aa, Homo Sapiens
KQVRKSLEM

SEQ ID NO: 278114 - protein, 9 aa, Homo Sapiens
LGLINNSRF

SEQ ID NO: 278115 - protein, 9 aa, Homo Sapiens
WSSTSPHIP

SEQ ID NO: 278116 - protein, 9 aa, Homo Sapiens
SPEDPTDDS

SEQ ID NO: 278117 - protein, 9 aa, Homo Sapiens
SGMQGGLHI

SEQ ID NO: 278118 - protein, 9 aa, Homo Sapiens
LNSTLQGTY

SEQ ID NO: 278119 - protein, 9 aa, Homo Sapiens
NLKKKCKED

SEQ ID NO: 278120 - protein, 9 aa, Homo Sapiens
ESARWIQMT

SEQ ID NO: 278121 - protein, 9 aa, Homo Sapiens
ATEEEPHND

SEQ ID NO: 278122 - protein, 9 aa, Homo Sapiens
LINSRRMEE

SEQ ID NO: 278123 - protein, 9 aa, Homo Sapiens
EKKALIYQF

SEQ ID NO: 278124 - protein, 9 aa, Homo Sapiens
TGMKYRDLG

SEQ ID NO: 278125 - protein, 9 aa, Homo Sapiens
SFELMQTDL

SEQ ID NO: 278126 - protein, 9 aa, Homo Sapiens
EMRKITPLH

SEQ ID NO: 278127 - protein, 9 aa, Homo Sapiens
PKVPADIEK

SEQ ID NO: 278128 - protein, 9 aa, Homo Sapiens
PDFVERRLI

SEQ ID NO: 278129 - protein, 9 aa, Homo Sapiens
IEAQPSKVS

SEQ ID NO: 278130 - protein, 9 aa, Homo Sapiens
VFLYKMLVG

SEQ ID NO: 278131 - protein, 9 aa, Homo Sapiens
EFLGFKHIP

SEQ ID NO: 278132 - protein, 9 aa, Homo Sapiens
PGYQATTYA

SEQ ID NO: 278133 - protein, 9 aa, Homo Sapiens
YFSKEQQTM

SEQ ID NO: 278134 - protein, 9 aa, Homo Sapiens
SDVAYSGIW

SEQ ID NO: 278135 - protein, 9 aa, Homo Sapiens
HLNIYTPAD

SEQ ID NO: 278136 - protein, 9 aa, Homo Sapiens
IYFVRGAKE

SEQ ID NO: 278137 - protein, 9 aa, Homo Sapiens
DVDKPDDKS

SEQ ID NO: 278138 - protein, 9 aa, Homo Sapiens
GQFGIPCCP

SEQ ID NO: 278139 - protein, 9 aa, Homo Sapiens
KQDLTTRLQ

SEQ ID NO: 278140 - protein, 9 aa, Homo Sapiens
QAEVEQEAG

SEQ ID NO: 278141 - protein, 9 aa, Homo Sapiens
TKDFIDKLL

SEQ ID NO: 278142 - protein, 9 aa, Homo Sapiens
PRNCDDEVS

SEQ ID NO: 278143 - protein, 9 aa, Homo Sapiens
DSSSSLYGG

SEQ ID NO: 278144 - protein, 9 aa, Homo Sapiens
WRNKTEDLA

SEQ ID NO: 278145 - protein, 9 aa, Homo Sapiens
PFSSSWVKH

SEQ ID NO: 278146 - protein, 9 aa, Homo Sapiens
PLLFCTQCG

SEQ ID NO: 278147 - protein, 9 aa, Homo Sapiens
AFDVKIERD

SEQ ID NO: 278148 - protein, 9 aa, Homo Sapiens
VMCTDATLH

SEQ ID NO: 278149 - protein, 9 aa, Homo Sapiens
NYDALVYSA

SEQ ID NO: 278150 - protein, 9 aa, Homo Sapiens
RLAVSLVLL

SEQ ID NO: 278151 - protein, 9 aa, Homo Sapiens
KTQETETLT

SEQ ID NO: 278152 - protein, 9 aa, Homo Sapiens
RSHHSGVDI

SEQ ID NO: 278153 - protein, 9 aa, Homo Sapiens
PELTIIALS

SEQ ID NO: 278154 - protein, 9 aa, Homo Sapiens
SLPKKVYLS

SEQ ID NO: 278155 - protein, 9 aa, Homo Sapiens
FTVAQNEEV

SEQ ID NO: 278156 - protein, 9 aa, Homo Sapiens
CYINVRWFP

SEQ ID NO: 278157 - protein, 9 aa, Homo Sapiens
NMLQCRSCL

SEQ ID NO: 278158 - protein, 9 aa, Homo Sapiens
PGFPGAQEG

SEQ ID NO: 278159 - protein, 9 aa, Homo Sapiens
GSKEDATVF

SEQ ID NO: 278160 - protein, 9 aa, Homo Sapiens
CLKHHVIQK

SEQ ID NO: 278161 - protein, 9 aa, Homo Sapiens
KAFNQSSDL

SEQ ID NO: 278162 - protein, 9 aa, Homo Sapiens
PMPPIQFHQ

SEQ ID NO: 278163 - protein, 9 aa, Homo Sapiens
DEYEYEDME

SEQ ID NO: 278164 - protein, 9 aa, Homo Sapiens
TNENRENYP

SEQ ID NO: 278165 - protein, 9 aa, Homo Sapiens
QPLETNTEN

SEQ ID NO: 278166 - protein, 9 aa, Homo Sapiens
LVIRTEPGL

SEQ ID NO: 278167 - protein, 9 aa, Homo Sapiens
DASVSHLSD

SEQ ID NO: 278168 - protein, 9 aa, Homo Sapiens
SVINNTPLY

SEQ ID NO: 278169 - protein, 9 aa, Homo Sapiens
EEKVHIVSI

SEQ ID NO: 278170 - protein, 9 aa, Homo Sapiens
GMEIYFAPA

SEQ ID NO: 278171 - protein, 9 aa, Homo Sapiens
KIIGEYTSP

SEQ ID NO: 278172 - protein, 9 aa, Homo Sapiens
GNFPLRGMH

SEQ ID NO: 278173 - protein, 9 aa, Homo Sapiens
VPASWPHHP

SEQ ID NO: 278174 - protein, 9 aa, Homo Sapiens
LSSACGIAQ

SEQ ID NO: 278175 - protein, 9 aa, Homo Sapiens
LLISNTGSK

SEQ ID NO: 278176 - protein, 9 aa, Homo Sapiens
KGKKDREKD

SEQ ID NO: 278177 - protein, 9 aa, Homo Sapiens
LPSRQKTLL

SEQ ID NO: 278178 - protein, 9 aa, Homo Sapiens
QAVAISCPL

SEQ ID NO: 278179 - protein, 9 aa, Homo Sapiens
CESRADNFQ

SEQ ID NO: 278180 - protein, 9 aa, Homo Sapiens
HQRASDYFN

SEQ ID NO: 278181 - protein, 9 aa, Homo Sapiens
AHLTEPGSI

SEQ ID NO: 278182 - protein, 9 aa, Homo Sapiens
YWYKQDSNK

SEQ ID NO: 278183 - protein, 9 aa, Homo Sapiens
EELGPGHAG

SEQ ID NO: 278184 - protein, 9 aa, Homo Sapiens
ERRWHAARK

SEQ ID NO: 278185 - protein, 9 aa, Homo Sapiens
GRGKISKGL

SEQ ID NO: 278186 - protein, 9 aa, Homo Sapiens
HVKETNDNP

SEQ ID NO: 278187 - protein, 9 aa, Homo Sapiens
VESSNKGTV

SEQ ID NO: 278188 - protein, 9 aa, Homo Sapiens
LRNLSVSSS

SEQ ID NO: 278189 - protein, 9 aa, Homo Sapiens
QGGKLSAVL

SEQ ID NO: 278190 - protein, 9 aa, Homo Sapiens
LNIKMSHFL

SEQ ID NO: 278191 - protein, 9 aa, Homo Sapiens
RLRILPCSH

SEQ ID NO: 278192 - protein, 9 aa, Homo Sapiens
SEYRVKMHF

SEQ ID NO: 278193 - protein, 9 aa, Homo Sapiens
EEQENYYLL

SEQ ID NO: 278194 - protein, 9 aa, Homo Sapiens
RIDKENREV

SEQ ID NO: 278195 - protein, 9 aa, Homo Sapiens
HYNTMIENL

SEQ ID NO: 278196 - protein, 9 aa, Homo Sapiens
KYRHKKNEE

SEQ ID NO: 278197 - protein, 9 aa, Homo Sapiens
TLTKLSCDD

SEQ ID NO: 278198 - protein, 9 aa, Homo Sapiens
NGWISKLVS

SEQ ID NO: 278199 - protein, 9 aa, Homo Sapiens
DMFYFCRKG

SEQ ID NO: 278200 - protein, 9 aa, Homo Sapiens
YFTCSTHLT

SEQ ID NO: 278201 - protein, 9 aa, Homo Sapiens
IGRLTDEGA

SEQ ID NO: 278202 - protein, 9 aa, Homo Sapiens
QEQIHRMNE

SEQ ID NO: 278203 - protein, 9 aa, Homo Sapiens
VCVKKSTRE

SEQ ID NO: 278204 - protein, 9 aa, Homo Sapiens
SSSDEDYIY

SEQ ID NO: 278205 - protein, 9 aa, Homo Sapiens
KIVGSRLPP

SEQ ID NO: 278206 - protein, 9 aa, Homo Sapiens
ITDTFRKVI

SEQ ID NO: 278207 - protein, 9 aa, Homo Sapiens
TYSEPKLTP

SEQ ID NO: 278208 - protein, 9 aa, Homo Sapiens
DLGRLQKKL

SEQ ID NO: 278209 - protein, 9 aa, Homo Sapiens
PASSCSISE

SEQ ID NO: 278210 - protein, 9 aa, Homo Sapiens
RIIIARSEI

SEQ ID NO: 278211 - protein, 9 aa, Homo Sapiens
EFQHMLVAE

SEQ ID NO: 278212 - protein, 9 aa, Homo Sapiens
QLSLIFVSS

SEQ ID NO: 278213 - protein, 9 aa, Homo Sapiens
LNEIIADVD

SEQ ID NO: 278214 - protein, 9 aa, Homo Sapiens
ANFTMLPTF

SEQ ID NO: 278215 - protein, 9 aa, Homo Sapiens
TLDEIYGDT

SEQ ID NO: 278216 - protein, 9 aa, Homo Sapiens
HSRHRREMA

SEQ ID NO: 278217 - protein, 9 aa, Homo Sapiens
GKLSAVLRA

SEQ ID NO: 278218 - protein, 9 aa, Homo Sapiens
YEVYKTARA

SEQ ID NO: 278219 - protein, 9 aa, Homo Sapiens
AIGSEKRLN

SEQ ID NO: 278220 - protein, 9 aa, Homo Sapiens
FSHLLSYIK

SEQ ID NO: 278221 - protein, 9 aa, Homo Sapiens
HLAQHQNIH

SEQ ID NO: 278222 - protein, 9 aa, Homo Sapiens
MLYSVIRGE

SEQ ID NO: 278223 - protein, 9 aa, Homo Sapiens
SVKASYVLR

SEQ ID NO: 278224 - protein, 9 aa, Homo Sapiens
IKEGCLKET

SEQ ID NO: 278225 - protein, 9 aa, Homo Sapiens
PDSQYCTYL

SEQ ID NO: 278226 - protein, 9 aa, Homo Sapiens
GQSIGIQKP

SEQ ID NO: 278227 - protein, 9 aa, Homo Sapiens
YKFQRKFLN

SEQ ID NO: 278228 - protein, 9 aa, Homo Sapiens
DPEVNEFQR

SEQ ID NO: 278229 - protein, 9 aa, Homo Sapiens
GSKKPDLKE

SEQ ID NO: 278230 - protein, 9 aa, Homo Sapiens
HMLLSFQHP

SEQ ID NO: 278231 - protein, 9 aa, Homo Sapiens
IHQVKTQSQ

SEQ ID NO: 278232 - protein, 9 aa, Homo Sapiens
SENPEQIIA

SEQ ID NO: 278233 - protein, 9 aa, Homo Sapiens
EGPLSTTAV

SEQ ID NO: 278234 - protein, 9 aa, Homo Sapiens
TNKLLQIIG

SEQ ID NO: 278235 - protein, 9 aa, Homo Sapiens
PPVTDFRES

SEQ ID NO: 278236 - protein, 9 aa, Homo Sapiens
GSTLDTTVA

SEQ ID NO: 278237 - protein, 9 aa, Homo Sapiens
HMTKGATKE

SEQ ID NO: 278238 - protein, 9 aa, Homo Sapiens
YQADIEQMY

SEQ ID NO: 278239 - protein, 9 aa, Homo Sapiens
IFQNHRVQF

SEQ ID NO: 278240 - protein, 9 aa, Homo Sapiens
QCESTVRTV

SEQ ID NO: 278241 - protein, 9 aa, Homo Sapiens
YLLKSIWLV

SEQ ID NO: 278242 - protein, 9 aa, Homo Sapiens
TSEKLRVDT

SEQ ID NO: 278243 - protein, 9 aa, Homo Sapiens
GTVCHPKYI

SEQ ID NO: 278244 - protein, 9 aa, Homo Sapiens
KECDKTLKR

SEQ ID NO: 278245 - protein, 9 aa, Homo Sapiens
LYDSDKSCR

SEQ ID NO: 278246 - protein, 9 aa, Homo Sapiens
KINYFSGGR

SEQ ID NO: 278247 - protein, 9 aa, Homo Sapiens
RLNSEKLSL

SEQ ID NO: 278248 - protein, 9 aa, Homo Sapiens
HSEGPLSTT

SEQ ID NO: 278249 - protein, 9 aa, Homo Sapiens
AHLPCVGPG

SEQ ID NO: 278250 - protein, 9 aa, Homo Sapiens
KCMPYTTYL

SEQ ID NO: 278251 - protein, 9 aa, Homo Sapiens
VSLTTSQLP

SEQ ID NO: 278252 - protein, 9 aa, Homo Sapiens
YNANTSIIS

SEQ ID NO: 278253 - protein, 9 aa, Homo Sapiens
AEDSAIMLG

SEQ ID NO: 278254 - protein, 9 aa, Homo Sapiens
THTLDSLQG

SEQ ID NO: 278255 - protein, 9 aa, Homo Sapiens
CWLFFFFLF

SEQ ID NO: 278256 - protein, 9 aa, Homo Sapiens
MLKLQHLVI

SEQ ID NO: 278257 - protein, 9 aa, Homo Sapiens
VRTVNNKTL

SEQ ID NO: 278258 - protein, 9 aa, Homo Sapiens
AESFEEESE

SEQ ID NO: 278259 - protein, 9 aa, Homo Sapiens
VEIARFIIN

SEQ ID NO: 278260 - protein, 9 aa, Homo Sapiens
TLMGTLSGT

SEQ ID NO: 278261 - protein, 9 aa, Homo Sapiens
LDQVWNILR

SEQ ID NO: 278262 - protein, 9 aa, Homo Sapiens
NKPCITDVK

SEQ ID NO: 278263 - protein, 9 aa, Homo Sapiens
VTCACLLTP

SEQ ID NO: 278264 - protein, 9 aa, Homo Sapiens
LPIAESRPL

SEQ ID NO: 278265 - protein, 9 aa, Homo Sapiens
KFPRGFKFN

SEQ ID NO: 278266 - protein, 9 aa, Homo Sapiens
VTGSPRLFT

SEQ ID NO: 278267 - protein, 9 aa, Homo Sapiens
QRLESLQEI

SEQ ID NO: 278268 - protein, 9 aa, Homo Sapiens
RYFSDEEGS

SEQ ID NO: 278269 - protein, 9 aa, Homo Sapiens
AAHLAVEGM

SEQ ID NO: 278270 - protein, 9 aa, Homo Sapiens
TCLTLNYVQ

SEQ ID NO: 278271 - protein, 9 aa, Homo Sapiens
STQTGVIPQ

SEQ ID NO: 278272 - protein, 9 aa, Homo Sapiens
DDKDYRKIR

SEQ ID NO: 278273 - protein, 9 aa, Homo Sapiens
DEERKQNRE

SEQ ID NO: 278274 - protein, 9 aa, Homo Sapiens
IQRYSALTK

SEQ ID NO: 278275 - protein, 9 aa, Homo Sapiens
ECGTAFSQR

SEQ ID NO: 278276 - protein, 9 aa, Homo Sapiens
DLEKRDFRK

SEQ ID NO: 278277 - protein, 9 aa, Homo Sapiens
GFESSFLKC

SEQ ID NO: 278278 - protein, 9 aa, Homo Sapiens
HNSALVINK

SEQ ID NO: 278279 - protein, 9 aa, Homo Sapiens
LLLCNLSLV

SEQ ID NO: 278280 - protein, 9 aa, Homo Sapiens
KKRDDCLEW

SEQ ID NO: 278281 - protein, 9 aa, Homo Sapiens
HELEYLVYH

SEQ ID NO: 278282 - protein, 9 aa, Homo Sapiens
KLINAYKED

SEQ ID NO: 278283 - protein, 9 aa, Homo Sapiens
QIVENLSPN

SEQ ID NO: 278284 - protein, 9 aa, Homo Sapiens
QIIFSLAAV

SEQ ID NO: 278285 - protein, 9 aa, Homo Sapiens
LALGARRKI

SEQ ID NO: 278286 - protein, 9 aa, Homo Sapiens
LLYMVVVSW

SEQ ID NO: 278287 - protein, 9 aa, Homo Sapiens
RITSDISPE

SEQ ID NO: 278288 - protein, 9 aa, Homo Sapiens
QDSDYINAT

SEQ ID NO: 278289 - protein, 9 aa, Homo Sapiens
KIDKWDLLK

SEQ ID NO: 278290 - protein, 9 aa, Homo Sapiens
RYFSGIKGL

SEQ ID NO: 278291 - protein, 9 aa, Homo Sapiens
PEEPPQTLL

SEQ ID NO: 278292 - protein, 9 aa, Homo Sapiens
LCSTENIYK

SEQ ID NO: 278293 - protein, 9 aa, Homo Sapiens
SLPRNIEVP

SEQ ID NO: 278294 - protein, 9 aa, Homo Sapiens
STLYDYCRV

SEQ ID NO: 278295 - protein, 9 aa, Homo Sapiens
VEAFLRPEW

SEQ ID NO: 278296 - protein, 9 aa, Homo Sapiens
RDLTHLYLA

SEQ ID NO: 278297 - protein, 9 aa, Homo Sapiens
AHLSPSGAD

SEQ ID NO: 278298 - protein, 9 aa, Homo Sapiens
AHNLNEDVS

SEQ ID NO: 278299 - protein, 9 aa, Homo Sapiens
TGHKNEQYC

SEQ ID NO: 278300 - protein, 9 aa, Homo Sapiens
RLKVLLDTS

SEQ ID NO: 278301 - protein, 9 aa, Homo Sapiens
AKIDKWDLL

SEQ ID NO: 278302 - protein, 9 aa, Homo Sapiens
TWLCRHVHR

SEQ ID NO: 278303 - protein, 9 aa, Homo Sapiens
TPAKPTVEE

SEQ ID NO: 278304 - protein, 9 aa, Homo Sapiens
NEDTNTFLL

SEQ ID NO: 278305 - protein, 9 aa, Homo Sapiens
ACNETIARR

SEQ ID NO: 278306 - protein, 9 aa, Homo Sapiens
NDGVTQTPK

SEQ ID NO: 278307 - protein, 9 aa, Homo Sapiens
LQTEDVKPY

SEQ ID NO: 278308 - protein, 9 aa, Homo Sapiens
YEMESPTIT

SEQ ID NO: 278309 - protein, 9 aa, Homo Sapiens
QERDRKSRL

SEQ ID NO: 278310 - protein, 9 aa, Homo Sapiens
SMTAGDFQD

SEQ ID NO: 278311 - protein, 9 aa, Homo Sapiens
GPEFIQVGV

SEQ ID NO: 278312 - protein, 9 aa, Homo Sapiens
GRKEAGRPW

SEQ ID NO: 278313 - protein, 9 aa, Homo Sapiens
LGAMSGGGA

SEQ ID NO: 278314 - protein, 9 aa, Homo Sapiens
LPNITPAGT

SEQ ID NO: 278315 - protein, 9 aa, Homo Sapiens
TWDGKALSF

SEQ ID NO: 278316 - protein, 9 aa, Homo Sapiens
RPFRPRPHQ

SEQ ID NO: 278317 - protein, 9 aa, Homo Sapiens
AQEIDETNE

SEQ ID NO: 278318 - protein, 9 aa, Homo Sapiens
ISPLVKIWN

SEQ ID NO: 278319 - protein, 9 aa, Homo Sapiens
LCMNVGGFL

SEQ ID NO: 278320 - protein, 9 aa, Homo Sapiens
NMMGPLAQQ

SEQ ID NO: 278321 - protein, 9 aa, Homo Sapiens
RHNGSMVGS

SEQ ID NO: 278322 - protein, 9 aa, Homo Sapiens
MCAALSPAV

SEQ ID NO: 278323 - protein, 9 aa, Homo Sapiens
TDAFGNIVF

SEQ ID NO: 278324 - protein, 9 aa, Homo Sapiens
DFYRCGYCN

SEQ ID NO: 278325 - protein, 9 aa, Homo Sapiens
FQIHGNDTS

SEQ ID NO: 278326 - protein, 9 aa, Homo Sapiens
CLHLNIYTP

SEQ ID NO: 278327 - protein, 9 aa, Homo Sapiens
QFSRKTYKM

SEQ ID NO: 278328 - protein, 9 aa, Homo Sapiens
LRFMETRLF

SEQ ID NO: 278329 - protein, 9 aa, Homo Sapiens
ETSNVPAMY

SEQ ID NO: 278330 - protein, 9 aa, Homo Sapiens
EEEEEGLEI

SEQ ID NO: 278331 - protein, 9 aa, Homo Sapiens
AALSREMNA

SEQ ID NO: 278332 - protein, 9 aa, Homo Sapiens
LEYHSSWTL

SEQ ID NO: 278333 - protein, 9 aa, Homo Sapiens
LWPHGCVSG

SEQ ID NO: 278334 - protein, 9 aa, Homo Sapiens
PCSSYSLDQ

SEQ ID NO: 278335 - protein, 9 aa, Homo Sapiens
SLDVNNLEN

SEQ ID NO: 278336 - protein, 9 aa, Homo Sapiens
GLPPARWTP

SEQ ID NO: 278337 - protein, 9 aa, Homo Sapiens
EMFQNMQNA

SEQ ID NO: 278338 - protein, 9 aa, Homo Sapiens
KELLSEGES

SEQ ID NO: 278339 - protein, 9 aa, Homo Sapiens
SENTSGALS

SEQ ID NO: 278340 - protein, 9 aa, Homo Sapiens
AVLSEAISL

SEQ ID NO: 278341 - protein, 9 aa, Homo Sapiens
DSITPSAQT

SEQ ID NO: 278342 - protein, 9 aa, Homo Sapiens
LFRLQTLGL

SEQ ID NO: 278343 - protein, 9 aa, Homo Sapiens
PRGQFGIPC

SEQ ID NO: 278344 - protein, 9 aa, Homo Sapiens
QVMKPPLIF

SEQ ID NO: 278345 - protein, 9 aa, Homo Sapiens
LYGKEKVNG

SEQ ID NO: 278346 - protein, 9 aa, Homo Sapiens
CYSNAAAVH

SEQ ID NO: 278347 - protein, 9 aa, Homo Sapiens
SSLFQSNKD

SEQ ID NO: 278348 - protein, 9 aa, Homo Sapiens
FLDAELEDG

SEQ ID NO: 278349 - protein, 9 aa, Homo Sapiens
QRIVGDCWF

SEQ ID NO: 278350 - protein, 9 aa, Homo Sapiens
WRHEDKEDN

SEQ ID NO: 278351 - protein, 9 aa, Homo Sapiens
ELKSAGGLV

SEQ ID NO: 278352 - protein, 9 aa, Homo Sapiens
SFERALYLA

SEQ ID NO: 278353 - protein, 9 aa, Homo Sapiens
KFGNLVETN

SEQ ID NO: 278354 - protein, 9 aa, Homo Sapiens
NPQTSNNCN

SEQ ID NO: 278355 - protein, 9 aa, Homo Sapiens
DFNTMFTDC

SEQ ID NO: 278356 - protein, 9 aa, Homo Sapiens
ETKHSAKVL

SEQ ID NO: 278357 - protein, 9 aa, Homo Sapiens
KNNHNLTST

SEQ ID NO: 278358 - protein, 9 aa, Homo Sapiens
ENVSSVEAL

SEQ ID NO: 278359 - protein, 9 aa, Homo Sapiens
VYLARLNES

SEQ ID NO: 278360 - protein, 9 aa, Homo Sapiens
HLQFNLLYR

SEQ ID NO: 278361 - protein, 9 aa, Homo Sapiens
PDQITGRAG

SEQ ID NO: 278362 - protein, 9 aa, Homo Sapiens
LKIRVIHAK

SEQ ID NO: 278363 - protein, 9 aa, Homo Sapiens
LHKLIRKST

SEQ ID NO: 278364 - protein, 9 aa, Homo Sapiens
VHANTPLPA

SEQ ID NO: 278365 - protein, 9 aa, Homo Sapiens
VKMHSKHFE

SEQ ID NO: 278366 - protein, 9 aa, Homo Sapiens
LKKEQANNK

SEQ ID NO: 278367 - protein, 9 aa, Homo Sapiens
AFGVELQEM

SEQ ID NO: 278368 - protein, 9 aa, Homo Sapiens
NLNYDTNLT

SEQ ID NO: 278369 - protein, 9 aa, Homo Sapiens
APSQVQHIH

SEQ ID NO: 278370 - protein, 9 aa, Homo Sapiens
IQMLQQIAA

SEQ ID NO: 278371 - protein, 9 aa, Homo Sapiens
NQIDHFVCD

SEQ ID NO: 278372 - protein, 9 aa, Homo Sapiens
FFLIVYIVA

SEQ ID NO: 278373 - protein, 9 aa, Homo Sapiens
PYPSIFWIN

SEQ ID NO: 278374 - protein, 9 aa, Homo Sapiens
YRGKRNANL

SEQ ID NO: 278375 - protein, 9 aa, Homo Sapiens
QCDKCGKAF

SEQ ID NO: 278376 - protein, 9 aa, Homo Sapiens
EKLFTVEPQ

SEQ ID NO: 278377 - protein, 9 aa, Homo Sapiens
LQDLLLDYS

SEQ ID NO: 278378 - protein, 9 aa, Homo Sapiens
MLWFRSYRK

SEQ ID NO: 278379 - protein, 9 aa, Homo Sapiens
IRQFITQVK

SEQ ID NO: 278380 - protein, 9 aa, Homo Sapiens
WPGGETEAR

SEQ ID NO: 278381 - protein, 9 aa, Homo Sapiens
ATQHILDEA

SEQ ID NO: 278382 - protein, 9 aa, Homo Sapiens
ESLNGGRPF

SEQ ID NO: 278383 - protein, 9 aa, Homo Sapiens
VSKFSDCTR

SEQ ID NO: 278384 - protein, 9 aa, Homo Sapiens
AHKYFPGVK

SEQ ID NO: 278385 - protein, 9 aa, Homo Sapiens
QNKGSVLIP

SEQ ID NO: 278386 - protein, 9 aa, Homo Sapiens
FQSGMKRLK

SEQ ID NO: 278387 - protein, 9 aa, Homo Sapiens
GPPNMQCCL

SEQ ID NO: 278388 - protein, 9 aa, Homo Sapiens
ADALYEALN

SEQ ID NO: 278389 - protein, 9 aa, Homo Sapiens
ELVEGQVPH

SEQ ID NO: 278390 - protein, 9 aa, Homo Sapiens
PLFEGCIWN

SEQ ID NO: 278391 - protein, 9 aa, Homo Sapiens
FQKHWAKII

SEQ ID NO: 278392 - protein, 9 aa, Homo Sapiens
CVHTLGSFH

SEQ ID NO: 278393 - protein, 9 aa, Homo Sapiens
CIPSSGLLV

SEQ ID NO: 278394 - protein, 9 aa, Homo Sapiens
KSREEVSSL

SEQ ID NO: 278395 - protein, 9 aa, Homo Sapiens
LSLKAWLEN

SEQ ID NO: 278396 - protein, 9 aa, Homo Sapiens
SLKEKLADA

SEQ ID NO: 278397 - protein, 9 aa, Homo Sapiens
RSVCGKQIS

SEQ ID NO: 278398 - protein, 9 aa, Homo Sapiens
HLALRRGYS

SEQ ID NO: 278399 - protein, 9 aa, Homo Sapiens
DLKVLSAQK

SEQ ID NO: 278400 - protein, 9 aa, Homo Sapiens
RQLVKVDGG

SEQ ID NO: 278401 - protein, 9 aa, Homo Sapiens
EWIPPQAKV

SEQ ID NO: 278402 - protein, 9 aa, Homo Sapiens
PDLTTVYVD

SEQ ID NO: 278403 - protein, 9 aa, Homo Sapiens
CANPIFYGF

SEQ ID NO: 278404 - protein, 9 aa, Homo Sapiens
VIGYILEKS

SEQ ID NO: 278405 - protein, 9 aa, Homo Sapiens
MTGDYHRYL

SEQ ID NO: 278406 - protein, 9 aa, Homo Sapiens
EDADEGALN

SEQ ID NO: 278407 - protein, 9 aa, Homo Sapiens
SPWQRKKMT

SEQ ID NO: 278408 - protein, 9 aa, Homo Sapiens
APESHFLKC

SEQ ID NO: 278409 - protein, 9 aa, Homo Sapiens
VLGTGGIKP

SEQ ID NO: 278410 - protein, 9 aa, Homo Sapiens
AKKVANKDT

SEQ ID NO: 278411 - protein, 9 aa, Homo Sapiens
CIHYCDVNG

SEQ ID NO: 278412 - protein, 9 aa, Homo Sapiens
YSGQQQSDY

SEQ ID NO: 278413 - protein, 9 aa, Homo Sapiens
SGPGFKLLL

SEQ ID NO: 278414 - protein, 9 aa, Homo Sapiens
EGCISVKDH

SEQ ID NO: 278415 - protein, 9 aa, Homo Sapiens
KNAATEDIW

SEQ ID NO: 278416 - protein, 9 aa, Homo Sapiens
ELPQILGDI

SEQ ID NO: 278417 - protein, 9 aa, Homo Sapiens
LPLGVPISG

SEQ ID NO: 278418 - protein, 9 aa, Homo Sapiens
EARVGLWPL

SEQ ID NO: 278419 - protein, 9 aa, Homo Sapiens
LHYLGFPYK

SEQ ID NO: 278420 - protein, 9 aa, Homo Sapiens
PQLTDDYGL

SEQ ID NO: 278421 - protein, 9 aa, Homo Sapiens
YEIEILDAS

SEQ ID NO: 278422 - protein, 9 aa, Homo Sapiens
QQPPPRIKN

SEQ ID NO: 278423 - protein, 9 aa, Homo Sapiens
NNLWIYLAA

SEQ ID NO: 278424 - protein, 9 aa, Homo Sapiens
KAMAPHYVP

SEQ ID NO: 278425 - protein, 9 aa, Homo Sapiens
EINPMAEDS

SEQ ID NO: 278426 - protein, 9 aa, Homo Sapiens
SMIYCLCYE

SEQ ID NO: 278427 - protein, 9 aa, Homo Sapiens
DGSNETIDS

SEQ ID NO: 278428 - protein, 9 aa, Homo Sapiens
QNHSKCITE

SEQ ID NO: 278429 - protein, 9 aa, Homo Sapiens
KPLYLHLRQ

SEQ ID NO: 278430 - protein, 9 aa, Homo Sapiens
LKPSADPDN

SEQ ID NO: 278431 - protein, 9 aa, Homo Sapiens
GVCQEGWNR

SEQ ID NO: 278432 - protein, 9 aa, Homo Sapiens
YYYKSRRNC

SEQ ID NO: 278433 - protein, 9 aa, Homo Sapiens
IRVFFMLHS

SEQ ID NO: 278434 - protein, 9 aa, Homo Sapiens
PGSSEFVQE

SEQ ID NO: 278435 - protein, 9 aa, Homo Sapiens
RVKFVVSDP

SEQ ID NO: 278436 - protein, 9 aa, Homo Sapiens
EALQKRCIH

SEQ ID NO: 278437 - protein, 9 aa, Homo Sapiens
VQWSLPFII

SEQ ID NO: 278438 - protein, 9 aa, Homo Sapiens
IWEVMPRTL

SEQ ID NO: 278439 - protein, 9 aa, Homo Sapiens
TQYTTAVVV

SEQ ID NO: 278440 - protein, 9 aa, Homo Sapiens
EAHKRLGNS

SEQ ID NO: 278441 - protein, 9 aa, Homo Sapiens
IKYRHKKNE

SEQ ID NO: 278442 - protein, 9 aa, Homo Sapiens
VGEVVLALE

SEQ ID NO: 278443 - protein, 9 aa, Homo Sapiens
PGIDKTKEE

SEQ ID NO: 278444 - protein, 9 aa, Homo Sapiens
TVDVRDELS

SEQ ID NO: 278445 - protein, 9 aa, Homo Sapiens
EPDGSNQTV

SEQ ID NO: 278446 - protein, 9 aa, Homo Sapiens
VMLINLTRI

SEQ ID NO: 278447 - protein, 9 aa, Homo Sapiens
KTQEERVKG

SEQ ID NO: 278448 - protein, 9 aa, Homo Sapiens
SDSKLEIPV

SEQ ID NO: 278449 - protein, 9 aa, Homo Sapiens
QRIAQVLSE

SEQ ID NO: 278450 - protein, 9 aa, Homo Sapiens
TEKAHVDLF

SEQ ID NO: 278451 - protein, 9 aa, Homo Sapiens
NAKNAVLSE

SEQ ID NO: 278452 - protein, 9 aa, Homo Sapiens
TSEPNQLVQ

SEQ ID NO: 278453 - protein, 9 aa, Homo Sapiens
TLGKQHCLP

SEQ ID NO: 278454 - protein, 9 aa, Homo Sapiens
QLNKSMKGA

SEQ ID NO: 278455 - protein, 9 aa, Homo Sapiens
APEICTSPQ

SEQ ID NO: 278456 - protein, 9 aa, Homo Sapiens
YNNELSMFI

SEQ ID NO: 278457 - protein, 9 aa, Homo Sapiens
NNYFNILDK

SEQ ID NO: 278458 - protein, 9 aa, Homo Sapiens
KLYFPVIQF

SEQ ID NO: 278459 - protein, 9 aa, Homo Sapiens
SSQSCSSYE

SEQ ID NO: 278460 - protein, 9 aa, Homo Sapiens
SADGETSEA

SEQ ID NO: 278461 - protein, 9 aa, Homo Sapiens
LWFREAEIY

SEQ ID NO: 278462 - protein, 9 aa, Homo Sapiens
TKKEKNVLQ

SEQ ID NO: 278463 - protein, 9 aa, Homo Sapiens
SVLTTTSPS

SEQ ID NO: 278464 - protein, 9 aa, Homo Sapiens
NRLHSSDWN

SEQ ID NO: 278465 - protein, 9 aa, Homo Sapiens
ASLQKVSMD

SEQ ID NO: 278466 - protein, 9 aa, Homo Sapiens
EPSYVSQTR

SEQ ID NO: 278467 - protein, 9 aa, Homo Sapiens
YPSLNLEKY

SEQ ID NO: 278468 - protein, 9 aa, Homo Sapiens
VGDWIMATS

SEQ ID NO: 278469 - protein, 9 aa, Homo Sapiens
LDCFHAVNK

SEQ ID NO: 278470 - protein, 9 aa, Homo Sapiens
DMPGAAHGI

SEQ ID NO: 278471 - protein, 9 aa, Homo Sapiens
DGDCSKGLF

SEQ ID NO: 278472 - protein, 9 aa, Homo Sapiens
GENFQCLNC

SEQ ID NO: 278473 - protein, 9 aa, Homo Sapiens
QQLSVNQIK

SEQ ID NO: 278474 - protein, 9 aa, Homo Sapiens
TSEELSALK

SEQ ID NO: 278475 - protein, 9 aa, Homo Sapiens
HPMMITNAK

SEQ ID NO: 278476 - protein, 9 aa, Homo Sapiens
QKLSAPREM

SEQ ID NO: 278477 - protein, 9 aa, Homo Sapiens
AQQTKPQMQ

SEQ ID NO: 278478 - protein, 9 aa, Homo Sapiens
IGRAPEASR

SEQ ID NO: 278479 - protein, 9 aa, Homo Sapiens
RGATQHILD

SEQ ID NO: 278480 - protein, 9 aa, Homo Sapiens
FPFICIACF

SEQ ID NO: 278481 - protein, 9 aa, Homo Sapiens
KYFPGVKLV

SEQ ID NO: 278482 - protein, 9 aa, Homo Sapiens
SHFSFRAGQ

SEQ ID NO: 278483 - protein, 9 aa, Homo Sapiens
VSYEVRGTF

SEQ ID NO: 278484 - protein, 9 aa, Homo Sapiens
STEDNKSPH

SEQ ID NO: 278485 - protein, 9 aa, Homo Sapiens
ALTSVQLLD

SEQ ID NO: 278486 - protein, 9 aa, Homo Sapiens
SPFPGIQVR

SEQ ID NO: 278487 - protein, 9 aa, Homo Sapiens
HIQYKLLDE

SEQ ID NO: 278488 - protein, 9 aa, Homo Sapiens
CRHSPGESE

SEQ ID NO: 278489 - protein, 9 aa, Homo Sapiens
LSAVTDRCL

SEQ ID NO: 278490 - protein, 9 aa, Homo Sapiens
PVHRFCVEK

SEQ ID NO: 278491 - protein, 9 aa, Homo Sapiens
KYALLGNYD

SEQ ID NO: 278492 - protein, 9 aa, Homo Sapiens
AVTVLKECI

SEQ ID NO: 278493 - protein, 9 aa, Homo Sapiens
GTSLTTENS

SEQ ID NO: 278494 - protein, 9 aa, Homo Sapiens
LDDCAQVEE

SEQ ID NO: 278495 - protein, 9 aa, Homo Sapiens
EKVVTIIPR

SEQ ID NO: 278496 - protein, 9 aa, Homo Sapiens
SLCDQNQKK

SEQ ID NO: 278497 - protein, 9 aa, Homo Sapiens
RGNTWSREH

SEQ ID NO: 278498 - protein, 9 aa, Homo Sapiens
SPPPCPVSF

SEQ ID NO: 278499 - protein, 9 aa, Homo Sapiens
DNTLNPDCV

SEQ ID NO: 278500 - protein, 9 aa, Homo Sapiens
CKLQDTKST

SEQ ID NO: 278501 - protein, 9 aa, Homo Sapiens
FTLQIMLQS

SEQ ID NO: 278502 - protein, 9 aa, Homo Sapiens
PGAISRRII

SEQ ID NO: 278503 - protein, 9 aa, Homo Sapiens
EISNQIRSR

SEQ ID NO: 278504 - protein, 9 aa, Homo Sapiens
TPVVTSQLG

SEQ ID NO: 278505 - protein, 9 aa, Homo Sapiens
NGFQSGMKR

SEQ ID NO: 278506 - protein, 9 aa, Homo Sapiens
TLPTTNMAQ

SEQ ID NO: 278507 - protein, 9 aa, Homo Sapiens
AYSYFRSVR

SEQ ID NO: 278508 - protein, 9 aa, Homo Sapiens
DGIDLNQTK

SEQ ID NO: 278509 - protein, 9 aa, Homo Sapiens
INGNHDAFN

SEQ ID NO: 278510 - protein, 9 aa, Homo Sapiens
TAICQYAIQ

SEQ ID NO: 278511 - protein, 9 aa, Homo Sapiens
QSHKKLELT

SEQ ID NO: 278512 - protein, 9 aa, Homo Sapiens
LGSIASLAS

SEQ ID NO: 278513 - protein, 9 aa, Homo Sapiens
PFVLKSLVN

SEQ ID NO: 278514 - protein, 9 aa, Homo Sapiens
APAGPVGTA

SEQ ID NO: 278515 - protein, 9 aa, Homo Sapiens
LSTTAVWHQ

SEQ ID NO: 278516 - protein, 9 aa, Homo Sapiens
QEMMDNLFD

SEQ ID NO: 278517 - protein, 9 aa, Homo Sapiens
VLPLKCSLA

SEQ ID NO: 278518 - protein, 9 aa, Homo Sapiens
AINSGGIPL

SEQ ID NO: 278519 - protein, 9 aa, Homo Sapiens
KKCHLIVHK

SEQ ID NO: 278520 - protein, 9 aa, Homo Sapiens
KCYCKPHFI

SEQ ID NO: 278521 - protein, 9 aa, Homo Sapiens
ITRQATSPH

SEQ ID NO: 278522 - protein, 9 aa, Homo Sapiens
YNILAVVLS

SEQ ID NO: 278523 - protein, 9 aa, Homo Sapiens
SVSHYELSR

SEQ ID NO: 278524 - protein, 9 aa, Homo Sapiens
LLTETGEVC

SEQ ID NO: 278525 - protein, 9 aa, Homo Sapiens
QRCQEYLIK

SEQ ID NO: 278526 - protein, 9 aa, Homo Sapiens
LEQKIRELD

SEQ ID NO: 278527 - protein, 9 aa, Homo Sapiens
SLPFCCMYI

SEQ ID NO: 278528 - protein, 9 aa, Homo Sapiens
LNIAVTPLK

SEQ ID NO: 278529 - protein, 9 aa, Homo Sapiens
FHPFVKDVV

SEQ ID NO: 278530 - protein, 9 aa, Homo Sapiens
AWQGDYGKF

SEQ ID NO: 278531 - protein, 9 aa, Homo Sapiens
PVYSQSTVL

SEQ ID NO: 278532 - protein, 9 aa, Homo Sapiens
VKCLNISGT

SEQ ID NO: 278533 - protein, 9 aa, Homo Sapiens
RRIPCMHLF

SEQ ID NO: 278534 - protein, 9 aa, Homo Sapiens
RHKMKVIKS

SEQ ID NO: 278535 - protein, 9 aa, Homo Sapiens
ILQCFIHDV

SEQ ID NO: 278536 - protein, 9 aa, Homo Sapiens
LANLPYRTI

SEQ ID NO: 278537 - protein, 9 aa, Homo Sapiens
CKLTRNGHV

SEQ ID NO: 278538 - protein, 9 aa, Homo Sapiens
PAILMHLNA

SEQ ID NO: 278539 - protein, 9 aa, Homo Sapiens
INDAGVMMC

SEQ ID NO: 278540 - protein, 9 aa, Homo Sapiens
STAPAPEFI

SEQ ID NO: 278541 - protein, 9 aa, Homo Sapiens
VKLKNFKKI

SEQ ID NO: 278542 - protein, 9 aa, Homo Sapiens
PTLKSFGEC

SEQ ID NO: 278543 - protein, 9 aa, Homo Sapiens
LEKVNETDG

SEQ ID NO: 278544 - protein, 9 aa, Homo Sapiens
REEHLDNSN

SEQ ID NO: 278545 - protein, 9 aa, Homo Sapiens
DLDELEEEV

SEQ ID NO: 278546 - protein, 9 aa, Homo Sapiens
VSTSRVFQS

SEQ ID NO: 278547 - protein, 9 aa, Homo Sapiens
TTGSGATGS

SEQ ID NO: 278548 - protein, 9 aa, Homo Sapiens
VMAWLKQQF

SEQ ID NO: 278549 - protein, 9 aa, Homo Sapiens
TSECGKSFG

SEQ ID NO: 278550 - protein, 9 aa, Homo Sapiens
RVQKAPLQK

SEQ ID NO: 278551 - protein, 9 aa, Homo Sapiens
YGTLKLHVE

SEQ ID NO: 278552 - protein, 9 aa, Homo Sapiens
GTVFAIMSP

SEQ ID NO: 278553 - protein, 9 aa, Homo Sapiens
SSLIIHKII

SEQ ID NO: 278554 - protein, 9 aa, Homo Sapiens
SILESKYLY

SEQ ID NO: 278555 - protein, 9 aa, Homo Sapiens
IKGVLMFVA

SEQ ID NO: 278556 - protein, 9 aa, Homo Sapiens
DKDKASETE

SEQ ID NO: 278557 - protein, 9 aa, Homo Sapiens
KVQRHDMRV

SEQ ID NO: 278558 - protein, 9 aa, Homo Sapiens
LEKGILIIH

SEQ ID NO: 278559 - protein, 9 aa, Homo Sapiens
GGHSTLRVA

SEQ ID NO: 278560 - protein, 9 aa, Homo Sapiens
FCDCWPYLE

SEQ ID NO: 278561 - protein, 9 aa, Homo Sapiens
INVEKAIKF

SEQ ID NO: 278562 - protein, 9 aa, Homo Sapiens
EGCMQDMVP

SEQ ID NO: 278563 - protein, 9 aa, Homo Sapiens
SQEPSDQHR

SEQ ID NO: 278564 - protein, 9 aa, Homo Sapiens
DSVINKVTD

SEQ ID NO: 278565 - protein, 9 aa, Homo Sapiens
QSKFMLKDD

SEQ ID NO: 278566 - protein, 9 aa, Homo Sapiens
KYSFEKVTL

SEQ ID NO: 278567 - protein, 9 aa, Homo Sapiens
LNHEELELL

SEQ ID NO: 278568 - protein, 9 aa, Homo Sapiens
EVIITNAGW

SEQ ID NO: 278569 - protein, 9 aa, Homo Sapiens
DMDAEIRRI

SEQ ID NO: 278570 - protein, 9 aa, Homo Sapiens
AIPKEHHRV

SEQ ID NO: 278571 - protein, 9 aa, Homo Sapiens
EPDPGVHYE

SEQ ID NO: 278572 - protein, 9 aa, Homo Sapiens
PQLEKWLQD

SEQ ID NO: 278573 - protein, 9 aa, Homo Sapiens
RYKFIIQVL

SEQ ID NO: 278574 - protein, 9 aa, Homo Sapiens
APVPMPSEY

SEQ ID NO: 278575 - protein, 9 aa, Homo Sapiens
MKLLFDNLV

SEQ ID NO: 278576 - protein, 9 aa, Homo Sapiens
VFWTDAITI

SEQ ID NO: 278577 - protein, 9 aa, Homo Sapiens
SALHAAVPS

SEQ ID NO: 278578 - protein, 9 aa, Homo Sapiens
YFAPATSHE

SEQ ID NO: 278579 - protein, 9 aa, Homo Sapiens
EMQINEAKI

SEQ ID NO: 278580 - protein, 9 aa, Homo Sapiens
FQRVAISTL

SEQ ID NO: 278581 - protein, 9 aa, Homo Sapiens
LGATNNPSG

SEQ ID NO: 278582 - protein, 9 aa, Homo Sapiens
QERLWALLA

SEQ ID NO: 278583 - protein, 9 aa, Homo Sapiens
AHLLMDQAF

SEQ ID NO: 278584 - protein, 9 aa, Homo Sapiens
PQRWQNIFS

SEQ ID NO: 278585 - protein, 9 aa, Homo Sapiens
EKVFRSGSK

SEQ ID NO: 278586 - protein, 9 aa, Homo Sapiens
TESVNASFK

SEQ ID NO: 278587 - protein, 9 aa, Homo Sapiens
MAHTGSMLQ

SEQ ID NO: 278588 - protein, 9 aa, Homo Sapiens
SPSLLDDLT

SEQ ID NO: 278589 - protein, 9 aa, Homo Sapiens
KFDNLLINQ

SEQ ID NO: 278590 - protein, 9 aa, Homo Sapiens
KCGKAFNNS

SEQ ID NO: 278591 - protein, 9 aa, Homo Sapiens
RTEIGVLIR

SEQ ID NO: 278592 - protein, 9 aa, Homo Sapiens
KRRSISSDR

SEQ ID NO: 278593 - protein, 9 aa, Homo Sapiens
GEDEEGISP

SEQ ID NO: 278594 - protein, 9 aa, Homo Sapiens
SIITKNLLK

SEQ ID NO: 278595 - protein, 9 aa, Homo Sapiens
DSRGVPRGV

SEQ ID NO: 278596 - protein, 9 aa, Homo Sapiens
REERLWFRE

SEQ ID NO: 278597 - protein, 9 aa, Homo Sapiens
FIIQVLFIQ

SEQ ID NO: 278598 - protein, 9 aa, Homo Sapiens
GRVVTLLEY

SEQ ID NO: 278599 - protein, 9 aa, Homo Sapiens
LWNKYKDGD

SEQ ID NO: 278600 - protein, 9 aa, Homo Sapiens
PPVAPVMPL

SEQ ID NO: 278601 - protein, 9 aa, Homo Sapiens
HTEEKPFKC

SEQ ID NO: 278602 - protein, 9 aa, Homo Sapiens
LSSAHNLNE

SEQ ID NO: 278603 - protein, 9 aa, Homo Sapiens
RCKNLSSLK

SEQ ID NO: 278604 - protein, 9 aa, Homo Sapiens
MQFGAPLAR

SEQ ID NO: 278605 - protein, 9 aa, Homo Sapiens
HQKDTFHDN

SEQ ID NO: 278606 - protein, 9 aa, Homo Sapiens
NNYPENTYY

SEQ ID NO: 278607 - protein, 9 aa, Homo Sapiens
TSSGIENKS

SEQ ID NO: 278608 - protein, 9 aa, Homo Sapiens
TATTKSETK

SEQ ID NO: 278609 - protein, 9 aa, Homo Sapiens
PKKWIGNMD

SEQ ID NO: 278610 - protein, 9 aa, Homo Sapiens
EDGDRLRIL

SEQ ID NO: 278611 - protein, 9 aa, Homo Sapiens
IQQVKSHFA

SEQ ID NO: 278612 - protein, 9 aa, Homo Sapiens
KVSFQDKEK

SEQ ID NO: 278613 - protein, 9 aa, Homo Sapiens
MYEMLYGKT

SEQ ID NO: 278614 - protein, 9 aa, Homo Sapiens
SGGQEASGG

SEQ ID NO: 278615 - protein, 9 aa, Homo Sapiens
GWVTLEGDF

SEQ ID NO: 278616 - protein, 9 aa, Homo Sapiens
RKLDFFRSK

SEQ ID NO: 278617 - protein, 9 aa, Homo Sapiens
PRKGSKMRQ

SEQ ID NO: 278618 - protein, 9 aa, Homo Sapiens
EDRILLSRE

SEQ ID NO: 278619 - protein, 9 aa, Homo Sapiens
HVLYHTKIR

SEQ ID NO: 278620 - protein, 9 aa, Homo Sapiens
PSSNLYALH

SEQ ID NO: 278621 - protein, 9 aa, Homo Sapiens
VALNANVVS

SEQ ID NO: 278622 - protein, 9 aa, Homo Sapiens
DAEDNYTCT

SEQ ID NO: 278623 - protein, 9 aa, Homo Sapiens
REFSRIIIC

SEQ ID NO: 278624 - protein, 9 aa, Homo Sapiens
ERRRPQSRP

SEQ ID NO: 278625 - protein, 9 aa, Homo Sapiens
QCKLYSSLL

SEQ ID NO: 278626 - protein, 9 aa, Homo Sapiens
TDVANKQLK

SEQ ID NO: 278627 - protein, 9 aa, Homo Sapiens
HFRGKAMAP

SEQ ID NO: 278628 - protein, 9 aa, Homo Sapiens
LADEGMLQP

SEQ ID NO: 278629 - protein, 9 aa, Homo Sapiens
GGLCYYLPP

SEQ ID NO: 278630 - protein, 9 aa, Homo Sapiens
GEDNFEVVK

SEQ ID NO: 278631 - protein, 9 aa, Homo Sapiens
EIKHIPSDG

SEQ ID NO: 278632 - protein, 9 aa, Homo Sapiens
HKVRCNCVE

SEQ ID NO: 278633 - protein, 9 aa, Homo Sapiens
KMKKMSKET

SEQ ID NO: 278634 - protein, 9 aa, Homo Sapiens
LKSGVCTLI

SEQ ID NO: 278635 - protein, 9 aa, Homo Sapiens
KVGMRREVV

SEQ ID NO: 278636 - protein, 9 aa, Homo Sapiens
TRKKKIAII

SEQ ID NO: 278637 - protein, 9 aa, Homo Sapiens
VQVSQLLCL

SEQ ID NO: 278638 - protein, 9 aa, Homo Sapiens
PQTILRKLL

SEQ ID NO: 278639 - protein, 9 aa, Homo Sapiens
GGKQFCSIA

SEQ ID NO: 278640 - protein, 9 aa, Homo Sapiens
KTYQINLKS

SEQ ID NO: 278641 - protein, 9 aa, Homo Sapiens
VLHTLWVES

SEQ ID NO: 278642 - protein, 9 aa, Homo Sapiens
AFIYRPIQQ

SEQ ID NO: 278643 - protein, 9 aa, Homo Sapiens
EKQKKVIAS

SEQ ID NO: 278644 - protein, 9 aa, Homo Sapiens
PLPQFCSKK

SEQ ID NO: 278645 - protein, 9 aa, Homo Sapiens
SQLKTKDPF

SEQ ID NO: 278646 - protein, 9 aa, Homo Sapiens
FSSREERLW

SEQ ID NO: 278647 - protein, 9 aa, Homo Sapiens
EIKPLALST

SEQ ID NO: 278648 - protein, 9 aa, Homo Sapiens
CSFNTYVQL

SEQ ID NO: 278649 - protein, 9 aa, Homo Sapiens
TKDSCFLTI

SEQ ID NO: 278650 - protein, 9 aa, Homo Sapiens
TRPLTMTEL

SEQ ID NO: 278651 - protein, 9 aa, Homo Sapiens
NNSENPKNT

SEQ ID NO: 278652 - protein, 9 aa, Homo Sapiens
QGDRHFVSD

SEQ ID NO: 278653 - protein, 9 aa, Homo Sapiens
QDTNSQSIG

SEQ ID NO: 278654 - protein, 9 aa, Homo Sapiens
MFVSVSAFF

SEQ ID NO: 278655 - protein, 9 aa, Homo Sapiens
DYAVEDKPS

SEQ ID NO: 278656 - protein, 9 aa, Homo Sapiens
QNISNIITS

SEQ ID NO: 278657 - protein, 9 aa, Homo Sapiens
ILRNSAGNV

SEQ ID NO: 278658 - protein, 9 aa, Homo Sapiens
GWEGANYAV

SEQ ID NO: 278659 - protein, 9 aa, Homo Sapiens
PEGSPVRDM

SEQ ID NO: 278660 - protein, 9 aa, Homo Sapiens
NSGNYGDKP

SEQ ID NO: 278661 - protein, 9 aa, Homo Sapiens
IKIKSILDI

SEQ ID NO: 278662 - protein, 9 aa, Homo Sapiens
SYIVGAPRY

SEQ ID NO: 278663 - protein, 9 aa, Homo Sapiens
LLINQIENL

SEQ ID NO: 278664 - protein, 9 aa, Homo Sapiens
GQIHMYEQG

SEQ ID NO: 278665 - protein, 9 aa, Homo Sapiens
AVNYHLLGN

SEQ ID NO: 278666 - protein, 9 aa, Homo Sapiens
KDFLEPESV

SEQ ID NO: 278667 - protein, 9 aa, Homo Sapiens
PSDFHQTKA

SEQ ID NO: 278668 - protein, 9 aa, Homo Sapiens
MFSICMVES

SEQ ID NO: 278669 - protein, 9 aa, Homo Sapiens
SQSSDNKFG

SEQ ID NO: 278670 - protein, 9 aa, Homo Sapiens
MDISKGLSG

SEQ ID NO: 278671 - protein, 9 aa, Homo Sapiens
REHGLCGHW

SEQ ID NO: 278672 - protein, 9 aa, Homo Sapiens
KSSKLNYKF

SEQ ID NO: 278673 - protein, 9 aa, Homo Sapiens
GTNENRENY

SEQ ID NO: 278674 - protein, 9 aa, Homo Sapiens
IISWLIFGS

SEQ ID NO: 278675 - protein, 9 aa, Homo Sapiens
AHFLLNVMN

SEQ ID NO: 278676 - protein, 9 aa, Homo Sapiens
HTLDHLLKL

SEQ ID NO: 278677 - protein, 9 aa, Homo Sapiens
VGDTATKES

SEQ ID NO: 278678 - protein, 9 aa, Homo Sapiens
WDTVFTLLA

SEQ ID NO: 278679 - protein, 9 aa, Homo Sapiens
QLYAWPFLE

SEQ ID NO: 278680 - protein, 9 aa, Homo Sapiens
SCSISEDSE

SEQ ID NO: 278681 - protein, 9 aa, Homo Sapiens
EEPTPVCGR

SEQ ID NO: 278682 - protein, 9 aa, Homo Sapiens
VGLKLNSVN

SEQ ID NO: 278683 - protein, 9 aa, Homo Sapiens
QRHDMRVHP

SEQ ID NO: 278684 - protein, 9 aa, Homo Sapiens
PISSFFGGS

SEQ ID NO: 278685 - protein, 9 aa, Homo Sapiens
AAATSFTHI

SEQ ID NO: 278686 - protein, 9 aa, Homo Sapiens
ISLNWNHDS

SEQ ID NO: 278687 - protein, 9 aa, Homo Sapiens
LDQVQVMPL

SEQ ID NO: 278688 - protein, 9 aa, Homo Sapiens
WEEKSRVQE

SEQ ID NO: 278689 - protein, 9 aa, Homo Sapiens
CYFTGSEPM

SEQ ID NO: 278690 - protein, 9 aa, Homo Sapiens
IVVTVLLTP

SEQ ID NO: 278691 - protein, 9 aa, Homo Sapiens
EEGLEIDER

SEQ ID NO: 278692 - protein, 9 aa, Homo Sapiens
AARNMSCQG

SEQ ID NO: 278693 - protein, 9 aa, Homo Sapiens
APQSFLCRA

SEQ ID NO: 278694 - protein, 9 aa, Homo Sapiens
GWVWNQLFV

SEQ ID NO: 278695 - protein, 9 aa, Homo Sapiens
KYRHRQVPL

SEQ ID NO: 278696 - protein, 9 aa, Homo Sapiens
KELNEYQSN

SEQ ID NO: 278697 - protein, 9 aa, Homo Sapiens
KKSTRERFA

SEQ ID NO: 278698 - protein, 9 aa, Homo Sapiens
NVFPRTRKW

SEQ ID NO: 278699 - protein, 9 aa, Homo Sapiens
KYQPGKSSV

SEQ ID NO: 278700 - protein, 9 aa, Homo Sapiens
IDDAQVLEY

SEQ ID NO: 278701 - protein, 9 aa, Homo Sapiens
VTLVPPPWP

SEQ ID NO: 278702 - protein, 9 aa, Homo Sapiens
VDLAHTIGR

SEQ ID NO: 278703 - protein, 9 aa, Homo Sapiens
PPSPFRNSV

SEQ ID NO: 278704 - protein, 9 aa, Homo Sapiens
WQSLRSERN

SEQ ID NO: 278705 - protein, 9 aa, Homo Sapiens
GSRDLTPSR

SEQ ID NO: 278706 - protein, 9 aa, Homo Sapiens
ACVAGPENR

SEQ ID NO: 278707 - protein, 9 aa, Homo Sapiens
LDNNQIKTF

SEQ ID NO: 278708 - protein, 9 aa, Homo Sapiens
QILERMCER

SEQ ID NO: 278709 - protein, 9 aa, Homo Sapiens
LEVKEEPET

SEQ ID NO: 278710 - protein, 9 aa, Homo Sapiens
CTLDKGGES

SEQ ID NO: 278711 - protein, 9 aa, Homo Sapiens
LSKTHGTSP

SEQ ID NO: 278712 - protein, 9 aa, Homo Sapiens
HCMCRNLQN

SEQ ID NO: 278713 - protein, 9 aa, Homo Sapiens
HKKIHIAEK

SEQ ID NO: 278714 - protein, 9 aa, Homo Sapiens
QNMIEYRTE

SEQ ID NO: 278715 - protein, 9 aa, Homo Sapiens
LDNFSILET

SEQ ID NO: 278716 - protein, 9 aa, Homo Sapiens
YQDYEIEIL

SEQ ID NO: 278717 - protein, 9 aa, Homo Sapiens
VAGLLRLTC

SEQ ID NO: 278718 - protein, 9 aa, Homo Sapiens
SSDMEQISI

SEQ ID NO: 278719 - protein, 9 aa, Homo Sapiens
SHVSWIAGQ

SEQ ID NO: 278720 - protein, 9 aa, Homo Sapiens
SPSAVELRR

SEQ ID NO: 278721 - protein, 9 aa, Homo Sapiens
IIEAKQKGY

SEQ ID NO: 278722 - protein, 9 aa, Homo Sapiens
RSALEKNLI

SEQ ID NO: 278723 - protein, 9 aa, Homo Sapiens
LAQQMNHLS

SEQ ID NO: 278724 - protein, 9 aa, Homo Sapiens
HKRSECPWL

SEQ ID NO: 278725 - protein, 9 aa, Homo Sapiens
SSGILDFQI

SEQ ID NO: 278726 - protein, 9 aa, Homo Sapiens
ERETQRGLR

SEQ ID NO: 278727 - protein, 9 aa, Homo Sapiens
TLKKCIKLL

SEQ ID NO: 278728 - protein, 9 aa, Homo Sapiens
HLCSYIAWY

SEQ ID NO: 278729 - protein, 9 aa, Homo Sapiens
FASGQRTVF

SEQ ID NO: 278730 - protein, 9 aa, Homo Sapiens
VVMFTLGGS

SEQ ID NO: 278731 - protein, 9 aa, Homo Sapiens
PCRSYTYFK

SEQ ID NO: 278732 - protein, 9 aa, Homo Sapiens
SRNLFVKDV

SEQ ID NO: 278733 - protein, 9 aa, Homo Sapiens
EAEKPPTPK

SEQ ID NO: 278734 - protein, 9 aa, Homo Sapiens
CNSVFSDAD

SEQ ID NO: 278735 - protein, 9 aa, Homo Sapiens
KLFTVEPQH

SEQ ID NO: 278736 - protein, 9 aa, Homo Sapiens
LQSWVEFNA

SEQ ID NO: 278737 - protein, 9 aa, Homo Sapiens
TVAGCAVAT

SEQ ID NO: 278738 - protein, 9 aa, Homo Sapiens
CTLLGLRDW

SEQ ID NO: 278739 - protein, 9 aa, Homo Sapiens
RIHLVGKWN

SEQ ID NO: 278740 - protein, 9 aa, Homo Sapiens
TSLYGFSTA

SEQ ID NO: 278741 - protein, 9 aa, Homo Sapiens
EWKAIQDKD

SEQ ID NO: 278742 - protein, 9 aa, Homo Sapiens
FSLASSSNA

SEQ ID NO: 278743 - protein, 9 aa, Homo Sapiens
TSFERALYL

SEQ ID NO: 278744 - protein, 9 aa, Homo Sapiens
IRMESLFNT

SEQ ID NO: 278745 - protein, 9 aa, Homo Sapiens
EGSTITGSH

SEQ ID NO: 278746 - protein, 9 aa, Homo Sapiens
RGKAMAPHY

SEQ ID NO: 278747 - protein, 9 aa, Homo Sapiens
VDFLRLSTH

SEQ ID NO: 278748 - protein, 9 aa, Homo Sapiens
ERKRFHFNS

SEQ ID NO: 278749 - protein, 9 aa, Homo Sapiens
AELEDGEGE

SEQ ID NO: 278750 - protein, 9 aa, Homo Sapiens
VYRWVREKR

SEQ ID NO: 278751 - protein, 9 aa, Homo Sapiens
NRYEVEINR

SEQ ID NO: 278752 - protein, 9 aa, Homo Sapiens
LARLNESHF

SEQ ID NO: 278753 - protein, 9 aa, Homo Sapiens
DLGFELFEA

SEQ ID NO: 278754 - protein, 9 aa, Homo Sapiens
LLRSVPHFA

SEQ ID NO: 278755 - protein, 9 aa, Homo Sapiens
MIILYDLHS

SEQ ID NO: 278756 - protein, 9 aa, Homo Sapiens
LNEPLDELV

SEQ ID NO: 278757 - protein, 9 aa, Homo Sapiens
KKMAYLARK

SEQ ID NO: 278758 - protein, 9 aa, Homo Sapiens
DGHSFPMRY

SEQ ID NO: 278759 - protein, 9 aa, Homo Sapiens
YSNPMNPYP

SEQ ID NO: 278760 - protein, 9 aa, Homo Sapiens
FFVLYGGIV

SEQ ID NO: 278761 - protein, 9 aa, Homo Sapiens
PGQPGEGKP

SEQ ID NO: 278762 - protein, 9 aa, Homo Sapiens
KLSFQNKII

SEQ ID NO: 278763 - protein, 9 aa, Homo Sapiens
TDRCLQVEN

SEQ ID NO: 278764 - protein, 9 aa, Homo Sapiens
HHQVQSFAP

SEQ ID NO: 278765 - protein, 9 aa, Homo Sapiens
EEDEEMVEA

SEQ ID NO: 278766 - protein, 9 aa, Homo Sapiens
GSYLNYSNP

SEQ ID NO: 278767 - protein, 9 aa, Homo Sapiens
SVIALVCKE

SEQ ID NO: 278768 - protein, 9 aa, Homo Sapiens
DIARRQLPA

SEQ ID NO: 278769 - protein, 9 aa, Homo Sapiens
LNSHLIQHK

SEQ ID NO: 278770 - protein, 9 aa, Homo Sapiens
KVFGKEQAA

SEQ ID NO: 278771 - protein, 9 aa, Homo Sapiens
PHTADQDTS

SEQ ID NO: 278772 - protein, 9 aa, Homo Sapiens
FQKTEDMKR

SEQ ID NO: 278773 - protein, 9 aa, Homo Sapiens
IGFYCQNVQ

SEQ ID NO: 278774 - protein, 9 aa, Homo Sapiens
HDVIVMAWL

SEQ ID NO: 278775 - protein, 9 aa, Homo Sapiens
SPKEVRKKF

SEQ ID NO: 278776 - protein, 9 aa, Homo Sapiens
ALGCVLYKL

SEQ ID NO: 278777 - protein, 9 aa, Homo Sapiens
LQAWTGKIF

SEQ ID NO: 278778 - protein, 9 aa, Homo Sapiens
QKCRDSYQE

SEQ ID NO: 278779 - protein, 9 aa, Homo Sapiens
EEPRSDLKA

SEQ ID NO: 278780 - protein, 9 aa, Homo Sapiens
TSNVSSLSS

SEQ ID NO: 278781 - protein, 9 aa, Homo Sapiens
FSQKHCASH

SEQ ID NO: 278782 - protein, 9 aa, Homo Sapiens
IKGQSAGGI

SEQ ID NO: 278783 - protein, 9 aa, Homo Sapiens
LTVTPENGT

SEQ ID NO: 278784 - protein, 9 aa, Homo Sapiens
LGSSPPVLP

SEQ ID NO: 278785 - protein, 9 aa, Homo Sapiens
KSIKLIPVS

SEQ ID NO: 278786 - protein, 9 aa, Homo Sapiens
NMVNHRLIG

SEQ ID NO: 278787 - protein, 9 aa, Homo Sapiens
VKHFCSHLG

SEQ ID NO: 278788 - protein, 9 aa, Homo Sapiens
YTIVTSILR

SEQ ID NO: 278789 - protein, 9 aa, Homo Sapiens
PITPECVKG

SEQ ID NO: 278790 - protein, 9 aa, Homo Sapiens
SGSEQTFLI

SEQ ID NO: 278791 - protein, 9 aa, Homo Sapiens
KYDYPLDVN

SEQ ID NO: 278792 - protein, 9 aa, Homo Sapiens
ESMENGALD

SEQ ID NO: 278793 - protein, 9 aa, Homo Sapiens
AVRLTTRSC

SEQ ID NO: 278794 - protein, 9 aa, Homo Sapiens
LASSWKHPE

SEQ ID NO: 278795 - protein, 9 aa, Homo Sapiens
PVSKIIQSI

SEQ ID NO: 278796 - protein, 9 aa, Homo Sapiens
GLPGELTPP

SEQ ID NO: 278797 - protein, 9 aa, Homo Sapiens
LTDTYNKIL

SEQ ID NO: 278798 - protein, 9 aa, Homo Sapiens
GMQIPRVCY

SEQ ID NO: 278799 - protein, 9 aa, Homo Sapiens
YAVKQHSFI

SEQ ID NO: 278800 - protein, 9 aa, Homo Sapiens
AASPRICPH

SEQ ID NO: 278801 - protein, 9 aa, Homo Sapiens
RDRKSRLEE

SEQ ID NO: 278802 - protein, 9 aa, Homo Sapiens
VQTARECLV

SEQ ID NO: 278803 - protein, 9 aa, Homo Sapiens
TIFQFKGTH

SEQ ID NO: 278804 - protein, 9 aa, Homo Sapiens
ENPYPSIFW

SEQ ID NO: 278805 - protein, 9 aa, Homo Sapiens
DFLGMLNQT

SEQ ID NO: 278806 - protein, 9 aa, Homo Sapiens
NTGLSAFIF

SEQ ID NO: 278807 - protein, 9 aa, Homo Sapiens
TYLKTIALY

SEQ ID NO: 278808 - protein, 9 aa, Homo Sapiens
ETDLSKNLF

SEQ ID NO: 278809 - protein, 9 aa, Homo Sapiens
NNVAETACN

SEQ ID NO: 278810 - protein, 9 aa, Homo Sapiens
HNWRYATGG

SEQ ID NO: 278811 - protein, 9 aa, Homo Sapiens
RPFRYKHKM

SEQ ID NO: 278812 - protein, 9 aa, Homo Sapiens
KKKKNKSQD

SEQ ID NO: 278813 - protein, 9 aa, Homo Sapiens
AGLVFVFEA

SEQ ID NO: 278814 - protein, 9 aa, Homo Sapiens
RLGRQGNKG

SEQ ID NO: 278815 - protein, 9 aa, Homo Sapiens
YPAVSLRHR

SEQ ID NO: 278816 - protein, 9 aa, Homo Sapiens
LELIKQAQA

SEQ ID NO: 278817 - protein, 9 aa, Homo Sapiens
AEVKHSRHR

SEQ ID NO: 278818 - protein, 9 aa, Homo Sapiens
VNYLHERSE

SEQ ID NO: 278819 - protein, 9 aa, Homo Sapiens
FNTNVVFGN

SEQ ID NO: 278820 - protein, 9 aa, Homo Sapiens
SEVEQVSSF

SEQ ID NO: 278821 - protein, 9 aa, Homo Sapiens
LETSSKEEV

SEQ ID NO: 278822 - protein, 9 aa, Homo Sapiens
VAQHSQAPD

SEQ ID NO: 278823 - protein, 9 aa, Homo Sapiens
GSKGESVWL

SEQ ID NO: 278824 - protein, 9 aa, Homo Sapiens
TDSFNHKKF

SEQ ID NO: 278825 - protein, 9 aa, Homo Sapiens
GLMAQEADD

SEQ ID NO: 278826 - protein, 9 aa, Homo Sapiens
LTVAQHSQA

SEQ ID NO: 278827 - protein, 9 aa, Homo Sapiens
KDKTYGVRN

SEQ ID NO: 278828 - protein, 9 aa, Homo Sapiens
GQSYTCPYS

SEQ ID NO: 278829 - protein, 9 aa, Homo Sapiens
VAASLQKVS

SEQ ID NO: 278830 - protein, 9 aa, Homo Sapiens
SAQEAQKET

SEQ ID NO: 278831 - protein, 9 aa, Homo Sapiens
SRIMTLYQF

SEQ ID NO: 278832 - protein, 9 aa, Homo Sapiens
GIFKNLRET

SEQ ID NO: 278833 - protein, 9 aa, Homo Sapiens
SKEFLSKPK

SEQ ID NO: 278834 - protein, 9 aa, Homo Sapiens
EKFQEMKEA

SEQ ID NO: 278835 - protein, 9 aa, Homo Sapiens
SQKYDRVVH

SEQ ID NO: 278836 - protein, 9 aa, Homo Sapiens
VDALALHYF

SEQ ID NO: 278837 - protein, 9 aa, Homo Sapiens
YPMIILYDL

SEQ ID NO: 278838 - protein, 9 aa, Homo Sapiens
KKLSLLIDT

SEQ ID NO: 278839 - protein, 9 aa, Homo Sapiens
EQYQIRKRG

SEQ ID NO: 278840 - protein, 9 aa, Homo Sapiens
FCDLVWSAP

SEQ ID NO: 278841 - protein, 9 aa, Homo Sapiens
VNVTFKDQQ

SEQ ID NO: 278842 - protein, 9 aa, Homo Sapiens
RKWIRPIKT

SEQ ID NO: 278843 - protein, 9 aa, Homo Sapiens
PEDKVSIYK

SEQ ID NO: 278844 - protein, 9 aa, Homo Sapiens
QHISPNRHK

SEQ ID NO: 278845 - protein, 9 aa, Homo Sapiens
EMLLKFYSF

SEQ ID NO: 278846 - protein, 9 aa, Homo Sapiens
KECEALICN

SEQ ID NO: 278847 - protein, 9 aa, Homo Sapiens
LIAKLATAQ

SEQ ID NO: 278848 - protein, 9 aa, Homo Sapiens
WDKLIFANI

SEQ ID NO: 278849 - protein, 9 aa, Homo Sapiens
RKAVRDIGR

SEQ ID NO: 278850 - protein, 9 aa, Homo Sapiens
KFIIQVLFI

SEQ ID NO: 278851 - protein, 9 aa, Homo Sapiens
MVFCLLATD

SEQ ID NO: 278852 - protein, 9 aa, Homo Sapiens
LLAFQVFII

SEQ ID NO: 278853 - protein, 9 aa, Homo Sapiens
RDFIKLTLE

SEQ ID NO: 278854 - protein, 9 aa, Homo Sapiens
FNNVAITFS

SEQ ID NO: 278855 - protein, 9 aa, Homo Sapiens
LNNSANPII

SEQ ID NO: 278856 - protein, 9 aa, Homo Sapiens
SHPRSPNML

SEQ ID NO: 278857 - protein, 9 aa, Homo Sapiens
GASVMTKTV

SEQ ID NO: 278858 - protein, 9 aa, Homo Sapiens
LDMYGECTM

SEQ ID NO: 278859 - protein, 9 aa, Homo Sapiens
FLLDRRNYP

SEQ ID NO: 278860 - protein, 9 aa, Homo Sapiens
SHTQCIADK

SEQ ID NO: 278861 - protein, 9 aa, Homo Sapiens
DWDRKRCRV

SEQ ID NO: 278862 - protein, 9 aa, Homo Sapiens
AISCVRVIT

SEQ ID NO: 278863 - protein, 9 aa, Homo Sapiens
WSSRPGIPA

SEQ ID NO: 278864 - protein, 9 aa, Homo Sapiens
KICLRCQKG

SEQ ID NO: 278865 - protein, 9 aa, Homo Sapiens
NQLGKQEPG

SEQ ID NO: 278866 - protein, 9 aa, Homo Sapiens
EKYQLQVFM

SEQ ID NO: 278867 - protein, 9 aa, Homo Sapiens
KQEEERKWQ

SEQ ID NO: 278868 - protein, 9 aa, Homo Sapiens
MCTHHTDTD

SEQ ID NO: 278869 - protein, 9 aa, Homo Sapiens
SSSAGYLQH

SEQ ID NO: 278870 - protein, 9 aa, Homo Sapiens
DMVTCSQII

SEQ ID NO: 278871 - protein, 9 aa, Homo Sapiens
EQQQQLSSS

SEQ ID NO: 278872 - protein, 9 aa, Homo Sapiens
SHVEKETQP

SEQ ID NO: 278873 - protein, 9 aa, Homo Sapiens
PVIRYKDVT

SEQ ID NO: 278874 - protein, 9 aa, Homo Sapiens
LKLYFPVIQ

SEQ ID NO: 278875 - protein, 9 aa, Homo Sapiens
VSYNRLHSS

SEQ ID NO: 278876 - protein, 9 aa, Homo Sapiens
CISMYVKPS

SEQ ID NO: 278877 - protein, 9 aa, Homo Sapiens
YYVPCILIY

SEQ ID NO: 278878 - protein, 9 aa, Homo Sapiens
EKEVTELYV

SEQ ID NO: 278879 - protein, 9 aa, Homo Sapiens
ISYICIVAT

SEQ ID NO: 278880 - protein, 9 aa, Homo Sapiens
SGEELWPGS

SEQ ID NO: 278881 - protein, 9 aa, Homo Sapiens
SRQERDRKS

SEQ ID NO: 278882 - protein, 9 aa, Homo Sapiens
LLSYYTIVT

SEQ ID NO: 278883 - protein, 9 aa, Homo Sapiens
MNMKKFQIP

SEQ ID NO: 278884 - protein, 9 aa, Homo Sapiens
NVSSVEALQ

SEQ ID NO: 278885 - protein, 9 aa, Homo Sapiens
QFNTEDQVE

SEQ ID NO: 278886 - protein, 9 aa, Homo Sapiens
QAEEYAHFR

SEQ ID NO: 278887 - protein, 9 aa, Homo Sapiens
FSAHKYFPG

SEQ ID NO: 278888 - protein, 9 aa, Homo Sapiens
MDIIFHSSD

SEQ ID NO: 278889 - protein, 9 aa, Homo Sapiens
GPYPTPPPP

SEQ ID NO: 278890 - protein, 9 aa, Homo Sapiens
PQGQQPPPR

SEQ ID NO: 278891 - protein, 9 aa, Homo Sapiens
LERTEQLLE

SEQ ID NO: 278892 - protein, 9 aa, Homo Sapiens
ALKGCDDYV

SEQ ID NO: 278893 - protein, 9 aa, Homo Sapiens
MLKGQGTFY

SEQ ID NO: 278894 - protein, 9 aa, Homo Sapiens
APQGNSHTE

SEQ ID NO: 278895 - protein, 9 aa, Homo Sapiens
SFTLTKLSC

SEQ ID NO: 278896 - protein, 9 aa, Homo Sapiens
LQTAPTLST

SEQ ID NO: 278897 - protein, 9 aa, Homo Sapiens
FQEIKMCGK

SEQ ID NO: 278898 - protein, 9 aa, Homo Sapiens
SVVALGTSI

SEQ ID NO: 278899 - protein, 9 aa, Homo Sapiens
VLDSSQGHS

SEQ ID NO: 278900 - protein, 9 aa, Homo Sapiens
PSSSVSLTV

SEQ ID NO: 278901 - protein, 9 aa, Homo Sapiens
SVISDKTAE

SEQ ID NO: 278902 - protein, 9 aa, Homo Sapiens
NQAYHWDTS

SEQ ID NO: 278903 - protein, 9 aa, Homo Sapiens
IELEKNFNN

SEQ ID NO: 278904 - protein, 9 aa, Homo Sapiens
NPFCGTGTD

SEQ ID NO: 278905 - protein, 9 aa, Homo Sapiens
KRHVLGLSA

SEQ ID NO: 278906 - protein, 9 aa, Homo Sapiens
HCEEHVALF

SEQ ID NO: 278907 - protein, 9 aa, Homo Sapiens
LAHQSVEGE

SEQ ID NO: 278908 - protein, 9 aa, Homo Sapiens
NDMERKVEE

SEQ ID NO: 278909 - protein, 9 aa, Homo Sapiens
LQEEKGKVD

SEQ ID NO: 278910 - protein, 9 aa, Homo Sapiens
KTVYCFVNF

SEQ ID NO: 278911 - protein, 9 aa, Homo Sapiens
SSCKGMVTA

SEQ ID NO: 278912 - protein, 9 aa, Homo Sapiens
SPYLVSIWR

SEQ ID NO: 278913 - protein, 9 aa, Homo Sapiens
EDQKHSYEQ

SEQ ID NO: 278914 - protein, 9 aa, Homo Sapiens
DRCLQVENE

SEQ ID NO: 278915 - protein, 9 aa, Homo Sapiens
EFVKAAGLC

SEQ ID NO: 278916 - protein, 9 aa, Homo Sapiens
EEETQLRES

SEQ ID NO: 278917 - protein, 9 aa, Homo Sapiens
EKRKKYKQE

SEQ ID NO: 278918 - protein, 9 aa, Homo Sapiens
LPLLQPTWD

SEQ ID NO: 278919 - protein, 9 aa, Homo Sapiens
FLSKCDNKC

SEQ ID NO: 278920 - protein, 9 aa, Homo Sapiens
SSALTQHQI

SEQ ID NO: 278921 - protein, 9 aa, Homo Sapiens
IKLGSTETK

SEQ ID NO: 278922 - protein, 9 aa, Homo Sapiens
SLAPGQFIL

SEQ ID NO: 278923 - protein, 9 aa, Homo Sapiens
LSCVTVPNM

SEQ ID NO: 278924 - protein, 9 aa, Homo Sapiens
YEANYYEEI

SEQ ID NO: 278925 - protein, 9 aa, Homo Sapiens
NIVMPHRVC

SEQ ID NO: 278926 - protein, 9 aa, Homo Sapiens
NLDNLFLQC

SEQ ID NO: 278927 - protein, 9 aa, Homo Sapiens
RTLNGKDVF

SEQ ID NO: 278928 - protein, 9 aa, Homo Sapiens
RYGQIQQVK

SEQ ID NO: 278929 - protein, 9 aa, Homo Sapiens
KPHMVPHHS

SEQ ID NO: 278930 - protein, 9 aa, Homo Sapiens
NLIYHMLQP

SEQ ID NO: 278931 - protein, 9 aa, Homo Sapiens
ATCNHSLLF

SEQ ID NO: 278932 - protein, 9 aa, Homo Sapiens
NWKCPVKFD

SEQ ID NO: 278933 - protein, 9 aa, Homo Sapiens
LLDCFHAVN

SEQ ID NO: 278934 - protein, 9 aa, Homo Sapiens
AEEILSWSQ

SEQ ID NO: 278935 - protein, 9 aa, Homo Sapiens
KETDREAVV

SEQ ID NO: 278936 - protein, 9 aa, Homo Sapiens
MKGGEYGSG

SEQ ID NO: 278937 - protein, 9 aa, Homo Sapiens
TVHLYDKWI

SEQ ID NO: 278938 - protein, 9 aa, Homo Sapiens
GAADRWFIL

SEQ ID NO: 278939 - protein, 9 aa, Homo Sapiens
DATVFASAM

SEQ ID NO: 278940 - protein, 9 aa, Homo Sapiens
YEVQAKSSN

SEQ ID NO: 278941 - protein, 9 aa, Homo Sapiens
LLGQVGALH

SEQ ID NO: 278942 - protein, 9 aa, Homo Sapiens
INALKSEST

SEQ ID NO: 278943 - protein, 9 aa, Homo Sapiens
CKTTIVPVE

SEQ ID NO: 278944 - protein, 9 aa, Homo Sapiens
LFLTMVISC

SEQ ID NO: 278945 - protein, 9 aa, Homo Sapiens
LADVTRRLP

SEQ ID NO: 278946 - protein, 9 aa, Homo Sapiens
NWNSISSGY

SEQ ID NO: 278947 - protein, 9 aa, Homo Sapiens
KPYKKHRRK

SEQ ID NO: 278948 - protein, 9 aa, Homo Sapiens
ATYMVIEHC

SEQ ID NO: 278949 - protein, 9 aa, Homo Sapiens
VPTEFLPRH

SEQ ID NO: 278950 - protein, 9 aa, Homo Sapiens
HFNSYDISR

SEQ ID NO: 278951 - protein, 9 aa, Homo Sapiens
KYIIHFFRH

SEQ ID NO: 278952 - protein, 9 aa, Homo Sapiens
YHPPQFGKS

SEQ ID NO: 278953 - protein, 9 aa, Homo Sapiens
GDGVRVSAA

SEQ ID NO: 278954 - protein, 9 aa, Homo Sapiens
QYPYTNLYL

SEQ ID NO: 278955 - protein, 9 aa, Homo Sapiens
VEYQMTSGS

SEQ ID NO: 278956 - protein, 9 aa, Homo Sapiens
EYKILAVFY

SEQ ID NO: 278957 - protein, 9 aa, Homo Sapiens
VSETTLGNY

SEQ ID NO: 278958 - protein, 9 aa, Homo Sapiens
MVSQAGLRS

SEQ ID NO: 278959 - protein, 9 aa, Homo Sapiens
EFEVDDLNY

SEQ ID NO: 278960 - protein, 9 aa, Homo Sapiens
KLKNLNCPF

SEQ ID NO: 278961 - protein, 9 aa, Homo Sapiens
AASLQKVSM

SEQ ID NO: 278962 - protein, 9 aa, Homo Sapiens
FRSKKELNH

SEQ ID NO: 278963 - protein, 9 aa, Homo Sapiens
DTNALHVPQ

SEQ ID NO: 278964 - protein, 9 aa, Homo Sapiens
FKALVAEQE

SEQ ID NO: 278965 - protein, 9 aa, Homo Sapiens
RLLMMHRIN

SEQ ID NO: 278966 - protein, 9 aa, Homo Sapiens
ASLSQDSSS

SEQ ID NO: 278967 - protein, 9 aa, Homo Sapiens
GCDVAFEWK

SEQ ID NO: 278968 - protein, 9 aa, Homo Sapiens
TESLTQVPN

SEQ ID NO: 278969 - protein, 9 aa, Homo Sapiens
TCYQQQSRI

SEQ ID NO: 278970 - protein, 9 aa, Homo Sapiens
HHQILATES

SEQ ID NO: 278971 - protein, 9 aa, Homo Sapiens
SILVHPDTN

SEQ ID NO: 278972 - protein, 9 aa, Homo Sapiens
VEPYNSIIT

SEQ ID NO: 278973 - protein, 9 aa, Homo Sapiens
EPDIYRPLD

SEQ ID NO: 278974 - protein, 9 aa, Homo Sapiens
FQALNRPDD

SEQ ID NO: 278975 - protein, 9 aa, Homo Sapiens
ESLESTRAA

SEQ ID NO: 278976 - protein, 9 aa, Homo Sapiens
TTDEQLVAV

SEQ ID NO: 278977 - protein, 9 aa, Homo Sapiens
DPEARKLIK

SEQ ID NO: 278978 - protein, 9 aa, Homo Sapiens
SLLNLSLTT

SEQ ID NO: 278979 - protein, 9 aa, Homo Sapiens
GLPCDTLAS

SEQ ID NO: 278980 - protein, 9 aa, Homo Sapiens
NGKETSPNH

SEQ ID NO: 278981 - protein, 9 aa, Homo Sapiens
LYEFPEYSQ

SEQ ID NO: 278982 - protein, 9 aa, Homo Sapiens
EAAIRSILY

SEQ ID NO: 278983 - protein, 9 aa, Homo Sapiens
SRDTRRHFC

SEQ ID NO: 278984 - protein, 9 aa, Homo Sapiens
DLTLCKAGL

SEQ ID NO: 278985 - protein, 9 aa, Homo Sapiens
NLKEKYILV

SEQ ID NO: 278986 - protein, 9 aa, Homo Sapiens
YTALLVMLQ

SEQ ID NO: 278987 - protein, 9 aa, Homo Sapiens
TPKKYQVEL

SEQ ID NO: 278988 - protein, 9 aa, Homo Sapiens
KKWNDYLFE

SEQ ID NO: 278989 - protein, 9 aa, Homo Sapiens
RVYVVGKAN

SEQ ID NO: 278990 - protein, 9 aa, Homo Sapiens
PSILSWDPL

SEQ ID NO: 278991 - protein, 9 aa, Homo Sapiens
HNIYLHLAL

SEQ ID NO: 278992 - protein, 9 aa, Homo Sapiens
CVTTVPGKT

SEQ ID NO: 278993 - protein, 9 aa, Homo Sapiens
EMPTDAFGN

SEQ ID NO: 278994 - protein, 9 aa, Homo Sapiens
SWDTVFTLL

SEQ ID NO: 278995 - protein, 9 aa, Homo Sapiens
KKYLMLEES

SEQ ID NO: 278996 - protein, 9 aa, Homo Sapiens
PMDSEEAMI

SEQ ID NO: 278997 - protein, 9 aa, Homo Sapiens
ARFLQGFGD

SEQ ID NO: 278998 - protein, 9 aa, Homo Sapiens
KLTKTCFLD

SEQ ID NO: 278999 - protein, 9 aa, Homo Sapiens
WPLCGLPAA

SEQ ID NO: 279000 - protein, 9 aa, Homo Sapiens
LGADVTAVD

SEQ ID NO: 279001 - protein, 9 aa, Homo Sapiens
CKVCQQGGE

SEQ ID NO: 279002 - protein, 9 aa, Homo Sapiens
QDCYFETHS

SEQ ID NO: 279003 - protein, 9 aa, Homo Sapiens
SLSQRQRLT

SEQ ID NO: 279004 - protein, 9 aa, Homo Sapiens
IRSLCDQNQ

SEQ ID NO: 279005 - protein, 9 aa, Homo Sapiens
TLSHERLLH

SEQ ID NO: 279006 - protein, 9 aa, Homo Sapiens
PDKDKEIKA

SEQ ID NO: 279007 - protein, 9 aa, Homo Sapiens
QEAKLERKQ

SEQ ID NO: 279008 - protein, 9 aa, Homo Sapiens
KSKEMVYSL

SEQ ID NO: 279009 - protein, 9 aa, Homo Sapiens
RQIVKQLKE

SEQ ID NO: 279010 - protein, 9 aa, Homo Sapiens
TFDITADLD

SEQ ID NO: 279011 - protein, 9 aa, Homo Sapiens
EGDLRTMPE

SEQ ID NO: 279012 - protein, 9 aa, Homo Sapiens
SNGVRTEQY

SEQ ID NO: 279013 - protein, 9 aa, Homo Sapiens
ESYGIEHLK

SEQ ID NO: 279014 - protein, 9 aa, Homo Sapiens
QFDLCKHIA

SEQ ID NO: 279015 - protein, 9 aa, Homo Sapiens
FHMSPIKLH

SEQ ID NO: 279016 - protein, 9 aa, Homo Sapiens
PWNWLNFTV

SEQ ID NO: 279017 - protein, 9 aa, Homo Sapiens
PEIYWKLDY

SEQ ID NO: 279018 - protein, 9 aa, Homo Sapiens
VVVKLLNAK

SEQ ID NO: 279019 - protein, 9 aa, Homo Sapiens
KTNKGDGLS

SEQ ID NO: 279020 - protein, 9 aa, Homo Sapiens
LSWCLLYAG

SEQ ID NO: 279021 - protein, 9 aa, Homo Sapiens
KRPDEGMRG

SEQ ID NO: 279022 - protein, 9 aa, Homo Sapiens
EFNLDIDPN

SEQ ID NO: 279023 - protein, 9 aa, Homo Sapiens
EEDRALPDN

SEQ ID NO: 279024 - protein, 9 aa, Homo Sapiens
DNVNKLLVG

SEQ ID NO: 279025 - protein, 9 aa, Homo Sapiens
INKGGLNGV

SEQ ID NO: 279026 - protein, 9 aa, Homo Sapiens
LETNELQQL

SEQ ID NO: 279027 - protein, 9 aa, Homo Sapiens
QVQIAGNQD

SEQ ID NO: 279028 - protein, 9 aa, Homo Sapiens
IKDLRAKLL

SEQ ID NO: 279029 - protein, 9 aa, Homo Sapiens
ASQLETLCP

SEQ ID NO: 279030 - protein, 9 aa, Homo Sapiens
QSGMKRLKV

SEQ ID NO: 279031 - protein, 9 aa, Homo Sapiens
DCTSDTWIL

SEQ ID NO: 279032 - protein, 9 aa, Homo Sapiens
KVEAHDSDI

SEQ ID NO: 279033 - protein, 9 aa, Homo Sapiens
PKPRFHEVP

SEQ ID NO: 279034 - protein, 9 aa, Homo Sapiens
AVVLVVSRE

SEQ ID NO: 279035 - protein, 9 aa, Homo Sapiens
KEGCLKETQ

SEQ ID NO: 279036 - protein, 9 aa, Homo Sapiens
QWLEWGSWG

SEQ ID NO: 279037 - protein, 9 aa, Homo Sapiens
NETLHNITG

SEQ ID NO: 279038 - protein, 9 aa, Homo Sapiens
KGKILAKKI

SEQ ID NO: 279039 - protein, 9 aa, Homo Sapiens
IIYAITSAI

SEQ ID NO: 279040 - protein, 9 aa, Homo Sapiens
TQSTTVSDI

SEQ ID NO: 279041 - protein, 9 aa, Homo Sapiens
RIAHGTEKL

SEQ ID NO: 279042 - protein, 9 aa, Homo Sapiens
HSQLARHRI

SEQ ID NO: 279043 - protein, 9 aa, Homo Sapiens
ASKVQASLY

SEQ ID NO: 279044 - protein, 9 aa, Homo Sapiens
ATVNELAPV

SEQ ID NO: 279045 - protein, 9 aa, Homo Sapiens
PSTRKAQAG

SEQ ID NO: 279046 - protein, 9 aa, Homo Sapiens
LEDLFNLCS

SEQ ID NO: 279047 - protein, 9 aa, Homo Sapiens
DKGRFTTLV

SEQ ID NO: 279048 - protein, 9 aa, Homo Sapiens
EHKNRMSQM

SEQ ID NO: 279049 - protein, 9 aa, Homo Sapiens
VNYLILEGP

SEQ ID NO: 279050 - protein, 9 aa, Homo Sapiens
SSPSAEHSQ

SEQ ID NO: 279051 - protein, 9 aa, Homo Sapiens
RLRKLGLHY

SEQ ID NO: 279052 - protein, 9 aa, Homo Sapiens
AVRSRLECH

SEQ ID NO: 279053 - protein, 9 aa, Homo Sapiens
DVDDLLSKP

SEQ ID NO: 279054 - protein, 9 aa, Homo Sapiens
RYPGIQLTA

SEQ ID NO: 279055 - protein, 9 aa, Homo Sapiens
SEWELNPVK

SEQ ID NO: 279056 - protein, 9 aa, Homo Sapiens
ELSNEEINL

SEQ ID NO: 279057 - protein, 9 aa, Homo Sapiens
RKDKDILRL

SEQ ID NO: 279058 - protein, 9 aa, Homo Sapiens
QKKTQVTHN

SEQ ID NO: 279059 - protein, 9 aa, Homo Sapiens
CEVQVTNGG

SEQ ID NO: 279060 - protein, 9 aa, Homo Sapiens
DAELDNDIK

SEQ ID NO: 279061 - protein, 9 aa, Homo Sapiens
HKTTASAAT

SEQ ID NO: 279062 - protein, 9 aa, Homo Sapiens
HQDADIEDL

SEQ ID NO: 279063 - protein, 9 aa, Homo Sapiens
IRNLTKDNS

SEQ ID NO: 279064 - protein, 9 aa, Homo Sapiens
SQYLIVHCK

SEQ ID NO: 279065 - protein, 9 aa, Homo Sapiens
SNELHDKQK

SEQ ID NO: 279066 - protein, 9 aa, Homo Sapiens
RIIREVCRV

SEQ ID NO: 279067 - protein, 9 aa, Homo Sapiens
RTCGGGVKT

SEQ ID NO: 279068 - protein, 9 aa, Homo Sapiens
EGEIEDDDE

SEQ ID NO: 279069 - protein, 9 aa, Homo Sapiens
HWAKIIKNR

SEQ ID NO: 279070 - protein, 9 aa, Homo Sapiens
LEKYLYTFM

SEQ ID NO: 279071 - protein, 9 aa, Homo Sapiens
AVATARCPR

SEQ ID NO: 279072 - protein, 9 aa, Homo Sapiens
EEIRQRSQE

SEQ ID NO: 279073 - protein, 9 aa, Homo Sapiens
VTSSLILKT

SEQ ID NO: 279074 - protein, 9 aa, Homo Sapiens
FLKKHKKTS

SEQ ID NO: 279075 - protein, 9 aa, Homo Sapiens
RNPKTDNMV

SEQ ID NO: 279076 - protein, 9 aa, Homo Sapiens
DMDTESHLF

SEQ ID NO: 279077 - protein, 9 aa, Homo Sapiens
VLNTTILCV

SEQ ID NO: 279078 - protein, 9 aa, Homo Sapiens
HMGLAGGNI

SEQ ID NO: 279079 - protein, 9 aa, Homo Sapiens
HVLTRNRSK

SEQ ID NO: 279080 - protein, 9 aa, Homo Sapiens
TIIGLSIHI

SEQ ID NO: 279081 - protein, 9 aa, Homo Sapiens
FIPFNPLAK

SEQ ID NO: 279082 - protein, 9 aa, Homo Sapiens
QRAVSDALM

SEQ ID NO: 279083 - protein, 9 aa, Homo Sapiens
AIVGVSVFA

SEQ ID NO: 279084 - protein, 9 aa, Homo Sapiens
IQEVIVGEG

SEQ ID NO: 279085 - protein, 9 aa, Homo Sapiens
EGTQKQKDI

SEQ ID NO: 279086 - protein, 9 aa, Homo Sapiens
AAKILWDYA

SEQ ID NO: 279087 - protein, 9 aa, Homo Sapiens
ENRAQKKRL

SEQ ID NO: 279088 - protein, 9 aa, Homo Sapiens
TFGFYEVFK

SEQ ID NO: 279089 - protein, 9 aa, Homo Sapiens
VSRNRNCKQ

SEQ ID NO: 279090 - protein, 9 aa, Homo Sapiens
KPYVCMERG

SEQ ID NO: 279091 - protein, 9 aa, Homo Sapiens
LGLSDRPQM

SEQ ID NO: 279092 - protein, 9 aa, Homo Sapiens
CEKDIAMRE

SEQ ID NO: 279093 - protein, 9 aa, Homo Sapiens
LSQRLKNGG

SEQ ID NO: 279094 - protein, 9 aa, Homo Sapiens
GNVAQTAIR

SEQ ID NO: 279095 - protein, 9 aa, Homo Sapiens
AVVVTDGEI

SEQ ID NO: 279096 - protein, 9 aa, Homo Sapiens
DSRLHSAIN

SEQ ID NO: 279097 - protein, 9 aa, Homo Sapiens
LRVTAAKFI

SEQ ID NO: 279098 - protein, 9 aa, Homo Sapiens
EDSAEEEAT

SEQ ID NO: 279099 - protein, 9 aa, Homo Sapiens
TGTGTLPNI

SEQ ID NO: 279100 - protein, 9 aa, Homo Sapiens
QITFMERVK

SEQ ID NO: 279101 - protein, 9 aa, Homo Sapiens
NDYSFEDLC

SEQ ID NO: 279102 - protein, 9 aa, Homo Sapiens
ANGGLTCTI

SEQ ID NO: 279103 - protein, 9 aa, Homo Sapiens
PPNTVFKDK

SEQ ID NO: 279104 - protein, 9 aa, Homo Sapiens
TQLSEFTPD

SEQ ID NO: 279105 - protein, 9 aa, Homo Sapiens
RYVHSIIIA

SEQ ID NO: 279106 - protein, 9 aa, Homo Sapiens
IIIGERTGF

SEQ ID NO: 279107 - protein, 9 aa, Homo Sapiens
NAALNLGCI

SEQ ID NO: 279108 - protein, 9 aa, Homo Sapiens
NMAQTNPTP

SEQ ID NO: 279109 - protein, 9 aa, Homo Sapiens
RELFEPWNT

SEQ ID NO: 279110 - protein, 9 aa, Homo Sapiens
MKENPMTNC

SEQ ID NO: 279111 - protein, 9 aa, Homo Sapiens
PMFVVTGRK

SEQ ID NO: 279112 - protein, 9 aa, Homo Sapiens
NILIQVEEV

SEQ ID NO: 279113 - protein, 9 aa, Homo Sapiens
IYAYMNFIT

SEQ ID NO: 279114 - protein, 9 aa, Homo Sapiens
RECLVKCMD

SEQ ID NO: 279115 - protein, 9 aa, Homo Sapiens
IQALHWYCP

SEQ ID NO: 279116 - protein, 9 aa, Homo Sapiens
GVEKKSVAR

SEQ ID NO: 279117 - protein, 9 aa, Homo Sapiens
KERDKEAGA

SEQ ID NO: 279118 - protein, 9 aa, Homo Sapiens
LFKSSRHDP

SEQ ID NO: 279119 - protein, 9 aa, Homo Sapiens
SNERKLNQA

SEQ ID NO: 279120 - protein, 9 aa, Homo Sapiens
KRRSFSKQA

SEQ ID NO: 279121 - protein, 9 aa, Homo Sapiens
DSAEEEATL

SEQ ID NO: 279122 - protein, 9 aa, Homo Sapiens
REMVAQLLD

SEQ ID NO: 279123 - protein, 9 aa, Homo Sapiens
VLGPGLPWL

SEQ ID NO: 279124 - protein, 9 aa, Homo Sapiens
CGKAFIWPA

SEQ ID NO: 279125 - protein, 9 aa, Homo Sapiens
VANKDTEKE

SEQ ID NO: 279126 - protein, 9 aa, Homo Sapiens
PSPVSLSAP

SEQ ID NO: 279127 - protein, 9 aa, Homo Sapiens
DKSNVYRDH

SEQ ID NO: 279128 - protein, 9 aa, Homo Sapiens
AFGNIVFTG

SEQ ID NO: 279129 - protein, 9 aa, Homo Sapiens
WDIITSIVN

SEQ ID NO: 279130 - protein, 9 aa, Homo Sapiens
LSLSTPPLP

SEQ ID NO: 279131 - protein, 9 aa, Homo Sapiens
GVQISDRII

SEQ ID NO: 279132 - protein, 9 aa, Homo Sapiens
HEGEVNCAR

SEQ ID NO: 279133 - protein, 9 aa, Homo Sapiens
DHCAVTEEH

SEQ ID NO: 279134 - protein, 9 aa, Homo Sapiens
LSPLNAACC

SEQ ID NO: 279135 - protein, 9 aa, Homo Sapiens
MIVIKYKYY

SEQ ID NO: 279136 - protein, 9 aa, Homo Sapiens
DTLSRRLDD

SEQ ID NO: 279137 - protein, 9 aa, Homo Sapiens
KSCSGTTRS

SEQ ID NO: 279138 - protein, 9 aa, Homo Sapiens
KKGKPEKFK

SEQ ID NO: 279139 - protein, 9 aa, Homo Sapiens
AFLFSFQNH

SEQ ID NO: 279140 - protein, 9 aa, Homo Sapiens
QSPPQQVSF

SEQ ID NO: 279141 - protein, 9 aa, Homo Sapiens
GSVPSHSKS

SEQ ID NO: 279142 - protein, 9 aa, Homo Sapiens
RSSSYHSPG

SEQ ID NO: 279143 - protein, 9 aa, Homo Sapiens
KEHGPFFLY

SEQ ID NO: 279144 - protein, 9 aa, Homo Sapiens
SSFAHTASS

SEQ ID NO: 279145 - protein, 9 aa, Homo Sapiens
KAKMKQPKG

SEQ ID NO: 279146 - protein, 9 aa, Homo Sapiens
PQEAVQGYV

SEQ ID NO: 279147 - protein, 9 aa, Homo Sapiens
CSLRLLAGA

SEQ ID NO: 279148 - protein, 9 aa, Homo Sapiens
EEHCAKNRS

SEQ ID NO: 279149 - protein, 9 aa, Homo Sapiens
VTNSVGNTT

SEQ ID NO: 279150 - protein, 9 aa, Homo Sapiens
GNDYLYEII

SEQ ID NO: 279151 - protein, 9 aa, Homo Sapiens
AEVVIGLLG

SEQ ID NO: 279152 - protein, 9 aa, Homo Sapiens
KVGIRKRIN

SEQ ID NO: 279153 - protein, 9 aa, Homo Sapiens
PEQPTAGNV

SEQ ID NO: 279154 - protein, 9 aa, Homo Sapiens
CYSSTLTFQ

SEQ ID NO: 279155 - protein, 9 aa, Homo Sapiens
SHLECRVNR

SEQ ID NO: 279156 - protein, 9 aa, Homo Sapiens
GLIPVNYVK

SEQ ID NO: 279157 - protein, 9 aa, Homo Sapiens
LGTVIYLPL

SEQ ID NO: 279158 - protein, 9 aa, Homo Sapiens
SAIFGGEQF

SEQ ID NO: 279159 - protein, 9 aa, Homo Sapiens
ISLQNLILG

SEQ ID NO: 279160 - protein, 9 aa, Homo Sapiens
TNGAYTSLL

SEQ ID NO: 279161 - protein, 9 aa, Homo Sapiens
EFSCDGKAL

SEQ ID NO: 279162 - protein, 9 aa, Homo Sapiens
KPTVTIIVD

SEQ ID NO: 279163 - protein, 9 aa, Homo Sapiens
WTGDVEELE

SEQ ID NO: 279164 - protein, 9 aa, Homo Sapiens
HSNLTEMLL

SEQ ID NO: 279165 - protein, 9 aa, Homo Sapiens
REDGSADGD

SEQ ID NO: 279166 - protein, 9 aa, Homo Sapiens
KNRHWHWSS

SEQ ID NO: 279167 - protein, 9 aa, Homo Sapiens
GRHNGYIHV

SEQ ID NO: 279168 - protein, 9 aa, Homo Sapiens
KDTFVEIGA

SEQ ID NO: 279169 - protein, 9 aa, Homo Sapiens
IYTGEETKF

SEQ ID NO: 279170 - protein, 9 aa, Homo Sapiens
FVRELVNLI

SEQ ID NO: 279171 - protein, 9 aa, Homo Sapiens
KGALTKVVG

SEQ ID NO: 279172 - protein, 9 aa, Homo Sapiens
QCHCHQHMV

SEQ ID NO: 279173 - protein, 9 aa, Homo Sapiens
MTLLHATLD

SEQ ID NO: 279174 - protein, 9 aa, Homo Sapiens
STSPPKQAK

SEQ ID NO: 279175 - protein, 9 aa, Homo Sapiens
CMVTNSVGN

SEQ ID NO: 279176 - protein, 9 aa, Homo Sapiens
SIGVSTVLL

SEQ ID NO: 279177 - protein, 9 aa, Homo Sapiens
PKEDSDIRC

SEQ ID NO: 279178 - protein, 9 aa, Homo Sapiens
KLNMDSTER

SEQ ID NO: 279179 - protein, 9 aa, Homo Sapiens
KSSLAETLY

SEQ ID NO: 279180 - protein, 9 aa, Homo Sapiens
ITSAILASV

SEQ ID NO: 279181 - protein, 9 aa, Homo Sapiens
KANFCTGIE

SEQ ID NO: 279182 - protein, 9 aa, Homo Sapiens
KKLRSGSYF

SEQ ID NO: 279183 - protein, 9 aa, Homo Sapiens
KHKEKKSND

SEQ ID NO: 279184 - protein, 9 aa, Homo Sapiens
VESFQELNS

SEQ ID NO: 279185 - protein, 9 aa, Homo Sapiens
GPLWRVLSF

SEQ ID NO: 279186 - protein, 9 aa, Homo Sapiens
DIFLNMEHE

SEQ ID NO: 279187 - protein, 9 aa, Homo Sapiens
VLGLHFIGP

SEQ ID NO: 279188 - protein, 9 aa, Homo Sapiens
LEKDKWMLD

SEQ ID NO: 279189 - protein, 9 aa, Homo Sapiens
TLHQSGSFI

SEQ ID NO: 279190 - protein, 9 aa, Homo Sapiens
VALEINGLE

SEQ ID NO: 279191 - protein, 9 aa, Homo Sapiens
DPLKIDEVY

SEQ ID NO: 279192 - protein, 9 aa, Homo Sapiens
KLDPYDYEI

SEQ ID NO: 279193 - protein, 9 aa, Homo Sapiens
IKNLKIHYT

SEQ ID NO: 279194 - protein, 9 aa, Homo Sapiens
REMGMYSIT

SEQ ID NO: 279195 - protein, 9 aa, Homo Sapiens
CHHTQLLFC

SEQ ID NO: 279196 - protein, 9 aa, Homo Sapiens
NCDDEVSEL

SEQ ID NO: 279197 - protein, 9 aa, Homo Sapiens
TPLVESYSF

SEQ ID NO: 279198 - protein, 9 aa, Homo Sapiens
ANIFEIQTM

SEQ ID NO: 279199 - protein, 9 aa, Homo Sapiens
ESGLELKKD

SEQ ID NO: 279200 - protein, 9 aa, Homo Sapiens
TEKDKIEKE

SEQ ID NO: 279201 - protein, 9 aa, Homo Sapiens
RDGGIPNID

SEQ ID NO: 279202 - protein, 9 aa, Homo Sapiens
VGFLDHLAT

SEQ ID NO: 279203 - protein, 9 aa, Homo Sapiens
ATLIYVDKD

SEQ ID NO: 279204 - protein, 9 aa, Homo Sapiens
QSNDNMLVK

SEQ ID NO: 279205 - protein, 9 aa, Homo Sapiens
LKIASKPPP

SEQ ID NO: 279206 - protein, 9 aa, Homo Sapiens
GNISKACLL

SEQ ID NO: 279207 - protein, 9 aa, Homo Sapiens
EKILFEQHI

SEQ ID NO: 279208 - protein, 9 aa, Homo Sapiens
CQISCTLAR

SEQ ID NO: 279209 - protein, 9 aa, Homo Sapiens
CSSNSFKLY

SEQ ID NO: 279210 - protein, 9 aa, Homo Sapiens
PAHANTGSK

SEQ ID NO: 279211 - protein, 9 aa, Homo Sapiens
PISLDRLVV

SEQ ID NO: 279212 - protein, 9 aa, Homo Sapiens
VRRYFSDEE

SEQ ID NO: 279213 - protein, 9 aa, Homo Sapiens
FVCEAIQRF

SEQ ID NO: 279214 - protein, 9 aa, Homo Sapiens
LRKDKDILR

SEQ ID NO: 279215 - protein, 9 aa, Homo Sapiens
QGDSAHELE

SEQ ID NO: 279216 - protein, 9 aa, Homo Sapiens
DNLNDTRKM

SEQ ID NO: 279217 - protein, 9 aa, Homo Sapiens
ERTEQLLET

SEQ ID NO: 279218 - protein, 9 aa, Homo Sapiens
TARPNQTLS

SEQ ID NO: 279219 - protein, 9 aa, Homo Sapiens
NLLEMTCYQ

SEQ ID NO: 279220 - protein, 9 aa, Homo Sapiens
VRRVAVRPK

SEQ ID NO: 279221 - protein, 9 aa, Homo Sapiens
QHKKNILEK

SEQ ID NO: 279222 - protein, 9 aa, Homo Sapiens
TQETAKEKE

SEQ ID NO: 279223 - protein, 9 aa, Homo Sapiens
PNSTPAKNI

SEQ ID NO: 279224 - protein, 9 aa, Homo Sapiens
EVKDTLRET

SEQ ID NO: 279225 - protein, 9 aa, Homo Sapiens
DQITFMERV

SEQ ID NO: 279226 - protein, 9 aa, Homo Sapiens
SLSYDADVT

SEQ ID NO: 279227 - protein, 9 aa, Homo Sapiens
YNFPKQVFA

SEQ ID NO: 279228 - protein, 9 aa, Homo Sapiens
SSSTLQSVS

SEQ ID NO: 279229 - protein, 9 aa, Homo Sapiens
NGNYFIQGP

SEQ ID NO: 279230 - protein, 9 aa, Homo Sapiens
HVLGDGTDK

SEQ ID NO: 279231 - protein, 9 aa, Homo Sapiens
QSSSNNNGN

SEQ ID NO: 279232 - protein, 9 aa, Homo Sapiens
IMEMWLLIL

SEQ ID NO: 279233 - protein, 9 aa, Homo Sapiens
QKCIEQSDL

SEQ ID NO: 279234 - protein, 9 aa, Homo Sapiens
NARSSLSTS

SEQ ID NO: 279235 - protein, 9 aa, Homo Sapiens
TILHHIYGK

SEQ ID NO: 279236 - protein, 9 aa, Homo Sapiens
VDLVMCPYE

SEQ ID NO: 279237 - protein, 9 aa, Homo Sapiens
AAPPSYFRR

SEQ ID NO: 279238 - protein, 9 aa, Homo Sapiens
AEGCMQDMV

SEQ ID NO: 279239 - protein, 9 aa, Homo Sapiens
QSLEPIGTR

SEQ ID NO: 279240 - protein, 9 aa, Homo Sapiens
AHKGYFCEA

SEQ ID NO: 279241 - protein, 9 aa, Homo Sapiens
EHDPVTECI

SEQ ID NO: 279242 - protein, 9 aa, Homo Sapiens
PLPNTALIS

SEQ ID NO: 279243 - protein, 9 aa, Homo Sapiens
STKEIFRRS

SEQ ID NO: 279244 - protein, 9 aa, Homo Sapiens
NATRDGVIQ

SEQ ID NO: 279245 - protein, 9 aa, Homo Sapiens
FINSSGQFV

SEQ ID NO: 279246 - protein, 9 aa, Homo Sapiens
LLFMEREDK

SEQ ID NO: 279247 - protein, 9 aa, Homo Sapiens
NDTKSIYYL

SEQ ID NO: 279248 - protein, 9 aa, Homo Sapiens
IQFSRKTYK

SEQ ID NO: 279249 - protein, 9 aa, Homo Sapiens
SRLYVGRDK

SEQ ID NO: 279250 - protein, 9 aa, Homo Sapiens
KEGKRSIRG

SEQ ID NO: 279251 - protein, 9 aa, Homo Sapiens
PDVLKSQFQ

SEQ ID NO: 279252 - protein, 9 aa, Homo Sapiens
AYVMVIQAI

SEQ ID NO: 279253 - protein, 9 aa, Homo Sapiens
LKTIALYGF

SEQ ID NO: 279254 - protein, 9 aa, Homo Sapiens
LLILREIVI

SEQ ID NO: 279255 - protein, 9 aa, Homo Sapiens
APFWTIKLK

SEQ ID NO: 279256 - protein, 9 aa, Homo Sapiens
TKVNFYDWK

SEQ ID NO: 279257 - protein, 9 aa, Homo Sapiens
RFLSVTRVV

SEQ ID NO: 279258 - protein, 9 aa, Homo Sapiens
ANEAVKSEQ

SEQ ID NO: 279259 - protein, 9 aa, Homo Sapiens
GNLVETNSF

SEQ ID NO: 279260 - protein, 9 aa, Homo Sapiens
LSADSSYLQ

SEQ ID NO: 279261 - protein, 9 aa, Homo Sapiens
GVQETATGP

SEQ ID NO: 279262 - protein, 9 aa, Homo Sapiens
CLQVYRWVR

SEQ ID NO: 279263 - protein, 9 aa, Homo Sapiens
ELPEFFRDC

SEQ ID NO: 279264 - protein, 9 aa, Homo Sapiens
IIEVVLKVI

SEQ ID NO: 279265 - protein, 9 aa, Homo Sapiens
SGGGNIKYI

SEQ ID NO: 279266 - protein, 9 aa, Homo Sapiens
GTKKELSML

SEQ ID NO: 279267 - protein, 9 aa, Homo Sapiens
QTCDWKVDC

SEQ ID NO: 279268 - protein, 9 aa, Homo Sapiens
DNLTQHKKI

SEQ ID NO: 279269 - protein, 9 aa, Homo Sapiens
TKKKSDQAL

SEQ ID NO: 279270 - protein, 9 aa, Homo Sapiens
CEKGCQSHP

SEQ ID NO: 279271 - protein, 9 aa, Homo Sapiens
YASLGKITD

SEQ ID NO: 279272 - protein, 9 aa, Homo Sapiens
LVIPMIGPT

SEQ ID NO: 279273 - protein, 9 aa, Homo Sapiens
CIEQNLTST

SEQ ID NO: 279274 - protein, 9 aa, Homo Sapiens
KPEVEFTTL

SEQ ID NO: 279275 - protein, 9 aa, Homo Sapiens
TPEFELSDM

SEQ ID NO: 279276 - protein, 9 aa, Homo Sapiens
LTNIKIAVI

SEQ ID NO: 279277 - protein, 9 aa, Homo Sapiens
LNNERTILT

SEQ ID NO: 279278 - protein, 9 aa, Homo Sapiens
LHIIPYLSF

SEQ ID NO: 279279 - protein, 9 aa, Homo Sapiens
KKRKKAAIF

SEQ ID NO: 279280 - protein, 9 aa, Homo Sapiens
DKTGALTQN

SEQ ID NO: 279281 - protein, 9 aa, Homo Sapiens
KITDFGMRK

SEQ ID NO: 279282 - protein, 9 aa, Homo Sapiens
TEGEEDAQQ

SEQ ID NO: 279283 - protein, 9 aa, Homo Sapiens
LDPSQNNLY

SEQ ID NO: 279284 - protein, 9 aa, Homo Sapiens
RGNYQKAVK

SEQ ID NO: 279285 - protein, 9 aa, Homo Sapiens
VTADIYLAK

SEQ ID NO: 279286 - protein, 9 aa, Homo Sapiens
GPMPFRTGT

SEQ ID NO: 279287 - protein, 9 aa, Homo Sapiens
FNRLSYLTK

SEQ ID NO: 279288 - protein, 9 aa, Homo Sapiens
LIQASGLGR

SEQ ID NO: 279289 - protein, 9 aa, Homo Sapiens
TQPVYLANT

SEQ ID NO: 279290 - protein, 9 aa, Homo Sapiens
YKHKMTQRM

SEQ ID NO: 279291 - protein, 9 aa, Homo Sapiens
EGARLLASN

SEQ ID NO: 279292 - protein, 9 aa, Homo Sapiens
RVLGKLLRD

SEQ ID NO: 279293 - protein, 9 aa, Homo Sapiens
MLLEICWSG

SEQ ID NO: 279294 - protein, 9 aa, Homo Sapiens
LISREKISL

SEQ ID NO: 279295 - protein, 9 aa, Homo Sapiens
YSTLFCSRS

SEQ ID NO: 279296 - protein, 9 aa, Homo Sapiens
PRSWQRHGT

SEQ ID NO: 279297 - protein, 9 aa, Homo Sapiens
SAENEEDKN

SEQ ID NO: 279298 - protein, 9 aa, Homo Sapiens
GHPAPPATL

SEQ ID NO: 279299 - protein, 9 aa, Homo Sapiens
NANFNTQKK

SEQ ID NO: 279300 - protein, 9 aa, Homo Sapiens
IQAFSLLQS

SEQ ID NO: 279301 - protein, 9 aa, Homo Sapiens
KGALKKLIN

SEQ ID NO: 279302 - protein, 9 aa, Homo Sapiens
DVFGMGKEV

SEQ ID NO: 279303 - protein, 9 aa, Homo Sapiens
DAIKKKCQG

SEQ ID NO: 279304 - protein, 9 aa, Homo Sapiens
TCEPSPSAN

SEQ ID NO: 279305 - protein, 9 aa, Homo Sapiens
SNKWHRFRF

SEQ ID NO: 279306 - protein, 9 aa, Homo Sapiens
PLNHKAYRD

SEQ ID NO: 279307 - protein, 9 aa, Homo Sapiens
VVVNTKTEY

SEQ ID NO: 279308 - protein, 9 aa, Homo Sapiens
NCSTMDPVQ

SEQ ID NO: 279309 - protein, 9 aa, Homo Sapiens
KPDKAEREP

SEQ ID NO: 279310 - protein, 9 aa, Homo Sapiens
PQSSCLGDE

SEQ ID NO: 279311 - protein, 9 aa, Homo Sapiens
PEEPLNGEF

SEQ ID NO: 279312 - protein, 9 aa, Homo Sapiens
GACPYLWSA

SEQ ID NO: 279313 - protein, 9 aa, Homo Sapiens
DNFIDKHIA

SEQ ID NO: 279314 - protein, 9 aa, Homo Sapiens
KPRIIQNQN

SEQ ID NO: 279315 - protein, 9 aa, Homo Sapiens
IKQMEQKLI

SEQ ID NO: 279316 - protein, 9 aa, Homo Sapiens
HLECRVNRN

SEQ ID NO: 279317 - protein, 9 aa, Homo Sapiens
EQLEQVKRF

SEQ ID NO: 279318 - protein, 9 aa, Homo Sapiens
GNLSPIDAE

SEQ ID NO: 279319 - protein, 9 aa, Homo Sapiens
LLKFQEIKM

SEQ ID NO: 279320 - protein, 9 aa, Homo Sapiens
LKALEGLIA

SEQ ID NO: 279321 - protein, 9 aa, Homo Sapiens
VLQQLVVAK

SEQ ID NO: 279322 - protein, 9 aa, Homo Sapiens
PESSTCSTV

SEQ ID NO: 279323 - protein, 9 aa, Homo Sapiens
IQKTFTCTR

SEQ ID NO: 279324 - protein, 9 aa, Homo Sapiens
VKIYKHEGV

SEQ ID NO: 279325 - protein, 9 aa, Homo Sapiens
AKNVFEKKY

SEQ ID NO: 279326 - protein, 9 aa, Homo Sapiens
YIILKTLLD

SEQ ID NO: 279327 - protein, 9 aa, Homo Sapiens
VRLSRRLNT

SEQ ID NO: 279328 - protein, 9 aa, Homo Sapiens
SYISSSARR

SEQ ID NO: 279329 - protein, 9 aa, Homo Sapiens
RMESLFNTE

SEQ ID NO: 279330 - protein, 9 aa, Homo Sapiens
YRAAEKNFH

SEQ ID NO: 279331 - protein, 9 aa, Homo Sapiens
NTSFRRNVG

SEQ ID NO: 279332 - protein, 9 aa, Homo Sapiens
KMLRASSLF

SEQ ID NO: 279333 - protein, 9 aa, Homo Sapiens
NSNLVARRR

SEQ ID NO: 279334 - protein, 9 aa, Homo Sapiens
LKVFEYYAR

SEQ ID NO: 279335 - protein, 9 aa, Homo Sapiens
EIRVKSLKS

SEQ ID NO: 279336 - protein, 9 aa, Homo Sapiens
LFDKTCTEH

SEQ ID NO: 279337 - protein, 9 aa, Homo Sapiens
GRCFYVDIT

SEQ ID NO: 279338 - protein, 9 aa, Homo Sapiens
HGEKTKTPR

SEQ ID NO: 279339 - protein, 9 aa, Homo Sapiens
FHDQFDYKD

SEQ ID NO: 279340 - protein, 9 aa, Homo Sapiens
YSSSRTLFF

SEQ ID NO: 279341 - protein, 9 aa, Homo Sapiens
LTNPLYAIF

SEQ ID NO: 279342 - protein, 9 aa, Homo Sapiens
INKIIYVFY

SEQ ID NO: 279343 - protein, 9 aa, Homo Sapiens
DRPLRSVFV

SEQ ID NO: 279344 - protein, 9 aa, Homo Sapiens
VLSILLGGY

SEQ ID NO: 279345 - protein, 9 aa, Homo Sapiens
ELFMEIRKF

SEQ ID NO: 279346 - protein, 9 aa, Homo Sapiens
ARWEQPQLF

SEQ ID NO: 279347 - protein, 9 aa, Homo Sapiens
DKLIFANIQ

SEQ ID NO: 279348 - protein, 9 aa, Homo Sapiens
IGDHHWKCA

SEQ ID NO: 279349 - protein, 9 aa, Homo Sapiens
VPTTSGNGS

SEQ ID NO: 279350 - protein, 9 aa, Homo Sapiens
NIHKSVQIA

SEQ ID NO: 279351 - protein, 9 aa, Homo Sapiens
NREYTRNAS

SEQ ID NO: 279352 - protein, 9 aa, Homo Sapiens
EEQRMRSRS

SEQ ID NO: 279353 - protein, 9 aa, Homo Sapiens
NSPLYLPFV

SEQ ID NO: 279354 - protein, 9 aa, Homo Sapiens
LWFRSYRKE

SEQ ID NO: 279355 - protein, 9 aa, Homo Sapiens
LTSNMFCAD

SEQ ID NO: 279356 - protein, 9 aa, Homo Sapiens
KEREEQNEQ

SEQ ID NO: 279357 - protein, 9 aa, Homo Sapiens
FMKANSGYK

SEQ ID NO: 279358 - protein, 9 aa, Homo Sapiens
YCSTCAESM

SEQ ID NO: 279359 - protein, 9 aa, Homo Sapiens
HDIDLIIYT

SEQ ID NO: 279360 - protein, 9 aa, Homo Sapiens
CSDVVGWQS

SEQ ID NO: 279361 - protein, 9 aa, Homo Sapiens
EGLSLAQKY

SEQ ID NO: 279362 - protein, 9 aa, Homo Sapiens
KRVPQLIFK

SEQ ID NO: 279363 - protein, 9 aa, Homo Sapiens
GLDRSLRPE

SEQ ID NO: 279364 - protein, 9 aa, Homo Sapiens
LILFRWCDI

SEQ ID NO: 279365 - protein, 9 aa, Homo Sapiens
INNRQKIQK

SEQ ID NO: 279366 - protein, 9 aa, Homo Sapiens
AGGLMVFPP

SEQ ID NO: 279367 - protein, 9 aa, Homo Sapiens
IKKHQDPPD

SEQ ID NO: 279368 - protein, 9 aa, Homo Sapiens
PECIPSSGL

SEQ ID NO: 279369 - protein, 9 aa, Homo Sapiens
VDIFPKKRG

SEQ ID NO: 279370 - protein, 9 aa, Homo Sapiens
KSARDCHES

SEQ ID NO: 279371 - protein, 9 aa, Homo Sapiens
ADGYHVPFC

SEQ ID NO: 279372 - protein, 9 aa, Homo Sapiens
LYSVASFSL

SEQ ID NO: 279373 - protein, 9 aa, Homo Sapiens
GIPGMNMGP

SEQ ID NO: 279374 - protein, 9 aa, Homo Sapiens
PQQHGLRPV

SEQ ID NO: 279375 - protein, 9 aa, Homo Sapiens
KDKRHLRKA

SEQ ID NO: 279376 - protein, 9 aa, Homo Sapiens
KPIHIMWSQ

SEQ ID NO: 279377 - protein, 9 aa, Homo Sapiens
AELAVEPNT

SEQ ID NO: 279378 - protein, 9 aa, Homo Sapiens
NDQNSKLLQ

SEQ ID NO: 279379 - protein, 9 aa, Homo Sapiens
GEDYDKVKL

SEQ ID NO: 279380 - protein, 9 aa, Homo Sapiens
PDELTLART

SEQ ID NO: 279381 - protein, 9 aa, Homo Sapiens
NFDKNRNYI

SEQ ID NO: 279382 - protein, 9 aa, Homo Sapiens
EVCDLPEEL

SEQ ID NO: 279383 - protein, 9 aa, Homo Sapiens
SVPTEFLPR

SEQ ID NO: 279384 - protein, 9 aa, Homo Sapiens
VGHGLWTWR

SEQ ID NO: 279385 - protein, 9 aa, Homo Sapiens
VWMGPIFPI

SEQ ID NO: 279386 - protein, 9 aa, Homo Sapiens
QLTVDRISI

SEQ ID NO: 279387 - protein, 9 aa, Homo Sapiens
ACTDLEQGP

SEQ ID NO: 279388 - protein, 9 aa, Homo Sapiens
DRTSLQSAV

SEQ ID NO: 279389 - protein, 9 aa, Homo Sapiens
ECLQTVECY

SEQ ID NO: 279390 - protein, 9 aa, Homo Sapiens
ESGNILHLS

SEQ ID NO: 279391 - protein, 9 aa, Homo Sapiens
ASKANFCTG

SEQ ID NO: 279392 - protein, 9 aa, Homo Sapiens
KMGGDLNEI

SEQ ID NO: 279393 - protein, 9 aa, Homo Sapiens
HTQLKDQRI

SEQ ID NO: 279394 - protein, 9 aa, Homo Sapiens
VAPIMSPGN

SEQ ID NO: 279395 - protein, 9 aa, Homo Sapiens
NKPPGTPPP

SEQ ID NO: 279396 - protein, 9 aa, Homo Sapiens
NGGSPCTTV

SEQ ID NO: 279397 - protein, 9 aa, Homo Sapiens
KPPNDTNGV

SEQ ID NO: 279398 - protein, 9 aa, Homo Sapiens
NVLRKHKDL

SEQ ID NO: 279399 - protein, 9 aa, Homo Sapiens
NIPKSSSTQ

SEQ ID NO: 279400 - protein, 9 aa, Homo Sapiens
TNPSQPCSK

SEQ ID NO: 279401 - protein, 9 aa, Homo Sapiens
SDETFGPNI

SEQ ID NO: 279402 - protein, 9 aa, Homo Sapiens
DNYPMVEKI

SEQ ID NO: 279403 - protein, 9 aa, Homo Sapiens
CFLLLSAHS

SEQ ID NO: 279404 - protein, 9 aa, Homo Sapiens
GYPEIDKKI

SEQ ID NO: 279405 - protein, 9 aa, Homo Sapiens
DFIETSNQS

SEQ ID NO: 279406 - protein, 9 aa, Homo Sapiens
EPLRQEQAK

SEQ ID NO: 279407 - protein, 9 aa, Homo Sapiens
DFSHAIQKE

SEQ ID NO: 279408 - protein, 9 aa, Homo Sapiens
CMSVNGLFA

SEQ ID NO: 279409 - protein, 9 aa, Homo Sapiens
CLRVAICKQ

SEQ ID NO: 279410 - protein, 9 aa, Homo Sapiens
GLFTLEVYD

SEQ ID NO: 279411 - protein, 9 aa, Homo Sapiens
TNKKIIFVP

SEQ ID NO: 279412 - protein, 9 aa, Homo Sapiens
QSSTPTFII

SEQ ID NO: 279413 - protein, 9 aa, Homo Sapiens
HNNFENVAR

SEQ ID NO: 279414 - protein, 9 aa, Homo Sapiens
GRPDISLDE

SEQ ID NO: 279415 - protein, 9 aa, Homo Sapiens
HSLGPEFGG

SEQ ID NO: 279416 - protein, 9 aa, Homo Sapiens
ALKSLNKTS

SEQ ID NO: 279417 - protein, 9 aa, Homo Sapiens
AKHLMKHGY

SEQ ID NO: 279418 - protein, 9 aa, Homo Sapiens
KVIGISNFN

SEQ ID NO: 279419 - protein, 9 aa, Homo Sapiens
SERVKRILN

SEQ ID NO: 279420 - protein, 9 aa, Homo Sapiens
IDWQWQYDA

SEQ ID NO: 279421 - protein, 9 aa, Homo Sapiens
ISFSLSINL

SEQ ID NO: 279422 - protein, 9 aa, Homo Sapiens
TYNKLTKTC

SEQ ID NO: 279423 - protein, 9 aa, Homo Sapiens
YSSRCLVIE

SEQ ID NO: 279424 - protein, 9 aa, Homo Sapiens
TNWQAVVKG

SEQ ID NO: 279425 - protein, 9 aa, Homo Sapiens
AQAVHVQSG

SEQ ID NO: 279426 - protein, 9 aa, Homo Sapiens
INITGEKFD

SEQ ID NO: 279427 - protein, 9 aa, Homo Sapiens
EEEIMRNQL

SEQ ID NO: 279428 - protein, 9 aa, Homo Sapiens
AAAKILWDY

SEQ ID NO: 279429 - protein, 9 aa, Homo Sapiens
LFFRKLTYG

SEQ ID NO: 279430 - protein, 9 aa, Homo Sapiens
ILLVNRDSI

SEQ ID NO: 279431 - protein, 9 aa, Homo Sapiens
KITEDGRSC

SEQ ID NO: 279432 - protein, 9 aa, Homo Sapiens
GLNNGHIKI

SEQ ID NO: 279433 - protein, 9 aa, Homo Sapiens
IARRQLPAS

SEQ ID NO: 279434 - protein, 9 aa, Homo Sapiens
GVKGNYLRT

SEQ ID NO: 279435 - protein, 9 aa, Homo Sapiens
FRSASTFKI

SEQ ID NO: 279436 - protein, 9 aa, Homo Sapiens
YVNAFQRHQ

SEQ ID NO: 279437 - protein, 9 aa, Homo Sapiens
AHTLAMDYR

SEQ ID NO: 279438 - protein, 9 aa, Homo Sapiens
GFRILPQVI

SEQ ID NO: 279439 - protein, 9 aa, Homo Sapiens
EQNKNHCSA

SEQ ID NO: 279440 - protein, 9 aa, Homo Sapiens
KMYKLSPET

SEQ ID NO: 279441 - protein, 9 aa, Homo Sapiens
QLYSFQDCY

SEQ ID NO: 279442 - protein, 9 aa, Homo Sapiens
IDQRFKKVS

SEQ ID NO: 279443 - protein, 9 aa, Homo Sapiens
PFRDGSSGQ

SEQ ID NO: 279444 - protein, 9 aa, Homo Sapiens
QALHYAVKQ

SEQ ID NO: 279445 - protein, 9 aa, Homo Sapiens
AYIAGLLGL

SEQ ID NO: 279446 - protein, 9 aa, Homo Sapiens
FPAELYPHI

SEQ ID NO: 279447 - protein, 9 aa, Homo Sapiens
KGQGTFYGE

SEQ ID NO: 279448 - protein, 9 aa, Homo Sapiens
VKSYSMPIS

SEQ ID NO: 279449 - protein, 9 aa, Homo Sapiens
IREQEKKEI

SEQ ID NO: 279450 - protein, 9 aa, Homo Sapiens
FLKKESRET

SEQ ID NO: 279451 - protein, 9 aa, Homo Sapiens
DDEKFMLLI

SEQ ID NO: 279452 - protein, 9 aa, Homo Sapiens
TVIFIVTQC

SEQ ID NO: 279453 - protein, 9 aa, Homo Sapiens
PPQKVRIHL

SEQ ID NO: 279454 - protein, 9 aa, Homo Sapiens
HKIKDSDNV

SEQ ID NO: 279455 - protein, 9 aa, Homo Sapiens
LALSTTFEH

SEQ ID NO: 279456 - protein, 9 aa, Homo Sapiens
AGVLCATGI

SEQ ID NO: 279457 - protein, 9 aa, Homo Sapiens
RRGRPDISL

SEQ ID NO: 279458 - protein, 9 aa, Homo Sapiens
MKERPVIPS

SEQ ID NO: 279459 - protein, 9 aa, Homo Sapiens
HPIIDARRA

SEQ ID NO: 279460 - protein, 9 aa, Homo Sapiens
SCAKAKMKQ

SEQ ID NO: 279461 - protein, 9 aa, Homo Sapiens
TERECGNYL

SEQ ID NO: 279462 - protein, 9 aa, Homo Sapiens
EMYDKYIDL

SEQ ID NO: 279463 - protein, 9 aa, Homo Sapiens
FLDFGFSNA

SEQ ID NO: 279464 - protein, 9 aa, Homo Sapiens
SVWEEIDRG

SEQ ID NO: 279465 - protein, 9 aa, Homo Sapiens
YVSQTRIAA

SEQ ID NO: 279466 - protein, 9 aa, Homo Sapiens
VVYVATLLM

SEQ ID NO: 279467 - protein, 9 aa, Homo Sapiens
RQSSVTSVG

SEQ ID NO: 279468 - protein, 9 aa, Homo Sapiens
SGMKRLKVQ

SEQ ID NO: 279469 - protein, 9 aa, Homo Sapiens
HQHAVDTIR

SEQ ID NO: 279470 - protein, 9 aa, Homo Sapiens
CTYFIRTTE

SEQ ID NO: 279471 - protein, 9 aa, Homo Sapiens
DQRTTTKWV

SEQ ID NO: 279472 - protein, 9 aa, Homo Sapiens
FEDRILLSR

SEQ ID NO: 279473 - protein, 9 aa, Homo Sapiens
KLFTLTAYA

SEQ ID NO: 279474 - protein, 9 aa, Homo Sapiens
GISSEGVFK

SEQ ID NO: 279475 - protein, 9 aa, Homo Sapiens
GHFSVVLQK

SEQ ID NO: 279476 - protein, 9 aa, Homo Sapiens
NLARNLGKG

SEQ ID NO: 279477 - protein, 9 aa, Homo Sapiens
EKSRQYLKR

SEQ ID NO: 279478 - protein, 9 aa, Homo Sapiens
ITIVSCNPS

SEQ ID NO: 279479 - protein, 9 aa, Homo Sapiens
ALKKLINAA

SEQ ID NO: 279480 - protein, 9 aa, Homo Sapiens
FMISHSLGP

SEQ ID NO: 279481 - protein, 9 aa, Homo Sapiens
ISTLQKAIQ

SEQ ID NO: 279482 - protein, 9 aa, Homo Sapiens
CHSCTCGNS

SEQ ID NO: 279483 - protein, 9 aa, Homo Sapiens
KLKKWNDYL

SEQ ID NO: 279484 - protein, 9 aa, Homo Sapiens
LGLASVINN

SEQ ID NO: 279485 - protein, 9 aa, Homo Sapiens
QVGSEGTSQ

SEQ ID NO: 279486 - protein, 9 aa, Homo Sapiens
KHLLTSGSD

SEQ ID NO: 279487 - protein, 9 aa, Homo Sapiens
YGSVANHQV

SEQ ID NO: 279488 - protein, 9 aa, Homo Sapiens
KGGMEVCNL

SEQ ID NO: 279489 - protein, 9 aa, Homo Sapiens
ESSLLTSES

SEQ ID NO: 279490 - protein, 9 aa, Homo Sapiens
QNIHTGVKS

SEQ ID NO: 279491 - protein, 9 aa, Homo Sapiens
GFLLSKFRL

SEQ ID NO: 279492 - protein, 9 aa, Homo Sapiens
TIHIVYDIP

SEQ ID NO: 279493 - protein, 9 aa, Homo Sapiens
QELRQKSKL

SEQ ID NO: 279494 - protein, 9 aa, Homo Sapiens
HSSETAIMN

SEQ ID NO: 279495 - protein, 9 aa, Homo Sapiens
FMKHGGLHA

SEQ ID NO: 279496 - protein, 9 aa, Homo Sapiens
MMHRINKLF

SEQ ID NO: 279497 - protein, 9 aa, Homo Sapiens
DKTNELWNK

SEQ ID NO: 279498 - protein, 9 aa, Homo Sapiens
QNPVSNTSD

SEQ ID NO: 279499 - protein, 9 aa, Homo Sapiens
SKNGANCWY

SEQ ID NO: 279500 - protein, 9 aa, Homo Sapiens
LAERERLEC

SEQ ID NO: 279501 - protein, 9 aa, Homo Sapiens
KLNLERHRR

SEQ ID NO: 279502 - protein, 9 aa, Homo Sapiens
CLPHLKNKD

SEQ ID NO: 279503 - protein, 9 aa, Homo Sapiens
DPGVHYEYH

SEQ ID NO: 279504 - protein, 9 aa, Homo Sapiens
WFGVTSVLL

SEQ ID NO: 279505 - protein, 9 aa, Homo Sapiens
PNIQYKSGK

SEQ ID NO: 279506 - protein, 9 aa, Homo Sapiens
KPQFLQRFY

SEQ ID NO: 279507 - protein, 9 aa, Homo Sapiens
ISVKQDITF

SEQ ID NO: 279508 - protein, 9 aa, Homo Sapiens
RNHHCAHFT

SEQ ID NO: 279509 - protein, 9 aa, Homo Sapiens
RRIELTVLD

SEQ ID NO: 279510 - protein, 9 aa, Homo Sapiens
KRGSDSIIV

SEQ ID NO: 279511 - protein, 9 aa, Homo Sapiens
FVKDVPQIP

SEQ ID NO: 279512 - protein, 9 aa, Homo Sapiens
LRAESVTNT

SEQ ID NO: 279513 - protein, 9 aa, Homo Sapiens
DPFLTGSSK

SEQ ID NO: 279514 - protein, 9 aa, Homo Sapiens
KLEITPQKN

SEQ ID NO: 279515 - protein, 9 aa, Homo Sapiens
THQFNTEDQ

SEQ ID NO: 279516 - protein, 9 aa, Homo Sapiens
LKLSREKKA

SEQ ID NO: 279517 - protein, 9 aa, Homo Sapiens
TDNCSFNTY

SEQ ID NO: 279518 - protein, 9 aa, Homo Sapiens
GQCDTIFTF

SEQ ID NO: 279519 - protein, 9 aa, Homo Sapiens
EKKRNIPSL

SEQ ID NO: 279520 - protein, 9 aa, Homo Sapiens
LLGSYMFRH

SEQ ID NO: 279521 - protein, 9 aa, Homo Sapiens
LPKAASTAT

SEQ ID NO: 279522 - protein, 9 aa, Homo Sapiens
SYIAWYCRW

SEQ ID NO: 279523 - protein, 9 aa, Homo Sapiens
LSLNTSLID

SEQ ID NO: 279524 - protein, 9 aa, Homo Sapiens
ATAWLVGEH

SEQ ID NO: 279525 - protein, 9 aa, Homo Sapiens
LVNEALKTG

SEQ ID NO: 279526 - protein, 9 aa, Homo Sapiens
YYHSRVKLA

SEQ ID NO: 279527 - protein, 9 aa, Homo Sapiens
YGPQTPSEC

SEQ ID NO: 279528 - protein, 9 aa, Homo Sapiens
LPVNISDAC

SEQ ID NO: 279529 - protein, 9 aa, Homo Sapiens
TWTAGSWKF

SEQ ID NO: 279530 - protein, 9 aa, Homo Sapiens
FQCLCHVGQ

SEQ ID NO: 279531 - protein, 9 aa, Homo Sapiens
TCQEKFKQL

SEQ ID NO: 279532 - protein, 9 aa, Homo Sapiens
KGRWITNPS

SEQ ID NO: 279533 - protein, 9 aa, Homo Sapiens
SNANKQAVH

SEQ ID NO: 279534 - protein, 9 aa, Homo Sapiens
WKVMPLVYM

SEQ ID NO: 279535 - protein, 9 aa, Homo Sapiens
PPEGAPLAG

SEQ ID NO: 279536 - protein, 9 aa, Homo Sapiens
GSQAPIVSP

SEQ ID NO: 279537 - protein, 9 aa, Homo Sapiens
NHAWKLHNK

SEQ ID NO: 279538 - protein, 9 aa, Homo Sapiens
VQAVVMTRD

SEQ ID NO: 279539 - protein, 9 aa, Homo Sapiens
ISQDTQTLK

SEQ ID NO: 279540 - protein, 9 aa, Homo Sapiens
NTSVENGWI

SEQ ID NO: 279541 - protein, 9 aa, Homo Sapiens
NQDILIPTH

SEQ ID NO: 279542 - protein, 9 aa, Homo Sapiens
SREFSVPER

SEQ ID NO: 279543 - protein, 9 aa, Homo Sapiens
LSLIFVSSY

SEQ ID NO: 279544 - protein, 9 aa, Homo Sapiens
LQGCNKKAV

SEQ ID NO: 279545 - protein, 9 aa, Homo Sapiens
EDYRKRKYL

SEQ ID NO: 279546 - protein, 9 aa, Homo Sapiens
CSSYSLDQD

SEQ ID NO: 279547 - protein, 9 aa, Homo Sapiens
SKCMMKDFS

SEQ ID NO: 279548 - protein, 9 aa, Homo Sapiens
CKIYARAAN

SEQ ID NO: 279549 - protein, 9 aa, Homo Sapiens
KQKGVKVSP

SEQ ID NO: 279550 - protein, 9 aa, Homo Sapiens
PGSNKPERR

SEQ ID NO: 279551 - protein, 9 aa, Homo Sapiens
LDNYPMVEK

SEQ ID NO: 279552 - protein, 9 aa, Homo Sapiens
KKLLVSITV

SEQ ID NO: 279553 - protein, 9 aa, Homo Sapiens
LPGIDKTKE

SEQ ID NO: 279554 - protein, 9 aa, Homo Sapiens
EALSQMDII

SEQ ID NO: 279555 - protein, 9 aa, Homo Sapiens
TSLQSAVSN

SEQ ID NO: 279556 - protein, 9 aa, Homo Sapiens
ESLTDPPLN

SEQ ID NO: 279557 - protein, 9 aa, Homo Sapiens
NIPYFCLPT

SEQ ID NO: 279558 - protein, 9 aa, Homo Sapiens
LLDVKPRLE

SEQ ID NO: 279559 - protein, 9 aa, Homo Sapiens
APGDPSGFA

SEQ ID NO: 279560 - protein, 9 aa, Homo Sapiens
ENTNNLLCL

SEQ ID NO: 279561 - protein, 9 aa, Homo Sapiens
MALNVAPVG

SEQ ID NO: 279562 - protein, 9 aa, Homo Sapiens
HIQHVFCDF

SEQ ID NO: 279563 - protein, 9 aa, Homo Sapiens
SQPRYSWEW

SEQ ID NO: 279564 - protein, 9 aa, Homo Sapiens
VYKPPALRK

SEQ ID NO: 279565 - protein, 9 aa, Homo Sapiens
DTMPKKGGR

SEQ ID NO: 279566 - protein, 9 aa, Homo Sapiens
DFRRNLILS

SEQ ID NO: 279567 - protein, 9 aa, Homo Sapiens
AFKFFQDHN

SEQ ID NO: 279568 - protein, 9 aa, Homo Sapiens
SMIILSALV

SEQ ID NO: 279569 - protein, 9 aa, Homo Sapiens
HSGTRGWQA

SEQ ID NO: 279570 - protein, 9 aa, Homo Sapiens
PDSLDRIKE

SEQ ID NO: 279571 - protein, 9 aa, Homo Sapiens
PGALWTVAQ

SEQ ID NO: 279572 - protein, 9 aa, Homo Sapiens
QATMKYIKG

SEQ ID NO: 279573 - protein, 9 aa, Homo Sapiens
YYFDRGDVA

SEQ ID NO: 279574 - protein, 9 aa, Homo Sapiens
AANIILPSN

SEQ ID NO: 279575 - protein, 9 aa, Homo Sapiens
VKLVVFVYF

SEQ ID NO: 279576 - protein, 9 aa, Homo Sapiens
GKIISSDSP

SEQ ID NO: 279577 - protein, 9 aa, Homo Sapiens
GKDVLNCNL

SEQ ID NO: 279578 - protein, 9 aa, Homo Sapiens
EFHIYIAKG

SEQ ID NO: 279579 - protein, 9 aa, Homo Sapiens
LSSDLRHVR

SEQ ID NO: 279580 - protein, 9 aa, Homo Sapiens
IKILFARGE

SEQ ID NO: 279581 - protein, 9 aa, Homo Sapiens
ANHRDNEHG

SEQ ID NO: 279582 - protein, 9 aa, Homo Sapiens
TEFTIIRVS

SEQ ID NO: 279583 - protein, 9 aa, Homo Sapiens
TTELDKIFL

SEQ ID NO: 279584 - protein, 9 aa, Homo Sapiens
RLELKTLGA

SEQ ID NO: 279585 - protein, 9 aa, Homo Sapiens
CPSGCRMKW

SEQ ID NO: 279586 - protein, 9 aa, Homo Sapiens
LLLGQICSL

SEQ ID NO: 279587 - protein, 9 aa, Homo Sapiens
CAGVLCATG

SEQ ID NO: 279588 - protein, 9 aa, Homo Sapiens
SSGSTGGGG

SEQ ID NO: 279589 - protein, 9 aa, Homo Sapiens
GCNLEFNLD

SEQ ID NO: 279590 - protein, 9 aa, Homo Sapiens
IDAEDNYTC

SEQ ID NO: 279591 - protein, 9 aa, Homo Sapiens
RERAFIQWL

SEQ ID NO: 279592 - protein, 9 aa, Homo Sapiens
KSDNEEYVI

SEQ ID NO: 279593 - protein, 9 aa, Homo Sapiens
RSQMLAMHI

SEQ ID NO: 279594 - protein, 9 aa, Homo Sapiens
STPSPTEVQ

SEQ ID NO: 279595 - protein, 9 aa, Homo Sapiens
AMLVANSLS

SEQ ID NO: 279596 - protein, 9 aa, Homo Sapiens
VLRHLFSIA

SEQ ID NO: 279597 - protein, 9 aa, Homo Sapiens
ASSEPQMHL

SEQ ID NO: 279598 - protein, 9 aa, Homo Sapiens
ITSGKMSLI

SEQ ID NO: 279599 - protein, 9 aa, Homo Sapiens
EKLIKKCKP

SEQ ID NO: 279600 - protein, 9 aa, Homo Sapiens
ASENANKGR

SEQ ID NO: 279601 - protein, 9 aa, Homo Sapiens
HPGVAMTDL

SEQ ID NO: 279602 - protein, 9 aa, Homo Sapiens
SEEQRKMCK

SEQ ID NO: 279603 - protein, 9 aa, Homo Sapiens
RPPTLAITY

SEQ ID NO: 279604 - protein, 9 aa, Homo Sapiens
QVAHITEFT

SEQ ID NO: 279605 - protein, 9 aa, Homo Sapiens
GLQYILNKH

SEQ ID NO: 279606 - protein, 9 aa, Homo Sapiens
LIPSEDFIT

SEQ ID NO: 279607 - protein, 9 aa, Homo Sapiens
GPGIKLYPF

SEQ ID NO: 279608 - protein, 9 aa, Homo Sapiens
IDMLSVEQV

SEQ ID NO: 279609 - protein, 9 aa, Homo Sapiens
VHIQALQTV

SEQ ID NO: 279610 - protein, 9 aa, Homo Sapiens
DSVFQLIEE

SEQ ID NO: 279611 - protein, 9 aa, Homo Sapiens
TCISLQNLI

SEQ ID NO: 279612 - protein, 9 aa, Homo Sapiens
FKDKLSSIP

SEQ ID NO: 279613 - protein, 9 aa, Homo Sapiens
VPCFIDTDT

SEQ ID NO: 279614 - protein, 9 aa, Homo Sapiens
FEEDVHKLR

SEQ ID NO: 279615 - protein, 9 aa, Homo Sapiens
TFQNNSKVV

SEQ ID NO: 279616 - protein, 9 aa, Homo Sapiens
NTGIGLGSI

SEQ ID NO: 279617 - protein, 9 aa, Homo Sapiens
YIKNLNYLS

SEQ ID NO: 279618 - protein, 9 aa, Homo Sapiens
RAGLCDHCA

SEQ ID NO: 279619 - protein, 9 aa, Homo Sapiens
YPPDPVQLS

SEQ ID NO: 279620 - protein, 9 aa, Homo Sapiens
HQALLFKAL

SEQ ID NO: 279621 - protein, 9 aa, Homo Sapiens
DNEDYNDVL

SEQ ID NO: 279622 - protein, 9 aa, Homo Sapiens
VFSDADLRP

SEQ ID NO: 279623 - protein, 9 aa, Homo Sapiens
DHPLAALVS

SEQ ID NO: 279624 - protein, 9 aa, Homo Sapiens
IVDDFSERE

SEQ ID NO: 279625 - protein, 9 aa, Homo Sapiens
AMAFVYFEQ

SEQ ID NO: 279626 - protein, 9 aa, Homo Sapiens
RNAIFPNGA

SEQ ID NO: 279627 - protein, 9 aa, Homo Sapiens
TEDLQPSDL

SEQ ID NO: 279628 - protein, 9 aa, Homo Sapiens
RYLFFALWI

SEQ ID NO: 279629 - protein, 9 aa, Homo Sapiens
REGAFLAAQ

SEQ ID NO: 279630 - protein, 9 aa, Homo Sapiens
LYHCFLPAE

SEQ ID NO: 279631 - protein, 9 aa, Homo Sapiens
MLSVALSQR

SEQ ID NO: 279632 - protein, 9 aa, Homo Sapiens
KTWALLDRK

SEQ ID NO: 279633 - protein, 9 aa, Homo Sapiens
VPVPGPRSH

SEQ ID NO: 279634 - protein, 9 aa, Homo Sapiens
QLKQPSVFV

SEQ ID NO: 279635 - protein, 9 aa, Homo Sapiens
HSDIDSGGG

SEQ ID NO: 279636 - protein, 9 aa, Homo Sapiens
ASSVSKEVD

SEQ ID NO: 279637 - protein, 9 aa, Homo Sapiens
TTSDKFGCS

SEQ ID NO: 279638 - protein, 9 aa, Homo Sapiens
GKGDGRYVS

SEQ ID NO: 279639 - protein, 9 aa, Homo Sapiens
GKVKLCEKM

SEQ ID NO: 279640 - protein, 9 aa, Homo Sapiens
AVATKVQRH

SEQ ID NO: 279641 - protein, 9 aa, Homo Sapiens
NSAGNVKLG

SEQ ID NO: 279642 - protein, 9 aa, Homo Sapiens
DINKKLYSA

SEQ ID NO: 279643 - protein, 9 aa, Homo Sapiens
FSGLWRALE

SEQ ID NO: 279644 - protein, 9 aa, Homo Sapiens
DESVRELSP

SEQ ID NO: 279645 - protein, 9 aa, Homo Sapiens
LSARPSSIE

SEQ ID NO: 279646 - protein, 9 aa, Homo Sapiens
LNLEKYEKF

SEQ ID NO: 279647 - protein, 9 aa, Homo Sapiens
GILGKCLGP

SEQ ID NO: 279648 - protein, 9 aa, Homo Sapiens
GRKRRRVKG

SEQ ID NO: 279649 - protein, 9 aa, Homo Sapiens
FLCEVPTMI

SEQ ID NO: 279650 - protein, 9 aa, Homo Sapiens
ENEYDNSPT

SEQ ID NO: 279651 - protein, 9 aa, Homo Sapiens
GDLIFQYGH

SEQ ID NO: 279652 - protein, 9 aa, Homo Sapiens
NCPGDNAIF

SEQ ID NO: 279653 - protein, 9 aa, Homo Sapiens
SLEGGLAWI

SEQ ID NO: 279654 - protein, 9 aa, Homo Sapiens
CAVLYSNHT

SEQ ID NO: 279655 - protein, 9 aa, Homo Sapiens
DGNKTCQDI

SEQ ID NO: 279656 - protein, 9 aa, Homo Sapiens
GFSSKMKAV

SEQ ID NO: 279657 - protein, 9 aa, Homo Sapiens
FDVKIERDA

SEQ ID NO: 279658 - protein, 9 aa, Homo Sapiens
EVPELASEI

SEQ ID NO: 279659 - protein, 9 aa, Homo Sapiens
VLSPTGGES

SEQ ID NO: 279660 - protein, 9 aa, Homo Sapiens
IWISLPFCC

SEQ ID NO: 279661 - protein, 9 aa, Homo Sapiens
KKFAEAFET

SEQ ID NO: 279662 - protein, 9 aa, Homo Sapiens
NNWNREKVE

SEQ ID NO: 279663 - protein, 9 aa, Homo Sapiens
SWFTSTQEN

SEQ ID NO: 279664 - protein, 9 aa, Homo Sapiens
QIFRKLWCQ

SEQ ID NO: 279665 - protein, 9 aa, Homo Sapiens
YLQIVRFLD

SEQ ID NO: 279666 - protein, 9 aa, Homo Sapiens
IKQGYTCKD

SEQ ID NO: 279667 - protein, 9 aa, Homo Sapiens
HENVDKVAF

SEQ ID NO: 279668 - protein, 9 aa, Homo Sapiens
TLGWIPIDN

SEQ ID NO: 279669 - protein, 9 aa, Homo Sapiens
VGSFTIKSD

SEQ ID NO: 279670 - protein, 9 aa, Homo Sapiens
YPKEDSDIR

SEQ ID NO: 279671 - protein, 9 aa, Homo Sapiens
ICIVATILR

SEQ ID NO: 279672 - protein, 9 aa, Homo Sapiens
VEAVNKGFP

SEQ ID NO: 279673 - protein, 9 aa, Homo Sapiens
VDYSEQYQI

SEQ ID NO: 279674 - protein, 9 aa, Homo Sapiens
LECTECGKS

SEQ ID NO: 279675 - protein, 9 aa, Homo Sapiens
GPSSEKLEE

SEQ ID NO: 279676 - protein, 9 aa, Homo Sapiens
FTHLQGVAA

SEQ ID NO: 279677 - protein, 9 aa, Homo Sapiens
SLYIIRAKA

SEQ ID NO: 279678 - protein, 9 aa, Homo Sapiens
LVTGSYDGD

SEQ ID NO: 279679 - protein, 9 aa, Homo Sapiens
NNCNNSLTE

SEQ ID NO: 279680 - protein, 9 aa, Homo Sapiens
PPHEEELLS

SEQ ID NO: 279681 - protein, 9 aa, Homo Sapiens
SVRFYLVVY

SEQ ID NO: 279682 - protein, 9 aa, Homo Sapiens
KREEALAAF

SEQ ID NO: 279683 - protein, 9 aa, Homo Sapiens
ARSVSEKIS

SEQ ID NO: 279684 - protein, 9 aa, Homo Sapiens
MTMRSFKRR

SEQ ID NO: 279685 - protein, 9 aa, Homo Sapiens
VPRRLRLAF

SEQ ID NO: 279686 - protein, 9 aa, Homo Sapiens
TGTLTQNRI

SEQ ID NO: 279687 - protein, 9 aa, Homo Sapiens
SPTEGLGSW

SEQ ID NO: 279688 - protein, 9 aa, Homo Sapiens
RCKMKNNFI

SEQ ID NO: 279689 - protein, 9 aa, Homo Sapiens
KLNGVLEAN

SEQ ID NO: 279690 - protein, 9 aa, Homo Sapiens
TNWRHLLLF

SEQ ID NO: 279691 - protein, 9 aa, Homo Sapiens
RLEKWLTQV

SEQ ID NO: 279692 - protein, 9 aa, Homo Sapiens
SEEELIHKK

SEQ ID NO: 279693 - protein, 9 aa, Homo Sapiens
IFQTDTRIY

SEQ ID NO: 279694 - protein, 9 aa, Homo Sapiens
DKVKLLEIS

SEQ ID NO: 279695 - protein, 9 aa, Homo Sapiens
EMNYQGRYE

SEQ ID NO: 279696 - protein, 9 aa, Homo Sapiens
KEFMLMNAQ

SEQ ID NO: 279697 - protein, 9 aa, Homo Sapiens
EVAEKVQKL

SEQ ID NO: 279698 - protein, 9 aa, Homo Sapiens
NLIPEYEIA

SEQ ID NO: 279699 - protein, 9 aa, Homo Sapiens
LQLYSVASF

SEQ ID NO: 279700 - protein, 9 aa, Homo Sapiens
CCPDFRGGD

SEQ ID NO: 279701 - protein, 9 aa, Homo Sapiens
RDTRRHFCP

SEQ ID NO: 279702 - protein, 9 aa, Homo Sapiens
EASIWKLFF

SEQ ID NO: 279703 - protein, 9 aa, Homo Sapiens
RPQSFFAAA

SEQ ID NO: 279704 - protein, 9 aa, Homo Sapiens
ELKLNSHPI

SEQ ID NO: 279705 - protein, 9 aa, Homo Sapiens
LQAVMKDIL

SEQ ID NO: 279706 - protein, 9 aa, Homo Sapiens
WKSLDLYLS

SEQ ID NO: 279707 - protein, 9 aa, Homo Sapiens
ACEQILASL

SEQ ID NO: 279708 - protein, 9 aa, Homo Sapiens
QSIIHQDET

SEQ ID NO: 279709 - protein, 9 aa, Homo Sapiens
NPGCPNYED

SEQ ID NO: 279710 - protein, 9 aa, Homo Sapiens
IIHTERETL

SEQ ID NO: 279711 - protein, 9 aa, Homo Sapiens
LDLRRNIQV

SEQ ID NO: 279712 - protein, 9 aa, Homo Sapiens
STNNVNNSF

SEQ ID NO: 279713 - protein, 9 aa, Homo Sapiens
PTSSQANPG

SEQ ID NO: 279714 - protein, 9 aa, Homo Sapiens
GLAGGNIYL

SEQ ID NO: 279715 - protein, 9 aa, Homo Sapiens
AAFEAWKAM

SEQ ID NO: 279716 - protein, 9 aa, Homo Sapiens
GTNINRSIL

SEQ ID NO: 279717 - protein, 9 aa, Homo Sapiens
ESLQKQLGQ

SEQ ID NO: 279718 - protein, 9 aa, Homo Sapiens
GTTEAQNIR

SEQ ID NO: 279719 - protein, 9 aa, Homo Sapiens
FLKDTFVEI

SEQ ID NO: 279720 - protein, 9 aa, Homo Sapiens
VPAMDPNAA

SEQ ID NO: 279721 - protein, 9 aa, Homo Sapiens
EILLTSGLG

SEQ ID NO: 279722 - protein, 9 aa, Homo Sapiens
EEEKYATVQ

SEQ ID NO: 279723 - protein, 9 aa, Homo Sapiens
FDAHTLAMD

SEQ ID NO: 279724 - protein, 9 aa, Homo Sapiens
TSYRPHLLL

SEQ ID NO: 279725 - protein, 9 aa, Homo Sapiens
RDVTVLQNT

SEQ ID NO: 279726 - protein, 9 aa, Homo Sapiens
KRLEWKNKE

SEQ ID NO: 279727 - protein, 9 aa, Homo Sapiens
RIYWSMYQR

SEQ ID NO: 279728 - protein, 9 aa, Homo Sapiens
QNQEYSLLI

SEQ ID NO: 279729 - protein, 9 aa, Homo Sapiens
LLFVVLFAI

SEQ ID NO: 279730 - protein, 9 aa, Homo Sapiens
PLNAACCQD

SEQ ID NO: 279731 - protein, 9 aa, Homo Sapiens
LDTFNRQGI

SEQ ID NO: 279732 - protein, 9 aa, Homo Sapiens
QYKPVPDKE

SEQ ID NO: 279733 - protein, 9 aa, Homo Sapiens
HLRFTYGTQ

SEQ ID NO: 279734 - protein, 9 aa, Homo Sapiens
EDPEVADLL

SEQ ID NO: 279735 - protein, 9 aa, Homo Sapiens
TRWARQRQP

SEQ ID NO: 279736 - protein, 9 aa, Homo Sapiens
LIQVTIMLY

SEQ ID NO: 279737 - protein, 9 aa, Homo Sapiens
LYKFQAGNR

SEQ ID NO: 279738 - protein, 9 aa, Homo Sapiens
PRCIKEEDT

SEQ ID NO: 279739 - protein, 9 aa, Homo Sapiens
VTIQKTFTC

SEQ ID NO: 279740 - protein, 9 aa, Homo Sapiens
DIAKELGLP

SEQ ID NO: 279741 - protein, 9 aa, Homo Sapiens
KPTAFQKFY

SEQ ID NO: 279742 - protein, 9 aa, Homo Sapiens
PITGRRSTF

SEQ ID NO: 279743 - protein, 9 aa, Homo Sapiens
ALPASAPTV

SEQ ID NO: 279744 - protein, 9 aa, Homo Sapiens
SDTYNNELS

SEQ ID NO: 279745 - protein, 9 aa, Homo Sapiens
RGRDIRSPA

SEQ ID NO: 279746 - protein, 9 aa, Homo Sapiens
SESRSTYND

SEQ ID NO: 279747 - protein, 9 aa, Homo Sapiens
LTTVYVDLK

SEQ ID NO: 279748 - protein, 9 aa, Homo Sapiens
ELLTYSSDK

SEQ ID NO: 279749 - protein, 9 aa, Homo Sapiens
LISSLMIVL

SEQ ID NO: 279750 - protein, 9 aa, Homo Sapiens
SEVLESEKV

SEQ ID NO: 279751 - protein, 9 aa, Homo Sapiens
GLVNKWTTF

SEQ ID NO: 279752 - protein, 9 aa, Homo Sapiens
KMFQEDHGS

SEQ ID NO: 279753 - protein, 9 aa, Homo Sapiens
VAKNEFMQI

SEQ ID NO: 279754 - protein, 9 aa, Homo Sapiens
HSISPFMIK

SEQ ID NO: 279755 - protein, 9 aa, Homo Sapiens
DFCKIVGRS

SEQ ID NO: 279756 - protein, 9 aa, Homo Sapiens
REHVDTFEA

SEQ ID NO: 279757 - protein, 9 aa, Homo Sapiens
DTLQNQKET

SEQ ID NO: 279758 - protein, 9 aa, Homo Sapiens
APTIRGIYI

SEQ ID NO: 279759 - protein, 9 aa, Homo Sapiens
LKSLNKTSG

SEQ ID NO: 279760 - protein, 9 aa, Homo Sapiens
IALLFLMDV

SEQ ID NO: 279761 - protein, 9 aa, Homo Sapiens
ILRFFFHLG

SEQ ID NO: 279762 - protein, 9 aa, Homo Sapiens
AEHLYDMNR

SEQ ID NO: 279763 - protein, 9 aa, Homo Sapiens
SLASSESMR

SEQ ID NO: 279764 - protein, 9 aa, Homo Sapiens
SKFGTVSQE

SEQ ID NO: 279765 - protein, 9 aa, Homo Sapiens
SSFVPSAWR

SEQ ID NO: 279766 - protein, 9 aa, Homo Sapiens
VSLKRNHNN

SEQ ID NO: 279767 - protein, 9 aa, Homo Sapiens
DGTIQIQGY

SEQ ID NO: 279768 - protein, 9 aa, Homo Sapiens
KYVELVTVA

SEQ ID NO: 279769 - protein, 9 aa, Homo Sapiens
AVHDPDKKK

SEQ ID NO: 279770 - protein, 9 aa, Homo Sapiens
LTYYPSERK

SEQ ID NO: 279771 - protein, 9 aa, Homo Sapiens
KSNIKQNSV

SEQ ID NO: 279772 - protein, 9 aa, Homo Sapiens
KVLMLAYAV

SEQ ID NO: 279773 - protein, 9 aa, Homo Sapiens
QSFAPHGPQ

SEQ ID NO: 279774 - protein, 9 aa, Homo Sapiens
LCRTIKKQR

SEQ ID NO: 279775 - protein, 9 aa, Homo Sapiens
YAPTSSRAF

SEQ ID NO: 279776 - protein, 9 aa, Homo Sapiens
QRSLEPLLS

SEQ ID NO: 279777 - protein, 9 aa, Homo Sapiens
SETGHSPPP

SEQ ID NO: 279778 - protein, 9 aa, Homo Sapiens
IRKNKDKCD

SEQ ID NO: 279779 - protein, 9 aa, Homo Sapiens
NNLPCANVR

SEQ ID NO: 279780 - protein, 9 aa, Homo Sapiens
DKSDQNAMS

SEQ ID NO: 279781 - protein, 9 aa, Homo Sapiens
DSIIEDYAN

SEQ ID NO: 279782 - protein, 9 aa, Homo Sapiens
KWHSVMYKS

SEQ ID NO: 279783 - protein, 9 aa, Homo Sapiens
IITGLLECE

SEQ ID NO: 279784 - protein, 9 aa, Homo Sapiens
FVTFSLLFN

SEQ ID NO: 279785 - protein, 9 aa, Homo Sapiens
LLQWHEKTL

SEQ ID NO: 279786 - protein, 9 aa, Homo Sapiens
LGTFFISWG

SEQ ID NO: 279787 - protein, 9 aa, Homo Sapiens
RRLDDLSLS

SEQ ID NO: 279788 - protein, 9 aa, Homo Sapiens
DPTVDVWNS

SEQ ID NO: 279789 - protein, 9 aa, Homo Sapiens
MKSIVNLDY

SEQ ID NO: 279790 - protein, 9 aa, Homo Sapiens
VTVYLFCAD

SEQ ID NO: 279791 - protein, 9 aa, Homo Sapiens
DMYTPLSAT

SEQ ID NO: 279792 - protein, 9 aa, Homo Sapiens
DTSNEPSVR

SEQ ID NO: 279793 - protein, 9 aa, Homo Sapiens
CLEWPEYFM

SEQ ID NO: 279794 - protein, 9 aa, Homo Sapiens
STALILAAH

SEQ ID NO: 279795 - protein, 9 aa, Homo Sapiens
LKFSDAETD

SEQ ID NO: 279796 - protein, 9 aa, Homo Sapiens
DTQDAEARV

SEQ ID NO: 279797 - protein, 9 aa, Homo Sapiens
YVIEPLERG

SEQ ID NO: 279798 - protein, 9 aa, Homo Sapiens
GKKPYQCDK

SEQ ID NO: 279799 - protein, 9 aa, Homo Sapiens
NQIFSKNER

SEQ ID NO: 279800 - protein, 9 aa, Homo Sapiens
SSVTEFILK

SEQ ID NO: 279801 - protein, 9 aa, Homo Sapiens
YALLFISST

SEQ ID NO: 279802 - protein, 9 aa, Homo Sapiens
EMVAQLLDD

SEQ ID NO: 279803 - protein, 9 aa, Homo Sapiens
KKEQELKKR

SEQ ID NO: 279804 - protein, 9 aa, Homo Sapiens
TVLTHKQSY

SEQ ID NO: 279805 - protein, 9 aa, Homo Sapiens
TLIRQHQEL

SEQ ID NO: 279806 - protein, 9 aa, Homo Sapiens
ALQKRCIHL

SEQ ID NO: 279807 - protein, 9 aa, Homo Sapiens
EVVQRGRMP

SEQ ID NO: 279808 - protein, 9 aa, Homo Sapiens
VNSDTQLKQ

SEQ ID NO: 279809 - protein, 9 aa, Homo Sapiens
IQTDSHLHT

SEQ ID NO: 279810 - protein, 9 aa, Homo Sapiens
IPTSNLYPS

SEQ ID NO: 279811 - protein, 9 aa, Homo Sapiens
IPPQAKVDF

SEQ ID NO: 279812 - protein, 9 aa, Homo Sapiens
EPEGLLAGP

SEQ ID NO: 279813 - protein, 9 aa, Homo Sapiens
YINSMLDPV

SEQ ID NO: 279814 - protein, 9 aa, Homo Sapiens
EKIIHASFI

SEQ ID NO: 279815 - protein, 9 aa, Homo Sapiens
IFAQQRDSK

SEQ ID NO: 279816 - protein, 9 aa, Homo Sapiens
QKEDDKQYM

SEQ ID NO: 279817 - protein, 9 aa, Homo Sapiens
SELSDQITF

SEQ ID NO: 279818 - protein, 9 aa, Homo Sapiens
RIAFLQGKR

SEQ ID NO: 279819 - protein, 9 aa, Homo Sapiens
RKFFSFTPA

SEQ ID NO: 279820 - protein, 9 aa, Homo Sapiens
LRLPFQKQV

SEQ ID NO: 279821 - protein, 9 aa, Homo Sapiens
PVFNETEIE

SEQ ID NO: 279822 - protein, 9 aa, Homo Sapiens
PTTITLAAF

SEQ ID NO: 279823 - protein, 9 aa, Homo Sapiens
GSLLWGIVR

SEQ ID NO: 279824 - protein, 9 aa, Homo Sapiens
PLLIIATTE

SEQ ID NO: 279825 - protein, 9 aa, Homo Sapiens
PGHLPGSKR

SEQ ID NO: 279826 - protein, 9 aa, Homo Sapiens
GIYIHALHL

SEQ ID NO: 279827 - protein, 9 aa, Homo Sapiens
VVALGTSII

SEQ ID NO: 279828 - protein, 9 aa, Homo Sapiens
PFSKALTFY

SEQ ID NO: 279829 - protein, 9 aa, Homo Sapiens
RMSFCELFK

SEQ ID NO: 279830 - protein, 9 aa, Homo Sapiens
DAAVKATAQ

SEQ ID NO: 279831 - protein, 9 aa, Homo Sapiens
SCYINVRWF

SEQ ID NO: 279832 - protein, 9 aa, Homo Sapiens
SHQSYSQNT

SEQ ID NO: 279833 - protein, 9 aa, Homo Sapiens
SPGSIEIFF

SEQ ID NO: 279834 - protein, 9 aa, Homo Sapiens
LKSSAQFMG

SEQ ID NO: 279835 - protein, 9 aa, Homo Sapiens
ASLSFQDVT

SEQ ID NO: 279836 - protein, 9 aa, Homo Sapiens
AEINKIIST

SEQ ID NO: 279837 - protein, 9 aa, Homo Sapiens
AQSPLWIDW

SEQ ID NO: 279838 - protein, 9 aa, Homo Sapiens
LVRLGSSPP

SEQ ID NO: 279839 - protein, 9 aa, Homo Sapiens
ESFKNLFWS

SEQ ID NO: 279840 - protein, 9 aa, Homo Sapiens
RYSVWEEID

SEQ ID NO: 279841 - protein, 9 aa, Homo Sapiens
LNIKAGEQS

SEQ ID NO: 279842 - protein, 9 aa, Homo Sapiens
NHSQSSSQN

SEQ ID NO: 279843 - protein, 9 aa, Homo Sapiens
DQSISQNHA

SEQ ID NO: 279844 - protein, 9 aa, Homo Sapiens
HRDSIGLDY

SEQ ID NO: 279845 - protein, 9 aa, Homo Sapiens
DTTGSGATG

SEQ ID NO: 279846 - protein, 9 aa, Homo Sapiens
KGHKIKHFL

SEQ ID NO: 279847 - protein, 9 aa, Homo Sapiens
LRTYLRMPR

SEQ ID NO: 279848 - protein, 9 aa, Homo Sapiens
ENKWGHNIT

SEQ ID NO: 279849 - protein, 9 aa, Homo Sapiens
RKSTKRTNQ

SEQ ID NO: 279850 - protein, 9 aa, Homo Sapiens
PQDADVTLG

SEQ ID NO: 279851 - protein, 9 aa, Homo Sapiens
IWELNEYLE

SEQ ID NO: 279852 - protein, 9 aa, Homo Sapiens
GYTGKVHLT

SEQ ID NO: 279853 - protein, 9 aa, Homo Sapiens
TDNQVRLCK

SEQ ID NO: 279854 - protein, 9 aa, Homo Sapiens
TFIILNKGK

SEQ ID NO: 279855 - protein, 9 aa, Homo Sapiens
NAVAASLQK

SEQ ID NO: 279856 - protein, 9 aa, Homo Sapiens
TCEIKIKQK

SEQ ID NO: 279857 - protein, 9 aa, Homo Sapiens
IIQFAFQAS

SEQ ID NO: 279858 - protein, 9 aa, Homo Sapiens
GYPKTKAFI

SEQ ID NO: 279859 - protein, 9 aa, Homo Sapiens
DKNILHIKH

SEQ ID NO: 279860 - protein, 9 aa, Homo Sapiens
RALNVLKYE

SEQ ID NO: 279861 - protein, 9 aa, Homo Sapiens
YQLLNHSAN

SEQ ID NO: 279862 - protein, 9 aa, Homo Sapiens
NMTGWAYEK

SEQ ID NO: 279863 - protein, 9 aa, Homo Sapiens
LFRWCDIQD

SEQ ID NO: 279864 - protein, 9 aa, Homo Sapiens
TLGGLFSPP

SEQ ID NO: 279865 - protein, 9 aa, Homo Sapiens
YLYPLSLPQ

SEQ ID NO: 279866 - protein, 9 aa, Homo Sapiens
VYLYPLSLP

SEQ ID NO: 279867 - protein, 9 aa, Homo Sapiens
GNKSRSAQS

SEQ ID NO: 279868 - protein, 9 aa, Homo Sapiens
KHNTDTVVD

SEQ ID NO: 279869 - protein, 9 aa, Homo Sapiens
LDRDEEDIG

SEQ ID NO: 279870 - protein, 9 aa, Homo Sapiens
QQMDIENPN

SEQ ID NO: 279871 - protein, 9 aa, Homo Sapiens
FLQVEISDA

SEQ ID NO: 279872 - protein, 9 aa, Homo Sapiens
ELMLGSETP

SEQ ID NO: 279873 - protein, 9 aa, Homo Sapiens
TKFILMGFM

SEQ ID NO: 279874 - protein, 9 aa, Homo Sapiens
ESEEQRKMC

SEQ ID NO: 279875 - protein, 9 aa, Homo Sapiens
VLMTLFAGI

SEQ ID NO: 279876 - protein, 9 aa, Homo Sapiens
EDYIHIIIQ

SEQ ID NO: 279877 - protein, 9 aa, Homo Sapiens
SKKELNHLA

SEQ ID NO: 279878 - protein, 9 aa, Homo Sapiens
GKSRRDKLY

SEQ ID NO: 279879 - protein, 9 aa, Homo Sapiens
YFKERDPLK

SEQ ID NO: 279880 - protein, 9 aa, Homo Sapiens
LLEMWKPHV

SEQ ID NO: 279881 - protein, 9 aa, Homo Sapiens
IDSYLVQYA

SEQ ID NO: 279882 - protein, 9 aa, Homo Sapiens
IIYPVVIKL

SEQ ID NO: 279883 - protein, 9 aa, Homo Sapiens
YDVKTRTWS

SEQ ID NO: 279884 - protein, 9 aa, Homo Sapiens
LITATTTAV

SEQ ID NO: 279885 - protein, 9 aa, Homo Sapiens
DTETRPEKE

SEQ ID NO: 279886 - protein, 9 aa, Homo Sapiens
NTAAKEQQG

SEQ ID NO: 279887 - protein, 9 aa, Homo Sapiens
NTVFLRYER

SEQ ID NO: 279888 - protein, 9 aa, Homo Sapiens
TIPDSLDRI

SEQ ID NO: 279889 - protein, 9 aa, Homo Sapiens
RDMGYKTNF

SEQ ID NO: 279890 - protein, 9 aa, Homo Sapiens
NFRAKVCGK

SEQ ID NO: 279891 - protein, 9 aa, Homo Sapiens
RLNSPLYLP

SEQ ID NO: 279892 - protein, 9 aa, Homo Sapiens
AGPNTNGSH

SEQ ID NO: 279893 - protein, 9 aa, Homo Sapiens
EKLAENINT

SEQ ID NO: 279894 - protein, 9 aa, Homo Sapiens
RNTSFRRNV

SEQ ID NO: 279895 - protein, 9 aa, Homo Sapiens
LRYVHSIII

SEQ ID NO: 279896 - protein, 9 aa, Homo Sapiens
GSYNGVLYE

SEQ ID NO: 279897 - protein, 9 aa, Homo Sapiens
TYNPEGTLL

SEQ ID NO: 279898 - protein, 9 aa, Homo Sapiens
AEDCGFIQR

SEQ ID NO: 279899 - protein, 9 aa, Homo Sapiens
VINTFENVD

SEQ ID NO: 279900 - protein, 9 aa, Homo Sapiens
QNVITDMRT

SEQ ID NO: 279901 - protein, 9 aa, Homo Sapiens
LNWGYQVAL

SEQ ID NO: 279902 - protein, 9 aa, Homo Sapiens
GESAEEEDN

SEQ ID NO: 279903 - protein, 9 aa, Homo Sapiens
GSRLMDTFL

SEQ ID NO: 279904 - protein, 9 aa, Homo Sapiens
PGTDCNLTC

SEQ ID NO: 279905 - protein, 9 aa, Homo Sapiens
TDLLLGLMV

SEQ ID NO: 279906 - protein, 9 aa, Homo Sapiens
AIKVLISFI

SEQ ID NO: 279907 - protein, 9 aa, Homo Sapiens
NKNKLPKLN

SEQ ID NO: 279908 - protein, 9 aa, Homo Sapiens
EHPAEPSIY

SEQ ID NO: 279909 - protein, 9 aa, Homo Sapiens
KIVKEIHGQ

SEQ ID NO: 279910 - protein, 9 aa, Homo Sapiens
CFRNLFHIW

SEQ ID NO: 279911 - protein, 9 aa, Homo Sapiens
KSTLAMSPW

SEQ ID NO: 279912 - protein, 9 aa, Homo Sapiens
GDFQTVTFK

SEQ ID NO: 279913 - protein, 9 aa, Homo Sapiens
AEARVGLWP

SEQ ID NO: 279914 - protein, 9 aa, Homo Sapiens
KSGSMQDQE

SEQ ID NO: 279915 - protein, 9 aa, Homo Sapiens
SVAPQQDFA

SEQ ID NO: 279916 - protein, 9 aa, Homo Sapiens
INVGSFTIK

SEQ ID NO: 279917 - protein, 9 aa, Homo Sapiens
NIILLGESQ

SEQ ID NO: 279918 - protein, 9 aa, Homo Sapiens
FGRPVSLPW

SEQ ID NO: 279919 - protein, 9 aa, Homo Sapiens
SGAPGEHDS

SEQ ID NO: 279920 - protein, 9 aa, Homo Sapiens
VLAVAAVLD

SEQ ID NO: 279921 - protein, 9 aa, Homo Sapiens
RHICMVNIA

SEQ ID NO: 279922 - protein, 9 aa, Homo Sapiens
SSMQQEAPS

SEQ ID NO: 279923 - protein, 9 aa, Homo Sapiens
QHTSRLCYD

SEQ ID NO: 279924 - protein, 9 aa, Homo Sapiens
TTPNKLVQL

SEQ ID NO: 279925 - protein, 9 aa, Homo Sapiens
GFLMVCLGT

SEQ ID NO: 279926 - protein, 9 aa, Homo Sapiens
ERMHDEILQ

SEQ ID NO: 279927 - protein, 9 aa, Homo Sapiens
QEAHGRLAE

SEQ ID NO: 279928 - protein, 9 aa, Homo Sapiens
LAMCARGGQ

SEQ ID NO: 279929 - protein, 9 aa, Homo Sapiens
KHVYGPFYA

SEQ ID NO: 279930 - protein, 9 aa, Homo Sapiens
TQPGLHRFA

SEQ ID NO: 279931 - protein, 9 aa, Homo Sapiens
QVGEIIRNV

SEQ ID NO: 279932 - protein, 9 aa, Homo Sapiens
WIEEMINNQ

SEQ ID NO: 279933 - protein, 9 aa, Homo Sapiens
FTCSTHLTV

SEQ ID NO: 279934 - protein, 9 aa, Homo Sapiens
DDDRLRDGE

SEQ ID NO: 279935 - protein, 9 aa, Homo Sapiens
KLKAELKLL

SEQ ID NO: 279936 - protein, 9 aa, Homo Sapiens
CEELLSVNF

SEQ ID NO: 279937 - protein, 9 aa, Homo Sapiens
VSGFNVDHG

SEQ ID NO: 279938 - protein, 9 aa, Homo Sapiens
SARWIQMTH

SEQ ID NO: 279939 - protein, 9 aa, Homo Sapiens
NHSFFSEII

SEQ ID NO: 279940 - protein, 9 aa, Homo Sapiens
EESDAEFDK

SEQ ID NO: 279941 - protein, 9 aa, Homo Sapiens
EVKEEPETI

SEQ ID NO: 279942 - protein, 9 aa, Homo Sapiens
SSVTSVGKV

SEQ ID NO: 279943 - protein, 9 aa, Homo Sapiens
LALYSTRFP

SEQ ID NO: 279944 - protein, 9 aa, Homo Sapiens
LGWIPIDNS

SEQ ID NO: 279945 - protein, 9 aa, Homo Sapiens
AFAGNTKCY

SEQ ID NO: 279946 - protein, 9 aa, Homo Sapiens
EIIAKEEQQ

SEQ ID NO: 279947 - protein, 9 aa, Homo Sapiens
ASSLFQSNK

SEQ ID NO: 279948 - protein, 9 aa, Homo Sapiens
PALVARLPI

SEQ ID NO: 279949 - protein, 9 aa, Homo Sapiens
PSGCRMKWL

SEQ ID NO: 279950 - protein, 9 aa, Homo Sapiens
ISSKCMMKD

SEQ ID NO: 279951 - protein, 9 aa, Homo Sapiens
TIMLYLAEV

SEQ ID NO: 279952 - protein, 9 aa, Homo Sapiens
TSLGQDARW

SEQ ID NO: 279953 - protein, 9 aa, Homo Sapiens
HLCHSAAEF

SEQ ID NO: 279954 - protein, 9 aa, Homo Sapiens
MHMGLAGGN

SEQ ID NO: 279955 - protein, 9 aa, Homo Sapiens
NFLSSFTLM

SEQ ID NO: 279956 - protein, 9 aa, Homo Sapiens
PTFKQRKGE

SEQ ID NO: 279957 - protein, 9 aa, Homo Sapiens
TVTWIHISP

SEQ ID NO: 279958 - protein, 9 aa, Homo Sapiens
LSLDQIDLL

SEQ ID NO: 279959 - protein, 9 aa, Homo Sapiens
LFALAWPPQ

SEQ ID NO: 279960 - protein, 9 aa, Homo Sapiens
MTSKKTLLQ

SEQ ID NO: 279961 - protein, 9 aa, Homo Sapiens
DNINLTNGS

SEQ ID NO: 279962 - protein, 9 aa, Homo Sapiens
SLFIRFLCP

SEQ ID NO: 279963 - protein, 9 aa, Homo Sapiens
KINLHQHQR

SEQ ID NO: 279964 - protein, 9 aa, Homo Sapiens
WTLPKNFHS

SEQ ID NO: 279965 - protein, 9 aa, Homo Sapiens
RFQGISWEP

SEQ ID NO: 279966 - protein, 9 aa, Homo Sapiens
FHLCSYIAW

SEQ ID NO: 279967 - protein, 9 aa, Homo Sapiens
KELETLLET

SEQ ID NO: 279968 - protein, 9 aa, Homo Sapiens
VTIKEGLHD

SEQ ID NO: 279969 - protein, 9 aa, Homo Sapiens
EKEASDDDT

SEQ ID NO: 279970 - protein, 9 aa, Homo Sapiens
NTNLTGYPD

SEQ ID NO: 279971 - protein, 9 aa, Homo Sapiens
LYLPKFKYP

SEQ ID NO: 279972 - protein, 9 aa, Homo Sapiens
GQWEDEGFQ

SEQ ID NO: 279973 - protein, 9 aa, Homo Sapiens
LFGSNAQYI

SEQ ID NO: 279974 - protein, 9 aa, Homo Sapiens
FPTRIASSL

SEQ ID NO: 279975 - protein, 9 aa, Homo Sapiens
ILANIGPKD

SEQ ID NO: 279976 - protein, 9 aa, Homo Sapiens
KGCQSHPGL

SEQ ID NO: 279977 - protein, 9 aa, Homo Sapiens
FVGGQSYTC

SEQ ID NO: 279978 - protein, 9 aa, Homo Sapiens
GPDICCREH

SEQ ID NO: 279979 - protein, 9 aa, Homo Sapiens
VVIGKNGEK

SEQ ID NO: 279980 - protein, 9 aa, Homo Sapiens
EPHNDNLYL

SEQ ID NO: 279981 - protein, 9 aa, Homo Sapiens
DNCKETAKE

SEQ ID NO: 279982 - protein, 9 aa, Homo Sapiens
DSPKEVRKK

SEQ ID NO: 279983 - protein, 9 aa, Homo Sapiens
FPDMWLFPD

SEQ ID NO: 279984 - protein, 9 aa, Homo Sapiens
FLQNCLPHL

SEQ ID NO: 279985 - protein, 9 aa, Homo Sapiens
CIVWLAFLP

SEQ ID NO: 279986 - protein, 9 aa, Homo Sapiens
KVSSRVEND

SEQ ID NO: 279987 - protein, 9 aa, Homo Sapiens
VKHKLKEMA

SEQ ID NO: 279988 - protein, 9 aa, Homo Sapiens
RIYVYVLDK

SEQ ID NO: 279989 - protein, 9 aa, Homo Sapiens
TYVCSISDS

SEQ ID NO: 279990 - protein, 9 aa, Homo Sapiens
APVQGTAFN

SEQ ID NO: 279991 - protein, 9 aa, Homo Sapiens
PPGWVTLEG

SEQ ID NO: 279992 - protein, 9 aa, Homo Sapiens
SGFDPFQLD

SEQ ID NO: 279993 - protein, 9 aa, Homo Sapiens
FLGICHSKE

SEQ ID NO: 279994 - protein, 9 aa, Homo Sapiens
SVSGPQHTE

SEQ ID NO: 279995 - protein, 9 aa, Homo Sapiens
GGQDRKSNL

SEQ ID NO: 279996 - protein, 9 aa, Homo Sapiens
NGSLLVIIH

SEQ ID NO: 279997 - protein, 9 aa, Homo Sapiens
DLSTNTQEK

SEQ ID NO: 279998 - protein, 9 aa, Homo Sapiens
VRSEAERQA

SEQ ID NO: 279999 - protein, 9 aa, Homo Sapiens
EAEYLTVFK

SEQ ID NO: 280000 - protein, 9 aa, Homo Sapiens
KNLIAYFIP

SEQ ID NO: 280001 - protein, 9 aa, Homo Sapiens
SLGKSVVMR

SEQ ID NO: 280002 - protein, 9 aa, Homo Sapiens
YMEASTKIR

SEQ ID NO: 280003 - protein, 9 aa, Homo Sapiens
YIDQYAAIK

SEQ ID NO: 280004 - protein, 9 aa, Homo Sapiens
TGNATGEDP

SEQ ID NO: 280005 - protein, 9 aa, Homo Sapiens
SNSYPRDVV

SEQ ID NO: 280006 - protein, 9 aa, Homo Sapiens
NKPERRPRG

SEQ ID NO: 280007 - protein, 9 aa, Homo Sapiens
ARERELYKA

SEQ ID NO: 280008 - protein, 9 aa, Homo Sapiens
LQSACDALN

SEQ ID NO: 280009 - protein, 9 aa, Homo Sapiens
GSGAAFDAD

SEQ ID NO: 280010 - protein, 9 aa, Homo Sapiens
ASLQEYVIE

SEQ ID NO: 280011 - protein, 9 aa, Homo Sapiens
PSSSPTDPK

SEQ ID NO: 280012 - protein, 9 aa, Homo Sapiens
PTFCQSGMD

SEQ ID NO: 280013 - protein, 9 aa, Homo Sapiens
HHGNRHKFS

SEQ ID NO: 280014 - protein, 9 aa, Homo Sapiens
LISNKEFEE

SEQ ID NO: 280015 - protein, 9 aa, Homo Sapiens
KDDALSHLT

SEQ ID NO: 280016 - protein, 9 aa, Homo Sapiens
HKKICLRCQ

SEQ ID NO: 280017 - protein, 9 aa, Homo Sapiens
CSNAFPFYS

SEQ ID NO: 280018 - protein, 9 aa, Homo Sapiens
TILINFLIC

SEQ ID NO: 280019 - protein, 9 aa, Homo Sapiens
SSKSIKLIP

SEQ ID NO: 280020 - protein, 9 aa, Homo Sapiens
QESFTSFVP

SEQ ID NO: 280021 - protein, 9 aa, Homo Sapiens
RFGPNAILV

SEQ ID NO: 280022 - protein, 9 aa, Homo Sapiens
DLLGEYLLS

SEQ ID NO: 280023 - protein, 9 aa, Homo Sapiens
NQNESINNY

SEQ ID NO: 280024 - protein, 9 aa, Homo Sapiens
LEKWLQDNL

SEQ ID NO: 280025 - protein, 9 aa, Homo Sapiens
SLQKQLGQD

SEQ ID NO: 280026 - protein, 9 aa, Homo Sapiens
VSKIIQSII

SEQ ID NO: 280027 - protein, 9 aa, Homo Sapiens
RDFDFLDAE

SEQ ID NO: 280028 - protein, 9 aa, Homo Sapiens
ITYIQANIP

SEQ ID NO: 280029 - protein, 9 aa, Homo Sapiens
SPGAQSQYV

SEQ ID NO: 280030 - protein, 9 aa, Homo Sapiens
RVGSPWIPL

SEQ ID NO: 280031 - protein, 9 aa, Homo Sapiens
KITREEKHC

SEQ ID NO: 280032 - protein, 9 aa, Homo Sapiens
SIKKKMSEE

SEQ ID NO: 280033 - protein, 9 aa, Homo Sapiens
SKRMPQERI

SEQ ID NO: 280034 - protein, 9 aa, Homo Sapiens
DIYGRTALI

SEQ ID NO: 280035 - protein, 9 aa, Homo Sapiens
RAQDESLKH

SEQ ID NO: 280036 - protein, 9 aa, Homo Sapiens
ERIAIAVVG

SEQ ID NO: 280037 - protein, 9 aa, Homo Sapiens
HSGEKNNSC

SEQ ID NO: 280038 - protein, 9 aa, Homo Sapiens
IPVEEHFRT

SEQ ID NO: 280039 - protein, 9 aa, Homo Sapiens
KIRVIHAKE

SEQ ID NO: 280040 - protein, 9 aa, Homo Sapiens
DYGICLNRS

SEQ ID NO: 280041 - protein, 9 aa, Homo Sapiens
YLIYGPVLP

SEQ ID NO: 280042 - protein, 9 aa, Homo Sapiens
TLIQLTVKL

SEQ ID NO: 280043 - protein, 9 aa, Homo Sapiens
KLWNDILRK

SEQ ID NO: 280044 - protein, 9 aa, Homo Sapiens
KPALEAGVA

SEQ ID NO: 280045 - protein, 9 aa, Homo Sapiens
RLLKRTPCP

SEQ ID NO: 280046 - protein, 9 aa, Homo Sapiens
VAELIMNNT

SEQ ID NO: 280047 - protein, 9 aa, Homo Sapiens
AVTSVQVSQ

SEQ ID NO: 280048 - protein, 9 aa, Homo Sapiens
GTVALACSL

SEQ ID NO: 280049 - protein, 9 aa, Homo Sapiens
HSNSIAIVG

SEQ ID NO: 280050 - protein, 9 aa, Homo Sapiens
RAAEKNFHN

SEQ ID NO: 280051 - protein, 9 aa, Homo Sapiens
SAYSSLDTS

SEQ ID NO: 280052 - protein, 9 aa, Homo Sapiens
TLLKKASEG

SEQ ID NO: 280053 - protein, 9 aa, Homo Sapiens
LKDEIIQAS

SEQ ID NO: 280054 - protein, 9 aa, Homo Sapiens
CGNIMQTLK

SEQ ID NO: 280055 - protein, 9 aa, Homo Sapiens
GLPPVKLHC

SEQ ID NO: 280056 - protein, 9 aa, Homo Sapiens
MLAEKLAPS

SEQ ID NO: 280057 - protein, 9 aa, Homo Sapiens
WTGKIFAQA

SEQ ID NO: 280058 - protein, 9 aa, Homo Sapiens
AALFTSEPL

SEQ ID NO: 280059 - protein, 9 aa, Homo Sapiens
FQLIEEAWS

SEQ ID NO: 280060 - protein, 9 aa, Homo Sapiens
RTSQNHSKC

SEQ ID NO: 280061 - protein, 9 aa, Homo Sapiens
VKKNNDNLL

SEQ ID NO: 280062 - protein, 9 aa, Homo Sapiens
VSTHSPYVA

SEQ ID NO: 280063 - protein, 9 aa, Homo Sapiens
ENENVSNCI

SEQ ID NO: 280064 - protein, 9 aa, Homo Sapiens
LDKKPESKI

SEQ ID NO: 280065 - protein, 9 aa, Homo Sapiens
VNASFKGAD

SEQ ID NO: 280066 - protein, 9 aa, Homo Sapiens
ESTEISLDE

SEQ ID NO: 280067 - protein, 9 aa, Homo Sapiens
SVKKAPKKI

SEQ ID NO: 280068 - protein, 9 aa, Homo Sapiens
ERSSFEINA

SEQ ID NO: 280069 - protein, 9 aa, Homo Sapiens
FPKKRGPPG

SEQ ID NO: 280070 - protein, 9 aa, Homo Sapiens
LNNFYTLVT

SEQ ID NO: 280071 - protein, 9 aa, Homo Sapiens
KKHRNGTKN

SEQ ID NO: 280072 - protein, 9 aa, Homo Sapiens
IWKLRRELE

SEQ ID NO: 280073 - protein, 9 aa, Homo Sapiens
EGEMNESVG

SEQ ID NO: 280074 - protein, 9 aa, Homo Sapiens
KKIQKETSH

SEQ ID NO: 280075 - protein, 9 aa, Homo Sapiens
SCYFDDPRL

SEQ ID NO: 280076 - protein, 9 aa, Homo Sapiens
LANKTPHNW

SEQ ID NO: 280077 - protein, 9 aa, Homo Sapiens
ETVVRYEKL

SEQ ID NO: 280078 - protein, 9 aa, Homo Sapiens
APVGTTIFT

SEQ ID NO: 280079 - protein, 9 aa, Homo Sapiens
FGADARAVM

SEQ ID NO: 280080 - protein, 9 aa, Homo Sapiens
RGPGGKMHG

SEQ ID NO: 280081 - protein, 9 aa, Homo Sapiens
DNGEPGTRV

SEQ ID NO: 280082 - protein, 9 aa, Homo Sapiens
ERVYVVGKA

SEQ ID NO: 280083 - protein, 9 aa, Homo Sapiens
TQELSFQKC

SEQ ID NO: 280084 - protein, 9 aa, Homo Sapiens
NVDEAIHFI

SEQ ID NO: 280085 - protein, 9 aa, Homo Sapiens
AHFNLYMFR

SEQ ID NO: 280086 - protein, 9 aa, Homo Sapiens
AVESALNYS

SEQ ID NO: 280087 - protein, 9 aa, Homo Sapiens
SRQSGENGR

SEQ ID NO: 280088 - protein, 9 aa, Homo Sapiens
SLLKRHEKS

SEQ ID NO: 280089 - protein, 9 aa, Homo Sapiens
GSRSQRDVF

SEQ ID NO: 280090 - protein, 9 aa, Homo Sapiens
SSSGCLHGS

SEQ ID NO: 280091 - protein, 9 aa, Homo Sapiens
GEPGVPVPR

SEQ ID NO: 280092 - protein, 9 aa, Homo Sapiens
PRRITVFGL

SEQ ID NO: 280093 - protein, 9 aa, Homo Sapiens
SVKQIKEGC

SEQ ID NO: 280094 - protein, 9 aa, Homo Sapiens
EGIINIQKE

SEQ ID NO: 280095 - protein, 9 aa, Homo Sapiens
KTQEEGKLW

SEQ ID NO: 280096 - protein, 9 aa, Homo Sapiens
EQEKHIKCL

SEQ ID NO: 280097 - protein, 9 aa, Homo Sapiens
QKTEQGKSQ

SEQ ID NO: 280098 - protein, 9 aa, Homo Sapiens
KGAQPSPFL

SEQ ID NO: 280099 - protein, 9 aa, Homo Sapiens
EKSRVQESF

SEQ ID NO: 280100 - protein, 9 aa, Homo Sapiens
KAVVVVDYR

SEQ ID NO: 280101 - protein, 9 aa, Homo Sapiens
VKIKRTSFV

SEQ ID NO: 280102 - protein, 9 aa, Homo Sapiens
VEDETLQGK

SEQ ID NO: 280103 - protein, 9 aa, Homo Sapiens
AQFMGSPQL

SEQ ID NO: 280104 - protein, 9 aa, Homo Sapiens
IKPSSSVSL

SEQ ID NO: 280105 - protein, 9 aa, Homo Sapiens
GDFLPIPQF

SEQ ID NO: 280106 - protein, 9 aa, Homo Sapiens
QFITQVKNY

SEQ ID NO: 280107 - protein, 9 aa, Homo Sapiens
ILRIGNLWQ

SEQ ID NO: 280108 - protein, 9 aa, Homo Sapiens
INGLEEKLS

SEQ ID NO: 280109 - protein, 9 aa, Homo Sapiens
ADTCPEVLG

SEQ ID NO: 280110 - protein, 9 aa, Homo Sapiens
GCAVCLEVL

SEQ ID NO: 280111 - protein, 9 aa, Homo Sapiens
CEVKYEKDD

SEQ ID NO: 280112 - protein, 9 aa, Homo Sapiens
ENQSKPEKP

SEQ ID NO: 280113 - protein, 9 aa, Homo Sapiens
TVGGVNYLF

SEQ ID NO: 280114 - protein, 9 aa, Homo Sapiens
FGRSNIFIR

SEQ ID NO: 280115 - protein, 9 aa, Homo Sapiens
IIPDMLQQR

SEQ ID NO: 280116 - protein, 9 aa, Homo Sapiens
EDLNDLIME

SEQ ID NO: 280117 - protein, 9 aa, Homo Sapiens
MYFFFFFGR

SEQ ID NO: 280118 - protein, 9 aa, Homo Sapiens
VDVPEHRDR

SEQ ID NO: 280119 - protein, 9 aa, Homo Sapiens
YNDGSPGRK

SEQ ID NO: 280120 - protein, 9 aa, Homo Sapiens
IVRPDDWSQ

SEQ ID NO: 280121 - protein, 9 aa, Homo Sapiens
NKQLKCTET

SEQ ID NO: 280122 - protein, 9 aa, Homo Sapiens
QLEGAEKGR

SEQ ID NO: 280123 - protein, 9 aa, Homo Sapiens
ITLYLTENK

SEQ ID NO: 280124 - protein, 9 aa, Homo Sapiens
RELVAQALK

SEQ ID NO: 280125 - protein, 9 aa, Homo Sapiens
EQNLVSRGR

SEQ ID NO: 280126 - protein, 9 aa, Homo Sapiens
KEGKETKAC

SEQ ID NO: 280127 - protein, 9 aa, Homo Sapiens
ITLTNRIDE

SEQ ID NO: 280128 - protein, 9 aa, Homo Sapiens
LENTAEGNP

SEQ ID NO: 280129 - protein, 9 aa, Homo Sapiens
QLLNHSANQ

SEQ ID NO: 280130 - protein, 9 aa, Homo Sapiens
ARHYKKSFF

SEQ ID NO: 280131 - protein, 9 aa, Homo Sapiens
RHLRFTYGT

SEQ ID NO: 280132 - protein, 9 aa, Homo Sapiens
MSGGCDTQC

SEQ ID NO: 280133 - protein, 9 aa, Homo Sapiens
VRYIYYGNT

SEQ ID NO: 280134 - protein, 9 aa, Homo Sapiens
SPVKKVNCV

SEQ ID NO: 280135 - protein, 9 aa, Homo Sapiens
FGKHYGNNK

SEQ ID NO: 280136 - protein, 9 aa, Homo Sapiens
ALSREMNAK

SEQ ID NO: 280137 - protein, 9 aa, Homo Sapiens
YIVYCTGVS

SEQ ID NO: 280138 - protein, 9 aa, Homo Sapiens
LSILEADPF

SEQ ID NO: 280139 - protein, 9 aa, Homo Sapiens
IKEIEPVLS

SEQ ID NO: 280140 - protein, 9 aa, Homo Sapiens
ERKIEEAQS

SEQ ID NO: 280141 - protein, 9 aa, Homo Sapiens
RLQESDYLA

SEQ ID NO: 280142 - protein, 9 aa, Homo Sapiens
IKSDNEEYV

SEQ ID NO: 280143 - protein, 9 aa, Homo Sapiens
DFQWRNVGP

SEQ ID NO: 280144 - protein, 9 aa, Homo Sapiens
FVLYGGIVF

SEQ ID NO: 280145 - protein, 9 aa, Homo Sapiens
VRLDLNSRP

SEQ ID NO: 280146 - protein, 9 aa, Homo Sapiens
ENLELPEDE

SEQ ID NO: 280147 - protein, 9 aa, Homo Sapiens
YIFTLHKKT

SEQ ID NO: 280148 - protein, 9 aa, Homo Sapiens
EPFWESGNW

SEQ ID NO: 280149 - protein, 9 aa, Homo Sapiens
ALPQYLQAA

SEQ ID NO: 280150 - protein, 9 aa, Homo Sapiens
VLNYLKYTF

SEQ ID NO: 280151 - protein, 9 aa, Homo Sapiens
TPEEICKTF

SEQ ID NO: 280152 - protein, 9 aa, Homo Sapiens
LSNLKKKCK

SEQ ID NO: 280153 - protein, 9 aa, Homo Sapiens
SYSFTWLCR

SEQ ID NO: 280154 - protein, 9 aa, Homo Sapiens
VSPHLHAPW

SEQ ID NO: 280155 - protein, 9 aa, Homo Sapiens
NGILFVNSQ

SEQ ID NO: 280156 - protein, 9 aa, Homo Sapiens
KDILKLNAS

SEQ ID NO: 280157 - protein, 9 aa, Homo Sapiens
KKKDEGPYR

SEQ ID NO: 280158 - protein, 9 aa, Homo Sapiens
GDGELCQGI

SEQ ID NO: 280159 - protein, 9 aa, Homo Sapiens
EGKLWNDIL

SEQ ID NO: 280160 - protein, 9 aa, Homo Sapiens
YFHNLFLNT

SEQ ID NO: 280161 - protein, 9 aa, Homo Sapiens
YSDGGTCQG

SEQ ID NO: 280162 - protein, 9 aa, Homo Sapiens
QVYKQSDLD

SEQ ID NO: 280163 - protein, 9 aa, Homo Sapiens
VLLFNYKPL

SEQ ID NO: 280164 - protein, 9 aa, Homo Sapiens
CSTCAESMA

SEQ ID NO: 280165 - protein, 9 aa, Homo Sapiens
FMMVPHPLI

SEQ ID NO: 280166 - protein, 9 aa, Homo Sapiens
LWEHLRSWE

SEQ ID NO: 280167 - protein, 9 aa, Homo Sapiens
IACFDVIVS

SEQ ID NO: 280168 - protein, 9 aa, Homo Sapiens
KEGGSLIYD

SEQ ID NO: 280169 - protein, 9 aa, Homo Sapiens
IKMSHFLKM

SEQ ID NO: 280170 - protein, 9 aa, Homo Sapiens
PAINRLAEE

SEQ ID NO: 280171 - protein, 9 aa, Homo Sapiens
KKDCKQVIQ

SEQ ID NO: 280172 - protein, 9 aa, Homo Sapiens
EFLCYVNGL

SEQ ID NO: 280173 - protein, 9 aa, Homo Sapiens
GPKEPALDP

SEQ ID NO: 280174 - protein, 9 aa, Homo Sapiens
KVLEDVRNG

SEQ ID NO: 280175 - protein, 9 aa, Homo Sapiens
ITKLAQYVG

SEQ ID NO: 280176 - protein, 9 aa, Homo Sapiens
PPIKFHAGY

SEQ ID NO: 280177 - protein, 9 aa, Homo Sapiens
FQSIPNCTV

SEQ ID NO: 280178 - protein, 9 aa, Homo Sapiens
SSNHSQSSS

SEQ ID NO: 280179 - protein, 9 aa, Homo Sapiens
KYSYKGLWS

SEQ ID NO: 280180 - protein, 9 aa, Homo Sapiens
ECIKSEDKT

SEQ ID NO: 280181 - protein, 9 aa, Homo Sapiens
ASPRTFPRE

SEQ ID NO: 280182 - protein, 9 aa, Homo Sapiens
AESTWWFTS

SEQ ID NO: 280183 - protein, 9 aa, Homo Sapiens
KNFEEVVSD

SEQ ID NO: 280184 - protein, 9 aa, Homo Sapiens
HESGNILHL

SEQ ID NO: 280185 - protein, 9 aa, Homo Sapiens
NITFQNIVV

SEQ ID NO: 280186 - protein, 9 aa, Homo Sapiens
KALVDELNI

SEQ ID NO: 280187 - protein, 9 aa, Homo Sapiens
VVDLFNRVN

SEQ ID NO: 280188 - protein, 9 aa, Homo Sapiens
FNNFTLCYI

SEQ ID NO: 280189 - protein, 9 aa, Homo Sapiens
VWQLAHQFV

SEQ ID NO: 280190 - protein, 9 aa, Homo Sapiens
EVLMHVSTA

SEQ ID NO: 280191 - protein, 9 aa, Homo Sapiens
IVFAYVTDF

SEQ ID NO: 280192 - protein, 9 aa, Homo Sapiens
NREMVAQLL

SEQ ID NO: 280193 - protein, 9 aa, Homo Sapiens
GALRNFSAC

SEQ ID NO: 280194 - protein, 9 aa, Homo Sapiens
ASCTAPAPP

SEQ ID NO: 280195 - protein, 9 aa, Homo Sapiens
ESSHFCPHV

SEQ ID NO: 280196 - protein, 9 aa, Homo Sapiens
PEKTQMIYK

SEQ ID NO: 280197 - protein, 9 aa, Homo Sapiens
CRIKVSREE

SEQ ID NO: 280198 - protein, 9 aa, Homo Sapiens
NSRLPSTQT

SEQ ID NO: 280199 - protein, 9 aa, Homo Sapiens
NVFEKKDKN

SEQ ID NO: 280200 - protein, 9 aa, Homo Sapiens
PGSNKLVVA

SEQ ID NO: 280201 - protein, 9 aa, Homo Sapiens
ILSLGLFAA

SEQ ID NO: 280202 - protein, 9 aa, Homo Sapiens
TMTNVFVTL

SEQ ID NO: 280203 - protein, 9 aa, Homo Sapiens
CPGDFAVDK

SEQ ID NO: 280204 - protein, 9 aa, Homo Sapiens
ALNPRKCMA

SEQ ID NO: 280205 - protein, 9 aa, Homo Sapiens
LQEMRKITP

SEQ ID NO: 280206 - protein, 9 aa, Homo Sapiens
SSRTVHQII

SEQ ID NO: 280207 - protein, 9 aa, Homo Sapiens
KLRHDLEKT

SEQ ID NO: 280208 - protein, 9 aa, Homo Sapiens
QRWQNIFSF

SEQ ID NO: 280209 - protein, 9 aa, Homo Sapiens
PECIENPKH

SEQ ID NO: 280210 - protein, 9 aa, Homo Sapiens
QMIMNKGVL

SEQ ID NO: 280211 - protein, 9 aa, Homo Sapiens
TSRLCYDRI

SEQ ID NO: 280212 - protein, 9 aa, Homo Sapiens
YPSNMDCFW

SEQ ID NO: 280213 - protein, 9 aa, Homo Sapiens
AAYHKGRDA

SEQ ID NO: 280214 - protein, 9 aa, Homo Sapiens
TSSRHLMVH

SEQ ID NO: 280215 - protein, 9 aa, Homo Sapiens
ITILKEDSP

SEQ ID NO: 280216 - protein, 9 aa, Homo Sapiens
PRKKATYKD

SEQ ID NO: 280217 - protein, 9 aa, Homo Sapiens
SLGQDARWL

SEQ ID NO: 280218 - protein, 9 aa, Homo Sapiens
QNIQSQQEN

SEQ ID NO: 280219 - protein, 9 aa, Homo Sapiens
IEKFEGWYF

SEQ ID NO: 280220 - protein, 9 aa, Homo Sapiens
YTTLPAIFT

SEQ ID NO: 280221 - protein, 9 aa, Homo Sapiens
AIVIRCKDG

SEQ ID NO: 280222 - protein, 9 aa, Homo Sapiens
LYTVVFPML

SEQ ID NO: 280223 - protein, 9 aa, Homo Sapiens
FWKNMTFIK

SEQ ID NO: 280224 - protein, 9 aa, Homo Sapiens
KELNMMKLL

SEQ ID NO: 280225 - protein, 9 aa, Homo Sapiens
GKDCGDSPP

SEQ ID NO: 280226 - protein, 9 aa, Homo Sapiens
PIVSPSDTS

SEQ ID NO: 280227 - protein, 9 aa, Homo Sapiens
NVALQKHGE

SEQ ID NO: 280228 - protein, 9 aa, Homo Sapiens
PFKFKFHFN

SEQ ID NO: 280229 - protein, 9 aa, Homo Sapiens
SDHLGHSMV

SEQ ID NO: 280230 - protein, 9 aa, Homo Sapiens
AATERECGN

SEQ ID NO: 280231 - protein, 9 aa, Homo Sapiens
ILEGIGIFS

SEQ ID NO: 280232 - protein, 9 aa, Homo Sapiens
LPITICSLS

SEQ ID NO: 280233 - protein, 9 aa, Homo Sapiens
VFRFKVLML

SEQ ID NO: 280234 - protein, 9 aa, Homo Sapiens
SCLVVLEFD

SEQ ID NO: 280235 - protein, 9 aa, Homo Sapiens
DDSKLCPSL

SEQ ID NO: 280236 - protein, 9 aa, Homo Sapiens
LHNNFLLGV

SEQ ID NO: 280237 - protein, 9 aa, Homo Sapiens
CKELENTLK

SEQ ID NO: 280238 - protein, 9 aa, Homo Sapiens
GYNREECLQ

SEQ ID NO: 280239 - protein, 9 aa, Homo Sapiens
LLIYLITMM

SEQ ID NO: 280240 - protein, 9 aa, Homo Sapiens
NERKLNQAF

SEQ ID NO: 280241 - protein, 9 aa, Homo Sapiens
CKNKNKWYK

SEQ ID NO: 280242 - protein, 9 aa, Homo Sapiens
PTSPGLPPG

SEQ ID NO: 280243 - protein, 9 aa, Homo Sapiens
DLRAESVTN

SEQ ID NO: 280244 - protein, 9 aa, Homo Sapiens
MSPGNARPW

SEQ ID NO: 280245 - protein, 9 aa, Homo Sapiens
GLIRHWGFH

SEQ ID NO: 280246 - protein, 9 aa, Homo Sapiens
QPGPHTTAA

SEQ ID NO: 280247 - protein, 9 aa, Homo Sapiens
VKVLMHLKD

SEQ ID NO: 280248 - protein, 9 aa, Homo Sapiens
RFLKPSKVE

SEQ ID NO: 280249 - protein, 9 aa, Homo Sapiens
SYSYLVHCK

SEQ ID NO: 280250 - protein, 9 aa, Homo Sapiens
KSGVCTLIF

SEQ ID NO: 280251 - protein, 9 aa, Homo Sapiens
TECGKHFRS

SEQ ID NO: 280252 - protein, 9 aa, Homo Sapiens
PGFWYSWRY

SEQ ID NO: 280253 - protein, 9 aa, Homo Sapiens
YWNRIFIHG

SEQ ID NO: 280254 - protein, 9 aa, Homo Sapiens
LEKEKYDVW

SEQ ID NO: 280255 - protein, 9 aa, Homo Sapiens
RVFLIWAVI

SEQ ID NO: 280256 - protein, 9 aa, Homo Sapiens
SSHVSWIAG

SEQ ID NO: 280257 - protein, 9 aa, Homo Sapiens
HVDKLEHHF

SEQ ID NO: 280258 - protein, 9 aa, Homo Sapiens
YKMEDGKVI

SEQ ID NO: 280259 - protein, 9 aa, Homo Sapiens
KIENVYAEG

SEQ ID NO: 280260 - protein, 9 aa, Homo Sapiens
DQLEQLKKE

SEQ ID NO: 280261 - protein, 9 aa, Homo Sapiens
ACRLYTKLS

SEQ ID NO: 280262 - protein, 9 aa, Homo Sapiens
FATPRAKAQ

SEQ ID NO: 280263 - protein, 9 aa, Homo Sapiens
RHKDVRRIC

SEQ ID NO: 280264 - protein, 9 aa, Homo Sapiens
DAGQIRFGA

SEQ ID NO: 280265 - protein, 9 aa, Homo Sapiens
SDVSISAFC

SEQ ID NO: 280266 - protein, 9 aa, Homo Sapiens
ILLGLSDRP

SEQ ID NO: 280267 - protein, 9 aa, Homo Sapiens
LPTCISRRG

SEQ ID NO: 280268 - protein, 9 aa, Homo Sapiens
MFFIHGFTF

SEQ ID NO: 280269 - protein, 9 aa, Homo Sapiens
RPDEGMRGD

SEQ ID NO: 280270 - protein, 9 aa, Homo Sapiens
PRVPFAMRN

SEQ ID NO: 280271 - protein, 9 aa, Homo Sapiens
DIVPVDNKI

SEQ ID NO: 280272 - protein, 9 aa, Homo Sapiens
QRKWEKHFY

SEQ ID NO: 280273 - protein, 9 aa, Homo Sapiens
IGHTIWGSV

SEQ ID NO: 280274 - protein, 9 aa, Homo Sapiens
LRNEIQRYS

SEQ ID NO: 280275 - protein, 9 aa, Homo Sapiens
TLDADTCPE

SEQ ID NO: 280276 - protein, 9 aa, Homo Sapiens
IIRAKAIDR

SEQ ID NO: 280277 - protein, 9 aa, Homo Sapiens
LSSSRHTLK

SEQ ID NO: 280278 - protein, 9 aa, Homo Sapiens
IFQIARLIP

SEQ ID NO: 280279 - protein, 9 aa, Homo Sapiens
CDVPGGHST

SEQ ID NO: 280280 - protein, 9 aa, Homo Sapiens
TKNFDIGPE

SEQ ID NO: 280281 - protein, 9 aa, Homo Sapiens
KALYGSEED

SEQ ID NO: 280282 - protein, 9 aa, Homo Sapiens
AFIFFIASI

SEQ ID NO: 280283 - protein, 9 aa, Homo Sapiens
VIQFKGQHL

SEQ ID NO: 280284 - protein, 9 aa, Homo Sapiens
RPVSYRGCV

SEQ ID NO: 280285 - protein, 9 aa, Homo Sapiens
AVNSLREEL

SEQ ID NO: 280286 - protein, 9 aa, Homo Sapiens
KNVESVADI

SEQ ID NO: 280287 - protein, 9 aa, Homo Sapiens
KPKENLELP

SEQ ID NO: 280288 - protein, 9 aa, Homo Sapiens
LMSHQITHT

SEQ ID NO: 280289 - protein, 9 aa, Homo Sapiens
GQDGGVCEG

SEQ ID NO: 280290 - protein, 9 aa, Homo Sapiens
IINIQKELD

SEQ ID NO: 280291 - protein, 9 aa, Homo Sapiens
AKKGRKYAL

SEQ ID NO: 280292 - protein, 9 aa, Homo Sapiens
LSFQDVTVE

SEQ ID NO: 280293 - protein, 9 aa, Homo Sapiens
QITFIERVK

SEQ ID NO: 280294 - protein, 9 aa, Homo Sapiens
EKEKPNEIP

SEQ ID NO: 280295 - protein, 9 aa, Homo Sapiens
LCKNDSALK

SEQ ID NO: 280296 - protein, 9 aa, Homo Sapiens
SKQEGRQQY

SEQ ID NO: 280297 - protein, 9 aa, Homo Sapiens
PVIRAGWLD

SEQ ID NO: 280298 - protein, 9 aa, Homo Sapiens
EYIKPHVRP

SEQ ID NO: 280299 - protein, 9 aa, Homo Sapiens
VFVFEAGPT

SEQ ID NO: 280300 - protein, 9 aa, Homo Sapiens
FKTSVDCLW

SEQ ID NO: 280301 - protein, 9 aa, Homo Sapiens
HRKDFGYHT

SEQ ID NO: 280302 - protein, 9 aa, Homo Sapiens
GKAKRRNQE

SEQ ID NO: 280303 - protein, 9 aa, Homo Sapiens
LEFDLLYGR

SEQ ID NO: 280304 - protein, 9 aa, Homo Sapiens
KGALKNVLA

SEQ ID NO: 280305 - protein, 9 aa, Homo Sapiens
QAKEYIKPH

SEQ ID NO: 280306 - protein, 9 aa, Homo Sapiens
RTEEEETIK

SEQ ID NO: 280307 - protein, 9 aa, Homo Sapiens
KAHKVFIPD

SEQ ID NO: 280308 - protein, 9 aa, Homo Sapiens
IVGSKVDMN

SEQ ID NO: 280309 - protein, 9 aa, Homo Sapiens
TSKKNVFRK

SEQ ID NO: 280310 - protein, 9 aa, Homo Sapiens
NNLSSSAGY

SEQ ID NO: 280311 - protein, 9 aa, Homo Sapiens
HHNPWTVRP

SEQ ID NO: 280312 - protein, 9 aa, Homo Sapiens
QEEIKKEPD

SEQ ID NO: 280313 - protein, 9 aa, Homo Sapiens
RPQSRPQSF

SEQ ID NO: 280314 - protein, 9 aa, Homo Sapiens
FINSKKASE

SEQ ID NO: 280315 - protein, 9 aa, Homo Sapiens
GVKKLPWPC

SEQ ID NO: 280316 - protein, 9 aa, Homo Sapiens
VVEQWSTVI

SEQ ID NO: 280317 - protein, 9 aa, Homo Sapiens
EEQRARYLF

SEQ ID NO: 280318 - protein, 9 aa, Homo Sapiens
GIPGHPAPP

SEQ ID NO: 280319 - protein, 9 aa, Homo Sapiens
PTEGLGSWA

SEQ ID NO: 280320 - protein, 9 aa, Homo Sapiens
ISNKRNISF

SEQ ID NO: 280321 - protein, 9 aa, Homo Sapiens
FDVCDAFPP

SEQ ID NO: 280322 - protein, 9 aa, Homo Sapiens
SITRVTANL

SEQ ID NO: 280323 - protein, 9 aa, Homo Sapiens
EKIHTEEKP

SEQ ID NO: 280324 - protein, 9 aa, Homo Sapiens
ISVTLYGKE

SEQ ID NO: 280325 - protein, 9 aa, Homo Sapiens
SDKGALQEG

SEQ ID NO: 280326 - protein, 9 aa, Homo Sapiens
QQLPFVIFL

SEQ ID NO: 280327 - protein, 9 aa, Homo Sapiens
LIIDAGQIR

SEQ ID NO: 280328 - protein, 9 aa, Homo Sapiens
CMIQTYLYF

SEQ ID NO: 280329 - protein, 9 aa, Homo Sapiens
NISRIHLVG

SEQ ID NO: 280330 - protein, 9 aa, Homo Sapiens
ANTGSKLPV

SEQ ID NO: 280331 - protein, 9 aa, Homo Sapiens
PNVLYFSRY

SEQ ID NO: 280332 - protein, 9 aa, Homo Sapiens
QIKMELQQK

SEQ ID NO: 280333 - protein, 9 aa, Homo Sapiens
IQTVPTPVR

SEQ ID NO: 280334 - protein, 9 aa, Homo Sapiens
YVRYSKIRY

SEQ ID NO: 280335 - protein, 9 aa, Homo Sapiens
PMVSVVTTI

SEQ ID NO: 280336 - protein, 9 aa, Homo Sapiens
LIAYNVTSK

SEQ ID NO: 280337 - protein, 9 aa, Homo Sapiens
HTAKTRALV

SEQ ID NO: 280338 - protein, 9 aa, Homo Sapiens
LYSSLPRNI

SEQ ID NO: 280339 - protein, 9 aa, Homo Sapiens
LLASKSREE

SEQ ID NO: 280340 - protein, 9 aa, Homo Sapiens
RALVKHKLK

SEQ ID NO: 280341 - protein, 9 aa, Homo Sapiens
CQQGSQRRC

SEQ ID NO: 280342 - protein, 9 aa, Homo Sapiens
QIELDHERM

SEQ ID NO: 280343 - protein, 9 aa, Homo Sapiens
EGQFTQLIT

SEQ ID NO: 280344 - protein, 9 aa, Homo Sapiens
WQVMLLVNG

SEQ ID NO: 280345 - protein, 9 aa, Homo Sapiens
FFIHGFTFM

SEQ ID NO: 280346 - protein, 9 aa, Homo Sapiens
KEKKKTYFC

SEQ ID NO: 280347 - protein, 9 aa, Homo Sapiens
MPKFNKIPL

SEQ ID NO: 280348 - protein, 9 aa, Homo Sapiens
GRFQTAREK

SEQ ID NO: 280349 - protein, 9 aa, Homo Sapiens
SCLGSILTP

SEQ ID NO: 280350 - protein, 9 aa, Homo Sapiens
GREHIANRA

SEQ ID NO: 280351 - protein, 9 aa, Homo Sapiens
HYGVASCGA

SEQ ID NO: 280352 - protein, 9 aa, Homo Sapiens
IHSILANIG

SEQ ID NO: 280353 - protein, 9 aa, Homo Sapiens
VKFRKWMGI

SEQ ID NO: 280354 - protein, 9 aa, Homo Sapiens
LAVADLMVS

SEQ ID NO: 280355 - protein, 9 aa, Homo Sapiens
TIVPVEDWE

SEQ ID NO: 280356 - protein, 9 aa, Homo Sapiens
VSHKRVVCN

SEQ ID NO: 280357 - protein, 9 aa, Homo Sapiens
KSKKEIKQL

SEQ ID NO: 280358 - protein, 9 aa, Homo Sapiens
KEEPDEFII

SEQ ID NO: 280359 - protein, 9 aa, Homo Sapiens
SVLSPEPPK

SEQ ID NO: 280360 - protein, 9 aa, Homo Sapiens
SIYGTVYSI

SEQ ID NO: 280361 - protein, 9 aa, Homo Sapiens
EQVTHQHAV

SEQ ID NO: 280362 - protein, 9 aa, Homo Sapiens
VKLLSFASG

SEQ ID NO: 280363 - protein, 9 aa, Homo Sapiens
ATVIFIVTQ

SEQ ID NO: 280364 - protein, 9 aa, Homo Sapiens
KILFEQHIF

SEQ ID NO: 280365 - protein, 9 aa, Homo Sapiens
QAPCSTNNC

SEQ ID NO: 280366 - protein, 9 aa, Homo Sapiens
VVEPYNSII

SEQ ID NO: 280367 - protein, 9 aa, Homo Sapiens
DFFRSKKEL

SEQ ID NO: 280368 - protein, 9 aa, Homo Sapiens
SSPVRREIK

SEQ ID NO: 280369 - protein, 9 aa, Homo Sapiens
LLPSGSKGE

SEQ ID NO: 280370 - protein, 9 aa, Homo Sapiens
ITECVRTAL

SEQ ID NO: 280371 - protein, 9 aa, Homo Sapiens
YPNTFIQRD

SEQ ID NO: 280372 - protein, 9 aa, Homo Sapiens
EPGLIAFEW

SEQ ID NO: 280373 - protein, 9 aa, Homo Sapiens
SQLNDLQTI

SEQ ID NO: 280374 - protein, 9 aa, Homo Sapiens
CEKIFNHRA

SEQ ID NO: 280375 - protein, 9 aa, Homo Sapiens
AFEAWKAMK

SEQ ID NO: 280376 - protein, 9 aa, Homo Sapiens
DSKLEIPVP

SEQ ID NO: 280377 - protein, 9 aa, Homo Sapiens
VEAIALAAL

SEQ ID NO: 280378 - protein, 9 aa, Homo Sapiens
GKGGDDKYD

SEQ ID NO: 280379 - protein, 9 aa, Homo Sapiens
GKSFSRSTT

SEQ ID NO: 280380 - protein, 9 aa, Homo Sapiens
QVNDDDVRL

SEQ ID NO: 280381 - protein, 9 aa, Homo Sapiens
FMLMNAQLQ

SEQ ID NO: 280382 - protein, 9 aa, Homo Sapiens
EARKWSSRP

SEQ ID NO: 280383 - protein, 9 aa, Homo Sapiens
APVQYNAQK

SEQ ID NO: 280384 - protein, 9 aa, Homo Sapiens
IKDKILFGT

SEQ ID NO: 280385 - protein, 9 aa, Homo Sapiens
SEKKLSPEK

SEQ ID NO: 280386 - protein, 9 aa, Homo Sapiens
IHFGAFTIK

SEQ ID NO: 280387 - protein, 9 aa, Homo Sapiens
TAQRKRMKM

SEQ ID NO: 280388 - protein, 9 aa, Homo Sapiens
WPCIPDLDF

SEQ ID NO: 280389 - protein, 9 aa, Homo Sapiens
DHFCLGQLS

SEQ ID NO: 280390 - protein, 9 aa, Homo Sapiens
PPVYLLEDG

SEQ ID NO: 280391 - protein, 9 aa, Homo Sapiens
DLTEPCLLH

SEQ ID NO: 280392 - protein, 9 aa, Homo Sapiens
SRADAESWY

SEQ ID NO: 280393 - protein, 9 aa, Homo Sapiens
YYSHFIDEK

SEQ ID NO: 280394 - protein, 9 aa, Homo Sapiens
WIDTFIITL

SEQ ID NO: 280395 - protein, 9 aa, Homo Sapiens
QGDSFLQVE

SEQ ID NO: 280396 - protein, 9 aa, Homo Sapiens
SMLSPNSYY

SEQ ID NO: 280397 - protein, 9 aa, Homo Sapiens
FLTDTQLFP

SEQ ID NO: 280398 - protein, 9 aa, Homo Sapiens
EQVTQNVLI

SEQ ID NO: 280399 - protein, 9 aa, Homo Sapiens
IKFVLSCMN

SEQ ID NO: 280400 - protein, 9 aa, Homo Sapiens
KKFCEACIE

SEQ ID NO: 280401 - protein, 9 aa, Homo Sapiens
YAFGKCPTV

SEQ ID NO: 280402 - protein, 9 aa, Homo Sapiens
IQASGLGRM

SEQ ID NO: 280403 - protein, 9 aa, Homo Sapiens
SESHVVSAL

SEQ ID NO: 280404 - protein, 9 aa, Homo Sapiens
GTMQLESRE

SEQ ID NO: 280405 - protein, 9 aa, Homo Sapiens
LSGIVSKGD

SEQ ID NO: 280406 - protein, 9 aa, Homo Sapiens
QNLLFDNTT

SEQ ID NO: 280407 - protein, 9 aa, Homo Sapiens
NKSPHSDPY

SEQ ID NO: 280408 - protein, 9 aa, Homo Sapiens
NIFEIQTMP

SEQ ID NO: 280409 - protein, 9 aa, Homo Sapiens
LSATVRTVL

SEQ ID NO: 280410 - protein, 9 aa, Homo Sapiens
MANKLSQMD

SEQ ID NO: 280411 - protein, 9 aa, Homo Sapiens
RLHSWADDG

SEQ ID NO: 280412 - protein, 9 aa, Homo Sapiens
TVLESLETF

SEQ ID NO: 280413 - protein, 9 aa, Homo Sapiens
RQRIPYQLG

SEQ ID NO: 280414 - protein, 9 aa, Homo Sapiens
TEGAVRSRL

SEQ ID NO: 280415 - protein, 9 aa, Homo Sapiens
DVKKELTYH

SEQ ID NO: 280416 - protein, 9 aa, Homo Sapiens
QGLREDALS

SEQ ID NO: 280417 - protein, 9 aa, Homo Sapiens
VLCAATPPA

SEQ ID NO: 280418 - protein, 9 aa, Homo Sapiens
PRCITKLAQ

SEQ ID NO: 280419 - protein, 9 aa, Homo Sapiens
NDEIEANLE

SEQ ID NO: 280420 - protein, 9 aa, Homo Sapiens
NREGTETVA

SEQ ID NO: 280421 - protein, 9 aa, Homo Sapiens
FVCGIFFSI

SEQ ID NO: 280422 - protein, 9 aa, Homo Sapiens
QNQIVTDPD

SEQ ID NO: 280423 - protein, 9 aa, Homo Sapiens
RPKDLADLE

SEQ ID NO: 280424 - protein, 9 aa, Homo Sapiens
PILVRLGSS

SEQ ID NO: 280425 - protein, 9 aa, Homo Sapiens
ITKNLLKAA

SEQ ID NO: 280426 - protein, 9 aa, Homo Sapiens
TRQVEKEET

SEQ ID NO: 280427 - protein, 9 aa, Homo Sapiens
ALQREQQVT

SEQ ID NO: 280428 - protein, 9 aa, Homo Sapiens
PNHLAQAVH

SEQ ID NO: 280429 - protein, 9 aa, Homo Sapiens
DAGVMMCPY

SEQ ID NO: 280430 - protein, 9 aa, Homo Sapiens
MQSEQIWKL

SEQ ID NO: 280431 - protein, 9 aa, Homo Sapiens
RWITNPSQP

SEQ ID NO: 280432 - protein, 9 aa, Homo Sapiens
AGKLFLLCG

SEQ ID NO: 280433 - protein, 9 aa, Homo Sapiens
GLREKEQNT

SEQ ID NO: 280434 - protein, 9 aa, Homo Sapiens
ASATPPRPR

SEQ ID NO: 280435 - protein, 9 aa, Homo Sapiens
FGNFFSNMF

SEQ ID NO: 280436 - protein, 9 aa, Homo Sapiens
GPPLVVIHP

SEQ ID NO: 280437 - protein, 9 aa, Homo Sapiens
VIFQAALKN

SEQ ID NO: 280438 - protein, 9 aa, Homo Sapiens
GMRREVVQR

SEQ ID NO: 280439 - protein, 9 aa, Homo Sapiens
QNQESELRT

SEQ ID NO: 280440 - protein, 9 aa, Homo Sapiens
VAFLKAVFT

SEQ ID NO: 280441 - protein, 9 aa, Homo Sapiens
HLSKCWDYR

SEQ ID NO: 280442 - protein, 9 aa, Homo Sapiens
GVSLNSDFI

SEQ ID NO: 280443 - protein, 9 aa, Homo Sapiens
VEQNHQRAS

SEQ ID NO: 280444 - protein, 9 aa, Homo Sapiens
SLFLDNFSI

SEQ ID NO: 280445 - protein, 9 aa, Homo Sapiens
TCTKTPCLP

SEQ ID NO: 280446 - protein, 9 aa, Homo Sapiens
EEPKGADWP

SEQ ID NO: 280447 - protein, 9 aa, Homo Sapiens
TSNFCSLVD

SEQ ID NO: 280448 - protein, 9 aa, Homo Sapiens
KQYMKSLQK

SEQ ID NO: 280449 - protein, 9 aa, Homo Sapiens
DEELNTLLG

SEQ ID NO: 280450 - protein, 9 aa, Homo Sapiens
YLLIAALGM

SEQ ID NO: 280451 - protein, 9 aa, Homo Sapiens
NELEKHRQA

SEQ ID NO: 280452 - protein, 9 aa, Homo Sapiens
IQLTVKLRL

SEQ ID NO: 280453 - protein, 9 aa, Homo Sapiens
HSAILDQKS

SEQ ID NO: 280454 - protein, 9 aa, Homo Sapiens
QGSYDEQST

SEQ ID NO: 280455 - protein, 9 aa, Homo Sapiens
ACYGGFDLC

SEQ ID NO: 280456 - protein, 9 aa, Homo Sapiens
YVVGKANSV

SEQ ID NO: 280457 - protein, 9 aa, Homo Sapiens
KDAKKVANK

SEQ ID NO: 280458 - protein, 9 aa, Homo Sapiens
FRPQNELIP

SEQ ID NO: 280459 - protein, 9 aa, Homo Sapiens
RNVIRMMSL

SEQ ID NO: 280460 - protein, 9 aa, Homo Sapiens
QQLQPGAHF

SEQ ID NO: 280461 - protein, 9 aa, Homo Sapiens
KPTVDLAHT

SEQ ID NO: 280462 - protein, 9 aa, Homo Sapiens
FPTKQSLAN

SEQ ID NO: 280463 - protein, 9 aa, Homo Sapiens
TEFLATLIF

SEQ ID NO: 280464 - protein, 9 aa, Homo Sapiens
PLPPGWVTL

SEQ ID NO: 280465 - protein, 9 aa, Homo Sapiens
FYLETQAEK

SEQ ID NO: 280466 - protein, 9 aa, Homo Sapiens
DLDNGNNSV

SEQ ID NO: 280467 - protein, 9 aa, Homo Sapiens
KLLCERNDK

SEQ ID NO: 280468 - protein, 9 aa, Homo Sapiens
EGRLPMAHP

SEQ ID NO: 280469 - protein, 9 aa, Homo Sapiens
IEMKFNNML

SEQ ID NO: 280470 - protein, 9 aa, Homo Sapiens
EQNNTTEVW

SEQ ID NO: 280471 - protein, 9 aa, Homo Sapiens
GSISASMLL

SEQ ID NO: 280472 - protein, 9 aa, Homo Sapiens
SEETMESRK

SEQ ID NO: 280473 - protein, 9 aa, Homo Sapiens
NQCKESSSF

SEQ ID NO: 280474 - protein, 9 aa, Homo Sapiens
EDNYTCTYV

SEQ ID NO: 280475 - protein, 9 aa, Homo Sapiens
IHLTQHKII

SEQ ID NO: 280476 - protein, 9 aa, Homo Sapiens
DAKAAKDAQ

SEQ ID NO: 280477 - protein, 9 aa, Homo Sapiens
KYRYFFQTL

SEQ ID NO: 280478 - protein, 9 aa, Homo Sapiens
LSQRLQVVA

SEQ ID NO: 280479 - protein, 9 aa, Homo Sapiens
EKWLTQVRN

SEQ ID NO: 280480 - protein, 9 aa, Homo Sapiens
QEGNDYLYE

SEQ ID NO: 280481 - protein, 9 aa, Homo Sapiens
EMQLMAIFK

SEQ ID NO: 280482 - protein, 9 aa, Homo Sapiens
LVKVIGISN

SEQ ID NO: 280483 - protein, 9 aa, Homo Sapiens
KVTGKSDAE

SEQ ID NO: 280484 - protein, 9 aa, Homo Sapiens
KINHNLALG

SEQ ID NO: 280485 - protein, 9 aa, Homo Sapiens
PGVDHVPSS

SEQ ID NO: 280486 - protein, 9 aa, Homo Sapiens
PPLRSQFQA

SEQ ID NO: 280487 - protein, 9 aa, Homo Sapiens
IRSRSVSDY

SEQ ID NO: 280488 - protein, 9 aa, Homo Sapiens
LEEELVCRL

SEQ ID NO: 280489 - protein, 9 aa, Homo Sapiens
LWEVSEGTT

SEQ ID NO: 280490 - protein, 9 aa, Homo Sapiens
SAHKYFPGV

SEQ ID NO: 280491 - protein, 9 aa, Homo Sapiens
SLGYGSMIT

SEQ ID NO: 280492 - protein, 9 aa, Homo Sapiens
NKFAPFIDK

SEQ ID NO: 280493 - protein, 9 aa, Homo Sapiens
NKDRNDGYV

SEQ ID NO: 280494 - protein, 9 aa, Homo Sapiens
DGILTNKKI

SEQ ID NO: 280495 - protein, 9 aa, Homo Sapiens
EESQESNRI

SEQ ID NO: 280496 - protein, 9 aa, Homo Sapiens
LSLNARSSL

SEQ ID NO: 280497 - protein, 9 aa, Homo Sapiens
CNKKAVTDT

SEQ ID NO: 280498 - protein, 9 aa, Homo Sapiens
QYLSLLHAN

SEQ ID NO: 280499 - protein, 9 aa, Homo Sapiens
LMEYSHQEL

SEQ ID NO: 280500 - protein, 9 aa, Homo Sapiens
SLYEYFHMS

SEQ ID NO: 280501 - protein, 9 aa, Homo Sapiens
CLSMTEHVL

SEQ ID NO: 280502 - protein, 9 aa, Homo Sapiens
YGLTFTDKW

SEQ ID NO: 280503 - protein, 9 aa, Homo Sapiens
PQLEEETKE

SEQ ID NO: 280504 - protein, 9 aa, Homo Sapiens
DSLIDRGRT

SEQ ID NO: 280505 - protein, 9 aa, Homo Sapiens
NYAVWFRLY

SEQ ID NO: 280506 - protein, 9 aa, Homo Sapiens
PNYDALVYS

SEQ ID NO: 280507 - protein, 9 aa, Homo Sapiens
VRYEKLFTV

SEQ ID NO: 280508 - protein, 9 aa, Homo Sapiens
SHKHNSSHF

SEQ ID NO: 280509 - protein, 9 aa, Homo Sapiens
LKHLDLAFN

SEQ ID NO: 280510 - protein, 9 aa, Homo Sapiens
WLHVKNVCQ

SEQ ID NO: 280511 - protein, 9 aa, Homo Sapiens
DTLDQLLQN

SEQ ID NO: 280512 - protein, 9 aa, Homo Sapiens
TPIMNAKDV

SEQ ID NO: 280513 - protein, 9 aa, Homo Sapiens
FQSVRKVIQ

SEQ ID NO: 280514 - protein, 9 aa, Homo Sapiens
LNQETSNFC

SEQ ID NO: 280515 - protein, 9 aa, Homo Sapiens
LDEELRRER

SEQ ID NO: 280516 - protein, 9 aa, Homo Sapiens
SSGKKCLPR

SEQ ID NO: 280517 - protein, 9 aa, Homo Sapiens
YYAASPRIC

SEQ ID NO: 280518 - protein, 9 aa, Homo Sapiens
QKDIQSCLT

SEQ ID NO: 280519 - protein, 9 aa, Homo Sapiens
TCGNSNSWD

SEQ ID NO: 280520 - protein, 9 aa, Homo Sapiens
HFRAVFMAV

SEQ ID NO: 280521 - protein, 9 aa, Homo Sapiens
SDGMEVPDD

SEQ ID NO: 280522 - protein, 9 aa, Homo Sapiens
SLLNYAVTV

SEQ ID NO: 280523 - protein, 9 aa, Homo Sapiens
YARSKALSA

SEQ ID NO: 280524 - protein, 9 aa, Homo Sapiens
SRHRVQTEK

SEQ ID NO: 280525 - protein, 9 aa, Homo Sapiens
NSTPAKNID

SEQ ID NO: 280526 - protein, 9 aa, Homo Sapiens
FTPCFNYMH

SEQ ID NO: 280527 - protein, 9 aa, Homo Sapiens
KKSVARLQD

SEQ ID NO: 280528 - protein, 9 aa, Homo Sapiens
SKGLSGMQG

SEQ ID NO: 280529 - protein, 9 aa, Homo Sapiens
NVEARRFFS

SEQ ID NO: 280530 - protein, 9 aa, Homo Sapiens
ASLYGKSWD

SEQ ID NO: 280531 - protein, 9 aa, Homo Sapiens
YIHTHTFYV

SEQ ID NO: 280532 - protein, 9 aa, Homo Sapiens
LELFSKKSD

SEQ ID NO: 280533 - protein, 9 aa, Homo Sapiens
KPVPDKEPN

SEQ ID NO: 280534 - protein, 9 aa, Homo Sapiens
DLALLRSVP

SEQ ID NO: 280535 - protein, 9 aa, Homo Sapiens
ALEISGAQR

SEQ ID NO: 280536 - protein, 9 aa, Homo Sapiens
NNVGVCIYV

SEQ ID NO: 280537 - protein, 9 aa, Homo Sapiens
VDNGLSPVI

SEQ ID NO: 280538 - protein, 9 aa, Homo Sapiens
IEYISEELD

SEQ ID NO: 280539 - protein, 9 aa, Homo Sapiens
MYGLDSRGE

SEQ ID NO: 280540 - protein, 9 aa, Homo Sapiens
CTALCEVIT

SEQ ID NO: 280541 - protein, 9 aa, Homo Sapiens
SLWAGSNMK

SEQ ID NO: 280542 - protein, 9 aa, Homo Sapiens
GKLAMDSFP

SEQ ID NO: 280543 - protein, 9 aa, Homo Sapiens
EWNQQLLRW

SEQ ID NO: 280544 - protein, 9 aa, Homo Sapiens
APRGQFGIP

SEQ ID NO: 280545 - protein, 9 aa, Homo Sapiens
VVAFGVELQ

SEQ ID NO: 280546 - protein, 9 aa, Homo Sapiens
TGKCWVIAS

SEQ ID NO: 280547 - protein, 9 aa, Homo Sapiens
TQCAVVACA

SEQ ID NO: 280548 - protein, 9 aa, Homo Sapiens
HVLMPEVTP

SEQ ID NO: 280549 - protein, 9 aa, Homo Sapiens
AHNAANQGL

SEQ ID NO: 280550 - protein, 9 aa, Homo Sapiens
RVPMNGFAK

SEQ ID NO: 280551 - protein, 9 aa, Homo Sapiens
GGRESKWKR

SEQ ID NO: 280552 - protein, 9 aa, Homo Sapiens
LGEKLFKRD

SEQ ID NO: 280553 - protein, 9 aa, Homo Sapiens
KKPCFDYSQ

SEQ ID NO: 280554 - protein, 9 aa, Homo Sapiens
VPEINLDTD

SEQ ID NO: 280555 - protein, 9 aa, Homo Sapiens
LIIHMRIHD

SEQ ID NO: 280556 - protein, 9 aa, Homo Sapiens
ANTCNAVIQ

SEQ ID NO: 280557 - protein, 9 aa, Homo Sapiens
EFPDVDEET

SEQ ID NO: 280558 - protein, 9 aa, Homo Sapiens
AKWLTSKKN

SEQ ID NO: 280559 - protein, 9 aa, Homo Sapiens
ITLYEDRAF

SEQ ID NO: 280560 - protein, 9 aa, Homo Sapiens
SANPVALQC

SEQ ID NO: 280561 - protein, 9 aa, Homo Sapiens
VNLLSKSLS

SEQ ID NO: 280562 - protein, 9 aa, Homo Sapiens
AIYFIDCVR

SEQ ID NO: 280563 - protein, 9 aa, Homo Sapiens
QWNQIFSKN

SEQ ID NO: 280564 - protein, 9 aa, Homo Sapiens
SGAQQWMTQ

SEQ ID NO: 280565 - protein, 9 aa, Homo Sapiens
EAQPSKVSE

SEQ ID NO: 280566 - protein, 9 aa, Homo Sapiens
LLEKLENKI

SEQ ID NO: 280567 - protein, 9 aa, Homo Sapiens
GGVYWICNN

SEQ ID NO: 280568 - protein, 9 aa, Homo Sapiens
RNRTERLSA

SEQ ID NO: 280569 - protein, 9 aa, Homo Sapiens
WNCSCDLLS

SEQ ID NO: 280570 - protein, 9 aa, Homo Sapiens
LPSIGVSTV

SEQ ID NO: 280571 - protein, 9 aa, Homo Sapiens
TIKDKILFG

SEQ ID NO: 280572 - protein, 9 aa, Homo Sapiens
RELPCLKSR

SEQ ID NO: 280573 - protein, 9 aa, Homo Sapiens
SFLYSVLIA

SEQ ID NO: 280574 - protein, 9 aa, Homo Sapiens
RMSQMLEDR

SEQ ID NO: 280575 - protein, 9 aa, Homo Sapiens
VQKSSGGKS

SEQ ID NO: 280576 - protein, 9 aa, Homo Sapiens
LRNVIIITW

SEQ ID NO: 280577 - protein, 9 aa, Homo Sapiens
LLQFIFQTD

SEQ ID NO: 280578 - protein, 9 aa, Homo Sapiens
GSSFKMTTG

SEQ ID NO: 280579 - protein, 9 aa, Homo Sapiens
ETSPNHPGF

SEQ ID NO: 280580 - protein, 9 aa, Homo Sapiens
KLWLSHRPA

SEQ ID NO: 280581 - protein, 9 aa, Homo Sapiens
CIWNKIQCV

SEQ ID NO: 280582 - protein, 9 aa, Homo Sapiens
DQVQVMPLQ

SEQ ID NO: 280583 - protein, 9 aa, Homo Sapiens
DLSFNRIEH

SEQ ID NO: 280584 - protein, 9 aa, Homo Sapiens
QIQTSRNID

SEQ ID NO: 280585 - protein, 9 aa, Homo Sapiens
LIIYTDEAA

SEQ ID NO: 280586 - protein, 9 aa, Homo Sapiens
TAVAEFIIL

SEQ ID NO: 280587 - protein, 9 aa, Homo Sapiens
DLNSVVCQQ

SEQ ID NO: 280588 - protein, 9 aa, Homo Sapiens
NTRVTGDHV

SEQ ID NO: 280589 - protein, 9 aa, Homo Sapiens
GMDNDTNNL

SEQ ID NO: 280590 - protein, 9 aa, Homo Sapiens
NCAEVNIFP

SEQ ID NO: 280591 - protein, 9 aa, Homo Sapiens
IKNCKHQIK

SEQ ID NO: 280592 - protein, 9 aa, Homo Sapiens
VVLYLGKTF

SEQ ID NO: 280593 - protein, 9 aa, Homo Sapiens
DYKDQSAWT

SEQ ID NO: 280594 - protein, 9 aa, Homo Sapiens
AKNYSAVIQ

SEQ ID NO: 280595 - protein, 9 aa, Homo Sapiens
YRHERRKRY

SEQ ID NO: 280596 - protein, 9 aa, Homo Sapiens
NHNSDLIGF

SEQ ID NO: 280597 - protein, 9 aa, Homo Sapiens
DEMYDKYID

SEQ ID NO: 280598 - protein, 9 aa, Homo Sapiens
PNECVVSEW

SEQ ID NO: 280599 - protein, 9 aa, Homo Sapiens
FKNVCSGEN

SEQ ID NO: 280600 - protein, 9 aa, Homo Sapiens
AIPSEVKSE

SEQ ID NO: 280601 - protein, 9 aa, Homo Sapiens
LGLLAVLGP

SEQ ID NO: 280602 - protein, 9 aa, Homo Sapiens
SPLATKEII

SEQ ID NO: 280603 - protein, 9 aa, Homo Sapiens
SLNARSSLS

SEQ ID NO: 280604 - protein, 9 aa, Homo Sapiens
VRSLVRRHI

SEQ ID NO: 280605 - protein, 9 aa, Homo Sapiens
YPAGRAQPV

SEQ ID NO: 280606 - protein, 9 aa, Homo Sapiens
QDKLGEDDK

SEQ ID NO: 280607 - protein, 9 aa, Homo Sapiens
RTAISGIRP

SEQ ID NO: 280608 - protein, 9 aa, Homo Sapiens
YLVAGTPWP

SEQ ID NO: 280609 - protein, 9 aa, Homo Sapiens
VLDSELFLD

SEQ ID NO: 280610 - protein, 9 aa, Homo Sapiens
PVQIEKELS

SEQ ID NO: 280611 - protein, 9 aa, Homo Sapiens
EHVDTFEAS

SEQ ID NO: 280612 - protein, 9 aa, Homo Sapiens
ETYPNGSQD

SEQ ID NO: 280613 - protein, 9 aa, Homo Sapiens
GFIQERELC

SEQ ID NO: 280614 - protein, 9 aa, Homo Sapiens
GAPLKVYHQ

SEQ ID NO: 280615 - protein, 9 aa, Homo Sapiens
EFQKTEDMK

SEQ ID NO: 280616 - protein, 9 aa, Homo Sapiens
LNREGTETV

SEQ ID NO: 280617 - protein, 9 aa, Homo Sapiens
DGVRVSAAT

SEQ ID NO: 280618 - protein, 9 aa, Homo Sapiens
FALGFVKLP

SEQ ID NO: 280619 - protein, 9 aa, Homo Sapiens
ISDDHLIPI

SEQ ID NO: 280620 - protein, 9 aa, Homo Sapiens
CQDPRFDAE

SEQ ID NO: 280621 - protein, 9 aa, Homo Sapiens
RVRNSLTIY

SEQ ID NO: 280622 - protein, 9 aa, Homo Sapiens
WIAFQSNCY

SEQ ID NO: 280623 - protein, 9 aa, Homo Sapiens
ALGILQCFI

SEQ ID NO: 280624 - protein, 9 aa, Homo Sapiens
AHTLVTCWG

SEQ ID NO: 280625 - protein, 9 aa, Homo Sapiens
LCIAFYRYA

SEQ ID NO: 280626 - protein, 9 aa, Homo Sapiens
PGYQSRYIL

SEQ ID NO: 280627 - protein, 9 aa, Homo Sapiens
ITHATVEDS

SEQ ID NO: 280628 - protein, 9 aa, Homo Sapiens
QPSPFLPVR

SEQ ID NO: 280629 - protein, 9 aa, Homo Sapiens
QPPSYHNKP

SEQ ID NO: 280630 - protein, 9 aa, Homo Sapiens
YDMNRWLNR

SEQ ID NO: 280631 - protein, 9 aa, Homo Sapiens
AQLRVFGTG

SEQ ID NO: 280632 - protein, 9 aa, Homo Sapiens
DKMKMGQEF

SEQ ID NO: 280633 - protein, 9 aa, Homo Sapiens
KEEVKEEII

SEQ ID NO: 280634 - protein, 9 aa, Homo Sapiens
LNAKLQQQL

SEQ ID NO: 280635 - protein, 9 aa, Homo Sapiens
LCLECEKTY

SEQ ID NO: 280636 - protein, 9 aa, Homo Sapiens
LYFRVPVRA

SEQ ID NO: 280637 - protein, 9 aa, Homo Sapiens
DLQQLETCI

SEQ ID NO: 280638 - protein, 9 aa, Homo Sapiens
KSPVREEPG

SEQ ID NO: 280639 - protein, 9 aa, Homo Sapiens
NTSRHTSEK

SEQ ID NO: 280640 - protein, 9 aa, Homo Sapiens
DARRIGKDC

SEQ ID NO: 280641 - protein, 9 aa, Homo Sapiens
PQLIFKKGS

SEQ ID NO: 280642 - protein, 9 aa, Homo Sapiens
QIDNINLTN

SEQ ID NO: 280643 - protein, 9 aa, Homo Sapiens
VIITNAGWS

SEQ ID NO: 280644 - protein, 9 aa, Homo Sapiens
SHSDRCWMP

SEQ ID NO: 280645 - protein, 9 aa, Homo Sapiens
ESFQAIHQF

SEQ ID NO: 280646 - protein, 9 aa, Homo Sapiens
AGISDDDSL

SEQ ID NO: 280647 - protein, 9 aa, Homo Sapiens
FVADGLQAD

SEQ ID NO: 280648 - protein, 9 aa, Homo Sapiens
CNSLESVEF

SEQ ID NO: 280649 - protein, 9 aa, Homo Sapiens
AAALIILNS

SEQ ID NO: 280650 - protein, 9 aa, Homo Sapiens
SHVNLPATK

SEQ ID NO: 280651 - protein, 9 aa, Homo Sapiens
VWLPSKHIW

SEQ ID NO: 280652 - protein, 9 aa, Homo Sapiens
FIGSANFGE

SEQ ID NO: 280653 - protein, 9 aa, Homo Sapiens
KHKTRHTGE

SEQ ID NO: 280654 - protein, 9 aa, Homo Sapiens
STFSHLRYF

SEQ ID NO: 280655 - protein, 9 aa, Homo Sapiens
LSIVTQEEA

SEQ ID NO: 280656 - protein, 9 aa, Homo Sapiens
RKQRRREIW

SEQ ID NO: 280657 - protein, 9 aa, Homo Sapiens
SQISSKENE

SEQ ID NO: 280658 - protein, 9 aa, Homo Sapiens
YWKLDYKAV

SEQ ID NO: 280659 - protein, 9 aa, Homo Sapiens
TGIIIVMSA

SEQ ID NO: 280660 - protein, 9 aa, Homo Sapiens
SKVRTLKKC

SEQ ID NO: 280661 - protein, 9 aa, Homo Sapiens
EMKCQKIQR

SEQ ID NO: 280662 - protein, 9 aa, Homo Sapiens
RKRRRVKGD

SEQ ID NO: 280663 - protein, 9 aa, Homo Sapiens
CTNSATGIF

SEQ ID NO: 280664 - protein, 9 aa, Homo Sapiens
SKDKNILHI

SEQ ID NO: 280665 - protein, 9 aa, Homo Sapiens
QRIVKSIEI

SEQ ID NO: 280666 - protein, 9 aa, Homo Sapiens
TRKSVVAYQ

SEQ ID NO: 280667 - protein, 9 aa, Homo Sapiens
SCINKIENW

SEQ ID NO: 280668 - protein, 9 aa, Homo Sapiens
IIGLLIVHK

SEQ ID NO: 280669 - protein, 9 aa, Homo Sapiens
QPNENTGEI

SEQ ID NO: 280670 - protein, 9 aa, Homo Sapiens
LQGLDALLE

SEQ ID NO: 280671 - protein, 9 aa, Homo Sapiens
RTYLRMPRQ

SEQ ID NO: 280672 - protein, 9 aa, Homo Sapiens
HIPRFSPAT

SEQ ID NO: 280673 - protein, 9 aa, Homo Sapiens
LGKITDYGK

SEQ ID NO: 280674 - protein, 9 aa, Homo Sapiens
LAAATSFTH

SEQ ID NO: 280675 - protein, 9 aa, Homo Sapiens
IYISRLKES

SEQ ID NO: 280676 - protein, 9 aa, Homo Sapiens
YAQKQLSEE

SEQ ID NO: 280677 - protein, 9 aa, Homo Sapiens
TTSKPYINS

SEQ ID NO: 280678 - protein, 9 aa, Homo Sapiens
RFALTNIKI

SEQ ID NO: 280679 - protein, 9 aa, Homo Sapiens
AILMTIVLL

SEQ ID NO: 280680 - protein, 9 aa, Homo Sapiens
TLMTEEETQ

SEQ ID NO: 280681 - protein, 9 aa, Homo Sapiens
CNLEYHSSW

SEQ ID NO: 280682 - protein, 9 aa, Homo Sapiens
QKTAQLLYL

SEQ ID NO: 280683 - protein, 9 aa, Homo Sapiens
GSKVGVHIN

SEQ ID NO: 280684 - protein, 9 aa, Homo Sapiens
IYDRKELLL

SEQ ID NO: 280685 - protein, 9 aa, Homo Sapiens
TWSIIMNSV

SEQ ID NO: 280686 - protein, 9 aa, Homo Sapiens
VDVAQVRNS

SEQ ID NO: 280687 - protein, 9 aa, Homo Sapiens
CRMKWLIDE

SEQ ID NO: 280688 - protein, 9 aa, Homo Sapiens
NPQRKALLH

SEQ ID NO: 280689 - protein, 9 aa, Homo Sapiens
VFDVQRKGT

SEQ ID NO: 280690 - protein, 9 aa, Homo Sapiens
LVCMVTVCA

SEQ ID NO: 280691 - protein, 9 aa, Homo Sapiens
DLLIHQKVH

SEQ ID NO: 280692 - protein, 9 aa, Homo Sapiens
HRGVQAGWL

SEQ ID NO: 280693 - protein, 9 aa, Homo Sapiens
LTKSLEYPR

SEQ ID NO: 280694 - protein, 9 aa, Homo Sapiens
ASPVVVVAF

SEQ ID NO: 280695 - protein, 9 aa, Homo Sapiens
CPCKESETC

SEQ ID NO: 280696 - protein, 9 aa, Homo Sapiens
SLKIWSVTR

SEQ ID NO: 280697 - protein, 9 aa, Homo Sapiens
DWREGPAQM

SEQ ID NO: 280698 - protein, 9 aa, Homo Sapiens
YWDFYIFEL

SEQ ID NO: 280699 - protein, 9 aa, Homo Sapiens
PICATRWSS

SEQ ID NO: 280700 - protein, 9 aa, Homo Sapiens
RIEERNEEL

SEQ ID NO: 280701 - protein, 9 aa, Homo Sapiens
ATQQSPLMV

SEQ ID NO: 280702 - protein, 9 aa, Homo Sapiens
QMDSPTQIS

SEQ ID NO: 280703 - protein, 9 aa, Homo Sapiens
RIGKDPAHF

SEQ ID NO: 280704 - protein, 9 aa, Homo Sapiens
QFTQLITLP

SEQ ID NO: 280705 - protein, 9 aa, Homo Sapiens
LKTCDCFSP

SEQ ID NO: 280706 - protein, 9 aa, Homo Sapiens
PLVYMPTHL

SEQ ID NO: 280707 - protein, 9 aa, Homo Sapiens
GKLYFADYE

SEQ ID NO: 280708 - protein, 9 aa, Homo Sapiens
EHDDQSLVK

SEQ ID NO: 280709 - protein, 9 aa, Homo Sapiens
DCRERVVLG

SEQ ID NO: 280710 - protein, 9 aa, Homo Sapiens
SQITNLNYD

SEQ ID NO: 280711 - protein, 9 aa, Homo Sapiens
LYFSYLCVP

SEQ ID NO: 280712 - protein, 9 aa, Homo Sapiens
HYIARVKDP

SEQ ID NO: 280713 - protein, 9 aa, Homo Sapiens
GAMTDAVRV

SEQ ID NO: 280714 - protein, 9 aa, Homo Sapiens
FGKEQAAKN

SEQ ID NO: 280715 - protein, 9 aa, Homo Sapiens
VTTLRCRAF

SEQ ID NO: 280716 - protein, 9 aa, Homo Sapiens
TPTLQYYLS

SEQ ID NO: 280717 - protein, 9 aa, Homo Sapiens
FSSYHNNEK

SEQ ID NO: 280718 - protein, 9 aa, Homo Sapiens
HDLEKTSIT

SEQ ID NO: 280719 - protein, 9 aa, Homo Sapiens
QERIEASNW

SEQ ID NO: 280720 - protein, 9 aa, Homo Sapiens
AKQGTSSTI

SEQ ID NO: 280721 - protein, 9 aa, Homo Sapiens
KAIKQCLWF

SEQ ID NO: 280722 - protein, 9 aa, Homo Sapiens
TKAFKFKVL

SEQ ID NO: 280723 - protein, 9 aa, Homo Sapiens
TLDYFGEEA

SEQ ID NO: 280724 - protein, 9 aa, Homo Sapiens
SLLENKPVA

SEQ ID NO: 280725 - protein, 9 aa, Homo Sapiens
FSGATMLIH

SEQ ID NO: 280726 - protein, 9 aa, Homo Sapiens
KPINYQLEL

SEQ ID NO: 280727 - protein, 9 aa, Homo Sapiens
ANMTDDITT

SEQ ID NO: 280728 - protein, 9 aa, Homo Sapiens
MSCVKGWGA

SEQ ID NO: 280729 - protein, 9 aa, Homo Sapiens
VRMNMIGLV

SEQ ID NO: 280730 - protein, 9 aa, Homo Sapiens
ERMNVDKVI

SEQ ID NO: 280731 - protein, 9 aa, Homo Sapiens
NASTIIRSK

SEQ ID NO: 280732 - protein, 9 aa, Homo Sapiens
QYLLPGRVY

SEQ ID NO: 280733 - protein, 9 aa, Homo Sapiens
LESRLELQA

SEQ ID NO: 280734 - protein, 9 aa, Homo Sapiens
PAFSYKPWF

SEQ ID NO: 280735 - protein, 9 aa, Homo Sapiens
LELGQCKKT

SEQ ID NO: 280736 - protein, 9 aa, Homo Sapiens
FFFHLGVKA

SEQ ID NO: 280737 - protein, 9 aa, Homo Sapiens
PTVVTVTCS

SEQ ID NO: 280738 - protein, 9 aa, Homo Sapiens
TSSPAAGSP

SEQ ID NO: 280739 - protein, 9 aa, Homo Sapiens
LSQYYCSKT

SEQ ID NO: 280740 - protein, 9 aa, Homo Sapiens
SSSVVMGDN

SEQ ID NO: 280741 - protein, 9 aa, Homo Sapiens
TIAPKFIIY

SEQ ID NO: 280742 - protein, 9 aa, Homo Sapiens
KHLIFRENT

SEQ ID NO: 280743 - protein, 9 aa, Homo Sapiens
NLARHCRIH

SEQ ID NO: 280744 - protein, 9 aa, Homo Sapiens
FLQPAALAA

SEQ ID NO: 280745 - protein, 9 aa, Homo Sapiens
RLESESRST

SEQ ID NO: 280746 - protein, 9 aa, Homo Sapiens
ITSHLGNVH

SEQ ID NO: 280747 - protein, 9 aa, Homo Sapiens
MVHLLSNKK

SEQ ID NO: 280748 - protein, 9 aa, Homo Sapiens
RKLSSILTN

SEQ ID NO: 280749 - protein, 9 aa, Homo Sapiens
CYLAASVFT

SEQ ID NO: 280750 - protein, 9 aa, Homo Sapiens
PTNIVPPAT

SEQ ID NO: 280751 - protein, 9 aa, Homo Sapiens
KVLLYLDMQ

SEQ ID NO: 280752 - protein, 9 aa, Homo Sapiens
LAIATYPKS

SEQ ID NO: 280753 - protein, 9 aa, Homo Sapiens
ARTRLERHL

SEQ ID NO: 280754 - protein, 9 aa, Homo Sapiens
GKDDALSHL

SEQ ID NO: 280755 - protein, 9 aa, Homo Sapiens
PELSFFNPV

SEQ ID NO: 280756 - protein, 9 aa, Homo Sapiens
YRWVREKRR

SEQ ID NO: 280757 - protein, 9 aa, Homo Sapiens
RVQAVVMTR

SEQ ID NO: 280758 - protein, 9 aa, Homo Sapiens
PKTMKTFLH

SEQ ID NO: 280759 - protein, 9 aa, Homo Sapiens
RLEQEVAWQ

SEQ ID NO: 280760 - protein, 9 aa, Homo Sapiens
VMNHGCSYT

SEQ ID NO: 280761 - protein, 9 aa, Homo Sapiens
RGYDCGYDR

SEQ ID NO: 280762 - protein, 9 aa, Homo Sapiens
FQKEQRELV

SEQ ID NO: 280763 - protein, 9 aa, Homo Sapiens
SHSNLNGQH

SEQ ID NO: 280764 - protein, 9 aa, Homo Sapiens
LGTSIICNK

SEQ ID NO: 280765 - protein, 9 aa, Homo Sapiens
IFARGKRNG

SEQ ID NO: 280766 - protein, 9 aa, Homo Sapiens
VIELGGTSL

SEQ ID NO: 280767 - protein, 9 aa, Homo Sapiens
MNEQDFCKI

SEQ ID NO: 280768 - protein, 9 aa, Homo Sapiens
AQLQLERQL

SEQ ID NO: 280769 - protein, 9 aa, Homo Sapiens
PTKEKEAES

SEQ ID NO: 280770 - protein, 9 aa, Homo Sapiens
CRDMGYKTN

SEQ ID NO: 280771 - protein, 9 aa, Homo Sapiens
RRAQDESLK

SEQ ID NO: 280772 - protein, 9 aa, Homo Sapiens
VDKLEHHFT

SEQ ID NO: 280773 - protein, 9 aa, Homo Sapiens
LIYSLRNTE

SEQ ID NO: 280774 - protein, 9 aa, Homo Sapiens
YSLIVVGHS

SEQ ID NO: 280775 - protein, 9 aa, Homo Sapiens
HIAEKPYKC

SEQ ID NO: 280776 - protein, 9 aa, Homo Sapiens
NYYLQVSLK

SEQ ID NO: 280777 - protein, 9 aa, Homo Sapiens
IAHAEKASK

SEQ ID NO: 280778 - protein, 9 aa, Homo Sapiens
EDTYELDIL

SEQ ID NO: 280779 - protein, 9 aa, Homo Sapiens
STVEPKEPA

SEQ ID NO: 280780 - protein, 9 aa, Homo Sapiens
HYFIIINCG

SEQ ID NO: 280781 - protein, 9 aa, Homo Sapiens
LPTNCLTLW

SEQ ID NO: 280782 - protein, 9 aa, Homo Sapiens
VPQDGAEVM

SEQ ID NO: 280783 - protein, 9 aa, Homo Sapiens
EKEDILKKQ

SEQ ID NO: 280784 - protein, 9 aa, Homo Sapiens
FIIINCGAN

SEQ ID NO: 280785 - protein, 9 aa, Homo Sapiens
FCFRFCIHH

SEQ ID NO: 280786 - protein, 9 aa, Homo Sapiens
RRKARSLPD

SEQ ID NO: 280787 - protein, 9 aa, Homo Sapiens
ALTKVVGRV

SEQ ID NO: 280788 - protein, 9 aa, Homo Sapiens
DVPGPPRVP

SEQ ID NO: 280789 - protein, 9 aa, Homo Sapiens
EKIKLGSTE

SEQ ID NO: 280790 - protein, 9 aa, Homo Sapiens
REALRHLDV

SEQ ID NO: 280791 - protein, 9 aa, Homo Sapiens
KIEIRAQVA

SEQ ID NO: 280792 - protein, 9 aa, Homo Sapiens
SATDSFNHK

SEQ ID NO: 280793 - protein, 9 aa, Homo Sapiens
VAQLDFYHF

SEQ ID NO: 280794 - protein, 9 aa, Homo Sapiens
WKVPDEILA

SEQ ID NO: 280795 - protein, 9 aa, Homo Sapiens
KYTKKKSDQ

SEQ ID NO: 280796 - protein, 9 aa, Homo Sapiens
LSVVTSEIN

SEQ ID NO: 280797 - protein, 9 aa, Homo Sapiens
KHLQINQMF

SEQ ID NO: 280798 - protein, 9 aa, Homo Sapiens
QIGERIQVI

SEQ ID NO: 280799 - protein, 9 aa, Homo Sapiens
SFLLGKYIY

SEQ ID NO: 280800 - protein, 9 aa, Homo Sapiens
GAVDMLVNS

SEQ ID NO: 280801 - protein, 9 aa, Homo Sapiens
TQDFFDEPT

SEQ ID NO: 280802 - protein, 9 aa, Homo Sapiens
KFCFINHQC

SEQ ID NO: 280803 - protein, 9 aa, Homo Sapiens
LGITSILYY

SEQ ID NO: 280804 - protein, 9 aa, Homo Sapiens
LDEGGHFKK

SEQ ID NO: 280805 - protein, 9 aa, Homo Sapiens
DIEDLFSLS

SEQ ID NO: 280806 - protein, 9 aa, Homo Sapiens
LTGAIKVFV

SEQ ID NO: 280807 - protein, 9 aa, Homo Sapiens
LSFALERIG

SEQ ID NO: 280808 - protein, 9 aa, Homo Sapiens
GESITASLG

SEQ ID NO: 280809 - protein, 9 aa, Homo Sapiens
KLSENTDCL

SEQ ID NO: 280810 - protein, 9 aa, Homo Sapiens
RLQLDEELR

SEQ ID NO: 280811 - protein, 9 aa, Homo Sapiens
IELGGTSLQ

SEQ ID NO: 280812 - protein, 9 aa, Homo Sapiens
YSKKKEDDV

SEQ ID NO: 280813 - protein, 9 aa, Homo Sapiens
LTSKKNVFR

SEQ ID NO: 280814 - protein, 9 aa, Homo Sapiens
ARENIQRLF

SEQ ID NO: 280815 - protein, 9 aa, Homo Sapiens
LRKLLENSG

SEQ ID NO: 280816 - protein, 9 aa, Homo Sapiens
RSDSKLEIP

SEQ ID NO: 280817 - protein, 9 aa, Homo Sapiens
KKGTVPWFP

SEQ ID NO: 280818 - protein, 9 aa, Homo Sapiens
ALHFSFSQK

SEQ ID NO: 280819 - protein, 9 aa, Homo Sapiens
YVRKHEITH

SEQ ID NO: 280820 - protein, 9 aa, Homo Sapiens
ELPSHPKKK

SEQ ID NO: 280821 - protein, 9 aa, Homo Sapiens
MSMAGCATQ

SEQ ID NO: 280822 - protein, 9 aa, Homo Sapiens
YATWSIIMN

SEQ ID NO: 280823 - protein, 9 aa, Homo Sapiens
LMEKDSLPH

SEQ ID NO: 280824 - protein, 9 aa, Homo Sapiens
EFVEHHIMH

SEQ ID NO: 280825 - protein, 9 aa, Homo Sapiens
VQDCSFVVC

SEQ ID NO: 280826 - protein, 9 aa, Homo Sapiens
DSLNDFVTQ

SEQ ID NO: 280827 - protein, 9 aa, Homo Sapiens
SCFSIHKTQ

SEQ ID NO: 280828 - protein, 9 aa, Homo Sapiens
MLACFLDTR

SEQ ID NO: 280829 - protein, 9 aa, Homo Sapiens
PNAVVGQYT

SEQ ID NO: 280830 - protein, 9 aa, Homo Sapiens
MDNKRCARH

SEQ ID NO: 280831 - protein, 9 aa, Homo Sapiens
NGAVVKYET

SEQ ID NO: 280832 - protein, 9 aa, Homo Sapiens
ELKTELHST

SEQ ID NO: 280833 - protein, 9 aa, Homo Sapiens
SESMNDRNY

SEQ ID NO: 280834 - protein, 9 aa, Homo Sapiens
LNTVFLRYE

SEQ ID NO: 280835 - protein, 9 aa, Homo Sapiens
SSSLIIHKI

SEQ ID NO: 280836 - protein, 9 aa, Homo Sapiens
GQFRPKVSM

SEQ ID NO: 280837 - protein, 9 aa, Homo Sapiens
TQSSGYISN

SEQ ID NO: 280838 - protein, 9 aa, Homo Sapiens
VKALLVLLL

SEQ ID NO: 280839 - protein, 9 aa, Homo Sapiens
LRSKFGTVS

SEQ ID NO: 280840 - protein, 9 aa, Homo Sapiens
KMFIGSANF

SEQ ID NO: 280841 - protein, 9 aa, Homo Sapiens
DNGLSPVIF

SEQ ID NO: 280842 - protein, 9 aa, Homo Sapiens
RNLTCRALR

SEQ ID NO: 280843 - protein, 9 aa, Homo Sapiens
RPINAHSPG

SEQ ID NO: 280844 - protein, 9 aa, Homo Sapiens
LCKRKEIRE

SEQ ID NO: 280845 - protein, 9 aa, Homo Sapiens
TKSIYYLGV

SEQ ID NO: 280846 - protein, 9 aa, Homo Sapiens
LSSFQRHMI

SEQ ID NO: 280847 - protein, 9 aa, Homo Sapiens
LEESYQEQK

SEQ ID NO: 280848 - protein, 9 aa, Homo Sapiens
TNLNYDTNL

SEQ ID NO: 280849 - protein, 9 aa, Homo Sapiens
EDKHARQAA

SEQ ID NO: 280850 - protein, 9 aa, Homo Sapiens
LNHSANQLS

SEQ ID NO: 280851 - protein, 9 aa, Homo Sapiens
DPDNSGLTL

SEQ ID NO: 280852 - protein, 9 aa, Homo Sapiens
QAKENIFQA

SEQ ID NO: 280853 - protein, 9 aa, Homo Sapiens
QINNLMSQL

SEQ ID NO: 280854 - protein, 9 aa, Homo Sapiens
FGSTPTLDK

SEQ ID NO: 280855 - protein, 9 aa, Homo Sapiens
VRYPIKRNS

SEQ ID NO: 280856 - protein, 9 aa, Homo Sapiens
RPTLIRHQN

SEQ ID NO: 280857 - protein, 9 aa, Homo Sapiens
GNSHTETSK

SEQ ID NO: 280858 - protein, 9 aa, Homo Sapiens
KQRASKVLG

SEQ ID NO: 280859 - protein, 9 aa, Homo Sapiens
CMPYTTYLV

SEQ ID NO: 280860 - protein, 9 aa, Homo Sapiens
DGEIILGLG

SEQ ID NO: 280861 - protein, 9 aa, Homo Sapiens
YSHQELLRK

SEQ ID NO: 280862 - protein, 9 aa, Homo Sapiens
KSHAGENSL

SEQ ID NO: 280863 - protein, 9 aa, Homo Sapiens
FTQKSELIT

SEQ ID NO: 280864 - protein, 9 aa, Homo Sapiens
SLLQSRLGD

SEQ ID NO: 280865 - protein, 9 aa, Homo Sapiens
SKPRSLWFT

SEQ ID NO: 280866 - protein, 9 aa, Homo Sapiens
GPTLDEFLN

SEQ ID NO: 280867 - protein, 9 aa, Homo Sapiens
YLLSGKKNQ

SEQ ID NO: 280868 - protein, 9 aa, Homo Sapiens
QLRPNDSHM

SEQ ID NO: 280869 - protein, 9 aa, Homo Sapiens
GGGDNDSEN

SEQ ID NO: 280870 - protein, 9 aa, Homo Sapiens
SQVFCLYLQ

SEQ ID NO: 280871 - protein, 9 aa, Homo Sapiens
WSVCYSVFF

SEQ ID NO: 280872 - protein, 9 aa, Homo Sapiens
VKIERDAQE

SEQ ID NO: 280873 - protein, 9 aa, Homo Sapiens
RERSDCERM

SEQ ID NO: 280874 - protein, 9 aa, Homo Sapiens
ENYPLNLQP

SEQ ID NO: 280875 - protein, 9 aa, Homo Sapiens
GEVLVFVNP

SEQ ID NO: 280876 - protein, 9 aa, Homo Sapiens
RDCAANTLI

SEQ ID NO: 280877 - protein, 9 aa, Homo Sapiens
HPSNLQLQR

SEQ ID NO: 280878 - protein, 9 aa, Homo Sapiens
MDAEIRRIK

SEQ ID NO: 280879 - protein, 9 aa, Homo Sapiens
CQNNSFPYE

SEQ ID NO: 280880 - protein, 9 aa, Homo Sapiens
SPDLVGPST

SEQ ID NO: 280881 - protein, 9 aa, Homo Sapiens
LCHTLRDVI

SEQ ID NO: 280882 - protein, 9 aa, Homo Sapiens
YSKRAILNV

SEQ ID NO: 280883 - protein, 9 aa, Homo Sapiens
FSSVVALGT

SEQ ID NO: 280884 - protein, 9 aa, Homo Sapiens
ASRMSFCEL

SEQ ID NO: 280885 - protein, 9 aa, Homo Sapiens
TSSTSNVSS

SEQ ID NO: 280886 - protein, 9 aa, Homo Sapiens
QDGWEWIKA

SEQ ID NO: 280887 - protein, 9 aa, Homo Sapiens
VSSSTLQSV

SEQ ID NO: 280888 - protein, 9 aa, Homo Sapiens
KFNSRMNNK

SEQ ID NO: 280889 - protein, 9 aa, Homo Sapiens
QDCSFVVCT

SEQ ID NO: 280890 - protein, 9 aa, Homo Sapiens
SLGMQGRLC

SEQ ID NO: 280891 - protein, 9 aa, Homo Sapiens
LKLCLNWII

SEQ ID NO: 280892 - protein, 9 aa, Homo Sapiens
GGVTEWYKL

SEQ ID NO: 280893 - protein, 9 aa, Homo Sapiens
TPTYMAPEI

SEQ ID NO: 280894 - protein, 9 aa, Homo Sapiens
EEGTGNATG

SEQ ID NO: 280895 - protein, 9 aa, Homo Sapiens
EKMHKVSFQ

SEQ ID NO: 280896 - protein, 9 aa, Homo Sapiens
APKKNKNKG

SEQ ID NO: 280897 - protein, 9 aa, Homo Sapiens
RTTLIIHMR

SEQ ID NO: 280898 - protein, 9 aa, Homo Sapiens
EESNESAEY

SEQ ID NO: 280899 - protein, 9 aa, Homo Sapiens
NPLDRPTFS

SEQ ID NO: 280900 - protein, 9 aa, Homo Sapiens
INRLALLIT

SEQ ID NO: 280901 - protein, 9 aa, Homo Sapiens
KDKWMLDLN

SEQ ID NO: 280902 - protein, 9 aa, Homo Sapiens
KLYGSNGPQ

SEQ ID NO: 280903 - protein, 9 aa, Homo Sapiens
KFNTDELNF

SEQ ID NO: 280904 - protein, 9 aa, Homo Sapiens
EEEKLVISK

SEQ ID NO: 280905 - protein, 9 aa, Homo Sapiens
VVGLFFGID

SEQ ID NO: 280906 - protein, 9 aa, Homo Sapiens
NNSSAAWDE

SEQ ID NO: 280907 - protein, 9 aa, Homo Sapiens
SAANLNGEP

SEQ ID NO: 280908 - protein, 9 aa, Homo Sapiens
DKRCCIPNT

SEQ ID NO: 280909 - protein, 9 aa, Homo Sapiens
EPLFQYQII

SEQ ID NO: 280910 - protein, 9 aa, Homo Sapiens
TRLFKLLME

SEQ ID NO: 280911 - protein, 9 aa, Homo Sapiens
ELNSLLRYK

SEQ ID NO: 280912 - protein, 9 aa, Homo Sapiens
FCYMLPLVL

SEQ ID NO: 280913 - protein, 9 aa, Homo Sapiens
GVDISLLRC

SEQ ID NO: 280914 - protein, 9 aa, Homo Sapiens
GAMTHKNKD

SEQ ID NO: 280915 - protein, 9 aa, Homo Sapiens
RKESKVMCT

SEQ ID NO: 280916 - protein, 9 aa, Homo Sapiens
TISVPVPPG

SEQ ID NO: 280917 - protein, 9 aa, Homo Sapiens
SDLIEHQII

SEQ ID NO: 280918 - protein, 9 aa, Homo Sapiens
CLNITHKAK

SEQ ID NO: 280919 - protein, 9 aa, Homo Sapiens
IACPSIGSG

SEQ ID NO: 280920 - protein, 9 aa, Homo Sapiens
HHELIKLSW

SEQ ID NO: 280921 - protein, 9 aa, Homo Sapiens
VLRMIKSGS

SEQ ID NO: 280922 - protein, 9 aa, Homo Sapiens
VEEYPDKDK

SEQ ID NO: 280923 - protein, 9 aa, Homo Sapiens
ASGKLYQLR

SEQ ID NO: 280924 - protein, 9 aa, Homo Sapiens
TKKNKLVEE

SEQ ID NO: 280925 - protein, 9 aa, Homo Sapiens
SYQYQASGP

SEQ ID NO: 280926 - protein, 9 aa, Homo Sapiens
LSNLARHQR

SEQ ID NO: 280927 - protein, 9 aa, Homo Sapiens
HCQALVPEY

SEQ ID NO: 280928 - protein, 9 aa, Homo Sapiens
SRIHLVGKW

SEQ ID NO: 280929 - protein, 9 aa, Homo Sapiens
VANKQLKCT

SEQ ID NO: 280930 - protein, 9 aa, Homo Sapiens
VAKKGAICT

SEQ ID NO: 280931 - protein, 9 aa, Homo Sapiens
LNTSLIDMN

SEQ ID NO: 280932 - protein, 9 aa, Homo Sapiens
ESERATSDE

SEQ ID NO: 280933 - protein, 9 aa, Homo Sapiens
RNWKCPVKF

SEQ ID NO: 280934 - protein, 9 aa, Homo Sapiens
ATVMLNGQK

SEQ ID NO: 280935 - protein, 9 aa, Homo Sapiens
AKPTVEELS

SEQ ID NO: 280936 - protein, 9 aa, Homo Sapiens
HEEKPVRMN

SEQ ID NO: 280937 - protein, 9 aa, Homo Sapiens
EISAYQRLA

SEQ ID NO: 280938 - protein, 9 aa, Homo Sapiens
SPDQKDSDG

SEQ ID NO: 280939 - protein, 9 aa, Homo Sapiens
LIANFNQTH

SEQ ID NO: 280940 - protein, 9 aa, Homo Sapiens
DRGHTYIKF

SEQ ID NO: 280941 - protein, 9 aa, Homo Sapiens
EKGCQSHPG

SEQ ID NO: 280942 - protein, 9 aa, Homo Sapiens
VNQELIALG

SEQ ID NO: 280943 - protein, 9 aa, Homo Sapiens
QNGQLKEAL

SEQ ID NO: 280944 - protein, 9 aa, Homo Sapiens
ALLDWRYLG

SEQ ID NO: 280945 - protein, 9 aa, Homo Sapiens
KAEIDLLIV

SEQ ID NO: 280946 - protein, 9 aa, Homo Sapiens
KSDNVKEDT

SEQ ID NO: 280947 - protein, 9 aa, Homo Sapiens
QQLAAAVGL

SEQ ID NO: 280948 - protein, 9 aa, Homo Sapiens
GHKTTASAA

SEQ ID NO: 280949 - protein, 9 aa, Homo Sapiens
EIFGHGEFS

SEQ ID NO: 280950 - protein, 9 aa, Homo Sapiens
YPNYDALVY

SEQ ID NO: 280951 - protein, 9 aa, Homo Sapiens
FVTLLAAAD

SEQ ID NO: 280952 - protein, 9 aa, Homo Sapiens
KRHVMVAKP

SEQ ID NO: 280953 - protein, 9 aa, Homo Sapiens
YFSYLCVPL

SEQ ID NO: 280954 - protein, 9 aa, Homo Sapiens
HVSFLKTDG

SEQ ID NO: 280955 - protein, 9 aa, Homo Sapiens
CRRTGISAP

SEQ ID NO: 280956 - protein, 9 aa, Homo Sapiens
IKDVKRHIT

SEQ ID NO: 280957 - protein, 9 aa, Homo Sapiens
CLSSLKDEI

SEQ ID NO: 280958 - protein, 9 aa, Homo Sapiens
RNIAHQQHG

SEQ ID NO: 280959 - protein, 9 aa, Homo Sapiens
LSQRQRLTS

SEQ ID NO: 280960 - protein, 9 aa, Homo Sapiens
RSLLGSEDC

SEQ ID NO: 280961 - protein, 9 aa, Homo Sapiens
HRAVSTNVL

SEQ ID NO: 280962 - protein, 9 aa, Homo Sapiens
VEDNDYLHE

SEQ ID NO: 280963 - protein, 9 aa, Homo Sapiens
LGLREKEQN

SEQ ID NO: 280964 - protein, 9 aa, Homo Sapiens
GCTKRTNRK

SEQ ID NO: 280965 - protein, 9 aa, Homo Sapiens
TLIQDEDYM

SEQ ID NO: 280966 - protein, 9 aa, Homo Sapiens
ILSETKDVF

SEQ ID NO: 280967 - protein, 9 aa, Homo Sapiens
SLATAWLVG

SEQ ID NO: 280968 - protein, 9 aa, Homo Sapiens
RVTLDWSEN

SEQ ID NO: 280969 - protein, 9 aa, Homo Sapiens
LQRSVKLSW

SEQ ID NO: 280970 - protein, 9 aa, Homo Sapiens
RHFLDEGGH

SEQ ID NO: 280971 - protein, 9 aa, Homo Sapiens
DIMNDEGEI

SEQ ID NO: 280972 - protein, 9 aa, Homo Sapiens
YWTMIQLHS

SEQ ID NO: 280973 - protein, 9 aa, Homo Sapiens
LGNCSKQHL

SEQ ID NO: 280974 - protein, 9 aa, Homo Sapiens
ILKLVGVGE

SEQ ID NO: 280975 - protein, 9 aa, Homo Sapiens
RIETDERDL

SEQ ID NO: 280976 - protein, 9 aa, Homo Sapiens
VQSFAPHGP

SEQ ID NO: 280977 - protein, 9 aa, Homo Sapiens
KPQPKPNTR

SEQ ID NO: 280978 - protein, 9 aa, Homo Sapiens
QRRREIWLQ

SEQ ID NO: 280979 - protein, 9 aa, Homo Sapiens
PNDQTCCLK

SEQ ID NO: 280980 - protein, 9 aa, Homo Sapiens
AAFGIIAFS

SEQ ID NO: 280981 - protein, 9 aa, Homo Sapiens
TKVVVYGSY

SEQ ID NO: 280982 - protein, 9 aa, Homo Sapiens
STKSQSGSS

SEQ ID NO: 280983 - protein, 9 aa, Homo Sapiens
AAGALRNFS

SEQ ID NO: 280984 - protein, 9 aa, Homo Sapiens
RGSPGQSIG

SEQ ID NO: 280985 - protein, 9 aa, Homo Sapiens
KASIMLKFW

SEQ ID NO: 280986 - protein, 9 aa, Homo Sapiens
QVVQGLEVL

SEQ ID NO: 280987 - protein, 9 aa, Homo Sapiens
IDIQKNIDC

SEQ ID NO: 280988 - protein, 9 aa, Homo Sapiens
PFQPQLTDD

SEQ ID NO: 280989 - protein, 9 aa, Homo Sapiens
PYYFVNNLP

SEQ ID NO: 280990 - protein, 9 aa, Homo Sapiens
ALVDELNIK

SEQ ID NO: 280991 - protein, 9 aa, Homo Sapiens
MVWNQTTHL

SEQ ID NO: 280992 - protein, 9 aa, Homo Sapiens
AQAQVHLQK

SEQ ID NO: 280993 - protein, 9 aa, Homo Sapiens
DVTLVTPPQ

SEQ ID NO: 280994 - protein, 9 aa, Homo Sapiens
LSGPGLVCM

SEQ ID NO: 280995 - protein, 9 aa, Homo Sapiens
GDVILKIEP

SEQ ID NO: 280996 - protein, 9 aa, Homo Sapiens
VTSVQEEGP

SEQ ID NO: 280997 - protein, 9 aa, Homo Sapiens
HDFKMLFAP

SEQ ID NO: 280998 - protein, 9 aa, Homo Sapiens
PIFGGQPLD

SEQ ID NO: 280999 - protein, 9 aa, Homo Sapiens
EAKLERKQE

SEQ ID NO: 281000 - protein, 9 aa, Homo Sapiens
PDLLELIRD

SEQ ID NO: 281001 - protein, 9 aa, Homo Sapiens
PELCETPKS

SEQ ID NO: 281002 - protein, 9 aa, Homo Sapiens
FSLSQYYCS

SEQ ID NO: 281003 - protein, 9 aa, Homo Sapiens
NREECLQTV

SEQ ID NO: 281004 - protein, 9 aa, Homo Sapiens
SMTEHVLGD

SEQ ID NO: 281005 - protein, 9 aa, Homo Sapiens
FSQSQYLIV

SEQ ID NO: 281006 - protein, 9 aa, Homo Sapiens
KLDNLNKDI

SEQ ID NO: 281007 - protein, 9 aa, Homo Sapiens
KYGVWQNVS

SEQ ID NO: 281008 - protein, 9 aa, Homo Sapiens
LDFIETSNQ

SEQ ID NO: 281009 - protein, 9 aa, Homo Sapiens
LNRPGDACG

SEQ ID NO: 281010 - protein, 9 aa, Homo Sapiens
NSSFARHQK

SEQ ID NO: 281011 - protein, 9 aa, Homo Sapiens
AILRKETAK

SEQ ID NO: 281012 - protein, 9 aa, Homo Sapiens
VGALHPANR

SEQ ID NO: 281013 - protein, 9 aa, Homo Sapiens
VYEQLIYAF

SEQ ID NO: 281014 - protein, 9 aa, Homo Sapiens
KMQCEVKYE

SEQ ID NO: 281015 - protein, 9 aa, Homo Sapiens
LASIMSSLT

SEQ ID NO: 281016 - protein, 9 aa, Homo Sapiens
AADVLEFVC

SEQ ID NO: 281017 - protein, 9 aa, Homo Sapiens
RSQRDVFGN

SEQ ID NO: 281018 - protein, 9 aa, Homo Sapiens
RCGKFEYDI

SEQ ID NO: 281019 - protein, 9 aa, Homo Sapiens
SLIAEIIIV

SEQ ID NO: 281020 - protein, 9 aa, Homo Sapiens
SYYDRGYDC

SEQ ID NO: 281021 - protein, 9 aa, Homo Sapiens
SYSSQSSSI

SEQ ID NO: 281022 - protein, 9 aa, Homo Sapiens
CTHHTDTDM

SEQ ID NO: 281023 - protein, 9 aa, Homo Sapiens
SGLYILSFF

SEQ ID NO: 281024 - protein, 9 aa, Homo Sapiens
VAVVREDNL

SEQ ID NO: 281025 - protein, 9 aa, Homo Sapiens
SHLIIHQIV

SEQ ID NO: 281026 - protein, 9 aa, Homo Sapiens
DIQSCLTVW

SEQ ID NO: 281027 - protein, 9 aa, Homo Sapiens
DLSSPDLIN

SEQ ID NO: 281028 - protein, 9 aa, Homo Sapiens
QIRGLTKEQ

SEQ ID NO: 281029 - protein, 9 aa, Homo Sapiens
CFPRYRSRT

SEQ ID NO: 281030 - protein, 9 aa, Homo Sapiens
LISDGFIVN

SEQ ID NO: 281031 - protein, 9 aa, Homo Sapiens
FNLCSRKFS

SEQ ID NO: 281032 - protein, 9 aa, Homo Sapiens
PVVKTNYGK

SEQ ID NO: 281033 - protein, 9 aa, Homo Sapiens
LIGGVDVFY

SEQ ID NO: 281034 - protein, 9 aa, Homo Sapiens
VRLLEQQNK

SEQ ID NO: 281035 - protein, 9 aa, Homo Sapiens
RLRVTAAKF

SEQ ID NO: 281036 - protein, 9 aa, Homo Sapiens
VKAALKSAR

SEQ ID NO: 281037 - protein, 9 aa, Homo Sapiens
FENSLLLTK

SEQ ID NO: 281038 - protein, 9 aa, Homo Sapiens
RAKEYESVM

SEQ ID NO: 281039 - protein, 9 aa, Homo Sapiens
LPISKIEQW

SEQ ID NO: 281040 - protein, 9 aa, Homo Sapiens
CYDPTVDVW

SEQ ID NO: 281041 - protein, 9 aa, Homo Sapiens
WTTTNVLGD

SEQ ID NO: 281042 - protein, 9 aa, Homo Sapiens
GKESTFGLS

SEQ ID NO: 281043 - protein, 9 aa, Homo Sapiens
VAYGLISCE

SEQ ID NO: 281044 - protein, 9 aa, Homo Sapiens
QIRDLESGV

SEQ ID NO: 281045 - protein, 9 aa, Homo Sapiens
NVCNAPHWS

SEQ ID NO: 281046 - protein, 9 aa, Homo Sapiens
STPTVLHGI

SEQ ID NO: 281047 - protein, 9 aa, Homo Sapiens
RKAITLILS

SEQ ID NO: 281048 - protein, 9 aa, Homo Sapiens
CSLASSLRI

SEQ ID NO: 281049 - protein, 9 aa, Homo Sapiens
TFLLQSIQA

SEQ ID NO: 281050 - protein, 9 aa, Homo Sapiens
KGSKKPDLK

SEQ ID NO: 281051 - protein, 9 aa, Homo Sapiens
NLSLVDIFV

SEQ ID NO: 281052 - protein, 9 aa, Homo Sapiens
EYAQNVLRK

SEQ ID NO: 281053 - protein, 9 aa, Homo Sapiens
FLCQEKYQL

SEQ ID NO: 281054 - protein, 9 aa, Homo Sapiens
DLSADSSYL

SEQ ID NO: 281055 - protein, 9 aa, Homo Sapiens
SMTTVGYGY

SEQ ID NO: 281056 - protein, 9 aa, Homo Sapiens
IFYGFLSDN

SEQ ID NO: 281057 - protein, 9 aa, Homo Sapiens
GVIVCLYII

SEQ ID NO: 281058 - protein, 9 aa, Homo Sapiens
TIHEMKQSN

SEQ ID NO: 281059 - protein, 9 aa, Homo Sapiens
HINCHTTSI

SEQ ID NO: 281060 - protein, 9 aa, Homo Sapiens
SLDFVLKQD

SEQ ID NO: 281061 - protein, 9 aa, Homo Sapiens
NGIPKIHEF

SEQ ID NO: 281062 - protein, 9 aa, Homo Sapiens
VVSWKSRTK

SEQ ID NO: 281063 - protein, 9 aa, Homo Sapiens
IKLQDMERK

SEQ ID NO: 281064 - protein, 9 aa, Homo Sapiens
SLSHHQRVH

SEQ ID NO: 281065 - protein, 9 aa, Homo Sapiens
VTVLSENKE

SEQ ID NO: 281066 - protein, 9 aa, Homo Sapiens
ESPFKYGWD

SEQ ID NO: 281067 - protein, 9 aa, Homo Sapiens
PEEIKQMEQ

SEQ ID NO: 281068 - protein, 9 aa, Homo Sapiens
WRRETTRLF

SEQ ID NO: 281069 - protein, 9 aa, Homo Sapiens
KQLTKAKII

SEQ ID NO: 281070 - protein, 9 aa, Homo Sapiens
AMLKEALGP

SEQ ID NO: 281071 - protein, 9 aa, Homo Sapiens
HVVQIVEKL

SEQ ID NO: 281072 - protein, 9 aa, Homo Sapiens
MLTKENSRD

SEQ ID NO: 281073 - protein, 9 aa, Homo Sapiens
RDKEVGAVS

SEQ ID NO: 281074 - protein, 9 aa, Homo Sapiens
NPKLNVAFV

SEQ ID NO: 281075 - protein, 9 aa, Homo Sapiens
YPFGYVKAS

SEQ ID NO: 281076 - protein, 9 aa, Homo Sapiens
SIEIFFQAE

SEQ ID NO: 281077 - protein, 9 aa, Homo Sapiens
GEYNRASSE

SEQ ID NO: 281078 - protein, 9 aa, Homo Sapiens
KALSYICRD

SEQ ID NO: 281079 - protein, 9 aa, Homo Sapiens
DIWGDFTTS

SEQ ID NO: 281080 - protein, 9 aa, Homo Sapiens
YLIHEITHT

SEQ ID NO: 281081 - protein, 9 aa, Homo Sapiens
QLHRVFVQE

SEQ ID NO: 281082 - protein, 9 aa, Homo Sapiens
DNITGHLPV

SEQ ID NO: 281083 - protein, 9 aa, Homo Sapiens
KLMAKCQML

SEQ ID NO: 281084 - protein, 9 aa, Homo Sapiens
TCPAETTHR

SEQ ID NO: 281085 - protein, 9 aa, Homo Sapiens
STFSSEMEY

SEQ ID NO: 281086 - protein, 9 aa, Homo Sapiens
IIDEDHSGP

SEQ ID NO: 281087 - protein, 9 aa, Homo Sapiens
KKSADNFID

SEQ ID NO: 281088 - protein, 9 aa, Homo Sapiens
VYRQFLFVV

SEQ ID NO: 281089 - protein, 9 aa, Homo Sapiens
STNFLPGLN

SEQ ID NO: 281090 - protein, 9 aa, Homo Sapiens
KHSFAFTPI

SEQ ID NO: 281091 - protein, 9 aa, Homo Sapiens
KVCGKIGLI

SEQ ID NO: 281092 - protein, 9 aa, Homo Sapiens
QLSKPYITI

SEQ ID NO: 281093 - protein, 9 aa, Homo Sapiens
CTSRGQFLW

SEQ ID NO: 281094 - protein, 9 aa, Homo Sapiens
GNVTYFFFR

SEQ ID NO: 281095 - protein, 9 aa, Homo Sapiens
RAIVGSLPG

SEQ ID NO: 281096 - protein, 9 aa, Homo Sapiens
HKFNKPCIT

SEQ ID NO: 281097 - protein, 9 aa, Homo Sapiens
KIFQYTNFD

SEQ ID NO: 281098 - protein, 9 aa, Homo Sapiens
IMYWAKEDG

SEQ ID NO: 281099 - protein, 9 aa, Homo Sapiens
PGQTSASFL

SEQ ID NO: 281100 - protein, 9 aa, Homo Sapiens
SHHSPARRS

SEQ ID NO: 281101 - protein, 9 aa, Homo Sapiens
CPNPLAPSP

SEQ ID NO: 281102 - protein, 9 aa, Homo Sapiens
ELSLEEWEF

SEQ ID NO: 281103 - protein, 9 aa, Homo Sapiens
LRRGYSFLI

SEQ ID NO: 281104 - protein, 9 aa, Homo Sapiens
HDNIYTPKK

SEQ ID NO: 281105 - protein, 9 aa, Homo Sapiens
LTLRVIAID

SEQ ID NO: 281106 - protein, 9 aa, Homo Sapiens
ILHHIYGKF

SEQ ID NO: 281107 - protein, 9 aa, Homo Sapiens
HFQSDISFQ

SEQ ID NO: 281108 - protein, 9 aa, Homo Sapiens
KGSWVNTFP

SEQ ID NO: 281109 - protein, 9 aa, Homo Sapiens
IFREEDTSR

SEQ ID NO: 281110 - protein, 9 aa, Homo Sapiens
ENFKDRLKP

SEQ ID NO: 281111 - protein, 9 aa, Homo Sapiens
WLFALAWPP

SEQ ID NO: 281112 - protein, 9 aa, Homo Sapiens
IYSRHKMYK

SEQ ID NO: 281113 - protein, 9 aa, Homo Sapiens
SISGYPEID

SEQ ID NO: 281114 - protein, 9 aa, Homo Sapiens
CHTLRDVIG

SEQ ID NO: 281115 - protein, 9 aa, Homo Sapiens
LILLVRYQK

SEQ ID NO: 281116 - protein, 9 aa, Homo Sapiens
QQSLNMEQA

SEQ ID NO: 281117 - protein, 9 aa, Homo Sapiens
DYGKEYQAK

SEQ ID NO: 281118 - protein, 9 aa, Homo Sapiens
KHSPQSLLS

SEQ ID NO: 281119 - protein, 9 aa, Homo Sapiens
FRKTRYSLR

SEQ ID NO: 281120 - protein, 9 aa, Homo Sapiens
WKPPNDTNG

SEQ ID NO: 281121 - protein, 9 aa, Homo Sapiens
NIRKDLYAN

SEQ ID NO: 281122 - protein, 9 aa, Homo Sapiens
LLWPHGCVS

SEQ ID NO: 281123 - protein, 9 aa, Homo Sapiens
PTVNPTLGV

SEQ ID NO: 281124 - protein, 9 aa, Homo Sapiens
LTDDFSYGM

SEQ ID NO: 281125 - protein, 9 aa, Homo Sapiens
GHSQAQNSP

SEQ ID NO: 281126 - protein, 9 aa, Homo Sapiens
QYTNFDKNR

SEQ ID NO: 281127 - protein, 9 aa, Homo Sapiens
NKIRSELDG

SEQ ID NO: 281128 - protein, 9 aa, Homo Sapiens
IQTRGGNSN

SEQ ID NO: 281129 - protein, 9 aa, Homo Sapiens
GHLPVEPNN

SEQ ID NO: 281130 - protein, 9 aa, Homo Sapiens
RRPNSGPAW

SEQ ID NO: 281131 - protein, 9 aa, Homo Sapiens
HLMEKASIM

SEQ ID NO: 281132 - protein, 9 aa, Homo Sapiens
KVKSYSMPI

SEQ ID NO: 281133 - protein, 9 aa, Homo Sapiens
LINFLICIR

SEQ ID NO: 281134 - protein, 9 aa, Homo Sapiens
GYYDRMDYD

SEQ ID NO: 281135 - protein, 9 aa, Homo Sapiens
RITKCIGNI

SEQ ID NO: 281136 - protein, 9 aa, Homo Sapiens
VVGKANSVF

SEQ ID NO: 281137 - protein, 9 aa, Homo Sapiens
QDGLDKVHL

SEQ ID NO: 281138 - protein, 9 aa, Homo Sapiens
YRSLLGSED

SEQ ID NO: 281139 - protein, 9 aa, Homo Sapiens
FLKLQTRLE

SEQ ID NO: 281140 - protein, 9 aa, Homo Sapiens
REEKPAVTT

SEQ ID NO: 281141 - protein, 9 aa, Homo Sapiens
LWDSKKQSV

SEQ ID NO: 281142 - protein, 9 aa, Homo Sapiens
LCYLLGMLY

SEQ ID NO: 281143 - protein, 9 aa, Homo Sapiens
KIIEYPLKA

SEQ ID NO: 281144 - protein, 9 aa, Homo Sapiens
ICAGVLCAT

SEQ ID NO: 281145 - protein, 9 aa, Homo Sapiens
ATSQTDREI

SEQ ID NO: 281146 - protein, 9 aa, Homo Sapiens
LFGCPPGYR

SEQ ID NO: 281147 - protein, 9 aa, Homo Sapiens
KAGATATYE

SEQ ID NO: 281148 - protein, 9 aa, Homo Sapiens
LMEQIQNPE

SEQ ID NO: 281149 - protein, 9 aa, Homo Sapiens
KEPLHLFED

SEQ ID NO: 281150 - protein, 9 aa, Homo Sapiens
GDVKVKTER

SEQ ID NO: 281151 - protein, 9 aa, Homo Sapiens
TCRDKEICA

SEQ ID NO: 281152 - protein, 9 aa, Homo Sapiens
GDVVEILNG

SEQ ID NO: 281153 - protein, 9 aa, Homo Sapiens
LEEGLFKVD

SEQ ID NO: 281154 - protein, 9 aa, Homo Sapiens
TIKELQDAA

SEQ ID NO: 281155 - protein, 9 aa, Homo Sapiens
LDGNKTCQD

SEQ ID NO: 281156 - protein, 9 aa, Homo Sapiens
EEESQESNR

SEQ ID NO: 281157 - protein, 9 aa, Homo Sapiens
SEKLEEETE

SEQ ID NO: 281158 - protein, 9 aa, Homo Sapiens
AAMPYTVSI

SEQ ID NO: 281159 - protein, 9 aa, Homo Sapiens
SSVAEVVIG

SEQ ID NO: 281160 - protein, 9 aa, Homo Sapiens
VHQRTNSGE

SEQ ID NO: 281161 - protein, 9 aa, Homo Sapiens
NNMLFPMIV

SEQ ID NO: 281162 - protein, 9 aa, Homo Sapiens
AEDAAVKAT

SEQ ID NO: 281163 - protein, 9 aa, Homo Sapiens
QKAPLQKFT

SEQ ID NO: 281164 - protein, 9 aa, Homo Sapiens
WNDMKPSPS

SEQ ID NO: 281165 - protein, 9 aa, Homo Sapiens
YILGNCSKQ

SEQ ID NO: 281166 - protein, 9 aa, Homo Sapiens
TGVIPQGEY

SEQ ID NO: 281167 - protein, 9 aa, Homo Sapiens
EVLSMRPRV

SEQ ID NO: 281168 - protein, 9 aa, Homo Sapiens
NKPKENLEL

SEQ ID NO: 281169 - protein, 9 aa, Homo Sapiens
DYLVGDKLS

SEQ ID NO: 281170 - protein, 9 aa, Homo Sapiens
ERVNDASPN

SEQ ID NO: 281171 - protein, 9 aa, Homo Sapiens
HLHQIHHLL

SEQ ID NO: 281172 - protein, 9 aa, Homo Sapiens
EEAVVDFGK

SEQ ID NO: 281173 - protein, 9 aa, Homo Sapiens
SGLKNGSFS

SEQ ID NO: 281174 - protein, 9 aa, Homo Sapiens
APMFEKDKL

SEQ ID NO: 281175 - protein, 9 aa, Homo Sapiens
PKKRGPPGP

SEQ ID NO: 281176 - protein, 9 aa, Homo Sapiens
SNDGAYSRV

SEQ ID NO: 281177 - protein, 9 aa, Homo Sapiens
SNTSRHTSE

SEQ ID NO: 281178 - protein, 9 aa, Homo Sapiens
SFSQKYDRV

SEQ ID NO: 281179 - protein, 9 aa, Homo Sapiens
ERKALKVLG

SEQ ID NO: 281180 - protein, 9 aa, Homo Sapiens
VACVKLRDM

SEQ ID NO: 281181 - protein, 9 aa, Homo Sapiens
ELGQCKKTQ

SEQ ID NO: 281182 - protein, 9 aa, Homo Sapiens
KLLFCRIRP

SEQ ID NO: 281183 - protein, 9 aa, Homo Sapiens
PGQDLVSLK

SEQ ID NO: 281184 - protein, 9 aa, Homo Sapiens
TGFELVVSF

SEQ ID NO: 281185 - protein, 9 aa, Homo Sapiens
IYVSLSGFV

SEQ ID NO: 281186 - protein, 9 aa, Homo Sapiens
DKVDLEKSA

SEQ ID NO: 281187 - protein, 9 aa, Homo Sapiens
RHTLKGDLQ

SEQ ID NO: 281188 - protein, 9 aa, Homo Sapiens
SYDPLKIDE

SEQ ID NO: 281189 - protein, 9 aa, Homo Sapiens
SKIDYFPNE

SEQ ID NO: 281190 - protein, 9 aa, Homo Sapiens
YYNKRILHN

SEQ ID NO: 281191 - protein, 9 aa, Homo Sapiens
GVVQIYHRK

SEQ ID NO: 281192 - protein, 9 aa, Homo Sapiens
GENNVIFIT

SEQ ID NO: 281193 - protein, 9 aa, Homo Sapiens
VEQWSTVIC

SEQ ID NO: 281194 - protein, 9 aa, Homo Sapiens
KDTSTTTSR

SEQ ID NO: 281195 - protein, 9 aa, Homo Sapiens
SDTFTYVFL

SEQ ID NO: 281196 - protein, 9 aa, Homo Sapiens
AIFQALLQN

SEQ ID NO: 281197 - protein, 9 aa, Homo Sapiens
ISKLVSGNL

SEQ ID NO: 281198 - protein, 9 aa, Homo Sapiens
RATSDESIK

SEQ ID NO: 281199 - protein, 9 aa, Homo Sapiens
LTQVPNSGS

SEQ ID NO: 281200 - protein, 9 aa, Homo Sapiens
TLKLQKKDF

SEQ ID NO: 281201 - protein, 9 aa, Homo Sapiens
IRTEPGLIA

SEQ ID NO: 281202 - protein, 9 aa, Homo Sapiens
GKIFAQAFL

SEQ ID NO: 281203 - protein, 9 aa, Homo Sapiens
DEDYCPHSK

SEQ ID NO: 281204 - protein, 9 aa, Homo Sapiens
LNNLKNIRC

SEQ ID NO: 281205 - protein, 9 aa, Homo Sapiens
AQRLKLLCE

SEQ ID NO: 281206 - protein, 9 aa, Homo Sapiens
SRKAISSAS

SEQ ID NO: 281207 - protein, 9 aa, Homo Sapiens
IGKDPAHFN

SEQ ID NO: 281208 - protein, 9 aa, Homo Sapiens
RIGKDCGDS

SEQ ID NO: 281209 - protein, 9 aa, Homo Sapiens
AKKLNIAQN

SEQ ID NO: 281210 - protein, 9 aa, Homo Sapiens
IPPDVLKSQ

SEQ ID NO: 281211 - protein, 9 aa, Homo Sapiens
QEKMHKVSF

SEQ ID NO: 281212 - protein, 9 aa, Homo Sapiens
LYGSEEDEA

SEQ ID NO: 281213 - protein, 9 aa, Homo Sapiens
DSDPHESFT

SEQ ID NO: 281214 - protein, 9 aa, Homo Sapiens
QSFLCRALC

SEQ ID NO: 281215 - protein, 9 aa, Homo Sapiens
ELKQCPNPL

SEQ ID NO: 281216 - protein, 9 aa, Homo Sapiens
VISVSTGTT

SEQ ID NO: 281217 - protein, 9 aa, Homo Sapiens
PPMHEYADK

SEQ ID NO: 281218 - protein, 9 aa, Homo Sapiens
LNPASKVLC

SEQ ID NO: 281219 - protein, 9 aa, Homo Sapiens
AETLGALLS

SEQ ID NO: 281220 - protein, 9 aa, Homo Sapiens
RTSPTFQRP

SEQ ID NO: 281221 - protein, 9 aa, Homo Sapiens
SSCGDHPSK

SEQ ID NO: 281222 - protein, 9 aa, Homo Sapiens
LEQQDCGIA

SEQ ID NO: 281223 - protein, 9 aa, Homo Sapiens
VLYFVMDLP

SEQ ID NO: 281224 - protein, 9 aa, Homo Sapiens
YTCTYVWSV

SEQ ID NO: 281225 - protein, 9 aa, Homo Sapiens
TCLCKDSLD

SEQ ID NO: 281226 - protein, 9 aa, Homo Sapiens
EEPDIAVPT

SEQ ID NO: 281227 - protein, 9 aa, Homo Sapiens
GNQEFIALG

SEQ ID NO: 281228 - protein, 9 aa, Homo Sapiens
IVNPPVITA

SEQ ID NO: 281229 - protein, 9 aa, Homo Sapiens
EWNPLQKDP

SEQ ID NO: 281230 - protein, 9 aa, Homo Sapiens
GLEDDVAKK

SEQ ID NO: 281231 - protein, 9 aa, Homo Sapiens
NKGEFTHLQ

SEQ ID NO: 281232 - protein, 9 aa, Homo Sapiens
QGYTCKDCG

SEQ ID NO: 281233 - protein, 9 aa, Homo Sapiens
HSEMLAINQ

SEQ ID NO: 281234 - protein, 9 aa, Homo Sapiens
VKASTTLTC

SEQ ID NO: 281235 - protein, 9 aa, Homo Sapiens
RTSGSRSQR

SEQ ID NO: 281236 - protein, 9 aa, Homo Sapiens
DPLGDYMVK

SEQ ID NO: 281237 - protein, 9 aa, Homo Sapiens
ITDFGISKI

SEQ ID NO: 281238 - protein, 9 aa, Homo Sapiens
FSYNSSCYI

SEQ ID NO: 281239 - protein, 9 aa, Homo Sapiens
LSSDYLIPP

SEQ ID NO: 281240 - protein, 9 aa, Homo Sapiens
GLIKGQSAG

SEQ ID NO: 281241 - protein, 9 aa, Homo Sapiens
AANIALMNS

SEQ ID NO: 281242 - protein, 9 aa, Homo Sapiens
IIRLMSAGI

SEQ ID NO: 281243 - protein, 9 aa, Homo Sapiens
KGCFCPPDK

SEQ ID NO: 281244 - protein, 9 aa, Homo Sapiens
MKLINGKQQ

SEQ ID NO: 281245 - protein, 9 aa, Homo Sapiens
GVMLINLTR

SEQ ID NO: 281246 - protein, 9 aa, Homo Sapiens
WIEIIALSL

SEQ ID NO: 281247 - protein, 9 aa, Homo Sapiens
TLAKLGICE

SEQ ID NO: 281248 - protein, 9 aa, Homo Sapiens
QTLKRHKAA

SEQ ID NO: 281249 - protein, 9 aa, Homo Sapiens
DTSTRTHHL

SEQ ID NO: 281250 - protein, 9 aa, Homo Sapiens
PTPARCPQP

SEQ ID NO: 281251 - protein, 9 aa, Homo Sapiens
AIAGDLHCD

SEQ ID NO: 281252 - protein, 9 aa, Homo Sapiens
LYFVMDLPK

SEQ ID NO: 281253 - protein, 9 aa, Homo Sapiens
LKHHVIQKH

SEQ ID NO: 281254 - protein, 9 aa, Homo Sapiens
AVLQLYPDN

SEQ ID NO: 281255 - protein, 9 aa, Homo Sapiens
ATRVQPEPR

SEQ ID NO: 281256 - protein, 9 aa, Homo Sapiens
SDKGITPEG

SEQ ID NO: 281257 - protein, 9 aa, Homo Sapiens
TVITRYRLV

SEQ ID NO: 281258 - protein, 9 aa, Homo Sapiens
AESPQCTSL

SEQ ID NO: 281259 - protein, 9 aa, Homo Sapiens
ILSMAILSL

SEQ ID NO: 281260 - protein, 9 aa, Homo Sapiens
NTDGSYRCQ

SEQ ID NO: 281261 - protein, 9 aa, Homo Sapiens
CTDQGIWIQ

SEQ ID NO: 281262 - protein, 9 aa, Homo Sapiens
IQMDLSADS

SEQ ID NO: 281263 - protein, 9 aa, Homo Sapiens
QQGSQRRCP

SEQ ID NO: 281264 - protein, 9 aa, Homo Sapiens
LDQLLQNQI

SEQ ID NO: 281265 - protein, 9 aa, Homo Sapiens
IDFCSEAIG

SEQ ID NO: 281266 - protein, 9 aa, Homo Sapiens
FIDGYVVLW

SEQ ID NO: 281267 - protein, 9 aa, Homo Sapiens
DTNSQSIGS

SEQ ID NO: 281268 - protein, 9 aa, Homo Sapiens
PICYERECK

SEQ ID NO: 281269 - protein, 9 aa, Homo Sapiens
GSKGVKCMP

SEQ ID NO: 281270 - protein, 9 aa, Homo Sapiens
IAKLATAQD

SEQ ID NO: 281271 - protein, 9 aa, Homo Sapiens
CMVSGSEQT

SEQ ID NO: 281272 - protein, 9 aa, Homo Sapiens
LKNTSAETR

SEQ ID NO: 281273 - protein, 9 aa, Homo Sapiens
TLTSHWTLC

SEQ ID NO: 281274 - protein, 9 aa, Homo Sapiens
KDKSKVAKK

SEQ ID NO: 281275 - protein, 9 aa, Homo Sapiens
LDTCALHEQ

SEQ ID NO: 281276 - protein, 9 aa, Homo Sapiens
ALTHIASGT

SEQ ID NO: 281277 - protein, 9 aa, Homo Sapiens
GLNVSSCEI

SEQ ID NO: 281278 - protein, 9 aa, Homo Sapiens
PEVEFTTLD

SEQ ID NO: 281279 - protein, 9 aa, Homo Sapiens
WHRGAMVIH

SEQ ID NO: 281280 - protein, 9 aa, Homo Sapiens
NTETPLTTK

SEQ ID NO: 281281 - protein, 9 aa, Homo Sapiens
HAVNKAMQY

SEQ ID NO: 281282 - protein, 9 aa, Homo Sapiens
VLCNSVFSD

SEQ ID NO: 281283 - protein, 9 aa, Homo Sapiens
VRLCFVELC

SEQ ID NO: 281284 - protein, 9 aa, Homo Sapiens
VFGESLLNY

SEQ ID NO: 281285 - protein, 9 aa, Homo Sapiens
QWIVSHIME

SEQ ID NO: 281286 - protein, 9 aa, Homo Sapiens
LMLFDAICN

SEQ ID NO: 281287 - protein, 9 aa, Homo Sapiens
YIQAGPNCG

SEQ ID NO: 281288 - protein, 9 aa, Homo Sapiens
TITVRPRNA

SEQ ID NO: 281289 - protein, 9 aa, Homo Sapiens
KDNSNVYMV

SEQ ID NO: 281290 - protein, 9 aa, Homo Sapiens
PQGTSWGRG

SEQ ID NO: 281291 - protein, 9 aa, Homo Sapiens
FSSAPYVSS

SEQ ID NO: 281292 - protein, 9 aa, Homo Sapiens
ICSYQWDVP

SEQ ID NO: 281293 - protein, 9 aa, Homo Sapiens
HAIKILDRE

SEQ ID NO: 281294 - protein, 9 aa, Homo Sapiens
RRICSLQRS

SEQ ID NO: 281295 - protein, 9 aa, Homo Sapiens
MAALYLVQI

SEQ ID NO: 281296 - protein, 9 aa, Homo Sapiens
NTSGALSRL

SEQ ID NO: 281297 - protein, 9 aa, Homo Sapiens
LFKRVFVNL

SEQ ID NO: 281298 - protein, 9 aa, Homo Sapiens
IFPDGGIAQ

SEQ ID NO: 281299 - protein, 9 aa, Homo Sapiens
VEQFMKELS

SEQ ID NO: 281300 - protein, 9 aa, Homo Sapiens
LEICWSGSE

SEQ ID NO: 281301 - protein, 9 aa, Homo Sapiens
HTMDKRRLP

SEQ ID NO: 281302 - protein, 9 aa, Homo Sapiens
LLMLLYVIL

SEQ ID NO: 281303 - protein, 9 aa, Homo Sapiens
AANIHQEFL

SEQ ID NO: 281304 - protein, 9 aa, Homo Sapiens
GLFLVSLLV

SEQ ID NO: 281305 - protein, 9 aa, Homo Sapiens
KEMMKHARN

SEQ ID NO: 281306 - protein, 9 aa, Homo Sapiens
LEVLRAEHH

SEQ ID NO: 281307 - protein, 9 aa, Homo Sapiens
KFRDLFLPK

SEQ ID NO: 281308 - protein, 9 aa, Homo Sapiens
LIQQVTLNI

SEQ ID NO: 281309 - protein, 9 aa, Homo Sapiens
LLVLFILFI

SEQ ID NO: 281310 - protein, 9 aa, Homo Sapiens
QKESKDNQW

SEQ ID NO: 281311 - protein, 9 aa, Homo Sapiens
ECGKYFSRK

SEQ ID NO: 281312 - protein, 9 aa, Homo Sapiens
INLDLKHLV

SEQ ID NO: 281313 - protein, 9 aa, Homo Sapiens
LQNNPSLGN

SEQ ID NO: 281314 - protein, 9 aa, Homo Sapiens
IYLQWLRRI

SEQ ID NO: 281315 - protein, 9 aa, Homo Sapiens
GTAVSTISY

SEQ ID NO: 281316 - protein, 9 aa, Homo Sapiens
KKAKHQGPQ

SEQ ID NO: 281317 - protein, 9 aa, Homo Sapiens
LLQSNKDLG

SEQ ID NO: 281318 - protein, 9 aa, Homo Sapiens
DEKGVVLCY

SEQ ID NO: 281319 - protein, 9 aa, Homo Sapiens
LFYFNNILN

SEQ ID NO: 281320 - protein, 9 aa, Homo Sapiens
ASTIIRSKK

SEQ ID NO: 281321 - protein, 9 aa, Homo Sapiens
HFVCDFSPL

SEQ ID NO: 281322 - protein, 9 aa, Homo Sapiens
TEQDMLYNF

SEQ ID NO: 281323 - protein, 9 aa, Homo Sapiens
DLNNTTGLI

SEQ ID NO: 281324 - protein, 9 aa, Homo Sapiens
IKSRLQLVM

SEQ ID NO: 281325 - protein, 9 aa, Homo Sapiens
YAFAHRIPP

SEQ ID NO: 281326 - protein, 9 aa, Homo Sapiens
TFYGEENAV

SEQ ID NO: 281327 - protein, 9 aa, Homo Sapiens
ESLGSPGRT

SEQ ID NO: 281328 - protein, 9 aa, Homo Sapiens
HISMEDYGA

SEQ ID NO: 281329 - protein, 9 aa, Homo Sapiens
IHSQMDGLI

SEQ ID NO: 281330 - protein, 9 aa, Homo Sapiens
VEREVINMR

SEQ ID NO: 281331 - protein, 9 aa, Homo Sapiens
LARNNVTQA

SEQ ID NO: 281332 - protein, 9 aa, Homo Sapiens
DCNYHNEEY

SEQ ID NO: 281333 - protein, 9 aa, Homo Sapiens
WINFDHYYP

SEQ ID NO: 281334 - protein, 9 aa, Homo Sapiens
LVGFAGVIA

SEQ ID NO: 281335 - protein, 9 aa, Homo Sapiens
AVNNFILKV

SEQ ID NO: 281336 - protein, 9 aa, Homo Sapiens
CKTWQDEDG

SEQ ID NO: 281337 - protein, 9 aa, Homo Sapiens
LKSIACPSI

SEQ ID NO: 281338 - protein, 9 aa, Homo Sapiens
QKYNCGFFE

SEQ ID NO: 281339 - protein, 9 aa, Homo Sapiens
LRTLLTYVK

SEQ ID NO: 281340 - protein, 9 aa, Homo Sapiens
VYVATLLMT

SEQ ID NO: 281341 - protein, 9 aa, Homo Sapiens
DTPQGRYSD

SEQ ID NO: 281342 - protein, 9 aa, Homo Sapiens
TLSIPPGML

SEQ ID NO: 281343 - protein, 9 aa, Homo Sapiens
SRPGTRTGP

SEQ ID NO: 281344 - protein, 9 aa, Homo Sapiens
PAGFQNFVG

SEQ ID NO: 281345 - protein, 9 aa, Homo Sapiens
VIRYKDVTF

SEQ ID NO: 281346 - protein, 9 aa, Homo Sapiens
KYISNPLLN

SEQ ID NO: 281347 - protein, 9 aa, Homo Sapiens
MDVAFVQLL

SEQ ID NO: 281348 - protein, 9 aa, Homo Sapiens
EEEPHNDNL

SEQ ID NO: 281349 - protein, 9 aa, Homo Sapiens
CGQSFSYKS

SEQ ID NO: 281350 - protein, 9 aa, Homo Sapiens
YVLSSCRAE

SEQ ID NO: 281351 - protein, 9 aa, Homo Sapiens
NTWSREHLK

SEQ ID NO: 281352 - protein, 9 aa, Homo Sapiens
SKRKVLGIK

SEQ ID NO: 281353 - protein, 9 aa, Homo Sapiens
HTTSTSKPA

SEQ ID NO: 281354 - protein, 9 aa, Homo Sapiens
DSLVTADSL

SEQ ID NO: 281355 - protein, 9 aa, Homo Sapiens
LVVANGGLT

SEQ ID NO: 281356 - protein, 9 aa, Homo Sapiens
SKSHFREWL

SEQ ID NO: 281357 - protein, 9 aa, Homo Sapiens
DFRIPTSNL

SEQ ID NO: 281358 - protein, 9 aa, Homo Sapiens
ALAALHDRM

SEQ ID NO: 281359 - protein, 9 aa, Homo Sapiens
GRWITNPSQ

SEQ ID NO: 281360 - protein, 9 aa, Homo Sapiens
SLNIDLRVT

SEQ ID NO: 281361 - protein, 9 aa, Homo Sapiens
IAKHRIKET

SEQ ID NO: 281362 - protein, 9 aa, Homo Sapiens
IFYGSVANH

SEQ ID NO: 281363 - protein, 9 aa, Homo Sapiens
VHLAHHQQI

SEQ ID NO: 281364 - protein, 9 aa, Homo Sapiens
VESQQDLEN

SEQ ID NO: 281365 - protein, 9 aa, Homo Sapiens
TEEFEVLKE

SEQ ID NO: 281366 - protein, 9 aa, Homo Sapiens
AGKSARAVT

SEQ ID NO: 281367 - protein, 9 aa, Homo Sapiens
GMCAALSPA

SEQ ID NO: 281368 - protein, 9 aa, Homo Sapiens
KSKTLDLID

SEQ ID NO: 281369 - protein, 9 aa, Homo Sapiens
TEHFTANVQ

SEQ ID NO: 281370 - protein, 9 aa, Homo Sapiens
PAGNWANRP

SEQ ID NO: 281371 - protein, 9 aa, Homo Sapiens
AAAGGVVLG

SEQ ID NO: 281372 - protein, 9 aa, Homo Sapiens
LLDILQHDP

SEQ ID NO: 281373 - protein, 9 aa, Homo Sapiens
GIKPSKGVI

SEQ ID NO: 281374 - protein, 9 aa, Homo Sapiens
SIYNISKKH

SEQ ID NO: 281375 - protein, 9 aa, Homo Sapiens
NKCEEFNQS

SEQ ID NO: 281376 - protein, 9 aa, Homo Sapiens
LKDQRILER

SEQ ID NO: 281377 - protein, 9 aa, Homo Sapiens
FLNSYTVQA

SEQ ID NO: 281378 - protein, 9 aa, Homo Sapiens
LASAKALVF

SEQ ID NO: 281379 - protein, 9 aa, Homo Sapiens
IVRAYQYTA

SEQ ID NO: 281380 - protein, 9 aa, Homo Sapiens
TFTITVRPR

SEQ ID NO: 281381 - protein, 9 aa, Homo Sapiens
NNLNLGGAM

SEQ ID NO: 281382 - protein, 9 aa, Homo Sapiens
LEACLGGKL

SEQ ID NO: 281383 - protein, 9 aa, Homo Sapiens
TFGLEDDVA

SEQ ID NO: 281384 - protein, 9 aa, Homo Sapiens
VFGFIDHTV

SEQ ID NO: 281385 - protein, 9 aa, Homo Sapiens
IPGARWIVH

SEQ ID NO: 281386 - protein, 9 aa, Homo Sapiens
SHFYRSPEV

SEQ ID NO: 281387 - protein, 9 aa, Homo Sapiens
MSVGSPYGS

SEQ ID NO: 281388 - protein, 9 aa, Homo Sapiens
PIYSCKVFI

SEQ ID NO: 281389 - protein, 9 aa, Homo Sapiens
HWKFPQGQN

SEQ ID NO: 281390 - protein, 9 aa, Homo Sapiens
TIASLLYLL

SEQ ID NO: 281391 - protein, 9 aa, Homo Sapiens
VPTMIKLAC

SEQ ID NO: 281392 - protein, 9 aa, Homo Sapiens
PVSLSAPGT

SEQ ID NO: 281393 - protein, 9 aa, Homo Sapiens
CLYIICAVI

SEQ ID NO: 281394 - protein, 9 aa, Homo Sapiens
EEDKNVISL

SEQ ID NO: 281395 - protein, 9 aa, Homo Sapiens
VSFWKQLLP

SEQ ID NO: 281396 - protein, 9 aa, Homo Sapiens
GQICYSTDS

SEQ ID NO: 281397 - protein, 9 aa, Homo Sapiens
SREFSRIII

SEQ ID NO: 281398 - protein, 9 aa, Homo Sapiens
PERTNKLLQ

SEQ ID NO: 281399 - protein, 9 aa, Homo Sapiens
AVDMLVNSA

SEQ ID NO: 281400 - protein, 9 aa, Homo Sapiens
NLNGFIEII

SEQ ID NO: 281401 - protein, 9 aa, Homo Sapiens
ALEKNLIKV

SEQ ID NO: 281402 - protein, 9 aa, Homo Sapiens
DKRSQCKEI

SEQ ID NO: 281403 - protein, 9 aa, Homo Sapiens
YQIKIDAHL

SEQ ID NO: 281404 - protein, 9 aa, Homo Sapiens
KSLESIKSR

SEQ ID NO: 281405 - protein, 9 aa, Homo Sapiens
SGENGRWRF

SEQ ID NO: 281406 - protein, 9 aa, Homo Sapiens
FPFLCLYYP

SEQ ID NO: 281407 - protein, 9 aa, Homo Sapiens
LISVTPDST

SEQ ID NO: 281408 - protein, 9 aa, Homo Sapiens
ASIFIYARS

SEQ ID NO: 281409 - protein, 9 aa, Homo Sapiens
YLEYNVIKD

SEQ ID NO: 281410 - protein, 9 aa, Homo Sapiens
MDEIDAALG

SEQ ID NO: 281411 - protein, 9 aa, Homo Sapiens
SKLLEIFAL

SEQ ID NO: 281412 - protein, 9 aa, Homo Sapiens
APWGKAACL

SEQ ID NO: 281413 - protein, 9 aa, Homo Sapiens
LTKCNVQKT

SEQ ID NO: 281414 - protein, 9 aa, Homo Sapiens
EGGLAWITQ

SEQ ID NO: 281415 - protein, 9 aa, Homo Sapiens
REKQSSLTK

SEQ ID NO: 281416 - protein, 9 aa, Homo Sapiens
KTGHEMEKE

SEQ ID NO: 281417 - protein, 9 aa, Homo Sapiens
HLTVQINSA

SEQ ID NO: 281418 - protein, 9 aa, Homo Sapiens
LLLFCLCEL

SEQ ID NO: 281419 - protein, 9 aa, Homo Sapiens
GSYFMISHS

SEQ ID NO: 281420 - protein, 9 aa, Homo Sapiens
EAAVMAVPH

SEQ ID NO: 281421 - protein, 9 aa, Homo Sapiens
VKSTGDRLE

SEQ ID NO: 281422 - protein, 9 aa, Homo Sapiens
NPTWHCIVS

SEQ ID NO: 281423 - protein, 9 aa, Homo Sapiens
MHHLQPLNV

SEQ ID NO: 281424 - protein, 9 aa, Homo Sapiens
NGNIYIARN

SEQ ID NO: 281425 - protein, 9 aa, Homo Sapiens
RQKITCKGF

SEQ ID NO: 281426 - protein, 9 aa, Homo Sapiens
NGKLRYEIY

SEQ ID NO: 281427 - protein, 9 aa, Homo Sapiens
TATTMKDVQ

SEQ ID NO: 281428 - protein, 9 aa, Homo Sapiens
EKRKSLDVN

SEQ ID NO: 281429 - protein, 9 aa, Homo Sapiens
VWPLDPLNG

SEQ ID NO: 281430 - protein, 9 aa, Homo Sapiens
HLRNFFFIF

SEQ ID NO: 281431 - protein, 9 aa, Homo Sapiens
RERREDGSA

SEQ ID NO: 281432 - protein, 9 aa, Homo Sapiens
RSNGVPVTR

SEQ ID NO: 281433 - protein, 9 aa, Homo Sapiens
PNMNHIALG

SEQ ID NO: 281434 - protein, 9 aa, Homo Sapiens
NTKILHTAW

SEQ ID NO: 281435 - protein, 9 aa, Homo Sapiens
TELCKRSPA

SEQ ID NO: 281436 - protein, 9 aa, Homo Sapiens
TKTLSPSRR

SEQ ID NO: 281437 - protein, 9 aa, Homo Sapiens
KDKNILHIK

SEQ ID NO: 281438 - protein, 9 aa, Homo Sapiens
NRMSQMLED

SEQ ID NO: 281439 - protein, 9 aa, Homo Sapiens
NLEKYEKFF

SEQ ID NO: 281440 - protein, 9 aa, Homo Sapiens
LDKVLEDVR

SEQ ID NO: 281441 - protein, 9 aa, Homo Sapiens
MGVIPRIVQ

SEQ ID NO: 281442 - protein, 9 aa, Homo Sapiens
QQPKENETV

SEQ ID NO: 281443 - protein, 9 aa, Homo Sapiens
TCKITLPEP

SEQ ID NO: 281444 - protein, 9 aa, Homo Sapiens
KSRDTRRHF

SEQ ID NO: 281445 - protein, 9 aa, Homo Sapiens
SYLNYSNPM

SEQ ID NO: 281446 - protein, 9 aa, Homo Sapiens
TQNRFSITS

SEQ ID NO: 281447 - protein, 9 aa, Homo Sapiens
IRGKLENDG

SEQ ID NO: 281448 - protein, 9 aa, Homo Sapiens
PPKKWIGNM

SEQ ID NO: 281449 - protein, 9 aa, Homo Sapiens
SDKPLSERL

SEQ ID NO: 281450 - protein, 9 aa, Homo Sapiens
WGPGESYQP

SEQ ID NO: 281451 - protein, 9 aa, Homo Sapiens
EAALPKVSF

SEQ ID NO: 281452 - protein, 9 aa, Homo Sapiens
LGADERILE

SEQ ID NO: 281453 - protein, 9 aa, Homo Sapiens
PERDMHYLP

SEQ ID NO: 281454 - protein, 9 aa, Homo Sapiens
DKPIDREKT

SEQ ID NO: 281455 - protein, 9 aa, Homo Sapiens
QIATTDLRQ

SEQ ID NO: 281456 - protein, 9 aa, Homo Sapiens
LFKPQQHGL

SEQ ID NO: 281457 - protein, 9 aa, Homo Sapiens
VKQINQEEC

SEQ ID NO: 281458 - protein, 9 aa, Homo Sapiens
NMIEYRTES

SEQ ID NO: 281459 - protein, 9 aa, Homo Sapiens
LCGRTLRNR

SEQ ID NO: 281460 - protein, 9 aa, Homo Sapiens
KKNRSSVKT

SEQ ID NO: 281461 - protein, 9 aa, Homo Sapiens
DLLIVGSKV

SEQ ID NO: 281462 - protein, 9 aa, Homo Sapiens
GNPMAKHLM

SEQ ID NO: 281463 - protein, 9 aa, Homo Sapiens
ELNTNLFDN

SEQ ID NO: 281464 - protein, 9 aa, Homo Sapiens
PVEEVDALF

SEQ ID NO: 281465 - protein, 9 aa, Homo Sapiens
SLYLIHEIT

SEQ ID NO: 281466 - protein, 9 aa, Homo Sapiens
ATAICQYAI

SEQ ID NO: 281467 - protein, 9 aa, Homo Sapiens
QKMRPGYGM

SEQ ID NO: 281468 - protein, 9 aa, Homo Sapiens
AQDYGAGTY

SEQ ID NO: 281469 - protein, 9 aa, Homo Sapiens
GSGDLIFQY

SEQ ID NO: 281470 - protein, 9 aa, Homo Sapiens
YIHRNSAMI

SEQ ID NO: 281471 - protein, 9 aa, Homo Sapiens
SAIVRQLLY

SEQ ID NO: 281472 - protein, 9 aa, Homo Sapiens
FGHLAGCGA

SEQ ID NO: 281473 - protein, 9 aa, Homo Sapiens
MYGRPQAEV

SEQ ID NO: 281474 - protein, 9 aa, Homo Sapiens
TTSGNGSET

SEQ ID NO: 281475 - protein, 9 aa, Homo Sapiens
GSSKDLSTL

SEQ ID NO: 281476 - protein, 9 aa, Homo Sapiens
YLNLGLLDF

SEQ ID NO: 281477 - protein, 9 aa, Homo Sapiens
DIITYREQI

SEQ ID NO: 281478 - protein, 9 aa, Homo Sapiens
IALIIFNIS

SEQ ID NO: 281479 - protein, 9 aa, Homo Sapiens
ALMVSSTSW

SEQ ID NO: 281480 - protein, 9 aa, Homo Sapiens
KRQKPTPKH

SEQ ID NO: 281481 - protein, 9 aa, Homo Sapiens
RNAVIHIPG

SEQ ID NO: 281482 - protein, 9 aa, Homo Sapiens
VTLNVRRAL

SEQ ID NO: 281483 - protein, 9 aa, Homo Sapiens
AKREEIANT

SEQ ID NO: 281484 - protein, 9 aa, Homo Sapiens
MKVVKTEYK

SEQ ID NO: 281485 - protein, 9 aa, Homo Sapiens
FSQYSSFNE

SEQ ID NO: 281486 - protein, 9 aa, Homo Sapiens
RSRSQLSEL

SEQ ID NO: 281487 - protein, 9 aa, Homo Sapiens
WIRELMLGS

SEQ ID NO: 281488 - protein, 9 aa, Homo Sapiens
AQNEEVDKD

SEQ ID NO: 281489 - protein, 9 aa, Homo Sapiens
HQVKTQSQL

SEQ ID NO: 281490 - protein, 9 aa, Homo Sapiens
QLLKATKLG

SEQ ID NO: 281491 - protein, 9 aa, Homo Sapiens
HHNYRGILY

SEQ ID NO: 281492 - protein, 9 aa, Homo Sapiens
TMYKGKSSF

SEQ ID NO: 281493 - protein, 9 aa, Homo Sapiens
EMESPTITD

SEQ ID NO: 281494 - protein, 9 aa, Homo Sapiens
DYSENLQEI

SEQ ID NO: 281495 - protein, 9 aa, Homo Sapiens
QYKKEDDLN

SEQ ID NO: 281496 - protein, 9 aa, Homo Sapiens
DNISEASER

SEQ ID NO: 281497 - protein, 9 aa, Homo Sapiens
ASTIESGYG

SEQ ID NO: 281498 - protein, 9 aa, Homo Sapiens
SSPERFPVP

SEQ ID NO: 281499 - protein, 9 aa, Homo Sapiens
MDSFKDKME

SEQ ID NO: 281500 - protein, 9 aa, Homo Sapiens
QLSYALRTI

SEQ ID NO: 281501 - protein, 9 aa, Homo Sapiens
PLEIVLKLL

SEQ ID NO: 281502 - protein, 9 aa, Homo Sapiens
SSLYGGEVL

SEQ ID NO: 281503 - protein, 9 aa, Homo Sapiens
NSKKTTTNP

SEQ ID NO: 281504 - protein, 9 aa, Homo Sapiens
LGEYLLSGK

SEQ ID NO: 281505 - protein, 9 aa, Homo Sapiens
FLDLCFTMS

SEQ ID NO: 281506 - protein, 9 aa, Homo Sapiens
PAKNYSAVI

SEQ ID NO: 281507 - protein, 9 aa, Homo Sapiens
EQKRMNISP

SEQ ID NO: 281508 - protein, 9 aa, Homo Sapiens
QPKTQFIGV

SEQ ID NO: 281509 - protein, 9 aa, Homo Sapiens
RHEDKEDNA

SEQ ID NO: 281510 - protein, 9 aa, Homo Sapiens
YKSLLSVEE

SEQ ID NO: 281511 - protein, 9 aa, Homo Sapiens
TLAVGGLGS

SEQ ID NO: 281512 - protein, 9 aa, Homo Sapiens
NIHLKKMAY

SEQ ID NO: 281513 - protein, 9 aa, Homo Sapiens
HTGNTPFVC

SEQ ID NO: 281514 - protein, 9 aa, Homo Sapiens
ERDRKSRLE

SEQ ID NO: 281515 - protein, 9 aa, Homo Sapiens
MSEFPNTCT

SEQ ID NO: 281516 - protein, 9 aa, Homo Sapiens
DKGYPKLLQ

SEQ ID NO: 281517 - protein, 9 aa, Homo Sapiens
KCLVRYIYY

SEQ ID NO: 281518 - protein, 9 aa, Homo Sapiens
ATTDPITNS

SEQ ID NO: 281519 - protein, 9 aa, Homo Sapiens
VFTEFLATL

SEQ ID NO: 281520 - protein, 9 aa, Homo Sapiens
HYYSIMNRR

SEQ ID NO: 281521 - protein, 9 aa, Homo Sapiens
HVNMMASSA

SEQ ID NO: 281522 - protein, 9 aa, Homo Sapiens
MEMKELLSE

SEQ ID NO: 281523 - protein, 9 aa, Homo Sapiens
NRHVQINAH

SEQ ID NO: 281524 - protein, 9 aa, Homo Sapiens
NRYRYVSPF

SEQ ID NO: 281525 - protein, 9 aa, Homo Sapiens
EYYARTWYW

SEQ ID NO: 281526 - protein, 9 aa, Homo Sapiens
ELAVEPNTE

SEQ ID NO: 281527 - protein, 9 aa, Homo Sapiens
RMKWKKYNK

SEQ ID NO: 281528 - protein, 9 aa, Homo Sapiens
MGPLAQQMN

SEQ ID NO: 281529 - protein, 9 aa, Homo Sapiens
FQESNDTTQ

SEQ ID NO: 281530 - protein, 9 aa, Homo Sapiens
LYSPGPLDS

SEQ ID NO: 281531 - protein, 9 aa, Homo Sapiens
RVSWQDLKE

SEQ ID NO: 281532 - protein, 9 aa, Homo Sapiens
LLTYVKGRK

SEQ ID NO: 281533 - protein, 9 aa, Homo Sapiens
SMEDYGAEK

SEQ ID NO: 281534 - protein, 9 aa, Homo Sapiens
HLVKSYPGA

SEQ ID NO: 281535 - protein, 9 aa, Homo Sapiens
SHLNNSDSI

SEQ ID NO: 281536 - protein, 9 aa, Homo Sapiens
SCFPRYRSR

SEQ ID NO: 281537 - protein, 9 aa, Homo Sapiens
HVKKEKTEK

SEQ ID NO: 281538 - protein, 9 aa, Homo Sapiens
TTQLIFGSV

SEQ ID NO: 281539 - protein, 9 aa, Homo Sapiens
IWKLFFRKL

SEQ ID NO: 281540 - protein, 9 aa, Homo Sapiens
LKWLPSGMK

SEQ ID NO: 281541 - protein, 9 aa, Homo Sapiens
EVPDDSALQ

SEQ ID NO: 281542 - protein, 9 aa, Homo Sapiens
LNHFSRAVA

SEQ ID NO: 281543 - protein, 9 aa, Homo Sapiens
RRDCLVELE

SEQ ID NO: 281544 - protein, 9 aa, Homo Sapiens
EDGTLIVVG

SEQ ID NO: 281545 - protein, 9 aa, Homo Sapiens
YTLLDEPFQ

SEQ ID NO: 281546 - protein, 9 aa, Homo Sapiens
VEENNFGSS

SEQ ID NO: 281547 - protein, 9 aa, Homo Sapiens
SPLNAACCQ

SEQ ID NO: 281548 - protein, 9 aa, Homo Sapiens
LYLLSMASS

SEQ ID NO: 281549 - protein, 9 aa, Homo Sapiens
EESPQKYIY

SEQ ID NO: 281550 - protein, 9 aa, Homo Sapiens
NLLWLSVCH

SEQ ID NO: 281551 - protein, 9 aa, Homo Sapiens
SYSVTKSYI

SEQ ID NO: 281552 - protein, 9 aa, Homo Sapiens
REAVVTAVQ

SEQ ID NO: 281553 - protein, 9 aa, Homo Sapiens
CAQSNQYQV

SEQ ID NO: 281554 - protein, 9 aa, Homo Sapiens
LTLPWRTHD

SEQ ID NO: 281555 - protein, 9 aa, Homo Sapiens
CESDSLNDF

SEQ ID NO: 281556 - protein, 9 aa, Homo Sapiens
NATFIKGVY

SEQ ID NO: 281557 - protein, 9 aa, Homo Sapiens
WRTSGKWTS

SEQ ID NO: 281558 - protein, 9 aa, Homo Sapiens
FVIEDIPGE

SEQ ID NO: 281559 - protein, 9 aa, Homo Sapiens
AEVAEVEMG

SEQ ID NO: 281560 - protein, 9 aa, Homo Sapiens
LITGVNFTG

SEQ ID NO: 281561 - protein, 9 aa, Homo Sapiens
QVTLNIPIS

SEQ ID NO: 281562 - protein, 9 aa, Homo Sapiens
WSWCRIPSE

SEQ ID NO: 281563 - protein, 9 aa, Homo Sapiens
TCQIPSLEE

SEQ ID NO: 281564 - protein, 9 aa, Homo Sapiens
IHADKQDCR

SEQ ID NO: 281565 - protein, 9 aa, Homo Sapiens
LHKFLETEK

SEQ ID NO: 281566 - protein, 9 aa, Homo Sapiens
NSRTDESEF

SEQ ID NO: 281567 - protein, 9 aa, Homo Sapiens
QFMPPEKVH

SEQ ID NO: 281568 - protein, 9 aa, Homo Sapiens
EDKEDNARK

SEQ ID NO: 281569 - protein, 9 aa, Homo Sapiens
TRYKIKSDE

SEQ ID NO: 281570 - protein, 9 aa, Homo Sapiens
ELQYFDDIA

SEQ ID NO: 281571 - protein, 9 aa, Homo Sapiens
CSLRNVQPD

SEQ ID NO: 281572 - protein, 9 aa, Homo Sapiens
YNTGTFESM

SEQ ID NO: 281573 - protein, 9 aa, Homo Sapiens
NKRYIRESA

SEQ ID NO: 281574 - protein, 9 aa, Homo Sapiens
YGRGVCMYH

SEQ ID NO: 281575 - protein, 9 aa, Homo Sapiens
PDMDTESHL

SEQ ID NO: 281576 - protein, 9 aa, Homo Sapiens
RMDYDDDRL

SEQ ID NO: 281577 - protein, 9 aa, Homo Sapiens
KQQTFPWFG

SEQ ID NO: 281578 - protein, 9 aa, Homo Sapiens
QESKRAIQA

SEQ ID NO: 281579 - protein, 9 aa, Homo Sapiens
GRDLGPPTK

SEQ ID NO: 281580 - protein, 9 aa, Homo Sapiens
PHVLMPEVT

SEQ ID NO: 281581 - protein, 9 aa, Homo Sapiens
HAAPFSKAL

SEQ ID NO: 281582 - protein, 9 aa, Homo Sapiens
LVDELNIKA

SEQ ID NO: 281583 - protein, 9 aa, Homo Sapiens
AIYVKGQWE

SEQ ID NO: 281584 - protein, 9 aa, Homo Sapiens
HLMNVTATY

SEQ ID NO: 281585 - protein, 9 aa, Homo Sapiens
SDLIGFKRN

SEQ ID NO: 281586 - protein, 9 aa, Homo Sapiens
GLSDLKALQ

SEQ ID NO: 281587 - protein, 9 aa, Homo Sapiens
LHISMEDYG

SEQ ID NO: 281588 - protein, 9 aa, Homo Sapiens
RQYHGAWLS

SEQ ID NO: 281589 - protein, 9 aa, Homo Sapiens
GFAGMDEMV

SEQ ID NO: 281590 - protein, 9 aa, Homo Sapiens
THNLYMIMR

SEQ ID NO: 281591 - protein, 9 aa, Homo Sapiens
RSILALGNV

SEQ ID NO: 281592 - protein, 9 aa, Homo Sapiens
EVWEKRITK

SEQ ID NO: 281593 - protein, 9 aa, Homo Sapiens
CIRIHKVMK

SEQ ID NO: 281594 - protein, 9 aa, Homo Sapiens
KSHLIRHQI

SEQ ID NO: 281595 - protein, 9 aa, Homo Sapiens
DWSKEKQLR

SEQ ID NO: 281596 - protein, 9 aa, Homo Sapiens
RGENFQCLN

SEQ ID NO: 281597 - protein, 9 aa, Homo Sapiens
NRIDKENRE

SEQ ID NO: 281598 - protein, 9 aa, Homo Sapiens
PPSSGSTGG

SEQ ID NO: 281599 - protein, 9 aa, Homo Sapiens
QLVAVQAIR

SEQ ID NO: 281600 - protein, 9 aa, Homo Sapiens
VSFHIGSDC

SEQ ID NO: 281601 - protein, 9 aa, Homo Sapiens
RNFFFIFFF

SEQ ID NO: 281602 - protein, 9 aa, Homo Sapiens
EKAIAQQWL

SEQ ID NO: 281603 - protein, 9 aa, Homo Sapiens
SRCHSSRSH

SEQ ID NO: 281604 - protein, 9 aa, Homo Sapiens
LLLDFKREL

SEQ ID NO: 281605 - protein, 9 aa, Homo Sapiens
IYPVVIKLS

SEQ ID NO: 281606 - protein, 9 aa, Homo Sapiens
GESLLNYAV

SEQ ID NO: 281607 - protein, 9 aa, Homo Sapiens
HVYGPFYAN

SEQ ID NO: 281608 - protein, 9 aa, Homo Sapiens
KELDSLQNE

SEQ ID NO: 281609 - protein, 9 aa, Homo Sapiens
RQAASQSLG

SEQ ID NO: 281610 - protein, 9 aa, Homo Sapiens
LKSHGIIRF

SEQ ID NO: 281611 - protein, 9 aa, Homo Sapiens
RSVFGEINF

SEQ ID NO: 281612 - protein, 9 aa, Homo Sapiens
GKAFFSPSL

SEQ ID NO: 281613 - protein, 9 aa, Homo Sapiens
GFNVDHGIC

SEQ ID NO: 281614 - protein, 9 aa, Homo Sapiens
LNSPLTGKF

SEQ ID NO: 281615 - protein, 9 aa, Homo Sapiens
CYYSHFIDE

SEQ ID NO: 281616 - protein, 9 aa, Homo Sapiens
ELSALKTQR

SEQ ID NO: 281617 - protein, 9 aa, Homo Sapiens
AFTQENYTV

SEQ ID NO: 281618 - protein, 9 aa, Homo Sapiens
EEMKKLPLL

SEQ ID NO: 281619 - protein, 9 aa, Homo Sapiens
VSNQKPGTD

SEQ ID NO: 281620 - protein, 9 aa, Homo Sapiens
TILCDKLSG

SEQ ID NO: 281621 - protein, 9 aa, Homo Sapiens
AEIAISLFF

SEQ ID NO: 281622 - protein, 9 aa, Homo Sapiens
EVLLTKIHL

SEQ ID NO: 281623 - protein, 9 aa, Homo Sapiens
LINTFSLIE

SEQ ID NO: 281624 - protein, 9 aa, Homo Sapiens
KRMPQERIE

SEQ ID NO: 281625 - protein, 9 aa, Homo Sapiens
LSQICLNTE

SEQ ID NO: 281626 - protein, 9 aa, Homo Sapiens
VGWPRNWHQ

SEQ ID NO: 281627 - protein, 9 aa, Homo Sapiens
EQKQEIKYA

SEQ ID NO: 281628 - protein, 9 aa, Homo Sapiens
RSAQKENTA

SEQ ID NO: 281629 - protein, 9 aa, Homo Sapiens
NVQEMSQAK

SEQ ID NO: 281630 - protein, 9 aa, Homo Sapiens
LMEKKPSWS

SEQ ID NO: 281631 - protein, 9 aa, Homo Sapiens
LRCPLQRLL

SEQ ID NO: 281632 - protein, 9 aa, Homo Sapiens
SGKRLSSVD

SEQ ID NO: 281633 - protein, 9 aa, Homo Sapiens
MSHFLKMES

SEQ ID NO: 281634 - protein, 9 aa, Homo Sapiens
FILYAYWIG

SEQ ID NO: 281635 - protein, 9 aa, Homo Sapiens
VDGLMLKFA

SEQ ID NO: 281636 - protein, 9 aa, Homo Sapiens
KNFFVEASM

SEQ ID NO: 281637 - protein, 9 aa, Homo Sapiens
LILHDALSL

SEQ ID NO: 281638 - protein, 9 aa, Homo Sapiens
RTLEDHIKR

SEQ ID NO: 281639 - protein, 9 aa, Homo Sapiens
PDKAEREPL

SEQ ID NO: 281640 - protein, 9 aa, Homo Sapiens
VVKVVKPKR

SEQ ID NO: 281641 - protein, 9 aa, Homo Sapiens
KVGDWIMAT

SEQ ID NO: 281642 - protein, 9 aa, Homo Sapiens
GMIIIININ

SEQ ID NO: 281643 - protein, 9 aa, Homo Sapiens
MGYTSRSEQ

SEQ ID NO: 281644 - protein, 9 aa, Homo Sapiens
MMFPVLGPQ

SEQ ID NO: 281645 - protein, 9 aa, Homo Sapiens
DSYLVQYAL

SEQ ID NO: 281646 - protein, 9 aa, Homo Sapiens
LGVKGNYLR

SEQ ID NO: 281647 - protein, 9 aa, Homo Sapiens
ALVGMYGRK

SEQ ID NO: 281648 - protein, 9 aa, Homo Sapiens
SLRITKCIG

SEQ ID NO: 281649 - protein, 9 aa, Homo Sapiens
AGGVVLGGY

SEQ ID NO: 281650 - protein, 9 aa, Homo Sapiens
ANGIQFRAL

SEQ ID NO: 281651 - protein, 9 aa, Homo Sapiens
GHSLGPSHT

SEQ ID NO: 281652 - protein, 9 aa, Homo Sapiens
ILTQTALNL

SEQ ID NO: 281653 - protein, 9 aa, Homo Sapiens
VGVGLYGNS

SEQ ID NO: 281654 - protein, 9 aa, Homo Sapiens
SAWCLWRPQ

SEQ ID NO: 281655 - protein, 9 aa, Homo Sapiens
LDPNLSFEG

SEQ ID NO: 281656 - protein, 9 aa, Homo Sapiens
GETKKTGHE

SEQ ID NO: 281657 - protein, 9 aa, Homo Sapiens
LEELRQIVK

SEQ ID NO: 281658 - protein, 9 aa, Homo Sapiens
PEPSTYIQI

SEQ ID NO: 281659 - protein, 9 aa, Homo Sapiens
DSLKTTQPE

SEQ ID NO: 281660 - protein, 9 aa, Homo Sapiens
DLMKKFAEA

SEQ ID NO: 281661 - protein, 9 aa, Homo Sapiens
RLKESKTPA

SEQ ID NO: 281662 - protein, 9 aa, Homo Sapiens
AENINTFLT

SEQ ID NO: 281663 - protein, 9 aa, Homo Sapiens
QPAPAMTSH

SEQ ID NO: 281664 - protein, 9 aa, Homo Sapiens
GAQQWMTQS

SEQ ID NO: 281665 - protein, 9 aa, Homo Sapiens
DMKRYLHQN

SEQ ID NO: 281666 - protein, 9 aa, Homo Sapiens
DKFCHSSLS

SEQ ID NO: 281667 - protein, 9 aa, Homo Sapiens
YLVFTVGLL

SEQ ID NO: 281668 - protein, 9 aa, Homo Sapiens
ESDSLNDFV

SEQ ID NO: 281669 - protein, 9 aa, Homo Sapiens
MYQRLQGND

SEQ ID NO: 281670 - protein, 9 aa, Homo Sapiens
KVLQNHLQE

SEQ ID NO: 281671 - protein, 9 aa, Homo Sapiens
LKTLLDFIL

SEQ ID NO: 281672 - protein, 9 aa, Homo Sapiens
NILQRRLMG

SEQ ID NO: 281673 - protein, 9 aa, Homo Sapiens
TRCGKFEYD

SEQ ID NO: 281674 - protein, 9 aa, Homo Sapiens
PNNLFFFFF

SEQ ID NO: 281675 - protein, 9 aa, Homo Sapiens
LNITHKAKS

SEQ ID NO: 281676 - protein, 9 aa, Homo Sapiens
IIIARSEID

SEQ ID NO: 281677 - protein, 9 aa, Homo Sapiens
PSLDNPTPL

SEQ ID NO: 281678 - protein, 9 aa, Homo Sapiens
LPSQPRYSW

SEQ ID NO: 281679 - protein, 9 aa, Homo Sapiens
ANTSIISFQ

SEQ ID NO: 281680 - protein, 9 aa, Homo Sapiens
QFRALRWYL

SEQ ID NO: 281681 - protein, 9 aa, Homo Sapiens
YPGLPGELT

SEQ ID NO: 281682 - protein, 9 aa, Homo Sapiens
GPQGDKGDQ

SEQ ID NO: 281683 - protein, 9 aa, Homo Sapiens
DNFIPGHLQ

SEQ ID NO: 281684 - protein, 9 aa, Homo Sapiens
ILSYSGSVD

SEQ ID NO: 281685 - protein, 9 aa, Homo Sapiens
RLSFDYRVD

SEQ ID NO: 281686 - protein, 9 aa, Homo Sapiens
FKMTTGHTY

SEQ ID NO: 281687 - protein, 9 aa, Homo Sapiens
INFEMQPIH

SEQ ID NO: 281688 - protein, 9 aa, Homo Sapiens
GCFGEGDNL

SEQ ID NO: 281689 - protein, 9 aa, Homo Sapiens
YSCWRTNPL

SEQ ID NO: 281690 - protein, 9 aa, Homo Sapiens
ETICYLAAS

SEQ ID NO: 281691 - protein, 9 aa, Homo Sapiens
LGGCEIVLL

SEQ ID NO: 281692 - protein, 9 aa, Homo Sapiens
VKDDIAYVS

SEQ ID NO: 281693 - protein, 9 aa, Homo Sapiens
AHAQEQIHR

SEQ ID NO: 281694 - protein, 9 aa, Homo Sapiens
NNLFFFFFF

SEQ ID NO: 281695 - protein, 9 aa, Homo Sapiens
NHSVIVNPP

SEQ ID NO: 281696 - protein, 9 aa, Homo Sapiens
QPSPHKPPY

SEQ ID NO: 281697 - protein, 9 aa, Homo Sapiens
LVGIFILTV

SEQ ID NO: 281698 - protein, 9 aa, Homo Sapiens
LYPDNSEQL

SEQ ID NO: 281699 - protein, 9 aa, Homo Sapiens
VDDLNYEDK

SEQ ID NO: 281700 - protein, 9 aa, Homo Sapiens
DETEDIFLN

SEQ ID NO: 281701 - protein, 9 aa, Homo Sapiens
KSKLVIWDI

SEQ ID NO: 281702 - protein, 9 aa, Homo Sapiens
KSMSMAGCA

SEQ ID NO: 281703 - protein, 9 aa, Homo Sapiens
IEQNRRAQD

SEQ ID NO: 281704 - protein, 9 aa, Homo Sapiens
VPLKIEYIS

SEQ ID NO: 281705 - protein, 9 aa, Homo Sapiens
NYMQLKQPS

SEQ ID NO: 281706 - protein, 9 aa, Homo Sapiens
ISGIRPENL

SEQ ID NO: 281707 - protein, 9 aa, Homo Sapiens
TPIGYPYRD

SEQ ID NO: 281708 - protein, 9 aa, Homo Sapiens
GPQPSTRKA

SEQ ID NO: 281709 - protein, 9 aa, Homo Sapiens
SFCGANAIR

SEQ ID NO: 281710 - protein, 9 aa, Homo Sapiens
ECLQTNTDH

SEQ ID NO: 281711 - protein, 9 aa, Homo Sapiens
KNEQYCIFA

SEQ ID NO: 281712 - protein, 9 aa, Homo Sapiens
EITKNIDVK

SEQ ID NO: 281713 - protein, 9 aa, Homo Sapiens
MGGVYWICN

SEQ ID NO: 281714 - protein, 9 aa, Homo Sapiens
VHISAHHLH

SEQ ID NO: 281715 - protein, 9 aa, Homo Sapiens
LEALGILQC

SEQ ID NO: 281716 - protein, 9 aa, Homo Sapiens
HSYLFKGAY

SEQ ID NO: 281717 - protein, 9 aa, Homo Sapiens
RTVNNKTLY

SEQ ID NO: 281718 - protein, 9 aa, Homo Sapiens
QQIMQLLCE

SEQ ID NO: 281719 - protein, 9 aa, Homo Sapiens
VTGNFFIFL

SEQ ID NO: 281720 - protein, 9 aa, Homo Sapiens
DHHIIHTGE

SEQ ID NO: 281721 - protein, 9 aa, Homo Sapiens
RSKKFLIWL

SEQ ID NO: 281722 - protein, 9 aa, Homo Sapiens
QNRCSSCGY

SEQ ID NO: 281723 - protein, 9 aa, Homo Sapiens
STLIPSESK

SEQ ID NO: 281724 - protein, 9 aa, Homo Sapiens
SVNSVLCHG

SEQ ID NO: 281725 - protein, 9 aa, Homo Sapiens
TNSSHYGDF

SEQ ID NO: 281726 - protein, 9 aa, Homo Sapiens
DANWWKGEH

SEQ ID NO: 281727 - protein, 9 aa, Homo Sapiens
SSSVSLTVT

SEQ ID NO: 281728 - protein, 9 aa, Homo Sapiens
CDGKNLTIN

SEQ ID NO: 281729 - protein, 9 aa, Homo Sapiens
SLHCSWNYR

SEQ ID NO: 281730 - protein, 9 aa, Homo Sapiens
GVVLGGYSP

SEQ ID NO: 281731 - protein, 9 aa, Homo Sapiens
YCKTWQDED

SEQ ID NO: 281732 - protein, 9 aa, Homo Sapiens
TQDPFLTGS

SEQ ID NO: 281733 - protein, 9 aa, Homo Sapiens
YQWDVPEDW

SEQ ID NO: 281734 - protein, 9 aa, Homo Sapiens
KHLKGKVVT

SEQ ID NO: 281735 - protein, 9 aa, Homo Sapiens
PISGPGFKL

SEQ ID NO: 281736 - protein, 9 aa, Homo Sapiens
SSKCLSYQG

SEQ ID NO: 281737 - protein, 9 aa, Homo Sapiens
LTPVFVRCL

SEQ ID NO: 281738 - protein, 9 aa, Homo Sapiens
TPGELPSHP

SEQ ID NO: 281739 - protein, 9 aa, Homo Sapiens
KCKMSLEIT

SEQ ID NO: 281740 - protein, 9 aa, Homo Sapiens
DQTSLELFS

SEQ ID NO: 281741 - protein, 9 aa, Homo Sapiens
FVKLSNNMK

SEQ ID NO: 281742 - protein, 9 aa, Homo Sapiens
YRIDHTFEQ

SEQ ID NO: 281743 - protein, 9 aa, Homo Sapiens
YGSQMESWG

SEQ ID NO: 281744 - protein, 9 aa, Homo Sapiens
LLNEIIADV

SEQ ID NO: 281745 - protein, 9 aa, Homo Sapiens
IHECTHTGE

SEQ ID NO: 281746 - protein, 9 aa, Homo Sapiens
SLEYLNNKY

SEQ ID NO: 281747 - protein, 9 aa, Homo Sapiens
TYISCPLIG

SEQ ID NO: 281748 - protein, 9 aa, Homo Sapiens
YVDKDNGEP

SEQ ID NO: 281749 - protein, 9 aa, Homo Sapiens
KQGKRKNAI

SEQ ID NO: 281750 - protein, 9 aa, Homo Sapiens
GEPDIYRPL

SEQ ID NO: 281751 - protein, 9 aa, Homo Sapiens
SAVNMFQKH

SEQ ID NO: 281752 - protein, 9 aa, Homo Sapiens
MELIVGKKF

SEQ ID NO: 281753 - protein, 9 aa, Homo Sapiens
KIRPNWQLE

SEQ ID NO: 281754 - protein, 9 aa, Homo Sapiens
GDNAIFESL

SEQ ID NO: 281755 - protein, 9 aa, Homo Sapiens
IFYQIISGQ

SEQ ID NO: 281756 - protein, 9 aa, Homo Sapiens
HGLCGHWGR

SEQ ID NO: 281757 - protein, 9 aa, Homo Sapiens
KDKGISDED

SEQ ID NO: 281758 - protein, 9 aa, Homo Sapiens
RAQLKKILW

SEQ ID NO: 281759 - protein, 9 aa, Homo Sapiens
NDTTQLIFG

SEQ ID NO: 281760 - protein, 9 aa, Homo Sapiens
DVHWHKSKG

SEQ ID NO: 281761 - protein, 9 aa, Homo Sapiens
EGPVEKETE

SEQ ID NO: 281762 - protein, 9 aa, Homo Sapiens
PAGFFNMWG

SEQ ID NO: 281763 - protein, 9 aa, Homo Sapiens
KLQRRDNTL

SEQ ID NO: 281764 - protein, 9 aa, Homo Sapiens
LLFVELFIS

SEQ ID NO: 281765 - protein, 9 aa, Homo Sapiens
KPYCQKDFL

SEQ ID NO: 281766 - protein, 9 aa, Homo Sapiens
NLWIYLAAV

SEQ ID NO: 281767 - protein, 9 aa, Homo Sapiens
LQAGKLFLL

SEQ ID NO: 281768 - protein, 9 aa, Homo Sapiens
CPRSRALSR

SEQ ID NO: 281769 - protein, 9 aa, Homo Sapiens
ACPTRDLPR

SEQ ID NO: 281770 - protein, 9 aa, Homo Sapiens
SRGQTQSGK

SEQ ID NO: 281771 - protein, 9 aa, Homo Sapiens
TRLEKDKWM

SEQ ID NO: 281772 - protein, 9 aa, Homo Sapiens
AAGVIVCLY

SEQ ID NO: 281773 - protein, 9 aa, Homo Sapiens
SRRLDDLSL

SEQ ID NO: 281774 - protein, 9 aa, Homo Sapiens
KPQVCLTTS

SEQ ID NO: 281775 - protein, 9 aa, Homo Sapiens
CTAPAPPIE

SEQ ID NO: 281776 - protein, 9 aa, Homo Sapiens
PMDYAFSYL

SEQ ID NO: 281777 - protein, 9 aa, Homo Sapiens
DEEMVEAKV

SEQ ID NO: 281778 - protein, 9 aa, Homo Sapiens
GKTPEEICK

SEQ ID NO: 281779 - protein, 9 aa, Homo Sapiens
QRKFLNDLE

SEQ ID NO: 281780 - protein, 9 aa, Homo Sapiens
WAQIINDAF

SEQ ID NO: 281781 - protein, 9 aa, Homo Sapiens
SAGWKNSIH

SEQ ID NO: 281782 - protein, 9 aa, Homo Sapiens
AKEGDLQKV

SEQ ID NO: 281783 - protein, 9 aa, Homo Sapiens
SRFSQVFCL

SEQ ID NO: 281784 - protein, 9 aa, Homo Sapiens
GASESISTN

SEQ ID NO: 281785 - protein, 9 aa, Homo Sapiens
NVDFGQPSP

SEQ ID NO: 281786 - protein, 9 aa, Homo Sapiens
IQEPSYVSQ

SEQ ID NO: 281787 - protein, 9 aa, Homo Sapiens
FSVCILTAC

SEQ ID NO: 281788 - protein, 9 aa, Homo Sapiens
GILAIFQAL

SEQ ID NO: 281789 - protein, 9 aa, Homo Sapiens
EECGKRFTD

SEQ ID NO: 281790 - protein, 9 aa, Homo Sapiens
EHLPYLSPY

SEQ ID NO: 281791 - protein, 9 aa, Homo Sapiens
KKKNFERES

SEQ ID NO: 281792 - protein, 9 aa, Homo Sapiens
QGYIEVKMS

SEQ ID NO: 281793 - protein, 9 aa, Homo Sapiens
HVSTSRVFQ

SEQ ID NO: 281794 - protein, 9 aa, Homo Sapiens
SSKRMLPPA

SEQ ID NO: 281795 - protein, 9 aa, Homo Sapiens
ISCPGRDSF

SEQ ID NO: 281796 - protein, 9 aa, Homo Sapiens
SDDGRGFVD

SEQ ID NO: 281797 - protein, 9 aa, Homo Sapiens
QGTHTIIDN

SEQ ID NO: 281798 - protein, 9 aa, Homo Sapiens
VEDEDDEFL

SEQ ID NO: 281799 - protein, 9 aa, Homo Sapiens
EQFHLFCKD

SEQ ID NO: 281800 - protein, 9 aa, Homo Sapiens
DILKKQEGA

SEQ ID NO: 281801 - protein, 9 aa, Homo Sapiens
SSTESLGLH

SEQ ID NO: 281802 - protein, 9 aa, Homo Sapiens
INNHTGPSH

SEQ ID NO: 281803 - protein, 9 aa, Homo Sapiens
EILDPNDPL

SEQ ID NO: 281804 - protein, 9 aa, Homo Sapiens
KNLEKEKYD

SEQ ID NO: 281805 - protein, 9 aa, Homo Sapiens
EITRQATSP

SEQ ID NO: 281806 - protein, 9 aa, Homo Sapiens
VLSEDGDGH

SEQ ID NO: 281807 - protein, 9 aa, Homo Sapiens
PPGFPVKIG

SEQ ID NO: 281808 - protein, 9 aa, Homo Sapiens
EKSTKKTYF

SEQ ID NO: 281809 - protein, 9 aa, Homo Sapiens
KKVWEYTML

SEQ ID NO: 281810 - protein, 9 aa, Homo Sapiens
QLVRGIRKE

SEQ ID NO: 281811 - protein, 9 aa, Homo Sapiens
LCLYVVAGV

SEQ ID NO: 281812 - protein, 9 aa, Homo Sapiens
MAKKHKKIC

SEQ ID NO: 281813 - protein, 9 aa, Homo Sapiens
ECQMREMEE

SEQ ID NO: 281814 - protein, 9 aa, Homo Sapiens
VNHEFAYTT

SEQ ID NO: 281815 - protein, 9 aa, Homo Sapiens
YRGRATGKG

SEQ ID NO: 281816 - protein, 9 aa, Homo Sapiens
WCNNAPDIF

SEQ ID NO: 281817 - protein, 9 aa, Homo Sapiens
NTRVYKQTN

SEQ ID NO: 281818 - protein, 9 aa, Homo Sapiens
DVDTKAAVA

SEQ ID NO: 281819 - protein, 9 aa, Homo Sapiens
SMCSHFSFR

SEQ ID NO: 281820 - protein, 9 aa, Homo Sapiens
RSTIHNTYH

SEQ ID NO: 281821 - protein, 9 aa, Homo Sapiens
AVSLLYPVA

SEQ ID NO: 281822 - protein, 9 aa, Homo Sapiens
YQVMFMCCC

SEQ ID NO: 281823 - protein, 9 aa, Homo Sapiens
TTGSRQSST

SEQ ID NO: 281824 - protein, 9 aa, Homo Sapiens
DKPEAQRLN

SEQ ID NO: 281825 - protein, 9 aa, Homo Sapiens
PEEVTKYQP

SEQ ID NO: 281826 - protein, 9 aa, Homo Sapiens
DKHEAVLQS

SEQ ID NO: 281827 - protein, 9 aa, Homo Sapiens
RLMSAGILG

SEQ ID NO: 281828 - protein, 9 aa, Homo Sapiens
DRNSMTSQE

SEQ ID NO: 281829 - protein, 9 aa, Homo Sapiens
KRNSHTDSD

SEQ ID NO: 281830 - protein, 9 aa, Homo Sapiens
WGTPAKINK

SEQ ID NO: 281831 - protein, 9 aa, Homo Sapiens
LVDWMYPTY

SEQ ID NO: 281832 - protein, 9 aa, Homo Sapiens
GLSMPMDSE

SEQ ID NO: 281833 - protein, 9 aa, Homo Sapiens
KRIKKLLVS

SEQ ID NO: 281834 - protein, 9 aa, Homo Sapiens
TEALSNLTA

SEQ ID NO: 281835 - protein, 9 aa, Homo Sapiens
EASKSVSST

SEQ ID NO: 281836 - protein, 9 aa, Homo Sapiens
AQLLFNTTK

SEQ ID NO: 281837 - protein, 9 aa, Homo Sapiens
MYEQFYSPN

SEQ ID NO: 281838 - protein, 9 aa, Homo Sapiens
LDDNPWDCS

SEQ ID NO: 281839 - protein, 9 aa, Homo Sapiens
VSNYEKIRT

SEQ ID NO: 281840 - protein, 9 aa, Homo Sapiens
RWEQPQLFW

SEQ ID NO: 281841 - protein, 9 aa, Homo Sapiens
CVTVPNMLG

SEQ ID NO: 281842 - protein, 9 aa, Homo Sapiens
AAIKEAIRI

SEQ ID NO: 281843 - protein, 9 aa, Homo Sapiens
PSGMEIYFA

SEQ ID NO: 281844 - protein, 9 aa, Homo Sapiens
GREKTLAQI

SEQ ID NO: 281845 - protein, 9 aa, Homo Sapiens
SEAISLIIH

SEQ ID NO: 281846 - protein, 9 aa, Homo Sapiens
KNKNKGKKG

SEQ ID NO: 281847 - protein, 9 aa, Homo Sapiens
QCRRIELTV

SEQ ID NO: 281848 - protein, 9 aa, Homo Sapiens
NLGVALEIN

SEQ ID NO: 281849 - protein, 9 aa, Homo Sapiens
FQNHIRIHT

SEQ ID NO: 281850 - protein, 9 aa, Homo Sapiens
DNDIKVEIR

SEQ ID NO: 281851 - protein, 9 aa, Homo Sapiens
SESKSQIKL

SEQ ID NO: 281852 - protein, 9 aa, Homo Sapiens
HLPYLSPYH

SEQ ID NO: 281853 - protein, 9 aa, Homo Sapiens
AQGDYPKYI

SEQ ID NO: 281854 - protein, 9 aa, Homo Sapiens
VPEAAKGKP

SEQ ID NO: 281855 - protein, 9 aa, Homo Sapiens
GAQLDILID

SEQ ID NO: 281856 - protein, 9 aa, Homo Sapiens
QPLAYLWQK

SEQ ID NO: 281857 - protein, 9 aa, Homo Sapiens
DQACPRMDD

SEQ ID NO: 281858 - protein, 9 aa, Homo Sapiens
KSPEVPEVV

SEQ ID NO: 281859 - protein, 9 aa, Homo Sapiens
QSVVYVATL

SEQ ID NO: 281860 - protein, 9 aa, Homo Sapiens
IILNKGKAI

SEQ ID NO: 281861 - protein, 9 aa, Homo Sapiens
LNQSDIKED

SEQ ID NO: 281862 - protein, 9 aa, Homo Sapiens
TLFCCHKGP

SEQ ID NO: 281863 - protein, 9 aa, Homo Sapiens
CKDLAVVLV

SEQ ID NO: 281864 - protein, 9 aa, Homo Sapiens
QELTVFRED

SEQ ID NO: 281865 - protein, 9 aa, Homo Sapiens
SVKYQNQHT

SEQ ID NO: 281866 - protein, 9 aa, Homo Sapiens
AKNAVLSEA

SEQ ID NO: 281867 - protein, 9 aa, Homo Sapiens
RYMLEQRDV

SEQ ID NO: 281868 - protein, 9 aa, Homo Sapiens
YRCQCPPGH

SEQ ID NO: 281869 - protein, 9 aa, Homo Sapiens
SYCFKTSVD

SEQ ID NO: 281870 - protein, 9 aa, Homo Sapiens
LLDPSQNNL

SEQ ID NO: 281871 - protein, 9 aa, Homo Sapiens
EIILDIATK

SEQ ID NO: 281872 - protein, 9 aa, Homo Sapiens
DFLEDVYIQ

SEQ ID NO: 281873 - protein, 9 aa, Homo Sapiens
VAAVLDQHA

SEQ ID NO: 281874 - protein, 9 aa, Homo Sapiens
PTIRGIYIH

SEQ ID NO: 281875 - protein, 9 aa, Homo Sapiens
KLTALKEKY

SEQ ID NO: 281876 - protein, 9 aa, Homo Sapiens
QDELFILGS

SEQ ID NO: 281877 - protein, 9 aa, Homo Sapiens
IYCQVEAVP

SEQ ID NO: 281878 - protein, 9 aa, Homo Sapiens
GTSLQIAHM

SEQ ID NO: 281879 - protein, 9 aa, Homo Sapiens
ILAFDVKIE

SEQ ID NO: 281880 - protein, 9 aa, Homo Sapiens
CSSGTLPVV

SEQ ID NO: 281881 - protein, 9 aa, Homo Sapiens
PDCVRKFIL

SEQ ID NO: 281882 - protein, 9 aa, Homo Sapiens
TSEDIFQHL

SEQ ID NO: 281883 - protein, 9 aa, Homo Sapiens
KQIFIQTSM

SEQ ID NO: 281884 - protein, 9 aa, Homo Sapiens
GGLMVFPPA

SEQ ID NO: 281885 - protein, 9 aa, Homo Sapiens
AMSLECGCA

SEQ ID NO: 281886 - protein, 9 aa, Homo Sapiens
NLAKALMIR

SEQ ID NO: 281887 - protein, 9 aa, Homo Sapiens
SGCKIWVQG

SEQ ID NO: 281888 - protein, 9 aa, Homo Sapiens
DTYNKILQL

SEQ ID NO: 281889 - protein, 9 aa, Homo Sapiens
KVVVNTKTE

SEQ ID NO: 281890 - protein, 9 aa, Homo Sapiens
KGSLVFQLK

SEQ ID NO: 281891 - protein, 9 aa, Homo Sapiens
NYNAPDCRF

SEQ ID NO: 281892 - protein, 9 aa, Homo Sapiens
SSRKSTKRT

SEQ ID NO: 281893 - protein, 9 aa, Homo Sapiens
DNLIPIEPL

SEQ ID NO: 281894 - protein, 9 aa, Homo Sapiens
GYGSCLFIY

SEQ ID NO: 281895 - protein, 9 aa, Homo Sapiens
NNIKTRSAQ

SEQ ID NO: 281896 - protein, 9 aa, Homo Sapiens
ENLLSKPPN

SEQ ID NO: 281897 - protein, 9 aa, Homo Sapiens
HDKQKFYLR

SEQ ID NO: 281898 - protein, 9 aa, Homo Sapiens
LPAPIKNIM

SEQ ID NO: 281899 - protein, 9 aa, Homo Sapiens
LDAAGHEGS

SEQ ID NO: 281900 - protein, 9 aa, Homo Sapiens
IYYSECLTQ

SEQ ID NO: 281901 - protein, 9 aa, Homo Sapiens
PIGLPPARW

SEQ ID NO: 281902 - protein, 9 aa, Homo Sapiens
TIMVGEGIF

SEQ ID NO: 281903 - protein, 9 aa, Homo Sapiens
FQKHGKMHT

SEQ ID NO: 281904 - protein, 9 aa, Homo Sapiens
LYLTKDSCF

SEQ ID NO: 281905 - protein, 9 aa, Homo Sapiens
DESLKEIKS

SEQ ID NO: 281906 - protein, 9 aa, Homo Sapiens
SCIKTLNNL

SEQ ID NO: 281907 - protein, 9 aa, Homo Sapiens
IRDCAANTL

SEQ ID NO: 281908 - protein, 9 aa, Homo Sapiens
IYLHLLNDL

SEQ ID NO: 281909 - protein, 9 aa, Homo Sapiens
RRSHANRVK

SEQ ID NO: 281910 - protein, 9 aa, Homo Sapiens
IKRCLAWDK

SEQ ID NO: 281911 - protein, 9 aa, Homo Sapiens
VNYHFTHQC

SEQ ID NO: 281912 - protein, 9 aa, Homo Sapiens
PTVLKEKGI

SEQ ID NO: 281913 - protein, 9 aa, Homo Sapiens
YLAPQNLPS

SEQ ID NO: 281914 - protein, 9 aa, Homo Sapiens
DGLQADALY

SEQ ID NO: 281915 - protein, 9 aa, Homo Sapiens
DERFVFMAT

SEQ ID NO: 281916 - protein, 9 aa, Homo Sapiens
KHYYGEGCS

SEQ ID NO: 281917 - protein, 9 aa, Homo Sapiens
LQEVFKAFC

SEQ ID NO: 281918 - protein, 9 aa, Homo Sapiens
NILAATFIH

SEQ ID NO: 281919 - protein, 9 aa, Homo Sapiens
YDIGNVTYF

SEQ ID NO: 281920 - protein, 9 aa, Homo Sapiens
DLIDVLLLS

SEQ ID NO: 281921 - protein, 9 aa, Homo Sapiens
AYQESCVDT

SEQ ID NO: 281922 - protein, 9 aa, Homo Sapiens
ISLFFLQSK

SEQ ID NO: 281923 - protein, 9 aa, Homo Sapiens
CEEYIQPPQ

SEQ ID NO: 281924 - protein, 9 aa, Homo Sapiens
PGLVCMVTV

SEQ ID NO: 281925 - protein, 9 aa, Homo Sapiens
YIYTHIYIH

SEQ ID NO: 281926 - protein, 9 aa, Homo Sapiens
AKRLDLCQR

SEQ ID NO: 281927 - protein, 9 aa, Homo Sapiens
ARAAPHRIR

SEQ ID NO: 281928 - protein, 9 aa, Homo Sapiens
ELSFQKCIE

SEQ ID NO: 281929 - protein, 9 aa, Homo Sapiens
HIGRFKSMS

SEQ ID NO: 281930 - protein, 9 aa, Homo Sapiens
QILNINTSD

SEQ ID NO: 281931 - protein, 9 aa, Homo Sapiens
SLSKNVGIY

SEQ ID NO: 281932 - protein, 9 aa, Homo Sapiens
QPSPVSAML

SEQ ID NO: 281933 - protein, 9 aa, Homo Sapiens
GIKSFDSVL

SEQ ID NO: 281934 - protein, 9 aa, Homo Sapiens
RMGDKAQQT

SEQ ID NO: 281935 - protein, 9 aa, Homo Sapiens
LPQINLSKR

SEQ ID NO: 281936 - protein, 9 aa, Homo Sapiens
QALLQNNTL

SEQ ID NO: 281937 - protein, 9 aa, Homo Sapiens
QQVAGLQLK

SEQ ID NO: 281938 - protein, 9 aa, Homo Sapiens
FINHQCVHT

SEQ ID NO: 281939 - protein, 9 aa, Homo Sapiens
QFGKHYGNN

SEQ ID NO: 281940 - protein, 9 aa, Homo Sapiens
RCHSSRSHS

SEQ ID NO: 281941 - protein, 9 aa, Homo Sapiens
NIKPTSFLC

SEQ ID NO: 281942 - protein, 9 aa, Homo Sapiens
ECDKAFNRL

SEQ ID NO: 281943 - protein, 9 aa, Homo Sapiens
PVYLLEDGL

SEQ ID NO: 281944 - protein, 9 aa, Homo Sapiens
SSVDLSDRL

SEQ ID NO: 281945 - protein, 9 aa, Homo Sapiens
AGYITYIQA

SEQ ID NO: 281946 - protein, 9 aa, Homo Sapiens
RTIRTAQTQ

SEQ ID NO: 281947 - protein, 9 aa, Homo Sapiens
THENPLETN

SEQ ID NO: 281948 - protein, 9 aa, Homo Sapiens
SDYPLWEAF

SEQ ID NO: 281949 - protein, 9 aa, Homo Sapiens
KEEALPCTD

SEQ ID NO: 281950 - protein, 9 aa, Homo Sapiens
FELSNLNHK

SEQ ID NO: 281951 - protein, 9 aa, Homo Sapiens
NRMWKLFEN

SEQ ID NO: 281952 - protein, 9 aa, Homo Sapiens
CCICGGNKS

SEQ ID NO: 281953 - protein, 9 aa, Homo Sapiens
RTDRNHIEN

SEQ ID NO: 281954 - protein, 9 aa, Homo Sapiens
LSPERLNAF

SEQ ID NO: 281955 - protein, 9 aa, Homo Sapiens
QGYVGSFVL

SEQ ID NO: 281956 - protein, 9 aa, Homo Sapiens
SVCYYSHFI

SEQ ID NO: 281957 - protein, 9 aa, Homo Sapiens
KNERSHMPD

SEQ ID NO: 281958 - protein, 9 aa, Homo Sapiens
TLLGLRDWL

SEQ ID NO: 281959 - protein, 9 aa, Homo Sapiens
EPFASVAAT

SEQ ID NO: 281960 - protein, 9 aa, Homo Sapiens
FVELTMLYS

SEQ ID NO: 281961 - protein, 9 aa, Homo Sapiens
PSIYRSLAK

SEQ ID NO: 281962 - protein, 9 aa, Homo Sapiens
PVFSLQLFW

SEQ ID NO: 281963 - protein, 9 aa, Homo Sapiens
FNDSLRRDI

SEQ ID NO: 281964 - protein, 9 aa, Homo Sapiens
LLNLATMDT

SEQ ID NO: 281965 - protein, 9 aa, Homo Sapiens
DNYTCTYVW

SEQ ID NO: 281966 - protein, 9 aa, Homo Sapiens
VNVTWDGKA

SEQ ID NO: 281967 - protein, 9 aa, Homo Sapiens
EKSYTCNDC

SEQ ID NO: 281968 - protein, 9 aa, Homo Sapiens
PEFILVGYV

SEQ ID NO: 281969 - protein, 9 aa, Homo Sapiens
SLKLNDFKA

SEQ ID NO: 281970 - protein, 9 aa, Homo Sapiens
TKWKHYKKE

SEQ ID NO: 281971 - protein, 9 aa, Homo Sapiens
TIMGETFKK

SEQ ID NO: 281972 - protein, 9 aa, Homo Sapiens
YELSRVREF

SEQ ID NO: 281973 - protein, 9 aa, Homo Sapiens
RTVGQLMEP

SEQ ID NO: 281974 - protein, 9 aa, Homo Sapiens
AFYSVELII

SEQ ID NO: 281975 - protein, 9 aa, Homo Sapiens
TENSVAVPR

SEQ ID NO: 281976 - protein, 9 aa, Homo Sapiens
EESQSRLSQ

SEQ ID NO: 281977 - protein, 9 aa, Homo Sapiens
KSLLEAKQT

SEQ ID NO: 281978 - protein, 9 aa, Homo Sapiens
MLAAATSFT

SEQ ID NO: 281979 - protein, 9 aa, Homo Sapiens
IIPLSDNTI

SEQ ID NO: 281980 - protein, 9 aa, Homo Sapiens
NDIHYFPTE

SEQ ID NO: 281981 - protein, 9 aa, Homo Sapiens
MVIQAIEPR

SEQ ID NO: 281982 - protein, 9 aa, Homo Sapiens
LHAFSAIKA

SEQ ID NO: 281983 - protein, 9 aa, Homo Sapiens
NDGYVLRLN

SEQ ID NO: 281984 - protein, 9 aa, Homo Sapiens
GYLIKILTT

SEQ ID NO: 281985 - protein, 9 aa, Homo Sapiens
LILESHNWR

SEQ ID NO: 281986 - protein, 9 aa, Homo Sapiens
CKSRVSGKK

SEQ ID NO: 281987 - protein, 9 aa, Homo Sapiens
ETWLRLAVS

SEQ ID NO: 281988 - protein, 9 aa, Homo Sapiens
KNKQKKEAF

SEQ ID NO: 281989 - protein, 9 aa, Homo Sapiens
IWRPANVPI

SEQ ID NO: 281990 - protein, 9 aa, Homo Sapiens
SYLWSSSLS

SEQ ID NO: 281991 - protein, 9 aa, Homo Sapiens
LQGDSAHEL

SEQ ID NO: 281992 - protein, 9 aa, Homo Sapiens
DERIYITNY

SEQ ID NO: 281993 - protein, 9 aa, Homo Sapiens
PCVGPGPPR

SEQ ID NO: 281994 - protein, 9 aa, Homo Sapiens
PALELDKVL

SEQ ID NO: 281995 - protein, 9 aa, Homo Sapiens
LNRMHSQNI

SEQ ID NO: 281996 - protein, 9 aa, Homo Sapiens
TKLGNQLEG

SEQ ID NO: 281997 - protein, 9 aa, Homo Sapiens
VNYLFDVEV

SEQ ID NO: 281998 - protein, 9 aa, Homo Sapiens
EMGSTDCRN

SEQ ID NO: 281999 - protein, 9 aa, Homo Sapiens
ELGIPLYGT

SEQ ID NO: 282000 - protein, 9 aa, Homo Sapiens
PSTGDDDYP

SEQ ID NO: 282001 - protein, 9 aa, Homo Sapiens
CRRRKISDD

SEQ ID NO: 282002 - protein, 9 aa, Homo Sapiens
SENNWNREK

SEQ ID NO: 282003 - protein, 9 aa, Homo Sapiens
CLQTNTDHL

SEQ ID NO: 282004 - protein, 9 aa, Homo Sapiens
DVPVMDELG

SEQ ID NO: 282005 - protein, 9 aa, Homo Sapiens
RGEGNTTQI

SEQ ID NO: 282006 - protein, 9 aa, Homo Sapiens
AENKLEENP

SEQ ID NO: 282007 - protein, 9 aa, Homo Sapiens
KALTFYRKE

SEQ ID NO: 282008 - protein, 9 aa, Homo Sapiens
ADKLRIIPL

SEQ ID NO: 282009 - protein, 9 aa, Homo Sapiens
DLLGDPSPS

SEQ ID NO: 282010 - protein, 9 aa, Homo Sapiens
RAKSTWLHN

SEQ ID NO: 282011 - protein, 9 aa, Homo Sapiens
LVISKEGQR

SEQ ID NO: 282012 - protein, 9 aa, Homo Sapiens
NTVKSTGDR

SEQ ID NO: 282013 - protein, 9 aa, Homo Sapiens
PKQAKAVLK

SEQ ID NO: 282014 - protein, 9 aa, Homo Sapiens
LYQYLSLLH

SEQ ID NO: 282015 - protein, 9 aa, Homo Sapiens
AAFLCQPSG

SEQ ID NO: 282016 - protein, 9 aa, Homo Sapiens
EDCQELLSV

SEQ ID NO: 282017 - protein, 9 aa, Homo Sapiens
DPDVGVNLL

SEQ ID NO: 282018 - protein, 9 aa, Homo Sapiens
SASTFKIHE

SEQ ID NO: 282019 - protein, 9 aa, Homo Sapiens
GLEDVSRVL

SEQ ID NO: 282020 - protein, 9 aa, Homo Sapiens
TAGSWKFTK

SEQ ID NO: 282021 - protein, 9 aa, Homo Sapiens
ANYAVAVGS

SEQ ID NO: 282022 - protein, 9 aa, Homo Sapiens
TAFKDFKAH

SEQ ID NO: 282023 - protein, 9 aa, Homo Sapiens
IRSDRYKNL

SEQ ID NO: 282024 - protein, 9 aa, Homo Sapiens
SNSFKLYSP

SEQ ID NO: 282025 - protein, 9 aa, Homo Sapiens
LLTPLPSTV

SEQ ID NO: 282026 - protein, 9 aa, Homo Sapiens
RNSMTSQEE

SEQ ID NO: 282027 - protein, 9 aa, Homo Sapiens
VCCCQSEMF

SEQ ID NO: 282028 - protein, 9 aa, Homo Sapiens
HYVDSTTMH

SEQ ID NO: 282029 - protein, 9 aa, Homo Sapiens
VELPVVIII

SEQ ID NO: 282030 - protein, 9 aa, Homo Sapiens
RQRVCSGKA

SEQ ID NO: 282031 - protein, 9 aa, Homo Sapiens
KRRFKETFS

SEQ ID NO: 282032 - protein, 9 aa, Homo Sapiens
FHIYIAKGC

SEQ ID NO: 282033 - protein, 9 aa, Homo Sapiens
ADVKIGNGQ

SEQ ID NO: 282034 - protein, 9 aa, Homo Sapiens
FDLCFILDK

SEQ ID NO: 282035 - protein, 9 aa, Homo Sapiens
LREKSPTFS

SEQ ID NO: 282036 - protein, 9 aa, Homo Sapiens
NNFTLCYIK

SEQ ID NO: 282037 - protein, 9 aa, Homo Sapiens
MPFQQDRHC

SEQ ID NO: 282038 - protein, 9 aa, Homo Sapiens
IHKLIVTEE

SEQ ID NO: 282039 - protein, 9 aa, Homo Sapiens
NMNKINGDG

SEQ ID NO: 282040 - protein, 9 aa, Homo Sapiens
EQDVNCLSP

SEQ ID NO: 282041 - protein, 9 aa, Homo Sapiens
KSQIDNINL

SEQ ID NO: 282042 - protein, 9 aa, Homo Sapiens
PCSLSVDNE

SEQ ID NO: 282043 - protein, 9 aa, Homo Sapiens
HSKKANLGK

SEQ ID NO: 282044 - protein, 9 aa, Homo Sapiens
QQSNLARHC

SEQ ID NO: 282045 - protein, 9 aa, Homo Sapiens
GEQFMLEET

SEQ ID NO: 282046 - protein, 9 aa, Homo Sapiens
FTWLCRHVH

SEQ ID NO: 282047 - protein, 9 aa, Homo Sapiens
EIDLLIVGS

SEQ ID NO: 282048 - protein, 9 aa, Homo Sapiens
TTKSETKEI

SEQ ID NO: 282049 - protein, 9 aa, Homo Sapiens
LCMRLFSEP

SEQ ID NO: 282050 - protein, 9 aa, Homo Sapiens
PQCSLTELY

SEQ ID NO: 282051 - protein, 9 aa, Homo Sapiens
FGKESTFGL

SEQ ID NO: 282052 - protein, 9 aa, Homo Sapiens
YQIRYRAAH

SEQ ID NO: 282053 - protein, 9 aa, Homo Sapiens
DAKEALDIF

SEQ ID NO: 282054 - protein, 9 aa, Homo Sapiens
NVLLPPIKF

SEQ ID NO: 282055 - protein, 9 aa, Homo Sapiens
KWEEKARED

SEQ ID NO: 282056 - protein, 9 aa, Homo Sapiens
KSVVAYQGF

SEQ ID NO: 282057 - protein, 9 aa, Homo Sapiens
QEVIQKAQQ

SEQ ID NO: 282058 - protein, 9 aa, Homo Sapiens
RPKDLWDIL

SEQ ID NO: 282059 - protein, 9 aa, Homo Sapiens
KKKSKDETD

SEQ ID NO: 282060 - protein, 9 aa, Homo Sapiens
KIDQYSQIL

SEQ ID NO: 282061 - protein, 9 aa, Homo Sapiens
DNPMNPNKY

SEQ ID NO: 282062 - protein, 9 aa, Homo Sapiens
YSPSDEKTR

SEQ ID NO: 282063 - protein, 9 aa, Homo Sapiens
KNVLQKILE

SEQ ID NO: 282064 - protein, 9 aa, Homo Sapiens
HGSPISGQL

SEQ ID NO: 282065 - protein, 9 aa, Homo Sapiens
DSSSSAAFA

SEQ ID NO: 282066 - protein, 9 aa, Homo Sapiens
TSAPRPTQF

SEQ ID NO: 282067 - protein, 9 aa, Homo Sapiens
GGLLDYINK

SEQ ID NO: 282068 - protein, 9 aa, Homo Sapiens
TNQDDADRA

SEQ ID NO: 282069 - protein, 9 aa, Homo Sapiens
PPFGSSYIR

SEQ ID NO: 282070 - protein, 9 aa, Homo Sapiens
RSPRGLSNS

SEQ ID NO: 282071 - protein, 9 aa, Homo Sapiens
GIVFIILLT

SEQ ID NO: 282072 - protein, 9 aa, Homo Sapiens
NNQNKSVVR

SEQ ID NO: 282073 - protein, 9 aa, Homo Sapiens
VAPDGKVAG

SEQ ID NO: 282074 - protein, 9 aa, Homo Sapiens
PVEEHFRTL

SEQ ID NO: 282075 - protein, 9 aa, Homo Sapiens
AGYFHNLFL

SEQ ID NO: 282076 - protein, 9 aa, Homo Sapiens
EKGNLYKFQ

SEQ ID NO: 282077 - protein, 9 aa, Homo Sapiens
RDLAPEPRL

SEQ ID NO: 282078 - protein, 9 aa, Homo Sapiens
KWMGIKSED

SEQ ID NO: 282079 - protein, 9 aa, Homo Sapiens
TIEATVWSR

SEQ ID NO: 282080 - protein, 9 aa, Homo Sapiens
ILTVAQHSQ

SEQ ID NO: 282081 - protein, 9 aa, Homo Sapiens
RGIHSQMDG

SEQ ID NO: 282082 - protein, 9 aa, Homo Sapiens
IDGFLQSRP

SEQ ID NO: 282083 - protein, 9 aa, Homo Sapiens
MDEANLELL

SEQ ID NO: 282084 - protein, 9 aa, Homo Sapiens
GMRVVDRQI

SEQ ID NO: 282085 - protein, 9 aa, Homo Sapiens
DFLCETKLE

SEQ ID NO: 282086 - protein, 9 aa, Homo Sapiens
NESDDDDQI

SEQ ID NO: 282087 - protein, 9 aa, Homo Sapiens
RRKKWCHGL

SEQ ID NO: 282088 - protein, 9 aa, Homo Sapiens
KTHGTSPED

SEQ ID NO: 282089 - protein, 9 aa, Homo Sapiens
ECKGKRGSV

SEQ ID NO: 282090 - protein, 9 aa, Homo Sapiens
LKWKPLIHS

SEQ ID NO: 282091 - protein, 9 aa, Homo Sapiens
FEVANDAPH

SEQ ID NO: 282092 - protein, 9 aa, Homo Sapiens
QSLLATKHP

SEQ ID NO: 282093 - protein, 9 aa, Homo Sapiens
QVCQFSNVI

SEQ ID NO: 282094 - protein, 9 aa, Homo Sapiens
ISISYSGCM

SEQ ID NO: 282095 - protein, 9 aa, Homo Sapiens
SKGYGFSDP

SEQ ID NO: 282096 - protein, 9 aa, Homo Sapiens
IAISLFFLQ

SEQ ID NO: 282097 - protein, 9 aa, Homo Sapiens
TDSDSMDKS

SEQ ID NO: 282098 - protein, 9 aa, Homo Sapiens
KSTKGSTFS

SEQ ID NO: 282099 - protein, 9 aa, Homo Sapiens
RVLAACSDF

SEQ ID NO: 282100 - protein, 9 aa, Homo Sapiens
IGNYAVWFR

SEQ ID NO: 282101 - protein, 9 aa, Homo Sapiens
DRARWQERM

SEQ ID NO: 282102 - protein, 9 aa, Homo Sapiens
ENLQEIKKE

SEQ ID NO: 282103 - protein, 9 aa, Homo Sapiens
SHHQRVHNK

SEQ ID NO: 282104 - protein, 9 aa, Homo Sapiens
LKEKLADAS

SEQ ID NO: 282105 - protein, 9 aa, Homo Sapiens
AWPFLETVF

SEQ ID NO: 282106 - protein, 9 aa, Homo Sapiens
LLVRYQKCI

SEQ ID NO: 282107 - protein, 9 aa, Homo Sapiens
QVIGYRAAE

SEQ ID NO: 282108 - protein, 9 aa, Homo Sapiens
SHHIRKNAD

SEQ ID NO: 282109 - protein, 9 aa, Homo Sapiens
QDAANIHQE

SEQ ID NO: 282110 - protein, 9 aa, Homo Sapiens
EGTVICVTH

SEQ ID NO: 282111 - protein, 9 aa, Homo Sapiens
KINVHIEHI

SEQ ID NO: 282112 - protein, 9 aa, Homo Sapiens
QQTFPWFGM

SEQ ID NO: 282113 - protein, 9 aa, Homo Sapiens
ESMNDRNYA

SEQ ID NO: 282114 - protein, 9 aa, Homo Sapiens
ACEITSFAF

SEQ ID NO: 282115 - protein, 9 aa, Homo Sapiens
VNKKNKIKL

SEQ ID NO: 282116 - protein, 9 aa, Homo Sapiens
KTIFQFKGT

SEQ ID NO: 282117 - protein, 9 aa, Homo Sapiens
VEDYKNRYE

SEQ ID NO: 282118 - protein, 9 aa, Homo Sapiens
NENLKAQEY

SEQ ID NO: 282119 - protein, 9 aa, Homo Sapiens
PGPFQPCEH

SEQ ID NO: 282120 - protein, 9 aa, Homo Sapiens
YPHSLWVGW

SEQ ID NO: 282121 - protein, 9 aa, Homo Sapiens
LLNNGEHFV

SEQ ID NO: 282122 - protein, 9 aa, Homo Sapiens
SLVYRVLLT

SEQ ID NO: 282123 - protein, 9 aa, Homo Sapiens
YSNSRYSRC

SEQ ID NO: 282124 - protein, 9 aa, Homo Sapiens
KFQYPESSE

SEQ ID NO: 282125 - protein, 9 aa, Homo Sapiens
NRKENRNNL

SEQ ID NO: 282126 - protein, 9 aa, Homo Sapiens
MAVAEANQH

SEQ ID NO: 282127 - protein, 9 aa, Homo Sapiens
PHTDQLQEY

SEQ ID NO: 282128 - protein, 9 aa, Homo Sapiens
QLVQFMLTI

SEQ ID NO: 282129 - protein, 9 aa, Homo Sapiens
CMKKKRLRS

SEQ ID NO: 282130 - protein, 9 aa, Homo Sapiens
ERNSFSIWS

SEQ ID NO: 282131 - protein, 9 aa, Homo Sapiens
MKIQFSRKT

SEQ ID NO: 282132 - protein, 9 aa, Homo Sapiens
KDGDIDSYL

SEQ ID NO: 282133 - protein, 9 aa, Homo Sapiens
HEVEAYKHF

SEQ ID NO: 282134 - protein, 9 aa, Homo Sapiens
ECGKAFNRY

SEQ ID NO: 282135 - protein, 9 aa, Homo Sapiens
SQPHWSNKL

SEQ ID NO: 282136 - protein, 9 aa, Homo Sapiens
RVGCLEQAL

SEQ ID NO: 282137 - protein, 9 aa, Homo Sapiens
LFDANYDGK

SEQ ID NO: 282138 - protein, 9 aa, Homo Sapiens
RLQKKLYAK

SEQ ID NO: 282139 - protein, 9 aa, Homo Sapiens
ILGNPLLGS

SEQ ID NO: 282140 - protein, 9 aa, Homo Sapiens
QGKADIRIW

SEQ ID NO: 282141 - protein, 9 aa, Homo Sapiens
EILLEKLPY

SEQ ID NO: 282142 - protein, 9 aa, Homo Sapiens
DRLLIEKLI

SEQ ID NO: 282143 - protein, 9 aa, Homo Sapiens
LRCRRTGIS

SEQ ID NO: 282144 - protein, 9 aa, Homo Sapiens
IEPDAVLQT

SEQ ID NO: 282145 - protein, 9 aa, Homo Sapiens
HVSWIAGQA

SEQ ID NO: 282146 - protein, 9 aa, Homo Sapiens
GHLPGSKRW

SEQ ID NO: 282147 - protein, 9 aa, Homo Sapiens
QLRHPVRLF

SEQ ID NO: 282148 - protein, 9 aa, Homo Sapiens
RAANIVSQD

SEQ ID NO: 282149 - protein, 9 aa, Homo Sapiens
TIAEPFNTD

SEQ ID NO: 282150 - protein, 9 aa, Homo Sapiens
YAITSAILA

SEQ ID NO: 282151 - protein, 9 aa, Homo Sapiens
EKTINLNVD

SEQ ID NO: 282152 - protein, 9 aa, Homo Sapiens
FDQVMKFSE

SEQ ID NO: 282153 - protein, 9 aa, Homo Sapiens
PDKPGGILI

SEQ ID NO: 282154 - protein, 9 aa, Homo Sapiens
LPKFKYPSV

SEQ ID NO: 282155 - protein, 9 aa, Homo Sapiens
IPCHRRVLA

SEQ ID NO: 282156 - protein, 9 aa, Homo Sapiens
MVDCYSPWC

SEQ ID NO: 282157 - protein, 9 aa, Homo Sapiens
DRIFFVPAK

SEQ ID NO: 282158 - protein, 9 aa, Homo Sapiens
DGLNLEEIR

SEQ ID NO: 282159 - protein, 9 aa, Homo Sapiens
SGISGTTAI

SEQ ID NO: 282160 - protein, 9 aa, Homo Sapiens
RRVPDELTL

SEQ ID NO: 282161 - protein, 9 aa, Homo Sapiens
SQRRCPLGC

SEQ ID NO: 282162 - protein, 9 aa, Homo Sapiens
KLGVCLYYR

SEQ ID NO: 282163 - protein, 9 aa, Homo Sapiens
CGKYFSSEG

SEQ ID NO: 282164 - protein, 9 aa, Homo Sapiens
IHHNLSLHS

SEQ ID NO: 282165 - protein, 9 aa, Homo Sapiens
QTGREKATE

SEQ ID NO: 282166 - protein, 9 aa, Homo Sapiens
PLHSGDDVS

SEQ ID NO: 282167 - protein, 9 aa, Homo Sapiens
EEELLSQDQ

SEQ ID NO: 282168 - protein, 9 aa, Homo Sapiens
PVRRHMVKC

SEQ ID NO: 282169 - protein, 9 aa, Homo Sapiens
LRGEYNAAN

SEQ ID NO: 282170 - protein, 9 aa, Homo Sapiens
YELPTCSCL

SEQ ID NO: 282171 - protein, 9 aa, Homo Sapiens
ICSVIFHDQ

SEQ ID NO: 282172 - protein, 9 aa, Homo Sapiens
CVNIHGIFS

SEQ ID NO: 282173 - protein, 9 aa, Homo Sapiens
LGLHYFDHF

SEQ ID NO: 282174 - protein, 9 aa, Homo Sapiens
QIHSILANI

SEQ ID NO: 282175 - protein, 9 aa, Homo Sapiens
FLGATNNPS

SEQ ID NO: 282176 - protein, 9 aa, Homo Sapiens
SVFSVVRHH

SEQ ID NO: 282177 - protein, 9 aa, Homo Sapiens
RIVGDCWFL

SEQ ID NO: 282178 - protein, 9 aa, Homo Sapiens
VGMRREVVQ

SEQ ID NO: 282179 - protein, 9 aa, Homo Sapiens
VYLLLKKIL

SEQ ID NO: 282180 - protein, 9 aa, Homo Sapiens
FIRFLCPAI

SEQ ID NO: 282181 - protein, 9 aa, Homo Sapiens
EQKANETIL

SEQ ID NO: 282182 - protein, 9 aa, Homo Sapiens
AQSIGAQKA

SEQ ID NO: 282183 - protein, 9 aa, Homo Sapiens
QINKLYVTF

SEQ ID NO: 282184 - protein, 9 aa, Homo Sapiens
YAHYSGSYN

SEQ ID NO: 282185 - protein, 9 aa, Homo Sapiens
EKDKKPYCQ

SEQ ID NO: 282186 - protein, 9 aa, Homo Sapiens
MNIGMETLS

SEQ ID NO: 282187 - protein, 9 aa, Homo Sapiens
KITCLEIYY

SEQ ID NO: 282188 - protein, 9 aa, Homo Sapiens
LRSLDYVKI

SEQ ID NO: 282189 - protein, 9 aa, Homo Sapiens
FIQWLRRKR

SEQ ID NO: 282190 - protein, 9 aa, Homo Sapiens
KLQSVAPQQ

SEQ ID NO: 282191 - protein, 9 aa, Homo Sapiens
VHEISLQDL

SEQ ID NO: 282192 - protein, 9 aa, Homo Sapiens
YRLDDYDRE

SEQ ID NO: 282193 - protein, 9 aa, Homo Sapiens
RQIVLAVHY

SEQ ID NO: 282194 - protein, 9 aa, Homo Sapiens
DLCKHIASG

SEQ ID NO: 282195 - protein, 9 aa, Homo Sapiens
TLPHLTIPT

SEQ ID NO: 282196 - protein, 9 aa, Homo Sapiens
YVTCQPFRR

SEQ ID NO: 282197 - protein, 9 aa, Homo Sapiens
LYSTRFPSQ

SEQ ID NO: 282198 - protein, 9 aa, Homo Sapiens
LITRLLCLL

SEQ ID NO: 282199 - protein, 9 aa, Homo Sapiens
QNKSVVRSM

SEQ ID NO: 282200 - protein, 9 aa, Homo Sapiens
MYPALQPLD

SEQ ID NO: 282201 - protein, 9 aa, Homo Sapiens
QIANYLTRC

SEQ ID NO: 282202 - protein, 9 aa, Homo Sapiens
LERLFLHSN

SEQ ID NO: 282203 - protein, 9 aa, Homo Sapiens
DQHQIIHFL

SEQ ID NO: 282204 - protein, 9 aa, Homo Sapiens
DSFWVSMIS

SEQ ID NO: 282205 - protein, 9 aa, Homo Sapiens
QIRFGAVSC

SEQ ID NO: 282206 - protein, 9 aa, Homo Sapiens
EQILKVEYE

SEQ ID NO: 282207 - protein, 9 aa, Homo Sapiens
MIILSALVQ

SEQ ID NO: 282208 - protein, 9 aa, Homo Sapiens
HTSFYKEYP

SEQ ID NO: 282209 - protein, 9 aa, Homo Sapiens
NTSIISFQA

SEQ ID NO: 282210 - protein, 9 aa, Homo Sapiens
ENHNISITH

SEQ ID NO: 282211 - protein, 9 aa, Homo Sapiens
VSEKISSAL

SEQ ID NO: 282212 - protein, 9 aa, Homo Sapiens
WQGLEGSLR

SEQ ID NO: 282213 - protein, 9 aa, Homo Sapiens
RNSPYDGLC

SEQ ID NO: 282214 - protein, 9 aa, Homo Sapiens
IPGVSLNSD

SEQ ID NO: 282215 - protein, 9 aa, Homo Sapiens
CKQCSNAFP

SEQ ID NO: 282216 - protein, 9 aa, Homo Sapiens
WNILRSDTD

SEQ ID NO: 282217 - protein, 9 aa, Homo Sapiens
LPKNAALNL

SEQ ID NO: 282218 - protein, 9 aa, Homo Sapiens
SMNLSQAFY

SEQ ID NO: 282219 - protein, 9 aa, Homo Sapiens
DWPKLFEKY

SEQ ID NO: 282220 - protein, 9 aa, Homo Sapiens
REELCDPTE

SEQ ID NO: 282221 - protein, 9 aa, Homo Sapiens
MIRGKLEND

SEQ ID NO: 282222 - protein, 9 aa, Homo Sapiens
LTRWARQRQ

SEQ ID NO: 282223 - protein, 9 aa, Homo Sapiens
RIIIGDHHW

SEQ ID NO: 282224 - protein, 9 aa, Homo Sapiens
YYYLTNKNE

SEQ ID NO: 282225 - protein, 9 aa, Homo Sapiens
TQDSLPITI

SEQ ID NO: 282226 - protein, 9 aa, Homo Sapiens
YDYPLDVNQ

SEQ ID NO: 282227 - protein, 9 aa, Homo Sapiens
SSSNPWGPR

SEQ ID NO: 282228 - protein, 9 aa, Homo Sapiens
LKVNRLDMH

SEQ ID NO: 282229 - protein, 9 aa, Homo Sapiens
LFRFGQHLI

SEQ ID NO: 282230 - protein, 9 aa, Homo Sapiens
SILSWDPLH

SEQ ID NO: 282231 - protein, 9 aa, Homo Sapiens
LTDHMNLLQ

SEQ ID NO: 282232 - protein, 9 aa, Homo Sapiens
GRSNIFIRN

SEQ ID NO: 282233 - protein, 9 aa, Homo Sapiens
EVVLDSTRQ

SEQ ID NO: 282234 - protein, 9 aa, Homo Sapiens
TQAGVKWYN

SEQ ID NO: 282235 - protein, 9 aa, Homo Sapiens
QPHWSNKLI

SEQ ID NO: 282236 - protein, 9 aa, Homo Sapiens
SEILLKEFI

SEQ ID NO: 282237 - protein, 9 aa, Homo Sapiens
KQLCSGAAY

SEQ ID NO: 282238 - protein, 9 aa, Homo Sapiens
VASCGACKA

SEQ ID NO: 282239 - protein, 9 aa, Homo Sapiens
HPLAALVSK

SEQ ID NO: 282240 - protein, 9 aa, Homo Sapiens
TKEKEVKKI

SEQ ID NO: 282241 - protein, 9 aa, Homo Sapiens
QKKKRNKEP

SEQ ID NO: 282242 - protein, 9 aa, Homo Sapiens
LGGSEHLQT

SEQ ID NO: 282243 - protein, 9 aa, Homo Sapiens
APEEECALE

SEQ ID NO: 282244 - protein, 9 aa, Homo Sapiens
VTAVDFLGH

SEQ ID NO: 282245 - protein, 9 aa, Homo Sapiens
HFTLIQAVC

SEQ ID NO: 282246 - protein, 9 aa, Homo Sapiens
PQFYQASIV

SEQ ID NO: 282247 - protein, 9 aa, Homo Sapiens
IILLGESQG

SEQ ID NO: 282248 - protein, 9 aa, Homo Sapiens
KPANCTHNL

SEQ ID NO: 282249 - protein, 9 aa, Homo Sapiens
LSVEQVKIH

SEQ ID NO: 282250 - protein, 9 aa, Homo Sapiens
YSGIWDNFH

SEQ ID NO: 282251 - protein, 9 aa, Homo Sapiens
TLAMDYRSL

SEQ ID NO: 282252 - protein, 9 aa, Homo Sapiens
VKASYVLRL

SEQ ID NO: 282253 - protein, 9 aa, Homo Sapiens
KKSKKEIKQ

SEQ ID NO: 282254 - protein, 9 aa, Homo Sapiens
FQYTNFDKN

SEQ ID NO: 282255 - protein, 9 aa, Homo Sapiens
NHTRMGRHK

SEQ ID NO: 282256 - protein, 9 aa, Homo Sapiens
SVRKVIQNP

SEQ ID NO: 282257 - protein, 9 aa, Homo Sapiens
ALYEALNNL

SEQ ID NO: 282258 - protein, 9 aa, Homo Sapiens
TLFAGIFYM

SEQ ID NO: 282259 - protein, 9 aa, Homo Sapiens
SNAPISQRR

SEQ ID NO: 282260 - protein, 9 aa, Homo Sapiens
RTIQLNITY

SEQ ID NO: 282261 - protein, 9 aa, Homo Sapiens
LWLSHRPAF

SEQ ID NO: 282262 - protein, 9 aa, Homo Sapiens
MVVAMVLQL

SEQ ID NO: 282263 - protein, 9 aa, Homo Sapiens
KDFLVRSIF

SEQ ID NO: 282264 - protein, 9 aa, Homo Sapiens
IRDNFLDFA

SEQ ID NO: 282265 - protein, 9 aa, Homo Sapiens
CHEIQIYEE

SEQ ID NO: 282266 - protein, 9 aa, Homo Sapiens
DLLSNINNH

SEQ ID NO: 282267 - protein, 9 aa, Homo Sapiens
VDFTEYRLM

SEQ ID NO: 282268 - protein, 9 aa, Homo Sapiens
KDKIEKERQ

SEQ ID NO: 282269 - protein, 9 aa, Homo Sapiens
LKDVSSCYR

SEQ ID NO: 282270 - protein, 9 aa, Homo Sapiens
SLQNKGSVL

SEQ ID NO: 282271 - protein, 9 aa, Homo Sapiens
ECGTSFSHK

SEQ ID NO: 282272 - protein, 9 aa, Homo Sapiens
SPEGSPVRD

SEQ ID NO: 282273 - protein, 9 aa, Homo Sapiens
LQRYVSPED

SEQ ID NO: 282274 - protein, 9 aa, Homo Sapiens
EILLKEFIK

SEQ ID NO: 282275 - protein, 9 aa, Homo Sapiens
DEGSKPGIY

SEQ ID NO: 282276 - protein, 9 aa, Homo Sapiens
DREAVVTAV

SEQ ID NO: 282277 - protein, 9 aa, Homo Sapiens
PQLEWQYYH

SEQ ID NO: 282278 - protein, 9 aa, Homo Sapiens
MAELQDIIG

SEQ ID NO: 282279 - protein, 9 aa, Homo Sapiens
WLEWGSWGP

SEQ ID NO: 282280 - protein, 9 aa, Homo Sapiens
PAEAPMTLL

SEQ ID NO: 282281 - protein, 9 aa, Homo Sapiens
RRHFCPPNH

SEQ ID NO: 282282 - protein, 9 aa, Homo Sapiens
TLVGIVSWD

SEQ ID NO: 282283 - protein, 9 aa, Homo Sapiens
QYSQILFPV

SEQ ID NO: 282284 - protein, 9 aa, Homo Sapiens
KKLYDAKVE

SEQ ID NO: 282285 - protein, 9 aa, Homo Sapiens
DWERTKVLH

SEQ ID NO: 282286 - protein, 9 aa, Homo Sapiens
NAKKGRKYA

SEQ ID NO: 282287 - protein, 9 aa, Homo Sapiens
KSNNIHTIE

SEQ ID NO: 282288 - protein, 9 aa, Homo Sapiens
RQEGRVPVS

SEQ ID NO: 282289 - protein, 9 aa, Homo Sapiens
NKHLIFREN

SEQ ID NO: 282290 - protein, 9 aa, Homo Sapiens
TVFILMLVL

SEQ ID NO: 282291 - protein, 9 aa, Homo Sapiens
LAWVTSKCE

SEQ ID NO: 282292 - protein, 9 aa, Homo Sapiens
RDMHYLPDM

SEQ ID NO: 282293 - protein, 9 aa, Homo Sapiens
GMLVPDIGE

SEQ ID NO: 282294 - protein, 9 aa, Homo Sapiens
HSLNAGLVG

SEQ ID NO: 282295 - protein, 9 aa, Homo Sapiens
EKEHGEIEV

SEQ ID NO: 282296 - protein, 9 aa, Homo Sapiens
NTLHCQLGD

SEQ ID NO: 282297 - protein, 9 aa, Homo Sapiens
GGVRRVAVR

SEQ ID NO: 282298 - protein, 9 aa, Homo Sapiens
EELLVAVKR

SEQ ID NO: 282299 - protein, 9 aa, Homo Sapiens
PLQIILEKV

SEQ ID NO: 282300 - protein, 9 aa, Homo Sapiens
ALTLVGTQD

SEQ ID NO: 282301 - protein, 9 aa, Homo Sapiens
LLECQFMPP

SEQ ID NO: 282302 - protein, 9 aa, Homo Sapiens
TPVTPVIRA

SEQ ID NO: 282303 - protein, 9 aa, Homo Sapiens
VNGGINTLQ

SEQ ID NO: 282304 - protein, 9 aa, Homo Sapiens
DYINKEIIP

SEQ ID NO: 282305 - protein, 9 aa, Homo Sapiens
SSFVLNGCM

SEQ ID NO: 282306 - protein, 9 aa, Homo Sapiens
HDNTPADSQ

SEQ ID NO: 282307 - protein, 9 aa, Homo Sapiens
QKSLQLKSK

SEQ ID NO: 282308 - protein, 9 aa, Homo Sapiens
DIYLHLLND

SEQ ID NO: 282309 - protein, 9 aa, Homo Sapiens
YFPAASPHA

SEQ ID NO: 282310 - protein, 9 aa, Homo Sapiens
LCDYINDMN

SEQ ID NO: 282311 - protein, 9 aa, Homo Sapiens
DSALKIKVK

SEQ ID NO: 282312 - protein, 9 aa, Homo Sapiens
KMNLMVQAR

SEQ ID NO: 282313 - protein, 9 aa, Homo Sapiens
SQEEGSGMK

SEQ ID NO: 282314 - protein, 9 aa, Homo Sapiens
FVMGLNLVI

SEQ ID NO: 282315 - protein, 9 aa, Homo Sapiens
LMTSKKTLL

SEQ ID NO: 282316 - protein, 9 aa, Homo Sapiens
SIMKCDINI

SEQ ID NO: 282317 - protein, 9 aa, Homo Sapiens
VYCIPIGHW

SEQ ID NO: 282318 - protein, 9 aa, Homo Sapiens
FYESCCPTS

SEQ ID NO: 282319 - protein, 9 aa, Homo Sapiens
ALVMEVDER

SEQ ID NO: 282320 - protein, 9 aa, Homo Sapiens
AGHFSDTPE

SEQ ID NO: 282321 - protein, 9 aa, Homo Sapiens
CGTAFSQRS

SEQ ID NO: 282322 - protein, 9 aa, Homo Sapiens
LQKELDSLQ

SEQ ID NO: 282323 - protein, 9 aa, Homo Sapiens
LWGLLDQGI

SEQ ID NO: 282324 - protein, 9 aa, Homo Sapiens
QDGGVCEGV

SEQ ID NO: 282325 - protein, 9 aa, Homo Sapiens
KMFEFLEDG

SEQ ID NO: 282326 - protein, 9 aa, Homo Sapiens
HQDKDQHEQ

SEQ ID NO: 282327 - protein, 9 aa, Homo Sapiens
TCLEIYYVV

SEQ ID NO: 282328 - protein, 9 aa, Homo Sapiens
LKTILHHIY

SEQ ID NO: 282329 - protein, 9 aa, Homo Sapiens
QRNVTVIPN

SEQ ID NO: 282330 - protein, 9 aa, Homo Sapiens
LLPTQDEKT

SEQ ID NO: 282331 - protein, 9 aa, Homo Sapiens
KAIEVECIK

SEQ ID NO: 282332 - protein, 9 aa, Homo Sapiens
ILDKDFGYL

SEQ ID NO: 282333 - protein, 9 aa, Homo Sapiens
EIMRNQLSV

SEQ ID NO: 282334 - protein, 9 aa, Homo Sapiens
NTLKKRNHQ

SEQ ID NO: 282335 - protein, 9 aa, Homo Sapiens
MMKLLFDNL

SEQ ID NO: 282336 - protein, 9 aa, Homo Sapiens
EAQKETDLS

SEQ ID NO: 282337 - protein, 9 aa, Homo Sapiens
MPTSALKSE

SEQ ID NO: 282338 - protein, 9 aa, Homo Sapiens
HHSPARRSH

SEQ ID NO: 282339 - protein, 9 aa, Homo Sapiens
CPSIGSGRN

SEQ ID NO: 282340 - protein, 9 aa, Homo Sapiens
VANGIQFRA

SEQ ID NO: 282341 - protein, 9 aa, Homo Sapiens
EVSRQYHGA

SEQ ID NO: 282342 - protein, 9 aa, Homo Sapiens
REGPAQMRK

SEQ ID NO: 282343 - protein, 9 aa, Homo Sapiens
QIQALHWYC

SEQ ID NO: 282344 - protein, 9 aa, Homo Sapiens
IHHWTPPRG

SEQ ID NO: 282345 - protein, 9 aa, Homo Sapiens
GSKDMKVLQ

SEQ ID NO: 282346 - protein, 9 aa, Homo Sapiens
LTEMYRIVS

SEQ ID NO: 282347 - protein, 9 aa, Homo Sapiens
DFGYDYLWC

SEQ ID NO: 282348 - protein, 9 aa, Homo Sapiens
HFCPHVKLK

SEQ ID NO: 282349 - protein, 9 aa, Homo Sapiens
APVRSRVHT

SEQ ID NO: 282350 - protein, 9 aa, Homo Sapiens
RLCRFFANS

SEQ ID NO: 282351 - protein, 9 aa, Homo Sapiens
SSQSSSVDS

SEQ ID NO: 282352 - protein, 9 aa, Homo Sapiens
KPDLKECIL

SEQ ID NO: 282353 - protein, 9 aa, Homo Sapiens
AIIFSYGHC

SEQ ID NO: 282354 - protein, 9 aa, Homo Sapiens
VTWIHISPK

SEQ ID NO: 282355 - protein, 9 aa, Homo Sapiens
VSEWGLWSK

SEQ ID NO: 282356 - protein, 9 aa, Homo Sapiens
EDYKNRYEV

SEQ ID NO: 282357 - protein, 9 aa, Homo Sapiens
NTGTFESMP

SEQ ID NO: 282358 - protein, 9 aa, Homo Sapiens
HVRISPTVT

SEQ ID NO: 282359 - protein, 9 aa, Homo Sapiens
AEVNIFPQK

SEQ ID NO: 282360 - protein, 9 aa, Homo Sapiens
KTYGVRNRK

SEQ ID NO: 282361 - protein, 9 aa, Homo Sapiens
KDIRINIVS

SEQ ID NO: 282362 - protein, 9 aa, Homo Sapiens
NLLPQLSKP

SEQ ID NO: 282363 - protein, 9 aa, Homo Sapiens
WKSEAEEGT

SEQ ID NO: 282364 - protein, 9 aa, Homo Sapiens
KDRLKPALR

SEQ ID NO: 282365 - protein, 9 aa, Homo Sapiens
EDPNGIPKI

SEQ ID NO: 282366 - protein, 9 aa, Homo Sapiens
PTSRRQCRH

SEQ ID NO: 282367 - protein, 9 aa, Homo Sapiens
SVARLQDER

SEQ ID NO: 282368 - protein, 9 aa, Homo Sapiens
NWANRPYVP

SEQ ID NO: 282369 - protein, 9 aa, Homo Sapiens
IIKDTSLVL

SEQ ID NO: 282370 - protein, 9 aa, Homo Sapiens
KRKKAAIFC

SEQ ID NO: 282371 - protein, 9 aa, Homo Sapiens
AQACNETIA

SEQ ID NO: 282372 - protein, 9 aa, Homo Sapiens
TLVKIKRTS

SEQ ID NO: 282373 - protein, 9 aa, Homo Sapiens
RSAGKVRDM

SEQ ID NO: 282374 - protein, 9 aa, Homo Sapiens
VQTTTMCIY

SEQ ID NO: 282375 - protein, 9 aa, Homo Sapiens
KANAFHSPC

SEQ ID NO: 282376 - protein, 9 aa, Homo Sapiens
VDSALSTRW

SEQ ID NO: 282377 - protein, 9 aa, Homo Sapiens
QRHYLVSSL

SEQ ID NO: 282378 - protein, 9 aa, Homo Sapiens
PEASRQDKE

SEQ ID NO: 282379 - protein, 9 aa, Homo Sapiens
YKKNSGQLW

SEQ ID NO: 282380 - protein, 9 aa, Homo Sapiens
ALDRMQFGA

SEQ ID NO: 282381 - protein, 9 aa, Homo Sapiens
SFVSMYTHL

SEQ ID NO: 282382 - protein, 9 aa, Homo Sapiens
DCFSPYENG

SEQ ID NO: 282383 - protein, 9 aa, Homo Sapiens
KKIRQPIDK

SEQ ID NO: 282384 - protein, 9 aa, Homo Sapiens
KRIHTGDKP

SEQ ID NO: 282385 - protein, 9 aa, Homo Sapiens
LMMDTQLSE

SEQ ID NO: 282386 - protein, 9 aa, Homo Sapiens
VNQALHYAV

SEQ ID NO: 282387 - protein, 9 aa, Homo Sapiens
ILIPLSGCF

SEQ ID NO: 282388 - protein, 9 aa, Homo Sapiens
QDLVSLKRN

SEQ ID NO: 282389 - protein, 9 aa, Homo Sapiens
AFMVNLKKN

SEQ ID NO: 282390 - protein, 9 aa, Homo Sapiens
TERLDQDGR

SEQ ID NO: 282391 - protein, 9 aa, Homo Sapiens
LPCLKSRPF

SEQ ID NO: 282392 - protein, 9 aa, Homo Sapiens
IKNEEIAFR

SEQ ID NO: 282393 - protein, 9 aa, Homo Sapiens
VYWICNNLI

SEQ ID NO: 282394 - protein, 9 aa, Homo Sapiens
ESEGDKKSV

SEQ ID NO: 282395 - protein, 9 aa, Homo Sapiens
LSQMDIIFH

SEQ ID NO: 282396 - protein, 9 aa, Homo Sapiens
LDTDKSETK

SEQ ID NO: 282397 - protein, 9 aa, Homo Sapiens
IIVKNENIK

SEQ ID NO: 282398 - protein, 9 aa, Homo Sapiens
TGHSPPPAY

SEQ ID NO: 282399 - protein, 9 aa, Homo Sapiens
CIFFHLNAV

SEQ ID NO: 282400 - protein, 9 aa, Homo Sapiens
GRHPYKCKE

SEQ ID NO: 282401 - protein, 9 aa, Homo Sapiens
ALQIHECTH

SEQ ID NO: 282402 - protein, 9 aa, Homo Sapiens
QNAQLVYNI

SEQ ID NO: 282403 - protein, 9 aa, Homo Sapiens
MAYDQAVAI

SEQ ID NO: 282404 - protein, 9 aa, Homo Sapiens
LSKDLRDEL

SEQ ID NO: 282405 - protein, 9 aa, Homo Sapiens
LRTISTTLG

SEQ ID NO: 282406 - protein, 9 aa, Homo Sapiens
TCNAVIQKP

SEQ ID NO: 282407 - protein, 9 aa, Homo Sapiens
RLMNRNFVR

SEQ ID NO: 282408 - protein, 9 aa, Homo Sapiens
SGLSHVQNK

SEQ ID NO: 282409 - protein, 9 aa, Homo Sapiens
FGALLNPLI

SEQ ID NO: 282410 - protein, 9 aa, Homo Sapiens
HQLLPHHAL

SEQ ID NO: 282411 - protein, 9 aa, Homo Sapiens
NRKKTSEDI

SEQ ID NO: 282412 - protein, 9 aa, Homo Sapiens
NQYHPDSGS

SEQ ID NO: 282413 - protein, 9 aa, Homo Sapiens
LMLVLYVVI

SEQ ID NO: 282414 - protein, 9 aa, Homo Sapiens
NSTFENGTD

SEQ ID NO: 282415 - protein, 9 aa, Homo Sapiens
IGVLIRLSH

SEQ ID NO: 282416 - protein, 9 aa, Homo Sapiens
SQVILHLIT

SEQ ID NO: 282417 - protein, 9 aa, Homo Sapiens
LIKGTLVFF

SEQ ID NO: 282418 - protein, 9 aa, Homo Sapiens
VQVMPLQFS

SEQ ID NO: 282419 - protein, 9 aa, Homo Sapiens
TCTNSATGI

SEQ ID NO: 282420 - protein, 9 aa, Homo Sapiens
NGVLYENKV

SEQ ID NO: 282421 - protein, 9 aa, Homo Sapiens
CPHRCACYM

SEQ ID NO: 282422 - protein, 9 aa, Homo Sapiens
WMQGSATGE

SEQ ID NO: 282423 - protein, 9 aa, Homo Sapiens
QRFKKVSYF

SEQ ID NO: 282424 - protein, 9 aa, Homo Sapiens
DVSEETMES

SEQ ID NO: 282425 - protein, 9 aa, Homo Sapiens
ENSFSLNSY

SEQ ID NO: 282426 - protein, 9 aa, Homo Sapiens
DDHPENYIS

SEQ ID NO: 282427 - protein, 9 aa, Homo Sapiens
ASIYNISKK

SEQ ID NO: 282428 - protein, 9 aa, Homo Sapiens
PGARFIHFL

SEQ ID NO: 282429 - protein, 9 aa, Homo Sapiens
GWVVSHDFP

SEQ ID NO: 282430 - protein, 9 aa, Homo Sapiens
SMKQYRKII

SEQ ID NO: 282431 - protein, 9 aa, Homo Sapiens
CEQNSPDGA

SEQ ID NO: 282432 - protein, 9 aa, Homo Sapiens
ACRCPTGFP

SEQ ID NO: 282433 - protein, 9 aa, Homo Sapiens
DKLFDEESE

SEQ ID NO: 282434 - protein, 9 aa, Homo Sapiens
CCQDEKAHL

SEQ ID NO: 282435 - protein, 9 aa, Homo Sapiens
CACAEEDDG

SEQ ID NO: 282436 - protein, 9 aa, Homo Sapiens
NAQSSQVGP

SEQ ID NO: 282437 - protein, 9 aa, Homo Sapiens
LIPHGPMPQ

SEQ ID NO: 282438 - protein, 9 aa, Homo Sapiens
RVREVAKEA

SEQ ID NO: 282439 - protein, 9 aa, Homo Sapiens
ESITSDTAE

SEQ ID NO: 282440 - protein, 9 aa, Homo Sapiens
EIILGLGDL

SEQ ID NO: 282441 - protein, 9 aa, Homo Sapiens
PEKCLGFRD

SEQ ID NO: 282442 - protein, 9 aa, Homo Sapiens
FTSIHQILE

SEQ ID NO: 282443 - protein, 9 aa, Homo Sapiens
MKKLMRNKM

SEQ ID NO: 282444 - protein, 9 aa, Homo Sapiens
GLLLALAPH

SEQ ID NO: 282445 - protein, 9 aa, Homo Sapiens
FPSSNLYAL

SEQ ID NO: 282446 - protein, 9 aa, Homo Sapiens
NYRLSNANK

SEQ ID NO: 282447 - protein, 9 aa, Homo Sapiens
TVSSFFQKH

SEQ ID NO: 282448 - protein, 9 aa, Homo Sapiens
LSPYFYEES

SEQ ID NO: 282449 - protein, 9 aa, Homo Sapiens
EIKWIYFVR

SEQ ID NO: 282450 - protein, 9 aa, Homo Sapiens
LDHWKFPQG

SEQ ID NO: 282451 - protein, 9 aa, Homo Sapiens
TLIQAVCCE

SEQ ID NO: 282452 - protein, 9 aa, Homo Sapiens
KEEYKWGME

SEQ ID NO: 282453 - protein, 9 aa, Homo Sapiens
HNISITHAT

SEQ ID NO: 282454 - protein, 9 aa, Homo Sapiens
DTNTFLLLL

SEQ ID NO: 282455 - protein, 9 aa, Homo Sapiens
QMSDDIDNI

SEQ ID NO: 282456 - protein, 9 aa, Homo Sapiens
SSEGIFKNL

SEQ ID NO: 282457 - protein, 9 aa, Homo Sapiens
HLKGPDVKG

SEQ ID NO: 282458 - protein, 9 aa, Homo Sapiens
TRNLPDSGK

SEQ ID NO: 282459 - protein, 9 aa, Homo Sapiens
LEQEQSSKC

SEQ ID NO: 282460 - protein, 9 aa, Homo Sapiens
ISNTLLNNY

SEQ ID NO: 282461 - protein, 9 aa, Homo Sapiens
SKKPDLKEC

SEQ ID NO: 282462 - protein, 9 aa, Homo Sapiens
STWWFTSFF

SEQ ID NO: 282463 - protein, 9 aa, Homo Sapiens
FRPNCLSEV

SEQ ID NO: 282464 - protein, 9 aa, Homo Sapiens
LLYGDIIQQ

SEQ ID NO: 282465 - protein, 9 aa, Homo Sapiens
ETFGPNIPK

SEQ ID NO: 282466 - protein, 9 aa, Homo Sapiens
GSKSSKLNY

SEQ ID NO: 282467 - protein, 9 aa, Homo Sapiens
QVSYSADET

SEQ ID NO: 282468 - protein, 9 aa, Homo Sapiens
DPIRGPGGK

SEQ ID NO: 282469 - protein, 9 aa, Homo Sapiens
ANERVNDAS

SEQ ID NO: 282470 - protein, 9 aa, Homo Sapiens
VTTAETLTF

SEQ ID NO: 282471 - protein, 9 aa, Homo Sapiens
SIAIVGVND

SEQ ID NO: 282472 - protein, 9 aa, Homo Sapiens
AMPRPVSYR

SEQ ID NO: 282473 - protein, 9 aa, Homo Sapiens
RANWSSLRN

SEQ ID NO: 282474 - protein, 9 aa, Homo Sapiens
QLYSYMRIR

SEQ ID NO: 282475 - protein, 9 aa, Homo Sapiens
VILELGYFN

SEQ ID NO: 282476 - protein, 9 aa, Homo Sapiens
VKAKNKAKP

SEQ ID NO: 282477 - protein, 9 aa, Homo Sapiens
LSLAPGQFI

SEQ ID NO: 282478 - protein, 9 aa, Homo Sapiens
VGTNKYLTE

SEQ ID NO: 282479 - protein, 9 aa, Homo Sapiens
SHALYSHIL

SEQ ID NO: 282480 - protein, 9 aa, Homo Sapiens
KFIAGFRVR

SEQ ID NO: 282481 - protein, 9 aa, Homo Sapiens
QSRLKVELS

SEQ ID NO: 282482 - protein, 9 aa, Homo Sapiens
QVFMVIGNR

SEQ ID NO: 282483 - protein, 9 aa, Homo Sapiens
AIRISLEEM

SEQ ID NO: 282484 - protein, 9 aa, Homo Sapiens
EEINPTEKS

SEQ ID NO: 282485 - protein, 9 aa, Homo Sapiens
TDSEKGNLY

SEQ ID NO: 282486 - protein, 9 aa, Homo Sapiens
VMPHRVCSI

SEQ ID NO: 282487 - protein, 9 aa, Homo Sapiens
QQFFIKICD

SEQ ID NO: 282488 - protein, 9 aa, Homo Sapiens
PNKFISRLR

SEQ ID NO: 282489 - protein, 9 aa, Homo Sapiens
SRSFENLLD

SEQ ID NO: 282490 - protein, 9 aa, Homo Sapiens
LSVCEDSVP

SEQ ID NO: 282491 - protein, 9 aa, Homo Sapiens
SITASTYYG

SEQ ID NO: 282492 - protein, 9 aa, Homo Sapiens
NVESVADIF

SEQ ID NO: 282493 - protein, 9 aa, Homo Sapiens
QVMASDADG

SEQ ID NO: 282494 - protein, 9 aa, Homo Sapiens
VKANAFHSP

SEQ ID NO: 282495 - protein, 9 aa, Homo Sapiens
YPLDVNQEL

SEQ ID NO: 282496 - protein, 9 aa, Homo Sapiens
LRHLDVLFA

SEQ ID NO: 282497 - protein, 9 aa, Homo Sapiens
QQVHGLLSC

SEQ ID NO: 282498 - protein, 9 aa, Homo Sapiens
KASASSSNH

SEQ ID NO: 282499 - protein, 9 aa, Homo Sapiens
GSPCLECPE

SEQ ID NO: 282500 - protein, 9 aa, Homo Sapiens
IYGDPNFTV

SEQ ID NO: 282501 - protein, 9 aa, Homo Sapiens
RKNTFALLV

SEQ ID NO: 282502 - protein, 9 aa, Homo Sapiens
VAVLETSSS

SEQ ID NO: 282503 - protein, 9 aa, Homo Sapiens
RAAWKACCH

SEQ ID NO: 282504 - protein, 9 aa, Homo Sapiens
IVSENTISF

SEQ ID NO: 282505 - protein, 9 aa, Homo Sapiens
GNGGVLNNK

SEQ ID NO: 282506 - protein, 9 aa, Homo Sapiens
DKWERAFFF

SEQ ID NO: 282507 - protein, 9 aa, Homo Sapiens
GLFFGIDMV

SEQ ID NO: 282508 - protein, 9 aa, Homo Sapiens
KREWVKIYE

SEQ ID NO: 282509 - protein, 9 aa, Homo Sapiens
PEFELSDMF

SEQ ID NO: 282510 - protein, 9 aa, Homo Sapiens
ILYNKFFDY

SEQ ID NO: 282511 - protein, 9 aa, Homo Sapiens
GSNGLQSSY

SEQ ID NO: 282512 - protein, 9 aa, Homo Sapiens
KTVVEVLFQ

SEQ ID NO: 282513 - protein, 9 aa, Homo Sapiens
CTNTDGSYR

SEQ ID NO: 282514 - protein, 9 aa, Homo Sapiens
LPICATRWS

SEQ ID NO: 282515 - protein, 9 aa, Homo Sapiens
AEIVEAKEI

SEQ ID NO: 282516 - protein, 9 aa, Homo Sapiens
SKVELEVCD

SEQ ID NO: 282517 - protein, 9 aa, Homo Sapiens
GDESVRELS

SEQ ID NO: 282518 - protein, 9 aa, Homo Sapiens
MFQEDHGSW

SEQ ID NO: 282519 - protein, 9 aa, Homo Sapiens
NCPKGACIG

SEQ ID NO: 282520 - protein, 9 aa, Homo Sapiens
RQTGGSLRG

SEQ ID NO: 282521 - protein, 9 aa, Homo Sapiens
VQRAKAYLG

SEQ ID NO: 282522 - protein, 9 aa, Homo Sapiens
HFSVVLQKE

SEQ ID NO: 282523 - protein, 9 aa, Homo Sapiens
QDSNKFLKI

SEQ ID NO: 282524 - protein, 9 aa, Homo Sapiens
IGREVKIYC

SEQ ID NO: 282525 - protein, 9 aa, Homo Sapiens
ILFVNSQID

SEQ ID NO: 282526 - protein, 9 aa, Homo Sapiens
LSFKLQSVA

SEQ ID NO: 282527 - protein, 9 aa, Homo Sapiens
KVYLSSDTT

SEQ ID NO: 282528 - protein, 9 aa, Homo Sapiens
GHNETSNCR

SEQ ID NO: 282529 - protein, 9 aa, Homo Sapiens
KKWKCPGPI

SEQ ID NO: 282530 - protein, 9 aa, Homo Sapiens
DGTNINAVC

SEQ ID NO: 282531 - protein, 9 aa, Homo Sapiens
APCAIQISK

SEQ ID NO: 282532 - protein, 9 aa, Homo Sapiens
RTVGFGTQS

SEQ ID NO: 282533 - protein, 9 aa, Homo Sapiens
YDPLKIDEV

SEQ ID NO: 282534 - protein, 9 aa, Homo Sapiens
RYLIQFLSK

SEQ ID NO: 282535 - protein, 9 aa, Homo Sapiens
KKTRRMGTY

SEQ ID NO: 282536 - protein, 9 aa, Homo Sapiens
ASGRLCGFL

SEQ ID NO: 282537 - protein, 9 aa, Homo Sapiens
ETWIILNKK

SEQ ID NO: 282538 - protein, 9 aa, Homo Sapiens
KAHGGYSAF

SEQ ID NO: 282539 - protein, 9 aa, Homo Sapiens
DPRVVLNMQ

SEQ ID NO: 282540 - protein, 9 aa, Homo Sapiens
SVEAVGAPL

SEQ ID NO: 282541 - protein, 9 aa, Homo Sapiens
AGTAARQDA

SEQ ID NO: 282542 - protein, 9 aa, Homo Sapiens
LTGQIDPLN

SEQ ID NO: 282543 - protein, 9 aa, Homo Sapiens
AALPKVSFC

SEQ ID NO: 282544 - protein, 9 aa, Homo Sapiens
WDKGGQPWQ

SEQ ID NO: 282545 - protein, 9 aa, Homo Sapiens
SVQAKVLTW

SEQ ID NO: 282546 - protein, 9 aa, Homo Sapiens
MLPVNLGQP

SEQ ID NO: 282547 - protein, 9 aa, Homo Sapiens
AIMVSSVAE

SEQ ID NO: 282548 - protein, 9 aa, Homo Sapiens
LGYLMITCV

SEQ ID NO: 282549 - protein, 9 aa, Homo Sapiens
VRAYQQLLE

SEQ ID NO: 282550 - protein, 9 aa, Homo Sapiens
MPYTVSIYG

SEQ ID NO: 282551 - protein, 9 aa, Homo Sapiens
FLWLLSASA

SEQ ID NO: 282552 - protein, 9 aa, Homo Sapiens
YECDECGTS

SEQ ID NO: 282553 - protein, 9 aa, Homo Sapiens
PTTIDKKHR

SEQ ID NO: 282554 - protein, 9 aa, Homo Sapiens
KVFFNLVHL

SEQ ID NO: 282555 - protein, 9 aa, Homo Sapiens
TKYVELVTV

SEQ ID NO: 282556 - protein, 9 aa, Homo Sapiens
GSFNLLSNT

SEQ ID NO: 282557 - protein, 9 aa, Homo Sapiens
ADVTAVDFL

SEQ ID NO: 282558 - protein, 9 aa, Homo Sapiens
DPESFPLKL

SEQ ID NO: 282559 - protein, 9 aa, Homo Sapiens
AKTAMNVNK

SEQ ID NO: 282560 - protein, 9 aa, Homo Sapiens
LHRKDLEIQ

SEQ ID NO: 282561 - protein, 9 aa, Homo Sapiens
NLSQKPRFL

SEQ ID NO: 282562 - protein, 9 aa, Homo Sapiens
TPELVHASP

SEQ ID NO: 282563 - protein, 9 aa, Homo Sapiens
GVSIFCPPR

SEQ ID NO: 282564 - protein, 9 aa, Homo Sapiens
QAVLMDLIN

SEQ ID NO: 282565 - protein, 9 aa, Homo Sapiens
EKYDVWAKV

SEQ ID NO: 282566 - protein, 9 aa, Homo Sapiens
SVPSHSKSS

SEQ ID NO: 282567 - protein, 9 aa, Homo Sapiens
LFGLANKKR

SEQ ID NO: 282568 - protein, 9 aa, Homo Sapiens
RPNFLATLP

SEQ ID NO: 282569 - protein, 9 aa, Homo Sapiens
QQAASPVDS

SEQ ID NO: 282570 - protein, 9 aa, Homo Sapiens
TEKKVLAEG

SEQ ID NO: 282571 - protein, 9 aa, Homo Sapiens
MWELGIPLY

SEQ ID NO: 282572 - protein, 9 aa, Homo Sapiens
PTTNMAQTN

SEQ ID NO: 282573 - protein, 9 aa, Homo Sapiens
GILKVEDSE

SEQ ID NO: 282574 - protein, 9 aa, Homo Sapiens
FVERNIISF

SEQ ID NO: 282575 - protein, 9 aa, Homo Sapiens
LNLFQLLVL

SEQ ID NO: 282576 - protein, 9 aa, Homo Sapiens
SGTYVCTAD

SEQ ID NO: 282577 - protein, 9 aa, Homo Sapiens
AADIRWFEN

SEQ ID NO: 282578 - protein, 9 aa, Homo Sapiens
LILVLKRLS

SEQ ID NO: 282579 - protein, 9 aa, Homo Sapiens
CLYYRVMES

SEQ ID NO: 282580 - protein, 9 aa, Homo Sapiens
LRASSLFQS

SEQ ID NO: 282581 - protein, 9 aa, Homo Sapiens
ALSPASRWS

SEQ ID NO: 282582 - protein, 9 aa, Homo Sapiens
VTDTNNHQI

SEQ ID NO: 282583 - protein, 9 aa, Homo Sapiens
TFFQKPDSC

SEQ ID NO: 282584 - protein, 9 aa, Homo Sapiens
LCSIKEKET

SEQ ID NO: 282585 - protein, 9 aa, Homo Sapiens
AFLAAQVQR

SEQ ID NO: 282586 - protein, 9 aa, Homo Sapiens
LRIGANWRT

SEQ ID NO: 282587 - protein, 9 aa, Homo Sapiens
LWRGEVFWD

SEQ ID NO: 282588 - protein, 9 aa, Homo Sapiens
MTGWAYEKI

SEQ ID NO: 282589 - protein, 9 aa, Homo Sapiens
KAFSQIIHL

SEQ ID NO: 282590 - protein, 9 aa, Homo Sapiens
GSHRRVRLS

SEQ ID NO: 282591 - protein, 9 aa, Homo Sapiens
SHLSDLNIG

SEQ ID NO: 282592 - protein, 9 aa, Homo Sapiens
NTLTVASEH

SEQ ID NO: 282593 - protein, 9 aa, Homo Sapiens
PFTITVFED

SEQ ID NO: 282594 - protein, 9 aa, Homo Sapiens
SEGTSQRDD

SEQ ID NO: 282595 - protein, 9 aa, Homo Sapiens
PLSMDRMVL

SEQ ID NO: 282596 - protein, 9 aa, Homo Sapiens
TKRNALCVA

SEQ ID NO: 282597 - protein, 9 aa, Homo Sapiens
KNAQVQINK

SEQ ID NO: 282598 - protein, 9 aa, Homo Sapiens
RKYFREKSV

SEQ ID NO: 282599 - protein, 9 aa, Homo Sapiens
MYFRPCSSY

SEQ ID NO: 282600 - protein, 9 aa, Homo Sapiens
TNHDNTPAD

SEQ ID NO: 282601 - protein, 9 aa, Homo Sapiens
TCQPFRRKE

SEQ ID NO: 282602 - protein, 9 aa, Homo Sapiens
NKQDTNSQS

SEQ ID NO: 282603 - protein, 9 aa, Homo Sapiens
PVYCVNGVG

SEQ ID NO: 282604 - protein, 9 aa, Homo Sapiens
LPPSTLLPQ

SEQ ID NO: 282605 - protein, 9 aa, Homo Sapiens
FPATQKNLP

SEQ ID NO: 282606 - protein, 9 aa, Homo Sapiens
QNLKSEVMV

SEQ ID NO: 282607 - protein, 9 aa, Homo Sapiens
CSYTAISTI

SEQ ID NO: 282608 - protein, 9 aa, Homo Sapiens
LSAVLRAED

SEQ ID NO: 282609 - protein, 9 aa, Homo Sapiens
VTCTNSATG

SEQ ID NO: 282610 - protein, 9 aa, Homo Sapiens
LAKEKTQRG

SEQ ID NO: 282611 - protein, 9 aa, Homo Sapiens
LLSVEEAAK

SEQ ID NO: 282612 - protein, 9 aa, Homo Sapiens
DENFRPQNE

SEQ ID NO: 282613 - protein, 9 aa, Homo Sapiens
KGYFCEARD

SEQ ID NO: 282614 - protein, 9 aa, Homo Sapiens
IQERLKTSP

SEQ ID NO: 282615 - protein, 9 aa, Homo Sapiens
SMYTHLWEN

SEQ ID NO: 282616 - protein, 9 aa, Homo Sapiens
TLIDSLKTT

SEQ ID NO: 282617 - protein, 9 aa, Homo Sapiens
CLLESNRKL

SEQ ID NO: 282618 - protein, 9 aa, Homo Sapiens
IPCVCDHSW

SEQ ID NO: 282619 - protein, 9 aa, Homo Sapiens
MCQDKKYRV

SEQ ID NO: 282620 - protein, 9 aa, Homo Sapiens
LTLPVIICV

SEQ ID NO: 282621 - protein, 9 aa, Homo Sapiens
CFSPYENGE

SEQ ID NO: 282622 - protein, 9 aa, Homo Sapiens
DGMAVWKTL

SEQ ID NO: 282623 - protein, 9 aa, Homo Sapiens
EEIKKEPDK

SEQ ID NO: 282624 - protein, 9 aa, Homo Sapiens
CRCGAGTAP

SEQ ID NO: 282625 - protein, 9 aa, Homo Sapiens
EVKLLSFAS

SEQ ID NO: 282626 - protein, 9 aa, Homo Sapiens
EIQGTRTQQ

SEQ ID NO: 282627 - protein, 9 aa, Homo Sapiens
QIPCVDAGL

SEQ ID NO: 282628 - protein, 9 aa, Homo Sapiens
NKKLYSAEN

SEQ ID NO: 282629 - protein, 9 aa, Homo Sapiens
GTNFTLAKL

SEQ ID NO: 282630 - protein, 9 aa, Homo Sapiens
EEANFVIHR

SEQ ID NO: 282631 - protein, 9 aa, Homo Sapiens
AKQTNIEYG

SEQ ID NO: 282632 - protein, 9 aa, Homo Sapiens
PVEHPDKVL

SEQ ID NO: 282633 - protein, 9 aa, Homo Sapiens
LTSALDIKE

SEQ ID NO: 282634 - protein, 9 aa, Homo Sapiens
RKHEMLLSK

SEQ ID NO: 282635 - protein, 9 aa, Homo Sapiens
RHRALIRIM

SEQ ID NO: 282636 - protein, 9 aa, Homo Sapiens
ISRCRDGLK

SEQ ID NO: 282637 - protein, 9 aa, Homo Sapiens
EGGLATYQT

SEQ ID NO: 282638 - protein, 9 aa, Homo Sapiens
PGHPAPPAT

SEQ ID NO: 282639 - protein, 9 aa, Homo Sapiens
LLATGLDDS

SEQ ID NO: 282640 - protein, 9 aa, Homo Sapiens
IGFHSVKPT

SEQ ID NO: 282641 - protein, 9 aa, Homo Sapiens
YTFMSMCRR

SEQ ID NO: 282642 - protein, 9 aa, Homo Sapiens
QFRPKVSMD

SEQ ID NO: 282643 - protein, 9 aa, Homo Sapiens
EALGVELEP

SEQ ID NO: 282644 - protein, 9 aa, Homo Sapiens
RLVYKWFIL

SEQ ID NO: 282645 - protein, 9 aa, Homo Sapiens
QGIWIQLDH

SEQ ID NO: 282646 - protein, 9 aa, Homo Sapiens
QLEKWLQDN

SEQ ID NO: 282647 - protein, 9 aa, Homo Sapiens
TDRGKKTEE

SEQ ID NO: 282648 - protein, 9 aa, Homo Sapiens
SSKFSSINL

SEQ ID NO: 282649 - protein, 9 aa, Homo Sapiens
RRKTEYIDG

SEQ ID NO: 282650 - protein, 9 aa, Homo Sapiens
QSQYVCRLY

SEQ ID NO: 282651 - protein, 9 aa, Homo Sapiens
IMQLLCEMQ

SEQ ID NO: 282652 - protein, 9 aa, Homo Sapiens
QSRYILLRP

SEQ ID NO: 282653 - protein, 9 aa, Homo Sapiens
NDYLFEIVQ

SEQ ID NO: 282654 - protein, 9 aa, Homo Sapiens
MYIEMPYVI

SEQ ID NO: 282655 - protein, 9 aa, Homo Sapiens
IYVTYNGQE

SEQ ID NO: 282656 - protein, 9 aa, Homo Sapiens
LNQTKLECE

SEQ ID NO: 282657 - protein, 9 aa, Homo Sapiens
EMIEALQKR

SEQ ID NO: 282658 - protein, 9 aa, Homo Sapiens
SNASPPEGA

SEQ ID NO: 282659 - protein, 9 aa, Homo Sapiens
YFSELVLTL

SEQ ID NO: 282660 - protein, 9 aa, Homo Sapiens
KEREIPPRR

SEQ ID NO: 282661 - protein, 9 aa, Homo Sapiens
IQENEDKHA

SEQ ID NO: 282662 - protein, 9 aa, Homo Sapiens
GCPNYEDKN

SEQ ID NO: 282663 - protein, 9 aa, Homo Sapiens
KTSEKLEEW

SEQ ID NO: 282664 - protein, 9 aa, Homo Sapiens
RNCKQKCRD

SEQ ID NO: 282665 - protein, 9 aa, Homo Sapiens
ATFLCQEKY

SEQ ID NO: 282666 - protein, 9 aa, Homo Sapiens
ICSSLQAPI

SEQ ID NO: 282667 - protein, 9 aa, Homo Sapiens
FVKAAGLCG

SEQ ID NO: 282668 - protein, 9 aa, Homo Sapiens
PTVFAPILS

SEQ ID NO: 282669 - protein, 9 aa, Homo Sapiens
LKVVLRQVG

SEQ ID NO: 282670 - protein, 9 aa, Homo Sapiens
VFITVPFML

SEQ ID NO: 282671 - protein, 9 aa, Homo Sapiens
SHPDKPLPA

SEQ ID NO: 282672 - protein, 9 aa, Homo Sapiens
YYEEIVFLM

SEQ ID NO: 282673 - protein, 9 aa, Homo Sapiens
ILPPVKRSL

SEQ ID NO: 282674 - protein, 9 aa, Homo Sapiens
THIREKSYT

SEQ ID NO: 282675 - protein, 9 aa, Homo Sapiens
DFQRERSDC

SEQ ID NO: 282676 - protein, 9 aa, Homo Sapiens
YLSRKMAFF

SEQ ID NO: 282677 - protein, 9 aa, Homo Sapiens
HPKTQQYVR

SEQ ID NO: 282678 - protein, 9 aa, Homo Sapiens
GYHTAFAQQ

SEQ ID NO: 282679 - protein, 9 aa, Homo Sapiens
ALRLSCAGI

SEQ ID NO: 282680 - protein, 9 aa, Homo Sapiens
EEEQNIGKV

SEQ ID NO: 282681 - protein, 9 aa, Homo Sapiens
MLADTDLRM

SEQ ID NO: 282682 - protein, 9 aa, Homo Sapiens
KVKTTESSL

SEQ ID NO: 282683 - protein, 9 aa, Homo Sapiens
GVRTEQYLY

SEQ ID NO: 282684 - protein, 9 aa, Homo Sapiens
KKEKEHGEI

SEQ ID NO: 282685 - protein, 9 aa, Homo Sapiens
HYTKAIGIW

SEQ ID NO: 282686 - protein, 9 aa, Homo Sapiens
IPDSLDRIK

SEQ ID NO: 282687 - protein, 9 aa, Homo Sapiens
QGRQDGSES

SEQ ID NO: 282688 - protein, 9 aa, Homo Sapiens
LASAPTVAL

SEQ ID NO: 282689 - protein, 9 aa, Homo Sapiens
LIRKEWKRL

SEQ ID NO: 282690 - protein, 9 aa, Homo Sapiens
DKPRGTQKT

SEQ ID NO: 282691 - protein, 9 aa, Homo Sapiens
WSQGAIIAD

SEQ ID NO: 282692 - protein, 9 aa, Homo Sapiens
SCQQQQIEA

SEQ ID NO: 282693 - protein, 9 aa, Homo Sapiens
MCNPIHHLD

SEQ ID NO: 282694 - protein, 9 aa, Homo Sapiens
NKGNKLMHC

SEQ ID NO: 282695 - protein, 9 aa, Homo Sapiens
KSIVNLDYP

SEQ ID NO: 282696 - protein, 9 aa, Homo Sapiens
FVKVLMHLK

SEQ ID NO: 282697 - protein, 9 aa, Homo Sapiens
YSTQSEKSK

SEQ ID NO: 282698 - protein, 9 aa, Homo Sapiens
EGGSLIYDK

SEQ ID NO: 282699 - protein, 9 aa, Homo Sapiens
ATFDLSAEP

SEQ ID NO: 282700 - protein, 9 aa, Homo Sapiens
EAAAQFTLG

SEQ ID NO: 282701 - protein, 9 aa, Homo Sapiens
GCCENLGSS

SEQ ID NO: 282702 - protein, 9 aa, Homo Sapiens
NERTILTRG

SEQ ID NO: 282703 - protein, 9 aa, Homo Sapiens
TDKYNSGVI

SEQ ID NO: 282704 - protein, 9 aa, Homo Sapiens
TLISCPGRD

SEQ ID NO: 282705 - protein, 9 aa, Homo Sapiens
GDVLSEQDG

SEQ ID NO: 282706 - protein, 9 aa, Homo Sapiens
SKGVILYGP

SEQ ID NO: 282707 - protein, 9 aa, Homo Sapiens
EEEGLEIDE

SEQ ID NO: 282708 - protein, 9 aa, Homo Sapiens
PDNKQIEAK

SEQ ID NO: 282709 - protein, 9 aa, Homo Sapiens
TIGDLGHAT

SEQ ID NO: 282710 - protein, 9 aa, Homo Sapiens
KLNYKFWKH

SEQ ID NO: 282711 - protein, 9 aa, Homo Sapiens
QVTACHSAP

SEQ ID NO: 282712 - protein, 9 aa, Homo Sapiens
LPDLLELIR

SEQ ID NO: 282713 - protein, 9 aa, Homo Sapiens
KEPASSVSK

SEQ ID NO: 282714 - protein, 9 aa, Homo Sapiens
AFSLLQSRL

SEQ ID NO: 282715 - protein, 9 aa, Homo Sapiens
YDKIKELFH

SEQ ID NO: 282716 - protein, 9 aa, Homo Sapiens
WSSSLSPTS

SEQ ID NO: 282717 - protein, 9 aa, Homo Sapiens
KKGFQRPSE

SEQ ID NO: 282718 - protein, 9 aa, Homo Sapiens
FRPCSSYSL

SEQ ID NO: 282719 - protein, 9 aa, Homo Sapiens
LRHPKYNTS

SEQ ID NO: 282720 - protein, 9 aa, Homo Sapiens
GYGYMYPIT

SEQ ID NO: 282721 - protein, 9 aa, Homo Sapiens
EKDKEKEKI

SEQ ID NO: 282722 - protein, 9 aa, Homo Sapiens
EPTPVCGRE

SEQ ID NO: 282723 - protein, 9 aa, Homo Sapiens
KIRQPIDKT

SEQ ID NO: 282724 - protein, 9 aa, Homo Sapiens
FGVFLAIYP

SEQ ID NO: 282725 - protein, 9 aa, Homo Sapiens
NPLRFTREN

SEQ ID NO: 282726 - protein, 9 aa, Homo Sapiens
EEYIQPPQR

SEQ ID NO: 282727 - protein, 9 aa, Homo Sapiens
GLCTSRHLR

SEQ ID NO: 282728 - protein, 9 aa, Homo Sapiens
ILERKKDCK

SEQ ID NO: 282729 - protein, 9 aa, Homo Sapiens
FNAFVLFLG

SEQ ID NO: 282730 - protein, 9 aa, Homo Sapiens
TMLVDWMYP

SEQ ID NO: 282731 - protein, 9 aa, Homo Sapiens
DYLYEIITE

SEQ ID NO: 282732 - protein, 9 aa, Homo Sapiens
LYYYNKQRE

SEQ ID NO: 282733 - protein, 9 aa, Homo Sapiens
STKGSTFSN

SEQ ID NO: 282734 - protein, 9 aa, Homo Sapiens
KNVKCTAQE

SEQ ID NO: 282735 - protein, 9 aa, Homo Sapiens
SKKEREIPP

SEQ ID NO: 282736 - protein, 9 aa, Homo Sapiens
RSQAPYGTV

SEQ ID NO: 282737 - protein, 9 aa, Homo Sapiens
PSQRGTLTY

SEQ ID NO: 282738 - protein, 9 aa, Homo Sapiens
EMIGNYAVW

SEQ ID NO: 282739 - protein, 9 aa, Homo Sapiens
ANWSSLRNF

SEQ ID NO: 282740 - protein, 9 aa, Homo Sapiens
VKQDITFTD

SEQ ID NO: 282741 - protein, 9 aa, Homo Sapiens
LMSRGLHVP

SEQ ID NO: 282742 - protein, 9 aa, Homo Sapiens
CYISCDRGY

SEQ ID NO: 282743 - protein, 9 aa, Homo Sapiens
FLGMLNQTL

SEQ ID NO: 282744 - protein, 9 aa, Homo Sapiens
GIQFRALRW

SEQ ID NO: 282745 - protein, 9 aa, Homo Sapiens
KSIYKYQPG

SEQ ID NO: 282746 - protein, 9 aa, Homo Sapiens
PTVEELSRT

SEQ ID NO: 282747 - protein, 9 aa, Homo Sapiens
YHVLPERRP

SEQ ID NO: 282748 - protein, 9 aa, Homo Sapiens
LAKLYRNNL

SEQ ID NO: 282749 - protein, 9 aa, Homo Sapiens
TDAGGVTKA

SEQ ID NO: 282750 - protein, 9 aa, Homo Sapiens
RSKCRQIVS

SEQ ID NO: 282751 - protein, 9 aa, Homo Sapiens
VMHGSLGAA

SEQ ID NO: 282752 - protein, 9 aa, Homo Sapiens
RYKMEDGKV

SEQ ID NO: 282753 - protein, 9 aa, Homo Sapiens
LDNLFCDVP

SEQ ID NO: 282754 - protein, 9 aa, Homo Sapiens
RWQIHHSEN

SEQ ID NO: 282755 - protein, 9 aa, Homo Sapiens
QTLEACFDV

SEQ ID NO: 282756 - protein, 9 aa, Homo Sapiens
NLRNHGLQK

SEQ ID NO: 282757 - protein, 9 aa, Homo Sapiens
EKRQEQEAN

SEQ ID NO: 282758 - protein, 9 aa, Homo Sapiens
WGDYDNSAF

SEQ ID NO: 282759 - protein, 9 aa, Homo Sapiens
GGFGSTGNN

SEQ ID NO: 282760 - protein, 9 aa, Homo Sapiens
EQNKKMNRE

SEQ ID NO: 282761 - protein, 9 aa, Homo Sapiens
ISANSTHAD

SEQ ID NO: 282762 - protein, 9 aa, Homo Sapiens
KLSIIHHDQ

SEQ ID NO: 282763 - protein, 9 aa, Homo Sapiens
VPDVELLLL

SEQ ID NO: 282764 - protein, 9 aa, Homo Sapiens
EERVYVVGK

SEQ ID NO: 282765 - protein, 9 aa, Homo Sapiens
LGGVRRVAV

SEQ ID NO: 282766 - protein, 9 aa, Homo Sapiens
NTDKAISFL

SEQ ID NO: 282767 - protein, 9 aa, Homo Sapiens
KLSENRAQK

SEQ ID NO: 282768 - protein, 9 aa, Homo Sapiens
ISRASRCRP

SEQ ID NO: 282769 - protein, 9 aa, Homo Sapiens
HSHKRRKQN

SEQ ID NO: 282770 - protein, 9 aa, Homo Sapiens
SGQYSAIAP

SEQ ID NO: 282771 - protein, 9 aa, Homo Sapiens
SGCRMKWLI

SEQ ID NO: 282772 - protein, 9 aa, Homo Sapiens
PGRCFYVDI

SEQ ID NO: 282773 - protein, 9 aa, Homo Sapiens
WFTSTQENK

SEQ ID NO: 282774 - protein, 9 aa, Homo Sapiens
INTYLLHME

SEQ ID NO: 282775 - protein, 9 aa, Homo Sapiens
FCLYSPGPL

SEQ ID NO: 282776 - protein, 9 aa, Homo Sapiens
GADGQAESI

SEQ ID NO: 282777 - protein, 9 aa, Homo Sapiens
TLRVIAIDR

SEQ ID NO: 282778 - protein, 9 aa, Homo Sapiens
HELSNEEIN

SEQ ID NO: 282779 - protein, 9 aa, Homo Sapiens
YALQPLNHE

SEQ ID NO: 282780 - protein, 9 aa, Homo Sapiens
RRSIQNQKA

SEQ ID NO: 282781 - protein, 9 aa, Homo Sapiens
IIFGATGLT

SEQ ID NO: 282782 - protein, 9 aa, Homo Sapiens
PCDSRYFWG

SEQ ID NO: 282783 - protein, 9 aa, Homo Sapiens
SFGNHQITL

SEQ ID NO: 282784 - protein, 9 aa, Homo Sapiens
EECKGFSYF

SEQ ID NO: 282785 - protein, 9 aa, Homo Sapiens
EDEGSGAEV

SEQ ID NO: 282786 - protein, 9 aa, Homo Sapiens
YLDKVLNKR

SEQ ID NO: 282787 - protein, 9 aa, Homo Sapiens
SCHSCTCGN

SEQ ID NO: 282788 - protein, 9 aa, Homo Sapiens
NLDYPMVSP

SEQ ID NO: 282789 - protein, 9 aa, Homo Sapiens
DNTPADSQP

SEQ ID NO: 282790 - protein, 9 aa, Homo Sapiens
SRKNSAILE

SEQ ID NO: 282791 - protein, 9 aa, Homo Sapiens
ESELRTAFR

SEQ ID NO: 282792 - protein, 9 aa, Homo Sapiens
CDLLSLKAW

SEQ ID NO: 282793 - protein, 9 aa, Homo Sapiens
ANIAFGQSM

SEQ ID NO: 282794 - protein, 9 aa, Homo Sapiens
NMLNAGQDA

SEQ ID NO: 282795 - protein, 9 aa, Homo Sapiens
KLYAKNERL

SEQ ID NO: 282796 - protein, 9 aa, Homo Sapiens
LLCQADVKI

SEQ ID NO: 282797 - protein, 9 aa, Homo Sapiens
GGILKVEDS

SEQ ID NO: 282798 - protein, 9 aa, Homo Sapiens
SELEPLPFT

SEQ ID NO: 282799 - protein, 9 aa, Homo Sapiens
STSPVKLKN

SEQ ID NO: 282800 - protein, 9 aa, Homo Sapiens
EVVTENYHT

SEQ ID NO: 282801 - protein, 9 aa, Homo Sapiens
VVKELWRLE

SEQ ID NO: 282802 - protein, 9 aa, Homo Sapiens
SLGMDIDSR

SEQ ID NO: 282803 - protein, 9 aa, Homo Sapiens
DVPPPRPPQ

SEQ ID NO: 282804 - protein, 9 aa, Homo Sapiens
PTSIQTGYM

SEQ ID NO: 282805 - protein, 9 aa, Homo Sapiens
HLRQTLHKE

SEQ ID NO: 282806 - protein, 9 aa, Homo Sapiens
TGSPRLFTS

SEQ ID NO: 282807 - protein, 9 aa, Homo Sapiens
ISGAQRSAS

SEQ ID NO: 282808 - protein, 9 aa, Homo Sapiens
YDCKECGKY

SEQ ID NO: 282809 - protein, 9 aa, Homo Sapiens
AWNLYLPRP

SEQ ID NO: 282810 - protein, 9 aa, Homo Sapiens
KLKIQSLMY

SEQ ID NO: 282811 - protein, 9 aa, Homo Sapiens
IYTSSQGSK

SEQ ID NO: 282812 - protein, 9 aa, Homo Sapiens
INEIQRIAE

SEQ ID NO: 282813 - protein, 9 aa, Homo Sapiens
LREIIWSYL

SEQ ID NO: 282814 - protein, 9 aa, Homo Sapiens
IAFQSNCYF

SEQ ID NO: 282815 - protein, 9 aa, Homo Sapiens
LTCTIVFLL

SEQ ID NO: 282816 - protein, 9 aa, Homo Sapiens
SGIENKSGR

SEQ ID NO: 282817 - protein, 9 aa, Homo Sapiens
LRLIANAIQ

SEQ ID NO: 282818 - protein, 9 aa, Homo Sapiens
VKSHFAATY

SEQ ID NO: 282819 - protein, 9 aa, Homo Sapiens
IKGQHLIST

SEQ ID NO: 282820 - protein, 9 aa, Homo Sapiens
YEREQLETT

SEQ ID NO: 282821 - protein, 9 aa, Homo Sapiens
QLLNKINEL

SEQ ID NO: 282822 - protein, 9 aa, Homo Sapiens
TFIHSLHKN

SEQ ID NO: 282823 - protein, 9 aa, Homo Sapiens
IADAYSYFR

SEQ ID NO: 282824 - protein, 9 aa, Homo Sapiens
TLTAIGFGD

SEQ ID NO: 282825 - protein, 9 aa, Homo Sapiens
FNRELSRMS

SEQ ID NO: 282826 - protein, 9 aa, Homo Sapiens
YGAEKENTS

SEQ ID NO: 282827 - protein, 9 aa, Homo Sapiens
AIRSHHSGV

SEQ ID NO: 282828 - protein, 9 aa, Homo Sapiens
MSLWAGSNM

SEQ ID NO: 282829 - protein, 9 aa, Homo Sapiens
LRGALQATG

SEQ ID NO: 282830 - protein, 9 aa, Homo Sapiens
WFRKAITLI

SEQ ID NO: 282831 - protein, 9 aa, Homo Sapiens
DLPSDSGLS

SEQ ID NO: 282832 - protein, 9 aa, Homo Sapiens
YGRDRLSPY

SEQ ID NO: 282833 - protein, 9 aa, Homo Sapiens
CFGEGDNLP

SEQ ID NO: 282834 - protein, 9 aa, Homo Sapiens
DQPHQTCCP

SEQ ID NO: 282835 - protein, 9 aa, Homo Sapiens
VQDYSENLQ

SEQ ID NO: 282836 - protein, 9 aa, Homo Sapiens
ELEVCDLPE

SEQ ID NO: 282837 - protein, 9 aa, Homo Sapiens
LNESHFIVA

SEQ ID NO: 282838 - protein, 9 aa, Homo Sapiens
IHTFPYRGG

SEQ ID NO: 282839 - protein, 9 aa, Homo Sapiens
GEIGKPGAE

SEQ ID NO: 282840 - protein, 9 aa, Homo Sapiens
GTEDYIHII

SEQ ID NO: 282841 - protein, 9 aa, Homo Sapiens
DGTETGLLS

SEQ ID NO: 282842 - protein, 9 aa, Homo Sapiens
SLEVLIEYP

SEQ ID NO: 282843 - protein, 9 aa, Homo Sapiens
PRLKKMKTS

SEQ ID NO: 282844 - protein, 9 aa, Homo Sapiens
SEKMFEFLE

SEQ ID NO: 282845 - protein, 9 aa, Homo Sapiens
HLKIENVYA

SEQ ID NO: 282846 - protein, 9 aa, Homo Sapiens
THVLYHTKI

SEQ ID NO: 282847 - protein, 9 aa, Homo Sapiens
LCFVELCCK

SEQ ID NO: 282848 - protein, 9 aa, Homo Sapiens
FTYTLDEKG

SEQ ID NO: 282849 - protein, 9 aa, Homo Sapiens
QLSVKCWLR

SEQ ID NO: 282850 - protein, 9 aa, Homo Sapiens
NSISSGYLR

SEQ ID NO: 282851 - protein, 9 aa, Homo Sapiens
GYSMQGLCT

SEQ ID NO: 282852 - protein, 9 aa, Homo Sapiens
IFGGLSQVS

SEQ ID NO: 282853 - protein, 9 aa, Homo Sapiens
RLDDLSLSR

SEQ ID NO: 282854 - protein, 9 aa, Homo Sapiens
RPWPLCGLP

SEQ ID NO: 282855 - protein, 9 aa, Homo Sapiens
LAFIRLSYN

SEQ ID NO: 282856 - protein, 9 aa, Homo Sapiens
NRTWTDYTQ

SEQ ID NO: 282857 - protein, 9 aa, Homo Sapiens
ERGVISYTE

SEQ ID NO: 282858 - protein, 9 aa, Homo Sapiens
ELRQKSKLV

SEQ ID NO: 282859 - protein, 9 aa, Homo Sapiens
RYDKCGHDN

SEQ ID NO: 282860 - protein, 9 aa, Homo Sapiens
SLLSFYFGI

SEQ ID NO: 282861 - protein, 9 aa, Homo Sapiens
LPSLSQSPP

SEQ ID NO: 282862 - protein, 9 aa, Homo Sapiens
ASSSNHSQS

SEQ ID NO: 282863 - protein, 9 aa, Homo Sapiens
KSLNKTSGL

SEQ ID NO: 282864 - protein, 9 aa, Homo Sapiens
DSLPPSMSS

SEQ ID NO: 282865 - protein, 9 aa, Homo Sapiens
FRTLNGKDV

SEQ ID NO: 282866 - protein, 9 aa, Homo Sapiens
APQDFEHSD

SEQ ID NO: 282867 - protein, 9 aa, Homo Sapiens
LTSFLGITK

SEQ ID NO: 282868 - protein, 9 aa, Homo Sapiens
PSIKQNYSS

SEQ ID NO: 282869 - protein, 9 aa, Homo Sapiens
FLDSKLVPP

SEQ ID NO: 282870 - protein, 9 aa, Homo Sapiens
VVDNSELAD

SEQ ID NO: 282871 - protein, 9 aa, Homo Sapiens
TFALKYRHR

SEQ ID NO: 282872 - protein, 9 aa, Homo Sapiens
SLATDLKKH

SEQ ID NO: 282873 - protein, 9 aa, Homo Sapiens
KWLIDEVNQ

SEQ ID NO: 282874 - protein, 9 aa, Homo Sapiens
AARTPIPCV

SEQ ID NO: 282875 - protein, 9 aa, Homo Sapiens
TNRNRLSKG

SEQ ID NO: 282876 - protein, 9 aa, Homo Sapiens
KDKADVLCP

SEQ ID NO: 282877 - protein, 9 aa, Homo Sapiens
RMLAAATSF

SEQ ID NO: 282878 - protein, 9 aa, Homo Sapiens
DKPANCTHN

SEQ ID NO: 282879 - protein, 9 aa, Homo Sapiens
HQASISGIQ

SEQ ID NO: 282880 - protein, 9 aa, Homo Sapiens
LNKLLEKSN

SEQ ID NO: 282881 - protein, 9 aa, Homo Sapiens
EKKLEREQR

SEQ ID NO: 282882 - protein, 9 aa, Homo Sapiens
QQTRDTYEG

SEQ ID NO: 282883 - protein, 9 aa, Homo Sapiens
FIFQLKAER

SEQ ID NO: 282884 - protein, 9 aa, Homo Sapiens
GIFWFDAHK

SEQ ID NO: 282885 - protein, 9 aa, Homo Sapiens
SGNPKLNVA

SEQ ID NO: 282886 - protein, 9 aa, Homo Sapiens
RLTLIQMTH

SEQ ID NO: 282887 - protein, 9 aa, Homo Sapiens
VLCATGIII

SEQ ID NO: 282888 - protein, 9 aa, Homo Sapiens
PSVLLFRKP

SEQ ID NO: 282889 - protein, 9 aa, Homo Sapiens
RKITPLHND

SEQ ID NO: 282890 - protein, 9 aa, Homo Sapiens
GPRTESKGL

SEQ ID NO: 282891 - protein, 9 aa, Homo Sapiens
AGVPSIEMV

SEQ ID NO: 282892 - protein, 9 aa, Homo Sapiens
KLGNQEPGD

SEQ ID NO: 282893 - protein, 9 aa, Homo Sapiens
VMGVDVMLI

SEQ ID NO: 282894 - protein, 9 aa, Homo Sapiens
VDTFLIVCY

SEQ ID NO: 282895 - protein, 9 aa, Homo Sapiens
GGIIFLAFA

SEQ ID NO: 282896 - protein, 9 aa, Homo Sapiens
SSRGGGRGR

SEQ ID NO: 282897 - protein, 9 aa, Homo Sapiens
ELQDSLYAE

SEQ ID NO: 282898 - protein, 9 aa, Homo Sapiens
VFGSKNTAF

SEQ ID NO: 282899 - protein, 9 aa, Homo Sapiens
DTYKTIKQY

SEQ ID NO: 282900 - protein, 9 aa, Homo Sapiens
PDAPWGKAA

SEQ ID NO: 282901 - protein, 9 aa, Homo Sapiens
LNPHFISAF

SEQ ID NO: 282902 - protein, 9 aa, Homo Sapiens
KITPLHNDN

SEQ ID NO: 282903 - protein, 9 aa, Homo Sapiens
SGDEDYCPH

SEQ ID NO: 282904 - protein, 9 aa, Homo Sapiens
YLTSLPLEI

SEQ ID NO: 282905 - protein, 9 aa, Homo Sapiens
VELRRNSRV

SEQ ID NO: 282906 - protein, 9 aa, Homo Sapiens
DKVLAHPPQ

SEQ ID NO: 282907 - protein, 9 aa, Homo Sapiens
VKKAENKLE

SEQ ID NO: 282908 - protein, 9 aa, Homo Sapiens
SSRHLMVHQ

SEQ ID NO: 282909 - protein, 9 aa, Homo Sapiens
KLMELTNLQ

SEQ ID NO: 282910 - protein, 9 aa, Homo Sapiens
AEEKEKPNE

SEQ ID NO: 282911 - protein, 9 aa, Homo Sapiens
FQMPDLRAE

SEQ ID NO: 282912 - protein, 9 aa, Homo Sapiens
HVNRFVVRS

SEQ ID NO: 282913 - protein, 9 aa, Homo Sapiens
NGPQSSKGH

SEQ ID NO: 282914 - protein, 9 aa, Homo Sapiens
KSQLNDLQT

SEQ ID NO: 282915 - protein, 9 aa, Homo Sapiens
QDFVPILKD

SEQ ID NO: 282916 - protein, 9 aa, Homo Sapiens
VRGHSSLQE

SEQ ID NO: 282917 - protein, 9 aa, Homo Sapiens
RMEEIIFNL

SEQ ID NO: 282918 - protein, 9 aa, Homo Sapiens
LHKRKILPP

SEQ ID NO: 282919 - protein, 9 aa, Homo Sapiens
MAQKCLKGA

SEQ ID NO: 282920 - protein, 9 aa, Homo Sapiens
YRPPPKVNN

SEQ ID NO: 282921 - protein, 9 aa, Homo Sapiens
MSESQKLAH

SEQ ID NO: 282922 - protein, 9 aa, Homo Sapiens
IQQLEKVLK

SEQ ID NO: 282923 - protein, 9 aa, Homo Sapiens
IIQIISHVS

SEQ ID NO: 282924 - protein, 9 aa, Homo Sapiens
KLSERVLIT

SEQ ID NO: 282925 - protein, 9 aa, Homo Sapiens
ATASACTNH

SEQ ID NO: 282926 - protein, 9 aa, Homo Sapiens
KKTSNHLLG

SEQ ID NO: 282927 - protein, 9 aa, Homo Sapiens
YRYVSPFDH

SEQ ID NO: 282928 - protein, 9 aa, Homo Sapiens
LEHKALDEP

SEQ ID NO: 282929 - protein, 9 aa, Homo Sapiens
GYRDGGIPN

SEQ ID NO: 282930 - protein, 9 aa, Homo Sapiens
IQAQSIGAQ

SEQ ID NO: 282931 - protein, 9 aa, Homo Sapiens
GMGWDGSDL

SEQ ID NO: 282932 - protein, 9 aa, Homo Sapiens
RVVQSVNHT

SEQ ID NO: 282933 - protein, 9 aa, Homo Sapiens
VFDTAESPI

SEQ ID NO: 282934 - protein, 9 aa, Homo Sapiens
PNEMVPLGD

SEQ ID NO: 282935 - protein, 9 aa, Homo Sapiens
EMRTSCLIK

SEQ ID NO: 282936 - protein, 9 aa, Homo Sapiens
VHNGETVIF

SEQ ID NO: 282937 - protein, 9 aa, Homo Sapiens
VHPGVAMTD

SEQ ID NO: 282938 - protein, 9 aa, Homo Sapiens
SVKLSPFGQ

SEQ ID NO: 282939 - protein, 9 aa, Homo Sapiens
GELSDRIGS

SEQ ID NO: 282940 - protein, 9 aa, Homo Sapiens
VEKDKDNIF

SEQ ID NO: 282941 - protein, 9 aa, Homo Sapiens
LIWPFILEG

SEQ ID NO: 282942 - protein, 9 aa, Homo Sapiens
FQEAIYFID

SEQ ID NO: 282943 - protein, 9 aa, Homo Sapiens
YSFTWLCRH

SEQ ID NO: 282944 - protein, 9 aa, Homo Sapiens
NVTYFFFRE

SEQ ID NO: 282945 - protein, 9 aa, Homo Sapiens
PDERFVFMA

SEQ ID NO: 282946 - protein, 9 aa, Homo Sapiens
PSGKHKRGE

SEQ ID NO: 282947 - protein, 9 aa, Homo Sapiens
TCVLKKKLS

SEQ ID NO: 282948 - protein, 9 aa, Homo Sapiens
GVEAFAKPV

SEQ ID NO: 282949 - protein, 9 aa, Homo Sapiens
TMVNNLSSE

SEQ ID NO: 282950 - protein, 9 aa, Homo Sapiens
ERSTYLSAL

SEQ ID NO: 282951 - protein, 9 aa, Homo Sapiens
PDTCNPCFR

SEQ ID NO: 282952 - protein, 9 aa, Homo Sapiens
AEWNIMCWE

SEQ ID NO: 282953 - protein, 9 aa, Homo Sapiens
LRCRSLSEC

SEQ ID NO: 282954 - protein, 9 aa, Homo Sapiens
GKKLMAKCQ

SEQ ID NO: 282955 - protein, 9 aa, Homo Sapiens
APIMSPGNA

SEQ ID NO: 282956 - protein, 9 aa, Homo Sapiens
AKTIVKLSD

SEQ ID NO: 282957 - protein, 9 aa, Homo Sapiens
CFTMSCVPQ

SEQ ID NO: 282958 - protein, 9 aa, Homo Sapiens
SSDEDYIYM

SEQ ID NO: 282959 - protein, 9 aa, Homo Sapiens
LESLETFSG

SEQ ID NO: 282960 - protein, 9 aa, Homo Sapiens
LRKMEDYFH

SEQ ID NO: 282961 - protein, 9 aa, Homo Sapiens
LVGIVSWDS

SEQ ID NO: 282962 - protein, 9 aa, Homo Sapiens
LLVGFAGVI

SEQ ID NO: 282963 - protein, 9 aa, Homo Sapiens
GAPSVIVGH

SEQ ID NO: 282964 - protein, 9 aa, Homo Sapiens
HNVEDERWR

SEQ ID NO: 282965 - protein, 9 aa, Homo Sapiens
LIWGQNGRA

SEQ ID NO: 282966 - protein, 9 aa, Homo Sapiens
LDVNGHFVK

SEQ ID NO: 282967 - protein, 9 aa, Homo Sapiens
QALLFKALA

SEQ ID NO: 282968 - protein, 9 aa, Homo Sapiens
PEDSDQEVD

SEQ ID NO: 282969 - protein, 9 aa, Homo Sapiens
KFAIPSEVK

SEQ ID NO: 282970 - protein, 9 aa, Homo Sapiens
NSEKLSLVN

SEQ ID NO: 282971 - protein, 9 aa, Homo Sapiens
KVSREEIFE

SEQ ID NO: 282972 - protein, 9 aa, Homo Sapiens
GPMPADMLI

SEQ ID NO: 282973 - protein, 9 aa, Homo Sapiens
RKKATYKDY

SEQ ID NO: 282974 - protein, 9 aa, Homo Sapiens
SYPGYLQIV

SEQ ID NO: 282975 - protein, 9 aa, Homo Sapiens
AEDSNAKID

SEQ ID NO: 282976 - protein, 9 aa, Homo Sapiens
EGRSLQNKG

SEQ ID NO: 282977 - protein, 9 aa, Homo Sapiens
KHKNNIMEN

SEQ ID NO: 282978 - protein, 9 aa, Homo Sapiens
AGSPNLPHS

SEQ ID NO: 282979 - protein, 9 aa, Homo Sapiens
EGQFINSKK

SEQ ID NO: 282980 - protein, 9 aa, Homo Sapiens
DLVVKELWR

SEQ ID NO: 282981 - protein, 9 aa, Homo Sapiens
LETLLETQK

SEQ ID NO: 282982 - protein, 9 aa, Homo Sapiens
SDNLWGSIS

SEQ ID NO: 282983 - protein, 9 aa, Homo Sapiens
SEPLRQEQA

SEQ ID NO: 282984 - protein, 9 aa, Homo Sapiens
YRLREITEN

SEQ ID NO: 282985 - protein, 9 aa, Homo Sapiens
IHINYYLQV

SEQ ID NO: 282986 - protein, 9 aa, Homo Sapiens
SKRGPRRPK

SEQ ID NO: 282987 - protein, 9 aa, Homo Sapiens
QFYSPNIMA

SEQ ID NO: 282988 - protein, 9 aa, Homo Sapiens
YPSTRVMRN

SEQ ID NO: 282989 - protein, 9 aa, Homo Sapiens
GLASVINNT

SEQ ID NO: 282990 - protein, 9 aa, Homo Sapiens
PELRRHRSE

SEQ ID NO: 282991 - protein, 9 aa, Homo Sapiens
VISRHSLNA

SEQ ID NO: 282992 - protein, 9 aa, Homo Sapiens
LSEFTPDIT

SEQ ID NO: 282993 - protein, 9 aa, Homo Sapiens
NISTDKSWQ

SEQ ID NO: 282994 - protein, 9 aa, Homo Sapiens
QPFKFTIPD

SEQ ID NO: 282995 - protein, 9 aa, Homo Sapiens
GHGLWTWRY

SEQ ID NO: 282996 - protein, 9 aa, Homo Sapiens
VAEIIKEAQ

SEQ ID NO: 282997 - protein, 9 aa, Homo Sapiens
SDAETLKVM

SEQ ID NO: 282998 - protein, 9 aa, Homo Sapiens
KRKGQENLK

SEQ ID NO: 282999 - protein, 9 aa, Homo Sapiens
NNGRKYDTN

SEQ ID NO: 283000 - protein, 9 aa, Homo Sapiens
KDCGDSPPA

SEQ ID NO: 283001 - protein, 9 aa, Homo Sapiens
MISHSLGPE

SEQ ID NO: 283002 - protein, 9 aa, Homo Sapiens
MCWGGMITS

SEQ ID NO: 283003 - protein, 9 aa, Homo Sapiens
TKNETGPYQ

SEQ ID NO: 283004 - protein, 9 aa, Homo Sapiens
SCRVSFITQ

SEQ ID NO: 283005 - protein, 9 aa, Homo Sapiens
VNFLRKPGG

SEQ ID NO: 283006 - protein, 9 aa, Homo Sapiens
CMECEKRFR

SEQ ID NO: 283007 - protein, 9 aa, Homo Sapiens
FKPINYQLE

SEQ ID NO: 283008 - protein, 9 aa, Homo Sapiens
GNRESGSKL

SEQ ID NO: 283009 - protein, 9 aa, Homo Sapiens
HLVFTSIFI

SEQ ID NO: 283010 - protein, 9 aa, Homo Sapiens
QCCLFCFWK

SEQ ID NO: 283011 - protein, 9 aa, Homo Sapiens
GCLKETQKH

SEQ ID NO: 283012 - protein, 9 aa, Homo Sapiens
TLDKGGESC

SEQ ID NO: 283013 - protein, 9 aa, Homo Sapiens
GSIEIFFQA

SEQ ID NO: 283014 - protein, 9 aa, Homo Sapiens
HWCYEVQAK

SEQ ID NO: 283015 - protein, 9 aa, Homo Sapiens
QATRVQPEP

SEQ ID NO: 283016 - protein, 9 aa, Homo Sapiens
LMGTNLSKL

SEQ ID NO: 283017 - protein, 9 aa, Homo Sapiens
GRPQIQRRE

SEQ ID NO: 283018 - protein, 9 aa, Homo Sapiens
LSTCGSHLA

SEQ ID NO: 283019 - protein, 9 aa, Homo Sapiens
LNDKLKEMS

SEQ ID NO: 283020 - protein, 9 aa, Homo Sapiens
AAKRKGRKW

SEQ ID NO: 283021 - protein, 9 aa, Homo Sapiens
GRNKSWLCF

SEQ ID NO: 283022 - protein, 9 aa, Homo Sapiens
FNLLYRFWI

SEQ ID NO: 283023 - protein, 9 aa, Homo Sapiens
SSSTQDFFD

SEQ ID NO: 283024 - protein, 9 aa, Homo Sapiens
ILPIFFLAL

SEQ ID NO: 283025 - protein, 9 aa, Homo Sapiens
ERLWFREAE

SEQ ID NO: 283026 - protein, 9 aa, Homo Sapiens
LIVFSQVVL

SEQ ID NO: 283027 - protein, 9 aa, Homo Sapiens
YSPMVKSKP

SEQ ID NO: 283028 - protein, 9 aa, Homo Sapiens
KLLAMIMWL

SEQ ID NO: 283029 - protein, 9 aa, Homo Sapiens
PMTLLEFET

SEQ ID NO: 283030 - protein, 9 aa, Homo Sapiens
YSIMNRRLC

SEQ ID NO: 283031 - protein, 9 aa, Homo Sapiens
YFGHLAGCG

SEQ ID NO: 283032 - protein, 9 aa, Homo Sapiens
HIKYRHKKN

SEQ ID NO: 283033 - protein, 9 aa, Homo Sapiens
ESTNYNEIH

SEQ ID NO: 283034 - protein, 9 aa, Homo Sapiens
DIPSGLPLH

SEQ ID NO: 283035 - protein, 9 aa, Homo Sapiens
QKFYERGDF

SEQ ID NO: 283036 - protein, 9 aa, Homo Sapiens
FKFKVLAKD

SEQ ID NO: 283037 - protein, 9 aa, Homo Sapiens
VPSGKHKRG

SEQ ID NO: 283038 - protein, 9 aa, Homo Sapiens
NNERTILTR

SEQ ID NO: 283039 - protein, 9 aa, Homo Sapiens
VTIEAQPSK

SEQ ID NO: 283040 - protein, 9 aa, Homo Sapiens
PTRELANQL

SEQ ID NO: 283041 - protein, 9 aa, Homo Sapiens
EEAEFQMKE

SEQ ID NO: 283042 - protein, 9 aa, Homo Sapiens
DNLAPTATV

SEQ ID NO: 283043 - protein, 9 aa, Homo Sapiens
KLLQASFER

SEQ ID NO: 283044 - protein, 9 aa, Homo Sapiens
AAYGFRLQG

SEQ ID NO: 283045 - protein, 9 aa, Homo Sapiens
RMKRQTLLD

SEQ ID NO: 283046 - protein, 9 aa, Homo Sapiens
DIEKCQDRM

SEQ ID NO: 283047 - protein, 9 aa, Homo Sapiens
SDYRFLEEV

SEQ ID NO: 283048 - protein, 9 aa, Homo Sapiens
INSYTWGIS

SEQ ID NO: 283049 - protein, 9 aa, Homo Sapiens
EDPSNHSFF

SEQ ID NO: 283050 - protein, 9 aa, Homo Sapiens
YVKVKVNLS

SEQ ID NO: 283051 - protein, 9 aa, Homo Sapiens
LCDQTAQDM

SEQ ID NO: 283052 - protein, 9 aa, Homo Sapiens
KCDNKCKVL

SEQ ID NO: 283053 - protein, 9 aa, Homo Sapiens
ISRPFRYKH

SEQ ID NO: 283054 - protein, 9 aa, Homo Sapiens
EDAAAGLRD

SEQ ID NO: 283055 - protein, 9 aa, Homo Sapiens
NPDNKQIEA

SEQ ID NO: 283056 - protein, 9 aa, Homo Sapiens
QPMIKKAHK

SEQ ID NO: 283057 - protein, 9 aa, Homo Sapiens
HRSSSYHSP

SEQ ID NO: 283058 - protein, 9 aa, Homo Sapiens
QTNTDHLQS

SEQ ID NO: 283059 - protein, 9 aa, Homo Sapiens
LIKLWAKLS

SEQ ID NO: 283060 - protein, 9 aa, Homo Sapiens
FWPEQNIKY

SEQ ID NO: 283061 - protein, 9 aa, Homo Sapiens
DPDSTGGPV

SEQ ID NO: 283062 - protein, 9 aa, Homo Sapiens
QIIDMLSVE

SEQ ID NO: 283063 - protein, 9 aa, Homo Sapiens
NTLRDKASR

SEQ ID NO: 283064 - protein, 9 aa, Homo Sapiens
KPHVSGRPP

SEQ ID NO: 283065 - protein, 9 aa, Homo Sapiens
TPVCGREAE

SEQ ID NO: 283066 - protein, 9 aa, Homo Sapiens
ATERECGNY

SEQ ID NO: 283067 - protein, 9 aa, Homo Sapiens
ILISRLYNA

SEQ ID NO: 283068 - protein, 9 aa, Homo Sapiens
LVQFMLTIT

SEQ ID NO: 283069 - protein, 9 aa, Homo Sapiens
LVTYNTGTF

SEQ ID NO: 283070 - protein, 9 aa, Homo Sapiens
YGRASCTLH

SEQ ID NO: 283071 - protein, 9 aa, Homo Sapiens
AFPNELSLH

SEQ ID NO: 283072 - protein, 9 aa, Homo Sapiens
KYQYFLSSL

SEQ ID NO: 283073 - protein, 9 aa, Homo Sapiens
MSQVIFAFT

SEQ ID NO: 283074 - protein, 9 aa, Homo Sapiens
EECLQTVEC

SEQ ID NO: 283075 - protein, 9 aa, Homo Sapiens
LRHPGILEN

SEQ ID NO: 283076 - protein, 9 aa, Homo Sapiens
ENQDSDSIP

SEQ ID NO: 283077 - protein, 9 aa, Homo Sapiens
RFVVRSQHQ

SEQ ID NO: 283078 - protein, 9 aa, Homo Sapiens
DEARKWSSR

SEQ ID NO: 283079 - protein, 9 aa, Homo Sapiens
IKYFQMDFG

SEQ ID NO: 283080 - protein, 9 aa, Homo Sapiens
HQEMIGGLW

SEQ ID NO: 283081 - protein, 9 aa, Homo Sapiens
PTSSSRQRP

SEQ ID NO: 283082 - protein, 9 aa, Homo Sapiens
SENFRVIII

SEQ ID NO: 283083 - protein, 9 aa, Homo Sapiens
KTKTTVERK

SEQ ID NO: 283084 - protein, 9 aa, Homo Sapiens
RRLIGLENF

SEQ ID NO: 283085 - protein, 9 aa, Homo Sapiens
WRMVWEQNV

SEQ ID NO: 283086 - protein, 9 aa, Homo Sapiens
MLENYSKLV

SEQ ID NO: 283087 - protein, 9 aa, Homo Sapiens
RHTAFIGDI

SEQ ID NO: 283088 - protein, 9 aa, Homo Sapiens
EFVQGNLEI

SEQ ID NO: 283089 - protein, 9 aa, Homo Sapiens
VRGESHILL

SEQ ID NO: 283090 - protein, 9 aa, Homo Sapiens
ALSEHRKQR

SEQ ID NO: 283091 - protein, 9 aa, Homo Sapiens
FLKSYFPTQ

SEQ ID NO: 283092 - protein, 9 aa, Homo Sapiens
CAATPPAVK

SEQ ID NO: 283093 - protein, 9 aa, Homo Sapiens
HNRQPQINS

SEQ ID NO: 283094 - protein, 9 aa, Homo Sapiens
LLKHICRFL

SEQ ID NO: 283095 - protein, 9 aa, Homo Sapiens
LFIARFLGS

SEQ ID NO: 283096 - protein, 9 aa, Homo Sapiens
LNLTAPGTP

SEQ ID NO: 283097 - protein, 9 aa, Homo Sapiens
ERERNKIRS

SEQ ID NO: 283098 - protein, 9 aa, Homo Sapiens
YVTEEAEST

SEQ ID NO: 283099 - protein, 9 aa, Homo Sapiens
GPLPNTALI

SEQ ID NO: 283100 - protein, 9 aa, Homo Sapiens
FHYDVISCL

SEQ ID NO: 283101 - protein, 9 aa, Homo Sapiens
EGSDITTVS

SEQ ID NO: 283102 - protein, 9 aa, Homo Sapiens
DNFFTICNY

SEQ ID NO: 283103 - protein, 9 aa, Homo Sapiens
NTDIANYVV

SEQ ID NO: 283104 - protein, 9 aa, Homo Sapiens
KFSHRQVRY

SEQ ID NO: 283105 - protein, 9 aa, Homo Sapiens
MFQYDTEST

SEQ ID NO: 283106 - protein, 9 aa, Homo Sapiens
TQIMFETSN

SEQ ID NO: 283107 - protein, 9 aa, Homo Sapiens
DLWMPAVRG

SEQ ID NO: 283108 - protein, 9 aa, Homo Sapiens
NGELLYVTD

SEQ ID NO: 283109 - protein, 9 aa, Homo Sapiens
YLRRNLLSL

SEQ ID NO: 283110 - protein, 9 aa, Homo Sapiens
LDIATKRKQ

SEQ ID NO: 283111 - protein, 9 aa, Homo Sapiens
EFSVRDDVF

SEQ ID NO: 283112 - protein, 9 aa, Homo Sapiens
YLSNLKKKC

SEQ ID NO: 283113 - protein, 9 aa, Homo Sapiens
ISLMHNGNY

SEQ ID NO: 283114 - protein, 9 aa, Homo Sapiens
YCLDDQKAL

SEQ ID NO: 283115 - protein, 9 aa, Homo Sapiens
VQNNSVIIK

SEQ ID NO: 283116 - protein, 9 aa, Homo Sapiens
ESFHKLANQ

SEQ ID NO: 283117 - protein, 9 aa, Homo Sapiens
VTGFELVVS

SEQ ID NO: 283118 - protein, 9 aa, Homo Sapiens
DKPDDKSIM

SEQ ID NO: 283119 - protein, 9 aa, Homo Sapiens
SSSFDTTLK

SEQ ID NO: 283120 - protein, 9 aa, Homo Sapiens
LHQHHELCD

SEQ ID NO: 283121 - protein, 9 aa, Homo Sapiens
MTSQEERNE

SEQ ID NO: 283122 - protein, 9 aa, Homo Sapiens
CLCFLLLSA

SEQ ID NO: 283123 - protein, 9 aa, Homo Sapiens
FILKPTLNN

SEQ ID NO: 283124 - protein, 9 aa, Homo Sapiens
IWDGTEEIR

SEQ ID NO: 283125 - protein, 9 aa, Homo Sapiens
KKKGKPEKF

SEQ ID NO: 283126 - protein, 9 aa, Homo Sapiens
ASEKTVVEV

SEQ ID NO: 283127 - protein, 9 aa, Homo Sapiens
PENGDPVHP

SEQ ID NO: 283128 - protein, 9 aa, Homo Sapiens
NKYQYLLPG

SEQ ID NO: 283129 - protein, 9 aa, Homo Sapiens
PLHLAAHNN

SEQ ID NO: 283130 - protein, 9 aa, Homo Sapiens
VTSVGKVKL

SEQ ID NO: 283131 - protein, 9 aa, Homo Sapiens
KTCQEKFKQ

SEQ ID NO: 283132 - protein, 9 aa, Homo Sapiens
RQERDRKSR

SEQ ID NO: 283133 - protein, 9 aa, Homo Sapiens
ILNYVIYTN

SEQ ID NO: 283134 - protein, 9 aa, Homo Sapiens
DNFEYLTRN

SEQ ID NO: 283135 - protein, 9 aa, Homo Sapiens
DILVPYSHP

SEQ ID NO: 283136 - protein, 9 aa, Homo Sapiens
VPSLTPLTT

SEQ ID NO: 283137 - protein, 9 aa, Homo Sapiens
FRNLFHIWR

SEQ ID NO: 283138 - protein, 9 aa, Homo Sapiens
VPVFYHNQG

SEQ ID NO: 283139 - protein, 9 aa, Homo Sapiens
KSSSTQQDN

SEQ ID NO: 283140 - protein, 9 aa, Homo Sapiens
LGIYSKKKE

SEQ ID NO: 283141 - protein, 9 aa, Homo Sapiens
VGDKLSRAD

SEQ ID NO: 283142 - protein, 9 aa, Homo Sapiens
ATEGLDWEY

SEQ ID NO: 283143 - protein, 9 aa, Homo Sapiens
EARMETLNS

SEQ ID NO: 283144 - protein, 9 aa, Homo Sapiens
IGLSIHICT

SEQ ID NO: 283145 - protein, 9 aa, Homo Sapiens
IYSKKKEDD

SEQ ID NO: 283146 - protein, 9 aa, Homo Sapiens
TTMKDVQTS

SEQ ID NO: 283147 - protein, 9 aa, Homo Sapiens
ISANIQQHQ

SEQ ID NO: 283148 - protein, 9 aa, Homo Sapiens
AFLSTLFAS

SEQ ID NO: 283149 - protein, 9 aa, Homo Sapiens
IVYQLCAAA

SEQ ID NO: 283150 - protein, 9 aa, Homo Sapiens
KDHAKAAAA

SEQ ID NO: 283151 - protein, 9 aa, Homo Sapiens
RKSLDVNQD

SEQ ID NO: 283152 - protein, 9 aa, Homo Sapiens
LQNLILGRP

SEQ ID NO: 283153 - protein, 9 aa, Homo Sapiens
VVSERSLQS

SEQ ID NO: 283154 - protein, 9 aa, Homo Sapiens
ICKLADQCT

SEQ ID NO: 283155 - protein, 9 aa, Homo Sapiens
VIVFAYVTD

SEQ ID NO: 283156 - protein, 9 aa, Homo Sapiens
EPEQSNGGS

SEQ ID NO: 283157 - protein, 9 aa, Homo Sapiens
ILGLVQTEE

SEQ ID NO: 283158 - protein, 9 aa, Homo Sapiens
QFYLKEVNI

SEQ ID NO: 283159 - protein, 9 aa, Homo Sapiens
ALNANVVSW

SEQ ID NO: 283160 - protein, 9 aa, Homo Sapiens
KILDREEKA

SEQ ID NO: 283161 - protein, 9 aa, Homo Sapiens
AVHNLLERR

SEQ ID NO: 283162 - protein, 9 aa, Homo Sapiens
FVEWIPPQA

SEQ ID NO: 283163 - protein, 9 aa, Homo Sapiens
CHVFWWPEG

SEQ ID NO: 283164 - protein, 9 aa, Homo Sapiens
LTVSSSVVM

SEQ ID NO: 283165 - protein, 9 aa, Homo Sapiens
ELPCLKSRP

SEQ ID NO: 283166 - protein, 9 aa, Homo Sapiens
AMETWLRLA

SEQ ID NO: 283167 - protein, 9 aa, Homo Sapiens
DREAVRSEA

SEQ ID NO: 283168 - protein, 9 aa, Homo Sapiens
RIIQNQNVI

SEQ ID NO: 283169 - protein, 9 aa, Homo Sapiens
DKELLNEKP

SEQ ID NO: 283170 - protein, 9 aa, Homo Sapiens
FQESKRAIQ

SEQ ID NO: 283171 - protein, 9 aa, Homo Sapiens
SPVSLSAPG

SEQ ID NO: 283172 - protein, 9 aa, Homo Sapiens
RVHILYGRI

SEQ ID NO: 283173 - protein, 9 aa, Homo Sapiens
SSQVTEISR

SEQ ID NO: 283174 - protein, 9 aa, Homo Sapiens
LSGETQEWE

SEQ ID NO: 283175 - protein, 9 aa, Homo Sapiens
DKKKEVVTP

SEQ ID NO: 283176 - protein, 9 aa, Homo Sapiens
EQINNSLKE

SEQ ID NO: 283177 - protein, 9 aa, Homo Sapiens
FAGNTKCYK

SEQ ID NO: 283178 - protein, 9 aa, Homo Sapiens
GKAFNISST

SEQ ID NO: 283179 - protein, 9 aa, Homo Sapiens
IFNALSSSS

SEQ ID NO: 283180 - protein, 9 aa, Homo Sapiens
VNLDYPMVS

SEQ ID NO: 283181 - protein, 9 aa, Homo Sapiens
DWEYKDAPG

SEQ ID NO: 283182 - protein, 9 aa, Homo Sapiens
MDVCATSQT

SEQ ID NO: 283183 - protein, 9 aa, Homo Sapiens
RQTAPRPRL

SEQ ID NO: 283184 - protein, 9 aa, Homo Sapiens
LKYMALNIG

SEQ ID NO: 283185 - protein, 9 aa, Homo Sapiens
SSSLLKPLA

SEQ ID NO: 283186 - protein, 9 aa, Homo Sapiens
APDGKVAGA

SEQ ID NO: 283187 - protein, 9 aa, Homo Sapiens
IINQVFQSL

SEQ ID NO: 283188 - protein, 9 aa, Homo Sapiens
LWIVGCIFA

SEQ ID NO: 283189 - protein, 9 aa, Homo Sapiens
TPGGKACPH

SEQ ID NO: 283190 - protein, 9 aa, Homo Sapiens
CTIGFYCQN

SEQ ID NO: 283191 - protein, 9 aa, Homo Sapiens
RKKYDIDPS

SEQ ID NO: 283192 - protein, 9 aa, Homo Sapiens
PEKFNSRMN

SEQ ID NO: 283193 - protein, 9 aa, Homo Sapiens
QTTARNTSQ

SEQ ID NO: 283194 - protein, 9 aa, Homo Sapiens
IHCIDILFA

SEQ ID NO: 283195 - protein, 9 aa, Homo Sapiens
NQEPGDQTA

SEQ ID NO: 283196 - protein, 9 aa, Homo Sapiens
LSITKTLSP

SEQ ID NO: 283197 - protein, 9 aa, Homo Sapiens
MGVDISLLR

SEQ ID NO: 283198 - protein, 9 aa, Homo Sapiens
CDCCDGTDK

SEQ ID NO: 283199 - protein, 9 aa, Homo Sapiens
KLLQIIGKC

SEQ ID NO: 283200 - protein, 9 aa, Homo Sapiens
KPKASLNID

SEQ ID NO: 283201 - protein, 9 aa, Homo Sapiens
QEMIGGLWN

SEQ ID NO: 283202 - protein, 9 aa, Homo Sapiens
AWKVLSREE

SEQ ID NO: 283203 - protein, 9 aa, Homo Sapiens
RALYLAENE

SEQ ID NO: 283204 - protein, 9 aa, Homo Sapiens
WITNPSQPC

SEQ ID NO: 283205 - protein, 9 aa, Homo Sapiens
GKALSFTEE

SEQ ID NO: 283206 - protein, 9 aa, Homo Sapiens
YHSGEGPMP

SEQ ID NO: 283207 - protein, 9 aa, Homo Sapiens
LFITWCRVQ

SEQ ID NO: 283208 - protein, 9 aa, Homo Sapiens
LAAHLAVEG

SEQ ID NO: 283209 - protein, 9 aa, Homo Sapiens
KPRLEGEIN

SEQ ID NO: 283210 - protein, 9 aa, Homo Sapiens
CRPEKIVQM

SEQ ID NO: 283211 - protein, 9 aa, Homo Sapiens
QMKEFLRKQ

SEQ ID NO: 283212 - protein, 9 aa, Homo Sapiens
HDDLEKVNE

SEQ ID NO: 283213 - protein, 9 aa, Homo Sapiens
LPLPGYRLR

SEQ ID NO: 283214 - protein, 9 aa, Homo Sapiens
RSSPATLQV

SEQ ID NO: 283215 - protein, 9 aa, Homo Sapiens
EHLYYNGVD

SEQ ID NO: 283216 - protein, 9 aa, Homo Sapiens
PESARWIQM

SEQ ID NO: 283217 - protein, 9 aa, Homo Sapiens
RSQHNKKVE

SEQ ID NO: 283218 - protein, 9 aa, Homo Sapiens
SHLIQHQIT

SEQ ID NO: 283219 - protein, 9 aa, Homo Sapiens
GFSGLRLPF

SEQ ID NO: 283220 - protein, 9 aa, Homo Sapiens
EKIPSDYNS

SEQ ID NO: 283221 - protein, 9 aa, Homo Sapiens
EEPDHSTKV

SEQ ID NO: 283222 - protein, 9 aa, Homo Sapiens
LQTPVVRPA

SEQ ID NO: 283223 - protein, 9 aa, Homo Sapiens
FSNKFPHYS

SEQ ID NO: 283224 - protein, 9 aa, Homo Sapiens
LIKLKTKLK

SEQ ID NO: 283225 - protein, 9 aa, Homo Sapiens
IENDQSISQ

SEQ ID NO: 283226 - protein, 9 aa, Homo Sapiens
GTPVVTSQL

SEQ ID NO: 283227 - protein, 9 aa, Homo Sapiens
MQNEMKMIK

SEQ ID NO: 283228 - protein, 9 aa, Homo Sapiens
AIKKLLESD

SEQ ID NO: 283229 - protein, 9 aa, Homo Sapiens
QDVMQPATN

SEQ ID NO: 283230 - protein, 9 aa, Homo Sapiens
TGSLGMQGR

SEQ ID NO: 283231 - protein, 9 aa, Homo Sapiens
ELFGDLPRK

SEQ ID NO: 283232 - protein, 9 aa, Homo Sapiens
DLLRKMEDY

SEQ ID NO: 283233 - protein, 9 aa, Homo Sapiens
RGGQVRVAE

SEQ ID NO: 283234 - protein, 9 aa, Homo Sapiens
LFTFELPPQ

SEQ ID NO: 283235 - protein, 9 aa, Homo Sapiens
PTLMMDTQL

SEQ ID NO: 283236 - protein, 9 aa, Homo Sapiens
LFLYLIIMS

SEQ ID NO: 283237 - protein, 9 aa, Homo Sapiens
NPSHHMTKR

SEQ ID NO: 283238 - protein, 9 aa, Homo Sapiens
GKRYPGIQL

SEQ ID NO: 283239 - protein, 9 aa, Homo Sapiens
PEAPQPGPH

SEQ ID NO: 283240 - protein, 9 aa, Homo Sapiens
GFAGVIALS

SEQ ID NO: 283241 - protein, 9 aa, Homo Sapiens
IHLHQIHHL

SEQ ID NO: 283242 - protein, 9 aa, Homo Sapiens
YLSGSKSMS

SEQ ID NO: 283243 - protein, 9 aa, Homo Sapiens
PMKPLYWTM

SEQ ID NO: 283244 - protein, 9 aa, Homo Sapiens
ANCTHNLYM

SEQ ID NO: 283245 - protein, 9 aa, Homo Sapiens
GLRRVPDEL

SEQ ID NO: 283246 - protein, 9 aa, Homo Sapiens
FSSSGCLHG

SEQ ID NO: 283247 - protein, 9 aa, Homo Sapiens
SLDHSCTSG

SEQ ID NO: 283248 - protein, 9 aa, Homo Sapiens
GSVPLLAAP

SEQ ID NO: 283249 - protein, 9 aa, Homo Sapiens
NISKRVLGK

SEQ ID NO: 283250 - protein, 9 aa, Homo Sapiens
LIAPNINRI

SEQ ID NO: 283251 - protein, 9 aa, Homo Sapiens
HLPGLLITE

SEQ ID NO: 283252 - protein, 9 aa, Homo Sapiens
DRLWTTTNV

SEQ ID NO: 283253 - protein, 9 aa, Homo Sapiens
SAMRGCATE

SEQ ID NO: 283254 - protein, 9 aa, Homo Sapiens
ETTLGNYKN

SEQ ID NO: 283255 - protein, 9 aa, Homo Sapiens
LSSDIRKQP

SEQ ID NO: 283256 - protein, 9 aa, Homo Sapiens
QHGSGEFSH

SEQ ID NO: 283257 - protein, 9 aa, Homo Sapiens
FGWHRAETL

SEQ ID NO: 283258 - protein, 9 aa, Homo Sapiens
QSFKTQNKV

SEQ ID NO: 283259 - protein, 9 aa, Homo Sapiens
PLFRSAQPW

SEQ ID NO: 283260 - protein, 9 aa, Homo Sapiens
SIDLLTNLM

SEQ ID NO: 283261 - protein, 9 aa, Homo Sapiens
TSYSESLCC

SEQ ID NO: 283262 - protein, 9 aa, Homo Sapiens
TYVGRPFMT

SEQ ID NO: 283263 - protein, 9 aa, Homo Sapiens
LNALDIYGR

SEQ ID NO: 283264 - protein, 9 aa, Homo Sapiens
GEKNNSCSI

SEQ ID NO: 283265 - protein, 9 aa, Homo Sapiens
CLDDQKALE

SEQ ID NO: 283266 - protein, 9 aa, Homo Sapiens
ISEGQKYSV

SEQ ID NO: 283267 - protein, 9 aa, Homo Sapiens
LPKGTEPSA

SEQ ID NO: 283268 - protein, 9 aa, Homo Sapiens
GKGAASEGD

SEQ ID NO: 283269 - protein, 9 aa, Homo Sapiens
SKEIVRWRT

SEQ ID NO: 283270 - protein, 9 aa, Homo Sapiens
GQLETPGEL

SEQ ID NO: 283271 - protein, 9 aa, Homo Sapiens
YQTSYRGSL

SEQ ID NO: 283272 - protein, 9 aa, Homo Sapiens
FKDKPEAQR

SEQ ID NO: 283273 - protein, 9 aa, Homo Sapiens
KPGKKEKEH

SEQ ID NO: 283274 - protein, 9 aa, Homo Sapiens
CSELSAVTD

SEQ ID NO: 283275 - protein, 9 aa, Homo Sapiens
IYVYVLDKL

SEQ ID NO: 283276 - protein, 9 aa, Homo Sapiens
TVSQVVHAK

SEQ ID NO: 283277 - protein, 9 aa, Homo Sapiens
DTFTYVFLR

SEQ ID NO: 283278 - protein, 9 aa, Homo Sapiens
VSLIHCFHM

SEQ ID NO: 283279 - protein, 9 aa, Homo Sapiens
MPQFFMDQY

SEQ ID NO: 283280 - protein, 9 aa, Homo Sapiens
GSSLPAHGP

SEQ ID NO: 283281 - protein, 9 aa, Homo Sapiens
EIRKQVLKI

SEQ ID NO: 283282 - protein, 9 aa, Homo Sapiens
LWGEGSPAA

SEQ ID NO: 283283 - protein, 9 aa, Homo Sapiens
EKDRKFVIF

SEQ ID NO: 283284 - protein, 9 aa, Homo Sapiens
GYPLHLEAQ

SEQ ID NO: 283285 - protein, 9 aa, Homo Sapiens
DKNKELRFK

SEQ ID NO: 283286 - protein, 9 aa, Homo Sapiens
RTPIPCVCD

SEQ ID NO: 283287 - protein, 9 aa, Homo Sapiens
VVSWRLCLL

SEQ ID NO: 283288 - protein, 9 aa, Homo Sapiens
MLVMEQLMI

SEQ ID NO: 283289 - protein, 9 aa, Homo Sapiens
RYFLERYCD

SEQ ID NO: 283290 - protein, 9 aa, Homo Sapiens
DFQICGYRV

SEQ ID NO: 283291 - protein, 9 aa, Homo Sapiens
ALCILSHLV

SEQ ID NO: 283292 - protein, 9 aa, Homo Sapiens
ASPRHKMKV

SEQ ID NO: 283293 - protein, 9 aa, Homo Sapiens
CDDIAMNCI

SEQ ID NO: 283294 - protein, 9 aa, Homo Sapiens
ALAAFEAWK

SEQ ID NO: 283295 - protein, 9 aa, Homo Sapiens
PKQIQISSK

SEQ ID NO: 283296 - protein, 9 aa, Homo Sapiens
KFIIYLLAK

SEQ ID NO: 283297 - protein, 9 aa, Homo Sapiens
KGNYLRTST

SEQ ID NO: 283298 - protein, 9 aa, Homo Sapiens
GDLSTLFNV

SEQ ID NO: 283299 - protein, 9 aa, Homo Sapiens
LTYVTEEAE

SEQ ID NO: 283300 - protein, 9 aa, Homo Sapiens
VKETEAIES

SEQ ID NO: 283301 - protein, 9 aa, Homo Sapiens
ATIASLLYL

SEQ ID NO: 283302 - protein, 9 aa, Homo Sapiens
YQAVNDEIE

SEQ ID NO: 283303 - protein, 9 aa, Homo Sapiens
KEEMIQIIN

SEQ ID NO: 283304 - protein, 9 aa, Homo Sapiens
RTVLFWAPI

SEQ ID NO: 283305 - protein, 9 aa, Homo Sapiens
SSEQVQINP

SEQ ID NO: 283306 - protein, 9 aa, Homo Sapiens
GKEKDNPAP

SEQ ID NO: 283307 - protein, 9 aa, Homo Sapiens
TSIRTIEKL

SEQ ID NO: 283308 - protein, 9 aa, Homo Sapiens
KTQFKETIE

SEQ ID NO: 283309 - protein, 9 aa, Homo Sapiens
VQKSKEMVY

SEQ ID NO: 283310 - protein, 9 aa, Homo Sapiens
PSIGVSTVL

SEQ ID NO: 283311 - protein, 9 aa, Homo Sapiens
WGLEVDSVE

SEQ ID NO: 283312 - protein, 9 aa, Homo Sapiens
ALSSAHNLN

SEQ ID NO: 283313 - protein, 9 aa, Homo Sapiens
LEGRLPMAH

SEQ ID NO: 283314 - protein, 9 aa, Homo Sapiens
ISLAAGFSC

SEQ ID NO: 283315 - protein, 9 aa, Homo Sapiens
SLLTSESRS

SEQ ID NO: 283316 - protein, 9 aa, Homo Sapiens
PGSVPSHSK

SEQ ID NO: 283317 - protein, 9 aa, Homo Sapiens
ENGNLKEKY

SEQ ID NO: 283318 - protein, 9 aa, Homo Sapiens
FNTTKSVEF

SEQ ID NO: 283319 - protein, 9 aa, Homo Sapiens
PCGSIYFTT

SEQ ID NO: 283320 - protein, 9 aa, Homo Sapiens
LSTHKFCRC

SEQ ID NO: 283321 - protein, 9 aa, Homo Sapiens
RSAESKTME

SEQ ID NO: 283322 - protein, 9 aa, Homo Sapiens
LNIPDTYAH

SEQ ID NO: 283323 - protein, 9 aa, Homo Sapiens
VKAIIQGAK

SEQ ID NO: 283324 - protein, 9 aa, Homo Sapiens
LGLAQPTSA

SEQ ID NO: 283325 - protein, 9 aa, Homo Sapiens
FLLICGLQQ

SEQ ID NO: 283326 - protein, 9 aa, Homo Sapiens
LIAPSQVQH

SEQ ID NO: 283327 - protein, 9 aa, Homo Sapiens
PRSLWFTWS

SEQ ID NO: 283328 - protein, 9 aa, Homo Sapiens
REALSGACM

SEQ ID NO: 283329 - protein, 9 aa, Homo Sapiens
QLQMATYLD

SEQ ID NO: 283330 - protein, 9 aa, Homo Sapiens
VGKLSLDQI

SEQ ID NO: 283331 - protein, 9 aa, Homo Sapiens
SKAFPDDVV

SEQ ID NO: 283332 - protein, 9 aa, Homo Sapiens
YTCPYSTTT

SEQ ID NO: 283333 - protein, 9 aa, Homo Sapiens
TPATVGLPI

SEQ ID NO: 283334 - protein, 9 aa, Homo Sapiens
RRERLVQLP

SEQ ID NO: 283335 - protein, 9 aa, Homo Sapiens
GTVPWFPRT

SEQ ID NO: 283336 - protein, 9 aa, Homo Sapiens
KNYNNLIIK

SEQ ID NO: 283337 - protein, 9 aa, Homo Sapiens
GLLPEELTA

SEQ ID NO: 283338 - protein, 9 aa, Homo Sapiens
NPFIYSLMN

SEQ ID NO: 283339 - protein, 9 aa, Homo Sapiens
NVDMILKFF

SEQ ID NO: 283340 - protein, 9 aa, Homo Sapiens
FQELNSLLR

SEQ ID NO: 283341 - protein, 9 aa, Homo Sapiens
DAATANNCF

SEQ ID NO: 283342 - protein, 9 aa, Homo Sapiens
APEFITLHD

SEQ ID NO: 283343 - protein, 9 aa, Homo Sapiens
HVIGLLDVF

SEQ ID NO: 283344 - protein, 9 aa, Homo Sapiens
TTENSVAVP

SEQ ID NO: 283345 - protein, 9 aa, Homo Sapiens
TMLYSVIRG

SEQ ID NO: 283346 - protein, 9 aa, Homo Sapiens
PKVRRYFSD

SEQ ID NO: 283347 - protein, 9 aa, Homo Sapiens
LTLLTVFSD

SEQ ID NO: 283348 - protein, 9 aa, Homo Sapiens
LTDAWNTFD

SEQ ID NO: 283349 - protein, 9 aa, Homo Sapiens
RTLRFPAEP

SEQ ID NO: 283350 - protein, 9 aa, Homo Sapiens
KTNNRIHYR

SEQ ID NO: 283351 - protein, 9 aa, Homo Sapiens
TMLMRKRWK

SEQ ID NO: 283352 - protein, 9 aa, Homo Sapiens
LQRNQKRIA

SEQ ID NO: 283353 - protein, 9 aa, Homo Sapiens
SELVLTLNA

SEQ ID NO: 283354 - protein, 9 aa, Homo Sapiens
FNSDSQAVA

SEQ ID NO: 283355 - protein, 9 aa, Homo Sapiens
LLKITNLRL

SEQ ID NO: 283356 - protein, 9 aa, Homo Sapiens
LLRLKMFQE

SEQ ID NO: 283357 - protein, 9 aa, Homo Sapiens
LQESLHQNF

SEQ ID NO: 283358 - protein, 9 aa, Homo Sapiens
GDFQWRNVG

SEQ ID NO: 283359 - protein, 9 aa, Homo Sapiens
CGIKHINCH

SEQ ID NO: 283360 - protein, 9 aa, Homo Sapiens
SSTLIRHKK

SEQ ID NO: 283361 - protein, 9 aa, Homo Sapiens
EPLNGEFYE

SEQ ID NO: 283362 - protein, 9 aa, Homo Sapiens
ALEISGGFG

SEQ ID NO: 283363 - protein, 9 aa, Homo Sapiens
KVHGAFMFV

SEQ ID NO: 283364 - protein, 9 aa, Homo Sapiens
ERKQFAGVL

SEQ ID NO: 283365 - protein, 9 aa, Homo Sapiens
LPKDPRKWI

SEQ ID NO: 283366 - protein, 9 aa, Homo Sapiens
VRGKKYLML

SEQ ID NO: 283367 - protein, 9 aa, Homo Sapiens
SELIAETTE

SEQ ID NO: 283368 - protein, 9 aa, Homo Sapiens
SLGSLFNKT

SEQ ID NO: 283369 - protein, 9 aa, Homo Sapiens
HECTHTGEK

SEQ ID NO: 283370 - protein, 9 aa, Homo Sapiens
MDLSADSSY

SEQ ID NO: 283371 - protein, 9 aa, Homo Sapiens
AFRLLSQDA

SEQ ID NO: 283372 - protein, 9 aa, Homo Sapiens
SLEMKCQKI

SEQ ID NO: 283373 - protein, 9 aa, Homo Sapiens
LKKWNDYLF

SEQ ID NO: 283374 - protein, 9 aa, Homo Sapiens
KHWLGNEVV

SEQ ID NO: 283375 - protein, 9 aa, Homo Sapiens
SALEDSYSK

SEQ ID NO: 283376 - protein, 9 aa, Homo Sapiens
VNLLQQYYL

SEQ ID NO: 283377 - protein, 9 aa, Homo Sapiens
IQLNITYVP

SEQ ID NO: 283378 - protein, 9 aa, Homo Sapiens
LSGLEDVSR

SEQ ID NO: 283379 - protein, 9 aa, Homo Sapiens
EGGGEGGVT

SEQ ID NO: 283380 - protein, 9 aa, Homo Sapiens
LCEYVSQHL

SEQ ID NO: 283381 - protein, 9 aa, Homo Sapiens
SFKYVEYFW

SEQ ID NO: 283382 - protein, 9 aa, Homo Sapiens
LISLSYFLI

SEQ ID NO: 283383 - protein, 9 aa, Homo Sapiens
CVHKMLRQQ

SEQ ID NO: 283384 - protein, 9 aa, Homo Sapiens
AQQWMTQSL

SEQ ID NO: 283385 - protein, 9 aa, Homo Sapiens
SVPQTILRK

SEQ ID NO: 283386 - protein, 9 aa, Homo Sapiens
IRKFSAKYS

SEQ ID NO: 283387 - protein, 9 aa, Homo Sapiens
DIYQEEIRD

SEQ ID NO: 283388 - protein, 9 aa, Homo Sapiens
GTVNKKNKI

SEQ ID NO: 283389 - protein, 9 aa, Homo Sapiens
KLWERNITS

SEQ ID NO: 283390 - protein, 9 aa, Homo Sapiens
ERLRASLER

SEQ ID NO: 283391 - protein, 9 aa, Homo Sapiens
HNGETVIFH

SEQ ID NO: 283392 - protein, 9 aa, Homo Sapiens
SLHLHEIIH

SEQ ID NO: 283393 - protein, 9 aa, Homo Sapiens
KTRMKLTLL

SEQ ID NO: 283394 - protein, 9 aa, Homo Sapiens
ASKRMPQER

SEQ ID NO: 283395 - protein, 9 aa, Homo Sapiens
CKLNNGRWH

SEQ ID NO: 283396 - protein, 9 aa, Homo Sapiens
LRGFFTICK

SEQ ID NO: 283397 - protein, 9 aa, Homo Sapiens
KSADNFIDK

SEQ ID NO: 283398 - protein, 9 aa, Homo Sapiens
PEICTSPQS

SEQ ID NO: 283399 - protein, 9 aa, Homo Sapiens
DISLDERGE

SEQ ID NO: 283400 - protein, 9 aa, Homo Sapiens
IKQMQEVYN

SEQ ID NO: 283401 - protein, 9 aa, Homo Sapiens
LDALINVLI

SEQ ID NO: 283402 - protein, 9 aa, Homo Sapiens
LRSGSYFSQ

SEQ ID NO: 283403 - protein, 9 aa, Homo Sapiens
SVIWIGYLA

SEQ ID NO: 283404 - protein, 9 aa, Homo Sapiens
NTGIATTLI

SEQ ID NO: 283405 - protein, 9 aa, Homo Sapiens
TAIPGLIPY

SEQ ID NO: 283406 - protein, 9 aa, Homo Sapiens
LGKRISKRI

SEQ ID NO: 283407 - protein, 9 aa, Homo Sapiens
KTLGKQHCL

SEQ ID NO: 283408 - protein, 9 aa, Homo Sapiens
YKISVTLYG

SEQ ID NO: 283409 - protein, 9 aa, Homo Sapiens
KLELTKMRA

SEQ ID NO: 283410 - protein, 9 aa, Homo Sapiens
FLWQVEADA

SEQ ID NO: 283411 - protein, 9 aa, Homo Sapiens
SSFEINAFK

SEQ ID NO: 283412 - protein, 9 aa, Homo Sapiens
HKQKVVEKE

SEQ ID NO: 283413 - protein, 9 aa, Homo Sapiens
SADKLRIIP

SEQ ID NO: 283414 - protein, 9 aa, Homo Sapiens
ESSDLTKVV

SEQ ID NO: 283415 - protein, 9 aa, Homo Sapiens
HYAVKQHSF

SEQ ID NO: 283416 - protein, 9 aa, Homo Sapiens
QEGRSLQNK

SEQ ID NO: 283417 - protein, 9 aa, Homo Sapiens
NVSSLSSKF

SEQ ID NO: 283418 - protein, 9 aa, Homo Sapiens
HCHYKAPAV

SEQ ID NO: 283419 - protein, 9 aa, Homo Sapiens
IGNKCEEFN

SEQ ID NO: 283420 - protein, 9 aa, Homo Sapiens
DKNLIAYFI

SEQ ID NO: 283421 - protein, 9 aa, Homo Sapiens
NPQYYKKPI

SEQ ID NO: 283422 - protein, 9 aa, Homo Sapiens
RNVQPDFKI

SEQ ID NO: 283423 - protein, 9 aa, Homo Sapiens
LFQYQIIHA

SEQ ID NO: 283424 - protein, 9 aa, Homo Sapiens
PTFSENMSK

SEQ ID NO: 283425 - protein, 9 aa, Homo Sapiens
AKAVNYHLL

SEQ ID NO: 283426 - protein, 9 aa, Homo Sapiens
SPRHKMKVI

SEQ ID NO: 283427 - protein, 9 aa, Homo Sapiens
EINFNIHSS

SEQ ID NO: 283428 - protein, 9 aa, Homo Sapiens
GNKEKKSAK

SEQ ID NO: 283429 - protein, 9 aa, Homo Sapiens
EKKRIKKLL

SEQ ID NO: 283430 - protein, 9 aa, Homo Sapiens
NIFQAFLSK

SEQ ID NO: 283431 - protein, 9 aa, Homo Sapiens
LLRPHVLMP

SEQ ID NO: 283432 - protein, 9 aa, Homo Sapiens
NSTQRVVVE

SEQ ID NO: 283433 - protein, 9 aa, Homo Sapiens
MPLQFDLCK

SEQ ID NO: 283434 - protein, 9 aa, Homo Sapiens
DDQSLVKST

SEQ ID NO: 283435 - protein, 9 aa, Homo Sapiens
DALGIASCL

SEQ ID NO: 283436 - protein, 9 aa, Homo Sapiens
GEDPFQTDN

SEQ ID NO: 283437 - protein, 9 aa, Homo Sapiens
CKTFNIKND

SEQ ID NO: 283438 - protein, 9 aa, Homo Sapiens
DLRHFRAVF

SEQ ID NO: 283439 - protein, 9 aa, Homo Sapiens
LRISNISLM

SEQ ID NO: 283440 - protein, 9 aa, Homo Sapiens
LYFCLGNLA

SEQ ID NO: 283441 - protein, 9 aa, Homo Sapiens
LCEMQNPRE

SEQ ID NO: 283442 - protein, 9 aa, Homo Sapiens
LDSATLLIQ

SEQ ID NO: 283443 - protein, 9 aa, Homo Sapiens
PLQQQLSVN

SEQ ID NO: 283444 - protein, 9 aa, Homo Sapiens
KKHTTSAEK

SEQ ID NO: 283445 - protein, 9 aa, Homo Sapiens
VLLDTSNEP

SEQ ID NO: 283446 - protein, 9 aa, Homo Sapiens
ARRRIIPDM

SEQ ID NO: 283447 - protein, 9 aa, Homo Sapiens
VCNLCILGE

SEQ ID NO: 283448 - protein, 9 aa, Homo Sapiens
ENFLLKFQE

SEQ ID NO: 283449 - protein, 9 aa, Homo Sapiens
HSARCIFVE

SEQ ID NO: 283450 - protein, 9 aa, Homo Sapiens
FLNTGSFNL

SEQ ID NO: 283451 - protein, 9 aa, Homo Sapiens
DGSMINSHL

SEQ ID NO: 283452 - protein, 9 aa, Homo Sapiens
DADLESKLV

SEQ ID NO: 283453 - protein, 9 aa, Homo Sapiens
KSVQTISNK

SEQ ID NO: 283454 - protein, 9 aa, Homo Sapiens
LHVWVMNLH

SEQ ID NO: 283455 - protein, 9 aa, Homo Sapiens
KSWCQEELL

SEQ ID NO: 283456 - protein, 9 aa, Homo Sapiens
KTDGFVNLP

SEQ ID NO: 283457 - protein, 9 aa, Homo Sapiens
VDSSSSLYG

SEQ ID NO: 283458 - protein, 9 aa, Homo Sapiens
GYPDVARYL

SEQ ID NO: 283459 - protein, 9 aa, Homo Sapiens
CPREEAGVP

SEQ ID NO: 283460 - protein, 9 aa, Homo Sapiens
MWLQVLELD

SEQ ID NO: 283461 - protein, 9 aa, Homo Sapiens
HQVAESVKY

SEQ ID NO: 283462 - protein, 9 aa, Homo Sapiens
YRINTGKRS

SEQ ID NO: 283463 - protein, 9 aa, Homo Sapiens
GSPACSYNQ

SEQ ID NO: 283464 - protein, 9 aa, Homo Sapiens
KGTQICAYF

SEQ ID NO: 283465 - protein, 9 aa, Homo Sapiens
TYLLEKSRF

SEQ ID NO: 283466 - protein, 9 aa, Homo Sapiens
QLIFKKGSR

SEQ ID NO: 283467 - protein, 9 aa, Homo Sapiens
DKVSPSGNI

SEQ ID NO: 283468 - protein, 9 aa, Homo Sapiens
QVMAKRIHA

SEQ ID NO: 283469 - protein, 9 aa, Homo Sapiens
NLLKAAMKH

SEQ ID NO: 283470 - protein, 9 aa, Homo Sapiens
CEGQENAIE

SEQ ID NO: 283471 - protein, 9 aa, Homo Sapiens
CKLPKIDVH

SEQ ID NO: 283472 - protein, 9 aa, Homo Sapiens
GGSTTFCIF

SEQ ID NO: 283473 - protein, 9 aa, Homo Sapiens
IPEWVYEEE

SEQ ID NO: 283474 - protein, 9 aa, Homo Sapiens
LIRHQNIHI

SEQ ID NO: 283475 - protein, 9 aa, Homo Sapiens
NDNYPSFAT

SEQ ID NO: 283476 - protein, 9 aa, Homo Sapiens
VLYFSRYGV

SEQ ID NO: 283477 - protein, 9 aa, Homo Sapiens
VVLHNKGNQ

SEQ ID NO: 283478 - protein, 9 aa, Homo Sapiens
IAIVGVNDF

SEQ ID NO: 283479 - protein, 9 aa, Homo Sapiens
AYGFRLQGL

SEQ ID NO: 283480 - protein, 9 aa, Homo Sapiens
QLIIDAGQI

SEQ ID NO: 283481 - protein, 9 aa, Homo Sapiens
PVVSAVGGI

SEQ ID NO: 283482 - protein, 9 aa, Homo Sapiens
EVWEITDTF

SEQ ID NO: 283483 - protein, 9 aa, Homo Sapiens
QVSNTQQKP

SEQ ID NO: 283484 - protein, 9 aa, Homo Sapiens
PEPPYIFHQ

SEQ ID NO: 283485 - protein, 9 aa, Homo Sapiens
GDRHFVSDH

SEQ ID NO: 283486 - protein, 9 aa, Homo Sapiens
SYAFGKCPT

SEQ ID NO: 283487 - protein, 9 aa, Homo Sapiens
RLISREKIS

SEQ ID NO: 283488 - protein, 9 aa, Homo Sapiens
RDGSSGQRR

SEQ ID NO: 283489 - protein, 9 aa, Homo Sapiens
NILDLHNKL

SEQ ID NO: 283490 - protein, 9 aa, Homo Sapiens
VNHTKRKSS

SEQ ID NO: 283491 - protein, 9 aa, Homo Sapiens
IPAVMLIFG

SEQ ID NO: 283492 - protein, 9 aa, Homo Sapiens
ERERKKLLD

SEQ ID NO: 283493 - protein, 9 aa, Homo Sapiens
DLSKKTLLH

SEQ ID NO: 283494 - protein, 9 aa, Homo Sapiens
HNKSVSCHR

SEQ ID NO: 283495 - protein, 9 aa, Homo Sapiens
VINSEAITL

SEQ ID NO: 283496 - protein, 9 aa, Homo Sapiens
NALMLYMKE

SEQ ID NO: 283497 - protein, 9 aa, Homo Sapiens
LPCDTLASS

SEQ ID NO: 283498 - protein, 9 aa, Homo Sapiens
PSLYMSPEL

SEQ ID NO: 283499 - protein, 9 aa, Homo Sapiens
ESKINEEAC

SEQ ID NO: 283500 - protein, 9 aa, Homo Sapiens
QDRHGKTFT

SEQ ID NO: 283501 - protein, 9 aa, Homo Sapiens
FFVVGTLLV

SEQ ID NO: 283502 - protein, 9 aa, Homo Sapiens
NLDTDKSET

SEQ ID NO: 283503 - protein, 9 aa, Homo Sapiens
QDPVSPILV

SEQ ID NO: 283504 - protein, 9 aa, Homo Sapiens
GRSLQNKGS

SEQ ID NO: 283505 - protein, 9 aa, Homo Sapiens
LDAAEHGNI

SEQ ID NO: 283506 - protein, 9 aa, Homo Sapiens
RDDKRMPAK

SEQ ID NO: 283507 - protein, 9 aa, Homo Sapiens
TCRHLRIYV

SEQ ID NO: 283508 - protein, 9 aa, Homo Sapiens
KESFELMQT

SEQ ID NO: 283509 - protein, 9 aa, Homo Sapiens
KMLRQQQHL

SEQ ID NO: 283510 - protein, 9 aa, Homo Sapiens
MFQSAGIWM

SEQ ID NO: 283511 - protein, 9 aa, Homo Sapiens
REKSKRDYT

SEQ ID NO: 283512 - protein, 9 aa, Homo Sapiens
ALEDRNSMT

SEQ ID NO: 283513 - protein, 9 aa, Homo Sapiens
NRPLKDRVN

SEQ ID NO: 283514 - protein, 9 aa, Homo Sapiens
HKKCSTQDF

SEQ ID NO: 283515 - protein, 9 aa, Homo Sapiens
DGHAMDFSF

SEQ ID NO: 283516 - protein, 9 aa, Homo Sapiens
NYWDKCVKR

SEQ ID NO: 283517 - protein, 9 aa, Homo Sapiens
LETNTENSS

SEQ ID NO: 283518 - protein, 9 aa, Homo Sapiens
EIICVIVEK

SEQ ID NO: 283519 - protein, 9 aa, Homo Sapiens
LLEEILGKI

SEQ ID NO: 283520 - protein, 9 aa, Homo Sapiens
DRHFVSDHS

SEQ ID NO: 283521 - protein, 9 aa, Homo Sapiens
NECISVKGI

SEQ ID NO: 283522 - protein, 9 aa, Homo Sapiens
IKQLRHPKY

SEQ ID NO: 283523 - protein, 9 aa, Homo Sapiens
MTKGATKEA

SEQ ID NO: 283524 - protein, 9 aa, Homo Sapiens
RKTESSCKA

SEQ ID NO: 283525 - protein, 9 aa, Homo Sapiens
ILHKCMTKE

SEQ ID NO: 283526 - protein, 9 aa, Homo Sapiens
ADPKPPASF

SEQ ID NO: 283527 - protein, 9 aa, Homo Sapiens
FVLNGCMYS

SEQ ID NO: 283528 - protein, 9 aa, Homo Sapiens
GSAIVAVIA

SEQ ID NO: 283529 - protein, 9 aa, Homo Sapiens
QIHRELIEI

SEQ ID NO: 283530 - protein, 9 aa, Homo Sapiens
YSNQMAEKT

SEQ ID NO: 283531 - protein, 9 aa, Homo Sapiens
KIILASNLA

SEQ ID NO: 283532 - protein, 9 aa, Homo Sapiens
SASKLSPGG

SEQ ID NO: 283533 - protein, 9 aa, Homo Sapiens
DGKNLTINT

SEQ ID NO: 283534 - protein, 9 aa, Homo Sapiens
ASESLGELF

SEQ ID NO: 283535 - protein, 9 aa, Homo Sapiens
CYYQLHRVF

SEQ ID NO: 283536 - protein, 9 aa, Homo Sapiens
LTAYLPDNK

SEQ ID NO: 283537 - protein, 9 aa, Homo Sapiens
QIWNDGRVL

SEQ ID NO: 283538 - protein, 9 aa, Homo Sapiens
LIMVARISD

SEQ ID NO: 283539 - protein, 9 aa, Homo Sapiens
VSSEISSAT

SEQ ID NO: 283540 - protein, 9 aa, Homo Sapiens
IKVEVATYA

SEQ ID NO: 283541 - protein, 9 aa, Homo Sapiens
GFQSGMKRL

SEQ ID NO: 283542 - protein, 9 aa, Homo Sapiens
NGRHPGGRG

SEQ ID NO: 283543 - protein, 9 aa, Homo Sapiens
AGNQGRLGR

SEQ ID NO: 283544 - protein, 9 aa, Homo Sapiens
NRDTKMALN

SEQ ID NO: 283545 - protein, 9 aa, Homo Sapiens
ERTILTRGL

SEQ ID NO: 283546 - protein, 9 aa, Homo Sapiens
DSKPRSLWF

SEQ ID NO: 283547 - protein, 9 aa, Homo Sapiens
EHFRTLNGK

SEQ ID NO: 283548 - protein, 9 aa, Homo Sapiens
HLEPYFESF

SEQ ID NO: 283549 - protein, 9 aa, Homo Sapiens
QLDKSMCSH

SEQ ID NO: 283550 - protein, 9 aa, Homo Sapiens
ESLISLEIK

SEQ ID NO: 283551 - protein, 9 aa, Homo Sapiens
DVWPLDPLN

SEQ ID NO: 283552 - protein, 9 aa, Homo Sapiens
VKIIGEYTS

SEQ ID NO: 283553 - protein, 9 aa, Homo Sapiens
TYFKAGNCF

SEQ ID NO: 283554 - protein, 9 aa, Homo Sapiens
IIHLWKHGI

SEQ ID NO: 283555 - protein, 9 aa, Homo Sapiens
LNYQLIYHQ

SEQ ID NO: 283556 - protein, 9 aa, Homo Sapiens
DPASGEELW

SEQ ID NO: 283557 - protein, 9 aa, Homo Sapiens
DMERKANPS

SEQ ID NO: 283558 - protein, 9 aa, Homo Sapiens
LATAQDDVT

SEQ ID NO: 283559 - protein, 9 aa, Homo Sapiens
VYKSPASGA

SEQ ID NO: 283560 - protein, 9 aa, Homo Sapiens
TQCCLFCFW

SEQ ID NO: 283561 - protein, 9 aa, Homo Sapiens
LLPCSQEWH

SEQ ID NO: 283562 - protein, 9 aa, Homo Sapiens
FQKTLRLCR

SEQ ID NO: 283563 - protein, 9 aa, Homo Sapiens
LEDDLLGEY

SEQ ID NO: 283564 - protein, 9 aa, Homo Sapiens
IPHTGKKRY

SEQ ID NO: 283565 - protein, 9 aa, Homo Sapiens
FTYHKITHT

SEQ ID NO: 283566 - protein, 9 aa, Homo Sapiens
TPVRGEEPM

SEQ ID NO: 283567 - protein, 9 aa, Homo Sapiens
LHYAVKQHS

SEQ ID NO: 283568 - protein, 9 aa, Homo Sapiens
PQFRAVLGK

SEQ ID NO: 283569 - protein, 9 aa, Homo Sapiens
SFVLNGCMY

SEQ ID NO: 283570 - protein, 9 aa, Homo Sapiens
DLLKLKSFC

SEQ ID NO: 283571 - protein, 9 aa, Homo Sapiens
EFQGPMPAD

SEQ ID NO: 283572 - protein, 9 aa, Homo Sapiens
MRYMNESQN

SEQ ID NO: 283573 - protein, 9 aa, Homo Sapiens
PTKQSLANI

SEQ ID NO: 283574 - protein, 9 aa, Homo Sapiens
EEEIVLQSY

SEQ ID NO: 283575 - protein, 9 aa, Homo Sapiens
KHFPFWLWI

SEQ ID NO: 283576 - protein, 9 aa, Homo Sapiens
QEARWAVGG

SEQ ID NO: 283577 - protein, 9 aa, Homo Sapiens
LENKWGHNI

SEQ ID NO: 283578 - protein, 9 aa, Homo Sapiens
QESNTSRHT

SEQ ID NO: 283579 - protein, 9 aa, Homo Sapiens
FQHISPNRH

SEQ ID NO: 283580 - protein, 9 aa, Homo Sapiens
KEQNLVSRG

SEQ ID NO: 283581 - protein, 9 aa, Homo Sapiens
STLIDSLKT

SEQ ID NO: 283582 - protein, 9 aa, Homo Sapiens
PIFKADRPL

SEQ ID NO: 283583 - protein, 9 aa, Homo Sapiens
FVELFISYV

SEQ ID NO: 283584 - protein, 9 aa, Homo Sapiens
IVCFYGKTD

SEQ ID NO: 283585 - protein, 9 aa, Homo Sapiens
ESQDVMQPA

SEQ ID NO: 283586 - protein, 9 aa, Homo Sapiens
GADSPSAAR

SEQ ID NO: 283587 - protein, 9 aa, Homo Sapiens
MYEQGGGLE

SEQ ID NO: 283588 - protein, 9 aa, Homo Sapiens
PGLEGGTTS

SEQ ID NO: 283589 - protein, 9 aa, Homo Sapiens
YVPGILSFL

SEQ ID NO: 283590 - protein, 9 aa, Homo Sapiens
CAILHHFIP

SEQ ID NO: 283591 - protein, 9 aa, Homo Sapiens
EEQNKLIQN

SEQ ID NO: 283592 - protein, 9 aa, Homo Sapiens
WLSVCHFTL

SEQ ID NO: 283593 - protein, 9 aa, Homo Sapiens
SNTGSKHLP

SEQ ID NO: 283594 - protein, 9 aa, Homo Sapiens
DKSSRKNVF

SEQ ID NO: 283595 - protein, 9 aa, Homo Sapiens
GFIDKTFVV

SEQ ID NO: 283596 - protein, 9 aa, Homo Sapiens
PEPTVTWIH

SEQ ID NO: 283597 - protein, 9 aa, Homo Sapiens
SSTSPQLAK

SEQ ID NO: 283598 - protein, 9 aa, Homo Sapiens
LFYFFSFTI

SEQ ID NO: 283599 - protein, 9 aa, Homo Sapiens
LQSGVDPSV

SEQ ID NO: 283600 - protein, 9 aa, Homo Sapiens
KNFHSPMVF

SEQ ID NO: 283601 - protein, 9 aa, Homo Sapiens
QNVKFRKWM

SEQ ID NO: 283602 - protein, 9 aa, Homo Sapiens
KTAFMKVVE

SEQ ID NO: 283603 - protein, 9 aa, Homo Sapiens
SGTGLRMMI

SEQ ID NO: 283604 - protein, 9 aa, Homo Sapiens
QTTEAKRDD

SEQ ID NO: 283605 - protein, 9 aa, Homo Sapiens
SRLKESKTP

SEQ ID NO: 283606 - protein, 9 aa, Homo Sapiens
SLTTENSTG

SEQ ID NO: 283607 - protein, 9 aa, Homo Sapiens
SKCVGILSW

SEQ ID NO: 283608 - protein, 9 aa, Homo Sapiens
NFLLGSEIS

SEQ ID NO: 283609 - protein, 9 aa, Homo Sapiens
TNESLECQM

SEQ ID NO: 283610 - protein, 9 aa, Homo Sapiens
TITLAAFTL

SEQ ID NO: 283611 - protein, 9 aa, Homo Sapiens
TYNKILQLD

SEQ ID NO: 283612 - protein, 9 aa, Homo Sapiens
YSKQRMPQE

SEQ ID NO: 283613 - protein, 9 aa, Homo Sapiens
HLAHKFFPK

SEQ ID NO: 283614 - protein, 9 aa, Homo Sapiens
LRDMHWALV

SEQ ID NO: 283615 - protein, 9 aa, Homo Sapiens
PVSNTSDSI

SEQ ID NO: 283616 - protein, 9 aa, Homo Sapiens
NFLRKPGGN

SEQ ID NO: 283617 - protein, 9 aa, Homo Sapiens
TILTRGLLK

SEQ ID NO: 283618 - protein, 9 aa, Homo Sapiens
HKALDADIH

SEQ ID NO: 283619 - protein, 9 aa, Homo Sapiens
LNSVNPTMS

SEQ ID NO: 283620 - protein, 9 aa, Homo Sapiens
MDKTIIVKN

SEQ ID NO: 283621 - protein, 9 aa, Homo Sapiens
ELGRGVQKL

SEQ ID NO: 283622 - protein, 9 aa, Homo Sapiens
LQMALEEHL

SEQ ID NO: 283623 - protein, 9 aa, Homo Sapiens
KISDDHLIP

SEQ ID NO: 283624 - protein, 9 aa, Homo Sapiens
QDHDKLFEL

SEQ ID NO: 283625 - protein, 9 aa, Homo Sapiens
PIIQIISHV

SEQ ID NO: 283626 - protein, 9 aa, Homo Sapiens
VMCPYERRA

SEQ ID NO: 283627 - protein, 9 aa, Homo Sapiens
PDKFCHSSL

SEQ ID NO: 283628 - protein, 9 aa, Homo Sapiens
KDKYTKKKS

SEQ ID NO: 283629 - protein, 9 aa, Homo Sapiens
SLRKDPINA

SEQ ID NO: 283630 - protein, 9 aa, Homo Sapiens
LSNEFHIYI

SEQ ID NO: 283631 - protein, 9 aa, Homo Sapiens
IHIMWSQRD

SEQ ID NO: 283632 - protein, 9 aa, Homo Sapiens
YTAQDYGAG

SEQ ID NO: 283633 - protein, 9 aa, Homo Sapiens
DAARRFILN

SEQ ID NO: 283634 - protein, 9 aa, Homo Sapiens
CFNYMHECF

SEQ ID NO: 283635 - protein, 9 aa, Homo Sapiens
GNKPYECTE

SEQ ID NO: 283636 - protein, 9 aa, Homo Sapiens
VVQRGRMPP

SEQ ID NO: 283637 - protein, 9 aa, Homo Sapiens
NYNQAYHWD

SEQ ID NO: 283638 - protein, 9 aa, Homo Sapiens
FALESAQFL

SEQ ID NO: 283639 - protein, 9 aa, Homo Sapiens
QDRMIADGA

SEQ ID NO: 283640 - protein, 9 aa, Homo Sapiens
PGSHNLETA

SEQ ID NO: 283641 - protein, 9 aa, Homo Sapiens
VDPLCSIKE

SEQ ID NO: 283642 - protein, 9 aa, Homo Sapiens
CGGGVKTAI

SEQ ID NO: 283643 - protein, 9 aa, Homo Sapiens
TAGKKCRIL

SEQ ID NO: 283644 - protein, 9 aa, Homo Sapiens
LSIIHHDQP

SEQ ID NO: 283645 - protein, 9 aa, Homo Sapiens
CSIAFKNQT

SEQ ID NO: 283646 - protein, 9 aa, Homo Sapiens
PHSTHRYLA

SEQ ID NO: 283647 - protein, 9 aa, Homo Sapiens
GTAFNLRKP

SEQ ID NO: 283648 - protein, 9 aa, Homo Sapiens
LLICGLQQV

SEQ ID NO: 283649 - protein, 9 aa, Homo Sapiens
KLPWPCDSR

SEQ ID NO: 283650 - protein, 9 aa, Homo Sapiens
EEVARTADH

SEQ ID NO: 283651 - protein, 9 aa, Homo Sapiens
KCGDLYVIF

SEQ ID NO: 283652 - protein, 9 aa, Homo Sapiens
CNDCCFGTF

SEQ ID NO: 283653 - protein, 9 aa, Homo Sapiens
KEEKLFTLT

SEQ ID NO: 283654 - protein, 9 aa, Homo Sapiens
TIIKHQRIH

SEQ ID NO: 283655 - protein, 9 aa, Homo Sapiens
ALPKVSFCG

SEQ ID NO: 283656 - protein, 9 aa, Homo Sapiens
VGGQVIKPS

SEQ ID NO: 283657 - protein, 9 aa, Homo Sapiens
YMGMCSMKR

SEQ ID NO: 283658 - protein, 9 aa, Homo Sapiens
HKRKSIAVA

SEQ ID NO: 283659 - protein, 9 aa, Homo Sapiens
CIVATILRI

SEQ ID NO: 283660 - protein, 9 aa, Homo Sapiens
VKKIINQVF

SEQ ID NO: 283661 - protein, 9 aa, Homo Sapiens
LMILASDGL

SEQ ID NO: 283662 - protein, 9 aa, Homo Sapiens
HLDVLFAEF

SEQ ID NO: 283663 - protein, 9 aa, Homo Sapiens
NELDTVVEK

SEQ ID NO: 283664 - protein, 9 aa, Homo Sapiens
SMFVFVCLF

SEQ ID NO: 283665 - protein, 9 aa, Homo Sapiens
NKNNFVPYR

SEQ ID NO: 283666 - protein, 9 aa, Homo Sapiens
SSQPKELFE

SEQ ID NO: 283667 - protein, 9 aa, Homo Sapiens
TTNMAQTNP

SEQ ID NO: 283668 - protein, 9 aa, Homo Sapiens
TDYIKRIML

SEQ ID NO: 283669 - protein, 9 aa, Homo Sapiens
EAVKSEQSC

SEQ ID NO: 283670 - protein, 9 aa, Homo Sapiens
FLDRYDPNH

SEQ ID NO: 283671 - protein, 9 aa, Homo Sapiens
TIEAQPSKV

SEQ ID NO: 283672 - protein, 9 aa, Homo Sapiens
GVVESYEIT

SEQ ID NO: 283673 - protein, 9 aa, Homo Sapiens
SEVRGCDVA

SEQ ID NO: 283674 - protein, 9 aa, Homo Sapiens
DKERTRVKL

SEQ ID NO: 283675 - protein, 9 aa, Homo Sapiens
EEGRKHEML

SEQ ID NO: 283676 - protein, 9 aa, Homo Sapiens
SQNHAVLTA

SEQ ID NO: 283677 - protein, 9 aa, Homo Sapiens
FRLNWTWIS

SEQ ID NO: 283678 - protein, 9 aa, Homo Sapiens
RSRQSGENG

SEQ ID NO: 283679 - protein, 9 aa, Homo Sapiens
IHLKKMAYL

SEQ ID NO: 283680 - protein, 9 aa, Homo Sapiens
GPKQYPYTN

SEQ ID NO: 283681 - protein, 9 aa, Homo Sapiens
GLKHLMQLN

SEQ ID NO: 283682 - protein, 9 aa, Homo Sapiens
LELPLPQFC

SEQ ID NO: 283683 - protein, 9 aa, Homo Sapiens
RLHIQGTHT

SEQ ID NO: 283684 - protein, 9 aa, Homo Sapiens
LENKIINKY

SEQ ID NO: 283685 - protein, 9 aa, Homo Sapiens
ATDISRLQQ

SEQ ID NO: 283686 - protein, 9 aa, Homo Sapiens
WILDKDFGY

SEQ ID NO: 283687 - protein, 9 aa, Homo Sapiens
DLLTLAEKD

SEQ ID NO: 283688 - protein, 9 aa, Homo Sapiens
YFTHILGFE

SEQ ID NO: 283689 - protein, 9 aa, Homo Sapiens
LWLLQFIFQ

SEQ ID NO: 283690 - protein, 9 aa, Homo Sapiens
ASTLYDYCR

SEQ ID NO: 283691 - protein, 9 aa, Homo Sapiens
HIEESFQES

SEQ ID NO: 283692 - protein, 9 aa, Homo Sapiens
ISTEDGEES

SEQ ID NO: 283693 - protein, 9 aa, Homo Sapiens
ALRTLRFPA

SEQ ID NO: 283694 - protein, 9 aa, Homo Sapiens
NTLYDQHLG

SEQ ID NO: 283695 - protein, 9 aa, Homo Sapiens
SSASMLTLR

SEQ ID NO: 283696 - protein, 9 aa, Homo Sapiens
IDEDHSGPW

SEQ ID NO: 283697 - protein, 9 aa, Homo Sapiens
LFVLLKALF

SEQ ID NO: 283698 - protein, 9 aa, Homo Sapiens
YIRESAWKQ

SEQ ID NO: 283699 - protein, 9 aa, Homo Sapiens
GYRADLWMP

SEQ ID NO: 283700 - protein, 9 aa, Homo Sapiens
LQRLLDRVV

SEQ ID NO: 283701 - protein, 9 aa, Homo Sapiens
SAWRKQIPF

SEQ ID NO: 283702 - protein, 9 aa, Homo Sapiens
MTLFFAHGR

SEQ ID NO: 283703 - protein, 9 aa, Homo Sapiens
YQQELHQMG

SEQ ID NO: 283704 - protein, 9 aa, Homo Sapiens
KRRKNIQLL

SEQ ID NO: 283705 - protein, 9 aa, Homo Sapiens
DPVHPGVAM

SEQ ID NO: 283706 - protein, 9 aa, Homo Sapiens
YEDFYFSEA

SEQ ID NO: 283707 - protein, 9 aa, Homo Sapiens
VERELGALL

SEQ ID NO: 283708 - protein, 9 aa, Homo Sapiens
DYDIASKEQ

SEQ ID NO: 283709 - protein, 9 aa, Homo Sapiens
VLTAFSQEM

SEQ ID NO: 283710 - protein, 9 aa, Homo Sapiens
FGRSPSIKQ

SEQ ID NO: 283711 - protein, 9 aa, Homo Sapiens
ELSKCNPCG

SEQ ID NO: 283712 - protein, 9 aa, Homo Sapiens
TDPKWFGDE

SEQ ID NO: 283713 - protein, 9 aa, Homo Sapiens
FGESLLNYA

SEQ ID NO: 283714 - protein, 9 aa, Homo Sapiens
IGLLIVHKP

SEQ ID NO: 283715 - protein, 9 aa, Homo Sapiens
LFQDRMIAD

SEQ ID NO: 283716 - protein, 9 aa, Homo Sapiens
RHRKKRRST

SEQ ID NO: 283717 - protein, 9 aa, Homo Sapiens
VNTGLSAFI

SEQ ID NO: 283718 - protein, 9 aa, Homo Sapiens
FQGPMPADM

SEQ ID NO: 283719 - protein, 9 aa, Homo Sapiens
DECKLQKYY

SEQ ID NO: 283720 - protein, 9 aa, Homo Sapiens
GEKPYMCRE

SEQ ID NO: 283721 - protein, 9 aa, Homo Sapiens
QRCPVYLRE

SEQ ID NO: 283722 - protein, 9 aa, Homo Sapiens
TSKEANIRA

SEQ ID NO: 283723 - protein, 9 aa, Homo Sapiens
FSNACEKTS

SEQ ID NO: 283724 - protein, 9 aa, Homo Sapiens
DMVVYMVPD

SEQ ID NO: 283725 - protein, 9 aa, Homo Sapiens
DTEAAIRSI

SEQ ID NO: 283726 - protein, 9 aa, Homo Sapiens
LGVVQIYHR

SEQ ID NO: 283727 - protein, 9 aa, Homo Sapiens
ISNISLMHN

SEQ ID NO: 283728 - protein, 9 aa, Homo Sapiens
QPQPSTNMF

SEQ ID NO: 283729 - protein, 9 aa, Homo Sapiens
RVFEMVVNA

SEQ ID NO: 283730 - protein, 9 aa, Homo Sapiens
LSDCIFIWF

SEQ ID NO: 283731 - protein, 9 aa, Homo Sapiens
YTTLFNNMT

SEQ ID NO: 283732 - protein, 9 aa, Homo Sapiens
PLRNIPLFE

SEQ ID NO: 283733 - protein, 9 aa, Homo Sapiens
IKHSPQSLL

SEQ ID NO: 283734 - protein, 9 aa, Homo Sapiens
TEAHVKAIK

SEQ ID NO: 283735 - protein, 9 aa, Homo Sapiens
HNKGNQGRI

SEQ ID NO: 283736 - protein, 9 aa, Homo Sapiens
AKLKSKLVI

SEQ ID NO: 283737 - protein, 9 aa, Homo Sapiens
STEKDLDKK

SEQ ID NO: 283738 - protein, 9 aa, Homo Sapiens
LKNRCGFSD

SEQ ID NO: 283739 - protein, 9 aa, Homo Sapiens
PSGASQSRV

SEQ ID NO: 283740 - protein, 9 aa, Homo Sapiens
QVTHQHAVD

SEQ ID NO: 283741 - protein, 9 aa, Homo Sapiens
QYLDCCGNI

SEQ ID NO: 283742 - protein, 9 aa, Homo Sapiens
SECGKSFGT

SEQ ID NO: 283743 - protein, 9 aa, Homo Sapiens
CKYKKNSGQ

SEQ ID NO: 283744 - protein, 9 aa, Homo Sapiens
LTPLTTSQG

SEQ ID NO: 283745 - protein, 9 aa, Homo Sapiens
QIMLQSGVD

SEQ ID NO: 283746 - protein, 9 aa, Homo Sapiens
INYSKIDYF

SEQ ID NO: 283747 - protein, 9 aa, Homo Sapiens
NVLRLVQSV

SEQ ID NO: 283748 - protein, 9 aa, Homo Sapiens
LQDIIGKAD

SEQ ID NO: 283749 - protein, 9 aa, Homo Sapiens
MSYSLCKFS

SEQ ID NO: 283750 - protein, 9 aa, Homo Sapiens
YPKYIFSLE

SEQ ID NO: 283751 - protein, 9 aa, Homo Sapiens
QLTKAKIIM

SEQ ID NO: 283752 - protein, 9 aa, Homo Sapiens
PLPFPCFSP

SEQ ID NO: 283753 - protein, 9 aa, Homo Sapiens
KYQLQVFMV

SEQ ID NO: 283754 - protein, 9 aa, Homo Sapiens
FILLGLSDR

SEQ ID NO: 283755 - protein, 9 aa, Homo Sapiens
GLISCELYL

SEQ ID NO: 283756 - protein, 9 aa, Homo Sapiens
FFGRHRFSG

SEQ ID NO: 283757 - protein, 9 aa, Homo Sapiens
WALIASWGQ

SEQ ID NO: 283758 - protein, 9 aa, Homo Sapiens
SVIFRSNYP

SEQ ID NO: 283759 - protein, 9 aa, Homo Sapiens
KSCEQNIEE

SEQ ID NO: 283760 - protein, 9 aa, Homo Sapiens
RAMDRTSLQ

SEQ ID NO: 283761 - protein, 9 aa, Homo Sapiens
EIIEVVLKV

SEQ ID NO: 283762 - protein, 9 aa, Homo Sapiens
YQANERVND

SEQ ID NO: 283763 - protein, 9 aa, Homo Sapiens
VGIVSWDSD

SEQ ID NO: 283764 - protein, 9 aa, Homo Sapiens
KLIFANIQD

SEQ ID NO: 283765 - protein, 9 aa, Homo Sapiens
VKTSEKLEE

SEQ ID NO: 283766 - protein, 9 aa, Homo Sapiens
YQASGPNNV

SEQ ID NO: 283767 - protein, 9 aa, Homo Sapiens
EKKMKLFPM

SEQ ID NO: 283768 - protein, 9 aa, Homo Sapiens
LLSNINNHT

SEQ ID NO: 283769 - protein, 9 aa, Homo Sapiens
LLKVLACTD

SEQ ID NO: 283770 - protein, 9 aa, Homo Sapiens
SSTSPHIPR

SEQ ID NO: 283771 - protein, 9 aa, Homo Sapiens
DENSQVPQS

SEQ ID NO: 283772 - protein, 9 aa, Homo Sapiens
TLQHAELFL

SEQ ID NO: 283773 - protein, 9 aa, Homo Sapiens
NILCVQSDY

SEQ ID NO: 283774 - protein, 9 aa, Homo Sapiens
AKLATRPIN

SEQ ID NO: 283775 - protein, 9 aa, Homo Sapiens
ETQAEKLEA

SEQ ID NO: 283776 - protein, 9 aa, Homo Sapiens
SGQLNTQEN

SEQ ID NO: 283777 - protein, 9 aa, Homo Sapiens
HPFVKDVVE

SEQ ID NO: 283778 - protein, 9 aa, Homo Sapiens
VDSCDELIP

SEQ ID NO: 283779 - protein, 9 aa, Homo Sapiens
ISVSSVCMN

SEQ ID NO: 283780 - protein, 9 aa, Homo Sapiens
ISKCGDLYV

SEQ ID NO: 283781 - protein, 9 aa, Homo Sapiens
LCQENDYSF

SEQ ID NO: 283782 - protein, 9 aa, Homo Sapiens
NLTPIQITH

SEQ ID NO: 283783 - protein, 9 aa, Homo Sapiens
QPLWEHLRS

SEQ ID NO: 283784 - protein, 9 aa, Homo Sapiens
EEEDKDSTL

SEQ ID NO: 283785 - protein, 9 aa, Homo Sapiens
LGMLNQTLL

SEQ ID NO: 283786 - protein, 9 aa, Homo Sapiens
DLVWSAPED

SEQ ID NO: 283787 - protein, 9 aa, Homo Sapiens
WQYYHNKIL

SEQ ID NO: 283788 - protein, 9 aa, Homo Sapiens
QTKAFKFKV

SEQ ID NO: 283789 - protein, 9 aa, Homo Sapiens
WVAWINRCQ

SEQ ID NO: 283790 - protein, 9 aa, Homo Sapiens
RHLHNNFLL

SEQ ID NO: 283791 - protein, 9 aa, Homo Sapiens
RLPRTLEAS

SEQ ID NO: 283792 - protein, 9 aa, Homo Sapiens
RSALKLYQY

SEQ ID NO: 283793 - protein, 9 aa, Homo Sapiens
VCTADNSVG

SEQ ID NO: 283794 - protein, 9 aa, Homo Sapiens
HSCTCGNSN

SEQ ID NO: 283795 - protein, 9 aa, Homo Sapiens
MFVLLLCNL

SEQ ID NO: 283796 - protein, 9 aa, Homo Sapiens
SGRLVTRAA

SEQ ID NO: 283797 - protein, 9 aa, Homo Sapiens
GADERILEL

SEQ ID NO: 283798 - protein, 9 aa, Homo Sapiens
LYGGVCHAG

SEQ ID NO: 283799 - protein, 9 aa, Homo Sapiens
VKYWKDQHV

SEQ ID NO: 283800 - protein, 9 aa, Homo Sapiens
PCGIKHINC

SEQ ID NO: 283801 - protein, 9 aa, Homo Sapiens
MTLFAGIFY

SEQ ID NO: 283802 - protein, 9 aa, Homo Sapiens
MKLDNLNKD

SEQ ID NO: 283803 - protein, 9 aa, Homo Sapiens
PLHYYSIMN

SEQ ID NO: 283804 - protein, 9 aa, Homo Sapiens
GYHLTQHQN

SEQ ID NO: 283805 - protein, 9 aa, Homo Sapiens
ILFLSQKAR

SEQ ID NO: 283806 - protein, 9 aa, Homo Sapiens
NRLTDYINK

SEQ ID NO: 283807 - protein, 9 aa, Homo Sapiens
QENYNAPDC

SEQ ID NO: 283808 - protein, 9 aa, Homo Sapiens
RTHHLEPYF

SEQ ID NO: 283809 - protein, 9 aa, Homo Sapiens
FPTPYTSSN

SEQ ID NO: 283810 - protein, 9 aa, Homo Sapiens
PPVILSMAI

SEQ ID NO: 283811 - protein, 9 aa, Homo Sapiens
AQRLWPQDE

SEQ ID NO: 283812 - protein, 9 aa, Homo Sapiens
VVEIKNCKH

SEQ ID NO: 283813 - protein, 9 aa, Homo Sapiens
WNILQTPIS

SEQ ID NO: 283814 - protein, 9 aa, Homo Sapiens
IEDTLCHFG

SEQ ID NO: 283815 - protein, 9 aa, Homo Sapiens
QVQVMPLQF

SEQ ID NO: 283816 - protein, 9 aa, Homo Sapiens
FFERNSFSI

SEQ ID NO: 283817 - protein, 9 aa, Homo Sapiens
RYARIYIYW

SEQ ID NO: 283818 - protein, 9 aa, Homo Sapiens
YLRQPSPVS

SEQ ID NO: 283819 - protein, 9 aa, Homo Sapiens
IQWFKKLFD

SEQ ID NO: 283820 - protein, 9 aa, Homo Sapiens
TLSHREPKK

SEQ ID NO: 283821 - protein, 9 aa, Homo Sapiens
VVVISVEVF

SEQ ID NO: 283822 - protein, 9 aa, Homo Sapiens
SSIPCLSPN

SEQ ID NO: 283823 - protein, 9 aa, Homo Sapiens
CFLRKENKI

SEQ ID NO: 283824 - protein, 9 aa, Homo Sapiens
DYLASQLHV

SEQ ID NO: 283825 - protein, 9 aa, Homo Sapiens
YLHLALVKS

SEQ ID NO: 283826 - protein, 9 aa, Homo Sapiens
TFIKEIPPK

SEQ ID NO: 283827 - protein, 9 aa, Homo Sapiens
EQTETHKSV

SEQ ID NO: 283828 - protein, 9 aa, Homo Sapiens
LHAIGVEAH

SEQ ID NO: 283829 - protein, 9 aa, Homo Sapiens
RGKPMELIV

SEQ ID NO: 283830 - protein, 9 aa, Homo Sapiens
LSALEQLEY

SEQ ID NO: 283831 - protein, 9 aa, Homo Sapiens
LHCQIIEPN

SEQ ID NO: 283832 - protein, 9 aa, Homo Sapiens
RLCFVELCC

SEQ ID NO: 283833 - protein, 9 aa, Homo Sapiens
IWGQNGRAE

SEQ ID NO: 283834 - protein, 9 aa, Homo Sapiens
KVNLSDRVF

SEQ ID NO: 283835 - protein, 9 aa, Homo Sapiens
QQNHTGEKP

SEQ ID NO: 283836 - protein, 9 aa, Homo Sapiens
DKDRAKVEF

SEQ ID NO: 283837 - protein, 9 aa, Homo Sapiens
VNSQFPTSL

SEQ ID NO: 283838 - protein, 9 aa, Homo Sapiens
KLQDFTRDH

SEQ ID NO: 283839 - protein, 9 aa, Homo Sapiens
TGISAPVVF

SEQ ID NO: 283840 - protein, 9 aa, Homo Sapiens
KERGIGDIN

SEQ ID NO: 283841 - protein, 9 aa, Homo Sapiens
TVILFKVLL

SEQ ID NO: 283842 - protein, 9 aa, Homo Sapiens
VYSFWFHVV

SEQ ID NO: 283843 - protein, 9 aa, Homo Sapiens
QTLPLMQRF

SEQ ID NO: 283844 - protein, 9 aa, Homo Sapiens
CEYRGKVFK

SEQ ID NO: 283845 - protein, 9 aa, Homo Sapiens
QIAGNQDGW

SEQ ID NO: 283846 - protein, 9 aa, Homo Sapiens
HPRSPNMLS

SEQ ID NO: 283847 - protein, 9 aa, Homo Sapiens
SAPVSLAAA

SEQ ID NO: 283848 - protein, 9 aa, Homo Sapiens
SKGSLKSTS

SEQ ID NO: 283849 - protein, 9 aa, Homo Sapiens
KKKNERLQT

SEQ ID NO: 283850 - protein, 9 aa, Homo Sapiens
NSDTQLKQH

SEQ ID NO: 283851 - protein, 9 aa, Homo Sapiens
SYIHRNSAM

SEQ ID NO: 283852 - protein, 9 aa, Homo Sapiens
ATAKFREQI

SEQ ID NO: 283853 - protein, 9 aa, Homo Sapiens
VLLTGVQKR

SEQ ID NO: 283854 - protein, 9 aa, Homo Sapiens
LIDNPRHIE

SEQ ID NO: 283855 - protein, 9 aa, Homo Sapiens
IIQYSKFMN

SEQ ID NO: 283856 - protein, 9 aa, Homo Sapiens
IIHFLENPF

SEQ ID NO: 283857 - protein, 9 aa, Homo Sapiens
YFYYMAGNK

SEQ ID NO: 283858 - protein, 9 aa, Homo Sapiens
CLPYDVINT

SEQ ID NO: 283859 - protein, 9 aa, Homo Sapiens
LGQMCFQIG

SEQ ID NO: 283860 - protein, 9 aa, Homo Sapiens
TNCPKGACI

SEQ ID NO: 283861 - protein, 9 aa, Homo Sapiens
TRGTTVQKS

SEQ ID NO: 283862 - protein, 9 aa, Homo Sapiens
RIAQVLSED

SEQ ID NO: 283863 - protein, 9 aa, Homo Sapiens
KPGHYQYTV

SEQ ID NO: 283864 - protein, 9 aa, Homo Sapiens
GAMVIHATW

SEQ ID NO: 283865 - protein, 9 aa, Homo Sapiens
RWGPLWRVL

SEQ ID NO: 283866 - protein, 9 aa, Homo Sapiens
GCLLFLMKA

SEQ ID NO: 283867 - protein, 9 aa, Homo Sapiens
KLEIFHPFV

SEQ ID NO: 283868 - protein, 9 aa, Homo Sapiens
DCGKGLSSD

SEQ ID NO: 283869 - protein, 9 aa, Homo Sapiens
KFGSKHKSS

SEQ ID NO: 283870 - protein, 9 aa, Homo Sapiens
SSLASSESM

SEQ ID NO: 283871 - protein, 9 aa, Homo Sapiens
QGQICYSTD

SEQ ID NO: 283872 - protein, 9 aa, Homo Sapiens
IHTEEKPFK

SEQ ID NO: 283873 - protein, 9 aa, Homo Sapiens
KERPVIPSS

SEQ ID NO: 283874 - protein, 9 aa, Homo Sapiens
GGEQFMLEE

SEQ ID NO: 283875 - protein, 9 aa, Homo Sapiens
VGELFLWQV

SEQ ID NO: 283876 - protein, 9 aa, Homo Sapiens
TLDYLDFAR

SEQ ID NO: 283877 - protein, 9 aa, Homo Sapiens
PAALSPTPK

SEQ ID NO: 283878 - protein, 9 aa, Homo Sapiens
SFAPHGPQN

SEQ ID NO: 283879 - protein, 9 aa, Homo Sapiens
NKPVVTEVR

SEQ ID NO: 283880 - protein, 9 aa, Homo Sapiens
VRYSKIRYR

SEQ ID NO: 283881 - protein, 9 aa, Homo Sapiens
EAQSQANQK

SEQ ID NO: 283882 - protein, 9 aa, Homo Sapiens
STGDDDYPD

SEQ ID NO: 283883 - protein, 9 aa, Homo Sapiens
IMRNQLSVK

SEQ ID NO: 283884 - protein, 9 aa, Homo Sapiens
DGGQDRKSN

SEQ ID NO: 283885 - protein, 9 aa, Homo Sapiens
AAVHDPDKK

SEQ ID NO: 283886 - protein, 9 aa, Homo Sapiens
GGDPTGAGR

SEQ ID NO: 283887 - protein, 9 aa, Homo Sapiens
NSDSGTCQI

SEQ ID NO: 283888 - protein, 9 aa, Homo Sapiens
MLALSLQVC

SEQ ID NO: 283889 - protein, 9 aa, Homo Sapiens
QKLKNVLPK

SEQ ID NO: 283890 - protein, 9 aa, Homo Sapiens
GRDSSSDTY

SEQ ID NO: 283891 - protein, 9 aa, Homo Sapiens
QIEINHFYC

SEQ ID NO: 283892 - protein, 9 aa, Homo Sapiens
HGQNLSFID

SEQ ID NO: 283893 - protein, 9 aa, Homo Sapiens
AGKQREDGH

SEQ ID NO: 283894 - protein, 9 aa, Homo Sapiens
SMRPRVHGS

SEQ ID NO: 283895 - protein, 9 aa, Homo Sapiens
SNSRTDESE

SEQ ID NO: 283896 - protein, 9 aa, Homo Sapiens
NYLILEGPA

SEQ ID NO: 283897 - protein, 9 aa, Homo Sapiens
KSQNYLTSL

SEQ ID NO: 283898 - protein, 9 aa, Homo Sapiens
EKHNNGGLI

SEQ ID NO: 283899 - protein, 9 aa, Homo Sapiens
LKNVLAKAL

SEQ ID NO: 283900 - protein, 9 aa, Homo Sapiens
TLTRFVRLP

SEQ ID NO: 283901 - protein, 9 aa, Homo Sapiens
PTDPKWFGD

SEQ ID NO: 283902 - protein, 9 aa, Homo Sapiens
EASLLENKP

SEQ ID NO: 283903 - protein, 9 aa, Homo Sapiens
QKGMGLIPE

SEQ ID NO: 283904 - protein, 9 aa, Homo Sapiens
PLGEITEKS

SEQ ID NO: 283905 - protein, 9 aa, Homo Sapiens
KSRDNEIIL

SEQ ID NO: 283906 - protein, 9 aa, Homo Sapiens
LPTSPGLPP

SEQ ID NO: 283907 - protein, 9 aa, Homo Sapiens
QEMSQAKKL

SEQ ID NO: 283908 - protein, 9 aa, Homo Sapiens
SAIVLWCYS

SEQ ID NO: 283909 - protein, 9 aa, Homo Sapiens
FAIPSEVKS

SEQ ID NO: 283910 - protein, 9 aa, Homo Sapiens
EKSRTRYPE

SEQ ID NO: 283911 - protein, 9 aa, Homo Sapiens
LFMLTPSSH

SEQ ID NO: 283912 - protein, 9 aa, Homo Sapiens
TVTFKGPEI

SEQ ID NO: 283913 - protein, 9 aa, Homo Sapiens
YRYFFQTLS

SEQ ID NO: 283914 - protein, 9 aa, Homo Sapiens
IRINIVSSK

SEQ ID NO: 283915 - protein, 9 aa, Homo Sapiens
INYYLQVSL

SEQ ID NO: 283916 - protein, 9 aa, Homo Sapiens
SVGNLYSGQ

SEQ ID NO: 283917 - protein, 9 aa, Homo Sapiens
NDFKALDSV

SEQ ID NO: 283918 - protein, 9 aa, Homo Sapiens
NEESNEAED

SEQ ID NO: 283919 - protein, 9 aa, Homo Sapiens
PCNQLGKQE

SEQ ID NO: 283920 - protein, 9 aa, Homo Sapiens
AVLDQHATS

SEQ ID NO: 283921 - protein, 9 aa, Homo Sapiens
TLAKSRKNE

SEQ ID NO: 283922 - protein, 9 aa, Homo Sapiens
ASWVLVRVM

SEQ ID NO: 283923 - protein, 9 aa, Homo Sapiens
LFNGCRSRE

SEQ ID NO: 283924 - protein, 9 aa, Homo Sapiens
NFTMLPTFI

SEQ ID NO: 283925 - protein, 9 aa, Homo Sapiens
KLLYIVAEF

SEQ ID NO: 283926 - protein, 9 aa, Homo Sapiens
KMLDKARAK

SEQ ID NO: 283927 - protein, 9 aa, Homo Sapiens
VSIKKKMSE

SEQ ID NO: 283928 - protein, 9 aa, Homo Sapiens
KAFNISSTL

SEQ ID NO: 283929 - protein, 9 aa, Homo Sapiens
SFDKLKLTS

SEQ ID NO: 283930 - protein, 9 aa, Homo Sapiens
YESELEPLP

SEQ ID NO: 283931 - protein, 9 aa, Homo Sapiens
QEVVGDYFG

SEQ ID NO: 283932 - protein, 9 aa, Homo Sapiens
QKKGHKIKH

SEQ ID NO: 283933 - protein, 9 aa, Homo Sapiens
QKENEQAKK

SEQ ID NO: 283934 - protein, 9 aa, Homo Sapiens
GHPLTRWAR

SEQ ID NO: 283935 - protein, 9 aa, Homo Sapiens
RIWVAIPLD

SEQ ID NO: 283936 - protein, 9 aa, Homo Sapiens
KGEFTHLQG

SEQ ID NO: 283937 - protein, 9 aa, Homo Sapiens
KYKKNSGQL

SEQ ID NO: 283938 - protein, 9 aa, Homo Sapiens
LESPFKYGW

SEQ ID NO: 283939 - protein, 9 aa, Homo Sapiens
QHLSQLLPQ

SEQ ID NO: 283940 - protein, 9 aa, Homo Sapiens
AHIGLVHSK

SEQ ID NO: 283941 - protein, 9 aa, Homo Sapiens
QLLARLTGI

SEQ ID NO: 283942 - protein, 9 aa, Homo Sapiens
NKNFVPVSV

SEQ ID NO: 283943 - protein, 9 aa, Homo Sapiens
YGFVSTLVF

SEQ ID NO: 283944 - protein, 9 aa, Homo Sapiens
TTQKHNTDT

SEQ ID NO: 283945 - protein, 9 aa, Homo Sapiens
INLDKCQTS

SEQ ID NO: 283946 - protein, 9 aa, Homo Sapiens
NKPFTSHRL

SEQ ID NO: 283947 - protein, 9 aa, Homo Sapiens
LGGNSFNCD

SEQ ID NO: 283948 - protein, 9 aa, Homo Sapiens
CQQIPGTSS

SEQ ID NO: 283949 - protein, 9 aa, Homo Sapiens
LATRPINAH

SEQ ID NO: 283950 - protein, 9 aa, Homo Sapiens
KRARPPRPR

SEQ ID NO: 283951 - protein, 9 aa, Homo Sapiens
ISVTPDSTR

SEQ ID NO: 283952 - protein, 9 aa, Homo Sapiens
GYDYLWCVS

SEQ ID NO: 283953 - protein, 9 aa, Homo Sapiens
QDGAEVMSP

SEQ ID NO: 283954 - protein, 9 aa, Homo Sapiens
YCSLRLLAG

SEQ ID NO: 283955 - protein, 9 aa, Homo Sapiens
LEEDDSSEN

SEQ ID NO: 283956 - protein, 9 aa, Homo Sapiens
FRDVNNHLN

SEQ ID NO: 283957 - protein, 9 aa, Homo Sapiens
AQNPVSNTS

SEQ ID NO: 283958 - protein, 9 aa, Homo Sapiens
WNRIFIHGW

SEQ ID NO: 283959 - protein, 9 aa, Homo Sapiens
FESSFLKCI

SEQ ID NO: 283960 - protein, 9 aa, Homo Sapiens
GGWRTSGKW

SEQ ID NO: 283961 - protein, 9 aa, Homo Sapiens
KKILWGVAV

SEQ ID NO: 283962 - protein, 9 aa, Homo Sapiens
LVSLTSLYG

SEQ ID NO: 283963 - protein, 9 aa, Homo Sapiens
KIVQDPMLL

SEQ ID NO: 283964 - protein, 9 aa, Homo Sapiens
RICAIISVS

SEQ ID NO: 283965 - protein, 9 aa, Homo Sapiens
SKWKRELQQ

SEQ ID NO: 283966 - protein, 9 aa, Homo Sapiens
LNTNLFDNL

SEQ ID NO: 283967 - protein, 9 aa, Homo Sapiens
GSSLPLVER

SEQ ID NO: 283968 - protein, 9 aa, Homo Sapiens
YNINYQIKE

SEQ ID NO: 283969 - protein, 9 aa, Homo Sapiens
QGITTNSEQ

SEQ ID NO: 283970 - protein, 9 aa, Homo Sapiens
MAGEPRPYR

SEQ ID NO: 283971 - protein, 9 aa, Homo Sapiens
VQRIEKQFI

SEQ ID NO: 283972 - protein, 9 aa, Homo Sapiens
TQSLLTSTS

SEQ ID NO: 283973 - protein, 9 aa, Homo Sapiens
TLQYYLSYT

SEQ ID NO: 283974 - protein, 9 aa, Homo Sapiens
KHLNLATDK

SEQ ID NO: 283975 - protein, 9 aa, Homo Sapiens
VAYQGFQAG

SEQ ID NO: 283976 - protein, 9 aa, Homo Sapiens
RDTHVYTEY

SEQ ID NO: 283977 - protein, 9 aa, Homo Sapiens
WCYEVQAKS

SEQ ID NO: 283978 - protein, 9 aa, Homo Sapiens
EPRVTLDWS

SEQ ID NO: 283979 - protein, 9 aa, Homo Sapiens
DAAAGLRDD

SEQ ID NO: 283980 - protein, 9 aa, Homo Sapiens
ADEGALNEI

SEQ ID NO: 283981 - protein, 9 aa, Homo Sapiens
FGVEYFMRI

SEQ ID NO: 283982 - protein, 9 aa, Homo Sapiens
IHLKKGTEG

SEQ ID NO: 283983 - protein, 9 aa, Homo Sapiens
VVCNQEEKI

SEQ ID NO: 283984 - protein, 9 aa, Homo Sapiens
QTVTFKGPE

SEQ ID NO: 283985 - protein, 9 aa, Homo Sapiens
VRVSAATAS

SEQ ID NO: 283986 - protein, 9 aa, Homo Sapiens
IPIGHWIEA

SEQ ID NO: 283987 - protein, 9 aa, Homo Sapiens
EVFKAFCLG

SEQ ID NO: 283988 - protein, 9 aa, Homo Sapiens
MLLVNGAQL

SEQ ID NO: 283989 - protein, 9 aa, Homo Sapiens
CTSQIKEVQ

SEQ ID NO: 283990 - protein, 9 aa, Homo Sapiens
EQNLLSVAY

SEQ ID NO: 283991 - protein, 9 aa, Homo Sapiens
NVKHSGVDN

SEQ ID NO: 283992 - protein, 9 aa, Homo Sapiens
QKITNCEQN

SEQ ID NO: 283993 - protein, 9 aa, Homo Sapiens
IFHQCKDNE

SEQ ID NO: 283994 - protein, 9 aa, Homo Sapiens
LIAQDKMAT

SEQ ID NO: 283995 - protein, 9 aa, Homo Sapiens
LLQSFQKEL

SEQ ID NO: 283996 - protein, 9 aa, Homo Sapiens
KETNEGVLY

SEQ ID NO: 283997 - protein, 9 aa, Homo Sapiens
FIELFPTSL

SEQ ID NO: 283998 - protein, 9 aa, Homo Sapiens
LHVPGLNNT

SEQ ID NO: 283999 - protein, 9 aa, Homo Sapiens
YFTTSKFSY

SEQ ID NO: 284000 - protein, 9 aa, Homo Sapiens
LFVADGLQA

SEQ ID NO: 284001 - protein, 9 aa, Homo Sapiens
AICCPIHYT

SEQ ID NO: 284002 - protein, 9 aa, Homo Sapiens
DIPGEFTQD

SEQ ID NO: 284003 - protein, 9 aa, Homo Sapiens
QIEKELSGM

SEQ ID NO: 284004 - protein, 9 aa, Homo Sapiens
CYEVQAKSS

SEQ ID NO: 284005 - protein, 9 aa, Homo Sapiens
DDTLSRRLD

SEQ ID NO: 284006 - protein, 9 aa, Homo Sapiens
PSLEVEDLF

SEQ ID NO: 284007 - protein, 9 aa, Homo Sapiens
QPSMKQVGT

SEQ ID NO: 284008 - protein, 9 aa, Homo Sapiens
RKHFKKPFK

SEQ ID NO: 284009 - protein, 9 aa, Homo Sapiens
IKLKIQSLM

SEQ ID NO: 284010 - protein, 9 aa, Homo Sapiens
NETYQYYGL

SEQ ID NO: 284011 - protein, 9 aa, Homo Sapiens
ETFKNFFVE

SEQ ID NO: 284012 - protein, 9 aa, Homo Sapiens
IRLFIGGKI

SEQ ID NO: 284013 - protein, 9 aa, Homo Sapiens
GFFKFEASG

SEQ ID NO: 284014 - protein, 9 aa, Homo Sapiens
LCQVIQIEL

SEQ ID NO: 284015 - protein, 9 aa, Homo Sapiens
RAVWENNMK

SEQ ID NO: 284016 - protein, 9 aa, Homo Sapiens
FLLTGQCNF

SEQ ID NO: 284017 - protein, 9 aa, Homo Sapiens
CSYTQTCTK

SEQ ID NO: 284018 - protein, 9 aa, Homo Sapiens
RRIGFNVVT

SEQ ID NO: 284019 - protein, 9 aa, Homo Sapiens
YESGVKYHI

SEQ ID NO: 284020 - protein, 9 aa, Homo Sapiens
RNTVALNAD

SEQ ID NO: 284021 - protein, 9 aa, Homo Sapiens
MDILGFSVG

SEQ ID NO: 284022 - protein, 9 aa, Homo Sapiens
VEDKVLCRV

SEQ ID NO: 284023 - protein, 9 aa, Homo Sapiens
QRMKHSSHK

SEQ ID NO: 284024 - protein, 9 aa, Homo Sapiens
RVAVRPKPL

SEQ ID NO: 284025 - protein, 9 aa, Homo Sapiens
MFPASYSSP

SEQ ID NO: 284026 - protein, 9 aa, Homo Sapiens
DICPEKGSG

SEQ ID NO: 284027 - protein, 9 aa, Homo Sapiens
IYCAVHFTR

SEQ ID NO: 284028 - protein, 9 aa, Homo Sapiens
DLTTVYVDL

SEQ ID NO: 284029 - protein, 9 aa, Homo Sapiens
FAINQEQTE

SEQ ID NO: 284030 - protein, 9 aa, Homo Sapiens
DKKLKSIAC

SEQ ID NO: 284031 - protein, 9 aa, Homo Sapiens
TLTRVKVQY

SEQ ID NO: 284032 - protein, 9 aa, Homo Sapiens
VHSGEKNNS

SEQ ID NO: 284033 - protein, 9 aa, Homo Sapiens
VRECTQFLT

SEQ ID NO: 284034 - protein, 9 aa, Homo Sapiens
YISKGSLKS

SEQ ID NO: 284035 - protein, 9 aa, Homo Sapiens
NIHQIRSPP

SEQ ID NO: 284036 - protein, 9 aa, Homo Sapiens
RPHKVRCNC

SEQ ID NO: 284037 - protein, 9 aa, Homo Sapiens
SCVLSSDLR

SEQ ID NO: 284038 - protein, 9 aa, Homo Sapiens
PPEAFHLIV

SEQ ID NO: 284039 - protein, 9 aa, Homo Sapiens
FNNFIDGYV

SEQ ID NO: 284040 - protein, 9 aa, Homo Sapiens
SSDSDPHES

SEQ ID NO: 284041 - protein, 9 aa, Homo Sapiens
EPASSVSKE

SEQ ID NO: 284042 - protein, 9 aa, Homo Sapiens
FPVPSPPGS

SEQ ID NO: 284043 - protein, 9 aa, Homo Sapiens
YKVLFKMFI

SEQ ID NO: 284044 - protein, 9 aa, Homo Sapiens
NPPQRSFNN

SEQ ID NO: 284045 - protein, 9 aa, Homo Sapiens
NRVVHNAGP

SEQ ID NO: 284046 - protein, 9 aa, Homo Sapiens
SIITKTPIM

SEQ ID NO: 284047 - protein, 9 aa, Homo Sapiens
TISQAAFPL

SEQ ID NO: 284048 - protein, 9 aa, Homo Sapiens
LKRASVIWI

SEQ ID NO: 284049 - protein, 9 aa, Homo Sapiens
RKVKEMFDA

SEQ ID NO: 284050 - protein, 9 aa, Homo Sapiens
NLDKSLGEK

SEQ ID NO: 284051 - protein, 9 aa, Homo Sapiens
LYFNFVEKV

SEQ ID NO: 284052 - protein, 9 aa, Homo Sapiens
LLFCQSQSS

SEQ ID NO: 284053 - protein, 9 aa, Homo Sapiens
HRQVPLEGQ

SEQ ID NO: 284054 - protein, 9 aa, Homo Sapiens
HAIFNETKN

SEQ ID NO: 284055 - protein, 9 aa, Homo Sapiens
SSTNNVNNS

SEQ ID NO: 284056 - protein, 9 aa, Homo Sapiens
AEKTDGFVN

SEQ ID NO: 284057 - protein, 9 aa, Homo Sapiens
TDNDMQNIL

SEQ ID NO: 284058 - protein, 9 aa, Homo Sapiens
SVDSLDFNT

SEQ ID NO: 284059 - protein, 9 aa, Homo Sapiens
YCDFMLFMG

SEQ ID NO: 284060 - protein, 9 aa, Homo Sapiens
MKATVEDET

SEQ ID NO: 284061 - protein, 9 aa, Homo Sapiens
KPPVTFAKK

SEQ ID NO: 284062 - protein, 9 aa, Homo Sapiens
RNEEQRMRS

SEQ ID NO: 284063 - protein, 9 aa, Homo Sapiens
PHSHNDKTK

SEQ ID NO: 284064 - protein, 9 aa, Homo Sapiens
DEIDAALGF

SEQ ID NO: 284065 - protein, 9 aa, Homo Sapiens
NGIDSQYYC

SEQ ID NO: 284066 - protein, 9 aa, Homo Sapiens
LSHVNLPAT

SEQ ID NO: 284067 - protein, 9 aa, Homo Sapiens
YTYFKAGNC

SEQ ID NO: 284068 - protein, 9 aa, Homo Sapiens
KNGANCWYD

SEQ ID NO: 284069 - protein, 9 aa, Homo Sapiens
PSASRAAWK

SEQ ID NO: 284070 - protein, 9 aa, Homo Sapiens
GARFIHFLH

SEQ ID NO: 284071 - protein, 9 aa, Homo Sapiens
TGAESPGIF

SEQ ID NO: 284072 - protein, 9 aa, Homo Sapiens
HSLEYSLQI

SEQ ID NO: 284073 - protein, 9 aa, Homo Sapiens
CSHVHSNGY

SEQ ID NO: 284074 - protein, 9 aa, Homo Sapiens
DQEYFSLNN

SEQ ID NO: 284075 - protein, 9 aa, Homo Sapiens
LCQADVKIG

SEQ ID NO: 284076 - protein, 9 aa, Homo Sapiens
PASSSEFYK

SEQ ID NO: 284077 - protein, 9 aa, Homo Sapiens
PYECSECGT

SEQ ID NO: 284078 - protein, 9 aa, Homo Sapiens
YTGHKNEQY

SEQ ID NO: 284079 - protein, 9 aa, Homo Sapiens
LPINSKTRP

SEQ ID NO: 284080 - protein, 9 aa, Homo Sapiens
IQWEKNITL

SEQ ID NO: 284081 - protein, 9 aa, Homo Sapiens
KEDFHLSHV

SEQ ID NO: 284082 - protein, 9 aa, Homo Sapiens
SPPTKQEMK

SEQ ID NO: 284083 - protein, 9 aa, Homo Sapiens
HRELIEISE

SEQ ID NO: 284084 - protein, 9 aa, Homo Sapiens
PSAEHSQGL

SEQ ID NO: 284085 - protein, 9 aa, Homo Sapiens
DVQKLFLYF

SEQ ID NO: 284086 - protein, 9 aa, Homo Sapiens
DAANIHQEF

SEQ ID NO: 284087 - protein, 9 aa, Homo Sapiens
RYAQYKKFK

SEQ ID NO: 284088 - protein, 9 aa, Homo Sapiens
DDELTIQVG

SEQ ID NO: 284089 - protein, 9 aa, Homo Sapiens
EPFKALLEG

SEQ ID NO: 284090 - protein, 9 aa, Homo Sapiens
LVHCKYYAH

SEQ ID NO: 284091 - protein, 9 aa, Homo Sapiens
LIYIVSSQK

SEQ ID NO: 284092 - protein, 9 aa, Homo Sapiens
TRCNNVGVC

SEQ ID NO: 284093 - protein, 9 aa, Homo Sapiens
IGSEKRLNI

SEQ ID NO: 284094 - protein, 9 aa, Homo Sapiens
CLIQWFDTA

SEQ ID NO: 284095 - protein, 9 aa, Homo Sapiens
SVKKLYDVM

SEQ ID NO: 284096 - protein, 9 aa, Homo Sapiens
VGPKNPNVG

SEQ ID NO: 284097 - protein, 9 aa, Homo Sapiens
YPVEHPDKV

SEQ ID NO: 284098 - protein, 9 aa, Homo Sapiens
NKAESGECQ

SEQ ID NO: 284099 - protein, 9 aa, Homo Sapiens
LTGLFGGYI

SEQ ID NO: 284100 - protein, 9 aa, Homo Sapiens
NSYTVQADL

SEQ ID NO: 284101 - protein, 9 aa, Homo Sapiens
DTVGMAPSS

SEQ ID NO: 284102 - protein, 9 aa, Homo Sapiens
KKIVFRLKK

SEQ ID NO: 284103 - protein, 9 aa, Homo Sapiens
LFAHNEYLV

SEQ ID NO: 284104 - protein, 9 aa, Homo Sapiens
IYIQLPGID

SEQ ID NO: 284105 - protein, 9 aa, Homo Sapiens
EHWMLEAQF

SEQ ID NO: 284106 - protein, 9 aa, Homo Sapiens
WLDDCAQVE

SEQ ID NO: 284107 - protein, 9 aa, Homo Sapiens
GGVQVTTIP

SEQ ID NO: 284108 - protein, 9 aa, Homo Sapiens
ITPEGILRY

SEQ ID NO: 284109 - protein, 9 aa, Homo Sapiens
GRKYALLGN

SEQ ID NO: 284110 - protein, 9 aa, Homo Sapiens
GMLFPPVEA

SEQ ID NO: 284111 - protein, 9 aa, Homo Sapiens
ANLRFLNKL

SEQ ID NO: 284112 - protein, 9 aa, Homo Sapiens
ERNKIRSEL

SEQ ID NO: 284113 - protein, 9 aa, Homo Sapiens
VSRYDGALL

SEQ ID NO: 284114 - protein, 9 aa, Homo Sapiens
EDHIEPKKL

SEQ ID NO: 284115 - protein, 9 aa, Homo Sapiens
PDGSCRWDP

SEQ ID NO: 284116 - protein, 9 aa, Homo Sapiens
NYQKAVKLL

SEQ ID NO: 284117 - protein, 9 aa, Homo Sapiens
KGICKSFTN

SEQ ID NO: 284118 - protein, 9 aa, Homo Sapiens
KPLALSTTF

SEQ ID NO: 284119 - protein, 9 aa, Homo Sapiens
IYEGDESVR

SEQ ID NO: 284120 - protein, 9 aa, Homo Sapiens
PEPPKPTPL

SEQ ID NO: 284121 - protein, 9 aa, Homo Sapiens
LPESSATDY

SEQ ID NO: 284122 - protein, 9 aa, Homo Sapiens
ENQCKESSS

SEQ ID NO: 284123 - protein, 9 aa, Homo Sapiens
LILVATSVQ

SEQ ID NO: 284124 - protein, 9 aa, Homo Sapiens
NSVATKTVE

SEQ ID NO: 284125 - protein, 9 aa, Homo Sapiens
VEKETETMN

SEQ ID NO: 284126 - protein, 9 aa, Homo Sapiens
KRCCIPNTS

SEQ ID NO: 284127 - protein, 9 aa, Homo Sapiens
CAFYDKCGK

SEQ ID NO: 284128 - protein, 9 aa, Homo Sapiens
SLNDFVTQQ

SEQ ID NO: 284129 - protein, 9 aa, Homo Sapiens
TLDREEIKE

SEQ ID NO: 284130 - protein, 9 aa, Homo Sapiens
DNIKNPMHN

SEQ ID NO: 284131 - protein, 9 aa, Homo Sapiens
YKDKYTKKK

SEQ ID NO: 284132 - protein, 9 aa, Homo Sapiens
PRLIKNLGV

SEQ ID NO: 284133 - protein, 9 aa, Homo Sapiens
LYDVMILTV

SEQ ID NO: 284134 - protein, 9 aa, Homo Sapiens
LHPDVISYL

SEQ ID NO: 284135 - protein, 9 aa, Homo Sapiens
GVPILVRLG

SEQ ID NO: 284136 - protein, 9 aa, Homo Sapiens
FGLVTSPLF

SEQ ID NO: 284137 - protein, 9 aa, Homo Sapiens
PATQKNLPI

SEQ ID NO: 284138 - protein, 9 aa, Homo Sapiens
IALTSSKLL

SEQ ID NO: 284139 - protein, 9 aa, Homo Sapiens
LIVHQRTNS

SEQ ID NO: 284140 - protein, 9 aa, Homo Sapiens
QELNSLLRY

SEQ ID NO: 284141 - protein, 9 aa, Homo Sapiens
ERNVLTAFS

SEQ ID NO: 284142 - protein, 9 aa, Homo Sapiens
MVIFQAALK

SEQ ID NO: 284143 - protein, 9 aa, Homo Sapiens
SFNKHSGTR

SEQ ID NO: 284144 - protein, 9 aa, Homo Sapiens
VPAINRLAE

SEQ ID NO: 284145 - protein, 9 aa, Homo Sapiens
NPIYEIMCM

SEQ ID NO: 284146 - protein, 9 aa, Homo Sapiens
TNRPPTLAI

SEQ ID NO: 284147 - protein, 9 aa, Homo Sapiens
IGVQHFESE

SEQ ID NO: 284148 - protein, 9 aa, Homo Sapiens
KLSPGGGSE

SEQ ID NO: 284149 - protein, 9 aa, Homo Sapiens
LSLEVLIEY

SEQ ID NO: 284150 - protein, 9 aa, Homo Sapiens
LTRHAAVHD

SEQ ID NO: 284151 - protein, 9 aa, Homo Sapiens
GIILAVAKK

SEQ ID NO: 284152 - protein, 9 aa, Homo Sapiens
YGALRTLRF

SEQ ID NO: 284153 - protein, 9 aa, Homo Sapiens
MASTLYDYC

SEQ ID NO: 284154 - protein, 9 aa, Homo Sapiens
CFRQLFVCD

SEQ ID NO: 284155 - protein, 9 aa, Homo Sapiens
ADGRFKGSL

SEQ ID NO: 284156 - protein, 9 aa, Homo Sapiens
ENTDCLAPG

SEQ ID NO: 284157 - protein, 9 aa, Homo Sapiens
LHEQPELQK

SEQ ID NO: 284158 - protein, 9 aa, Homo Sapiens
INGILERGA

SEQ ID NO: 284159 - protein, 9 aa, Homo Sapiens
EYEKGKQNL

SEQ ID NO: 284160 - protein, 9 aa, Homo Sapiens
APVTTNNPA

SEQ ID NO: 284161 - protein, 9 aa, Homo Sapiens
AVVFTDEEL

SEQ ID NO: 284162 - protein, 9 aa, Homo Sapiens
QDVIKVPDF

SEQ ID NO: 284163 - protein, 9 aa, Homo Sapiens
LLLVTKDIL

SEQ ID NO: 284164 - protein, 9 aa, Homo Sapiens
LRLCRFFAN

SEQ ID NO: 284165 - protein, 9 aa, Homo Sapiens
MKEFLRKQG

SEQ ID NO: 284166 - protein, 9 aa, Homo Sapiens
TDSGFCLYS

SEQ ID NO: 284167 - protein, 9 aa, Homo Sapiens
DTAFALGFV

SEQ ID NO: 284168 - protein, 9 aa, Homo Sapiens
LYPEKTQMI

SEQ ID NO: 284169 - protein, 9 aa, Homo Sapiens
TGQHDQRHD

SEQ ID NO: 284170 - protein, 9 aa, Homo Sapiens
TPLFQPNEN

SEQ ID NO: 284171 - protein, 9 aa, Homo Sapiens
PLEPDFVPN

SEQ ID NO: 284172 - protein, 9 aa, Homo Sapiens
STNVDMILK

SEQ ID NO: 284173 - protein, 9 aa, Homo Sapiens
LLRIAHGTE

SEQ ID NO: 284174 - protein, 9 aa, Homo Sapiens
EYIQAGPNC

SEQ ID NO: 284175 - protein, 9 aa, Homo Sapiens
YLQRLDFYQ

SEQ ID NO: 284176 - protein, 9 aa, Homo Sapiens
NNSSVSTLS

SEQ ID NO: 284177 - protein, 9 aa, Homo Sapiens
KDKLSSIPL

SEQ ID NO: 284178 - protein, 9 aa, Homo Sapiens
LDTTVAGCA

SEQ ID NO: 284179 - protein, 9 aa, Homo Sapiens
VHRDLAACN

SEQ ID NO: 284180 - protein, 9 aa, Homo Sapiens
KIGDAKSSS

SEQ ID NO: 284181 - protein, 9 aa, Homo Sapiens
HIPRIGPRF

SEQ ID NO: 284182 - protein, 9 aa, Homo Sapiens
DNSFGCPSV

SEQ ID NO: 284183 - protein, 9 aa, Homo Sapiens
PPNKFISRL

SEQ ID NO: 284184 - protein, 9 aa, Homo Sapiens
SEHIVLREG

SEQ ID NO: 284185 - protein, 9 aa, Homo Sapiens
DDQIIVSYL

SEQ ID NO: 284186 - protein, 9 aa, Homo Sapiens
LPSLREKAK

SEQ ID NO: 284187 - protein, 9 aa, Homo Sapiens
NKGVHSSTN

SEQ ID NO: 284188 - protein, 9 aa, Homo Sapiens
KEDAKPKKK

SEQ ID NO: 284189 - protein, 9 aa, Homo Sapiens
TMKYIKGVL

SEQ ID NO: 284190 - protein, 9 aa, Homo Sapiens
ATQELIPSE

SEQ ID NO: 284191 - protein, 9 aa, Homo Sapiens
LCQGINSCL

SEQ ID NO: 284192 - protein, 9 aa, Homo Sapiens
SSTKNYPST

SEQ ID NO: 284193 - protein, 9 aa, Homo Sapiens
FEKDKHSIL

SEQ ID NO: 284194 - protein, 9 aa, Homo Sapiens
ESNFDRVNV

SEQ ID NO: 284195 - protein, 9 aa, Homo Sapiens
VCEDLKLPE

SEQ ID NO: 284196 - protein, 9 aa, Homo Sapiens
PELQDSLYA

SEQ ID NO: 284197 - protein, 9 aa, Homo Sapiens
NDLEKQYNK

SEQ ID NO: 284198 - protein, 9 aa, Homo Sapiens
SLNNSANPI

SEQ ID NO: 284199 - protein, 9 aa, Homo Sapiens
HKAVTRPEL

SEQ ID NO: 284200 - protein, 9 aa, Homo Sapiens
LIANAIQRS

SEQ ID NO: 284201 - protein, 9 aa, Homo Sapiens
VKKAPKKIR

SEQ ID NO: 284202 - protein, 9 aa, Homo Sapiens
EKGIPFNRI

SEQ ID NO: 284203 - protein, 9 aa, Homo Sapiens
LRHRDNNKP

SEQ ID NO: 284204 - protein, 9 aa, Homo Sapiens
KDQQKINKF

SEQ ID NO: 284205 - protein, 9 aa, Homo Sapiens
TKDDGFSSY

SEQ ID NO: 284206 - protein, 9 aa, Homo Sapiens
VTFIENRAK

SEQ ID NO: 284207 - protein, 9 aa, Homo Sapiens
KLWACLTIN

SEQ ID NO: 284208 - protein, 9 aa, Homo Sapiens
NFTVITFAY

SEQ ID NO: 284209 - protein, 9 aa, Homo Sapiens
EQNTPRRLR

SEQ ID NO: 284210 - protein, 9 aa, Homo Sapiens
GMFTDPAHT

SEQ ID NO: 284211 - protein, 9 aa, Homo Sapiens
TMVVQHTPE

SEQ ID NO: 284212 - protein, 9 aa, Homo Sapiens
SLLKPLAVP

SEQ ID NO: 284213 - protein, 9 aa, Homo Sapiens
RKGIPVRQT

SEQ ID NO: 284214 - protein, 9 aa, Homo Sapiens
AAPFSKALT

SEQ ID NO: 284215 - protein, 9 aa, Homo Sapiens
QKEESPSAL

SEQ ID NO: 284216 - protein, 9 aa, Homo Sapiens
SQDTWNMHT

SEQ ID NO: 284217 - protein, 9 aa, Homo Sapiens
DFLTVMKSD

SEQ ID NO: 284218 - protein, 9 aa, Homo Sapiens
VQIHSILAN

SEQ ID NO: 284219 - protein, 9 aa, Homo Sapiens
TDLTDPDIH

SEQ ID NO: 284220 - protein, 9 aa, Homo Sapiens
CNLCILGES

SEQ ID NO: 284221 - protein, 9 aa, Homo Sapiens
KHQIKIRDR

SEQ ID NO: 284222 - protein, 9 aa, Homo Sapiens
HHLTVVTQT

SEQ ID NO: 284223 - protein, 9 aa, Homo Sapiens
SKDKGISDE

SEQ ID NO: 284224 - protein, 9 aa, Homo Sapiens
RKKEQPTSS

SEQ ID NO: 284225 - protein, 9 aa, Homo Sapiens
ENILCVQSD

SEQ ID NO: 284226 - protein, 9 aa, Homo Sapiens
MVISCFGCM

SEQ ID NO: 284227 - protein, 9 aa, Homo Sapiens
IQSHFYRSP

SEQ ID NO: 284228 - protein, 9 aa, Homo Sapiens
LFLWQVEAD

SEQ ID NO: 284229 - protein, 9 aa, Homo Sapiens
EHNKEPASS

SEQ ID NO: 284230 - protein, 9 aa, Homo Sapiens
LRSSKKRTE

SEQ ID NO: 284231 - protein, 9 aa, Homo Sapiens
GELPLCSRC

SEQ ID NO: 284232 - protein, 9 aa, Homo Sapiens
SHYELSRVR

SEQ ID NO: 284233 - protein, 9 aa, Homo Sapiens
CEVCPTLPA

SEQ ID NO: 284234 - protein, 9 aa, Homo Sapiens
EWSLKIRKG

SEQ ID NO: 284235 - protein, 9 aa, Homo Sapiens
LKPALRKGH

SEQ ID NO: 284236 - protein, 9 aa, Homo Sapiens
INSKTRPES

SEQ ID NO: 284237 - protein, 9 aa, Homo Sapiens
TTSQASKQP

SEQ ID NO: 284238 - protein, 9 aa, Homo Sapiens
GAFLAAQVQ

SEQ ID NO: 284239 - protein, 9 aa, Homo Sapiens
TMESLNGGR

SEQ ID NO: 284240 - protein, 9 aa, Homo Sapiens
FPDTQTIHI

SEQ ID NO: 284241 - protein, 9 aa, Homo Sapiens
EAIAAGYRH

SEQ ID NO: 284242 - protein, 9 aa, Homo Sapiens
NEIASEPLN

SEQ ID NO: 284243 - protein, 9 aa, Homo Sapiens
RFRDLHHYM

SEQ ID NO: 284244 - protein, 9 aa, Homo Sapiens
ALESAQFLL

SEQ ID NO: 284245 - protein, 9 aa, Homo Sapiens
ERVHTGDKP

SEQ ID NO: 284246 - protein, 9 aa, Homo Sapiens
EDRLLSGSV

SEQ ID NO: 284247 - protein, 9 aa, Homo Sapiens
YIDLEPDNA

SEQ ID NO: 284248 - protein, 9 aa, Homo Sapiens
HCGTFSSFV

SEQ ID NO: 284249 - protein, 9 aa, Homo Sapiens
GLYNPYGPQ

SEQ ID NO: 284250 - protein, 9 aa, Homo Sapiens
IPLPTLKWK

SEQ ID NO: 284251 - protein, 9 aa, Homo Sapiens
MLSSAFGLD

SEQ ID NO: 284252 - protein, 9 aa, Homo Sapiens
SPDPQMDYL

SEQ ID NO: 284253 - protein, 9 aa, Homo Sapiens
GEWPPAHLS

SEQ ID NO: 284254 - protein, 9 aa, Homo Sapiens
KEATEMLQN

SEQ ID NO: 284255 - protein, 9 aa, Homo Sapiens
QDPKTEQDG

SEQ ID NO: 284256 - protein, 9 aa, Homo Sapiens
IQMTHGKNS

SEQ ID NO: 284257 - protein, 9 aa, Homo Sapiens
GPSGPCVLS

SEQ ID NO: 284258 - protein, 9 aa, Homo Sapiens
LVKMHSKHF

SEQ ID NO: 284259 - protein, 9 aa, Homo Sapiens
VRREIKRSH

SEQ ID NO: 284260 - protein, 9 aa, Homo Sapiens
QKETDLSKN

SEQ ID NO: 284261 - protein, 9 aa, Homo Sapiens
QQVTLNIPI

SEQ ID NO: 284262 - protein, 9 aa, Homo Sapiens
NRIYKVISR

SEQ ID NO: 284263 - protein, 9 aa, Homo Sapiens
HNLKCDCST

SEQ ID NO: 284264 - protein, 9 aa, Homo Sapiens
YLANTQPRG

SEQ ID NO: 284265 - protein, 9 aa, Homo Sapiens
TEAQNTMLE

SEQ ID NO: 284266 - protein, 9 aa, Homo Sapiens
ERICQRTHF

SEQ ID NO: 284267 - protein, 9 aa, Homo Sapiens
ENPEQIIAT

SEQ ID NO: 284268 - protein, 9 aa, Homo Sapiens
GRLCGFLKS

SEQ ID NO: 284269 - protein, 9 aa, Homo Sapiens
GWIGGAPSV

SEQ ID NO: 284270 - protein, 9 aa, Homo Sapiens
RAGRKEAGR

SEQ ID NO: 284271 - protein, 9 aa, Homo Sapiens
FAGVLLSLR

SEQ ID NO: 284272 - protein, 9 aa, Homo Sapiens
GLIQPLGDI

SEQ ID NO: 284273 - protein, 9 aa, Homo Sapiens
CPSIKGTPL

SEQ ID NO: 284274 - protein, 9 aa, Homo Sapiens
PTPDLEKVV

SEQ ID NO: 284275 - protein, 9 aa, Homo Sapiens
VLYGGIVFG

SEQ ID NO: 284276 - protein, 9 aa, Homo Sapiens
QANFTMLPT

SEQ ID NO: 284277 - protein, 9 aa, Homo Sapiens
HTQCIADKP

SEQ ID NO: 284278 - protein, 9 aa, Homo Sapiens
CAPDGSCRW

SEQ ID NO: 284279 - protein, 9 aa, Homo Sapiens
DKHSILITA

SEQ ID NO: 284280 - protein, 9 aa, Homo Sapiens
DKASETEEN

SEQ ID NO: 284281 - protein, 9 aa, Homo Sapiens
KCNECGQSF

SEQ ID NO: 284282 - protein, 9 aa, Homo Sapiens
TENSSSVTV

SEQ ID NO: 284283 - protein, 9 aa, Homo Sapiens
VGHKKIHTG

SEQ ID NO: 284284 - protein, 9 aa, Homo Sapiens
EMGQNGQKT

SEQ ID NO: 284285 - protein, 9 aa, Homo Sapiens
EKANVSVPA

SEQ ID NO: 284286 - protein, 9 aa, Homo Sapiens
VITAQVHPG

SEQ ID NO: 284287 - protein, 9 aa, Homo Sapiens
SKCSKFLRR

SEQ ID NO: 284288 - protein, 9 aa, Homo Sapiens
SIITLMLNH

SEQ ID NO: 284289 - protein, 9 aa, Homo Sapiens
ILNRGPENS

SEQ ID NO: 284290 - protein, 9 aa, Homo Sapiens
KTQIQKLDD

SEQ ID NO: 284291 - protein, 9 aa, Homo Sapiens
PVSQETEPE

SEQ ID NO: 284292 - protein, 9 aa, Homo Sapiens
IIHIRENSY

SEQ ID NO: 284293 - protein, 9 aa, Homo Sapiens
RRTIGVQHF

SEQ ID NO: 284294 - protein, 9 aa, Homo Sapiens
QCSRSRSQL

SEQ ID NO: 284295 - protein, 9 aa, Homo Sapiens
YFSTDMSSG

SEQ ID NO: 284296 - protein, 9 aa, Homo Sapiens
NKIVQDPML

SEQ ID NO: 284297 - protein, 9 aa, Homo Sapiens
CSFPSSNLY

SEQ ID NO: 284298 - protein, 9 aa, Homo Sapiens
PKKNKNKGK

SEQ ID NO: 284299 - protein, 9 aa, Homo Sapiens
REDGHSLSD

SEQ ID NO: 284300 - protein, 9 aa, Homo Sapiens
SSLKQVETG

SEQ ID NO: 284301 - protein, 9 aa, Homo Sapiens
SGDINRTST

SEQ ID NO: 284302 - protein, 9 aa, Homo Sapiens
KREHWFRFS

SEQ ID NO: 284303 - protein, 9 aa, Homo Sapiens
FDVIVSAKR

SEQ ID NO: 284304 - protein, 9 aa, Homo Sapiens
VGWEGANYA

SEQ ID NO: 284305 - protein, 9 aa, Homo Sapiens
LLVLLLLQV

SEQ ID NO: 284306 - protein, 9 aa, Homo Sapiens
LGQFSFDIA

SEQ ID NO: 284307 - protein, 9 aa, Homo Sapiens
ALGIASCLY

SEQ ID NO: 284308 - protein, 9 aa, Homo Sapiens
SWLLFCACA

SEQ ID NO: 284309 - protein, 9 aa, Homo Sapiens
YSEKCCLTE

SEQ ID NO: 284310 - protein, 9 aa, Homo Sapiens
KERAKREMG

SEQ ID NO: 284311 - protein, 9 aa, Homo Sapiens
DLTGISMHG

SEQ ID NO: 284312 - protein, 9 aa, Homo Sapiens
ELIVGKKFK

SEQ ID NO: 284313 - protein, 9 aa, Homo Sapiens
SQLMMDGAT

SEQ ID NO: 284314 - protein, 9 aa, Homo Sapiens
FNPGHFLDV

SEQ ID NO: 284315 - protein, 9 aa, Homo Sapiens
NPTPLPNLG

SEQ ID NO: 284316 - protein, 9 aa, Homo Sapiens
ILPQVITEF

SEQ ID NO: 284317 - protein, 9 aa, Homo Sapiens
FDAQSPLYS

SEQ ID NO: 284318 - protein, 9 aa, Homo Sapiens
LISQEPDPG

SEQ ID NO: 284319 - protein, 9 aa, Homo Sapiens
RAEIMISFS

SEQ ID NO: 284320 - protein, 9 aa, Homo Sapiens
QQQVLKHNR

SEQ ID NO: 284321 - protein, 9 aa, Homo Sapiens
KFAHFLLNV

SEQ ID NO: 284322 - protein, 9 aa, Homo Sapiens
MIVFLDKEV

SEQ ID NO: 284323 - protein, 9 aa, Homo Sapiens
YAGLGPSPC

SEQ ID NO: 284324 - protein, 9 aa, Homo Sapiens
IPGLSKKLK

SEQ ID NO: 284325 - protein, 9 aa, Homo Sapiens
ILMTIVLLL

SEQ ID NO: 284326 - protein, 9 aa, Homo Sapiens
EYSLLISIK

SEQ ID NO: 284327 - protein, 9 aa, Homo Sapiens
LAATFIHSL

SEQ ID NO: 284328 - protein, 9 aa, Homo Sapiens
IVGEGLNLK

SEQ ID NO: 284329 - protein, 9 aa, Homo Sapiens
EPSEDSCET

SEQ ID NO: 284330 - protein, 9 aa, Homo Sapiens
HGLHGHPPL

SEQ ID NO: 284331 - protein, 9 aa, Homo Sapiens
VPKANTPVH

SEQ ID NO: 284332 - protein, 9 aa, Homo Sapiens
EGISPLVKI

SEQ ID NO: 284333 - protein, 9 aa, Homo Sapiens
LFCVEQREF

SEQ ID NO: 284334 - protein, 9 aa, Homo Sapiens
RSKFGTVSQ

SEQ ID NO: 284335 - protein, 9 aa, Homo Sapiens
SSNSFKLYS

SEQ ID NO: 284336 - protein, 9 aa, Homo Sapiens
NKDLHDKLI

SEQ ID NO: 284337 - protein, 9 aa, Homo Sapiens
IPMVSVVTT

SEQ ID NO: 284338 - protein, 9 aa, Homo Sapiens
YYCHSQTRL

SEQ ID NO: 284339 - protein, 9 aa, Homo Sapiens
KKEYSNKNA

SEQ ID NO: 284340 - protein, 9 aa, Homo Sapiens
VQFVRELVN

SEQ ID NO: 284341 - protein, 9 aa, Homo Sapiens
AIPMVSVVT

SEQ ID NO: 284342 - protein, 9 aa, Homo Sapiens
TSTTTSRVT

SEQ ID NO: 284343 - protein, 9 aa, Homo Sapiens
GHAINSYTW

SEQ ID NO: 284344 - protein, 9 aa, Homo Sapiens
KVVSSENFD

SEQ ID NO: 284345 - protein, 9 aa, Homo Sapiens
NPYSFQPDV

SEQ ID NO: 284346 - protein, 9 aa, Homo Sapiens
DPYDYEIIE

SEQ ID NO: 284347 - protein, 9 aa, Homo Sapiens
QEIESMEEV

SEQ ID NO: 284348 - protein, 9 aa, Homo Sapiens
FQNVAALHL

SEQ ID NO: 284349 - protein, 9 aa, Homo Sapiens
PKQECLLNL

SEQ ID NO: 284350 - protein, 9 aa, Homo Sapiens
INQVLDWCR

SEQ ID NO: 284351 - protein, 9 aa, Homo Sapiens
YDKCGHDNL

SEQ ID NO: 284352 - protein, 9 aa, Homo Sapiens
FKALLEGLH

SEQ ID NO: 284353 - protein, 9 aa, Homo Sapiens
HSYIKEIKD

SEQ ID NO: 284354 - protein, 9 aa, Homo Sapiens
TDIDSTLDS

SEQ ID NO: 284355 - protein, 9 aa, Homo Sapiens
TERKIWDSQ

SEQ ID NO: 284356 - protein, 9 aa, Homo Sapiens
ATGCSSILP

SEQ ID NO: 284357 - protein, 9 aa, Homo Sapiens
SQRNCGAWS

SEQ ID NO: 284358 - protein, 9 aa, Homo Sapiens
SAGGLVFNT

SEQ ID NO: 284359 - protein, 9 aa, Homo Sapiens
EEYDLLCTI

SEQ ID NO: 284360 - protein, 9 aa, Homo Sapiens
AFNKEITRQ

SEQ ID NO: 284361 - protein, 9 aa, Homo Sapiens
YIHALHLQN

SEQ ID NO: 284362 - protein, 9 aa, Homo Sapiens
ILPIEQLCS

SEQ ID NO: 284363 - protein, 9 aa, Homo Sapiens
WEVYATAVL

SEQ ID NO: 284364 - protein, 9 aa, Homo Sapiens
PAKSAVNCV

SEQ ID NO: 284365 - protein, 9 aa, Homo Sapiens
LEFYYSELY

SEQ ID NO: 284366 - protein, 9 aa, Homo Sapiens
AVVREDNLE

SEQ ID NO: 284367 - protein, 9 aa, Homo Sapiens
EAELAVEPN

SEQ ID NO: 284368 - protein, 9 aa, Homo Sapiens
GQRRSKGTK

SEQ ID NO: 284369 - protein, 9 aa, Homo Sapiens
YPSIFWINF

SEQ ID NO: 284370 - protein, 9 aa, Homo Sapiens
WLIDEVNQD

SEQ ID NO: 284371 - protein, 9 aa, Homo Sapiens
KDLVMPNEM

SEQ ID NO: 284372 - protein, 9 aa, Homo Sapiens
LDLWTQGKN

SEQ ID NO: 284373 - protein, 9 aa, Homo Sapiens
TQLLFCIFS

SEQ ID NO: 284374 - protein, 9 aa, Homo Sapiens
PEFINKIQE

SEQ ID NO: 284375 - protein, 9 aa, Homo Sapiens
GCCSEQQEE

SEQ ID NO: 284376 - protein, 9 aa, Homo Sapiens
ITREEKHCM

SEQ ID NO: 284377 - protein, 9 aa, Homo Sapiens
TGNTLSSVS

SEQ ID NO: 284378 - protein, 9 aa, Homo Sapiens
LQLLLPTQD

SEQ ID NO: 284379 - protein, 9 aa, Homo Sapiens
IETKNKTVC

SEQ ID NO: 284380 - protein, 9 aa, Homo Sapiens
QIYHRKAKY

SEQ ID NO: 284381 - protein, 9 aa, Homo Sapiens
TPVHLSVNQ

SEQ ID NO: 284382 - protein, 9 aa, Homo Sapiens
NRDPVLMYL

SEQ ID NO: 284383 - protein, 9 aa, Homo Sapiens
SKYLKDVQN

SEQ ID NO: 284384 - protein, 9 aa, Homo Sapiens
SNKKLFSLA

SEQ ID NO: 284385 - protein, 9 aa, Homo Sapiens
FSSTQSRMD

SEQ ID NO: 284386 - protein, 9 aa, Homo Sapiens
DFLQYTVDA

SEQ ID NO: 284387 - protein, 9 aa, Homo Sapiens
LLGLALCHI

SEQ ID NO: 284388 - protein, 9 aa, Homo Sapiens
EFDYWDYVV

SEQ ID NO: 284389 - protein, 9 aa, Homo Sapiens
ASCHIVPVF

SEQ ID NO: 284390 - protein, 9 aa, Homo Sapiens
VQPTMSQFK

SEQ ID NO: 284391 - protein, 9 aa, Homo Sapiens
SYDNREKSK

SEQ ID NO: 284392 - protein, 9 aa, Homo Sapiens
QSLTRHAAV

SEQ ID NO: 284393 - protein, 9 aa, Homo Sapiens
AIAEGCMQD

SEQ ID NO: 284394 - protein, 9 aa, Homo Sapiens
NNLKNMALF

SEQ ID NO: 284395 - protein, 9 aa, Homo Sapiens
SYEVRGTFL

SEQ ID NO: 284396 - protein, 9 aa, Homo Sapiens
DADEGIFEI

SEQ ID NO: 284397 - protein, 9 aa, Homo Sapiens
KSSRHDPSI

SEQ ID NO: 284398 - protein, 9 aa, Homo Sapiens
QTFLRPDPQ

SEQ ID NO: 284399 - protein, 9 aa, Homo Sapiens
DDKSIMTYV

SEQ ID NO: 284400 - protein, 9 aa, Homo Sapiens
AARRFILNI

SEQ ID NO: 284401 - protein, 9 aa, Homo Sapiens
LNPVKDVLI

SEQ ID NO: 284402 - protein, 9 aa, Homo Sapiens
EVKGALKNV

SEQ ID NO: 284403 - protein, 9 aa, Homo Sapiens
MFKYEFSNS

SEQ ID NO: 284404 - protein, 9 aa, Homo Sapiens
INQQSPFRE

SEQ ID NO: 284405 - protein, 9 aa, Homo Sapiens
LTIPTVVTV

SEQ ID NO: 284406 - protein, 9 aa, Homo Sapiens
KKTGHEMEK

SEQ ID NO: 284407 - protein, 9 aa, Homo Sapiens
NTQKVTFED

SEQ ID NO: 284408 - protein, 9 aa, Homo Sapiens
FLPAGFVTL

SEQ ID NO: 284409 - protein, 8 aa, Homo Sapiens
NPSMKQKQ

SEQ ID NO: 284410 - protein, 9 aa, Homo Sapiens
KIANIFEIQ

SEQ ID NO: 284411 - protein, 9 aa, Homo Sapiens
IFKSSCYIN

SEQ ID NO: 284412 - protein, 9 aa, Homo Sapiens
HIQALQTVI

SEQ ID NO: 284413 - protein, 9 aa, Homo Sapiens
FVIFFQKYY

SEQ ID NO: 284414 - protein, 9 aa, Homo Sapiens
VNETSIIIR

SEQ ID NO: 284415 - protein, 9 aa, Homo Sapiens
ICSYQLTLH

SEQ ID NO: 284416 - protein, 9 aa, Homo Sapiens
DKLRIIPLS

SEQ ID NO: 284417 - protein, 9 aa, Homo Sapiens
NLSAGSGKL

SEQ ID NO: 284418 - protein, 9 aa, Homo Sapiens
AFPCNQLGK

SEQ ID NO: 284419 - protein, 9 aa, Homo Sapiens
LWECVLPEE

SEQ ID NO: 284420 - protein, 9 aa, Homo Sapiens
WEQPQLFWL

SEQ ID NO: 284421 - protein, 9 aa, Homo Sapiens
NNYRRVPYH

SEQ ID NO: 284422 - protein, 9 aa, Homo Sapiens
LGFVVVLSI

SEQ ID NO: 284423 - protein, 9 aa, Homo Sapiens
DLAHTIGRK

SEQ ID NO: 284424 - protein, 9 aa, Homo Sapiens
LQNILGLDS

SEQ ID NO: 284425 - protein, 9 aa, Homo Sapiens
EVLEQNFQT

SEQ ID NO: 284426 - protein, 9 aa, Homo Sapiens
HYLLCDDTI

SEQ ID NO: 284427 - protein, 9 aa, Homo Sapiens
DGPLPRASS

SEQ ID NO: 284428 - protein, 9 aa, Homo Sapiens
KVFPGNVET

SEQ ID NO: 284429 - protein, 9 aa, Homo Sapiens
IFYHQALLF

SEQ ID NO: 284430 - protein, 9 aa, Homo Sapiens
TRNAEFDCH

SEQ ID NO: 284431 - protein, 9 aa, Homo Sapiens
DLFNLCSRK

SEQ ID NO: 284432 - protein, 9 aa, Homo Sapiens
TNLQKGVRR

SEQ ID NO: 284433 - protein, 9 aa, Homo Sapiens
TQKSELITH

SEQ ID NO: 284434 - protein, 9 aa, Homo Sapiens
WLQVLELDH

SEQ ID NO: 284435 - protein, 9 aa, Homo Sapiens
DCIFIWFCI

SEQ ID NO: 284436 - protein, 9 aa, Homo Sapiens
FKFFQDHNM

SEQ ID NO: 284437 - protein, 9 aa, Homo Sapiens
IPYCQPRAI

SEQ ID NO: 284438 - protein, 9 aa, Homo Sapiens
SKGKSPHNE

SEQ ID NO: 284439 - protein, 9 aa, Homo Sapiens
RFVLLGIST

SEQ ID NO: 284440 - protein, 9 aa, Homo Sapiens
EDYPMIILY

SEQ ID NO: 284441 - protein, 9 aa, Homo Sapiens
ELLTYKEVA

SEQ ID NO: 284442 - protein, 9 aa, Homo Sapiens
DSLPHFVRS

SEQ ID NO: 284443 - protein, 9 aa, Homo Sapiens
SVCRASNLH

SEQ ID NO: 284444 - protein, 9 aa, Homo Sapiens
YVKEYKEVN

SEQ ID NO: 284445 - protein, 9 aa, Homo Sapiens
TKKKKKKNK

SEQ ID NO: 284446 - protein, 9 aa, Homo Sapiens
MVAINQVLD

SEQ ID NO: 284447 - protein, 9 aa, Homo Sapiens
APKSHVEKE

SEQ ID NO: 284448 - protein, 9 aa, Homo Sapiens
FLYYEMGYT

SEQ ID NO: 284449 - protein, 9 aa, Homo Sapiens
LEENETLQA

SEQ ID NO: 284450 - protein, 9 aa, Homo Sapiens
MFDISAVYP

SEQ ID NO: 284451 - protein, 9 aa, Homo Sapiens
LPEDAFNNF

SEQ ID NO: 284452 - protein, 9 aa, Homo Sapiens
YETFKNFFV

SEQ ID NO: 284453 - protein, 9 aa, Homo Sapiens
LEDSFLKSY

SEQ ID NO: 284454 - protein, 9 aa, Homo Sapiens
ITVTTDGSI

SEQ ID NO: 284455 - protein, 9 aa, Homo Sapiens
RDTKMALNP

SEQ ID NO: 284456 - protein, 9 aa, Homo Sapiens
LVQVVDNSE

SEQ ID NO: 284457 - protein, 9 aa, Homo Sapiens
NLQLQRMIR

SEQ ID NO: 284458 - protein, 9 aa, Homo Sapiens
TALKEKYME

SEQ ID NO: 284459 - protein, 9 aa, Homo Sapiens
KRLGNSWAE

SEQ ID NO: 284460 - protein, 9 aa, Homo Sapiens
HGFPGFWYS

SEQ ID NO: 284461 - protein, 9 aa, Homo Sapiens
PGAQSQYVC

SEQ ID NO: 284462 - protein, 9 aa, Homo Sapiens
DVTFNTICK

SEQ ID NO: 284463 - protein, 9 aa, Homo Sapiens
EAFDKMKGQ

SEQ ID NO: 284464 - protein, 9 aa, Homo Sapiens
VWSKCETIF

SEQ ID NO: 284465 - protein, 9 aa, Homo Sapiens
EAVNKGFPP

SEQ ID NO: 284466 - protein, 9 aa, Homo Sapiens
CQAPCSTNN

SEQ ID NO: 284467 - protein, 9 aa, Homo Sapiens
KNNSCSICS

SEQ ID NO: 284468 - protein, 9 aa, Homo Sapiens
DKLSELHVN

SEQ ID NO: 284469 - protein, 9 aa, Homo Sapiens
QTLGHFMSH

SEQ ID NO: 284470 - protein, 9 aa, Homo Sapiens
LSLVGIIIM

SEQ ID NO: 284471 - protein, 9 aa, Homo Sapiens
QMLAMHIEK

SEQ ID NO: 284472 - protein, 9 aa, Homo Sapiens
VINWAQIIN

SEQ ID NO: 284473 - protein, 9 aa, Homo Sapiens
ECVLPEEDS

SEQ ID NO: 284474 - protein, 9 aa, Homo Sapiens
FRYKHKMTQ

SEQ ID NO: 284475 - protein, 9 aa, Homo Sapiens
LRCVEMKQN

SEQ ID NO: 284476 - protein, 9 aa, Homo Sapiens
WGPPTAFYL

SEQ ID NO: 284477 - protein, 9 aa, Homo Sapiens
KVLQGCWLL

SEQ ID NO: 284478 - protein, 9 aa, Homo Sapiens
SRNGLEKTG

SEQ ID NO: 284479 - protein, 9 aa, Homo Sapiens
VQEDSQAFT

SEQ ID NO: 284480 - protein, 9 aa, Homo Sapiens
ADVWPLDPL

SEQ ID NO: 284481 - protein, 9 aa, Homo Sapiens
IKIMLINSF

SEQ ID NO: 284482 - protein, 9 aa, Homo Sapiens
YGNLSHVNM

SEQ ID NO: 284483 - protein, 9 aa, Homo Sapiens
REKAKNVFE

SEQ ID NO: 284484 - protein, 9 aa, Homo Sapiens
IASKPPPVR

SEQ ID NO: 284485 - protein, 9 aa, Homo Sapiens
HHNEKKRNN

SEQ ID NO: 284486 - protein, 9 aa, Homo Sapiens
IKDSGDMSV

SEQ ID NO: 284487 - protein, 9 aa, Homo Sapiens
KPCFDYSQQ

SEQ ID NO: 284488 - protein, 9 aa, Homo Sapiens
NRSSEILNK

SEQ ID NO: 284489 - protein, 9 aa, Homo Sapiens
DTAFRTDNG

SEQ ID NO: 284490 - protein, 9 aa, Homo Sapiens
STQNLITKM

SEQ ID NO: 284491 - protein, 9 aa, Homo Sapiens
HLIQHQQVH

SEQ ID NO: 284492 - protein, 9 aa, Homo Sapiens
QPLDILTYK

SEQ ID NO: 284493 - protein, 9 aa, Homo Sapiens
SAPGTPGTQ

SEQ ID NO: 284494 - protein, 9 aa, Homo Sapiens
IDILFAFTK

SEQ ID NO: 284495 - protein, 9 aa, Homo Sapiens
RIMGHAVQT

SEQ ID NO: 284496 - protein, 9 aa, Homo Sapiens
EIYWKLDYK

SEQ ID NO: 284497 - protein, 9 aa, Homo Sapiens
RRWGCYPGS

SEQ ID NO: 284498 - protein, 9 aa, Homo Sapiens
QRNITYKAN

SEQ ID NO: 284499 - protein, 9 aa, Homo Sapiens
APSKGRPTP

SEQ ID NO: 284500 - protein, 9 aa, Homo Sapiens
QFNSMEPNT

SEQ ID NO: 284501 - protein, 9 aa, Homo Sapiens
LSFFTTSLL

SEQ ID NO: 284502 - protein, 9 aa, Homo Sapiens
KTASENANK

SEQ ID NO: 284503 - protein, 9 aa, Homo Sapiens
KGSVSPTFL

SEQ ID NO: 284504 - protein, 9 aa, Homo Sapiens
FTDCYIYNK

SEQ ID NO: 284505 - protein, 9 aa, Homo Sapiens
RNIDPQPPI

SEQ ID NO: 284506 - protein, 9 aa, Homo Sapiens
VHADDLLSS

SEQ ID NO: 284507 - protein, 9 aa, Homo Sapiens
RGTKHYSLI

SEQ ID NO: 284508 - protein, 9 aa, Homo Sapiens
DFEDDDEWG

SEQ ID NO: 284509 - protein, 9 aa, Homo Sapiens
ICGQVLNNF

SEQ ID NO: 284510 - protein, 9 aa, Homo Sapiens
LTIIACFDV

SEQ ID NO: 284511 - protein, 9 aa, Homo Sapiens
MPRTLEGCI

SEQ ID NO: 284512 - protein, 9 aa, Homo Sapiens
NTIKKCEKD

SEQ ID NO: 284513 - protein, 9 aa, Homo Sapiens
ILVLKRLSD

SEQ ID NO: 284514 - protein, 9 aa, Homo Sapiens
FSACGGFEV

SEQ ID NO: 284515 - protein, 9 aa, Homo Sapiens
PIYMSYDSY

SEQ ID NO: 284516 - protein, 9 aa, Homo Sapiens
IKTGHYDLM

SEQ ID NO: 284517 - protein, 9 aa, Homo Sapiens
WGIVRQGLQ

SEQ ID NO: 284518 - protein, 9 aa, Homo Sapiens
PEKPNKVKD

SEQ ID NO: 284519 - protein, 9 aa, Homo Sapiens
QGEGYILVK

SEQ ID NO: 284520 - protein, 9 aa, Homo Sapiens
NVMATKYGP

SEQ ID NO: 284521 - protein, 9 aa, Homo Sapiens
PLAPIFPPM

SEQ ID NO: 284522 - protein, 9 aa, Homo Sapiens
PQTLEIHWL

SEQ ID NO: 284523 - protein, 9 aa, Homo Sapiens
PPTLKNDAK

SEQ ID NO: 284524 - protein, 9 aa, Homo Sapiens
NSSTVEPKE

SEQ ID NO: 284525 - protein, 9 aa, Homo Sapiens
ASDADGPTY

SEQ ID NO: 284526 - protein, 9 aa, Homo Sapiens
NELQQLQSK

SEQ ID NO: 284527 - protein, 9 aa, Homo Sapiens
AKNLAKALM

SEQ ID NO: 284528 - protein, 9 aa, Homo Sapiens
TVSSSQVTE

SEQ ID NO: 284529 - protein, 9 aa, Homo Sapiens
ALASSIMPN

SEQ ID NO: 284530 - protein, 9 aa, Homo Sapiens
QPCVFWTDA

SEQ ID NO: 284531 - protein, 9 aa, Homo Sapiens
GKARANNTF

SEQ ID NO: 284532 - protein, 9 aa, Homo Sapiens
PPPHPSNLQ

SEQ ID NO: 284533 - protein, 9 aa, Homo Sapiens
IAHGTEKLG

SEQ ID NO: 284534 - protein, 9 aa, Homo Sapiens
ITDEDINGI

SEQ ID NO: 284535 - protein, 9 aa, Homo Sapiens
DIDDAQVLE

SEQ ID NO: 284536 - protein, 9 aa, Homo Sapiens
TQFFGHNVE

SEQ ID NO: 284537 - protein, 9 aa, Homo Sapiens
YSHPPQPSN

SEQ ID NO: 284538 - protein, 9 aa, Homo Sapiens
IAYVSVVLQ

SEQ ID NO: 284539 - protein, 9 aa, Homo Sapiens
VGTKKELSM

SEQ ID NO: 284540 - protein, 9 aa, Homo Sapiens
DMLIERSSD

SEQ ID NO: 284541 - protein, 9 aa, Homo Sapiens
SLHKIYVCQ

SEQ ID NO: 284542 - protein, 9 aa, Homo Sapiens
SFHSSRDSV

SEQ ID NO: 284543 - protein, 9 aa, Homo Sapiens
VAFVQLLAS

SEQ ID NO: 284544 - protein, 9 aa, Homo Sapiens
HQELKQCPN

SEQ ID NO: 284545 - protein, 9 aa, Homo Sapiens
IPFNPLAKS

SEQ ID NO: 284546 - protein, 9 aa, Homo Sapiens
YKNRYEVEI

SEQ ID NO: 284547 - protein, 9 aa, Homo Sapiens
NKKGGERRR

SEQ ID NO: 284548 - protein, 9 aa, Homo Sapiens
VVEICITSI

SEQ ID NO: 284549 - protein, 9 aa, Homo Sapiens
AGPGNHVQI

SEQ ID NO: 284550 - protein, 9 aa, Homo Sapiens
YCGQIYIET

SEQ ID NO: 284551 - protein, 9 aa, Homo Sapiens
SGPCVLSSP

SEQ ID NO: 284552 - protein, 9 aa, Homo Sapiens
GQAKENIFQ

SEQ ID NO: 284553 - protein, 9 aa, Homo Sapiens
HNSKPSVPV

SEQ ID NO: 284554 - protein, 9 aa, Homo Sapiens
EREHPAEPS

SEQ ID NO: 284555 - protein, 9 aa, Homo Sapiens
DDFKPEVKM

SEQ ID NO: 284556 - protein, 9 aa, Homo Sapiens
DLLRLFEHG

SEQ ID NO: 284557 - protein, 9 aa, Homo Sapiens
YALRTIHTA

SEQ ID NO: 284558 - protein, 9 aa, Homo Sapiens
YRHKKNEEN

SEQ ID NO: 284559 - protein, 9 aa, Homo Sapiens
LEMCQKPRP

SEQ ID NO: 284560 - protein, 9 aa, Homo Sapiens
CARGGQVRV

SEQ ID NO: 284561 - protein, 9 aa, Homo Sapiens
HISVVMDKF

SEQ ID NO: 284562 - protein, 9 aa, Homo Sapiens
NDLVDASDL

SEQ ID NO: 284563 - protein, 9 aa, Homo Sapiens
ASLATDLKK

SEQ ID NO: 284564 - protein, 9 aa, Homo Sapiens
SYARVQAVV

SEQ ID NO: 284565 - protein, 9 aa, Homo Sapiens
NHYQHLLSC

SEQ ID NO: 284566 - protein, 9 aa, Homo Sapiens
VTVLQLMER

SEQ ID NO: 284567 - protein, 9 aa, Homo Sapiens
NQQVSYGQR

SEQ ID NO: 284568 - protein, 9 aa, Homo Sapiens
DHLKLYFPV

SEQ ID NO: 284569 - protein, 9 aa, Homo Sapiens
RKIIGVVSQ

SEQ ID NO: 284570 - protein, 9 aa, Homo Sapiens
SAQACNETI

SEQ ID NO: 284571 - protein, 9 aa, Homo Sapiens
ASSLNKGNK

SEQ ID NO: 284572 - protein, 9 aa, Homo Sapiens
RHYRINTGK

SEQ ID NO: 284573 - protein, 9 aa, Homo Sapiens
LTMLYSVIR

SEQ ID NO: 284574 - protein, 9 aa, Homo Sapiens
PRSDLKAAR

SEQ ID NO: 284575 - protein, 9 aa, Homo Sapiens
DHRTSQNHS

SEQ ID NO: 284576 - protein, 9 aa, Homo Sapiens
EVPKGGVTD

SEQ ID NO: 284577 - protein, 9 aa, Homo Sapiens
KISKDVLAG

SEQ ID NO: 284578 - protein, 9 aa, Homo Sapiens
FSEVEIARF

SEQ ID NO: 284579 - protein, 9 aa, Homo Sapiens
DAATYNSLL

SEQ ID NO: 284580 - protein, 9 aa, Homo Sapiens
LGGNTVKST

SEQ ID NO: 284581 - protein, 9 aa, Homo Sapiens
YWKKERNEG

SEQ ID NO: 284582 - protein, 9 aa, Homo Sapiens
SAVTASVTF

SEQ ID NO: 284583 - protein, 9 aa, Homo Sapiens
LFTLDYFGE

SEQ ID NO: 284584 - protein, 9 aa, Homo Sapiens
ITVPFMLIV

SEQ ID NO: 284585 - protein, 9 aa, Homo Sapiens
CRNGGVCQE

SEQ ID NO: 284586 - protein, 9 aa, Homo Sapiens
GSTSAHTLV

SEQ ID NO: 284587 - protein, 9 aa, Homo Sapiens
LSVDYLLEK

SEQ ID NO: 284588 - protein, 9 aa, Homo Sapiens
VFRAPGTIK

SEQ ID NO: 284589 - protein, 9 aa, Homo Sapiens
YLSALVRSS

SEQ ID NO: 284590 - protein, 9 aa, Homo Sapiens
TIIACFDVI

SEQ ID NO: 284591 - protein, 9 aa, Homo Sapiens
EGNPDDGTK

SEQ ID NO: 284592 - protein, 9 aa, Homo Sapiens
TSSTSPQLA

SEQ ID NO: 284593 - protein, 9 aa, Homo Sapiens
NGLEEKLSQ

SEQ ID NO: 284594 - protein, 9 aa, Homo Sapiens
EQEQQQQLS

SEQ ID NO: 284595 - protein, 9 aa, Homo Sapiens
PTYASTYGK

SEQ ID NO: 284596 - protein, 9 aa, Homo Sapiens
NRDGPADVW

SEQ ID NO: 284597 - protein, 9 aa, Homo Sapiens
GAWAGHPCS

SEQ ID NO: 284598 - protein, 9 aa, Homo Sapiens
QVKIWIVYF

SEQ ID NO: 284599 - protein, 9 aa, Homo Sapiens
RKQANLNSR

SEQ ID NO: 284600 - protein, 9 aa, Homo Sapiens
ARTPIPCVC

SEQ ID NO: 284601 - protein, 9 aa, Homo Sapiens
KAQQTKPQM

SEQ ID NO: 284602 - protein, 9 aa, Homo Sapiens
ADLVILLSI

SEQ ID NO: 284603 - protein, 9 aa, Homo Sapiens
NILLILQYI

SEQ ID NO: 284604 - protein, 9 aa, Homo Sapiens
GTSSYTAQD

SEQ ID NO: 284605 - protein, 9 aa, Homo Sapiens
YGRYWSYDF

SEQ ID NO: 284606 - protein, 9 aa, Homo Sapiens
HSNKLSKIP

SEQ ID NO: 284607 - protein, 9 aa, Homo Sapiens
QSTLIPSES

SEQ ID NO: 284608 - protein, 9 aa, Homo Sapiens
DCSKGLFLV

SEQ ID NO: 284609 - protein, 9 aa, Homo Sapiens
ALSEADHYL

SEQ ID NO: 284610 - protein, 9 aa, Homo Sapiens
IIDMLSVEQ

SEQ ID NO: 284611 - protein, 9 aa, Homo Sapiens
TEMLQNNPS

SEQ ID NO: 284612 - protein, 9 aa, Homo Sapiens
PTDNQVRLC

SEQ ID NO: 284613 - protein, 9 aa, Homo Sapiens
GLHKFCLGR

SEQ ID NO: 284614 - protein, 9 aa, Homo Sapiens
NIFPQKKCE

SEQ ID NO: 284615 - protein, 9 aa, Homo Sapiens
VQDLAGDFQ

SEQ ID NO: 284616 - protein, 9 aa, Homo Sapiens
AFSYKPWFT

SEQ ID NO: 284617 - protein, 9 aa, Homo Sapiens
QSGMDNDTN

SEQ ID NO: 284618 - protein, 9 aa, Homo Sapiens
LHDQTVIRR

SEQ ID NO: 284619 - protein, 9 aa, Homo Sapiens
ALMYGLDSR

SEQ ID NO: 284620 - protein, 9 aa, Homo Sapiens
VEILDPNDP

SEQ ID NO: 284621 - protein, 9 aa, Homo Sapiens
MPNMLGIFW

SEQ ID NO: 284622 - protein, 9 aa, Homo Sapiens
DLIANFNQT

SEQ ID NO: 284623 - protein, 9 aa, Homo Sapiens
SPDRLAAIN

SEQ ID NO: 284624 - protein, 9 aa, Homo Sapiens
RIESITSDT

SEQ ID NO: 284625 - protein, 9 aa, Homo Sapiens
NNMKVVKTE

SEQ ID NO: 284626 - protein, 9 aa, Homo Sapiens
EKDMMVYVF

SEQ ID NO: 284627 - protein, 9 aa, Homo Sapiens
DPDAPPQNR

SEQ ID NO: 284628 - protein, 9 aa, Homo Sapiens
TFDIYANGI

SEQ ID NO: 284629 - protein, 9 aa, Homo Sapiens
TAFNLRKPV

SEQ ID NO: 284630 - protein, 9 aa, Homo Sapiens
IVNLDYPMV

SEQ ID NO: 284631 - protein, 9 aa, Homo Sapiens
SLLVIIHAP

SEQ ID NO: 284632 - protein, 9 aa, Homo Sapiens
PQSSSNNNG

SEQ ID NO: 284633 - protein, 9 aa, Homo Sapiens
LFIKEVDMK

SEQ ID NO: 284634 - protein, 9 aa, Homo Sapiens
FGVQVLQDN

SEQ ID NO: 284635 - protein, 9 aa, Homo Sapiens
HLNKAEENC

SEQ ID NO: 284636 - protein, 9 aa, Homo Sapiens
DRSSDPGRC

SEQ ID NO: 284637 - protein, 9 aa, Homo Sapiens
EFGEYNFPK

SEQ ID NO: 284638 - protein, 9 aa, Homo Sapiens
LGSILTPKS

SEQ ID NO: 284639 - protein, 9 aa, Homo Sapiens
SRLEKWLTQ

SEQ ID NO: 284640 - protein, 9 aa, Homo Sapiens
DVAQDDAEK

SEQ ID NO: 284641 - protein, 9 aa, Homo Sapiens
FSAAGLPRN

SEQ ID NO: 284642 - protein, 9 aa, Homo Sapiens
DTALLLLKD

SEQ ID NO: 284643 - protein, 9 aa, Homo Sapiens
EPAKNKKEQ

SEQ ID NO: 284644 - protein, 9 aa, Homo Sapiens
PLAVPPGYT

SEQ ID NO: 284645 - protein, 9 aa, Homo Sapiens
WHQNGGCNT

SEQ ID NO: 284646 - protein, 9 aa, Homo Sapiens
WICNNLIKE

SEQ ID NO: 284647 - protein, 9 aa, Homo Sapiens
EEIKQMEQK

SEQ ID NO: 284648 - protein, 9 aa, Homo Sapiens
KRTFFHWSA

SEQ ID NO: 284649 - protein, 9 aa, Homo Sapiens
GVPISGPGF

SEQ ID NO: 284650 - protein, 9 aa, Homo Sapiens
AQPCTPSSS

SEQ ID NO: 284651 - protein, 9 aa, Homo Sapiens
LHIMHTSYF

SEQ ID NO: 284652 - protein, 9 aa, Homo Sapiens
WKNMTFIKK

SEQ ID NO: 284653 - protein, 9 aa, Homo Sapiens
ESLHGSLGK

SEQ ID NO: 284654 - protein, 9 aa, Homo Sapiens
ASFQTEVSY

SEQ ID NO: 284655 - protein, 9 aa, Homo Sapiens
VLICFDSSR

SEQ ID NO: 284656 - protein, 9 aa, Homo Sapiens
PPSLPTIPP

SEQ ID NO: 284657 - protein, 9 aa, Homo Sapiens
ERYGQIQQV

SEQ ID NO: 284658 - protein, 9 aa, Homo Sapiens
DSSSSEDSN

SEQ ID NO: 284659 - protein, 9 aa, Homo Sapiens
SCLPYGHTV

SEQ ID NO: 284660 - protein, 9 aa, Homo Sapiens
GPECEELLS

SEQ ID NO: 284661 - protein, 9 aa, Homo Sapiens
KIKKNYLPI

SEQ ID NO: 284662 - protein, 9 aa, Homo Sapiens
KQLARNNVT

SEQ ID NO: 284663 - protein, 9 aa, Homo Sapiens
ILEQKIREL

SEQ ID NO: 284664 - protein, 9 aa, Homo Sapiens
YVVAGVSLL

SEQ ID NO: 284665 - protein, 9 aa, Homo Sapiens
LDSLQNEHA

SEQ ID NO: 284666 - protein, 9 aa, Homo Sapiens
DECGKTFRQ

SEQ ID NO: 284667 - protein, 9 aa, Homo Sapiens
SKPKQECLL

SEQ ID NO: 284668 - protein, 9 aa, Homo Sapiens
AFSDAQMHI

SEQ ID NO: 284669 - protein, 9 aa, Homo Sapiens
EDDKQYMKS

SEQ ID NO: 284670 - protein, 9 aa, Homo Sapiens
VPDDSALQE

SEQ ID NO: 284671 - protein, 9 aa, Homo Sapiens
VLHLISSPF

SEQ ID NO: 284672 - protein, 9 aa, Homo Sapiens
TGIYTSESL

SEQ ID NO: 284673 - protein, 9 aa, Homo Sapiens
IARFIINDW

SEQ ID NO: 284674 - protein, 9 aa, Homo Sapiens
GGCNLEFNL

SEQ ID NO: 284675 - protein, 9 aa, Homo Sapiens
PQIQRREVH

SEQ ID NO: 284676 - protein, 9 aa, Homo Sapiens
TEEETQLRE

SEQ ID NO: 284677 - protein, 9 aa, Homo Sapiens
SEKAKICLW

SEQ ID NO: 284678 - protein, 9 aa, Homo Sapiens
QNAFLYKDC

SEQ ID NO: 284679 - protein, 9 aa, Homo Sapiens
HSVMDSGQK

SEQ ID NO: 284680 - protein, 9 aa, Homo Sapiens
EKHIKCLES

SEQ ID NO: 284681 - protein, 9 aa, Homo Sapiens
AWGRSEGDP

SEQ ID NO: 284682 - protein, 9 aa, Homo Sapiens
SAERLQLDE

SEQ ID NO: 284683 - protein, 9 aa, Homo Sapiens
PGLSKKLKR

SEQ ID NO: 284684 - protein, 9 aa, Homo Sapiens
MVYFGRRVL

SEQ ID NO: 284685 - protein, 9 aa, Homo Sapiens
DELNIKAGE

SEQ ID NO: 284686 - protein, 9 aa, Homo Sapiens
PCPREEAGV

SEQ ID NO: 284687 - protein, 9 aa, Homo Sapiens
VAQLLDDFK

SEQ ID NO: 284688 - protein, 9 aa, Homo Sapiens
CTERQKYWW

SEQ ID NO: 284689 - protein, 9 aa, Homo Sapiens
SGEKPYMCR

SEQ ID NO: 284690 - protein, 9 aa, Homo Sapiens
AIEVECIKA

SEQ ID NO: 284691 - protein, 9 aa, Homo Sapiens
NNSKARESR

SEQ ID NO: 284692 - protein, 9 aa, Homo Sapiens
VPYPDSLEP

SEQ ID NO: 284693 - protein, 9 aa, Homo Sapiens
CNLLSFTYR

SEQ ID NO: 284694 - protein, 9 aa, Homo Sapiens
SMEVKANAF

SEQ ID NO: 284695 - protein, 9 aa, Homo Sapiens
SYYLICVLL

SEQ ID NO: 284696 - protein, 9 aa, Homo Sapiens
FFAERLFAL

SEQ ID NO: 284697 - protein, 9 aa, Homo Sapiens
GLFLHPHCK

SEQ ID NO: 284698 - protein, 9 aa, Homo Sapiens
LWCYSNAAA

SEQ ID NO: 284699 - protein, 9 aa, Homo Sapiens
CQPRAINHF

SEQ ID NO: 284700 - protein, 9 aa, Homo Sapiens
KGSTLNIHQ

SEQ ID NO: 284701 - protein, 9 aa, Homo Sapiens
KEITYTKAE

SEQ ID NO: 284702 - protein, 9 aa, Homo Sapiens
KSYKDSWDF

SEQ ID NO: 284703 - protein, 9 aa, Homo Sapiens
DTLDNSRSI

SEQ ID NO: 284704 - protein, 9 aa, Homo Sapiens
KVVVYGSYL

SEQ ID NO: 284705 - protein, 9 aa, Homo Sapiens
KGFKVPGFL

SEQ ID NO: 284706 - protein, 9 aa, Homo Sapiens
RKPDKAERE

SEQ ID NO: 284707 - protein, 9 aa, Homo Sapiens
GHLAGCGAD

SEQ ID NO: 284708 - protein, 9 aa, Homo Sapiens
IIYACFSVK

SEQ ID NO: 284709 - protein, 9 aa, Homo Sapiens
HEDVTMGKI

SEQ ID NO: 284710 - protein, 9 aa, Homo Sapiens
QRKGFNAQF

SEQ ID NO: 284711 - protein, 9 aa, Homo Sapiens
IEDYTHQFN

SEQ ID NO: 284712 - protein, 9 aa, Homo Sapiens
DTTQLIFGS

SEQ ID NO: 284713 - protein, 9 aa, Homo Sapiens
DMIRKSGGH

SEQ ID NO: 284714 - protein, 9 aa, Homo Sapiens
VQLTLFLHL

SEQ ID NO: 284715 - protein, 9 aa, Homo Sapiens
ELCKRSPAA

SEQ ID NO: 284716 - protein, 9 aa, Homo Sapiens
LHHYMEQIL

SEQ ID NO: 284717 - protein, 9 aa, Homo Sapiens
EARTGGSTT

SEQ ID NO: 284718 - protein, 9 aa, Homo Sapiens
KVACVKLRD

SEQ ID NO: 284719 - protein, 9 aa, Homo Sapiens
LHCQLLYIT

SEQ ID NO: 284720 - protein, 9 aa, Homo Sapiens
LMYPALQPL

SEQ ID NO: 284721 - protein, 9 aa, Homo Sapiens
QNDLVDASD

SEQ ID NO: 284722 - protein, 9 aa, Homo Sapiens
SLSREINDC

SEQ ID NO: 284723 - protein, 9 aa, Homo Sapiens
KYHAALKMD

SEQ ID NO: 284724 - protein, 9 aa, Homo Sapiens
NGLSPVIFS

SEQ ID NO: 284725 - protein, 9 aa, Homo Sapiens
VRFNQLNEE

SEQ ID NO: 284726 - protein, 9 aa, Homo Sapiens
VTQSLLTST

SEQ ID NO: 284727 - protein, 9 aa, Homo Sapiens
LQDALGIAS

SEQ ID NO: 284728 - protein, 9 aa, Homo Sapiens
KEPDKPIDR

SEQ ID NO: 284729 - protein, 9 aa, Homo Sapiens
YRCGYCNNE

SEQ ID NO: 284730 - protein, 9 aa, Homo Sapiens
SEKTVVEVL

SEQ ID NO: 284731 - protein, 9 aa, Homo Sapiens
NLNKSESQR

SEQ ID NO: 284732 - protein, 9 aa, Homo Sapiens
SHYGDFLPI

SEQ ID NO: 284733 - protein, 9 aa, Homo Sapiens
YHRFGMTRN

SEQ ID NO: 284734 - protein, 9 aa, Homo Sapiens
DYEIEILDA

SEQ ID NO: 284735 - protein, 9 aa, Homo Sapiens
KHFCSHLGV

SEQ ID NO: 284736 - protein, 9 aa, Homo Sapiens
KNNLKNMAL

SEQ ID NO: 284737 - protein, 9 aa, Homo Sapiens
TKERQSTYN

SEQ ID NO: 284738 - protein, 9 aa, Homo Sapiens
KDSSCIRIH

SEQ ID NO: 284739 - protein, 9 aa, Homo Sapiens
VPEHKLHLA

SEQ ID NO: 284740 - protein, 9 aa, Homo Sapiens
MKAVASRLL

SEQ ID NO: 284741 - protein, 9 aa, Homo Sapiens
LTALKEKYM

SEQ ID NO: 284742 - protein, 9 aa, Homo Sapiens
HALATRYLL

SEQ ID NO: 284743 - protein, 9 aa, Homo Sapiens
SKMRQHQRE

SEQ ID NO: 284744 - protein, 9 aa, Homo Sapiens
VQSHMFDIS

SEQ ID NO: 284745 - protein, 9 aa, Homo Sapiens
FDFLDAELE

SEQ ID NO: 284746 - protein, 9 aa, Homo Sapiens
EGVSMRTNI

SEQ ID NO: 284747 - protein, 9 aa, Homo Sapiens
RVDLVMCPY

SEQ ID NO: 284748 - protein, 9 aa, Homo Sapiens
VCLLLNHFS

SEQ ID NO: 284749 - protein, 9 aa, Homo Sapiens
SAIPQAKCD

SEQ ID NO: 284750 - protein, 9 aa, Homo Sapiens
PKGADWPTP

SEQ ID NO: 284751 - protein, 9 aa, Homo Sapiens
SFLLGKKNI

SEQ ID NO: 284752 - protein, 9 aa, Homo Sapiens
LLNHSANQL

SEQ ID NO: 284753 - protein, 9 aa, Homo Sapiens
SGCCENLGS

SEQ ID NO: 284754 - protein, 9 aa, Homo Sapiens
ATIRSLCDQ

SEQ ID NO: 284755 - protein, 9 aa, Homo Sapiens
QKYWWDAVC

SEQ ID NO: 284756 - protein, 9 aa, Homo Sapiens
GVFASFVCA

SEQ ID NO: 284757 - protein, 9 aa, Homo Sapiens
IENWDEQAY

SEQ ID NO: 284758 - protein, 9 aa, Homo Sapiens
LKSCLNITH

SEQ ID NO: 284759 - protein, 9 aa, Homo Sapiens
PIQKEWVMA

SEQ ID NO: 284760 - protein, 9 aa, Homo Sapiens
CFLTINIMN

SEQ ID NO: 284761 - protein, 9 aa, Homo Sapiens
SFSLNSYIS

SEQ ID NO: 284762 - protein, 9 aa, Homo Sapiens
KLDKTQRKR

SEQ ID NO: 284763 - protein, 9 aa, Homo Sapiens
FDPFRFAPS

SEQ ID NO: 284764 - protein, 9 aa, Homo Sapiens
ECQQKKKRL

SEQ ID NO: 284765 - protein, 9 aa, Homo Sapiens
SPYRGKRNA

SEQ ID NO: 284766 - protein, 9 aa, Homo Sapiens
EHLKKVDTK

SEQ ID NO: 284767 - protein, 9 aa, Homo Sapiens
VISDKTAEW

SEQ ID NO: 284768 - protein, 9 aa, Homo Sapiens
DLLSDLLQS

SEQ ID NO: 284769 - protein, 9 aa, Homo Sapiens
NALKSESTS

SEQ ID NO: 284770 - protein, 9 aa, Homo Sapiens
CITKLAQYV

SEQ ID NO: 284771 - protein, 9 aa, Homo Sapiens
ALQRSLCST

SEQ ID NO: 284772 - protein, 9 aa, Homo Sapiens
TGDYHRYLA

SEQ ID NO: 284773 - protein, 9 aa, Homo Sapiens
SGEGEDEGS

SEQ ID NO: 284774 - protein, 9 aa, Homo Sapiens
LFRLYLLSM

SEQ ID NO: 284775 - protein, 9 aa, Homo Sapiens
LVPFPQRHY

SEQ ID NO: 284776 - protein, 9 aa, Homo Sapiens
DCKECGKYF

SEQ ID NO: 284777 - protein, 9 aa, Homo Sapiens
FLRNNELSW

SEQ ID NO: 284778 - protein, 9 aa, Homo Sapiens
KSGSLALLC

SEQ ID NO: 284779 - protein, 9 aa, Homo Sapiens
HDRLWQSLR

SEQ ID NO: 284780 - protein, 9 aa, Homo Sapiens
VNSQIDREE

SEQ ID NO: 284781 - protein, 9 aa, Homo Sapiens
KAFPDDVVR

SEQ ID NO: 284782 - protein, 9 aa, Homo Sapiens
PVYLANTQP

SEQ ID NO: 284783 - protein, 9 aa, Homo Sapiens
SEAITLTDD

SEQ ID NO: 284784 - protein, 9 aa, Homo Sapiens
YLVVYPASA

SEQ ID NO: 284785 - protein, 9 aa, Homo Sapiens
GMSVGSPYG

SEQ ID NO: 284786 - protein, 9 aa, Homo Sapiens
IKHQIIHSR

SEQ ID NO: 284787 - protein, 9 aa, Homo Sapiens
SLNSKLWKH

SEQ ID NO: 284788 - protein, 9 aa, Homo Sapiens
SVKDHRTSQ

SEQ ID NO: 284789 - protein, 9 aa, Homo Sapiens
DLIWYNTIF

SEQ ID NO: 284790 - protein, 9 aa, Homo Sapiens
VEEDTENMA

SEQ ID NO: 284791 - protein, 9 aa, Homo Sapiens
QLRRIGLDL

SEQ ID NO: 284792 - protein, 9 aa, Homo Sapiens
SGLWTVPAM

SEQ ID NO: 284793 - protein, 9 aa, Homo Sapiens
FGGPECEEL

SEQ ID NO: 284794 - protein, 9 aa, Homo Sapiens
YVILIEYLP

SEQ ID NO: 284795 - protein, 9 aa, Homo Sapiens
VVKKKSKKE

SEQ ID NO: 284796 - protein, 9 aa, Homo Sapiens
CEAIQRFDN

SEQ ID NO: 284797 - protein, 9 aa, Homo Sapiens
KTMIALSIG

SEQ ID NO: 284798 - protein, 9 aa, Homo Sapiens
LIVHKPSYF

SEQ ID NO: 284799 - protein, 9 aa, Homo Sapiens
VLQLYPDNS

SEQ ID NO: 284800 - protein, 9 aa, Homo Sapiens
DAKENFYHV

SEQ ID NO: 284801 - protein, 9 aa, Homo Sapiens
LNISKRVLG

SEQ ID NO: 284802 - protein, 9 aa, Homo Sapiens
EQRKMCKRI

SEQ ID NO: 284803 - protein, 9 aa, Homo Sapiens
NLYSGQILT

SEQ ID NO: 284804 - protein, 9 aa, Homo Sapiens
EYFHMSPIK

SEQ ID NO: 284805 - protein, 9 aa, Homo Sapiens
PNGSQDVGL

SEQ ID NO: 284806 - protein, 9 aa, Homo Sapiens
EKEHNKEPA

SEQ ID NO: 284807 - protein, 9 aa, Homo Sapiens
SDYIDQLKH

SEQ ID NO: 284808 - protein, 9 aa, Homo Sapiens
QVTVYLFCA

SEQ ID NO: 284809 - protein, 9 aa, Homo Sapiens
EARDTHHSQ

SEQ ID NO: 284810 - protein, 9 aa, Homo Sapiens
QIHTGRKPY

SEQ ID NO: 284811 - protein, 9 aa, Homo Sapiens
TVMVIDTNY

SEQ ID NO: 284812 - protein, 9 aa, Homo Sapiens
EDWERTKVL

SEQ ID NO: 284813 - protein, 9 aa, Homo Sapiens
GDKLGTGEN

SEQ ID NO: 284814 - protein, 9 aa, Homo Sapiens
TSSTVQTEG

SEQ ID NO: 284815 - protein, 9 aa, Homo Sapiens
RTAYFSESR

SEQ ID NO: 284816 - protein, 9 aa, Homo Sapiens
YMEVRPYKC

SEQ ID NO: 284817 - protein, 9 aa, Homo Sapiens
KAAKDAQER

SEQ ID NO: 284818 - protein, 9 aa, Homo Sapiens
VFGVIGSLK

SEQ ID NO: 284819 - protein, 9 aa, Homo Sapiens
PPAPQSFLC

SEQ ID NO: 284820 - protein, 9 aa, Homo Sapiens
EQEVNTLHC

SEQ ID NO: 284821 - protein, 9 aa, Homo Sapiens
EDYCPHSKK

SEQ ID NO: 284822 - protein, 9 aa, Homo Sapiens
LKDTFVEIG

SEQ ID NO: 284823 - protein, 9 aa, Homo Sapiens
CILTACFLS

SEQ ID NO: 284824 - protein, 9 aa, Homo Sapiens
LYLAVLSNR

SEQ ID NO: 284825 - protein, 9 aa, Homo Sapiens
KELAEVKVE

SEQ ID NO: 284826 - protein, 9 aa, Homo Sapiens
YTKLSARPS

SEQ ID NO: 284827 - protein, 9 aa, Homo Sapiens
TLNIHQIRS

SEQ ID NO: 284828 - protein, 9 aa, Homo Sapiens
PRQIVIHRG

SEQ ID NO: 284829 - protein, 9 aa, Homo Sapiens
LRKIQGSYG

SEQ ID NO: 284830 - protein, 9 aa, Homo Sapiens
KTSYTMLVD

SEQ ID NO: 284831 - protein, 9 aa, Homo Sapiens
DDQRAIVGS

SEQ ID NO: 284832 - protein, 9 aa, Homo Sapiens
EHLYDMNRW

SEQ ID NO: 284833 - protein, 9 aa, Homo Sapiens
TWALLDRKD

SEQ ID NO: 284834 - protein, 9 aa, Homo Sapiens
NKNLIDRET

SEQ ID NO: 284835 - protein, 9 aa, Homo Sapiens
PLFLYLIIM

SEQ ID NO: 284836 - protein, 8 aa, Homo Sapiens
KRKKTRLD

SEQ ID NO: 284837 - protein, 9 aa, Homo Sapiens
WEVMPRTLE

SEQ ID NO: 284838 - protein, 9 aa, Homo Sapiens
GGAGATPRT

SEQ ID NO: 284839 - protein, 9 aa, Homo Sapiens
HTFFQKPDS

SEQ ID NO: 284840 - protein, 9 aa, Homo Sapiens
SFHNLKCDC

SEQ ID NO: 284841 - protein, 9 aa, Homo Sapiens
SGNWSHCSA

SEQ ID NO: 284842 - protein, 9 aa, Homo Sapiens
IVQEVNITL

SEQ ID NO: 284843 - protein, 9 aa, Homo Sapiens
QDNEGGEKA

SEQ ID NO: 284844 - protein, 9 aa, Homo Sapiens
HHVVSVAGW

SEQ ID NO: 284845 - protein, 9 aa, Homo Sapiens
SRSTDDQII

SEQ ID NO: 284846 - protein, 9 aa, Homo Sapiens
GYNQRNIID

SEQ ID NO: 284847 - protein, 9 aa, Homo Sapiens
NVDHGICIM

SEQ ID NO: 284848 - protein, 9 aa, Homo Sapiens
IHTGDKPYA

SEQ ID NO: 284849 - protein, 9 aa, Homo Sapiens
QLRVFGTGQ

SEQ ID NO: 284850 - protein, 9 aa, Homo Sapiens
TKKESFELM

SEQ ID NO: 284851 - protein, 9 aa, Homo Sapiens
RFTRENSEK

SEQ ID NO: 284852 - protein, 9 aa, Homo Sapiens
QETTDPSDK

SEQ ID NO: 284853 - protein, 9 aa, Homo Sapiens
GSLQIHERT

SEQ ID NO: 284854 - protein, 9 aa, Homo Sapiens
PGAAPYSCV

SEQ ID NO: 284855 - protein, 9 aa, Homo Sapiens
LKKKCKEDF

SEQ ID NO: 284856 - protein, 9 aa, Homo Sapiens
CAQIEAKFD

SEQ ID NO: 284857 - protein, 9 aa, Homo Sapiens
TCLTSQGKK

SEQ ID NO: 284858 - protein, 9 aa, Homo Sapiens
DIVNSGGLH

SEQ ID NO: 284859 - protein, 9 aa, Homo Sapiens
DDKYDDEDD

SEQ ID NO: 284860 - protein, 9 aa, Homo Sapiens
TEYRLMIFK

SEQ ID NO: 284861 - protein, 9 aa, Homo Sapiens
DKGRGMVQV

SEQ ID NO: 284862 - protein, 9 aa, Homo Sapiens
PCIPDLDFP

SEQ ID NO: 284863 - protein, 9 aa, Homo Sapiens
KLPFTTPEL

SEQ ID NO: 284864 - protein, 9 aa, Homo Sapiens
REIWLQKQG

SEQ ID NO: 284865 - protein, 9 aa, Homo Sapiens
FKCTFINDV

SEQ ID NO: 284866 - protein, 9 aa, Homo Sapiens
IMAQKCLKG

SEQ ID NO: 284867 - protein, 9 aa, Homo Sapiens
IVRQGLQCK

SEQ ID NO: 284868 - protein, 9 aa, Homo Sapiens
VTSSLTKYM

SEQ ID NO: 284869 - protein, 9 aa, Homo Sapiens
TPHNWSREN

SEQ ID NO: 284870 - protein, 9 aa, Homo Sapiens
VVSAVGGII

SEQ ID NO: 284871 - protein, 9 aa, Homo Sapiens
KALASIYYP

SEQ ID NO: 284872 - protein, 9 aa, Homo Sapiens
SHESGEQNK

SEQ ID NO: 284873 - protein, 9 aa, Homo Sapiens
EQIIATEQN

SEQ ID NO: 284874 - protein, 9 aa, Homo Sapiens
PTTDISTDK

SEQ ID NO: 284875 - protein, 9 aa, Homo Sapiens
DIMPISELQ

SEQ ID NO: 284876 - protein, 9 aa, Homo Sapiens
AQNVLRKHK

SEQ ID NO: 284877 - protein, 9 aa, Homo Sapiens
TQLKDQRIL

SEQ ID NO: 284878 - protein, 9 aa, Homo Sapiens
VESLQKQLG

SEQ ID NO: 284879 - protein, 9 aa, Homo Sapiens
TLIGKRIAS

SEQ ID NO: 284880 - protein, 9 aa, Homo Sapiens
FQNHVHLMG

SEQ ID NO: 284881 - protein, 9 aa, Homo Sapiens
KPNEIPTKN

SEQ ID NO: 284882 - protein, 9 aa, Homo Sapiens
QTHATRMRT

SEQ ID NO: 284883 - protein, 9 aa, Homo Sapiens
KLNSIIDQG

SEQ ID NO: 284884 - protein, 9 aa, Homo Sapiens
YGGSQGLSL

SEQ ID NO: 284885 - protein, 9 aa, Homo Sapiens
LVGDLRAES

SEQ ID NO: 284886 - protein, 9 aa, Homo Sapiens
STTCHLPRP

SEQ ID NO: 284887 - protein, 9 aa, Homo Sapiens
LEWQYYHNK

SEQ ID NO: 284888 - protein, 9 aa, Homo Sapiens
LNNTSSFSC

SEQ ID NO: 284889 - protein, 9 aa, Homo Sapiens
NIWRKVKCA

SEQ ID NO: 284890 - protein, 9 aa, Homo Sapiens
KKNEGLICK

SEQ ID NO: 284891 - protein, 9 aa, Homo Sapiens
PCLQPSLER

SEQ ID NO: 284892 - protein, 9 aa, Homo Sapiens
YFRPCSSYS

SEQ ID NO: 284893 - protein, 9 aa, Homo Sapiens
EETQLRESV

SEQ ID NO: 284894 - protein, 9 aa, Homo Sapiens
NIQKQELKY

SEQ ID NO: 284895 - protein, 9 aa, Homo Sapiens
IPHQQTRDT

SEQ ID NO: 284896 - protein, 9 aa, Homo Sapiens
AANTLIEDS

SEQ ID NO: 284897 - protein, 9 aa, Homo Sapiens
VFLSQSKLL

SEQ ID NO: 284898 - protein, 9 aa, Homo Sapiens
VLTGAALTL

SEQ ID NO: 284899 - protein, 9 aa, Homo Sapiens
ACLNGNFRG

SEQ ID NO: 284900 - protein, 9 aa, Homo Sapiens
ERKVEESLM

SEQ ID NO: 284901 - protein, 9 aa, Homo Sapiens
CVFASCRIV

SEQ ID NO: 284902 - protein, 9 aa, Homo Sapiens
RDNLNKLMT

SEQ ID NO: 284903 - protein, 9 aa, Homo Sapiens
LSANDVFPC

SEQ ID NO: 284904 - protein, 9 aa, Homo Sapiens
KNAAASYFS

SEQ ID NO: 284905 - protein, 9 aa, Homo Sapiens
KNLMENVEA

SEQ ID NO: 284906 - protein, 9 aa, Homo Sapiens
VLLLHFNVL

SEQ ID NO: 284907 - protein, 9 aa, Homo Sapiens
TQYKPVPDK

SEQ ID NO: 284908 - protein, 9 aa, Homo Sapiens
FCPGDFAVD

SEQ ID NO: 284909 - protein, 9 aa, Homo Sapiens
AQMRKRIKR

SEQ ID NO: 284910 - protein, 9 aa, Homo Sapiens
VTKLGNQLE

SEQ ID NO: 284911 - protein, 9 aa, Homo Sapiens
LTKTNQIYR

SEQ ID NO: 284912 - protein, 9 aa, Homo Sapiens
TCANIKHQQ

SEQ ID NO: 284913 - protein, 9 aa, Homo Sapiens
KDMMVYVFY

SEQ ID NO: 284914 - protein, 9 aa, Homo Sapiens
VWMQGSATG

SEQ ID NO: 284915 - protein, 9 aa, Homo Sapiens
STLTRHKIM

SEQ ID NO: 284916 - protein, 9 aa, Homo Sapiens
TRATLVGGT

SEQ ID NO: 284917 - protein, 9 aa, Homo Sapiens
LNCTALCEV

SEQ ID NO: 284918 - protein, 9 aa, Homo Sapiens
ALVFLDNRI

SEQ ID NO: 284919 - protein, 9 aa, Homo Sapiens
GDIIQQDFL

SEQ ID NO: 284920 - protein, 9 aa, Homo Sapiens
KPRAQAGSD

SEQ ID NO: 284921 - protein, 9 aa, Homo Sapiens
LNITYVPQN

SEQ ID NO: 284922 - protein, 9 aa, Homo Sapiens
ETTRLFCPQ

SEQ ID NO: 284923 - protein, 9 aa, Homo Sapiens
PGELPSHPK

SEQ ID NO: 284924 - protein, 9 aa, Homo Sapiens
DKPVLSLNT

SEQ ID NO: 284925 - protein, 9 aa, Homo Sapiens
RDVPGPPRV

SEQ ID NO: 284926 - protein, 9 aa, Homo Sapiens
SCPEDEFLR

SEQ ID NO: 284927 - protein, 9 aa, Homo Sapiens
VSPSDTSRS

SEQ ID NO: 284928 - protein, 9 aa, Homo Sapiens
NQYICRLNW

SEQ ID NO: 284929 - protein, 9 aa, Homo Sapiens
GLFGGYILG

SEQ ID NO: 284930 - protein, 9 aa, Homo Sapiens
KIISSDSPP

SEQ ID NO: 284931 - protein, 9 aa, Homo Sapiens
KMTGDYHRY

SEQ ID NO: 284932 - protein, 9 aa, Homo Sapiens
ATKQEGMAG

SEQ ID NO: 284933 - protein, 9 aa, Homo Sapiens
VLCLTIEAT

SEQ ID NO: 284934 - protein, 9 aa, Homo Sapiens
AHVHAENGD

SEQ ID NO: 284935 - protein, 9 aa, Homo Sapiens
NSFKLYSPK

SEQ ID NO: 284936 - protein, 9 aa, Homo Sapiens
VSKQSLVYG

SEQ ID NO: 284937 - protein, 9 aa, Homo Sapiens
GLNLRRAAE

SEQ ID NO: 284938 - protein, 9 aa, Homo Sapiens
QPLNHEELE

SEQ ID NO: 284939 - protein, 9 aa, Homo Sapiens
HPYLHRHLP

SEQ ID NO: 284940 - protein, 9 aa, Homo Sapiens
RMATAICQY

SEQ ID NO: 284941 - protein, 9 aa, Homo Sapiens
KKELTYHNT

SEQ ID NO: 284942 - protein, 9 aa, Homo Sapiens
LLLGLMVLP

SEQ ID NO: 284943 - protein, 9 aa, Homo Sapiens
HQAFSDYQI

SEQ ID NO: 284944 - protein, 9 aa, Homo Sapiens
LDNDIKVEI

SEQ ID NO: 284945 - protein, 9 aa, Homo Sapiens
NRVKPDVMH

SEQ ID NO: 284946 - protein, 9 aa, Homo Sapiens
KIEPDAVLQ

SEQ ID NO: 284947 - protein, 9 aa, Homo Sapiens
PAASALIQT

SEQ ID NO: 284948 - protein, 9 aa, Homo Sapiens
KQRHSIRKI

SEQ ID NO: 284949 - protein, 9 aa, Homo Sapiens
QSNSKARQK

SEQ ID NO: 284950 - protein, 9 aa, Homo Sapiens
NRSKGRKFP

SEQ ID NO: 284951 - protein, 9 aa, Homo Sapiens
LSSLSSSDR

SEQ ID NO: 284952 - protein, 9 aa, Homo Sapiens
NDTNGVITL

SEQ ID NO: 284953 - protein, 9 aa, Homo Sapiens
FCGPNHIQH

SEQ ID NO: 284954 - protein, 9 aa, Homo Sapiens
GACKAFTGE

SEQ ID NO: 284955 - protein, 9 aa, Homo Sapiens
ADFKQELRQ

SEQ ID NO: 284956 - protein, 9 aa, Homo Sapiens
PNGKYVYIA

SEQ ID NO: 284957 - protein, 9 aa, Homo Sapiens
EKGILIIHF

SEQ ID NO: 284958 - protein, 9 aa, Homo Sapiens
HPSKGCFCP

SEQ ID NO: 284959 - protein, 9 aa, Homo Sapiens
IAIGLDPYC

SEQ ID NO: 284960 - protein, 9 aa, Homo Sapiens
SWREGDKVT

SEQ ID NO: 284961 - protein, 9 aa, Homo Sapiens
LDKVLNKRI

SEQ ID NO: 284962 - protein, 9 aa, Homo Sapiens
EIDFIGMFT

SEQ ID NO: 284963 - protein, 9 aa, Homo Sapiens
TKHRRIHAG

SEQ ID NO: 284964 - protein, 9 aa, Homo Sapiens
LGLCPSETP

SEQ ID NO: 284965 - protein, 9 aa, Homo Sapiens
EAERLTLIQ

SEQ ID NO: 284966 - protein, 9 aa, Homo Sapiens
YTDAGGVTK

SEQ ID NO: 284967 - protein, 9 aa, Homo Sapiens
ENFLSVRGT

SEQ ID NO: 284968 - protein, 9 aa, Homo Sapiens
LYFFSDCIN

SEQ ID NO: 284969 - protein, 9 aa, Homo Sapiens
YLTSSKIMA

SEQ ID NO: 284970 - protein, 9 aa, Homo Sapiens
WQMADNIYN

SEQ ID NO: 284971 - protein, 9 aa, Homo Sapiens
QSVSVQEEK

SEQ ID NO: 284972 - protein, 9 aa, Homo Sapiens
FTQENYTVQ

SEQ ID NO: 284973 - protein, 9 aa, Homo Sapiens
VLHFDEAKD

SEQ ID NO: 284974 - protein, 9 aa, Homo Sapiens
SEADHYLTD

SEQ ID NO: 284975 - protein, 9 aa, Homo Sapiens
EKESDFEFL

SEQ ID NO: 284976 - protein, 9 aa, Homo Sapiens
KLGLHYFDH

SEQ ID NO: 284977 - protein, 9 aa, Homo Sapiens
GEDKLGEVY

SEQ ID NO: 284978 - protein, 9 aa, Homo Sapiens
GLETAHHWI

SEQ ID NO: 284979 - protein, 9 aa, Homo Sapiens
FDVQRKGTY

SEQ ID NO: 284980 - protein, 9 aa, Homo Sapiens
QTVVVYMPD

SEQ ID NO: 284981 - protein, 9 aa, Homo Sapiens
SFNLLSNTG

SEQ ID NO: 284982 - protein, 9 aa, Homo Sapiens
RSSSDPHLG

SEQ ID NO: 284983 - protein, 9 aa, Homo Sapiens
SSDRNDLSE

SEQ ID NO: 284984 - protein, 9 aa, Homo Sapiens
TGGRGKISK

SEQ ID NO: 284985 - protein, 9 aa, Homo Sapiens
TRERVHTGD

SEQ ID NO: 284986 - protein, 9 aa, Homo Sapiens
EKFNSRMNN

SEQ ID NO: 284987 - protein, 9 aa, Homo Sapiens
EPTLKNAII

SEQ ID NO: 284988 - protein, 9 aa, Homo Sapiens
GYGFSDPLT

SEQ ID NO: 284989 - protein, 9 aa, Homo Sapiens
QSRPQSFFA

SEQ ID NO: 284990 - protein, 9 aa, Homo Sapiens
EDALEVELG

SEQ ID NO: 284991 - protein, 9 aa, Homo Sapiens
PSYYHRFGM

SEQ ID NO: 284992 - protein, 9 aa, Homo Sapiens
GLSHAFIFF

SEQ ID NO: 284993 - protein, 9 aa, Homo Sapiens
QNVLILECD

SEQ ID NO: 284994 - protein, 9 aa, Homo Sapiens
EFLKGEVPQ

SEQ ID NO: 284995 - protein, 9 aa, Homo Sapiens
ENAASPDNE

SEQ ID NO: 284996 - protein, 9 aa, Homo Sapiens
CLKSRPFWG

SEQ ID NO: 284997 - protein, 9 aa, Homo Sapiens
KGIIYSILK

SEQ ID NO: 284998 - protein, 9 aa, Homo Sapiens
ELSIELENV

SEQ ID NO: 284999 - protein, 9 aa, Homo Sapiens
KHFSLLYTI

SEQ ID NO: 285000 - protein, 9 aa, Homo Sapiens
AFKFRVGAT

SEQ ID NO: 285001 - protein, 9 aa, Homo Sapiens
TSLSGVAQN

SEQ ID NO: 285002 - protein, 9 aa, Homo Sapiens
VLYKLCYFT

SEQ ID NO: 285003 - protein, 9 aa, Homo Sapiens
HHALQDKKA

SEQ ID NO: 285004 - protein, 9 aa, Homo Sapiens
FWPDQSIKY

SEQ ID NO: 285005 - protein, 9 aa, Homo Sapiens
PSYFRRFTL

SEQ ID NO: 285006 - protein, 9 aa, Homo Sapiens
YVTGMGWDG

SEQ ID NO: 285007 - protein, 9 aa, Homo Sapiens
HHRVVIGKN

SEQ ID NO: 285008 - protein, 9 aa, Homo Sapiens
EILDLNDNY

SEQ ID NO: 285009 - protein, 9 aa, Homo Sapiens
PVAPVMPLD

SEQ ID NO: 285010 - protein, 9 aa, Homo Sapiens
VKEIHGQLK

SEQ ID NO: 285011 - protein, 9 aa, Homo Sapiens
LACTDLEQG

SEQ ID NO: 285012 - protein, 9 aa, Homo Sapiens
ETKKKKKKN

SEQ ID NO: 285013 - protein, 9 aa, Homo Sapiens
PDDSALQEF

SEQ ID NO: 285014 - protein, 9 aa, Homo Sapiens
NTTILCVGP

SEQ ID NO: 285015 - protein, 9 aa, Homo Sapiens
ANLTTHKII

SEQ ID NO: 285016 - protein, 9 aa, Homo Sapiens
NLRKDKSKV

SEQ ID NO: 285017 - protein, 9 aa, Homo Sapiens
DKKKGTVPW

SEQ ID NO: 285018 - protein, 9 aa, Homo Sapiens
FRATDCFGG

SEQ ID NO: 285019 - protein, 9 aa, Homo Sapiens
SILVHANTP

SEQ ID NO: 285020 - protein, 9 aa, Homo Sapiens
TSMLSPNSY

SEQ ID NO: 285021 - protein, 9 aa, Homo Sapiens
TLLHHFRPN

SEQ ID NO: 285022 - protein, 9 aa, Homo Sapiens
LILDAPDLG

SEQ ID NO: 285023 - protein, 9 aa, Homo Sapiens
LDASEVEKE

SEQ ID NO: 285024 - protein, 9 aa, Homo Sapiens
ADLDNIFDW

SEQ ID NO: 285025 - protein, 9 aa, Homo Sapiens
WWFTSFFHS

SEQ ID NO: 285026 - protein, 9 aa, Homo Sapiens
LVNRDSIFR

SEQ ID NO: 285027 - protein, 9 aa, Homo Sapiens
SLRHRDNNK

SEQ ID NO: 285028 - protein, 9 aa, Homo Sapiens
CSSSSQTID

SEQ ID NO: 285029 - protein, 9 aa, Homo Sapiens
WKSPLGTVK

SEQ ID NO: 285030 - protein, 9 aa, Homo Sapiens
KQQEKIELM

SEQ ID NO: 285031 - protein, 9 aa, Homo Sapiens
RTGVEFTKH

SEQ ID NO: 285032 - protein, 9 aa, Homo Sapiens
SIRVSAFTN

SEQ ID NO: 285033 - protein, 9 aa, Homo Sapiens
EDSASESLG

SEQ ID NO: 285034 - protein, 9 aa, Homo Sapiens
LLLALLMFA

SEQ ID NO: 285035 - protein, 9 aa, Homo Sapiens
WIYFVRGAK

SEQ ID NO: 285036 - protein, 9 aa, Homo Sapiens
VCLGTFFIS

SEQ ID NO: 285037 - protein, 9 aa, Homo Sapiens
GPAVQREER

SEQ ID NO: 285038 - protein, 9 aa, Homo Sapiens
GESVWLNLR

SEQ ID NO: 285039 - protein, 9 aa, Homo Sapiens
VISISYICI

SEQ ID NO: 285040 - protein, 9 aa, Homo Sapiens
ASIMSSLTS

SEQ ID NO: 285041 - protein, 9 aa, Homo Sapiens
CWFPLYYEL

SEQ ID NO: 285042 - protein, 9 aa, Homo Sapiens
TISEGQKYS

SEQ ID NO: 285043 - protein, 9 aa, Homo Sapiens
KYGDEINKR

SEQ ID NO: 285044 - protein, 9 aa, Homo Sapiens
NTTQIFNVY

SEQ ID NO: 285045 - protein, 9 aa, Homo Sapiens
KICLWEVSE

SEQ ID NO: 285046 - protein, 9 aa, Homo Sapiens
REIWNQTSA

SEQ ID NO: 285047 - protein, 9 aa, Homo Sapiens
ESSVHWPIF

SEQ ID NO: 285048 - protein, 9 aa, Homo Sapiens
WHSVMYKSV

SEQ ID NO: 285049 - protein, 9 aa, Homo Sapiens
LLATKAMLN

SEQ ID NO: 285050 - protein, 9 aa, Homo Sapiens
VNSCHSCTC

SEQ ID NO: 285051 - protein, 9 aa, Homo Sapiens
QVHLQKVKG

SEQ ID NO: 285052 - protein, 9 aa, Homo Sapiens
NCLPHLKNK

SEQ ID NO: 285053 - protein, 9 aa, Homo Sapiens
YIKNFGEYM

SEQ ID NO: 285054 - protein, 9 aa, Homo Sapiens
YGLDSRGEI

SEQ ID NO: 285055 - protein, 9 aa, Homo Sapiens
DTPRLIKNL

SEQ ID NO: 285056 - protein, 9 aa, Homo Sapiens
LDRINASSR

SEQ ID NO: 285057 - protein, 9 aa, Homo Sapiens
RFTDNSQLH

SEQ ID NO: 285058 - protein, 9 aa, Homo Sapiens
SVSDHLGHS

SEQ ID NO: 285059 - protein, 9 aa, Homo Sapiens
TSCKHVVWK

SEQ ID NO: 285060 - protein, 9 aa, Homo Sapiens
ECEVYLEYL

SEQ ID NO: 285061 - protein, 9 aa, Homo Sapiens
IFTPFFLWM

SEQ ID NO: 285062 - protein, 9 aa, Homo Sapiens
TSKDVCSQS

SEQ ID NO: 285063 - protein, 9 aa, Homo Sapiens
VPINITGEK

SEQ ID NO: 285064 - protein, 9 aa, Homo Sapiens
KQYMHFQNV

SEQ ID NO: 285065 - protein, 9 aa, Homo Sapiens
DFKQELRQK

SEQ ID NO: 285066 - protein, 9 aa, Homo Sapiens
NFKDLMPKL

SEQ ID NO: 285067 - protein, 9 aa, Homo Sapiens
TASVTFRAT

SEQ ID NO: 285068 - protein, 9 aa, Homo Sapiens
IIGKADPNS

SEQ ID NO: 285069 - protein, 9 aa, Homo Sapiens
SLSFFTTSL

SEQ ID NO: 285070 - protein, 9 aa, Homo Sapiens
FILVGYVDS

SEQ ID NO: 285071 - protein, 9 aa, Homo Sapiens
GIADFFNVI

SEQ ID NO: 285072 - protein, 9 aa, Homo Sapiens
LKLKSFCTA

SEQ ID NO: 285073 - protein, 9 aa, Homo Sapiens
IEPLFQYQI

SEQ ID NO: 285074 - protein, 9 aa, Homo Sapiens
EGRVPVSRS

SEQ ID NO: 285075 - protein, 9 aa, Homo Sapiens
MMGNVGMIL

SEQ ID NO: 285076 - protein, 9 aa, Homo Sapiens
ITLITELCK

SEQ ID NO: 285077 - protein, 9 aa, Homo Sapiens
NSQSEDSGG

SEQ ID NO: 285078 - protein, 9 aa, Homo Sapiens
MKNMNQSRM

SEQ ID NO: 285079 - protein, 9 aa, Homo Sapiens
NRFSYLTQH

SEQ ID NO: 285080 - protein, 9 aa, Homo Sapiens
YKEGDLRTM

SEQ ID NO: 285081 - protein, 9 aa, Homo Sapiens
ESVADIFDC

SEQ ID NO: 285082 - protein, 9 aa, Homo Sapiens
ICRLNWSDS

SEQ ID NO: 285083 - protein, 9 aa, Homo Sapiens
NLQTAPTLS

SEQ ID NO: 285084 - protein, 9 aa, Homo Sapiens
TLFASLNFV

SEQ ID NO: 285085 - protein, 9 aa, Homo Sapiens
LCRHNGSMV

SEQ ID NO: 285086 - protein, 9 aa, Homo Sapiens
SKRSPIINV

SEQ ID NO: 285087 - protein, 9 aa, Homo Sapiens
WLALYSTRF

SEQ ID NO: 285088 - protein, 9 aa, Homo Sapiens
HVTHAFHAA

SEQ ID NO: 285089 - protein, 9 aa, Homo Sapiens
IGMKGLIFD

SEQ ID NO: 285090 - protein, 9 aa, Homo Sapiens
SKYQLLNHS

SEQ ID NO: 285091 - protein, 9 aa, Homo Sapiens
QDFEHSDVD

SEQ ID NO: 285092 - protein, 9 aa, Homo Sapiens
WSGRELIEN

SEQ ID NO: 285093 - protein, 9 aa, Homo Sapiens
ERVEAFLRP

SEQ ID NO: 285094 - protein, 9 aa, Homo Sapiens
ENFQCLNCS

SEQ ID NO: 285095 - protein, 9 aa, Homo Sapiens
INQKMRPGY

SEQ ID NO: 285096 - protein, 9 aa, Homo Sapiens
LRKFQEEIR

SEQ ID NO: 285097 - protein, 9 aa, Homo Sapiens
ARSKALSAF

SEQ ID NO: 285098 - protein, 9 aa, Homo Sapiens
EITPQKNVQ

SEQ ID NO: 285099 - protein, 9 aa, Homo Sapiens
NRYDITNNS

SEQ ID NO: 285100 - protein, 9 aa, Homo Sapiens
LLFYFNNIL

SEQ ID NO: 285101 - protein, 9 aa, Homo Sapiens
YNKLTKTCF

SEQ ID NO: 285102 - protein, 9 aa, Homo Sapiens
QTPVVRPAH

SEQ ID NO: 285103 - protein, 9 aa, Homo Sapiens
VVQHTPEEE

SEQ ID NO: 285104 - protein, 9 aa, Homo Sapiens
KTDPLEHEL

SEQ ID NO: 285105 - protein, 9 aa, Homo Sapiens
PAWGSKEMG

SEQ ID NO: 285106 - protein, 9 aa, Homo Sapiens
AQKKRLNII

SEQ ID NO: 285107 - protein, 9 aa, Homo Sapiens
LYYLVFTVG

SEQ ID NO: 285108 - protein, 9 aa, Homo Sapiens
METLNSFIS

SEQ ID NO: 285109 - protein, 9 aa, Homo Sapiens
SSGAVESAL

SEQ ID NO: 285110 - protein, 9 aa, Homo Sapiens
ESYQIRYRA

SEQ ID NO: 285111 - protein, 9 aa, Homo Sapiens
DSSRPETLD

SEQ ID NO: 285112 - protein, 9 aa, Homo Sapiens
HLCCICGGN

SEQ ID NO: 285113 - protein, 9 aa, Homo Sapiens
GTSGPDLTT

SEQ ID NO: 285114 - protein, 9 aa, Homo Sapiens
SGKTLGKQH

SEQ ID NO: 285115 - protein, 9 aa, Homo Sapiens
QSQDETEQN

SEQ ID NO: 285116 - protein, 9 aa, Homo Sapiens
TPSCNRARP

SEQ ID NO: 285117 - protein, 9 aa, Homo Sapiens
AVTDRCLQV

SEQ ID NO: 285118 - protein, 9 aa, Homo Sapiens
REAENVCSQ

SEQ ID NO: 285119 - protein, 9 aa, Homo Sapiens
CIACFYGRI

SEQ ID NO: 285120 - protein, 9 aa, Homo Sapiens
RWDIIDLED

SEQ ID NO: 285121 - protein, 9 aa, Homo Sapiens
KTEYIDGLE

SEQ ID NO: 285122 - protein, 9 aa, Homo Sapiens
FGNLVETNS

SEQ ID NO: 285123 - protein, 9 aa, Homo Sapiens
PDAHSDYAH

SEQ ID NO: 285124 - protein, 9 aa, Homo Sapiens
VESYQIRYR

SEQ ID NO: 285125 - protein, 9 aa, Homo Sapiens
KTSLAHQSV

SEQ ID NO: 285126 - protein, 9 aa, Homo Sapiens
PYECDECGT

SEQ ID NO: 285127 - protein, 9 aa, Homo Sapiens
SWKLAPALA

SEQ ID NO: 285128 - protein, 9 aa, Homo Sapiens
ERGEARIQQ

SEQ ID NO: 285129 - protein, 9 aa, Homo Sapiens
PDNSVRAHT

SEQ ID NO: 285130 - protein, 9 aa, Homo Sapiens
RHAAVHDPD

SEQ ID NO: 285131 - protein, 9 aa, Homo Sapiens
ADGQAESII

SEQ ID NO: 285132 - protein, 9 aa, Homo Sapiens
QRLQGNDLL

SEQ ID NO: 285133 - protein, 9 aa, Homo Sapiens
FCNAKVPSG

SEQ ID NO: 285134 - protein, 9 aa, Homo Sapiens
ASEQPENAA

SEQ ID NO: 285135 - protein, 9 aa, Homo Sapiens
QVYRWVREK

SEQ ID NO: 285136 - protein, 9 aa, Homo Sapiens
ECKGFSYFG

SEQ ID NO: 285137 - protein, 9 aa, Homo Sapiens
IANIFEIQT

SEQ ID NO: 285138 - protein, 9 aa, Homo Sapiens
SSNSYQSLA

SEQ ID NO: 285139 - protein, 9 aa, Homo Sapiens
GTSQRDDAP

SEQ ID NO: 285140 - protein, 9 aa, Homo Sapiens
LEMKCQKIQ

SEQ ID NO: 285141 - protein, 9 aa, Homo Sapiens
MGFMLMYDI

SEQ ID NO: 285142 - protein, 9 aa, Homo Sapiens
ETYCMCQDK

SEQ ID NO: 285143 - protein, 9 aa, Homo Sapiens
SSSLKLNDF

SEQ ID NO: 285144 - protein, 9 aa, Homo Sapiens
LGPSHTQCI

SEQ ID NO: 285145 - protein, 9 aa, Homo Sapiens
SVRERKKEG

SEQ ID NO: 285146 - protein, 9 aa, Homo Sapiens
LQYVQRPLR

SEQ ID NO: 285147 - protein, 9 aa, Homo Sapiens
SSADLQIRK

SEQ ID NO: 285148 - protein, 9 aa, Homo Sapiens
KGVKCMPYT

SEQ ID NO: 285149 - protein, 9 aa, Homo Sapiens
RSGKTLGKQ

SEQ ID NO: 285150 - protein, 9 aa, Homo Sapiens
NDKKSALQL

SEQ ID NO: 285151 - protein, 9 aa, Homo Sapiens
GGMITSLIS

SEQ ID NO: 285152 - protein, 9 aa, Homo Sapiens
RRRYNINYQ

SEQ ID NO: 285153 - protein, 9 aa, Homo Sapiens
TCLCFLLLS

SEQ ID NO: 285154 - protein, 9 aa, Homo Sapiens
DDTSVIDYD

SEQ ID NO: 285155 - protein, 9 aa, Homo Sapiens
ETLDAKEMQ

SEQ ID NO: 285156 - protein, 9 aa, Homo Sapiens
YQASRMSFC

SEQ ID NO: 285157 - protein, 9 aa, Homo Sapiens
GLQTHCYRA

SEQ ID NO: 285158 - protein, 9 aa, Homo Sapiens
EESIVTLLD

SEQ ID NO: 285159 - protein, 9 aa, Homo Sapiens
YPMVSPPPD

SEQ ID NO: 285160 - protein, 9 aa, Homo Sapiens
RFSYLTQHK

SEQ ID NO: 285161 - protein, 9 aa, Homo Sapiens
CSRSRSQLS

SEQ ID NO: 285162 - protein, 9 aa, Homo Sapiens
LHYLLCDDT

SEQ ID NO: 285163 - protein, 9 aa, Homo Sapiens
EVIKQLRHP

SEQ ID NO: 285164 - protein, 9 aa, Homo Sapiens
NKVLISLLE

SEQ ID NO: 285165 - protein, 9 aa, Homo Sapiens
HKKNEENFS

SEQ ID NO: 285166 - protein, 9 aa, Homo Sapiens
LSILDLSET

SEQ ID NO: 285167 - protein, 9 aa, Homo Sapiens
LPCNHVFHT

SEQ ID NO: 285168 - protein, 9 aa, Homo Sapiens
EDINGILER

SEQ ID NO: 285169 - protein, 9 aa, Homo Sapiens
RLLPSIGVS

SEQ ID NO: 285170 - protein, 9 aa, Homo Sapiens
MRIWAAGCC

SEQ ID NO: 285171 - protein, 9 aa, Homo Sapiens
KVVAANDIK

SEQ ID NO: 285172 - protein, 9 aa, Homo Sapiens
VTRRLPEDY

SEQ ID NO: 285173 - protein, 9 aa, Homo Sapiens
VIASRQYTV

SEQ ID NO: 285174 - protein, 9 aa, Homo Sapiens
NALSDVVNY

SEQ ID NO: 285175 - protein, 9 aa, Homo Sapiens
TLDLIDVLL

SEQ ID NO: 285176 - protein, 9 aa, Homo Sapiens
STISYISRT

SEQ ID NO: 285177 - protein, 9 aa, Homo Sapiens
DHNSGLIRD

SEQ ID NO: 285178 - protein, 9 aa, Homo Sapiens
DENFKQCFR

SEQ ID NO: 285179 - protein, 9 aa, Homo Sapiens
ASWKLAPAL

SEQ ID NO: 285180 - protein, 9 aa, Homo Sapiens
ITTHTTLEH

SEQ ID NO: 285181 - protein, 9 aa, Homo Sapiens
LVPPPWPSR

SEQ ID NO: 285182 - protein, 9 aa, Homo Sapiens
LLTVFSDTS

SEQ ID NO: 285183 - protein, 9 aa, Homo Sapiens
EGVLGLVHA

SEQ ID NO: 285184 - protein, 9 aa, Homo Sapiens
VTATYTRHP

SEQ ID NO: 285185 - protein, 9 aa, Homo Sapiens
TNNKYESKN

SEQ ID NO: 285186 - protein, 9 aa, Homo Sapiens
DADIEDLKA

SEQ ID NO: 285187 - protein, 9 aa, Homo Sapiens
VQHLGALRW

SEQ ID NO: 285188 - protein, 9 aa, Homo Sapiens
RIEMFQNMQ

SEQ ID NO: 285189 - protein, 9 aa, Homo Sapiens
LSGLPTGEV

SEQ ID NO: 285190 - protein, 9 aa, Homo Sapiens
GLMVLPFSA

SEQ ID NO: 285191 - protein, 9 aa, Homo Sapiens
YPPYTEWNQ

SEQ ID NO: 285192 - protein, 9 aa, Homo Sapiens
GDEKGVVLC

SEQ ID NO: 285193 - protein, 9 aa, Homo Sapiens
VMLASIMSS

SEQ ID NO: 285194 - protein, 9 aa, Homo Sapiens
VHICGMNEH

SEQ ID NO: 285195 - protein, 9 aa, Homo Sapiens
HYLPDMDPG

SEQ ID NO: 285196 - protein, 9 aa, Homo Sapiens
GSLCLRYAA

SEQ ID NO: 285197 - protein, 9 aa, Homo Sapiens
NAKVPSGIS

SEQ ID NO: 285198 - protein, 9 aa, Homo Sapiens
RALSPASRW

SEQ ID NO: 285199 - protein, 9 aa, Homo Sapiens
QHILAAMIA

SEQ ID NO: 285200 - protein, 9 aa, Homo Sapiens
ATIHENIGV

SEQ ID NO: 285201 - protein, 9 aa, Homo Sapiens
AKVSACHFL

SEQ ID NO: 285202 - protein, 9 aa, Homo Sapiens
KPPPEALAA

SEQ ID NO: 285203 - protein, 9 aa, Homo Sapiens
SGQKYFKCE

SEQ ID NO: 285204 - protein, 9 aa, Homo Sapiens
AAIRSILYK

SEQ ID NO: 285205 - protein, 9 aa, Homo Sapiens
HLEPFKALL

SEQ ID NO: 285206 - protein, 9 aa, Homo Sapiens
IFLSSQFGF

SEQ ID NO: 285207 - protein, 9 aa, Homo Sapiens
LSYYYTDNH

SEQ ID NO: 285208 - protein, 9 aa, Homo Sapiens
LLEPSVNIE

SEQ ID NO: 285209 - protein, 9 aa, Homo Sapiens
YLTKDSCFL

SEQ ID NO: 285210 - protein, 9 aa, Homo Sapiens
TFKQKMFMS

SEQ ID NO: 285211 - protein, 9 aa, Homo Sapiens
DKPEDVLTS

SEQ ID NO: 285212 - protein, 9 aa, Homo Sapiens
ILGFSVGEK

SEQ ID NO: 285213 - protein, 9 aa, Homo Sapiens
HLHNNFLLG

SEQ ID NO: 285214 - protein, 9 aa, Homo Sapiens
FCDNIIVSS

SEQ ID NO: 285215 - protein, 9 aa, Homo Sapiens
LGSGTTAEN

SEQ ID NO: 285216 - protein, 9 aa, Homo Sapiens
TGSFNLLSN

SEQ ID NO: 285217 - protein, 9 aa, Homo Sapiens
THDSGIVMQ

SEQ ID NO: 285218 - protein, 9 aa, Homo Sapiens
AQKCLKGAA

SEQ ID NO: 285219 - protein, 9 aa, Homo Sapiens
SRNKNYKAE

SEQ ID NO: 285220 - protein, 9 aa, Homo Sapiens
DDFLGMLNQ

SEQ ID NO: 285221 - protein, 9 aa, Homo Sapiens
KQSRTNLSY

SEQ ID NO: 285222 - protein, 9 aa, Homo Sapiens
FNVLVLPVS

SEQ ID NO: 285223 - protein, 9 aa, Homo Sapiens
ENTTTGISQ

SEQ ID NO: 285224 - protein, 9 aa, Homo Sapiens
LMCPNECVV

SEQ ID NO: 285225 - protein, 9 aa, Homo Sapiens
SQILFPVAF

SEQ ID NO: 285226 - protein, 9 aa, Homo Sapiens
RKCNWKMGH

SEQ ID NO: 285227 - protein, 9 aa, Homo Sapiens
SLTGNTLSS

SEQ ID NO: 285228 - protein, 9 aa, Homo Sapiens
TSKEEANFV

SEQ ID NO: 285229 - protein, 9 aa, Homo Sapiens
VTSSVCYYS

SEQ ID NO: 285230 - protein, 9 aa, Homo Sapiens
PKYNVDNVP

SEQ ID NO: 285231 - protein, 9 aa, Homo Sapiens
TNHVTIPKE

SEQ ID NO: 285232 - protein, 9 aa, Homo Sapiens
SEIPEDSDQ

SEQ ID NO: 285233 - protein, 9 aa, Homo Sapiens
EKDKHSILI

SEQ ID NO: 285234 - protein, 9 aa, Homo Sapiens
DHIKRKDLS

SEQ ID NO: 285235 - protein, 9 aa, Homo Sapiens
FIAGLFPPQ

SEQ ID NO: 285236 - protein, 9 aa, Homo Sapiens
NQEIESMEE

SEQ ID NO: 285237 - protein, 9 aa, Homo Sapiens
YSDHGEDEV

SEQ ID NO: 285238 - protein, 9 aa, Homo Sapiens
WNYRLPAGR

SEQ ID NO: 285239 - protein, 9 aa, Homo Sapiens
KAFNRLSYL

SEQ ID NO: 285240 - protein, 9 aa, Homo Sapiens
LGLTQITNT

SEQ ID NO: 285241 - protein, 9 aa, Homo Sapiens
RSLLALPQY

SEQ ID NO: 285242 - protein, 9 aa, Homo Sapiens
SIPTFLLQS

SEQ ID NO: 285243 - protein, 9 aa, Homo Sapiens
ECVVSEWGL

SEQ ID NO: 285244 - protein, 9 aa, Homo Sapiens
NLDPNLSFE

SEQ ID NO: 285245 - protein, 9 aa, Homo Sapiens
NLVTGSPRL

SEQ ID NO: 285246 - protein, 9 aa, Homo Sapiens
FGFSNACEK

SEQ ID NO: 285247 - protein, 9 aa, Homo Sapiens
NGSKDKEKY

SEQ ID NO: 285248 - protein, 9 aa, Homo Sapiens
EDVQDYSEN

SEQ ID NO: 285249 - protein, 9 aa, Homo Sapiens
GGVQRGGGR

SEQ ID NO: 285250 - protein, 9 aa, Homo Sapiens
FLPSLSQSP

SEQ ID NO: 285251 - protein, 9 aa, Homo Sapiens
VTFTYHTRP

SEQ ID NO: 285252 - protein, 9 aa, Homo Sapiens
NVVFGNNGT

SEQ ID NO: 285253 - protein, 9 aa, Homo Sapiens
GFSVGEKCA

SEQ ID NO: 285254 - protein, 9 aa, Homo Sapiens
YVFSTHPVS

SEQ ID NO: 285255 - protein, 9 aa, Homo Sapiens
TIDSLEEVL

SEQ ID NO: 285256 - protein, 9 aa, Homo Sapiens
GSMEVKANA

SEQ ID NO: 285257 - protein, 9 aa, Homo Sapiens
EGRLQEFLA

SEQ ID NO: 285258 - protein, 9 aa, Homo Sapiens
GHPDVATLL

SEQ ID NO: 285259 - protein, 9 aa, Homo Sapiens
LHPLHKIEA

SEQ ID NO: 285260 - protein, 9 aa, Homo Sapiens
QSKEHFRGL

SEQ ID NO: 285261 - protein, 9 aa, Homo Sapiens
RLQTLLGDN

SEQ ID NO: 285262 - protein, 9 aa, Homo Sapiens
TVQTEGAEA

SEQ ID NO: 285263 - protein, 9 aa, Homo Sapiens
EDATVFASA

SEQ ID NO: 285264 - protein, 9 aa, Homo Sapiens
NLVRLLLNN

SEQ ID NO: 285265 - protein, 9 aa, Homo Sapiens
TEEVFRGHE

SEQ ID NO: 285266 - protein, 9 aa, Homo Sapiens
VIFTDCKVV

SEQ ID NO: 285267 - protein, 9 aa, Homo Sapiens
EGMGVIPRI

SEQ ID NO: 285268 - protein, 9 aa, Homo Sapiens
MGTLSGTAE

SEQ ID NO: 285269 - protein, 9 aa, Homo Sapiens
DRLRILPCS

SEQ ID NO: 285270 - protein, 9 aa, Homo Sapiens
NPDVPHDFG

SEQ ID NO: 285271 - protein, 9 aa, Homo Sapiens
GYILEKSSK

SEQ ID NO: 285272 - protein, 9 aa, Homo Sapiens
TNFYSSQGI

SEQ ID NO: 285273 - protein, 9 aa, Homo Sapiens
QSAGKNKNN

SEQ ID NO: 285274 - protein, 9 aa, Homo Sapiens
VPGILSFLT

SEQ ID NO: 285275 - protein, 9 aa, Homo Sapiens
GEDWERTKV

SEQ ID NO: 285276 - protein, 9 aa, Homo Sapiens
FRSMQDDWK

SEQ ID NO: 285277 - protein, 9 aa, Homo Sapiens
SRLINTFSL

SEQ ID NO: 285278 - protein, 9 aa, Homo Sapiens
MIQLHSKRD

SEQ ID NO: 285279 - protein, 9 aa, Homo Sapiens
VLQNHLQEI

SEQ ID NO: 285280 - protein, 9 aa, Homo Sapiens
VRRVFIVDS

SEQ ID NO: 285281 - protein, 9 aa, Homo Sapiens
DSFLQVEIS

SEQ ID NO: 285282 - protein, 9 aa, Homo Sapiens
ICMSVNGLF

SEQ ID NO: 285283 - protein, 9 aa, Homo Sapiens
GDFRIYSIR

SEQ ID NO: 285284 - protein, 9 aa, Homo Sapiens
SESKFIFRK

SEQ ID NO: 285285 - protein, 9 aa, Homo Sapiens
SSSDPHLGT

SEQ ID NO: 285286 - protein, 9 aa, Homo Sapiens
PPLHLEYRF

SEQ ID NO: 285287 - protein, 9 aa, Homo Sapiens
PFSECMIQV

SEQ ID NO: 285288 - protein, 9 aa, Homo Sapiens
RESEGDKKS

SEQ ID NO: 285289 - protein, 9 aa, Homo Sapiens
FNYVNHEFA

SEQ ID NO: 285290 - protein, 9 aa, Homo Sapiens
LQMATYLDR

SEQ ID NO: 285291 - protein, 9 aa, Homo Sapiens
EIANPCSNI

SEQ ID NO: 285292 - protein, 9 aa, Homo Sapiens
KNLKYYRPR

SEQ ID NO: 285293 - protein, 9 aa, Homo Sapiens
KGRDSSSDT

SEQ ID NO: 285294 - protein, 9 aa, Homo Sapiens
YDLLRLFEH

SEQ ID NO: 285295 - protein, 9 aa, Homo Sapiens
HKALDEPAK

SEQ ID NO: 285296 - protein, 9 aa, Homo Sapiens
FSRSTTLTT

SEQ ID NO: 285297 - protein, 9 aa, Homo Sapiens
DSSFVSMYT

SEQ ID NO: 285298 - protein, 9 aa, Homo Sapiens
MTEEETQLR

SEQ ID NO: 285299 - protein, 9 aa, Homo Sapiens
LGTCANIKH

SEQ ID NO: 285300 - protein, 9 aa, Homo Sapiens
AGLHCQLLY

SEQ ID NO: 285301 - protein, 9 aa, Homo Sapiens
LLRTISTTL

SEQ ID NO: 285302 - protein, 9 aa, Homo Sapiens
ERLASVIPA

SEQ ID NO: 285303 - protein, 9 aa, Homo Sapiens
VSWIAGQAM

SEQ ID NO: 285304 - protein, 9 aa, Homo Sapiens
ERKYVADYY

SEQ ID NO: 285305 - protein, 9 aa, Homo Sapiens
GLALCHIAV

SEQ ID NO: 285306 - protein, 9 aa, Homo Sapiens
ENRENYPAG

SEQ ID NO: 285307 - protein, 9 aa, Homo Sapiens
LKRTPCPAS

SEQ ID NO: 285308 - protein, 9 aa, Homo Sapiens
NTDIAKELG

SEQ ID NO: 285309 - protein, 9 aa, Homo Sapiens
PPQTKALGN

SEQ ID NO: 285310 - protein, 9 aa, Homo Sapiens
GVALEINGL

SEQ ID NO: 285311 - protein, 9 aa, Homo Sapiens
VVREDNLEA

SEQ ID NO: 285312 - protein, 9 aa, Homo Sapiens
ANMMGPLAQ

SEQ ID NO: 285313 - protein, 9 aa, Homo Sapiens
VEQMAINWL

SEQ ID NO: 285314 - protein, 9 aa, Homo Sapiens
ANFLRVNRV

SEQ ID NO: 285315 - protein, 9 aa, Homo Sapiens
DAGIDFCSE

SEQ ID NO: 285316 - protein, 9 aa, Homo Sapiens
GCGKAFSQN

SEQ ID NO: 285317 - protein, 9 aa, Homo Sapiens
GEVRTWVKF

SEQ ID NO: 285318 - protein, 9 aa, Homo Sapiens
YIRIFCWFN

SEQ ID NO: 285319 - protein, 9 aa, Homo Sapiens
AFENYQPNM

SEQ ID NO: 285320 - protein, 9 aa, Homo Sapiens
SNGDKSDQN

SEQ ID NO: 285321 - protein, 9 aa, Homo Sapiens
EAAWALTHI

SEQ ID NO: 285322 - protein, 9 aa, Homo Sapiens
FYDWKRMEV

SEQ ID NO: 285323 - protein, 9 aa, Homo Sapiens
PTLIRHQNI

SEQ ID NO: 285324 - protein, 9 aa, Homo Sapiens
STPVPDGKK

SEQ ID NO: 285325 - protein, 9 aa, Homo Sapiens
TDTNNHQIK

SEQ ID NO: 285326 - protein, 9 aa, Homo Sapiens
TQNLITKMN

SEQ ID NO: 285327 - protein, 9 aa, Homo Sapiens
KRKKYKQED

SEQ ID NO: 285328 - protein, 9 aa, Homo Sapiens
LKAKVMQHI

SEQ ID NO: 285329 - protein, 9 aa, Homo Sapiens
CPTGFPGTD

SEQ ID NO: 285330 - protein, 9 aa, Homo Sapiens
LAMHIEKKL

SEQ ID NO: 285331 - protein, 9 aa, Homo Sapiens
HLSKVRSLT

SEQ ID NO: 285332 - protein, 9 aa, Homo Sapiens
IRCLQNPLD

SEQ ID NO: 285333 - protein, 9 aa, Homo Sapiens
DFENLLSKP

SEQ ID NO: 285334 - protein, 9 aa, Homo Sapiens
EGLIAVVTQ

SEQ ID NO: 285335 - protein, 9 aa, Homo Sapiens
LLQVLILNY

SEQ ID NO: 285336 - protein, 9 aa, Homo Sapiens
PKELFERKS

SEQ ID NO: 285337 - protein, 9 aa, Homo Sapiens
SFAFTPIYS

SEQ ID NO: 285338 - protein, 9 aa, Homo Sapiens
SHMFDISAV

SEQ ID NO: 285339 - protein, 9 aa, Homo Sapiens
ATLFTLDYF

SEQ ID NO: 285340 - protein, 9 aa, Homo Sapiens
KVWLPSKHI

SEQ ID NO: 285341 - protein, 9 aa, Homo Sapiens
GVDNMVLLS

SEQ ID NO: 285342 - protein, 9 aa, Homo Sapiens
LGEITEKSL

SEQ ID NO: 285343 - protein, 9 aa, Homo Sapiens
RLVKEAAVI

SEQ ID NO: 285344 - protein, 9 aa, Homo Sapiens
HHYHLTCGC

SEQ ID NO: 285345 - protein, 9 aa, Homo Sapiens
SFQESKRAI

SEQ ID NO: 285346 - protein, 9 aa, Homo Sapiens
TGSGIYAPT

SEQ ID NO: 285347 - protein, 9 aa, Homo Sapiens
LSEQHRNCA

SEQ ID NO: 285348 - protein, 9 aa, Homo Sapiens
CGPNHIQHV

SEQ ID NO: 285349 - protein, 9 aa, Homo Sapiens
VVTLLEYHE

SEQ ID NO: 285350 - protein, 9 aa, Homo Sapiens
KLSPFSTIR

SEQ ID NO: 285351 - protein, 9 aa, Homo Sapiens
VLIAQDKMA

SEQ ID NO: 285352 - protein, 9 aa, Homo Sapiens
GDLQKVLLY

SEQ ID NO: 285353 - protein, 9 aa, Homo Sapiens
CQAWKGSVS

SEQ ID NO: 285354 - protein, 9 aa, Homo Sapiens
DNSAEKQAK

SEQ ID NO: 285355 - protein, 9 aa, Homo Sapiens
LYVGRDKKL

SEQ ID NO: 285356 - protein, 9 aa, Homo Sapiens
IQITHSINN

SEQ ID NO: 285357 - protein, 9 aa, Homo Sapiens
ETFTEDPHL

SEQ ID NO: 285358 - protein, 9 aa, Homo Sapiens
KFCRSRVPV

SEQ ID NO: 285359 - protein, 9 aa, Homo Sapiens
GDEVPYVLV

SEQ ID NO: 285360 - protein, 9 aa, Homo Sapiens
KENFNQTLT

SEQ ID NO: 285361 - protein, 9 aa, Homo Sapiens
GNGKTFLEK

SEQ ID NO: 285362 - protein, 9 aa, Homo Sapiens
LFKIMKTLT

SEQ ID NO: 285363 - protein, 9 aa, Homo Sapiens
CIYECIWNK

SEQ ID NO: 285364 - protein, 9 aa, Homo Sapiens
GIFYCCLSK

SEQ ID NO: 285365 - protein, 9 aa, Homo Sapiens
MVGEGIFYC

SEQ ID NO: 285366 - protein, 9 aa, Homo Sapiens
KVWEYTMLR

SEQ ID NO: 285367 - protein, 9 aa, Homo Sapiens
FGRSECFLL

SEQ ID NO: 285368 - protein, 9 aa, Homo Sapiens
KENNFLPFQ

SEQ ID NO: 285369 - protein, 9 aa, Homo Sapiens
DLSVQYPPD

SEQ ID NO: 285370 - protein, 9 aa, Homo Sapiens
EKIAETDLE

SEQ ID NO: 285371 - protein, 9 aa, Homo Sapiens
LLCRSMRLL

SEQ ID NO: 285372 - protein, 9 aa, Homo Sapiens
SLIDVFMGF

SEQ ID NO: 285373 - protein, 9 aa, Homo Sapiens
GLDKVHLEP

SEQ ID NO: 285374 - protein, 9 aa, Homo Sapiens
SAVSHAGSK

SEQ ID NO: 285375 - protein, 9 aa, Homo Sapiens
LVQEEYLQR

SEQ ID NO: 285376 - protein, 9 aa, Homo Sapiens
YCGKIISSD

SEQ ID NO: 285377 - protein, 9 aa, Homo Sapiens
VLVFVNPYQ

SEQ ID NO: 285378 - protein, 9 aa, Homo Sapiens
SVFTLVVIA

SEQ ID NO: 285379 - protein, 9 aa, Homo Sapiens
QIQKVDVYD

SEQ ID NO: 285380 - protein, 9 aa, Homo Sapiens
LQDTKSTDQ

SEQ ID NO: 285381 - protein, 9 aa, Homo Sapiens
GLKCATGDI

SEQ ID NO: 285382 - protein, 9 aa, Homo Sapiens
SVLCHGIPD

SEQ ID NO: 285383 - protein, 9 aa, Homo Sapiens
YGDIIQQDF

SEQ ID NO: 285384 - protein, 9 aa, Homo Sapiens
VDEGLVKVI

SEQ ID NO: 285385 - protein, 9 aa, Homo Sapiens
SFKDKMENF

SEQ ID NO: 285386 - protein, 9 aa, Homo Sapiens
WQKIISSLD

SEQ ID NO: 285387 - protein, 9 aa, Homo Sapiens
PTSKREHWF

SEQ ID NO: 285388 - protein, 9 aa, Homo Sapiens
NTIFLFFKP

SEQ ID NO: 285389 - protein, 9 aa, Homo Sapiens
DKKPYCQKD

SEQ ID NO: 285390 - protein, 9 aa, Homo Sapiens
APESSTCST

SEQ ID NO: 285391 - protein, 9 aa, Homo Sapiens
FNVDHGICI

SEQ ID NO: 285392 - protein, 9 aa, Homo Sapiens
PSDSGLSDP

SEQ ID NO: 285393 - protein, 9 aa, Homo Sapiens
DKPHDILGI

SEQ ID NO: 285394 - protein, 9 aa, Homo Sapiens
VKVSPLQQS

SEQ ID NO: 285395 - protein, 9 aa, Homo Sapiens
AAQMKTLKP

SEQ ID NO: 285396 - protein, 9 aa, Homo Sapiens
ADSLPPSMS

SEQ ID NO: 285397 - protein, 9 aa, Homo Sapiens
QFGSWFGHI

SEQ ID NO: 285398 - protein, 9 aa, Homo Sapiens
PQKVLFRFC

SEQ ID NO: 285399 - protein, 9 aa, Homo Sapiens
HILEAMLYA

SEQ ID NO: 285400 - protein, 9 aa, Homo Sapiens
GVVLFSMFL

SEQ ID NO: 285401 - protein, 9 aa, Homo Sapiens
LSETKDVFQ

SEQ ID NO: 285402 - protein, 9 aa, Homo Sapiens
EQISHKRSE

SEQ ID NO: 285403 - protein, 9 aa, Homo Sapiens
REQEKHIKC

SEQ ID NO: 285404 - protein, 9 aa, Homo Sapiens
LSETYLEKD

SEQ ID NO: 285405 - protein, 9 aa, Homo Sapiens
DQGIWIQLD

SEQ ID NO: 285406 - protein, 9 aa, Homo Sapiens
KVTLICSAR

SEQ ID NO: 285407 - protein, 9 aa, Homo Sapiens
KPKKSVNAK

SEQ ID NO: 285408 - protein, 9 aa, Homo Sapiens
DKNCEPVVP

SEQ ID NO: 285409 - protein, 9 aa, Homo Sapiens
FKKVSYFVF

SEQ ID NO: 285410 - protein, 9 aa, Homo Sapiens
SEDNITEFQ

SEQ ID NO: 285411 - protein, 9 aa, Homo Sapiens
HKKKILNKE

SEQ ID NO: 285412 - protein, 9 aa, Homo Sapiens
TAIIVSIFQ

SEQ ID NO: 285413 - protein, 9 aa, Homo Sapiens
DEAYLRQIK

SEQ ID NO: 285414 - protein, 9 aa, Homo Sapiens
HTMSRSKKF

SEQ ID NO: 285415 - protein, 9 aa, Homo Sapiens
LPFVIFLLL

SEQ ID NO: 285416 - protein, 9 aa, Homo Sapiens
RVMEHDDQS

SEQ ID NO: 285417 - protein, 9 aa, Homo Sapiens
ADFVWSLIS

SEQ ID NO: 285418 - protein, 9 aa, Homo Sapiens
SAIPVINWA

SEQ ID NO: 285419 - protein, 9 aa, Homo Sapiens
LQWDVLDGL

SEQ ID NO: 285420 - protein, 9 aa, Homo Sapiens
TPELCAALR

SEQ ID NO: 285421 - protein, 9 aa, Homo Sapiens
STLQKAIQE

SEQ ID NO: 285422 - protein, 9 aa, Homo Sapiens
RQHRDAKEA

SEQ ID NO: 285423 - protein, 9 aa, Homo Sapiens
VGKSRRDKL

SEQ ID NO: 285424 - protein, 9 aa, Homo Sapiens
ARQQYRRAL

SEQ ID NO: 285425 - protein, 9 aa, Homo Sapiens
HSFFVVGTL

SEQ ID NO: 285426 - protein, 9 aa, Homo Sapiens
SDFERLHQN

SEQ ID NO: 285427 - protein, 9 aa, Homo Sapiens
NLKCDCSTA

SEQ ID NO: 285428 - protein, 9 aa, Homo Sapiens
SSENDDLRQ

SEQ ID NO: 285429 - protein, 9 aa, Homo Sapiens
LHSRETPHA

SEQ ID NO: 285430 - protein, 9 aa, Homo Sapiens
IYHVSDLMT

SEQ ID NO: 285431 - protein, 9 aa, Homo Sapiens
NCVIFQDHL

SEQ ID NO: 285432 - protein, 9 aa, Homo Sapiens
QCAVVACAV

SEQ ID NO: 285433 - protein, 9 aa, Homo Sapiens
DSARRAPQD

SEQ ID NO: 285434 - protein, 9 aa, Homo Sapiens
SSLDAVISV

SEQ ID NO: 285435 - protein, 9 aa, Homo Sapiens
LNKPARTQG

SEQ ID NO: 285436 - protein, 9 aa, Homo Sapiens
TEIAPDKSV

SEQ ID NO: 285437 - protein, 9 aa, Homo Sapiens
DYLKTVLHI

SEQ ID NO: 285438 - protein, 9 aa, Homo Sapiens
NNSYIKDFL

SEQ ID NO: 285439 - protein, 9 aa, Homo Sapiens
STSIPVVSQ

SEQ ID NO: 285440 - protein, 9 aa, Homo Sapiens
CPPIALRNV

SEQ ID NO: 285441 - protein, 9 aa, Homo Sapiens
QGLRRWGCY

SEQ ID NO: 285442 - protein, 9 aa, Homo Sapiens
QISDRIIVC

SEQ ID NO: 285443 - protein, 9 aa, Homo Sapiens
DTEGAVRSR

SEQ ID NO: 285444 - protein, 9 aa, Homo Sapiens
CSTVSKSIL

SEQ ID NO: 285445 - protein, 9 aa, Homo Sapiens
LQVNGFKYL

SEQ ID NO: 285446 - protein, 9 aa, Homo Sapiens
LRPWFYNIL

SEQ ID NO: 285447 - protein, 9 aa, Homo Sapiens
NEGLICKAP

SEQ ID NO: 285448 - protein, 9 aa, Homo Sapiens
STKKTYFKN

SEQ ID NO: 285449 - protein, 9 aa, Homo Sapiens
FIEVKTIMN

SEQ ID NO: 285450 - protein, 9 aa, Homo Sapiens
KKSVNAKKD

SEQ ID NO: 285451 - protein, 9 aa, Homo Sapiens
GKDCNKTSF

SEQ ID NO: 285452 - protein, 9 aa, Homo Sapiens
IIPPKSLGI

SEQ ID NO: 285453 - protein, 9 aa, Homo Sapiens
NNILNSFIV

SEQ ID NO: 285454 - protein, 9 aa, Homo Sapiens
IHNTYHSQM

SEQ ID NO: 285455 - protein, 9 aa, Homo Sapiens
WIPLHHSRK

SEQ ID NO: 285456 - protein, 9 aa, Homo Sapiens
VADVKSASE

SEQ ID NO: 285457 - protein, 9 aa, Homo Sapiens
MMVYVFYTI

SEQ ID NO: 285458 - protein, 9 aa, Homo Sapiens
ESVGVLAEI

SEQ ID NO: 285459 - protein, 9 aa, Homo Sapiens
HVFIHERPQ

SEQ ID NO: 285460 - protein, 9 aa, Homo Sapiens
STTERFDMA

SEQ ID NO: 285461 - protein, 9 aa, Homo Sapiens
YQLRNDSNF

SEQ ID NO: 285462 - protein, 9 aa, Homo Sapiens
QEIDQVSYS

SEQ ID NO: 285463 - protein, 9 aa, Homo Sapiens
KDIYRTMNI

SEQ ID NO: 285464 - protein, 9 aa, Homo Sapiens
NYHNEEYVS

SEQ ID NO: 285465 - protein, 9 aa, Homo Sapiens
KDTFHDNDF

SEQ ID NO: 285466 - protein, 9 aa, Homo Sapiens
ENIYGGSQG

SEQ ID NO: 285467 - protein, 9 aa, Homo Sapiens
VDDILMSHE

SEQ ID NO: 285468 - protein, 9 aa, Homo Sapiens
LKNKQKKEA

SEQ ID NO: 285469 - protein, 9 aa, Homo Sapiens
TKNKTVCFI

SEQ ID NO: 285470 - protein, 9 aa, Homo Sapiens
IYYPDHTNN

SEQ ID NO: 285471 - protein, 9 aa, Homo Sapiens
SGKKRTQKL

SEQ ID NO: 285472 - protein, 9 aa, Homo Sapiens
QFGIPCCPV

SEQ ID NO: 285473 - protein, 9 aa, Homo Sapiens
KTRQSKRNE

SEQ ID NO: 285474 - protein, 9 aa, Homo Sapiens
ADEDYGRDL

SEQ ID NO: 285475 - protein, 9 aa, Homo Sapiens
GRYWSYDFY

SEQ ID NO: 285476 - protein, 9 aa, Homo Sapiens
KKHDCFNSY

SEQ ID NO: 285477 - protein, 9 aa, Homo Sapiens
ATWLIGLDD

SEQ ID NO: 285478 - protein, 9 aa, Homo Sapiens
GTTAINYKH

SEQ ID NO: 285479 - protein, 9 aa, Homo Sapiens
PVLEWGDSE

SEQ ID NO: 285480 - protein, 9 aa, Homo Sapiens
GLHYFDHFH

SEQ ID NO: 285481 - protein, 9 aa, Homo Sapiens
LIGKRIASQ

SEQ ID NO: 285482 - protein, 9 aa, Homo Sapiens
SLDRTKDDG

SEQ ID NO: 285483 - protein, 9 aa, Homo Sapiens
TYMEASTKI

SEQ ID NO: 285484 - protein, 9 aa, Homo Sapiens
VQPPPDNKI

SEQ ID NO: 285485 - protein, 9 aa, Homo Sapiens
AAAVSRKKT

SEQ ID NO: 285486 - protein, 9 aa, Homo Sapiens
KDKFRKTRY

SEQ ID NO: 285487 - protein, 9 aa, Homo Sapiens
PPQEPFWES

SEQ ID NO: 285488 - protein, 9 aa, Homo Sapiens
KSQRLESLQ

SEQ ID NO: 285489 - protein, 9 aa, Homo Sapiens
ISNSRTDES

SEQ ID NO: 285490 - protein, 9 aa, Homo Sapiens
EADECIKSE

SEQ ID NO: 285491 - protein, 9 aa, Homo Sapiens
LAHLLMDQA

SEQ ID NO: 285492 - protein, 9 aa, Homo Sapiens
SIPVVSQPQ

SEQ ID NO: 285493 - protein, 9 aa, Homo Sapiens
QGQQPPPRI

SEQ ID NO: 285494 - protein, 9 aa, Homo Sapiens
VFCLICIDL

SEQ ID NO: 285495 - protein, 9 aa, Homo Sapiens
IARQQYRRA

SEQ ID NO: 285496 - protein, 9 aa, Homo Sapiens
LHLFKDGKM

SEQ ID NO: 285497 - protein, 9 aa, Homo Sapiens
VHTLGSFHC

SEQ ID NO: 285498 - protein, 9 aa, Homo Sapiens
SLQAPPPGL

SEQ ID NO: 285499 - protein, 9 aa, Homo Sapiens
CKVCCALLM

SEQ ID NO: 285500 - protein, 9 aa, Homo Sapiens
GSNQTVFVS

SEQ ID NO: 285501 - protein, 9 aa, Homo Sapiens
RVDKYGPGP

SEQ ID NO: 285502 - protein, 9 aa, Homo Sapiens
VILSRIIIG

SEQ ID NO: 285503 - protein, 9 aa, Homo Sapiens
HTIEEIISF

SEQ ID NO: 285504 - protein, 9 aa, Homo Sapiens
YLPLSGIIC

SEQ ID NO: 285505 - protein, 9 aa, Homo Sapiens
PRSAAENAV

SEQ ID NO: 285506 - protein, 9 aa, Homo Sapiens
AMHDPLLER

SEQ ID NO: 285507 - protein, 9 aa, Homo Sapiens
EHKALDEPA

SEQ ID NO: 285508 - protein, 9 aa, Homo Sapiens
GEFTHLQGV

SEQ ID NO: 285509 - protein, 9 aa, Homo Sapiens
RVSPSPMRI

SEQ ID NO: 285510 - protein, 9 aa, Homo Sapiens
VIESVTELC

SEQ ID NO: 285511 - protein, 9 aa, Homo Sapiens
RKISDDHLI

SEQ ID NO: 285512 - protein, 9 aa, Homo Sapiens
SRNLNCTAL

SEQ ID NO: 285513 - protein, 9 aa, Homo Sapiens
QEEQASINN

SEQ ID NO: 285514 - protein, 9 aa, Homo Sapiens
PAEKEVTEL

SEQ ID NO: 285515 - protein, 9 aa, Homo Sapiens
YNKRILHNT

SEQ ID NO: 285516 - protein, 9 aa, Homo Sapiens
PLGTPLPPG

SEQ ID NO: 285517 - protein, 9 aa, Homo Sapiens
DTDLRMTFT

SEQ ID NO: 285518 - protein, 9 aa, Homo Sapiens
QYIGKLHSD

SEQ ID NO: 285519 - protein, 9 aa, Homo Sapiens
MSSPEDDLD

SEQ ID NO: 285520 - protein, 9 aa, Homo Sapiens
TQEEGKLWN

SEQ ID NO: 285521 - protein, 9 aa, Homo Sapiens
SDRNDLSED

SEQ ID NO: 285522 - protein, 9 aa, Homo Sapiens
PNKLVQLNK

SEQ ID NO: 285523 - protein, 9 aa, Homo Sapiens
FTFLKPIIP

SEQ ID NO: 285524 - protein, 9 aa, Homo Sapiens
IMRDTMPKK

SEQ ID NO: 285525 - protein, 9 aa, Homo Sapiens
LCREYPCSG

SEQ ID NO: 285526 - protein, 9 aa, Homo Sapiens
VIFYRGMLD

SEQ ID NO: 285527 - protein, 9 aa, Homo Sapiens
AHNNFENVA

SEQ ID NO: 285528 - protein, 9 aa, Homo Sapiens
FATKVRNLM

SEQ ID NO: 285529 - protein, 9 aa, Homo Sapiens
VLPNPTLAE

SEQ ID NO: 285530 - protein, 9 aa, Homo Sapiens
IHMYEQGGG

SEQ ID NO: 285531 - protein, 9 aa, Homo Sapiens
AKRLSTRLF

SEQ ID NO: 285532 - protein, 9 aa, Homo Sapiens
VKSHKQVKS

SEQ ID NO: 285533 - protein, 9 aa, Homo Sapiens
CNPSYRNSL

SEQ ID NO: 285534 - protein, 9 aa, Homo Sapiens
CCMYIIAVV

SEQ ID NO: 285535 - protein, 9 aa, Homo Sapiens
LLPGPKEPA

SEQ ID NO: 285536 - protein, 9 aa, Homo Sapiens
EIHGQLKAF

SEQ ID NO: 285537 - protein, 9 aa, Homo Sapiens
QTCYLELES

SEQ ID NO: 285538 - protein, 9 aa, Homo Sapiens
TLTQDKIIH

SEQ ID NO: 285539 - protein, 9 aa, Homo Sapiens
DGETNLKCK

SEQ ID NO: 285540 - protein, 9 aa, Homo Sapiens
QLFWLSSCQ

SEQ ID NO: 285541 - protein, 9 aa, Homo Sapiens
ELSLEEWHC

SEQ ID NO: 285542 - protein, 9 aa, Homo Sapiens
RQRDTGQMF

SEQ ID NO: 285543 - protein, 9 aa, Homo Sapiens
PDPHSHNDK

SEQ ID NO: 285544 - protein, 9 aa, Homo Sapiens
KECGKYFTS

SEQ ID NO: 285545 - protein, 9 aa, Homo Sapiens
FEQNNSLNA

SEQ ID NO: 285546 - protein, 9 aa, Homo Sapiens
ITSNKKLFS

SEQ ID NO: 285547 - protein, 9 aa, Homo Sapiens
LEPVYFYMY

SEQ ID NO: 285548 - protein, 9 aa, Homo Sapiens
LREDALSMK

SEQ ID NO: 285549 - protein, 9 aa, Homo Sapiens
KAFVFDKAI

SEQ ID NO: 285550 - protein, 9 aa, Homo Sapiens
SVLQAANII

SEQ ID NO: 285551 - protein, 9 aa, Homo Sapiens
DISRLQQRL

SEQ ID NO: 285552 - protein, 9 aa, Homo Sapiens
PHLPGLLIT

SEQ ID NO: 285553 - protein, 9 aa, Homo Sapiens
EPMFVVTGR

SEQ ID NO: 285554 - protein, 9 aa, Homo Sapiens
VWNKPTVES

SEQ ID NO: 285555 - protein, 9 aa, Homo Sapiens
KCQGIKHEW

SEQ ID NO: 285556 - protein, 9 aa, Homo Sapiens
ELPNFPHID

SEQ ID NO: 285557 - protein, 9 aa, Homo Sapiens
IEVCKSHSK

SEQ ID NO: 285558 - protein, 9 aa, Homo Sapiens
AIAHVHAEN

SEQ ID NO: 285559 - protein, 9 aa, Homo Sapiens
FGGEQFMLE

SEQ ID NO: 285560 - protein, 9 aa, Homo Sapiens
VCLYYRVME

SEQ ID NO: 285561 - protein, 9 aa, Homo Sapiens
IKYAFELFD

SEQ ID NO: 285562 - protein, 9 aa, Homo Sapiens
SHLHLSKCW

SEQ ID NO: 285563 - protein, 9 aa, Homo Sapiens
EEIINENEK

SEQ ID NO: 285564 - protein, 9 aa, Homo Sapiens
TQATPPVAP

SEQ ID NO: 285565 - protein, 9 aa, Homo Sapiens
KAIGIWAIG

SEQ ID NO: 285566 - protein, 9 aa, Homo Sapiens
IVAYYHSRV

SEQ ID NO: 285567 - protein, 9 aa, Homo Sapiens
PFCGTGTDR

SEQ ID NO: 285568 - protein, 9 aa, Homo Sapiens
CNPCGKVFT

SEQ ID NO: 285569 - protein, 9 aa, Homo Sapiens
VERGAFLGM

SEQ ID NO: 285570 - protein, 9 aa, Homo Sapiens
GIKHINCHT

SEQ ID NO: 285571 - protein, 9 aa, Homo Sapiens
FADMIRKSP

SEQ ID NO: 285572 - protein, 9 aa, Homo Sapiens
MTLLEFETQ

SEQ ID NO: 285573 - protein, 9 aa, Homo Sapiens
RCRNGHRGV

SEQ ID NO: 285574 - protein, 9 aa, Homo Sapiens
LGNLALVDF

SEQ ID NO: 285575 - protein, 9 aa, Homo Sapiens
DMLPKNSEE

SEQ ID NO: 285576 - protein, 9 aa, Homo Sapiens
GLREQEKHI

SEQ ID NO: 285577 - protein, 9 aa, Homo Sapiens
NADIKSSET

SEQ ID NO: 285578 - protein, 9 aa, Homo Sapiens
CSMIILSAL

SEQ ID NO: 285579 - protein, 9 aa, Homo Sapiens
KNRPLKDRV

SEQ ID NO: 285580 - protein, 9 aa, Homo Sapiens
IGVAGFKMS

SEQ ID NO: 285581 - protein, 9 aa, Homo Sapiens
SALKIKVKE

SEQ ID NO: 285582 - protein, 9 aa, Homo Sapiens
ALSSSSEDE

SEQ ID NO: 285583 - protein, 9 aa, Homo Sapiens
FDTTLKVWD

SEQ ID NO: 285584 - protein, 9 aa, Homo Sapiens
DDIMNDEGE

SEQ ID NO: 285585 - protein, 9 aa, Homo Sapiens
DKVVSIHQD

SEQ ID NO: 285586 - protein, 9 aa, Homo Sapiens
REIIWSYLM

SEQ ID NO: 285587 - protein, 9 aa, Homo Sapiens
ALEDSYSKF

SEQ ID NO: 285588 - protein, 9 aa, Homo Sapiens
PEAGGGAVE

SEQ ID NO: 285589 - protein, 9 aa, Homo Sapiens
VNMMASSAP

SEQ ID NO: 285590 - protein, 9 aa, Homo Sapiens
DYVKITLRN

SEQ ID NO: 285591 - protein, 9 aa, Homo Sapiens
AYIDNAGNL

SEQ ID NO: 285592 - protein, 9 aa, Homo Sapiens
YISEELDAW

SEQ ID NO: 285593 - protein, 9 aa, Homo Sapiens
DKYIDLEPD

SEQ ID NO: 285594 - protein, 9 aa, Homo Sapiens
KRANIIFRN

SEQ ID NO: 285595 - protein, 9 aa, Homo Sapiens
IKLCQENDY

SEQ ID NO: 285596 - protein, 9 aa, Homo Sapiens
SRFVLLGIS

SEQ ID NO: 285597 - protein, 9 aa, Homo Sapiens
FPGFWYSWR

SEQ ID NO: 285598 - protein, 9 aa, Homo Sapiens
QKNNITKKN

SEQ ID NO: 285599 - protein, 9 aa, Homo Sapiens
MVPPDLQNK

SEQ ID NO: 285600 - protein, 9 aa, Homo Sapiens
SQAPYGTVG

SEQ ID NO: 285601 - protein, 9 aa, Homo Sapiens
LCDKLSGHP

SEQ ID NO: 285602 - protein, 9 aa, Homo Sapiens
NVNGGKQFC

SEQ ID NO: 285603 - protein, 9 aa, Homo Sapiens
YRGCVTIHR

SEQ ID NO: 285604 - protein, 9 aa, Homo Sapiens
NPISVYIGH

SEQ ID NO: 285605 - protein, 9 aa, Homo Sapiens
RTFSCMFFG

SEQ ID NO: 285606 - protein, 9 aa, Homo Sapiens
VPQTILRKL

SEQ ID NO: 285607 - protein, 9 aa, Homo Sapiens
YHVSDLMTI

SEQ ID NO: 285608 - protein, 9 aa, Homo Sapiens
EKAVSEHLP

SEQ ID NO: 285609 - protein, 9 aa, Homo Sapiens
LDSSQGHSI

SEQ ID NO: 285610 - protein, 9 aa, Homo Sapiens
EDGSMINSH

SEQ ID NO: 285611 - protein, 9 aa, Homo Sapiens
QCRHSPGES

SEQ ID NO: 285612 - protein, 9 aa, Homo Sapiens
LTECTKEEL

SEQ ID NO: 285613 - protein, 9 aa, Homo Sapiens
KKPLNALML

SEQ ID NO: 285614 - protein, 9 aa, Homo Sapiens
LSSLCEHFG

SEQ ID NO: 285615 - protein, 9 aa, Homo Sapiens
NPTMSIDLK

SEQ ID NO: 285616 - protein, 9 aa, Homo Sapiens
DPVFDTSDP

SEQ ID NO: 285617 - protein, 9 aa, Homo Sapiens
ETATGPRTE

SEQ ID NO: 285618 - protein, 9 aa, Homo Sapiens
SYLMRDRSA

SEQ ID NO: 285619 - protein, 9 aa, Homo Sapiens
IALSIGDPT

SEQ ID NO: 285620 - protein, 9 aa, Homo Sapiens
ARYLFFALW

SEQ ID NO: 285621 - protein, 9 aa, Homo Sapiens
PLETNNICF

SEQ ID NO: 285622 - protein, 9 aa, Homo Sapiens
QSEINYLWR

SEQ ID NO: 285623 - protein, 9 aa, Homo Sapiens
KGMGLIPEE

SEQ ID NO: 285624 - protein, 9 aa, Homo Sapiens
AEYLTVFKK

SEQ ID NO: 285625 - protein, 9 aa, Homo Sapiens
QSENEAYHP

SEQ ID NO: 285626 - protein, 9 aa, Homo Sapiens
FEDYPMIIL

SEQ ID NO: 285627 - protein, 9 aa, Homo Sapiens
IDPSNGIPK

SEQ ID NO: 285628 - protein, 9 aa, Homo Sapiens
ITADLDNIF

SEQ ID NO: 285629 - protein, 9 aa, Homo Sapiens
QQKWKDERL

SEQ ID NO: 285630 - protein, 9 aa, Homo Sapiens
MPTDAFGNI

SEQ ID NO: 285631 - protein, 9 aa, Homo Sapiens
LSTIPPGAF

SEQ ID NO: 285632 - protein, 9 aa, Homo Sapiens
QNYLTSLPL

SEQ ID NO: 285633 - protein, 9 aa, Homo Sapiens
ELLFGGHKT

SEQ ID NO: 285634 - protein, 9 aa, Homo Sapiens
PHKRNLDLE

SEQ ID NO: 285635 - protein, 9 aa, Homo Sapiens
LESFFQDKG

SEQ ID NO: 285636 - protein, 9 aa, Homo Sapiens
KEAFDKMKG

SEQ ID NO: 285637 - protein, 9 aa, Homo Sapiens
DVLDCLPLG

SEQ ID NO: 285638 - protein, 9 aa, Homo Sapiens
TFGPNIPKQ

SEQ ID NO: 285639 - protein, 9 aa, Homo Sapiens
VGLVCCECS

SEQ ID NO: 285640 - protein, 9 aa, Homo Sapiens
VISSIKGSN

SEQ ID NO: 285641 - protein, 9 aa, Homo Sapiens
IRLLGLIRA

SEQ ID NO: 285642 - protein, 9 aa, Homo Sapiens
YKMCWGGMI

SEQ ID NO: 285643 - protein, 9 aa, Homo Sapiens
ENIQRLFGH

SEQ ID NO: 285644 - protein, 9 aa, Homo Sapiens
ESKYLYDEV

SEQ ID NO: 285645 - protein, 9 aa, Homo Sapiens
YLFRDFDIT

SEQ ID NO: 285646 - protein, 9 aa, Homo Sapiens
DFEGERGKP

SEQ ID NO: 285647 - protein, 9 aa, Homo Sapiens
RALPKASLF

SEQ ID NO: 285648 - protein, 9 aa, Homo Sapiens
VQAGQSLEL

SEQ ID NO: 285649 - protein, 9 aa, Homo Sapiens
SWRGLHILG

SEQ ID NO: 285650 - protein, 9 aa, Homo Sapiens
SSGIENKSG

SEQ ID NO: 285651 - protein, 9 aa, Homo Sapiens
HIKEDRARW

SEQ ID NO: 285652 - protein, 9 aa, Homo Sapiens
QVVEHLMNS

SEQ ID NO: 285653 - protein, 9 aa, Homo Sapiens
MIEYRTESA

SEQ ID NO: 285654 - protein, 9 aa, Homo Sapiens
RKSVVAYQG

SEQ ID NO: 285655 - protein, 9 aa, Homo Sapiens
HVWVMNLHW

SEQ ID NO: 285656 - protein, 9 aa, Homo Sapiens
LIQWFDTAP

SEQ ID NO: 285657 - protein, 9 aa, Homo Sapiens
PSRSGSRDL

SEQ ID NO: 285658 - protein, 9 aa, Homo Sapiens
LYDLSSDYL

SEQ ID NO: 285659 - protein, 9 aa, Homo Sapiens
TSSLILKTT

SEQ ID NO: 285660 - protein, 9 aa, Homo Sapiens
GGDEIARQQ

SEQ ID NO: 285661 - protein, 9 aa, Homo Sapiens
GGCKGHFAK

SEQ ID NO: 285662 - protein, 9 aa, Homo Sapiens
NKECEALIC

SEQ ID NO: 285663 - protein, 9 aa, Homo Sapiens
SSSVDSLPD

SEQ ID NO: 285664 - protein, 9 aa, Homo Sapiens
DTFNRQGIL

SEQ ID NO: 285665 - protein, 9 aa, Homo Sapiens
CLDFIETSN

SEQ ID NO: 285666 - protein, 9 aa, Homo Sapiens
SLTYNPEGT

SEQ ID NO: 285667 - protein, 9 aa, Homo Sapiens
DMLVNSAQA

SEQ ID NO: 285668 - protein, 9 aa, Homo Sapiens
DQGEQCDNM

SEQ ID NO: 285669 - protein, 9 aa, Homo Sapiens
GQYGSRETY

SEQ ID NO: 285670 - protein, 9 aa, Homo Sapiens
SLLSEFDYW

SEQ ID NO: 285671 - protein, 9 aa, Homo Sapiens
NFRLNWTWI

SEQ ID NO: 285672 - protein, 9 aa, Homo Sapiens
PLTLGMRVA

SEQ ID NO: 285673 - protein, 9 aa, Homo Sapiens
LESHLKAAS

SEQ ID NO: 285674 - protein, 9 aa, Homo Sapiens
EDRALPDNE

SEQ ID NO: 285675 - protein, 9 aa, Homo Sapiens
FIKIAAIDN

SEQ ID NO: 285676 - protein, 9 aa, Homo Sapiens
TDIANYVVR

SEQ ID NO: 285677 - protein, 9 aa, Homo Sapiens
TGAMHLARG

SEQ ID NO: 285678 - protein, 9 aa, Homo Sapiens
KFIQEMALF

SEQ ID NO: 285679 - protein, 9 aa, Homo Sapiens
VNLSDRVFK

SEQ ID NO: 285680 - protein, 9 aa, Homo Sapiens
EQNKKSVTE

SEQ ID NO: 285681 - protein, 9 aa, Homo Sapiens
QSYSQNTLI

SEQ ID NO: 285682 - protein, 9 aa, Homo Sapiens
FLYLTKDSC

SEQ ID NO: 285683 - protein, 9 aa, Homo Sapiens
LERCGYGEL

SEQ ID NO: 285684 - protein, 9 aa, Homo Sapiens
TFNRQGILH

SEQ ID NO: 285685 - protein, 9 aa, Homo Sapiens
INDLSIISG

SEQ ID NO: 285686 - protein, 9 aa, Homo Sapiens
PSIWDEPEG

SEQ ID NO: 285687 - protein, 9 aa, Homo Sapiens
CFSGEVYWE

SEQ ID NO: 285688 - protein, 9 aa, Homo Sapiens
RLEQDIATY

SEQ ID NO: 285689 - protein, 9 aa, Homo Sapiens
TKSSSSDED

SEQ ID NO: 285690 - protein, 9 aa, Homo Sapiens
CYQLQKWTG

SEQ ID NO: 285691 - protein, 9 aa, Homo Sapiens
EEVQAKNPK

SEQ ID NO: 285692 - protein, 9 aa, Homo Sapiens
CGIMDDKTV

SEQ ID NO: 285693 - protein, 9 aa, Homo Sapiens
SLGLFAAGV

SEQ ID NO: 285694 - protein, 9 aa, Homo Sapiens
RADLWMPAV

SEQ ID NO: 285695 - protein, 9 aa, Homo Sapiens
IAEDSAIML

SEQ ID NO: 285696 - protein, 9 aa, Homo Sapiens
PSPVSAMLV

SEQ ID NO: 285697 - protein, 9 aa, Homo Sapiens
SILTNHKII

SEQ ID NO: 285698 - protein, 9 aa, Homo Sapiens
LRGLQSRIE

SEQ ID NO: 285699 - protein, 9 aa, Homo Sapiens
KSRRDKLYH

SEQ ID NO: 285700 - protein, 9 aa, Homo Sapiens
LLEIFALES

SEQ ID NO: 285701 - protein, 9 aa, Homo Sapiens
FSTVDIEGH

SEQ ID NO: 285702 - protein, 9 aa, Homo Sapiens
QSQSSTFSI

SEQ ID NO: 285703 - protein, 9 aa, Homo Sapiens
PRCSENPEQ

SEQ ID NO: 285704 - protein, 9 aa, Homo Sapiens
VVVSWRLCL

SEQ ID NO: 285705 - protein, 9 aa, Homo Sapiens
PILQGHFSV

SEQ ID NO: 285706 - protein, 9 aa, Homo Sapiens
RRFRDLHHY

SEQ ID NO: 285707 - protein, 9 aa, Homo Sapiens
AMGPWGLLL

SEQ ID NO: 285708 - protein, 9 aa, Homo Sapiens
RIKDVKRHI

SEQ ID NO: 285709 - protein, 9 aa, Homo Sapiens
NYQPNMVVF

SEQ ID NO: 285710 - protein, 9 aa, Homo Sapiens
LYLDMQTIK

SEQ ID NO: 285711 - protein, 9 aa, Homo Sapiens
SLVPLQIIL

SEQ ID NO: 285712 - protein, 9 aa, Homo Sapiens
ELSQTRYFI

SEQ ID NO: 285713 - protein, 9 aa, Homo Sapiens
HQEADKTRQ

SEQ ID NO: 285714 - protein, 9 aa, Homo Sapiens
ELSDQITFI

SEQ ID NO: 285715 - protein, 9 aa, Homo Sapiens
SMVLPEVEV

SEQ ID NO: 285716 - protein, 9 aa, Homo Sapiens
HRRVLAACS

SEQ ID NO: 285717 - protein, 9 aa, Homo Sapiens
RFQEHHGTS

SEQ ID NO: 285718 - protein, 9 aa, Homo Sapiens
FPAEPLGVE

SEQ ID NO: 285719 - protein, 9 aa, Homo Sapiens
ELTPCETDN

SEQ ID NO: 285720 - protein, 9 aa, Homo Sapiens
CTLRCLGLG

SEQ ID NO: 285721 - protein, 9 aa, Homo Sapiens
LKNAIIIGE

SEQ ID NO: 285722 - protein, 9 aa, Homo Sapiens
RLYGGVCHA

SEQ ID NO: 285723 - protein, 9 aa, Homo Sapiens
CSGKAPPKT

SEQ ID NO: 285724 - protein, 9 aa, Homo Sapiens
VDCYSPWCH

SEQ ID NO: 285725 - protein, 9 aa, Homo Sapiens
SVRMGKKVW

SEQ ID NO: 285726 - protein, 9 aa, Homo Sapiens
FRTLCDLIF

SEQ ID NO: 285727 - protein, 9 aa, Homo Sapiens
SLKGLRNCA

SEQ ID NO: 285728 - protein, 9 aa, Homo Sapiens
SADPDNSGL

SEQ ID NO: 285729 - protein, 9 aa, Homo Sapiens
LRRNLLSLV

SEQ ID NO: 285730 - protein, 9 aa, Homo Sapiens
TQGKNTEVQ

SEQ ID NO: 285731 - protein, 9 aa, Homo Sapiens
LICCCCTTL

SEQ ID NO: 285732 - protein, 9 aa, Homo Sapiens
IHRELIEIS

SEQ ID NO: 285733 - protein, 9 aa, Homo Sapiens
DKSKVAKKI

SEQ ID NO: 285734 - protein, 9 aa, Homo Sapiens
KEIHGQLKA

SEQ ID NO: 285735 - protein, 9 aa, Homo Sapiens
RDSKETAPG

SEQ ID NO: 285736 - protein, 9 aa, Homo Sapiens
MWAFLSLDH

SEQ ID NO: 285737 - protein, 9 aa, Homo Sapiens
ASGANGSEI

SEQ ID NO: 285738 - protein, 9 aa, Homo Sapiens
EGRPLCDNH

SEQ ID NO: 285739 - protein, 9 aa, Homo Sapiens
SLESLLSND

SEQ ID NO: 285740 - protein, 9 aa, Homo Sapiens
NVLTAFSQE

SEQ ID NO: 285741 - protein, 9 aa, Homo Sapiens
RFDENENVS

SEQ ID NO: 285742 - protein, 9 aa, Homo Sapiens
WCFYPNTIN

SEQ ID NO: 285743 - protein, 9 aa, Homo Sapiens
VLIHHCAKC

SEQ ID NO: 285744 - protein, 9 aa, Homo Sapiens
TSNRMWKLF

SEQ ID NO: 285745 - protein, 9 aa, Homo Sapiens
LEMWKPHVS

SEQ ID NO: 285746 - protein, 9 aa, Homo Sapiens
FTSLIGVLI

SEQ ID NO: 285747 - protein, 9 aa, Homo Sapiens
NSEESAAPS

SEQ ID NO: 285748 - protein, 9 aa, Homo Sapiens
AVQQPDGFN

SEQ ID NO: 285749 - protein, 9 aa, Homo Sapiens
NQKAFDLDV

SEQ ID NO: 285750 - protein, 9 aa, Homo Sapiens
LTQHKIIHI

SEQ ID NO: 285751 - protein, 9 aa, Homo Sapiens
IITSGKMSL

SEQ ID NO: 285752 - protein, 9 aa, Homo Sapiens
LQVAKLKPP

SEQ ID NO: 285753 - protein, 9 aa, Homo Sapiens
IVSHIMEMW

SEQ ID NO: 285754 - protein, 9 aa, Homo Sapiens
NGEPGGGPI

SEQ ID NO: 285755 - protein, 9 aa, Homo Sapiens
GCVAQLDFY

SEQ ID NO: 285756 - protein, 9 aa, Homo Sapiens
EISEGTGFR

SEQ ID NO: 285757 - protein, 9 aa, Homo Sapiens
TAARQDAAS

SEQ ID NO: 285758 - protein, 9 aa, Homo Sapiens
PLGHIKQMQ

SEQ ID NO: 285759 - protein, 9 aa, Homo Sapiens
KPLWFDVCD

SEQ ID NO: 285760 - protein, 9 aa, Homo Sapiens
IRLSYNKLT

SEQ ID NO: 285761 - protein, 9 aa, Homo Sapiens
ARGGQVRVA

SEQ ID NO: 285762 - protein, 9 aa, Homo Sapiens
VVRDEKRKW

SEQ ID NO: 285763 - protein, 9 aa, Homo Sapiens
WTPLHLAAH

SEQ ID NO: 285764 - protein, 9 aa, Homo Sapiens
IGKSWIYKR

SEQ ID NO: 285765 - protein, 9 aa, Homo Sapiens
QDGSLLYLF

SEQ ID NO: 285766 - protein, 9 aa, Homo Sapiens
TVMGNISII

SEQ ID NO: 285767 - protein, 9 aa, Homo Sapiens
LSREILWSG

SEQ ID NO: 285768 - protein, 9 aa, Homo Sapiens
INFLICIRI

SEQ ID NO: 285769 - protein, 9 aa, Homo Sapiens
LPFIIFGAT

SEQ ID NO: 285770 - protein, 9 aa, Homo Sapiens
IYIKNLNYL

SEQ ID NO: 285771 - protein, 9 aa, Homo Sapiens
YTTAVVVIH

SEQ ID NO: 285772 - protein, 9 aa, Homo Sapiens
LKGRVALTG

SEQ ID NO: 285773 - protein, 9 aa, Homo Sapiens
LYRVVERLA

SEQ ID NO: 285774 - protein, 9 aa, Homo Sapiens
CFYVDITTG

SEQ ID NO: 285775 - protein, 9 aa, Homo Sapiens
EGSPVRDMD

SEQ ID NO: 285776 - protein, 9 aa, Homo Sapiens
STLAMCARG

SEQ ID NO: 285777 - protein, 9 aa, Homo Sapiens
KSHKQVKSL

SEQ ID NO: 285778 - protein, 9 aa, Homo Sapiens
AGKVRDMNR

SEQ ID NO: 285779 - protein, 9 aa, Homo Sapiens
GNTTQIFNV

SEQ ID NO: 285780 - protein, 9 aa, Homo Sapiens
IAVNMVFCE

SEQ ID NO: 285781 - protein, 9 aa, Homo Sapiens
NGGYFHPSS

SEQ ID NO: 285782 - protein, 9 aa, Homo Sapiens
VTKVDKVVA

SEQ ID NO: 285783 - protein, 9 aa, Homo Sapiens
EKTNNRIHY

SEQ ID NO: 285784 - protein, 9 aa, Homo Sapiens
FLTLKTHHV

SEQ ID NO: 285785 - protein, 9 aa, Homo Sapiens
IQQLEKYLY

SEQ ID NO: 285786 - protein, 9 aa, Homo Sapiens
GLYILSFFT

SEQ ID NO: 285787 - protein, 9 aa, Homo Sapiens
EVFGKLKNL

SEQ ID NO: 285788 - protein, 9 aa, Homo Sapiens
VTLFCCHKG

SEQ ID NO: 285789 - protein, 9 aa, Homo Sapiens
KRVFVNLDG

SEQ ID NO: 285790 - protein, 9 aa, Homo Sapiens
LLWLSVCHF

SEQ ID NO: 285791 - protein, 9 aa, Homo Sapiens
PQMLTKENS

SEQ ID NO: 285792 - protein, 9 aa, Homo Sapiens
ALSDSHHSP

SEQ ID NO: 285793 - protein, 9 aa, Homo Sapiens
KYSVGVSGN

SEQ ID NO: 285794 - protein, 9 aa, Homo Sapiens
AEMVAINQV

SEQ ID NO: 285795 - protein, 9 aa, Homo Sapiens
RQQYLLIAA

SEQ ID NO: 285796 - protein, 9 aa, Homo Sapiens
DLGGNSFNC

SEQ ID NO: 285797 - protein, 9 aa, Homo Sapiens
QLRGLQSRI

SEQ ID NO: 285798 - protein, 9 aa, Homo Sapiens
KKKRLRSSK

SEQ ID NO: 285799 - protein, 9 aa, Homo Sapiens
SSLPAHGPE

SEQ ID NO: 285800 - protein, 9 aa, Homo Sapiens
KTYNDALFQ

SEQ ID NO: 285801 - protein, 9 aa, Homo Sapiens
VRLNQDKRS

SEQ ID NO: 285802 - protein, 9 aa, Homo Sapiens
GGRALLLQT

SEQ ID NO: 285803 - protein, 9 aa, Homo Sapiens
KEQESPDKL

SEQ ID NO: 285804 - protein, 9 aa, Homo Sapiens
IAERVRKLR

SEQ ID NO: 285805 - protein, 9 aa, Homo Sapiens
TNGAVVKYE

SEQ ID NO: 285806 - protein, 9 aa, Homo Sapiens
KEASDDDTP

SEQ ID NO: 285807 - protein, 9 aa, Homo Sapiens
FDEEVHDLE

SEQ ID NO: 285808 - protein, 9 aa, Homo Sapiens
KTRKCSLLD

SEQ ID NO: 285809 - protein, 9 aa, Homo Sapiens
RKSRLEEQK

SEQ ID NO: 285810 - protein, 9 aa, Homo Sapiens
IRRIKSLLP

SEQ ID NO: 285811 - protein, 9 aa, Homo Sapiens
CNSYCFKTS

SEQ ID NO: 285812 - protein, 9 aa, Homo Sapiens
EAQKEMQKT

SEQ ID NO: 285813 - protein, 9 aa, Homo Sapiens
EEATLTKLG

SEQ ID NO: 285814 - protein, 9 aa, Homo Sapiens
QLAHQFVLL

SEQ ID NO: 285815 - protein, 9 aa, Homo Sapiens
LFPMEPYNH

SEQ ID NO: 285816 - protein, 9 aa, Homo Sapiens
IYGGSQGLS

SEQ ID NO: 285817 - protein, 9 aa, Homo Sapiens
LNELHKFLE

SEQ ID NO: 285818 - protein, 9 aa, Homo Sapiens
IPSILLILW

SEQ ID NO: 285819 - protein, 9 aa, Homo Sapiens
WNDDRCKMK

SEQ ID NO: 285820 - protein, 9 aa, Homo Sapiens
ELTKSLEYP

SEQ ID NO: 285821 - protein, 9 aa, Homo Sapiens
MFAFFPDDF

SEQ ID NO: 285822 - protein, 9 aa, Homo Sapiens
QNIVESQIN

SEQ ID NO: 285823 - protein, 9 aa, Homo Sapiens
ARWTPIGMP

SEQ ID NO: 285824 - protein, 9 aa, Homo Sapiens
HNTDLSEIK

SEQ ID NO: 285825 - protein, 9 aa, Homo Sapiens
RVGAVSSPQ

SEQ ID NO: 285826 - protein, 9 aa, Homo Sapiens
YCLRHVENG

SEQ ID NO: 285827 - protein, 9 aa, Homo Sapiens
WTILGLSHA

SEQ ID NO: 285828 - protein, 9 aa, Homo Sapiens
EINLDTDKS

SEQ ID NO: 285829 - protein, 9 aa, Homo Sapiens
SVIDYDIVN

SEQ ID NO: 285830 - protein, 9 aa, Homo Sapiens
PNRKKTSED

SEQ ID NO: 285831 - protein, 9 aa, Homo Sapiens
YNGVLYENK

SEQ ID NO: 285832 - protein, 9 aa, Homo Sapiens
FNPHLQAPM

SEQ ID NO: 285833 - protein, 9 aa, Homo Sapiens
ELAPVGTTI

SEQ ID NO: 285834 - protein, 9 aa, Homo Sapiens
TEELFSVVT

SEQ ID NO: 285835 - protein, 9 aa, Homo Sapiens
NNMKTQFKE

SEQ ID NO: 285836 - protein, 9 aa, Homo Sapiens
KHDCFNSYH

SEQ ID NO: 285837 - protein, 9 aa, Homo Sapiens
REQEQQQQL

SEQ ID NO: 285838 - protein, 9 aa, Homo Sapiens
QQCLAPRLP

SEQ ID NO: 285839 - protein, 9 aa, Homo Sapiens
NYIINCAYS

SEQ ID NO: 285840 - protein, 9 aa, Homo Sapiens
PTGMTCLES

SEQ ID NO: 285841 - protein, 9 aa, Homo Sapiens
MQIPRVCYH

SEQ ID NO: 285842 - protein, 9 aa, Homo Sapiens
MAEKLFSSE

SEQ ID NO: 285843 - protein, 9 aa, Homo Sapiens
LYTKLSARP

SEQ ID NO: 285844 - protein, 9 aa, Homo Sapiens
LNSVGNYLS

SEQ ID NO: 285845 - protein, 9 aa, Homo Sapiens
TNIKAKLHQ

SEQ ID NO: 285846 - protein, 9 aa, Homo Sapiens
FMEIRKFDL

SEQ ID NO: 285847 - protein, 9 aa, Homo Sapiens
FLSEIQWEK

SEQ ID NO: 285848 - protein, 9 aa, Homo Sapiens
LKNDHNSGL

SEQ ID NO: 285849 - protein, 9 aa, Homo Sapiens
LPKTHPHGD

SEQ ID NO: 285850 - protein, 9 aa, Homo Sapiens
LQGDRHFVS

SEQ ID NO: 285851 - protein, 9 aa, Homo Sapiens
PLCYLLGML

SEQ ID NO: 285852 - protein, 9 aa, Homo Sapiens
DKTILNLEV

SEQ ID NO: 285853 - protein, 9 aa, Homo Sapiens
EIYYLTNME

SEQ ID NO: 285854 - protein, 9 aa, Homo Sapiens
ADTDLRMTF

SEQ ID NO: 285855 - protein, 9 aa, Homo Sapiens
TYRQHRDAK

SEQ ID NO: 285856 - protein, 9 aa, Homo Sapiens
RKKEGKETK

SEQ ID NO: 285857 - protein, 9 aa, Homo Sapiens
LQGLLHIIP

SEQ ID NO: 285858 - protein, 9 aa, Homo Sapiens
NMNAFMVNL

SEQ ID NO: 285859 - protein, 9 aa, Homo Sapiens
FTGSKGESV

SEQ ID NO: 285860 - protein, 9 aa, Homo Sapiens
NQHVSTSRV

SEQ ID NO: 285861 - protein, 9 aa, Homo Sapiens
VQAKSSNYP

SEQ ID NO: 285862 - protein, 9 aa, Homo Sapiens
GRLFRLQTL

SEQ ID NO: 285863 - protein, 9 aa, Homo Sapiens
TAENQSKPE

SEQ ID NO: 285864 - protein, 9 aa, Homo Sapiens
FFPQTLEIH

SEQ ID NO: 285865 - protein, 9 aa, Homo Sapiens
TGDKPYACE

SEQ ID NO: 285866 - protein, 9 aa, Homo Sapiens
TDKWNTDNT

SEQ ID NO: 285867 - protein, 9 aa, Homo Sapiens
SILYIGEKT

SEQ ID NO: 285868 - protein, 9 aa, Homo Sapiens
NCQAPCSTN

SEQ ID NO: 285869 - protein, 9 aa, Homo Sapiens
TLRLCRFFA

SEQ ID NO: 285870 - protein, 9 aa, Homo Sapiens
DLLELIRDA

SEQ ID NO: 285871 - protein, 9 aa, Homo Sapiens
LTKIHLSPG

SEQ ID NO: 285872 - protein, 9 aa, Homo Sapiens
ALLKKTTIP

SEQ ID NO: 285873 - protein, 9 aa, Homo Sapiens
AKILEESYQ

SEQ ID NO: 285874 - protein, 9 aa, Homo Sapiens
FCSSGTLPV

SEQ ID NO: 285875 - protein, 9 aa, Homo Sapiens
PHVSGRPPV

SEQ ID NO: 285876 - protein, 9 aa, Homo Sapiens
AAAVASLTN

SEQ ID NO: 285877 - protein, 9 aa, Homo Sapiens
RKLKKAKAL

SEQ ID NO: 285878 - protein, 9 aa, Homo Sapiens
LLLISLAHV

SEQ ID NO: 285879 - protein, 9 aa, Homo Sapiens
MQRNAMYLN

SEQ ID NO: 285880 - protein, 9 aa, Homo Sapiens
SPHTAVKYF

SEQ ID NO: 285881 - protein, 9 aa, Homo Sapiens
YGMSSVPSA

SEQ ID NO: 285882 - protein, 9 aa, Homo Sapiens
ADRERIEAS

SEQ ID NO: 285883 - protein, 9 aa, Homo Sapiens
VNFLDIDPR

SEQ ID NO: 285884 - protein, 9 aa, Homo Sapiens
TGLTDCILS

SEQ ID NO: 285885 - protein, 9 aa, Homo Sapiens
GKSVQKKQS

SEQ ID NO: 285886 - protein, 9 aa, Homo Sapiens
GSVQAKVLT

SEQ ID NO: 285887 - protein, 9 aa, Homo Sapiens
LIPVEEHFR

SEQ ID NO: 285888 - protein, 9 aa, Homo Sapiens
NIFIRNPRT

SEQ ID NO: 285889 - protein, 9 aa, Homo Sapiens
NDLLTSALD

SEQ ID NO: 285890 - protein, 9 aa, Homo Sapiens
TNCEQNSPD

SEQ ID NO: 285891 - protein, 9 aa, Homo Sapiens
PNNYLSKEG

SEQ ID NO: 285892 - protein, 9 aa, Homo Sapiens
VISVLVILS

SEQ ID NO: 285893 - protein, 9 aa, Homo Sapiens
TGFPCVRLL

SEQ ID NO: 285894 - protein, 9 aa, Homo Sapiens
TVVEKHKES

SEQ ID NO: 285895 - protein, 9 aa, Homo Sapiens
VAVAPNTLH

SEQ ID NO: 285896 - protein, 9 aa, Homo Sapiens
TPNRLKHIW

SEQ ID NO: 285897 - protein, 9 aa, Homo Sapiens
EDVHKLREL

SEQ ID NO: 285898 - protein, 9 aa, Homo Sapiens
VESLTCLCN

SEQ ID NO: 285899 - protein, 9 aa, Homo Sapiens
IIEIFDNIN

SEQ ID NO: 285900 - protein, 9 aa, Homo Sapiens
EAQFAKIKL

SEQ ID NO: 285901 - protein, 9 aa, Homo Sapiens
PVESIVTLN

SEQ ID NO: 285902 - protein, 9 aa, Homo Sapiens
QVSCNINIT

SEQ ID NO: 285903 - protein, 9 aa, Homo Sapiens
IADKQSGKN

SEQ ID NO: 285904 - protein, 9 aa, Homo Sapiens
KGKDDALSH

SEQ ID NO: 285905 - protein, 9 aa, Homo Sapiens
NGDMERVAN

SEQ ID NO: 285906 - protein, 9 aa, Homo Sapiens
IRGNLANSN

SEQ ID NO: 285907 - protein, 9 aa, Homo Sapiens
MATAICQYA

SEQ ID NO: 285908 - protein, 9 aa, Homo Sapiens
ITWCRVQKQ

SEQ ID NO: 285909 - protein, 9 aa, Homo Sapiens
QNHRVQFEE

SEQ ID NO: 285910 - protein, 9 aa, Homo Sapiens
IWPASLNEH

SEQ ID NO: 285911 - protein, 9 aa, Homo Sapiens
IPHIVNNAC

SEQ ID NO: 285912 - protein, 9 aa, Homo Sapiens
GVQRGGGRG

SEQ ID NO: 285913 - protein, 9 aa, Homo Sapiens
TEESFNKTW

SEQ ID NO: 285914 - protein, 9 aa, Homo Sapiens
GSKDKEKYS

SEQ ID NO: 285915 - protein, 9 aa, Homo Sapiens
ADFEAKIIE

SEQ ID NO: 285916 - protein, 9 aa, Homo Sapiens
MQLESREEH

SEQ ID NO: 285917 - protein, 9 aa, Homo Sapiens
IVIDGSSVA

SEQ ID NO: 285918 - protein, 9 aa, Homo Sapiens
PKEMVLDFV

SEQ ID NO: 285919 - protein, 9 aa, Homo Sapiens
KLDFETMSL

SEQ ID NO: 285920 - protein, 9 aa, Homo Sapiens
HYRHRFNNC

SEQ ID NO: 285921 - protein, 9 aa, Homo Sapiens
PNGIPKIHE

SEQ ID NO: 285922 - protein, 9 aa, Homo Sapiens
QTLLFKRVF

SEQ ID NO: 285923 - protein, 9 aa, Homo Sapiens
AEKFQEMKE

SEQ ID NO: 285924 - protein, 9 aa, Homo Sapiens
QQIANYLTR

SEQ ID NO: 285925 - protein, 9 aa, Homo Sapiens
NTSRMEKLL

SEQ ID NO: 285926 - protein, 9 aa, Homo Sapiens
LRRLNFTGN

SEQ ID NO: 285927 - protein, 9 aa, Homo Sapiens
LLTSTEKAH

SEQ ID NO: 285928 - protein, 9 aa, Homo Sapiens
SGQSEVYLI

SEQ ID NO: 285929 - protein, 9 aa, Homo Sapiens
RPVSQETEP

SEQ ID NO: 285930 - protein, 9 aa, Homo Sapiens
SGKAPPKTD

SEQ ID NO: 285931 - protein, 9 aa, Homo Sapiens
WRNRNKKTE

SEQ ID NO: 285932 - protein, 9 aa, Homo Sapiens
QMAINWLTG

SEQ ID NO: 285933 - protein, 9 aa, Homo Sapiens
TKCIGNIFQ

SEQ ID NO: 285934 - protein, 9 aa, Homo Sapiens
AKYVAELSI

SEQ ID NO: 285935 - protein, 9 aa, Homo Sapiens
KRLNIFFSS

SEQ ID NO: 285936 - protein, 9 aa, Homo Sapiens
SVTSVGKVK

SEQ ID NO: 285937 - protein, 9 aa, Homo Sapiens
SCAFHDCQN

SEQ ID NO: 285938 - protein, 9 aa, Homo Sapiens
LNAKTFYTD

SEQ ID NO: 285939 - protein, 9 aa, Homo Sapiens
NTPNNYLSK

SEQ ID NO: 285940 - protein, 9 aa, Homo Sapiens
VAMIPRCIK

SEQ ID NO: 285941 - protein, 9 aa, Homo Sapiens
EKHLGRVHF

SEQ ID NO: 285942 - protein, 9 aa, Homo Sapiens
RATYALCIL

SEQ ID NO: 285943 - protein, 9 aa, Homo Sapiens
EEQEKMLQE

SEQ ID NO: 285944 - protein, 9 aa, Homo Sapiens
KPKVFILHS

SEQ ID NO: 285945 - protein, 9 aa, Homo Sapiens
DKYQYFLSS

SEQ ID NO: 285946 - protein, 9 aa, Homo Sapiens
FGCGVLASA

SEQ ID NO: 285947 - protein, 9 aa, Homo Sapiens
FQDGDKLGT

SEQ ID NO: 285948 - protein, 9 aa, Homo Sapiens
KMREALRHL

SEQ ID NO: 285949 - protein, 9 aa, Homo Sapiens
QCTLDKGGE

SEQ ID NO: 285950 - protein, 9 aa, Homo Sapiens
GFTGMQPCV

SEQ ID NO: 285951 - protein, 9 aa, Homo Sapiens
VSPDVMLDK

SEQ ID NO: 285952 - protein, 9 aa, Homo Sapiens
LMTCISLQN

SEQ ID NO: 285953 - protein, 9 aa, Homo Sapiens
TSSKIMAAA

SEQ ID NO: 285954 - protein, 9 aa, Homo Sapiens
AKTLISLEN

SEQ ID NO: 285955 - protein, 9 aa, Homo Sapiens
EVRTWVKFQ

SEQ ID NO: 285956 - protein, 9 aa, Homo Sapiens
IYEREQLET

SEQ ID NO: 285957 - protein, 9 aa, Homo Sapiens
LLLHGFPGF

SEQ ID NO: 285958 - protein, 9 aa, Homo Sapiens
QEQTEALSN

SEQ ID NO: 285959 - protein, 9 aa, Homo Sapiens
KTIISQHEN

SEQ ID NO: 285960 - protein, 9 aa, Homo Sapiens
VSDHLGHSM

SEQ ID NO: 285961 - protein, 9 aa, Homo Sapiens
LYSVIRGEA

SEQ ID NO: 285962 - protein, 9 aa, Homo Sapiens
SSKAESPQC

SEQ ID NO: 285963 - protein, 9 aa, Homo Sapiens
IGQAKENIF

SEQ ID NO: 285964 - protein, 9 aa, Homo Sapiens
SSTGLAPDP

SEQ ID NO: 285965 - protein, 9 aa, Homo Sapiens
PPGLTPFSC

SEQ ID NO: 285966 - protein, 9 aa, Homo Sapiens
EMPQESFRS

SEQ ID NO: 285967 - protein, 9 aa, Homo Sapiens
SRYAQYKKF

SEQ ID NO: 285968 - protein, 9 aa, Homo Sapiens
GHFLIVPFG

SEQ ID NO: 285969 - protein, 9 aa, Homo Sapiens
KLVSMAGHS

SEQ ID NO: 285970 - protein, 9 aa, Homo Sapiens
MKYRDLGKS

SEQ ID NO: 285971 - protein, 9 aa, Homo Sapiens
ISNYAYAPS

SEQ ID NO: 285972 - protein, 9 aa, Homo Sapiens
INATFIKGV

SEQ ID NO: 285973 - protein, 9 aa, Homo Sapiens
TTKEAGSVS

SEQ ID NO: 285974 - protein, 9 aa, Homo Sapiens
ETQEWERIL

SEQ ID NO: 285975 - protein, 9 aa, Homo Sapiens
ESPDKLDKK

SEQ ID NO: 285976 - protein, 9 aa, Homo Sapiens
MECEKRFRK

SEQ ID NO: 285977 - protein, 9 aa, Homo Sapiens
NLFCDVPQV

SEQ ID NO: 285978 - protein, 9 aa, Homo Sapiens
TDSAEQINK

SEQ ID NO: 285979 - protein, 9 aa, Homo Sapiens
KTFWEKSNP

SEQ ID NO: 285980 - protein, 9 aa, Homo Sapiens
LAFDVKIER

SEQ ID NO: 285981 - protein, 9 aa, Homo Sapiens
LATKTSKRA

SEQ ID NO: 285982 - protein, 9 aa, Homo Sapiens
QEECKGFSY

SEQ ID NO: 285983 - protein, 9 aa, Homo Sapiens
PQAKCDSEE

SEQ ID NO: 285984 - protein, 9 aa, Homo Sapiens
DVMQPATNA

SEQ ID NO: 285985 - protein, 9 aa, Homo Sapiens
YQQFHIIVC

SEQ ID NO: 285986 - protein, 9 aa, Homo Sapiens
YNADLLSPL

SEQ ID NO: 285987 - protein, 9 aa, Homo Sapiens
AKPPLPCAP

SEQ ID NO: 285988 - protein, 9 aa, Homo Sapiens
KSRLQLVMK

SEQ ID NO: 285989 - protein, 9 aa, Homo Sapiens
GKKNRSSVK

SEQ ID NO: 285990 - protein, 9 aa, Homo Sapiens
VVSDSELHQ

SEQ ID NO: 285991 - protein, 9 aa, Homo Sapiens
NVMNVLSIL

SEQ ID NO: 285992 - protein, 9 aa, Homo Sapiens
IANKTNRGR

SEQ ID NO: 285993 - protein, 9 aa, Homo Sapiens
YFSGIKGLQ

SEQ ID NO: 285994 - protein, 9 aa, Homo Sapiens
NRTPQNLHA

SEQ ID NO: 285995 - protein, 9 aa, Homo Sapiens
LEFGYPGET

SEQ ID NO: 285996 - protein, 9 aa, Homo Sapiens
SYYKSLLSV

SEQ ID NO: 285997 - protein, 9 aa, Homo Sapiens
AWNLVIQER

SEQ ID NO: 285998 - protein, 9 aa, Homo Sapiens
LFILFITWC

SEQ ID NO: 285999 - protein, 9 aa, Homo Sapiens
ITRYKIKSD

SEQ ID NO: 286000 - protein, 9 aa, Homo Sapiens
YPSPGPYPT

SEQ ID NO: 286001 - protein, 9 aa, Homo Sapiens
WRQNTNSSR

SEQ ID NO: 286002 - protein, 9 aa, Homo Sapiens
PDLKECILI

SEQ ID NO: 286003 - protein, 9 aa, Homo Sapiens
MAKCQMLIQ

SEQ ID NO: 286004 - protein, 9 aa, Homo Sapiens
SVKAIIQGA

SEQ ID NO: 286005 - protein, 9 aa, Homo Sapiens
TLWAAYRQV

SEQ ID NO: 286006 - protein, 9 aa, Homo Sapiens
PQNKGLPLL

SEQ ID NO: 286007 - protein, 9 aa, Homo Sapiens
DSELFLDKF

SEQ ID NO: 286008 - protein, 9 aa, Homo Sapiens
SELSAVTDR

SEQ ID NO: 286009 - protein, 9 aa, Homo Sapiens
PNDSHMLVA

SEQ ID NO: 286010 - protein, 9 aa, Homo Sapiens
SDFEDYPMI

SEQ ID NO: 286011 - protein, 9 aa, Homo Sapiens
RCLGVTAQQ

SEQ ID NO: 286012 - protein, 9 aa, Homo Sapiens
FEIICVIVE

SEQ ID NO: 286013 - protein, 9 aa, Homo Sapiens
KLSDLTLGH

SEQ ID NO: 286014 - protein, 9 aa, Homo Sapiens
NLSFNDIHY

SEQ ID NO: 286015 - protein, 9 aa, Homo Sapiens
LGSPGRTFK

SEQ ID NO: 286016 - protein, 9 aa, Homo Sapiens
PKDLWDILN

SEQ ID NO: 286017 - protein, 9 aa, Homo Sapiens
YYFFSNLSF

SEQ ID NO: 286018 - protein, 9 aa, Homo Sapiens
TNLNFSVIA

SEQ ID NO: 286019 - protein, 9 aa, Homo Sapiens
HGSTFICNT

SEQ ID NO: 286020 - protein, 9 aa, Homo Sapiens
IFTLDEIYG

SEQ ID NO: 286021 - protein, 9 aa, Homo Sapiens
AVDRPLRSV

SEQ ID NO: 286022 - protein, 9 aa, Homo Sapiens
KTTVCDLFC

SEQ ID NO: 286023 - protein, 9 aa, Homo Sapiens
TEHSDIYLQ

SEQ ID NO: 286024 - protein, 9 aa, Homo Sapiens
ICCCCTTLT

SEQ ID NO: 286025 - protein, 9 aa, Homo Sapiens
SKPGIYVMT

SEQ ID NO: 286026 - protein, 9 aa, Homo Sapiens
SHGSPISGQ

SEQ ID NO: 286027 - protein, 9 aa, Homo Sapiens
EEPPVASED

SEQ ID NO: 286028 - protein, 9 aa, Homo Sapiens
VTLAKSRKN

SEQ ID NO: 286029 - protein, 9 aa, Homo Sapiens
RDIRSPAAA

SEQ ID NO: 286030 - protein, 9 aa, Homo Sapiens
SSSSSICKY

SEQ ID NO: 286031 - protein, 9 aa, Homo Sapiens
NTDQDAPVT

SEQ ID NO: 286032 - protein, 9 aa, Homo Sapiens
NGKARANNT

SEQ ID NO: 286033 - protein, 9 aa, Homo Sapiens
LLSNDLVAF

SEQ ID NO: 286034 - protein, 9 aa, Homo Sapiens
LIWAVIHSV

SEQ ID NO: 286035 - protein, 9 aa, Homo Sapiens
SKDNNSGAG

SEQ ID NO: 286036 - protein, 9 aa, Homo Sapiens
SFDTTLKVW

SEQ ID NO: 286037 - protein, 9 aa, Homo Sapiens
EEESEILRR

SEQ ID NO: 286038 - protein, 9 aa, Homo Sapiens
APEKQRLFA

SEQ ID NO: 286039 - protein, 9 aa, Homo Sapiens
SISKDDLIA

SEQ ID NO: 286040 - protein, 9 aa, Homo Sapiens
SHAIGKQQE

SEQ ID NO: 286041 - protein, 9 aa, Homo Sapiens
AFVEWIPPQ

SEQ ID NO: 286042 - protein, 9 aa, Homo Sapiens
DQQSHLECR

SEQ ID NO: 286043 - protein, 9 aa, Homo Sapiens
ANSKHALLP

SEQ ID NO: 286044 - protein, 9 aa, Homo Sapiens
GVATATVNA

SEQ ID NO: 286045 - protein, 9 aa, Homo Sapiens
FDYSKVSFW

SEQ ID NO: 286046 - protein, 9 aa, Homo Sapiens
LGFIFVVND

SEQ ID NO: 286047 - protein, 9 aa, Homo Sapiens
SGGGDNDSE

SEQ ID NO: 286048 - protein, 9 aa, Homo Sapiens
KAVNYHLLG

SEQ ID NO: 286049 - protein, 9 aa, Homo Sapiens
AFFPAFSYK

SEQ ID NO: 286050 - protein, 9 aa, Homo Sapiens
LDREEIKEH

SEQ ID NO: 286051 - protein, 9 aa, Homo Sapiens
QPKLGNIVK

SEQ ID NO: 286052 - protein, 9 aa, Homo Sapiens
GELPSHPKK

SEQ ID NO: 286053 - protein, 9 aa, Homo Sapiens
QSEMFKYEF

SEQ ID NO: 286054 - protein, 9 aa, Homo Sapiens
SGDEKGVVL

SEQ ID NO: 286055 - protein, 9 aa, Homo Sapiens
SQTQPVYLA

SEQ ID NO: 286056 - protein, 9 aa, Homo Sapiens
KETTHSMVE

SEQ ID NO: 286057 - protein, 9 aa, Homo Sapiens
RLRGPPPAG

SEQ ID NO: 286058 - protein, 9 aa, Homo Sapiens
TMMFFSNCP

SEQ ID NO: 286059 - protein, 9 aa, Homo Sapiens
EDEGEDKDD

SEQ ID NO: 286060 - protein, 9 aa, Homo Sapiens
FQDCYFETH

SEQ ID NO: 286061 - protein, 9 aa, Homo Sapiens
YDKYIDLEP

SEQ ID NO: 286062 - protein, 9 aa, Homo Sapiens
LHEIIHTGE

SEQ ID NO: 286063 - protein, 9 aa, Homo Sapiens
KLQQVPRLF

SEQ ID NO: 286064 - protein, 9 aa, Homo Sapiens
FCSKKKLRE

SEQ ID NO: 286065 - protein, 9 aa, Homo Sapiens
EYVSWWWCF

SEQ ID NO: 286066 - protein, 9 aa, Homo Sapiens
ITTREQLSR

SEQ ID NO: 286067 - protein, 9 aa, Homo Sapiens
LVLYLGSIS

SEQ ID NO: 286068 - protein, 9 aa, Homo Sapiens
DVNHATLAG

SEQ ID NO: 286069 - protein, 9 aa, Homo Sapiens
TLVKIYKHE

SEQ ID NO: 286070 - protein, 9 aa, Homo Sapiens
TAGAAQMKT

SEQ ID NO: 286071 - protein, 9 aa, Homo Sapiens
NKLSARDHQ

SEQ ID NO: 286072 - protein, 9 aa, Homo Sapiens
RRKRSGNFN

SEQ ID NO: 286073 - protein, 9 aa, Homo Sapiens
LILREIVIN

SEQ ID NO: 286074 - protein, 9 aa, Homo Sapiens
ISSLMIVLL

SEQ ID NO: 286075 - protein, 9 aa, Homo Sapiens
DSKEIVRWR

SEQ ID NO: 286076 - protein, 9 aa, Homo Sapiens
EREHVDTFE

SEQ ID NO: 286077 - protein, 9 aa, Homo Sapiens
VMDPSLCLL

SEQ ID NO: 286078 - protein, 9 aa, Homo Sapiens
LWIYLAAVK

SEQ ID NO: 286079 - protein, 9 aa, Homo Sapiens
CCCTTLTAI

SEQ ID NO: 286080 - protein, 9 aa, Homo Sapiens
LSFQHPPEA

SEQ ID NO: 286081 - protein, 9 aa, Homo Sapiens
EMLFNRRRK

SEQ ID NO: 286082 - protein, 9 aa, Homo Sapiens
NVVVISVLV

SEQ ID NO: 286083 - protein, 9 aa, Homo Sapiens
GEILSPTYP

SEQ ID NO: 286084 - protein, 9 aa, Homo Sapiens
VQVLQDNFV

SEQ ID NO: 286085 - protein, 9 aa, Homo Sapiens
LMLAEPPHN

SEQ ID NO: 286086 - protein, 9 aa, Homo Sapiens
QNKRGRRTR

SEQ ID NO: 286087 - protein, 9 aa, Homo Sapiens
RFVIPSKAF

SEQ ID NO: 286088 - protein, 9 aa, Homo Sapiens
RKRRSFSKQ

SEQ ID NO: 286089 - protein, 9 aa, Homo Sapiens
RHITILKLV

SEQ ID NO: 286090 - protein, 9 aa, Homo Sapiens
PYGIKSFDS

SEQ ID NO: 286091 - protein, 9 aa, Homo Sapiens
SVQTISNKQ

SEQ ID NO: 286092 - protein, 9 aa, Homo Sapiens
MNLRLCVQL

SEQ ID NO: 286093 - protein, 9 aa, Homo Sapiens
NGAYTSLLS

SEQ ID NO: 286094 - protein, 9 aa, Homo Sapiens
ETYQESVRQ

SEQ ID NO: 286095 - protein, 9 aa, Homo Sapiens
AYEIKPLAL

SEQ ID NO: 286096 - protein, 9 aa, Homo Sapiens
GQEGPLEGE

SEQ ID NO: 286097 - protein, 9 aa, Homo Sapiens
PMIILYDLH

SEQ ID NO: 286098 - protein, 9 aa, Homo Sapiens
FIKEVDMKD

SEQ ID NO: 286099 - protein, 9 aa, Homo Sapiens
EYGLTFTDK

SEQ ID NO: 286100 - protein, 9 aa, Homo Sapiens
SIASLASYM

SEQ ID NO: 286101 - protein, 9 aa, Homo Sapiens
YKNLSLRYS

SEQ ID NO: 286102 - protein, 9 aa, Homo Sapiens
QLMEKKPSW

SEQ ID NO: 286103 - protein, 9 aa, Homo Sapiens
EKTRMKLTL

SEQ ID NO: 286104 - protein, 9 aa, Homo Sapiens
ANPIFYGFL

SEQ ID NO: 286105 - protein, 9 aa, Homo Sapiens
KLFPMEPYN

SEQ ID NO: 286106 - protein, 9 aa, Homo Sapiens
FQTILTEMY

SEQ ID NO: 286107 - protein, 9 aa, Homo Sapiens
KRGPPGPQV

SEQ ID NO: 286108 - protein, 9 aa, Homo Sapiens
VLPTSPTPA

SEQ ID NO: 286109 - protein, 9 aa, Homo Sapiens
EFYESCCPT

SEQ ID NO: 286110 - protein, 9 aa, Homo Sapiens
PVIICVTTV

SEQ ID NO: 286111 - protein, 9 aa, Homo Sapiens
PTLKNDAKA

SEQ ID NO: 286112 - protein, 9 aa, Homo Sapiens
AGQIRYSVW

SEQ ID NO: 286113 - protein, 9 aa, Homo Sapiens
IFENNIYYG

SEQ ID NO: 286114 - protein, 9 aa, Homo Sapiens
GNVSLHYAC

SEQ ID NO: 286115 - protein, 9 aa, Homo Sapiens
WGGGLKRAK

SEQ ID NO: 286116 - protein, 9 aa, Homo Sapiens
ETYSDGGTC

SEQ ID NO: 286117 - protein, 9 aa, Homo Sapiens
EHRKQRREV

SEQ ID NO: 286118 - protein, 9 aa, Homo Sapiens
NALCVAEVW

SEQ ID NO: 286119 - protein, 9 aa, Homo Sapiens
ALRGLCSLT

SEQ ID NO: 286120 - protein, 9 aa, Homo Sapiens
FQSENEAYH

SEQ ID NO: 286121 - protein, 9 aa, Homo Sapiens
TRATYALCI

SEQ ID NO: 286122 - protein, 9 aa, Homo Sapiens
CVKRKVMDK

SEQ ID NO: 286123 - protein, 9 aa, Homo Sapiens
VRTWVKFQY

SEQ ID NO: 286124 - protein, 9 aa, Homo Sapiens
FYKCTECAK

SEQ ID NO: 286125 - protein, 9 aa, Homo Sapiens
CSITLSNWW

SEQ ID NO: 286126 - protein, 9 aa, Homo Sapiens
SAIPSVVSS

SEQ ID NO: 286127 - protein, 9 aa, Homo Sapiens
MKIYLVQSV

SEQ ID NO: 286128 - protein, 9 aa, Homo Sapiens
SDSGLSDPE

SEQ ID NO: 286129 - protein, 9 aa, Homo Sapiens
QISSKTGIP

SEQ ID NO: 286130 - protein, 9 aa, Homo Sapiens
EPVNRDNFT

SEQ ID NO: 286131 - protein, 9 aa, Homo Sapiens
QREEQDKML

SEQ ID NO: 286132 - protein, 9 aa, Homo Sapiens
LVIWDINKH

SEQ ID NO: 286133 - protein, 9 aa, Homo Sapiens
GIDSQYYCN

SEQ ID NO: 286134 - protein, 9 aa, Homo Sapiens
SLCCLCRGD

SEQ ID NO: 286135 - protein, 9 aa, Homo Sapiens
KVLVHLQHD

SEQ ID NO: 286136 - protein, 9 aa, Homo Sapiens
ENNFGSSHV

SEQ ID NO: 286137 - protein, 9 aa, Homo Sapiens
LGNLKYMAL

SEQ ID NO: 286138 - protein, 9 aa, Homo Sapiens
VHSGQKYFK

SEQ ID NO: 286139 - protein, 9 aa, Homo Sapiens
TRYLLPCSH

SEQ ID NO: 286140 - protein, 9 aa, Homo Sapiens
NVDLGGNSF

SEQ ID NO: 286141 - protein, 9 aa, Homo Sapiens
LGKAALVGM

SEQ ID NO: 286142 - protein, 9 aa, Homo Sapiens
YISLADMMA

SEQ ID NO: 286143 - protein, 9 aa, Homo Sapiens
IRIESITSD

SEQ ID NO: 286144 - protein, 9 aa, Homo Sapiens
IKRPWPLCG

SEQ ID NO: 286145 - protein, 9 aa, Homo Sapiens
VFENGKPKF

SEQ ID NO: 286146 - protein, 9 aa, Homo Sapiens
FQPTNEMLL

SEQ ID NO: 286147 - protein, 9 aa, Homo Sapiens
PMDTNMMVP

SEQ ID NO: 286148 - protein, 9 aa, Homo Sapiens
GRKLEELSN

SEQ ID NO: 286149 - protein, 9 aa, Homo Sapiens
SPQIPLPAQ

SEQ ID NO: 286150 - protein, 9 aa, Homo Sapiens
INKLKNELR

SEQ ID NO: 286151 - protein, 9 aa, Homo Sapiens
AAEDAAVKA

SEQ ID NO: 286152 - protein, 9 aa, Homo Sapiens
AILHHFIPD

SEQ ID NO: 286153 - protein, 9 aa, Homo Sapiens
SLIGYWVLQ

SEQ ID NO: 286154 - protein, 9 aa, Homo Sapiens
YHHKKTFSG

SEQ ID NO: 286155 - protein, 9 aa, Homo Sapiens
VKFKVPDVE

SEQ ID NO: 286156 - protein, 9 aa, Homo Sapiens
MDLPKGLPG

SEQ ID NO: 286157 - protein, 9 aa, Homo Sapiens
QSIKDTFIS

SEQ ID NO: 286158 - protein, 9 aa, Homo Sapiens
APIVSPSDT

SEQ ID NO: 286159 - protein, 9 aa, Homo Sapiens
EVLQQNIQG

SEQ ID NO: 286160 - protein, 9 aa, Homo Sapiens
RIVAIKKLL

SEQ ID NO: 286161 - protein, 9 aa, Homo Sapiens
SHSEGPLST

SEQ ID NO: 286162 - protein, 9 aa, Homo Sapiens
GPEENFLSV

SEQ ID NO: 286163 - protein, 9 aa, Homo Sapiens
LGRGTKHYS

SEQ ID NO: 286164 - protein, 9 aa, Homo Sapiens
KLERKQEQR

SEQ ID NO: 286165 - protein, 9 aa, Homo Sapiens
LFLLEGVRS

SEQ ID NO: 286166 - protein, 9 aa, Homo Sapiens
NENVSSSAV

SEQ ID NO: 286167 - protein, 9 aa, Homo Sapiens
IKDINKKLY

SEQ ID NO: 286168 - protein, 9 aa, Homo Sapiens
RLDAGVKLF

SEQ ID NO: 286169 - protein, 9 aa, Homo Sapiens
QSGVDPSVT

SEQ ID NO: 286170 - protein, 9 aa, Homo Sapiens
HQNGERVEQ

SEQ ID NO: 286171 - protein, 9 aa, Homo Sapiens
KSILDIVTK

SEQ ID NO: 286172 - protein, 9 aa, Homo Sapiens
ENKYSPCAW

SEQ ID NO: 286173 - protein, 9 aa, Homo Sapiens
LATSKDKLF

SEQ ID NO: 286174 - protein, 9 aa, Homo Sapiens
EKLENKIIN

SEQ ID NO: 286175 - protein, 9 aa, Homo Sapiens
SVQEEGPRV

SEQ ID NO: 286176 - protein, 9 aa, Homo Sapiens
PITNSASQV

SEQ ID NO: 286177 - protein, 9 aa, Homo Sapiens
IITPYTLPR

SEQ ID NO: 286178 - protein, 9 aa, Homo Sapiens
ANLPYRTIS

SEQ ID NO: 286179 - protein, 9 aa, Homo Sapiens
YSNSKDGET

SEQ ID NO: 286180 - protein, 9 aa, Homo Sapiens
FTKAKLFIK

SEQ ID NO: 286181 - protein, 9 aa, Homo Sapiens
TCGGVKGML

SEQ ID NO: 286182 - protein, 9 aa, Homo Sapiens
LRPAGNRLG

SEQ ID NO: 286183 - protein, 9 aa, Homo Sapiens
NLKREAENV

SEQ ID NO: 286184 - protein, 9 aa, Homo Sapiens
EEHFRTLNG

SEQ ID NO: 286185 - protein, 9 aa, Homo Sapiens
RATLVGGTT

SEQ ID NO: 286186 - protein, 9 aa, Homo Sapiens
SFTKNTKKN

SEQ ID NO: 286187 - protein, 9 aa, Homo Sapiens
GYPYRDKIT

SEQ ID NO: 286188 - protein, 9 aa, Homo Sapiens
LLLRSIEEL

SEQ ID NO: 286189 - protein, 9 aa, Homo Sapiens
RGFVVDVPE

SEQ ID NO: 286190 - protein, 9 aa, Homo Sapiens
NKMLRASSL

SEQ ID NO: 286191 - protein, 9 aa, Homo Sapiens
AESIITKTP

SEQ ID NO: 286192 - protein, 9 aa, Homo Sapiens
TCYPFVQAN

SEQ ID NO: 286193 - protein, 9 aa, Homo Sapiens
VLKKKLSAS

SEQ ID NO: 286194 - protein, 9 aa, Homo Sapiens
NGFGRSGRL

SEQ ID NO: 286195 - protein, 9 aa, Homo Sapiens
QWFKKLFDA

SEQ ID NO: 286196 - protein, 9 aa, Homo Sapiens
CDGKALERF

SEQ ID NO: 286197 - protein, 9 aa, Homo Sapiens
DLFLKGNIS

SEQ ID NO: 286198 - protein, 9 aa, Homo Sapiens
VTFKGPEIR

SEQ ID NO: 286199 - protein, 9 aa, Homo Sapiens
RQNRFASSK

SEQ ID NO: 286200 - protein, 9 aa, Homo Sapiens
GLMKLPFTT

SEQ ID NO: 286201 - protein, 9 aa, Homo Sapiens
TKDREYMGS

SEQ ID NO: 286202 - protein, 9 aa, Homo Sapiens
WAQSFENVM

SEQ ID NO: 286203 - protein, 9 aa, Homo Sapiens
KFKRCIRTA

SEQ ID NO: 286204 - protein, 9 aa, Homo Sapiens
KGGWQHNRK

SEQ ID NO: 286205 - protein, 9 aa, Homo Sapiens
DSTPTVLHG

SEQ ID NO: 286206 - protein, 9 aa, Homo Sapiens
PHSDPYNQR

SEQ ID NO: 286207 - protein, 9 aa, Homo Sapiens
SFNNFTLCY

SEQ ID NO: 286208 - protein, 9 aa, Homo Sapiens
DLLSLKAWL

SEQ ID NO: 286209 - protein, 9 aa, Homo Sapiens
QIISHVSGY

SEQ ID NO: 286210 - protein, 9 aa, Homo Sapiens
VKMSTFDIA

SEQ ID NO: 286211 - protein, 9 aa, Homo Sapiens
GQFLWRGEV

SEQ ID NO: 286212 - protein, 9 aa, Homo Sapiens
CDECGNTFS

SEQ ID NO: 286213 - protein, 9 aa, Homo Sapiens
FLYVILLFF

SEQ ID NO: 286214 - protein, 9 aa, Homo Sapiens
ILIQVEEVS

SEQ ID NO: 286215 - protein, 9 aa, Homo Sapiens
AYSTQSEKS

SEQ ID NO: 286216 - protein, 9 aa, Homo Sapiens
STGPSYYRS

SEQ ID NO: 286217 - protein, 9 aa, Homo Sapiens
SHQELLRKE

SEQ ID NO: 286218 - protein, 9 aa, Homo Sapiens
KKEREIPPR

SEQ ID NO: 286219 - protein, 9 aa, Homo Sapiens
KAIHADKQD

SEQ ID NO: 286220 - protein, 9 aa, Homo Sapiens
IKILDREEK

SEQ ID NO: 286221 - protein, 9 aa, Homo Sapiens
DPDDHPENY

SEQ ID NO: 286222 - protein, 9 aa, Homo Sapiens
WRLCLLLVS

SEQ ID NO: 286223 - protein, 9 aa, Homo Sapiens
NESNDRGKT

SEQ ID NO: 286224 - protein, 9 aa, Homo Sapiens
SLVQEFPQL

SEQ ID NO: 286225 - protein, 9 aa, Homo Sapiens
AALTLTDSE

SEQ ID NO: 286226 - protein, 9 aa, Homo Sapiens
ELVLTLNAW

SEQ ID NO: 286227 - protein, 9 aa, Homo Sapiens
GYLQIVRFL

SEQ ID NO: 286228 - protein, 9 aa, Homo Sapiens
AVPFPISLN

SEQ ID NO: 286229 - protein, 9 aa, Homo Sapiens
CNNESGSRS

SEQ ID NO: 286230 - protein, 9 aa, Homo Sapiens
KPKIGDAKS

SEQ ID NO: 286231 - protein, 9 aa, Homo Sapiens
APTLSTSTS

SEQ ID NO: 286232 - protein, 9 aa, Homo Sapiens
WEEKAREDK

SEQ ID NO: 286233 - protein, 9 aa, Homo Sapiens
NKSLVSQLD

SEQ ID NO: 286234 - protein, 9 aa, Homo Sapiens
EEQNLLSVA

SEQ ID NO: 286235 - protein, 9 aa, Homo Sapiens
KSNLDGTNW

SEQ ID NO: 286236 - protein, 9 aa, Homo Sapiens
HLPCVGPGP

SEQ ID NO: 286237 - protein, 9 aa, Homo Sapiens
PLISTEDGE

SEQ ID NO: 286238 - protein, 9 aa, Homo Sapiens
SGDKNIENV

SEQ ID NO: 286239 - protein, 9 aa, Homo Sapiens
FAHRIPPSY

SEQ ID NO: 286240 - protein, 9 aa, Homo Sapiens
LSHAFIFFF

SEQ ID NO: 286241 - protein, 9 aa, Homo Sapiens
LGRYQVSGS

SEQ ID NO: 286242 - protein, 9 aa, Homo Sapiens
SNQTVFVSI

SEQ ID NO: 286243 - protein, 9 aa, Homo Sapiens
DVNEDGKRR

SEQ ID NO: 286244 - protein, 9 aa, Homo Sapiens
LVYRVLLTG

SEQ ID NO: 286245 - protein, 9 aa, Homo Sapiens
HKIIHNREK

SEQ ID NO: 286246 - protein, 9 aa, Homo Sapiens
LCPSIKGTP

SEQ ID NO: 286247 - protein, 9 aa, Homo Sapiens
PIQNGNFRK

SEQ ID NO: 286248 - protein, 9 aa, Homo Sapiens
AVVVVDYRG

SEQ ID NO: 286249 - protein, 9 aa, Homo Sapiens
LLEEMEQAN

SEQ ID NO: 286250 - protein, 9 aa, Homo Sapiens
KDEYFAKDE

SEQ ID NO: 286251 - protein, 9 aa, Homo Sapiens
AFVNSREDN

SEQ ID NO: 286252 - protein, 9 aa, Homo Sapiens
SLVSQLDCL

SEQ ID NO: 286253 - protein, 9 aa, Homo Sapiens
LLEDLNDLI

SEQ ID NO: 286254 - protein, 9 aa, Homo Sapiens
VATATVNAM

SEQ ID NO: 286255 - protein, 9 aa, Homo Sapiens
NLSYMELPF

SEQ ID NO: 286256 - protein, 9 aa, Homo Sapiens
NKLMHCRSH

SEQ ID NO: 286257 - protein, 9 aa, Homo Sapiens
CPRMDDEDE

SEQ ID NO: 286258 - protein, 9 aa, Homo Sapiens
IPHFFCDFV

SEQ ID NO: 286259 - protein, 9 aa, Homo Sapiens
LNLMEFNLL

SEQ ID NO: 286260 - protein, 9 aa, Homo Sapiens
ACRDMGYKT

SEQ ID NO: 286261 - protein, 9 aa, Homo Sapiens
KVNRLDMHG

SEQ ID NO: 286262 - protein, 9 aa, Homo Sapiens
QQTRWSKSH

SEQ ID NO: 286263 - protein, 9 aa, Homo Sapiens
YVTGRLLRA

SEQ ID NO: 286264 - protein, 9 aa, Homo Sapiens
RKCQARFLQ

SEQ ID NO: 286265 - protein, 9 aa, Homo Sapiens
LLSIFEEEI

SEQ ID NO: 286266 - protein, 9 aa, Homo Sapiens
CNYFDATES

SEQ ID NO: 286267 - protein, 9 aa, Homo Sapiens
LPVPKKSPT

SEQ ID NO: 286268 - protein, 9 aa, Homo Sapiens
DVLEFVCEA

SEQ ID NO: 286269 - protein, 9 aa, Homo Sapiens
LSTTQSTTV

SEQ ID NO: 286270 - protein, 9 aa, Homo Sapiens
LKIPLNGRP

SEQ ID NO: 286271 - protein, 9 aa, Homo Sapiens
QFAFQASIT

SEQ ID NO: 286272 - protein, 9 aa, Homo Sapiens
CGFWSRLHT

SEQ ID NO: 286273 - protein, 9 aa, Homo Sapiens
LPNMDSSVP

SEQ ID NO: 286274 - protein, 9 aa, Homo Sapiens
AVVSSVNSV

SEQ ID NO: 286275 - protein, 9 aa, Homo Sapiens
TGECKNLIY

SEQ ID NO: 286276 - protein, 9 aa, Homo Sapiens
RSAANIALM

SEQ ID NO: 286277 - protein, 9 aa, Homo Sapiens
LLRANQARD

SEQ ID NO: 286278 - protein, 9 aa, Homo Sapiens
CTDHTVLIQ

SEQ ID NO: 286279 - protein, 9 aa, Homo Sapiens
QLGLMTTEN

SEQ ID NO: 286280 - protein, 9 aa, Homo Sapiens
WDLLKLKSF

SEQ ID NO: 286281 - protein, 9 aa, Homo Sapiens
PKPKQIQIS

SEQ ID NO: 286282 - protein, 9 aa, Homo Sapiens
WAEVAEVEM

SEQ ID NO: 286283 - protein, 9 aa, Homo Sapiens
SQFKMDTYA

SEQ ID NO: 286284 - protein, 9 aa, Homo Sapiens
DITFTDVSE

SEQ ID NO: 286285 - protein, 9 aa, Homo Sapiens
LRNSAGNVK

SEQ ID NO: 286286 - protein, 9 aa, Homo Sapiens
SSCLPEEKV

SEQ ID NO: 286287 - protein, 9 aa, Homo Sapiens
LEPIGTRIA

SEQ ID NO: 286288 - protein, 9 aa, Homo Sapiens
LLALLMFAF

SEQ ID NO: 286289 - protein, 9 aa, Homo Sapiens
LLNPLIADP

SEQ ID NO: 286290 - protein, 9 aa, Homo Sapiens
DQRYLYFKD

SEQ ID NO: 286291 - protein, 9 aa, Homo Sapiens
RNLNCTALC

SEQ ID NO: 286292 - protein, 9 aa, Homo Sapiens
PEMMKNAAA

SEQ ID NO: 286293 - protein, 9 aa, Homo Sapiens
DTDLMKKFA

SEQ ID NO: 286294 - protein, 9 aa, Homo Sapiens
KKERLSLIL

SEQ ID NO: 286295 - protein, 9 aa, Homo Sapiens
HDLYHDIVS

SEQ ID NO: 286296 - protein, 9 aa, Homo Sapiens
QEKMLQEKK

SEQ ID NO: 286297 - protein, 9 aa, Homo Sapiens
IVGVNDFCP

SEQ ID NO: 286298 - protein, 9 aa, Homo Sapiens
IFEAKKSFL

SEQ ID NO: 286299 - protein, 9 aa, Homo Sapiens
NSSRIEAIK

SEQ ID NO: 286300 - protein, 9 aa, Homo Sapiens
GWIPIDNSI

SEQ ID NO: 286301 - protein, 9 aa, Homo Sapiens
RAPQDFEHS

SEQ ID NO: 286302 - protein, 9 aa, Homo Sapiens
VDFGKTSST

SEQ ID NO: 286303 - protein, 9 aa, Homo Sapiens
FYLLKSIWL

SEQ ID NO: 286304 - protein, 9 aa, Homo Sapiens
LSIELENVF

SEQ ID NO: 286305 - protein, 8 aa, Homo Sapiens
CTGGCARC

SEQ ID NO: 286306 - protein, 9 aa, Homo Sapiens
CLLLNHFSR

SEQ ID NO: 286307 - protein, 9 aa, Homo Sapiens
YFWQAVVIA

SEQ ID NO: 286308 - protein, 9 aa, Homo Sapiens
RIEASRNEL

SEQ ID NO: 286309 - protein, 9 aa, Homo Sapiens
GNRVNKTKP

SEQ ID NO: 286310 - protein, 9 aa, Homo Sapiens
GIFSVITNA

SEQ ID NO: 286311 - protein, 9 aa, Homo Sapiens
NHQDDGKMF

SEQ ID NO: 286312 - protein, 9 aa, Homo Sapiens
IFVIPSIKD

SEQ ID NO: 286313 - protein, 9 aa, Homo Sapiens
TLLGDNEKM

SEQ ID NO: 286314 - protein, 9 aa, Homo Sapiens
VLTRNRSKG

SEQ ID NO: 286315 - protein, 9 aa, Homo Sapiens
CKIALFNLS

SEQ ID NO: 286316 - protein, 9 aa, Homo Sapiens
ILASYAVQA

SEQ ID NO: 286317 - protein, 9 aa, Homo Sapiens
TNEIMLVRS

SEQ ID NO: 286318 - protein, 9 aa, Homo Sapiens
VAVHVVDLF

SEQ ID NO: 286319 - protein, 9 aa, Homo Sapiens
VGKSMFVFV

SEQ ID NO: 286320 - protein, 9 aa, Homo Sapiens
LCGMGGFSD

SEQ ID NO: 286321 - protein, 9 aa, Homo Sapiens
PTVDLAHTI

SEQ ID NO: 286322 - protein, 9 aa, Homo Sapiens
SMTLSYLQN

SEQ ID NO: 286323 - protein, 9 aa, Homo Sapiens
QILEQKIRE

SEQ ID NO: 286324 - protein, 9 aa, Homo Sapiens
RLDKSLQKE

SEQ ID NO: 286325 - protein, 9 aa, Homo Sapiens
HLVIPWAPE

SEQ ID NO: 286326 - protein, 9 aa, Homo Sapiens
KCDCIIISD

SEQ ID NO: 286327 - protein, 9 aa, Homo Sapiens
LSPSNHVPN

SEQ ID NO: 286328 - protein, 9 aa, Homo Sapiens
FFPDAPWGK

SEQ ID NO: 286329 - protein, 9 aa, Homo Sapiens
LNVNARERR

SEQ ID NO: 286330 - protein, 9 aa, Homo Sapiens
AALHLYLYS

SEQ ID NO: 286331 - protein, 9 aa, Homo Sapiens
VEAPVREEY

SEQ ID NO: 286332 - protein, 9 aa, Homo Sapiens
GGRVGAVSS

SEQ ID NO: 286333 - protein, 9 aa, Homo Sapiens
KNTLNHVYN

SEQ ID NO: 286334 - protein, 9 aa, Homo Sapiens
KKDSLDEEF

SEQ ID NO: 286335 - protein, 9 aa, Homo Sapiens
QRQSSVTSV

SEQ ID NO: 286336 - protein, 9 aa, Homo Sapiens
SLHPRPFGR

SEQ ID NO: 286337 - protein, 9 aa, Homo Sapiens
NEGVLYVVK

SEQ ID NO: 286338 - protein, 9 aa, Homo Sapiens
FIKENNFLP

SEQ ID NO: 286339 - protein, 9 aa, Homo Sapiens
SGSLQIHER

SEQ ID NO: 286340 - protein, 9 aa, Homo Sapiens
TRLENQNIL

SEQ ID NO: 286341 - protein, 9 aa, Homo Sapiens
TKPKQDNEG

SEQ ID NO: 286342 - protein, 9 aa, Homo Sapiens
AEPPHNLIA

SEQ ID NO: 286343 - protein, 9 aa, Homo Sapiens
EGFKKSYSH

SEQ ID NO: 286344 - protein, 9 aa, Homo Sapiens
SRELNFGSF

SEQ ID NO: 286345 - protein, 9 aa, Homo Sapiens
GRCRNGHRG

SEQ ID NO: 286346 - protein, 9 aa, Homo Sapiens
EGLEIDERG

SEQ ID NO: 286347 - protein, 9 aa, Homo Sapiens
TELPWGGGL

SEQ ID NO: 286348 - protein, 9 aa, Homo Sapiens
YGTVMCMYL

SEQ ID NO: 286349 - protein, 9 aa, Homo Sapiens
PQLSAELKN

SEQ ID NO: 286350 - protein, 9 aa, Homo Sapiens
DGDIDSYLV

SEQ ID NO: 286351 - protein, 9 aa, Homo Sapiens
TSNADIKSS

SEQ ID NO: 286352 - protein, 9 aa, Homo Sapiens
PYDGLCIAL

SEQ ID NO: 286353 - protein, 9 aa, Homo Sapiens
TGKTLIGKR

SEQ ID NO: 286354 - protein, 9 aa, Homo Sapiens
MGWDGSDLT

SEQ ID NO: 286355 - protein, 9 aa, Homo Sapiens
SKMALLPLL

SEQ ID NO: 286356 - protein, 9 aa, Homo Sapiens
QGHSIFQIN

SEQ ID NO: 286357 - protein, 9 aa, Homo Sapiens
GEGSQPSHT

SEQ ID NO: 286358 - protein, 9 aa, Homo Sapiens
NQALHYAVK

SEQ ID NO: 286359 - protein, 9 aa, Homo Sapiens
YITNYYYGN

SEQ ID NO: 286360 - protein, 9 aa, Homo Sapiens
VKIYEDFST

SEQ ID NO: 286361 - protein, 9 aa, Homo Sapiens
LFDLNNTTG

SEQ ID NO: 286362 - protein, 9 aa, Homo Sapiens
GEAIGFHSV

SEQ ID NO: 286363 - protein, 9 aa, Homo Sapiens
RELNFGSFV

SEQ ID NO: 286364 - protein, 9 aa, Homo Sapiens
EIIPCHRRV

SEQ ID NO: 286365 - protein, 9 aa, Homo Sapiens
STCINSTWD

SEQ ID NO: 286366 - protein, 9 aa, Homo Sapiens
LQEMASCQQ

SEQ ID NO: 286367 - protein, 9 aa, Homo Sapiens
VRDNSKKTT

SEQ ID NO: 286368 - protein, 9 aa, Homo Sapiens
VIIQTYFIW

SEQ ID NO: 286369 - protein, 9 aa, Homo Sapiens
YGSGAAFDA

SEQ ID NO: 286370 - protein, 9 aa, Homo Sapiens
VHVQDVIKV

SEQ ID NO: 286371 - protein, 9 aa, Homo Sapiens
HLGTTSTIS

SEQ ID NO: 286372 - protein, 9 aa, Homo Sapiens
LPWRLQMAL

SEQ ID NO: 286373 - protein, 9 aa, Homo Sapiens
HSTLRVAIH

SEQ ID NO: 286374 - protein, 9 aa, Homo Sapiens
GETKVKQNG

SEQ ID NO: 286375 - protein, 9 aa, Homo Sapiens
AHANTGSKL

SEQ ID NO: 286376 - protein, 9 aa, Homo Sapiens
RNKIRPNWQ

SEQ ID NO: 286377 - protein, 9 aa, Homo Sapiens
STKRTNQSS

SEQ ID NO: 286378 - protein, 9 aa, Homo Sapiens
LTSFERALY

SEQ ID NO: 286379 - protein, 9 aa, Homo Sapiens
LYYYLTNKN

SEQ ID NO: 286380 - protein, 9 aa, Homo Sapiens
DWQEAHGRL

SEQ ID NO: 286381 - protein, 9 aa, Homo Sapiens
GNPPPPPGL

SEQ ID NO: 286382 - protein, 9 aa, Homo Sapiens
YFRRFTLIA

SEQ ID NO: 286383 - protein, 9 aa, Homo Sapiens
VNLLERSPE

SEQ ID NO: 286384 - protein, 9 aa, Homo Sapiens
TMPASLSQT

SEQ ID NO: 286385 - protein, 9 aa, Homo Sapiens
NSMTLLHAT

SEQ ID NO: 286386 - protein, 9 aa, Homo Sapiens
HPAEPSIYA

SEQ ID NO: 286387 - protein, 9 aa, Homo Sapiens
EDIAHRRSE

SEQ ID NO: 286388 - protein, 9 aa, Homo Sapiens
AGDFQDIYS

SEQ ID NO: 286389 - protein, 9 aa, Homo Sapiens
NSPALAYHV

SEQ ID NO: 286390 - protein, 9 aa, Homo Sapiens
LGEGFQTVC

SEQ ID NO: 286391 - protein, 9 aa, Homo Sapiens
RDDGKCGEE

SEQ ID NO: 286392 - protein, 9 aa, Homo Sapiens
TLNKHHNVH

SEQ ID NO: 286393 - protein, 9 aa, Homo Sapiens
GPGARFIHF

SEQ ID NO: 286394 - protein, 9 aa, Homo Sapiens
PVRALNVLK

SEQ ID NO: 286395 - protein, 9 aa, Homo Sapiens
DHLGHSMVD

SEQ ID NO: 286396 - protein, 9 aa, Homo Sapiens
KLPKIDVHL

SEQ ID NO: 286397 - protein, 9 aa, Homo Sapiens
NLSLAKRSV

SEQ ID NO: 286398 - protein, 9 aa, Homo Sapiens
MQNYEKIHV

SEQ ID NO: 286399 - protein, 9 aa, Homo Sapiens
VSLSSSRHT

SEQ ID NO: 286400 - protein, 9 aa, Homo Sapiens
PYLVTAEDS

SEQ ID NO: 286401 - protein, 9 aa, Homo Sapiens
IHQIVHTRE

SEQ ID NO: 286402 - protein, 9 aa, Homo Sapiens
KKIHNFDCQ

SEQ ID NO: 286403 - protein, 9 aa, Homo Sapiens
GQYMISAYG

SEQ ID NO: 286404 - protein, 9 aa, Homo Sapiens
MQETHDSIV

SEQ ID NO: 286405 - protein, 9 aa, Homo Sapiens
CSHFQSEIK

SEQ ID NO: 286406 - protein, 9 aa, Homo Sapiens
VNEDGKRRT

SEQ ID NO: 286407 - protein, 9 aa, Homo Sapiens
ERKQEQRRH

SEQ ID NO: 286408 - protein, 9 aa, Homo Sapiens
EMEDQKHSY

SEQ ID NO: 286409 - protein, 9 aa, Homo Sapiens
CMIMSGGCD

SEQ ID NO: 286410 - protein, 9 aa, Homo Sapiens
PELSNRRST

SEQ ID NO: 286411 - protein, 9 aa, Homo Sapiens
SSPVYRIDH

SEQ ID NO: 286412 - protein, 9 aa, Homo Sapiens
RESFHKLAN

SEQ ID NO: 286413 - protein, 9 aa, Homo Sapiens
RLWFREAEI

SEQ ID NO: 286414 - protein, 9 aa, Homo Sapiens
VIIKDTSLV

SEQ ID NO: 286415 - protein, 9 aa, Homo Sapiens
TENYHTLYD

SEQ ID NO: 286416 - protein, 9 aa, Homo Sapiens
RTLCDLIFD

SEQ ID NO: 286417 - protein, 9 aa, Homo Sapiens
LRRTTNRML

SEQ ID NO: 286418 - protein, 9 aa, Homo Sapiens
GKSWIYKRI

SEQ ID NO: 286419 - protein, 9 aa, Homo Sapiens
ENRTMLFTS

SEQ ID NO: 286420 - protein, 9 aa, Homo Sapiens
PRTALKSLN

SEQ ID NO: 286421 - protein, 9 aa, Homo Sapiens
NKDKCDCII

SEQ ID NO: 286422 - protein, 9 aa, Homo Sapiens
ILIYLRAGS

SEQ ID NO: 286423 - protein, 9 aa, Homo Sapiens
ELPHELGEF

SEQ ID NO: 286424 - protein, 9 aa, Homo Sapiens
SMPMDSEEA

SEQ ID NO: 286425 - protein, 9 aa, Homo Sapiens
RRLGEPEDY

SEQ ID NO: 286426 - protein, 9 aa, Homo Sapiens
RDAHIFEKI

SEQ ID NO: 286427 - protein, 9 aa, Homo Sapiens
PLSPSLSNK

SEQ ID NO: 286428 - protein, 9 aa, Homo Sapiens
GRDSTNAFS

SEQ ID NO: 286429 - protein, 9 aa, Homo Sapiens
SPEQNKNHC

SEQ ID NO: 286430 - protein, 9 aa, Homo Sapiens
ETLQANEIM

SEQ ID NO: 286431 - protein, 9 aa, Homo Sapiens
PHLQWDVLD

SEQ ID NO: 286432 - protein, 9 aa, Homo Sapiens
NDEGEIEDD

SEQ ID NO: 286433 - protein, 9 aa, Homo Sapiens
LHSPLTLGM

SEQ ID NO: 286434 - protein, 9 aa, Homo Sapiens
KEAGYFYYM

SEQ ID NO: 286435 - protein, 9 aa, Homo Sapiens
ENPCYFTGS

SEQ ID NO: 286436 - protein, 9 aa, Homo Sapiens
EHQIIHTGE

SEQ ID NO: 286437 - protein, 9 aa, Homo Sapiens
LVRIRSDRY

SEQ ID NO: 286438 - protein, 9 aa, Homo Sapiens
PIKFHAGYS

SEQ ID NO: 286439 - protein, 9 aa, Homo Sapiens
EAQAARQKN

SEQ ID NO: 286440 - protein, 9 aa, Homo Sapiens
CKNDSALKI

SEQ ID NO: 286441 - protein, 9 aa, Homo Sapiens
KSQGITTNS

SEQ ID NO: 286442 - protein, 9 aa, Homo Sapiens
WKLRRELES

SEQ ID NO: 286443 - protein, 9 aa, Homo Sapiens
MKNAAASYF

SEQ ID NO: 286444 - protein, 9 aa, Homo Sapiens
SLEFGSPGK

SEQ ID NO: 286445 - protein, 9 aa, Homo Sapiens
PDNDSLFYN

SEQ ID NO: 286446 - protein, 9 aa, Homo Sapiens
LIDIKEYWM

SEQ ID NO: 286447 - protein, 9 aa, Homo Sapiens
ISEHVFLGS

SEQ ID NO: 286448 - protein, 9 aa, Homo Sapiens
VNFLAKNMM

SEQ ID NO: 286449 - protein, 9 aa, Homo Sapiens
YEKHNNGGL

SEQ ID NO: 286450 - protein, 9 aa, Homo Sapiens
LFCIFSRDG

SEQ ID NO: 286451 - protein, 9 aa, Homo Sapiens
NEPTKNLPL

SEQ ID NO: 286452 - protein, 9 aa, Homo Sapiens
QVNSDTQLK

SEQ ID NO: 286453 - protein, 9 aa, Homo Sapiens
SPERLNAFI

SEQ ID NO: 286454 - protein, 9 aa, Homo Sapiens
APVANGIQF

SEQ ID NO: 286455 - protein, 9 aa, Homo Sapiens
LNIIKLKEL

SEQ ID NO: 286456 - protein, 9 aa, Homo Sapiens
ESLEFYYSE

SEQ ID NO: 286457 - protein, 9 aa, Homo Sapiens
SCTIGFYCQ

SEQ ID NO: 286458 - protein, 9 aa, Homo Sapiens
DFSEVEIAR

SEQ ID NO: 286459 - protein, 9 aa, Homo Sapiens
PPFFGWSWF

SEQ ID NO: 286460 - protein, 9 aa, Homo Sapiens
RRRKISDDH

SEQ ID NO: 286461 - protein, 9 aa, Homo Sapiens
LWCLQYISL

SEQ ID NO: 286462 - protein, 9 aa, Homo Sapiens
TSLTIPLPQ

SEQ ID NO: 286463 - protein, 9 aa, Homo Sapiens
SKFMNLLAM

SEQ ID NO: 286464 - protein, 9 aa, Homo Sapiens
VTWDGKALS

SEQ ID NO: 286465 - protein, 9 aa, Homo Sapiens
HCAKCEDVW

SEQ ID NO: 286466 - protein, 9 aa, Homo Sapiens
LYRQLALNT

SEQ ID NO: 286467 - protein, 9 aa, Homo Sapiens
DDINFEPVV

SEQ ID NO: 286468 - protein, 9 aa, Homo Sapiens
TKCYKCPPH

SEQ ID NO: 286469 - protein, 9 aa, Homo Sapiens
EILQAVSKG

SEQ ID NO: 286470 - protein, 9 aa, Homo Sapiens
KIIILYDTS

SEQ ID NO: 286471 - protein, 9 aa, Homo Sapiens
EEYWDFYIF

SEQ ID NO: 286472 - protein, 9 aa, Homo Sapiens
IHRMNENSH

SEQ ID NO: 286473 - protein, 9 aa, Homo Sapiens
KVLKEIDSH

SEQ ID NO: 286474 - protein, 9 aa, Homo Sapiens
QSDKGALQE

SEQ ID NO: 286475 - protein, 9 aa, Homo Sapiens
DNNNRTLDF

SEQ ID NO: 286476 - protein, 9 aa, Homo Sapiens
QGERKQFAG

SEQ ID NO: 286477 - protein, 9 aa, Homo Sapiens
RSIHSARCI

SEQ ID NO: 286478 - protein, 9 aa, Homo Sapiens
HKQKFAPFN

SEQ ID NO: 286479 - protein, 9 aa, Homo Sapiens
LDKIIKISV

SEQ ID NO: 286480 - protein, 9 aa, Homo Sapiens
ELFLWQVEA

SEQ ID NO: 286481 - protein, 9 aa, Homo Sapiens
GFNIIITSL

SEQ ID NO: 286482 - protein, 9 aa, Homo Sapiens
PEDNFWMVM

SEQ ID NO: 286483 - protein, 9 aa, Homo Sapiens
ANKLSQMDQ

SEQ ID NO: 286484 - protein, 9 aa, Homo Sapiens
ETDNPMGGY

SEQ ID NO: 286485 - protein, 9 aa, Homo Sapiens
YLNGKVDSC

SEQ ID NO: 286486 - protein, 9 aa, Homo Sapiens
HHRIHTGNK

SEQ ID NO: 286487 - protein, 9 aa, Homo Sapiens
ENLGELSSS

SEQ ID NO: 286488 - protein, 9 aa, Homo Sapiens
ANPSILSWD

SEQ ID NO: 286489 - protein, 9 aa, Homo Sapiens
IHRNSAMIP

SEQ ID NO: 286490 - protein, 9 aa, Homo Sapiens
IFTNLVTGS

SEQ ID NO: 286491 - protein, 9 aa, Homo Sapiens
VDKGRFTTL

SEQ ID NO: 286492 - protein, 9 aa, Homo Sapiens
QLTVKLRLL

SEQ ID NO: 286493 - protein, 9 aa, Homo Sapiens
NDLVCKKRV

SEQ ID NO: 286494 - protein, 9 aa, Homo Sapiens
TCRLRLSYG

SEQ ID NO: 286495 - protein, 9 aa, Homo Sapiens
NPELIWPFI

SEQ ID NO: 286496 - protein, 9 aa, Homo Sapiens
LTGLATIAS

SEQ ID NO: 286497 - protein, 9 aa, Homo Sapiens
SAPARHRKK

SEQ ID NO: 286498 - protein, 9 aa, Homo Sapiens
MNCIIAKHI

SEQ ID NO: 286499 - protein, 9 aa, Homo Sapiens
LIWYNTIFL

SEQ ID NO: 286500 - protein, 9 aa, Homo Sapiens
LSEDCLHLN

SEQ ID NO: 286501 - protein, 9 aa, Homo Sapiens
TDGMAVWKT

SEQ ID NO: 286502 - protein, 9 aa, Homo Sapiens
VITLMGTLS

SEQ ID NO: 286503 - protein, 9 aa, Homo Sapiens
LYDYCRVPM

SEQ ID NO: 286504 - protein, 9 aa, Homo Sapiens
RMHDEILQA

SEQ ID NO: 286505 - protein, 9 aa, Homo Sapiens
NLKYKRVRL

SEQ ID NO: 286506 - protein, 9 aa, Homo Sapiens
TTVCDLFCN

SEQ ID NO: 286507 - protein, 9 aa, Homo Sapiens
PAPEFITLH

SEQ ID NO: 286508 - protein, 9 aa, Homo Sapiens
KQAPPQKVL

SEQ ID NO: 286509 - protein, 9 aa, Homo Sapiens
NTEQNGLKD

SEQ ID NO: 286510 - protein, 9 aa, Homo Sapiens
GIFKPRSAM

SEQ ID NO: 286511 - protein, 9 aa, Homo Sapiens
YLEIRALLY

SEQ ID NO: 286512 - protein, 9 aa, Homo Sapiens
LRVIAIDRY

SEQ ID NO: 286513 - protein, 9 aa, Homo Sapiens
VSEAINKNL

SEQ ID NO: 286514 - protein, 9 aa, Homo Sapiens
EDIDHLNKA

SEQ ID NO: 286515 - protein, 9 aa, Homo Sapiens
GTAFSQRSH

SEQ ID NO: 286516 - protein, 9 aa, Homo Sapiens
IVYPCRCVR

SEQ ID NO: 286517 - protein, 9 aa, Homo Sapiens
SWAEIAKLL

SEQ ID NO: 286518 - protein, 9 aa, Homo Sapiens
MPLANHRDN

SEQ ID NO: 286519 - protein, 9 aa, Homo Sapiens
SGIYAPTSS

SEQ ID NO: 286520 - protein, 9 aa, Homo Sapiens
ISYSNSKDG

SEQ ID NO: 286521 - protein, 9 aa, Homo Sapiens
QHILDEAER

SEQ ID NO: 286522 - protein, 9 aa, Homo Sapiens
FQPCEHLLD

SEQ ID NO: 286523 - protein, 9 aa, Homo Sapiens
EAFENYQPN

SEQ ID NO: 286524 - protein, 9 aa, Homo Sapiens
GVIAFFPAF

SEQ ID NO: 286525 - protein, 9 aa, Homo Sapiens
NQTVFVSID

SEQ ID NO: 286526 - protein, 9 aa, Homo Sapiens
MALNPRKCM

SEQ ID NO: 286527 - protein, 9 aa, Homo Sapiens
HLYDMNRWL

SEQ ID NO: 286528 - protein, 9 aa, Homo Sapiens
TDPITNSAS

SEQ ID NO: 286529 - protein, 9 aa, Homo Sapiens
PPHNLIAQS

SEQ ID NO: 286530 - protein, 9 aa, Homo Sapiens
NDTSNTKAV

SEQ ID NO: 286531 - protein, 9 aa, Homo Sapiens
VYVFYTILT

SEQ ID NO: 286532 - protein, 9 aa, Homo Sapiens
KFCPELTTD

SEQ ID NO: 286533 - protein, 9 aa, Homo Sapiens
GKLQAELSQ

SEQ ID NO: 286534 - protein, 9 aa, Homo Sapiens
TAPTLSTST

SEQ ID NO: 286535 - protein, 9 aa, Homo Sapiens
DKGGQPWQQ

SEQ ID NO: 286536 - protein, 9 aa, Homo Sapiens
ATLLIQAAK

SEQ ID NO: 286537 - protein, 9 aa, Homo Sapiens
AWNIKEMLS

SEQ ID NO: 286538 - protein, 9 aa, Homo Sapiens
KNNLTRVTK

SEQ ID NO: 286539 - protein, 9 aa, Homo Sapiens
DEFWLLGNK

SEQ ID NO: 286540 - protein, 9 aa, Homo Sapiens
TPSLPLFTP

SEQ ID NO: 286541 - protein, 9 aa, Homo Sapiens
LAMRRSLED

SEQ ID NO: 286542 - protein, 9 aa, Homo Sapiens
PTASKWALI

SEQ ID NO: 286543 - protein, 9 aa, Homo Sapiens
IYCLCYEGK

SEQ ID NO: 286544 - protein, 9 aa, Homo Sapiens
ESPISGLQA

SEQ ID NO: 286545 - protein, 9 aa, Homo Sapiens
RSIAEIGIA

SEQ ID NO: 286546 - protein, 9 aa, Homo Sapiens
KDKGTARAG

SEQ ID NO: 286547 - protein, 9 aa, Homo Sapiens
RLLNPKWPN

SEQ ID NO: 286548 - protein, 9 aa, Homo Sapiens
TECTKEELS

SEQ ID NO: 286549 - protein, 9 aa, Homo Sapiens
HQPLVTYTT

SEQ ID NO: 286550 - protein, 9 aa, Homo Sapiens
KSFGECCDV

SEQ ID NO: 286551 - protein, 9 aa, Homo Sapiens
NETVVLSGL

SEQ ID NO: 286552 - protein, 9 aa, Homo Sapiens
PGEHDSQVS

SEQ ID NO: 286553 - protein, 9 aa, Homo Sapiens
SFIDHHGNR

SEQ ID NO: 286554 - protein, 9 aa, Homo Sapiens
QTQMKGVLV

SEQ ID NO: 286555 - protein, 9 aa, Homo Sapiens
AFVGTWKVV

SEQ ID NO: 286556 - protein, 9 aa, Homo Sapiens
YSAENDRDI

SEQ ID NO: 286557 - protein, 9 aa, Homo Sapiens
LMRGIHSQM

SEQ ID NO: 286558 - protein, 9 aa, Homo Sapiens
LCSDGRLVW

SEQ ID NO: 286559 - protein, 9 aa, Homo Sapiens
RFKPWLHPE

SEQ ID NO: 286560 - protein, 9 aa, Homo Sapiens
QSKPEKPQD

SEQ ID NO: 286561 - protein, 9 aa, Homo Sapiens
IINNCINAL

SEQ ID NO: 286562 - protein, 9 aa, Homo Sapiens
RPRPHQQPT

SEQ ID NO: 286563 - protein, 9 aa, Homo Sapiens
TKYQLSQPE

SEQ ID NO: 286564 - protein, 9 aa, Homo Sapiens
IVERLASVI

SEQ ID NO: 286565 - protein, 9 aa, Homo Sapiens
KQSLTRHAA

SEQ ID NO: 286566 - protein, 9 aa, Homo Sapiens
QLEWQYYHN

SEQ ID NO: 286567 - protein, 9 aa, Homo Sapiens
DCKQVIQRE

SEQ ID NO: 286568 - protein, 9 aa, Homo Sapiens
RPVESIVTL

SEQ ID NO: 286569 - protein, 9 aa, Homo Sapiens
GKPKFDVLK

SEQ ID NO: 286570 - protein, 9 aa, Homo Sapiens
IFIHGWPWV

SEQ ID NO: 286571 - protein, 9 aa, Homo Sapiens
SSPEDDLDT

SEQ ID NO: 286572 - protein, 9 aa, Homo Sapiens
SGIFGGLSQ

SEQ ID NO: 286573 - protein, 9 aa, Homo Sapiens
LEDPVIKRC

SEQ ID NO: 286574 - protein, 9 aa, Homo Sapiens
AMHLARGTI

SEQ ID NO: 286575 - protein, 9 aa, Homo Sapiens
MLQLTFCDS

SEQ ID NO: 286576 - protein, 9 aa, Homo Sapiens
PGDFLFMSP

SEQ ID NO: 286577 - protein, 9 aa, Homo Sapiens
RVFFMLHSL

SEQ ID NO: 286578 - protein, 9 aa, Homo Sapiens
DNQWLGVSV

SEQ ID NO: 286579 - protein, 9 aa, Homo Sapiens
DPDHLNKLL

SEQ ID NO: 286580 - protein, 9 aa, Homo Sapiens
NAWGHQHGY

SEQ ID NO: 286581 - protein, 9 aa, Homo Sapiens
GATKINITD

SEQ ID NO: 286582 - protein, 9 aa, Homo Sapiens
QDTWNMHTC

SEQ ID NO: 286583 - protein, 9 aa, Homo Sapiens
SLADMMAFC

SEQ ID NO: 286584 - protein, 9 aa, Homo Sapiens
HHYMEQILN

SEQ ID NO: 286585 - protein, 9 aa, Homo Sapiens
RNVSKFSDC

SEQ ID NO: 286586 - protein, 9 aa, Homo Sapiens
NVEAIWELN

SEQ ID NO: 286587 - protein, 9 aa, Homo Sapiens
ELECFRFLP

SEQ ID NO: 286588 - protein, 9 aa, Homo Sapiens
EEQSNDGKN

SEQ ID NO: 286589 - protein, 9 aa, Homo Sapiens
LGFTPEDKV

SEQ ID NO: 286590 - protein, 9 aa, Homo Sapiens
KNKEVFARL

SEQ ID NO: 286591 - protein, 9 aa, Homo Sapiens
TTPELVHAS

SEQ ID NO: 286592 - protein, 9 aa, Homo Sapiens
SEQISHKRS

SEQ ID NO: 286593 - protein, 9 aa, Homo Sapiens
IESITSDTA

SEQ ID NO: 286594 - protein, 9 aa, Homo Sapiens
ELLNEKPRL

SEQ ID NO: 286595 - protein, 9 aa, Homo Sapiens
GEWTPTLQY

SEQ ID NO: 286596 - protein, 9 aa, Homo Sapiens
EMVVAMVLQ

SEQ ID NO: 286597 - protein, 9 aa, Homo Sapiens
AFWIISITA

SEQ ID NO: 286598 - protein, 9 aa, Homo Sapiens
EGMLFPPVE

SEQ ID NO: 286599 - protein, 9 aa, Homo Sapiens
KSKVGFLDH

SEQ ID NO: 286600 - protein, 9 aa, Homo Sapiens
LYLAENEEE

SEQ ID NO: 286601 - protein, 9 aa, Homo Sapiens
WKKRLEPTA

SEQ ID NO: 286602 - protein, 9 aa, Homo Sapiens
LRTNTSCKH

SEQ ID NO: 286603 - protein, 9 aa, Homo Sapiens
ALKMDLLQG

SEQ ID NO: 286604 - protein, 9 aa, Homo Sapiens
SPQESFTSF

SEQ ID NO: 286605 - protein, 9 aa, Homo Sapiens
WSQIPLPHV

SEQ ID NO: 286606 - protein, 9 aa, Homo Sapiens
DHFQSEKKV

SEQ ID NO: 286607 - protein, 9 aa, Homo Sapiens
SRNSQFQML

SEQ ID NO: 286608 - protein, 9 aa, Homo Sapiens
PTLSTSTST

SEQ ID NO: 286609 - protein, 9 aa, Homo Sapiens
RGEDYDKVK

SEQ ID NO: 286610 - protein, 9 aa, Homo Sapiens
ANSFDPSKT

SEQ ID NO: 286611 - protein, 9 aa, Homo Sapiens
SLEVEDLFL

SEQ ID NO: 286612 - protein, 9 aa, Homo Sapiens
IFHQVTIDK

SEQ ID NO: 286613 - protein, 9 aa, Homo Sapiens
CESHRKSRK

SEQ ID NO: 286614 - protein, 9 aa, Homo Sapiens
SGTCQIPSL

SEQ ID NO: 286615 - protein, 9 aa, Homo Sapiens
EEGLSLAQK

SEQ ID NO: 286616 - protein, 9 aa, Homo Sapiens
ESISTNKTQ

SEQ ID NO: 286617 - protein, 9 aa, Homo Sapiens
QCCQSACCQ

SEQ ID NO: 286618 - protein, 9 aa, Homo Sapiens
QQVKSHFAA

SEQ ID NO: 286619 - protein, 9 aa, Homo Sapiens
SCFQNMGIC

SEQ ID NO: 286620 - protein, 9 aa, Homo Sapiens
NKPSIAAVV

SEQ ID NO: 286621 - protein, 9 aa, Homo Sapiens
EIKDLRAKL

SEQ ID NO: 286622 - protein, 9 aa, Homo Sapiens
SITKDYELP

SEQ ID NO: 286623 - protein, 9 aa, Homo Sapiens
TGRHKALST

SEQ ID NO: 286624 - protein, 9 aa, Homo Sapiens
YPVVKTNYG

SEQ ID NO: 286625 - protein, 9 aa, Homo Sapiens
KGDKGEIGL

SEQ ID NO: 286626 - protein, 9 aa, Homo Sapiens
ELQAPDLRH

SEQ ID NO: 286627 - protein, 9 aa, Homo Sapiens
YHPESLLSE

SEQ ID NO: 286628 - protein, 9 aa, Homo Sapiens
DLCQRIVGD

SEQ ID NO: 286629 - protein, 9 aa, Homo Sapiens
RFEKCGHDN

SEQ ID NO: 286630 - protein, 9 aa, Homo Sapiens
TCGLEGNGI

SEQ ID NO: 286631 - protein, 9 aa, Homo Sapiens
TLDTTVAGC

SEQ ID NO: 286632 - protein, 9 aa, Homo Sapiens
HPNNKPFTS

SEQ ID NO: 286633 - protein, 9 aa, Homo Sapiens
CLYVVAGVS

SEQ ID NO: 286634 - protein, 9 aa, Homo Sapiens
NGVLPDCNM

SEQ ID NO: 286635 - protein, 9 aa, Homo Sapiens
LNGHLPHPS

SEQ ID NO: 286636 - protein, 9 aa, Homo Sapiens
GPVEKETET

SEQ ID NO: 286637 - protein, 9 aa, Homo Sapiens
LTLIRQHQE

SEQ ID NO: 286638 - protein, 9 aa, Homo Sapiens
QLKKILWGV

SEQ ID NO: 286639 - protein, 9 aa, Homo Sapiens
ELYVQNENS

SEQ ID NO: 286640 - protein, 9 aa, Homo Sapiens
ICNKRYIRE

SEQ ID NO: 286641 - protein, 9 aa, Homo Sapiens
HDSLKKIVF

SEQ ID NO: 286642 - protein, 9 aa, Homo Sapiens
ESKWKRELQ

SEQ ID NO: 286643 - protein, 9 aa, Homo Sapiens
FMIKGAVGD

SEQ ID NO: 286644 - protein, 9 aa, Homo Sapiens
SNLQLQRMI

SEQ ID NO: 286645 - protein, 9 aa, Homo Sapiens
TEFGGSACF

SEQ ID NO: 286646 - protein, 9 aa, Homo Sapiens
DFVKPKGAC

SEQ ID NO: 286647 - protein, 9 aa, Homo Sapiens
GTYNKLTKT

SEQ ID NO: 286648 - protein, 9 aa, Homo Sapiens
VVMNHGCSY

SEQ ID NO: 286649 - protein, 9 aa, Homo Sapiens
FQSFTRPKS

SEQ ID NO: 286650 - protein, 9 aa, Homo Sapiens
TSTIPVVSA

SEQ ID NO: 286651 - protein, 9 aa, Homo Sapiens
STRTNKDGK

SEQ ID NO: 286652 - protein, 9 aa, Homo Sapiens
GYYNVDFGQ

SEQ ID NO: 286653 - protein, 9 aa, Homo Sapiens
QVSYGQRLS

SEQ ID NO: 286654 - protein, 9 aa, Homo Sapiens
SLAQKYNCG

SEQ ID NO: 286655 - protein, 9 aa, Homo Sapiens
HFRQNSAEN

SEQ ID NO: 286656 - protein, 9 aa, Homo Sapiens
VTSPVIQRL

SEQ ID NO: 286657 - protein, 9 aa, Homo Sapiens
DRLQRITVA

SEQ ID NO: 286658 - protein, 9 aa, Homo Sapiens
DGYIWPWTK

SEQ ID NO: 286659 - protein, 9 aa, Homo Sapiens
VDNFHLDKY

SEQ ID NO: 286660 - protein, 9 aa, Homo Sapiens
DKARAKNKK

SEQ ID NO: 286661 - protein, 9 aa, Homo Sapiens
TGDIHAIKI

SEQ ID NO: 286662 - protein, 9 aa, Homo Sapiens
ENFRVIIIK

SEQ ID NO: 286663 - protein, 9 aa, Homo Sapiens
KEQLDPKPH

SEQ ID NO: 286664 - protein, 9 aa, Homo Sapiens
DIRSPAAAP

SEQ ID NO: 286665 - protein, 9 aa, Homo Sapiens
FRRICKSRV

SEQ ID NO: 286666 - protein, 9 aa, Homo Sapiens
MEWNGWGYN

SEQ ID NO: 286667 - protein, 9 aa, Homo Sapiens
TEDKKNGIW

SEQ ID NO: 286668 - protein, 9 aa, Homo Sapiens
ANQPLETNT

SEQ ID NO: 286669 - protein, 9 aa, Homo Sapiens
QPRGNEVCR

SEQ ID NO: 286670 - protein, 9 aa, Homo Sapiens
TLGHGYFKY

SEQ ID NO: 286671 - protein, 9 aa, Homo Sapiens
CSKKKLREV

SEQ ID NO: 286672 - protein, 9 aa, Homo Sapiens
MDANEPTKN

SEQ ID NO: 286673 - protein, 9 aa, Homo Sapiens
VVMNDSLFC

SEQ ID NO: 286674 - protein, 9 aa, Homo Sapiens
VKVKVCVNI

SEQ ID NO: 286675 - protein, 9 aa, Homo Sapiens
DSVIALVCK

SEQ ID NO: 286676 - protein, 9 aa, Homo Sapiens
SSNPPLATV

SEQ ID NO: 286677 - protein, 9 aa, Homo Sapiens
EELSALKTQ

SEQ ID NO: 286678 - protein, 9 aa, Homo Sapiens
TRRKRRKNV

SEQ ID NO: 286679 - protein, 9 aa, Homo Sapiens
KSADKLRII

SEQ ID NO: 286680 - protein, 9 aa, Homo Sapiens
WVYLLLKKI

SEQ ID NO: 286681 - protein, 9 aa, Homo Sapiens
KHKKTSNHL

SEQ ID NO: 286682 - protein, 9 aa, Homo Sapiens
VVIIIDNLH

SEQ ID NO: 286683 - protein, 9 aa, Homo Sapiens
ELHPQIKQL

SEQ ID NO: 286684 - protein, 9 aa, Homo Sapiens
TRGRQVDSR

SEQ ID NO: 286685 - protein, 9 aa, Homo Sapiens
VCIDTIPNI

SEQ ID NO: 286686 - protein, 9 aa, Homo Sapiens
NGIHFDPEN

SEQ ID NO: 286687 - protein, 9 aa, Homo Sapiens
KLSSILTNI

SEQ ID NO: 286688 - protein, 9 aa, Homo Sapiens
KNNDNLLKA

SEQ ID NO: 286689 - protein, 9 aa, Homo Sapiens
VLLPCSQEW

SEQ ID NO: 286690 - protein, 9 aa, Homo Sapiens
LFCRIRPIF

SEQ ID NO: 286691 - protein, 9 aa, Homo Sapiens
LFIFMEYFL

SEQ ID NO: 286692 - protein, 9 aa, Homo Sapiens
WLPSRQKTL

SEQ ID NO: 286693 - protein, 9 aa, Homo Sapiens
TETLGAMDV

SEQ ID NO: 286694 - protein, 9 aa, Homo Sapiens
LPPTNMKTV

SEQ ID NO: 286695 - protein, 9 aa, Homo Sapiens
KKDNAAALE

SEQ ID NO: 286696 - protein, 9 aa, Homo Sapiens
GVCLSNQGS

SEQ ID NO: 286697 - protein, 9 aa, Homo Sapiens
IHEITHTGE

SEQ ID NO: 286698 - protein, 9 aa, Homo Sapiens
MQKDLKRYK

SEQ ID NO: 286699 - protein, 9 aa, Homo Sapiens
TGIQAKLER

SEQ ID NO: 286700 - protein, 9 aa, Homo Sapiens
KHYKKEGSE

SEQ ID NO: 286701 - protein, 9 aa, Homo Sapiens
KADTITDEI

SEQ ID NO: 286702 - protein, 9 aa, Homo Sapiens
QSPVADRKQ

SEQ ID NO: 286703 - protein, 9 aa, Homo Sapiens
CPLIGVLNV

SEQ ID NO: 286704 - protein, 9 aa, Homo Sapiens
QIVICLGET

SEQ ID NO: 286705 - protein, 9 aa, Homo Sapiens
LGDYDPDDH

SEQ ID NO: 286706 - protein, 9 aa, Homo Sapiens
GHTMDKRRL

SEQ ID NO: 286707 - protein, 9 aa, Homo Sapiens
SLFNTETPL

SEQ ID NO: 286708 - protein, 9 aa, Homo Sapiens
NIYSDSSSM

SEQ ID NO: 286709 - protein, 9 aa, Homo Sapiens
TKIKQLCSG

SEQ ID NO: 286710 - protein, 9 aa, Homo Sapiens
LNMEQANYT

SEQ ID NO: 286711 - protein, 9 aa, Homo Sapiens
DIKIVKEKN

SEQ ID NO: 286712 - protein, 9 aa, Homo Sapiens
WLTQVRNLQ

SEQ ID NO: 286713 - protein, 9 aa, Homo Sapiens
AFCEKTRFC

SEQ ID NO: 286714 - protein, 9 aa, Homo Sapiens
PTPPPPQAP

SEQ ID NO: 286715 - protein, 9 aa, Homo Sapiens
KNISFNFSE

SEQ ID NO: 286716 - protein, 9 aa, Homo Sapiens
LSAPKQLRV

SEQ ID NO: 286717 - protein, 9 aa, Homo Sapiens
GDLDDIEDE

SEQ ID NO: 286718 - protein, 9 aa, Homo Sapiens
YKVVKKRKT

SEQ ID NO: 286719 - protein, 9 aa, Homo Sapiens
VFRIMDDNN

SEQ ID NO: 286720 - protein, 9 aa, Homo Sapiens
ANIIFRNFL

SEQ ID NO: 286721 - protein, 9 aa, Homo Sapiens
VIGISNFNH

SEQ ID NO: 286722 - protein, 9 aa, Homo Sapiens
QYISLGFFC

SEQ ID NO: 286723 - protein, 9 aa, Homo Sapiens
KRRWQPPDF

SEQ ID NO: 286724 - protein, 9 aa, Homo Sapiens
IGYRAAEKN

SEQ ID NO: 286725 - protein, 9 aa, Homo Sapiens
TDKSNVYRD

SEQ ID NO: 286726 - protein, 9 aa, Homo Sapiens
CLPPEHTIV

SEQ ID NO: 286727 - protein, 9 aa, Homo Sapiens
PFKFTIPDS

SEQ ID NO: 286728 - protein, 9 aa, Homo Sapiens
LKVEDSERK

SEQ ID NO: 286729 - protein, 9 aa, Homo Sapiens
QGCWLLYYQ

SEQ ID NO: 286730 - protein, 9 aa, Homo Sapiens
QRPKDLWDI

SEQ ID NO: 286731 - protein, 9 aa, Homo Sapiens
HKQVKSLPK

SEQ ID NO: 286732 - protein, 9 aa, Homo Sapiens
CGVQSSKCM

SEQ ID NO: 286733 - protein, 9 aa, Homo Sapiens
TLPINSKTR

SEQ ID NO: 286734 - protein, 9 aa, Homo Sapiens
GDAGPIVAT

SEQ ID NO: 286735 - protein, 9 aa, Homo Sapiens
VEEAAKQKK

SEQ ID NO: 286736 - protein, 9 aa, Homo Sapiens
RYMNESQNP

SEQ ID NO: 286737 - protein, 9 aa, Homo Sapiens
HFKKSNYFM

SEQ ID NO: 286738 - protein, 9 aa, Homo Sapiens
QRFCDNIIV

SEQ ID NO: 286739 - protein, 9 aa, Homo Sapiens
GKCRNVSVR

SEQ ID NO: 286740 - protein, 9 aa, Homo Sapiens
AEKLEAQNR

SEQ ID NO: 286741 - protein, 9 aa, Homo Sapiens
TPQDELFIL

SEQ ID NO: 286742 - protein, 9 aa, Homo Sapiens
KCETIFFTI

SEQ ID NO: 286743 - protein, 9 aa, Homo Sapiens
FNKTWDIIT

SEQ ID NO: 286744 - protein, 9 aa, Homo Sapiens
HVALFKQIF

SEQ ID NO: 286745 - protein, 9 aa, Homo Sapiens
VENDYNDLF

SEQ ID NO: 286746 - protein, 9 aa, Homo Sapiens
LSKRTVSTV

SEQ ID NO: 286747 - protein, 9 aa, Homo Sapiens
KCWNSEPEN

SEQ ID NO: 286748 - protein, 9 aa, Homo Sapiens
PPCSDSCYF

SEQ ID NO: 286749 - protein, 9 aa, Homo Sapiens
KGQETFAPR

SEQ ID NO: 286750 - protein, 9 aa, Homo Sapiens
NRSLCRNTH

SEQ ID NO: 286751 - protein, 9 aa, Homo Sapiens
LAALVSKAQ

SEQ ID NO: 286752 - protein, 9 aa, Homo Sapiens
CHLTVQINS

SEQ ID NO: 286753 - protein, 9 aa, Homo Sapiens
RSSAQYPFS

SEQ ID NO: 286754 - protein, 9 aa, Homo Sapiens
SASLFIRFL

SEQ ID NO: 286755 - protein, 9 aa, Homo Sapiens
VQAKNPKVS

SEQ ID NO: 286756 - protein, 9 aa, Homo Sapiens
FGYVKASTT

SEQ ID NO: 286757 - protein, 9 aa, Homo Sapiens
QHFVQIPNK

SEQ ID NO: 286758 - protein, 9 aa, Homo Sapiens
YDRYLTSSK

SEQ ID NO: 286759 - protein, 9 aa, Homo Sapiens
YIQSHFYRS

SEQ ID NO: 286760 - protein, 9 aa, Homo Sapiens
GDVSNVIKK

SEQ ID NO: 286761 - protein, 9 aa, Homo Sapiens
DKNRNYILS

SEQ ID NO: 286762 - protein, 9 aa, Homo Sapiens
GGTDIFLLT

SEQ ID NO: 286763 - protein, 9 aa, Homo Sapiens
EQLHSYPHT

SEQ ID NO: 286764 - protein, 9 aa, Homo Sapiens
GLLGLALCH

SEQ ID NO: 286765 - protein, 9 aa, Homo Sapiens
ACKIYARAA

SEQ ID NO: 286766 - protein, 9 aa, Homo Sapiens
TRWSKSHFR

SEQ ID NO: 286767 - protein, 9 aa, Homo Sapiens
ILKSELTKF

SEQ ID NO: 286768 - protein, 9 aa, Homo Sapiens
KQIQISSKT

SEQ ID NO: 286769 - protein, 9 aa, Homo Sapiens
KFDQFKRRI

SEQ ID NO: 286770 - protein, 9 aa, Homo Sapiens
YRTLPINSK

SEQ ID NO: 286771 - protein, 9 aa, Homo Sapiens
PYLNLFQLL

SEQ ID NO: 286772 - protein, 9 aa, Homo Sapiens
AHKLPKYGV

SEQ ID NO: 286773 - protein, 9 aa, Homo Sapiens
RLELQAYPD

SEQ ID NO: 286774 - protein, 9 aa, Homo Sapiens
EPVYFYMYT

SEQ ID NO: 286775 - protein, 9 aa, Homo Sapiens
KIIHASFIV

SEQ ID NO: 286776 - protein, 9 aa, Homo Sapiens
TRHICMVNI

SEQ ID NO: 286777 - protein, 9 aa, Homo Sapiens
RSVKLSWQE

SEQ ID NO: 286778 - protein, 9 aa, Homo Sapiens
AIQRSLEPL

SEQ ID NO: 286779 - protein, 9 aa, Homo Sapiens
EIKMCGKEF

SEQ ID NO: 286780 - protein, 9 aa, Homo Sapiens
TLLQTATLI

SEQ ID NO: 286781 - protein, 9 aa, Homo Sapiens
MWEAFQDGD

SEQ ID NO: 286782 - protein, 9 aa, Homo Sapiens
GDFAVDKRV

SEQ ID NO: 286783 - protein, 9 aa, Homo Sapiens
YRMLMQKDL

SEQ ID NO: 286784 - protein, 9 aa, Homo Sapiens
QEVWGKMMS

SEQ ID NO: 286785 - protein, 9 aa, Homo Sapiens
KAYFTCSTH

SEQ ID NO: 286786 - protein, 9 aa, Homo Sapiens
HRLCKLLFC

SEQ ID NO: 286787 - protein, 9 aa, Homo Sapiens
EVVKKKSKK

SEQ ID NO: 286788 - protein, 9 aa, Homo Sapiens
VTYVGRPFM

SEQ ID NO: 286789 - protein, 9 aa, Homo Sapiens
EKHKEKKSN

SEQ ID NO: 286790 - protein, 9 aa, Homo Sapiens
ADDTLSRRL

SEQ ID NO: 286791 - protein, 9 aa, Homo Sapiens
ANVMYTIGD

SEQ ID NO: 286792 - protein, 9 aa, Homo Sapiens
REAEEKEKP

SEQ ID NO: 286793 - protein, 9 aa, Homo Sapiens
FNKMLKSTS

SEQ ID NO: 286794 - protein, 9 aa, Homo Sapiens
YTPLSATRI

SEQ ID NO: 286795 - protein, 9 aa, Homo Sapiens
ETREQYPNT

SEQ ID NO: 286796 - protein, 9 aa, Homo Sapiens
VSWRLCLLL

SEQ ID NO: 286797 - protein, 9 aa, Homo Sapiens
AITFSHSEG

SEQ ID NO: 286798 - protein, 9 aa, Homo Sapiens
LIKQAQARV

SEQ ID NO: 286799 - protein, 9 aa, Homo Sapiens
VQERNYAQK

SEQ ID NO: 286800 - protein, 9 aa, Homo Sapiens
ICEAALPKV

SEQ ID NO: 286801 - protein, 9 aa, Homo Sapiens
EDDKPHDIL

SEQ ID NO: 286802 - protein, 9 aa, Homo Sapiens
YQSNEMEVH

SEQ ID NO: 286803 - protein, 9 aa, Homo Sapiens
KASMKQYRK

SEQ ID NO: 286804 - protein, 9 aa, Homo Sapiens
RIQGLDVDT

SEQ ID NO: 286805 - protein, 9 aa, Homo Sapiens
MADLSSQIR

SEQ ID NO: 286806 - protein, 9 aa, Homo Sapiens
SARCIFVEN

SEQ ID NO: 286807 - protein, 9 aa, Homo Sapiens
YCLTLNPEH

SEQ ID NO: 286808 - protein, 9 aa, Homo Sapiens
LKLETNELQ

SEQ ID NO: 286809 - protein, 9 aa, Homo Sapiens
VRGTFLFIS

SEQ ID NO: 286810 - protein, 9 aa, Homo Sapiens
PISVYIGHT

SEQ ID NO: 286811 - protein, 9 aa, Homo Sapiens
ISEAGPAHN

SEQ ID NO: 286812 - protein, 9 aa, Homo Sapiens
QLIQPLECM

SEQ ID NO: 286813 - protein, 9 aa, Homo Sapiens
RKSRKEKKK

SEQ ID NO: 286814 - protein, 9 aa, Homo Sapiens
VKQNEARME

SEQ ID NO: 286815 - protein, 9 aa, Homo Sapiens
GEKTKTPRS

SEQ ID NO: 286816 - protein, 9 aa, Homo Sapiens
RRCQTADAD

SEQ ID NO: 286817 - protein, 9 aa, Homo Sapiens
GTWKVVSSE

SEQ ID NO: 286818 - protein, 9 aa, Homo Sapiens
LDQKEDDKQ

SEQ ID NO: 286819 - protein, 9 aa, Homo Sapiens
WYFQINYRQ

SEQ ID NO: 286820 - protein, 9 aa, Homo Sapiens
NLNDTRKML

SEQ ID NO: 286821 - protein, 9 aa, Homo Sapiens
GPVPVPGPR

SEQ ID NO: 286822 - protein, 9 aa, Homo Sapiens
VIYSTEANT

SEQ ID NO: 286823 - protein, 9 aa, Homo Sapiens
QTAREKRAF

SEQ ID NO: 286824 - protein, 9 aa, Homo Sapiens
AIATLHGNI

SEQ ID NO: 286825 - protein, 9 aa, Homo Sapiens
IFHPFVKDV

SEQ ID NO: 286826 - protein, 9 aa, Homo Sapiens
RYFILPCDV

SEQ ID NO: 286827 - protein, 9 aa, Homo Sapiens
DSGKAQDFM

SEQ ID NO: 286828 - protein, 9 aa, Homo Sapiens
GSIEVVKQG

SEQ ID NO: 286829 - protein, 9 aa, Homo Sapiens
IMRENNPDM

SEQ ID NO: 286830 - protein, 9 aa, Homo Sapiens
RMDPRVVLN

SEQ ID NO: 286831 - protein, 9 aa, Homo Sapiens
EHWFRFSTD

SEQ ID NO: 286832 - protein, 9 aa, Homo Sapiens
GICQDCIRN

SEQ ID NO: 286833 - protein, 9 aa, Homo Sapiens
YLVGDKLSR

SEQ ID NO: 286834 - protein, 9 aa, Homo Sapiens
NAPMFEKDK

SEQ ID NO: 286835 - protein, 9 aa, Homo Sapiens
MFSLVMKHL

SEQ ID NO: 286836 - protein, 9 aa, Homo Sapiens
YLGRYRLLG

SEQ ID NO: 286837 - protein, 9 aa, Homo Sapiens
TWVKFQYPE

SEQ ID NO: 286838 - protein, 9 aa, Homo Sapiens
KTTTSLEKV

SEQ ID NO: 286839 - protein, 9 aa, Homo Sapiens
SDQITFMER

SEQ ID NO: 286840 - protein, 9 aa, Homo Sapiens
YPYTNLYLE

SEQ ID NO: 286841 - protein, 9 aa, Homo Sapiens
SWVLVRVMD

SEQ ID NO: 286842 - protein, 9 aa, Homo Sapiens
SRFYDRNYI

SEQ ID NO: 286843 - protein, 9 aa, Homo Sapiens
QKKRLNIII

SEQ ID NO: 286844 - protein, 9 aa, Homo Sapiens
GKRLSSVDV

SEQ ID NO: 286845 - protein, 9 aa, Homo Sapiens
KEHSLLLTA

SEQ ID NO: 286846 - protein, 9 aa, Homo Sapiens
NQSWSWCRI

SEQ ID NO: 286847 - protein, 9 aa, Homo Sapiens
SFVIQMDLS

SEQ ID NO: 286848 - protein, 9 aa, Homo Sapiens
IFIWFCIVP

SEQ ID NO: 286849 - protein, 9 aa, Homo Sapiens
KDILRLRDF

SEQ ID NO: 286850 - protein, 9 aa, Homo Sapiens
VEESFKNLF

SEQ ID NO: 286851 - protein, 9 aa, Homo Sapiens
SLEDLFNLC

SEQ ID NO: 286852 - protein, 9 aa, Homo Sapiens
ERPRQQNPQ

SEQ ID NO: 286853 - protein, 9 aa, Homo Sapiens
VTEFGGSAC

SEQ ID NO: 286854 - protein, 9 aa, Homo Sapiens
HICGMNEHP

SEQ ID NO: 286855 - protein, 9 aa, Homo Sapiens
QRLQVVACT

SEQ ID NO: 286856 - protein, 9 aa, Homo Sapiens
CAGSLVNEQ

SEQ ID NO: 286857 - protein, 9 aa, Homo Sapiens
LTLCKAGLE

SEQ ID NO: 286858 - protein, 9 aa, Homo Sapiens
NDGKNDGDM

SEQ ID NO: 286859 - protein, 9 aa, Homo Sapiens
NGGYGLSGF

SEQ ID NO: 286860 - protein, 9 aa, Homo Sapiens
GEAKKDSLD

SEQ ID NO: 286861 - protein, 9 aa, Homo Sapiens
SVIFHDQFD

SEQ ID NO: 286862 - protein, 9 aa, Homo Sapiens
PDEVGKRWQ

SEQ ID NO: 286863 - protein, 9 aa, Homo Sapiens
QFCSIAFKN

SEQ ID NO: 286864 - protein, 9 aa, Homo Sapiens
GSPYGSQPH

SEQ ID NO: 286865 - protein, 9 aa, Homo Sapiens
SLAPEKQRL

SEQ ID NO: 286866 - protein, 9 aa, Homo Sapiens
GNTLSSVSP

SEQ ID NO: 286867 - protein, 9 aa, Homo Sapiens
TAPEAINVG

SEQ ID NO: 286868 - protein, 9 aa, Homo Sapiens
DQITGRAGL

SEQ ID NO: 286869 - protein, 9 aa, Homo Sapiens
IRVSAFTNV

SEQ ID NO: 286870 - protein, 9 aa, Homo Sapiens
QELKWQKDT

SEQ ID NO: 286871 - protein, 9 aa, Homo Sapiens
EILAFYNNA

SEQ ID NO: 286872 - protein, 9 aa, Homo Sapiens
ENVCSQRGL

SEQ ID NO: 286873 - protein, 9 aa, Homo Sapiens
KKGTSAFLQ

SEQ ID NO: 286874 - protein, 9 aa, Homo Sapiens
IQQRISIKK

SEQ ID NO: 286875 - protein, 9 aa, Homo Sapiens
VDHSHLEEG

SEQ ID NO: 286876 - protein, 9 aa, Homo Sapiens
SELILVGNQ

SEQ ID NO: 286877 - protein, 9 aa, Homo Sapiens
KNKDCFERP

SEQ ID NO: 286878 - protein, 9 aa, Homo Sapiens
KERNRITVT

SEQ ID NO: 286879 - protein, 9 aa, Homo Sapiens
RQCRHSPGE

SEQ ID NO: 286880 - protein, 9 aa, Homo Sapiens
LCETKLEAI

SEQ ID NO: 286881 - protein, 9 aa, Homo Sapiens
QFAKIKLEK

SEQ ID NO: 286882 - protein, 9 aa, Homo Sapiens
KSLEKFFLR

SEQ ID NO: 286883 - protein, 9 aa, Homo Sapiens
EPMKSRAPP

SEQ ID NO: 286884 - protein, 9 aa, Homo Sapiens
DEECDRKLL

SEQ ID NO: 286885 - protein, 9 aa, Homo Sapiens
ERTFRVETP

SEQ ID NO: 286886 - protein, 9 aa, Homo Sapiens
PLTVSSSVV

SEQ ID NO: 286887 - protein, 9 aa, Homo Sapiens
NNFPFLEEL

SEQ ID NO: 286888 - protein, 9 aa, Homo Sapiens
DPDNLSEEK

SEQ ID NO: 286889 - protein, 9 aa, Homo Sapiens
PGCFGEGDN

SEQ ID NO: 286890 - protein, 9 aa, Homo Sapiens
ALKKASTRR

SEQ ID NO: 286891 - protein, 9 aa, Homo Sapiens
QTAGFSPDC

SEQ ID NO: 286892 - protein, 9 aa, Homo Sapiens
GKLRYEIYT

SEQ ID NO: 286893 - protein, 9 aa, Homo Sapiens
NIKINHNLA

SEQ ID NO: 286894 - protein, 9 aa, Homo Sapiens
NLRNLATGV

SEQ ID NO: 286895 - protein, 9 aa, Homo Sapiens
HSAIPVINW

SEQ ID NO: 286896 - protein, 9 aa, Homo Sapiens
LNIIEIFDN

SEQ ID NO: 286897 - protein, 9 aa, Homo Sapiens
CYLPEYKIF

SEQ ID NO: 286898 - protein, 9 aa, Homo Sapiens
KSAEKRKKY

SEQ ID NO: 286899 - protein, 9 aa, Homo Sapiens
IDGLSEQGN

SEQ ID NO: 286900 - protein, 9 aa, Homo Sapiens
VHVQSGPEE

SEQ ID NO: 286901 - protein, 9 aa, Homo Sapiens
DNEFKKQIW

SEQ ID NO: 286902 - protein, 9 aa, Homo Sapiens
LLRLTCCFC

SEQ ID NO: 286903 - protein, 9 aa, Homo Sapiens
HRDLAACNI

SEQ ID NO: 286904 - protein, 9 aa, Homo Sapiens
LSETKTIYY

SEQ ID NO: 286905 - protein, 9 aa, Homo Sapiens
GGTSLQIAH

SEQ ID NO: 286906 - protein, 9 aa, Homo Sapiens
LVKCLAPIQ

SEQ ID NO: 286907 - protein, 9 aa, Homo Sapiens
KKYFLDQIK

SEQ ID NO: 286908 - protein, 9 aa, Homo Sapiens
DFIKENNFL

SEQ ID NO: 286909 - protein, 9 aa, Homo Sapiens
CCALLMSES

SEQ ID NO: 286910 - protein, 9 aa, Homo Sapiens
EPKCHSLTR

SEQ ID NO: 286911 - protein, 9 aa, Homo Sapiens
CKAFTGEGQ

SEQ ID NO: 286912 - protein, 9 aa, Homo Sapiens
CSGDKNIEN

SEQ ID NO: 286913 - protein, 9 aa, Homo Sapiens
CKEDFPRTE

SEQ ID NO: 286914 - protein, 9 aa, Homo Sapiens
EAACNDVDL

SEQ ID NO: 286915 - protein, 9 aa, Homo Sapiens
DECHQQVHG

SEQ ID NO: 286916 - protein, 9 aa, Homo Sapiens
GRLDAGVKL

SEQ ID NO: 286917 - protein, 9 aa, Homo Sapiens
VGYPALQRE

SEQ ID NO: 286918 - protein, 9 aa, Homo Sapiens
ITLILSGDV

SEQ ID NO: 286919 - protein, 9 aa, Homo Sapiens
KLELFVEEN

SEQ ID NO: 286920 - protein, 9 aa, Homo Sapiens
SLISCWPLP

SEQ ID NO: 286921 - protein, 9 aa, Homo Sapiens
NSKYQLLNH

SEQ ID NO: 286922 - protein, 9 aa, Homo Sapiens
IMLGKCDPT

SEQ ID NO: 286923 - protein, 9 aa, Homo Sapiens
DRWFILQME

SEQ ID NO: 286924 - protein, 9 aa, Homo Sapiens
FFTICKREP

SEQ ID NO: 286925 - protein, 9 aa, Homo Sapiens
YFSAIRKIG

SEQ ID NO: 286926 - protein, 9 aa, Homo Sapiens
KYFEDIKIV

SEQ ID NO: 286927 - protein, 9 aa, Homo Sapiens
DGNKPSIAA

SEQ ID NO: 286928 - protein, 9 aa, Homo Sapiens
YTCRHLRIY

SEQ ID NO: 286929 - protein, 9 aa, Homo Sapiens
VFDAKQLNK

SEQ ID NO: 286930 - protein, 9 aa, Homo Sapiens
SIKQNYSSK

SEQ ID NO: 286931 - protein, 9 aa, Homo Sapiens
NMFQKHNSK

SEQ ID NO: 286932 - protein, 9 aa, Homo Sapiens
LYPLSLPQA

SEQ ID NO: 286933 - protein, 9 aa, Homo Sapiens
FQNVSKDME

SEQ ID NO: 286934 - protein, 9 aa, Homo Sapiens
HHQAPSGGQ

SEQ ID NO: 286935 - protein, 9 aa, Homo Sapiens
IHTIEEIIS

SEQ ID NO: 286936 - protein, 9 aa, Homo Sapiens
YLGIVSFLC

SEQ ID NO: 286937 - protein, 9 aa, Homo Sapiens
TIIPAHPTL

SEQ ID NO: 286938 - protein, 9 aa, Homo Sapiens
EQMTNEDNS

SEQ ID NO: 286939 - protein, 9 aa, Homo Sapiens
RLRAGLCDH

SEQ ID NO: 286940 - protein, 9 aa, Homo Sapiens
DYFMSKALG

SEQ ID NO: 286941 - protein, 9 aa, Homo Sapiens
LHVEMLADQ

SEQ ID NO: 286942 - protein, 9 aa, Homo Sapiens
QKNISFNFS

SEQ ID NO: 286943 - protein, 9 aa, Homo Sapiens
KQKKCKLTR

SEQ ID NO: 286944 - protein, 9 aa, Homo Sapiens
YKAVPSQTV

SEQ ID NO: 286945 - protein, 9 aa, Homo Sapiens
LLSGSVPLL

SEQ ID NO: 286946 - protein, 9 aa, Homo Sapiens
TKVKQNGSS

SEQ ID NO: 286947 - protein, 9 aa, Homo Sapiens
TTLYVADVK

SEQ ID NO: 286948 - protein, 9 aa, Homo Sapiens
SATYDRRTQ

SEQ ID NO: 286949 - protein, 9 aa, Homo Sapiens
VQVTTIPAV

SEQ ID NO: 286950 - protein, 9 aa, Homo Sapiens
LVEFPQKGL

SEQ ID NO: 286951 - protein, 9 aa, Homo Sapiens
PGRKIADMQ

SEQ ID NO: 286952 - protein, 9 aa, Homo Sapiens
KYYFPVILK

SEQ ID NO: 286953 - protein, 9 aa, Homo Sapiens
RVNRVAVHI

SEQ ID NO: 286954 - protein, 9 aa, Homo Sapiens
SVDYLLEKD

SEQ ID NO: 286955 - protein, 9 aa, Homo Sapiens
RHVHRNILS

SEQ ID NO: 286956 - protein, 9 aa, Homo Sapiens
VQQPSLRIT

SEQ ID NO: 286957 - protein, 9 aa, Homo Sapiens
EKDSLPHFV

SEQ ID NO: 286958 - protein, 9 aa, Homo Sapiens
DFHQTKAMA

SEQ ID NO: 286959 - protein, 9 aa, Homo Sapiens
TSVQVSQLL

SEQ ID NO: 286960 - protein, 9 aa, Homo Sapiens
LGCLLFLMK

SEQ ID NO: 286961 - protein, 9 aa, Homo Sapiens
FHTPEVTLV

SEQ ID NO: 286962 - protein, 9 aa, Homo Sapiens
FPVKIGIPL

SEQ ID NO: 286963 - protein, 9 aa, Homo Sapiens
RVLSSSNPW

SEQ ID NO: 286964 - protein, 9 aa, Homo Sapiens
QDQELDITK

SEQ ID NO: 286965 - protein, 9 aa, Homo Sapiens
DLYKMKAAS

SEQ ID NO: 286966 - protein, 9 aa, Homo Sapiens
VESSRRLVK

SEQ ID NO: 286967 - protein, 9 aa, Homo Sapiens
TSDEGIYRC

SEQ ID NO: 286968 - protein, 9 aa, Homo Sapiens
DFVWSLISE

SEQ ID NO: 286969 - protein, 9 aa, Homo Sapiens
GHIKGWLRM

SEQ ID NO: 286970 - protein, 9 aa, Homo Sapiens
MKLFPMEPY

SEQ ID NO: 286971 - protein, 9 aa, Homo Sapiens
WWSHIQVAI

SEQ ID NO: 286972 - protein, 9 aa, Homo Sapiens
NVIIITWEI

SEQ ID NO: 286973 - protein, 9 aa, Homo Sapiens
SVYPNGQFV

SEQ ID NO: 286974 - protein, 9 aa, Homo Sapiens
IANYLTRCQ

SEQ ID NO: 286975 - protein, 9 aa, Homo Sapiens
SRLKVELSD

SEQ ID NO: 286976 - protein, 9 aa, Homo Sapiens
LLYRFWIHT

SEQ ID NO: 286977 - protein, 9 aa, Homo Sapiens
RAQEKMHKV

SEQ ID NO: 286978 - protein, 9 aa, Homo Sapiens
LYWTMIQLH

SEQ ID NO: 286979 - protein, 9 aa, Homo Sapiens
PNKDLEWKN

SEQ ID NO: 286980 - protein, 9 aa, Homo Sapiens
GKKITLKCS

SEQ ID NO: 286981 - protein, 9 aa, Homo Sapiens
QEAQKETDL

SEQ ID NO: 286982 - protein, 9 aa, Homo Sapiens
LTTQPKRQK

SEQ ID NO: 286983 - protein, 9 aa, Homo Sapiens
ASGSPCLEC

SEQ ID NO: 286984 - protein, 9 aa, Homo Sapiens
SSLRNFPSA

SEQ ID NO: 286985 - protein, 9 aa, Homo Sapiens
KKLSASQFW

SEQ ID NO: 286986 - protein, 9 aa, Homo Sapiens
SLSFCGANA

SEQ ID NO: 286987 - protein, 9 aa, Homo Sapiens
TEARTRLER

SEQ ID NO: 286988 - protein, 9 aa, Homo Sapiens
KCDSEEDTT

SEQ ID NO: 286989 - protein, 9 aa, Homo Sapiens
SLMATSLDD

SEQ ID NO: 286990 - protein, 9 aa, Homo Sapiens
GNKPSIAAV

SEQ ID NO: 286991 - protein, 9 aa, Homo Sapiens
NGFKYLHEC

SEQ ID NO: 286992 - protein, 9 aa, Homo Sapiens
HVSPTGLLL

SEQ ID NO: 286993 - protein, 9 aa, Homo Sapiens
PTEVTPELS

SEQ ID NO: 286994 - protein, 9 aa, Homo Sapiens
AASPDNEDG

SEQ ID NO: 286995 - protein, 9 aa, Homo Sapiens
NLKHLDLAF

SEQ ID NO: 286996 - protein, 9 aa, Homo Sapiens
TCKKGGCKG

SEQ ID NO: 286997 - protein, 9 aa, Homo Sapiens
LVYKWFILI

SEQ ID NO: 286998 - protein, 9 aa, Homo Sapiens
ELKLLQKVE

SEQ ID NO: 286999 - protein, 9 aa, Homo Sapiens
LIDKNLIAY

SEQ ID NO: 287000 - protein, 9 aa, Homo Sapiens
YISANIQQH

SEQ ID NO: 287001 - protein, 9 aa, Homo Sapiens
QPHQTCCPD

SEQ ID NO: 287002 - protein, 9 aa, Homo Sapiens
AGHNMQNSA

SEQ ID NO: 287003 - protein, 9 aa, Homo Sapiens
LSEQLEQVK

SEQ ID NO: 287004 - protein, 9 aa, Homo Sapiens
VVDYRGRAT

SEQ ID NO: 287005 - protein, 9 aa, Homo Sapiens
DNPGRKIAD

SEQ ID NO: 287006 - protein, 9 aa, Homo Sapiens
IKQLTTDPD

SEQ ID NO: 287007 - protein, 9 aa, Homo Sapiens
LPQILGDIL

SEQ ID NO: 287008 - protein, 9 aa, Homo Sapiens
WLEQQQGNQ

SEQ ID NO: 287009 - protein, 9 aa, Homo Sapiens
PAQKKPPSS

SEQ ID NO: 287010 - protein, 9 aa, Homo Sapiens
TTRLKLQLL

SEQ ID NO: 287011 - protein, 9 aa, Homo Sapiens
VSTISYISR

SEQ ID NO: 287012 - protein, 9 aa, Homo Sapiens
VPHTADQDT

SEQ ID NO: 287013 - protein, 9 aa, Homo Sapiens
LREAMHDPL

SEQ ID NO: 287014 - protein, 9 aa, Homo Sapiens
IISEKKTIS

SEQ ID NO: 287015 - protein, 9 aa, Homo Sapiens
PRLVVLQGM

SEQ ID NO: 287016 - protein, 9 aa, Homo Sapiens
DNFTQTLPK

SEQ ID NO: 287017 - protein, 9 aa, Homo Sapiens
RPQVANTRL

SEQ ID NO: 287018 - protein, 9 aa, Homo Sapiens
GKGYFDAHT

SEQ ID NO: 287019 - protein, 9 aa, Homo Sapiens
YSSSLLMIW

SEQ ID NO: 287020 - protein, 9 aa, Homo Sapiens
TFQYWRNSL

SEQ ID NO: 287021 - protein, 9 aa, Homo Sapiens
NKQRASKVL

SEQ ID NO: 287022 - protein, 9 aa, Homo Sapiens
RLPEDYGVL

SEQ ID NO: 287023 - protein, 9 aa, Homo Sapiens
FEKILFEQH

SEQ ID NO: 287024 - protein, 9 aa, Homo Sapiens
QKERNRITV

SEQ ID NO: 287025 - protein, 9 aa, Homo Sapiens
LRELRPAGN

SEQ ID NO: 287026 - protein, 9 aa, Homo Sapiens
RPQAEVEQE

SEQ ID NO: 287027 - protein, 9 aa, Homo Sapiens
LNALMLYMK

SEQ ID NO: 287028 - protein, 9 aa, Homo Sapiens
SDWPKLFEK

SEQ ID NO: 287029 - protein, 9 aa, Homo Sapiens
YLQEELKIS

SEQ ID NO: 287030 - protein, 9 aa, Homo Sapiens
STPNKYELQ

SEQ ID NO: 287031 - protein, 9 aa, Homo Sapiens
FQPKTQFIG

SEQ ID NO: 287032 - protein, 9 aa, Homo Sapiens
DFKEEPDPG

SEQ ID NO: 287033 - protein, 9 aa, Homo Sapiens
DEGALNEIA

SEQ ID NO: 287034 - protein, 9 aa, Homo Sapiens
KVELSDSEA

SEQ ID NO: 287035 - protein, 9 aa, Homo Sapiens
HQNIAFGAL

SEQ ID NO: 287036 - protein, 9 aa, Homo Sapiens
TQGMSHGEL

SEQ ID NO: 287037 - protein, 9 aa, Homo Sapiens
PEDPAEAPM

SEQ ID NO: 287038 - protein, 9 aa, Homo Sapiens
ELVTVADNR

SEQ ID NO: 287039 - protein, 9 aa, Homo Sapiens
MDYLALSQE

SEQ ID NO: 287040 - protein, 9 aa, Homo Sapiens
ELFILGSKG

SEQ ID NO: 287041 - protein, 9 aa, Homo Sapiens
PRAQAGSDY

SEQ ID NO: 287042 - protein, 9 aa, Homo Sapiens
GSVYKNASF

SEQ ID NO: 287043 - protein, 9 aa, Homo Sapiens
VQYLVLEPT

SEQ ID NO: 287044 - protein, 9 aa, Homo Sapiens
NRYLKGALT

SEQ ID NO: 287045 - protein, 9 aa, Homo Sapiens
RQRKLHLFK

SEQ ID NO: 287046 - protein, 9 aa, Homo Sapiens
DIKTLEGAE

SEQ ID NO: 287047 - protein, 9 aa, Homo Sapiens
NGHSQAQNS

SEQ ID NO: 287048 - protein, 9 aa, Homo Sapiens
YNCPGDNAI

SEQ ID NO: 287049 - protein, 9 aa, Homo Sapiens
QTKLWLSHR

SEQ ID NO: 287050 - protein, 9 aa, Homo Sapiens
DKFMKDLKD

SEQ ID NO: 287051 - protein, 9 aa, Homo Sapiens
KLTRNIDNV

SEQ ID NO: 287052 - protein, 9 aa, Homo Sapiens
DCDEGKCYC

SEQ ID NO: 287053 - protein, 9 aa, Homo Sapiens
TLFNVGGII

SEQ ID NO: 287054 - protein, 9 aa, Homo Sapiens
PTTSGNGSE

SEQ ID NO: 287055 - protein, 9 aa, Homo Sapiens
SLVGIIIMV

SEQ ID NO: 287056 - protein, 9 aa, Homo Sapiens
QKGLRGPPP

SEQ ID NO: 287057 - protein, 9 aa, Homo Sapiens
NKQAVHTVM

SEQ ID NO: 287058 - protein, 9 aa, Homo Sapiens
FILGSCASD

SEQ ID NO: 287059 - protein, 9 aa, Homo Sapiens
KNRYEVEIN

SEQ ID NO: 287060 - protein, 9 aa, Homo Sapiens
YSGILNQSD

SEQ ID NO: 287061 - protein, 9 aa, Homo Sapiens
GRDTHVYTE

SEQ ID NO: 287062 - protein, 9 aa, Homo Sapiens
YLELESYAY

SEQ ID NO: 287063 - protein, 9 aa, Homo Sapiens
YQADGGQDR

SEQ ID NO: 287064 - protein, 9 aa, Homo Sapiens
KKDKKYKWM

SEQ ID NO: 287065 - protein, 9 aa, Homo Sapiens
RSEMAEKLF

SEQ ID NO: 287066 - protein, 9 aa, Homo Sapiens
EKMQCEVKY

SEQ ID NO: 287067 - protein, 9 aa, Homo Sapiens
LYSAENDRD

SEQ ID NO: 287068 - protein, 9 aa, Homo Sapiens
IKGSNNSSE

SEQ ID NO: 287069 - protein, 9 aa, Homo Sapiens
AQGDLTKEN

SEQ ID NO: 287070 - protein, 9 aa, Homo Sapiens
KCENHHDKL

SEQ ID NO: 287071 - protein, 9 aa, Homo Sapiens
RQTVSQVVH

SEQ ID NO: 287072 - protein, 9 aa, Homo Sapiens
NITRQNQLY

SEQ ID NO: 287073 - protein, 9 aa, Homo Sapiens
ENEYLDVLS

SEQ ID NO: 287074 - protein, 9 aa, Homo Sapiens
FDQPHQTCC

SEQ ID NO: 287075 - protein, 9 aa, Homo Sapiens
VILLFFMAL

SEQ ID NO: 287076 - protein, 9 aa, Homo Sapiens
CLVAVHELG

SEQ ID NO: 287077 - protein, 9 aa, Homo Sapiens
WVQGDWIRE

SEQ ID NO: 287078 - protein, 9 aa, Homo Sapiens
STVQTEGAE

SEQ ID NO: 287079 - protein, 9 aa, Homo Sapiens
SKCETIFFT

SEQ ID NO: 287080 - protein, 9 aa, Homo Sapiens
APEFTRDEL

SEQ ID NO: 287081 - protein, 9 aa, Homo Sapiens
KTKGANGTF

SEQ ID NO: 287082 - protein, 9 aa, Homo Sapiens
NCSKLRKKL

SEQ ID NO: 287083 - protein, 9 aa, Homo Sapiens
LQVFMVIGN

SEQ ID NO: 287084 - protein, 9 aa, Homo Sapiens
TFVEIGAHK

SEQ ID NO: 287085 - protein, 9 aa, Homo Sapiens
DEIYGDTIS

SEQ ID NO: 287086 - protein, 9 aa, Homo Sapiens
NKLKNELRT

SEQ ID NO: 287087 - protein, 9 aa, Homo Sapiens
VFAYVTDFV

SEQ ID NO: 287088 - protein, 9 aa, Homo Sapiens
REWPSDKGS

SEQ ID NO: 287089 - protein, 9 aa, Homo Sapiens
NQELAIERC

SEQ ID NO: 287090 - protein, 9 aa, Homo Sapiens
FVLGITSIL

SEQ ID NO: 287091 - protein, 9 aa, Homo Sapiens
MNDEGEIED

SEQ ID NO: 287092 - protein, 9 aa, Homo Sapiens
NKLGLTSDD

SEQ ID NO: 287093 - protein, 9 aa, Homo Sapiens
SCVTVPNML

SEQ ID NO: 287094 - protein, 9 aa, Homo Sapiens
KDMKVLQNH

SEQ ID NO: 287095 - protein, 9 aa, Homo Sapiens
RELGALLEQ

SEQ ID NO: 287096 - protein, 9 aa, Homo Sapiens
GPLTPELEA

SEQ ID NO: 287097 - protein, 9 aa, Homo Sapiens
GIEHLKLKD

SEQ ID NO: 287098 - protein, 9 aa, Homo Sapiens
SIENINLDL

SEQ ID NO: 287099 - protein, 9 aa, Homo Sapiens
VDGVYCIPI

SEQ ID NO: 287100 - protein, 9 aa, Homo Sapiens
YCQELKKVS

SEQ ID NO: 287101 - protein, 9 aa, Homo Sapiens
VKFAHFLLN

SEQ ID NO: 287102 - protein, 9 aa, Homo Sapiens
IYARSKALS

SEQ ID NO: 287103 - protein, 9 aa, Homo Sapiens
GGEYGSGAA

SEQ ID NO: 287104 - protein, 9 aa, Homo Sapiens
MSKKTVYCF

SEQ ID NO: 287105 - protein, 9 aa, Homo Sapiens
SSSYHSPGS

SEQ ID NO: 287106 - protein, 9 aa, Homo Sapiens
ASDNLWGSI

SEQ ID NO: 287107 - protein, 9 aa, Homo Sapiens
APEDVDTWA

SEQ ID NO: 287108 - protein, 9 aa, Homo Sapiens
LFQSFTRPK

SEQ ID NO: 287109 - protein, 9 aa, Homo Sapiens
KLYDSDKSC

SEQ ID NO: 287110 - protein, 9 aa, Homo Sapiens
ELCEYVSQH

SEQ ID NO: 287111 - protein, 9 aa, Homo Sapiens
HENIGVAGF

SEQ ID NO: 287112 - protein, 9 aa, Homo Sapiens
SGIENVSSV

SEQ ID NO: 287113 - protein, 9 aa, Homo Sapiens
PDSIQDLEI

SEQ ID NO: 287114 - protein, 9 aa, Homo Sapiens
HVYLWRHHI

SEQ ID NO: 287115 - protein, 9 aa, Homo Sapiens
GFIITVTTD

SEQ ID NO: 287116 - protein, 9 aa, Homo Sapiens
ASCQQQQIE

SEQ ID NO: 287117 - protein, 9 aa, Homo Sapiens
LECQMREME

SEQ ID NO: 287118 - protein, 9 aa, Homo Sapiens
GRKKAYFTC

SEQ ID NO: 287119 - protein, 9 aa, Homo Sapiens
TDALRKIQG

SEQ ID NO: 287120 - protein, 9 aa, Homo Sapiens
IVTLLDAII

SEQ ID NO: 287121 - protein, 9 aa, Homo Sapiens
SCWRTNPLD

SEQ ID NO: 287122 - protein, 9 aa, Homo Sapiens
LGQKITLYF

SEQ ID NO: 287123 - protein, 9 aa, Homo Sapiens
LFFQRFSVI

SEQ ID NO: 287124 - protein, 9 aa, Homo Sapiens
AHKRLGNSW

SEQ ID NO: 287125 - protein, 9 aa, Homo Sapiens
GYIWPWTKN

SEQ ID NO: 287126 - protein, 9 aa, Homo Sapiens
NAEFKCEEY

SEQ ID NO: 287127 - protein, 9 aa, Homo Sapiens
QRTLNQFGT

SEQ ID NO: 287128 - protein, 9 aa, Homo Sapiens
FDITADLDN

SEQ ID NO: 287129 - protein, 9 aa, Homo Sapiens
KEQQKLKKL

SEQ ID NO: 287130 - protein, 9 aa, Homo Sapiens
HCIWMPGQF

SEQ ID NO: 287131 - protein, 9 aa, Homo Sapiens
DVNNSKARE

SEQ ID NO: 287132 - protein, 9 aa, Homo Sapiens
DALFKGDNL

SEQ ID NO: 287133 - protein, 9 aa, Homo Sapiens
RAKREMGMY

SEQ ID NO: 287134 - protein, 9 aa, Homo Sapiens
IYTSNRMWK

SEQ ID NO: 287135 - protein, 9 aa, Homo Sapiens
RDRLFRQLR

SEQ ID NO: 287136 - protein, 9 aa, Homo Sapiens
LNSLGQNRS

SEQ ID NO: 287137 - protein, 9 aa, Homo Sapiens
PLHLFEDYF

SEQ ID NO: 287138 - protein, 9 aa, Homo Sapiens
FYRDRPADS

SEQ ID NO: 287139 - protein, 9 aa, Homo Sapiens
KLKNELRTT

SEQ ID NO: 287140 - protein, 9 aa, Homo Sapiens
PDLEKVVPL

SEQ ID NO: 287141 - protein, 9 aa, Homo Sapiens
SSAIHMTKG

SEQ ID NO: 287142 - protein, 9 aa, Homo Sapiens
CKRILVELA

SEQ ID NO: 287143 - protein, 9 aa, Homo Sapiens
IEYLPKTPI

SEQ ID NO: 287144 - protein, 9 aa, Homo Sapiens
IFFVPAKEV

SEQ ID NO: 287145 - protein, 9 aa, Homo Sapiens
VLFVADGLQ

SEQ ID NO: 287146 - protein, 9 aa, Homo Sapiens
GLKVEINCT

SEQ ID NO: 287147 - protein, 9 aa, Homo Sapiens
GSEFFRNRS

SEQ ID NO: 287148 - protein, 9 aa, Homo Sapiens
QRMRSRSKG

SEQ ID NO: 287149 - protein, 9 aa, Homo Sapiens
TVMCMYLRP

SEQ ID NO: 287150 - protein, 9 aa, Homo Sapiens
AGLYYVRND

SEQ ID NO: 287151 - protein, 9 aa, Homo Sapiens
LKVGMRREV

SEQ ID NO: 287152 - protein, 9 aa, Homo Sapiens
SGKLYQLRH

SEQ ID NO: 287153 - protein, 9 aa, Homo Sapiens
VKAIKVLIS

SEQ ID NO: 287154 - protein, 9 aa, Homo Sapiens
RRAVNSQFP

SEQ ID NO: 287155 - protein, 9 aa, Homo Sapiens
WEQNVYAII

SEQ ID NO: 287156 - protein, 9 aa, Homo Sapiens
FCTDHTVLI

SEQ ID NO: 287157 - protein, 9 aa, Homo Sapiens
VISEKMFEF

SEQ ID NO: 287158 - protein, 9 aa, Homo Sapiens
FGIDMVVYM

SEQ ID NO: 287159 - protein, 9 aa, Homo Sapiens
RVISGKQEL

SEQ ID NO: 287160 - protein, 9 aa, Homo Sapiens
KSQHQEDTY

SEQ ID NO: 287161 - protein, 9 aa, Homo Sapiens
SFESTANNK

SEQ ID NO: 287162 - protein, 9 aa, Homo Sapiens
NVETVTYRN

SEQ ID NO: 287163 - protein, 9 aa, Homo Sapiens
CFILDKSGS

SEQ ID NO: 287164 - protein, 9 aa, Homo Sapiens
LFNSKLPVD

SEQ ID NO: 287165 - protein, 9 aa, Homo Sapiens
PVQGTAFNL

SEQ ID NO: 287166 - protein, 9 aa, Homo Sapiens
SQSLGPFIS

SEQ ID NO: 287167 - protein, 9 aa, Homo Sapiens
RYVKAVYQY

SEQ ID NO: 287168 - protein, 9 aa, Homo Sapiens
QLLEKEGFV

SEQ ID NO: 287169 - protein, 9 aa, Homo Sapiens
QNNTTEVWE

SEQ ID NO: 287170 - protein, 9 aa, Homo Sapiens
FPGFPGEIG

SEQ ID NO: 287171 - protein, 9 aa, Homo Sapiens
QVPNSGSSA

SEQ ID NO: 287172 - protein, 9 aa, Homo Sapiens
RVAKTGSLN

SEQ ID NO: 287173 - protein, 9 aa, Homo Sapiens
KLVSGNLSP

SEQ ID NO: 287174 - protein, 9 aa, Homo Sapiens
DVISFIKWH

SEQ ID NO: 287175 - protein, 9 aa, Homo Sapiens
MDIDSRPTA

SEQ ID NO: 287176 - protein, 9 aa, Homo Sapiens
FTTSLLSNY

SEQ ID NO: 287177 - protein, 9 aa, Homo Sapiens
SEKPTLQAK

SEQ ID NO: 287178 - protein, 9 aa, Homo Sapiens
NEAVKSEQS

SEQ ID NO: 287179 - protein, 9 aa, Homo Sapiens
DLVVQERNY

SEQ ID NO: 287180 - protein, 9 aa, Homo Sapiens
ATVHIQVNN

SEQ ID NO: 287181 - protein, 9 aa, Homo Sapiens
PEDYRRGQV

SEQ ID NO: 287182 - protein, 9 aa, Homo Sapiens
KDIDPEGKT

SEQ ID NO: 287183 - protein, 9 aa, Homo Sapiens
STSPQLAKP

SEQ ID NO: 287184 - protein, 9 aa, Homo Sapiens
SASIREEPL

SEQ ID NO: 287185 - protein, 9 aa, Homo Sapiens
RLQDERTVR

SEQ ID NO: 287186 - protein, 9 aa, Homo Sapiens
VKLFLTKKR

SEQ ID NO: 287187 - protein, 9 aa, Homo Sapiens
DWFLDRLWT

SEQ ID NO: 287188 - protein, 9 aa, Homo Sapiens
KGQHLISTE

SEQ ID NO: 287189 - protein, 9 aa, Homo Sapiens
DNSKKTTTN

SEQ ID NO: 287190 - protein, 9 aa, Homo Sapiens
VCFKVITKD

SEQ ID NO: 287191 - protein, 9 aa, Homo Sapiens
SSRLMSHQI

SEQ ID NO: 287192 - protein, 9 aa, Homo Sapiens
RADAESWYR

SEQ ID NO: 287193 - protein, 9 aa, Homo Sapiens
NLPPCPFPL

SEQ ID NO: 287194 - protein, 9 aa, Homo Sapiens
FSDADLRPS

SEQ ID NO: 287195 - protein, 9 aa, Homo Sapiens
GNAFICSYQ

SEQ ID NO: 287196 - protein, 9 aa, Homo Sapiens
PVMIITESM

SEQ ID NO: 287197 - protein, 9 aa, Homo Sapiens
NEIISDPEV

SEQ ID NO: 287198 - protein, 9 aa, Homo Sapiens
NLFNIKKFT

SEQ ID NO: 287199 - protein, 9 aa, Homo Sapiens
VWMVDCYSP

SEQ ID NO: 287200 - protein, 9 aa, Homo Sapiens
SGEKNNSCS

SEQ ID NO: 287201 - protein, 9 aa, Homo Sapiens
EFQRKMRKF

SEQ ID NO: 287202 - protein, 9 aa, Homo Sapiens
IDLNQTKLE

SEQ ID NO: 287203 - protein, 9 aa, Homo Sapiens
SIFIYARSK

SEQ ID NO: 287204 - protein, 9 aa, Homo Sapiens
YFGRCSLSS

SEQ ID NO: 287205 - protein, 9 aa, Homo Sapiens
PYPDSLEPR

SEQ ID NO: 287206 - protein, 9 aa, Homo Sapiens
PDLSELFKE

SEQ ID NO: 287207 - protein, 9 aa, Homo Sapiens
HKKIHTGEM

SEQ ID NO: 287208 - protein, 9 aa, Homo Sapiens
IGRFKSMSP

SEQ ID NO: 287209 - protein, 9 aa, Homo Sapiens
EYLGAIYRS

SEQ ID NO: 287210 - protein, 9 aa, Homo Sapiens
RPLKTTTSL

SEQ ID NO: 287211 - protein, 9 aa, Homo Sapiens
PTNDFAHEM

SEQ ID NO: 287212 - protein, 9 aa, Homo Sapiens
TSKIDQYSQ

SEQ ID NO: 287213 - protein, 9 aa, Homo Sapiens
YVDGSNLIT

SEQ ID NO: 287214 - protein, 9 aa, Homo Sapiens
ADFQLSVDY

SEQ ID NO: 287215 - protein, 9 aa, Homo Sapiens
LFQPNENTG

SEQ ID NO: 287216 - protein, 9 aa, Homo Sapiens
VLLDVKPRL

SEQ ID NO: 287217 - protein, 9 aa, Homo Sapiens
YYIDKAKKF

SEQ ID NO: 287218 - protein, 9 aa, Homo Sapiens
LVLTLNAWE

SEQ ID NO: 287219 - protein, 9 aa, Homo Sapiens
RGCTKRTNR

SEQ ID NO: 287220 - protein, 9 aa, Homo Sapiens
STLTQDKII

SEQ ID NO: 287221 - protein, 9 aa, Homo Sapiens
EIHGSLPHM

SEQ ID NO: 287222 - protein, 9 aa, Homo Sapiens
EPKSIYKYQ

SEQ ID NO: 287223 - protein, 9 aa, Homo Sapiens
LTSKNCIHR

SEQ ID NO: 287224 - protein, 9 aa, Homo Sapiens
APPAMLSVS

SEQ ID NO: 287225 - protein, 9 aa, Homo Sapiens
SDLNIGSGA

SEQ ID NO: 287226 - protein, 9 aa, Homo Sapiens
DKISIKLVC

SEQ ID NO: 287227 - protein, 9 aa, Homo Sapiens
TFIELFPTS

SEQ ID NO: 287228 - protein, 9 aa, Homo Sapiens
RKENVFPGT

SEQ ID NO: 287229 - protein, 9 aa, Homo Sapiens
EMNAKEELS

SEQ ID NO: 287230 - protein, 9 aa, Homo Sapiens
MAYLARKVS

SEQ ID NO: 287231 - protein, 9 aa, Homo Sapiens
DTSFKNTLY

SEQ ID NO: 287232 - protein, 9 aa, Homo Sapiens
EIPTGMTCL

SEQ ID NO: 287233 - protein, 9 aa, Homo Sapiens
VEEEQGYIE

SEQ ID NO: 287234 - protein, 9 aa, Homo Sapiens
AREALSGAC

SEQ ID NO: 287235 - protein, 9 aa, Homo Sapiens
SQYGRFLCC

SEQ ID NO: 287236 - protein, 9 aa, Homo Sapiens
EPRGPRERR

SEQ ID NO: 287237 - protein, 9 aa, Homo Sapiens
QYCIFANFS

SEQ ID NO: 287238 - protein, 9 aa, Homo Sapiens
SRRNCSKLR

SEQ ID NO: 287239 - protein, 9 aa, Homo Sapiens
ALNLTAPGT

SEQ ID NO: 287240 - protein, 9 aa, Homo Sapiens
VDVMLISLS

SEQ ID NO: 287241 - protein, 9 aa, Homo Sapiens
FEDLNNDKK

SEQ ID NO: 287242 - protein, 9 aa, Homo Sapiens
TVESIMRDT

SEQ ID NO: 287243 - protein, 9 aa, Homo Sapiens
LLDRKDKTT

SEQ ID NO: 287244 - protein, 9 aa, Homo Sapiens
SAPQGNSHT

SEQ ID NO: 287245 - protein, 9 aa, Homo Sapiens
LQWEHMGKR

SEQ ID NO: 287246 - protein, 9 aa, Homo Sapiens
EPECYFPDE

SEQ ID NO: 287247 - protein, 9 aa, Homo Sapiens
NENQELHDG

SEQ ID NO: 287248 - protein, 9 aa, Homo Sapiens
ERGKAFSCL

SEQ ID NO: 287249 - protein, 9 aa, Homo Sapiens
FLAAYAPGA

SEQ ID NO: 287250 - protein, 9 aa, Homo Sapiens
AFRRDQRYL

SEQ ID NO: 287251 - protein, 9 aa, Homo Sapiens
RDEEAAETK

SEQ ID NO: 287252 - protein, 9 aa, Homo Sapiens
VSRPGYQHW

SEQ ID NO: 287253 - protein, 9 aa, Homo Sapiens
LGLGNKSFQ

SEQ ID NO: 287254 - protein, 9 aa, Homo Sapiens
QRAIVGSLP

SEQ ID NO: 287255 - protein, 9 aa, Homo Sapiens
GAGPASMSC

SEQ ID NO: 287256 - protein, 9 aa, Homo Sapiens
TVADHREGI

SEQ ID NO: 287257 - protein, 9 aa, Homo Sapiens
VRRLPRIHA

SEQ ID NO: 287258 - protein, 9 aa, Homo Sapiens
PENAPVNTQ

SEQ ID NO: 287259 - protein, 9 aa, Homo Sapiens
TYTDAGGVT

SEQ ID NO: 287260 - protein, 9 aa, Homo Sapiens
QHRSFPLPG

SEQ ID NO: 287261 - protein, 9 aa, Homo Sapiens
SSQDVIELK

SEQ ID NO: 287262 - protein, 9 aa, Homo Sapiens
LEGCISVKD

SEQ ID NO: 287263 - protein, 9 aa, Homo Sapiens
DQVSYSADE

SEQ ID NO: 287264 - protein, 9 aa, Homo Sapiens
IYCYYGDGF

SEQ ID NO: 287265 - protein, 9 aa, Homo Sapiens
QSGKDKEMN

SEQ ID NO: 287266 - protein, 9 aa, Homo Sapiens
QDVCIPVGS

SEQ ID NO: 287267 - protein, 9 aa, Homo Sapiens
HRPDLFDLN

SEQ ID NO: 287268 - protein, 9 aa, Homo Sapiens
LYVRRVFIV

SEQ ID NO: 287269 - protein, 9 aa, Homo Sapiens
VKRIRKKQA

SEQ ID NO: 287270 - protein, 9 aa, Homo Sapiens
LHSFFVVGT

SEQ ID NO: 287271 - protein, 9 aa, Homo Sapiens
GCWLFFFFL

SEQ ID NO: 287272 - protein, 9 aa, Homo Sapiens
RSSDPGRCF

SEQ ID NO: 287273 - protein, 9 aa, Homo Sapiens
TGKVHLTAT

SEQ ID NO: 287274 - protein, 9 aa, Homo Sapiens
QVIQHKIIH

SEQ ID NO: 287275 - protein, 9 aa, Homo Sapiens
LDSTRQVEK

SEQ ID NO: 287276 - protein, 9 aa, Homo Sapiens
QTRYFILPC

SEQ ID NO: 287277 - protein, 9 aa, Homo Sapiens
VTLDQVWNI

SEQ ID NO: 287278 - protein, 9 aa, Homo Sapiens
EDTFKWNLT

SEQ ID NO: 287279 - protein, 9 aa, Homo Sapiens
PLRYSYILT

SEQ ID NO: 287280 - protein, 9 aa, Homo Sapiens
AVNSLQLKA

SEQ ID NO: 287281 - protein, 9 aa, Homo Sapiens
PSLSQSPPT

SEQ ID NO: 287282 - protein, 9 aa, Homo Sapiens
QADALYELD

SEQ ID NO: 287283 - protein, 9 aa, Homo Sapiens
LDLSETYLE

SEQ ID NO: 287284 - protein, 9 aa, Homo Sapiens
CRSYTYFKA

SEQ ID NO: 287285 - protein, 9 aa, Homo Sapiens
GLCSLTHLS

SEQ ID NO: 287286 - protein, 9 aa, Homo Sapiens
LASKANFCT

SEQ ID NO: 287287 - protein, 9 aa, Homo Sapiens
TRTYCYKQE

SEQ ID NO: 287288 - protein, 9 aa, Homo Sapiens
SKALSAFDT

SEQ ID NO: 287289 - protein, 9 aa, Homo Sapiens
VTLGNTVYF

SEQ ID NO: 287290 - protein, 9 aa, Homo Sapiens
TCNHSLLFL

SEQ ID NO: 287291 - protein, 9 aa, Homo Sapiens
PHDAEINKI

SEQ ID NO: 287292 - protein, 9 aa, Homo Sapiens
TQMDDKKPR

SEQ ID NO: 287293 - protein, 9 aa, Homo Sapiens
DIESVKKNN

SEQ ID NO: 287294 - protein, 9 aa, Homo Sapiens
MEVPPPAPQ

SEQ ID NO: 287295 - protein, 9 aa, Homo Sapiens
TLAECWAAL

SEQ ID NO: 287296 - protein, 9 aa, Homo Sapiens
ILLELGQCK

SEQ ID NO: 287297 - protein, 9 aa, Homo Sapiens
LYLKKNKIH

SEQ ID NO: 287298 - protein, 9 aa, Homo Sapiens
AEEKACLAA

SEQ ID NO: 287299 - protein, 9 aa, Homo Sapiens
FTICNYFDA

SEQ ID NO: 287300 - protein, 9 aa, Homo Sapiens
DNKSPHSDP

SEQ ID NO: 287301 - protein, 9 aa, Homo Sapiens
IGIPLFHVL

SEQ ID NO: 287302 - protein, 9 aa, Homo Sapiens
SRSPNPRVS

SEQ ID NO: 287303 - protein, 9 aa, Homo Sapiens
TPPRPREDL

SEQ ID NO: 287304 - protein, 9 aa, Homo Sapiens
LTDDYGLDN

SEQ ID NO: 287305 - protein, 9 aa, Homo Sapiens
FTQVSHLAQ

SEQ ID NO: 287306 - protein, 9 aa, Homo Sapiens
TGACMPVLV

SEQ ID NO: 287307 - protein, 9 aa, Homo Sapiens
PKFSIKTSF

SEQ ID NO: 287308 - protein, 9 aa, Homo Sapiens
VGRVRYMLE

SEQ ID NO: 287309 - protein, 9 aa, Homo Sapiens
LKVFGKEQA

SEQ ID NO: 287310 - protein, 9 aa, Homo Sapiens
AVGVNVSGG

SEQ ID NO: 287311 - protein, 9 aa, Homo Sapiens
VLKEKTKET

SEQ ID NO: 287312 - protein, 9 aa, Homo Sapiens
CCKKCQDWY

SEQ ID NO: 287313 - protein, 9 aa, Homo Sapiens
ASQSLGPFI

SEQ ID NO: 287314 - protein, 9 aa, Homo Sapiens
LDIPKGEMV

SEQ ID NO: 287315 - protein, 9 aa, Homo Sapiens
KTNFLKKHK

SEQ ID NO: 287316 - protein, 9 aa, Homo Sapiens
SFSNKFPHY

SEQ ID NO: 287317 - protein, 9 aa, Homo Sapiens
DKNVISLQL

SEQ ID NO: 287318 - protein, 9 aa, Homo Sapiens
QRELEQAQA

SEQ ID NO: 287319 - protein, 9 aa, Homo Sapiens
KKEDDVPQF

SEQ ID NO: 287320 - protein, 9 aa, Homo Sapiens
FSPSLLKRH

SEQ ID NO: 287321 - protein, 9 aa, Homo Sapiens
EIRRIKSLL

SEQ ID NO: 287322 - protein, 9 aa, Homo Sapiens
VYATAVLQQ

SEQ ID NO: 287323 - protein, 9 aa, Homo Sapiens
TSFFHSEPV

SEQ ID NO: 287324 - protein, 9 aa, Homo Sapiens
HQCNYKCGF

SEQ ID NO: 287325 - protein, 9 aa, Homo Sapiens
NRNHQPPQT

SEQ ID NO: 287326 - protein, 9 aa, Homo Sapiens
PFVDLIANF

SEQ ID NO: 287327 - protein, 9 aa, Homo Sapiens
LGKQLSESA

SEQ ID NO: 287328 - protein, 9 aa, Homo Sapiens
GFVQLYNTE

SEQ ID NO: 287329 - protein, 9 aa, Homo Sapiens
LLEEKVHIV

SEQ ID NO: 287330 - protein, 9 aa, Homo Sapiens
ARMNLRLCV

SEQ ID NO: 287331 - protein, 9 aa, Homo Sapiens
QEYKLQKEH

SEQ ID NO: 287332 - protein, 9 aa, Homo Sapiens
LHACGVATY

SEQ ID NO: 287333 - protein, 9 aa, Homo Sapiens
TVAQNEEVD

SEQ ID NO: 287334 - protein, 9 aa, Homo Sapiens
LFCRVRFDN

SEQ ID NO: 287335 - protein, 9 aa, Homo Sapiens
SRWVRQAAS

SEQ ID NO: 287336 - protein, 9 aa, Homo Sapiens
KQQPDKVAE

SEQ ID NO: 287337 - protein, 9 aa, Homo Sapiens
YPFVDLIAN

SEQ ID NO: 287338 - protein, 9 aa, Homo Sapiens
TKLLYRLVG

SEQ ID NO: 287339 - protein, 9 aa, Homo Sapiens
IAWEINDVA

SEQ ID NO: 287340 - protein, 9 aa, Homo Sapiens
RLLKRSFSA

SEQ ID NO: 287341 - protein, 9 aa, Homo Sapiens
VRDRPDTQK

SEQ ID NO: 287342 - protein, 9 aa, Homo Sapiens
AGMGRDSAV

SEQ ID NO: 287343 - protein, 9 aa, Homo Sapiens
YGSRETYGF

SEQ ID NO: 287344 - protein, 9 aa, Homo Sapiens
HAMARYPHS

SEQ ID NO: 287345 - protein, 9 aa, Homo Sapiens
ALAPHKEQY

SEQ ID NO: 287346 - protein, 9 aa, Homo Sapiens
KEKQHKKNI

SEQ ID NO: 287347 - protein, 9 aa, Homo Sapiens
LRNFPSAKC

SEQ ID NO: 287348 - protein, 9 aa, Homo Sapiens
ASDFLTDTQ

SEQ ID NO: 287349 - protein, 9 aa, Homo Sapiens
KVSFCGRRK

SEQ ID NO: 287350 - protein, 9 aa, Homo Sapiens
KSSSSDEDY

SEQ ID NO: 287351 - protein, 9 aa, Homo Sapiens
IYYGNTEIL

SEQ ID NO: 287352 - protein, 9 aa, Homo Sapiens
SCDVPGGHS

SEQ ID NO: 287353 - protein, 9 aa, Homo Sapiens
TEAVKEAIA

SEQ ID NO: 287354 - protein, 9 aa, Homo Sapiens
ALVYSAASP

SEQ ID NO: 287355 - protein, 9 aa, Homo Sapiens
KEDYVLTKC

SEQ ID NO: 287356 - protein, 9 aa, Homo Sapiens
SKAGTETAI

SEQ ID NO: 287357 - protein, 9 aa, Homo Sapiens
SPLSSDYPV

SEQ ID NO: 287358 - protein, 9 aa, Homo Sapiens
CEGVGWHIQ

SEQ ID NO: 287359 - protein, 9 aa, Homo Sapiens
YLPDMDPGS

SEQ ID NO: 287360 - protein, 9 aa, Homo Sapiens
IFTIHVSSK

SEQ ID NO: 287361 - protein, 9 aa, Homo Sapiens
FSTDMSSGQ

SEQ ID NO: 287362 - protein, 9 aa, Homo Sapiens
RQIKMELQQ

SEQ ID NO: 287363 - protein, 9 aa, Homo Sapiens
EPWNTLPKY

SEQ ID NO: 287364 - protein, 9 aa, Homo Sapiens
DKVSENFRV

SEQ ID NO: 287365 - protein, 9 aa, Homo Sapiens
REKRRNATG

SEQ ID NO: 287366 - protein, 9 aa, Homo Sapiens
FQMKEFLRK

SEQ ID NO: 287367 - protein, 9 aa, Homo Sapiens
NHIPLRLGF

SEQ ID NO: 287368 - protein, 9 aa, Homo Sapiens
RRITVFGLG

SEQ ID NO: 287369 - protein, 9 aa, Homo Sapiens
ERQIQVNDD

SEQ ID NO: 287370 - protein, 9 aa, Homo Sapiens
GQAGAVDML

SEQ ID NO: 287371 - protein, 9 aa, Homo Sapiens
MDFGTVRDT

SEQ ID NO: 287372 - protein, 9 aa, Homo Sapiens
FQGTMEADR

SEQ ID NO: 287373 - protein, 9 aa, Homo Sapiens
EASLKTCDC

SEQ ID NO: 287374 - protein, 9 aa, Homo Sapiens
EPDSANPVA

SEQ ID NO: 287375 - protein, 9 aa, Homo Sapiens
LVSKAQADS

SEQ ID NO: 287376 - protein, 9 aa, Homo Sapiens
MANSKHALL

SEQ ID NO: 287377 - protein, 9 aa, Homo Sapiens
VGAPRYKHH

SEQ ID NO: 287378 - protein, 9 aa, Homo Sapiens
SEPMLCSEL

SEQ ID NO: 287379 - protein, 9 aa, Homo Sapiens
HESLGKSVV

SEQ ID NO: 287380 - protein, 9 aa, Homo Sapiens
SGPAWGSKE

SEQ ID NO: 287381 - protein, 9 aa, Homo Sapiens
TTRGKKNRS

SEQ ID NO: 287382 - protein, 9 aa, Homo Sapiens
KPVLFNSKL

SEQ ID NO: 287383 - protein, 9 aa, Homo Sapiens
DTVFTLLAI

SEQ ID NO: 287384 - protein, 9 aa, Homo Sapiens
ENVSSSTLQ

SEQ ID NO: 287385 - protein, 9 aa, Homo Sapiens
WFTWSMKTT

SEQ ID NO: 287386 - protein, 9 aa, Homo Sapiens
HLKKELFTK

SEQ ID NO: 287387 - protein, 9 aa, Homo Sapiens
IQTSMGLSC

SEQ ID NO: 287388 - protein, 9 aa, Homo Sapiens
CKECEKVFR

SEQ ID NO: 287389 - protein, 9 aa, Homo Sapiens
NATFDLSAE

SEQ ID NO: 287390 - protein, 9 aa, Homo Sapiens
KKMGREPED

SEQ ID NO: 287391 - protein, 9 aa, Homo Sapiens
QVKRLEWKN

SEQ ID NO: 287392 - protein, 9 aa, Homo Sapiens
MCVFSHLLS

SEQ ID NO: 287393 - protein, 9 aa, Homo Sapiens
PDLDFPFLC

SEQ ID NO: 287394 - protein, 9 aa, Homo Sapiens
LCYQLQKWT

SEQ ID NO: 287395 - protein, 9 aa, Homo Sapiens
DKLEHHFTQ

SEQ ID NO: 287396 - protein, 9 aa, Homo Sapiens
TYTVNIVAI

SEQ ID NO: 287397 - protein, 9 aa, Homo Sapiens
EFNKMLKST

SEQ ID NO: 287398 - protein, 9 aa, Homo Sapiens
GGVCEGVGW

SEQ ID NO: 287399 - protein, 9 aa, Homo Sapiens
EWNTVERFK

SEQ ID NO: 287400 - protein, 9 aa, Homo Sapiens
KKTGECSDK

SEQ ID NO: 287401 - protein, 9 aa, Homo Sapiens
IIQVLFIQK

SEQ ID NO: 287402 - protein, 9 aa, Homo Sapiens
VDKKAMMEA

SEQ ID NO: 287403 - protein, 9 aa, Homo Sapiens
FDMIRGKLE

SEQ ID NO: 287404 - protein, 9 aa, Homo Sapiens
CIDILFAFT

SEQ ID NO: 287405 - protein, 9 aa, Homo Sapiens
ISPLPPLLA

SEQ ID NO: 287406 - protein, 9 aa, Homo Sapiens
SEFVEHHIM

SEQ ID NO: 287407 - protein, 9 aa, Homo Sapiens
PQYSPEVDT

SEQ ID NO: 287408 - protein, 9 aa, Homo Sapiens
AIDLISSLM

SEQ ID NO: 287409 - protein, 9 aa, Homo Sapiens
INRSILALG

SEQ ID NO: 287410 - protein, 9 aa, Homo Sapiens
AAQVAPIMS

SEQ ID NO: 287411 - protein, 9 aa, Homo Sapiens
AIPPRDTAF

SEQ ID NO: 287412 - protein, 9 aa, Homo Sapiens
AKDERIYIT

SEQ ID NO: 287413 - protein, 9 aa, Homo Sapiens
EEKKALIYQ

SEQ ID NO: 287414 - protein, 9 aa, Homo Sapiens
STSSKAESP

SEQ ID NO: 287415 - protein, 9 aa, Homo Sapiens
ELMNDVNYL

SEQ ID NO: 287416 - protein, 9 aa, Homo Sapiens
QTGYMPRKA

SEQ ID NO: 287417 - protein, 9 aa, Homo Sapiens
EEVRKKSKK

SEQ ID NO: 287418 - protein, 9 aa, Homo Sapiens
QDLLLDYSF

SEQ ID NO: 287419 - protein, 9 aa, Homo Sapiens
AYGRSKDKN

SEQ ID NO: 287420 - protein, 9 aa, Homo Sapiens
QSSVTSVGK

SEQ ID NO: 287421 - protein, 9 aa, Homo Sapiens
KIRFVGRQK

SEQ ID NO: 287422 - protein, 9 aa, Homo Sapiens
DQKHSYEQK

SEQ ID NO: 287423 - protein, 9 aa, Homo Sapiens
GRIILNIKW

SEQ ID NO: 287424 - protein, 9 aa, Homo Sapiens
QVALKDVSS

SEQ ID NO: 287425 - protein, 9 aa, Homo Sapiens
PPDSGENRK

SEQ ID NO: 287426 - protein, 9 aa, Homo Sapiens
SSLAETLYS

SEQ ID NO: 287427 - protein, 9 aa, Homo Sapiens
KHNSKPSVP

SEQ ID NO: 287428 - protein, 9 aa, Homo Sapiens
KCCLTECTK

SEQ ID NO: 287429 - protein, 9 aa, Homo Sapiens
MKNLEVLMH

SEQ ID NO: 287430 - protein, 9 aa, Homo Sapiens
LDSTAIDGM

SEQ ID NO: 287431 - protein, 9 aa, Homo Sapiens
RLPFIGFTF

SEQ ID NO: 287432 - protein, 9 aa, Homo Sapiens
LWGSISASM

SEQ ID NO: 287433 - protein, 9 aa, Homo Sapiens
AIIGNKMFT

SEQ ID NO: 287434 - protein, 9 aa, Homo Sapiens
LQEVPLCYL

SEQ ID NO: 287435 - protein, 9 aa, Homo Sapiens
GGSVYKNAS

SEQ ID NO: 287436 - protein, 9 aa, Homo Sapiens
YAAKIINTN

SEQ ID NO: 287437 - protein, 9 aa, Homo Sapiens
VKVWGSIQG

SEQ ID NO: 287438 - protein, 9 aa, Homo Sapiens
HNERKRKTK

SEQ ID NO: 287439 - protein, 9 aa, Homo Sapiens
WDVLDGLLA

SEQ ID NO: 287440 - protein, 9 aa, Homo Sapiens
YGYPEVKDT

SEQ ID NO: 287441 - protein, 9 aa, Homo Sapiens
PHVTHAFHA

SEQ ID NO: 287442 - protein, 9 aa, Homo Sapiens
EESKDKGIS

SEQ ID NO: 287443 - protein, 9 aa, Homo Sapiens
RYRYVSPFD

SEQ ID NO: 287444 - protein, 9 aa, Homo Sapiens
ETDLEKRDF

SEQ ID NO: 287445 - protein, 9 aa, Homo Sapiens
CGREAEVVM

SEQ ID NO: 287446 - protein, 9 aa, Homo Sapiens
DYTQCNVNT

SEQ ID NO: 287447 - protein, 9 aa, Homo Sapiens
HTHVLYHTK

SEQ ID NO: 287448 - protein, 9 aa, Homo Sapiens
NTMKFGKNM

SEQ ID NO: 287449 - protein, 9 aa, Homo Sapiens
SFAHTASSA

SEQ ID NO: 287450 - protein, 9 aa, Homo Sapiens
DKHYYGEGC

SEQ ID NO: 287451 - protein, 9 aa, Homo Sapiens
HFLVNAAGI

SEQ ID NO: 287452 - protein, 9 aa, Homo Sapiens
HERPQKING

SEQ ID NO: 287453 - protein, 9 aa, Homo Sapiens
MSSNLNKSE

SEQ ID NO: 287454 - protein, 9 aa, Homo Sapiens
KAIIQGAKL

SEQ ID NO: 287455 - protein, 9 aa, Homo Sapiens
RCQEISNQI

SEQ ID NO: 287456 - protein, 9 aa, Homo Sapiens
LDTRLPVTK

SEQ ID NO: 287457 - protein, 9 aa, Homo Sapiens
LTVFSDTSP

SEQ ID NO: 287458 - protein, 9 aa, Homo Sapiens
HAPWDLGMA

SEQ ID NO: 287459 - protein, 9 aa, Homo Sapiens
RCLQNPLDN

SEQ ID NO: 287460 - protein, 9 aa, Homo Sapiens
KTPATVGLP

SEQ ID NO: 287461 - protein, 9 aa, Homo Sapiens
AKSKYSTPN

SEQ ID NO: 287462 - protein, 9 aa, Homo Sapiens
RESPLDTTH

SEQ ID NO: 287463 - protein, 9 aa, Homo Sapiens
SLSVPCRGA

SEQ ID NO: 287464 - protein, 9 aa, Homo Sapiens
VVGNGGVLN

SEQ ID NO: 287465 - protein, 9 aa, Homo Sapiens
PAPFLDHTG

SEQ ID NO: 287466 - protein, 9 aa, Homo Sapiens
QWSTVICAL

SEQ ID NO: 287467 - protein, 9 aa, Homo Sapiens
LRQSDPHKR

SEQ ID NO: 287468 - protein, 9 aa, Homo Sapiens
CHESGNILH

SEQ ID NO: 287469 - protein, 9 aa, Homo Sapiens
PACVLLFSI

SEQ ID NO: 287470 - protein, 9 aa, Homo Sapiens
FTMLINNFY

SEQ ID NO: 287471 - protein, 9 aa, Homo Sapiens
SRTDESEFF

SEQ ID NO: 287472 - protein, 9 aa, Homo Sapiens
ALRLNVNAR

SEQ ID NO: 287473 - protein, 9 aa, Homo Sapiens
YFVMDLPKG

SEQ ID NO: 287474 - protein, 9 aa, Homo Sapiens
KCVKRKVMD

SEQ ID NO: 287475 - protein, 9 aa, Homo Sapiens
DKLMYNAYE

SEQ ID NO: 287476 - protein, 9 aa, Homo Sapiens
IISNSSSFV

SEQ ID NO: 287477 - protein, 9 aa, Homo Sapiens
EASQYGRFL

SEQ ID NO: 287478 - protein, 9 aa, Homo Sapiens
QVAPIMSPG

SEQ ID NO: 287479 - protein, 9 aa, Homo Sapiens
KDKCENHHD

SEQ ID NO: 287480 - protein, 9 aa, Homo Sapiens
GWAIKETPT

SEQ ID NO: 287481 - protein, 9 aa, Homo Sapiens
VGVLAEIVK

SEQ ID NO: 287482 - protein, 9 aa, Homo Sapiens
GNLEKQMRQ

SEQ ID NO: 287483 - protein, 9 aa, Homo Sapiens
RECKLPKID

SEQ ID NO: 287484 - protein, 9 aa, Homo Sapiens
YILPALLHK

SEQ ID NO: 287485 - protein, 9 aa, Homo Sapiens
PGGTQPHSC

SEQ ID NO: 287486 - protein, 9 aa, Homo Sapiens
PENHFVIDI

SEQ ID NO: 287487 - protein, 9 aa, Homo Sapiens
KMLQENCEG

SEQ ID NO: 287488 - protein, 9 aa, Homo Sapiens
YIALVWIIF

SEQ ID NO: 287489 - protein, 9 aa, Homo Sapiens
TIVNLLKPN

SEQ ID NO: 287490 - protein, 9 aa, Homo Sapiens
HHTTSTSKP

SEQ ID NO: 287491 - protein, 9 aa, Homo Sapiens
CDKCGKAFN

SEQ ID NO: 287492 - protein, 9 aa, Homo Sapiens
GVVLSESMN

SEQ ID NO: 287493 - protein, 9 aa, Homo Sapiens
MAPVPMPSE

SEQ ID NO: 287494 - protein, 9 aa, Homo Sapiens
DLYHAMAGN

SEQ ID NO: 287495 - protein, 9 aa, Homo Sapiens
ENEEYWDFY

SEQ ID NO: 287496 - protein, 9 aa, Homo Sapiens
KPNIKMSSD

SEQ ID NO: 287497 - protein, 9 aa, Homo Sapiens
KAKQRPKDL

SEQ ID NO: 287498 - protein, 9 aa, Homo Sapiens
TLEASSRHV

SEQ ID NO: 287499 - protein, 9 aa, Homo Sapiens
GFIDHTVLD

SEQ ID NO: 287500 - protein, 9 aa, Homo Sapiens
FYSAKSFQI

SEQ ID NO: 287501 - protein, 9 aa, Homo Sapiens
VRISPTVTT

SEQ ID NO: 287502 - protein, 9 aa, Homo Sapiens
TSETGSYNG

SEQ ID NO: 287503 - protein, 9 aa, Homo Sapiens
WKSKEMQVR

SEQ ID NO: 287504 - protein, 9 aa, Homo Sapiens
KMIQLPSNN

SEQ ID NO: 287505 - protein, 9 aa, Homo Sapiens
WNSEPENRP

SEQ ID NO: 287506 - protein, 9 aa, Homo Sapiens
IISSDSPPS

SEQ ID NO: 287507 - protein, 9 aa, Homo Sapiens
TVQIPEGRA

SEQ ID NO: 287508 - protein, 9 aa, Homo Sapiens
TSAGKEYIL

SEQ ID NO: 287509 - protein, 9 aa, Homo Sapiens
QMLTYYPSE

SEQ ID NO: 287510 - protein, 9 aa, Homo Sapiens
YKDAPGTLV

SEQ ID NO: 287511 - protein, 9 aa, Homo Sapiens
ISVETEGNK

SEQ ID NO: 287512 - protein, 9 aa, Homo Sapiens
AMQCLETVF

SEQ ID NO: 287513 - protein, 9 aa, Homo Sapiens
PVNGGINTL

SEQ ID NO: 287514 - protein, 9 aa, Homo Sapiens
YLSSSCKGM

SEQ ID NO: 287515 - protein, 9 aa, Homo Sapiens
KLKPPPEAL

SEQ ID NO: 287516 - protein, 9 aa, Homo Sapiens
TFRAVDSSA

SEQ ID NO: 287517 - protein, 9 aa, Homo Sapiens
EFYLSLTQY

SEQ ID NO: 287518 - protein, 9 aa, Homo Sapiens
TSDEMYKQV

SEQ ID NO: 287519 - protein, 9 aa, Homo Sapiens
NVLVLPVSL

SEQ ID NO: 287520 - protein, 9 aa, Homo Sapiens
EFDKGFKVP

SEQ ID NO: 287521 - protein, 9 aa, Homo Sapiens
TCPYSPAGR

SEQ ID NO: 287522 - protein, 9 aa, Homo Sapiens
SKDVAREWK

SEQ ID NO: 287523 - protein, 9 aa, Homo Sapiens
CDVGYPALQ

SEQ ID NO: 287524 - protein, 9 aa, Homo Sapiens
GEFLCYVNG

SEQ ID NO: 287525 - protein, 9 aa, Homo Sapiens
GESGDLLSD

SEQ ID NO: 287526 - protein, 9 aa, Homo Sapiens
IIDGLSEQG

SEQ ID NO: 287527 - protein, 9 aa, Homo Sapiens
ADTLLQQDF

SEQ ID NO: 287528 - protein, 9 aa, Homo Sapiens
KPPYNSKAE

SEQ ID NO: 287529 - protein, 9 aa, Homo Sapiens
FPAPGKPGH

SEQ ID NO: 287530 - protein, 9 aa, Homo Sapiens
AVWENNMKM

SEQ ID NO: 287531 - protein, 9 aa, Homo Sapiens
ANKTPHNWS

SEQ ID NO: 287532 - protein, 9 aa, Homo Sapiens
ITCVQPLGS

SEQ ID NO: 287533 - protein, 9 aa, Homo Sapiens
SRTAYFSES

SEQ ID NO: 287534 - protein, 9 aa, Homo Sapiens
TENYHNYSY

SEQ ID NO: 287535 - protein, 9 aa, Homo Sapiens
ETVTYRNVK

SEQ ID NO: 287536 - protein, 9 aa, Homo Sapiens
RHDTAFVEF

SEQ ID NO: 287537 - protein, 9 aa, Homo Sapiens
NENFLSVRG

SEQ ID NO: 287538 - protein, 9 aa, Homo Sapiens
APPSLPTIP

SEQ ID NO: 287539 - protein, 9 aa, Homo Sapiens
GPQKQKLSL

SEQ ID NO: 287540 - protein, 9 aa, Homo Sapiens
QAPLEIVLK

SEQ ID NO: 287541 - protein, 9 aa, Homo Sapiens
PSASIREEP

SEQ ID NO: 287542 - protein, 9 aa, Homo Sapiens
PPANPSILS

SEQ ID NO: 287543 - protein, 9 aa, Homo Sapiens
HKIIHTERE

SEQ ID NO: 287544 - protein, 9 aa, Homo Sapiens
HFRTLNGKD

SEQ ID NO: 287545 - protein, 9 aa, Homo Sapiens
IFFVMGITS

SEQ ID NO: 287546 - protein, 9 aa, Homo Sapiens
MITKIWWVH

SEQ ID NO: 287547 - protein, 9 aa, Homo Sapiens
TFRCGETRL

SEQ ID NO: 287548 - protein, 9 aa, Homo Sapiens
LTGKFTAAT

SEQ ID NO: 287549 - protein, 9 aa, Homo Sapiens
YEQGGGLEN

SEQ ID NO: 287550 - protein, 9 aa, Homo Sapiens
DAEFDKGFK

SEQ ID NO: 287551 - protein, 9 aa, Homo Sapiens
KGKPEKFKR

SEQ ID NO: 287552 - protein, 9 aa, Homo Sapiens
RGHTYIKFF

SEQ ID NO: 287553 - protein, 9 aa, Homo Sapiens
LIPPTARLT

SEQ ID NO: 287554 - protein, 9 aa, Homo Sapiens
PVEPNNHHH

SEQ ID NO: 287555 - protein, 9 aa, Homo Sapiens
DTESHLFLT

SEQ ID NO: 287556 - protein, 9 aa, Homo Sapiens
VKGDKKKRD

SEQ ID NO: 287557 - protein, 9 aa, Homo Sapiens
CQKIQRELM

SEQ ID NO: 287558 - protein, 9 aa, Homo Sapiens
HADKQDCRS

SEQ ID NO: 287559 - protein, 9 aa, Homo Sapiens
ASPEQNKNH

SEQ ID NO: 287560 - protein, 9 aa, Homo Sapiens
ARSVCGKQI

SEQ ID NO: 287561 - protein, 9 aa, Homo Sapiens
GKRGSDSII

SEQ ID NO: 287562 - protein, 9 aa, Homo Sapiens
TQSEKSKRD

SEQ ID NO: 287563 - protein, 9 aa, Homo Sapiens
EFQRKYEET

SEQ ID NO: 287564 - protein, 9 aa, Homo Sapiens
RNLSVSSSV

SEQ ID NO: 287565 - protein, 9 aa, Homo Sapiens
CIPPEGRRG

SEQ ID NO: 287566 - protein, 9 aa, Homo Sapiens
TSPVKLKNF

SEQ ID NO: 287567 - protein, 9 aa, Homo Sapiens
PRTLEGCIS

SEQ ID NO: 287568 - protein, 9 aa, Homo Sapiens
AIRSRLINT

SEQ ID NO: 287569 - protein, 9 aa, Homo Sapiens
QPPPDNKIN

SEQ ID NO: 287570 - protein, 9 aa, Homo Sapiens
SEFVILGFS

SEQ ID NO: 287571 - protein, 9 aa, Homo Sapiens
KKLKSIACP

SEQ ID NO: 287572 - protein, 9 aa, Homo Sapiens
KLCLNWIIN

SEQ ID NO: 287573 - protein, 9 aa, Homo Sapiens
VEDVLQRCQ

SEQ ID NO: 287574 - protein, 9 aa, Homo Sapiens
ASAIPMVSV

SEQ ID NO: 287575 - protein, 9 aa, Homo Sapiens
THRRRRLVQ

SEQ ID NO: 287576 - protein, 9 aa, Homo Sapiens
PCTIITSLD

SEQ ID NO: 287577 - protein, 9 aa, Homo Sapiens
RLKLQLLEH

SEQ ID NO: 287578 - protein, 9 aa, Homo Sapiens
RVNINLSFS

SEQ ID NO: 287579 - protein, 9 aa, Homo Sapiens
EDLNNDKKS

SEQ ID NO: 287580 - protein, 9 aa, Homo Sapiens
DVEDIITYR

SEQ ID NO: 287581 - protein, 9 aa, Homo Sapiens
LSAPGTPGT

SEQ ID NO: 287582 - protein, 9 aa, Homo Sapiens
DISPELFMQ

SEQ ID NO: 287583 - protein, 9 aa, Homo Sapiens
RIASSLDSL

SEQ ID NO: 287584 - protein, 9 aa, Homo Sapiens
DLAIATYPK

SEQ ID NO: 287585 - protein, 9 aa, Homo Sapiens
KTLKRLSTL

SEQ ID NO: 287586 - protein, 9 aa, Homo Sapiens
LESSREQEY

SEQ ID NO: 287587 - protein, 9 aa, Homo Sapiens
KSKEMQVRQ

SEQ ID NO: 287588 - protein, 9 aa, Homo Sapiens
FHVSPDVML

SEQ ID NO: 287589 - protein, 9 aa, Homo Sapiens
PHRIRLHGI

SEQ ID NO: 287590 - protein, 9 aa, Homo Sapiens
RPGYGMLSI

SEQ ID NO: 287591 - protein, 9 aa, Homo Sapiens
DTEKNIPKY

SEQ ID NO: 287592 - protein, 9 aa, Homo Sapiens
GLEVDSVEL

SEQ ID NO: 287593 - protein, 9 aa, Homo Sapiens
PDSTGGPVP

SEQ ID NO: 287594 - protein, 9 aa, Homo Sapiens
FTYINSMLD

SEQ ID NO: 287595 - protein, 9 aa, Homo Sapiens
MMFKVMEPT

SEQ ID NO: 287596 - protein, 9 aa, Homo Sapiens
ERSAQKENT

SEQ ID NO: 287597 - protein, 9 aa, Homo Sapiens
CRNVSVRGI

SEQ ID NO: 287598 - protein, 9 aa, Homo Sapiens
STHRYLALP

SEQ ID NO: 287599 - protein, 9 aa, Homo Sapiens
GERPYKCNG

SEQ ID NO: 287600 - protein, 9 aa, Homo Sapiens
RLALLITYL

SEQ ID NO: 287601 - protein, 9 aa, Homo Sapiens
NDYLYEIIT

SEQ ID NO: 287602 - protein, 9 aa, Homo Sapiens
SDNKFGAAC

SEQ ID NO: 287603 - protein, 9 aa, Homo Sapiens
CSNNVERKK

SEQ ID NO: 287604 - protein, 9 aa, Homo Sapiens
VKIGIPLFH

SEQ ID NO: 287605 - protein, 9 aa, Homo Sapiens
TRNIDNVET

SEQ ID NO: 287606 - protein, 9 aa, Homo Sapiens
VMLQGVDLL

SEQ ID NO: 287607 - protein, 9 aa, Homo Sapiens
DLCLRVAIC

SEQ ID NO: 287608 - protein, 9 aa, Homo Sapiens
WRPANVPID

SEQ ID NO: 287609 - protein, 9 aa, Homo Sapiens
SLYPEKTQM

SEQ ID NO: 287610 - protein, 9 aa, Homo Sapiens
IHFQSDISF

SEQ ID NO: 287611 - protein, 9 aa, Homo Sapiens
PKRFCRSPC

SEQ ID NO: 287612 - protein, 9 aa, Homo Sapiens
DPAIPMPPI

SEQ ID NO: 287613 - protein, 9 aa, Homo Sapiens
TNMAQTNPT

SEQ ID NO: 287614 - protein, 9 aa, Homo Sapiens
PRRDDHGGR

SEQ ID NO: 287615 - protein, 9 aa, Homo Sapiens
TFTDKWNTD

SEQ ID NO: 287616 - protein, 9 aa, Homo Sapiens
ARPNQTLSA

SEQ ID NO: 287617 - protein, 9 aa, Homo Sapiens
SERYNGSVL

SEQ ID NO: 287618 - protein, 9 aa, Homo Sapiens
LCILLYPDL

SEQ ID NO: 287619 - protein, 9 aa, Homo Sapiens
NQNILIQVE

SEQ ID NO: 287620 - protein, 9 aa, Homo Sapiens
KGLSPFRKQ

SEQ ID NO: 287621 - protein, 9 aa, Homo Sapiens
HFNVLVLPV

SEQ ID NO: 287622 - protein, 9 aa, Homo Sapiens
HRFSGRPKL

SEQ ID NO: 287623 - protein, 9 aa, Homo Sapiens
KSNEMITNV

SEQ ID NO: 287624 - protein, 9 aa, Homo Sapiens
VLTTTSPST

SEQ ID NO: 287625 - protein, 9 aa, Homo Sapiens
SIHHNLSLH

SEQ ID NO: 287626 - protein, 9 aa, Homo Sapiens
IQAREQRIR

SEQ ID NO: 287627 - protein, 9 aa, Homo Sapiens
LKEKGIPFN

SEQ ID NO: 287628 - protein, 9 aa, Homo Sapiens
VTTNNPARA

SEQ ID NO: 287629 - protein, 9 aa, Homo Sapiens
CQEVKTLVG

SEQ ID NO: 287630 - protein, 9 aa, Homo Sapiens
FQRPSEKNQ

SEQ ID NO: 287631 - protein, 9 aa, Homo Sapiens
PLPHVTHAF

SEQ ID NO: 287632 - protein, 9 aa, Homo Sapiens
ASAPTVALN

SEQ ID NO: 287633 - protein, 9 aa, Homo Sapiens
DSDYINATF

SEQ ID NO: 287634 - protein, 9 aa, Homo Sapiens
HTLWVESDN

SEQ ID NO: 287635 - protein, 9 aa, Homo Sapiens
IVCAAYAHK

SEQ ID NO: 287636 - protein, 9 aa, Homo Sapiens
RDGVRSLIQ

SEQ ID NO: 287637 - protein, 9 aa, Homo Sapiens
YKFHLIAPS

SEQ ID NO: 287638 - protein, 9 aa, Homo Sapiens
QINQMFEEL

SEQ ID NO: 287639 - protein, 9 aa, Homo Sapiens
YMELPFRND

SEQ ID NO: 287640 - protein, 9 aa, Homo Sapiens
YKMLVGDTP

SEQ ID NO: 287641 - protein, 9 aa, Homo Sapiens
SRVENDYND

SEQ ID NO: 287642 - protein, 9 aa, Homo Sapiens
KTEAKNEAK

SEQ ID NO: 287643 - protein, 9 aa, Homo Sapiens
VVMDKFGFS

SEQ ID NO: 287644 - protein, 9 aa, Homo Sapiens
NLEAVKSKL

SEQ ID NO: 287645 - protein, 9 aa, Homo Sapiens
FITVKYQIH

SEQ ID NO: 287646 - protein, 9 aa, Homo Sapiens
IPVTNASTF

SEQ ID NO: 287647 - protein, 9 aa, Homo Sapiens
SEMFKYEFS

SEQ ID NO: 287648 - protein, 9 aa, Homo Sapiens
SSEGVFKRK

SEQ ID NO: 287649 - protein, 9 aa, Homo Sapiens
SYESGVKYH

SEQ ID NO: 287650 - protein, 9 aa, Homo Sapiens
QASLSFQDV

SEQ ID NO: 287651 - protein, 9 aa, Homo Sapiens
GGATLFTLD

SEQ ID NO: 287652 - protein, 9 aa, Homo Sapiens
NNDKKSALQ

SEQ ID NO: 287653 - protein, 9 aa, Homo Sapiens
PNNKPFTSH

SEQ ID NO: 287654 - protein, 9 aa, Homo Sapiens
QSRVGCLEQ

SEQ ID NO: 287655 - protein, 9 aa, Homo Sapiens
RFAPSSAQH

SEQ ID NO: 287656 - protein, 9 aa, Homo Sapiens
NKLLQIIGK

SEQ ID NO: 287657 - protein, 9 aa, Homo Sapiens
HVYQNIKYR

SEQ ID NO: 287658 - protein, 9 aa, Homo Sapiens
MLVMLHFDL

SEQ ID NO: 287659 - protein, 9 aa, Homo Sapiens
CKLQKYYNG

SEQ ID NO: 287660 - protein, 9 aa, Homo Sapiens
SILLEMKAN

SEQ ID NO: 287661 - protein, 9 aa, Homo Sapiens
AGYLNGKVD

SEQ ID NO: 287662 - protein, 9 aa, Homo Sapiens
NPCIKHYHV

SEQ ID NO: 287663 - protein, 9 aa, Homo Sapiens
WMPGQFAPD

SEQ ID NO: 287664 - protein, 9 aa, Homo Sapiens
VKMVQGDYR

SEQ ID NO: 287665 - protein, 9 aa, Homo Sapiens
QIPNKPDVT

SEQ ID NO: 287666 - protein, 9 aa, Homo Sapiens
DAHKINYGA

SEQ ID NO: 287667 - protein, 9 aa, Homo Sapiens
RVRRRRMEM

SEQ ID NO: 287668 - protein, 9 aa, Homo Sapiens
GSHTIDFFE

SEQ ID NO: 287669 - protein, 9 aa, Homo Sapiens
KVIASRQYT

SEQ ID NO: 287670 - protein, 9 aa, Homo Sapiens
FQWLGGLAP

SEQ ID NO: 287671 - protein, 9 aa, Homo Sapiens
IITVTTDGS

SEQ ID NO: 287672 - protein, 9 aa, Homo Sapiens
ITSWPKANP

SEQ ID NO: 287673 - protein, 9 aa, Homo Sapiens
TRKWSKMNL

SEQ ID NO: 287674 - protein, 9 aa, Homo Sapiens
ELTVTYATP

SEQ ID NO: 287675 - protein, 9 aa, Homo Sapiens
MCWECCEYD

SEQ ID NO: 287676 - protein, 9 aa, Homo Sapiens
RQLALNTPG

SEQ ID NO: 287677 - protein, 9 aa, Homo Sapiens
FYVPGILSF

SEQ ID NO: 287678 - protein, 9 aa, Homo Sapiens
EYQDTTYIH

SEQ ID NO: 287679 - protein, 9 aa, Homo Sapiens
REAVRSEAE

SEQ ID NO: 287680 - protein, 9 aa, Homo Sapiens
AVTRPELLL

SEQ ID NO: 287681 - protein, 9 aa, Homo Sapiens
EHVTGENFF

SEQ ID NO: 287682 - protein, 9 aa, Homo Sapiens
YTSNRMWKL

SEQ ID NO: 287683 - protein, 9 aa, Homo Sapiens
QGRYEITAE

SEQ ID NO: 287684 - protein, 9 aa, Homo Sapiens
GPGIPGMNM

SEQ ID NO: 287685 - protein, 9 aa, Homo Sapiens
CIQESEEKE

SEQ ID NO: 287686 - protein, 9 aa, Homo Sapiens
EQLDPKPHV

SEQ ID NO: 287687 - protein, 9 aa, Homo Sapiens
HLGAADRWF

SEQ ID NO: 287688 - protein, 9 aa, Homo Sapiens
SLTIYHVSD

SEQ ID NO: 287689 - protein, 9 aa, Homo Sapiens
YHIFYQIIS

SEQ ID NO: 287690 - protein, 9 aa, Homo Sapiens
HIFITMFAT

SEQ ID NO: 287691 - protein, 9 aa, Homo Sapiens
VADIFDCLG

SEQ ID NO: 287692 - protein, 9 aa, Homo Sapiens
TTLFNNMTS

SEQ ID NO: 287693 - protein, 9 aa, Homo Sapiens
WNLLETSSK

SEQ ID NO: 287694 - protein, 9 aa, Homo Sapiens
KAFRYLSSL

SEQ ID NO: 287695 - protein, 9 aa, Homo Sapiens
QVVKYAVLD

SEQ ID NO: 287696 - protein, 9 aa, Homo Sapiens
RNAQFSTLI

SEQ ID NO: 287697 - protein, 9 aa, Homo Sapiens
QYLENLDKL

SEQ ID NO: 287698 - protein, 9 aa, Homo Sapiens
VCCENDIDI

SEQ ID NO: 287699 - protein, 9 aa, Homo Sapiens
GGAYGSQIM

SEQ ID NO: 287700 - protein, 9 aa, Homo Sapiens
TLCHFGFEV

SEQ ID NO: 287701 - protein, 9 aa, Homo Sapiens
NSAMIPFIL

SEQ ID NO: 287702 - protein, 9 aa, Homo Sapiens
DNSNVYMVM

SEQ ID NO: 287703 - protein, 9 aa, Homo Sapiens
TGGSVYKNA

SEQ ID NO: 287704 - protein, 9 aa, Homo Sapiens
AYYHSRVKL

SEQ ID NO: 287705 - protein, 9 aa, Homo Sapiens
IAPNINRIN

SEQ ID NO: 287706 - protein, 9 aa, Homo Sapiens
ARRFILNIL

SEQ ID NO: 287707 - protein, 9 aa, Homo Sapiens
QGIGWHLDE

SEQ ID NO: 287708 - protein, 9 aa, Homo Sapiens
QNTSRKENF

SEQ ID NO: 287709 - protein, 9 aa, Homo Sapiens
QILPRGPDF

SEQ ID NO: 287710 - protein, 9 aa, Homo Sapiens
PGGVQVTTI

SEQ ID NO: 287711 - protein, 9 aa, Homo Sapiens
LQINITDVA

SEQ ID NO: 287712 - protein, 9 aa, Homo Sapiens
GSLLKGRVA

SEQ ID NO: 287713 - protein, 9 aa, Homo Sapiens
MYVLAHSNL

SEQ ID NO: 287714 - protein, 9 aa, Homo Sapiens
NSGEKPYGC

SEQ ID NO: 287715 - protein, 9 aa, Homo Sapiens
CTYLDKSTE

SEQ ID NO: 287716 - protein, 9 aa, Homo Sapiens
SPYGSQPHS

SEQ ID NO: 287717 - protein, 9 aa, Homo Sapiens
ELIKGTLVF

SEQ ID NO: 287718 - protein, 9 aa, Homo Sapiens
LMIVLLSYL

SEQ ID NO: 287719 - protein, 9 aa, Homo Sapiens
PFVDPLFQI

SEQ ID NO: 287720 - protein, 9 aa, Homo Sapiens
TSFTHICAG

SEQ ID NO: 287721 - protein, 9 aa, Homo Sapiens
CPEDEFLRN

SEQ ID NO: 287722 - protein, 9 aa, Homo Sapiens
LEGGLAWIT

SEQ ID NO: 287723 - protein, 9 aa, Homo Sapiens
CLGVTAQQF

SEQ ID NO: 287724 - protein, 9 aa, Homo Sapiens
ATTSFQYPS

SEQ ID NO: 287725 - protein, 9 aa, Homo Sapiens
QRFEFETTP

SEQ ID NO: 287726 - protein, 9 aa, Homo Sapiens
RRYGQKNKK

SEQ ID NO: 287727 - protein, 9 aa, Homo Sapiens
TLQANEIMW

SEQ ID NO: 287728 - protein, 9 aa, Homo Sapiens
SGVSIFCPP

SEQ ID NO: 287729 - protein, 9 aa, Homo Sapiens
EPPNTFTFD

SEQ ID NO: 287730 - protein, 9 aa, Homo Sapiens
IGKLHSDQD

SEQ ID NO: 287731 - protein, 9 aa, Homo Sapiens
VQTAPKKNK

SEQ ID NO: 287732 - protein, 9 aa, Homo Sapiens
LSDMFYFCR

SEQ ID NO: 287733 - protein, 9 aa, Homo Sapiens
AQNFLSSFT

SEQ ID NO: 287734 - protein, 9 aa, Homo Sapiens
LDKSLQKER

SEQ ID NO: 287735 - protein, 9 aa, Homo Sapiens
QMDIIFHSS

SEQ ID NO: 287736 - protein, 9 aa, Homo Sapiens
IHEMKQSNS

SEQ ID NO: 287737 - protein, 9 aa, Homo Sapiens
DKIIHTGEK

SEQ ID NO: 287738 - protein, 9 aa, Homo Sapiens
ISVVMDKFG

SEQ ID NO: 287739 - protein, 9 aa, Homo Sapiens
GCLDWDENT

SEQ ID NO: 287740 - protein, 9 aa, Homo Sapiens
TSKKTLLQT

SEQ ID NO: 287741 - protein, 9 aa, Homo Sapiens
TEEKESDFE

SEQ ID NO: 287742 - protein, 9 aa, Homo Sapiens
CQEKYQLQV

SEQ ID NO: 287743 - protein, 9 aa, Homo Sapiens
KNALRGLCS

SEQ ID NO: 287744 - protein, 9 aa, Homo Sapiens
LYFADYELA

SEQ ID NO: 287745 - protein, 9 aa, Homo Sapiens
HQEVWGKMM

SEQ ID NO: 287746 - protein, 9 aa, Homo Sapiens
LHIPYCQPR

SEQ ID NO: 287747 - protein, 9 aa, Homo Sapiens
KITLPEPCH

SEQ ID NO: 287748 - protein, 9 aa, Homo Sapiens
AMGKNYGNG

SEQ ID NO: 287749 - protein, 9 aa, Homo Sapiens
PSSGQIISD

SEQ ID NO: 287750 - protein, 9 aa, Homo Sapiens
GKTLGKQHC

SEQ ID NO: 287751 - protein, 9 aa, Homo Sapiens
YDRVVHQRT

SEQ ID NO: 287752 - protein, 9 aa, Homo Sapiens
ALLFLMDVL

SEQ ID NO: 287753 - protein, 9 aa, Homo Sapiens
MNSSPVYRI

SEQ ID NO: 287754 - protein, 9 aa, Homo Sapiens
NTKKNSSEG

SEQ ID NO: 287755 - protein, 9 aa, Homo Sapiens
CEQKLLCGQ

SEQ ID NO: 287756 - protein, 9 aa, Homo Sapiens
RITVFGLGI

SEQ ID NO: 287757 - protein, 9 aa, Homo Sapiens
YFDFKDTDM

SEQ ID NO: 287758 - protein, 9 aa, Homo Sapiens
YPERVGDKD

SEQ ID NO: 287759 - protein, 9 aa, Homo Sapiens
ADSLDHSCT

SEQ ID NO: 287760 - protein, 9 aa, Homo Sapiens
FRFLVIEAS

SEQ ID NO: 287761 - protein, 9 aa, Homo Sapiens
ELPYSDDEK

SEQ ID NO: 287762 - protein, 9 aa, Homo Sapiens
KLRRTTNRM

SEQ ID NO: 287763 - protein, 9 aa, Homo Sapiens
ASPRICPHL

SEQ ID NO: 287764 - protein, 9 aa, Homo Sapiens
GSVHHNYRG

SEQ ID NO: 287765 - protein, 9 aa, Homo Sapiens
KFRKTRYSL

SEQ ID NO: 287766 - protein, 9 aa, Homo Sapiens
DVKVKTERD

SEQ ID NO: 287767 - protein, 9 aa, Homo Sapiens
CDAFPPLRE

SEQ ID NO: 287768 - protein, 9 aa, Homo Sapiens
IHFINEREK

SEQ ID NO: 287769 - protein, 9 aa, Homo Sapiens
KMYRLRTQD

SEQ ID NO: 287770 - protein, 9 aa, Homo Sapiens
PRYVKAVYQ

SEQ ID NO: 287771 - protein, 9 aa, Homo Sapiens
DLVEDYKNR

SEQ ID NO: 287772 - protein, 9 aa, Homo Sapiens
LTLVGTQDR

SEQ ID NO: 287773 - protein, 9 aa, Homo Sapiens
LLCYICLSI

SEQ ID NO: 287774 - protein, 9 aa, Homo Sapiens
SIDGMEIPG

SEQ ID NO: 287775 - protein, 9 aa, Homo Sapiens
YCQNVQDFK

SEQ ID NO: 287776 - protein, 9 aa, Homo Sapiens
PNAQSSQVG

SEQ ID NO: 287777 - protein, 9 aa, Homo Sapiens
TKKRREITD

SEQ ID NO: 287778 - protein, 9 aa, Homo Sapiens
NYAVAVGSL

SEQ ID NO: 287779 - protein, 9 aa, Homo Sapiens
VKRYTGEFD

SEQ ID NO: 287780 - protein, 9 aa, Homo Sapiens
QGSVTLKDV

SEQ ID NO: 287781 - protein, 9 aa, Homo Sapiens
NILPGNMKD

SEQ ID NO: 287782 - protein, 9 aa, Homo Sapiens
INRINEIQR

SEQ ID NO: 287783 - protein, 9 aa, Homo Sapiens
EKAIKFVLS

SEQ ID NO: 287784 - protein, 9 aa, Homo Sapiens
DLRACKESR

SEQ ID NO: 287785 - protein, 9 aa, Homo Sapiens
TDTYKTIKQ

SEQ ID NO: 287786 - protein, 9 aa, Homo Sapiens
GTAARQDAA

SEQ ID NO: 287787 - protein, 9 aa, Homo Sapiens
TNKNENYKA

SEQ ID NO: 287788 - protein, 9 aa, Homo Sapiens
WHDNVFTSV

SEQ ID NO: 287789 - protein, 9 aa, Homo Sapiens
GLWRALEQL

SEQ ID NO: 287790 - protein, 9 aa, Homo Sapiens
KACCHPPEV

SEQ ID NO: 287791 - protein, 9 aa, Homo Sapiens
ALDDGEFWT

SEQ ID NO: 287792 - protein, 9 aa, Homo Sapiens
LSRPGTRTG

SEQ ID NO: 287793 - protein, 9 aa, Homo Sapiens
IANYVVRFI

SEQ ID NO: 287794 - protein, 9 aa, Homo Sapiens
EEEGAGGLH

SEQ ID NO: 287795 - protein, 9 aa, Homo Sapiens
HIASQKNVK

SEQ ID NO: 287796 - protein, 9 aa, Homo Sapiens
ASLSQTCCT

SEQ ID NO: 287797 - protein, 9 aa, Homo Sapiens
FLYSVLIAK

SEQ ID NO: 287798 - protein, 9 aa, Homo Sapiens
TFSSTQSRM

SEQ ID NO: 287799 - protein, 9 aa, Homo Sapiens
AISLFFLQS

SEQ ID NO: 287800 - protein, 9 aa, Homo Sapiens
HPKYIYATD

SEQ ID NO: 287801 - protein, 9 aa, Homo Sapiens
ERVLQRSVK

SEQ ID NO: 287802 - protein, 9 aa, Homo Sapiens
KYFYRGCLD

SEQ ID NO: 287803 - protein, 9 aa, Homo Sapiens
NVWPVKIIG

SEQ ID NO: 287804 - protein, 9 aa, Homo Sapiens
GIIESLITK

SEQ ID NO: 287805 - protein, 9 aa, Homo Sapiens
KNGIWEVMP

SEQ ID NO: 287806 - protein, 9 aa, Homo Sapiens
FSPWDPRTV

SEQ ID NO: 287807 - protein, 9 aa, Homo Sapiens
VPEYPGKPG

SEQ ID NO: 287808 - protein, 9 aa, Homo Sapiens
NLIKHKRIY

SEQ ID NO: 287809 - protein, 9 aa, Homo Sapiens
TYTTSSEQM

SEQ ID NO: 287810 - protein, 9 aa, Homo Sapiens
GDKDKASET

SEQ ID NO: 287811 - protein, 9 aa, Homo Sapiens
RTGMLTVVN

SEQ ID NO: 287812 - protein, 9 aa, Homo Sapiens
YADKLAALL

SEQ ID NO: 287813 - protein, 9 aa, Homo Sapiens
PLENQFKKM

SEQ ID NO: 287814 - protein, 9 aa, Homo Sapiens
VTVADNREF

SEQ ID NO: 287815 - protein, 9 aa, Homo Sapiens
CPLQRLLDR

SEQ ID NO: 287816 - protein, 9 aa, Homo Sapiens
VDYLLEKDN

SEQ ID NO: 287817 - protein, 9 aa, Homo Sapiens
FTITVRPRN

SEQ ID NO: 287818 - protein, 9 aa, Homo Sapiens
SASSKRMLP

SEQ ID NO: 287819 - protein, 9 aa, Homo Sapiens
RMNNKLWYF

SEQ ID NO: 287820 - protein, 9 aa, Homo Sapiens
DVEFYLSLT

SEQ ID NO: 287821 - protein, 9 aa, Homo Sapiens
GKRLNIHLK

SEQ ID NO: 287822 - protein, 9 aa, Homo Sapiens
NYQIKIDAH

SEQ ID NO: 287823 - protein, 9 aa, Homo Sapiens
THHLEPYFE

SEQ ID NO: 287824 - protein, 9 aa, Homo Sapiens
SIGKWRFRI

SEQ ID NO: 287825 - protein, 9 aa, Homo Sapiens
KLGLTSDDE

SEQ ID NO: 287826 - protein, 9 aa, Homo Sapiens
RPRQSCPGD

SEQ ID NO: 287827 - protein, 9 aa, Homo Sapiens
KSRTRYPEK

SEQ ID NO: 287828 - protein, 9 aa, Homo Sapiens
HFSLGFVAR

SEQ ID NO: 287829 - protein, 9 aa, Homo Sapiens
KAHVKRPAL

SEQ ID NO: 287830 - protein, 9 aa, Homo Sapiens
CHVDAHATL

SEQ ID NO: 287831 - protein, 9 aa, Homo Sapiens
PTGTAVSTI

SEQ ID NO: 287832 - protein, 9 aa, Homo Sapiens
IIPAHPTLL

SEQ ID NO: 287833 - protein, 9 aa, Homo Sapiens
GVYCIPIGH

SEQ ID NO: 287834 - protein, 9 aa, Homo Sapiens
FKMFIGSAN

SEQ ID NO: 287835 - protein, 9 aa, Homo Sapiens
SRTLFFQRF

SEQ ID NO: 287836 - protein, 9 aa, Homo Sapiens
TPVRRHMVK

SEQ ID NO: 287837 - protein, 9 aa, Homo Sapiens
STFQQALKD

SEQ ID NO: 287838 - protein, 9 aa, Homo Sapiens
GSPVRDMDD

SEQ ID NO: 287839 - protein, 9 aa, Homo Sapiens
FVDPLFQIQ

SEQ ID NO: 287840 - protein, 9 aa, Homo Sapiens
LYSHILDYY

SEQ ID NO: 287841 - protein, 9 aa, Homo Sapiens
IFFLALVVF

SEQ ID NO: 287842 - protein, 9 aa, Homo Sapiens
PQPELFGDL

SEQ ID NO: 287843 - protein, 9 aa, Homo Sapiens
SKLNYKFWK

SEQ ID NO: 287844 - protein, 9 aa, Homo Sapiens
VLDRICKLA

SEQ ID NO: 287845 - protein, 9 aa, Homo Sapiens
KGIPFNRIT

SEQ ID NO: 287846 - protein, 9 aa, Homo Sapiens
ARSKKLDHF

SEQ ID NO: 287847 - protein, 9 aa, Homo Sapiens
EEGDADEKR

SEQ ID NO: 287848 - protein, 9 aa, Homo Sapiens
SVTPGEKMV

SEQ ID NO: 287849 - protein, 9 aa, Homo Sapiens
GKVVQEDGC

SEQ ID NO: 287850 - protein, 9 aa, Homo Sapiens
PVFITASED

SEQ ID NO: 287851 - protein, 9 aa, Homo Sapiens
SKLVSGNLS

SEQ ID NO: 287852 - protein, 9 aa, Homo Sapiens
RHCRIHTGE

SEQ ID NO: 287853 - protein, 9 aa, Homo Sapiens
SSRVQPELY

SEQ ID NO: 287854 - protein, 9 aa, Homo Sapiens
HVVSALTVV

SEQ ID NO: 287855 - protein, 9 aa, Homo Sapiens
SKNFEEVVS

SEQ ID NO: 287856 - protein, 9 aa, Homo Sapiens
LDPIQNNLT

SEQ ID NO: 287857 - protein, 9 aa, Homo Sapiens
NNSCSICSE

SEQ ID NO: 287858 - protein, 9 aa, Homo Sapiens
TDTVEVTDG

SEQ ID NO: 287859 - protein, 9 aa, Homo Sapiens
VSGLDSATL

SEQ ID NO: 287860 - protein, 9 aa, Homo Sapiens
PPSYHNKPP

SEQ ID NO: 287861 - protein, 9 aa, Homo Sapiens
APGTPGTQH

SEQ ID NO: 287862 - protein, 9 aa, Homo Sapiens
REWVKIYED

SEQ ID NO: 287863 - protein, 9 aa, Homo Sapiens
SSFTKCEIT

SEQ ID NO: 287864 - protein, 9 aa, Homo Sapiens
DETYLMFWF

SEQ ID NO: 287865 - protein, 9 aa, Homo Sapiens
GGGLRLPFQ

SEQ ID NO: 287866 - protein, 9 aa, Homo Sapiens
LFTLTAYAV

SEQ ID NO: 287867 - protein, 9 aa, Homo Sapiens
NVEDNDYLH

SEQ ID NO: 287868 - protein, 9 aa, Homo Sapiens
TWDVDLILS

SEQ ID NO: 287869 - protein, 9 aa, Homo Sapiens
MRLPGQPGE

SEQ ID NO: 287870 - protein, 9 aa, Homo Sapiens
NSHLIQHQQ

SEQ ID NO: 287871 - protein, 9 aa, Homo Sapiens
ASKPPPVRE

SEQ ID NO: 287872 - protein, 9 aa, Homo Sapiens
LTSSRHLMV

SEQ ID NO: 287873 - protein, 9 aa, Homo Sapiens
LAAFVEVNN

SEQ ID NO: 287874 - protein, 9 aa, Homo Sapiens
TGLFGGYIL

SEQ ID NO: 287875 - protein, 9 aa, Homo Sapiens
SKQYLCVAL

SEQ ID NO: 287876 - protein, 9 aa, Homo Sapiens
APGEHDSQV

SEQ ID NO: 287877 - protein, 9 aa, Homo Sapiens
LGFSLLLLV

SEQ ID NO: 287878 - protein, 9 aa, Homo Sapiens
GHGGKSQNY

SEQ ID NO: 287879 - protein, 9 aa, Homo Sapiens
CPGGFRILP

SEQ ID NO: 287880 - protein, 9 aa, Homo Sapiens
PKFQNVAAL

SEQ ID NO: 287881 - protein, 9 aa, Homo Sapiens
LCQRIVGDC

SEQ ID NO: 287882 - protein, 9 aa, Homo Sapiens
RWAVGGVPL

SEQ ID NO: 287883 - protein, 9 aa, Homo Sapiens
GTAPEICTS

SEQ ID NO: 287884 - protein, 9 aa, Homo Sapiens
KPALRKGHP

SEQ ID NO: 287885 - protein, 9 aa, Homo Sapiens
FSKDVAREW

SEQ ID NO: 287886 - protein, 9 aa, Homo Sapiens
VFTDEELGL

SEQ ID NO: 287887 - protein, 9 aa, Homo Sapiens
SYVRKHEIT

SEQ ID NO: 287888 - protein, 9 aa, Homo Sapiens
PCKRCHPSV

SEQ ID NO: 287889 - protein, 9 aa, Homo Sapiens
QSPQFYNSE

SEQ ID NO: 287890 - protein, 9 aa, Homo Sapiens
EMSSVQKKN

SEQ ID NO: 287891 - protein, 9 aa, Homo Sapiens
EKVKKAENK

SEQ ID NO: 287892 - protein, 9 aa, Homo Sapiens
NRFVVRSQH

SEQ ID NO: 287893 - protein, 9 aa, Homo Sapiens
LSLIIDAAT

SEQ ID NO: 287894 - protein, 9 aa, Homo Sapiens
NASFKGADP

SEQ ID NO: 287895 - protein, 9 aa, Homo Sapiens
DGKARQQWC

SEQ ID NO: 287896 - protein, 9 aa, Homo Sapiens
MEIPGNLNK

SEQ ID NO: 287897 - protein, 9 aa, Homo Sapiens
VTGQLGAGI

SEQ ID NO: 287898 - protein, 9 aa, Homo Sapiens
FRVPVRAFL

SEQ ID NO: 287899 - protein, 9 aa, Homo Sapiens
RNKDVKTAF

SEQ ID NO: 287900 - protein, 9 aa, Homo Sapiens
GRVPVSRSC

SEQ ID NO: 287901 - protein, 9 aa, Homo Sapiens
TENIYKEFY

SEQ ID NO: 287902 - protein, 9 aa, Homo Sapiens
CGKSFGTLG

SEQ ID NO: 287903 - protein, 9 aa, Homo Sapiens
LDMHGEKYK

SEQ ID NO: 287904 - protein, 9 aa, Homo Sapiens
SQLCSGARR

SEQ ID NO: 287905 - protein, 9 aa, Homo Sapiens
VLESEKVPH

SEQ ID NO: 287906 - protein, 9 aa, Homo Sapiens
RAWGLEVDS

SEQ ID NO: 287907 - protein, 9 aa, Homo Sapiens
PFKPINYQL

SEQ ID NO: 287908 - protein, 9 aa, Homo Sapiens
ITNAKRLRR

SEQ ID NO: 287909 - protein, 9 aa, Homo Sapiens
LNSLLRYKG

SEQ ID NO: 287910 - protein, 9 aa, Homo Sapiens
AEVCLNVLR

SEQ ID NO: 287911 - protein, 9 aa, Homo Sapiens
QEKKEIELE

SEQ ID NO: 287912 - protein, 9 aa, Homo Sapiens
GLDSATLLI

SEQ ID NO: 287913 - protein, 9 aa, Homo Sapiens
TKYMTGKED

SEQ ID NO: 287914 - protein, 9 aa, Homo Sapiens
NKKNKIKLF

SEQ ID NO: 287915 - protein, 9 aa, Homo Sapiens
LHDLRQKSP

SEQ ID NO: 287916 - protein, 9 aa, Homo Sapiens
KRTACQSES

SEQ ID NO: 287917 - protein, 9 aa, Homo Sapiens
ANQLAKDFK

SEQ ID NO: 287918 - protein, 9 aa, Homo Sapiens
LDVNYHPPQ

SEQ ID NO: 287919 - protein, 9 aa, Homo Sapiens
ATTKSETKE

SEQ ID NO: 287920 - protein, 9 aa, Homo Sapiens
ESIAVKTRK

SEQ ID NO: 287921 - protein, 9 aa, Homo Sapiens
PTSSRAFHY

SEQ ID NO: 287922 - protein, 9 aa, Homo Sapiens
IPLELQRRV

SEQ ID NO: 287923 - protein, 9 aa, Homo Sapiens
LQRCQEYLI

SEQ ID NO: 287924 - protein, 9 aa, Homo Sapiens
SSLPFIYQT

SEQ ID NO: 287925 - protein, 9 aa, Homo Sapiens
AQVLEYLND

SEQ ID NO: 287926 - protein, 9 aa, Homo Sapiens
LATMDTICT

SEQ ID NO: 287927 - protein, 9 aa, Homo Sapiens
THRYLALPG

SEQ ID NO: 287928 - protein, 9 aa, Homo Sapiens
LACFVAILT

SEQ ID NO: 287929 - protein, 9 aa, Homo Sapiens
ALVDFCCAC

SEQ ID NO: 287930 - protein, 9 aa, Homo Sapiens
YLIQFLSKL

SEQ ID NO: 287931 - protein, 9 aa, Homo Sapiens
TILNLEVKE

SEQ ID NO: 287932 - protein, 9 aa, Homo Sapiens
PGWVTLEGD

SEQ ID NO: 287933 - protein, 9 aa, Homo Sapiens
ICYSTDSDQ

SEQ ID NO: 287934 - protein, 9 aa, Homo Sapiens
GKHYGNNKY

SEQ ID NO: 287935 - protein, 9 aa, Homo Sapiens
VFQLIEEAW

SEQ ID NO: 287936 - protein, 9 aa, Homo Sapiens
NVEDERWRK

SEQ ID NO: 287937 - protein, 9 aa, Homo Sapiens
PFRYKHKMT

SEQ ID NO: 287938 - protein, 9 aa, Homo Sapiens
EVPTMIKLA

SEQ ID NO: 287939 - protein, 9 aa, Homo Sapiens
VVSVHFLDS

SEQ ID NO: 287940 - protein, 9 aa, Homo Sapiens
SEHRKQRRE

SEQ ID NO: 287941 - protein, 9 aa, Homo Sapiens
WTAGSWKFT

SEQ ID NO: 287942 - protein, 9 aa, Homo Sapiens
KKRFKEDLK

SEQ ID NO: 287943 - protein, 9 aa, Homo Sapiens
IQRREVHED

SEQ ID NO: 287944 - protein, 9 aa, Homo Sapiens
QKTSNLIVL

SEQ ID NO: 287945 - protein, 9 aa, Homo Sapiens
DKEEALPCT

SEQ ID NO: 287946 - protein, 9 aa, Homo Sapiens
NIFFSSADG

SEQ ID NO: 287947 - protein, 9 aa, Homo Sapiens
LYDLDIEAS

SEQ ID NO: 287948 - protein, 9 aa, Homo Sapiens
PLPLVPVQV

SEQ ID NO: 287949 - protein, 9 aa, Homo Sapiens
SQKERNRIT

SEQ ID NO: 287950 - protein, 9 aa, Homo Sapiens
DDFLCETKL

SEQ ID NO: 287951 - protein, 9 aa, Homo Sapiens
EVECIKAES

SEQ ID NO: 287952 - protein, 9 aa, Homo Sapiens
CAANTLIED

SEQ ID NO: 287953 - protein, 9 aa, Homo Sapiens
LQNQSQKVD

SEQ ID NO: 287954 - protein, 9 aa, Homo Sapiens
EIQVLRVVQ

SEQ ID NO: 287955 - protein, 9 aa, Homo Sapiens
LQIHECTHT

SEQ ID NO: 287956 - protein, 9 aa, Homo Sapiens
IWRVQKAPL

SEQ ID NO: 287957 - protein, 9 aa, Homo Sapiens
HHKKTFSGA

SEQ ID NO: 287958 - protein, 9 aa, Homo Sapiens
ESPQCTSLA

SEQ ID NO: 287959 - protein, 9 aa, Homo Sapiens
EHLRSWEAL

SEQ ID NO: 287960 - protein, 9 aa, Homo Sapiens
KHRKHFKKP

SEQ ID NO: 287961 - protein, 9 aa, Homo Sapiens
ILFITWCRV

SEQ ID NO: 287962 - protein, 9 aa, Homo Sapiens
TVISDVPVH

SEQ ID NO: 287963 - protein, 9 aa, Homo Sapiens
QACNETIAR

SEQ ID NO: 287964 - protein, 9 aa, Homo Sapiens
NSSTHSSPE

SEQ ID NO: 287965 - protein, 9 aa, Homo Sapiens
YYKMTGDYH

SEQ ID NO: 287966 - protein, 9 aa, Homo Sapiens
NGHRGVQAG

SEQ ID NO: 287967 - protein, 9 aa, Homo Sapiens
RSPSIKQNY

SEQ ID NO: 287968 - protein, 9 aa, Homo Sapiens
SLKQQLLSY

SEQ ID NO: 287969 - protein, 9 aa, Homo Sapiens
LFQLLVLAG

SEQ ID NO: 287970 - protein, 9 aa, Homo Sapiens
IESVKKNND

SEQ ID NO: 287971 - protein, 9 aa, Homo Sapiens
KTKNKGVHS

SEQ ID NO: 287972 - protein, 9 aa, Homo Sapiens
SVIEALKDT

SEQ ID NO: 287973 - protein, 9 aa, Homo Sapiens
VNTTIYVIW

SEQ ID NO: 287974 - protein, 9 aa, Homo Sapiens
ASKLSFQNK

SEQ ID NO: 287975 - protein, 9 aa, Homo Sapiens
HSPGESEEK

SEQ ID NO: 287976 - protein, 9 aa, Homo Sapiens
KDQHVICVT

SEQ ID NO: 287977 - protein, 9 aa, Homo Sapiens
VPTFKQRKG

SEQ ID NO: 287978 - protein, 9 aa, Homo Sapiens
KHIFITMFA

SEQ ID NO: 287979 - protein, 9 aa, Homo Sapiens
VIKDIKPLT

SEQ ID NO: 287980 - protein, 9 aa, Homo Sapiens
EALSGACMG

SEQ ID NO: 287981 - protein, 9 aa, Homo Sapiens
NKAMQYGFL

SEQ ID NO: 287982 - protein, 9 aa, Homo Sapiens
TVYRMLMQK

SEQ ID NO: 287983 - protein, 9 aa, Homo Sapiens
IPLYGTVCF

SEQ ID NO: 287984 - protein, 9 aa, Homo Sapiens
SPTSIQTGY

SEQ ID NO: 287985 - protein, 9 aa, Homo Sapiens
KFMLLIEQS

SEQ ID NO: 287986 - protein, 9 aa, Homo Sapiens
SILDLSETY

SEQ ID NO: 287987 - protein, 9 aa, Homo Sapiens
CGKIGLIEE

SEQ ID NO: 287988 - protein, 9 aa, Homo Sapiens
MGDKAQQTK

SEQ ID NO: 287989 - protein, 9 aa, Homo Sapiens
ILAGHRFSN

SEQ ID NO: 287990 - protein, 9 aa, Homo Sapiens
HPEEEIVLQ

SEQ ID NO: 287991 - protein, 9 aa, Homo Sapiens
TTKWVAMIP

SEQ ID NO: 287992 - protein, 9 aa, Homo Sapiens
SDFLRFQGI

SEQ ID NO: 287993 - protein, 9 aa, Homo Sapiens
NWSTNQCFG

SEQ ID NO: 287994 - protein, 9 aa, Homo Sapiens
EEGKLWNDI

SEQ ID NO: 287995 - protein, 9 aa, Homo Sapiens
LSMAILSLT

SEQ ID NO: 287996 - protein, 9 aa, Homo Sapiens
FELFEASAK

SEQ ID NO: 287997 - protein, 9 aa, Homo Sapiens
VRTSGSRSQ

SEQ ID NO: 287998 - protein, 9 aa, Homo Sapiens
PCSNIPYFC

SEQ ID NO: 287999 - protein, 9 aa, Homo Sapiens
NGDLDDIED

SEQ ID NO: 288000 - protein, 9 aa, Homo Sapiens
KFSSINLDK

SEQ ID NO: 288001 - protein, 9 aa, Homo Sapiens
PWVYLLLKK

SEQ ID NO: 288002 - protein, 9 aa, Homo Sapiens
LNVTFIENR

SEQ ID NO: 288003 - protein, 9 aa, Homo Sapiens
IHTHTFYVS

SEQ ID NO: 288004 - protein, 9 aa, Homo Sapiens
RLFATKPGG

SEQ ID NO: 288005 - protein, 9 aa, Homo Sapiens
MEDQKHSYE

SEQ ID NO: 288006 - protein, 9 aa, Homo Sapiens
SDLLRKMED

SEQ ID NO: 288007 - protein, 9 aa, Homo Sapiens
APKPASPKN

SEQ ID NO: 288008 - protein, 9 aa, Homo Sapiens
MFRFAYYTL

SEQ ID NO: 288009 - protein, 9 aa, Homo Sapiens
GPEEEGAGG

SEQ ID NO: 288010 - protein, 9 aa, Homo Sapiens
TDVRRVLLQ

SEQ ID NO: 288011 - protein, 9 aa, Homo Sapiens
DYEQAAKNL

SEQ ID NO: 288012 - protein, 9 aa, Homo Sapiens
APLITATTT

SEQ ID NO: 288013 - protein, 9 aa, Homo Sapiens
PHNDNLYLG

SEQ ID NO: 288014 - protein, 9 aa, Homo Sapiens
DHDHDGKLY

SEQ ID NO: 288015 - protein, 9 aa, Homo Sapiens
ISAWNNGKI

SEQ ID NO: 288016 - protein, 9 aa, Homo Sapiens
DTSAGKEYI

SEQ ID NO: 288017 - protein, 9 aa, Homo Sapiens
MCIYVSLSG

SEQ ID NO: 288018 - protein, 9 aa, Homo Sapiens
RIRSDRYKN

SEQ ID NO: 288019 - protein, 9 aa, Homo Sapiens
LPKETEHLF

SEQ ID NO: 288020 - protein, 9 aa, Homo Sapiens
QNRITVSHL

SEQ ID NO: 288021 - protein, 9 aa, Homo Sapiens
NEFQRKMRK

SEQ ID NO: 288022 - protein, 9 aa, Homo Sapiens
LSQTCCTDH

SEQ ID NO: 288023 - protein, 9 aa, Homo Sapiens
VLFATKVRN

SEQ ID NO: 288024 - protein, 9 aa, Homo Sapiens
ILISFIDHH

SEQ ID NO: 288025 - protein, 9 aa, Homo Sapiens
PTLAECWAA

SEQ ID NO: 288026 - protein, 9 aa, Homo Sapiens
QRERSDCER

SEQ ID NO: 288027 - protein, 9 aa, Homo Sapiens
HALSDSHHS

SEQ ID NO: 288028 - protein, 9 aa, Homo Sapiens
NTTKSVEFT

SEQ ID NO: 288029 - protein, 9 aa, Homo Sapiens
MLNKPVVTE

SEQ ID NO: 288030 - protein, 9 aa, Homo Sapiens
RKDMLAEKL

SEQ ID NO: 288031 - protein, 9 aa, Homo Sapiens
RADYDIASK

SEQ ID NO: 288032 - protein, 9 aa, Homo Sapiens
TSPQLAKPS

SEQ ID NO: 288033 - protein, 9 aa, Homo Sapiens
EAKIIEAKQ

SEQ ID NO: 288034 - protein, 9 aa, Homo Sapiens
VVEILNGEK

SEQ ID NO: 288035 - protein, 9 aa, Homo Sapiens
NQDPVSPIL

SEQ ID NO: 288036 - protein, 9 aa, Homo Sapiens
DFSGLWRAL

SEQ ID NO: 288037 - protein, 9 aa, Homo Sapiens
LYPDLILID

SEQ ID NO: 288038 - protein, 9 aa, Homo Sapiens
KWSHNNSPI

SEQ ID NO: 288039 - protein, 9 aa, Homo Sapiens
KGLRGPPPA

SEQ ID NO: 288040 - protein, 9 aa, Homo Sapiens
SNDRGKTPL

SEQ ID NO: 288041 - protein, 9 aa, Homo Sapiens
QESLVINLN

SEQ ID NO: 288042 - protein, 9 aa, Homo Sapiens
RKKYPQMND

SEQ ID NO: 288043 - protein, 9 aa, Homo Sapiens
AFSFLMTKA

SEQ ID NO: 288044 - protein, 9 aa, Homo Sapiens
ESIVLIFLL

SEQ ID NO: 288045 - protein, 9 aa, Homo Sapiens
HIPMHLLLG

SEQ ID NO: 288046 - protein, 9 aa, Homo Sapiens
SYSVIIDII

SEQ ID NO: 288047 - protein, 9 aa, Homo Sapiens
SCLNITHKA

SEQ ID NO: 288048 - protein, 9 aa, Homo Sapiens
PAVLHTLWV

SEQ ID NO: 288049 - protein, 9 aa, Homo Sapiens
KIYKHEGVR

SEQ ID NO: 288050 - protein, 9 aa, Homo Sapiens
RTNKDGKGI

SEQ ID NO: 288051 - protein, 9 aa, Homo Sapiens
LQGLTTQDL

SEQ ID NO: 288052 - protein, 9 aa, Homo Sapiens
FSQITPWLF

SEQ ID NO: 288053 - protein, 9 aa, Homo Sapiens
WMCNTFRCG

SEQ ID NO: 288054 - protein, 9 aa, Homo Sapiens
FLLILAIYC

SEQ ID NO: 288055 - protein, 9 aa, Homo Sapiens
EEHISQLEL

SEQ ID NO: 288056 - protein, 9 aa, Homo Sapiens
FIWPASLNE

SEQ ID NO: 288057 - protein, 9 aa, Homo Sapiens
DRHGKTFTF

SEQ ID NO: 288058 - protein, 9 aa, Homo Sapiens
PDPSGGFQG

SEQ ID NO: 288059 - protein, 9 aa, Homo Sapiens
LEEETKEAL

SEQ ID NO: 288060 - protein, 9 aa, Homo Sapiens
ALQESLHQN

SEQ ID NO: 288061 - protein, 9 aa, Homo Sapiens
AAIFCLSAD

SEQ ID NO: 288062 - protein, 9 aa, Homo Sapiens
PAPAMTSHL

SEQ ID NO: 288063 - protein, 9 aa, Homo Sapiens
TVSTKSQSG

SEQ ID NO: 288064 - protein, 9 aa, Homo Sapiens
QGNPCTLVK

SEQ ID NO: 288065 - protein, 9 aa, Homo Sapiens
STVDIEGHE

SEQ ID NO: 288066 - protein, 9 aa, Homo Sapiens
KKNTLNHVY

SEQ ID NO: 288067 - protein, 9 aa, Homo Sapiens
TLDFATYLL

SEQ ID NO: 288068 - protein, 9 aa, Homo Sapiens
IGDINILQN

SEQ ID NO: 288069 - protein, 9 aa, Homo Sapiens
TLFFQRFSV

SEQ ID NO: 288070 - protein, 9 aa, Homo Sapiens
DLKEFLPEE

SEQ ID NO: 288071 - protein, 9 aa, Homo Sapiens
GKQHCLPEP

SEQ ID NO: 288072 - protein, 9 aa, Homo Sapiens
AQNTMLESL

SEQ ID NO: 288073 - protein, 9 aa, Homo Sapiens
SRSCRVHLS

SEQ ID NO: 288074 - protein, 9 aa, Homo Sapiens
GPSSALVQQ

SEQ ID NO: 288075 - protein, 9 aa, Homo Sapiens
DLLTNLMYV

SEQ ID NO: 288076 - protein, 9 aa, Homo Sapiens
PSYDPLKID

SEQ ID NO: 288077 - protein, 9 aa, Homo Sapiens
NYPVPIRDD

SEQ ID NO: 288078 - protein, 9 aa, Homo Sapiens
QQNLRQLVK

SEQ ID NO: 288079 - protein, 9 aa, Homo Sapiens
SPFNVVLLQ

SEQ ID NO: 288080 - protein, 9 aa, Homo Sapiens
VCLLPLLLP

SEQ ID NO: 288081 - protein, 9 aa, Homo Sapiens
VYTEYTLQL

SEQ ID NO: 288082 - protein, 9 aa, Homo Sapiens
TIILYFRVP

SEQ ID NO: 288083 - protein, 9 aa, Homo Sapiens
WKHYKKEGS

SEQ ID NO: 288084 - protein, 9 aa, Homo Sapiens
LKGAAAEIR

SEQ ID NO: 288085 - protein, 9 aa, Homo Sapiens
LGKLMPNLL

SEQ ID NO: 288086 - protein, 9 aa, Homo Sapiens
VDEETGILP

SEQ ID NO: 288087 - protein, 9 aa, Homo Sapiens
LSNSADDIK

SEQ ID NO: 288088 - protein, 9 aa, Homo Sapiens
KRLPYSELL

SEQ ID NO: 288089 - protein, 9 aa, Homo Sapiens
SSLSHHQRV

SEQ ID NO: 288090 - protein, 9 aa, Homo Sapiens
DTIKELQDA

SEQ ID NO: 288091 - protein, 9 aa, Homo Sapiens
AFYNNASKF

SEQ ID NO: 288092 - protein, 9 aa, Homo Sapiens
ALSLQVCLT

SEQ ID NO: 288093 - protein, 9 aa, Homo Sapiens
SPQKPQGAP

SEQ ID NO: 288094 - protein, 9 aa, Homo Sapiens
CFWKIALPV

SEQ ID NO: 288095 - protein, 9 aa, Homo Sapiens
KKNKGNKTQ

SEQ ID NO: 288096 - protein, 9 aa, Homo Sapiens
SGSPSLLSN

SEQ ID NO: 288097 - protein, 9 aa, Homo Sapiens
TFIHGQHSP

SEQ ID NO: 288098 - protein, 9 aa, Homo Sapiens
AAGLRDDGK

SEQ ID NO: 288099 - protein, 9 aa, Homo Sapiens
KHLRPQFLL

SEQ ID NO: 288100 - protein, 9 aa, Homo Sapiens
CPGWASTIE

SEQ ID NO: 288101 - protein, 9 aa, Homo Sapiens
LRLKFVKLH

SEQ ID NO: 288102 - protein, 9 aa, Homo Sapiens
ISITHATVE

SEQ ID NO: 288103 - protein, 9 aa, Homo Sapiens
ALSADRYRS

SEQ ID NO: 288104 - protein, 9 aa, Homo Sapiens
ISCVRVITS

SEQ ID NO: 288105 - protein, 9 aa, Homo Sapiens
KSKSNIKQN

SEQ ID NO: 288106 - protein, 9 aa, Homo Sapiens
HNALSDVVN

SEQ ID NO: 288107 - protein, 9 aa, Homo Sapiens
HGQLKAFWR

SEQ ID NO: 288108 - protein, 9 aa, Homo Sapiens
RKEQEELAQ

SEQ ID NO: 288109 - protein, 9 aa, Homo Sapiens
LFKPENSTF

SEQ ID NO: 288110 - protein, 9 aa, Homo Sapiens
KGLRTAGLF

SEQ ID NO: 288111 - protein, 9 aa, Homo Sapiens
GGKACPHRC

SEQ ID NO: 288112 - protein, 9 aa, Homo Sapiens
KVHLTATHP

SEQ ID NO: 288113 - protein, 9 aa, Homo Sapiens
QEAVQGYVG

SEQ ID NO: 288114 - protein, 9 aa, Homo Sapiens
TIGRKPPAF

SEQ ID NO: 288115 - protein, 9 aa, Homo Sapiens
TQERIYLQW

SEQ ID NO: 288116 - protein, 9 aa, Homo Sapiens
SQIIYNYNP

SEQ ID NO: 288117 - protein, 9 aa, Homo Sapiens
KIPQKVMWR

SEQ ID NO: 288118 - protein, 9 aa, Homo Sapiens
SSSGGSEFF

SEQ ID NO: 288119 - protein, 9 aa, Homo Sapiens
GMEDGNKQD

SEQ ID NO: 288120 - protein, 9 aa, Homo Sapiens
YQLRHPVRL

SEQ ID NO: 288121 - protein, 9 aa, Homo Sapiens
TQELIPSED

SEQ ID NO: 288122 - protein, 9 aa, Homo Sapiens
YWDQHDLSW

SEQ ID NO: 288123 - protein, 9 aa, Homo Sapiens
DMKQEMDKR

SEQ ID NO: 288124 - protein, 9 aa, Homo Sapiens
NGTNSAEFV

SEQ ID NO: 288125 - protein, 9 aa, Homo Sapiens
WIRPIKTTS

SEQ ID NO: 288126 - protein, 9 aa, Homo Sapiens
RGLNVSSCE

SEQ ID NO: 288127 - protein, 9 aa, Homo Sapiens
ITGEKFDRQ

SEQ ID NO: 288128 - protein, 9 aa, Homo Sapiens
WHAARKPLD

SEQ ID NO: 288129 - protein, 9 aa, Homo Sapiens
EDSERKARE

SEQ ID NO: 288130 - protein, 9 aa, Homo Sapiens
RPSGYRADL

SEQ ID NO: 288131 - protein, 9 aa, Homo Sapiens
SDHFQIHTG

SEQ ID NO: 288132 - protein, 9 aa, Homo Sapiens
NFLLKFQEI

SEQ ID NO: 288133 - protein, 9 aa, Homo Sapiens
IQIISHVSG

SEQ ID NO: 288134 - protein, 9 aa, Homo Sapiens
SITHKEKEH

SEQ ID NO: 288135 - protein, 9 aa, Homo Sapiens
IIFRNFLRL

SEQ ID NO: 288136 - protein, 9 aa, Homo Sapiens
LQKALEPAL

SEQ ID NO: 288137 - protein, 9 aa, Homo Sapiens
HTRMGRHKP

SEQ ID NO: 288138 - protein, 9 aa, Homo Sapiens
WGQRLETQE

SEQ ID NO: 288139 - protein, 9 aa, Homo Sapiens
VEYFWWPML

SEQ ID NO: 288140 - protein, 9 aa, Homo Sapiens
EEPPQTLLR

SEQ ID NO: 288141 - protein, 9 aa, Homo Sapiens
IWPWTKNRM

SEQ ID NO: 288142 - protein, 9 aa, Homo Sapiens
NLLSFTYRL

SEQ ID NO: 288143 - protein, 9 aa, Homo Sapiens
VMEQLMISM

SEQ ID NO: 288144 - protein, 9 aa, Homo Sapiens
KYKEAFDKM

SEQ ID NO: 288145 - protein, 9 aa, Homo Sapiens
GILIMDLKE

SEQ ID NO: 288146 - protein, 9 aa, Homo Sapiens
YSHILDYYE

SEQ ID NO: 288147 - protein, 9 aa, Homo Sapiens
QEVPQENGL

SEQ ID NO: 288148 - protein, 9 aa, Homo Sapiens
VWKSLDLYL

SEQ ID NO: 288149 - protein, 9 aa, Homo Sapiens
WRVLSFSWE

SEQ ID NO: 288150 - protein, 9 aa, Homo Sapiens
CLRYAAAAA

SEQ ID NO: 288151 - protein, 9 aa, Homo Sapiens
RPLSMDRMV

SEQ ID NO: 288152 - protein, 9 aa, Homo Sapiens
KLEAIARPV

SEQ ID NO: 288153 - protein, 9 aa, Homo Sapiens
EEWLALYST

SEQ ID NO: 288154 - protein, 9 aa, Homo Sapiens
PFLEVKMES

SEQ ID NO: 288155 - protein, 9 aa, Homo Sapiens
NITVLEADA

SEQ ID NO: 288156 - protein, 9 aa, Homo Sapiens
DPVLMYLKE

SEQ ID NO: 288157 - protein, 9 aa, Homo Sapiens
LSDAACIVC

SEQ ID NO: 288158 - protein, 9 aa, Homo Sapiens
EAVGQLTPT

SEQ ID NO: 288159 - protein, 9 aa, Homo Sapiens
KVLTWGEEI

SEQ ID NO: 288160 - protein, 9 aa, Homo Sapiens
RVHGGQVNL

SEQ ID NO: 288161 - protein, 9 aa, Homo Sapiens
IQLDHYCKE

SEQ ID NO: 288162 - protein, 9 aa, Homo Sapiens
DVPVENYVA

SEQ ID NO: 288163 - protein, 9 aa, Homo Sapiens
NCKDLAVVL

SEQ ID NO: 288164 - protein, 9 aa, Homo Sapiens
YALCILSHL

SEQ ID NO: 288165 - protein, 9 aa, Homo Sapiens
IKAMLVANS

SEQ ID NO: 288166 - protein, 9 aa, Homo Sapiens
GNLTILHVM

SEQ ID NO: 288167 - protein, 9 aa, Homo Sapiens
DDEEQLTAN

SEQ ID NO: 288168 - protein, 9 aa, Homo Sapiens
GGSGSKQLP

SEQ ID NO: 288169 - protein, 9 aa, Homo Sapiens
VYFNFFKAP

SEQ ID NO: 288170 - protein, 9 aa, Homo Sapiens
IPSLFLDNF

SEQ ID NO: 288171 - protein, 9 aa, Homo Sapiens
GQLALLDYL

SEQ ID NO: 288172 - protein, 9 aa, Homo Sapiens
VFLWVGKLV

SEQ ID NO: 288173 - protein, 9 aa, Homo Sapiens
DKRLQEMEI

SEQ ID NO: 288174 - protein, 9 aa, Homo Sapiens
DMQNILDLH

SEQ ID NO: 288175 - protein, 9 aa, Homo Sapiens
KGLPCDTLA

SEQ ID NO: 288176 - protein, 9 aa, Homo Sapiens
LIEYPELQI

SEQ ID NO: 288177 - protein, 9 aa, Homo Sapiens
FYHVANWLV

SEQ ID NO: 288178 - protein, 9 aa, Homo Sapiens
AANLNGEPG

SEQ ID NO: 288179 - protein, 9 aa, Homo Sapiens
VADLMVSVA

SEQ ID NO: 288180 - protein, 9 aa, Homo Sapiens
AAAQFTLGS

SEQ ID NO: 288181 - protein, 9 aa, Homo Sapiens
GALQESLHQ

SEQ ID NO: 288182 - protein, 9 aa, Homo Sapiens
QFTLPRYVK

SEQ ID NO: 288183 - protein, 9 aa, Homo Sapiens
LVNDSSSDV

SEQ ID NO: 288184 - protein, 9 aa, Homo Sapiens
SFIQCLLSS

SEQ ID NO: 288185 - protein, 9 aa, Homo Sapiens
KANPGSWFS

SEQ ID NO: 288186 - protein, 9 aa, Homo Sapiens
QETAKEKEF

SEQ ID NO: 288187 - protein, 9 aa, Homo Sapiens
VVDFSDRAT

SEQ ID NO: 288188 - protein, 9 aa, Homo Sapiens
KDKKYKWMV

SEQ ID NO: 288189 - protein, 9 aa, Homo Sapiens
KLCLPSSND

SEQ ID NO: 288190 - protein, 9 aa, Homo Sapiens
GHTFFQKPD

SEQ ID NO: 288191 - protein, 9 aa, Homo Sapiens
ESTPVEEVD

SEQ ID NO: 288192 - protein, 9 aa, Homo Sapiens
LETEYAASK

SEQ ID NO: 288193 - protein, 9 aa, Homo Sapiens
DEIILDIAT

SEQ ID NO: 288194 - protein, 9 aa, Homo Sapiens
QTFLSEIQW

SEQ ID NO: 288195 - protein, 9 aa, Homo Sapiens
SARCSDSVI

SEQ ID NO: 288196 - protein, 9 aa, Homo Sapiens
VQVWFQKHW

SEQ ID NO: 288197 - protein, 9 aa, Homo Sapiens
EDTSRQIVF

SEQ ID NO: 288198 - protein, 9 aa, Homo Sapiens
HGQCQAWKG

SEQ ID NO: 288199 - protein, 9 aa, Homo Sapiens
IDLTGSKVG

SEQ ID NO: 288200 - protein, 9 aa, Homo Sapiens
PKVFPGNVE

SEQ ID NO: 288201 - protein, 9 aa, Homo Sapiens
NTPGENILF

SEQ ID NO: 288202 - protein, 9 aa, Homo Sapiens
TICAGGKPH

SEQ ID NO: 288203 - protein, 9 aa, Homo Sapiens
WTLCMNVGG

SEQ ID NO: 288204 - protein, 9 aa, Homo Sapiens
SKPHLPGLL

SEQ ID NO: 288205 - protein, 9 aa, Homo Sapiens
PLPNMDSSV

SEQ ID NO: 288206 - protein, 9 aa, Homo Sapiens
KTSFFFEAR

SEQ ID NO: 288207 - protein, 9 aa, Homo Sapiens
PIQFHQLAA

SEQ ID NO: 288208 - protein, 9 aa, Homo Sapiens
SVMDSGQKE

SEQ ID NO: 288209 - protein, 9 aa, Homo Sapiens
AACNILVNS

SEQ ID NO: 288210 - protein, 9 aa, Homo Sapiens
QFSCLTLPS

SEQ ID NO: 288211 - protein, 9 aa, Homo Sapiens
STRTHHLEP

SEQ ID NO: 288212 - protein, 9 aa, Homo Sapiens
DKWMLDLNS

SEQ ID NO: 288213 - protein, 9 aa, Homo Sapiens
GKPIHIMWS

SEQ ID NO: 288214 - protein, 9 aa, Homo Sapiens
HQIHHLLFT

SEQ ID NO: 288215 - protein, 9 aa, Homo Sapiens
KVKGLGQSY

SEQ ID NO: 288216 - protein, 9 aa, Homo Sapiens
QKVDELVAC

SEQ ID NO: 288217 - protein, 9 aa, Homo Sapiens
ARIIDSNDQ

SEQ ID NO: 288218 - protein, 9 aa, Homo Sapiens
KVFEYYART

SEQ ID NO: 288219 - protein, 9 aa, Homo Sapiens
GEFWTAFKD

SEQ ID NO: 288220 - protein, 9 aa, Homo Sapiens
YLGEECPAT

SEQ ID NO: 288221 - protein, 9 aa, Homo Sapiens
GRPQAEVEQ

SEQ ID NO: 288222 - protein, 9 aa, Homo Sapiens
EILSETKDV

SEQ ID NO: 288223 - protein, 9 aa, Homo Sapiens
QALQTVIFF

SEQ ID NO: 288224 - protein, 9 aa, Homo Sapiens
LGSEDCKLP

SEQ ID NO: 288225 - protein, 9 aa, Homo Sapiens
QYPPDNLRV

SEQ ID NO: 288226 - protein, 9 aa, Homo Sapiens
LHLAAHNNF

SEQ ID NO: 288227 - protein, 9 aa, Homo Sapiens
VVKYETSLT

SEQ ID NO: 288228 - protein, 9 aa, Homo Sapiens
KVLQQMPNF

SEQ ID NO: 288229 - protein, 9 aa, Homo Sapiens
DVSISAFCE

SEQ ID NO: 288230 - protein, 9 aa, Homo Sapiens
IYIARLFWH

SEQ ID NO: 288231 - protein, 9 aa, Homo Sapiens
SSVDVSKVN

SEQ ID NO: 288232 - protein, 9 aa, Homo Sapiens
AQSSQVGPN

SEQ ID NO: 288233 - protein, 9 aa, Homo Sapiens
ASGDGVRVS

SEQ ID NO: 288234 - protein, 9 aa, Homo Sapiens
STAVCTLRC

SEQ ID NO: 288235 - protein, 9 aa, Homo Sapiens
KINDLSIIS

SEQ ID NO: 288236 - protein, 9 aa, Homo Sapiens
NGKDIFKPI

SEQ ID NO: 288237 - protein, 9 aa, Homo Sapiens
GLLMLLYVI

SEQ ID NO: 288238 - protein, 9 aa, Homo Sapiens
EKRRRATAE

SEQ ID NO: 288239 - protein, 9 aa, Homo Sapiens
YRQRSQTAL

SEQ ID NO: 288240 - protein, 9 aa, Homo Sapiens
KSFPEIYFL

SEQ ID NO: 288241 - protein, 9 aa, Homo Sapiens
LNPPSYLLI

SEQ ID NO: 288242 - protein, 9 aa, Homo Sapiens
EKGKVDKQY

SEQ ID NO: 288243 - protein, 9 aa, Homo Sapiens
ALLCELMDM

SEQ ID NO: 288244 - protein, 9 aa, Homo Sapiens
QNLRQLVKV

SEQ ID NO: 288245 - protein, 9 aa, Homo Sapiens
RNIEVPGDD

SEQ ID NO: 288246 - protein, 9 aa, Homo Sapiens
ILEKSSKSH

SEQ ID NO: 288247 - protein, 9 aa, Homo Sapiens
LVVLQGMQV

SEQ ID NO: 288248 - protein, 9 aa, Homo Sapiens
ERVKRILNF

SEQ ID NO: 288249 - protein, 9 aa, Homo Sapiens
ISITRVTAN

SEQ ID NO: 288250 - protein, 9 aa, Homo Sapiens
FLTDREVQL

SEQ ID NO: 288251 - protein, 9 aa, Homo Sapiens
LARVIHDWA

SEQ ID NO: 288252 - protein, 9 aa, Homo Sapiens
RQSGENGRW

SEQ ID NO: 288253 - protein, 9 aa, Homo Sapiens
GKNLKYRMY

SEQ ID NO: 288254 - protein, 9 aa, Homo Sapiens
KQFCSIAFK

SEQ ID NO: 288255 - protein, 9 aa, Homo Sapiens
ELDSLQNEH

SEQ ID NO: 288256 - protein, 9 aa, Homo Sapiens
AKVCGKIGL

SEQ ID NO: 288257 - protein, 9 aa, Homo Sapiens
FTLPRYVKA

SEQ ID NO: 288258 - protein, 9 aa, Homo Sapiens
EFFRDCFLE

SEQ ID NO: 288259 - protein, 9 aa, Homo Sapiens
EWELNPVKD

SEQ ID NO: 288260 - protein, 9 aa, Homo Sapiens
LGDFQWRNV

SEQ ID NO: 288261 - protein, 9 aa, Homo Sapiens
SDQQSHLEC

SEQ ID NO: 288262 - protein, 9 aa, Homo Sapiens
NMFCADELV

SEQ ID NO: 288263 - protein, 9 aa, Homo Sapiens
FTEHFTANV

SEQ ID NO: 288264 - protein, 9 aa, Homo Sapiens
PQEGTAPEI

SEQ ID NO: 288265 - protein, 9 aa, Homo Sapiens
VLDFVNAMK

SEQ ID NO: 288266 - protein, 9 aa, Homo Sapiens
QTTGLIPVN

SEQ ID NO: 288267 - protein, 9 aa, Homo Sapiens
HPGLHHGRH

SEQ ID NO: 288268 - protein, 9 aa, Homo Sapiens
LQRQYCSPR

SEQ ID NO: 288269 - protein, 9 aa, Homo Sapiens
FSHSEGPLS

SEQ ID NO: 288270 - protein, 9 aa, Homo Sapiens
NHNLLSTIP

SEQ ID NO: 288271 - protein, 9 aa, Homo Sapiens
CRKLYEKSL

SEQ ID NO: 288272 - protein, 9 aa, Homo Sapiens
HHQVHADDL

SEQ ID NO: 288273 - protein, 9 aa, Homo Sapiens
SETSESHPN

SEQ ID NO: 288274 - protein, 9 aa, Homo Sapiens
NRAQKKRLN

SEQ ID NO: 288275 - protein, 9 aa, Homo Sapiens
QAQASAGDT

SEQ ID NO: 288276 - protein, 9 aa, Homo Sapiens
YLICKDEMS

SEQ ID NO: 288277 - protein, 9 aa, Homo Sapiens
ERDFSVCIL

SEQ ID NO: 288278 - protein, 9 aa, Homo Sapiens
CKESSSFKT

SEQ ID NO: 288279 - protein, 9 aa, Homo Sapiens
HYGDFLPIP

SEQ ID NO: 288280 - protein, 9 aa, Homo Sapiens
LPENMRKLT

SEQ ID NO: 288281 - protein, 9 aa, Homo Sapiens
LFPTKQSLA

SEQ ID NO: 288282 - protein, 9 aa, Homo Sapiens
ILLSLGLVA

SEQ ID NO: 288283 - protein, 9 aa, Homo Sapiens
LTKLSCDDI

SEQ ID NO: 288284 - protein, 9 aa, Homo Sapiens
RSAYCAAAV

SEQ ID NO: 288285 - protein, 9 aa, Homo Sapiens
CVRECTQFL

SEQ ID NO: 288286 - protein, 9 aa, Homo Sapiens
FYLNHFSGV

SEQ ID NO: 288287 - protein, 9 aa, Homo Sapiens
FCIQLVAVP

SEQ ID NO: 288288 - protein, 9 aa, Homo Sapiens
KKCKLTRNG

SEQ ID NO: 288289 - protein, 9 aa, Homo Sapiens
VVYGNILLI

SEQ ID NO: 288290 - protein, 9 aa, Homo Sapiens
TELYRTGNK

SEQ ID NO: 288291 - protein, 9 aa, Homo Sapiens
QAAFPLAFL

SEQ ID NO: 288292 - protein, 9 aa, Homo Sapiens
VFHPVIIYP

SEQ ID NO: 288293 - protein, 9 aa, Homo Sapiens
EKKEIENLA

SEQ ID NO: 288294 - protein, 9 aa, Homo Sapiens
ALLMSESQK

SEQ ID NO: 288295 - protein, 9 aa, Homo Sapiens
GFIQRFEMK

SEQ ID NO: 288296 - protein, 9 aa, Homo Sapiens
NFPHIDEFF

SEQ ID NO: 288297 - protein, 9 aa, Homo Sapiens
FTSHALYSH

SEQ ID NO: 288298 - protein, 9 aa, Homo Sapiens
LFISHANEK

SEQ ID NO: 288299 - protein, 9 aa, Homo Sapiens
KLNSVGNYL

SEQ ID NO: 288300 - protein, 9 aa, Homo Sapiens
PPMDYAFSY

SEQ ID NO: 288301 - protein, 9 aa, Homo Sapiens
SGSRDLTPS

SEQ ID NO: 288302 - protein, 9 aa, Homo Sapiens
VTAYQSTDI

SEQ ID NO: 288303 - protein, 9 aa, Homo Sapiens
AVDGRHNGY

SEQ ID NO: 288304 - protein, 9 aa, Homo Sapiens
CMQDMVPYL

SEQ ID NO: 288305 - protein, 9 aa, Homo Sapiens
MMVPHPLIP

SEQ ID NO: 288306 - protein, 9 aa, Homo Sapiens
QENYYLLCD

SEQ ID NO: 288307 - protein, 9 aa, Homo Sapiens
SEDSITPSA

SEQ ID NO: 288308 - protein, 9 aa, Homo Sapiens
GGTCQGQWQ

SEQ ID NO: 288309 - protein, 9 aa, Homo Sapiens
LLEYHEGCT

SEQ ID NO: 288310 - protein, 9 aa, Homo Sapiens
TVDIEGHEC

SEQ ID NO: 288311 - protein, 9 aa, Homo Sapiens
TLGDKIHGF

SEQ ID NO: 288312 - protein, 9 aa, Homo Sapiens
VPYVLVIPM

SEQ ID NO: 288313 - protein, 9 aa, Homo Sapiens
IILGLGDLG

SEQ ID NO: 288314 - protein, 9 aa, Homo Sapiens
QTLLETLQK

SEQ ID NO: 288315 - protein, 9 aa, Homo Sapiens
DEMVAPRIG

SEQ ID NO: 288316 - protein, 9 aa, Homo Sapiens
RLFDLNNTT

SEQ ID NO: 288317 - protein, 9 aa, Homo Sapiens
YYSECLTQM

SEQ ID NO: 288318 - protein, 9 aa, Homo Sapiens
PLLRYLALC

SEQ ID NO: 288319 - protein, 9 aa, Homo Sapiens
PKFKYPSVA

SEQ ID NO: 288320 - protein, 9 aa, Homo Sapiens
QTHFSTAYE

SEQ ID NO: 288321 - protein, 9 aa, Homo Sapiens
MFVVTGRKE

SEQ ID NO: 288322 - protein, 9 aa, Homo Sapiens
TSSKLLYIY

SEQ ID NO: 288323 - protein, 9 aa, Homo Sapiens
CSECGTAFS

SEQ ID NO: 288324 - protein, 9 aa, Homo Sapiens
KELYVPEHK

SEQ ID NO: 288325 - protein, 9 aa, Homo Sapiens
RLLQIWNDG

SEQ ID NO: 288326 - protein, 9 aa, Homo Sapiens
VQANQSNRQ

SEQ ID NO: 288327 - protein, 9 aa, Homo Sapiens
IYEIKPFPK

SEQ ID NO: 288328 - protein, 9 aa, Homo Sapiens
HERPALMVS

SEQ ID NO: 288329 - protein, 9 aa, Homo Sapiens
SSSGSSKDL

SEQ ID NO: 288330 - protein, 9 aa, Homo Sapiens
YIFELEAAT

SEQ ID NO: 288331 - protein, 9 aa, Homo Sapiens
MGLIPEEPR

SEQ ID NO: 288332 - protein, 9 aa, Homo Sapiens
DCEDPNNSS

SEQ ID NO: 288333 - protein, 9 aa, Homo Sapiens
ARLLGATVT

SEQ ID NO: 288334 - protein, 9 aa, Homo Sapiens
GKQFCSIAF

SEQ ID NO: 288335 - protein, 9 aa, Homo Sapiens
RQTISVPVP

SEQ ID NO: 288336 - protein, 9 aa, Homo Sapiens
NANMHAHMC

SEQ ID NO: 288337 - protein, 9 aa, Homo Sapiens
TDDSKTAQA

SEQ ID NO: 288338 - protein, 9 aa, Homo Sapiens
TNPLDRPTF

SEQ ID NO: 288339 - protein, 9 aa, Homo Sapiens
NQLVQPAWQ

SEQ ID NO: 288340 - protein, 9 aa, Homo Sapiens
RKFLNALTS

SEQ ID NO: 288341 - protein, 9 aa, Homo Sapiens
VTVIPNSMT

SEQ ID NO: 288342 - protein, 9 aa, Homo Sapiens
RPADSRDTV

SEQ ID NO: 288343 - protein, 9 aa, Homo Sapiens
SKLWMLELS

SEQ ID NO: 288344 - protein, 9 aa, Homo Sapiens
KSHPRSPNM

SEQ ID NO: 288345 - protein, 9 aa, Homo Sapiens
DISTDKERT

SEQ ID NO: 288346 - protein, 9 aa, Homo Sapiens
GKYIYIGSE

SEQ ID NO: 288347 - protein, 9 aa, Homo Sapiens
WILLSLGLV

SEQ ID NO: 288348 - protein, 9 aa, Homo Sapiens
QYLKTKKNY

SEQ ID NO: 288349 - protein, 9 aa, Homo Sapiens
LTSLYGFST

SEQ ID NO: 288350 - protein, 9 aa, Homo Sapiens
EVPPGRGSC

SEQ ID NO: 288351 - protein, 9 aa, Homo Sapiens
LLTCRDKEI

SEQ ID NO: 288352 - protein, 9 aa, Homo Sapiens
LEAEFLISL

SEQ ID NO: 288353 - protein, 9 aa, Homo Sapiens
PRQTAPRPR

SEQ ID NO: 288354 - protein, 9 aa, Homo Sapiens
IWVAIPLDY

SEQ ID NO: 288355 - protein, 9 aa, Homo Sapiens
YLLAKIKTI

SEQ ID NO: 288356 - protein, 9 aa, Homo Sapiens
SALEQQNIQ

SEQ ID NO: 288357 - protein, 9 aa, Homo Sapiens
QPQVKEEII

SEQ ID NO: 288358 - protein, 9 aa, Homo Sapiens
GCMYSLIGL

SEQ ID NO: 288359 - protein, 9 aa, Homo Sapiens
YFKGSWVNT

SEQ ID NO: 288360 - protein, 9 aa, Homo Sapiens
LFKGDFRIY

SEQ ID NO: 288361 - protein, 9 aa, Homo Sapiens
KAMSIFSSA

SEQ ID NO: 288362 - protein, 9 aa, Homo Sapiens
TSGSLLLVV

SEQ ID NO: 288363 - protein, 9 aa, Homo Sapiens
DLTPSRPAQ

SEQ ID NO: 288364 - protein, 9 aa, Homo Sapiens
TRYFILPCD

SEQ ID NO: 288365 - protein, 9 aa, Homo Sapiens
AFGIIAFSC

SEQ ID NO: 288366 - protein, 9 aa, Homo Sapiens
CDHCAVTEE

SEQ ID NO: 288367 - protein, 9 aa, Homo Sapiens
VLPDCNMSE

SEQ ID NO: 288368 - protein, 9 aa, Homo Sapiens
LPKNFHSPM

SEQ ID NO: 288369 - protein, 9 aa, Homo Sapiens
LYFYALLFI

SEQ ID NO: 288370 - protein, 9 aa, Homo Sapiens
GNSHVHYTD

SEQ ID NO: 288371 - protein, 9 aa, Homo Sapiens
EHTLAVEIL

SEQ ID NO: 288372 - protein, 9 aa, Homo Sapiens
PVNLELQDL

SEQ ID NO: 288373 - protein, 9 aa, Homo Sapiens
SQNNLYRDV

SEQ ID NO: 288374 - protein, 9 aa, Homo Sapiens
GHAGAPEPG

SEQ ID NO: 288375 - protein, 9 aa, Homo Sapiens
GRRNKYMPQ

SEQ ID NO: 288376 - protein, 9 aa, Homo Sapiens
HMEFPGVDG

SEQ ID NO: 288377 - protein, 9 aa, Homo Sapiens
FLTLFASHF

SEQ ID NO: 288378 - protein, 9 aa, Homo Sapiens
IFALESAQF

SEQ ID NO: 288379 - protein, 9 aa, Homo Sapiens
SDEELSGGQ

SEQ ID NO: 288380 - protein, 9 aa, Homo Sapiens
HAGAPEPGP

SEQ ID NO: 288381 - protein, 9 aa, Homo Sapiens
CHSSLSHHQ

SEQ ID NO: 288382 - protein, 9 aa, Homo Sapiens
DLESKLVDW

SEQ ID NO: 288383 - protein, 9 aa, Homo Sapiens
NINTFLTSD

SEQ ID NO: 288384 - protein, 9 aa, Homo Sapiens
TGFVYGGNC

SEQ ID NO: 288385 - protein, 9 aa, Homo Sapiens
NTLYMSHRE

SEQ ID NO: 288386 - protein, 9 aa, Homo Sapiens
GHFKKSNYF

SEQ ID NO: 288387 - protein, 9 aa, Homo Sapiens
DTKVNFYDW

SEQ ID NO: 288388 - protein, 9 aa, Homo Sapiens
LSPASRWSK

SEQ ID NO: 288389 - protein, 9 aa, Homo Sapiens
HAIVLVNGT

SEQ ID NO: 288390 - protein, 9 aa, Homo Sapiens
IAVVAGLLR

SEQ ID NO: 288391 - protein, 9 aa, Homo Sapiens
SHENVDKVA

SEQ ID NO: 288392 - protein, 9 aa, Homo Sapiens
LLYIVAEFC

SEQ ID NO: 288393 - protein, 9 aa, Homo Sapiens
LKSYFPTQA

SEQ ID NO: 288394 - protein, 9 aa, Homo Sapiens
ILENALIGQ

SEQ ID NO: 288395 - protein, 9 aa, Homo Sapiens
QDPMLLATV

SEQ ID NO: 288396 - protein, 9 aa, Homo Sapiens
CNAPHWSKI

SEQ ID NO: 288397 - protein, 9 aa, Homo Sapiens
KDTSLVLTP

SEQ ID NO: 288398 - protein, 9 aa, Homo Sapiens
GCVPQLEKW

SEQ ID NO: 288399 - protein, 9 aa, Homo Sapiens
QAGKLFLLC

SEQ ID NO: 288400 - protein, 9 aa, Homo Sapiens
LDKCQTSMD

SEQ ID NO: 288401 - protein, 9 aa, Homo Sapiens
MKDLQDLML

SEQ ID NO: 288402 - protein, 9 aa, Homo Sapiens
HKRKILPPV

SEQ ID NO: 288403 - protein, 9 aa, Homo Sapiens
IHHLTVVTQ

SEQ ID NO: 288404 - protein, 9 aa, Homo Sapiens
MQKESKDNQ

SEQ ID NO: 288405 - protein, 9 aa, Homo Sapiens
DVKIGNGQA

SEQ ID NO: 288406 - protein, 9 aa, Homo Sapiens
TSFYKEYPG

SEQ ID NO: 288407 - protein, 9 aa, Homo Sapiens
NVRDSRKNS

SEQ ID NO: 288408 - protein, 9 aa, Homo Sapiens
EEHVALFKQ

SEQ ID NO: 288409 - protein, 9 aa, Homo Sapiens
LDGSDKRHC

SEQ ID NO: 288410 - protein, 9 aa, Homo Sapiens
DKPHDAEIN

SEQ ID NO: 288411 - protein, 9 aa, Homo Sapiens
LCSRKFSLK

SEQ ID NO: 288412 - protein, 9 aa, Homo Sapiens
VQFGSWFGH

SEQ ID NO: 288413 - protein, 9 aa, Homo Sapiens
ATRMRTFMY

SEQ ID NO: 288414 - protein, 9 aa, Homo Sapiens
NIVSENTIS

SEQ ID NO: 288415 - protein, 9 aa, Homo Sapiens
FMVVYGNIL

SEQ ID NO: 288416 - protein, 9 aa, Homo Sapiens
RRKISDDHL

SEQ ID NO: 288417 - protein, 9 aa, Homo Sapiens
YHRIIKQPM

SEQ ID NO: 288418 - protein, 9 aa, Homo Sapiens
SDDEGLYAV

SEQ ID NO: 288419 - protein, 9 aa, Homo Sapiens
NSSILGPHH

SEQ ID NO: 288420 - protein, 9 aa, Homo Sapiens
TNYLANVFE

SEQ ID NO: 288421 - protein, 9 aa, Homo Sapiens
FIGMFTDPA

SEQ ID NO: 288422 - protein, 9 aa, Homo Sapiens
AAGYFHNLF

SEQ ID NO: 288423 - protein, 9 aa, Homo Sapiens
LLKKHHHHN

SEQ ID NO: 288424 - protein, 9 aa, Homo Sapiens
DMKVLQNHL

SEQ ID NO: 288425 - protein, 9 aa, Homo Sapiens
SPEGEGLRY

SEQ ID NO: 288426 - protein, 9 aa, Homo Sapiens
DGYPDVARY

SEQ ID NO: 288427 - protein, 9 aa, Homo Sapiens
QTRFMTPEF

SEQ ID NO: 288428 - protein, 9 aa, Homo Sapiens
DNVKEDTFK

SEQ ID NO: 288429 - protein, 9 aa, Homo Sapiens
LLCVRECTQ

SEQ ID NO: 288430 - protein, 9 aa, Homo Sapiens
PPLLAQEHN

SEQ ID NO: 288431 - protein, 9 aa, Homo Sapiens
DEYEDGDRL

SEQ ID NO: 288432 - protein, 9 aa, Homo Sapiens
GKTFDRVSR

SEQ ID NO: 288433 - protein, 9 aa, Homo Sapiens
WLTSKKNVF

SEQ ID NO: 288434 - protein, 9 aa, Homo Sapiens
KGIFYHQAL

SEQ ID NO: 288435 - protein, 9 aa, Homo Sapiens
GITPEGILR

SEQ ID NO: 288436 - protein, 9 aa, Homo Sapiens
GKHVGNKFF

SEQ ID NO: 288437 - protein, 9 aa, Homo Sapiens
VLNTTCKKG

SEQ ID NO: 288438 - protein, 9 aa, Homo Sapiens
TILCVGPSD

SEQ ID NO: 288439 - protein, 9 aa, Homo Sapiens
MSDDIDNIK

SEQ ID NO: 288440 - protein, 9 aa, Homo Sapiens
YESVMETKN

SEQ ID NO: 288441 - protein, 9 aa, Homo Sapiens
RDGKFLHLS

SEQ ID NO: 288442 - protein, 9 aa, Homo Sapiens
KCAMKKYIK

SEQ ID NO: 288443 - protein, 9 aa, Homo Sapiens
QAYHWDTSD

SEQ ID NO: 288444 - protein, 9 aa, Homo Sapiens
TIRTAQTQA

SEQ ID NO: 288445 - protein, 9 aa, Homo Sapiens
GTIHEMKQS

SEQ ID NO: 288446 - protein, 9 aa, Homo Sapiens
IAVTAYQST

SEQ ID NO: 288447 - protein, 9 aa, Homo Sapiens
YSMRSTVVY

SEQ ID NO: 288448 - protein, 9 aa, Homo Sapiens
RSELDGLQS

SEQ ID NO: 288449 - protein, 9 aa, Homo Sapiens
ANIHQEFLS

SEQ ID NO: 288450 - protein, 9 aa, Homo Sapiens
LFEGCIWNL

SEQ ID NO: 288451 - protein, 9 aa, Homo Sapiens
GHSIFQINM

SEQ ID NO: 288452 - protein, 9 aa, Homo Sapiens
YAASPRICP

SEQ ID NO: 288453 - protein, 9 aa, Homo Sapiens
LLPLIVKRI

SEQ ID NO: 288454 - protein, 9 aa, Homo Sapiens
NQSKPEKPQ

SEQ ID NO: 288455 - protein, 9 aa, Homo Sapiens
GGVKTAIRE

SEQ ID NO: 288456 - protein, 9 aa, Homo Sapiens
DSGFCLYSP

SEQ ID NO: 288457 - protein, 9 aa, Homo Sapiens
PETWIILNK

SEQ ID NO: 288458 - protein, 9 aa, Homo Sapiens
LRALPKASL

SEQ ID NO: 288459 - protein, 9 aa, Homo Sapiens
LARERELYK

SEQ ID NO: 288460 - protein, 9 aa, Homo Sapiens
TLLDFILKT

SEQ ID NO: 288461 - protein, 9 aa, Homo Sapiens
QVIQGDSKY

SEQ ID NO: 288462 - protein, 9 aa, Homo Sapiens
QPVSIENIN

SEQ ID NO: 288463 - protein, 9 aa, Homo Sapiens
YHLTCGCQI

SEQ ID NO: 288464 - protein, 9 aa, Homo Sapiens
GGGAVEGRV

SEQ ID NO: 288465 - protein, 9 aa, Homo Sapiens
ATTMKDVQT

SEQ ID NO: 288466 - protein, 9 aa, Homo Sapiens
KNERFNCYP

SEQ ID NO: 288467 - protein, 9 aa, Homo Sapiens
ILVLELVPD

SEQ ID NO: 288468 - protein, 9 aa, Homo Sapiens
LRQKSKLVE

SEQ ID NO: 288469 - protein, 9 aa, Homo Sapiens
DVICDETNN

SEQ ID NO: 288470 - protein, 9 aa, Homo Sapiens
SLPKYLIYG

SEQ ID NO: 288471 - protein, 9 aa, Homo Sapiens
HRNGINTLG

SEQ ID NO: 288472 - protein, 9 aa, Homo Sapiens
DPSGGFQGT

SEQ ID NO: 288473 - protein, 9 aa, Homo Sapiens
LYRTGNKSH

SEQ ID NO: 288474 - protein, 9 aa, Homo Sapiens
HLKKGTEGL

SEQ ID NO: 288475 - protein, 9 aa, Homo Sapiens
FIIAIVVTV

SEQ ID NO: 288476 - protein, 9 aa, Homo Sapiens
ALCPTCLLP

SEQ ID NO: 288477 - protein, 9 aa, Homo Sapiens
SGLDSATLL

SEQ ID NO: 288478 - protein, 9 aa, Homo Sapiens
TTLPAIFTP

SEQ ID NO: 288479 - protein, 9 aa, Homo Sapiens
TNLTGYPDR

SEQ ID NO: 288480 - protein, 9 aa, Homo Sapiens
TKHSAKVLV

SEQ ID NO: 288481 - protein, 9 aa, Homo Sapiens
KAVCLFGCP

SEQ ID NO: 288482 - protein, 9 aa, Homo Sapiens
SPACSYNQS

SEQ ID NO: 288483 - protein, 9 aa, Homo Sapiens
EKYATVQPY

SEQ ID NO: 288484 - protein, 9 aa, Homo Sapiens
LQEAKLERK

SEQ ID NO: 288485 - protein, 9 aa, Homo Sapiens
DKDLLAFIS

SEQ ID NO: 288486 - protein, 9 aa, Homo Sapiens
NSLLQTRFM

SEQ ID NO: 288487 - protein, 9 aa, Homo Sapiens
LAWGRSEGD

SEQ ID NO: 288488 - protein, 9 aa, Homo Sapiens
EKQIKAKIE

SEQ ID NO: 288489 - protein, 9 aa, Homo Sapiens
YLEDVTAEY

SEQ ID NO: 288490 - protein, 9 aa, Homo Sapiens
CKLCLNPKT

SEQ ID NO: 288491 - protein, 9 aa, Homo Sapiens
LMILSYSGS

SEQ ID NO: 288492 - protein, 9 aa, Homo Sapiens
PPNTFTFDT

SEQ ID NO: 288493 - protein, 9 aa, Homo Sapiens
LKVEAHDSD

SEQ ID NO: 288494 - protein, 9 aa, Homo Sapiens
DSLIAFRMR

SEQ ID NO: 288495 - protein, 9 aa, Homo Sapiens
QLSLKNDHN

SEQ ID NO: 288496 - protein, 9 aa, Homo Sapiens
EITHTGEKP

SEQ ID NO: 288497 - protein, 9 aa, Homo Sapiens
AQKTAQLLY

SEQ ID NO: 288498 - protein, 9 aa, Homo Sapiens
LQVIQGDSK

SEQ ID NO: 288499 - protein, 9 aa, Homo Sapiens
LASNSLLNR

SEQ ID NO: 288500 - protein, 9 aa, Homo Sapiens
PDLFDLNSV

SEQ ID NO: 288501 - protein, 9 aa, Homo Sapiens
TLLDVNYHP

SEQ ID NO: 288502 - protein, 9 aa, Homo Sapiens
AAAGRDSTN

SEQ ID NO: 288503 - protein, 9 aa, Homo Sapiens
DKLGEVYIL

SEQ ID NO: 288504 - protein, 9 aa, Homo Sapiens
DYRGRATGK

SEQ ID NO: 288505 - protein, 9 aa, Homo Sapiens
ELGGTSLQI

SEQ ID NO: 288506 - protein, 9 aa, Homo Sapiens
SLKKIVFRL

SEQ ID NO: 288507 - protein, 9 aa, Homo Sapiens
PEEICKTFN

SEQ ID NO: 288508 - protein, 9 aa, Homo Sapiens
DSRAIIIIN

SEQ ID NO: 288509 - protein, 9 aa, Homo Sapiens
VPNPNPTPS

SEQ ID NO: 288510 - protein, 9 aa, Homo Sapiens
TFLPDNDSL

SEQ ID NO: 288511 - protein, 9 aa, Homo Sapiens
EMESLQWEH

SEQ ID NO: 288512 - protein, 9 aa, Homo Sapiens
KFYMDKVLM

SEQ ID NO: 288513 - protein, 9 aa, Homo Sapiens
LSDEYLTKQ

SEQ ID NO: 288514 - protein, 9 aa, Homo Sapiens
PEARKLIKK

SEQ ID NO: 288515 - protein, 9 aa, Homo Sapiens
KSEVKYLGP

SEQ ID NO: 288516 - protein, 9 aa, Homo Sapiens
EKTKTPRSA

SEQ ID NO: 288517 - protein, 9 aa, Homo Sapiens
HIKKTLMLN

SEQ ID NO: 288518 - protein, 9 aa, Homo Sapiens
LVYNITLAF

SEQ ID NO: 288519 - protein, 9 aa, Homo Sapiens
VSVPRPHKV

SEQ ID NO: 288520 - protein, 9 aa, Homo Sapiens
STRLEKDKW

SEQ ID NO: 288521 - protein, 9 aa, Homo Sapiens
LLNNYSYNE

SEQ ID NO: 288522 - protein, 9 aa, Homo Sapiens
LTSESRSKR

SEQ ID NO: 288523 - protein, 9 aa, Homo Sapiens
LLETQKVEC

SEQ ID NO: 288524 - protein, 9 aa, Homo Sapiens
WAPEWKRVE

SEQ ID NO: 288525 - protein, 9 aa, Homo Sapiens
ILESHNWRY

SEQ ID NO: 288526 - protein, 9 aa, Homo Sapiens
SRLMSHQIT

SEQ ID NO: 288527 - protein, 9 aa, Homo Sapiens
ITQTPGERS

SEQ ID NO: 288528 - protein, 9 aa, Homo Sapiens
SYGQRLSFD

SEQ ID NO: 288529 - protein, 9 aa, Homo Sapiens
LVSIPSRSF

SEQ ID NO: 288530 - protein, 9 aa, Homo Sapiens
YGIEHLKLK

SEQ ID NO: 288531 - protein, 9 aa, Homo Sapiens
CSIDEDCKL

SEQ ID NO: 288532 - protein, 9 aa, Homo Sapiens
PNTEMRTSC

SEQ ID NO: 288533 - protein, 9 aa, Homo Sapiens
KKMGGDLNE

SEQ ID NO: 288534 - protein, 9 aa, Homo Sapiens
QVLKHNRSS

SEQ ID NO: 288535 - protein, 9 aa, Homo Sapiens
PKRQKHLKY

SEQ ID NO: 288536 - protein, 9 aa, Homo Sapiens
VVYENYSQQ

SEQ ID NO: 288537 - protein, 9 aa, Homo Sapiens
CQRDKVITI

SEQ ID NO: 288538 - protein, 9 aa, Homo Sapiens
GCRPEKIVQ

SEQ ID NO: 288539 - protein, 9 aa, Homo Sapiens
EMKKAGERH

SEQ ID NO: 288540 - protein, 9 aa, Homo Sapiens
MTTELDKIF

SEQ ID NO: 288541 - protein, 9 aa, Homo Sapiens
EYNFITMKR

SEQ ID NO: 288542 - protein, 9 aa, Homo Sapiens
IHICTTILL

SEQ ID NO: 288543 - protein, 9 aa, Homo Sapiens
LRPVKVNVI

SEQ ID NO: 288544 - protein, 9 aa, Homo Sapiens
AYLVCLAAA

SEQ ID NO: 288545 - protein, 9 aa, Homo Sapiens
CKRQLMEKK

SEQ ID NO: 288546 - protein, 9 aa, Homo Sapiens
KTKKLVYLP

SEQ ID NO: 288547 - protein, 9 aa, Homo Sapiens
KEKEHAHLK

SEQ ID NO: 288548 - protein, 9 aa, Homo Sapiens
ELVSVDFGY

SEQ ID NO: 288549 - protein, 9 aa, Homo Sapiens
PKVQYKSSC

SEQ ID NO: 288550 - protein, 9 aa, Homo Sapiens
GYVGSFVLK

SEQ ID NO: 288551 - protein, 9 aa, Homo Sapiens
LSCNNTLLT

SEQ ID NO: 288552 - protein, 9 aa, Homo Sapiens
LWQKNQEDL

SEQ ID NO: 288553 - protein, 9 aa, Homo Sapiens
LSHAKYNKI

SEQ ID NO: 288554 - protein, 9 aa, Homo Sapiens
VNLQVAKLK

SEQ ID NO: 288555 - protein, 9 aa, Homo Sapiens
RIWKPYKKH

SEQ ID NO: 288556 - protein, 9 aa, Homo Sapiens
IRYRAAHDK

SEQ ID NO: 288557 - protein, 9 aa, Homo Sapiens
MESMLNTNP

SEQ ID NO: 288558 - protein, 9 aa, Homo Sapiens
LLFKRVFVN

SEQ ID NO: 288559 - protein, 9 aa, Homo Sapiens
RTEQLLETI

SEQ ID NO: 288560 - protein, 9 aa, Homo Sapiens
ALSIGDPTV

SEQ ID NO: 288561 - protein, 9 aa, Homo Sapiens
WIYLAAVKR

SEQ ID NO: 288562 - protein, 9 aa, Homo Sapiens
GLVFVFEAG

SEQ ID NO: 288563 - protein, 9 aa, Homo Sapiens
AGFVTLSLS

SEQ ID NO: 288564 - protein, 9 aa, Homo Sapiens
IQLTGDLPG

SEQ ID NO: 288565 - protein, 9 aa, Homo Sapiens
VTKHKEVIE

SEQ ID NO: 288566 - protein, 9 aa, Homo Sapiens
DPPLNHKAY

SEQ ID NO: 288567 - protein, 9 aa, Homo Sapiens
NGGGFMFPP

SEQ ID NO: 288568 - protein, 9 aa, Homo Sapiens
TSSGQYSAI

SEQ ID NO: 288569 - protein, 9 aa, Homo Sapiens
EEINNMKTQ

SEQ ID NO: 288570 - protein, 9 aa, Homo Sapiens
TKLNEDLKR

SEQ ID NO: 288571 - protein, 9 aa, Homo Sapiens
DQFKRRIED

SEQ ID NO: 288572 - protein, 9 aa, Homo Sapiens
RVIRNQDIL

SEQ ID NO: 288573 - protein, 9 aa, Homo Sapiens
GGYNRFASY

SEQ ID NO: 288574 - protein, 9 aa, Homo Sapiens
GNTPFVCTE

SEQ ID NO: 288575 - protein, 9 aa, Homo Sapiens
SVNPTMSID

SEQ ID NO: 288576 - protein, 9 aa, Homo Sapiens
CGKAFSCKD

SEQ ID NO: 288577 - protein, 9 aa, Homo Sapiens
HDKAIANVL

SEQ ID NO: 288578 - protein, 9 aa, Homo Sapiens
LYHDIVSRL

SEQ ID NO: 288579 - protein, 9 aa, Homo Sapiens
VLMYVLAHS

SEQ ID NO: 288580 - protein, 9 aa, Homo Sapiens
EGIFKNLRE

SEQ ID NO: 288581 - protein, 9 aa, Homo Sapiens
SKTTAAHYL

SEQ ID NO: 288582 - protein, 9 aa, Homo Sapiens
QKDLLGYLN

SEQ ID NO: 288583 - protein, 9 aa, Homo Sapiens
DSSFAHTAS

SEQ ID NO: 288584 - protein, 9 aa, Homo Sapiens
VTLLEYHEG

SEQ ID NO: 288585 - protein, 9 aa, Homo Sapiens
TESTVPQNQ

SEQ ID NO: 288586 - protein, 9 aa, Homo Sapiens
HRINNTTVI

SEQ ID NO: 288587 - protein, 9 aa, Homo Sapiens
KELETEYAA

SEQ ID NO: 288588 - protein, 9 aa, Homo Sapiens
AWCLWRPQG

SEQ ID NO: 288589 - protein, 9 aa, Homo Sapiens
EDSDDINFE

SEQ ID NO: 288590 - protein, 9 aa, Homo Sapiens
GQQPPPRIK

SEQ ID NO: 288591 - protein, 9 aa, Homo Sapiens
ISIADPLFR

SEQ ID NO: 288592 - protein, 9 aa, Homo Sapiens
GLQADALYE

SEQ ID NO: 288593 - protein, 9 aa, Homo Sapiens
SSQLMMDGA

SEQ ID NO: 288594 - protein, 9 aa, Homo Sapiens
RKFIFKDKE

SEQ ID NO: 288595 - protein, 9 aa, Homo Sapiens
LSLHCSWNY

SEQ ID NO: 288596 - protein, 9 aa, Homo Sapiens
TDFQFGREY

SEQ ID NO: 288597 - protein, 9 aa, Homo Sapiens
CPRVIHLHE

SEQ ID NO: 288598 - protein, 9 aa, Homo Sapiens
TPLSGRKLQ

SEQ ID NO: 288599 - protein, 9 aa, Homo Sapiens
KTKTPRSAY

SEQ ID NO: 288600 - protein, 9 aa, Homo Sapiens
FDKMKGQML

SEQ ID NO: 288601 - protein, 9 aa, Homo Sapiens
IFVSSYVSE

SEQ ID NO: 288602 - protein, 9 aa, Homo Sapiens
VFAPILSFL

SEQ ID NO: 288603 - protein, 9 aa, Homo Sapiens
NNNRTLDFK

SEQ ID NO: 288604 - protein, 9 aa, Homo Sapiens
APVSLAAAK

SEQ ID NO: 288605 - protein, 9 aa, Homo Sapiens
SNGGSPCTT

SEQ ID NO: 288606 - protein, 9 aa, Homo Sapiens
LSSAFGLDR

SEQ ID NO: 288607 - protein, 9 aa, Homo Sapiens
DNIFDWNVK

SEQ ID NO: 288608 - protein, 9 aa, Homo Sapiens
FQYGHLISG

SEQ ID NO: 288609 - protein, 9 aa, Homo Sapiens
KNKNKLPKL

SEQ ID NO: 288610 - protein, 9 aa, Homo Sapiens
LLVIKNHKQ

SEQ ID NO: 288611 - protein, 9 aa, Homo Sapiens
STRGRQVDS

SEQ ID NO: 288612 - protein, 9 aa, Homo Sapiens
HVIGGTDKG

SEQ ID NO: 288613 - protein, 9 aa, Homo Sapiens
VAINQVLDW

SEQ ID NO: 288614 - protein, 9 aa, Homo Sapiens
TSPTFQRPK

SEQ ID NO: 288615 - protein, 9 aa, Homo Sapiens
KVRERLRAS

SEQ ID NO: 288616 - protein, 9 aa, Homo Sapiens
ILDIATKRK

SEQ ID NO: 288617 - protein, 9 aa, Homo Sapiens
GDKFKTPAT

SEQ ID NO: 288618 - protein, 9 aa, Homo Sapiens
KTLDREEIK

SEQ ID NO: 288619 - protein, 9 aa, Homo Sapiens
RFIKCCCFQ

SEQ ID NO: 288620 - protein, 9 aa, Homo Sapiens
DKPLFPLVP

SEQ ID NO: 288621 - protein, 9 aa, Homo Sapiens
KAALEMCQK

SEQ ID NO: 288622 - protein, 9 aa, Homo Sapiens
YGMLSIRVI

SEQ ID NO: 288623 - protein, 9 aa, Homo Sapiens
PLYNWLLIY

SEQ ID NO: 288624 - protein, 9 aa, Homo Sapiens
NHEGEVNCA

SEQ ID NO: 288625 - protein, 9 aa, Homo Sapiens
GDTKWLTLE

SEQ ID NO: 288626 - protein, 9 aa, Homo Sapiens
SEMAEKLFS

SEQ ID NO: 288627 - protein, 9 aa, Homo Sapiens
FVKDVVEKK

SEQ ID NO: 288628 - protein, 9 aa, Homo Sapiens
VLQQNIQGY

SEQ ID NO: 288629 - protein, 9 aa, Homo Sapiens
DFGVAGVEA

SEQ ID NO: 288630 - protein, 9 aa, Homo Sapiens
LKLTRNIDN

SEQ ID NO: 288631 - protein, 9 aa, Homo Sapiens
NSYPRDVVN

SEQ ID NO: 288632 - protein, 9 aa, Homo Sapiens
KMATDISRL

SEQ ID NO: 288633 - protein, 9 aa, Homo Sapiens
PIFYGFLSD

SEQ ID NO: 288634 - protein, 9 aa, Homo Sapiens
LFNCLMYKM

SEQ ID NO: 288635 - protein, 9 aa, Homo Sapiens
YFYLNHFSG

SEQ ID NO: 288636 - protein, 9 aa, Homo Sapiens
GSMINSHLP

SEQ ID NO: 288637 - protein, 9 aa, Homo Sapiens
HIVSIKDYF

SEQ ID NO: 288638 - protein, 9 aa, Homo Sapiens
LGKNLKYRM

SEQ ID NO: 288639 - protein, 9 aa, Homo Sapiens
ICLRCQKGI

SEQ ID NO: 288640 - protein, 9 aa, Homo Sapiens
TAIRFTHAE

SEQ ID NO: 288641 - protein, 9 aa, Homo Sapiens
GSLPHMAEP

SEQ ID NO: 288642 - protein, 9 aa, Homo Sapiens
HFVPALKIG

SEQ ID NO: 288643 - protein, 9 aa, Homo Sapiens
VDYGFVSTL

SEQ ID NO: 288644 - protein, 9 aa, Homo Sapiens
QNIRKDTRE

SEQ ID NO: 288645 - protein, 9 aa, Homo Sapiens
QFLQPAALA

SEQ ID NO: 288646 - protein, 9 aa, Homo Sapiens
SSVLPNPTL

SEQ ID NO: 288647 - protein, 9 aa, Homo Sapiens
ATKAMLNKP

SEQ ID NO: 288648 - protein, 9 aa, Homo Sapiens
AFLQGKRKG

SEQ ID NO: 288649 - protein, 9 aa, Homo Sapiens
QYQIRKRGN

SEQ ID NO: 288650 - protein, 9 aa, Homo Sapiens
EVDTTPPAL

SEQ ID NO: 288651 - protein, 9 aa, Homo Sapiens
DGLRSALED

SEQ ID NO: 288652 - protein, 9 aa, Homo Sapiens
SHLVGHKKI

SEQ ID NO: 288653 - protein, 9 aa, Homo Sapiens
LKSDDGGKV

SEQ ID NO: 288654 - protein, 9 aa, Homo Sapiens
LGITEMFIK

SEQ ID NO: 288655 - protein, 9 aa, Homo Sapiens
QVIFTDCKV

SEQ ID NO: 288656 - protein, 9 aa, Homo Sapiens
LTRNIDNVE

SEQ ID NO: 288657 - protein, 9 aa, Homo Sapiens
REIKRSHSR

SEQ ID NO: 288658 - protein, 9 aa, Homo Sapiens
FDKELLNEK

SEQ ID NO: 288659 - protein, 9 aa, Homo Sapiens
VCCLVPCFI

SEQ ID NO: 288660 - protein, 9 aa, Homo Sapiens
TVEVIITNA

SEQ ID NO: 288661 - protein, 9 aa, Homo Sapiens
AALKMDLLQ

SEQ ID NO: 288662 - protein, 9 aa, Homo Sapiens
LGIPLYGTV

SEQ ID NO: 288663 - protein, 9 aa, Homo Sapiens
EDEVLAFAD

SEQ ID NO: 288664 - protein, 9 aa, Homo Sapiens
TTESSLPAP

SEQ ID NO: 288665 - protein, 9 aa, Homo Sapiens
VYCVNGVGT

SEQ ID NO: 288666 - protein, 9 aa, Homo Sapiens
SGQIISDSV

SEQ ID NO: 288667 - protein, 9 aa, Homo Sapiens
RFNYVNHEF

SEQ ID NO: 288668 - protein, 9 aa, Homo Sapiens
DHLNKLLEK

SEQ ID NO: 288669 - protein, 9 aa, Homo Sapiens
DYHTDIQDI

SEQ ID NO: 288670 - protein, 9 aa, Homo Sapiens
FFTLTLMHL

SEQ ID NO: 288671 - protein, 9 aa, Homo Sapiens
SEGDKKSVP

SEQ ID NO: 288672 - protein, 9 aa, Homo Sapiens
YLQKDGAKE

SEQ ID NO: 288673 - protein, 9 aa, Homo Sapiens
EAPMTLLEF

SEQ ID NO: 288674 - protein, 9 aa, Homo Sapiens
EMKDQGAQM

SEQ ID NO: 288675 - protein, 9 aa, Homo Sapiens
DGSLLYLFP

SEQ ID NO: 288676 - protein, 9 aa, Homo Sapiens
RNSHTDSDS

SEQ ID NO: 288677 - protein, 9 aa, Homo Sapiens
DRKDVAQDD

SEQ ID NO: 288678 - protein, 9 aa, Homo Sapiens
VQNISIETN

SEQ ID NO: 288679 - protein, 9 aa, Homo Sapiens
MAGNDDEDG

SEQ ID NO: 288680 - protein, 9 aa, Homo Sapiens
ENGKPKFDV

SEQ ID NO: 288681 - protein, 9 aa, Homo Sapiens
KPHLPGLLI

SEQ ID NO: 288682 - protein, 9 aa, Homo Sapiens
QILELPLPQ

SEQ ID NO: 288683 - protein, 9 aa, Homo Sapiens
DIIGKADPN

SEQ ID NO: 288684 - protein, 9 aa, Homo Sapiens
NIITSGKMS

SEQ ID NO: 288685 - protein, 9 aa, Homo Sapiens
VINFEMQPI

SEQ ID NO: 288686 - protein, 9 aa, Homo Sapiens
TASKVQASL

SEQ ID NO: 288687 - protein, 9 aa, Homo Sapiens
VLPTCISRR

SEQ ID NO: 288688 - protein, 9 aa, Homo Sapiens
TGDVNRDGK

SEQ ID NO: 288689 - protein, 9 aa, Homo Sapiens
EGNGIDSQY

SEQ ID NO: 288690 - protein, 9 aa, Homo Sapiens
PQIKQLLGK

SEQ ID NO: 288691 - protein, 9 aa, Homo Sapiens
EWVYEEEML

SEQ ID NO: 288692 - protein, 9 aa, Homo Sapiens
SVSSVCMNT

SEQ ID NO: 288693 - protein, 9 aa, Homo Sapiens
IFCPPRKSC

SEQ ID NO: 288694 - protein, 9 aa, Homo Sapiens
IVLQSYPAS

SEQ ID NO: 288695 - protein, 9 aa, Homo Sapiens
AMKGGEYGS

SEQ ID NO: 288696 - protein, 9 aa, Homo Sapiens
HTALRELRP

SEQ ID NO: 288697 - protein, 9 aa, Homo Sapiens
KIWIVYFTH

SEQ ID NO: 288698 - protein, 9 aa, Homo Sapiens
SVTQAGVKW

SEQ ID NO: 288699 - protein, 9 aa, Homo Sapiens
KISRSLFDY

SEQ ID NO: 288700 - protein, 9 aa, Homo Sapiens
INFEPVVQM

SEQ ID NO: 288701 - protein, 9 aa, Homo Sapiens
PGGTLCQGK

SEQ ID NO: 288702 - protein, 9 aa, Homo Sapiens
LPGPHDPAD

SEQ ID NO: 288703 - protein, 9 aa, Homo Sapiens
FVKVKRTAL

SEQ ID NO: 288704 - protein, 9 aa, Homo Sapiens
ICFDSSRPE

SEQ ID NO: 288705 - protein, 9 aa, Homo Sapiens
CEDVWQCWW

SEQ ID NO: 288706 - protein, 9 aa, Homo Sapiens
KSKGKSPHN

SEQ ID NO: 288707 - protein, 9 aa, Homo Sapiens
SLQKSRTEM

SEQ ID NO: 288708 - protein, 9 aa, Homo Sapiens
LFKGLSCAN

SEQ ID NO: 288709 - protein, 9 aa, Homo Sapiens
IPGIVDFEW

SEQ ID NO: 288710 - protein, 9 aa, Homo Sapiens
SSVYEQLIY

SEQ ID NO: 288711 - protein, 9 aa, Homo Sapiens
MLKQHLKNR

SEQ ID NO: 288712 - protein, 9 aa, Homo Sapiens
DGFKITEDG

SEQ ID NO: 288713 - protein, 9 aa, Homo Sapiens
GLMGETKVK

SEQ ID NO: 288714 - protein, 9 aa, Homo Sapiens
WSREHLKLS

SEQ ID NO: 288715 - protein, 9 aa, Homo Sapiens
WVSAQACNE

SEQ ID NO: 288716 - protein, 9 aa, Homo Sapiens
EILSPTYPQ

SEQ ID NO: 288717 - protein, 9 aa, Homo Sapiens
EDDEYAPMI

SEQ ID NO: 288718 - protein, 9 aa, Homo Sapiens
DEIIPCHRR

SEQ ID NO: 288719 - protein, 9 aa, Homo Sapiens
LLITQATPP

SEQ ID NO: 288720 - protein, 9 aa, Homo Sapiens
LLAWVTSKC

SEQ ID NO: 288721 - protein, 9 aa, Homo Sapiens
AFADSQVNQ

SEQ ID NO: 288722 - protein, 9 aa, Homo Sapiens
FSEYLGAIY

SEQ ID NO: 288723 - protein, 9 aa, Homo Sapiens
ADLSHLICH

SEQ ID NO: 288724 - protein, 9 aa, Homo Sapiens
LEEVRKKSK

SEQ ID NO: 288725 - protein, 9 aa, Homo Sapiens
LPLQVRLDR

SEQ ID NO: 288726 - protein, 9 aa, Homo Sapiens
HHWTPPRGH

SEQ ID NO: 288727 - protein, 9 aa, Homo Sapiens
GRIVAIKKL

SEQ ID NO: 288728 - protein, 9 aa, Homo Sapiens
KWKRELQQH

SEQ ID NO: 288729 - protein, 9 aa, Homo Sapiens
NCHTTSISD

SEQ ID NO: 288730 - protein, 9 aa, Homo Sapiens
EWGDSEKYQ

SEQ ID NO: 288731 - protein, 9 aa, Homo Sapiens
DPHLVNDPA

SEQ ID NO: 288732 - protein, 9 aa, Homo Sapiens
YGGNCFNCG

SEQ ID NO: 288733 - protein, 9 aa, Homo Sapiens
ISKLAECIR

SEQ ID NO: 288734 - protein, 9 aa, Homo Sapiens
EVEDAVEAI

SEQ ID NO: 288735 - protein, 9 aa, Homo Sapiens
GRYQVSGSG

SEQ ID NO: 288736 - protein, 9 aa, Homo Sapiens
PRDKLAAAE

SEQ ID NO: 288737 - protein, 9 aa, Homo Sapiens
TGPIDLAQN

SEQ ID NO: 288738 - protein, 9 aa, Homo Sapiens
LYEFLGATN

SEQ ID NO: 288739 - protein, 9 aa, Homo Sapiens
FIDHHGNRH

SEQ ID NO: 288740 - protein, 9 aa, Homo Sapiens
SSRTLFFQR

SEQ ID NO: 288741 - protein, 9 aa, Homo Sapiens
IRTLQTKNH

SEQ ID NO: 288742 - protein, 9 aa, Homo Sapiens
NQGRLGRQG

SEQ ID NO: 288743 - protein, 9 aa, Homo Sapiens
GYNANTSII

SEQ ID NO: 288744 - protein, 9 aa, Homo Sapiens
EIINAGSQF

SEQ ID NO: 288745 - protein, 9 aa, Homo Sapiens
QFNTNVVFG

SEQ ID NO: 288746 - protein, 9 aa, Homo Sapiens
FAFIDMPGA

SEQ ID NO: 288747 - protein, 9 aa, Homo Sapiens
ENQNILIQV

SEQ ID NO: 288748 - protein, 9 aa, Homo Sapiens
ITKNCLKHH

SEQ ID NO: 288749 - protein, 9 aa, Homo Sapiens
GELLGTLSP

SEQ ID NO: 288750 - protein, 9 aa, Homo Sapiens
MEDTAFRTD

SEQ ID NO: 288751 - protein, 9 aa, Homo Sapiens
CHTKICHVD

SEQ ID NO: 288752 - protein, 9 aa, Homo Sapiens
DAACIVCPY

SEQ ID NO: 288753 - protein, 9 aa, Homo Sapiens
RFPAEPLGV

SEQ ID NO: 288754 - protein, 9 aa, Homo Sapiens
NSKIEKTDT

SEQ ID NO: 288755 - protein, 9 aa, Homo Sapiens
RHWHWSSGS

SEQ ID NO: 288756 - protein, 9 aa, Homo Sapiens
LQGVALSDL

SEQ ID NO: 288757 - protein, 9 aa, Homo Sapiens
LLFMYFRPC

SEQ ID NO: 288758 - protein, 9 aa, Homo Sapiens
QWSLPFIIF

SEQ ID NO: 288759 - protein, 9 aa, Homo Sapiens
GTDHRSSSY

SEQ ID NO: 288760 - protein, 9 aa, Homo Sapiens
TLIDEQDTP

SEQ ID NO: 288761 - protein, 9 aa, Homo Sapiens
HAHLKEILL

SEQ ID NO: 288762 - protein, 9 aa, Homo Sapiens
DENENVSNC

SEQ ID NO: 288763 - protein, 9 aa, Homo Sapiens
HHDCIIDED

SEQ ID NO: 288764 - protein, 9 aa, Homo Sapiens
CVFDVLIYG

SEQ ID NO: 288765 - protein, 9 aa, Homo Sapiens
YSKIDYFPN

SEQ ID NO: 288766 - protein, 9 aa, Homo Sapiens
AEREIVQDI

SEQ ID NO: 288767 - protein, 9 aa, Homo Sapiens
WIVHGLVPV

SEQ ID NO: 288768 - protein, 9 aa, Homo Sapiens
LHYFDHFHS

SEQ ID NO: 288769 - protein, 9 aa, Homo Sapiens
RHERRKRYN

SEQ ID NO: 288770 - protein, 9 aa, Homo Sapiens
SSVHWPIFK

SEQ ID NO: 288771 - protein, 9 aa, Homo Sapiens
TVGNDSCFC

SEQ ID NO: 288772 - protein, 9 aa, Homo Sapiens
KLGSANGVT

SEQ ID NO: 288773 - protein, 9 aa, Homo Sapiens
VIAFFPAFS

SEQ ID NO: 288774 - protein, 9 aa, Homo Sapiens
VITRNLPDS

SEQ ID NO: 288775 - protein, 9 aa, Homo Sapiens
VKLFPKSKS

SEQ ID NO: 288776 - protein, 9 aa, Homo Sapiens
KRTNQSSKN

SEQ ID NO: 288777 - protein, 9 aa, Homo Sapiens
ASDDTPELC

SEQ ID NO: 288778 - protein, 9 aa, Homo Sapiens
NQNKSVVRS

SEQ ID NO: 288779 - protein, 9 aa, Homo Sapiens
STLGQIQNL

SEQ ID NO: 288780 - protein, 9 aa, Homo Sapiens
CSKFLRRCN

SEQ ID NO: 288781 - protein, 9 aa, Homo Sapiens
EVIIKDTSL

SEQ ID NO: 288782 - protein, 9 aa, Homo Sapiens
DEEGISPLV

SEQ ID NO: 288783 - protein, 9 aa, Homo Sapiens
SISLAIALL

SEQ ID NO: 288784 - protein, 9 aa, Homo Sapiens
KEKGIPFNR

SEQ ID NO: 288785 - protein, 9 aa, Homo Sapiens
QNYSTMFAE

SEQ ID NO: 288786 - protein, 9 aa, Homo Sapiens
DNARKIRTV

SEQ ID NO: 288787 - protein, 9 aa, Homo Sapiens
LEFLWTFRH

SEQ ID NO: 288788 - protein, 9 aa, Homo Sapiens
VREKRRNAT

SEQ ID NO: 288789 - protein, 9 aa, Homo Sapiens
ELWNKYKDG

SEQ ID NO: 288790 - protein, 9 aa, Homo Sapiens
SNPWGPRPL

SEQ ID NO: 288791 - protein, 9 aa, Homo Sapiens
RRKNIQLLK

SEQ ID NO: 288792 - protein, 9 aa, Homo Sapiens
FGDSKEIVR

SEQ ID NO: 288793 - protein, 9 aa, Homo Sapiens
YNPENVETC

SEQ ID NO: 288794 - protein, 9 aa, Homo Sapiens
AIQLAKEKT

SEQ ID NO: 288795 - protein, 9 aa, Homo Sapiens
SSRFSIYTT

SEQ ID NO: 288796 - protein, 9 aa, Homo Sapiens
NIVFTGLSQ

SEQ ID NO: 288797 - protein, 9 aa, Homo Sapiens
KSINVFFKE

SEQ ID NO: 288798 - protein, 9 aa, Homo Sapiens
KDVQNLSVG

SEQ ID NO: 288799 - protein, 9 aa, Homo Sapiens
LFNVGGIIG

SEQ ID NO: 288800 - protein, 9 aa, Homo Sapiens
TKNCCGPSV

SEQ ID NO: 288801 - protein, 9 aa, Homo Sapiens
FFPAFSYKP

SEQ ID NO: 288802 - protein, 9 aa, Homo Sapiens
RGAMVIHAT

SEQ ID NO: 288803 - protein, 9 aa, Homo Sapiens
LGMSLVILP

SEQ ID NO: 288804 - protein, 9 aa, Homo Sapiens
IAIVVTVLL

SEQ ID NO: 288805 - protein, 9 aa, Homo Sapiens
KGDYAVEDK

SEQ ID NO: 288806 - protein, 9 aa, Homo Sapiens
KDNENFLSV

SEQ ID NO: 288807 - protein, 9 aa, Homo Sapiens
FLWVGKLVD

SEQ ID NO: 288808 - protein, 9 aa, Homo Sapiens
VSYSADETE

SEQ ID NO: 288809 - protein, 9 aa, Homo Sapiens
LSDPESEAK

SEQ ID NO: 288810 - protein, 9 aa, Homo Sapiens
SPASGAYIV

SEQ ID NO: 288811 - protein, 9 aa, Homo Sapiens
QLSAELKNA

SEQ ID NO: 288812 - protein, 9 aa, Homo Sapiens
FYFCYRWLL

SEQ ID NO: 288813 - protein, 9 aa, Homo Sapiens
PVFTEVDNF

SEQ ID NO: 288814 - protein, 9 aa, Homo Sapiens
KAGSPTLFN

SEQ ID NO: 288815 - protein, 9 aa, Homo Sapiens
NIKYREKFT

SEQ ID NO: 288816 - protein, 9 aa, Homo Sapiens
RSAQEIDET

SEQ ID NO: 288817 - protein, 9 aa, Homo Sapiens
DDSQDVCIP

SEQ ID NO: 288818 - protein, 9 aa, Homo Sapiens
AMRRSLEDG

SEQ ID NO: 288819 - protein, 9 aa, Homo Sapiens
VVNYNLLKH

SEQ ID NO: 288820 - protein, 9 aa, Homo Sapiens
TLITELCKR

SEQ ID NO: 288821 - protein, 9 aa, Homo Sapiens
VLMDLINKY

SEQ ID NO: 288822 - protein, 9 aa, Homo Sapiens
WRKVKCASC

SEQ ID NO: 288823 - protein, 9 aa, Homo Sapiens
PLQFDLCKH

SEQ ID NO: 288824 - protein, 9 aa, Homo Sapiens
DSRLNSPLY

SEQ ID NO: 288825 - protein, 9 aa, Homo Sapiens
TDTCFLGAP

SEQ ID NO: 288826 - protein, 9 aa, Homo Sapiens
PRGFKFNTD

SEQ ID NO: 288827 - protein, 9 aa, Homo Sapiens
GKNAEDVHH

SEQ ID NO: 288828 - protein, 9 aa, Homo Sapiens
LQCRRIELT

SEQ ID NO: 288829 - protein, 9 aa, Homo Sapiens
ALFIIAIVV

SEQ ID NO: 288830 - protein, 9 aa, Homo Sapiens
ERTKVLHKK

SEQ ID NO: 288831 - protein, 9 aa, Homo Sapiens
IFEKISNII

SEQ ID NO: 288832 - protein, 9 aa, Homo Sapiens
LIATHSRNI

SEQ ID NO: 288833 - protein, 9 aa, Homo Sapiens
SHPGLHHGR

SEQ ID NO: 288834 - protein, 9 aa, Homo Sapiens
ESNKLADME

SEQ ID NO: 288835 - protein, 9 aa, Homo Sapiens
LLQETWLEN

SEQ ID NO: 288836 - protein, 9 aa, Homo Sapiens
ILLYIMNQV

SEQ ID NO: 288837 - protein, 9 aa, Homo Sapiens
PGFPVKIGI

SEQ ID NO: 288838 - protein, 9 aa, Homo Sapiens
SENQNESIN

SEQ ID NO: 288839 - protein, 9 aa, Homo Sapiens
KNNIKTRSA

SEQ ID NO: 288840 - protein, 9 aa, Homo Sapiens
RESKSKLLQ

SEQ ID NO: 288841 - protein, 9 aa, Homo Sapiens
QIQGYPLHL

SEQ ID NO: 288842 - protein, 9 aa, Homo Sapiens
CLYRKDGSA

SEQ ID NO: 288843 - protein, 9 aa, Homo Sapiens
KRKKDSPFW

SEQ ID NO: 288844 - protein, 9 aa, Homo Sapiens
IVTEFGGSA

SEQ ID NO: 288845 - protein, 9 aa, Homo Sapiens
TPLPSTVPR

SEQ ID NO: 288846 - protein, 9 aa, Homo Sapiens
KEDDKQYMK

SEQ ID NO: 288847 - protein, 9 aa, Homo Sapiens
KVYCVVLVI

SEQ ID NO: 288848 - protein, 9 aa, Homo Sapiens
KYFTSHSTL

SEQ ID NO: 288849 - protein, 9 aa, Homo Sapiens
NSLLRYKGP

SEQ ID NO: 288850 - protein, 9 aa, Homo Sapiens
PPGSVPSHS

SEQ ID NO: 288851 - protein, 9 aa, Homo Sapiens
LPQPPFLYP

SEQ ID NO: 288852 - protein, 9 aa, Homo Sapiens
SLEEENQCK

SEQ ID NO: 288853 - protein, 9 aa, Homo Sapiens
ETLYSTGSL

SEQ ID NO: 288854 - protein, 9 aa, Homo Sapiens
GNCSKQHLR

SEQ ID NO: 288855 - protein, 9 aa, Homo Sapiens
GFHYDVISC

SEQ ID NO: 288856 - protein, 9 aa, Homo Sapiens
KNDSALKIK

SEQ ID NO: 288857 - protein, 9 aa, Homo Sapiens
IITYREQIF

SEQ ID NO: 288858 - protein, 9 aa, Homo Sapiens
AGHRFSNAG

SEQ ID NO: 288859 - protein, 9 aa, Homo Sapiens
GFLCEVPTM

SEQ ID NO: 288860 - protein, 9 aa, Homo Sapiens
FRVASKIHG

SEQ ID NO: 288861 - protein, 9 aa, Homo Sapiens
VCGKQISKQ

SEQ ID NO: 288862 - protein, 9 aa, Homo Sapiens
PLSPGFKRL

SEQ ID NO: 288863 - protein, 9 aa, Homo Sapiens
SSGKRLSSV

SEQ ID NO: 288864 - protein, 9 aa, Homo Sapiens
EESCKLRHL

SEQ ID NO: 288865 - protein, 9 aa, Homo Sapiens
NKLLEKSNP

SEQ ID NO: 288866 - protein, 9 aa, Homo Sapiens
NDSHMLVAL

SEQ ID NO: 288867 - protein, 9 aa, Homo Sapiens
TFSENMSKL

SEQ ID NO: 288868 - protein, 9 aa, Homo Sapiens
VFLDNRIVA

SEQ ID NO: 288869 - protein, 9 aa, Homo Sapiens
NLLKHICRF

SEQ ID NO: 288870 - protein, 9 aa, Homo Sapiens
QALKDPNQL

SEQ ID NO: 288871 - protein, 9 aa, Homo Sapiens
QKINGICIS

SEQ ID NO: 288872 - protein, 9 aa, Homo Sapiens
PSQPTTDIS

SEQ ID NO: 288873 - protein, 9 aa, Homo Sapiens
IANVLKKIA

SEQ ID NO: 288874 - protein, 9 aa, Homo Sapiens
WYMRFVTVW

SEQ ID NO: 288875 - protein, 9 aa, Homo Sapiens
VGPLLFCTQ

SEQ ID NO: 288876 - protein, 9 aa, Homo Sapiens
HSGDDVSEQ

SEQ ID NO: 288877 - protein, 9 aa, Homo Sapiens
SDKTNELWN

SEQ ID NO: 288878 - protein, 9 aa, Homo Sapiens
AVFRFKVLM

SEQ ID NO: 288879 - protein, 9 aa, Homo Sapiens
AFFSPSLLK

SEQ ID NO: 288880 - protein, 9 aa, Homo Sapiens
HSFAFTPIY

SEQ ID NO: 288881 - protein, 9 aa, Homo Sapiens
QLNSEASLL

SEQ ID NO: 288882 - protein, 9 aa, Homo Sapiens
NSILYHNLM

SEQ ID NO: 288883 - protein, 9 aa, Homo Sapiens
LISLYLACW

SEQ ID NO: 288884 - protein, 9 aa, Homo Sapiens
SNDLVAFEH

SEQ ID NO: 288885 - protein, 9 aa, Homo Sapiens
PAVMLIFGV

SEQ ID NO: 288886 - protein, 9 aa, Homo Sapiens
LNKGNKLMH

SEQ ID NO: 288887 - protein, 9 aa, Homo Sapiens
KYLNMNVNS

SEQ ID NO: 288888 - protein, 9 aa, Homo Sapiens
HRNLMQETH

SEQ ID NO: 288889 - protein, 9 aa, Homo Sapiens
DDKTVTSTD

SEQ ID NO: 288890 - protein, 9 aa, Homo Sapiens
TADLDNIFD

SEQ ID NO: 288891 - protein, 9 aa, Homo Sapiens
SVHFLDSKL

SEQ ID NO: 288892 - protein, 9 aa, Homo Sapiens
NLNMLQCRS

SEQ ID NO: 288893 - protein, 9 aa, Homo Sapiens
NFQHISPNR

SEQ ID NO: 288894 - protein, 9 aa, Homo Sapiens
SNKGTVQSK

SEQ ID NO: 288895 - protein, 9 aa, Homo Sapiens
ADPDNSGLT

SEQ ID NO: 288896 - protein, 9 aa, Homo Sapiens
VERLAKAQE

SEQ ID NO: 288897 - protein, 9 aa, Homo Sapiens
IYSYSYLVH

SEQ ID NO: 288898 - protein, 9 aa, Homo Sapiens
HTGTLQRHA

SEQ ID NO: 288899 - protein, 9 aa, Homo Sapiens
NERENFRST

SEQ ID NO: 288900 - protein, 9 aa, Homo Sapiens
RQSTYNLIN

SEQ ID NO: 288901 - protein, 9 aa, Homo Sapiens
LGEFAMLLQ

SEQ ID NO: 288902 - protein, 9 aa, Homo Sapiens
HRVFVQEEL

SEQ ID NO: 288903 - protein, 9 aa, Homo Sapiens
NSAFECGTY

SEQ ID NO: 288904 - protein, 9 aa, Homo Sapiens
LGDQSAALL

SEQ ID NO: 288905 - protein, 9 aa, Homo Sapiens
FQGSVTLKD

SEQ ID NO: 288906 - protein, 9 aa, Homo Sapiens
HPDVRVVGV

SEQ ID NO: 288907 - protein, 9 aa, Homo Sapiens
GVQVLQDNF

SEQ ID NO: 288908 - protein, 9 aa, Homo Sapiens
DLSIEKLSE

SEQ ID NO: 288909 - protein, 9 aa, Homo Sapiens
QLSCIKTLN

SEQ ID NO: 288910 - protein, 9 aa, Homo Sapiens
VDLIQSQVQ

SEQ ID NO: 288911 - protein, 9 aa, Homo Sapiens
LVVFVYFWQ

SEQ ID NO: 288912 - protein, 9 aa, Homo Sapiens
KPAVTTAPK

SEQ ID NO: 288913 - protein, 9 aa, Homo Sapiens
SLQIQKVDV

SEQ ID NO: 288914 - protein, 9 aa, Homo Sapiens
LAKIPQKVM

SEQ ID NO: 288915 - protein, 9 aa, Homo Sapiens
YKRIAPRYR

SEQ ID NO: 288916 - protein, 9 aa, Homo Sapiens
EELSRTKFR

SEQ ID NO: 288917 - protein, 9 aa, Homo Sapiens
KNEGLICKA

SEQ ID NO: 288918 - protein, 9 aa, Homo Sapiens
YYNVDFGQP

SEQ ID NO: 288919 - protein, 9 aa, Homo Sapiens
DTYNNELSM

SEQ ID NO: 288920 - protein, 9 aa, Homo Sapiens
READECIKS

SEQ ID NO: 288921 - protein, 9 aa, Homo Sapiens
SNGIPKLTP

SEQ ID NO: 288922 - protein, 9 aa, Homo Sapiens
PLSQDEGIL

SEQ ID NO: 288923 - protein, 9 aa, Homo Sapiens
RGLDIRKDK

SEQ ID NO: 288924 - protein, 9 aa, Homo Sapiens
IGIYCAVHF

SEQ ID NO: 288925 - protein, 9 aa, Homo Sapiens
SENFILEVE

SEQ ID NO: 288926 - protein, 9 aa, Homo Sapiens
VMNDSLFCV

SEQ ID NO: 288927 - protein, 9 aa, Homo Sapiens
APHRIRLHG

SEQ ID NO: 288928 - protein, 9 aa, Homo Sapiens
ESIVTLNVR

SEQ ID NO: 288929 - protein, 9 aa, Homo Sapiens
CHSKESGDF

SEQ ID NO: 288930 - protein, 9 aa, Homo Sapiens
EADHYLTDA

SEQ ID NO: 288931 - protein, 9 aa, Homo Sapiens
GKNFSQSQY

SEQ ID NO: 288932 - protein, 9 aa, Homo Sapiens
FRVRLLAAA

SEQ ID NO: 288933 - protein, 9 aa, Homo Sapiens
MKQFLDFGF

SEQ ID NO: 288934 - protein, 9 aa, Homo Sapiens
NSEAITLTD

SEQ ID NO: 288935 - protein, 9 aa, Homo Sapiens
LDECKLQKY

SEQ ID NO: 288936 - protein, 9 aa, Homo Sapiens
DDCAQVEEG

SEQ ID NO: 288937 - protein, 9 aa, Homo Sapiens
RSHFQHVKR

SEQ ID NO: 288938 - protein, 9 aa, Homo Sapiens
PSEKVKKII

SEQ ID NO: 288939 - protein, 9 aa, Homo Sapiens
PAGVQMNKY

SEQ ID NO: 288940 - protein, 9 aa, Homo Sapiens
NERSHMPDT

SEQ ID NO: 288941 - protein, 9 aa, Homo Sapiens
NRVLSSSNP

SEQ ID NO: 288942 - protein, 9 aa, Homo Sapiens
STLFCSRSF

SEQ ID NO: 288943 - protein, 9 aa, Homo Sapiens
EYDLLCTIM

SEQ ID NO: 288944 - protein, 9 aa, Homo Sapiens
KEALDPIDC

SEQ ID NO: 288945 - protein, 9 aa, Homo Sapiens
LFTVEPQHI

SEQ ID NO: 288946 - protein, 9 aa, Homo Sapiens
SLASEQYDK

SEQ ID NO: 288947 - protein, 9 aa, Homo Sapiens
SHQSLVAQQ

SEQ ID NO: 288948 - protein, 9 aa, Homo Sapiens
HARNNYKGY

SEQ ID NO: 288949 - protein, 9 aa, Homo Sapiens
KVKKAENKL

SEQ ID NO: 288950 - protein, 9 aa, Homo Sapiens
DCLVELECF

SEQ ID NO: 288951 - protein, 9 aa, Homo Sapiens
AGKEYILPA

SEQ ID NO: 288952 - protein, 9 aa, Homo Sapiens
EVEIARFII

SEQ ID NO: 288953 - protein, 9 aa, Homo Sapiens
HPFFSAIDL

SEQ ID NO: 288954 - protein, 9 aa, Homo Sapiens
KDQGEQCDN

SEQ ID NO: 288955 - protein, 9 aa, Homo Sapiens
FMLFFVLYG

SEQ ID NO: 288956 - protein, 9 aa, Homo Sapiens
RGKKYLMLE

SEQ ID NO: 288957 - protein, 9 aa, Homo Sapiens
WTVRSDSKL

SEQ ID NO: 288958 - protein, 9 aa, Homo Sapiens
EKCCLTECT

SEQ ID NO: 288959 - protein, 9 aa, Homo Sapiens
SEINQLRGE

SEQ ID NO: 288960 - protein, 9 aa, Homo Sapiens
QGTFYGEEN

SEQ ID NO: 288961 - protein, 9 aa, Homo Sapiens
KKVLQQMPN

SEQ ID NO: 288962 - protein, 9 aa, Homo Sapiens
EIKLCQEND

SEQ ID NO: 288963 - protein, 9 aa, Homo Sapiens
TKMALNPRK

SEQ ID NO: 288964 - protein, 9 aa, Homo Sapiens
LRYFSGIKG

SEQ ID NO: 288965 - protein, 9 aa, Homo Sapiens
YVTDTNNHQ

SEQ ID NO: 288966 - protein, 9 aa, Homo Sapiens
EELGAPAKS

SEQ ID NO: 288967 - protein, 9 aa, Homo Sapiens
DGKKAMSIF

SEQ ID NO: 288968 - protein, 9 aa, Homo Sapiens
WRLQMALEE

SEQ ID NO: 288969 - protein, 9 aa, Homo Sapiens
IYIAKGCNP

SEQ ID NO: 288970 - protein, 9 aa, Homo Sapiens
LAAGFSCCS

SEQ ID NO: 288971 - protein, 9 aa, Homo Sapiens
VMTKTVPCG

SEQ ID NO: 288972 - protein, 9 aa, Homo Sapiens
DSKPHLPGL

SEQ ID NO: 288973 - protein, 9 aa, Homo Sapiens
VATWLIGLD

SEQ ID NO: 288974 - protein, 9 aa, Homo Sapiens
LDRKDKTTF

SEQ ID NO: 288975 - protein, 9 aa, Homo Sapiens
YNLLKHICR

SEQ ID NO: 288976 - protein, 9 aa, Homo Sapiens
MNVSESHVV

SEQ ID NO: 288977 - protein, 9 aa, Homo Sapiens
VTLVTPPQD

SEQ ID NO: 288978 - protein, 9 aa, Homo Sapiens
LCSRCHIIS

SEQ ID NO: 288979 - protein, 9 aa, Homo Sapiens
TLVISAMVS

SEQ ID NO: 288980 - protein, 9 aa, Homo Sapiens
VNRQVMMKF

SEQ ID NO: 288981 - protein, 9 aa, Homo Sapiens
LFWKTFFLY

SEQ ID NO: 288982 - protein, 9 aa, Homo Sapiens
FRVETPEER

SEQ ID NO: 288983 - protein, 9 aa, Homo Sapiens
QTPLFQPNE

SEQ ID NO: 288984 - protein, 9 aa, Homo Sapiens
GSEQTFLIG

SEQ ID NO: 288985 - protein, 9 aa, Homo Sapiens
ASPLLRCPL

SEQ ID NO: 288986 - protein, 9 aa, Homo Sapiens
AVNEHGNVS

SEQ ID NO: 288987 - protein, 9 aa, Homo Sapiens
DYDPDDHPE

SEQ ID NO: 288988 - protein, 9 aa, Homo Sapiens
HEPFASVAA

SEQ ID NO: 288989 - protein, 9 aa, Homo Sapiens
KVVAVTFFS

SEQ ID NO: 288990 - protein, 9 aa, Homo Sapiens
MNYQGRYEI

SEQ ID NO: 288991 - protein, 9 aa, Homo Sapiens
IKDSDNVEL

SEQ ID NO: 288992 - protein, 9 aa, Homo Sapiens
CYMLPLVLC

SEQ ID NO: 288993 - protein, 9 aa, Homo Sapiens
GACMPVLVL

SEQ ID NO: 288994 - protein, 9 aa, Homo Sapiens
HNPKVFPGN

SEQ ID NO: 288995 - protein, 9 aa, Homo Sapiens
GGLVFNTGI

SEQ ID NO: 288996 - protein, 9 aa, Homo Sapiens
QQEIVALLN

SEQ ID NO: 288997 - protein, 9 aa, Homo Sapiens
HMGKRINHH

SEQ ID NO: 288998 - protein, 9 aa, Homo Sapiens
YVPEHKLHL

SEQ ID NO: 288999 - protein, 9 aa, Homo Sapiens
IIKILFARG

SEQ ID NO: 289000 - protein, 9 aa, Homo Sapiens
NSTIGAYFL

SEQ ID NO: 289001 - protein, 9 aa, Homo Sapiens
FGSWFGHIK

SEQ ID NO: 289002 - protein, 9 aa, Homo Sapiens
GNKLMHCRS

SEQ ID NO: 289003 - protein, 9 aa, Homo Sapiens
ASSPQAVPT

SEQ ID NO: 289004 - protein, 9 aa, Homo Sapiens
QMTFLWLLS

SEQ ID NO: 289005 - protein, 9 aa, Homo Sapiens
LFNKNFVPV

SEQ ID NO: 289006 - protein, 9 aa, Homo Sapiens
SQPSHTENR

SEQ ID NO: 289007 - protein, 9 aa, Homo Sapiens
RGENNELIK

SEQ ID NO: 289008 - protein, 9 aa, Homo Sapiens
SWNDMKPSP

SEQ ID NO: 289009 - protein, 9 aa, Homo Sapiens
KHKRIYMEV

SEQ ID NO: 289010 - protein, 9 aa, Homo Sapiens
KKPFKCKDC

SEQ ID NO: 289011 - protein, 9 aa, Homo Sapiens
FFPDDFKPE

SEQ ID NO: 289012 - protein, 9 aa, Homo Sapiens
SQTFSPGAQ

SEQ ID NO: 289013 - protein, 9 aa, Homo Sapiens
LNIFFSSAD

SEQ ID NO: 289014 - protein, 9 aa, Homo Sapiens
EWSLHKIYV

SEQ ID NO: 289015 - protein, 9 aa, Homo Sapiens
NHQPPQTKA

SEQ ID NO: 289016 - protein, 9 aa, Homo Sapiens
RSPIINVKN

SEQ ID NO: 289017 - protein, 9 aa, Homo Sapiens
LLIPQSSSN

SEQ ID NO: 289018 - protein, 9 aa, Homo Sapiens
LGGTSTSVL

SEQ ID NO: 289019 - protein, 9 aa, Homo Sapiens
TLECEPPQR

SEQ ID NO: 289020 - protein, 9 aa, Homo Sapiens
ELLRKKHTT

SEQ ID NO: 289021 - protein, 9 aa, Homo Sapiens
LHWCNNAPD

SEQ ID NO: 289022 - protein, 9 aa, Homo Sapiens
IKFFVPSWR

SEQ ID NO: 289023 - protein, 9 aa, Homo Sapiens
DMYDLSTNT

SEQ ID NO: 289024 - protein, 9 aa, Homo Sapiens
VPPPRLPAK

SEQ ID NO: 289025 - protein, 9 aa, Homo Sapiens
LETICYLAA

SEQ ID NO: 289026 - protein, 9 aa, Homo Sapiens
KCHAPETRR

SEQ ID NO: 289027 - protein, 9 aa, Homo Sapiens
LGDIMPISE

SEQ ID NO: 289028 - protein, 9 aa, Homo Sapiens
PDFRGGDCQ

SEQ ID NO: 289029 - protein, 9 aa, Homo Sapiens
LVNNLRKDK

SEQ ID NO: 289030 - protein, 9 aa, Homo Sapiens
AFSYYIHPV

SEQ ID NO: 289031 - protein, 9 aa, Homo Sapiens
LTESVNASF

SEQ ID NO: 289032 - protein, 9 aa, Homo Sapiens
DILDPVEDA

SEQ ID NO: 289033 - protein, 9 aa, Homo Sapiens
ETLSHERLL

SEQ ID NO: 289034 - protein, 9 aa, Homo Sapiens
GSSYIRIFC

SEQ ID NO: 289035 - protein, 9 aa, Homo Sapiens
KHITSEELS

SEQ ID NO: 289036 - protein, 9 aa, Homo Sapiens
RRREIWLQK

SEQ ID NO: 289037 - protein, 9 aa, Homo Sapiens
YLQWLRRIQ

SEQ ID NO: 289038 - protein, 9 aa, Homo Sapiens
IRGFTMPKK

SEQ ID NO: 289039 - protein, 9 aa, Homo Sapiens
AVTAYQSTD

SEQ ID NO: 289040 - protein, 9 aa, Homo Sapiens
SSNLYALHW

SEQ ID NO: 289041 - protein, 9 aa, Homo Sapiens
PLALSTTFE

SEQ ID NO: 289042 - protein, 9 aa, Homo Sapiens
DKIVQYMIE

SEQ ID NO: 289043 - protein, 9 aa, Homo Sapiens
ITNPSQPCS

SEQ ID NO: 289044 - protein, 9 aa, Homo Sapiens
SVTDSSWSA

SEQ ID NO: 289045 - protein, 9 aa, Homo Sapiens
QYESELEPL

SEQ ID NO: 289046 - protein, 9 aa, Homo Sapiens
SCSQKYADY

SEQ ID NO: 289047 - protein, 9 aa, Homo Sapiens
GRNPTIVTY

SEQ ID NO: 289048 - protein, 9 aa, Homo Sapiens
FGIIAFSCP

SEQ ID NO: 289049 - protein, 9 aa, Homo Sapiens
KTLKPTEMK

SEQ ID NO: 289050 - protein, 9 aa, Homo Sapiens
KEQRELVAQ

SEQ ID NO: 289051 - protein, 9 aa, Homo Sapiens
LESAQFLLL

SEQ ID NO: 289052 - protein, 9 aa, Homo Sapiens
SGSESSKNR

SEQ ID NO: 289053 - protein, 9 aa, Homo Sapiens
MDCFWKIAL

SEQ ID NO: 289054 - protein, 9 aa, Homo Sapiens
WALSWRGLH

SEQ ID NO: 289055 - protein, 9 aa, Homo Sapiens
ARECLVKCM

SEQ ID NO: 289056 - protein, 9 aa, Homo Sapiens
AGAWDPTVS

SEQ ID NO: 289057 - protein, 9 aa, Homo Sapiens
PAVFVYTGG

SEQ ID NO: 289058 - protein, 9 aa, Homo Sapiens
CPGPDGYPG

SEQ ID NO: 289059 - protein, 9 aa, Homo Sapiens
LLESRLELQ

SEQ ID NO: 289060 - protein, 9 aa, Homo Sapiens
QELHDGCSE

SEQ ID NO: 289061 - protein, 9 aa, Homo Sapiens
SKKCHLIVH

SEQ ID NO: 289062 - protein, 9 aa, Homo Sapiens
KIGIPLFHV

SEQ ID NO: 289063 - protein, 9 aa, Homo Sapiens
KFTIPDSLD

SEQ ID NO: 289064 - protein, 9 aa, Homo Sapiens
KFHAGYSLK

SEQ ID NO: 289065 - protein, 9 aa, Homo Sapiens
GFNVVTLSG

SEQ ID NO: 289066 - protein, 9 aa, Homo Sapiens
RTNKLLQII

SEQ ID NO: 289067 - protein, 9 aa, Homo Sapiens
CTQELTVFR

SEQ ID NO: 289068 - protein, 9 aa, Homo Sapiens
GCTTFTHLR

SEQ ID NO: 289069 - protein, 9 aa, Homo Sapiens
LNPFIYSLM

SEQ ID NO: 289070 - protein, 9 aa, Homo Sapiens
KGNKLMHCR

SEQ ID NO: 289071 - protein, 9 aa, Homo Sapiens
DVLQGVALS

SEQ ID NO: 289072 - protein, 9 aa, Homo Sapiens
ELPITKYPK

SEQ ID NO: 289073 - protein, 9 aa, Homo Sapiens
CRVSFITQT

SEQ ID NO: 289074 - protein, 9 aa, Homo Sapiens
IFKSQIDNI

SEQ ID NO: 289075 - protein, 9 aa, Homo Sapiens
MNKMGIKSG

SEQ ID NO: 289076 - protein, 9 aa, Homo Sapiens
SDPTLVDKM

SEQ ID NO: 289077 - protein, 9 aa, Homo Sapiens
AQKEMQKTM

SEQ ID NO: 289078 - protein, 9 aa, Homo Sapiens
EINPTEKSR

SEQ ID NO: 289079 - protein, 9 aa, Homo Sapiens
YLSSLHIHE

SEQ ID NO: 289080 - protein, 9 aa, Homo Sapiens
FQILICNRV

SEQ ID NO: 289081 - protein, 9 aa, Homo Sapiens
ACLLLRSIE

SEQ ID NO: 289082 - protein, 9 aa, Homo Sapiens
LNGQHFRSI

SEQ ID NO: 289083 - protein, 9 aa, Homo Sapiens
PTIPPIQVP

SEQ ID NO: 289084 - protein, 9 aa, Homo Sapiens
MLMQKDLKR

SEQ ID NO: 289085 - protein, 9 aa, Homo Sapiens
FTLDYFGEE

SEQ ID NO: 289086 - protein, 9 aa, Homo Sapiens
NHINSKKLN

SEQ ID NO: 289087 - protein, 9 aa, Homo Sapiens
HVQAVPTTT

SEQ ID NO: 289088 - protein, 9 aa, Homo Sapiens
YLTKKHLKK

SEQ ID NO: 289089 - protein, 9 aa, Homo Sapiens
REKTREKEE

SEQ ID NO: 289090 - protein, 9 aa, Homo Sapiens
IQLLKDMQS

SEQ ID NO: 289091 - protein, 9 aa, Homo Sapiens
KEEQQKAWK

SEQ ID NO: 289092 - protein, 9 aa, Homo Sapiens
QRFLVTYIS

SEQ ID NO: 289093 - protein, 9 aa, Homo Sapiens
TAMIRPDHP

SEQ ID NO: 289094 - protein, 9 aa, Homo Sapiens
IFPKKRGPP

SEQ ID NO: 289095 - protein, 9 aa, Homo Sapiens
SCVLQQCLA

SEQ ID NO: 289096 - protein, 9 aa, Homo Sapiens
VQLSYALRT

SEQ ID NO: 289097 - protein, 9 aa, Homo Sapiens
VDEHHHWIS

SEQ ID NO: 289098 - protein, 9 aa, Homo Sapiens
VKNVIAETI

SEQ ID NO: 289099 - protein, 9 aa, Homo Sapiens
ALMLYMKEM

SEQ ID NO: 289100 - protein, 9 aa, Homo Sapiens
YVSQHLGEY

SEQ ID NO: 289101 - protein, 9 aa, Homo Sapiens
GKQREDGHS

SEQ ID NO: 289102 - protein, 9 aa, Homo Sapiens
IILYFRVPV

SEQ ID NO: 289103 - protein, 9 aa, Homo Sapiens
DPERKRFHF

SEQ ID NO: 289104 - protein, 9 aa, Homo Sapiens
VWSAGLTPY

SEQ ID NO: 289105 - protein, 9 aa, Homo Sapiens
QLETTCPQC

SEQ ID NO: 289106 - protein, 9 aa, Homo Sapiens
DMVSQAGLR

SEQ ID NO: 289107 - protein, 9 aa, Homo Sapiens
LNTATTMKD

SEQ ID NO: 289108 - protein, 9 aa, Homo Sapiens
YIAWYCRWI

SEQ ID NO: 289109 - protein, 9 aa, Homo Sapiens
EQIQALHWY

SEQ ID NO: 289110 - protein, 9 aa, Homo Sapiens
HRKSRKEKK

SEQ ID NO: 289111 - protein, 9 aa, Homo Sapiens
DEGMLQPQV

SEQ ID NO: 289112 - protein, 9 aa, Homo Sapiens
EAVNRQVMM

SEQ ID NO: 289113 - protein, 9 aa, Homo Sapiens
DGRHNGYIH

SEQ ID NO: 289114 - protein, 9 aa, Homo Sapiens
YLKHLKGQH

SEQ ID NO: 289115 - protein, 9 aa, Homo Sapiens
LQLESISSG

SEQ ID NO: 289116 - protein, 9 aa, Homo Sapiens
QEWERILYQ

SEQ ID NO: 289117 - protein, 9 aa, Homo Sapiens
QDLVEDYKN

SEQ ID NO: 289118 - protein, 9 aa, Homo Sapiens
RKVEGAPTQ

SEQ ID NO: 289119 - protein, 9 aa, Homo Sapiens
NEMKMIKDE

SEQ ID NO: 289120 - protein, 9 aa, Homo Sapiens
MVPHHSNQN

SEQ ID NO: 289121 - protein, 9 aa, Homo Sapiens
FQINYRQFF

SEQ ID NO: 289122 - protein, 9 aa, Homo Sapiens
TSQEEGSGM

SEQ ID NO: 289123 - protein, 9 aa, Homo Sapiens
SSLRISNIS

SEQ ID NO: 289124 - protein, 9 aa, Homo Sapiens
TAKGAEIKT

SEQ ID NO: 289125 - protein, 9 aa, Homo Sapiens
SPGQSIGIQ

SEQ ID NO: 289126 - protein, 9 aa, Homo Sapiens
TMGKISAPS

SEQ ID NO: 289127 - protein, 9 aa, Homo Sapiens
GVGTQNAHN

SEQ ID NO: 289128 - protein, 9 aa, Homo Sapiens
ETDVRRVLL

SEQ ID NO: 289129 - protein, 9 aa, Homo Sapiens
IIGIYCAVH

SEQ ID NO: 289130 - protein, 9 aa, Homo Sapiens
DFVDLGNVS

SEQ ID NO: 289131 - protein, 9 aa, Homo Sapiens
DLHCDCYTG

SEQ ID NO: 289132 - protein, 9 aa, Homo Sapiens
LGQLRRIQR

SEQ ID NO: 289133 - protein, 9 aa, Homo Sapiens
SVFCNTNQI

SEQ ID NO: 289134 - protein, 9 aa, Homo Sapiens
AAAWKVLSR

SEQ ID NO: 289135 - protein, 9 aa, Homo Sapiens
SFQMHERTH

SEQ ID NO: 289136 - protein, 9 aa, Homo Sapiens
EDAVLYLLD

SEQ ID NO: 289137 - protein, 9 aa, Homo Sapiens
NNKPFTSHR

SEQ ID NO: 289138 - protein, 9 aa, Homo Sapiens
CEGRAAPRQ

SEQ ID NO: 289139 - protein, 9 aa, Homo Sapiens
SLAYQTDNK

SEQ ID NO: 289140 - protein, 9 aa, Homo Sapiens
GDQGVPEYP

SEQ ID NO: 289141 - protein, 9 aa, Homo Sapiens
ITFQNIVVE

SEQ ID NO: 289142 - protein, 9 aa, Homo Sapiens
TEQNQALLQ

SEQ ID NO: 289143 - protein, 9 aa, Homo Sapiens
CNTFRCGET

SEQ ID NO: 289144 - protein, 9 aa, Homo Sapiens
KVLVWNRIY

SEQ ID NO: 289145 - protein, 9 aa, Homo Sapiens
EEEEDDDYD

SEQ ID NO: 289146 - protein, 9 aa, Homo Sapiens
NSFLTLKTH

SEQ ID NO: 289147 - protein, 9 aa, Homo Sapiens
CKRKEIRED

SEQ ID NO: 289148 - protein, 9 aa, Homo Sapiens
CFSQASSLQ

SEQ ID NO: 289149 - protein, 9 aa, Homo Sapiens
RFKGWMSVS

SEQ ID NO: 289150 - protein, 9 aa, Homo Sapiens
LFSPSLDGD

SEQ ID NO: 289151 - protein, 9 aa, Homo Sapiens
RFKEDLKGL

SEQ ID NO: 289152 - protein, 9 aa, Homo Sapiens
EKTKWLDIN

SEQ ID NO: 289153 - protein, 9 aa, Homo Sapiens
ILGFTPEDK

SEQ ID NO: 289154 - protein, 9 aa, Homo Sapiens
QLLCVRECT

SEQ ID NO: 289155 - protein, 9 aa, Homo Sapiens
GSIASLASY

SEQ ID NO: 289156 - protein, 9 aa, Homo Sapiens
VFVYTGGRE

SEQ ID NO: 289157 - protein, 9 aa, Homo Sapiens
KCITECVRT

SEQ ID NO: 289158 - protein, 9 aa, Homo Sapiens
TLKNDAKAP

SEQ ID NO: 289159 - protein, 9 aa, Homo Sapiens
PVSATLSYG

SEQ ID NO: 289160 - protein, 9 aa, Homo Sapiens
TEMPQESFR

SEQ ID NO: 289161 - protein, 9 aa, Homo Sapiens
ATHPNNKPF

SEQ ID NO: 289162 - protein, 9 aa, Homo Sapiens
KFSKDVARE

SEQ ID NO: 289163 - protein, 9 aa, Homo Sapiens
KAKVACVKL

SEQ ID NO: 289164 - protein, 9 aa, Homo Sapiens
DDLIAYVSN

SEQ ID NO: 289165 - protein, 9 aa, Homo Sapiens
FKSMSPQEL

SEQ ID NO: 289166 - protein, 9 aa, Homo Sapiens
NKNYKAEFA

SEQ ID NO: 289167 - protein, 9 aa, Homo Sapiens
LGSIGSAIV

SEQ ID NO: 289168 - protein, 9 aa, Homo Sapiens
RNGINTLGE

SEQ ID NO: 289169 - protein, 9 aa, Homo Sapiens
MVVQHTPEE

SEQ ID NO: 289170 - protein, 9 aa, Homo Sapiens
YQNQHTMNK

SEQ ID NO: 289171 - protein, 9 aa, Homo Sapiens
DSYSKQRMP

SEQ ID NO: 289172 - protein, 9 aa, Homo Sapiens
LTELIRAKL

SEQ ID NO: 289173 - protein, 9 aa, Homo Sapiens
GSSAAYLVC

SEQ ID NO: 289174 - protein, 9 aa, Homo Sapiens
ANIFVPSSY

SEQ ID NO: 289175 - protein, 9 aa, Homo Sapiens
VGPKQYPYT

SEQ ID NO: 289176 - protein, 9 aa, Homo Sapiens
ISSDRGRTT

SEQ ID NO: 289177 - protein, 9 aa, Homo Sapiens
STLRDHHII

SEQ ID NO: 289178 - protein, 9 aa, Homo Sapiens
FPRRPKHML

SEQ ID NO: 289179 - protein, 9 aa, Homo Sapiens
EDSKTLATK

SEQ ID NO: 289180 - protein, 9 aa, Homo Sapiens
AWVTSKCEL

SEQ ID NO: 289181 - protein, 9 aa, Homo Sapiens
QQRDSKETA

SEQ ID NO: 289182 - protein, 9 aa, Homo Sapiens
PELCAALRS

SEQ ID NO: 289183 - protein, 9 aa, Homo Sapiens
KCVEVVKTC

SEQ ID NO: 289184 - protein, 9 aa, Homo Sapiens
NHVQELPYG

SEQ ID NO: 289185 - protein, 9 aa, Homo Sapiens
GVPVFYHNQ

SEQ ID NO: 289186 - protein, 9 aa, Homo Sapiens
RQKNISFNF

SEQ ID NO: 289187 - protein, 9 aa, Homo Sapiens
GTKSYKDSW

SEQ ID NO: 289188 - protein, 9 aa, Homo Sapiens
EKLVWVLFE

SEQ ID NO: 289189 - protein, 9 aa, Homo Sapiens
RQPIDKTAG

SEQ ID NO: 289190 - protein, 9 aa, Homo Sapiens
FRKAEQFCK

SEQ ID NO: 289191 - protein, 9 aa, Homo Sapiens
VQINKQHEV

SEQ ID NO: 289192 - protein, 9 aa, Homo Sapiens
MQLLCEMQN

SEQ ID NO: 289193 - protein, 9 aa, Homo Sapiens
QLSERYNGS

SEQ ID NO: 289194 - protein, 9 aa, Homo Sapiens
HHSPSSTSF

SEQ ID NO: 289195 - protein, 9 aa, Homo Sapiens
NGSDNSHLR

SEQ ID NO: 289196 - protein, 9 aa, Homo Sapiens
VIPSIKDSN

SEQ ID NO: 289197 - protein, 9 aa, Homo Sapiens
ELEESGFDP

SEQ ID NO: 289198 - protein, 9 aa, Homo Sapiens
EEKDKGTAR

SEQ ID NO: 289199 - protein, 9 aa, Homo Sapiens
SRMSFCELF

SEQ ID NO: 289200 - protein, 9 aa, Homo Sapiens
YLGMGPQHA

SEQ ID NO: 289201 - protein, 9 aa, Homo Sapiens
SRHRREMAS

SEQ ID NO: 289202 - protein, 9 aa, Homo Sapiens
GFNASTIIR

SEQ ID NO: 289203 - protein, 9 aa, Homo Sapiens
VRKAVRDIG

SEQ ID NO: 289204 - protein, 9 aa, Homo Sapiens
EKGLELAYL

SEQ ID NO: 289205 - protein, 9 aa, Homo Sapiens
HKMTQRMAL

SEQ ID NO: 289206 - protein, 9 aa, Homo Sapiens
KNVGIYDEG

SEQ ID NO: 289207 - protein, 9 aa, Homo Sapiens
LPPSMSSVM

SEQ ID NO: 289208 - protein, 9 aa, Homo Sapiens
EGESCEVNV

SEQ ID NO: 289209 - protein, 9 aa, Homo Sapiens
QSLVAQQEA

SEQ ID NO: 289210 - protein, 9 aa, Homo Sapiens
YSQDPTMYL

SEQ ID NO: 289211 - protein, 9 aa, Homo Sapiens
ELGDYDPDD

SEQ ID NO: 289212 - protein, 9 aa, Homo Sapiens
LVQEMEVVT

SEQ ID NO: 289213 - protein, 9 aa, Homo Sapiens
HESGEQNKK

SEQ ID NO: 289214 - protein, 9 aa, Homo Sapiens
LQSHLNNSD

SEQ ID NO: 289215 - protein, 9 aa, Homo Sapiens
VFMVIGNRE

SEQ ID NO: 289216 - protein, 9 aa, Homo Sapiens
PDNSGLTLY

SEQ ID NO: 289217 - protein, 9 aa, Homo Sapiens
SIMPNMLGI

SEQ ID NO: 289218 - protein, 9 aa, Homo Sapiens
PSISHLTKD

SEQ ID NO: 289219 - protein, 9 aa, Homo Sapiens
SENQHKERT

SEQ ID NO: 289220 - protein, 9 aa, Homo Sapiens
LSDENSQVP

SEQ ID NO: 289221 - protein, 9 aa, Homo Sapiens
DTAPSRTCP

SEQ ID NO: 289222 - protein, 9 aa, Homo Sapiens
KYELQYVQR

SEQ ID NO: 289223 - protein, 9 aa, Homo Sapiens
PAGAQDALS

SEQ ID NO: 289224 - protein, 9 aa, Homo Sapiens
NFKNSERCQ

SEQ ID NO: 289225 - protein, 9 aa, Homo Sapiens
ALPTCSRLT

SEQ ID NO: 289226 - protein, 9 aa, Homo Sapiens
NTFQYWRNS

SEQ ID NO: 289227 - protein, 9 aa, Homo Sapiens
GPVFYGFKH

SEQ ID NO: 289228 - protein, 9 aa, Homo Sapiens
EKFKRCIRT

SEQ ID NO: 289229 - protein, 9 aa, Homo Sapiens
GRQGNKGEP

SEQ ID NO: 289230 - protein, 9 aa, Homo Sapiens
SNLDPNLSF

SEQ ID NO: 289231 - protein, 9 aa, Homo Sapiens
GEYSRNTKL

SEQ ID NO: 289232 - protein, 9 aa, Homo Sapiens
ATAGLHCQL

SEQ ID NO: 289233 - protein, 9 aa, Homo Sapiens
MYSCWRTNP

SEQ ID NO: 289234 - protein, 9 aa, Homo Sapiens
LSVDNENYA

SEQ ID NO: 289235 - protein, 9 aa, Homo Sapiens
TDHTVLIQT

SEQ ID NO: 289236 - protein, 9 aa, Homo Sapiens
VESLPCDIC

SEQ ID NO: 289237 - protein, 9 aa, Homo Sapiens
FVYTGGRER

SEQ ID NO: 289238 - protein, 9 aa, Homo Sapiens
VPHHSNQNS

SEQ ID NO: 289239 - protein, 9 aa, Homo Sapiens
SISYGSCIS

SEQ ID NO: 289240 - protein, 9 aa, Homo Sapiens
SFTIFFSFP

SEQ ID NO: 289241 - protein, 9 aa, Homo Sapiens
IYKDVEDII

SEQ ID NO: 289242 - protein, 9 aa, Homo Sapiens
NLRSPAEYK

SEQ ID NO: 289243 - protein, 9 aa, Homo Sapiens
RSHPSASSG

SEQ ID NO: 289244 - protein, 9 aa, Homo Sapiens
IQPSPHKPP

SEQ ID NO: 289245 - protein, 9 aa, Homo Sapiens
ANKQLKCTE

SEQ ID NO: 289246 - protein, 9 aa, Homo Sapiens
VQEMEVVTQ

SEQ ID NO: 289247 - protein, 9 aa, Homo Sapiens
YPWFRKAIT

SEQ ID NO: 289248 - protein, 9 aa, Homo Sapiens
RRRRYGQKN

SEQ ID NO: 289249 - protein, 9 aa, Homo Sapiens
DKPYACEEC

SEQ ID NO: 289250 - protein, 9 aa, Homo Sapiens
TKENSRDDS

SEQ ID NO: 289251 - protein, 9 aa, Homo Sapiens
SYPGAQLDI

SEQ ID NO: 289252 - protein, 9 aa, Homo Sapiens
VKIARPKKR

SEQ ID NO: 289253 - protein, 9 aa, Homo Sapiens
NLATVGGQV

SEQ ID NO: 289254 - protein, 9 aa, Homo Sapiens
STDSGFCLY

SEQ ID NO: 289255 - protein, 9 aa, Homo Sapiens
NKFFDYYSK

SEQ ID NO: 289256 - protein, 9 aa, Homo Sapiens
SVELAVEAV

SEQ ID NO: 289257 - protein, 9 aa, Homo Sapiens
DYPEHVCKV

SEQ ID NO: 289258 - protein, 9 aa, Homo Sapiens
KLEHILLFI

SEQ ID NO: 289259 - protein, 9 aa, Homo Sapiens
DSATLLIQA

SEQ ID NO: 289260 - protein, 9 aa, Homo Sapiens
RKTINPVFN

SEQ ID NO: 289261 - protein, 9 aa, Homo Sapiens
VGFFFHIFS

SEQ ID NO: 289262 - protein, 9 aa, Homo Sapiens
PRQSCPGDK

SEQ ID NO: 289263 - protein, 9 aa, Homo Sapiens
LAKDERIYI

SEQ ID NO: 289264 - protein, 9 aa, Homo Sapiens
PYPTPPPPQ

SEQ ID NO: 289265 - protein, 9 aa, Homo Sapiens
DYDDDRLRD

SEQ ID NO: 289266 - protein, 9 aa, Homo Sapiens
GVIGSLKGN

SEQ ID NO: 289267 - protein, 9 aa, Homo Sapiens
YIPKDGETI

SEQ ID NO: 289268 - protein, 9 aa, Homo Sapiens
QSTTFPNNS

SEQ ID NO: 289269 - protein, 9 aa, Homo Sapiens
VSMRTNIKA

SEQ ID NO: 289270 - protein, 9 aa, Homo Sapiens
NTNNLLCLF

SEQ ID NO: 289271 - protein, 9 aa, Homo Sapiens
LQEELKISR

SEQ ID NO: 289272 - protein, 9 aa, Homo Sapiens
WCLLYAGFI

SEQ ID NO: 289273 - protein, 9 aa, Homo Sapiens
VMVAKPPVV

SEQ ID NO: 289274 - protein, 9 aa, Homo Sapiens
YQLTLHQRI

SEQ ID NO: 289275 - protein, 9 aa, Homo Sapiens
TETHKSVPG

SEQ ID NO: 289276 - protein, 9 aa, Homo Sapiens
KFNNMLFPM

SEQ ID NO: 289277 - protein, 9 aa, Homo Sapiens
AVAYGLISC

SEQ ID NO: 289278 - protein, 9 aa, Homo Sapiens
ECIQEPSYV

SEQ ID NO: 289279 - protein, 9 aa, Homo Sapiens
LRPHVLMPE

SEQ ID NO: 289280 - protein, 9 aa, Homo Sapiens
ATSSTSNVS

SEQ ID NO: 289281 - protein, 9 aa, Homo Sapiens
NLEVLMHVS

SEQ ID NO: 289282 - protein, 9 aa, Homo Sapiens
KERSTYLSA

SEQ ID NO: 289283 - protein, 9 aa, Homo Sapiens
VKKSTRERF

SEQ ID NO: 289284 - protein, 9 aa, Homo Sapiens
LGLMVLPFS

SEQ ID NO: 289285 - protein, 9 aa, Homo Sapiens
SEGPLSTTA

SEQ ID NO: 289286 - protein, 9 aa, Homo Sapiens
LPTKEKEAE

SEQ ID NO: 289287 - protein, 9 aa, Homo Sapiens
FNLLDPRET

SEQ ID NO: 289288 - protein, 9 aa, Homo Sapiens
NQTKLECES

SEQ ID NO: 289289 - protein, 9 aa, Homo Sapiens
LHLNIYTPA

SEQ ID NO: 289290 - protein, 9 aa, Homo Sapiens
PGFQNLHID

SEQ ID NO: 289291 - protein, 9 aa, Homo Sapiens
SHANEKTLL

SEQ ID NO: 289292 - protein, 9 aa, Homo Sapiens
IKDFMSTVS

SEQ ID NO: 289293 - protein, 9 aa, Homo Sapiens
GSNKLVVAT

SEQ ID NO: 289294 - protein, 9 aa, Homo Sapiens
VEETADLTL

SEQ ID NO: 289295 - protein, 9 aa, Homo Sapiens
ENLLEMTCY

SEQ ID NO: 289296 - protein, 9 aa, Homo Sapiens
PTQFLRSQQ

SEQ ID NO: 289297 - protein, 9 aa, Homo Sapiens
FSQVVLGVC

SEQ ID NO: 289298 - protein, 9 aa, Homo Sapiens
RHYTKAIGI

SEQ ID NO: 289299 - protein, 9 aa, Homo Sapiens
TLDELMAHL

SEQ ID NO: 289300 - protein, 9 aa, Homo Sapiens
HEDKEDNAR

SEQ ID NO: 289301 - protein, 9 aa, Homo Sapiens
VEFTKHLLT

SEQ ID NO: 289302 - protein, 9 aa, Homo Sapiens
FTEFLATLI

SEQ ID NO: 289303 - protein, 9 aa, Homo Sapiens
IQKELTCVI

SEQ ID NO: 289304 - protein, 9 aa, Homo Sapiens
AVGAPLKVY

SEQ ID NO: 289305 - protein, 9 aa, Homo Sapiens
PMLCSELVE

SEQ ID NO: 289306 - protein, 9 aa, Homo Sapiens
STKVHIQAL

SEQ ID NO: 289307 - protein, 9 aa, Homo Sapiens
QEMASCQQQ

SEQ ID NO: 289308 - protein, 9 aa, Homo Sapiens
EMLQNNPSL

SEQ ID NO: 289309 - protein, 9 aa, Homo Sapiens
KIKSDEQED

SEQ ID NO: 289310 - protein, 9 aa, Homo Sapiens
EVQKVLLYL

SEQ ID NO: 289311 - protein, 9 aa, Homo Sapiens
VWEITDTFR

SEQ ID NO: 289312 - protein, 9 aa, Homo Sapiens
FIILGFSEY

SEQ ID NO: 289313 - protein, 9 aa, Homo Sapiens
PSFLKSDMY

SEQ ID NO: 289314 - protein, 9 aa, Homo Sapiens
EQIDNQTRT

SEQ ID NO: 289315 - protein, 9 aa, Homo Sapiens
DGSVVINAQ

SEQ ID NO: 289316 - protein, 9 aa, Homo Sapiens
KSLPGFQNL

SEQ ID NO: 289317 - protein, 9 aa, Homo Sapiens
LNSTQRVVV

SEQ ID NO: 289318 - protein, 9 aa, Homo Sapiens
RDTLDAGNY

SEQ ID NO: 289319 - protein, 9 aa, Homo Sapiens
VLSPHIKYP

SEQ ID NO: 289320 - protein, 9 aa, Homo Sapiens
VQESFQAIH

SEQ ID NO: 289321 - protein, 9 aa, Homo Sapiens
YRQLALNTP

SEQ ID NO: 289322 - protein, 9 aa, Homo Sapiens
LNVKHHGNG

SEQ ID NO: 289323 - protein, 9 aa, Homo Sapiens
PLATVLIPP

SEQ ID NO: 289324 - protein, 9 aa, Homo Sapiens
DDLVPEAAK

SEQ ID NO: 289325 - protein, 9 aa, Homo Sapiens
QQYPDPHSH

SEQ ID NO: 289326 - protein, 9 aa, Homo Sapiens
NCASDPRGL

SEQ ID NO: 289327 - protein, 9 aa, Homo Sapiens
APVNTQLAI

SEQ ID NO: 289328 - protein, 9 aa, Homo Sapiens
GAAALGSAL

SEQ ID NO: 289329 - protein, 9 aa, Homo Sapiens
LVDQLYSFQ

SEQ ID NO: 289330 - protein, 9 aa, Homo Sapiens
ECKLCLNPK

SEQ ID NO: 289331 - protein, 9 aa, Homo Sapiens
TNYIYVTYN

SEQ ID NO: 289332 - protein, 9 aa, Homo Sapiens
ELFHIDIGG

SEQ ID NO: 289333 - protein, 9 aa, Homo Sapiens
EQAGDLGTE

SEQ ID NO: 289334 - protein, 9 aa, Homo Sapiens
PGCPNYEDK

SEQ ID NO: 289335 - protein, 9 aa, Homo Sapiens
KRLSKRGPR

SEQ ID NO: 289336 - protein, 9 aa, Homo Sapiens
QAGVKWYNH

SEQ ID NO: 289337 - protein, 9 aa, Homo Sapiens
SPLGLKLQR

SEQ ID NO: 289338 - protein, 9 aa, Homo Sapiens
RKFQEEIRQ

SEQ ID NO: 289339 - protein, 9 aa, Homo Sapiens
LGLHSRETP

SEQ ID NO: 289340 - protein, 9 aa, Homo Sapiens
AQISNTLLN

SEQ ID NO: 289341 - protein, 9 aa, Homo Sapiens
PSYRNSLLF

SEQ ID NO: 289342 - protein, 9 aa, Homo Sapiens
AYHSGEGPM

SEQ ID NO: 289343 - protein, 9 aa, Homo Sapiens
MLHSLSLQL

SEQ ID NO: 289344 - protein, 9 aa, Homo Sapiens
QGFRKEAGY

SEQ ID NO: 289345 - protein, 9 aa, Homo Sapiens
LPRTLEASS

SEQ ID NO: 289346 - protein, 9 aa, Homo Sapiens
QFHYFIIIN

SEQ ID NO: 289347 - protein, 9 aa, Homo Sapiens
ISSEAAYHK

SEQ ID NO: 289348 - protein, 9 aa, Homo Sapiens
YFKCEECGK

SEQ ID NO: 289349 - protein, 9 aa, Homo Sapiens
VQIRSDLKA

SEQ ID NO: 289350 - protein, 9 aa, Homo Sapiens
NKFYLDQVA

SEQ ID NO: 289351 - protein, 9 aa, Homo Sapiens
ADDLGFELF

SEQ ID NO: 289352 - protein, 9 aa, Homo Sapiens
SINVFFKEI

SEQ ID NO: 289353 - protein, 9 aa, Homo Sapiens
TLFNNMTSV

SEQ ID NO: 289354 - protein, 9 aa, Homo Sapiens
GKSLEIRRW

SEQ ID NO: 289355 - protein, 9 aa, Homo Sapiens
IHEKTHSGE

SEQ ID NO: 289356 - protein, 9 aa, Homo Sapiens
CGACKAFFK

SEQ ID NO: 289357 - protein, 9 aa, Homo Sapiens
NAILVSLSP

SEQ ID NO: 289358 - protein, 9 aa, Homo Sapiens
GINDKMAEY

SEQ ID NO: 289359 - protein, 9 aa, Homo Sapiens
FNVEEAFIN

SEQ ID NO: 289360 - protein, 9 aa, Homo Sapiens
HYELSRVRE

SEQ ID NO: 289361 - protein, 9 aa, Homo Sapiens
AGGVTKADL

SEQ ID NO: 289362 - protein, 9 aa, Homo Sapiens
WGHQHGYRI

SEQ ID NO: 289363 - protein, 9 aa, Homo Sapiens
KESTCINST

SEQ ID NO: 289364 - protein, 9 aa, Homo Sapiens
GVMPKRGLN

SEQ ID NO: 289365 - protein, 9 aa, Homo Sapiens
REFDMIRGK

SEQ ID NO: 289366 - protein, 9 aa, Homo Sapiens
LYEYFHMSP

SEQ ID NO: 289367 - protein, 9 aa, Homo Sapiens
TSLVQEFPQ

SEQ ID NO: 289368 - protein, 9 aa, Homo Sapiens
LAFYNNASK

SEQ ID NO: 289369 - protein, 9 aa, Homo Sapiens
NLVSLVLGM

SEQ ID NO: 289370 - protein, 9 aa, Homo Sapiens
TIQMWLCKR

SEQ ID NO: 289371 - protein, 9 aa, Homo Sapiens
VILCENKSV

SEQ ID NO: 289372 - protein, 9 aa, Homo Sapiens
ENKIIDRVL

SEQ ID NO: 289373 - protein, 9 aa, Homo Sapiens
YSRVVKVVK

SEQ ID NO: 289374 - protein, 9 aa, Homo Sapiens
ILNILNMVF

SEQ ID NO: 289375 - protein, 9 aa, Homo Sapiens
LDEWKAIQD

SEQ ID NO: 289376 - protein, 9 aa, Homo Sapiens
HINSKKLNN

SEQ ID NO: 289377 - protein, 9 aa, Homo Sapiens
PSPFLPVRW

SEQ ID NO: 289378 - protein, 9 aa, Homo Sapiens
RHQQIHTGR

SEQ ID NO: 289379 - protein, 9 aa, Homo Sapiens
IDLLTNLMY

SEQ ID NO: 289380 - protein, 9 aa, Homo Sapiens
ASRQDKEGA

SEQ ID NO: 289381 - protein, 9 aa, Homo Sapiens
YISRLKESK

SEQ ID NO: 289382 - protein, 9 aa, Homo Sapiens
RPWENLNMS

SEQ ID NO: 289383 - protein, 9 aa, Homo Sapiens
KYQYLLPGR

SEQ ID NO: 289384 - protein, 9 aa, Homo Sapiens
VFEAGPTGT

SEQ ID NO: 289385 - protein, 9 aa, Homo Sapiens
IIGNKMFTH

SEQ ID NO: 289386 - protein, 9 aa, Homo Sapiens
LRCRAFNYY

SEQ ID NO: 289387 - protein, 9 aa, Homo Sapiens
PNPRVSPRY

SEQ ID NO: 289388 - protein, 9 aa, Homo Sapiens
FPQTLEIHW

SEQ ID NO: 289389 - protein, 9 aa, Homo Sapiens
VENGTFIEL

SEQ ID NO: 289390 - protein, 9 aa, Homo Sapiens
TQHQNIHTG

SEQ ID NO: 289391 - protein, 9 aa, Homo Sapiens
ISWILVLEL

SEQ ID NO: 289392 - protein, 9 aa, Homo Sapiens
QGLLHIIPY

SEQ ID NO: 289393 - protein, 9 aa, Homo Sapiens
QKSSGGKST

SEQ ID NO: 289394 - protein, 9 aa, Homo Sapiens
KNITLHCEA

SEQ ID NO: 289395 - protein, 9 aa, Homo Sapiens
NITKKNKLV

SEQ ID NO: 289396 - protein, 9 aa, Homo Sapiens
EEGEMNESV

SEQ ID NO: 289397 - protein, 9 aa, Homo Sapiens
LKRDCGQKM

SEQ ID NO: 289398 - protein, 9 aa, Homo Sapiens
IMADLSSQI

SEQ ID NO: 289399 - protein, 9 aa, Homo Sapiens
YLIRGREAC

SEQ ID NO: 289400 - protein, 9 aa, Homo Sapiens
LLLEEGSKP

SEQ ID NO: 289401 - protein, 9 aa, Homo Sapiens
GFSGPVRSN

SEQ ID NO: 289402 - protein, 9 aa, Homo Sapiens
HTVLIQTRG

SEQ ID NO: 289403 - protein, 9 aa, Homo Sapiens
VSTGTTCIN

SEQ ID NO: 289404 - protein, 9 aa, Homo Sapiens
IHLWKHGIP

SEQ ID NO: 289405 - protein, 9 aa, Homo Sapiens
SHDLSECQG

SEQ ID NO: 289406 - protein, 9 aa, Homo Sapiens
ASTENSEND

SEQ ID NO: 289407 - protein, 9 aa, Homo Sapiens
GQDRKSNLH

SEQ ID NO: 289408 - protein, 9 aa, Homo Sapiens
TAIGFGDYV

SEQ ID NO: 289409 - protein, 9 aa, Homo Sapiens
HSVTQAGVK

SEQ ID NO: 289410 - protein, 9 aa, Homo Sapiens
NVGVLNGGQ

SEQ ID NO: 289411 - protein, 9 aa, Homo Sapiens
FYHQALLFK

SEQ ID NO: 289412 - protein, 9 aa, Homo Sapiens
SDGGTCQGQ

SEQ ID NO: 289413 - protein, 9 aa, Homo Sapiens
AFLQPNNIH

SEQ ID NO: 289414 - protein, 9 aa, Homo Sapiens
TINKLKNEL

SEQ ID NO: 289415 - protein, 9 aa, Homo Sapiens
GVSRPGRDE

SEQ ID NO: 289416 - protein, 9 aa, Homo Sapiens
VLAHKGYFC

SEQ ID NO: 289417 - protein, 9 aa, Homo Sapiens
IQKDFVDIN

SEQ ID NO: 289418 - protein, 9 aa, Homo Sapiens
FSAIDLSSD

SEQ ID NO: 289419 - protein, 9 aa, Homo Sapiens
KDSFHSSRD

SEQ ID NO: 289420 - protein, 9 aa, Homo Sapiens
IKLTLENYV

SEQ ID NO: 289421 - protein, 9 aa, Homo Sapiens
CWRIKKFCE

SEQ ID NO: 289422 - protein, 9 aa, Homo Sapiens
RYLALPGVS

SEQ ID NO: 289423 - protein, 9 aa, Homo Sapiens
REPNLSQKP

SEQ ID NO: 289424 - protein, 9 aa, Homo Sapiens
ERSPEDPTD

SEQ ID NO: 289425 - protein, 9 aa, Homo Sapiens
KEKTEKLEK

SEQ ID NO: 289426 - protein, 9 aa, Homo Sapiens
TLISLENFR

SEQ ID NO: 289427 - protein, 9 aa, Homo Sapiens
LLDLPMQAI

SEQ ID NO: 289428 - protein, 9 aa, Homo Sapiens
KPEKFKRCI

SEQ ID NO: 289429 - protein, 9 aa, Homo Sapiens
SDKTGALTQ

SEQ ID NO: 289430 - protein, 9 aa, Homo Sapiens
VAKEAQAAR

SEQ ID NO: 289431 - protein, 9 aa, Homo Sapiens
KNNITKKNK

SEQ ID NO: 289432 - protein, 9 aa, Homo Sapiens
KYICIVYPC

SEQ ID NO: 289433 - protein, 9 aa, Homo Sapiens
SQKNTKVDL

SEQ ID NO: 289434 - protein, 9 aa, Homo Sapiens
WVWNQLFVL

SEQ ID NO: 289435 - protein, 9 aa, Homo Sapiens
FLDCLLKLG

SEQ ID NO: 289436 - protein, 9 aa, Homo Sapiens
DTKSIYYLG

SEQ ID NO: 289437 - protein, 9 aa, Homo Sapiens
VCKDLQLPP

SEQ ID NO: 289438 - protein, 9 aa, Homo Sapiens
DAEKYGPHS

SEQ ID NO: 289439 - protein, 9 aa, Homo Sapiens
LFAIYLITV

SEQ ID NO: 289440 - protein, 9 aa, Homo Sapiens
LGSYMFRHV

SEQ ID NO: 289441 - protein, 9 aa, Homo Sapiens
FKKKYGDEI

SEQ ID NO: 289442 - protein, 9 aa, Homo Sapiens
VNSGGLHEF

SEQ ID NO: 289443 - protein, 9 aa, Homo Sapiens
GPQIRDLES

SEQ ID NO: 289444 - protein, 9 aa, Homo Sapiens
HGNIYAYME

SEQ ID NO: 289445 - protein, 9 aa, Homo Sapiens
SDLSSFQRH

SEQ ID NO: 289446 - protein, 9 aa, Homo Sapiens
LGIASCLYM

SEQ ID NO: 289447 - protein, 9 aa, Homo Sapiens
NLSENASTN

SEQ ID NO: 289448 - protein, 9 aa, Homo Sapiens
DPTGAGRGG

SEQ ID NO: 289449 - protein, 9 aa, Homo Sapiens
CSTMDPVQK

SEQ ID NO: 289450 - protein, 9 aa, Homo Sapiens
ISWLIFGSV

SEQ ID NO: 289451 - protein, 9 aa, Homo Sapiens
SLNSSNYAS

SEQ ID NO: 289452 - protein, 9 aa, Homo Sapiens
RSSILNANN

SEQ ID NO: 289453 - protein, 9 aa, Homo Sapiens
EITDTFRKV

SEQ ID NO: 289454 - protein, 9 aa, Homo Sapiens
IYIGSEAEK

SEQ ID NO: 289455 - protein, 9 aa, Homo Sapiens
SFLTLKTHH

SEQ ID NO: 289456 - protein, 9 aa, Homo Sapiens
WLSGSLHFA

SEQ ID NO: 289457 - protein, 9 aa, Homo Sapiens
PEITINGPQ

SEQ ID NO: 289458 - protein, 9 aa, Homo Sapiens
LFVMMEAFL

SEQ ID NO: 289459 - protein, 9 aa, Homo Sapiens
KEQEELAQQ

SEQ ID NO: 289460 - protein, 9 aa, Homo Sapiens
KLWKHVRYQ

SEQ ID NO: 289461 - protein, 9 aa, Homo Sapiens
HDTAFVEFE

SEQ ID NO: 289462 - protein, 9 aa, Homo Sapiens
KVRLLEQQN

SEQ ID NO: 289463 - protein, 9 aa, Homo Sapiens
MKQVGTSQS

SEQ ID NO: 289464 - protein, 9 aa, Homo Sapiens
EYSGGNIIR

SEQ ID NO: 289465 - protein, 9 aa, Homo Sapiens
NSEDGDPNA

SEQ ID NO: 289466 - protein, 9 aa, Homo Sapiens
GKDTSTTTS

SEQ ID NO: 289467 - protein, 9 aa, Homo Sapiens
ELISQEPDP

SEQ ID NO: 289468 - protein, 9 aa, Homo Sapiens
AKRLRRKRA

SEQ ID NO: 289469 - protein, 9 aa, Homo Sapiens
RNKNYKAEF

SEQ ID NO: 289470 - protein, 9 aa, Homo Sapiens
YGKFVIKDP

SEQ ID NO: 289471 - protein, 9 aa, Homo Sapiens
APISQRRPS

SEQ ID NO: 289472 - protein, 9 aa, Homo Sapiens
IHNFDCQWR

SEQ ID NO: 289473 - protein, 9 aa, Homo Sapiens
TPVIRAGWL

SEQ ID NO: 289474 - protein, 9 aa, Homo Sapiens
IEELEDVLL

SEQ ID NO: 289475 - protein, 9 aa, Homo Sapiens
NEQTLGHFM

SEQ ID NO: 289476 - protein, 9 aa, Homo Sapiens
QPLGEITEK

SEQ ID NO: 289477 - protein, 9 aa, Homo Sapiens
PGLNNTSSF

SEQ ID NO: 289478 - protein, 9 aa, Homo Sapiens
DESEFFLAS

SEQ ID NO: 289479 - protein, 9 aa, Homo Sapiens
ECGQSFSYK

SEQ ID NO: 289480 - protein, 9 aa, Homo Sapiens
AKYLDDRYK

SEQ ID NO: 289481 - protein, 9 aa, Homo Sapiens
GSKTKKLVY

SEQ ID NO: 289482 - protein, 9 aa, Homo Sapiens
KGGRVGAVS

SEQ ID NO: 289483 - protein, 9 aa, Homo Sapiens
NLAKDQRTH

SEQ ID NO: 289484 - protein, 9 aa, Homo Sapiens
GACHHTQLL

SEQ ID NO: 289485 - protein, 9 aa, Homo Sapiens
CVKIARKPI

SEQ ID NO: 289486 - protein, 9 aa, Homo Sapiens
GEQGGRAGD

SEQ ID NO: 289487 - protein, 9 aa, Homo Sapiens
NIYSATYDR

SEQ ID NO: 289488 - protein, 9 aa, Homo Sapiens
LFGDQPESM

SEQ ID NO: 289489 - protein, 9 aa, Homo Sapiens
VCSDYLEKA

SEQ ID NO: 289490 - protein, 9 aa, Homo Sapiens
SKKRGKKVN

SEQ ID NO: 289491 - protein, 9 aa, Homo Sapiens
SKRNWKCPV

SEQ ID NO: 289492 - protein, 9 aa, Homo Sapiens
GTPLPPGWV

SEQ ID NO: 289493 - protein, 9 aa, Homo Sapiens
VVLDSTRQV

SEQ ID NO: 289494 - protein, 9 aa, Homo Sapiens
RHCVNMLFL

SEQ ID NO: 289495 - protein, 9 aa, Homo Sapiens
CLLKAAASP

SEQ ID NO: 289496 - protein, 9 aa, Homo Sapiens
VRDDVFGMG

SEQ ID NO: 289497 - protein, 9 aa, Homo Sapiens
RLLGLIRAK

SEQ ID NO: 289498 - protein, 9 aa, Homo Sapiens
GTNEFTFLK

SEQ ID NO: 289499 - protein, 9 aa, Homo Sapiens
DEESLESTR

SEQ ID NO: 289500 - protein, 9 aa, Homo Sapiens
TPEQPTAGN

SEQ ID NO: 289501 - protein, 9 aa, Homo Sapiens
RKDFGYHTA

SEQ ID NO: 289502 - protein, 9 aa, Homo Sapiens
TVFKKTVSS

SEQ ID NO: 289503 - protein, 9 aa, Homo Sapiens
QPQINSYVE

SEQ ID NO: 289504 - protein, 9 aa, Homo Sapiens
HHSNQNSSG

SEQ ID NO: 289505 - protein, 9 aa, Homo Sapiens
PPKKEASKC

SEQ ID NO: 289506 - protein, 9 aa, Homo Sapiens
LNKHHNVHT

SEQ ID NO: 289507 - protein, 9 aa, Homo Sapiens
PQTKALGNQ

SEQ ID NO: 289508 - protein, 9 aa, Homo Sapiens
EQGPQGIGG

SEQ ID NO: 289509 - protein, 9 aa, Homo Sapiens
SDRIIVCYL

SEQ ID NO: 289510 - protein, 9 aa, Homo Sapiens
KTQSKDIFD

SEQ ID NO: 289511 - protein, 9 aa, Homo Sapiens
SWQRHGTLL

SEQ ID NO: 289512 - protein, 9 aa, Homo Sapiens
HGDQGSHPR

SEQ ID NO: 289513 - protein, 9 aa, Homo Sapiens
GTDAAIFQS

SEQ ID NO: 289514 - protein, 9 aa, Homo Sapiens
DSGGGDNDS

SEQ ID NO: 289515 - protein, 9 aa, Homo Sapiens
ECHTKICHV

SEQ ID NO: 289516 - protein, 9 aa, Homo Sapiens
FSTNNSSAA

SEQ ID NO: 289517 - protein, 9 aa, Homo Sapiens
MFAEGNISQ

SEQ ID NO: 289518 - protein, 9 aa, Homo Sapiens
GTLCQGKTS

SEQ ID NO: 289519 - protein, 9 aa, Homo Sapiens
EQMAINWLT

SEQ ID NO: 289520 - protein, 9 aa, Homo Sapiens
ECEALICNC

SEQ ID NO: 289521 - protein, 9 aa, Homo Sapiens
RELCRQDAK

SEQ ID NO: 289522 - protein, 9 aa, Homo Sapiens
SSKDLSTLT

SEQ ID NO: 289523 - protein, 9 aa, Homo Sapiens
EHLDNSNTF

SEQ ID NO: 289524 - protein, 9 aa, Homo Sapiens
ALHLYLYSA

SEQ ID NO: 289525 - protein, 9 aa, Homo Sapiens
SLNAGLVGL

SEQ ID NO: 289526 - protein, 9 aa, Homo Sapiens
PIIDARRAD

SEQ ID NO: 289527 - protein, 9 aa, Homo Sapiens
TSPNHPGFK

SEQ ID NO: 289528 - protein, 9 aa, Homo Sapiens
LHPIIDARR

SEQ ID NO: 289529 - protein, 9 aa, Homo Sapiens
KVYALQPLN

SEQ ID NO: 289530 - protein, 9 aa, Homo Sapiens
LAGCGADLH

SEQ ID NO: 289531 - protein, 9 aa, Homo Sapiens
KRFRQADEV

SEQ ID NO: 289532 - protein, 9 aa, Homo Sapiens
FRPKVSMDG

SEQ ID NO: 289533 - protein, 9 aa, Homo Sapiens
LWSRVWQLA

SEQ ID NO: 289534 - protein, 9 aa, Homo Sapiens
GLTCREELL

SEQ ID NO: 289535 - protein, 9 aa, Homo Sapiens
ANLEDELVN

SEQ ID NO: 289536 - protein, 9 aa, Homo Sapiens
QFILILKKN

SEQ ID NO: 289537 - protein, 9 aa, Homo Sapiens
KSALHAIGV

SEQ ID NO: 289538 - protein, 9 aa, Homo Sapiens
SYYLKNTSA

SEQ ID NO: 289539 - protein, 9 aa, Homo Sapiens
FDSSRPETL

SEQ ID NO: 289540 - protein, 9 aa, Homo Sapiens
LNISFNKHS

SEQ ID NO: 289541 - protein, 9 aa, Homo Sapiens
LNSLLQTRF

SEQ ID NO: 289542 - protein, 9 aa, Homo Sapiens
PEKCKNKNK

SEQ ID NO: 289543 - protein, 9 aa, Homo Sapiens
AHHQQIHTG

SEQ ID NO: 289544 - protein, 9 aa, Homo Sapiens
LLIAYNVTS

SEQ ID NO: 289545 - protein, 9 aa, Homo Sapiens
INIVSSKKI

SEQ ID NO: 289546 - protein, 9 aa, Homo Sapiens
ILRLRDFQE

SEQ ID NO: 289547 - protein, 9 aa, Homo Sapiens
GFFPQTLEI

SEQ ID NO: 289548 - protein, 9 aa, Homo Sapiens
LQQLPFVIF

SEQ ID NO: 289549 - protein, 9 aa, Homo Sapiens
AGYFYYMAG

SEQ ID NO: 289550 - protein, 9 aa, Homo Sapiens
IKKKCQGIK

SEQ ID NO: 289551 - protein, 9 aa, Homo Sapiens
GSSQSCSSY

SEQ ID NO: 289552 - protein, 9 aa, Homo Sapiens
QGTNSVGKD

SEQ ID NO: 289553 - protein, 9 aa, Homo Sapiens
ALCVALPMS

SEQ ID NO: 289554 - protein, 9 aa, Homo Sapiens
YWRHEDKED

SEQ ID NO: 289555 - protein, 9 aa, Homo Sapiens
ERIYLQWLR

SEQ ID NO: 289556 - protein, 9 aa, Homo Sapiens
FEEQENYYL

SEQ ID NO: 289557 - protein, 9 aa, Homo Sapiens
LEAVDKYEE

SEQ ID NO: 289558 - protein, 9 aa, Homo Sapiens
VEVVKTCNL

SEQ ID NO: 289559 - protein, 9 aa, Homo Sapiens
DPLHSGDDV

SEQ ID NO: 289560 - protein, 9 aa, Homo Sapiens
ICWSGSETS

SEQ ID NO: 289561 - protein, 9 aa, Homo Sapiens
FSVVRHHQF

SEQ ID NO: 289562 - protein, 9 aa, Homo Sapiens
PYGSQPHSR

SEQ ID NO: 289563 - protein, 9 aa, Homo Sapiens
GKLFLLCGQ

SEQ ID NO: 289564 - protein, 9 aa, Homo Sapiens
YICIVYPCR

SEQ ID NO: 289565 - protein, 9 aa, Homo Sapiens
FSSVCSRNR

SEQ ID NO: 289566 - protein, 9 aa, Homo Sapiens
VTYNTGTFE

SEQ ID NO: 289567 - protein, 9 aa, Homo Sapiens
SPYFYEESE

SEQ ID NO: 289568 - protein, 9 aa, Homo Sapiens
VGTLDADTC

SEQ ID NO: 289569 - protein, 9 aa, Homo Sapiens
VGQDGGVCE

SEQ ID NO: 289570 - protein, 9 aa, Homo Sapiens
SSSLLMIWA

SEQ ID NO: 289571 - protein, 9 aa, Homo Sapiens
GIAQLRVFG

SEQ ID NO: 289572 - protein, 9 aa, Homo Sapiens
LYLRFGVQV

SEQ ID NO: 289573 - protein, 9 aa, Homo Sapiens
DLISSLMIV

SEQ ID NO: 289574 - protein, 9 aa, Homo Sapiens
AELSILEAD

SEQ ID NO: 289575 - protein, 9 aa, Homo Sapiens
FYMYTLFGL

SEQ ID NO: 289576 - protein, 9 aa, Homo Sapiens
QTDNLPENL

SEQ ID NO: 289577 - protein, 9 aa, Homo Sapiens
SLLGLCPSE

SEQ ID NO: 289578 - protein, 9 aa, Homo Sapiens
LLGVVQIYH

SEQ ID NO: 289579 - protein, 9 aa, Homo Sapiens
TFPGLFKIV

SEQ ID NO: 289580 - protein, 9 aa, Homo Sapiens
NPHFISAFE

SEQ ID NO: 289581 - protein, 9 aa, Homo Sapiens
DCLEWPEYF

SEQ ID NO: 289582 - protein, 9 aa, Homo Sapiens
RELIEISEG

SEQ ID NO: 289583 - protein, 9 aa, Homo Sapiens
IDQLKHIME

SEQ ID NO: 289584 - protein, 9 aa, Homo Sapiens
QAVPTSSSR

SEQ ID NO: 289585 - protein, 9 aa, Homo Sapiens
ITICSLSHQ

SEQ ID NO: 289586 - protein, 9 aa, Homo Sapiens
SKFMLKDDL

SEQ ID NO: 289587 - protein, 9 aa, Homo Sapiens
SQHAAMFRQ

SEQ ID NO: 289588 - protein, 9 aa, Homo Sapiens
WVIYSTEAN

SEQ ID NO: 289589 - protein, 9 aa, Homo Sapiens
PNQGRKVEG

SEQ ID NO: 289590 - protein, 9 aa, Homo Sapiens
NFILKVWNS

SEQ ID NO: 289591 - protein, 9 aa, Homo Sapiens
VAKTGSLNA

SEQ ID NO: 289592 - protein, 9 aa, Homo Sapiens
FYHEDVTMG

SEQ ID NO: 289593 - protein, 9 aa, Homo Sapiens
KHSGTRGWQ

SEQ ID NO: 289594 - protein, 9 aa, Homo Sapiens
IGYNQRNII

SEQ ID NO: 289595 - protein, 9 aa, Homo Sapiens
SSVCMNTPM

SEQ ID NO: 289596 - protein, 9 aa, Homo Sapiens
YSNHTRMGR

SEQ ID NO: 289597 - protein, 9 aa, Homo Sapiens
NGSSGSESS

SEQ ID NO: 289598 - protein, 9 aa, Homo Sapiens
SQGITTNSE

SEQ ID NO: 289599 - protein, 9 aa, Homo Sapiens
LLYRLVGSE

SEQ ID NO: 289600 - protein, 9 aa, Homo Sapiens
DLINKYKQN

SEQ ID NO: 289601 - protein, 9 aa, Homo Sapiens
AGLLGLALC

SEQ ID NO: 289602 - protein, 9 aa, Homo Sapiens
KSIGYLCTD

SEQ ID NO: 289603 - protein, 9 aa, Homo Sapiens
EFILKGLTH

SEQ ID NO: 289604 - protein, 9 aa, Homo Sapiens
WEINDVAGE

SEQ ID NO: 289605 - protein, 9 aa, Homo Sapiens
ENGLSRPVS

SEQ ID NO: 289606 - protein, 9 aa, Homo Sapiens
MNESVGVLA

SEQ ID NO: 289607 - protein, 9 aa, Homo Sapiens
SIHQILERM

SEQ ID NO: 289608 - protein, 9 aa, Homo Sapiens
AMKKYIKTN

SEQ ID NO: 289609 - protein, 9 aa, Homo Sapiens
IPKFSHRQV

SEQ ID NO: 289610 - protein, 9 aa, Homo Sapiens
FTNYFGHLA

SEQ ID NO: 289611 - protein, 9 aa, Homo Sapiens
AIPSVVSSG

SEQ ID NO: 289612 - protein, 9 aa, Homo Sapiens
LFVKVKRTA

SEQ ID NO: 289613 - protein, 9 aa, Homo Sapiens
PPPEHPGFN

SEQ ID NO: 289614 - protein, 9 aa, Homo Sapiens
ASYSSPSET

SEQ ID NO: 289615 - protein, 9 aa, Homo Sapiens
LYYCKGITL

SEQ ID NO: 289616 - protein, 9 aa, Homo Sapiens
EYGMFTYHK

SEQ ID NO: 289617 - protein, 9 aa, Homo Sapiens
PAGFVTLSL

SEQ ID NO: 289618 - protein, 9 aa, Homo Sapiens
PWTEPECYF

SEQ ID NO: 289619 - protein, 9 aa, Homo Sapiens
PVGTAGTAR

SEQ ID NO: 289620 - protein, 9 aa, Homo Sapiens
EYCELCKHS

SEQ ID NO: 289621 - protein, 9 aa, Homo Sapiens
VCFTCVDGK

SEQ ID NO: 289622 - protein, 9 aa, Homo Sapiens
VKIARKPIT

SEQ ID NO: 289623 - protein, 9 aa, Homo Sapiens
DIFMENIML

SEQ ID NO: 289624 - protein, 9 aa, Homo Sapiens
VKATAQPPT

SEQ ID NO: 289625 - protein, 9 aa, Homo Sapiens
LLASVSGKV

SEQ ID NO: 289626 - protein, 9 aa, Homo Sapiens
KVKKIINQV

SEQ ID NO: 289627 - protein, 9 aa, Homo Sapiens
YMALNIGNE

SEQ ID NO: 289628 - protein, 9 aa, Homo Sapiens
DNCINTMVN

SEQ ID NO: 289629 - protein, 9 aa, Homo Sapiens
LFLDNFSIL

SEQ ID NO: 289630 - protein, 9 aa, Homo Sapiens
KLLDILQHD

SEQ ID NO: 289631 - protein, 9 aa, Homo Sapiens
IDFVLWCDR

SEQ ID NO: 289632 - protein, 9 aa, Homo Sapiens
QSSTKHPGA

SEQ ID NO: 289633 - protein, 9 aa, Homo Sapiens
DYDNSTPPY

SEQ ID NO: 289634 - protein, 9 aa, Homo Sapiens
SNECENVSI

SEQ ID NO: 289635 - protein, 9 aa, Homo Sapiens
NQLAKDFKD

SEQ ID NO: 289636 - protein, 9 aa, Homo Sapiens
KDMLAEKLA

SEQ ID NO: 289637 - protein, 9 aa, Homo Sapiens
VKFQYPESS

SEQ ID NO: 289638 - protein, 9 aa, Homo Sapiens
TIKKCEKDI

SEQ ID NO: 289639 - protein, 9 aa, Homo Sapiens
RKLYEKSLE

SEQ ID NO: 289640 - protein, 9 aa, Homo Sapiens
TTSTGSTSS

SEQ ID NO: 289641 - protein, 9 aa, Homo Sapiens
CFYGRILLA

SEQ ID NO: 289642 - protein, 9 aa, Homo Sapiens
TSIPVVSQP

SEQ ID NO: 289643 - protein, 9 aa, Homo Sapiens
MNKGVLMKL

SEQ ID NO: 289644 - protein, 9 aa, Homo Sapiens
KGGLNKKPL

SEQ ID NO: 289645 - protein, 9 aa, Homo Sapiens
DEYFAKDEN

SEQ ID NO: 289646 - protein, 9 aa, Homo Sapiens
PHTMSRSKK

SEQ ID NO: 289647 - protein, 9 aa, Homo Sapiens
KQLSESADE

SEQ ID NO: 289648 - protein, 9 aa, Homo Sapiens
ADLESKLVD

SEQ ID NO: 289649 - protein, 9 aa, Homo Sapiens
TLDQLLQNQ

SEQ ID NO: 289650 - protein, 9 aa, Homo Sapiens
NSVRQRQLQ

SEQ ID NO: 289651 - protein, 9 aa, Homo Sapiens
LCQETILIS

SEQ ID NO: 289652 - protein, 9 aa, Homo Sapiens
EVNTLDLEE

SEQ ID NO: 289653 - protein, 9 aa, Homo Sapiens
YNRMTIHFQ

SEQ ID NO: 289654 - protein, 9 aa, Homo Sapiens
GMRKENVFP

SEQ ID NO: 289655 - protein, 9 aa, Homo Sapiens
FGGHRGLVN

SEQ ID NO: 289656 - protein, 9 aa, Homo Sapiens
ADLEVLVKQ

SEQ ID NO: 289657 - protein, 9 aa, Homo Sapiens
NTFLTSDNN

SEQ ID NO: 289658 - protein, 9 aa, Homo Sapiens
RGSDSIIVG

SEQ ID NO: 289659 - protein, 9 aa, Homo Sapiens
GELSSSSSW

SEQ ID NO: 289660 - protein, 9 aa, Homo Sapiens
YLASQLHVR

SEQ ID NO: 289661 - protein, 9 aa, Homo Sapiens
SGPQKQKLS

SEQ ID NO: 289662 - protein, 9 aa, Homo Sapiens
MKYHVLPER

SEQ ID NO: 289663 - protein, 9 aa, Homo Sapiens
QEELNTNLF

SEQ ID NO: 289664 - protein, 9 aa, Homo Sapiens
AVAPNTLHL

SEQ ID NO: 289665 - protein, 9 aa, Homo Sapiens
RSIVNPMDM

SEQ ID NO: 289666 - protein, 9 aa, Homo Sapiens
QCKKTQILV

SEQ ID NO: 289667 - protein, 9 aa, Homo Sapiens
PWESNIKIV

SEQ ID NO: 289668 - protein, 9 aa, Homo Sapiens
NRPGDACGL

SEQ ID NO: 289669 - protein, 9 aa, Homo Sapiens
LKLQRFLVT

SEQ ID NO: 289670 - protein, 9 aa, Homo Sapiens
ENNLPCANV

SEQ ID NO: 289671 - protein, 9 aa, Homo Sapiens
QNNPSLGNM

SEQ ID NO: 289672 - protein, 9 aa, Homo Sapiens
WSSLRNFPS

SEQ ID NO: 289673 - protein, 9 aa, Homo Sapiens
CPSISHNKM

SEQ ID NO: 289674 - protein, 9 aa, Homo Sapiens
VAYTAIQRW

SEQ ID NO: 289675 - protein, 9 aa, Homo Sapiens
EGNKEKKSA

SEQ ID NO: 289676 - protein, 9 aa, Homo Sapiens
VIYCKRQLM

SEQ ID NO: 289677 - protein, 9 aa, Homo Sapiens
KSTKKTYFK

SEQ ID NO: 289678 - protein, 9 aa, Homo Sapiens
VENLSPNQT

SEQ ID NO: 289679 - protein, 9 aa, Homo Sapiens
KLCLNPKTN

SEQ ID NO: 289680 - protein, 9 aa, Homo Sapiens
GNLKEKYIL

SEQ ID NO: 289681 - protein, 9 aa, Homo Sapiens
NNVNNSFTV

SEQ ID NO: 289682 - protein, 9 aa, Homo Sapiens
ENYNAPDCR

SEQ ID NO: 289683 - protein, 9 aa, Homo Sapiens
NLGSSGCCG

SEQ ID NO: 289684 - protein, 9 aa, Homo Sapiens
KSLEYPRED

SEQ ID NO: 289685 - protein, 9 aa, Homo Sapiens
RHRGQKGLR

SEQ ID NO: 289686 - protein, 9 aa, Homo Sapiens
ALYNSINNE

SEQ ID NO: 289687 - protein, 9 aa, Homo Sapiens
PYRTISENT

SEQ ID NO: 289688 - protein, 9 aa, Homo Sapiens
LSVDDILMS

SEQ ID NO: 289689 - protein, 9 aa, Homo Sapiens
ERNRITVTG

SEQ ID NO: 289690 - protein, 9 aa, Homo Sapiens
NNGKIRAFA

SEQ ID NO: 289691 - protein, 9 aa, Homo Sapiens
INVSFCVKK

SEQ ID NO: 289692 - protein, 9 aa, Homo Sapiens
PVTNASTFS

SEQ ID NO: 289693 - protein, 9 aa, Homo Sapiens
QWFLNNYPG

SEQ ID NO: 289694 - protein, 9 aa, Homo Sapiens
VICDETNNC

SEQ ID NO: 289695 - protein, 9 aa, Homo Sapiens
EQENYYLLC

SEQ ID NO: 289696 - protein, 9 aa, Homo Sapiens
IRLASGGPS

SEQ ID NO: 289697 - protein, 9 aa, Homo Sapiens
PREMKRLKK

SEQ ID NO: 289698 - protein, 9 aa, Homo Sapiens
IFSLAAVFL

SEQ ID NO: 289699 - protein, 9 aa, Homo Sapiens
YSCKVFIGG

SEQ ID NO: 289700 - protein, 9 aa, Homo Sapiens
PLPNLGPSE

SEQ ID NO: 289701 - protein, 9 aa, Homo Sapiens
QMFAMKMLH

SEQ ID NO: 289702 - protein, 9 aa, Homo Sapiens
LDVNEDGKR

SEQ ID NO: 289703 - protein, 9 aa, Homo Sapiens
IRHQNIHIR

SEQ ID NO: 289704 - protein, 9 aa, Homo Sapiens
NLVNNLRKD

SEQ ID NO: 289705 - protein, 9 aa, Homo Sapiens
RLLCLLVLL

SEQ ID NO: 289706 - protein, 9 aa, Homo Sapiens
TKTCFLDCV

SEQ ID NO: 289707 - protein, 9 aa, Homo Sapiens
TMQEKAFGA

SEQ ID NO: 289708 - protein, 9 aa, Homo Sapiens
WTLLDQARR

SEQ ID NO: 289709 - protein, 9 aa, Homo Sapiens
EVEETKLMG

SEQ ID NO: 289710 - protein, 9 aa, Homo Sapiens
GPGHAGAPE

SEQ ID NO: 289711 - protein, 9 aa, Homo Sapiens
KKLFDANYD

SEQ ID NO: 289712 - protein, 9 aa, Homo Sapiens
KGDKKKRDR

SEQ ID NO: 289713 - protein, 9 aa, Homo Sapiens
VSLVLGMVG

SEQ ID NO: 289714 - protein, 9 aa, Homo Sapiens
QQQQLSSSA

SEQ ID NO: 289715 - protein, 9 aa, Homo Sapiens
YSRCHSSRS

SEQ ID NO: 289716 - protein, 9 aa, Homo Sapiens
LMTKALLVF

SEQ ID NO: 289717 - protein, 9 aa, Homo Sapiens
KPVRMNMIG

SEQ ID NO: 289718 - protein, 9 aa, Homo Sapiens
NITGEKFDR

SEQ ID NO: 289719 - protein, 9 aa, Homo Sapiens
GLAWGLESR

SEQ ID NO: 289720 - protein, 9 aa, Homo Sapiens
GSGFGKFER

SEQ ID NO: 289721 - protein, 9 aa, Homo Sapiens
SQEDEFGIK

SEQ ID NO: 289722 - protein, 9 aa, Homo Sapiens
HLTEPGSIK

SEQ ID NO: 289723 - protein, 9 aa, Homo Sapiens
NLMHHAARN

SEQ ID NO: 289724 - protein, 9 aa, Homo Sapiens
FLDVNGHFV

SEQ ID NO: 289725 - protein, 9 aa, Homo Sapiens
MCTDATLHG

SEQ ID NO: 289726 - protein, 9 aa, Homo Sapiens
DAHDFLQYT

SEQ ID NO: 289727 - protein, 9 aa, Homo Sapiens
VAISTLQKA

SEQ ID NO: 289728 - protein, 9 aa, Homo Sapiens
GTWHHDCII

SEQ ID NO: 289729 - protein, 9 aa, Homo Sapiens
LGLKVFEYY

SEQ ID NO: 289730 - protein, 9 aa, Homo Sapiens
ACMAEILYV

SEQ ID NO: 289731 - protein, 9 aa, Homo Sapiens
ARHRKKRRS

SEQ ID NO: 289732 - protein, 9 aa, Homo Sapiens
QICAYFGAS

SEQ ID NO: 289733 - protein, 9 aa, Homo Sapiens
WSKPTSETL

SEQ ID NO: 289734 - protein, 9 aa, Homo Sapiens
ERDPLKDCT

SEQ ID NO: 289735 - protein, 9 aa, Homo Sapiens
IDYFPNELE

SEQ ID NO: 289736 - protein, 9 aa, Homo Sapiens
SSITLQATR

SEQ ID NO: 289737 - protein, 9 aa, Homo Sapiens
GPIDLAQNF

SEQ ID NO: 289738 - protein, 9 aa, Homo Sapiens
GNGAIDFVL

SEQ ID NO: 289739 - protein, 9 aa, Homo Sapiens
IRISIGSLF

SEQ ID NO: 289740 - protein, 9 aa, Homo Sapiens
PEELTALIL

SEQ ID NO: 289741 - protein, 9 aa, Homo Sapiens
PLLAMRRSL

SEQ ID NO: 289742 - protein, 9 aa, Homo Sapiens
ILDLNDNYP

SEQ ID NO: 289743 - protein, 9 aa, Homo Sapiens
LLGCLLFLM

SEQ ID NO: 289744 - protein, 9 aa, Homo Sapiens
PLQRLLDRV

SEQ ID NO: 289745 - protein, 9 aa, Homo Sapiens
DVGRYIDQY

SEQ ID NO: 289746 - protein, 9 aa, Homo Sapiens
LRHFRAVFM

SEQ ID NO: 289747 - protein, 9 aa, Homo Sapiens
SLIDKKKHD

SEQ ID NO: 289748 - protein, 9 aa, Homo Sapiens
AFISRCRDG

SEQ ID NO: 289749 - protein, 9 aa, Homo Sapiens
PEYDRYLTS

SEQ ID NO: 289750 - protein, 9 aa, Homo Sapiens
PVPVPGPRS

SEQ ID NO: 289751 - protein, 9 aa, Homo Sapiens
ENRVRGNLD

SEQ ID NO: 289752 - protein, 9 aa, Homo Sapiens
YQSIQNYLI

SEQ ID NO: 289753 - protein, 9 aa, Homo Sapiens
KILTTSIQN

SEQ ID NO: 289754 - protein, 9 aa, Homo Sapiens
LGEYLFKRL

SEQ ID NO: 289755 - protein, 9 aa, Homo Sapiens
NELIKEIEP

SEQ ID NO: 289756 - protein, 9 aa, Homo Sapiens
DASVIALES

SEQ ID NO: 289757 - protein, 9 aa, Homo Sapiens
DSCIYECIW

SEQ ID NO: 289758 - protein, 9 aa, Homo Sapiens
ERGNNHKEN

SEQ ID NO: 289759 - protein, 9 aa, Homo Sapiens
QIRYRAAHD

SEQ ID NO: 289760 - protein, 9 aa, Homo Sapiens
YFVVITLTA

SEQ ID NO: 289761 - protein, 9 aa, Homo Sapiens
TSDISPELF

SEQ ID NO: 289762 - protein, 9 aa, Homo Sapiens
MSRSDAETK

SEQ ID NO: 289763 - protein, 9 aa, Homo Sapiens
KYSFQEIIL

SEQ ID NO: 289764 - protein, 9 aa, Homo Sapiens
RARYLFFAL

SEQ ID NO: 289765 - protein, 9 aa, Homo Sapiens
YLLFCQSQS

SEQ ID NO: 289766 - protein, 9 aa, Homo Sapiens
GFGDPAGKH

SEQ ID NO: 289767 - protein, 9 aa, Homo Sapiens
TLPHEVTQL

SEQ ID NO: 289768 - protein, 9 aa, Homo Sapiens
KKRNKEPAN

SEQ ID NO: 289769 - protein, 9 aa, Homo Sapiens
QADVKIGNG

SEQ ID NO: 289770 - protein, 9 aa, Homo Sapiens
WAARWAPCG

SEQ ID NO: 289771 - protein, 9 aa, Homo Sapiens
PYKMCWGGM

SEQ ID NO: 289772 - protein, 9 aa, Homo Sapiens
ISKKHTGKP

SEQ ID NO: 289773 - protein, 9 aa, Homo Sapiens
LALPTCSRL

SEQ ID NO: 289774 - protein, 9 aa, Homo Sapiens
NGHNETSNC

SEQ ID NO: 289775 - protein, 9 aa, Homo Sapiens
HVNLPATKL

SEQ ID NO: 289776 - protein, 9 aa, Homo Sapiens
PEDNSKISH

SEQ ID NO: 289777 - protein, 9 aa, Homo Sapiens
GQICSLKVS

SEQ ID NO: 289778 - protein, 9 aa, Homo Sapiens
WTMIQLHSK

SEQ ID NO: 289779 - protein, 9 aa, Homo Sapiens
FVEVNNYPE

SEQ ID NO: 289780 - protein, 9 aa, Homo Sapiens
LTLISCPGR

SEQ ID NO: 289781 - protein, 9 aa, Homo Sapiens
RVSGDAGPI

SEQ ID NO: 289782 - protein, 9 aa, Homo Sapiens
IHENIGVAG

SEQ ID NO: 289783 - protein, 9 aa, Homo Sapiens
YQQKVGIMH

SEQ ID NO: 289784 - protein, 9 aa, Homo Sapiens
NSKKLNNDL

SEQ ID NO: 289785 - protein, 9 aa, Homo Sapiens
CLAWDKDLR

SEQ ID NO: 289786 - protein, 9 aa, Homo Sapiens
VYRYAHTLV

SEQ ID NO: 289787 - protein, 9 aa, Homo Sapiens
EVVKTCNLP

SEQ ID NO: 289788 - protein, 9 aa, Homo Sapiens
LFTHTSFYK

SEQ ID NO: 289789 - protein, 9 aa, Homo Sapiens
KYFKCEECG

SEQ ID NO: 289790 - protein, 9 aa, Homo Sapiens
NKHLKGKVV

SEQ ID NO: 289791 - protein, 9 aa, Homo Sapiens
PGGGPIGVL

SEQ ID NO: 289792 - protein, 9 aa, Homo Sapiens
KARQQWCFD

SEQ ID NO: 289793 - protein, 9 aa, Homo Sapiens
TSNMFCADE

SEQ ID NO: 289794 - protein, 9 aa, Homo Sapiens
KSIQWLTVH

SEQ ID NO: 289795 - protein, 9 aa, Homo Sapiens
METSAKTAF

SEQ ID NO: 289796 - protein, 9 aa, Homo Sapiens
QMRKRIKRL

SEQ ID NO: 289797 - protein, 9 aa, Homo Sapiens
FPRENKPCI

SEQ ID NO: 289798 - protein, 9 aa, Homo Sapiens
SWGRGGTCV

SEQ ID NO: 289799 - protein, 9 aa, Homo Sapiens
SFVFADMIR

SEQ ID NO: 289800 - protein, 9 aa, Homo Sapiens
ENPMTNCST

SEQ ID NO: 289801 - protein, 9 aa, Homo Sapiens
KSNLSNSAD

SEQ ID NO: 289802 - protein, 9 aa, Homo Sapiens
QAGQSLELP

SEQ ID NO: 289803 - protein, 9 aa, Homo Sapiens
TPAAEDAAV

SEQ ID NO: 289804 - protein, 9 aa, Homo Sapiens
QDKQLQDLW

SEQ ID NO: 289805 - protein, 9 aa, Homo Sapiens
HIIIQQRNG

SEQ ID NO: 289806 - protein, 9 aa, Homo Sapiens
SPFKPINYQ

SEQ ID NO: 289807 - protein, 9 aa, Homo Sapiens
QKDTCHSFF

SEQ ID NO: 289808 - protein, 9 aa, Homo Sapiens
VISFIKWHS

SEQ ID NO: 289809 - protein, 9 aa, Homo Sapiens
LERPQVANT

SEQ ID NO: 289810 - protein, 9 aa, Homo Sapiens
KRKVKEMFD

SEQ ID NO: 289811 - protein, 9 aa, Homo Sapiens
LIVHFQDKN

SEQ ID NO: 289812 - protein, 9 aa, Homo Sapiens
LGKAQQLPK

SEQ ID NO: 289813 - protein, 9 aa, Homo Sapiens
KKFSKTQSK

SEQ ID NO: 289814 - protein, 9 aa, Homo Sapiens
REKSYTCND

SEQ ID NO: 289815 - protein, 9 aa, Homo Sapiens
HNLETALRR

SEQ ID NO: 289816 - protein, 9 aa, Homo Sapiens
VLGGIILAV

SEQ ID NO: 289817 - protein, 9 aa, Homo Sapiens
PPEHPGFNA

SEQ ID NO: 289818 - protein, 9 aa, Homo Sapiens
DNLRVMVSQ

SEQ ID NO: 289819 - protein, 9 aa, Homo Sapiens
QTYFIWVSA

SEQ ID NO: 289820 - protein, 9 aa, Homo Sapiens
YITYIQANI

SEQ ID NO: 289821 - protein, 9 aa, Homo Sapiens
LKKLEKYLQ

SEQ ID NO: 289822 - protein, 9 aa, Homo Sapiens
SFTLQIMLQ

SEQ ID NO: 289823 - protein, 9 aa, Homo Sapiens
SGGSDGTVQ

SEQ ID NO: 289824 - protein, 9 aa, Homo Sapiens
LPEEYIKQR

SEQ ID NO: 289825 - protein, 9 aa, Homo Sapiens
LTSNELDDQ

SEQ ID NO: 289826 - protein, 9 aa, Homo Sapiens
GLEIKEEEP

SEQ ID NO: 289827 - protein, 9 aa, Homo Sapiens
TNHTHVLYH

SEQ ID NO: 289828 - protein, 9 aa, Homo Sapiens
RIATNALKD

SEQ ID NO: 289829 - protein, 9 aa, Homo Sapiens
LKVEINCTR

SEQ ID NO: 289830 - protein, 9 aa, Homo Sapiens
ERTNKLLQI

SEQ ID NO: 289831 - protein, 9 aa, Homo Sapiens
EASFQTEVS

SEQ ID NO: 289832 - protein, 9 aa, Homo Sapiens
QLFGVFLVM

SEQ ID NO: 289833 - protein, 9 aa, Homo Sapiens
FEEVVSDSE

SEQ ID NO: 289834 - protein, 9 aa, Homo Sapiens
AIAGEYALV

SEQ ID NO: 289835 - protein, 9 aa, Homo Sapiens
STSSYSSQS

SEQ ID NO: 289836 - protein, 9 aa, Homo Sapiens
YVDSTTMHE

SEQ ID NO: 289837 - protein, 9 aa, Homo Sapiens
GPKAHISKL

SEQ ID NO: 289838 - protein, 9 aa, Homo Sapiens
QILNIPDTY

SEQ ID NO: 289839 - protein, 9 aa, Homo Sapiens
ISDKVSPSG

SEQ ID NO: 289840 - protein, 9 aa, Homo Sapiens
GEESPQKYI

SEQ ID NO: 289841 - protein, 9 aa, Homo Sapiens
TEDIFLNME

SEQ ID NO: 289842 - protein, 9 aa, Homo Sapiens
RRINSLPPS

SEQ ID NO: 289843 - protein, 9 aa, Homo Sapiens
GALTQNRMT

SEQ ID NO: 289844 - protein, 9 aa, Homo Sapiens
TFGLLEIAQ

SEQ ID NO: 289845 - protein, 9 aa, Homo Sapiens
ASALIQTLG

SEQ ID NO: 289846 - protein, 9 aa, Homo Sapiens
LLREAMHDP

SEQ ID NO: 289847 - protein, 9 aa, Homo Sapiens
GHYIARVKD

SEQ ID NO: 289848 - protein, 9 aa, Homo Sapiens
VDNKIYRYV

SEQ ID NO: 289849 - protein, 9 aa, Homo Sapiens
LDFLKSDDG

SEQ ID NO: 289850 - protein, 9 aa, Homo Sapiens
NKITKIKDG

SEQ ID NO: 289851 - protein, 9 aa, Homo Sapiens
LGIYVVTVM

SEQ ID NO: 289852 - protein, 9 aa, Homo Sapiens
VVAGLLRLT

SEQ ID NO: 289853 - protein, 9 aa, Homo Sapiens
ELTPPVPDS

SEQ ID NO: 289854 - protein, 9 aa, Homo Sapiens
QAHIGLVHS

SEQ ID NO: 289855 - protein, 9 aa, Homo Sapiens
RRYDKCGHD

SEQ ID NO: 289856 - protein, 9 aa, Homo Sapiens
VILASYAVQ

SEQ ID NO: 289857 - protein, 9 aa, Homo Sapiens
CERALQYTL

SEQ ID NO: 289858 - protein, 9 aa, Homo Sapiens
NYLTSLPLE

SEQ ID NO: 289859 - protein, 9 aa, Homo Sapiens
EDWKRANII

SEQ ID NO: 289860 - protein, 9 aa, Homo Sapiens
DLKIIYLQN

SEQ ID NO: 289861 - protein, 9 aa, Homo Sapiens
ECTECGKHF

SEQ ID NO: 289862 - protein, 9 aa, Homo Sapiens
EKISNKSYV

SEQ ID NO: 289863 - protein, 9 aa, Homo Sapiens
QEDPFIFTY

SEQ ID NO: 289864 - protein, 9 aa, Homo Sapiens
RLFCCAVLC

SEQ ID NO: 289865 - protein, 9 aa, Homo Sapiens
LNLLPQLSK

SEQ ID NO: 289866 - protein, 9 aa, Homo Sapiens
RKCRKIDYS

SEQ ID NO: 289867 - protein, 9 aa, Homo Sapiens
QMAEKTDGF

SEQ ID NO: 289868 - protein, 9 aa, Homo Sapiens
IKDKGSSLP

SEQ ID NO: 289869 - protein, 9 aa, Homo Sapiens
HFKAQWANS

SEQ ID NO: 289870 - protein, 9 aa, Homo Sapiens
DMNELYHCF

SEQ ID NO: 289871 - protein, 9 aa, Homo Sapiens
RSAQSPPGK

SEQ ID NO: 289872 - protein, 9 aa, Homo Sapiens
QNLNNERTI

SEQ ID NO: 289873 - protein, 9 aa, Homo Sapiens
TDASGRLCG

SEQ ID NO: 289874 - protein, 9 aa, Homo Sapiens
ASAPTVSQP

SEQ ID NO: 289875 - protein, 9 aa, Homo Sapiens
RNTRVTGDH

SEQ ID NO: 289876 - protein, 9 aa, Homo Sapiens
SRVWQLAHQ

SEQ ID NO: 289877 - protein, 9 aa, Homo Sapiens
PHANNGRFS

SEQ ID NO: 289878 - protein, 9 aa, Homo Sapiens
ACSGPFMGQ

SEQ ID NO: 289879 - protein, 9 aa, Homo Sapiens
FCRSRVPVI

SEQ ID NO: 289880 - protein, 9 aa, Homo Sapiens
GYISKGSLK

SEQ ID NO: 289881 - protein, 9 aa, Homo Sapiens
ISEELDAWR

SEQ ID NO: 289882 - protein, 9 aa, Homo Sapiens
VLHIPYCQP

SEQ ID NO: 289883 - protein, 9 aa, Homo Sapiens
LSCPTTTPS

SEQ ID NO: 289884 - protein, 9 aa, Homo Sapiens
CSSILPAGF

SEQ ID NO: 289885 - protein, 9 aa, Homo Sapiens
RYQVSGSGA

SEQ ID NO: 289886 - protein, 9 aa, Homo Sapiens
SQSLSKNVG

SEQ ID NO: 289887 - protein, 9 aa, Homo Sapiens
NGTVTVITR

SEQ ID NO: 289888 - protein, 9 aa, Homo Sapiens
PEVEVALAE

SEQ ID NO: 289889 - protein, 9 aa, Homo Sapiens
GGNTVKSTG

SEQ ID NO: 289890 - protein, 9 aa, Homo Sapiens
GYPFGYVKA

SEQ ID NO: 289891 - protein, 9 aa, Homo Sapiens
GRSTATFPL

SEQ ID NO: 289892 - protein, 9 aa, Homo Sapiens
TVQVLKWSG

SEQ ID NO: 289893 - protein, 9 aa, Homo Sapiens
LFDEESEEE

SEQ ID NO: 289894 - protein, 9 aa, Homo Sapiens
SPGRKFYMD

SEQ ID NO: 289895 - protein, 9 aa, Homo Sapiens
VGMYGRKGL

SEQ ID NO: 289896 - protein, 9 aa, Homo Sapiens
NTNVVFGNN

SEQ ID NO: 289897 - protein, 9 aa, Homo Sapiens
IMRVISINN

SEQ ID NO: 289898 - protein, 9 aa, Homo Sapiens
AIESLEHVQ

SEQ ID NO: 289899 - protein, 9 aa, Homo Sapiens
DFPFLCLYY

SEQ ID NO: 289900 - protein, 9 aa, Homo Sapiens
ELEEEVNTL

SEQ ID NO: 289901 - protein, 9 aa, Homo Sapiens
IGGTLVELV

SEQ ID NO: 289902 - protein, 9 aa, Homo Sapiens
LLIAAHKQK

SEQ ID NO: 289903 - protein, 9 aa, Homo Sapiens
HKIIHIREN

SEQ ID NO: 289904 - protein, 9 aa, Homo Sapiens
HLAYIDNAG

SEQ ID NO: 289905 - protein, 9 aa, Homo Sapiens
ALKDHAKAA

SEQ ID NO: 289906 - protein, 9 aa, Homo Sapiens
VFKGSKKPD

SEQ ID NO: 289907 - protein, 9 aa, Homo Sapiens
GICKRRVHM

SEQ ID NO: 289908 - protein, 9 aa, Homo Sapiens
VRDKKCMTL

SEQ ID NO: 289909 - protein, 9 aa, Homo Sapiens
NKTKPAAHF

SEQ ID NO: 289910 - protein, 9 aa, Homo Sapiens
IRVAKTGSL

SEQ ID NO: 289911 - protein, 9 aa, Homo Sapiens
ICLYRKDGS

SEQ ID NO: 289912 - protein, 9 aa, Homo Sapiens
PVIKRCLAW

SEQ ID NO: 289913 - protein, 9 aa, Homo Sapiens
KLLSREDEI

SEQ ID NO: 289914 - protein, 9 aa, Homo Sapiens
ITTLECEPP

SEQ ID NO: 289915 - protein, 9 aa, Homo Sapiens
PARGGGELD

SEQ ID NO: 289916 - protein, 9 aa, Homo Sapiens
PWWTLPKNF

SEQ ID NO: 289917 - protein, 9 aa, Homo Sapiens
HLICVLNKC

SEQ ID NO: 289918 - protein, 9 aa, Homo Sapiens
CGKYFTSHS

SEQ ID NO: 289919 - protein, 9 aa, Homo Sapiens
TKFRDLFLP

SEQ ID NO: 289920 - protein, 9 aa, Homo Sapiens
VSKDDCSDV

SEQ ID NO: 289921 - protein, 9 aa, Homo Sapiens
KDLGTPVLT

SEQ ID NO: 289922 - protein, 9 aa, Homo Sapiens
QFISQLQNK

SEQ ID NO: 289923 - protein, 9 aa, Homo Sapiens
SLKKEYSNK

SEQ ID NO: 289924 - protein, 9 aa, Homo Sapiens
RMSASQLET

SEQ ID NO: 289925 - protein, 9 aa, Homo Sapiens
YYPSERKRH

SEQ ID NO: 289926 - protein, 9 aa, Homo Sapiens
SIKDTFISN

SEQ ID NO: 289927 - protein, 9 aa, Homo Sapiens
EEIMRNQLS

SEQ ID NO: 289928 - protein, 9 aa, Homo Sapiens
GYFNDITET

SEQ ID NO: 289929 - protein, 9 aa, Homo Sapiens
AKLQTDIHE

SEQ ID NO: 289930 - protein, 9 aa, Homo Sapiens
KRMQQHKLK

SEQ ID NO: 289931 - protein, 9 aa, Homo Sapiens
DSPTEKQWL

SEQ ID NO: 289932 - protein, 9 aa, Homo Sapiens
VMCTSPPLI

SEQ ID NO: 289933 - protein, 9 aa, Homo Sapiens
QQEEEIQAR

SEQ ID NO: 289934 - protein, 9 aa, Homo Sapiens
YEVRGTFLF

SEQ ID NO: 289935 - protein, 9 aa, Homo Sapiens
QEGDNYIIN

SEQ ID NO: 289936 - protein, 9 aa, Homo Sapiens
LWMPAVRGE

SEQ ID NO: 289937 - protein, 9 aa, Homo Sapiens
IQAQNFLSS

SEQ ID NO: 289938 - protein, 9 aa, Homo Sapiens
LKCNSLESV

SEQ ID NO: 289939 - protein, 9 aa, Homo Sapiens
VRGIRKEEV

SEQ ID NO: 289940 - protein, 9 aa, Homo Sapiens
AQQRDSKET

SEQ ID NO: 289941 - protein, 9 aa, Homo Sapiens
NLFHIWRNK

SEQ ID NO: 289942 - protein, 9 aa, Homo Sapiens
FLDENFKQC

SEQ ID NO: 289943 - protein, 9 aa, Homo Sapiens
YHMKYRDST

SEQ ID NO: 289944 - protein, 9 aa, Homo Sapiens
ETSESHPNS

SEQ ID NO: 289945 - protein, 9 aa, Homo Sapiens
RTSFVMEYV

SEQ ID NO: 289946 - protein, 9 aa, Homo Sapiens
SSQARSSPA

SEQ ID NO: 289947 - protein, 9 aa, Homo Sapiens
LIAEIIIVD

SEQ ID NO: 289948 - protein, 9 aa, Homo Sapiens
EIICDDELI

SEQ ID NO: 289949 - protein, 9 aa, Homo Sapiens
SGSVPLLAA

SEQ ID NO: 289950 - protein, 9 aa, Homo Sapiens
RQYCSPRRK

SEQ ID NO: 289951 - protein, 9 aa, Homo Sapiens
KIHTGEMPY

SEQ ID NO: 289952 - protein, 9 aa, Homo Sapiens
KDLLCHDPD

SEQ ID NO: 289953 - protein, 9 aa, Homo Sapiens
KLMEQIQNP

SEQ ID NO: 289954 - protein, 9 aa, Homo Sapiens
SISYILAGV

SEQ ID NO: 289955 - protein, 9 aa, Homo Sapiens
HLGEKLFKR

SEQ ID NO: 289956 - protein, 9 aa, Homo Sapiens
LLCPKEFSY

SEQ ID NO: 289957 - protein, 9 aa, Homo Sapiens
RLTPQEISE

SEQ ID NO: 289958 - protein, 9 aa, Homo Sapiens
LLLQVPAQA

SEQ ID NO: 289959 - protein, 9 aa, Homo Sapiens
DNETPSVVS

SEQ ID NO: 289960 - protein, 9 aa, Homo Sapiens
KENEQAKKM

SEQ ID NO: 289961 - protein, 9 aa, Homo Sapiens
LMDLINKYK

SEQ ID NO: 289962 - protein, 9 aa, Homo Sapiens
FCLLATDTC

SEQ ID NO: 289963 - protein, 9 aa, Homo Sapiens
NAQVQINKQ

SEQ ID NO: 289964 - protein, 9 aa, Homo Sapiens
IHDDPIRLL

SEQ ID NO: 289965 - protein, 9 aa, Homo Sapiens
EGSISIYTS

SEQ ID NO: 289966 - protein, 9 aa, Homo Sapiens
LSVSTPQTL

SEQ ID NO: 289967 - protein, 9 aa, Homo Sapiens
ELSGGQEAS

SEQ ID NO: 289968 - protein, 9 aa, Homo Sapiens
DSLPITICS

SEQ ID NO: 289969 - protein, 9 aa, Homo Sapiens
LRNVSSEGE

SEQ ID NO: 289970 - protein, 9 aa, Homo Sapiens
KKVANKDTE

SEQ ID NO: 289971 - protein, 9 aa, Homo Sapiens
CKRTACQSE

SEQ ID NO: 289972 - protein, 9 aa, Homo Sapiens
DLEVIIKDT

SEQ ID NO: 289973 - protein, 9 aa, Homo Sapiens
GSEYRVKMH

SEQ ID NO: 289974 - protein, 9 aa, Homo Sapiens
QEEFSCDGK

SEQ ID NO: 289975 - protein, 9 aa, Homo Sapiens
KILTTSNLP

SEQ ID NO: 289976 - protein, 9 aa, Homo Sapiens
NCIEITFDG

SEQ ID NO: 289977 - protein, 9 aa, Homo Sapiens
NDLCLVAVH

SEQ ID NO: 289978 - protein, 9 aa, Homo Sapiens
STGGPVPNP

SEQ ID NO: 289979 - protein, 9 aa, Homo Sapiens
SVTTSEAQP

SEQ ID NO: 289980 - protein, 9 aa, Homo Sapiens
NVYLARLNE

SEQ ID NO: 289981 - protein, 9 aa, Homo Sapiens
PLQLVRDAM

SEQ ID NO: 289982 - protein, 9 aa, Homo Sapiens
LWTVAQALT

SEQ ID NO: 289983 - protein, 9 aa, Homo Sapiens
YYGLSHTVG

SEQ ID NO: 289984 - protein, 9 aa, Homo Sapiens
RLDPGGQSF

SEQ ID NO: 289985 - protein, 9 aa, Homo Sapiens
LQAFKFRVG

SEQ ID NO: 289986 - protein, 9 aa, Homo Sapiens
KLKNFKKIP

SEQ ID NO: 289987 - protein, 9 aa, Homo Sapiens
PCFRVWFNF

SEQ ID NO: 289988 - protein, 9 aa, Homo Sapiens
NELKTELHS

SEQ ID NO: 289989 - protein, 9 aa, Homo Sapiens
AQNFGYKLV

SEQ ID NO: 289990 - protein, 9 aa, Homo Sapiens
YKPVPDKEP

SEQ ID NO: 289991 - protein, 9 aa, Homo Sapiens
EEERKWQEE

SEQ ID NO: 289992 - protein, 9 aa, Homo Sapiens
ERERLECQQ

SEQ ID NO: 289993 - protein, 9 aa, Homo Sapiens
EKQKKCKLT

SEQ ID NO: 289994 - protein, 9 aa, Homo Sapiens
TASQNPKSR

SEQ ID NO: 289995 - protein, 9 aa, Homo Sapiens
QMFDMGFEY

SEQ ID NO: 289996 - protein, 9 aa, Homo Sapiens
NQFTCSCDI

SEQ ID NO: 289997 - protein, 9 aa, Homo Sapiens
ENYNEAKFV

SEQ ID NO: 289998 - protein, 9 aa, Homo Sapiens
LPQYMCEAM

SEQ ID NO: 289999 - protein, 9 aa, Homo Sapiens
YAQNVVQIQ

SEQ ID NO: 290000 - protein, 9 aa, Homo Sapiens
YLILEGPAL

SEQ ID NO: 290001 - protein, 9 aa, Homo Sapiens
NSMEPNTQK

SEQ ID NO: 290002 - protein, 9 aa, Homo Sapiens
QKAGPGLQT

SEQ ID NO: 290003 - protein, 9 aa, Homo Sapiens
NPYPSIFWI

SEQ ID NO: 290004 - protein, 9 aa, Homo Sapiens
DYFPNELEK

SEQ ID NO: 290005 - protein, 9 aa, Homo Sapiens
ILIIVNVSL

SEQ ID NO: 290006 - protein, 9 aa, Homo Sapiens
IPTVTFSYE

SEQ ID NO: 290007 - protein, 9 aa, Homo Sapiens
GGVCQEGWN

SEQ ID NO: 290008 - protein, 9 aa, Homo Sapiens
LELVPDINL

SEQ ID NO: 290009 - protein, 9 aa, Homo Sapiens
CESSGGGLR

SEQ ID NO: 290010 - protein, 9 aa, Homo Sapiens
HEFWDVIQK

SEQ ID NO: 290011 - protein, 9 aa, Homo Sapiens
HLKKVDTKP

SEQ ID NO: 290012 - protein, 9 aa, Homo Sapiens
KKRKTESSC

SEQ ID NO: 290013 - protein, 9 aa, Homo Sapiens
LDNPHTQKA

SEQ ID NO: 290014 - protein, 9 aa, Homo Sapiens
GVAILMTIV

SEQ ID NO: 290015 - protein, 9 aa, Homo Sapiens
SCDGKALER

SEQ ID NO: 290016 - protein, 9 aa, Homo Sapiens
FESTANNKS

SEQ ID NO: 290017 - protein, 9 aa, Homo Sapiens
TNQCFGNFF

SEQ ID NO: 290018 - protein, 9 aa, Homo Sapiens
MVVNAACKE

SEQ ID NO: 290019 - protein, 9 aa, Homo Sapiens
YHYGVASCG

SEQ ID NO: 290020 - protein, 9 aa, Homo Sapiens
APHLHFSIK

SEQ ID NO: 290021 - protein, 9 aa, Homo Sapiens
IPPFFGWSW

SEQ ID NO: 290022 - protein, 9 aa, Homo Sapiens
KFEASGSPC

SEQ ID NO: 290023 - protein, 9 aa, Homo Sapiens
GLSKALPTL

SEQ ID NO: 290024 - protein, 9 aa, Homo Sapiens
QQRISIKKA

SEQ ID NO: 290025 - protein, 9 aa, Homo Sapiens
KKDFLEPES

SEQ ID NO: 290026 - protein, 9 aa, Homo Sapiens
VLGKDCNKT

SEQ ID NO: 290027 - protein, 9 aa, Homo Sapiens
PNENTGEIS

SEQ ID NO: 290028 - protein, 9 aa, Homo Sapiens
IAVPTFKQR

SEQ ID NO: 290029 - protein, 9 aa, Homo Sapiens
QRKFLNALT

SEQ ID NO: 290030 - protein, 9 aa, Homo Sapiens
KRPAPFSSS

SEQ ID NO: 290031 - protein, 9 aa, Homo Sapiens
MIYKLPELI

SEQ ID NO: 290032 - protein, 9 aa, Homo Sapiens
GFLDHLATD

SEQ ID NO: 290033 - protein, 9 aa, Homo Sapiens
ARSLPDRTP

SEQ ID NO: 290034 - protein, 9 aa, Homo Sapiens
VVGPLLFCT

SEQ ID NO: 290035 - protein, 9 aa, Homo Sapiens
FEAAWALTH

SEQ ID NO: 290036 - protein, 9 aa, Homo Sapiens
LPLVERIHV

SEQ ID NO: 290037 - protein, 9 aa, Homo Sapiens
QQEQQEILL

SEQ ID NO: 290038 - protein, 9 aa, Homo Sapiens
QTNAWGHQH

SEQ ID NO: 290039 - protein, 9 aa, Homo Sapiens
MQKTMTSLK

SEQ ID NO: 290040 - protein, 9 aa, Homo Sapiens
AASQGRQDG

SEQ ID NO: 290041 - protein, 9 aa, Homo Sapiens
SGPNRSHQP

SEQ ID NO: 290042 - protein, 9 aa, Homo Sapiens
VPQPGNTKS

SEQ ID NO: 290043 - protein, 9 aa, Homo Sapiens
VIKGKPIHI

SEQ ID NO: 290044 - protein, 9 aa, Homo Sapiens
SFELSEFQR

SEQ ID NO: 290045 - protein, 9 aa, Homo Sapiens
MLTPSSHHQ

SEQ ID NO: 290046 - protein, 9 aa, Homo Sapiens
ANIIQDEST

SEQ ID NO: 290047 - protein, 9 aa, Homo Sapiens
HARQAACIN

SEQ ID NO: 290048 - protein, 9 aa, Homo Sapiens
VLPKAASTA

SEQ ID NO: 290049 - protein, 9 aa, Homo Sapiens
QRKTKGANG

SEQ ID NO: 290050 - protein, 9 aa, Homo Sapiens
WVYPPEKKD

SEQ ID NO: 290051 - protein, 9 aa, Homo Sapiens
QILICNRVT

SEQ ID NO: 290052 - protein, 9 aa, Homo Sapiens
THAKLALYF

SEQ ID NO: 290053 - protein, 9 aa, Homo Sapiens
RSFENLLDE

SEQ ID NO: 290054 - protein, 9 aa, Homo Sapiens
AGQIRFGAV

SEQ ID NO: 290055 - protein, 9 aa, Homo Sapiens
EYIQPPQRE

SEQ ID NO: 290056 - protein, 9 aa, Homo Sapiens
NRMTIHFQS

SEQ ID NO: 290057 - protein, 9 aa, Homo Sapiens
ASGSRPLTD

SEQ ID NO: 290058 - protein, 9 aa, Homo Sapiens
ETLIIGTGF

SEQ ID NO: 290059 - protein, 9 aa, Homo Sapiens
ILSLVLCLT

SEQ ID NO: 290060 - protein, 9 aa, Homo Sapiens
IWGDFTTST

SEQ ID NO: 290061 - protein, 9 aa, Homo Sapiens
HICRFLDEV

SEQ ID NO: 290062 - protein, 9 aa, Homo Sapiens
YSHESGEQN

SEQ ID NO: 290063 - protein, 9 aa, Homo Sapiens
CVRVITSAF

SEQ ID NO: 290064 - protein, 9 aa, Homo Sapiens
QRWYMRFVT

SEQ ID NO: 290065 - protein, 9 aa, Homo Sapiens
PNIALQGSW

SEQ ID NO: 290066 - protein, 9 aa, Homo Sapiens
HLQGVAAST

SEQ ID NO: 290067 - protein, 9 aa, Homo Sapiens
SILALGNVI

SEQ ID NO: 290068 - protein, 9 aa, Homo Sapiens
DGDNETPSV

SEQ ID NO: 290069 - protein, 9 aa, Homo Sapiens
TRNNLGFTP

SEQ ID NO: 290070 - protein, 9 aa, Homo Sapiens
SPDLVNWII

SEQ ID NO: 290071 - protein, 9 aa, Homo Sapiens
RKAFAAHKE

SEQ ID NO: 290072 - protein, 9 aa, Homo Sapiens
EKEKDKHKH

SEQ ID NO: 290073 - protein, 9 aa, Homo Sapiens
SNNTFNLEK

SEQ ID NO: 290074 - protein, 9 aa, Homo Sapiens
MFRQFQQIM

SEQ ID NO: 290075 - protein, 9 aa, Homo Sapiens
IMATSAIPP

SEQ ID NO: 290076 - protein, 9 aa, Homo Sapiens
EKVKKIINQ

SEQ ID NO: 290077 - protein, 9 aa, Homo Sapiens
EDVAVYLIR

SEQ ID NO: 290078 - protein, 9 aa, Homo Sapiens
SVGGTVLYC

SEQ ID NO: 290079 - protein, 9 aa, Homo Sapiens
SQTAGFSPD

SEQ ID NO: 290080 - protein, 9 aa, Homo Sapiens
RKRHVLGLS

SEQ ID NO: 290081 - protein, 9 aa, Homo Sapiens
VQKLDLPGH

SEQ ID NO: 290082 - protein, 9 aa, Homo Sapiens
YAALYFSPI

SEQ ID NO: 290083 - protein, 9 aa, Homo Sapiens
GFMFPPSYV

SEQ ID NO: 290084 - protein, 9 aa, Homo Sapiens
EEVVQEIIC

SEQ ID NO: 290085 - protein, 9 aa, Homo Sapiens
TVASEHYNQ

SEQ ID NO: 290086 - protein, 9 aa, Homo Sapiens
GPIFPIIRF

SEQ ID NO: 290087 - protein, 9 aa, Homo Sapiens
SVDTEHSDI

SEQ ID NO: 290088 - protein, 9 aa, Homo Sapiens
STQYTTAVV

SEQ ID NO: 290089 - protein, 9 aa, Homo Sapiens
VPAGVQMNK

SEQ ID NO: 290090 - protein, 9 aa, Homo Sapiens
EMWDKMKDL

SEQ ID NO: 290091 - protein, 9 aa, Homo Sapiens
DNPMGGYGK

SEQ ID NO: 290092 - protein, 9 aa, Homo Sapiens
DIAYVSVVL

SEQ ID NO: 290093 - protein, 9 aa, Homo Sapiens
MQKFELHPQ

SEQ ID NO: 290094 - protein, 9 aa, Homo Sapiens
RSGSRDLTP

SEQ ID NO: 290095 - protein, 9 aa, Homo Sapiens
IDGSSVAMS

SEQ ID NO: 290096 - protein, 9 aa, Homo Sapiens
LYFDFKDTD

SEQ ID NO: 290097 - protein, 9 aa, Homo Sapiens
FDLNSVVCQ

SEQ ID NO: 290098 - protein, 9 aa, Homo Sapiens
DSLQLEQLS

SEQ ID NO: 290099 - protein, 9 aa, Homo Sapiens
HHFRPNCLS

SEQ ID NO: 290100 - protein, 9 aa, Homo Sapiens
IYCGQIYIE

SEQ ID NO: 290101 - protein, 9 aa, Homo Sapiens
QEKHIKCLE

SEQ ID NO: 290102 - protein, 9 aa, Homo Sapiens
TFINSSGQF

SEQ ID NO: 290103 - protein, 9 aa, Homo Sapiens
EPTLKSFGE

SEQ ID NO: 290104 - protein, 9 aa, Homo Sapiens
EQPQLFWLS

SEQ ID NO: 290105 - protein, 9 aa, Homo Sapiens
SDDDDQIRG

SEQ ID NO: 290106 - protein, 9 aa, Homo Sapiens
KVLWVLVFV

SEQ ID NO: 290107 - protein, 9 aa, Homo Sapiens
REQLSRHPS

SEQ ID NO: 290108 - protein, 9 aa, Homo Sapiens
TMYLPLKRR

SEQ ID NO: 290109 - protein, 9 aa, Homo Sapiens
TSQTCDWKV

SEQ ID NO: 290110 - protein, 9 aa, Homo Sapiens
LATIASLLY

SEQ ID NO: 290111 - protein, 9 aa, Homo Sapiens
TPYLALLAS

SEQ ID NO: 290112 - protein, 9 aa, Homo Sapiens
VSAFANTGG

SEQ ID NO: 290113 - protein, 9 aa, Homo Sapiens
EWDERAKIT

SEQ ID NO: 290114 - protein, 9 aa, Homo Sapiens
HIKDSFHSS

SEQ ID NO: 290115 - protein, 9 aa, Homo Sapiens
GYVKASTTL

SEQ ID NO: 290116 - protein, 9 aa, Homo Sapiens
TGPKDTDTL

SEQ ID NO: 290117 - protein, 9 aa, Homo Sapiens
IQHKIIHTG

SEQ ID NO: 290118 - protein, 9 aa, Homo Sapiens
NIYIARNGS

SEQ ID NO: 290119 - protein, 9 aa, Homo Sapiens
NCEGRAAPR

SEQ ID NO: 290120 - protein, 9 aa, Homo Sapiens
NLMQETHDS

SEQ ID NO: 290121 - protein, 9 aa, Homo Sapiens
CLSDSDMVS

SEQ ID NO: 290122 - protein, 9 aa, Homo Sapiens
LKNIRCLEH

SEQ ID NO: 290123 - protein, 9 aa, Homo Sapiens
KQLLYDEIE

SEQ ID NO: 290124 - protein, 9 aa, Homo Sapiens
LKNELRTTK

SEQ ID NO: 290125 - protein, 9 aa, Homo Sapiens
SESLVKILA

SEQ ID NO: 290126 - protein, 9 aa, Homo Sapiens
IPSLCYSPK

SEQ ID NO: 290127 - protein, 9 aa, Homo Sapiens
DGEDDKPHD

SEQ ID NO: 290128 - protein, 9 aa, Homo Sapiens
NTVINSECS

SEQ ID NO: 290129 - protein, 9 aa, Homo Sapiens
GLELPFMMV

SEQ ID NO: 290130 - protein, 9 aa, Homo Sapiens
SIYYPDHTN

SEQ ID NO: 290131 - protein, 9 aa, Homo Sapiens
LPEILFFVA

SEQ ID NO: 290132 - protein, 9 aa, Homo Sapiens
FTRKLWACL

SEQ ID NO: 290133 - protein, 9 aa, Homo Sapiens
KTEDSDDIN

SEQ ID NO: 290134 - protein, 9 aa, Homo Sapiens
AITLILSGD

SEQ ID NO: 290135 - protein, 9 aa, Homo Sapiens
PVVVVAFCA

SEQ ID NO: 290136 - protein, 9 aa, Homo Sapiens
LSYGTPSVL

SEQ ID NO: 290137 - protein, 9 aa, Homo Sapiens
SKVLSEVVM

SEQ ID NO: 290138 - protein, 9 aa, Homo Sapiens
AHKDHALRW

SEQ ID NO: 290139 - protein, 9 aa, Homo Sapiens
GFKHIFITM

SEQ ID NO: 290140 - protein, 9 aa, Homo Sapiens
GETLSCIFP

SEQ ID NO: 290141 - protein, 9 aa, Homo Sapiens
HGEFSSSRA

SEQ ID NO: 290142 - protein, 9 aa, Homo Sapiens
INGEIIPMS

SEQ ID NO: 290143 - protein, 9 aa, Homo Sapiens
FNGELEASV

SEQ ID NO: 290144 - protein, 9 aa, Homo Sapiens
ECKEAFAKL

SEQ ID NO: 290145 - protein, 9 aa, Homo Sapiens
GERPFPCME

SEQ ID NO: 290146 - protein, 9 aa, Homo Sapiens
KTYGLWECV

SEQ ID NO: 290147 - protein, 9 aa, Homo Sapiens
QCLNPIKDF

SEQ ID NO: 290148 - protein, 9 aa, Homo Sapiens
FPGVDGCNQ

SEQ ID NO: 290149 - protein, 9 aa, Homo Sapiens
SVNSREFSR

SEQ ID NO: 290150 - protein, 9 aa, Homo Sapiens
VEKESKRLT

SEQ ID NO: 290151 - protein, 9 aa, Homo Sapiens
QRIADGYHV

SEQ ID NO: 290152 - protein, 9 aa, Homo Sapiens
AAYLVCLAA

SEQ ID NO: 290153 - protein, 9 aa, Homo Sapiens
SSSNNNGNY

SEQ ID NO: 290154 - protein, 9 aa, Homo Sapiens
KKHLKKNNL

SEQ ID NO: 290155 - protein, 9 aa, Homo Sapiens
LSFQGPQGD

SEQ ID NO: 290156 - protein, 9 aa, Homo Sapiens
LKRHKAAES

SEQ ID NO: 290157 - protein, 9 aa, Homo Sapiens
KHINCHTTS

SEQ ID NO: 290158 - protein, 9 aa, Homo Sapiens
SHFFICTAK

SEQ ID NO: 290159 - protein, 9 aa, Homo Sapiens
SSSLCDYIN

SEQ ID NO: 290160 - protein, 9 aa, Homo Sapiens
VIPTSDPVM

SEQ ID NO: 290161 - protein, 9 aa, Homo Sapiens
CQETILISK

SEQ ID NO: 290162 - protein, 9 aa, Homo Sapiens
EVTLVPPPW

SEQ ID NO: 290163 - protein, 9 aa, Homo Sapiens
MEKASIMLK

SEQ ID NO: 290164 - protein, 9 aa, Homo Sapiens
KLDPIVTRR

SEQ ID NO: 290165 - protein, 9 aa, Homo Sapiens
AVGAVSLTT

SEQ ID NO: 290166 - protein, 9 aa, Homo Sapiens
APEAIHFGA

SEQ ID NO: 290167 - protein, 9 aa, Homo Sapiens
LILWGEGSP

SEQ ID NO: 290168 - protein, 9 aa, Homo Sapiens
PMMLCVTGN

SEQ ID NO: 290169 - protein, 9 aa, Homo Sapiens
CFDYSQQYI

SEQ ID NO: 290170 - protein, 9 aa, Homo Sapiens
VLACTDLEQ

SEQ ID NO: 290171 - protein, 9 aa, Homo Sapiens
LSAQKAGYG

SEQ ID NO: 290172 - protein, 9 aa, Homo Sapiens
SGGSQPSMK

SEQ ID NO: 290173 - protein, 9 aa, Homo Sapiens
SMRLLHCSL

SEQ ID NO: 290174 - protein, 9 aa, Homo Sapiens
QELLTYSSD

SEQ ID NO: 290175 - protein, 9 aa, Homo Sapiens
GAALTLTDS

SEQ ID NO: 290176 - protein, 9 aa, Homo Sapiens
REGHPMYQR

SEQ ID NO: 290177 - protein, 9 aa, Homo Sapiens
KDYLASQLH

SEQ ID NO: 290178 - protein, 9 aa, Homo Sapiens
GRPLCDNHF

SEQ ID NO: 290179 - protein, 9 aa, Homo Sapiens
VQRVNINLS

SEQ ID NO: 290180 - protein, 9 aa, Homo Sapiens
EWPSDKGSL

SEQ ID NO: 290181 - protein, 9 aa, Homo Sapiens
DLQLWQMES

SEQ ID NO: 290182 - protein, 9 aa, Homo Sapiens
FITKSFNYS

SEQ ID NO: 290183 - protein, 9 aa, Homo Sapiens
PALRVLLCH

SEQ ID NO: 290184 - protein, 9 aa, Homo Sapiens
CEARDVFAQ

SEQ ID NO: 290185 - protein, 9 aa, Homo Sapiens
MDNQLTKRV

SEQ ID NO: 290186 - protein, 9 aa, Homo Sapiens
LSWMKEKIL

SEQ ID NO: 290187 - protein, 9 aa, Homo Sapiens
ICPHLCSLC

SEQ ID NO: 290188 - protein, 9 aa, Homo Sapiens
STLVFLVSG

SEQ ID NO: 290189 - protein, 9 aa, Homo Sapiens
FQYLLVIKN

SEQ ID NO: 290190 - protein, 9 aa, Homo Sapiens
SQESMKVQG

SEQ ID NO: 290191 - protein, 9 aa, Homo Sapiens
HCQQGSQRR

SEQ ID NO: 290192 - protein, 9 aa, Homo Sapiens
PNTALISLV

SEQ ID NO: 290193 - protein, 9 aa, Homo Sapiens
LNPLIADPF

SEQ ID NO: 290194 - protein, 9 aa, Homo Sapiens
EISYYNINR

SEQ ID NO: 290195 - protein, 9 aa, Homo Sapiens
QNYEKIHVN

SEQ ID NO: 290196 - protein, 9 aa, Homo Sapiens
TEGAVGATI

SEQ ID NO: 290197 - protein, 9 aa, Homo Sapiens
NLKERGVIS

SEQ ID NO: 290198 - protein, 9 aa, Homo Sapiens
RPAPFSSSW

SEQ ID NO: 290199 - protein, 9 aa, Homo Sapiens
LLQQYYLSP

SEQ ID NO: 290200 - protein, 9 aa, Homo Sapiens
SDGLGSSSA

SEQ ID NO: 290201 - protein, 9 aa, Homo Sapiens
THRYVINLM

SEQ ID NO: 290202 - protein, 9 aa, Homo Sapiens
KELLNELHK

SEQ ID NO: 290203 - protein, 9 aa, Homo Sapiens
SRLNSPLYL

SEQ ID NO: 290204 - protein, 9 aa, Homo Sapiens
KRDCGQKMS

SEQ ID NO: 290205 - protein, 9 aa, Homo Sapiens
LPQYLQAAR

SEQ ID NO: 290206 - protein, 9 aa, Homo Sapiens
SINLDKSLG

SEQ ID NO: 290207 - protein, 9 aa, Homo Sapiens
KAFKFKVLA

SEQ ID NO: 290208 - protein, 9 aa, Homo Sapiens
ELILHDALS

SEQ ID NO: 290209 - protein, 9 aa, Homo Sapiens
NKYLGSFYT

SEQ ID NO: 290210 - protein, 9 aa, Homo Sapiens
AAKLATRPI

SEQ ID NO: 290211 - protein, 9 aa, Homo Sapiens
NFTPDKFCH

SEQ ID NO: 290212 - protein, 9 aa, Homo Sapiens
ELFEPWNTL

SEQ ID NO: 290213 - protein, 9 aa, Homo Sapiens
RRLMGTNLS

SEQ ID NO: 290214 - protein, 9 aa, Homo Sapiens
ASISGIQAE

SEQ ID NO: 290215 - protein, 9 aa, Homo Sapiens
TCYIANLFL

SEQ ID NO: 290216 - protein, 9 aa, Homo Sapiens
VVWALIASW

SEQ ID NO: 290217 - protein, 9 aa, Homo Sapiens
SAGLTPYLV

SEQ ID NO: 290218 - protein, 9 aa, Homo Sapiens
GPIVATAGF

SEQ ID NO: 290219 - protein, 9 aa, Homo Sapiens
KPTLQAKSQ

SEQ ID NO: 290220 - protein, 9 aa, Homo Sapiens
LFSYYLICV

SEQ ID NO: 290221 - protein, 9 aa, Homo Sapiens
TFIKKPKSW

SEQ ID NO: 290222 - protein, 9 aa, Homo Sapiens
PVSFLAVSS

SEQ ID NO: 290223 - protein, 9 aa, Homo Sapiens
FYNQDHDKL

SEQ ID NO: 290224 - protein, 9 aa, Homo Sapiens
CVFSHLLSY

SEQ ID NO: 290225 - protein, 9 aa, Homo Sapiens
NLRLKFVKL

SEQ ID NO: 290226 - protein, 9 aa, Homo Sapiens
HYHLTCGCQ

SEQ ID NO: 290227 - protein, 9 aa, Homo Sapiens
GQCNFGSNC

SEQ ID NO: 290228 - protein, 9 aa, Homo Sapiens
TALLVMLQS

SEQ ID NO: 290229 - protein, 9 aa, Homo Sapiens
TLLNNYSYN

SEQ ID NO: 290230 - protein, 9 aa, Homo Sapiens
TEGLGSWAW

SEQ ID NO: 290231 - protein, 9 aa, Homo Sapiens
ARQRQPPSP

SEQ ID NO: 290232 - protein, 9 aa, Homo Sapiens
KIFRQEGDR

SEQ ID NO: 290233 - protein, 9 aa, Homo Sapiens
VRRRRMEMI

SEQ ID NO: 290234 - protein, 9 aa, Homo Sapiens
IHLVFGFID

SEQ ID NO: 290235 - protein, 9 aa, Homo Sapiens
DNAAALEEL

SEQ ID NO: 290236 - protein, 9 aa, Homo Sapiens
ILTRGLLKI

SEQ ID NO: 290237 - protein, 9 aa, Homo Sapiens
IAGFRVRLL

SEQ ID NO: 290238 - protein, 9 aa, Homo Sapiens
AIQNAHNNS

SEQ ID NO: 290239 - protein, 9 aa, Homo Sapiens
SLPLPPKKW

SEQ ID NO: 290240 - protein, 9 aa, Homo Sapiens
PSTTCHLPR

SEQ ID NO: 290241 - protein, 9 aa, Homo Sapiens
PHEEELLSQ

SEQ ID NO: 290242 - protein, 9 aa, Homo Sapiens
GGMASTFGL

SEQ ID NO: 290243 - protein, 9 aa, Homo Sapiens
SSKLWMLEL

SEQ ID NO: 290244 - protein, 9 aa, Homo Sapiens
SNPTKHQRS

SEQ ID NO: 290245 - protein, 9 aa, Homo Sapiens
TAGNEAVLI

SEQ ID NO: 290246 - protein, 9 aa, Homo Sapiens
SGSCPEDEF

SEQ ID NO: 290247 - protein, 9 aa, Homo Sapiens
MAFCSVAQA

SEQ ID NO: 290248 - protein, 9 aa, Homo Sapiens
MYWRTALLR

SEQ ID NO: 290249 - protein, 9 aa, Homo Sapiens
EQQQGNQER

SEQ ID NO: 290250 - protein, 9 aa, Homo Sapiens
LHDGCSEAF

SEQ ID NO: 290251 - protein, 9 aa, Homo Sapiens
ATRDGVIQY

SEQ ID NO: 290252 - protein, 9 aa, Homo Sapiens
LDSSRDNEV

SEQ ID NO: 290253 - protein, 9 aa, Homo Sapiens
FKDNSNVYM

SEQ ID NO: 290254 - protein, 9 aa, Homo Sapiens
SVMETKNSG

SEQ ID NO: 290255 - protein, 9 aa, Homo Sapiens
NQNEKQIAT

SEQ ID NO: 290256 - protein, 9 aa, Homo Sapiens
EALDGFIIT

SEQ ID NO: 290257 - protein, 9 aa, Homo Sapiens
DFQKYFVKY

SEQ ID NO: 290258 - protein, 9 aa, Homo Sapiens
EEQDKMLSL

SEQ ID NO: 290259 - protein, 9 aa, Homo Sapiens
QVHSGEKNN

SEQ ID NO: 290260 - protein, 9 aa, Homo Sapiens
IEPPEGTKS

SEQ ID NO: 290261 - protein, 9 aa, Homo Sapiens
MTSATERET

SEQ ID NO: 290262 - protein, 9 aa, Homo Sapiens
TLGFSAACV

SEQ ID NO: 290263 - protein, 9 aa, Homo Sapiens
PSYHNKPPG

SEQ ID NO: 290264 - protein, 9 aa, Homo Sapiens
CPHSTHRYL

SEQ ID NO: 290265 - protein, 9 aa, Homo Sapiens
LTTASLMEK

SEQ ID NO: 290266 - protein, 9 aa, Homo Sapiens
TLRCRAFNY

SEQ ID NO: 290267 - protein, 9 aa, Homo Sapiens
DLLYGRASC

SEQ ID NO: 290268 - protein, 9 aa, Homo Sapiens
EEKSRVQES

SEQ ID NO: 290269 - protein, 9 aa, Homo Sapiens
IDGHMSGQV

SEQ ID NO: 290270 - protein, 9 aa, Homo Sapiens
NNSRRQSQK

SEQ ID NO: 290271 - protein, 9 aa, Homo Sapiens
KSPKTMKTF

SEQ ID NO: 290272 - protein, 9 aa, Homo Sapiens
FDKLKLTSN

SEQ ID NO: 290273 - protein, 9 aa, Homo Sapiens
DLQKVLLYV

SEQ ID NO: 290274 - protein, 9 aa, Homo Sapiens
KDNIFQQHR

SEQ ID NO: 290275 - protein, 9 aa, Homo Sapiens
GEPGGGPIG

SEQ ID NO: 290276 - protein, 9 aa, Homo Sapiens
ELKLSPFST

SEQ ID NO: 290277 - protein, 9 aa, Homo Sapiens
RYLSSLHIH

SEQ ID NO: 290278 - protein, 9 aa, Homo Sapiens
QPERICQRT

SEQ ID NO: 290279 - protein, 9 aa, Homo Sapiens
KEVKGALKN

SEQ ID NO: 290280 - protein, 9 aa, Homo Sapiens
KQGEGYILV

SEQ ID NO: 290281 - protein, 9 aa, Homo Sapiens
TDIKTEFIN

SEQ ID NO: 290282 - protein, 9 aa, Homo Sapiens
KDIQSCLTV

SEQ ID NO: 290283 - protein, 9 aa, Homo Sapiens
KILNKEKSD

SEQ ID NO: 290284 - protein, 9 aa, Homo Sapiens
ILPGTEQDM

SEQ ID NO: 290285 - protein, 9 aa, Homo Sapiens
LQDKNCEPV

SEQ ID NO: 290286 - protein, 9 aa, Homo Sapiens
KKMNREYTR

SEQ ID NO: 290287 - protein, 9 aa, Homo Sapiens
NVVRDRPDT

SEQ ID NO: 290288 - protein, 9 aa, Homo Sapiens
TISPQMNTL

SEQ ID NO: 290289 - protein, 9 aa, Homo Sapiens
FLEAEFLIS

SEQ ID NO: 290290 - protein, 9 aa, Homo Sapiens
GEGLRYFSG

SEQ ID NO: 290291 - protein, 9 aa, Homo Sapiens
KINFLLGSE

SEQ ID NO: 290292 - protein, 9 aa, Homo Sapiens
KLSLDQIDL

SEQ ID NO: 290293 - protein, 9 aa, Homo Sapiens
KKRIKKLLV

SEQ ID NO: 290294 - protein, 9 aa, Homo Sapiens
DCGDSPPAP

SEQ ID NO: 290295 - protein, 9 aa, Homo Sapiens
NVKFRKWMG

SEQ ID NO: 290296 - protein, 9 aa, Homo Sapiens
IELYQVMFM

SEQ ID NO: 290297 - protein, 9 aa, Homo Sapiens
VLGPTPVRR

SEQ ID NO: 290298 - protein, 9 aa, Homo Sapiens
CSLIHINYY

SEQ ID NO: 290299 - protein, 9 aa, Homo Sapiens
KLQPELMIL

SEQ ID NO: 290300 - protein, 9 aa, Homo Sapiens
LFNRVNLIY

SEQ ID NO: 290301 - protein, 9 aa, Homo Sapiens
KENIFQAFL

SEQ ID NO: 290302 - protein, 9 aa, Homo Sapiens
LLKPNSLYT

SEQ ID NO: 290303 - protein, 9 aa, Homo Sapiens
VKFYPPDPV

SEQ ID NO: 290304 - protein, 9 aa, Homo Sapiens
VANTRLCGA

SEQ ID NO: 290305 - protein, 9 aa, Homo Sapiens
SCSFPDFFA

SEQ ID NO: 290306 - protein, 9 aa, Homo Sapiens
IALSPRLEC

SEQ ID NO: 290307 - protein, 9 aa, Homo Sapiens
KLLEIFALE

SEQ ID NO: 290308 - protein, 9 aa, Homo Sapiens
KHEQPVEEV

SEQ ID NO: 290309 - protein, 9 aa, Homo Sapiens
HNLQLSKNK

SEQ ID NO: 290310 - protein, 9 aa, Homo Sapiens
GLAENITPE

SEQ ID NO: 290311 - protein, 9 aa, Homo Sapiens
FEKGAEDRL

SEQ ID NO: 290312 - protein, 9 aa, Homo Sapiens
WPPAHLSPS

SEQ ID NO: 290313 - protein, 9 aa, Homo Sapiens
FPCSMIILS

SEQ ID NO: 290314 - protein, 9 aa, Homo Sapiens
KDKCDCIII

SEQ ID NO: 290315 - protein, 9 aa, Homo Sapiens
HFFICTAKT

SEQ ID NO: 290316 - protein, 9 aa, Homo Sapiens
QFLRSQQEL

SEQ ID NO: 290317 - protein, 9 aa, Homo Sapiens
NNGRFSLCE

SEQ ID NO: 290318 - protein, 9 aa, Homo Sapiens
TEVDALALH

SEQ ID NO: 290319 - protein, 9 aa, Homo Sapiens
QAKLERVYN

SEQ ID NO: 290320 - protein, 9 aa, Homo Sapiens
EMVVPDLSE

SEQ ID NO: 290321 - protein, 9 aa, Homo Sapiens
AEFDKGFKV

SEQ ID NO: 290322 - protein, 9 aa, Homo Sapiens
NCCPIDWIA

SEQ ID NO: 290323 - protein, 9 aa, Homo Sapiens
LQLLQVDFL

SEQ ID NO: 290324 - protein, 9 aa, Homo Sapiens
ELCKHSFAF

SEQ ID NO: 290325 - protein, 9 aa, Homo Sapiens
GSNETIDSL

SEQ ID NO: 290326 - protein, 9 aa, Homo Sapiens
SIIEDYANY

SEQ ID NO: 290327 - protein, 9 aa, Homo Sapiens
AARGEDYDK

SEQ ID NO: 290328 - protein, 9 aa, Homo Sapiens
YYFSELVLT

SEQ ID NO: 290329 - protein, 9 aa, Homo Sapiens
EMDGSIGAW

SEQ ID NO: 290330 - protein, 9 aa, Homo Sapiens
EYAQHIKED

SEQ ID NO: 290331 - protein, 9 aa, Homo Sapiens
TNINAVCRA

SEQ ID NO: 290332 - protein, 9 aa, Homo Sapiens
FFRVHILYG

SEQ ID NO: 290333 - protein, 9 aa, Homo Sapiens
EILSWSQNF

SEQ ID NO: 290334 - protein, 9 aa, Homo Sapiens
SRCQCTLDK

SEQ ID NO: 290335 - protein, 9 aa, Homo Sapiens
REMNAKEEL

SEQ ID NO: 290336 - protein, 9 aa, Homo Sapiens
DKHFSLLYT

SEQ ID NO: 290337 - protein, 9 aa, Homo Sapiens
VFQPKTQFI

SEQ ID NO: 290338 - protein, 9 aa, Homo Sapiens
ADYANYNYC

SEQ ID NO: 290339 - protein, 9 aa, Homo Sapiens
RINRFIVSH

SEQ ID NO: 290340 - protein, 9 aa, Homo Sapiens
LEADTETRP

SEQ ID NO: 290341 - protein, 9 aa, Homo Sapiens
NKRPDEGMR

SEQ ID NO: 290342 - protein, 9 aa, Homo Sapiens
RYKQFSCLT

SEQ ID NO: 290343 - protein, 9 aa, Homo Sapiens
EYFMRIWAA

SEQ ID NO: 290344 - protein, 9 aa, Homo Sapiens
RIDSANMTD

SEQ ID NO: 290345 - protein, 9 aa, Homo Sapiens
YGDMYDLST

SEQ ID NO: 290346 - protein, 9 aa, Homo Sapiens
APSSAQHSH

SEQ ID NO: 290347 - protein, 9 aa, Homo Sapiens
LGGLAPPSL

SEQ ID NO: 290348 - protein, 9 aa, Homo Sapiens
EHIVLREGR

SEQ ID NO: 290349 - protein, 9 aa, Homo Sapiens
LQTRFMTPE

SEQ ID NO: 290350 - protein, 9 aa, Homo Sapiens
STNQCFGNF

SEQ ID NO: 290351 - protein, 9 aa, Homo Sapiens
EDVRQHHRY

SEQ ID NO: 290352 - protein, 9 aa, Homo Sapiens
CNNAPDIFI

SEQ ID NO: 290353 - protein, 9 aa, Homo Sapiens
LLDVNYHPP

SEQ ID NO: 290354 - protein, 9 aa, Homo Sapiens
FVYFWQAVV

SEQ ID NO: 290355 - protein, 9 aa, Homo Sapiens
LIMKITCLE

SEQ ID NO: 290356 - protein, 9 aa, Homo Sapiens
VGGVPLQAN

SEQ ID NO: 290357 - protein, 9 aa, Homo Sapiens
LNIDLRVTS

SEQ ID NO: 290358 - protein, 9 aa, Homo Sapiens
DSSTSSYSS

SEQ ID NO: 290359 - protein, 9 aa, Homo Sapiens
NLPLPVPPS

SEQ ID NO: 290360 - protein, 9 aa, Homo Sapiens
VIWIGYLAK

SEQ ID NO: 290361 - protein, 9 aa, Homo Sapiens
VLGGYSPPR

SEQ ID NO: 290362 - protein, 9 aa, Homo Sapiens
IFYIVPAIL

SEQ ID NO: 290363 - protein, 9 aa, Homo Sapiens
KIPFLIWQK

SEQ ID NO: 290364 - protein, 9 aa, Homo Sapiens
GQNFQHISP

SEQ ID NO: 290365 - protein, 9 aa, Homo Sapiens
QNTPRRLRL

SEQ ID NO: 290366 - protein, 9 aa, Homo Sapiens
PSTSSTVQT

SEQ ID NO: 290367 - protein, 9 aa, Homo Sapiens
GPNAILVSL

SEQ ID NO: 290368 - protein, 9 aa, Homo Sapiens
GFQVIFTDC

SEQ ID NO: 290369 - protein, 9 aa, Homo Sapiens
NDFVTQQTT

SEQ ID NO: 290370 - protein, 9 aa, Homo Sapiens
IVRDKKCMT

SEQ ID NO: 290371 - protein, 9 aa, Homo Sapiens
AKIKEDIEA

SEQ ID NO: 290372 - protein, 9 aa, Homo Sapiens
LTGGRGKIS

SEQ ID NO: 290373 - protein, 9 aa, Homo Sapiens
MQNSVPNKD

SEQ ID NO: 290374 - protein, 9 aa, Homo Sapiens
ISKAGTETA

SEQ ID NO: 290375 - protein, 9 aa, Homo Sapiens
NGRYKCDLR

SEQ ID NO: 290376 - protein, 9 aa, Homo Sapiens
RFKHEQIYT

SEQ ID NO: 290377 - protein, 9 aa, Homo Sapiens
LPHELGEFA

SEQ ID NO: 290378 - protein, 9 aa, Homo Sapiens
SSVCRLISR

SEQ ID NO: 290379 - protein, 9 aa, Homo Sapiens
LSIFEEEIM

SEQ ID NO: 290380 - protein, 9 aa, Homo Sapiens
VLEEAEFQM

SEQ ID NO: 290381 - protein, 9 aa, Homo Sapiens
SWMEDTAFR

SEQ ID NO: 290382 - protein, 9 aa, Homo Sapiens
QCSNAFPFY

SEQ ID NO: 290383 - protein, 9 aa, Homo Sapiens
PYELGRLFR

SEQ ID NO: 290384 - protein, 9 aa, Homo Sapiens
IKSDEQEDE

SEQ ID NO: 290385 - protein, 9 aa, Homo Sapiens
AFRRLFELF

SEQ ID NO: 290386 - protein, 9 aa, Homo Sapiens
GERPYTCDE

SEQ ID NO: 290387 - protein, 9 aa, Homo Sapiens
PEIIEMDGS

SEQ ID NO: 290388 - protein, 9 aa, Homo Sapiens
QSSDLTKHK

SEQ ID NO: 290389 - protein, 9 aa, Homo Sapiens
SGDVTLVTP

SEQ ID NO: 290390 - protein, 9 aa, Homo Sapiens
CIPDLDFPF

SEQ ID NO: 290391 - protein, 9 aa, Homo Sapiens
IIEAIHTFP

SEQ ID NO: 290392 - protein, 9 aa, Homo Sapiens
VGYGQKFCI

SEQ ID NO: 290393 - protein, 9 aa, Homo Sapiens
LVTSPLFIL

SEQ ID NO: 290394 - protein, 9 aa, Homo Sapiens
SVTLKDVIV

SEQ ID NO: 290395 - protein, 9 aa, Homo Sapiens
QKYYQLLEK

SEQ ID NO: 290396 - protein, 9 aa, Homo Sapiens
VIRRGPISM

SEQ ID NO: 290397 - protein, 9 aa, Homo Sapiens
KNRCGFSDS

SEQ ID NO: 290398 - protein, 9 aa, Homo Sapiens
QSNDGKNDG

SEQ ID NO: 290399 - protein, 9 aa, Homo Sapiens
GLTQITNTA

SEQ ID NO: 290400 - protein, 9 aa, Homo Sapiens
PAMDPNAAY

SEQ ID NO: 290401 - protein, 9 aa, Homo Sapiens
YDRNYIEKE

SEQ ID NO: 290402 - protein, 9 aa, Homo Sapiens
FLNDLEKQY

SEQ ID NO: 290403 - protein, 9 aa, Homo Sapiens
DNLNKLMTN

SEQ ID NO: 290404 - protein, 9 aa, Homo Sapiens
VITHRLLKD

SEQ ID NO: 290405 - protein, 9 aa, Homo Sapiens
GGRISLKHP

SEQ ID NO: 290406 - protein, 9 aa, Homo Sapiens
LALPVCPDT

SEQ ID NO: 290407 - protein, 9 aa, Homo Sapiens
QSLLRANQA

SEQ ID NO: 290408 - protein, 9 aa, Homo Sapiens
LQQQEEEIQ

SEQ ID NO: 290409 - protein, 9 aa, Homo Sapiens
VTSTIPVVS

SEQ ID NO: 290410 - protein, 9 aa, Homo Sapiens
PSKHTQTGR

SEQ ID NO: 290411 - protein, 9 aa, Homo Sapiens
PMNPNKYLG

SEQ ID NO: 290412 - protein, 9 aa, Homo Sapiens
FVWGLICIS

SEQ ID NO: 290413 - protein, 9 aa, Homo Sapiens
GGWQHNRKQ

SEQ ID NO: 290414 - protein, 9 aa, Homo Sapiens
LPRFKPWLH

SEQ ID NO: 290415 - protein, 9 aa, Homo Sapiens
YTDNHASIC

SEQ ID NO: 290416 - protein, 9 aa, Homo Sapiens
HRRRRLVQK

SEQ ID NO: 290417 - protein, 9 aa, Homo Sapiens
SLMLFDAIC

SEQ ID NO: 290418 - protein, 9 aa, Homo Sapiens
RRKIFLPKV

SEQ ID NO: 290419 - protein, 9 aa, Homo Sapiens
AVRDIGRCA

SEQ ID NO: 290420 - protein, 9 aa, Homo Sapiens
SPPEDYRRG

SEQ ID NO: 290421 - protein, 9 aa, Homo Sapiens
QLQVFMVIG

SEQ ID NO: 290422 - protein, 9 aa, Homo Sapiens
NSGIINTQP

SEQ ID NO: 290423 - protein, 9 aa, Homo Sapiens
SPHKPPYNS

SEQ ID NO: 290424 - protein, 9 aa, Homo Sapiens
NQRKTKGAN

SEQ ID NO: 290425 - protein, 9 aa, Homo Sapiens
ESASSYQEA

SEQ ID NO: 290426 - protein, 9 aa, Homo Sapiens
YKYYFPVIL

SEQ ID NO: 290427 - protein, 9 aa, Homo Sapiens
KTLAQILAD

SEQ ID NO: 290428 - protein, 9 aa, Homo Sapiens
KMLSPHENE

SEQ ID NO: 290429 - protein, 9 aa, Homo Sapiens
FIKWHSVMY

SEQ ID NO: 290430 - protein, 9 aa, Homo Sapiens
CKHQIKIRD

SEQ ID NO: 290431 - protein, 9 aa, Homo Sapiens
MWCLERLCL

SEQ ID NO: 290432 - protein, 9 aa, Homo Sapiens
LITKMNLMV

SEQ ID NO: 290433 - protein, 9 aa, Homo Sapiens
DLNDSFIDD

SEQ ID NO: 290434 - protein, 9 aa, Homo Sapiens
FKEGYNDLN

SEQ ID NO: 290435 - protein, 9 aa, Homo Sapiens
TTSVSSEFI

SEQ ID NO: 290436 - protein, 9 aa, Homo Sapiens
GHCRIKVSR

SEQ ID NO: 290437 - protein, 9 aa, Homo Sapiens
NTFRCGETR

SEQ ID NO: 290438 - protein, 9 aa, Homo Sapiens
ASAWCLWRP

SEQ ID NO: 290439 - protein, 9 aa, Homo Sapiens
QVMKFSEKA

SEQ ID NO: 290440 - protein, 9 aa, Homo Sapiens
CQFSNVIRK

SEQ ID NO: 290441 - protein, 9 aa, Homo Sapiens
QEMKKAGER

SEQ ID NO: 290442 - protein, 9 aa, Homo Sapiens
SPILENALI

SEQ ID NO: 290443 - protein, 9 aa, Homo Sapiens
YSVELIITS

SEQ ID NO: 290444 - protein, 9 aa, Homo Sapiens
DSELLRKHN

SEQ ID NO: 290445 - protein, 9 aa, Homo Sapiens
SKRAIQAKD

SEQ ID NO: 290446 - protein, 9 aa, Homo Sapiens
RVKTMLLKS

SEQ ID NO: 290447 - protein, 9 aa, Homo Sapiens
GEGTALPFS

SEQ ID NO: 290448 - protein, 9 aa, Homo Sapiens
GLMVFPPAF

SEQ ID NO: 290449 - protein, 9 aa, Homo Sapiens
GNKTCQDIN

SEQ ID NO: 290450 - protein, 9 aa, Homo Sapiens
DDIDNIKWE

SEQ ID NO: 290451 - protein, 9 aa, Homo Sapiens
SSILPAGFK

SEQ ID NO: 290452 - protein, 9 aa, Homo Sapiens
VTKFILMGF

SEQ ID NO: 290453 - protein, 9 aa, Homo Sapiens
LSMLSLSFF

SEQ ID NO: 290454 - protein, 9 aa, Homo Sapiens
KQNPSSGVR

SEQ ID NO: 290455 - protein, 9 aa, Homo Sapiens
MTYIKKNHE

SEQ ID NO: 290456 - protein, 9 aa, Homo Sapiens
RKRFNAFVL

SEQ ID NO: 290457 - protein, 9 aa, Homo Sapiens
PHDPADAAE

SEQ ID NO: 290458 - protein, 9 aa, Homo Sapiens
EEYAQNVLR

SEQ ID NO: 290459 - protein, 9 aa, Homo Sapiens
SFTWLCRHV

SEQ ID NO: 290460 - protein, 9 aa, Homo Sapiens
KMALNPRKC

SEQ ID NO: 290461 - protein, 9 aa, Homo Sapiens
NVLILECDV

SEQ ID NO: 290462 - protein, 9 aa, Homo Sapiens
KRALCPTCL

SEQ ID NO: 290463 - protein, 9 aa, Homo Sapiens
FIFREEDTS

SEQ ID NO: 290464 - protein, 9 aa, Homo Sapiens
GRTLHQSGS

SEQ ID NO: 290465 - protein, 9 aa, Homo Sapiens
HVGNKFFLT

SEQ ID NO: 290466 - protein, 9 aa, Homo Sapiens
TSDPQSNDN

SEQ ID NO: 290467 - protein, 9 aa, Homo Sapiens
VARYLISLG

SEQ ID NO: 290468 - protein, 9 aa, Homo Sapiens
IQVNNVNEY

SEQ ID NO: 290469 - protein, 9 aa, Homo Sapiens
TFVSRYDGA

SEQ ID NO: 290470 - protein, 9 aa, Homo Sapiens
VVSSVNSVA

SEQ ID NO: 290471 - protein, 9 aa, Homo Sapiens
NPVWLRSKF

SEQ ID NO: 290472 - protein, 9 aa, Homo Sapiens
TSVLEAIAG

SEQ ID NO: 290473 - protein, 9 aa, Homo Sapiens
ILWGEGSPA

SEQ ID NO: 290474 - protein, 9 aa, Homo Sapiens
PIWRVQKAP

SEQ ID NO: 290475 - protein, 9 aa, Homo Sapiens
EQIWKLRRE

SEQ ID NO: 290476 - protein, 9 aa, Homo Sapiens
EEPSEDPEA

SEQ ID NO: 290477 - protein, 9 aa, Homo Sapiens
GQEESDPSY

SEQ ID NO: 290478 - protein, 9 aa, Homo Sapiens
KFKVPDVEL

SEQ ID NO: 290479 - protein, 9 aa, Homo Sapiens
KSPIMADLS

SEQ ID NO: 290480 - protein, 9 aa, Homo Sapiens
NHETQVGIC

SEQ ID NO: 290481 - protein, 9 aa, Homo Sapiens
FFNLVHLTE

SEQ ID NO: 290482 - protein, 9 aa, Homo Sapiens
FTNRNRLSK

SEQ ID NO: 290483 - protein, 9 aa, Homo Sapiens
CTLVKMNRI

SEQ ID NO: 290484 - protein, 9 aa, Homo Sapiens
NRCGFSDSK

SEQ ID NO: 290485 - protein, 9 aa, Homo Sapiens
NTFALLVEM

SEQ ID NO: 290486 - protein, 9 aa, Homo Sapiens
QCVQLNDGH

SEQ ID NO: 290487 - protein, 9 aa, Homo Sapiens
LALGLAQPT

SEQ ID NO: 290488 - protein, 9 aa, Homo Sapiens
RSPAEYKIL

SEQ ID NO: 290489 - protein, 9 aa, Homo Sapiens
YLVDAVIYA

SEQ ID NO: 290490 - protein, 9 aa, Homo Sapiens
NRALSVLRM

SEQ ID NO: 290491 - protein, 9 aa, Homo Sapiens
VQNIVESQI

SEQ ID NO: 290492 - protein, 9 aa, Homo Sapiens
AGTKSPVRE

SEQ ID NO: 290493 - protein, 9 aa, Homo Sapiens
VKEDAKPKK

SEQ ID NO: 290494 - protein, 9 aa, Homo Sapiens
DNSTPPYKD

SEQ ID NO: 290495 - protein, 9 aa, Homo Sapiens
KTINPVFNE

SEQ ID NO: 290496 - protein, 9 aa, Homo Sapiens
VIVPTDIKT

SEQ ID NO: 290497 - protein, 9 aa, Homo Sapiens
SWNYRLPAG

SEQ ID NO: 290498 - protein, 9 aa, Homo Sapiens
QKFCIAGFR

SEQ ID NO: 290499 - protein, 9 aa, Homo Sapiens
VLVWNRIYK

SEQ ID NO: 290500 - protein, 9 aa, Homo Sapiens
TKAYQQMVL

SEQ ID NO: 290501 - protein, 9 aa, Homo Sapiens
LDVSRNELP

SEQ ID NO: 290502 - protein, 9 aa, Homo Sapiens
HQVQEKDYL

SEQ ID NO: 290503 - protein, 9 aa, Homo Sapiens
TSTGSTSSQ

SEQ ID NO: 290504 - protein, 9 aa, Homo Sapiens
LFLLCGQYS

SEQ ID NO: 290505 - protein, 9 aa, Homo Sapiens
GRLVWLGLD

SEQ ID NO: 290506 - protein, 9 aa, Homo Sapiens
CLFGCPPGY

SEQ ID NO: 290507 - protein, 9 aa, Homo Sapiens
HTPEVTLVP

SEQ ID NO: 290508 - protein, 9 aa, Homo Sapiens
AHNKSVSCH

SEQ ID NO: 290509 - protein, 9 aa, Homo Sapiens
ETKKTGHEM

SEQ ID NO: 290510 - protein, 9 aa, Homo Sapiens
YVNHEFAYT

SEQ ID NO: 290511 - protein, 9 aa, Homo Sapiens
QVLSEDGDG

SEQ ID NO: 290512 - protein, 9 aa, Homo Sapiens
LVNVDGEEV

SEQ ID NO: 290513 - protein, 9 aa, Homo Sapiens
IARLFWHMD

SEQ ID NO: 290514 - protein, 9 aa, Homo Sapiens
TDKSRQKEA

SEQ ID NO: 290515 - protein, 9 aa, Homo Sapiens
GDMERVANS

SEQ ID NO: 290516 - protein, 9 aa, Homo Sapiens
DLSTTQSTT

SEQ ID NO: 290517 - protein, 9 aa, Homo Sapiens
YFTLNPASK

SEQ ID NO: 290518 - protein, 9 aa, Homo Sapiens
GICLNRSER

SEQ ID NO: 290519 - protein, 9 aa, Homo Sapiens
IFHPEYGMF

SEQ ID NO: 290520 - protein, 9 aa, Homo Sapiens
FYCQNVQDF

SEQ ID NO: 290521 - protein, 9 aa, Homo Sapiens
KSSLKQVET

SEQ ID NO: 290522 - protein, 9 aa, Homo Sapiens
YLLILDAVR

SEQ ID NO: 290523 - protein, 9 aa, Homo Sapiens
DTKMALNPR

SEQ ID NO: 290524 - protein, 9 aa, Homo Sapiens
LCDLTEPCL

SEQ ID NO: 290525 - protein, 9 aa, Homo Sapiens
VPGGHSTLR

SEQ ID NO: 290526 - protein, 9 aa, Homo Sapiens
FANIQDSLG

SEQ ID NO: 290527 - protein, 9 aa, Homo Sapiens
GCDDYVFIE

SEQ ID NO: 290528 - protein, 9 aa, Homo Sapiens
VDEGSKPGI

SEQ ID NO: 290529 - protein, 9 aa, Homo Sapiens
GEHDPVTEC

SEQ ID NO: 290530 - protein, 9 aa, Homo Sapiens
VLGLIWGQN

SEQ ID NO: 290531 - protein, 9 aa, Homo Sapiens
IHLKIFRQE

SEQ ID NO: 290532 - protein, 9 aa, Homo Sapiens
NDNSYARVQ

SEQ ID NO: 290533 - protein, 9 aa, Homo Sapiens
LSVCKDLQL

SEQ ID NO: 290534 - protein, 9 aa, Homo Sapiens
CEDPNNSSV

SEQ ID NO: 290535 - protein, 9 aa, Homo Sapiens
KEISDDEED

SEQ ID NO: 290536 - protein, 9 aa, Homo Sapiens
HQDPPDSGE

SEQ ID NO: 290537 - protein, 9 aa, Homo Sapiens
KDKGYPKLL

SEQ ID NO: 290538 - protein, 9 aa, Homo Sapiens
QVSFPHNGP

SEQ ID NO: 290539 - protein, 9 aa, Homo Sapiens
SSVCSRNRH

SEQ ID NO: 290540 - protein, 9 aa, Homo Sapiens
EKRAKIKED

SEQ ID NO: 290541 - protein, 9 aa, Homo Sapiens
CVLNKCDLV

SEQ ID NO: 290542 - protein, 9 aa, Homo Sapiens
SAETRETLQ

SEQ ID NO: 290543 - protein, 9 aa, Homo Sapiens
EEYSFGRSN

SEQ ID NO: 290544 - protein, 9 aa, Homo Sapiens
PRTRKWSKM

SEQ ID NO: 290545 - protein, 9 aa, Homo Sapiens
KLQDTKSTD

SEQ ID NO: 290546 - protein, 9 aa, Homo Sapiens
IYMEVRPYK

SEQ ID NO: 290547 - protein, 9 aa, Homo Sapiens
YNVDNVPRV

SEQ ID NO: 290548 - protein, 9 aa, Homo Sapiens
SQHTSRLCY

SEQ ID NO: 290549 - protein, 9 aa, Homo Sapiens
NKGKILAKK

SEQ ID NO: 290550 - protein, 9 aa, Homo Sapiens
GHLLLGVVQ

SEQ ID NO: 290551 - protein, 9 aa, Homo Sapiens
QLRGALQAT

SEQ ID NO: 290552 - protein, 9 aa, Homo Sapiens
VDLQGDSFL

SEQ ID NO: 290553 - protein, 9 aa, Homo Sapiens
KLQSESQKI

SEQ ID NO: 290554 - protein, 9 aa, Homo Sapiens
DCSNFDKEL

SEQ ID NO: 290555 - protein, 9 aa, Homo Sapiens
HEALEILSA

SEQ ID NO: 290556 - protein, 9 aa, Homo Sapiens
PSSLDAVIS

SEQ ID NO: 290557 - protein, 9 aa, Homo Sapiens
KGNRVNKTK

SEQ ID NO: 290558 - protein, 9 aa, Homo Sapiens
VKGDYAVED

SEQ ID NO: 290559 - protein, 9 aa, Homo Sapiens
TYGFGQHGL

SEQ ID NO: 290560 - protein, 9 aa, Homo Sapiens
RHVMVAKPP

SEQ ID NO: 290561 - protein, 9 aa, Homo Sapiens
MKPEVISHP

SEQ ID NO: 290562 - protein, 9 aa, Homo Sapiens
RDSRKNSAI

SEQ ID NO: 290563 - protein, 9 aa, Homo Sapiens
RAVMLQGVD

SEQ ID NO: 290564 - protein, 9 aa, Homo Sapiens
LQGQVLKTA

SEQ ID NO: 290565 - protein, 9 aa, Homo Sapiens
GKETSPNHP

SEQ ID NO: 290566 - protein, 9 aa, Homo Sapiens
THNPGTVKI

SEQ ID NO: 290567 - protein, 9 aa, Homo Sapiens
APDPVFDTS

SEQ ID NO: 290568 - protein, 9 aa, Homo Sapiens
QHHRIHTGN

SEQ ID NO: 290569 - protein, 9 aa, Homo Sapiens
GDITTLIRE

SEQ ID NO: 290570 - protein, 9 aa, Homo Sapiens
YNAANLRNL

SEQ ID NO: 290571 - protein, 9 aa, Homo Sapiens
PENGEEHTL

SEQ ID NO: 290572 - protein, 9 aa, Homo Sapiens
AIAQQWLEY

SEQ ID NO: 290573 - protein, 9 aa, Homo Sapiens
GAGSNGLQS

SEQ ID NO: 290574 - protein, 9 aa, Homo Sapiens
RKIGERALQ

SEQ ID NO: 290575 - protein, 9 aa, Homo Sapiens
QFVPPLYYL

SEQ ID NO: 290576 - protein, 9 aa, Homo Sapiens
ANLELLNNG

SEQ ID NO: 290577 - protein, 9 aa, Homo Sapiens
NVKEDTFKW

SEQ ID NO: 290578 - protein, 9 aa, Homo Sapiens
KETWTAGSW

SEQ ID NO: 290579 - protein, 9 aa, Homo Sapiens
MASCQQQQI

SEQ ID NO: 290580 - protein, 9 aa, Homo Sapiens
HGVPEFILV

SEQ ID NO: 290581 - protein, 9 aa, Homo Sapiens
NVCVSLVFS

SEQ ID NO: 290582 - protein, 9 aa, Homo Sapiens
EYTRNASNL

SEQ ID NO: 290583 - protein, 9 aa, Homo Sapiens
VKDVPQIPL

SEQ ID NO: 290584 - protein, 9 aa, Homo Sapiens
FRQLRRIGL

SEQ ID NO: 290585 - protein, 9 aa, Homo Sapiens
SPTPASYAA

SEQ ID NO: 290586 - protein, 9 aa, Homo Sapiens
DQRHDGNKH

SEQ ID NO: 290587 - protein, 9 aa, Homo Sapiens
QVNGVLPDC

SEQ ID NO: 290588 - protein, 9 aa, Homo Sapiens
PQINSYVEV

SEQ ID NO: 290589 - protein, 9 aa, Homo Sapiens
RGESHILLV

SEQ ID NO: 290590 - protein, 9 aa, Homo Sapiens
VAFYVAGFD

SEQ ID NO: 290591 - protein, 9 aa, Homo Sapiens
TDNYTHDVV

SEQ ID NO: 290592 - protein, 9 aa, Homo Sapiens
CMLRNERQF

SEQ ID NO: 290593 - protein, 9 aa, Homo Sapiens
DCLPKFLVI

SEQ ID NO: 290594 - protein, 9 aa, Homo Sapiens
KNVCQLESE

SEQ ID NO: 290595 - protein, 9 aa, Homo Sapiens
EFTIIRVSQ

SEQ ID NO: 290596 - protein, 9 aa, Homo Sapiens
DRIHCIDIL

SEQ ID NO: 290597 - protein, 9 aa, Homo Sapiens
PCPVSFLAV

SEQ ID NO: 290598 - protein, 9 aa, Homo Sapiens
VAEVVIGLL

SEQ ID NO: 290599 - protein, 9 aa, Homo Sapiens
KLIIHLWKH

SEQ ID NO: 290600 - protein, 9 aa, Homo Sapiens
TGTLQRHAS

SEQ ID NO: 290601 - protein, 9 aa, Homo Sapiens
VSNRFQLGT

SEQ ID NO: 290602 - protein, 9 aa, Homo Sapiens
NMKTVSLSV

SEQ ID NO: 290603 - protein, 9 aa, Homo Sapiens
CSLDLAGNQ

SEQ ID NO: 290604 - protein, 9 aa, Homo Sapiens
HTTDILGIT

SEQ ID NO: 290605 - protein, 9 aa, Homo Sapiens
IEQWLEQYT

SEQ ID NO: 290606 - protein, 9 aa, Homo Sapiens
WTALHCAAQ

SEQ ID NO: 290607 - protein, 9 aa, Homo Sapiens
KYRSFKVAG

SEQ ID NO: 290608 - protein, 9 aa, Homo Sapiens
TKRAQDIYV

SEQ ID NO: 290609 - protein, 9 aa, Homo Sapiens
EETKEALAS

SEQ ID NO: 290610 - protein, 9 aa, Homo Sapiens
ALKDVSSCY

SEQ ID NO: 290611 - protein, 9 aa, Homo Sapiens
RPTKPTAFQ

SEQ ID NO: 290612 - protein, 9 aa, Homo Sapiens
HKLANQYHP

SEQ ID NO: 290613 - protein, 9 aa, Homo Sapiens
RLMIFKLVQ

SEQ ID NO: 290614 - protein, 9 aa, Homo Sapiens
LTGLCLTLL

SEQ ID NO: 290615 - protein, 9 aa, Homo Sapiens
LIKLSWLLA

SEQ ID NO: 290616 - protein, 9 aa, Homo Sapiens
PSSAQHSHA

SEQ ID NO: 290617 - protein, 9 aa, Homo Sapiens
YVFLRQAVN

SEQ ID NO: 290618 - protein, 9 aa, Homo Sapiens
YTNWRHLLL

SEQ ID NO: 290619 - protein, 9 aa, Homo Sapiens
YVIYTNTHI

SEQ ID NO: 290620 - protein, 9 aa, Homo Sapiens
FQNHRVQFE

SEQ ID NO: 290621 - protein, 9 aa, Homo Sapiens
FDEFLGICH

SEQ ID NO: 290622 - protein, 9 aa, Homo Sapiens
PSDEKTRMK

SEQ ID NO: 290623 - protein, 9 aa, Homo Sapiens
WETRVLGVY

SEQ ID NO: 290624 - protein, 9 aa, Homo Sapiens
DVSDKYQYF

SEQ ID NO: 290625 - protein, 9 aa, Homo Sapiens
HGTSQDKAI

SEQ ID NO: 290626 - protein, 9 aa, Homo Sapiens
MLNTNPSLR

SEQ ID NO: 290627 - protein, 9 aa, Homo Sapiens
PGNTKSPEP

SEQ ID NO: 290628 - protein, 9 aa, Homo Sapiens
LLGAMSGGG

SEQ ID NO: 290629 - protein, 9 aa, Homo Sapiens
EFKALVAEQ

SEQ ID NO: 290630 - protein, 9 aa, Homo Sapiens
DEGYGMSSV

SEQ ID NO: 290631 - protein, 9 aa, Homo Sapiens
HLHSFFVVG

SEQ ID NO: 290632 - protein, 9 aa, Homo Sapiens
QAPMYFFLS

SEQ ID NO: 290633 - protein, 9 aa, Homo Sapiens
YPHITFENM

SEQ ID NO: 290634 - protein, 9 aa, Homo Sapiens
QTESLTQVP

SEQ ID NO: 290635 - protein, 9 aa, Homo Sapiens
DKASVNYLK

SEQ ID NO: 290636 - protein, 9 aa, Homo Sapiens
QRNSLCVKF

SEQ ID NO: 290637 - protein, 9 aa, Homo Sapiens
AAIVIGTVA

SEQ ID NO: 290638 - protein, 9 aa, Homo Sapiens
GEYLLSGKK

SEQ ID NO: 290639 - protein, 9 aa, Homo Sapiens
LSPTSSFSA

SEQ ID NO: 290640 - protein, 9 aa, Homo Sapiens
PQKVMWRFD

SEQ ID NO: 290641 - protein, 9 aa, Homo Sapiens
CYGGFDLCF

SEQ ID NO: 290642 - protein, 9 aa, Homo Sapiens
KTVILFKVL

SEQ ID NO: 290643 - protein, 9 aa, Homo Sapiens
PPTKQEMKK

SEQ ID NO: 290644 - protein, 9 aa, Homo Sapiens
KQIQIIDFG

SEQ ID NO: 290645 - protein, 9 aa, Homo Sapiens
PSDLGAMDV

SEQ ID NO: 290646 - protein, 9 aa, Homo Sapiens
HHFIPDLID

SEQ ID NO: 290647 - protein, 9 aa, Homo Sapiens
LPDYHRIIK

SEQ ID NO: 290648 - protein, 9 aa, Homo Sapiens
SHIFQDLQS

SEQ ID NO: 290649 - protein, 9 aa, Homo Sapiens
HNNFLLGVL

SEQ ID NO: 290650 - protein, 9 aa, Homo Sapiens
EIKQLTTDP

SEQ ID NO: 290651 - protein, 9 aa, Homo Sapiens
ETNTENSSS

SEQ ID NO: 290652 - protein, 9 aa, Homo Sapiens
DYLTSFLGI

SEQ ID NO: 290653 - protein, 9 aa, Homo Sapiens
ISGDINRTS

SEQ ID NO: 290654 - protein, 9 aa, Homo Sapiens
ARSWVTVLQ

SEQ ID NO: 290655 - protein, 9 aa, Homo Sapiens
LLEACLGGK

SEQ ID NO: 290656 - protein, 9 aa, Homo Sapiens
PPSRFLKPS

SEQ ID NO: 290657 - protein, 9 aa, Homo Sapiens
VNNLENFQL

SEQ ID NO: 290658 - protein, 9 aa, Homo Sapiens
WDFYIFELE

SEQ ID NO: 290659 - protein, 9 aa, Homo Sapiens
ICNNLIKEL

SEQ ID NO: 290660 - protein, 9 aa, Homo Sapiens
FFMDQYKYE

SEQ ID NO: 290661 - protein, 9 aa, Homo Sapiens
ITRNLPDSG

SEQ ID NO: 290662 - protein, 9 aa, Homo Sapiens
IKEVDMKDL

SEQ ID NO: 290663 - protein, 9 aa, Homo Sapiens
YKELLNELH

SEQ ID NO: 290664 - protein, 9 aa, Homo Sapiens
LVELECFRF

SEQ ID NO: 290665 - protein, 9 aa, Homo Sapiens
SKNHQDDGK

SEQ ID NO: 290666 - protein, 9 aa, Homo Sapiens
ASVINNTPL

SEQ ID NO: 290667 - protein, 9 aa, Homo Sapiens
AVVLHMTKT

SEQ ID NO: 290668 - protein, 9 aa, Homo Sapiens
HYSTLFCSR

SEQ ID NO: 290669 - protein, 9 aa, Homo Sapiens
QVVDFSDRA

SEQ ID NO: 290670 - protein, 9 aa, Homo Sapiens
SEGNGGYFH

SEQ ID NO: 290671 - protein, 9 aa, Homo Sapiens
QKDTFHDND

SEQ ID NO: 290672 - protein, 9 aa, Homo Sapiens
DKSADKLRI

SEQ ID NO: 290673 - protein, 9 aa, Homo Sapiens
ECGKHFRSG

SEQ ID NO: 290674 - protein, 9 aa, Homo Sapiens
MLAMHIEKK

SEQ ID NO: 290675 - protein, 9 aa, Homo Sapiens
YPFSSPTSR

SEQ ID NO: 290676 - protein, 9 aa, Homo Sapiens
DALRALPKA

SEQ ID NO: 290677 - protein, 9 aa, Homo Sapiens
IPDMLQQRR

SEQ ID NO: 290678 - protein, 9 aa, Homo Sapiens
YGLSHTVGR

SEQ ID NO: 290679 - protein, 9 aa, Homo Sapiens
SCKLRHLRF

SEQ ID NO: 290680 - protein, 9 aa, Homo Sapiens
RNEEFDWPI

SEQ ID NO: 290681 - protein, 9 aa, Homo Sapiens
NHDNTPADS

SEQ ID NO: 290682 - protein, 9 aa, Homo Sapiens
DGKVAGAWD

SEQ ID NO: 290683 - protein, 9 aa, Homo Sapiens
CAYFGASLC

SEQ ID NO: 290684 - protein, 9 aa, Homo Sapiens
YEHRSRLDK

SEQ ID NO: 290685 - protein, 9 aa, Homo Sapiens
KPEKPQDSL

SEQ ID NO: 290686 - protein, 9 aa, Homo Sapiens
AKICLWEVS

SEQ ID NO: 290687 - protein, 9 aa, Homo Sapiens
RNIQVLESS

SEQ ID NO: 290688 - protein, 9 aa, Homo Sapiens
LQAELSQPL

SEQ ID NO: 290689 - protein, 9 aa, Homo Sapiens
TKVRNLMAE

SEQ ID NO: 290690 - protein, 9 aa, Homo Sapiens
AKKKDQATA

SEQ ID NO: 290691 - protein, 9 aa, Homo Sapiens
LQREQQVTF

SEQ ID NO: 290692 - protein, 9 aa, Homo Sapiens
AEIDLLIVG

SEQ ID NO: 290693 - protein, 9 aa, Homo Sapiens
SNTTPRVEN

SEQ ID NO: 290694 - protein, 9 aa, Homo Sapiens
FKPRSAMRG

SEQ ID NO: 290695 - protein, 9 aa, Homo Sapiens
LNNFSGRIE

SEQ ID NO: 290696 - protein, 9 aa, Homo Sapiens
KAYERELGK

SEQ ID NO: 290697 - protein, 9 aa, Homo Sapiens
AHKQKVVEK

SEQ ID NO: 290698 - protein, 9 aa, Homo Sapiens
HTADQDTST

SEQ ID NO: 290699 - protein, 9 aa, Homo Sapiens
AFKPKHYLT

SEQ ID NO: 290700 - protein, 9 aa, Homo Sapiens
AFRACFLKV

SEQ ID NO: 290701 - protein, 9 aa, Homo Sapiens
SLILLGKAQ

SEQ ID NO: 290702 - protein, 9 aa, Homo Sapiens
VKTQEERVK

SEQ ID NO: 290703 - protein, 9 aa, Homo Sapiens
MKDQGAQME

SEQ ID NO: 290704 - protein, 9 aa, Homo Sapiens
LHDRLWQSL

SEQ ID NO: 290705 - protein, 9 aa, Homo Sapiens
ETSSKEEVI

SEQ ID NO: 290706 - protein, 9 aa, Homo Sapiens
HLRYFLERY

SEQ ID NO: 290707 - protein, 9 aa, Homo Sapiens
TDKSKSNIK

SEQ ID NO: 290708 - protein, 9 aa, Homo Sapiens
SQMLAMHIE

SEQ ID NO: 290709 - protein, 9 aa, Homo Sapiens
FLKAALDNK

SEQ ID NO: 290710 - protein, 9 aa, Homo Sapiens
QELKKRQEL

SEQ ID NO: 290711 - protein, 9 aa, Homo Sapiens
NLVETNSFS

SEQ ID NO: 290712 - protein, 9 aa, Homo Sapiens
QLNDLQTIC

SEQ ID NO: 290713 - protein, 9 aa, Homo Sapiens
TKLMGFVDD

SEQ ID NO: 290714 - protein, 9 aa, Homo Sapiens
ISPQMNTLK

SEQ ID NO: 290715 - protein, 9 aa, Homo Sapiens
EVQSLCTIS

SEQ ID NO: 290716 - protein, 9 aa, Homo Sapiens
VAVRPKPLF

SEQ ID NO: 290717 - protein, 9 aa, Homo Sapiens
NCSYTQTCT

SEQ ID NO: 290718 - protein, 9 aa, Homo Sapiens
NAFMVNLKK

SEQ ID NO: 290719 - protein, 9 aa, Homo Sapiens
KTNELWNKY

SEQ ID NO: 290720 - protein, 9 aa, Homo Sapiens
LFKVLLTVQ

SEQ ID NO: 290721 - protein, 9 aa, Homo Sapiens
SKDNQWLGV

SEQ ID NO: 290722 - protein, 9 aa, Homo Sapiens
ETVVLSGLA

SEQ ID NO: 290723 - protein, 9 aa, Homo Sapiens
SGVRLNQDK

SEQ ID NO: 290724 - protein, 9 aa, Homo Sapiens
QLLPHHALQ

SEQ ID NO: 290725 - protein, 9 aa, Homo Sapiens
DGLSEQGNL

SEQ ID NO: 290726 - protein, 9 aa, Homo Sapiens
LPAMKQIDN

SEQ ID NO: 290727 - protein, 9 aa, Homo Sapiens
ACPYLWSAD

SEQ ID NO: 290728 - protein, 9 aa, Homo Sapiens
SSYIRIFCW

SEQ ID NO: 290729 - protein, 9 aa, Homo Sapiens
VFLVTFLLA

SEQ ID NO: 290730 - protein, 9 aa, Homo Sapiens
VVLFSMFLL

SEQ ID NO: 290731 - protein, 9 aa, Homo Sapiens
LSGMQGGLH

SEQ ID NO: 290732 - protein, 9 aa, Homo Sapiens
RAKVCGKIG

SEQ ID NO: 290733 - protein, 9 aa, Homo Sapiens
WVTVLQLME

SEQ ID NO: 290734 - protein, 9 aa, Homo Sapiens
GLRDDGKCG

SEQ ID NO: 290735 - protein, 9 aa, Homo Sapiens
QDYSENLQE

SEQ ID NO: 290736 - protein, 9 aa, Homo Sapiens
TNTDHLQSQ

SEQ ID NO: 290737 - protein, 9 aa, Homo Sapiens
LVLIGQIIF

SEQ ID NO: 290738 - protein, 9 aa, Homo Sapiens
KIHLVFGFI

SEQ ID NO: 290739 - protein, 9 aa, Homo Sapiens
MKPEEPPQT

SEQ ID NO: 290740 - protein, 9 aa, Homo Sapiens
YSQPQPSGQ

SEQ ID NO: 290741 - protein, 9 aa, Homo Sapiens
LLMIWAIIL

SEQ ID NO: 290742 - protein, 9 aa, Homo Sapiens
VIKGREKTL

SEQ ID NO: 290743 - protein, 9 aa, Homo Sapiens
SELMRQCWR

SEQ ID NO: 290744 - protein, 9 aa, Homo Sapiens
ISSALKKAV

SEQ ID NO: 290745 - protein, 9 aa, Homo Sapiens
HRPRCITKL

SEQ ID NO: 290746 - protein, 9 aa, Homo Sapiens
TWKADVTPI

SEQ ID NO: 290747 - protein, 9 aa, Homo Sapiens
SLNKTSGLK

SEQ ID NO: 290748 - protein, 9 aa, Homo Sapiens
LGSLTTASL

SEQ ID NO: 290749 - protein, 9 aa, Homo Sapiens
VFGKLKNLN

SEQ ID NO: 290750 - protein, 9 aa, Homo Sapiens
WELNPVKDV

SEQ ID NO: 290751 - protein, 9 aa, Homo Sapiens
EITDTFFRV

SEQ ID NO: 290752 - protein, 9 aa, Homo Sapiens
TICKKCGWN

SEQ ID NO: 290753 - protein, 9 aa, Homo Sapiens
TDLMKKFAE

SEQ ID NO: 290754 - protein, 9 aa, Homo Sapiens
LFMYFRPCS

SEQ ID NO: 290755 - protein, 9 aa, Homo Sapiens
VTYYHKHGS

SEQ ID NO: 290756 - protein, 9 aa, Homo Sapiens
NSKDVQNLS

SEQ ID NO: 290757 - protein, 9 aa, Homo Sapiens
LTLGMRVAF

SEQ ID NO: 290758 - protein, 9 aa, Homo Sapiens
FSECHTKIC

SEQ ID NO: 290759 - protein, 9 aa, Homo Sapiens
KLPLQPHEF

SEQ ID NO: 290760 - protein, 9 aa, Homo Sapiens
RKLGLHYFD

SEQ ID NO: 290761 - protein, 9 aa, Homo Sapiens
PPAHLSPSG

SEQ ID NO: 290762 - protein, 9 aa, Homo Sapiens
SHLFLTDFF

SEQ ID NO: 290763 - protein, 9 aa, Homo Sapiens
QLFQMVRTQ

SEQ ID NO: 290764 - protein, 9 aa, Homo Sapiens
MEQTFDLLI

SEQ ID NO: 290765 - protein, 9 aa, Homo Sapiens
SSHFQEAIY

SEQ ID NO: 290766 - protein, 9 aa, Homo Sapiens
CAIVGVSVF

SEQ ID NO: 290767 - protein, 9 aa, Homo Sapiens
GKAFSHTSY

SEQ ID NO: 290768 - protein, 9 aa, Homo Sapiens
ISKACLLLR

SEQ ID NO: 290769 - protein, 9 aa, Homo Sapiens
PFNTIKVKM

SEQ ID NO: 290770 - protein, 9 aa, Homo Sapiens
EAEEKEKPN

SEQ ID NO: 290771 - protein, 9 aa, Homo Sapiens
IVTFIHGQH

SEQ ID NO: 290772 - protein, 9 aa, Homo Sapiens
IFGHGEFSS

SEQ ID NO: 290773 - protein, 9 aa, Homo Sapiens
PNWQLERLV

SEQ ID NO: 290774 - protein, 9 aa, Homo Sapiens
SGYSYDTIG

SEQ ID NO: 290775 - protein, 9 aa, Homo Sapiens
ASHGVGQHQ

SEQ ID NO: 290776 - protein, 9 aa, Homo Sapiens
YCRKSFRQR

SEQ ID NO: 290777 - protein, 9 aa, Homo Sapiens
ESSLERPKF

SEQ ID NO: 290778 - protein, 9 aa, Homo Sapiens
DDLLGEYLL

SEQ ID NO: 290779 - protein, 9 aa, Homo Sapiens
TESRKKPGH

SEQ ID NO: 290780 - protein, 9 aa, Homo Sapiens
NFDRVNVWS

SEQ ID NO: 290781 - protein, 9 aa, Homo Sapiens
GSVKVPAGV

SEQ ID NO: 290782 - protein, 9 aa, Homo Sapiens
YFIAAAKIL

SEQ ID NO: 290783 - protein, 9 aa, Homo Sapiens
SLPNITPAG

SEQ ID NO: 290784 - protein, 9 aa, Homo Sapiens
IPRVCYHER

SEQ ID NO: 290785 - protein, 9 aa, Homo Sapiens
FRYVKMSTF

SEQ ID NO: 290786 - protein, 9 aa, Homo Sapiens
KPPKEELLK

SEQ ID NO: 290787 - protein, 9 aa, Homo Sapiens
LPEVEVALA

SEQ ID NO: 290788 - protein, 9 aa, Homo Sapiens
IPLDFISKR

SEQ ID NO: 290789 - protein, 9 aa, Homo Sapiens
RPTQFLRSQ

SEQ ID NO: 290790 - protein, 9 aa, Homo Sapiens
AVLYSNHTR

SEQ ID NO: 290791 - protein, 9 aa, Homo Sapiens
AEPVPAGFF

SEQ ID NO: 290792 - protein, 9 aa, Homo Sapiens
AIPVINWAQ

SEQ ID NO: 290793 - protein, 9 aa, Homo Sapiens
EMKEAAKIA

SEQ ID NO: 290794 - protein, 9 aa, Homo Sapiens
ERIEASRNE

SEQ ID NO: 290795 - protein, 9 aa, Homo Sapiens
DPISDYHFL

SEQ ID NO: 290796 - protein, 9 aa, Homo Sapiens
LAVEPNTES

SEQ ID NO: 290797 - protein, 9 aa, Homo Sapiens
TDNMVNHRL

SEQ ID NO: 290798 - protein, 9 aa, Homo Sapiens
QQSPLMVDL

SEQ ID NO: 290799 - protein, 9 aa, Homo Sapiens
LLQNQIVTD

SEQ ID NO: 290800 - protein, 9 aa, Homo Sapiens
VLSEQDGVD

SEQ ID NO: 290801 - protein, 9 aa, Homo Sapiens
KYNKLKSMS

SEQ ID NO: 290802 - protein, 9 aa, Homo Sapiens
PDSHKRKGL

SEQ ID NO: 290803 - protein, 9 aa, Homo Sapiens
NELSMFIVA

SEQ ID NO: 290804 - protein, 9 aa, Homo Sapiens
LISLVLMAG

SEQ ID NO: 290805 - protein, 9 aa, Homo Sapiens
SVPRPHKVR

SEQ ID NO: 290806 - protein, 9 aa, Homo Sapiens
ALLGPSQNN

SEQ ID NO: 290807 - protein, 9 aa, Homo Sapiens
YTKKKSDQA

SEQ ID NO: 290808 - protein, 9 aa, Homo Sapiens
IYVLSSCRA

SEQ ID NO: 290809 - protein, 9 aa, Homo Sapiens
GATNTKKKK

SEQ ID NO: 290810 - protein, 9 aa, Homo Sapiens
DTATKESYA

SEQ ID NO: 290811 - protein, 9 aa, Homo Sapiens
SFATKLSDY

SEQ ID NO: 290812 - protein, 9 aa, Homo Sapiens
ILLASSWKH

SEQ ID NO: 290813 - protein, 9 aa, Homo Sapiens
LGILQCFIH

SEQ ID NO: 290814 - protein, 9 aa, Homo Sapiens
SPYLNPDRM

SEQ ID NO: 290815 - protein, 9 aa, Homo Sapiens
SKENEDLIS

SEQ ID NO: 290816 - protein, 9 aa, Homo Sapiens
EVSQQCEDI

SEQ ID NO: 290817 - protein, 9 aa, Homo Sapiens
IWKLAAMGC

SEQ ID NO: 290818 - protein, 9 aa, Homo Sapiens
MGSPQLRQV

SEQ ID NO: 290819 - protein, 9 aa, Homo Sapiens
QEFLYVILL

SEQ ID NO: 290820 - protein, 9 aa, Homo Sapiens
CKAGLEAQV

SEQ ID NO: 290821 - protein, 9 aa, Homo Sapiens
VFASFVCAD

SEQ ID NO: 290822 - protein, 9 aa, Homo Sapiens
LNFTVITFA

SEQ ID NO: 290823 - protein, 9 aa, Homo Sapiens
KCKLTRNGH

SEQ ID NO: 290824 - protein, 9 aa, Homo Sapiens
KGKPSYYHR

SEQ ID NO: 290825 - protein, 9 aa, Homo Sapiens
QGNLEIECM

SEQ ID NO: 290826 - protein, 9 aa, Homo Sapiens
HIVPVFSLQ

SEQ ID NO: 290827 - protein, 9 aa, Homo Sapiens
SPAEYVKVL

SEQ ID NO: 290828 - protein, 9 aa, Homo Sapiens
KRNIPSLTS

SEQ ID NO: 290829 - protein, 9 aa, Homo Sapiens
GCALCVALP

SEQ ID NO: 290830 - protein, 9 aa, Homo Sapiens
ISFNKHSGT

SEQ ID NO: 290831 - protein, 9 aa, Homo Sapiens
KSRPVESIV

SEQ ID NO: 290832 - protein, 9 aa, Homo Sapiens
DYGAGTYGA

SEQ ID NO: 290833 - protein, 9 aa, Homo Sapiens
VYSQSTVLT

SEQ ID NO: 290834 - protein, 9 aa, Homo Sapiens
NSITFCNAK

SEQ ID NO: 290835 - protein, 9 aa, Homo Sapiens
KFVLSCMNF

SEQ ID NO: 290836 - protein, 9 aa, Homo Sapiens
VPCRGAEAW

SEQ ID NO: 290837 - protein, 9 aa, Homo Sapiens
QKAFDLDVA

SEQ ID NO: 290838 - protein, 9 aa, Homo Sapiens
RTFPRENKP

SEQ ID NO: 290839 - protein, 9 aa, Homo Sapiens
RKKDSPFWL

SEQ ID NO: 290840 - protein, 9 aa, Homo Sapiens
SELLRKHNL

SEQ ID NO: 290841 - protein, 9 aa, Homo Sapiens
RLEKVYCVV

SEQ ID NO: 290842 - protein, 9 aa, Homo Sapiens
SVCTSVNSV

SEQ ID NO: 290843 - protein, 9 aa, Homo Sapiens
EQLRTLLTY

SEQ ID NO: 290844 - protein, 9 aa, Homo Sapiens
MEYSHQELL

SEQ ID NO: 290845 - protein, 9 aa, Homo Sapiens
VIYIARLFW

SEQ ID NO: 290846 - protein, 9 aa, Homo Sapiens
MANSMNGRH

SEQ ID NO: 290847 - protein, 9 aa, Homo Sapiens
QKRMNISPA

SEQ ID NO: 290848 - protein, 9 aa, Homo Sapiens
LLFLMKAAK

SEQ ID NO: 290849 - protein, 9 aa, Homo Sapiens
MSVNGLFAF

SEQ ID NO: 290850 - protein, 9 aa, Homo Sapiens
SPSLLKRHE

SEQ ID NO: 290851 - protein, 9 aa, Homo Sapiens
VALNQLKKT

SEQ ID NO: 290852 - protein, 9 aa, Homo Sapiens
GHRFSNAGQ

SEQ ID NO: 290853 - protein, 9 aa, Homo Sapiens
DIIQQDFLD

SEQ ID NO: 290854 - protein, 9 aa, Homo Sapiens
VLLAHRLWR

SEQ ID NO: 290855 - protein, 9 aa, Homo Sapiens
LHLRQTLHK

SEQ ID NO: 290856 - protein, 9 aa, Homo Sapiens
LHSLSLQLR

SEQ ID NO: 290857 - protein, 9 aa, Homo Sapiens
NGGINTLQP

SEQ ID NO: 290858 - protein, 9 aa, Homo Sapiens
IAGMGYHVS

SEQ ID NO: 290859 - protein, 9 aa, Homo Sapiens
KKHHHHNEK

SEQ ID NO: 290860 - protein, 9 aa, Homo Sapiens
LQPAALAAA

SEQ ID NO: 290861 - protein, 9 aa, Homo Sapiens
KEQELKKRQ

SEQ ID NO: 290862 - protein, 9 aa, Homo Sapiens
QFGAPLARN

SEQ ID NO: 290863 - protein, 9 aa, Homo Sapiens
IGVVGGTLK

SEQ ID NO: 290864 - protein, 9 aa, Homo Sapiens
QFKGTHIDT

SEQ ID NO: 290865 - protein, 9 aa, Homo Sapiens
LDIPVLFKI

SEQ ID NO: 290866 - protein, 9 aa, Homo Sapiens
NFKVDIPDI

SEQ ID NO: 290867 - protein, 9 aa, Homo Sapiens
PRPTQFLRS

SEQ ID NO: 290868 - protein, 9 aa, Homo Sapiens
LHLSKENQT

SEQ ID NO: 290869 - protein, 9 aa, Homo Sapiens
NPSGASQSR

SEQ ID NO: 290870 - protein, 9 aa, Homo Sapiens
KTIIVKNEN

SEQ ID NO: 290871 - protein, 9 aa, Homo Sapiens
RRKCQARFL

SEQ ID NO: 290872 - protein, 9 aa, Homo Sapiens
HNGKDIFKP

SEQ ID NO: 290873 - protein, 9 aa, Homo Sapiens
AIRLKKKMG

SEQ ID NO: 290874 - protein, 9 aa, Homo Sapiens
YFLGPKDAS

SEQ ID NO: 290875 - protein, 9 aa, Homo Sapiens
HFIMDSYSK

SEQ ID NO: 290876 - protein, 9 aa, Homo Sapiens
PLKSCLNIT

SEQ ID NO: 290877 - protein, 9 aa, Homo Sapiens
QFSKKIRQP

SEQ ID NO: 290878 - protein, 9 aa, Homo Sapiens
ANQGLRGPG

SEQ ID NO: 290879 - protein, 9 aa, Homo Sapiens
THCILLRCV

SEQ ID NO: 290880 - protein, 9 aa, Homo Sapiens
GDVGRVRYM

SEQ ID NO: 290881 - protein, 9 aa, Homo Sapiens
THEKLSQIC

SEQ ID NO: 290882 - protein, 9 aa, Homo Sapiens
ATLTKLGNT

SEQ ID NO: 290883 - protein, 9 aa, Homo Sapiens
CEDGFKITE

SEQ ID NO: 290884 - protein, 9 aa, Homo Sapiens
LDFNTKILH

SEQ ID NO: 290885 - protein, 9 aa, Homo Sapiens
KLEEWNEKV

SEQ ID NO: 290886 - protein, 9 aa, Homo Sapiens
LICKDEMSS

SEQ ID NO: 290887 - protein, 9 aa, Homo Sapiens
GSGEFSHSP

SEQ ID NO: 290888 - protein, 9 aa, Homo Sapiens
LKAELKLLQ

SEQ ID NO: 290889 - protein, 9 aa, Homo Sapiens
KSSKNELHY

SEQ ID NO: 290890 - protein, 9 aa, Homo Sapiens
ELLVAVKRA

SEQ ID NO: 290891 - protein, 9 aa, Homo Sapiens
RLLSVDGIW

SEQ ID NO: 290892 - protein, 9 aa, Homo Sapiens
QEDGCMLLI

SEQ ID NO: 290893 - protein, 9 aa, Homo Sapiens
LVGNQFTCS

SEQ ID NO: 290894 - protein, 9 aa, Homo Sapiens
IILIVVAAF

SEQ ID NO: 290895 - protein, 9 aa, Homo Sapiens
VLLKCNSLE

SEQ ID NO: 290896 - protein, 9 aa, Homo Sapiens
REHLKLSPK

SEQ ID NO: 290897 - protein, 9 aa, Homo Sapiens
NAHVRMATA

SEQ ID NO: 290898 - protein, 9 aa, Homo Sapiens
QRLKKEQAN

SEQ ID NO: 290899 - protein, 9 aa, Homo Sapiens
LQSLIKFAS

SEQ ID NO: 290900 - protein, 9 aa, Homo Sapiens
TNIQSSTRD

SEQ ID NO: 290901 - protein, 9 aa, Homo Sapiens
FYLVVYPAS

SEQ ID NO: 290902 - protein, 9 aa, Homo Sapiens
YVFIEFLKR

SEQ ID NO: 290903 - protein, 9 aa, Homo Sapiens
IFSYGHCQI

SEQ ID NO: 290904 - protein, 9 aa, Homo Sapiens
MQNQSSTKH

SEQ ID NO: 290905 - protein, 9 aa, Homo Sapiens
CYRRKGDYS

SEQ ID NO: 290906 - protein, 9 aa, Homo Sapiens
DVHHQILAT

SEQ ID NO: 290907 - protein, 9 aa, Homo Sapiens
FKGLKHLMQ

SEQ ID NO: 290908 - protein, 9 aa, Homo Sapiens
IHGFTFMES

SEQ ID NO: 290909 - protein, 9 aa, Homo Sapiens
REELANVQD

SEQ ID NO: 290910 - protein, 9 aa, Homo Sapiens
PNESDPRLT

SEQ ID NO: 290911 - protein, 9 aa, Homo Sapiens
NHSERSDNI

SEQ ID NO: 290912 - protein, 9 aa, Homo Sapiens
IGLDKIIIL

SEQ ID NO: 290913 - protein, 9 aa, Homo Sapiens
IILPSNTHK

SEQ ID NO: 290914 - protein, 9 aa, Homo Sapiens
VIKLSDLTL

SEQ ID NO: 290915 - protein, 9 aa, Homo Sapiens
IFKNLRETL

SEQ ID NO: 290916 - protein, 9 aa, Homo Sapiens
NRKQANLNS

SEQ ID NO: 290917 - protein, 9 aa, Homo Sapiens
CTHVYIRVF

SEQ ID NO: 290918 - protein, 9 aa, Homo Sapiens
PSAVELRRN

SEQ ID NO: 290919 - protein, 9 aa, Homo Sapiens
LDGRGWAIK

SEQ ID NO: 290920 - protein, 9 aa, Homo Sapiens
LIAFRMRSK

SEQ ID NO: 290921 - protein, 9 aa, Homo Sapiens
LKKILLRKF

SEQ ID NO: 290922 - protein, 9 aa, Homo Sapiens
LCMCGDNCK

SEQ ID NO: 290923 - protein, 9 aa, Homo Sapiens
CGKHFRSGY

SEQ ID NO: 290924 - protein, 9 aa, Homo Sapiens
LNEVSQQCE

SEQ ID NO: 290925 - protein, 9 aa, Homo Sapiens
IARQRIPYQ

SEQ ID NO: 290926 - protein, 9 aa, Homo Sapiens
YGDEINKRT

SEQ ID NO: 290927 - protein, 9 aa, Homo Sapiens
KTCFLDCVK

SEQ ID NO: 290928 - protein, 9 aa, Homo Sapiens
FSAIRKIGE

SEQ ID NO: 290929 - protein, 9 aa, Homo Sapiens
FLYWTILGL

SEQ ID NO: 290930 - protein, 9 aa, Homo Sapiens
GFSLLLLVI

SEQ ID NO: 290931 - protein, 9 aa, Homo Sapiens
PASMSCASF

SEQ ID NO: 290932 - protein, 9 aa, Homo Sapiens
FHGCLEHLY

SEQ ID NO: 290933 - protein, 9 aa, Homo Sapiens
SGGLCMCGD

SEQ ID NO: 290934 - protein, 9 aa, Homo Sapiens
EKTGKAKAL

SEQ ID NO: 290935 - protein, 9 aa, Homo Sapiens
DFLKTILHH

SEQ ID NO: 290936 - protein, 9 aa, Homo Sapiens
ERLLECQFM

SEQ ID NO: 290937 - protein, 9 aa, Homo Sapiens
QSKLLWSQD

SEQ ID NO: 290938 - protein, 9 aa, Homo Sapiens
MFPPSYVPV

SEQ ID NO: 290939 - protein, 9 aa, Homo Sapiens
LGAECPGWA

SEQ ID NO: 290940 - protein, 9 aa, Homo Sapiens
EAVWQTSLT

SEQ ID NO: 290941 - protein, 9 aa, Homo Sapiens
KALQSHLNN

SEQ ID NO: 290942 - protein, 9 aa, Homo Sapiens
FVQGNLEIE

SEQ ID NO: 290943 - protein, 9 aa, Homo Sapiens
PKEFSYESG

SEQ ID NO: 290944 - protein, 9 aa, Homo Sapiens
EVEILDPND

SEQ ID NO: 290945 - protein, 9 aa, Homo Sapiens
VHILYGRIY

SEQ ID NO: 290946 - protein, 9 aa, Homo Sapiens
KKTLLHFWL

SEQ ID NO: 290947 - protein, 9 aa, Homo Sapiens
GQKITLYFN

SEQ ID NO: 290948 - protein, 9 aa, Homo Sapiens
IEQKEELDY

SEQ ID NO: 290949 - protein, 9 aa, Homo Sapiens
GFVVDVPEH

SEQ ID NO: 290950 - protein, 9 aa, Homo Sapiens
LSAGDLGDS

SEQ ID NO: 290951 - protein, 9 aa, Homo Sapiens
RDDVFGMGK

SEQ ID NO: 290952 - protein, 9 aa, Homo Sapiens
TDAILSLNA

SEQ ID NO: 290953 - protein, 9 aa, Homo Sapiens
HQQNHTGEK

SEQ ID NO: 290954 - protein, 9 aa, Homo Sapiens
PTFLPWVPA

SEQ ID NO: 290955 - protein, 9 aa, Homo Sapiens
NTYLLHMEK

SEQ ID NO: 290956 - protein, 9 aa, Homo Sapiens
VKINDLSII

SEQ ID NO: 290957 - protein, 9 aa, Homo Sapiens
TALRPGSRR

SEQ ID NO: 290958 - protein, 9 aa, Homo Sapiens
RDPVLMYLK

SEQ ID NO: 290959 - protein, 9 aa, Homo Sapiens
KPQNPIQLT

SEQ ID NO: 290960 - protein, 9 aa, Homo Sapiens
CIKSEDKTL

SEQ ID NO: 290961 - protein, 9 aa, Homo Sapiens
EIIYAITSA

SEQ ID NO: 290962 - protein, 9 aa, Homo Sapiens
QGVHLDRDE

SEQ ID NO: 290963 - protein, 9 aa, Homo Sapiens
HSPQEDPFI

SEQ ID NO: 290964 - protein, 9 aa, Homo Sapiens
ACCQDEKAH

SEQ ID NO: 290965 - protein, 9 aa, Homo Sapiens
KKYDIDPSN

SEQ ID NO: 290966 - protein, 9 aa, Homo Sapiens
NITSHLGNV

SEQ ID NO: 290967 - protein, 9 aa, Homo Sapiens
MSPYLVSIW

SEQ ID NO: 290968 - protein, 9 aa, Homo Sapiens
ILTNKKIIF

SEQ ID NO: 290969 - protein, 9 aa, Homo Sapiens
AAWALTHIA

SEQ ID NO: 290970 - protein, 9 aa, Homo Sapiens
KFCTAAMSY

SEQ ID NO: 290971 - protein, 9 aa, Homo Sapiens
KKIIFVPSY

SEQ ID NO: 290972 - protein, 9 aa, Homo Sapiens
QLQVNSDTQ

SEQ ID NO: 290973 - protein, 9 aa, Homo Sapiens
IASSLDSLA

SEQ ID NO: 290974 - protein, 9 aa, Homo Sapiens
LYVQVNTFA

SEQ ID NO: 290975 - protein, 9 aa, Homo Sapiens
GYPALQREQ

SEQ ID NO: 290976 - protein, 9 aa, Homo Sapiens
LNKSLKVFK

SEQ ID NO: 290977 - protein, 9 aa, Homo Sapiens
TEPSADGET

SEQ ID NO: 290978 - protein, 9 aa, Homo Sapiens
CTSRHLRNF

SEQ ID NO: 290979 - protein, 9 aa, Homo Sapiens
NALKDHAKA

SEQ ID NO: 290980 - protein, 9 aa, Homo Sapiens
QGLPHPFTI

SEQ ID NO: 290981 - protein, 9 aa, Homo Sapiens
LSQKARRKG

SEQ ID NO: 290982 - protein, 9 aa, Homo Sapiens
FCSLRNVQP

SEQ ID NO: 290983 - protein, 9 aa, Homo Sapiens
QPLEKKMKL

SEQ ID NO: 290984 - protein, 9 aa, Homo Sapiens
RLISASLFI

SEQ ID NO: 290985 - protein, 9 aa, Homo Sapiens
AAGQSVVYV

SEQ ID NO: 290986 - protein, 9 aa, Homo Sapiens
PQSPDLVGP

SEQ ID NO: 290987 - protein, 9 aa, Homo Sapiens
AFQGGKLSA

SEQ ID NO: 290988 - protein, 9 aa, Homo Sapiens
VSTKSQSGS

SEQ ID NO: 290989 - protein, 9 aa, Homo Sapiens
PNLSFEGTK

SEQ ID NO: 290990 - protein, 9 aa, Homo Sapiens
EEEEEEQNI

SEQ ID NO: 290991 - protein, 9 aa, Homo Sapiens
KTQMIYKLP

SEQ ID NO: 290992 - protein, 9 aa, Homo Sapiens
INGTVITEF

SEQ ID NO: 290993 - protein, 9 aa, Homo Sapiens
LTTSNLPEE

SEQ ID NO: 290994 - protein, 9 aa, Homo Sapiens
TSSYTAQDY

SEQ ID NO: 290995 - protein, 9 aa, Homo Sapiens
IRKRINNGS

SEQ ID NO: 290996 - protein, 9 aa, Homo Sapiens
VQFEEKNIA

SEQ ID NO: 290997 - protein, 9 aa, Homo Sapiens
EKNGSDNSH

SEQ ID NO: 290998 - protein, 9 aa, Homo Sapiens
CVTGNFFIF

SEQ ID NO: 290999 - protein, 9 aa, Homo Sapiens
AVFFDYSKV

SEQ ID NO: 291000 - protein, 9 aa, Homo Sapiens
CYNTSQTCD

SEQ ID NO: 291001 - protein, 9 aa, Homo Sapiens
VISVEVFLP

SEQ ID NO: 291002 - protein, 9 aa, Homo Sapiens
KEIDDVYEQ

SEQ ID NO: 291003 - protein, 9 aa, Homo Sapiens
CDQTAQDMQ

SEQ ID NO: 291004 - protein, 9 aa, Homo Sapiens
HTETSKSKV

SEQ ID NO: 291005 - protein, 9 aa, Homo Sapiens
VVVILRTVY

SEQ ID NO: 291006 - protein, 9 aa, Homo Sapiens
EKMVLNFTT

SEQ ID NO: 291007 - protein, 9 aa, Homo Sapiens
THDVVMNDS

SEQ ID NO: 291008 - protein, 9 aa, Homo Sapiens
LGLPPVKLH

SEQ ID NO: 291009 - protein, 9 aa, Homo Sapiens
SGFSSKMKA

SEQ ID NO: 291010 - protein, 9 aa, Homo Sapiens
RFLEEVART

SEQ ID NO: 291011 - protein, 9 aa, Homo Sapiens
SLPIRRKAR

SEQ ID NO: 291012 - protein, 9 aa, Homo Sapiens
HPATQQSPL

SEQ ID NO: 291013 - protein, 9 aa, Homo Sapiens
LLTSGLGFA

SEQ ID NO: 291014 - protein, 9 aa, Homo Sapiens
EVLPINVGV

SEQ ID NO: 291015 - protein, 9 aa, Homo Sapiens
CMCQDKKYR

SEQ ID NO: 291016 - protein, 9 aa, Homo Sapiens
NANKGRELW

SEQ ID NO: 291017 - protein, 9 aa, Homo Sapiens
EGRVFQDKW

SEQ ID NO: 291018 - protein, 9 aa, Homo Sapiens
ANLNGEPGG

SEQ ID NO: 291019 - protein, 9 aa, Homo Sapiens
QRNIIDTLM

SEQ ID NO: 291020 - protein, 9 aa, Homo Sapiens
VEDALEVEL

SEQ ID NO: 291021 - protein, 9 aa, Homo Sapiens
HVKRGWVWN

SEQ ID NO: 291022 - protein, 9 aa, Homo Sapiens
ENGRWRFYW

SEQ ID NO: 291023 - protein, 9 aa, Homo Sapiens
FDFLTVMKS

SEQ ID NO: 291024 - protein, 9 aa, Homo Sapiens
GFPGFPGEI

SEQ ID NO: 291025 - protein, 9 aa, Homo Sapiens
KGFLVIGYI

SEQ ID NO: 291026 - protein, 9 aa, Homo Sapiens
CLTIEATVW

SEQ ID NO: 291027 - protein, 9 aa, Homo Sapiens
INRFIVSHF

SEQ ID NO: 291028 - protein, 9 aa, Homo Sapiens
DHSTRLILD

SEQ ID NO: 291029 - protein, 9 aa, Homo Sapiens
KLYSSLLAL

SEQ ID NO: 291030 - protein, 9 aa, Homo Sapiens
VLSSLNNSA

SEQ ID NO: 291031 - protein, 9 aa, Homo Sapiens
KFFSFTPAW

SEQ ID NO: 291032 - protein, 9 aa, Homo Sapiens
SLVRLCYFG

SEQ ID NO: 291033 - protein, 9 aa, Homo Sapiens
QSDNLCSYI

SEQ ID NO: 291034 - protein, 9 aa, Homo Sapiens
KPKQIQISS

SEQ ID NO: 291035 - protein, 9 aa, Homo Sapiens
SSSLSPTSS

SEQ ID NO: 291036 - protein, 9 aa, Homo Sapiens
PAPSRTAYF

SEQ ID NO: 291037 - protein, 9 aa, Homo Sapiens
KCEDVWQCW

SEQ ID NO: 291038 - protein, 9 aa, Homo Sapiens
QKSLKRAEV

SEQ ID NO: 291039 - protein, 9 aa, Homo Sapiens
NKEPASSVS

SEQ ID NO: 291040 - protein, 9 aa, Homo Sapiens
SQDVMQPAT

SEQ ID NO: 291041 - protein, 9 aa, Homo Sapiens
IALVWIIFV

SEQ ID NO: 291042 - protein, 9 aa, Homo Sapiens
LTDKHEAVL

SEQ ID NO: 291043 - protein, 9 aa, Homo Sapiens
KLPLKFSDA

SEQ ID NO: 291044 - protein, 9 aa, Homo Sapiens
TYEKHNNGG

SEQ ID NO: 291045 - protein, 9 aa, Homo Sapiens
EEERMHDEI

SEQ ID NO: 291046 - protein, 9 aa, Homo Sapiens
LSWIKKLLK

SEQ ID NO: 291047 - protein, 9 aa, Homo Sapiens
PLAALVSKA

SEQ ID NO: 291048 - protein, 9 aa, Homo Sapiens
GTYVCTADN

SEQ ID NO: 291049 - protein, 9 aa, Homo Sapiens
ESQSRLSQI

SEQ ID NO: 291050 - protein, 9 aa, Homo Sapiens
CHAPETRRK

SEQ ID NO: 291051 - protein, 9 aa, Homo Sapiens
VGTPIGYPY

SEQ ID NO: 291052 - protein, 9 aa, Homo Sapiens
AISSASLLV

SEQ ID NO: 291053 - protein, 9 aa, Homo Sapiens
SIWKLFFRK

SEQ ID NO: 291054 - protein, 9 aa, Homo Sapiens
EVDALFKGD

SEQ ID NO: 291055 - protein, 9 aa, Homo Sapiens
VGICQDCIR

SEQ ID NO: 291056 - protein, 9 aa, Homo Sapiens
QFALRLSCA

SEQ ID NO: 291057 - protein, 9 aa, Homo Sapiens
NASFQVEND

SEQ ID NO: 291058 - protein, 9 aa, Homo Sapiens
FGNNGTLVD

SEQ ID NO: 291059 - protein, 9 aa, Homo Sapiens
SGVCTLIFG

SEQ ID NO: 291060 - protein, 9 aa, Homo Sapiens
DVRRICSLQ

SEQ ID NO: 291061 - protein, 9 aa, Homo Sapiens
VVLSILLGG

SEQ ID NO: 291062 - protein, 9 aa, Homo Sapiens
NRTERLSAL

SEQ ID NO: 291063 - protein, 9 aa, Homo Sapiens
ITEFQHMLV

SEQ ID NO: 291064 - protein, 9 aa, Homo Sapiens
DYMVKTIVL

SEQ ID NO: 291065 - protein, 9 aa, Homo Sapiens
TQRASNKKV

SEQ ID NO: 291066 - protein, 9 aa, Homo Sapiens
NRTSTLNQG

SEQ ID NO: 291067 - protein, 9 aa, Homo Sapiens
LKETTHSMV

SEQ ID NO: 291068 - protein, 9 aa, Homo Sapiens
VNEDASTEN

SEQ ID NO: 291069 - protein, 9 aa, Homo Sapiens
CKLLFCRIR

SEQ ID NO: 291070 - protein, 9 aa, Homo Sapiens
NGHQSKFML

SEQ ID NO: 291071 - protein, 9 aa, Homo Sapiens
LDTVVEKHK

SEQ ID NO: 291072 - protein, 9 aa, Homo Sapiens
IIAEIVEAK

SEQ ID NO: 291073 - protein, 9 aa, Homo Sapiens
TNVGKKQKT

SEQ ID NO: 291074 - protein, 9 aa, Homo Sapiens
YGYMYPITV

SEQ ID NO: 291075 - protein, 9 aa, Homo Sapiens
YLLEKDNDH

SEQ ID NO: 291076 - protein, 9 aa, Homo Sapiens
DRPQMKIFL

SEQ ID NO: 291077 - protein, 9 aa, Homo Sapiens
TDEERPDLL

SEQ ID NO: 291078 - protein, 9 aa, Homo Sapiens
SRPGIPAAE

SEQ ID NO: 291079 - protein, 9 aa, Homo Sapiens
VLDQPISLD

SEQ ID NO: 291080 - protein, 9 aa, Homo Sapiens
QGQAQVMHG

SEQ ID NO: 291081 - protein, 9 aa, Homo Sapiens
FSHLVGHKK

SEQ ID NO: 291082 - protein, 9 aa, Homo Sapiens
RDIKAFGVH

SEQ ID NO: 291083 - protein, 9 aa, Homo Sapiens
PDPVQLSED

SEQ ID NO: 291084 - protein, 9 aa, Homo Sapiens
ITGTFLVKI

SEQ ID NO: 291085 - protein, 9 aa, Homo Sapiens
AKKSFLLGK

SEQ ID NO: 291086 - protein, 9 aa, Homo Sapiens
KYYRPRKIS

SEQ ID NO: 291087 - protein, 9 aa, Homo Sapiens
CINNHVFCL

SEQ ID NO: 291088 - protein, 9 aa, Homo Sapiens
SLPLFTPAP

SEQ ID NO: 291089 - protein, 9 aa, Homo Sapiens
DKEAGALET

SEQ ID NO: 291090 - protein, 9 aa, Homo Sapiens
TIIRVSQEP

SEQ ID NO: 291091 - protein, 9 aa, Homo Sapiens
IIDQRFKKV

SEQ ID NO: 291092 - protein, 9 aa, Homo Sapiens
DAVIYAYMN

SEQ ID NO: 291093 - protein, 9 aa, Homo Sapiens
DCERMNEEK

SEQ ID NO: 291094 - protein, 9 aa, Homo Sapiens
VNFTGTTVG

SEQ ID NO: 291095 - protein, 9 aa, Homo Sapiens
SDVVGWQSP

SEQ ID NO: 291096 - protein, 9 aa, Homo Sapiens
YECKYCRKS

SEQ ID NO: 291097 - protein, 9 aa, Homo Sapiens
AISMTMRSF

SEQ ID NO: 291098 - protein, 9 aa, Homo Sapiens
VNSLREELA

SEQ ID NO: 291099 - protein, 9 aa, Homo Sapiens
SEQYQIRKR

SEQ ID NO: 291100 - protein, 9 aa, Homo Sapiens
KTTVERKGS

SEQ ID NO: 291101 - protein, 9 aa, Homo Sapiens
VLIDIKEYW

SEQ ID NO: 291102 - protein, 9 aa, Homo Sapiens
AYGLISCEL

SEQ ID NO: 291103 - protein, 9 aa, Homo Sapiens
IYLITMMGN

SEQ ID NO: 291104 - protein, 9 aa, Homo Sapiens
HLQPLNVKH

SEQ ID NO: 291105 - protein, 9 aa, Homo Sapiens
MLVRSSFNS

SEQ ID NO: 291106 - protein, 9 aa, Homo Sapiens
HSPSSTSFL

SEQ ID NO: 291107 - protein, 9 aa, Homo Sapiens
HIPLRLGFI

SEQ ID NO: 291108 - protein, 9 aa, Homo Sapiens
AKLERVYNL

SEQ ID NO: 291109 - protein, 9 aa, Homo Sapiens
LFGWLFCRV

SEQ ID NO: 291110 - protein, 9 aa, Homo Sapiens
AEFIILGLV

SEQ ID NO: 291111 - protein, 9 aa, Homo Sapiens
IAAHKQKVV

SEQ ID NO: 291112 - protein, 9 aa, Homo Sapiens
GVRVSAATA

SEQ ID NO: 291113 - protein, 9 aa, Homo Sapiens
PNLSQKPRF

SEQ ID NO: 291114 - protein, 9 aa, Homo Sapiens
IIVDGKMMT

SEQ ID NO: 291115 - protein, 9 aa, Homo Sapiens
VKLANLPYR

SEQ ID NO: 291116 - protein, 9 aa, Homo Sapiens
VTKTPLPNM

SEQ ID NO: 291117 - protein, 9 aa, Homo Sapiens
DYGPMKGGS

SEQ ID NO: 291118 - protein, 9 aa, Homo Sapiens
GYHVSQQQR

SEQ ID NO: 291119 - protein, 9 aa, Homo Sapiens
EAPESSTCS

SEQ ID NO: 291120 - protein, 9 aa, Homo Sapiens
PKKYQVELL

SEQ ID NO: 291121 - protein, 9 aa, Homo Sapiens
LYQLRHPVR

SEQ ID NO: 291122 - protein, 9 aa, Homo Sapiens
PEYGMFTYH

SEQ ID NO: 291123 - protein, 9 aa, Homo Sapiens
PRNAALGPG

SEQ ID NO: 291124 - protein, 9 aa, Homo Sapiens
IQRSLEPLL

SEQ ID NO: 291125 - protein, 9 aa, Homo Sapiens
VIKRCLAWD

SEQ ID NO: 291126 - protein, 9 aa, Homo Sapiens
VKPLPFPCF

SEQ ID NO: 291127 - protein, 9 aa, Homo Sapiens
IQGLTEGLH

SEQ ID NO: 291128 - protein, 9 aa, Homo Sapiens
DKMKDLQDL

SEQ ID NO: 291129 - protein, 9 aa, Homo Sapiens
DRVNVWSMV

SEQ ID NO: 291130 - protein, 9 aa, Homo Sapiens
ITNNIMLIA

SEQ ID NO: 291131 - protein, 9 aa, Homo Sapiens
HRRFRDLHH

SEQ ID NO: 291132 - protein, 9 aa, Homo Sapiens
SIACPSIGS

SEQ ID NO: 291133 - protein, 9 aa, Homo Sapiens
RMKWLIDEV

SEQ ID NO: 291134 - protein, 9 aa, Homo Sapiens
YPDVARYLI

SEQ ID NO: 291135 - protein, 9 aa, Homo Sapiens
TKKSLESIK

SEQ ID NO: 291136 - protein, 9 aa, Homo Sapiens
PVSNQKPGT

SEQ ID NO: 291137 - protein, 9 aa, Homo Sapiens
VTRPELLLD

SEQ ID NO: 291138 - protein, 9 aa, Homo Sapiens
LVSPLKYGS

SEQ ID NO: 291139 - protein, 9 aa, Homo Sapiens
FEAKIIEAK

SEQ ID NO: 291140 - protein, 9 aa, Homo Sapiens
AALSPTPKE

SEQ ID NO: 291141 - protein, 9 aa, Homo Sapiens
AGRHQHRSF

SEQ ID NO: 291142 - protein, 9 aa, Homo Sapiens
QFFTLTLMH

SEQ ID NO: 291143 - protein, 9 aa, Homo Sapiens
TSKPEVEFT

SEQ ID NO: 291144 - protein, 9 aa, Homo Sapiens
SMYVKPSAK

SEQ ID NO: 291145 - protein, 9 aa, Homo Sapiens
VYGKKQPHE

SEQ ID NO: 291146 - protein, 9 aa, Homo Sapiens
TFKWNLTTR

SEQ ID NO: 291147 - protein, 9 aa, Homo Sapiens
TSEYSDHPH

SEQ ID NO: 291148 - protein, 9 aa, Homo Sapiens
ITLQATRVQ

SEQ ID NO: 291149 - protein, 9 aa, Homo Sapiens
VGNFVGSNA

SEQ ID NO: 291150 - protein, 9 aa, Homo Sapiens
QPSLRITKC

SEQ ID NO: 291151 - protein, 9 aa, Homo Sapiens
PDPPTLKND

SEQ ID NO: 291152 - protein, 9 aa, Homo Sapiens
GGPGEWNLN

SEQ ID NO: 291153 - protein, 9 aa, Homo Sapiens
HHRSNSKDV

SEQ ID NO: 291154 - protein, 9 aa, Homo Sapiens
SFQELNSLL

SEQ ID NO: 291155 - protein, 9 aa, Homo Sapiens
VRFREHWQK

SEQ ID NO: 291156 - protein, 9 aa, Homo Sapiens
QLHSYPHTD

SEQ ID NO: 291157 - protein, 9 aa, Homo Sapiens
KLDYKAVPS

SEQ ID NO: 291158 - protein, 9 aa, Homo Sapiens
AAAVFLASK

SEQ ID NO: 291159 - protein, 9 aa, Homo Sapiens
AEVEVYKLK

SEQ ID NO: 291160 - protein, 9 aa, Homo Sapiens
ILGKCLGPF

SEQ ID NO: 291161 - protein, 9 aa, Homo Sapiens
TQDEAEIYY

SEQ ID NO: 291162 - protein, 9 aa, Homo Sapiens
LLRKMEDYF

SEQ ID NO: 291163 - protein, 9 aa, Homo Sapiens
LPGTEQDML

SEQ ID NO: 291164 - protein, 9 aa, Homo Sapiens
MERKANPSS

SEQ ID NO: 291165 - protein, 9 aa, Homo Sapiens
ALKNVLAKA

SEQ ID NO: 291166 - protein, 9 aa, Homo Sapiens
VYQASRMSF

SEQ ID NO: 291167 - protein, 9 aa, Homo Sapiens
ISELIISNS

SEQ ID NO: 291168 - protein, 9 aa, Homo Sapiens
FTNVGNGNQ

SEQ ID NO: 291169 - protein, 9 aa, Homo Sapiens
HFLDVNGHF

SEQ ID NO: 291170 - protein, 9 aa, Homo Sapiens
LRVPLLHCD

SEQ ID NO: 291171 - protein, 9 aa, Homo Sapiens
AEKRKKYKQ

SEQ ID NO: 291172 - protein, 9 aa, Homo Sapiens
CLKFCTAAM

SEQ ID NO: 291173 - protein, 9 aa, Homo Sapiens
LSQGITAAF

SEQ ID NO: 291174 - protein, 9 aa, Homo Sapiens
YAVTVVLYN

SEQ ID NO: 291175 - protein, 9 aa, Homo Sapiens
IIDNDHENV

SEQ ID NO: 291176 - protein, 9 aa, Homo Sapiens
DASDFLTDT

SEQ ID NO: 291177 - protein, 9 aa, Homo Sapiens
GLHCQLLYI

SEQ ID NO: 291178 - protein, 9 aa, Homo Sapiens
PQESFTSFV

SEQ ID NO: 291179 - protein, 9 aa, Homo Sapiens
RRQTGGSLR

SEQ ID NO: 291180 - protein, 9 aa, Homo Sapiens
PREGHPMYQ

SEQ ID NO: 291181 - protein, 9 aa, Homo Sapiens
ELLTAGKKC

SEQ ID NO: 291182 - protein, 9 aa, Homo Sapiens
SFQNENVSS

SEQ ID NO: 291183 - protein, 9 aa, Homo Sapiens
FAPSLYIIH

SEQ ID NO: 291184 - protein, 9 aa, Homo Sapiens
FSSVYEQLI

SEQ ID NO: 291185 - protein, 9 aa, Homo Sapiens
DKTLKRLST

SEQ ID NO: 291186 - protein, 9 aa, Homo Sapiens
ELDNTPNNY

SEQ ID NO: 291187 - protein, 9 aa, Homo Sapiens
QGCNKKAVT

SEQ ID NO: 291188 - protein, 9 aa, Homo Sapiens
FIYLPVPLP

SEQ ID NO: 291189 - protein, 9 aa, Homo Sapiens
YINTLFPTK

SEQ ID NO: 291190 - protein, 9 aa, Homo Sapiens
YPIKRNSLI

SEQ ID NO: 291191 - protein, 9 aa, Homo Sapiens
NLDTCALHE

SEQ ID NO: 291192 - protein, 9 aa, Homo Sapiens
FDALISKMY

SEQ ID NO: 291193 - protein, 9 aa, Homo Sapiens
PEDYGVLKT

SEQ ID NO: 291194 - protein, 9 aa, Homo Sapiens
CIMEASTNF

SEQ ID NO: 291195 - protein, 9 aa, Homo Sapiens
QCVQCSRSR

SEQ ID NO: 291196 - protein, 9 aa, Homo Sapiens
NAQKSQQMP

SEQ ID NO: 291197 - protein, 9 aa, Homo Sapiens
VCLSNQGSQ

SEQ ID NO: 291198 - protein, 9 aa, Homo Sapiens
NEVDHCEHL

SEQ ID NO: 291199 - protein, 9 aa, Homo Sapiens
LKVLACTDL

SEQ ID NO: 291200 - protein, 9 aa, Homo Sapiens
NDYNDLFDG

SEQ ID NO: 291201 - protein, 9 aa, Homo Sapiens
HYSLIVVGH

SEQ ID NO: 291202 - protein, 9 aa, Homo Sapiens
TDIAKELGL

SEQ ID NO: 291203 - protein, 9 aa, Homo Sapiens
NYEDKNFPR

SEQ ID NO: 291204 - protein, 9 aa, Homo Sapiens
DAYSYFRSV

SEQ ID NO: 291205 - protein, 9 aa, Homo Sapiens
MGCRLFCCA

SEQ ID NO: 291206 - protein, 9 aa, Homo Sapiens
PEQSNGGSP

SEQ ID NO: 291207 - protein, 9 aa, Homo Sapiens
FITMKRSRN

SEQ ID NO: 291208 - protein, 9 aa, Homo Sapiens
NNKSKARPK

SEQ ID NO: 291209 - protein, 9 aa, Homo Sapiens
WNISSEKIN

SEQ ID NO: 291210 - protein, 9 aa, Homo Sapiens
SQIHRELIE

SEQ ID NO: 291211 - protein, 9 aa, Homo Sapiens
LDIRLASGG

SEQ ID NO: 291212 - protein, 9 aa, Homo Sapiens
DLKRDCGQK

SEQ ID NO: 291213 - protein, 9 aa, Homo Sapiens
LPNHLAQAV

SEQ ID NO: 291214 - protein, 9 aa, Homo Sapiens
MVWVAWLFL

SEQ ID NO: 291215 - protein, 9 aa, Homo Sapiens
VALSDLSTL

SEQ ID NO: 291216 - protein, 9 aa, Homo Sapiens
PSSQVKYSR

SEQ ID NO: 291217 - protein, 9 aa, Homo Sapiens
DNCPQKSNL

SEQ ID NO: 291218 - protein, 9 aa, Homo Sapiens
IEKLSETIS

SEQ ID NO: 291219 - protein, 9 aa, Homo Sapiens
PVTTNNPAR

SEQ ID NO: 291220 - protein, 9 aa, Homo Sapiens
PADIEKCQD

SEQ ID NO: 291221 - protein, 9 aa, Homo Sapiens
DVETSGIAD

SEQ ID NO: 291222 - protein, 9 aa, Homo Sapiens
MTILEIVLF

SEQ ID NO: 291223 - protein, 9 aa, Homo Sapiens
PNMLGDFLQ

SEQ ID NO: 291224 - protein, 9 aa, Homo Sapiens
KPCITDVKI

SEQ ID NO: 291225 - protein, 9 aa, Homo Sapiens
LAGFSGPVR

SEQ ID NO: 291226 - protein, 9 aa, Homo Sapiens
KLVSIPSRS

SEQ ID NO: 291227 - protein, 9 aa, Homo Sapiens
QNGTITCVQ

SEQ ID NO: 291228 - protein, 9 aa, Homo Sapiens
LKIENVYAE

SEQ ID NO: 291229 - protein, 9 aa, Homo Sapiens
DEIGLPTIF

SEQ ID NO: 291230 - protein, 9 aa, Homo Sapiens
SKLVPPSQK

SEQ ID NO: 291231 - protein, 9 aa, Homo Sapiens
ERKWQEEEK

SEQ ID NO: 291232 - protein, 9 aa, Homo Sapiens
QMWLCKRRH

SEQ ID NO: 291233 - protein, 9 aa, Homo Sapiens
EVGTGAESP

SEQ ID NO: 291234 - protein, 9 aa, Homo Sapiens
EQSIKDYFQ

SEQ ID NO: 291235 - protein, 9 aa, Homo Sapiens
ACGIAQASH

SEQ ID NO: 291236 - protein, 9 aa, Homo Sapiens
LSMASSIIT

SEQ ID NO: 291237 - protein, 9 aa, Homo Sapiens
GIIKQGYTC

SEQ ID NO: 291238 - protein, 9 aa, Homo Sapiens
DLLEEILGK

SEQ ID NO: 291239 - protein, 9 aa, Homo Sapiens
PKHYLTDAW

SEQ ID NO: 291240 - protein, 9 aa, Homo Sapiens
KFGNRIKAL

SEQ ID NO: 291241 - protein, 9 aa, Homo Sapiens
LITMMGNVG

SEQ ID NO: 291242 - protein, 9 aa, Homo Sapiens
LDSLQNSFN

SEQ ID NO: 291243 - protein, 9 aa, Homo Sapiens
AGPPLEADT

SEQ ID NO: 291244 - protein, 9 aa, Homo Sapiens
LYMSPELRC

SEQ ID NO: 291245 - protein, 9 aa, Homo Sapiens
AVADLMVSV

SEQ ID NO: 291246 - protein, 9 aa, Homo Sapiens
FTAATEKQT

SEQ ID NO: 291247 - protein, 9 aa, Homo Sapiens
GHFLDVNGH

SEQ ID NO: 291248 - protein, 9 aa, Homo Sapiens
GGIPLFSLH

SEQ ID NO: 291249 - protein, 9 aa, Homo Sapiens
LHVIDNQRT

SEQ ID NO: 291250 - protein, 9 aa, Homo Sapiens
PGDPSGFAV

SEQ ID NO: 291251 - protein, 9 aa, Homo Sapiens
LVSKKEREI

SEQ ID NO: 291252 - protein, 9 aa, Homo Sapiens
LRAAPGDPS

SEQ ID NO: 291253 - protein, 9 aa, Homo Sapiens
ETPSVVSAS

SEQ ID NO: 291254 - protein, 9 aa, Homo Sapiens
QLYSVASFS

SEQ ID NO: 291255 - protein, 9 aa, Homo Sapiens
DYVFIEFLK

SEQ ID NO: 291256 - protein, 9 aa, Homo Sapiens
PNFLATLPH

SEQ ID NO: 291257 - protein, 9 aa, Homo Sapiens
EKIVQMTEA

SEQ ID NO: 291258 - protein, 9 aa, Homo Sapiens
ESENSKVFD

SEQ ID NO: 291259 - protein, 9 aa, Homo Sapiens
GIIRFYHDG

SEQ ID NO: 291260 - protein, 9 aa, Homo Sapiens
KGPDVKGEY

SEQ ID NO: 291261 - protein, 9 aa, Homo Sapiens
SRAAWKACC

SEQ ID NO: 291262 - protein, 9 aa, Homo Sapiens
CIEITFDGK

SEQ ID NO: 291263 - protein, 9 aa, Homo Sapiens
LSPEKEFKI

SEQ ID NO: 291264 - protein, 9 aa, Homo Sapiens
MCARGGQVR

SEQ ID NO: 291265 - protein, 9 aa, Homo Sapiens
SGLRLPFIG

SEQ ID NO: 291266 - protein, 9 aa, Homo Sapiens
QNCCGRSRP

SEQ ID NO: 291267 - protein, 9 aa, Homo Sapiens
VAQNEEVDK

SEQ ID NO: 291268 - protein, 9 aa, Homo Sapiens
SYGIEHLKL

SEQ ID NO: 291269 - protein, 9 aa, Homo Sapiens
NRNVMETFA

SEQ ID NO: 291270 - protein, 9 aa, Homo Sapiens
EKRLNIFFS

SEQ ID NO: 291271 - protein, 9 aa, Homo Sapiens
YKATMNILV

SEQ ID NO: 291272 - protein, 9 aa, Homo Sapiens
VMASAWCLW

SEQ ID NO: 291273 - protein, 9 aa, Homo Sapiens
KGDKLQSPQ

SEQ ID NO: 291274 - protein, 9 aa, Homo Sapiens
EKACLAAEE

SEQ ID NO: 291275 - protein, 9 aa, Homo Sapiens
RKSNLSNSA

SEQ ID NO: 291276 - protein, 9 aa, Homo Sapiens
EDGNKQDTN

SEQ ID NO: 291277 - protein, 9 aa, Homo Sapiens
LKKMHQTQM

SEQ ID NO: 291278 - protein, 9 aa, Homo Sapiens
PELQYFDDI

SEQ ID NO: 291279 - protein, 9 aa, Homo Sapiens
DDLLKINEN

SEQ ID NO: 291280 - protein, 9 aa, Homo Sapiens
TLLLASGAP

SEQ ID NO: 291281 - protein, 9 aa, Homo Sapiens
MDKEQQVAG

SEQ ID NO: 291282 - protein, 9 aa, Homo Sapiens
AVTVMLGGE

SEQ ID NO: 291283 - protein, 9 aa, Homo Sapiens
LYLGCNKLA

SEQ ID NO: 291284 - protein, 9 aa, Homo Sapiens
CQENRQWRC

SEQ ID NO: 291285 - protein, 9 aa, Homo Sapiens
LFPQDINGK

SEQ ID NO: 291286 - protein, 9 aa, Homo Sapiens
IVSIFQERD

SEQ ID NO: 291287 - protein, 9 aa, Homo Sapiens
LECRVNRNN

SEQ ID NO: 291288 - protein, 9 aa, Homo Sapiens
GGVVLFSMF

SEQ ID NO: 291289 - protein, 9 aa, Homo Sapiens
PFVKDVVEK

SEQ ID NO: 291290 - protein, 9 aa, Homo Sapiens
LIQFLSKLS

SEQ ID NO: 291291 - protein, 9 aa, Homo Sapiens
ILDPVEDAL

SEQ ID NO: 291292 - protein, 9 aa, Homo Sapiens
SLPFIYQTS

SEQ ID NO: 291293 - protein, 9 aa, Homo Sapiens
SKDVCSQSC

SEQ ID NO: 291294 - protein, 9 aa, Homo Sapiens
QGLRGPGLI

SEQ ID NO: 291295 - protein, 9 aa, Homo Sapiens
QSLPAGAQD

SEQ ID NO: 291296 - protein, 9 aa, Homo Sapiens
FFQYEREKT

SEQ ID NO: 291297 - protein, 9 aa, Homo Sapiens
QTISVPVPP

SEQ ID NO: 291298 - protein, 9 aa, Homo Sapiens
AGNTKCYKC

SEQ ID NO: 291299 - protein, 9 aa, Homo Sapiens
YFYMYTLFG

SEQ ID NO: 291300 - protein, 9 aa, Homo Sapiens
IAFRRDQRY

SEQ ID NO: 291301 - protein, 9 aa, Homo Sapiens
VPVENYVAQ

SEQ ID NO: 291302 - protein, 9 aa, Homo Sapiens
VRKSRGKAK

SEQ ID NO: 291303 - protein, 9 aa, Homo Sapiens
EDQTSLELF

SEQ ID NO: 291304 - protein, 9 aa, Homo Sapiens
LEIKHIPSD

SEQ ID NO: 291305 - protein, 9 aa, Homo Sapiens
SYNRLHSSD

SEQ ID NO: 291306 - protein, 9 aa, Homo Sapiens
KRIYMEVRP

SEQ ID NO: 291307 - protein, 9 aa, Homo Sapiens
VNDDLNTVF

SEQ ID NO: 291308 - protein, 9 aa, Homo Sapiens
SKKLDHFQS

SEQ ID NO: 291309 - protein, 9 aa, Homo Sapiens
VYGNILLIL

SEQ ID NO: 291310 - protein, 9 aa, Homo Sapiens
DDSSENDDL

SEQ ID NO: 291311 - protein, 9 aa, Homo Sapiens
DRLFRQLRR

SEQ ID NO: 291312 - protein, 9 aa, Homo Sapiens
VVTSEINQL

SEQ ID NO: 291313 - protein, 9 aa, Homo Sapiens
AAVPSGNIK

SEQ ID NO: 291314 - protein, 9 aa, Homo Sapiens
LNGKVDSCQ

SEQ ID NO: 291315 - protein, 9 aa, Homo Sapiens
KTKERQSTY

SEQ ID NO: 291316 - protein, 9 aa, Homo Sapiens
DEAEIYYLT

SEQ ID NO: 291317 - protein, 9 aa, Homo Sapiens
RNLRSPAEY

SEQ ID NO: 291318 - protein, 9 aa, Homo Sapiens
QEDDFGVAG

SEQ ID NO: 291319 - protein, 9 aa, Homo Sapiens
EVNKNVKCT

SEQ ID NO: 291320 - protein, 9 aa, Homo Sapiens
NTSCKHVVW

SEQ ID NO: 291321 - protein, 9 aa, Homo Sapiens
TAIQRWYMR

SEQ ID NO: 291322 - protein, 9 aa, Homo Sapiens
LPDIVNSGG

SEQ ID NO: 291323 - protein, 9 aa, Homo Sapiens
KEYSNKNAV

SEQ ID NO: 291324 - protein, 9 aa, Homo Sapiens
HLTHDRIKD

SEQ ID NO: 291325 - protein, 9 aa, Homo Sapiens
ALESSDLTK

SEQ ID NO: 291326 - protein, 9 aa, Homo Sapiens
KLFLTKKRR

SEQ ID NO: 291327 - protein, 9 aa, Homo Sapiens
LTINTESTL

SEQ ID NO: 291328 - protein, 9 aa, Homo Sapiens
NMTDDITTS

SEQ ID NO: 291329 - protein, 9 aa, Homo Sapiens
IKKPLNALM

SEQ ID NO: 291330 - protein, 9 aa, Homo Sapiens
KRMLEKKIT

SEQ ID NO: 291331 - protein, 9 aa, Homo Sapiens
NYQGRYEIT

SEQ ID NO: 291332 - protein, 9 aa, Homo Sapiens
HSLLFLLCH

SEQ ID NO: 291333 - protein, 9 aa, Homo Sapiens
IDDVYEQYK

SEQ ID NO: 291334 - protein, 9 aa, Homo Sapiens
FIGVYFVSS

SEQ ID NO: 291335 - protein, 9 aa, Homo Sapiens
EAKAASQGR

SEQ ID NO: 291336 - protein, 9 aa, Homo Sapiens
LLKKTTIPF

SEQ ID NO: 291337 - protein, 9 aa, Homo Sapiens
PVGPKNPNV

SEQ ID NO: 291338 - protein, 9 aa, Homo Sapiens
NWHQKEDHQ

SEQ ID NO: 291339 - protein, 9 aa, Homo Sapiens
IFLAFAFSA

SEQ ID NO: 291340 - protein, 9 aa, Homo Sapiens
HFVIDIQKN

SEQ ID NO: 291341 - protein, 9 aa, Homo Sapiens
FFVPAKEVL

SEQ ID NO: 291342 - protein, 9 aa, Homo Sapiens
PGPGQYMIS

SEQ ID NO: 291343 - protein, 9 aa, Homo Sapiens
VIALESLNS

SEQ ID NO: 291344 - protein, 9 aa, Homo Sapiens
FVDLIANFN

SEQ ID NO: 291345 - protein, 9 aa, Homo Sapiens
RKQRYCVNQ

SEQ ID NO: 291346 - protein, 9 aa, Homo Sapiens
KLGICEPSP

SEQ ID NO: 291347 - protein, 9 aa, Homo Sapiens
KEQQVAGLQ

SEQ ID NO: 291348 - protein, 9 aa, Homo Sapiens
EINKIIYVF

SEQ ID NO: 291349 - protein, 9 aa, Homo Sapiens
TIRMSCVKG

SEQ ID NO: 291350 - protein, 9 aa, Homo Sapiens
INTSDEGIY

SEQ ID NO: 291351 - protein, 9 aa, Homo Sapiens
GQPQNQHQD

SEQ ID NO: 291352 - protein, 9 aa, Homo Sapiens
LINRGTSIT

SEQ ID NO: 291353 - protein, 9 aa, Homo Sapiens
CWGGMITSL

SEQ ID NO: 291354 - protein, 9 aa, Homo Sapiens
EGHLKEVKI

SEQ ID NO: 291355 - protein, 9 aa, Homo Sapiens
YKNPASSSE

SEQ ID NO: 291356 - protein, 9 aa, Homo Sapiens
TLPWRTHDS

SEQ ID NO: 291357 - protein, 9 aa, Homo Sapiens
FWLLGNKED

SEQ ID NO: 291358 - protein, 9 aa, Homo Sapiens
LQPLNVKHH

SEQ ID NO: 291359 - protein, 9 aa, Homo Sapiens
KLNNGRWHC

SEQ ID NO: 291360 - protein, 9 aa, Homo Sapiens
TISDRLQIP

SEQ ID NO: 291361 - protein, 9 aa, Homo Sapiens
IIIDNLHHV

SEQ ID NO: 291362 - protein, 9 aa, Homo Sapiens
TEDYIHIII

SEQ ID NO: 291363 - protein, 9 aa, Homo Sapiens
NEPLSNEEQ

SEQ ID NO: 291364 - protein, 9 aa, Homo Sapiens
QKNTKVDLF

SEQ ID NO: 291365 - protein, 9 aa, Homo Sapiens
KAKIEDLEN

SEQ ID NO: 291366 - protein, 9 aa, Homo Sapiens
IFTDCKVVN

SEQ ID NO: 291367 - protein, 9 aa, Homo Sapiens
VINAQNQNN

SEQ ID NO: 291368 - protein, 9 aa, Homo Sapiens
FYGSVANHQ

SEQ ID NO: 291369 - protein, 9 aa, Homo Sapiens
YDMLKAGAT

SEQ ID NO: 291370 - protein, 9 aa, Homo Sapiens
RILPGTEQD

SEQ ID NO: 291371 - protein, 9 aa, Homo Sapiens
RELVNLIPE

SEQ ID NO: 291372 - protein, 9 aa, Homo Sapiens
QIINNCINA

SEQ ID NO: 291373 - protein, 9 aa, Homo Sapiens
STATKMFLI

SEQ ID NO: 291374 - protein, 9 aa, Homo Sapiens
AFRLDRREN

SEQ ID NO: 291375 - protein, 9 aa, Homo Sapiens
KPRSLWFTW

SEQ ID NO: 291376 - protein, 9 aa, Homo Sapiens
VEKLIKKCK

SEQ ID NO: 291377 - protein, 9 aa, Homo Sapiens
NCSQYSDIV

SEQ ID NO: 291378 - protein, 9 aa, Homo Sapiens
VNVSGGKTR

SEQ ID NO: 291379 - protein, 9 aa, Homo Sapiens
DSCYFDDPR

SEQ ID NO: 291380 - protein, 9 aa, Homo Sapiens
ERYHALEKQ

SEQ ID NO: 291381 - protein, 9 aa, Homo Sapiens
LEHKKKILN

SEQ ID NO: 291382 - protein, 9 aa, Homo Sapiens
QDIKEKLCY

SEQ ID NO: 291383 - protein, 9 aa, Homo Sapiens
LKNLNCPFL

SEQ ID NO: 291384 - protein, 9 aa, Homo Sapiens
ILFKVLLTV

SEQ ID NO: 291385 - protein, 9 aa, Homo Sapiens
KEMQKTMTS

SEQ ID NO: 291386 - protein, 9 aa, Homo Sapiens
QEKIELMRT

SEQ ID NO: 291387 - protein, 9 aa, Homo Sapiens
REKKERLSL

SEQ ID NO: 291388 - protein, 9 aa, Homo Sapiens
CLQLSCLLE

SEQ ID NO: 291389 - protein, 9 aa, Homo Sapiens
DLWPAPVPG

SEQ ID NO: 291390 - protein, 9 aa, Homo Sapiens
VTPDSTRDG

SEQ ID NO: 291391 - protein, 9 aa, Homo Sapiens
NYRIRYRCS

SEQ ID NO: 291392 - protein, 9 aa, Homo Sapiens
HKIPVEAVN

SEQ ID NO: 291393 - protein, 9 aa, Homo Sapiens
KFFDYYSKL

SEQ ID NO: 291394 - protein, 9 aa, Homo Sapiens
NLGLDDTNI

SEQ ID NO: 291395 - protein, 9 aa, Homo Sapiens
LRAKNAQLS

SEQ ID NO: 291396 - protein, 9 aa, Homo Sapiens
ELIMNNTGE

SEQ ID NO: 291397 - protein, 9 aa, Homo Sapiens
ITLPKTLQQ

SEQ ID NO: 291398 - protein, 9 aa, Homo Sapiens
KLSEDCLHL

SEQ ID NO: 291399 - protein, 9 aa, Homo Sapiens
PVKEEHEKR

SEQ ID NO: 291400 - protein, 9 aa, Homo Sapiens
FTLTKLSCD

SEQ ID NO: 291401 - protein, 9 aa, Homo Sapiens
KGASPEGFK

SEQ ID NO: 291402 - protein, 9 aa, Homo Sapiens
EGEYNRASS

SEQ ID NO: 291403 - protein, 9 aa, Homo Sapiens
FSPGSNKLV

SEQ ID NO: 291404 - protein, 9 aa, Homo Sapiens
RLYVQVNTF

SEQ ID NO: 291405 - protein, 9 aa, Homo Sapiens
DCNKTSFFF

SEQ ID NO: 291406 - protein, 9 aa, Homo Sapiens
HHHNPWTVR

SEQ ID NO: 291407 - protein, 9 aa, Homo Sapiens
PHLHAPWDL

SEQ ID NO: 291408 - protein, 9 aa, Homo Sapiens
VKQMLKSVM

SEQ ID NO: 291409 - protein, 9 aa, Homo Sapiens
ENWLEQQQG

SEQ ID NO: 291410 - protein, 9 aa, Homo Sapiens
QQDLDPWKS

SEQ ID NO: 291411 - protein, 9 aa, Homo Sapiens
TFLQPKHKT

SEQ ID NO: 291412 - protein, 9 aa, Homo Sapiens
EIQWEKNIT

SEQ ID NO: 291413 - protein, 9 aa, Homo Sapiens
DERAKITDP

SEQ ID NO: 291414 - protein, 9 aa, Homo Sapiens
QAQNSPKGC

SEQ ID NO: 291415 - protein, 9 aa, Homo Sapiens
LPFMKHGGL

SEQ ID NO: 291416 - protein, 9 aa, Homo Sapiens
HCESSVHWP

SEQ ID NO: 291417 - protein, 9 aa, Homo Sapiens
MVSVVTTIK

SEQ ID NO: 291418 - protein, 9 aa, Homo Sapiens
LYYEMGYTS

SEQ ID NO: 291419 - protein, 9 aa, Homo Sapiens
AEDSDGAVL

SEQ ID NO: 291420 - protein, 9 aa, Homo Sapiens
GPFKFKFHF

SEQ ID NO: 291421 - protein, 9 aa, Homo Sapiens
ICYFGKGAA

SEQ ID NO: 291422 - protein, 9 aa, Homo Sapiens
FKLLQASFE

SEQ ID NO: 291423 - protein, 9 aa, Homo Sapiens
KRLSSVDVS

SEQ ID NO: 291424 - protein, 9 aa, Homo Sapiens
LKIPPEEIK

SEQ ID NO: 291425 - protein, 9 aa, Homo Sapiens
SPEVPEVVV

SEQ ID NO: 291426 - protein, 9 aa, Homo Sapiens
NKIQEAASQ

SEQ ID NO: 291427 - protein, 9 aa, Homo Sapiens
YLKTIALYG

SEQ ID NO: 291428 - protein, 9 aa, Homo Sapiens
HLICHEAPY

SEQ ID NO: 291429 - protein, 9 aa, Homo Sapiens
WVKLLYIVA

SEQ ID NO: 291430 - protein, 9 aa, Homo Sapiens
YRDLGKSGL

SEQ ID NO: 291431 - protein, 9 aa, Homo Sapiens
IQIINKCCE

SEQ ID NO: 291432 - protein, 9 aa, Homo Sapiens
AAKFIQEMA

SEQ ID NO: 291433 - protein, 9 aa, Homo Sapiens
GGNSFNCDC

SEQ ID NO: 291434 - protein, 9 aa, Homo Sapiens
KEDNARKIR

SEQ ID NO: 291435 - protein, 9 aa, Homo Sapiens
HSFQTQEIP

SEQ ID NO: 291436 - protein, 9 aa, Homo Sapiens
SFQYPSQPP

SEQ ID NO: 291437 - protein, 9 aa, Homo Sapiens
KIKNRYFPV

SEQ ID NO: 291438 - protein, 9 aa, Homo Sapiens
EKWHQLQVI

SEQ ID NO: 291439 - protein, 9 aa, Homo Sapiens
HHMTKRKRV

SEQ ID NO: 291440 - protein, 9 aa, Homo Sapiens
YVAICCPIH

SEQ ID NO: 291441 - protein, 9 aa, Homo Sapiens
LDRSLRPEE

SEQ ID NO: 291442 - protein, 9 aa, Homo Sapiens
YTDEAAAED

SEQ ID NO: 291443 - protein, 9 aa, Homo Sapiens
TMFAEGNIS

SEQ ID NO: 291444 - protein, 9 aa, Homo Sapiens
PYLNPDRMS

SEQ ID NO: 291445 - protein, 9 aa, Homo Sapiens
DINMAGEPR

SEQ ID NO: 291446 - protein, 9 aa, Homo Sapiens
KYATVQPYT

SEQ ID NO: 291447 - protein, 9 aa, Homo Sapiens
YQQQSRIQQ

SEQ ID NO: 291448 - protein, 9 aa, Homo Sapiens
KTLLLASGA

SEQ ID NO: 291449 - protein, 9 aa, Homo Sapiens
SLDEKIKLG

SEQ ID NO: 291450 - protein, 9 aa, Homo Sapiens
QLQPGAHFQ

SEQ ID NO: 291451 - protein, 9 aa, Homo Sapiens
IEFRNAIFP

SEQ ID NO: 291452 - protein, 9 aa, Homo Sapiens
LLETHNSVA

SEQ ID NO: 291453 - protein, 9 aa, Homo Sapiens
VQEEGPRVL

SEQ ID NO: 291454 - protein, 9 aa, Homo Sapiens
ADADSESDH

SEQ ID NO: 291455 - protein, 9 aa, Homo Sapiens
KEYWMDPEG

SEQ ID NO: 291456 - protein, 9 aa, Homo Sapiens
HLVGHKKIH

SEQ ID NO: 291457 - protein, 9 aa, Homo Sapiens
LTAPLYFCL

SEQ ID NO: 291458 - protein, 9 aa, Homo Sapiens
YDKEQKANE

SEQ ID NO: 291459 - protein, 9 aa, Homo Sapiens
DKGFKVPGF

SEQ ID NO: 291460 - protein, 9 aa, Homo Sapiens
VFEYYARTW

SEQ ID NO: 291461 - protein, 9 aa, Homo Sapiens
ALITDTYKT

SEQ ID NO: 291462 - protein, 9 aa, Homo Sapiens
YGTVCFGQL

SEQ ID NO: 291463 - protein, 9 aa, Homo Sapiens
TTAMFRPSV

SEQ ID NO: 291464 - protein, 9 aa, Homo Sapiens
VAQNLFNIK

SEQ ID NO: 291465 - protein, 9 aa, Homo Sapiens
NLNKHVYGP

SEQ ID NO: 291466 - protein, 9 aa, Homo Sapiens
LKATSDNKD

SEQ ID NO: 291467 - protein, 9 aa, Homo Sapiens
KKMSKETCP

SEQ ID NO: 291468 - protein, 9 aa, Homo Sapiens
VDLENNQIT

SEQ ID NO: 291469 - protein, 9 aa, Homo Sapiens
AVMLIFGVV

SEQ ID NO: 291470 - protein, 9 aa, Homo Sapiens
LRTFSCMFF

SEQ ID NO: 291471 - protein, 9 aa, Homo Sapiens
SLEKYLYTF

SEQ ID NO: 291472 - protein, 9 aa, Homo Sapiens
SAFNKEITR

SEQ ID NO: 291473 - protein, 9 aa, Homo Sapiens
IYVVTVMGN

SEQ ID NO: 291474 - protein, 9 aa, Homo Sapiens
GEREIWNQT

SEQ ID NO: 291475 - protein, 9 aa, Homo Sapiens
SALFMLFFS

SEQ ID NO: 291476 - protein, 9 aa, Homo Sapiens
KCTAQEIYD

SEQ ID NO: 291477 - protein, 9 aa, Homo Sapiens
TNVDLGGNS

SEQ ID NO: 291478 - protein, 9 aa, Homo Sapiens
EFLTGQIDP

SEQ ID NO: 291479 - protein, 9 aa, Homo Sapiens
SLSAPGTPG

SEQ ID NO: 291480 - protein, 9 aa, Homo Sapiens
TVTYRNVKF

SEQ ID NO: 291481 - protein, 9 aa, Homo Sapiens
RLKLLCERN

SEQ ID NO: 291482 - protein, 9 aa, Homo Sapiens
LTTENSTGR

SEQ ID NO: 291483 - protein, 9 aa, Homo Sapiens
LLKRSFSAD

SEQ ID NO: 291484 - protein, 9 aa, Homo Sapiens
PYDVINTFE

SEQ ID NO: 291485 - protein, 9 aa, Homo Sapiens
SSPFPEVWH

SEQ ID NO: 291486 - protein, 9 aa, Homo Sapiens
APYGTVGAV

SEQ ID NO: 291487 - protein, 9 aa, Homo Sapiens
CNFDLKVLS

SEQ ID NO: 291488 - protein, 9 aa, Homo Sapiens
LEHEKIHTE

SEQ ID NO: 291489 - protein, 9 aa, Homo Sapiens
LDQRHSKLR

SEQ ID NO: 291490 - protein, 9 aa, Homo Sapiens
KPTVESLPC

SEQ ID NO: 291491 - protein, 9 aa, Homo Sapiens
QSDPHKRNL

SEQ ID NO: 291492 - protein, 9 aa, Homo Sapiens
CFIEVKTIM

SEQ ID NO: 291493 - protein, 9 aa, Homo Sapiens
PHDILGIPS

SEQ ID NO: 291494 - protein, 9 aa, Homo Sapiens
RSSDPSHLA

SEQ ID NO: 291495 - protein, 9 aa, Homo Sapiens
RSLQNKGSV

SEQ ID NO: 291496 - protein, 9 aa, Homo Sapiens
YQFPQSIDL

SEQ ID NO: 291497 - protein, 9 aa, Homo Sapiens
GKTYGLWEC

SEQ ID NO: 291498 - protein, 9 aa, Homo Sapiens
DPMLLATVE

SEQ ID NO: 291499 - protein, 9 aa, Homo Sapiens
QQWCFDQIN

SEQ ID NO: 291500 - protein, 9 aa, Homo Sapiens
IFTTGDVNR

SEQ ID NO: 291501 - protein, 9 aa, Homo Sapiens
VIRVLWGLL

SEQ ID NO: 291502 - protein, 9 aa, Homo Sapiens
GFPGEIGKP

SEQ ID NO: 291503 - protein, 9 aa, Homo Sapiens
YEMGYTSRS

SEQ ID NO: 291504 - protein, 9 aa, Homo Sapiens
KFDVLKNHL

SEQ ID NO: 291505 - protein, 9 aa, Homo Sapiens
QSVKKLYDV

SEQ ID NO: 291506 - protein, 9 aa, Homo Sapiens
QFLQWTELL

SEQ ID NO: 291507 - protein, 9 aa, Homo Sapiens
AKQRPKDLW

SEQ ID NO: 291508 - protein, 9 aa, Homo Sapiens
KTKLKYGQT

SEQ ID NO: 291509 - protein, 9 aa, Homo Sapiens
ALVPEYSKA

SEQ ID NO: 291510 - protein, 9 aa, Homo Sapiens
VLQLMERNP

SEQ ID NO: 291511 - protein, 9 aa, Homo Sapiens
GSAVADTLD

SEQ ID NO: 291512 - protein, 9 aa, Homo Sapiens
DNYLINNCS

SEQ ID NO: 291513 - protein, 9 aa, Homo Sapiens
GYNVNTSVL

SEQ ID NO: 291514 - protein, 9 aa, Homo Sapiens
YKNYLRKTR

SEQ ID NO: 291515 - protein, 9 aa, Homo Sapiens
GVAGEAAFI

SEQ ID NO: 291516 - protein, 9 aa, Homo Sapiens
AKETKVKEL

SEQ ID NO: 291517 - protein, 9 aa, Homo Sapiens
PSPKISRSP

SEQ ID NO: 291518 - protein, 9 aa, Homo Sapiens
VWNDYSLTK

SEQ ID NO: 291519 - protein, 9 aa, Homo Sapiens
EVEQEVKII

SEQ ID NO: 291520 - protein, 9 aa, Homo Sapiens
VQEEANAAA

SEQ ID NO: 291521 - protein, 9 aa, Homo Sapiens
IAVDPIAGT

SEQ ID NO: 291522 - protein, 9 aa, Homo Sapiens
CPLVVPNLG

SEQ ID NO: 291523 - protein, 9 aa, Homo Sapiens
VCTGSDNGT

SEQ ID NO: 291524 - protein, 9 aa, Homo Sapiens
GREDYSPLI

SEQ ID NO: 291525 - protein, 9 aa, Homo Sapiens
KEPLGNIYF

SEQ ID NO: 291526 - protein, 9 aa, Homo Sapiens
TILHTLIYD

SEQ ID NO: 291527 - protein, 9 aa, Homo Sapiens
LTQEPESIH

SEQ ID NO: 291528 - protein, 9 aa, Homo Sapiens
VEFLYNLLY

SEQ ID NO: 291529 - protein, 9 aa, Homo Sapiens
LHHDGNIID

SEQ ID NO: 291530 - protein, 9 aa, Homo Sapiens
DRIIATLQS

SEQ ID NO: 291531 - protein, 9 aa, Homo Sapiens
FYLVTIQEN

SEQ ID NO: 291532 - protein, 9 aa, Homo Sapiens
LRTVQYIMN

SEQ ID NO: 291533 - protein, 9 aa, Homo Sapiens
RSMSINLSM

SEQ ID NO: 291534 - protein, 9 aa, Homo Sapiens
HEKTNDTLL

SEQ ID NO: 291535 - protein, 9 aa, Homo Sapiens
GNSEAVKLL

SEQ ID NO: 291536 - protein, 9 aa, Homo Sapiens
GIVSIIYSI

SEQ ID NO: 291537 - protein, 9 aa, Homo Sapiens
RVRIFRADK

SEQ ID NO: 291538 - protein, 9 aa, Homo Sapiens
YLQYKHVRP

SEQ ID NO: 291539 - protein, 9 aa, Homo Sapiens
GAANLQLIQ

SEQ ID NO: 291540 - protein, 9 aa, Homo Sapiens
FSPAKLEWV

SEQ ID NO: 291541 - protein, 9 aa, Homo Sapiens
DQQDQAIKT

SEQ ID NO: 291542 - protein, 9 aa, Homo Sapiens
CKIALGCNL

SEQ ID NO: 291543 - protein, 9 aa, Homo Sapiens
QQFLTNIGL

SEQ ID NO: 291544 - protein, 9 aa, Homo Sapiens
EVWNPQKAI

SEQ ID NO: 291545 - protein, 9 aa, Homo Sapiens
NKLGETLSG

SEQ ID NO: 291546 - protein, 9 aa, Homo Sapiens
QHIEDNIIN

SEQ ID NO: 291547 - protein, 9 aa, Homo Sapiens
NRVRYMVVV

SEQ ID NO: 291548 - protein, 9 aa, Homo Sapiens
IFLMMLHKG

SEQ ID NO: 291549 - protein, 9 aa, Homo Sapiens
PKHNHILKP

SEQ ID NO: 291550 - protein, 9 aa, Homo Sapiens
PVCGSDGEL

SEQ ID NO: 291551 - protein, 9 aa, Homo Sapiens
ELSYGFDGR

SEQ ID NO: 291552 - protein, 9 aa, Homo Sapiens
VGLSQERVA

SEQ ID NO: 291553 - protein, 9 aa, Homo Sapiens
APQLDLSKI

SEQ ID NO: 291554 - protein, 9 aa, Homo Sapiens
LFDAHEGFS

SEQ ID NO: 291555 - protein, 9 aa, Homo Sapiens
VKQMLHRLT

SEQ ID NO: 291556 - protein, 9 aa, Homo Sapiens
KNGLKFPTY

SEQ ID NO: 291557 - protein, 9 aa, Homo Sapiens
DAPPAWGQR

SEQ ID NO: 291558 - protein, 9 aa, Homo Sapiens
MVEDSLASG

SEQ ID NO: 291559 - protein, 9 aa, Homo Sapiens
IVVANTIDA

SEQ ID NO: 291560 - protein, 9 aa, Homo Sapiens
INKVEELNK

SEQ ID NO: 291561 - protein, 9 aa, Homo Sapiens
STLISASQQ

SEQ ID NO: 291562 - protein, 9 aa, Homo Sapiens
NVTDMLAGG

SEQ ID NO: 291563 - protein, 9 aa, Homo Sapiens
SGMSGIKRK

SEQ ID NO: 291564 - protein, 9 aa, Homo Sapiens
RLAKQGNPK

SEQ ID NO: 291565 - protein, 9 aa, Homo Sapiens
MKDKWWRGS

SEQ ID NO: 291566 - protein, 9 aa, Homo Sapiens
QSKKKGPHT

SEQ ID NO: 291567 - protein, 9 aa, Homo Sapiens
PDQCCIVYL

SEQ ID NO: 291568 - protein, 9 aa, Homo Sapiens
IPLGECCAV

SEQ ID NO: 291569 - protein, 9 aa, Homo Sapiens
EWIRHLFPK

SEQ ID NO: 291570 - protein, 9 aa, Homo Sapiens
DSIRTLWLF

SEQ ID NO: 291571 - protein, 9 aa, Homo Sapiens
PKPQEQDVK

SEQ ID NO: 291572 - protein, 9 aa, Homo Sapiens
PSLAHSAGY

SEQ ID NO: 291573 - protein, 9 aa, Homo Sapiens
TYIRPRNLR

SEQ ID NO: 291574 - protein, 9 aa, Homo Sapiens
WFYNEDVTL

SEQ ID NO: 291575 - protein, 9 aa, Homo Sapiens
REKDKDKDR

SEQ ID NO: 291576 - protein, 9 aa, Homo Sapiens
RFGILDFIS

SEQ ID NO: 291577 - protein, 9 aa, Homo Sapiens
KDEIRHSRK

SEQ ID NO: 291578 - protein, 9 aa, Homo Sapiens
NKPNLYNND

SEQ ID NO: 291579 - protein, 9 aa, Homo Sapiens
AVNRMFQKE

SEQ ID NO: 291580 - protein, 9 aa, Homo Sapiens
LISTFRFNF

SEQ ID NO: 291581 - protein, 9 aa, Homo Sapiens
NVLATITTD

SEQ ID NO: 291582 - protein, 9 aa, Homo Sapiens
PLDFRDVAI

SEQ ID NO: 291583 - protein, 9 aa, Homo Sapiens
DNKYDTGEH

SEQ ID NO: 291584 - protein, 9 aa, Homo Sapiens
RSRANQKSL

SEQ ID NO: 291585 - protein, 9 aa, Homo Sapiens
RCCLQENNC

SEQ ID NO: 291586 - protein, 9 aa, Homo Sapiens
ADNEAGKEE

SEQ ID NO: 291587 - protein, 9 aa, Homo Sapiens
DGRFYPLYK

SEQ ID NO: 291588 - protein, 9 aa, Homo Sapiens
FVLIFFSRA

SEQ ID NO: 291589 - protein, 9 aa, Homo Sapiens
LKLLRAIAS

SEQ ID NO: 291590 - protein, 9 aa, Homo Sapiens
QGKNRESSD

SEQ ID NO: 291591 - protein, 9 aa, Homo Sapiens
IKSKFALRT

SEQ ID NO: 291592 - protein, 9 aa, Homo Sapiens
APGDQVTGT

SEQ ID NO: 291593 - protein, 9 aa, Homo Sapiens
FPLLSFNIN

SEQ ID NO: 291594 - protein, 9 aa, Homo Sapiens
LQEQNITPQ

SEQ ID NO: 291595 - protein, 9 aa, Homo Sapiens
PAESAAVWN

SEQ ID NO: 291596 - protein, 9 aa, Homo Sapiens
EILNTLREK

SEQ ID NO: 291597 - protein, 9 aa, Homo Sapiens
DIYDVPPVW

SEQ ID NO: 291598 - protein, 9 aa, Homo Sapiens
EDFPPPSPQ

SEQ ID NO: 291599 - protein, 9 aa, Homo Sapiens
YRALCIRDK

SEQ ID NO: 291600 - protein, 9 aa, Homo Sapiens
YVNRTPMYM

SEQ ID NO: 291601 - protein, 9 aa, Homo Sapiens
TSQHLQNFF

SEQ ID NO: 291602 - protein, 9 aa, Homo Sapiens
HLDLRQEGE

SEQ ID NO: 291603 - protein, 9 aa, Homo Sapiens
PNPPILSLP

SEQ ID NO: 291604 - protein, 9 aa, Homo Sapiens
GCPINNLDA

SEQ ID NO: 291605 - protein, 9 aa, Homo Sapiens
PDLETKSQS

SEQ ID NO: 291606 - protein, 9 aa, Homo Sapiens
VSKRVCIPL

SEQ ID NO: 291607 - protein, 9 aa, Homo Sapiens
TMKADLESE

SEQ ID NO: 291608 - protein, 9 aa, Homo Sapiens
SFLDILNYL

SEQ ID NO: 291609 - protein, 9 aa, Homo Sapiens
NIHSSCATS

SEQ ID NO: 291610 - protein, 9 aa, Homo Sapiens
GKFEKIIKR

SEQ ID NO: 291611 - protein, 9 aa, Homo Sapiens
TRDLMDKLK

SEQ ID NO: 291612 - protein, 9 aa, Homo Sapiens
EMINEDGRV

SEQ ID NO: 291613 - protein, 9 aa, Homo Sapiens
RPWTRKGRT

SEQ ID NO: 291614 - protein, 9 aa, Homo Sapiens
LIQHQKFHT

SEQ ID NO: 291615 - protein, 9 aa, Homo Sapiens
RNDKVHQDT

SEQ ID NO: 291616 - protein, 9 aa, Homo Sapiens
KNTKKHGKS

SEQ ID NO: 291617 - protein, 9 aa, Homo Sapiens
QKVVIPPSF

SEQ ID NO: 291618 - protein, 9 aa, Homo Sapiens
KYSEVQIKQ

SEQ ID NO: 291619 - protein, 9 aa, Homo Sapiens
ITHTGEKPF

SEQ ID NO: 291620 - protein, 9 aa, Homo Sapiens
LLPSNKQPP

SEQ ID NO: 291621 - protein, 9 aa, Homo Sapiens
VIVEQPFPI

SEQ ID NO: 291622 - protein, 9 aa, Homo Sapiens
CTESPHKCL

SEQ ID NO: 291623 - protein, 9 aa, Homo Sapiens
EPESIHKWR

SEQ ID NO: 291624 - protein, 9 aa, Homo Sapiens
TKSGGGMPK

SEQ ID NO: 291625 - protein, 9 aa, Homo Sapiens
CLLLNVQPD

SEQ ID NO: 291626 - protein, 9 aa, Homo Sapiens
ALGFIHEVQ

SEQ ID NO: 291627 - protein, 9 aa, Homo Sapiens
SLSYHQGCP

SEQ ID NO: 291628 - protein, 9 aa, Homo Sapiens
PAEVGCLVH

SEQ ID NO: 291629 - protein, 9 aa, Homo Sapiens
ALHDDADIV

SEQ ID NO: 291630 - protein, 9 aa, Homo Sapiens
EKRKLKGKE

SEQ ID NO: 291631 - protein, 9 aa, Homo Sapiens
KGSKNYSEI

SEQ ID NO: 291632 - protein, 9 aa, Homo Sapiens
KFVMQEDLS

SEQ ID NO: 291633 - protein, 9 aa, Homo Sapiens
FYLLENITF

SEQ ID NO: 291634 - protein, 9 aa, Homo Sapiens
LTVRALRRA

SEQ ID NO: 291635 - protein, 9 aa, Homo Sapiens
STVELAQTC

SEQ ID NO: 291636 - protein, 9 aa, Homo Sapiens
SLKEKVNLQ

SEQ ID NO: 291637 - protein, 9 aa, Homo Sapiens
KKPFLSGPQ

SEQ ID NO: 291638 - protein, 9 aa, Homo Sapiens
KTAEKKDRD

SEQ ID NO: 291639 - protein, 9 aa, Homo Sapiens
VYNWSPQIQ

SEQ ID NO: 291640 - protein, 9 aa, Homo Sapiens
EGVFELIPQ

SEQ ID NO: 291641 - protein, 9 aa, Homo Sapiens
AKVDPALGK

SEQ ID NO: 291642 - protein, 9 aa, Homo Sapiens
SSSVPTPLP

SEQ ID NO: 291643 - protein, 9 aa, Homo Sapiens
GKVKPFNQN

SEQ ID NO: 291644 - protein, 9 aa, Homo Sapiens
LPRTFKFMK

SEQ ID NO: 291645 - protein, 9 aa, Homo Sapiens
HHDNHCGSH

SEQ ID NO: 291646 - protein, 9 aa, Homo Sapiens
LTPSRINFK

SEQ ID NO: 291647 - protein, 9 aa, Homo Sapiens
KIFPQYVLL

SEQ ID NO: 291648 - protein, 9 aa, Homo Sapiens
ASEGLPGMC

SEQ ID NO: 291649 - protein, 9 aa, Homo Sapiens
VTAPHPAVH

SEQ ID NO: 291650 - protein, 9 aa, Homo Sapiens
YQIIMTPRL

SEQ ID NO: 291651 - protein, 9 aa, Homo Sapiens
QTPQGKQKV

SEQ ID NO: 291652 - protein, 9 aa, Homo Sapiens
VSLVDVSGS

SEQ ID NO: 291653 - protein, 9 aa, Homo Sapiens
AKRSVLNNS

SEQ ID NO: 291654 - protein, 9 aa, Homo Sapiens
NNSIKLRLN

SEQ ID NO: 291655 - protein, 9 aa, Homo Sapiens
KYVIGWNKS

SEQ ID NO: 291656 - protein, 9 aa, Homo Sapiens
SSSLTQHVI

SEQ ID NO: 291657 - protein, 9 aa, Homo Sapiens
LCNLDIALE

SEQ ID NO: 291658 - protein, 9 aa, Homo Sapiens
AVEATRISR

SEQ ID NO: 291659 - protein, 9 aa, Homo Sapiens
SDRVSLISL

SEQ ID NO: 291660 - protein, 9 aa, Homo Sapiens
PDKSQSLCE

SEQ ID NO: 291661 - protein, 9 aa, Homo Sapiens
FNEYIYLVE

SEQ ID NO: 291662 - protein, 9 aa, Homo Sapiens
KVSNDITSI

SEQ ID NO: 291663 - protein, 9 aa, Homo Sapiens
CGTTSSPEP

SEQ ID NO: 291664 - protein, 9 aa, Homo Sapiens
SKCCKNVYQ

SEQ ID NO: 291665 - protein, 9 aa, Homo Sapiens
TFKCNICLE

SEQ ID NO: 291666 - protein, 9 aa, Homo Sapiens
KGTAEKLDN

SEQ ID NO: 291667 - protein, 9 aa, Homo Sapiens
EVILKGLEV

SEQ ID NO: 291668 - protein, 9 aa, Homo Sapiens
FYHHCQSKM

SEQ ID NO: 291669 - protein, 9 aa, Homo Sapiens
HCMKLMQQQ

SEQ ID NO: 291670 - protein, 9 aa, Homo Sapiens
HNISNICSY

SEQ ID NO: 291671 - protein, 9 aa, Homo Sapiens
IQEDDLNNL

SEQ ID NO: 291672 - protein, 9 aa, Homo Sapiens
YIIKKYFFG

SEQ ID NO: 291673 - protein, 9 aa, Homo Sapiens
WNKSEGSPP

SEQ ID NO: 291674 - protein, 9 aa, Homo Sapiens
GDNLITRSQ

SEQ ID NO: 291675 - protein, 9 aa, Homo Sapiens
NNTTDQKIE

SEQ ID NO: 291676 - protein, 9 aa, Homo Sapiens
IREGHYPKP

SEQ ID NO: 291677 - protein, 9 aa, Homo Sapiens
GKAKSQQVR

SEQ ID NO: 291678 - protein, 9 aa, Homo Sapiens
TGEESSTLL

SEQ ID NO: 291679 - protein, 9 aa, Homo Sapiens
EFTQHIFVK

SEQ ID NO: 291680 - protein, 9 aa, Homo Sapiens
KETVTLNSS

SEQ ID NO: 291681 - protein, 9 aa, Homo Sapiens
DQCELDCDE

SEQ ID NO: 291682 - protein, 9 aa, Homo Sapiens
ANLQLIQAL

SEQ ID NO: 291683 - protein, 9 aa, Homo Sapiens
VFYPTEKAL

SEQ ID NO: 291684 - protein, 9 aa, Homo Sapiens
VKFGNHMES

SEQ ID NO: 291685 - protein, 9 aa, Homo Sapiens
LLSDNMLIL

SEQ ID NO: 291686 - protein, 9 aa, Homo Sapiens
LSLFFVFPP

SEQ ID NO: 291687 - protein, 9 aa, Homo Sapiens
GLMVSMSIV

SEQ ID NO: 291688 - protein, 9 aa, Homo Sapiens
SISVQTSKH

SEQ ID NO: 291689 - protein, 9 aa, Homo Sapiens
QEHALKTQN

SEQ ID NO: 291690 - protein, 9 aa, Homo Sapiens
PPLGLCVKN

SEQ ID NO: 291691 - protein, 9 aa, Homo Sapiens
ESSQLIYPP

SEQ ID NO: 291692 - protein, 9 aa, Homo Sapiens
CETDLIFLT

SEQ ID NO: 291693 - protein, 9 aa, Homo Sapiens
LKFPTYLHS

SEQ ID NO: 291694 - protein, 9 aa, Homo Sapiens
QHFRPKSGT

SEQ ID NO: 291695 - protein, 9 aa, Homo Sapiens
TLARISAQG

SEQ ID NO: 291696 - protein, 9 aa, Homo Sapiens
DNQNLRMQV

SEQ ID NO: 291697 - protein, 9 aa, Homo Sapiens
EHFIASSDL

SEQ ID NO: 291698 - protein, 9 aa, Homo Sapiens
ANHLKEKTG

SEQ ID NO: 291699 - protein, 9 aa, Homo Sapiens
VVVIYKKVI

SEQ ID NO: 291700 - protein, 9 aa, Homo Sapiens
LVICEDGNS

SEQ ID NO: 291701 - protein, 9 aa, Homo Sapiens
DTIFTFVET

SEQ ID NO: 291702 - protein, 9 aa, Homo Sapiens
TFSPLPLKV

SEQ ID NO: 291703 - protein, 9 aa, Homo Sapiens
GKLFEYTLK

SEQ ID NO: 291704 - protein, 9 aa, Homo Sapiens
RLVIRDKNK

SEQ ID NO: 291705 - protein, 9 aa, Homo Sapiens
NPDYTYTNF

SEQ ID NO: 291706 - protein, 9 aa, Homo Sapiens
QNVFCDVSI

SEQ ID NO: 291707 - protein, 9 aa, Homo Sapiens
HYFILVSFT

SEQ ID NO: 291708 - protein, 9 aa, Homo Sapiens
PETTAQRCF

SEQ ID NO: 291709 - protein, 9 aa, Homo Sapiens
DNGTVKLWD

SEQ ID NO: 291710 - protein, 9 aa, Homo Sapiens
GKALFYSAS

SEQ ID NO: 291711 - protein, 9 aa, Homo Sapiens
KRNYIVPII

SEQ ID NO: 291712 - protein, 9 aa, Homo Sapiens
SIINSTEYP

SEQ ID NO: 291713 - protein, 9 aa, Homo Sapiens
DNMIVPIKL

SEQ ID NO: 291714 - protein, 9 aa, Homo Sapiens
SLLVLLTQL

SEQ ID NO: 291715 - protein, 9 aa, Homo Sapiens
RQINHSGSF

SEQ ID NO: 291716 - protein, 9 aa, Homo Sapiens
KNCVHLLKI

SEQ ID NO: 291717 - protein, 9 aa, Homo Sapiens
DFHKKFALR

SEQ ID NO: 291718 - protein, 9 aa, Homo Sapiens
TNKDCKTSS

SEQ ID NO: 291719 - protein, 9 aa, Homo Sapiens
DSQTVYQYQ

SEQ ID NO: 291720 - protein, 9 aa, Homo Sapiens
QNHEPEFDY

SEQ ID NO: 291721 - protein, 9 aa, Homo Sapiens
YKYSPFTTE

SEQ ID NO: 291722 - protein, 9 aa, Homo Sapiens
SLNKRLQTL

SEQ ID NO: 291723 - protein, 9 aa, Homo Sapiens
TFLSNPDSS

SEQ ID NO: 291724 - protein, 9 aa, Homo Sapiens
TIRKELKRN

SEQ ID NO: 291725 - protein, 9 aa, Homo Sapiens
YISDEEWEV

SEQ ID NO: 291726 - protein, 9 aa, Homo Sapiens
AAFRKAASH

SEQ ID NO: 291727 - protein, 9 aa, Homo Sapiens
LMMLHKGGE

SEQ ID NO: 291728 - protein, 9 aa, Homo Sapiens
DRARRSPQK

SEQ ID NO: 291729 - protein, 9 aa, Homo Sapiens
AKYKWYLKG

SEQ ID NO: 291730 - protein, 9 aa, Homo Sapiens
ACLAASFLK

SEQ ID NO: 291731 - protein, 9 aa, Homo Sapiens
CGYNVISHL

SEQ ID NO: 291732 - protein, 9 aa, Homo Sapiens
KIIYMFLPI

SEQ ID NO: 291733 - protein, 9 aa, Homo Sapiens
LDDEIKLRN

SEQ ID NO: 291734 - protein, 9 aa, Homo Sapiens
VCQGVLAPD

SEQ ID NO: 291735 - protein, 9 aa, Homo Sapiens
TMDSHIAEE

SEQ ID NO: 291736 - protein, 9 aa, Homo Sapiens
NKKPRKSSM

SEQ ID NO: 291737 - protein, 9 aa, Homo Sapiens
SIQIEEATE

SEQ ID NO: 291738 - protein, 9 aa, Homo Sapiens
AHVIKRHRG

SEQ ID NO: 291739 - protein, 9 aa, Homo Sapiens
SDVVNVSIP

SEQ ID NO: 291740 - protein, 9 aa, Homo Sapiens
LLRTPYTSA

SEQ ID NO: 291741 - protein, 9 aa, Homo Sapiens
MKFFQIKMY

SEQ ID NO: 291742 - protein, 9 aa, Homo Sapiens
FTGSAAITE

SEQ ID NO: 291743 - protein, 9 aa, Homo Sapiens
SVSLLSNSA

SEQ ID NO: 291744 - protein, 9 aa, Homo Sapiens
GKAFSQLSS

SEQ ID NO: 291745 - protein, 9 aa, Homo Sapiens
CKGRIDLAE

SEQ ID NO: 291746 - protein, 9 aa, Homo Sapiens
VKEYPQLEQ

SEQ ID NO: 291747 - protein, 9 aa, Homo Sapiens
LKELGRMCQ

SEQ ID NO: 291748 - protein, 9 aa, Homo Sapiens
STENTLGCR

SEQ ID NO: 291749 - protein, 9 aa, Homo Sapiens
PFLYSLQFS

SEQ ID NO: 291750 - protein, 9 aa, Homo Sapiens
PDSKKVLYT

SEQ ID NO: 291751 - protein, 9 aa, Homo Sapiens
KPLSCPECN

SEQ ID NO: 291752 - protein, 9 aa, Homo Sapiens
RRQNGYRAL

SEQ ID NO: 291753 - protein, 9 aa, Homo Sapiens
NVDHLSCTP

SEQ ID NO: 291754 - protein, 9 aa, Homo Sapiens
YYPCEPALG

SEQ ID NO: 291755 - protein, 9 aa, Homo Sapiens
PQRSSRLFT

SEQ ID NO: 291756 - protein, 9 aa, Homo Sapiens
IEDFDLAHK

SEQ ID NO: 291757 - protein, 9 aa, Homo Sapiens
CLIKKCLSS

SEQ ID NO: 291758 - protein, 9 aa, Homo Sapiens
LPFKKPSIK

SEQ ID NO: 291759 - protein, 9 aa, Homo Sapiens
EEEEEELNF

SEQ ID NO: 291760 - protein, 9 aa, Homo Sapiens
LQKHPAPPP

SEQ ID NO: 291761 - protein, 9 aa, Homo Sapiens
QYVLLFGLL

SEQ ID NO: 291762 - protein, 9 aa, Homo Sapiens
GHLSADMAK

SEQ ID NO: 291763 - protein, 9 aa, Homo Sapiens
VVKQMLHRL

SEQ ID NO: 291764 - protein, 9 aa, Homo Sapiens
IEKLSGEVH

SEQ ID NO: 291765 - protein, 9 aa, Homo Sapiens
QMVKMTESS

SEQ ID NO: 291766 - protein, 9 aa, Homo Sapiens
FTQNPHLAN

SEQ ID NO: 291767 - protein, 9 aa, Homo Sapiens
DNTFATCSD

SEQ ID NO: 291768 - protein, 9 aa, Homo Sapiens
QMPVYSVGT

SEQ ID NO: 291769 - protein, 9 aa, Homo Sapiens
PFQLYLNPE

SEQ ID NO: 291770 - protein, 9 aa, Homo Sapiens
GETFSLIQD

SEQ ID NO: 291771 - protein, 9 aa, Homo Sapiens
GATLTVRAL

SEQ ID NO: 291772 - protein, 9 aa, Homo Sapiens
AALCVRQSG

SEQ ID NO: 291773 - protein, 9 aa, Homo Sapiens
EIPPMPENR

SEQ ID NO: 291774 - protein, 9 aa, Homo Sapiens
IWWTVLFIY

SEQ ID NO: 291775 - protein, 9 aa, Homo Sapiens
KLLSSQLEE

SEQ ID NO: 291776 - protein, 9 aa, Homo Sapiens
HATGLGAML

SEQ ID NO: 291777 - protein, 9 aa, Homo Sapiens
IAYKPPGCS

SEQ ID NO: 291778 - protein, 9 aa, Homo Sapiens
CYTAENKSP

SEQ ID NO: 291779 - protein, 9 aa, Homo Sapiens
NPVMCPSAG

SEQ ID NO: 291780 - protein, 9 aa, Homo Sapiens
FLRCYNKKV

SEQ ID NO: 291781 - protein, 9 aa, Homo Sapiens
IKRGGCTFT

SEQ ID NO: 291782 - protein, 9 aa, Homo Sapiens
RNSALLRYH

SEQ ID NO: 291783 - protein, 9 aa, Homo Sapiens
QVATMKADL

SEQ ID NO: 291784 - protein, 9 aa, Homo Sapiens
ILGIPGSRG

SEQ ID NO: 291785 - protein, 9 aa, Homo Sapiens
RSLVTRIYD

SEQ ID NO: 291786 - protein, 9 aa, Homo Sapiens
IPHIFCNVT

SEQ ID NO: 291787 - protein, 9 aa, Homo Sapiens
RELYKFHNR

SEQ ID NO: 291788 - protein, 9 aa, Homo Sapiens
WTSSCTNQN

SEQ ID NO: 291789 - protein, 9 aa, Homo Sapiens
NSNKGVSVL

SEQ ID NO: 291790 - protein, 9 aa, Homo Sapiens
GGEHGPQVS

SEQ ID NO: 291791 - protein, 9 aa, Homo Sapiens
EFPLSSHQP

SEQ ID NO: 291792 - protein, 9 aa, Homo Sapiens
QIEKGTPKE

SEQ ID NO: 291793 - protein, 9 aa, Homo Sapiens
AVEELNNNV

SEQ ID NO: 291794 - protein, 9 aa, Homo Sapiens
LYLWETIVL

SEQ ID NO: 291795 - protein, 9 aa, Homo Sapiens
ILPNWNFFI

SEQ ID NO: 291796 - protein, 9 aa, Homo Sapiens
GYPEQFCVI

SEQ ID NO: 291797 - protein, 9 aa, Homo Sapiens
GIMTRLSTR

SEQ ID NO: 291798 - protein, 9 aa, Homo Sapiens
LLGMYMFRH

SEQ ID NO: 291799 - protein, 9 aa, Homo Sapiens
AENSKFFKT

SEQ ID NO: 291800 - protein, 9 aa, Homo Sapiens
LPKENHIFL

SEQ ID NO: 291801 - protein, 9 aa, Homo Sapiens
WPKLITEKE

SEQ ID NO: 291802 - protein, 9 aa, Homo Sapiens
WSAGVPLDL

SEQ ID NO: 291803 - protein, 9 aa, Homo Sapiens
DQQKINTFA

SEQ ID NO: 291804 - protein, 9 aa, Homo Sapiens
FATGKHGSM

SEQ ID NO: 291805 - protein, 9 aa, Homo Sapiens
KIKFGEYVD

SEQ ID NO: 291806 - protein, 9 aa, Homo Sapiens
DADNQILKT

SEQ ID NO: 291807 - protein, 9 aa, Homo Sapiens
GDNKYDTGE

SEQ ID NO: 291808 - protein, 9 aa, Homo Sapiens
NENCEEIIN

SEQ ID NO: 291809 - protein, 9 aa, Homo Sapiens
SDKPIFFES

SEQ ID NO: 291810 - protein, 9 aa, Homo Sapiens
SHFEHIIYQ

SEQ ID NO: 291811 - protein, 9 aa, Homo Sapiens
LKRVPQTGW

SEQ ID NO: 291812 - protein, 9 aa, Homo Sapiens
CDVQERVIS

SEQ ID NO: 291813 - protein, 9 aa, Homo Sapiens
VKVWFQEAE

SEQ ID NO: 291814 - protein, 9 aa, Homo Sapiens
RQLENEFQM

SEQ ID NO: 291815 - protein, 9 aa, Homo Sapiens
NVAILYNDR

SEQ ID NO: 291816 - protein, 9 aa, Homo Sapiens
RAGERSVVE

SEQ ID NO: 291817 - protein, 9 aa, Homo Sapiens
NKVLHFPNP

SEQ ID NO: 291818 - protein, 9 aa, Homo Sapiens
FQFALHSSE

SEQ ID NO: 291819 - protein, 9 aa, Homo Sapiens
YKSLTSGIV

SEQ ID NO: 291820 - protein, 9 aa, Homo Sapiens
NFFVCSTGC

SEQ ID NO: 291821 - protein, 9 aa, Homo Sapiens
VLVCSKDIS

SEQ ID NO: 291822 - protein, 9 aa, Homo Sapiens
TDKQPRKDY

SEQ ID NO: 291823 - protein, 9 aa, Homo Sapiens
FNCKTKDLK

SEQ ID NO: 291824 - protein, 9 aa, Homo Sapiens
SYKTLADQM

SEQ ID NO: 291825 - protein, 9 aa, Homo Sapiens
TMADNEAGK

SEQ ID NO: 291826 - protein, 9 aa, Homo Sapiens
QQPPPQKVQ

SEQ ID NO: 291827 - protein, 9 aa, Homo Sapiens
YVIQVTATD

SEQ ID NO: 291828 - protein, 9 aa, Homo Sapiens
KETNKQFDK

SEQ ID NO: 291829 - protein, 9 aa, Homo Sapiens
PVDGAWMEW

SEQ ID NO: 291830 - protein, 9 aa, Homo Sapiens
RCYHKVTKL

SEQ ID NO: 291831 - protein, 9 aa, Homo Sapiens
KNCMASELD

SEQ ID NO: 291832 - protein, 9 aa, Homo Sapiens
LSSKMLSQQ

SEQ ID NO: 291833 - protein, 9 aa, Homo Sapiens
VKISRMEER

SEQ ID NO: 291834 - protein, 9 aa, Homo Sapiens
HLCDSNIIH

SEQ ID NO: 291835 - protein, 9 aa, Homo Sapiens
GRSCPGNAE

SEQ ID NO: 291836 - protein, 9 aa, Homo Sapiens
NSRLLEELE

SEQ ID NO: 291837 - protein, 9 aa, Homo Sapiens
LIYVMLEIL

SEQ ID NO: 291838 - protein, 9 aa, Homo Sapiens
VQSSSGSSV

SEQ ID NO: 291839 - protein, 9 aa, Homo Sapiens
GDQAHKEQG

SEQ ID NO: 291840 - protein, 9 aa, Homo Sapiens
NPNITDVFG

SEQ ID NO: 291841 - protein, 9 aa, Homo Sapiens
KLSLPGYIM

SEQ ID NO: 291842 - protein, 9 aa, Homo Sapiens
PTKTYLSYL

SEQ ID NO: 291843 - protein, 9 aa, Homo Sapiens
SVYDKEFPQ

SEQ ID NO: 291844 - protein, 9 aa, Homo Sapiens
MHTGERPHT

SEQ ID NO: 291845 - protein, 9 aa, Homo Sapiens
GVLGDSCIL

SEQ ID NO: 291846 - protein, 9 aa, Homo Sapiens
TSWGCFDAM

SEQ ID NO: 291847 - protein, 9 aa, Homo Sapiens
ESSKALWSW

SEQ ID NO: 291848 - protein, 9 aa, Homo Sapiens
YKEPLGNIY

SEQ ID NO: 291849 - protein, 9 aa, Homo Sapiens
EKKPECGSR

SEQ ID NO: 291850 - protein, 9 aa, Homo Sapiens
GCKKVMDVH

SEQ ID NO: 291851 - protein, 9 aa, Homo Sapiens
FQNEDRWAW

SEQ ID NO: 291852 - protein, 9 aa, Homo Sapiens
ELMVRLSRA

SEQ ID NO: 291853 - protein, 9 aa, Homo Sapiens
RAVDDKQLR

SEQ ID NO: 291854 - protein, 9 aa, Homo Sapiens
IREKTYAHF

SEQ ID NO: 291855 - protein, 9 aa, Homo Sapiens
LGAPGILGI

SEQ ID NO: 291856 - protein, 9 aa, Homo Sapiens
PGFPFLDND

SEQ ID NO: 291857 - protein, 9 aa, Homo Sapiens
EYDDLVECL

SEQ ID NO: 291858 - protein, 9 aa, Homo Sapiens
YTPQNFIDN

SEQ ID NO: 291859 - protein, 9 aa, Homo Sapiens
PHLANHQRI

SEQ ID NO: 291860 - protein, 9 aa, Homo Sapiens
DNLLLYEKL

SEQ ID NO: 291861 - protein, 9 aa, Homo Sapiens
QHIHQKSLS

SEQ ID NO: 291862 - protein, 9 aa, Homo Sapiens
VNYEQVKEY

SEQ ID NO: 291863 - protein, 9 aa, Homo Sapiens
YLRQLFRII

SEQ ID NO: 291864 - protein, 9 aa, Homo Sapiens
PLYGVITAL

SEQ ID NO: 291865 - protein, 9 aa, Homo Sapiens
QDAIFRLEM

SEQ ID NO: 291866 - protein, 9 aa, Homo Sapiens
FAIILKLMA

SEQ ID NO: 291867 - protein, 9 aa, Homo Sapiens
QPDFLQKKL

SEQ ID NO: 291868 - protein, 9 aa, Homo Sapiens
GAGATFKCN

SEQ ID NO: 291869 - protein, 9 aa, Homo Sapiens
LLTQLGPQP

SEQ ID NO: 291870 - protein, 9 aa, Homo Sapiens
IIGKNKPAA

SEQ ID NO: 291871 - protein, 9 aa, Homo Sapiens
LPRAVDDKQ

SEQ ID NO: 291872 - protein, 9 aa, Homo Sapiens
TMPVAILVY

SEQ ID NO: 291873 - protein, 9 aa, Homo Sapiens
MSDLLFLST

SEQ ID NO: 291874 - protein, 9 aa, Homo Sapiens
TPDLILQVP

SEQ ID NO: 291875 - protein, 9 aa, Homo Sapiens
FPLSSHQPA

SEQ ID NO: 291876 - protein, 9 aa, Homo Sapiens
AICYYSENE

SEQ ID NO: 291877 - protein, 9 aa, Homo Sapiens
LNLKITFLE

SEQ ID NO: 291878 - protein, 9 aa, Homo Sapiens
VARRYPEAT

SEQ ID NO: 291879 - protein, 9 aa, Homo Sapiens
RNYNDTFTV

SEQ ID NO: 291880 - protein, 9 aa, Homo Sapiens
SFVTGYAIS

SEQ ID NO: 291881 - protein, 9 aa, Homo Sapiens
EEEELNFEV

SEQ ID NO: 291882 - protein, 9 aa, Homo Sapiens
ARRSPQKLP

SEQ ID NO: 291883 - protein, 9 aa, Homo Sapiens
PTNDIEAYD

SEQ ID NO: 291884 - protein, 9 aa, Homo Sapiens
LNHILYSLR

SEQ ID NO: 291885 - protein, 9 aa, Homo Sapiens
STTTNANAI

SEQ ID NO: 291886 - protein, 9 aa, Homo Sapiens
QFLRCYNKK

SEQ ID NO: 291887 - protein, 9 aa, Homo Sapiens
LLASDSNSF

SEQ ID NO: 291888 - protein, 9 aa, Homo Sapiens
NFKEGHKIL

SEQ ID NO: 291889 - protein, 9 aa, Homo Sapiens
NKLVILELR

SEQ ID NO: 291890 - protein, 9 aa, Homo Sapiens
LPNFGKMLD

SEQ ID NO: 291891 - protein, 9 aa, Homo Sapiens
VILQEKEHQ

SEQ ID NO: 291892 - protein, 9 aa, Homo Sapiens
KSKYDSLDS

SEQ ID NO: 291893 - protein, 9 aa, Homo Sapiens
VEVILEVNI

SEQ ID NO: 291894 - protein, 9 aa, Homo Sapiens
LNQNHRDAS

SEQ ID NO: 291895 - protein, 9 aa, Homo Sapiens
MLTNVNWTL

SEQ ID NO: 291896 - protein, 9 aa, Homo Sapiens
NHLKEKTGK

SEQ ID NO: 291897 - protein, 9 aa, Homo Sapiens
PSLNKLQKL

SEQ ID NO: 291898 - protein, 9 aa, Homo Sapiens
ALLLVFFTV

SEQ ID NO: 291899 - protein, 9 aa, Homo Sapiens
ASRQEDTYV

SEQ ID NO: 291900 - protein, 9 aa, Homo Sapiens
RNLEQDNQN

SEQ ID NO: 291901 - protein, 9 aa, Homo Sapiens
IEVYGHNIN

SEQ ID NO: 291902 - protein, 9 aa, Homo Sapiens
LFGFYRGLM

SEQ ID NO: 291903 - protein, 9 aa, Homo Sapiens
TIHLLGKEL

SEQ ID NO: 291904 - protein, 9 aa, Homo Sapiens
FIADHYMFL

SEQ ID NO: 291905 - protein, 9 aa, Homo Sapiens
SKFLLLAVM

SEQ ID NO: 291906 - protein, 9 aa, Homo Sapiens
GKDLSLVLP

SEQ ID NO: 291907 - protein, 9 aa, Homo Sapiens
CGSPVIGCG

SEQ ID NO: 291908 - protein, 9 aa, Homo Sapiens
RDKNKYNTP

SEQ ID NO: 291909 - protein, 9 aa, Homo Sapiens
KALKTIKLM

SEQ ID NO: 291910 - protein, 9 aa, Homo Sapiens
KADMETLVR

SEQ ID NO: 291911 - protein, 9 aa, Homo Sapiens
PTSGLSGDN

SEQ ID NO: 291912 - protein, 9 aa, Homo Sapiens
LIPSVENFY

SEQ ID NO: 291913 - protein, 9 aa, Homo Sapiens
NNVLESYYN

SEQ ID NO: 291914 - protein, 9 aa, Homo Sapiens
VSLRRMHSL

SEQ ID NO: 291915 - protein, 9 aa, Homo Sapiens
SIPEGVRLS

SEQ ID NO: 291916 - protein, 9 aa, Homo Sapiens
AYSETFILP

SEQ ID NO: 291917 - protein, 9 aa, Homo Sapiens
KYTVKAEIP

SEQ ID NO: 291918 - protein, 9 aa, Homo Sapiens
DGTSYQRLF

SEQ ID NO: 291919 - protein, 9 aa, Homo Sapiens
ANGFSVVQS

SEQ ID NO: 291920 - protein, 9 aa, Homo Sapiens
NQTFVRKFI

SEQ ID NO: 291921 - protein, 9 aa, Homo Sapiens
NVIHNIFSK

SEQ ID NO: 291922 - protein, 9 aa, Homo Sapiens
DLFLVVSIN

SEQ ID NO: 291923 - protein, 9 aa, Homo Sapiens
ALCVRQSGH

SEQ ID NO: 291924 - protein, 9 aa, Homo Sapiens
PLDKASTYL

SEQ ID NO: 291925 - protein, 9 aa, Homo Sapiens
QATEEEKST

SEQ ID NO: 291926 - protein, 9 aa, Homo Sapiens
WTVVHAGTR

SEQ ID NO: 291927 - protein, 9 aa, Homo Sapiens
DTKYKSLVT

SEQ ID NO: 291928 - protein, 9 aa, Homo Sapiens
VAFYANMYA

SEQ ID NO: 291929 - protein, 9 aa, Homo Sapiens
ITGKRKIQE

SEQ ID NO: 291930 - protein, 9 aa, Homo Sapiens
AHGFTQQPL

SEQ ID NO: 291931 - protein, 9 aa, Homo Sapiens
DNEFLGHRI

SEQ ID NO: 291932 - protein, 9 aa, Homo Sapiens
EGHYPKPAH

SEQ ID NO: 291933 - protein, 9 aa, Homo Sapiens
MNKKELITV

SEQ ID NO: 291934 - protein, 9 aa, Homo Sapiens
FNISLAKDY

SEQ ID NO: 291935 - protein, 9 aa, Homo Sapiens
ENIPKYVEF

SEQ ID NO: 291936 - protein, 9 aa, Homo Sapiens
ETLEEGHFR

SEQ ID NO: 291937 - protein, 9 aa, Homo Sapiens
DGPSGPPEP

SEQ ID NO: 291938 - protein, 9 aa, Homo Sapiens
VHKQLYLFY

SEQ ID NO: 291939 - protein, 9 aa, Homo Sapiens
FSLAFIIWS

SEQ ID NO: 291940 - protein, 9 aa, Homo Sapiens
LMSWLQSSS

SEQ ID NO: 291941 - protein, 9 aa, Homo Sapiens
KLTVTISVD

SEQ ID NO: 291942 - protein, 9 aa, Homo Sapiens
CVSIYLIDL

SEQ ID NO: 291943 - protein, 9 aa, Homo Sapiens
EAKERVNAS

SEQ ID NO: 291944 - protein, 9 aa, Homo Sapiens
YDEMKDVIG

SEQ ID NO: 291945 - protein, 9 aa, Homo Sapiens
DYVKLKVEG

SEQ ID NO: 291946 - protein, 9 aa, Homo Sapiens
PLSCPECNL

SEQ ID NO: 291947 - protein, 9 aa, Homo Sapiens
ETPLDDETV

SEQ ID NO: 291948 - protein, 9 aa, Homo Sapiens
RLPSLNKLQ

SEQ ID NO: 291949 - protein, 9 aa, Homo Sapiens
EIGHQRQTT

SEQ ID NO: 291950 - protein, 9 aa, Homo Sapiens
AWQASLEGA

SEQ ID NO: 291951 - protein, 9 aa, Homo Sapiens
TFKFMKGHK

SEQ ID NO: 291952 - protein, 9 aa, Homo Sapiens
GANPNITDV

SEQ ID NO: 291953 - protein, 9 aa, Homo Sapiens
SFQSHMIMH

SEQ ID NO: 291954 - protein, 9 aa, Homo Sapiens
CDQILWKGK

SEQ ID NO: 291955 - protein, 9 aa, Homo Sapiens
HGQVGKDLS

SEQ ID NO: 291956 - protein, 9 aa, Homo Sapiens
RRYRPTKTY

SEQ ID NO: 291957 - protein, 9 aa, Homo Sapiens
NCLANTVDL

SEQ ID NO: 291958 - protein, 9 aa, Homo Sapiens
HDKNAKKTT

SEQ ID NO: 291959 - protein, 9 aa, Homo Sapiens
IPTYNIRRI

SEQ ID NO: 291960 - protein, 9 aa, Homo Sapiens
ISQRIMPVR

SEQ ID NO: 291961 - protein, 9 aa, Homo Sapiens
YPGIPPEWL

SEQ ID NO: 291962 - protein, 9 aa, Homo Sapiens
LAFFNSLVD

SEQ ID NO: 291963 - protein, 9 aa, Homo Sapiens
KLCLSCLLP

SEQ ID NO: 291964 - protein, 9 aa, Homo Sapiens
LENEFQMEE

SEQ ID NO: 291965 - protein, 9 aa, Homo Sapiens
NHSPFSSKS

SEQ ID NO: 291966 - protein, 9 aa, Homo Sapiens
RLSNNECLC

SEQ ID NO: 291967 - protein, 9 aa, Homo Sapiens
ENKRQESSC

SEQ ID NO: 291968 - protein, 9 aa, Homo Sapiens
VTLHVNEPP

SEQ ID NO: 291969 - protein, 9 aa, Homo Sapiens
DILIIGSKV

SEQ ID NO: 291970 - protein, 9 aa, Homo Sapiens
DESWALKTI

SEQ ID NO: 291971 - protein, 9 aa, Homo Sapiens
QNNAAVFRV

SEQ ID NO: 291972 - protein, 9 aa, Homo Sapiens
KEKGMGKQG

SEQ ID NO: 291973 - protein, 9 aa, Homo Sapiens
PGDKGEAGE

SEQ ID NO: 291974 - protein, 9 aa, Homo Sapiens
FIPYCSMVH

SEQ ID NO: 291975 - protein, 9 aa, Homo Sapiens
PINHYQNIF

SEQ ID NO: 291976 - protein, 9 aa, Homo Sapiens
CMRTNSRDP

SEQ ID NO: 291977 - protein, 9 aa, Homo Sapiens
QEQSLVVRK

SEQ ID NO: 291978 - protein, 9 aa, Homo Sapiens
CFSEGGKVN

SEQ ID NO: 291979 - protein, 9 aa, Homo Sapiens
KDRDEHMKS

SEQ ID NO: 291980 - protein, 9 aa, Homo Sapiens
IFGDLSYRS

SEQ ID NO: 291981 - protein, 9 aa, Homo Sapiens
NKHSRLLLL

SEQ ID NO: 291982 - protein, 9 aa, Homo Sapiens
TNGLHQVLN

SEQ ID NO: 291983 - protein, 9 aa, Homo Sapiens
VISEGDGNR

SEQ ID NO: 291984 - protein, 9 aa, Homo Sapiens
KGRPFVIQP

SEQ ID NO: 291985 - protein, 9 aa, Homo Sapiens
ENYLPKPKL

SEQ ID NO: 291986 - protein, 9 aa, Homo Sapiens
LGDLEGLTP

SEQ ID NO: 291987 - protein, 9 aa, Homo Sapiens
GGVAGEAAF

SEQ ID NO: 291988 - protein, 9 aa, Homo Sapiens
DTVKDKSAS

SEQ ID NO: 291989 - protein, 9 aa, Homo Sapiens
GPTQKLLLK

SEQ ID NO: 291990 - protein, 9 aa, Homo Sapiens
NKQNLILQN

SEQ ID NO: 291991 - protein, 9 aa, Homo Sapiens
VIEPQFQRY

SEQ ID NO: 291992 - protein, 9 aa, Homo Sapiens
VGRPLLCCR

SEQ ID NO: 291993 - protein, 9 aa, Homo Sapiens
AAQRQKVVE

SEQ ID NO: 291994 - protein, 9 aa, Homo Sapiens
WWFLSWFNH

SEQ ID NO: 291995 - protein, 9 aa, Homo Sapiens
ITTLTGLDV

SEQ ID NO: 291996 - protein, 9 aa, Homo Sapiens
DKEINSPNV

SEQ ID NO: 291997 - protein, 9 aa, Homo Sapiens
RVKVLYVRT

SEQ ID NO: 291998 - protein, 9 aa, Homo Sapiens
WYWQKENIP

SEQ ID NO: 291999 - protein, 9 aa, Homo Sapiens
YYLKNQIGD

SEQ ID NO: 292000 - protein, 9 aa, Homo Sapiens
VVFLKALYG

SEQ ID NO: 292001 - protein, 9 aa, Homo Sapiens
EDKLHIMKD

SEQ ID NO: 292002 - protein, 9 aa, Homo Sapiens
FQLYLNPEL

SEQ ID NO: 292003 - protein, 9 aa, Homo Sapiens
QDGIIGVVG

SEQ ID NO: 292004 - protein, 9 aa, Homo Sapiens
KGYKEQKLR

SEQ ID NO: 292005 - protein, 9 aa, Homo Sapiens
EAAVPKIRP

SEQ ID NO: 292006 - protein, 9 aa, Homo Sapiens
NTGGVLGDS

SEQ ID NO: 292007 - protein, 9 aa, Homo Sapiens
NKKMKKYLE

SEQ ID NO: 292008 - protein, 9 aa, Homo Sapiens
KSYMTFLKK

SEQ ID NO: 292009 - protein, 9 aa, Homo Sapiens
DILMQHIET

SEQ ID NO: 292010 - protein, 9 aa, Homo Sapiens
RNYLSGLRR

SEQ ID NO: 292011 - protein, 9 aa, Homo Sapiens
RDVSHQPET

SEQ ID NO: 292012 - protein, 9 aa, Homo Sapiens
GSIQIEEAT

SEQ ID NO: 292013 - protein, 9 aa, Homo Sapiens
QGVLAPDKV

SEQ ID NO: 292014 - protein, 9 aa, Homo Sapiens
YTRYRAGKQ

SEQ ID NO: 292015 - protein, 9 aa, Homo Sapiens
NPLRYQIIM

SEQ ID NO: 292016 - protein, 9 aa, Homo Sapiens
QAAPGIIWK

SEQ ID NO: 292017 - protein, 9 aa, Homo Sapiens
TELLSNHFS

SEQ ID NO: 292018 - protein, 9 aa, Homo Sapiens
LSPSSHSFL

SEQ ID NO: 292019 - protein, 9 aa, Homo Sapiens
ENLLNILTE

SEQ ID NO: 292020 - protein, 9 aa, Homo Sapiens
ILSYSYIIT

SEQ ID NO: 292021 - protein, 9 aa, Homo Sapiens
CFIFKPDVI

SEQ ID NO: 292022 - protein, 9 aa, Homo Sapiens
GLPGKKGHR

SEQ ID NO: 292023 - protein, 9 aa, Homo Sapiens
KITRENISE

SEQ ID NO: 292024 - protein, 9 aa, Homo Sapiens
SSKMLSQQE

SEQ ID NO: 292025 - protein, 9 aa, Homo Sapiens
HHSKHLKTH

SEQ ID NO: 292026 - protein, 9 aa, Homo Sapiens
IIHQEEKAY

SEQ ID NO: 292027 - protein, 9 aa, Homo Sapiens
TINGKLEES

SEQ ID NO: 292028 - protein, 9 aa, Homo Sapiens
ESESSQLIY

SEQ ID NO: 292029 - protein, 9 aa, Homo Sapiens
TTLYWGGKA

SEQ ID NO: 292030 - protein, 9 aa, Homo Sapiens
RTKTYECNK

SEQ ID NO: 292031 - protein, 9 aa, Homo Sapiens
ERLQNQEKR

SEQ ID NO: 292032 - protein, 9 aa, Homo Sapiens
QEDILMQHI

SEQ ID NO: 292033 - protein, 9 aa, Homo Sapiens
VADVYISIH

SEQ ID NO: 292034 - protein, 9 aa, Homo Sapiens
SPTDNTFAT

SEQ ID NO: 292035 - protein, 9 aa, Homo Sapiens
HPQRITCTC

SEQ ID NO: 292036 - protein, 9 aa, Homo Sapiens
HRIIHNGEK

SEQ ID NO: 292037 - protein, 9 aa, Homo Sapiens
SHLPIVTLF

SEQ ID NO: 292038 - protein, 9 aa, Homo Sapiens
TVELAQTCI

SEQ ID NO: 292039 - protein, 9 aa, Homo Sapiens
DRVRIFRAD

SEQ ID NO: 292040 - protein, 9 aa, Homo Sapiens
VNNPEDNNS

SEQ ID NO: 292041 - protein, 9 aa, Homo Sapiens
IDYILYSKT

SEQ ID NO: 292042 - protein, 9 aa, Homo Sapiens
CKPLHYKII

SEQ ID NO: 292043 - protein, 9 aa, Homo Sapiens
ESCMSGADS

SEQ ID NO: 292044 - protein, 9 aa, Homo Sapiens
AHLQQYSQE

SEQ ID NO: 292045 - protein, 9 aa, Homo Sapiens
KWTKLTLDY

SEQ ID NO: 292046 - protein, 9 aa, Homo Sapiens
EKLDNSPGH

SEQ ID NO: 292047 - protein, 9 aa, Homo Sapiens
VKRGHYGVK

SEQ ID NO: 292048 - protein, 9 aa, Homo Sapiens
KNLNNSQMC

SEQ ID NO: 292049 - protein, 9 aa, Homo Sapiens
AWKFICDVS

SEQ ID NO: 292050 - protein, 9 aa, Homo Sapiens
QRLSVFGEI

SEQ ID NO: 292051 - protein, 9 aa, Homo Sapiens
LINDKQFAK

SEQ ID NO: 292052 - protein, 9 aa, Homo Sapiens
NFYSISAAL

SEQ ID NO: 292053 - protein, 9 aa, Homo Sapiens
GLLWHHRDE

SEQ ID NO: 292054 - protein, 9 aa, Homo Sapiens
LTNIPEEVC

SEQ ID NO: 292055 - protein, 9 aa, Homo Sapiens
LRGFRVDRV

SEQ ID NO: 292056 - protein, 9 aa, Homo Sapiens
PYQPKFWCQ

SEQ ID NO: 292057 - protein, 9 aa, Homo Sapiens
GDQYTNGLY

SEQ ID NO: 292058 - protein, 9 aa, Homo Sapiens
INEALKELG

SEQ ID NO: 292059 - protein, 9 aa, Homo Sapiens
KEDLTDELS

SEQ ID NO: 292060 - protein, 9 aa, Homo Sapiens
KILKRHLSS

SEQ ID NO: 292061 - protein, 9 aa, Homo Sapiens
VRYSESFCN

SEQ ID NO: 292062 - protein, 9 aa, Homo Sapiens
IQMVTALVS

SEQ ID NO: 292063 - protein, 9 aa, Homo Sapiens
DAHEKDDVH

SEQ ID NO: 292064 - protein, 9 aa, Homo Sapiens
HDQKNKYVF

SEQ ID NO: 292065 - protein, 9 aa, Homo Sapiens
NCVHLLKIK

SEQ ID NO: 292066 - protein, 9 aa, Homo Sapiens
RDLDIGTDG

SEQ ID NO: 292067 - protein, 9 aa, Homo Sapiens
DESSFLTLD

SEQ ID NO: 292068 - protein, 9 aa, Homo Sapiens
QQEEDGLEF

SEQ ID NO: 292069 - protein, 9 aa, Homo Sapiens
LNTRSSQNG

SEQ ID NO: 292070 - protein, 9 aa, Homo Sapiens
FWGRDVLDL

SEQ ID NO: 292071 - protein, 9 aa, Homo Sapiens
HVIIHAAEK

SEQ ID NO: 292072 - protein, 9 aa, Homo Sapiens
TMTMTEKVE

SEQ ID NO: 292073 - protein, 9 aa, Homo Sapiens
KTDFDETSL

SEQ ID NO: 292074 - protein, 9 aa, Homo Sapiens
KMKGIKARW

SEQ ID NO: 292075 - protein, 9 aa, Homo Sapiens
KDITAKEEQ

SEQ ID NO: 292076 - protein, 9 aa, Homo Sapiens
LSNHFSTLV

SEQ ID NO: 292077 - protein, 9 aa, Homo Sapiens
LMAHKAVLA

SEQ ID NO: 292078 - protein, 9 aa, Homo Sapiens
LNKNIRNAQ

SEQ ID NO: 292079 - protein, 9 aa, Homo Sapiens
NTKYEFAVQ

SEQ ID NO: 292080 - protein, 9 aa, Homo Sapiens
PQIPDSTHA

SEQ ID NO: 292081 - protein, 9 aa, Homo Sapiens
ITGFYRHSG

SEQ ID NO: 292082 - protein, 9 aa, Homo Sapiens
TIPNNLVGC

SEQ ID NO: 292083 - protein, 9 aa, Homo Sapiens
DIPWRRKQM

SEQ ID NO: 292084 - protein, 9 aa, Homo Sapiens
IVHLVGIIR

SEQ ID NO: 292085 - protein, 9 aa, Homo Sapiens
IKSAGYKVI

SEQ ID NO: 292086 - protein, 9 aa, Homo Sapiens
NVTTCWRDG

SEQ ID NO: 292087 - protein, 9 aa, Homo Sapiens
ILTMLTGHS

SEQ ID NO: 292088 - protein, 9 aa, Homo Sapiens
GCFLQLYFF

SEQ ID NO: 292089 - protein, 9 aa, Homo Sapiens
EKWENYKVV

SEQ ID NO: 292090 - protein, 9 aa, Homo Sapiens
NIINKLRAK

SEQ ID NO: 292091 - protein, 9 aa, Homo Sapiens
VFSFIDPLA

SEQ ID NO: 292092 - protein, 9 aa, Homo Sapiens
GLIKVTLHM

SEQ ID NO: 292093 - protein, 9 aa, Homo Sapiens
KVFAESKEI

SEQ ID NO: 292094 - protein, 9 aa, Homo Sapiens
FFKTHGIRN

SEQ ID NO: 292095 - protein, 9 aa, Homo Sapiens
LQGTNEYVP

SEQ ID NO: 292096 - protein, 9 aa, Homo Sapiens
YVAHMVLNK

SEQ ID NO: 292097 - protein, 9 aa, Homo Sapiens
VIWWAPNVQ

SEQ ID NO: 292098 - protein, 9 aa, Homo Sapiens
ESFLLDLFM

SEQ ID NO: 292099 - protein, 9 aa, Homo Sapiens
EDYPVVKQM

SEQ ID NO: 292100 - protein, 9 aa, Homo Sapiens
SHHSSFQSH

SEQ ID NO: 292101 - protein, 9 aa, Homo Sapiens
LQNILHQTE

SEQ ID NO: 292102 - protein, 9 aa, Homo Sapiens
QIGLLLNKS

SEQ ID NO: 292103 - protein, 9 aa, Homo Sapiens
ILSTVLKIT

SEQ ID NO: 292104 - protein, 9 aa, Homo Sapiens
DVPRKAKIK

SEQ ID NO: 292105 - protein, 9 aa, Homo Sapiens
STSASQVAE

SEQ ID NO: 292106 - protein, 9 aa, Homo Sapiens
QKSLRRTLK

SEQ ID NO: 292107 - protein, 9 aa, Homo Sapiens
LLDRTVVAF

SEQ ID NO: 292108 - protein, 9 aa, Homo Sapiens
GDSLHQQEI

SEQ ID NO: 292109 - protein, 9 aa, Homo Sapiens
PYGLQVNYD

SEQ ID NO: 292110 - protein, 9 aa, Homo Sapiens
PAFQNCMQE

SEQ ID NO: 292111 - protein, 9 aa, Homo Sapiens
YDKTPDLIL

SEQ ID NO: 292112 - protein, 9 aa, Homo Sapiens
LHPVLGEYS

SEQ ID NO: 292113 - protein, 9 aa, Homo Sapiens
AHQIIHTED

SEQ ID NO: 292114 - protein, 9 aa, Homo Sapiens
HEEPAFQNC

SEQ ID NO: 292115 - protein, 9 aa, Homo Sapiens
VSLSQPPED

SEQ ID NO: 292116 - protein, 9 aa, Homo Sapiens
MTDDPQSFK

SEQ ID NO: 292117 - protein, 9 aa, Homo Sapiens
GKYRKYFHH

SEQ ID NO: 292118 - protein, 9 aa, Homo Sapiens
KPEIYQDTM

SEQ ID NO: 292119 - protein, 9 aa, Homo Sapiens
RAALCVRQS

SEQ ID NO: 292120 - protein, 9 aa, Homo Sapiens
QNTHTGDKP

SEQ ID NO: 292121 - protein, 9 aa, Homo Sapiens
SEKFMSLQE

SEQ ID NO: 292122 - protein, 9 aa, Homo Sapiens
QLWALPALP

SEQ ID NO: 292123 - protein, 9 aa, Homo Sapiens
TVNNSRSTK

SEQ ID NO: 292124 - protein, 9 aa, Homo Sapiens
NSKVKIYPY

SEQ ID NO: 292125 - protein, 9 aa, Homo Sapiens
HVHQRPTVA

SEQ ID NO: 292126 - protein, 9 aa, Homo Sapiens
CTLNKNIRN

SEQ ID NO: 292127 - protein, 9 aa, Homo Sapiens
RTKASPYTR

SEQ ID NO: 292128 - protein, 9 aa, Homo Sapiens
GKAFNRSYH

SEQ ID NO: 292129 - protein, 9 aa, Homo Sapiens
IECGQAFVQ

SEQ ID NO: 292130 - protein, 9 aa, Homo Sapiens
LGVQLCGTT

SEQ ID NO: 292131 - protein, 9 aa, Homo Sapiens
EMNHRSSMQ

SEQ ID NO: 292132 - protein, 9 aa, Homo Sapiens
YSPFTTEAE

SEQ ID NO: 292133 - protein, 9 aa, Homo Sapiens
SEKMQYASE

SEQ ID NO: 292134 - protein, 9 aa, Homo Sapiens
TIIENNFKE

SEQ ID NO: 292135 - protein, 9 aa, Homo Sapiens
ALCIRDKYM

SEQ ID NO: 292136 - protein, 9 aa, Homo Sapiens
YLAKKQDVD

SEQ ID NO: 292137 - protein, 9 aa, Homo Sapiens
LHQTVTSPQ

SEQ ID NO: 292138 - protein, 9 aa, Homo Sapiens
QIITSTGQP

SEQ ID NO: 292139 - protein, 9 aa, Homo Sapiens
VCRAGKAKS

SEQ ID NO: 292140 - protein, 9 aa, Homo Sapiens
LFLVPYNDL

SEQ ID NO: 292141 - protein, 9 aa, Homo Sapiens
MCSAQDRTA

SEQ ID NO: 292142 - protein, 9 aa, Homo Sapiens
NRISKKKTH

SEQ ID NO: 292143 - protein, 9 aa, Homo Sapiens
FLKHGKMHT

SEQ ID NO: 292144 - protein, 9 aa, Homo Sapiens
PSKIDGRAL

SEQ ID NO: 292145 - protein, 9 aa, Homo Sapiens
YKLDRHKNP

SEQ ID NO: 292146 - protein, 9 aa, Homo Sapiens
PTYLHSRQL

SEQ ID NO: 292147 - protein, 9 aa, Homo Sapiens
TYNIRRIIC

SEQ ID NO: 292148 - protein, 9 aa, Homo Sapiens
RNKKWNLEI

SEQ ID NO: 292149 - protein, 9 aa, Homo Sapiens
PLVAQMPVY

SEQ ID NO: 292150 - protein, 9 aa, Homo Sapiens
LARISAQGL

SEQ ID NO: 292151 - protein, 9 aa, Homo Sapiens
LAGLPGKKG

SEQ ID NO: 292152 - protein, 9 aa, Homo Sapiens
AQDFLQCLA

SEQ ID NO: 292153 - protein, 9 aa, Homo Sapiens
VMLESYRNL

SEQ ID NO: 292154 - protein, 9 aa, Homo Sapiens
THKLTQPQL

SEQ ID NO: 292155 - protein, 9 aa, Homo Sapiens
RMSIKYDPD

SEQ ID NO: 292156 - protein, 9 aa, Homo Sapiens
QKINTFARN

SEQ ID NO: 292157 - protein, 9 aa, Homo Sapiens
ELNNLLAFS

SEQ ID NO: 292158 - protein, 9 aa, Homo Sapiens
AHQEVNLEF

SEQ ID NO: 292159 - protein, 9 aa, Homo Sapiens
LGFIHEVQV

SEQ ID NO: 292160 - protein, 9 aa, Homo Sapiens
SVEQLQKIC

SEQ ID NO: 292161 - protein, 9 aa, Homo Sapiens
NPPILSLPL

SEQ ID NO: 292162 - protein, 9 aa, Homo Sapiens
TTKTGDNRK

SEQ ID NO: 292163 - protein, 9 aa, Homo Sapiens
DLSTVGHKN

SEQ ID NO: 292164 - protein, 9 aa, Homo Sapiens
AGETINDAV

SEQ ID NO: 292165 - protein, 9 aa, Homo Sapiens
IWVFIFKLL

SEQ ID NO: 292166 - protein, 9 aa, Homo Sapiens
KKPKIIPPG

SEQ ID NO: 292167 - protein, 9 aa, Homo Sapiens
TCTPKKIRK

SEQ ID NO: 292168 - protein, 9 aa, Homo Sapiens
QLFLSQTAQ

SEQ ID NO: 292169 - protein, 9 aa, Homo Sapiens
VNRMFQKEQ

SEQ ID NO: 292170 - protein, 9 aa, Homo Sapiens
FASTSRFAR

SEQ ID NO: 292171 - protein, 9 aa, Homo Sapiens
AVELRRNSR

SEQ ID NO: 292172 - protein, 9 aa, Homo Sapiens
CCRTPVSPG

SEQ ID NO: 292173 - protein, 9 aa, Homo Sapiens
QLYKCHPDI

SEQ ID NO: 292174 - protein, 9 aa, Homo Sapiens
GADDKKEEF

SEQ ID NO: 292175 - protein, 9 aa, Homo Sapiens
EINIFLQQL

SEQ ID NO: 292176 - protein, 9 aa, Homo Sapiens
ELTIPNNLV

SEQ ID NO: 292177 - protein, 9 aa, Homo Sapiens
HKEINTEDK

SEQ ID NO: 292178 - protein, 9 aa, Homo Sapiens
LLSPSAVEL

SEQ ID NO: 292179 - protein, 9 aa, Homo Sapiens
NFDNSYQNT

SEQ ID NO: 292180 - protein, 9 aa, Homo Sapiens
PAFQTFLKR

SEQ ID NO: 292181 - protein, 9 aa, Homo Sapiens
SIVIRVTEE

SEQ ID NO: 292182 - protein, 9 aa, Homo Sapiens
KRQESSCSH

SEQ ID NO: 292183 - protein, 9 aa, Homo Sapiens
KICDLIAIE

SEQ ID NO: 292184 - protein, 9 aa, Homo Sapiens
SGGQIITST

SEQ ID NO: 292185 - protein, 9 aa, Homo Sapiens
SRKGGNDSS

SEQ ID NO: 292186 - protein, 9 aa, Homo Sapiens
QDKQTKKAE

SEQ ID NO: 292187 - protein, 9 aa, Homo Sapiens
VMQQQRQQF

SEQ ID NO: 292188 - protein, 9 aa, Homo Sapiens
KKIKPPSKM

SEQ ID NO: 292189 - protein, 9 aa, Homo Sapiens
RCEDLARLI

SEQ ID NO: 292190 - protein, 9 aa, Homo Sapiens
KPLHYKIIL

SEQ ID NO: 292191 - protein, 9 aa, Homo Sapiens
TKDRQVEDD

SEQ ID NO: 292192 - protein, 9 aa, Homo Sapiens
PGSCRHEKK

SEQ ID NO: 292193 - protein, 9 aa, Homo Sapiens
DKSQSLCEP

SEQ ID NO: 292194 - protein, 9 aa, Homo Sapiens
FPISHIHYW

SEQ ID NO: 292195 - protein, 9 aa, Homo Sapiens
TQKLLLKRN

SEQ ID NO: 292196 - protein, 9 aa, Homo Sapiens
DSNVKFFYV

SEQ ID NO: 292197 - protein, 9 aa, Homo Sapiens
HCIGPSCDR

SEQ ID NO: 292198 - protein, 9 aa, Homo Sapiens
TILYGTLIF

SEQ ID NO: 292199 - protein, 9 aa, Homo Sapiens
RPSWGLLGA

SEQ ID NO: 292200 - protein, 9 aa, Homo Sapiens
EDGTGGQPH

SEQ ID NO: 292201 - protein, 9 aa, Homo Sapiens
YAQNLINDK

SEQ ID NO: 292202 - protein, 9 aa, Homo Sapiens
WAVLSEYVK

SEQ ID NO: 292203 - protein, 9 aa, Homo Sapiens
KELLNNFSE

SEQ ID NO: 292204 - protein, 9 aa, Homo Sapiens
GRQLFSSVS

SEQ ID NO: 292205 - protein, 9 aa, Homo Sapiens
ETIGVLSPS

SEQ ID NO: 292206 - protein, 9 aa, Homo Sapiens
AKERVNAST

SEQ ID NO: 292207 - protein, 9 aa, Homo Sapiens
RADTTATAD

SEQ ID NO: 292208 - protein, 9 aa, Homo Sapiens
WMFDCWKNN

SEQ ID NO: 292209 - protein, 9 aa, Homo Sapiens
IQHKITHTS

SEQ ID NO: 292210 - protein, 9 aa, Homo Sapiens
QEKEQRKAN

SEQ ID NO: 292211 - protein, 9 aa, Homo Sapiens
DTSRPYKCS

SEQ ID NO: 292212 - protein, 9 aa, Homo Sapiens
DDGEFMETK

SEQ ID NO: 292213 - protein, 9 aa, Homo Sapiens
KFYSAPVPP

SEQ ID NO: 292214 - protein, 9 aa, Homo Sapiens
HQQCETFIP

SEQ ID NO: 292215 - protein, 9 aa, Homo Sapiens
EPLGNIYFY

SEQ ID NO: 292216 - protein, 9 aa, Homo Sapiens
KLLIQLSNE

SEQ ID NO: 292217 - protein, 9 aa, Homo Sapiens
ILRGFRVDR

SEQ ID NO: 292218 - protein, 9 aa, Homo Sapiens
MFEDMDKMF

SEQ ID NO: 292219 - protein, 9 aa, Homo Sapiens
QPCVCSSLL

SEQ ID NO: 292220 - protein, 9 aa, Homo Sapiens
SELHNYQRI

SEQ ID NO: 292221 - protein, 9 aa, Homo Sapiens
FVEGVRMEK

SEQ ID NO: 292222 - protein, 9 aa, Homo Sapiens
RINISQCDL

SEQ ID NO: 292223 - protein, 9 aa, Homo Sapiens
QWVIYLQGS

SEQ ID NO: 292224 - protein, 9 aa, Homo Sapiens
IGTDGEISY

SEQ ID NO: 292225 - protein, 9 aa, Homo Sapiens
ERSFQDLKL

SEQ ID NO: 292226 - protein, 9 aa, Homo Sapiens
CLVSGLVLS

SEQ ID NO: 292227 - protein, 9 aa, Homo Sapiens
SEQLQKDIK

SEQ ID NO: 292228 - protein, 9 aa, Homo Sapiens
QEALFGKEL

SEQ ID NO: 292229 - protein, 9 aa, Homo Sapiens
ITQNVLQKL

SEQ ID NO: 292230 - protein, 9 aa, Homo Sapiens
ICNPLRYQI

SEQ ID NO: 292231 - protein, 9 aa, Homo Sapiens
HLQKNQLWA

SEQ ID NO: 292232 - protein, 9 aa, Homo Sapiens
DEVTQLAKE

SEQ ID NO: 292233 - protein, 9 aa, Homo Sapiens
NESQGKNRE

SEQ ID NO: 292234 - protein, 9 aa, Homo Sapiens
SKKLSLFVR

SEQ ID NO: 292235 - protein, 9 aa, Homo Sapiens
TPEICKYKK

SEQ ID NO: 292236 - protein, 9 aa, Homo Sapiens
HFLCDISPL

SEQ ID NO: 292237 - protein, 9 aa, Homo Sapiens
HVRGMQDKL

SEQ ID NO: 292238 - protein, 9 aa, Homo Sapiens
NSFCGQLQV

SEQ ID NO: 292239 - protein, 9 aa, Homo Sapiens
LRKHREVCK

SEQ ID NO: 292240 - protein, 9 aa, Homo Sapiens
YANVVCRQL

SEQ ID NO: 292241 - protein, 9 aa, Homo Sapiens
ILAAHQPAC

SEQ ID NO: 292242 - protein, 9 aa, Homo Sapiens
EGIWWTVLF

SEQ ID NO: 292243 - protein, 9 aa, Homo Sapiens
EVVGIAHKL

SEQ ID NO: 292244 - protein, 9 aa, Homo Sapiens
EDIIAENLS

SEQ ID NO: 292245 - protein, 9 aa, Homo Sapiens
VLELNNLTV

SEQ ID NO: 292246 - protein, 9 aa, Homo Sapiens
NGMMDHEDF

SEQ ID NO: 292247 - protein, 9 aa, Homo Sapiens
YEVAKMIRE

SEQ ID NO: 292248 - protein, 9 aa, Homo Sapiens
FSLEVSSRL

SEQ ID NO: 292249 - protein, 9 aa, Homo Sapiens
LNKSVAQIG

SEQ ID NO: 292250 - protein, 9 aa, Homo Sapiens
VIKEAFAST

SEQ ID NO: 292251 - protein, 9 aa, Homo Sapiens
LLFTEHFHF

SEQ ID NO: 292252 - protein, 9 aa, Homo Sapiens
EYTDLQKMM

SEQ ID NO: 292253 - protein, 9 aa, Homo Sapiens
YRTGQLFSL

SEQ ID NO: 292254 - protein, 9 aa, Homo Sapiens
ERVISVLLN

SEQ ID NO: 292255 - protein, 9 aa, Homo Sapiens
TGSCYCGKI

SEQ ID NO: 292256 - protein, 9 aa, Homo Sapiens
RIQVWFSNQ

SEQ ID NO: 292257 - protein, 9 aa, Homo Sapiens
FTLSSTLNT

SEQ ID NO: 292258 - protein, 9 aa, Homo Sapiens
PHTCKICGK

SEQ ID NO: 292259 - protein, 9 aa, Homo Sapiens
LKLEAKKAA

SEQ ID NO: 292260 - protein, 9 aa, Homo Sapiens
TVGHKNKEP

SEQ ID NO: 292261 - protein, 9 aa, Homo Sapiens
GKKSLGTTQ

SEQ ID NO: 292262 - protein, 9 aa, Homo Sapiens
PQQTQTLEE

SEQ ID NO: 292263 - protein, 9 aa, Homo Sapiens
GGAGATFKC

SEQ ID NO: 292264 - protein, 9 aa, Homo Sapiens
NDQSSSSTS

SEQ ID NO: 292265 - protein, 9 aa, Homo Sapiens
VALQKKQQL

SEQ ID NO: 292266 - protein, 9 aa, Homo Sapiens
GACLFHNMV

SEQ ID NO: 292267 - protein, 9 aa, Homo Sapiens
SNFFVCSTG

SEQ ID NO: 292268 - protein, 9 aa, Homo Sapiens
TAPLQMYNP

SEQ ID NO: 292269 - protein, 9 aa, Homo Sapiens
EEVNSNKGV

SEQ ID NO: 292270 - protein, 9 aa, Homo Sapiens
LAQILPTKE

SEQ ID NO: 292271 - protein, 9 aa, Homo Sapiens
CVNSEEIMR

SEQ ID NO: 292272 - protein, 9 aa, Homo Sapiens
LEAKERVNA

SEQ ID NO: 292273 - protein, 9 aa, Homo Sapiens
ANIKYPGQI

SEQ ID NO: 292274 - protein, 9 aa, Homo Sapiens
KCLQEAKIL

SEQ ID NO: 292275 - protein, 9 aa, Homo Sapiens
GQAGSPGDK

SEQ ID NO: 292276 - protein, 9 aa, Homo Sapiens
CPDKQDVRD

SEQ ID NO: 292277 - protein, 9 aa, Homo Sapiens
DECGKDFTQ

SEQ ID NO: 292278 - protein, 9 aa, Homo Sapiens
RKPFFHSVL

SEQ ID NO: 292279 - protein, 9 aa, Homo Sapiens
PLEDYVFSD

SEQ ID NO: 292280 - protein, 9 aa, Homo Sapiens
EFLRYTINA

SEQ ID NO: 292281 - protein, 9 aa, Homo Sapiens
ALLRYHTNT

SEQ ID NO: 292282 - protein, 9 aa, Homo Sapiens
PFNQNDEQF

SEQ ID NO: 292283 - protein, 9 aa, Homo Sapiens
NLRWYKQYT

SEQ ID NO: 292284 - protein, 9 aa, Homo Sapiens
PLVACAKVV

SEQ ID NO: 292285 - protein, 9 aa, Homo Sapiens
TYDKAEIDI

SEQ ID NO: 292286 - protein, 9 aa, Homo Sapiens
IPNILDLCV

SEQ ID NO: 292287 - protein, 9 aa, Homo Sapiens
DGLLWHHRD

SEQ ID NO: 292288 - protein, 9 aa, Homo Sapiens
DADSSYFEI

SEQ ID NO: 292289 - protein, 9 aa, Homo Sapiens
SSYLIQHKI

SEQ ID NO: 292290 - protein, 9 aa, Homo Sapiens
CNKCEKIFK

SEQ ID NO: 292291 - protein, 9 aa, Homo Sapiens
WRFCIEKWG

SEQ ID NO: 292292 - protein, 9 aa, Homo Sapiens
DMLIIRTNR

SEQ ID NO: 292293 - protein, 9 aa, Homo Sapiens
AKWEKEKHE

SEQ ID NO: 292294 - protein, 9 aa, Homo Sapiens
EVKSQNGEL

SEQ ID NO: 292295 - protein, 9 aa, Homo Sapiens
ILCLIEQID

SEQ ID NO: 292296 - protein, 9 aa, Homo Sapiens
ENNQRLQKL

SEQ ID NO: 292297 - protein, 9 aa, Homo Sapiens
AGPQECAKG

SEQ ID NO: 292298 - protein, 9 aa, Homo Sapiens
TLSQPKIGK

SEQ ID NO: 292299 - protein, 9 aa, Homo Sapiens
EFTNWSIIN

SEQ ID NO: 292300 - protein, 9 aa, Homo Sapiens
NYRFLHDNI

SEQ ID NO: 292301 - protein, 9 aa, Homo Sapiens
LEGLTPQKV

SEQ ID NO: 292302 - protein, 9 aa, Homo Sapiens
ASVVDLKNN

SEQ ID NO: 292303 - protein, 9 aa, Homo Sapiens
EDSELYEND

SEQ ID NO: 292304 - protein, 9 aa, Homo Sapiens
QQLHSRTIV

SEQ ID NO: 292305 - protein, 9 aa, Homo Sapiens
SRQEDTYVH

SEQ ID NO: 292306 - protein, 9 aa, Homo Sapiens
TVYPANLLS

SEQ ID NO: 292307 - protein, 9 aa, Homo Sapiens
TPFPFDKPR

SEQ ID NO: 292308 - protein, 9 aa, Homo Sapiens
YVESDDETP

SEQ ID NO: 292309 - protein, 9 aa, Homo Sapiens
FLHPHCKIA

SEQ ID NO: 292310 - protein, 9 aa, Homo Sapiens
IVIILAIIQ

SEQ ID NO: 292311 - protein, 9 aa, Homo Sapiens
TRVENCYSS

SEQ ID NO: 292312 - protein, 9 aa, Homo Sapiens
HRSSMQVLG

SEQ ID NO: 292313 - protein, 9 aa, Homo Sapiens
LPFLLIPSV

SEQ ID NO: 292314 - protein, 9 aa, Homo Sapiens
ENKYLKDIT

SEQ ID NO: 292315 - protein, 9 aa, Homo Sapiens
EEPVHFHPI

SEQ ID NO: 292316 - protein, 9 aa, Homo Sapiens
EYKNRARSQ

SEQ ID NO: 292317 - protein, 9 aa, Homo Sapiens
VYHLHPSGR

SEQ ID NO: 292318 - protein, 9 aa, Homo Sapiens
AAHQPACKI

SEQ ID NO: 292319 - protein, 9 aa, Homo Sapiens
LRYHTNTGF

SEQ ID NO: 292320 - protein, 9 aa, Homo Sapiens
DGIIGVVGG

SEQ ID NO: 292321 - protein, 9 aa, Homo Sapiens
KAQEDPLPV

SEQ ID NO: 292322 - protein, 9 aa, Homo Sapiens
YRNVMLESY

SEQ ID NO: 292323 - protein, 9 aa, Homo Sapiens
IKQIISHSN

SEQ ID NO: 292324 - protein, 9 aa, Homo Sapiens
FQQPQRHLT

SEQ ID NO: 292325 - protein, 9 aa, Homo Sapiens
GSQSSHGGG

SEQ ID NO: 292326 - protein, 9 aa, Homo Sapiens
KSFINSTLT

SEQ ID NO: 292327 - protein, 9 aa, Homo Sapiens
SFSNYLQKY

SEQ ID NO: 292328 - protein, 9 aa, Homo Sapiens
PGMTYCENT

SEQ ID NO: 292329 - protein, 9 aa, Homo Sapiens
SCESNYPFP

SEQ ID NO: 292330 - protein, 9 aa, Homo Sapiens
GVIDLSAAH

SEQ ID NO: 292331 - protein, 9 aa, Homo Sapiens
AWTHRLRDR

SEQ ID NO: 292332 - protein, 9 aa, Homo Sapiens
GVLSPSSHS

SEQ ID NO: 292333 - protein, 9 aa, Homo Sapiens
HLDVKPDNL

SEQ ID NO: 292334 - protein, 9 aa, Homo Sapiens
LKNIFYIVN

SEQ ID NO: 292335 - protein, 9 aa, Homo Sapiens
LFNPHQHTD

SEQ ID NO: 292336 - protein, 9 aa, Homo Sapiens
SAKTGYNMK

SEQ ID NO: 292337 - protein, 9 aa, Homo Sapiens
TIMIVYFIF

SEQ ID NO: 292338 - protein, 9 aa, Homo Sapiens
SNICSYADH

SEQ ID NO: 292339 - protein, 9 aa, Homo Sapiens
AQTAQVQKD

SEQ ID NO: 292340 - protein, 9 aa, Homo Sapiens
YFHLWKADN

SEQ ID NO: 292341 - protein, 9 aa, Homo Sapiens
FEITIGLLV

SEQ ID NO: 292342 - protein, 9 aa, Homo Sapiens
VFAPEKERE

SEQ ID NO: 292343 - protein, 9 aa, Homo Sapiens
EGKLTGPKF

SEQ ID NO: 292344 - protein, 9 aa, Homo Sapiens
FLQRMGQLC

SEQ ID NO: 292345 - protein, 9 aa, Homo Sapiens
ILDAQHESG

SEQ ID NO: 292346 - protein, 9 aa, Homo Sapiens
YGVKRTELL

SEQ ID NO: 292347 - protein, 9 aa, Homo Sapiens
NLNLVLIWR

SEQ ID NO: 292348 - protein, 9 aa, Homo Sapiens
NWAEGSLYQ

SEQ ID NO: 292349 - protein, 9 aa, Homo Sapiens
KHKHKKFRQ

SEQ ID NO: 292350 - protein, 9 aa, Homo Sapiens
LCDNEFLGH

SEQ ID NO: 292351 - protein, 9 aa, Homo Sapiens
PNIYSFNST

SEQ ID NO: 292352 - protein, 9 aa, Homo Sapiens
IPWRRKQML

SEQ ID NO: 292353 - protein, 9 aa, Homo Sapiens
HPTSWPKLI

SEQ ID NO: 292354 - protein, 9 aa, Homo Sapiens
DVHHLSVVP

SEQ ID NO: 292355 - protein, 9 aa, Homo Sapiens
HRKDEKRKG

SEQ ID NO: 292356 - protein, 9 aa, Homo Sapiens
LGSLGKSTP

SEQ ID NO: 292357 - protein, 9 aa, Homo Sapiens
TEKMLTNVN

SEQ ID NO: 292358 - protein, 9 aa, Homo Sapiens
NISILIKVV

SEQ ID NO: 292359 - protein, 9 aa, Homo Sapiens
HGCFVCGME

SEQ ID NO: 292360 - protein, 9 aa, Homo Sapiens
ESNYPFPVH

SEQ ID NO: 292361 - protein, 9 aa, Homo Sapiens
GWNGVSDVV

SEQ ID NO: 292362 - protein, 9 aa, Homo Sapiens
AYCRVTAPH

SEQ ID NO: 292363 - protein, 9 aa, Homo Sapiens
INSCYPKEI

SEQ ID NO: 292364 - protein, 9 aa, Homo Sapiens
AKSANKVKT

SEQ ID NO: 292365 - protein, 9 aa, Homo Sapiens
ASGCPLAVK

SEQ ID NO: 292366 - protein, 9 aa, Homo Sapiens
PLNFIPRHF

SEQ ID NO: 292367 - protein, 9 aa, Homo Sapiens
STSPLVACA

SEQ ID NO: 292368 - protein, 9 aa, Homo Sapiens
WKKVYLKAL

SEQ ID NO: 292369 - protein, 9 aa, Homo Sapiens
SQNGSLKTW

SEQ ID NO: 292370 - protein, 9 aa, Homo Sapiens
RQQKRVQTM

SEQ ID NO: 292371 - protein, 9 aa, Homo Sapiens
SFIDPLAYE

SEQ ID NO: 292372 - protein, 9 aa, Homo Sapiens
MGQLKRNEC

SEQ ID NO: 292373 - protein, 9 aa, Homo Sapiens
VTIIQMDLH

SEQ ID NO: 292374 - protein, 9 aa, Homo Sapiens
WNLWRSQLE

SEQ ID NO: 292375 - protein, 9 aa, Homo Sapiens
VDESSFLTL

SEQ ID NO: 292376 - protein, 9 aa, Homo Sapiens
MLLQNILHQ

SEQ ID NO: 292377 - protein, 9 aa, Homo Sapiens
VSQFSVKGY

SEQ ID NO: 292378 - protein, 9 aa, Homo Sapiens
IQLSDSEAQ

SEQ ID NO: 292379 - protein, 9 aa, Homo Sapiens
LGYNVNTSV

SEQ ID NO: 292380 - protein, 9 aa, Homo Sapiens
RVLSQWRVF

SEQ ID NO: 292381 - protein, 9 aa, Homo Sapiens
SRANILVTV

SEQ ID NO: 292382 - protein, 9 aa, Homo Sapiens
QGRQKSLSI

SEQ ID NO: 292383 - protein, 9 aa, Homo Sapiens
WVYLKVIKF

SEQ ID NO: 292384 - protein, 9 aa, Homo Sapiens
PRPGKFEKI

SEQ ID NO: 292385 - protein, 9 aa, Homo Sapiens
RALLLLSYI

SEQ ID NO: 292386 - protein, 9 aa, Homo Sapiens
DISLRPLLV

SEQ ID NO: 292387 - protein, 9 aa, Homo Sapiens
TDNTFATCS

SEQ ID NO: 292388 - protein, 9 aa, Homo Sapiens
LMFLTQKYR

SEQ ID NO: 292389 - protein, 9 aa, Homo Sapiens
TCLSQDSST

SEQ ID NO: 292390 - protein, 9 aa, Homo Sapiens
LIKKCLSSV

SEQ ID NO: 292391 - protein, 9 aa, Homo Sapiens
EWMKIFNPP

SEQ ID NO: 292392 - protein, 9 aa, Homo Sapiens
QYKAAKETK

SEQ ID NO: 292393 - protein, 9 aa, Homo Sapiens
QIILWDPST

SEQ ID NO: 292394 - protein, 9 aa, Homo Sapiens
LFCPSNKWC

SEQ ID NO: 292395 - protein, 9 aa, Homo Sapiens
KINPDYTYT

SEQ ID NO: 292396 - protein, 9 aa, Homo Sapiens
WHIFYLQHH

SEQ ID NO: 292397 - protein, 9 aa, Homo Sapiens
NHYISDTFW

SEQ ID NO: 292398 - protein, 9 aa, Homo Sapiens
SQNGELMTH

SEQ ID NO: 292399 - protein, 9 aa, Homo Sapiens
YFILVSFTW

SEQ ID NO: 292400 - protein, 9 aa, Homo Sapiens
ETDLIFLTL

SEQ ID NO: 292401 - protein, 9 aa, Homo Sapiens
YVPCLILLL

SEQ ID NO: 292402 - protein, 9 aa, Homo Sapiens
IRCQQEAEL

SEQ ID NO: 292403 - protein, 9 aa, Homo Sapiens
SPYTRCKGS

SEQ ID NO: 292404 - protein, 9 aa, Homo Sapiens
PESMRLDLN

SEQ ID NO: 292405 - protein, 9 aa, Homo Sapiens
WGHEKIHTG

SEQ ID NO: 292406 - protein, 9 aa, Homo Sapiens
ASSSTQIIV

SEQ ID NO: 292407 - protein, 9 aa, Homo Sapiens
TAEMYTLAA

SEQ ID NO: 292408 - protein, 9 aa, Homo Sapiens
KKDQNRDLE

SEQ ID NO: 292409 - protein, 9 aa, Homo Sapiens
GTHKLTQPQ

SEQ ID NO: 292410 - protein, 9 aa, Homo Sapiens
LTEHLRPSW

SEQ ID NO: 292411 - protein, 9 aa, Homo Sapiens
PGWQPNQKT

SEQ ID NO: 292412 - protein, 9 aa, Homo Sapiens
IQINTKGEV

SEQ ID NO: 292413 - protein, 9 aa, Homo Sapiens
VCLHEGKTP

SEQ ID NO: 292414 - protein, 9 aa, Homo Sapiens
WWMFDCWKN

SEQ ID NO: 292415 - protein, 9 aa, Homo Sapiens
ACAVPGGPV

SEQ ID NO: 292416 - protein, 9 aa, Homo Sapiens
ITFLSKLSE

SEQ ID NO: 292417 - protein, 9 aa, Homo Sapiens
KPNKKKKAQ

SEQ ID NO: 292418 - protein, 9 aa, Homo Sapiens
EKQIDDNRT

SEQ ID NO: 292419 - protein, 9 aa, Homo Sapiens
KRALQLFDR

SEQ ID NO: 292420 - protein, 9 aa, Homo Sapiens
RNLRRHMLE

SEQ ID NO: 292421 - protein, 9 aa, Homo Sapiens
KSQLTEHKK

SEQ ID NO: 292422 - protein, 9 aa, Homo Sapiens
EKEQRKANR

SEQ ID NO: 292423 - protein, 9 aa, Homo Sapiens
SFPHESTFD

SEQ ID NO: 292424 - protein, 9 aa, Homo Sapiens
PDLRSLNDM

SEQ ID NO: 292425 - protein, 9 aa, Homo Sapiens
TEEEKSTLE

SEQ ID NO: 292426 - protein, 9 aa, Homo Sapiens
LVGRPLLCC

SEQ ID NO: 292427 - protein, 9 aa, Homo Sapiens
KLSVNKTLV

SEQ ID NO: 292428 - protein, 9 aa, Homo Sapiens
QPARISLVA

SEQ ID NO: 292429 - protein, 9 aa, Homo Sapiens
ERGTHIMNS

SEQ ID NO: 292430 - protein, 9 aa, Homo Sapiens
SLSSTSVLI

SEQ ID NO: 292431 - protein, 9 aa, Homo Sapiens
LLLDALELC

SEQ ID NO: 292432 - protein, 9 aa, Homo Sapiens
NYPTALQSL

SEQ ID NO: 292433 - protein, 9 aa, Homo Sapiens
MLSQQESEA

SEQ ID NO: 292434 - protein, 9 aa, Homo Sapiens
HFHFYKRYT

SEQ ID NO: 292435 - protein, 9 aa, Homo Sapiens
VSVISFLEL

SEQ ID NO: 292436 - protein, 9 aa, Homo Sapiens
EKLYKIECD

SEQ ID NO: 292437 - protein, 9 aa, Homo Sapiens
DIRGDKITR

SEQ ID NO: 292438 - protein, 9 aa, Homo Sapiens
PEKKQGHQI

SEQ ID NO: 292439 - protein, 9 aa, Homo Sapiens
DSMFVHNNS

SEQ ID NO: 292440 - protein, 9 aa, Homo Sapiens
CYHEIMTPE

SEQ ID NO: 292441 - protein, 9 aa, Homo Sapiens
AKKADNSSN

SEQ ID NO: 292442 - protein, 9 aa, Homo Sapiens
PALRPHVHT

SEQ ID NO: 292443 - protein, 9 aa, Homo Sapiens
TYKNVNRTK

SEQ ID NO: 292444 - protein, 9 aa, Homo Sapiens
GNSSGVFRK

SEQ ID NO: 292445 - protein, 9 aa, Homo Sapiens
TGIWVFIFK

SEQ ID NO: 292446 - protein, 9 aa, Homo Sapiens
KKLQESIFD

SEQ ID NO: 292447 - protein, 9 aa, Homo Sapiens
HYSPASWPL

SEQ ID NO: 292448 - protein, 9 aa, Homo Sapiens
RKQLLVGQF

SEQ ID NO: 292449 - protein, 9 aa, Homo Sapiens
DSSDATTPA

SEQ ID NO: 292450 - protein, 9 aa, Homo Sapiens
ILAIIQGLI

SEQ ID NO: 292451 - protein, 9 aa, Homo Sapiens
RCAGFLHPW

SEQ ID NO: 292452 - protein, 9 aa, Homo Sapiens
AAPVSGPQL

SEQ ID NO: 292453 - protein, 9 aa, Homo Sapiens
ENLMEAIWG

SEQ ID NO: 292454 - protein, 9 aa, Homo Sapiens
LGGNYASYT

SEQ ID NO: 292455 - protein, 9 aa, Homo Sapiens
LVCVFLIML

SEQ ID NO: 292456 - protein, 9 aa, Homo Sapiens
EYCEGRDLN

SEQ ID NO: 292457 - protein, 9 aa, Homo Sapiens
TKENFLLCF

SEQ ID NO: 292458 - protein, 9 aa, Homo Sapiens
STHCDKIKA

SEQ ID NO: 292459 - protein, 9 aa, Homo Sapiens
QPSFTAAVR

SEQ ID NO: 292460 - protein, 9 aa, Homo Sapiens
SNGHKSLGL

SEQ ID NO: 292461 - protein, 9 aa, Homo Sapiens
SWGLGFFMA

SEQ ID NO: 292462 - protein, 9 aa, Homo Sapiens
VAVEIIAVL

SEQ ID NO: 292463 - protein, 9 aa, Homo Sapiens
KCLQDLSST

SEQ ID NO: 292464 - protein, 9 aa, Homo Sapiens
EQRKANRAE

SEQ ID NO: 292465 - protein, 9 aa, Homo Sapiens
FSICKEIMR

SEQ ID NO: 292466 - protein, 9 aa, Homo Sapiens
SISDSNELA

SEQ ID NO: 292467 - protein, 9 aa, Homo Sapiens
DAIFRLEMP

SEQ ID NO: 292468 - protein, 9 aa, Homo Sapiens
CKNYSLIIH

SEQ ID NO: 292469 - protein, 9 aa, Homo Sapiens
LVLELNNLT

SEQ ID NO: 292470 - protein, 9 aa, Homo Sapiens
FMRLFGGNC

SEQ ID NO: 292471 - protein, 9 aa, Homo Sapiens
LIKRGTAKL

SEQ ID NO: 292472 - protein, 9 aa, Homo Sapiens
ESVERQLQM

SEQ ID NO: 292473 - protein, 9 aa, Homo Sapiens
LYDLWAKTI

SEQ ID NO: 292474 - protein, 9 aa, Homo Sapiens
SESFLLDLF

SEQ ID NO: 292475 - protein, 9 aa, Homo Sapiens
VVIYKKVII

SEQ ID NO: 292476 - protein, 9 aa, Homo Sapiens
CGKAFSHHQ

SEQ ID NO: 292477 - protein, 9 aa, Homo Sapiens
LISLILIYE

SEQ ID NO: 292478 - protein, 9 aa, Homo Sapiens
LSSSSIKVH

SEQ ID NO: 292479 - protein, 9 aa, Homo Sapiens
VRQDDCMLL

SEQ ID NO: 292480 - protein, 9 aa, Homo Sapiens
NLRLILQQS

SEQ ID NO: 292481 - protein, 9 aa, Homo Sapiens
NKRLQTLQD

SEQ ID NO: 292482 - protein, 9 aa, Homo Sapiens
IYLQQLRAS

SEQ ID NO: 292483 - protein, 9 aa, Homo Sapiens
DKLYEEDDM

SEQ ID NO: 292484 - protein, 9 aa, Homo Sapiens
LLFNMCLID

SEQ ID NO: 292485 - protein, 9 aa, Homo Sapiens
IIIHTHKCT

SEQ ID NO: 292486 - protein, 9 aa, Homo Sapiens
VSYGLILST

SEQ ID NO: 292487 - protein, 9 aa, Homo Sapiens
AALRWQLLQ

SEQ ID NO: 292488 - protein, 9 aa, Homo Sapiens
YQLFAFVSH

SEQ ID NO: 292489 - protein, 9 aa, Homo Sapiens
IYQELNMEQ

SEQ ID NO: 292490 - protein, 9 aa, Homo Sapiens
YRFLHDNIV

SEQ ID NO: 292491 - protein, 9 aa, Homo Sapiens
GGVYSSGLS

SEQ ID NO: 292492 - protein, 9 aa, Homo Sapiens
IHILQKHGK

SEQ ID NO: 292493 - protein, 9 aa, Homo Sapiens
KKCLSSVEG

SEQ ID NO: 292494 - protein, 9 aa, Homo Sapiens
DKYDKSCDM

SEQ ID NO: 292495 - protein, 9 aa, Homo Sapiens
KEADDLFTS

SEQ ID NO: 292496 - protein, 9 aa, Homo Sapiens
APAWCDQIL

SEQ ID NO: 292497 - protein, 9 aa, Homo Sapiens
RIMECSAPL

SEQ ID NO: 292498 - protein, 9 aa, Homo Sapiens
KGAFKKIKP

SEQ ID NO: 292499 - protein, 9 aa, Homo Sapiens
LVRQEAHIS

SEQ ID NO: 292500 - protein, 9 aa, Homo Sapiens
SEKSIYNGF

SEQ ID NO: 292501 - protein, 9 aa, Homo Sapiens
FTLGNNRIS

SEQ ID NO: 292502 - protein, 9 aa, Homo Sapiens
ELYKFHNRT

SEQ ID NO: 292503 - protein, 9 aa, Homo Sapiens
SKLMEHKII

SEQ ID NO: 292504 - protein, 9 aa, Homo Sapiens
VSNTNSPTN

SEQ ID NO: 292505 - protein, 9 aa, Homo Sapiens
QNGELMTHK

SEQ ID NO: 292506 - protein, 9 aa, Homo Sapiens
FKQWHSIRE

SEQ ID NO: 292507 - protein, 9 aa, Homo Sapiens
ELCSSDSPQ

SEQ ID NO: 292508 - protein, 9 aa, Homo Sapiens
ALQSLVLAE

SEQ ID NO: 292509 - protein, 9 aa, Homo Sapiens
ENNRLWGPL

SEQ ID NO: 292510 - protein, 9 aa, Homo Sapiens
DVIKSIIKI

SEQ ID NO: 292511 - protein, 9 aa, Homo Sapiens
PWPLPLHPV

SEQ ID NO: 292512 - protein, 9 aa, Homo Sapiens
NKRQESSCS

SEQ ID NO: 292513 - protein, 9 aa, Homo Sapiens
QEDTLKAKY

SEQ ID NO: 292514 - protein, 9 aa, Homo Sapiens
EELFGDLNN

SEQ ID NO: 292515 - protein, 9 aa, Homo Sapiens
MVPNYFSPQ

SEQ ID NO: 292516 - protein, 9 aa, Homo Sapiens
PQTGWVYRN

SEQ ID NO: 292517 - protein, 9 aa, Homo Sapiens
HFLPFKKPS

SEQ ID NO: 292518 - protein, 9 aa, Homo Sapiens
LCDNYIYFI

SEQ ID NO: 292519 - protein, 9 aa, Homo Sapiens
NQAEVYVFL

SEQ ID NO: 292520 - protein, 9 aa, Homo Sapiens
STESETAVV

SEQ ID NO: 292521 - protein, 9 aa, Homo Sapiens
KALLRMKQL

SEQ ID NO: 292522 - protein, 9 aa, Homo Sapiens
TEIDPVCAL

SEQ ID NO: 292523 - protein, 9 aa, Homo Sapiens
GRINNTNVP

SEQ ID NO: 292524 - protein, 9 aa, Homo Sapiens
MCREFLSER

SEQ ID NO: 292525 - protein, 9 aa, Homo Sapiens
VPICCQCKL

SEQ ID NO: 292526 - protein, 9 aa, Homo Sapiens
FKQLSCLIL

SEQ ID NO: 292527 - protein, 9 aa, Homo Sapiens
SNPVMCPSA

SEQ ID NO: 292528 - protein, 9 aa, Homo Sapiens
LIQKEKPAI

SEQ ID NO: 292529 - protein, 9 aa, Homo Sapiens
LASFELIQK

SEQ ID NO: 292530 - protein, 9 aa, Homo Sapiens
SSILDLEKS

SEQ ID NO: 292531 - protein, 9 aa, Homo Sapiens
IVIRVTEES

SEQ ID NO: 292532 - protein, 9 aa, Homo Sapiens
EEKPNKKKK

SEQ ID NO: 292533 - protein, 9 aa, Homo Sapiens
RWYKQYTGR

SEQ ID NO: 292534 - protein, 9 aa, Homo Sapiens
IIYHILIKN

SEQ ID NO: 292535 - protein, 9 aa, Homo Sapiens
YRENLTQSF

SEQ ID NO: 292536 - protein, 9 aa, Homo Sapiens
NRRTSFPKY

SEQ ID NO: 292537 - protein, 9 aa, Homo Sapiens
ELQKQPLRK

SEQ ID NO: 292538 - protein, 9 aa, Homo Sapiens
NQYLTSTQS

SEQ ID NO: 292539 - protein, 9 aa, Homo Sapiens
GHYGVKRTE

SEQ ID NO: 292540 - protein, 9 aa, Homo Sapiens
DSDSLLKEA

SEQ ID NO: 292541 - protein, 9 aa, Homo Sapiens
AVITTTDDY

SEQ ID NO: 292542 - protein, 9 aa, Homo Sapiens
EFQMEEYLK

SEQ ID NO: 292543 - protein, 9 aa, Homo Sapiens
RGDPCQGNT

SEQ ID NO: 292544 - protein, 9 aa, Homo Sapiens
DTNYANVVC

SEQ ID NO: 292545 - protein, 9 aa, Homo Sapiens
EKRIKLHIW

SEQ ID NO: 292546 - protein, 9 aa, Homo Sapiens
PLGPDAPPD

SEQ ID NO: 292547 - protein, 9 aa, Homo Sapiens
SENETEKEV

SEQ ID NO: 292548 - protein, 9 aa, Homo Sapiens
HLMTLALSE

SEQ ID NO: 292549 - protein, 9 aa, Homo Sapiens
TSSSSDTTS

SEQ ID NO: 292550 - protein, 9 aa, Homo Sapiens
ATNSMNNNE

SEQ ID NO: 292551 - protein, 9 aa, Homo Sapiens
KKLPHEFPK

SEQ ID NO: 292552 - protein, 9 aa, Homo Sapiens
EVLVIPKIN

SEQ ID NO: 292553 - protein, 9 aa, Homo Sapiens
SERKSSELK

SEQ ID NO: 292554 - protein, 9 aa, Homo Sapiens
QKTYQKKSV

SEQ ID NO: 292555 - protein, 9 aa, Homo Sapiens
VPSVTLVDP

SEQ ID NO: 292556 - protein, 9 aa, Homo Sapiens
LINGRHNTL

SEQ ID NO: 292557 - protein, 9 aa, Homo Sapiens
QDNQNLRMQ

SEQ ID NO: 292558 - protein, 9 aa, Homo Sapiens
QTLPLEDYV

SEQ ID NO: 292559 - protein, 9 aa, Homo Sapiens
ENRKSGVFT

SEQ ID NO: 292560 - protein, 9 aa, Homo Sapiens
VSNKYSSED

SEQ ID NO: 292561 - protein, 9 aa, Homo Sapiens
LKYSVPEET

SEQ ID NO: 292562 - protein, 9 aa, Homo Sapiens
ITGSLKILR

SEQ ID NO: 292563 - protein, 9 aa, Homo Sapiens
RRVRSNPGG

SEQ ID NO: 292564 - protein, 9 aa, Homo Sapiens
CGSDGELYE

SEQ ID NO: 292565 - protein, 9 aa, Homo Sapiens
RCACDYCSL

SEQ ID NO: 292566 - protein, 9 aa, Homo Sapiens
CNECTKLII

SEQ ID NO: 292567 - protein, 9 aa, Homo Sapiens
DIIKDVEDC

SEQ ID NO: 292568 - protein, 9 aa, Homo Sapiens
QLQKICDLI

SEQ ID NO: 292569 - protein, 9 aa, Homo Sapiens
KVFAPEKER

SEQ ID NO: 292570 - protein, 9 aa, Homo Sapiens
LPNYATHLK

SEQ ID NO: 292571 - protein, 9 aa, Homo Sapiens
EWDHVRQQC

SEQ ID NO: 292572 - protein, 9 aa, Homo Sapiens
AKPRADTTA

SEQ ID NO: 292573 - protein, 9 aa, Homo Sapiens
RPIGDIPQI

SEQ ID NO: 292574 - protein, 9 aa, Homo Sapiens
QELLYPKDL

SEQ ID NO: 292575 - protein, 9 aa, Homo Sapiens
KYSVPEETE

SEQ ID NO: 292576 - protein, 9 aa, Homo Sapiens
IVHKQLYLF

SEQ ID NO: 292577 - protein, 9 aa, Homo Sapiens
LTSTQSKIF

SEQ ID NO: 292578 - protein, 9 aa, Homo Sapiens
LKDKIPHVR

SEQ ID NO: 292579 - protein, 9 aa, Homo Sapiens
MLPPLKTPL

SEQ ID NO: 292580 - protein, 9 aa, Homo Sapiens
NCVEPVGLN

SEQ ID NO: 292581 - protein, 9 aa, Homo Sapiens
KRNECTHLI

SEQ ID NO: 292582 - protein, 9 aa, Homo Sapiens
MWVSASNAD

SEQ ID NO: 292583 - protein, 9 aa, Homo Sapiens
TKSSSAAWD

SEQ ID NO: 292584 - protein, 9 aa, Homo Sapiens
TENTLGCRN

SEQ ID NO: 292585 - protein, 9 aa, Homo Sapiens
LSSFELFEE

SEQ ID NO: 292586 - protein, 9 aa, Homo Sapiens
GVTLECEDG

SEQ ID NO: 292587 - protein, 9 aa, Homo Sapiens
FMDPSFFQR

SEQ ID NO: 292588 - protein, 9 aa, Homo Sapiens
YTEKENLRS

SEQ ID NO: 292589 - protein, 9 aa, Homo Sapiens
FFLTPANNA

SEQ ID NO: 292590 - protein, 9 aa, Homo Sapiens
CLKTVAGLC

SEQ ID NO: 292591 - protein, 9 aa, Homo Sapiens
GTQEVSVQP

SEQ ID NO: 292592 - protein, 9 aa, Homo Sapiens
PSGGLSNSR

SEQ ID NO: 292593 - protein, 9 aa, Homo Sapiens
LKQRLSVFG

SEQ ID NO: 292594 - protein, 9 aa, Homo Sapiens
EEQVAESQK

SEQ ID NO: 292595 - protein, 9 aa, Homo Sapiens
RLPQLMDCD

SEQ ID NO: 292596 - protein, 9 aa, Homo Sapiens
YTYRRPLQT

SEQ ID NO: 292597 - protein, 9 aa, Homo Sapiens
KPDNLLVWD

SEQ ID NO: 292598 - protein, 9 aa, Homo Sapiens
SKAFLLQTA

SEQ ID NO: 292599 - protein, 9 aa, Homo Sapiens
KGPDMFCKL

SEQ ID NO: 292600 - protein, 9 aa, Homo Sapiens
IVATRVLEL

SEQ ID NO: 292601 - protein, 9 aa, Homo Sapiens
MRSQSESCL

SEQ ID NO: 292602 - protein, 9 aa, Homo Sapiens
SPHLYNSVN

SEQ ID NO: 292603 - protein, 9 aa, Homo Sapiens
APADSGRYW

SEQ ID NO: 292604 - protein, 9 aa, Homo Sapiens
NCDGPLKFI

SEQ ID NO: 292605 - protein, 9 aa, Homo Sapiens
TFFQKKETK

SEQ ID NO: 292606 - protein, 9 aa, Homo Sapiens
IATLLLANN

SEQ ID NO: 292607 - protein, 9 aa, Homo Sapiens
AITGITILR

SEQ ID NO: 292608 - protein, 9 aa, Homo Sapiens
SRVQMRGKR

SEQ ID NO: 292609 - protein, 9 aa, Homo Sapiens
RNRDLLSKN

SEQ ID NO: 292610 - protein, 9 aa, Homo Sapiens
QKEEERLQN

SEQ ID NO: 292611 - protein, 9 aa, Homo Sapiens
ADMAKSHRD

SEQ ID NO: 292612 - protein, 9 aa, Homo Sapiens
SVKKRSVWN

SEQ ID NO: 292613 - protein, 9 aa, Homo Sapiens
IKCLQEAKI

SEQ ID NO: 292614 - protein, 9 aa, Homo Sapiens
EDKMVQQLQ

SEQ ID NO: 292615 - protein, 9 aa, Homo Sapiens
KEEHQAYLT

SEQ ID NO: 292616 - protein, 9 aa, Homo Sapiens
VAQECLFHR

SEQ ID NO: 292617 - protein, 9 aa, Homo Sapiens
GGNSLNNRI

SEQ ID NO: 292618 - protein, 9 aa, Homo Sapiens
TQEILPLHV

SEQ ID NO: 292619 - protein, 9 aa, Homo Sapiens
IFDEWMKIF

SEQ ID NO: 292620 - protein, 9 aa, Homo Sapiens
ILSYRIFSN

SEQ ID NO: 292621 - protein, 9 aa, Homo Sapiens
EELYQKLGS

SEQ ID NO: 292622 - protein, 9 aa, Homo Sapiens
WLDKEVKDG

SEQ ID NO: 292623 - protein, 9 aa, Homo Sapiens
CLGKCRGQA

SEQ ID NO: 292624 - protein, 9 aa, Homo Sapiens
ETSLINTAI

SEQ ID NO: 292625 - protein, 9 aa, Homo Sapiens
FTQEILPLH

SEQ ID NO: 292626 - protein, 9 aa, Homo Sapiens
LIKKDGTEV

SEQ ID NO: 292627 - protein, 9 aa, Homo Sapiens
LKRLQKIRE

SEQ ID NO: 292628 - protein, 9 aa, Homo Sapiens
CYKGSCFHR

SEQ ID NO: 292629 - protein, 9 aa, Homo Sapiens
LSLDPGKRA

SEQ ID NO: 292630 - protein, 9 aa, Homo Sapiens
LINAEELVG

SEQ ID NO: 292631 - protein, 9 aa, Homo Sapiens
QAQQILEAK

SEQ ID NO: 292632 - protein, 9 aa, Homo Sapiens
SSDSPQWLP

SEQ ID NO: 292633 - protein, 9 aa, Homo Sapiens
CIQGSQRDR

SEQ ID NO: 292634 - protein, 9 aa, Homo Sapiens
GIRCENVTT

SEQ ID NO: 292635 - protein, 9 aa, Homo Sapiens
WLDHSKHGL

SEQ ID NO: 292636 - protein, 9 aa, Homo Sapiens
DTFTNTYQA

SEQ ID NO: 292637 - protein, 9 aa, Homo Sapiens
KEIDTINGK

SEQ ID NO: 292638 - protein, 9 aa, Homo Sapiens
ELHVNVEFQ

SEQ ID NO: 292639 - protein, 9 aa, Homo Sapiens
EVGCLVHLM

SEQ ID NO: 292640 - protein, 9 aa, Homo Sapiens
GLACEAVNR

SEQ ID NO: 292641 - protein, 9 aa, Homo Sapiens
IINSTEYPH

SEQ ID NO: 292642 - protein, 9 aa, Homo Sapiens
PVIKLYIIY

SEQ ID NO: 292643 - protein, 9 aa, Homo Sapiens
PHTVKKAIE

SEQ ID NO: 292644 - protein, 9 aa, Homo Sapiens
FRINISQCD

SEQ ID NO: 292645 - protein, 9 aa, Homo Sapiens
FQIKMYPVE

SEQ ID NO: 292646 - protein, 9 aa, Homo Sapiens
NIKEIAAKH

SEQ ID NO: 292647 - protein, 9 aa, Homo Sapiens
VPGGEDESI

SEQ ID NO: 292648 - protein, 9 aa, Homo Sapiens
IATLQSKEY

SEQ ID NO: 292649 - protein, 9 aa, Homo Sapiens
LLVCILKAH

SEQ ID NO: 292650 - protein, 9 aa, Homo Sapiens
STLTDNIKN

SEQ ID NO: 292651 - protein, 9 aa, Homo Sapiens
DLNNLNQLQ

SEQ ID NO: 292652 - protein, 9 aa, Homo Sapiens
IPQKGLWRF

SEQ ID NO: 292653 - protein, 9 aa, Homo Sapiens
RKVGDKIFG

SEQ ID NO: 292654 - protein, 9 aa, Homo Sapiens
PGYIMKIKP

SEQ ID NO: 292655 - protein, 9 aa, Homo Sapiens
IHQIIHTGE

SEQ ID NO: 292656 - protein, 9 aa, Homo Sapiens
NNLVAVDWE

SEQ ID NO: 292657 - protein, 9 aa, Homo Sapiens
NKDQSKTEG

SEQ ID NO: 292658 - protein, 9 aa, Homo Sapiens
RYHYLGGRC

SEQ ID NO: 292659 - protein, 9 aa, Homo Sapiens
LNKPLMKQA

SEQ ID NO: 292660 - protein, 9 aa, Homo Sapiens
KSRLDQKLE

SEQ ID NO: 292661 - protein, 9 aa, Homo Sapiens
IKSKDNKSP

SEQ ID NO: 292662 - protein, 9 aa, Homo Sapiens
NMYASILTM

SEQ ID NO: 292663 - protein, 9 aa, Homo Sapiens
GGITEEYLK

SEQ ID NO: 292664 - protein, 9 aa, Homo Sapiens
LSITGNITI

SEQ ID NO: 292665 - protein, 9 aa, Homo Sapiens
LWELDGRQL

SEQ ID NO: 292666 - protein, 9 aa, Homo Sapiens
EARVLLKRR

SEQ ID NO: 292667 - protein, 9 aa, Homo Sapiens
ELRHGHVRL

SEQ ID NO: 292668 - protein, 9 aa, Homo Sapiens
AQHWIIHTG

SEQ ID NO: 292669 - protein, 9 aa, Homo Sapiens
VSFGTKLNP

SEQ ID NO: 292670 - protein, 9 aa, Homo Sapiens
GLHLENCVS

SEQ ID NO: 292671 - protein, 9 aa, Homo Sapiens
SQLEDIIAE

SEQ ID NO: 292672 - protein, 9 aa, Homo Sapiens
VLSYTYQHG

SEQ ID NO: 292673 - protein, 9 aa, Homo Sapiens
VNKTSGPTR

SEQ ID NO: 292674 - protein, 9 aa, Homo Sapiens
ISDEEWEVL

SEQ ID NO: 292675 - protein, 9 aa, Homo Sapiens
ETFILPHLK

SEQ ID NO: 292676 - protein, 9 aa, Homo Sapiens
LSDLAQPDP

SEQ ID NO: 292677 - protein, 9 aa, Homo Sapiens
KAGSKKKSS

SEQ ID NO: 292678 - protein, 9 aa, Homo Sapiens
YMETTKTGD

SEQ ID NO: 292679 - protein, 9 aa, Homo Sapiens
NIETATSFK

SEQ ID NO: 292680 - protein, 9 aa, Homo Sapiens
KLSGEVHTA

SEQ ID NO: 292681 - protein, 9 aa, Homo Sapiens
HQISHSGDK

SEQ ID NO: 292682 - protein, 9 aa, Homo Sapiens
NSIALEILQ

SEQ ID NO: 292683 - protein, 9 aa, Homo Sapiens
IRGQPVIKL

SEQ ID NO: 292684 - protein, 9 aa, Homo Sapiens
GQVAQARFL

SEQ ID NO: 292685 - protein, 9 aa, Homo Sapiens
SEYFKSVSL

SEQ ID NO: 292686 - protein, 9 aa, Homo Sapiens
SGFRRIVHL

SEQ ID NO: 292687 - protein, 9 aa, Homo Sapiens
QSSDQDVAH

SEQ ID NO: 292688 - protein, 9 aa, Homo Sapiens
GAPGILGIP

SEQ ID NO: 292689 - protein, 9 aa, Homo Sapiens
TIKWNDVTL

SEQ ID NO: 292690 - protein, 9 aa, Homo Sapiens
KDIIYIINN

SEQ ID NO: 292691 - protein, 9 aa, Homo Sapiens
YEQVKEYCL

SEQ ID NO: 292692 - protein, 9 aa, Homo Sapiens
IVVFFVFVL

SEQ ID NO: 292693 - protein, 9 aa, Homo Sapiens
WVLRPLKTI

SEQ ID NO: 292694 - protein, 9 aa, Homo Sapiens
IYNIKSANF

SEQ ID NO: 292695 - protein, 9 aa, Homo Sapiens
ASTMYGSSP

SEQ ID NO: 292696 - protein, 9 aa, Homo Sapiens
PDDSDQTLR

SEQ ID NO: 292697 - protein, 9 aa, Homo Sapiens
STIIENNFK

SEQ ID NO: 292698 - protein, 9 aa, Homo Sapiens
KQTRTMAPE

SEQ ID NO: 292699 - protein, 9 aa, Homo Sapiens
SPDLLLDAL

SEQ ID NO: 292700 - protein, 9 aa, Homo Sapiens
SLHQQEIQV

SEQ ID NO: 292701 - protein, 9 aa, Homo Sapiens
KHSVKQTET

SEQ ID NO: 292702 - protein, 9 aa, Homo Sapiens
YKEKSSKKG

SEQ ID NO: 292703 - protein, 9 aa, Homo Sapiens
KPGRKRTKH

SEQ ID NO: 292704 - protein, 9 aa, Homo Sapiens
GLLLNKSLD

SEQ ID NO: 292705 - protein, 9 aa, Homo Sapiens
ATGLGAMLW

SEQ ID NO: 292706 - protein, 9 aa, Homo Sapiens
LYDICSMTL

SEQ ID NO: 292707 - protein, 9 aa, Homo Sapiens
RGLVSLCLM

SEQ ID NO: 292708 - protein, 9 aa, Homo Sapiens
SLVSTSNGV

SEQ ID NO: 292709 - protein, 9 aa, Homo Sapiens
RSHRMWRHH

SEQ ID NO: 292710 - protein, 9 aa, Homo Sapiens
IENNFKEGH

SEQ ID NO: 292711 - protein, 9 aa, Homo Sapiens
ETKFNKLFR

SEQ ID NO: 292712 - protein, 9 aa, Homo Sapiens
ITTTLYWGG

SEQ ID NO: 292713 - protein, 9 aa, Homo Sapiens
PEVLGPDKY

SEQ ID NO: 292714 - protein, 9 aa, Homo Sapiens
APPAWGQRR

SEQ ID NO: 292715 - protein, 9 aa, Homo Sapiens
RDREKEDKY

SEQ ID NO: 292716 - protein, 9 aa, Homo Sapiens
LSLGLKSGQ

SEQ ID NO: 292717 - protein, 9 aa, Homo Sapiens
PGSRKLRNL

SEQ ID NO: 292718 - protein, 9 aa, Homo Sapiens
PILYWFYNE

SEQ ID NO: 292719 - protein, 9 aa, Homo Sapiens
PYSAYAQAR

SEQ ID NO: 292720 - protein, 9 aa, Homo Sapiens
ADLNTTLYH

SEQ ID NO: 292721 - protein, 9 aa, Homo Sapiens
PRKAKIKTN

SEQ ID NO: 292722 - protein, 9 aa, Homo Sapiens
EDIKANVTD

SEQ ID NO: 292723 - protein, 9 aa, Homo Sapiens
YAQARMQQQ

SEQ ID NO: 292724 - protein, 9 aa, Homo Sapiens
NTNYRFLHD

SEQ ID NO: 292725 - protein, 9 aa, Homo Sapiens
TLENTKYLQ

SEQ ID NO: 292726 - protein, 9 aa, Homo Sapiens
LKILRCLLN

SEQ ID NO: 292727 - protein, 9 aa, Homo Sapiens
YRKYFHHNS

SEQ ID NO: 292728 - protein, 9 aa, Homo Sapiens
WGSSIKQLK

SEQ ID NO: 292729 - protein, 9 aa, Homo Sapiens
GLSQLPKQC

SEQ ID NO: 292730 - protein, 9 aa, Homo Sapiens
LQSGPRVPW

SEQ ID NO: 292731 - protein, 9 aa, Homo Sapiens
FRGLRGECE

SEQ ID NO: 292732 - protein, 9 aa, Homo Sapiens
VGRHSLKNK

SEQ ID NO: 292733 - protein, 9 aa, Homo Sapiens
YGKTFTLGN

SEQ ID NO: 292734 - protein, 9 aa, Homo Sapiens
IGDKEAIVT

SEQ ID NO: 292735 - protein, 9 aa, Homo Sapiens
LHVNEPPVI

SEQ ID NO: 292736 - protein, 9 aa, Homo Sapiens
TDVTAWRGD

SEQ ID NO: 292737 - protein, 9 aa, Homo Sapiens
TCFYLGELP

SEQ ID NO: 292738 - protein, 9 aa, Homo Sapiens
AADTCIMFD

SEQ ID NO: 292739 - protein, 9 aa, Homo Sapiens
QLDKVPEKR

SEQ ID NO: 292740 - protein, 9 aa, Homo Sapiens
SILWQTLQA

SEQ ID NO: 292741 - protein, 9 aa, Homo Sapiens
MLAVTILYG

SEQ ID NO: 292742 - protein, 9 aa, Homo Sapiens
HYAKNVIID

SEQ ID NO: 292743 - protein, 9 aa, Homo Sapiens
YNVSVEEFQ

SEQ ID NO: 292744 - protein, 9 aa, Homo Sapiens
CVGSSKKIA

SEQ ID NO: 292745 - protein, 9 aa, Homo Sapiens
LVNVSGKLF

SEQ ID NO: 292746 - protein, 9 aa, Homo Sapiens
RLFHLLMVL

SEQ ID NO: 292747 - protein, 9 aa, Homo Sapiens
ANTIDADIN

SEQ ID NO: 292748 - protein, 9 aa, Homo Sapiens
NQSSSRIIH

SEQ ID NO: 292749 - protein, 9 aa, Homo Sapiens
RANYLLQPE

SEQ ID NO: 292750 - protein, 9 aa, Homo Sapiens
IREHIWGYM

SEQ ID NO: 292751 - protein, 9 aa, Homo Sapiens
SPLITRFVY

SEQ ID NO: 292752 - protein, 9 aa, Homo Sapiens
PPKSPQTTV

SEQ ID NO: 292753 - protein, 9 aa, Homo Sapiens
LQKNQLWAL

SEQ ID NO: 292754 - protein, 9 aa, Homo Sapiens
TLLSVDYLV

SEQ ID NO: 292755 - protein, 9 aa, Homo Sapiens
LMPMYNFNP

SEQ ID NO: 292756 - protein, 9 aa, Homo Sapiens
FEDVTVADT

SEQ ID NO: 292757 - protein, 9 aa, Homo Sapiens
GKMLDNIFL

SEQ ID NO: 292758 - protein, 9 aa, Homo Sapiens
HRGRNLRRH

SEQ ID NO: 292759 - protein, 9 aa, Homo Sapiens
DSLWLRMHL

SEQ ID NO: 292760 - protein, 9 aa, Homo Sapiens
EQIIHQEEK

SEQ ID NO: 292761 - protein, 9 aa, Homo Sapiens
SQDFKNTAD

SEQ ID NO: 292762 - protein, 9 aa, Homo Sapiens
EEKLDKWAK

SEQ ID NO: 292763 - protein, 9 aa, Homo Sapiens
TASHNSPGS

SEQ ID NO: 292764 - protein, 9 aa, Homo Sapiens
GRPLLCCRT

SEQ ID NO: 292765 - protein, 9 aa, Homo Sapiens
TYYKENNVE

SEQ ID NO: 292766 - protein, 9 aa, Homo Sapiens
NKFVKTLKW

SEQ ID NO: 292767 - protein, 9 aa, Homo Sapiens
CPRSTNKIS

SEQ ID NO: 292768 - protein, 9 aa, Homo Sapiens
DEFIESCQE

SEQ ID NO: 292769 - protein, 9 aa, Homo Sapiens
DLMNAYLFK

SEQ ID NO: 292770 - protein, 9 aa, Homo Sapiens
ADDFLEYLP

SEQ ID NO: 292771 - protein, 9 aa, Homo Sapiens
EGADFALRV

SEQ ID NO: 292772 - protein, 9 aa, Homo Sapiens
SLRRMHSLS

SEQ ID NO: 292773 - protein, 9 aa, Homo Sapiens
ESPIEVPQS

SEQ ID NO: 292774 - protein, 9 aa, Homo Sapiens
FRANYLLQP

SEQ ID NO: 292775 - protein, 9 aa, Homo Sapiens
PPLKTPLFS

SEQ ID NO: 292776 - protein, 9 aa, Homo Sapiens
HLLGKELAD

SEQ ID NO: 292777 - protein, 9 aa, Homo Sapiens
TWKESVMER

SEQ ID NO: 292778 - protein, 9 aa, Homo Sapiens
DLSEHEKTN

SEQ ID NO: 292779 - protein, 9 aa, Homo Sapiens
YGNAVLILL

SEQ ID NO: 292780 - protein, 9 aa, Homo Sapiens
DVAHFFKGL

SEQ ID NO: 292781 - protein, 9 aa, Homo Sapiens
EFVCQIMYV

SEQ ID NO: 292782 - protein, 9 aa, Homo Sapiens
EFILVGYVD

SEQ ID NO: 292783 - protein, 9 aa, Homo Sapiens
VQCYIQIGS

SEQ ID NO: 292784 - protein, 9 aa, Homo Sapiens
PVLLEYPVL

SEQ ID NO: 292785 - protein, 9 aa, Homo Sapiens
HNYQRINHF

SEQ ID NO: 292786 - protein, 9 aa, Homo Sapiens
GQLAHRFTV

SEQ ID NO: 292787 - protein, 9 aa, Homo Sapiens
DQRCCLQEN

SEQ ID NO: 292788 - protein, 9 aa, Homo Sapiens
PKVFAPEKE

SEQ ID NO: 292789 - protein, 9 aa, Homo Sapiens
VHTGEKPFW

SEQ ID NO: 292790 - protein, 9 aa, Homo Sapiens
EYKTEDGEA

SEQ ID NO: 292791 - protein, 9 aa, Homo Sapiens
LLEGNECIS

SEQ ID NO: 292792 - protein, 9 aa, Homo Sapiens
ISHLYCDSL

SEQ ID NO: 292793 - protein, 9 aa, Homo Sapiens
MREEVYFFS

SEQ ID NO: 292794 - protein, 9 aa, Homo Sapiens
EWFWGRDVL

SEQ ID NO: 292795 - protein, 9 aa, Homo Sapiens
TCGEKGPDM

SEQ ID NO: 292796 - protein, 9 aa, Homo Sapiens
EYQQAKCRD

SEQ ID NO: 292797 - protein, 9 aa, Homo Sapiens
HSKTTAYSK

SEQ ID NO: 292798 - protein, 9 aa, Homo Sapiens
LLPYHLFSS

SEQ ID NO: 292799 - protein, 9 aa, Homo Sapiens
KTNYIFCNI

SEQ ID NO: 292800 - protein, 9 aa, Homo Sapiens
LKRNECTHL

SEQ ID NO: 292801 - protein, 9 aa, Homo Sapiens
KTSSSSSFC

SEQ ID NO: 292802 - protein, 9 aa, Homo Sapiens
LEEFKKVLG

SEQ ID NO: 292803 - protein, 9 aa, Homo Sapiens
TLDHLLHLM

SEQ ID NO: 292804 - protein, 9 aa, Homo Sapiens
TGLSAPLNF

SEQ ID NO: 292805 - protein, 9 aa, Homo Sapiens
LWESSKALW

SEQ ID NO: 292806 - protein, 9 aa, Homo Sapiens
ITVLPIGLC

SEQ ID NO: 292807 - protein, 9 aa, Homo Sapiens
LINRKLSSL

SEQ ID NO: 292808 - protein, 9 aa, Homo Sapiens
VDLAHLCLY

SEQ ID NO: 292809 - protein, 9 aa, Homo Sapiens
NILVGELEL

SEQ ID NO: 292810 - protein, 9 aa, Homo Sapiens
AFNDIAKYF

SEQ ID NO: 292811 - protein, 9 aa, Homo Sapiens
KKTTFQKKN

SEQ ID NO: 292812 - protein, 9 aa, Homo Sapiens
DLKEELTEA

SEQ ID NO: 292813 - protein, 9 aa, Homo Sapiens
IGKGQITSD

SEQ ID NO: 292814 - protein, 9 aa, Homo Sapiens
SPVCRAGKA

SEQ ID NO: 292815 - protein, 9 aa, Homo Sapiens
DLILQVPVA

SEQ ID NO: 292816 - protein, 9 aa, Homo Sapiens
GRLRVNYCI

SEQ ID NO: 292817 - protein, 9 aa, Homo Sapiens
RSHHYSPAS

SEQ ID NO: 292818 - protein, 9 aa, Homo Sapiens
ERIMECSAP

SEQ ID NO: 292819 - protein, 9 aa, Homo Sapiens
SLFVCLMFL

SEQ ID NO: 292820 - protein, 9 aa, Homo Sapiens
EGKEENKGG

SEQ ID NO: 292821 - protein, 9 aa, Homo Sapiens
VTDMLAGGV

SEQ ID NO: 292822 - protein, 9 aa, Homo Sapiens
TIEFLWHLK

SEQ ID NO: 292823 - protein, 9 aa, Homo Sapiens
INLLLDRIR

SEQ ID NO: 292824 - protein, 9 aa, Homo Sapiens
PWQRSAAED

SEQ ID NO: 292825 - protein, 9 aa, Homo Sapiens
IIVAHIKKC

SEQ ID NO: 292826 - protein, 9 aa, Homo Sapiens
CGKAFHNNS

SEQ ID NO: 292827 - protein, 9 aa, Homo Sapiens
DKETVTLNS

SEQ ID NO: 292828 - protein, 9 aa, Homo Sapiens
GGIALEPPP

SEQ ID NO: 292829 - protein, 9 aa, Homo Sapiens
LNRFNSELA

SEQ ID NO: 292830 - protein, 9 aa, Homo Sapiens
SATFEYFQI

SEQ ID NO: 292831 - protein, 9 aa, Homo Sapiens
FNYQSQAEA

SEQ ID NO: 292832 - protein, 9 aa, Homo Sapiens
YKQDELFKR

SEQ ID NO: 292833 - protein, 9 aa, Homo Sapiens
IMYVFYQMV

SEQ ID NO: 292834 - protein, 9 aa, Homo Sapiens
EFELCIYVH

SEQ ID NO: 292835 - protein, 9 aa, Homo Sapiens
QNIFSCLPL

SEQ ID NO: 292836 - protein, 9 aa, Homo Sapiens
RFKNQKDRE

SEQ ID NO: 292837 - protein, 9 aa, Homo Sapiens
KPAIKDSRG

SEQ ID NO: 292838 - protein, 9 aa, Homo Sapiens
RPQDHDTDL

SEQ ID NO: 292839 - protein, 9 aa, Homo Sapiens
TPRPQDHDT

SEQ ID NO: 292840 - protein, 9 aa, Homo Sapiens
FITSSHHSK

SEQ ID NO: 292841 - protein, 9 aa, Homo Sapiens
VKVPRNSRL

SEQ ID NO: 292842 - protein, 9 aa, Homo Sapiens
LQIVDNTVY

SEQ ID NO: 292843 - protein, 9 aa, Homo Sapiens
VGACLFHNM

SEQ ID NO: 292844 - protein, 9 aa, Homo Sapiens
VTTAMTTTL

SEQ ID NO: 292845 - protein, 9 aa, Homo Sapiens
DSSYFEIFK

SEQ ID NO: 292846 - protein, 9 aa, Homo Sapiens
KWTNQLNYL

SEQ ID NO: 292847 - protein, 9 aa, Homo Sapiens
LEKKQDKTG

SEQ ID NO: 292848 - protein, 9 aa, Homo Sapiens
DLPSGCLLD

SEQ ID NO: 292849 - protein, 9 aa, Homo Sapiens
QSFTCKSYL

SEQ ID NO: 292850 - protein, 9 aa, Homo Sapiens
YKQINAVAL

SEQ ID NO: 292851 - protein, 9 aa, Homo Sapiens
NSSGVFRKS

SEQ ID NO: 292852 - protein, 9 aa, Homo Sapiens
RSVKPHLCS

SEQ ID NO: 292853 - protein, 9 aa, Homo Sapiens
HLTKHKIIH

SEQ ID NO: 292854 - protein, 9 aa, Homo Sapiens
ARWVELDKP

SEQ ID NO: 292855 - protein, 9 aa, Homo Sapiens
DKQDVRDLP

SEQ ID NO: 292856 - protein, 9 aa, Homo Sapiens
PLGLCVKNP

SEQ ID NO: 292857 - protein, 9 aa, Homo Sapiens
MDKMFSFSG

SEQ ID NO: 292858 - protein, 9 aa, Homo Sapiens
VQTMFNLEQ

SEQ ID NO: 292859 - protein, 9 aa, Homo Sapiens
AIEFYQEEW

SEQ ID NO: 292860 - protein, 9 aa, Homo Sapiens
TARLLSERY

SEQ ID NO: 292861 - protein, 9 aa, Homo Sapiens
VFPSQSMDA

SEQ ID NO: 292862 - protein, 9 aa, Homo Sapiens
ESIKYPLKA

SEQ ID NO: 292863 - protein, 9 aa, Homo Sapiens
ALLEDVVTK

SEQ ID NO: 292864 - protein, 9 aa, Homo Sapiens
KAQKKLKRL

SEQ ID NO: 292865 - protein, 9 aa, Homo Sapiens
KIQCVQNKP

SEQ ID NO: 292866 - protein, 9 aa, Homo Sapiens
QNPHLANHQ

SEQ ID NO: 292867 - protein, 9 aa, Homo Sapiens
EKMLTNVNW

SEQ ID NO: 292868 - protein, 9 aa, Homo Sapiens
IAYIMWGYL

SEQ ID NO: 292869 - protein, 9 aa, Homo Sapiens
CTPKKIRKI

SEQ ID NO: 292870 - protein, 9 aa, Homo Sapiens
AQLGCPINN

SEQ ID NO: 292871 - protein, 9 aa, Homo Sapiens
FVSVISFLE

SEQ ID NO: 292872 - protein, 9 aa, Homo Sapiens
ISKSSIMYF

SEQ ID NO: 292873 - protein, 9 aa, Homo Sapiens
QVNSAGYLT

SEQ ID NO: 292874 - protein, 9 aa, Homo Sapiens
YINKVEELN

SEQ ID NO: 292875 - protein, 9 aa, Homo Sapiens
QMRGKRRPQ

SEQ ID NO: 292876 - protein, 9 aa, Homo Sapiens
EFSKWWPTE

SEQ ID NO: 292877 - protein, 9 aa, Homo Sapiens
PGQITTLTG

SEQ ID NO: 292878 - protein, 9 aa, Homo Sapiens
VRNYVLLLI

SEQ ID NO: 292879 - protein, 9 aa, Homo Sapiens
LEKESRIIL

SEQ ID NO: 292880 - protein, 9 aa, Homo Sapiens
FYQEEWTCL

SEQ ID NO: 292881 - protein, 9 aa, Homo Sapiens
LTPNMKKDK

SEQ ID NO: 292882 - protein, 9 aa, Homo Sapiens
PVCLHEGKT

SEQ ID NO: 292883 - protein, 9 aa, Homo Sapiens
LKEGFRLVS

SEQ ID NO: 292884 - protein, 9 aa, Homo Sapiens
TITIFRNSI

SEQ ID NO: 292885 - protein, 9 aa, Homo Sapiens
GSKNYSEIS

SEQ ID NO: 292886 - protein, 9 aa, Homo Sapiens
QMGDALPVS

SEQ ID NO: 292887 - protein, 9 aa, Homo Sapiens
AFRKAASHN

SEQ ID NO: 292888 - protein, 9 aa, Homo Sapiens
PIRALQKVF

SEQ ID NO: 292889 - protein, 9 aa, Homo Sapiens
ECGSRDVSH

SEQ ID NO: 292890 - protein, 9 aa, Homo Sapiens
IGEKPFTCN

SEQ ID NO: 292891 - protein, 9 aa, Homo Sapiens
GNIYFYPNG

SEQ ID NO: 292892 - protein, 9 aa, Homo Sapiens
LCKIFVMLF

SEQ ID NO: 292893 - protein, 9 aa, Homo Sapiens
VSSFLCNLD

SEQ ID NO: 292894 - protein, 9 aa, Homo Sapiens
GPDRPFKCP

SEQ ID NO: 292895 - protein, 9 aa, Homo Sapiens
NIVNSFIVS

SEQ ID NO: 292896 - protein, 9 aa, Homo Sapiens
YHTNTGFLQ

SEQ ID NO: 292897 - protein, 9 aa, Homo Sapiens
HTLIYDGKV

SEQ ID NO: 292898 - protein, 9 aa, Homo Sapiens
VKEQGSHSK

SEQ ID NO: 292899 - protein, 9 aa, Homo Sapiens
RQGVTIFYV

SEQ ID NO: 292900 - protein, 9 aa, Homo Sapiens
NKTLVVNPG

SEQ ID NO: 292901 - protein, 9 aa, Homo Sapiens
DASTMYGSS

SEQ ID NO: 292902 - protein, 9 aa, Homo Sapiens
QVNYWVGIN

SEQ ID NO: 292903 - protein, 9 aa, Homo Sapiens
DLDHFDKLP

SEQ ID NO: 292904 - protein, 9 aa, Homo Sapiens
DAITNFRAK

SEQ ID NO: 292905 - protein, 9 aa, Homo Sapiens
CVASEYPLI

SEQ ID NO: 292906 - protein, 9 aa, Homo Sapiens
PVVLAVKEL

SEQ ID NO: 292907 - protein, 9 aa, Homo Sapiens
LTARLNLTE

SEQ ID NO: 292908 - protein, 9 aa, Homo Sapiens
CELIHALYP

SEQ ID NO: 292909 - protein, 9 aa, Homo Sapiens
HVVKQLEGE

SEQ ID NO: 292910 - protein, 9 aa, Homo Sapiens
GASQGYFPP

SEQ ID NO: 292911 - protein, 9 aa, Homo Sapiens
YVLNQIIYR

SEQ ID NO: 292912 - protein, 9 aa, Homo Sapiens
IQFEINFDR

SEQ ID NO: 292913 - protein, 9 aa, Homo Sapiens
GVGAGGRQR

SEQ ID NO: 292914 - protein, 9 aa, Homo Sapiens
NDLFLVVSI

SEQ ID NO: 292915 - protein, 9 aa, Homo Sapiens
NNRGEIVKT

SEQ ID NO: 292916 - protein, 9 aa, Homo Sapiens
FKDAIRRFA

SEQ ID NO: 292917 - protein, 9 aa, Homo Sapiens
LPEEPVHFH

SEQ ID NO: 292918 - protein, 9 aa, Homo Sapiens
YIITTILKF

SEQ ID NO: 292919 - protein, 9 aa, Homo Sapiens
NDIEAYDAR

SEQ ID NO: 292920 - protein, 9 aa, Homo Sapiens
LRKCFSEGG

SEQ ID NO: 292921 - protein, 9 aa, Homo Sapiens
STQADEGRT

SEQ ID NO: 292922 - protein, 9 aa, Homo Sapiens
KILTEWKQK

SEQ ID NO: 292923 - protein, 9 aa, Homo Sapiens
NGQEVRRTI

SEQ ID NO: 292924 - protein, 9 aa, Homo Sapiens
YSVNNSEVK

SEQ ID NO: 292925 - protein, 9 aa, Homo Sapiens
FCGQLQVYT

SEQ ID NO: 292926 - protein, 9 aa, Homo Sapiens
GPPEPPGKP

SEQ ID NO: 292927 - protein, 9 aa, Homo Sapiens
GQLFSLNSK

SEQ ID NO: 292928 - protein, 9 aa, Homo Sapiens
KNKYVFQLT

SEQ ID NO: 292929 - protein, 9 aa, Homo Sapiens
ERTSYLENK

SEQ ID NO: 292930 - protein, 9 aa, Homo Sapiens
GDIKVTELE

SEQ ID NO: 292931 - protein, 9 aa, Homo Sapiens
PKYMNRTVT

SEQ ID NO: 292932 - protein, 9 aa, Homo Sapiens
NIFSKFGKI

SEQ ID NO: 292933 - protein, 9 aa, Homo Sapiens
FSRNLHPAS

SEQ ID NO: 292934 - protein, 9 aa, Homo Sapiens
SGRHMDRIG

SEQ ID NO: 292935 - protein, 9 aa, Homo Sapiens
ATLQALGYQ

SEQ ID NO: 292936 - protein, 9 aa, Homo Sapiens
SQGRFGGVI

SEQ ID NO: 292937 - protein, 9 aa, Homo Sapiens
KEEDPSHLR

SEQ ID NO: 292938 - protein, 9 aa, Homo Sapiens
RIEDSLIQL

SEQ ID NO: 292939 - protein, 9 aa, Homo Sapiens
SCLGGECNN

SEQ ID NO: 292940 - protein, 9 aa, Homo Sapiens
IRNNSAFLK

SEQ ID NO: 292941 - protein, 9 aa, Homo Sapiens
FHEGIRAVL

SEQ ID NO: 292942 - protein, 9 aa, Homo Sapiens
VARFYREAS

SEQ ID NO: 292943 - protein, 9 aa, Homo Sapiens
EPGQTEGKG

SEQ ID NO: 292944 - protein, 9 aa, Homo Sapiens
RIDYKVKTK

SEQ ID NO: 292945 - protein, 9 aa, Homo Sapiens
RINDDLSSE

SEQ ID NO: 292946 - protein, 9 aa, Homo Sapiens
GKEFINLLL

SEQ ID NO: 292947 - protein, 9 aa, Homo Sapiens
APEKNVTKE

SEQ ID NO: 292948 - protein, 9 aa, Homo Sapiens
GKEENKGGP

SEQ ID NO: 292949 - protein, 9 aa, Homo Sapiens
ITIVEVILE

SEQ ID NO: 292950 - protein, 9 aa, Homo Sapiens
EMICILCLF

SEQ ID NO: 292951 - protein, 9 aa, Homo Sapiens
NITIITLTL

SEQ ID NO: 292952 - protein, 9 aa, Homo Sapiens
QTWVKLEII

SEQ ID NO: 292953 - protein, 9 aa, Homo Sapiens
EWLEALLIN

SEQ ID NO: 292954 - protein, 9 aa, Homo Sapiens
IINPNKARI

SEQ ID NO: 292955 - protein, 9 aa, Homo Sapiens
SQSDLARDL

SEQ ID NO: 292956 - protein, 9 aa, Homo Sapiens
YVARFYREA

SEQ ID NO: 292957 - protein, 9 aa, Homo Sapiens
KCVVLLQTA

SEQ ID NO: 292958 - protein, 9 aa, Homo Sapiens
RMHSLSSGQ

SEQ ID NO: 292959 - protein, 9 aa, Homo Sapiens
TPDFIILGL

SEQ ID NO: 292960 - protein, 9 aa, Homo Sapiens
SSVSWKILL

SEQ ID NO: 292961 - protein, 9 aa, Homo Sapiens
VSTESETAV

SEQ ID NO: 292962 - protein, 9 aa, Homo Sapiens
QSSSRIIHQ

SEQ ID NO: 292963 - protein, 9 aa, Homo Sapiens
FPEHLINVL

SEQ ID NO: 292964 - protein, 9 aa, Homo Sapiens
VALDPELEE

SEQ ID NO: 292965 - protein, 9 aa, Homo Sapiens
EQLHQKVGK

SEQ ID NO: 292966 - protein, 9 aa, Homo Sapiens
YPDEFKNMV

SEQ ID NO: 292967 - protein, 9 aa, Homo Sapiens
RFLQSWNLN

SEQ ID NO: 292968 - protein, 9 aa, Homo Sapiens
PHCKIALFN

SEQ ID NO: 292969 - protein, 9 aa, Homo Sapiens
ILSADIAQN

SEQ ID NO: 292970 - protein, 9 aa, Homo Sapiens
LELIPLTAQ

SEQ ID NO: 292971 - protein, 9 aa, Homo Sapiens
TGYAISTVC

SEQ ID NO: 292972 - protein, 9 aa, Homo Sapiens
SCVQGILLP

SEQ ID NO: 292973 - protein, 9 aa, Homo Sapiens
PSSKKRGRS

SEQ ID NO: 292974 - protein, 9 aa, Homo Sapiens
LTLPPLLPY

SEQ ID NO: 292975 - protein, 9 aa, Homo Sapiens
HQNRVFHDF

SEQ ID NO: 292976 - protein, 9 aa, Homo Sapiens
NRDKDTKII

SEQ ID NO: 292977 - protein, 9 aa, Homo Sapiens
DNLITRSQS

SEQ ID NO: 292978 - protein, 9 aa, Homo Sapiens
FLCDISPLL

SEQ ID NO: 292979 - protein, 9 aa, Homo Sapiens
NQQMVMAQL

SEQ ID NO: 292980 - protein, 9 aa, Homo Sapiens
DDKKEEFDV

SEQ ID NO: 292981 - protein, 9 aa, Homo Sapiens
HTEGILNQN

SEQ ID NO: 292982 - protein, 9 aa, Homo Sapiens
PPGICPHVA

SEQ ID NO: 292983 - protein, 9 aa, Homo Sapiens
FLTPANNAF

SEQ ID NO: 292984 - protein, 9 aa, Homo Sapiens
SRSVDCRVS

SEQ ID NO: 292985 - protein, 9 aa, Homo Sapiens
ERVCIGADD

SEQ ID NO: 292986 - protein, 9 aa, Homo Sapiens
SSRAHLIRH

SEQ ID NO: 292987 - protein, 9 aa, Homo Sapiens
QREGMRQYG

SEQ ID NO: 292988 - protein, 9 aa, Homo Sapiens
RVAKVHTAK

SEQ ID NO: 292989 - protein, 9 aa, Homo Sapiens
FTNWSIINP

SEQ ID NO: 292990 - protein, 9 aa, Homo Sapiens
HRNWIVNKH

SEQ ID NO: 292991 - protein, 9 aa, Homo Sapiens
QDLFDRYMA

SEQ ID NO: 292992 - protein, 9 aa, Homo Sapiens
DVQERVISV

SEQ ID NO: 292993 - protein, 9 aa, Homo Sapiens
LDNYLINNC

SEQ ID NO: 292994 - protein, 9 aa, Homo Sapiens
LSDSEAQSH

SEQ ID NO: 292995 - protein, 9 aa, Homo Sapiens
SQKIYLRLK

SEQ ID NO: 292996 - protein, 9 aa, Homo Sapiens
DIPNILDLC

SEQ ID NO: 292997 - protein, 9 aa, Homo Sapiens
SNKVLHFPN

SEQ ID NO: 292998 - protein, 9 aa, Homo Sapiens
KDFLPDPAL

SEQ ID NO: 292999 - protein, 9 aa, Homo Sapiens
EINFDRQKS

SEQ ID NO: 293000 - protein, 9 aa, Homo Sapiens
FILVSFTWM

SEQ ID NO: 293001 - protein, 9 aa, Homo Sapiens
TDMLAGGVD

SEQ ID NO: 293002 - protein, 9 aa, Homo Sapiens
DDLFTSLGL

SEQ ID NO: 293003 - protein, 9 aa, Homo Sapiens
CIRDKYMQK

SEQ ID NO: 293004 - protein, 9 aa, Homo Sapiens
NNKSRNADV

SEQ ID NO: 293005 - protein, 9 aa, Homo Sapiens
KSPQTTVHD

SEQ ID NO: 293006 - protein, 9 aa, Homo Sapiens
ANPNVRAMY

SEQ ID NO: 293007 - protein, 9 aa, Homo Sapiens
KPGKKLPDL

SEQ ID NO: 293008 - protein, 9 aa, Homo Sapiens
PTSPANSQA

SEQ ID NO: 293009 - protein, 9 aa, Homo Sapiens
ARVGASAHY

SEQ ID NO: 293010 - protein, 9 aa, Homo Sapiens
KFYAGTVLL

SEQ ID NO: 293011 - protein, 9 aa, Homo Sapiens
KLAPSQINL

SEQ ID NO: 293012 - protein, 9 aa, Homo Sapiens
KSRLLESVE

SEQ ID NO: 293013 - protein, 9 aa, Homo Sapiens
CLSLWRQQG

SEQ ID NO: 293014 - protein, 9 aa, Homo Sapiens
DCNWLARDM

SEQ ID NO: 293015 - protein, 9 aa, Homo Sapiens
CGKEKDLMN

SEQ ID NO: 293016 - protein, 9 aa, Homo Sapiens
FNPTEEQDE

SEQ ID NO: 293017 - protein, 9 aa, Homo Sapiens
VDITSWYNG

SEQ ID NO: 293018 - protein, 9 aa, Homo Sapiens
KNYSLIIHQ

SEQ ID NO: 293019 - protein, 9 aa, Homo Sapiens
LDEMLTHNI

SEQ ID NO: 293020 - protein, 9 aa, Homo Sapiens
ELFEEADFS

SEQ ID NO: 293021 - protein, 9 aa, Homo Sapiens
MILETAPTS

SEQ ID NO: 293022 - protein, 9 aa, Homo Sapiens
QHMVQTKHY

SEQ ID NO: 293023 - protein, 9 aa, Homo Sapiens
VRHANSGGT

SEQ ID NO: 293024 - protein, 9 aa, Homo Sapiens
LIYGEQSEN

SEQ ID NO: 293025 - protein, 9 aa, Homo Sapiens
AVTDTVDIA

SEQ ID NO: 293026 - protein, 9 aa, Homo Sapiens
CLIKHQQEV

SEQ ID NO: 293027 - protein, 9 aa, Homo Sapiens
KLRYQKPDE

SEQ ID NO: 293028 - protein, 9 aa, Homo Sapiens
SNPKIHIKE

SEQ ID NO: 293029 - protein, 9 aa, Homo Sapiens
MCPGEKQKV

SEQ ID NO: 293030 - protein, 9 aa, Homo Sapiens
SEEVEISKA

SEQ ID NO: 293031 - protein, 9 aa, Homo Sapiens
KLQLFCVRL

SEQ ID NO: 293032 - protein, 9 aa, Homo Sapiens
NLTLLNSFW

SEQ ID NO: 293033 - protein, 9 aa, Homo Sapiens
PISKKLRLK

SEQ ID NO: 293034 - protein, 9 aa, Homo Sapiens
KTLASTSVD

SEQ ID NO: 293035 - protein, 9 aa, Homo Sapiens
SKLHYAFQL

SEQ ID NO: 293036 - protein, 9 aa, Homo Sapiens
GEDLFLHVK

SEQ ID NO: 293037 - protein, 9 aa, Homo Sapiens
FVIVFVLIF

SEQ ID NO: 293038 - protein, 9 aa, Homo Sapiens
ENLRSKLIQ

SEQ ID NO: 293039 - protein, 9 aa, Homo Sapiens
FDETSLINT

SEQ ID NO: 293040 - protein, 9 aa, Homo Sapiens
KETCAPSSP

SEQ ID NO: 293041 - protein, 9 aa, Homo Sapiens
DNNTSQTLK

SEQ ID NO: 293042 - protein, 9 aa, Homo Sapiens
SFTGGSQEN

SEQ ID NO: 293043 - protein, 9 aa, Homo Sapiens
IKNNKVIIK

SEQ ID NO: 293044 - protein, 9 aa, Homo Sapiens
KPEELRQTL

SEQ ID NO: 293045 - protein, 9 aa, Homo Sapiens
ENYFLIFKE

SEQ ID NO: 293046 - protein, 9 aa, Homo Sapiens
ERAALCVRQ

SEQ ID NO: 293047 - protein, 9 aa, Homo Sapiens
EDVPDNKAW

SEQ ID NO: 293048 - protein, 9 aa, Homo Sapiens
ASLCLGVSL

SEQ ID NO: 293049 - protein, 9 aa, Homo Sapiens
LADTYNRLT

SEQ ID NO: 293050 - protein, 9 aa, Homo Sapiens
VMNPHICLK

SEQ ID NO: 293051 - protein, 9 aa, Homo Sapiens
IHVKVKYIN

SEQ ID NO: 293052 - protein, 9 aa, Homo Sapiens
INLTLPSLL

SEQ ID NO: 293053 - protein, 9 aa, Homo Sapiens
RNRIQLPFH

SEQ ID NO: 293054 - protein, 9 aa, Homo Sapiens
IIFAVMAYD

SEQ ID NO: 293055 - protein, 9 aa, Homo Sapiens
NISGSFTLM

SEQ ID NO: 293056 - protein, 9 aa, Homo Sapiens
LGCPINNLD

SEQ ID NO: 293057 - protein, 9 aa, Homo Sapiens
DDSDQTLRR

SEQ ID NO: 293058 - protein, 9 aa, Homo Sapiens
LINATFTLQ

SEQ ID NO: 293059 - protein, 9 aa, Homo Sapiens
PQRRSHSPS

SEQ ID NO: 293060 - protein, 9 aa, Homo Sapiens
RAMYGNTAL

SEQ ID NO: 293061 - protein, 9 aa, Homo Sapiens
FSFTAEQYQ

SEQ ID NO: 293062 - protein, 9 aa, Homo Sapiens
FLLDLFMVS

SEQ ID NO: 293063 - protein, 9 aa, Homo Sapiens
SGCPLAVKR

SEQ ID NO: 293064 - protein, 9 aa, Homo Sapiens
TQNPHLANH

SEQ ID NO: 293065 - protein, 9 aa, Homo Sapiens
AGYLTSSPT

SEQ ID NO: 293066 - protein, 9 aa, Homo Sapiens
KSNYICHMG

SEQ ID NO: 293067 - protein, 9 aa, Homo Sapiens
FFSLAFIIW

SEQ ID NO: 293068 - protein, 9 aa, Homo Sapiens
YRALLKLLR

SEQ ID NO: 293069 - protein, 9 aa, Homo Sapiens
NEKTGIVLL

SEQ ID NO: 293070 - protein, 9 aa, Homo Sapiens
DAVARFTVI

SEQ ID NO: 293071 - protein, 9 aa, Homo Sapiens
TLQAPPNTD

SEQ ID NO: 293072 - protein, 9 aa, Homo Sapiens
LKLSVNKTL

SEQ ID NO: 293073 - protein, 9 aa, Homo Sapiens
DCENNYTCV

SEQ ID NO: 293074 - protein, 9 aa, Homo Sapiens
NGRHNTLRC

SEQ ID NO: 293075 - protein, 9 aa, Homo Sapiens
VAPKKDVDA

SEQ ID NO: 293076 - protein, 9 aa, Homo Sapiens
HQQEIQVVL

SEQ ID NO: 293077 - protein, 9 aa, Homo Sapiens
KGGNDSSKF

SEQ ID NO: 293078 - protein, 9 aa, Homo Sapiens
VSNIHSSCA

SEQ ID NO: 293079 - protein, 9 aa, Homo Sapiens
FLQCLAQLA

SEQ ID NO: 293080 - protein, 9 aa, Homo Sapiens
NAYIDIQLQ

SEQ ID NO: 293081 - protein, 9 aa, Homo Sapiens
KSKEKDSPF

SEQ ID NO: 293082 - protein, 9 aa, Homo Sapiens
TEKHTKHKK

SEQ ID NO: 293083 - protein, 9 aa, Homo Sapiens
FLQREGMRQ

SEQ ID NO: 293084 - protein, 9 aa, Homo Sapiens
DALHHLSCK

SEQ ID NO: 293085 - protein, 9 aa, Homo Sapiens
GFYFFFKDS

SEQ ID NO: 293086 - protein, 9 aa, Homo Sapiens
EVEYCTTTG

SEQ ID NO: 293087 - protein, 9 aa, Homo Sapiens
IKLHIWDTA

SEQ ID NO: 293088 - protein, 9 aa, Homo Sapiens
SIHHFVKKV

SEQ ID NO: 293089 - protein, 9 aa, Homo Sapiens
ALFPCNECT

SEQ ID NO: 293090 - protein, 9 aa, Homo Sapiens
PIMAHGFTQ

SEQ ID NO: 293091 - protein, 9 aa, Homo Sapiens
FVCAKCSKP

SEQ ID NO: 293092 - protein, 9 aa, Homo Sapiens
CGGDDSTCC

SEQ ID NO: 293093 - protein, 9 aa, Homo Sapiens
RKCVVLLQT

SEQ ID NO: 293094 - protein, 9 aa, Homo Sapiens
ENCEQVSTE

SEQ ID NO: 293095 - protein, 9 aa, Homo Sapiens
FTLSVVASD

SEQ ID NO: 293096 - protein, 9 aa, Homo Sapiens
ADTYNRLTN

SEQ ID NO: 293097 - protein, 9 aa, Homo Sapiens
DRQSKEQMK

SEQ ID NO: 293098 - protein, 9 aa, Homo Sapiens
SQPSLRAWQ

SEQ ID NO: 293099 - protein, 9 aa, Homo Sapiens
EPRPGKFEK

SEQ ID NO: 293100 - protein, 9 aa, Homo Sapiens
VNTGDKNDV

SEQ ID NO: 293101 - protein, 9 aa, Homo Sapiens
CVRQSGHGP

SEQ ID NO: 293102 - protein, 9 aa, Homo Sapiens
LPSSVAQAN

SEQ ID NO: 293103 - protein, 9 aa, Homo Sapiens
GVKPKLVIN

SEQ ID NO: 293104 - protein, 9 aa, Homo Sapiens
DQICSLMAV

SEQ ID NO: 293105 - protein, 9 aa, Homo Sapiens
VTGMDKGIS

SEQ ID NO: 293106 - protein, 9 aa, Homo Sapiens
NYLSKTLLD

SEQ ID NO: 293107 - protein, 9 aa, Homo Sapiens
EHNCMRTNS

SEQ ID NO: 293108 - protein, 9 aa, Homo Sapiens
ESIPFVVDE

SEQ ID NO: 293109 - protein, 9 aa, Homo Sapiens
SHLCPQPPK

SEQ ID NO: 293110 - protein, 9 aa, Homo Sapiens
VCKLKNAMT

SEQ ID NO: 293111 - protein, 9 aa, Homo Sapiens
ASFPKKKPR

SEQ ID NO: 293112 - protein, 9 aa, Homo Sapiens
EVQNIISFL

SEQ ID NO: 293113 - protein, 9 aa, Homo Sapiens
LEKADLNTT

SEQ ID NO: 293114 - protein, 9 aa, Homo Sapiens
RVGKAFHAS

SEQ ID NO: 293115 - protein, 9 aa, Homo Sapiens
ESAPVLMIP

SEQ ID NO: 293116 - protein, 9 aa, Homo Sapiens
IFGMAPMLS

SEQ ID NO: 293117 - protein, 9 aa, Homo Sapiens
GSIILKSSE

SEQ ID NO: 293118 - protein, 9 aa, Homo Sapiens
GPTRGKHAW

SEQ ID NO: 293119 - protein, 9 aa, Homo Sapiens
KEGRIDYLL

SEQ ID NO: 293120 - protein, 9 aa, Homo Sapiens
GKRAKPQMQ

SEQ ID NO: 293121 - protein, 9 aa, Homo Sapiens
VSVCNQIVS

SEQ ID NO: 293122 - protein, 9 aa, Homo Sapiens
PASPQRKYA

SEQ ID NO: 293123 - protein, 9 aa, Homo Sapiens
RTARPKGLP

SEQ ID NO: 293124 - protein, 9 aa, Homo Sapiens
AGYTLWEDG

SEQ ID NO: 293125 - protein, 9 aa, Homo Sapiens
GHSRKDNIF

SEQ ID NO: 293126 - protein, 9 aa, Homo Sapiens
GGLLLLTLI

SEQ ID NO: 293127 - protein, 9 aa, Homo Sapiens
ADENSRLLQ

SEQ ID NO: 293128 - protein, 9 aa, Homo Sapiens
TASTNINAM

SEQ ID NO: 293129 - protein, 9 aa, Homo Sapiens
PNRLNPKHV

SEQ ID NO: 293130 - protein, 9 aa, Homo Sapiens
NLQAQIRHW

SEQ ID NO: 293131 - protein, 9 aa, Homo Sapiens
PQQTHRPHP

SEQ ID NO: 293132 - protein, 9 aa, Homo Sapiens
VELAQTCIG

SEQ ID NO: 293133 - protein, 9 aa, Homo Sapiens
SIPGEMVTL

SEQ ID NO: 293134 - protein, 9 aa, Homo Sapiens
NWTSSQRCC

SEQ ID NO: 293135 - protein, 9 aa, Homo Sapiens
YKTGINKAP

SEQ ID NO: 293136 - protein, 9 aa, Homo Sapiens
ENNYNMYIF

SEQ ID NO: 293137 - protein, 9 aa, Homo Sapiens
ISAMQMLNM

SEQ ID NO: 293138 - protein, 9 aa, Homo Sapiens
DHLRCEDLA

SEQ ID NO: 293139 - protein, 9 aa, Homo Sapiens
ARDLDIGTD

SEQ ID NO: 293140 - protein, 9 aa, Homo Sapiens
QNKPFQKEE

SEQ ID NO: 293141 - protein, 9 aa, Homo Sapiens
TMLLIQLPL

SEQ ID NO: 293142 - protein, 9 aa, Homo Sapiens
IKIVIKEYV

SEQ ID NO: 293143 - protein, 9 aa, Homo Sapiens
LHSLVQFIF

SEQ ID NO: 293144 - protein, 9 aa, Homo Sapiens
SKLYLDLHP

SEQ ID NO: 293145 - protein, 9 aa, Homo Sapiens
EKESRIILC

SEQ ID NO: 293146 - protein, 9 aa, Homo Sapiens
ESVAHNKRK

SEQ ID NO: 293147 - protein, 9 aa, Homo Sapiens
QYTNGLYSL

SEQ ID NO: 293148 - protein, 9 aa, Homo Sapiens
SNPGGGGLA

SEQ ID NO: 293149 - protein, 9 aa, Homo Sapiens
YMALIKRGT

SEQ ID NO: 293150 - protein, 9 aa, Homo Sapiens
AKRAFVHWC

SEQ ID NO: 293151 - protein, 9 aa, Homo Sapiens
STFNRDFLA

SEQ ID NO: 293152 - protein, 9 aa, Homo Sapiens
GNNRISKTI

SEQ ID NO: 293153 - protein, 9 aa, Homo Sapiens
NYPSTPCQN

SEQ ID NO: 293154 - protein, 9 aa, Homo Sapiens
RNKYFSLDH

SEQ ID NO: 293155 - protein, 9 aa, Homo Sapiens
NNLERFIED

SEQ ID NO: 293156 - protein, 9 aa, Homo Sapiens
PSNKQPPSI

SEQ ID NO: 293157 - protein, 9 aa, Homo Sapiens
VGLSIGVEQ

SEQ ID NO: 293158 - protein, 9 aa, Homo Sapiens
IYKTKFSET

SEQ ID NO: 293159 - protein, 9 aa, Homo Sapiens
KGKCRHHSH

SEQ ID NO: 293160 - protein, 9 aa, Homo Sapiens
MFDCWKNNK

SEQ ID NO: 293161 - protein, 9 aa, Homo Sapiens
ALKTIEALS

SEQ ID NO: 293162 - protein, 9 aa, Homo Sapiens
RKRKNMPAS

SEQ ID NO: 293163 - protein, 9 aa, Homo Sapiens
KMKAPVLPE

SEQ ID NO: 293164 - protein, 9 aa, Homo Sapiens
FQNYVILEK

SEQ ID NO: 293165 - protein, 9 aa, Homo Sapiens
RNRVLSQWR

SEQ ID NO: 293166 - protein, 9 aa, Homo Sapiens
VAQIGGRLL

SEQ ID NO: 293167 - protein, 9 aa, Homo Sapiens
TKFSETAFA

SEQ ID NO: 293168 - protein, 9 aa, Homo Sapiens
SQEPAFELD

SEQ ID NO: 293169 - protein, 9 aa, Homo Sapiens
SLGCFIFKP

SEQ ID NO: 293170 - protein, 9 aa, Homo Sapiens
VYLKVIKFK

SEQ ID NO: 293171 - protein, 9 aa, Homo Sapiens
LQTRVDQII

SEQ ID NO: 293172 - protein, 9 aa, Homo Sapiens
LATITTDQR

SEQ ID NO: 293173 - protein, 9 aa, Homo Sapiens
TSSQRCCDS

SEQ ID NO: 293174 - protein, 9 aa, Homo Sapiens
LPPLKTPLF

SEQ ID NO: 293175 - protein, 9 aa, Homo Sapiens
EAEDLFYQR

SEQ ID NO: 293176 - protein, 9 aa, Homo Sapiens
TFYFVPPSK

SEQ ID NO: 293177 - protein, 9 aa, Homo Sapiens
HAGNKHIQD

SEQ ID NO: 293178 - protein, 9 aa, Homo Sapiens
KEDNEVYVL

SEQ ID NO: 293179 - protein, 9 aa, Homo Sapiens
TTNYPSTPC

SEQ ID NO: 293180 - protein, 9 aa, Homo Sapiens
DLAFEFEGM

SEQ ID NO: 293181 - protein, 9 aa, Homo Sapiens
GGTTNQQEA

SEQ ID NO: 293182 - protein, 9 aa, Homo Sapiens
IDTAKLCLS

SEQ ID NO: 293183 - protein, 9 aa, Homo Sapiens
LTLKSSMDS

SEQ ID NO: 293184 - protein, 9 aa, Homo Sapiens
ILYLSEKAY

SEQ ID NO: 293185 - protein, 9 aa, Homo Sapiens
EDNYILWCV

SEQ ID NO: 293186 - protein, 9 aa, Homo Sapiens
RYTINAMQK

SEQ ID NO: 293187 - protein, 9 aa, Homo Sapiens
KYPGQITTL

SEQ ID NO: 293188 - protein, 9 aa, Homo Sapiens
KVKTIVMIA

SEQ ID NO: 293189 - protein, 9 aa, Homo Sapiens
EVAIYISDE

SEQ ID NO: 293190 - protein, 9 aa, Homo Sapiens
QVEDDRQMD

SEQ ID NO: 293191 - protein, 9 aa, Homo Sapiens
IWRGSTPKE

SEQ ID NO: 293192 - protein, 9 aa, Homo Sapiens
SGSPPKSPQ

SEQ ID NO: 293193 - protein, 9 aa, Homo Sapiens
EAQEEDAKK

SEQ ID NO: 293194 - protein, 9 aa, Homo Sapiens
RERLRVYLE

SEQ ID NO: 293195 - protein, 9 aa, Homo Sapiens
NNQIEAQEN

SEQ ID NO: 293196 - protein, 9 aa, Homo Sapiens
DPIAGTLFF

SEQ ID NO: 293197 - protein, 9 aa, Homo Sapiens
CTVLVCSKD

SEQ ID NO: 293198 - protein, 9 aa, Homo Sapiens
DTSCKGRID

SEQ ID NO: 293199 - protein, 9 aa, Homo Sapiens
VGMITAIAV

SEQ ID NO: 293200 - protein, 9 aa, Homo Sapiens
RDWRKKKPT

SEQ ID NO: 293201 - protein, 9 aa, Homo Sapiens
YYYCEVPFD

SEQ ID NO: 293202 - protein, 9 aa, Homo Sapiens
TLLDDATKL

SEQ ID NO: 293203 - protein, 9 aa, Homo Sapiens
SFSMSASKR

SEQ ID NO: 293204 - protein, 9 aa, Homo Sapiens
PHVTQEQDI

SEQ ID NO: 293205 - protein, 9 aa, Homo Sapiens
TRSNVAILY

SEQ ID NO: 293206 - protein, 9 aa, Homo Sapiens
NSPKLTPNM

SEQ ID NO: 293207 - protein, 9 aa, Homo Sapiens
ENSSEEELF

SEQ ID NO: 293208 - protein, 9 aa, Homo Sapiens
GFSLLFYVV

SEQ ID NO: 293209 - protein, 9 aa, Homo Sapiens
VELKYIIRQ

SEQ ID NO: 293210 - protein, 9 aa, Homo Sapiens
WMKIFNPPA

SEQ ID NO: 293211 - protein, 9 aa, Homo Sapiens
DLLTFLSNP

SEQ ID NO: 293212 - protein, 9 aa, Homo Sapiens
PLVCKSGSI

SEQ ID NO: 293213 - protein, 9 aa, Homo Sapiens
TDFWGRFLS

SEQ ID NO: 293214 - protein, 9 aa, Homo Sapiens
SWLDKEVKD

SEQ ID NO: 293215 - protein, 9 aa, Homo Sapiens
VQAEAYIHR

SEQ ID NO: 293216 - protein, 9 aa, Homo Sapiens
SAPVLMIPP

SEQ ID NO: 293217 - protein, 9 aa, Homo Sapiens
QGCPFSTED

SEQ ID NO: 293218 - protein, 9 aa, Homo Sapiens
SETCLSQDS

SEQ ID NO: 293219 - protein, 9 aa, Homo Sapiens
YPEATSLSL

SEQ ID NO: 293220 - protein, 9 aa, Homo Sapiens
GTLFITFGI

SEQ ID NO: 293221 - protein, 9 aa, Homo Sapiens
HPSHRNWIV

SEQ ID NO: 293222 - protein, 9 aa, Homo Sapiens
NYDKGLKVG

SEQ ID NO: 293223 - protein, 9 aa, Homo Sapiens
IDDMLLRLK

SEQ ID NO: 293224 - protein, 9 aa, Homo Sapiens
SCQPAGCTS

SEQ ID NO: 293225 - protein, 9 aa, Homo Sapiens
RHYWNPWKA

SEQ ID NO: 293226 - protein, 9 aa, Homo Sapiens
EGKQTKRGG

SEQ ID NO: 293227 - protein, 9 aa, Homo Sapiens
IKNNLCRNF

SEQ ID NO: 293228 - protein, 9 aa, Homo Sapiens
VTRGVGAGG

SEQ ID NO: 293229 - protein, 9 aa, Homo Sapiens
DKITRIEGK

SEQ ID NO: 293230 - protein, 9 aa, Homo Sapiens
STALSRLFP

SEQ ID NO: 293231 - protein, 9 aa, Homo Sapiens
EGFISKRSD

SEQ ID NO: 293232 - protein, 9 aa, Homo Sapiens
TGGSQENHL

SEQ ID NO: 293233 - protein, 9 aa, Homo Sapiens
DKPYNCNEC

SEQ ID NO: 293234 - protein, 9 aa, Homo Sapiens
VIDYILYSK

SEQ ID NO: 293235 - protein, 9 aa, Homo Sapiens
LEWATIQIE

SEQ ID NO: 293236 - protein, 9 aa, Homo Sapiens
SNRSKLYLD

SEQ ID NO: 293237 - protein, 9 aa, Homo Sapiens
EVELEEFKK

SEQ ID NO: 293238 - protein, 9 aa, Homo Sapiens
DTTELQVWD

SEQ ID NO: 293239 - protein, 9 aa, Homo Sapiens
EDTSCKGRI

SEQ ID NO: 293240 - protein, 9 aa, Homo Sapiens
PFEITGNTV

SEQ ID NO: 293241 - protein, 9 aa, Homo Sapiens
YCPEGVHQE

SEQ ID NO: 293242 - protein, 9 aa, Homo Sapiens
QSKKYLYQH

SEQ ID NO: 293243 - protein, 9 aa, Homo Sapiens
ALLKLLRAI

SEQ ID NO: 293244 - protein, 9 aa, Homo Sapiens
RAPAWCDQI

SEQ ID NO: 293245 - protein, 9 aa, Homo Sapiens
LPVIDNKVC

SEQ ID NO: 293246 - protein, 9 aa, Homo Sapiens
CRDIFGKDA

SEQ ID NO: 293247 - protein, 9 aa, Homo Sapiens
CSEQQEEDG

SEQ ID NO: 293248 - protein, 9 aa, Homo Sapiens
QWKELSKED

SEQ ID NO: 293249 - protein, 9 aa, Homo Sapiens
ICHMGHEFI

SEQ ID NO: 293250 - protein, 9 aa, Homo Sapiens
QSILFSPVS

SEQ ID NO: 293251 - protein, 9 aa, Homo Sapiens
YDELFPVSH

SEQ ID NO: 293252 - protein, 9 aa, Homo Sapiens
RAADDFLEY

SEQ ID NO: 293253 - protein, 9 aa, Homo Sapiens
VCVFLIMLG

SEQ ID NO: 293254 - protein, 9 aa, Homo Sapiens
CFGKHILQN

SEQ ID NO: 293255 - protein, 9 aa, Homo Sapiens
FCEKLEEQL

SEQ ID NO: 293256 - protein, 9 aa, Homo Sapiens
IKSILWQTL

SEQ ID NO: 293257 - protein, 9 aa, Homo Sapiens
NSSPISKKL

SEQ ID NO: 293258 - protein, 9 aa, Homo Sapiens
GCIQGSQRD

SEQ ID NO: 293259 - protein, 9 aa, Homo Sapiens
DTFIESSFW

SEQ ID NO: 293260 - protein, 9 aa, Homo Sapiens
TVIKTAILV

SEQ ID NO: 293261 - protein, 9 aa, Homo Sapiens
QTAQVQKDA

SEQ ID NO: 293262 - protein, 9 aa, Homo Sapiens
PIIKKIVQK

SEQ ID NO: 293263 - protein, 9 aa, Homo Sapiens
QNIIAVQYI

SEQ ID NO: 293264 - protein, 9 aa, Homo Sapiens
YQKLRVELT

SEQ ID NO: 293265 - protein, 9 aa, Homo Sapiens
SDADKQLLY

SEQ ID NO: 293266 - protein, 9 aa, Homo Sapiens
YSQEHALKT

SEQ ID NO: 293267 - protein, 9 aa, Homo Sapiens
VDCRVSSPV

SEQ ID NO: 293268 - protein, 9 aa, Homo Sapiens
PSMITPLRE

SEQ ID NO: 293269 - protein, 9 aa, Homo Sapiens
TNSPTNILP

SEQ ID NO: 293270 - protein, 9 aa, Homo Sapiens
SGRKQLLVG

SEQ ID NO: 293271 - protein, 9 aa, Homo Sapiens
HQPACKIPD

SEQ ID NO: 293272 - protein, 9 aa, Homo Sapiens
IGPSCDRDC

SEQ ID NO: 293273 - protein, 9 aa, Homo Sapiens
YYKENNPSV

SEQ ID NO: 293274 - protein, 9 aa, Homo Sapiens
NMAGLVKLT

SEQ ID NO: 293275 - protein, 9 aa, Homo Sapiens
SAMEELVKS

SEQ ID NO: 293276 - protein, 9 aa, Homo Sapiens
IQCVQNKPF

SEQ ID NO: 293277 - protein, 9 aa, Homo Sapiens
GARHSKHTV

SEQ ID NO: 293278 - protein, 9 aa, Homo Sapiens
LNTTLYHTK

SEQ ID NO: 293279 - protein, 9 aa, Homo Sapiens
LCDSNIIHH

SEQ ID NO: 293280 - protein, 9 aa, Homo Sapiens
LSFISFLQS

SEQ ID NO: 293281 - protein, 9 aa, Homo Sapiens
SEKMVSSTS

SEQ ID NO: 293282 - protein, 9 aa, Homo Sapiens
GNSIFGMAP

SEQ ID NO: 293283 - protein, 9 aa, Homo Sapiens
KKSLGTTQD

SEQ ID NO: 293284 - protein, 9 aa, Homo Sapiens
VMKPDNMIV

SEQ ID NO: 293285 - protein, 9 aa, Homo Sapiens
DFLHPHPES

SEQ ID NO: 293286 - protein, 9 aa, Homo Sapiens
GNSVNVWPV

SEQ ID NO: 293287 - protein, 9 aa, Homo Sapiens
KLDNSPGHG

SEQ ID NO: 293288 - protein, 9 aa, Homo Sapiens
AEMYTLAAM

SEQ ID NO: 293289 - protein, 9 aa, Homo Sapiens
AHKVAVSLP

SEQ ID NO: 293290 - protein, 9 aa, Homo Sapiens
FSTSFLSYT

SEQ ID NO: 293291 - protein, 9 aa, Homo Sapiens
KAKIKTNKG

SEQ ID NO: 293292 - protein, 9 aa, Homo Sapiens
KTGSFQIVS

SEQ ID NO: 293293 - protein, 9 aa, Homo Sapiens
SANIDTPKG

SEQ ID NO: 293294 - protein, 9 aa, Homo Sapiens
LDFYRELGL

SEQ ID NO: 293295 - protein, 9 aa, Homo Sapiens
GVFRKSVSP

SEQ ID NO: 293296 - protein, 9 aa, Homo Sapiens
IKVTELEIK

SEQ ID NO: 293297 - protein, 9 aa, Homo Sapiens
LNKVVGRVV

SEQ ID NO: 293298 - protein, 9 aa, Homo Sapiens
KLQKLELSD

SEQ ID NO: 293299 - protein, 9 aa, Homo Sapiens
ERLYLPPDL

SEQ ID NO: 293300 - protein, 9 aa, Homo Sapiens
SNDSHYREN

SEQ ID NO: 293301 - protein, 9 aa, Homo Sapiens
ACVNSEEIM

SEQ ID NO: 293302 - protein, 9 aa, Homo Sapiens
QCSRMYGAT

SEQ ID NO: 293303 - protein, 9 aa, Homo Sapiens
SPIIENALV

SEQ ID NO: 293304 - protein, 9 aa, Homo Sapiens
ECVILDIEN

SEQ ID NO: 293305 - protein, 9 aa, Homo Sapiens
GNNSVSYEY

SEQ ID NO: 293306 - protein, 9 aa, Homo Sapiens
TNYPSTPCQ

SEQ ID NO: 293307 - protein, 9 aa, Homo Sapiens
IEKIYPYDV

SEQ ID NO: 293308 - protein, 9 aa, Homo Sapiens
QDNVNLPPS

SEQ ID NO: 293309 - protein, 9 aa, Homo Sapiens
ISGQNSSVW

SEQ ID NO: 293310 - protein, 9 aa, Homo Sapiens
VNNSEVKGA

SEQ ID NO: 293311 - protein, 9 aa, Homo Sapiens
LMEDGSIQI

SEQ ID NO: 293312 - protein, 9 aa, Homo Sapiens
SLFTLTEII

SEQ ID NO: 293313 - protein, 9 aa, Homo Sapiens
RHMDRIGAI

SEQ ID NO: 293314 - protein, 9 aa, Homo Sapiens
CLQDLSSTD

SEQ ID NO: 293315 - protein, 9 aa, Homo Sapiens
LNSQVEYLR

SEQ ID NO: 293316 - protein, 9 aa, Homo Sapiens
NGNPMHVAV

SEQ ID NO: 293317 - protein, 9 aa, Homo Sapiens
SGPKPENPA

SEQ ID NO: 293318 - protein, 9 aa, Homo Sapiens
KQCDQAFSC

SEQ ID NO: 293319 - protein, 9 aa, Homo Sapiens
FSHSIHNFT

SEQ ID NO: 293320 - protein, 9 aa, Homo Sapiens
RPEEIPPMP

SEQ ID NO: 293321 - protein, 9 aa, Homo Sapiens
ILNIYSGIA

SEQ ID NO: 293322 - protein, 9 aa, Homo Sapiens
TSFGPVSYH

SEQ ID NO: 293323 - protein, 9 aa, Homo Sapiens
LKYVDTRKI

SEQ ID NO: 293324 - protein, 9 aa, Homo Sapiens
KRLENRKSG

SEQ ID NO: 293325 - protein, 9 aa, Homo Sapiens
LLVMALDRY

SEQ ID NO: 293326 - protein, 9 aa, Homo Sapiens
IITLREALK

SEQ ID NO: 293327 - protein, 9 aa, Homo Sapiens
LNTCFDIEK

SEQ ID NO: 293328 - protein, 9 aa, Homo Sapiens
YYRYNVSVE

SEQ ID NO: 293329 - protein, 9 aa, Homo Sapiens
VEHNSGPLS

SEQ ID NO: 293330 - protein, 9 aa, Homo Sapiens
LQLQKWYVP

SEQ ID NO: 293331 - protein, 9 aa, Homo Sapiens
WLKLNTKVT

SEQ ID NO: 293332 - protein, 9 aa, Homo Sapiens
CWDPEVCIR

SEQ ID NO: 293333 - protein, 9 aa, Homo Sapiens
NKISWLYRI

SEQ ID NO: 293334 - protein, 9 aa, Homo Sapiens
DKHGDDQPN

SEQ ID NO: 293335 - protein, 9 aa, Homo Sapiens
FCIAWFSLE

SEQ ID NO: 293336 - protein, 9 aa, Homo Sapiens
FCPSNKWCE

SEQ ID NO: 293337 - protein, 9 aa, Homo Sapiens
RLQNQEKRL

SEQ ID NO: 293338 - protein, 9 aa, Homo Sapiens
PLKFRDAET

SEQ ID NO: 293339 - protein, 9 aa, Homo Sapiens
FWKLPSSVA

SEQ ID NO: 293340 - protein, 9 aa, Homo Sapiens
GDKGEAGEK

SEQ ID NO: 293341 - protein, 9 aa, Homo Sapiens
LESFRTREV

SEQ ID NO: 293342 - protein, 9 aa, Homo Sapiens
VMDVHKVNI

SEQ ID NO: 293343 - protein, 9 aa, Homo Sapiens
HRPHSSGCC

SEQ ID NO: 293344 - protein, 9 aa, Homo Sapiens
IHKWREEQR

SEQ ID NO: 293345 - protein, 9 aa, Homo Sapiens
GQYMGQLKR

SEQ ID NO: 293346 - protein, 9 aa, Homo Sapiens
DEWMKIFNP

SEQ ID NO: 293347 - protein, 9 aa, Homo Sapiens
TVYRQKMDC

SEQ ID NO: 293348 - protein, 9 aa, Homo Sapiens
VERNVEAVI

SEQ ID NO: 293349 - protein, 9 aa, Homo Sapiens
NKQPPSISH

SEQ ID NO: 293350 - protein, 9 aa, Homo Sapiens
CGHCHCHQQ

SEQ ID NO: 293351 - protein, 9 aa, Homo Sapiens
VTIQENNPE

SEQ ID NO: 293352 - protein, 9 aa, Homo Sapiens
PKKAQEDPL

SEQ ID NO: 293353 - protein, 9 aa, Homo Sapiens
GEAAFIDTE

SEQ ID NO: 293354 - protein, 9 aa, Homo Sapiens
RQPQPFFAA

SEQ ID NO: 293355 - protein, 9 aa, Homo Sapiens
GHYPKPAHL

SEQ ID NO: 293356 - protein, 9 aa, Homo Sapiens
KEMLEESYK

SEQ ID NO: 293357 - protein, 9 aa, Homo Sapiens
QFIFIYQLP

SEQ ID NO: 293358 - protein, 9 aa, Homo Sapiens
SLSTKSCRV

SEQ ID NO: 293359 - protein, 9 aa, Homo Sapiens
VKARQPQPF

SEQ ID NO: 293360 - protein, 9 aa, Homo Sapiens
EEINQGAMS

SEQ ID NO: 293361 - protein, 9 aa, Homo Sapiens
DTKDRQVED

SEQ ID NO: 293362 - protein, 9 aa, Homo Sapiens
YGDELGLPP

SEQ ID NO: 293363 - protein, 9 aa, Homo Sapiens
AEDTIGQQL

SEQ ID NO: 293364 - protein, 9 aa, Homo Sapiens
QILEEKNNN

SEQ ID NO: 293365 - protein, 9 aa, Homo Sapiens
LAMASSIFR

SEQ ID NO: 293366 - protein, 9 aa, Homo Sapiens
TWCPIMAHG

SEQ ID NO: 293367 - protein, 9 aa, Homo Sapiens
AHEILCLEK

SEQ ID NO: 293368 - protein, 9 aa, Homo Sapiens
LGYVARFYR

SEQ ID NO: 293369 - protein, 9 aa, Homo Sapiens
MVRLSRAEA

SEQ ID NO: 293370 - protein, 9 aa, Homo Sapiens
QNQARLYDT

SEQ ID NO: 293371 - protein, 9 aa, Homo Sapiens
LLKVHYSDC

SEQ ID NO: 293372 - protein, 9 aa, Homo Sapiens
MLLVKDKTL

SEQ ID NO: 293373 - protein, 9 aa, Homo Sapiens
LLSPVCEEL

SEQ ID NO: 293374 - protein, 9 aa, Homo Sapiens
QQMEIVLTS

SEQ ID NO: 293375 - protein, 9 aa, Homo Sapiens
PHPDVCMAD

SEQ ID NO: 293376 - protein, 9 aa, Homo Sapiens
EYLKQKKEQ

SEQ ID NO: 293377 - protein, 9 aa, Homo Sapiens
NIYFYPNGG

SEQ ID NO: 293378 - protein, 9 aa, Homo Sapiens
RLSSYTRLF

SEQ ID NO: 293379 - protein, 9 aa, Homo Sapiens
FTGKTEPGL

SEQ ID NO: 293380 - protein, 9 aa, Homo Sapiens
SSPLRTASS

SEQ ID NO: 293381 - protein, 9 aa, Homo Sapiens
PSYVLTIYD

SEQ ID NO: 293382 - protein, 9 aa, Homo Sapiens
WGEPHAVTI

SEQ ID NO: 293383 - protein, 9 aa, Homo Sapiens
NITNKMDPH

SEQ ID NO: 293384 - protein, 9 aa, Homo Sapiens
HKNKEPDDI

SEQ ID NO: 293385 - protein, 9 aa, Homo Sapiens
REMIPAFQT

SEQ ID NO: 293386 - protein, 9 aa, Homo Sapiens
EYIQQLHSR

SEQ ID NO: 293387 - protein, 9 aa, Homo Sapiens
LLFLPEEED

SEQ ID NO: 293388 - protein, 9 aa, Homo Sapiens
RQESSCSHS

SEQ ID NO: 293389 - protein, 9 aa, Homo Sapiens
RKQMLDILV

SEQ ID NO: 293390 - protein, 9 aa, Homo Sapiens
TINSIQAAQ

SEQ ID NO: 293391 - protein, 9 aa, Homo Sapiens
SKLNETQPI

SEQ ID NO: 293392 - protein, 9 aa, Homo Sapiens
VCQELLYPK

SEQ ID NO: 293393 - protein, 9 aa, Homo Sapiens
FMNNILSYR

SEQ ID NO: 293394 - protein, 9 aa, Homo Sapiens
TAPTSDNDF

SEQ ID NO: 293395 - protein, 9 aa, Homo Sapiens
KQTHSKARS

SEQ ID NO: 293396 - protein, 9 aa, Homo Sapiens
LARSYPRLS

SEQ ID NO: 293397 - protein, 9 aa, Homo Sapiens
LDCDECHSN

SEQ ID NO: 293398 - protein, 9 aa, Homo Sapiens
LLSAFLATQ

SEQ ID NO: 293399 - protein, 9 aa, Homo Sapiens
SVYTHGRVS

SEQ ID NO: 293400 - protein, 9 aa, Homo Sapiens
DWNEWTNDT

SEQ ID NO: 293401 - protein, 9 aa, Homo Sapiens
PASLTPQRE

SEQ ID NO: 293402 - protein, 9 aa, Homo Sapiens
FAGPSLRNM

SEQ ID NO: 293403 - protein, 9 aa, Homo Sapiens
VHHLSVVPR

SEQ ID NO: 293404 - protein, 9 aa, Homo Sapiens
LLRSLVTRI

SEQ ID NO: 293405 - protein, 9 aa, Homo Sapiens
LQFIPEMIC

SEQ ID NO: 293406 - protein, 9 aa, Homo Sapiens
LHGHSRKDN

SEQ ID NO: 293407 - protein, 9 aa, Homo Sapiens
KKIHTGKKP

SEQ ID NO: 293408 - protein, 9 aa, Homo Sapiens
PGKPALSKN

SEQ ID NO: 293409 - protein, 9 aa, Homo Sapiens
AENKISYHL

SEQ ID NO: 293410 - protein, 9 aa, Homo Sapiens
KDVAIEFYQ

SEQ ID NO: 293411 - protein, 9 aa, Homo Sapiens
LLSIFAKEH

SEQ ID NO: 293412 - protein, 9 aa, Homo Sapiens
NMCGKCFSC

SEQ ID NO: 293413 - protein, 9 aa, Homo Sapiens
LFYKYVYTR

SEQ ID NO: 293414 - protein, 9 aa, Homo Sapiens
KAAPVSGPQ

SEQ ID NO: 293415 - protein, 9 aa, Homo Sapiens
TLMPTLEAL

SEQ ID NO: 293416 - protein, 9 aa, Homo Sapiens
RPTLSVTSF

SEQ ID NO: 293417 - protein, 9 aa, Homo Sapiens
IMRIYESYG

SEQ ID NO: 293418 - protein, 9 aa, Homo Sapiens
SFKKPKIIP

SEQ ID NO: 293419 - protein, 9 aa, Homo Sapiens
PVASRQEDT

SEQ ID NO: 293420 - protein, 9 aa, Homo Sapiens
YGISAIKRN

SEQ ID NO: 293421 - protein, 9 aa, Homo Sapiens
TNKLLDNIK

SEQ ID NO: 293422 - protein, 9 aa, Homo Sapiens
WYSSIFAFP

SEQ ID NO: 293423 - protein, 9 aa, Homo Sapiens
RHHILHAGE

SEQ ID NO: 293424 - protein, 9 aa, Homo Sapiens
IIEKNPGLG

SEQ ID NO: 293425 - protein, 9 aa, Homo Sapiens
ECLLERLTD

SEQ ID NO: 293426 - protein, 9 aa, Homo Sapiens
RRKDLAFEF

SEQ ID NO: 293427 - protein, 9 aa, Homo Sapiens
KNVIHNIFS

SEQ ID NO: 293428 - protein, 9 aa, Homo Sapiens
VKKQRTKDI

SEQ ID NO: 293429 - protein, 9 aa, Homo Sapiens
AKTMLESSL

SEQ ID NO: 293430 - protein, 9 aa, Homo Sapiens
QSSDDRRKA

SEQ ID NO: 293431 - protein, 9 aa, Homo Sapiens
TGNYPHLLE

SEQ ID NO: 293432 - protein, 9 aa, Homo Sapiens
HLAAVPGAT

SEQ ID NO: 293433 - protein, 9 aa, Homo Sapiens
FDCWKNNKS

SEQ ID NO: 293434 - protein, 9 aa, Homo Sapiens
KQDELFKRL

SEQ ID NO: 293435 - protein, 9 aa, Homo Sapiens
VFVFCALLL

SEQ ID NO: 293436 - protein, 9 aa, Homo Sapiens
ITFSETGAD

SEQ ID NO: 293437 - protein, 9 aa, Homo Sapiens
EELFVKYKN

SEQ ID NO: 293438 - protein, 9 aa, Homo Sapiens
LGFIVFGSQ

SEQ ID NO: 293439 - protein, 9 aa, Homo Sapiens
DLYVQMKWE

SEQ ID NO: 293440 - protein, 9 aa, Homo Sapiens
QKLELSDNI

SEQ ID NO: 293441 - protein, 9 aa, Homo Sapiens
DTANILESE

SEQ ID NO: 293442 - protein, 9 aa, Homo Sapiens
SYTYRRPLQ

SEQ ID NO: 293443 - protein, 9 aa, Homo Sapiens
IGAQPLCIS

SEQ ID NO: 293444 - protein, 9 aa, Homo Sapiens
SNTTSTQTS

SEQ ID NO: 293445 - protein, 9 aa, Homo Sapiens
FSRKGLYDD

SEQ ID NO: 293446 - protein, 9 aa, Homo Sapiens
AHLITHQRI

SEQ ID NO: 293447 - protein, 9 aa, Homo Sapiens
SQESTASHN

SEQ ID NO: 293448 - protein, 9 aa, Homo Sapiens
LSGNISGSF

SEQ ID NO: 293449 - protein, 9 aa, Homo Sapiens
AVAQEGQCW

SEQ ID NO: 293450 - protein, 9 aa, Homo Sapiens
NKIEDLEKA

SEQ ID NO: 293451 - protein, 9 aa, Homo Sapiens
NTADQLTTG

SEQ ID NO: 293452 - protein, 9 aa, Homo Sapiens
LICHQKIHT

SEQ ID NO: 293453 - protein, 9 aa, Homo Sapiens
SNTVQGQLR

SEQ ID NO: 293454 - protein, 9 aa, Homo Sapiens
KHKAISFWG

SEQ ID NO: 293455 - protein, 9 aa, Homo Sapiens
WADENSRLL

SEQ ID NO: 293456 - protein, 9 aa, Homo Sapiens
KQKQMKYSA

SEQ ID NO: 293457 - protein, 9 aa, Homo Sapiens
GLWRFDGNK

SEQ ID NO: 293458 - protein, 9 aa, Homo Sapiens
FLLQTADGK

SEQ ID NO: 293459 - protein, 9 aa, Homo Sapiens
SRDRVAKVH

SEQ ID NO: 293460 - protein, 9 aa, Homo Sapiens
RRARLHVVA

SEQ ID NO: 293461 - protein, 9 aa, Homo Sapiens
SRMEERSGL

SEQ ID NO: 293462 - protein, 9 aa, Homo Sapiens
MAQDFLQCL

SEQ ID NO: 293463 - protein, 9 aa, Homo Sapiens
EAIPWQRSA

SEQ ID NO: 293464 - protein, 9 aa, Homo Sapiens
GKLMRHQII

SEQ ID NO: 293465 - protein, 9 aa, Homo Sapiens
WVIYLQGSA

SEQ ID NO: 293466 - protein, 9 aa, Homo Sapiens
GNNKYCFDF

SEQ ID NO: 293467 - protein, 9 aa, Homo Sapiens
CYGEISQEE

SEQ ID NO: 293468 - protein, 9 aa, Homo Sapiens
HSEGFISKR

SEQ ID NO: 293469 - protein, 9 aa, Homo Sapiens
LDPSFESEN

SEQ ID NO: 293470 - protein, 9 aa, Homo Sapiens
ALNTTKTQS

SEQ ID NO: 293471 - protein, 9 aa, Homo Sapiens
PLLDEVLHT

SEQ ID NO: 293472 - protein, 9 aa, Homo Sapiens
DQSKKYLYQ

SEQ ID NO: 293473 - protein, 9 aa, Homo Sapiens
GDGNIVRKE

SEQ ID NO: 293474 - protein, 9 aa, Homo Sapiens
LQIHVRTHT

SEQ ID NO: 293475 - protein, 9 aa, Homo Sapiens
SDFEIPTYN

SEQ ID NO: 293476 - protein, 9 aa, Homo Sapiens
TYNNLSDKT

SEQ ID NO: 293477 - protein, 9 aa, Homo Sapiens
CTYFKLFTT

SEQ ID NO: 293478 - protein, 9 aa, Homo Sapiens
NYLMASLVG

SEQ ID NO: 293479 - protein, 9 aa, Homo Sapiens
MRSIVIRVT

SEQ ID NO: 293480 - protein, 9 aa, Homo Sapiens
IQTLSRVEF

SEQ ID NO: 293481 - protein, 9 aa, Homo Sapiens
MKKIIETMT

SEQ ID NO: 293482 - protein, 9 aa, Homo Sapiens
PQTPSECSY

SEQ ID NO: 293483 - protein, 9 aa, Homo Sapiens
FNPHQHTDD

SEQ ID NO: 293484 - protein, 9 aa, Homo Sapiens
GKNRESSDL

SEQ ID NO: 293485 - protein, 9 aa, Homo Sapiens
LKMKPGRPQ

SEQ ID NO: 293486 - protein, 9 aa, Homo Sapiens
DTPKGGFDA

SEQ ID NO: 293487 - protein, 9 aa, Homo Sapiens
INNLDALEN

SEQ ID NO: 293488 - protein, 9 aa, Homo Sapiens
AAGSAMKWG

SEQ ID NO: 293489 - protein, 9 aa, Homo Sapiens
VAVAMYVAG

SEQ ID NO: 293490 - protein, 9 aa, Homo Sapiens
GPLDFRDVA

SEQ ID NO: 293491 - protein, 9 aa, Homo Sapiens
ILLDPKPVA

SEQ ID NO: 293492 - protein, 9 aa, Homo Sapiens
ISKTITMLE

SEQ ID NO: 293493 - protein, 9 aa, Homo Sapiens
VGSSPLRTA

SEQ ID NO: 293494 - protein, 9 aa, Homo Sapiens
ISHSNKVLH

SEQ ID NO: 293495 - protein, 9 aa, Homo Sapiens
ELLQHPYLK

SEQ ID NO: 293496 - protein, 9 aa, Homo Sapiens
KANKFTIDK

SEQ ID NO: 293497 - protein, 9 aa, Homo Sapiens
LETKSQSDE

SEQ ID NO: 293498 - protein, 9 aa, Homo Sapiens
ILNQNHRDA

SEQ ID NO: 293499 - protein, 9 aa, Homo Sapiens
QTPSECSYY

SEQ ID NO: 293500 - protein, 9 aa, Homo Sapiens
ADGVIKSIL

SEQ ID NO: 293501 - protein, 9 aa, Homo Sapiens
LSKRSLRYL

SEQ ID NO: 293502 - protein, 9 aa, Homo Sapiens
IYLVEDVSS

SEQ ID NO: 293503 - protein, 9 aa, Homo Sapiens
LQCNHTSCG

SEQ ID NO: 293504 - protein, 9 aa, Homo Sapiens
AEIDILIIG

SEQ ID NO: 293505 - protein, 9 aa, Homo Sapiens
FATFNEVQS

SEQ ID NO: 293506 - protein, 9 aa, Homo Sapiens
NKNLQEDIS

SEQ ID NO: 293507 - protein, 9 aa, Homo Sapiens
ICLGGPEPW

SEQ ID NO: 293508 - protein, 9 aa, Homo Sapiens
VCIGADDKK

SEQ ID NO: 293509 - protein, 9 aa, Homo Sapiens
LQIMKQTHK

SEQ ID NO: 293510 - protein, 9 aa, Homo Sapiens
EEEERQIIL

SEQ ID NO: 293511 - protein, 9 aa, Homo Sapiens
AQPLCISFK

SEQ ID NO: 293512 - protein, 9 aa, Homo Sapiens
IETANVREY

SEQ ID NO: 293513 - protein, 9 aa, Homo Sapiens
NTGARPYVC

SEQ ID NO: 293514 - protein, 9 aa, Homo Sapiens
KVIKIVGLA

SEQ ID NO: 293515 - protein, 9 aa, Homo Sapiens
LLGHLSADM

SEQ ID NO: 293516 - protein, 9 aa, Homo Sapiens
TTKLKVEEE

SEQ ID NO: 293517 - protein, 9 aa, Homo Sapiens
SSFELFEEA

SEQ ID NO: 293518 - protein, 9 aa, Homo Sapiens
DNRVILLDP

SEQ ID NO: 293519 - protein, 9 aa, Homo Sapiens
KCRALTHLG

SEQ ID NO: 293520 - protein, 9 aa, Homo Sapiens
VVAGEDFPP

SEQ ID NO: 293521 - protein, 9 aa, Homo Sapiens
VRASSCREH

SEQ ID NO: 293522 - protein, 9 aa, Homo Sapiens
QILPTKENF

SEQ ID NO: 293523 - protein, 9 aa, Homo Sapiens
FPGLHLENC

SEQ ID NO: 293524 - protein, 9 aa, Homo Sapiens
KFSATLQAL

SEQ ID NO: 293525 - protein, 9 aa, Homo Sapiens
NQIVSHLHI

SEQ ID NO: 293526 - protein, 9 aa, Homo Sapiens
KRLTREAMQ

SEQ ID NO: 293527 - protein, 9 aa, Homo Sapiens
AKKTTFQKK

SEQ ID NO: 293528 - protein, 9 aa, Homo Sapiens
VFFDFSTKD

SEQ ID NO: 293529 - protein, 9 aa, Homo Sapiens
GSPSGGLSN

SEQ ID NO: 293530 - protein, 9 aa, Homo Sapiens
VDLKNNLEY

SEQ ID NO: 293531 - protein, 9 aa, Homo Sapiens
LLNKLDKTI

SEQ ID NO: 293532 - protein, 9 aa, Homo Sapiens
VFYNKLLEK

SEQ ID NO: 293533 - protein, 9 aa, Homo Sapiens
DLETKSQSD

SEQ ID NO: 293534 - protein, 9 aa, Homo Sapiens
EELNNNVTE

SEQ ID NO: 293535 - protein, 9 aa, Homo Sapiens
RCRPAAGRP

SEQ ID NO: 293536 - protein, 9 aa, Homo Sapiens
SNEDPSSLR

SEQ ID NO: 293537 - protein, 9 aa, Homo Sapiens
EIEGNDCPF

SEQ ID NO: 293538 - protein, 9 aa, Homo Sapiens
KVVTLTAGL

SEQ ID NO: 293539 - protein, 9 aa, Homo Sapiens
GIIWKLGSE

SEQ ID NO: 293540 - protein, 9 aa, Homo Sapiens
SFLCNLDIA

SEQ ID NO: 293541 - protein, 9 aa, Homo Sapiens
FWSRKIAVE

SEQ ID NO: 293542 - protein, 9 aa, Homo Sapiens
TDDMGLKTY

SEQ ID NO: 293543 - protein, 9 aa, Homo Sapiens
SASKRDLST

SEQ ID NO: 293544 - protein, 9 aa, Homo Sapiens
TPSSSNGHK

SEQ ID NO: 293545 - protein, 9 aa, Homo Sapiens
NGELMTHKL

SEQ ID NO: 293546 - protein, 9 aa, Homo Sapiens
NPQIFKKKQ

SEQ ID NO: 293547 - protein, 9 aa, Homo Sapiens
DPWVQQLIL

SEQ ID NO: 293548 - protein, 9 aa, Homo Sapiens
PEPPGKPGR

SEQ ID NO: 293549 - protein, 9 aa, Homo Sapiens
ASTLSQLPT

SEQ ID NO: 293550 - protein, 9 aa, Homo Sapiens
DKQTGETNI

SEQ ID NO: 293551 - protein, 9 aa, Homo Sapiens
FQNHEPEFD

SEQ ID NO: 293552 - protein, 9 aa, Homo Sapiens
TGDKNDVDL

SEQ ID NO: 293553 - protein, 9 aa, Homo Sapiens
QLQIASFSQ

SEQ ID NO: 293554 - protein, 9 aa, Homo Sapiens
SSVMKPDNM

SEQ ID NO: 293555 - protein, 9 aa, Homo Sapiens
AKEEQEEVE

SEQ ID NO: 293556 - protein, 9 aa, Homo Sapiens
TVTDMDVVY

SEQ ID NO: 293557 - protein, 9 aa, Homo Sapiens
FIFKKTVCD

SEQ ID NO: 293558 - protein, 9 aa, Homo Sapiens
KNRLSLTFF

SEQ ID NO: 293559 - protein, 9 aa, Homo Sapiens
PTQKLLLKR

SEQ ID NO: 293560 - protein, 9 aa, Homo Sapiens
CAEEAVAGG

SEQ ID NO: 293561 - protein, 9 aa, Homo Sapiens
ELKQRLSVF

SEQ ID NO: 293562 - protein, 9 aa, Homo Sapiens
LQIASADGR

SEQ ID NO: 293563 - protein, 9 aa, Homo Sapiens
ELFQFLYPK

SEQ ID NO: 293564 - protein, 9 aa, Homo Sapiens
MWVKKITDL

SEQ ID NO: 293565 - protein, 9 aa, Homo Sapiens
LAEPQELWV

SEQ ID NO: 293566 - protein, 9 aa, Homo Sapiens
LSIQCQALN

SEQ ID NO: 293567 - protein, 9 aa, Homo Sapiens
HHHDNHCGS

SEQ ID NO: 293568 - protein, 9 aa, Homo Sapiens
NISETWRRR

SEQ ID NO: 293569 - protein, 9 aa, Homo Sapiens
SSFVLPCFG

SEQ ID NO: 293570 - protein, 9 aa, Homo Sapiens
LEVGYIVSV

SEQ ID NO: 293571 - protein, 9 aa, Homo Sapiens
CAPSSPRTH

SEQ ID NO: 293572 - protein, 9 aa, Homo Sapiens
TMPASKKYT

SEQ ID NO: 293573 - protein, 9 aa, Homo Sapiens
GPPPGHLVG

SEQ ID NO: 293574 - protein, 9 aa, Homo Sapiens
SQSVSENYF

SEQ ID NO: 293575 - protein, 9 aa, Homo Sapiens
KVYLKALLR

SEQ ID NO: 293576 - protein, 9 aa, Homo Sapiens
DTKDQSHDI

SEQ ID NO: 293577 - protein, 9 aa, Homo Sapiens
VLRTPGSCR

SEQ ID NO: 293578 - protein, 9 aa, Homo Sapiens
VCDKHKIIF

SEQ ID NO: 293579 - protein, 9 aa, Homo Sapiens
NSPNVLKMI

SEQ ID NO: 293580 - protein, 9 aa, Homo Sapiens
EAFIQSILS

SEQ ID NO: 293581 - protein, 9 aa, Homo Sapiens
SSQPKEFSE

SEQ ID NO: 293582 - protein, 9 aa, Homo Sapiens
HPAAHNRFL

SEQ ID NO: 293583 - protein, 9 aa, Homo Sapiens
LGSTEWADE

SEQ ID NO: 293584 - protein, 9 aa, Homo Sapiens
AISQDSLAA

SEQ ID NO: 293585 - protein, 9 aa, Homo Sapiens
QFGTVITLI

SEQ ID NO: 293586 - protein, 9 aa, Homo Sapiens
GHSLTVTTA

SEQ ID NO: 293587 - protein, 9 aa, Homo Sapiens
GYCIDQLPI

SEQ ID NO: 293588 - protein, 9 aa, Homo Sapiens
GSSKKIARR

SEQ ID NO: 293589 - protein, 9 aa, Homo Sapiens
DGEFMETKR

SEQ ID NO: 293590 - protein, 9 aa, Homo Sapiens
SSYTHGLNI

SEQ ID NO: 293591 - protein, 9 aa, Homo Sapiens
CIGPSCDRD

SEQ ID NO: 293592 - protein, 9 aa, Homo Sapiens
TYRNDLIDF

SEQ ID NO: 293593 - protein, 9 aa, Homo Sapiens
PLESMDSAF

SEQ ID NO: 293594 - protein, 9 aa, Homo Sapiens
GQKIIKNNL

SEQ ID NO: 293595 - protein, 9 aa, Homo Sapiens
SVPTPLPIQ

SEQ ID NO: 293596 - protein, 9 aa, Homo Sapiens
FIASSDLPP

SEQ ID NO: 293597 - protein, 9 aa, Homo Sapiens
LQKKLIGAK

SEQ ID NO: 293598 - protein, 9 aa, Homo Sapiens
AKVQELSKN

SEQ ID NO: 293599 - protein, 9 aa, Homo Sapiens
SECGQSFTC

SEQ ID NO: 293600 - protein, 9 aa, Homo Sapiens
NYGIQNYRF

SEQ ID NO: 293601 - protein, 9 aa, Homo Sapiens
LAQRKEEHQ

SEQ ID NO: 293602 - protein, 9 aa, Homo Sapiens
HQIIHRGEK

SEQ ID NO: 293603 - protein, 9 aa, Homo Sapiens
IRAVLIDKD

SEQ ID NO: 293604 - protein, 9 aa, Homo Sapiens
CGLNTDGQL

SEQ ID NO: 293605 - protein, 9 aa, Homo Sapiens
TYVNNPEDN

SEQ ID NO: 293606 - protein, 9 aa, Homo Sapiens
NAITGITIL

SEQ ID NO: 293607 - protein, 9 aa, Homo Sapiens
YQWIQGWLK

SEQ ID NO: 293608 - protein, 9 aa, Homo Sapiens
DWNRGATTF

SEQ ID NO: 293609 - protein, 9 aa, Homo Sapiens
HDALAFFNS

SEQ ID NO: 293610 - protein, 9 aa, Homo Sapiens
FRLHRKVHT

SEQ ID NO: 293611 - protein, 9 aa, Homo Sapiens
AVQMKQKNK

SEQ ID NO: 293612 - protein, 9 aa, Homo Sapiens
EHALLQKHP

SEQ ID NO: 293613 - protein, 9 aa, Homo Sapiens
ATKNDLFLV

SEQ ID NO: 293614 - protein, 9 aa, Homo Sapiens
RVFKTKKRR

SEQ ID NO: 293615 - protein, 9 aa, Homo Sapiens
VILVQYKAA

SEQ ID NO: 293616 - protein, 9 aa, Homo Sapiens
NPAWAVWEE

SEQ ID NO: 293617 - protein, 9 aa, Homo Sapiens
EEVCEHVKL

SEQ ID NO: 293618 - protein, 9 aa, Homo Sapiens
AVLTKSVSL

SEQ ID NO: 293619 - protein, 9 aa, Homo Sapiens
KHGSMESIW

SEQ ID NO: 293620 - protein, 9 aa, Homo Sapiens
QGYFPPRDF

SEQ ID NO: 293621 - protein, 9 aa, Homo Sapiens
GVGRHSLKN

SEQ ID NO: 293622 - protein, 9 aa, Homo Sapiens
GAGVTLECE

SEQ ID NO: 293623 - protein, 9 aa, Homo Sapiens
SYRQQAADL

SEQ ID NO: 293624 - protein, 9 aa, Homo Sapiens
LFATFNEVQ

SEQ ID NO: 293625 - protein, 9 aa, Homo Sapiens
STVCVGLAF

SEQ ID NO: 293626 - protein, 9 aa, Homo Sapiens
SVLEQLHQT

SEQ ID NO: 293627 - protein, 9 aa, Homo Sapiens
NKGTLANDF

SEQ ID NO: 293628 - protein, 9 aa, Homo Sapiens
KRIDTEMTT

SEQ ID NO: 293629 - protein, 9 aa, Homo Sapiens
KELLQHPYL

SEQ ID NO: 293630 - protein, 9 aa, Homo Sapiens
TSLEKILTM

SEQ ID NO: 293631 - protein, 9 aa, Homo Sapiens
CGNFFRYIS

SEQ ID NO: 293632 - protein, 9 aa, Homo Sapiens
TYSQEERHN

SEQ ID NO: 293633 - protein, 9 aa, Homo Sapiens
AHKEQGKEQ

SEQ ID NO: 293634 - protein, 9 aa, Homo Sapiens
IHQITHTGE

SEQ ID NO: 293635 - protein, 9 aa, Homo Sapiens
SEVQRLAKK

SEQ ID NO: 293636 - protein, 9 aa, Homo Sapiens
SAQILDNYL

SEQ ID NO: 293637 - protein, 9 aa, Homo Sapiens
GEHFELFSL

SEQ ID NO: 293638 - protein, 9 aa, Homo Sapiens
STLRYWGTM

SEQ ID NO: 293639 - protein, 9 aa, Homo Sapiens
LPKCLQDLS

SEQ ID NO: 293640 - protein, 9 aa, Homo Sapiens
PESVQGRQK

SEQ ID NO: 293641 - protein, 9 aa, Homo Sapiens
EFNYLHNQN

SEQ ID NO: 293642 - protein, 9 aa, Homo Sapiens
CDKHKIIFC

SEQ ID NO: 293643 - protein, 9 aa, Homo Sapiens
HQSLSVHQR

SEQ ID NO: 293644 - protein, 9 aa, Homo Sapiens
TWILKDSLG

SEQ ID NO: 293645 - protein, 9 aa, Homo Sapiens
FDSPSLCQR

SEQ ID NO: 293646 - protein, 9 aa, Homo Sapiens
HSKARSSPK

SEQ ID NO: 293647 - protein, 9 aa, Homo Sapiens
GPSSGYCID

SEQ ID NO: 293648 - protein, 9 aa, Homo Sapiens
NNYNMYIFP

SEQ ID NO: 293649 - protein, 9 aa, Homo Sapiens
VSRAVNWQE

SEQ ID NO: 293650 - protein, 9 aa, Homo Sapiens
YPQLEQRYD

SEQ ID NO: 293651 - protein, 9 aa, Homo Sapiens
YSELSGDVD

SEQ ID NO: 293652 - protein, 9 aa, Homo Sapiens
QPSLRAWQA

SEQ ID NO: 293653 - protein, 9 aa, Homo Sapiens
FIILMECMN

SEQ ID NO: 293654 - protein, 9 aa, Homo Sapiens
QSHLSRHHI

SEQ ID NO: 293655 - protein, 9 aa, Homo Sapiens
STNLIRHRK

SEQ ID NO: 293656 - protein, 9 aa, Homo Sapiens
CLRLSLGPQ

SEQ ID NO: 293657 - protein, 9 aa, Homo Sapiens
GNETMLDFQ

SEQ ID NO: 293658 - protein, 9 aa, Homo Sapiens
FSSVMKHLS

SEQ ID NO: 293659 - protein, 9 aa, Homo Sapiens
NECLCTFRE

SEQ ID NO: 293660 - protein, 9 aa, Homo Sapiens
EEAYYKEKS

SEQ ID NO: 293661 - protein, 9 aa, Homo Sapiens
SKYDSLDSD

SEQ ID NO: 293662 - protein, 9 aa, Homo Sapiens
SEHALLQKH

SEQ ID NO: 293663 - protein, 9 aa, Homo Sapiens
SNPKYMNRT

SEQ ID NO: 293664 - protein, 9 aa, Homo Sapiens
TQNQVLINS

SEQ ID NO: 293665 - protein, 9 aa, Homo Sapiens
CQSKMKPSW

SEQ ID NO: 293666 - protein, 9 aa, Homo Sapiens
PTSWPKLIT

SEQ ID NO: 293667 - protein, 9 aa, Homo Sapiens
PCPEKCAKH

SEQ ID NO: 293668 - protein, 9 aa, Homo Sapiens
LLQFTVEHT

SEQ ID NO: 293669 - protein, 9 aa, Homo Sapiens
KPAEFTQHI

SEQ ID NO: 293670 - protein, 9 aa, Homo Sapiens
PSNLKLEAK

SEQ ID NO: 293671 - protein, 9 aa, Homo Sapiens
VLSPRYDPD

SEQ ID NO: 293672 - protein, 9 aa, Homo Sapiens
PASSSTQII

SEQ ID NO: 293673 - protein, 9 aa, Homo Sapiens
LIQHKIIHT

SEQ ID NO: 293674 - protein, 9 aa, Homo Sapiens
IRHEDIHQQ

SEQ ID NO: 293675 - protein, 9 aa, Homo Sapiens
SAFLATQAR

SEQ ID NO: 293676 - protein, 9 aa, Homo Sapiens
KITARLCDL

SEQ ID NO: 293677 - protein, 9 aa, Homo Sapiens
LLEFSDIFF

SEQ ID NO: 293678 - protein, 9 aa, Homo Sapiens
CMVNNNLSF

SEQ ID NO: 293679 - protein, 9 aa, Homo Sapiens
QSILSKPFK

SEQ ID NO: 293680 - protein, 9 aa, Homo Sapiens
PLMDQGDIS

SEQ ID NO: 293681 - protein, 9 aa, Homo Sapiens
VVNNITAKG

SEQ ID NO: 293682 - protein, 9 aa, Homo Sapiens
INGNSVNVW

SEQ ID NO: 293683 - protein, 9 aa, Homo Sapiens
GFSGLCGTL

SEQ ID NO: 293684 - protein, 9 aa, Homo Sapiens
VRRKAGYNK

SEQ ID NO: 293685 - protein, 9 aa, Homo Sapiens
EQIDGKAVL

SEQ ID NO: 293686 - protein, 9 aa, Homo Sapiens
YTEKEKLIR

SEQ ID NO: 293687 - protein, 9 aa, Homo Sapiens
RQLDRIIAT

SEQ ID NO: 293688 - protein, 9 aa, Homo Sapiens
CALLLVLIF

SEQ ID NO: 293689 - protein, 9 aa, Homo Sapiens
EQGDKPWRE

SEQ ID NO: 293690 - protein, 9 aa, Homo Sapiens
AHQIVQLIQ

SEQ ID NO: 293691 - protein, 9 aa, Homo Sapiens
INVYPPRGF

SEQ ID NO: 293692 - protein, 9 aa, Homo Sapiens
LEDIIAENL

SEQ ID NO: 293693 - protein, 9 aa, Homo Sapiens
TSLPVHNSN

SEQ ID NO: 293694 - protein, 9 aa, Homo Sapiens
AFLLQTADG

SEQ ID NO: 293695 - protein, 9 aa, Homo Sapiens
KLIAYSTVF

SEQ ID NO: 293696 - protein, 9 aa, Homo Sapiens
PTRGKHAWT

SEQ ID NO: 293697 - protein, 9 aa, Homo Sapiens
GKQTKRGGG

SEQ ID NO: 293698 - protein, 9 aa, Homo Sapiens
NRSSYLIQH

SEQ ID NO: 293699 - protein, 9 aa, Homo Sapiens
TNYANVVCR

SEQ ID NO: 293700 - protein, 9 aa, Homo Sapiens
DADIVHHCI

SEQ ID NO: 293701 - protein, 9 aa, Homo Sapiens
LDPYTELQK

SEQ ID NO: 293702 - protein, 9 aa, Homo Sapiens
TTAYSKLNE

SEQ ID NO: 293703 - protein, 9 aa, Homo Sapiens
DKPWREENE

SEQ ID NO: 293704 - protein, 9 aa, Homo Sapiens
RVIDQDTAN

SEQ ID NO: 293705 - protein, 9 aa, Homo Sapiens
GMKPRHCLL

SEQ ID NO: 293706 - protein, 9 aa, Homo Sapiens
DLFDRYMAT

SEQ ID NO: 293707 - protein, 9 aa, Homo Sapiens
REKRDKKAT

SEQ ID NO: 293708 - protein, 9 aa, Homo Sapiens
EWTTLYGEI

SEQ ID NO: 293709 - protein, 9 aa, Homo Sapiens
QKEDNEVYV

SEQ ID NO: 293710 - protein, 9 aa, Homo Sapiens
TGQDMLFVF

SEQ ID NO: 293711 - protein, 9 aa, Homo Sapiens
DPVCALQAC

SEQ ID NO: 293712 - protein, 9 aa, Homo Sapiens
CLLVCILKA

SEQ ID NO: 293713 - protein, 9 aa, Homo Sapiens
QMLNMDRVN

SEQ ID NO: 293714 - protein, 9 aa, Homo Sapiens
LVDYSSSSP

SEQ ID NO: 293715 - protein, 9 aa, Homo Sapiens
IALPFVEVS

SEQ ID NO: 293716 - protein, 9 aa, Homo Sapiens
IYDVPPVWG

SEQ ID NO: 293717 - protein, 9 aa, Homo Sapiens
LIYLVEDVS

SEQ ID NO: 293718 - protein, 9 aa, Homo Sapiens
FDYCKIKHI

SEQ ID NO: 293719 - protein, 9 aa, Homo Sapiens
ERLRVYLER

SEQ ID NO: 293720 - protein, 9 aa, Homo Sapiens
EDRDYMDTI

SEQ ID NO: 293721 - protein, 9 aa, Homo Sapiens
CDVSSELLE

SEQ ID NO: 293722 - protein, 9 aa, Homo Sapiens
QRITYLHTQ

SEQ ID NO: 293723 - protein, 9 aa, Homo Sapiens
MTWAAKIDG

SEQ ID NO: 293724 - protein, 9 aa, Homo Sapiens
SGGKPMIIY

SEQ ID NO: 293725 - protein, 9 aa, Homo Sapiens
FRYATYYKE

SEQ ID NO: 293726 - protein, 9 aa, Homo Sapiens
VFGLGYVAH

SEQ ID NO: 293727 - protein, 9 aa, Homo Sapiens
VRGDHPAAH

SEQ ID NO: 293728 - protein, 9 aa, Homo Sapiens
SSSRIIHQR

SEQ ID NO: 293729 - protein, 9 aa, Homo Sapiens
VRDINEALK

SEQ ID NO: 293730 - protein, 9 aa, Homo Sapiens
QSLSRALFK

SEQ ID NO: 293731 - protein, 9 aa, Homo Sapiens
FDVAVLHCL

SEQ ID NO: 293732 - protein, 9 aa, Homo Sapiens
ANEKTLISS

SEQ ID NO: 293733 - protein, 9 aa, Homo Sapiens
EVLIKTGAD

SEQ ID NO: 293734 - protein, 9 aa, Homo Sapiens
NIPKYVEFM

SEQ ID NO: 293735 - protein, 9 aa, Homo Sapiens
PLKFIPCRG

SEQ ID NO: 293736 - protein, 9 aa, Homo Sapiens
SQSVLSVYT

SEQ ID NO: 293737 - protein, 9 aa, Homo Sapiens
TAAKVSKQS

SEQ ID NO: 293738 - protein, 9 aa, Homo Sapiens
GHEKIHTGE

SEQ ID NO: 293739 - protein, 9 aa, Homo Sapiens
LNLKGGTNA

SEQ ID NO: 293740 - protein, 9 aa, Homo Sapiens
NCKTKDLKK

SEQ ID NO: 293741 - protein, 9 aa, Homo Sapiens
RCYNKKVFA

SEQ ID NO: 293742 - protein, 9 aa, Homo Sapiens
VSMSRLHLC

SEQ ID NO: 293743 - protein, 9 aa, Homo Sapiens
LQSLVLAEN

SEQ ID NO: 293744 - protein, 9 aa, Homo Sapiens
PHNVPYIVH

SEQ ID NO: 293745 - protein, 9 aa, Homo Sapiens
AQGVGRHSL

SEQ ID NO: 293746 - protein, 9 aa, Homo Sapiens
GGEDESINA

SEQ ID NO: 293747 - protein, 9 aa, Homo Sapiens
PTFQRLFGA

SEQ ID NO: 293748 - protein, 9 aa, Homo Sapiens
VTLDEFIES

SEQ ID NO: 293749 - protein, 9 aa, Homo Sapiens
KWEEHSVKD

SEQ ID NO: 293750 - protein, 9 aa, Homo Sapiens
GALNKVVGR

SEQ ID NO: 293751 - protein, 9 aa, Homo Sapiens
GIINRDLKP

SEQ ID NO: 293752 - protein, 9 aa, Homo Sapiens
ICLLQTLSL

SEQ ID NO: 293753 - protein, 9 aa, Homo Sapiens
RESIPFVVD

SEQ ID NO: 293754 - protein, 9 aa, Homo Sapiens
VSHLHIHVF

SEQ ID NO: 293755 - protein, 9 aa, Homo Sapiens
PQLDLSKIK

SEQ ID NO: 293756 - protein, 9 aa, Homo Sapiens
TSLALSRSS

SEQ ID NO: 293757 - protein, 9 aa, Homo Sapiens
SIDEEGCIQ

SEQ ID NO: 293758 - protein, 9 aa, Homo Sapiens
TQTHWEKFV

SEQ ID NO: 293759 - protein, 9 aa, Homo Sapiens
SPFAAGPQP

SEQ ID NO: 293760 - protein, 9 aa, Homo Sapiens
KNWTSSQRC

SEQ ID NO: 293761 - protein, 9 aa, Homo Sapiens
PGRPQIKKD

SEQ ID NO: 293762 - protein, 9 aa, Homo Sapiens
RSSMQVLGD

SEQ ID NO: 293763 - protein, 9 aa, Homo Sapiens
KWGLYIAVI

SEQ ID NO: 293764 - protein, 9 aa, Homo Sapiens
CTCYRASQV

SEQ ID NO: 293765 - protein, 9 aa, Homo Sapiens
NERIQEVTG

SEQ ID NO: 293766 - protein, 9 aa, Homo Sapiens
KDADYRLRR

SEQ ID NO: 293767 - protein, 9 aa, Homo Sapiens
SKESVRNDS

SEQ ID NO: 293768 - protein, 9 aa, Homo Sapiens
LMSPDILHI

SEQ ID NO: 293769 - protein, 9 aa, Homo Sapiens
HYEVAKMIR

SEQ ID NO: 293770 - protein, 9 aa, Homo Sapiens
GKLLVKNIV

SEQ ID NO: 293771 - protein, 9 aa, Homo Sapiens
PSRNTDETL

SEQ ID NO: 293772 - protein, 9 aa, Homo Sapiens
GANPNVRAM

SEQ ID NO: 293773 - protein, 9 aa, Homo Sapiens
AVIKEAFAS

SEQ ID NO: 293774 - protein, 9 aa, Homo Sapiens
ANMYASILT

SEQ ID NO: 293775 - protein, 9 aa, Homo Sapiens
FVRKFILLG

SEQ ID NO: 293776 - protein, 9 aa, Homo Sapiens
CALLGIPLF

SEQ ID NO: 293777 - protein, 9 aa, Homo Sapiens
ESLKKQLQQ

SEQ ID NO: 293778 - protein, 9 aa, Homo Sapiens
HLCPQPPKT

SEQ ID NO: 293779 - protein, 9 aa, Homo Sapiens
HKHKKFRQK

SEQ ID NO: 293780 - protein, 9 aa, Homo Sapiens
QSKETCAPS

SEQ ID NO: 293781 - protein, 9 aa, Homo Sapiens
LPDNFSPLS

SEQ ID NO: 293782 - protein, 9 aa, Homo Sapiens
DQCCPVCPD

SEQ ID NO: 293783 - protein, 9 aa, Homo Sapiens
ASVLRGLVS

SEQ ID NO: 293784 - protein, 9 aa, Homo Sapiens
EPTEGSIIL

SEQ ID NO: 293785 - protein, 9 aa, Homo Sapiens
DRHADGLLW

SEQ ID NO: 293786 - protein, 9 aa, Homo Sapiens
TSFLDASTM

SEQ ID NO: 293787 - protein, 9 aa, Homo Sapiens
PPSSLVINK

SEQ ID NO: 293788 - protein, 9 aa, Homo Sapiens
LGLKNIFYI

SEQ ID NO: 293789 - protein, 9 aa, Homo Sapiens
RDNEKPTCK

SEQ ID NO: 293790 - protein, 9 aa, Homo Sapiens
ANTVDLSFS

SEQ ID NO: 293791 - protein, 9 aa, Homo Sapiens
SCKGRIDLA

SEQ ID NO: 293792 - protein, 9 aa, Homo Sapiens
YIRTSYDTT

SEQ ID NO: 293793 - protein, 9 aa, Homo Sapiens
YTTLKKSKI

SEQ ID NO: 293794 - protein, 9 aa, Homo Sapiens
NVSNIHSSC

SEQ ID NO: 293795 - protein, 9 aa, Homo Sapiens
RLFTNLNFV

SEQ ID NO: 293796 - protein, 9 aa, Homo Sapiens
RDIFGKDAK

SEQ ID NO: 293797 - protein, 9 aa, Homo Sapiens
SQPKIGKWD

SEQ ID NO: 293798 - protein, 9 aa, Homo Sapiens
RPPLKELFV

SEQ ID NO: 293799 - protein, 9 aa, Homo Sapiens
CQITNETAS

SEQ ID NO: 293800 - protein, 9 aa, Homo Sapiens
VPEFILVGY

SEQ ID NO: 293801 - protein, 9 aa, Homo Sapiens
DLYHADRAI

SEQ ID NO: 293802 - protein, 9 aa, Homo Sapiens
KELNNLLAF

SEQ ID NO: 293803 - protein, 9 aa, Homo Sapiens
TEKGKKINK

SEQ ID NO: 293804 - protein, 9 aa, Homo Sapiens
WASEKDLCL

SEQ ID NO: 293805 - protein, 9 aa, Homo Sapiens
RIHKYKRQL

SEQ ID NO: 293806 - protein, 9 aa, Homo Sapiens
NNSLETKSG

SEQ ID NO: 293807 - protein, 9 aa, Homo Sapiens
YLFDNPRRY

SEQ ID NO: 293808 - protein, 9 aa, Homo Sapiens
NKFLLEHHT

SEQ ID NO: 293809 - protein, 9 aa, Homo Sapiens
QPSSGLSGT

SEQ ID NO: 293810 - protein, 9 aa, Homo Sapiens
LFGDLNNFR

SEQ ID NO: 293811 - protein, 9 aa, Homo Sapiens
DITAKEEQE

SEQ ID NO: 293812 - protein, 9 aa, Homo Sapiens
PPLKELFVD

SEQ ID NO: 293813 - protein, 9 aa, Homo Sapiens
KEQRKANRA

SEQ ID NO: 293814 - protein, 9 aa, Homo Sapiens
GCPSECTCY

SEQ ID NO: 293815 - protein, 9 aa, Homo Sapiens
QDKLKAIEP

SEQ ID NO: 293816 - protein, 9 aa, Homo Sapiens
EIMRPVKAA

SEQ ID NO: 293817 - protein, 9 aa, Homo Sapiens
INGALLVLG

SEQ ID NO: 293818 - protein, 9 aa, Homo Sapiens
LKNVIHNIF

SEQ ID NO: 293819 - protein, 9 aa, Homo Sapiens
VGYWKKHFT

SEQ ID NO: 293820 - protein, 9 aa, Homo Sapiens
PATSLPVHN

SEQ ID NO: 293821 - protein, 9 aa, Homo Sapiens
KLCETPKIS

SEQ ID NO: 293822 - protein, 9 aa, Homo Sapiens
KFSETAFAG

SEQ ID NO: 293823 - protein, 9 aa, Homo Sapiens
METNLSKLQ

SEQ ID NO: 293824 - protein, 9 aa, Homo Sapiens
EQLSVVKGI

SEQ ID NO: 293825 - protein, 9 aa, Homo Sapiens
YDVYSTFQN

SEQ ID NO: 293826 - protein, 9 aa, Homo Sapiens
NKESEVYKM

SEQ ID NO: 293827 - protein, 9 aa, Homo Sapiens
VCENCKPLR

SEQ ID NO: 293828 - protein, 9 aa, Homo Sapiens
SAGPAIIRH

SEQ ID NO: 293829 - protein, 9 aa, Homo Sapiens
YNECGKAFI

SEQ ID NO: 293830 - protein, 9 aa, Homo Sapiens
LEYGNYTVL

SEQ ID NO: 293831 - protein, 9 aa, Homo Sapiens
EDPSSLRAS

SEQ ID NO: 293832 - protein, 9 aa, Homo Sapiens
QGRFGGVIT

SEQ ID NO: 293833 - protein, 9 aa, Homo Sapiens
QVILHLGTH

SEQ ID NO: 293834 - protein, 9 aa, Homo Sapiens
PSTFYFVPP

SEQ ID NO: 293835 - protein, 9 aa, Homo Sapiens
ISLKRVTVV

SEQ ID NO: 293836 - protein, 9 aa, Homo Sapiens
EANSGYGSY

SEQ ID NO: 293837 - protein, 9 aa, Homo Sapiens
EKKEGRIDY

SEQ ID NO: 293838 - protein, 9 aa, Homo Sapiens
GKKQNPGLK

SEQ ID NO: 293839 - protein, 9 aa, Homo Sapiens
LLSECDAAK

SEQ ID NO: 293840 - protein, 9 aa, Homo Sapiens
GDFKKFENK

SEQ ID NO: 293841 - protein, 9 aa, Homo Sapiens
TGKRKIQEE

SEQ ID NO: 293842 - protein, 9 aa, Homo Sapiens
EGVHQEYKE

SEQ ID NO: 293843 - protein, 9 aa, Homo Sapiens
QLPPACAVP

SEQ ID NO: 293844 - protein, 9 aa, Homo Sapiens
KVREWYSSI

SEQ ID NO: 293845 - protein, 9 aa, Homo Sapiens
IKYAPGAGS

SEQ ID NO: 293846 - protein, 9 aa, Homo Sapiens
QRSMSINLS

SEQ ID NO: 293847 - protein, 9 aa, Homo Sapiens
NLILQNQIQ

SEQ ID NO: 293848 - protein, 9 aa, Homo Sapiens
QMNDAQHGG

SEQ ID NO: 293849 - protein, 9 aa, Homo Sapiens
MVNNNLSFR

SEQ ID NO: 293850 - protein, 9 aa, Homo Sapiens
KGSLTQTHW

SEQ ID NO: 293851 - protein, 9 aa, Homo Sapiens
HPETLTLVS

SEQ ID NO: 293852 - protein, 9 aa, Homo Sapiens
SPTPTTRSA

SEQ ID NO: 293853 - protein, 9 aa, Homo Sapiens
QEELQTSIS

SEQ ID NO: 293854 - protein, 9 aa, Homo Sapiens
RVISVLLNE

SEQ ID NO: 293855 - protein, 9 aa, Homo Sapiens
FKKFENKII

SEQ ID NO: 293856 - protein, 9 aa, Homo Sapiens
EAVKLLLDR

SEQ ID NO: 293857 - protein, 9 aa, Homo Sapiens
CGKAFRNNY

SEQ ID NO: 293858 - protein, 9 aa, Homo Sapiens
VAVMQLNVP

SEQ ID NO: 293859 - protein, 9 aa, Homo Sapiens
DRAIAFSIC

SEQ ID NO: 293860 - protein, 9 aa, Homo Sapiens
CQIRFNYQS

SEQ ID NO: 293861 - protein, 9 aa, Homo Sapiens
HNSGPLSVP

SEQ ID NO: 293862 - protein, 9 aa, Homo Sapiens
VEIIAVLRQ

SEQ ID NO: 293863 - protein, 9 aa, Homo Sapiens
SVSMSVFPS

SEQ ID NO: 293864 - protein, 9 aa, Homo Sapiens
KQLLVGQFT

SEQ ID NO: 293865 - protein, 9 aa, Homo Sapiens
PDYTYTNFD

SEQ ID NO: 293866 - protein, 9 aa, Homo Sapiens
IYISDEEWE

SEQ ID NO: 293867 - protein, 9 aa, Homo Sapiens
NGCGKAFSQ

SEQ ID NO: 293868 - protein, 9 aa, Homo Sapiens
WTVSFGTKL

SEQ ID NO: 293869 - protein, 9 aa, Homo Sapiens
EHLMKAFLD

SEQ ID NO: 293870 - protein, 9 aa, Homo Sapiens
MGLVSRVMN

SEQ ID NO: 293871 - protein, 9 aa, Homo Sapiens
IIRRVRLLV

SEQ ID NO: 293872 - protein, 9 aa, Homo Sapiens
VGIAHKLFG

SEQ ID NO: 293873 - protein, 9 aa, Homo Sapiens
KAVQMGMGA

SEQ ID NO: 293874 - protein, 9 aa, Homo Sapiens
IVTVLNYYT

SEQ ID NO: 293875 - protein, 9 aa, Homo Sapiens
SHCHRPHSS

SEQ ID NO: 293876 - protein, 9 aa, Homo Sapiens
VLIFKNNIG

SEQ ID NO: 293877 - protein, 9 aa, Homo Sapiens
AAVPKIRPC

SEQ ID NO: 293878 - protein, 9 aa, Homo Sapiens
ICGAHRQTK

SEQ ID NO: 293879 - protein, 9 aa, Homo Sapiens
DDSDADTYG

SEQ ID NO: 293880 - protein, 9 aa, Homo Sapiens
AADDFLEYL

SEQ ID NO: 293881 - protein, 9 aa, Homo Sapiens
GQYTEAEEL

SEQ ID NO: 293882 - protein, 9 aa, Homo Sapiens
GDLSAHCSI

SEQ ID NO: 293883 - protein, 9 aa, Homo Sapiens
ESTFDVGNF

SEQ ID NO: 293884 - protein, 9 aa, Homo Sapiens
WQINLKTNI

SEQ ID NO: 293885 - protein, 9 aa, Homo Sapiens
LMSLSGGKP

SEQ ID NO: 293886 - protein, 9 aa, Homo Sapiens
TSRQINGYQ

SEQ ID NO: 293887 - protein, 9 aa, Homo Sapiens
QLFDRKNLV

SEQ ID NO: 293888 - protein, 9 aa, Homo Sapiens
LIFNLSFTD

SEQ ID NO: 293889 - protein, 9 aa, Homo Sapiens
DIHNKTYRH

SEQ ID NO: 293890 - protein, 9 aa, Homo Sapiens
DFVVDATHK

SEQ ID NO: 293891 - protein, 9 aa, Homo Sapiens
EHFELFSLP

SEQ ID NO: 293892 - protein, 9 aa, Homo Sapiens
TQIKENIFP

SEQ ID NO: 293893 - protein, 9 aa, Homo Sapiens
ILHENRDKD

SEQ ID NO: 293894 - protein, 9 aa, Homo Sapiens
SKSFINSTL

SEQ ID NO: 293895 - protein, 9 aa, Homo Sapiens
RRAVQLGLC

SEQ ID NO: 293896 - protein, 9 aa, Homo Sapiens
NSQLRHIHL

SEQ ID NO: 293897 - protein, 9 aa, Homo Sapiens
AHGQVGKDL

SEQ ID NO: 293898 - protein, 9 aa, Homo Sapiens
AIEVYGHNI

SEQ ID NO: 293899 - protein, 9 aa, Homo Sapiens
TYAHFVDVI

SEQ ID NO: 293900 - protein, 9 aa, Homo Sapiens
LRHYWNPWK

SEQ ID NO: 293901 - protein, 9 aa, Homo Sapiens
GKFIFISCD

SEQ ID NO: 293902 - protein, 9 aa, Homo Sapiens
SMRLDLNPH

SEQ ID NO: 293903 - protein, 9 aa, Homo Sapiens
LEPIRCSVL

SEQ ID NO: 293904 - protein, 9 aa, Homo Sapiens
SKDMLQTLA

SEQ ID NO: 293905 - protein, 9 aa, Homo Sapiens
HLVRHQNIH

SEQ ID NO: 293906 - protein, 9 aa, Homo Sapiens
ECENYLSKT

SEQ ID NO: 293907 - protein, 9 aa, Homo Sapiens
IENGTGTIY

SEQ ID NO: 293908 - protein, 9 aa, Homo Sapiens
WNFVKEKNV

SEQ ID NO: 293909 - protein, 9 aa, Homo Sapiens
KDCKTSSSS

SEQ ID NO: 293910 - protein, 9 aa, Homo Sapiens
SLLGKKWEE

SEQ ID NO: 293911 - protein, 9 aa, Homo Sapiens
ADKYAPDNA

SEQ ID NO: 293912 - protein, 9 aa, Homo Sapiens
FSTDSWLDK

SEQ ID NO: 293913 - protein, 9 aa, Homo Sapiens
TTSEEKKAS

SEQ ID NO: 293914 - protein, 9 aa, Homo Sapiens
PVAIFITSY

SEQ ID NO: 293915 - protein, 9 aa, Homo Sapiens
VSCQEGKTK

SEQ ID NO: 293916 - protein, 9 aa, Homo Sapiens
GDDSTCCLV

SEQ ID NO: 293917 - protein, 9 aa, Homo Sapiens
FSYVKVQEG

SEQ ID NO: 293918 - protein, 9 aa, Homo Sapiens
WDHVRQQCK

SEQ ID NO: 293919 - protein, 9 aa, Homo Sapiens
RALGFIHEV

SEQ ID NO: 293920 - protein, 9 aa, Homo Sapiens
SASSRAHLI

SEQ ID NO: 293921 - protein, 9 aa, Homo Sapiens
ITRENISET

SEQ ID NO: 293922 - protein, 9 aa, Homo Sapiens
DQASMGAVV

SEQ ID NO: 293923 - protein, 9 aa, Homo Sapiens
AGKASEARG

SEQ ID NO: 293924 - protein, 9 aa, Homo Sapiens
TPNTLPNDQ

SEQ ID NO: 293925 - protein, 9 aa, Homo Sapiens
VYSSGLSRM

SEQ ID NO: 293926 - protein, 9 aa, Homo Sapiens
HSALWHPRN

SEQ ID NO: 293927 - protein, 9 aa, Homo Sapiens
IKSANFNWA

SEQ ID NO: 293928 - protein, 9 aa, Homo Sapiens
EHLQNELRE

SEQ ID NO: 293929 - protein, 9 aa, Homo Sapiens
KKLHLVNCV

SEQ ID NO: 293930 - protein, 9 aa, Homo Sapiens
PHVGGEVSP

SEQ ID NO: 293931 - protein, 9 aa, Homo Sapiens
DFIDIKSKF

SEQ ID NO: 293932 - protein, 9 aa, Homo Sapiens
QGKQKVINT

SEQ ID NO: 293933 - protein, 9 aa, Homo Sapiens
LHRALPLLD

SEQ ID NO: 293934 - protein, 9 aa, Homo Sapiens
TDLSIQCQA

SEQ ID NO: 293935 - protein, 9 aa, Homo Sapiens
ESSFWSRKI

SEQ ID NO: 293936 - protein, 9 aa, Homo Sapiens
ESFRTREVM

SEQ ID NO: 293937 - protein, 9 aa, Homo Sapiens
FMTSGHNEI

SEQ ID NO: 293938 - protein, 9 aa, Homo Sapiens
KVGDKIFGD

SEQ ID NO: 293939 - protein, 9 aa, Homo Sapiens
HNTLRCEVS

SEQ ID NO: 293940 - protein, 9 aa, Homo Sapiens
WKFALLRKH

SEQ ID NO: 293941 - protein, 9 aa, Homo Sapiens
CRVWWHAPV

SEQ ID NO: 293942 - protein, 9 aa, Homo Sapiens
YPRLSTPGL

SEQ ID NO: 293943 - protein, 9 aa, Homo Sapiens
EALYDICSM

SEQ ID NO: 293944 - protein, 9 aa, Homo Sapiens
ILQKAITTM

SEQ ID NO: 293945 - protein, 9 aa, Homo Sapiens
VSDSMFVHN

SEQ ID NO: 293946 - protein, 9 aa, Homo Sapiens
AGEKPYVCR

SEQ ID NO: 293947 - protein, 9 aa, Homo Sapiens
FYKYVYTRY

SEQ ID NO: 293948 - protein, 9 aa, Homo Sapiens
KLKNQAEVY

SEQ ID NO: 293949 - protein, 9 aa, Homo Sapiens
YFQASGYSG

SEQ ID NO: 293950 - protein, 9 aa, Homo Sapiens
SELFGKFIF

SEQ ID NO: 293951 - protein, 9 aa, Homo Sapiens
SSAHAGLFV

SEQ ID NO: 293952 - protein, 9 aa, Homo Sapiens
MASLVGLLP

SEQ ID NO: 293953 - protein, 9 aa, Homo Sapiens
KIVGLANSM

SEQ ID NO: 293954 - protein, 9 aa, Homo Sapiens
RLYRRDDMS

SEQ ID NO: 293955 - protein, 9 aa, Homo Sapiens
AMYGNTALH

SEQ ID NO: 293956 - protein, 9 aa, Homo Sapiens
LLQTADGKH

SEQ ID NO: 293957 - protein, 9 aa, Homo Sapiens
MEKSNNQLN

SEQ ID NO: 293958 - protein, 9 aa, Homo Sapiens
NIFYIVNQK

SEQ ID NO: 293959 - protein, 9 aa, Homo Sapiens
WETIVLFSL

SEQ ID NO: 293960 - protein, 9 aa, Homo Sapiens
TLHYLAKSL

SEQ ID NO: 293961 - protein, 9 aa, Homo Sapiens
QCTSSGNRD

SEQ ID NO: 293962 - protein, 9 aa, Homo Sapiens
LLIQLPLCG

SEQ ID NO: 293963 - protein, 9 aa, Homo Sapiens
CDGKSLLDK

SEQ ID NO: 293964 - protein, 9 aa, Homo Sapiens
SELNLKGGT

SEQ ID NO: 293965 - protein, 9 aa, Homo Sapiens
TVVKKRDRE

SEQ ID NO: 293966 - protein, 9 aa, Homo Sapiens
KIKQVKDNL

SEQ ID NO: 293967 - protein, 9 aa, Homo Sapiens
LQTTQAPYL

SEQ ID NO: 293968 - protein, 9 aa, Homo Sapiens
TTLIKRDPA

SEQ ID NO: 293969 - protein, 9 aa, Homo Sapiens
LFLTFILHN

SEQ ID NO: 293970 - protein, 9 aa, Homo Sapiens
FQHRRSRLL

SEQ ID NO: 293971 - protein, 9 aa, Homo Sapiens
RPSPPHPDV

SEQ ID NO: 293972 - protein, 9 aa, Homo Sapiens
EEEEEQDYY

SEQ ID NO: 293973 - protein, 9 aa, Homo Sapiens
LMYSTAAKV

SEQ ID NO: 293974 - protein, 9 aa, Homo Sapiens
ALIIHQIIH

SEQ ID NO: 293975 - protein, 9 aa, Homo Sapiens
TRKQGSTTD

SEQ ID NO: 293976 - protein, 9 aa, Homo Sapiens
ITAEMYTLA

SEQ ID NO: 293977 - protein, 9 aa, Homo Sapiens
ADVFVELFS

SEQ ID NO: 293978 - protein, 9 aa, Homo Sapiens
FERRPSTRY

SEQ ID NO: 293979 - protein, 9 aa, Homo Sapiens
EDIRRVRAI

SEQ ID NO: 293980 - protein, 9 aa, Homo Sapiens
LQERPSYVL

SEQ ID NO: 293981 - protein, 9 aa, Homo Sapiens
VGHQQIIHT

SEQ ID NO: 293982 - protein, 9 aa, Homo Sapiens
LRYLMEEEA

SEQ ID NO: 293983 - protein, 9 aa, Homo Sapiens
INRDQLQKF

SEQ ID NO: 293984 - protein, 9 aa, Homo Sapiens
RCTGFDAHY

SEQ ID NO: 293985 - protein, 9 aa, Homo Sapiens
TSPPTIPLT

SEQ ID NO: 293986 - protein, 9 aa, Homo Sapiens
DLRHKLKLR

SEQ ID NO: 293987 - protein, 9 aa, Homo Sapiens
AANLQLIQA

SEQ ID NO: 293988 - protein, 9 aa, Homo Sapiens
CEPPGDFPF

SEQ ID NO: 293989 - protein, 9 aa, Homo Sapiens
VLAEELIFQ

SEQ ID NO: 293990 - protein, 9 aa, Homo Sapiens
INHSGSFSS

SEQ ID NO: 293991 - protein, 9 aa, Homo Sapiens
ATISPGMTY

SEQ ID NO: 293992 - protein, 9 aa, Homo Sapiens
LCEVFSRYG

SEQ ID NO: 293993 - protein, 9 aa, Homo Sapiens
NAVQMKQKN

SEQ ID NO: 293994 - protein, 9 aa, Homo Sapiens
AGYNKKLWK

SEQ ID NO: 293995 - protein, 9 aa, Homo Sapiens
RSAGVLSGA

SEQ ID NO: 293996 - protein, 9 aa, Homo Sapiens
YMGSRKGSL

SEQ ID NO: 293997 - protein, 9 aa, Homo Sapiens
TGDKPYECA

SEQ ID NO: 293998 - protein, 9 aa, Homo Sapiens
SENQVNSRP

SEQ ID NO: 293999 - protein, 9 aa, Homo Sapiens
LQDNIGNGD

SEQ ID NO: 294000 - protein, 9 aa, Homo Sapiens
PPVWGLLPS

SEQ ID NO: 294001 - protein, 9 aa, Homo Sapiens
TKLPLKFRD

SEQ ID NO: 294002 - protein, 9 aa, Homo Sapiens
ERFNKSISN

SEQ ID NO: 294003 - protein, 9 aa, Homo Sapiens
SVAHNKRKM

SEQ ID NO: 294004 - protein, 9 aa, Homo Sapiens
VLVALKEWG

SEQ ID NO: 294005 - protein, 9 aa, Homo Sapiens
HCNLICHQK

SEQ ID NO: 294006 - protein, 9 aa, Homo Sapiens
DILNYLSFQ

SEQ ID NO: 294007 - protein, 9 aa, Homo Sapiens
KQLTEHLRP

SEQ ID NO: 294008 - protein, 9 aa, Homo Sapiens
PLKAGETIN

SEQ ID NO: 294009 - protein, 9 aa, Homo Sapiens
ESDEVILKG

SEQ ID NO: 294010 - protein, 9 aa, Homo Sapiens
DLEIKFQGL

SEQ ID NO: 294011 - protein, 9 aa, Homo Sapiens
IKTNKGLAH

SEQ ID NO: 294012 - protein, 9 aa, Homo Sapiens
TANILESER

SEQ ID NO: 294013 - protein, 9 aa, Homo Sapiens
LAIVQNALK

SEQ ID NO: 294014 - protein, 9 aa, Homo Sapiens
STQQVYFFL

SEQ ID NO: 294015 - protein, 9 aa, Homo Sapiens
LLTFLSNPD

SEQ ID NO: 294016 - protein, 9 aa, Homo Sapiens
RENNGSFCS

SEQ ID NO: 294017 - protein, 9 aa, Homo Sapiens
IVHKNDILY

SEQ ID NO: 294018 - protein, 9 aa, Homo Sapiens
KRKNMPASQ

SEQ ID NO: 294019 - protein, 9 aa, Homo Sapiens
TQKGSGAKW

SEQ ID NO: 294020 - protein, 9 aa, Homo Sapiens
DMPETSQET

SEQ ID NO: 294021 - protein, 9 aa, Homo Sapiens
QLYLFYNFE

SEQ ID NO: 294022 - protein, 9 aa, Homo Sapiens
IHTVAIYSE

SEQ ID NO: 294023 - protein, 9 aa, Homo Sapiens
PLNGQLFAL

SEQ ID NO: 294024 - protein, 9 aa, Homo Sapiens
PSIYIPEDD

SEQ ID NO: 294025 - protein, 9 aa, Homo Sapiens
KQRLSVFGE

SEQ ID NO: 294026 - protein, 9 aa, Homo Sapiens
ALIKKDGTE

SEQ ID NO: 294027 - protein, 9 aa, Homo Sapiens
GNLKLSFTP

SEQ ID NO: 294028 - protein, 9 aa, Homo Sapiens
KCLSSVEGS

SEQ ID NO: 294029 - protein, 9 aa, Homo Sapiens
NLAYHQIIH

SEQ ID NO: 294030 - protein, 9 aa, Homo Sapiens
LQNENGIDA

SEQ ID NO: 294031 - protein, 9 aa, Homo Sapiens
VEVLIKTGA

SEQ ID NO: 294032 - protein, 9 aa, Homo Sapiens
TIEKIYPYD

SEQ ID NO: 294033 - protein, 9 aa, Homo Sapiens
NIGLGVTLR

SEQ ID NO: 294034 - protein, 9 aa, Homo Sapiens
YNVPILSAD

SEQ ID NO: 294035 - protein, 9 aa, Homo Sapiens
DIKLSMKNN

SEQ ID NO: 294036 - protein, 9 aa, Homo Sapiens
PSVTISEQL

SEQ ID NO: 294037 - protein, 9 aa, Homo Sapiens
LPAGSQCSV

SEQ ID NO: 294038 - protein, 9 aa, Homo Sapiens
VVDSFKSGC

SEQ ID NO: 294039 - protein, 9 aa, Homo Sapiens
PLQMYNPTT

SEQ ID NO: 294040 - protein, 9 aa, Homo Sapiens
VIRAAPEKN

SEQ ID NO: 294041 - protein, 9 aa, Homo Sapiens
QRELRKLVH

SEQ ID NO: 294042 - protein, 9 aa, Homo Sapiens
ITNFRAKHH

SEQ ID NO: 294043 - protein, 9 aa, Homo Sapiens
CFIFKKTVC

SEQ ID NO: 294044 - protein, 9 aa, Homo Sapiens
LSLLEKLLI

SEQ ID NO: 294045 - protein, 9 aa, Homo Sapiens
KKMKKYLEE

SEQ ID NO: 294046 - protein, 9 aa, Homo Sapiens
WKPEIYQDT

SEQ ID NO: 294047 - protein, 9 aa, Homo Sapiens
ILGDHFRDM

SEQ ID NO: 294048 - protein, 9 aa, Homo Sapiens
ITLFKTEKM

SEQ ID NO: 294049 - protein, 9 aa, Homo Sapiens
RRTSFPKYG

SEQ ID NO: 294050 - protein, 9 aa, Homo Sapiens
IQEEKPNKK

SEQ ID NO: 294051 - protein, 9 aa, Homo Sapiens
KPRWIILLV

SEQ ID NO: 294052 - protein, 9 aa, Homo Sapiens
ATTGEEVWN

SEQ ID NO: 294053 - protein, 9 aa, Homo Sapiens
SFQNIGIIT

SEQ ID NO: 294054 - protein, 9 aa, Homo Sapiens
ISLAKDYLL

SEQ ID NO: 294055 - protein, 9 aa, Homo Sapiens
CVCKIALGC

SEQ ID NO: 294056 - protein, 9 aa, Homo Sapiens
WFQHRRSRL

SEQ ID NO: 294057 - protein, 9 aa, Homo Sapiens
FMKYFTDKM

SEQ ID NO: 294058 - protein, 9 aa, Homo Sapiens
SYDTTLDHL

SEQ ID NO: 294059 - protein, 9 aa, Homo Sapiens
EGFRLVSTR

SEQ ID NO: 294060 - protein, 9 aa, Homo Sapiens
HFCILYYFL

SEQ ID NO: 294061 - protein, 9 aa, Homo Sapiens
NIIAVQYIS

SEQ ID NO: 294062 - protein, 9 aa, Homo Sapiens
PRTQDDIIE

SEQ ID NO: 294063 - protein, 9 aa, Homo Sapiens
VIMRIYESY

SEQ ID NO: 294064 - protein, 9 aa, Homo Sapiens
PTTRSAGVL

SEQ ID NO: 294065 - protein, 9 aa, Homo Sapiens
TSTFLVKIP

SEQ ID NO: 294066 - protein, 9 aa, Homo Sapiens
IFNLSFTDI

SEQ ID NO: 294067 - protein, 9 aa, Homo Sapiens
SSCTNQNAI

SEQ ID NO: 294068 - protein, 9 aa, Homo Sapiens
LFTEHFHFY

SEQ ID NO: 294069 - protein, 9 aa, Homo Sapiens
FLWHLKSFF

SEQ ID NO: 294070 - protein, 9 aa, Homo Sapiens
MLLGRWCLS

SEQ ID NO: 294071 - protein, 9 aa, Homo Sapiens
LQIPLWSQW

SEQ ID NO: 294072 - protein, 9 aa, Homo Sapiens
ILDFISIAV

SEQ ID NO: 294073 - protein, 9 aa, Homo Sapiens
FSALGQVAQ

SEQ ID NO: 294074 - protein, 9 aa, Homo Sapiens
NNSAFLKKM

SEQ ID NO: 294075 - protein, 9 aa, Homo Sapiens
SGYCIDQLP

SEQ ID NO: 294076 - protein, 9 aa, Homo Sapiens
TGYNMKKLF

SEQ ID NO: 294077 - protein, 9 aa, Homo Sapiens
QELHKHSVK

SEQ ID NO: 294078 - protein, 9 aa, Homo Sapiens
QTKEPVKKI

SEQ ID NO: 294079 - protein, 9 aa, Homo Sapiens
ASPTFQRLF

SEQ ID NO: 294080 - protein, 9 aa, Homo Sapiens
SLQSEGHFY

SEQ ID NO: 294081 - protein, 9 aa, Homo Sapiens
KQTKRGGGG

SEQ ID NO: 294082 - protein, 9 aa, Homo Sapiens
HPDKSQSLC

SEQ ID NO: 294083 - protein, 9 aa, Homo Sapiens
TFQNHEPEF

SEQ ID NO: 294084 - protein, 9 aa, Homo Sapiens
EKLTTLKQN

SEQ ID NO: 294085 - protein, 9 aa, Homo Sapiens
QKNLNNSQM

SEQ ID NO: 294086 - protein, 9 aa, Homo Sapiens
TTTDDYLQS

SEQ ID NO: 294087 - protein, 9 aa, Homo Sapiens
NTVLQKEVQ

SEQ ID NO: 294088 - protein, 9 aa, Homo Sapiens
RVTEVCADT

SEQ ID NO: 294089 - protein, 9 aa, Homo Sapiens
TWRSLNFGI

SEQ ID NO: 294090 - protein, 9 aa, Homo Sapiens
DPPGSEVLC

SEQ ID NO: 294091 - protein, 9 aa, Homo Sapiens
HSSFQSHMI

SEQ ID NO: 294092 - protein, 9 aa, Homo Sapiens
SPTNILPKT

SEQ ID NO: 294093 - protein, 9 aa, Homo Sapiens
YFLIFKESA

SEQ ID NO: 294094 - protein, 9 aa, Homo Sapiens
TLKRENNNL

SEQ ID NO: 294095 - protein, 9 aa, Homo Sapiens
VVSMLYTLG

SEQ ID NO: 294096 - protein, 9 aa, Homo Sapiens
FSRQGKLQL

SEQ ID NO: 294097 - protein, 9 aa, Homo Sapiens
HLENNENKP

SEQ ID NO: 294098 - protein, 9 aa, Homo Sapiens
PEAAPAHVS

SEQ ID NO: 294099 - protein, 9 aa, Homo Sapiens
EDKIWEELS

SEQ ID NO: 294100 - protein, 9 aa, Homo Sapiens
GRALAQDAI

SEQ ID NO: 294101 - protein, 9 aa, Homo Sapiens
ALRWQLLQK

SEQ ID NO: 294102 - protein, 9 aa, Homo Sapiens
VDMRSIVIR

SEQ ID NO: 294103 - protein, 9 aa, Homo Sapiens
LDLDGRFYP

SEQ ID NO: 294104 - protein, 9 aa, Homo Sapiens
NQLNYLNQA

SEQ ID NO: 294105 - protein, 9 aa, Homo Sapiens
KYAPGAGSL

SEQ ID NO: 294106 - protein, 9 aa, Homo Sapiens
HREVCKVKT

SEQ ID NO: 294107 - protein, 9 aa, Homo Sapiens
TQEAVGRHI

SEQ ID NO: 294108 - protein, 9 aa, Homo Sapiens
VEYCTTTGT

SEQ ID NO: 294109 - protein, 9 aa, Homo Sapiens
TSYKNKTKS

SEQ ID NO: 294110 - protein, 9 aa, Homo Sapiens
PPPPPVIQN

SEQ ID NO: 294111 - protein, 9 aa, Homo Sapiens
NHLYGGLAS

SEQ ID NO: 294112 - protein, 9 aa, Homo Sapiens
YLNQAVVSK

SEQ ID NO: 294113 - protein, 9 aa, Homo Sapiens
GIINREALP

SEQ ID NO: 294114 - protein, 9 aa, Homo Sapiens
NNAFFDEKC

SEQ ID NO: 294115 - protein, 9 aa, Homo Sapiens
LDFRDVAIE

SEQ ID NO: 294116 - protein, 9 aa, Homo Sapiens
ITIFRNSIA

SEQ ID NO: 294117 - protein, 9 aa, Homo Sapiens
KNLLFTAKV

SEQ ID NO: 294118 - protein, 9 aa, Homo Sapiens
LSGDVDSLE

SEQ ID NO: 294119 - protein, 9 aa, Homo Sapiens
TIQENNPEE

SEQ ID NO: 294120 - protein, 9 aa, Homo Sapiens
LKWGLYIAV

SEQ ID NO: 294121 - protein, 9 aa, Homo Sapiens
ETWKESVME

SEQ ID NO: 294122 - protein, 9 aa, Homo Sapiens
HLINVLRRE

SEQ ID NO: 294123 - protein, 9 aa, Homo Sapiens
PNALPQRSS

SEQ ID NO: 294124 - protein, 9 aa, Homo Sapiens
SASGRHMDR

SEQ ID NO: 294125 - protein, 9 aa, Homo Sapiens
VCWAQAGKE

SEQ ID NO: 294126 - protein, 9 aa, Homo Sapiens
IHKYVQHIS

SEQ ID NO: 294127 - protein, 9 aa, Homo Sapiens
EHSNFLFLS

SEQ ID NO: 294128 - protein, 9 aa, Homo Sapiens
EDKAAEMED

SEQ ID NO: 294129 - protein, 9 aa, Homo Sapiens
SIILKSSEK

SEQ ID NO: 294130 - protein, 9 aa, Homo Sapiens
LPTKENFLL

SEQ ID NO: 294131 - protein, 9 aa, Homo Sapiens
IHERAHNGD

SEQ ID NO: 294132 - protein, 9 aa, Homo Sapiens
QRCCLQENN

SEQ ID NO: 294133 - protein, 9 aa, Homo Sapiens
EEAARICLG

SEQ ID NO: 294134 - protein, 9 aa, Homo Sapiens
ELDCDECHS

SEQ ID NO: 294135 - protein, 9 aa, Homo Sapiens
INNLELEVI

SEQ ID NO: 294136 - protein, 9 aa, Homo Sapiens
RVLKYAKEV

SEQ ID NO: 294137 - protein, 9 aa, Homo Sapiens
GEIHYSKMR

SEQ ID NO: 294138 - protein, 9 aa, Homo Sapiens
GMLTVVKKR

SEQ ID NO: 294139 - protein, 9 aa, Homo Sapiens
HISWFGSPT

SEQ ID NO: 294140 - protein, 9 aa, Homo Sapiens
LSVNDFTTI

SEQ ID NO: 294141 - protein, 9 aa, Homo Sapiens
GFRLVSTRT

SEQ ID NO: 294142 - protein, 9 aa, Homo Sapiens
LIEWWRENN

SEQ ID NO: 294143 - protein, 9 aa, Homo Sapiens
GLVHIPTHG

SEQ ID NO: 294144 - protein, 9 aa, Homo Sapiens
LTHQILHSR

SEQ ID NO: 294145 - protein, 9 aa, Homo Sapiens
GPLGAAQPL

SEQ ID NO: 294146 - protein, 9 aa, Homo Sapiens
KSSIIGKNK

SEQ ID NO: 294147 - protein, 9 aa, Homo Sapiens
LHTLIYDGK

SEQ ID NO: 294148 - protein, 9 aa, Homo Sapiens
PDRPFKCPT

SEQ ID NO: 294149 - protein, 9 aa, Homo Sapiens
YGAGVTLEC

SEQ ID NO: 294150 - protein, 9 aa, Homo Sapiens
KKSAEKPQS

SEQ ID NO: 294151 - protein, 9 aa, Homo Sapiens
TSTQSKIFQ

SEQ ID NO: 294152 - protein, 9 aa, Homo Sapiens
FDMGNNKYC

SEQ ID NO: 294153 - protein, 9 aa, Homo Sapiens
KRNPEVQHV

SEQ ID NO: 294154 - protein, 9 aa, Homo Sapiens
FAGCLTQSF

SEQ ID NO: 294155 - protein, 9 aa, Homo Sapiens
RRELAPKVI

SEQ ID NO: 294156 - protein, 9 aa, Homo Sapiens
VREGKEENK

SEQ ID NO: 294157 - protein, 9 aa, Homo Sapiens
PLGNIYFYP

SEQ ID NO: 294158 - protein, 9 aa, Homo Sapiens
ATITTDQRA

SEQ ID NO: 294159 - protein, 9 aa, Homo Sapiens
QWIQGWLKA

SEQ ID NO: 294160 - protein, 9 aa, Homo Sapiens
KRSISDSNE

SEQ ID NO: 294161 - protein, 9 aa, Homo Sapiens
KAGPYTFPP

SEQ ID NO: 294162 - protein, 9 aa, Homo Sapiens
KSVSLKEKS

SEQ ID NO: 294163 - protein, 9 aa, Homo Sapiens
MLPDNFSPL

SEQ ID NO: 294164 - protein, 9 aa, Homo Sapiens
PFSNPKYMN

SEQ ID NO: 294165 - protein, 9 aa, Homo Sapiens
SSIQKQWKE

SEQ ID NO: 294166 - protein, 9 aa, Homo Sapiens
HVTQEQDIE

SEQ ID NO: 294167 - protein, 9 aa, Homo Sapiens
HIMDRTPDK

SEQ ID NO: 294168 - protein, 9 aa, Homo Sapiens
QTHRPHPKP

SEQ ID NO: 294169 - protein, 9 aa, Homo Sapiens
EEDGLRLKW

SEQ ID NO: 294170 - protein, 9 aa, Homo Sapiens
LRQEGEFYP

SEQ ID NO: 294171 - protein, 9 aa, Homo Sapiens
FWYLLESKG

SEQ ID NO: 294172 - protein, 9 aa, Homo Sapiens
MDCDKVKSS

SEQ ID NO: 294173 - protein, 9 aa, Homo Sapiens
IVSISKTIT

SEQ ID NO: 294174 - protein, 9 aa, Homo Sapiens
SDVPALHTE

SEQ ID NO: 294175 - protein, 9 aa, Homo Sapiens
LILNIYSGI

SEQ ID NO: 294176 - protein, 9 aa, Homo Sapiens
ITEEYLKQK

SEQ ID NO: 294177 - protein, 9 aa, Homo Sapiens
SALGQVAQA

SEQ ID NO: 294178 - protein, 9 aa, Homo Sapiens
GLLHPSHRN

SEQ ID NO: 294179 - protein, 9 aa, Homo Sapiens
LKGQKNDKL

SEQ ID NO: 294180 - protein, 9 aa, Homo Sapiens
IQLPLCGNN

SEQ ID NO: 294181 - protein, 9 aa, Homo Sapiens
ESDGKRIED

SEQ ID NO: 294182 - protein, 9 aa, Homo Sapiens
GDTSKKGVK

SEQ ID NO: 294183 - protein, 9 aa, Homo Sapiens
DQAHKEQGK

SEQ ID NO: 294184 - protein, 9 aa, Homo Sapiens
IQPISSPLM

SEQ ID NO: 294185 - protein, 9 aa, Homo Sapiens
MEMDQEKMT

SEQ ID NO: 294186 - protein, 9 aa, Homo Sapiens
DEFILKKVN

SEQ ID NO: 294187 - protein, 9 aa, Homo Sapiens
NNPKVNKCR

SEQ ID NO: 294188 - protein, 9 aa, Homo Sapiens
YNMRDRLHI

SEQ ID NO: 294189 - protein, 9 aa, Homo Sapiens
NQFVVYRDL

SEQ ID NO: 294190 - protein, 9 aa, Homo Sapiens
PNMKKDKRA

SEQ ID NO: 294191 - protein, 9 aa, Homo Sapiens
QKLFFFLQR

SEQ ID NO: 294192 - protein, 9 aa, Homo Sapiens
ESDLSEHEK

SEQ ID NO: 294193 - protein, 9 aa, Homo Sapiens
KRLQKIREK

SEQ ID NO: 294194 - protein, 9 aa, Homo Sapiens
QQKMNYFMD

SEQ ID NO: 294195 - protein, 9 aa, Homo Sapiens
SQIDDSLST

SEQ ID NO: 294196 - protein, 9 aa, Homo Sapiens
DYCKIKHIS

SEQ ID NO: 294197 - protein, 9 aa, Homo Sapiens
RRSKLHYAF

SEQ ID NO: 294198 - protein, 9 aa, Homo Sapiens
LGKAQTAQV

SEQ ID NO: 294199 - protein, 9 aa, Homo Sapiens
HSAGIINRD

SEQ ID NO: 294200 - protein, 9 aa, Homo Sapiens
LGIPGSRGE

SEQ ID NO: 294201 - protein, 9 aa, Homo Sapiens
FYLALRPVI

SEQ ID NO: 294202 - protein, 9 aa, Homo Sapiens
NKSRLDQKL

SEQ ID NO: 294203 - protein, 9 aa, Homo Sapiens
EFLSERADL

SEQ ID NO: 294204 - protein, 9 aa, Homo Sapiens
IFLAPCMRD

SEQ ID NO: 294205 - protein, 9 aa, Homo Sapiens
KNLFCIGVI

SEQ ID NO: 294206 - protein, 9 aa, Homo Sapiens
EQVAESQKQ

SEQ ID NO: 294207 - protein, 9 aa, Homo Sapiens
VYTRYRAGK

SEQ ID NO: 294208 - protein, 9 aa, Homo Sapiens
IDKPAIYKR

SEQ ID NO: 294209 - protein, 9 aa, Homo Sapiens
VQIMPSQIS

SEQ ID NO: 294210 - protein, 9 aa, Homo Sapiens
LIFFSRASV

SEQ ID NO: 294211 - protein, 9 aa, Homo Sapiens
SVPWTCEQG

SEQ ID NO: 294212 - protein, 9 aa, Homo Sapiens
VYSNTVQGQ

SEQ ID NO: 294213 - protein, 9 aa, Homo Sapiens
MGGTTNQQE

SEQ ID NO: 294214 - protein, 9 aa, Homo Sapiens
FGGRDRPFQ

SEQ ID NO: 294215 - protein, 9 aa, Homo Sapiens
CVRDPQKSF

SEQ ID NO: 294216 - protein, 9 aa, Homo Sapiens
LFWSNPTAF

SEQ ID NO: 294217 - protein, 9 aa, Homo Sapiens
HLSCKMLTP

SEQ ID NO: 294218 - protein, 9 aa, Homo Sapiens
KCVEPLGLD

SEQ ID NO: 294219 - protein, 9 aa, Homo Sapiens
RARHHVGRV

SEQ ID NO: 294220 - protein, 9 aa, Homo Sapiens
KEEQVAESQ

SEQ ID NO: 294221 - protein, 9 aa, Homo Sapiens
TQTLEEIKE

SEQ ID NO: 294222 - protein, 9 aa, Homo Sapiens
SSSSDTTST

SEQ ID NO: 294223 - protein, 9 aa, Homo Sapiens
TDTVDIAPN

SEQ ID NO: 294224 - protein, 9 aa, Homo Sapiens
LSADIAQNQ

SEQ ID NO: 294225 - protein, 9 aa, Homo Sapiens
HYWNPWKAA

SEQ ID NO: 294226 - protein, 9 aa, Homo Sapiens
TTQAPYLQK

SEQ ID NO: 294227 - protein, 9 aa, Homo Sapiens
RLSRAEAIT

SEQ ID NO: 294228 - protein, 9 aa, Homo Sapiens
LYTLGIPML

SEQ ID NO: 294229 - protein, 9 aa, Homo Sapiens
ITTILKFPS

SEQ ID NO: 294230 - protein, 9 aa, Homo Sapiens
SLLGPNGIN

SEQ ID NO: 294231 - protein, 9 aa, Homo Sapiens
LPNTSTNKL

SEQ ID NO: 294232 - protein, 9 aa, Homo Sapiens
IRHKALLEP

SEQ ID NO: 294233 - protein, 9 aa, Homo Sapiens
RLNRRTSFP

SEQ ID NO: 294234 - protein, 9 aa, Homo Sapiens
RQTTPEGLQ

SEQ ID NO: 294235 - protein, 9 aa, Homo Sapiens
SRIILCSKF

SEQ ID NO: 294236 - protein, 9 aa, Homo Sapiens
EAHDALHHL

SEQ ID NO: 294237 - protein, 9 aa, Homo Sapiens
GEGADFALR

SEQ ID NO: 294238 - protein, 9 aa, Homo Sapiens
LCVCEICPW

SEQ ID NO: 294239 - protein, 9 aa, Homo Sapiens
EKQICGAHR

SEQ ID NO: 294240 - protein, 9 aa, Homo Sapiens
NKSISNAAP

SEQ ID NO: 294241 - protein, 9 aa, Homo Sapiens
LKHGKMHTG

SEQ ID NO: 294242 - protein, 9 aa, Homo Sapiens
DVKGGSFPL

SEQ ID NO: 294243 - protein, 9 aa, Homo Sapiens
RIIHQRTHT

SEQ ID NO: 294244 - protein, 9 aa, Homo Sapiens
QSKSSPKIG

SEQ ID NO: 294245 - protein, 9 aa, Homo Sapiens
EEELNFEVI

SEQ ID NO: 294246 - protein, 9 aa, Homo Sapiens
CRALTHLGI

SEQ ID NO: 294247 - protein, 9 aa, Homo Sapiens
SSRRVSEDG

SEQ ID NO: 294248 - protein, 9 aa, Homo Sapiens
KYLGLSAVQ

SEQ ID NO: 294249 - protein, 9 aa, Homo Sapiens
YYMALIKRG

SEQ ID NO: 294250 - protein, 9 aa, Homo Sapiens
CWMTDTPNA

SEQ ID NO: 294251 - protein, 9 aa, Homo Sapiens
GLFRGLRGE

SEQ ID NO: 294252 - protein, 9 aa, Homo Sapiens
QFSVGYTFE

SEQ ID NO: 294253 - protein, 9 aa, Homo Sapiens
MDEFILKKV

SEQ ID NO: 294254 - protein, 9 aa, Homo Sapiens
LTGRPFYKG

SEQ ID NO: 294255 - protein, 9 aa, Homo Sapiens
CQRHETTHT

SEQ ID NO: 294256 - protein, 9 aa, Homo Sapiens
LQNGDIWEL

SEQ ID NO: 294257 - protein, 9 aa, Homo Sapiens
CGPNEVNHL

SEQ ID NO: 294258 - protein, 9 aa, Homo Sapiens
KKINKRNKS

SEQ ID NO: 294259 - protein, 9 aa, Homo Sapiens
GSTKFDISW

SEQ ID NO: 294260 - protein, 9 aa, Homo Sapiens
PKCALYESV

SEQ ID NO: 294261 - protein, 9 aa, Homo Sapiens
DGPLKFIPC

SEQ ID NO: 294262 - protein, 9 aa, Homo Sapiens
YPVTCLEQE

SEQ ID NO: 294263 - protein, 9 aa, Homo Sapiens
KIRKIIYMF

SEQ ID NO: 294264 - protein, 9 aa, Homo Sapiens
TNLSAQVCE

SEQ ID NO: 294265 - protein, 9 aa, Homo Sapiens
DSLAPLDKV

SEQ ID NO: 294266 - protein, 9 aa, Homo Sapiens
SALSFLDIW

SEQ ID NO: 294267 - protein, 9 aa, Homo Sapiens
YPDFSVVVI

SEQ ID NO: 294268 - protein, 9 aa, Homo Sapiens
RNDRDGERG

SEQ ID NO: 294269 - protein, 9 aa, Homo Sapiens
PPETTAQRC

SEQ ID NO: 294270 - protein, 9 aa, Homo Sapiens
ESDNSGDSG

SEQ ID NO: 294271 - protein, 9 aa, Homo Sapiens
GIVNIILIL

SEQ ID NO: 294272 - protein, 9 aa, Homo Sapiens
VSTFNNYYS

SEQ ID NO: 294273 - protein, 9 aa, Homo Sapiens
ATHQKEIDT

SEQ ID NO: 294274 - protein, 9 aa, Homo Sapiens
HVSKHKSDK

SEQ ID NO: 294275 - protein, 9 aa, Homo Sapiens
TKRSRGFCF

SEQ ID NO: 294276 - protein, 9 aa, Homo Sapiens
LCGNNVISH

SEQ ID NO: 294277 - protein, 9 aa, Homo Sapiens
VINKESEVY

SEQ ID NO: 294278 - protein, 9 aa, Homo Sapiens
HNNIRYLIT

SEQ ID NO: 294279 - protein, 9 aa, Homo Sapiens
INSLEGANA

SEQ ID NO: 294280 - protein, 9 aa, Homo Sapiens
QTRSNVAIL

SEQ ID NO: 294281 - protein, 9 aa, Homo Sapiens
LVPHPKVSN

SEQ ID NO: 294282 - protein, 9 aa, Homo Sapiens
PKIRPCPTS

SEQ ID NO: 294283 - protein, 9 aa, Homo Sapiens
DIPVLFKIM

SEQ ID NO: 294284 - protein, 9 aa, Homo Sapiens
LSSYTRLFS

SEQ ID NO: 294285 - protein, 9 aa, Homo Sapiens
PRTLHYLAK

SEQ ID NO: 294286 - protein, 9 aa, Homo Sapiens
TLMEDGSIQ

SEQ ID NO: 294287 - protein, 9 aa, Homo Sapiens
AYYLKNQIG

SEQ ID NO: 294288 - protein, 9 aa, Homo Sapiens
RLVDSDGEL

SEQ ID NO: 294289 - protein, 9 aa, Homo Sapiens
QNSNIVNHQ

SEQ ID NO: 294290 - protein, 9 aa, Homo Sapiens
VLSDYNSAL

SEQ ID NO: 294291 - protein, 9 aa, Homo Sapiens
KLMAQHLID

SEQ ID NO: 294292 - protein, 9 aa, Homo Sapiens
AWCDQILWK

SEQ ID NO: 294293 - protein, 9 aa, Homo Sapiens
QQFQNFLTE

SEQ ID NO: 294294 - protein, 9 aa, Homo Sapiens
LERHRIIHN

SEQ ID NO: 294295 - protein, 9 aa, Homo Sapiens
PTALQSLVL

SEQ ID NO: 294296 - protein, 9 aa, Homo Sapiens
NYSEISSEP

SEQ ID NO: 294297 - protein, 9 aa, Homo Sapiens
LQEALFGKE

SEQ ID NO: 294298 - protein, 9 aa, Homo Sapiens
ITDIKLSMK

SEQ ID NO: 294299 - protein, 9 aa, Homo Sapiens
SYGRNDRDG

SEQ ID NO: 294300 - protein, 9 aa, Homo Sapiens
GFMVYKLLL

SEQ ID NO: 294301 - protein, 9 aa, Homo Sapiens
RGSGPKPEN

SEQ ID NO: 294302 - protein, 9 aa, Homo Sapiens
KREEEEEEL

SEQ ID NO: 294303 - protein, 9 aa, Homo Sapiens
LSLGTQIAY

SEQ ID NO: 294304 - protein, 9 aa, Homo Sapiens
AYEAHDENT

SEQ ID NO: 294305 - protein, 9 aa, Homo Sapiens
GCLYVVSTR

SEQ ID NO: 294306 - protein, 9 aa, Homo Sapiens
TKLIIQAGI

SEQ ID NO: 294307 - protein, 9 aa, Homo Sapiens
KKETRFKWF

SEQ ID NO: 294308 - protein, 9 aa, Homo Sapiens
VIMSQTVCI

SEQ ID NO: 294309 - protein, 9 aa, Homo Sapiens
GSVQSSSGS

SEQ ID NO: 294310 - protein, 9 aa, Homo Sapiens
DISRVFHSY

SEQ ID NO: 294311 - protein, 9 aa, Homo Sapiens
IYLEKLNVG

SEQ ID NO: 294312 - protein, 9 aa, Homo Sapiens
SGGSPTNDI

SEQ ID NO: 294313 - protein, 9 aa, Homo Sapiens
KFALRCSVC

SEQ ID NO: 294314 - protein, 9 aa, Homo Sapiens
TVTKILRAC

SEQ ID NO: 294315 - protein, 9 aa, Homo Sapiens
DNIFMYGCD

SEQ ID NO: 294316 - protein, 9 aa, Homo Sapiens
FLRYTINAM

SEQ ID NO: 294317 - protein, 9 aa, Homo Sapiens
GLKYVDTRK

SEQ ID NO: 294318 - protein, 9 aa, Homo Sapiens
RELPSATPT

SEQ ID NO: 294319 - protein, 9 aa, Homo Sapiens
GHSFHVHFE

SEQ ID NO: 294320 - protein, 9 aa, Homo Sapiens
WEINIFLQQ

SEQ ID NO: 294321 - protein, 9 aa, Homo Sapiens
LCYTAENKS

SEQ ID NO: 294322 - protein, 9 aa, Homo Sapiens
VTRTGEQDP

SEQ ID NO: 294323 - protein, 9 aa, Homo Sapiens
LVRKAMLNW

SEQ ID NO: 294324 - protein, 9 aa, Homo Sapiens
ITYNNLSDK

SEQ ID NO: 294325 - protein, 9 aa, Homo Sapiens
FDEWMKIFN

SEQ ID NO: 294326 - protein, 9 aa, Homo Sapiens
GQALVSEEG

SEQ ID NO: 294327 - protein, 9 aa, Homo Sapiens
TMMGKTRQI

SEQ ID NO: 294328 - protein, 9 aa, Homo Sapiens
VPVTDIEVE

SEQ ID NO: 294329 - protein, 9 aa, Homo Sapiens
TFLEAGIYE

SEQ ID NO: 294330 - protein, 9 aa, Homo Sapiens
QAEAYIHRA

SEQ ID NO: 294331 - protein, 9 aa, Homo Sapiens
VGMKPRHCL

SEQ ID NO: 294332 - protein, 9 aa, Homo Sapiens
VERMVEDSL

SEQ ID NO: 294333 - protein, 9 aa, Homo Sapiens
HLGGITEEY

SEQ ID NO: 294334 - protein, 9 aa, Homo Sapiens
LNLNSPEKL

SEQ ID NO: 294335 - protein, 9 aa, Homo Sapiens
SSEFPDKFG

SEQ ID NO: 294336 - protein, 9 aa, Homo Sapiens
PDNTERFDS

SEQ ID NO: 294337 - protein, 9 aa, Homo Sapiens
HQPPADKVP

SEQ ID NO: 294338 - protein, 9 aa, Homo Sapiens
NKACLRGGG

SEQ ID NO: 294339 - protein, 9 aa, Homo Sapiens
GQKTYRCNK

SEQ ID NO: 294340 - protein, 9 aa, Homo Sapiens
EQVKEYCLK

SEQ ID NO: 294341 - protein, 9 aa, Homo Sapiens
ERVAELMTR

SEQ ID NO: 294342 - protein, 9 aa, Homo Sapiens
VYAQNLIND

SEQ ID NO: 294343 - protein, 9 aa, Homo Sapiens
EKIDDIFNK

SEQ ID NO: 294344 - protein, 9 aa, Homo Sapiens
SNQRAKWRR

SEQ ID NO: 294345 - protein, 9 aa, Homo Sapiens
AEAHTEVFP

SEQ ID NO: 294346 - protein, 9 aa, Homo Sapiens
VSMLYTLGI

SEQ ID NO: 294347 - protein, 9 aa, Homo Sapiens
IEVETVEPP

SEQ ID NO: 294348 - protein, 9 aa, Homo Sapiens
CREFLSERA

SEQ ID NO: 294349 - protein, 9 aa, Homo Sapiens
TDISWAKNV

SEQ ID NO: 294350 - protein, 9 aa, Homo Sapiens
DIIVLAKSM

SEQ ID NO: 294351 - protein, 9 aa, Homo Sapiens
WEPPVRASP

SEQ ID NO: 294352 - protein, 9 aa, Homo Sapiens
TAVKNCMAS

SEQ ID NO: 294353 - protein, 9 aa, Homo Sapiens
SLIKLKESS

SEQ ID NO: 294354 - protein, 9 aa, Homo Sapiens
AFTKYCNKW

SEQ ID NO: 294355 - protein, 9 aa, Homo Sapiens
MQPPVTNTP

SEQ ID NO: 294356 - protein, 9 aa, Homo Sapiens
AWNTSTSYI

SEQ ID NO: 294357 - protein, 9 aa, Homo Sapiens
FHSNSDCGK

SEQ ID NO: 294358 - protein, 9 aa, Homo Sapiens
NSEEIMRLL

SEQ ID NO: 294359 - protein, 9 aa, Homo Sapiens
LLCGNRTYA

SEQ ID NO: 294360 - protein, 9 aa, Homo Sapiens
CKISVSRGR

SEQ ID NO: 294361 - protein, 9 aa, Homo Sapiens
KREFVFNAI

SEQ ID NO: 294362 - protein, 9 aa, Homo Sapiens
VPNRKVNYM

SEQ ID NO: 294363 - protein, 9 aa, Homo Sapiens
YRPTKTYLS

SEQ ID NO: 294364 - protein, 9 aa, Homo Sapiens
NKLSNPKIH

SEQ ID NO: 294365 - protein, 9 aa, Homo Sapiens
CFPTSRHIL

SEQ ID NO: 294366 - protein, 9 aa, Homo Sapiens
SKEKDSPFK

SEQ ID NO: 294367 - protein, 9 aa, Homo Sapiens
HLLFNMCLI

SEQ ID NO: 294368 - protein, 9 aa, Homo Sapiens
MFLSVRSRN

SEQ ID NO: 294369 - protein, 9 aa, Homo Sapiens
LFTNLNFVL

SEQ ID NO: 294370 - protein, 9 aa, Homo Sapiens
DLSDQSKKY

SEQ ID NO: 294371 - protein, 9 aa, Homo Sapiens
DIAVTPLKL

SEQ ID NO: 294372 - protein, 9 aa, Homo Sapiens
LDEFTNWSI

SEQ ID NO: 294373 - protein, 9 aa, Homo Sapiens
PMPENRFLM

SEQ ID NO: 294374 - protein, 9 aa, Homo Sapiens
LGYVAHMVL

SEQ ID NO: 294375 - protein, 9 aa, Homo Sapiens
CPFEITGNT

SEQ ID NO: 294376 - protein, 9 aa, Homo Sapiens
LNYLNQAVV

SEQ ID NO: 294377 - protein, 9 aa, Homo Sapiens
IIKIPHLDL

SEQ ID NO: 294378 - protein, 9 aa, Homo Sapiens
FGFFYLFTG

SEQ ID NO: 294379 - protein, 9 aa, Homo Sapiens
GLKSGQGQG

SEQ ID NO: 294380 - protein, 9 aa, Homo Sapiens
VPPVWGLLP

SEQ ID NO: 294381 - protein, 9 aa, Homo Sapiens
MVQTEAQYQ

SEQ ID NO: 294382 - protein, 9 aa, Homo Sapiens
SDLSEHEKT

SEQ ID NO: 294383 - protein, 9 aa, Homo Sapiens
EFNCKTKDL

SEQ ID NO: 294384 - protein, 9 aa, Homo Sapiens
YLDESTQES

SEQ ID NO: 294385 - protein, 9 aa, Homo Sapiens
FPFTGVACS

SEQ ID NO: 294386 - protein, 9 aa, Homo Sapiens
ALLSKCLCG

SEQ ID NO: 294387 - protein, 9 aa, Homo Sapiens
GIIGVVGGC

SEQ ID NO: 294388 - protein, 9 aa, Homo Sapiens
IEDMINQKA

SEQ ID NO: 294389 - protein, 9 aa, Homo Sapiens
DGDVKYMLS

SEQ ID NO: 294390 - protein, 9 aa, Homo Sapiens
ACVLQPDVD

SEQ ID NO: 294391 - protein, 9 aa, Homo Sapiens
VNCVEPVGL

SEQ ID NO: 294392 - protein, 9 aa, Homo Sapiens
YLGCNKLAS

SEQ ID NO: 294393 - protein, 9 aa, Homo Sapiens
ECQKCHILS

SEQ ID NO: 294394 - protein, 9 aa, Homo Sapiens
AGVLSGACP

SEQ ID NO: 294395 - protein, 9 aa, Homo Sapiens
SIKYPLKAG

SEQ ID NO: 294396 - protein, 9 aa, Homo Sapiens
LDKETVTLN

SEQ ID NO: 294397 - protein, 9 aa, Homo Sapiens
QGKTLASTS

SEQ ID NO: 294398 - protein, 9 aa, Homo Sapiens
PGHRSQAPI

SEQ ID NO: 294399 - protein, 9 aa, Homo Sapiens
WNAKKGTGI

SEQ ID NO: 294400 - protein, 9 aa, Homo Sapiens
LQTADGKHQ

SEQ ID NO: 294401 - protein, 9 aa, Homo Sapiens
GFNTDHLAW

SEQ ID NO: 294402 - protein, 9 aa, Homo Sapiens
KKDSILDLS

SEQ ID NO: 294403 - protein, 9 aa, Homo Sapiens
SYRMLQKED

SEQ ID NO: 294404 - protein, 9 aa, Homo Sapiens
TKFDISWIM

SEQ ID NO: 294405 - protein, 9 aa, Homo Sapiens
LWGLFHDSS

SEQ ID NO: 294406 - protein, 9 aa, Homo Sapiens
PIFLAPCMR

SEQ ID NO: 294407 - protein, 9 aa, Homo Sapiens
DYLLRANCD

SEQ ID NO: 294408 - protein, 9 aa, Homo Sapiens
LHNQNGSEL

SEQ ID NO: 294409 - protein, 9 aa, Homo Sapiens
PKIHYEAPL

SEQ ID NO: 294410 - protein, 9 aa, Homo Sapiens
STPDKTDMT

SEQ ID NO: 294411 - protein, 9 aa, Homo Sapiens
WNIARLNTI

SEQ ID NO: 294412 - protein, 9 aa, Homo Sapiens
LPIGLCSLS

SEQ ID NO: 294413 - protein, 9 aa, Homo Sapiens
MAEEVGKTI

SEQ ID NO: 294414 - protein, 9 aa, Homo Sapiens
IQIEEATEE

SEQ ID NO: 294415 - protein, 9 aa, Homo Sapiens
NNTMNISIP

SEQ ID NO: 294416 - protein, 9 aa, Homo Sapiens
CFMKYFTDK

SEQ ID NO: 294417 - protein, 9 aa, Homo Sapiens
SAAELVSAM

SEQ ID NO: 294418 - protein, 9 aa, Homo Sapiens
VQKVTPNTV

SEQ ID NO: 294419 - protein, 9 aa, Homo Sapiens
PLNVDHLSC

SEQ ID NO: 294420 - protein, 9 aa, Homo Sapiens
EFAVQLHVD

SEQ ID NO: 294421 - protein, 9 aa, Homo Sapiens
RWVELDKPL

SEQ ID NO: 294422 - protein, 9 aa, Homo Sapiens
PPCQHKLFC

SEQ ID NO: 294423 - protein, 9 aa, Homo Sapiens
IILCSKFKE

SEQ ID NO: 294424 - protein, 9 aa, Homo Sapiens
LRNAFNTSP

SEQ ID NO: 294425 - protein, 9 aa, Homo Sapiens
MWRHHHHHQ

SEQ ID NO: 294426 - protein, 9 aa, Homo Sapiens
HFDRRKNGM

SEQ ID NO: 294427 - protein, 9 aa, Homo Sapiens
RALPLLDEV

SEQ ID NO: 294428 - protein, 9 aa, Homo Sapiens
PEDRSVKPH

SEQ ID NO: 294429 - protein, 9 aa, Homo Sapiens
NVLQKLDVF

SEQ ID NO: 294430 - protein, 9 aa, Homo Sapiens
SLITLIGIN

SEQ ID NO: 294431 - protein, 9 aa, Homo Sapiens
GKLFRRGSN

SEQ ID NO: 294432 - protein, 9 aa, Homo Sapiens
APFVYTYIR

SEQ ID NO: 294433 - protein, 9 aa, Homo Sapiens
ILQKHGKNV

SEQ ID NO: 294434 - protein, 9 aa, Homo Sapiens
GRKHVVPCV

SEQ ID NO: 294435 - protein, 9 aa, Homo Sapiens
CSSTLNKHK

SEQ ID NO: 294436 - protein, 9 aa, Homo Sapiens
HILRERKQL

SEQ ID NO: 294437 - protein, 9 aa, Homo Sapiens
PKRIDTEMT

SEQ ID NO: 294438 - protein, 9 aa, Homo Sapiens
CGNRTYAGQ

SEQ ID NO: 294439 - protein, 9 aa, Homo Sapiens
RAVQLGLCL

SEQ ID NO: 294440 - protein, 9 aa, Homo Sapiens
DIKSKFALR

SEQ ID NO: 294441 - protein, 9 aa, Homo Sapiens
SLAKDYLLG

SEQ ID NO: 294442 - protein, 9 aa, Homo Sapiens
AKMINMMRP

SEQ ID NO: 294443 - protein, 9 aa, Homo Sapiens
LREQGQALV

SEQ ID NO: 294444 - protein, 9 aa, Homo Sapiens
SSYLAQHWI

SEQ ID NO: 294445 - protein, 9 aa, Homo Sapiens
CSDVPALHT

SEQ ID NO: 294446 - protein, 9 aa, Homo Sapiens
YQVAKMINM

SEQ ID NO: 294447 - protein, 9 aa, Homo Sapiens
CPWGVAEVE

SEQ ID NO: 294448 - protein, 9 aa, Homo Sapiens
VLSFLLNAQ

SEQ ID NO: 294449 - protein, 9 aa, Homo Sapiens
LSALLYLLI

SEQ ID NO: 294450 - protein, 9 aa, Homo Sapiens
MQEQTTDNI

SEQ ID NO: 294451 - protein, 9 aa, Homo Sapiens
DNLLEEPEM

SEQ ID NO: 294452 - protein, 9 aa, Homo Sapiens
ILLCCLYQL

SEQ ID NO: 294453 - protein, 9 aa, Homo Sapiens
CSLSYLEEL

SEQ ID NO: 294454 - protein, 9 aa, Homo Sapiens
EVNSNKGVS

SEQ ID NO: 294455 - protein, 9 aa, Homo Sapiens
HLEDHVFCQ

SEQ ID NO: 294456 - protein, 9 aa, Homo Sapiens
LMNAYLFKG

SEQ ID NO: 294457 - protein, 9 aa, Homo Sapiens
GISAIKRNA

SEQ ID NO: 294458 - protein, 9 aa, Homo Sapiens
KKEKRKLKG

SEQ ID NO: 294459 - protein, 9 aa, Homo Sapiens
APHPQRITC

SEQ ID NO: 294460 - protein, 9 aa, Homo Sapiens
DLSNPSIAQ

SEQ ID NO: 294461 - protein, 9 aa, Homo Sapiens
NVRINHLVH

SEQ ID NO: 294462 - protein, 9 aa, Homo Sapiens
TLVEDVQLK

SEQ ID NO: 294463 - protein, 9 aa, Homo Sapiens
ASASGARPT

SEQ ID NO: 294464 - protein, 9 aa, Homo Sapiens
DTWYDLEEV

SEQ ID NO: 294465 - protein, 9 aa, Homo Sapiens
TPSTTSLVS

SEQ ID NO: 294466 - protein, 9 aa, Homo Sapiens
KWKDQKMED

SEQ ID NO: 294467 - protein, 9 aa, Homo Sapiens
FSTVHITNK

SEQ ID NO: 294468 - protein, 9 aa, Homo Sapiens
HQSNTFTRY

SEQ ID NO: 294469 - protein, 9 aa, Homo Sapiens
FYNEDVTLG

SEQ ID NO: 294470 - protein, 9 aa, Homo Sapiens
HISDLHNCF

SEQ ID NO: 294471 - protein, 9 aa, Homo Sapiens
RFIANHMRS

SEQ ID NO: 294472 - protein, 9 aa, Homo Sapiens
ALLSAFLAT

SEQ ID NO: 294473 - protein, 9 aa, Homo Sapiens
RVPQTGWVY

SEQ ID NO: 294474 - protein, 9 aa, Homo Sapiens
GALQELQQY

SEQ ID NO: 294475 - protein, 9 aa, Homo Sapiens
GCFVCGMEN

SEQ ID NO: 294476 - protein, 9 aa, Homo Sapiens
SVKPHLCSL

SEQ ID NO: 294477 - protein, 9 aa, Homo Sapiens
KPFECNGCG

SEQ ID NO: 294478 - protein, 9 aa, Homo Sapiens
LPKPQEQDV

SEQ ID NO: 294479 - protein, 9 aa, Homo Sapiens
LNNLLAFSQ

SEQ ID NO: 294480 - protein, 9 aa, Homo Sapiens
TDYSENIFT

SEQ ID NO: 294481 - protein, 9 aa, Homo Sapiens
SRRTSTQQV

SEQ ID NO: 294482 - protein, 9 aa, Homo Sapiens
NVQSEERSD

SEQ ID NO: 294483 - protein, 9 aa, Homo Sapiens
VIVEFTKKL

SEQ ID NO: 294484 - protein, 9 aa, Homo Sapiens
RPVIWWAPN

SEQ ID NO: 294485 - protein, 9 aa, Homo Sapiens
LLSAWSTPQ

SEQ ID NO: 294486 - protein, 9 aa, Homo Sapiens
SAFLGIVNI

SEQ ID NO: 294487 - protein, 9 aa, Homo Sapiens
LSSTFRVEK

SEQ ID NO: 294488 - protein, 9 aa, Homo Sapiens
KLYQPDGLS

SEQ ID NO: 294489 - protein, 9 aa, Homo Sapiens
QLKNLFCIG

SEQ ID NO: 294490 - protein, 9 aa, Homo Sapiens
KVYVCNMLI

SEQ ID NO: 294491 - protein, 9 aa, Homo Sapiens
NDHLRTVQY

SEQ ID NO: 294492 - protein, 9 aa, Homo Sapiens
GFDKVSNDI

SEQ ID NO: 294493 - protein, 9 aa, Homo Sapiens
SQHEAFIQS

SEQ ID NO: 294494 - protein, 9 aa, Homo Sapiens
HQRITDHYK

SEQ ID NO: 294495 - protein, 9 aa, Homo Sapiens
LGSSDPSTS

SEQ ID NO: 294496 - protein, 9 aa, Homo Sapiens
SHLWGHEKI

SEQ ID NO: 294497 - protein, 9 aa, Homo Sapiens
ASSRAHLIR

SEQ ID NO: 294498 - protein, 9 aa, Homo Sapiens
HLFANIHPI

SEQ ID NO: 294499 - protein, 9 aa, Homo Sapiens
GGVDVFSLL

SEQ ID NO: 294500 - protein, 9 aa, Homo Sapiens
KKFPAPVHI

SEQ ID NO: 294501 - protein, 9 aa, Homo Sapiens
RLCDLKSRL

SEQ ID NO: 294502 - protein, 9 aa, Homo Sapiens
LNNNVTEDI

SEQ ID NO: 294503 - protein, 9 aa, Homo Sapiens
KYCNKWQDE

SEQ ID NO: 294504 - protein, 9 aa, Homo Sapiens
ELFGKFIFI

SEQ ID NO: 294505 - protein, 9 aa, Homo Sapiens
RITQETVDA

SEQ ID NO: 294506 - protein, 9 aa, Homo Sapiens
INSPNVLKM

SEQ ID NO: 294507 - protein, 9 aa, Homo Sapiens
WTYASSIFF

SEQ ID NO: 294508 - protein, 9 aa, Homo Sapiens
GRISWAGDL

SEQ ID NO: 294509 - protein, 9 aa, Homo Sapiens
TNKQFDKVR

SEQ ID NO: 294510 - protein, 9 aa, Homo Sapiens
PAGLMVSMS

SEQ ID NO: 294511 - protein, 9 aa, Homo Sapiens
LNELTSKSR

SEQ ID NO: 294512 - protein, 9 aa, Homo Sapiens
GKNKPAAAK

SEQ ID NO: 294513 - protein, 9 aa, Homo Sapiens
LEVENAMMI

SEQ ID NO: 294514 - protein, 9 aa, Homo Sapiens
HPQQTQTLE

SEQ ID NO: 294515 - protein, 9 aa, Homo Sapiens
SRLFPSSFT

SEQ ID NO: 294516 - protein, 9 aa, Homo Sapiens
TSKMVGDIH

SEQ ID NO: 294517 - protein, 9 aa, Homo Sapiens
LIEAQNQRF

SEQ ID NO: 294518 - protein, 9 aa, Homo Sapiens
LILNLEQQM

SEQ ID NO: 294519 - protein, 9 aa, Homo Sapiens
LKFRDAETD

SEQ ID NO: 294520 - protein, 9 aa, Homo Sapiens
SPSAVELRR

SEQ ID NO: 294521 - protein, 9 aa, Homo Sapiens
CSFISAIAL

SEQ ID NO: 294522 - protein, 9 aa, Homo Sapiens
HVKPRLDMV

SEQ ID NO: 294523 - protein, 9 aa, Homo Sapiens
EYCTTTGTW

SEQ ID NO: 294524 - protein, 9 aa, Homo Sapiens
KLPSSVAQA

SEQ ID NO: 294525 - protein, 9 aa, Homo Sapiens
QPFPINQAF

SEQ ID NO: 294526 - protein, 9 aa, Homo Sapiens
KPRADTTAT

SEQ ID NO: 294527 - protein, 9 aa, Homo Sapiens
IQEVTGSLI

SEQ ID NO: 294528 - protein, 9 aa, Homo Sapiens
QLVVELKYI

SEQ ID NO: 294529 - protein, 9 aa, Homo Sapiens
KIDDIFNKI

SEQ ID NO: 294530 - protein, 9 aa, Homo Sapiens
TSCKGRIDL

SEQ ID NO: 294531 - protein, 9 aa, Homo Sapiens
LQCWCVRCH

SEQ ID NO: 294532 - protein, 9 aa, Homo Sapiens
IFRNSIALE

SEQ ID NO: 294533 - protein, 9 aa, Homo Sapiens
DLNSQVEYL

SEQ ID NO: 294534 - protein, 9 aa, Homo Sapiens
DTVDIAPNQ

SEQ ID NO: 294535 - protein, 9 aa, Homo Sapiens
ARRVRSNPG

SEQ ID NO: 294536 - protein, 9 aa, Homo Sapiens
AEFTQHIFV

SEQ ID NO: 294537 - protein, 9 aa, Homo Sapiens
AGKKNEKSI

SEQ ID NO: 294538 - protein, 9 aa, Homo Sapiens
ERQQKRVQT

SEQ ID NO: 294539 - protein, 9 aa, Homo Sapiens
VKLKVEGSP

SEQ ID NO: 294540 - protein, 9 aa, Homo Sapiens
FGLKKDNVI

SEQ ID NO: 294541 - protein, 9 aa, Homo Sapiens
TFLSEIQWE

SEQ ID NO: 294542 - protein, 9 aa, Homo Sapiens
KLLVKNIVS

SEQ ID NO: 294543 - protein, 9 aa, Homo Sapiens
QTVPDQSDR

SEQ ID NO: 294544 - protein, 9 aa, Homo Sapiens
KHILIFSPP

SEQ ID NO: 294545 - protein, 9 aa, Homo Sapiens
KLEYKTEDG

SEQ ID NO: 294546 - protein, 9 aa, Homo Sapiens
SFIQPPKPL

SEQ ID NO: 294547 - protein, 9 aa, Homo Sapiens
PFEDNEFID

SEQ ID NO: 294548 - protein, 9 aa, Homo Sapiens
LPRNIALPF

SEQ ID NO: 294549 - protein, 9 aa, Homo Sapiens
KWKSSGNNL

SEQ ID NO: 294550 - protein, 9 aa, Homo Sapiens
LSGEPGQTE

SEQ ID NO: 294551 - protein, 9 aa, Homo Sapiens
RALLKLLRA

SEQ ID NO: 294552 - protein, 9 aa, Homo Sapiens
AATYNVDRS

SEQ ID NO: 294553 - protein, 9 aa, Homo Sapiens
EHLRPSWGL

SEQ ID NO: 294554 - protein, 9 aa, Homo Sapiens
DVSPFNIEP

SEQ ID NO: 294555 - protein, 9 aa, Homo Sapiens
YATHLKDKS

SEQ ID NO: 294556 - protein, 9 aa, Homo Sapiens
TIKIVIKEY

SEQ ID NO: 294557 - protein, 9 aa, Homo Sapiens
RVCIGADDK

SEQ ID NO: 294558 - protein, 9 aa, Homo Sapiens
ILKGLEVLA

SEQ ID NO: 294559 - protein, 9 aa, Homo Sapiens
CCCFLLLLL

SEQ ID NO: 294560 - protein, 9 aa, Homo Sapiens
GGLSPEITT

SEQ ID NO: 294561 - protein, 9 aa, Homo Sapiens
KCYESCMSG

SEQ ID NO: 294562 - protein, 9 aa, Homo Sapiens
DEVAIYISD

SEQ ID NO: 294563 - protein, 9 aa, Homo Sapiens
QRDASCVNH

SEQ ID NO: 294564 - protein, 9 aa, Homo Sapiens
DSPFPASTS

SEQ ID NO: 294565 - protein, 9 aa, Homo Sapiens
QLEQKKERE

SEQ ID NO: 294566 - protein, 9 aa, Homo Sapiens
SLGKAQTAQ

SEQ ID NO: 294567 - protein, 9 aa, Homo Sapiens
FFVRLVDKT

SEQ ID NO: 294568 - protein, 9 aa, Homo Sapiens
KLQPHLGLE

SEQ ID NO: 294569 - protein, 9 aa, Homo Sapiens
TTTPAGASL

SEQ ID NO: 294570 - protein, 9 aa, Homo Sapiens
AVFQNEDRW

SEQ ID NO: 294571 - protein, 9 aa, Homo Sapiens
TLSAHLITH

SEQ ID NO: 294572 - protein, 9 aa, Homo Sapiens
SLKLKLGLI

SEQ ID NO: 294573 - protein, 9 aa, Homo Sapiens
IGHLNTLKE

SEQ ID NO: 294574 - protein, 9 aa, Homo Sapiens
LLMEKNGDQ

SEQ ID NO: 294575 - protein, 9 aa, Homo Sapiens
SSSLQIHVR

SEQ ID NO: 294576 - protein, 9 aa, Homo Sapiens
GEHFIASSD

SEQ ID NO: 294577 - protein, 9 aa, Homo Sapiens
HDMLLGRWC

SEQ ID NO: 294578 - protein, 9 aa, Homo Sapiens
GIFKINNSR

SEQ ID NO: 294579 - protein, 9 aa, Homo Sapiens
NSTITRKVD

SEQ ID NO: 294580 - protein, 9 aa, Homo Sapiens
LVNQQMVMA

SEQ ID NO: 294581 - protein, 9 aa, Homo Sapiens
YPTALQSLV

SEQ ID NO: 294582 - protein, 9 aa, Homo Sapiens
EYRAASHKL

SEQ ID NO: 294583 - protein, 9 aa, Homo Sapiens
TPGICLVSG

SEQ ID NO: 294584 - protein, 9 aa, Homo Sapiens
RKFILLGLS

SEQ ID NO: 294585 - protein, 9 aa, Homo Sapiens
QWEINIFLQ

SEQ ID NO: 294586 - protein, 9 aa, Homo Sapiens
DLQIMKQTH

SEQ ID NO: 294587 - protein, 9 aa, Homo Sapiens
FLSVRSRNR

SEQ ID NO: 294588 - protein, 9 aa, Homo Sapiens
CETGYELEG

SEQ ID NO: 294589 - protein, 9 aa, Homo Sapiens
QMEPNVLPF

SEQ ID NO: 294590 - protein, 9 aa, Homo Sapiens
VQTSKHLFW

SEQ ID NO: 294591 - protein, 9 aa, Homo Sapiens
VRLESAWAN

SEQ ID NO: 294592 - protein, 9 aa, Homo Sapiens
FEGYCQKCL

SEQ ID NO: 294593 - protein, 9 aa, Homo Sapiens
PTIPLTVFP

SEQ ID NO: 294594 - protein, 9 aa, Homo Sapiens
GDNMNKLQT

SEQ ID NO: 294595 - protein, 9 aa, Homo Sapiens
DRTAQMCCS

SEQ ID NO: 294596 - protein, 9 aa, Homo Sapiens
PLWESSKAL

SEQ ID NO: 294597 - protein, 9 aa, Homo Sapiens
FTTALLLVF

SEQ ID NO: 294598 - protein, 9 aa, Homo Sapiens
PPEPVEDIR

SEQ ID NO: 294599 - protein, 9 aa, Homo Sapiens
ITLISVNDL

SEQ ID NO: 294600 - protein, 9 aa, Homo Sapiens
ISKRSDPIE

SEQ ID NO: 294601 - protein, 9 aa, Homo Sapiens
KLFGAENSV

SEQ ID NO: 294602 - protein, 9 aa, Homo Sapiens
LSDQSKKYL

SEQ ID NO: 294603 - protein, 9 aa, Homo Sapiens
DVDPEQLEM

SEQ ID NO: 294604 - protein, 9 aa, Homo Sapiens
GYIINSDQT

SEQ ID NO: 294605 - protein, 9 aa, Homo Sapiens
SRVGGKKSL

SEQ ID NO: 294606 - protein, 9 aa, Homo Sapiens
QLIKECYYL

SEQ ID NO: 294607 - protein, 9 aa, Homo Sapiens
NHFLICVKS

SEQ ID NO: 294608 - protein, 9 aa, Homo Sapiens
PSSQTKVLS

SEQ ID NO: 294609 - protein, 9 aa, Homo Sapiens
QELIGSMPN

SEQ ID NO: 294610 - protein, 9 aa, Homo Sapiens
EDFKTAVKK

SEQ ID NO: 294611 - protein, 9 aa, Homo Sapiens
QLLPSNKQP

SEQ ID NO: 294612 - protein, 9 aa, Homo Sapiens
RLVQCYIQI

SEQ ID NO: 294613 - protein, 9 aa, Homo Sapiens
KVTELEIKR

SEQ ID NO: 294614 - protein, 9 aa, Homo Sapiens
ELKRNKKWN

SEQ ID NO: 294615 - protein, 9 aa, Homo Sapiens
YLNQPYEII

SEQ ID NO: 294616 - protein, 9 aa, Homo Sapiens
VNEIFQDEK

SEQ ID NO: 294617 - protein, 9 aa, Homo Sapiens
LFRGLRGEC

SEQ ID NO: 294618 - protein, 9 aa, Homo Sapiens
ILHQTEEGS

SEQ ID NO: 294619 - protein, 9 aa, Homo Sapiens
RLCLHNLPR

SEQ ID NO: 294620 - protein, 9 aa, Homo Sapiens
PSRINFKKK

SEQ ID NO: 294621 - protein, 9 aa, Homo Sapiens
LFPKQKCFV

SEQ ID NO: 294622 - protein, 9 aa, Homo Sapiens
WLLFTVGAC

SEQ ID NO: 294623 - protein, 9 aa, Homo Sapiens
DPLNVDHLS

SEQ ID NO: 294624 - protein, 9 aa, Homo Sapiens
EMSIVFGIH

SEQ ID NO: 294625 - protein, 9 aa, Homo Sapiens
GGPRSDFYM

SEQ ID NO: 294626 - protein, 9 aa, Homo Sapiens
ASAVLFNIT

SEQ ID NO: 294627 - protein, 9 aa, Homo Sapiens
ETNKQFDKV

SEQ ID NO: 294628 - protein, 9 aa, Homo Sapiens
DPRPSPPHP

SEQ ID NO: 294629 - protein, 9 aa, Homo Sapiens
VVANTIDAD

SEQ ID NO: 294630 - protein, 9 aa, Homo Sapiens
EKAFCKNYS

SEQ ID NO: 294631 - protein, 9 aa, Homo Sapiens
KRVPQTGWV

SEQ ID NO: 294632 - protein, 9 aa, Homo Sapiens
PFTIPEDDG

SEQ ID NO: 294633 - protein, 9 aa, Homo Sapiens
DPEVCIREM

SEQ ID NO: 294634 - protein, 9 aa, Homo Sapiens
ASSSKMKAP

SEQ ID NO: 294635 - protein, 9 aa, Homo Sapiens
GGPKAQKKL

SEQ ID NO: 294636 - protein, 9 aa, Homo Sapiens
FNEVQSQNL

SEQ ID NO: 294637 - protein, 9 aa, Homo Sapiens
KGNSNKVVQ

SEQ ID NO: 294638 - protein, 9 aa, Homo Sapiens
TFSFTVRDS

SEQ ID NO: 294639 - protein, 9 aa, Homo Sapiens
ARRELAPKV

SEQ ID NO: 294640 - protein, 9 aa, Homo Sapiens
VRHLNMPKM

SEQ ID NO: 294641 - protein, 9 aa, Homo Sapiens
YDSRNDKVH

SEQ ID NO: 294642 - protein, 9 aa, Homo Sapiens
LLLDLNNKI

SEQ ID NO: 294643 - protein, 9 aa, Homo Sapiens
KDTPYCETD

SEQ ID NO: 294644 - protein, 9 aa, Homo Sapiens
CSVPWTCEQ

SEQ ID NO: 294645 - protein, 9 aa, Homo Sapiens
FAPEKERES

SEQ ID NO: 294646 - protein, 9 aa, Homo Sapiens
IRPWTRKGR

SEQ ID NO: 294647 - protein, 9 aa, Homo Sapiens
TEAQSLSRA

SEQ ID NO: 294648 - protein, 9 aa, Homo Sapiens
WEEGKQKII

SEQ ID NO: 294649 - protein, 9 aa, Homo Sapiens
YSTWLKLNT

SEQ ID NO: 294650 - protein, 9 aa, Homo Sapiens
TLPLEDYVF

SEQ ID NO: 294651 - protein, 9 aa, Homo Sapiens
QIVSHLHIH

SEQ ID NO: 294652 - protein, 9 aa, Homo Sapiens
NKALPVNVK

SEQ ID NO: 294653 - protein, 9 aa, Homo Sapiens
NIKKNEDAK

SEQ ID NO: 294654 - protein, 9 aa, Homo Sapiens
SIEELFGDL

SEQ ID NO: 294655 - protein, 9 aa, Homo Sapiens
AEQEIIRRE

SEQ ID NO: 294656 - protein, 9 aa, Homo Sapiens
KEFNYLHNQ

SEQ ID NO: 294657 - protein, 9 aa, Homo Sapiens
MMETMCSRQ

SEQ ID NO: 294658 - protein, 9 aa, Homo Sapiens
TTILKFPSA

SEQ ID NO: 294659 - protein, 9 aa, Homo Sapiens
KKKVDRYIE

SEQ ID NO: 294660 - protein, 9 aa, Homo Sapiens
GAVGYWKKH

SEQ ID NO: 294661 - protein, 9 aa, Homo Sapiens
SLHVRCAGF

SEQ ID NO: 294662 - protein, 9 aa, Homo Sapiens
KMEDEYKNP

SEQ ID NO: 294663 - protein, 9 aa, Homo Sapiens
LEEFYEQFM

SEQ ID NO: 294664 - protein, 9 aa, Homo Sapiens
CAGRDSYLC

SEQ ID NO: 294665 - protein, 9 aa, Homo Sapiens
QNAEVRQIE

SEQ ID NO: 294666 - protein, 9 aa, Homo Sapiens
TDHLAWTRN

SEQ ID NO: 294667 - protein, 9 aa, Homo Sapiens
KWDLEYLQD

SEQ ID NO: 294668 - protein, 9 aa, Homo Sapiens
RCVRDPQKS

SEQ ID NO: 294669 - protein, 9 aa, Homo Sapiens
IMTPEQFQL

SEQ ID NO: 294670 - protein, 9 aa, Homo Sapiens
NFNPTEEQD

SEQ ID NO: 294671 - protein, 9 aa, Homo Sapiens
QSKKLSLFV

SEQ ID NO: 294672 - protein, 9 aa, Homo Sapiens
LRPIFQTYV

SEQ ID NO: 294673 - protein, 9 aa, Homo Sapiens
KLQEQNITP

SEQ ID NO: 294674 - protein, 9 aa, Homo Sapiens
LLANYILFR

SEQ ID NO: 294675 - protein, 9 aa, Homo Sapiens
GYLNQPYEI

SEQ ID NO: 294676 - protein, 9 aa, Homo Sapiens
RHILEGDQG

SEQ ID NO: 294677 - protein, 9 aa, Homo Sapiens
FNNIREQNE

SEQ ID NO: 294678 - protein, 9 aa, Homo Sapiens
FHPIYRGAS

SEQ ID NO: 294679 - protein, 9 aa, Homo Sapiens
VIYKKVIIA

SEQ ID NO: 294680 - protein, 9 aa, Homo Sapiens
NEYPTPQSY

SEQ ID NO: 294681 - protein, 9 aa, Homo Sapiens
VLGPDKYDK

SEQ ID NO: 294682 - protein, 9 aa, Homo Sapiens
LCVKNPMVI

SEQ ID NO: 294683 - protein, 9 aa, Homo Sapiens
CSNVYVDVK

SEQ ID NO: 294684 - protein, 9 aa, Homo Sapiens
PPTIPLTVF

SEQ ID NO: 294685 - protein, 9 aa, Homo Sapiens
SKLVDLEIK

SEQ ID NO: 294686 - protein, 9 aa, Homo Sapiens
WNYNPEEVC

SEQ ID NO: 294687 - protein, 9 aa, Homo Sapiens
FVRASSCRE

SEQ ID NO: 294688 - protein, 9 aa, Homo Sapiens
CNSILEDTE

SEQ ID NO: 294689 - protein, 9 aa, Homo Sapiens
GPKAQKKLK

SEQ ID NO: 294690 - protein, 9 aa, Homo Sapiens
KRQSKFQVP

SEQ ID NO: 294691 - protein, 9 aa, Homo Sapiens
ELTEALRDL

SEQ ID NO: 294692 - protein, 9 aa, Homo Sapiens
AFQFALHSS

SEQ ID NO: 294693 - protein, 9 aa, Homo Sapiens
HALLQKHPA

SEQ ID NO: 294694 - protein, 9 aa, Homo Sapiens
VFLFLVPYN

SEQ ID NO: 294695 - protein, 9 aa, Homo Sapiens
TLSQINRDQ

SEQ ID NO: 294696 - protein, 9 aa, Homo Sapiens
EERQIILAV

SEQ ID NO: 294697 - protein, 9 aa, Homo Sapiens
FEPKDITAK

SEQ ID NO: 294698 - protein, 9 aa, Homo Sapiens
FKQFCLLLN

SEQ ID NO: 294699 - protein, 9 aa, Homo Sapiens
NYLSFQEVR

SEQ ID NO: 294700 - protein, 9 aa, Homo Sapiens
GQVGKDLSL

SEQ ID NO: 294701 - protein, 9 aa, Homo Sapiens
TLADQMNLI

SEQ ID NO: 294702 - protein, 9 aa, Homo Sapiens
IQNEQVRQR

SEQ ID NO: 294703 - protein, 9 aa, Homo Sapiens
TFYLAQDLF

SEQ ID NO: 294704 - protein, 9 aa, Homo Sapiens
VDKDEDATS

SEQ ID NO: 294705 - protein, 9 aa, Homo Sapiens
LGLEIANNL

SEQ ID NO: 294706 - protein, 9 aa, Homo Sapiens
VPDNKAWPA

SEQ ID NO: 294707 - protein, 9 aa, Homo Sapiens
NVLKMIRHT

SEQ ID NO: 294708 - protein, 9 aa, Homo Sapiens
MIPRARKIG

SEQ ID NO: 294709 - protein, 9 aa, Homo Sapiens
TSLSQQPEA

SEQ ID NO: 294710 - protein, 9 aa, Homo Sapiens
IKNTLHKFC

SEQ ID NO: 294711 - protein, 9 aa, Homo Sapiens
MEKIILDAQ

SEQ ID NO: 294712 - protein, 9 aa, Homo Sapiens
LYYMALIKR

SEQ ID NO: 294713 - protein, 9 aa, Homo Sapiens
NYPHLLEAI

SEQ ID NO: 294714 - protein, 9 aa, Homo Sapiens
SMDSAFTGK

SEQ ID NO: 294715 - protein, 9 aa, Homo Sapiens
VFQTAQNAG

SEQ ID NO: 294716 - protein, 9 aa, Homo Sapiens
TLNKLEVEL

SEQ ID NO: 294717 - protein, 9 aa, Homo Sapiens
QNTAPAQLS

SEQ ID NO: 294718 - protein, 9 aa, Homo Sapiens
DKLKAIEPN

SEQ ID NO: 294719 - protein, 9 aa, Homo Sapiens
DKPAIYKRA

SEQ ID NO: 294720 - protein, 9 aa, Homo Sapiens
TGADISLLD

SEQ ID NO: 294721 - protein, 9 aa, Homo Sapiens
QPHNVPYIV

SEQ ID NO: 294722 - protein, 9 aa, Homo Sapiens
KERDFQNLR

SEQ ID NO: 294723 - protein, 9 aa, Homo Sapiens
DTGHCFCRI

SEQ ID NO: 294724 - protein, 9 aa, Homo Sapiens
PLRYQIIMT

SEQ ID NO: 294725 - protein, 9 aa, Homo Sapiens
LNKPAIKDS

SEQ ID NO: 294726 - protein, 9 aa, Homo Sapiens
CADTGGLGR

SEQ ID NO: 294727 - protein, 9 aa, Homo Sapiens
SIFGDNMNK

SEQ ID NO: 294728 - protein, 9 aa, Homo Sapiens
ALLRMKQLE

SEQ ID NO: 294729 - protein, 9 aa, Homo Sapiens
EKLKNQAEV

SEQ ID NO: 294730 - protein, 9 aa, Homo Sapiens
LHSVMTYRL

SEQ ID NO: 294731 - protein, 9 aa, Homo Sapiens
IGETVNNSR

SEQ ID NO: 294732 - protein, 9 aa, Homo Sapiens
IYESYGIEN

SEQ ID NO: 294733 - protein, 9 aa, Homo Sapiens
SIMQPNYIS

SEQ ID NO: 294734 - protein, 9 aa, Homo Sapiens
VSEDVIYRP

SEQ ID NO: 294735 - protein, 9 aa, Homo Sapiens
ENHLGKQKV

SEQ ID NO: 294736 - protein, 9 aa, Homo Sapiens
SYFEIFKTK

SEQ ID NO: 294737 - protein, 9 aa, Homo Sapiens
SYSSSFQIH

SEQ ID NO: 294738 - protein, 9 aa, Homo Sapiens
GPDAHVIKR

SEQ ID NO: 294739 - protein, 9 aa, Homo Sapiens
MRNSWNFKL

SEQ ID NO: 294740 - protein, 9 aa, Homo Sapiens
YVILEKLQP

SEQ ID NO: 294741 - protein, 9 aa, Homo Sapiens
NDCENNYTC

SEQ ID NO: 294742 - protein, 9 aa, Homo Sapiens
LICRTCNLS

SEQ ID NO: 294743 - protein, 9 aa, Homo Sapiens
LKMFMSLLV

SEQ ID NO: 294744 - protein, 9 aa, Homo Sapiens
LIRNKCGSA

SEQ ID NO: 294745 - protein, 9 aa, Homo Sapiens
QDELFKRLK

SEQ ID NO: 294746 - protein, 9 aa, Homo Sapiens
DILRVIGNQ

SEQ ID NO: 294747 - protein, 9 aa, Homo Sapiens
NPNITVIYD

SEQ ID NO: 294748 - protein, 9 aa, Homo Sapiens
TLTLQAPPN

SEQ ID NO: 294749 - protein, 9 aa, Homo Sapiens
WYKQYTGRG

SEQ ID NO: 294750 - protein, 9 aa, Homo Sapiens
QIQRHHTFL

SEQ ID NO: 294751 - protein, 9 aa, Homo Sapiens
YQYILVRNV

SEQ ID NO: 294752 - protein, 9 aa, Homo Sapiens
FPTYLHSRQ

SEQ ID NO: 294753 - protein, 9 aa, Homo Sapiens
VKRQKENPL

SEQ ID NO: 294754 - protein, 9 aa, Homo Sapiens
FLSLTKHKV

SEQ ID NO: 294755 - protein, 9 aa, Homo Sapiens
SAGVPLDLL

SEQ ID NO: 294756 - protein, 9 aa, Homo Sapiens
LQNHKHHDT

SEQ ID NO: 294757 - protein, 9 aa, Homo Sapiens
KAIDFGSAS

SEQ ID NO: 294758 - protein, 9 aa, Homo Sapiens
YLKLAKPLS

SEQ ID NO: 294759 - protein, 9 aa, Homo Sapiens
LEQDNQNLR

SEQ ID NO: 294760 - protein, 9 aa, Homo Sapiens
SQVILHLGT

SEQ ID NO: 294761 - protein, 9 aa, Homo Sapiens
RSELKQRLS

SEQ ID NO: 294762 - protein, 9 aa, Homo Sapiens
LIGNIVLRK

SEQ ID NO: 294763 - protein, 9 aa, Homo Sapiens
ELPELTVES

SEQ ID NO: 294764 - protein, 9 aa, Homo Sapiens
VWVEKEKGP

SEQ ID NO: 294765 - protein, 9 aa, Homo Sapiens
KGDLQIMKQ

SEQ ID NO: 294766 - protein, 9 aa, Homo Sapiens
LRSLVTRIY

SEQ ID NO: 294767 - protein, 9 aa, Homo Sapiens
CERGAPWIP

SEQ ID NO: 294768 - protein, 9 aa, Homo Sapiens
DPQSFKKIV

SEQ ID NO: 294769 - protein, 9 aa, Homo Sapiens
NILDLCVLF

SEQ ID NO: 294770 - protein, 9 aa, Homo Sapiens
CNNTVGSYQ

SEQ ID NO: 294771 - protein, 9 aa, Homo Sapiens
IYVVQAYIN

SEQ ID NO: 294772 - protein, 9 aa, Homo Sapiens
GFPNGYPYY

SEQ ID NO: 294773 - protein, 9 aa, Homo Sapiens
EDNHIKDAL

SEQ ID NO: 294774 - protein, 9 aa, Homo Sapiens
GVRFIANHM

SEQ ID NO: 294775 - protein, 9 aa, Homo Sapiens
KLFGVLRQI

SEQ ID NO: 294776 - protein, 9 aa, Homo Sapiens
TSQTLKNSL

SEQ ID NO: 294777 - protein, 9 aa, Homo Sapiens
ETLLYAMVT

SEQ ID NO: 294778 - protein, 9 aa, Homo Sapiens
EKRSTQTRL

SEQ ID NO: 294779 - protein, 9 aa, Homo Sapiens
SSCLTQHQI

SEQ ID NO: 294780 - protein, 9 aa, Homo Sapiens
YTELQKQPL

SEQ ID NO: 294781 - protein, 9 aa, Homo Sapiens
FCSEAGMST

SEQ ID NO: 294782 - protein, 9 aa, Homo Sapiens
DVIEGGLLA

SEQ ID NO: 294783 - protein, 9 aa, Homo Sapiens
PRGPSSGYC

SEQ ID NO: 294784 - protein, 9 aa, Homo Sapiens
FTGGSQENH

SEQ ID NO: 294785 - protein, 9 aa, Homo Sapiens
CYCGKIISS

SEQ ID NO: 294786 - protein, 9 aa, Homo Sapiens
QFWFLMYPF

SEQ ID NO: 294787 - protein, 9 aa, Homo Sapiens
LTAADTCIM

SEQ ID NO: 294788 - protein, 9 aa, Homo Sapiens
RTNKDCKTS

SEQ ID NO: 294789 - protein, 9 aa, Homo Sapiens
DYQIIQYIP

SEQ ID NO: 294790 - protein, 9 aa, Homo Sapiens
QRLAKKIRE

SEQ ID NO: 294791 - protein, 9 aa, Homo Sapiens
SGLFGQVFR

SEQ ID NO: 294792 - protein, 9 aa, Homo Sapiens
TQARAASQN

SEQ ID NO: 294793 - protein, 9 aa, Homo Sapiens
PRKICCTDK

SEQ ID NO: 294794 - protein, 9 aa, Homo Sapiens
LCTVAATLV

SEQ ID NO: 294795 - protein, 9 aa, Homo Sapiens
HLARRVRSN

SEQ ID NO: 294796 - protein, 9 aa, Homo Sapiens
TCNLSLPFH

SEQ ID NO: 294797 - protein, 9 aa, Homo Sapiens
TPCAEEAVA

SEQ ID NO: 294798 - protein, 9 aa, Homo Sapiens
QERVAELMT

SEQ ID NO: 294799 - protein, 9 aa, Homo Sapiens
LRPHVHTQT

SEQ ID NO: 294800 - protein, 9 aa, Homo Sapiens
KLQWCIMHA

SEQ ID NO: 294801 - protein, 9 aa, Homo Sapiens
RLHLCDSNI

SEQ ID NO: 294802 - protein, 9 aa, Homo Sapiens
SGFSGLCGT

SEQ ID NO: 294803 - protein, 9 aa, Homo Sapiens
YFAFGLFGV

SEQ ID NO: 294804 - protein, 9 aa, Homo Sapiens
FGTDYSENI

SEQ ID NO: 294805 - protein, 9 aa, Homo Sapiens
KSVAQIGGR

SEQ ID NO: 294806 - protein, 9 aa, Homo Sapiens
RLLESVERQ

SEQ ID NO: 294807 - protein, 9 aa, Homo Sapiens
WCLSLELFG

SEQ ID NO: 294808 - protein, 9 aa, Homo Sapiens
GYVARFYRE

SEQ ID NO: 294809 - protein, 9 aa, Homo Sapiens
QRKLSKIKL

SEQ ID NO: 294810 - protein, 9 aa, Homo Sapiens
YNIKSANFN

SEQ ID NO: 294811 - protein, 9 aa, Homo Sapiens
NENSTPDKT

SEQ ID NO: 294812 - protein, 9 aa, Homo Sapiens
HKRDKFHSN

SEQ ID NO: 294813 - protein, 9 aa, Homo Sapiens
SIKNEPFTI

SEQ ID NO: 294814 - protein, 9 aa, Homo Sapiens
GLGSTKFDI

SEQ ID NO: 294815 - protein, 9 aa, Homo Sapiens
QIAAAPTPD

SEQ ID NO: 294816 - protein, 9 aa, Homo Sapiens
RIFREVGPN

SEQ ID NO: 294817 - protein, 9 aa, Homo Sapiens
ENKGGPPGR

SEQ ID NO: 294818 - protein, 9 aa, Homo Sapiens
LSDNMLILE

SEQ ID NO: 294819 - protein, 9 aa, Homo Sapiens
PEDKIWEEL

SEQ ID NO: 294820 - protein, 9 aa, Homo Sapiens
GRELKKDHC

SEQ ID NO: 294821 - protein, 9 aa, Homo Sapiens
AFLISLILI

SEQ ID NO: 294822 - protein, 9 aa, Homo Sapiens
IFLAKLLKK

SEQ ID NO: 294823 - protein, 9 aa, Homo Sapiens
TSQETRLQR

SEQ ID NO: 294824 - protein, 9 aa, Homo Sapiens
ITATEIRNK

SEQ ID NO: 294825 - protein, 9 aa, Homo Sapiens
QLFFVRLVD

SEQ ID NO: 294826 - protein, 9 aa, Homo Sapiens
GYCQKCLIE

SEQ ID NO: 294827 - protein, 9 aa, Homo Sapiens
SSSVSWKIL

SEQ ID NO: 294828 - protein, 9 aa, Homo Sapiens
KLTHLDLSV

SEQ ID NO: 294829 - protein, 9 aa, Homo Sapiens
RNTDETLFG

SEQ ID NO: 294830 - protein, 9 aa, Homo Sapiens
LTKMKSTLI

SEQ ID NO: 294831 - protein, 9 aa, Homo Sapiens
KTIEALSGK

SEQ ID NO: 294832 - protein, 9 aa, Homo Sapiens
FIPLPRLLT

SEQ ID NO: 294833 - protein, 9 aa, Homo Sapiens
SSLRASPAH

SEQ ID NO: 294834 - protein, 9 aa, Homo Sapiens
QISLNELTS

SEQ ID NO: 294835 - protein, 9 aa, Homo Sapiens
VPCCTHYLP

SEQ ID NO: 294836 - protein, 9 aa, Homo Sapiens
NELDNLYCD

SEQ ID NO: 294837 - protein, 9 aa, Homo Sapiens
FILLCCLYQ

SEQ ID NO: 294838 - protein, 9 aa, Homo Sapiens
PTPLPIQLG

SEQ ID NO: 294839 - protein, 9 aa, Homo Sapiens
INTLSGIVQ

SEQ ID NO: 294840 - protein, 9 aa, Homo Sapiens
NHRESDNSG

SEQ ID NO: 294841 - protein, 9 aa, Homo Sapiens
WRHHHHHQH

SEQ ID NO: 294842 - protein, 9 aa, Homo Sapiens
MADNEAGKE

SEQ ID NO: 294843 - protein, 9 aa, Homo Sapiens
TMCSRQWQL

SEQ ID NO: 294844 - protein, 9 aa, Homo Sapiens
FVVMNPHIC

SEQ ID NO: 294845 - protein, 9 aa, Homo Sapiens
KVFYPTEKA

SEQ ID NO: 294846 - protein, 9 aa, Homo Sapiens
NICKISVSR

SEQ ID NO: 294847 - protein, 9 aa, Homo Sapiens
KVLQGKFNG

SEQ ID NO: 294848 - protein, 9 aa, Homo Sapiens
GKTFTLGNN

SEQ ID NO: 294849 - protein, 9 aa, Homo Sapiens
TREVMTTEE

SEQ ID NO: 294850 - protein, 9 aa, Homo Sapiens
VQLKNQAMS

SEQ ID NO: 294851 - protein, 9 aa, Homo Sapiens
LIGSMPNPN

SEQ ID NO: 294852 - protein, 9 aa, Homo Sapiens
LADMYGTVQ

SEQ ID NO: 294853 - protein, 9 aa, Homo Sapiens
CIQNVLSEK

SEQ ID NO: 294854 - protein, 9 aa, Homo Sapiens
WDFIAQLSI

SEQ ID NO: 294855 - protein, 9 aa, Homo Sapiens
SDIIVHQRI

SEQ ID NO: 294856 - protein, 9 aa, Homo Sapiens
NYRTLPTAS

SEQ ID NO: 294857 - protein, 9 aa, Homo Sapiens
RNSRLLEEL

SEQ ID NO: 294858 - protein, 9 aa, Homo Sapiens
RESLIKKIQ

SEQ ID NO: 294859 - protein, 9 aa, Homo Sapiens
FNESQGKNR

SEQ ID NO: 294860 - protein, 9 aa, Homo Sapiens
KKTEQLHQK

SEQ ID NO: 294861 - protein, 9 aa, Homo Sapiens
TYQHGGLTG

SEQ ID NO: 294862 - protein, 9 aa, Homo Sapiens
HIMKDKWWR

SEQ ID NO: 294863 - protein, 9 aa, Homo Sapiens
PLCGNNVIS

SEQ ID NO: 294864 - protein, 9 aa, Homo Sapiens
SILQIASAD

SEQ ID NO: 294865 - protein, 9 aa, Homo Sapiens
GNFFRYIST

SEQ ID NO: 294866 - protein, 9 aa, Homo Sapiens
TRSIPKDTW

SEQ ID NO: 294867 - protein, 9 aa, Homo Sapiens
RRSHCHRPH

SEQ ID NO: 294868 - protein, 9 aa, Homo Sapiens
HVQVIVEFT

SEQ ID NO: 294869 - protein, 9 aa, Homo Sapiens
NKLIAYSTV

SEQ ID NO: 294870 - protein, 9 aa, Homo Sapiens
YTIKCYESC

SEQ ID NO: 294871 - protein, 9 aa, Homo Sapiens
EVQAILRIN

SEQ ID NO: 294872 - protein, 9 aa, Homo Sapiens
VFPVAIFIT

SEQ ID NO: 294873 - protein, 9 aa, Homo Sapiens
WNPQKAIPI

SEQ ID NO: 294874 - protein, 9 aa, Homo Sapiens
LNYLGNLAK

SEQ ID NO: 294875 - protein, 9 aa, Homo Sapiens
QARMQQQTT

SEQ ID NO: 294876 - protein, 9 aa, Homo Sapiens
TVSVKKRSV

SEQ ID NO: 294877 - protein, 9 aa, Homo Sapiens
IIQFVGACN

SEQ ID NO: 294878 - protein, 9 aa, Homo Sapiens
ETSLTETEV

SEQ ID NO: 294879 - protein, 9 aa, Homo Sapiens
NVGHSFHVH

SEQ ID NO: 294880 - protein, 9 aa, Homo Sapiens
DHYMFLKGH

SEQ ID NO: 294881 - protein, 9 aa, Homo Sapiens
RRTIHYENG

SEQ ID NO: 294882 - protein, 9 aa, Homo Sapiens
LYRALLKLL

SEQ ID NO: 294883 - protein, 9 aa, Homo Sapiens
TNILPKTLG

SEQ ID NO: 294884 - protein, 9 aa, Homo Sapiens
LNDDQRDVY

SEQ ID NO: 294885 - protein, 9 aa, Homo Sapiens
TGDEFYFME

SEQ ID NO: 294886 - protein, 9 aa, Homo Sapiens
LLKNQAVQG

SEQ ID NO: 294887 - protein, 9 aa, Homo Sapiens
SSCATSPTG

SEQ ID NO: 294888 - protein, 9 aa, Homo Sapiens
WTQEAVGRH

SEQ ID NO: 294889 - protein, 9 aa, Homo Sapiens
SAYSETFIL

SEQ ID NO: 294890 - protein, 9 aa, Homo Sapiens
DICRGLRSH

SEQ ID NO: 294891 - protein, 9 aa, Homo Sapiens
PGVTDVLCS

SEQ ID NO: 294892 - protein, 9 aa, Homo Sapiens
PQTGKPSMI

SEQ ID NO: 294893 - protein, 9 aa, Homo Sapiens
FPVAIFITS

SEQ ID NO: 294894 - protein, 9 aa, Homo Sapiens
MLHKSIDVT

SEQ ID NO: 294895 - protein, 9 aa, Homo Sapiens
GAKGAFKKI

SEQ ID NO: 294896 - protein, 9 aa, Homo Sapiens
HEVQVGERL

SEQ ID NO: 294897 - protein, 9 aa, Homo Sapiens
TDGKWQRDV

SEQ ID NO: 294898 - protein, 9 aa, Homo Sapiens
KSPHTEREN

SEQ ID NO: 294899 - protein, 9 aa, Homo Sapiens
ALGKPSHLR

SEQ ID NO: 294900 - protein, 9 aa, Homo Sapiens
STNNSNPVM

SEQ ID NO: 294901 - protein, 9 aa, Homo Sapiens
IHNFTETHV

SEQ ID NO: 294902 - protein, 9 aa, Homo Sapiens
QDTSHLYTD

SEQ ID NO: 294903 - protein, 9 aa, Homo Sapiens
RAHLAHHEI

SEQ ID NO: 294904 - protein, 9 aa, Homo Sapiens
QIVYNNADG

SEQ ID NO: 294905 - protein, 9 aa, Homo Sapiens
SVAKIDSLA

SEQ ID NO: 294906 - protein, 9 aa, Homo Sapiens
VADPLMDQG

SEQ ID NO: 294907 - protein, 9 aa, Homo Sapiens
SFFLKHGKM

SEQ ID NO: 294908 - protein, 9 aa, Homo Sapiens
NFIQINTKG

SEQ ID NO: 294909 - protein, 9 aa, Homo Sapiens
LRDMKAIGI

SEQ ID NO: 294910 - protein, 9 aa, Homo Sapiens
EFLWHLKSF

SEQ ID NO: 294911 - protein, 9 aa, Homo Sapiens
FDNSYQNTT

SEQ ID NO: 294912 - protein, 9 aa, Homo Sapiens
TSDERGTHI

SEQ ID NO: 294913 - protein, 9 aa, Homo Sapiens
DPKYQQRLP

SEQ ID NO: 294914 - protein, 9 aa, Homo Sapiens
EGDGNRMTL

SEQ ID NO: 294915 - protein, 9 aa, Homo Sapiens
DPKRAKAMQ

SEQ ID NO: 294916 - protein, 9 aa, Homo Sapiens
EVDMRSIVI

SEQ ID NO: 294917 - protein, 9 aa, Homo Sapiens
YFMEDSRLV

SEQ ID NO: 294918 - protein, 9 aa, Homo Sapiens
ALIKRGTAK

SEQ ID NO: 294919 - protein, 9 aa, Homo Sapiens
QQEIQVVLE

SEQ ID NO: 294920 - protein, 9 aa, Homo Sapiens
IQMNAPSKS

SEQ ID NO: 294921 - protein, 9 aa, Homo Sapiens
STPCAEEAV

SEQ ID NO: 294922 - protein, 9 aa, Homo Sapiens
DVKDNTKRF

SEQ ID NO: 294923 - protein, 9 aa, Homo Sapiens
PEDKMFLLD

SEQ ID NO: 294924 - protein, 9 aa, Homo Sapiens
DFHPKIKYY

SEQ ID NO: 294925 - protein, 9 aa, Homo Sapiens
QTFVRKFIL

SEQ ID NO: 294926 - protein, 9 aa, Homo Sapiens
LAVKELSWQ

SEQ ID NO: 294927 - protein, 9 aa, Homo Sapiens
PLFRINISQ

SEQ ID NO: 294928 - protein, 9 aa, Homo Sapiens
SVRVPSVTL

SEQ ID NO: 294929 - protein, 9 aa, Homo Sapiens
PIGHLNTLK

SEQ ID NO: 294930 - protein, 9 aa, Homo Sapiens
HLDNHRESD

SEQ ID NO: 294931 - protein, 9 aa, Homo Sapiens
YLYRSKSRQ

SEQ ID NO: 294932 - protein, 9 aa, Homo Sapiens
IQVKRIHKY

SEQ ID NO: 294933 - protein, 9 aa, Homo Sapiens
VNRPNKKKI

SEQ ID NO: 294934 - protein, 9 aa, Homo Sapiens
SLSKDIIYI

SEQ ID NO: 294935 - protein, 9 aa, Homo Sapiens
NLFCIGVIL

SEQ ID NO: 294936 - protein, 9 aa, Homo Sapiens
PFNESQGKN

SEQ ID NO: 294937 - protein, 9 aa, Homo Sapiens
PGLLSRANI

SEQ ID NO: 294938 - protein, 9 aa, Homo Sapiens
TMTEKVEEL

SEQ ID NO: 294939 - protein, 9 aa, Homo Sapiens
LLNILTEPE

SEQ ID NO: 294940 - protein, 9 aa, Homo Sapiens
KDQSHDIGL

SEQ ID NO: 294941 - protein, 9 aa, Homo Sapiens
ELEEREENL

SEQ ID NO: 294942 - protein, 9 aa, Homo Sapiens
APAHRRLWY

SEQ ID NO: 294943 - protein, 9 aa, Homo Sapiens
EVPAKEKTS

SEQ ID NO: 294944 - protein, 9 aa, Homo Sapiens
KIVIKEYVQ

SEQ ID NO: 294945 - protein, 9 aa, Homo Sapiens
IRMEKELQA

SEQ ID NO: 294946 - protein, 9 aa, Homo Sapiens
SQGKNRESS

SEQ ID NO: 294947 - protein, 9 aa, Homo Sapiens
TIECNEILE

SEQ ID NO: 294948 - protein, 9 aa, Homo Sapiens
QWEPPVRAS

SEQ ID NO: 294949 - protein, 9 aa, Homo Sapiens
CTTTNYPST

SEQ ID NO: 294950 - protein, 9 aa, Homo Sapiens
HNNSSLIQH

SEQ ID NO: 294951 - protein, 9 aa, Homo Sapiens
GTYVIQVTA

SEQ ID NO: 294952 - protein, 9 aa, Homo Sapiens
KGHSPEDIC

SEQ ID NO: 294953 - protein, 9 aa, Homo Sapiens
SGSAHFSFT

SEQ ID NO: 294954 - protein, 9 aa, Homo Sapiens
IENCLANTV

SEQ ID NO: 294955 - protein, 9 aa, Homo Sapiens
ERDFQNLRK

SEQ ID NO: 294956 - protein, 9 aa, Homo Sapiens
NISIPGEMV

SEQ ID NO: 294957 - protein, 9 aa, Homo Sapiens
LQRTGQEKE

SEQ ID NO: 294958 - protein, 9 aa, Homo Sapiens
ELIYLVEDV

SEQ ID NO: 294959 - protein, 9 aa, Homo Sapiens
EGRSDSRNY

SEQ ID NO: 294960 - protein, 9 aa, Homo Sapiens
VTEVCADTG

SEQ ID NO: 294961 - protein, 9 aa, Homo Sapiens
REINITKLE

SEQ ID NO: 294962 - protein, 9 aa, Homo Sapiens
EAEQEIIRR

SEQ ID NO: 294963 - protein, 9 aa, Homo Sapiens
VRSNPGGGG

SEQ ID NO: 294964 - protein, 9 aa, Homo Sapiens
TCSVPWTCE

SEQ ID NO: 294965 - protein, 9 aa, Homo Sapiens
MVERVLGTH

SEQ ID NO: 294966 - protein, 9 aa, Homo Sapiens
LKMLLENVK

SEQ ID NO: 294967 - protein, 9 aa, Homo Sapiens
FEMGGSKGI

SEQ ID NO: 294968 - protein, 9 aa, Homo Sapiens
AQMEPNVLP

SEQ ID NO: 294969 - protein, 9 aa, Homo Sapiens
LLRMKQLED

SEQ ID NO: 294970 - protein, 9 aa, Homo Sapiens
NIDTPKGGF

SEQ ID NO: 294971 - protein, 9 aa, Homo Sapiens
NVKFFYVVS

SEQ ID NO: 294972 - protein, 9 aa, Homo Sapiens
RWCLSLELF

SEQ ID NO: 294973 - protein, 9 aa, Homo Sapiens
TLSLCLTAV

SEQ ID NO: 294974 - protein, 9 aa, Homo Sapiens
GCEPPGDFP

SEQ ID NO: 294975 - protein, 9 aa, Homo Sapiens
KLRKAFNDI

SEQ ID NO: 294976 - protein, 9 aa, Homo Sapiens
SDERGTHIM

SEQ ID NO: 294977 - protein, 9 aa, Homo Sapiens
KSKGKSPHT

SEQ ID NO: 294978 - protein, 9 aa, Homo Sapiens
QDIREHIWG

SEQ ID NO: 294979 - protein, 9 aa, Homo Sapiens
ALQLFDRKN

SEQ ID NO: 294980 - protein, 9 aa, Homo Sapiens
GQRLSLIST

SEQ ID NO: 294981 - protein, 9 aa, Homo Sapiens
VFCQYLFRN

SEQ ID NO: 294982 - protein, 9 aa, Homo Sapiens
LPKQEDSKI

SEQ ID NO: 294983 - protein, 9 aa, Homo Sapiens
LNKSLDREE

SEQ ID NO: 294984 - protein, 9 aa, Homo Sapiens
DDNNSVNHV

SEQ ID NO: 294985 - protein, 9 aa, Homo Sapiens
KGPHTPSPP

SEQ ID NO: 294986 - protein, 9 aa, Homo Sapiens
HTQTEKTTR

SEQ ID NO: 294987 - protein, 9 aa, Homo Sapiens
FLGITVSKL

SEQ ID NO: 294988 - protein, 9 aa, Homo Sapiens
QWVDLAHLC

SEQ ID NO: 294989 - protein, 9 aa, Homo Sapiens
PFKLVSTFN

SEQ ID NO: 294990 - protein, 9 aa, Homo Sapiens
DIEVETVEP

SEQ ID NO: 294991 - protein, 9 aa, Homo Sapiens
PRGNSIFGM

SEQ ID NO: 294992 - protein, 9 aa, Homo Sapiens
KKICSNVYV

SEQ ID NO: 294993 - protein, 9 aa, Homo Sapiens
QDIRRREIK

SEQ ID NO: 294994 - protein, 9 aa, Homo Sapiens
SYDSPFPAS

SEQ ID NO: 294995 - protein, 9 aa, Homo Sapiens
IVEVILEVN

SEQ ID NO: 294996 - protein, 9 aa, Homo Sapiens
DLEGLTPQK

SEQ ID NO: 294997 - protein, 9 aa, Homo Sapiens
DQHCRDIFG

SEQ ID NO: 294998 - protein, 9 aa, Homo Sapiens
TYASSIFFR

SEQ ID NO: 294999 - protein, 9 aa, Homo Sapiens
VSDGALQEL

SEQ ID NO: 295000 - protein, 9 aa, Homo Sapiens
DFREQIVRV

SEQ ID NO: 295001 - protein, 9 aa, Homo Sapiens
QIEASIRGE

SEQ ID NO: 295002 - protein, 9 aa, Homo Sapiens
ELELLDRTV

SEQ ID NO: 295003 - protein, 9 aa, Homo Sapiens
NSTPDKTDM

SEQ ID NO: 295004 - protein, 9 aa, Homo Sapiens
LLRQQNVFC

SEQ ID NO: 295005 - protein, 9 aa, Homo Sapiens
NYQGSIHKS

SEQ ID NO: 295006 - protein, 9 aa, Homo Sapiens
KRKDSQTVY

SEQ ID NO: 295007 - protein, 9 aa, Homo Sapiens
DNPSPTQQE

SEQ ID NO: 295008 - protein, 9 aa, Homo Sapiens
AARICLGGP

SEQ ID NO: 295009 - protein, 9 aa, Homo Sapiens
RGTLDLRKR

SEQ ID NO: 295010 - protein, 9 aa, Homo Sapiens
MLSLASHLS

SEQ ID NO: 295011 - protein, 9 aa, Homo Sapiens
TCTAYGDLH

SEQ ID NO: 295012 - protein, 9 aa, Homo Sapiens
PLPPGFKQL

SEQ ID NO: 295013 - protein, 9 aa, Homo Sapiens
GAICYYSEN

SEQ ID NO: 295014 - protein, 9 aa, Homo Sapiens
PNGYPYYTH

SEQ ID NO: 295015 - protein, 9 aa, Homo Sapiens
MIGFKNFYS

SEQ ID NO: 295016 - protein, 9 aa, Homo Sapiens
ATVVSDEDK

SEQ ID NO: 295017 - protein, 9 aa, Homo Sapiens
LCSFRKVIS

SEQ ID NO: 295018 - protein, 9 aa, Homo Sapiens
FPKVIMRIY

SEQ ID NO: 295019 - protein, 9 aa, Homo Sapiens
GDLLTFLSN

SEQ ID NO: 295020 - protein, 9 aa, Homo Sapiens
VLRQITGSL

SEQ ID NO: 295021 - protein, 9 aa, Homo Sapiens
MFLTQKYRW

SEQ ID NO: 295022 - protein, 9 aa, Homo Sapiens
DKVPERKCG

SEQ ID NO: 295023 - protein, 9 aa, Homo Sapiens
DENTVLQKE

SEQ ID NO: 295024 - protein, 9 aa, Homo Sapiens
DLLSKNNRL

SEQ ID NO: 295025 - protein, 9 aa, Homo Sapiens
GKKLYTCEE

SEQ ID NO: 295026 - protein, 9 aa, Homo Sapiens
GQTEGKGQE

SEQ ID NO: 295027 - protein, 9 aa, Homo Sapiens
LTRFKQWHS

SEQ ID NO: 295028 - protein, 9 aa, Homo Sapiens
PPGKMNDRL

SEQ ID NO: 295029 - protein, 9 aa, Homo Sapiens
RMVLVQQYL

SEQ ID NO: 295030 - protein, 9 aa, Homo Sapiens
QLTEHLRPS

SEQ ID NO: 295031 - protein, 9 aa, Homo Sapiens
GTDGEISYA

SEQ ID NO: 295032 - protein, 9 aa, Homo Sapiens
LMGGTTNQQ

SEQ ID NO: 295033 - protein, 9 aa, Homo Sapiens
VEAQVNVIV

SEQ ID NO: 295034 - protein, 9 aa, Homo Sapiens
VEQPFPINQ

SEQ ID NO: 295035 - protein, 9 aa, Homo Sapiens
RVQTMFNLE

SEQ ID NO: 295036 - protein, 9 aa, Homo Sapiens
RLRDKLFSG

SEQ ID NO: 295037 - protein, 9 aa, Homo Sapiens
KIKANGGLQ

SEQ ID NO: 295038 - protein, 9 aa, Homo Sapiens
KITHSKELS

SEQ ID NO: 295039 - protein, 9 aa, Homo Sapiens
DTLKAKYRG

SEQ ID NO: 295040 - protein, 9 aa, Homo Sapiens
SFGPLGLLY

SEQ ID NO: 295041 - protein, 9 aa, Homo Sapiens
NLKLSFTPP

SEQ ID NO: 295042 - protein, 9 aa, Homo Sapiens
SGLPSGEVI

SEQ ID NO: 295043 - protein, 9 aa, Homo Sapiens
EKKQKLEDH

SEQ ID NO: 295044 - protein, 9 aa, Homo Sapiens
MWSSKERQG

SEQ ID NO: 295045 - protein, 9 aa, Homo Sapiens
SSSPSKIDG

SEQ ID NO: 295046 - protein, 9 aa, Homo Sapiens
RSCPGNAEG

SEQ ID NO: 295047 - protein, 9 aa, Homo Sapiens
ESEIKGKIS

SEQ ID NO: 295048 - protein, 9 aa, Homo Sapiens
CEIKDKTGL

SEQ ID NO: 295049 - protein, 9 aa, Homo Sapiens
GWRRARLHV

SEQ ID NO: 295050 - protein, 9 aa, Homo Sapiens
ELESFRTRE

SEQ ID NO: 295051 - protein, 9 aa, Homo Sapiens
GAEDLSDQS

SEQ ID NO: 295052 - protein, 9 aa, Homo Sapiens
SYAYYLKNQ

SEQ ID NO: 295053 - protein, 9 aa, Homo Sapiens
VPKLLSNHH

SEQ ID NO: 295054 - protein, 9 aa, Homo Sapiens
RLAVSSRGD

SEQ ID NO: 295055 - protein, 9 aa, Homo Sapiens
AQRKEEHQA

SEQ ID NO: 295056 - protein, 9 aa, Homo Sapiens
KLLSNHHTL

SEQ ID NO: 295057 - protein, 9 aa, Homo Sapiens
GSMPNPNHD

SEQ ID NO: 295058 - protein, 9 aa, Homo Sapiens
QTTVHDKSA

SEQ ID NO: 295059 - protein, 9 aa, Homo Sapiens
PYRVKAIDF

SEQ ID NO: 295060 - protein, 9 aa, Homo Sapiens
LIKALFEVL

SEQ ID NO: 295061 - protein, 9 aa, Homo Sapiens
CTLTKEDNC

SEQ ID NO: 295062 - protein, 9 aa, Homo Sapiens
GTIAVIVFV

SEQ ID NO: 295063 - protein, 9 aa, Homo Sapiens
ENNGSFCSR

SEQ ID NO: 295064 - protein, 9 aa, Homo Sapiens
TDVLRNAFN

SEQ ID NO: 295065 - protein, 9 aa, Homo Sapiens
DTYGDINIM

SEQ ID NO: 295066 - protein, 9 aa, Homo Sapiens
SRAFKVKII

SEQ ID NO: 295067 - protein, 9 aa, Homo Sapiens
QLDLSKIKV

SEQ ID NO: 295068 - protein, 9 aa, Homo Sapiens
VSGRKQLLV

SEQ ID NO: 295069 - protein, 9 aa, Homo Sapiens
GRYWASPTR

SEQ ID NO: 295070 - protein, 9 aa, Homo Sapiens
DGVIKSILW

SEQ ID NO: 295071 - protein, 9 aa, Homo Sapiens
LEDTEEEEE

SEQ ID NO: 295072 - protein, 9 aa, Homo Sapiens
AYDHYLAIC

SEQ ID NO: 295073 - protein, 9 aa, Homo Sapiens
WGPDSKKVL

SEQ ID NO: 295074 - protein, 9 aa, Homo Sapiens
EIIVAHIKK

SEQ ID NO: 295075 - protein, 9 aa, Homo Sapiens
PEGLFRGLR

SEQ ID NO: 295076 - protein, 9 aa, Homo Sapiens
LVHIPTHGS

SEQ ID NO: 295077 - protein, 9 aa, Homo Sapiens
PMLNHILYS

SEQ ID NO: 295078 - protein, 9 aa, Homo Sapiens
DQIIGKGQI

SEQ ID NO: 295079 - protein, 9 aa, Homo Sapiens
SDMAQDFLQ

SEQ ID NO: 295080 - protein, 9 aa, Homo Sapiens
SLVITTTLY

SEQ ID NO: 295081 - protein, 9 aa, Homo Sapiens
YTGRGPVSL

SEQ ID NO: 295082 - protein, 9 aa, Homo Sapiens
VDKVVGAVD

SEQ ID NO: 295083 - protein, 9 aa, Homo Sapiens
GSALILHQI

SEQ ID NO: 295084 - protein, 9 aa, Homo Sapiens
LSASGRHMD

SEQ ID NO: 295085 - protein, 9 aa, Homo Sapiens
HFCAGRDSY

SEQ ID NO: 295086 - protein, 9 aa, Homo Sapiens
FVAKVVTLT

SEQ ID NO: 295087 - protein, 9 aa, Homo Sapiens
MPSLIYWLQ

SEQ ID NO: 295088 - protein, 9 aa, Homo Sapiens
FFFAIILKL

SEQ ID NO: 295089 - protein, 9 aa, Homo Sapiens
KITACSSSP

SEQ ID NO: 295090 - protein, 9 aa, Homo Sapiens
SPTNDIEAY

SEQ ID NO: 295091 - protein, 9 aa, Homo Sapiens
HSIYKTKFS

SEQ ID NO: 295092 - protein, 9 aa, Homo Sapiens
KHISDLHNC

SEQ ID NO: 295093 - protein, 9 aa, Homo Sapiens
PNVLKMIRH

SEQ ID NO: 295094 - protein, 9 aa, Homo Sapiens
FSSVMKPDN

SEQ ID NO: 295095 - protein, 9 aa, Homo Sapiens
QIPDSTHAQ

SEQ ID NO: 295096 - protein, 9 aa, Homo Sapiens
AFYPVGHPG

SEQ ID NO: 295097 - protein, 9 aa, Homo Sapiens
YSSDVVNVS

SEQ ID NO: 295098 - protein, 9 aa, Homo Sapiens
EVRRTIHYE

SEQ ID NO: 295099 - protein, 9 aa, Homo Sapiens
KYFDNWCSL

SEQ ID NO: 295100 - protein, 9 aa, Homo Sapiens
YRDSKITWI

SEQ ID NO: 295101 - protein, 9 aa, Homo Sapiens
NGKLMRHQI

SEQ ID NO: 295102 - protein, 9 aa, Homo Sapiens
TFSGFLVFH

SEQ ID NO: 295103 - protein, 9 aa, Homo Sapiens
ECSAPLPLE

SEQ ID NO: 295104 - protein, 9 aa, Homo Sapiens
LEGVIDLSA

SEQ ID NO: 295105 - protein, 9 aa, Homo Sapiens
AMWDDFITC

SEQ ID NO: 295106 - protein, 9 aa, Homo Sapiens
GPDSKKVLY

SEQ ID NO: 295107 - protein, 9 aa, Homo Sapiens
MTEGSVTVG

SEQ ID NO: 295108 - protein, 9 aa, Homo Sapiens
LDGRQLFSS

SEQ ID NO: 295109 - protein, 9 aa, Homo Sapiens
SGRRWLCEQ

SEQ ID NO: 295110 - protein, 9 aa, Homo Sapiens
FNFIGPQVH

SEQ ID NO: 295111 - protein, 9 aa, Homo Sapiens
LRLFVRKNK

SEQ ID NO: 295112 - protein, 9 aa, Homo Sapiens
CNLICHQKI

SEQ ID NO: 295113 - protein, 9 aa, Homo Sapiens
SPTPNPPIL

SEQ ID NO: 295114 - protein, 9 aa, Homo Sapiens
HCKIALFNL

SEQ ID NO: 295115 - protein, 9 aa, Homo Sapiens
LYSGESLLQ

SEQ ID NO: 295116 - protein, 9 aa, Homo Sapiens
TVKKAIEYL

SEQ ID NO: 295117 - protein, 9 aa, Homo Sapiens
FKKTVCDIS

SEQ ID NO: 295118 - protein, 9 aa, Homo Sapiens
RHQQTHEEK

SEQ ID NO: 295119 - protein, 9 aa, Homo Sapiens
LVRGGHKII

SEQ ID NO: 295120 - protein, 9 aa, Homo Sapiens
VLSVSCQEG

SEQ ID NO: 295121 - protein, 9 aa, Homo Sapiens
KLGLISSTA

SEQ ID NO: 295122 - protein, 9 aa, Homo Sapiens
TQRELRKLV

SEQ ID NO: 295123 - protein, 9 aa, Homo Sapiens
SPIEVPQSF

SEQ ID NO: 295124 - protein, 9 aa, Homo Sapiens
ADHYMFLKG

SEQ ID NO: 295125 - protein, 9 aa, Homo Sapiens
KYGKQKTYQ

SEQ ID NO: 295126 - protein, 9 aa, Homo Sapiens
KKQPCVCSS

SEQ ID NO: 295127 - protein, 9 aa, Homo Sapiens
SSETCLSQD

SEQ ID NO: 295128 - protein, 9 aa, Homo Sapiens
VQLGLCLAE

SEQ ID NO: 295129 - protein, 9 aa, Homo Sapiens
TYVIQVTAT

SEQ ID NO: 295130 - protein, 9 aa, Homo Sapiens
IIVEVKKPK

SEQ ID NO: 295131 - protein, 9 aa, Homo Sapiens
QDQLGLSFH

SEQ ID NO: 295132 - protein, 9 aa, Homo Sapiens
TTNANAILQ

SEQ ID NO: 295133 - protein, 9 aa, Homo Sapiens
ILAVQKKEQ

SEQ ID NO: 295134 - protein, 9 aa, Homo Sapiens
TALSRLFPS

SEQ ID NO: 295135 - protein, 9 aa, Homo Sapiens
LEEGHFRLQ

SEQ ID NO: 295136 - protein, 9 aa, Homo Sapiens
QVKRIHKYK

SEQ ID NO: 295137 - protein, 9 aa, Homo Sapiens
GRDRPFQKP

SEQ ID NO: 295138 - protein, 9 aa, Homo Sapiens
IGSLSQRLK

SEQ ID NO: 295139 - protein, 9 aa, Homo Sapiens
DQDTANILE

SEQ ID NO: 295140 - protein, 9 aa, Homo Sapiens
IKALFEVLA

SEQ ID NO: 295141 - protein, 9 aa, Homo Sapiens
HIGEKPFTC

SEQ ID NO: 295142 - protein, 9 aa, Homo Sapiens
NALPTCISH

SEQ ID NO: 295143 - protein, 9 aa, Homo Sapiens
LLRYHTNTG

SEQ ID NO: 295144 - protein, 9 aa, Homo Sapiens
LALAQIDNS

SEQ ID NO: 295145 - protein, 9 aa, Homo Sapiens
TPQKVDFWR

SEQ ID NO: 295146 - protein, 9 aa, Homo Sapiens
IVYFIFWAP

SEQ ID NO: 295147 - protein, 9 aa, Homo Sapiens
LRSLWDTVK

SEQ ID NO: 295148 - protein, 9 aa, Homo Sapiens
CFQIELSNN

SEQ ID NO: 295149 - protein, 9 aa, Homo Sapiens
SLIYTVPWI

SEQ ID NO: 295150 - protein, 9 aa, Homo Sapiens
LSGDNLITR

SEQ ID NO: 295151 - protein, 9 aa, Homo Sapiens
RRMHSLSSG

SEQ ID NO: 295152 - protein, 9 aa, Homo Sapiens
MSEESDGKR

SEQ ID NO: 295153 - protein, 9 aa, Homo Sapiens
VNIQLQGTN

SEQ ID NO: 295154 - protein, 9 aa, Homo Sapiens
PDPHFSPAK

SEQ ID NO: 295155 - protein, 9 aa, Homo Sapiens
RKLQNAVEA

SEQ ID NO: 295156 - protein, 9 aa, Homo Sapiens
AYYKEKSSK

SEQ ID NO: 295157 - protein, 9 aa, Homo Sapiens
AQKKLKRLM

SEQ ID NO: 295158 - protein, 9 aa, Homo Sapiens
KPALSKNNP

SEQ ID NO: 295159 - protein, 9 aa, Homo Sapiens
GQKNDKLGP

SEQ ID NO: 295160 - protein, 9 aa, Homo Sapiens
DFQTSKFVL

SEQ ID NO: 295161 - protein, 9 aa, Homo Sapiens
IERFWDFIA

SEQ ID NO: 295162 - protein, 9 aa, Homo Sapiens
SIGVEQIFY

SEQ ID NO: 295163 - protein, 9 aa, Homo Sapiens
ASIKTLCAL

SEQ ID NO: 295164 - protein, 9 aa, Homo Sapiens
STTSLVSMA

SEQ ID NO: 295165 - protein, 9 aa, Homo Sapiens
HIWDTAGQE

SEQ ID NO: 295166 - protein, 9 aa, Homo Sapiens
LFIHLFANI

SEQ ID NO: 295167 - protein, 9 aa, Homo Sapiens
HAVVISLSH

SEQ ID NO: 295168 - protein, 9 aa, Homo Sapiens
PPPAPFAMI

SEQ ID NO: 295169 - protein, 9 aa, Homo Sapiens
ILYVHRIIH

SEQ ID NO: 295170 - protein, 9 aa, Homo Sapiens
ISEDVVILA

SEQ ID NO: 295171 - protein, 9 aa, Homo Sapiens
RDEHMKSSE

SEQ ID NO: 295172 - protein, 9 aa, Homo Sapiens
PEWLFNLLK

SEQ ID NO: 295173 - protein, 9 aa, Homo Sapiens
ESMDSAFTG

SEQ ID NO: 295174 - protein, 9 aa, Homo Sapiens
EALGKPSHL

SEQ ID NO: 295175 - protein, 9 aa, Homo Sapiens
AKAHSKDKT

SEQ ID NO: 295176 - protein, 9 aa, Homo Sapiens
DNHRESDNS

SEQ ID NO: 295177 - protein, 9 aa, Homo Sapiens
SENTSPSET

SEQ ID NO: 295178 - protein, 9 aa, Homo Sapiens
HTFNLKMLL

SEQ ID NO: 295179 - protein, 9 aa, Homo Sapiens
TQNVLQKLD

SEQ ID NO: 295180 - protein, 9 aa, Homo Sapiens
TYLSYLTAP

SEQ ID NO: 295181 - protein, 9 aa, Homo Sapiens
GGAGTPLSS

SEQ ID NO: 295182 - protein, 9 aa, Homo Sapiens
QGPSQNVPR

SEQ ID NO: 295183 - protein, 9 aa, Homo Sapiens
LETKSGGGM

SEQ ID NO: 295184 - protein, 9 aa, Homo Sapiens
SKEQMKNSV

SEQ ID NO: 295185 - protein, 9 aa, Homo Sapiens
HQKSLSCPE

SEQ ID NO: 295186 - protein, 9 aa, Homo Sapiens
YSNSRPCKR

SEQ ID NO: 295187 - protein, 9 aa, Homo Sapiens
GGSGVTGNY

SEQ ID NO: 295188 - protein, 9 aa, Homo Sapiens
PWGINPHRL

SEQ ID NO: 295189 - protein, 9 aa, Homo Sapiens
SKCLCGAAC

SEQ ID NO: 295190 - protein, 9 aa, Homo Sapiens
PTQHLSRKI

SEQ ID NO: 295191 - protein, 9 aa, Homo Sapiens
SDSNELASG

SEQ ID NO: 295192 - protein, 9 aa, Homo Sapiens
RKLRNLKTS

SEQ ID NO: 295193 - protein, 9 aa, Homo Sapiens
LNDKIQEYK

SEQ ID NO: 295194 - protein, 9 aa, Homo Sapiens
SMLYTLGIP

SEQ ID NO: 295195 - protein, 9 aa, Homo Sapiens
AVTIHGEDD

SEQ ID NO: 295196 - protein, 9 aa, Homo Sapiens
DLFWSNPTA

SEQ ID NO: 295197 - protein, 9 aa, Homo Sapiens
MHNQFVVYR

SEQ ID NO: 295198 - protein, 9 aa, Homo Sapiens
ENQDTSHLY

SEQ ID NO: 295199 - protein, 9 aa, Homo Sapiens
GRHNTLRCE

SEQ ID NO: 295200 - protein, 9 aa, Homo Sapiens
PRRSHRMWR

SEQ ID NO: 295201 - protein, 9 aa, Homo Sapiens
NNLTVIFAD

SEQ ID NO: 295202 - protein, 9 aa, Homo Sapiens
MKPDNMIVP

SEQ ID NO: 295203 - protein, 9 aa, Homo Sapiens
GNRSLFTLT

SEQ ID NO: 295204 - protein, 9 aa, Homo Sapiens
EIHVKVKYI

SEQ ID NO: 295205 - protein, 9 aa, Homo Sapiens
QGELDKAIK

SEQ ID NO: 295206 - protein, 9 aa, Homo Sapiens
VNRDSVCSI

SEQ ID NO: 295207 - protein, 9 aa, Homo Sapiens
TYLHTQKQW

SEQ ID NO: 295208 - protein, 9 aa, Homo Sapiens
QELKIKCLQ

SEQ ID NO: 295209 - protein, 9 aa, Homo Sapiens
LIFIIIHWA

SEQ ID NO: 295210 - protein, 9 aa, Homo Sapiens
SHNQISILY

SEQ ID NO: 295211 - protein, 9 aa, Homo Sapiens
TLLPEGFQD

SEQ ID NO: 295212 - protein, 9 aa, Homo Sapiens
RSHLWGHEK

SEQ ID NO: 295213 - protein, 9 aa, Homo Sapiens
NKQTDDLGD

SEQ ID NO: 295214 - protein, 9 aa, Homo Sapiens
RHSLKNKLI

SEQ ID NO: 295215 - protein, 9 aa, Homo Sapiens
REHAVVISL

SEQ ID NO: 295216 - protein, 9 aa, Homo Sapiens
RSVDCRVSS

SEQ ID NO: 295217 - protein, 9 aa, Homo Sapiens
EIIRREKEK

SEQ ID NO: 295218 - protein, 9 aa, Homo Sapiens
EAMLLFKKS

SEQ ID NO: 295219 - protein, 9 aa, Homo Sapiens
GSACLQPRA

SEQ ID NO: 295220 - protein, 9 aa, Homo Sapiens
AIKNASLRK

SEQ ID NO: 295221 - protein, 9 aa, Homo Sapiens
KSKKHQVET

SEQ ID NO: 295222 - protein, 9 aa, Homo Sapiens
IMGMKFFQI

SEQ ID NO: 295223 - protein, 9 aa, Homo Sapiens
TDKSQSSKK

SEQ ID NO: 295224 - protein, 9 aa, Homo Sapiens
SNITNKMDP

SEQ ID NO: 295225 - protein, 9 aa, Homo Sapiens
EANCTYFKL

SEQ ID NO: 295226 - protein, 9 aa, Homo Sapiens
TDNIKNTLH

SEQ ID NO: 295227 - protein, 9 aa, Homo Sapiens
QHKRALRAQ

SEQ ID NO: 295228 - protein, 9 aa, Homo Sapiens
MNNNESDLI

SEQ ID NO: 295229 - protein, 9 aa, Homo Sapiens
RLADMYGTV

SEQ ID NO: 295230 - protein, 9 aa, Homo Sapiens
PALKLSVNK

SEQ ID NO: 295231 - protein, 9 aa, Homo Sapiens
RQGRAEAHT

SEQ ID NO: 295232 - protein, 9 aa, Homo Sapiens
RTAQMCCSK

SEQ ID NO: 295233 - protein, 9 aa, Homo Sapiens
PQARGTYPR

SEQ ID NO: 295234 - protein, 9 aa, Homo Sapiens
AMQMLNMDR

SEQ ID NO: 295235 - protein, 9 aa, Homo Sapiens
RALQKVFDE

SEQ ID NO: 295236 - protein, 9 aa, Homo Sapiens
FKGGNYAVK

SEQ ID NO: 295237 - protein, 9 aa, Homo Sapiens
DVGMKPRHC

SEQ ID NO: 295238 - protein, 9 aa, Homo Sapiens
QDKLARLNL

SEQ ID NO: 295239 - protein, 9 aa, Homo Sapiens
EVEHNSGPL

SEQ ID NO: 295240 - protein, 9 aa, Homo Sapiens
LENDVEQVR

SEQ ID NO: 295241 - protein, 9 aa, Homo Sapiens
LPGMCTRSL

SEQ ID NO: 295242 - protein, 9 aa, Homo Sapiens
SSVAQANRA

SEQ ID NO: 295243 - protein, 9 aa, Homo Sapiens
KLKLRVSGA

SEQ ID NO: 295244 - protein, 9 aa, Homo Sapiens
QCMHETQRE

SEQ ID NO: 295245 - protein, 9 aa, Homo Sapiens
GDLMLYFIV

SEQ ID NO: 295246 - protein, 9 aa, Homo Sapiens
WNFQEDTLK

SEQ ID NO: 295247 - protein, 9 aa, Homo Sapiens
LNKLEVELL

SEQ ID NO: 295248 - protein, 9 aa, Homo Sapiens
FSNPKYMNR

SEQ ID NO: 295249 - protein, 9 aa, Homo Sapiens
QWEKNITLG

SEQ ID NO: 295250 - protein, 9 aa, Homo Sapiens
HLLEGNECI

SEQ ID NO: 295251 - protein, 9 aa, Homo Sapiens
IKKDGTEVR

SEQ ID NO: 295252 - protein, 9 aa, Homo Sapiens
DGRALEKCR

SEQ ID NO: 295253 - protein, 9 aa, Homo Sapiens
NLQKTMDSH

SEQ ID NO: 295254 - protein, 9 aa, Homo Sapiens
MLIGNIVLR

SEQ ID NO: 295255 - protein, 9 aa, Homo Sapiens
LSSVFWICM

SEQ ID NO: 295256 - protein, 9 aa, Homo Sapiens
YFFFKDSWD

SEQ ID NO: 295257 - protein, 9 aa, Homo Sapiens
CCCCFLLLL

SEQ ID NO: 295258 - protein, 9 aa, Homo Sapiens
SQQPEAAPA

SEQ ID NO: 295259 - protein, 9 aa, Homo Sapiens
MCKIRCLCE

SEQ ID NO: 295260 - protein, 9 aa, Homo Sapiens
KLASFSFDH

SEQ ID NO: 295261 - protein, 9 aa, Homo Sapiens
NTSPSETSL

SEQ ID NO: 295262 - protein, 9 aa, Homo Sapiens
FRKVISYRG

SEQ ID NO: 295263 - protein, 9 aa, Homo Sapiens
VQALIKKDG

SEQ ID NO: 295264 - protein, 9 aa, Homo Sapiens
HSRFGILDF

SEQ ID NO: 295265 - protein, 9 aa, Homo Sapiens
CQPAGCTSS

SEQ ID NO: 295266 - protein, 9 aa, Homo Sapiens
KFARKGNKG

SEQ ID NO: 295267 - protein, 9 aa, Homo Sapiens
SLKLDYLEP

SEQ ID NO: 295268 - protein, 9 aa, Homo Sapiens
SWQESNKAC

SEQ ID NO: 295269 - protein, 9 aa, Homo Sapiens
SGHFIADHY

SEQ ID NO: 295270 - protein, 9 aa, Homo Sapiens
QSLAKKESF

SEQ ID NO: 295271 - protein, 9 aa, Homo Sapiens
KENIRNNSA

SEQ ID NO: 295272 - protein, 9 aa, Homo Sapiens
QIIHRGEKP

SEQ ID NO: 295273 - protein, 9 aa, Homo Sapiens
NDSHYRENL

SEQ ID NO: 295274 - protein, 9 aa, Homo Sapiens
DTLQRTGQE

SEQ ID NO: 295275 - protein, 9 aa, Homo Sapiens
ALEVFMANQ

SEQ ID NO: 295276 - protein, 9 aa, Homo Sapiens
SDDRRKAVS

SEQ ID NO: 295277 - protein, 9 aa, Homo Sapiens
WQKENIPKY

SEQ ID NO: 295278 - protein, 9 aa, Homo Sapiens
SWKLILAQK

SEQ ID NO: 295279 - protein, 9 aa, Homo Sapiens
ILPKENHIF

SEQ ID NO: 295280 - protein, 9 aa, Homo Sapiens
ALQVLRDMK

SEQ ID NO: 295281 - protein, 9 aa, Homo Sapiens
APSEGACDV

SEQ ID NO: 295282 - protein, 9 aa, Homo Sapiens
LPEIIGKMS

SEQ ID NO: 295283 - protein, 9 aa, Homo Sapiens
NAPSKSVGR

SEQ ID NO: 295284 - protein, 9 aa, Homo Sapiens
EIYLQQLRA

SEQ ID NO: 295285 - protein, 9 aa, Homo Sapiens
NKIILKLDH

SEQ ID NO: 295286 - protein, 9 aa, Homo Sapiens
NLTLPSLLL

SEQ ID NO: 295287 - protein, 9 aa, Homo Sapiens
ARLYDTAMK

SEQ ID NO: 295288 - protein, 9 aa, Homo Sapiens
YLKAICTEI

SEQ ID NO: 295289 - protein, 9 aa, Homo Sapiens
WERGMKNGV

SEQ ID NO: 295290 - protein, 9 aa, Homo Sapiens
RCSVLEETE

SEQ ID NO: 295291 - protein, 9 aa, Homo Sapiens
ETDRVTGMD

SEQ ID NO: 295292 - protein, 9 aa, Homo Sapiens
YLLQPELMP

SEQ ID NO: 295293 - protein, 9 aa, Homo Sapiens
FQKPINLPV

SEQ ID NO: 295294 - protein, 9 aa, Homo Sapiens
AMEELVKSK

SEQ ID NO: 295295 - protein, 9 aa, Homo Sapiens
LQWNRVYSN

SEQ ID NO: 295296 - protein, 9 aa, Homo Sapiens
PREPRPGKF

SEQ ID NO: 295297 - protein, 9 aa, Homo Sapiens
VLRLLDTKY

SEQ ID NO: 295298 - protein, 9 aa, Homo Sapiens
SRLYVGREN

SEQ ID NO: 295299 - protein, 9 aa, Homo Sapiens
QKKGEATCP

SEQ ID NO: 295300 - protein, 9 aa, Homo Sapiens
LSKNNRLRM

SEQ ID NO: 295301 - protein, 9 aa, Homo Sapiens
KLFCEKLEE

SEQ ID NO: 295302 - protein, 9 aa, Homo Sapiens
CNASSQEYR

SEQ ID NO: 295303 - protein, 9 aa, Homo Sapiens
KGLFDEKKK

SEQ ID NO: 295304 - protein, 9 aa, Homo Sapiens
PFVIQPISS

SEQ ID NO: 295305 - protein, 9 aa, Homo Sapiens
LFLHVKPRL

SEQ ID NO: 295306 - protein, 9 aa, Homo Sapiens
ALDKITARL

SEQ ID NO: 295307 - protein, 9 aa, Homo Sapiens
FKWFFQRAE

SEQ ID NO: 295308 - protein, 9 aa, Homo Sapiens
SSIIGKNKP

SEQ ID NO: 295309 - protein, 9 aa, Homo Sapiens
HLYCDLPQL

SEQ ID NO: 295310 - protein, 9 aa, Homo Sapiens
AKSMCMIMM

SEQ ID NO: 295311 - protein, 9 aa, Homo Sapiens
SLSQPPEDE

SEQ ID NO: 295312 - protein, 9 aa, Homo Sapiens
ESSCSHSSW

SEQ ID NO: 295313 - protein, 9 aa, Homo Sapiens
PQVYWLKGG

SEQ ID NO: 295314 - protein, 9 aa, Homo Sapiens
GSDVIEGGL

SEQ ID NO: 295315 - protein, 9 aa, Homo Sapiens
IKAEKRDVS

SEQ ID NO: 295316 - protein, 9 aa, Homo Sapiens
QYSQEHALK

SEQ ID NO: 295317 - protein, 9 aa, Homo Sapiens
KVPRNSRLL

SEQ ID NO: 295318 - protein, 9 aa, Homo Sapiens
TLRNQQVKD

SEQ ID NO: 295319 - protein, 9 aa, Homo Sapiens
SIFAKEHLQ

SEQ ID NO: 295320 - protein, 9 aa, Homo Sapiens
SSEEELFDA

SEQ ID NO: 295321 - protein, 9 aa, Homo Sapiens
LINTAISDA

SEQ ID NO: 295322 - protein, 9 aa, Homo Sapiens
QVLRRGLSI

SEQ ID NO: 295323 - protein, 9 aa, Homo Sapiens
DSSRNEGIS

SEQ ID NO: 295324 - protein, 9 aa, Homo Sapiens
FHLRTSYKN

SEQ ID NO: 295325 - protein, 9 aa, Homo Sapiens
RPQLGEDEL

SEQ ID NO: 295326 - protein, 9 aa, Homo Sapiens
HLYNSVNTS

SEQ ID NO: 295327 - protein, 9 aa, Homo Sapiens
QRVNTGARP

SEQ ID NO: 295328 - protein, 9 aa, Homo Sapiens
NRHCNLICH

SEQ ID NO: 295329 - protein, 9 aa, Homo Sapiens
MVYKLLLTI

SEQ ID NO: 295330 - protein, 9 aa, Homo Sapiens
QVDVAVEII

SEQ ID NO: 295331 - protein, 9 aa, Homo Sapiens
VLFKIMKTL

SEQ ID NO: 295332 - protein, 9 aa, Homo Sapiens
KRGGCTFTH

SEQ ID NO: 295333 - protein, 9 aa, Homo Sapiens
GLEVLAEIA

SEQ ID NO: 295334 - protein, 9 aa, Homo Sapiens
VNSAGYLTS

SEQ ID NO: 295335 - protein, 9 aa, Homo Sapiens
DELFPVSHV

SEQ ID NO: 295336 - protein, 9 aa, Homo Sapiens
KKRDREKED

SEQ ID NO: 295337 - protein, 9 aa, Homo Sapiens
NGKACISTG

SEQ ID NO: 295338 - protein, 9 aa, Homo Sapiens
RVKAIDFGS

SEQ ID NO: 295339 - protein, 9 aa, Homo Sapiens
GYVAHMVLN

SEQ ID NO: 295340 - protein, 9 aa, Homo Sapiens
YVDTRKIIK

SEQ ID NO: 295341 - protein, 9 aa, Homo Sapiens
HTAMKSGSL

SEQ ID NO: 295342 - protein, 9 aa, Homo Sapiens
KLEDHGEKK

SEQ ID NO: 295343 - protein, 9 aa, Homo Sapiens
SESFCNASS

SEQ ID NO: 295344 - protein, 9 aa, Homo Sapiens
FSNLTDHNK

SEQ ID NO: 295345 - protein, 9 aa, Homo Sapiens
AKTPFPFDK

SEQ ID NO: 295346 - protein, 9 aa, Homo Sapiens
LLEDVVTKV

SEQ ID NO: 295347 - protein, 9 aa, Homo Sapiens
EVTSKDMLQ

SEQ ID NO: 295348 - protein, 9 aa, Homo Sapiens
QFPGLNENL

SEQ ID NO: 295349 - protein, 9 aa, Homo Sapiens
QAPRKEITG

SEQ ID NO: 295350 - protein, 9 aa, Homo Sapiens
PKVNKCRLS

SEQ ID NO: 295351 - protein, 9 aa, Homo Sapiens
PAWAVWEET

SEQ ID NO: 295352 - protein, 9 aa, Homo Sapiens
RKATSILDF

SEQ ID NO: 295353 - protein, 9 aa, Homo Sapiens
FPWLLFTVG

SEQ ID NO: 295354 - protein, 9 aa, Homo Sapiens
YGYLMSMYL

SEQ ID NO: 295355 - protein, 9 aa, Homo Sapiens
RLVSTRTVS

SEQ ID NO: 295356 - protein, 9 aa, Homo Sapiens
FSGFLVFHL

SEQ ID NO: 295357 - protein, 9 aa, Homo Sapiens
ESENPYSPY

SEQ ID NO: 295358 - protein, 9 aa, Homo Sapiens
SHKLTVTIV

SEQ ID NO: 295359 - protein, 9 aa, Homo Sapiens
AQTCIGTPY

SEQ ID NO: 295360 - protein, 9 aa, Homo Sapiens
MFGASQGYF

SEQ ID NO: 295361 - protein, 9 aa, Homo Sapiens
LSSEFPDKF

SEQ ID NO: 295362 - protein, 9 aa, Homo Sapiens
MSLEAKERV

SEQ ID NO: 295363 - protein, 9 aa, Homo Sapiens
EPVSINEEH

SEQ ID NO: 295364 - protein, 9 aa, Homo Sapiens
RTMLTFSSA

SEQ ID NO: 295365 - protein, 9 aa, Homo Sapiens
FGTRIIKVS

SEQ ID NO: 295366 - protein, 9 aa, Homo Sapiens
EIKDKTGLS

SEQ ID NO: 295367 - protein, 9 aa, Homo Sapiens
KFKKEDLTD

SEQ ID NO: 295368 - protein, 9 aa, Homo Sapiens
LKEWGLFRG

SEQ ID NO: 295369 - protein, 9 aa, Homo Sapiens
GKRVQIWKA

SEQ ID NO: 295370 - protein, 9 aa, Homo Sapiens
QQSPVNKER

SEQ ID NO: 295371 - protein, 9 aa, Homo Sapiens
FLSQTAQRS

SEQ ID NO: 295372 - protein, 9 aa, Homo Sapiens
SFPKKKPRL

SEQ ID NO: 295373 - protein, 9 aa, Homo Sapiens
EYFVFNFIG

SEQ ID NO: 295374 - protein, 9 aa, Homo Sapiens
FIHLFIHLF

SEQ ID NO: 295375 - protein, 9 aa, Homo Sapiens
RVIAEKKLF

SEQ ID NO: 295376 - protein, 9 aa, Homo Sapiens
QVLQADMLI

SEQ ID NO: 295377 - protein, 9 aa, Homo Sapiens
KSVSETDVQ

SEQ ID NO: 295378 - protein, 9 aa, Homo Sapiens
ELRRNSRVT

SEQ ID NO: 295379 - protein, 9 aa, Homo Sapiens
DLNDKIQEY

SEQ ID NO: 295380 - protein, 9 aa, Homo Sapiens
IATSSTGLE

SEQ ID NO: 295381 - protein, 9 aa, Homo Sapiens
RRRAPGNDQ

SEQ ID NO: 295382 - protein, 9 aa, Homo Sapiens
ARSRSRLQN

SEQ ID NO: 295383 - protein, 9 aa, Homo Sapiens
SIFDIIFAD

SEQ ID NO: 295384 - protein, 9 aa, Homo Sapiens
EPPVRASPS

SEQ ID NO: 295385 - protein, 9 aa, Homo Sapiens
TKDNVSLNK

SEQ ID NO: 295386 - protein, 9 aa, Homo Sapiens
NNVDSSPET

SEQ ID NO: 295387 - protein, 9 aa, Homo Sapiens
LHEGKTPAG

SEQ ID NO: 295388 - protein, 9 aa, Homo Sapiens
ILNYLSFQE

SEQ ID NO: 295389 - protein, 9 aa, Homo Sapiens
SAYAQARMQ

SEQ ID NO: 295390 - protein, 9 aa, Homo Sapiens
MNKLQTFVA

SEQ ID NO: 295391 - protein, 9 aa, Homo Sapiens
LGLLYEYLE

SEQ ID NO: 295392 - protein, 9 aa, Homo Sapiens
PITLLRHYW

SEQ ID NO: 295393 - protein, 9 aa, Homo Sapiens
SEGQKHKHK

SEQ ID NO: 295394 - protein, 9 aa, Homo Sapiens
RKMYQYGAG

SEQ ID NO: 295395 - protein, 9 aa, Homo Sapiens
IRTSYDTTL

SEQ ID NO: 295396 - protein, 9 aa, Homo Sapiens
IARRGSSSD

SEQ ID NO: 295397 - protein, 9 aa, Homo Sapiens
NVQEEANAA

SEQ ID NO: 295398 - protein, 9 aa, Homo Sapiens
NKNSQSFIS

SEQ ID NO: 295399 - protein, 9 aa, Homo Sapiens
DIWSVDPAS

SEQ ID NO: 295400 - protein, 9 aa, Homo Sapiens
KAQTAQVQK

SEQ ID NO: 295401 - protein, 9 aa, Homo Sapiens
GRQKSLSIR

SEQ ID NO: 295402 - protein, 9 aa, Homo Sapiens
YLYFASLNK

SEQ ID NO: 295403 - protein, 9 aa, Homo Sapiens
LEFLDKQNE

SEQ ID NO: 295404 - protein, 9 aa, Homo Sapiens
GAQGVGRHS

SEQ ID NO: 295405 - protein, 9 aa, Homo Sapiens
AVSDGALQE

SEQ ID NO: 295406 - protein, 9 aa, Homo Sapiens
NANMEIATK

SEQ ID NO: 295407 - protein, 9 aa, Homo Sapiens
QGLSNFINF

SEQ ID NO: 295408 - protein, 9 aa, Homo Sapiens
MPNPNHDTL

SEQ ID NO: 295409 - protein, 9 aa, Homo Sapiens
NRLYPSGTY

SEQ ID NO: 295410 - protein, 9 aa, Homo Sapiens
SNTFTRYFF

SEQ ID NO: 295411 - protein, 9 aa, Homo Sapiens
QKHKHKKFR

SEQ ID NO: 295412 - protein, 9 aa, Homo Sapiens
QGSACLQPR

SEQ ID NO: 295413 - protein, 9 aa, Homo Sapiens
VPKKAQEDP

SEQ ID NO: 295414 - protein, 9 aa, Homo Sapiens
LHQIIHSGE

SEQ ID NO: 295415 - protein, 9 aa, Homo Sapiens
FEKKRRDNK

SEQ ID NO: 295416 - protein, 9 aa, Homo Sapiens
VLAFICLQC

SEQ ID NO: 295417 - protein, 9 aa, Homo Sapiens
CYYSENETE

SEQ ID NO: 295418 - protein, 9 aa, Homo Sapiens
DLCYTAENK

SEQ ID NO: 295419 - protein, 9 aa, Homo Sapiens
FHVIQASSF

SEQ ID NO: 295420 - protein, 9 aa, Homo Sapiens
RERVYELLS

SEQ ID NO: 295421 - protein, 9 aa, Homo Sapiens
TKHYQVSGY

SEQ ID NO: 295422 - protein, 9 aa, Homo Sapiens
ITGNITIIT

SEQ ID NO: 295423 - protein, 9 aa, Homo Sapiens
STCTAYGDL

SEQ ID NO: 295424 - protein, 9 aa, Homo Sapiens
LTCPEINES

SEQ ID NO: 295425 - protein, 9 aa, Homo Sapiens
CRTPVSPGS

SEQ ID NO: 295426 - protein, 9 aa, Homo Sapiens
EAEDTIGQQ

SEQ ID NO: 295427 - protein, 9 aa, Homo Sapiens
YNVISHLYC

SEQ ID NO: 295428 - protein, 9 aa, Homo Sapiens
LYDFLKQNT

SEQ ID NO: 295429 - protein, 9 aa, Homo Sapiens
SAAPSQSIL

SEQ ID NO: 295430 - protein, 9 aa, Homo Sapiens
RCISPREHC

SEQ ID NO: 295431 - protein, 9 aa, Homo Sapiens
AGELVRKLG

SEQ ID NO: 295432 - protein, 9 aa, Homo Sapiens
DGYKFSNPN

SEQ ID NO: 295433 - protein, 9 aa, Homo Sapiens
SRDWRKKKP

SEQ ID NO: 295434 - protein, 9 aa, Homo Sapiens
HLSEDCSDV

SEQ ID NO: 295435 - protein, 9 aa, Homo Sapiens
KEFFSKPKH

SEQ ID NO: 295436 - protein, 9 aa, Homo Sapiens
YKLLLTIQL

SEQ ID NO: 295437 - protein, 9 aa, Homo Sapiens
STGEKGFCY

SEQ ID NO: 295438 - protein, 9 aa, Homo Sapiens
PFIRITSLL

SEQ ID NO: 295439 - protein, 9 aa, Homo Sapiens
DQEKMTMNK

SEQ ID NO: 295440 - protein, 9 aa, Homo Sapiens
KGCRSVDEC

SEQ ID NO: 295441 - protein, 9 aa, Homo Sapiens
YRLNFCGSN

SEQ ID NO: 295442 - protein, 9 aa, Homo Sapiens
VTELEIKRR

SEQ ID NO: 295443 - protein, 9 aa, Homo Sapiens
NLYCDVPQV

SEQ ID NO: 295444 - protein, 9 aa, Homo Sapiens
IIENALVGQ

SEQ ID NO: 295445 - protein, 9 aa, Homo Sapiens
GDQRTQTKS

SEQ ID NO: 295446 - protein, 9 aa, Homo Sapiens
AIYKRAEHE

SEQ ID NO: 295447 - protein, 9 aa, Homo Sapiens
LWSQWVIYL

SEQ ID NO: 295448 - protein, 9 aa, Homo Sapiens
QHIETVHPF

SEQ ID NO: 295449 - protein, 9 aa, Homo Sapiens
SMNNNESDL

SEQ ID NO: 295450 - protein, 9 aa, Homo Sapiens
DRTPDKLKK

SEQ ID NO: 295451 - protein, 9 aa, Homo Sapiens
TNINAMAAV

SEQ ID NO: 295452 - protein, 9 aa, Homo Sapiens
TFRFNFLAP

SEQ ID NO: 295453 - protein, 9 aa, Homo Sapiens
SSGNRDNEK

SEQ ID NO: 295454 - protein, 9 aa, Homo Sapiens
SSDIIVHQR

SEQ ID NO: 295455 - protein, 9 aa, Homo Sapiens
REPRPGKFE

SEQ ID NO: 295456 - protein, 9 aa, Homo Sapiens
LYGNAVLIL

SEQ ID NO: 295457 - protein, 9 aa, Homo Sapiens
SYQRLFQAL

SEQ ID NO: 295458 - protein, 9 aa, Homo Sapiens
DLPRTFKFM

SEQ ID NO: 295459 - protein, 9 aa, Homo Sapiens
NCKLEYKTE

SEQ ID NO: 295460 - protein, 9 aa, Homo Sapiens
PNIKEIAAK

SEQ ID NO: 295461 - protein, 9 aa, Homo Sapiens
QQTQTLEEI

SEQ ID NO: 295462 - protein, 9 aa, Homo Sapiens
SKTITMLEM

SEQ ID NO: 295463 - protein, 9 aa, Homo Sapiens
HKLFGAENS

SEQ ID NO: 295464 - protein, 9 aa, Homo Sapiens
QLFAFVSHM

SEQ ID NO: 295465 - protein, 9 aa, Homo Sapiens
KLYEFYLSK

SEQ ID NO: 295466 - protein, 9 aa, Homo Sapiens
EQHDALAFF

SEQ ID NO: 295467 - protein, 9 aa, Homo Sapiens
VARRIEFRN

SEQ ID NO: 295468 - protein, 9 aa, Homo Sapiens
LNFIPRHFR

SEQ ID NO: 295469 - protein, 9 aa, Homo Sapiens
LQNQEKRLW

SEQ ID NO: 295470 - protein, 9 aa, Homo Sapiens
KSKNTKKHG

SEQ ID NO: 295471 - protein, 9 aa, Homo Sapiens
EHTFNLKML

SEQ ID NO: 295472 - protein, 9 aa, Homo Sapiens
AVGQIMTCG

SEQ ID NO: 295473 - protein, 9 aa, Homo Sapiens
DKTGLSIRG

SEQ ID NO: 295474 - protein, 9 aa, Homo Sapiens
FVKAISQDS

SEQ ID NO: 295475 - protein, 9 aa, Homo Sapiens
LFSLAASKE

SEQ ID NO: 295476 - protein, 9 aa, Homo Sapiens
GDRSATLKI

SEQ ID NO: 295477 - protein, 9 aa, Homo Sapiens
KPPGCSLMY

SEQ ID NO: 295478 - protein, 9 aa, Homo Sapiens
NILSYRIFS

SEQ ID NO: 295479 - protein, 9 aa, Homo Sapiens
KKVLKDVVN

SEQ ID NO: 295480 - protein, 9 aa, Homo Sapiens
QEVTGSLIF

SEQ ID NO: 295481 - protein, 9 aa, Homo Sapiens
APNKKPRKS

SEQ ID NO: 295482 - protein, 9 aa, Homo Sapiens
LMQHIETVH

SEQ ID NO: 295483 - protein, 9 aa, Homo Sapiens
CQSALAIVQ

SEQ ID NO: 295484 - protein, 9 aa, Homo Sapiens
KAVLLLTQT

SEQ ID NO: 295485 - protein, 9 aa, Homo Sapiens
NEKRIKLHI

SEQ ID NO: 295486 - protein, 9 aa, Homo Sapiens
VLAIFEITI

SEQ ID NO: 295487 - protein, 9 aa, Homo Sapiens
QKIETLLYA

SEQ ID NO: 295488 - protein, 9 aa, Homo Sapiens
FENKIILKL

SEQ ID NO: 295489 - protein, 9 aa, Homo Sapiens
KGQGTCFYL

SEQ ID NO: 295490 - protein, 9 aa, Homo Sapiens
ILERHRISH

SEQ ID NO: 295491 - protein, 9 aa, Homo Sapiens
YHSESSSRS

SEQ ID NO: 295492 - protein, 9 aa, Homo Sapiens
EEFRENNQR

SEQ ID NO: 295493 - protein, 9 aa, Homo Sapiens
DLHYRTFDG

SEQ ID NO: 295494 - protein, 9 aa, Homo Sapiens
CKIKHISEL

SEQ ID NO: 295495 - protein, 9 aa, Homo Sapiens
LPRSTRETL

SEQ ID NO: 295496 - protein, 9 aa, Homo Sapiens
SVAGNIKKH

SEQ ID NO: 295497 - protein, 9 aa, Homo Sapiens
NEYLPLYSS

SEQ ID NO: 295498 - protein, 9 aa, Homo Sapiens
PEPINNDNP

SEQ ID NO: 295499 - protein, 9 aa, Homo Sapiens
FKGVIDYIL

SEQ ID NO: 295500 - protein, 9 aa, Homo Sapiens
EICPSSPII

SEQ ID NO: 295501 - protein, 9 aa, Homo Sapiens
GPGGIALEP

SEQ ID NO: 295502 - protein, 9 aa, Homo Sapiens
EAGLFVLIY

SEQ ID NO: 295503 - protein, 9 aa, Homo Sapiens
LDVDADNQI

SEQ ID NO: 295504 - protein, 9 aa, Homo Sapiens
VSFQNIGII

SEQ ID NO: 295505 - protein, 9 aa, Homo Sapiens
DLSTKVRNY

SEQ ID NO: 295506 - protein, 9 aa, Homo Sapiens
IRDYSDLKI

SEQ ID NO: 295507 - protein, 9 aa, Homo Sapiens
FKNNIGWAW

SEQ ID NO: 295508 - protein, 9 aa, Homo Sapiens
LNMPKMSFQ

SEQ ID NO: 295509 - protein, 9 aa, Homo Sapiens
LKRVTVVED

SEQ ID NO: 295510 - protein, 9 aa, Homo Sapiens
DIVHHCIKK

SEQ ID NO: 295511 - protein, 9 aa, Homo Sapiens
SAAVWNDYS

SEQ ID NO: 295512 - protein, 9 aa, Homo Sapiens
RTAVKNCMA

SEQ ID NO: 295513 - protein, 9 aa, Homo Sapiens
GSAHFSFTA

SEQ ID NO: 295514 - protein, 9 aa, Homo Sapiens
SKKVLYTAG

SEQ ID NO: 295515 - protein, 9 aa, Homo Sapiens
RVWTITSSL

SEQ ID NO: 295516 - protein, 9 aa, Homo Sapiens
NKLQKLELS

SEQ ID NO: 295517 - protein, 9 aa, Homo Sapiens
SEEIYLQQL

SEQ ID NO: 295518 - protein, 9 aa, Homo Sapiens
LSSLRTSDS

SEQ ID NO: 295519 - protein, 9 aa, Homo Sapiens
QKSLQFNKT

SEQ ID NO: 295520 - protein, 9 aa, Homo Sapiens
EMSANKINY

SEQ ID NO: 295521 - protein, 9 aa, Homo Sapiens
QERVISVLL

SEQ ID NO: 295522 - protein, 9 aa, Homo Sapiens
GSSYLPASA

SEQ ID NO: 295523 - protein, 9 aa, Homo Sapiens
CIVYLQYPS

SEQ ID NO: 295524 - protein, 9 aa, Homo Sapiens
VLQELICTG

SEQ ID NO: 295525 - protein, 9 aa, Homo Sapiens
KLDFTAHQI

SEQ ID NO: 295526 - protein, 9 aa, Homo Sapiens
VDPALGKFP

SEQ ID NO: 295527 - protein, 9 aa, Homo Sapiens
FEISAMQML

SEQ ID NO: 295528 - protein, 9 aa, Homo Sapiens
EEIPPMPEN

SEQ ID NO: 295529 - protein, 9 aa, Homo Sapiens
NSTQADEGR

SEQ ID NO: 295530 - protein, 9 aa, Homo Sapiens
NLRSKLIQA

SEQ ID NO: 295531 - protein, 9 aa, Homo Sapiens
SPRSYLFDN

SEQ ID NO: 295532 - protein, 9 aa, Homo Sapiens
KRIRKPFFH

SEQ ID NO: 295533 - protein, 9 aa, Homo Sapiens
RISHTEEKP

SEQ ID NO: 295534 - protein, 9 aa, Homo Sapiens
MSFATKLSD

SEQ ID NO: 295535 - protein, 9 aa, Homo Sapiens
YFINQILFL

SEQ ID NO: 295536 - protein, 9 aa, Homo Sapiens
KAFLINKET

SEQ ID NO: 295537 - protein, 9 aa, Homo Sapiens
HKLTVTIVR

SEQ ID NO: 295538 - protein, 9 aa, Homo Sapiens
DSESRRLPH

SEQ ID NO: 295539 - protein, 9 aa, Homo Sapiens
GKRVRGRQC

SEQ ID NO: 295540 - protein, 9 aa, Homo Sapiens
KYRKNVLKE

SEQ ID NO: 295541 - protein, 9 aa, Homo Sapiens
GIIVKAQKC

SEQ ID NO: 295542 - protein, 9 aa, Homo Sapiens
AKRKTVTDM

SEQ ID NO: 295543 - protein, 9 aa, Homo Sapiens
RKWKTFFTS

SEQ ID NO: 295544 - protein, 9 aa, Homo Sapiens
IAVSHKAPT

SEQ ID NO: 295545 - protein, 9 aa, Homo Sapiens
AAQPLFLHP

SEQ ID NO: 295546 - protein, 9 aa, Homo Sapiens
KRQAAPGII

SEQ ID NO: 295547 - protein, 9 aa, Homo Sapiens
REWYSSIFA

SEQ ID NO: 295548 - protein, 9 aa, Homo Sapiens
KENLLNILT

SEQ ID NO: 295549 - protein, 9 aa, Homo Sapiens
TEGFWNAKK

SEQ ID NO: 295550 - protein, 9 aa, Homo Sapiens
TKLTLDYLK

SEQ ID NO: 295551 - protein, 9 aa, Homo Sapiens
MMDHEDFRA

SEQ ID NO: 295552 - protein, 9 aa, Homo Sapiens
FSRRTSTQQ

SEQ ID NO: 295553 - protein, 9 aa, Homo Sapiens
TPGSVQSSS

SEQ ID NO: 295554 - protein, 9 aa, Homo Sapiens
SPSPTGKFY

SEQ ID NO: 295555 - protein, 9 aa, Homo Sapiens
TSVKIHLKV

SEQ ID NO: 295556 - protein, 9 aa, Homo Sapiens
VVYAVSKAG

SEQ ID NO: 295557 - protein, 9 aa, Homo Sapiens
NLICHQKIH

SEQ ID NO: 295558 - protein, 9 aa, Homo Sapiens
RSWKLILAQ

SEQ ID NO: 295559 - protein, 9 aa, Homo Sapiens
LFLSQTAQR

SEQ ID NO: 295560 - protein, 9 aa, Homo Sapiens
SSPKLFPVR

SEQ ID NO: 295561 - protein, 9 aa, Homo Sapiens
IDQQQQKSI

SEQ ID NO: 295562 - protein, 9 aa, Homo Sapiens
ILVQYKAAK

SEQ ID NO: 295563 - protein, 9 aa, Homo Sapiens
YKIIRHEDI

SEQ ID NO: 295564 - protein, 9 aa, Homo Sapiens
QGEPQARGT

SEQ ID NO: 295565 - protein, 9 aa, Homo Sapiens
SGSIFGSSR

SEQ ID NO: 295566 - protein, 9 aa, Homo Sapiens
KKIRKIIYM

SEQ ID NO: 295567 - protein, 9 aa, Homo Sapiens
VSDKKILLE

SEQ ID NO: 295568 - protein, 9 aa, Homo Sapiens
PKNNSIPTS

SEQ ID NO: 295569 - protein, 9 aa, Homo Sapiens
LVDPAAIPP

SEQ ID NO: 295570 - protein, 9 aa, Homo Sapiens
YLKGLQDGI

SEQ ID NO: 295571 - protein, 9 aa, Homo Sapiens
YDTGEHGLQ

SEQ ID NO: 295572 - protein, 9 aa, Homo Sapiens
RQFWFLMYP

SEQ ID NO: 295573 - protein, 9 aa, Homo Sapiens
NQGAMSPLE

SEQ ID NO: 295574 - protein, 9 aa, Homo Sapiens
NYVLLLIQT

SEQ ID NO: 295575 - protein, 9 aa, Homo Sapiens
KNIRNAQLA

SEQ ID NO: 295576 - protein, 9 aa, Homo Sapiens
RKAGYNKKL

SEQ ID NO: 295577 - protein, 9 aa, Homo Sapiens
PSTSASQVA

SEQ ID NO: 295578 - protein, 9 aa, Homo Sapiens
RLEPIRCSV

SEQ ID NO: 295579 - protein, 9 aa, Homo Sapiens
ESVQGRQKS

SEQ ID NO: 295580 - protein, 9 aa, Homo Sapiens
MIVTNKVIK

SEQ ID NO: 295581 - protein, 9 aa, Homo Sapiens
ILWDPSTGK

SEQ ID NO: 295582 - protein, 9 aa, Homo Sapiens
HRAEVRKVL

SEQ ID NO: 295583 - protein, 9 aa, Homo Sapiens
TLDEFIESC

SEQ ID NO: 295584 - protein, 9 aa, Homo Sapiens
HGGDMSNHP

SEQ ID NO: 295585 - protein, 9 aa, Homo Sapiens
CVLQPDVDS

SEQ ID NO: 295586 - protein, 9 aa, Homo Sapiens
RPDFKRKYY

SEQ ID NO: 295587 - protein, 9 aa, Homo Sapiens
QVADIVFQT

SEQ ID NO: 295588 - protein, 9 aa, Homo Sapiens
GFISKRSDP

SEQ ID NO: 295589 - protein, 9 aa, Homo Sapiens
GLSFLFVAP

SEQ ID NO: 295590 - protein, 9 aa, Homo Sapiens
NHTHLYVCG

SEQ ID NO: 295591 - protein, 9 aa, Homo Sapiens
YTYIRPRNL

SEQ ID NO: 295592 - protein, 9 aa, Homo Sapiens
SELPKCLQD

SEQ ID NO: 295593 - protein, 9 aa, Homo Sapiens
GLSFISFLQ

SEQ ID NO: 295594 - protein, 9 aa, Homo Sapiens
LAASFLKKR

SEQ ID NO: 295595 - protein, 9 aa, Homo Sapiens
PGNRSLFTL

SEQ ID NO: 295596 - protein, 9 aa, Homo Sapiens
QDVAHFFKG

SEQ ID NO: 295597 - protein, 9 aa, Homo Sapiens
RKDLAFEFE

SEQ ID NO: 295598 - protein, 9 aa, Homo Sapiens
LPPPGDRPE

SEQ ID NO: 295599 - protein, 9 aa, Homo Sapiens
VPTDVTAWR

SEQ ID NO: 295600 - protein, 9 aa, Homo Sapiens
NLTQHKIIH

SEQ ID NO: 295601 - protein, 9 aa, Homo Sapiens
KKNSLNELM

SEQ ID NO: 295602 - protein, 9 aa, Homo Sapiens
SAGIINRDL

SEQ ID NO: 295603 - protein, 9 aa, Homo Sapiens
DIKDKANKF

SEQ ID NO: 295604 - protein, 9 aa, Homo Sapiens
DFLAEKLQL

SEQ ID NO: 295605 - protein, 9 aa, Homo Sapiens
TGEKGFCYK

SEQ ID NO: 295606 - protein, 9 aa, Homo Sapiens
SLATDSGLE

SEQ ID NO: 295607 - protein, 9 aa, Homo Sapiens
HALEEIKKL

SEQ ID NO: 295608 - protein, 9 aa, Homo Sapiens
VHITNKRNG

SEQ ID NO: 295609 - protein, 9 aa, Homo Sapiens
FFLGASKFL

SEQ ID NO: 295610 - protein, 9 aa, Homo Sapiens
LKGCRSVDE

SEQ ID NO: 295611 - protein, 9 aa, Homo Sapiens
KFFYVVSLS

SEQ ID NO: 295612 - protein, 9 aa, Homo Sapiens
FKRKYYSMF

SEQ ID NO: 295613 - protein, 9 aa, Homo Sapiens
WKDQKMEDE

SEQ ID NO: 295614 - protein, 9 aa, Homo Sapiens
LITRFVYHL

SEQ ID NO: 295615 - protein, 9 aa, Homo Sapiens
SDLCYTAEN

SEQ ID NO: 295616 - protein, 9 aa, Homo Sapiens
VDIKENLQA

SEQ ID NO: 295617 - protein, 9 aa, Homo Sapiens
NCFLGIYLC

SEQ ID NO: 295618 - protein, 9 aa, Homo Sapiens
IIAYKPPGC

SEQ ID NO: 295619 - protein, 9 aa, Homo Sapiens
SRFVPSFLC

SEQ ID NO: 295620 - protein, 9 aa, Homo Sapiens
PVQFDTFDS

SEQ ID NO: 295621 - protein, 9 aa, Homo Sapiens
IALEPPPTT

SEQ ID NO: 295622 - protein, 9 aa, Homo Sapiens
LIGAKEGSG

SEQ ID NO: 295623 - protein, 9 aa, Homo Sapiens
QKNDKLGPE

SEQ ID NO: 295624 - protein, 9 aa, Homo Sapiens
LFFVFPPTP

SEQ ID NO: 295625 - protein, 9 aa, Homo Sapiens
EERHNALPT

SEQ ID NO: 295626 - protein, 9 aa, Homo Sapiens
RALCIRDKY

SEQ ID NO: 295627 - protein, 9 aa, Homo Sapiens
QSPVNKERI

SEQ ID NO: 295628 - protein, 9 aa, Homo Sapiens
RAIDAVPHV

SEQ ID NO: 295629 - protein, 9 aa, Homo Sapiens
HLRCEDLAR

SEQ ID NO: 295630 - protein, 9 aa, Homo Sapiens
ALEEFRENN

SEQ ID NO: 295631 - protein, 9 aa, Homo Sapiens
LAQLGCPIN

SEQ ID NO: 295632 - protein, 9 aa, Homo Sapiens
LPKYTEKEN

SEQ ID NO: 295633 - protein, 9 aa, Homo Sapiens
RRVSEDGQP

SEQ ID NO: 295634 - protein, 9 aa, Homo Sapiens
RNRYWGTLG

SEQ ID NO: 295635 - protein, 9 aa, Homo Sapiens
EPHAVTIHG

SEQ ID NO: 295636 - protein, 9 aa, Homo Sapiens
TEEKLYKIE

SEQ ID NO: 295637 - protein, 9 aa, Homo Sapiens
QMDDVYKEP

SEQ ID NO: 295638 - protein, 9 aa, Homo Sapiens
WAVRASSIF

SEQ ID NO: 295639 - protein, 9 aa, Homo Sapiens
IVQNALKSA

SEQ ID NO: 295640 - protein, 9 aa, Homo Sapiens
KTESINDGN

SEQ ID NO: 295641 - protein, 9 aa, Homo Sapiens
VHELPELTV

SEQ ID NO: 295642 - protein, 9 aa, Homo Sapiens
LLGDLEGLT

SEQ ID NO: 295643 - protein, 9 aa, Homo Sapiens
SPTAGPQEC

SEQ ID NO: 295644 - protein, 9 aa, Homo Sapiens
TSLADTYNR

SEQ ID NO: 295645 - protein, 9 aa, Homo Sapiens
ILGLFNHTR

SEQ ID NO: 295646 - protein, 9 aa, Homo Sapiens
DVLTELLSN

SEQ ID NO: 295647 - protein, 9 aa, Homo Sapiens
QELQHKRAL

SEQ ID NO: 295648 - protein, 9 aa, Homo Sapiens
GCFIFKPDV

SEQ ID NO: 295649 - protein, 9 aa, Homo Sapiens
DVLSPRYDP

SEQ ID NO: 295650 - protein, 9 aa, Homo Sapiens
QDNKKMKKY

SEQ ID NO: 295651 - protein, 9 aa, Homo Sapiens
NRTFSLFAE

SEQ ID NO: 295652 - protein, 9 aa, Homo Sapiens
YYLSYVKAQ

SEQ ID NO: 295653 - protein, 9 aa, Homo Sapiens
SWGCFDAMG

SEQ ID NO: 295654 - protein, 9 aa, Homo Sapiens
RNNSLETKS

SEQ ID NO: 295655 - protein, 9 aa, Homo Sapiens
KYFVLNFNG

SEQ ID NO: 295656 - protein, 9 aa, Homo Sapiens
LLPYDPAKS

SEQ ID NO: 295657 - protein, 9 aa, Homo Sapiens
EVLCIQNVL

SEQ ID NO: 295658 - protein, 9 aa, Homo Sapiens
RRPGDCFLL

SEQ ID NO: 295659 - protein, 9 aa, Homo Sapiens
NNIREQNEE

SEQ ID NO: 295660 - protein, 9 aa, Homo Sapiens
GKTLASTSV

SEQ ID NO: 295661 - protein, 9 aa, Homo Sapiens
ELVDGMLSR

SEQ ID NO: 295662 - protein, 9 aa, Homo Sapiens
QNFLTEISK

SEQ ID NO: 295663 - protein, 9 aa, Homo Sapiens
SFTTHIFNT

SEQ ID NO: 295664 - protein, 9 aa, Homo Sapiens
TFLYDIYLR

SEQ ID NO: 295665 - protein, 9 aa, Homo Sapiens
PERNRVLSQ

SEQ ID NO: 295666 - protein, 9 aa, Homo Sapiens
TLKQNVKLK

SEQ ID NO: 295667 - protein, 9 aa, Homo Sapiens
QSPHVSDKS

SEQ ID NO: 295668 - protein, 9 aa, Homo Sapiens
PHLYNSVNT

SEQ ID NO: 295669 - protein, 9 aa, Homo Sapiens
QRHQQGQGD

SEQ ID NO: 295670 - protein, 9 aa, Homo Sapiens
IGNIENGHV

SEQ ID NO: 295671 - protein, 9 aa, Homo Sapiens
SQTVCIRLV

SEQ ID NO: 295672 - protein, 9 aa, Homo Sapiens
CTDGYEWDH

SEQ ID NO: 295673 - protein, 9 aa, Homo Sapiens
NADEAGSDH

SEQ ID NO: 295674 - protein, 9 aa, Homo Sapiens
TLTPEMCVE

SEQ ID NO: 295675 - protein, 9 aa, Homo Sapiens
AQDAIFRLE

SEQ ID NO: 295676 - protein, 9 aa, Homo Sapiens
TGILMYTIA

SEQ ID NO: 295677 - protein, 9 aa, Homo Sapiens
KNLQEDISD

SEQ ID NO: 295678 - protein, 9 aa, Homo Sapiens
ATIQIEKGT

SEQ ID NO: 295679 - protein, 9 aa, Homo Sapiens
IISFLKMQH

SEQ ID NO: 295680 - protein, 9 aa, Homo Sapiens
SSLTQHVII

SEQ ID NO: 295681 - protein, 9 aa, Homo Sapiens
RKDSQTVYQ

SEQ ID NO: 295682 - protein, 9 aa, Homo Sapiens
FGMAPMLSD

SEQ ID NO: 295683 - protein, 9 aa, Homo Sapiens
LVSFSFLCV

SEQ ID NO: 295684 - protein, 9 aa, Homo Sapiens
QFRANYLLQ

SEQ ID NO: 295685 - protein, 9 aa, Homo Sapiens
NEYIYLVEK

SEQ ID NO: 295686 - protein, 9 aa, Homo Sapiens
HHQSLSVHQ

SEQ ID NO: 295687 - protein, 9 aa, Homo Sapiens
DTINGKLEE

SEQ ID NO: 295688 - protein, 9 aa, Homo Sapiens
GGINAWNTS

SEQ ID NO: 295689 - protein, 9 aa, Homo Sapiens
RDRVAKVHT

SEQ ID NO: 295690 - protein, 9 aa, Homo Sapiens
LVASKEPNK

SEQ ID NO: 295691 - protein, 9 aa, Homo Sapiens
KEVEYCTTT

SEQ ID NO: 295692 - protein, 9 aa, Homo Sapiens
QRVHTEEKL

SEQ ID NO: 295693 - protein, 9 aa, Homo Sapiens
EFYFMEDSR

SEQ ID NO: 295694 - protein, 9 aa, Homo Sapiens
RLGEIHYSK

SEQ ID NO: 295695 - protein, 9 aa, Homo Sapiens
VCLSEAGAG

SEQ ID NO: 295696 - protein, 9 aa, Homo Sapiens
IRCENVTTC

SEQ ID NO: 295697 - protein, 9 aa, Homo Sapiens
QSSFCSEAG

SEQ ID NO: 295698 - protein, 9 aa, Homo Sapiens
PHAVTIHGE

SEQ ID NO: 295699 - protein, 9 aa, Homo Sapiens
LIKRDPALK

SEQ ID NO: 295700 - protein, 9 aa, Homo Sapiens
CVPPALEKK

SEQ ID NO: 295701 - protein, 9 aa, Homo Sapiens
GTTSSPEPE

SEQ ID NO: 295702 - protein, 9 aa, Homo Sapiens
YSDLKILRC

SEQ ID NO: 295703 - protein, 9 aa, Homo Sapiens
KNNKSRNAD

SEQ ID NO: 295704 - protein, 9 aa, Homo Sapiens
FINYLDEST

SEQ ID NO: 295705 - protein, 9 aa, Homo Sapiens
DAVTDTVDI

SEQ ID NO: 295706 - protein, 9 aa, Homo Sapiens
PESERVWTI

SEQ ID NO: 295707 - protein, 9 aa, Homo Sapiens
ILMECMNKK

SEQ ID NO: 295708 - protein, 9 aa, Homo Sapiens
NEFLGHRIV

SEQ ID NO: 295709 - protein, 9 aa, Homo Sapiens
GLCGTLFIT

SEQ ID NO: 295710 - protein, 9 aa, Homo Sapiens
KSGQGQGQH

SEQ ID NO: 295711 - protein, 9 aa, Homo Sapiens
EIIQFVGAC

SEQ ID NO: 295712 - protein, 9 aa, Homo Sapiens
GFTEMPTDT

SEQ ID NO: 295713 - protein, 9 aa, Homo Sapiens
AFSLDEMAT

SEQ ID NO: 295714 - protein, 9 aa, Homo Sapiens
HAGTRRMKE

SEQ ID NO: 295715 - protein, 9 aa, Homo Sapiens
IALANGFLY

SEQ ID NO: 295716 - protein, 9 aa, Homo Sapiens
SSLVINKES

SEQ ID NO: 295717 - protein, 9 aa, Homo Sapiens
PSLRNMASL

SEQ ID NO: 295718 - protein, 9 aa, Homo Sapiens
GKQLEDKMV

SEQ ID NO: 295719 - protein, 9 aa, Homo Sapiens
NENMQVNNI

SEQ ID NO: 295720 - protein, 9 aa, Homo Sapiens
IERLYLPPD

SEQ ID NO: 295721 - protein, 9 aa, Homo Sapiens
EHQNRVFHD

SEQ ID NO: 295722 - protein, 9 aa, Homo Sapiens
LSANSIGAM

SEQ ID NO: 295723 - protein, 9 aa, Homo Sapiens
VDDDKILPL

SEQ ID NO: 295724 - protein, 9 aa, Homo Sapiens
DQYTNGLYS

SEQ ID NO: 295725 - protein, 9 aa, Homo Sapiens
LENITFSNL

SEQ ID NO: 295726 - protein, 9 aa, Homo Sapiens
LLDSAQRNL

SEQ ID NO: 295727 - protein, 9 aa, Homo Sapiens
QEAKKADNS

SEQ ID NO: 295728 - protein, 9 aa, Homo Sapiens
QGDYQIIQY

SEQ ID NO: 295729 - protein, 9 aa, Homo Sapiens
RGVHIKSAG

SEQ ID NO: 295730 - protein, 9 aa, Homo Sapiens
KRQEAERNK

SEQ ID NO: 295731 - protein, 9 aa, Homo Sapiens
SGHDQKNKY

SEQ ID NO: 295732 - protein, 9 aa, Homo Sapiens
VDIAPNQRV

SEQ ID NO: 295733 - protein, 9 aa, Homo Sapiens
SSYRLVASG

SEQ ID NO: 295734 - protein, 9 aa, Homo Sapiens
LLQGFINYL

SEQ ID NO: 295735 - protein, 9 aa, Homo Sapiens
HFRPKSGTR

SEQ ID NO: 295736 - protein, 9 aa, Homo Sapiens
LSRALFKRN

SEQ ID NO: 295737 - protein, 9 aa, Homo Sapiens
RMKELAGML

SEQ ID NO: 295738 - protein, 9 aa, Homo Sapiens
KFKQFCLLL

SEQ ID NO: 295739 - protein, 9 aa, Homo Sapiens
EEEKSTLES

SEQ ID NO: 295740 - protein, 9 aa, Homo Sapiens
LTKDDEQLC

SEQ ID NO: 295741 - protein, 9 aa, Homo Sapiens
FQYFSDTFN

SEQ ID NO: 295742 - protein, 9 aa, Homo Sapiens
KRRDNKTPT

SEQ ID NO: 295743 - protein, 9 aa, Homo Sapiens
KMLSEKFMS

SEQ ID NO: 295744 - protein, 9 aa, Homo Sapiens
TESINDGNI

SEQ ID NO: 295745 - protein, 9 aa, Homo Sapiens
RMHEFHSQD

SEQ ID NO: 295746 - protein, 9 aa, Homo Sapiens
TACKTKERE

SEQ ID NO: 295747 - protein, 9 aa, Homo Sapiens
TEIRNKVKK

SEQ ID NO: 295748 - protein, 9 aa, Homo Sapiens
NTLKELNVA

SEQ ID NO: 295749 - protein, 9 aa, Homo Sapiens
FWAGHRTPL

SEQ ID NO: 295750 - protein, 9 aa, Homo Sapiens
NRVCWAQAG

SEQ ID NO: 295751 - protein, 9 aa, Homo Sapiens
DLMAHKAVL

SEQ ID NO: 295752 - protein, 9 aa, Homo Sapiens
NNRIELKTI

SEQ ID NO: 295753 - protein, 9 aa, Homo Sapiens
REENLKKRP

SEQ ID NO: 295754 - protein, 9 aa, Homo Sapiens
TIIYQCETG

SEQ ID NO: 295755 - protein, 9 aa, Homo Sapiens
LKEVEYCTT

SEQ ID NO: 295756 - protein, 9 aa, Homo Sapiens
DFQNLRKME

SEQ ID NO: 295757 - protein, 9 aa, Homo Sapiens
VKNKSTHLN

SEQ ID NO: 295758 - protein, 9 aa, Homo Sapiens
PEELFQFLY

SEQ ID NO: 295759 - protein, 9 aa, Homo Sapiens
YAVKLVNDS

SEQ ID NO: 295760 - protein, 9 aa, Homo Sapiens
NDKQFAKLH

SEQ ID NO: 295761 - protein, 9 aa, Homo Sapiens
RREQPESLQ

SEQ ID NO: 295762 - protein, 9 aa, Homo Sapiens
TKDFLPDPA

SEQ ID NO: 295763 - protein, 9 aa, Homo Sapiens
LKKELLIHN

SEQ ID NO: 295764 - protein, 9 aa, Homo Sapiens
DKSQSSKKP

SEQ ID NO: 295765 - protein, 9 aa, Homo Sapiens
ATAEIIDEF

SEQ ID NO: 295766 - protein, 9 aa, Homo Sapiens
VTSFGPVSY

SEQ ID NO: 295767 - protein, 9 aa, Homo Sapiens
RNPEVQHVD

SEQ ID NO: 295768 - protein, 9 aa, Homo Sapiens
YNKKLWKKT

SEQ ID NO: 295769 - protein, 9 aa, Homo Sapiens
RQVEDDRQM

SEQ ID NO: 295770 - protein, 9 aa, Homo Sapiens
DMPDDNKII

SEQ ID NO: 295771 - protein, 9 aa, Homo Sapiens
VHNSNSGPN

SEQ ID NO: 295772 - protein, 9 aa, Homo Sapiens
EFILKKVND

SEQ ID NO: 295773 - protein, 9 aa, Homo Sapiens
LKNGPESII

SEQ ID NO: 295774 - protein, 9 aa, Homo Sapiens
LSCLSLPSS

SEQ ID NO: 295775 - protein, 9 aa, Homo Sapiens
PLIYSVNNS

SEQ ID NO: 295776 - protein, 9 aa, Homo Sapiens
ESQEELQTS

SEQ ID NO: 295777 - protein, 9 aa, Homo Sapiens
AFASTSRFA

SEQ ID NO: 295778 - protein, 9 aa, Homo Sapiens
DIGLHVLSC

SEQ ID NO: 295779 - protein, 9 aa, Homo Sapiens
PGAICYYSE

SEQ ID NO: 295780 - protein, 9 aa, Homo Sapiens
QKEIDTING

SEQ ID NO: 295781 - protein, 9 aa, Homo Sapiens
RIKYAPGAG

SEQ ID NO: 295782 - protein, 9 aa, Homo Sapiens
PTAFDYLNP

SEQ ID NO: 295783 - protein, 9 aa, Homo Sapiens
KGVIDYILY

SEQ ID NO: 295784 - protein, 9 aa, Homo Sapiens
YMLSITGNI

SEQ ID NO: 295785 - protein, 9 aa, Homo Sapiens
ISHPMGTSN

SEQ ID NO: 295786 - protein, 9 aa, Homo Sapiens
AAKVQELSK

SEQ ID NO: 295787 - protein, 9 aa, Homo Sapiens
GRVQPSKQK

SEQ ID NO: 295788 - protein, 9 aa, Homo Sapiens
SQPKEFSER

SEQ ID NO: 295789 - protein, 9 aa, Homo Sapiens
PPQKVQINL

SEQ ID NO: 295790 - protein, 9 aa, Homo Sapiens
LGNFTTRYI

SEQ ID NO: 295791 - protein, 9 aa, Homo Sapiens
KMINMMRPG

SEQ ID NO: 295792 - protein, 9 aa, Homo Sapiens
CQKCHILSG

SEQ ID NO: 295793 - protein, 9 aa, Homo Sapiens
VNLQDTSDE

SEQ ID NO: 295794 - protein, 9 aa, Homo Sapiens
IGAEDLSDQ

SEQ ID NO: 295795 - protein, 9 aa, Homo Sapiens
YTVPWINYF

SEQ ID NO: 295796 - protein, 9 aa, Homo Sapiens
LGDSLHQQE

SEQ ID NO: 295797 - protein, 9 aa, Homo Sapiens
IIHLIKWPD

SEQ ID NO: 295798 - protein, 9 aa, Homo Sapiens
FDAMGSLGA

SEQ ID NO: 295799 - protein, 9 aa, Homo Sapiens
PKIGKWDRD

SEQ ID NO: 295800 - protein, 9 aa, Homo Sapiens
DAVEVLIKT

SEQ ID NO: 295801 - protein, 9 aa, Homo Sapiens
RFQICLIAL

SEQ ID NO: 295802 - protein, 9 aa, Homo Sapiens
SSFLCNLDI

SEQ ID NO: 295803 - protein, 9 aa, Homo Sapiens
SMVHAQLCF

SEQ ID NO: 295804 - protein, 9 aa, Homo Sapiens
ENKLGETLS

SEQ ID NO: 295805 - protein, 9 aa, Homo Sapiens
LIIFAVMAY

SEQ ID NO: 295806 - protein, 9 aa, Homo Sapiens
SDTQIKENI

SEQ ID NO: 295807 - protein, 9 aa, Homo Sapiens
ERNRIQLPF

SEQ ID NO: 295808 - protein, 9 aa, Homo Sapiens
REWIRHLFP

SEQ ID NO: 295809 - protein, 9 aa, Homo Sapiens
KCECAQSEL

SEQ ID NO: 295810 - protein, 9 aa, Homo Sapiens
TYECNKCEK

SEQ ID NO: 295811 - protein, 9 aa, Homo Sapiens
SALSMITEI

SEQ ID NO: 295812 - protein, 9 aa, Homo Sapiens
KKPTVKEEL

SEQ ID NO: 295813 - protein, 9 aa, Homo Sapiens
AMQNYLKER

SEQ ID NO: 295814 - protein, 9 aa, Homo Sapiens
QEAMLLFKK

SEQ ID NO: 295815 - protein, 9 aa, Homo Sapiens
GIALEPPPT

SEQ ID NO: 295816 - protein, 9 aa, Homo Sapiens
PGKKLPDLE

SEQ ID NO: 295817 - protein, 9 aa, Homo Sapiens
GQLYKCHPD

SEQ ID NO: 295818 - protein, 9 aa, Homo Sapiens
EGGKVNYEK

SEQ ID NO: 295819 - protein, 9 aa, Homo Sapiens
HKKIHTGKK

SEQ ID NO: 295820 - protein, 9 aa, Homo Sapiens
QPHVGGEVS

SEQ ID NO: 295821 - protein, 9 aa, Homo Sapiens
KFSNPNITV

SEQ ID NO: 295822 - protein, 9 aa, Homo Sapiens
QETVDAVLQ

SEQ ID NO: 295823 - protein, 9 aa, Homo Sapiens
RLHLNLPKR

SEQ ID NO: 295824 - protein, 9 aa, Homo Sapiens
DDLVECLLR

SEQ ID NO: 295825 - protein, 9 aa, Homo Sapiens
VLVYLHTLT

SEQ ID NO: 295826 - protein, 9 aa, Homo Sapiens
TPSPSENNS

SEQ ID NO: 295827 - protein, 9 aa, Homo Sapiens
CCDSQDADL

SEQ ID NO: 295828 - protein, 9 aa, Homo Sapiens
QIHERAHNG

SEQ ID NO: 295829 - protein, 9 aa, Homo Sapiens
PTGKFYMGS

SEQ ID NO: 295830 - protein, 9 aa, Homo Sapiens
YKRAEHESP

SEQ ID NO: 295831 - protein, 9 aa, Homo Sapiens
NIINHFLCD

SEQ ID NO: 295832 - protein, 9 aa, Homo Sapiens
LFFFLQREG

SEQ ID NO: 295833 - protein, 9 aa, Homo Sapiens
EIENGFIYE

SEQ ID NO: 295834 - protein, 9 aa, Homo Sapiens
WIHCMIMAL

SEQ ID NO: 295835 - protein, 9 aa, Homo Sapiens
AMQTKEPVK

SEQ ID NO: 295836 - protein, 9 aa, Homo Sapiens
FVVNVAPQL

SEQ ID NO: 295837 - protein, 9 aa, Homo Sapiens
SPKFYAGTV

SEQ ID NO: 295838 - protein, 9 aa, Homo Sapiens
RTSYLENKL

SEQ ID NO: 295839 - protein, 9 aa, Homo Sapiens
KCNICLETA

SEQ ID NO: 295840 - protein, 9 aa, Homo Sapiens
GEDTLELAK

SEQ ID NO: 295841 - protein, 9 aa, Homo Sapiens
ILHNFNLKS

SEQ ID NO: 295842 - protein, 9 aa, Homo Sapiens
WWRENNGSF

SEQ ID NO: 295843 - protein, 9 aa, Homo Sapiens
EGYKDADYR

SEQ ID NO: 295844 - protein, 9 aa, Homo Sapiens
SDAKEVKMA

SEQ ID NO: 295845 - protein, 9 aa, Homo Sapiens
LFYGTLLFM

SEQ ID NO: 295846 - protein, 9 aa, Homo Sapiens
IAVIVFVLI

SEQ ID NO: 295847 - protein, 9 aa, Homo Sapiens
ETMCSRQWQ

SEQ ID NO: 295848 - protein, 9 aa, Homo Sapiens
DNWYNTYSS

SEQ ID NO: 295849 - protein, 9 aa, Homo Sapiens
EVIYLEKLN

SEQ ID NO: 295850 - protein, 9 aa, Homo Sapiens
IRYLITFLS

SEQ ID NO: 295851 - protein, 9 aa, Homo Sapiens
LPIQLGSLV

SEQ ID NO: 295852 - protein, 9 aa, Homo Sapiens
ECNKCEKIF

SEQ ID NO: 295853 - protein, 9 aa, Homo Sapiens
FKSSCYFFS

SEQ ID NO: 295854 - protein, 9 aa, Homo Sapiens
KPFWCTFEG

SEQ ID NO: 295855 - protein, 9 aa, Homo Sapiens
VFKSYSGNI

SEQ ID NO: 295856 - protein, 9 aa, Homo Sapiens
HIQKRLIQR

SEQ ID NO: 295857 - protein, 9 aa, Homo Sapiens
QLEMESKLH

SEQ ID NO: 295858 - protein, 9 aa, Homo Sapiens
HTKINPDYT

SEQ ID NO: 295859 - protein, 9 aa, Homo Sapiens
PLWSQWVIY

SEQ ID NO: 295860 - protein, 9 aa, Homo Sapiens
QERTSYLEN

SEQ ID NO: 295861 - protein, 9 aa, Homo Sapiens
AQEEDAKKT

SEQ ID NO: 295862 - protein, 9 aa, Homo Sapiens
MQNYLKERG

SEQ ID NO: 295863 - protein, 9 aa, Homo Sapiens
AYGLDTSED

SEQ ID NO: 295864 - protein, 9 aa, Homo Sapiens
ELTFYKEFM

SEQ ID NO: 295865 - protein, 9 aa, Homo Sapiens
LSEHQIIHR

SEQ ID NO: 295866 - protein, 9 aa, Homo Sapiens
LHRKVHTGE

SEQ ID NO: 295867 - protein, 9 aa, Homo Sapiens
NKVIKIVGL

SEQ ID NO: 295868 - protein, 9 aa, Homo Sapiens
QAVQGQWED

SEQ ID NO: 295869 - protein, 9 aa, Homo Sapiens
EVEECENYL

SEQ ID NO: 295870 - protein, 9 aa, Homo Sapiens
WSSDDNVDS

SEQ ID NO: 295871 - protein, 9 aa, Homo Sapiens
LNHGRQGED

SEQ ID NO: 295872 - protein, 9 aa, Homo Sapiens
HSTTAVSDK

SEQ ID NO: 295873 - protein, 9 aa, Homo Sapiens
VVSLSHDSG

SEQ ID NO: 295874 - protein, 9 aa, Homo Sapiens
SFLDASTMY

SEQ ID NO: 295875 - protein, 9 aa, Homo Sapiens
QIDDSLSTK

SEQ ID NO: 295876 - protein, 9 aa, Homo Sapiens
GTHIMNSTC

SEQ ID NO: 295877 - protein, 9 aa, Homo Sapiens
RTGQEKEKA

SEQ ID NO: 295878 - protein, 9 aa, Homo Sapiens
SYLTTHQIS

SEQ ID NO: 295879 - protein, 9 aa, Homo Sapiens
LHVNVEFQG

SEQ ID NO: 295880 - protein, 9 aa, Homo Sapiens
VKELSWQKR

SEQ ID NO: 295881 - protein, 9 aa, Homo Sapiens
INPVFYFIL

SEQ ID NO: 295882 - protein, 9 aa, Homo Sapiens
GFIHEVQVG

SEQ ID NO: 295883 - protein, 9 aa, Homo Sapiens
TDIKLSMKN

SEQ ID NO: 295884 - protein, 9 aa, Homo Sapiens
FRNNYGLKV

SEQ ID NO: 295885 - protein, 9 aa, Homo Sapiens
AEGRLRDKL

SEQ ID NO: 295886 - protein, 9 aa, Homo Sapiens
DDRRKAVST

SEQ ID NO: 295887 - protein, 9 aa, Homo Sapiens
VTLKNLSRQ

SEQ ID NO: 295888 - protein, 9 aa, Homo Sapiens
QSVSENYFL

SEQ ID NO: 295889 - protein, 9 aa, Homo Sapiens
SGEPGQTEG

SEQ ID NO: 295890 - protein, 9 aa, Homo Sapiens
QFFGPLGAA

SEQ ID NO: 295891 - protein, 9 aa, Homo Sapiens
QEILPLHVL

SEQ ID NO: 295892 - protein, 9 aa, Homo Sapiens
PVIQEEKPN

SEQ ID NO: 295893 - protein, 9 aa, Homo Sapiens
IRITSLLQH

SEQ ID NO: 295894 - protein, 9 aa, Homo Sapiens
DFSTKDFLP

SEQ ID NO: 295895 - protein, 9 aa, Homo Sapiens
NGNSVNVWP

SEQ ID NO: 295896 - protein, 9 aa, Homo Sapiens
DFIILGLFN

SEQ ID NO: 295897 - protein, 9 aa, Homo Sapiens
TNYIFCNIT

SEQ ID NO: 295898 - protein, 9 aa, Homo Sapiens
EVTRQMGDA

SEQ ID NO: 295899 - protein, 9 aa, Homo Sapiens
CKVGTKTIN

SEQ ID NO: 295900 - protein, 9 aa, Homo Sapiens
QEVSVQPSV

SEQ ID NO: 295901 - protein, 9 aa, Homo Sapiens
DKTSKQMAL

SEQ ID NO: 295902 - protein, 9 aa, Homo Sapiens
GAIGRSDAD

SEQ ID NO: 295903 - protein, 9 aa, Homo Sapiens
EEFSELPKC

SEQ ID NO: 295904 - protein, 9 aa, Homo Sapiens
GRKWKTFFT

SEQ ID NO: 295905 - protein, 9 aa, Homo Sapiens
GNDCPFEIT

SEQ ID NO: 295906 - protein, 9 aa, Homo Sapiens
DFPPPSPQE

SEQ ID NO: 295907 - protein, 9 aa, Homo Sapiens
LSQQPEAAP

SEQ ID NO: 295908 - protein, 9 aa, Homo Sapiens
RNVEAVINA

SEQ ID NO: 295909 - protein, 9 aa, Homo Sapiens
AFYHQPWTQ

SEQ ID NO: 295910 - protein, 9 aa, Homo Sapiens
AGPSLRNMA

SEQ ID NO: 295911 - protein, 9 aa, Homo Sapiens
GACDVDNLF

SEQ ID NO: 295912 - protein, 9 aa, Homo Sapiens
QVSTESETA

SEQ ID NO: 295913 - protein, 9 aa, Homo Sapiens
LYKIECDKD

SEQ ID NO: 295914 - protein, 9 aa, Homo Sapiens
VRRTVRSLG

SEQ ID NO: 295915 - protein, 9 aa, Homo Sapiens
ATCPHFLKC

SEQ ID NO: 295916 - protein, 9 aa, Homo Sapiens
NYIFCNITE

SEQ ID NO: 295917 - protein, 9 aa, Homo Sapiens
KCALYESVF

SEQ ID NO: 295918 - protein, 9 aa, Homo Sapiens
KASDQASEE

SEQ ID NO: 295919 - protein, 9 aa, Homo Sapiens
TERDLCEVF

SEQ ID NO: 295920 - protein, 9 aa, Homo Sapiens
VAVLHCLLQ

SEQ ID NO: 295921 - protein, 9 aa, Homo Sapiens
TTTLYWGGK

SEQ ID NO: 295922 - protein, 9 aa, Homo Sapiens
KRVQTMFNL

SEQ ID NO: 295923 - protein, 9 aa, Homo Sapiens
CLVCRKEKT

SEQ ID NO: 295924 - protein, 9 aa, Homo Sapiens
TIPPTVGDD

SEQ ID NO: 295925 - protein, 9 aa, Homo Sapiens
KSQLIIHQI

SEQ ID NO: 295926 - protein, 9 aa, Homo Sapiens
SQTKVLSSK

SEQ ID NO: 295927 - protein, 9 aa, Homo Sapiens
NTMFLSVRS

SEQ ID NO: 295928 - protein, 9 aa, Homo Sapiens
KARQPQPFF

SEQ ID NO: 295929 - protein, 9 aa, Homo Sapiens
RAAPEKNVT

SEQ ID NO: 295930 - protein, 9 aa, Homo Sapiens
FYKGINECK

SEQ ID NO: 295931 - protein, 9 aa, Homo Sapiens
VHIGEKPFT

SEQ ID NO: 295932 - protein, 9 aa, Homo Sapiens
KTVPVTDIE

SEQ ID NO: 295933 - protein, 9 aa, Homo Sapiens
TAEEKDKLV

SEQ ID NO: 295934 - protein, 9 aa, Homo Sapiens
CKECGKLFR

SEQ ID NO: 295935 - protein, 9 aa, Homo Sapiens
QITTLTGLD

SEQ ID NO: 295936 - protein, 9 aa, Homo Sapiens
RCNKCGKVY

SEQ ID NO: 295937 - protein, 9 aa, Homo Sapiens
RTSFPKYGG

SEQ ID NO: 295938 - protein, 9 aa, Homo Sapiens
GKAFYRLSY

SEQ ID NO: 295939 - protein, 9 aa, Homo Sapiens
IGWNKSEGS

SEQ ID NO: 295940 - protein, 9 aa, Homo Sapiens
IKCGIWTPD

SEQ ID NO: 295941 - protein, 9 aa, Homo Sapiens
TYAGQCPEG

SEQ ID NO: 295942 - protein, 9 aa, Homo Sapiens
QKNKQNISQ

SEQ ID NO: 295943 - protein, 9 aa, Homo Sapiens
DFMLHKSID

SEQ ID NO: 295944 - protein, 9 aa, Homo Sapiens
MQKSMQNNA

SEQ ID NO: 295945 - protein, 9 aa, Homo Sapiens
KLFSAQTNR

SEQ ID NO: 295946 - protein, 9 aa, Homo Sapiens
LWLRMHLLA

SEQ ID NO: 295947 - protein, 9 aa, Homo Sapiens
YDCQQIIIH

SEQ ID NO: 295948 - protein, 9 aa, Homo Sapiens
QISHSGDKP

SEQ ID NO: 295949 - protein, 9 aa, Homo Sapiens
RLDQKLEGG

SEQ ID NO: 295950 - protein, 9 aa, Homo Sapiens
LDLFMVSIL

SEQ ID NO: 295951 - protein, 9 aa, Homo Sapiens
TEQLHQKVG

SEQ ID NO: 295952 - protein, 8 aa, Homo Sapiens
NPVNATAL

SEQ ID NO: 295953 - protein, 9 aa, Homo Sapiens
CWYCRRQNG

SEQ ID NO: 295954 - protein, 9 aa, Homo Sapiens
AFSHHQSLS

SEQ ID NO: 295955 - protein, 9 aa, Homo Sapiens
RDSKITWIL

SEQ ID NO: 295956 - protein, 9 aa, Homo Sapiens
HKDILRVIG

SEQ ID NO: 295957 - protein, 9 aa, Homo Sapiens
SQRLKDTRV

SEQ ID NO: 295958 - protein, 9 aa, Homo Sapiens
YLPKPKLPE

SEQ ID NO: 295959 - protein, 9 aa, Homo Sapiens
RFYPLYKQD

SEQ ID NO: 295960 - protein, 9 aa, Homo Sapiens
TVECTYSVS

SEQ ID NO: 295961 - protein, 9 aa, Homo Sapiens
KQFWYLLES

SEQ ID NO: 295962 - protein, 9 aa, Homo Sapiens
SNIHSSCAT

SEQ ID NO: 295963 - protein, 9 aa, Homo Sapiens
SKNNRLRME

SEQ ID NO: 295964 - protein, 9 aa, Homo Sapiens
FLGLGNFTT

SEQ ID NO: 295965 - protein, 9 aa, Homo Sapiens
HSVKQTETA

SEQ ID NO: 295966 - protein, 9 aa, Homo Sapiens
LRKVGDKIF

SEQ ID NO: 295967 - protein, 9 aa, Homo Sapiens
WDPGCLYVV

SEQ ID NO: 295968 - protein, 9 aa, Homo Sapiens
KIGFFREET

SEQ ID NO: 295969 - protein, 9 aa, Homo Sapiens
TLGMEESKQ

SEQ ID NO: 295970 - protein, 9 aa, Homo Sapiens
TQETVDAVL

SEQ ID NO: 295971 - protein, 9 aa, Homo Sapiens
GLYTPQNFI

SEQ ID NO: 295972 - protein, 9 aa, Homo Sapiens
VDLPSYQEH

SEQ ID NO: 295973 - protein, 9 aa, Homo Sapiens
SIYKTKFSE

SEQ ID NO: 295974 - protein, 9 aa, Homo Sapiens
MGAVVSLLA

SEQ ID NO: 295975 - protein, 9 aa, Homo Sapiens
NNYQTMHGR

SEQ ID NO: 295976 - protein, 9 aa, Homo Sapiens
PEDYPVVKQ

SEQ ID NO: 295977 - protein, 9 aa, Homo Sapiens
GRLEKLPDV

SEQ ID NO: 295978 - protein, 9 aa, Homo Sapiens
VDQDSYRES

SEQ ID NO: 295979 - protein, 9 aa, Homo Sapiens
EINQQLPVA

SEQ ID NO: 295980 - protein, 9 aa, Homo Sapiens
LAGGHVKFR

SEQ ID NO: 295981 - protein, 9 aa, Homo Sapiens
SVSENYFLI

SEQ ID NO: 295982 - protein, 9 aa, Homo Sapiens
KKCSMNQNG

SEQ ID NO: 295983 - protein, 9 aa, Homo Sapiens
VTEETDKGS

SEQ ID NO: 295984 - protein, 9 aa, Homo Sapiens
NACLNKALP

SEQ ID NO: 295985 - protein, 9 aa, Homo Sapiens
LKGLQDGIG

SEQ ID NO: 295986 - protein, 9 aa, Homo Sapiens
STPSRDWRK

SEQ ID NO: 295987 - protein, 9 aa, Homo Sapiens
NLLYLVICA

SEQ ID NO: 295988 - protein, 9 aa, Homo Sapiens
YSFSSSLQI

SEQ ID NO: 295989 - protein, 9 aa, Homo Sapiens
LEQKKEREL

SEQ ID NO: 295990 - protein, 9 aa, Homo Sapiens
YHVTIRKKH

SEQ ID NO: 295991 - protein, 9 aa, Homo Sapiens
HGEKKQKLE

SEQ ID NO: 295992 - protein, 9 aa, Homo Sapiens
LLRRAVQLG

SEQ ID NO: 295993 - protein, 9 aa, Homo Sapiens
YLINNGSKK

SEQ ID NO: 295994 - protein, 9 aa, Homo Sapiens
KSQNGELMT

SEQ ID NO: 295995 - protein, 9 aa, Homo Sapiens
KSLALERKR

SEQ ID NO: 295996 - protein, 9 aa, Homo Sapiens
MLVLPHDPS

SEQ ID NO: 295997 - protein, 9 aa, Homo Sapiens
SSGSAHFSF

SEQ ID NO: 295998 - protein, 9 aa, Homo Sapiens
YSLIIHQRM

SEQ ID NO: 295999 - protein, 9 aa, Homo Sapiens
CNKWQDEDG

SEQ ID NO: 296000 - protein, 9 aa, Homo Sapiens
LANNYILMQ

SEQ ID NO: 296001 - protein, 9 aa, Homo Sapiens
VIGDRSIPK

SEQ ID NO: 296002 - protein, 9 aa, Homo Sapiens
QIVGQGPGD

SEQ ID NO: 296003 - protein, 9 aa, Homo Sapiens
ENAHGHQHF

SEQ ID NO: 296004 - protein, 9 aa, Homo Sapiens
ETALLIQAL

SEQ ID NO: 296005 - protein, 9 aa, Homo Sapiens
METIIKEKK

SEQ ID NO: 296006 - protein, 9 aa, Homo Sapiens
LALHHHTNL

SEQ ID NO: 296007 - protein, 9 aa, Homo Sapiens
VHWCVGEGM

SEQ ID NO: 296008 - protein, 9 aa, Homo Sapiens
LGQVAQARF

SEQ ID NO: 296009 - protein, 9 aa, Homo Sapiens
SCTSIYKCG

SEQ ID NO: 296010 - protein, 9 aa, Homo Sapiens
NIQFGLVND

SEQ ID NO: 296011 - protein, 9 aa, Homo Sapiens
RQKSLSIRA

SEQ ID NO: 296012 - protein, 9 aa, Homo Sapiens
QGAPDVLSP

SEQ ID NO: 296013 - protein, 9 aa, Homo Sapiens
VQYKAAKET

SEQ ID NO: 296014 - protein, 9 aa, Homo Sapiens
YRGPRTQDD

SEQ ID NO: 296015 - protein, 9 aa, Homo Sapiens
EMGGSKGIV

SEQ ID NO: 296016 - protein, 9 aa, Homo Sapiens
FNKTMDAKK

SEQ ID NO: 296017 - protein, 9 aa, Homo Sapiens
QQTHEEKSY

SEQ ID NO: 296018 - protein, 9 aa, Homo Sapiens
CGKIISSDS

SEQ ID NO: 296019 - protein, 9 aa, Homo Sapiens
TVPWINYFQ

SEQ ID NO: 296020 - protein, 9 aa, Homo Sapiens
ASKNTSQGY

SEQ ID NO: 296021 - protein, 9 aa, Homo Sapiens
LKKQLQQKQ

SEQ ID NO: 296022 - protein, 9 aa, Homo Sapiens
SRGFCFVTY

SEQ ID NO: 296023 - protein, 9 aa, Homo Sapiens
SDRIDSLQQ

SEQ ID NO: 296024 - protein, 9 aa, Homo Sapiens
SLSSKMLSQ

SEQ ID NO: 296025 - protein, 9 aa, Homo Sapiens
AIDDDNKTD

SEQ ID NO: 296026 - protein, 9 aa, Homo Sapiens
LLTKDEGED

SEQ ID NO: 296027 - protein, 9 aa, Homo Sapiens
NDTGHCFCR

SEQ ID NO: 296028 - protein, 9 aa, Homo Sapiens
ENNYTCVDG

SEQ ID NO: 296029 - protein, 9 aa, Homo Sapiens
TNGETGQLA

SEQ ID NO: 296030 - protein, 9 aa, Homo Sapiens
FKKVLGEKE

SEQ ID NO: 296031 - protein, 9 aa, Homo Sapiens
TDGEEEERE

SEQ ID NO: 296032 - protein, 9 aa, Homo Sapiens
DYSSSSPSR

SEQ ID NO: 296033 - protein, 9 aa, Homo Sapiens
ECLCTFREI

SEQ ID NO: 296034 - protein, 9 aa, Homo Sapiens
CEHQSPVQF

SEQ ID NO: 296035 - protein, 9 aa, Homo Sapiens
KSYKTLADQ

SEQ ID NO: 296036 - protein, 9 aa, Homo Sapiens
SQSFISVLL

SEQ ID NO: 296037 - protein, 9 aa, Homo Sapiens
KDLIKYMLR

SEQ ID NO: 296038 - protein, 9 aa, Homo Sapiens
DVPPVWGLL

SEQ ID NO: 296039 - protein, 9 aa, Homo Sapiens
EYKALTKDD

SEQ ID NO: 296040 - protein, 9 aa, Homo Sapiens
PETLTLQAP

SEQ ID NO: 296041 - protein, 9 aa, Homo Sapiens
QKEMEKTLR

SEQ ID NO: 296042 - protein, 9 aa, Homo Sapiens
NRKSGVFTS

SEQ ID NO: 296043 - protein, 9 aa, Homo Sapiens
EKKRRDNKT

SEQ ID NO: 296044 - protein, 9 aa, Homo Sapiens
EKLKSIDEH

SEQ ID NO: 296045 - protein, 9 aa, Homo Sapiens
HNQISILYL

SEQ ID NO: 296046 - protein, 9 aa, Homo Sapiens
CSKDISALT

SEQ ID NO: 296047 - protein, 9 aa, Homo Sapiens
APSGPGGIA

SEQ ID NO: 296048 - protein, 9 aa, Homo Sapiens
YNLDRLCLP

SEQ ID NO: 296049 - protein, 9 aa, Homo Sapiens
RRKCPLPRT

SEQ ID NO: 296050 - protein, 9 aa, Homo Sapiens
QRFHTGNTS

SEQ ID NO: 296051 - protein, 9 aa, Homo Sapiens
QFCVIIEKN

SEQ ID NO: 296052 - protein, 9 aa, Homo Sapiens
RIEDFDLAH

SEQ ID NO: 296053 - protein, 9 aa, Homo Sapiens
DKWTNQLNY

SEQ ID NO: 296054 - protein, 9 aa, Homo Sapiens
ELKIKCLQE

SEQ ID NO: 296055 - protein, 9 aa, Homo Sapiens
TTFLSLTKH

SEQ ID NO: 296056 - protein, 9 aa, Homo Sapiens
KQKPLPPLP

SEQ ID NO: 296057 - protein, 9 aa, Homo Sapiens
ESNKENYSE

SEQ ID NO: 296058 - protein, 9 aa, Homo Sapiens
LSDKTSKQM

SEQ ID NO: 296059 - protein, 9 aa, Homo Sapiens
KNVSVIGRM

SEQ ID NO: 296060 - protein, 9 aa, Homo Sapiens
GICLVSGLV

SEQ ID NO: 296061 - protein, 9 aa, Homo Sapiens
KAKLGWPAG

SEQ ID NO: 296062 - protein, 9 aa, Homo Sapiens
SKVVLAEEK

SEQ ID NO: 296063 - protein, 9 aa, Homo Sapiens
QTRLSTETG

SEQ ID NO: 296064 - protein, 9 aa, Homo Sapiens
DYRLRRFEA

SEQ ID NO: 296065 - protein, 9 aa, Homo Sapiens
SQTAQRSAL

SEQ ID NO: 296066 - protein, 9 aa, Homo Sapiens
QKMNYFMDI

SEQ ID NO: 296067 - protein, 9 aa, Homo Sapiens
RTITQNVLQ

SEQ ID NO: 296068 - protein, 9 aa, Homo Sapiens
TSMNSSPIS

SEQ ID NO: 296069 - protein, 9 aa, Homo Sapiens
KSTPSRDWR

SEQ ID NO: 296070 - protein, 9 aa, Homo Sapiens
GTVADVYIS

SEQ ID NO: 296071 - protein, 9 aa, Homo Sapiens
NTFLRAFRT

SEQ ID NO: 296072 - protein, 9 aa, Homo Sapiens
DQKFMEKSN

SEQ ID NO: 296073 - protein, 9 aa, Homo Sapiens
DMKDKLLLV

SEQ ID NO: 296074 - protein, 9 aa, Homo Sapiens
QTVPLLKKF

SEQ ID NO: 296075 - protein, 9 aa, Homo Sapiens
LLIQDNVNL

SEQ ID NO: 296076 - protein, 9 aa, Homo Sapiens
MKEKWENYK

SEQ ID NO: 296077 - protein, 9 aa, Homo Sapiens
NRIQLPFHT

SEQ ID NO: 296078 - protein, 9 aa, Homo Sapiens
NNLTLLNSF

SEQ ID NO: 296079 - protein, 9 aa, Homo Sapiens
KQDKTGSFQ

SEQ ID NO: 296080 - protein, 9 aa, Homo Sapiens
GKAVLLLTQ

SEQ ID NO: 296081 - protein, 9 aa, Homo Sapiens
LSNNRLYRR

SEQ ID NO: 296082 - protein, 9 aa, Homo Sapiens
VKSEAAPKC

SEQ ID NO: 296083 - protein, 9 aa, Homo Sapiens
LERHRISHT

SEQ ID NO: 296084 - protein, 9 aa, Homo Sapiens
MLDNIFLPL

SEQ ID NO: 296085 - protein, 9 aa, Homo Sapiens
HGPDAHVIK

SEQ ID NO: 296086 - protein, 9 aa, Homo Sapiens
TYNVDRSGN

SEQ ID NO: 296087 - protein, 9 aa, Homo Sapiens
VDLCQKGLV

SEQ ID NO: 296088 - protein, 9 aa, Homo Sapiens
GIQNYRFHT

SEQ ID NO: 296089 - protein, 9 aa, Homo Sapiens
FCIICALLG

SEQ ID NO: 296090 - protein, 9 aa, Homo Sapiens
TLEVGYIVS

SEQ ID NO: 296091 - protein, 9 aa, Homo Sapiens
TTEAELMQQ

SEQ ID NO: 296092 - protein, 9 aa, Homo Sapiens
WKLILAQKL

SEQ ID NO: 296093 - protein, 9 aa, Homo Sapiens
PGSGLTATR

SEQ ID NO: 296094 - protein, 9 aa, Homo Sapiens
APILGSYSG

SEQ ID NO: 296095 - protein, 9 aa, Homo Sapiens
HSGSCNSIL

SEQ ID NO: 296096 - protein, 9 aa, Homo Sapiens
PVKLYEFYL

SEQ ID NO: 296097 - protein, 9 aa, Homo Sapiens
MKGIKARWS

SEQ ID NO: 296098 - protein, 9 aa, Homo Sapiens
AHFDPKVEH

SEQ ID NO: 296099 - protein, 9 aa, Homo Sapiens
AMWVKKITD

SEQ ID NO: 296100 - protein, 9 aa, Homo Sapiens
AVSKQYPVT

SEQ ID NO: 296101 - protein, 9 aa, Homo Sapiens
MGLVHIPTH

SEQ ID NO: 296102 - protein, 9 aa, Homo Sapiens
NSQEVQAAF

SEQ ID NO: 296103 - protein, 9 aa, Homo Sapiens
GVLAIFEIT

SEQ ID NO: 296104 - protein, 9 aa, Homo Sapiens
CPQPPKTQV

SEQ ID NO: 296105 - protein, 9 aa, Homo Sapiens
KPNDALVYT

SEQ ID NO: 296106 - protein, 9 aa, Homo Sapiens
QIMYVFYQM

SEQ ID NO: 296107 - protein, 9 aa, Homo Sapiens
TNIPEEVCE

SEQ ID NO: 296108 - protein, 9 aa, Homo Sapiens
ELSWQKRTG

SEQ ID NO: 296109 - protein, 9 aa, Homo Sapiens
IVQLIQKHP

SEQ ID NO: 296110 - protein, 9 aa, Homo Sapiens
IPAFQTFLK

SEQ ID NO: 296111 - protein, 9 aa, Homo Sapiens
GSHNHEASS

SEQ ID NO: 296112 - protein, 9 aa, Homo Sapiens
SLENNGGPS

SEQ ID NO: 296113 - protein, 9 aa, Homo Sapiens
VLALAQIDN

SEQ ID NO: 296114 - protein, 9 aa, Homo Sapiens
DEPPNDVFD

SEQ ID NO: 296115 - protein, 9 aa, Homo Sapiens
EIEHLQNEL

SEQ ID NO: 296116 - protein, 9 aa, Homo Sapiens
RPFVIQPIS

SEQ ID NO: 296117 - protein, 9 aa, Homo Sapiens
KCSLATDSG

SEQ ID NO: 296118 - protein, 9 aa, Homo Sapiens
QLEKHHVCS

SEQ ID NO: 296119 - protein, 9 aa, Homo Sapiens
KTPFPFDKP

SEQ ID NO: 296120 - protein, 9 aa, Homo Sapiens
NHILYSLRN

SEQ ID NO: 296121 - protein, 9 aa, Homo Sapiens
MCKLGYNVN

SEQ ID NO: 296122 - protein, 9 aa, Homo Sapiens
RIRGRKEGE

SEQ ID NO: 296123 - protein, 9 aa, Homo Sapiens
VCLMFLTQK

SEQ ID NO: 296124 - protein, 9 aa, Homo Sapiens
TGVKVPRNS

SEQ ID NO: 296125 - protein, 9 aa, Homo Sapiens
WTPSPSENN

SEQ ID NO: 296126 - protein, 9 aa, Homo Sapiens
GRPKNNSIP

SEQ ID NO: 296127 - protein, 9 aa, Homo Sapiens
MHEFHSQDN

SEQ ID NO: 296128 - protein, 9 aa, Homo Sapiens
GVPEFILVG

SEQ ID NO: 296129 - protein, 9 aa, Homo Sapiens
LSVSCQEGK

SEQ ID NO: 296130 - protein, 9 aa, Homo Sapiens
KNKQNISQL

SEQ ID NO: 296131 - protein, 9 aa, Homo Sapiens
LAVDPVAAG

SEQ ID NO: 296132 - protein, 9 aa, Homo Sapiens
IAVQYISLG

SEQ ID NO: 296133 - protein, 9 aa, Homo Sapiens
LGWNGVSDV

SEQ ID NO: 296134 - protein, 9 aa, Homo Sapiens
ETILHTLIY

SEQ ID NO: 296135 - protein, 9 aa, Homo Sapiens
FKTVTSSGV

SEQ ID NO: 296136 - protein, 9 aa, Homo Sapiens
QNDLKMGKG

SEQ ID NO: 296137 - protein, 9 aa, Homo Sapiens
LEDDGEFME

SEQ ID NO: 296138 - protein, 9 aa, Homo Sapiens
EQLQKDIKD

SEQ ID NO: 296139 - protein, 9 aa, Homo Sapiens
TQDTSFEGT

SEQ ID NO: 296140 - protein, 9 aa, Homo Sapiens
ITHSKELSE

SEQ ID NO: 296141 - protein, 9 aa, Homo Sapiens
VVARERLTA

SEQ ID NO: 296142 - protein, 9 aa, Homo Sapiens
EQFMSGKVV

SEQ ID NO: 296143 - protein, 9 aa, Homo Sapiens
TFLKKILAR

SEQ ID NO: 296144 - protein, 9 aa, Homo Sapiens
TSVQKLFNP

SEQ ID NO: 296145 - protein, 9 aa, Homo Sapiens
LGWKPEIYQ

SEQ ID NO: 296146 - protein, 9 aa, Homo Sapiens
VKTYLEEKL

SEQ ID NO: 296147 - protein, 9 aa, Homo Sapiens
YQHIHQKSL

SEQ ID NO: 296148 - protein, 9 aa, Homo Sapiens
LVGHQQIIH

SEQ ID NO: 296149 - protein, 9 aa, Homo Sapiens
ILQQPTDKV

SEQ ID NO: 296150 - protein, 9 aa, Homo Sapiens
AALNYPRLA

SEQ ID NO: 296151 - protein, 9 aa, Homo Sapiens
KDKLVKAER

SEQ ID NO: 296152 - protein, 9 aa, Homo Sapiens
VKEKNVVGQ

SEQ ID NO: 296153 - protein, 9 aa, Homo Sapiens
VVPICTIKS

SEQ ID NO: 296154 - protein, 9 aa, Homo Sapiens
ACHHSISVQ

SEQ ID NO: 296155 - protein, 9 aa, Homo Sapiens
LDQASMGAV

SEQ ID NO: 296156 - protein, 9 aa, Homo Sapiens
SAHLITHQR

SEQ ID NO: 296157 - protein, 9 aa, Homo Sapiens
WGRGITRLL

SEQ ID NO: 296158 - protein, 9 aa, Homo Sapiens
SSTLLTVKV

SEQ ID NO: 296159 - protein, 9 aa, Homo Sapiens
QFALHSSED

SEQ ID NO: 296160 - protein, 9 aa, Homo Sapiens
SDIVSISKT

SEQ ID NO: 296161 - protein, 9 aa, Homo Sapiens
DSWLDKEVK

SEQ ID NO: 296162 - protein, 9 aa, Homo Sapiens
RADKSYTVQ

SEQ ID NO: 296163 - protein, 9 aa, Homo Sapiens
SHKRAISTP

SEQ ID NO: 296164 - protein, 9 aa, Homo Sapiens
SGYLLRKLK

SEQ ID NO: 296165 - protein, 9 aa, Homo Sapiens
STASTNINA

SEQ ID NO: 296166 - protein, 9 aa, Homo Sapiens
ETRFKWFFQ

SEQ ID NO: 296167 - protein, 9 aa, Homo Sapiens
QEDISDLTE

SEQ ID NO: 296168 - protein, 9 aa, Homo Sapiens
MYNFNPTEE

SEQ ID NO: 296169 - protein, 9 aa, Homo Sapiens
LQKYHNTIC

SEQ ID NO: 296170 - protein, 9 aa, Homo Sapiens
GCTSSPCQH

SEQ ID NO: 296171 - protein, 9 aa, Homo Sapiens
LLSDLNKQV

SEQ ID NO: 296172 - protein, 9 aa, Homo Sapiens
GPYQPKFWC

SEQ ID NO: 296173 - protein, 9 aa, Homo Sapiens
QMKQKNKQN

SEQ ID NO: 296174 - protein, 9 aa, Homo Sapiens
WCDQILWKG

SEQ ID NO: 296175 - protein, 9 aa, Homo Sapiens
ATGDEFYFM

SEQ ID NO: 296176 - protein, 9 aa, Homo Sapiens
MSIVFGIHP

SEQ ID NO: 296177 - protein, 9 aa, Homo Sapiens
KAHSKDKTK

SEQ ID NO: 296178 - protein, 9 aa, Homo Sapiens
YNGAVLTKS

SEQ ID NO: 296179 - protein, 9 aa, Homo Sapiens
SIQKQWKEL

SEQ ID NO: 296180 - protein, 9 aa, Homo Sapiens
AHYDSLEEK

SEQ ID NO: 296181 - protein, 9 aa, Homo Sapiens
INTVPHLAA

SEQ ID NO: 296182 - protein, 9 aa, Homo Sapiens
AKFVDMPQS

SEQ ID NO: 296183 - protein, 9 aa, Homo Sapiens
KMSQGNISK

SEQ ID NO: 296184 - protein, 9 aa, Homo Sapiens
DFHALKDII

SEQ ID NO: 296185 - protein, 9 aa, Homo Sapiens
KNVLKEMKK

SEQ ID NO: 296186 - protein, 9 aa, Homo Sapiens
STPPKIIFC

SEQ ID NO: 296187 - protein, 9 aa, Homo Sapiens
NMQRLLETE

SEQ ID NO: 296188 - protein, 9 aa, Homo Sapiens
EHIAKRAMD

SEQ ID NO: 296189 - protein, 9 aa, Homo Sapiens
ALKEWGLFR

SEQ ID NO: 296190 - protein, 9 aa, Homo Sapiens
GCLLDCFLL

SEQ ID NO: 296191 - protein, 9 aa, Homo Sapiens
KCGIWTPDD

SEQ ID NO: 296192 - protein, 9 aa, Homo Sapiens
QKEKPAIHH

SEQ ID NO: 296193 - protein, 9 aa, Homo Sapiens
RLKDKIPHV

SEQ ID NO: 296194 - protein, 9 aa, Homo Sapiens
ELAPKVIGS

SEQ ID NO: 296195 - protein, 9 aa, Homo Sapiens
IFSRNLHPA

SEQ ID NO: 296196 - protein, 9 aa, Homo Sapiens
LLEEPEMES

SEQ ID NO: 296197 - protein, 9 aa, Homo Sapiens
STGQDMLFV

SEQ ID NO: 296198 - protein, 9 aa, Homo Sapiens
YLSERGSQQ

SEQ ID NO: 296199 - protein, 9 aa, Homo Sapiens
RPHVHTQTE

SEQ ID NO: 296200 - protein, 9 aa, Homo Sapiens
EIFFHYSEL

SEQ ID NO: 296201 - protein, 9 aa, Homo Sapiens
SNKKKKETS

SEQ ID NO: 296202 - protein, 9 aa, Homo Sapiens
YLGNLAKSL

SEQ ID NO: 296203 - protein, 9 aa, Homo Sapiens
NIDPALRRF

SEQ ID NO: 296204 - protein, 9 aa, Homo Sapiens
RNVMLESYR

SEQ ID NO: 296205 - protein, 9 aa, Homo Sapiens
ADTCIMFDS

SEQ ID NO: 296206 - protein, 9 aa, Homo Sapiens
VQAILRINW

SEQ ID NO: 296207 - protein, 9 aa, Homo Sapiens
DEECERFRQ

SEQ ID NO: 296208 - protein, 9 aa, Homo Sapiens
RAIQYLKTI

SEQ ID NO: 296209 - protein, 9 aa, Homo Sapiens
QLKDLLKKN

SEQ ID NO: 296210 - protein, 9 aa, Homo Sapiens
STSFLSYTV

SEQ ID NO: 296211 - protein, 9 aa, Homo Sapiens
PRNIALPFV

SEQ ID NO: 296212 - protein, 9 aa, Homo Sapiens
LKVIKFKDG

SEQ ID NO: 296213 - protein, 9 aa, Homo Sapiens
VLLTQIKSK

SEQ ID NO: 296214 - protein, 9 aa, Homo Sapiens
FIVHAIRHC

SEQ ID NO: 296215 - protein, 9 aa, Homo Sapiens
VYVLSLLGN

SEQ ID NO: 296216 - protein, 9 aa, Homo Sapiens
IMRPVKAAL

SEQ ID NO: 296217 - protein, 9 aa, Homo Sapiens
RKIALQDRT

SEQ ID NO: 296218 - protein, 9 aa, Homo Sapiens
IALSYFKMA

SEQ ID NO: 296219 - protein, 9 aa, Homo Sapiens
DSDMAQDFL

SEQ ID NO: 296220 - protein, 9 aa, Homo Sapiens
QTLQDLSVS

SEQ ID NO: 296221 - protein, 9 aa, Homo Sapiens
GTQIFVYVS

SEQ ID NO: 296222 - protein, 9 aa, Homo Sapiens
IGTPVKVWF

SEQ ID NO: 296223 - protein, 9 aa, Homo Sapiens
LCIEKLSGE

SEQ ID NO: 296224 - protein, 9 aa, Homo Sapiens
HSALIIHQI

SEQ ID NO: 296225 - protein, 9 aa, Homo Sapiens
LFRLLEFSD

SEQ ID NO: 296226 - protein, 9 aa, Homo Sapiens
MGQILGETP

SEQ ID NO: 296227 - protein, 9 aa, Homo Sapiens
GHVKFRFDC

SEQ ID NO: 296228 - protein, 9 aa, Homo Sapiens
FKNIREKTY

SEQ ID NO: 296229 - protein, 9 aa, Homo Sapiens
KLSLDPGKR

SEQ ID NO: 296230 - protein, 9 aa, Homo Sapiens
IEWWRENNG

SEQ ID NO: 296231 - protein, 9 aa, Homo Sapiens
TFLSLGSRS

SEQ ID NO: 296232 - protein, 9 aa, Homo Sapiens
TKLSDYFLL

SEQ ID NO: 296233 - protein, 9 aa, Homo Sapiens
FYFLFHQPL

SEQ ID NO: 296234 - protein, 9 aa, Homo Sapiens
DLEYLQDNI

SEQ ID NO: 296235 - protein, 9 aa, Homo Sapiens
ELDQHTADV

SEQ ID NO: 296236 - protein, 9 aa, Homo Sapiens
KVPCCTHYL

SEQ ID NO: 296237 - protein, 9 aa, Homo Sapiens
RTPQGDYQI

SEQ ID NO: 296238 - protein, 9 aa, Homo Sapiens
TFEYFQIRP

SEQ ID NO: 296239 - protein, 9 aa, Homo Sapiens
DVLQELICT

SEQ ID NO: 296240 - protein, 9 aa, Homo Sapiens
DLPSYQEHS

SEQ ID NO: 296241 - protein, 9 aa, Homo Sapiens
AILDVDADN

SEQ ID NO: 296242 - protein, 9 aa, Homo Sapiens
ALDIYGRTV

SEQ ID NO: 296243 - protein, 9 aa, Homo Sapiens
PKVPCCTHY

SEQ ID NO: 296244 - protein, 9 aa, Homo Sapiens
KWENYKVVA

SEQ ID NO: 296245 - protein, 9 aa, Homo Sapiens
YDVKAPSDS

SEQ ID NO: 296246 - protein, 9 aa, Homo Sapiens
ETGADEEEE

SEQ ID NO: 296247 - protein, 9 aa, Homo Sapiens
TKINPDYTY

SEQ ID NO: 296248 - protein, 9 aa, Homo Sapiens
RWDPGCLYV

SEQ ID NO: 296249 - protein, 9 aa, Homo Sapiens
LKLTTNYVD

SEQ ID NO: 296250 - protein, 9 aa, Homo Sapiens
FETYADARW

SEQ ID NO: 296251 - protein, 9 aa, Homo Sapiens
YSAYAQARM

SEQ ID NO: 296252 - protein, 9 aa, Homo Sapiens
TKRGGGGGF

SEQ ID NO: 296253 - protein, 9 aa, Homo Sapiens
FWGRFLSHV

SEQ ID NO: 296254 - protein, 9 aa, Homo Sapiens
QLRTLDLWR

SEQ ID NO: 296255 - protein, 9 aa, Homo Sapiens
VKTLKWGLY

SEQ ID NO: 296256 - protein, 9 aa, Homo Sapiens
SYTGSDVIE

SEQ ID NO: 296257 - protein, 9 aa, Homo Sapiens
QIIHTRERS

SEQ ID NO: 296258 - protein, 9 aa, Homo Sapiens
RIFRQNSDI

SEQ ID NO: 296259 - protein, 9 aa, Homo Sapiens
GDITIFTES

SEQ ID NO: 296260 - protein, 9 aa, Homo Sapiens
GLGYVAHMV

SEQ ID NO: 296261 - protein, 9 aa, Homo Sapiens
IDEITKKHI

SEQ ID NO: 296262 - protein, 9 aa, Homo Sapiens
DKIFGDLSY

SEQ ID NO: 296263 - protein, 9 aa, Homo Sapiens
LESYAYYLK

SEQ ID NO: 296264 - protein, 9 aa, Homo Sapiens
LHMHLIQHQ

SEQ ID NO: 296265 - protein, 9 aa, Homo Sapiens
IPHVRIQAV

SEQ ID NO: 296266 - protein, 9 aa, Homo Sapiens
DEIEGNDCP

SEQ ID NO: 296267 - protein, 9 aa, Homo Sapiens
FLENVCYSI

SEQ ID NO: 296268 - protein, 9 aa, Homo Sapiens
WKDCKIRIF

SEQ ID NO: 296269 - protein, 9 aa, Homo Sapiens
KTLVVNPGE

SEQ ID NO: 296270 - protein, 9 aa, Homo Sapiens
WGLGFFMAE

SEQ ID NO: 296271 - protein, 9 aa, Homo Sapiens
LLIFIIIHW

SEQ ID NO: 296272 - protein, 9 aa, Homo Sapiens
LGTHKLTQP

SEQ ID NO: 296273 - protein, 9 aa, Homo Sapiens
NDTLTFKEC

SEQ ID NO: 296274 - protein, 9 aa, Homo Sapiens
DVGDLMLYF

SEQ ID NO: 296275 - protein, 9 aa, Homo Sapiens
CDEFVGARH

SEQ ID NO: 296276 - protein, 9 aa, Homo Sapiens
SKHISDLHN

SEQ ID NO: 296277 - protein, 9 aa, Homo Sapiens
VRSLGIYTF

SEQ ID NO: 296278 - protein, 9 aa, Homo Sapiens
LKEDWASEK

SEQ ID NO: 296279 - protein, 9 aa, Homo Sapiens
MLWGLFHDS

SEQ ID NO: 296280 - protein, 9 aa, Homo Sapiens
DLKNNLEYA

SEQ ID NO: 296281 - protein, 9 aa, Homo Sapiens
PQSDTPEIC

SEQ ID NO: 296282 - protein, 9 aa, Homo Sapiens
SAHCSIQVE

SEQ ID NO: 296283 - protein, 9 aa, Homo Sapiens
TSRQLFESE

SEQ ID NO: 296284 - protein, 9 aa, Homo Sapiens
DINEALKEL

SEQ ID NO: 296285 - protein, 9 aa, Homo Sapiens
DLKESICSW

SEQ ID NO: 296286 - protein, 9 aa, Homo Sapiens
SYPFVTSQL

SEQ ID NO: 296287 - protein, 9 aa, Homo Sapiens
TADGKHQDL

SEQ ID NO: 296288 - protein, 9 aa, Homo Sapiens
YDVGMKPRH

SEQ ID NO: 296289 - protein, 9 aa, Homo Sapiens
RGNSIFGMA

SEQ ID NO: 296290 - protein, 9 aa, Homo Sapiens
CGSPHDSGT

SEQ ID NO: 296291 - protein, 9 aa, Homo Sapiens
INQGAMSPL

SEQ ID NO: 296292 - protein, 9 aa, Homo Sapiens
QSLVVRKKR

SEQ ID NO: 296293 - protein, 9 aa, Homo Sapiens
TNNSNPVMC

SEQ ID NO: 296294 - protein, 9 aa, Homo Sapiens
YLLRANCDL

SEQ ID NO: 296295 - protein, 9 aa, Homo Sapiens
SKRFCFDDS

SEQ ID NO: 296296 - protein, 9 aa, Homo Sapiens
SEDGTGGQP

SEQ ID NO: 296297 - protein, 9 aa, Homo Sapiens
DLNVRINHL

SEQ ID NO: 296298 - protein, 9 aa, Homo Sapiens
KLSKDKTNL

SEQ ID NO: 296299 - protein, 9 aa, Homo Sapiens
DTRVFVQKE

SEQ ID NO: 296300 - protein, 9 aa, Homo Sapiens
ELAATLVKC

SEQ ID NO: 296301 - protein, 9 aa, Homo Sapiens
QKVQINLQQ

SEQ ID NO: 296302 - protein, 9 aa, Homo Sapiens
QLADTSTFL

SEQ ID NO: 296303 - protein, 9 aa, Homo Sapiens
RHVTLHVNE

SEQ ID NO: 296304 - protein, 9 aa, Homo Sapiens
TCGSPVIGC

SEQ ID NO: 296305 - protein, 9 aa, Homo Sapiens
LSKDKTNLS

SEQ ID NO: 296306 - protein, 9 aa, Homo Sapiens
TITTDQRAR

SEQ ID NO: 296307 - protein, 9 aa, Homo Sapiens
SRTLHINEY

SEQ ID NO: 296308 - protein, 9 aa, Homo Sapiens
ENLQAQIRH

SEQ ID NO: 296309 - protein, 9 aa, Homo Sapiens
RLHMHLIQH

SEQ ID NO: 296310 - protein, 9 aa, Homo Sapiens
DKTNLSAQV

SEQ ID NO: 296311 - protein, 9 aa, Homo Sapiens
SINDGNIQI

SEQ ID NO: 296312 - protein, 9 aa, Homo Sapiens
SRSWKLILA

SEQ ID NO: 296313 - protein, 9 aa, Homo Sapiens
KLIQNHFVD

SEQ ID NO: 296314 - protein, 9 aa, Homo Sapiens
TASVIIAFY

SEQ ID NO: 296315 - protein, 9 aa, Homo Sapiens
TTATAGIMT

SEQ ID NO: 296316 - protein, 9 aa, Homo Sapiens
PVYNWSPQI

SEQ ID NO: 296317 - protein, 9 aa, Homo Sapiens
EIPTYNIRR

SEQ ID NO: 296318 - protein, 9 aa, Homo Sapiens
MGHEFIPTL

SEQ ID NO: 296319 - protein, 9 aa, Homo Sapiens
NKKLWKKTP

SEQ ID NO: 296320 - protein, 9 aa, Homo Sapiens
DLQISTKPR

SEQ ID NO: 296321 - protein, 9 aa, Homo Sapiens
SMSINLSMS

SEQ ID NO: 296322 - protein, 9 aa, Homo Sapiens
SLSRALFKR

SEQ ID NO: 296323 - protein, 9 aa, Homo Sapiens
ATMSNLVPP

SEQ ID NO: 296324 - protein, 9 aa, Homo Sapiens
ESGHNKLSN

SEQ ID NO: 296325 - protein, 9 aa, Homo Sapiens
GELVRKLGA

SEQ ID NO: 296326 - protein, 9 aa, Homo Sapiens
GVFSFIDPL

SEQ ID NO: 296327 - protein, 9 aa, Homo Sapiens
KSFNCSSDI

SEQ ID NO: 296328 - protein, 9 aa, Homo Sapiens
AVKRTITQN

SEQ ID NO: 296329 - protein, 9 aa, Homo Sapiens
TSGSLSSKM

SEQ ID NO: 296330 - protein, 9 aa, Homo Sapiens
HCLIKKCLS

SEQ ID NO: 296331 - protein, 9 aa, Homo Sapiens
FVGARHSKH

SEQ ID NO: 296332 - protein, 9 aa, Homo Sapiens
KRKTVTDMD

SEQ ID NO: 296333 - protein, 9 aa, Homo Sapiens
QILWKGKNI

SEQ ID NO: 296334 - protein, 9 aa, Homo Sapiens
TELEIKRRS

SEQ ID NO: 296335 - protein, 9 aa, Homo Sapiens
AGQIFQQKM

SEQ ID NO: 296336 - protein, 9 aa, Homo Sapiens
PKQEDSKIK

SEQ ID NO: 296337 - protein, 9 aa, Homo Sapiens
NRVYSNTVQ

SEQ ID NO: 296338 - protein, 9 aa, Homo Sapiens
NSSEEELFD

SEQ ID NO: 296339 - protein, 9 aa, Homo Sapiens
QLFSSVSCA

SEQ ID NO: 296340 - protein, 9 aa, Homo Sapiens
SGVFTSAQA

SEQ ID NO: 296341 - protein, 9 aa, Homo Sapiens
NIIKISKSS

SEQ ID NO: 296342 - protein, 9 aa, Homo Sapiens
KNVTSGTVI

SEQ ID NO: 296343 - protein, 9 aa, Homo Sapiens
IIIVTIIQM

SEQ ID NO: 296344 - protein, 9 aa, Homo Sapiens
VLFSRRTST

SEQ ID NO: 296345 - protein, 9 aa, Homo Sapiens
GALEVKLNG

SEQ ID NO: 296346 - protein, 9 aa, Homo Sapiens
LLSYGASIN

SEQ ID NO: 296347 - protein, 9 aa, Homo Sapiens
QTEGKGQET

SEQ ID NO: 296348 - protein, 9 aa, Homo Sapiens
KKELLIHNN

SEQ ID NO: 296349 - protein, 9 aa, Homo Sapiens
NKIFGYNKN

SEQ ID NO: 296350 - protein, 9 aa, Homo Sapiens
NIEPSSGQL

SEQ ID NO: 296351 - protein, 9 aa, Homo Sapiens
PSVSSYFLF

SEQ ID NO: 296352 - protein, 9 aa, Homo Sapiens
GSRESASSR

SEQ ID NO: 296353 - protein, 9 aa, Homo Sapiens
SRQWQLGVA

SEQ ID NO: 296354 - protein, 9 aa, Homo Sapiens
VEQLQKICD

SEQ ID NO: 296355 - protein, 9 aa, Homo Sapiens
DKASTYLPG

SEQ ID NO: 296356 - protein, 9 aa, Homo Sapiens
HSLSSGQSF

SEQ ID NO: 296357 - protein, 9 aa, Homo Sapiens
PVRASPSQG

SEQ ID NO: 296358 - protein, 9 aa, Homo Sapiens
QYQFIYMAV

SEQ ID NO: 296359 - protein, 9 aa, Homo Sapiens
VVLAVKELS

SEQ ID NO: 296360 - protein, 9 aa, Homo Sapiens
LVSAMEELV

SEQ ID NO: 296361 - protein, 9 aa, Homo Sapiens
YNKLLEKAF

SEQ ID NO: 296362 - protein, 9 aa, Homo Sapiens
TLLFMYVQT

SEQ ID NO: 296363 - protein, 9 aa, Homo Sapiens
NNEKTGIVL

SEQ ID NO: 296364 - protein, 9 aa, Homo Sapiens
ASVVYTVVI

SEQ ID NO: 296365 - protein, 9 aa, Homo Sapiens
IERVCIGAD

SEQ ID NO: 296366 - protein, 9 aa, Homo Sapiens
QKREINITK

SEQ ID NO: 296367 - protein, 9 aa, Homo Sapiens
NQISILYLS

SEQ ID NO: 296368 - protein, 9 aa, Homo Sapiens
SLTETEVDH

SEQ ID NO: 296369 - protein, 9 aa, Homo Sapiens
LYLFYNFEY

SEQ ID NO: 296370 - protein, 9 aa, Homo Sapiens
QLPMLLKNF

SEQ ID NO: 296371 - protein, 9 aa, Homo Sapiens
QQQSPVNKE

SEQ ID NO: 296372 - protein, 9 aa, Homo Sapiens
VAKVHTAKE

SEQ ID NO: 296373 - protein, 9 aa, Homo Sapiens
GIMFIVSGI

SEQ ID NO: 296374 - protein, 9 aa, Homo Sapiens
VGKDLSLVL

SEQ ID NO: 296375 - protein, 9 aa, Homo Sapiens
NIWNIETAT

SEQ ID NO: 296376 - protein, 9 aa, Homo Sapiens
AVAMYVAGF

SEQ ID NO: 296377 - protein, 9 aa, Homo Sapiens
ELPKCLQDL

SEQ ID NO: 296378 - protein, 9 aa, Homo Sapiens
MGNNSVSYE

SEQ ID NO: 296379 - protein, 9 aa, Homo Sapiens
RNFDEDVGK

SEQ ID NO: 296380 - protein, 9 aa, Homo Sapiens
SSVDLKTRC

SEQ ID NO: 296381 - protein, 9 aa, Homo Sapiens
LAVSSRGDN

SEQ ID NO: 296382 - protein, 9 aa, Homo Sapiens
KDNLLSCKM

SEQ ID NO: 296383 - protein, 9 aa, Homo Sapiens
DKIWEELSV

SEQ ID NO: 296384 - protein, 9 aa, Homo Sapiens
EAPLQVAQE

SEQ ID NO: 296385 - protein, 9 aa, Homo Sapiens
AKDMCKIRC

SEQ ID NO: 296386 - protein, 9 aa, Homo Sapiens
FHKVTYKSL

SEQ ID NO: 296387 - protein, 9 aa, Homo Sapiens
AKEGGLFGF

SEQ ID NO: 296388 - protein, 9 aa, Homo Sapiens
SLNELTSKS

SEQ ID NO: 296389 - protein, 9 aa, Homo Sapiens
GTVYPANLL

SEQ ID NO: 296390 - protein, 9 aa, Homo Sapiens
QLFCVRLRK

SEQ ID NO: 296391 - protein, 9 aa, Homo Sapiens
PQPLSSPGV

SEQ ID NO: 296392 - protein, 9 aa, Homo Sapiens
SNIFEMLVI

SEQ ID NO: 296393 - protein, 9 aa, Homo Sapiens
GFKQLSCLI

SEQ ID NO: 296394 - protein, 9 aa, Homo Sapiens
DIERGSRES

SEQ ID NO: 296395 - protein, 9 aa, Homo Sapiens
GGQIPNTLL

SEQ ID NO: 296396 - protein, 9 aa, Homo Sapiens
EGEAIPWQR

SEQ ID NO: 296397 - protein, 9 aa, Homo Sapiens
HFLICVKSW

SEQ ID NO: 296398 - protein, 9 aa, Homo Sapiens
NSRPCKRTA

SEQ ID NO: 296399 - protein, 9 aa, Homo Sapiens
GAFSKVVLA

SEQ ID NO: 296400 - protein, 9 aa, Homo Sapiens
NKPFQKEEA

SEQ ID NO: 296401 - protein, 9 aa, Homo Sapiens
ATITIVEVI

SEQ ID NO: 296402 - protein, 9 aa, Homo Sapiens
RKEEHQAYL

SEQ ID NO: 296403 - protein, 9 aa, Homo Sapiens
ETDLSIQCQ

SEQ ID NO: 296404 - protein, 9 aa, Homo Sapiens
PIKYSEVQI

SEQ ID NO: 296405 - protein, 9 aa, Homo Sapiens
IVEVKKPKS

SEQ ID NO: 296406 - protein, 9 aa, Homo Sapiens
KHIQLKKEI

SEQ ID NO: 296407 - protein, 9 aa, Homo Sapiens
KYYSMFEDD

SEQ ID NO: 296408 - protein, 9 aa, Homo Sapiens
NEPTEGSII

SEQ ID NO: 296409 - protein, 9 aa, Homo Sapiens
NQQLPVATD

SEQ ID NO: 296410 - protein, 9 aa, Homo Sapiens
YLINNCSET

SEQ ID NO: 296411 - protein, 9 aa, Homo Sapiens
SIETANVRE

SEQ ID NO: 296412 - protein, 9 aa, Homo Sapiens
NQFLRCYNK

SEQ ID NO: 296413 - protein, 9 aa, Homo Sapiens
IIVKAQKCL

SEQ ID NO: 296414 - protein, 9 aa, Homo Sapiens
DKYNVPILS

SEQ ID NO: 296415 - protein, 9 aa, Homo Sapiens
VRQFWFLMY

SEQ ID NO: 296416 - protein, 9 aa, Homo Sapiens
ELGRVYVSV

SEQ ID NO: 296417 - protein, 9 aa, Homo Sapiens
LFSATADAA

SEQ ID NO: 296418 - protein, 9 aa, Homo Sapiens
GSPTNDIEA

SEQ ID NO: 296419 - protein, 9 aa, Homo Sapiens
KKITDLTGA

SEQ ID NO: 296420 - protein, 9 aa, Homo Sapiens
IIRHKALLE

SEQ ID NO: 296421 - protein, 9 aa, Homo Sapiens
LVMALDRYV

SEQ ID NO: 296422 - protein, 9 aa, Homo Sapiens
KDFTQNSNL

SEQ ID NO: 296423 - protein, 9 aa, Homo Sapiens
DISALTDFS

SEQ ID NO: 296424 - protein, 9 aa, Homo Sapiens
RTPDKLKKE

SEQ ID NO: 296425 - protein, 9 aa, Homo Sapiens
DQKLEGGKQ

SEQ ID NO: 296426 - protein, 9 aa, Homo Sapiens
ALVINTLPT

SEQ ID NO: 296427 - protein, 9 aa, Homo Sapiens
PAWCDQILW

SEQ ID NO: 296428 - protein, 9 aa, Homo Sapiens
LEILQKAIT

SEQ ID NO: 296429 - protein, 9 aa, Homo Sapiens
DDDYVKLKV

SEQ ID NO: 296430 - protein, 9 aa, Homo Sapiens
IRYASVECL

SEQ ID NO: 296431 - protein, 9 aa, Homo Sapiens
DDHRYKLCD

SEQ ID NO: 296432 - protein, 9 aa, Homo Sapiens
NIYQRNAPD

SEQ ID NO: 296433 - protein, 9 aa, Homo Sapiens
LLKEGFRLV

SEQ ID NO: 296434 - protein, 9 aa, Homo Sapiens
KHREVCKVK

SEQ ID NO: 296435 - protein, 9 aa, Homo Sapiens
RGPSSGYCI

SEQ ID NO: 296436 - protein, 9 aa, Homo Sapiens
LPHEFPKST

SEQ ID NO: 296437 - protein, 9 aa, Homo Sapiens
GPAIIRHKA

SEQ ID NO: 296438 - protein, 9 aa, Homo Sapiens
GNPLTVECT

SEQ ID NO: 296439 - protein, 9 aa, Homo Sapiens
PQRHLTLSI

SEQ ID NO: 296440 - protein, 9 aa, Homo Sapiens
FFQKLINKH

SEQ ID NO: 296441 - protein, 9 aa, Homo Sapiens
LAFEFEGMG

SEQ ID NO: 296442 - protein, 9 aa, Homo Sapiens
WDTVKDKSA

SEQ ID NO: 296443 - protein, 9 aa, Homo Sapiens
DFYRELGLP

SEQ ID NO: 296444 - protein, 9 aa, Homo Sapiens
CQEYTDLQK

SEQ ID NO: 296445 - protein, 9 aa, Homo Sapiens
NEGKQTKRG

SEQ ID NO: 296446 - protein, 9 aa, Homo Sapiens
KGCTTTNYP

SEQ ID NO: 296447 - protein, 9 aa, Homo Sapiens
QQPTDKVLA

SEQ ID NO: 296448 - protein, 9 aa, Homo Sapiens
RLLWTACKT

SEQ ID NO: 296449 - protein, 9 aa, Homo Sapiens
WYLKGLQDG

SEQ ID NO: 296450 - protein, 9 aa, Homo Sapiens
QYFNQMETI

SEQ ID NO: 296451 - protein, 9 aa, Homo Sapiens
GSKANYIKQ

SEQ ID NO: 296452 - protein, 9 aa, Homo Sapiens
QCVQNKPFQ

SEQ ID NO: 296453 - protein, 9 aa, Homo Sapiens
GIPRTNQYW

SEQ ID NO: 296454 - protein, 9 aa, Homo Sapiens
YLHNQNGSE

SEQ ID NO: 296455 - protein, 9 aa, Homo Sapiens
KEIMRPVKA

SEQ ID NO: 296456 - protein, 9 aa, Homo Sapiens
YNFRLHRKV

SEQ ID NO: 296457 - protein, 9 aa, Homo Sapiens
SMEHLNHYI

SEQ ID NO: 296458 - protein, 9 aa, Homo Sapiens
LTPQKVDFW

SEQ ID NO: 296459 - protein, 9 aa, Homo Sapiens
KRENNNLQQ

SEQ ID NO: 296460 - protein, 9 aa, Homo Sapiens
NKNRERFCN

SEQ ID NO: 296461 - protein, 9 aa, Homo Sapiens
VCGKAFSHH

SEQ ID NO: 296462 - protein, 9 aa, Homo Sapiens
EIRGTLDLR

SEQ ID NO: 296463 - protein, 9 aa, Homo Sapiens
TLKKIIVEA

SEQ ID NO: 296464 - protein, 9 aa, Homo Sapiens
GLCVKNPMV

SEQ ID NO: 296465 - protein, 9 aa, Homo Sapiens
VGMVGSLPV

SEQ ID NO: 296466 - protein, 9 aa, Homo Sapiens
GLGLRVQAE

SEQ ID NO: 296467 - protein, 9 aa, Homo Sapiens
GIRYFDLQI

SEQ ID NO: 296468 - protein, 9 aa, Homo Sapiens
SNTNSPTNI

SEQ ID NO: 296469 - protein, 9 aa, Homo Sapiens
PFAAGPQPP

SEQ ID NO: 296470 - protein, 9 aa, Homo Sapiens
ECTKLIIQA

SEQ ID NO: 296471 - protein, 9 aa, Homo Sapiens
FIRITSLLQ

SEQ ID NO: 296472 - protein, 9 aa, Homo Sapiens
TAKVLYLLE

SEQ ID NO: 296473 - protein, 9 aa, Homo Sapiens
PINKKQPCV

SEQ ID NO: 296474 - protein, 9 aa, Homo Sapiens
GLAGLPGKK

SEQ ID NO: 296475 - protein, 9 aa, Homo Sapiens
ISMLLVKDK

SEQ ID NO: 296476 - protein, 9 aa, Homo Sapiens
SLVICEDGN

SEQ ID NO: 296477 - protein, 9 aa, Homo Sapiens
CILCLFGYL

SEQ ID NO: 296478 - protein, 9 aa, Homo Sapiens
QELICTGSR

SEQ ID NO: 296479 - protein, 9 aa, Homo Sapiens
EFKELIYLV

SEQ ID NO: 296480 - protein, 9 aa, Homo Sapiens
NAWNTSTSY

SEQ ID NO: 296481 - protein, 9 aa, Homo Sapiens
QPSVIQKLE

SEQ ID NO: 296482 - protein, 9 aa, Homo Sapiens
VTGSLIFRA

SEQ ID NO: 296483 - protein, 9 aa, Homo Sapiens
LTFYKEFMA

SEQ ID NO: 296484 - protein, 9 aa, Homo Sapiens
CRDAVFMQF

SEQ ID NO: 296485 - protein, 9 aa, Homo Sapiens
NSINSCYPK

SEQ ID NO: 296486 - protein, 9 aa, Homo Sapiens
LSDYFLLIE

SEQ ID NO: 296487 - protein, 9 aa, Homo Sapiens
FYKTAEEKD

SEQ ID NO: 296488 - protein, 9 aa, Homo Sapiens
NNKLYQPDG

SEQ ID NO: 296489 - protein, 9 aa, Homo Sapiens
KQTETAELP

SEQ ID NO: 296490 - protein, 9 aa, Homo Sapiens
CLVCVFLIM

SEQ ID NO: 296491 - protein, 9 aa, Homo Sapiens
SKHKSDKTS

SEQ ID NO: 296492 - protein, 9 aa, Homo Sapiens
QAHLRDSGI

SEQ ID NO: 296493 - protein, 9 aa, Homo Sapiens
ITSSHHSKH

SEQ ID NO: 296494 - protein, 9 aa, Homo Sapiens
EQEIIRREK

SEQ ID NO: 296495 - protein, 9 aa, Homo Sapiens
EGLKYVDTR

SEQ ID NO: 296496 - protein, 9 aa, Homo Sapiens
LHLPSFYAH

SEQ ID NO: 296497 - protein, 9 aa, Homo Sapiens
AALAYGLDT

SEQ ID NO: 296498 - protein, 9 aa, Homo Sapiens
RVYAQNLIN

SEQ ID NO: 296499 - protein, 9 aa, Homo Sapiens
ICAIAGVSV

SEQ ID NO: 296500 - protein, 9 aa, Homo Sapiens
LSQTAQRSA

SEQ ID NO: 296501 - protein, 9 aa, Homo Sapiens
GCWYCRRQN

SEQ ID NO: 296502 - protein, 9 aa, Homo Sapiens
KTYAHFVDV

SEQ ID NO: 296503 - protein, 9 aa, Homo Sapiens
KIRPCPTSE

SEQ ID NO: 296504 - protein, 9 aa, Homo Sapiens
LGALLQRCT

SEQ ID NO: 296505 - protein, 9 aa, Homo Sapiens
GSINTMPPK

SEQ ID NO: 296506 - protein, 9 aa, Homo Sapiens
EIMSSTNMM

SEQ ID NO: 296507 - protein, 9 aa, Homo Sapiens
MAMGKLHKK

SEQ ID NO: 296508 - protein, 9 aa, Homo Sapiens
IVPAGDQRT

SEQ ID NO: 296509 - protein, 9 aa, Homo Sapiens
CRKEKTTKG

SEQ ID NO: 296510 - protein, 9 aa, Homo Sapiens
QIGGRLLMR

SEQ ID NO: 296511 - protein, 9 aa, Homo Sapiens
GVVWCNLSA

SEQ ID NO: 296512 - protein, 9 aa, Homo Sapiens
QRCTAPGLA

SEQ ID NO: 296513 - protein, 9 aa, Homo Sapiens
EDNEVYVLG

SEQ ID NO: 296514 - protein, 9 aa, Homo Sapiens
GNIRELYKF

SEQ ID NO: 296515 - protein, 9 aa, Homo Sapiens
QGYIINSDQ

SEQ ID NO: 296516 - protein, 9 aa, Homo Sapiens
STQIIVQGR

SEQ ID NO: 296517 - protein, 9 aa, Homo Sapiens
TLKLLDRET

SEQ ID NO: 296518 - protein, 9 aa, Homo Sapiens
GKCRHHSHS

SEQ ID NO: 296519 - protein, 9 aa, Homo Sapiens
FVETQNMQR

SEQ ID NO: 296520 - protein, 9 aa, Homo Sapiens
SFSTDSWLD

SEQ ID NO: 296521 - protein, 9 aa, Homo Sapiens
RENNNLQQE

SEQ ID NO: 296522 - protein, 9 aa, Homo Sapiens
CFVCAKCSK

SEQ ID NO: 296523 - protein, 9 aa, Homo Sapiens
LLLFLPEEE

SEQ ID NO: 296524 - protein, 9 aa, Homo Sapiens
GQPPPHSLA

SEQ ID NO: 296525 - protein, 9 aa, Homo Sapiens
ADDKKEEFD

SEQ ID NO: 296526 - protein, 9 aa, Homo Sapiens
REYKCDVSS

SEQ ID NO: 296527 - protein, 9 aa, Homo Sapiens
FSVLCEIKD

SEQ ID NO: 296528 - protein, 9 aa, Homo Sapiens
TVVGNLSLI

SEQ ID NO: 296529 - protein, 9 aa, Homo Sapiens
TLLNKHGPT

SEQ ID NO: 296530 - protein, 9 aa, Homo Sapiens
ILLKNQAVQ

SEQ ID NO: 296531 - protein, 9 aa, Homo Sapiens
SLGTQIAYI

SEQ ID NO: 296532 - protein, 9 aa, Homo Sapiens
ELEKESRII

SEQ ID NO: 296533 - protein, 9 aa, Homo Sapiens
DRIDSLQQT

SEQ ID NO: 296534 - protein, 9 aa, Homo Sapiens
PNVQHLSDP

SEQ ID NO: 296535 - protein, 9 aa, Homo Sapiens
RLFDSHRRP

SEQ ID NO: 296536 - protein, 9 aa, Homo Sapiens
DNSSRRVSE

SEQ ID NO: 296537 - protein, 9 aa, Homo Sapiens
GMAPMLSDT

SEQ ID NO: 296538 - protein, 9 aa, Homo Sapiens
PQLGEDELS

SEQ ID NO: 296539 - protein, 9 aa, Homo Sapiens
SLTQTHWEK

SEQ ID NO: 296540 - protein, 9 aa, Homo Sapiens
HEMKCKNCV

SEQ ID NO: 296541 - protein, 9 aa, Homo Sapiens
KTPKLCETP

SEQ ID NO: 296542 - protein, 9 aa, Homo Sapiens
MNKGYRHIP

SEQ ID NO: 296543 - protein, 9 aa, Homo Sapiens
LPRLLTMVM

SEQ ID NO: 296544 - protein, 9 aa, Homo Sapiens
INHLVHLPE

SEQ ID NO: 296545 - protein, 9 aa, Homo Sapiens
RSRGFCFVT

SEQ ID NO: 296546 - protein, 9 aa, Homo Sapiens
QAASASFPK

SEQ ID NO: 296547 - protein, 9 aa, Homo Sapiens
MEDIETILH

SEQ ID NO: 296548 - protein, 9 aa, Homo Sapiens
PRTSRQAQS

SEQ ID NO: 296549 - protein, 9 aa, Homo Sapiens
CRTKASPYT

SEQ ID NO: 296550 - protein, 9 aa, Homo Sapiens
LFEEADFSP

SEQ ID NO: 296551 - protein, 9 aa, Homo Sapiens
TNSMNNNES

SEQ ID NO: 296552 - protein, 9 aa, Homo Sapiens
SFRKVISYR

SEQ ID NO: 296553 - protein, 9 aa, Homo Sapiens
TKVTQQDVK

SEQ ID NO: 296554 - protein, 9 aa, Homo Sapiens
ETMTMTEKV

SEQ ID NO: 296555 - protein, 9 aa, Homo Sapiens
WRRKQMLDI

SEQ ID NO: 296556 - protein, 9 aa, Homo Sapiens
LILQVPVAV

SEQ ID NO: 296557 - protein, 9 aa, Homo Sapiens
QEEYKNYLR

SEQ ID NO: 296558 - protein, 9 aa, Homo Sapiens
SYPRLSTPG

SEQ ID NO: 296559 - protein, 9 aa, Homo Sapiens
IFIIIHWAA

SEQ ID NO: 296560 - protein, 9 aa, Homo Sapiens
QSTPCAFNV

SEQ ID NO: 296561 - protein, 9 aa, Homo Sapiens
SKILRLPCT

SEQ ID NO: 296562 - protein, 9 aa, Homo Sapiens
ADDLFTSLG

SEQ ID NO: 296563 - protein, 9 aa, Homo Sapiens
FGASQGYFP

SEQ ID NO: 296564 - protein, 9 aa, Homo Sapiens
KDDVHHLSV

SEQ ID NO: 296565 - protein, 9 aa, Homo Sapiens
GLLYEYLET

SEQ ID NO: 296566 - protein, 9 aa, Homo Sapiens
KFHNRTFLK

SEQ ID NO: 296567 - protein, 9 aa, Homo Sapiens
NEPFTIPED

SEQ ID NO: 296568 - protein, 9 aa, Homo Sapiens
FISVYDKEF

SEQ ID NO: 296569 - protein, 9 aa, Homo Sapiens
IMECSAPLP

SEQ ID NO: 296570 - protein, 9 aa, Homo Sapiens
PNTLLPEGF

SEQ ID NO: 296571 - protein, 9 aa, Homo Sapiens
ILFINLTLP

SEQ ID NO: 296572 - protein, 9 aa, Homo Sapiens
EFSERKSSE

SEQ ID NO: 296573 - protein, 9 aa, Homo Sapiens
GRYVCENCK

SEQ ID NO: 296574 - protein, 9 aa, Homo Sapiens
VHQRTHTGD

SEQ ID NO: 296575 - protein, 9 aa, Homo Sapiens
THTGDKPYN

SEQ ID NO: 296576 - protein, 9 aa, Homo Sapiens
NRTYAGQCP

SEQ ID NO: 296577 - protein, 9 aa, Homo Sapiens
KCTTDKQPR

SEQ ID NO: 296578 - protein, 9 aa, Homo Sapiens
TLESGLTNG

SEQ ID NO: 296579 - protein, 9 aa, Homo Sapiens
TLASTSVDL

SEQ ID NO: 296580 - protein, 9 aa, Homo Sapiens
KQEEETHIQ

SEQ ID NO: 296581 - protein, 9 aa, Homo Sapiens
IIFRTLNHQ

SEQ ID NO: 296582 - protein, 9 aa, Homo Sapiens
QVIVEFTKK

SEQ ID NO: 296583 - protein, 9 aa, Homo Sapiens
NSPGSTDTT

SEQ ID NO: 296584 - protein, 9 aa, Homo Sapiens
LAYGLDTSE

SEQ ID NO: 296585 - protein, 9 aa, Homo Sapiens
RMQQQTTVL

SEQ ID NO: 296586 - protein, 9 aa, Homo Sapiens
AYIHRASLL

SEQ ID NO: 296587 - protein, 9 aa, Homo Sapiens
NKVEELNKK

SEQ ID NO: 296588 - protein, 9 aa, Homo Sapiens
QKQMKYSAV

SEQ ID NO: 296589 - protein, 9 aa, Homo Sapiens
RLVASGADK

SEQ ID NO: 296590 - protein, 9 aa, Homo Sapiens
PLCMQSRRP

SEQ ID NO: 296591 - protein, 9 aa, Homo Sapiens
QKRLIQRRW

SEQ ID NO: 296592 - protein, 9 aa, Homo Sapiens
EREAKKSAE

SEQ ID NO: 296593 - protein, 9 aa, Homo Sapiens
FTCEECGKR

SEQ ID NO: 296594 - protein, 9 aa, Homo Sapiens
PRQASISCV

SEQ ID NO: 296595 - protein, 9 aa, Homo Sapiens
EDGRLRVNY

SEQ ID NO: 296596 - protein, 9 aa, Homo Sapiens
PKSYSKDLE

SEQ ID NO: 296597 - protein, 9 aa, Homo Sapiens
EINLESQIK

SEQ ID NO: 296598 - protein, 9 aa, Homo Sapiens
LSNHHTLLD

SEQ ID NO: 296599 - protein, 9 aa, Homo Sapiens
AIDAVPHVT

SEQ ID NO: 296600 - protein, 9 aa, Homo Sapiens
CQELLYPKD

SEQ ID NO: 296601 - protein, 9 aa, Homo Sapiens
LFLVVSINE

SEQ ID NO: 296602 - protein, 9 aa, Homo Sapiens
DKCTTDKQP

SEQ ID NO: 296603 - protein, 9 aa, Homo Sapiens
TIASAICEE

SEQ ID NO: 296604 - protein, 9 aa, Homo Sapiens
AKTTLIKRD

SEQ ID NO: 296605 - protein, 9 aa, Homo Sapiens
QHFKITGTG

SEQ ID NO: 296606 - protein, 9 aa, Homo Sapiens
KVNTGDKND

SEQ ID NO: 296607 - protein, 9 aa, Homo Sapiens
YCRVTAPHP

SEQ ID NO: 296608 - protein, 9 aa, Homo Sapiens
QVRLEPIRC

SEQ ID NO: 296609 - protein, 9 aa, Homo Sapiens
SASNADEAG

SEQ ID NO: 296610 - protein, 9 aa, Homo Sapiens
NTIDADINV

SEQ ID NO: 296611 - protein, 9 aa, Homo Sapiens
APKVPQQTH

SEQ ID NO: 296612 - protein, 9 aa, Homo Sapiens
PKGRPKNNS

SEQ ID NO: 296613 - protein, 9 aa, Homo Sapiens
GRDLNDKIQ

SEQ ID NO: 296614 - protein, 9 aa, Homo Sapiens
LSLASHLST

SEQ ID NO: 296615 - protein, 9 aa, Homo Sapiens
TSLPNYATH

SEQ ID NO: 296616 - protein, 9 aa, Homo Sapiens
IADHYMFLK

SEQ ID NO: 296617 - protein, 9 aa, Homo Sapiens
VTRKQGSTT

SEQ ID NO: 296618 - protein, 9 aa, Homo Sapiens
KSLGTTQDF

SEQ ID NO: 296619 - protein, 9 aa, Homo Sapiens
IYKKIEDLI

SEQ ID NO: 296620 - protein, 9 aa, Homo Sapiens
EQEQQRHTA

SEQ ID NO: 296621 - protein, 9 aa, Homo Sapiens
NCAHQASVA

SEQ ID NO: 296622 - protein, 9 aa, Homo Sapiens
RLPLQWVDL

SEQ ID NO: 296623 - protein, 9 aa, Homo Sapiens
RNEGISAQQ

SEQ ID NO: 296624 - protein, 9 aa, Homo Sapiens
ASVGSSPQR

SEQ ID NO: 296625 - protein, 9 aa, Homo Sapiens
ALHKIMALL

SEQ ID NO: 296626 - protein, 9 aa, Homo Sapiens
QDAGELVRK

SEQ ID NO: 296627 - protein, 9 aa, Homo Sapiens
TGEEVWNPQ

SEQ ID NO: 296628 - protein, 9 aa, Homo Sapiens
NLAKVIHET

SEQ ID NO: 296629 - protein, 9 aa, Homo Sapiens
VQIWKAPQA

SEQ ID NO: 296630 - protein, 9 aa, Homo Sapiens
RNAFNTSPG

SEQ ID NO: 296631 - protein, 9 aa, Homo Sapiens
LRQLFRIIF

SEQ ID NO: 296632 - protein, 9 aa, Homo Sapiens
CLMKGKGQE

SEQ ID NO: 296633 - protein, 9 aa, Homo Sapiens
RLLTMVMVT

SEQ ID NO: 296634 - protein, 9 aa, Homo Sapiens
DYHVTIRKK

SEQ ID NO: 296635 - protein, 9 aa, Homo Sapiens
DAHVIKRHR

SEQ ID NO: 296636 - protein, 9 aa, Homo Sapiens
SLNFGIMPD

SEQ ID NO: 296637 - protein, 9 aa, Homo Sapiens
DKTPIETLI

SEQ ID NO: 296638 - protein, 9 aa, Homo Sapiens
WCTFEGCGK

SEQ ID NO: 296639 - protein, 9 aa, Homo Sapiens
LQQVWQQLK

SEQ ID NO: 296640 - protein, 9 aa, Homo Sapiens
MICILCLFG

SEQ ID NO: 296641 - protein, 9 aa, Homo Sapiens
QQEAELARM

SEQ ID NO: 296642 - protein, 9 aa, Homo Sapiens
LESAWANRV

SEQ ID NO: 296643 - protein, 9 aa, Homo Sapiens
LHLCDSNII

SEQ ID NO: 296644 - protein, 9 aa, Homo Sapiens
KFNPQIFKK

SEQ ID NO: 296645 - protein, 9 aa, Homo Sapiens
NKLREENTF

SEQ ID NO: 296646 - protein, 9 aa, Homo Sapiens
STLLSLHNM

SEQ ID NO: 296647 - protein, 9 aa, Homo Sapiens
CLYQLCKKS

SEQ ID NO: 296648 - protein, 9 aa, Homo Sapiens
FLNKPAIKD

SEQ ID NO: 296649 - protein, 9 aa, Homo Sapiens
LPNKEFKDK

SEQ ID NO: 296650 - protein, 9 aa, Homo Sapiens
GTLNILEED

SEQ ID NO: 296651 - protein, 9 aa, Homo Sapiens
KKDGTEVRC

SEQ ID NO: 296652 - protein, 9 aa, Homo Sapiens
VQERVISVL

SEQ ID NO: 296653 - protein, 9 aa, Homo Sapiens
GKEKDLMNA

SEQ ID NO: 296654 - protein, 9 aa, Homo Sapiens
WKSHKDVDE

SEQ ID NO: 296655 - protein, 9 aa, Homo Sapiens
EKDREKDKD

SEQ ID NO: 296656 - protein, 9 aa, Homo Sapiens
ANRVRYMVV

SEQ ID NO: 296657 - protein, 9 aa, Homo Sapiens
YFLFGSSAV

SEQ ID NO: 296658 - protein, 9 aa, Homo Sapiens
ENVQSEERS

SEQ ID NO: 296659 - protein, 9 aa, Homo Sapiens
SPSHLSTDD

SEQ ID NO: 296660 - protein, 9 aa, Homo Sapiens
EMKDVIGDR

SEQ ID NO: 296661 - protein, 9 aa, Homo Sapiens
PQMNNFNIK

SEQ ID NO: 296662 - protein, 9 aa, Homo Sapiens
EDFVSSTRN

SEQ ID NO: 296663 - protein, 9 aa, Homo Sapiens
SRQPYRVKA

SEQ ID NO: 296664 - protein, 9 aa, Homo Sapiens
NILSTSTIG

SEQ ID NO: 296665 - protein, 9 aa, Homo Sapiens
QDVKDNTKR

SEQ ID NO: 296666 - protein, 9 aa, Homo Sapiens
PLSEKMQYA

SEQ ID NO: 296667 - protein, 9 aa, Homo Sapiens
LRYQIIMTP

SEQ ID NO: 296668 - protein, 9 aa, Homo Sapiens
KVWFQEAEE

SEQ ID NO: 296669 - protein, 9 aa, Homo Sapiens
VVTLHDIVH

SEQ ID NO: 296670 - protein, 9 aa, Homo Sapiens
MKRFVKYLG

SEQ ID NO: 296671 - protein, 9 aa, Homo Sapiens
ALLQRCTAP

SEQ ID NO: 296672 - protein, 9 aa, Homo Sapiens
PGGIALEPP

SEQ ID NO: 296673 - protein, 9 aa, Homo Sapiens
PHVAQDIWP

SEQ ID NO: 296674 - protein, 9 aa, Homo Sapiens
EEQSLKLDY

SEQ ID NO: 296675 - protein, 9 aa, Homo Sapiens
LLMVLEKII

SEQ ID NO: 296676 - protein, 9 aa, Homo Sapiens
EIGAQPLCI

SEQ ID NO: 296677 - protein, 9 aa, Homo Sapiens
CPVKLYEFY

SEQ ID NO: 296678 - protein, 9 aa, Homo Sapiens
SSVWGRGIT

SEQ ID NO: 296679 - protein, 9 aa, Homo Sapiens
YVYVLSLLG

SEQ ID NO: 296680 - protein, 9 aa, Homo Sapiens
IVYFIAVDD

SEQ ID NO: 296681 - protein, 9 aa, Homo Sapiens
RLCQQLVGP

SEQ ID NO: 296682 - protein, 9 aa, Homo Sapiens
IINHFLCDI

SEQ ID NO: 296683 - protein, 9 aa, Homo Sapiens
KEVVKENAA

SEQ ID NO: 296684 - protein, 9 aa, Homo Sapiens
KAFSHHQSL

SEQ ID NO: 296685 - protein, 9 aa, Homo Sapiens
LIQHKITHT

SEQ ID NO: 296686 - protein, 9 aa, Homo Sapiens
ICPHVAQDI

SEQ ID NO: 296687 - protein, 9 aa, Homo Sapiens
TGLKFPSLA

SEQ ID NO: 296688 - protein, 9 aa, Homo Sapiens
DDETPLDDE

SEQ ID NO: 296689 - protein, 9 aa, Homo Sapiens
TLRYWGTMW

SEQ ID NO: 296690 - protein, 9 aa, Homo Sapiens
KFRDAETDQ

SEQ ID NO: 296691 - protein, 9 aa, Homo Sapiens
FDPKYQQRL

SEQ ID NO: 296692 - protein, 9 aa, Homo Sapiens
SSSNYQGSI

SEQ ID NO: 296693 - protein, 9 aa, Homo Sapiens
VLSVYTHGR

SEQ ID NO: 296694 - protein, 9 aa, Homo Sapiens
NGFVKLGII

SEQ ID NO: 296695 - protein, 9 aa, Homo Sapiens
YRAASHKLT

SEQ ID NO: 296696 - protein, 9 aa, Homo Sapiens
QINLPWKFE

SEQ ID NO: 296697 - protein, 9 aa, Homo Sapiens
PLPLQKELN

SEQ ID NO: 296698 - protein, 9 aa, Homo Sapiens
FTCSENQVN

SEQ ID NO: 296699 - protein, 9 aa, Homo Sapiens
QSHDIGLHV

SEQ ID NO: 296700 - protein, 9 aa, Homo Sapiens
KNQKDREAE

SEQ ID NO: 296701 - protein, 9 aa, Homo Sapiens
IKSLRVLWV

SEQ ID NO: 296702 - protein, 9 aa, Homo Sapiens
RLNTILDVV

SEQ ID NO: 296703 - protein, 9 aa, Homo Sapiens
FKEEDPSHL

SEQ ID NO: 296704 - protein, 9 aa, Homo Sapiens
IKRQEAERN

SEQ ID NO: 296705 - protein, 9 aa, Homo Sapiens
QYLTSTQSK

SEQ ID NO: 296706 - protein, 9 aa, Homo Sapiens
KDVIGDRSI

SEQ ID NO: 296707 - protein, 9 aa, Homo Sapiens
DEGYLERID

SEQ ID NO: 296708 - protein, 9 aa, Homo Sapiens
PPQPQSLAK

SEQ ID NO: 296709 - protein, 9 aa, Homo Sapiens
FEMHDKLSC

SEQ ID NO: 296710 - protein, 9 aa, Homo Sapiens
FLSGPQRLS

SEQ ID NO: 296711 - protein, 9 aa, Homo Sapiens
CPSQTCRPD

SEQ ID NO: 296712 - protein, 9 aa, Homo Sapiens
QFQRYFISL

SEQ ID NO: 296713 - protein, 9 aa, Homo Sapiens
RHMLERLYQ

SEQ ID NO: 296714 - protein, 9 aa, Homo Sapiens
DKDKDRERE

SEQ ID NO: 296715 - protein, 9 aa, Homo Sapiens
NALDIYGRT

SEQ ID NO: 296716 - protein, 9 aa, Homo Sapiens
FHYSELSGD

SEQ ID NO: 296717 - protein, 9 aa, Homo Sapiens
QTCGFDFGG

SEQ ID NO: 296718 - protein, 9 aa, Homo Sapiens
YTCEECGKS

SEQ ID NO: 296719 - protein, 9 aa, Homo Sapiens
IFQDEKNKE

SEQ ID NO: 296720 - protein, 9 aa, Homo Sapiens
RKEEDNAKQ

SEQ ID NO: 296721 - protein, 9 aa, Homo Sapiens
GSLAAESIF

SEQ ID NO: 296722 - protein, 9 aa, Homo Sapiens
MGKTRQINH

SEQ ID NO: 296723 - protein, 9 aa, Homo Sapiens
GAVVSLLAG

SEQ ID NO: 296724 - protein, 9 aa, Homo Sapiens
IRPCPTSED

SEQ ID NO: 296725 - protein, 9 aa, Homo Sapiens
VKGEKGDQG

SEQ ID NO: 296726 - protein, 9 aa, Homo Sapiens
CPNPEIPLG

SEQ ID NO: 296727 - protein, 9 aa, Homo Sapiens
SVCLSEAGA

SEQ ID NO: 296728 - protein, 9 aa, Homo Sapiens
ETRKEEKVA

SEQ ID NO: 296729 - protein, 9 aa, Homo Sapiens
VMCPSAGSG

SEQ ID NO: 296730 - protein, 9 aa, Homo Sapiens
LHDDADIVH

SEQ ID NO: 296731 - protein, 9 aa, Homo Sapiens
RGRQCPWGV

SEQ ID NO: 296732 - protein, 9 aa, Homo Sapiens
IQCQALNIA

SEQ ID NO: 296733 - protein, 9 aa, Homo Sapiens
RHRKTHTGE

SEQ ID NO: 296734 - protein, 9 aa, Homo Sapiens
TVPCSTDFW

SEQ ID NO: 296735 - protein, 9 aa, Homo Sapiens
KNQAVQGQW

SEQ ID NO: 296736 - protein, 9 aa, Homo Sapiens
QLQKDIKDL

SEQ ID NO: 296737 - protein, 9 aa, Homo Sapiens
SILMERQIR

SEQ ID NO: 296738 - protein, 9 aa, Homo Sapiens
LKKEGEQQC

SEQ ID NO: 296739 - protein, 9 aa, Homo Sapiens
DFYLLENIT

SEQ ID NO: 296740 - protein, 9 aa, Homo Sapiens
LQKHGKNVP

SEQ ID NO: 296741 - protein, 9 aa, Homo Sapiens
QINTKGEVI

SEQ ID NO: 296742 - protein, 9 aa, Homo Sapiens
SQSASSSSD

SEQ ID NO: 296743 - protein, 9 aa, Homo Sapiens
LAQDLFDRY

SEQ ID NO: 296744 - protein, 9 aa, Homo Sapiens
FVYTYIRPR

SEQ ID NO: 296745 - protein, 9 aa, Homo Sapiens
TSMDASSSK

SEQ ID NO: 296746 - protein, 9 aa, Homo Sapiens
GIGSDFKLK

SEQ ID NO: 296747 - protein, 9 aa, Homo Sapiens
MLEESYKPQ

SEQ ID NO: 296748 - protein, 9 aa, Homo Sapiens
LSEYVKTML

SEQ ID NO: 296749 - protein, 9 aa, Homo Sapiens
ELNNNVTED

SEQ ID NO: 296750 - protein, 9 aa, Homo Sapiens
FDEDVGKEQ

SEQ ID NO: 296751 - protein, 9 aa, Homo Sapiens
VEHNPDTLL

SEQ ID NO: 296752 - protein, 9 aa, Homo Sapiens
TIKLIQNHF

SEQ ID NO: 296753 - protein, 9 aa, Homo Sapiens
ENETPQRRS

SEQ ID NO: 296754 - protein, 9 aa, Homo Sapiens
GVQSHPSST

SEQ ID NO: 296755 - protein, 9 aa, Homo Sapiens
FVFCALLLV

SEQ ID NO: 296756 - protein, 9 aa, Homo Sapiens
KISRMEERS

SEQ ID NO: 296757 - protein, 9 aa, Homo Sapiens
EEYKNYLRK

SEQ ID NO: 296758 - protein, 9 aa, Homo Sapiens
PGQTEGKGQ

SEQ ID NO: 296759 - protein, 9 aa, Homo Sapiens
QPFFAAGNT

SEQ ID NO: 296760 - protein, 9 aa, Homo Sapiens
NKRNKSLIL

SEQ ID NO: 296761 - protein, 9 aa, Homo Sapiens
LFEAEDTIG

SEQ ID NO: 296762 - protein, 9 aa, Homo Sapiens
KEQMKNSVQ

SEQ ID NO: 296763 - protein, 9 aa, Homo Sapiens
SNNVEYTFT

SEQ ID NO: 296764 - protein, 9 aa, Homo Sapiens
LSTGEKGFC

SEQ ID NO: 296765 - protein, 9 aa, Homo Sapiens
SQGLGIAKP

SEQ ID NO: 296766 - protein, 9 aa, Homo Sapiens
NGSIFTLKL

SEQ ID NO: 296767 - protein, 9 aa, Homo Sapiens
FNIEPSSGQ

SEQ ID NO: 296768 - protein, 9 aa, Homo Sapiens
YMDTIPPTV

SEQ ID NO: 296769 - protein, 9 aa, Homo Sapiens
PPGSEVLCI

SEQ ID NO: 296770 - protein, 9 aa, Homo Sapiens
GRNLRRHML

SEQ ID NO: 296771 - protein, 9 aa, Homo Sapiens
LTIKLIQNH

SEQ ID NO: 296772 - protein, 9 aa, Homo Sapiens
GRENKLGET

SEQ ID NO: 296773 - protein, 9 aa, Homo Sapiens
QPISSPLMK

SEQ ID NO: 296774 - protein, 9 aa, Homo Sapiens
VPHTTRSRQ

SEQ ID NO: 296775 - protein, 9 aa, Homo Sapiens
HVDELCPLV

SEQ ID NO: 296776 - protein, 9 aa, Homo Sapiens
YSSEDDISR

SEQ ID NO: 296777 - protein, 9 aa, Homo Sapiens
FSNYLQKYH

SEQ ID NO: 296778 - protein, 9 aa, Homo Sapiens
VNSNEGKQT

SEQ ID NO: 296779 - protein, 9 aa, Homo Sapiens
ENYNNLVAV

SEQ ID NO: 296780 - protein, 9 aa, Homo Sapiens
LEVPVKISR

SEQ ID NO: 296781 - protein, 9 aa, Homo Sapiens
LLILRGFRV

SEQ ID NO: 296782 - protein, 9 aa, Homo Sapiens
DLARLIIVK

SEQ ID NO: 296783 - protein, 9 aa, Homo Sapiens
PCQHKLFCE

SEQ ID NO: 296784 - protein, 9 aa, Homo Sapiens
QLGEDELSY

SEQ ID NO: 296785 - protein, 9 aa, Homo Sapiens
EIKKLLVPD

SEQ ID NO: 296786 - protein, 9 aa, Homo Sapiens
DCRVSSPVM

SEQ ID NO: 296787 - protein, 9 aa, Homo Sapiens
MMFTTALLL

SEQ ID NO: 296788 - protein, 9 aa, Homo Sapiens
EMKCKNCVH

SEQ ID NO: 296789 - protein, 9 aa, Homo Sapiens
GLIFLMMLH

SEQ ID NO: 296790 - protein, 9 aa, Homo Sapiens
LEHMHNQFV

SEQ ID NO: 296791 - protein, 9 aa, Homo Sapiens
RIKLHIWDT

SEQ ID NO: 296792 - protein, 9 aa, Homo Sapiens
NWNFFIALS

SEQ ID NO: 296793 - protein, 9 aa, Homo Sapiens
YFQRITIYL

SEQ ID NO: 296794 - protein, 9 aa, Homo Sapiens
GCTRKGTLK

SEQ ID NO: 296795 - protein, 9 aa, Homo Sapiens
SAKEEVNSN

SEQ ID NO: 296796 - protein, 9 aa, Homo Sapiens
KINSHNFCE

SEQ ID NO: 296797 - protein, 9 aa, Homo Sapiens
SKSRQLLQN

SEQ ID NO: 296798 - protein, 9 aa, Homo Sapiens
FPNGNNGKK

SEQ ID NO: 296799 - protein, 9 aa, Homo Sapiens
QKQWTALIC

SEQ ID NO: 296800 - protein, 9 aa, Homo Sapiens
KSSSSVSWK

SEQ ID NO: 296801 - protein, 9 aa, Homo Sapiens
AQTKLWMSY

SEQ ID NO: 296802 - protein, 9 aa, Homo Sapiens
SWLALIKRG

SEQ ID NO: 296803 - protein, 9 aa, Homo Sapiens
FRLHMHLIQ

SEQ ID NO: 296804 - protein, 9 aa, Homo Sapiens
RKPAQYGFA

SEQ ID NO: 296805 - protein, 9 aa, Homo Sapiens
KEKKKKDSI

SEQ ID NO: 296806 - protein, 9 aa, Homo Sapiens
LPFATGKHG

SEQ ID NO: 296807 - protein, 9 aa, Homo Sapiens
WCNLSALLY

SEQ ID NO: 296808 - protein, 9 aa, Homo Sapiens
LLQHPYLKL

SEQ ID NO: 296809 - protein, 9 aa, Homo Sapiens
NNEITTIKW

SEQ ID NO: 296810 - protein, 9 aa, Homo Sapiens
GFVKLGIIN

SEQ ID NO: 296811 - protein, 9 aa, Homo Sapiens
QAKAVITTT

SEQ ID NO: 296812 - protein, 9 aa, Homo Sapiens
IEPTSGVIC

SEQ ID NO: 296813 - protein, 9 aa, Homo Sapiens
KVKCIYVVQ

SEQ ID NO: 296814 - protein, 9 aa, Homo Sapiens
TEHFHFYKR

SEQ ID NO: 296815 - protein, 9 aa, Homo Sapiens
QSHMIMHTG

SEQ ID NO: 296816 - protein, 9 aa, Homo Sapiens
INFDRQKSR

SEQ ID NO: 296817 - protein, 9 aa, Homo Sapiens
NKWQDEDGK

SEQ ID NO: 296818 - protein, 9 aa, Homo Sapiens
HQQFQNFLT

SEQ ID NO: 296819 - protein, 9 aa, Homo Sapiens
YHQPWTQEA

SEQ ID NO: 296820 - protein, 9 aa, Homo Sapiens
EINQGAMSP

SEQ ID NO: 296821 - protein, 9 aa, Homo Sapiens
SRSRLQNRY

SEQ ID NO: 296822 - protein, 9 aa, Homo Sapiens
PCAFNVGST

SEQ ID NO: 296823 - protein, 9 aa, Homo Sapiens
LKNQAEVYV

SEQ ID NO: 296824 - protein, 9 aa, Homo Sapiens
TATEIRNKV

SEQ ID NO: 296825 - protein, 9 aa, Homo Sapiens
SATLKIQSL

SEQ ID NO: 296826 - protein, 9 aa, Homo Sapiens
KTFSICKEI

SEQ ID NO: 296827 - protein, 9 aa, Homo Sapiens
KSLQIAALL

SEQ ID NO: 296828 - protein, 9 aa, Homo Sapiens
NLFPPWKLI

SEQ ID NO: 296829 - protein, 9 aa, Homo Sapiens
PGYLNQPYE

SEQ ID NO: 296830 - protein, 9 aa, Homo Sapiens
KNEYLPLYS

SEQ ID NO: 296831 - protein, 9 aa, Homo Sapiens
VLNQIIYRK

SEQ ID NO: 296832 - protein, 9 aa, Homo Sapiens
STKSSSAAW

SEQ ID NO: 296833 - protein, 9 aa, Homo Sapiens
IFAVMAYDH

SEQ ID NO: 296834 - protein, 9 aa, Homo Sapiens
YEIQMLDNR

SEQ ID NO: 296835 - protein, 9 aa, Homo Sapiens
FSCLSSLHL

SEQ ID NO: 296836 - protein, 9 aa, Homo Sapiens
YKFSNPNIT

SEQ ID NO: 296837 - protein, 9 aa, Homo Sapiens
ELDKAVQMG

SEQ ID NO: 296838 - protein, 9 aa, Homo Sapiens
GTGAFSKVV

SEQ ID NO: 296839 - protein, 9 aa, Homo Sapiens
NQEKEAEKN

SEQ ID NO: 296840 - protein, 9 aa, Homo Sapiens
IRESTQENK

SEQ ID NO: 296841 - protein, 9 aa, Homo Sapiens
GYPYYTHCI

SEQ ID NO: 296842 - protein, 9 aa, Homo Sapiens
CLPFIRITS

SEQ ID NO: 296843 - protein, 9 aa, Homo Sapiens
TRHTRKTVL

SEQ ID NO: 296844 - protein, 9 aa, Homo Sapiens
EGACDVDNL

SEQ ID NO: 296845 - protein, 9 aa, Homo Sapiens
LCTFREICL

SEQ ID NO: 296846 - protein, 9 aa, Homo Sapiens
PRTAVKNCM

SEQ ID NO: 296847 - protein, 9 aa, Homo Sapiens
DDCNWLARD

SEQ ID NO: 296848 - protein, 9 aa, Homo Sapiens
LELRIKLAI

SEQ ID NO: 296849 - protein, 9 aa, Homo Sapiens
LLKLLRAIA

SEQ ID NO: 296850 - protein, 9 aa, Homo Sapiens
VNDALGYVA

SEQ ID NO: 296851 - protein, 9 aa, Homo Sapiens
SNVKFFYVV

SEQ ID NO: 296852 - protein, 9 aa, Homo Sapiens
TKTINSIQA

SEQ ID NO: 296853 - protein, 9 aa, Homo Sapiens
NNNESDLIE

SEQ ID NO: 296854 - protein, 9 aa, Homo Sapiens
LNLPKRIDT

SEQ ID NO: 296855 - protein, 9 aa, Homo Sapiens
KVNRDSVCS

SEQ ID NO: 296856 - protein, 9 aa, Homo Sapiens
YIKIFPSRR

SEQ ID NO: 296857 - protein, 9 aa, Homo Sapiens
LIYSVNNSE

SEQ ID NO: 296858 - protein, 9 aa, Homo Sapiens
TRIIKVSGQ

SEQ ID NO: 296859 - protein, 9 aa, Homo Sapiens
CKTPIRALQ

SEQ ID NO: 296860 - protein, 9 aa, Homo Sapiens
EKKKLLGQL

SEQ ID NO: 296861 - protein, 9 aa, Homo Sapiens
VQPSVIQKL

SEQ ID NO: 296862 - protein, 9 aa, Homo Sapiens
TKPMGLVSR

SEQ ID NO: 296863 - protein, 9 aa, Homo Sapiens
THCDKIKAN

SEQ ID NO: 296864 - protein, 9 aa, Homo Sapiens
MWYKNSSIL

SEQ ID NO: 296865 - protein, 9 aa, Homo Sapiens
PSTYTEKEK

SEQ ID NO: 296866 - protein, 9 aa, Homo Sapiens
LSYGASINA

SEQ ID NO: 296867 - protein, 9 aa, Homo Sapiens
CALFVALLP

SEQ ID NO: 296868 - protein, 9 aa, Homo Sapiens
PQFQRYFIS

SEQ ID NO: 296869 - protein, 9 aa, Homo Sapiens
LNSFGFNIQ

SEQ ID NO: 296870 - protein, 9 aa, Homo Sapiens
ISANIDTPK

SEQ ID NO: 296871 - protein, 9 aa, Homo Sapiens
PQFAVLYDT

SEQ ID NO: 296872 - protein, 9 aa, Homo Sapiens
QIIYHILIK

SEQ ID NO: 296873 - protein, 9 aa, Homo Sapiens
DSHRRPGDC

SEQ ID NO: 296874 - protein, 9 aa, Homo Sapiens
TIKNEKRED

SEQ ID NO: 296875 - protein, 9 aa, Homo Sapiens
IKLIQNHFV

SEQ ID NO: 296876 - protein, 9 aa, Homo Sapiens
AGNIKKHFN

SEQ ID NO: 296877 - protein, 9 aa, Homo Sapiens
SSSAAWDET

SEQ ID NO: 296878 - protein, 9 aa, Homo Sapiens
PRTFKFMKG

SEQ ID NO: 296879 - protein, 9 aa, Homo Sapiens
FVFFFIIYI

SEQ ID NO: 296880 - protein, 9 aa, Homo Sapiens
PVFYFILGD

SEQ ID NO: 296881 - protein, 9 aa, Homo Sapiens
LQNHYLNVT

SEQ ID NO: 296882 - protein, 9 aa, Homo Sapiens
KMKVNWCHK

SEQ ID NO: 296883 - protein, 9 aa, Homo Sapiens
LRDLNVRIN

SEQ ID NO: 296884 - protein, 9 aa, Homo Sapiens
TEGLPNYSI

SEQ ID NO: 296885 - protein, 9 aa, Homo Sapiens
GGGPDYAKE

SEQ ID NO: 296886 - protein, 9 aa, Homo Sapiens
DLNPHGFPW

SEQ ID NO: 296887 - protein, 9 aa, Homo Sapiens
DKRKRNVLI

SEQ ID NO: 296888 - protein, 9 aa, Homo Sapiens
SGARPTSFM

SEQ ID NO: 296889 - protein, 9 aa, Homo Sapiens
EKYFPNGNN

SEQ ID NO: 296890 - protein, 9 aa, Homo Sapiens
CSRTARPKG

SEQ ID NO: 296891 - protein, 9 aa, Homo Sapiens
CKLKNAMTK

SEQ ID NO: 296892 - protein, 9 aa, Homo Sapiens
LLVPDYNDE

SEQ ID NO: 296893 - protein, 9 aa, Homo Sapiens
RHSKHTVVA

SEQ ID NO: 296894 - protein, 9 aa, Homo Sapiens
INQKQFQWL

SEQ ID NO: 296895 - protein, 9 aa, Homo Sapiens
QGCNNTYNE

SEQ ID NO: 296896 - protein, 9 aa, Homo Sapiens
ELDGRQLFS

SEQ ID NO: 296897 - protein, 9 aa, Homo Sapiens
SVPDNTERF

SEQ ID NO: 296898 - protein, 9 aa, Homo Sapiens
KGQDGIIGV

SEQ ID NO: 296899 - protein, 9 aa, Homo Sapiens
RQCWMTDTP

SEQ ID NO: 296900 - protein, 9 aa, Homo Sapiens
KEGFRLVST

SEQ ID NO: 296901 - protein, 9 aa, Homo Sapiens
TMNISIPGE

SEQ ID NO: 296902 - protein, 9 aa, Homo Sapiens
NNKYCFDFG

SEQ ID NO: 296903 - protein, 9 aa, Homo Sapiens
PQSIIGLFV

SEQ ID NO: 296904 - protein, 9 aa, Homo Sapiens
IRFNYQSQA

SEQ ID NO: 296905 - protein, 9 aa, Homo Sapiens
VDATHKGNK

SEQ ID NO: 296906 - protein, 9 aa, Homo Sapiens
SFNCSSDII

SEQ ID NO: 296907 - protein, 9 aa, Homo Sapiens
FDHCSAGES

SEQ ID NO: 296908 - protein, 9 aa, Homo Sapiens
HIHLENNEN

SEQ ID NO: 296909 - protein, 9 aa, Homo Sapiens
IIMNIHTCN

SEQ ID NO: 296910 - protein, 9 aa, Homo Sapiens
DMKAIGIEP

SEQ ID NO: 296911 - protein, 9 aa, Homo Sapiens
LLFAISEAS

SEQ ID NO: 296912 - protein, 9 aa, Homo Sapiens
LKPEWFWGR

SEQ ID NO: 296913 - protein, 9 aa, Homo Sapiens
QSKEQMKNS

SEQ ID NO: 296914 - protein, 9 aa, Homo Sapiens
HPKVSNFFV

SEQ ID NO: 296915 - protein, 9 aa, Homo Sapiens
EQQEEDGLE

SEQ ID NO: 296916 - protein, 9 aa, Homo Sapiens
EKDEDFVSS

SEQ ID NO: 296917 - protein, 9 aa, Homo Sapiens
QTHVQAGTL

SEQ ID NO: 296918 - protein, 9 aa, Homo Sapiens
NVNLVGLIK

SEQ ID NO: 296919 - protein, 9 aa, Homo Sapiens
LPGFKRLSC

SEQ ID NO: 296920 - protein, 9 aa, Homo Sapiens
GRQCWMTDT

SEQ ID NO: 296921 - protein, 9 aa, Homo Sapiens
THILRERKQ

SEQ ID NO: 296922 - protein, 9 aa, Homo Sapiens
DMLAGGVDT

SEQ ID NO: 296923 - protein, 9 aa, Homo Sapiens
TTLSDAYQD

SEQ ID NO: 296924 - protein, 9 aa, Homo Sapiens
DPIRNKYFS

SEQ ID NO: 296925 - protein, 9 aa, Homo Sapiens
RKAKIKTNK

SEQ ID NO: 296926 - protein, 9 aa, Homo Sapiens
IFAFPVYQG

SEQ ID NO: 296927 - protein, 9 aa, Homo Sapiens
RASASGARP

SEQ ID NO: 296928 - protein, 9 aa, Homo Sapiens
WPWPATQPL

SEQ ID NO: 296929 - protein, 9 aa, Homo Sapiens
HYQKLKKFM

SEQ ID NO: 296930 - protein, 9 aa, Homo Sapiens
TPQKREINI

SEQ ID NO: 296931 - protein, 9 aa, Homo Sapiens
NNVHGDIHA

SEQ ID NO: 296932 - protein, 9 aa, Homo Sapiens
CNPLHYDVG

SEQ ID NO: 296933 - protein, 9 aa, Homo Sapiens
LQLFDRKNL

SEQ ID NO: 296934 - protein, 9 aa, Homo Sapiens
IPSNLKLEA

SEQ ID NO: 296935 - protein, 9 aa, Homo Sapiens
LIPEELFQF

SEQ ID NO: 296936 - protein, 9 aa, Homo Sapiens
LDHFDKLPI

SEQ ID NO: 296937 - protein, 9 aa, Homo Sapiens
SEINKPNLY

SEQ ID NO: 296938 - protein, 9 aa, Homo Sapiens
TQLAKEVAK

SEQ ID NO: 296939 - protein, 9 aa, Homo Sapiens
QFYAAPMTL

SEQ ID NO: 296940 - protein, 9 aa, Homo Sapiens
QDIVTCTRV

SEQ ID NO: 296941 - protein, 9 aa, Homo Sapiens
LHNSNIINK

SEQ ID NO: 296942 - protein, 9 aa, Homo Sapiens
DYPVVKQML

SEQ ID NO: 296943 - protein, 9 aa, Homo Sapiens
NNKILANGG

SEQ ID NO: 296944 - protein, 9 aa, Homo Sapiens
VSLNLTFGS

SEQ ID NO: 296945 - protein, 9 aa, Homo Sapiens
EVNLEFHVQ

SEQ ID NO: 296946 - protein, 9 aa, Homo Sapiens
APSQSILFS

SEQ ID NO: 296947 - protein, 9 aa, Homo Sapiens
LRRNSRVTG

SEQ ID NO: 296948 - protein, 9 aa, Homo Sapiens
QLEDIIAEN

SEQ ID NO: 296949 - protein, 9 aa, Homo Sapiens
RLLSECDAA

SEQ ID NO: 296950 - protein, 9 aa, Homo Sapiens
IICALLGIP

SEQ ID NO: 296951 - protein, 9 aa, Homo Sapiens
QNTFSPLPL

SEQ ID NO: 296952 - protein, 9 aa, Homo Sapiens
CNTMFLSVR

SEQ ID NO: 296953 - protein, 9 aa, Homo Sapiens
LGLEHMHNQ

SEQ ID NO: 296954 - protein, 9 aa, Homo Sapiens
GPITPPGPP

SEQ ID NO: 296955 - protein, 9 aa, Homo Sapiens
FSIENGTGT

SEQ ID NO: 296956 - protein, 9 aa, Homo Sapiens
HNILELKKY

SEQ ID NO: 296957 - protein, 9 aa, Homo Sapiens
TPAGLMVSM

SEQ ID NO: 296958 - protein, 9 aa, Homo Sapiens
DIIVHQRIH

SEQ ID NO: 296959 - protein, 9 aa, Homo Sapiens
ISQEPAFEL

SEQ ID NO: 296960 - protein, 9 aa, Homo Sapiens
QNCMQESMA

SEQ ID NO: 296961 - protein, 9 aa, Homo Sapiens
GHNKLSNPK

SEQ ID NO: 296962 - protein, 9 aa, Homo Sapiens
DTAEYFLWA

SEQ ID NO: 296963 - protein, 9 aa, Homo Sapiens
TSQIDDSLS

SEQ ID NO: 296964 - protein, 9 aa, Homo Sapiens
IETLLYAMV

SEQ ID NO: 296965 - protein, 9 aa, Homo Sapiens
MDYLINNGS

SEQ ID NO: 296966 - protein, 9 aa, Homo Sapiens
ASPQRKYAL

SEQ ID NO: 296967 - protein, 9 aa, Homo Sapiens
FVAPKKDVD

SEQ ID NO: 296968 - protein, 9 aa, Homo Sapiens
PKGYYTCCD

SEQ ID NO: 296969 - protein, 9 aa, Homo Sapiens
AEFSKWWPT

SEQ ID NO: 296970 - protein, 9 aa, Homo Sapiens
LFGKFIFIS

SEQ ID NO: 296971 - protein, 9 aa, Homo Sapiens
HTFPEVQIM

SEQ ID NO: 296972 - protein, 9 aa, Homo Sapiens
GCDTQMIDD

SEQ ID NO: 296973 - protein, 9 aa, Homo Sapiens
NNLDALENA

SEQ ID NO: 296974 - protein, 9 aa, Homo Sapiens
EEQPPETTA

SEQ ID NO: 296975 - protein, 9 aa, Homo Sapiens
KNNLCRNFM

SEQ ID NO: 296976 - protein, 9 aa, Homo Sapiens
LHTGKKPLS

SEQ ID NO: 296977 - protein, 9 aa, Homo Sapiens
ARLFTNLNF

SEQ ID NO: 296978 - protein, 9 aa, Homo Sapiens
SKNTKKHGK

SEQ ID NO: 296979 - protein, 9 aa, Homo Sapiens
KVGSVCLSE

SEQ ID NO: 296980 - protein, 9 aa, Homo Sapiens
QTQTLEEIK

SEQ ID NO: 296981 - protein, 9 aa, Homo Sapiens
MKSTLISAS

SEQ ID NO: 296982 - protein, 9 aa, Homo Sapiens
LLLANNYIL

SEQ ID NO: 296983 - protein, 9 aa, Homo Sapiens
LLSYILTHF

SEQ ID NO: 296984 - protein, 9 aa, Homo Sapiens
YLGGRCVPP

SEQ ID NO: 296985 - protein, 9 aa, Homo Sapiens
KRTQQIQDE

SEQ ID NO: 296986 - protein, 9 aa, Homo Sapiens
RSPQKLPTS

SEQ ID NO: 296987 - protein, 9 aa, Homo Sapiens
QEYTDLQKM

SEQ ID NO: 296988 - protein, 9 aa, Homo Sapiens
NQQEQEQSL

SEQ ID NO: 296989 - protein, 9 aa, Homo Sapiens
TPMYFLIFN

SEQ ID NO: 296990 - protein, 9 aa, Homo Sapiens
VGELELLDR

SEQ ID NO: 296991 - protein, 9 aa, Homo Sapiens
GQHSPKIIS

SEQ ID NO: 296992 - protein, 9 aa, Homo Sapiens
PIGDIPQIP

SEQ ID NO: 296993 - protein, 9 aa, Homo Sapiens
ASCGTEGFW

SEQ ID NO: 296994 - protein, 9 aa, Homo Sapiens
FQNIIAVQY

SEQ ID NO: 296995 - protein, 9 aa, Homo Sapiens
PAERCLPRM

SEQ ID NO: 296996 - protein, 9 aa, Homo Sapiens
QLCVCEICP

SEQ ID NO: 296997 - protein, 9 aa, Homo Sapiens
RLKDTRVNY

SEQ ID NO: 296998 - protein, 9 aa, Homo Sapiens
ISWRHCIGP

SEQ ID NO: 296999 - protein, 9 aa, Homo Sapiens
CFVTYSCVT

SEQ ID NO: 297000 - protein, 9 aa, Homo Sapiens
MLEILIFCI

SEQ ID NO: 297001 - protein, 9 aa, Homo Sapiens
VAQDIWPEQ

SEQ ID NO: 297002 - protein, 9 aa, Homo Sapiens
KFHSNSDCG

SEQ ID NO: 297003 - protein, 9 aa, Homo Sapiens
SRHSGSHNH

SEQ ID NO: 297004 - protein, 9 aa, Homo Sapiens
VRGNLLRSL

SEQ ID NO: 297005 - protein, 9 aa, Homo Sapiens
CQQLVGPFL

SEQ ID NO: 297006 - protein, 9 aa, Homo Sapiens
VHGPDAHVI

SEQ ID NO: 297007 - protein, 9 aa, Homo Sapiens
KTTWQINLK

SEQ ID NO: 297008 - protein, 9 aa, Homo Sapiens
SRALFKRNP

SEQ ID NO: 297009 - protein, 9 aa, Homo Sapiens
SSSSLLQNE

SEQ ID NO: 297010 - protein, 9 aa, Homo Sapiens
KLQTFVANR

SEQ ID NO: 297011 - protein, 9 aa, Homo Sapiens
HADRAIAFS

SEQ ID NO: 297012 - protein, 9 aa, Homo Sapiens
IPYCSMVHA

SEQ ID NO: 297013 - protein, 9 aa, Homo Sapiens
HPSSTQIFQ

SEQ ID NO: 297014 - protein, 9 aa, Homo Sapiens
LAGFLIIFS

SEQ ID NO: 297015 - protein, 9 aa, Homo Sapiens
LWNAGTVAD

SEQ ID NO: 297016 - protein, 9 aa, Homo Sapiens
SVVECSNLL

SEQ ID NO: 297017 - protein, 9 aa, Homo Sapiens
VVTPMLNHI

SEQ ID NO: 297018 - protein, 9 aa, Homo Sapiens
TESRTLHIN

SEQ ID NO: 297019 - protein, 9 aa, Homo Sapiens
SHIFVKAIS

SEQ ID NO: 297020 - protein, 9 aa, Homo Sapiens
DKSYTVQSG

SEQ ID NO: 297021 - protein, 9 aa, Homo Sapiens
VKAYLALHH

SEQ ID NO: 297022 - protein, 9 aa, Homo Sapiens
TFNRDFLAE

SEQ ID NO: 297023 - protein, 9 aa, Homo Sapiens
FPDGGIAQL

SEQ ID NO: 297024 - protein, 9 aa, Homo Sapiens
VTASIKTLC

SEQ ID NO: 297025 - protein, 9 aa, Homo Sapiens
TDLSNPSIA

SEQ ID NO: 297026 - protein, 9 aa, Homo Sapiens
GNDQFPGLN

SEQ ID NO: 297027 - protein, 9 aa, Homo Sapiens
LCDYDTHNI

SEQ ID NO: 297028 - protein, 9 aa, Homo Sapiens
LFTVGACLF

SEQ ID NO: 297029 - protein, 9 aa, Homo Sapiens
INAMQKACL

SEQ ID NO: 297030 - protein, 9 aa, Homo Sapiens
EMHDKLSCM

SEQ ID NO: 297031 - protein, 9 aa, Homo Sapiens
QAFRAINRA

SEQ ID NO: 297032 - protein, 9 aa, Homo Sapiens
QQLPVATDF

SEQ ID NO: 297033 - protein, 9 aa, Homo Sapiens
GIPGVQGIM

SEQ ID NO: 297034 - protein, 9 aa, Homo Sapiens
TGQSTPCAF

SEQ ID NO: 297035 - protein, 9 aa, Homo Sapiens
FCLPFIRIT

SEQ ID NO: 297036 - protein, 9 aa, Homo Sapiens
VYTYIRPRN

SEQ ID NO: 297037 - protein, 9 aa, Homo Sapiens
VIDNKVCNR

SEQ ID NO: 297038 - protein, 9 aa, Homo Sapiens
VGSVCLSEA

SEQ ID NO: 297039 - protein, 9 aa, Homo Sapiens
LQEKEHQRI

SEQ ID NO: 297040 - protein, 9 aa, Homo Sapiens
ATSILDFYR

SEQ ID NO: 297041 - protein, 9 aa, Homo Sapiens
DSWDTNYAN

SEQ ID NO: 297042 - protein, 9 aa, Homo Sapiens
LSTASTNIN

SEQ ID NO: 297043 - protein, 9 aa, Homo Sapiens
PGEKQKVVI

SEQ ID NO: 297044 - protein, 9 aa, Homo Sapiens
IFNTYRNDL

SEQ ID NO: 297045 - protein, 9 aa, Homo Sapiens
KDRQVEDDR

SEQ ID NO: 297046 - protein, 9 aa, Homo Sapiens
GHRSQAPIH

SEQ ID NO: 297047 - protein, 9 aa, Homo Sapiens
QKFMEKSNN

SEQ ID NO: 297048 - protein, 9 aa, Homo Sapiens
ALSFLDIWY

SEQ ID NO: 297049 - protein, 9 aa, Homo Sapiens
VDLHLLHHD

SEQ ID NO: 297050 - protein, 9 aa, Homo Sapiens
SQQCFIIFH

SEQ ID NO: 297051 - protein, 9 aa, Homo Sapiens
YRLVASGAD

SEQ ID NO: 297052 - protein, 9 aa, Homo Sapiens
NLMEAIWGS

SEQ ID NO: 297053 - protein, 9 aa, Homo Sapiens
SRKTAKDMC

SEQ ID NO: 297054 - protein, 9 aa, Homo Sapiens
VNYDKGLKV

SEQ ID NO: 297055 - protein, 9 aa, Homo Sapiens
WDLEPNTDY

SEQ ID NO: 297056 - protein, 9 aa, Homo Sapiens
NPEEVCAVL

SEQ ID NO: 297057 - protein, 9 aa, Homo Sapiens
IILGLFNHT

SEQ ID NO: 297058 - protein, 9 aa, Homo Sapiens
INVTSELEQ

SEQ ID NO: 297059 - protein, 9 aa, Homo Sapiens
GVEQIFYIV

SEQ ID NO: 297060 - protein, 9 aa, Homo Sapiens
KGEATCPHF

SEQ ID NO: 297061 - protein, 9 aa, Homo Sapiens
PKDTWYDLE

SEQ ID NO: 297062 - protein, 9 aa, Homo Sapiens
HMGHEFIPT

SEQ ID NO: 297063 - protein, 9 aa, Homo Sapiens
ARLMSWLQS

SEQ ID NO: 297064 - protein, 9 aa, Homo Sapiens
HTRKTVLRR

SEQ ID NO: 297065 - protein, 9 aa, Homo Sapiens
NIKKHFNTG

SEQ ID NO: 297066 - protein, 9 aa, Homo Sapiens
QLIHLFSKF

SEQ ID NO: 297067 - protein, 9 aa, Homo Sapiens
ARLHVVAVT

SEQ ID NO: 297068 - protein, 9 aa, Homo Sapiens
ECGQSFTCK

SEQ ID NO: 297069 - protein, 9 aa, Homo Sapiens
SNPNITVIY

SEQ ID NO: 297070 - protein, 9 aa, Homo Sapiens
ESIINSTEY

SEQ ID NO: 297071 - protein, 9 aa, Homo Sapiens
VKLVNDSLY

SEQ ID NO: 297072 - protein, 9 aa, Homo Sapiens
HPHVANPQL

SEQ ID NO: 297073 - protein, 9 aa, Homo Sapiens
LNPHGFPWE

SEQ ID NO: 297074 - protein, 9 aa, Homo Sapiens
LPFTLENTY

SEQ ID NO: 297075 - protein, 9 aa, Homo Sapiens
RKLSKIKLP

SEQ ID NO: 297076 - protein, 9 aa, Homo Sapiens
PVHFHPIYR

SEQ ID NO: 297077 - protein, 9 aa, Homo Sapiens
VLGDSCILE

SEQ ID NO: 297078 - protein, 9 aa, Homo Sapiens
LVGCIIGRQ

SEQ ID NO: 297079 - protein, 9 aa, Homo Sapiens
QKCDILELK

SEQ ID NO: 297080 - protein, 9 aa, Homo Sapiens
IIGKGQITS

SEQ ID NO: 297081 - protein, 9 aa, Homo Sapiens
QRLKDTRVN

SEQ ID NO: 297082 - protein, 9 aa, Homo Sapiens
AVRIDQICS

SEQ ID NO: 297083 - protein, 9 aa, Homo Sapiens
VILRKELEE

SEQ ID NO: 297084 - protein, 9 aa, Homo Sapiens
DGRLRVNYC

SEQ ID NO: 297085 - protein, 9 aa, Homo Sapiens
TSYDTTLDH

SEQ ID NO: 297086 - protein, 9 aa, Homo Sapiens
VYDKEFPQV

SEQ ID NO: 297087 - protein, 9 aa, Homo Sapiens
SPPEDKMFL

SEQ ID NO: 297088 - protein, 9 aa, Homo Sapiens
EKKDRDEHM

SEQ ID NO: 297089 - protein, 9 aa, Homo Sapiens
TGSFQIVSA

SEQ ID NO: 297090 - protein, 9 aa, Homo Sapiens
KQGRRMFPL

SEQ ID NO: 297091 - protein, 9 aa, Homo Sapiens
KPGRPQIKK

SEQ ID NO: 297092 - protein, 9 aa, Homo Sapiens
YDRTAQMCC

SEQ ID NO: 297093 - protein, 9 aa, Homo Sapiens
SLWLRMHLL

SEQ ID NO: 297094 - protein, 9 aa, Homo Sapiens
NTMPPKIHY

SEQ ID NO: 297095 - protein, 9 aa, Homo Sapiens
GSKSKEKDS

SEQ ID NO: 297096 - protein, 9 aa, Homo Sapiens
IPREPRPGK

SEQ ID NO: 297097 - protein, 9 aa, Homo Sapiens
IEDADIHNK

SEQ ID NO: 297098 - protein, 9 aa, Homo Sapiens
DSNKKKKET

SEQ ID NO: 297099 - protein, 9 aa, Homo Sapiens
TIIKKNGDI

SEQ ID NO: 297100 - protein, 9 aa, Homo Sapiens
TPMLNHILY

SEQ ID NO: 297101 - protein, 9 aa, Homo Sapiens
LRDIERGSR

SEQ ID NO: 297102 - protein, 9 aa, Homo Sapiens
GWNKRIKYA

SEQ ID NO: 297103 - protein, 9 aa, Homo Sapiens
FTCNECGRL

SEQ ID NO: 297104 - protein, 9 aa, Homo Sapiens
PNVRAMYGN

SEQ ID NO: 297105 - protein, 9 aa, Homo Sapiens
LDILNYLSF

SEQ ID NO: 297106 - protein, 9 aa, Homo Sapiens
KTGINKAPI

SEQ ID NO: 297107 - protein, 9 aa, Homo Sapiens
KETTVTKIL

SEQ ID NO: 297108 - protein, 9 aa, Homo Sapiens
LKGLEVLAE

SEQ ID NO: 297109 - protein, 9 aa, Homo Sapiens
ILQQSQAYF

SEQ ID NO: 297110 - protein, 9 aa, Homo Sapiens
LCLGVSLAE

SEQ ID NO: 297111 - protein, 9 aa, Homo Sapiens
QARFLHETN

SEQ ID NO: 297112 - protein, 9 aa, Homo Sapiens
MEIRGTLDL

SEQ ID NO: 297113 - protein, 9 aa, Homo Sapiens
KISKSSIMY

SEQ ID NO: 297114 - protein, 9 aa, Homo Sapiens
LMASLVGLL

SEQ ID NO: 297115 - protein, 9 aa, Homo Sapiens
PELTVESLE

SEQ ID NO: 297116 - protein, 9 aa, Homo Sapiens
RYWASPTRT

SEQ ID NO: 297117 - protein, 9 aa, Homo Sapiens
SATYQPSFT

SEQ ID NO: 297118 - protein, 9 aa, Homo Sapiens
QETGGNLYW

SEQ ID NO: 297119 - protein, 9 aa, Homo Sapiens
DTQWCVCKL

SEQ ID NO: 297120 - protein, 9 aa, Homo Sapiens
TVAATLVSH

SEQ ID NO: 297121 - protein, 9 aa, Homo Sapiens
TATTQCQIT

SEQ ID NO: 297122 - protein, 9 aa, Homo Sapiens
DLDKTLPNS

SEQ ID NO: 297123 - protein, 9 aa, Homo Sapiens
PQTTVHDKS

SEQ ID NO: 297124 - protein, 9 aa, Homo Sapiens
TLQTKRKLP

SEQ ID NO: 297125 - protein, 9 aa, Homo Sapiens
FAFVSHMGT

SEQ ID NO: 297126 - protein, 9 aa, Homo Sapiens
FPYDLYHAD

SEQ ID NO: 297127 - protein, 9 aa, Homo Sapiens
RQRFGNSHA

SEQ ID NO: 297128 - protein, 9 aa, Homo Sapiens
HADGLLWHH

SEQ ID NO: 297129 - protein, 9 aa, Homo Sapiens
IHESDSILG

SEQ ID NO: 297130 - protein, 9 aa, Homo Sapiens
GNDSSKFDE

SEQ ID NO: 297131 - protein, 9 aa, Homo Sapiens
EEKDKLVKA

SEQ ID NO: 297132 - protein, 9 aa, Homo Sapiens
LLLLFLPEE

SEQ ID NO: 297133 - protein, 9 aa, Homo Sapiens
RRIRGRKEG

SEQ ID NO: 297134 - protein, 9 aa, Homo Sapiens
EDLSDQSKK

SEQ ID NO: 297135 - protein, 9 aa, Homo Sapiens
EHLINVLRR

SEQ ID NO: 297136 - protein, 9 aa, Homo Sapiens
QVISEGDGN

SEQ ID NO: 297137 - protein, 9 aa, Homo Sapiens
SDNSGDSGY

SEQ ID NO: 297138 - protein, 9 aa, Homo Sapiens
CLDPDAPII

SEQ ID NO: 297139 - protein, 9 aa, Homo Sapiens
KENLQAQIR

SEQ ID NO: 297140 - protein, 9 aa, Homo Sapiens
TKGEVIDVH

SEQ ID NO: 297141 - protein, 9 aa, Homo Sapiens
HILQKHGKN

SEQ ID NO: 297142 - protein, 9 aa, Homo Sapiens
CFLQLYFFF

SEQ ID NO: 297143 - protein, 9 aa, Homo Sapiens
IFGDNMNKL

SEQ ID NO: 297144 - protein, 9 aa, Homo Sapiens
TIEALSGKI

SEQ ID NO: 297145 - protein, 9 aa, Homo Sapiens
ITEVLLNAR

SEQ ID NO: 297146 - protein, 9 aa, Homo Sapiens
YLAKSLCIL

SEQ ID NO: 297147 - protein, 9 aa, Homo Sapiens
YLQQLRASP

SEQ ID NO: 297148 - protein, 9 aa, Homo Sapiens
EAYCRVTAP

SEQ ID NO: 297149 - protein, 9 aa, Homo Sapiens
ELAGMLLSE

SEQ ID NO: 297150 - protein, 9 aa, Homo Sapiens
NSPEKLYPK

SEQ ID NO: 297151 - protein, 9 aa, Homo Sapiens
LEELLTALF

SEQ ID NO: 297152 - protein, 9 aa, Homo Sapiens
KPWREENEH

SEQ ID NO: 297153 - protein, 9 aa, Homo Sapiens
FTKLFEKHP

SEQ ID NO: 297154 - protein, 9 aa, Homo Sapiens
QKKKPTVKE

SEQ ID NO: 297155 - protein, 9 aa, Homo Sapiens
ENNFKEGHK

SEQ ID NO: 297156 - protein, 9 aa, Homo Sapiens
LAPKVPQQT

SEQ ID NO: 297157 - protein, 9 aa, Homo Sapiens
SIDEHYHIR

SEQ ID NO: 297158 - protein, 9 aa, Homo Sapiens
IVAVEKDYF

SEQ ID NO: 297159 - protein, 9 aa, Homo Sapiens
TQAPSEGAC

SEQ ID NO: 297160 - protein, 9 aa, Homo Sapiens
SHLYLGCNK

SEQ ID NO: 297161 - protein, 9 aa, Homo Sapiens
KRAGERSVV

SEQ ID NO: 297162 - protein, 9 aa, Homo Sapiens
KVTSKVIKK

SEQ ID NO: 297163 - protein, 9 aa, Homo Sapiens
EAKDPGDLS

SEQ ID NO: 297164 - protein, 9 aa, Homo Sapiens
KIVHSIVSY

SEQ ID NO: 297165 - protein, 9 aa, Homo Sapiens
IKDKANKFT

SEQ ID NO: 297166 - protein, 9 aa, Homo Sapiens
LGPQTHVQA

SEQ ID NO: 297167 - protein, 9 aa, Homo Sapiens
DESDLSEHE

SEQ ID NO: 297168 - protein, 9 aa, Homo Sapiens
SYHQGCPFS

SEQ ID NO: 297169 - protein, 9 aa, Homo Sapiens
YIYLVEKYI

SEQ ID NO: 297170 - protein, 9 aa, Homo Sapiens
LERRVVMLT

SEQ ID NO: 297171 - protein, 9 aa, Homo Sapiens
PFKYVDSDK

SEQ ID NO: 297172 - protein, 9 aa, Homo Sapiens
TIERLYLPP

SEQ ID NO: 297173 - protein, 9 aa, Homo Sapiens
LDFQTSKFV

SEQ ID NO: 297174 - protein, 9 aa, Homo Sapiens
PYYTHCIWR

SEQ ID NO: 297175 - protein, 9 aa, Homo Sapiens
PACEAGLCT

SEQ ID NO: 297176 - protein, 9 aa, Homo Sapiens
ANLGEDAIT

SEQ ID NO: 297177 - protein, 9 aa, Homo Sapiens
ERNVEAVIN

SEQ ID NO: 297178 - protein, 9 aa, Homo Sapiens
QTKRGGGGG

SEQ ID NO: 297179 - protein, 9 aa, Homo Sapiens
ADIHNKTYR

SEQ ID NO: 297180 - protein, 9 aa, Homo Sapiens
MHDKLSCMA

SEQ ID NO: 297181 - protein, 9 aa, Homo Sapiens
SKMREKRKL

SEQ ID NO: 297182 - protein, 9 aa, Homo Sapiens
QKIIPQELW

SEQ ID NO: 297183 - protein, 9 aa, Homo Sapiens
NRSLFTLTE

SEQ ID NO: 297184 - protein, 9 aa, Homo Sapiens
PQYVLLFGL

SEQ ID NO: 297185 - protein, 9 aa, Homo Sapiens
FKCPTCGVR

SEQ ID NO: 297186 - protein, 9 aa, Homo Sapiens
YFQEAMLLF

SEQ ID NO: 297187 - protein, 9 aa, Homo Sapiens
KESVSMSVF

SEQ ID NO: 297188 - protein, 9 aa, Homo Sapiens
STMYGSSPA

SEQ ID NO: 297189 - protein, 9 aa, Homo Sapiens
VDIIDAVKL

SEQ ID NO: 297190 - protein, 9 aa, Homo Sapiens
SLAHSAGYI

SEQ ID NO: 297191 - protein, 9 aa, Homo Sapiens
QNLRKMELL

SEQ ID NO: 297192 - protein, 9 aa, Homo Sapiens
VKDVFWDVL

SEQ ID NO: 297193 - protein, 9 aa, Homo Sapiens
GCSLMYHLL

SEQ ID NO: 297194 - protein, 9 aa, Homo Sapiens
LIMLGCFQL

SEQ ID NO: 297195 - protein, 9 aa, Homo Sapiens
LLPGFKRLS

SEQ ID NO: 297196 - protein, 9 aa, Homo Sapiens
VSKRFCFDD

SEQ ID NO: 297197 - protein, 9 aa, Homo Sapiens
VAGNIKKHF

SEQ ID NO: 297198 - protein, 9 aa, Homo Sapiens
QSVPFKYVD

SEQ ID NO: 297199 - protein, 9 aa, Homo Sapiens
RLQAVSDGA

SEQ ID NO: 297200 - protein, 9 aa, Homo Sapiens
VGQGPGDRK

SEQ ID NO: 297201 - protein, 9 aa, Homo Sapiens
TGLGAMLWG

SEQ ID NO: 297202 - protein, 9 aa, Homo Sapiens
QRQKQKQMK

SEQ ID NO: 297203 - protein, 9 aa, Homo Sapiens
EQTTDNIFF

SEQ ID NO: 297204 - protein, 9 aa, Homo Sapiens
KKLIGAKEG

SEQ ID NO: 297205 - protein, 9 aa, Homo Sapiens
IENGFIYES

SEQ ID NO: 297206 - protein, 9 aa, Homo Sapiens
KGKKQNPGL

SEQ ID NO: 297207 - protein, 9 aa, Homo Sapiens
LCSKQTRTM

SEQ ID NO: 297208 - protein, 9 aa, Homo Sapiens
PVAILVYKV

SEQ ID NO: 297209 - protein, 9 aa, Homo Sapiens
EGEQQCFLF

SEQ ID NO: 297210 - protein, 9 aa, Homo Sapiens
GNTFLRAFR

SEQ ID NO: 297211 - protein, 9 aa, Homo Sapiens
SCMSGADSF

SEQ ID NO: 297212 - protein, 9 aa, Homo Sapiens
YAHLTELTD

SEQ ID NO: 297213 - protein, 9 aa, Homo Sapiens
EGKTPAGRI

SEQ ID NO: 297214 - protein, 9 aa, Homo Sapiens
NKLQTFVAN

SEQ ID NO: 297215 - protein, 9 aa, Homo Sapiens
IPVLFKIMK

SEQ ID NO: 297216 - protein, 9 aa, Homo Sapiens
DNKSPAIKY

SEQ ID NO: 297217 - protein, 9 aa, Homo Sapiens
ALERKRALL

SEQ ID NO: 297218 - protein, 9 aa, Homo Sapiens
LKDTRVNYR

SEQ ID NO: 297219 - protein, 9 aa, Homo Sapiens
VKPKLVINV

SEQ ID NO: 297220 - protein, 9 aa, Homo Sapiens
VSLLSNSAT

SEQ ID NO: 297221 - protein, 9 aa, Homo Sapiens
WVDDKVNFH

SEQ ID NO: 297222 - protein, 9 aa, Homo Sapiens
CPHVAQDIW

SEQ ID NO: 297223 - protein, 9 aa, Homo Sapiens
GKKGHRGDP

SEQ ID NO: 297224 - protein, 9 aa, Homo Sapiens
RDPQKSFAL

SEQ ID NO: 297225 - protein, 9 aa, Homo Sapiens
RIIFRTLNH

SEQ ID NO: 297226 - protein, 9 aa, Homo Sapiens
NFDEDVGKE

SEQ ID NO: 297227 - protein, 9 aa, Homo Sapiens
LRGSNGLWR

SEQ ID NO: 297228 - protein, 9 aa, Homo Sapiens
YEQEKVILR

SEQ ID NO: 297229 - protein, 9 aa, Homo Sapiens
ILRERKQLV

SEQ ID NO: 297230 - protein, 9 aa, Homo Sapiens
YLMASLVGL

SEQ ID NO: 297231 - protein, 9 aa, Homo Sapiens
PTEFKTVKF

SEQ ID NO: 297232 - protein, 9 aa, Homo Sapiens
LDTDISWAK

SEQ ID NO: 297233 - protein, 9 aa, Homo Sapiens
KLVDLEIKF

SEQ ID NO: 297234 - protein, 9 aa, Homo Sapiens
KPKLLNKLD

SEQ ID NO: 297235 - protein, 9 aa, Homo Sapiens
RDLNDKIQE

SEQ ID NO: 297236 - protein, 9 aa, Homo Sapiens
ELTSKSREL

SEQ ID NO: 297237 - protein, 9 aa, Homo Sapiens
FKRHKSLAL

SEQ ID NO: 297238 - protein, 9 aa, Homo Sapiens
LFYVVILVL

SEQ ID NO: 297239 - protein, 9 aa, Homo Sapiens
NFPIGHLNT

SEQ ID NO: 297240 - protein, 9 aa, Homo Sapiens
QTMHGRAVN

SEQ ID NO: 297241 - protein, 9 aa, Homo Sapiens
FDVFCQNNV

SEQ ID NO: 297242 - protein, 9 aa, Homo Sapiens
IFRADKSYT

SEQ ID NO: 297243 - protein, 9 aa, Homo Sapiens
HKLKLRVSG

SEQ ID NO: 297244 - protein, 9 aa, Homo Sapiens
LLSVPGQNN

SEQ ID NO: 297245 - protein, 9 aa, Homo Sapiens
HIFNTYRND

SEQ ID NO: 297246 - protein, 9 aa, Homo Sapiens
LDQKLEGGK

SEQ ID NO: 297247 - protein, 9 aa, Homo Sapiens
KVLEICDNE

SEQ ID NO: 297248 - protein, 9 aa, Homo Sapiens
SGQNSSVWG

SEQ ID NO: 297249 - protein, 9 aa, Homo Sapiens
RFTCSENQV

SEQ ID NO: 297250 - protein, 9 aa, Homo Sapiens
RHNALPTCI

SEQ ID NO: 297251 - protein, 9 aa, Homo Sapiens
GASINAVNI

SEQ ID NO: 297252 - protein, 9 aa, Homo Sapiens
NYSLIIHQR

SEQ ID NO: 297253 - protein, 9 aa, Homo Sapiens
EEEDGLRLK

SEQ ID NO: 297254 - protein, 9 aa, Homo Sapiens
PDEECERFR

SEQ ID NO: 297255 - protein, 9 aa, Homo Sapiens
ATLNVLAVD

SEQ ID NO: 297256 - protein, 9 aa, Homo Sapiens
CNWLARDMA

SEQ ID NO: 297257 - protein, 9 aa, Homo Sapiens
DLDQASMGA

SEQ ID NO: 297258 - protein, 9 aa, Homo Sapiens
VLRDMKAIG

SEQ ID NO: 297259 - protein, 9 aa, Homo Sapiens
GEPGQTEGK

SEQ ID NO: 297260 - protein, 9 aa, Homo Sapiens
FTSRLNRRT

SEQ ID NO: 297261 - protein, 9 aa, Homo Sapiens
YAIKDGGLC

SEQ ID NO: 297262 - protein, 9 aa, Homo Sapiens
WQQLKKLEE

SEQ ID NO: 297263 - protein, 9 aa, Homo Sapiens
ASSFTNSTW

SEQ ID NO: 297264 - protein, 9 aa, Homo Sapiens
SKPKHNHIL

SEQ ID NO: 297265 - protein, 9 aa, Homo Sapiens
ERPHTCKIC

SEQ ID NO: 297266 - protein, 9 aa, Homo Sapiens
RVQMRGKRR

SEQ ID NO: 297267 - protein, 9 aa, Homo Sapiens
FLDIWYTTA

SEQ ID NO: 297268 - protein, 9 aa, Homo Sapiens
GNSNKVVQM

SEQ ID NO: 297269 - protein, 9 aa, Homo Sapiens
CIEKLSGEV

SEQ ID NO: 297270 - protein, 9 aa, Homo Sapiens
AAPGIIWKL

SEQ ID NO: 297271 - protein, 9 aa, Homo Sapiens
LFDIPNILD

SEQ ID NO: 297272 - protein, 9 aa, Homo Sapiens
NRPGFPFLD

SEQ ID NO: 297273 - protein, 9 aa, Homo Sapiens
PECGSRDVS

SEQ ID NO: 297274 - protein, 9 aa, Homo Sapiens
NQNAISSSY

SEQ ID NO: 297275 - protein, 9 aa, Homo Sapiens
STFLVKIPE

SEQ ID NO: 297276 - protein, 9 aa, Homo Sapiens
DNLLVWDGA

SEQ ID NO: 297277 - protein, 9 aa, Homo Sapiens
RSLFVCLMF

SEQ ID NO: 297278 - protein, 9 aa, Homo Sapiens
AKKQDVDES

SEQ ID NO: 297279 - protein, 9 aa, Homo Sapiens
DVHKVNITK

SEQ ID NO: 297280 - protein, 9 aa, Homo Sapiens
EDLARLIIV

SEQ ID NO: 297281 - protein, 9 aa, Homo Sapiens
HTGQKTYRC

SEQ ID NO: 297282 - protein, 9 aa, Homo Sapiens
SQDNLVVHI

SEQ ID NO: 297283 - protein, 9 aa, Homo Sapiens
DEIEHLQNE

SEQ ID NO: 297284 - protein, 9 aa, Homo Sapiens
KFIPCRGHG

SEQ ID NO: 297285 - protein, 9 aa, Homo Sapiens
SSSLLQNEN

SEQ ID NO: 297286 - protein, 9 aa, Homo Sapiens
RKHILIFSP

SEQ ID NO: 297287 - protein, 9 aa, Homo Sapiens
RKKRVSQPS

SEQ ID NO: 297288 - protein, 9 aa, Homo Sapiens
QLLGHLSAD

SEQ ID NO: 297289 - protein, 9 aa, Homo Sapiens
ATNHVQVIV

SEQ ID NO: 297290 - protein, 9 aa, Homo Sapiens
YQDNINNLE

SEQ ID NO: 297291 - protein, 9 aa, Homo Sapiens
VIYRPHSPP

SEQ ID NO: 297292 - protein, 9 aa, Homo Sapiens
QPQEKGKVW

SEQ ID NO: 297293 - protein, 9 aa, Homo Sapiens
HIAKRAMDN

SEQ ID NO: 297294 - protein, 9 aa, Homo Sapiens
ENTYGNYYR

SEQ ID NO: 297295 - protein, 9 aa, Homo Sapiens
VTEIDPVCA

SEQ ID NO: 297296 - protein, 9 aa, Homo Sapiens
AESAAVWND

SEQ ID NO: 297297 - protein, 9 aa, Homo Sapiens
RKNMPASQR

SEQ ID NO: 297298 - protein, 9 aa, Homo Sapiens
KEDSEVSCF

SEQ ID NO: 297299 - protein, 9 aa, Homo Sapiens
SVLLFCPSN

SEQ ID NO: 297300 - protein, 9 aa, Homo Sapiens
GGPDYAKEI

SEQ ID NO: 297301 - protein, 9 aa, Homo Sapiens
NYFSPQTDK

SEQ ID NO: 297302 - protein, 9 aa, Homo Sapiens
ITTTDDYLQ

SEQ ID NO: 297303 - protein, 9 aa, Homo Sapiens
SAVQTCGFD

SEQ ID NO: 297304 - protein, 9 aa, Homo Sapiens
EVNHLYCDL

SEQ ID NO: 297305 - protein, 9 aa, Homo Sapiens
QQPQRHLTL

SEQ ID NO: 297306 - protein, 9 aa, Homo Sapiens
SFRDYIDLN

SEQ ID NO: 297307 - protein, 9 aa, Homo Sapiens
HYLAICQSL

SEQ ID NO: 297308 - protein, 9 aa, Homo Sapiens
VSRKGDLQI

SEQ ID NO: 297309 - protein, 9 aa, Homo Sapiens
KRVTVVEDF

SEQ ID NO: 297310 - protein, 9 aa, Homo Sapiens
QQGIYSIYE

SEQ ID NO: 297311 - protein, 9 aa, Homo Sapiens
FISVLLNIN

SEQ ID NO: 297312 - protein, 9 aa, Homo Sapiens
TTKTQSKEV

SEQ ID NO: 297313 - protein, 9 aa, Homo Sapiens
LLPEGFQDA

SEQ ID NO: 297314 - protein, 9 aa, Homo Sapiens
YYEENKFYK

SEQ ID NO: 297315 - protein, 9 aa, Homo Sapiens
NEVSKRVCI

SEQ ID NO: 297316 - protein, 9 aa, Homo Sapiens
SNNECLCTF

SEQ ID NO: 297317 - protein, 9 aa, Homo Sapiens
MDKLKGRTS

SEQ ID NO: 297318 - protein, 9 aa, Homo Sapiens
KQFLLFTEH

SEQ ID NO: 297319 - protein, 9 aa, Homo Sapiens
VKDKSASRG

SEQ ID NO: 297320 - protein, 9 aa, Homo Sapiens
IIDKVHLFV

SEQ ID NO: 297321 - protein, 9 aa, Homo Sapiens
AENKSPSEA

SEQ ID NO: 297322 - protein, 9 aa, Homo Sapiens
HNQFVVYRD

SEQ ID NO: 297323 - protein, 9 aa, Homo Sapiens
SKANYIKQR

SEQ ID NO: 297324 - protein, 9 aa, Homo Sapiens
MSASKRDLS

SEQ ID NO: 297325 - protein, 9 aa, Homo Sapiens
DKTGNVSRA

SEQ ID NO: 297326 - protein, 9 aa, Homo Sapiens
CKRNLEQDN

SEQ ID NO: 297327 - protein, 9 aa, Homo Sapiens
YCSLSHILT

SEQ ID NO: 297328 - protein, 9 aa, Homo Sapiens
NIVRKEVVK

SEQ ID NO: 297329 - protein, 9 aa, Homo Sapiens
QPLCISFKW

SEQ ID NO: 297330 - protein, 9 aa, Homo Sapiens
TFSLFAERK

SEQ ID NO: 297331 - protein, 9 aa, Homo Sapiens
SLAAESIFN

SEQ ID NO: 297332 - protein, 9 aa, Homo Sapiens
HPETLTLQA

SEQ ID NO: 297333 - protein, 9 aa, Homo Sapiens
MDSHIAEEK

SEQ ID NO: 297334 - protein, 9 aa, Homo Sapiens
KNKFKKEDL

SEQ ID NO: 297335 - protein, 9 aa, Homo Sapiens
RPFQKPINL

SEQ ID NO: 297336 - protein, 9 aa, Homo Sapiens
TKYSYKYPQ

SEQ ID NO: 297337 - protein, 9 aa, Homo Sapiens
KIYPYDVKA

SEQ ID NO: 297338 - protein, 9 aa, Homo Sapiens
ATDNVNKVG

SEQ ID NO: 297339 - protein, 9 aa, Homo Sapiens
QKENIPKYV

SEQ ID NO: 297340 - protein, 9 aa, Homo Sapiens
LRCEDLARL

SEQ ID NO: 297341 - protein, 9 aa, Homo Sapiens
EDNCCVGKI

SEQ ID NO: 297342 - protein, 9 aa, Homo Sapiens
GEIIVAHIK

SEQ ID NO: 297343 - protein, 9 aa, Homo Sapiens
HKIMALLSA

SEQ ID NO: 297344 - protein, 9 aa, Homo Sapiens
NYNANTLVM

SEQ ID NO: 297345 - protein, 9 aa, Homo Sapiens
YCGGKMAET

SEQ ID NO: 297346 - protein, 9 aa, Homo Sapiens
PPHPATFFC

SEQ ID NO: 297347 - protein, 9 aa, Homo Sapiens
NTVDLSFSP

SEQ ID NO: 297348 - protein, 9 aa, Homo Sapiens
DLKSMDEFI

SEQ ID NO: 297349 - protein, 9 aa, Homo Sapiens
DEMKKKFVQ

SEQ ID NO: 297350 - protein, 9 aa, Homo Sapiens
FVMWEVGYP

SEQ ID NO: 297351 - protein, 9 aa, Homo Sapiens
QRKYALKAV

SEQ ID NO: 297352 - protein, 9 aa, Homo Sapiens
KTPDLILQV

SEQ ID NO: 297353 - protein, 9 aa, Homo Sapiens
QTVCIRLVA

SEQ ID NO: 297354 - protein, 9 aa, Homo Sapiens
LVLLTQLGP

SEQ ID NO: 297355 - protein, 9 aa, Homo Sapiens
PTFTLSVVA

SEQ ID NO: 297356 - protein, 9 aa, Homo Sapiens
VVGAETALL

SEQ ID NO: 297357 - protein, 9 aa, Homo Sapiens
IMFDSDWNP

SEQ ID NO: 297358 - protein, 9 aa, Homo Sapiens
QPDDSDQTL

SEQ ID NO: 297359 - protein, 9 aa, Homo Sapiens
QHRRSRLLL

SEQ ID NO: 297360 - protein, 9 aa, Homo Sapiens
HLPIVTLFY

SEQ ID NO: 297361 - protein, 9 aa, Homo Sapiens
RYKLCDNKW

SEQ ID NO: 297362 - protein, 9 aa, Homo Sapiens
PKIISFLYD

SEQ ID NO: 297363 - protein, 9 aa, Homo Sapiens
YFRDQTRFP

SEQ ID NO: 297364 - protein, 9 aa, Homo Sapiens
RKKELNNLL

SEQ ID NO: 297365 - protein, 9 aa, Homo Sapiens
VCIRTTKDE

SEQ ID NO: 297366 - protein, 9 aa, Homo Sapiens
VRYIIKKYF

SEQ ID NO: 297367 - protein, 9 aa, Homo Sapiens
ILTIMWKWI

SEQ ID NO: 297368 - protein, 9 aa, Homo Sapiens
VPLYKKICS

SEQ ID NO: 297369 - protein, 9 aa, Homo Sapiens
NCGSPHDSG

SEQ ID NO: 297370 - protein, 9 aa, Homo Sapiens
LEFNCKTKD

SEQ ID NO: 297371 - protein, 9 aa, Homo Sapiens
DQTPAGLMV

SEQ ID NO: 297372 - protein, 9 aa, Homo Sapiens
GKAATYNVD

SEQ ID NO: 297373 - protein, 9 aa, Homo Sapiens
TPNPPILSL

SEQ ID NO: 297374 - protein, 9 aa, Homo Sapiens
QKSLSCPEP

SEQ ID NO: 297375 - protein, 9 aa, Homo Sapiens
SEDFNVQEE

SEQ ID NO: 297376 - protein, 9 aa, Homo Sapiens
LGKKWEEHS

SEQ ID NO: 297377 - protein, 9 aa, Homo Sapiens
NLLRSLVTR

SEQ ID NO: 297378 - protein, 9 aa, Homo Sapiens
AMAQETGGN

SEQ ID NO: 297379 - protein, 9 aa, Homo Sapiens
GTAEKLDNS

SEQ ID NO: 297380 - protein, 9 aa, Homo Sapiens
NTTILTVIC

SEQ ID NO: 297381 - protein, 9 aa, Homo Sapiens
KTRHTRKTV

SEQ ID NO: 297382 - protein, 9 aa, Homo Sapiens
LLQIETAYD

SEQ ID NO: 297383 - protein, 9 aa, Homo Sapiens
LEEWLNTCF

SEQ ID NO: 297384 - protein, 9 aa, Homo Sapiens
PIGLCSLSY

SEQ ID NO: 297385 - protein, 9 aa, Homo Sapiens
EDGYKGTIL

SEQ ID NO: 297386 - protein, 9 aa, Homo Sapiens
LQKAITTME

SEQ ID NO: 297387 - protein, 9 aa, Homo Sapiens
EKTLRQMEE

SEQ ID NO: 297388 - protein, 9 aa, Homo Sapiens
RQLDDEIKL

SEQ ID NO: 297389 - protein, 9 aa, Homo Sapiens
DNVNLPPSS

SEQ ID NO: 297390 - protein, 9 aa, Homo Sapiens
MTYRLNFCG

SEQ ID NO: 297391 - protein, 9 aa, Homo Sapiens
NICLLQTLS

SEQ ID NO: 297392 - protein, 9 aa, Homo Sapiens
TTHIFNTYR

SEQ ID NO: 297393 - protein, 9 aa, Homo Sapiens
GNIVRKEVV

SEQ ID NO: 297394 - protein, 9 aa, Homo Sapiens
VFWICMTWF

SEQ ID NO: 297395 - protein, 9 aa, Homo Sapiens
KNVTKEDLE

SEQ ID NO: 297396 - protein, 9 aa, Homo Sapiens
QWHSIREIN

SEQ ID NO: 297397 - protein, 9 aa, Homo Sapiens
NCTYFKLFT

SEQ ID NO: 297398 - protein, 9 aa, Homo Sapiens
VFLFTNLKY

SEQ ID NO: 297399 - protein, 9 aa, Homo Sapiens
AFEFEGMGV

SEQ ID NO: 297400 - protein, 9 aa, Homo Sapiens
SAMQMLNMD

SEQ ID NO: 297401 - protein, 9 aa, Homo Sapiens
FLWKLHVRG

SEQ ID NO: 297402 - protein, 9 aa, Homo Sapiens
FTVGACLFH

SEQ ID NO: 297403 - protein, 9 aa, Homo Sapiens
WLTRFKQWH

SEQ ID NO: 297404 - protein, 9 aa, Homo Sapiens
NFVKEKNVV

SEQ ID NO: 297405 - protein, 9 aa, Homo Sapiens
DFVSSTRNT

SEQ ID NO: 297406 - protein, 9 aa, Homo Sapiens
TPGSCRHEK

SEQ ID NO: 297407 - protein, 9 aa, Homo Sapiens
LDSGMSGIK

SEQ ID NO: 297408 - protein, 9 aa, Homo Sapiens
GASALNRVC

SEQ ID NO: 297409 - protein, 9 aa, Homo Sapiens
MQQQRQQFL

SEQ ID NO: 297410 - protein, 9 aa, Homo Sapiens
KISYHLCDL

SEQ ID NO: 297411 - protein, 9 aa, Homo Sapiens
QFQWLRALL

SEQ ID NO: 297412 - protein, 9 aa, Homo Sapiens
PGKKGHRGD

SEQ ID NO: 297413 - protein, 9 aa, Homo Sapiens
RHHVGRVAL

SEQ ID NO: 297414 - protein, 9 aa, Homo Sapiens
QRSKQSSFC

SEQ ID NO: 297415 - protein, 9 aa, Homo Sapiens
THLTHQILH

SEQ ID NO: 297416 - protein, 9 aa, Homo Sapiens
GDDQPNSSS

SEQ ID NO: 297417 - protein, 9 aa, Homo Sapiens
ILVYKVACN

SEQ ID NO: 297418 - protein, 9 aa, Homo Sapiens
TYFDVAVLH

SEQ ID NO: 297419 - protein, 9 aa, Homo Sapiens
VLGGSGYNL

SEQ ID NO: 297420 - protein, 9 aa, Homo Sapiens
GMKNGVGRF

SEQ ID NO: 297421 - protein, 9 aa, Homo Sapiens
VVGMVGSLP

SEQ ID NO: 297422 - protein, 9 aa, Homo Sapiens
LWLFPFSSK

SEQ ID NO: 297423 - protein, 9 aa, Homo Sapiens
NGPDRPFKC

SEQ ID NO: 297424 - protein, 9 aa, Homo Sapiens
KFWCQQTSP

SEQ ID NO: 297425 - protein, 9 aa, Homo Sapiens
IVAHIKKCS

SEQ ID NO: 297426 - protein, 9 aa, Homo Sapiens
MYHLIRGQP

SEQ ID NO: 297427 - protein, 9 aa, Homo Sapiens
RRSPPHPAT

SEQ ID NO: 297428 - protein, 9 aa, Homo Sapiens
ILSLPLVGL

SEQ ID NO: 297429 - protein, 9 aa, Homo Sapiens
GEQSRQSAH

SEQ ID NO: 297430 - protein, 9 aa, Homo Sapiens
SQHVVKQLE

SEQ ID NO: 297431 - protein, 9 aa, Homo Sapiens
YENAHGHQH

SEQ ID NO: 297432 - protein, 9 aa, Homo Sapiens
VIQEEKPNK

SEQ ID NO: 297433 - protein, 9 aa, Homo Sapiens
SRKDNIFMY

SEQ ID NO: 297434 - protein, 9 aa, Homo Sapiens
LATQARKGF

SEQ ID NO: 297435 - protein, 9 aa, Homo Sapiens
YRYKQDELF

SEQ ID NO: 297436 - protein, 9 aa, Homo Sapiens
TLSSTLNTH

SEQ ID NO: 297437 - protein, 9 aa, Homo Sapiens
RGGHKIILA

SEQ ID NO: 297438 - protein, 9 aa, Homo Sapiens
RHSKRKDSQ

SEQ ID NO: 297439 - protein, 9 aa, Homo Sapiens
YQMDDVYKE

SEQ ID NO: 297440 - protein, 9 aa, Homo Sapiens
SNFIQINTK

SEQ ID NO: 297441 - protein, 9 aa, Homo Sapiens
RFVKYLGLS

SEQ ID NO: 297442 - protein, 9 aa, Homo Sapiens
VSYHDMEYT

SEQ ID NO: 297443 - protein, 9 aa, Homo Sapiens
FVCQIMYVF

SEQ ID NO: 297444 - protein, 9 aa, Homo Sapiens
EQAFRAINR

SEQ ID NO: 297445 - protein, 9 aa, Homo Sapiens
FRDAETDQI

SEQ ID NO: 297446 - protein, 9 aa, Homo Sapiens
NIKSANFNW

SEQ ID NO: 297447 - protein, 9 aa, Homo Sapiens
QMAAFKEGV

SEQ ID NO: 297448 - protein, 9 aa, Homo Sapiens
GKFPFAKCF

SEQ ID NO: 297449 - protein, 9 aa, Homo Sapiens
SSQKIYLRL

SEQ ID NO: 297450 - protein, 9 aa, Homo Sapiens
FIFWAPYNI

SEQ ID NO: 297451 - protein, 9 aa, Homo Sapiens
QESIFDIIF

SEQ ID NO: 297452 - protein, 9 aa, Homo Sapiens
KLYPKFASP

SEQ ID NO: 297453 - protein, 9 aa, Homo Sapiens
CELDKAVQM

SEQ ID NO: 297454 - protein, 9 aa, Homo Sapiens
TKLWGIRVA

SEQ ID NO: 297455 - protein, 9 aa, Homo Sapiens
EKHTKHKKE

SEQ ID NO: 297456 - protein, 9 aa, Homo Sapiens
FDFPYHLQG

SEQ ID NO: 297457 - protein, 9 aa, Homo Sapiens
GYYYRYNVS

SEQ ID NO: 297458 - protein, 9 aa, Homo Sapiens
AEELFVKYK

SEQ ID NO: 297459 - protein, 9 aa, Homo Sapiens
VSGICAIAG

SEQ ID NO: 297460 - protein, 9 aa, Homo Sapiens
QNHRDASSL

SEQ ID NO: 297461 - protein, 9 aa, Homo Sapiens
QKCHILSGT

SEQ ID NO: 297462 - protein, 9 aa, Homo Sapiens
ACSKPIEPC

SEQ ID NO: 297463 - protein, 9 aa, Homo Sapiens
REVCKVKTI

SEQ ID NO: 297464 - protein, 9 aa, Homo Sapiens
KPFLSGPQR

SEQ ID NO: 297465 - protein, 9 aa, Homo Sapiens
VGLIKVTLH

SEQ ID NO: 297466 - protein, 9 aa, Homo Sapiens
FSLLFYVVI

SEQ ID NO: 297467 - protein, 9 aa, Homo Sapiens
KCFNQSSSR

SEQ ID NO: 297468 - protein, 9 aa, Homo Sapiens
NFFRYISTL

SEQ ID NO: 297469 - protein, 9 aa, Homo Sapiens
KWEEGKQKI

SEQ ID NO: 297470 - protein, 9 aa, Homo Sapiens
QNKNSQSFI

SEQ ID NO: 297471 - protein, 9 aa, Homo Sapiens
IKLSLPGYI

SEQ ID NO: 297472 - protein, 9 aa, Homo Sapiens
IIHTRERSY

SEQ ID NO: 297473 - protein, 9 aa, Homo Sapiens
LDKAVQMGM

SEQ ID NO: 297474 - protein, 9 aa, Homo Sapiens
TPRRVTEVC

SEQ ID NO: 297475 - protein, 9 aa, Homo Sapiens
AEVGCLVHL

SEQ ID NO: 297476 - protein, 9 aa, Homo Sapiens
IEYQWIQGW

SEQ ID NO: 297477 - protein, 9 aa, Homo Sapiens
LKKDKNEYL

SEQ ID NO: 297478 - protein, 9 aa, Homo Sapiens
ESIKNEPFT

SEQ ID NO: 297479 - protein, 9 aa, Homo Sapiens
PQEKGKVWV

SEQ ID NO: 297480 - protein, 9 aa, Homo Sapiens
EDESINAFR

SEQ ID NO: 297481 - protein, 9 aa, Homo Sapiens
PQNFIDNRI

SEQ ID NO: 297482 - protein, 9 aa, Homo Sapiens
YTFSFTVRD

SEQ ID NO: 297483 - protein, 9 aa, Homo Sapiens
CDRQSKEQM

SEQ ID NO: 297484 - protein, 9 aa, Homo Sapiens
PKIIFCDLR

SEQ ID NO: 297485 - protein, 9 aa, Homo Sapiens
LFSTKSSSA

SEQ ID NO: 297486 - protein, 9 aa, Homo Sapiens
KMNDRLDPS

SEQ ID NO: 297487 - protein, 9 aa, Homo Sapiens
FVKLGIINR

SEQ ID NO: 297488 - protein, 9 aa, Homo Sapiens
KKIARRGSS

SEQ ID NO: 297489 - protein, 9 aa, Homo Sapiens
RRGALTGGY

SEQ ID NO: 297490 - protein, 9 aa, Homo Sapiens
DSLSTKSCR

SEQ ID NO: 297491 - protein, 9 aa, Homo Sapiens
EIALANGFL

SEQ ID NO: 297492 - protein, 9 aa, Homo Sapiens
DASSSKMKA

SEQ ID NO: 297493 - protein, 9 aa, Homo Sapiens
TQEVSVQPS

SEQ ID NO: 297494 - protein, 9 aa, Homo Sapiens
LPSVTISEQ

SEQ ID NO: 297495 - protein, 9 aa, Homo Sapiens
FNKSISNAA

SEQ ID NO: 297496 - protein, 9 aa, Homo Sapiens
YMRLNSWFD

SEQ ID NO: 297497 - protein, 9 aa, Homo Sapiens
VSGGQIITS

SEQ ID NO: 297498 - protein, 9 aa, Homo Sapiens
IAWFSLEVS

SEQ ID NO: 297499 - protein, 9 aa, Homo Sapiens
RKFDFEACN

SEQ ID NO: 297500 - protein, 9 aa, Homo Sapiens
FSNPPDWSN

SEQ ID NO: 297501 - protein, 9 aa, Homo Sapiens
LRKHILIFS

SEQ ID NO: 297502 - protein, 9 aa, Homo Sapiens
NQQVKDVFW

SEQ ID NO: 297503 - protein, 9 aa, Homo Sapiens
RQLFSSVSC

SEQ ID NO: 297504 - protein, 9 aa, Homo Sapiens
VRGMQDKLA

SEQ ID NO: 297505 - protein, 9 aa, Homo Sapiens
NLLEEPEME

SEQ ID NO: 297506 - protein, 9 aa, Homo Sapiens
TNIKNYYKR

SEQ ID NO: 297507 - protein, 9 aa, Homo Sapiens
DVAVLHCLL

SEQ ID NO: 297508 - protein, 9 aa, Homo Sapiens
FALHSSEDP

SEQ ID NO: 297509 - protein, 9 aa, Homo Sapiens
SCLKTVAGL

SEQ ID NO: 297510 - protein, 9 aa, Homo Sapiens
LCRRLNTVN

SEQ ID NO: 297511 - protein, 9 aa, Homo Sapiens
VSSTRNTNI

SEQ ID NO: 297512 - protein, 9 aa, Homo Sapiens
SNPYIQLGS

SEQ ID NO: 297513 - protein, 9 aa, Homo Sapiens
LTLQEARVL

SEQ ID NO: 297514 - protein, 9 aa, Homo Sapiens
GIWWTVLFI

SEQ ID NO: 297515 - protein, 9 aa, Homo Sapiens
ESDDETPLD

SEQ ID NO: 297516 - protein, 9 aa, Homo Sapiens
QKYHNTICG

SEQ ID NO: 297517 - protein, 9 aa, Homo Sapiens
QSPVLQIII

SEQ ID NO: 297518 - protein, 9 aa, Homo Sapiens
IIRTNRTTF

SEQ ID NO: 297519 - protein, 9 aa, Homo Sapiens
TLVRKAMLN

SEQ ID NO: 297520 - protein, 9 aa, Homo Sapiens
KIKYEDLSG

SEQ ID NO: 297521 - protein, 9 aa, Homo Sapiens
YISSVLQAH

SEQ ID NO: 297522 - protein, 9 aa, Homo Sapiens
DALELSQNP

SEQ ID NO: 297523 - protein, 9 aa, Homo Sapiens
QQASKNTSQ

SEQ ID NO: 297524 - protein, 9 aa, Homo Sapiens
EMYTLAAMH

SEQ ID NO: 297525 - protein, 9 aa, Homo Sapiens
TFCDVTVLI

SEQ ID NO: 297526 - protein, 9 aa, Homo Sapiens
ETCAPSSPR

SEQ ID NO: 297527 - protein, 9 aa, Homo Sapiens
NNSLSGLSI

SEQ ID NO: 297528 - protein, 9 aa, Homo Sapiens
LRHKLKLRV

SEQ ID NO: 297529 - protein, 9 aa, Homo Sapiens
IWVLCTVAA

SEQ ID NO: 297530 - protein, 9 aa, Homo Sapiens
ILIIGSKVD

SEQ ID NO: 297531 - protein, 9 aa, Homo Sapiens
HSLTVTTAM

SEQ ID NO: 297532 - protein, 9 aa, Homo Sapiens
TGSLSASGR

SEQ ID NO: 297533 - protein, 9 aa, Homo Sapiens
WGLYIAVIF

SEQ ID NO: 297534 - protein, 9 aa, Homo Sapiens
KRVSQPSHP

SEQ ID NO: 297535 - protein, 9 aa, Homo Sapiens
VRRFGQSKC

SEQ ID NO: 297536 - protein, 9 aa, Homo Sapiens
EISILESNS

SEQ ID NO: 297537 - protein, 9 aa, Homo Sapiens
KLWGIRVAR

SEQ ID NO: 297538 - protein, 9 aa, Homo Sapiens
KVRNYVLLL

SEQ ID NO: 297539 - protein, 9 aa, Homo Sapiens
VCQIMYVFY

SEQ ID NO: 297540 - protein, 9 aa, Homo Sapiens
DALGYVARF

SEQ ID NO: 297541 - protein, 9 aa, Homo Sapiens
APVYNWSPQ

SEQ ID NO: 297542 - protein, 9 aa, Homo Sapiens
LHENRDKDT

SEQ ID NO: 297543 - protein, 9 aa, Homo Sapiens
FLYTGDSFL

SEQ ID NO: 297544 - protein, 9 aa, Homo Sapiens
QLVCTGSDN

SEQ ID NO: 297545 - protein, 9 aa, Homo Sapiens
TFVMWEVGY

SEQ ID NO: 297546 - protein, 9 aa, Homo Sapiens
QDTPVASRQ

SEQ ID NO: 297547 - protein, 9 aa, Homo Sapiens
QSAEAGLFV

SEQ ID NO: 297548 - protein, 9 aa, Homo Sapiens
LSEIQWEKN

SEQ ID NO: 297549 - protein, 9 aa, Homo Sapiens
VQQLILNLE

SEQ ID NO: 297550 - protein, 9 aa, Homo Sapiens
ADPLMDQGD

SEQ ID NO: 297551 - protein, 9 aa, Homo Sapiens
QDQEVAGRD

SEQ ID NO: 297552 - protein, 9 aa, Homo Sapiens
KANGGLQLL

SEQ ID NO: 297553 - protein, 9 aa, Homo Sapiens
IPSVENFYT

SEQ ID NO: 297554 - protein, 9 aa, Homo Sapiens
TAEKKDRDE

SEQ ID NO: 297555 - protein, 9 aa, Homo Sapiens
HFVQKHGEY

SEQ ID NO: 297556 - protein, 9 aa, Homo Sapiens
LQLYFFFSL

SEQ ID NO: 297557 - protein, 9 aa, Homo Sapiens
LHELSGDKI

SEQ ID NO: 297558 - protein, 9 aa, Homo Sapiens
VVISLSHTS

SEQ ID NO: 297559 - protein, 9 aa, Homo Sapiens
DKEMMLQNL

SEQ ID NO: 297560 - protein, 9 aa, Homo Sapiens
EESTEKAVE

SEQ ID NO: 297561 - protein, 9 aa, Homo Sapiens
LLGICLQSE

SEQ ID NO: 297562 - protein, 9 aa, Homo Sapiens
KIAELADKY

SEQ ID NO: 297563 - protein, 9 aa, Homo Sapiens
YMLSRDRET

SEQ ID NO: 297564 - protein, 9 aa, Homo Sapiens
PRSTRETLE

SEQ ID NO: 297565 - protein, 9 aa, Homo Sapiens
PEMVGMITA

SEQ ID NO: 297566 - protein, 9 aa, Homo Sapiens
PLNSRRSKL

SEQ ID NO: 297567 - protein, 9 aa, Homo Sapiens
LVVSINERQ

SEQ ID NO: 297568 - protein, 9 aa, Homo Sapiens
PVDVGFMVY

SEQ ID NO: 297569 - protein, 9 aa, Homo Sapiens
APKCALYES

SEQ ID NO: 297570 - protein, 9 aa, Homo Sapiens
PHEFPKSTR

SEQ ID NO: 297571 - protein, 9 aa, Homo Sapiens
LWGEPHAVT

SEQ ID NO: 297572 - protein, 9 aa, Homo Sapiens
LSQRLKDTR

SEQ ID NO: 297573 - protein, 9 aa, Homo Sapiens
MYHFVSVIS

SEQ ID NO: 297574 - protein, 9 aa, Homo Sapiens
RRMVLVQQY

SEQ ID NO: 297575 - protein, 9 aa, Homo Sapiens
VEGVRMEKI

SEQ ID NO: 297576 - protein, 9 aa, Homo Sapiens
TTSLVSMAS

SEQ ID NO: 297577 - protein, 9 aa, Homo Sapiens
VLPVKTLLE

SEQ ID NO: 297578 - protein, 9 aa, Homo Sapiens
EALKELGRM

SEQ ID NO: 297579 - protein, 9 aa, Homo Sapiens
RDFENNYNM

SEQ ID NO: 297580 - protein, 9 aa, Homo Sapiens
RDIERGSRE

SEQ ID NO: 297581 - protein, 9 aa, Homo Sapiens
LFYQRSLAS

SEQ ID NO: 297582 - protein, 9 aa, Homo Sapiens
PPPPPPVIQ

SEQ ID NO: 297583 - protein, 9 aa, Homo Sapiens
TASGCPLAV

SEQ ID NO: 297584 - protein, 9 aa, Homo Sapiens
EVQHVDLEI

SEQ ID NO: 297585 - protein, 9 aa, Homo Sapiens
SLQTLVEDV

SEQ ID NO: 297586 - protein, 9 aa, Homo Sapiens
SRPYKCSEC

SEQ ID NO: 297587 - protein, 9 aa, Homo Sapiens
EMVGMITAI

SEQ ID NO: 297588 - protein, 9 aa, Homo Sapiens
WTVLFIYTI

SEQ ID NO: 297589 - protein, 9 aa, Homo Sapiens
DQSSSSTSA

SEQ ID NO: 297590 - protein, 9 aa, Homo Sapiens
NNIDPALRR

SEQ ID NO: 297591 - protein, 9 aa, Homo Sapiens
PSPSENNSS

SEQ ID NO: 297592 - protein, 9 aa, Homo Sapiens
DKNAKKTTF

SEQ ID NO: 297593 - protein, 9 aa, Homo Sapiens
CPPCQHKLF

SEQ ID NO: 297594 - protein, 9 aa, Homo Sapiens
VQFPLWESS

SEQ ID NO: 297595 - protein, 9 aa, Homo Sapiens
SCKSRLLES

SEQ ID NO: 297596 - protein, 9 aa, Homo Sapiens
RKCFSEGGK

SEQ ID NO: 297597 - protein, 9 aa, Homo Sapiens
SLENAVCKL

SEQ ID NO: 297598 - protein, 9 aa, Homo Sapiens
QEWTTLYGE

SEQ ID NO: 297599 - protein, 9 aa, Homo Sapiens
AAPEKNVTK

SEQ ID NO: 297600 - protein, 9 aa, Homo Sapiens
NAVEATRIS

SEQ ID NO: 297601 - protein, 9 aa, Homo Sapiens
GKEFELCIY

SEQ ID NO: 297602 - protein, 9 aa, Homo Sapiens
YLPASASCV

SEQ ID NO: 297603 - protein, 9 aa, Homo Sapiens
NINDPRKNP

SEQ ID NO: 297604 - protein, 9 aa, Homo Sapiens
ELNLKGGTN

SEQ ID NO: 297605 - protein, 9 aa, Homo Sapiens
INSTEYPHG

SEQ ID NO: 297606 - protein, 9 aa, Homo Sapiens
EATSLSLEK

SEQ ID NO: 297607 - protein, 9 aa, Homo Sapiens
GLPNTSTNK

SEQ ID NO: 297608 - protein, 9 aa, Homo Sapiens
KTSILNSKD

SEQ ID NO: 297609 - protein, 9 aa, Homo Sapiens
LLNKSLDRE

SEQ ID NO: 297610 - protein, 9 aa, Homo Sapiens
STNKISWLY

SEQ ID NO: 297611 - protein, 9 aa, Homo Sapiens
GNHELTFYK

SEQ ID NO: 297612 - protein, 9 aa, Homo Sapiens
KIIPQELWE

SEQ ID NO: 297613 - protein, 9 aa, Homo Sapiens
WWYWQKENI

SEQ ID NO: 297614 - protein, 9 aa, Homo Sapiens
SVECLLERL

SEQ ID NO: 297615 - protein, 9 aa, Homo Sapiens
NIHTCNFVV

SEQ ID NO: 297616 - protein, 9 aa, Homo Sapiens
DNRTFSLFA

SEQ ID NO: 297617 - protein, 9 aa, Homo Sapiens
GIWVFIFKL

SEQ ID NO: 297618 - protein, 9 aa, Homo Sapiens
CIREMDQKG

SEQ ID NO: 297619 - protein, 9 aa, Homo Sapiens
QGNPKCRAL

SEQ ID NO: 297620 - protein, 9 aa, Homo Sapiens
TLNVLAVDP

SEQ ID NO: 297621 - protein, 9 aa, Homo Sapiens
GEENSTFLN

SEQ ID NO: 297622 - protein, 9 aa, Homo Sapiens
KHSYPFVTS

SEQ ID NO: 297623 - protein, 9 aa, Homo Sapiens
GEKQKVVIP

SEQ ID NO: 297624 - protein, 9 aa, Homo Sapiens
VAHNKRKMA

SEQ ID NO: 297625 - protein, 9 aa, Homo Sapiens
PLVGLLLFY

SEQ ID NO: 297626 - protein, 9 aa, Homo Sapiens
EGDITIFTE

SEQ ID NO: 297627 - protein, 9 aa, Homo Sapiens
SRTARPKGL

SEQ ID NO: 297628 - protein, 9 aa, Homo Sapiens
DLPPPPPLY

SEQ ID NO: 297629 - protein, 9 aa, Homo Sapiens
AYSKLNETQ

SEQ ID NO: 297630 - protein, 9 aa, Homo Sapiens
GLGLEIANN

SEQ ID NO: 297631 - protein, 9 aa, Homo Sapiens
QQPEAAPAH

SEQ ID NO: 297632 - protein, 9 aa, Homo Sapiens
VKQTETAEL

SEQ ID NO: 297633 - protein, 9 aa, Homo Sapiens
STEKAVECY

SEQ ID NO: 297634 - protein, 9 aa, Homo Sapiens
FNTDHLAWT

SEQ ID NO: 297635 - protein, 9 aa, Homo Sapiens
EDATSLGSQ

SEQ ID NO: 297636 - protein, 9 aa, Homo Sapiens
DDEFVCQIM

SEQ ID NO: 297637 - protein, 9 aa, Homo Sapiens
KIHYEAPLL

SEQ ID NO: 297638 - protein, 9 aa, Homo Sapiens
KVFTQNPHL

SEQ ID NO: 297639 - protein, 9 aa, Homo Sapiens
PKKREFVFN

SEQ ID NO: 297640 - protein, 9 aa, Homo Sapiens
DKLLLVLGA

SEQ ID NO: 297641 - protein, 9 aa, Homo Sapiens
EIILPMLLE

SEQ ID NO: 297642 - protein, 9 aa, Homo Sapiens
EDIKDKANK

SEQ ID NO: 297643 - protein, 9 aa, Homo Sapiens
EACVLQPDV

SEQ ID NO: 297644 - protein, 9 aa, Homo Sapiens
LRTASSYNS

SEQ ID NO: 297645 - protein, 9 aa, Homo Sapiens
LGGECNNTV

SEQ ID NO: 297646 - protein, 9 aa, Homo Sapiens
ETLWCHRWH

SEQ ID NO: 297647 - protein, 9 aa, Homo Sapiens
KTVCDISYV

SEQ ID NO: 297648 - protein, 9 aa, Homo Sapiens
QPFEDNEFI

SEQ ID NO: 297649 - protein, 9 aa, Homo Sapiens
LPSNKQPPS

SEQ ID NO: 297650 - protein, 9 aa, Homo Sapiens
MKHVNEIFQ

SEQ ID NO: 297651 - protein, 9 aa, Homo Sapiens
NAEVRQIEL

SEQ ID NO: 297652 - protein, 9 aa, Homo Sapiens
NLTDHNKIH

SEQ ID NO: 297653 - protein, 9 aa, Homo Sapiens
NCEQVSTES

SEQ ID NO: 297654 - protein, 9 aa, Homo Sapiens
ENICLLQTL

SEQ ID NO: 297655 - protein, 9 aa, Homo Sapiens
LRHIHLENN

SEQ ID NO: 297656 - protein, 9 aa, Homo Sapiens
ASHKLTVTI

SEQ ID NO: 297657 - protein, 9 aa, Homo Sapiens
GLFVLIYKM

SEQ ID NO: 297658 - protein, 9 aa, Homo Sapiens
GEKPFWCTF

SEQ ID NO: 297659 - protein, 9 aa, Homo Sapiens
PEMICILCL

SEQ ID NO: 297660 - protein, 9 aa, Homo Sapiens
RDLLSKNNR

SEQ ID NO: 297661 - protein, 9 aa, Homo Sapiens
VLFSLAASK

SEQ ID NO: 297662 - protein, 9 aa, Homo Sapiens
LVVELKYII

SEQ ID NO: 297663 - protein, 9 aa, Homo Sapiens
VILHLGTHT

SEQ ID NO: 297664 - protein, 9 aa, Homo Sapiens
GCNNTYNET

SEQ ID NO: 297665 - protein, 9 aa, Homo Sapiens
RKYYSMFED

SEQ ID NO: 297666 - protein, 9 aa, Homo Sapiens
IQTFNHTHL

SEQ ID NO: 297667 - protein, 9 aa, Homo Sapiens
GGPLTNKQT

SEQ ID NO: 297668 - protein, 9 aa, Homo Sapiens
YLIDLLTAD

SEQ ID NO: 297669 - protein, 9 aa, Homo Sapiens
SANGNSEAV

SEQ ID NO: 297670 - protein, 9 aa, Homo Sapiens
THAEINQQL

SEQ ID NO: 297671 - protein, 9 aa, Homo Sapiens
VCGLNTDGQ

SEQ ID NO: 297672 - protein, 9 aa, Homo Sapiens
VCKVKTIVM

SEQ ID NO: 297673 - protein, 9 aa, Homo Sapiens
AGSAMKWGL

SEQ ID NO: 297674 - protein, 9 aa, Homo Sapiens
KNFHNISNI

SEQ ID NO: 297675 - protein, 9 aa, Homo Sapiens
HASISGSSV

SEQ ID NO: 297676 - protein, 9 aa, Homo Sapiens
QSGPRVPWA

SEQ ID NO: 297677 - protein, 9 aa, Homo Sapiens
QPAGCTSSP

SEQ ID NO: 297678 - protein, 9 aa, Homo Sapiens
LYVYVLSLL

SEQ ID NO: 297679 - protein, 9 aa, Homo Sapiens
VLHLDVKPD

SEQ ID NO: 297680 - protein, 9 aa, Homo Sapiens
QQSSCQPAG

SEQ ID NO: 297681 - protein, 9 aa, Homo Sapiens
QKQLLHVKG

SEQ ID NO: 297682 - protein, 9 aa, Homo Sapiens
RDDVPKAKV

SEQ ID NO: 297683 - protein, 9 aa, Homo Sapiens
LDVEFLYNL

SEQ ID NO: 297684 - protein, 9 aa, Homo Sapiens
DIEAYDARA

SEQ ID NO: 297685 - protein, 9 aa, Homo Sapiens
FYRTGQLFS

SEQ ID NO: 297686 - protein, 9 aa, Homo Sapiens
QKMEDEYKN

SEQ ID NO: 297687 - protein, 9 aa, Homo Sapiens
LEFILAAHQ

SEQ ID NO: 297688 - protein, 9 aa, Homo Sapiens
ALILHQIIH

SEQ ID NO: 297689 - protein, 9 aa, Homo Sapiens
HLIRGQPVI

SEQ ID NO: 297690 - protein, 9 aa, Homo Sapiens
LQLQGEPQA

SEQ ID NO: 297691 - protein, 9 aa, Homo Sapiens
VDTATTSDV

SEQ ID NO: 297692 - protein, 9 aa, Homo Sapiens
EMATYDLPA

SEQ ID NO: 297693 - protein, 9 aa, Homo Sapiens
VRSGLFGQV

SEQ ID NO: 297694 - protein, 9 aa, Homo Sapiens
INERIQEVT

SEQ ID NO: 297695 - protein, 9 aa, Homo Sapiens
EKTGKCSEL

SEQ ID NO: 297696 - protein, 9 aa, Homo Sapiens
VLHGLCTSQ

SEQ ID NO: 297697 - protein, 9 aa, Homo Sapiens
ACDVDNLFF

SEQ ID NO: 297698 - protein, 9 aa, Homo Sapiens
CSRQWQLGV

SEQ ID NO: 297699 - protein, 9 aa, Homo Sapiens
GNNLERFIE

SEQ ID NO: 297700 - protein, 9 aa, Homo Sapiens
YSCTSIYKC

SEQ ID NO: 297701 - protein, 9 aa, Homo Sapiens
LSFLDIWYT

SEQ ID NO: 297702 - protein, 9 aa, Homo Sapiens
HVANPQLQM

SEQ ID NO: 297703 - protein, 9 aa, Homo Sapiens
TVLCELIHA

SEQ ID NO: 297704 - protein, 9 aa, Homo Sapiens
PVSGPQLDF

SEQ ID NO: 297705 - protein, 9 aa, Homo Sapiens
EIIEKLKSI

SEQ ID NO: 297706 - protein, 9 aa, Homo Sapiens
ASTYLPGEP

SEQ ID NO: 297707 - protein, 9 aa, Homo Sapiens
VCEHVKLLL

SEQ ID NO: 297708 - protein, 9 aa, Homo Sapiens
LFESENFDK

SEQ ID NO: 297709 - protein, 9 aa, Homo Sapiens
QKSMQNNAA

SEQ ID NO: 297710 - protein, 9 aa, Homo Sapiens
PLQKELNEY

SEQ ID NO: 297711 - protein, 9 aa, Homo Sapiens
PENVQSEER

SEQ ID NO: 297712 - protein, 9 aa, Homo Sapiens
SSQNGSLKT

SEQ ID NO: 297713 - protein, 9 aa, Homo Sapiens
VSFSNYLQK

SEQ ID NO: 297714 - protein, 9 aa, Homo Sapiens
DKVLADTKE

SEQ ID NO: 297715 - protein, 9 aa, Homo Sapiens
RPFKCPTCG

SEQ ID NO: 297716 - protein, 9 aa, Homo Sapiens
IHKYKRQLL

SEQ ID NO: 297717 - protein, 9 aa, Homo Sapiens
QINLQQQPP

SEQ ID NO: 297718 - protein, 9 aa, Homo Sapiens
SNVSNKYSS

SEQ ID NO: 297719 - protein, 9 aa, Homo Sapiens
QIELLNETS

SEQ ID NO: 297720 - protein, 9 aa, Homo Sapiens
DKSEGPCVR

SEQ ID NO: 297721 - protein, 9 aa, Homo Sapiens
VADIVFQTA

SEQ ID NO: 297722 - protein, 9 aa, Homo Sapiens
EAHISWFGS

SEQ ID NO: 297723 - protein, 9 aa, Homo Sapiens
AGPYTFPPT

SEQ ID NO: 297724 - protein, 9 aa, Homo Sapiens
FAGRKWKTF

SEQ ID NO: 297725 - protein, 9 aa, Homo Sapiens
NINNLELEV

SEQ ID NO: 297726 - protein, 9 aa, Homo Sapiens
PASWPLRPT

SEQ ID NO: 297727 - protein, 9 aa, Homo Sapiens
IRNKCGSAD

SEQ ID NO: 297728 - protein, 9 aa, Homo Sapiens
NWNDVDDCN

SEQ ID NO: 297729 - protein, 9 aa, Homo Sapiens
SFHVHFEDN

SEQ ID NO: 297730 - protein, 9 aa, Homo Sapiens
PFPINQAFV

SEQ ID NO: 297731 - protein, 9 aa, Homo Sapiens
SSPISKKLR

SEQ ID NO: 297732 - protein, 9 aa, Homo Sapiens
EVRKLQNAV

SEQ ID NO: 297733 - protein, 9 aa, Homo Sapiens
VLAVDPVAA

SEQ ID NO: 297734 - protein, 9 aa, Homo Sapiens
RNLFTKIGN

SEQ ID NO: 297735 - protein, 9 aa, Homo Sapiens
LINVLRREL

SEQ ID NO: 297736 - protein, 9 aa, Homo Sapiens
NSNIVNHQR

SEQ ID NO: 297737 - protein, 9 aa, Homo Sapiens
TDQRAREGK

SEQ ID NO: 297738 - protein, 9 aa, Homo Sapiens
SMDASSSKM

SEQ ID NO: 297739 - protein, 9 aa, Homo Sapiens
VTALVSQLI

SEQ ID NO: 297740 - protein, 9 aa, Homo Sapiens
HLFFSHHKI

SEQ ID NO: 297741 - protein, 9 aa, Homo Sapiens
DFRDVAIEF

SEQ ID NO: 297742 - protein, 9 aa, Homo Sapiens
PNASVVPVI

SEQ ID NO: 297743 - protein, 9 aa, Homo Sapiens
YGLDTSEDK

SEQ ID NO: 297744 - protein, 9 aa, Homo Sapiens
LQKCDILEL

SEQ ID NO: 297745 - protein, 9 aa, Homo Sapiens
VPGKMKGIK

SEQ ID NO: 297746 - protein, 9 aa, Homo Sapiens
NPVFYFILG

SEQ ID NO: 297747 - protein, 9 aa, Homo Sapiens
IFISCDLLT

SEQ ID NO: 297748 - protein, 9 aa, Homo Sapiens
LLIHNNVLE

SEQ ID NO: 297749 - protein, 9 aa, Homo Sapiens
VVGAVYSPK

SEQ ID NO: 297750 - protein, 9 aa, Homo Sapiens
CSKPIEPCL

SEQ ID NO: 297751 - protein, 9 aa, Homo Sapiens
KRKLKGKEG

SEQ ID NO: 297752 - protein, 9 aa, Homo Sapiens
TGRPFYKGI

SEQ ID NO: 297753 - protein, 9 aa, Homo Sapiens
HTEVFPGQR

SEQ ID NO: 297754 - protein, 9 aa, Homo Sapiens
MWQEYYFFN

SEQ ID NO: 297755 - protein, 9 aa, Homo Sapiens
YLSFQEVRE

SEQ ID NO: 297756 - protein, 9 aa, Homo Sapiens
LFSLNSKSG

SEQ ID NO: 297757 - protein, 9 aa, Homo Sapiens
TSPLKEDSE

SEQ ID NO: 297758 - protein, 9 aa, Homo Sapiens
RKKWLQEWK

SEQ ID NO: 297759 - protein, 9 aa, Homo Sapiens
TMYQKLRVE

SEQ ID NO: 297760 - protein, 9 aa, Homo Sapiens
GRQLDKVPE

SEQ ID NO: 297761 - protein, 9 aa, Homo Sapiens
SFWGCITQI

SEQ ID NO: 297762 - protein, 9 aa, Homo Sapiens
KYDSLDSDS

SEQ ID NO: 297763 - protein, 9 aa, Homo Sapiens
KDLAFEFEG

SEQ ID NO: 297764 - protein, 9 aa, Homo Sapiens
DLLCKIFVM

SEQ ID NO: 297765 - protein, 9 aa, Homo Sapiens
KTAVKFGNH

SEQ ID NO: 297766 - protein, 9 aa, Homo Sapiens
AQFGTVITL

SEQ ID NO: 297767 - protein, 9 aa, Homo Sapiens
KKSKNTKKH

SEQ ID NO: 297768 - protein, 9 aa, Homo Sapiens
DPYLLKCFN

SEQ ID NO: 297769 - protein, 9 aa, Homo Sapiens
SCLSSLHLH

SEQ ID NO: 297770 - protein, 9 aa, Homo Sapiens
YLHSLGKAQ

SEQ ID NO: 297771 - protein, 9 aa, Homo Sapiens
NKFKKEDLT

SEQ ID NO: 297772 - protein, 9 aa, Homo Sapiens
GTEGFWNAK

SEQ ID NO: 297773 - protein, 9 aa, Homo Sapiens
GLLGDLDTD

SEQ ID NO: 297774 - protein, 9 aa, Homo Sapiens
RAINRADYY

SEQ ID NO: 297775 - protein, 9 aa, Homo Sapiens
CLSSLHLHE

SEQ ID NO: 297776 - protein, 9 aa, Homo Sapiens
QNQEKRLWD

SEQ ID NO: 297777 - protein, 9 aa, Homo Sapiens
GKAFVRASS

SEQ ID NO: 297778 - protein, 9 aa, Homo Sapiens
AFSCLSSLH

SEQ ID NO: 297779 - protein, 9 aa, Homo Sapiens
IRLKDKIPH

SEQ ID NO: 297780 - protein, 9 aa, Homo Sapiens
MRKGAVGYW

SEQ ID NO: 297781 - protein, 9 aa, Homo Sapiens
NKENLLNIL

SEQ ID NO: 297782 - protein, 9 aa, Homo Sapiens
SICHLTLPD

SEQ ID NO: 297783 - protein, 9 aa, Homo Sapiens
SRRLPHSNS

SEQ ID NO: 297784 - protein, 9 aa, Homo Sapiens
FKKFNEISI

SEQ ID NO: 297785 - protein, 9 aa, Homo Sapiens
RPCPTSEDT

SEQ ID NO: 297786 - protein, 9 aa, Homo Sapiens
LGPRTSRQA

SEQ ID NO: 297787 - protein, 9 aa, Homo Sapiens
KDLMAHKAV

SEQ ID NO: 297788 - protein, 9 aa, Homo Sapiens
LCSSPGAPM

SEQ ID NO: 297789 - protein, 9 aa, Homo Sapiens
TIGKEFINL

SEQ ID NO: 297790 - protein, 9 aa, Homo Sapiens
PHALVINTL

SEQ ID NO: 297791 - protein, 9 aa, Homo Sapiens
QINHSGSFS

SEQ ID NO: 297792 - protein, 9 aa, Homo Sapiens
VTPQDHEIA

SEQ ID NO: 297793 - protein, 9 aa, Homo Sapiens
EELFQFLYP

SEQ ID NO: 297794 - protein, 9 aa, Homo Sapiens
TIPEDDGND

SEQ ID NO: 297795 - protein, 9 aa, Homo Sapiens
IINKLRAKD

SEQ ID NO: 297796 - protein, 9 aa, Homo Sapiens
MAPDIHDER

SEQ ID NO: 297797 - protein, 9 aa, Homo Sapiens
LHHLSCKML

SEQ ID NO: 297798 - protein, 9 aa, Homo Sapiens
FFVIVIILA

SEQ ID NO: 297799 - protein, 9 aa, Homo Sapiens
PPEDKMFLL

SEQ ID NO: 297800 - protein, 9 aa, Homo Sapiens
SKFFKTHGI

SEQ ID NO: 297801 - protein, 9 aa, Homo Sapiens
FKLPHPFLP

SEQ ID NO: 297802 - protein, 9 aa, Homo Sapiens
DGRMRLSQK

SEQ ID NO: 297803 - protein, 9 aa, Homo Sapiens
ISVAKIDSL

SEQ ID NO: 297804 - protein, 9 aa, Homo Sapiens
LRTSPDKRI

SEQ ID NO: 297805 - protein, 9 aa, Homo Sapiens
SPPPGWQPN

SEQ ID NO: 297806 - protein, 9 aa, Homo Sapiens
HCSAGESGL

SEQ ID NO: 297807 - protein, 9 aa, Homo Sapiens
YNNHDIRSG

SEQ ID NO: 297808 - protein, 9 aa, Homo Sapiens
LQREGMRQY

SEQ ID NO: 297809 - protein, 9 aa, Homo Sapiens
GINECKAFP

SEQ ID NO: 297810 - protein, 9 aa, Homo Sapiens
FKNQKDREA

SEQ ID NO: 297811 - protein, 9 aa, Homo Sapiens
HVIKRHRGD

SEQ ID NO: 297812 - protein, 9 aa, Homo Sapiens
VWEEYIIQT

SEQ ID NO: 297813 - protein, 9 aa, Homo Sapiens
YKTAEEKDK

SEQ ID NO: 297814 - protein, 9 aa, Homo Sapiens
QPRGPITPP

SEQ ID NO: 297815 - protein, 9 aa, Homo Sapiens
NANLTKMKS

SEQ ID NO: 297816 - protein, 9 aa, Homo Sapiens
SILDFYREL

SEQ ID NO: 297817 - protein, 9 aa, Homo Sapiens
IIFSPVMLL

SEQ ID NO: 297818 - protein, 9 aa, Homo Sapiens
SVDLCQKGL

SEQ ID NO: 297819 - protein, 9 aa, Homo Sapiens
ERKRSRANQ

SEQ ID NO: 297820 - protein, 9 aa, Homo Sapiens
SMGAVVSLL

SEQ ID NO: 297821 - protein, 9 aa, Homo Sapiens
NKLFRLNNF

SEQ ID NO: 297822 - protein, 9 aa, Homo Sapiens
SCSHSSWSA

SEQ ID NO: 297823 - protein, 9 aa, Homo Sapiens
YYTFALFTI

SEQ ID NO: 297824 - protein, 9 aa, Homo Sapiens
NPMLLELMT

SEQ ID NO: 297825 - protein, 9 aa, Homo Sapiens
SFSPTDNTF

SEQ ID NO: 297826 - protein, 9 aa, Homo Sapiens
NNLSFREDL

SEQ ID NO: 297827 - protein, 9 aa, Homo Sapiens
PKKRRIKIH

SEQ ID NO: 297828 - protein, 9 aa, Homo Sapiens
CLANTVDLS

SEQ ID NO: 297829 - protein, 9 aa, Homo Sapiens
SGDKILEKF

SEQ ID NO: 297830 - protein, 9 aa, Homo Sapiens
CMKLMQQQQ

SEQ ID NO: 297831 - protein, 9 aa, Homo Sapiens
HLWKADNTL

SEQ ID NO: 297832 - protein, 9 aa, Homo Sapiens
VPRESCKPV

SEQ ID NO: 297833 - protein, 9 aa, Homo Sapiens
TGQEKEKAS

SEQ ID NO: 297834 - protein, 9 aa, Homo Sapiens
LQKIREKRD

SEQ ID NO: 297835 - protein, 9 aa, Homo Sapiens
AANTLGMEE

SEQ ID NO: 297836 - protein, 9 aa, Homo Sapiens
AGMIPRARK

SEQ ID NO: 297837 - protein, 9 aa, Homo Sapiens
RVVGAETAL

SEQ ID NO: 297838 - protein, 9 aa, Homo Sapiens
TPQRRSHSP

SEQ ID NO: 297839 - protein, 9 aa, Homo Sapiens
EQQCFLFSK

SEQ ID NO: 297840 - protein, 9 aa, Homo Sapiens
QEERIMECS

SEQ ID NO: 297841 - protein, 9 aa, Homo Sapiens
TNKRIAVIG

SEQ ID NO: 297842 - protein, 9 aa, Homo Sapiens
LFVALLPVW

SEQ ID NO: 297843 - protein, 9 aa, Homo Sapiens
DKTGSFQIV

SEQ ID NO: 297844 - protein, 9 aa, Homo Sapiens
IVTDNKGTL

SEQ ID NO: 297845 - protein, 9 aa, Homo Sapiens
YKAAKETKV

SEQ ID NO: 297846 - protein, 9 aa, Homo Sapiens
AGLPGKKGH

SEQ ID NO: 297847 - protein, 9 aa, Homo Sapiens
RLILQQSQA

SEQ ID NO: 297848 - protein, 9 aa, Homo Sapiens
IHLKVLEIC

SEQ ID NO: 297849 - protein, 9 aa, Homo Sapiens
CVELSSDKQ

SEQ ID NO: 297850 - protein, 9 aa, Homo Sapiens
FKNTADQLT

SEQ ID NO: 297851 - protein, 9 aa, Homo Sapiens
SKDNCTGVQ

SEQ ID NO: 297852 - protein, 9 aa, Homo Sapiens
WTHRLRDRK

SEQ ID NO: 297853 - protein, 9 aa, Homo Sapiens
GEEQPPETT

SEQ ID NO: 297854 - protein, 9 aa, Homo Sapiens
KKVLYTAGK

SEQ ID NO: 297855 - protein, 9 aa, Homo Sapiens
PPKIHYEAP

SEQ ID NO: 297856 - protein, 9 aa, Homo Sapiens
SIYNGFFEC

SEQ ID NO: 297857 - protein, 9 aa, Homo Sapiens
KENHFLICV

SEQ ID NO: 297858 - protein, 9 aa, Homo Sapiens
DTCIMFDSD

SEQ ID NO: 297859 - protein, 9 aa, Homo Sapiens
CQPQRITYL

SEQ ID NO: 297860 - protein, 9 aa, Homo Sapiens
VYFIFWAPY

SEQ ID NO: 297861 - protein, 9 aa, Homo Sapiens
ILDVDADNQ

SEQ ID NO: 297862 - protein, 9 aa, Homo Sapiens
ALKSSSSVS

SEQ ID NO: 297863 - protein, 9 aa, Homo Sapiens
SLEVSSRLL

SEQ ID NO: 297864 - protein, 9 aa, Homo Sapiens
GKAFTLSST

SEQ ID NO: 297865 - protein, 9 aa, Homo Sapiens
TFLLLSVLA

SEQ ID NO: 297866 - protein, 9 aa, Homo Sapiens
HKIILAAFD

SEQ ID NO: 297867 - protein, 9 aa, Homo Sapiens
VNQQMVMAQ

SEQ ID NO: 297868 - protein, 9 aa, Homo Sapiens
EKQKVVIPP

SEQ ID NO: 297869 - protein, 9 aa, Homo Sapiens
SVHHQPPAD

SEQ ID NO: 297870 - protein, 9 aa, Homo Sapiens
DHNKIHTGE

SEQ ID NO: 297871 - protein, 9 aa, Homo Sapiens
AASHNSSLW

SEQ ID NO: 297872 - protein, 9 aa, Homo Sapiens
EVTRKQTVP

SEQ ID NO: 297873 - protein, 9 aa, Homo Sapiens
CVFNTLNKL

SEQ ID NO: 297874 - protein, 9 aa, Homo Sapiens
EMKKKFVQI

SEQ ID NO: 297875 - protein, 9 aa, Homo Sapiens
HDFHEGIRA

SEQ ID NO: 297876 - protein, 9 aa, Homo Sapiens
AEGKLLVKN

SEQ ID NO: 297877 - protein, 9 aa, Homo Sapiens
QICGAHRQT

SEQ ID NO: 297878 - protein, 9 aa, Homo Sapiens
YRNGTYIIY

SEQ ID NO: 297879 - protein, 9 aa, Homo Sapiens
YQFDFMGLI

SEQ ID NO: 297880 - protein, 9 aa, Homo Sapiens
ALEVKLNGQ

SEQ ID NO: 297881 - protein, 9 aa, Homo Sapiens
FLGASKFLL

SEQ ID NO: 297882 - protein, 9 aa, Homo Sapiens
RQLAVFIEA

SEQ ID NO: 297883 - protein, 9 aa, Homo Sapiens
SHNSSLWAQ

SEQ ID NO: 297884 - protein, 9 aa, Homo Sapiens
SSTSTSETF

SEQ ID NO: 297885 - protein, 9 aa, Homo Sapiens
FGEHFIASS

SEQ ID NO: 297886 - protein, 9 aa, Homo Sapiens
TFYKEFMAD

SEQ ID NO: 297887 - protein, 9 aa, Homo Sapiens
QKSFALGIQ

SEQ ID NO: 297888 - protein, 9 aa, Homo Sapiens
PFATGKHGS

SEQ ID NO: 297889 - protein, 9 aa, Homo Sapiens
FGVVWCNLS

SEQ ID NO: 297890 - protein, 9 aa, Homo Sapiens
SNKHSRLLL

SEQ ID NO: 297891 - protein, 9 aa, Homo Sapiens
SYLFDNPRR

SEQ ID NO: 297892 - protein, 9 aa, Homo Sapiens
SRNTDETLF

SEQ ID NO: 297893 - protein, 9 aa, Homo Sapiens
GLLSRANIL

SEQ ID NO: 297894 - protein, 9 aa, Homo Sapiens
LHPSGRFVI

SEQ ID NO: 297895 - protein, 9 aa, Homo Sapiens
YMVTMYQKL

SEQ ID NO: 297896 - protein, 9 aa, Homo Sapiens
AKNRISKKK

SEQ ID NO: 297897 - protein, 9 aa, Homo Sapiens
TSPSQYVPC

SEQ ID NO: 297898 - protein, 9 aa, Homo Sapiens
YILVRNVSL

SEQ ID NO: 297899 - protein, 9 aa, Homo Sapiens
ITALVAWVM

SEQ ID NO: 297900 - protein, 9 aa, Homo Sapiens
LTSMNSSPI

SEQ ID NO: 297901 - protein, 9 aa, Homo Sapiens
VLIFFSRAS

SEQ ID NO: 297902 - protein, 9 aa, Homo Sapiens
RHQRTHAGE

SEQ ID NO: 297903 - protein, 9 aa, Homo Sapiens
EIINLWCDI

SEQ ID NO: 297904 - protein, 9 aa, Homo Sapiens
QSHPSSTQI

SEQ ID NO: 297905 - protein, 9 aa, Homo Sapiens
HQGIFKINN

SEQ ID NO: 297906 - protein, 9 aa, Homo Sapiens
HKRTQQIQD

SEQ ID NO: 297907 - protein, 9 aa, Homo Sapiens
IRDKNKYNT

SEQ ID NO: 297908 - protein, 9 aa, Homo Sapiens
CAPEDKIWE

SEQ ID NO: 297909 - protein, 9 aa, Homo Sapiens
KQFCLLLNV

SEQ ID NO: 297910 - protein, 9 aa, Homo Sapiens
TATYTEEDD

SEQ ID NO: 297911 - protein, 9 aa, Homo Sapiens
YKYPQLSVH

SEQ ID NO: 297912 - protein, 9 aa, Homo Sapiens
LDIQGCNNT

SEQ ID NO: 297913 - protein, 9 aa, Homo Sapiens
PGIPPEWLF

SEQ ID NO: 297914 - protein, 9 aa, Homo Sapiens
VKLFDPKYQ

SEQ ID NO: 297915 - protein, 9 aa, Homo Sapiens
QLQMASPEE

SEQ ID NO: 297916 - protein, 9 aa, Homo Sapiens
EEFYEQFMS

SEQ ID NO: 297917 - protein, 9 aa, Homo Sapiens
ANVLATITT

SEQ ID NO: 297918 - protein, 9 aa, Homo Sapiens
NNNLQQEIS

SEQ ID NO: 297919 - protein, 9 aa, Homo Sapiens
SIKAEKRDV

SEQ ID NO: 297920 - protein, 9 aa, Homo Sapiens
LWCHRWHIF

SEQ ID NO: 297921 - protein, 9 aa, Homo Sapiens
GREALGKPS

SEQ ID NO: 297922 - protein, 9 aa, Homo Sapiens
LSPSAVELR

SEQ ID NO: 297923 - protein, 9 aa, Homo Sapiens
APVSGPQLD

SEQ ID NO: 297924 - protein, 9 aa, Homo Sapiens
KTMLESSLA

SEQ ID NO: 297925 - protein, 9 aa, Homo Sapiens
MKLSLGSLG

SEQ ID NO: 297926 - protein, 9 aa, Homo Sapiens
KDLKHANVV

SEQ ID NO: 297927 - protein, 9 aa, Homo Sapiens
LGCFIFKPD

SEQ ID NO: 297928 - protein, 9 aa, Homo Sapiens
EMDDRESIP

SEQ ID NO: 297929 - protein, 9 aa, Homo Sapiens
HRLRDRKQL

SEQ ID NO: 297930 - protein, 9 aa, Homo Sapiens
QNAKVNTGD

SEQ ID NO: 297931 - protein, 9 aa, Homo Sapiens
TGNVSRAVN

SEQ ID NO: 297932 - protein, 9 aa, Homo Sapiens
RRPLYGVIT

SEQ ID NO: 297933 - protein, 9 aa, Homo Sapiens
RGPWPLPLH

SEQ ID NO: 297934 - protein, 9 aa, Homo Sapiens
VHLMTLALS

SEQ ID NO: 297935 - protein, 9 aa, Homo Sapiens
LRVYLAKKQ

SEQ ID NO: 297936 - protein, 9 aa, Homo Sapiens
VQKKKPTVK

SEQ ID NO: 297937 - protein, 9 aa, Homo Sapiens
FKLVSTFNN

SEQ ID NO: 297938 - protein, 9 aa, Homo Sapiens
HFELFSLPP

SEQ ID NO: 297939 - protein, 9 aa, Homo Sapiens
VDRYIEELT

SEQ ID NO: 297940 - protein, 9 aa, Homo Sapiens
PSPPKAETT

SEQ ID NO: 297941 - protein, 9 aa, Homo Sapiens
LQTLAQAKK

SEQ ID NO: 297942 - protein, 9 aa, Homo Sapiens
NVSLNKGDF

SEQ ID NO: 297943 - protein, 9 aa, Homo Sapiens
DNEVYVLGA

SEQ ID NO: 297944 - protein, 9 aa, Homo Sapiens
PPLLPYDPA

SEQ ID NO: 297945 - protein, 9 aa, Homo Sapiens
RNSWNFKLP

SEQ ID NO: 297946 - protein, 9 aa, Homo Sapiens
KIQSLDQVT

SEQ ID NO: 297947 - protein, 9 aa, Homo Sapiens
TAVLMFYGY

SEQ ID NO: 297948 - protein, 9 aa, Homo Sapiens
EIAYDPKHF

SEQ ID NO: 297949 - protein, 9 aa, Homo Sapiens
KNNPGVVAY

SEQ ID NO: 297950 - protein, 9 aa, Homo Sapiens
SVSSTSSTP

SEQ ID NO: 297951 - protein, 9 aa, Homo Sapiens
SQTCRPDQF

SEQ ID NO: 297952 - protein, 9 aa, Homo Sapiens
GSQLPLFRI

SEQ ID NO: 297953 - protein, 9 aa, Homo Sapiens
YFSPQTDKL

SEQ ID NO: 297954 - protein, 9 aa, Homo Sapiens
DVGKEQCLF

SEQ ID NO: 297955 - protein, 9 aa, Homo Sapiens
RTSRQAQSH

SEQ ID NO: 297956 - protein, 9 aa, Homo Sapiens
EEKKASDQA

SEQ ID NO: 297957 - protein, 9 aa, Homo Sapiens
DMYGTVQES

SEQ ID NO: 297958 - protein, 9 aa, Homo Sapiens
GNAEGKGRY

SEQ ID NO: 297959 - protein, 9 aa, Homo Sapiens
TMLTFSSAT

SEQ ID NO: 297960 - protein, 9 aa, Homo Sapiens
DGSIQIEEA

SEQ ID NO: 297961 - protein, 9 aa, Homo Sapiens
IGALEVKLN

SEQ ID NO: 297962 - protein, 9 aa, Homo Sapiens
LFQALPGPP

SEQ ID NO: 297963 - protein, 9 aa, Homo Sapiens
SYRLVASGA

SEQ ID NO: 297964 - protein, 9 aa, Homo Sapiens
NYNPEEVCA

SEQ ID NO: 297965 - protein, 9 aa, Homo Sapiens
RKRTKHKKH

SEQ ID NO: 297966 - protein, 9 aa, Homo Sapiens
PSPTGKFYM

SEQ ID NO: 297967 - protein, 9 aa, Homo Sapiens
QQIIIHTHK

SEQ ID NO: 297968 - protein, 9 aa, Homo Sapiens
LTTNYVDFY

SEQ ID NO: 297969 - protein, 9 aa, Homo Sapiens
YNPYGPQTP

SEQ ID NO: 297970 - protein, 9 aa, Homo Sapiens
HHILHAGEK

SEQ ID NO: 297971 - protein, 9 aa, Homo Sapiens
NSIFGMAPM

SEQ ID NO: 297972 - protein, 9 aa, Homo Sapiens
KLKLGLISS

SEQ ID NO: 297973 - protein, 9 aa, Homo Sapiens
HKHSVKQTE

SEQ ID NO: 297974 - protein, 9 aa, Homo Sapiens
KIPHVRIQA

SEQ ID NO: 297975 - protein, 9 aa, Homo Sapiens
GQLCECVLF

SEQ ID NO: 297976 - protein, 9 aa, Homo Sapiens
RDDMSSIVQ

SEQ ID NO: 297977 - protein, 9 aa, Homo Sapiens
RSVLNNSGK

SEQ ID NO: 297978 - protein, 9 aa, Homo Sapiens
LLWHHRDEL

SEQ ID NO: 297979 - protein, 9 aa, Homo Sapiens
IEPCLSNPC

SEQ ID NO: 297980 - protein, 9 aa, Homo Sapiens
DCQQIIIHT

SEQ ID NO: 297981 - protein, 9 aa, Homo Sapiens
ATCGEKGPD

SEQ ID NO: 297982 - protein, 9 aa, Homo Sapiens
VFVELFSPR

SEQ ID NO: 297983 - protein, 9 aa, Homo Sapiens
DSEGQKHKH

SEQ ID NO: 297984 - protein, 9 aa, Homo Sapiens
FVETNVATW

SEQ ID NO: 297985 - protein, 9 aa, Homo Sapiens
SSNYQGSIH

SEQ ID NO: 297986 - protein, 9 aa, Homo Sapiens
ADEEEENDQ

SEQ ID NO: 297987 - protein, 9 aa, Homo Sapiens
NLFSTKSSS

SEQ ID NO: 297988 - protein, 9 aa, Homo Sapiens
LAGRYLMAC

SEQ ID NO: 297989 - protein, 9 aa, Homo Sapiens
NYLRAQIAQ

SEQ ID NO: 297990 - protein, 9 aa, Homo Sapiens
PLLCCRTPV

SEQ ID NO: 297991 - protein, 9 aa, Homo Sapiens
YPQLSVHVT

SEQ ID NO: 297992 - protein, 9 aa, Homo Sapiens
GVIKSILWQ

SEQ ID NO: 297993 - protein, 9 aa, Homo Sapiens
IDFDIIRNY

SEQ ID NO: 297994 - protein, 9 aa, Homo Sapiens
IDPLAYEIW

SEQ ID NO: 297995 - protein, 9 aa, Homo Sapiens
VAGIPRTNQ

SEQ ID NO: 297996 - protein, 9 aa, Homo Sapiens
THRLRDRKQ

SEQ ID NO: 297997 - protein, 9 aa, Homo Sapiens
PFWCTFEGC

SEQ ID NO: 297998 - protein, 9 aa, Homo Sapiens
KTPLFSGSA

SEQ ID NO: 297999 - protein, 9 aa, Homo Sapiens
AEGNPLTVE

SEQ ID NO: 298000 - protein, 9 aa, Homo Sapiens
KKYFFGLDT

SEQ ID NO: 298001 - protein, 9 aa, Homo Sapiens
KLLKKADTR

SEQ ID NO: 298002 - protein, 9 aa, Homo Sapiens
KALTKDDEQ

SEQ ID NO: 298003 - protein, 9 aa, Homo Sapiens
GVIPSIFDF

SEQ ID NO: 298004 - protein, 9 aa, Homo Sapiens
SKNVTSGTV

SEQ ID NO: 298005 - protein, 9 aa, Homo Sapiens
RDYIDLNAT

SEQ ID NO: 298006 - protein, 9 aa, Homo Sapiens
LGNLKLSFT

SEQ ID NO: 298007 - protein, 9 aa, Homo Sapiens
LVECLLRQK

SEQ ID NO: 298008 - protein, 9 aa, Homo Sapiens
DKQTKKAEG

SEQ ID NO: 298009 - protein, 9 aa, Homo Sapiens
SLLSVPGQN

SEQ ID NO: 298010 - protein, 9 aa, Homo Sapiens
MLLFKKSEQ

SEQ ID NO: 298011 - protein, 9 aa, Homo Sapiens
SQAPIHRPP

SEQ ID NO: 298012 - protein, 9 aa, Homo Sapiens
TFICQEKEQ

SEQ ID NO: 298013 - protein, 9 aa, Homo Sapiens
NRRHPQINF

SEQ ID NO: 298014 - protein, 9 aa, Homo Sapiens
VTVQLQNGD

SEQ ID NO: 298015 - protein, 9 aa, Homo Sapiens
YVLIFKNNI

SEQ ID NO: 298016 - protein, 9 aa, Homo Sapiens
IPSIFDFPY

SEQ ID NO: 298017 - protein, 9 aa, Homo Sapiens
VNSDRIDSL

SEQ ID NO: 298018 - protein, 9 aa, Homo Sapiens
DPSLLEDPN

SEQ ID NO: 298019 - protein, 9 aa, Homo Sapiens
AIKDGGLCF

SEQ ID NO: 298020 - protein, 9 aa, Homo Sapiens
EPPGKPGRP

SEQ ID NO: 298021 - protein, 9 aa, Homo Sapiens
LKKPRWIIL

SEQ ID NO: 298022 - protein, 9 aa, Homo Sapiens
WHLKSFFQI

SEQ ID NO: 298023 - protein, 9 aa, Homo Sapiens
KLMRHQIIH

SEQ ID NO: 298024 - protein, 9 aa, Homo Sapiens
ELARSYPRL

SEQ ID NO: 298025 - protein, 9 aa, Homo Sapiens
RDAVFMQFC

SEQ ID NO: 298026 - protein, 9 aa, Homo Sapiens
KIREKRDKK

SEQ ID NO: 298027 - protein, 9 aa, Homo Sapiens
SRQINGYQI

SEQ ID NO: 298028 - protein, 9 aa, Homo Sapiens
TAENKSPSE

SEQ ID NO: 298029 - protein, 9 aa, Homo Sapiens
FEDQQKINT

SEQ ID NO: 298030 - protein, 9 aa, Homo Sapiens
KELAGMLLS

SEQ ID NO: 298031 - protein, 9 aa, Homo Sapiens
CHKLLFAIS

SEQ ID NO: 298032 - protein, 9 aa, Homo Sapiens
TTTTPAGAS

SEQ ID NO: 298033 - protein, 9 aa, Homo Sapiens
QHQRFHTGN

SEQ ID NO: 298034 - protein, 9 aa, Homo Sapiens
RLYLPPDLS

SEQ ID NO: 298035 - protein, 9 aa, Homo Sapiens
NKCRLSEWI

SEQ ID NO: 298036 - protein, 9 aa, Homo Sapiens
LQNHLYGGL

SEQ ID NO: 298037 - protein, 9 aa, Homo Sapiens
ICRTCNLSL

SEQ ID NO: 298038 - protein, 9 aa, Homo Sapiens
ALKELGRMC

SEQ ID NO: 298039 - protein, 9 aa, Homo Sapiens
SPHTERENF

SEQ ID NO: 298040 - protein, 9 aa, Homo Sapiens
NLKTSDVSW

SEQ ID NO: 298041 - protein, 9 aa, Homo Sapiens
RKNGMMDHE

SEQ ID NO: 298042 - protein, 9 aa, Homo Sapiens
HFHVFVGGL

SEQ ID NO: 298043 - protein, 9 aa, Homo Sapiens
IQVNYWVGI

SEQ ID NO: 298044 - protein, 9 aa, Homo Sapiens
ARERVYELL

SEQ ID NO: 298045 - protein, 9 aa, Homo Sapiens
IASADGRKK

SEQ ID NO: 298046 - protein, 9 aa, Homo Sapiens
CCIVYLQYP

SEQ ID NO: 298047 - protein, 9 aa, Homo Sapiens
PGFKQLSCL

SEQ ID NO: 298048 - protein, 9 aa, Homo Sapiens
HHRAHYKTE

SEQ ID NO: 298049 - protein, 9 aa, Homo Sapiens
RAFDIVHKN

SEQ ID NO: 298050 - protein, 9 aa, Homo Sapiens
KCPTCGVRF

SEQ ID NO: 298051 - protein, 9 aa, Homo Sapiens
VLKYAKEVN

SEQ ID NO: 298052 - protein, 9 aa, Homo Sapiens
VASGADKDG

SEQ ID NO: 298053 - protein, 9 aa, Homo Sapiens
VTKKGLTLK

SEQ ID NO: 298054 - protein, 9 aa, Homo Sapiens
ETLKRENNN

SEQ ID NO: 298055 - protein, 9 aa, Homo Sapiens
KQFQYSASS

SEQ ID NO: 298056 - protein, 9 aa, Homo Sapiens
FHLLMVLEK

SEQ ID NO: 298057 - protein, 9 aa, Homo Sapiens
PPPHSLAAT

SEQ ID NO: 298058 - protein, 9 aa, Homo Sapiens
IILPMLLEL

SEQ ID NO: 298059 - protein, 9 aa, Homo Sapiens
VWAVFQNED

SEQ ID NO: 298060 - protein, 9 aa, Homo Sapiens
LKAGETIND

SEQ ID NO: 298061 - protein, 9 aa, Homo Sapiens
LNYLSFQEV

SEQ ID NO: 298062 - protein, 9 aa, Homo Sapiens
QFSPHLYNS

SEQ ID NO: 298063 - protein, 9 aa, Homo Sapiens
FNCSSTLNK

SEQ ID NO: 298064 - protein, 9 aa, Homo Sapiens
HAYYLQYKH

SEQ ID NO: 298065 - protein, 9 aa, Homo Sapiens
HPYLKLAKP

SEQ ID NO: 298066 - protein, 9 aa, Homo Sapiens
DSLHQQEIQ

SEQ ID NO: 298067 - protein, 9 aa, Homo Sapiens
YRRDDMSSI

SEQ ID NO: 298068 - protein, 9 aa, Homo Sapiens
YHFVSVISF

SEQ ID NO: 298069 - protein, 9 aa, Homo Sapiens
KVPQQTHRP

SEQ ID NO: 298070 - protein, 9 aa, Homo Sapiens
KMLPPLKTP

SEQ ID NO: 298071 - protein, 9 aa, Homo Sapiens
SQSAGITDI

SEQ ID NO: 298072 - protein, 9 aa, Homo Sapiens
TVCDISYVL

SEQ ID NO: 298073 - protein, 9 aa, Homo Sapiens
HQSIHTGKK

SEQ ID NO: 298074 - protein, 9 aa, Homo Sapiens
ICHQKIHTV

SEQ ID NO: 298075 - protein, 9 aa, Homo Sapiens
ALAFFNSLV

SEQ ID NO: 298076 - protein, 9 aa, Homo Sapiens
KALYGNAVL

SEQ ID NO: 298077 - protein, 9 aa, Homo Sapiens
KRVGYCSGG

SEQ ID NO: 298078 - protein, 9 aa, Homo Sapiens
CKNSYSSDV

SEQ ID NO: 298079 - protein, 9 aa, Homo Sapiens
DFTQNSNLA

SEQ ID NO: 298080 - protein, 9 aa, Homo Sapiens
QDNLVVHIP

SEQ ID NO: 298081 - protein, 9 aa, Homo Sapiens
KFYMGSRKG

SEQ ID NO: 298082 - protein, 9 aa, Homo Sapiens
VYFIAVDDD

SEQ ID NO: 298083 - protein, 9 aa, Homo Sapiens
AFRAINRAD

SEQ ID NO: 298084 - protein, 9 aa, Homo Sapiens
KDCKIRIFI

SEQ ID NO: 298085 - protein, 9 aa, Homo Sapiens
PNFGKMLDN

SEQ ID NO: 298086 - protein, 9 aa, Homo Sapiens
VKTLLEYLE

SEQ ID NO: 298087 - protein, 9 aa, Homo Sapiens
ICLVSGLVL

SEQ ID NO: 298088 - protein, 9 aa, Homo Sapiens
RKICCTDKL

SEQ ID NO: 298089 - protein, 9 aa, Homo Sapiens
ASDLPSPIY

SEQ ID NO: 298090 - protein, 9 aa, Homo Sapiens
TSAKTGYNM

SEQ ID NO: 298091 - protein, 9 aa, Homo Sapiens
IIVTIIQMD

SEQ ID NO: 298092 - protein, 9 aa, Homo Sapiens
QARLYDTAM

SEQ ID NO: 298093 - protein, 9 aa, Homo Sapiens
SIIHESDSI

SEQ ID NO: 298094 - protein, 9 aa, Homo Sapiens
TSILDFYRE

SEQ ID NO: 298095 - protein, 9 aa, Homo Sapiens
IFFHYSELS

SEQ ID NO: 298096 - protein, 9 aa, Homo Sapiens
PDSIEIVAT

SEQ ID NO: 298097 - protein, 9 aa, Homo Sapiens
VVELKYIIR

SEQ ID NO: 298098 - protein, 9 aa, Homo Sapiens
LRKKELNNL

SEQ ID NO: 298099 - protein, 9 aa, Homo Sapiens
PNRTEAMWD

SEQ ID NO: 298100 - protein, 9 aa, Homo Sapiens
SPGDKGEAG

SEQ ID NO: 298101 - protein, 9 aa, Homo Sapiens
ILAGRYLMA

SEQ ID NO: 298102 - protein, 9 aa, Homo Sapiens
QALIKKDGT

SEQ ID NO: 298103 - protein, 9 aa, Homo Sapiens
GRTTTTPAG

SEQ ID NO: 298104 - protein, 9 aa, Homo Sapiens
AVSLLGPNG

SEQ ID NO: 298105 - protein, 9 aa, Homo Sapiens
SIKEKETDK

SEQ ID NO: 298106 - protein, 9 aa, Homo Sapiens
TTYGQISNG

SEQ ID NO: 298107 - protein, 9 aa, Homo Sapiens
MREKRKLQP

SEQ ID NO: 298108 - protein, 9 aa, Homo Sapiens
VKFFYVVSL

SEQ ID NO: 298109 - protein, 9 aa, Homo Sapiens
QFLIYVMLE

SEQ ID NO: 298110 - protein, 9 aa, Homo Sapiens
EYDCQQIII

SEQ ID NO: 298111 - protein, 9 aa, Homo Sapiens
KHIQDQLGL

SEQ ID NO: 298112 - protein, 9 aa, Homo Sapiens
HAIYEKITA

SEQ ID NO: 298113 - protein, 9 aa, Homo Sapiens
TFSICKEIM

SEQ ID NO: 298114 - protein, 9 aa, Homo Sapiens
LSVDYLVEK

SEQ ID NO: 298115 - protein, 9 aa, Homo Sapiens
LAATLVKCE

SEQ ID NO: 298116 - protein, 9 aa, Homo Sapiens
IYYSCLDNK

SEQ ID NO: 298117 - protein, 9 aa, Homo Sapiens
LCNKLIAYS

SEQ ID NO: 298118 - protein, 9 aa, Homo Sapiens
HMGQILGET

SEQ ID NO: 298119 - protein, 9 aa, Homo Sapiens
VSDEDKAAE

SEQ ID NO: 298120 - protein, 9 aa, Homo Sapiens
LLNTNYRFL

SEQ ID NO: 298121 - protein, 9 aa, Homo Sapiens
YHHCQSKMK

SEQ ID NO: 298122 - protein, 9 aa, Homo Sapiens
NVPRESCKP

SEQ ID NO: 298123 - protein, 9 aa, Homo Sapiens
SSQSKETCA

SEQ ID NO: 298124 - protein, 9 aa, Homo Sapiens
KDNVSLNKG

SEQ ID NO: 298125 - protein, 9 aa, Homo Sapiens
HVGGEVSPH

SEQ ID NO: 298126 - protein, 9 aa, Homo Sapiens
TIDADINVT

SEQ ID NO: 298127 - protein, 9 aa, Homo Sapiens
LYQPDGLSD

SEQ ID NO: 298128 - protein, 9 aa, Homo Sapiens
NHHTLLDKT

SEQ ID NO: 298129 - protein, 9 aa, Homo Sapiens
RIFIGGKIN

SEQ ID NO: 298130 - protein, 9 aa, Homo Sapiens
AFVHWCVGE

SEQ ID NO: 298131 - protein, 9 aa, Homo Sapiens
PGRTTTTPA

SEQ ID NO: 298132 - protein, 9 aa, Homo Sapiens
KKQDKTGSF

SEQ ID NO: 298133 - protein, 9 aa, Homo Sapiens
DDVPKAKVL

SEQ ID NO: 298134 - protein, 9 aa, Homo Sapiens
ELICPMCMN

SEQ ID NO: 298135 - protein, 9 aa, Homo Sapiens
ANLNALDIY

SEQ ID NO: 298136 - protein, 9 aa, Homo Sapiens
ALDEMLTHN

SEQ ID NO: 298137 - protein, 9 aa, Homo Sapiens
LIYSFASIK

SEQ ID NO: 298138 - protein, 9 aa, Homo Sapiens
DPSHLRCHS

SEQ ID NO: 298139 - protein, 9 aa, Homo Sapiens
SVWGRGITR

SEQ ID NO: 298140 - protein, 9 aa, Homo Sapiens
FFYVVSLSH

SEQ ID NO: 298141 - protein, 9 aa, Homo Sapiens
NQKQFQWLR

SEQ ID NO: 298142 - protein, 9 aa, Homo Sapiens
DRQVEDDRQ

SEQ ID NO: 298143 - protein, 9 aa, Homo Sapiens
INCLKNLSS

SEQ ID NO: 298144 - protein, 9 aa, Homo Sapiens
PPVIQNGAR

SEQ ID NO: 298145 - protein, 9 aa, Homo Sapiens
VELEEFKKV

SEQ ID NO: 298146 - protein, 9 aa, Homo Sapiens
VRRTTKLKV

SEQ ID NO: 298147 - protein, 9 aa, Homo Sapiens
YDLYHADRA

SEQ ID NO: 298148 - protein, 9 aa, Homo Sapiens
LYLNPELIF

SEQ ID NO: 298149 - protein, 9 aa, Homo Sapiens
SCNSPNVTI

SEQ ID NO: 298150 - protein, 9 aa, Homo Sapiens
PAGYTLWED

SEQ ID NO: 298151 - protein, 9 aa, Homo Sapiens
QENHLGKQK

SEQ ID NO: 298152 - protein, 9 aa, Homo Sapiens
VIQASSFTN

SEQ ID NO: 298153 - protein, 9 aa, Homo Sapiens
FRDQTRFPV

SEQ ID NO: 298154 - protein, 9 aa, Homo Sapiens
INGKPQFYA

SEQ ID NO: 298155 - protein, 9 aa, Homo Sapiens
PCIVVANTI

SEQ ID NO: 298156 - protein, 9 aa, Homo Sapiens
EIKFQGLQQ

SEQ ID NO: 298157 - protein, 9 aa, Homo Sapiens
QGVGRHSLK

SEQ ID NO: 298158 - protein, 9 aa, Homo Sapiens
GHLNTLKEL

SEQ ID NO: 298159 - protein, 9 aa, Homo Sapiens
LSTQKLINA

SEQ ID NO: 298160 - protein, 9 aa, Homo Sapiens
IQPKVEENI

SEQ ID NO: 298161 - protein, 9 aa, Homo Sapiens
GQLSLGLKS

SEQ ID NO: 298162 - protein, 9 aa, Homo Sapiens
LTKDEGEDT

SEQ ID NO: 298163 - protein, 9 aa, Homo Sapiens
EGISAQQMS

SEQ ID NO: 298164 - protein, 9 aa, Homo Sapiens
AVYSPKFYA

SEQ ID NO: 298165 - protein, 9 aa, Homo Sapiens
PLEYQDKLK

SEQ ID NO: 298166 - protein, 9 aa, Homo Sapiens
DKDEDATSL

SEQ ID NO: 298167 - protein, 9 aa, Homo Sapiens
LIKLKESSA

SEQ ID NO: 298168 - protein, 9 aa, Homo Sapiens
ANMEIATKE

SEQ ID NO: 298169 - protein, 9 aa, Homo Sapiens
GFFYLFTGS

SEQ ID NO: 298170 - protein, 9 aa, Homo Sapiens
GLFDEKKKC

SEQ ID NO: 298171 - protein, 9 aa, Homo Sapiens
TLNILEEDN

SEQ ID NO: 298172 - protein, 9 aa, Homo Sapiens
HKNPDAFTF

SEQ ID NO: 298173 - protein, 9 aa, Homo Sapiens
KEKDLKEEL

SEQ ID NO: 298174 - protein, 9 aa, Homo Sapiens
HKYKRQLLN

SEQ ID NO: 298175 - protein, 9 aa, Homo Sapiens
HQESNDSHY

SEQ ID NO: 298176 - protein, 9 aa, Homo Sapiens
RIDTEMTTA

SEQ ID NO: 298177 - protein, 9 aa, Homo Sapiens
IDGKAVLLL

SEQ ID NO: 298178 - protein, 9 aa, Homo Sapiens
HQNTHTGDK

SEQ ID NO: 298179 - protein, 9 aa, Homo Sapiens
EKVVSMLYT

SEQ ID NO: 298180 - protein, 9 aa, Homo Sapiens
NHKHHDTFT

SEQ ID NO: 298181 - protein, 9 aa, Homo Sapiens
SNKQPPSIS

SEQ ID NO: 298182 - protein, 9 aa, Homo Sapiens
LDIEQLSVV

SEQ ID NO: 298183 - protein, 9 aa, Homo Sapiens
ALFVALLPV

SEQ ID NO: 298184 - protein, 9 aa, Homo Sapiens
VTIHGEDDL

SEQ ID NO: 298185 - protein, 9 aa, Homo Sapiens
YGKQKTYQK

SEQ ID NO: 298186 - protein, 9 aa, Homo Sapiens
IHHFVKKVW

SEQ ID NO: 298187 - protein, 9 aa, Homo Sapiens
AAGQLKYSV

SEQ ID NO: 298188 - protein, 9 aa, Homo Sapiens
NNLQEALID

SEQ ID NO: 298189 - protein, 9 aa, Homo Sapiens
EEHEGFEHN

SEQ ID NO: 298190 - protein, 9 aa, Homo Sapiens
ICEDGNSIS

SEQ ID NO: 298191 - protein, 9 aa, Homo Sapiens
PSLSLENNG

SEQ ID NO: 298192 - protein, 9 aa, Homo Sapiens
SQERVAELM

SEQ ID NO: 298193 - protein, 9 aa, Homo Sapiens
PNKKKKAQE

SEQ ID NO: 298194 - protein, 9 aa, Homo Sapiens
PAKEKTSFE

SEQ ID NO: 298195 - protein, 9 aa, Homo Sapiens
NILHQTEEG

SEQ ID NO: 298196 - protein, 9 aa, Homo Sapiens
YLIQHKIIH

SEQ ID NO: 298197 - protein, 9 aa, Homo Sapiens
EMLKMFMSL

SEQ ID NO: 298198 - protein, 9 aa, Homo Sapiens
LRVDQIRGN

SEQ ID NO: 298199 - protein, 9 aa, Homo Sapiens
KCLGKCRGQ

SEQ ID NO: 298200 - protein, 9 aa, Homo Sapiens
IIHQITHTG

SEQ ID NO: 298201 - protein, 9 aa, Homo Sapiens
SEEPFMPAE

SEQ ID NO: 298202 - protein, 9 aa, Homo Sapiens
RPGKFEKII

SEQ ID NO: 298203 - protein, 9 aa, Homo Sapiens
SMQNNAAVF

SEQ ID NO: 298204 - protein, 9 aa, Homo Sapiens
FTQNSNLAN

SEQ ID NO: 298205 - protein, 9 aa, Homo Sapiens
RQGKLQLQK

SEQ ID NO: 298206 - protein, 9 aa, Homo Sapiens
HLFPKQKCF

SEQ ID NO: 298207 - protein, 9 aa, Homo Sapiens
CFYYAIKDG

SEQ ID NO: 298208 - protein, 9 aa, Homo Sapiens
STKDFLPDP

SEQ ID NO: 298209 - protein, 9 aa, Homo Sapiens
QAELVNYEQ

SEQ ID NO: 298210 - protein, 9 aa, Homo Sapiens
DYLINNGSK

SEQ ID NO: 298211 - protein, 9 aa, Homo Sapiens
KEEKVALDP

SEQ ID NO: 298212 - protein, 9 aa, Homo Sapiens
TVLQKEVQR

SEQ ID NO: 298213 - protein, 9 aa, Homo Sapiens
KRGVHIKSA

SEQ ID NO: 298214 - protein, 9 aa, Homo Sapiens
DSSNVSNKY

SEQ ID NO: 298215 - protein, 9 aa, Homo Sapiens
MILVVQNDL

SEQ ID NO: 298216 - protein, 9 aa, Homo Sapiens
GWLKAEQQE

SEQ ID NO: 298217 - protein, 9 aa, Homo Sapiens
IDAYVCIRT

SEQ ID NO: 298218 - protein, 9 aa, Homo Sapiens
AWGQRRNMP

SEQ ID NO: 298219 - protein, 9 aa, Homo Sapiens
QPQAPRKEI

SEQ ID NO: 298220 - protein, 9 aa, Homo Sapiens
QADSEDNLL

SEQ ID NO: 298221 - protein, 9 aa, Homo Sapiens
EFSHRSRKI

SEQ ID NO: 298222 - protein, 9 aa, Homo Sapiens
TVKNRMIQL

SEQ ID NO: 298223 - protein, 9 aa, Homo Sapiens
CNLSALLYL

SEQ ID NO: 298224 - protein, 9 aa, Homo Sapiens
SYSYIITTI

SEQ ID NO: 298225 - protein, 9 aa, Homo Sapiens
AIDVDKVVG

SEQ ID NO: 298226 - protein, 9 aa, Homo Sapiens
RKKLEQHIQ

SEQ ID NO: 298227 - protein, 9 aa, Homo Sapiens
LEDKMVQQL

SEQ ID NO: 298228 - protein, 9 aa, Homo Sapiens
ELLNTNYRF

SEQ ID NO: 298229 - protein, 9 aa, Homo Sapiens
WRSLNFGIM

SEQ ID NO: 298230 - protein, 9 aa, Homo Sapiens
ACEAVNRMF

SEQ ID NO: 298231 - protein, 9 aa, Homo Sapiens
EVLLRTPYT

SEQ ID NO: 298232 - protein, 9 aa, Homo Sapiens
KPFSNPKYM

SEQ ID NO: 298233 - protein, 9 aa, Homo Sapiens
TDLQKMMKV

SEQ ID NO: 298234 - protein, 9 aa, Homo Sapiens
LTFILHNFN

SEQ ID NO: 298235 - protein, 9 aa, Homo Sapiens
GGSPTNDIE

SEQ ID NO: 298236 - protein, 9 aa, Homo Sapiens
MGYKDTDGE

SEQ ID NO: 298237 - protein, 9 aa, Homo Sapiens
QTDSLFPSP

SEQ ID NO: 298238 - protein, 9 aa, Homo Sapiens
LSERYVAKH

SEQ ID NO: 298239 - protein, 9 aa, Homo Sapiens
KEEQEEVEN

SEQ ID NO: 298240 - protein, 9 aa, Homo Sapiens
VLAKVQIEG

SEQ ID NO: 298241 - protein, 9 aa, Homo Sapiens
SSTLNKHKI

SEQ ID NO: 298242 - protein, 9 aa, Homo Sapiens
DHSRFGILD

SEQ ID NO: 298243 - protein, 9 aa, Homo Sapiens
GAYITKVDL

SEQ ID NO: 298244 - protein, 9 aa, Homo Sapiens
QYTEAEELF

SEQ ID NO: 298245 - protein, 9 aa, Homo Sapiens
SPDQCCIVY

SEQ ID NO: 298246 - protein, 9 aa, Homo Sapiens
LLMRDMQQM

SEQ ID NO: 298247 - protein, 9 aa, Homo Sapiens
PAIIRHKAL

SEQ ID NO: 298248 - protein, 9 aa, Homo Sapiens
FLISLILIY

SEQ ID NO: 298249 - protein, 9 aa, Homo Sapiens
HRESDNSGD

SEQ ID NO: 298250 - protein, 9 aa, Homo Sapiens
GLRVQAEGQ

SEQ ID NO: 298251 - protein, 9 aa, Homo Sapiens
IIIMELDMQ

SEQ ID NO: 298252 - protein, 9 aa, Homo Sapiens
LLDNYLINN

SEQ ID NO: 298253 - protein, 9 aa, Homo Sapiens
TPDKIQFEI

SEQ ID NO: 298254 - protein, 9 aa, Homo Sapiens
MKHLSGPQQ

SEQ ID NO: 298255 - protein, 9 aa, Homo Sapiens
VCCNDTRVF

SEQ ID NO: 298256 - protein, 9 aa, Homo Sapiens
MLSITGNIT

SEQ ID NO: 298257 - protein, 9 aa, Homo Sapiens
EDKMFLLDP

SEQ ID NO: 298258 - protein, 9 aa, Homo Sapiens
LQCTSSGNR

SEQ ID NO: 298259 - protein, 9 aa, Homo Sapiens
EKPFWCTFE

SEQ ID NO: 298260 - protein, 9 aa, Homo Sapiens
ATRASPTAG

SEQ ID NO: 298261 - protein, 9 aa, Homo Sapiens
VPIIWLNET

SEQ ID NO: 298262 - protein, 9 aa, Homo Sapiens
MAQLKMSQG

SEQ ID NO: 298263 - protein, 9 aa, Homo Sapiens
YSQEERHNA

SEQ ID NO: 298264 - protein, 9 aa, Homo Sapiens
SEGIGSDFK

SEQ ID NO: 298265 - protein, 9 aa, Homo Sapiens
GARPTSFMR

SEQ ID NO: 298266 - protein, 9 aa, Homo Sapiens
ELFDAHEGF

SEQ ID NO: 298267 - protein, 9 aa, Homo Sapiens
VTRKQTVPL

SEQ ID NO: 298268 - protein, 9 aa, Homo Sapiens
DVFSLLVMA

SEQ ID NO: 298269 - protein, 9 aa, Homo Sapiens
LALPVWVYL

SEQ ID NO: 298270 - protein, 9 aa, Homo Sapiens
PTGSKDVKN

SEQ ID NO: 298271 - protein, 9 aa, Homo Sapiens
LSGYLLRKL

SEQ ID NO: 298272 - protein, 9 aa, Homo Sapiens
APINKKQPC

SEQ ID NO: 298273 - protein, 9 aa, Homo Sapiens
SVMKPDNMI

SEQ ID NO: 298274 - protein, 9 aa, Homo Sapiens
VNVAPQLDL

SEQ ID NO: 298275 - protein, 9 aa, Homo Sapiens
MLMSPDILH

SEQ ID NO: 298276 - protein, 9 aa, Homo Sapiens
RARLHVVAV

SEQ ID NO: 298277 - protein, 9 aa, Homo Sapiens
SQQKEVEHN

SEQ ID NO: 298278 - protein, 9 aa, Homo Sapiens
PKRPPLKEL

SEQ ID NO: 298279 - protein, 9 aa, Homo Sapiens
KYAMFYPIN

SEQ ID NO: 298280 - protein, 9 aa, Homo Sapiens
YASRSWKLI

SEQ ID NO: 298281 - protein, 9 aa, Homo Sapiens
IKTSILNSK

SEQ ID NO: 298282 - protein, 9 aa, Homo Sapiens
VREYARYVL

SEQ ID NO: 298283 - protein, 9 aa, Homo Sapiens
YASSIFFRI

SEQ ID NO: 298284 - protein, 9 aa, Homo Sapiens
DWSNNVEYT

SEQ ID NO: 298285 - protein, 9 aa, Homo Sapiens
CLQSEGSPL

SEQ ID NO: 298286 - protein, 9 aa, Homo Sapiens
CRAPAWCDQ

SEQ ID NO: 298287 - protein, 9 aa, Homo Sapiens
DVVNNITAK

SEQ ID NO: 298288 - protein, 9 aa, Homo Sapiens
FTRDLMDKL

SEQ ID NO: 298289 - protein, 9 aa, Homo Sapiens
CNQIVSHLH

SEQ ID NO: 298290 - protein, 9 aa, Homo Sapiens
ELLSAWSTP

SEQ ID NO: 298291 - protein, 9 aa, Homo Sapiens
YLQNGKYRK

SEQ ID NO: 298292 - protein, 9 aa, Homo Sapiens
LPPPPPLYG

SEQ ID NO: 298293 - protein, 9 aa, Homo Sapiens
DFEIPTYNI

SEQ ID NO: 298294 - protein, 9 aa, Homo Sapiens
KVWVEKEKG

SEQ ID NO: 298295 - protein, 9 aa, Homo Sapiens
WKTFFTSQV

SEQ ID NO: 298296 - protein, 9 aa, Homo Sapiens
RFSGLEMSI

SEQ ID NO: 298297 - protein, 9 aa, Homo Sapiens
QLGSSIVGG

SEQ ID NO: 298298 - protein, 9 aa, Homo Sapiens
KGKEGKETG

SEQ ID NO: 298299 - protein, 9 aa, Homo Sapiens
AGFLIIFSP

SEQ ID NO: 298300 - protein, 9 aa, Homo Sapiens
CLIEAQNQR

SEQ ID NO: 298301 - protein, 9 aa, Homo Sapiens
PTTIIKKNG

SEQ ID NO: 298302 - protein, 9 aa, Homo Sapiens
GVDVFSLLV

SEQ ID NO: 298303 - protein, 9 aa, Homo Sapiens
RDSEDFNVQ

SEQ ID NO: 298304 - protein, 9 aa, Homo Sapiens
SHNHEASSW

SEQ ID NO: 298305 - protein, 9 aa, Homo Sapiens
AASQNNLVR

SEQ ID NO: 298306 - protein, 9 aa, Homo Sapiens
NEGISAQQM

SEQ ID NO: 298307 - protein, 9 aa, Homo Sapiens
VAIYISDEE

SEQ ID NO: 298308 - protein, 9 aa, Homo Sapiens
QCFIIFHPN

SEQ ID NO: 298309 - protein, 9 aa, Homo Sapiens
HLDIQGCNN

SEQ ID NO: 298310 - protein, 9 aa, Homo Sapiens
EVLGPDKYD

SEQ ID NO: 298311 - protein, 9 aa, Homo Sapiens
QKLINKHEF

SEQ ID NO: 298312 - protein, 9 aa, Homo Sapiens
KYSPFTTEA

SEQ ID NO: 298313 - protein, 9 aa, Homo Sapiens
ILPMLLELE

SEQ ID NO: 298314 - protein, 9 aa, Homo Sapiens
SKKRGRSKK

SEQ ID NO: 298315 - protein, 9 aa, Homo Sapiens
RNFDKILTE

SEQ ID NO: 298316 - protein, 9 aa, Homo Sapiens
TDETLFGVQ

SEQ ID NO: 298317 - protein, 9 aa, Homo Sapiens
YSKLNETQP

SEQ ID NO: 298318 - protein, 9 aa, Homo Sapiens
EKNNNLQEA

SEQ ID NO: 298319 - protein, 9 aa, Homo Sapiens
NLEEFYEQF

SEQ ID NO: 298320 - protein, 9 aa, Homo Sapiens
YIVDDALSW

SEQ ID NO: 298321 - protein, 9 aa, Homo Sapiens
YTAENKSPS

SEQ ID NO: 298322 - protein, 9 aa, Homo Sapiens
NPLTVECTY

SEQ ID NO: 298323 - protein, 9 aa, Homo Sapiens
LRRPSFRDY

SEQ ID NO: 298324 - protein, 9 aa, Homo Sapiens
PTHGSWQWE

SEQ ID NO: 298325 - protein, 9 aa, Homo Sapiens
GGVLGDSCI

SEQ ID NO: 298326 - protein, 9 aa, Homo Sapiens
FGNQFGLEE

SEQ ID NO: 298327 - protein, 9 aa, Homo Sapiens
SWKILLQFQ

SEQ ID NO: 298328 - protein, 9 aa, Homo Sapiens
KYRKYFHHN

SEQ ID NO: 298329 - protein, 9 aa, Homo Sapiens
QQLILNLEQ

SEQ ID NO: 298330 - protein, 9 aa, Homo Sapiens
KLDKWAKIA

SEQ ID NO: 298331 - protein, 9 aa, Homo Sapiens
INKPNLYNN

SEQ ID NO: 298332 - protein, 9 aa, Homo Sapiens
LIMELNNAS

SEQ ID NO: 298333 - protein, 9 aa, Homo Sapiens
FGSFLGFYF

SEQ ID NO: 298334 - protein, 9 aa, Homo Sapiens
EISAMQMLN

SEQ ID NO: 298335 - protein, 9 aa, Homo Sapiens
EEGCIQGSQ

SEQ ID NO: 298336 - protein, 9 aa, Homo Sapiens
HKRAISTPE

SEQ ID NO: 298337 - protein, 9 aa, Homo Sapiens
PDNEDATDN

SEQ ID NO: 298338 - protein, 9 aa, Homo Sapiens
MAPMLSDTD

SEQ ID NO: 298339 - protein, 9 aa, Homo Sapiens
AFCKNYSLI

SEQ ID NO: 298340 - protein, 9 aa, Homo Sapiens
VELDKPLKK

SEQ ID NO: 298341 - protein, 9 aa, Homo Sapiens
VKKKMTEGS

SEQ ID NO: 298342 - protein, 9 aa, Homo Sapiens
IIGPPMYEM

SEQ ID NO: 298343 - protein, 9 aa, Homo Sapiens
VSKKGIFPW

SEQ ID NO: 298344 - protein, 9 aa, Homo Sapiens
YKRQAAPGI

SEQ ID NO: 298345 - protein, 9 aa, Homo Sapiens
LQLPMLLKN

SEQ ID NO: 298346 - protein, 9 aa, Homo Sapiens
RTPGSCRHE

SEQ ID NO: 298347 - protein, 9 aa, Homo Sapiens
EGVQLLPSN

SEQ ID NO: 298348 - protein, 9 aa, Homo Sapiens
HDIIKDVED

SEQ ID NO: 298349 - protein, 9 aa, Homo Sapiens
QQIIHTRER

SEQ ID NO: 298350 - protein, 9 aa, Homo Sapiens
FTFEQLLAP

SEQ ID NO: 298351 - protein, 9 aa, Homo Sapiens
HLSRHHIIH

SEQ ID NO: 298352 - protein, 9 aa, Homo Sapiens
FPQVVHKAF

SEQ ID NO: 298353 - protein, 9 aa, Homo Sapiens
IAKIQEDDL

SEQ ID NO: 298354 - protein, 9 aa, Homo Sapiens
DPGDLSAHC

SEQ ID NO: 298355 - protein, 9 aa, Homo Sapiens
INESLSVED

SEQ ID NO: 298356 - protein, 9 aa, Homo Sapiens
KTVTDMDVV

SEQ ID NO: 298357 - protein, 9 aa, Homo Sapiens
KNTSQGYTV

SEQ ID NO: 298358 - protein, 9 aa, Homo Sapiens
GYNFRYATY

SEQ ID NO: 298359 - protein, 9 aa, Homo Sapiens
SIKTLCALA

SEQ ID NO: 298360 - protein, 9 aa, Homo Sapiens
QIDGKAVLL

SEQ ID NO: 298361 - protein, 9 aa, Homo Sapiens
VGKRVQIWK

SEQ ID NO: 298362 - protein, 9 aa, Homo Sapiens
KCPLPRTIW

SEQ ID NO: 298363 - protein, 9 aa, Homo Sapiens
LVYTFRAKV

SEQ ID NO: 298364 - protein, 9 aa, Homo Sapiens
NITEDRAAA

SEQ ID NO: 298365 - protein, 9 aa, Homo Sapiens
KKKPTVKEE

SEQ ID NO: 298366 - protein, 9 aa, Homo Sapiens
SICLTRHQI

SEQ ID NO: 298367 - protein, 9 aa, Homo Sapiens
IIHTMESFL

SEQ ID NO: 298368 - protein, 9 aa, Homo Sapiens
ASHNSSLWA

SEQ ID NO: 298369 - protein, 9 aa, Homo Sapiens
GRPFVIQPI

SEQ ID NO: 298370 - protein, 9 aa, Homo Sapiens
CTQRRLDRE

SEQ ID NO: 298371 - protein, 9 aa, Homo Sapiens
IKRVGYCSG

SEQ ID NO: 298372 - protein, 9 aa, Homo Sapiens
REVSSFLCN

SEQ ID NO: 298373 - protein, 9 aa, Homo Sapiens
QIKSKKHQV

SEQ ID NO: 298374 - protein, 9 aa, Homo Sapiens
IFKLLILQY

SEQ ID NO: 298375 - protein, 9 aa, Homo Sapiens
KSKFALRTP

SEQ ID NO: 298376 - protein, 9 aa, Homo Sapiens
PTAGPQECA

SEQ ID NO: 298377 - protein, 9 aa, Homo Sapiens
PLRKKRVSQ

SEQ ID NO: 298378 - protein, 9 aa, Homo Sapiens
PQSYTREHK

SEQ ID NO: 298379 - protein, 9 aa, Homo Sapiens
RFKQWHSIR

SEQ ID NO: 298380 - protein, 9 aa, Homo Sapiens
IIGKMSFTE

SEQ ID NO: 298381 - protein, 9 aa, Homo Sapiens
NHKNIHTGE

SEQ ID NO: 298382 - protein, 9 aa, Homo Sapiens
YTRCKGSIY

SEQ ID NO: 298383 - protein, 9 aa, Homo Sapiens
TLDYLKEVD

SEQ ID NO: 298384 - protein, 9 aa, Homo Sapiens
RIILCSKFK

SEQ ID NO: 298385 - protein, 9 aa, Homo Sapiens
MSLSGGKPM

SEQ ID NO: 298386 - protein, 9 aa, Homo Sapiens
CKGSLTQTH

SEQ ID NO: 298387 - protein, 9 aa, Homo Sapiens
NTDGQLGLG

SEQ ID NO: 298388 - protein, 9 aa, Homo Sapiens
KYVDTRKII

SEQ ID NO: 298389 - protein, 9 aa, Homo Sapiens
KLREENTFC

SEQ ID NO: 298390 - protein, 9 aa, Homo Sapiens
DDEIKLRNR

SEQ ID NO: 298391 - protein, 9 aa, Homo Sapiens
KNGGRCLIE

SEQ ID NO: 298392 - protein, 9 aa, Homo Sapiens
AKEVNSDAG

SEQ ID NO: 298393 - protein, 9 aa, Homo Sapiens
ISFLKMQHL

SEQ ID NO: 298394 - protein, 9 aa, Homo Sapiens
GQPARISLV

SEQ ID NO: 298395 - protein, 9 aa, Homo Sapiens
NAMQKACLN

SEQ ID NO: 298396 - protein, 9 aa, Homo Sapiens
IFREVGPNN

SEQ ID NO: 298397 - protein, 9 aa, Homo Sapiens
VKAQKCLVF

SEQ ID NO: 298398 - protein, 9 aa, Homo Sapiens
NKVVGRVVF

SEQ ID NO: 298399 - protein, 9 aa, Homo Sapiens
EETHIQNEQ

SEQ ID NO: 298400 - protein, 9 aa, Homo Sapiens
AQLGFIVFG

SEQ ID NO: 298401 - protein, 9 aa, Homo Sapiens
HISELLFKW

SEQ ID NO: 298402 - protein, 9 aa, Homo Sapiens
FDLAHKLEK

SEQ ID NO: 298403 - protein, 9 aa, Homo Sapiens
KAETTKGHD

SEQ ID NO: 298404 - protein, 9 aa, Homo Sapiens
DGKRIEDSL

SEQ ID NO: 298405 - protein, 9 aa, Homo Sapiens
ELSQNPMLL

SEQ ID NO: 298406 - protein, 9 aa, Homo Sapiens
TYDLPATIN

SEQ ID NO: 298407 - protein, 9 aa, Homo Sapiens
ATLSKIATT

SEQ ID NO: 298408 - protein, 9 aa, Homo Sapiens
KKEKGMGKQ

SEQ ID NO: 298409 - protein, 9 aa, Homo Sapiens
QGEIKGQEN

SEQ ID NO: 298410 - protein, 9 aa, Homo Sapiens
WEEYIIQTL

SEQ ID NO: 298411 - protein, 9 aa, Homo Sapiens
VLSSSSIKV

SEQ ID NO: 298412 - protein, 9 aa, Homo Sapiens
FLTNIGLGV

SEQ ID NO: 298413 - protein, 9 aa, Homo Sapiens
QLTSDERGT

SEQ ID NO: 298414 - protein, 9 aa, Homo Sapiens
QCPWGVAEV

SEQ ID NO: 298415 - protein, 9 aa, Homo Sapiens
CGKDFTQNS

SEQ ID NO: 298416 - protein, 9 aa, Homo Sapiens
RHKSLALER

SEQ ID NO: 298417 - protein, 9 aa, Homo Sapiens
FMGLINTTE

SEQ ID NO: 298418 - protein, 9 aa, Homo Sapiens
ISDPTSPLI

SEQ ID NO: 298419 - protein, 9 aa, Homo Sapiens
DQTRFPVLV

SEQ ID NO: 298420 - protein, 9 aa, Homo Sapiens
RSKQSSFCS

SEQ ID NO: 298421 - protein, 9 aa, Homo Sapiens
AQHMNFLPS

SEQ ID NO: 298422 - protein, 9 aa, Homo Sapiens
LLEHLMKAF

SEQ ID NO: 298423 - protein, 9 aa, Homo Sapiens
SKVKIYPYT

SEQ ID NO: 298424 - protein, 9 aa, Homo Sapiens
KIDSLAPLD

SEQ ID NO: 298425 - protein, 9 aa, Homo Sapiens
ASSYNSLVP

SEQ ID NO: 298426 - protein, 9 aa, Homo Sapiens
VIHETWKES

SEQ ID NO: 298427 - protein, 9 aa, Homo Sapiens
NFDLRTFQS

SEQ ID NO: 298428 - protein, 9 aa, Homo Sapiens
CAVPGGPVI

SEQ ID NO: 298429 - protein, 9 aa, Homo Sapiens
SANKSRVQM

SEQ ID NO: 298430 - protein, 9 aa, Homo Sapiens
IHLFANIHP

SEQ ID NO: 298431 - protein, 9 aa, Homo Sapiens
LAITSESKD

SEQ ID NO: 298432 - protein, 9 aa, Homo Sapiens
KLTCPEINE

SEQ ID NO: 298433 - protein, 9 aa, Homo Sapiens
YLLENITFS

SEQ ID NO: 298434 - protein, 9 aa, Homo Sapiens
LTSKSRELS

SEQ ID NO: 298435 - protein, 9 aa, Homo Sapiens
NECTKLIIQ

SEQ ID NO: 298436 - protein, 9 aa, Homo Sapiens
LRTAGSQSS

SEQ ID NO: 298437 - protein, 9 aa, Homo Sapiens
FLIFNLSFT

SEQ ID NO: 298438 - protein, 9 aa, Homo Sapiens
VKNPMVIPG

SEQ ID NO: 298439 - protein, 9 aa, Homo Sapiens
LPAKAPVYN

SEQ ID NO: 298440 - protein, 9 aa, Homo Sapiens
KMLDNIFLP

SEQ ID NO: 298441 - protein, 9 aa, Homo Sapiens
CRELARHQS

SEQ ID NO: 298442 - protein, 9 aa, Homo Sapiens
NQDHGCFVC

SEQ ID NO: 298443 - protein, 9 aa, Homo Sapiens
DNAKQILQR

SEQ ID NO: 298444 - protein, 9 aa, Homo Sapiens
KIQNAEVRQ

SEQ ID NO: 298445 - protein, 9 aa, Homo Sapiens
SPTFQRLFG

SEQ ID NO: 298446 - protein, 9 aa, Homo Sapiens
FLKLFCMSF

SEQ ID NO: 298447 - protein, 9 aa, Homo Sapiens
DTGEHGLQE

SEQ ID NO: 298448 - protein, 9 aa, Homo Sapiens
PRPTLSVTS

SEQ ID NO: 298449 - protein, 9 aa, Homo Sapiens
DNLVHQIQY

SEQ ID NO: 298450 - protein, 9 aa, Homo Sapiens
RRIKIHRMD

SEQ ID NO: 298451 - protein, 9 aa, Homo Sapiens
YDHYLAICQ

SEQ ID NO: 298452 - protein, 9 aa, Homo Sapiens
FISNYMRLN

SEQ ID NO: 298453 - protein, 9 aa, Homo Sapiens
AGIRCENVT

SEQ ID NO: 298454 - protein, 9 aa, Homo Sapiens
ILDFYRELG

SEQ ID NO: 298455 - protein, 9 aa, Homo Sapiens
RYIKIFPSR

SEQ ID NO: 298456 - protein, 9 aa, Homo Sapiens
FQRDASCVN

SEQ ID NO: 298457 - protein, 9 aa, Homo Sapiens
FSLFVRDFD

SEQ ID NO: 298458 - protein, 9 aa, Homo Sapiens
QASSYRLVA

SEQ ID NO: 298459 - protein, 9 aa, Homo Sapiens
GARMSIKYD

SEQ ID NO: 298460 - protein, 9 aa, Homo Sapiens
QRKCTQDTS

SEQ ID NO: 298461 - protein, 9 aa, Homo Sapiens
RLRDRKQLV

SEQ ID NO: 298462 - protein, 9 aa, Homo Sapiens
ISTFRFNFL

SEQ ID NO: 298463 - protein, 9 aa, Homo Sapiens
KISQRIMPV

SEQ ID NO: 298464 - protein, 9 aa, Homo Sapiens
RYSVTEETD

SEQ ID NO: 298465 - protein, 9 aa, Homo Sapiens
RHEKKIHEH

SEQ ID NO: 298466 - protein, 9 aa, Homo Sapiens
VSVKKRSVW

SEQ ID NO: 298467 - protein, 9 aa, Homo Sapiens
KRGVFGTDY

SEQ ID NO: 298468 - protein, 9 aa, Homo Sapiens
VSKTRHTRK

SEQ ID NO: 298469 - protein, 9 aa, Homo Sapiens
SVLKENYLP

SEQ ID NO: 298470 - protein, 9 aa, Homo Sapiens
MPMYNFNPT

SEQ ID NO: 298471 - protein, 9 aa, Homo Sapiens
KTGKCSELL

SEQ ID NO: 298472 - protein, 9 aa, Homo Sapiens
DDALSWTFL

SEQ ID NO: 298473 - protein, 9 aa, Homo Sapiens
LSFLFVAPL

SEQ ID NO: 298474 - protein, 9 aa, Homo Sapiens
GLTPQKVDF

SEQ ID NO: 298475 - protein, 9 aa, Homo Sapiens
FRENNQRLQ

SEQ ID NO: 298476 - protein, 9 aa, Homo Sapiens
DYTYTNFDN

SEQ ID NO: 298477 - protein, 9 aa, Homo Sapiens
PKLLSNHHT

SEQ ID NO: 298478 - protein, 9 aa, Homo Sapiens
LVKEYPQLE

SEQ ID NO: 298479 - protein, 9 aa, Homo Sapiens
HALYPEGQA

SEQ ID NO: 298480 - protein, 9 aa, Homo Sapiens
AHFLPFKKP

SEQ ID NO: 298481 - protein, 9 aa, Homo Sapiens
PGEHIRCQQ

SEQ ID NO: 298482 - protein, 9 aa, Homo Sapiens
NISFSDDFS

SEQ ID NO: 298483 - protein, 9 aa, Homo Sapiens
DPTRLIVVF

SEQ ID NO: 298484 - protein, 9 aa, Homo Sapiens
FGPVSYHDM

SEQ ID NO: 298485 - protein, 9 aa, Homo Sapiens
TTPEGLQES

SEQ ID NO: 298486 - protein, 9 aa, Homo Sapiens
GNVSRAVNW

SEQ ID NO: 298487 - protein, 9 aa, Homo Sapiens
NSPTNILPK

SEQ ID NO: 298488 - protein, 9 aa, Homo Sapiens
LKDLKHANV

SEQ ID NO: 298489 - protein, 9 aa, Homo Sapiens
KLIKALFEV

SEQ ID NO: 298490 - protein, 9 aa, Homo Sapiens
YMLRDIERG

SEQ ID NO: 298491 - protein, 9 aa, Homo Sapiens
SDRFLYVNR

SEQ ID NO: 298492 - protein, 9 aa, Homo Sapiens
LNNASLQDQ

SEQ ID NO: 298493 - protein, 9 aa, Homo Sapiens
SYVKVQEGQ

SEQ ID NO: 298494 - protein, 9 aa, Homo Sapiens
SGVGTYVIQ

SEQ ID NO: 298495 - protein, 9 aa, Homo Sapiens
KDKTGLSIR

SEQ ID NO: 298496 - protein, 9 aa, Homo Sapiens
GPNRLNPKH

SEQ ID NO: 298497 - protein, 9 aa, Homo Sapiens
TWAAKIDGT

SEQ ID NO: 298498 - protein, 9 aa, Homo Sapiens
QKELNEYQA

SEQ ID NO: 298499 - protein, 9 aa, Homo Sapiens
LARDLSSLR

SEQ ID NO: 298500 - protein, 9 aa, Homo Sapiens
KIIRHEDIH

SEQ ID NO: 298501 - protein, 9 aa, Homo Sapiens
EVSSFLCNL

SEQ ID NO: 298502 - protein, 9 aa, Homo Sapiens
LYFFFSLGT

SEQ ID NO: 298503 - protein, 9 aa, Homo Sapiens
KAYLALHHH

SEQ ID NO: 298504 - protein, 9 aa, Homo Sapiens
PDMFCKLVE

SEQ ID NO: 298505 - protein, 9 aa, Homo Sapiens
APLGPDAPP

SEQ ID NO: 298506 - protein, 9 aa, Homo Sapiens
DAIFKPELL

SEQ ID NO: 298507 - protein, 9 aa, Homo Sapiens
ITSSLEKLS

SEQ ID NO: 298508 - protein, 9 aa, Homo Sapiens
SGLEMSIVF

SEQ ID NO: 298509 - protein, 9 aa, Homo Sapiens
NKRVFKTKK

SEQ ID NO: 298510 - protein, 9 aa, Homo Sapiens
DATKLWGIR

SEQ ID NO: 298511 - protein, 9 aa, Homo Sapiens
NILPKTLGP

SEQ ID NO: 298512 - protein, 9 aa, Homo Sapiens
DNLYCDVPQ

SEQ ID NO: 298513 - protein, 9 aa, Homo Sapiens
GLSIGVEQI

SEQ ID NO: 298514 - protein, 9 aa, Homo Sapiens
GFRRIVHLV

SEQ ID NO: 298515 - protein, 9 aa, Homo Sapiens
ENTSPSETS

SEQ ID NO: 298516 - protein, 9 aa, Homo Sapiens
QKHPAPPPS

SEQ ID NO: 298517 - protein, 9 aa, Homo Sapiens
FQTFLKRHD

SEQ ID NO: 298518 - protein, 9 aa, Homo Sapiens
RPLPPPGDR

SEQ ID NO: 298519 - protein, 9 aa, Homo Sapiens
AKCSLATDS

SEQ ID NO: 298520 - protein, 9 aa, Homo Sapiens
LNTTKTQSK

SEQ ID NO: 298521 - protein, 9 aa, Homo Sapiens
EQIFYIVEQ

SEQ ID NO: 298522 - protein, 9 aa, Homo Sapiens
LDHSKHGLS

SEQ ID NO: 298523 - protein, 9 aa, Homo Sapiens
EKSVSETDV

SEQ ID NO: 298524 - protein, 9 aa, Homo Sapiens
NHFHVFVGG

SEQ ID NO: 298525 - protein, 9 aa, Homo Sapiens
MCSRQWQLG

SEQ ID NO: 298526 - protein, 9 aa, Homo Sapiens
LPIVTLFYG

SEQ ID NO: 298527 - protein, 9 aa, Homo Sapiens
VCISVRQFW

SEQ ID NO: 298528 - protein, 9 aa, Homo Sapiens
LIFLAKLLK

SEQ ID NO: 298529 - protein, 9 aa, Homo Sapiens
PNNLVGCII

SEQ ID NO: 298530 - protein, 9 aa, Homo Sapiens
EDFDLAHKL

SEQ ID NO: 298531 - protein, 9 aa, Homo Sapiens
HHQRLSGNI

SEQ ID NO: 298532 - protein, 9 aa, Homo Sapiens
NFIGPQVHL

SEQ ID NO: 298533 - protein, 9 aa, Homo Sapiens
VFIFKLLIL

SEQ ID NO: 298534 - protein, 9 aa, Homo Sapiens
TYLEEKLDK

SEQ ID NO: 298535 - protein, 9 aa, Homo Sapiens
GGRCVPPAL

SEQ ID NO: 298536 - protein, 9 aa, Homo Sapiens
KDSQTVYQY

SEQ ID NO: 298537 - protein, 9 aa, Homo Sapiens
MLLENVKVD

SEQ ID NO: 298538 - protein, 9 aa, Homo Sapiens
FPAYLQEAL

SEQ ID NO: 298539 - protein, 9 aa, Homo Sapiens
PVRSFIQPP

SEQ ID NO: 298540 - protein, 9 aa, Homo Sapiens
VRQLENEFQ

SEQ ID NO: 298541 - protein, 9 aa, Homo Sapiens
GGQPHHPEQ

SEQ ID NO: 298542 - protein, 9 aa, Homo Sapiens
VTNTPSLDQ

SEQ ID NO: 298543 - protein, 9 aa, Homo Sapiens
KNRVKKKMT

SEQ ID NO: 298544 - protein, 9 aa, Homo Sapiens
FCLLLNVQP

SEQ ID NO: 298545 - protein, 9 aa, Homo Sapiens
DPENVQSEE

SEQ ID NO: 298546 - protein, 9 aa, Homo Sapiens
TDPKEGLKY

SEQ ID NO: 298547 - protein, 8 aa, Homo Sapiens
KQKMMARL

SEQ ID NO: 298548 - protein, 9 aa, Homo Sapiens
SATLQALGY

SEQ ID NO: 298549 - protein, 9 aa, Homo Sapiens
QAFSCLSSL

SEQ ID NO: 298550 - protein, 9 aa, Homo Sapiens
RYIIKKYFF

SEQ ID NO: 298551 - protein, 9 aa, Homo Sapiens
QNGYRALMD

SEQ ID NO: 298552 - protein, 9 aa, Homo Sapiens
DSEDNLLEE

SEQ ID NO: 298553 - protein, 9 aa, Homo Sapiens
ESPPPGWQP

SEQ ID NO: 298554 - protein, 9 aa, Homo Sapiens
SEANSGYGS

SEQ ID NO: 298555 - protein, 9 aa, Homo Sapiens
ITIVKETNA

SEQ ID NO: 298556 - protein, 9 aa, Homo Sapiens
PAIKDSRGI

SEQ ID NO: 298557 - protein, 9 aa, Homo Sapiens
GQEKEKASF

SEQ ID NO: 298558 - protein, 9 aa, Homo Sapiens
KTFTLGNNR

SEQ ID NO: 298559 - protein, 9 aa, Homo Sapiens
TSPDKRIAV

SEQ ID NO: 298560 - protein, 9 aa, Homo Sapiens
GLEFNCKTK

SEQ ID NO: 298561 - protein, 9 aa, Homo Sapiens
LSQLPTPTS

SEQ ID NO: 298562 - protein, 9 aa, Homo Sapiens
LLSLHNMIS

SEQ ID NO: 298563 - protein, 9 aa, Homo Sapiens
VLEACVLQP

SEQ ID NO: 298564 - protein, 9 aa, Homo Sapiens
HRELESFRT

SEQ ID NO: 298565 - protein, 9 aa, Homo Sapiens
PEPVEDIRR

SEQ ID NO: 298566 - protein, 9 aa, Homo Sapiens
IKDKTGLSI

SEQ ID NO: 298567 - protein, 9 aa, Homo Sapiens
HQQIIHTRE

SEQ ID NO: 298568 - protein, 9 aa, Homo Sapiens
INQKATEGA

SEQ ID NO: 298569 - protein, 9 aa, Homo Sapiens
LIPQLQLPM

SEQ ID NO: 298570 - protein, 9 aa, Homo Sapiens
ESAWANRVR

SEQ ID NO: 298571 - protein, 9 aa, Homo Sapiens
TTELQVWDL

SEQ ID NO: 298572 - protein, 9 aa, Homo Sapiens
TATADAKVK

SEQ ID NO: 298573 - protein, 9 aa, Homo Sapiens
RWQLLQKQE

SEQ ID NO: 298574 - protein, 9 aa, Homo Sapiens
NIMLVKTET

SEQ ID NO: 298575 - protein, 9 aa, Homo Sapiens
PFMPAERCL

SEQ ID NO: 298576 - protein, 9 aa, Homo Sapiens
MMIKTIKKQ

SEQ ID NO: 298577 - protein, 9 aa, Homo Sapiens
LESQIKCGI

SEQ ID NO: 298578 - protein, 9 aa, Homo Sapiens
VHAIRHCYQ

SEQ ID NO: 298579 - protein, 9 aa, Homo Sapiens
GETITKMYE

SEQ ID NO: 298580 - protein, 9 aa, Homo Sapiens
ITPQFFAFR

SEQ ID NO: 298581 - protein, 9 aa, Homo Sapiens
KDMLQTLAQ

SEQ ID NO: 298582 - protein, 9 aa, Homo Sapiens
LSNSPNSTA

SEQ ID NO: 298583 - protein, 9 aa, Homo Sapiens
TLKEDWASE

SEQ ID NO: 298584 - protein, 9 aa, Homo Sapiens
CQALNIAED

SEQ ID NO: 298585 - protein, 9 aa, Homo Sapiens
EKVILRKEL

SEQ ID NO: 298586 - protein, 9 aa, Homo Sapiens
FLINGRHNT

SEQ ID NO: 298587 - protein, 9 aa, Homo Sapiens
DAPVMTMAA

SEQ ID NO: 298588 - protein, 9 aa, Homo Sapiens
HWNFQEDTL

SEQ ID NO: 298589 - protein, 9 aa, Homo Sapiens
HNALPTCIS

SEQ ID NO: 298590 - protein, 9 aa, Homo Sapiens
PKVEHNPDT

SEQ ID NO: 298591 - protein, 9 aa, Homo Sapiens
RKDLVKAKL

SEQ ID NO: 298592 - protein, 9 aa, Homo Sapiens
DMINQKATE

SEQ ID NO: 298593 - protein, 9 aa, Homo Sapiens
CGSRDVSHQ

SEQ ID NO: 298594 - protein, 9 aa, Homo Sapiens
FLDASTMYG

SEQ ID NO: 298595 - protein, 9 aa, Homo Sapiens
APEKERESG

SEQ ID NO: 298596 - protein, 9 aa, Homo Sapiens
FVCGLNTDG

SEQ ID NO: 298597 - protein, 9 aa, Homo Sapiens
KLEIIQFVG

SEQ ID NO: 298598 - protein, 9 aa, Homo Sapiens
VMTYRLNFC

SEQ ID NO: 298599 - protein, 9 aa, Homo Sapiens
LSAAHAARG

SEQ ID NO: 298600 - protein, 9 aa, Homo Sapiens
SAPSGPGGI

SEQ ID NO: 298601 - protein, 9 aa, Homo Sapiens
NVSNKYSSE

SEQ ID NO: 298602 - protein, 9 aa, Homo Sapiens
SGEVTRQMG

SEQ ID NO: 298603 - protein, 9 aa, Homo Sapiens
SIAPSSQTK

SEQ ID NO: 298604 - protein, 9 aa, Homo Sapiens
HTVLVIAHR

SEQ ID NO: 298605 - protein, 9 aa, Homo Sapiens
SSGVFRKSV

SEQ ID NO: 298606 - protein, 9 aa, Homo Sapiens
TVVEDFFDI

SEQ ID NO: 298607 - protein, 9 aa, Homo Sapiens
LKENYLPKP

SEQ ID NO: 298608 - protein, 9 aa, Homo Sapiens
SAYRFKTVT

SEQ ID NO: 298609 - protein, 9 aa, Homo Sapiens
SFISFLQSV

SEQ ID NO: 298610 - protein, 9 aa, Homo Sapiens
TLTKEDNCC

SEQ ID NO: 298611 - protein, 9 aa, Homo Sapiens
TATTSDVNS

SEQ ID NO: 298612 - protein, 9 aa, Homo Sapiens
SASATFEYF

SEQ ID NO: 298613 - protein, 9 aa, Homo Sapiens
GDGNRMTLS

SEQ ID NO: 298614 - protein, 9 aa, Homo Sapiens
DDMLLRLKS

SEQ ID NO: 298615 - protein, 9 aa, Homo Sapiens
PYCETDLIF

SEQ ID NO: 298616 - protein, 9 aa, Homo Sapiens
QKQQASKNT

SEQ ID NO: 298617 - protein, 9 aa, Homo Sapiens
EQQQDMAQL

SEQ ID NO: 298618 - protein, 9 aa, Homo Sapiens
PEHLINVLR

SEQ ID NO: 298619 - protein, 9 aa, Homo Sapiens
ESEEPFMPA

SEQ ID NO: 298620 - protein, 9 aa, Homo Sapiens
ECGKALFYS

SEQ ID NO: 298621 - protein, 9 aa, Homo Sapiens
SGCKNGQII

SEQ ID NO: 298622 - protein, 9 aa, Homo Sapiens
QVKEGGPAC

SEQ ID NO: 298623 - protein, 9 aa, Homo Sapiens
SGPQQQAFK

SEQ ID NO: 298624 - protein, 9 aa, Homo Sapiens
MEAIWGSSI

SEQ ID NO: 298625 - protein, 9 aa, Homo Sapiens
PKQCHQPSD

SEQ ID NO: 298626 - protein, 9 aa, Homo Sapiens
NIALPFVEV

SEQ ID NO: 298627 - protein, 9 aa, Homo Sapiens
WIPGQPGLP

SEQ ID NO: 298628 - protein, 9 aa, Homo Sapiens
SLPVHNSNS

SEQ ID NO: 298629 - protein, 9 aa, Homo Sapiens
YQRNAPDHM

SEQ ID NO: 298630 - protein, 9 aa, Homo Sapiens
KPGDKKKEN

SEQ ID NO: 298631 - protein, 9 aa, Homo Sapiens
IIKNNLCRN

SEQ ID NO: 298632 - protein, 9 aa, Homo Sapiens
DVCNVLLQL

SEQ ID NO: 298633 - protein, 9 aa, Homo Sapiens
ELDKPLKKH

SEQ ID NO: 298634 - protein, 9 aa, Homo Sapiens
VIQGTELKY

SEQ ID NO: 298635 - protein, 9 aa, Homo Sapiens
RGQPARISL

SEQ ID NO: 298636 - protein, 9 aa, Homo Sapiens
IDAVARFTV

SEQ ID NO: 298637 - protein, 9 aa, Homo Sapiens
EYFLWAVRA

SEQ ID NO: 298638 - protein, 9 aa, Homo Sapiens
PEKLYPKFA

SEQ ID NO: 298639 - protein, 9 aa, Homo Sapiens
WLGLKNIFY

SEQ ID NO: 298640 - protein, 9 aa, Homo Sapiens
YMLREELQF

SEQ ID NO: 298641 - protein, 9 aa, Homo Sapiens
VLYVRTLMI

SEQ ID NO: 298642 - protein, 9 aa, Homo Sapiens
RDVVGGLMT

SEQ ID NO: 298643 - protein, 9 aa, Homo Sapiens
QGVRKDLMA

SEQ ID NO: 298644 - protein, 9 aa, Homo Sapiens
SRLNRRTSF

SEQ ID NO: 298645 - protein, 9 aa, Homo Sapiens
EDVGKEQCL

SEQ ID NO: 298646 - protein, 9 aa, Homo Sapiens
IGIIVKAQK

SEQ ID NO: 298647 - protein, 9 aa, Homo Sapiens
VRAMYGNTA

SEQ ID NO: 298648 - protein, 9 aa, Homo Sapiens
IQIEKGTPK

SEQ ID NO: 298649 - protein, 9 aa, Homo Sapiens
QNLEEFYEQ

SEQ ID NO: 298650 - protein, 9 aa, Homo Sapiens
HTEEKLYKI

SEQ ID NO: 298651 - protein, 9 aa, Homo Sapiens
HGKNVPKYQ

SEQ ID NO: 298652 - protein, 9 aa, Homo Sapiens
NNRISKTIL

SEQ ID NO: 298653 - protein, 9 aa, Homo Sapiens
VFLIMLGCF

SEQ ID NO: 298654 - protein, 9 aa, Homo Sapiens
VNVSGKLFE

SEQ ID NO: 298655 - protein, 9 aa, Homo Sapiens
SLASHLSTV

SEQ ID NO: 298656 - protein, 9 aa, Homo Sapiens
KKLSLFVRD

SEQ ID NO: 298657 - protein, 9 aa, Homo Sapiens
DARKKQFWY

SEQ ID NO: 298658 - protein, 9 aa, Homo Sapiens
RSTRETLEE

SEQ ID NO: 298659 - protein, 9 aa, Homo Sapiens
DYLEPRLQR

SEQ ID NO: 298660 - protein, 9 aa, Homo Sapiens
FYLQSSQGS

SEQ ID NO: 298661 - protein, 9 aa, Homo Sapiens
GIKETVQKV

SEQ ID NO: 298662 - protein, 9 aa, Homo Sapiens
RINWNQYKI

SEQ ID NO: 298663 - protein, 9 aa, Homo Sapiens
VQAANTLGM

SEQ ID NO: 298664 - protein, 9 aa, Homo Sapiens
DFWGRFLSH

SEQ ID NO: 298665 - protein, 9 aa, Homo Sapiens
DDNKTDKTK

SEQ ID NO: 298666 - protein, 9 aa, Homo Sapiens
LEHHTRSIP

SEQ ID NO: 298667 - protein, 9 aa, Homo Sapiens
MLVESVAHN

SEQ ID NO: 298668 - protein, 9 aa, Homo Sapiens
GFTQQPLPA

SEQ ID NO: 298669 - protein, 9 aa, Homo Sapiens
TEHCIKQNN

SEQ ID NO: 298670 - protein, 9 aa, Homo Sapiens
IINTVPHLA

SEQ ID NO: 298671 - protein, 9 aa, Homo Sapiens
GIKRKASIS

SEQ ID NO: 298672 - protein, 9 aa, Homo Sapiens
DVTILMKGE

SEQ ID NO: 298673 - protein, 9 aa, Homo Sapiens
SEARGEAGG

SEQ ID NO: 298674 - protein, 9 aa, Homo Sapiens
IANNLVLAG

SEQ ID NO: 298675 - protein, 9 aa, Homo Sapiens
IMKDKWWRG

SEQ ID NO: 298676 - protein, 9 aa, Homo Sapiens
SIKVHWTVD

SEQ ID NO: 298677 - protein, 9 aa, Homo Sapiens
IIRREKEKE

SEQ ID NO: 298678 - protein, 9 aa, Homo Sapiens
ATLKIQSLD

SEQ ID NO: 298679 - protein, 9 aa, Homo Sapiens
HQILHSREK

SEQ ID NO: 298680 - protein, 9 aa, Homo Sapiens
SLCQRHETT

SEQ ID NO: 298681 - protein, 9 aa, Homo Sapiens
YFSNKHSRL

SEQ ID NO: 298682 - protein, 9 aa, Homo Sapiens
PQWLPCHVG

SEQ ID NO: 298683 - protein, 9 aa, Homo Sapiens
NRDLLSKNN

SEQ ID NO: 298684 - protein, 9 aa, Homo Sapiens
TRKEEKVAL

SEQ ID NO: 298685 - protein, 9 aa, Homo Sapiens
INSFLQNTD

SEQ ID NO: 298686 - protein, 9 aa, Homo Sapiens
GKPYMETTK

SEQ ID NO: 298687 - protein, 9 aa, Homo Sapiens
LAGWQCPEC

SEQ ID NO: 298688 - protein, 9 aa, Homo Sapiens
TISFHGCMG

SEQ ID NO: 298689 - protein, 9 aa, Homo Sapiens
GEPQARGTY

SEQ ID NO: 298690 - protein, 9 aa, Homo Sapiens
MKQKNKQNI

SEQ ID NO: 298691 - protein, 9 aa, Homo Sapiens
SAPSDLRLV

SEQ ID NO: 298692 - protein, 9 aa, Homo Sapiens
HQISEDVVI

SEQ ID NO: 298693 - protein, 9 aa, Homo Sapiens
VAMYVAGFA

SEQ ID NO: 298694 - protein, 9 aa, Homo Sapiens
GNIKKHFNT

SEQ ID NO: 298695 - protein, 9 aa, Homo Sapiens
TRFPVLVTS

SEQ ID NO: 298696 - protein, 9 aa, Homo Sapiens
LKLLDRETL

SEQ ID NO: 298697 - protein, 9 aa, Homo Sapiens
IQLHPDGTV

SEQ ID NO: 298698 - protein, 9 aa, Homo Sapiens
LLSPKSLDI

SEQ ID NO: 298699 - protein, 9 aa, Homo Sapiens
FLFDIPNIL

SEQ ID NO: 298700 - protein, 9 aa, Homo Sapiens
WKLPSSVAQ

SEQ ID NO: 298701 - protein, 9 aa, Homo Sapiens
PLDLFNNIR

SEQ ID NO: 298702 - protein, 9 aa, Homo Sapiens
PVQKKKPTV

SEQ ID NO: 298703 - protein, 9 aa, Homo Sapiens
MPDDNKIIR

SEQ ID NO: 298704 - protein, 9 aa, Homo Sapiens
PDGLSDITE

SEQ ID NO: 298705 - protein, 9 aa, Homo Sapiens
LTTEKVGSV

SEQ ID NO: 298706 - protein, 9 aa, Homo Sapiens
DYSENIFTS

SEQ ID NO: 298707 - protein, 9 aa, Homo Sapiens
GHFVQKHGE

SEQ ID NO: 298708 - protein, 9 aa, Homo Sapiens
DHLLFNMCL

SEQ ID NO: 298709 - protein, 9 aa, Homo Sapiens
VCSKDISAL

SEQ ID NO: 298710 - protein, 9 aa, Homo Sapiens
HSSSSNYQG

SEQ ID NO: 298711 - protein, 9 aa, Homo Sapiens
ESSLEDHIQ

SEQ ID NO: 298712 - protein, 9 aa, Homo Sapiens
QVKEYCLKV

SEQ ID NO: 298713 - protein, 9 aa, Homo Sapiens
KTTGKQIEA

SEQ ID NO: 298714 - protein, 9 aa, Homo Sapiens
SILEDTEEE

SEQ ID NO: 298715 - protein, 9 aa, Homo Sapiens
EGLTPQKVD

SEQ ID NO: 298716 - protein, 9 aa, Homo Sapiens
TSPLITRFV

SEQ ID NO: 298717 - protein, 9 aa, Homo Sapiens
GLSPEITTE

SEQ ID NO: 298718 - protein, 9 aa, Homo Sapiens
ARFYREASS

SEQ ID NO: 298719 - protein, 9 aa, Homo Sapiens
TFLSKLSEY

SEQ ID NO: 298720 - protein, 9 aa, Homo Sapiens
PCQGNTFLR

SEQ ID NO: 298721 - protein, 9 aa, Homo Sapiens
GPRTQDDII

SEQ ID NO: 298722 - protein, 9 aa, Homo Sapiens
IATTGEEVW

SEQ ID NO: 298723 - protein, 9 aa, Homo Sapiens
PSECTCYRA

SEQ ID NO: 298724 - protein, 9 aa, Homo Sapiens
KGRIDLAEV

SEQ ID NO: 298725 - protein, 9 aa, Homo Sapiens
TCPHFLKCL

SEQ ID NO: 298726 - protein, 9 aa, Homo Sapiens
NKEFKDKPE

SEQ ID NO: 298727 - protein, 9 aa, Homo Sapiens
SSFCSEAGM

SEQ ID NO: 298728 - protein, 9 aa, Homo Sapiens
NNIFSIENG

SEQ ID NO: 298729 - protein, 9 aa, Homo Sapiens
HKSDKTSGE

SEQ ID NO: 298730 - protein, 9 aa, Homo Sapiens
RRITQETVD

SEQ ID NO: 298731 - protein, 9 aa, Homo Sapiens
YSKMRLEQD

SEQ ID NO: 298732 - protein, 9 aa, Homo Sapiens
QLSFRVFYN

SEQ ID NO: 298733 - protein, 9 aa, Homo Sapiens
SRRGALTGG

SEQ ID NO: 298734 - protein, 9 aa, Homo Sapiens
GATAKGLYW

SEQ ID NO: 298735 - protein, 9 aa, Homo Sapiens
FAVQLHVDQ

SEQ ID NO: 298736 - protein, 9 aa, Homo Sapiens
QLEQGDKPW

SEQ ID NO: 298737 - protein, 9 aa, Homo Sapiens
FQICLIALF

SEQ ID NO: 298738 - protein, 9 aa, Homo Sapiens
PFKKPSIKK

SEQ ID NO: 298739 - protein, 9 aa, Homo Sapiens
NDRDGERGP

SEQ ID NO: 298740 - protein, 9 aa, Homo Sapiens
ALNKVVGRV

SEQ ID NO: 298741 - protein, 9 aa, Homo Sapiens
DPGCLYVVS

SEQ ID NO: 298742 - protein, 9 aa, Homo Sapiens
PSHRNWIVN

SEQ ID NO: 298743 - protein, 9 aa, Homo Sapiens
NRMIQLHPD

SEQ ID NO: 298744 - protein, 9 aa, Homo Sapiens
FIALSYFKM

SEQ ID NO: 298745 - protein, 9 aa, Homo Sapiens
AQYQFIYMA

SEQ ID NO: 298746 - protein, 9 aa, Homo Sapiens
RHLTLSIIH

SEQ ID NO: 298747 - protein, 9 aa, Homo Sapiens
GEESSTLLT

SEQ ID NO: 298748 - protein, 9 aa, Homo Sapiens
YVMLEILIF

SEQ ID NO: 298749 - protein, 9 aa, Homo Sapiens
MYSTAAKVS

SEQ ID NO: 298750 - protein, 9 aa, Homo Sapiens
QNGARDAPP

SEQ ID NO: 298751 - protein, 9 aa, Homo Sapiens
LSTSPLVAC

SEQ ID NO: 298752 - protein, 9 aa, Homo Sapiens
TTPSKGSHK

SEQ ID NO: 298753 - protein, 9 aa, Homo Sapiens
PGEGADFAL

SEQ ID NO: 298754 - protein, 9 aa, Homo Sapiens
QPYRVKAID

SEQ ID NO: 298755 - protein, 9 aa, Homo Sapiens
HNQFLRCYN

SEQ ID NO: 298756 - protein, 9 aa, Homo Sapiens
YFELDRADR

SEQ ID NO: 298757 - protein, 9 aa, Homo Sapiens
ESLIKKIQD

SEQ ID NO: 298758 - protein, 9 aa, Homo Sapiens
VTDNKGTLA

SEQ ID NO: 298759 - protein, 9 aa, Homo Sapiens
PNNYQTMHG

SEQ ID NO: 298760 - protein, 9 aa, Homo Sapiens
GRMRLSQKV

SEQ ID NO: 298761 - protein, 9 aa, Homo Sapiens
EILPLHVLN

SEQ ID NO: 298762 - protein, 9 aa, Homo Sapiens
PQGSACLQP

SEQ ID NO: 298763 - protein, 9 aa, Homo Sapiens
GSRSSSKNK

SEQ ID NO: 298764 - protein, 9 aa, Homo Sapiens
KDYRIILKE

SEQ ID NO: 298765 - protein, 9 aa, Homo Sapiens
TTAVSDKKI

SEQ ID NO: 298766 - protein, 9 aa, Homo Sapiens
MALIKRGTA

SEQ ID NO: 298767 - protein, 9 aa, Homo Sapiens
PFKCPTCGV

SEQ ID NO: 298768 - protein, 9 aa, Homo Sapiens
ANPQLQMAS

SEQ ID NO: 298769 - protein, 9 aa, Homo Sapiens
AEVFSTDLS

SEQ ID NO: 298770 - protein, 9 aa, Homo Sapiens
GNRTYAGQC

SEQ ID NO: 298771 - protein, 9 aa, Homo Sapiens
PLQVAQECL

SEQ ID NO: 298772 - protein, 9 aa, Homo Sapiens
LLFYKYVYT

SEQ ID NO: 298773 - protein, 9 aa, Homo Sapiens
VVDLKNNLE

SEQ ID NO: 298774 - protein, 9 aa, Homo Sapiens
LEIIQFVGA

SEQ ID NO: 298775 - protein, 9 aa, Homo Sapiens
KRSTQTRLS

SEQ ID NO: 298776 - protein, 9 aa, Homo Sapiens
LLIQLSNEF

SEQ ID NO: 298777 - protein, 9 aa, Homo Sapiens
KVNLQKCDI

SEQ ID NO: 298778 - protein, 9 aa, Homo Sapiens
TCEECGKRF

SEQ ID NO: 298779 - protein, 9 aa, Homo Sapiens
PNSQEVQAA

SEQ ID NO: 298780 - protein, 9 aa, Homo Sapiens
EQDYYLGGL

SEQ ID NO: 298781 - protein, 9 aa, Homo Sapiens
CSKPLVDLI

SEQ ID NO: 298782 - protein, 9 aa, Homo Sapiens
NPTWRSLNF

SEQ ID NO: 298783 - protein, 9 aa, Homo Sapiens
YKWYLKGLQ

SEQ ID NO: 298784 - protein, 9 aa, Homo Sapiens
GINAWNTST

SEQ ID NO: 298785 - protein, 9 aa, Homo Sapiens
GHQHFRPKS

SEQ ID NO: 298786 - protein, 9 aa, Homo Sapiens
VQNIISFLK

SEQ ID NO: 298787 - protein, 9 aa, Homo Sapiens
YHDVTILMK

SEQ ID NO: 298788 - protein, 9 aa, Homo Sapiens
NMPASQRSK

SEQ ID NO: 298789 - protein, 9 aa, Homo Sapiens
AKLEWVTKE

SEQ ID NO: 298790 - protein, 9 aa, Homo Sapiens
QEEETHIQN

SEQ ID NO: 298791 - protein, 9 aa, Homo Sapiens
STQTSLDSN

SEQ ID NO: 298792 - protein, 9 aa, Homo Sapiens
FYANMYASI

SEQ ID NO: 298793 - protein, 9 aa, Homo Sapiens
YIYPLVCAL

SEQ ID NO: 298794 - protein, 9 aa, Homo Sapiens
YAGIRCENV

SEQ ID NO: 298795 - protein, 9 aa, Homo Sapiens
KKLLVPDYN

SEQ ID NO: 298796 - protein, 9 aa, Homo Sapiens
FTNLNFVLL

SEQ ID NO: 298797 - protein, 9 aa, Homo Sapiens
NVCYSIPEE

SEQ ID NO: 298798 - protein, 9 aa, Homo Sapiens
MPPKIHYEA

SEQ ID NO: 298799 - protein, 9 aa, Homo Sapiens
LRLLDTKYK

SEQ ID NO: 298800 - protein, 9 aa, Homo Sapiens
ICSPDLLLD

SEQ ID NO: 298801 - protein, 9 aa, Homo Sapiens
HTGKKPLSC

SEQ ID NO: 298802 - protein, 9 aa, Homo Sapiens
AGLEWLAQE

SEQ ID NO: 298803 - protein, 9 aa, Homo Sapiens
AFDYLNPNV

SEQ ID NO: 298804 - protein, 9 aa, Homo Sapiens
GTMGYKDTD

SEQ ID NO: 298805 - protein, 9 aa, Homo Sapiens
REKSNRSKL

SEQ ID NO: 298806 - protein, 9 aa, Homo Sapiens
KDEGEDTLE

SEQ ID NO: 298807 - protein, 9 aa, Homo Sapiens
KTRQLEKHH

SEQ ID NO: 298808 - protein, 9 aa, Homo Sapiens
RYPEATSLS

SEQ ID NO: 298809 - protein, 9 aa, Homo Sapiens
MVSKRFCFD

SEQ ID NO: 298810 - protein, 9 aa, Homo Sapiens
AQYYLYRSK

SEQ ID NO: 298811 - protein, 9 aa, Homo Sapiens
GWEWGKDDN

SEQ ID NO: 298812 - protein, 9 aa, Homo Sapiens
RGDNLVHQI

SEQ ID NO: 298813 - protein, 9 aa, Homo Sapiens
TTVLRLLDT

SEQ ID NO: 298814 - protein, 9 aa, Homo Sapiens
HKDPNVNML

SEQ ID NO: 298815 - protein, 9 aa, Homo Sapiens
TILRVKFKS

SEQ ID NO: 298816 - protein, 9 aa, Homo Sapiens
IFKKTVCDI

SEQ ID NO: 298817 - protein, 9 aa, Homo Sapiens
FIAVDDDKI

SEQ ID NO: 298818 - protein, 9 aa, Homo Sapiens
MLNMDRVNV

SEQ ID NO: 298819 - protein, 9 aa, Homo Sapiens
LGGQAEKHR

SEQ ID NO: 298820 - protein, 9 aa, Homo Sapiens
EYPTPQSYT

SEQ ID NO: 298821 - protein, 9 aa, Homo Sapiens
LPGYIMKIK

SEQ ID NO: 298822 - protein, 9 aa, Homo Sapiens
VKLYNNHDI

SEQ ID NO: 298823 - protein, 9 aa, Homo Sapiens
YLALRPVIA

SEQ ID NO: 298824 - protein, 9 aa, Homo Sapiens
CDDSWDTNY

SEQ ID NO: 298825 - protein, 9 aa, Homo Sapiens
EIPLGECCA

SEQ ID NO: 298826 - protein, 9 aa, Homo Sapiens
DNKAWPAHP

SEQ ID NO: 298827 - protein, 9 aa, Homo Sapiens
NLYHAKNRI

SEQ ID NO: 298828 - protein, 9 aa, Homo Sapiens
DSLASGYQD

SEQ ID NO: 298829 - protein, 9 aa, Homo Sapiens
EMLEESYKP

SEQ ID NO: 298830 - protein, 9 aa, Homo Sapiens
KNTQKSVTA

SEQ ID NO: 298831 - protein, 9 aa, Homo Sapiens
HAVTIHGED

SEQ ID NO: 298832 - protein, 9 aa, Homo Sapiens
ECNNTVGSY

SEQ ID NO: 298833 - protein, 9 aa, Homo Sapiens
QEKEHQRIT

SEQ ID NO: 298834 - protein, 9 aa, Homo Sapiens
ESTLLSLHN

SEQ ID NO: 298835 - protein, 9 aa, Homo Sapiens
QLPVATDFE

SEQ ID NO: 298836 - protein, 9 aa, Homo Sapiens
GLSNSRELN

SEQ ID NO: 298837 - protein, 9 aa, Homo Sapiens
PSPPHPDVC

SEQ ID NO: 298838 - protein, 9 aa, Homo Sapiens
TLSVVASDL

SEQ ID NO: 298839 - protein, 9 aa, Homo Sapiens
DKAAEMEDE

SEQ ID NO: 298840 - protein, 9 aa, Homo Sapiens
DTKIIHMRD

SEQ ID NO: 298841 - protein, 9 aa, Homo Sapiens
FKGRISWAG

SEQ ID NO: 298842 - protein, 9 aa, Homo Sapiens
PSGPPEPPG

SEQ ID NO: 298843 - protein, 9 aa, Homo Sapiens
ANLTKMKST

SEQ ID NO: 298844 - protein, 9 aa, Homo Sapiens
GMSDLLFLS

SEQ ID NO: 298845 - protein, 9 aa, Homo Sapiens
PAGSQCSVD

SEQ ID NO: 298846 - protein, 9 aa, Homo Sapiens
FDKVSNDIT

SEQ ID NO: 298847 - protein, 9 aa, Homo Sapiens
PKPAHLSAN

SEQ ID NO: 298848 - protein, 9 aa, Homo Sapiens
IVFVLIFFS

SEQ ID NO: 298849 - protein, 9 aa, Homo Sapiens
EKREGYPLW

SEQ ID NO: 298850 - protein, 9 aa, Homo Sapiens
NLKGGTNAE

SEQ ID NO: 298851 - protein, 9 aa, Homo Sapiens
TSAKNTLFT

SEQ ID NO: 298852 - protein, 9 aa, Homo Sapiens
AVKLLLDRR

SEQ ID NO: 298853 - protein, 9 aa, Homo Sapiens
GSGVTGNYP

SEQ ID NO: 298854 - protein, 9 aa, Homo Sapiens
GTGGQPHHP

SEQ ID NO: 298855 - protein, 9 aa, Homo Sapiens
AIMREEVYF

SEQ ID NO: 298856 - protein, 9 aa, Homo Sapiens
SRQDQEVAG

SEQ ID NO: 298857 - protein, 9 aa, Homo Sapiens
EVFMANQTS

SEQ ID NO: 298858 - protein, 9 aa, Homo Sapiens
KTTFQKKNC

SEQ ID NO: 298859 - protein, 9 aa, Homo Sapiens
GFSVVQSYC

SEQ ID NO: 298860 - protein, 9 aa, Homo Sapiens
SSNLIQHQI

SEQ ID NO: 298861 - protein, 9 aa, Homo Sapiens
PHWNFQEDT

SEQ ID NO: 298862 - protein, 9 aa, Homo Sapiens
SVISFLELW

SEQ ID NO: 298863 - protein, 9 aa, Homo Sapiens
FKSYSGNIS

SEQ ID NO: 298864 - protein, 9 aa, Homo Sapiens
KDLRTSPDK

SEQ ID NO: 298865 - protein, 9 aa, Homo Sapiens
ELLNNFSEI

SEQ ID NO: 298866 - protein, 9 aa, Homo Sapiens
IINSDQTTC

SEQ ID NO: 298867 - protein, 9 aa, Homo Sapiens
ALSHHSSFQ

SEQ ID NO: 298868 - protein, 9 aa, Homo Sapiens
MVLVQQYLA

SEQ ID NO: 298869 - protein, 9 aa, Homo Sapiens
KKVAKSANK

SEQ ID NO: 298870 - protein, 9 aa, Homo Sapiens
NGRNLGRDW

SEQ ID NO: 298871 - protein, 9 aa, Homo Sapiens
PNRKVNYMC

SEQ ID NO: 298872 - protein, 9 aa, Homo Sapiens
ISLILIYET

SEQ ID NO: 298873 - protein, 9 aa, Homo Sapiens
LDAQHMNFL

SEQ ID NO: 298874 - protein, 9 aa, Homo Sapiens
PKVSNFFVC

SEQ ID NO: 298875 - protein, 9 aa, Homo Sapiens
QDFCLPFIR

SEQ ID NO: 298876 - protein, 9 aa, Homo Sapiens
NIISFLKMQ

SEQ ID NO: 298877 - protein, 9 aa, Homo Sapiens
TRCKGSIYL

SEQ ID NO: 298878 - protein, 9 aa, Homo Sapiens
GRHSLKNKL

SEQ ID NO: 298879 - protein, 9 aa, Homo Sapiens
LKKNSLNEL

SEQ ID NO: 298880 - protein, 9 aa, Homo Sapiens
MFEKKRRDN

SEQ ID NO: 298881 - protein, 9 aa, Homo Sapiens
KRAFVHWCV

SEQ ID NO: 298882 - protein, 9 aa, Homo Sapiens
QLIQKHPQH

SEQ ID NO: 298883 - protein, 9 aa, Homo Sapiens
FAQTKLWMS

SEQ ID NO: 298884 - protein, 9 aa, Homo Sapiens
METMCSRQW

SEQ ID NO: 298885 - protein, 9 aa, Homo Sapiens
FIAQLSINT

SEQ ID NO: 298886 - protein, 9 aa, Homo Sapiens
ENEDNYILW

SEQ ID NO: 298887 - protein, 9 aa, Homo Sapiens
AEVRKVLAN

SEQ ID NO: 298888 - protein, 9 aa, Homo Sapiens
IRGTLDLRK

SEQ ID NO: 298889 - protein, 9 aa, Homo Sapiens
LQGEPQARG

SEQ ID NO: 298890 - protein, 9 aa, Homo Sapiens
CQPNEHNNQ

SEQ ID NO: 298891 - protein, 9 aa, Homo Sapiens
PHTVRRTTK

SEQ ID NO: 298892 - protein, 9 aa, Homo Sapiens
SQLQIHRRI

SEQ ID NO: 298893 - protein, 9 aa, Homo Sapiens
TSLVSMASK

SEQ ID NO: 298894 - protein, 9 aa, Homo Sapiens
DTLLIQDNV

SEQ ID NO: 298895 - protein, 9 aa, Homo Sapiens
KFLLEHHTR

SEQ ID NO: 298896 - protein, 9 aa, Homo Sapiens
FTAKVLYLL

SEQ ID NO: 298897 - protein, 9 aa, Homo Sapiens
LFSRQGKLQ

SEQ ID NO: 298898 - protein, 9 aa, Homo Sapiens
WAVWEETRD

SEQ ID NO: 298899 - protein, 9 aa, Homo Sapiens
LFKIMKTLT

SEQ ID NO: 298900 - protein, 9 aa, Homo Sapiens
SFSGCFLQL

SEQ ID NO: 298901 - protein, 9 aa, Homo Sapiens
NWEYFKSSC

SEQ ID NO: 298902 - protein, 9 aa, Homo Sapiens
GGDTSKKGV

SEQ ID NO: 298903 - protein, 9 aa, Homo Sapiens
YCETDLIFL

SEQ ID NO: 298904 - protein, 9 aa, Homo Sapiens
ILVSFTWMG

SEQ ID NO: 298905 - protein, 9 aa, Homo Sapiens
LVRNVSLNL

SEQ ID NO: 298906 - protein, 9 aa, Homo Sapiens
QGPPQPQSL

SEQ ID NO: 298907 - protein, 9 aa, Homo Sapiens
NCSSTLNKH

SEQ ID NO: 298908 - protein, 9 aa, Homo Sapiens
VDGMLSRAL

SEQ ID NO: 298909 - protein, 9 aa, Homo Sapiens
QHVVKQLEG

SEQ ID NO: 298910 - protein, 9 aa, Homo Sapiens
LKVLEICDN

SEQ ID NO: 298911 - protein, 9 aa, Homo Sapiens
HGLCTSQHL

SEQ ID NO: 298912 - protein, 9 aa, Homo Sapiens
LAAVPGATR

SEQ ID NO: 298913 - protein, 9 aa, Homo Sapiens
PVSLEMINE

SEQ ID NO: 298914 - protein, 9 aa, Homo Sapiens
LKTIPESEP

SEQ ID NO: 298915 - protein, 9 aa, Homo Sapiens
SEKLTTLKQ

SEQ ID NO: 298916 - protein, 9 aa, Homo Sapiens
IKASRCRPA

SEQ ID NO: 298917 - protein, 9 aa, Homo Sapiens
LSRLAKQGN

SEQ ID NO: 298918 - protein, 9 aa, Homo Sapiens
NIQPKVEEN

SEQ ID NO: 298919 - protein, 9 aa, Homo Sapiens
ADIVFQTAQ

SEQ ID NO: 298920 - protein, 9 aa, Homo Sapiens
GQSPVLQII

SEQ ID NO: 298921 - protein, 9 aa, Homo Sapiens
WLRMHLLAH

SEQ ID NO: 298922 - protein, 9 aa, Homo Sapiens
ANHMRSEDD

SEQ ID NO: 298923 - protein, 9 aa, Homo Sapiens
RFKTVTSSG

SEQ ID NO: 298924 - protein, 9 aa, Homo Sapiens
FSATLQALG

SEQ ID NO: 298925 - protein, 9 aa, Homo Sapiens
GKPALSKNN

SEQ ID NO: 298926 - protein, 9 aa, Homo Sapiens
SYRESICHL

SEQ ID NO: 298927 - protein, 9 aa, Homo Sapiens
LTVICTEPS

SEQ ID NO: 298928 - protein, 9 aa, Homo Sapiens
CEPALGQYP

SEQ ID NO: 298929 - protein, 9 aa, Homo Sapiens
PVWGLLPSQ

SEQ ID NO: 298930 - protein, 9 aa, Homo Sapiens
VEQEVKIII

SEQ ID NO: 298931 - protein, 9 aa, Homo Sapiens
GQKHKHKKF

SEQ ID NO: 298932 - protein, 9 aa, Homo Sapiens
SDTTSTFKP

SEQ ID NO: 298933 - protein, 9 aa, Homo Sapiens
YLVASKEPN

SEQ ID NO: 298934 - protein, 9 aa, Homo Sapiens
TYIIYNYHG

SEQ ID NO: 298935 - protein, 9 aa, Homo Sapiens
KNVNRTKEA

SEQ ID NO: 298936 - protein, 9 aa, Homo Sapiens
LSRHHIIHT

SEQ ID NO: 298937 - protein, 9 aa, Homo Sapiens
QALNIAEDL

SEQ ID NO: 298938 - protein, 9 aa, Homo Sapiens
NLCDYDTHN

SEQ ID NO: 298939 - protein, 9 aa, Homo Sapiens
DLVECLLRQ

SEQ ID NO: 298940 - protein, 9 aa, Homo Sapiens
FEINFDRQK

SEQ ID NO: 298941 - protein, 9 aa, Homo Sapiens
ADFREQIVR

SEQ ID NO: 298942 - protein, 9 aa, Homo Sapiens
SLDSGMSGI

SEQ ID NO: 298943 - protein, 9 aa, Homo Sapiens
KYKRQLLNC

SEQ ID NO: 298944 - protein, 9 aa, Homo Sapiens
LKGKEGKET

SEQ ID NO: 298945 - protein, 9 aa, Homo Sapiens
EERLQNQEK

SEQ ID NO: 298946 - protein, 9 aa, Homo Sapiens
RRWLCEQQH

SEQ ID NO: 298947 - protein, 9 aa, Homo Sapiens
NLVGLIKVT

SEQ ID NO: 298948 - protein, 9 aa, Homo Sapiens
PDHMELTSI

SEQ ID NO: 298949 - protein, 9 aa, Homo Sapiens
FRADKSYTV

SEQ ID NO: 298950 - protein, 9 aa, Homo Sapiens
YDPDREKSP

SEQ ID NO: 298951 - protein, 9 aa, Homo Sapiens
GVFGTDYSE

SEQ ID NO: 298952 - protein, 9 aa, Homo Sapiens
CVSVCNQIV

SEQ ID NO: 298953 - protein, 9 aa, Homo Sapiens
PLTFNFISY

SEQ ID NO: 298954 - protein, 9 aa, Homo Sapiens
WSSALNSLH

SEQ ID NO: 298955 - protein, 9 aa, Homo Sapiens
DHCMKLMQQ

SEQ ID NO: 298956 - protein, 9 aa, Homo Sapiens
ALPLLDEVL

SEQ ID NO: 298957 - protein, 9 aa, Homo Sapiens
EFVGARHSK

SEQ ID NO: 298958 - protein, 9 aa, Homo Sapiens
QGTNEYVPR

SEQ ID NO: 298959 - protein, 9 aa, Homo Sapiens
HAKMRQEHQ

SEQ ID NO: 298960 - protein, 9 aa, Homo Sapiens
QGPGDRKAR

SEQ ID NO: 298961 - protein, 9 aa, Homo Sapiens
DKLHIMKDK

SEQ ID NO: 298962 - protein, 9 aa, Homo Sapiens
HYWVLQFLF

SEQ ID NO: 298963 - protein, 9 aa, Homo Sapiens
NLQEDISDL

SEQ ID NO: 298964 - protein, 9 aa, Homo Sapiens
IPQLQLPML

SEQ ID NO: 298965 - protein, 9 aa, Homo Sapiens
QYNYGIQNY

SEQ ID NO: 298966 - protein, 9 aa, Homo Sapiens
LQRIEDFDL

SEQ ID NO: 298967 - protein, 9 aa, Homo Sapiens
LNKAFLINK

SEQ ID NO: 298968 - protein, 9 aa, Homo Sapiens
FTPRPQDHD

SEQ ID NO: 298969 - protein, 9 aa, Homo Sapiens
YFASLNKSA

SEQ ID NO: 298970 - protein, 9 aa, Homo Sapiens
KNKIFGYNK

SEQ ID NO: 298971 - protein, 9 aa, Homo Sapiens
IYPPLAQAI

SEQ ID NO: 298972 - protein, 9 aa, Homo Sapiens
NVDSDSGFL

SEQ ID NO: 298973 - protein, 9 aa, Homo Sapiens
DLSRDGNAL

SEQ ID NO: 298974 - protein, 9 aa, Homo Sapiens
DLRLVDSDG

SEQ ID NO: 298975 - protein, 9 aa, Homo Sapiens
IEHLQNELR

SEQ ID NO: 298976 - protein, 9 aa, Homo Sapiens
RGGAGATFK

SEQ ID NO: 298977 - protein, 9 aa, Homo Sapiens
TINAMQKAC

SEQ ID NO: 298978 - protein, 9 aa, Homo Sapiens
SDDSSRNEG

SEQ ID NO: 298979 - protein, 9 aa, Homo Sapiens
TKMYETTTT

SEQ ID NO: 298980 - protein, 9 aa, Homo Sapiens
PPPPLYGDE

SEQ ID NO: 298981 - protein, 9 aa, Homo Sapiens
KDGDVKYML

SEQ ID NO: 298982 - protein, 9 aa, Homo Sapiens
NKSLTPAVP

SEQ ID NO: 298983 - protein, 9 aa, Homo Sapiens
SNCGIWQPK

SEQ ID NO: 298984 - protein, 9 aa, Homo Sapiens
FTEMPTDTF

SEQ ID NO: 298985 - protein, 9 aa, Homo Sapiens
VPSFLCGES

SEQ ID NO: 298986 - protein, 9 aa, Homo Sapiens
EYQGVRKDL

SEQ ID NO: 298987 - protein, 9 aa, Homo Sapiens
VQVQWEINI

SEQ ID NO: 298988 - protein, 9 aa, Homo Sapiens
KGLEVLAEI

SEQ ID NO: 298989 - protein, 9 aa, Homo Sapiens
TDESDLSEH

SEQ ID NO: 298990 - protein, 9 aa, Homo Sapiens
PMYHFVSVI

SEQ ID NO: 298991 - protein, 9 aa, Homo Sapiens
KQRTKDISR

SEQ ID NO: 298992 - protein, 9 aa, Homo Sapiens
QMDLHLHTP

SEQ ID NO: 298993 - protein, 9 aa, Homo Sapiens
KNHRIASSL

SEQ ID NO: 298994 - protein, 9 aa, Homo Sapiens
LSYRIFSNM

SEQ ID NO: 298995 - protein, 9 aa, Homo Sapiens
STGPYPCGK

SEQ ID NO: 298996 - protein, 9 aa, Homo Sapiens
ETPQRRSHS

SEQ ID NO: 298997 - protein, 9 aa, Homo Sapiens
LAQPDDSDQ

SEQ ID NO: 298998 - protein, 9 aa, Homo Sapiens
QKAITTMEM

SEQ ID NO: 298999 - protein, 9 aa, Homo Sapiens
HLYLGCNKL

SEQ ID NO: 299000 - protein, 9 aa, Homo Sapiens
ASATFEYFQ

SEQ ID NO: 299001 - protein, 9 aa, Homo Sapiens
HKGQDGIIG

SEQ ID NO: 299002 - protein, 9 aa, Homo Sapiens
EIQYPLNKL

SEQ ID NO: 299003 - protein, 9 aa, Homo Sapiens
RGEHAWTHI

SEQ ID NO: 299004 - protein, 9 aa, Homo Sapiens
QSAQILDNY

SEQ ID NO: 299005 - protein, 9 aa, Homo Sapiens
FGDLLCKIF

SEQ ID NO: 299006 - protein, 9 aa, Homo Sapiens
SAHYDSLEE

SEQ ID NO: 299007 - protein, 9 aa, Homo Sapiens
AKGTAEKLD

SEQ ID NO: 299008 - protein, 9 aa, Homo Sapiens
DDQPNSSSL

SEQ ID NO: 299009 - protein, 9 aa, Homo Sapiens
EGGIHKDIL

SEQ ID NO: 299010 - protein, 9 aa, Homo Sapiens
IHETWKESV

SEQ ID NO: 299011 - protein, 9 aa, Homo Sapiens
LVCSKDISA

SEQ ID NO: 299012 - protein, 9 aa, Homo Sapiens
LRQITGSLK

SEQ ID NO: 299013 - protein, 9 aa, Homo Sapiens
QGFYCGGKM

SEQ ID NO: 299014 - protein, 9 aa, Homo Sapiens
PGGVYSSGL

SEQ ID NO: 299015 - protein, 9 aa, Homo Sapiens
AVGYWKKHF

SEQ ID NO: 299016 - protein, 9 aa, Homo Sapiens
GPRETEPEG

SEQ ID NO: 299017 - protein, 9 aa, Homo Sapiens
VQMKQKNKQ

SEQ ID NO: 299018 - protein, 9 aa, Homo Sapiens
AKCSKPLVD

SEQ ID NO: 299019 - protein, 9 aa, Homo Sapiens
FSFIDPLAY

SEQ ID NO: 299020 - protein, 9 aa, Homo Sapiens
EAIQHSLVS

SEQ ID NO: 299021 - protein, 9 aa, Homo Sapiens
APGFPGVKG

SEQ ID NO: 299022 - protein, 9 aa, Homo Sapiens
QCQITNETA

SEQ ID NO: 299023 - protein, 9 aa, Homo Sapiens
LLKTNSAVQ

SEQ ID NO: 299024 - protein, 9 aa, Homo Sapiens
FHRTMLTFS

SEQ ID NO: 299025 - protein, 9 aa, Homo Sapiens
PVKTLLEYL

SEQ ID NO: 299026 - protein, 9 aa, Homo Sapiens
DHQGIFKIN

SEQ ID NO: 299027 - protein, 9 aa, Homo Sapiens
IPCVLGWNG

SEQ ID NO: 299028 - protein, 9 aa, Homo Sapiens
FTTHIFNTY

SEQ ID NO: 299029 - protein, 9 aa, Homo Sapiens
NYEQVKEYC

SEQ ID NO: 299030 - protein, 9 aa, Homo Sapiens
ECSECGQSF

SEQ ID NO: 299031 - protein, 9 aa, Homo Sapiens
IVRHLNMPK

SEQ ID NO: 299032 - protein, 9 aa, Homo Sapiens
LFKDAIRRF

SEQ ID NO: 299033 - protein, 9 aa, Homo Sapiens
TLPNDQSSS

SEQ ID NO: 299034 - protein, 9 aa, Homo Sapiens
PDKTDMTPS

SEQ ID NO: 299035 - protein, 9 aa, Homo Sapiens
ECISPQSRL

SEQ ID NO: 299036 - protein, 9 aa, Homo Sapiens
YNDTFTVKY

SEQ ID NO: 299037 - protein, 9 aa, Homo Sapiens
LRTPGSCRH

SEQ ID NO: 299038 - protein, 9 aa, Homo Sapiens
KHKNIHTGE

SEQ ID NO: 299039 - protein, 9 aa, Homo Sapiens
QKVTPNTVL

SEQ ID NO: 299040 - protein, 9 aa, Homo Sapiens
KECGKALFY

SEQ ID NO: 299041 - protein, 9 aa, Homo Sapiens
KSSLERHRI

SEQ ID NO: 299042 - protein, 9 aa, Homo Sapiens
LFVRDFDPV

SEQ ID NO: 299043 - protein, 9 aa, Homo Sapiens
LLYPKDLRL

SEQ ID NO: 299044 - protein, 9 aa, Homo Sapiens
NPEIPLGEC

SEQ ID NO: 299045 - protein, 9 aa, Homo Sapiens
LISVGTFLL

SEQ ID NO: 299046 - protein, 9 aa, Homo Sapiens
RWIILLVKA

SEQ ID NO: 299047 - protein, 9 aa, Homo Sapiens
SESKDNCTG

SEQ ID NO: 299048 - protein, 9 aa, Homo Sapiens
IIYIEDNLS

SEQ ID NO: 299049 - protein, 9 aa, Homo Sapiens
QEVNLEFHV

SEQ ID NO: 299050 - protein, 9 aa, Homo Sapiens
NICQIRFNY

SEQ ID NO: 299051 - protein, 9 aa, Homo Sapiens
CNGCGKAFS

SEQ ID NO: 299052 - protein, 9 aa, Homo Sapiens
SDLPSPIYL

SEQ ID NO: 299053 - protein, 9 aa, Homo Sapiens
KPRRSHRMW

SEQ ID NO: 299054 - protein, 9 aa, Homo Sapiens
CVEPLGLDN

SEQ ID NO: 299055 - protein, 9 aa, Homo Sapiens
TVYNNRGEI

SEQ ID NO: 299056 - protein, 9 aa, Homo Sapiens
SKQYPVTCL

SEQ ID NO: 299057 - protein, 9 aa, Homo Sapiens
SSSEIILPM

SEQ ID NO: 299058 - protein, 9 aa, Homo Sapiens
KPQEQDVKD

SEQ ID NO: 299059 - protein, 9 aa, Homo Sapiens
TVRALRRAL

SEQ ID NO: 299060 - protein, 9 aa, Homo Sapiens
FKETNKQFD

SEQ ID NO: 299061 - protein, 9 aa, Homo Sapiens
EVDKDEDAT

SEQ ID NO: 299062 - protein, 9 aa, Homo Sapiens
DRESIPFVV

SEQ ID NO: 299063 - protein, 9 aa, Homo Sapiens
NTNSPTNIL

SEQ ID NO: 299064 - protein, 9 aa, Homo Sapiens
KTLKEDWAS

SEQ ID NO: 299065 - protein, 9 aa, Homo Sapiens
TLKKSKIED

SEQ ID NO: 299066 - protein, 9 aa, Homo Sapiens
SSEKQICGA

SEQ ID NO: 299067 - protein, 9 aa, Homo Sapiens
SVSHGSETI

SEQ ID NO: 299068 - protein, 9 aa, Homo Sapiens
LDSDKPIFF

SEQ ID NO: 299069 - protein, 9 aa, Homo Sapiens
YSKDLESAE

SEQ ID NO: 299070 - protein, 9 aa, Homo Sapiens
RHCIGPSCD

SEQ ID NO: 299071 - protein, 9 aa, Homo Sapiens
KCFNKRKTY

SEQ ID NO: 299072 - protein, 9 aa, Homo Sapiens
IRHSRKKRL

SEQ ID NO: 299073 - protein, 9 aa, Homo Sapiens
CESNYPFPV

SEQ ID NO: 299074 - protein, 9 aa, Homo Sapiens
HNGDMEKII

SEQ ID NO: 299075 - protein, 9 aa, Homo Sapiens
EVVEGDLIK

SEQ ID NO: 299076 - protein, 9 aa, Homo Sapiens
VKDNLLSCK

SEQ ID NO: 299077 - protein, 9 aa, Homo Sapiens
GFLIIFSPV

SEQ ID NO: 299078 - protein, 9 aa, Homo Sapiens
YILFRARWK

SEQ ID NO: 299079 - protein, 9 aa, Homo Sapiens
KTLCALAVD

SEQ ID NO: 299080 - protein, 9 aa, Homo Sapiens
GTLSTASTN

SEQ ID NO: 299081 - protein, 9 aa, Homo Sapiens
AERKNIYQE

SEQ ID NO: 299082 - protein, 9 aa, Homo Sapiens
LLFYFIPSQ

SEQ ID NO: 299083 - protein, 9 aa, Homo Sapiens
ADRAFDIVH

SEQ ID NO: 299084 - protein, 9 aa, Homo Sapiens
NTTKTQSKE

SEQ ID NO: 299085 - protein, 9 aa, Homo Sapiens
LGRVYVSVD

SEQ ID NO: 299086 - protein, 9 aa, Homo Sapiens
SKLKELLNN

SEQ ID NO: 299087 - protein, 9 aa, Homo Sapiens
LIPWLLSPK

SEQ ID NO: 299088 - protein, 9 aa, Homo Sapiens
SKSSYLIIH

SEQ ID NO: 299089 - protein, 9 aa, Homo Sapiens
KGATATYTE

SEQ ID NO: 299090 - protein, 9 aa, Homo Sapiens
DPTFTLSVV

SEQ ID NO: 299091 - protein, 9 aa, Homo Sapiens
FVMQEDLSR

SEQ ID NO: 299092 - protein, 9 aa, Homo Sapiens
MFCITNIEF

SEQ ID NO: 299093 - protein, 9 aa, Homo Sapiens
NKRIAVIGG

SEQ ID NO: 299094 - protein, 9 aa, Homo Sapiens
NDILIMELN

SEQ ID NO: 299095 - protein, 9 aa, Homo Sapiens
QRHTAYISE

SEQ ID NO: 299096 - protein, 9 aa, Homo Sapiens
RLHRKVHTG

SEQ ID NO: 299097 - protein, 9 aa, Homo Sapiens
HHDGNIIDA

SEQ ID NO: 299098 - protein, 9 aa, Homo Sapiens
LMLCRSETV

SEQ ID NO: 299099 - protein, 9 aa, Homo Sapiens
TGKHGSMES

SEQ ID NO: 299100 - protein, 9 aa, Homo Sapiens
IHALYPEGQ

SEQ ID NO: 299101 - protein, 9 aa, Homo Sapiens
EAYYKEKSS

SEQ ID NO: 299102 - protein, 9 aa, Homo Sapiens
TNQNAISSS

SEQ ID NO: 299103 - protein, 9 aa, Homo Sapiens
YVNNPEDNN

SEQ ID NO: 299104 - protein, 9 aa, Homo Sapiens
ALTIKLIQN

SEQ ID NO: 299105 - protein, 9 aa, Homo Sapiens
FVDMPQSPL

SEQ ID NO: 299106 - protein, 9 aa, Homo Sapiens
LVNYEQVKE

SEQ ID NO: 299107 - protein, 9 aa, Homo Sapiens
LLDEPNPTS

SEQ ID NO: 299108 - protein, 9 aa, Homo Sapiens
NHYQNIFSC

SEQ ID NO: 299109 - protein, 9 aa, Homo Sapiens
ASPSELNLK

SEQ ID NO: 299110 - protein, 9 aa, Homo Sapiens
MNHRSSMQV

SEQ ID NO: 299111 - protein, 9 aa, Homo Sapiens
NLKITFLEA

SEQ ID NO: 299112 - protein, 9 aa, Homo Sapiens
AKNPKLMLC

SEQ ID NO: 299113 - protein, 9 aa, Homo Sapiens
ALAQDAIFR

SEQ ID NO: 299114 - protein, 9 aa, Homo Sapiens
TGQKTYRCN

SEQ ID NO: 299115 - protein, 9 aa, Homo Sapiens
FCVRLRKKN

SEQ ID NO: 299116 - protein, 9 aa, Homo Sapiens
PFTTEAELM

SEQ ID NO: 299117 - protein, 9 aa, Homo Sapiens
QTRFPVLVT

SEQ ID NO: 299118 - protein, 9 aa, Homo Sapiens
MKNHRIASS

SEQ ID NO: 299119 - protein, 9 aa, Homo Sapiens
IRYKLDRHK

SEQ ID NO: 299120 - protein, 9 aa, Homo Sapiens
GKAFTTFLS

SEQ ID NO: 299121 - protein, 9 aa, Homo Sapiens
KQRFEDKCY

SEQ ID NO: 299122 - protein, 9 aa, Homo Sapiens
PKLITEKED

SEQ ID NO: 299123 - protein, 9 aa, Homo Sapiens
LKGSFSLFV

SEQ ID NO: 299124 - protein, 9 aa, Homo Sapiens
IRELPKSQP

SEQ ID NO: 299125 - protein, 9 aa, Homo Sapiens
LLSNLNIWN

SEQ ID NO: 299126 - protein, 9 aa, Homo Sapiens
IQSRFLQSW

SEQ ID NO: 299127 - protein, 9 aa, Homo Sapiens
SEGACDVDN

SEQ ID NO: 299128 - protein, 9 aa, Homo Sapiens
TVQKVTPNT

SEQ ID NO: 299129 - protein, 9 aa, Homo Sapiens
VHTGKKSKN

SEQ ID NO: 299130 - protein, 9 aa, Homo Sapiens
TNKRNGGGS

SEQ ID NO: 299131 - protein, 9 aa, Homo Sapiens
NTLFTWKAN

SEQ ID NO: 299132 - protein, 9 aa, Homo Sapiens
GKQKTYQKK

SEQ ID NO: 299133 - protein, 9 aa, Homo Sapiens
NRVGKAFHA

SEQ ID NO: 299134 - protein, 9 aa, Homo Sapiens
PGDLSAHCS

SEQ ID NO: 299135 - protein, 9 aa, Homo Sapiens
QTHEEKSYG

SEQ ID NO: 299136 - protein, 9 aa, Homo Sapiens
KIKTNKGLA

SEQ ID NO: 299137 - protein, 9 aa, Homo Sapiens
FDIPNILDL

SEQ ID NO: 299138 - protein, 9 aa, Homo Sapiens
YPKEIVRYY

SEQ ID NO: 299139 - protein, 9 aa, Homo Sapiens
ELESYAYYL

SEQ ID NO: 299140 - protein, 9 aa, Homo Sapiens
ATSPPTIPL

SEQ ID NO: 299141 - protein, 9 aa, Homo Sapiens
FKCNICLET

SEQ ID NO: 299142 - protein, 9 aa, Homo Sapiens
PFVTSQLYS

SEQ ID NO: 299143 - protein, 9 aa, Homo Sapiens
VPLRKKRVS

SEQ ID NO: 299144 - protein, 9 aa, Homo Sapiens
QAHLSEDCS

SEQ ID NO: 299145 - protein, 9 aa, Homo Sapiens
PPGATAKGL

SEQ ID NO: 299146 - protein, 9 aa, Homo Sapiens
YASILTMTC

SEQ ID NO: 299147 - protein, 9 aa, Homo Sapiens
QFQYQDNIN

SEQ ID NO: 299148 - protein, 9 aa, Homo Sapiens
NVVGQILVF

SEQ ID NO: 299149 - protein, 9 aa, Homo Sapiens
ILEEDNHIK

SEQ ID NO: 299150 - protein, 9 aa, Homo Sapiens
NGYQIVYNN

SEQ ID NO: 299151 - protein, 9 aa, Homo Sapiens
SMTLKLPTP

SEQ ID NO: 299152 - protein, 9 aa, Homo Sapiens
PSIHHFVKK

SEQ ID NO: 299153 - protein, 9 aa, Homo Sapiens
PEEVCEHVK

SEQ ID NO: 299154 - protein, 9 aa, Homo Sapiens
YKCNDCGNF

SEQ ID NO: 299155 - protein, 9 aa, Homo Sapiens
REVGPNNSY

SEQ ID NO: 299156 - protein, 9 aa, Homo Sapiens
PIEPCLSNP

SEQ ID NO: 299157 - protein, 9 aa, Homo Sapiens
RPLYGVITA

SEQ ID NO: 299158 - protein, 9 aa, Homo Sapiens
IVTIIQMDL

SEQ ID NO: 299159 - protein, 9 aa, Homo Sapiens
EHAWTHILR

SEQ ID NO: 299160 - protein, 9 aa, Homo Sapiens
IFISNYMRL

SEQ ID NO: 299161 - protein, 9 aa, Homo Sapiens
CDQAFSCLS

SEQ ID NO: 299162 - protein, 9 aa, Homo Sapiens
RRFSGLEMS

SEQ ID NO: 299163 - protein, 9 aa, Homo Sapiens
TGLERRVVM

SEQ ID NO: 299164 - protein, 9 aa, Homo Sapiens
EAHLQQYSQ

SEQ ID NO: 299165 - protein, 9 aa, Homo Sapiens
QISHTGERP

SEQ ID NO: 299166 - protein, 9 aa, Homo Sapiens
AFSKVVLAE

SEQ ID NO: 299167 - protein, 9 aa, Homo Sapiens
IPTHGSWQW

SEQ ID NO: 299168 - protein, 9 aa, Homo Sapiens
QIKCGIWTP

SEQ ID NO: 299169 - protein, 9 aa, Homo Sapiens
GMATNIKNY

SEQ ID NO: 299170 - protein, 9 aa, Homo Sapiens
CEDGNSISS

SEQ ID NO: 299171 - protein, 9 aa, Homo Sapiens
DFDLAHKLE

SEQ ID NO: 299172 - protein, 9 aa, Homo Sapiens
CCNDTRVFV

SEQ ID NO: 299173 - protein, 9 aa, Homo Sapiens
LLARDFENN

SEQ ID NO: 299174 - protein, 9 aa, Homo Sapiens
QNDEQFLEA

SEQ ID NO: 299175 - protein, 9 aa, Homo Sapiens
FSILEILFT

SEQ ID NO: 299176 - protein, 9 aa, Homo Sapiens
RPCKRTACQ

SEQ ID NO: 299177 - protein, 9 aa, Homo Sapiens
NITGFYRHS

SEQ ID NO: 299178 - protein, 9 aa, Homo Sapiens
MNAYLFKGN

SEQ ID NO: 299179 - protein, 9 aa, Homo Sapiens
RLQKIREKR

SEQ ID NO: 299180 - protein, 9 aa, Homo Sapiens
AQIAQISAG

SEQ ID NO: 299181 - protein, 9 aa, Homo Sapiens
DLMTIHLLG

SEQ ID NO: 299182 - protein, 9 aa, Homo Sapiens
LVTQQNVPI

SEQ ID NO: 299183 - protein, 9 aa, Homo Sapiens
NNPYFRDQT

SEQ ID NO: 299184 - protein, 9 aa, Homo Sapiens
MASSIFRVP

SEQ ID NO: 299185 - protein, 9 aa, Homo Sapiens
DFENNYNMY

SEQ ID NO: 299186 - protein, 9 aa, Homo Sapiens
QQEVLRAQK

SEQ ID NO: 299187 - protein, 9 aa, Homo Sapiens
ADARWWGLI

SEQ ID NO: 299188 - protein, 9 aa, Homo Sapiens
NSLNNRIEL

SEQ ID NO: 299189 - protein, 9 aa, Homo Sapiens
FLTFILHNF

SEQ ID NO: 299190 - protein, 9 aa, Homo Sapiens
SKTESINDG

SEQ ID NO: 299191 - protein, 9 aa, Homo Sapiens
KYPQLSVHV

SEQ ID NO: 299192 - protein, 9 aa, Homo Sapiens
LNNKILANG

SEQ ID NO: 299193 - protein, 9 aa, Homo Sapiens
WQASLEGAT

SEQ ID NO: 299194 - protein, 9 aa, Homo Sapiens
VELSSDKQY

SEQ ID NO: 299195 - protein, 9 aa, Homo Sapiens
CSTLIQHKI

SEQ ID NO: 299196 - protein, 9 aa, Homo Sapiens
LNIQFGLVN

SEQ ID NO: 299197 - protein, 9 aa, Homo Sapiens
QESSFWSRK

SEQ ID NO: 299198 - protein, 9 aa, Homo Sapiens
AGGHVKFRF

SEQ ID NO: 299199 - protein, 9 aa, Homo Sapiens
STAINRAAP

SEQ ID NO: 299200 - protein, 9 aa, Homo Sapiens
HYSKMRLEQ

SEQ ID NO: 299201 - protein, 9 aa, Homo Sapiens
GFHKVTYKS

SEQ ID NO: 299202 - protein, 9 aa, Homo Sapiens
IQVWFSNQR

SEQ ID NO: 299203 - protein, 9 aa, Homo Sapiens
SLISTFRFN

SEQ ID NO: 299204 - protein, 9 aa, Homo Sapiens
FKTEKMLTN

SEQ ID NO: 299205 - protein, 9 aa, Homo Sapiens
SYNFRLHRK

SEQ ID NO: 299206 - protein, 9 aa, Homo Sapiens
IKYYYCEVP

SEQ ID NO: 299207 - protein, 9 aa, Homo Sapiens
EGRDLNDKI

SEQ ID NO: 299208 - protein, 9 aa, Homo Sapiens
GNPKMKIHG

SEQ ID NO: 299209 - protein, 9 aa, Homo Sapiens
LFVKYKNYS

SEQ ID NO: 299210 - protein, 9 aa, Homo Sapiens
HLEFLDKQN

SEQ ID NO: 299211 - protein, 9 aa, Homo Sapiens
KLMEHKIIH

SEQ ID NO: 299212 - protein, 9 aa, Homo Sapiens
DNGKACIST

SEQ ID NO: 299213 - protein, 9 aa, Homo Sapiens
NNFLFDIPN

SEQ ID NO: 299214 - protein, 9 aa, Homo Sapiens
TVPNIIKIS

SEQ ID NO: 299215 - protein, 9 aa, Homo Sapiens
IYKCGRIEV

SEQ ID NO: 299216 - protein, 9 aa, Homo Sapiens
KDPNVNMLH

SEQ ID NO: 299217 - protein, 9 aa, Homo Sapiens
LSYRQQAAD

SEQ ID NO: 299218 - protein, 9 aa, Homo Sapiens
TGQLAHRFT

SEQ ID NO: 299219 - protein, 9 aa, Homo Sapiens
KSAEKPQSS

SEQ ID NO: 299220 - protein, 9 aa, Homo Sapiens
MPAERCLPR

SEQ ID NO: 299221 - protein, 9 aa, Homo Sapiens
DLSSFELFE

SEQ ID NO: 299222 - protein, 9 aa, Homo Sapiens
WSIINPNKA

SEQ ID NO: 299223 - protein, 9 aa, Homo Sapiens
ETTKTGDNR

SEQ ID NO: 299224 - protein, 9 aa, Homo Sapiens
SVRQLENEF

SEQ ID NO: 299225 - protein, 9 aa, Homo Sapiens
QYPVTCLEQ

SEQ ID NO: 299226 - protein, 9 aa, Homo Sapiens
SRPCKRTAC

SEQ ID NO: 299227 - protein, 9 aa, Homo Sapiens
WRHCIGPSC

SEQ ID NO: 299228 - protein, 9 aa, Homo Sapiens
HENLMEAIW

SEQ ID NO: 299229 - protein, 9 aa, Homo Sapiens
QFMADPCLS

SEQ ID NO: 299230 - protein, 9 aa, Homo Sapiens
YRRPLQTHY

SEQ ID NO: 299231 - protein, 9 aa, Homo Sapiens
VTGVHMNIL

SEQ ID NO: 299232 - protein, 9 aa, Homo Sapiens
GNDVNLQDT

SEQ ID NO: 299233 - protein, 9 aa, Homo Sapiens
TAYSKLNET

SEQ ID NO: 299234 - protein, 9 aa, Homo Sapiens
HLAWTRNKL

SEQ ID NO: 299235 - protein, 9 aa, Homo Sapiens
EVGPNNSYI

SEQ ID NO: 299236 - protein, 9 aa, Homo Sapiens
HEIPKVFAP

SEQ ID NO: 299237 - protein, 9 aa, Homo Sapiens
FIANHMRSE

SEQ ID NO: 299238 - protein, 9 aa, Homo Sapiens
NCMRTNSRD

SEQ ID NO: 299239 - protein, 9 aa, Homo Sapiens
FAFLISLIL

SEQ ID NO: 299240 - protein, 9 aa, Homo Sapiens
DIWELSRCS

SEQ ID NO: 299241 - protein, 9 aa, Homo Sapiens
DVRHANSGG

SEQ ID NO: 299242 - protein, 9 aa, Homo Sapiens
TKMKSTLIS

SEQ ID NO: 299243 - protein, 9 aa, Homo Sapiens
GKSLSSTSV

SEQ ID NO: 299244 - protein, 9 aa, Homo Sapiens
YQCETGYEL

SEQ ID NO: 299245 - protein, 9 aa, Homo Sapiens
NSTFLNSFG

SEQ ID NO: 299246 - protein, 9 aa, Homo Sapiens
NKIHTGEKP

SEQ ID NO: 299247 - protein, 9 aa, Homo Sapiens
STSVDLTNK

SEQ ID NO: 299248 - protein, 9 aa, Homo Sapiens
LYLPPDLSD

SEQ ID NO: 299249 - protein, 9 aa, Homo Sapiens
TDNKGTLAN

SEQ ID NO: 299250 - protein, 9 aa, Homo Sapiens
MVFGLGYVA

SEQ ID NO: 299251 - protein, 9 aa, Homo Sapiens
GIIQFISTL

SEQ ID NO: 299252 - protein, 9 aa, Homo Sapiens
LKYAKEVNS

SEQ ID NO: 299253 - protein, 9 aa, Homo Sapiens
EPVIQVNYW

SEQ ID NO: 299254 - protein, 9 aa, Homo Sapiens
LFAFVSHMG

SEQ ID NO: 299255 - protein, 9 aa, Homo Sapiens
HQPWTQEAV

SEQ ID NO: 299256 - protein, 9 aa, Homo Sapiens
IYSFASIKN

SEQ ID NO: 299257 - protein, 9 aa, Homo Sapiens
ALEAMKNTQ

SEQ ID NO: 299258 - protein, 9 aa, Homo Sapiens
QENNPEEIL

SEQ ID NO: 299259 - protein, 9 aa, Homo Sapiens
PPILYWFYN

SEQ ID NO: 299260 - protein, 9 aa, Homo Sapiens
YSSSFQIHE

SEQ ID NO: 299261 - protein, 9 aa, Homo Sapiens
FCAGRDSYL

SEQ ID NO: 299262 - protein, 9 aa, Homo Sapiens
LINTTEIVT

SEQ ID NO: 299263 - protein, 9 aa, Homo Sapiens
HFVSVISFL

SEQ ID NO: 299264 - protein, 9 aa, Homo Sapiens
IKTDNLLLY

SEQ ID NO: 299265 - protein, 9 aa, Homo Sapiens
PLPPPGDRP

SEQ ID NO: 299266 - protein, 9 aa, Homo Sapiens
APIIKKIVQ

SEQ ID NO: 299267 - protein, 9 aa, Homo Sapiens
NTDETLFGV

SEQ ID NO: 299268 - protein, 9 aa, Homo Sapiens
STQENKSIK

SEQ ID NO: 299269 - protein, 9 aa, Homo Sapiens
TGVDVDPEQ

SEQ ID NO: 299270 - protein, 9 aa, Homo Sapiens
IGKNKPAAA

SEQ ID NO: 299271 - protein, 9 aa, Homo Sapiens
TVENCEQVS

SEQ ID NO: 299272 - protein, 9 aa, Homo Sapiens
NSRGKNSFC

SEQ ID NO: 299273 - protein, 9 aa, Homo Sapiens
DAVPHVTQE

SEQ ID NO: 299274 - protein, 9 aa, Homo Sapiens
PKIKYYYCE

SEQ ID NO: 299275 - protein, 9 aa, Homo Sapiens
CLTRHQISH

SEQ ID NO: 299276 - protein, 9 aa, Homo Sapiens
SRLLEELEE

SEQ ID NO: 299277 - protein, 9 aa, Homo Sapiens
DDLSSEFPD

SEQ ID NO: 299278 - protein, 9 aa, Homo Sapiens
INCLSAYRF

SEQ ID NO: 299279 - protein, 9 aa, Homo Sapiens
NYHDVTILM

SEQ ID NO: 299280 - protein, 9 aa, Homo Sapiens
ESDSILGNK

SEQ ID NO: 299281 - protein, 9 aa, Homo Sapiens
SSKRKSAKD

SEQ ID NO: 299282 - protein, 9 aa, Homo Sapiens
ICLTRHQIS

SEQ ID NO: 299283 - protein, 9 aa, Homo Sapiens
LYGVITALV

SEQ ID NO: 299284 - protein, 9 aa, Homo Sapiens
QEPESIHKW

SEQ ID NO: 299285 - protein, 9 aa, Homo Sapiens
IQGNPKCRA

SEQ ID NO: 299286 - protein, 9 aa, Homo Sapiens
QEVLRAQKA

SEQ ID NO: 299287 - protein, 9 aa, Homo Sapiens
RPQPRGPIT

SEQ ID NO: 299288 - protein, 9 aa, Homo Sapiens
VVQNDLKMG

SEQ ID NO: 299289 - protein, 9 aa, Homo Sapiens
VSENYFLIF

SEQ ID NO: 299290 - protein, 9 aa, Homo Sapiens
MGNNKYCFD

SEQ ID NO: 299291 - protein, 9 aa, Homo Sapiens
GEDTSCKGR

SEQ ID NO: 299292 - protein, 9 aa, Homo Sapiens
PATQPLPGG

SEQ ID NO: 299293 - protein, 9 aa, Homo Sapiens
PYDLYHADR

SEQ ID NO: 299294 - protein, 9 aa, Homo Sapiens
QGGPRSDFY

SEQ ID NO: 299295 - protein, 9 aa, Homo Sapiens
ISIETANVR

SEQ ID NO: 299296 - protein, 9 aa, Homo Sapiens
QPHTVRRTT

SEQ ID NO: 299297 - protein, 9 aa, Homo Sapiens
KLPEIIGKM

SEQ ID NO: 299298 - protein, 9 aa, Homo Sapiens
RNFSILEIL

SEQ ID NO: 299299 - protein, 9 aa, Homo Sapiens
VNLYHAKNR

SEQ ID NO: 299300 - protein, 9 aa, Homo Sapiens
FPQSIIGLF

SEQ ID NO: 299301 - protein, 9 aa, Homo Sapiens
IIKKYFFGL

SEQ ID NO: 299302 - protein, 9 aa, Homo Sapiens
LYGTLIFMY

SEQ ID NO: 299303 - protein, 9 aa, Homo Sapiens
VARIDYKVK

SEQ ID NO: 299304 - protein, 9 aa, Homo Sapiens
IQMKQQALT

SEQ ID NO: 299305 - protein, 9 aa, Homo Sapiens
NSYSSDVVN

SEQ ID NO: 299306 - protein, 9 aa, Homo Sapiens
WCVGEGMEE

SEQ ID NO: 299307 - protein, 9 aa, Homo Sapiens
KEVEQEVKI

SEQ ID NO: 299308 - protein, 9 aa, Homo Sapiens
EKDLKEELT

SEQ ID NO: 299309 - protein, 9 aa, Homo Sapiens
RVAELMTRT

SEQ ID NO: 299310 - protein, 9 aa, Homo Sapiens
NQEKRLWDQ

SEQ ID NO: 299311 - protein, 9 aa, Homo Sapiens
KLRNLKTSD

SEQ ID NO: 299312 - protein, 9 aa, Homo Sapiens
YTGDSFLHI

SEQ ID NO: 299313 - protein, 9 aa, Homo Sapiens
DRVLKYAKE

SEQ ID NO: 299314 - protein, 9 aa, Homo Sapiens
CLVILLREV

SEQ ID NO: 299315 - protein, 9 aa, Homo Sapiens
VLAVSDSMF

SEQ ID NO: 299316 - protein, 9 aa, Homo Sapiens
HQRLSGNIS

SEQ ID NO: 299317 - protein, 9 aa, Homo Sapiens
EGRIDYLLR

SEQ ID NO: 299318 - protein, 9 aa, Homo Sapiens
QMSLEAKER

SEQ ID NO: 299319 - protein, 9 aa, Homo Sapiens
VPRKAKIKT

SEQ ID NO: 299320 - protein, 9 aa, Homo Sapiens
NSLETKSGG

SEQ ID NO: 299321 - protein, 9 aa, Homo Sapiens
HILQNTAPA

SEQ ID NO: 299322 - protein, 9 aa, Homo Sapiens
AHHEIIHTM

SEQ ID NO: 299323 - protein, 9 aa, Homo Sapiens
QPHLGLEKK

SEQ ID NO: 299324 - protein, 9 aa, Homo Sapiens
GFKNFYSIS

SEQ ID NO: 299325 - protein, 9 aa, Homo Sapiens
NCFFMTSGH

SEQ ID NO: 299326 - protein, 9 aa, Homo Sapiens
TDFDETSLI

SEQ ID NO: 299327 - protein, 9 aa, Homo Sapiens
LFTNLKYKR

SEQ ID NO: 299328 - protein, 9 aa, Homo Sapiens
CEAGLCTGD

SEQ ID NO: 299329 - protein, 9 aa, Homo Sapiens
QDSIVNNSI

SEQ ID NO: 299330 - protein, 9 aa, Homo Sapiens
QIIQYIPVS

SEQ ID NO: 299331 - protein, 9 aa, Homo Sapiens
NHWNSTITR

SEQ ID NO: 299332 - protein, 9 aa, Homo Sapiens
RTFKFMKGH

SEQ ID NO: 299333 - protein, 9 aa, Homo Sapiens
DKILTEWKQ

SEQ ID NO: 299334 - protein, 9 aa, Homo Sapiens
GHKSLGLWT

SEQ ID NO: 299335 - protein, 9 aa, Homo Sapiens
HIETVHPFR

SEQ ID NO: 299336 - protein, 9 aa, Homo Sapiens
LSMITEIHG

SEQ ID NO: 299337 - protein, 9 aa, Homo Sapiens
CMNKKELIT

SEQ ID NO: 299338 - protein, 9 aa, Homo Sapiens
AEVYVFLSV

SEQ ID NO: 299339 - protein, 9 aa, Homo Sapiens
DFLEYLPLE

SEQ ID NO: 299340 - protein, 9 aa, Homo Sapiens
LFDEVAIYI

SEQ ID NO: 299341 - protein, 9 aa, Homo Sapiens
QSRRPRLET

SEQ ID NO: 299342 - protein, 9 aa, Homo Sapiens
GLKFPSLAG

SEQ ID NO: 299343 - protein, 9 aa, Homo Sapiens
QLCECVLFT

SEQ ID NO: 299344 - protein, 9 aa, Homo Sapiens
KISELHNYQ

SEQ ID NO: 299345 - protein, 9 aa, Homo Sapiens
SPSQYVPCL

SEQ ID NO: 299346 - protein, 9 aa, Homo Sapiens
PNKKPRKSS

SEQ ID NO: 299347 - protein, 9 aa, Homo Sapiens
SATPTTAGS

SEQ ID NO: 299348 - protein, 9 aa, Homo Sapiens
LQKELNEYQ

SEQ ID NO: 299349 - protein, 9 aa, Homo Sapiens
YIRPRNLRS

SEQ ID NO: 299350 - protein, 9 aa, Homo Sapiens
KLINKHEFT

SEQ ID NO: 299351 - protein, 9 aa, Homo Sapiens
EARGEAGGS

SEQ ID NO: 299352 - protein, 9 aa, Homo Sapiens
YSMFEDDTV

SEQ ID NO: 299353 - protein, 9 aa, Homo Sapiens
RLPHSNSLG

SEQ ID NO: 299354 - protein, 9 aa, Homo Sapiens
LPEEAQEED

SEQ ID NO: 299355 - protein, 9 aa, Homo Sapiens
KGAVGYWKK

SEQ ID NO: 299356 - protein, 9 aa, Homo Sapiens
LKQGKTLAS

SEQ ID NO: 299357 - protein, 9 aa, Homo Sapiens
YVDSDKYSV

SEQ ID NO: 299358 - protein, 9 aa, Homo Sapiens
GYKQINAVA

SEQ ID NO: 299359 - protein, 9 aa, Homo Sapiens
LTFFQKKET

SEQ ID NO: 299360 - protein, 9 aa, Homo Sapiens
GGNDSSKFD

SEQ ID NO: 299361 - protein, 9 aa, Homo Sapiens
RSFIQPPKP

SEQ ID NO: 299362 - protein, 9 aa, Homo Sapiens
VIVVPICTI

SEQ ID NO: 299363 - protein, 9 aa, Homo Sapiens
GGLGLEIAN

SEQ ID NO: 299364 - protein, 9 aa, Homo Sapiens
RKLKGKEGK

SEQ ID NO: 299365 - protein, 9 aa, Homo Sapiens
SSHLTKHKI

SEQ ID NO: 299366 - protein, 9 aa, Homo Sapiens
SWDTNYANV

SEQ ID NO: 299367 - protein, 9 aa, Homo Sapiens
LSLVDYSSS

SEQ ID NO: 299368 - protein, 9 aa, Homo Sapiens
AGLFVEDNF

SEQ ID NO: 299369 - protein, 9 aa, Homo Sapiens
LLSFNINGL

SEQ ID NO: 299370 - protein, 9 aa, Homo Sapiens
LVEDNCEAV

SEQ ID NO: 299371 - protein, 9 aa, Homo Sapiens
VAPLILLVF

SEQ ID NO: 299372 - protein, 9 aa, Homo Sapiens
DSPTGSKDV

SEQ ID NO: 299373 - protein, 9 aa, Homo Sapiens
TFRNLFTKI

SEQ ID NO: 299374 - protein, 9 aa, Homo Sapiens
TSSPEPEQG

SEQ ID NO: 299375 - protein, 9 aa, Homo Sapiens
VQESSFWSR

SEQ ID NO: 299376 - protein, 9 aa, Homo Sapiens
FQGELICPM

SEQ ID NO: 299377 - protein, 9 aa, Homo Sapiens
PIRCSVLEE

SEQ ID NO: 299378 - protein, 9 aa, Homo Sapiens
INGRNLGRD

SEQ ID NO: 299379 - protein, 9 aa, Homo Sapiens
NTAPAQLSP

SEQ ID NO: 299380 - protein, 9 aa, Homo Sapiens
FVVTELIIF

SEQ ID NO: 299381 - protein, 9 aa, Homo Sapiens
LSAGPAIIR

SEQ ID NO: 299382 - protein, 9 aa, Homo Sapiens
SPGAPMGVH

SEQ ID NO: 299383 - protein, 9 aa, Homo Sapiens
GKNSFCGQL

SEQ ID NO: 299384 - protein, 9 aa, Homo Sapiens
NDVLQELIC

SEQ ID NO: 299385 - protein, 9 aa, Homo Sapiens
GYKEQKLRF

SEQ ID NO: 299386 - protein, 9 aa, Homo Sapiens
THLNKPLMK

SEQ ID NO: 299387 - protein, 9 aa, Homo Sapiens
LHTPMYFLI

SEQ ID NO: 299388 - protein, 9 aa, Homo Sapiens
SFTAAVRSN

SEQ ID NO: 299389 - protein, 9 aa, Homo Sapiens
AKLCLSCLL

SEQ ID NO: 299390 - protein, 9 aa, Homo Sapiens
HSEYFKSVS

SEQ ID NO: 299391 - protein, 9 aa, Homo Sapiens
LYKSQGELD

SEQ ID NO: 299392 - protein, 9 aa, Homo Sapiens
KRAKPQMQQ

SEQ ID NO: 299393 - protein, 9 aa, Homo Sapiens
KNPDAFTFD

SEQ ID NO: 299394 - protein, 9 aa, Homo Sapiens
NPKVNKCRL

SEQ ID NO: 299395 - protein, 9 aa, Homo Sapiens
TTKGPSRHP

SEQ ID NO: 299396 - protein, 9 aa, Homo Sapiens
LMRLVVDES

SEQ ID NO: 299397 - protein, 9 aa, Homo Sapiens
ARFTVIKTA

SEQ ID NO: 299398 - protein, 9 aa, Homo Sapiens
LTFEDVPDN

SEQ ID NO: 299399 - protein, 9 aa, Homo Sapiens
KAFVAKVVT

SEQ ID NO: 299400 - protein, 9 aa, Homo Sapiens
GRHMDRIGA

SEQ ID NO: 299401 - protein, 9 aa, Homo Sapiens
HLYGGLASS

SEQ ID NO: 299402 - protein, 9 aa, Homo Sapiens
KLQNAVEAT

SEQ ID NO: 299403 - protein, 9 aa, Homo Sapiens
QTLKNSLLA

SEQ ID NO: 299404 - protein, 9 aa, Homo Sapiens
FHLWKADNT

SEQ ID NO: 299405 - protein, 9 aa, Homo Sapiens
KLGGQAEKH

SEQ ID NO: 299406 - protein, 9 aa, Homo Sapiens
KSGVFTSAQ

SEQ ID NO: 299407 - protein, 9 aa, Homo Sapiens
AAKAESPIE

SEQ ID NO: 299408 - protein, 9 aa, Homo Sapiens
HKSLALERK

SEQ ID NO: 299409 - protein, 9 aa, Homo Sapiens
WGINPHRLY

SEQ ID NO: 299410 - protein, 9 aa, Homo Sapiens
LTALFSATA

SEQ ID NO: 299411 - protein, 9 aa, Homo Sapiens
KLLGQLYKC

SEQ ID NO: 299412 - protein, 9 aa, Homo Sapiens
AKGAFKKIK

SEQ ID NO: 299413 - protein, 9 aa, Homo Sapiens
LASSLINAT

SEQ ID NO: 299414 - protein, 9 aa, Homo Sapiens
SPSENNSSF

SEQ ID NO: 299415 - protein, 9 aa, Homo Sapiens
GYIMKIKPP

SEQ ID NO: 299416 - protein, 9 aa, Homo Sapiens
DEDATSLGS

SEQ ID NO: 299417 - protein, 9 aa, Homo Sapiens
KRKSAKDKK

SEQ ID NO: 299418 - protein, 9 aa, Homo Sapiens
KTVSIEELF

SEQ ID NO: 299419 - protein, 9 aa, Homo Sapiens
ENKSPSEAR

SEQ ID NO: 299420 - protein, 9 aa, Homo Sapiens
TYLPGEPEV

SEQ ID NO: 299421 - protein, 9 aa, Homo Sapiens
KQTGETNIL

SEQ ID NO: 299422 - protein, 9 aa, Homo Sapiens
KGGKIYFCA

SEQ ID NO: 299423 - protein, 9 aa, Homo Sapiens
YLGELPLSL

SEQ ID NO: 299424 - protein, 9 aa, Homo Sapiens
NIRELYKFH

SEQ ID NO: 299425 - protein, 9 aa, Homo Sapiens
RGRELKKDH

SEQ ID NO: 299426 - protein, 9 aa, Homo Sapiens
VINAKDERV

SEQ ID NO: 299427 - protein, 9 aa, Homo Sapiens
RSPSPKISR

SEQ ID NO: 299428 - protein, 9 aa, Homo Sapiens
QYTGRGPVS

SEQ ID NO: 299429 - protein, 9 aa, Homo Sapiens
LQLDIKTDN

SEQ ID NO: 299430 - protein, 9 aa, Homo Sapiens
ERVLGTHKL

SEQ ID NO: 299431 - protein, 9 aa, Homo Sapiens
LNTDGQLGL

SEQ ID NO: 299432 - protein, 9 aa, Homo Sapiens
HTGERPHTC

SEQ ID NO: 299433 - protein, 9 aa, Homo Sapiens
YLAQDLFDR

SEQ ID NO: 299434 - protein, 9 aa, Homo Sapiens
FKELIYLVE

SEQ ID NO: 299435 - protein, 9 aa, Homo Sapiens
ENRDKDTKI

SEQ ID NO: 299436 - protein, 9 aa, Homo Sapiens
LQNTDDMGL

SEQ ID NO: 299437 - protein, 9 aa, Homo Sapiens
HVQGLSNFI

SEQ ID NO: 299438 - protein, 9 aa, Homo Sapiens
NLPFTLENT

SEQ ID NO: 299439 - protein, 9 aa, Homo Sapiens
ESTEKAVEC

SEQ ID NO: 299440 - protein, 9 aa, Homo Sapiens
YLKDITIVK

SEQ ID NO: 299441 - protein, 9 aa, Homo Sapiens
WIQGWLKAE

SEQ ID NO: 299442 - protein, 9 aa, Homo Sapiens
LLQNILHQT

SEQ ID NO: 299443 - protein, 9 aa, Homo Sapiens
QIYKKKTEQ

SEQ ID NO: 299444 - protein, 9 aa, Homo Sapiens
TKPTTIIKK

SEQ ID NO: 299445 - protein, 9 aa, Homo Sapiens
LILSTVLKI

SEQ ID NO: 299446 - protein, 9 aa, Homo Sapiens
KNIFYIVNQ

SEQ ID NO: 299447 - protein, 9 aa, Homo Sapiens
SIIGKNKPA

SEQ ID NO: 299448 - protein, 9 aa, Homo Sapiens
FMEDSRLVC

SEQ ID NO: 299449 - protein, 9 aa, Homo Sapiens
QSPEPINND

SEQ ID NO: 299450 - protein, 9 aa, Homo Sapiens
SLINATFTL

SEQ ID NO: 299451 - protein, 9 aa, Homo Sapiens
LLGATLTVR

SEQ ID NO: 299452 - protein, 9 aa, Homo Sapiens
NQKSLRRTL

SEQ ID NO: 299453 - protein, 9 aa, Homo Sapiens
SDIWSVDPA

SEQ ID NO: 299454 - protein, 9 aa, Homo Sapiens
LLHHDGNII

SEQ ID NO: 299455 - protein, 9 aa, Homo Sapiens
SLFPSPNPV

SEQ ID NO: 299456 - protein, 9 aa, Homo Sapiens
VPLDKASTY

SEQ ID NO: 299457 - protein, 9 aa, Homo Sapiens
HKVTSKVIK

SEQ ID NO: 299458 - protein, 9 aa, Homo Sapiens
MTYCENTLN

SEQ ID NO: 299459 - protein, 9 aa, Homo Sapiens
KPKKNPFLV

SEQ ID NO: 299460 - protein, 9 aa, Homo Sapiens
RAPERQMRS

SEQ ID NO: 299461 - protein, 9 aa, Homo Sapiens
LHKGGEEKS

SEQ ID NO: 299462 - protein, 9 aa, Homo Sapiens
APGNDQFPG

SEQ ID NO: 299463 - protein, 9 aa, Homo Sapiens
SELSSKTES

SEQ ID NO: 299464 - protein, 9 aa, Homo Sapiens
DNCMVNNNL

SEQ ID NO: 299465 - protein, 9 aa, Homo Sapiens
KIFCIICAL

SEQ ID NO: 299466 - protein, 9 aa, Homo Sapiens
SSLVILFIN

SEQ ID NO: 299467 - protein, 9 aa, Homo Sapiens
VKNRMIQLH

SEQ ID NO: 299468 - protein, 9 aa, Homo Sapiens
LCDISPLLN

SEQ ID NO: 299469 - protein, 9 aa, Homo Sapiens
IHLFIHLFA

SEQ ID NO: 299470 - protein, 9 aa, Homo Sapiens
VRHQITHTG

SEQ ID NO: 299471 - protein, 9 aa, Homo Sapiens
DQAFSCLSS

SEQ ID NO: 299472 - protein, 9 aa, Homo Sapiens
KEDNCCVGK

SEQ ID NO: 299473 - protein, 9 aa, Homo Sapiens
SEIAYDPKH

SEQ ID NO: 299474 - protein, 9 aa, Homo Sapiens
YDKEFPQVV

SEQ ID NO: 299475 - protein, 9 aa, Homo Sapiens
IQLSNEFHI

SEQ ID NO: 299476 - protein, 9 aa, Homo Sapiens
NEAERKNIY

SEQ ID NO: 299477 - protein, 9 aa, Homo Sapiens
EKGMGKQGK

SEQ ID NO: 299478 - protein, 9 aa, Homo Sapiens
LQAHLRDSG

SEQ ID NO: 299479 - protein, 9 aa, Homo Sapiens
TKTGDNRKE

SEQ ID NO: 299480 - protein, 9 aa, Homo Sapiens
ELSEYIHAQ

SEQ ID NO: 299481 - protein, 9 aa, Homo Sapiens
NVNMLHVFV

SEQ ID NO: 299482 - protein, 9 aa, Homo Sapiens
NYLLQPELM

SEQ ID NO: 299483 - protein, 9 aa, Homo Sapiens
VYVFLSVKF

SEQ ID NO: 299484 - protein, 9 aa, Homo Sapiens
FVVDATHKG

SEQ ID NO: 299485 - protein, 9 aa, Homo Sapiens
HKQLYLFYN

SEQ ID NO: 299486 - protein, 9 aa, Homo Sapiens
LQEDILMQH

SEQ ID NO: 299487 - protein, 9 aa, Homo Sapiens
TFNHTHLYV

SEQ ID NO: 299488 - protein, 9 aa, Homo Sapiens
LFVDDFEEL

SEQ ID NO: 299489 - protein, 9 aa, Homo Sapiens
TLDLRKRQV

SEQ ID NO: 299490 - protein, 9 aa, Homo Sapiens
MYQKLRVEL

SEQ ID NO: 299491 - protein, 9 aa, Homo Sapiens
EDHGEKKQK

SEQ ID NO: 299492 - protein, 9 aa, Homo Sapiens
LDSGNKDSV

SEQ ID NO: 299493 - protein, 9 aa, Homo Sapiens
CSSLTKHKI

SEQ ID NO: 299494 - protein, 9 aa, Homo Sapiens
EGIRAVLID

SEQ ID NO: 299495 - protein, 9 aa, Homo Sapiens
HEGIRAVLI

SEQ ID NO: 299496 - protein, 9 aa, Homo Sapiens
EQPIFLAPC

SEQ ID NO: 299497 - protein, 9 aa, Homo Sapiens
KTLPNSQEV

SEQ ID NO: 299498 - protein, 9 aa, Homo Sapiens
FLVVSINER

SEQ ID NO: 299499 - protein, 9 aa, Homo Sapiens
GKFYMGSRK

SEQ ID NO: 299500 - protein, 9 aa, Homo Sapiens
NVLKEMKKV

SEQ ID NO: 299501 - protein, 9 aa, Homo Sapiens
RGKNSFCGQ

SEQ ID NO: 299502 - protein, 9 aa, Homo Sapiens
TREAMQNYL

SEQ ID NO: 299503 - protein, 9 aa, Homo Sapiens
HRKLQKKHE

SEQ ID NO: 299504 - protein, 9 aa, Homo Sapiens
HMVQTKHYQ

SEQ ID NO: 299505 - protein, 9 aa, Homo Sapiens
SLTVTTAMT

SEQ ID NO: 299506 - protein, 9 aa, Homo Sapiens
YSSIFAFPV

SEQ ID NO: 299507 - protein, 9 aa, Homo Sapiens
TENKDQSKT

SEQ ID NO: 299508 - protein, 9 aa, Homo Sapiens
STSVLIQHQ

SEQ ID NO: 299509 - protein, 9 aa, Homo Sapiens
FMCKLGYNV

SEQ ID NO: 299510 - protein, 9 aa, Homo Sapiens
KKKKDSILD

SEQ ID NO: 299511 - protein, 9 aa, Homo Sapiens
FLDSLWLRM

SEQ ID NO: 299512 - protein, 9 aa, Homo Sapiens
QWQLGVAFL

SEQ ID NO: 299513 - protein, 9 aa, Homo Sapiens
IELSNNYGM

SEQ ID NO: 299514 - protein, 9 aa, Homo Sapiens
VYNNRGEIV

SEQ ID NO: 299515 - protein, 9 aa, Homo Sapiens
NKYLKDITI

SEQ ID NO: 299516 - protein, 9 aa, Homo Sapiens
DIHKYVQHI

SEQ ID NO: 299517 - protein, 9 aa, Homo Sapiens
NFDKILTEW

SEQ ID NO: 299518 - protein, 9 aa, Homo Sapiens
AKKKQRHQQ

SEQ ID NO: 299519 - protein, 9 aa, Homo Sapiens
FDTTATAGI

SEQ ID NO: 299520 - protein, 9 aa, Homo Sapiens
TFNFISYLK

SEQ ID NO: 299521 - protein, 9 aa, Homo Sapiens
RTTTTPAGA

SEQ ID NO: 299522 - protein, 9 aa, Homo Sapiens
PIEVPQSFC

SEQ ID NO: 299523 - protein, 9 aa, Homo Sapiens
ESEVQRLAK

SEQ ID NO: 299524 - protein, 9 aa, Homo Sapiens
NLLSTKDEE

SEQ ID NO: 299525 - protein, 9 aa, Homo Sapiens
TFEIPLMLI

SEQ ID NO: 299526 - protein, 9 aa, Homo Sapiens
AEAGLFVLI

SEQ ID NO: 299527 - protein, 9 aa, Homo Sapiens
KKPECGSRD

SEQ ID NO: 299528 - protein, 9 aa, Homo Sapiens
SCLLVCILK

SEQ ID NO: 299529 - protein, 9 aa, Homo Sapiens
YFDVAVLHC

SEQ ID NO: 299530 - protein, 9 aa, Homo Sapiens
QLSVAGNIK

SEQ ID NO: 299531 - protein, 9 aa, Homo Sapiens
SKVQTLSLS

SEQ ID NO: 299532 - protein, 9 aa, Homo Sapiens
ILFGISLTG

SEQ ID NO: 299533 - protein, 9 aa, Homo Sapiens
ALAMTALDA

SEQ ID NO: 299534 - protein, 9 aa, Homo Sapiens
RTTVLRLLD

SEQ ID NO: 299535 - protein, 9 aa, Homo Sapiens
DETPLDDET

SEQ ID NO: 299536 - protein, 9 aa, Homo Sapiens
LLSEDENFL

SEQ ID NO: 299537 - protein, 9 aa, Homo Sapiens
VDSSSGRDN

SEQ ID NO: 299538 - protein, 9 aa, Homo Sapiens
DKINNLREV

SEQ ID NO: 299539 - protein, 9 aa, Homo Sapiens
ETANVREYA

SEQ ID NO: 299540 - protein, 9 aa, Homo Sapiens
FDIVHKNDI

SEQ ID NO: 299541 - protein, 9 aa, Homo Sapiens
QGYADNSCN

SEQ ID NO: 299542 - protein, 9 aa, Homo Sapiens
SAAITEVLL

SEQ ID NO: 299543 - protein, 9 aa, Homo Sapiens
TTRSRQDQE

SEQ ID NO: 299544 - protein, 9 aa, Homo Sapiens
IILKLMAQH

SEQ ID NO: 299545 - protein, 9 aa, Homo Sapiens
HISVLKENY

SEQ ID NO: 299546 - protein, 9 aa, Homo Sapiens
VVWCNLSAL

SEQ ID NO: 299547 - protein, 9 aa, Homo Sapiens
SSPSKIDGR

SEQ ID NO: 299548 - protein, 9 aa, Homo Sapiens
LEIKFQGLQ

SEQ ID NO: 299549 - protein, 9 aa, Homo Sapiens
VAVFLHYFI

SEQ ID NO: 299550 - protein, 9 aa, Homo Sapiens
YSEANSGYG

SEQ ID NO: 299551 - protein, 9 aa, Homo Sapiens
QNAVEATRI

SEQ ID NO: 299552 - protein, 9 aa, Homo Sapiens
DECEELYQK

SEQ ID NO: 299553 - protein, 9 aa, Homo Sapiens
HDTQWCVCK

SEQ ID NO: 299554 - protein, 9 aa, Homo Sapiens
LYAMVTPLF

SEQ ID NO: 299555 - protein, 9 aa, Homo Sapiens
SGLCGTLFI

SEQ ID NO: 299556 - protein, 9 aa, Homo Sapiens
IYESSSIYI

SEQ ID NO: 299557 - protein, 9 aa, Homo Sapiens
DVDDCNWLA

SEQ ID NO: 299558 - protein, 9 aa, Homo Sapiens
QYILVRNVS

SEQ ID NO: 299559 - protein, 9 aa, Homo Sapiens
IKKFPAPVH

SEQ ID NO: 299560 - protein, 9 aa, Homo Sapiens
GSCRHEKKI

SEQ ID NO: 299561 - protein, 9 aa, Homo Sapiens
QLHQTVTSP

SEQ ID NO: 299562 - protein, 9 aa, Homo Sapiens
PSENNSSFT

SEQ ID NO: 299563 - protein, 9 aa, Homo Sapiens
WCDLSSFEL

SEQ ID NO: 299564 - protein, 9 aa, Homo Sapiens
VLEAAKFVD

SEQ ID NO: 299565 - protein, 9 aa, Homo Sapiens
RMFKEADDL

SEQ ID NO: 299566 - protein, 9 aa, Homo Sapiens
YNYGIQNYR

SEQ ID NO: 299567 - protein, 9 aa, Homo Sapiens
RFTVIKTAI

SEQ ID NO: 299568 - protein, 9 aa, Homo Sapiens
YSTEKHTKH

SEQ ID NO: 299569 - protein, 9 aa, Homo Sapiens
ELFVDDFEE

SEQ ID NO: 299570 - protein, 9 aa, Homo Sapiens
RYWGTMWKQ

SEQ ID NO: 299571 - protein, 9 aa, Homo Sapiens
SMLLVKDKT

SEQ ID NO: 299572 - protein, 9 aa, Homo Sapiens
NRLSLTFFQ

SEQ ID NO: 299573 - protein, 9 aa, Homo Sapiens
EVTQLAKEV

SEQ ID NO: 299574 - protein, 9 aa, Homo Sapiens
PEEVKHREQ

SEQ ID NO: 299575 - protein, 9 aa, Homo Sapiens
HYFSYVKVQ

SEQ ID NO: 299576 - protein, 9 aa, Homo Sapiens
LAQTCIGTP

SEQ ID NO: 299577 - protein, 9 aa, Homo Sapiens
TGDIKVTEL

SEQ ID NO: 299578 - protein, 9 aa, Homo Sapiens
VQLRPIFQT

SEQ ID NO: 299579 - protein, 9 aa, Homo Sapiens
PELLSPVCE

SEQ ID NO: 299580 - protein, 9 aa, Homo Sapiens
ACTELGIHT

SEQ ID NO: 299581 - protein, 9 aa, Homo Sapiens
DPIISKYRV

SEQ ID NO: 299582 - protein, 9 aa, Homo Sapiens
VWNPQKAIP

SEQ ID NO: 299583 - protein, 9 aa, Homo Sapiens
ENEFQMEEY

SEQ ID NO: 299584 - protein, 9 aa, Homo Sapiens
ALKLSVNKT

SEQ ID NO: 299585 - protein, 9 aa, Homo Sapiens
RISAQGLIK

SEQ ID NO: 299586 - protein, 9 aa, Homo Sapiens
YFVFNFIGP

SEQ ID NO: 299587 - protein, 9 aa, Homo Sapiens
KAFNRSYHL

SEQ ID NO: 299588 - protein, 9 aa, Homo Sapiens
MKKYLEEEQ

SEQ ID NO: 299589 - protein, 9 aa, Homo Sapiens
KWQRDVCNV

SEQ ID NO: 299590 - protein, 9 aa, Homo Sapiens
KESRIILCS

SEQ ID NO: 299591 - protein, 9 aa, Homo Sapiens
CQHKLFCEK

SEQ ID NO: 299592 - protein, 9 aa, Homo Sapiens
YYAKKKQRH

SEQ ID NO: 299593 - protein, 9 aa, Homo Sapiens
EASVVDLKN

SEQ ID NO: 299594 - protein, 9 aa, Homo Sapiens
YLGDKPYRS

SEQ ID NO: 299595 - protein, 9 aa, Homo Sapiens
NNSSLIQHE

SEQ ID NO: 299596 - protein, 9 aa, Homo Sapiens
VIKDTENKD

SEQ ID NO: 299597 - protein, 9 aa, Homo Sapiens
GMVGSLPVD

SEQ ID NO: 299598 - protein, 9 aa, Homo Sapiens
YSQHVVKQL

SEQ ID NO: 299599 - protein, 9 aa, Homo Sapiens
IFWAPYNIV

SEQ ID NO: 299600 - protein, 9 aa, Homo Sapiens
HSKDKTKPQ

SEQ ID NO: 299601 - protein, 9 aa, Homo Sapiens
ATFEYFQIR

SEQ ID NO: 299602 - protein, 9 aa, Homo Sapiens
INNSIKLRL

SEQ ID NO: 299603 - protein, 9 aa, Homo Sapiens
GAPMGVHPS

SEQ ID NO: 299604 - protein, 9 aa, Homo Sapiens
PTPYPDEFK

SEQ ID NO: 299605 - protein, 9 aa, Homo Sapiens
AVPKIRPCP

SEQ ID NO: 299606 - protein, 9 aa, Homo Sapiens
SVTISEQLQ

SEQ ID NO: 299607 - protein, 9 aa, Homo Sapiens
SLIYWLQNL

SEQ ID NO: 299608 - protein, 9 aa, Homo Sapiens
GSVGCCSEQ

SEQ ID NO: 299609 - protein, 9 aa, Homo Sapiens
KEVKMAFFY

SEQ ID NO: 299610 - protein, 9 aa, Homo Sapiens
TYCENTLNT

SEQ ID NO: 299611 - protein, 9 aa, Homo Sapiens
DQIRGNMAG

SEQ ID NO: 299612 - protein, 9 aa, Homo Sapiens
RNIALPFVE

SEQ ID NO: 299613 - protein, 9 aa, Homo Sapiens
GKHGSMESI

SEQ ID NO: 299614 - protein, 9 aa, Homo Sapiens
LLLSVLAGA

SEQ ID NO: 299615 - protein, 9 aa, Homo Sapiens
LLLSYGASI

SEQ ID NO: 299616 - protein, 9 aa, Homo Sapiens
FASVVYTVV

SEQ ID NO: 299617 - protein, 9 aa, Homo Sapiens
IKHISELLF

SEQ ID NO: 299618 - protein, 9 aa, Homo Sapiens
CVCEICPWF

SEQ ID NO: 299619 - protein, 9 aa, Homo Sapiens
IQPQPLSSP

SEQ ID NO: 299620 - protein, 9 aa, Homo Sapiens
DYIDLNATF

SEQ ID NO: 299621 - protein, 9 aa, Homo Sapiens
KWKTFFTSQ

SEQ ID NO: 299622 - protein, 9 aa, Homo Sapiens
QPSTYTEKE

SEQ ID NO: 299623 - protein, 9 aa, Homo Sapiens
ERQIRPWIN

SEQ ID NO: 299624 - protein, 9 aa, Homo Sapiens
VYRDVMLEN

SEQ ID NO: 299625 - protein, 9 aa, Homo Sapiens
HIQMKQQAL

SEQ ID NO: 299626 - protein, 9 aa, Homo Sapiens
KPFFHSVLA

SEQ ID NO: 299627 - protein, 9 aa, Homo Sapiens
WVELDKPLK

SEQ ID NO: 299628 - protein, 9 aa, Homo Sapiens
ELAQTCIGT

SEQ ID NO: 299629 - protein, 9 aa, Homo Sapiens
AASASFPKK

SEQ ID NO: 299630 - protein, 9 aa, Homo Sapiens
LLHPSHRNW

SEQ ID NO: 299631 - protein, 9 aa, Homo Sapiens
LSSDKQYGR

SEQ ID NO: 299632 - protein, 9 aa, Homo Sapiens
KLLLKRNNV

SEQ ID NO: 299633 - protein, 9 aa, Homo Sapiens
AKLGWPAGV

SEQ ID NO: 299634 - protein, 9 aa, Homo Sapiens
QLSDSEAQS

SEQ ID NO: 299635 - protein, 9 aa, Homo Sapiens
TTLSRYYKW

SEQ ID NO: 299636 - protein, 9 aa, Homo Sapiens
KDVDGAYIT

SEQ ID NO: 299637 - protein, 9 aa, Homo Sapiens
TKYCNKWQD

SEQ ID NO: 299638 - protein, 9 aa, Homo Sapiens
PNTLPNDQS

SEQ ID NO: 299639 - protein, 9 aa, Homo Sapiens
GDINIMLVK

SEQ ID NO: 299640 - protein, 9 aa, Homo Sapiens
QQTHRPHPK

SEQ ID NO: 299641 - protein, 9 aa, Homo Sapiens
CQKCLIEAQ

SEQ ID NO: 299642 - protein, 9 aa, Homo Sapiens
CCSEQQEED

SEQ ID NO: 299643 - protein, 9 aa, Homo Sapiens
WVEEAYYKE

SEQ ID NO: 299644 - protein, 9 aa, Homo Sapiens
TLEKADLNT

SEQ ID NO: 299645 - protein, 9 aa, Homo Sapiens
PLSSTFRVE

SEQ ID NO: 299646 - protein, 9 aa, Homo Sapiens
TCTDVLRNA

SEQ ID NO: 299647 - protein, 9 aa, Homo Sapiens
RQLFRIIFR

SEQ ID NO: 299648 - protein, 9 aa, Homo Sapiens
KQLFRELPE

SEQ ID NO: 299649 - protein, 9 aa, Homo Sapiens
KSANFNWAK

SEQ ID NO: 299650 - protein, 9 aa, Homo Sapiens
MSLYSEANS

SEQ ID NO: 299651 - protein, 9 aa, Homo Sapiens
NGETGQLAH

SEQ ID NO: 299652 - protein, 9 aa, Homo Sapiens
PPPQKVQIN

SEQ ID NO: 299653 - protein, 9 aa, Homo Sapiens
LAPNKKPRK

SEQ ID NO: 299654 - protein, 9 aa, Homo Sapiens
KLLFAISEA

SEQ ID NO: 299655 - protein, 9 aa, Homo Sapiens
WLQNLRYYF

SEQ ID NO: 299656 - protein, 9 aa, Homo Sapiens
DNIINEDCL

SEQ ID NO: 299657 - protein, 9 aa, Homo Sapiens
VIVIILAII

SEQ ID NO: 299658 - protein, 9 aa, Homo Sapiens
IHQKSLSCP

SEQ ID NO: 299659 - protein, 9 aa, Homo Sapiens
CHRPHSSGC

SEQ ID NO: 299660 - protein, 9 aa, Homo Sapiens
SLNKSADDF

SEQ ID NO: 299661 - protein, 9 aa, Homo Sapiens
SSSGSAHFS

SEQ ID NO: 299662 - protein, 9 aa, Homo Sapiens
CGKAFVRAS

SEQ ID NO: 299663 - protein, 9 aa, Homo Sapiens
QEKEQEPEP

SEQ ID NO: 299664 - protein, 9 aa, Homo Sapiens
IYGRTVLIL

SEQ ID NO: 299665 - protein, 9 aa, Homo Sapiens
DERGTHIMN

SEQ ID NO: 299666 - protein, 9 aa, Homo Sapiens
NASVVPVIS

SEQ ID NO: 299667 - protein, 9 aa, Homo Sapiens
LSRLFPSSF

SEQ ID NO: 299668 - protein, 9 aa, Homo Sapiens
SRKGDLQIM

SEQ ID NO: 299669 - protein, 9 aa, Homo Sapiens
RWHIFYLQH

SEQ ID NO: 299670 - protein, 9 aa, Homo Sapiens
FNRSSYLIQ

SEQ ID NO: 299671 - protein, 9 aa, Homo Sapiens
NMNKLQTFV

SEQ ID NO: 299672 - protein, 9 aa, Homo Sapiens
KDFLHPHPE

SEQ ID NO: 299673 - protein, 9 aa, Homo Sapiens
RHKNPDAFT

SEQ ID NO: 299674 - protein, 9 aa, Homo Sapiens
YLGLSAVQA

SEQ ID NO: 299675 - protein, 9 aa, Homo Sapiens
QRLWPWPAT

SEQ ID NO: 299676 - protein, 9 aa, Homo Sapiens
KAQYYLYRS

SEQ ID NO: 299677 - protein, 9 aa, Homo Sapiens
KLVNDSLYD

SEQ ID NO: 299678 - protein, 9 aa, Homo Sapiens
TGKVKPFNQ

SEQ ID NO: 299679 - protein, 9 aa, Homo Sapiens
ERDPCPHMG

SEQ ID NO: 299680 - protein, 9 aa, Homo Sapiens
RTSYKNKTK

SEQ ID NO: 299681 - protein, 9 aa, Homo Sapiens
DEDTVYHLH

SEQ ID NO: 299682 - protein, 9 aa, Homo Sapiens
DNINNLELE

SEQ ID NO: 299683 - protein, 9 aa, Homo Sapiens
PDGPSGPPE

SEQ ID NO: 299684 - protein, 9 aa, Homo Sapiens
LSWFNHGIH

SEQ ID NO: 299685 - protein, 9 aa, Homo Sapiens
QMQTDSLFP

SEQ ID NO: 299686 - protein, 9 aa, Homo Sapiens
LLGSSYLPA

SEQ ID NO: 299687 - protein, 9 aa, Homo Sapiens
KKPLSCPEC

SEQ ID NO: 299688 - protein, 9 aa, Homo Sapiens
WNAGTVADV

SEQ ID NO: 299689 - protein, 9 aa, Homo Sapiens
EKLSGEVHT

SEQ ID NO: 299690 - protein, 9 aa, Homo Sapiens
ILEEKNNNL

SEQ ID NO: 299691 - protein, 9 aa, Homo Sapiens
KQGPNIYSF

SEQ ID NO: 299692 - protein, 9 aa, Homo Sapiens
TNQQEALQY

SEQ ID NO: 299693 - protein, 9 aa, Homo Sapiens
KKYLEEEQR

SEQ ID NO: 299694 - protein, 9 aa, Homo Sapiens
SFISVLLNI

SEQ ID NO: 299695 - protein, 9 aa, Homo Sapiens
TGKITRENI

SEQ ID NO: 299696 - protein, 9 aa, Homo Sapiens
ATGEESSTL

SEQ ID NO: 299697 - protein, 9 aa, Homo Sapiens
YKCGRIEVN

SEQ ID NO: 299698 - protein, 9 aa, Homo Sapiens
TNDIEAYDA

SEQ ID NO: 299699 - protein, 9 aa, Homo Sapiens
CSEDGTGGQ

SEQ ID NO: 299700 - protein, 9 aa, Homo Sapiens
IKTIKKQDD

SEQ ID NO: 299701 - protein, 9 aa, Homo Sapiens
KNSQSFISV

SEQ ID NO: 299702 - protein, 9 aa, Homo Sapiens
DTSKKGVKR

SEQ ID NO: 299703 - protein, 9 aa, Homo Sapiens
NNPAWAVWE

SEQ ID NO: 299704 - protein, 9 aa, Homo Sapiens
NSNIINKLR

SEQ ID NO: 299705 - protein, 9 aa, Homo Sapiens
PYMETTKTG

SEQ ID NO: 299706 - protein, 9 aa, Homo Sapiens
KESVRNDSN

SEQ ID NO: 299707 - protein, 9 aa, Homo Sapiens
ISCVQGILL

SEQ ID NO: 299708 - protein, 9 aa, Homo Sapiens
DTDISWAKN

SEQ ID NO: 299709 - protein, 9 aa, Homo Sapiens
INITKLEVL

SEQ ID NO: 299710 - protein, 9 aa, Homo Sapiens
TLFDMGNNK

SEQ ID NO: 299711 - protein, 9 aa, Homo Sapiens
TALVSQLIQ

SEQ ID NO: 299712 - protein, 9 aa, Homo Sapiens
CTLDTVGWV

SEQ ID NO: 299713 - protein, 9 aa, Homo Sapiens
FSFTVRDSP

SEQ ID NO: 299714 - protein, 9 aa, Homo Sapiens
KMLLENVKV

SEQ ID NO: 299715 - protein, 9 aa, Homo Sapiens
PKFYAGTVL

SEQ ID NO: 299716 - protein, 9 aa, Homo Sapiens
VPLYRALLK

SEQ ID NO: 299717 - protein, 9 aa, Homo Sapiens
FSTCASHLP

SEQ ID NO: 299718 - protein, 9 aa, Homo Sapiens
NTTPDFIIL

SEQ ID NO: 299719 - protein, 9 aa, Homo Sapiens
FISFLQSVA

SEQ ID NO: 299720 - protein, 9 aa, Homo Sapiens
ICILCLFGY

SEQ ID NO: 299721 - protein, 9 aa, Homo Sapiens
ENAVCKLKN

SEQ ID NO: 299722 - protein, 9 aa, Homo Sapiens
NNKGKETIY

SEQ ID NO: 299723 - protein, 9 aa, Homo Sapiens
PESLCPAFP

SEQ ID NO: 299724 - protein, 9 aa, Homo Sapiens
RANILVTVL

SEQ ID NO: 299725 - protein, 9 aa, Homo Sapiens
EEYIIQTLS

SEQ ID NO: 299726 - protein, 9 aa, Homo Sapiens
KLRVSGAAP

SEQ ID NO: 299727 - protein, 9 aa, Homo Sapiens
LFLSTGHPR

SEQ ID NO: 299728 - protein, 9 aa, Homo Sapiens
EVYFFSANT

SEQ ID NO: 299729 - protein, 9 aa, Homo Sapiens
AHLMSLSGG

SEQ ID NO: 299730 - protein, 9 aa, Homo Sapiens
DSTCCLVSG

SEQ ID NO: 299731 - protein, 9 aa, Homo Sapiens
DSLIKLKES

SEQ ID NO: 299732 - protein, 9 aa, Homo Sapiens
LKLFCMSFF

SEQ ID NO: 299733 - protein, 9 aa, Homo Sapiens
ITAKEEQEE

SEQ ID NO: 299734 - protein, 9 aa, Homo Sapiens
QRSSYDSPF

SEQ ID NO: 299735 - protein, 9 aa, Homo Sapiens
EEIINLWCD

SEQ ID NO: 299736 - protein, 9 aa, Homo Sapiens
LSYTYQHGG

SEQ ID NO: 299737 - protein, 9 aa, Homo Sapiens
LQTPQGKQK

SEQ ID NO: 299738 - protein, 9 aa, Homo Sapiens
LPNWNFFIA

SEQ ID NO: 299739 - protein, 9 aa, Homo Sapiens
EEHQAYLTN

SEQ ID NO: 299740 - protein, 9 aa, Homo Sapiens
SELYENDSN

SEQ ID NO: 299741 - protein, 9 aa, Homo Sapiens
SKIDGRALE

SEQ ID NO: 299742 - protein, 9 aa, Homo Sapiens
FVLIGFMIG

SEQ ID NO: 299743 - protein, 9 aa, Homo Sapiens
LALLEDVVT

SEQ ID NO: 299744 - protein, 9 aa, Homo Sapiens
VRMEKIVEG

SEQ ID NO: 299745 - protein, 9 aa, Homo Sapiens
KMILVVQND

SEQ ID NO: 299746 - protein, 9 aa, Homo Sapiens
AEKLDNSPG

SEQ ID NO: 299747 - protein, 9 aa, Homo Sapiens
KMIRELPKS

SEQ ID NO: 299748 - protein, 9 aa, Homo Sapiens
AILVYKVAC

SEQ ID NO: 299749 - protein, 9 aa, Homo Sapiens
FLQGEIKGQ

SEQ ID NO: 299750 - protein, 9 aa, Homo Sapiens
KPFNQNDEQ

SEQ ID NO: 299751 - protein, 9 aa, Homo Sapiens
RDNVSDLTL

SEQ ID NO: 299752 - protein, 9 aa, Homo Sapiens
NYVILEKLQ

SEQ ID NO: 299753 - protein, 9 aa, Homo Sapiens
CVRYIIKKY

SEQ ID NO: 299754 - protein, 9 aa, Homo Sapiens
ETNNLSPKE

SEQ ID NO: 299755 - protein, 9 aa, Homo Sapiens
GQRSSYDSP

SEQ ID NO: 299756 - protein, 9 aa, Homo Sapiens
SDGCTRKGT

SEQ ID NO: 299757 - protein, 9 aa, Homo Sapiens
GVRGNLLRS

SEQ ID NO: 299758 - protein, 9 aa, Homo Sapiens
VGKEQCLFP

SEQ ID NO: 299759 - protein, 9 aa, Homo Sapiens
VPGQNNVDS

SEQ ID NO: 299760 - protein, 9 aa, Homo Sapiens
DNDCENNYT

SEQ ID NO: 299761 - protein, 9 aa, Homo Sapiens
CLVSGNLTD

SEQ ID NO: 299762 - protein, 9 aa, Homo Sapiens
CGYHPNNNK

SEQ ID NO: 299763 - protein, 9 aa, Homo Sapiens
RDMQQMEIV

SEQ ID NO: 299764 - protein, 9 aa, Homo Sapiens
CDISLRPLL

SEQ ID NO: 299765 - protein, 9 aa, Homo Sapiens
VLCTVAATL

SEQ ID NO: 299766 - protein, 9 aa, Homo Sapiens
VFGVLAIFE

SEQ ID NO: 299767 - protein, 9 aa, Homo Sapiens
INNGSKKVI

SEQ ID NO: 299768 - protein, 9 aa, Homo Sapiens
IWQPKYGDR

SEQ ID NO: 299769 - protein, 9 aa, Homo Sapiens
DGCTRKGTL

SEQ ID NO: 299770 - protein, 9 aa, Homo Sapiens
LGIVNIILI

SEQ ID NO: 299771 - protein, 9 aa, Homo Sapiens
QLSEHQIIH

SEQ ID NO: 299772 - protein, 9 aa, Homo Sapiens
PGENQDTSH

SEQ ID NO: 299773 - protein, 9 aa, Homo Sapiens
APNVQHLSD

SEQ ID NO: 299774 - protein, 9 aa, Homo Sapiens
EFIESCQED

SEQ ID NO: 299775 - protein, 9 aa, Homo Sapiens
TPKKIRKII

SEQ ID NO: 299776 - protein, 9 aa, Homo Sapiens
KINNLREVR

SEQ ID NO: 299777 - protein, 9 aa, Homo Sapiens
KVVSIPKDT

SEQ ID NO: 299778 - protein, 9 aa, Homo Sapiens
SLQIHVRTH

SEQ ID NO: 299779 - protein, 9 aa, Homo Sapiens
AVIVHKQLY

SEQ ID NO: 299780 - protein, 9 aa, Homo Sapiens
IWLNETGTI

SEQ ID NO: 299781 - protein, 9 aa, Homo Sapiens
CPSSPIIEN

SEQ ID NO: 299782 - protein, 9 aa, Homo Sapiens
DNSYQNTTA

SEQ ID NO: 299783 - protein, 9 aa, Homo Sapiens
VVKKRDREK

SEQ ID NO: 299784 - protein, 9 aa, Homo Sapiens
YWNPWKAAY

SEQ ID NO: 299785 - protein, 9 aa, Homo Sapiens
HLQQYSQEH

SEQ ID NO: 299786 - protein, 9 aa, Homo Sapiens
KKDVDGAYI

SEQ ID NO: 299787 - protein, 9 aa, Homo Sapiens
HKHHDTFTN

SEQ ID NO: 299788 - protein, 9 aa, Homo Sapiens
RVYNLCSEI

SEQ ID NO: 299789 - protein, 9 aa, Homo Sapiens
GGIGALEVK

SEQ ID NO: 299790 - protein, 9 aa, Homo Sapiens
YKDTDGEEE

SEQ ID NO: 299791 - protein, 9 aa, Homo Sapiens
EYPVLCALA

SEQ ID NO: 299792 - protein, 9 aa, Homo Sapiens
TAYGDLHYR

SEQ ID NO: 299793 - protein, 9 aa, Homo Sapiens
DNHCGSHSG

SEQ ID NO: 299794 - protein, 9 aa, Homo Sapiens
QRQDMPETS

SEQ ID NO: 299795 - protein, 9 aa, Homo Sapiens
LKSSSSVSW

SEQ ID NO: 299796 - protein, 9 aa, Homo Sapiens
IFDIIFADA

SEQ ID NO: 299797 - protein, 9 aa, Homo Sapiens
QNGSELDLL

SEQ ID NO: 299798 - protein, 9 aa, Homo Sapiens
HVRLLSERL

SEQ ID NO: 299799 - protein, 9 aa, Homo Sapiens
NKKCLQILL

SEQ ID NO: 299800 - protein, 9 aa, Homo Sapiens
NNIRYLITF

SEQ ID NO: 299801 - protein, 9 aa, Homo Sapiens
AIPWQRSAA

SEQ ID NO: 299802 - protein, 9 aa, Homo Sapiens
EIFQDEKNK

SEQ ID NO: 299803 - protein, 9 aa, Homo Sapiens
IQTSDPENV

SEQ ID NO: 299804 - protein, 9 aa, Homo Sapiens
KAKPVTRGV

SEQ ID NO: 299805 - protein, 9 aa, Homo Sapiens
SVNDFTTIP

SEQ ID NO: 299806 - protein, 9 aa, Homo Sapiens
ISVLLNELD

SEQ ID NO: 299807 - protein, 9 aa, Homo Sapiens
VGRTYKNVN

SEQ ID NO: 299808 - protein, 9 aa, Homo Sapiens
IYSIPFFFL

SEQ ID NO: 299809 - protein, 9 aa, Homo Sapiens
HRHLVEDNC

SEQ ID NO: 299810 - protein, 9 aa, Homo Sapiens
FLIIFSPVM

SEQ ID NO: 299811 - protein, 9 aa, Homo Sapiens
PTEKALKTT

SEQ ID NO: 299812 - protein, 9 aa, Homo Sapiens
ATSLNKAFL

SEQ ID NO: 299813 - protein, 9 aa, Homo Sapiens
PATLGGNYA

SEQ ID NO: 299814 - protein, 9 aa, Homo Sapiens
WVQAANTLG

SEQ ID NO: 299815 - protein, 9 aa, Homo Sapiens
TKTYECNKC

SEQ ID NO: 299816 - protein, 9 aa, Homo Sapiens
KGRLQAITG

SEQ ID NO: 299817 - protein, 9 aa, Homo Sapiens
EIIHTMESF

SEQ ID NO: 299818 - protein, 9 aa, Homo Sapiens
EFEGMGVDL

SEQ ID NO: 299819 - protein, 9 aa, Homo Sapiens
DADKQLLYS

SEQ ID NO: 299820 - protein, 9 aa, Homo Sapiens
RNNSAFLKK

SEQ ID NO: 299821 - protein, 9 aa, Homo Sapiens
LFPKVIMRI

SEQ ID NO: 299822 - protein, 9 aa, Homo Sapiens
SNYMRLNSW

SEQ ID NO: 299823 - protein, 9 aa, Homo Sapiens
ANLLSTKDE

SEQ ID NO: 299824 - protein, 9 aa, Homo Sapiens
SQEVQAAFV

SEQ ID NO: 299825 - protein, 9 aa, Homo Sapiens
LQTLSLCLT

SEQ ID NO: 299826 - protein, 9 aa, Homo Sapiens
YLMSMYLKP

SEQ ID NO: 299827 - protein, 9 aa, Homo Sapiens
EPCYHEIMT

SEQ ID NO: 299828 - protein, 9 aa, Homo Sapiens
INKHEFTIL

SEQ ID NO: 299829 - protein, 9 aa, Homo Sapiens
HQPLRLLNL

SEQ ID NO: 299830 - protein, 9 aa, Homo Sapiens
RGASEGLPG

SEQ ID NO: 299831 - protein, 9 aa, Homo Sapiens
EENKKHKKK

SEQ ID NO: 299832 - protein, 9 aa, Homo Sapiens
IAKRAMDNM

SEQ ID NO: 299833 - protein, 9 aa, Homo Sapiens
AYYLQYKHV

SEQ ID NO: 299834 - protein, 9 aa, Homo Sapiens
QKLKKFMNK

SEQ ID NO: 299835 - protein, 9 aa, Homo Sapiens
KENTMADNE

SEQ ID NO: 299836 - protein, 9 aa, Homo Sapiens
NPYGPQTPS

SEQ ID NO: 299837 - protein, 9 aa, Homo Sapiens
DNIFFWNQS

SEQ ID NO: 299838 - protein, 9 aa, Homo Sapiens
QNGFDKVSN

SEQ ID NO: 299839 - protein, 9 aa, Homo Sapiens
NFKLPHPFL

SEQ ID NO: 299840 - protein, 9 aa, Homo Sapiens
SEIKGKISQ

SEQ ID NO: 299841 - protein, 9 aa, Homo Sapiens
SFQIHERAH

SEQ ID NO: 299842 - protein, 9 aa, Homo Sapiens
ECMKTTWQI

SEQ ID NO: 299843 - protein, 9 aa, Homo Sapiens
WTKLTLDYL

SEQ ID NO: 299844 - protein, 9 aa, Homo Sapiens
EKLVKEQGS

SEQ ID NO: 299845 - protein, 9 aa, Homo Sapiens
PHVANPQLQ

SEQ ID NO: 299846 - protein, 9 aa, Homo Sapiens
VDAVLQEKA

SEQ ID NO: 299847 - protein, 9 aa, Homo Sapiens
SEEDSELYE

SEQ ID NO: 299848 - protein, 9 aa, Homo Sapiens
IMSPDLPIG

SEQ ID NO: 299849 - protein, 9 aa, Homo Sapiens
WPATSLPVH

SEQ ID NO: 299850 - protein, 9 aa, Homo Sapiens
TTDKQPRKD

SEQ ID NO: 299851 - protein, 9 aa, Homo Sapiens
ITLNNTTDQ

SEQ ID NO: 299852 - protein, 9 aa, Homo Sapiens
QMNAPSKSV

SEQ ID NO: 299853 - protein, 9 aa, Homo Sapiens
KGLPRDWLW

SEQ ID NO: 299854 - protein, 9 aa, Homo Sapiens
SINTMPPKI

SEQ ID NO: 299855 - protein, 9 aa, Homo Sapiens
QKQKQMKYS

SEQ ID NO: 299856 - protein, 9 aa, Homo Sapiens
NGDQYTNGL

SEQ ID NO: 299857 - protein, 9 aa, Homo Sapiens
DNVDSDSGF

SEQ ID NO: 299858 - protein, 9 aa, Homo Sapiens
LQLFLSQTA

SEQ ID NO: 299859 - protein, 9 aa, Homo Sapiens
SILYLSEKA

SEQ ID NO: 299860 - protein, 9 aa, Homo Sapiens
REAKKSAEK

SEQ ID NO: 299861 - protein, 9 aa, Homo Sapiens
PFTLENTYG

SEQ ID NO: 299862 - protein, 9 aa, Homo Sapiens
PSSTQIFQE

SEQ ID NO: 299863 - protein, 9 aa, Homo Sapiens
STTCGRQLD

SEQ ID NO: 299864 - protein, 9 aa, Homo Sapiens
SEHQIIHRG

SEQ ID NO: 299865 - protein, 9 aa, Homo Sapiens
NYTCVDGIN

SEQ ID NO: 299866 - protein, 9 aa, Homo Sapiens
ERLTARLNL

SEQ ID NO: 299867 - protein, 9 aa, Homo Sapiens
YLENKLSCK

SEQ ID NO: 299868 - protein, 9 aa, Homo Sapiens
NKSTHLNKP

SEQ ID NO: 299869 - protein, 9 aa, Homo Sapiens
RENKLGETL

SEQ ID NO: 299870 - protein, 9 aa, Homo Sapiens
PSRDWRKKK

SEQ ID NO: 299871 - protein, 9 aa, Homo Sapiens
EQSENTSPS

SEQ ID NO: 299872 - protein, 9 aa, Homo Sapiens
CPAGYTLWE

SEQ ID NO: 299873 - protein, 9 aa, Homo Sapiens
PLNWEYFKS

SEQ ID NO: 299874 - protein, 9 aa, Homo Sapiens
TGPKFKMPE

SEQ ID NO: 299875 - protein, 9 aa, Homo Sapiens
YKIILTPQV

SEQ ID NO: 299876 - protein, 9 aa, Homo Sapiens
HLHPSGRFV

SEQ ID NO: 299877 - protein, 9 aa, Homo Sapiens
RQQAADLLQ

SEQ ID NO: 299878 - protein, 9 aa, Homo Sapiens
NQVLINSLE

SEQ ID NO: 299879 - protein, 9 aa, Homo Sapiens
ISEQLQKDI

SEQ ID NO: 299880 - protein, 9 aa, Homo Sapiens
ALFGKELLD

SEQ ID NO: 299881 - protein, 9 aa, Homo Sapiens
LPNSQEVQA

SEQ ID NO: 299882 - protein, 9 aa, Homo Sapiens
TTTKPMGLV

SEQ ID NO: 299883 - protein, 9 aa, Homo Sapiens
ANNAFFDEK

SEQ ID NO: 299884 - protein, 9 aa, Homo Sapiens
EGDNHLRNK

SEQ ID NO: 299885 - protein, 9 aa, Homo Sapiens
LNYPRLAKR

SEQ ID NO: 299886 - protein, 9 aa, Homo Sapiens
MCPSAGSGG

SEQ ID NO: 299887 - protein, 9 aa, Homo Sapiens
IYKKVIIAF

SEQ ID NO: 299888 - protein, 9 aa, Homo Sapiens
DKKTISFHG

SEQ ID NO: 299889 - protein, 9 aa, Homo Sapiens
KANVTDMLA

SEQ ID NO: 299890 - protein, 9 aa, Homo Sapiens
NANQTVPDQ

SEQ ID NO: 299891 - protein, 9 aa, Homo Sapiens
TSSTFNRDF

SEQ ID NO: 299892 - protein, 9 aa, Homo Sapiens
IDYLLRANC

SEQ ID NO: 299893 - protein, 9 aa, Homo Sapiens
DLSAAHAAR

SEQ ID NO: 299894 - protein, 9 aa, Homo Sapiens
LCRSETVVE

SEQ ID NO: 299895 - protein, 9 aa, Homo Sapiens
DRVSLISLH

SEQ ID NO: 299896 - protein, 9 aa, Homo Sapiens
VTPDQPIIV

SEQ ID NO: 299897 - protein, 9 aa, Homo Sapiens
VIYKIIRHE

SEQ ID NO: 299898 - protein, 9 aa, Homo Sapiens
GPGIIQSHS

SEQ ID NO: 299899 - protein, 9 aa, Homo Sapiens
NVNKVGEIH

SEQ ID NO: 299900 - protein, 9 aa, Homo Sapiens
WNGVSDVVK

SEQ ID NO: 299901 - protein, 9 aa, Homo Sapiens
FFQIKMYPV

SEQ ID NO: 299902 - protein, 9 aa, Homo Sapiens
EGETKFNKL

SEQ ID NO: 299903 - protein, 9 aa, Homo Sapiens
SCHDGYYLS

SEQ ID NO: 299904 - protein, 9 aa, Homo Sapiens
VQCMHETQR

SEQ ID NO: 299905 - protein, 9 aa, Homo Sapiens
KKKTEQLHQ

SEQ ID NO: 299906 - protein, 9 aa, Homo Sapiens
SFGTKLNPP

SEQ ID NO: 299907 - protein, 9 aa, Homo Sapiens
FRCYHKVTK

SEQ ID NO: 299908 - protein, 9 aa, Homo Sapiens
NKENYSEMD

SEQ ID NO: 299909 - protein, 9 aa, Homo Sapiens
EVLLEELSE

SEQ ID NO: 299910 - protein, 9 aa, Homo Sapiens
RGFRVDRVY

SEQ ID NO: 299911 - protein, 9 aa, Homo Sapiens
SCYPKEIVR

SEQ ID NO: 299912 - protein, 9 aa, Homo Sapiens
LSTEAQSLS

SEQ ID NO: 299913 - protein, 9 aa, Homo Sapiens
RKHREVCKV

SEQ ID NO: 299914 - protein, 9 aa, Homo Sapiens
IYVMLEILI

SEQ ID NO: 299915 - protein, 9 aa, Homo Sapiens
EQPSTYTEK

SEQ ID NO: 299916 - protein, 9 aa, Homo Sapiens
SKETCAPSS

SEQ ID NO: 299917 - protein, 9 aa, Homo Sapiens
SSSSIKVHW

SEQ ID NO: 299918 - protein, 9 aa, Homo Sapiens
RNSIALEIL

SEQ ID NO: 299919 - protein, 9 aa, Homo Sapiens
SLVQFIFIY

SEQ ID NO: 299920 - protein, 9 aa, Homo Sapiens
TDDSLTLSQ

SEQ ID NO: 299921 - protein, 9 aa, Homo Sapiens
HLQKKYVQV

SEQ ID NO: 299922 - protein, 9 aa, Homo Sapiens
ADTAEYFLW

SEQ ID NO: 299923 - protein, 9 aa, Homo Sapiens
AESRAENNR

SEQ ID NO: 299924 - protein, 9 aa, Homo Sapiens
EGISLKRVT

SEQ ID NO: 299925 - protein, 9 aa, Homo Sapiens
LHDIIKDVE

SEQ ID NO: 299926 - protein, 9 aa, Homo Sapiens
TGKKSKNTK

SEQ ID NO: 299927 - protein, 9 aa, Homo Sapiens
TVAGLCYHY

SEQ ID NO: 299928 - protein, 9 aa, Homo Sapiens
VMEDGYKGT

SEQ ID NO: 299929 - protein, 9 aa, Homo Sapiens
HHSISVQTS

SEQ ID NO: 299930 - protein, 9 aa, Homo Sapiens
SQLPKQCHQ

SEQ ID NO: 299931 - protein, 9 aa, Homo Sapiens
PLTNKQTDD

SEQ ID NO: 299932 - protein, 9 aa, Homo Sapiens
RKDNIFMYG

SEQ ID NO: 299933 - protein, 9 aa, Homo Sapiens
VVAVTLDPD

SEQ ID NO: 299934 - protein, 9 aa, Homo Sapiens
CTGSRPGAL

SEQ ID NO: 299935 - protein, 9 aa, Homo Sapiens
LFPPWKLIL

SEQ ID NO: 299936 - protein, 9 aa, Homo Sapiens
LEGMKYMYR

SEQ ID NO: 299937 - protein, 9 aa, Homo Sapiens
ARPTSFMRA

SEQ ID NO: 299938 - protein, 9 aa, Homo Sapiens
WASLLGKKW

SEQ ID NO: 299939 - protein, 9 aa, Homo Sapiens
RVHTEEKLY

SEQ ID NO: 299940 - protein, 9 aa, Homo Sapiens
ANGNSEAVK

SEQ ID NO: 299941 - protein, 9 aa, Homo Sapiens
PQLQLPMLL

SEQ ID NO: 299942 - protein, 9 aa, Homo Sapiens
EHYYKENNP

SEQ ID NO: 299943 - protein, 9 aa, Homo Sapiens
FSNPNITVI

SEQ ID NO: 299944 - protein, 9 aa, Homo Sapiens
LKEELTEAL

SEQ ID NO: 299945 - protein, 9 aa, Homo Sapiens
TIAVIVFVL

SEQ ID NO: 299946 - protein, 9 aa, Homo Sapiens
SDYLYFASL

SEQ ID NO: 299947 - protein, 9 aa, Homo Sapiens
PSWGLLGAP

SEQ ID NO: 299948 - protein, 9 aa, Homo Sapiens
SAKTTLIKR

SEQ ID NO: 299949 - protein, 9 aa, Homo Sapiens
KSTLARISA

SEQ ID NO: 299950 - protein, 9 aa, Homo Sapiens
DNSGDSGYP

SEQ ID NO: 299951 - protein, 9 aa, Homo Sapiens
QHLSRKIIY

SEQ ID NO: 299952 - protein, 9 aa, Homo Sapiens
RDLIRNYEQ

SEQ ID NO: 299953 - protein, 9 aa, Homo Sapiens
VKADMETLV

SEQ ID NO: 299954 - protein, 9 aa, Homo Sapiens
VQWEINIFL

SEQ ID NO: 299955 - protein, 9 aa, Homo Sapiens
LRWQLLQKQ

SEQ ID NO: 299956 - protein, 9 aa, Homo Sapiens
TLWLFPFSS

SEQ ID NO: 299957 - protein, 9 aa, Homo Sapiens
MHSLSSGQS

SEQ ID NO: 299958 - protein, 9 aa, Homo Sapiens
SDEGYLERI

SEQ ID NO: 299959 - protein, 9 aa, Homo Sapiens
FDKLPINGE

SEQ ID NO: 299960 - protein, 9 aa, Homo Sapiens
FEQLLAPHL

SEQ ID NO: 299961 - protein, 9 aa, Homo Sapiens
LSDMNTVSG

SEQ ID NO: 299962 - protein, 9 aa, Homo Sapiens
MVKMTESSL

SEQ ID NO: 299963 - protein, 9 aa, Homo Sapiens
SDNMLILEE

SEQ ID NO: 299964 - protein, 9 aa, Homo Sapiens
PVSFSNYLQ

SEQ ID NO: 299965 - protein, 9 aa, Homo Sapiens
LCKGSLTQT

SEQ ID NO: 299966 - protein, 9 aa, Homo Sapiens
ISIPGEMVT

SEQ ID NO: 299967 - protein, 9 aa, Homo Sapiens
SIRTLWLFP

SEQ ID NO: 299968 - protein, 9 aa, Homo Sapiens
QQKLFFFLQ

SEQ ID NO: 299969 - protein, 9 aa, Homo Sapiens
PWPATQPLP

SEQ ID NO: 299970 - protein, 9 aa, Homo Sapiens
QLRPIFQTY

SEQ ID NO: 299971 - protein, 9 aa, Homo Sapiens
NMAVEMLKM

SEQ ID NO: 299972 - protein, 9 aa, Homo Sapiens
WEYFKSSCY

SEQ ID NO: 299973 - protein, 9 aa, Homo Sapiens
DRPFQKPIN

SEQ ID NO: 299974 - protein, 9 aa, Homo Sapiens
GLFVEDNFM

SEQ ID NO: 299975 - protein, 9 aa, Homo Sapiens
DQFPGLNEN

SEQ ID NO: 299976 - protein, 9 aa, Homo Sapiens
SSYFEIFKT

SEQ ID NO: 299977 - protein, 9 aa, Homo Sapiens
VNENMQVNN

SEQ ID NO: 299978 - protein, 9 aa, Homo Sapiens
PKENHIFLF

SEQ ID NO: 299979 - protein, 9 aa, Homo Sapiens
EENLKKRPL

SEQ ID NO: 299980 - protein, 9 aa, Homo Sapiens
ANVREYARY

SEQ ID NO: 299981 - protein, 9 aa, Homo Sapiens
STIIYQCET

SEQ ID NO: 299982 - protein, 9 aa, Homo Sapiens
QQLLNQIQR

SEQ ID NO: 299983 - protein, 9 aa, Homo Sapiens
GNEPNNYQT

SEQ ID NO: 299984 - protein, 9 aa, Homo Sapiens
EEDSELYEN

SEQ ID NO: 299985 - protein, 9 aa, Homo Sapiens
NMMPVSSCT

SEQ ID NO: 299986 - protein, 9 aa, Homo Sapiens
KVNLYHAKN

SEQ ID NO: 299987 - protein, 9 aa, Homo Sapiens
AVREGKEEN

SEQ ID NO: 299988 - protein, 9 aa, Homo Sapiens
EVINKFACV

SEQ ID NO: 299989 - protein, 9 aa, Homo Sapiens
SGNNLERFI

SEQ ID NO: 299990 - protein, 9 aa, Homo Sapiens
GDVSFGDLL

SEQ ID NO: 299991 - protein, 9 aa, Homo Sapiens
NLLRQQNVF

SEQ ID NO: 299992 - protein, 9 aa, Homo Sapiens
DLLKKNSLN

SEQ ID NO: 299993 - protein, 9 aa, Homo Sapiens
FGTVITLIS

SEQ ID NO: 299994 - protein, 9 aa, Homo Sapiens
AEKPQSSST

SEQ ID NO: 299995 - protein, 9 aa, Homo Sapiens
RHPQINFIL

SEQ ID NO: 299996 - protein, 9 aa, Homo Sapiens
DVVARERLT

SEQ ID NO: 299997 - protein, 9 aa, Homo Sapiens
LGRDWNIGP

SEQ ID NO: 299998 - protein, 9 aa, Homo Sapiens
ILKLMAQHL

SEQ ID NO: 299999 - protein, 9 aa, Homo Sapiens
SLPNYATHL

SEQ ID NO: 300000 - protein, 9 aa, Homo Sapiens
ALAQRKEEH

SEQ ID NO: 300001 - protein, 9 aa, Homo Sapiens
NITVIYDGA

SEQ ID NO: 300002 - protein, 9 aa, Homo Sapiens
SALWHPRNA

SEQ ID NO: 300003 - protein, 9 aa, Homo Sapiens
SDQQDQAIK

SEQ ID NO: 300004 - protein, 9 aa, Homo Sapiens
YSTQYGLKL

SEQ ID NO: 300005 - protein, 9 aa, Homo Sapiens
PLHYDVGMK

SEQ ID NO: 300006 - protein, 9 aa, Homo Sapiens
KEEVNSNKG

SEQ ID NO: 300007 - protein, 9 aa, Homo Sapiens
FECNGCGKA

SEQ ID NO: 300008 - protein, 9 aa, Homo Sapiens
PIFQTYVTV

SEQ ID NO: 300009 - protein, 9 aa, Homo Sapiens
PESLQAQYG

SEQ ID NO: 300010 - protein, 9 aa, Homo Sapiens
QYMGQLKRN

SEQ ID NO: 300011 - protein, 9 aa, Homo Sapiens
QQNVPIERI

SEQ ID NO: 300012 - protein, 9 aa, Homo Sapiens
LCPLVVPNL

SEQ ID NO: 300013 - protein, 9 aa, Homo Sapiens
GKKPLSCPE

SEQ ID NO: 300014 - protein, 9 aa, Homo Sapiens
MTIHLLGKE

SEQ ID NO: 300015 - protein, 9 aa, Homo Sapiens
YLTTHQISH

SEQ ID NO: 300016 - protein, 9 aa, Homo Sapiens
LGRWCLSLE

SEQ ID NO: 300017 - protein, 9 aa, Homo Sapiens
YVPFEDGKE

SEQ ID NO: 300018 - protein, 9 aa, Homo Sapiens
IAGLLKQLF

SEQ ID NO: 300019 - protein, 9 aa, Homo Sapiens
KGLYWTLNG

SEQ ID NO: 300020 - protein, 9 aa, Homo Sapiens
KGGNYAVKL

SEQ ID NO: 300021 - protein, 9 aa, Homo Sapiens
PPEPPGKPG

SEQ ID NO: 300022 - protein, 9 aa, Homo Sapiens
YLERVSALE

SEQ ID NO: 300023 - protein, 9 aa, Homo Sapiens
QYKHVRPDY

SEQ ID NO: 300024 - protein, 9 aa, Homo Sapiens
LSLGPQTHV

SEQ ID NO: 300025 - protein, 9 aa, Homo Sapiens
EVTAHKVAV

SEQ ID NO: 300026 - protein, 9 aa, Homo Sapiens
FVGTDDNNS

SEQ ID NO: 300027 - protein, 9 aa, Homo Sapiens
FDPIRNKYF

SEQ ID NO: 300028 - protein, 9 aa, Homo Sapiens
AEGNPFDHC

SEQ ID NO: 300029 - protein, 9 aa, Homo Sapiens
KAISQDSLA

SEQ ID NO: 300030 - protein, 9 aa, Homo Sapiens
PNILDLCVL

SEQ ID NO: 300031 - protein, 9 aa, Homo Sapiens
KLDVRTRGS

SEQ ID NO: 300032 - protein, 9 aa, Homo Sapiens
SPVMLLLQL

SEQ ID NO: 300033 - protein, 9 aa, Homo Sapiens
ENLNLVLIW

SEQ ID NO: 300034 - protein, 9 aa, Homo Sapiens
YGTVQESLY

SEQ ID NO: 300035 - protein, 9 aa, Homo Sapiens
LKLGLISST

SEQ ID NO: 300036 - protein, 9 aa, Homo Sapiens
GTLTAAFYL

SEQ ID NO: 300037 - protein, 9 aa, Homo Sapiens
NTLGMEESK

SEQ ID NO: 300038 - protein, 9 aa, Homo Sapiens
KGSFSLFVR

SEQ ID NO: 300039 - protein, 9 aa, Homo Sapiens
KITAEMYTL

SEQ ID NO: 300040 - protein, 9 aa, Homo Sapiens
SFESENPYS

SEQ ID NO: 300041 - protein, 9 aa, Homo Sapiens
LYQKRGSSW

SEQ ID NO: 300042 - protein, 9 aa, Homo Sapiens
PDKRIAVGP

SEQ ID NO: 300043 - protein, 9 aa, Homo Sapiens
KPLVDLIYF

SEQ ID NO: 300044 - protein, 9 aa, Homo Sapiens
IQFTANEKT

SEQ ID NO: 300045 - protein, 9 aa, Homo Sapiens
TAVCSQDAG

SEQ ID NO: 300046 - protein, 9 aa, Homo Sapiens
MMPVSSCTP

SEQ ID NO: 300047 - protein, 9 aa, Homo Sapiens
IHRASLLQN

SEQ ID NO: 300048 - protein, 9 aa, Homo Sapiens
ILISVGTFL

SEQ ID NO: 300049 - protein, 9 aa, Homo Sapiens
SPFSSKSRA

SEQ ID NO: 300050 - protein, 9 aa, Homo Sapiens
YVKVQEGQW

SEQ ID NO: 300051 - protein, 9 aa, Homo Sapiens
AIAVKVNPE

SEQ ID NO: 300052 - protein, 9 aa, Homo Sapiens
LEALLINQT

SEQ ID NO: 300053 - protein, 9 aa, Homo Sapiens
LFPVSHVRL

SEQ ID NO: 300054 - protein, 9 aa, Homo Sapiens
MAHGFTQQP

SEQ ID NO: 300055 - protein, 9 aa, Homo Sapiens
CPEGVHQEY

SEQ ID NO: 300056 - protein, 9 aa, Homo Sapiens
PQDHEIALA

SEQ ID NO: 300057 - protein, 9 aa, Homo Sapiens
QAEKHRKLQ

SEQ ID NO: 300058 - protein, 9 aa, Homo Sapiens
PKLVINVTS

SEQ ID NO: 300059 - protein, 9 aa, Homo Sapiens
DHLRTVQYI

SEQ ID NO: 300060 - protein, 9 aa, Homo Sapiens
PHEIPKVFA

SEQ ID NO: 300061 - protein, 9 aa, Homo Sapiens
CENNYTCVD

SEQ ID NO: 300062 - protein, 9 aa, Homo Sapiens
LDRHKNPDA

SEQ ID NO: 300063 - protein, 9 aa, Homo Sapiens
DFSVVVIYK

SEQ ID NO: 300064 - protein, 9 aa, Homo Sapiens
VTVLNYYTF

SEQ ID NO: 300065 - protein, 9 aa, Homo Sapiens
WHLSNRSTD

SEQ ID NO: 300066 - protein, 9 aa, Homo Sapiens
PEYSTEKHT

SEQ ID NO: 300067 - protein, 9 aa, Homo Sapiens
EQEKSYMTF

SEQ ID NO: 300068 - protein, 9 aa, Homo Sapiens
LQPQAPRKE

SEQ ID NO: 300069 - protein, 9 aa, Homo Sapiens
LGEDAITNF

SEQ ID NO: 300070 - protein, 9 aa, Homo Sapiens
FIQSILSKP

SEQ ID NO: 300071 - protein, 9 aa, Homo Sapiens
FLFTNLKYK

SEQ ID NO: 300072 - protein, 9 aa, Homo Sapiens
ALLDSAQRN

SEQ ID NO: 300073 - protein, 9 aa, Homo Sapiens
LSEAQVMLS

SEQ ID NO: 300074 - protein, 9 aa, Homo Sapiens
SGEVIETTA

SEQ ID NO: 300075 - protein, 9 aa, Homo Sapiens
SPVLQIIIE

SEQ ID NO: 300076 - protein, 9 aa, Homo Sapiens
AYAQLGFIV

SEQ ID NO: 300077 - protein, 9 aa, Homo Sapiens
YVSVDLCQK

SEQ ID NO: 300078 - protein, 9 aa, Homo Sapiens
SRLDQKLEG

SEQ ID NO: 300079 - protein, 9 aa, Homo Sapiens
YKGTILHFL

SEQ ID NO: 300080 - protein, 9 aa, Homo Sapiens
SSSSSLLQN

SEQ ID NO: 300081 - protein, 9 aa, Homo Sapiens
VCSIQKSIF

SEQ ID NO: 300082 - protein, 9 aa, Homo Sapiens
PFLLIPSVE

SEQ ID NO: 300083 - protein, 9 aa, Homo Sapiens
LREKLEAAK

SEQ ID NO: 300084 - protein, 9 aa, Homo Sapiens
SAQDRTALL

SEQ ID NO: 300085 - protein, 9 aa, Homo Sapiens
LKLNTKVTQ

SEQ ID NO: 300086 - protein, 9 aa, Homo Sapiens
RVDQIVGQG

SEQ ID NO: 300087 - protein, 9 aa, Homo Sapiens
TIHGEDDLH

SEQ ID NO: 300088 - protein, 9 aa, Homo Sapiens
EDKCYGEIS

SEQ ID NO: 300089 - protein, 9 aa, Homo Sapiens
IIIHWAAVK

SEQ ID NO: 300090 - protein, 9 aa, Homo Sapiens
NTLNKLEVE

SEQ ID NO: 300091 - protein, 9 aa, Homo Sapiens
HDLDHFDKL

SEQ ID NO: 300092 - protein, 9 aa, Homo Sapiens
SPLKEDSEV

SEQ ID NO: 300093 - protein, 9 aa, Homo Sapiens
RKQEKEQRK

SEQ ID NO: 300094 - protein, 9 aa, Homo Sapiens
APITDLKSY

SEQ ID NO: 300095 - protein, 9 aa, Homo Sapiens
IVSGICAIA

SEQ ID NO: 300096 - protein, 9 aa, Homo Sapiens
DLVKAKLGW

SEQ ID NO: 300097 - protein, 9 aa, Homo Sapiens
GELELLDRT

SEQ ID NO: 300098 - protein, 9 aa, Homo Sapiens
DRSVKPHLC

SEQ ID NO: 300099 - protein, 9 aa, Homo Sapiens
EWATIQIEK

SEQ ID NO: 300100 - protein, 9 aa, Homo Sapiens
LFTLTEIIR

SEQ ID NO: 300101 - protein, 9 aa, Homo Sapiens
LFTSLGLLP

SEQ ID NO: 300102 - protein, 9 aa, Homo Sapiens
QPYKCDQCS

SEQ ID NO: 300103 - protein, 9 aa, Homo Sapiens
KLFEYTLKG

SEQ ID NO: 300104 - protein, 9 aa, Homo Sapiens
MYMFRHVDI

SEQ ID NO: 300105 - protein, 9 aa, Homo Sapiens
YAAPMTLLY

SEQ ID NO: 300106 - protein, 9 aa, Homo Sapiens
RHSGSHNHE

SEQ ID NO: 300107 - protein, 9 aa, Homo Sapiens
LSDAYQDKE

SEQ ID NO: 300108 - protein, 9 aa, Homo Sapiens
ITNKRNGGG

SEQ ID NO: 300109 - protein, 9 aa, Homo Sapiens
KFIFISCDL

SEQ ID NO: 300110 - protein, 9 aa, Homo Sapiens
VCSQDAGEL

SEQ ID NO: 300111 - protein, 9 aa, Homo Sapiens
ERSVVECSN

SEQ ID NO: 300112 - protein, 9 aa, Homo Sapiens
ENIFPQEEQ

SEQ ID NO: 300113 - protein, 9 aa, Homo Sapiens
TMYGSSPAL

SEQ ID NO: 300114 - protein, 9 aa, Homo Sapiens
FSEHALLQK

SEQ ID NO: 300115 - protein, 9 aa, Homo Sapiens
ANILESERF

SEQ ID NO: 300116 - protein, 9 aa, Homo Sapiens
PHKCLLKGK

SEQ ID NO: 300117 - protein, 9 aa, Homo Sapiens
LIQDSIVNN

SEQ ID NO: 300118 - protein, 9 aa, Homo Sapiens
LIQDNVNLP

SEQ ID NO: 300119 - protein, 9 aa, Homo Sapiens
LKTPLFSGS

SEQ ID NO: 300120 - protein, 9 aa, Homo Sapiens
NSNPVMCPS

SEQ ID NO: 300121 - protein, 9 aa, Homo Sapiens
FNHGIHNYQ

SEQ ID NO: 300122 - protein, 9 aa, Homo Sapiens
VDGSEGIGS

SEQ ID NO: 300123 - protein, 9 aa, Homo Sapiens
EQPPETTAQ

SEQ ID NO: 300124 - protein, 9 aa, Homo Sapiens
PLLSFNING

SEQ ID NO: 300125 - protein, 9 aa, Homo Sapiens
TLLTVKVSA

SEQ ID NO: 300126 - protein, 9 aa, Homo Sapiens
ICKISVSRG

SEQ ID NO: 300127 - protein, 9 aa, Homo Sapiens
LSPVCEELS

SEQ ID NO: 300128 - protein, 9 aa, Homo Sapiens
LDKASTYLP

SEQ ID NO: 300129 - protein, 9 aa, Homo Sapiens
GPGVAVMQL

SEQ ID NO: 300130 - protein, 9 aa, Homo Sapiens
SKQTRTMAP

SEQ ID NO: 300131 - protein, 9 aa, Homo Sapiens
YNVDRSGNV

SEQ ID NO: 300132 - protein, 9 aa, Homo Sapiens
PAAKAESPI

SEQ ID NO: 300133 - protein, 9 aa, Homo Sapiens
IYPYDVKAP

SEQ ID NO: 300134 - protein, 9 aa, Homo Sapiens
SLISLHEAV

SEQ ID NO: 300135 - protein, 9 aa, Homo Sapiens
DGRKKTFAT

SEQ ID NO: 300136 - protein, 9 aa, Homo Sapiens
RSVDECKLH

SEQ ID NO: 300137 - protein, 9 aa, Homo Sapiens
NKLYQPDGL

SEQ ID NO: 300138 - protein, 9 aa, Homo Sapiens
KNKKAKKAS

SEQ ID NO: 300139 - protein, 9 aa, Homo Sapiens
EMSGVGTYV

SEQ ID NO: 300140 - protein, 9 aa, Homo Sapiens
KSGSLAAES

SEQ ID NO: 300141 - protein, 9 aa, Homo Sapiens
SSRIIHQRT

SEQ ID NO: 300142 - protein, 9 aa, Homo Sapiens
AFLATQARK

SEQ ID NO: 300143 - protein, 9 aa, Homo Sapiens
FLFAIILYV

SEQ ID NO: 300144 - protein, 9 aa, Homo Sapiens
NQTVPDQSD

SEQ ID NO: 300145 - protein, 9 aa, Homo Sapiens
VENAMMIKT

SEQ ID NO: 300146 - protein, 9 aa, Homo Sapiens
SLASGYQDS

SEQ ID NO: 300147 - protein, 9 aa, Homo Sapiens
NRKQNVLEL

SEQ ID NO: 300148 - protein, 9 aa, Homo Sapiens
KESICSWNP

SEQ ID NO: 300149 - protein, 9 aa, Homo Sapiens
KYFGLKKDN

SEQ ID NO: 300150 - protein, 9 aa, Homo Sapiens
AHLVRHQNI

SEQ ID NO: 300151 - protein, 9 aa, Homo Sapiens
SNHSPFSSK

SEQ ID NO: 300152 - protein, 9 aa, Homo Sapiens
INATFTLQL

SEQ ID NO: 300153 - protein, 9 aa, Homo Sapiens
VNNNLSFRE

SEQ ID NO: 300154 - protein, 9 aa, Homo Sapiens
DQCCIVYLQ

SEQ ID NO: 300155 - protein, 9 aa, Homo Sapiens
GYPLWPELI

SEQ ID NO: 300156 - protein, 9 aa, Homo Sapiens
TYFKLFTTG

SEQ ID NO: 300157 - protein, 9 aa, Homo Sapiens
GVHQEYKED

SEQ ID NO: 300158 - protein, 9 aa, Homo Sapiens
YCKRNLEQD

SEQ ID NO: 300159 - protein, 9 aa, Homo Sapiens
CTDVLRNAF

SEQ ID NO: 300160 - protein, 9 aa, Homo Sapiens
LPELTVESL

SEQ ID NO: 300161 - protein, 9 aa, Homo Sapiens
AAIQELQHK

SEQ ID NO: 300162 - protein, 9 aa, Homo Sapiens
IFFWNQSLH

SEQ ID NO: 300163 - protein, 9 aa, Homo Sapiens
TRKTVLRRA

SEQ ID NO: 300164 - protein, 9 aa, Homo Sapiens
NNYILMQAQ

SEQ ID NO: 300165 - protein, 9 aa, Homo Sapiens
REENTFCDV

SEQ ID NO: 300166 - protein, 9 aa, Homo Sapiens
GLQVNYDKG

SEQ ID NO: 300167 - protein, 9 aa, Homo Sapiens
GKKINKRNK

SEQ ID NO: 300168 - protein, 9 aa, Homo Sapiens
RGPITPPGP

SEQ ID NO: 300169 - protein, 9 aa, Homo Sapiens
QIDSPTGSK

SEQ ID NO: 300170 - protein, 9 aa, Homo Sapiens
QCWCVRCHE

SEQ ID NO: 300171 - protein, 9 aa, Homo Sapiens
SVVDLKNNL

SEQ ID NO: 300172 - protein, 9 aa, Homo Sapiens
KIMALLSAN

SEQ ID NO: 300173 - protein, 9 aa, Homo Sapiens
MPPLEDDGE

SEQ ID NO: 300174 - protein, 9 aa, Homo Sapiens
KRRALLLLS

SEQ ID NO: 300175 - protein, 9 aa, Homo Sapiens
TVADVYISI

SEQ ID NO: 300176 - protein, 9 aa, Homo Sapiens
ESLIYTVPW

SEQ ID NO: 300177 - protein, 9 aa, Homo Sapiens
LFGISLTGV

SEQ ID NO: 300178 - protein, 9 aa, Homo Sapiens
DNIVNSFIV

SEQ ID NO: 300179 - protein, 9 aa, Homo Sapiens
SSALNSLHL

SEQ ID NO: 300180 - protein, 9 aa, Homo Sapiens
SPRINATRQ

SEQ ID NO: 300181 - protein, 9 aa, Homo Sapiens
GKITRENIS

SEQ ID NO: 300182 - protein, 9 aa, Homo Sapiens
TEGSIILKS

SEQ ID NO: 300183 - protein, 9 aa, Homo Sapiens
LFPQSIIGL

SEQ ID NO: 300184 - protein, 9 aa, Homo Sapiens
PGLHLENCV

SEQ ID NO: 300185 - protein, 9 aa, Homo Sapiens
ELVSAMEEL

SEQ ID NO: 300186 - protein, 9 aa, Homo Sapiens
YSIKEKETD

SEQ ID NO: 300187 - protein, 9 aa, Homo Sapiens
PCRVWWHAP

SEQ ID NO: 300188 - protein, 9 aa, Homo Sapiens
VESCDISLR

SEQ ID NO: 300189 - protein, 9 aa, Homo Sapiens
PQLEQRYDN

SEQ ID NO: 300190 - protein, 9 aa, Homo Sapiens
VVGQILVFV

SEQ ID NO: 300191 - protein, 9 aa, Homo Sapiens
DAYQDKEGS

SEQ ID NO: 300192 - protein, 9 aa, Homo Sapiens
FACVASEYP

SEQ ID NO: 300193 - protein, 9 aa, Homo Sapiens
FFCKEEKYF

SEQ ID NO: 300194 - protein, 9 aa, Homo Sapiens
IKIPHLDLL

SEQ ID NO: 300195 - protein, 9 aa, Homo Sapiens
LEQLHQTVT

SEQ ID NO: 300196 - protein, 9 aa, Homo Sapiens
LLYMVTMYQ

SEQ ID NO: 300197 - protein, 9 aa, Homo Sapiens
QRSSRLFTS

SEQ ID NO: 300198 - protein, 9 aa, Homo Sapiens
SQNNLVRLT

SEQ ID NO: 300199 - protein, 9 aa, Homo Sapiens
MIVYFIFWA

SEQ ID NO: 300200 - protein, 9 aa, Homo Sapiens
IQMLDNRKL

SEQ ID NO: 300201 - protein, 9 aa, Homo Sapiens
PPLEDDGEF

SEQ ID NO: 300202 - protein, 9 aa, Homo Sapiens
FALRVPTAG

SEQ ID NO: 300203 - protein, 9 aa, Homo Sapiens
IKRRALLLL

SEQ ID NO: 300204 - protein, 9 aa, Homo Sapiens
NFISYLKAI

SEQ ID NO: 300205 - protein, 9 aa, Homo Sapiens
IMKQTHKGK

SEQ ID NO: 300206 - protein, 9 aa, Homo Sapiens
QLNTRSSQN

SEQ ID NO: 300207 - protein, 9 aa, Homo Sapiens
QTVYQYQYT

SEQ ID NO: 300208 - protein, 9 aa, Homo Sapiens
FEACNEVPP

SEQ ID NO: 300209 - protein, 9 aa, Homo Sapiens
IHGVPEFIL

SEQ ID NO: 300210 - protein, 9 aa, Homo Sapiens
KYNECGKAF

SEQ ID NO: 300211 - protein, 9 aa, Homo Sapiens
GPGPSTFYF

SEQ ID NO: 300212 - protein, 9 aa, Homo Sapiens
ARRKDLAFE

SEQ ID NO: 300213 - protein, 9 aa, Homo Sapiens
QLPLCGNNV

SEQ ID NO: 300214 - protein, 9 aa, Homo Sapiens
LLSQVADIV

SEQ ID NO: 300215 - protein, 9 aa, Homo Sapiens
KKKPRLEDR

SEQ ID NO: 300216 - protein, 9 aa, Homo Sapiens
DSVCSIQKS

SEQ ID NO: 300217 - protein, 9 aa, Homo Sapiens
KWKDCKIRI

SEQ ID NO: 300218 - protein, 9 aa, Homo Sapiens
MDSVRSGLF

SEQ ID NO: 300219 - protein, 9 aa, Homo Sapiens
LWDTVKDKS

SEQ ID NO: 300220 - protein, 9 aa, Homo Sapiens
GEHAWTHIL

SEQ ID NO: 300221 - protein, 9 aa, Homo Sapiens
APRVRTDYV

SEQ ID NO: 300222 - protein, 9 aa, Homo Sapiens
RVDLHLLHH

SEQ ID NO: 300223 - protein, 9 aa, Homo Sapiens
GGKIYFCAH

SEQ ID NO: 300224 - protein, 9 aa, Homo Sapiens
ATSAKNTLF

SEQ ID NO: 300225 - protein, 9 aa, Homo Sapiens
VAIEFYQEE

SEQ ID NO: 300226 - protein, 9 aa, Homo Sapiens
RYSTSLADT

SEQ ID NO: 300227 - protein, 9 aa, Homo Sapiens
SIYFLSSLL

SEQ ID NO: 300228 - protein, 9 aa, Homo Sapiens
GGVSEDVIY

SEQ ID NO: 300229 - protein, 9 aa, Homo Sapiens
SDRNNSLET

SEQ ID NO: 300230 - protein, 9 aa, Homo Sapiens
ISEGDGNRM

SEQ ID NO: 300231 - protein, 9 aa, Homo Sapiens
YVPNRKVNY

SEQ ID NO: 300232 - protein, 9 aa, Homo Sapiens
NKVKKEMIL

SEQ ID NO: 300233 - protein, 9 aa, Homo Sapiens
DESNKENYS

SEQ ID NO: 300234 - protein, 9 aa, Homo Sapiens
HPSLEEENK

SEQ ID NO: 300235 - protein, 9 aa, Homo Sapiens
TTGKQIEAS

SEQ ID NO: 300236 - protein, 9 aa, Homo Sapiens
NSQSFISVL

SEQ ID NO: 300237 - protein, 9 aa, Homo Sapiens
NKLLDNIKN

SEQ ID NO: 300238 - protein, 9 aa, Homo Sapiens
QNGLYTPQN

SEQ ID NO: 300239 - protein, 9 aa, Homo Sapiens
PVMCPSAGS

SEQ ID NO: 300240 - protein, 9 aa, Homo Sapiens
NISLAKDYL

SEQ ID NO: 300241 - protein, 9 aa, Homo Sapiens
CNLDIALES

SEQ ID NO: 300242 - protein, 9 aa, Homo Sapiens
EKLKNVIHN

SEQ ID NO: 300243 - protein, 9 aa, Homo Sapiens
IAELADKYA

SEQ ID NO: 300244 - protein, 9 aa, Homo Sapiens
TSFPKYGGV

SEQ ID NO: 300245 - protein, 9 aa, Homo Sapiens
NRDNEKPTC

SEQ ID NO: 300246 - protein, 9 aa, Homo Sapiens
YLREQGQAL

SEQ ID NO: 300247 - protein, 9 aa, Homo Sapiens
RYHTNTGFL

SEQ ID NO: 300248 - protein, 9 aa, Homo Sapiens
TILTVICTE

SEQ ID NO: 300249 - protein, 9 aa, Homo Sapiens
VMKKLQESI

SEQ ID NO: 300250 - protein, 9 aa, Homo Sapiens
ALCRRLNTV

SEQ ID NO: 300251 - protein, 9 aa, Homo Sapiens
PDLKQRLCQ

SEQ ID NO: 300252 - protein, 9 aa, Homo Sapiens
SEHEKTNDT

SEQ ID NO: 300253 - protein, 9 aa, Homo Sapiens
LQDFCLPFI

SEQ ID NO: 300254 - protein, 9 aa, Homo Sapiens
LLLKRNNVS

SEQ ID NO: 300255 - protein, 9 aa, Homo Sapiens
AAPGRTTTT

SEQ ID NO: 300256 - protein, 9 aa, Homo Sapiens
VGQIMTCGS

SEQ ID NO: 300257 - protein, 9 aa, Homo Sapiens
VASRQEDTY

SEQ ID NO: 300258 - protein, 9 aa, Homo Sapiens
STQSKIFQC

SEQ ID NO: 300259 - protein, 9 aa, Homo Sapiens
DNMLILEEK

SEQ ID NO: 300260 - protein, 9 aa, Homo Sapiens
IQDQLGLSF

SEQ ID NO: 300261 - protein, 9 aa, Homo Sapiens
QEVRRTIHY

SEQ ID NO: 300262 - protein, 9 aa, Homo Sapiens
TTDQRAREG

SEQ ID NO: 300263 - protein, 9 aa, Homo Sapiens
TLQRTGQEK

SEQ ID NO: 300264 - protein, 9 aa, Homo Sapiens
SGKLFEYTL

SEQ ID NO: 300265 - protein, 9 aa, Homo Sapiens
NMEIATKEP

SEQ ID NO: 300266 - protein, 9 aa, Homo Sapiens
SKRRGSQDK

SEQ ID NO: 300267 - protein, 9 aa, Homo Sapiens
ANQTSVMFN

SEQ ID NO: 300268 - protein, 9 aa, Homo Sapiens
DMLLGRWCL

SEQ ID NO: 300269 - protein, 9 aa, Homo Sapiens
IFSYRGEKI

SEQ ID NO: 300270 - protein, 9 aa, Homo Sapiens
QGLSFISFL

SEQ ID NO: 300271 - protein, 9 aa, Homo Sapiens
KGTEGDISF

SEQ ID NO: 300272 - protein, 9 aa, Homo Sapiens
LEEREENLK

SEQ ID NO: 300273 - protein, 9 aa, Homo Sapiens
LFMVSILFS

SEQ ID NO: 300274 - protein, 9 aa, Homo Sapiens
AGSPGDKGE

SEQ ID NO: 300275 - protein, 9 aa, Homo Sapiens
FLCGESDIH

SEQ ID NO: 300276 - protein, 9 aa, Homo Sapiens
PEWFWGRDV

SEQ ID NO: 300277 - protein, 9 aa, Homo Sapiens
AGLVKLTVT

SEQ ID NO: 300278 - protein, 9 aa, Homo Sapiens
LYENDSNLG

SEQ ID NO: 300279 - protein, 9 aa, Homo Sapiens
YGVITALVA

SEQ ID NO: 300280 - protein, 9 aa, Homo Sapiens
RLLDTKYKS

SEQ ID NO: 300281 - protein, 9 aa, Homo Sapiens
TALDAIFKP

SEQ ID NO: 300282 - protein, 9 aa, Homo Sapiens
YANNFGPKG

SEQ ID NO: 300283 - protein, 9 aa, Homo Sapiens
SHKAPTFLY

SEQ ID NO: 300284 - protein, 9 aa, Homo Sapiens
LPSYQEHSN

SEQ ID NO: 300285 - protein, 9 aa, Homo Sapiens
LSEYIHAQV

SEQ ID NO: 300286 - protein, 9 aa, Homo Sapiens
QENNCHTAS

SEQ ID NO: 300287 - protein, 9 aa, Homo Sapiens
IRLQCNHTS

SEQ ID NO: 300288 - protein, 9 aa, Homo Sapiens
QHKLFCEKL

SEQ ID NO: 300289 - protein, 9 aa, Homo Sapiens
KAGYNKKLW

SEQ ID NO: 300290 - protein, 9 aa, Homo Sapiens
PSLEEENKK

SEQ ID NO: 300291 - protein, 9 aa, Homo Sapiens
ENNGGPSII

SEQ ID NO: 300292 - protein, 9 aa, Homo Sapiens
SYKYNECGK

SEQ ID NO: 300293 - protein, 9 aa, Homo Sapiens
QKPGKKLPD

SEQ ID NO: 300294 - protein, 9 aa, Homo Sapiens
CPWFTPQST

SEQ ID NO: 300295 - protein, 9 aa, Homo Sapiens
KVCLAIGNG

SEQ ID NO: 300296 - protein, 9 aa, Homo Sapiens
VVENNLTLL

SEQ ID NO: 300297 - protein, 9 aa, Homo Sapiens
LCECVLFTA

SEQ ID NO: 300298 - protein, 9 aa, Homo Sapiens
KMQYASESR

SEQ ID NO: 300299 - protein, 9 aa, Homo Sapiens
FWDFIAQLS

SEQ ID NO: 300300 - protein, 9 aa, Homo Sapiens
EMDQEKMTM

SEQ ID NO: 300301 - protein, 9 aa, Homo Sapiens
ISALSFLDI

SEQ ID NO: 300302 - protein, 9 aa, Homo Sapiens
LGTKKNKKA

SEQ ID NO: 300303 - protein, 9 aa, Homo Sapiens
MLHKGGEEK

SEQ ID NO: 300304 - protein, 9 aa, Homo Sapiens
VILLDPKPV

SEQ ID NO: 300305 - protein, 9 aa, Homo Sapiens
FPIGHLNTL

SEQ ID NO: 300306 - protein, 9 aa, Homo Sapiens
YTLSTQKLI

SEQ ID NO: 300307 - protein, 9 aa, Homo Sapiens
AFPISHIHY

SEQ ID NO: 300308 - protein, 9 aa, Homo Sapiens
KAATYNVDR

SEQ ID NO: 300309 - protein, 9 aa, Homo Sapiens
CFFMTSGHN

SEQ ID NO: 300310 - protein, 9 aa, Homo Sapiens
SSFFLKHGK

SEQ ID NO: 300311 - protein, 9 aa, Homo Sapiens
AQDIILQLI

SEQ ID NO: 300312 - protein, 9 aa, Homo Sapiens
VLLFCPSNK

SEQ ID NO: 300313 - protein, 9 aa, Homo Sapiens
SILDLEKSR

SEQ ID NO: 300314 - protein, 9 aa, Homo Sapiens
VWCNLSALL

SEQ ID NO: 300315 - protein, 9 aa, Homo Sapiens
KFKETNKQF

SEQ ID NO: 300316 - protein, 9 aa, Homo Sapiens
QGDKPWREE

SEQ ID NO: 300317 - protein, 9 aa, Homo Sapiens
RQEDTYVHF

SEQ ID NO: 300318 - protein, 9 aa, Homo Sapiens
RDMKAIGIE

SEQ ID NO: 300319 - protein, 9 aa, Homo Sapiens
FEIFKTKHD

SEQ ID NO: 300320 - protein, 9 aa, Homo Sapiens
NHGRQGEDQ

SEQ ID NO: 300321 - protein, 9 aa, Homo Sapiens
DPCLSLWRQ

SEQ ID NO: 300322 - protein, 9 aa, Homo Sapiens
CYRASQVEC

SEQ ID NO: 300323 - protein, 9 aa, Homo Sapiens
ARVLLKRRR

SEQ ID NO: 300324 - protein, 9 aa, Homo Sapiens
AGQIEENYN

SEQ ID NO: 300325 - protein, 9 aa, Homo Sapiens
HQEYKEDPK

SEQ ID NO: 300326 - protein, 9 aa, Homo Sapiens
ISVLLNINH

SEQ ID NO: 300327 - protein, 9 aa, Homo Sapiens
RVYSNTVQG

SEQ ID NO: 300328 - protein, 9 aa, Homo Sapiens
ILRVKFKSQ

SEQ ID NO: 300329 - protein, 9 aa, Homo Sapiens
KWKEQEWTT

SEQ ID NO: 300330 - protein, 9 aa, Homo Sapiens
QHLEGMKYM

SEQ ID NO: 300331 - protein, 9 aa, Homo Sapiens
VAKMINMMR

SEQ ID NO: 300332 - protein, 9 aa, Homo Sapiens
KKKVLSFLL

SEQ ID NO: 300333 - protein, 9 aa, Homo Sapiens
SLYSEANSG

SEQ ID NO: 300334 - protein, 9 aa, Homo Sapiens
RMIQLHPDG

SEQ ID NO: 300335 - protein, 9 aa, Homo Sapiens
HSPEDICQM

SEQ ID NO: 300336 - protein, 9 aa, Homo Sapiens
NTFSPLPLK

SEQ ID NO: 300337 - protein, 9 aa, Homo Sapiens
WLEALLINQ

SEQ ID NO: 300338 - protein, 9 aa, Homo Sapiens
FNPQIFKKK

SEQ ID NO: 300339 - protein, 9 aa, Homo Sapiens
VIKIVGLAN

SEQ ID NO: 300340 - protein, 9 aa, Homo Sapiens
PRPQDHDTD

SEQ ID NO: 300341 - protein, 9 aa, Homo Sapiens
SGPQRLSSA

SEQ ID NO: 300342 - protein, 9 aa, Homo Sapiens
TLTSDASTE

SEQ ID NO: 300343 - protein, 9 aa, Homo Sapiens
CVTYCEGDN

SEQ ID NO: 300344 - protein, 9 aa, Homo Sapiens
QKITAEMYT

SEQ ID NO: 300345 - protein, 9 aa, Homo Sapiens
NSDRIDSLQ

SEQ ID NO: 300346 - protein, 9 aa, Homo Sapiens
QPGEHIRCQ

SEQ ID NO: 300347 - protein, 9 aa, Homo Sapiens
AEVRQIELL

SEQ ID NO: 300348 - protein, 9 aa, Homo Sapiens
GAETALLIQ

SEQ ID NO: 300349 - protein, 9 aa, Homo Sapiens
ENYLSKTLL

SEQ ID NO: 300350 - protein, 9 aa, Homo Sapiens
GEGDQAHKE

SEQ ID NO: 300351 - protein, 9 aa, Homo Sapiens
ILHLGTHTK

SEQ ID NO: 300352 - protein, 9 aa, Homo Sapiens
IQELQKRMN

SEQ ID NO: 300353 - protein, 9 aa, Homo Sapiens
PQKGLWRFD

SEQ ID NO: 300354 - protein, 9 aa, Homo Sapiens
SLGPQTHVQ

SEQ ID NO: 300355 - protein, 9 aa, Homo Sapiens
FTEHFHFYK

SEQ ID NO: 300356 - protein, 9 aa, Homo Sapiens
IIHAAEKPC

SEQ ID NO: 300357 - protein, 9 aa, Homo Sapiens
QFTANEKTL

SEQ ID NO: 300358 - protein, 9 aa, Homo Sapiens
GPNIYSFNS

SEQ ID NO: 300359 - protein, 9 aa, Homo Sapiens
LNPKHVHQR

SEQ ID NO: 300360 - protein, 9 aa, Homo Sapiens
SSDTTSTFK

SEQ ID NO: 300361 - protein, 9 aa, Homo Sapiens
EKEEQVAES

SEQ ID NO: 300362 - protein, 9 aa, Homo Sapiens
GISAQQMSQ

SEQ ID NO: 300363 - protein, 9 aa, Homo Sapiens
VKSQNGELM

SEQ ID NO: 300364 - protein, 9 aa, Homo Sapiens
QYPVSLEMI

SEQ ID NO: 300365 - protein, 9 aa, Homo Sapiens
GAMLWGLFH

SEQ ID NO: 300366 - protein, 9 aa, Homo Sapiens
SGYNLDRLC

SEQ ID NO: 300367 - protein, 9 aa, Homo Sapiens
SALNRVCWA

SEQ ID NO: 300368 - protein, 9 aa, Homo Sapiens
DKGEAGEKG

SEQ ID NO: 300369 - protein, 9 aa, Homo Sapiens
ALKKVFAES

SEQ ID NO: 300370 - protein, 9 aa, Homo Sapiens
KKEDLTDEL

SEQ ID NO: 300371 - protein, 9 aa, Homo Sapiens
SVEDFLYGL

SEQ ID NO: 300372 - protein, 9 aa, Homo Sapiens
GPDAPPDAC

SEQ ID NO: 300373 - protein, 9 aa, Homo Sapiens
IALGCNLPR

SEQ ID NO: 300374 - protein, 9 aa, Homo Sapiens
SIYKCGRIE

SEQ ID NO: 300375 - protein, 9 aa, Homo Sapiens
EKDHKVCLA

SEQ ID NO: 300376 - protein, 9 aa, Homo Sapiens
NKVKTPQPK

SEQ ID NO: 300377 - protein, 9 aa, Homo Sapiens
KAFSQLSSL

SEQ ID NO: 300378 - protein, 9 aa, Homo Sapiens
DDRQMDTEA

SEQ ID NO: 300379 - protein, 9 aa, Homo Sapiens
KLKRLMLHR

SEQ ID NO: 300380 - protein, 9 aa, Homo Sapiens
EAPEFPLSS

SEQ ID NO: 300381 - protein, 9 aa, Homo Sapiens
IFSSPACLA

SEQ ID NO: 300382 - protein, 9 aa, Homo Sapiens
ENKSKKLKG

SEQ ID NO: 300383 - protein, 9 aa, Homo Sapiens
TILHFLQDA

SEQ ID NO: 300384 - protein, 9 aa, Homo Sapiens
AMALNTTKT

SEQ ID NO: 300385 - protein, 9 aa, Homo Sapiens
LHTLTSEYN

SEQ ID NO: 300386 - protein, 9 aa, Homo Sapiens
PQELKIKCL

SEQ ID NO: 300387 - protein, 9 aa, Homo Sapiens
MAATNRPNN

SEQ ID NO: 300388 - protein, 9 aa, Homo Sapiens
SAVELRRNS

SEQ ID NO: 300389 - protein, 9 aa, Homo Sapiens
MMLHKGGEE

SEQ ID NO: 300390 - protein, 9 aa, Homo Sapiens
APGRTTTTP

SEQ ID NO: 300391 - protein, 9 aa, Homo Sapiens
TNNPAWAVW

SEQ ID NO: 300392 - protein, 9 aa, Homo Sapiens
KNSLNELMK

SEQ ID NO: 300393 - protein, 9 aa, Homo Sapiens
DQEERIMEC

SEQ ID NO: 300394 - protein, 9 aa, Homo Sapiens
SYQNTTASV

SEQ ID NO: 300395 - protein, 9 aa, Homo Sapiens
PPNALPQRS

SEQ ID NO: 300396 - protein, 9 aa, Homo Sapiens
YLLRKLKNS

SEQ ID NO: 300397 - protein, 9 aa, Homo Sapiens
LGEIHYSKM

SEQ ID NO: 300398 - protein, 9 aa, Homo Sapiens
AESPIEVPQ

SEQ ID NO: 300399 - protein, 9 aa, Homo Sapiens
LNYYTFALF

SEQ ID NO: 300400 - protein, 9 aa, Homo Sapiens
LDSAGLEWL

SEQ ID NO: 300401 - protein, 9 aa, Homo Sapiens
ESQKQKEVL

SEQ ID NO: 300402 - protein, 9 aa, Homo Sapiens
QSRQSAHCV

SEQ ID NO: 300403 - protein, 9 aa, Homo Sapiens
ALLNVCMDA

SEQ ID NO: 300404 - protein, 9 aa, Homo Sapiens
PLQYNYGIQ

SEQ ID NO: 300405 - protein, 9 aa, Homo Sapiens
FQWLRALLG

SEQ ID NO: 300406 - protein, 9 aa, Homo Sapiens
CCGLGLRVQ

SEQ ID NO: 300407 - protein, 9 aa, Homo Sapiens
SEESDGKRI

SEQ ID NO: 300408 - protein, 9 aa, Homo Sapiens
YFLIFNLSF

SEQ ID NO: 300409 - protein, 9 aa, Homo Sapiens
APPKKRRIK

SEQ ID NO: 300410 - protein, 9 aa, Homo Sapiens
MITEIHGLK

SEQ ID NO: 300411 - protein, 9 aa, Homo Sapiens
LSQLPKQCH

SEQ ID NO: 300412 - protein, 9 aa, Homo Sapiens
CGTPQKREI

SEQ ID NO: 300413 - protein, 9 aa, Homo Sapiens
AMLWGLFHD

SEQ ID NO: 300414 - protein, 9 aa, Homo Sapiens
DTVYHLHPS

SEQ ID NO: 300415 - protein, 9 aa, Homo Sapiens
IESCQEDDN

SEQ ID NO: 300416 - protein, 9 aa, Homo Sapiens
EDCSDVPAL

SEQ ID NO: 300417 - protein, 9 aa, Homo Sapiens
LRASPAHSP

SEQ ID NO: 300418 - protein, 9 aa, Homo Sapiens
LPLLPYHLF

SEQ ID NO: 300419 - protein, 9 aa, Homo Sapiens
IRDKYMQKS

SEQ ID NO: 300420 - protein, 9 aa, Homo Sapiens
IAEHLSRHE

SEQ ID NO: 300421 - protein, 9 aa, Homo Sapiens
IREKRDKKA

SEQ ID NO: 300422 - protein, 9 aa, Homo Sapiens
KPSLLKTFK

SEQ ID NO: 300423 - protein, 9 aa, Homo Sapiens
AQAGHHHPD

SEQ ID NO: 300424 - protein, 9 aa, Homo Sapiens
RNWIVNKHR

SEQ ID NO: 300425 - protein, 9 aa, Homo Sapiens
HKLTQPQLE

SEQ ID NO: 300426 - protein, 9 aa, Homo Sapiens
YGDLHYRTF

SEQ ID NO: 300427 - protein, 9 aa, Homo Sapiens
YGRNDRDGE

SEQ ID NO: 300428 - protein, 9 aa, Homo Sapiens
STAEAFFKK

SEQ ID NO: 300429 - protein, 9 aa, Homo Sapiens
TDHNKIHTG

SEQ ID NO: 300430 - protein, 9 aa, Homo Sapiens
SMEGYYYRY

SEQ ID NO: 300431 - protein, 9 aa, Homo Sapiens
YPKDLRLYD

SEQ ID NO: 300432 - protein, 9 aa, Homo Sapiens
EVRKVLANC

SEQ ID NO: 300433 - protein, 9 aa, Homo Sapiens
RFNKSISNA

SEQ ID NO: 300434 - protein, 9 aa, Homo Sapiens
MYETTTTRT

SEQ ID NO: 300435 - protein, 9 aa, Homo Sapiens
DKGSFVVNL

SEQ ID NO: 300436 - protein, 9 aa, Homo Sapiens
VSIMYPGAK

SEQ ID NO: 300437 - protein, 9 aa, Homo Sapiens
LSVFGEIEE

SEQ ID NO: 300438 - protein, 9 aa, Homo Sapiens
VTVVKFNPQ

SEQ ID NO: 300439 - protein, 9 aa, Homo Sapiens
PDFSVVVIY

SEQ ID NO: 300440 - protein, 9 aa, Homo Sapiens
LSNNYGMSE

SEQ ID NO: 300441 - protein, 9 aa, Homo Sapiens
EIGNRYIKI

SEQ ID NO: 300442 - protein, 9 aa, Homo Sapiens
DEDFVSSTR

SEQ ID NO: 300443 - protein, 9 aa, Homo Sapiens
SEKLRKAFN

SEQ ID NO: 300444 - protein, 9 aa, Homo Sapiens
TVIMSQTVC

SEQ ID NO: 300445 - protein, 9 aa, Homo Sapiens
PLHYKIILT

SEQ ID NO: 300446 - protein, 9 aa, Homo Sapiens
NLYYMALIK

SEQ ID NO: 300447 - protein, 9 aa, Homo Sapiens
AQILDNYLQ

SEQ ID NO: 300448 - protein, 9 aa, Homo Sapiens
ERGAPWIPG

SEQ ID NO: 300449 - protein, 9 aa, Homo Sapiens
TKRIRKPFF

SEQ ID NO: 300450 - protein, 9 aa, Homo Sapiens
PNIINHFLC

SEQ ID NO: 300451 - protein, 9 aa, Homo Sapiens
NKYVIGWNK

SEQ ID NO: 300452 - protein, 9 aa, Homo Sapiens
TEATSPPTI

SEQ ID NO: 300453 - protein, 9 aa, Homo Sapiens
THIQNEQVR

SEQ ID NO: 300454 - protein, 9 aa, Homo Sapiens
EVKMAFFYC

SEQ ID NO: 300455 - protein, 9 aa, Homo Sapiens
PPVRASPSQ

SEQ ID NO: 300456 - protein, 9 aa, Homo Sapiens
FGGQEQVRE

SEQ ID NO: 300457 - protein, 9 aa, Homo Sapiens
RPLLCCRTP

SEQ ID NO: 300458 - protein, 9 aa, Homo Sapiens
SVWNSEPNN

SEQ ID NO: 300459 - protein, 9 aa, Homo Sapiens
RKLINRKLS

SEQ ID NO: 300460 - protein, 9 aa, Homo Sapiens
VGQLKRVPQ

SEQ ID NO: 300461 - protein, 9 aa, Homo Sapiens
CCRDAVFMQ

SEQ ID NO: 300462 - protein, 9 aa, Homo Sapiens
AGCAVATEY

SEQ ID NO: 300463 - protein, 9 aa, Homo Sapiens
SATTLSRYY

SEQ ID NO: 300464 - protein, 9 aa, Homo Sapiens
PPVTNTPSL

SEQ ID NO: 300465 - protein, 9 aa, Homo Sapiens
RLQLQGEPQ

SEQ ID NO: 300466 - protein, 9 aa, Homo Sapiens
GSRKLRNLK

SEQ ID NO: 300467 - protein, 9 aa, Homo Sapiens
GIGALEVKL

SEQ ID NO: 300468 - protein, 9 aa, Homo Sapiens
VAILVYKVA

SEQ ID NO: 300469 - protein, 9 aa, Homo Sapiens
HVVAVTLDP

SEQ ID NO: 300470 - protein, 9 aa, Homo Sapiens
GPQPPHHQF

SEQ ID NO: 300471 - protein, 9 aa, Homo Sapiens
GQVCCNDTR

SEQ ID NO: 300472 - protein, 9 aa, Homo Sapiens
YIRPLPPPG

SEQ ID NO: 300473 - protein, 9 aa, Homo Sapiens
YQHGGLTGS

SEQ ID NO: 300474 - protein, 9 aa, Homo Sapiens
HIFLFVCLF

SEQ ID NO: 300475 - protein, 9 aa, Homo Sapiens
ALGCNLPRW

SEQ ID NO: 300476 - protein, 9 aa, Homo Sapiens
LQAQQILEA

SEQ ID NO: 300477 - protein, 9 aa, Homo Sapiens
LNWAEGSLY

SEQ ID NO: 300478 - protein, 9 aa, Homo Sapiens
FLFVAPLIL

SEQ ID NO: 300479 - protein, 9 aa, Homo Sapiens
APLQVAQEC

SEQ ID NO: 300480 - protein, 9 aa, Homo Sapiens
HSIHNFTET

SEQ ID NO: 300481 - protein, 9 aa, Homo Sapiens
ADTNFSFYD

SEQ ID NO: 300482 - protein, 9 aa, Homo Sapiens
CRAGKAKSQ

SEQ ID NO: 300483 - protein, 9 aa, Homo Sapiens
RESDNSGDS

SEQ ID NO: 300484 - protein, 9 aa, Homo Sapiens
NLDRLCLPY

SEQ ID NO: 300485 - protein, 9 aa, Homo Sapiens
LQHKRALRA

SEQ ID NO: 300486 - protein, 9 aa, Homo Sapiens
DQEHLVIAE

SEQ ID NO: 300487 - protein, 9 aa, Homo Sapiens
QSDRSGTDR

SEQ ID NO: 300488 - protein, 9 aa, Homo Sapiens
GHYFSYVKV

SEQ ID NO: 300489 - protein, 9 aa, Homo Sapiens
LRRMHSLSS

SEQ ID NO: 300490 - protein, 9 aa, Homo Sapiens
QANGFSVVQ

SEQ ID NO: 300491 - protein, 9 aa, Homo Sapiens
TKKVAKSAN

SEQ ID NO: 300492 - protein, 9 aa, Homo Sapiens
IKGQENLKK

SEQ ID NO: 300493 - protein, 9 aa, Homo Sapiens
IESLKKQLQ

SEQ ID NO: 300494 - protein, 9 aa, Homo Sapiens
PSPPLGLCV

SEQ ID NO: 300495 - protein, 9 aa, Homo Sapiens
NNNLSFRED

SEQ ID NO: 300496 - protein, 9 aa, Homo Sapiens
GPNELDNLY

SEQ ID NO: 300497 - protein, 9 aa, Homo Sapiens
DYVFSDSAA

SEQ ID NO: 300498 - protein, 9 aa, Homo Sapiens
LILIYETFY

SEQ ID NO: 300499 - protein, 9 aa, Homo Sapiens
LEDVVTKVV

SEQ ID NO: 300500 - protein, 9 aa, Homo Sapiens
NQRAKWRRE

SEQ ID NO: 300501 - protein, 9 aa, Homo Sapiens
TKLFEKHPE

SEQ ID NO: 300502 - protein, 9 aa, Homo Sapiens
YSIKNQTIL

SEQ ID NO: 300503 - protein, 9 aa, Homo Sapiens
QICSLMAVE

SEQ ID NO: 300504 - protein, 9 aa, Homo Sapiens
QLLNQIQRH

SEQ ID NO: 300505 - protein, 9 aa, Homo Sapiens
TLSKIATTY

SEQ ID NO: 300506 - protein, 9 aa, Homo Sapiens
REGDCAPED

SEQ ID NO: 300507 - protein, 9 aa, Homo Sapiens
HKLFCEKLE

SEQ ID NO: 300508 - protein, 9 aa, Homo Sapiens
IYNGFFECE

SEQ ID NO: 300509 - protein, 9 aa, Homo Sapiens
LWRFCIEKW

SEQ ID NO: 300510 - protein, 9 aa, Homo Sapiens
QPPPHSLAA

SEQ ID NO: 300511 - protein, 9 aa, Homo Sapiens
VQLCGTTSS

SEQ ID NO: 300512 - protein, 9 aa, Homo Sapiens
HAILDVDAD

SEQ ID NO: 300513 - protein, 9 aa, Homo Sapiens
NRYLKGALN

SEQ ID NO: 300514 - protein, 9 aa, Homo Sapiens
ILPTKENFL

SEQ ID NO: 300515 - protein, 9 aa, Homo Sapiens
LTFVQALIK

SEQ ID NO: 300516 - protein, 9 aa, Homo Sapiens
RKMILETAP

SEQ ID NO: 300517 - protein, 9 aa, Homo Sapiens
PISWRHCIG

SEQ ID NO: 300518 - protein, 9 aa, Homo Sapiens
IRRREIKLL

SEQ ID NO: 300519 - protein, 9 aa, Homo Sapiens
IKVTLHMLP

SEQ ID NO: 300520 - protein, 9 aa, Homo Sapiens
QGKKGKFVL

SEQ ID NO: 300521 - protein, 9 aa, Homo Sapiens
HISQVISEG

SEQ ID NO: 300522 - protein, 9 aa, Homo Sapiens
KDITIVKET

SEQ ID NO: 300523 - protein, 9 aa, Homo Sapiens
IQKQWKELS

SEQ ID NO: 300524 - protein, 9 aa, Homo Sapiens
QQEALQYAK

SEQ ID NO: 300525 - protein, 9 aa, Homo Sapiens
IFHPNEFCY

SEQ ID NO: 300526 - protein, 9 aa, Homo Sapiens
CYVDGSEGI

SEQ ID NO: 300527 - protein, 9 aa, Homo Sapiens
FFLQREGMR

SEQ ID NO: 300528 - protein, 9 aa, Homo Sapiens
DCWKNNKSR

SEQ ID NO: 300529 - protein, 9 aa, Homo Sapiens
RCYVDGSEG

SEQ ID NO: 300530 - protein, 9 aa, Homo Sapiens
DHLGSSDPS

SEQ ID NO: 300531 - protein, 9 aa, Homo Sapiens
VQSEERSDS

SEQ ID NO: 300532 - protein, 9 aa, Homo Sapiens
EGVRMEKIV

SEQ ID NO: 300533 - protein, 9 aa, Homo Sapiens
TVPHLAAVP

SEQ ID NO: 300534 - protein, 9 aa, Homo Sapiens
RLENRKSGV

SEQ ID NO: 300535 - protein, 9 aa, Homo Sapiens
PRLSTPGLE

SEQ ID NO: 300536 - protein, 9 aa, Homo Sapiens
TSFLSYTVQ

SEQ ID NO: 300537 - protein, 9 aa, Homo Sapiens
VIPKINSHN

SEQ ID NO: 300538 - protein, 9 aa, Homo Sapiens
ALIEEIINL

SEQ ID NO: 300539 - protein, 9 aa, Homo Sapiens
LSEHEKTND

SEQ ID NO: 300540 - protein, 9 aa, Homo Sapiens
DLDTDISWA

SEQ ID NO: 300541 - protein, 9 aa, Homo Sapiens
VPAGDQRTQ

SEQ ID NO: 300542 - protein, 9 aa, Homo Sapiens
TLTDNIKNT

SEQ ID NO: 300543 - protein, 9 aa, Homo Sapiens
GWEMFWAGH

SEQ ID NO: 300544 - protein, 9 aa, Homo Sapiens
HNFTETHVG

SEQ ID NO: 300545 - protein, 9 aa, Homo Sapiens
ARSYPRLST

SEQ ID NO: 300546 - protein, 9 aa, Homo Sapiens
FTKIGNIEN

SEQ ID NO: 300547 - protein, 9 aa, Homo Sapiens
VPAKEKTSF

SEQ ID NO: 300548 - protein, 9 aa, Homo Sapiens
FPPWKLILS

SEQ ID NO: 300549 - protein, 9 aa, Homo Sapiens
CNICKISVS

SEQ ID NO: 300550 - protein, 9 aa, Homo Sapiens
HKQQLIKRH

SEQ ID NO: 300551 - protein, 9 aa, Homo Sapiens
HLRTVQYIM

SEQ ID NO: 300552 - protein, 9 aa, Homo Sapiens
DSSDSSDNS

SEQ ID NO: 300553 - protein, 9 aa, Homo Sapiens
LGYKQINAV

SEQ ID NO: 300554 - protein, 9 aa, Homo Sapiens
QYVPCLILL

SEQ ID NO: 300555 - protein, 9 aa, Homo Sapiens
GHLVGPRGP

SEQ ID NO: 300556 - protein, 9 aa, Homo Sapiens
VITLISVND

SEQ ID NO: 300557 - protein, 9 aa, Homo Sapiens
IDYKVKTKK

SEQ ID NO: 300558 - protein, 9 aa, Homo Sapiens
GETNILSTS

SEQ ID NO: 300559 - protein, 9 aa, Homo Sapiens
NYEKDEDFV

SEQ ID NO: 300560 - protein, 9 aa, Homo Sapiens
NNCHTASTT

SEQ ID NO: 300561 - protein, 9 aa, Homo Sapiens
FINLLLDRI

SEQ ID NO: 300562 - protein, 9 aa, Homo Sapiens
LFCEKLEEQ

SEQ ID NO: 300563 - protein, 9 aa, Homo Sapiens
VKPHLCSLS

SEQ ID NO: 300564 - protein, 9 aa, Homo Sapiens
IPKINSHNF

SEQ ID NO: 300565 - protein, 9 aa, Homo Sapiens
LHYCPRKCV

SEQ ID NO: 300566 - protein, 9 aa, Homo Sapiens
KTTKGPSRH

SEQ ID NO: 300567 - protein, 9 aa, Homo Sapiens
SEDVVILAN

SEQ ID NO: 300568 - protein, 9 aa, Homo Sapiens
KEKPAIHHI

SEQ ID NO: 300569 - protein, 9 aa, Homo Sapiens
QVCCNDTRV

SEQ ID NO: 300570 - protein, 9 aa, Homo Sapiens
TKSTPSRDW

SEQ ID NO: 300571 - protein, 9 aa, Homo Sapiens
VLAKSMCMI

SEQ ID NO: 300572 - protein, 9 aa, Homo Sapiens
PGTKVFKSY

SEQ ID NO: 300573 - protein, 9 aa, Homo Sapiens
LWEDGAMCR

SEQ ID NO: 300574 - protein, 9 aa, Homo Sapiens
NGFDKVSND

SEQ ID NO: 300575 - protein, 9 aa, Homo Sapiens
WQGWNKRIK

SEQ ID NO: 300576 - protein, 9 aa, Homo Sapiens
GHVRLLSER

SEQ ID NO: 300577 - protein, 9 aa, Homo Sapiens
FENNYNMYI

SEQ ID NO: 300578 - protein, 9 aa, Homo Sapiens
FCNVTPLLK

SEQ ID NO: 300579 - protein, 9 aa, Homo Sapiens
TVLRLLDTK

SEQ ID NO: 300580 - protein, 9 aa, Homo Sapiens
EKELPVADP

SEQ ID NO: 300581 - protein, 9 aa, Homo Sapiens
GLFPEHLIN

SEQ ID NO: 300582 - protein, 9 aa, Homo Sapiens
IAGVAYGHF

SEQ ID NO: 300583 - protein, 9 aa, Homo Sapiens
RFAAYNEGI

SEQ ID NO: 300584 - protein, 9 aa, Homo Sapiens
MQKIETLLY

SEQ ID NO: 300585 - protein, 9 aa, Homo Sapiens
DTQIKENIF

SEQ ID NO: 300586 - protein, 9 aa, Homo Sapiens
SRSTKYEMY

SEQ ID NO: 300587 - protein, 9 aa, Homo Sapiens
APWIPGQPG

SEQ ID NO: 300588 - protein, 9 aa, Homo Sapiens
VGDKIFGDL

SEQ ID NO: 300589 - protein, 9 aa, Homo Sapiens
GERFNKSIS

SEQ ID NO: 300590 - protein, 9 aa, Homo Sapiens
GSGLTATRS

SEQ ID NO: 300591 - protein, 9 aa, Homo Sapiens
WNSTITRKV

SEQ ID NO: 300592 - protein, 9 aa, Homo Sapiens
RCVGDNRVI

SEQ ID NO: 300593 - protein, 9 aa, Homo Sapiens
LLLLVSSVP

SEQ ID NO: 300594 - protein, 9 aa, Homo Sapiens
CPGEKQKVV

SEQ ID NO: 300595 - protein, 9 aa, Homo Sapiens
KCRGQAAAF

SEQ ID NO: 300596 - protein, 9 aa, Homo Sapiens
GSQENHLGK

SEQ ID NO: 300597 - protein, 9 aa, Homo Sapiens
SDKTSKQMA

SEQ ID NO: 300598 - protein, 9 aa, Homo Sapiens
KTSDHLLFN

SEQ ID NO: 300599 - protein, 9 aa, Homo Sapiens
GDLEGLTPQ

SEQ ID NO: 300600 - protein, 9 aa, Homo Sapiens
LEMSIVFGI

SEQ ID NO: 300601 - protein, 9 aa, Homo Sapiens
QDNIGNGDF

SEQ ID NO: 300602 - protein, 9 aa, Homo Sapiens
NFNWAKSWE

SEQ ID NO: 300603 - protein, 9 aa, Homo Sapiens
TLGNNRISK

SEQ ID NO: 300604 - protein, 9 aa, Homo Sapiens
VVAGIPRTN

SEQ ID NO: 300605 - protein, 9 aa, Homo Sapiens
VETNVATWK

SEQ ID NO: 300606 - protein, 9 aa, Homo Sapiens
LENCILLSI

SEQ ID NO: 300607 - protein, 9 aa, Homo Sapiens
INKESEVYK

SEQ ID NO: 300608 - protein, 9 aa, Homo Sapiens
RKTVTDMDV

SEQ ID NO: 300609 - protein, 9 aa, Homo Sapiens
QTTPEGLQE

SEQ ID NO: 300610 - protein, 9 aa, Homo Sapiens
IKDGGLCFP

SEQ ID NO: 300611 - protein, 9 aa, Homo Sapiens
YKTLADQMN

SEQ ID NO: 300612 - protein, 9 aa, Homo Sapiens
QTSVMFNFP

SEQ ID NO: 300613 - protein, 9 aa, Homo Sapiens
EDDDYVKLK

SEQ ID NO: 300614 - protein, 9 aa, Homo Sapiens
SGDGNIVRK

SEQ ID NO: 300615 - protein, 9 aa, Homo Sapiens
EDNWYNTYS

SEQ ID NO: 300616 - protein, 9 aa, Homo Sapiens
IETVYNNRG

SEQ ID NO: 300617 - protein, 9 aa, Homo Sapiens
EISYTGSDV

SEQ ID NO: 300618 - protein, 9 aa, Homo Sapiens
SVYRNGTYI

SEQ ID NO: 300619 - protein, 9 aa, Homo Sapiens
EESSTLLTV

SEQ ID NO: 300620 - protein, 9 aa, Homo Sapiens
YPRLAKRES

SEQ ID NO: 300621 - protein, 9 aa, Homo Sapiens
HLSGPQQQA

SEQ ID NO: 300622 - protein, 9 aa, Homo Sapiens
EFPQVVHKA

SEQ ID NO: 300623 - protein, 9 aa, Homo Sapiens
TPVASRQED

SEQ ID NO: 300624 - protein, 9 aa, Homo Sapiens
VMLSLASHL

SEQ ID NO: 300625 - protein, 9 aa, Homo Sapiens
AMTTTLLQP

SEQ ID NO: 300626 - protein, 9 aa, Homo Sapiens
VLAVKELSW

SEQ ID NO: 300627 - protein, 9 aa, Homo Sapiens
DMSNHPVCR

SEQ ID NO: 300628 - protein, 9 aa, Homo Sapiens
FTESRTLHI

SEQ ID NO: 300629 - protein, 9 aa, Homo Sapiens
TTCGRQLDK

SEQ ID NO: 300630 - protein, 9 aa, Homo Sapiens
SLAEPEAEP

SEQ ID NO: 300631 - protein, 9 aa, Homo Sapiens
QIASFSQNC

SEQ ID NO: 300632 - protein, 9 aa, Homo Sapiens
GSIFTLKLL

SEQ ID NO: 300633 - protein, 9 aa, Homo Sapiens
SKMKAPVLP

SEQ ID NO: 300634 - protein, 9 aa, Homo Sapiens
MSQSKGKKQ

SEQ ID NO: 300635 - protein, 9 aa, Homo Sapiens
NWSIINPNK

SEQ ID NO: 300636 - protein, 9 aa, Homo Sapiens
SHLYTDGSH

SEQ ID NO: 300637 - protein, 9 aa, Homo Sapiens
ICDLIAIER

SEQ ID NO: 300638 - protein, 9 aa, Homo Sapiens
AVKFGNHME

SEQ ID NO: 300639 - protein, 9 aa, Homo Sapiens
ELDKETVTL

SEQ ID NO: 300640 - protein, 9 aa, Homo Sapiens
TPDQPIIVE

SEQ ID NO: 300641 - protein, 9 aa, Homo Sapiens
QNNVVLYWL

SEQ ID NO: 300642 - protein, 9 aa, Homo Sapiens
RSDADKQLL

SEQ ID NO: 300643 - protein, 9 aa, Homo Sapiens
QLRHIHLEN

SEQ ID NO: 300644 - protein, 9 aa, Homo Sapiens
GSITEHCIK

SEQ ID NO: 300645 - protein, 9 aa, Homo Sapiens
RNKVKKEMI

SEQ ID NO: 300646 - protein, 9 aa, Homo Sapiens
SIVSYFAFG

SEQ ID NO: 300647 - protein, 9 aa, Homo Sapiens
SSSIKVHWT

SEQ ID NO: 300648 - protein, 9 aa, Homo Sapiens
LDSLWLRMH

SEQ ID NO: 300649 - protein, 9 aa, Homo Sapiens
QSKFQVPHA

SEQ ID NO: 300650 - protein, 9 aa, Homo Sapiens
GKTSDHLLF

SEQ ID NO: 300651 - protein, 9 aa, Homo Sapiens
NKGRPFVIQ

SEQ ID NO: 300652 - protein, 9 aa, Homo Sapiens
LLSKNNRLR

SEQ ID NO: 300653 - protein, 9 aa, Homo Sapiens
ITARLCDLK

SEQ ID NO: 300654 - protein, 9 aa, Homo Sapiens
QLTEHKKIH

SEQ ID NO: 300655 - protein, 9 aa, Homo Sapiens
SWTSSCTNQ

SEQ ID NO: 300656 - protein, 9 aa, Homo Sapiens
NKAFLINKE

SEQ ID NO: 300657 - protein, 9 aa, Homo Sapiens
ADSGRYWAS

SEQ ID NO: 300658 - protein, 9 aa, Homo Sapiens
TRETLEEGH

SEQ ID NO: 300659 - protein, 9 aa, Homo Sapiens
LSWQKRTGL

SEQ ID NO: 300660 - protein, 9 aa, Homo Sapiens
GTRLFHLLM

SEQ ID NO: 300661 - protein, 9 aa, Homo Sapiens
IQENNPEEI

SEQ ID NO: 300662 - protein, 9 aa, Homo Sapiens
EIDPVCALQ

SEQ ID NO: 300663 - protein, 9 aa, Homo Sapiens
SNYPFPVHP

SEQ ID NO: 300664 - protein, 9 aa, Homo Sapiens
THQKEIDTI

SEQ ID NO: 300665 - protein, 9 aa, Homo Sapiens
RVCIPLPVS

SEQ ID NO: 300666 - protein, 9 aa, Homo Sapiens
GDKNDVDLP

SEQ ID NO: 300667 - protein, 9 aa, Homo Sapiens
YESMCEYQQ

SEQ ID NO: 300668 - protein, 9 aa, Homo Sapiens
GRSDSRNYL

SEQ ID NO: 300669 - protein, 9 aa, Homo Sapiens
QALLRVYLA

SEQ ID NO: 300670 - protein, 9 aa, Homo Sapiens
SGGDTSKKG

SEQ ID NO: 300671 - protein, 9 aa, Homo Sapiens
SCATSPTGA

SEQ ID NO: 300672 - protein, 9 aa, Homo Sapiens
TNNKGKETI

SEQ ID NO: 300673 - protein, 9 aa, Homo Sapiens
VATLSKIAT

SEQ ID NO: 300674 - protein, 9 aa, Homo Sapiens
YGNYTVLAK

SEQ ID NO: 300675 - protein, 9 aa, Homo Sapiens
VFQNEDRWA

SEQ ID NO: 300676 - protein, 9 aa, Homo Sapiens
NSAVQTCGF

SEQ ID NO: 300677 - protein, 9 aa, Homo Sapiens
NNILSYRIF

SEQ ID NO: 300678 - protein, 9 aa, Homo Sapiens
YIQLGSSIV

SEQ ID NO: 300679 - protein, 9 aa, Homo Sapiens
LFINLTLPS

SEQ ID NO: 300680 - protein, 9 aa, Homo Sapiens
QIEAQENYI

SEQ ID NO: 300681 - protein, 9 aa, Homo Sapiens
RLFVRKNKI

SEQ ID NO: 300682 - protein, 9 aa, Homo Sapiens
PSFLCGESD

SEQ ID NO: 300683 - protein, 9 aa, Homo Sapiens
RLLMRDMQQ

SEQ ID NO: 300684 - protein, 9 aa, Homo Sapiens
SGQLSEKNY

SEQ ID NO: 300685 - protein, 9 aa, Homo Sapiens
WGCFDAMGS

SEQ ID NO: 300686 - protein, 9 aa, Homo Sapiens
LYVRTLMIS

SEQ ID NO: 300687 - protein, 9 aa, Homo Sapiens
LYKMLSEKF

SEQ ID NO: 300688 - protein, 9 aa, Homo Sapiens
CPSDGCTRK

SEQ ID NO: 300689 - protein, 9 aa, Homo Sapiens
YNIRRIICS

SEQ ID NO: 300690 - protein, 9 aa, Homo Sapiens
RKRLVIRDK

SEQ ID NO: 300691 - protein, 9 aa, Homo Sapiens
TGSDVIEGG

SEQ ID NO: 300692 - protein, 9 aa, Homo Sapiens
VHFEDNDNR

SEQ ID NO: 300693 - protein, 9 aa, Homo Sapiens
PDFLQKKLI

SEQ ID NO: 300694 - protein, 9 aa, Homo Sapiens
AKNVIIDKV

SEQ ID NO: 300695 - protein, 9 aa, Homo Sapiens
PQINFILGS

SEQ ID NO: 300696 - protein, 9 aa, Homo Sapiens
IFVYVSLLG

SEQ ID NO: 300697 - protein, 9 aa, Homo Sapiens
LEYDPAKII

SEQ ID NO: 300698 - protein, 9 aa, Homo Sapiens
YWGTMWKQL

SEQ ID NO: 300699 - protein, 9 aa, Homo Sapiens
MSNHPVCRH

SEQ ID NO: 300700 - protein, 9 aa, Homo Sapiens
CSHSNIFEM

SEQ ID NO: 300701 - protein, 9 aa, Homo Sapiens
LWAKTIVKF

SEQ ID NO: 300702 - protein, 9 aa, Homo Sapiens
WSRKIAVED

SEQ ID NO: 300703 - protein, 9 aa, Homo Sapiens
GDHPAAHNR

SEQ ID NO: 300704 - protein, 9 aa, Homo Sapiens
KPQFYAAPM

SEQ ID NO: 300705 - protein, 9 aa, Homo Sapiens
ECGKAFHNN

SEQ ID NO: 300706 - protein, 9 aa, Homo Sapiens
KHSSSSNYQ

SEQ ID NO: 300707 - protein, 9 aa, Homo Sapiens
VPAESAAVW

SEQ ID NO: 300708 - protein, 9 aa, Homo Sapiens
VSLLGPNGI

SEQ ID NO: 300709 - protein, 9 aa, Homo Sapiens
IGGIGALEV

SEQ ID NO: 300710 - protein, 9 aa, Homo Sapiens
KYIIRQKDV

SEQ ID NO: 300711 - protein, 9 aa, Homo Sapiens
RAFVHWCVG

SEQ ID NO: 300712 - protein, 9 aa, Homo Sapiens
RLPGKWILS

SEQ ID NO: 300713 - protein, 9 aa, Homo Sapiens
EQLVVELKY

SEQ ID NO: 300714 - protein, 9 aa, Homo Sapiens
INKFACVAS

SEQ ID NO: 300715 - protein, 9 aa, Homo Sapiens
GQPVIKLYI

SEQ ID NO: 300716 - protein, 9 aa, Homo Sapiens
ICQMALNQA

SEQ ID NO: 300717 - protein, 9 aa, Homo Sapiens
NLTNHKNIH

SEQ ID NO: 300718 - protein, 9 aa, Homo Sapiens
PHIFCNVTP

SEQ ID NO: 300719 - protein, 9 aa, Homo Sapiens
YGASINAVN

SEQ ID NO: 300720 - protein, 9 aa, Homo Sapiens
GGAANLQLI

SEQ ID NO: 300721 - protein, 9 aa, Homo Sapiens
TEKSNVYRY

SEQ ID NO: 300722 - protein, 9 aa, Homo Sapiens
SHYRENLTQ

SEQ ID NO: 300723 - protein, 9 aa, Homo Sapiens
LIIHQIIHT

SEQ ID NO: 300724 - protein, 9 aa, Homo Sapiens
SWRHCIGPS

SEQ ID NO: 300725 - protein, 9 aa, Homo Sapiens
KPAHLSANA

SEQ ID NO: 300726 - protein, 9 aa, Homo Sapiens
SLEEENKKH

SEQ ID NO: 300727 - protein, 9 aa, Homo Sapiens
LSLSKKELP

SEQ ID NO: 300728 - protein, 9 aa, Homo Sapiens
QSAGITDIK

SEQ ID NO: 300729 - protein, 9 aa, Homo Sapiens
SSLENAVCK

SEQ ID NO: 300730 - protein, 9 aa, Homo Sapiens
FIDPLAYEI

SEQ ID NO: 300731 - protein, 9 aa, Homo Sapiens
ALAIVQNAL

SEQ ID NO: 300732 - protein, 9 aa, Homo Sapiens
LKDFLHPHP

SEQ ID NO: 300733 - protein, 9 aa, Homo Sapiens
TGSAAITEV

SEQ ID NO: 300734 - protein, 9 aa, Homo Sapiens
LFNNIREQN

SEQ ID NO: 300735 - protein, 9 aa, Homo Sapiens
RELARHQSI

SEQ ID NO: 300736 - protein, 9 aa, Homo Sapiens
AGLLKQLFR

SEQ ID NO: 300737 - protein, 9 aa, Homo Sapiens
PSFESENPY

SEQ ID NO: 300738 - protein, 9 aa, Homo Sapiens
MVFLKLFCM

SEQ ID NO: 300739 - protein, 9 aa, Homo Sapiens
YHLFSSPSL

SEQ ID NO: 300740 - protein, 9 aa, Homo Sapiens
HFDPKVEHN

SEQ ID NO: 300741 - protein, 9 aa, Homo Sapiens
NQMETIIKE

SEQ ID NO: 300742 - protein, 9 aa, Homo Sapiens
SFDRFASVV

SEQ ID NO: 300743 - protein, 9 aa, Homo Sapiens
VDVTFSRKG

SEQ ID NO: 300744 - protein, 9 aa, Homo Sapiens
PSADLAPNK

SEQ ID NO: 300745 - protein, 9 aa, Homo Sapiens
QVKDVFWDV

SEQ ID NO: 300746 - protein, 9 aa, Homo Sapiens
DIDLFEAED

SEQ ID NO: 300747 - protein, 9 aa, Homo Sapiens
RKGDLQIMK

SEQ ID NO: 300748 - protein, 9 aa, Homo Sapiens
RVKIIYKKI

SEQ ID NO: 300749 - protein, 9 aa, Homo Sapiens
NAFNTSPGV

SEQ ID NO: 300750 - protein, 9 aa, Homo Sapiens
REHIWGYME

SEQ ID NO: 300751 - protein, 9 aa, Homo Sapiens
LFVRKNKIF

SEQ ID NO: 300752 - protein, 9 aa, Homo Sapiens
ISTHCDKIK

SEQ ID NO: 300753 - protein, 9 aa, Homo Sapiens
FKQCSRMYG

SEQ ID NO: 300754 - protein, 9 aa, Homo Sapiens
VEELNKKYG

SEQ ID NO: 300755 - protein, 9 aa, Homo Sapiens
DFKKFENKI

SEQ ID NO: 300756 - protein, 9 aa, Homo Sapiens
TPQDHEIAL

SEQ ID NO: 300757 - protein, 9 aa, Homo Sapiens
EEREENLKK

SEQ ID NO: 300758 - protein, 9 aa, Homo Sapiens
VEQIFYIVE

SEQ ID NO: 300759 - protein, 9 aa, Homo Sapiens
HFKITGTGT

SEQ ID NO: 300760 - protein, 9 aa, Homo Sapiens
EVYYAKKKQ

SEQ ID NO: 300761 - protein, 9 aa, Homo Sapiens
YNFNPTEEQ

SEQ ID NO: 300762 - protein, 9 aa, Homo Sapiens
CSQDFKNTA

SEQ ID NO: 300763 - protein, 9 aa, Homo Sapiens
IFCQTPKVG

SEQ ID NO: 300764 - protein, 9 aa, Homo Sapiens
MRVHTRYQP

SEQ ID NO: 300765 - protein, 9 aa, Homo Sapiens
RGPPPGHLV

SEQ ID NO: 300766 - protein, 9 aa, Homo Sapiens
CPAFPRLKE

SEQ ID NO: 300767 - protein, 9 aa, Homo Sapiens
ALGQVAQAR

SEQ ID NO: 300768 - protein, 9 aa, Homo Sapiens
RVTVVEDFF

SEQ ID NO: 300769 - protein, 9 aa, Homo Sapiens
HSLSKDIIY

SEQ ID NO: 300770 - protein, 9 aa, Homo Sapiens
PNVNMLHVF

SEQ ID NO: 300771 - protein, 9 aa, Homo Sapiens
NTYRNDLID

SEQ ID NO: 300772 - protein, 9 aa, Homo Sapiens
KHISELLFK

SEQ ID NO: 300773 - protein, 9 aa, Homo Sapiens
DNAPQFAVL

SEQ ID NO: 300774 - protein, 9 aa, Homo Sapiens
LTLQAPPNT

SEQ ID NO: 300775 - protein, 9 aa, Homo Sapiens
GYCSGGTST

SEQ ID NO: 300776 - protein, 9 aa, Homo Sapiens
SHGGDMSNH

SEQ ID NO: 300777 - protein, 9 aa, Homo Sapiens
EDHIQMKQQ

SEQ ID NO: 300778 - protein, 9 aa, Homo Sapiens
LSSTSVLIQ

SEQ ID NO: 300779 - protein, 9 aa, Homo Sapiens
INISQCDLP

SEQ ID NO: 300780 - protein, 9 aa, Homo Sapiens
VGTYVIQVT

SEQ ID NO: 300781 - protein, 9 aa, Homo Sapiens
QGIFKINNS

SEQ ID NO: 300782 - protein, 9 aa, Homo Sapiens
KMDPIISKY

SEQ ID NO: 300783 - protein, 9 aa, Homo Sapiens
EHIWGYMES

SEQ ID NO: 300784 - protein, 9 aa, Homo Sapiens
GMITAIAVK

SEQ ID NO: 300785 - protein, 9 aa, Homo Sapiens
KVLANCKEW

SEQ ID NO: 300786 - protein, 9 aa, Homo Sapiens
FFYLFTGSS

SEQ ID NO: 300787 - protein, 9 aa, Homo Sapiens
MQTDSLFPS

SEQ ID NO: 300788 - protein, 9 aa, Homo Sapiens
RRFQQPQRH

SEQ ID NO: 300789 - protein, 9 aa, Homo Sapiens
NKDIQPIKC

SEQ ID NO: 300790 - protein, 9 aa, Homo Sapiens
RKTVLRRAK

SEQ ID NO: 300791 - protein, 9 aa, Homo Sapiens
YDKAEIDIL

SEQ ID NO: 300792 - protein, 9 aa, Homo Sapiens
SQLLGHLSA

SEQ ID NO: 300793 - protein, 9 aa, Homo Sapiens
TVKDKSASR

SEQ ID NO: 300794 - protein, 9 aa, Homo Sapiens
FAIILYVYV

SEQ ID NO: 300795 - protein, 9 aa, Homo Sapiens
VTSKVIKKF

SEQ ID NO: 300796 - protein, 9 aa, Homo Sapiens
VDPLNVDHL

SEQ ID NO: 300797 - protein, 9 aa, Homo Sapiens
DGMLSRALK

SEQ ID NO: 300798 - protein, 9 aa, Homo Sapiens
SCKKAGSKK

SEQ ID NO: 300799 - protein, 9 aa, Homo Sapiens
LEVKLNGQE

SEQ ID NO: 300800 - protein, 9 aa, Homo Sapiens
RDNKTPTQS

SEQ ID NO: 300801 - protein, 9 aa, Homo Sapiens
EDNCMVNNN

SEQ ID NO: 300802 - protein, 9 aa, Homo Sapiens
SNLNIWNIE

SEQ ID NO: 300803 - protein, 9 aa, Homo Sapiens
GRNRYWGTL

SEQ ID NO: 300804 - protein, 9 aa, Homo Sapiens
CFDIEKLKN

SEQ ID NO: 300805 - protein, 9 aa, Homo Sapiens
IQIWFQNWR

SEQ ID NO: 300806 - protein, 9 aa, Homo Sapiens
LDIYGRTVL

SEQ ID NO: 300807 - protein, 9 aa, Homo Sapiens
LINRKEEDN

SEQ ID NO: 300808 - protein, 9 aa, Homo Sapiens
ALLSANSIG

SEQ ID NO: 300809 - protein, 9 aa, Homo Sapiens
QVGMATNIK

SEQ ID NO: 300810 - protein, 9 aa, Homo Sapiens
ADMLVSVSH

SEQ ID NO: 300811 - protein, 9 aa, Homo Sapiens
NNNKYFGFI

SEQ ID NO: 300812 - protein, 9 aa, Homo Sapiens
NLLNILTEP

SEQ ID NO: 300813 - protein, 9 aa, Homo Sapiens
SEAVKLLLD

SEQ ID NO: 300814 - protein, 9 aa, Homo Sapiens
EDTLELAKQ

SEQ ID NO: 300815 - protein, 9 aa, Homo Sapiens
RRNFDNSYQ

SEQ ID NO: 300816 - protein, 9 aa, Homo Sapiens
KSRLGEIHY

SEQ ID NO: 300817 - protein, 9 aa, Homo Sapiens
YFDPANAKC

SEQ ID NO: 300818 - protein, 9 aa, Homo Sapiens
CLVHLMTLA

SEQ ID NO: 300819 - protein, 9 aa, Homo Sapiens
LNDMHSEEL

SEQ ID NO: 300820 - protein, 9 aa, Homo Sapiens
KIFVMLFYT

SEQ ID NO: 300821 - protein, 9 aa, Homo Sapiens
THTGDKPFE

SEQ ID NO: 300822 - protein, 9 aa, Homo Sapiens
PLIKASRCR

SEQ ID NO: 300823 - protein, 9 aa, Homo Sapiens
LEDYVFSDS

SEQ ID NO: 300824 - protein, 9 aa, Homo Sapiens
SKTTAYSKL

SEQ ID NO: 300825 - protein, 9 aa, Homo Sapiens
ANVPQPFED

SEQ ID NO: 300826 - protein, 9 aa, Homo Sapiens
GASEGLPGM

SEQ ID NO: 300827 - protein, 9 aa, Homo Sapiens
LNTKENVND

SEQ ID NO: 300828 - protein, 9 aa, Homo Sapiens
PGDVSFGDL

SEQ ID NO: 300829 - protein, 9 aa, Homo Sapiens
NSKMREKRK

SEQ ID NO: 300830 - protein, 9 aa, Homo Sapiens
RVRSNPGGG

SEQ ID NO: 300831 - protein, 9 aa, Homo Sapiens
GISLTGVDP

SEQ ID NO: 300832 - protein, 9 aa, Homo Sapiens
KTFITSSHH

SEQ ID NO: 300833 - protein, 9 aa, Homo Sapiens
MIKTIKKQD

SEQ ID NO: 300834 - protein, 9 aa, Homo Sapiens
NSFLQNTDD

SEQ ID NO: 300835 - protein, 9 aa, Homo Sapiens
NLDIALESR

SEQ ID NO: 300836 - protein, 9 aa, Homo Sapiens
FWKFARKGN

SEQ ID NO: 300837 - protein, 9 aa, Homo Sapiens
YLEPRLQRE

SEQ ID NO: 300838 - protein, 9 aa, Homo Sapiens
KIGTPVKVW

SEQ ID NO: 300839 - protein, 9 aa, Homo Sapiens
QNREVSIMY

SEQ ID NO: 300840 - protein, 9 aa, Homo Sapiens
CMSGADSFD

SEQ ID NO: 300841 - protein, 9 aa, Homo Sapiens
SSVLQAHLR

SEQ ID NO: 300842 - protein, 9 aa, Homo Sapiens
IFQTYVTVG

SEQ ID NO: 300843 - protein, 9 aa, Homo Sapiens
MTALDAIFK

SEQ ID NO: 300844 - protein, 9 aa, Homo Sapiens
SGPGVAVMQ

SEQ ID NO: 300845 - protein, 9 aa, Homo Sapiens
LKRHLSSVS

SEQ ID NO: 300846 - protein, 9 aa, Homo Sapiens
DHKVCLAIG

SEQ ID NO: 300847 - protein, 9 aa, Homo Sapiens
FFMTSGHNE

SEQ ID NO: 300848 - protein, 9 aa, Homo Sapiens
YLQNHLYGG

SEQ ID NO: 300849 - protein, 9 aa, Homo Sapiens
AQAILSQGR

SEQ ID NO: 300850 - protein, 9 aa, Homo Sapiens
LCGTTSSPE

SEQ ID NO: 300851 - protein, 9 aa, Homo Sapiens
SPKIISFLY

SEQ ID NO: 300852 - protein, 9 aa, Homo Sapiens
VSFKQCSRM

SEQ ID NO: 300853 - protein, 9 aa, Homo Sapiens
LCLSCLLPW

SEQ ID NO: 300854 - protein, 9 aa, Homo Sapiens
QPKEFSERK

SEQ ID NO: 300855 - protein, 9 aa, Homo Sapiens
APVMTMAAS

SEQ ID NO: 300856 - protein, 9 aa, Homo Sapiens
LYLSEKAYL

SEQ ID NO: 300857 - protein, 9 aa, Homo Sapiens
TEPEGGSGW

SEQ ID NO: 300858 - protein, 9 aa, Homo Sapiens
LDLFNNIRE

SEQ ID NO: 300859 - protein, 9 aa, Homo Sapiens
SVDPASVGS

SEQ ID NO: 300860 - protein, 9 aa, Homo Sapiens
HYQNIFSCL

SEQ ID NO: 300861 - protein, 9 aa, Homo Sapiens
ILGFTNFIV

SEQ ID NO: 300862 - protein, 9 aa, Homo Sapiens
YELLSAWST

SEQ ID NO: 300863 - protein, 9 aa, Homo Sapiens
YWGTLGSGR

SEQ ID NO: 300864 - protein, 9 aa, Homo Sapiens
NKLSCKISQ

SEQ ID NO: 300865 - protein, 9 aa, Homo Sapiens
LHVRCAGFL

SEQ ID NO: 300866 - protein, 9 aa, Homo Sapiens
LSQINRDQL

SEQ ID NO: 300867 - protein, 9 aa, Homo Sapiens
WTNQLNYLN

SEQ ID NO: 300868 - protein, 9 aa, Homo Sapiens
TQGQVCCND

SEQ ID NO: 300869 - protein, 9 aa, Homo Sapiens
LEEENKKHK

SEQ ID NO: 300870 - protein, 9 aa, Homo Sapiens
FMNKLAEER

SEQ ID NO: 300871 - protein, 9 aa, Homo Sapiens
SLSKKELPG

SEQ ID NO: 300872 - protein, 9 aa, Homo Sapiens
NGTGTIYST

SEQ ID NO: 300873 - protein, 9 aa, Homo Sapiens
ELIEIKTKK

SEQ ID NO: 300874 - protein, 9 aa, Homo Sapiens
YMGQLKRNE

SEQ ID NO: 300875 - protein, 9 aa, Homo Sapiens
EELQTSISE

SEQ ID NO: 300876 - protein, 9 aa, Homo Sapiens
TSFHVIQAS

SEQ ID NO: 300877 - protein, 9 aa, Homo Sapiens
LMEKNGDQY

SEQ ID NO: 300878 - protein, 9 aa, Homo Sapiens
VVMNPHICL

SEQ ID NO: 300879 - protein, 9 aa, Homo Sapiens
LRTSYKNKT

SEQ ID NO: 300880 - protein, 9 aa, Homo Sapiens
GHVLAVSDS

SEQ ID NO: 300881 - protein, 9 aa, Homo Sapiens
LIFKNNIGW

SEQ ID NO: 300882 - protein, 9 aa, Homo Sapiens
LRTPYTSAV

SEQ ID NO: 300883 - protein, 9 aa, Homo Sapiens
KFENKIILK

SEQ ID NO: 300884 - protein, 9 aa, Homo Sapiens
QDVKSIYLQ

SEQ ID NO: 300885 - protein, 9 aa, Homo Sapiens
VIRDKNKYN

SEQ ID NO: 300886 - protein, 9 aa, Homo Sapiens
ISGGDTSKK

SEQ ID NO: 300887 - protein, 9 aa, Homo Sapiens
ITPFQLYLN

SEQ ID NO: 300888 - protein, 9 aa, Homo Sapiens
TGEQDPASA

SEQ ID NO: 300889 - protein, 9 aa, Homo Sapiens
NLEQDNQNL

SEQ ID NO: 300890 - protein, 9 aa, Homo Sapiens
SKDSIRTLW

SEQ ID NO: 300891 - protein, 9 aa, Homo Sapiens
QNLRKKELN

SEQ ID NO: 300892 - protein, 9 aa, Homo Sapiens
LHVKGLFDE

SEQ ID NO: 300893 - protein, 9 aa, Homo Sapiens
VYVSLLGAE

SEQ ID NO: 300894 - protein, 9 aa, Homo Sapiens
ISVRQFWFL

SEQ ID NO: 300895 - protein, 9 aa, Homo Sapiens
LKESICSWN

SEQ ID NO: 300896 - protein, 9 aa, Homo Sapiens
VLKEMKKVR

SEQ ID NO: 300897 - protein, 9 aa, Homo Sapiens
ILHTGKKPL

SEQ ID NO: 300898 - protein, 9 aa, Homo Sapiens
SDLLFLSTG

SEQ ID NO: 300899 - protein, 9 aa, Homo Sapiens
WMTDTPNAL

SEQ ID NO: 300900 - protein, 9 aa, Homo Sapiens
HLHRALPLL

SEQ ID NO: 300901 - protein, 9 aa, Homo Sapiens
SVGCCSEQQ

SEQ ID NO: 300902 - protein, 9 aa, Homo Sapiens
SPASWPLRP

SEQ ID NO: 300903 - protein, 9 aa, Homo Sapiens
ELAYQKEMV

SEQ ID NO: 300904 - protein, 9 aa, Homo Sapiens
KCLVFQGTV

SEQ ID NO: 300905 - protein, 9 aa, Homo Sapiens
TVITLISVN

SEQ ID NO: 300906 - protein, 9 aa, Homo Sapiens
YKPPGCSLM

SEQ ID NO: 300907 - protein, 9 aa, Homo Sapiens
FGHFVQKHG

SEQ ID NO: 300908 - protein, 9 aa, Homo Sapiens
VGAVYSPKF

SEQ ID NO: 300909 - protein, 9 aa, Homo Sapiens
ITNKMDPHS

SEQ ID NO: 300910 - protein, 9 aa, Homo Sapiens
PNGNNGKKA

SEQ ID NO: 300911 - protein, 9 aa, Homo Sapiens
GTQIAYIGL

SEQ ID NO: 300912 - protein, 9 aa, Homo Sapiens
QLLAPHLQG

SEQ ID NO: 300913 - protein, 9 aa, Homo Sapiens
KAPVYNWSP

SEQ ID NO: 300914 - protein, 9 aa, Homo Sapiens
ILHAVRIDQ

SEQ ID NO: 300915 - protein, 9 aa, Homo Sapiens
RIILKELEN

SEQ ID NO: 300916 - protein, 9 aa, Homo Sapiens
LNKSADDFH

SEQ ID NO: 300917 - protein, 9 aa, Homo Sapiens
IRRVRAILP

SEQ ID NO: 300918 - protein, 9 aa, Homo Sapiens
SETGADEEE

SEQ ID NO: 300919 - protein, 9 aa, Homo Sapiens
VIKKFPAPV

SEQ ID NO: 300920 - protein, 9 aa, Homo Sapiens
TVLNYYTFA

SEQ ID NO: 300921 - protein, 9 aa, Homo Sapiens
PEMSGVGTY

SEQ ID NO: 300922 - protein, 9 aa, Homo Sapiens
MPETSQETR

SEQ ID NO: 300923 - protein, 9 aa, Homo Sapiens
APKVIGSVV

SEQ ID NO: 300924 - protein, 9 aa, Homo Sapiens
VALKEWGLF

SEQ ID NO: 300925 - protein, 9 aa, Homo Sapiens
YSIPFFFLP

SEQ ID NO: 300926 - protein, 9 aa, Homo Sapiens
FINLTLPSL

SEQ ID NO: 300927 - protein, 9 aa, Homo Sapiens
LEHLMKAFL

SEQ ID NO: 300928 - protein, 9 aa, Homo Sapiens
HLDLSVNDF

SEQ ID NO: 300929 - protein, 9 aa, Homo Sapiens
QMLDNRKLG

SEQ ID NO: 300930 - protein, 9 aa, Homo Sapiens
GGDMSNHPV

SEQ ID NO: 300931 - protein, 9 aa, Homo Sapiens
YDRVLKYAK

SEQ ID NO: 300932 - protein, 9 aa, Homo Sapiens
GLSGTTDFI

SEQ ID NO: 300933 - protein, 9 aa, Homo Sapiens
VIHNIFSKF

SEQ ID NO: 300934 - protein, 9 aa, Homo Sapiens
ISGHFIADH

SEQ ID NO: 300935 - protein, 9 aa, Homo Sapiens
ARTMYQVLR

SEQ ID NO: 300936 - protein, 9 aa, Homo Sapiens
KELKRNKKW

SEQ ID NO: 300937 - protein, 9 aa, Homo Sapiens
GNLSLITLI

SEQ ID NO: 300938 - protein, 9 aa, Homo Sapiens
ALGALLQRC

SEQ ID NO: 300939 - protein, 9 aa, Homo Sapiens
ISDGKNFSP

SEQ ID NO: 300940 - protein, 9 aa, Homo Sapiens
YSEVQIKQS

SEQ ID NO: 300941 - protein, 9 aa, Homo Sapiens
RRVTEVCAD

SEQ ID NO: 300942 - protein, 9 aa, Homo Sapiens
RRPSTRYSR

SEQ ID NO: 300943 - protein, 9 aa, Homo Sapiens
YQDKLKAIE

SEQ ID NO: 300944 - protein, 9 aa, Homo Sapiens
KFFKTHGIR

SEQ ID NO: 300945 - protein, 9 aa, Homo Sapiens
ISPGMTYCE

SEQ ID NO: 300946 - protein, 9 aa, Homo Sapiens
PIPVINNSI

SEQ ID NO: 300947 - protein, 9 aa, Homo Sapiens
KTLRQMEEV

SEQ ID NO: 300948 - protein, 9 aa, Homo Sapiens
TIQIEKGTP

SEQ ID NO: 300949 - protein, 9 aa, Homo Sapiens
VTGNYPHLL

SEQ ID NO: 300950 - protein, 9 aa, Homo Sapiens
MKAFLDKKK

SEQ ID NO: 300951 - protein, 9 aa, Homo Sapiens
YEFNDTGHC

SEQ ID NO: 300952 - protein, 9 aa, Homo Sapiens
LGGSGYNLD

SEQ ID NO: 300953 - protein, 9 aa, Homo Sapiens
NLEVPVKIS

SEQ ID NO: 300954 - protein, 9 aa, Homo Sapiens
APVLMIPPS

SEQ ID NO: 300955 - protein, 9 aa, Homo Sapiens
VFPPTPALE

SEQ ID NO: 300956 - protein, 9 aa, Homo Sapiens
KVFKSYSGN

SEQ ID NO: 300957 - protein, 9 aa, Homo Sapiens
ISVSFKQCS

SEQ ID NO: 300958 - protein, 9 aa, Homo Sapiens
HLHSAGIIN

SEQ ID NO: 300959 - protein, 9 aa, Homo Sapiens
KSHHRAHYK

SEQ ID NO: 300960 - protein, 9 aa, Homo Sapiens
STNINAMAA

SEQ ID NO: 300961 - protein, 9 aa, Homo Sapiens
YEGPTQKLL

SEQ ID NO: 300962 - protein, 9 aa, Homo Sapiens
QISTKPRDP

SEQ ID NO: 300963 - protein, 9 aa, Homo Sapiens
EPQARGTYP

SEQ ID NO: 300964 - protein, 9 aa, Homo Sapiens
QNENGIDAE

SEQ ID NO: 300965 - protein, 9 aa, Homo Sapiens
DFISIAVGL

SEQ ID NO: 300966 - protein, 9 aa, Homo Sapiens
NQQEALQYA

SEQ ID NO: 300967 - protein, 9 aa, Homo Sapiens
LQTLQDLSV

SEQ ID NO: 300968 - protein, 9 aa, Homo Sapiens
PEDICQMAL

SEQ ID NO: 300969 - protein, 9 aa, Homo Sapiens
MSPSHLSTD

SEQ ID NO: 300970 - protein, 9 aa, Homo Sapiens
PYLKLAKPL

SEQ ID NO: 300971 - protein, 9 aa, Homo Sapiens
KRHKSLALE

SEQ ID NO: 300972 - protein, 9 aa, Homo Sapiens
EQLQKICDL

SEQ ID NO: 300973 - protein, 9 aa, Homo Sapiens
GLERRVVML

SEQ ID NO: 300974 - protein, 9 aa, Homo Sapiens
WVSASNADE

SEQ ID NO: 300975 - protein, 9 aa, Homo Sapiens
MFMSLLVGI

SEQ ID NO: 300976 - protein, 9 aa, Homo Sapiens
TQQVYFFLF

SEQ ID NO: 300977 - protein, 9 aa, Homo Sapiens
KQEKEQRKA

SEQ ID NO: 300978 - protein, 9 aa, Homo Sapiens
LGESVPDNT

SEQ ID NO: 300979 - protein, 9 aa, Homo Sapiens
LDSDSLLKE

SEQ ID NO: 300980 - protein, 9 aa, Homo Sapiens
ENKNLQEDI

SEQ ID NO: 300981 - protein, 9 aa, Homo Sapiens
HSTQKNLNN

SEQ ID NO: 300982 - protein, 9 aa, Homo Sapiens
NYLSGLRRK

SEQ ID NO: 300983 - protein, 9 aa, Homo Sapiens
RDINEALKE

SEQ ID NO: 300984 - protein, 9 aa, Homo Sapiens
SLLGICLQS

SEQ ID NO: 300985 - protein, 9 aa, Homo Sapiens
NLKLEAKKA

SEQ ID NO: 300986 - protein, 9 aa, Homo Sapiens
YRYHSESSS

SEQ ID NO: 300987 - protein, 9 aa, Homo Sapiens
NILPKENHI

SEQ ID NO: 300988 - protein, 9 aa, Homo Sapiens
QKTMDSHIA

SEQ ID NO: 300989 - protein, 9 aa, Homo Sapiens
CPLNWEYFK

SEQ ID NO: 300990 - protein, 9 aa, Homo Sapiens
HIHQKSLSC

SEQ ID NO: 300991 - protein, 9 aa, Homo Sapiens
IHEVQVGER

SEQ ID NO: 300992 - protein, 9 aa, Homo Sapiens
NEYKALTKD

SEQ ID NO: 300993 - protein, 9 aa, Homo Sapiens
NITFSNLGE

SEQ ID NO: 300994 - protein, 9 aa, Homo Sapiens
QPKVEENIS

SEQ ID NO: 300995 - protein, 9 aa, Homo Sapiens
RTNSRDPLA

SEQ ID NO: 300996 - protein, 9 aa, Homo Sapiens
DRNNSLETK

SEQ ID NO: 300997 - protein, 9 aa, Homo Sapiens
SSCLGGECN

SEQ ID NO: 300998 - protein, 9 aa, Homo Sapiens
KQKIIPQEL

SEQ ID NO: 300999 - protein, 9 aa, Homo Sapiens
YRQKMDCKA

SEQ ID NO: 301000 - protein, 9 aa, Homo Sapiens
NELESYAYY

SEQ ID NO: 301001 - protein, 9 aa, Homo Sapiens
VGLLLFYFI

SEQ ID NO: 301002 - protein, 9 aa, Homo Sapiens
LIWRGSTPK

SEQ ID NO: 301003 - protein, 9 aa, Homo Sapiens
MEKELQAQQ

SEQ ID NO: 301004 - protein, 9 aa, Homo Sapiens
QKGSGAKWE

SEQ ID NO: 301005 - protein, 9 aa, Homo Sapiens
TGCSRKIAL

SEQ ID NO: 301006 - protein, 9 aa, Homo Sapiens
LFYFDNIVN

SEQ ID NO: 301007 - protein, 9 aa, Homo Sapiens
AWMEWSKWS

SEQ ID NO: 301008 - protein, 9 aa, Homo Sapiens
KKFALRCSV

SEQ ID NO: 301009 - protein, 9 aa, Homo Sapiens
PNDVFDELF

SEQ ID NO: 301010 - protein, 9 aa, Homo Sapiens
VWGLLPSQY

SEQ ID NO: 301011 - protein, 9 aa, Homo Sapiens
YMTFTLISV

SEQ ID NO: 301012 - protein, 9 aa, Homo Sapiens
GRFYPLYKQ

SEQ ID NO: 301013 - protein, 9 aa, Homo Sapiens
VKIGGIGAL

SEQ ID NO: 301014 - protein, 9 aa, Homo Sapiens
LFTTGENAR

SEQ ID NO: 301015 - protein, 9 aa, Homo Sapiens
KVLKDVVNN

SEQ ID NO: 301016 - protein, 9 aa, Homo Sapiens
REVSIMYPG

SEQ ID NO: 301017 - protein, 9 aa, Homo Sapiens
LAQHWIIHT

SEQ ID NO: 301018 - protein, 9 aa, Homo Sapiens
VESVESCDI

SEQ ID NO: 301019 - protein, 9 aa, Homo Sapiens
GSTVMFEIM

SEQ ID NO: 301020 - protein, 9 aa, Homo Sapiens
SLNSFSMSA

SEQ ID NO: 301021 - protein, 9 aa, Homo Sapiens
LAPSQINLY

SEQ ID NO: 301022 - protein, 9 aa, Homo Sapiens
KMVSSTSSE

SEQ ID NO: 301023 - protein, 9 aa, Homo Sapiens
GAGIAEHLS

SEQ ID NO: 301024 - protein, 9 aa, Homo Sapiens
LMRHQIIHT

SEQ ID NO: 301025 - protein, 9 aa, Homo Sapiens
GYKDTDGEE

SEQ ID NO: 301026 - protein, 9 aa, Homo Sapiens
SGWQIAYIM

SEQ ID NO: 301027 - protein, 9 aa, Homo Sapiens
RRMFPLLSF

SEQ ID NO: 301028 - protein, 9 aa, Homo Sapiens
MEQEKKLLA

SEQ ID NO: 301029 - protein, 9 aa, Homo Sapiens
LESAVDTAT

SEQ ID NO: 301030 - protein, 9 aa, Homo Sapiens
ASPYTRCKG

SEQ ID NO: 301031 - protein, 9 aa, Homo Sapiens
ITAIAVKVN

SEQ ID NO: 301032 - protein, 9 aa, Homo Sapiens
VEDIRRVRA

SEQ ID NO: 301033 - protein, 9 aa, Homo Sapiens
MLCRSETVV

SEQ ID NO: 301034 - protein, 9 aa, Homo Sapiens
INSHNFCED

SEQ ID NO: 301035 - protein, 9 aa, Homo Sapiens
GISLKRVTV

SEQ ID NO: 301036 - protein, 9 aa, Homo Sapiens
DHSKHGLSV

SEQ ID NO: 301037 - protein, 9 aa, Homo Sapiens
QAFVQKTHL

SEQ ID NO: 301038 - protein, 9 aa, Homo Sapiens
VGLACEAVN

SEQ ID NO: 301039 - protein, 9 aa, Homo Sapiens
AFVAKVVTL

SEQ ID NO: 301040 - protein, 9 aa, Homo Sapiens
HLNHYISDT

SEQ ID NO: 301041 - protein, 9 aa, Homo Sapiens
KNEKREDVL

SEQ ID NO: 301042 - protein, 9 aa, Homo Sapiens
SSRGDNLVH

SEQ ID NO: 301043 - protein, 9 aa, Homo Sapiens
AIFISNYMR

SEQ ID NO: 301044 - protein, 9 aa, Homo Sapiens
RLSQKVLQS

SEQ ID NO: 301045 - protein, 9 aa, Homo Sapiens
TYGQISNGE

SEQ ID NO: 301046 - protein, 9 aa, Homo Sapiens
YQCNMCGKC

SEQ ID NO: 301047 - protein, 9 aa, Homo Sapiens
CGRQLDKVP

SEQ ID NO: 301048 - protein, 9 aa, Homo Sapiens
AKGLYWTLN

SEQ ID NO: 301049 - protein, 9 aa, Homo Sapiens
KFVDIIDAV

SEQ ID NO: 301050 - protein, 9 aa, Homo Sapiens
DCMLLKEFL

SEQ ID NO: 301051 - protein, 9 aa, Homo Sapiens
QIIVQGRET

SEQ ID NO: 301052 - protein, 9 aa, Homo Sapiens
IALQDRTQF

SEQ ID NO: 301053 - protein, 9 aa, Homo Sapiens
NNLVRLTLE

SEQ ID NO: 301054 - protein, 9 aa, Homo Sapiens
VGRFKNQKD

SEQ ID NO: 301055 - protein, 9 aa, Homo Sapiens
CSQDAGELV

SEQ ID NO: 301056 - protein, 9 aa, Homo Sapiens
DLIKTEDEY

SEQ ID NO: 301057 - protein, 9 aa, Homo Sapiens
PLAVKRQKE

SEQ ID NO: 301058 - protein, 9 aa, Homo Sapiens
ANQTVPDQS

SEQ ID NO: 301059 - protein, 9 aa, Homo Sapiens
IWFQNWRAK

SEQ ID NO: 301060 - protein, 9 aa, Homo Sapiens
WALKTIEAL

SEQ ID NO: 301061 - protein, 9 aa, Homo Sapiens
RIAFLQGEI

SEQ ID NO: 301062 - protein, 9 aa, Homo Sapiens
LIEIKTKKK

SEQ ID NO: 301063 - protein, 9 aa, Homo Sapiens
CTVAATLVS

SEQ ID NO: 301064 - protein, 9 aa, Homo Sapiens
LLYELEEST

SEQ ID NO: 301065 - protein, 9 aa, Homo Sapiens
TGKCSELLL

SEQ ID NO: 301066 - protein, 9 aa, Homo Sapiens
AVDVTFSRK

SEQ ID NO: 301067 - protein, 9 aa, Homo Sapiens
DRINDDLSS

SEQ ID NO: 301068 - protein, 9 aa, Homo Sapiens
KVTYKSLTS

SEQ ID NO: 301069 - protein, 9 aa, Homo Sapiens
ADMETLVRE

SEQ ID NO: 301070 - protein, 9 aa, Homo Sapiens
DKPRGTLAS

SEQ ID NO: 301071 - protein, 9 aa, Homo Sapiens
KWCKNSYSS

SEQ ID NO: 301072 - protein, 9 aa, Homo Sapiens
QVGKDLSLV

SEQ ID NO: 301073 - protein, 9 aa, Homo Sapiens
HLQNELRET

SEQ ID NO: 301074 - protein, 9 aa, Homo Sapiens
LVSGLVLSH

SEQ ID NO: 301075 - protein, 9 aa, Homo Sapiens
KDVLDIEQL

SEQ ID NO: 301076 - protein, 9 aa, Homo Sapiens
RKCTQDTSF

SEQ ID NO: 301077 - protein, 9 aa, Homo Sapiens
AVQYISLGI

SEQ ID NO: 301078 - protein, 9 aa, Homo Sapiens
KTTLIKRDP

SEQ ID NO: 301079 - protein, 9 aa, Homo Sapiens
LLVSSVPVT

SEQ ID NO: 301080 - protein, 9 aa, Homo Sapiens
LNTKVTQQD

SEQ ID NO: 301081 - protein, 9 aa, Homo Sapiens
MGPLDFRDV

SEQ ID NO: 301082 - protein, 9 aa, Homo Sapiens
DDADIVHHC

SEQ ID NO: 301083 - protein, 9 aa, Homo Sapiens
AFVRASSCR

SEQ ID NO: 301084 - protein, 9 aa, Homo Sapiens
TQNSNLANH

SEQ ID NO: 301085 - protein, 9 aa, Homo Sapiens
IDDDNKTDK

SEQ ID NO: 301086 - protein, 9 aa, Homo Sapiens
FDEMKKKFV

SEQ ID NO: 301087 - protein, 9 aa, Homo Sapiens
NRVKKKMTE

SEQ ID NO: 301088 - protein, 9 aa, Homo Sapiens
CSGGTSTGA

SEQ ID NO: 301089 - protein, 9 aa, Homo Sapiens
LSQNPMLLE

SEQ ID NO: 301090 - protein, 9 aa, Homo Sapiens
RDSVCSIQK

SEQ ID NO: 301091 - protein, 9 aa, Homo Sapiens
AAPKCALYE

SEQ ID NO: 301092 - protein, 9 aa, Homo Sapiens
PPLYGDELG

SEQ ID NO: 301093 - protein, 9 aa, Homo Sapiens
CLTQHQITH

SEQ ID NO: 301094 - protein, 9 aa, Homo Sapiens
KIIETMTMT

SEQ ID NO: 301095 - protein, 9 aa, Homo Sapiens
LEKLPDVCY

SEQ ID NO: 301096 - protein, 9 aa, Homo Sapiens
KCNDCGNFF

SEQ ID NO: 301097 - protein, 9 aa, Homo Sapiens
LHPSHRNWI

SEQ ID NO: 301098 - protein, 9 aa, Homo Sapiens
DLLFLSTGH

SEQ ID NO: 301099 - protein, 9 aa, Homo Sapiens
RDLSSLRTS

SEQ ID NO: 301100 - protein, 9 aa, Homo Sapiens
GDSCILECK

SEQ ID NO: 301101 - protein, 9 aa, Homo Sapiens
PQRKYALKA

SEQ ID NO: 301102 - protein, 9 aa, Homo Sapiens
LVCALFVAL

SEQ ID NO: 301103 - protein, 9 aa, Homo Sapiens
STKDNVSLN

SEQ ID NO: 301104 - protein, 9 aa, Homo Sapiens
SKFQVPHAS

SEQ ID NO: 301105 - protein, 9 aa, Homo Sapiens
RQASISCVQ

SEQ ID NO: 301106 - protein, 9 aa, Homo Sapiens
SGSCNSILE

SEQ ID NO: 301107 - protein, 9 aa, Homo Sapiens
ELSNNYGMS

SEQ ID NO: 301108 - protein, 9 aa, Homo Sapiens
KELQAQQIL

SEQ ID NO: 301109 - protein, 9 aa, Homo Sapiens
QHQISEDVV

SEQ ID NO: 301110 - protein, 9 aa, Homo Sapiens
PKGGFDAIM

SEQ ID NO: 301111 - protein, 9 aa, Homo Sapiens
DDEELTDDS

SEQ ID NO: 301112 - protein, 9 aa, Homo Sapiens
ISKALQRKS

SEQ ID NO: 301113 - protein, 9 aa, Homo Sapiens
TAHQIIHTE

SEQ ID NO: 301114 - protein, 9 aa, Homo Sapiens
SLDSDSLLK

SEQ ID NO: 301115 - protein, 9 aa, Homo Sapiens
SSVPTPLPI

SEQ ID NO: 301116 - protein, 9 aa, Homo Sapiens
QTLSRVEFL

SEQ ID NO: 301117 - protein, 9 aa, Homo Sapiens
LHTPATAAG

SEQ ID NO: 301118 - protein, 9 aa, Homo Sapiens
SSPGAPMGV

SEQ ID NO: 301119 - protein, 9 aa, Homo Sapiens
KRSRANQKS

SEQ ID NO: 301120 - protein, 9 aa, Homo Sapiens
DGKEFELCI

SEQ ID NO: 301121 - protein, 9 aa, Homo Sapiens
CSTDFWGRF

SEQ ID NO: 301122 - protein, 9 aa, Homo Sapiens
IILKELENL

SEQ ID NO: 301123 - protein, 9 aa, Homo Sapiens
NGNQQEQEQ

SEQ ID NO: 301124 - protein, 9 aa, Homo Sapiens
PGDQVTGTL

SEQ ID NO: 301125 - protein, 9 aa, Homo Sapiens
QNHKHHDTF

SEQ ID NO: 301126 - protein, 9 aa, Homo Sapiens
VPTISHPMG

SEQ ID NO: 301127 - protein, 9 aa, Homo Sapiens
NLARHHILH

SEQ ID NO: 301128 - protein, 9 aa, Homo Sapiens
NTVQGQLRE

SEQ ID NO: 301129 - protein, 9 aa, Homo Sapiens
LHSRTIVHT

SEQ ID NO: 301130 - protein, 9 aa, Homo Sapiens
PNLYNNDFD

SEQ ID NO: 301131 - protein, 9 aa, Homo Sapiens
NPQLQMASP

SEQ ID NO: 301132 - protein, 9 aa, Homo Sapiens
SDQASEEIW

SEQ ID NO: 301133 - protein, 9 aa, Homo Sapiens
YQIIQYIPV

SEQ ID NO: 301134 - protein, 9 aa, Homo Sapiens
RRKAGYNKK

SEQ ID NO: 301135 - protein, 9 aa, Homo Sapiens
FTVVGNLSL

SEQ ID NO: 301136 - protein, 9 aa, Homo Sapiens
IANHMRSED

SEQ ID NO: 301137 - protein, 9 aa, Homo Sapiens
PLLGMYMFR

SEQ ID NO: 301138 - protein, 9 aa, Homo Sapiens
YPYYTHCIW

SEQ ID NO: 301139 - protein, 9 aa, Homo Sapiens
GLTATRSGD

SEQ ID NO: 301140 - protein, 9 aa, Homo Sapiens
LKNSHGWQK

SEQ ID NO: 301141 - protein, 9 aa, Homo Sapiens
HIFVKICME

SEQ ID NO: 301142 - protein, 9 aa, Homo Sapiens
YRVRRKCPL

SEQ ID NO: 301143 - protein, 9 aa, Homo Sapiens
MGDALPVSC

SEQ ID NO: 301144 - protein, 9 aa, Homo Sapiens
LVCTGSDNG

SEQ ID NO: 301145 - protein, 9 aa, Homo Sapiens
CSAQDRTAL

SEQ ID NO: 301146 - protein, 9 aa, Homo Sapiens
ESVRNDSNK

SEQ ID NO: 301147 - protein, 9 aa, Homo Sapiens
GKGKQLEDK

SEQ ID NO: 301148 - protein, 9 aa, Homo Sapiens
AIGKPGYLN

SEQ ID NO: 301149 - protein, 9 aa, Homo Sapiens
DSYRESICH

SEQ ID NO: 301150 - protein, 9 aa, Homo Sapiens
KDKDKDRER

SEQ ID NO: 301151 - protein, 9 aa, Homo Sapiens
SIIKIPHLD

SEQ ID NO: 301152 - protein, 9 aa, Homo Sapiens
VNKDLNSQV

SEQ ID NO: 301153 - protein, 9 aa, Homo Sapiens
ASEARGEAG

SEQ ID NO: 301154 - protein, 9 aa, Homo Sapiens
VLYDTFVCE

SEQ ID NO: 301155 - protein, 9 aa, Homo Sapiens
IGFFREETD

SEQ ID NO: 301156 - protein, 9 aa, Homo Sapiens
DKDTKIIHM

SEQ ID NO: 301157 - protein, 9 aa, Homo Sapiens
YFCAHTPLN

SEQ ID NO: 301158 - protein, 9 aa, Homo Sapiens
MKADLESES

SEQ ID NO: 301159 - protein, 9 aa, Homo Sapiens
MKDVIGDRS

SEQ ID NO: 301160 - protein, 9 aa, Homo Sapiens
SLTKHKNIH

SEQ ID NO: 301161 - protein, 9 aa, Homo Sapiens
FEIPTYNIR

SEQ ID NO: 301162 - protein, 9 aa, Homo Sapiens
LLEHHTRSI

SEQ ID NO: 301163 - protein, 9 aa, Homo Sapiens
ESQGLSFIS

SEQ ID NO: 301164 - protein, 9 aa, Homo Sapiens
QLENEFQME

SEQ ID NO: 301165 - protein, 9 aa, Homo Sapiens
QGKTSDHLL

SEQ ID NO: 301166 - protein, 9 aa, Homo Sapiens
AIRRFAAYN

SEQ ID NO: 301167 - protein, 9 aa, Homo Sapiens
MIRELPKSQ

SEQ ID NO: 301168 - protein, 9 aa, Homo Sapiens
CENVTTCWR

SEQ ID NO: 301169 - protein, 9 aa, Homo Sapiens
SDEDKMKED

SEQ ID NO: 301170 - protein, 9 aa, Homo Sapiens
SIARLFTNL

SEQ ID NO: 301171 - protein, 9 aa, Homo Sapiens
IAQLRVFGT

SEQ ID NO: 301172 - protein, 9 aa, Homo Sapiens
KLKESSAKL

SEQ ID NO: 301173 - protein, 9 aa, Homo Sapiens
QLPTPTSSV

SEQ ID NO: 301174 - protein, 9 aa, Homo Sapiens
HVFCQYLFR

SEQ ID NO: 301175 - protein, 9 aa, Homo Sapiens
PLGLLYEYL

SEQ ID NO: 301176 - protein, 9 aa, Homo Sapiens
SQHLQNFFF

SEQ ID NO: 301177 - protein, 9 aa, Homo Sapiens
LDFISIAVG

SEQ ID NO: 301178 - protein, 9 aa, Homo Sapiens
GLCYHYCFA

SEQ ID NO: 301179 - protein, 9 aa, Homo Sapiens
EIMVPNYFS

SEQ ID NO: 301180 - protein, 9 aa, Homo Sapiens
KSRVQMRGK

SEQ ID NO: 301181 - protein, 9 aa, Homo Sapiens
CPVCPDKQD

SEQ ID NO: 301182 - protein, 9 aa, Homo Sapiens
KKNRLSLTF

SEQ ID NO: 301183 - protein, 9 aa, Homo Sapiens
DLEGVIDLS

SEQ ID NO: 301184 - protein, 9 aa, Homo Sapiens
SPPKAETTK

SEQ ID NO: 301185 - protein, 9 aa, Homo Sapiens
NLRKKELNN

SEQ ID NO: 301186 - protein, 9 aa, Homo Sapiens
LSRYYKWNG

SEQ ID NO: 301187 - protein, 9 aa, Homo Sapiens
QDHEIALAN

SEQ ID NO: 301188 - protein, 9 aa, Homo Sapiens
LYVHRIIHT

SEQ ID NO: 301189 - protein, 9 aa, Homo Sapiens
ELGCDRQSK

SEQ ID NO: 301190 - protein, 9 aa, Homo Sapiens
QGIYSIYED

SEQ ID NO: 301191 - protein, 9 aa, Homo Sapiens
FTIERLYLP

SEQ ID NO: 301192 - protein, 9 aa, Homo Sapiens
QPDGLSDIT

SEQ ID NO: 301193 - protein, 9 aa, Homo Sapiens
CGAACGVTC

SEQ ID NO: 301194 - protein, 9 aa, Homo Sapiens
PITDLKSYA

SEQ ID NO: 301195 - protein, 9 aa, Homo Sapiens
HVYNIKLPA

SEQ ID NO: 301196 - protein, 9 aa, Homo Sapiens
TLTNHKEIN

SEQ ID NO: 301197 - protein, 9 aa, Homo Sapiens
EKSTLESGL

SEQ ID NO: 301198 - protein, 9 aa, Homo Sapiens
TRLQAVSDG

SEQ ID NO: 301199 - protein, 9 aa, Homo Sapiens
HNNQIEAQE

SEQ ID NO: 301200 - protein, 9 aa, Homo Sapiens
YHQIIHTGE

SEQ ID NO: 301201 - protein, 9 aa, Homo Sapiens
TDVLCSAAK

SEQ ID NO: 301202 - protein, 9 aa, Homo Sapiens
VTNKVIKIV

SEQ ID NO: 301203 - protein, 9 aa, Homo Sapiens
IKNASLRKE

SEQ ID NO: 301204 - protein, 9 aa, Homo Sapiens
SSSSPSKID

SEQ ID NO: 301205 - protein, 9 aa, Homo Sapiens
MGCKKVMDV

SEQ ID NO: 301206 - protein, 9 aa, Homo Sapiens
EHIRCQQEA

SEQ ID NO: 301207 - protein, 9 aa, Homo Sapiens
FAQLNLKIT

SEQ ID NO: 301208 - protein, 9 aa, Homo Sapiens
YCQKCLIEA

SEQ ID NO: 301209 - protein, 9 aa, Homo Sapiens
QTKVLSSKL

SEQ ID NO: 301210 - protein, 9 aa, Homo Sapiens
CSSDSPQWL

SEQ ID NO: 301211 - protein, 9 aa, Homo Sapiens
NNSQMCQKS

SEQ ID NO: 301212 - protein, 9 aa, Homo Sapiens
VSKRRGSQD

SEQ ID NO: 301213 - protein, 9 aa, Homo Sapiens
VFMANQTSV

SEQ ID NO: 301214 - protein, 9 aa, Homo Sapiens
DVLDIEQLS

SEQ ID NO: 301215 - protein, 9 aa, Homo Sapiens
AIKDSRGIA

SEQ ID NO: 301216 - protein, 9 aa, Homo Sapiens
SAGLEWLAQ

SEQ ID NO: 301217 - protein, 9 aa, Homo Sapiens
GVFELIPQD

SEQ ID NO: 301218 - protein, 9 aa, Homo Sapiens
LDTKYKSLV

SEQ ID NO: 301219 - protein, 9 aa, Homo Sapiens
DPAKIITLR

SEQ ID NO: 301220 - protein, 9 aa, Homo Sapiens
RSSTSTSET

SEQ ID NO: 301221 - protein, 9 aa, Homo Sapiens
HDALHHLSC

SEQ ID NO: 301222 - protein, 9 aa, Homo Sapiens
TFNHLIEMD

SEQ ID NO: 301223 - protein, 9 aa, Homo Sapiens
DTTATADAK

SEQ ID NO: 301224 - protein, 9 aa, Homo Sapiens
ICLAIDDDN

SEQ ID NO: 301225 - protein, 9 aa, Homo Sapiens
GDHHHDNHC

SEQ ID NO: 301226 - protein, 9 aa, Homo Sapiens
NVAPQLDLS

SEQ ID NO: 301227 - protein, 9 aa, Homo Sapiens
SFASIKNNK

SEQ ID NO: 301228 - protein, 9 aa, Homo Sapiens
VWDLEPNTD

SEQ ID NO: 301229 - protein, 9 aa, Homo Sapiens
LIQALLDSE

SEQ ID NO: 301230 - protein, 9 aa, Homo Sapiens
MINVYPPRG

SEQ ID NO: 301231 - protein, 9 aa, Homo Sapiens
EKGKKINKR

SEQ ID NO: 301232 - protein, 9 aa, Homo Sapiens
REPSIHHFV

SEQ ID NO: 301233 - protein, 9 aa, Homo Sapiens
LFVNRPNKK

SEQ ID NO: 301234 - protein, 9 aa, Homo Sapiens
DKHKIIFCQ

SEQ ID NO: 301235 - protein, 9 aa, Homo Sapiens
HAWTHRLRD

SEQ ID NO: 301236 - protein, 9 aa, Homo Sapiens
DQRTQTKSG

SEQ ID NO: 301237 - protein, 9 aa, Homo Sapiens
IKLSMKNNI

SEQ ID NO: 301238 - protein, 9 aa, Homo Sapiens
QPIIVEVKK

SEQ ID NO: 301239 - protein, 9 aa, Homo Sapiens
GETKFNKLF

SEQ ID NO: 301240 - protein, 9 aa, Homo Sapiens
IDNKVCNRY

SEQ ID NO: 301241 - protein, 9 aa, Homo Sapiens
CPEINESLS

SEQ ID NO: 301242 - protein, 9 aa, Homo Sapiens
HKLLQIETA

SEQ ID NO: 301243 - protein, 9 aa, Homo Sapiens
HMHNQFVVY

SEQ ID NO: 301244 - protein, 9 aa, Homo Sapiens
DLFTSLGLL

SEQ ID NO: 301245 - protein, 9 aa, Homo Sapiens
RSVVECSNL

SEQ ID NO: 301246 - protein, 9 aa, Homo Sapiens
EKISELHNY

SEQ ID NO: 301247 - protein, 9 aa, Homo Sapiens
MAYDHYLAI

SEQ ID NO: 301248 - protein, 9 aa, Homo Sapiens
LDPDAPIIK

SEQ ID NO: 301249 - protein, 9 aa, Homo Sapiens
SEKNYPKNM

SEQ ID NO: 301250 - protein, 9 aa, Homo Sapiens
EQSYKYNEC

SEQ ID NO: 301251 - protein, 9 aa, Homo Sapiens
QQMVMAQLL

SEQ ID NO: 301252 - protein, 9 aa, Homo Sapiens
NLFTKIGNI

SEQ ID NO: 301253 - protein, 9 aa, Homo Sapiens
RGHDFHEGI

SEQ ID NO: 301254 - protein, 9 aa, Homo Sapiens
AKVNTGDKN

SEQ ID NO: 301255 - protein, 9 aa, Homo Sapiens
LTQLGPQPG

SEQ ID NO: 301256 - protein, 9 aa, Homo Sapiens
LPSGEVIET

SEQ ID NO: 301257 - protein, 9 aa, Homo Sapiens
RTMYQVLRR

SEQ ID NO: 301258 - protein, 9 aa, Homo Sapiens
DIKENLQAQ

SEQ ID NO: 301259 - protein, 9 aa, Homo Sapiens
ATNNKGKET

SEQ ID NO: 301260 - protein, 9 aa, Homo Sapiens
AKDKKSSSK

SEQ ID NO: 301261 - protein, 9 aa, Homo Sapiens
TSKVIKKFP

SEQ ID NO: 301262 - protein, 9 aa, Homo Sapiens
WAVFQNEDR

SEQ ID NO: 301263 - protein, 9 aa, Homo Sapiens
TLLYAMVTP

SEQ ID NO: 301264 - protein, 9 aa, Homo Sapiens
ANTLGMEES

SEQ ID NO: 301265 - protein, 9 aa, Homo Sapiens
GEEVWNPQK

SEQ ID NO: 301266 - protein, 9 aa, Homo Sapiens
TLWEDGAMC

SEQ ID NO: 301267 - protein, 9 aa, Homo Sapiens
PKVPQQTHR

SEQ ID NO: 301268 - protein, 9 aa, Homo Sapiens
QKVINTPEI

SEQ ID NO: 301269 - protein, 9 aa, Homo Sapiens
YSTAAKVSK

SEQ ID NO: 301270 - protein, 9 aa, Homo Sapiens
SPSELNLKG

SEQ ID NO: 301271 - protein, 9 aa, Homo Sapiens
YYTHCIWRV

SEQ ID NO: 301272 - protein, 9 aa, Homo Sapiens
TEAQYQFIY

SEQ ID NO: 301273 - protein, 9 aa, Homo Sapiens
FKPDVISSL

SEQ ID NO: 301274 - protein, 9 aa, Homo Sapiens
GCDRQSKEQ

SEQ ID NO: 301275 - protein, 9 aa, Homo Sapiens
QEYKEDPKR

SEQ ID NO: 301276 - protein, 9 aa, Homo Sapiens
EAHFLPFKK

SEQ ID NO: 301277 - protein, 9 aa, Homo Sapiens
TFDVGNFNA

SEQ ID NO: 301278 - protein, 9 aa, Homo Sapiens
NGNDVNLQD

SEQ ID NO: 301279 - protein, 9 aa, Homo Sapiens
NQARLYDTA

SEQ ID NO: 301280 - protein, 9 aa, Homo Sapiens
DIETILHTL

SEQ ID NO: 301281 - protein, 9 aa, Homo Sapiens
TIIQMDLHL

SEQ ID NO: 301282 - protein, 9 aa, Homo Sapiens
KTKPQRDSQ

SEQ ID NO: 301283 - protein, 9 aa, Homo Sapiens
EYMTFTLIS

SEQ ID NO: 301284 - protein, 9 aa, Homo Sapiens
FSGCFLQLY

SEQ ID NO: 301285 - protein, 9 aa, Homo Sapiens
GGQIITSTG

SEQ ID NO: 301286 - protein, 9 aa, Homo Sapiens
YSAPVPPNA

SEQ ID NO: 301287 - protein, 9 aa, Homo Sapiens
ARLCDLKSR

SEQ ID NO: 301288 - protein, 9 aa, Homo Sapiens
SKERQGVLR

SEQ ID NO: 301289 - protein, 9 aa, Homo Sapiens
HSKRKDSQT

SEQ ID NO: 301290 - protein, 9 aa, Homo Sapiens
LKALYGNAV

SEQ ID NO: 301291 - protein, 9 aa, Homo Sapiens
VNNIKKNED

SEQ ID NO: 301292 - protein, 9 aa, Homo Sapiens
NGGRCLIEK

SEQ ID NO: 301293 - protein, 9 aa, Homo Sapiens
NSILGTNEH

SEQ ID NO: 301294 - protein, 9 aa, Homo Sapiens
LLCCRTPVS

SEQ ID NO: 301295 - protein, 9 aa, Homo Sapiens
EFKKVLGEK

SEQ ID NO: 301296 - protein, 9 aa, Homo Sapiens
HHTRSIPKD

SEQ ID NO: 301297 - protein, 9 aa, Homo Sapiens
LNVDHLSCT

SEQ ID NO: 301298 - protein, 9 aa, Homo Sapiens
LLFMYVQTK

SEQ ID NO: 301299 - protein, 9 aa, Homo Sapiens
WWAPNVQHL

SEQ ID NO: 301300 - protein, 9 aa, Homo Sapiens
IQELQHKRA

SEQ ID NO: 301301 - protein, 9 aa, Homo Sapiens
TVADTNFSF

SEQ ID NO: 301302 - protein, 9 aa, Homo Sapiens
VKHREQHHP

SEQ ID NO: 301303 - protein, 9 aa, Homo Sapiens
VATEYMTFT

SEQ ID NO: 301304 - protein, 9 aa, Homo Sapiens
VRINHLVHL

SEQ ID NO: 301305 - protein, 9 aa, Homo Sapiens
YRQLDDEIK

SEQ ID NO: 301306 - protein, 9 aa, Homo Sapiens
MATYDLPAT

SEQ ID NO: 301307 - protein, 9 aa, Homo Sapiens
VNCPSQTCR

SEQ ID NO: 301308 - protein, 9 aa, Homo Sapiens
TGERPHTCK

SEQ ID NO: 301309 - protein, 9 aa, Homo Sapiens
LVTIQENNP

SEQ ID NO: 301310 - protein, 9 aa, Homo Sapiens
LWHLKSFFQ

SEQ ID NO: 301311 - protein, 9 aa, Homo Sapiens
QRLCQQLVG

SEQ ID NO: 301312 - protein, 9 aa, Homo Sapiens
AGVAYGHFP

SEQ ID NO: 301313 - protein, 9 aa, Homo Sapiens
AKDLLLDLN

SEQ ID NO: 301314 - protein, 9 aa, Homo Sapiens
YYTCCDLVV

SEQ ID NO: 301315 - protein, 9 aa, Homo Sapiens
DLAHLCLYN

SEQ ID NO: 301316 - protein, 9 aa, Homo Sapiens
NFRYATYYK

SEQ ID NO: 301317 - protein, 9 aa, Homo Sapiens
KMMNEKAWK

SEQ ID NO: 301318 - protein, 9 aa, Homo Sapiens
VPESLNKDK

SEQ ID NO: 301319 - protein, 9 aa, Homo Sapiens
GMTYCENTL

SEQ ID NO: 301320 - protein, 9 aa, Homo Sapiens
VTDVLCSAA

SEQ ID NO: 301321 - protein, 9 aa, Homo Sapiens
LFVKLPEII

SEQ ID NO: 301322 - protein, 9 aa, Homo Sapiens
PQKREINIT

SEQ ID NO: 301323 - protein, 9 aa, Homo Sapiens
QASISCVQG

SEQ ID NO: 301324 - protein, 9 aa, Homo Sapiens
QAGWEMFWA

SEQ ID NO: 301325 - protein, 9 aa, Homo Sapiens
SSSFVLPCF

SEQ ID NO: 301326 - protein, 9 aa, Homo Sapiens
DMWSSKERQ

SEQ ID NO: 301327 - protein, 9 aa, Homo Sapiens
YSISAALED

SEQ ID NO: 301328 - protein, 9 aa, Homo Sapiens
YKNVNRTKE

SEQ ID NO: 301329 - protein, 9 aa, Homo Sapiens
QAGHHHPDK

SEQ ID NO: 301330 - protein, 9 aa, Homo Sapiens
DLCEVFSRY

SEQ ID NO: 301331 - protein, 9 aa, Homo Sapiens
HRTMLTFSS

SEQ ID NO: 301332 - protein, 9 aa, Homo Sapiens
LLYAMVTPL

SEQ ID NO: 301333 - protein, 9 aa, Homo Sapiens
VKRTELLPG

SEQ ID NO: 301334 - protein, 9 aa, Homo Sapiens
QEKGKVWVE

SEQ ID NO: 301335 - protein, 9 aa, Homo Sapiens
DCELDKAVQ

SEQ ID NO: 301336 - protein, 9 aa, Homo Sapiens
IMLVLPHDP

SEQ ID NO: 301337 - protein, 9 aa, Homo Sapiens
MMNEKAWKR

SEQ ID NO: 301338 - protein, 9 aa, Homo Sapiens
TAKEEQEEV

SEQ ID NO: 301339 - protein, 9 aa, Homo Sapiens
ICCTDKLYE

SEQ ID NO: 301340 - protein, 9 aa, Homo Sapiens
RARRSPQKL

SEQ ID NO: 301341 - protein, 9 aa, Homo Sapiens
LYVNRTPMY

SEQ ID NO: 301342 - protein, 9 aa, Homo Sapiens
TDISSKSFI

SEQ ID NO: 301343 - protein, 9 aa, Homo Sapiens
HILHAGEKP

SEQ ID NO: 301344 - protein, 9 aa, Homo Sapiens
ILQNTAPAQ

SEQ ID NO: 301345 - protein, 9 aa, Homo Sapiens
SKITWILKD

SEQ ID NO: 301346 - protein, 9 aa, Homo Sapiens
VILKGLEVL

SEQ ID NO: 301347 - protein, 9 aa, Homo Sapiens
KNQAEVYVF

SEQ ID NO: 301348 - protein, 9 aa, Homo Sapiens
KPAIYKRAE

SEQ ID NO: 301349 - protein, 9 aa, Homo Sapiens
ATEIRNKVK

SEQ ID NO: 301350 - protein, 9 aa, Homo Sapiens
SPLRTASSY

SEQ ID NO: 301351 - protein, 9 aa, Homo Sapiens
CCVTYCEGD

SEQ ID NO: 301352 - protein, 9 aa, Homo Sapiens
DATSLGSQK

SEQ ID NO: 301353 - protein, 9 aa, Homo Sapiens
SRKIQCVQN

SEQ ID NO: 301354 - protein, 9 aa, Homo Sapiens
GWQIAYIMW

SEQ ID NO: 301355 - protein, 9 aa, Homo Sapiens
RTVLAMDLM

SEQ ID NO: 301356 - protein, 9 aa, Homo Sapiens
VFNFIGPQV

SEQ ID NO: 301357 - protein, 9 aa, Homo Sapiens
FEAEDTIGQ

SEQ ID NO: 301358 - protein, 9 aa, Homo Sapiens
LNENSTPDK

SEQ ID NO: 301359 - protein, 9 aa, Homo Sapiens
SLLDEPNPT

SEQ ID NO: 301360 - protein, 9 aa, Homo Sapiens
VELFSPRRK

SEQ ID NO: 301361 - protein, 9 aa, Homo Sapiens
RVLLKRRRP

SEQ ID NO: 301362 - protein, 9 aa, Homo Sapiens
KVLDPSFES

SEQ ID NO: 301363 - protein, 9 aa, Homo Sapiens
KSAGYKVIH

SEQ ID NO: 301364 - protein, 9 aa, Homo Sapiens
LNNLNQLQI

SEQ ID NO: 301365 - protein, 9 aa, Homo Sapiens
HLYCDSLPL

SEQ ID NO: 301366 - protein, 9 aa, Homo Sapiens
LHMKRFVKY

SEQ ID NO: 301367 - protein, 9 aa, Homo Sapiens
PDKIQFEIN

SEQ ID NO: 301368 - protein, 9 aa, Homo Sapiens
KYASRSWKL

SEQ ID NO: 301369 - protein, 9 aa, Homo Sapiens
NSPVLLEYP

SEQ ID NO: 301370 - protein, 9 aa, Homo Sapiens
VYNLCSEIA

SEQ ID NO: 301371 - protein, 9 aa, Homo Sapiens
QLFESENFD

SEQ ID NO: 301372 - protein, 9 aa, Homo Sapiens
LNILEEDNH

SEQ ID NO: 301373 - protein, 9 aa, Homo Sapiens
VLPFRGIYG

SEQ ID NO: 301374 - protein, 9 aa, Homo Sapiens
AQILPTKEN

SEQ ID NO: 301375 - protein, 9 aa, Homo Sapiens
CPHFLKCLF

SEQ ID NO: 301376 - protein, 9 aa, Homo Sapiens
TVLAKVQIE

SEQ ID NO: 301377 - protein, 9 aa, Homo Sapiens
ELFSPRRKR

SEQ ID NO: 301378 - protein, 9 aa, Homo Sapiens
LNRVCWAQA

SEQ ID NO: 301379 - protein, 9 aa, Homo Sapiens
PKCLQDLSS

SEQ ID NO: 301380 - protein, 9 aa, Homo Sapiens
WICMTWFIL

SEQ ID NO: 301381 - protein, 9 aa, Homo Sapiens
QAFPISHIH

SEQ ID NO: 301382 - protein, 9 aa, Homo Sapiens
YKSKILRLP

SEQ ID NO: 301383 - protein, 9 aa, Homo Sapiens
KRLPGKWIL

SEQ ID NO: 301384 - protein, 9 aa, Homo Sapiens
VLPIGLCSL

SEQ ID NO: 301385 - protein, 9 aa, Homo Sapiens
GHQQIIHTR

SEQ ID NO: 301386 - protein, 9 aa, Homo Sapiens
PSGPGGIAL

SEQ ID NO: 301387 - protein, 9 aa, Homo Sapiens
VDYLVEKLV

SEQ ID NO: 301388 - protein, 9 aa, Homo Sapiens
LSQDSSTTT

SEQ ID NO: 301389 - protein, 9 aa, Homo Sapiens
KTAEEKDKL

SEQ ID NO: 301390 - protein, 9 aa, Homo Sapiens
LAFICLQCW

SEQ ID NO: 301391 - protein, 9 aa, Homo Sapiens
ILHTLIYDG

SEQ ID NO: 301392 - protein, 9 aa, Homo Sapiens
FAYAQLGFI

SEQ ID NO: 301393 - protein, 9 aa, Homo Sapiens
SANFNWAKS

SEQ ID NO: 301394 - protein, 9 aa, Homo Sapiens
CRRLNTVNK

SEQ ID NO: 301395 - protein, 9 aa, Homo Sapiens
LKSYASAFS

SEQ ID NO: 301396 - protein, 9 aa, Homo Sapiens
DESINAFRE

SEQ ID NO: 301397 - protein, 9 aa, Homo Sapiens
CRKGGPLTN

SEQ ID NO: 301398 - protein, 9 aa, Homo Sapiens
VDYSSSSPS

SEQ ID NO: 301399 - protein, 9 aa, Homo Sapiens
VRIFRADKS

SEQ ID NO: 301400 - protein, 9 aa, Homo Sapiens
PSFFQRDAS

SEQ ID NO: 301401 - protein, 9 aa, Homo Sapiens
LLGQLYKCH

SEQ ID NO: 301402 - protein, 9 aa, Homo Sapiens
EYIRPLPPP

SEQ ID NO: 301403 - protein, 9 aa, Homo Sapiens
SDTFNHLIE

SEQ ID NO: 301404 - protein, 9 aa, Homo Sapiens
GLFPQSIIG

SEQ ID NO: 301405 - protein, 9 aa, Homo Sapiens
VLEQLHQTV

SEQ ID NO: 301406 - protein, 9 aa, Homo Sapiens
GILDFISIA

SEQ ID NO: 301407 - protein, 9 aa, Homo Sapiens
KTAVKKLNG

SEQ ID NO: 301408 - protein, 9 aa, Homo Sapiens
RVLQLFLSQ

SEQ ID NO: 301409 - protein, 9 aa, Homo Sapiens
IIVLAKSMC

SEQ ID NO: 301410 - protein, 9 aa, Homo Sapiens
ADLEGVIDL

SEQ ID NO: 301411 - protein, 9 aa, Homo Sapiens
GEDFMLHKS

SEQ ID NO: 301412 - protein, 9 aa, Homo Sapiens
GDLDTDISW

SEQ ID NO: 301413 - protein, 9 aa, Homo Sapiens
QGQNGLEFN

SEQ ID NO: 301414 - protein, 9 aa, Homo Sapiens
QQQQSPVNK

SEQ ID NO: 301415 - protein, 9 aa, Homo Sapiens
VNSEEIMRL

SEQ ID NO: 301416 - protein, 9 aa, Homo Sapiens
NKSLDREEA

SEQ ID NO: 301417 - protein, 9 aa, Homo Sapiens
NRDLEKRAS

SEQ ID NO: 301418 - protein, 9 aa, Homo Sapiens
QLGCPINNL

SEQ ID NO: 301419 - protein, 9 aa, Homo Sapiens
LVALKEWGL

SEQ ID NO: 301420 - protein, 9 aa, Homo Sapiens
EIMRLLIEH

SEQ ID NO: 301421 - protein, 9 aa, Homo Sapiens
AQNLINDKQ

SEQ ID NO: 301422 - protein, 9 aa, Homo Sapiens
EEQLRDLIR

SEQ ID NO: 301423 - protein, 9 aa, Homo Sapiens
NIRLVQCYI

SEQ ID NO: 301424 - protein, 9 aa, Homo Sapiens
YDVPPVWGL

SEQ ID NO: 301425 - protein, 9 aa, Homo Sapiens
SDEDKAAEM

SEQ ID NO: 301426 - protein, 9 aa, Homo Sapiens
YKTEGSRGA

SEQ ID NO: 301427 - protein, 9 aa, Homo Sapiens
MTDKCTTDK

SEQ ID NO: 301428 - protein, 9 aa, Homo Sapiens
STVGHKNKE

SEQ ID NO: 301429 - protein, 9 aa, Homo Sapiens
DQVTGTLPS

SEQ ID NO: 301430 - protein, 9 aa, Homo Sapiens
LVSLGCFIF

SEQ ID NO: 301431 - protein, 9 aa, Homo Sapiens
SRQLFESEN

SEQ ID NO: 301432 - protein, 9 aa, Homo Sapiens
KISRSPSGS

SEQ ID NO: 301433 - protein, 9 aa, Homo Sapiens
AHDALHHLS

SEQ ID NO: 301434 - protein, 9 aa, Homo Sapiens
VPIKYSEVQ

SEQ ID NO: 301435 - protein, 9 aa, Homo Sapiens
ETQRELRKL

SEQ ID NO: 301436 - protein, 9 aa, Homo Sapiens
HLSRKIIYI

SEQ ID NO: 301437 - protein, 9 aa, Homo Sapiens
ELYENHCEV

SEQ ID NO: 301438 - protein, 9 aa, Homo Sapiens
VLDVEFLYN

SEQ ID NO: 301439 - protein, 9 aa, Homo Sapiens
CAFNVGSTT

SEQ ID NO: 301440 - protein, 9 aa, Homo Sapiens
KKQLDAQHM

SEQ ID NO: 301441 - protein, 9 aa, Homo Sapiens
FSVVQSYCG

SEQ ID NO: 301442 - protein, 9 aa, Homo Sapiens
GLSGDNLIT

SEQ ID NO: 301443 - protein, 9 aa, Homo Sapiens
ANILVTVLD

SEQ ID NO: 301444 - protein, 9 aa, Homo Sapiens
NIVSLVRSA

SEQ ID NO: 301445 - protein, 9 aa, Homo Sapiens
QNNVDSSPE

SEQ ID NO: 301446 - protein, 9 aa, Homo Sapiens
LCPAFPRLK

SEQ ID NO: 301447 - protein, 9 aa, Homo Sapiens
TATRSGDVV

SEQ ID NO: 301448 - protein, 9 aa, Homo Sapiens
LPSLNKLQK

SEQ ID NO: 301449 - protein, 9 aa, Homo Sapiens
EPVHFHPIY

SEQ ID NO: 301450 - protein, 9 aa, Homo Sapiens
PHICLKMII

SEQ ID NO: 301451 - protein, 9 aa, Homo Sapiens
YTVIMSQTV

SEQ ID NO: 301452 - protein, 9 aa, Homo Sapiens
KDEPPNDVF

SEQ ID NO: 301453 - protein, 9 aa, Homo Sapiens
NKTKSSKLD

SEQ ID NO: 301454 - protein, 9 aa, Homo Sapiens
FWCTFEGCG

SEQ ID NO: 301455 - protein, 9 aa, Homo Sapiens
DTHNILELK

SEQ ID NO: 301456 - protein, 9 aa, Homo Sapiens
LTNHKNIHT

SEQ ID NO: 301457 - protein, 9 aa, Homo Sapiens
RLLSERYVA

SEQ ID NO: 301458 - protein, 9 aa, Homo Sapiens
QLQKWYVPL

SEQ ID NO: 301459 - protein, 9 aa, Homo Sapiens
CDYCSLSHI

SEQ ID NO: 301460 - protein, 9 aa, Homo Sapiens
IIFCDLRLD

SEQ ID NO: 301461 - protein, 9 aa, Homo Sapiens
KLDKTIKAE

SEQ ID NO: 301462 - protein, 9 aa, Homo Sapiens
QASMGAVVS

SEQ ID NO: 301463 - protein, 9 aa, Homo Sapiens
DRKGGKIYF

SEQ ID NO: 301464 - protein, 9 aa, Homo Sapiens
NECISPQSR

SEQ ID NO: 301465 - protein, 9 aa, Homo Sapiens
NQGQSYEIQ

SEQ ID NO: 301466 - protein, 9 aa, Homo Sapiens
LITEKEDKR

SEQ ID NO: 301467 - protein, 9 aa, Homo Sapiens
VKYINDNPP

SEQ ID NO: 301468 - protein, 9 aa, Homo Sapiens
TYTEEDDVN

SEQ ID NO: 301469 - protein, 9 aa, Homo Sapiens
SQLIYPPLA

SEQ ID NO: 301470 - protein, 9 aa, Homo Sapiens
LPDLERVTS

SEQ ID NO: 301471 - protein, 9 aa, Homo Sapiens
VRLSRAEAI

SEQ ID NO: 301472 - protein, 9 aa, Homo Sapiens
PKGSKSKEK

SEQ ID NO: 301473 - protein, 9 aa, Homo Sapiens
ETITKMYET

SEQ ID NO: 301474 - protein, 9 aa, Homo Sapiens
PEIQVMQIM

SEQ ID NO: 301475 - protein, 9 aa, Homo Sapiens
RDKDTKIIH

SEQ ID NO: 301476 - protein, 9 aa, Homo Sapiens
GQIILWDPS

SEQ ID NO: 301477 - protein, 9 aa, Homo Sapiens
VALLSKCLC

SEQ ID NO: 301478 - protein, 9 aa, Homo Sapiens
SHRMWRHHH

SEQ ID NO: 301479 - protein, 9 aa, Homo Sapiens
KNHWNSTIT

SEQ ID NO: 301480 - protein, 9 aa, Homo Sapiens
RHDAVTDTV

SEQ ID NO: 301481 - protein, 9 aa, Homo Sapiens
LSVNKTLVV

SEQ ID NO: 301482 - protein, 9 aa, Homo Sapiens
LTSDKPHTV

SEQ ID NO: 301483 - protein, 9 aa, Homo Sapiens
HNFNLKSLI

SEQ ID NO: 301484 - protein, 9 aa, Homo Sapiens
SQLTEHKKI

SEQ ID NO: 301485 - protein, 9 aa, Homo Sapiens
NVPLKDEIR

SEQ ID NO: 301486 - protein, 9 aa, Homo Sapiens
LISMLLVKD

SEQ ID NO: 301487 - protein, 9 aa, Homo Sapiens
QVLRDMKAI

SEQ ID NO: 301488 - protein, 9 aa, Homo Sapiens
QPQRITYLH

SEQ ID NO: 301489 - protein, 9 aa, Homo Sapiens
ETAPLQMYN

SEQ ID NO: 301490 - protein, 9 aa, Homo Sapiens
LASDSNSFM

SEQ ID NO: 301491 - protein, 9 aa, Homo Sapiens
QIKENIFPQ

SEQ ID NO: 301492 - protein, 9 aa, Homo Sapiens
NYASYTFVS

SEQ ID NO: 301493 - protein, 9 aa, Homo Sapiens
AAITEVLLN

SEQ ID NO: 301494 - protein, 9 aa, Homo Sapiens
DVFVELFSP

SEQ ID NO: 301495 - protein, 9 aa, Homo Sapiens
MGQLSLGLK

SEQ ID NO: 301496 - protein, 9 aa, Homo Sapiens
AYGDLHYRT

SEQ ID NO: 301497 - protein, 9 aa, Homo Sapiens
RGSQQSKTV

SEQ ID NO: 301498 - protein, 9 aa, Homo Sapiens
DFIAQLSIN

SEQ ID NO: 301499 - protein, 9 aa, Homo Sapiens
EPTSGVICT

SEQ ID NO: 301500 - protein, 9 aa, Homo Sapiens
ENTVLQKEV

SEQ ID NO: 301501 - protein, 9 aa, Homo Sapiens
IYLRLKRAV

SEQ ID NO: 301502 - protein, 9 aa, Homo Sapiens
DVVENNLTL

SEQ ID NO: 301503 - protein, 9 aa, Homo Sapiens
FIPCRGHGG

SEQ ID NO: 301504 - protein, 9 aa, Homo Sapiens
LDIGTDGEI

SEQ ID NO: 301505 - protein, 9 aa, Homo Sapiens
EIKLRNRRI

SEQ ID NO: 301506 - protein, 9 aa, Homo Sapiens
PVCEELSPV

SEQ ID NO: 301507 - protein, 9 aa, Homo Sapiens
VHKNDILYK

SEQ ID NO: 301508 - protein, 9 aa, Homo Sapiens
GKKWKDQKM

SEQ ID NO: 301509 - protein, 9 aa, Homo Sapiens
GYLMSMYLK

SEQ ID NO: 301510 - protein, 9 aa, Homo Sapiens
NLINGALLV

SEQ ID NO: 301511 - protein, 9 aa, Homo Sapiens
TIKSLRVLW

SEQ ID NO: 301512 - protein, 9 aa, Homo Sapiens
AYVCIRTTK

SEQ ID NO: 301513 - protein, 9 aa, Homo Sapiens
IKARWSVRP

SEQ ID NO: 301514 - protein, 9 aa, Homo Sapiens
NSLSNCGIW

SEQ ID NO: 301515 - protein, 9 aa, Homo Sapiens
TVQLQNGDI

SEQ ID NO: 301516 - protein, 9 aa, Homo Sapiens
RKGAVGYWK

SEQ ID NO: 301517 - protein, 9 aa, Homo Sapiens
SKMLSQQES

SEQ ID NO: 301518 - protein, 9 aa, Homo Sapiens
FNCSSDIIV

SEQ ID NO: 301519 - protein, 9 aa, Homo Sapiens
EYLKTTGKQ

SEQ ID NO: 301520 - protein, 9 aa, Homo Sapiens
ASFELIQKE

SEQ ID NO: 301521 - protein, 9 aa, Homo Sapiens
RKGGKIYFC

SEQ ID NO: 301522 - protein, 9 aa, Homo Sapiens
EQEKKLLAS

SEQ ID NO: 301523 - protein, 9 aa, Homo Sapiens
RSVWNSEPN

SEQ ID NO: 301524 - protein, 9 aa, Homo Sapiens
GLSAPLNFI

SEQ ID NO: 301525 - protein, 9 aa, Homo Sapiens
FWNAKKGTG

SEQ ID NO: 301526 - protein, 9 aa, Homo Sapiens
ETYADARWW

SEQ ID NO: 301527 - protein, 9 aa, Homo Sapiens
EVKVVEMHE

SEQ ID NO: 301528 - protein, 9 aa, Homo Sapiens
FQYSASSRA

SEQ ID NO: 301529 - protein, 9 aa, Homo Sapiens
SCFPTSRHI

SEQ ID NO: 301530 - protein, 9 aa, Homo Sapiens
ELYENDSNL

SEQ ID NO: 301531 - protein, 9 aa, Homo Sapiens
TGVACSYGW

SEQ ID NO: 301532 - protein, 9 aa, Homo Sapiens
VSISKTITM

SEQ ID NO: 301533 - protein, 9 aa, Homo Sapiens
SDKPHTVKK

SEQ ID NO: 301534 - protein, 9 aa, Homo Sapiens
EVCEHVKLL

SEQ ID NO: 301535 - protein, 9 aa, Homo Sapiens
SKDIIYIIN

SEQ ID NO: 301536 - protein, 9 aa, Homo Sapiens
KFACVASEY

SEQ ID NO: 301537 - protein, 9 aa, Homo Sapiens
KRSVLNNSG

SEQ ID NO: 301538 - protein, 9 aa, Homo Sapiens
IVHAIRHCY

SEQ ID NO: 301539 - protein, 9 aa, Homo Sapiens
LSSHQPAQS

SEQ ID NO: 301540 - protein, 9 aa, Homo Sapiens
GTPQKREIN

SEQ ID NO: 301541 - protein, 9 aa, Homo Sapiens
RRLPHSNSL

SEQ ID NO: 301542 - protein, 9 aa, Homo Sapiens
MDDRESIPF

SEQ ID NO: 301543 - protein, 9 aa, Homo Sapiens
EIRAIQYLK

SEQ ID NO: 301544 - protein, 9 aa, Homo Sapiens
YYDRTAQMC

SEQ ID NO: 301545 - protein, 9 aa, Homo Sapiens
EINESLSVE

SEQ ID NO: 301546 - protein, 9 aa, Homo Sapiens
RNTEYVNQL

SEQ ID NO: 301547 - protein, 9 aa, Homo Sapiens
NNASLQDQG

SEQ ID NO: 301548 - protein, 9 aa, Homo Sapiens
NPLRCPVKL

SEQ ID NO: 301549 - protein, 9 aa, Homo Sapiens
PPMPENRFL

SEQ ID NO: 301550 - protein, 9 aa, Homo Sapiens
FKDVAIEFY

SEQ ID NO: 301551 - protein, 9 aa, Homo Sapiens
SALILHQII

SEQ ID NO: 301552 - protein, 9 aa, Homo Sapiens
VGLSFLFVA

SEQ ID NO: 301553 - protein, 9 aa, Homo Sapiens
VDNHLDLRQ

SEQ ID NO: 301554 - protein, 9 aa, Homo Sapiens
LAAHQPACK

SEQ ID NO: 301555 - protein, 9 aa, Homo Sapiens
RLTARLNLT

SEQ ID NO: 301556 - protein, 9 aa, Homo Sapiens
FVVFLKALY

SEQ ID NO: 301557 - protein, 9 aa, Homo Sapiens
CSSDIIVHQ

SEQ ID NO: 301558 - protein, 9 aa, Homo Sapiens
IAAQRQKVV

SEQ ID NO: 301559 - protein, 9 aa, Homo Sapiens
FNRDFLAEK

SEQ ID NO: 301560 - protein, 9 aa, Homo Sapiens
QNEDRWAWI

SEQ ID NO: 301561 - protein, 9 aa, Homo Sapiens
VPLKDEIRH

SEQ ID NO: 301562 - protein, 9 aa, Homo Sapiens
DFSAGLILG

SEQ ID NO: 301563 - protein, 9 aa, Homo Sapiens
MHLIQHQKF

SEQ ID NO: 301564 - protein, 9 aa, Homo Sapiens
VLGWNGVSD

SEQ ID NO: 301565 - protein, 9 aa, Homo Sapiens
ENMQVNNIK

SEQ ID NO: 301566 - protein, 9 aa, Homo Sapiens
LCGAACGVT

SEQ ID NO: 301567 - protein, 9 aa, Homo Sapiens
SRGSGPKPE

SEQ ID NO: 301568 - protein, 9 aa, Homo Sapiens
QPLRLLNLL

SEQ ID NO: 301569 - protein, 9 aa, Homo Sapiens
ICQIRFNYQ

SEQ ID NO: 301570 - protein, 9 aa, Homo Sapiens
AGSKKKSSQ

SEQ ID NO: 301571 - protein, 9 aa, Homo Sapiens
NYLINNCSE

SEQ ID NO: 301572 - protein, 9 aa, Homo Sapiens
KRLGGGPDY

SEQ ID NO: 301573 - protein, 9 aa, Homo Sapiens
ITGITILRV

SEQ ID NO: 301574 - protein, 9 aa, Homo Sapiens
EELTDDSLT

SEQ ID NO: 301575 - protein, 9 aa, Homo Sapiens
HHFVKKVWF

SEQ ID NO: 301576 - protein, 9 aa, Homo Sapiens
FKSGCEPPG

SEQ ID NO: 301577 - protein, 9 aa, Homo Sapiens
NNTYNETNL

SEQ ID NO: 301578 - protein, 9 aa, Homo Sapiens
QVAQECLFH

SEQ ID NO: 301579 - protein, 9 aa, Homo Sapiens
KAFLLQTAD

SEQ ID NO: 301580 - protein, 9 aa, Homo Sapiens
TSGVICTQR

SEQ ID NO: 301581 - protein, 9 aa, Homo Sapiens
AQLSINTFG

SEQ ID NO: 301582 - protein, 9 aa, Homo Sapiens
TPKGGFDAI

SEQ ID NO: 301583 - protein, 9 aa, Homo Sapiens
IFTFVETNV

SEQ ID NO: 301584 - protein, 9 aa, Homo Sapiens
YQKLGSDVF

SEQ ID NO: 301585 - protein, 9 aa, Homo Sapiens
KAITTMEMN

SEQ ID NO: 301586 - protein, 9 aa, Homo Sapiens
KGFCYKGSC

SEQ ID NO: 301587 - protein, 9 aa, Homo Sapiens
IFRQNSDIV

SEQ ID NO: 301588 - protein, 9 aa, Homo Sapiens
KNYRYKQDE

SEQ ID NO: 301589 - protein, 9 aa, Homo Sapiens
NAPILGSYS

SEQ ID NO: 301590 - protein, 9 aa, Homo Sapiens
ECMNKKELI

SEQ ID NO: 301591 - protein, 9 aa, Homo Sapiens
TFIPYCSMV

SEQ ID NO: 301592 - protein, 9 aa, Homo Sapiens
TFVEKLVKE

SEQ ID NO: 301593 - protein, 9 aa, Homo Sapiens
QGELICPMC

SEQ ID NO: 301594 - protein, 9 aa, Homo Sapiens
KKHIQLKKE

SEQ ID NO: 301595 - protein, 9 aa, Homo Sapiens
SVVVIYKKV

SEQ ID NO: 301596 - protein, 9 aa, Homo Sapiens
IKTKKKLLI

SEQ ID NO: 301597 - protein, 9 aa, Homo Sapiens
SKSKEKDSP

SEQ ID NO: 301598 - protein, 9 aa, Homo Sapiens
GQITTLTGL

SEQ ID NO: 301599 - protein, 9 aa, Homo Sapiens
NIPEEVCEH

SEQ ID NO: 301600 - protein, 9 aa, Homo Sapiens
EDSEVSCFT

SEQ ID NO: 301601 - protein, 9 aa, Homo Sapiens
SEGHFYLQS

SEQ ID NO: 301602 - protein, 9 aa, Homo Sapiens
NWQGFYCGG

SEQ ID NO: 301603 - protein, 9 aa, Homo Sapiens
VNLCSFRKV

SEQ ID NO: 301604 - protein, 9 aa, Homo Sapiens
PLSSHQPAQ

SEQ ID NO: 301605 - protein, 9 aa, Homo Sapiens
SKNGGRCLI

SEQ ID NO: 301606 - protein, 9 aa, Homo Sapiens
QPPVTNTPS

SEQ ID NO: 301607 - protein, 9 aa, Homo Sapiens
LQNGKYRKY

SEQ ID NO: 301608 - protein, 9 aa, Homo Sapiens
KDKKSSSKD

SEQ ID NO: 301609 - protein, 9 aa, Homo Sapiens
ITLKDYRII

SEQ ID NO: 301610 - protein, 9 aa, Homo Sapiens
QAQIRHWFI

SEQ ID NO: 301611 - protein, 9 aa, Homo Sapiens
LDKPLKKHL

SEQ ID NO: 301612 - protein, 9 aa, Homo Sapiens
AYSFSSSLQ

SEQ ID NO: 301613 - protein, 9 aa, Homo Sapiens
TMAASLLPL

SEQ ID NO: 301614 - protein, 9 aa, Homo Sapiens
LEIHVKVKY

SEQ ID NO: 301615 - protein, 9 aa, Homo Sapiens
HHSSFQSHM

SEQ ID NO: 301616 - protein, 9 aa, Homo Sapiens
KKEGRIDYL

SEQ ID NO: 301617 - protein, 9 aa, Homo Sapiens
TTPDFIILG

SEQ ID NO: 301618 - protein, 9 aa, Homo Sapiens
HKIMKMIHG

SEQ ID NO: 301619 - protein, 9 aa, Homo Sapiens
GGLRTAGSQ

SEQ ID NO: 301620 - protein, 9 aa, Homo Sapiens
IGKEFINLL

SEQ ID NO: 301621 - protein, 9 aa, Homo Sapiens
IKEKETDKS

SEQ ID NO: 301622 - protein, 9 aa, Homo Sapiens
GTDDNNSVN

SEQ ID NO: 301623 - protein, 9 aa, Homo Sapiens
QIMKQTHKG

SEQ ID NO: 301624 - protein, 9 aa, Homo Sapiens
RDPKKREFV

SEQ ID NO: 301625 - protein, 9 aa, Homo Sapiens
AYFSNKHSR

SEQ ID NO: 301626 - protein, 9 aa, Homo Sapiens
CPEKCAKHK

SEQ ID NO: 301627 - protein, 9 aa, Homo Sapiens
PGHLVGPRG

SEQ ID NO: 301628 - protein, 9 aa, Homo Sapiens
LYCDVPQVI

SEQ ID NO: 301629 - protein, 9 aa, Homo Sapiens
TAKGLYWTL

SEQ ID NO: 301630 - protein, 9 aa, Homo Sapiens
LQVKKVYVC

SEQ ID NO: 301631 - protein, 9 aa, Homo Sapiens
ANNFGPKGF

SEQ ID NO: 301632 - protein, 9 aa, Homo Sapiens
SVCSIQKSI

SEQ ID NO: 301633 - protein, 9 aa, Homo Sapiens
SERYVAKHR

SEQ ID NO: 301634 - protein, 9 aa, Homo Sapiens
VSIIYSIPF

SEQ ID NO: 301635 - protein, 9 aa, Homo Sapiens
VDQIVGQGP

SEQ ID NO: 301636 - protein, 9 aa, Homo Sapiens
LLYEYLETV

SEQ ID NO: 301637 - protein, 9 aa, Homo Sapiens
SHHRAHYKT

SEQ ID NO: 301638 - protein, 9 aa, Homo Sapiens
CSHSSWSAG

SEQ ID NO: 301639 - protein, 9 aa, Homo Sapiens
VRRTIHYEN

SEQ ID NO: 301640 - protein, 9 aa, Homo Sapiens
WNDYSLTKS

SEQ ID NO: 301641 - protein, 9 aa, Homo Sapiens
PVLFKIMKT

SEQ ID NO: 301642 - protein, 9 aa, Homo Sapiens
SKNYSEISS

SEQ ID NO: 301643 - protein, 9 aa, Homo Sapiens
HKNDILYKA

SEQ ID NO: 301644 - protein, 9 aa, Homo Sapiens
SKMVGDIHK

SEQ ID NO: 301645 - protein, 9 aa, Homo Sapiens
SPQTTVHDK

SEQ ID NO: 301646 - protein, 9 aa, Homo Sapiens
SMSASKRDL

SEQ ID NO: 301647 - protein, 9 aa, Homo Sapiens
DQDVAHFFK

SEQ ID NO: 301648 - protein, 9 aa, Homo Sapiens
ISKKLRLKF

SEQ ID NO: 301649 - protein, 9 aa, Homo Sapiens
SKLVPESLN

SEQ ID NO: 301650 - protein, 9 aa, Homo Sapiens
VIQNGARDA

SEQ ID NO: 301651 - protein, 9 aa, Homo Sapiens
PIPGGVYSS

SEQ ID NO: 301652 - protein, 9 aa, Homo Sapiens
VKVQEGQWY

SEQ ID NO: 301653 - protein, 9 aa, Homo Sapiens
QCGKAFVRA

SEQ ID NO: 301654 - protein, 9 aa, Homo Sapiens
GEKDHKVCL

SEQ ID NO: 301655 - protein, 9 aa, Homo Sapiens
PGNAEGKGR

SEQ ID NO: 301656 - protein, 9 aa, Homo Sapiens
ITEKEDKRK

SEQ ID NO: 301657 - protein, 9 aa, Homo Sapiens
RRALLLLSY

SEQ ID NO: 301658 - protein, 9 aa, Homo Sapiens
QEKISELHN

SEQ ID NO: 301659 - protein, 9 aa, Homo Sapiens
LVGPRGPHP

SEQ ID NO: 301660 - protein, 9 aa, Homo Sapiens
QTGWVYRNV

SEQ ID NO: 301661 - protein, 9 aa, Homo Sapiens
RANQKSLRR

SEQ ID NO: 301662 - protein, 9 aa, Homo Sapiens
KSALTIKLI

SEQ ID NO: 301663 - protein, 9 aa, Homo Sapiens
GAHRQTKKM

SEQ ID NO: 301664 - protein, 9 aa, Homo Sapiens
LPGQSPVLQ

SEQ ID NO: 301665 - protein, 9 aa, Homo Sapiens
AHYKTEGSR

SEQ ID NO: 301666 - protein, 9 aa, Homo Sapiens
CIAWFSLEV

SEQ ID NO: 301667 - protein, 9 aa, Homo Sapiens
KTPEGLFRG

SEQ ID NO: 301668 - protein, 9 aa, Homo Sapiens
AHQISLNEL

SEQ ID NO: 301669 - protein, 9 aa, Homo Sapiens
MQLGSITEH

SEQ ID NO: 301670 - protein, 9 aa, Homo Sapiens
SQTLKNSLL

SEQ ID NO: 301671 - protein, 9 aa, Homo Sapiens
VYKLLLTIQ

SEQ ID NO: 301672 - protein, 9 aa, Homo Sapiens
KIIHAEEKP

SEQ ID NO: 301673 - protein, 9 aa, Homo Sapiens
AKAESPIEV

SEQ ID NO: 301674 - protein, 9 aa, Homo Sapiens
PEGVHQEYK

SEQ ID NO: 301675 - protein, 9 aa, Homo Sapiens
LQKQPLRKY

SEQ ID NO: 301676 - protein, 9 aa, Homo Sapiens
LVRRTVRSL

SEQ ID NO: 301677 - protein, 9 aa, Homo Sapiens
DEELTDDSL

SEQ ID NO: 301678 - protein, 9 aa, Homo Sapiens
IALFCITNI

SEQ ID NO: 301679 - protein, 9 aa, Homo Sapiens
ADEGRTKKG

SEQ ID NO: 301680 - protein, 9 aa, Homo Sapiens
RTKDISRVF

SEQ ID NO: 301681 - protein, 9 aa, Homo Sapiens
STWLKLNTK

SEQ ID NO: 301682 - protein, 9 aa, Homo Sapiens
ESFLDILNY

SEQ ID NO: 301683 - protein, 9 aa, Homo Sapiens
HQKEIDTIN

SEQ ID NO: 301684 - protein, 9 aa, Homo Sapiens
EKEQEPEPV

SEQ ID NO: 301685 - protein, 9 aa, Homo Sapiens
GTYDAFPLA

SEQ ID NO: 301686 - protein, 9 aa, Homo Sapiens
DTERSFQDL

SEQ ID NO: 301687 - protein, 9 aa, Homo Sapiens
VEYLRTPDM

SEQ ID NO: 301688 - protein, 9 aa, Homo Sapiens
VSSGRRWLC

SEQ ID NO: 301689 - protein, 9 aa, Homo Sapiens
ELQTSISEL

SEQ ID NO: 301690 - protein, 9 aa, Homo Sapiens
FADLGYKQI

SEQ ID NO: 301691 - protein, 9 aa, Homo Sapiens
HGDDQPNSS

SEQ ID NO: 301692 - protein, 9 aa, Homo Sapiens
YLVEDVSSN

SEQ ID NO: 301693 - protein, 9 aa, Homo Sapiens
SHRNWIVNK

SEQ ID NO: 301694 - protein, 9 aa, Homo Sapiens
LGSSYLPAS

SEQ ID NO: 301695 - protein, 9 aa, Homo Sapiens
GKEGKETGS

SEQ ID NO: 301696 - protein, 9 aa, Homo Sapiens
PACLAASFL

SEQ ID NO: 301697 - protein, 9 aa, Homo Sapiens
SIIGLFVFT

SEQ ID NO: 301698 - protein, 9 aa, Homo Sapiens
ISTLLLYWQ

SEQ ID NO: 301699 - protein, 9 aa, Homo Sapiens
VRGRQCPWG

SEQ ID NO: 301700 - protein, 9 aa, Homo Sapiens
DKVNRDSVC

SEQ ID NO: 301701 - protein, 9 aa, Homo Sapiens
FNAYFSNKH

SEQ ID NO: 301702 - protein, 9 aa, Homo Sapiens
KEKWENYKV

SEQ ID NO: 301703 - protein, 9 aa, Homo Sapiens
PKISRSPSG

SEQ ID NO: 301704 - protein, 9 aa, Homo Sapiens
TPQSYTREH

SEQ ID NO: 301705 - protein, 9 aa, Homo Sapiens
QRLSLISTF

SEQ ID NO: 301706 - protein, 9 aa, Homo Sapiens
VYSVGTTPL

SEQ ID NO: 301707 - protein, 9 aa, Homo Sapiens
ALFEVLAHP

SEQ ID NO: 301708 - protein, 9 aa, Homo Sapiens
FMAEEVGKT

SEQ ID NO: 301709 - protein, 9 aa, Homo Sapiens
PVVKQMLHR

SEQ ID NO: 301710 - protein, 9 aa, Homo Sapiens
GEQEEKMRE

SEQ ID NO: 301711 - protein, 9 aa, Homo Sapiens
ESERVWTIT

SEQ ID NO: 301712 - protein, 9 aa, Homo Sapiens
GWQFLIYVM

SEQ ID NO: 301713 - protein, 9 aa, Homo Sapiens
RINATRQGV

SEQ ID NO: 301714 - protein, 9 aa, Homo Sapiens
ESRRLPHSN

SEQ ID NO: 301715 - protein, 9 aa, Homo Sapiens
IQASSFTNS

SEQ ID NO: 301716 - protein, 9 aa, Homo Sapiens
VTDMDVVYA

SEQ ID NO: 301717 - protein, 9 aa, Homo Sapiens
QLRLNGIKS

SEQ ID NO: 301718 - protein, 9 aa, Homo Sapiens
SSCSHSSWS

SEQ ID NO: 301719 - protein, 9 aa, Homo Sapiens
KTLADQMNL

SEQ ID NO: 301720 - protein, 9 aa, Homo Sapiens
SENEDNYIL

SEQ ID NO: 301721 - protein, 9 aa, Homo Sapiens
RDLDQASMG

SEQ ID NO: 301722 - protein, 9 aa, Homo Sapiens
RTASSYNSL

SEQ ID NO: 301723 - protein, 9 aa, Homo Sapiens
IIYQCETGY

SEQ ID NO: 301724 - protein, 9 aa, Homo Sapiens
DELTLEVGY

SEQ ID NO: 301725 - protein, 9 aa, Homo Sapiens
INRADYYLE

SEQ ID NO: 301726 - protein, 9 aa, Homo Sapiens
IEYDDLVEC

SEQ ID NO: 301727 - protein, 9 aa, Homo Sapiens
LIEEIINLW

SEQ ID NO: 301728 - protein, 9 aa, Homo Sapiens
DVKPDNLLV

SEQ ID NO: 301729 - protein, 9 aa, Homo Sapiens
KLDYLEPRL

SEQ ID NO: 301730 - protein, 9 aa, Homo Sapiens
PSFYAHLTE

SEQ ID NO: 301731 - protein, 9 aa, Homo Sapiens
NAEGKGRYE

SEQ ID NO: 301732 - protein, 9 aa, Homo Sapiens
INQTVMSKN

SEQ ID NO: 301733 - protein, 9 aa, Homo Sapiens
SEDCSDVPA

SEQ ID NO: 301734 - protein, 9 aa, Homo Sapiens
HCGSHSGGG

SEQ ID NO: 301735 - protein, 9 aa, Homo Sapiens
FTDKMKVNW

SEQ ID NO: 301736 - protein, 9 aa, Homo Sapiens
LFDRKNLVP

SEQ ID NO: 301737 - protein, 9 aa, Homo Sapiens
GVYSSGLSR

SEQ ID NO: 301738 - protein, 9 aa, Homo Sapiens
KKPRWIILL

SEQ ID NO: 301739 - protein, 9 aa, Homo Sapiens
QNPGLKIPK

SEQ ID NO: 301740 - protein, 9 aa, Homo Sapiens
QPQRHLTLS

SEQ ID NO: 301741 - protein, 9 aa, Homo Sapiens
TQMIDDMLL

SEQ ID NO: 301742 - protein, 9 aa, Homo Sapiens
PFAMINVYP

SEQ ID NO: 301743 - protein, 9 aa, Homo Sapiens
HVFVGGLSP

SEQ ID NO: 301744 - protein, 9 aa, Homo Sapiens
SEEIMRLLI

SEQ ID NO: 301745 - protein, 9 aa, Homo Sapiens
NLNNSQMCQ

SEQ ID NO: 301746 - protein, 9 aa, Homo Sapiens
YILYSKTHM

SEQ ID NO: 301747 - protein, 9 aa, Homo Sapiens
KNTADQLTT

SEQ ID NO: 301748 - protein, 9 aa, Homo Sapiens
PEATSLSLE

SEQ ID NO: 301749 - protein, 9 aa, Homo Sapiens
TIFTFVETN

SEQ ID NO: 301750 - protein, 9 aa, Homo Sapiens
GSEGIGSDF

SEQ ID NO: 301751 - protein, 9 aa, Homo Sapiens
GIIQSHSLP

SEQ ID NO: 301752 - protein, 9 aa, Homo Sapiens
TSDHLLFNM

SEQ ID NO: 301753 - protein, 9 aa, Homo Sapiens
FQIHERAHN

SEQ ID NO: 301754 - protein, 9 aa, Homo Sapiens
IELHVNVEF

SEQ ID NO: 301755 - protein, 9 aa, Homo Sapiens
VGRENKLGE

SEQ ID NO: 301756 - protein, 9 aa, Homo Sapiens
QSFFAIFLG

SEQ ID NO: 301757 - protein, 9 aa, Homo Sapiens
FRLVSTRTV

SEQ ID NO: 301758 - protein, 9 aa, Homo Sapiens
NKLRAKDKE

SEQ ID NO: 301759 - protein, 9 aa, Homo Sapiens
KADNTLSKL

SEQ ID NO: 301760 - protein, 9 aa, Homo Sapiens
SCNSILEDT

SEQ ID NO: 301761 - protein, 9 aa, Homo Sapiens
IKKCSMNQN

SEQ ID NO: 301762 - protein, 9 aa, Homo Sapiens
IHLLGKELA

SEQ ID NO: 301763 - protein, 9 aa, Homo Sapiens
IKANVTDML

SEQ ID NO: 301764 - protein, 9 aa, Homo Sapiens
RHIHLENNE

SEQ ID NO: 301765 - protein, 9 aa, Homo Sapiens
NIKLPAGSQ

SEQ ID NO: 301766 - protein, 9 aa, Homo Sapiens
CSIAGVAYG

SEQ ID NO: 301767 - protein, 9 aa, Homo Sapiens
ARMQQQTTV

SEQ ID NO: 301768 - protein, 9 aa, Homo Sapiens
APEVLLRTP

SEQ ID NO: 301769 - protein, 9 aa, Homo Sapiens
TRQMGDALP

SEQ ID NO: 301770 - protein, 9 aa, Homo Sapiens
KLVKEQGSH

SEQ ID NO: 301771 - protein, 9 aa, Homo Sapiens
RQGVLRQQG

SEQ ID NO: 301772 - protein, 9 aa, Homo Sapiens
INTLPTKLR

SEQ ID NO: 301773 - protein, 9 aa, Homo Sapiens
KFEKIIKRL

SEQ ID NO: 301774 - protein, 9 aa, Homo Sapiens
YSDCLVILL

SEQ ID NO: 301775 - protein, 9 aa, Homo Sapiens
CKNGQIILW

SEQ ID NO: 301776 - protein, 9 aa, Homo Sapiens
LICSTLACI

SEQ ID NO: 301777 - protein, 9 aa, Homo Sapiens
GENQDTSHL

SEQ ID NO: 301778 - protein, 9 aa, Homo Sapiens
AGPQPPHHQ

SEQ ID NO: 301779 - protein, 9 aa, Homo Sapiens
AGMLLSEDE

SEQ ID NO: 301780 - protein, 9 aa, Homo Sapiens
TRSAGVLSG

SEQ ID NO: 301781 - protein, 9 aa, Homo Sapiens
IRNKVKKEM

SEQ ID NO: 301782 - protein, 9 aa, Homo Sapiens
NIARLNTIL

SEQ ID NO: 301783 - protein, 9 aa, Homo Sapiens
GPWPLPLHP

SEQ ID NO: 301784 - protein, 9 aa, Homo Sapiens
LELNNLTVI

SEQ ID NO: 301785 - protein, 9 aa, Homo Sapiens
NCMASELDD

SEQ ID NO: 301786 - protein, 9 aa, Homo Sapiens
EFILAAHQP

SEQ ID NO: 301787 - protein, 9 aa, Homo Sapiens
GYKLPNKEM

SEQ ID NO: 301788 - protein, 9 aa, Homo Sapiens
DDSSRNEGI

SEQ ID NO: 301789 - protein, 9 aa, Homo Sapiens
LYWFYNEDV

SEQ ID NO: 301790 - protein, 9 aa, Homo Sapiens
WAQLKNLFC

SEQ ID NO: 301791 - protein, 9 aa, Homo Sapiens
AVLMFYGYL

SEQ ID NO: 301792 - protein, 9 aa, Homo Sapiens
KQKVVIPPS

SEQ ID NO: 301793 - protein, 9 aa, Homo Sapiens
SWNLNCIAL

SEQ ID NO: 301794 - protein, 9 aa, Homo Sapiens
QFQNFLTEI

SEQ ID NO: 301795 - protein, 9 aa, Homo Sapiens
KAFHNNSSL

SEQ ID NO: 301796 - protein, 9 aa, Homo Sapiens
HSVMTYRLN

SEQ ID NO: 301797 - protein, 9 aa, Homo Sapiens
NSGKRTIIE

SEQ ID NO: 301798 - protein, 9 aa, Homo Sapiens
DNLPFTLEN

SEQ ID NO: 301799 - protein, 9 aa, Homo Sapiens
MVGSLPVDD

SEQ ID NO: 301800 - protein, 9 aa, Homo Sapiens
KDLMNAYLF

SEQ ID NO: 301801 - protein, 9 aa, Homo Sapiens
GSQDKQTKK

SEQ ID NO: 301802 - protein, 9 aa, Homo Sapiens
SASSSSDEG

SEQ ID NO: 301803 - protein, 9 aa, Homo Sapiens
KAEVTAHKV

SEQ ID NO: 301804 - protein, 9 aa, Homo Sapiens
ICSNVYVDV

SEQ ID NO: 301805 - protein, 9 aa, Homo Sapiens
GCTLNKNIR

SEQ ID NO: 301806 - protein, 9 aa, Homo Sapiens
PSQTHKERS

SEQ ID NO: 301807 - protein, 9 aa, Homo Sapiens
TLRQMEEVV

SEQ ID NO: 301808 - protein, 9 aa, Homo Sapiens
TIVATMSNL

SEQ ID NO: 301809 - protein, 9 aa, Homo Sapiens
LNILTEPER

SEQ ID NO: 301810 - protein, 9 aa, Homo Sapiens
EKWKSSGNN

SEQ ID NO: 301811 - protein, 9 aa, Homo Sapiens
EIMTPEQFQ

SEQ ID NO: 301812 - protein, 9 aa, Homo Sapiens
FDLRTFQSV

SEQ ID NO: 301813 - protein, 9 aa, Homo Sapiens
YFDLQISTK

SEQ ID NO: 301814 - protein, 9 aa, Homo Sapiens
FDFEACNEV

SEQ ID NO: 301815 - protein, 9 aa, Homo Sapiens
SSVLSDYNS

SEQ ID NO: 301816 - protein, 9 aa, Homo Sapiens
VLIGFMIGY

SEQ ID NO: 301817 - protein, 9 aa, Homo Sapiens
PRDHSKNVT

SEQ ID NO: 301818 - protein, 9 aa, Homo Sapiens
AKEKTSFEL

SEQ ID NO: 301819 - protein, 9 aa, Homo Sapiens
EDISDLTEQ

SEQ ID NO: 301820 - protein, 9 aa, Homo Sapiens
TSVFLENVC

SEQ ID NO: 301821 - protein, 9 aa, Homo Sapiens
AFTLSSTLN

SEQ ID NO: 301822 - protein, 9 aa, Homo Sapiens
IECNEILEW

SEQ ID NO: 301823 - protein, 9 aa, Homo Sapiens
VSHLSEKMV

SEQ ID NO: 301824 - protein, 9 aa, Homo Sapiens
TERQQKRVQ

SEQ ID NO: 301825 - protein, 9 aa, Homo Sapiens
ELDFLLQFT

SEQ ID NO: 301826 - protein, 9 aa, Homo Sapiens
RGPYQPKFW

SEQ ID NO: 301827 - protein, 9 aa, Homo Sapiens
LFRIIFRTL

SEQ ID NO: 301828 - protein, 9 aa, Homo Sapiens
PPPPYGPGI

SEQ ID NO: 301829 - protein, 9 aa, Homo Sapiens
LYENHCEVH

SEQ ID NO: 301830 - protein, 9 aa, Homo Sapiens
QDDIIEFAH

SEQ ID NO: 301831 - protein, 9 aa, Homo Sapiens
MVKTYLEEK

SEQ ID NO: 301832 - protein, 9 aa, Homo Sapiens
KEGEQQCFL

SEQ ID NO: 301833 - protein, 9 aa, Homo Sapiens
WKADNTLSK

SEQ ID NO: 301834 - protein, 9 aa, Homo Sapiens
QPIFLAPCM

SEQ ID NO: 301835 - protein, 9 aa, Homo Sapiens
SVLRGLVSL

SEQ ID NO: 301836 - protein, 9 aa, Homo Sapiens
ATSPKDIVS

SEQ ID NO: 301837 - protein, 9 aa, Homo Sapiens
LESGHDQKN

SEQ ID NO: 301838 - protein, 9 aa, Homo Sapiens
HLKDKSSLV

SEQ ID NO: 301839 - protein, 9 aa, Homo Sapiens
NQIIYTLQT

SEQ ID NO: 301840 - protein, 9 aa, Homo Sapiens
TELLPQGSA

SEQ ID NO: 301841 - protein, 9 aa, Homo Sapiens
LNPTWRSLN

SEQ ID NO: 301842 - protein, 9 aa, Homo Sapiens
ERQGVLRQQ

SEQ ID NO: 301843 - protein, 9 aa, Homo Sapiens
LIEKLDRLG

SEQ ID NO: 301844 - protein, 9 aa, Homo Sapiens
PCFGLGQMY

SEQ ID NO: 301845 - protein, 9 aa, Homo Sapiens
HFSIYFLSS

SEQ ID NO: 301846 - protein, 9 aa, Homo Sapiens
AGTVYPANL

SEQ ID NO: 301847 - protein, 9 aa, Homo Sapiens
ICLKMIIMI

SEQ ID NO: 301848 - protein, 9 aa, Homo Sapiens
LTLLNSFWF

SEQ ID NO: 301849 - protein, 9 aa, Homo Sapiens
KLQLQKWYV

SEQ ID NO: 301850 - protein, 9 aa, Homo Sapiens
IVFVLIGFM

SEQ ID NO: 301851 - protein, 9 aa, Homo Sapiens
RMGIFSYRG

SEQ ID NO: 301852 - protein, 9 aa, Homo Sapiens
SVERQLQMD

SEQ ID NO: 301853 - protein, 9 aa, Homo Sapiens
LIDLLTADF

SEQ ID NO: 301854 - protein, 9 aa, Homo Sapiens
QKRGSSWHL

SEQ ID NO: 301855 - protein, 9 aa, Homo Sapiens
QQIQDEIIL

SEQ ID NO: 301856 - protein, 9 aa, Homo Sapiens
HEIMTPEQF

SEQ ID NO: 301857 - protein, 9 aa, Homo Sapiens
SVMTYRLNF

SEQ ID NO: 301858 - protein, 9 aa, Homo Sapiens
HGRDGRKHV

SEQ ID NO: 301859 - protein, 9 aa, Homo Sapiens
FLLDPSDLD

SEQ ID NO: 301860 - protein, 9 aa, Homo Sapiens
KADNSSNEE

SEQ ID NO: 301861 - protein, 9 aa, Homo Sapiens
VQVSGGQII

SEQ ID NO: 301862 - protein, 9 aa, Homo Sapiens
EKNYPKNME

SEQ ID NO: 301863 - protein, 9 aa, Homo Sapiens
DPRTLHYLA

SEQ ID NO: 301864 - protein, 9 aa, Homo Sapiens
QFIPEMICI

SEQ ID NO: 301865 - protein, 9 aa, Homo Sapiens
IVIKDTENK

SEQ ID NO: 301866 - protein, 9 aa, Homo Sapiens
WYCRRQNGY

SEQ ID NO: 301867 - protein, 9 aa, Homo Sapiens
GRLRDKLFS

SEQ ID NO: 301868 - protein, 9 aa, Homo Sapiens
GCNKLASFS

SEQ ID NO: 301869 - protein, 9 aa, Homo Sapiens
LLCQEYTDL

SEQ ID NO: 301870 - protein, 9 aa, Homo Sapiens
PHLCSLSSS

SEQ ID NO: 301871 - protein, 9 aa, Homo Sapiens
PLGAAQPLF

SEQ ID NO: 301872 - protein, 9 aa, Homo Sapiens
KVPGGEDES

SEQ ID NO: 301873 - protein, 9 aa, Homo Sapiens
RDKLFSGYD

SEQ ID NO: 301874 - protein, 9 aa, Homo Sapiens
PLYGDELGL

SEQ ID NO: 301875 - protein, 9 aa, Homo Sapiens
KNIIWVLCT

SEQ ID NO: 301876 - protein, 9 aa, Homo Sapiens
KPHTVKKAI

SEQ ID NO: 301877 - protein, 9 aa, Homo Sapiens
SISGSSVSS

SEQ ID NO: 301878 - protein, 9 aa, Homo Sapiens
GNLLRSLVT

SEQ ID NO: 301879 - protein, 9 aa, Homo Sapiens
EKSIYNGFF

SEQ ID NO: 301880 - protein, 9 aa, Homo Sapiens
IPPTVGDDV

SEQ ID NO: 301881 - protein, 9 aa, Homo Sapiens
KLSDLAQPD

SEQ ID NO: 301882 - protein, 9 aa, Homo Sapiens
TNLSKLQSG

SEQ ID NO: 301883 - protein, 9 aa, Homo Sapiens
LAKDYLLGI

SEQ ID NO: 301884 - protein, 9 aa, Homo Sapiens
QVNYDKGLK

SEQ ID NO: 301885 - protein, 9 aa, Homo Sapiens
EPQELWVDN

SEQ ID NO: 301886 - protein, 9 aa, Homo Sapiens
VLMIPPSVF

SEQ ID NO: 301887 - protein, 9 aa, Homo Sapiens
NFIDNRIIS

SEQ ID NO: 301888 - protein, 9 aa, Homo Sapiens
AVHQQFQNF

SEQ ID NO: 301889 - protein, 9 aa, Homo Sapiens
LEEKNNNLQ

SEQ ID NO: 301890 - protein, 9 aa, Homo Sapiens
LVSKKIQRK

SEQ ID NO: 301891 - protein, 9 aa, Homo Sapiens
LQAVSDGAL

SEQ ID NO: 301892 - protein, 9 aa, Homo Sapiens
QDKINNLRE

SEQ ID NO: 301893 - protein, 9 aa, Homo Sapiens
NEFQMEEYL

SEQ ID NO: 301894 - protein, 9 aa, Homo Sapiens
ISVYDKEFP

SEQ ID NO: 301895 - protein, 9 aa, Homo Sapiens
CSAGESGLH

SEQ ID NO: 301896 - protein, 9 aa, Homo Sapiens
STFRVEKAQ

SEQ ID NO: 301897 - protein, 9 aa, Homo Sapiens
PYDVKAPSD

SEQ ID NO: 301898 - protein, 9 aa, Homo Sapiens
LAKLLKKAD

SEQ ID NO: 301899 - protein, 9 aa, Homo Sapiens
SWIHCMIMA

SEQ ID NO: 301900 - protein, 9 aa, Homo Sapiens
VNNSRSTKY

SEQ ID NO: 301901 - protein, 9 aa, Homo Sapiens
TLVSFSFLC

SEQ ID NO: 301902 - protein, 9 aa, Homo Sapiens
SLYKSQGEL

SEQ ID NO: 301903 - protein, 9 aa, Homo Sapiens
HGRQGEDQE

SEQ ID NO: 301904 - protein, 9 aa, Homo Sapiens
PEGKLTGPK

SEQ ID NO: 301905 - protein, 9 aa, Homo Sapiens
FKINNSRLM

SEQ ID NO: 301906 - protein, 9 aa, Homo Sapiens
KMRQEHQNR

SEQ ID NO: 301907 - protein, 9 aa, Homo Sapiens
QEHSNFLFL

SEQ ID NO: 301908 - protein, 9 aa, Homo Sapiens
QAILSQGRF

SEQ ID NO: 301909 - protein, 9 aa, Homo Sapiens
DWEFGRETN

SEQ ID NO: 301910 - protein, 9 aa, Homo Sapiens
YLQTTLNIL

SEQ ID NO: 301911 - protein, 9 aa, Homo Sapiens
ITPPGPPPP

SEQ ID NO: 301912 - protein, 9 aa, Homo Sapiens
AMDLMVFTL

SEQ ID NO: 301913 - protein, 9 aa, Homo Sapiens
LTFLSNPDS

SEQ ID NO: 301914 - protein, 9 aa, Homo Sapiens
EIPLMLIGN

SEQ ID NO: 301915 - protein, 9 aa, Homo Sapiens
LHVKPRLDM

SEQ ID NO: 301916 - protein, 9 aa, Homo Sapiens
ENSKFFKTH

SEQ ID NO: 301917 - protein, 9 aa, Homo Sapiens
GRNLGRDWN

SEQ ID NO: 301918 - protein, 9 aa, Homo Sapiens
NNGSKKVIQ

SEQ ID NO: 301919 - protein, 9 aa, Homo Sapiens
DIREHIWGY

SEQ ID NO: 301920 - protein, 9 aa, Homo Sapiens
KNSSILDLE

SEQ ID NO: 301921 - protein, 9 aa, Homo Sapiens
VESVAHNKR

SEQ ID NO: 301922 - protein, 9 aa, Homo Sapiens
RQTLMPTLE

SEQ ID NO: 301923 - protein, 9 aa, Homo Sapiens
SLNKAFLIN

SEQ ID NO: 301924 - protein, 9 aa, Homo Sapiens
ECGHCHCHQ

SEQ ID NO: 301925 - protein, 9 aa, Homo Sapiens
ARHQSIHTG

SEQ ID NO: 301926 - protein, 9 aa, Homo Sapiens
ELLSDNMLI

SEQ ID NO: 301927 - protein, 9 aa, Homo Sapiens
NIVNHQRIH

SEQ ID NO: 301928 - protein, 9 aa, Homo Sapiens
LGECCAVCP

SEQ ID NO: 301929 - protein, 9 aa, Homo Sapiens
IFRTLNHQY

SEQ ID NO: 301930 - protein, 9 aa, Homo Sapiens
VPCSTDFWG

SEQ ID NO: 301931 - protein, 9 aa, Homo Sapiens
NEIAPLGPD

SEQ ID NO: 301932 - protein, 9 aa, Homo Sapiens
SLLPFATGK

SEQ ID NO: 301933 - protein, 9 aa, Homo Sapiens
AVTPLKLAG

SEQ ID NO: 301934 - protein, 9 aa, Homo Sapiens
KAASHNSSL

SEQ ID NO: 301935 - protein, 9 aa, Homo Sapiens
DIVTCTRVE

SEQ ID NO: 301936 - protein, 9 aa, Homo Sapiens
ARRYPEATS

SEQ ID NO: 301937 - protein, 9 aa, Homo Sapiens
IVIKEYVQQ

SEQ ID NO: 301938 - protein, 9 aa, Homo Sapiens
LSYSYIITT

SEQ ID NO: 301939 - protein, 9 aa, Homo Sapiens
MNFLPSTWR

SEQ ID NO: 301940 - protein, 9 aa, Homo Sapiens
HTNTGFLQR

SEQ ID NO: 301941 - protein, 9 aa, Homo Sapiens
RSISDSNEL

SEQ ID NO: 301942 - protein, 9 aa, Homo Sapiens
SLLQNENGI

SEQ ID NO: 301943 - protein, 9 aa, Homo Sapiens
DNNSVNHVI

SEQ ID NO: 301944 - protein, 9 aa, Homo Sapiens
RSRDRVAKV

SEQ ID NO: 301945 - protein, 9 aa, Homo Sapiens
AAPTPDKEM

SEQ ID NO: 301946 - protein, 9 aa, Homo Sapiens
NLSLVDYSS

SEQ ID NO: 301947 - protein, 9 aa, Homo Sapiens
YFLNTKENV

SEQ ID NO: 301948 - protein, 9 aa, Homo Sapiens
KHGPTYKEQ

SEQ ID NO: 301949 - protein, 9 aa, Homo Sapiens
QHGGWTTKM

SEQ ID NO: 301950 - protein, 9 aa, Homo Sapiens
VDVDPEQLE

SEQ ID NO: 301951 - protein, 9 aa, Homo Sapiens
LTLEVGYIV

SEQ ID NO: 301952 - protein, 9 aa, Homo Sapiens
LNKLQKLEL

SEQ ID NO: 301953 - protein, 9 aa, Homo Sapiens
YLSKTLLDR

SEQ ID NO: 301954 - protein, 9 aa, Homo Sapiens
ENNEKTGIV

SEQ ID NO: 301955 - protein, 9 aa, Homo Sapiens
TLLSLHNMI

SEQ ID NO: 301956 - protein, 9 aa, Homo Sapiens
VLCIQNVLS

SEQ ID NO: 301957 - protein, 9 aa, Homo Sapiens
EDRKGGKIY

SEQ ID NO: 301958 - protein, 9 aa, Homo Sapiens
AGLFVLIYK

SEQ ID NO: 301959 - protein, 9 aa, Homo Sapiens
KTIKLMEVP

SEQ ID NO: 301960 - protein, 9 aa, Homo Sapiens
MCEYQQAKC

SEQ ID NO: 301961 - protein, 9 aa, Homo Sapiens
CLPKFTIKN

SEQ ID NO: 301962 - protein, 9 aa, Homo Sapiens
LVIRDKNKY

SEQ ID NO: 301963 - protein, 9 aa, Homo Sapiens
LEGPEGKLT

SEQ ID NO: 301964 - protein, 9 aa, Homo Sapiens
KYVDSDKYS

SEQ ID NO: 301965 - protein, 9 aa, Homo Sapiens
HRHVTLHVN

SEQ ID NO: 301966 - protein, 9 aa, Homo Sapiens
RSYHLIGHQ

SEQ ID NO: 301967 - protein, 9 aa, Homo Sapiens
LPCTVARLL

SEQ ID NO: 301968 - protein, 9 aa, Homo Sapiens
SHHQSLSVH

SEQ ID NO: 301969 - protein, 9 aa, Homo Sapiens
KLHIMKDKW

SEQ ID NO: 301970 - protein, 9 aa, Homo Sapiens
SNGESEVQR

SEQ ID NO: 301971 - protein, 9 aa, Homo Sapiens
VFTVVGNLS

SEQ ID NO: 301972 - protein, 9 aa, Homo Sapiens
STHLNKPLM

SEQ ID NO: 301973 - protein, 9 aa, Homo Sapiens
AVQMGMGAV

SEQ ID NO: 301974 - protein, 9 aa, Homo Sapiens
QNVPRESCK

SEQ ID NO: 301975 - protein, 9 aa, Homo Sapiens
LFVCGLNTD

SEQ ID NO: 301976 - protein, 9 aa, Homo Sapiens
ASLIRNKCG

SEQ ID NO: 301977 - protein, 9 aa, Homo Sapiens
VRSKNNNSL

SEQ ID NO: 301978 - protein, 9 aa, Homo Sapiens
LIKYMLREE

SEQ ID NO: 301979 - protein, 9 aa, Homo Sapiens
CLCTFREIC

SEQ ID NO: 301980 - protein, 9 aa, Homo Sapiens
KMKPSWADS

SEQ ID NO: 301981 - protein, 9 aa, Homo Sapiens
VDADNQILK

SEQ ID NO: 301982 - protein, 9 aa, Homo Sapiens
QSWNLNCIA

SEQ ID NO: 301983 - protein, 9 aa, Homo Sapiens
NFHIQTRSN

SEQ ID NO: 301984 - protein, 9 aa, Homo Sapiens
WAPKVKADM

SEQ ID NO: 301985 - protein, 9 aa, Homo Sapiens
SGGLSNSRE

SEQ ID NO: 301986 - protein, 9 aa, Homo Sapiens
VVHAGTRRM

SEQ ID NO: 301987 - protein, 9 aa, Homo Sapiens
AFKEGVFEL

SEQ ID NO: 301988 - protein, 9 aa, Homo Sapiens
RHNTLRCEV

SEQ ID NO: 301989 - protein, 9 aa, Homo Sapiens
DNYIYFIPR

SEQ ID NO: 301990 - protein, 9 aa, Homo Sapiens
CQMALNQAL

SEQ ID NO: 301991 - protein, 9 aa, Homo Sapiens
RYLKGALNK

SEQ ID NO: 301992 - protein, 9 aa, Homo Sapiens
SQYVPCLIL

SEQ ID NO: 301993 - protein, 9 aa, Homo Sapiens
HESDSILGN

SEQ ID NO: 301994 - protein, 9 aa, Homo Sapiens
SFWSRKIAV

SEQ ID NO: 301995 - protein, 9 aa, Homo Sapiens
GKIYFCAHT

SEQ ID NO: 301996 - protein, 9 aa, Homo Sapiens
KLFEKHPEI

SEQ ID NO: 301997 - protein, 9 aa, Homo Sapiens
DIVSISKTI

SEQ ID NO: 301998 - protein, 9 aa, Homo Sapiens
LQIIIENLF

SEQ ID NO: 301999 - protein, 9 aa, Homo Sapiens
PVSHLSEKM

SEQ ID NO: 302000 - protein, 9 aa, Homo Sapiens
GCKNGQIIL

SEQ ID NO: 302001 - protein, 9 aa, Homo Sapiens
SCLTQHQIT

SEQ ID NO: 302002 - protein, 9 aa, Homo Sapiens
CQQIIIHTH

SEQ ID NO: 302003 - protein, 9 aa, Homo Sapiens
NRYIKIFPS

SEQ ID NO: 302004 - protein, 9 aa, Homo Sapiens
VSRRGALTG

SEQ ID NO: 302005 - protein, 9 aa, Homo Sapiens
MELNNASLQ

SEQ ID NO: 302006 - protein, 9 aa, Homo Sapiens
WNVCQELLY

SEQ ID NO: 302007 - protein, 9 aa, Homo Sapiens
NEDATDNVN

SEQ ID NO: 302008 - protein, 9 aa, Homo Sapiens
KYFFGLDTN

SEQ ID NO: 302009 - protein, 9 aa, Homo Sapiens
QKNQLWALP

SEQ ID NO: 302010 - protein, 9 aa, Homo Sapiens
FRVFYNKLL

SEQ ID NO: 302011 - protein, 9 aa, Homo Sapiens
LSLPLVGLV

SEQ ID NO: 302012 - protein, 9 aa, Homo Sapiens
INNCDGKSL

SEQ ID NO: 302013 - protein, 9 aa, Homo Sapiens
VNKYVIGWN

SEQ ID NO: 302014 - protein, 9 aa, Homo Sapiens
ENDHLRCED

SEQ ID NO: 302015 - protein, 9 aa, Homo Sapiens
GLILSTVLK

SEQ ID NO: 302016 - protein, 9 aa, Homo Sapiens
GPIAKFVDM

SEQ ID NO: 302017 - protein, 9 aa, Homo Sapiens
REQGQALVS

SEQ ID NO: 302018 - protein, 9 aa, Homo Sapiens
GRPFYKGIN

SEQ ID NO: 302019 - protein, 9 aa, Homo Sapiens
MGLINTTEI

SEQ ID NO: 302020 - protein, 9 aa, Homo Sapiens
SVFLENVCY

SEQ ID NO: 302021 - protein, 9 aa, Homo Sapiens
GHHHPDKSQ

SEQ ID NO: 302022 - protein, 9 aa, Homo Sapiens
YKALTKDDE

SEQ ID NO: 302023 - protein, 9 aa, Homo Sapiens
LLAQPDDSD

SEQ ID NO: 302024 - protein, 9 aa, Homo Sapiens
VDMPQSPLF

SEQ ID NO: 302025 - protein, 9 aa, Homo Sapiens
IVFQTAQNA

SEQ ID NO: 302026 - protein, 9 aa, Homo Sapiens
YVRTLMIST

SEQ ID NO: 302027 - protein, 9 aa, Homo Sapiens
ANNPKVNKC

SEQ ID NO: 302028 - protein, 9 aa, Homo Sapiens
PTNILPKTL

SEQ ID NO: 302029 - protein, 9 aa, Homo Sapiens
SVNNSEVKG

SEQ ID NO: 302030 - protein, 9 aa, Homo Sapiens
PKIGFFREE

SEQ ID NO: 302031 - protein, 9 aa, Homo Sapiens
LPLEDYVFS

SEQ ID NO: 302032 - protein, 9 aa, Homo Sapiens
LEYLPLEET

SEQ ID NO: 302033 - protein, 9 aa, Homo Sapiens
PSGPGVAVM

SEQ ID NO: 302034 - protein, 9 aa, Homo Sapiens
ASAPSDLRL

SEQ ID NO: 302035 - protein, 9 aa, Homo Sapiens
DIKLSLPGY

SEQ ID NO: 302036 - protein, 9 aa, Homo Sapiens
SQEHALKTQ

SEQ ID NO: 302037 - protein, 9 aa, Homo Sapiens
KKREFVFNA

SEQ ID NO: 302038 - protein, 9 aa, Homo Sapiens
IDEYKNRAR

SEQ ID NO: 302039 - protein, 9 aa, Homo Sapiens
HLSEKMVSS

SEQ ID NO: 302040 - protein, 9 aa, Homo Sapiens
LFVGTDDNN

SEQ ID NO: 302041 - protein, 9 aa, Homo Sapiens
HQISHTGER

SEQ ID NO: 302042 - protein, 9 aa, Homo Sapiens
KNKTKSSKL

SEQ ID NO: 302043 - protein, 9 aa, Homo Sapiens
LTELLSNHF

SEQ ID NO: 302044 - protein, 9 aa, Homo Sapiens
NNSSFTWSV

SEQ ID NO: 302045 - protein, 9 aa, Homo Sapiens
LRTQNQVLI

SEQ ID NO: 302046 - protein, 9 aa, Homo Sapiens
LVGLLPTQL

SEQ ID NO: 302047 - protein, 9 aa, Homo Sapiens
SKDGDVKYM

SEQ ID NO: 302048 - protein, 9 aa, Homo Sapiens
VYLHTLTSE

SEQ ID NO: 302049 - protein, 9 aa, Homo Sapiens
TIMWKWIGE

SEQ ID NO: 302050 - protein, 9 aa, Homo Sapiens
EHQIIHRGE

SEQ ID NO: 302051 - protein, 9 aa, Homo Sapiens
LLVLLTQLG

SEQ ID NO: 302052 - protein, 9 aa, Homo Sapiens
YGLKVHKRI

SEQ ID NO: 302053 - protein, 9 aa, Homo Sapiens
VPFKYVDSD

SEQ ID NO: 302054 - protein, 9 aa, Homo Sapiens
TVRRTTKLK

SEQ ID NO: 302055 - protein, 9 aa, Homo Sapiens
PAALNYPRL

SEQ ID NO: 302056 - protein, 9 aa, Homo Sapiens
GGNLQKTMD

SEQ ID NO: 302057 - protein, 9 aa, Homo Sapiens
RLQCNHTSC

SEQ ID NO: 302058 - protein, 9 aa, Homo Sapiens
IFGVVWCNL

SEQ ID NO: 302059 - protein, 9 aa, Homo Sapiens
SPPTIPLTV

SEQ ID NO: 302060 - protein, 9 aa, Homo Sapiens
LDNYLQADT

SEQ ID NO: 302061 - protein, 9 aa, Homo Sapiens
EAVINAKDE

SEQ ID NO: 302062 - protein, 9 aa, Homo Sapiens
LILSTSLPL

SEQ ID NO: 302063 - protein, 9 aa, Homo Sapiens
FNKIKFGEY

SEQ ID NO: 302064 - protein, 9 aa, Homo Sapiens
LWALPALPS

SEQ ID NO: 302065 - protein, 9 aa, Homo Sapiens
ILKSSEKKL

SEQ ID NO: 302066 - protein, 9 aa, Homo Sapiens
NELTSKSRE

SEQ ID NO: 302067 - protein, 9 aa, Homo Sapiens
ASTSRFARL

SEQ ID NO: 302068 - protein, 9 aa, Homo Sapiens
NTLREKLEA

SEQ ID NO: 302069 - protein, 9 aa, Homo Sapiens
MANQTSVMF

SEQ ID NO: 302070 - protein, 9 aa, Homo Sapiens
LWHHRDELL

SEQ ID NO: 302071 - protein, 9 aa, Homo Sapiens
NVREYARYV

SEQ ID NO: 302072 - protein, 9 aa, Homo Sapiens
EVNCPSQTC

SEQ ID NO: 302073 - protein, 9 aa, Homo Sapiens
GQLVNGIHL

SEQ ID NO: 302074 - protein, 9 aa, Homo Sapiens
IRVDLHLLH

SEQ ID NO: 302075 - protein, 9 aa, Homo Sapiens
GERSVVECS

SEQ ID NO: 302076 - protein, 9 aa, Homo Sapiens
FCVIIEKNP

SEQ ID NO: 302077 - protein, 9 aa, Homo Sapiens
GITDIKLSM

SEQ ID NO: 302078 - protein, 9 aa, Homo Sapiens
KENIFPQEE

SEQ ID NO: 302079 - protein, 9 aa, Homo Sapiens
INPDYTYTN

SEQ ID NO: 302080 - protein, 9 aa, Homo Sapiens
QNIISFLKM

SEQ ID NO: 302081 - protein, 9 aa, Homo Sapiens
CSAAKFYRR

SEQ ID NO: 302082 - protein, 9 aa, Homo Sapiens
VRASPSQGS

SEQ ID NO: 302083 - protein, 8 aa, Homo Sapiens
SGCFPVSG

SEQ ID NO: 302084 - protein, 9 aa, Homo Sapiens
KFMSLQEIP

SEQ ID NO: 302085 - protein, 9 aa, Homo Sapiens
IYSVNNSEV

SEQ ID NO: 302086 - protein, 9 aa, Homo Sapiens
NKVVQMEQE

SEQ ID NO: 302087 - protein, 9 aa, Homo Sapiens
PRLLTMVMV

SEQ ID NO: 302088 - protein, 9 aa, Homo Sapiens
IDLSAAHAA

SEQ ID NO: 302089 - protein, 9 aa, Homo Sapiens
RPEEVKHRE

SEQ ID NO: 302090 - protein, 9 aa, Homo Sapiens
LNSTVELAQ

SEQ ID NO: 302091 - protein, 9 aa, Homo Sapiens
VGGKKSLGT

SEQ ID NO: 302092 - protein, 9 aa, Homo Sapiens
TNKISWLYR

SEQ ID NO: 302093 - protein, 9 aa, Homo Sapiens
LPQLMDCDK

SEQ ID NO: 302094 - protein, 9 aa, Homo Sapiens
PHESTFDVG

SEQ ID NO: 302095 - protein, 9 aa, Homo Sapiens
HLSFAGLEQ

SEQ ID NO: 302096 - protein, 9 aa, Homo Sapiens
AEDLFYQRS

SEQ ID NO: 302097 - protein, 9 aa, Homo Sapiens
FQNIGIITH

SEQ ID NO: 302098 - protein, 9 aa, Homo Sapiens
NTEYVNQLK

SEQ ID NO: 302099 - protein, 9 aa, Homo Sapiens
KNEKSIKAE

SEQ ID NO: 302100 - protein, 9 aa, Homo Sapiens
VNKCRLSEW

SEQ ID NO: 302101 - protein, 9 aa, Homo Sapiens
GSDNGTVKL

SEQ ID NO: 302102 - protein, 9 aa, Homo Sapiens
GLEHMHNQF

SEQ ID NO: 302103 - protein, 9 aa, Homo Sapiens
FIILLLSTS

SEQ ID NO: 302104 - protein, 9 aa, Homo Sapiens
PVKVWFQEA

SEQ ID NO: 302105 - protein, 9 aa, Homo Sapiens
LNEYQAHAG

SEQ ID NO: 302106 - protein, 9 aa, Homo Sapiens
EFHVQEIEV

SEQ ID NO: 302107 - protein, 9 aa, Homo Sapiens
AGDQRTQTK

SEQ ID NO: 302108 - protein, 9 aa, Homo Sapiens
GAGTPLSST

SEQ ID NO: 302109 - protein, 9 aa, Homo Sapiens
TPWGINPHR

SEQ ID NO: 302110 - protein, 9 aa, Homo Sapiens
EAQLPVIDN

SEQ ID NO: 302111 - protein, 9 aa, Homo Sapiens
SMITEIHGL

SEQ ID NO: 302112 - protein, 9 aa, Homo Sapiens
QVKKVYVCN

SEQ ID NO: 302113 - protein, 9 aa, Homo Sapiens
CNKLIAYST

SEQ ID NO: 302114 - protein, 9 aa, Homo Sapiens
QEQNITPQF

SEQ ID NO: 302115 - protein, 9 aa, Homo Sapiens
ESVSMSVFP

SEQ ID NO: 302116 - protein, 9 aa, Homo Sapiens
KYDPDREKS

SEQ ID NO: 302117 - protein, 9 aa, Homo Sapiens
NERKRKNMP

SEQ ID NO: 302118 - protein, 9 aa, Homo Sapiens
KPLGLYDLW

SEQ ID NO: 302119 - protein, 9 aa, Homo Sapiens
ETNILSTST

SEQ ID NO: 302120 - protein, 9 aa, Homo Sapiens
LKRENNNLQ

SEQ ID NO: 302121 - protein, 9 aa, Homo Sapiens
IQDVKSIYL

SEQ ID NO: 302122 - protein, 9 aa, Homo Sapiens
NKIIRRVRL

SEQ ID NO: 302123 - protein, 9 aa, Homo Sapiens
AGIINRDLK

SEQ ID NO: 302124 - protein, 9 aa, Homo Sapiens
ALLHSVMTY

SEQ ID NO: 302125 - protein, 9 aa, Homo Sapiens
LCLIEQIDV

SEQ ID NO: 302126 - protein, 9 aa, Homo Sapiens
CSMVHAQLC

SEQ ID NO: 302127 - protein, 9 aa, Homo Sapiens
YHDVTLKNL

SEQ ID NO: 302128 - protein, 9 aa, Homo Sapiens
IVIQLMYTI

SEQ ID NO: 302129 - protein, 9 aa, Homo Sapiens
HELSGDKIL

SEQ ID NO: 302130 - protein, 9 aa, Homo Sapiens
LWVDNSTSV

SEQ ID NO: 302131 - protein, 9 aa, Homo Sapiens
KQWTALICS

SEQ ID NO: 302132 - protein, 9 aa, Homo Sapiens
TFVRKFILL

SEQ ID NO: 302133 - protein, 9 aa, Homo Sapiens
SSMQVLGDV

SEQ ID NO: 302134 - protein, 9 aa, Homo Sapiens
QSYEIQMLD

SEQ ID NO: 302135 - protein, 9 aa, Homo Sapiens
HRRSRLLLQ

SEQ ID NO: 302136 - protein, 9 aa, Homo Sapiens
FNVQEEANA

SEQ ID NO: 302137 - protein, 9 aa, Homo Sapiens
FSHHKITHS

SEQ ID NO: 302138 - protein, 9 aa, Homo Sapiens
YSCLDNKKV

SEQ ID NO: 302139 - protein, 9 aa, Homo Sapiens
TLKSSMDSR

SEQ ID NO: 302140 - protein, 9 aa, Homo Sapiens
KHGDDQPNS

SEQ ID NO: 302141 - protein, 9 aa, Homo Sapiens
TPSRDWRKK

SEQ ID NO: 302142 - protein, 9 aa, Homo Sapiens
YPSTPCQNC

SEQ ID NO: 302143 - protein, 9 aa, Homo Sapiens
SVGGLLLLT

SEQ ID NO: 302144 - protein, 9 aa, Homo Sapiens
VSNDITSIL

SEQ ID NO: 302145 - protein, 9 aa, Homo Sapiens
KKAAKVQEL

SEQ ID NO: 302146 - protein, 9 aa, Homo Sapiens
QGWNKRIKY

SEQ ID NO: 302147 - protein, 9 aa, Homo Sapiens
NHEPEFDYL

SEQ ID NO: 302148 - protein, 9 aa, Homo Sapiens
ELTVESLEA

SEQ ID NO: 302149 - protein, 9 aa, Homo Sapiens
LLGDLDTDI

SEQ ID NO: 302150 - protein, 9 aa, Homo Sapiens
LQDTSDESS

SEQ ID NO: 302151 - protein, 9 aa, Homo Sapiens
TTGKAATYN

SEQ ID NO: 302152 - protein, 9 aa, Homo Sapiens
DNTERFDSQ

SEQ ID NO: 302153 - protein, 9 aa, Homo Sapiens
EENISFSDD

SEQ ID NO: 302154 - protein, 9 aa, Homo Sapiens
KRDYTPSTT

SEQ ID NO: 302155 - protein, 9 aa, Homo Sapiens
NSRRSKLHY

SEQ ID NO: 302156 - protein, 9 aa, Homo Sapiens
TLLEYLEYE

SEQ ID NO: 302157 - protein, 9 aa, Homo Sapiens
QLDFDPDIV

SEQ ID NO: 302158 - protein, 9 aa, Homo Sapiens
TTLKKSKIE

SEQ ID NO: 302159 - protein, 9 aa, Homo Sapiens
HVNEIFQDE

SEQ ID NO: 302160 - protein, 9 aa, Homo Sapiens
DISDLTEQI

SEQ ID NO: 302161 - protein, 9 aa, Homo Sapiens
NSSRRVSED

SEQ ID NO: 302162 - protein, 9 aa, Homo Sapiens
QQTPSQTHK

SEQ ID NO: 302163 - protein, 9 aa, Homo Sapiens
ETCLSQDSS

SEQ ID NO: 302164 - protein, 9 aa, Homo Sapiens
KVDRYIEEL

SEQ ID NO: 302165 - protein, 9 aa, Homo Sapiens
WQEYYFFNV

SEQ ID NO: 302166 - protein, 9 aa, Homo Sapiens
NSIQAAQDL

SEQ ID NO: 302167 - protein, 9 aa, Homo Sapiens
KPREWIRHL

SEQ ID NO: 302168 - protein, 9 aa, Homo Sapiens
ALRPHVHTQ

SEQ ID NO: 302169 - protein, 9 aa, Homo Sapiens
LCCRTPVSP

SEQ ID NO: 302170 - protein, 9 aa, Homo Sapiens
NKYSSEDDI

SEQ ID NO: 302171 - protein, 9 aa, Homo Sapiens
FPFDKPRGT

SEQ ID NO: 302172 - protein, 9 aa, Homo Sapiens
ETTKGHDGS

SEQ ID NO: 302173 - protein, 9 aa, Homo Sapiens
THQISHTGE

SEQ ID NO: 302174 - protein, 9 aa, Homo Sapiens
ENITFSNLG

SEQ ID NO: 302175 - protein, 9 aa, Homo Sapiens
NLTCSVPWT

SEQ ID NO: 302176 - protein, 9 aa, Homo Sapiens
YVVSLSHDS

SEQ ID NO: 302177 - protein, 9 aa, Homo Sapiens
VLFIYTIYT

SEQ ID NO: 302178 - protein, 9 aa, Homo Sapiens
RTGESAPVL

SEQ ID NO: 302179 - protein, 9 aa, Homo Sapiens
HLRDSGILS

SEQ ID NO: 302180 - protein, 9 aa, Homo Sapiens
ASATLNVLA

SEQ ID NO: 302181 - protein, 9 aa, Homo Sapiens
KSEAAPKCA

SEQ ID NO: 302182 - protein, 9 aa, Homo Sapiens
ECGKDFTQN

SEQ ID NO: 302183 - protein, 9 aa, Homo Sapiens
SVTLVDPAA

SEQ ID NO: 302184 - protein, 9 aa, Homo Sapiens
IGKMSFTEK

SEQ ID NO: 302185 - protein, 9 aa, Homo Sapiens
QNAISSSYS

SEQ ID NO: 302186 - protein, 9 aa, Homo Sapiens
VATMKADLE

SEQ ID NO: 302187 - protein, 9 aa, Homo Sapiens
PYCSMVHAQ

SEQ ID NO: 302188 - protein, 9 aa, Homo Sapiens
TTIKWNDVT

SEQ ID NO: 302189 - protein, 9 aa, Homo Sapiens
NTDDMGLKT

SEQ ID NO: 302190 - protein, 9 aa, Homo Sapiens
SFYRTGQLF

SEQ ID NO: 302191 - protein, 9 aa, Homo Sapiens
CCLVSGNLT

SEQ ID NO: 302192 - protein, 9 aa, Homo Sapiens
YTVKAEIPE

SEQ ID NO: 302193 - protein, 9 aa, Homo Sapiens
NPGGGGLAY

SEQ ID NO: 302194 - protein, 9 aa, Homo Sapiens
IIYSIPFFF

SEQ ID NO: 302195 - protein, 9 aa, Homo Sapiens
NPKIHIKET

SEQ ID NO: 302196 - protein, 9 aa, Homo Sapiens
NGLPLEYQD

SEQ ID NO: 302197 - protein, 9 aa, Homo Sapiens
ERHRISHTE

SEQ ID NO: 302198 - protein, 9 aa, Homo Sapiens
EVLRAQKAT

SEQ ID NO: 302199 - protein, 9 aa, Homo Sapiens
YVYTRYRAG

SEQ ID NO: 302200 - protein, 9 aa, Homo Sapiens
PLVVPNLGV

SEQ ID NO: 302201 - protein, 9 aa, Homo Sapiens
LPASSSTQI

SEQ ID NO: 302202 - protein, 9 aa, Homo Sapiens
KLFNPHQHT

SEQ ID NO: 302203 - protein, 9 aa, Homo Sapiens
QEQEQSLVV

SEQ ID NO: 302204 - protein, 9 aa, Homo Sapiens
THKGNKIRF

SEQ ID NO: 302205 - protein, 9 aa, Homo Sapiens
SQFTGLKFP

SEQ ID NO: 302206 - protein, 9 aa, Homo Sapiens
PGKRAKPQM

SEQ ID NO: 302207 - protein, 9 aa, Homo Sapiens
WATLAQRLG

SEQ ID NO: 302208 - protein, 9 aa, Homo Sapiens
GRQCPWGVA

SEQ ID NO: 302209 - protein, 9 aa, Homo Sapiens
YYLYRSKSR

SEQ ID NO: 302210 - protein, 9 aa, Homo Sapiens
DHLSCTPLM

SEQ ID NO: 302211 - protein, 9 aa, Homo Sapiens
CITNIEFLP

SEQ ID NO: 302212 - protein, 9 aa, Homo Sapiens
SLLAEPQEL

SEQ ID NO: 302213 - protein, 9 aa, Homo Sapiens
IYCKGCYAN

SEQ ID NO: 302214 - protein, 9 aa, Homo Sapiens
AVEKDYFQA

SEQ ID NO: 302215 - protein, 9 aa, Homo Sapiens
LMRDMQQME

SEQ ID NO: 302216 - protein, 9 aa, Homo Sapiens
LEIKRRSHL

SEQ ID NO: 302217 - protein, 9 aa, Homo Sapiens
EMIGFKNFY

SEQ ID NO: 302218 - protein, 9 aa, Homo Sapiens
VVILVLSAV

SEQ ID NO: 302219 - protein, 9 aa, Homo Sapiens
RFNSELAHE

SEQ ID NO: 302220 - protein, 9 aa, Homo Sapiens
CIMFDSDWN

SEQ ID NO: 302221 - protein, 9 aa, Homo Sapiens
SSLEDHIQM

SEQ ID NO: 302222 - protein, 9 aa, Homo Sapiens
QCETGYELE

SEQ ID NO: 302223 - protein, 9 aa, Homo Sapiens
EIPRWTNAN

SEQ ID NO: 302224 - protein, 9 aa, Homo Sapiens
AASPSELNL

SEQ ID NO: 302225 - protein, 9 aa, Homo Sapiens
RKGGNDSSK

SEQ ID NO: 302226 - protein, 9 aa, Homo Sapiens
TYSNSRPCK

SEQ ID NO: 302227 - protein, 9 aa, Homo Sapiens
SVPFKYVDS

SEQ ID NO: 302228 - protein, 9 aa, Homo Sapiens
LREEQIIHQ

SEQ ID NO: 302229 - protein, 9 aa, Homo Sapiens
SEKQICGAH

SEQ ID NO: 302230 - protein, 9 aa, Homo Sapiens
DLKQRLCQQ

SEQ ID NO: 302231 - protein, 9 aa, Homo Sapiens
LINNCSETQ

SEQ ID NO: 302232 - protein, 9 aa, Homo Sapiens
LAPHLQGEA

SEQ ID NO: 302233 - protein, 9 aa, Homo Sapiens
AERCLPRMA

SEQ ID NO: 302234 - protein, 9 aa, Homo Sapiens
FGIDMKDKL

SEQ ID NO: 302235 - protein, 9 aa, Homo Sapiens
INNLREVRG

SEQ ID NO: 302236 - protein, 9 aa, Homo Sapiens
DLRTFQSVL

SEQ ID NO: 302237 - protein, 9 aa, Homo Sapiens
CLSQDSSTT

SEQ ID NO: 302238 - protein, 9 aa, Homo Sapiens
VLPCFGLGQ

SEQ ID NO: 302239 - protein, 9 aa, Homo Sapiens
DFLGLGNFT

SEQ ID NO: 302240 - protein, 9 aa, Homo Sapiens
EDEIEHLQN

SEQ ID NO: 302241 - protein, 9 aa, Homo Sapiens
KKVYLKALL

SEQ ID NO: 302242 - protein, 9 aa, Homo Sapiens
ETFSLIQDS

SEQ ID NO: 302243 - protein, 9 aa, Homo Sapiens
TEGDISFPG

SEQ ID NO: 302244 - protein, 9 aa, Homo Sapiens
ADGKHQDLK

SEQ ID NO: 302245 - protein, 9 aa, Homo Sapiens
INLSMSCLD

SEQ ID NO: 302246 - protein, 9 aa, Homo Sapiens
QKDREAELR

SEQ ID NO: 302247 - protein, 9 aa, Homo Sapiens
NSRELNSGN

SEQ ID NO: 302248 - protein, 9 aa, Homo Sapiens
SILGTNEHI

SEQ ID NO: 302249 - protein, 9 aa, Homo Sapiens
NYPFPVHPG

SEQ ID NO: 302250 - protein, 9 aa, Homo Sapiens
SAGLILGGK

SEQ ID NO: 302251 - protein, 9 aa, Homo Sapiens
LEDHIQMKQ

SEQ ID NO: 302252 - protein, 9 aa, Homo Sapiens
DKFHSNSDC

SEQ ID NO: 302253 - protein, 9 aa, Homo Sapiens
NKYVFQLTH

SEQ ID NO: 302254 - protein, 9 aa, Homo Sapiens
QMSPSHLST

SEQ ID NO: 302255 - protein, 9 aa, Homo Sapiens
GNKLYWAVL

SEQ ID NO: 302256 - protein, 9 aa, Homo Sapiens
KDSIRTLWL

SEQ ID NO: 302257 - protein, 9 aa, Homo Sapiens
VFLKALYGN

SEQ ID NO: 302258 - protein, 9 aa, Homo Sapiens
EDNLLEEPE

SEQ ID NO: 302259 - protein, 9 aa, Homo Sapiens
DLVSKKIQR

SEQ ID NO: 302260 - protein, 9 aa, Homo Sapiens
KETRFKWFF

SEQ ID NO: 302261 - protein, 9 aa, Homo Sapiens
TGEKPFWCT

SEQ ID NO: 302262 - protein, 9 aa, Homo Sapiens
SGPPEPPGK

SEQ ID NO: 302263 - protein, 9 aa, Homo Sapiens
CPMCMNYFI

SEQ ID NO: 302264 - protein, 9 aa, Homo Sapiens
QGTCFYLGE

SEQ ID NO: 302265 - protein, 9 aa, Homo Sapiens
LIRLQCNHT

SEQ ID NO: 302266 - protein, 9 aa, Homo Sapiens
TIPGIHILT

SEQ ID NO: 302267 - protein, 9 aa, Homo Sapiens
CKQLRTLDL

SEQ ID NO: 302268 - protein, 9 aa, Homo Sapiens
IDINNCDGK

SEQ ID NO: 302269 - protein, 9 aa, Homo Sapiens
KSANKVKTP

SEQ ID NO: 302270 - protein, 9 aa, Homo Sapiens
QGEDQEHLV

SEQ ID NO: 302271 - protein, 9 aa, Homo Sapiens
IPGEMVTLG

SEQ ID NO: 302272 - protein, 9 aa, Homo Sapiens
ADVYISIHG

SEQ ID NO: 302273 - protein, 9 aa, Homo Sapiens
EQGQALVSE

SEQ ID NO: 302274 - protein, 9 aa, Homo Sapiens
RSSPKLFPV

SEQ ID NO: 302275 - protein, 9 aa, Homo Sapiens
LDLRQEGEF

SEQ ID NO: 302276 - protein, 9 aa, Homo Sapiens
PKCRALTHL

SEQ ID NO: 302277 - protein, 9 aa, Homo Sapiens
MYVAGFAET

SEQ ID NO: 302278 - protein, 9 aa, Homo Sapiens
KAAPAHRRL

SEQ ID NO: 302279 - protein, 9 aa, Homo Sapiens
TPPKIIFCD

SEQ ID NO: 302280 - protein, 9 aa, Homo Sapiens
DKRKDVSFQ

SEQ ID NO: 302281 - protein, 9 aa, Homo Sapiens
CLAIDDDNK

SEQ ID NO: 302282 - protein, 9 aa, Homo Sapiens
FKKEDLTDE

SEQ ID NO: 302283 - protein, 9 aa, Homo Sapiens
NKAPIQTYV

SEQ ID NO: 302284 - protein, 9 aa, Homo Sapiens
NAILQIDNA

SEQ ID NO: 302285 - protein, 9 aa, Homo Sapiens
KQTVPLLKK

SEQ ID NO: 302286 - protein, 9 aa, Homo Sapiens
KLINAEELV

SEQ ID NO: 302287 - protein, 9 aa, Homo Sapiens
PEPLNSRRS

SEQ ID NO: 302288 - protein, 9 aa, Homo Sapiens
RHKLKLRVS

SEQ ID NO: 302289 - protein, 9 aa, Homo Sapiens
PEFPLSSHQ

SEQ ID NO: 302290 - protein, 9 aa, Homo Sapiens
NKKELITVF

SEQ ID NO: 302291 - protein, 9 aa, Homo Sapiens
TFLVKIPEE

SEQ ID NO: 302292 - protein, 9 aa, Homo Sapiens
KGTILHFLQ

SEQ ID NO: 302293 - protein, 9 aa, Homo Sapiens
LLEYLEYEK

SEQ ID NO: 302294 - protein, 9 aa, Homo Sapiens
QLDDEIKLR

SEQ ID NO: 302295 - protein, 9 aa, Homo Sapiens
KQIGLLLNK

SEQ ID NO: 302296 - protein, 9 aa, Homo Sapiens
KRLVIRDKN

SEQ ID NO: 302297 - protein, 9 aa, Homo Sapiens
PANLLSTKD

SEQ ID NO: 302298 - protein, 9 aa, Homo Sapiens
VAGFAETVV

SEQ ID NO: 302299 - protein, 9 aa, Homo Sapiens
DEGRTKKGV

SEQ ID NO: 302300 - protein, 9 aa, Homo Sapiens
FLKALYGNA

SEQ ID NO: 302301 - protein, 9 aa, Homo Sapiens
EDFHKKFAL

SEQ ID NO: 302302 - protein, 9 aa, Homo Sapiens
FVNRPNKKK

SEQ ID NO: 302303 - protein, 9 aa, Homo Sapiens
AYRFKTVTS

SEQ ID NO: 302304 - protein, 9 aa, Homo Sapiens
LLFYVVILV

SEQ ID NO: 302305 - protein, 9 aa, Homo Sapiens
LGNYPPFKG

SEQ ID NO: 302306 - protein, 9 aa, Homo Sapiens
PLKEDSEVS

SEQ ID NO: 302307 - protein, 9 aa, Homo Sapiens
TTSDVNSSV

SEQ ID NO: 302308 - protein, 9 aa, Homo Sapiens
DEFYFMEDS

SEQ ID NO: 302309 - protein, 9 aa, Homo Sapiens
QFWYLLESK

SEQ ID NO: 302310 - protein, 9 aa, Homo Sapiens
QLVFGNQFG

SEQ ID NO: 302311 - protein, 9 aa, Homo Sapiens
GKISQRIMP

SEQ ID NO: 302312 - protein, 9 aa, Homo Sapiens
QVSGGQIIT

SEQ ID NO: 302313 - protein, 9 aa, Homo Sapiens
PSLSLFFVF

SEQ ID NO: 302314 - protein, 9 aa, Homo Sapiens
QGHKQQLIK

SEQ ID NO: 302315 - protein, 9 aa, Homo Sapiens
ALLIQALST

SEQ ID NO: 302316 - protein, 9 aa, Homo Sapiens
CSLMYHLLN

SEQ ID NO: 302317 - protein, 9 aa, Homo Sapiens
PKAQKKLKR

SEQ ID NO: 302318 - protein, 9 aa, Homo Sapiens
DFKNTADQL

SEQ ID NO: 302319 - protein, 9 aa, Homo Sapiens
RKAASHNSS

SEQ ID NO: 302320 - protein, 9 aa, Homo Sapiens
WRSQLEQKK

SEQ ID NO: 302321 - protein, 9 aa, Homo Sapiens
LPLEYQDKL

SEQ ID NO: 302322 - protein, 9 aa, Homo Sapiens
TMPPKIHYE

SEQ ID NO: 302323 - protein, 9 aa, Homo Sapiens
GWNKSEGSP

SEQ ID NO: 302324 - protein, 9 aa, Homo Sapiens
SDLRLVDSD

SEQ ID NO: 302325 - protein, 9 aa, Homo Sapiens
SIFGSSRVQ

SEQ ID NO: 302326 - protein, 9 aa, Homo Sapiens
SSKSFINST

SEQ ID NO: 302327 - protein, 9 aa, Homo Sapiens
QERPSYVLT

SEQ ID NO: 302328 - protein, 9 aa, Homo Sapiens
IYKYSPFTT

SEQ ID NO: 302329 - protein, 9 aa, Homo Sapiens
MLNKSVAQI

SEQ ID NO: 302330 - protein, 9 aa, Homo Sapiens
FEYFQIRPH

SEQ ID NO: 302331 - protein, 9 aa, Homo Sapiens
LGAAQPLFL

SEQ ID NO: 302332 - protein, 9 aa, Homo Sapiens
STKKRRIRG

SEQ ID NO: 302333 - protein, 9 aa, Homo Sapiens
SPTGSKDVK

SEQ ID NO: 302334 - protein, 9 aa, Homo Sapiens
QQSKTVDDN

SEQ ID NO: 302335 - protein, 9 aa, Homo Sapiens
ISLNELTSK

SEQ ID NO: 302336 - protein, 9 aa, Homo Sapiens
KIHSEGFIS

SEQ ID NO: 302337 - protein, 9 aa, Homo Sapiens
PPGWQPNQK

SEQ ID NO: 302338 - protein, 9 aa, Homo Sapiens
LFEMHDKLS

SEQ ID NO: 302339 - protein, 9 aa, Homo Sapiens
MEPNVLPFR

SEQ ID NO: 302340 - protein, 9 aa, Homo Sapiens
STVKDSLIK

SEQ ID NO: 302341 - protein, 9 aa, Homo Sapiens
IARLFTNLN

SEQ ID NO: 302342 - protein, 9 aa, Homo Sapiens
QKRMNKQHS

SEQ ID NO: 302343 - protein, 9 aa, Homo Sapiens
LNTILDVVE

SEQ ID NO: 302344 - protein, 9 aa, Homo Sapiens
QYISLGIPK

SEQ ID NO: 302345 - protein, 9 aa, Homo Sapiens
YIIYNYHGI

SEQ ID NO: 302346 - protein, 9 aa, Homo Sapiens
LFDNPRRYD

SEQ ID NO: 302347 - protein, 9 aa, Homo Sapiens
QLLHVKGLF

SEQ ID NO: 302348 - protein, 9 aa, Homo Sapiens
SRAENNRLW

SEQ ID NO: 302349 - protein, 9 aa, Homo Sapiens
IPGVQGIMG

SEQ ID NO: 302350 - protein, 9 aa, Homo Sapiens
SNKGVSVLI

SEQ ID NO: 302351 - protein, 9 aa, Homo Sapiens
EFEAEQEII

SEQ ID NO: 302352 - protein, 9 aa, Homo Sapiens
YASVECLLE

SEQ ID NO: 302353 - protein, 9 aa, Homo Sapiens
ALGYVARFY

SEQ ID NO: 302354 - protein, 9 aa, Homo Sapiens
YVGKRVQIW

SEQ ID NO: 302355 - protein, 9 aa, Homo Sapiens
LFKKSEQEK

SEQ ID NO: 302356 - protein, 9 aa, Homo Sapiens
GYIVSVIDM

SEQ ID NO: 302357 - protein, 9 aa, Homo Sapiens
KHLNYLGNL

SEQ ID NO: 302358 - protein, 9 aa, Homo Sapiens
KPQSLELLN

SEQ ID NO: 302359 - protein, 9 aa, Homo Sapiens
IEPSIYIPE

SEQ ID NO: 302360 - protein, 9 aa, Homo Sapiens
GNQIIYTLQ

SEQ ID NO: 302361 - protein, 9 aa, Homo Sapiens
NTSQTLKNS

SEQ ID NO: 302362 - protein, 9 aa, Homo Sapiens
SQLIQCVVH

SEQ ID NO: 302363 - protein, 9 aa, Homo Sapiens
PATAAGSAM

SEQ ID NO: 302364 - protein, 9 aa, Homo Sapiens
CEEIINLPI

SEQ ID NO: 302365 - protein, 9 aa, Homo Sapiens
MLNWAEGSL

SEQ ID NO: 302366 - protein, 9 aa, Homo Sapiens
QLAKEVAKQ

SEQ ID NO: 302367 - protein, 9 aa, Homo Sapiens
NLNIWNIET

SEQ ID NO: 302368 - protein, 9 aa, Homo Sapiens
SYTHGLNIT

SEQ ID NO: 302369 - protein, 9 aa, Homo Sapiens
IIPQELWEM

SEQ ID NO: 302370 - protein, 9 aa, Homo Sapiens
APHLQGEAS

SEQ ID NO: 302371 - protein, 9 aa, Homo Sapiens
ANKSRVQMR

SEQ ID NO: 302372 - protein, 9 aa, Homo Sapiens
LYAIKNASL

SEQ ID NO: 302373 - protein, 9 aa, Homo Sapiens
KFMNKLAEE

SEQ ID NO: 302374 - protein, 9 aa, Homo Sapiens
KEDNCMVNN

SEQ ID NO: 302375 - protein, 9 aa, Homo Sapiens
HTTRSRQDQ

SEQ ID NO: 302376 - protein, 9 aa, Homo Sapiens
IKVHWTVDQ

SEQ ID NO: 302377 - protein, 9 aa, Homo Sapiens
IVTCTRVEN

SEQ ID NO: 302378 - protein, 9 aa, Homo Sapiens
IKRNARIIK

SEQ ID NO: 302379 - protein, 9 aa, Homo Sapiens
NEIFQDEKN

SEQ ID NO: 302380 - protein, 9 aa, Homo Sapiens
VNSEKLTTL

SEQ ID NO: 302381 - protein, 9 aa, Homo Sapiens
YFGLKKDNV

SEQ ID NO: 302382 - protein, 9 aa, Homo Sapiens
IFSPVMLLL

SEQ ID NO: 302383 - protein, 9 aa, Homo Sapiens
DLAQPDPEV

SEQ ID NO: 302384 - protein, 9 aa, Homo Sapiens
SDGKRIEDS

SEQ ID NO: 302385 - protein, 9 aa, Homo Sapiens
EQIVRVKED

SEQ ID NO: 302386 - protein, 9 aa, Homo Sapiens
KPAQYGFAL

SEQ ID NO: 302387 - protein, 9 aa, Homo Sapiens
TAIAVKVNP

SEQ ID NO: 302388 - protein, 9 aa, Homo Sapiens
QKNKYVFQL

SEQ ID NO: 302389 - protein, 9 aa, Homo Sapiens
SLRASPAHS

SEQ ID NO: 302390 - protein, 9 aa, Homo Sapiens
KVKPFNQND

SEQ ID NO: 302391 - protein, 9 aa, Homo Sapiens
IKFYSAPVP

SEQ ID NO: 302392 - protein, 9 aa, Homo Sapiens
ATFNEVQSQ

SEQ ID NO: 302393 - protein, 9 aa, Homo Sapiens
SNHPVCRHF

SEQ ID NO: 302394 - protein, 9 aa, Homo Sapiens
HLGLEKKEE

SEQ ID NO: 302395 - protein, 9 aa, Homo Sapiens
RNYIVPIIW

SEQ ID NO: 302396 - protein, 9 aa, Homo Sapiens
NCMQESMAQ

SEQ ID NO: 302397 - protein, 9 aa, Homo Sapiens
VGTKTINSI

SEQ ID NO: 302398 - protein, 9 aa, Homo Sapiens
NYLNQAVVS

SEQ ID NO: 302399 - protein, 9 aa, Homo Sapiens
TGMDKGISS

SEQ ID NO: 302400 - protein, 9 aa, Homo Sapiens
YFFSNTFGR

SEQ ID NO: 302401 - protein, 9 aa, Homo Sapiens
EDTWVVEML

SEQ ID NO: 302402 - protein, 9 aa, Homo Sapiens
VGCCSEQQE

SEQ ID NO: 302403 - protein, 9 aa, Homo Sapiens
SLFLVRHFC

SEQ ID NO: 302404 - protein, 9 aa, Homo Sapiens
SPNVLKMIR

SEQ ID NO: 302405 - protein, 9 aa, Homo Sapiens
RHRIIHNGE

SEQ ID NO: 302406 - protein, 9 aa, Homo Sapiens
QLKMSQGNI

SEQ ID NO: 302407 - protein, 9 aa, Homo Sapiens
CKIFVMLFY

SEQ ID NO: 302408 - protein, 9 aa, Homo Sapiens
SSQAKAVIT

SEQ ID NO: 302409 - protein, 9 aa, Homo Sapiens
MWEVGYPLY

SEQ ID NO: 302410 - protein, 9 aa, Homo Sapiens
HLSCTPLMW

SEQ ID NO: 302411 - protein, 9 aa, Homo Sapiens
FMQFCANKL

SEQ ID NO: 302412 - protein, 9 aa, Homo Sapiens
LVAQMPVYS

SEQ ID NO: 302413 - protein, 9 aa, Homo Sapiens
LFLPEEEDG

SEQ ID NO: 302414 - protein, 9 aa, Homo Sapiens
TLENTYGNY

SEQ ID NO: 302415 - protein, 9 aa, Homo Sapiens
HLKEKTGKC

SEQ ID NO: 302416 - protein, 9 aa, Homo Sapiens
LLSRANILV

SEQ ID NO: 302417 - protein, 9 aa, Homo Sapiens
PSSAHAGLF

SEQ ID NO: 302418 - protein, 9 aa, Homo Sapiens
TDNLLLYEK

SEQ ID NO: 302419 - protein, 9 aa, Homo Sapiens
YCNCDADWN

SEQ ID NO: 302420 - protein, 9 aa, Homo Sapiens
REQPESLQA

SEQ ID NO: 302421 - protein, 9 aa, Homo Sapiens
TEDATYVNN

SEQ ID NO: 302422 - protein, 9 aa, Homo Sapiens
YFIPSQLCE

SEQ ID NO: 302423 - protein, 9 aa, Homo Sapiens
ETEENENKS

SEQ ID NO: 302424 - protein, 9 aa, Homo Sapiens
YPGQITTLT

SEQ ID NO: 302425 - protein, 9 aa, Homo Sapiens
VGDNRVILL

SEQ ID NO: 302426 - protein, 9 aa, Homo Sapiens
LPSPIYLEQ

SEQ ID NO: 302427 - protein, 9 aa, Homo Sapiens
VEMLKMFMS

SEQ ID NO: 302428 - protein, 9 aa, Homo Sapiens
AMYVAGFAE

SEQ ID NO: 302429 - protein, 9 aa, Homo Sapiens
FKNMVKTVQ

SEQ ID NO: 302430 - protein, 9 aa, Homo Sapiens
MLYKMLSEK

SEQ ID NO: 302431 - protein, 9 aa, Homo Sapiens
EGEKDHKVC

SEQ ID NO: 302432 - protein, 9 aa, Homo Sapiens
NSSSLKSRG

SEQ ID NO: 302433 - protein, 9 aa, Homo Sapiens
GKACISTGP

SEQ ID NO: 302434 - protein, 9 aa, Homo Sapiens
NSCNKQQRA

SEQ ID NO: 302435 - protein, 9 aa, Homo Sapiens
VLSEYVKTM

SEQ ID NO: 302436 - protein, 9 aa, Homo Sapiens
RVPGNRSLF

SEQ ID NO: 302437 - protein, 9 aa, Homo Sapiens
QRFEDKCYG

SEQ ID NO: 302438 - protein, 9 aa, Homo Sapiens
RNFDNSYQN

SEQ ID NO: 302439 - protein, 9 aa, Homo Sapiens
GRSDADKQL

SEQ ID NO: 302440 - protein, 9 aa, Homo Sapiens
YLNPELIFK

SEQ ID NO: 302441 - protein, 9 aa, Homo Sapiens
PQLDFDPDI

SEQ ID NO: 302442 - protein, 9 aa, Homo Sapiens
KKLEQHIQK

SEQ ID NO: 302443 - protein, 9 aa, Homo Sapiens
AKCYETKGE

SEQ ID NO: 302444 - protein, 9 aa, Homo Sapiens
PQRITYLHT

SEQ ID NO: 302445 - protein, 9 aa, Homo Sapiens
TFTNTYQAF

SEQ ID NO: 302446 - protein, 9 aa, Homo Sapiens
FSSHFNNVH

SEQ ID NO: 302447 - protein, 9 aa, Homo Sapiens
AEEEKSVSE

SEQ ID NO: 302448 - protein, 9 aa, Homo Sapiens
TLFKTEKML

SEQ ID NO: 302449 - protein, 9 aa, Homo Sapiens
SIENGTGTI

SEQ ID NO: 302450 - protein, 9 aa, Homo Sapiens
KIQEDDLNN

SEQ ID NO: 302451 - protein, 9 aa, Homo Sapiens
LHPSLEEEN

SEQ ID NO: 302452 - protein, 9 aa, Homo Sapiens
CRCKQGYII

SEQ ID NO: 302453 - protein, 9 aa, Homo Sapiens
SPSGPGVAV

SEQ ID NO: 302454 - protein, 9 aa, Homo Sapiens
EAHTEVFPG

SEQ ID NO: 302455 - protein, 9 aa, Homo Sapiens
RQLDKVPEK

SEQ ID NO: 302456 - protein, 9 aa, Homo Sapiens
NFQLKGCRS

SEQ ID NO: 302457 - protein, 9 aa, Homo Sapiens
ILYGTLIFM

SEQ ID NO: 302458 - protein, 9 aa, Homo Sapiens
RPNKKKILF

SEQ ID NO: 302459 - protein, 9 aa, Homo Sapiens
NLWRSQLEQ

SEQ ID NO: 302460 - protein, 9 aa, Homo Sapiens
FIQINTKGE

SEQ ID NO: 302461 - protein, 9 aa, Homo Sapiens
PGATAKGLY

SEQ ID NO: 302462 - protein, 9 aa, Homo Sapiens
PSSVAQANR

SEQ ID NO: 302463 - protein, 9 aa, Homo Sapiens
QCCIVYLQY

SEQ ID NO: 302464 - protein, 9 aa, Homo Sapiens
LSNSRELNS

SEQ ID NO: 302465 - protein, 9 aa, Homo Sapiens
PTPNPPILS

SEQ ID NO: 302466 - protein, 9 aa, Homo Sapiens
NYILWCVNH

SEQ ID NO: 302467 - protein, 9 aa, Homo Sapiens
MMKLSLGSL

SEQ ID NO: 302468 - protein, 9 aa, Homo Sapiens
NKYFSLDHM

SEQ ID NO: 302469 - protein, 9 aa, Homo Sapiens
SDTPEICKY

SEQ ID NO: 302470 - protein, 9 aa, Homo Sapiens
IFNEYIYLV

SEQ ID NO: 302471 - protein, 9 aa, Homo Sapiens
PSSPIIENA

SEQ ID NO: 302472 - protein, 9 aa, Homo Sapiens
ERQIILAVQ

SEQ ID NO: 302473 - protein, 9 aa, Homo Sapiens
GDIPQIPDS

SEQ ID NO: 302474 - protein, 9 aa, Homo Sapiens
HFEHIIYQM

SEQ ID NO: 302475 - protein, 9 aa, Homo Sapiens
KTSFELSGA

SEQ ID NO: 302476 - protein, 9 aa, Homo Sapiens
AAKETKVKE

SEQ ID NO: 302477 - protein, 9 aa, Homo Sapiens
CFVCGMENG

SEQ ID NO: 302478 - protein, 9 aa, Homo Sapiens
NKSTLARIS

SEQ ID NO: 302479 - protein, 9 aa, Homo Sapiens
DPASAPRNV

SEQ ID NO: 302480 - protein, 9 aa, Homo Sapiens
STYLPGEPE

SEQ ID NO: 302481 - protein, 9 aa, Homo Sapiens
LTPGICLVS

SEQ ID NO: 302482 - protein, 9 aa, Homo Sapiens
HIKSAGYKV

SEQ ID NO: 302483 - protein, 9 aa, Homo Sapiens
AAAPGRTTT

SEQ ID NO: 302484 - protein, 9 aa, Homo Sapiens
EGVIDLSAA

SEQ ID NO: 302485 - protein, 9 aa, Homo Sapiens
GVACSYGWV

SEQ ID NO: 302486 - protein, 9 aa, Homo Sapiens
SVAQIGGRL

SEQ ID NO: 302487 - protein, 9 aa, Homo Sapiens
RTHTGDKPF

SEQ ID NO: 302488 - protein, 9 aa, Homo Sapiens
LEYKTEDGE

SEQ ID NO: 302489 - protein, 9 aa, Homo Sapiens
HKVCLAIGN

SEQ ID NO: 302490 - protein, 9 aa, Homo Sapiens
TIVTVLNYY

SEQ ID NO: 302491 - protein, 9 aa, Homo Sapiens
GVSLAEPEA

SEQ ID NO: 302492 - protein, 9 aa, Homo Sapiens
GFPFLDNDF

SEQ ID NO: 302493 - protein, 9 aa, Homo Sapiens
CLSLELFGR

SEQ ID NO: 302494 - protein, 9 aa, Homo Sapiens
GIKARWSVR

SEQ ID NO: 302495 - protein, 9 aa, Homo Sapiens
KDTKIIHMR

SEQ ID NO: 302496 - protein, 9 aa, Homo Sapiens
VINVTSELE

SEQ ID NO: 302497 - protein, 9 aa, Homo Sapiens
KTINSIQAA

SEQ ID NO: 302498 - protein, 9 aa, Homo Sapiens
PHSNSLGAG

SEQ ID NO: 302499 - protein, 9 aa, Homo Sapiens
FEDNEFIDA

SEQ ID NO: 302500 - protein, 9 aa, Homo Sapiens
HITYNNLSD

SEQ ID NO: 302501 - protein, 9 aa, Homo Sapiens
QAVSLLGPN

SEQ ID NO: 302502 - protein, 9 aa, Homo Sapiens
VCGRKALTL

SEQ ID NO: 302503 - protein, 9 aa, Homo Sapiens
SVRSGLFGQ

SEQ ID NO: 302504 - protein, 9 aa, Homo Sapiens
ADYRLRRFE

SEQ ID NO: 302505 - protein, 9 aa, Homo Sapiens
YVFLFTNLK

SEQ ID NO: 302506 - protein, 9 aa, Homo Sapiens
FAASPSELN

SEQ ID NO: 302507 - protein, 9 aa, Homo Sapiens
KDLLKKNSL

SEQ ID NO: 302508 - protein, 9 aa, Homo Sapiens
SSIFAFPVY

SEQ ID NO: 302509 - protein, 9 aa, Homo Sapiens
RYVAKHRLV

SEQ ID NO: 302510 - protein, 9 aa, Homo Sapiens
LLFGLLVES

SEQ ID NO: 302511 - protein, 9 aa, Homo Sapiens
FQTYVTVGP

SEQ ID NO: 302512 - protein, 9 aa, Homo Sapiens
PTDKVLADT

SEQ ID NO: 302513 - protein, 9 aa, Homo Sapiens
KQNLILQNQ

SEQ ID NO: 302514 - protein, 9 aa, Homo Sapiens
SEAQSHSSA

SEQ ID NO: 302515 - protein, 9 aa, Homo Sapiens
DFPCPEKCA

SEQ ID NO: 302516 - protein, 9 aa, Homo Sapiens
ERMVEDSLA

SEQ ID NO: 302517 - protein, 9 aa, Homo Sapiens
MNLLRQQNV

SEQ ID NO: 302518 - protein, 9 aa, Homo Sapiens
KDHCMKLMQ

SEQ ID NO: 302519 - protein, 9 aa, Homo Sapiens
TAGSQSSHG

SEQ ID NO: 302520 - protein, 9 aa, Homo Sapiens
MRKPAQYGF

SEQ ID NO: 302521 - protein, 9 aa, Homo Sapiens
EFSSHFNNV

SEQ ID NO: 302522 - protein, 9 aa, Homo Sapiens
IPNNLVGCI

SEQ ID NO: 302523 - protein, 9 aa, Homo Sapiens
PGRKRTKHK

SEQ ID NO: 302524 - protein, 9 aa, Homo Sapiens
TTQCQITNE

SEQ ID NO: 302525 - protein, 9 aa, Homo Sapiens
QEQTTDNIF

SEQ ID NO: 302526 - protein, 9 aa, Homo Sapiens
KLILSTSLP

SEQ ID NO: 302527 - protein, 9 aa, Homo Sapiens
NLESQIKCG

SEQ ID NO: 302528 - protein, 9 aa, Homo Sapiens
YLQKYHNTI

SEQ ID NO: 302529 - protein, 9 aa, Homo Sapiens
QYFSDTFNH

SEQ ID NO: 302530 - protein, 9 aa, Homo Sapiens
TSTQQVYFF

SEQ ID NO: 302531 - protein, 9 aa, Homo Sapiens
IIMTPRLCA

SEQ ID NO: 302532 - protein, 9 aa, Homo Sapiens
RPKGLPRDW

SEQ ID NO: 302533 - protein, 9 aa, Homo Sapiens
CNNKLYQPD

SEQ ID NO: 302534 - protein, 9 aa, Homo Sapiens
PEEQEEYKN

SEQ ID NO: 302535 - protein, 9 aa, Homo Sapiens
TCIMFDSDW

SEQ ID NO: 302536 - protein, 9 aa, Homo Sapiens
FRTQAGMIP

SEQ ID NO: 302537 - protein, 9 aa, Homo Sapiens
LIYTVPWIN

SEQ ID NO: 302538 - protein, 9 aa, Homo Sapiens
VSKKIQRKL

SEQ ID NO: 302539 - protein, 9 aa, Homo Sapiens
ENGTGTIYS

SEQ ID NO: 302540 - protein, 9 aa, Homo Sapiens
QFDFMGLIN

SEQ ID NO: 302541 - protein, 9 aa, Homo Sapiens
GNEYPTPQS

SEQ ID NO: 302542 - protein, 9 aa, Homo Sapiens
GEVQAILRI

SEQ ID NO: 302543 - protein, 9 aa, Homo Sapiens
VWHIQFTAN

SEQ ID NO: 302544 - protein, 9 aa, Homo Sapiens
SPALQVLRD

SEQ ID NO: 302545 - protein, 9 aa, Homo Sapiens
TKNDLFLVV

SEQ ID NO: 302546 - protein, 9 aa, Homo Sapiens
EDNIINEDC

SEQ ID NO: 302547 - protein, 9 aa, Homo Sapiens
KMKSTLISA

SEQ ID NO: 302548 - protein, 9 aa, Homo Sapiens
AEKKLFTVS

SEQ ID NO: 302549 - protein, 9 aa, Homo Sapiens
ELIFQYLPD

SEQ ID NO: 302550 - protein, 9 aa, Homo Sapiens
YSESFCNAS

SEQ ID NO: 302551 - protein, 9 aa, Homo Sapiens
PGICPHVAQ

SEQ ID NO: 302552 - protein, 9 aa, Homo Sapiens
YDTHNILEL

SEQ ID NO: 302553 - protein, 9 aa, Homo Sapiens
RKSAKDKKS

SEQ ID NO: 302554 - protein, 9 aa, Homo Sapiens
NKSKKLKGE

SEQ ID NO: 302555 - protein, 9 aa, Homo Sapiens
EKHLNYLGN

SEQ ID NO: 302556 - protein, 9 aa, Homo Sapiens
IKKYFFGLD

SEQ ID NO: 302557 - protein, 9 aa, Homo Sapiens
KANYIKQRK

SEQ ID NO: 302558 - protein, 9 aa, Homo Sapiens
SDFTQEILP

SEQ ID NO: 302559 - protein, 9 aa, Homo Sapiens
FYVVSLSHD

SEQ ID NO: 302560 - protein, 9 aa, Homo Sapiens
PGKMKGIKA

SEQ ID NO: 302561 - protein, 9 aa, Homo Sapiens
YGLKLTTNY

SEQ ID NO: 302562 - protein, 9 aa, Homo Sapiens
WSVDPASVG

SEQ ID NO: 302563 - protein, 9 aa, Homo Sapiens
YLFTGSSQL

SEQ ID NO: 302564 - protein, 9 aa, Homo Sapiens
LCSEIAYDP

SEQ ID NO: 302565 - protein, 9 aa, Homo Sapiens
TGGVLGDSC

SEQ ID NO: 302566 - protein, 9 aa, Homo Sapiens
KQKNKQNIS

SEQ ID NO: 302567 - protein, 9 aa, Homo Sapiens
SSLLQNENG

SEQ ID NO: 302568 - protein, 9 aa, Homo Sapiens
QVWQQLKKL

SEQ ID NO: 302569 - protein, 9 aa, Homo Sapiens
IIQSSIPEG

SEQ ID NO: 302570 - protein, 9 aa, Homo Sapiens
KIYLRLKRA

SEQ ID NO: 302571 - protein, 9 aa, Homo Sapiens
LLSANSIGA

SEQ ID NO: 302572 - protein, 9 aa, Homo Sapiens
FIHLFANIH

SEQ ID NO: 302573 - protein, 9 aa, Homo Sapiens
TLLRHYWNP

SEQ ID NO: 302574 - protein, 9 aa, Homo Sapiens
KQVKDNLLS

SEQ ID NO: 302575 - protein, 9 aa, Homo Sapiens
QKCLVFQGT

SEQ ID NO: 302576 - protein, 9 aa, Homo Sapiens
EEIESLKKQ

SEQ ID NO: 302577 - protein, 9 aa, Homo Sapiens
TDLIFLTLT

SEQ ID NO: 302578 - protein, 9 aa, Homo Sapiens
GKKLPDLER

SEQ ID NO: 302579 - protein, 9 aa, Homo Sapiens
RLCSKQTRT

SEQ ID NO: 302580 - protein, 9 aa, Homo Sapiens
QPESVQGRQ

SEQ ID NO: 302581 - protein, 9 aa, Homo Sapiens
SNPFNESQG

SEQ ID NO: 302582 - protein, 9 aa, Homo Sapiens
GLNGRLEKL

SEQ ID NO: 302583 - protein, 9 aa, Homo Sapiens
KAVITTTDD

SEQ ID NO: 302584 - protein, 9 aa, Homo Sapiens
EDDGEFMET

SEQ ID NO: 302585 - protein, 9 aa, Homo Sapiens
LVRHQNIHT

SEQ ID NO: 302586 - protein, 9 aa, Homo Sapiens
KALALLEDV

SEQ ID NO: 302587 - protein, 9 aa, Homo Sapiens
REQFEDNWY

SEQ ID NO: 302588 - protein, 8 aa, Homo Sapiens
SAWELTHL

SEQ ID NO: 302589 - protein, 9 aa, Homo Sapiens
LRHFSIYFL

SEQ ID NO: 302590 - protein, 9 aa, Homo Sapiens
NLLISMLLV

SEQ ID NO: 302591 - protein, 9 aa, Homo Sapiens
EKTGIVLLP

SEQ ID NO: 302592 - protein, 9 aa, Homo Sapiens
LLSSQLEEI

SEQ ID NO: 302593 - protein, 9 aa, Homo Sapiens
LQTSISELY

SEQ ID NO: 302594 - protein, 9 aa, Homo Sapiens
EGVAKMDPI

SEQ ID NO: 302595 - protein, 9 aa, Homo Sapiens
VYRYHSESS

SEQ ID NO: 302596 - protein, 9 aa, Homo Sapiens
CECVLFTAS

SEQ ID NO: 302597 - protein, 9 aa, Homo Sapiens
EIGSKANYI

SEQ ID NO: 302598 - protein, 9 aa, Homo Sapiens
YFLFHQPLR

SEQ ID NO: 302599 - protein, 9 aa, Homo Sapiens
GLGLVPIKY

SEQ ID NO: 302600 - protein, 9 aa, Homo Sapiens
SQLIIHQIT

SEQ ID NO: 302601 - protein, 9 aa, Homo Sapiens
KAFVRASSC

SEQ ID NO: 302602 - protein, 9 aa, Homo Sapiens
CDKKKVLSF

SEQ ID NO: 302603 - protein, 9 aa, Homo Sapiens
GKCRGQAAA

SEQ ID NO: 302604 - protein, 9 aa, Homo Sapiens
VDGAYITKV

SEQ ID NO: 302605 - protein, 9 aa, Homo Sapiens
SYLKAICTE

SEQ ID NO: 302606 - protein, 9 aa, Homo Sapiens
LLKKNSLNE

SEQ ID NO: 302607 - protein, 9 aa, Homo Sapiens
TGSKDVKND

SEQ ID NO: 302608 - protein, 9 aa, Homo Sapiens
FCKEEKYFD

SEQ ID NO: 302609 - protein, 9 aa, Homo Sapiens
ATSSTGLER

SEQ ID NO: 302610 - protein, 9 aa, Homo Sapiens
EIHLHRALP

SEQ ID NO: 302611 - protein, 9 aa, Homo Sapiens
LIVPAGDQR

SEQ ID NO: 302612 - protein, 9 aa, Homo Sapiens
LIDKPAIYK

SEQ ID NO: 302613 - protein, 9 aa, Homo Sapiens
VCRKEKTTK

SEQ ID NO: 302614 - protein, 9 aa, Homo Sapiens
EINITKLEV

SEQ ID NO: 302615 - protein, 9 aa, Homo Sapiens
VAPQLDLSK

SEQ ID NO: 302616 - protein, 9 aa, Homo Sapiens
IINLWCDIQ

SEQ ID NO: 302617 - protein, 9 aa, Homo Sapiens
QLPLFRINI

SEQ ID NO: 302618 - protein, 9 aa, Homo Sapiens
RVNTGARPY

SEQ ID NO: 302619 - protein, 9 aa, Homo Sapiens
LKKDHCEQI

SEQ ID NO: 302620 - protein, 9 aa, Homo Sapiens
IFEITIGLL

SEQ ID NO: 302621 - protein, 9 aa, Homo Sapiens
RHADGLLWH

SEQ ID NO: 302622 - protein, 9 aa, Homo Sapiens
IEWKFAQTK

SEQ ID NO: 302623 - protein, 9 aa, Homo Sapiens
YLEKLNVGN

SEQ ID NO: 302624 - protein, 9 aa, Homo Sapiens
GLDTSEDKV

SEQ ID NO: 302625 - protein, 9 aa, Homo Sapiens
ASHIFVKAI

SEQ ID NO: 302626 - protein, 9 aa, Homo Sapiens
LSQGRFGGV

SEQ ID NO: 302627 - protein, 9 aa, Homo Sapiens
LNKHGPTYK

SEQ ID NO: 302628 - protein, 9 aa, Homo Sapiens
CLGGECNNT

SEQ ID NO: 302629 - protein, 9 aa, Homo Sapiens
LSELFGKFI

SEQ ID NO: 302630 - protein, 9 aa, Homo Sapiens
FSPSLQNHY

SEQ ID NO: 302631 - protein, 9 aa, Homo Sapiens
SQDAGELVR

SEQ ID NO: 302632 - protein, 9 aa, Homo Sapiens
FPHESTFDV

SEQ ID NO: 302633 - protein, 9 aa, Homo Sapiens
GFGHFVQKH

SEQ ID NO: 302634 - protein, 9 aa, Homo Sapiens
GSLTQTHWE

SEQ ID NO: 302635 - protein, 9 aa, Homo Sapiens
HIRCQQEAE

SEQ ID NO: 302636 - protein, 9 aa, Homo Sapiens
QSVLSVYTH

SEQ ID NO: 302637 - protein, 9 aa, Homo Sapiens
ENVTTCWRD

SEQ ID NO: 302638 - protein, 9 aa, Homo Sapiens
TRDDVPKAK

SEQ ID NO: 302639 - protein, 9 aa, Homo Sapiens
GLPSGEVIE

SEQ ID NO: 302640 - protein, 9 aa, Homo Sapiens
LTVTTAMTT

SEQ ID NO: 302641 - protein, 9 aa, Homo Sapiens
NKCGSADNI

SEQ ID NO: 302642 - protein, 9 aa, Homo Sapiens
EQINLPWKF

SEQ ID NO: 302643 - protein, 9 aa, Homo Sapiens
NATRQGVTI

SEQ ID NO: 302644 - protein, 9 aa, Homo Sapiens
YLKTIPESE

SEQ ID NO: 302645 - protein, 9 aa, Homo Sapiens
GDKLQLFCV

SEQ ID NO: 302646 - protein, 9 aa, Homo Sapiens
PLPIQLGSL

SEQ ID NO: 302647 - protein, 9 aa, Homo Sapiens
AKSCESNYP

SEQ ID NO: 302648 - protein, 9 aa, Homo Sapiens
KYTEKENLR

SEQ ID NO: 302649 - protein, 9 aa, Homo Sapiens
QLQGTNEYV

SEQ ID NO: 302650 - protein, 9 aa, Homo Sapiens
NRPNNIDPA

SEQ ID NO: 302651 - protein, 9 aa, Homo Sapiens
YQNLVKEYP

SEQ ID NO: 302652 - protein, 9 aa, Homo Sapiens
ARLNTILDV

SEQ ID NO: 302653 - protein, 9 aa, Homo Sapiens
EQEVKIIIM

SEQ ID NO: 302654 - protein, 9 aa, Homo Sapiens
KDLKEELTE

SEQ ID NO: 302655 - protein, 9 aa, Homo Sapiens
KVVGAVDVL

SEQ ID NO: 302656 - protein, 9 aa, Homo Sapiens
DKLKGRTSR

SEQ ID NO: 302657 - protein, 9 aa, Homo Sapiens
HAGLFVEDN

SEQ ID NO: 302658 - protein, 9 aa, Homo Sapiens
KYQLFAFVS

SEQ ID NO: 302659 - protein, 9 aa, Homo Sapiens
SSPKIGFFR

SEQ ID NO: 302660 - protein, 9 aa, Homo Sapiens
YGLQVNYDK

SEQ ID NO: 302661 - protein, 9 aa, Homo Sapiens
KRERVKIIY

SEQ ID NO: 302662 - protein, 9 aa, Homo Sapiens
EDNAKQILQ

SEQ ID NO: 302663 - protein, 9 aa, Homo Sapiens
PTDVTAWRG

SEQ ID NO: 302664 - protein, 9 aa, Homo Sapiens
VLLFGLLVE

SEQ ID NO: 302665 - protein, 9 aa, Homo Sapiens
MYPGAKDQR

SEQ ID NO: 302666 - protein, 9 aa, Homo Sapiens
FGRETNNLS

SEQ ID NO: 302667 - protein, 9 aa, Homo Sapiens
LMVRLSRAE

SEQ ID NO: 302668 - protein, 9 aa, Homo Sapiens
GPQTPSECS

SEQ ID NO: 302669 - protein, 9 aa, Homo Sapiens
EGSLWWTYA

SEQ ID NO: 302670 - protein, 9 aa, Homo Sapiens
LQESIFDII

SEQ ID NO: 302671 - protein, 9 aa, Homo Sapiens
EREKSNRSK

SEQ ID NO: 302672 - protein, 9 aa, Homo Sapiens
NDKLGPETP

SEQ ID NO: 302673 - protein, 9 aa, Homo Sapiens
SGCEPPGDF

SEQ ID NO: 302674 - protein, 9 aa, Homo Sapiens
PLCISFKWM

SEQ ID NO: 302675 - protein, 9 aa, Homo Sapiens
LKRLPGKWI

SEQ ID NO: 302676 - protein, 9 aa, Homo Sapiens
SDPSTSASQ

SEQ ID NO: 302677 - protein, 9 aa, Homo Sapiens
HLRITAEVK

SEQ ID NO: 302678 - protein, 9 aa, Homo Sapiens
QNQIQQAFV

SEQ ID NO: 302679 - protein, 9 aa, Homo Sapiens
YKHVRPDYL

SEQ ID NO: 302680 - protein, 9 aa, Homo Sapiens
VVECSNLLR

SEQ ID NO: 302681 - protein, 9 aa, Homo Sapiens
QLDSAGLEW

SEQ ID NO: 302682 - protein, 9 aa, Homo Sapiens
CQGNTFLRA

SEQ ID NO: 302683 - protein, 9 aa, Homo Sapiens
SPIYLEQCQ

SEQ ID NO: 302684 - protein, 9 aa, Homo Sapiens
AIFITSYAR

SEQ ID NO: 302685 - protein, 9 aa, Homo Sapiens
TSYQRLFQA

SEQ ID NO: 302686 - protein, 9 aa, Homo Sapiens
NIKYPGQIT

SEQ ID NO: 302687 - protein, 9 aa, Homo Sapiens
RTVRSLGIY

SEQ ID NO: 302688 - protein, 9 aa, Homo Sapiens
KIEYDDLVE

SEQ ID NO: 302689 - protein, 9 aa, Homo Sapiens
VSSTSSTPE

SEQ ID NO: 302690 - protein, 9 aa, Homo Sapiens
KNSFCGQLQ

SEQ ID NO: 302691 - protein, 9 aa, Homo Sapiens
RHFCILYYF

SEQ ID NO: 302692 - protein, 9 aa, Homo Sapiens
KSRSPSPKI

SEQ ID NO: 302693 - protein, 9 aa, Homo Sapiens
TAEVKVVEM

SEQ ID NO: 302694 - protein, 9 aa, Homo Sapiens
IARLNTILD

SEQ ID NO: 302695 - protein, 9 aa, Homo Sapiens
RRTVRSLGI

SEQ ID NO: 302696 - protein, 9 aa, Homo Sapiens
TSTNKLLDN

SEQ ID NO: 302697 - protein, 9 aa, Homo Sapiens
TFQSVLAML

SEQ ID NO: 302698 - protein, 9 aa, Homo Sapiens
KQYPVTCLE

SEQ ID NO: 302699 - protein, 9 aa, Homo Sapiens
CKTKEREKE

SEQ ID NO: 302700 - protein, 9 aa, Homo Sapiens
EQLEMESKL

SEQ ID NO: 302701 - protein, 9 aa, Homo Sapiens
VGMATNIKN

SEQ ID NO: 302702 - protein, 9 aa, Homo Sapiens
HSGSHNHEA

SEQ ID NO: 302703 - protein, 9 aa, Homo Sapiens
LGNEPNNYQ

SEQ ID NO: 302704 - protein, 9 aa, Homo Sapiens
KPDNMIVPI

SEQ ID NO: 302705 - protein, 9 aa, Homo Sapiens
YHITVRGQP

SEQ ID NO: 302706 - protein, 9 aa, Homo Sapiens
LTTLKQNVK

SEQ ID NO: 302707 - protein, 9 aa, Homo Sapiens
PHPKVSNFF

SEQ ID NO: 302708 - protein, 9 aa, Homo Sapiens
RTTKLKVEE

SEQ ID NO: 302709 - protein, 9 aa, Homo Sapiens
RQEAHISWF

SEQ ID NO: 302710 - protein, 9 aa, Homo Sapiens
ADTSTFLVK

SEQ ID NO: 302711 - protein, 9 aa, Homo Sapiens
KVVALQKKQ

SEQ ID NO: 302712 - protein, 9 aa, Homo Sapiens
FLQKKLIGA

SEQ ID NO: 302713 - protein, 9 aa, Homo Sapiens
LTDNIKNTL

SEQ ID NO: 302714 - protein, 9 aa, Homo Sapiens
THVSKHKSD

SEQ ID NO: 302715 - protein, 9 aa, Homo Sapiens
LEEIKKLLV

SEQ ID NO: 302716 - protein, 9 aa, Homo Sapiens
LKSIDEHYH

SEQ ID NO: 302717 - protein, 9 aa, Homo Sapiens
ENCVSEDLG

SEQ ID NO: 302718 - protein, 9 aa, Homo Sapiens
YLTTYGQIS

SEQ ID NO: 302719 - protein, 9 aa, Homo Sapiens
FLDNDFFGT

SEQ ID NO: 302720 - protein, 9 aa, Homo Sapiens
EYTTLKKSK

SEQ ID NO: 302721 - protein, 9 aa, Homo Sapiens
LFGVQWVRP

SEQ ID NO: 302722 - protein, 9 aa, Homo Sapiens
SQEERHNAL

SEQ ID NO: 302723 - protein, 9 aa, Homo Sapiens
VRKAMLNWA

SEQ ID NO: 302724 - protein, 9 aa, Homo Sapiens
HIPLFSRMG

SEQ ID NO: 302725 - protein, 9 aa, Homo Sapiens
QRKVKCIYV

SEQ ID NO: 302726 - protein, 9 aa, Homo Sapiens
LNNFSEIVV

SEQ ID NO: 302727 - protein, 9 aa, Homo Sapiens
RCENVTTCW

SEQ ID NO: 302728 - protein, 9 aa, Homo Sapiens
TSVLIQHQR

SEQ ID NO: 302729 - protein, 9 aa, Homo Sapiens
KVVEMHESD

SEQ ID NO: 302730 - protein, 9 aa, Homo Sapiens
CPLCMQSRR

SEQ ID NO: 302731 - protein, 9 aa, Homo Sapiens
SDQTLRRDS

SEQ ID NO: 302732 - protein, 9 aa, Homo Sapiens
KLRNRRIIK

SEQ ID NO: 302733 - protein, 9 aa, Homo Sapiens
AVPHVTQEQ

SEQ ID NO: 302734 - protein, 9 aa, Homo Sapiens
VTRQMGDAL

SEQ ID NO: 302735 - protein, 9 aa, Homo Sapiens
FFTKLFEKH

SEQ ID NO: 302736 - protein, 9 aa, Homo Sapiens
NLRRHMLER

SEQ ID NO: 302737 - protein, 9 aa, Homo Sapiens
VNTGARPYV

SEQ ID NO: 302738 - protein, 9 aa, Homo Sapiens
VAGEAAFID

SEQ ID NO: 302739 - protein, 9 aa, Homo Sapiens
KQLRTLDLW

SEQ ID NO: 302740 - protein, 9 aa, Homo Sapiens
SWALKTIEA

SEQ ID NO: 302741 - protein, 9 aa, Homo Sapiens
KNNNLQEAL

SEQ ID NO: 302742 - protein, 9 aa, Homo Sapiens
GLFLHPHCK

SEQ ID NO: 302743 - protein, 9 aa, Homo Sapiens
VSIYLIDLL

SEQ ID NO: 302744 - protein, 9 aa, Homo Sapiens
NQRQKQKQM

SEQ ID NO: 302745 - protein, 9 aa, Homo Sapiens
NLPRAVDDK

SEQ ID NO: 302746 - protein, 9 aa, Homo Sapiens
STDFWGRFL

SEQ ID NO: 302747 - protein, 9 aa, Homo Sapiens
LLELHQQCE

SEQ ID NO: 302748 - protein, 9 aa, Homo Sapiens
SNNRLYRRD

SEQ ID NO: 302749 - protein, 9 aa, Homo Sapiens
FCGYHPNNN

SEQ ID NO: 302750 - protein, 9 aa, Homo Sapiens
GTSYQRLFQ

SEQ ID NO: 302751 - protein, 9 aa, Homo Sapiens
DTSFEGTDY

SEQ ID NO: 302752 - protein, 9 aa, Homo Sapiens
HSNSLGAGG

SEQ ID NO: 302753 - protein, 9 aa, Homo Sapiens
LQAQIRHWF

SEQ ID NO: 302754 - protein, 9 aa, Homo Sapiens
LKIKCLQEA

SEQ ID NO: 302755 - protein, 9 aa, Homo Sapiens
QSKMKPSWA

SEQ ID NO: 302756 - protein, 9 aa, Homo Sapiens
EAIWGSSIK

SEQ ID NO: 302757 - protein, 9 aa, Homo Sapiens
SMFSHSIHN

SEQ ID NO: 302758 - protein, 9 aa, Homo Sapiens
CWKNNKSRN

SEQ ID NO: 302759 - protein, 9 aa, Homo Sapiens
AQETGGNLY

SEQ ID NO: 302760 - protein, 9 aa, Homo Sapiens
EGIGSDFKL

SEQ ID NO: 302761 - protein, 9 aa, Homo Sapiens
SQNPMLLEL

SEQ ID NO: 302762 - protein, 9 aa, Homo Sapiens
SQTHKERST

SEQ ID NO: 302763 - protein, 9 aa, Homo Sapiens
ECTYSVSGN

SEQ ID NO: 302764 - protein, 9 aa, Homo Sapiens
SSLINATFT

SEQ ID NO: 302765 - protein, 9 aa, Homo Sapiens
ESVLSVSCQ

SEQ ID NO: 302766 - protein, 9 aa, Homo Sapiens
MTMPASKKY

SEQ ID NO: 302767 - protein, 9 aa, Homo Sapiens
EDLSRDGNA

SEQ ID NO: 302768 - protein, 9 aa, Homo Sapiens
GKPQFYAAP

SEQ ID NO: 302769 - protein, 9 aa, Homo Sapiens
SSKALWSWR

SEQ ID NO: 302770 - protein, 9 aa, Homo Sapiens
TSGPTRGKH

SEQ ID NO: 302771 - protein, 9 aa, Homo Sapiens
ILVVQNDLK

SEQ ID NO: 302772 - protein, 9 aa, Homo Sapiens
EGMKYMYRE

SEQ ID NO: 302773 - protein, 9 aa, Homo Sapiens
HQSPVQFDT

SEQ ID NO: 302774 - protein, 9 aa, Homo Sapiens
NVRYSESFC

SEQ ID NO: 302775 - protein, 9 aa, Homo Sapiens
KLMEVPVIK

SEQ ID NO: 302776 - protein, 9 aa, Homo Sapiens
GSPPKSPQT

SEQ ID NO: 302777 - protein, 9 aa, Homo Sapiens
AGRYLMACA

SEQ ID NO: 302778 - protein, 9 aa, Homo Sapiens
NKQFDKVRE

SEQ ID NO: 302779 - protein, 9 aa, Homo Sapiens
GTLDLRKRQ

SEQ ID NO: 302780 - protein, 9 aa, Homo Sapiens
KQLLHVKGL

SEQ ID NO: 302781 - protein, 9 aa, Homo Sapiens
VFSTDLSNP

SEQ ID NO: 302782 - protein, 9 aa, Homo Sapiens
YFPNGNNGK

SEQ ID NO: 302783 - protein, 9 aa, Homo Sapiens
LIKTGADIS

SEQ ID NO: 302784 - protein, 9 aa, Homo Sapiens
PKSPQTTVH

SEQ ID NO: 302785 - protein, 9 aa, Homo Sapiens
KCLIKHQQE

SEQ ID NO: 302786 - protein, 9 aa, Homo Sapiens
DYKVKTKKE

SEQ ID NO: 302787 - protein, 9 aa, Homo Sapiens
EWLFNLLKT

SEQ ID NO: 302788 - protein, 9 aa, Homo Sapiens
EPNNYQTMH

SEQ ID NO: 302789 - protein, 9 aa, Homo Sapiens
ISRMEERSG

SEQ ID NO: 302790 - protein, 9 aa, Homo Sapiens
KTNLSAQVC

SEQ ID NO: 302791 - protein, 9 aa, Homo Sapiens
PCEPALGQY

SEQ ID NO: 302792 - protein, 9 aa, Homo Sapiens
PGPSTFYFV

SEQ ID NO: 302793 - protein, 9 aa, Homo Sapiens
EPKDITAKE

SEQ ID NO: 302794 - protein, 9 aa, Homo Sapiens
PEIPLGECC

SEQ ID NO: 302795 - protein, 9 aa, Homo Sapiens
GETIKIVIK

SEQ ID NO: 302796 - protein, 9 aa, Homo Sapiens
ADGRKKTFA

SEQ ID NO: 302797 - protein, 9 aa, Homo Sapiens
GAFKKIKPP

SEQ ID NO: 302798 - protein, 9 aa, Homo Sapiens
EDFYLLENI

SEQ ID NO: 302799 - protein, 9 aa, Homo Sapiens
ADTYGEEND

SEQ ID NO: 302800 - protein, 9 aa, Homo Sapiens
AKEVKMAFF

SEQ ID NO: 302801 - protein, 9 aa, Homo Sapiens
SAKSCESNY

SEQ ID NO: 302802 - protein, 9 aa, Homo Sapiens
FFSKPKHNH

SEQ ID NO: 302803 - protein, 9 aa, Homo Sapiens
SFLSYTVQS

SEQ ID NO: 302804 - protein, 9 aa, Homo Sapiens
PIRNKYFSL

SEQ ID NO: 302805 - protein, 9 aa, Homo Sapiens
AVDDDKILP

SEQ ID NO: 302806 - protein, 9 aa, Homo Sapiens
KCAKHKRFL

SEQ ID NO: 302807 - protein, 9 aa, Homo Sapiens
MDASSSKMK

SEQ ID NO: 302808 - protein, 9 aa, Homo Sapiens
FVRQDDCML

SEQ ID NO: 302809 - protein, 9 aa, Homo Sapiens
EAEGRLRDK

SEQ ID NO: 302810 - protein, 9 aa, Homo Sapiens
EDMDKMFSF

SEQ ID NO: 302811 - protein, 9 aa, Homo Sapiens
ENLKKRPLL

SEQ ID NO: 302812 - protein, 9 aa, Homo Sapiens
KGMGKQGKK

SEQ ID NO: 302813 - protein, 9 aa, Homo Sapiens
CVLCDNEFL

SEQ ID NO: 302814 - protein, 9 aa, Homo Sapiens
GYLTSSPTT

SEQ ID NO: 302815 - protein, 9 aa, Homo Sapiens
RVDQIIGKG

SEQ ID NO: 302816 - protein, 9 aa, Homo Sapiens
DTFNHLIEM

SEQ ID NO: 302817 - protein, 9 aa, Homo Sapiens
KMAHKIMKM

SEQ ID NO: 302818 - protein, 9 aa, Homo Sapiens
FKFMKGHKH

SEQ ID NO: 302819 - protein, 9 aa, Homo Sapiens
RTKKGVLEA

SEQ ID NO: 302820 - protein, 9 aa, Homo Sapiens
TQIIVQGRE

SEQ ID NO: 302821 - protein, 9 aa, Homo Sapiens
GPQVSLSQP

SEQ ID NO: 302822 - protein, 9 aa, Homo Sapiens
QNHLYGGLA

SEQ ID NO: 302823 - protein, 9 aa, Homo Sapiens
LFGVLRQIT

SEQ ID NO: 302824 - protein, 9 aa, Homo Sapiens
NVSVIGRMV

SEQ ID NO: 302825 - protein, 9 aa, Homo Sapiens
ELEESTEKA

SEQ ID NO: 302826 - protein, 9 aa, Homo Sapiens
CTGFDAHYM

SEQ ID NO: 302827 - protein, 9 aa, Homo Sapiens
HKAEVTAHK

SEQ ID NO: 302828 - protein, 9 aa, Homo Sapiens
ISYHLCDLC

SEQ ID NO: 302829 - protein, 9 aa, Homo Sapiens
KEVNSDAGA

SEQ ID NO: 302830 - protein, 9 aa, Homo Sapiens
AGEGDQAHK

SEQ ID NO: 302831 - protein, 9 aa, Homo Sapiens
IGHQRQTTP

SEQ ID NO: 302832 - protein, 9 aa, Homo Sapiens
SNKWCEKLA

SEQ ID NO: 302833 - protein, 9 aa, Homo Sapiens
QRLCSKQTR

SEQ ID NO: 302834 - protein, 9 aa, Homo Sapiens
WANRVRYMV

SEQ ID NO: 302835 - protein, 9 aa, Homo Sapiens
FLSEIQWEK

SEQ ID NO: 302836 - protein, 9 aa, Homo Sapiens
CGKAFTTFL

SEQ ID NO: 302837 - protein, 9 aa, Homo Sapiens
VMWEVGYPL

SEQ ID NO: 302838 - protein, 9 aa, Homo Sapiens
DIQLQIASF

SEQ ID NO: 302839 - protein, 9 aa, Homo Sapiens
MIPAFQTFL

SEQ ID NO: 302840 - protein, 9 aa, Homo Sapiens
AISTVCVGL

SEQ ID NO: 302841 - protein, 9 aa, Homo Sapiens
VQINLQQQP

SEQ ID NO: 302842 - protein, 9 aa, Homo Sapiens
MFEDVTVAD

SEQ ID NO: 302843 - protein, 9 aa, Homo Sapiens
WVEKEKGPI

SEQ ID NO: 302844 - protein, 9 aa, Homo Sapiens
EMLTHNIAK

SEQ ID NO: 302845 - protein, 9 aa, Homo Sapiens
DQQQQKSIA

SEQ ID NO: 302846 - protein, 9 aa, Homo Sapiens
KGVKPKLVI

SEQ ID NO: 302847 - protein, 9 aa, Homo Sapiens
NSYQNTTAS

SEQ ID NO: 302848 - protein, 9 aa, Homo Sapiens
IKWNDVTLY

SEQ ID NO: 302849 - protein, 9 aa, Homo Sapiens
IHLHRALPL

SEQ ID NO: 302850 - protein, 9 aa, Homo Sapiens
DKPFECLEC

SEQ ID NO: 302851 - protein, 9 aa, Homo Sapiens
RTGQLFSLN

SEQ ID NO: 302852 - protein, 9 aa, Homo Sapiens
YGLILSTVL

SEQ ID NO: 302853 - protein, 9 aa, Homo Sapiens
TNKVIKIVG

SEQ ID NO: 302854 - protein, 9 aa, Homo Sapiens
SFAFNRKQN

SEQ ID NO: 302855 - protein, 9 aa, Homo Sapiens
CEGDNHLRN

SEQ ID NO: 302856 - protein, 9 aa, Homo Sapiens
SYSSDVVNV

SEQ ID NO: 302857 - protein, 9 aa, Homo Sapiens
PADDHRYKL

SEQ ID NO: 302858 - protein, 9 aa, Homo Sapiens
DDFITCLKD

SEQ ID NO: 302859 - protein, 9 aa, Homo Sapiens
CACDYCSLS

SEQ ID NO: 302860 - protein, 9 aa, Homo Sapiens
MQDKLARLN

SEQ ID NO: 302861 - protein, 9 aa, Homo Sapiens
PSGEVTRQM

SEQ ID NO: 302862 - protein, 9 aa, Homo Sapiens
CVIIEKNPG

SEQ ID NO: 302863 - protein, 9 aa, Homo Sapiens
EDNEFIDAS

SEQ ID NO: 302864 - protein, 9 aa, Homo Sapiens
INTKGEVID

SEQ ID NO: 302865 - protein, 9 aa, Homo Sapiens
TLITAALYK

SEQ ID NO: 302866 - protein, 9 aa, Homo Sapiens
SSPIIENAL

SEQ ID NO: 302867 - protein, 9 aa, Homo Sapiens
YCYQFGGQE

SEQ ID NO: 302868 - protein, 9 aa, Homo Sapiens
TAVSDKKIL

SEQ ID NO: 302869 - protein, 9 aa, Homo Sapiens
HDLKESICS

SEQ ID NO: 302870 - protein, 9 aa, Homo Sapiens
GHCFCRITH

SEQ ID NO: 302871 - protein, 9 aa, Homo Sapiens
RLMSWLQSS

SEQ ID NO: 302872 - protein, 9 aa, Homo Sapiens
SYLENKLSC

SEQ ID NO: 302873 - protein, 9 aa, Homo Sapiens
TGREHAVVI

SEQ ID NO: 302874 - protein, 9 aa, Homo Sapiens
SLDPGKRAK

SEQ ID NO: 302875 - protein, 9 aa, Homo Sapiens
SDKQNQARL

SEQ ID NO: 302876 - protein, 9 aa, Homo Sapiens
LAHLCLYNL

SEQ ID NO: 302877 - protein, 9 aa, Homo Sapiens
VIKRHRGDG

SEQ ID NO: 302878 - protein, 9 aa, Homo Sapiens
LVGLSQERV

SEQ ID NO: 302879 - protein, 9 aa, Homo Sapiens
PLPRLLTMV

SEQ ID NO: 302880 - protein, 9 aa, Homo Sapiens
ITVRGQPAR

SEQ ID NO: 302881 - protein, 9 aa, Homo Sapiens
WEAYCRVTA

SEQ ID NO: 302882 - protein, 9 aa, Homo Sapiens
HEIALANGF

SEQ ID NO: 302883 - protein, 9 aa, Homo Sapiens
RRKQMLDIL

SEQ ID NO: 302884 - protein, 9 aa, Homo Sapiens
EIANNLVLA

SEQ ID NO: 302885 - protein, 9 aa, Homo Sapiens
RYNIIMNIH

SEQ ID NO: 302886 - protein, 9 aa, Homo Sapiens
ILFRARWKH

SEQ ID NO: 302887 - protein, 9 aa, Homo Sapiens
RNLGRDWNI

SEQ ID NO: 302888 - protein, 9 aa, Homo Sapiens
DLHLLHHDG

SEQ ID NO: 302889 - protein, 9 aa, Homo Sapiens
ENDVEQVRQ

SEQ ID NO: 302890 - protein, 9 aa, Homo Sapiens
NLIRHRKTH

SEQ ID NO: 302891 - protein, 9 aa, Homo Sapiens
MSPLEKEIQ

SEQ ID NO: 302892 - protein, 9 aa, Homo Sapiens
EAQVMLSLA

SEQ ID NO: 302893 - protein, 9 aa, Homo Sapiens
LVCISVRQF

SEQ ID NO: 302894 - protein, 9 aa, Homo Sapiens
TPFQLYLNP

SEQ ID NO: 302895 - protein, 9 aa, Homo Sapiens
ICLQCWCVR

SEQ ID NO: 302896 - protein, 9 aa, Homo Sapiens
HLFSSPSLS

SEQ ID NO: 302897 - protein, 9 aa, Homo Sapiens
LWPELIESA

SEQ ID NO: 302898 - protein, 9 aa, Homo Sapiens
EDTVYHLHP

SEQ ID NO: 302899 - protein, 9 aa, Homo Sapiens
EPIRCSVLE

SEQ ID NO: 302900 - protein, 9 aa, Homo Sapiens
DDCMLLKEF

SEQ ID NO: 302901 - protein, 9 aa, Homo Sapiens
TFEQLLAPH

SEQ ID NO: 302902 - protein, 9 aa, Homo Sapiens
NKIIHLIKW

SEQ ID NO: 302903 - protein, 9 aa, Homo Sapiens
DRLHIYTCP

SEQ ID NO: 302904 - protein, 9 aa, Homo Sapiens
QLQKSYKTL

SEQ ID NO: 302905 - protein, 9 aa, Homo Sapiens
IIYKKIEDL

SEQ ID NO: 302906 - protein, 9 aa, Homo Sapiens
QSSHGGGWQ

SEQ ID NO: 302907 - protein, 9 aa, Homo Sapiens
EITIGLLVH

SEQ ID NO: 302908 - protein, 9 aa, Homo Sapiens
PLPLLPYHL

SEQ ID NO: 302909 - protein, 9 aa, Homo Sapiens
FDPKVEHNP

SEQ ID NO: 302910 - protein, 9 aa, Homo Sapiens
SEGIWWTVL

SEQ ID NO: 302911 - protein, 9 aa, Homo Sapiens
ASTENTLGC

SEQ ID NO: 302912 - protein, 9 aa, Homo Sapiens
EKTYAHFVD

SEQ ID NO: 302913 - protein, 9 aa, Homo Sapiens
TQYGLKLTT

SEQ ID NO: 302914 - protein, 9 aa, Homo Sapiens
QRDVYRDVM

SEQ ID NO: 302915 - protein, 9 aa, Homo Sapiens
GIAHKLFGA

SEQ ID NO: 302916 - protein, 9 aa, Homo Sapiens
LDGVEQINL

SEQ ID NO: 302917 - protein, 9 aa, Homo Sapiens
SEEELFDAH

SEQ ID NO: 302918 - protein, 9 aa, Homo Sapiens
LLHSVMTYR

SEQ ID NO: 302919 - protein, 9 aa, Homo Sapiens
QHKITHTSE

SEQ ID NO: 302920 - protein, 9 aa, Homo Sapiens
EVQSQNLLV

SEQ ID NO: 302921 - protein, 9 aa, Homo Sapiens
EADDLFTSL

SEQ ID NO: 302922 - protein, 9 aa, Homo Sapiens
VEIGHQRQT

SEQ ID NO: 302923 - protein, 9 aa, Homo Sapiens
ALQKVFDEH

SEQ ID NO: 302924 - protein, 9 aa, Homo Sapiens
HHYSPASWP

SEQ ID NO: 302925 - protein, 9 aa, Homo Sapiens
KCKQLRTLD

SEQ ID NO: 302926 - protein, 9 aa, Homo Sapiens
IYLIDLLTA

SEQ ID NO: 302927 - protein, 9 aa, Homo Sapiens
AVKNCMASE

SEQ ID NO: 302928 - protein, 9 aa, Homo Sapiens
NILVTVLDV

SEQ ID NO: 302929 - protein, 9 aa, Homo Sapiens
LFVEDNFMV

SEQ ID NO: 302930 - protein, 9 aa, Homo Sapiens
ELRQTLMPT

SEQ ID NO: 302931 - protein, 9 aa, Homo Sapiens
VAESLQQVW

SEQ ID NO: 302932 - protein, 9 aa, Homo Sapiens
HRSQAPIHR

SEQ ID NO: 302933 - protein, 9 aa, Homo Sapiens
TQEGGIHKD

SEQ ID NO: 302934 - protein, 9 aa, Homo Sapiens
SLWDTVKDK

SEQ ID NO: 302935 - protein, 9 aa, Homo Sapiens
LLFLSTGHP

SEQ ID NO: 302936 - protein, 9 aa, Homo Sapiens
SLNKGDFYQ

SEQ ID NO: 302937 - protein, 9 aa, Homo Sapiens
ILSQGRFGG

SEQ ID NO: 302938 - protein, 9 aa, Homo Sapiens
YLEEKLDKW

SEQ ID NO: 302939 - protein, 9 aa, Homo Sapiens
RNQQVKDVF

SEQ ID NO: 302940 - protein, 9 aa, Homo Sapiens
APSDLRLVD

SEQ ID NO: 302941 - protein, 9 aa, Homo Sapiens
MQVLGDVVR

SEQ ID NO: 302942 - protein, 9 aa, Homo Sapiens
GASAVLFNI

SEQ ID NO: 302943 - protein, 9 aa, Homo Sapiens
TDVLSYTYQ

SEQ ID NO: 302944 - protein, 9 aa, Homo Sapiens
KVQQPHVGG

SEQ ID NO: 302945 - protein, 9 aa, Homo Sapiens
KKKENKSLT

SEQ ID NO: 302946 - protein, 9 aa, Homo Sapiens
LITFLSKLS

SEQ ID NO: 302947 - protein, 9 aa, Homo Sapiens
RKKLPHEFP

SEQ ID NO: 302948 - protein, 9 aa, Homo Sapiens
LPVWVYLKV

SEQ ID NO: 302949 - protein, 9 aa, Homo Sapiens
KDILRVIGN

SEQ ID NO: 302950 - protein, 9 aa, Homo Sapiens
NGNNGKKAS

SEQ ID NO: 302951 - protein, 9 aa, Homo Sapiens
NLPFLLIPS

SEQ ID NO: 302952 - protein, 9 aa, Homo Sapiens
NTDHLAWTR

SEQ ID NO: 302953 - protein, 9 aa, Homo Sapiens
WMEWSKWSA

SEQ ID NO: 302954 - protein, 9 aa, Homo Sapiens
MPVAILVYK

SEQ ID NO: 302955 - protein, 9 aa, Homo Sapiens
KCGSADNIP

SEQ ID NO: 302956 - protein, 9 aa, Homo Sapiens
ILEKFRIEY

SEQ ID NO: 302957 - protein, 9 aa, Homo Sapiens
SLGLKSGQG

SEQ ID NO: 302958 - protein, 9 aa, Homo Sapiens
KQGNPKMKI

SEQ ID NO: 302959 - protein, 9 aa, Homo Sapiens
HPASLTPQR

SEQ ID NO: 302960 - protein, 9 aa, Homo Sapiens
TLKWGLYIA

SEQ ID NO: 302961 - protein, 9 aa, Homo Sapiens
DPKKREFVF

SEQ ID NO: 302962 - protein, 9 aa, Homo Sapiens
GEIKGQENL

SEQ ID NO: 302963 - protein, 9 aa, Homo Sapiens
MYTLSTQKL

SEQ ID NO: 302964 - protein, 9 aa, Homo Sapiens
DIQPIKCLI

SEQ ID NO: 302965 - protein, 9 aa, Homo Sapiens
PYPGIPPEW

SEQ ID NO: 302966 - protein, 9 aa, Homo Sapiens
TKHKKHFKK

SEQ ID NO: 302967 - protein, 9 aa, Homo Sapiens
RSRLQNRYA

SEQ ID NO: 302968 - protein, 9 aa, Homo Sapiens
LGQLYKCHP

SEQ ID NO: 302969 - protein, 9 aa, Homo Sapiens
SAVLFNITE

SEQ ID NO: 302970 - protein, 9 aa, Homo Sapiens
NNAAVFRVG

SEQ ID NO: 302971 - protein, 9 aa, Homo Sapiens
KTHGIRNGI

SEQ ID NO: 302972 - protein, 9 aa, Homo Sapiens
TSRQAQSHL

SEQ ID NO: 302973 - protein, 9 aa, Homo Sapiens
FILKKVNDL

SEQ ID NO: 302974 - protein, 9 aa, Homo Sapiens
KDPGDLSAH

SEQ ID NO: 302975 - protein, 9 aa, Homo Sapiens
EEKVALDPE

SEQ ID NO: 302976 - protein, 9 aa, Homo Sapiens
DSSSGRDNV

SEQ ID NO: 302977 - protein, 9 aa, Homo Sapiens
FKRLSCLSL

SEQ ID NO: 302978 - protein, 9 aa, Homo Sapiens
KTSRQLFES

SEQ ID NO: 302979 - protein, 9 aa, Homo Sapiens
KRIHKYKRQ

SEQ ID NO: 302980 - protein, 9 aa, Homo Sapiens
YMYRELWET

SEQ ID NO: 302981 - protein, 9 aa, Homo Sapiens
KQNVLELEI

SEQ ID NO: 302982 - protein, 9 aa, Homo Sapiens
GFWNAKKGT

SEQ ID NO: 302983 - protein, 9 aa, Homo Sapiens
PEKNVTKED

SEQ ID NO: 302984 - protein, 9 aa, Homo Sapiens
ENFPIGHLN

SEQ ID NO: 302985 - protein, 9 aa, Homo Sapiens
DTYNRLTNQ

SEQ ID NO: 302986 - protein, 9 aa, Homo Sapiens
TSPLVACAK

SEQ ID NO: 302987 - protein, 9 aa, Homo Sapiens
ALWHPRNAP

SEQ ID NO: 302988 - protein, 9 aa, Homo Sapiens
FSPRSYLFD

SEQ ID NO: 302989 - protein, 9 aa, Homo Sapiens
KIKPPSKML

SEQ ID NO: 302990 - protein, 9 aa, Homo Sapiens
ALALLEDVV

SEQ ID NO: 302991 - protein, 9 aa, Homo Sapiens
HMKRFVKYL

SEQ ID NO: 302992 - protein, 9 aa, Homo Sapiens
SQINLYRDV

SEQ ID NO: 302993 - protein, 9 aa, Homo Sapiens
NVCQELLYP

SEQ ID NO: 302994 - protein, 9 aa, Homo Sapiens
PVREDSTAK

SEQ ID NO: 302995 - protein, 9 aa, Homo Sapiens
LAKSMCMIM

SEQ ID NO: 302996 - protein, 9 aa, Homo Sapiens
KRGTAKLQA

SEQ ID NO: 302997 - protein, 9 aa, Homo Sapiens
VREDSTAKK

SEQ ID NO: 302998 - protein, 9 aa, Homo Sapiens
QVVKNLLFT

SEQ ID NO: 302999 - protein, 9 aa, Homo Sapiens
VGKIAELAD

SEQ ID NO: 303000 - protein, 9 aa, Homo Sapiens
LSTKVRNYV

SEQ ID NO: 303001 - protein, 9 aa, Homo Sapiens
HMRVHTRYQ

SEQ ID NO: 303002 - protein, 9 aa, Homo Sapiens
SLTFFQKKE

SEQ ID NO: 303003 - protein, 9 aa, Homo Sapiens
EAVHQQFQN

SEQ ID NO: 303004 - protein, 9 aa, Homo Sapiens
EEDPSHLRC

SEQ ID NO: 303005 - protein, 9 aa, Homo Sapiens
WRAKLKRSH

SEQ ID NO: 303006 - protein, 9 aa, Homo Sapiens
VVKQLEGEA

SEQ ID NO: 303007 - protein, 9 aa, Homo Sapiens
CELLSDNML

SEQ ID NO: 303008 - protein, 9 aa, Homo Sapiens
GKIMLVLPH

SEQ ID NO: 303009 - protein, 9 aa, Homo Sapiens
EPLNSRRSK

SEQ ID NO: 303010 - protein, 9 aa, Homo Sapiens
SRLAKQGNP

SEQ ID NO: 303011 - protein, 9 aa, Homo Sapiens
NEERCTGFD

SEQ ID NO: 303012 - protein, 9 aa, Homo Sapiens
LFGFVTRKQ

SEQ ID NO: 303013 - protein, 9 aa, Homo Sapiens
IYKKKTEQL

SEQ ID NO: 303014 - protein, 9 aa, Homo Sapiens
YQRSLASWN

SEQ ID NO: 303015 - protein, 9 aa, Homo Sapiens
QIAYIGLQF

SEQ ID NO: 303016 - protein, 9 aa, Homo Sapiens
VYELLSAWS

SEQ ID NO: 303017 - protein, 9 aa, Homo Sapiens
LYSKTHMNV

SEQ ID NO: 303018 - protein, 9 aa, Homo Sapiens
IIHESDSIL

SEQ ID NO: 303019 - protein, 9 aa, Homo Sapiens
PCSTDFWGR

SEQ ID NO: 303020 - protein, 9 aa, Homo Sapiens
TLEWATIQI

SEQ ID NO: 303021 - protein, 9 aa, Homo Sapiens
DGTGGQPHH

SEQ ID NO: 303022 - protein, 9 aa, Homo Sapiens
VKYMLSRDR

SEQ ID NO: 303023 - protein, 9 aa, Homo Sapiens
DDEDFKTAV

SEQ ID NO: 303024 - protein, 9 aa, Homo Sapiens
ARKGNKGKR

SEQ ID NO: 303025 - protein, 9 aa, Homo Sapiens
TYDAFPLAP

SEQ ID NO: 303026 - protein, 9 aa, Homo Sapiens
INDKQFAKL

SEQ ID NO: 303027 - protein, 9 aa, Homo Sapiens
DKDEPPNDV

SEQ ID NO: 303028 - protein, 9 aa, Homo Sapiens
HRISHTEEK

SEQ ID NO: 303029 - protein, 9 aa, Homo Sapiens
NRSKLYLDL

SEQ ID NO: 303030 - protein, 9 aa, Homo Sapiens
VSKQYPVTC

SEQ ID NO: 303031 - protein, 9 aa, Homo Sapiens
PDGGIAQLR

SEQ ID NO: 303032 - protein, 9 aa, Homo Sapiens
HKAPTFLYD

SEQ ID NO: 303033 - protein, 9 aa, Homo Sapiens
EEAVAGGLL

SEQ ID NO: 303034 - protein, 9 aa, Homo Sapiens
APDLYVQMK

SEQ ID NO: 303035 - protein, 9 aa, Homo Sapiens
FVFNAIETM

SEQ ID NO: 303036 - protein, 9 aa, Homo Sapiens
LFEVLAHPQ

SEQ ID NO: 303037 - protein, 9 aa, Homo Sapiens
WKEQEWTTL

SEQ ID NO: 303038 - protein, 9 aa, Homo Sapiens
SKKIQRKLS

SEQ ID NO: 303039 - protein, 9 aa, Homo Sapiens
HELPELTVE

SEQ ID NO: 303040 - protein, 9 aa, Homo Sapiens
RGQPVIKLY

SEQ ID NO: 303041 - protein, 9 aa, Homo Sapiens
QKCHKLLFA

SEQ ID NO: 303042 - protein, 9 aa, Homo Sapiens
HGVPEFILV

SEQ ID NO: 303043 - protein, 9 aa, Homo Sapiens
GLRTAGSQS

SEQ ID NO: 303044 - protein, 9 aa, Homo Sapiens
AKEEVNSNK

SEQ ID NO: 303045 - protein, 9 aa, Homo Sapiens
DFKRKYYSM

SEQ ID NO: 303046 - protein, 9 aa, Homo Sapiens
TDNVNKVGE

SEQ ID NO: 303047 - protein, 9 aa, Homo Sapiens
ETKSGGGMP

SEQ ID NO: 303048 - protein, 9 aa, Homo Sapiens
CMNKGYRHI

SEQ ID NO: 303049 - protein, 9 aa, Homo Sapiens
FLPLGAICF

SEQ ID NO: 303050 - protein, 9 aa, Homo Sapiens
SKIKYEDLS

SEQ ID NO: 303051 - protein, 9 aa, Homo Sapiens
TYLQNGKYR

SEQ ID NO: 303052 - protein, 9 aa, Homo Sapiens
SQPSHPLKS

SEQ ID NO: 303053 - protein, 9 aa, Homo Sapiens
LKKFMNKLA

SEQ ID NO: 303054 - protein, 9 aa, Homo Sapiens
HDERQYRCE

SEQ ID NO: 303055 - protein, 9 aa, Homo Sapiens
LLSNHHTLL

SEQ ID NO: 303056 - protein, 9 aa, Homo Sapiens
VEELNNNVT

SEQ ID NO: 303057 - protein, 9 aa, Homo Sapiens
SVVQSYCGH

SEQ ID NO: 303058 - protein, 9 aa, Homo Sapiens
SQVEYLRTP

SEQ ID NO: 303059 - protein, 9 aa, Homo Sapiens
YPPFKGRIS

SEQ ID NO: 303060 - protein, 9 aa, Homo Sapiens
TRSRQDQEV

SEQ ID NO: 303061 - protein, 9 aa, Homo Sapiens
IKANGGLQL

SEQ ID NO: 303062 - protein, 9 aa, Homo Sapiens
YLMEEEAVC

SEQ ID NO: 303063 - protein, 9 aa, Homo Sapiens
LSGPQQQAF

SEQ ID NO: 303064 - protein, 9 aa, Homo Sapiens
SAELVRHQI

SEQ ID NO: 303065 - protein, 9 aa, Homo Sapiens
AAFKEGVFE

SEQ ID NO: 303066 - protein, 9 aa, Homo Sapiens
AIVTSVELG

SEQ ID NO: 303067 - protein, 9 aa, Homo Sapiens
PHVHTQTEK

SEQ ID NO: 303068 - protein, 9 aa, Homo Sapiens
LFQCAKCSL

SEQ ID NO: 303069 - protein, 9 aa, Homo Sapiens
TRSSQNGSL

SEQ ID NO: 303070 - protein, 9 aa, Homo Sapiens
NEGNQIIYT

SEQ ID NO: 303071 - protein, 9 aa, Homo Sapiens
GKWQRDVCN

SEQ ID NO: 303072 - protein, 9 aa, Homo Sapiens
PAKLFGFVT

SEQ ID NO: 303073 - protein, 9 aa, Homo Sapiens
KDTENKDQS

SEQ ID NO: 303074 - protein, 9 aa, Homo Sapiens
YDTTLDHLL

SEQ ID NO: 303075 - protein, 9 aa, Homo Sapiens
DSLSYHQGC

SEQ ID NO: 303076 - protein, 9 aa, Homo Sapiens
PNGINTMSE

SEQ ID NO: 303077 - protein, 9 aa, Homo Sapiens
DKPLKKHLD

SEQ ID NO: 303078 - protein, 9 aa, Homo Sapiens
IEKLKSIDE

SEQ ID NO: 303079 - protein, 9 aa, Homo Sapiens
TKENVNDVD

SEQ ID NO: 303080 - protein, 9 aa, Homo Sapiens
ASQGYFPPR

SEQ ID NO: 303081 - protein, 9 aa, Homo Sapiens
SEGGKVNYE

SEQ ID NO: 303082 - protein, 9 aa, Homo Sapiens
GVEQINLPW

SEQ ID NO: 303083 - protein, 9 aa, Homo Sapiens
VLTELLSNH

SEQ ID NO: 303084 - protein, 9 aa, Homo Sapiens
VCPSDGCTR

SEQ ID NO: 303085 - protein, 9 aa, Homo Sapiens
LVKNIVSLV

SEQ ID NO: 303086 - protein, 9 aa, Homo Sapiens
LIRGQPVIK

SEQ ID NO: 303087 - protein, 9 aa, Homo Sapiens
VRERLRVYL

SEQ ID NO: 303088 - protein, 9 aa, Homo Sapiens
GNLDSDKPI

SEQ ID NO: 303089 - protein, 9 aa, Homo Sapiens
GRKQLLVGQ

SEQ ID NO: 303090 - protein, 9 aa, Homo Sapiens
EDTLKAKYR

SEQ ID NO: 303091 - protein, 9 aa, Homo Sapiens
LPVADPLMD

SEQ ID NO: 303092 - protein, 9 aa, Homo Sapiens
ASENEDNYI

SEQ ID NO: 303093 - protein, 9 aa, Homo Sapiens
NKYDTGEHG

SEQ ID NO: 303094 - protein, 9 aa, Homo Sapiens
KYMLSRDRE

SEQ ID NO: 303095 - protein, 9 aa, Homo Sapiens
GLLYELEES

SEQ ID NO: 303096 - protein, 9 aa, Homo Sapiens
DIVHKNDIL

SEQ ID NO: 303097 - protein, 9 aa, Homo Sapiens
HAGEKPYVC

SEQ ID NO: 303098 - protein, 9 aa, Homo Sapiens
QEQQRHTAY

SEQ ID NO: 303099 - protein, 9 aa, Homo Sapiens
SVSETDVQE

SEQ ID NO: 303100 - protein, 9 aa, Homo Sapiens
LSADMAKSH

SEQ ID NO: 303101 - protein, 9 aa, Homo Sapiens
LSVVASDLG

SEQ ID NO: 303102 - protein, 9 aa, Homo Sapiens
ELLSPVCEE

SEQ ID NO: 303103 - protein, 9 aa, Homo Sapiens
QYLGDKPYR

SEQ ID NO: 303104 - protein, 9 aa, Homo Sapiens
DDFLEYLPL

SEQ ID NO: 303105 - protein, 9 aa, Homo Sapiens
NTFARNTSR

SEQ ID NO: 303106 - protein, 9 aa, Homo Sapiens
WRRARLHVV

SEQ ID NO: 303107 - protein, 9 aa, Homo Sapiens
GIVLLPRLE

SEQ ID NO: 303108 - protein, 9 aa, Homo Sapiens
RSLNDMHSE

SEQ ID NO: 303109 - protein, 9 aa, Homo Sapiens
HGLSIQGHK

SEQ ID NO: 303110 - protein, 9 aa, Homo Sapiens
YFFLGASKF

SEQ ID NO: 303111 - protein, 9 aa, Homo Sapiens
GEKGPDMFC

SEQ ID NO: 303112 - protein, 9 aa, Homo Sapiens
IVLLPRLEC

SEQ ID NO: 303113 - protein, 9 aa, Homo Sapiens
PDVLSPRYD

SEQ ID NO: 303114 - protein, 9 aa, Homo Sapiens
SYRNLVFLG

SEQ ID NO: 303115 - protein, 9 aa, Homo Sapiens
ALQKKQQLA

SEQ ID NO: 303116 - protein, 9 aa, Homo Sapiens
GSPVCRAGK

SEQ ID NO: 303117 - protein, 9 aa, Homo Sapiens
TKIGNIENG

SEQ ID NO: 303118 - protein, 9 aa, Homo Sapiens
VLMFYGYLM

SEQ ID NO: 303119 - protein, 9 aa, Homo Sapiens
EHQAYLTNE

SEQ ID NO: 303120 - protein, 9 aa, Homo Sapiens
TRKGTLKEY

SEQ ID NO: 303121 - protein, 9 aa, Homo Sapiens
WKAPQAVSD

SEQ ID NO: 303122 - protein, 9 aa, Homo Sapiens
GVHMNILPF

SEQ ID NO: 303123 - protein, 9 aa, Homo Sapiens
RKQTVPLLK

SEQ ID NO: 303124 - protein, 9 aa, Homo Sapiens
RTQKGSGAK

SEQ ID NO: 303125 - protein, 9 aa, Homo Sapiens
FNVFFPLLK

SEQ ID NO: 303126 - protein, 9 aa, Homo Sapiens
VEDDRQMDT

SEQ ID NO: 303127 - protein, 9 aa, Homo Sapiens
NDESNKENY

SEQ ID NO: 303128 - protein, 9 aa, Homo Sapiens
DEKRKGKCR

SEQ ID NO: 303129 - protein, 9 aa, Homo Sapiens
IHSSCATSP

SEQ ID NO: 303130 - protein, 9 aa, Homo Sapiens
DSLDSDSLL

SEQ ID NO: 303131 - protein, 9 aa, Homo Sapiens
QSQAYFKLR

SEQ ID NO: 303132 - protein, 9 aa, Homo Sapiens
TFTRYFFSN

SEQ ID NO: 303133 - protein, 9 aa, Homo Sapiens
SDFYMAYER

SEQ ID NO: 303134 - protein, 9 aa, Homo Sapiens
APSSQTKVL

SEQ ID NO: 303135 - protein, 9 aa, Homo Sapiens
TRVDQIVGQ

SEQ ID NO: 303136 - protein, 9 aa, Homo Sapiens
PNVCYDELF

SEQ ID NO: 303137 - protein, 9 aa, Homo Sapiens
QRLFGAKAG

SEQ ID NO: 303138 - protein, 9 aa, Homo Sapiens
GGKIFCIIC

SEQ ID NO: 303139 - protein, 9 aa, Homo Sapiens
AYQDKEGSF

SEQ ID NO: 303140 - protein, 9 aa, Homo Sapiens
PMGTSNFDP

SEQ ID NO: 303141 - protein, 9 aa, Homo Sapiens
EEDNAKQIL

SEQ ID NO: 303142 - protein, 9 aa, Homo Sapiens
KHPHVANPQ

SEQ ID NO: 303143 - protein, 9 aa, Homo Sapiens
DFKTAVKKL

SEQ ID NO: 303144 - protein, 9 aa, Homo Sapiens
SRLLESVER

SEQ ID NO: 303145 - protein, 9 aa, Homo Sapiens
DFLQKKLIG

SEQ ID NO: 303146 - protein, 9 aa, Homo Sapiens
FDEVAIYIS

SEQ ID NO: 303147 - protein, 9 aa, Homo Sapiens
PTLSVTSFC

SEQ ID NO: 303148 - protein, 9 aa, Homo Sapiens
EMEKTLRQM

SEQ ID NO: 303149 - protein, 9 aa, Homo Sapiens
TYGDINIML

SEQ ID NO: 303150 - protein, 9 aa, Homo Sapiens
RIKWTKLTL

SEQ ID NO: 303151 - protein, 9 aa, Homo Sapiens
NMTDDPQSF

SEQ ID NO: 303152 - protein, 9 aa, Homo Sapiens
LKMSQGNIS

SEQ ID NO: 303153 - protein, 9 aa, Homo Sapiens
GTVLCELIH

SEQ ID NO: 303154 - protein, 9 aa, Homo Sapiens
VITTTDDYL

SEQ ID NO: 303155 - protein, 9 aa, Homo Sapiens
LFCVRLRKK

SEQ ID NO: 303156 - protein, 9 aa, Homo Sapiens
KQLQQKQLL

SEQ ID NO: 303157 - protein, 9 aa, Homo Sapiens
SPRVPKKAQ

SEQ ID NO: 303158 - protein, 9 aa, Homo Sapiens
QISEDVVIL

SEQ ID NO: 303159 - protein, 9 aa, Homo Sapiens
VLSPSSHSF

SEQ ID NO: 303160 - protein, 9 aa, Homo Sapiens
SRNDKVHQD

SEQ ID NO: 303161 - protein, 9 aa, Homo Sapiens
ITAEVKVVE

SEQ ID NO: 303162 - protein, 9 aa, Homo Sapiens
GDCAPEDKI

SEQ ID NO: 303163 - protein, 9 aa, Homo Sapiens
STFLNSFGF

SEQ ID NO: 303164 - protein, 9 aa, Homo Sapiens
RTCNLSLPF

SEQ ID NO: 303165 - protein, 9 aa, Homo Sapiens
NISDFTQEI

SEQ ID NO: 303166 - protein, 9 aa, Homo Sapiens
SITGNITII

SEQ ID NO: 303167 - protein, 9 aa, Homo Sapiens
PSDLPRTFK

SEQ ID NO: 303168 - protein, 9 aa, Homo Sapiens
IVEAQVNVI

SEQ ID NO: 303169 - protein, 9 aa, Homo Sapiens
KSSSVPTPL

SEQ ID NO: 303170 - protein, 9 aa, Homo Sapiens
EEEEQDYYL

SEQ ID NO: 303171 - protein, 9 aa, Homo Sapiens
NPIPSNLKL

SEQ ID NO: 303172 - protein, 9 aa, Homo Sapiens
ETDVQEECR

SEQ ID NO: 303173 - protein, 9 aa, Homo Sapiens
SMQVLGDVV

SEQ ID NO: 303174 - protein, 9 aa, Homo Sapiens
QTSKFVLRI

SEQ ID NO: 303175 - protein, 9 aa, Homo Sapiens
KLMLCRSET

SEQ ID NO: 303176 - protein, 9 aa, Homo Sapiens
VFCALLLVL

SEQ ID NO: 303177 - protein, 9 aa, Homo Sapiens
KEKNVVGQI

SEQ ID NO: 303178 - protein, 9 aa, Homo Sapiens
YDHQGIFKI

SEQ ID NO: 303179 - protein, 9 aa, Homo Sapiens
TRQINHSGS

SEQ ID NO: 303180 - protein, 9 aa, Homo Sapiens
GVQGIMGKP

SEQ ID NO: 303181 - protein, 9 aa, Homo Sapiens
PHLAAVPGA

SEQ ID NO: 303182 - protein, 9 aa, Homo Sapiens
LSWTFLGRN

SEQ ID NO: 303183 - protein, 9 aa, Homo Sapiens
AELVNYEQV

SEQ ID NO: 303184 - protein, 9 aa, Homo Sapiens
DDVPRKAKI

SEQ ID NO: 303185 - protein, 9 aa, Homo Sapiens
HSISVQTSK

SEQ ID NO: 303186 - protein, 9 aa, Homo Sapiens
VDDCNWLAR

SEQ ID NO: 303187 - protein, 9 aa, Homo Sapiens
TIDTAKLCL

SEQ ID NO: 303188 - protein, 9 aa, Homo Sapiens
AAENEFVAP

SEQ ID NO: 303189 - protein, 9 aa, Homo Sapiens
ESIFDIIFA

SEQ ID NO: 303190 - protein, 9 aa, Homo Sapiens
SQFSPHLYN

SEQ ID NO: 303191 - protein, 9 aa, Homo Sapiens
SLGAGIAEH

SEQ ID NO: 303192 - protein, 9 aa, Homo Sapiens
DIQVKRIHK

SEQ ID NO: 303193 - protein, 9 aa, Homo Sapiens
LFCMSFFCH

SEQ ID NO: 303194 - protein, 9 aa, Homo Sapiens
TLAQRLGLG

SEQ ID NO: 303195 - protein, 9 aa, Homo Sapiens
VQPSKQKPL

SEQ ID NO: 303196 - protein, 9 aa, Homo Sapiens
QSKTVDDNS

SEQ ID NO: 303197 - protein, 9 aa, Homo Sapiens
MLTGHSLMS

SEQ ID NO: 303198 - protein, 9 aa, Homo Sapiens
NKEVELEEF

SEQ ID NO: 303199 - protein, 9 aa, Homo Sapiens
GESTLLSLH

SEQ ID NO: 303200 - protein, 9 aa, Homo Sapiens
SLRAWQASL

SEQ ID NO: 303201 - protein, 9 aa, Homo Sapiens
REFLSERAD

SEQ ID NO: 303202 - protein, 9 aa, Homo Sapiens
TNLKYKRVR

SEQ ID NO: 303203 - protein, 9 aa, Homo Sapiens
PGIIQSHSL

SEQ ID NO: 303204 - protein, 9 aa, Homo Sapiens
FFGPLGAAQ

SEQ ID NO: 303205 - protein, 9 aa, Homo Sapiens
DSDKPIFFE

SEQ ID NO: 303206 - protein, 9 aa, Homo Sapiens
FLPEEEDGL

SEQ ID NO: 303207 - protein, 9 aa, Homo Sapiens
RMVEDSLAS

SEQ ID NO: 303208 - protein, 9 aa, Homo Sapiens
LEVVEGDLI

SEQ ID NO: 303209 - protein, 9 aa, Homo Sapiens
GMKFFQIKM

SEQ ID NO: 303210 - protein, 9 aa, Homo Sapiens
PQGKQKVIN

SEQ ID NO: 303211 - protein, 9 aa, Homo Sapiens
IYKRAEHES

SEQ ID NO: 303212 - protein, 9 aa, Homo Sapiens
VSWKILLQF

SEQ ID NO: 303213 - protein, 9 aa, Homo Sapiens
SYTYQHGGL

SEQ ID NO: 303214 - protein, 9 aa, Homo Sapiens
LYPSGTYDA

SEQ ID NO: 303215 - protein, 9 aa, Homo Sapiens
MNAPSKSVG

SEQ ID NO: 303216 - protein, 9 aa, Homo Sapiens
HENRDKDTK

SEQ ID NO: 303217 - protein, 9 aa, Homo Sapiens
GVIDYILYS

SEQ ID NO: 303218 - protein, 9 aa, Homo Sapiens
TEEYLKQKK

SEQ ID NO: 303219 - protein, 9 aa, Homo Sapiens
IQKPGKKLP

SEQ ID NO: 303220 - protein, 9 aa, Homo Sapiens
AGIPRTNQY

SEQ ID NO: 303221 - protein, 9 aa, Homo Sapiens
SLIFLAKLL

SEQ ID NO: 303222 - protein, 9 aa, Homo Sapiens
RFYFLFHQP

SEQ ID NO: 303223 - protein, 9 aa, Homo Sapiens
TARLLSECD

SEQ ID NO: 303224 - protein, 9 aa, Homo Sapiens
RDRPFQKPI

SEQ ID NO: 303225 - protein, 9 aa, Homo Sapiens
AQLKMSQGN

SEQ ID NO: 303226 - protein, 9 aa, Homo Sapiens
YEILELCRG

SEQ ID NO: 303227 - protein, 9 aa, Homo Sapiens
GDKITRIEG

SEQ ID NO: 303228 - protein, 9 aa, Homo Sapiens
WCHRWHIFY

SEQ ID NO: 303229 - protein, 9 aa, Homo Sapiens
KMTEGSVTV

SEQ ID NO: 303230 - protein, 9 aa, Homo Sapiens
NGDMEKIIL

SEQ ID NO: 303231 - protein, 9 aa, Homo Sapiens
SSKKRGRSK

SEQ ID NO: 303232 - protein, 9 aa, Homo Sapiens
GERNRIQLP

SEQ ID NO: 303233 - protein, 9 aa, Homo Sapiens
EFDYCKIKH

SEQ ID NO: 303234 - protein, 9 aa, Homo Sapiens
NNCDGKSLL

SEQ ID NO: 303235 - protein, 9 aa, Homo Sapiens
AKLFGFVTR

SEQ ID NO: 303236 - protein, 9 aa, Homo Sapiens
CISPQSRLT

SEQ ID NO: 303237 - protein, 9 aa, Homo Sapiens
KLGIINREA

SEQ ID NO: 303238 - protein, 9 aa, Homo Sapiens
KEGVFELIP

SEQ ID NO: 303239 - protein, 9 aa, Homo Sapiens
VRSFIQPPK

SEQ ID NO: 303240 - protein, 9 aa, Homo Sapiens
KRNARIIKW

SEQ ID NO: 303241 - protein, 9 aa, Homo Sapiens
YFIAVDDDK

SEQ ID NO: 303242 - protein, 9 aa, Homo Sapiens
ESINDGNIQ

SEQ ID NO: 303243 - protein, 9 aa, Homo Sapiens
TTSLALSRS

SEQ ID NO: 303244 - protein, 9 aa, Homo Sapiens
NKLDKTIKA

SEQ ID NO: 303245 - protein, 9 aa, Homo Sapiens
LITPFQLYL

SEQ ID NO: 303246 - protein, 9 aa, Homo Sapiens
QESNKACLR

SEQ ID NO: 303247 - protein, 9 aa, Homo Sapiens
FYYAIKDGG

SEQ ID NO: 303248 - protein, 9 aa, Homo Sapiens
TVICTEPSV

SEQ ID NO: 303249 - protein, 9 aa, Homo Sapiens
VLANCKEWQ

SEQ ID NO: 303250 - protein, 9 aa, Homo Sapiens
NVPILSADI

SEQ ID NO: 303251 - protein, 9 aa, Homo Sapiens
MQVNNIKKN

SEQ ID NO: 303252 - protein, 9 aa, Homo Sapiens
RSATLKIQS

SEQ ID NO: 303253 - protein, 9 aa, Homo Sapiens
DSQMSPSHL

SEQ ID NO: 303254 - protein, 9 aa, Homo Sapiens
CEHVKLLLN

SEQ ID NO: 303255 - protein, 9 aa, Homo Sapiens
RVSLRRMHS

SEQ ID NO: 303256 - protein, 9 aa, Homo Sapiens
EQEKVILRK

SEQ ID NO: 303257 - protein, 9 aa, Homo Sapiens
AQPDPEVRR

SEQ ID NO: 303258 - protein, 9 aa, Homo Sapiens
ITVSVKKRS

SEQ ID NO: 303259 - protein, 9 aa, Homo Sapiens
YWQKENIPK

SEQ ID NO: 303260 - protein, 9 aa, Homo Sapiens
PETLTLVSF

SEQ ID NO: 303261 - protein, 9 aa, Homo Sapiens
VSHLCPQPP

SEQ ID NO: 303262 - protein, 9 aa, Homo Sapiens
HKEQGKEQA

SEQ ID NO: 303263 - protein, 9 aa, Homo Sapiens
QKVVALQKK

SEQ ID NO: 303264 - protein, 9 aa, Homo Sapiens
PDLVLELNN

SEQ ID NO: 303265 - protein, 9 aa, Homo Sapiens
APCMRDLIK

SEQ ID NO: 303266 - protein, 9 aa, Homo Sapiens
SRRSKLHYA

SEQ ID NO: 303267 - protein, 9 aa, Homo Sapiens
KKKGPHTPS

SEQ ID NO: 303268 - protein, 9 aa, Homo Sapiens
VLDPYLLKC

SEQ ID NO: 303269 - protein, 9 aa, Homo Sapiens
TNVATWKSN

SEQ ID NO: 303270 - protein, 9 aa, Homo Sapiens
EIHYSKMRL

SEQ ID NO: 303271 - protein, 9 aa, Homo Sapiens
MKGKGQETS

SEQ ID NO: 303272 - protein, 9 aa, Homo Sapiens
VHKRDKFHS

SEQ ID NO: 303273 - protein, 9 aa, Homo Sapiens
EWGLFRGIE

SEQ ID NO: 303274 - protein, 9 aa, Homo Sapiens
LLNEFEGKT

SEQ ID NO: 303275 - protein, 9 aa, Homo Sapiens
QARAASQNN

SEQ ID NO: 303276 - protein, 9 aa, Homo Sapiens
YADNSCNKQ

SEQ ID NO: 303277 - protein, 9 aa, Homo Sapiens
KTVAGLCYH

SEQ ID NO: 303278 - protein, 9 aa, Homo Sapiens
KDRINDDLS

SEQ ID NO: 303279 - protein, 9 aa, Homo Sapiens
VAHIKKCSM

SEQ ID NO: 303280 - protein, 9 aa, Homo Sapiens
LIFQYLPDE

SEQ ID NO: 303281 - protein, 9 aa, Homo Sapiens
KHANVVTLH

SEQ ID NO: 303282 - protein, 9 aa, Homo Sapiens
KIHLKVLEI

SEQ ID NO: 303283 - protein, 9 aa, Homo Sapiens
GLNLNSPEK

SEQ ID NO: 303284 - protein, 9 aa, Homo Sapiens
DSRNDKVHQ

SEQ ID NO: 303285 - protein, 9 aa, Homo Sapiens
FYLGELPLS

SEQ ID NO: 303286 - protein, 9 aa, Homo Sapiens
EPAHLMSLS

SEQ ID NO: 303287 - protein, 9 aa, Homo Sapiens
LSRANILVT

SEQ ID NO: 303288 - protein, 9 aa, Homo Sapiens
SANKINYFE

SEQ ID NO: 303289 - protein, 9 aa, Homo Sapiens
VACSYGWVL

SEQ ID NO: 303290 - protein, 9 aa, Homo Sapiens
AGHHHPDKS

SEQ ID NO: 303291 - protein, 9 aa, Homo Sapiens
LTMLTGHSL

SEQ ID NO: 303292 - protein, 9 aa, Homo Sapiens
NTMNISIPG

SEQ ID NO: 303293 - protein, 9 aa, Homo Sapiens
ELLPQGSAC

SEQ ID NO: 303294 - protein, 9 aa, Homo Sapiens
KEGLKYVDT

SEQ ID NO: 303295 - protein, 9 aa, Homo Sapiens
RLHVVAVTL

SEQ ID NO: 303296 - protein, 9 aa, Homo Sapiens
YFDNIVNSF

SEQ ID NO: 303297 - protein, 9 aa, Homo Sapiens
SQKSLQIAA

SEQ ID NO: 303298 - protein, 9 aa, Homo Sapiens
FLNSFGFNI

SEQ ID NO: 303299 - protein, 9 aa, Homo Sapiens
SDHLLFNMC

SEQ ID NO: 303300 - protein, 9 aa, Homo Sapiens
KKLLASDSN

SEQ ID NO: 303301 - protein, 9 aa, Homo Sapiens
REVRHWKSH

SEQ ID NO: 303302 - protein, 9 aa, Homo Sapiens
THSKARSSP

SEQ ID NO: 303303 - protein, 9 aa, Homo Sapiens
APTPDKEMM

SEQ ID NO: 303304 - protein, 9 aa, Homo Sapiens
VWFSNQRAK

SEQ ID NO: 303305 - protein, 9 aa, Homo Sapiens
KITDLTGAF

SEQ ID NO: 303306 - protein, 9 aa, Homo Sapiens
TPSLDQQCD

SEQ ID NO: 303307 - protein, 9 aa, Homo Sapiens
EDSDMAQDF

SEQ ID NO: 303308 - protein, 9 aa, Homo Sapiens
HCECGHCHC

SEQ ID NO: 303309 - protein, 9 aa, Homo Sapiens
LSYLTKHKT

SEQ ID NO: 303310 - protein, 9 aa, Homo Sapiens
KEKVNLQKC

SEQ ID NO: 303311 - protein, 9 aa, Homo Sapiens
SVSWKILLQ

SEQ ID NO: 303312 - protein, 9 aa, Homo Sapiens
TETAPLQMY

SEQ ID NO: 303313 - protein, 9 aa, Homo Sapiens
ISDFEIPTY

SEQ ID NO: 303314 - protein, 9 aa, Homo Sapiens
NPNVRAMYG

SEQ ID NO: 303315 - protein, 9 aa, Homo Sapiens
KKGHRGDPG

SEQ ID NO: 303316 - protein, 9 aa, Homo Sapiens
PVQAEAYIH

SEQ ID NO: 303317 - protein, 9 aa, Homo Sapiens
MKDKLLLVL

SEQ ID NO: 303318 - protein, 9 aa, Homo Sapiens
QRCCDSQDA

SEQ ID NO: 303319 - protein, 9 aa, Homo Sapiens
KGKKINKRN

SEQ ID NO: 303320 - protein, 9 aa, Homo Sapiens
GMGKQGKKG

SEQ ID NO: 303321 - protein, 9 aa, Homo Sapiens
KKQRHQQGQ

SEQ ID NO: 303322 - protein, 9 aa, Homo Sapiens
LLTQIKSKK

SEQ ID NO: 303323 - protein, 9 aa, Homo Sapiens
ETVTLNSSL

SEQ ID NO: 303324 - protein, 9 aa, Homo Sapiens
TQIFQEKVL

SEQ ID NO: 303325 - protein, 9 aa, Homo Sapiens
TRYRAGKQR

SEQ ID NO: 303326 - protein, 9 aa, Homo Sapiens
KENNPSVRL

SEQ ID NO: 303327 - protein, 9 aa, Homo Sapiens
PSQYVPCLI

SEQ ID NO: 303328 - protein, 9 aa, Homo Sapiens
TSAGRYVCE

SEQ ID NO: 303329 - protein, 9 aa, Homo Sapiens
CYPKEIVRY

SEQ ID NO: 303330 - protein, 9 aa, Homo Sapiens
LVLEAAKFV

SEQ ID NO: 303331 - protein, 9 aa, Homo Sapiens
IIKDVEDCL

SEQ ID NO: 303332 - protein, 9 aa, Homo Sapiens
EKNRVKKKM

SEQ ID NO: 303333 - protein, 9 aa, Homo Sapiens
KADLNTTLY

SEQ ID NO: 303334 - protein, 9 aa, Homo Sapiens
LKRRDVGSS

SEQ ID NO: 303335 - protein, 9 aa, Homo Sapiens
KRIKYAPGA

SEQ ID NO: 303336 - protein, 9 aa, Homo Sapiens
CFNQSSSRI

SEQ ID NO: 303337 - protein, 9 aa, Homo Sapiens
YKCDVSSEL

SEQ ID NO: 303338 - protein, 9 aa, Homo Sapiens
GHPGDVSFG

SEQ ID NO: 303339 - protein, 9 aa, Homo Sapiens
LQSWNLNCI

SEQ ID NO: 303340 - protein, 9 aa, Homo Sapiens
VPGETITKM

SEQ ID NO: 303341 - protein, 9 aa, Homo Sapiens
RTVPNIIKI

SEQ ID NO: 303342 - protein, 9 aa, Homo Sapiens
CNDCGNFFR

SEQ ID NO: 303343 - protein, 9 aa, Homo Sapiens
YRLRRFEAE

SEQ ID NO: 303344 - protein, 9 aa, Homo Sapiens
TTEKVGSVC

SEQ ID NO: 303345 - protein, 9 aa, Homo Sapiens
YKFHNRTFL

SEQ ID NO: 303346 - protein, 9 aa, Homo Sapiens
VYLERVSAL

SEQ ID NO: 303347 - protein, 9 aa, Homo Sapiens
KSHKDVDES

SEQ ID NO: 303348 - protein, 9 aa, Homo Sapiens
PKEFSERKS

SEQ ID NO: 303349 - protein, 9 aa, Homo Sapiens
RQILCLIEQ

SEQ ID NO: 303350 - protein, 9 aa, Homo Sapiens
SYLPASASC

SEQ ID NO: 303351 - protein, 9 aa, Homo Sapiens
TVRSLGIYT

SEQ ID NO: 303352 - protein, 9 aa, Homo Sapiens
VHIPTHGSW

SEQ ID NO: 303353 - protein, 9 aa, Homo Sapiens
QTCIGTPYY

SEQ ID NO: 303354 - protein, 9 aa, Homo Sapiens
DEEGCIQGS

SEQ ID NO: 303355 - protein, 9 aa, Homo Sapiens
IFNKIKFGE

SEQ ID NO: 303356 - protein, 9 aa, Homo Sapiens
PQGDYQIIQ

SEQ ID NO: 303357 - protein, 9 aa, Homo Sapiens
ARHHILHAG

SEQ ID NO: 303358 - protein, 9 aa, Homo Sapiens
NYGQKIIKN

SEQ ID NO: 303359 - protein, 9 aa, Homo Sapiens
QNRVFHDFR

SEQ ID NO: 303360 - protein, 9 aa, Homo Sapiens
KAFNDIAKY

SEQ ID NO: 303361 - protein, 9 aa, Homo Sapiens
KDLVKAKLG

SEQ ID NO: 303362 - protein, 9 aa, Homo Sapiens
DTYGEENDE

SEQ ID NO: 303363 - protein, 9 aa, Homo Sapiens
ETETAPLQM

SEQ ID NO: 303364 - protein, 9 aa, Homo Sapiens
DNYILWCVN

SEQ ID NO: 303365 - protein, 9 aa, Homo Sapiens
APGVTDVLC

SEQ ID NO: 303366 - protein, 9 aa, Homo Sapiens
TVGACLFHN

SEQ ID NO: 303367 - protein, 9 aa, Homo Sapiens
KQGKKGKFV

SEQ ID NO: 303368 - protein, 9 aa, Homo Sapiens
LGAMLWGLF

SEQ ID NO: 303369 - protein, 9 aa, Homo Sapiens
TVTTAMTTT

SEQ ID NO: 303370 - protein, 9 aa, Homo Sapiens
RGHYGVKRT

SEQ ID NO: 303371 - protein, 9 aa, Homo Sapiens
VRHQNIHTG

SEQ ID NO: 303372 - protein, 9 aa, Homo Sapiens
HPSGRFVIG

SEQ ID NO: 303373 - protein, 9 aa, Homo Sapiens
IHYSKMRLE

SEQ ID NO: 303374 - protein, 9 aa, Homo Sapiens
QQSQAYFKL

SEQ ID NO: 303375 - protein, 9 aa, Homo Sapiens
SFLQNTDDM

SEQ ID NO: 303376 - protein, 9 aa, Homo Sapiens
KAFRNNYGL

SEQ ID NO: 303377 - protein, 9 aa, Homo Sapiens
GLNKKCLQI

SEQ ID NO: 303378 - protein, 9 aa, Homo Sapiens
MTSGHNEIQ

SEQ ID NO: 303379 - protein, 9 aa, Homo Sapiens
KKWKDQKME

SEQ ID NO: 303380 - protein, 9 aa, Homo Sapiens
DVSFQNIGI

SEQ ID NO: 303381 - protein, 9 aa, Homo Sapiens
VHQEYKEDP

SEQ ID NO: 303382 - protein, 9 aa, Homo Sapiens
SGNISGSFT

SEQ ID NO: 303383 - protein, 9 aa, Homo Sapiens
LFDPRTLHY

SEQ ID NO: 303384 - protein, 9 aa, Homo Sapiens
IKIHRMDHY

SEQ ID NO: 303385 - protein, 9 aa, Homo Sapiens
GYHPNNNKY

SEQ ID NO: 303386 - protein, 9 aa, Homo Sapiens
VVDATHKGN

SEQ ID NO: 303387 - protein, 9 aa, Homo Sapiens
PGIIWKLGS

SEQ ID NO: 303388 - protein, 9 aa, Homo Sapiens
IEFLWHLKS

SEQ ID NO: 303389 - protein, 9 aa, Homo Sapiens
VANPQLQMA

SEQ ID NO: 303390 - protein, 9 aa, Homo Sapiens
VYTVVIPML

SEQ ID NO: 303391 - protein, 9 aa, Homo Sapiens
SDLKILRCL

SEQ ID NO: 303392 - protein, 9 aa, Homo Sapiens
RARERVYEL

SEQ ID NO: 303393 - protein, 9 aa, Homo Sapiens
ASSYRLVAS

SEQ ID NO: 303394 - protein, 9 aa, Homo Sapiens
CRHEKKIHE

SEQ ID NO: 303395 - protein, 9 aa, Homo Sapiens
FLLLSVLAG

SEQ ID NO: 303396 - protein, 9 aa, Homo Sapiens
RGSNGLWRF

SEQ ID NO: 303397 - protein, 9 aa, Homo Sapiens
MKKKFVQIE

SEQ ID NO: 303398 - protein, 9 aa, Homo Sapiens
LLTALFSAT

SEQ ID NO: 303399 - protein, 9 aa, Homo Sapiens
PESLNKDKD

SEQ ID NO: 303400 - protein, 9 aa, Homo Sapiens
PAVIDAYVC

SEQ ID NO: 303401 - protein, 9 aa, Homo Sapiens
EFKNMVKTV

SEQ ID NO: 303402 - protein, 9 aa, Homo Sapiens
VNLRLILQQ

SEQ ID NO: 303403 - protein, 9 aa, Homo Sapiens
FSNEERCTG

SEQ ID NO: 303404 - protein, 9 aa, Homo Sapiens
FWWYWQKEN

SEQ ID NO: 303405 - protein, 9 aa, Homo Sapiens
EGWLCIEKL

SEQ ID NO: 303406 - protein, 9 aa, Homo Sapiens
LVNCVEPVG

SEQ ID NO: 303407 - protein, 9 aa, Homo Sapiens
SPQKLPTSL

SEQ ID NO: 303408 - protein, 9 aa, Homo Sapiens
FCIGVILVC

SEQ ID NO: 303409 - protein, 9 aa, Homo Sapiens
GKEACTLDT

SEQ ID NO: 303410 - protein, 9 aa, Homo Sapiens
DDIFNKIKF

SEQ ID NO: 303411 - protein, 9 aa, Homo Sapiens
VSVDLCQKG

SEQ ID NO: 303412 - protein, 9 aa, Homo Sapiens
RENKNLQED

SEQ ID NO: 303413 - protein, 9 aa, Homo Sapiens
DAVIVHKQL

SEQ ID NO: 303414 - protein, 9 aa, Homo Sapiens
QIMTCGSPV

SEQ ID NO: 303415 - protein, 9 aa, Homo Sapiens
SIYLIDLLT

SEQ ID NO: 303416 - protein, 9 aa, Homo Sapiens
KFDFEACNE

SEQ ID NO: 303417 - protein, 9 aa, Homo Sapiens
VKRIHKYKR

SEQ ID NO: 303418 - protein, 9 aa, Homo Sapiens
WNEWTNDTG

SEQ ID NO: 303419 - protein, 9 aa, Homo Sapiens
KETIYSAER

SEQ ID NO: 303420 - protein, 9 aa, Homo Sapiens
KHQKTRQLE

SEQ ID NO: 303421 - protein, 9 aa, Homo Sapiens
AGFAETVVD

SEQ ID NO: 303422 - protein, 9 aa, Homo Sapiens
IILWDPSTG

SEQ ID NO: 303423 - protein, 9 aa, Homo Sapiens
MLQTLAQAK

SEQ ID NO: 303424 - protein, 9 aa, Homo Sapiens
GSHPQQTQT

SEQ ID NO: 303425 - protein, 9 aa, Homo Sapiens
RRDVGSSAF

SEQ ID NO: 303426 - protein, 9 aa, Homo Sapiens
QMVMAHLVN

SEQ ID NO: 303427 - protein, 9 aa, Homo Sapiens
SSPGVNQVS

SEQ ID NO: 303428 - protein, 9 aa, Homo Sapiens
TKKETRFKW

SEQ ID NO: 303429 - protein, 9 aa, Homo Sapiens
NTNSKGPSS

SEQ ID NO: 303430 - protein, 9 aa, Homo Sapiens
SKDLESAEE

SEQ ID NO: 303431 - protein, 9 aa, Homo Sapiens
SDSMFVHNN

SEQ ID NO: 303432 - protein, 9 aa, Homo Sapiens
ARQPQPFFA

SEQ ID NO: 303433 - protein, 9 aa, Homo Sapiens
HNNVLESYY

SEQ ID NO: 303434 - protein, 9 aa, Homo Sapiens
RCVPPALEK

SEQ ID NO: 303435 - protein, 9 aa, Homo Sapiens
FLAEKLQLI

SEQ ID NO: 303436 - protein, 9 aa, Homo Sapiens
MKNTQKSVT

SEQ ID NO: 303437 - protein, 9 aa, Homo Sapiens
NDPWVQQLI

SEQ ID NO: 303438 - protein, 9 aa, Homo Sapiens
VPQQTHRPH

SEQ ID NO: 303439 - protein, 9 aa, Homo Sapiens
NHRSSMQVL

SEQ ID NO: 303440 - protein, 9 aa, Homo Sapiens
YQGVRKDLM

SEQ ID NO: 303441 - protein, 9 aa, Homo Sapiens
ECVCKIALG

SEQ ID NO: 303442 - protein, 9 aa, Homo Sapiens
SDNSSRRVS

SEQ ID NO: 303443 - protein, 9 aa, Homo Sapiens
NNLQQEISD

SEQ ID NO: 303444 - protein, 9 aa, Homo Sapiens
IIQMDLHLH

SEQ ID NO: 303445 - protein, 9 aa, Homo Sapiens
ERYTFSFTV

SEQ ID NO: 303446 - protein, 9 aa, Homo Sapiens
FVTGYAIST

SEQ ID NO: 303447 - protein, 9 aa, Homo Sapiens
TQIKSKKHQ

SEQ ID NO: 303448 - protein, 9 aa, Homo Sapiens
QTKHYQVSG

SEQ ID NO: 303449 - protein, 9 aa, Homo Sapiens
PRKCVVLLQ

SEQ ID NO: 303450 - protein, 9 aa, Homo Sapiens
HPRNAPPCK

SEQ ID NO: 303451 - protein, 9 aa, Homo Sapiens
LTVHYCYQF

SEQ ID NO: 303452 - protein, 9 aa, Homo Sapiens
PKKIRKIIY

SEQ ID NO: 303453 - protein, 9 aa, Homo Sapiens
HPESYSTGH

SEQ ID NO: 303454 - protein, 9 aa, Homo Sapiens
CEKTAVKFG

SEQ ID NO: 303455 - protein, 9 aa, Homo Sapiens
AESCECQKC

SEQ ID NO: 303456 - protein, 9 aa, Homo Sapiens
VETQNMQRL

SEQ ID NO: 303457 - protein, 9 aa, Homo Sapiens
ITDLKSYAS

SEQ ID NO: 303458 - protein, 9 aa, Homo Sapiens
FSPTDNTFA

SEQ ID NO: 303459 - protein, 9 aa, Homo Sapiens
DGAYITKVD

SEQ ID NO: 303460 - protein, 9 aa, Homo Sapiens
QLPKQCHQP

SEQ ID NO: 303461 - protein, 9 aa, Homo Sapiens
ADLAPNKKP

SEQ ID NO: 303462 - protein, 9 aa, Homo Sapiens
EDQQKINTF

SEQ ID NO: 303463 - protein, 9 aa, Homo Sapiens
ACLNKALPV

SEQ ID NO: 303464 - protein, 9 aa, Homo Sapiens
QLQNGDIWE

SEQ ID NO: 303465 - protein, 9 aa, Homo Sapiens
IKVSGQKIK

SEQ ID NO: 303466 - protein, 9 aa, Homo Sapiens
QQLVMQQQR

SEQ ID NO: 303467 - protein, 9 aa, Homo Sapiens
TLTAGLGSG

SEQ ID NO: 303468 - protein, 9 aa, Homo Sapiens
RIYESYGIE

SEQ ID NO: 303469 - protein, 9 aa, Homo Sapiens
MECMNKKEL

SEQ ID NO: 303470 - protein, 9 aa, Homo Sapiens
VTPMLNHIL

SEQ ID NO: 303471 - protein, 9 aa, Homo Sapiens
LELLDRTVV

SEQ ID NO: 303472 - protein, 9 aa, Homo Sapiens
VLYVLNQII

SEQ ID NO: 303473 - protein, 9 aa, Homo Sapiens
NDDQRDVYR

SEQ ID NO: 303474 - protein, 9 aa, Homo Sapiens
MDTIPPTVG

SEQ ID NO: 303475 - protein, 9 aa, Homo Sapiens
PGCLYVVST

SEQ ID NO: 303476 - protein, 9 aa, Homo Sapiens
PSPIYLEQC

SEQ ID NO: 303477 - protein, 9 aa, Homo Sapiens
NNYYSLVLD

SEQ ID NO: 303478 - protein, 9 aa, Homo Sapiens
TTEKGKKIN

SEQ ID NO: 303479 - protein, 9 aa, Homo Sapiens
IEEERRLDS

SEQ ID NO: 303480 - protein, 9 aa, Homo Sapiens
MRDMQQMEI

SEQ ID NO: 303481 - protein, 9 aa, Homo Sapiens
FNYLHNQNG

SEQ ID NO: 303482 - protein, 9 aa, Homo Sapiens
LGATLTVRA

SEQ ID NO: 303483 - protein, 9 aa, Homo Sapiens
YRMLQKEDN

SEQ ID NO: 303484 - protein, 9 aa, Homo Sapiens
TLSTQKLIN

SEQ ID NO: 303485 - protein, 9 aa, Homo Sapiens
HDIRSGKHI

SEQ ID NO: 303486 - protein, 9 aa, Homo Sapiens
ILFLRLWRV

SEQ ID NO: 303487 - protein, 9 aa, Homo Sapiens
GKAFSHHQS

SEQ ID NO: 303488 - protein, 9 aa, Homo Sapiens
SQVNSAGYL

SEQ ID NO: 303489 - protein, 9 aa, Homo Sapiens
LHLENCVSE

SEQ ID NO: 303490 - protein, 9 aa, Homo Sapiens
FHKKFALRC

SEQ ID NO: 303491 - protein, 9 aa, Homo Sapiens
YDSLDSDSL

SEQ ID NO: 303492 - protein, 9 aa, Homo Sapiens
FSAGLILGG

SEQ ID NO: 303493 - protein, 9 aa, Homo Sapiens
ARDFENNYN

SEQ ID NO: 303494 - protein, 9 aa, Homo Sapiens
PSGGLNGRL

SEQ ID NO: 303495 - protein, 9 aa, Homo Sapiens
SICKEIMRP

SEQ ID NO: 303496 - protein, 9 aa, Homo Sapiens
DPEQLEMES

SEQ ID NO: 303497 - protein, 9 aa, Homo Sapiens
PEINESLSV

SEQ ID NO: 303498 - protein, 9 aa, Homo Sapiens
GKLTGPKFK

SEQ ID NO: 303499 - protein, 9 aa, Homo Sapiens
KRVCIPLPV

SEQ ID NO: 303500 - protein, 9 aa, Homo Sapiens
GKIFCIICA

SEQ ID NO: 303501 - protein, 9 aa, Homo Sapiens
KPDLKQRLC

SEQ ID NO: 303502 - protein, 9 aa, Homo Sapiens
WIVYFIAVD

SEQ ID NO: 303503 - protein, 9 aa, Homo Sapiens
EYYFFNVFF

SEQ ID NO: 303504 - protein, 9 aa, Homo Sapiens
KVILRKELE

SEQ ID NO: 303505 - protein, 9 aa, Homo Sapiens
TKPKGRPKN

SEQ ID NO: 303506 - protein, 9 aa, Homo Sapiens
IVNIILILA

SEQ ID NO: 303507 - protein, 9 aa, Homo Sapiens
LRGLVSLCL

SEQ ID NO: 303508 - protein, 9 aa, Homo Sapiens
SRANQKSLR

SEQ ID NO: 303509 - protein, 9 aa, Homo Sapiens
CEFEMGGSK

SEQ ID NO: 303510 - protein, 9 aa, Homo Sapiens
MASNITNKM

SEQ ID NO: 303511 - protein, 9 aa, Homo Sapiens
KTLLEYLEY

SEQ ID NO: 303512 - protein, 9 aa, Homo Sapiens
KQMLHRLTA

SEQ ID NO: 303513 - protein, 9 aa, Homo Sapiens
CQEGKTKDP

SEQ ID NO: 303514 - protein, 9 aa, Homo Sapiens
MFPLLSFNI

SEQ ID NO: 303515 - protein, 9 aa, Homo Sapiens
GNQQEQEQS

SEQ ID NO: 303516 - protein, 9 aa, Homo Sapiens
HILIFSPPP

SEQ ID NO: 303517 - protein, 9 aa, Homo Sapiens
EPEGGSGWT

SEQ ID NO: 303518 - protein, 9 aa, Homo Sapiens
LSERGSQQS

SEQ ID NO: 303519 - protein, 9 aa, Homo Sapiens
DVSHKLLQI

SEQ ID NO: 303520 - protein, 9 aa, Homo Sapiens
VICEDGNSI

SEQ ID NO: 303521 - protein, 9 aa, Homo Sapiens
DDSTCCLVS

SEQ ID NO: 303522 - protein, 9 aa, Homo Sapiens
VPKIRPCPT

SEQ ID NO: 303523 - protein, 9 aa, Homo Sapiens
SKALQRKSR

SEQ ID NO: 303524 - protein, 9 aa, Homo Sapiens
CNQRQKQKQ

SEQ ID NO: 303525 - protein, 9 aa, Homo Sapiens
KYEFAVQLH

SEQ ID NO: 303526 - protein, 9 aa, Homo Sapiens
GMVITIEPS

SEQ ID NO: 303527 - protein, 9 aa, Homo Sapiens
VLGTHKLTQ

SEQ ID NO: 303528 - protein, 9 aa, Homo Sapiens
AFTVSSFFL

SEQ ID NO: 303529 - protein, 9 aa, Homo Sapiens
TVKDSLIKL

SEQ ID NO: 303530 - protein, 9 aa, Homo Sapiens
VAYGHFPEL

SEQ ID NO: 303531 - protein, 9 aa, Homo Sapiens
TCGRQLDKV

SEQ ID NO: 303532 - protein, 9 aa, Homo Sapiens
LDTSEDKVI

SEQ ID NO: 303533 - protein, 9 aa, Homo Sapiens
LTQHVIIHA

SEQ ID NO: 303534 - protein, 9 aa, Homo Sapiens
ASHNSPGST

SEQ ID NO: 303535 - protein, 9 aa, Homo Sapiens
SGVTGNYPH

SEQ ID NO: 303536 - protein, 9 aa, Homo Sapiens
KNNNSLSGL

SEQ ID NO: 303537 - protein, 9 aa, Homo Sapiens
CILKAHGEK

SEQ ID NO: 303538 - protein, 9 aa, Homo Sapiens
NAKKTTFQK

SEQ ID NO: 303539 - protein, 9 aa, Homo Sapiens
TIRFTCSEN

SEQ ID NO: 303540 - protein, 9 aa, Homo Sapiens
DSKIKYEDL

SEQ ID NO: 303541 - protein, 9 aa, Homo Sapiens
NVRAMYGNT

SEQ ID NO: 303542 - protein, 9 aa, Homo Sapiens
CDKKTISFH

SEQ ID NO: 303543 - protein, 9 aa, Homo Sapiens
DKVPGGEDE

SEQ ID NO: 303544 - protein, 9 aa, Homo Sapiens
IKILKRHLS

SEQ ID NO: 303545 - protein, 9 aa, Homo Sapiens
KEKDKTPKL

SEQ ID NO: 303546 - protein, 9 aa, Homo Sapiens
KIATLLLAN

SEQ ID NO: 303547 - protein, 9 aa, Homo Sapiens
DTSTFLVKI

SEQ ID NO: 303548 - protein, 9 aa, Homo Sapiens
ILKEVEYCT

SEQ ID NO: 303549 - protein, 9 aa, Homo Sapiens
RQMGDALPV

SEQ ID NO: 303550 - protein, 9 aa, Homo Sapiens
TLQEARVLL

SEQ ID NO: 303551 - protein, 9 aa, Homo Sapiens
VQYIMNNSF

SEQ ID NO: 303552 - protein, 9 aa, Homo Sapiens
VQELSKNEV

SEQ ID NO: 303553 - protein, 9 aa, Homo Sapiens
ENYKVVAMS

SEQ ID NO: 303554 - protein, 9 aa, Homo Sapiens
CTKLIIQAG

SEQ ID NO: 303555 - protein, 9 aa, Homo Sapiens
TALVTQQNV

SEQ ID NO: 303556 - protein, 9 aa, Homo Sapiens
FKTKYSPGV

SEQ ID NO: 303557 - protein, 9 aa, Homo Sapiens
SQLSEHQII

SEQ ID NO: 303558 - protein, 9 aa, Homo Sapiens
SWNFKLPHP

SEQ ID NO: 303559 - protein, 9 aa, Homo Sapiens
VRNDSNKKK

SEQ ID NO: 303560 - protein, 9 aa, Homo Sapiens
KDKQTGETN

SEQ ID NO: 303561 - protein, 9 aa, Homo Sapiens
ETLFGVQWV

SEQ ID NO: 303562 - protein, 9 aa, Homo Sapiens
TVQCATARD

SEQ ID NO: 303563 - protein, 9 aa, Homo Sapiens
RHIMDRTPD

SEQ ID NO: 303564 - protein, 9 aa, Homo Sapiens
CIFREQFED

SEQ ID NO: 303565 - protein, 9 aa, Homo Sapiens
WSQQKEVEH

SEQ ID NO: 303566 - protein, 9 aa, Homo Sapiens
KEQEKSYMT

SEQ ID NO: 303567 - protein, 9 aa, Homo Sapiens
DNVNKVGEI

SEQ ID NO: 303568 - protein, 9 aa, Homo Sapiens
ALSKNNPGV

SEQ ID NO: 303569 - protein, 9 aa, Homo Sapiens
IDNSAAVQK

SEQ ID NO: 303570 - protein, 9 aa, Homo Sapiens
IKKVRSKNN

SEQ ID NO: 303571 - protein, 9 aa, Homo Sapiens
LGCNKLASF

SEQ ID NO: 303572 - protein, 9 aa, Homo Sapiens
RVCWAQAGK

SEQ ID NO: 303573 - protein, 9 aa, Homo Sapiens
GCTTTNYPS

SEQ ID NO: 303574 - protein, 9 aa, Homo Sapiens
NTPWGINPH

SEQ ID NO: 303575 - protein, 9 aa, Homo Sapiens
SYASAFSER

SEQ ID NO: 303576 - protein, 9 aa, Homo Sapiens
KKTISFHGC

SEQ ID NO: 303577 - protein, 9 aa, Homo Sapiens
LTFNFISYL

SEQ ID NO: 303578 - protein, 9 aa, Homo Sapiens
LRRAVQLGL

SEQ ID NO: 303579 - protein, 9 aa, Homo Sapiens
QDSYRESIC

SEQ ID NO: 303580 - protein, 9 aa, Homo Sapiens
AEKYRKNVL

SEQ ID NO: 303581 - protein, 9 aa, Homo Sapiens
PQLCVCEIC

SEQ ID NO: 303582 - protein, 9 aa, Homo Sapiens
FGFVTRKQG

SEQ ID NO: 303583 - protein, 9 aa, Homo Sapiens
CIYVVQAYI

SEQ ID NO: 303584 - protein, 9 aa, Homo Sapiens
KSLQFNKTM

SEQ ID NO: 303585 - protein, 9 aa, Homo Sapiens
FLATQARKG

SEQ ID NO: 303586 - protein, 9 aa, Homo Sapiens
KLGYNVNTS

SEQ ID NO: 303587 - protein, 9 aa, Homo Sapiens
VAKIDSLAP

SEQ ID NO: 303588 - protein, 9 aa, Homo Sapiens
LDPYLLKCF

SEQ ID NO: 303589 - protein, 9 aa, Homo Sapiens
EEIYLQQLR

SEQ ID NO: 303590 - protein, 9 aa, Homo Sapiens
VGGLSPEIT

SEQ ID NO: 303591 - protein, 9 aa, Homo Sapiens
AKDPGDLSA

SEQ ID NO: 303592 - protein, 9 aa, Homo Sapiens
TFVVTELII

SEQ ID NO: 303593 - protein, 9 aa, Homo Sapiens
PNITVIYDG

SEQ ID NO: 303594 - protein, 9 aa, Homo Sapiens
EAVAGGLLV

SEQ ID NO: 303595 - protein, 9 aa, Homo Sapiens
DKTSGEKKC

SEQ ID NO: 303596 - protein, 9 aa, Homo Sapiens
LGDSCILEC

SEQ ID NO: 303597 - protein, 9 aa, Homo Sapiens
QFTGLKFPS

SEQ ID NO: 303598 - protein, 9 aa, Homo Sapiens
NNLEYAATV

SEQ ID NO: 303599 - protein, 9 aa, Homo Sapiens
KENIPKYVE

SEQ ID NO: 303600 - protein, 9 aa, Homo Sapiens
RESTQENKS

SEQ ID NO: 303601 - protein, 9 aa, Homo Sapiens
PLHISDRVS

SEQ ID NO: 303602 - protein, 9 aa, Homo Sapiens
EAPDLYVQM

SEQ ID NO: 303603 - protein, 9 aa, Homo Sapiens
SFYAHLTEL

SEQ ID NO: 303604 - protein, 9 aa, Homo Sapiens
EKGTEGDIS

SEQ ID NO: 303605 - protein, 9 aa, Homo Sapiens
WATIQIEKG

SEQ ID NO: 303606 - protein, 9 aa, Homo Sapiens
LDVKPDNLL

SEQ ID NO: 303607 - protein, 9 aa, Homo Sapiens
LDCFLLDSA

SEQ ID NO: 303608 - protein, 9 aa, Homo Sapiens
KLKKFMNKL

SEQ ID NO: 303609 - protein, 9 aa, Homo Sapiens
NHTSCGKKL

SEQ ID NO: 303610 - protein, 9 aa, Homo Sapiens
QKRVQTMFN

SEQ ID NO: 303611 - protein, 9 aa, Homo Sapiens
NTFTRYFFS

SEQ ID NO: 303612 - protein, 9 aa, Homo Sapiens
TTPAPRVRT

SEQ ID NO: 303613 - protein, 9 aa, Homo Sapiens
YNGVREELE

SEQ ID NO: 303614 - protein, 9 aa, Homo Sapiens
KLTTLKQNV

SEQ ID NO: 303615 - protein, 9 aa, Homo Sapiens
TDDNNSVNH

SEQ ID NO: 303616 - protein, 9 aa, Homo Sapiens
WNTSTSYID

SEQ ID NO: 303617 - protein, 9 aa, Homo Sapiens
DTAKLCLSC

SEQ ID NO: 303618 - protein, 9 aa, Homo Sapiens
SQMSPSHLS

SEQ ID NO: 303619 - protein, 9 aa, Homo Sapiens
AFHNNSSLI

SEQ ID NO: 303620 - protein, 9 aa, Homo Sapiens
RVILLDPKP

SEQ ID NO: 303621 - protein, 9 aa, Homo Sapiens
SRAHLIRHT

SEQ ID NO: 303622 - protein, 9 aa, Homo Sapiens
LSHHSSFQS

SEQ ID NO: 303623 - protein, 9 aa, Homo Sapiens
LQFNKTMDA

SEQ ID NO: 303624 - protein, 9 aa, Homo Sapiens
AFLGIVNII

SEQ ID NO: 303625 - protein, 9 aa, Homo Sapiens
AGRYVCENC

SEQ ID NO: 303626 - protein, 9 aa, Homo Sapiens
VITALVAWV

SEQ ID NO: 303627 - protein, 9 aa, Homo Sapiens
INNSRLMDE

SEQ ID NO: 303628 - protein, 9 aa, Homo Sapiens
VVSMSRLHL

SEQ ID NO: 303629 - protein, 9 aa, Homo Sapiens
GCLTQSFFA

SEQ ID NO: 303630 - protein, 9 aa, Homo Sapiens
YTDLQKMMK

SEQ ID NO: 303631 - protein, 9 aa, Homo Sapiens
WQIAYIMWG

SEQ ID NO: 303632 - protein, 9 aa, Homo Sapiens
VKYLGLSAV

SEQ ID NO: 303633 - protein, 9 aa, Homo Sapiens
YSLVICEDG

SEQ ID NO: 303634 - protein, 9 aa, Homo Sapiens
HSSEDPMDM

SEQ ID NO: 303635 - protein, 9 aa, Homo Sapiens
AIILYVYVL

SEQ ID NO: 303636 - protein, 9 aa, Homo Sapiens
TAEIIDEFI

SEQ ID NO: 303637 - protein, 9 aa, Homo Sapiens
IENALVGQY

SEQ ID NO: 303638 - protein, 9 aa, Homo Sapiens
KNNRLRMEL

SEQ ID NO: 303639 - protein, 9 aa, Homo Sapiens
LERVLEACV

SEQ ID NO: 303640 - protein, 9 aa, Homo Sapiens
EFETYADAR

SEQ ID NO: 303641 - protein, 9 aa, Homo Sapiens
AFTGKTEPG

SEQ ID NO: 303642 - protein, 9 aa, Homo Sapiens
DPCLRQMFC

SEQ ID NO: 303643 - protein, 9 aa, Homo Sapiens
HDVTILMKG

SEQ ID NO: 303644 - protein, 9 aa, Homo Sapiens
TCASHLPIV

SEQ ID NO: 303645 - protein, 9 aa, Homo Sapiens
KGKSPHTER

SEQ ID NO: 303646 - protein, 9 aa, Homo Sapiens
AETTKGHDG

SEQ ID NO: 303647 - protein, 9 aa, Homo Sapiens
SQWRVFAGA

SEQ ID NO: 303648 - protein, 9 aa, Homo Sapiens
TKYLQTTLN

SEQ ID NO: 303649 - protein, 9 aa, Homo Sapiens
PDGLNKKCL

SEQ ID NO: 303650 - protein, 9 aa, Homo Sapiens
AILRINWNQ

SEQ ID NO: 303651 - protein, 9 aa, Homo Sapiens
GLLLLTLIT

SEQ ID NO: 303652 - protein, 9 aa, Homo Sapiens
NVTSGTVII

SEQ ID NO: 303653 - protein, 9 aa, Homo Sapiens
NKPAAAKKG

SEQ ID NO: 303654 - protein, 9 aa, Homo Sapiens
AETALLIQA

SEQ ID NO: 303655 - protein, 9 aa, Homo Sapiens
LFPSPNPVS

SEQ ID NO: 303656 - protein, 9 aa, Homo Sapiens
LTNKQTDDL

SEQ ID NO: 303657 - protein, 9 aa, Homo Sapiens
FYPTEKALK

SEQ ID NO: 303658 - protein, 9 aa, Homo Sapiens
ALRCSVCKE

SEQ ID NO: 303659 - protein, 9 aa, Homo Sapiens
KKFMNKLAE

SEQ ID NO: 303660 - protein, 9 aa, Homo Sapiens
LAESRAENN

SEQ ID NO: 303661 - protein, 9 aa, Homo Sapiens
VCEICPWFT

SEQ ID NO: 303662 - protein, 9 aa, Homo Sapiens
SEVLCIQNV

SEQ ID NO: 303663 - protein, 9 aa, Homo Sapiens
LATGDEFYF

SEQ ID NO: 303664 - protein, 9 aa, Homo Sapiens
NGTLYYEEN

SEQ ID NO: 303665 - protein, 9 aa, Homo Sapiens
QKQPLRKYV

SEQ ID NO: 303666 - protein, 9 aa, Homo Sapiens
INHFLCDIS

SEQ ID NO: 303667 - protein, 9 aa, Homo Sapiens
GVLRQITGS

SEQ ID NO: 303668 - protein, 9 aa, Homo Sapiens
LDFLLQFTV

SEQ ID NO: 303669 - protein, 9 aa, Homo Sapiens
EVCADTGGL

SEQ ID NO: 303670 - protein, 9 aa, Homo Sapiens
RQLEKHHVC

SEQ ID NO: 303671 - protein, 9 aa, Homo Sapiens
AAGPQPPHH

SEQ ID NO: 303672 - protein, 9 aa, Homo Sapiens
RAEFSKWWP

SEQ ID NO: 303673 - protein, 9 aa, Homo Sapiens
QEDTYVHFN

SEQ ID NO: 303674 - protein, 9 aa, Homo Sapiens
KSSSSSLLQ

SEQ ID NO: 303675 - protein, 9 aa, Homo Sapiens
QLPFHTFAL

SEQ ID NO: 303676 - protein, 9 aa, Homo Sapiens
ENNNLQQEI

SEQ ID NO: 303677 - protein, 9 aa, Homo Sapiens
PEDTWVVEM

SEQ ID NO: 303678 - protein, 9 aa, Homo Sapiens
ESICSWNPG

SEQ ID NO: 303679 - protein, 9 aa, Homo Sapiens
LGLISSTAY

SEQ ID NO: 303680 - protein, 9 aa, Homo Sapiens
NNQLNKFLQ

SEQ ID NO: 303681 - protein, 9 aa, Homo Sapiens
TGADEEEEN

SEQ ID NO: 303682 - protein, 9 aa, Homo Sapiens
EEDNHIKDA

SEQ ID NO: 303683 - protein, 9 aa, Homo Sapiens
DRSATLKIQ

SEQ ID NO: 303684 - protein, 9 aa, Homo Sapiens
LCRGREDYS

SEQ ID NO: 303685 - protein, 9 aa, Homo Sapiens
KILEKFRIE

SEQ ID NO: 303686 - protein, 9 aa, Homo Sapiens
QIMPSQISL

SEQ ID NO: 303687 - protein, 9 aa, Homo Sapiens
HSPKIISFL

SEQ ID NO: 303688 - protein, 9 aa, Homo Sapiens
FRKATSILD

SEQ ID NO: 303689 - protein, 9 aa, Homo Sapiens
DELCPLVVP

SEQ ID NO: 303690 - protein, 9 aa, Homo Sapiens
THIFNTYRN

SEQ ID NO: 303691 - protein, 9 aa, Homo Sapiens
KEEKYFDNW

SEQ ID NO: 303692 - protein, 9 aa, Homo Sapiens
NKGGPPGRG

SEQ ID NO: 303693 - protein, 9 aa, Homo Sapiens
ETGQLAHRF

SEQ ID NO: 303694 - protein, 9 aa, Homo Sapiens
GGIHKDILR

SEQ ID NO: 303695 - protein, 9 aa, Homo Sapiens
TFLNSFGFN

SEQ ID NO: 303696 - protein, 9 aa, Homo Sapiens
EKKQDKTGS

SEQ ID NO: 303697 - protein, 9 aa, Homo Sapiens
HPHPESYST

SEQ ID NO: 303698 - protein, 9 aa, Homo Sapiens
AVVWAVFQN

SEQ ID NO: 303699 - protein, 9 aa, Homo Sapiens
LSPRYDPDS

SEQ ID NO: 303700 - protein, 9 aa, Homo Sapiens
FVPSFLCGE

SEQ ID NO: 303701 - protein, 9 aa, Homo Sapiens
HINEYGIAS

SEQ ID NO: 303702 - protein, 9 aa, Homo Sapiens
LKEDSEVSC

SEQ ID NO: 303703 - protein, 9 aa, Homo Sapiens
FYFFLGASK

SEQ ID NO: 303704 - protein, 9 aa, Homo Sapiens
KRTKHKKHF

SEQ ID NO: 303705 - protein, 9 aa, Homo Sapiens
MEGYYYRYN

SEQ ID NO: 303706 - protein, 9 aa, Homo Sapiens
FSSKSRALS

SEQ ID NO: 303707 - protein, 9 aa, Homo Sapiens
NVIVVDWNR

SEQ ID NO: 303708 - protein, 9 aa, Homo Sapiens
FFDFSTKDF

SEQ ID NO: 303709 - protein, 9 aa, Homo Sapiens
WDLPSGCLL

SEQ ID NO: 303710 - protein, 9 aa, Homo Sapiens
EECKDLIKY

SEQ ID NO: 303711 - protein, 9 aa, Homo Sapiens
DAVFMQFCA

SEQ ID NO: 303712 - protein, 9 aa, Homo Sapiens
PKHVHQRPT

SEQ ID NO: 303713 - protein, 9 aa, Homo Sapiens
SGPQLDFDP

SEQ ID NO: 303714 - protein, 9 aa, Homo Sapiens
AGCTSSPCQ

SEQ ID NO: 303715 - protein, 9 aa, Homo Sapiens
NYTVLAKVQ

SEQ ID NO: 303716 - protein, 9 aa, Homo Sapiens
YLHSRQLVF

SEQ ID NO: 303717 - protein, 9 aa, Homo Sapiens
CTQDTSFEG

SEQ ID NO: 303718 - protein, 9 aa, Homo Sapiens
VGYCSGGTS

SEQ ID NO: 303719 - protein, 9 aa, Homo Sapiens
RLHYAKNVI

SEQ ID NO: 303720 - protein, 9 aa, Homo Sapiens
SFCSEAGMS

SEQ ID NO: 303721 - protein, 9 aa, Homo Sapiens
LQQYSQEHA

SEQ ID NO: 303722 - protein, 9 aa, Homo Sapiens
IKENLQAQI

SEQ ID NO: 303723 - protein, 9 aa, Homo Sapiens
CECQKCHIL

SEQ ID NO: 303724 - protein, 9 aa, Homo Sapiens
KINQTFVRK

SEQ ID NO: 303725 - protein, 9 aa, Homo Sapiens
SHHYSPASW

SEQ ID NO: 303726 - protein, 9 aa, Homo Sapiens
PHFLKCLFS

SEQ ID NO: 303727 - protein, 9 aa, Homo Sapiens
SPPHPDVCM

SEQ ID NO: 303728 - protein, 9 aa, Homo Sapiens
LKLRVSGAA

SEQ ID NO: 303729 - protein, 9 aa, Homo Sapiens
NDKVHQDTY

SEQ ID NO: 303730 - protein, 9 aa, Homo Sapiens
PIVTLFYGT

SEQ ID NO: 303731 - protein, 9 aa, Homo Sapiens
KFNKLFRLN

SEQ ID NO: 303732 - protein, 9 aa, Homo Sapiens
TLVGHQQII

SEQ ID NO: 303733 - protein, 9 aa, Homo Sapiens
TLEEIKENA

SEQ ID NO: 303734 - protein, 9 aa, Homo Sapiens
QCWVDDKVN

SEQ ID NO: 303735 - protein, 9 aa, Homo Sapiens
KARSSPKLF

SEQ ID NO: 303736 - protein, 9 aa, Homo Sapiens
PLKLAGWQC

SEQ ID NO: 303737 - protein, 9 aa, Homo Sapiens
NNNSLSGLS

SEQ ID NO: 303738 - protein, 9 aa, Homo Sapiens
QNMQRLLET

SEQ ID NO: 303739 - protein, 9 aa, Homo Sapiens
AYKPPGCSL

SEQ ID NO: 303740 - protein, 9 aa, Homo Sapiens
TDDPQSFKK

SEQ ID NO: 303741 - protein, 9 aa, Homo Sapiens
KRKGKCRHH

SEQ ID NO: 303742 - protein, 9 aa, Homo Sapiens
SIFAFPVYQ

SEQ ID NO: 303743 - protein, 9 aa, Homo Sapiens
DFTAHQIIH

SEQ ID NO: 303744 - protein, 9 aa, Homo Sapiens
PPKAETTKG

SEQ ID NO: 303745 - protein, 9 aa, Homo Sapiens
TQIFVYVSL

SEQ ID NO: 303746 - protein, 9 aa, Homo Sapiens
NIRESTQEN

SEQ ID NO: 303747 - protein, 9 aa, Homo Sapiens
LNMDRVNVE

SEQ ID NO: 303748 - protein, 9 aa, Homo Sapiens
FSQLSSLQV

SEQ ID NO: 303749 - protein, 9 aa, Homo Sapiens
HILTIMWKW

SEQ ID NO: 303750 - protein, 9 aa, Homo Sapiens
PLDIPVLFK

SEQ ID NO: 303751 - protein, 9 aa, Homo Sapiens
KSNVYRYHS

SEQ ID NO: 303752 - protein, 9 aa, Homo Sapiens
IDSLQQTNT

SEQ ID NO: 303753 - protein, 9 aa, Homo Sapiens
ISFLELWYT

SEQ ID NO: 303754 - protein, 9 aa, Homo Sapiens
LVSYGLILS

SEQ ID NO: 303755 - protein, 9 aa, Homo Sapiens
AIKTSILNS

SEQ ID NO: 303756 - protein, 9 aa, Homo Sapiens
NHELTFYKE

SEQ ID NO: 303757 - protein, 9 aa, Homo Sapiens
PISGHFIAD

SEQ ID NO: 303758 - protein, 9 aa, Homo Sapiens
NVDRSGNVH

SEQ ID NO: 303759 - protein, 9 aa, Homo Sapiens
MMQVGMATN

SEQ ID NO: 303760 - protein, 9 aa, Homo Sapiens
TAGIMTRLS

SEQ ID NO: 303761 - protein, 9 aa, Homo Sapiens
KDYLLGIYG

SEQ ID NO: 303762 - protein, 9 aa, Homo Sapiens
NNIKKNEDA

SEQ ID NO: 303763 - protein, 9 aa, Homo Sapiens
GLGNLKLSF

SEQ ID NO: 303764 - protein, 9 aa, Homo Sapiens
DPALGKFPF

SEQ ID NO: 303765 - protein, 9 aa, Homo Sapiens
WGLFRGIED

SEQ ID NO: 303766 - protein, 9 aa, Homo Sapiens
IWWAPNVQH

SEQ ID NO: 303767 - protein, 9 aa, Homo Sapiens
LNVRINHLV

SEQ ID NO: 303768 - protein, 9 aa, Homo Sapiens
CKECGKALF

SEQ ID NO: 303769 - protein, 9 aa, Homo Sapiens
EYIIQTLSR

SEQ ID NO: 303770 - protein, 9 aa, Homo Sapiens
LFHLLMVLE

SEQ ID NO: 303771 - protein, 9 aa, Homo Sapiens
MYGTVQESL

SEQ ID NO: 303772 - protein, 9 aa, Homo Sapiens
ISVSRGRPG

SEQ ID NO: 303773 - protein, 9 aa, Homo Sapiens
DREKDKDKD

SEQ ID NO: 303774 - protein, 9 aa, Homo Sapiens
AADLLQDMG

SEQ ID NO: 303775 - protein, 9 aa, Homo Sapiens
LFAIILYVY

SEQ ID NO: 303776 - protein, 9 aa, Homo Sapiens
GENMTDDPQ

SEQ ID NO: 303777 - protein, 9 aa, Homo Sapiens
VRQLAVFIE

SEQ ID NO: 303778 - protein, 9 aa, Homo Sapiens
PWIPGQPGL

SEQ ID NO: 303779 - protein, 9 aa, Homo Sapiens
NAVCKLKNA

SEQ ID NO: 303780 - protein, 9 aa, Homo Sapiens
PPPYGPGII

SEQ ID NO: 303781 - protein, 9 aa, Homo Sapiens
VTLEVGDYT

SEQ ID NO: 303782 - protein, 9 aa, Homo Sapiens
RQSKFQVPH

SEQ ID NO: 303783 - protein, 9 aa, Homo Sapiens
VGLDQMVKM

SEQ ID NO: 303784 - protein, 9 aa, Homo Sapiens
ITTWSAGVP

SEQ ID NO: 303785 - protein, 9 aa, Homo Sapiens
TSDPENVQS

SEQ ID NO: 303786 - protein, 9 aa, Homo Sapiens
KRVRGRQCP

SEQ ID NO: 303787 - protein, 9 aa, Homo Sapiens
KFTIKNEKR

SEQ ID NO: 303788 - protein, 9 aa, Homo Sapiens
NSKLVDLEI

SEQ ID NO: 303789 - protein, 9 aa, Homo Sapiens
NKTMDAKKN

SEQ ID NO: 303790 - protein, 9 aa, Homo Sapiens
PNYLMASLV

SEQ ID NO: 303791 - protein, 9 aa, Homo Sapiens
LELMVRLSR

SEQ ID NO: 303792 - protein, 9 aa, Homo Sapiens
EAENKISYH

SEQ ID NO: 303793 - protein, 9 aa, Homo Sapiens
TSESKDNCT

SEQ ID NO: 303794 - protein, 9 aa, Homo Sapiens
LAHHEIIHT

SEQ ID NO: 303795 - protein, 9 aa, Homo Sapiens
EYGNYTVLA

SEQ ID NO: 303796 - protein, 9 aa, Homo Sapiens
MPASKKYTV

SEQ ID NO: 303797 - protein, 9 aa, Homo Sapiens
SPISKKLRL

SEQ ID NO: 303798 - protein, 9 aa, Homo Sapiens
QSFISVLLN

SEQ ID NO: 303799 - protein, 9 aa, Homo Sapiens
LCISFKWMV

SEQ ID NO: 303800 - protein, 9 aa, Homo Sapiens
VTGYAISTV

SEQ ID NO: 303801 - protein, 9 aa, Homo Sapiens
LLQSQSGHL

SEQ ID NO: 303802 - protein, 9 aa, Homo Sapiens
VSSQKIYLR

SEQ ID NO: 303803 - protein, 9 aa, Homo Sapiens
FWGEHFELF

SEQ ID NO: 303804 - protein, 9 aa, Homo Sapiens
VEGDLIKTE

SEQ ID NO: 303805 - protein, 9 aa, Homo Sapiens
AALHDDADI

SEQ ID NO: 303806 - protein, 9 aa, Homo Sapiens
ACDYCSLSH

SEQ ID NO: 303807 - protein, 9 aa, Homo Sapiens
IAVDDDKIL

SEQ ID NO: 303808 - protein, 9 aa, Homo Sapiens
VPFEDGKEF

SEQ ID NO: 303809 - protein, 9 aa, Homo Sapiens
YVKLKVEGS

SEQ ID NO: 303810 - protein, 9 aa, Homo Sapiens
MTPVREDST

SEQ ID NO: 303811 - protein, 9 aa, Homo Sapiens
NSALRFHKR

SEQ ID NO: 303812 - protein, 9 aa, Homo Sapiens
PQAPRKEIT

SEQ ID NO: 303813 - protein, 9 aa, Homo Sapiens
AQVMLSLAS

SEQ ID NO: 303814 - protein, 9 aa, Homo Sapiens
RVNGTLYYE

SEQ ID NO: 303815 - protein, 9 aa, Homo Sapiens
QADEGRTKK

SEQ ID NO: 303816 - protein, 9 aa, Homo Sapiens
LSPKSLDIK

SEQ ID NO: 303817 - protein, 9 aa, Homo Sapiens
TQAGMIPRA

SEQ ID NO: 303818 - protein, 9 aa, Homo Sapiens
LVCILKAHG

SEQ ID NO: 303819 - protein, 9 aa, Homo Sapiens
PEQLEMESK

SEQ ID NO: 303820 - protein, 9 aa, Homo Sapiens
LQLFCVRLR

SEQ ID NO: 303821 - protein, 9 aa, Homo Sapiens
LIMGMKFFQ

SEQ ID NO: 303822 - protein, 9 aa, Homo Sapiens
TKFNKLFRL

SEQ ID NO: 303823 - protein, 9 aa, Homo Sapiens
MLESYRNLV

SEQ ID NO: 303824 - protein, 9 aa, Homo Sapiens
EAQSHSSAD

SEQ ID NO: 303825 - protein, 9 aa, Homo Sapiens
NGRLEKLPD

SEQ ID NO: 303826 - protein, 9 aa, Homo Sapiens
GKSALTIKL

SEQ ID NO: 303827 - protein, 9 aa, Homo Sapiens
RSKLHYAFQ

SEQ ID NO: 303828 - protein, 9 aa, Homo Sapiens
WLFPFSSKQ

SEQ ID NO: 303829 - protein, 9 aa, Homo Sapiens
SLPVDDPTL

SEQ ID NO: 303830 - protein, 9 aa, Homo Sapiens
LQLNLRKFN

SEQ ID NO: 303831 - protein, 9 aa, Homo Sapiens
ATRSGDVVY

SEQ ID NO: 303832 - protein, 9 aa, Homo Sapiens
IPWLLSPKS

SEQ ID NO: 303833 - protein, 9 aa, Homo Sapiens
RGSQDKQTK

SEQ ID NO: 303834 - protein, 9 aa, Homo Sapiens
TELGIHTVA

SEQ ID NO: 303835 - protein, 9 aa, Homo Sapiens
HQLSVAGNI

SEQ ID NO: 303836 - protein, 9 aa, Homo Sapiens
KDHKVCLAI

SEQ ID NO: 303837 - protein, 9 aa, Homo Sapiens
SGPTRGKHA

SEQ ID NO: 303838 - protein, 9 aa, Homo Sapiens
MRLDLNPHG

SEQ ID NO: 303839 - protein, 9 aa, Homo Sapiens
AFLALPNKE

SEQ ID NO: 303840 - protein, 9 aa, Homo Sapiens
SILEILFTT

SEQ ID NO: 303841 - protein, 9 aa, Homo Sapiens
GLGNFTTRY

SEQ ID NO: 303842 - protein, 9 aa, Homo Sapiens
ATGEDLFLH

SEQ ID NO: 303843 - protein, 9 aa, Homo Sapiens
AYAQARMQQ

SEQ ID NO: 303844 - protein, 9 aa, Homo Sapiens
QRDVCNVLL

SEQ ID NO: 303845 - protein, 9 aa, Homo Sapiens
LQRMGQLCE

SEQ ID NO: 303846 - protein, 9 aa, Homo Sapiens
QNELRETVD

SEQ ID NO: 303847 - protein, 9 aa, Homo Sapiens
PSDLRLVDS

SEQ ID NO: 303848 - protein, 9 aa, Homo Sapiens
ITYLHTQKQ

SEQ ID NO: 303849 - protein, 9 aa, Homo Sapiens
LLLNKSLDR

SEQ ID NO: 303850 - protein, 9 aa, Homo Sapiens
IIEKLKSID

SEQ ID NO: 303851 - protein, 9 aa, Homo Sapiens
IKISKSSIM

SEQ ID NO: 303852 - protein, 9 aa, Homo Sapiens
QGNLSLVDY

SEQ ID NO: 303853 - protein, 9 aa, Homo Sapiens
GATFKCNIC

SEQ ID NO: 303854 - protein, 9 aa, Homo Sapiens
AFAGRKWKT

SEQ ID NO: 303855 - protein, 9 aa, Homo Sapiens
STDSWLDKE

SEQ ID NO: 303856 - protein, 9 aa, Homo Sapiens
QTHSKARSS

SEQ ID NO: 303857 - protein, 9 aa, Homo Sapiens
HQGCPFSTE

SEQ ID NO: 303858 - protein, 9 aa, Homo Sapiens
LSCLLVCIL

SEQ ID NO: 303859 - protein, 9 aa, Homo Sapiens
KNASLRKEK

SEQ ID NO: 303860 - protein, 9 aa, Homo Sapiens
LINGALLVL

SEQ ID NO: 303861 - protein, 9 aa, Homo Sapiens
QPTDKVLAD

SEQ ID NO: 303862 - protein, 9 aa, Homo Sapiens
ASDEVTQLA

SEQ ID NO: 303863 - protein, 9 aa, Homo Sapiens
YRASQVECT

SEQ ID NO: 303864 - protein, 9 aa, Homo Sapiens
EAFASTSRF

SEQ ID NO: 303865 - protein, 9 aa, Homo Sapiens
MPTDTFIES

SEQ ID NO: 303866 - protein, 9 aa, Homo Sapiens
VATMSNLVP

SEQ ID NO: 303867 - protein, 9 aa, Homo Sapiens
LPTASVIIA

SEQ ID NO: 303868 - protein, 9 aa, Homo Sapiens
RIVHLVGII

SEQ ID NO: 303869 - protein, 9 aa, Homo Sapiens
TFKECVILD

SEQ ID NO: 303870 - protein, 9 aa, Homo Sapiens
VRKFKETNK

SEQ ID NO: 303871 - protein, 9 aa, Homo Sapiens
KYVESDDET

SEQ ID NO: 303872 - protein, 9 aa, Homo Sapiens
LVPYNDLEA

SEQ ID NO: 303873 - protein, 9 aa, Homo Sapiens
IKYEDLSGE

SEQ ID NO: 303874 - protein, 9 aa, Homo Sapiens
KRPPLKELF

SEQ ID NO: 303875 - protein, 9 aa, Homo Sapiens
GTTQWEPPV

SEQ ID NO: 303876 - protein, 9 aa, Homo Sapiens
GPDKYDKSC

SEQ ID NO: 303877 - protein, 9 aa, Homo Sapiens
SMITPLREL

SEQ ID NO: 303878 - protein, 9 aa, Homo Sapiens
VTCTRVENC

SEQ ID NO: 303879 - protein, 9 aa, Homo Sapiens
QLQQKQLLI

SEQ ID NO: 303880 - protein, 9 aa, Homo Sapiens
DGALQELQQ

SEQ ID NO: 303881 - protein, 9 aa, Homo Sapiens
WDAPPAWGQ

SEQ ID NO: 303882 - protein, 9 aa, Homo Sapiens
YADARWWGL

SEQ ID NO: 303883 - protein, 9 aa, Homo Sapiens
QRNAPDHME

SEQ ID NO: 303884 - protein, 9 aa, Homo Sapiens
GSGAKWEKE

SEQ ID NO: 303885 - protein, 9 aa, Homo Sapiens
VVSIPKDTW

SEQ ID NO: 303886 - protein, 9 aa, Homo Sapiens
FPPPSPQES

SEQ ID NO: 303887 - protein, 9 aa, Homo Sapiens
VSESPPPGW

SEQ ID NO: 303888 - protein, 9 aa, Homo Sapiens
KIALFNLSN

SEQ ID NO: 303889 - protein, 9 aa, Homo Sapiens
TEETDKGSF

SEQ ID NO: 303890 - protein, 9 aa, Homo Sapiens
DNKKVEKIR

SEQ ID NO: 303891 - protein, 9 aa, Homo Sapiens
RRDFIDIKS

SEQ ID NO: 303892 - protein, 9 aa, Homo Sapiens
DSNELASGF

SEQ ID NO: 303893 - protein, 9 aa, Homo Sapiens
NPTSPANSQ

SEQ ID NO: 303894 - protein, 9 aa, Homo Sapiens
TLTVRALRR

SEQ ID NO: 303895 - protein, 9 aa, Homo Sapiens
PKPFSNPKY

SEQ ID NO: 303896 - protein, 9 aa, Homo Sapiens
EEPAFQNCM

SEQ ID NO: 303897 - protein, 9 aa, Homo Sapiens
LHKIMALLS

SEQ ID NO: 303898 - protein, 9 aa, Homo Sapiens
GTFLLLSVL

SEQ ID NO: 303899 - protein, 9 aa, Homo Sapiens
LWPWPATQP

SEQ ID NO: 303900 - protein, 9 aa, Homo Sapiens
GPYTFPPTS

SEQ ID NO: 303901 - protein, 9 aa, Homo Sapiens
KSIYNGFFE

SEQ ID NO: 303902 - protein, 9 aa, Homo Sapiens
LNIWNIETA

SEQ ID NO: 303903 - protein, 9 aa, Homo Sapiens
IEAHFLPFK

SEQ ID NO: 303904 - protein, 9 aa, Homo Sapiens
VLATITTDQ

SEQ ID NO: 303905 - protein, 9 aa, Homo Sapiens
YQDTMYLQY

SEQ ID NO: 303906 - protein, 9 aa, Homo Sapiens
YCKIKHISE

SEQ ID NO: 303907 - protein, 9 aa, Homo Sapiens
CLLDCFLLD

SEQ ID NO: 303908 - protein, 9 aa, Homo Sapiens
DPGCTLNKN

SEQ ID NO: 303909 - protein, 9 aa, Homo Sapiens
TISHPMGTS

SEQ ID NO: 303910 - protein, 9 aa, Homo Sapiens
PVSYHDMEY

SEQ ID NO: 303911 - protein, 9 aa, Homo Sapiens
KVKADMETL

SEQ ID NO: 303912 - protein, 9 aa, Homo Sapiens
IKRGTAKLQ

SEQ ID NO: 303913 - protein, 9 aa, Homo Sapiens
PILQQPTDK

SEQ ID NO: 303914 - protein, 9 aa, Homo Sapiens
LENNGGPSI

SEQ ID NO: 303915 - protein, 9 aa, Homo Sapiens
KMVGDIHKY

SEQ ID NO: 303916 - protein, 9 aa, Homo Sapiens
DEDKAAEME

SEQ ID NO: 303917 - protein, 9 aa, Homo Sapiens
LGNPLLGMY

SEQ ID NO: 303918 - protein, 9 aa, Homo Sapiens
EYFQIRPHA

SEQ ID NO: 303919 - protein, 9 aa, Homo Sapiens
TSEEKKASD

SEQ ID NO: 303920 - protein, 9 aa, Homo Sapiens
NAPQFAVLY

SEQ ID NO: 303921 - protein, 9 aa, Homo Sapiens
VFSLLVMAL

SEQ ID NO: 303922 - protein, 9 aa, Homo Sapiens
TFSRKGLYD

SEQ ID NO: 303923 - protein, 9 aa, Homo Sapiens
HGIHNYQQG

SEQ ID NO: 303924 - protein, 9 aa, Homo Sapiens
FRAINRADY

SEQ ID NO: 303925 - protein, 9 aa, Homo Sapiens
IHCMIMALV

SEQ ID NO: 303926 - protein, 9 aa, Homo Sapiens
IYAKEGGLF

SEQ ID NO: 303927 - protein, 9 aa, Homo Sapiens
LLNKHGPTY

SEQ ID NO: 303928 - protein, 9 aa, Homo Sapiens
SKSVGRNEE

SEQ ID NO: 303929 - protein, 9 aa, Homo Sapiens
FKEADDLFT

SEQ ID NO: 303930 - protein, 9 aa, Homo Sapiens
YYKEKSSKK

SEQ ID NO: 303931 - protein, 9 aa, Homo Sapiens
NYLQNHLYG

SEQ ID NO: 303932 - protein, 9 aa, Homo Sapiens
LIPLTAQMV

SEQ ID NO: 303933 - protein, 9 aa, Homo Sapiens
KLEGGKQLE

SEQ ID NO: 303934 - protein, 9 aa, Homo Sapiens
SSGRRWLCE

SEQ ID NO: 303935 - protein, 9 aa, Homo Sapiens
LTVTISVDG

SEQ ID NO: 303936 - protein, 9 aa, Homo Sapiens
SHHKITHSK

SEQ ID NO: 303937 - protein, 9 aa, Homo Sapiens
KEEERLQNQ

SEQ ID NO: 303938 - protein, 9 aa, Homo Sapiens
FHVHFEDND

SEQ ID NO: 303939 - protein, 9 aa, Homo Sapiens
RMRLSQKVL

SEQ ID NO: 303940 - protein, 9 aa, Homo Sapiens
KENVNDVDY

SEQ ID NO: 303941 - protein, 9 aa, Homo Sapiens
LRNLKTSDV

SEQ ID NO: 303942 - protein, 9 aa, Homo Sapiens
KDTSRPYKC

SEQ ID NO: 303943 - protein, 9 aa, Homo Sapiens
GPINHYQNI

SEQ ID NO: 303944 - protein, 9 aa, Homo Sapiens
VCALQACMD

SEQ ID NO: 303945 - protein, 9 aa, Homo Sapiens
RIELKTINI

SEQ ID NO: 303946 - protein, 9 aa, Homo Sapiens
SQFSVKGYK

SEQ ID NO: 303947 - protein, 9 aa, Homo Sapiens
SQKVLQSPA

SEQ ID NO: 303948 - protein, 9 aa, Homo Sapiens
RVHTRYQPY

SEQ ID NO: 303949 - protein, 9 aa, Homo Sapiens
HLMKHVNEI

SEQ ID NO: 303950 - protein, 9 aa, Homo Sapiens
FDFPCPEKC

SEQ ID NO: 303951 - protein, 9 aa, Homo Sapiens
DGEISYAFS

SEQ ID NO: 303952 - protein, 9 aa, Homo Sapiens
QTADGKHQD

SEQ ID NO: 303953 - protein, 9 aa, Homo Sapiens
EGQKHKHKK

SEQ ID NO: 303954 - protein, 9 aa, Homo Sapiens
QADMLIIRT

SEQ ID NO: 303955 - protein, 9 aa, Homo Sapiens
YVCQPQRIT

SEQ ID NO: 303956 - protein, 9 aa, Homo Sapiens
AAAPTPDKE

SEQ ID NO: 303957 - protein, 9 aa, Homo Sapiens
QTKRIRKPF

SEQ ID NO: 303958 - protein, 9 aa, Homo Sapiens
GEHGPQVSL

SEQ ID NO: 303959 - protein, 9 aa, Homo Sapiens
KSYSGNISL

SEQ ID NO: 303960 - protein, 9 aa, Homo Sapiens
GGIAQLRVF

SEQ ID NO: 303961 - protein, 9 aa, Homo Sapiens
VGCLVHLMT

SEQ ID NO: 303962 - protein, 9 aa, Homo Sapiens
DLFNNIREQ

SEQ ID NO: 303963 - protein, 9 aa, Homo Sapiens
KKNHKMMNE

SEQ ID NO: 303964 - protein, 9 aa, Homo Sapiens
LPKQCHQPS

SEQ ID NO: 303965 - protein, 9 aa, Homo Sapiens
VWQQLKKLE

SEQ ID NO: 303966 - protein, 9 aa, Homo Sapiens
SDPLRTHVQ

SEQ ID NO: 303967 - protein, 9 aa, Homo Sapiens
GKLDQIIYH

SEQ ID NO: 303968 - protein, 9 aa, Homo Sapiens
GTCFYLGEL

SEQ ID NO: 303969 - protein, 9 aa, Homo Sapiens
KEELTEALR

SEQ ID NO: 303970 - protein, 9 aa, Homo Sapiens
HKYFGLKKD

SEQ ID NO: 303971 - protein, 9 aa, Homo Sapiens
GKCSELLLS

SEQ ID NO: 303972 - protein, 9 aa, Homo Sapiens
SYSKDLESA

SEQ ID NO: 303973 - protein, 9 aa, Homo Sapiens
SKRSLRYLM

SEQ ID NO: 303974 - protein, 9 aa, Homo Sapiens
QEDLSRDGN

SEQ ID NO: 303975 - protein, 9 aa, Homo Sapiens
SYGASINAV

SEQ ID NO: 303976 - protein, 9 aa, Homo Sapiens
REYYDRTAQ

SEQ ID NO: 303977 - protein, 9 aa, Homo Sapiens
LRKAFNDIA

SEQ ID NO: 303978 - protein, 9 aa, Homo Sapiens
TRENISETW

SEQ ID NO: 303979 - protein, 9 aa, Homo Sapiens
KPMGLVSRV

SEQ ID NO: 303980 - protein, 9 aa, Homo Sapiens
EDVVILANR

SEQ ID NO: 303981 - protein, 9 aa, Homo Sapiens
IIAENLSSH

SEQ ID NO: 303982 - protein, 9 aa, Homo Sapiens
SLHLPSFYA

SEQ ID NO: 303983 - protein, 9 aa, Homo Sapiens
RRDDMSSIV

SEQ ID NO: 303984 - protein, 9 aa, Homo Sapiens
LKNNLEYAA

SEQ ID NO: 303985 - protein, 9 aa, Homo Sapiens
PPAPFAMIN

SEQ ID NO: 303986 - protein, 9 aa, Homo Sapiens
LGEDELSYG

SEQ ID NO: 303987 - protein, 9 aa, Homo Sapiens
LYMVTMYQK

SEQ ID NO: 303988 - protein, 9 aa, Homo Sapiens
TGEGETKFN

SEQ ID NO: 303989 - protein, 9 aa, Homo Sapiens
NNGKKASEP

SEQ ID NO: 303990 - protein, 9 aa, Homo Sapiens
IRIFIGGKI

SEQ ID NO: 303991 - protein, 9 aa, Homo Sapiens
YARKRLVIR

SEQ ID NO: 303992 - protein, 9 aa, Homo Sapiens
WTALICSTL

SEQ ID NO: 303993 - protein, 9 aa, Homo Sapiens
AQRQKVVEK

SEQ ID NO: 303994 - protein, 9 aa, Homo Sapiens
QIISHSNKV

SEQ ID NO: 303995 - protein, 9 aa, Homo Sapiens
REALGKPSH

SEQ ID NO: 303996 - protein, 9 aa, Homo Sapiens
GRLQAITGK

SEQ ID NO: 303997 - protein, 9 aa, Homo Sapiens
SSHHSKHLK

SEQ ID NO: 303998 - protein, 9 aa, Homo Sapiens
NTFATCSDD

SEQ ID NO: 303999 - protein, 9 aa, Homo Sapiens
WGLLPSQYG

SEQ ID NO: 304000 - protein, 9 aa, Homo Sapiens
VITTTLYWG

SEQ ID NO: 304001 - protein, 9 aa, Homo Sapiens
AVLLLTQTD

SEQ ID NO: 304002 - protein, 9 aa, Homo Sapiens
REQIVRVKE

SEQ ID NO: 304003 - protein, 9 aa, Homo Sapiens
GLVKLTVTI

SEQ ID NO: 304004 - protein, 9 aa, Homo Sapiens
EKNVTKEDL

SEQ ID NO: 304005 - protein, 9 aa, Homo Sapiens
YHLIGHQRI

SEQ ID NO: 304006 - protein, 9 aa, Homo Sapiens
STSYIDNQI

SEQ ID NO: 304007 - protein, 9 aa, Homo Sapiens
EKNGDQYTN

SEQ ID NO: 304008 - protein, 9 aa, Homo Sapiens
PLGWKPEIY

SEQ ID NO: 304009 - protein, 9 aa, Homo Sapiens
EFWKLPSSV

SEQ ID NO: 304010 - protein, 9 aa, Homo Sapiens
CISVRQFWF

SEQ ID NO: 304011 - protein, 9 aa, Homo Sapiens
HVDITSWYN

SEQ ID NO: 304012 - protein, 9 aa, Homo Sapiens
SLLQGFINY

SEQ ID NO: 304013 - protein, 9 aa, Homo Sapiens
SDLIVPAGD

SEQ ID NO: 304014 - protein, 9 aa, Homo Sapiens
PGKMNDRLD

SEQ ID NO: 304015 - protein, 9 aa, Homo Sapiens
FIFIYQLPF

SEQ ID NO: 304016 - protein, 9 aa, Homo Sapiens
WQESNKACL

SEQ ID NO: 304017 - protein, 9 aa, Homo Sapiens
SHMLAVTIL

SEQ ID NO: 304018 - protein, 9 aa, Homo Sapiens
VVEGDLIKT

SEQ ID NO: 304019 - protein, 9 aa, Homo Sapiens
EHNSGPLSV

SEQ ID NO: 304020 - protein, 9 aa, Homo Sapiens
GVITALVAW

SEQ ID NO: 304021 - protein, 9 aa, Homo Sapiens
EVRVNGTLY

SEQ ID NO: 304022 - protein, 9 aa, Homo Sapiens
PLLYMVTMY

SEQ ID NO: 304023 - protein, 9 aa, Homo Sapiens
ADNGKACIS

SEQ ID NO: 304024 - protein, 9 aa, Homo Sapiens
TCPRSTNKI

SEQ ID NO: 304025 - protein, 9 aa, Homo Sapiens
EAKKSAEKP

SEQ ID NO: 304026 - protein, 9 aa, Homo Sapiens
TETDISSKS

SEQ ID NO: 304027 - protein, 9 aa, Homo Sapiens
LKGATATYT

SEQ ID NO: 304028 - protein, 9 aa, Homo Sapiens
APEFPLSSH

SEQ ID NO: 304029 - protein, 9 aa, Homo Sapiens
YPEQFCVII

SEQ ID NO: 304030 - protein, 9 aa, Homo Sapiens
DHMELTSIH

SEQ ID NO: 304031 - protein, 9 aa, Homo Sapiens
LLVGQFTLL

SEQ ID NO: 304032 - protein, 9 aa, Homo Sapiens
EREENLKKR

SEQ ID NO: 304033 - protein, 9 aa, Homo Sapiens
PSSGYCIDQ

SEQ ID NO: 304034 - protein, 9 aa, Homo Sapiens
NAGTVYPAN

SEQ ID NO: 304035 - protein, 9 aa, Homo Sapiens
MLTHNIAKL

SEQ ID NO: 304036 - protein, 9 aa, Homo Sapiens
RVFVFCALL

SEQ ID NO: 304037 - protein, 9 aa, Homo Sapiens
DLIFLTLTK

SEQ ID NO: 304038 - protein, 9 aa, Homo Sapiens
YQIVYNNAD

SEQ ID NO: 304039 - protein, 9 aa, Homo Sapiens
ICPMCMNYF

SEQ ID NO: 304040 - protein, 9 aa, Homo Sapiens
MVQVSGGQI

SEQ ID NO: 304041 - protein, 9 aa, Homo Sapiens
DLNTTLYHT

SEQ ID NO: 304042 - protein, 9 aa, Homo Sapiens
QLNYLNQAV

SEQ ID NO: 304043 - protein, 9 aa, Homo Sapiens
KIILAAFDN

SEQ ID NO: 304044 - protein, 9 aa, Homo Sapiens
KWNDVTLYQ

SEQ ID NO: 304045 - protein, 9 aa, Homo Sapiens
SFRVFYNKL

SEQ ID NO: 304046 - protein, 9 aa, Homo Sapiens
QLRDLIRNY

SEQ ID NO: 304047 - protein, 9 aa, Homo Sapiens
HFYLQSSQG

SEQ ID NO: 304048 - protein, 9 aa, Homo Sapiens
GETGQLAHR

SEQ ID NO: 304049 - protein, 9 aa, Homo Sapiens
CHQPSDLHA

SEQ ID NO: 304050 - protein, 9 aa, Homo Sapiens
FLQNTDDMG

SEQ ID NO: 304051 - protein, 9 aa, Homo Sapiens
KISDGKNFS

SEQ ID NO: 304052 - protein, 9 aa, Homo Sapiens
AKEYIQQLH

SEQ ID NO: 304053 - protein, 9 aa, Homo Sapiens
LFEKHPEIN

SEQ ID NO: 304054 - protein, 9 aa, Homo Sapiens
MSSTNMMPV

SEQ ID NO: 304055 - protein, 9 aa, Homo Sapiens
KIRIFIGGK

SEQ ID NO: 304056 - protein, 9 aa, Homo Sapiens
ATVNIQLQG

SEQ ID NO: 304057 - protein, 9 aa, Homo Sapiens
LWEAYCRVT

SEQ ID NO: 304058 - protein, 9 aa, Homo Sapiens
INQTFVRKF

SEQ ID NO: 304059 - protein, 9 aa, Homo Sapiens
RLLEFSDIF

SEQ ID NO: 304060 - protein, 9 aa, Homo Sapiens
EAVNRMFQK

SEQ ID NO: 304061 - protein, 9 aa, Homo Sapiens
DKTKPQRDS

SEQ ID NO: 304062 - protein, 9 aa, Homo Sapiens
ELEIKRRSH

SEQ ID NO: 304063 - protein, 9 aa, Homo Sapiens
ISAQGLIKH

SEQ ID NO: 304064 - protein, 9 aa, Homo Sapiens
TMAPDIHDE

SEQ ID NO: 304065 - protein, 9 aa, Homo Sapiens
CILLSIFAK

SEQ ID NO: 304066 - protein, 9 aa, Homo Sapiens
DATTPAPRV

SEQ ID NO: 304067 - protein, 9 aa, Homo Sapiens
TKPQRDSQA

SEQ ID NO: 304068 - protein, 9 aa, Homo Sapiens
DSDTYGDIN

SEQ ID NO: 304069 - protein, 9 aa, Homo Sapiens
TRFKWFFQR

SEQ ID NO: 304070 - protein, 9 aa, Homo Sapiens
DLMLYFIVK

SEQ ID NO: 304071 - protein, 9 aa, Homo Sapiens
QEAERNKIE

SEQ ID NO: 304072 - protein, 9 aa, Homo Sapiens
EKPQSLELL

SEQ ID NO: 304073 - protein, 9 aa, Homo Sapiens
SHHSKHLKT

SEQ ID NO: 304074 - protein, 9 aa, Homo Sapiens
KSLDIKEIN

SEQ ID NO: 304075 - protein, 9 aa, Homo Sapiens
FRLLEFSDI

SEQ ID NO: 304076 - protein, 9 aa, Homo Sapiens
DLGYKQINA

SEQ ID NO: 304077 - protein, 9 aa, Homo Sapiens
VSKQDIREH

SEQ ID NO: 304078 - protein, 9 aa, Homo Sapiens
FQSVLAMLA

SEQ ID NO: 304079 - protein, 9 aa, Homo Sapiens
SYSSQLEDI

SEQ ID NO: 304080 - protein, 9 aa, Homo Sapiens
LEYLQDNIG

SEQ ID NO: 304081 - protein, 9 aa, Homo Sapiens
DIRRREIKL

SEQ ID NO: 304082 - protein, 9 aa, Homo Sapiens
QNNLVRLTL

SEQ ID NO: 304083 - protein, 9 aa, Homo Sapiens
VTSVELGED

SEQ ID NO: 304084 - protein, 9 aa, Homo Sapiens
ATGKHGSME

SEQ ID NO: 304085 - protein, 9 aa, Homo Sapiens
LDVANKSGI

SEQ ID NO: 304086 - protein, 9 aa, Homo Sapiens
GLGIAKPSL

SEQ ID NO: 304087 - protein, 9 aa, Homo Sapiens
HQRVNTGAR

SEQ ID NO: 304088 - protein, 9 aa, Homo Sapiens
EGGPACEAG

SEQ ID NO: 304089 - protein, 9 aa, Homo Sapiens
LAPCMRDLI

SEQ ID NO: 304090 - protein, 9 aa, Homo Sapiens
ATSLSLEKL

SEQ ID NO: 304091 - protein, 9 aa, Homo Sapiens
AITVSVKKR

SEQ ID NO: 304092 - protein, 9 aa, Homo Sapiens
FVIQPISSP

SEQ ID NO: 304093 - protein, 9 aa, Homo Sapiens
YFFSANTKD

SEQ ID NO: 304094 - protein, 9 aa, Homo Sapiens
GRCLIEKLD

SEQ ID NO: 304095 - protein, 9 aa, Homo Sapiens
VQGQWEDVV

SEQ ID NO: 304096 - protein, 9 aa, Homo Sapiens
QEKVVSMLY

SEQ ID NO: 304097 - protein, 9 aa, Homo Sapiens
AIFKPELLE

SEQ ID NO: 304098 - protein, 9 aa, Homo Sapiens
TTATADAKV

SEQ ID NO: 304099 - protein, 9 aa, Homo Sapiens
GHQIPALLG

SEQ ID NO: 304100 - protein, 9 aa, Homo Sapiens
PLKELFVDD

SEQ ID NO: 304101 - protein, 9 aa, Homo Sapiens
RVKGREALG

SEQ ID NO: 304102 - protein, 9 aa, Homo Sapiens
SSAFKIFLK

SEQ ID NO: 304103 - protein, 9 aa, Homo Sapiens
LQIASFSQN

SEQ ID NO: 304104 - protein, 9 aa, Homo Sapiens
IGSKANYIK

SEQ ID NO: 304105 - protein, 9 aa, Homo Sapiens
MEHKIIHTG

SEQ ID NO: 304106 - protein, 9 aa, Homo Sapiens
DPYTELQKQ

SEQ ID NO: 304107 - protein, 9 aa, Homo Sapiens
TFNNYYSLV

SEQ ID NO: 304108 - protein, 9 aa, Homo Sapiens
PVVAGEDFP

SEQ ID NO: 304109 - protein, 9 aa, Homo Sapiens
FNNVHGDIH

SEQ ID NO: 304110 - protein, 9 aa, Homo Sapiens
SHNSPGSTD

SEQ ID NO: 304111 - protein, 9 aa, Homo Sapiens
RIQIWFQNW

SEQ ID NO: 304112 - protein, 9 aa, Homo Sapiens
VQNKPFQKE

SEQ ID NO: 304113 - protein, 9 aa, Homo Sapiens
FFQRDASCV

SEQ ID NO: 304114 - protein, 9 aa, Homo Sapiens
HLRPSWGLL

SEQ ID NO: 304115 - protein, 9 aa, Homo Sapiens
KLLVPDYND

SEQ ID NO: 304116 - protein, 9 aa, Homo Sapiens
LDALELSQN

SEQ ID NO: 304117 - protein, 9 aa, Homo Sapiens
GRKFDFEAC

SEQ ID NO: 304118 - protein, 9 aa, Homo Sapiens
DNFSPLSGD

SEQ ID NO: 304119 - protein, 9 aa, Homo Sapiens
QNILHQTEE

SEQ ID NO: 304120 - protein, 9 aa, Homo Sapiens
PLSSPGVNQ

SEQ ID NO: 304121 - protein, 9 aa, Homo Sapiens
ACLVCVFLI

SEQ ID NO: 304122 - protein, 9 aa, Homo Sapiens
IAQISAGTH

SEQ ID NO: 304123 - protein, 9 aa, Homo Sapiens
PGMCTRSLT

SEQ ID NO: 304124 - protein, 9 aa, Homo Sapiens
KAMQTKEPV

SEQ ID NO: 304125 - protein, 9 aa, Homo Sapiens
YFKSSCYFF

SEQ ID NO: 304126 - protein, 9 aa, Homo Sapiens
CKKAGSKKK

SEQ ID NO: 304127 - protein, 9 aa, Homo Sapiens
ESYAYYLKN

SEQ ID NO: 304128 - protein, 9 aa, Homo Sapiens
NGPESIINS

SEQ ID NO: 304129 - protein, 9 aa, Homo Sapiens
VQLLPSNKQ

SEQ ID NO: 304130 - protein, 9 aa, Homo Sapiens
NNWNDVDDC

SEQ ID NO: 304131 - protein, 9 aa, Homo Sapiens
KTRQINHSG

SEQ ID NO: 304132 - protein, 9 aa, Homo Sapiens
LKTIKLMEV

SEQ ID NO: 304133 - protein, 9 aa, Homo Sapiens
NPDEECERF

SEQ ID NO: 304134 - protein, 9 aa, Homo Sapiens
NCVSEDLGN

SEQ ID NO: 304135 - protein, 9 aa, Homo Sapiens
GFQNYVILE

SEQ ID NO: 304136 - protein, 9 aa, Homo Sapiens
ASDAKEVKM

SEQ ID NO: 304137 - protein, 9 aa, Homo Sapiens
PWTCEQGTP

SEQ ID NO: 304138 - protein, 9 aa, Homo Sapiens
SVVYTVVIP

SEQ ID NO: 304139 - protein, 9 aa, Homo Sapiens
FDRKNLVPR

SEQ ID NO: 304140 - protein, 9 aa, Homo Sapiens
FLQLYFFFS

SEQ ID NO: 304141 - protein, 9 aa, Homo Sapiens
LFLYTGDSF

SEQ ID NO: 304142 - protein, 9 aa, Homo Sapiens
NIIIVTIIQ

SEQ ID NO: 304143 - protein, 9 aa, Homo Sapiens
IMQLGSITE

SEQ ID NO: 304144 - protein, 9 aa, Homo Sapiens
DGAWMEWSK

SEQ ID NO: 304145 - protein, 9 aa, Homo Sapiens
IMVPNYFSP

SEQ ID NO: 304146 - protein, 9 aa, Homo Sapiens
ITPLRELTL

SEQ ID NO: 304147 - protein, 9 aa, Homo Sapiens
NNYGMSEWR

SEQ ID NO: 304148 - protein, 9 aa, Homo Sapiens
QPPADKVPE

SEQ ID NO: 304149 - protein, 9 aa, Homo Sapiens
PYRDSKITW

SEQ ID NO: 304150 - protein, 9 aa, Homo Sapiens
QDTANILES

SEQ ID NO: 304151 - protein, 9 aa, Homo Sapiens
IIATLQSKE

SEQ ID NO: 304152 - protein, 9 aa, Homo Sapiens
SHLSTDDHS

SEQ ID NO: 304153 - protein, 9 aa, Homo Sapiens
YLLGIYGRR

SEQ ID NO: 304154 - protein, 9 aa, Homo Sapiens
KVHWTVDQQ

SEQ ID NO: 304155 - protein, 9 aa, Homo Sapiens
VINNSIKLR

SEQ ID NO: 304156 - protein, 9 aa, Homo Sapiens
RKEFSSHFN

SEQ ID NO: 304157 - protein, 9 aa, Homo Sapiens
DRAFDIVHK

SEQ ID NO: 304158 - protein, 9 aa, Homo Sapiens
QMLVNLCSF

SEQ ID NO: 304159 - protein, 9 aa, Homo Sapiens
FQGNKIIHL

SEQ ID NO: 304160 - protein, 9 aa, Homo Sapiens
DLFMVSILF

SEQ ID NO: 304161 - protein, 9 aa, Homo Sapiens
VHRIIHTGE

SEQ ID NO: 304162 - protein, 9 aa, Homo Sapiens
QSPVQFDTF

SEQ ID NO: 304163 - protein, 9 aa, Homo Sapiens
KAEIDILII

SEQ ID NO: 304164 - protein, 9 aa, Homo Sapiens
KFNEISILE

SEQ ID NO: 304165 - protein, 9 aa, Homo Sapiens
LPLQWVDLA

SEQ ID NO: 304166 - protein, 9 aa, Homo Sapiens
LQWVDLAHL

SEQ ID NO: 304167 - protein, 9 aa, Homo Sapiens
LPPACAVPG

SEQ ID NO: 304168 - protein, 9 aa, Homo Sapiens
NSKQVATMK

SEQ ID NO: 304169 - protein, 9 aa, Homo Sapiens
RINHLVHLP

SEQ ID NO: 304170 - protein, 9 aa, Homo Sapiens
MLYTLGIPM

SEQ ID NO: 304171 - protein, 9 aa, Homo Sapiens
KNHKMMNEK

SEQ ID NO: 304172 - protein, 9 aa, Homo Sapiens
KDQKMEDEY

SEQ ID NO: 304173 - protein, 9 aa, Homo Sapiens
AESKEIQKL

SEQ ID NO: 304174 - protein, 9 aa, Homo Sapiens
YHQGCPFST

SEQ ID NO: 304175 - protein, 9 aa, Homo Sapiens
THGRVSGLV

SEQ ID NO: 304176 - protein, 9 aa, Homo Sapiens
TFILHNFNL

SEQ ID NO: 304177 - protein, 9 aa, Homo Sapiens
SLELLNEFE

SEQ ID NO: 304178 - protein, 9 aa, Homo Sapiens
KEVELEEFK

SEQ ID NO: 304179 - protein, 9 aa, Homo Sapiens
ADGLLWHHR

SEQ ID NO: 304180 - protein, 9 aa, Homo Sapiens
KNEKRIKLH

SEQ ID NO: 304181 - protein, 9 aa, Homo Sapiens
IEIENGFIY

SEQ ID NO: 304182 - protein, 9 aa, Homo Sapiens
SSPACLAAS

SEQ ID NO: 304183 - protein, 9 aa, Homo Sapiens
VGHPGDVSF

SEQ ID NO: 304184 - protein, 9 aa, Homo Sapiens
VIRVTEESL

SEQ ID NO: 304185 - protein, 9 aa, Homo Sapiens
RPTKTYLSY

SEQ ID NO: 304186 - protein, 9 aa, Homo Sapiens
ISLTGVDPD

SEQ ID NO: 304187 - protein, 9 aa, Homo Sapiens
CDGPLKFIP

SEQ ID NO: 304188 - protein, 9 aa, Homo Sapiens
LYKFHNRTF

SEQ ID NO: 304189 - protein, 9 aa, Homo Sapiens
IVDNTVYRQ

SEQ ID NO: 304190 - protein, 9 aa, Homo Sapiens
NEDPSSLRA

SEQ ID NO: 304191 - protein, 9 aa, Homo Sapiens
SLLMRLVVD

SEQ ID NO: 304192 - protein, 9 aa, Homo Sapiens
NTSFACTEC

SEQ ID NO: 304193 - protein, 9 aa, Homo Sapiens
EHHTRSIPK

SEQ ID NO: 304194 - protein, 9 aa, Homo Sapiens
EFLDKQNEQ

SEQ ID NO: 304195 - protein, 9 aa, Homo Sapiens
HQEVNLEFH

SEQ ID NO: 304196 - protein, 9 aa, Homo Sapiens
IYQMDDVYK

SEQ ID NO: 304197 - protein, 9 aa, Homo Sapiens
EDATDNVNK

SEQ ID NO: 304198 - protein, 9 aa, Homo Sapiens
TPKLCETPK

SEQ ID NO: 304199 - protein, 9 aa, Homo Sapiens
TFSETGADE

SEQ ID NO: 304200 - protein, 9 aa, Homo Sapiens
YAISTVCVG

SEQ ID NO: 304201 - protein, 9 aa, Homo Sapiens
EQHIQKRLI

SEQ ID NO: 304202 - protein, 9 aa, Homo Sapiens
CSRSIEVFG

SEQ ID NO: 304203 - protein, 9 aa, Homo Sapiens
PGCNTMFLS

SEQ ID NO: 304204 - protein, 9 aa, Homo Sapiens
FMRKGAVGY

SEQ ID NO: 304205 - protein, 9 aa, Homo Sapiens
NTGDKNDVD

SEQ ID NO: 304206 - protein, 9 aa, Homo Sapiens
VGSSSEIIL

SEQ ID NO: 304207 - protein, 9 aa, Homo Sapiens
CTSVQKLFN

SEQ ID NO: 304208 - protein, 9 aa, Homo Sapiens
ASASFPKKK

SEQ ID NO: 304209 - protein, 9 aa, Homo Sapiens
NKDCKTSSS

SEQ ID NO: 304210 - protein, 9 aa, Homo Sapiens
LRQSGERFN

SEQ ID NO: 304211 - protein, 9 aa, Homo Sapiens
KKLLGQLYK

SEQ ID NO: 304212 - protein, 9 aa, Homo Sapiens
EKSNRSKLY

SEQ ID NO: 304213 - protein, 9 aa, Homo Sapiens
HNCMRTNSR

SEQ ID NO: 304214 - protein, 9 aa, Homo Sapiens
GLDNGNIAN

SEQ ID NO: 304215 - protein, 9 aa, Homo Sapiens
YQDKEGSFA

SEQ ID NO: 304216 - protein, 9 aa, Homo Sapiens
LRVNYCILR

SEQ ID NO: 304217 - protein, 9 aa, Homo Sapiens
PDNLLVWDG

SEQ ID NO: 304218 - protein, 9 aa, Homo Sapiens
LRKLINRKL

SEQ ID NO: 304219 - protein, 9 aa, Homo Sapiens
VRRKCPLPR

SEQ ID NO: 304220 - protein, 9 aa, Homo Sapiens
ETDPTFTLS

SEQ ID NO: 304221 - protein, 9 aa, Homo Sapiens
SHLTKHKII

SEQ ID NO: 304222 - protein, 9 aa, Homo Sapiens
FHKDPNVNM

SEQ ID NO: 304223 - protein, 9 aa, Homo Sapiens
LKDYRIILK

SEQ ID NO: 304224 - protein, 9 aa, Homo Sapiens
IDLFEAEDT

SEQ ID NO: 304225 - protein, 9 aa, Homo Sapiens
IRYRNQIFL

SEQ ID NO: 304226 - protein, 9 aa, Homo Sapiens
PSLIYWLQN

SEQ ID NO: 304227 - protein, 9 aa, Homo Sapiens
DSEEVEISK

SEQ ID NO: 304228 - protein, 9 aa, Homo Sapiens
QHEMKCKNC

SEQ ID NO: 304229 - protein, 9 aa, Homo Sapiens
HNIFSKFGK

SEQ ID NO: 304230 - protein, 9 aa, Homo Sapiens
ITIYLIERK

SEQ ID NO: 304231 - protein, 9 aa, Homo Sapiens
ALRVPTAGP

SEQ ID NO: 304232 - protein, 9 aa, Homo Sapiens
TQEPESIHK

SEQ ID NO: 304233 - protein, 9 aa, Homo Sapiens
IYPYTSSSL

SEQ ID NO: 304234 - protein, 9 aa, Homo Sapiens
SKVIKKFPA

SEQ ID NO: 304235 - protein, 9 aa, Homo Sapiens
DLIKYMLRE

SEQ ID NO: 304236 - protein, 9 aa, Homo Sapiens
ATFFCIFSR

SEQ ID NO: 304237 - protein, 9 aa, Homo Sapiens
RIEGKEPGC

SEQ ID NO: 304238 - protein, 9 aa, Homo Sapiens
HQKTRQLEK

SEQ ID NO: 304239 - protein, 9 aa, Homo Sapiens
FVSHMGTST

SEQ ID NO: 304240 - protein, 9 aa, Homo Sapiens
EYVLVYLHT

SEQ ID NO: 304241 - protein, 9 aa, Homo Sapiens
GLGAMLWGL

SEQ ID NO: 304242 - protein, 9 aa, Homo Sapiens
CAKHKRFLG

SEQ ID NO: 304243 - protein, 9 aa, Homo Sapiens
DSRNYLSGL

SEQ ID NO: 304244 - protein, 9 aa, Homo Sapiens
RVRRKCPLP

SEQ ID NO: 304245 - protein, 9 aa, Homo Sapiens
TGNTSFACT

SEQ ID NO: 304246 - protein, 9 aa, Homo Sapiens
NLEFHVQEI

SEQ ID NO: 304247 - protein, 9 aa, Homo Sapiens
KRFLDSLWL

SEQ ID NO: 304248 - protein, 9 aa, Homo Sapiens
TTLKQNVKL

SEQ ID NO: 304249 - protein, 9 aa, Homo Sapiens
IPLNGQLFA

SEQ ID NO: 304250 - protein, 9 aa, Homo Sapiens
KKMGQLIVQ

SEQ ID NO: 304251 - protein, 9 aa, Homo Sapiens
SETFILPHL

SEQ ID NO: 304252 - protein, 9 aa, Homo Sapiens
TKYSPGVFS

SEQ ID NO: 304253 - protein, 9 aa, Homo Sapiens
DDSEEVEIS

SEQ ID NO: 304254 - protein, 9 aa, Homo Sapiens
VSINEEHEG

SEQ ID NO: 304255 - protein, 9 aa, Homo Sapiens
MYASILTMT

SEQ ID NO: 304256 - protein, 9 aa, Homo Sapiens
SLAKDHCMK

SEQ ID NO: 304257 - protein, 9 aa, Homo Sapiens
DALVYTFRA

SEQ ID NO: 304258 - protein, 9 aa, Homo Sapiens
LLTLPPLLP

SEQ ID NO: 304259 - protein, 9 aa, Homo Sapiens
LTATRSGDV

SEQ ID NO: 304260 - protein, 9 aa, Homo Sapiens
YPTPYPDEF

SEQ ID NO: 304261 - protein, 9 aa, Homo Sapiens
YAKEGGLFG

SEQ ID NO: 304262 - protein, 9 aa, Homo Sapiens
LSLPGYIMK

SEQ ID NO: 304263 - protein, 9 aa, Homo Sapiens
EITKKHIQL

SEQ ID NO: 304264 - protein, 9 aa, Homo Sapiens
TGKQIEASI

SEQ ID NO: 304265 - protein, 9 aa, Homo Sapiens
YVGRENKLG

SEQ ID NO: 304266 - protein, 9 aa, Homo Sapiens
MLVFPVAIF

SEQ ID NO: 304267 - protein, 9 aa, Homo Sapiens
NISNICSYA

SEQ ID NO: 304268 - protein, 9 aa, Homo Sapiens
LALPNKEFK

SEQ ID NO: 304269 - protein, 9 aa, Homo Sapiens
NAYFSNKHS

SEQ ID NO: 304270 - protein, 9 aa, Homo Sapiens
CSRMYGATV

SEQ ID NO: 304271 - protein, 9 aa, Homo Sapiens
DIQGCNNTY

SEQ ID NO: 304272 - protein, 9 aa, Homo Sapiens
YMTFLKKIL

SEQ ID NO: 304273 - protein, 9 aa, Homo Sapiens
QQCFIIFHP

SEQ ID NO: 304274 - protein, 9 aa, Homo Sapiens
LYHAKNRIS

SEQ ID NO: 304275 - protein, 9 aa, Homo Sapiens
HYYDSRNDK

SEQ ID NO: 304276 - protein, 9 aa, Homo Sapiens
SFTVRDSPA

SEQ ID NO: 304277 - protein, 9 aa, Homo Sapiens
DPDAPIIKK

SEQ ID NO: 304278 - protein, 9 aa, Homo Sapiens
TFVQALIKK

SEQ ID NO: 304279 - protein, 9 aa, Homo Sapiens
FGKFIFISC

SEQ ID NO: 304280 - protein, 9 aa, Homo Sapiens
GKLHKKMGQ

SEQ ID NO: 304281 - protein, 9 aa, Homo Sapiens
VQTEAQYQF

SEQ ID NO: 304282 - protein, 9 aa, Homo Sapiens
GILNQNHRD

SEQ ID NO: 304283 - protein, 9 aa, Homo Sapiens
LVASGADKD

SEQ ID NO: 304284 - protein, 9 aa, Homo Sapiens
IYLEQCQSK

SEQ ID NO: 304285 - protein, 9 aa, Homo Sapiens
VIVFVLIGF

SEQ ID NO: 304286 - protein, 9 aa, Homo Sapiens
GYLLRKLKN

SEQ ID NO: 304287 - protein, 9 aa, Homo Sapiens
KKGLTLKSS

SEQ ID NO: 304288 - protein, 9 aa, Homo Sapiens
RNYVLLLIQ

SEQ ID NO: 304289 - protein, 9 aa, Homo Sapiens
IRTLWLFPF

SEQ ID NO: 304290 - protein, 9 aa, Homo Sapiens
TFLRAFRTI

SEQ ID NO: 304291 - protein, 9 aa, Homo Sapiens
QCYIQIGSK

SEQ ID NO: 304292 - protein, 9 aa, Homo Sapiens
LTPANNAFF

SEQ ID NO: 304293 - protein, 9 aa, Homo Sapiens
CCLQENNCH

SEQ ID NO: 304294 - protein, 9 aa, Homo Sapiens
CGAHRQTKK

SEQ ID NO: 304295 - protein, 9 aa, Homo Sapiens
FVKYLGLSA

SEQ ID NO: 304296 - protein, 9 aa, Homo Sapiens
CDLIAIERS

SEQ ID NO: 304297 - protein, 9 aa, Homo Sapiens
KKGEATCPH

SEQ ID NO: 304298 - protein, 9 aa, Homo Sapiens
LSVVKGIYL

SEQ ID NO: 304299 - protein, 9 aa, Homo Sapiens
GVGRFFHLD

SEQ ID NO: 304300 - protein, 9 aa, Homo Sapiens
RTPYTSAVD

SEQ ID NO: 304301 - protein, 9 aa, Homo Sapiens
DQIVGQGPG

SEQ ID NO: 304302 - protein, 9 aa, Homo Sapiens
NNFRQILCL

SEQ ID NO: 304303 - protein, 9 aa, Homo Sapiens
LFSAQTNRH

SEQ ID NO: 304304 - protein, 9 aa, Homo Sapiens
KQKSLQFNK

SEQ ID NO: 304305 - protein, 9 aa, Homo Sapiens
KTTDGFQNY

SEQ ID NO: 304306 - protein, 9 aa, Homo Sapiens
SGSLSSKML

SEQ ID NO: 304307 - protein, 9 aa, Homo Sapiens
YKMLSEKFM

SEQ ID NO: 304308 - protein, 9 aa, Homo Sapiens
WWAPKVKAD

SEQ ID NO: 304309 - protein, 9 aa, Homo Sapiens
SRLHLCDSN

SEQ ID NO: 304310 - protein, 9 aa, Homo Sapiens
PLGLYDLWA

SEQ ID NO: 304311 - protein, 9 aa, Homo Sapiens
CGKVFTQNP

SEQ ID NO: 304312 - protein, 9 aa, Homo Sapiens
RNIRLVQCY

SEQ ID NO: 304313 - protein, 9 aa, Homo Sapiens
TRGKHAWTH

SEQ ID NO: 304314 - protein, 9 aa, Homo Sapiens
WPSTAINRA

SEQ ID NO: 304315 - protein, 9 aa, Homo Sapiens
QLHNSNIIN

SEQ ID NO: 304316 - protein, 9 aa, Homo Sapiens
TVHITNKRN

SEQ ID NO: 304317 - protein, 9 aa, Homo Sapiens
GGHKIILAA

SEQ ID NO: 304318 - protein, 9 aa, Homo Sapiens
EGDQVSRRG

SEQ ID NO: 304319 - protein, 9 aa, Homo Sapiens
RKEKTTKGP

SEQ ID NO: 304320 - protein, 9 aa, Homo Sapiens
GQAFVQKTH

SEQ ID NO: 304321 - protein, 9 aa, Homo Sapiens
AQLKNLFCI

SEQ ID NO: 304322 - protein, 9 aa, Homo Sapiens
TNYRFLHDN

SEQ ID NO: 304323 - protein, 9 aa, Homo Sapiens
LMIPPSVFP

SEQ ID NO: 304324 - protein, 9 aa, Homo Sapiens
TSRHILEGD

SEQ ID NO: 304325 - protein, 9 aa, Homo Sapiens
ISNICSYAD

SEQ ID NO: 304326 - protein, 9 aa, Homo Sapiens
DVEQVRQLA

SEQ ID NO: 304327 - protein, 9 aa, Homo Sapiens
GYNMKKLFR

SEQ ID NO: 304328 - protein, 9 aa, Homo Sapiens
KKMTEGSVT

SEQ ID NO: 304329 - protein, 9 aa, Homo Sapiens
SCPGNAEGK

SEQ ID NO: 304330 - protein, 9 aa, Homo Sapiens
GRKMILETA

SEQ ID NO: 304331 - protein, 9 aa, Homo Sapiens
YSEISSEPG

SEQ ID NO: 304332 - protein, 9 aa, Homo Sapiens
NLQKCDILE

SEQ ID NO: 304333 - protein, 9 aa, Homo Sapiens
LFEYTLKGE

SEQ ID NO: 304334 - protein, 9 aa, Homo Sapiens
TGSDNGTVK

SEQ ID NO: 304335 - protein, 9 aa, Homo Sapiens
AEELIFQYL

SEQ ID NO: 304336 - protein, 9 aa, Homo Sapiens
DKCYGEISQ

SEQ ID NO: 304337 - protein, 9 aa, Homo Sapiens
IEKLDRLGL

SEQ ID NO: 304338 - protein, 9 aa, Homo Sapiens
NCCVGKIPE

SEQ ID NO: 304339 - protein, 9 aa, Homo Sapiens
KAPTFLYDI

SEQ ID NO: 304340 - protein, 9 aa, Homo Sapiens
KSCESNYPF

SEQ ID NO: 304341 - protein, 9 aa, Homo Sapiens
KNVIIDKVH

SEQ ID NO: 304342 - protein, 9 aa, Homo Sapiens
SGNRDNEKP

SEQ ID NO: 304343 - protein, 9 aa, Homo Sapiens
SRFLQSWNL

SEQ ID NO: 304344 - protein, 9 aa, Homo Sapiens
NNLSPKENI

SEQ ID NO: 304345 - protein, 9 aa, Homo Sapiens
PHQNQYLGD

SEQ ID NO: 304346 - protein, 9 aa, Homo Sapiens
RYCPEGVHQ

SEQ ID NO: 304347 - protein, 9 aa, Homo Sapiens
KVIMRIYES

SEQ ID NO: 304348 - protein, 9 aa, Homo Sapiens
KENYHDVTI

SEQ ID NO: 304349 - protein, 9 aa, Homo Sapiens
GLPSLSLEN

SEQ ID NO: 304350 - protein, 9 aa, Homo Sapiens
MVPFKTKYS

SEQ ID NO: 304351 - protein, 9 aa, Homo Sapiens
VFFFIIYIL

SEQ ID NO: 304352 - protein, 9 aa, Homo Sapiens
EWWRENNGS

SEQ ID NO: 304353 - protein, 9 aa, Homo Sapiens
KQYTGRGPV

SEQ ID NO: 304354 - protein, 9 aa, Homo Sapiens
DGNIVRKEV

SEQ ID NO: 304355 - protein, 9 aa, Homo Sapiens
LRNFDEDVG

SEQ ID NO: 304356 - protein, 9 aa, Homo Sapiens
WFNHGIHNY

SEQ ID NO: 304357 - protein, 9 aa, Homo Sapiens
KLLRAIASC

SEQ ID NO: 304358 - protein, 9 aa, Homo Sapiens
GSVCLSEAG

SEQ ID NO: 304359 - protein, 9 aa, Homo Sapiens
KLVPESLNK

SEQ ID NO: 304360 - protein, 9 aa, Homo Sapiens
LQKKQQLAI

SEQ ID NO: 304361 - protein, 9 aa, Homo Sapiens
DDNKIIRRV

SEQ ID NO: 304362 - protein, 9 aa, Homo Sapiens
FVELFSPRR

SEQ ID NO: 304363 - protein, 9 aa, Homo Sapiens
APEDKIWEE

SEQ ID NO: 304364 - protein, 9 aa, Homo Sapiens
ATMKADLES

SEQ ID NO: 304365 - protein, 9 aa, Homo Sapiens
STASHNSPG

SEQ ID NO: 304366 - protein, 9 aa, Homo Sapiens
CAVLEKLHS

SEQ ID NO: 304367 - protein, 9 aa, Homo Sapiens
SKTRHTRKT

SEQ ID NO: 304368 - protein, 9 aa, Homo Sapiens
FYSISAALE

SEQ ID NO: 304369 - protein, 9 aa, Homo Sapiens
PNNSYIAYI

SEQ ID NO: 304370 - protein, 9 aa, Homo Sapiens
GSQLFEMHD

SEQ ID NO: 304371 - protein, 9 aa, Homo Sapiens
LCVRQSGHG

SEQ ID NO: 304372 - protein, 9 aa, Homo Sapiens
RSSLVITTT

SEQ ID NO: 304373 - protein, 9 aa, Homo Sapiens
CVSEDLGNT

SEQ ID NO: 304374 - protein, 9 aa, Homo Sapiens
LKLMAQHLI

SEQ ID NO: 304375 - protein, 9 aa, Homo Sapiens
SNKVVQMEQ

SEQ ID NO: 304376 - protein, 9 aa, Homo Sapiens
PIPSNLKLE

SEQ ID NO: 304377 - protein, 9 aa, Homo Sapiens
ELIIFAVMA

SEQ ID NO: 304378 - protein, 9 aa, Homo Sapiens
MECSAPLPL

SEQ ID NO: 304379 - protein, 9 aa, Homo Sapiens
GPSLRNMAS

SEQ ID NO: 304380 - protein, 9 aa, Homo Sapiens
SESPPPGWQ

SEQ ID NO: 304381 - protein, 9 aa, Homo Sapiens
TIYLIERKY

SEQ ID NO: 304382 - protein, 9 aa, Homo Sapiens
DSSIQKQWK

SEQ ID NO: 304383 - protein, 9 aa, Homo Sapiens
LPLCGNNVI

SEQ ID NO: 304384 - protein, 9 aa, Homo Sapiens
SYLIQHKII

SEQ ID NO: 304385 - protein, 9 aa, Homo Sapiens
TITMLEMKE

SEQ ID NO: 304386 - protein, 9 aa, Homo Sapiens
VFLHYFILV

SEQ ID NO: 304387 - protein, 9 aa, Homo Sapiens
VRDSPAHFV

SEQ ID NO: 304388 - protein, 9 aa, Homo Sapiens
SDKKILLEA

SEQ ID NO: 304389 - protein, 9 aa, Homo Sapiens
LQCDKKKVL

SEQ ID NO: 304390 - protein, 9 aa, Homo Sapiens
FCNASSQEY

SEQ ID NO: 304391 - protein, 9 aa, Homo Sapiens
YGDINIMLV

SEQ ID NO: 304392 - protein, 9 aa, Homo Sapiens
IHKDILRVI

SEQ ID NO: 304393 - protein, 9 aa, Homo Sapiens
WLRALLGCS

SEQ ID NO: 304394 - protein, 9 aa, Homo Sapiens
DKLQLFCVR

SEQ ID NO: 304395 - protein, 9 aa, Homo Sapiens
HKKFALRCS

SEQ ID NO: 304396 - protein, 9 aa, Homo Sapiens
VFTQNPHLA

SEQ ID NO: 304397 - protein, 9 aa, Homo Sapiens
ALYYSQHVV

SEQ ID NO: 304398 - protein, 9 aa, Homo Sapiens
RSRSRLQNR

SEQ ID NO: 304399 - protein, 9 aa, Homo Sapiens
EKPFECNGC

SEQ ID NO: 304400 - protein, 9 aa, Homo Sapiens
LQILEEKNN

SEQ ID NO: 304401 - protein, 9 aa, Homo Sapiens
HSLVSTSNG

SEQ ID NO: 304402 - protein, 9 aa, Homo Sapiens
GKRPYECSE

SEQ ID NO: 304403 - protein, 9 aa, Homo Sapiens
CLMFLTQKY

SEQ ID NO: 304404 - protein, 9 aa, Homo Sapiens
TLDTVGWVQ

SEQ ID NO: 304405 - protein, 9 aa, Homo Sapiens
CIRTTKDEK

SEQ ID NO: 304406 - protein, 9 aa, Homo Sapiens
NSKFFKTHG

SEQ ID NO: 304407 - protein, 9 aa, Homo Sapiens
RTHVQGLSN

SEQ ID NO: 304408 - protein, 9 aa, Homo Sapiens
DIKTDNLLL

SEQ ID NO: 304409 - protein, 9 aa, Homo Sapiens
VSGIVSIIY

SEQ ID NO: 304410 - protein, 9 aa, Homo Sapiens
KKTVCDISY

SEQ ID NO: 304411 - protein, 9 aa, Homo Sapiens
VIVVDWNRG

SEQ ID NO: 304412 - protein, 9 aa, Homo Sapiens
SSLHVRCAG

SEQ ID NO: 304413 - protein, 9 aa, Homo Sapiens
IFIGGKINR

SEQ ID NO: 304414 - protein, 9 aa, Homo Sapiens
KLNPPLMKR

SEQ ID NO: 304415 - protein, 9 aa, Homo Sapiens
LVQFIFIYQ

SEQ ID NO: 304416 - protein, 9 aa, Homo Sapiens
NNRVGKAFH

SEQ ID NO: 304417 - protein, 9 aa, Homo Sapiens
SGLTATRSG

SEQ ID NO: 304418 - protein, 9 aa, Homo Sapiens
IKNEPFTIP

SEQ ID NO: 304419 - protein, 9 aa, Homo Sapiens
VEKDYFQAS

SEQ ID NO: 304420 - protein, 9 aa, Homo Sapiens
GRYLMACAQ

SEQ ID NO: 304421 - protein, 9 aa, Homo Sapiens
GDKPFECLE

SEQ ID NO: 304422 - protein, 9 aa, Homo Sapiens
WILSTSDTV

SEQ ID NO: 304423 - protein, 9 aa, Homo Sapiens
YDLCNKLIA

SEQ ID NO: 304424 - protein, 9 aa, Homo Sapiens
APDIHDERQ

SEQ ID NO: 304425 - protein, 9 aa, Homo Sapiens
CSECGQSFT

SEQ ID NO: 304426 - protein, 9 aa, Homo Sapiens
SKGIVESIQ

SEQ ID NO: 304427 - protein, 9 aa, Homo Sapiens
SSSSDEGYL

SEQ ID NO: 304428 - protein, 9 aa, Homo Sapiens
SSSTQIIVQ

SEQ ID NO: 304429 - protein, 9 aa, Homo Sapiens
KFILLGLSG

SEQ ID NO: 304430 - protein, 9 aa, Homo Sapiens
NHCGSHSGG

SEQ ID NO: 304431 - protein, 9 aa, Homo Sapiens
EKLDKWAKI

SEQ ID NO: 304432 - protein, 9 aa, Homo Sapiens
QKLKEVIYL

SEQ ID NO: 304433 - protein, 9 aa, Homo Sapiens
FREQFEDNW

SEQ ID NO: 304434 - protein, 9 aa, Homo Sapiens
GNYTVLAKV

SEQ ID NO: 304435 - protein, 9 aa, Homo Sapiens
LTQIKSKKH

SEQ ID NO: 304436 - protein, 9 aa, Homo Sapiens
IIAVLRQRL

SEQ ID NO: 304437 - protein, 9 aa, Homo Sapiens
VPGCNTMFL

SEQ ID NO: 304438 - protein, 9 aa, Homo Sapiens
YAKNVIIDK

SEQ ID NO: 304439 - protein, 9 aa, Homo Sapiens
WHIQFTANE

SEQ ID NO: 304440 - protein, 9 aa, Homo Sapiens
KPGVFSFID

SEQ ID NO: 304441 - protein, 9 aa, Homo Sapiens
INIFLQQLN

SEQ ID NO: 304442 - protein, 9 aa, Homo Sapiens
RGSSWHLSN

SEQ ID NO: 304443 - protein, 9 aa, Homo Sapiens
VLDIEQLSV

SEQ ID NO: 304444 - protein, 9 aa, Homo Sapiens
GSTKYSYKY

SEQ ID NO: 304445 - protein, 9 aa, Homo Sapiens
PKGLPRDWL

SEQ ID NO: 304446 - protein, 9 aa, Homo Sapiens
WTSSQRCCD

SEQ ID NO: 304447 - protein, 9 aa, Homo Sapiens
ARRITQETV

SEQ ID NO: 304448 - protein, 9 aa, Homo Sapiens
HSMEIRPWT

SEQ ID NO: 304449 - protein, 9 aa, Homo Sapiens
HTPATAAGS

SEQ ID NO: 304450 - protein, 9 aa, Homo Sapiens
NEVNHLYCD

SEQ ID NO: 304451 - protein, 9 aa, Homo Sapiens
VNSFIVSSL

SEQ ID NO: 304452 - protein, 9 aa, Homo Sapiens
AAELVSAME

SEQ ID NO: 304453 - protein, 9 aa, Homo Sapiens
MVSKKGIFP

SEQ ID NO: 304454 - protein, 9 aa, Homo Sapiens
WQGFYCGGK

SEQ ID NO: 304455 - protein, 9 aa, Homo Sapiens
LQFTVEHTH

SEQ ID NO: 304456 - protein, 9 aa, Homo Sapiens
KMGCKKVMD

SEQ ID NO: 304457 - protein, 9 aa, Homo Sapiens
EIKGKISQR

SEQ ID NO: 304458 - protein, 9 aa, Homo Sapiens
HAALRWQLL

SEQ ID NO: 304459 - protein, 9 aa, Homo Sapiens
YALKAVDTV

SEQ ID NO: 304460 - protein, 9 aa, Homo Sapiens
LLQRCTAPG

SEQ ID NO: 304461 - protein, 9 aa, Homo Sapiens
TNMMPVSSC

SEQ ID NO: 304462 - protein, 9 aa, Homo Sapiens
LLLSYILTH

SEQ ID NO: 304463 - protein, 9 aa, Homo Sapiens
GDMEKIILD

SEQ ID NO: 304464 - protein, 9 aa, Homo Sapiens
PDQSDRSGT

SEQ ID NO: 304465 - protein, 9 aa, Homo Sapiens
TLREKLEAA

SEQ ID NO: 304466 - protein, 9 aa, Homo Sapiens
LQKEDNEVY

SEQ ID NO: 304467 - protein, 9 aa, Homo Sapiens
NPFNESQGK

SEQ ID NO: 304468 - protein, 9 aa, Homo Sapiens
RWTNANMEI

SEQ ID NO: 304469 - protein, 9 aa, Homo Sapiens
QTRTMAPES

SEQ ID NO: 304470 - protein, 9 aa, Homo Sapiens
TTDNIFFWN

SEQ ID NO: 304471 - protein, 9 aa, Homo Sapiens
FLEYLPLEE

SEQ ID NO: 304472 - protein, 9 aa, Homo Sapiens
IFTESLQPS

SEQ ID NO: 304473 - protein, 9 aa, Homo Sapiens
VKMAFFYCK

SEQ ID NO: 304474 - protein, 9 aa, Homo Sapiens
LSYVKAQEG

SEQ ID NO: 304475 - protein, 9 aa, Homo Sapiens
PVIQNGARD

SEQ ID NO: 304476 - protein, 9 aa, Homo Sapiens
GTEGDISFP

SEQ ID NO: 304477 - protein, 9 aa, Homo Sapiens
RKGGPLTNK

SEQ ID NO: 304478 - protein, 9 aa, Homo Sapiens
YNMKKLFRR

SEQ ID NO: 304479 - protein, 9 aa, Homo Sapiens
HNKLSNPKI

SEQ ID NO: 304480 - protein, 9 aa, Homo Sapiens
LSLITLIGI

SEQ ID NO: 304481 - protein, 9 aa, Homo Sapiens
FRKAASHNS

SEQ ID NO: 304482 - protein, 9 aa, Homo Sapiens
PDWSNNVEY

SEQ ID NO: 304483 - protein, 9 aa, Homo Sapiens
IRAAPEKNV

SEQ ID NO: 304484 - protein, 9 aa, Homo Sapiens
SGHNEIQLF

SEQ ID NO: 304485 - protein, 9 aa, Homo Sapiens
TQKGNSNKV

SEQ ID NO: 304486 - protein, 9 aa, Homo Sapiens
GELDKAIKF

SEQ ID NO: 304487 - protein, 9 aa, Homo Sapiens
DRPFKCPTC

SEQ ID NO: 304488 - protein, 9 aa, Homo Sapiens
FQLKGCRSV

SEQ ID NO: 304489 - protein, 9 aa, Homo Sapiens
RVGYCSGGT

SEQ ID NO: 304490 - protein, 9 aa, Homo Sapiens
LQYNYGIQN

SEQ ID NO: 304491 - protein, 9 aa, Homo Sapiens
ESINAFRET

SEQ ID NO: 304492 - protein, 9 aa, Homo Sapiens
KMFMSLLVG

SEQ ID NO: 304493 - protein, 9 aa, Homo Sapiens
WQRDVCNVL

SEQ ID NO: 304494 - protein, 9 aa, Homo Sapiens
VTMYQKLRV

SEQ ID NO: 304495 - protein, 9 aa, Homo Sapiens
GIHILTIMW

SEQ ID NO: 304496 - protein, 9 aa, Homo Sapiens
GKRKIQEEI

SEQ ID NO: 304497 - protein, 9 aa, Homo Sapiens
SKKYTVKAE

SEQ ID NO: 304498 - protein, 9 aa, Homo Sapiens
EDNCEAVPH

SEQ ID NO: 304499 - protein, 9 aa, Homo Sapiens
CLTFEDVPD

SEQ ID NO: 304500 - protein, 9 aa, Homo Sapiens
FFLPLGAIC

SEQ ID NO: 304501 - protein, 9 aa, Homo Sapiens
RIFRADKSY

SEQ ID NO: 304502 - protein, 9 aa, Homo Sapiens
WPLPLHPVL

SEQ ID NO: 304503 - protein, 9 aa, Homo Sapiens
QQPHVGGEV

SEQ ID NO: 304504 - protein, 9 aa, Homo Sapiens
LHNCFLGIY

SEQ ID NO: 304505 - protein, 9 aa, Homo Sapiens
ATLVKCECA

SEQ ID NO: 304506 - protein, 9 aa, Homo Sapiens
SLQFNKTMD

SEQ ID NO: 304507 - protein, 9 aa, Homo Sapiens
LQSEGSPLV

SEQ ID NO: 304508 - protein, 9 aa, Homo Sapiens
GTPGSVQSS

SEQ ID NO: 304509 - protein, 9 aa, Homo Sapiens
PIISKYRVR

SEQ ID NO: 304510 - protein, 9 aa, Homo Sapiens
KNMPASQRS

SEQ ID NO: 304511 - protein, 9 aa, Homo Sapiens
LQYKHVRPD

SEQ ID NO: 304512 - protein, 9 aa, Homo Sapiens
EKVGSVCLS

SEQ ID NO: 304513 - protein, 9 aa, Homo Sapiens
PQIFKKKQK

SEQ ID NO: 304514 - protein, 9 aa, Homo Sapiens
STTSLALSR

SEQ ID NO: 304515 - protein, 9 aa, Homo Sapiens
NCTLFDMGN

SEQ ID NO: 304516 - protein, 9 aa, Homo Sapiens
RHIPLFSRM

SEQ ID NO: 304517 - protein, 9 aa, Homo Sapiens
SLEDHIQMK

SEQ ID NO: 304518 - protein, 9 aa, Homo Sapiens
TLFFTDYGN

SEQ ID NO: 304519 - protein, 9 aa, Homo Sapiens
GDIKLSLPG

SEQ ID NO: 304520 - protein, 9 aa, Homo Sapiens
VCIREMDQK

SEQ ID NO: 304521 - protein, 9 aa, Homo Sapiens
IAYDPKHFH

SEQ ID NO: 304522 - protein, 9 aa, Homo Sapiens
LSDYNSALR

SEQ ID NO: 304523 - protein, 9 aa, Homo Sapiens
HHQPPADKV

SEQ ID NO: 304524 - protein, 9 aa, Homo Sapiens
QNLEETIEC

SEQ ID NO: 304525 - protein, 9 aa, Homo Sapiens
TNSKGPSSK

SEQ ID NO: 304526 - protein, 9 aa, Homo Sapiens
QILHSREKL

SEQ ID NO: 304527 - protein, 9 aa, Homo Sapiens
VSHKAPTFL

SEQ ID NO: 304528 - protein, 9 aa, Homo Sapiens
TSGLSGDNL

SEQ ID NO: 304529 - protein, 9 aa, Homo Sapiens
DINNCDGKS

SEQ ID NO: 304530 - protein, 9 aa, Homo Sapiens
ALNLTELVD

SEQ ID NO: 304531 - protein, 9 aa, Homo Sapiens
SRRQGEDFM

SEQ ID NO: 304532 - protein, 9 aa, Homo Sapiens
MMHKRTQQI

SEQ ID NO: 304533 - protein, 9 aa, Homo Sapiens
STLSQLPTP

SEQ ID NO: 304534 - protein, 9 aa, Homo Sapiens
AGYKVIHIT

SEQ ID NO: 304535 - protein, 9 aa, Homo Sapiens
ALILGIELH

SEQ ID NO: 304536 - protein, 9 aa, Homo Sapiens
CSMTLKLPT

SEQ ID NO: 304537 - protein, 9 aa, Homo Sapiens
DYLLGIYGR

SEQ ID NO: 304538 - protein, 9 aa, Homo Sapiens
TSSTGLERR

SEQ ID NO: 304539 - protein, 9 aa, Homo Sapiens
KPEWFWGRD

SEQ ID NO: 304540 - protein, 9 aa, Homo Sapiens
IRRFAAYNE

SEQ ID NO: 304541 - protein, 9 aa, Homo Sapiens
HYSDCLVIL

SEQ ID NO: 304542 - protein, 9 aa, Homo Sapiens
PVIWWAPNV

SEQ ID NO: 304543 - protein, 9 aa, Homo Sapiens
LKEKTGKCS

SEQ ID NO: 304544 - protein, 9 aa, Homo Sapiens
ILYSKTHMN

SEQ ID NO: 304545 - protein, 9 aa, Homo Sapiens
ERVKIIYKK

SEQ ID NO: 304546 - protein, 9 aa, Homo Sapiens
LFTAKVLYL

SEQ ID NO: 304547 - protein, 9 aa, Homo Sapiens
VLSQWRVFA

SEQ ID NO: 304548 - protein, 9 aa, Homo Sapiens
HKLLFAISE

SEQ ID NO: 304549 - protein, 9 aa, Homo Sapiens
PPAWGQRRN

SEQ ID NO: 304550 - protein, 9 aa, Homo Sapiens
RFVPSFLCG

SEQ ID NO: 304551 - protein, 9 aa, Homo Sapiens
NKTSGPTRG

SEQ ID NO: 304552 - protein, 9 aa, Homo Sapiens
LNEVSKRVC

SEQ ID NO: 304553 - protein, 9 aa, Homo Sapiens
WAPNVQHLS

SEQ ID NO: 304554 - protein, 9 aa, Homo Sapiens
HDKLSCMAN

SEQ ID NO: 304555 - protein, 9 aa, Homo Sapiens
FDFSTKDFL

SEQ ID NO: 304556 - protein, 9 aa, Homo Sapiens
LRAWQASLE

SEQ ID NO: 304557 - protein, 9 aa, Homo Sapiens
QMNNFNIKE

SEQ ID NO: 304558 - protein, 9 aa, Homo Sapiens
EFCFYYAIK

SEQ ID NO: 304559 - protein, 9 aa, Homo Sapiens
NHVNSDRID

SEQ ID NO: 304560 - protein, 9 aa, Homo Sapiens
HYLAKSLCI

SEQ ID NO: 304561 - protein, 9 aa, Homo Sapiens
NGTVKLWDI

SEQ ID NO: 304562 - protein, 9 aa, Homo Sapiens
QNWRAKLKR

SEQ ID NO: 304563 - protein, 9 aa, Homo Sapiens
TPSKGSHKR

SEQ ID NO: 304564 - protein, 9 aa, Homo Sapiens
SSIVGGNET

SEQ ID NO: 304565 - protein, 9 aa, Homo Sapiens
YPGFGEHFI

SEQ ID NO: 304566 - protein, 9 aa, Homo Sapiens
CAKCSKPLV

SEQ ID NO: 304567 - protein, 9 aa, Homo Sapiens
TCKTPIRAL

SEQ ID NO: 304568 - protein, 9 aa, Homo Sapiens
RHTRKTVLR

SEQ ID NO: 304569 - protein, 9 aa, Homo Sapiens
IRHRKTHTG

SEQ ID NO: 304570 - protein, 9 aa, Homo Sapiens
KLKEVIYLE

SEQ ID NO: 304571 - protein, 9 aa, Homo Sapiens
PSVTLVDPA

SEQ ID NO: 304572 - protein, 9 aa, Homo Sapiens
VSSFFLKHG

SEQ ID NO: 304573 - protein, 9 aa, Homo Sapiens
CTRVENCYS

SEQ ID NO: 304574 - protein, 9 aa, Homo Sapiens
FIQPPKPLS

SEQ ID NO: 304575 - protein, 9 aa, Homo Sapiens
GNPDEECER

SEQ ID NO: 304576 - protein, 9 aa, Homo Sapiens
CIPLPVSNI

SEQ ID NO: 304577 - protein, 9 aa, Homo Sapiens
ASKFLLLAV

SEQ ID NO: 304578 - protein, 9 aa, Homo Sapiens
SLSLENNGG

SEQ ID NO: 304579 - protein, 9 aa, Homo Sapiens
LVSTSNGVS

SEQ ID NO: 304580 - protein, 9 aa, Homo Sapiens
SDIVNHRRS

SEQ ID NO: 304581 - protein, 9 aa, Homo Sapiens
GSLPVDDPT

SEQ ID NO: 304582 - protein, 9 aa, Homo Sapiens
QPQPFFAAG

SEQ ID NO: 304583 - protein, 9 aa, Homo Sapiens
QKKLKRLML

SEQ ID NO: 304584 - protein, 9 aa, Homo Sapiens
IDTPKGGFD

SEQ ID NO: 304585 - protein, 9 aa, Homo Sapiens
RYQPYKCDQ

SEQ ID NO: 304586 - protein, 9 aa, Homo Sapiens
FVFNFIGPQ

SEQ ID NO: 304587 - protein, 9 aa, Homo Sapiens
RSNPGGGGL

SEQ ID NO: 304588 - protein, 9 aa, Homo Sapiens
FTAHQIIHT

SEQ ID NO: 304589 - protein, 9 aa, Homo Sapiens
RNTTPDFII

SEQ ID NO: 304590 - protein, 9 aa, Homo Sapiens
TTKLPLKFR

SEQ ID NO: 304591 - protein, 9 aa, Homo Sapiens
RQIRPWINK

SEQ ID NO: 304592 - protein, 9 aa, Homo Sapiens
KAVEELNNN

SEQ ID NO: 304593 - protein, 9 aa, Homo Sapiens
ISAIKRNAR

SEQ ID NO: 304594 - protein, 9 aa, Homo Sapiens
NRIELKTIN

SEQ ID NO: 304595 - protein, 9 aa, Homo Sapiens
HGCMGQLFI

SEQ ID NO: 304596 - protein, 9 aa, Homo Sapiens
LTREAMQNY

SEQ ID NO: 304597 - protein, 9 aa, Homo Sapiens
AGTLFFTDY

SEQ ID NO: 304598 - protein, 9 aa, Homo Sapiens
QKICDLIAI

SEQ ID NO: 304599 - protein, 9 aa, Homo Sapiens
VLSQFSPHL

SEQ ID NO: 304600 - protein, 9 aa, Homo Sapiens
MRLLIEHGA

SEQ ID NO: 304601 - protein, 9 aa, Homo Sapiens
EAEELFVKY

SEQ ID NO: 304602 - protein, 9 aa, Homo Sapiens
FNTLNKLEV

SEQ ID NO: 304603 - protein, 9 aa, Homo Sapiens
KINYFELDR

SEQ ID NO: 304604 - protein, 9 aa, Homo Sapiens
ETDKGSFVV

SEQ ID NO: 304605 - protein, 9 aa, Homo Sapiens
QKTYRCNKC

SEQ ID NO: 304606 - protein, 9 aa, Homo Sapiens
STKFDISWI

SEQ ID NO: 304607 - protein, 9 aa, Homo Sapiens
THDLKESIC

SEQ ID NO: 304608 - protein, 9 aa, Homo Sapiens
AAAYYPCEP

SEQ ID NO: 304609 - protein, 9 aa, Homo Sapiens
SSQTKVLSS

SEQ ID NO: 304610 - protein, 9 aa, Homo Sapiens
RYWGTLGSG

SEQ ID NO: 304611 - protein, 9 aa, Homo Sapiens
SALLRYHTN

SEQ ID NO: 304612 - protein, 9 aa, Homo Sapiens
PALGKFPFA

SEQ ID NO: 304613 - protein, 9 aa, Homo Sapiens
LFVAPLILL

SEQ ID NO: 304614 - protein, 9 aa, Homo Sapiens
FLYVNRTPM

SEQ ID NO: 304615 - protein, 9 aa, Homo Sapiens
QLSSLQVHQ

SEQ ID NO: 304616 - protein, 9 aa, Homo Sapiens
ELNEYQAHA

SEQ ID NO: 304617 - protein, 9 aa, Homo Sapiens
ASLVGLLPT

SEQ ID NO: 304618 - protein, 9 aa, Homo Sapiens
LMPINTLSG

SEQ ID NO: 304619 - protein, 9 aa, Homo Sapiens
TANEKTLIS

SEQ ID NO: 304620 - protein, 9 aa, Homo Sapiens
ETLTLVSFS

SEQ ID NO: 304621 - protein, 9 aa, Homo Sapiens
EIFVVCQGV

SEQ ID NO: 304622 - protein, 9 aa, Homo Sapiens
KGSVKYGKQ

SEQ ID NO: 304623 - protein, 9 aa, Homo Sapiens
FQMEEYLKQ

SEQ ID NO: 304624 - protein, 9 aa, Homo Sapiens
EFSTSFLSY

SEQ ID NO: 304625 - protein, 9 aa, Homo Sapiens
EEYLKQKKE

SEQ ID NO: 304626 - protein, 9 aa, Homo Sapiens
VNLVGLIKV

SEQ ID NO: 304627 - protein, 9 aa, Homo Sapiens
EELNFEVIP

SEQ ID NO: 304628 - protein, 9 aa, Homo Sapiens
PVGHPGDVS

SEQ ID NO: 304629 - protein, 9 aa, Homo Sapiens
PNSTAEAFF

SEQ ID NO: 304630 - protein, 9 aa, Homo Sapiens
PCVLGWNGV

SEQ ID NO: 304631 - protein, 9 aa, Homo Sapiens
HFSPAKLEW

SEQ ID NO: 304632 - protein, 9 aa, Homo Sapiens
HKVTYKSLT

SEQ ID NO: 304633 - protein, 9 aa, Homo Sapiens
LPDGLNKKC

SEQ ID NO: 304634 - protein, 9 aa, Homo Sapiens
AMLNWAEGS

SEQ ID NO: 304635 - protein, 9 aa, Homo Sapiens
TIKLMEVPV

SEQ ID NO: 304636 - protein, 9 aa, Homo Sapiens
EKADLNTTL

SEQ ID NO: 304637 - protein, 9 aa, Homo Sapiens
ELQHKRALR

SEQ ID NO: 304638 - protein, 9 aa, Homo Sapiens
VFMQFCANK

SEQ ID NO: 304639 - protein, 9 aa, Homo Sapiens
KEINSPNVL

SEQ ID NO: 304640 - protein, 9 aa, Homo Sapiens
VGKPYMETT

SEQ ID NO: 304641 - protein, 9 aa, Homo Sapiens
GIEINGNSV

SEQ ID NO: 304642 - protein, 9 aa, Homo Sapiens
HSAYSETFI

SEQ ID NO: 304643 - protein, 9 aa, Homo Sapiens
EGQCWVDDK

SEQ ID NO: 304644 - protein, 9 aa, Homo Sapiens
QIEDADIHN

SEQ ID NO: 304645 - protein, 9 aa, Homo Sapiens
FSTKSSSAA

SEQ ID NO: 304646 - protein, 9 aa, Homo Sapiens
PQPRGPITP

SEQ ID NO: 304647 - protein, 9 aa, Homo Sapiens
HGFSPRSYL

SEQ ID NO: 304648 - protein, 9 aa, Homo Sapiens
GDKEAIVTS

SEQ ID NO: 304649 - protein, 9 aa, Homo Sapiens
LNPHALVIN

SEQ ID NO: 304650 - protein, 9 aa, Homo Sapiens
RLSPDQCCI

SEQ ID NO: 304651 - protein, 9 aa, Homo Sapiens
ADNNTSQTL

SEQ ID NO: 304652 - protein, 9 aa, Homo Sapiens
ELEEFKKVL

SEQ ID NO: 304653 - protein, 9 aa, Homo Sapiens
VPGGPVITA

SEQ ID NO: 304654 - protein, 9 aa, Homo Sapiens
LYTPQNFID

SEQ ID NO: 304655 - protein, 9 aa, Homo Sapiens
YGLIPEELF

SEQ ID NO: 304656 - protein, 9 aa, Homo Sapiens
YWKKHFTVA

SEQ ID NO: 304657 - protein, 9 aa, Homo Sapiens
ATFKCNICL

SEQ ID NO: 304658 - protein, 9 aa, Homo Sapiens
QEKKLLASD

SEQ ID NO: 304659 - protein, 9 aa, Homo Sapiens
AEDLSDQSK

SEQ ID NO: 304660 - protein, 9 aa, Homo Sapiens
SVRQFWFLM

SEQ ID NO: 304661 - protein, 9 aa, Homo Sapiens
INDVRHANS

SEQ ID NO: 304662 - protein, 9 aa, Homo Sapiens
LRLPCTVAR

SEQ ID NO: 304663 - protein, 9 aa, Homo Sapiens
GEKKQKLED

SEQ ID NO: 304664 - protein, 9 aa, Homo Sapiens
HICLKMIIM

SEQ ID NO: 304665 - protein, 9 aa, Homo Sapiens
DNLLSCKML

SEQ ID NO: 304666 - protein, 9 aa, Homo Sapiens
LPHGQLVNG

SEQ ID NO: 304667 - protein, 9 aa, Homo Sapiens
SQVISEGDG

SEQ ID NO: 304668 - protein, 9 aa, Homo Sapiens
ANRLYPSGT

SEQ ID NO: 304669 - protein, 9 aa, Homo Sapiens
KENYLPKPK

SEQ ID NO: 304670 - protein, 9 aa, Homo Sapiens
KRFVKYLGL

SEQ ID NO: 304671 - protein, 9 aa, Homo Sapiens
DKIQFEINF

SEQ ID NO: 304672 - protein, 9 aa, Homo Sapiens
LYELEESTE

SEQ ID NO: 304673 - protein, 9 aa, Homo Sapiens
WFWGRDVLD

SEQ ID NO: 304674 - protein, 9 aa, Homo Sapiens
QGRAEAHTE

SEQ ID NO: 304675 - protein, 9 aa, Homo Sapiens
SKRKDSQTV

SEQ ID NO: 304676 - protein, 9 aa, Homo Sapiens
GVAVMQLNV

SEQ ID NO: 304677 - protein, 9 aa, Homo Sapiens
WVSLLVLLT

SEQ ID NO: 304678 - protein, 9 aa, Homo Sapiens
IIRHEDIHQ

SEQ ID NO: 304679 - protein, 9 aa, Homo Sapiens
QITTWSAGV

SEQ ID NO: 304680 - protein, 9 aa, Homo Sapiens
DKQYGRITG

SEQ ID NO: 304681 - protein, 9 aa, Homo Sapiens
KLHIWDTAG

SEQ ID NO: 304682 - protein, 9 aa, Homo Sapiens
MAAFKEGVF

SEQ ID NO: 304683 - protein, 9 aa, Homo Sapiens
NRKVNYMCW

SEQ ID NO: 304684 - protein, 9 aa, Homo Sapiens
TIMAYDHYL

SEQ ID NO: 304685 - protein, 9 aa, Homo Sapiens
PQVSLSQPP

SEQ ID NO: 304686 - protein, 9 aa, Homo Sapiens
LPGKWILST

SEQ ID NO: 304687 - protein, 9 aa, Homo Sapiens
KKQKLEDHG

SEQ ID NO: 304688 - protein, 9 aa, Homo Sapiens
GGRCLIEKL

SEQ ID NO: 304689 - protein, 9 aa, Homo Sapiens
IPIILAGRY

SEQ ID NO: 304690 - protein, 9 aa, Homo Sapiens
CCTDKLYEE

SEQ ID NO: 304691 - protein, 9 aa, Homo Sapiens
RFIEDMINQ

SEQ ID NO: 304692 - protein, 9 aa, Homo Sapiens
CVCKLQWCI

SEQ ID NO: 304693 - protein, 9 aa, Homo Sapiens
ADIVHHCIK

SEQ ID NO: 304694 - protein, 9 aa, Homo Sapiens
VDSDSGFLA

SEQ ID NO: 304695 - protein, 9 aa, Homo Sapiens
ITDLTGAFR

SEQ ID NO: 304696 - protein, 9 aa, Homo Sapiens
SQINRDQLQ

SEQ ID NO: 304697 - protein, 9 aa, Homo Sapiens
MIQLHPDGT

SEQ ID NO: 304698 - protein, 9 aa, Homo Sapiens
TQAPYLQKR

SEQ ID NO: 304699 - protein, 9 aa, Homo Sapiens
EGSIILKSS

SEQ ID NO: 304700 - protein, 9 aa, Homo Sapiens
NEDVTLGSS

SEQ ID NO: 304701 - protein, 9 aa, Homo Sapiens
LIEYRKKLP

SEQ ID NO: 304702 - protein, 9 aa, Homo Sapiens
TALQSLVLA

SEQ ID NO: 304703 - protein, 9 aa, Homo Sapiens
IIVIKDTEN

SEQ ID NO: 304704 - protein, 9 aa, Homo Sapiens
FSKLTCPEI

SEQ ID NO: 304705 - protein, 9 aa, Homo Sapiens
MTLKLPTPT

SEQ ID NO: 304706 - protein, 9 aa, Homo Sapiens
PVCDRKYFV

SEQ ID NO: 304707 - protein, 9 aa, Homo Sapiens
VQVASVLRG

SEQ ID NO: 304708 - protein, 9 aa, Homo Sapiens
FRNSIALEI

SEQ ID NO: 304709 - protein, 9 aa, Homo Sapiens
QSLKLDYLE

SEQ ID NO: 304710 - protein, 9 aa, Homo Sapiens
AKMRQEHQN

SEQ ID NO: 304711 - protein, 9 aa, Homo Sapiens
QAIKTSILN

SEQ ID NO: 304712 - protein, 9 aa, Homo Sapiens
QTGREHAVV

SEQ ID NO: 304713 - protein, 9 aa, Homo Sapiens
KSIALQSGL

SEQ ID NO: 304714 - protein, 9 aa, Homo Sapiens
EGCIQGSQR

SEQ ID NO: 304715 - protein, 9 aa, Homo Sapiens
LAIDDDNKT

SEQ ID NO: 304716 - protein, 9 aa, Homo Sapiens
DVPKAKVLV

SEQ ID NO: 304717 - protein, 9 aa, Homo Sapiens
WLKGGQDIA

SEQ ID NO: 304718 - protein, 9 aa, Homo Sapiens
CHQKIHTVA

SEQ ID NO: 304719 - protein, 9 aa, Homo Sapiens
ECFQIELSN

SEQ ID NO: 304720 - protein, 9 aa, Homo Sapiens
LYRRDDMSS

SEQ ID NO: 304721 - protein, 9 aa, Homo Sapiens
PQPPHHQFF

SEQ ID NO: 304722 - protein, 9 aa, Homo Sapiens
RNTIDINNC

SEQ ID NO: 304723 - protein, 9 aa, Homo Sapiens
IFCIICALL

SEQ ID NO: 304724 - protein, 9 aa, Homo Sapiens
AHEVGHNCG

SEQ ID NO: 304725 - protein, 9 aa, Homo Sapiens
LRCSVCKEP

SEQ ID NO: 304726 - protein, 9 aa, Homo Sapiens
CTGSDNGTV

SEQ ID NO: 304727 - protein, 9 aa, Homo Sapiens
RIKRRALLL

SEQ ID NO: 304728 - protein, 9 aa, Homo Sapiens
INSKQVATM

SEQ ID NO: 304729 - protein, 9 aa, Homo Sapiens
EKKQGHQIP

SEQ ID NO: 304730 - protein, 9 aa, Homo Sapiens
GQNREVSIM

SEQ ID NO: 304731 - protein, 9 aa, Homo Sapiens
VQGNSSGVF

SEQ ID NO: 304732 - protein, 9 aa, Homo Sapiens
KYNVPILSA

SEQ ID NO: 304733 - protein, 9 aa, Homo Sapiens
KSGCEPPGD

SEQ ID NO: 304734 - protein, 9 aa, Homo Sapiens
FPSQSMDAA

SEQ ID NO: 304735 - protein, 9 aa, Homo Sapiens
EQEWTTLYG

SEQ ID NO: 304736 - protein, 9 aa, Homo Sapiens
VIDLSAAHA

SEQ ID NO: 304737 - protein, 9 aa, Homo Sapiens
HLLHHDGNI

SEQ ID NO: 304738 - protein, 9 aa, Homo Sapiens
WLSLGTQIA

SEQ ID NO: 304739 - protein, 9 aa, Homo Sapiens
ELIVTDNKG

SEQ ID NO: 304740 - protein, 9 aa, Homo Sapiens
GRKTPEGLF

SEQ ID NO: 304741 - protein, 9 aa, Homo Sapiens
ARIDYKVKT

SEQ ID NO: 304742 - protein, 9 aa, Homo Sapiens
VHLVGIIRE

SEQ ID NO: 304743 - protein, 9 aa, Homo Sapiens
GTVQVQWEI

SEQ ID NO: 304744 - protein, 9 aa, Homo Sapiens
ECGQAFVQK

SEQ ID NO: 304745 - protein, 9 aa, Homo Sapiens
APLNFIPRH

SEQ ID NO: 304746 - protein, 9 aa, Homo Sapiens
DHSRVGGKK

SEQ ID NO: 304747 - protein, 9 aa, Homo Sapiens
TPSTTSLAL

SEQ ID NO: 304748 - protein, 9 aa, Homo Sapiens
DKLVKAERK

SEQ ID NO: 304749 - protein, 9 aa, Homo Sapiens
NSMNNNESD

SEQ ID NO: 304750 - protein, 9 aa, Homo Sapiens
VEDVQLKNQ

SEQ ID NO: 304751 - protein, 9 aa, Homo Sapiens
HGPQVSLSQ

SEQ ID NO: 304752 - protein, 9 aa, Homo Sapiens
TFQRLFGAK

SEQ ID NO: 304753 - protein, 9 aa, Homo Sapiens
EYLPLYSSS

SEQ ID NO: 304754 - protein, 9 aa, Homo Sapiens
EAMALNTTK

SEQ ID NO: 304755 - protein, 9 aa, Homo Sapiens
KHAALRWQL

SEQ ID NO: 304756 - protein, 9 aa, Homo Sapiens
FRRIVHLVG

SEQ ID NO: 304757 - protein, 9 aa, Homo Sapiens
FPTSRHILE

SEQ ID NO: 304758 - protein, 9 aa, Homo Sapiens
LRVIAEKKL

SEQ ID NO: 304759 - protein, 9 aa, Homo Sapiens
LSLCLTAVF

SEQ ID NO: 304760 - protein, 9 aa, Homo Sapiens
LLRVYLAKK

SEQ ID NO: 304761 - protein, 9 aa, Homo Sapiens
YQFGGQEQV

SEQ ID NO: 304762 - protein, 9 aa, Homo Sapiens
SIQPQPLSS

SEQ ID NO: 304763 - protein, 9 aa, Homo Sapiens
TAEKLDNSP

SEQ ID NO: 304764 - protein, 9 aa, Homo Sapiens
QIDDNRTFS

SEQ ID NO: 304765 - protein, 9 aa, Homo Sapiens
DDSLTLSQS

SEQ ID NO: 304766 - protein, 9 aa, Homo Sapiens
GTILHFLQD

SEQ ID NO: 304767 - protein, 9 aa, Homo Sapiens
DHYLAICQS

SEQ ID NO: 304768 - protein, 9 aa, Homo Sapiens
FWICMTWFI

SEQ ID NO: 304769 - protein, 9 aa, Homo Sapiens
KDREKDKDK

SEQ ID NO: 304770 - protein, 9 aa, Homo Sapiens
ASLHLPSFY

SEQ ID NO: 304771 - protein, 9 aa, Homo Sapiens
STKYSYKYP

SEQ ID NO: 304772 - protein, 9 aa, Homo Sapiens
GFRVDRVYR

SEQ ID NO: 304773 - protein, 9 aa, Homo Sapiens
HTRYQPYKC

SEQ ID NO: 304774 - protein, 9 aa, Homo Sapiens
SKTVSIEEL

SEQ ID NO: 304775 - protein, 9 aa, Homo Sapiens
VLTKSVSLK

SEQ ID NO: 304776 - protein, 9 aa, Homo Sapiens
EVYVFLSVK

SEQ ID NO: 304777 - protein, 9 aa, Homo Sapiens
FTLKLLDRE

SEQ ID NO: 304778 - protein, 9 aa, Homo Sapiens
LSLISTFRF

SEQ ID NO: 304779 - protein, 9 aa, Homo Sapiens
SYKYPQLSV

SEQ ID NO: 304780 - protein, 9 aa, Homo Sapiens
GKTPAGRIV

SEQ ID NO: 304781 - protein, 9 aa, Homo Sapiens
FMKQMNDAQ

SEQ ID NO: 304782 - protein, 9 aa, Homo Sapiens
RAPGNDQFP

SEQ ID NO: 304783 - protein, 9 aa, Homo Sapiens
YGHNINDPR

SEQ ID NO: 304784 - protein, 9 aa, Homo Sapiens
FSGLCGTLF

SEQ ID NO: 304785 - protein, 9 aa, Homo Sapiens
YNVNTSVLS

SEQ ID NO: 304786 - protein, 9 aa, Homo Sapiens
FCITNIEFL

SEQ ID NO: 304787 - protein, 9 aa, Homo Sapiens
PHFSPAKLE

SEQ ID NO: 304788 - protein, 9 aa, Homo Sapiens
TCPEINESL

SEQ ID NO: 304789 - protein, 9 aa, Homo Sapiens
KNGMMDHED

SEQ ID NO: 304790 - protein, 9 aa, Homo Sapiens
NVCYDELFP

SEQ ID NO: 304791 - protein, 9 aa, Homo Sapiens
VRQSGHGPP

SEQ ID NO: 304792 - protein, 9 aa, Homo Sapiens
CNEILEWVN

SEQ ID NO: 304793 - protein, 9 aa, Homo Sapiens
MFCSRSIEV

SEQ ID NO: 304794 - protein, 9 aa, Homo Sapiens
DHHHDNHCG

SEQ ID NO: 304795 - protein, 9 aa, Homo Sapiens
HSRVGGKKS

SEQ ID NO: 304796 - protein, 9 aa, Homo Sapiens
RYASVECLL

SEQ ID NO: 304797 - protein, 9 aa, Homo Sapiens
KIIYKKIED

SEQ ID NO: 304798 - protein, 9 aa, Homo Sapiens
PFDHCSAGE

SEQ ID NO: 304799 - protein, 9 aa, Homo Sapiens
VLPEEAQEE

SEQ ID NO: 304800 - protein, 9 aa, Homo Sapiens
YFKLFTTGE

SEQ ID NO: 304801 - protein, 9 aa, Homo Sapiens
NHGIHNYQQ

SEQ ID NO: 304802 - protein, 9 aa, Homo Sapiens
CVLGWNGVS

SEQ ID NO: 304803 - protein, 9 aa, Homo Sapiens
ILIYETFYK

SEQ ID NO: 304804 - protein, 9 aa, Homo Sapiens
LKQNTFSPL

SEQ ID NO: 304805 - protein, 9 aa, Homo Sapiens
ENIRNNSAF

SEQ ID NO: 304806 - protein, 9 aa, Homo Sapiens
LHYTVIMSQ

SEQ ID NO: 304807 - protein, 9 aa, Homo Sapiens
QHSPKIISF

SEQ ID NO: 304808 - protein, 9 aa, Homo Sapiens
DNKTDKTKK

SEQ ID NO: 304809 - protein, 9 aa, Homo Sapiens
QKLLILRGF

SEQ ID NO: 304810 - protein, 9 aa, Homo Sapiens
VHYSDCLVI

SEQ ID NO: 304811 - protein, 9 aa, Homo Sapiens
EEKSVSETD

SEQ ID NO: 304812 - protein, 9 aa, Homo Sapiens
SDGALQELQ

SEQ ID NO: 304813 - protein, 9 aa, Homo Sapiens
EQVSTESET

SEQ ID NO: 304814 - protein, 9 aa, Homo Sapiens
SVEIMVPNY

SEQ ID NO: 304815 - protein, 9 aa, Homo Sapiens
GEQDPASAP

SEQ ID NO: 304816 - protein, 9 aa, Homo Sapiens
AFDSPSLCQ

SEQ ID NO: 304817 - protein, 9 aa, Homo Sapiens
TIEPSIYIP

SEQ ID NO: 304818 - protein, 9 aa, Homo Sapiens
DVRKFKETN

SEQ ID NO: 304819 - protein, 9 aa, Homo Sapiens
CTRKGTLKE

SEQ ID NO: 304820 - protein, 9 aa, Homo Sapiens
EGYCQKCLI

SEQ ID NO: 304821 - protein, 9 aa, Homo Sapiens
GRWDPGCLY

SEQ ID NO: 304822 - protein, 9 aa, Homo Sapiens
SLDEMATYD

SEQ ID NO: 304823 - protein, 9 aa, Homo Sapiens
NLLLDRIRK

SEQ ID NO: 304824 - protein, 9 aa, Homo Sapiens
PFQKPINLP

SEQ ID NO: 304825 - protein, 9 aa, Homo Sapiens
YWLQNLRYY

SEQ ID NO: 304826 - protein, 9 aa, Homo Sapiens
STLNKHKII

SEQ ID NO: 304827 - protein, 9 aa, Homo Sapiens
VRKLQNAVE

SEQ ID NO: 304828 - protein, 9 aa, Homo Sapiens
QNQVLINSL

SEQ ID NO: 304829 - protein, 9 aa, Homo Sapiens
FYEYDCQQI

SEQ ID NO: 304830 - protein, 9 aa, Homo Sapiens
DIILQLIKE

SEQ ID NO: 304831 - protein, 9 aa, Homo Sapiens
CFIIFHPNE

SEQ ID NO: 304832 - protein, 9 aa, Homo Sapiens
AGIMTRLST

SEQ ID NO: 304833 - protein, 9 aa, Homo Sapiens
SEDNLLEEP

SEQ ID NO: 304834 - protein, 9 aa, Homo Sapiens
TRYFFSNTF

SEQ ID NO: 304835 - protein, 9 aa, Homo Sapiens
VPHPKVSNF

SEQ ID NO: 304836 - protein, 9 aa, Homo Sapiens
LHPHCKIAL

SEQ ID NO: 304837 - protein, 9 aa, Homo Sapiens
RDALGALLQ

SEQ ID NO: 304838 - protein, 9 aa, Homo Sapiens
LFFSHHKIT

SEQ ID NO: 304839 - protein, 9 aa, Homo Sapiens
SGDQCELDC

SEQ ID NO: 304840 - protein, 9 aa, Homo Sapiens
ISDRVSLIS

SEQ ID NO: 304841 - protein, 9 aa, Homo Sapiens
IFGSSRVQY

SEQ ID NO: 304842 - protein, 9 aa, Homo Sapiens
DQMVKMTES

SEQ ID NO: 304843 - protein, 9 aa, Homo Sapiens
SLIRNKCGS

SEQ ID NO: 304844 - protein, 9 aa, Homo Sapiens
KDKNEYLPL

SEQ ID NO: 304845 - protein, 9 aa, Homo Sapiens
TPDKEMMLQ

SEQ ID NO: 304846 - protein, 9 aa, Homo Sapiens
SLAATPNLG

SEQ ID NO: 304847 - protein, 9 aa, Homo Sapiens
ASGRHMDRI

SEQ ID NO: 304848 - protein, 9 aa, Homo Sapiens
EILELCRGR

SEQ ID NO: 304849 - protein, 9 aa, Homo Sapiens
GYQIVYNNA

SEQ ID NO: 304850 - protein, 9 aa, Homo Sapiens
PNDALVYTF

SEQ ID NO: 304851 - protein, 9 aa, Homo Sapiens
KPTTIIKKN

SEQ ID NO: 304852 - protein, 9 aa, Homo Sapiens
IEIVATRVL

SEQ ID NO: 304853 - protein, 9 aa, Homo Sapiens
QIWFQHRRS

SEQ ID NO: 304854 - protein, 9 aa, Homo Sapiens
CFYLGELPL

SEQ ID NO: 304855 - protein, 9 aa, Homo Sapiens
IVLFSLAAS

SEQ ID NO: 304856 - protein, 9 aa, Homo Sapiens
TGITILRVK

SEQ ID NO: 304857 - protein, 9 aa, Homo Sapiens
DMAQDFLQC

SEQ ID NO: 304858 - protein, 9 aa, Homo Sapiens
NDIIVLAKS

SEQ ID NO: 304859 - protein, 9 aa, Homo Sapiens
RFPPKSYSK

SEQ ID NO: 304860 - protein, 9 aa, Homo Sapiens
TQHLSRKII

SEQ ID NO: 304861 - protein, 9 aa, Homo Sapiens
PKYTEKENL

SEQ ID NO: 304862 - protein, 9 aa, Homo Sapiens
RPHSSGCCS

SEQ ID NO: 304863 - protein, 9 aa, Homo Sapiens
TEHNCMRTN

SEQ ID NO: 304864 - protein, 9 aa, Homo Sapiens
CIECGQAFV

SEQ ID NO: 304865 - protein, 9 aa, Homo Sapiens
SVSFKQCSR

SEQ ID NO: 304866 - protein, 9 aa, Homo Sapiens
AEIIDEFIV

SEQ ID NO: 304867 - protein, 9 aa, Homo Sapiens
IPPEWLFNL

SEQ ID NO: 304868 - protein, 9 aa, Homo Sapiens
CGDLLTFLS

SEQ ID NO: 304869 - protein, 9 aa, Homo Sapiens
FVDIIDAVK

SEQ ID NO: 304870 - protein, 9 aa, Homo Sapiens
AVCNICKIS

SEQ ID NO: 304871 - protein, 9 aa, Homo Sapiens
KLAPKVPQQ

SEQ ID NO: 304872 - protein, 9 aa, Homo Sapiens
LREENTFCD

SEQ ID NO: 304873 - protein, 9 aa, Homo Sapiens
LLIPNASQA

SEQ ID NO: 304874 - protein, 9 aa, Homo Sapiens
QLCGTTSSP

SEQ ID NO: 304875 - protein, 9 aa, Homo Sapiens
HPHCKIALF

SEQ ID NO: 304876 - protein, 9 aa, Homo Sapiens
KVRSKNNNS

SEQ ID NO: 304877 - protein, 9 aa, Homo Sapiens
FSLDEMATY

SEQ ID NO: 304878 - protein, 9 aa, Homo Sapiens
SNVAILYND

SEQ ID NO: 304879 - protein, 9 aa, Homo Sapiens
ERHNALPTC

SEQ ID NO: 304880 - protein, 9 aa, Homo Sapiens
VHAQLCFHG

SEQ ID NO: 304881 - protein, 9 aa, Homo Sapiens
KNDLFLVVS

SEQ ID NO: 304882 - protein, 9 aa, Homo Sapiens
RKKQFWYLL

SEQ ID NO: 304883 - protein, 9 aa, Homo Sapiens
SKQVATMKA

SEQ ID NO: 304884 - protein, 9 aa, Homo Sapiens
LTGVDPDHF

SEQ ID NO: 304885 - protein, 9 aa, Homo Sapiens
FWCQQTSPS

SEQ ID NO: 304886 - protein, 9 aa, Homo Sapiens
GMQDKLARL

SEQ ID NO: 304887 - protein, 9 aa, Homo Sapiens
TRKVDTGGF

SEQ ID NO: 304888 - protein, 9 aa, Homo Sapiens
PLKTPLFSG

SEQ ID NO: 304889 - protein, 9 aa, Homo Sapiens
PCAEEAVAG

SEQ ID NO: 304890 - protein, 9 aa, Homo Sapiens
FKITGTGTP

SEQ ID NO: 304891 - protein, 9 aa, Homo Sapiens
VCKIALGCN

SEQ ID NO: 304892 - protein, 9 aa, Homo Sapiens
TSHPETLTL

SEQ ID NO: 304893 - protein, 9 aa, Homo Sapiens
KPYMETTKT

SEQ ID NO: 304894 - protein, 9 aa, Homo Sapiens
KDAHEKDDV

SEQ ID NO: 304895 - protein, 9 aa, Homo Sapiens
NNTVGSYQC

SEQ ID NO: 304896 - protein, 9 aa, Homo Sapiens
IFFSRASVW

SEQ ID NO: 304897 - protein, 9 aa, Homo Sapiens
FSNQRAKWR

SEQ ID NO: 304898 - protein, 9 aa, Homo Sapiens
EQRQDMPET

SEQ ID NO: 304899 - protein, 9 aa, Homo Sapiens
GADEEEEND

SEQ ID NO: 304900 - protein, 9 aa, Homo Sapiens
ALTKDDEQL

SEQ ID NO: 304901 - protein, 9 aa, Homo Sapiens
FCALLLVLI

SEQ ID NO: 304902 - protein, 9 aa, Homo Sapiens
LPGLGNLKL

SEQ ID NO: 304903 - protein, 9 aa, Homo Sapiens
YTEAEELFV

SEQ ID NO: 304904 - protein, 9 aa, Homo Sapiens
KKRRDNKTP

SEQ ID NO: 304905 - protein, 9 aa, Homo Sapiens
TSKDMLQTL

SEQ ID NO: 304906 - protein, 9 aa, Homo Sapiens
DCGNFFRYI

SEQ ID NO: 304907 - protein, 9 aa, Homo Sapiens
ISILESNSI

SEQ ID NO: 304908 - protein, 9 aa, Homo Sapiens
QPVRSFIQP

SEQ ID NO: 304909 - protein, 9 aa, Homo Sapiens
TSLGSQKGG

SEQ ID NO: 304910 - protein, 9 aa, Homo Sapiens
KIIPPGRSN

SEQ ID NO: 304911 - protein, 9 aa, Homo Sapiens
ASADGRKKT

SEQ ID NO: 304912 - protein, 9 aa, Homo Sapiens
TFSLIQDSI

SEQ ID NO: 304913 - protein, 9 aa, Homo Sapiens
YCEGRDLND

SEQ ID NO: 304914 - protein, 9 aa, Homo Sapiens
YDDLVECLL

SEQ ID NO: 304915 - protein, 9 aa, Homo Sapiens
VTAHKVAVS

SEQ ID NO: 304916 - protein, 9 aa, Homo Sapiens
KKPKLLNKL

SEQ ID NO: 304917 - protein, 9 aa, Homo Sapiens
ELMTHKLKH

SEQ ID NO: 304918 - protein, 9 aa, Homo Sapiens
QDMLFVFPK

SEQ ID NO: 304919 - protein, 9 aa, Homo Sapiens
EDYVFSDSA

SEQ ID NO: 304920 - protein, 9 aa, Homo Sapiens
FQEAMLLFK

SEQ ID NO: 304921 - protein, 9 aa, Homo Sapiens
MNSSPISKK

SEQ ID NO: 304922 - protein, 9 aa, Homo Sapiens
VEDNCEAVP

SEQ ID NO: 304923 - protein, 9 aa, Homo Sapiens
EDPNIKEIA

SEQ ID NO: 304924 - protein, 9 aa, Homo Sapiens
PMCMNYFID

SEQ ID NO: 304925 - protein, 9 aa, Homo Sapiens
DNLVVHIPK

SEQ ID NO: 304926 - protein, 9 aa, Homo Sapiens
PCPHMGQIL

SEQ ID NO: 304927 - protein, 9 aa, Homo Sapiens
HRAHYKTEG

SEQ ID NO: 304928 - protein, 9 aa, Homo Sapiens
LSAPLNFIP

SEQ ID NO: 304929 - protein, 9 aa, Homo Sapiens
YRGEKILMA

SEQ ID NO: 304930 - protein, 9 aa, Homo Sapiens
YHADRAIAF

SEQ ID NO: 304931 - protein, 9 aa, Homo Sapiens
QFEDNWYNT

SEQ ID NO: 304932 - protein, 9 aa, Homo Sapiens
DVLRNAFNT

SEQ ID NO: 304933 - protein, 9 aa, Homo Sapiens
NYLQKYHNT

SEQ ID NO: 304934 - protein, 9 aa, Homo Sapiens
SETDVQEEC

SEQ ID NO: 304935 - protein, 9 aa, Homo Sapiens
YLKALLRMK

SEQ ID NO: 304936 - protein, 9 aa, Homo Sapiens
SNHHTLLDK

SEQ ID NO: 304937 - protein, 9 aa, Homo Sapiens
LPILQQPTD

SEQ ID NO: 304938 - protein, 9 aa, Homo Sapiens
GSQLSEHQI

SEQ ID NO: 304939 - protein, 9 aa, Homo Sapiens
SSTSVLIQH

SEQ ID NO: 304940 - protein, 9 aa, Homo Sapiens
MRIYESYGI

SEQ ID NO: 304941 - protein, 9 aa, Homo Sapiens
RQEAERNKI

SEQ ID NO: 304942 - protein, 9 aa, Homo Sapiens
NACSKPIEP

SEQ ID NO: 304943 - protein, 9 aa, Homo Sapiens
DPRGPSSGY

SEQ ID NO: 304944 - protein, 9 aa, Homo Sapiens
PKDITAKEE

SEQ ID NO: 304945 - protein, 9 aa, Homo Sapiens
PQLMDCDKV

SEQ ID NO: 304946 - protein, 9 aa, Homo Sapiens
PPPPVIQNG

SEQ ID NO: 304947 - protein, 9 aa, Homo Sapiens
LLKEFLRAN

SEQ ID NO: 304948 - protein, 9 aa, Homo Sapiens
EPNPTSPAN

SEQ ID NO: 304949 - protein, 9 aa, Homo Sapiens
AQDLFDRYM

SEQ ID NO: 304950 - protein, 9 aa, Homo Sapiens
YLKGALNKV

SEQ ID NO: 304951 - protein, 9 aa, Homo Sapiens
FLFLTFILH

SEQ ID NO: 304952 - protein, 9 aa, Homo Sapiens
LNRRTSFPK

SEQ ID NO: 304953 - protein, 9 aa, Homo Sapiens
HAPVVPATC

SEQ ID NO: 304954 - protein, 9 aa, Homo Sapiens
TGHCFCRIT

SEQ ID NO: 304955 - protein, 9 aa, Homo Sapiens
IAGTLFFTD

SEQ ID NO: 304956 - protein, 9 aa, Homo Sapiens
NVNRTKEAE

SEQ ID NO: 304957 - protein, 9 aa, Homo Sapiens
VRRFSGLEM

SEQ ID NO: 304958 - protein, 9 aa, Homo Sapiens
ESKFPKGYY

SEQ ID NO: 304959 - protein, 9 aa, Homo Sapiens
LEAPDLYVQ

SEQ ID NO: 304960 - protein, 9 aa, Homo Sapiens
EQLRDLIRN

SEQ ID NO: 304961 - protein, 9 aa, Homo Sapiens
FNRSYHLIG

SEQ ID NO: 304962 - protein, 9 aa, Homo Sapiens
QKCLIEAQN

SEQ ID NO: 304963 - protein, 9 aa, Homo Sapiens
VPLLKKFLK

SEQ ID NO: 304964 - protein, 9 aa, Homo Sapiens
ALSRLFPSS

SEQ ID NO: 304965 - protein, 9 aa, Homo Sapiens
SSIKVHWTV

SEQ ID NO: 304966 - protein, 9 aa, Homo Sapiens
HYEFNDTGH

SEQ ID NO: 304967 - protein, 9 aa, Homo Sapiens
YYSMFEDDT

SEQ ID NO: 304968 - protein, 9 aa, Homo Sapiens
DERQYRCED

SEQ ID NO: 304969 - protein, 9 aa, Homo Sapiens
KILTMLTGH

SEQ ID NO: 304970 - protein, 9 aa, Homo Sapiens
CTAYGDLHY

SEQ ID NO: 304971 - protein, 9 aa, Homo Sapiens
NLNALDIYG

SEQ ID NO: 304972 - protein, 9 aa, Homo Sapiens
WIGDKEAIV

SEQ ID NO: 304973 - protein, 9 aa, Homo Sapiens
TEGILNQNH

SEQ ID NO: 304974 - protein, 9 aa, Homo Sapiens
TGRKMILET

SEQ ID NO: 304975 - protein, 9 aa, Homo Sapiens
ILQLNLRKF

SEQ ID NO: 304976 - protein, 9 aa, Homo Sapiens
ALYDICSMT

SEQ ID NO: 304977 - protein, 9 aa, Homo Sapiens
TETEVDHNM

SEQ ID NO: 304978 - protein, 9 aa, Homo Sapiens
LNKLDLVAI

SEQ ID NO: 304979 - protein, 9 aa, Homo Sapiens
GGRDRPFQK

SEQ ID NO: 304980 - protein, 9 aa, Homo Sapiens
ITRFVYHLS

SEQ ID NO: 304981 - protein, 9 aa, Homo Sapiens
EYKMILVVQ

SEQ ID NO: 304982 - protein, 9 aa, Homo Sapiens
CNDTRVFVQ

SEQ ID NO: 304983 - protein, 9 aa, Homo Sapiens
IDILIIGSK

SEQ ID NO: 304984 - protein, 9 aa, Homo Sapiens
IIQFISTLL

SEQ ID NO: 304985 - protein, 9 aa, Homo Sapiens
PQFYAAPMT

SEQ ID NO: 304986 - protein, 9 aa, Homo Sapiens
SSYLREQGQ

SEQ ID NO: 304987 - protein, 9 aa, Homo Sapiens
DQIIYHILI

SEQ ID NO: 304988 - protein, 9 aa, Homo Sapiens
YLPLEETGA

SEQ ID NO: 304989 - protein, 9 aa, Homo Sapiens
NNLCRNFML

SEQ ID NO: 304990 - protein, 9 aa, Homo Sapiens
EDFMLHKSI

SEQ ID NO: 304991 - protein, 9 aa, Homo Sapiens
ECGKLFRRG

SEQ ID NO: 304992 - protein, 9 aa, Homo Sapiens
VSIPKDTWY

SEQ ID NO: 304993 - protein, 9 aa, Homo Sapiens
DTTLDHLLH

SEQ ID NO: 304994 - protein, 9 aa, Homo Sapiens
SSKMKAPVL

SEQ ID NO: 304995 - protein, 9 aa, Homo Sapiens
YASYTFVSL

SEQ ID NO: 304996 - protein, 9 aa, Homo Sapiens
QWLRALLGC

SEQ ID NO: 304997 - protein, 9 aa, Homo Sapiens
EGYPLWPEL

SEQ ID NO: 304998 - protein, 9 aa, Homo Sapiens
CEVFSRYGP

SEQ ID NO: 304999 - protein, 9 aa, Homo Sapiens
LKDVVNNIT

SEQ ID NO: 305000 - protein, 9 aa, Homo Sapiens
LQNQIQQAF

SEQ ID NO: 305001 - protein, 9 aa, Homo Sapiens
PNYFSPQTD

SEQ ID NO: 305002 - protein, 9 aa, Homo Sapiens
MMVFGLGYV

SEQ ID NO: 305003 - protein, 9 aa, Homo Sapiens
TLSTASTNI

SEQ ID NO: 305004 - protein, 9 aa, Homo Sapiens
HQRFHTGNT

SEQ ID NO: 305005 - protein, 9 aa, Homo Sapiens
YFSYVKVQE

SEQ ID NO: 305006 - protein, 9 aa, Homo Sapiens
HLNYLGNLA

SEQ ID NO: 305007 - protein, 9 aa, Homo Sapiens
RSIVIRVTE

SEQ ID NO: 305008 - protein, 9 aa, Homo Sapiens
EVKIIIMEL

SEQ ID NO: 305009 - protein, 9 aa, Homo Sapiens
DAQHMNFLP

SEQ ID NO: 305010 - protein, 9 aa, Homo Sapiens
DRKYFVLNF

SEQ ID NO: 305011 - protein, 9 aa, Homo Sapiens
GETVNNSRS

SEQ ID NO: 305012 - protein, 9 aa, Homo Sapiens
PCTVARLLP

SEQ ID NO: 305013 - protein, 9 aa, Homo Sapiens
FIILGLFNH

SEQ ID NO: 305014 - protein, 9 aa, Homo Sapiens
QIEENYNAN

SEQ ID NO: 305015 - protein, 9 aa, Homo Sapiens
DLKRRMVLV

SEQ ID NO: 305016 - protein, 9 aa, Homo Sapiens
VRLLSERLL

SEQ ID NO: 305017 - protein, 9 aa, Homo Sapiens
ESLQQVWQQ

SEQ ID NO: 305018 - protein, 9 aa, Homo Sapiens
LHQRVNTGA

SEQ ID NO: 305019 - protein, 9 aa, Homo Sapiens
WVQQLILNL

SEQ ID NO: 305020 - protein, 9 aa, Homo Sapiens
EKPNKKKKA

SEQ ID NO: 305021 - protein, 9 aa, Homo Sapiens
EMPTDTFIE

SEQ ID NO: 305022 - protein, 9 aa, Homo Sapiens
SSNGHKSLG

SEQ ID NO: 305023 - protein, 9 aa, Homo Sapiens
RFEDKCYGE

SEQ ID NO: 305024 - protein, 9 aa, Homo Sapiens
MSPDILHIE

SEQ ID NO: 305025 - protein, 9 aa, Homo Sapiens
YVVQAYINR

SEQ ID NO: 305026 - protein, 9 aa, Homo Sapiens
RLWPWPATQ

SEQ ID NO: 305027 - protein, 9 aa, Homo Sapiens
FATVNIQLQ

SEQ ID NO: 305028 - protein, 9 aa, Homo Sapiens
GLKNIFYIV

SEQ ID NO: 305029 - protein, 9 aa, Homo Sapiens
EFGRETNNL

SEQ ID NO: 305030 - protein, 9 aa, Homo Sapiens
ASQNNLVRL

SEQ ID NO: 305031 - protein, 9 aa, Homo Sapiens
RTMAPESVL

SEQ ID NO: 305032 - protein, 9 aa, Homo Sapiens
PVHNSNSGP

SEQ ID NO: 305033 - protein, 9 aa, Homo Sapiens
FTYHDVTLK

SEQ ID NO: 305034 - protein, 9 aa, Homo Sapiens
NDVNLQDTS

SEQ ID NO: 305035 - protein, 9 aa, Homo Sapiens
KSSYLIIHQ

SEQ ID NO: 305036 - protein, 9 aa, Homo Sapiens
VCEELSPVL

SEQ ID NO: 305037 - protein, 9 aa, Homo Sapiens
LSKCLCGAA

SEQ ID NO: 305038 - protein, 9 aa, Homo Sapiens
ANQKSLRRT

SEQ ID NO: 305039 - protein, 9 aa, Homo Sapiens
RLSVFGEIE

SEQ ID NO: 305040 - protein, 9 aa, Homo Sapiens
WLCEQQHRR

SEQ ID NO: 305041 - protein, 9 aa, Homo Sapiens
SRKLRNLKT

SEQ ID NO: 305042 - protein, 9 aa, Homo Sapiens
CGKALFYSA

SEQ ID NO: 305043 - protein, 9 aa, Homo Sapiens
KTVLRRAKR

SEQ ID NO: 305044 - protein, 9 aa, Homo Sapiens
DMPRVFVFC

SEQ ID NO: 305045 - protein, 9 aa, Homo Sapiens
AGVTLECED

SEQ ID NO: 305046 - protein, 9 aa, Homo Sapiens
VRVKEDENV

SEQ ID NO: 305047 - protein, 9 aa, Homo Sapiens
EDLFYQRSL

SEQ ID NO: 305048 - protein, 9 aa, Homo Sapiens
KIVEGCTGA

SEQ ID NO: 305049 - protein, 9 aa, Homo Sapiens
ALSMITEIH

SEQ ID NO: 305050 - protein, 9 aa, Homo Sapiens
ILDNYLQAD

SEQ ID NO: 305051 - protein, 9 aa, Homo Sapiens
NGREYKCDV

SEQ ID NO: 305052 - protein, 9 aa, Homo Sapiens
RHLNMPKMS

SEQ ID NO: 305053 - protein, 9 aa, Homo Sapiens
SACLQPRAA

SEQ ID NO: 305054 - protein, 9 aa, Homo Sapiens
PDAPIIKKI

SEQ ID NO: 305055 - protein, 9 aa, Homo Sapiens
SLNKLQKLE

SEQ ID NO: 305056 - protein, 9 aa, Homo Sapiens
LLCKIFVML

SEQ ID NO: 305057 - protein, 9 aa, Homo Sapiens
DAVDVTFSR

SEQ ID NO: 305058 - protein, 9 aa, Homo Sapiens
SKDKTKPQR

SEQ ID NO: 305059 - protein, 9 aa, Homo Sapiens
YIIQTLSRV

SEQ ID NO: 305060 - protein, 9 aa, Homo Sapiens
HVKFRFDCG

SEQ ID NO: 305061 - protein, 9 aa, Homo Sapiens
FLSYTVQST

SEQ ID NO: 305062 - protein, 9 aa, Homo Sapiens
VKPDNLLVW

SEQ ID NO: 305063 - protein, 9 aa, Homo Sapiens
PGTMFGASQ

SEQ ID NO: 305064 - protein, 9 aa, Homo Sapiens
LENVCYSIP

SEQ ID NO: 305065 - protein, 9 aa, Homo Sapiens
MRFPPKSYS

SEQ ID NO: 305066 - protein, 9 aa, Homo Sapiens
LPPLLPYDP

SEQ ID NO: 305067 - protein, 9 aa, Homo Sapiens
ANIDTPKGG

SEQ ID NO: 305068 - protein, 9 aa, Homo Sapiens
DTPNALLWH

SEQ ID NO: 305069 - protein, 9 aa, Homo Sapiens
DRFLYVNRT

SEQ ID NO: 305070 - protein, 9 aa, Homo Sapiens
WTHILRERK

SEQ ID NO: 305071 - protein, 9 aa, Homo Sapiens
HSKNVTSGT

SEQ ID NO: 305072 - protein, 9 aa, Homo Sapiens
SLKKQLQQK

SEQ ID NO: 305073 - protein, 9 aa, Homo Sapiens
YAQLGFIVF

SEQ ID NO: 305074 - protein, 9 aa, Homo Sapiens
VDVFSLLVM

SEQ ID NO: 305075 - protein, 9 aa, Homo Sapiens
STSLADTYN

SEQ ID NO: 305076 - protein, 9 aa, Homo Sapiens
LFSPVSISM

SEQ ID NO: 305077 - protein, 9 aa, Homo Sapiens
GGRSCPGNA

SEQ ID NO: 305078 - protein, 9 aa, Homo Sapiens
VAVEKDYFQ

SEQ ID NO: 305079 - protein, 9 aa, Homo Sapiens
QPPSSLVIN

SEQ ID NO: 305080 - protein, 9 aa, Homo Sapiens
SQWVIYLQG

SEQ ID NO: 305081 - protein, 9 aa, Homo Sapiens
LLFKKSEQE

SEQ ID NO: 305082 - protein, 9 aa, Homo Sapiens
SKKIARRGS

SEQ ID NO: 305083 - protein, 9 aa, Homo Sapiens
MFYGYLMSM

SEQ ID NO: 305084 - protein, 9 aa, Homo Sapiens
DSKKVLYTA

SEQ ID NO: 305085 - protein, 9 aa, Homo Sapiens
CVKNPMVIP

SEQ ID NO: 305086 - protein, 9 aa, Homo Sapiens
KEQEWTTLY

SEQ ID NO: 305087 - protein, 9 aa, Homo Sapiens
GELICPMCM

SEQ ID NO: 305088 - protein, 9 aa, Homo Sapiens
GHSPEDICQ

SEQ ID NO: 305089 - protein, 9 aa, Homo Sapiens
FTFVETNVA

SEQ ID NO: 305090 - protein, 9 aa, Homo Sapiens
STLARISAQ

SEQ ID NO: 305091 - protein, 9 aa, Homo Sapiens
KSRSVDCRV

SEQ ID NO: 305092 - protein, 9 aa, Homo Sapiens
NSILEDTEE

SEQ ID NO: 305093 - protein, 9 aa, Homo Sapiens
KGDSSIQKQ

SEQ ID NO: 305094 - protein, 9 aa, Homo Sapiens
YNANTLVMI

SEQ ID NO: 305095 - protein, 9 aa, Homo Sapiens
LQKTMDSHI

SEQ ID NO: 305096 - protein, 9 aa, Homo Sapiens
MFWAGHRTP

SEQ ID NO: 305097 - protein, 9 aa, Homo Sapiens
KSATTLSRY

SEQ ID NO: 305098 - protein, 9 aa, Homo Sapiens
KHSRLLLLW

SEQ ID NO: 305099 - protein, 9 aa, Homo Sapiens
AILQIDNAR

SEQ ID NO: 305100 - protein, 9 aa, Homo Sapiens
EQQRHTAYI

SEQ ID NO: 305101 - protein, 9 aa, Homo Sapiens
DIGTDGEIS

SEQ ID NO: 305102 - protein, 9 aa, Homo Sapiens
GVLAPDKVD

SEQ ID NO: 305103 - protein, 9 aa, Homo Sapiens
KVEENISFS

SEQ ID NO: 305104 - protein, 9 aa, Homo Sapiens
TPLDDETVN

SEQ ID NO: 305105 - protein, 9 aa, Homo Sapiens
LERDPCPHM

SEQ ID NO: 305106 - protein, 9 aa, Homo Sapiens
AIKLFSAQT

SEQ ID NO: 305107 - protein, 9 aa, Homo Sapiens
KPNLYNNDF

SEQ ID NO: 305108 - protein, 9 aa, Homo Sapiens
FQRITIYLI

SEQ ID NO: 305109 - protein, 9 aa, Homo Sapiens
LLGRWCLSL

SEQ ID NO: 305110 - protein, 9 aa, Homo Sapiens
CTSQHLQNF

SEQ ID NO: 305111 - protein, 9 aa, Homo Sapiens
DYLVEKLVK

SEQ ID NO: 305112 - protein, 9 aa, Homo Sapiens
FSNKHSRLL

SEQ ID NO: 305113 - protein, 9 aa, Homo Sapiens
VTLSQPKIG

SEQ ID NO: 305114 - protein, 9 aa, Homo Sapiens
CDKIKANGG

SEQ ID NO: 305115 - protein, 9 aa, Homo Sapiens
VAQARFLHE

SEQ ID NO: 305116 - protein, 9 aa, Homo Sapiens
AFQNCMQES

SEQ ID NO: 305117 - protein, 9 aa, Homo Sapiens
EGRTKKGVL

SEQ ID NO: 305118 - protein, 9 aa, Homo Sapiens
MNISIPGEM

SEQ ID NO: 305119 - protein, 9 aa, Homo Sapiens
QTLAQAKKE

SEQ ID NO: 305120 - protein, 9 aa, Homo Sapiens
PKPKKNPFL

SEQ ID NO: 305121 - protein, 9 aa, Homo Sapiens
AATNRPNNI

SEQ ID NO: 305122 - protein, 9 aa, Homo Sapiens
MINEDGRVP

SEQ ID NO: 305123 - protein, 9 aa, Homo Sapiens
DFCLPFIRI

SEQ ID NO: 305124 - protein, 9 aa, Homo Sapiens
GRVNACLNK

SEQ ID NO: 305125 - protein, 9 aa, Homo Sapiens
DIWYTTATI

SEQ ID NO: 305126 - protein, 9 aa, Homo Sapiens
YKSQGELDK

SEQ ID NO: 305127 - protein, 9 aa, Homo Sapiens
NVMGFNTDH

SEQ ID NO: 305128 - protein, 9 aa, Homo Sapiens
FSTDLSNPS

SEQ ID NO: 305129 - protein, 9 aa, Homo Sapiens
ITGTGTPVK

SEQ ID NO: 305130 - protein, 9 aa, Homo Sapiens
LEAMKNTQK

SEQ ID NO: 305131 - protein, 9 aa, Homo Sapiens
RKVLANCKE

SEQ ID NO: 305132 - protein, 9 aa, Homo Sapiens
KSRALSTSS

SEQ ID NO: 305133 - protein, 9 aa, Homo Sapiens
VASVLRGLV

SEQ ID NO: 305134 - protein, 9 aa, Homo Sapiens
MLTVVKKRD

SEQ ID NO: 305135 - protein, 9 aa, Homo Sapiens
SGEAMALNT

SEQ ID NO: 305136 - protein, 9 aa, Homo Sapiens
YSYKYPQLS

SEQ ID NO: 305137 - protein, 9 aa, Homo Sapiens
HFFKGLNVA

SEQ ID NO: 305138 - protein, 9 aa, Homo Sapiens
KLPNKEMLE

SEQ ID NO: 305139 - protein, 9 aa, Homo Sapiens
VFELIPQDL

SEQ ID NO: 305140 - protein, 9 aa, Homo Sapiens
TARPKGLPR

SEQ ID NO: 305141 - protein, 9 aa, Homo Sapiens
QEAPHPQRI

SEQ ID NO: 305142 - protein, 9 aa, Homo Sapiens
LLIPSVENF

SEQ ID NO: 305143 - protein, 9 aa, Homo Sapiens
CPNVCYDEL

SEQ ID NO: 305144 - protein, 9 aa, Homo Sapiens
SVCNQIVSH

SEQ ID NO: 305145 - protein, 9 aa, Homo Sapiens
VDQIRGNMA

SEQ ID NO: 305146 - protein, 9 aa, Homo Sapiens
DTPVASRQE

SEQ ID NO: 305147 - protein, 9 aa, Homo Sapiens
LLDGVEQIN

SEQ ID NO: 305148 - protein, 9 aa, Homo Sapiens
AKEEAARIC

SEQ ID NO: 305149 - protein, 9 aa, Homo Sapiens
LKGGQDIAP

SEQ ID NO: 305150 - protein, 9 aa, Homo Sapiens
PCLSLWRQQ

SEQ ID NO: 305151 - protein, 9 aa, Homo Sapiens
VLESRGSGP

SEQ ID NO: 305152 - protein, 9 aa, Homo Sapiens
FEEFGFFYL

SEQ ID NO: 305153 - protein, 9 aa, Homo Sapiens
VRTLMISTT

SEQ ID NO: 305154 - protein, 9 aa, Homo Sapiens
HKGNKIRFA

SEQ ID NO: 305155 - protein, 9 aa, Homo Sapiens
TYTNFDNFG

SEQ ID NO: 305156 - protein, 9 aa, Homo Sapiens
NGFSVVQSY

SEQ ID NO: 305157 - protein, 9 aa, Homo Sapiens
ARPKGLPRD

SEQ ID NO: 305158 - protein, 9 aa, Homo Sapiens
SAWANRVRY

SEQ ID NO: 305159 - protein, 9 aa, Homo Sapiens
STNKLLDNI

SEQ ID NO: 305160 - protein, 9 aa, Homo Sapiens
PPGFKQLSC

SEQ ID NO: 305161 - protein, 9 aa, Homo Sapiens
TSRPYKCSE

SEQ ID NO: 305162 - protein, 9 aa, Homo Sapiens
SPNSTAEAF

SEQ ID NO: 305163 - protein, 9 aa, Homo Sapiens
GPYGLQVNY

SEQ ID NO: 305164 - protein, 9 aa, Homo Sapiens
LTHNIAKLM

SEQ ID NO: 305165 - protein, 9 aa, Homo Sapiens
ATYQPSFTA

SEQ ID NO: 305166 - protein, 9 aa, Homo Sapiens
RHLSSVSTE

SEQ ID NO: 305167 - protein, 9 aa, Homo Sapiens
REKRKLQPN

SEQ ID NO: 305168 - protein, 9 aa, Homo Sapiens
ASYGRNDRD

SEQ ID NO: 305169 - protein, 9 aa, Homo Sapiens
AQEDPLPVP

SEQ ID NO: 305170 - protein, 9 aa, Homo Sapiens
PPPPPLYGD

SEQ ID NO: 305171 - protein, 9 aa, Homo Sapiens
FLVFPFTGV

SEQ ID NO: 305172 - protein, 9 aa, Homo Sapiens
KHRKLQKKH

SEQ ID NO: 305173 - protein, 9 aa, Homo Sapiens
EQNITPQFF

SEQ ID NO: 305174 - protein, 9 aa, Homo Sapiens
ERRLDSGNK

SEQ ID NO: 305175 - protein, 9 aa, Homo Sapiens
QITGSLKIL

SEQ ID NO: 305176 - protein, 9 aa, Homo Sapiens
AQQLLNQIQ

SEQ ID NO: 305177 - protein, 9 aa, Homo Sapiens
SAGYKVIHI

SEQ ID NO: 305178 - protein, 9 aa, Homo Sapiens
YSGESLLQS

SEQ ID NO: 305179 - protein, 9 aa, Homo Sapiens
QTGETNILS

SEQ ID NO: 305180 - protein, 9 aa, Homo Sapiens
EVRHWKSHK

SEQ ID NO: 305181 - protein, 9 aa, Homo Sapiens
DMCKIRCLC

SEQ ID NO: 305182 - protein, 9 aa, Homo Sapiens
HVDSSSGRD

SEQ ID NO: 305183 - protein, 9 aa, Homo Sapiens
SFLGFYFFF

SEQ ID NO: 305184 - protein, 9 aa, Homo Sapiens
CHILSGTSC

SEQ ID NO: 305185 - protein, 9 aa, Homo Sapiens
SDPTSPLIT

SEQ ID NO: 305186 - protein, 9 aa, Homo Sapiens
VAGLCYHYC

SEQ ID NO: 305187 - protein, 9 aa, Homo Sapiens
YFILGDHFR

SEQ ID NO: 305188 - protein, 9 aa, Homo Sapiens
GLILGGKDL

SEQ ID NO: 305189 - protein, 9 aa, Homo Sapiens
NPLLGMYMF

SEQ ID NO: 305190 - protein, 9 aa, Homo Sapiens
VCTSVQKLF

SEQ ID NO: 305191 - protein, 9 aa, Homo Sapiens
TEVLLNARC

SEQ ID NO: 305192 - protein, 9 aa, Homo Sapiens
QQKSIALQS

SEQ ID NO: 305193 - protein, 9 aa, Homo Sapiens
GEHIRCQQE

SEQ ID NO: 305194 - protein, 9 aa, Homo Sapiens
SHIHYWVLQ

SEQ ID NO: 305195 - protein, 9 aa, Homo Sapiens
GKFKQFCLL

SEQ ID NO: 305196 - protein, 9 aa, Homo Sapiens
PDIASPTFQ

SEQ ID NO: 305197 - protein, 9 aa, Homo Sapiens
LTIDTAKLC

SEQ ID NO: 305198 - protein, 9 aa, Homo Sapiens
MSANKINYF

SEQ ID NO: 305199 - protein, 9 aa, Homo Sapiens
AFKKIKPPS

SEQ ID NO: 305200 - protein, 9 aa, Homo Sapiens
QVSLSQPPE

SEQ ID NO: 305201 - protein, 9 aa, Homo Sapiens
YKKICSNVY

SEQ ID NO: 305202 - protein, 9 aa, Homo Sapiens
SWPSTAINR

SEQ ID NO: 305203 - protein, 9 aa, Homo Sapiens
LNEYKALTK

SEQ ID NO: 305204 - protein, 9 aa, Homo Sapiens
LLEELSEYI

SEQ ID NO: 305205 - protein, 9 aa, Homo Sapiens
SYFAFGLFG

SEQ ID NO: 305206 - protein, 9 aa, Homo Sapiens
STLLTVKVS

SEQ ID NO: 305207 - protein, 9 aa, Homo Sapiens
KIARRGSSS

SEQ ID NO: 305208 - protein, 9 aa, Homo Sapiens
GCNLPRWHM

SEQ ID NO: 305209 - protein, 9 aa, Homo Sapiens
GPDYAKEIM

SEQ ID NO: 305210 - protein, 9 aa, Homo Sapiens
YRPHSPPEI

SEQ ID NO: 305211 - protein, 9 aa, Homo Sapiens
HVHFEDNDN

SEQ ID NO: 305212 - protein, 9 aa, Homo Sapiens
AEEKDKLVK

SEQ ID NO: 305213 - protein, 9 aa, Homo Sapiens
ATPTTAGSS

SEQ ID NO: 305214 - protein, 9 aa, Homo Sapiens
NKKQPCVCS

SEQ ID NO: 305215 - protein, 9 aa, Homo Sapiens
WKNNKSRNA

SEQ ID NO: 305216 - protein, 9 aa, Homo Sapiens
LIDQQQQKS

SEQ ID NO: 305217 - protein, 9 aa, Homo Sapiens
YKNSSILDL

SEQ ID NO: 305218 - protein, 9 aa, Homo Sapiens
CLLERLTDL

SEQ ID NO: 305219 - protein, 9 aa, Homo Sapiens
LELLNEFEG

SEQ ID NO: 305220 - protein, 9 aa, Homo Sapiens
RVQIWFQHR

SEQ ID NO: 305221 - protein, 9 aa, Homo Sapiens
EATSPPTIP

SEQ ID NO: 305222 - protein, 9 aa, Homo Sapiens
QEKEAEKNY

SEQ ID NO: 305223 - protein, 9 aa, Homo Sapiens
LLRHYWNPW

SEQ ID NO: 305224 - protein, 9 aa, Homo Sapiens
LDEMATYDL

SEQ ID NO: 305225 - protein, 9 aa, Homo Sapiens
YFIVKDSPK

SEQ ID NO: 305226 - protein, 9 aa, Homo Sapiens
FNGNPMHVA

SEQ ID NO: 305227 - protein, 9 aa, Homo Sapiens
RPGDCFLLL

SEQ ID NO: 305228 - protein, 9 aa, Homo Sapiens
KINTFARNT

SEQ ID NO: 305229 - protein, 9 aa, Homo Sapiens
GKDGIPGVQ

SEQ ID NO: 305230 - protein, 9 aa, Homo Sapiens
ANYIKQRKP

SEQ ID NO: 305231 - protein, 9 aa, Homo Sapiens
YFSLDHMNI

SEQ ID NO: 305232 - protein, 9 aa, Homo Sapiens
VAQQLLNQI

SEQ ID NO: 305233 - protein, 9 aa, Homo Sapiens
IGNRYIKIF

SEQ ID NO: 305234 - protein, 9 aa, Homo Sapiens
TDKMKVNWC

SEQ ID NO: 305235 - protein, 9 aa, Homo Sapiens
LCMQSRRPR

SEQ ID NO: 305236 - protein, 9 aa, Homo Sapiens
DPKEGLKYV

SEQ ID NO: 305237 - protein, 9 aa, Homo Sapiens
LKSGQGQGQ

SEQ ID NO: 305238 - protein, 9 aa, Homo Sapiens
LGLDNGNIA

SEQ ID NO: 305239 - protein, 9 aa, Homo Sapiens
GNLQKTMDS

SEQ ID NO: 305240 - protein, 9 aa, Homo Sapiens
QDMAQLIHL

SEQ ID NO: 305241 - protein, 9 aa, Homo Sapiens
WEDGAMCRD

SEQ ID NO: 305242 - protein, 9 aa, Homo Sapiens
VGGLICRTC

SEQ ID NO: 305243 - protein, 9 aa, Homo Sapiens
KFDISWIMS

SEQ ID NO: 305244 - protein, 9 aa, Homo Sapiens
STKVRNYVL

SEQ ID NO: 305245 - protein, 9 aa, Homo Sapiens
SLLEKLLIP

SEQ ID NO: 305246 - protein, 9 aa, Homo Sapiens
SRVSLRRMH

SEQ ID NO: 305247 - protein, 9 aa, Homo Sapiens
LLSCLLVCI

SEQ ID NO: 305248 - protein, 9 aa, Homo Sapiens
NKQIGLLLN

SEQ ID NO: 305249 - protein, 9 aa, Homo Sapiens
EHLIQHQII

SEQ ID NO: 305250 - protein, 9 aa, Homo Sapiens
DCVFNTLNK

SEQ ID NO: 305251 - protein, 9 aa, Homo Sapiens
LHCLLQPHW

SEQ ID NO: 305252 - protein, 9 aa, Homo Sapiens
ALLLLSYIL

SEQ ID NO: 305253 - protein, 9 aa, Homo Sapiens
EDVSPFNIE

SEQ ID NO: 305254 - protein, 9 aa, Homo Sapiens
RVPSVTLVD

SEQ ID NO: 305255 - protein, 9 aa, Homo Sapiens
RKVLQGKFN

SEQ ID NO: 305256 - protein, 9 aa, Homo Sapiens
EHNPDTLLV

SEQ ID NO: 305257 - protein, 9 aa, Homo Sapiens
QSNTFTRYF

SEQ ID NO: 305258 - protein, 9 aa, Homo Sapiens
KYKWYLKGL

SEQ ID NO: 305259 - protein, 9 aa, Homo Sapiens
TSSHHSKHL

SEQ ID NO: 305260 - protein, 9 aa, Homo Sapiens
SSSDEGYLE

SEQ ID NO: 305261 - protein, 9 aa, Homo Sapiens
VVKFNPQIF

SEQ ID NO: 305262 - protein, 9 aa, Homo Sapiens
GPHTPSPPP

SEQ ID NO: 305263 - protein, 9 aa, Homo Sapiens
GHNINDPRK

SEQ ID NO: 305264 - protein, 9 aa, Homo Sapiens
EALQDKINN

SEQ ID NO: 305265 - protein, 9 aa, Homo Sapiens
AMINVYPPR

SEQ ID NO: 305266 - protein, 9 aa, Homo Sapiens
PRKEITGWD

SEQ ID NO: 305267 - protein, 9 aa, Homo Sapiens
MDSAFTGKT

SEQ ID NO: 305268 - protein, 9 aa, Homo Sapiens
CCPVCPDKQ

SEQ ID NO: 305269 - protein, 9 aa, Homo Sapiens
VGNLLISML

SEQ ID NO: 305270 - protein, 9 aa, Homo Sapiens
SQVADIVFQ

SEQ ID NO: 305271 - protein, 9 aa, Homo Sapiens
ASISCVQGI

SEQ ID NO: 305272 - protein, 9 aa, Homo Sapiens
PYKCSECEI

SEQ ID NO: 305273 - protein, 9 aa, Homo Sapiens
YLQDNIGNG

SEQ ID NO: 305274 - protein, 9 aa, Homo Sapiens
SHPETLTLV

SEQ ID NO: 305275 - protein, 9 aa, Homo Sapiens
SHPETLTLQ

SEQ ID NO: 305276 - protein, 9 aa, Homo Sapiens
CKLGYNVNT

SEQ ID NO: 305277 - protein, 9 aa, Homo Sapiens
PVPTDVTAW

SEQ ID NO: 305278 - protein, 9 aa, Homo Sapiens
KFVQIENAA

SEQ ID NO: 305279 - protein, 9 aa, Homo Sapiens
LTNHKEINT

SEQ ID NO: 305280 - protein, 9 aa, Homo Sapiens
QCWMTDTPN

SEQ ID NO: 305281 - protein, 9 aa, Homo Sapiens
KGIKARWSV

SEQ ID NO: 305282 - protein, 9 aa, Homo Sapiens
TRYQPYKCD

SEQ ID NO: 305283 - protein, 9 aa, Homo Sapiens
AIKRVGYCS

SEQ ID NO: 305284 - protein, 9 aa, Homo Sapiens
KKLIKALFE

SEQ ID NO: 305285 - protein, 9 aa, Homo Sapiens
GPEIQVMQI

SEQ ID NO: 305286 - protein, 9 aa, Homo Sapiens
QTHYGYINV

SEQ ID NO: 305287 - protein, 9 aa, Homo Sapiens
CTELGIHTV

SEQ ID NO: 305288 - protein, 9 aa, Homo Sapiens
IGKPGYLNQ

SEQ ID NO: 305289 - protein, 9 aa, Homo Sapiens
LIQLSNEFH

SEQ ID NO: 305290 - protein, 9 aa, Homo Sapiens
EELSEYIHA

SEQ ID NO: 305291 - protein, 9 aa, Homo Sapiens
PWTRKGRTL

SEQ ID NO: 305292 - protein, 9 aa, Homo Sapiens
KLFFFLQRE

SEQ ID NO: 305293 - protein, 9 aa, Homo Sapiens
WGEHFELFS

SEQ ID NO: 305294 - protein, 9 aa, Homo Sapiens
LSQWRVFAG

SEQ ID NO: 305295 - protein, 9 aa, Homo Sapiens
VKLGIINRE

SEQ ID NO: 305296 - protein, 9 aa, Homo Sapiens
AINRAAPWG

SEQ ID NO: 305297 - protein, 9 aa, Homo Sapiens
RQNGYRALM

SEQ ID NO: 305298 - protein, 9 aa, Homo Sapiens
EAPHPQRIT

SEQ ID NO: 305299 - protein, 9 aa, Homo Sapiens
SMEIRPWTR

SEQ ID NO: 305300 - protein, 9 aa, Homo Sapiens
IEFKELIYL

SEQ ID NO: 305301 - protein, 9 aa, Homo Sapiens
LIVVFFVFV

SEQ ID NO: 305302 - protein, 9 aa, Homo Sapiens
PDKQDVRDL

SEQ ID NO: 305303 - protein, 9 aa, Homo Sapiens
KDKTNLSAQ

SEQ ID NO: 305304 - protein, 9 aa, Homo Sapiens
LVMQQQRQQ

SEQ ID NO: 305305 - protein, 9 aa, Homo Sapiens
KQGHQIPAL

SEQ ID NO: 305306 - protein, 9 aa, Homo Sapiens
QLKGCRSVD

SEQ ID NO: 305307 - protein, 9 aa, Homo Sapiens
KIGKWDRDM

SEQ ID NO: 305308 - protein, 9 aa, Homo Sapiens
SNSPNSTAE

SEQ ID NO: 305309 - protein, 9 aa, Homo Sapiens
AKDYLLGIY

SEQ ID NO: 305310 - protein, 9 aa, Homo Sapiens
VKVKYINDN

SEQ ID NO: 305311 - protein, 9 aa, Homo Sapiens
SEIQWEKNI

SEQ ID NO: 305312 - protein, 9 aa, Homo Sapiens
SAEKPQSSS

SEQ ID NO: 305313 - protein, 9 aa, Homo Sapiens
GPNGINTMS

SEQ ID NO: 305314 - protein, 9 aa, Homo Sapiens
TKQKKDQNR

SEQ ID NO: 305315 - protein, 9 aa, Homo Sapiens
SILERHRIS

SEQ ID NO: 305316 - protein, 9 aa, Homo Sapiens
MEHVRGMQD

SEQ ID NO: 305317 - protein, 9 aa, Homo Sapiens
MVITIEPSI

SEQ ID NO: 305318 - protein, 9 aa, Homo Sapiens
QYQDNINNL

SEQ ID NO: 305319 - protein, 9 aa, Homo Sapiens
LFGGNCAHQ

SEQ ID NO: 305320 - protein, 9 aa, Homo Sapiens
HHPDKSQSL

SEQ ID NO: 305321 - protein, 9 aa, Homo Sapiens
DNIFLPLFK

SEQ ID NO: 305322 - protein, 9 aa, Homo Sapiens
KDTLQRTGQ

SEQ ID NO: 305323 - protein, 9 aa, Homo Sapiens
ANKLVILEL

SEQ ID NO: 305324 - protein, 9 aa, Homo Sapiens
GIFSYRGEK

SEQ ID NO: 305325 - protein, 9 aa, Homo Sapiens
SYRGEKILM

SEQ ID NO: 305326 - protein, 9 aa, Homo Sapiens
LDKTLPNSQ

SEQ ID NO: 305327 - protein, 9 aa, Homo Sapiens
DYDTHNILE

SEQ ID NO: 305328 - protein, 9 aa, Homo Sapiens
ENNCHTAST

SEQ ID NO: 305329 - protein, 9 aa, Homo Sapiens
IMNIHTCNF

SEQ ID NO: 305330 - protein, 9 aa, Homo Sapiens
RGSRESASS

SEQ ID NO: 305331 - protein, 9 aa, Homo Sapiens
KIIHLIKWP

SEQ ID NO: 305332 - protein, 9 aa, Homo Sapiens
GEAMALNTT

SEQ ID NO: 305333 - protein, 9 aa, Homo Sapiens
FQNCMQESM

SEQ ID NO: 305334 - protein, 9 aa, Homo Sapiens
GFGEHFIAS

SEQ ID NO: 305335 - protein, 9 aa, Homo Sapiens
GPSQNVPRE

SEQ ID NO: 305336 - protein, 9 aa, Homo Sapiens
KKIQRKLSK

SEQ ID NO: 305337 - protein, 9 aa, Homo Sapiens
YIINNVFQA

SEQ ID NO: 305338 - protein, 9 aa, Homo Sapiens
REIGAQPLC

SEQ ID NO: 305339 - protein, 9 aa, Homo Sapiens
KGKVWVEKE

SEQ ID NO: 305340 - protein, 9 aa, Homo Sapiens
KQSSFCSEA

SEQ ID NO: 305341 - protein, 9 aa, Homo Sapiens
LMKGKGQET

SEQ ID NO: 305342 - protein, 9 aa, Homo Sapiens
FSDIFFVSI

SEQ ID NO: 305343 - protein, 9 aa, Homo Sapiens
ALLVLGLLF

SEQ ID NO: 305344 - protein, 9 aa, Homo Sapiens
TKKNHKMMN

SEQ ID NO: 305345 - protein, 9 aa, Homo Sapiens
KHILQNTAP

SEQ ID NO: 305346 - protein, 9 aa, Homo Sapiens
WVKKITDLT

SEQ ID NO: 305347 - protein, 9 aa, Homo Sapiens
TGKKPLSCP

SEQ ID NO: 305348 - protein, 9 aa, Homo Sapiens
SKPIEPCLS

SEQ ID NO: 305349 - protein, 9 aa, Homo Sapiens
ENCLANTVD

SEQ ID NO: 305350 - protein, 9 aa, Homo Sapiens
VYAVSKAGP

SEQ ID NO: 305351 - protein, 9 aa, Homo Sapiens
RTLHYLAKS

SEQ ID NO: 305352 - protein, 9 aa, Homo Sapiens
DCEKTAVKF

SEQ ID NO: 305353 - protein, 9 aa, Homo Sapiens
ICPWFTPQS

SEQ ID NO: 305354 - protein, 9 aa, Homo Sapiens
RSLNFGIMP

SEQ ID NO: 305355 - protein, 9 aa, Homo Sapiens
PYTELQKQP

SEQ ID NO: 305356 - protein, 9 aa, Homo Sapiens
QNSPKLTPN

SEQ ID NO: 305357 - protein, 9 aa, Homo Sapiens
FNLFSTKSS

SEQ ID NO: 305358 - protein, 9 aa, Homo Sapiens
HCHCHQQSL

SEQ ID NO: 305359 - protein, 9 aa, Homo Sapiens
KKRSVWNSE

SEQ ID NO: 305360 - protein, 9 aa, Homo Sapiens
KSKLVRHQI

SEQ ID NO: 305361 - protein, 9 aa, Homo Sapiens
GLMTWAAKI

SEQ ID NO: 305362 - protein, 9 aa, Homo Sapiens
EKDKLVKAE

SEQ ID NO: 305363 - protein, 9 aa, Homo Sapiens
VQNALKSAN

SEQ ID NO: 305364 - protein, 9 aa, Homo Sapiens
VIVHKQLYL

SEQ ID NO: 305365 - protein, 9 aa, Homo Sapiens
LVKLTVTIS

SEQ ID NO: 305366 - protein, 9 aa, Homo Sapiens
IDIKSKFAL

SEQ ID NO: 305367 - protein, 9 aa, Homo Sapiens
LQVLRDMKA

SEQ ID NO: 305368 - protein, 9 aa, Homo Sapiens
ENCWDPEVC

SEQ ID NO: 305369 - protein, 9 aa, Homo Sapiens
QSKGKKQNP

SEQ ID NO: 305370 - protein, 9 aa, Homo Sapiens
DKLPINGET

SEQ ID NO: 305371 - protein, 9 aa, Homo Sapiens
MNGIEINGN

SEQ ID NO: 305372 - protein, 9 aa, Homo Sapiens
RVKQGPNIY

SEQ ID NO: 305373 - protein, 9 aa, Homo Sapiens
TEAPLQVAQ

SEQ ID NO: 305374 - protein, 9 aa, Homo Sapiens
LHLQKNQLW

SEQ ID NO: 305375 - protein, 9 aa, Homo Sapiens
KGYDKTPDL

SEQ ID NO: 305376 - protein, 9 aa, Homo Sapiens
CKVKTIVMI

SEQ ID NO: 305377 - protein, 9 aa, Homo Sapiens
LNLRKFNLV

SEQ ID NO: 305378 - protein, 9 aa, Homo Sapiens
MGVHPSLAP

SEQ ID NO: 305379 - protein, 9 aa, Homo Sapiens
QDDCMLLKE

SEQ ID NO: 305380 - protein, 9 aa, Homo Sapiens
SGSHNHEAS

SEQ ID NO: 305381 - protein, 9 aa, Homo Sapiens
QQDQAIKTS

SEQ ID NO: 305382 - protein, 9 aa, Homo Sapiens
CKGCYANNF

SEQ ID NO: 305383 - protein, 9 aa, Homo Sapiens
IDMPDDNKI

SEQ ID NO: 305384 - protein, 9 aa, Homo Sapiens
GLVARIDYK

SEQ ID NO: 305385 - protein, 9 aa, Homo Sapiens
RMEKELQAQ

SEQ ID NO: 305386 - protein, 9 aa, Homo Sapiens
LKRLMLHRI

SEQ ID NO: 305387 - protein, 9 aa, Homo Sapiens
KKQGHQIPA

SEQ ID NO: 305388 - protein, 9 aa, Homo Sapiens
CNSPNVTID

SEQ ID NO: 305389 - protein, 9 aa, Homo Sapiens
KFPFAKCFV

SEQ ID NO: 305390 - protein, 9 aa, Homo Sapiens
YSTSLADTY

SEQ ID NO: 305391 - protein, 9 aa, Homo Sapiens
VELCSSDSP

SEQ ID NO: 305392 - protein, 9 aa, Homo Sapiens
AFTTFLSLT

SEQ ID NO: 305393 - protein, 9 aa, Homo Sapiens
SVLSDYNSA

SEQ ID NO: 305394 - protein, 9 aa, Homo Sapiens
MTFLKKILA

SEQ ID NO: 305395 - protein, 9 aa, Homo Sapiens
GNLLISMLL

SEQ ID NO: 305396 - protein, 9 aa, Homo Sapiens
LIKKIQDVK

SEQ ID NO: 305397 - protein, 9 aa, Homo Sapiens
LVRHFCILY

SEQ ID NO: 305398 - protein, 9 aa, Homo Sapiens
YQPSFTAAV

SEQ ID NO: 305399 - protein, 9 aa, Homo Sapiens
DLPSPIYLE

SEQ ID NO: 305400 - protein, 9 aa, Homo Sapiens
KLCDNKWMV

SEQ ID NO: 305401 - protein, 9 aa, Homo Sapiens
PDLILQVPV

SEQ ID NO: 305402 - protein, 9 aa, Homo Sapiens
KITWILKDS

SEQ ID NO: 305403 - protein, 9 aa, Homo Sapiens
SDFLGLGNF

SEQ ID NO: 305404 - protein, 9 aa, Homo Sapiens
SQSILFSPV

SEQ ID NO: 305405 - protein, 9 aa, Homo Sapiens
SKFPKGYYT

SEQ ID NO: 305406 - protein, 9 aa, Homo Sapiens
QEILNTLRE

SEQ ID NO: 305407 - protein, 9 aa, Homo Sapiens
VNLEFHVQE

SEQ ID NO: 305408 - protein, 9 aa, Homo Sapiens
RKELKRNKK

SEQ ID NO: 305409 - protein, 9 aa, Homo Sapiens
TPANNAFFD

SEQ ID NO: 305410 - protein, 9 aa, Homo Sapiens
GEDQEHLVI

SEQ ID NO: 305411 - protein, 9 aa, Homo Sapiens
ARSRDRVAK

SEQ ID NO: 305412 - protein, 9 aa, Homo Sapiens
TEEDDVNNY

SEQ ID NO: 305413 - protein, 9 aa, Homo Sapiens
FSPRRKRRG

SEQ ID NO: 305414 - protein, 9 aa, Homo Sapiens
GCDVQERVI

SEQ ID NO: 305415 - protein, 9 aa, Homo Sapiens
YVIGWNKSE

SEQ ID NO: 305416 - protein, 9 aa, Homo Sapiens
DLFEAEDTI

SEQ ID NO: 305417 - protein, 9 aa, Homo Sapiens
LDLNNKILA

SEQ ID NO: 305418 - protein, 9 aa, Homo Sapiens
LLTVKVSAS

SEQ ID NO: 305419 - protein, 9 aa, Homo Sapiens
WLLSPKSLD

SEQ ID NO: 305420 - protein, 9 aa, Homo Sapiens
PRTNQYWEK

SEQ ID NO: 305421 - protein, 9 aa, Homo Sapiens
NTKENVNDV

SEQ ID NO: 305422 - protein, 9 aa, Homo Sapiens
NANFDLRTF

SEQ ID NO: 305423 - protein, 9 aa, Homo Sapiens
CNCDADWNE

SEQ ID NO: 305424 - protein, 9 aa, Homo Sapiens
YVLVYLHTL

SEQ ID NO: 305425 - protein, 9 aa, Homo Sapiens
YKLCDNKWM

SEQ ID NO: 305426 - protein, 9 aa, Homo Sapiens
DPSSLRASP

SEQ ID NO: 305427 - protein, 9 aa, Homo Sapiens
REQEQQRHT

SEQ ID NO: 305428 - protein, 9 aa, Homo Sapiens
SSQLIYPPL

SEQ ID NO: 305429 - protein, 9 aa, Homo Sapiens
AVSHNQFLR

SEQ ID NO: 305430 - protein, 9 aa, Homo Sapiens
KYPLKAGET

SEQ ID NO: 305431 - protein, 9 aa, Homo Sapiens
GYRHIPLFS

SEQ ID NO: 305432 - protein, 9 aa, Homo Sapiens
TSFAIKLFS

SEQ ID NO: 305433 - protein, 9 aa, Homo Sapiens
SSSNGHKSL

SEQ ID NO: 305434 - protein, 9 aa, Homo Sapiens
TGVDPDHFY

SEQ ID NO: 305435 - protein, 9 aa, Homo Sapiens
SRINFKKKH

SEQ ID NO: 305436 - protein, 9 aa, Homo Sapiens
GFSPRSYLF

SEQ ID NO: 305437 - protein, 9 aa, Homo Sapiens
LLMRLVVDE

SEQ ID NO: 305438 - protein, 9 aa, Homo Sapiens
PRAVDDKQL

SEQ ID NO: 305439 - protein, 9 aa, Homo Sapiens
DSAFTGKTE

SEQ ID NO: 305440 - protein, 9 aa, Homo Sapiens
IIVEAQVNV

SEQ ID NO: 305441 - protein, 9 aa, Homo Sapiens
SLQQVWQQL

SEQ ID NO: 305442 - protein, 9 aa, Homo Sapiens
AIRMGIFSY

SEQ ID NO: 305443 - protein, 9 aa, Homo Sapiens
PVLQIIIEN

SEQ ID NO: 305444 - protein, 9 aa, Homo Sapiens
EKKASDQAS

SEQ ID NO: 305445 - protein, 9 aa, Homo Sapiens
ELHQQCETF

SEQ ID NO: 305446 - protein, 9 aa, Homo Sapiens
STLENTKYL

SEQ ID NO: 305447 - protein, 9 aa, Homo Sapiens
KRLQTLQDL

SEQ ID NO: 305448 - protein, 9 aa, Homo Sapiens
IAAAPTPDK

SEQ ID NO: 305449 - protein, 9 aa, Homo Sapiens
FGQSKCCKN

SEQ ID NO: 305450 - protein, 9 aa, Homo Sapiens
SQLRHIHLE

SEQ ID NO: 305451 - protein, 9 aa, Homo Sapiens
IPGGVYSSG

SEQ ID NO: 305452 - protein, 9 aa, Homo Sapiens
SPHVSDKSE

SEQ ID NO: 305453 - protein, 9 aa, Homo Sapiens
QELQKRMNK

SEQ ID NO: 305454 - protein, 9 aa, Homo Sapiens
NPKHVHQRP

SEQ ID NO: 305455 - protein, 9 aa, Homo Sapiens
AKNIERVYF

SEQ ID NO: 305456 - protein, 9 aa, Homo Sapiens
SAHFSFTAE

SEQ ID NO: 305457 - protein, 9 aa, Homo Sapiens
LFDMGNNKY

SEQ ID NO: 305458 - protein, 9 aa, Homo Sapiens
YCEGDNHLR

SEQ ID NO: 305459 - protein, 9 aa, Homo Sapiens
EIDTINGKL

SEQ ID NO: 305460 - protein, 9 aa, Homo Sapiens
STCASHLPI

SEQ ID NO: 305461 - protein, 9 aa, Homo Sapiens
EGNPLTVEC

SEQ ID NO: 305462 - protein, 9 aa, Homo Sapiens
QQARWVELD

SEQ ID NO: 305463 - protein, 9 aa, Homo Sapiens
SYAIGKPGY

SEQ ID NO: 305464 - protein, 9 aa, Homo Sapiens
PRVFVFCAL

SEQ ID NO: 305465 - protein, 9 aa, Homo Sapiens
QVRQLAVFI

SEQ ID NO: 305466 - protein, 9 aa, Homo Sapiens
SDVVENNLT

SEQ ID NO: 305467 - protein, 9 aa, Homo Sapiens
TDMCPGEKQ

SEQ ID NO: 305468 - protein, 9 aa, Homo Sapiens
NQILFLRLW

SEQ ID NO: 305469 - protein, 9 aa, Homo Sapiens
QLFRIIFRT

SEQ ID NO: 305470 - protein, 9 aa, Homo Sapiens
ATRQGVTIF

SEQ ID NO: 305471 - protein, 9 aa, Homo Sapiens
WLQEWKALK

SEQ ID NO: 305472 - protein, 9 aa, Homo Sapiens
SREEQLRDL

SEQ ID NO: 305473 - protein, 9 aa, Homo Sapiens
KACISTGPY

SEQ ID NO: 305474 - protein, 9 aa, Homo Sapiens
INVLRRELA

SEQ ID NO: 305475 - protein, 9 aa, Homo Sapiens
AMMIKTIKK

SEQ ID NO: 305476 - protein, 9 aa, Homo Sapiens
DAGELVRKL

SEQ ID NO: 305477 - protein, 9 aa, Homo Sapiens
VRDPQKSFA

SEQ ID NO: 305478 - protein, 9 aa, Homo Sapiens
QDNINNLEL

SEQ ID NO: 305479 - protein, 9 aa, Homo Sapiens
CGQAFVQKT

SEQ ID NO: 305480 - protein, 9 aa, Homo Sapiens
TNLQERPSY

SEQ ID NO: 305481 - protein, 9 aa, Homo Sapiens
CSQNGFDKV

SEQ ID NO: 305482 - protein, 9 aa, Homo Sapiens
ILQNQIQQA

SEQ ID NO: 305483 - protein, 9 aa, Homo Sapiens
KQGPSQNVP

SEQ ID NO: 305484 - protein, 9 aa, Homo Sapiens
YPLNKLDLV

SEQ ID NO: 305485 - protein, 9 aa, Homo Sapiens
KKRRIKIHR

SEQ ID NO: 305486 - protein, 9 aa, Homo Sapiens
RMLQKEDNE

SEQ ID NO: 305487 - protein, 9 aa, Homo Sapiens
QDKRKRNVL

SEQ ID NO: 305488 - protein, 9 aa, Homo Sapiens
TDGQLGLGH

SEQ ID NO: 305489 - protein, 9 aa, Homo Sapiens
MLNGQEVRR

SEQ ID NO: 305490 - protein, 9 aa, Homo Sapiens
VPGNRSLFT

SEQ ID NO: 305491 - protein, 9 aa, Homo Sapiens
YFTDKMKVN

SEQ ID NO: 305492 - protein, 9 aa, Homo Sapiens
TVLAMDLMV

SEQ ID NO: 305493 - protein, 9 aa, Homo Sapiens
LDECEELYQ

SEQ ID NO: 305494 - protein, 9 aa, Homo Sapiens
VTQLAKEVA

SEQ ID NO: 305495 - protein, 9 aa, Homo Sapiens
RHYEVAKMI

SEQ ID NO: 305496 - protein, 9 aa, Homo Sapiens
FLCPLCMQS

SEQ ID NO: 305497 - protein, 9 aa, Homo Sapiens
SITSLSQQP

SEQ ID NO: 305498 - protein, 9 aa, Homo Sapiens
AGSQSSHGG

SEQ ID NO: 305499 - protein, 9 aa, Homo Sapiens
RAEAHTEVF

SEQ ID NO: 305500 - protein, 9 aa, Homo Sapiens
DVTVADTNF

SEQ ID NO: 305501 - protein, 9 aa, Homo Sapiens
EWADENSRL

SEQ ID NO: 305502 - protein, 9 aa, Homo Sapiens
ESICHLTLP

SEQ ID NO: 305503 - protein, 9 aa, Homo Sapiens
ENCEEIINL

SEQ ID NO: 305504 - protein, 9 aa, Homo Sapiens
MYQYGAGVT

SEQ ID NO: 305505 - protein, 9 aa, Homo Sapiens
RKHSSSSNY

SEQ ID NO: 305506 - protein, 9 aa, Homo Sapiens
YHLHPSGRF

SEQ ID NO: 305507 - protein, 9 aa, Homo Sapiens
RMVMMADDP

SEQ ID NO: 305508 - protein, 9 aa, Homo Sapiens
LVGLLLFYF

SEQ ID NO: 305509 - protein, 9 aa, Homo Sapiens
IIWLNETGT

SEQ ID NO: 305510 - protein, 9 aa, Homo Sapiens
DEQPIFLAP

SEQ ID NO: 305511 - protein, 9 aa, Homo Sapiens
HNHILKPED

SEQ ID NO: 305512 - protein, 9 aa, Homo Sapiens
FLYNLLYLV

SEQ ID NO: 305513 - protein, 9 aa, Homo Sapiens
SGYIVDDAL

SEQ ID NO: 305514 - protein, 9 aa, Homo Sapiens
YQGSIHKSK

SEQ ID NO: 305515 - protein, 9 aa, Homo Sapiens
ADMYGTVQE

SEQ ID NO: 305516 - protein, 9 aa, Homo Sapiens
LKKIIVEAQ

SEQ ID NO: 305517 - protein, 9 aa, Homo Sapiens
QDEFFTKLF

SEQ ID NO: 305518 - protein, 9 aa, Homo Sapiens
AHEKDDVHH

SEQ ID NO: 305519 - protein, 9 aa, Homo Sapiens
CVFLIMLGC

SEQ ID NO: 305520 - protein, 9 aa, Homo Sapiens
PESIINSTE

SEQ ID NO: 305521 - protein, 9 aa, Homo Sapiens
SNLVRHQQT

SEQ ID NO: 305522 - protein, 9 aa, Homo Sapiens
RRAPGNDQF

SEQ ID NO: 305523 - protein, 9 aa, Homo Sapiens
AQEGQCWVD

SEQ ID NO: 305524 - protein, 9 aa, Homo Sapiens
KNIYQELNM

SEQ ID NO: 305525 - protein, 9 aa, Homo Sapiens
ERVWTITSS

SEQ ID NO: 305526 - protein, 9 aa, Homo Sapiens
AGTMGYKDT

SEQ ID NO: 305527 - protein, 9 aa, Homo Sapiens
YSPKFYAGT

SEQ ID NO: 305528 - protein, 9 aa, Homo Sapiens
DVVGGLMTW

SEQ ID NO: 305529 - protein, 9 aa, Homo Sapiens
NDVRHANSG

SEQ ID NO: 305530 - protein, 9 aa, Homo Sapiens
KVVLAEEKA

SEQ ID NO: 305531 - protein, 9 aa, Homo Sapiens
VGDIHKYVQ

SEQ ID NO: 305532 - protein, 9 aa, Homo Sapiens
NDRARRSPQ

SEQ ID NO: 305533 - protein, 9 aa, Homo Sapiens
DCPNPEIPL

SEQ ID NO: 305534 - protein, 9 aa, Homo Sapiens
YVVILVLSA

SEQ ID NO: 305535 - protein, 9 aa, Homo Sapiens
RDYTPSTTS

SEQ ID NO: 305536 - protein, 9 aa, Homo Sapiens
STPCAFNVG

SEQ ID NO: 305537 - protein, 9 aa, Homo Sapiens
DVLSLLEKL

SEQ ID NO: 305538 - protein, 9 aa, Homo Sapiens
CEICPWFTP

SEQ ID NO: 305539 - protein, 9 aa, Homo Sapiens
NSRDPLAIY

SEQ ID NO: 305540 - protein, 9 aa, Homo Sapiens
TMFLSVRSR

SEQ ID NO: 305541 - protein, 9 aa, Homo Sapiens
GSSAFKIFL

SEQ ID NO: 305542 - protein, 9 aa, Homo Sapiens
EQDVKDNTK

SEQ ID NO: 305543 - protein, 9 aa, Homo Sapiens
QSLELLNEF

SEQ ID NO: 305544 - protein, 9 aa, Homo Sapiens
GSSPLRTAS

SEQ ID NO: 305545 - protein, 9 aa, Homo Sapiens
SKGSHKRAI

SEQ ID NO: 305546 - protein, 9 aa, Homo Sapiens
SLLFYVVIL

SEQ ID NO: 305547 - protein, 9 aa, Homo Sapiens
CEELSPVLE

SEQ ID NO: 305548 - protein, 9 aa, Homo Sapiens
CPVDGAWME

SEQ ID NO: 305549 - protein, 9 aa, Homo Sapiens
KIIKNNLCR

SEQ ID NO: 305550 - protein, 9 aa, Homo Sapiens
MEWSKWSAC

SEQ ID NO: 305551 - protein, 9 aa, Homo Sapiens
KKDKNEYLP

SEQ ID NO: 305552 - protein, 9 aa, Homo Sapiens
LMVFTLRLI

SEQ ID NO: 305553 - protein, 9 aa, Homo Sapiens
GLEIANNLV

SEQ ID NO: 305554 - protein, 9 aa, Homo Sapiens
VLNNSGKRT

SEQ ID NO: 305555 - protein, 9 aa, Homo Sapiens
LEEFRENNQ

SEQ ID NO: 305556 - protein, 9 aa, Homo Sapiens
FICLQCWCV

SEQ ID NO: 305557 - protein, 9 aa, Homo Sapiens
LRSQSSDDR

SEQ ID NO: 305558 - protein, 9 aa, Homo Sapiens
CWCVRCHEP

SEQ ID NO: 305559 - protein, 9 aa, Homo Sapiens
TSQFTGLKF

SEQ ID NO: 305560 - protein, 9 aa, Homo Sapiens
IFFVETQNM

SEQ ID NO: 305561 - protein, 9 aa, Homo Sapiens
FQCAKCSLA

SEQ ID NO: 305562 - protein, 9 aa, Homo Sapiens
KRGPYQPKF

SEQ ID NO: 305563 - protein, 9 aa, Homo Sapiens
SIIYSIPFF

SEQ ID NO: 305564 - protein, 9 aa, Homo Sapiens
TKSVSLKEK

SEQ ID NO: 305565 - protein, 9 aa, Homo Sapiens
FTTEAELMQ

SEQ ID NO: 305566 - protein, 9 aa, Homo Sapiens
ELLNEFEGK

SEQ ID NO: 305567 - protein, 9 aa, Homo Sapiens
EVEISKALQ

SEQ ID NO: 305568 - protein, 9 aa, Homo Sapiens
KCEKIFKQP

SEQ ID NO: 305569 - protein, 9 aa, Homo Sapiens
FQQKMNYFM

SEQ ID NO: 305570 - protein, 9 aa, Homo Sapiens
LYGDELGLP

SEQ ID NO: 305571 - protein, 9 aa, Homo Sapiens
LPESMRLDL

SEQ ID NO: 305572 - protein, 9 aa, Homo Sapiens
TDIEVETVE

SEQ ID NO: 305573 - protein, 9 aa, Homo Sapiens
TCNECGRLF

SEQ ID NO: 305574 - protein, 9 aa, Homo Sapiens
EDRSVKPHL

SEQ ID NO: 305575 - protein, 9 aa, Homo Sapiens
PAKAPVYNW

SEQ ID NO: 305576 - protein, 9 aa, Homo Sapiens
FDVGNFNAF

SEQ ID NO: 305577 - protein, 9 aa, Homo Sapiens
EYLQDNIGN

SEQ ID NO: 305578 - protein, 9 aa, Homo Sapiens
PIAKFVDMP

SEQ ID NO: 305579 - protein, 9 aa, Homo Sapiens
STRETLEEG

SEQ ID NO: 305580 - protein, 9 aa, Homo Sapiens
LKKVFAESK

SEQ ID NO: 305581 - protein, 9 aa, Homo Sapiens
IKYPLKAGE

SEQ ID NO: 305582 - protein, 9 aa, Homo Sapiens
PRSTNKISW

SEQ ID NO: 305583 - protein, 9 aa, Homo Sapiens
SLSGGKPMI

SEQ ID NO: 305584 - protein, 9 aa, Homo Sapiens
FLLFTEHFH

SEQ ID NO: 305585 - protein, 9 aa, Homo Sapiens
KEKETDKSQ

SEQ ID NO: 305586 - protein, 9 aa, Homo Sapiens
ETHIQNEQV

SEQ ID NO: 305587 - protein, 9 aa, Homo Sapiens
ECEELYQKL

SEQ ID NO: 305588 - protein, 9 aa, Homo Sapiens
CKEEKYFDN

SEQ ID NO: 305589 - protein, 9 aa, Homo Sapiens
IDDNRTFSL

SEQ ID NO: 305590 - protein, 9 aa, Homo Sapiens
DHFDKLPIN

SEQ ID NO: 305591 - protein, 9 aa, Homo Sapiens
QAQYGTEMP

SEQ ID NO: 305592 - protein, 9 aa, Homo Sapiens
IGAQGVGRH

SEQ ID NO: 305593 - protein, 9 aa, Homo Sapiens
ILMERQIRP

SEQ ID NO: 305594 - protein, 9 aa, Homo Sapiens
LEQHIQKRL

SEQ ID NO: 305595 - protein, 9 aa, Homo Sapiens
TQCQITNET

SEQ ID NO: 305596 - protein, 9 aa, Homo Sapiens
VLFNITEDR

SEQ ID NO: 305597 - protein, 9 aa, Homo Sapiens
FFIALSYFK

SEQ ID NO: 305598 - protein, 9 aa, Homo Sapiens
QLHSRTIVH

SEQ ID NO: 305599 - protein, 9 aa, Homo Sapiens
LQEDISDLT

SEQ ID NO: 305600 - protein, 9 aa, Homo Sapiens
KQKLEDHGV

SEQ ID NO: 305601 - protein, 9 aa, Homo Sapiens
DSLFPSPNP

SEQ ID NO: 305602 - protein, 9 aa, Homo Sapiens
TEVCADTGG

SEQ ID NO: 305603 - protein, 9 aa, Homo Sapiens
GNGSIFTLK

SEQ ID NO: 305604 - protein, 9 aa, Homo Sapiens
YLRNFDEDV

SEQ ID NO: 305605 - protein, 9 aa, Homo Sapiens
ISLSCKKAG

SEQ ID NO: 305606 - protein, 9 aa, Homo Sapiens
PVNKERIKY

SEQ ID NO: 305607 - protein, 9 aa, Homo Sapiens
GASAHYDSL

SEQ ID NO: 305608 - protein, 9 aa, Homo Sapiens
SVVQPSSGL

SEQ ID NO: 305609 - protein, 9 aa, Homo Sapiens
YSASSRAHL

SEQ ID NO: 305610 - protein, 9 aa, Homo Sapiens
KVQINLQQQ

SEQ ID NO: 305611 - protein, 9 aa, Homo Sapiens
LRQMEEVVG

SEQ ID NO: 305612 - protein, 9 aa, Homo Sapiens
DISGGDTSK

SEQ ID NO: 305613 - protein, 9 aa, Homo Sapiens
FIIFHPNEF

SEQ ID NO: 305614 - protein, 9 aa, Homo Sapiens
SQRCCDSQD

SEQ ID NO: 305615 - protein, 9 aa, Homo Sapiens
YPSGTYDAF

SEQ ID NO: 305616 - protein, 9 aa, Homo Sapiens
HTPMYFLIF

SEQ ID NO: 305617 - protein, 9 aa, Homo Sapiens
QKHAALRWQ

SEQ ID NO: 305618 - protein, 9 aa, Homo Sapiens
EINSPNVLK

SEQ ID NO: 305619 - protein, 9 aa, Homo Sapiens
DFLLQFTVE

SEQ ID NO: 305620 - protein, 9 aa, Homo Sapiens
SQLSSLQVH

SEQ ID NO: 305621 - protein, 9 aa, Homo Sapiens
RRFGQSKCC

SEQ ID NO: 305622 - protein, 9 aa, Homo Sapiens
LAQRLGLGI

SEQ ID NO: 305623 - protein, 9 aa, Homo Sapiens
NIERVYFEI

SEQ ID NO: 305624 - protein, 9 aa, Homo Sapiens
CISFKWMVR

SEQ ID NO: 305625 - protein, 9 aa, Homo Sapiens
KRDREKEDK

SEQ ID NO: 305626 - protein, 9 aa, Homo Sapiens
NSTAEAFFK

SEQ ID NO: 305627 - protein, 9 aa, Homo Sapiens
EKGPDMFCK

SEQ ID NO: 305628 - protein, 9 aa, Homo Sapiens
EFFSKPKHN

SEQ ID NO: 305629 - protein, 9 aa, Homo Sapiens
AHISWFGSP

SEQ ID NO: 305630 - protein, 9 aa, Homo Sapiens
QRMGQLCEC

SEQ ID NO: 305631 - protein, 9 aa, Homo Sapiens
NFRQILCLI

SEQ ID NO: 305632 - protein, 9 aa, Homo Sapiens
FKSVSLLSN

SEQ ID NO: 305633 - protein, 9 aa, Homo Sapiens
GALLQRCTA

SEQ ID NO: 305634 - protein, 9 aa, Homo Sapiens
DYLYFASLN

SEQ ID NO: 305635 - protein, 9 aa, Homo Sapiens
SMNSSPISK

SEQ ID NO: 305636 - protein, 9 aa, Homo Sapiens
DTSEDKVIA

SEQ ID NO: 305637 - protein, 9 aa, Homo Sapiens
SNSKVKIYP

SEQ ID NO: 305638 - protein, 9 aa, Homo Sapiens
FLMMLHKGG

SEQ ID NO: 305639 - protein, 9 aa, Homo Sapiens
AVPGGPVIT

SEQ ID NO: 305640 - protein, 9 aa, Homo Sapiens
EAERKNIYQ

SEQ ID NO: 305641 - protein, 9 aa, Homo Sapiens
PFNIEPSSG

SEQ ID NO: 305642 - protein, 9 aa, Homo Sapiens
NKTPTQSLP

SEQ ID NO: 305643 - protein, 9 aa, Homo Sapiens
KFGNHMESK

SEQ ID NO: 305644 - protein, 9 aa, Homo Sapiens
LDEPNPTSP

SEQ ID NO: 305645 - protein, 9 aa, Homo Sapiens
TWSAGVPLD

SEQ ID NO: 305646 - protein, 9 aa, Homo Sapiens
GLPLEYQDK

SEQ ID NO: 305647 - protein, 9 aa, Homo Sapiens
WGRDVLDLG

SEQ ID NO: 305648 - protein, 9 aa, Homo Sapiens
NIREQNEEL

SEQ ID NO: 305649 - protein, 9 aa, Homo Sapiens
AHNRFLYVG

SEQ ID NO: 305650 - protein, 9 aa, Homo Sapiens
TNWSIINPN

SEQ ID NO: 305651 - protein, 9 aa, Homo Sapiens
NGEVLLEEL

SEQ ID NO: 305652 - protein, 9 aa, Homo Sapiens
IVTSVELGE

SEQ ID NO: 305653 - protein, 9 aa, Homo Sapiens
EKETTVTKI

SEQ ID NO: 305654 - protein, 9 aa, Homo Sapiens
RIGSLSQRL

SEQ ID NO: 305655 - protein, 9 aa, Homo Sapiens
KIMKTLTLV

SEQ ID NO: 305656 - protein, 9 aa, Homo Sapiens
YRKKLPHEF

SEQ ID NO: 305657 - protein, 9 aa, Homo Sapiens
FLALPNKEF

SEQ ID NO: 305658 - protein, 9 aa, Homo Sapiens
SLNKDKDGK

SEQ ID NO: 305659 - protein, 9 aa, Homo Sapiens
LACEAVNRM

SEQ ID NO: 305660 - protein, 9 aa, Homo Sapiens
VLCVTASIK

SEQ ID NO: 305661 - protein, 9 aa, Homo Sapiens
NDVEQVRQL

SEQ ID NO: 305662 - protein, 9 aa, Homo Sapiens
SNEGKQTKR

SEQ ID NO: 305663 - protein, 9 aa, Homo Sapiens
GLWRFCIEK

SEQ ID NO: 305664 - protein, 9 aa, Homo Sapiens
DISWIMSFL

SEQ ID NO: 305665 - protein, 9 aa, Homo Sapiens
NSSVWGRGI

SEQ ID NO: 305666 - protein, 9 aa, Homo Sapiens
MLQDLLSDL

SEQ ID NO: 305667 - protein, 9 aa, Homo Sapiens
LCIRDKYMQ

SEQ ID NO: 305668 - protein, 9 aa, Homo Sapiens
EICKYKKRF

SEQ ID NO: 305669 - protein, 9 aa, Homo Sapiens
LSTVLKITS

SEQ ID NO: 305670 - protein, 9 aa, Homo Sapiens
QMVMAQLLN

SEQ ID NO: 305671 - protein, 9 aa, Homo Sapiens
FWLGLKNIF

SEQ ID NO: 305672 - protein, 9 aa, Homo Sapiens
EKVERQQEV

SEQ ID NO: 305673 - protein, 9 aa, Homo Sapiens
ERKNIYQEL

SEQ ID NO: 305674 - protein, 9 aa, Homo Sapiens
KSFALGIQW

SEQ ID NO: 305675 - protein, 9 aa, Homo Sapiens
QLDAQHMNF

SEQ ID NO: 305676 - protein, 9 aa, Homo Sapiens
STEKHTKHK

SEQ ID NO: 305677 - protein, 9 aa, Homo Sapiens
VQTGIWVFI

SEQ ID NO: 305678 - protein, 9 aa, Homo Sapiens
VHYCYQFGG

SEQ ID NO: 305679 - protein, 9 aa, Homo Sapiens
VWVYLKVIK

SEQ ID NO: 305680 - protein, 9 aa, Homo Sapiens
TFIESSFWN

SEQ ID NO: 305681 - protein, 9 aa, Homo Sapiens
LNVLAVDPV

SEQ ID NO: 305682 - protein, 9 aa, Homo Sapiens
KIYFCAHTP

SEQ ID NO: 305683 - protein, 9 aa, Homo Sapiens
AIVQNALKS

SEQ ID NO: 305684 - protein, 9 aa, Homo Sapiens
IKGKISQRI

SEQ ID NO: 305685 - protein, 9 aa, Homo Sapiens
KIIRRVRLL

SEQ ID NO: 305686 - protein, 9 aa, Homo Sapiens
KNNKVIIKD

SEQ ID NO: 305687 - protein, 9 aa, Homo Sapiens
ATQPLPGGL

SEQ ID NO: 305688 - protein, 9 aa, Homo Sapiens
CEYQQAKCR

SEQ ID NO: 305689 - protein, 9 aa, Homo Sapiens
ALDPELEEA

SEQ ID NO: 305690 - protein, 9 aa, Homo Sapiens
KTKFSETAF

SEQ ID NO: 305691 - protein, 9 aa, Homo Sapiens
LHYKIILTP

SEQ ID NO: 305692 - protein, 9 aa, Homo Sapiens
EDVTVADTN

SEQ ID NO: 305693 - protein, 9 aa, Homo Sapiens
KDGIPGVQG

SEQ ID NO: 305694 - protein, 9 aa, Homo Sapiens
HTDVLSYTY

SEQ ID NO: 305695 - protein, 9 aa, Homo Sapiens
EDHVFCQYL

SEQ ID NO: 305696 - protein, 9 aa, Homo Sapiens
HIWGYMESQ

SEQ ID NO: 305697 - protein, 9 aa, Homo Sapiens
FEKPQSLEL

SEQ ID NO: 305698 - protein, 9 aa, Homo Sapiens
IGVEQIFYI

SEQ ID NO: 305699 - protein, 9 aa, Homo Sapiens
ITGCSRKIA

SEQ ID NO: 305700 - protein, 9 aa, Homo Sapiens
QLSEKNYPK

SEQ ID NO: 305701 - protein, 9 aa, Homo Sapiens
PRRTETSLT

SEQ ID NO: 305702 - protein, 9 aa, Homo Sapiens
GLSVETEAD

SEQ ID NO: 305703 - protein, 9 aa, Homo Sapiens
KENLRSKLI

SEQ ID NO: 305704 - protein, 9 aa, Homo Sapiens
SDSLLKEAQ

SEQ ID NO: 305705 - protein, 9 aa, Homo Sapiens
IVPIIWLNE

SEQ ID NO: 305706 - protein, 9 aa, Homo Sapiens
RVSQPSHPL

SEQ ID NO: 305707 - protein, 9 aa, Homo Sapiens
VTKLNNVKN

SEQ ID NO: 305708 - protein, 9 aa, Homo Sapiens
GEQSENTSP

SEQ ID NO: 305709 - protein, 9 aa, Homo Sapiens
VVQSYCGHG

SEQ ID NO: 305710 - protein, 9 aa, Homo Sapiens
VHAIFISNY

SEQ ID NO: 305711 - protein, 9 aa, Homo Sapiens
FWNLWRSQL

SEQ ID NO: 305712 - protein, 9 aa, Homo Sapiens
AGSQCSVDL

SEQ ID NO: 305713 - protein, 9 aa, Homo Sapiens
TAQMVMAHL

SEQ ID NO: 305714 - protein, 9 aa, Homo Sapiens
MDSDLSHAF

SEQ ID NO: 305715 - protein, 9 aa, Homo Sapiens
KQLSCLILP

SEQ ID NO: 305716 - protein, 9 aa, Homo Sapiens
DKKKVLSFL

SEQ ID NO: 305717 - protein, 9 aa, Homo Sapiens
FKIMKTLTL

SEQ ID NO: 305718 - protein, 9 aa, Homo Sapiens
SFTGSAAIT

SEQ ID NO: 305719 - protein, 9 aa, Homo Sapiens
KSSGNNLER

SEQ ID NO: 305720 - protein, 9 aa, Homo Sapiens
EDVQLKNQA

SEQ ID NO: 305721 - protein, 9 aa, Homo Sapiens
DGFQNYVIL

SEQ ID NO: 305722 - protein, 9 aa, Homo Sapiens
RALAQDAIF

SEQ ID NO: 305723 - protein, 9 aa, Homo Sapiens
ICSYADHSN

SEQ ID NO: 305724 - protein, 9 aa, Homo Sapiens
QRGPPPGHL

SEQ ID NO: 305725 - protein, 9 aa, Homo Sapiens
QNRDLEKRA

SEQ ID NO: 305726 - protein, 9 aa, Homo Sapiens
DVYRDVMLE

SEQ ID NO: 305727 - protein, 9 aa, Homo Sapiens
DNYLQADTV

SEQ ID NO: 305728 - protein, 9 aa, Homo Sapiens
EFWLGLKNI

SEQ ID NO: 305729 - protein, 9 aa, Homo Sapiens
LENCVSEDL

SEQ ID NO: 305730 - protein, 9 aa, Homo Sapiens
CQKCHKLLF

SEQ ID NO: 305731 - protein, 9 aa, Homo Sapiens
DCAPEDKIW

SEQ ID NO: 305732 - protein, 9 aa, Homo Sapiens
VERQQEVLR

SEQ ID NO: 305733 - protein, 9 aa, Homo Sapiens
ANGASTLSQ

SEQ ID NO: 305734 - protein, 9 aa, Homo Sapiens
EYPGFGEHF

SEQ ID NO: 305735 - protein, 9 aa, Homo Sapiens
EKIYPYDVK

SEQ ID NO: 305736 - protein, 9 aa, Homo Sapiens
NQIEAQENY

SEQ ID NO: 305737 - protein, 9 aa, Homo Sapiens
RLSLTFFQK

SEQ ID NO: 305738 - protein, 9 aa, Homo Sapiens
DSEEDSELY

SEQ ID NO: 305739 - protein, 9 aa, Homo Sapiens
QIFQQKMNY

SEQ ID NO: 305740 - protein, 9 aa, Homo Sapiens
NPYIQLGSS

SEQ ID NO: 305741 - protein, 9 aa, Homo Sapiens
SFLLDLFMV

SEQ ID NO: 305742 - protein, 9 aa, Homo Sapiens
GAVLTKSVS

SEQ ID NO: 305743 - protein, 9 aa, Homo Sapiens
KNTLHKFCG

SEQ ID NO: 305744 - protein, 9 aa, Homo Sapiens
IMGGAKNIE

SEQ ID NO: 305745 - protein, 9 aa, Homo Sapiens
TPYCETDLI

SEQ ID NO: 305746 - protein, 9 aa, Homo Sapiens
DPHWNFQED

SEQ ID NO: 305747 - protein, 9 aa, Homo Sapiens
TSTSYIDNQ

SEQ ID NO: 305748 - protein, 9 aa, Homo Sapiens
DRVTGMDKG

SEQ ID NO: 305749 - protein, 9 aa, Homo Sapiens
AYGHFPELA

SEQ ID NO: 305750 - protein, 9 aa, Homo Sapiens
LVHLMTLAL

SEQ ID NO: 305751 - protein, 9 aa, Homo Sapiens
QLHVDQLSS

SEQ ID NO: 305752 - protein, 9 aa, Homo Sapiens
DVTAWRGDC

SEQ ID NO: 305753 - protein, 9 aa, Homo Sapiens
TGKAATYNV

SEQ ID NO: 305754 - protein, 9 aa, Homo Sapiens
NLEVQNIIS

SEQ ID NO: 305755 - protein, 9 aa, Homo Sapiens
VKGYKEQKL

SEQ ID NO: 305756 - protein, 9 aa, Homo Sapiens
IIQSHSLPP

SEQ ID NO: 305757 - protein, 9 aa, Homo Sapiens
IDDSLSTKS

SEQ ID NO: 305758 - protein, 9 aa, Homo Sapiens
KIIYIEDNL

SEQ ID NO: 305759 - protein, 9 aa, Homo Sapiens
KDEKRKGKC

SEQ ID NO: 305760 - protein, 9 aa, Homo Sapiens
DRDEHMKSS

SEQ ID NO: 305761 - protein, 9 aa, Homo Sapiens
GKVNYEKFR

SEQ ID NO: 305762 - protein, 9 aa, Homo Sapiens
QEYYFFNVF

SEQ ID NO: 305763 - protein, 9 aa, Homo Sapiens
SWFNHGIHN

SEQ ID NO: 305764 - protein, 9 aa, Homo Sapiens
LTLMDYLIN

SEQ ID NO: 305765 - protein, 9 aa, Homo Sapiens
LGNIYFYPN

SEQ ID NO: 305766 - protein, 9 aa, Homo Sapiens
YPLVCALFV

SEQ ID NO: 305767 - protein, 9 aa, Homo Sapiens
KFPSLAGKP

SEQ ID NO: 305768 - protein, 9 aa, Homo Sapiens
TSHLYTDGS

SEQ ID NO: 305769 - protein, 9 aa, Homo Sapiens
MADPCLSLW

SEQ ID NO: 305770 - protein, 9 aa, Homo Sapiens
SPVQFDTFD

SEQ ID NO: 305771 - protein, 9 aa, Homo Sapiens
SWYNGVREE

SEQ ID NO: 305772 - protein, 9 aa, Homo Sapiens
KLPHEFPKS

SEQ ID NO: 305773 - protein, 9 aa, Homo Sapiens
EPINNDNPS

SEQ ID NO: 305774 - protein, 9 aa, Homo Sapiens
KLFRRGSNL

SEQ ID NO: 305775 - protein, 9 aa, Homo Sapiens
VGGLMTWAA

SEQ ID NO: 305776 - protein, 9 aa, Homo Sapiens
FFFVIVIIL

SEQ ID NO: 305777 - protein, 9 aa, Homo Sapiens
HNSSLWAQL

SEQ ID NO: 305778 - protein, 8 aa, Homo Sapiens
KRPSPGLP

SEQ ID NO: 305779 - protein, 9 aa, Homo Sapiens
YYFFNVFFP

SEQ ID NO: 305780 - protein, 9 aa, Homo Sapiens
AATSFAIKL

SEQ ID NO: 305781 - protein, 9 aa, Homo Sapiens
YRKNVLKEM

SEQ ID NO: 305782 - protein, 9 aa, Homo Sapiens
IFKNNIGWA

SEQ ID NO: 305783 - protein, 9 aa, Homo Sapiens
QIRMEKELQ

SEQ ID NO: 305784 - protein, 9 aa, Homo Sapiens
DTGAEIIHI

SEQ ID NO: 305785 - protein, 9 aa, Homo Sapiens
IEENYNANT

SEQ ID NO: 305786 - protein, 9 aa, Homo Sapiens
EYFQEAMLL

SEQ ID NO: 305787 - protein, 9 aa, Homo Sapiens
TDKDEPPND

SEQ ID NO: 305788 - protein, 9 aa, Homo Sapiens
SLDLDGRFY

SEQ ID NO: 305789 - protein, 9 aa, Homo Sapiens
SSRAFKVKI

SEQ ID NO: 305790 - protein, 9 aa, Homo Sapiens
PSLQNHYLN

SEQ ID NO: 305791 - protein, 9 aa, Homo Sapiens
DEMKDVIGD

SEQ ID NO: 305792 - protein, 9 aa, Homo Sapiens
NLSAQVCEY

SEQ ID NO: 305793 - protein, 9 aa, Homo Sapiens
VSQLIQCVV

SEQ ID NO: 305794 - protein, 9 aa, Homo Sapiens
NVPQPFEDN

SEQ ID NO: 305795 - protein, 9 aa, Homo Sapiens
NLQERPSYV

SEQ ID NO: 305796 - protein, 9 aa, Homo Sapiens
MGTSNFDPV

SEQ ID NO: 305797 - protein, 9 aa, Homo Sapiens
QIVRVKEDE

SEQ ID NO: 305798 - protein, 9 aa, Homo Sapiens
HTHLYVCGS

SEQ ID NO: 305799 - protein, 9 aa, Homo Sapiens
GQSTPCAFN

SEQ ID NO: 305800 - protein, 9 aa, Homo Sapiens
QTMFNLEQL

SEQ ID NO: 305801 - protein, 9 aa, Homo Sapiens
EDVIYRPHS

SEQ ID NO: 305802 - protein, 9 aa, Homo Sapiens
STITRKVDT

SEQ ID NO: 305803 - protein, 9 aa, Homo Sapiens
LHLGTHTKE

SEQ ID NO: 305804 - protein, 9 aa, Homo Sapiens
MGGAKNIER

SEQ ID NO: 305805 - protein, 9 aa, Homo Sapiens
LRYTINAMQ

SEQ ID NO: 305806 - protein, 9 aa, Homo Sapiens
GFVTRKQGS

SEQ ID NO: 305807 - protein, 9 aa, Homo Sapiens
YDSLEEKGL

SEQ ID NO: 305808 - protein, 9 aa, Homo Sapiens
QLMPMYNFN

SEQ ID NO: 305809 - protein, 9 aa, Homo Sapiens
IVSIIYSIP

SEQ ID NO: 305810 - protein, 9 aa, Homo Sapiens
DSTGQDMLF

SEQ ID NO: 305811 - protein, 9 aa, Homo Sapiens
FHPKIKYYY

SEQ ID NO: 305812 - protein, 9 aa, Homo Sapiens
GIHTVAIYS

SEQ ID NO: 305813 - protein, 9 aa, Homo Sapiens
FDIIRNYND

SEQ ID NO: 305814 - protein, 9 aa, Homo Sapiens
RKEVVKENA

SEQ ID NO: 305815 - protein, 9 aa, Homo Sapiens
GQIFQQKMN

SEQ ID NO: 305816 - protein, 9 aa, Homo Sapiens
PKSLDIKEI

SEQ ID NO: 305817 - protein, 9 aa, Homo Sapiens
EALFGKELL

SEQ ID NO: 305818 - protein, 9 aa, Homo Sapiens
ALRGSNGLW

SEQ ID NO: 305819 - protein, 9 aa, Homo Sapiens
QVTGTLPSV

SEQ ID NO: 305820 - protein, 9 aa, Homo Sapiens
PPGHLVGPR

SEQ ID NO: 305821 - protein, 9 aa, Homo Sapiens
TVPLLKKFL

SEQ ID NO: 305822 - protein, 9 aa, Homo Sapiens
KTSATINCL

SEQ ID NO: 305823 - protein, 9 aa, Homo Sapiens
TRIQLVFGN

SEQ ID NO: 305824 - protein, 9 aa, Homo Sapiens
FNQSSSRII

SEQ ID NO: 305825 - protein, 9 aa, Homo Sapiens
ALPNKEFKD

SEQ ID NO: 305826 - protein, 9 aa, Homo Sapiens
TARLNLTED

SEQ ID NO: 305827 - protein, 9 aa, Homo Sapiens
TQHLEGMKY

SEQ ID NO: 305828 - protein, 9 aa, Homo Sapiens
NYSIKNQTI

SEQ ID NO: 305829 - protein, 9 aa, Homo Sapiens
FSELPKCLQ

SEQ ID NO: 305830 - protein, 9 aa, Homo Sapiens
VTYCEGDNH

SEQ ID NO: 305831 - protein, 9 aa, Homo Sapiens
CNMCGKCFS

SEQ ID NO: 305832 - protein, 9 aa, Homo Sapiens
SFRTREVMT

SEQ ID NO: 305833 - protein, 9 aa, Homo Sapiens
PSIFDFPYH

SEQ ID NO: 305834 - protein, 9 aa, Homo Sapiens
QNFIDNRII

SEQ ID NO: 305835 - protein, 9 aa, Homo Sapiens
SPKSLDIKE

SEQ ID NO: 305836 - protein, 9 aa, Homo Sapiens
ELTLEVGYI

SEQ ID NO: 305837 - protein, 9 aa, Homo Sapiens
EPVQESSFW

SEQ ID NO: 305838 - protein, 9 aa, Homo Sapiens
YDFLKQNTF

SEQ ID NO: 305839 - protein, 9 aa, Homo Sapiens
KLIGAKEGS

SEQ ID NO: 305840 - protein, 9 aa, Homo Sapiens
AAFYLALRP

SEQ ID NO: 305841 - protein, 9 aa, Homo Sapiens
NFKKKHVGG

SEQ ID NO: 305842 - protein, 9 aa, Homo Sapiens
QEKEKASFP

SEQ ID NO: 305843 - protein, 9 aa, Homo Sapiens
LKSSIIGKN

SEQ ID NO: 305844 - protein, 9 aa, Homo Sapiens
KHKSDKTSG

SEQ ID NO: 305845 - protein, 9 aa, Homo Sapiens
VMLLANYIL

SEQ ID NO: 305846 - protein, 9 aa, Homo Sapiens
LKELLNNFS

SEQ ID NO: 305847 - protein, 9 aa, Homo Sapiens
FCSRSIEVF

SEQ ID NO: 305848 - protein, 9 aa, Homo Sapiens
FELIQKEKP

SEQ ID NO: 305849 - protein, 9 aa, Homo Sapiens
KRVFKTKKR

SEQ ID NO: 305850 - protein, 9 aa, Homo Sapiens
RNGTYIIYN

SEQ ID NO: 305851 - protein, 9 aa, Homo Sapiens
HIFVKAISQ

SEQ ID NO: 305852 - protein, 9 aa, Homo Sapiens
FYFMEDSRL

SEQ ID NO: 305853 - protein, 9 aa, Homo Sapiens
RGRNLRRHM

SEQ ID NO: 305854 - protein, 9 aa, Homo Sapiens
AHRFTVPGM

SEQ ID NO: 305855 - protein, 9 aa, Homo Sapiens
DIFFVSICT

SEQ ID NO: 305856 - protein, 9 aa, Homo Sapiens
EHLNHYISD

SEQ ID NO: 305857 - protein, 9 aa, Homo Sapiens
PDITKAWKF

SEQ ID NO: 305858 - protein, 9 aa, Homo Sapiens
DKMFSFSGF

SEQ ID NO: 305859 - protein, 9 aa, Homo Sapiens
NWATLAQRL

SEQ ID NO: 305860 - protein, 9 aa, Homo Sapiens
FLSWFNHGI

SEQ ID NO: 305861 - protein, 9 aa, Homo Sapiens
RERVKIIYK

SEQ ID NO: 305862 - protein, 9 aa, Homo Sapiens
SPKISRSPS

SEQ ID NO: 305863 - protein, 9 aa, Homo Sapiens
TLEYGNYTV

SEQ ID NO: 305864 - protein, 9 aa, Homo Sapiens
QSQSGHLES

SEQ ID NO: 305865 - protein, 9 aa, Homo Sapiens
GPNNSYIAY

SEQ ID NO: 305866 - protein, 9 aa, Homo Sapiens
EQPFPINQA

SEQ ID NO: 305867 - protein, 9 aa, Homo Sapiens
FQNFLTEIS

SEQ ID NO: 305868 - protein, 9 aa, Homo Sapiens
LTKHKNIHT

SEQ ID NO: 305869 - protein, 9 aa, Homo Sapiens
EKRDKKATA

SEQ ID NO: 305870 - protein, 9 aa, Homo Sapiens
NTILDVVEE

SEQ ID NO: 305871 - protein, 9 aa, Homo Sapiens
AKELLQHPY

SEQ ID NO: 305872 - protein, 9 aa, Homo Sapiens
ASEKDLCLE

SEQ ID NO: 305873 - protein, 9 aa, Homo Sapiens
VQSHPSSTQ

SEQ ID NO: 305874 - protein, 9 aa, Homo Sapiens
LLTMVMVTT

SEQ ID NO: 305875 - protein, 9 aa, Homo Sapiens
EHKKIHTGK

SEQ ID NO: 305876 - protein, 9 aa, Homo Sapiens
NVMLESYRN

SEQ ID NO: 305877 - protein, 9 aa, Homo Sapiens
QVSLGTKKN

SEQ ID NO: 305878 - protein, 9 aa, Homo Sapiens
AEKKDRDEH

SEQ ID NO: 305879 - protein, 9 aa, Homo Sapiens
ACVASEYPL

SEQ ID NO: 305880 - protein, 9 aa, Homo Sapiens
FQKLINKHE

SEQ ID NO: 305881 - protein, 9 aa, Homo Sapiens
SDQSKKYLY

SEQ ID NO: 305882 - protein, 9 aa, Homo Sapiens
KNNSIPTSE

SEQ ID NO: 305883 - protein, 9 aa, Homo Sapiens
SGSLAAESI

SEQ ID NO: 305884 - protein, 9 aa, Homo Sapiens
LVGLIKVTL

SEQ ID NO: 305885 - protein, 9 aa, Homo Sapiens
ETLSQINRD

SEQ ID NO: 305886 - protein, 9 aa, Homo Sapiens
DQILWKGKN

SEQ ID NO: 305887 - protein, 9 aa, Homo Sapiens
NVWEEYIIQ

SEQ ID NO: 305888 - protein, 9 aa, Homo Sapiens
GAVYSPKFY

SEQ ID NO: 305889 - protein, 9 aa, Homo Sapiens
SGRDNVSDL

SEQ ID NO: 305890 - protein, 9 aa, Homo Sapiens
PCLRQMFCS

SEQ ID NO: 305891 - protein, 9 aa, Homo Sapiens
LNSFSMSAS

SEQ ID NO: 305892 - protein, 9 aa, Homo Sapiens
YLPPDLSDT

SEQ ID NO: 305893 - protein, 9 aa, Homo Sapiens
INEYGIASI

SEQ ID NO: 305894 - protein, 9 aa, Homo Sapiens
DHGCFVCGM

SEQ ID NO: 305895 - protein, 9 aa, Homo Sapiens
RAQIAQISA

SEQ ID NO: 305896 - protein, 9 aa, Homo Sapiens
FGTKLNPPL

SEQ ID NO: 305897 - protein, 9 aa, Homo Sapiens
LWGHEKIHT

SEQ ID NO: 305898 - protein, 9 aa, Homo Sapiens
LENTKYLQT

SEQ ID NO: 305899 - protein, 9 aa, Homo Sapiens
VVGAVDVLT

SEQ ID NO: 305900 - protein, 9 aa, Homo Sapiens
TGDKPFECL

SEQ ID NO: 305901 - protein, 9 aa, Homo Sapiens
RERLTARLN

SEQ ID NO: 305902 - protein, 9 aa, Homo Sapiens
EQEQSLVVR

SEQ ID NO: 305903 - protein, 9 aa, Homo Sapiens
DPSTSASQV

SEQ ID NO: 305904 - protein, 9 aa, Homo Sapiens
AFYHHCQSK

SEQ ID NO: 305905 - protein, 9 aa, Homo Sapiens
NEISILESN

SEQ ID NO: 305906 - protein, 9 aa, Homo Sapiens
VGASAHYDS

SEQ ID NO: 305907 - protein, 9 aa, Homo Sapiens
EDMINQKAT

SEQ ID NO: 305908 - protein, 9 aa, Homo Sapiens
WDGKIMLVL

SEQ ID NO: 305909 - protein, 9 aa, Homo Sapiens
GKQKIIPQE

SEQ ID NO: 305910 - protein, 9 aa, Homo Sapiens
PGFSLLFYV

SEQ ID NO: 305911 - protein, 9 aa, Homo Sapiens
RAGKAKSQQ

SEQ ID NO: 305912 - protein, 9 aa, Homo Sapiens
ENYHDVTIL

SEQ ID NO: 305913 - protein, 9 aa, Homo Sapiens
DPLRTHVQG

SEQ ID NO: 305914 - protein, 9 aa, Homo Sapiens
YIIRQKDVQ

SEQ ID NO: 305915 - protein, 9 aa, Homo Sapiens
QHPYLKLAK

SEQ ID NO: 305916 - protein, 9 aa, Homo Sapiens
YFCIAWFSL

SEQ ID NO: 305917 - protein, 9 aa, Homo Sapiens
EENENKSKK

SEQ ID NO: 305918 - protein, 9 aa, Homo Sapiens
KNCSQDFKN

SEQ ID NO: 305919 - protein, 9 aa, Homo Sapiens
VREWYSSIF

SEQ ID NO: 305920 - protein, 9 aa, Homo Sapiens
VENYPTALQ

SEQ ID NO: 305921 - protein, 9 aa, Homo Sapiens
VAHFFKGLN

SEQ ID NO: 305922 - protein, 9 aa, Homo Sapiens
PLRTASSYN

SEQ ID NO: 305923 - protein, 9 aa, Homo Sapiens
FGIKETVQK

SEQ ID NO: 305924 - protein, 9 aa, Homo Sapiens
KCSKPLVDL

SEQ ID NO: 305925 - protein, 9 aa, Homo Sapiens
TGSLIFRAI

SEQ ID NO: 305926 - protein, 9 aa, Homo Sapiens
IWEQSKKLS

SEQ ID NO: 305927 - protein, 9 aa, Homo Sapiens
LAMTALDAI

SEQ ID NO: 305928 - protein, 9 aa, Homo Sapiens
VKFNPQIFK

SEQ ID NO: 305929 - protein, 9 aa, Homo Sapiens
SDEVTQLAK

SEQ ID NO: 305930 - protein, 9 aa, Homo Sapiens
LTAAFYLAL

SEQ ID NO: 305931 - protein, 9 aa, Homo Sapiens
NSLHLSFAG

SEQ ID NO: 305932 - protein, 9 aa, Homo Sapiens
SDEVNCPSQ

SEQ ID NO: 305933 - protein, 9 aa, Homo Sapiens
RAENNRLWG

SEQ ID NO: 305934 - protein, 9 aa, Homo Sapiens
RREIKLLEK

SEQ ID NO: 305935 - protein, 9 aa, Homo Sapiens
DARWWGLIT

SEQ ID NO: 305936 - protein, 9 aa, Homo Sapiens
SVFWICMTW

SEQ ID NO: 305937 - protein, 9 aa, Homo Sapiens
KKSPQMNNF

SEQ ID NO: 305938 - protein, 9 aa, Homo Sapiens
QVKDNLLSC

SEQ ID NO: 305939 - protein, 9 aa, Homo Sapiens
FTMPVAILV

SEQ ID NO: 305940 - protein, 9 aa, Homo Sapiens
VKAISQDSL

SEQ ID NO: 305941 - protein, 9 aa, Homo Sapiens
QVAESQKQK

SEQ ID NO: 305942 - protein, 9 aa, Homo Sapiens
SSTQIFQEK

SEQ ID NO: 305943 - protein, 9 aa, Homo Sapiens
PGYNFRYAT

SEQ ID NO: 305944 - protein, 9 aa, Homo Sapiens
SQGELDKAI

SEQ ID NO: 305945 - protein, 9 aa, Homo Sapiens
PDEYDQLVW

SEQ ID NO: 305946 - protein, 9 aa, Homo Sapiens
PKAKVLVPV

SEQ ID NO: 305947 - protein, 9 aa, Homo Sapiens
CTHAEINQQ

SEQ ID NO: 305948 - protein, 9 aa, Homo Sapiens
LWVLRPLKT

SEQ ID NO: 305949 - protein, 9 aa, Homo Sapiens
QGWLKAEQQ

SEQ ID NO: 305950 - protein, 9 aa, Homo Sapiens
LFSPRRKRR

SEQ ID NO: 305951 - protein, 9 aa, Homo Sapiens
CPINNLDAL

SEQ ID NO: 305952 - protein, 9 aa, Homo Sapiens
SRSPSPKIS

SEQ ID NO: 305953 - protein, 9 aa, Homo Sapiens
LLVNVSGKL

SEQ ID NO: 305954 - protein, 9 aa, Homo Sapiens
VYSTFQNHE

SEQ ID NO: 305955 - protein, 9 aa, Homo Sapiens
RKSGVFTSA

SEQ ID NO: 305956 - protein, 9 aa, Homo Sapiens
LTMAQLKMS

SEQ ID NO: 305957 - protein, 9 aa, Homo Sapiens
TNSAVQTCG

SEQ ID NO: 305958 - protein, 9 aa, Homo Sapiens
TGQLFSLNS

SEQ ID NO: 305959 - protein, 9 aa, Homo Sapiens
SMFVHNNSK

SEQ ID NO: 305960 - protein, 9 aa, Homo Sapiens
ILMYTIASA

SEQ ID NO: 305961 - protein, 9 aa, Homo Sapiens
RTVQYIMNN

SEQ ID NO: 305962 - protein, 9 aa, Homo Sapiens
GMRKPAQYG

SEQ ID NO: 305963 - protein, 9 aa, Homo Sapiens
KSTHLNKPL

SEQ ID NO: 305964 - protein, 9 aa, Homo Sapiens
HKITHSKEL

SEQ ID NO: 305965 - protein, 9 aa, Homo Sapiens
NLVLIWRGS

SEQ ID NO: 305966 - protein, 9 aa, Homo Sapiens
VSHMGTSTM

SEQ ID NO: 305967 - protein, 9 aa, Homo Sapiens
NLLSCLLVC

SEQ ID NO: 305968 - protein, 9 aa, Homo Sapiens
ASSSSDEGY

SEQ ID NO: 305969 - protein, 9 aa, Homo Sapiens
MCGKCFSCN

SEQ ID NO: 305970 - protein, 9 aa, Homo Sapiens
SVLCEIKDK

SEQ ID NO: 305971 - protein, 9 aa, Homo Sapiens
LWHPRNAPP

SEQ ID NO: 305972 - protein, 9 aa, Homo Sapiens
VRKFILLGL

SEQ ID NO: 305973 - protein, 9 aa, Homo Sapiens
VHMNILPFV

SEQ ID NO: 305974 - protein, 9 aa, Homo Sapiens
LSNCGIWQP

SEQ ID NO: 305975 - protein, 9 aa, Homo Sapiens
SLTQHVIIH

SEQ ID NO: 305976 - protein, 9 aa, Homo Sapiens
MQNNAAVFR

SEQ ID NO: 305977 - protein, 9 aa, Homo Sapiens
TDSLFPSPN

SEQ ID NO: 305978 - protein, 9 aa, Homo Sapiens
KKNGDILTL

SEQ ID NO: 305979 - protein, 9 aa, Homo Sapiens
KVKIYPYTS

SEQ ID NO: 305980 - protein, 9 aa, Homo Sapiens
KYQQRLPIF

SEQ ID NO: 305981 - protein, 9 aa, Homo Sapiens
RYVCENCKP

SEQ ID NO: 305982 - protein, 9 aa, Homo Sapiens
KTEKMLTNV

SEQ ID NO: 305983 - protein, 9 aa, Homo Sapiens
KEKRKLKGK

SEQ ID NO: 305984 - protein, 9 aa, Homo Sapiens
CRTNKDCKT

SEQ ID NO: 305985 - protein, 9 aa, Homo Sapiens
INKAPIQTY

SEQ ID NO: 305986 - protein, 9 aa, Homo Sapiens
TVESLEAGD

SEQ ID NO: 305987 - protein, 9 aa, Homo Sapiens
VMKHLSGPQ

SEQ ID NO: 305988 - protein, 9 aa, Homo Sapiens
YQNTTASVS

SEQ ID NO: 305989 - protein, 9 aa, Homo Sapiens
LVVPNLGVA

SEQ ID NO: 305990 - protein, 9 aa, Homo Sapiens
HLIQHQKFH

SEQ ID NO: 305991 - protein, 9 aa, Homo Sapiens
PFYKGINEC

SEQ ID NO: 305992 - protein, 9 aa, Homo Sapiens
FIHEVQVGE

SEQ ID NO: 305993 - protein, 9 aa, Homo Sapiens
HKYVQHISL

SEQ ID NO: 305994 - protein, 9 aa, Homo Sapiens
FKLFTTGEN

SEQ ID NO: 305995 - protein, 9 aa, Homo Sapiens
KEFPQVVHK

SEQ ID NO: 305996 - protein, 9 aa, Homo Sapiens
LRVYLERVS

SEQ ID NO: 305997 - protein, 9 aa, Homo Sapiens
KQLQKSYKT

SEQ ID NO: 305998 - protein, 9 aa, Homo Sapiens
PINNDNPSP

SEQ ID NO: 305999 - protein, 9 aa, Homo Sapiens
YQELNMEQK

SEQ ID NO: 306000 - protein, 9 aa, Homo Sapiens
YCTTTGTWA

SEQ ID NO: 306001 - protein, 9 aa, Homo Sapiens
GELMTHKLK

SEQ ID NO: 306002 - protein, 9 aa, Homo Sapiens
SALTIKLIQ

SEQ ID NO: 306003 - protein, 9 aa, Homo Sapiens
AQKCLVFQG

SEQ ID NO: 306004 - protein, 9 aa, Homo Sapiens
FNKLFRLNN

SEQ ID NO: 306005 - protein, 9 aa, Homo Sapiens
GGDNNAPIL

SEQ ID NO: 306006 - protein, 9 aa, Homo Sapiens
IVSHLHIHV

SEQ ID NO: 306007 - protein, 9 aa, Homo Sapiens
MNKLREENT

SEQ ID NO: 306008 - protein, 9 aa, Homo Sapiens
QKGNSNKVV

SEQ ID NO: 306009 - protein, 9 aa, Homo Sapiens
GYTLWEDGA

SEQ ID NO: 306010 - protein, 9 aa, Homo Sapiens
INEEHEGFE

SEQ ID NO: 306011 - protein, 9 aa, Homo Sapiens
KYINDNPPT

SEQ ID NO: 306012 - protein, 9 aa, Homo Sapiens
GLKLTTNYV

SEQ ID NO: 306013 - protein, 9 aa, Homo Sapiens
KKFVQIENA

SEQ ID NO: 306014 - protein, 9 aa, Homo Sapiens
TVVHAGTRR

SEQ ID NO: 306015 - protein, 9 aa, Homo Sapiens
FKKIKPPSK

SEQ ID NO: 306016 - protein, 9 aa, Homo Sapiens
GPASYGRND

SEQ ID NO: 306017 - protein, 9 aa, Homo Sapiens
GDKPYNCNE

SEQ ID NO: 306018 - protein, 9 aa, Homo Sapiens
PTDTFIESS

SEQ ID NO: 306019 - protein, 9 aa, Homo Sapiens
DKVPEKRDS

SEQ ID NO: 306020 - protein, 9 aa, Homo Sapiens
LSEKMQYAS

SEQ ID NO: 306021 - protein, 9 aa, Homo Sapiens
SSKSRALST

SEQ ID NO: 306022 - protein, 9 aa, Homo Sapiens
VQLKDLLKK

SEQ ID NO: 306023 - protein, 9 aa, Homo Sapiens
GFNTPWGIN

SEQ ID NO: 306024 - protein, 9 aa, Homo Sapiens
LVIPKINSH

SEQ ID NO: 306025 - protein, 9 aa, Homo Sapiens
MRDRLHIYT

SEQ ID NO: 306026 - protein, 9 aa, Homo Sapiens
SFNAYFSNK

SEQ ID NO: 306027 - protein, 9 aa, Homo Sapiens
QRLGLGILN

SEQ ID NO: 306028 - protein, 9 aa, Homo Sapiens
RQAAPGIIW

SEQ ID NO: 306029 - protein, 9 aa, Homo Sapiens
ALLRVYLAK

SEQ ID NO: 306030 - protein, 9 aa, Homo Sapiens
QVEYLRTPD

SEQ ID NO: 306031 - protein, 9 aa, Homo Sapiens
HYISDTFWK

SEQ ID NO: 306032 - protein, 9 aa, Homo Sapiens
DEGEDTLEL

SEQ ID NO: 306033 - protein, 9 aa, Homo Sapiens
IPEELFQFL

SEQ ID NO: 306034 - protein, 9 aa, Homo Sapiens
IDEEGCIQG

SEQ ID NO: 306035 - protein, 9 aa, Homo Sapiens
KEYIQQLHS

SEQ ID NO: 306036 - protein, 9 aa, Homo Sapiens
KMILETAPT

SEQ ID NO: 306037 - protein, 9 aa, Homo Sapiens
HVTLHVNEP

SEQ ID NO: 306038 - protein, 9 aa, Homo Sapiens
EELYAIKNA

SEQ ID NO: 306039 - protein, 9 aa, Homo Sapiens
TITQNVLQK

SEQ ID NO: 306040 - protein, 9 aa, Homo Sapiens
CTIVESCNS

SEQ ID NO: 306041 - protein, 9 aa, Homo Sapiens
VNKERIKYS

SEQ ID NO: 306042 - protein, 9 aa, Homo Sapiens
LSMSCLDSI

SEQ ID NO: 306043 - protein, 9 aa, Homo Sapiens
ADNTLSKLL

SEQ ID NO: 306044 - protein, 9 aa, Homo Sapiens
AAKVSKQSW

SEQ ID NO: 306045 - protein, 9 aa, Homo Sapiens
QPQSLAKKE

SEQ ID NO: 306046 - protein, 9 aa, Homo Sapiens
FNDTGHCFC

SEQ ID NO: 306047 - protein, 9 aa, Homo Sapiens
TEHLRPSWG

SEQ ID NO: 306048 - protein, 9 aa, Homo Sapiens
VQAEGQSCE

SEQ ID NO: 306049 - protein, 9 aa, Homo Sapiens
AKLLKKADT

SEQ ID NO: 306050 - protein, 9 aa, Homo Sapiens
ELADKYAPD

SEQ ID NO: 306051 - protein, 9 aa, Homo Sapiens
RSLRYLMEE

SEQ ID NO: 306052 - protein, 9 aa, Homo Sapiens
IDQDTANIL

SEQ ID NO: 306053 - protein, 9 aa, Homo Sapiens
LTETEVDHN

SEQ ID NO: 306054 - protein, 9 aa, Homo Sapiens
PVQESSFWS

SEQ ID NO: 306055 - protein, 9 aa, Homo Sapiens
LRSLNDMHS

SEQ ID NO: 306056 - protein, 9 aa, Homo Sapiens
EKLRKAFND

SEQ ID NO: 306057 - protein, 9 aa, Homo Sapiens
KSLSCPEPA

SEQ ID NO: 306058 - protein, 9 aa, Homo Sapiens
NGIEINGNS

SEQ ID NO: 306059 - protein, 9 aa, Homo Sapiens
ATNRPNNID

SEQ ID NO: 306060 - protein, 9 aa, Homo Sapiens
LIDEITKKH

SEQ ID NO: 306061 - protein, 9 aa, Homo Sapiens
AVSDSMFVH

SEQ ID NO: 306062 - protein, 9 aa, Homo Sapiens
GHDFHEGIR

SEQ ID NO: 306063 - protein, 9 aa, Homo Sapiens
YILWCVNHD

SEQ ID NO: 306064 - protein, 9 aa, Homo Sapiens
DLHGHSRKD

SEQ ID NO: 306065 - protein, 9 aa, Homo Sapiens
TQKLINAEE

SEQ ID NO: 306066 - protein, 9 aa, Homo Sapiens
GIYSIYEDE

SEQ ID NO: 306067 - protein, 9 aa, Homo Sapiens
AHKIMKMIH

SEQ ID NO: 306068 - protein, 9 aa, Homo Sapiens
NPQKTSATI

SEQ ID NO: 306069 - protein, 9 aa, Homo Sapiens
INLPWKFEH

SEQ ID NO: 306070 - protein, 9 aa, Homo Sapiens
TALICSTLA

SEQ ID NO: 306071 - protein, 9 aa, Homo Sapiens
GSFSLFVRD

SEQ ID NO: 306072 - protein, 9 aa, Homo Sapiens
DIIGPPMYE

SEQ ID NO: 306073 - protein, 9 aa, Homo Sapiens
QPEAAPAHV

SEQ ID NO: 306074 - protein, 9 aa, Homo Sapiens
RENLARHHI

SEQ ID NO: 306075 - protein, 9 aa, Homo Sapiens
ILHSREKLF

SEQ ID NO: 306076 - protein, 9 aa, Homo Sapiens
IDGRALEKC

SEQ ID NO: 306077 - protein, 9 aa, Homo Sapiens
EEKENIRNN

SEQ ID NO: 306078 - protein, 9 aa, Homo Sapiens
TLLEHLMKA

SEQ ID NO: 306079 - protein, 9 aa, Homo Sapiens
LINNGSKKV

SEQ ID NO: 306080 - protein, 9 aa, Homo Sapiens
INFKKKHVG

SEQ ID NO: 306081 - protein, 9 aa, Homo Sapiens
NVISHLYCD

SEQ ID NO: 306082 - protein, 9 aa, Homo Sapiens
DEVNCPSQT

SEQ ID NO: 306083 - protein, 9 aa, Homo Sapiens
TWVKLEIIQ

SEQ ID NO: 306084 - protein, 9 aa, Homo Sapiens
CGSADNIPN

SEQ ID NO: 306085 - protein, 9 aa, Homo Sapiens
EGDISFPGI

SEQ ID NO: 306086 - protein, 9 aa, Homo Sapiens
PMSEKSIYN

SEQ ID NO: 306087 - protein, 9 aa, Homo Sapiens
LCMNKGYRH

SEQ ID NO: 306088 - protein, 9 aa, Homo Sapiens
LGIHTVAIY

SEQ ID NO: 306089 - protein, 9 aa, Homo Sapiens
VQSQNLLVK

SEQ ID NO: 306090 - protein, 9 aa, Homo Sapiens
EKNVVGQIL

SEQ ID NO: 306091 - protein, 9 aa, Homo Sapiens
TIPLNGQLF

SEQ ID NO: 306092 - protein, 9 aa, Homo Sapiens
TDKCTTDKQ

SEQ ID NO: 306093 - protein, 9 aa, Homo Sapiens
CSSPGAPMG

SEQ ID NO: 306094 - protein, 9 aa, Homo Sapiens
KTLEWATIQ

SEQ ID NO: 306095 - protein, 9 aa, Homo Sapiens
TQTEKTTRV

SEQ ID NO: 306096 - protein, 9 aa, Homo Sapiens
NNFKEGHKI

SEQ ID NO: 306097 - protein, 9 aa, Homo Sapiens
VSKLKKPRW

SEQ ID NO: 306098 - protein, 9 aa, Homo Sapiens
KDKIPHVRI

SEQ ID NO: 306099 - protein, 9 aa, Homo Sapiens
EFVFNAIET

SEQ ID NO: 306100 - protein, 9 aa, Homo Sapiens
MGAGEQSRQ

SEQ ID NO: 306101 - protein, 9 aa, Homo Sapiens
SLQAQYGTE

SEQ ID NO: 306102 - protein, 9 aa, Homo Sapiens
RPFYKGINE

SEQ ID NO: 306103 - protein, 9 aa, Homo Sapiens
EYFKSVSLL

SEQ ID NO: 306104 - protein, 9 aa, Homo Sapiens
VTSQLYSLI

SEQ ID NO: 306105 - protein, 9 aa, Homo Sapiens
ILLSIFAKE

SEQ ID NO: 306106 - protein, 9 aa, Homo Sapiens
KSYSKDLES

SEQ ID NO: 306107 - protein, 9 aa, Homo Sapiens
MSGVGTYVI

SEQ ID NO: 306108 - protein, 9 aa, Homo Sapiens
PVTNTPSLD

SEQ ID NO: 306109 - protein, 9 aa, Homo Sapiens
PRPQPRGPI

SEQ ID NO: 306110 - protein, 9 aa, Homo Sapiens
STQYGLKLT

SEQ ID NO: 306111 - protein, 9 aa, Homo Sapiens
IKKLLVPDY

SEQ ID NO: 306112 - protein, 9 aa, Homo Sapiens
TSDTQIKEN

SEQ ID NO: 306113 - protein, 9 aa, Homo Sapiens
NEGDITIFT

SEQ ID NO: 306114 - protein, 9 aa, Homo Sapiens
AKIDSLAPL

SEQ ID NO: 306115 - protein, 9 aa, Homo Sapiens
KNKSTHLNK

SEQ ID NO: 306116 - protein, 9 aa, Homo Sapiens
ICQEKEQEP

SEQ ID NO: 306117 - protein, 9 aa, Homo Sapiens
PANNAFFDE

SEQ ID NO: 306118 - protein, 9 aa, Homo Sapiens
RSTKKRRIR

SEQ ID NO: 306119 - protein, 9 aa, Homo Sapiens
IIPPGRSNP

SEQ ID NO: 306120 - protein, 9 aa, Homo Sapiens
EDELSYGFD

SEQ ID NO: 306121 - protein, 9 aa, Homo Sapiens
KLTPNMKKD

SEQ ID NO: 306122 - protein, 9 aa, Homo Sapiens
FKKPKIIPP

SEQ ID NO: 306123 - protein, 9 aa, Homo Sapiens
EEELFDAHE

SEQ ID NO: 306124 - protein, 9 aa, Homo Sapiens
IKCYESCMS

SEQ ID NO: 306125 - protein, 9 aa, Homo Sapiens
DNHLDLRQE

SEQ ID NO: 306126 - protein, 9 aa, Homo Sapiens
WNFKLPHPF

SEQ ID NO: 306127 - protein, 9 aa, Homo Sapiens
EPQFQRYFI

SEQ ID NO: 306128 - protein, 9 aa, Homo Sapiens
LEDHGEKKQ

SEQ ID NO: 306129 - protein, 9 aa, Homo Sapiens
CLAASFLKK

SEQ ID NO: 306130 - protein, 9 aa, Homo Sapiens
LNKQVLEHE

SEQ ID NO: 306131 - protein, 9 aa, Homo Sapiens
PQPFFAAGN

SEQ ID NO: 306132 - protein, 9 aa, Homo Sapiens
EVSKRVCIP

SEQ ID NO: 306133 - protein, 9 aa, Homo Sapiens
DLVLELNNL

SEQ ID NO: 306134 - protein, 9 aa, Homo Sapiens
KLQESIFDI

SEQ ID NO: 306135 - protein, 9 aa, Homo Sapiens
ATEGLPNYS

SEQ ID NO: 306136 - protein, 9 aa, Homo Sapiens
EEVKHREQH

SEQ ID NO: 306137 - protein, 9 aa, Homo Sapiens
MQQMEIVLT

SEQ ID NO: 306138 - protein, 9 aa, Homo Sapiens
LKTRCISPR

SEQ ID NO: 306139 - protein, 9 aa, Homo Sapiens
DDRESIPFV

SEQ ID NO: 306140 - protein, 9 aa, Homo Sapiens
HSNKVLHFP

SEQ ID NO: 306141 - protein, 9 aa, Homo Sapiens
PYLLKCFNK

SEQ ID NO: 306142 - protein, 9 aa, Homo Sapiens
QILFLRLWR

SEQ ID NO: 306143 - protein, 9 aa, Homo Sapiens
YRCNKCGKV

SEQ ID NO: 306144 - protein, 9 aa, Homo Sapiens
LCYHYCFAK

SEQ ID NO: 306145 - protein, 9 aa, Homo Sapiens
GSQVNSAGY

SEQ ID NO: 306146 - protein, 9 aa, Homo Sapiens
MLLIQLPLC

SEQ ID NO: 306147 - protein, 9 aa, Homo Sapiens
VRNVSLNLT

SEQ ID NO: 306148 - protein, 9 aa, Homo Sapiens
QSIHTGKKP

SEQ ID NO: 306149 - protein, 9 aa, Homo Sapiens
RRLDSGNKD

SEQ ID NO: 306150 - protein, 9 aa, Homo Sapiens
KRHLSSVST

SEQ ID NO: 306151 - protein, 9 aa, Homo Sapiens
QDLLSDLNK

SEQ ID NO: 306152 - protein, 9 aa, Homo Sapiens
RYATYYKEN

SEQ ID NO: 306153 - protein, 9 aa, Homo Sapiens
YSVTEETDK

SEQ ID NO: 306154 - protein, 9 aa, Homo Sapiens
DNVIFFQQG

SEQ ID NO: 306155 - protein, 9 aa, Homo Sapiens
QTVTSPQPP

SEQ ID NO: 306156 - protein, 9 aa, Homo Sapiens
TSQLYSLID

SEQ ID NO: 306157 - protein, 9 aa, Homo Sapiens
EYQWIQGWL

SEQ ID NO: 306158 - protein, 9 aa, Homo Sapiens
ETGGNLYWG

SEQ ID NO: 306159 - protein, 9 aa, Homo Sapiens
IILAVQKKE

SEQ ID NO: 306160 - protein, 9 aa, Homo Sapiens
HETQRELRK

SEQ ID NO: 306161 - protein, 9 aa, Homo Sapiens
VEADNNTSQ

SEQ ID NO: 306162 - protein, 9 aa, Homo Sapiens
IFVKAISQD

SEQ ID NO: 306163 - protein, 9 aa, Homo Sapiens
QKLGSDVFS

SEQ ID NO: 306164 - protein, 9 aa, Homo Sapiens
RSSYDSPFP

SEQ ID NO: 306165 - protein, 9 aa, Homo Sapiens
QIDNSAAVQ

SEQ ID NO: 306166 - protein, 9 aa, Homo Sapiens
LFHQPLRLL

SEQ ID NO: 306167 - protein, 9 aa, Homo Sapiens
LTGPKFKMP

SEQ ID NO: 306168 - protein, 9 aa, Homo Sapiens
SKDKTNLSA

SEQ ID NO: 306169 - protein, 9 aa, Homo Sapiens
FLCNLDIAL

SEQ ID NO: 306170 - protein, 9 aa, Homo Sapiens
RQMRSQSES

SEQ ID NO: 306171 - protein, 9 aa, Homo Sapiens
ITKAWKFIC

SEQ ID NO: 306172 - protein, 9 aa, Homo Sapiens
AKFVDIIDA

SEQ ID NO: 306173 - protein, 9 aa, Homo Sapiens
GNSFKKPKI

SEQ ID NO: 306174 - protein, 9 aa, Homo Sapiens
IKEIEYTTL

SEQ ID NO: 306175 - protein, 9 aa, Homo Sapiens
KLITEKEDK

SEQ ID NO: 306176 - protein, 9 aa, Homo Sapiens
GNYAVKLVN

SEQ ID NO: 306177 - protein, 9 aa, Homo Sapiens
NQTSVMFNF

SEQ ID NO: 306178 - protein, 9 aa, Homo Sapiens
NHDIRSGKH

SEQ ID NO: 306179 - protein, 9 aa, Homo Sapiens
NSTVELAQT

SEQ ID NO: 306180 - protein, 9 aa, Homo Sapiens
VESDDETPL

SEQ ID NO: 306181 - protein, 9 aa, Homo Sapiens
QILFVNRPN

SEQ ID NO: 306182 - protein, 9 aa, Homo Sapiens
LTDDSLTLS

SEQ ID NO: 306183 - protein, 9 aa, Homo Sapiens
LDLNPHGFP

SEQ ID NO: 306184 - protein, 9 aa, Homo Sapiens
INSDQTTCR

SEQ ID NO: 306185 - protein, 9 aa, Homo Sapiens
TDNIFFWNQ

SEQ ID NO: 306186 - protein, 9 aa, Homo Sapiens
NYCILRVNE

SEQ ID NO: 306187 - protein, 9 aa, Homo Sapiens
LNGRLEKLP

SEQ ID NO: 306188 - protein, 9 aa, Homo Sapiens
KLEWVTKEK

SEQ ID NO: 306189 - protein, 9 aa, Homo Sapiens
NRGATTFIY

SEQ ID NO: 306190 - protein, 9 aa, Homo Sapiens
PNVLPFRGI

SEQ ID NO: 306191 - protein, 9 aa, Homo Sapiens
SIINPNKAR

SEQ ID NO: 306192 - protein, 9 aa, Homo Sapiens
KTNSAVQTC

SEQ ID NO: 306193 - protein, 9 aa, Homo Sapiens
LFSSVSCAT

SEQ ID NO: 306194 - protein, 9 aa, Homo Sapiens
TLVDPAAIP

SEQ ID NO: 306195 - protein, 9 aa, Homo Sapiens
QSDLARDLS

SEQ ID NO: 306196 - protein, 9 aa, Homo Sapiens
AVIDAYVCI

SEQ ID NO: 306197 - protein, 9 aa, Homo Sapiens
LLLLTLITA

SEQ ID NO: 306198 - protein, 9 aa, Homo Sapiens
HGANPNVRA

SEQ ID NO: 306199 - protein, 9 aa, Homo Sapiens
VNRTKEAEE

SEQ ID NO: 306200 - protein, 9 aa, Homo Sapiens
FTTFLSLTK

SEQ ID NO: 306201 - protein, 9 aa, Homo Sapiens
LSSQLEEIK

SEQ ID NO: 306202 - protein, 9 aa, Homo Sapiens
KRKYYSMFE

SEQ ID NO: 306203 - protein, 9 aa, Homo Sapiens
EAMKNTQKS

SEQ ID NO: 306204 - protein, 9 aa, Homo Sapiens
AIQYLKTIP

SEQ ID NO: 306205 - protein, 9 aa, Homo Sapiens
QKGLWRFDG

SEQ ID NO: 306206 - protein, 9 aa, Homo Sapiens
LMKAFLDKK

SEQ ID NO: 306207 - protein, 9 aa, Homo Sapiens
GSLGKSTPL

SEQ ID NO: 306208 - protein, 9 aa, Homo Sapiens
TALLIQALS

SEQ ID NO: 306209 - protein, 9 aa, Homo Sapiens
VIKEYVQQL

SEQ ID NO: 306210 - protein, 9 aa, Homo Sapiens
EYVNQLKDN

SEQ ID NO: 306211 - protein, 9 aa, Homo Sapiens
LLKQLFREL

SEQ ID NO: 306212 - protein, 9 aa, Homo Sapiens
SRHILEGDQ

SEQ ID NO: 306213 - protein, 9 aa, Homo Sapiens
THNILELKK

SEQ ID NO: 306214 - protein, 9 aa, Homo Sapiens
HKAISFWGC

SEQ ID NO: 306215 - protein, 9 aa, Homo Sapiens
FDRFASVVY

SEQ ID NO: 306216 - protein, 9 aa, Homo Sapiens
TTSQIDDSL

SEQ ID NO: 306217 - protein, 9 aa, Homo Sapiens
AHFSFTAEQ

SEQ ID NO: 306218 - protein, 9 aa, Homo Sapiens
FHNNSSLIQ

SEQ ID NO: 306219 - protein, 9 aa, Homo Sapiens
ELLTALFSA

SEQ ID NO: 306220 - protein, 9 aa, Homo Sapiens
WHAPVVPAT

SEQ ID NO: 306221 - protein, 9 aa, Homo Sapiens
IEYRKKLPH

SEQ ID NO: 306222 - protein, 9 aa, Homo Sapiens
SPQWLPCHV

SEQ ID NO: 306223 - protein, 9 aa, Homo Sapiens
YRSKSRQLL

SEQ ID NO: 306224 - protein, 9 aa, Homo Sapiens
LKTVAGLCY

SEQ ID NO: 306225 - protein, 9 aa, Homo Sapiens
IEYTTLKKS

SEQ ID NO: 306226 - protein, 9 aa, Homo Sapiens
LSQPKIGKW

SEQ ID NO: 306227 - protein, 9 aa, Homo Sapiens
PLQWVDLAH

SEQ ID NO: 306228 - protein, 9 aa, Homo Sapiens
LVDGMLSRA

SEQ ID NO: 306229 - protein, 9 aa, Homo Sapiens
PITPPGPPP

SEQ ID NO: 306230 - protein, 9 aa, Homo Sapiens
CKEIMRPVK

SEQ ID NO: 306231 - protein, 9 aa, Homo Sapiens
PQIEDADIH

SEQ ID NO: 306232 - protein, 9 aa, Homo Sapiens
RQGEDFMLH

SEQ ID NO: 306233 - protein, 9 aa, Homo Sapiens
PTSGVICTQ

SEQ ID NO: 306234 - protein, 9 aa, Homo Sapiens
LTQTHWEKF

SEQ ID NO: 306235 - protein, 9 aa, Homo Sapiens
VGKSALTIK

SEQ ID NO: 306236 - protein, 9 aa, Homo Sapiens
PEGGSGWTK

SEQ ID NO: 306237 - protein, 9 aa, Homo Sapiens
EYEGEAIPW

SEQ ID NO: 306238 - protein, 9 aa, Homo Sapiens
NILPFVAQG

SEQ ID NO: 306239 - protein, 9 aa, Homo Sapiens
CGQLQVYTY

SEQ ID NO: 306240 - protein, 9 aa, Homo Sapiens
QLAHRFTVP

SEQ ID NO: 306241 - protein, 9 aa, Homo Sapiens
CKIEYDDLV

SEQ ID NO: 306242 - protein, 9 aa, Homo Sapiens
VRLEPIRCS

SEQ ID NO: 306243 - protein, 9 aa, Homo Sapiens
PNTSTNKLL

SEQ ID NO: 306244 - protein, 9 aa, Homo Sapiens
DGLAGLPGK

SEQ ID NO: 306245 - protein, 9 aa, Homo Sapiens
GRDGRKHVV

SEQ ID NO: 306246 - protein, 9 aa, Homo Sapiens
VIPSIFDFP

SEQ ID NO: 306247 - protein, 9 aa, Homo Sapiens
KFRFDCGSG

SEQ ID NO: 306248 - protein, 9 aa, Homo Sapiens
NEPPVIQPQ

SEQ ID NO: 306249 - protein, 9 aa, Homo Sapiens
LEEPEMESL

SEQ ID NO: 306250 - protein, 9 aa, Homo Sapiens
IQFISTLLL

SEQ ID NO: 306251 - protein, 9 aa, Homo Sapiens
NQLWALPAL

SEQ ID NO: 306252 - protein, 9 aa, Homo Sapiens
LSNLNIWNI

SEQ ID NO: 306253 - protein, 9 aa, Homo Sapiens
RDYSDLKIL

SEQ ID NO: 306254 - protein, 9 aa, Homo Sapiens
AFVQKTHLI

SEQ ID NO: 306255 - protein, 9 aa, Homo Sapiens
QELWVDNST

SEQ ID NO: 306256 - protein, 9 aa, Homo Sapiens
VFLENVCYS

SEQ ID NO: 306257 - protein, 9 aa, Homo Sapiens
LVSQLIQCV

SEQ ID NO: 306258 - protein, 9 aa, Homo Sapiens
VPRNSRLLE

SEQ ID NO: 306259 - protein, 9 aa, Homo Sapiens
ESMRLDLNP

SEQ ID NO: 306260 - protein, 9 aa, Homo Sapiens
EVSVQPSVI

SEQ ID NO: 306261 - protein, 9 aa, Homo Sapiens
FGISLTGVD

SEQ ID NO: 306262 - protein, 9 aa, Homo Sapiens
YRKKWLQEW

SEQ ID NO: 306263 - protein, 9 aa, Homo Sapiens
RDFLAEKLQ

SEQ ID NO: 306264 - protein, 9 aa, Homo Sapiens
KTGIVLLPR

SEQ ID NO: 306265 - protein, 9 aa, Homo Sapiens
ELHNYQRIN

SEQ ID NO: 306266 - protein, 9 aa, Homo Sapiens
NQNHRDASS

SEQ ID NO: 306267 - protein, 9 aa, Homo Sapiens
KGQKNDKLG

SEQ ID NO: 306268 - protein, 9 aa, Homo Sapiens
TELIIFAVM

SEQ ID NO: 306269 - protein, 9 aa, Homo Sapiens
IKFQGLQQT

SEQ ID NO: 306270 - protein, 9 aa, Homo Sapiens
AKAMQTKEP

SEQ ID NO: 306271 - protein, 9 aa, Homo Sapiens
SESRRLPHS

SEQ ID NO: 306272 - protein, 9 aa, Homo Sapiens
FYPVGHPGD

SEQ ID NO: 306273 - protein, 9 aa, Homo Sapiens
PSTAINRAA

SEQ ID NO: 306274 - protein, 9 aa, Homo Sapiens
QKIYLRLKR

SEQ ID NO: 306275 - protein, 9 aa, Homo Sapiens
HGQHSPKII

SEQ ID NO: 306276 - protein, 9 aa, Homo Sapiens
AVQGQWEDV

SEQ ID NO: 306277 - protein, 9 aa, Homo Sapiens
VSLISLHEA

SEQ ID NO: 306278 - protein, 9 aa, Homo Sapiens
REKTYAHFV

SEQ ID NO: 306279 - protein, 9 aa, Homo Sapiens
TTMEMNISV

SEQ ID NO: 306280 - protein, 9 aa, Homo Sapiens
SHPSSTQIF

SEQ ID NO: 306281 - protein, 9 aa, Homo Sapiens
QNENCEEII

SEQ ID NO: 306282 - protein, 9 aa, Homo Sapiens
IRALQKVFD

SEQ ID NO: 306283 - protein, 9 aa, Homo Sapiens
PISETLSQI

SEQ ID NO: 306284 - protein, 9 aa, Homo Sapiens
LIKRGGCTF

SEQ ID NO: 306285 - protein, 9 aa, Homo Sapiens
TMVMVTTVP

SEQ ID NO: 306286 - protein, 9 aa, Homo Sapiens
RNKCGSADN

SEQ ID NO: 306287 - protein, 9 aa, Homo Sapiens
RGVGAGGRQ

SEQ ID NO: 306288 - protein, 9 aa, Homo Sapiens
QIKMYPVED

SEQ ID NO: 306289 - protein, 9 aa, Homo Sapiens
QDIILQLIK

SEQ ID NO: 306290 - protein, 9 aa, Homo Sapiens
HLRTSYKNK

SEQ ID NO: 306291 - protein, 9 aa, Homo Sapiens
PMLLKNFLQ

SEQ ID NO: 306292 - protein, 9 aa, Homo Sapiens
KDLLLDLNN

SEQ ID NO: 306293 - protein, 9 aa, Homo Sapiens
LPQELKIKC

SEQ ID NO: 306294 - protein, 9 aa, Homo Sapiens
HQTEEGSSR

SEQ ID NO: 306295 - protein, 9 aa, Homo Sapiens
NTYNETNLM

SEQ ID NO: 306296 - protein, 9 aa, Homo Sapiens
IIYIINNVF

SEQ ID NO: 306297 - protein, 9 aa, Homo Sapiens
WDDFITCLK

SEQ ID NO: 306298 - protein, 9 aa, Homo Sapiens
ALDVANKSG

SEQ ID NO: 306299 - protein, 9 aa, Homo Sapiens
PSLCQRHET

SEQ ID NO: 306300 - protein, 9 aa, Homo Sapiens
NKKVEKIRI

SEQ ID NO: 306301 - protein, 9 aa, Homo Sapiens
SSSKMKAPV

SEQ ID NO: 306302 - protein, 9 aa, Homo Sapiens
GNSTALSRL

SEQ ID NO: 306303 - protein, 9 aa, Homo Sapiens
LDCRPSLAH

SEQ ID NO: 306304 - protein, 9 aa, Homo Sapiens
FIKILKRHL

SEQ ID NO: 306305 - protein, 9 aa, Homo Sapiens
YVQVLMHDV

SEQ ID NO: 306306 - protein, 9 aa, Homo Sapiens
SLFVRDFDP

SEQ ID NO: 306307 - protein, 9 aa, Homo Sapiens
INAWNTSTS

SEQ ID NO: 306308 - protein, 9 aa, Homo Sapiens
KVNYMCWAS

SEQ ID NO: 306309 - protein, 9 aa, Homo Sapiens
IVTLDEFIE

SEQ ID NO: 306310 - protein, 9 aa, Homo Sapiens
ESSTLLTVK

SEQ ID NO: 306311 - protein, 9 aa, Homo Sapiens
ADSWLALIK

SEQ ID NO: 306312 - protein, 9 aa, Homo Sapiens
QGRRMFPLL

SEQ ID NO: 306313 - protein, 9 aa, Homo Sapiens
KLSLFVRDG

SEQ ID NO: 306314 - protein, 9 aa, Homo Sapiens
SSHQPAQSF

SEQ ID NO: 306315 - protein, 9 aa, Homo Sapiens
VKPFNQNDE

SEQ ID NO: 306316 - protein, 9 aa, Homo Sapiens
RLTREAMQN

SEQ ID NO: 306317 - protein, 9 aa, Homo Sapiens
QKQFQWLRA

SEQ ID NO: 306318 - protein, 9 aa, Homo Sapiens
TIVKETNAA

SEQ ID NO: 306319 - protein, 9 aa, Homo Sapiens
CNKLASFSF

SEQ ID NO: 306320 - protein, 9 aa, Homo Sapiens
VCNICKISV

SEQ ID NO: 306321 - protein, 9 aa, Homo Sapiens
PRETEPEGG

SEQ ID NO: 306322 - protein, 9 aa, Homo Sapiens
RKENTMADN

SEQ ID NO: 306323 - protein, 9 aa, Homo Sapiens
YHLIRGQPV

SEQ ID NO: 306324 - protein, 9 aa, Homo Sapiens
PIYLEQCQS

SEQ ID NO: 306325 - protein, 9 aa, Homo Sapiens
DKIPHVRIQ

SEQ ID NO: 306326 - protein, 9 aa, Homo Sapiens
YTLTPEMCV

SEQ ID NO: 306327 - protein, 9 aa, Homo Sapiens
IMTCGSPVI

SEQ ID NO: 306328 - protein, 9 aa, Homo Sapiens
LPSLSLENN

SEQ ID NO: 306329 - protein, 9 aa, Homo Sapiens
VQDSTGQDM

SEQ ID NO: 306330 - protein, 9 aa, Homo Sapiens
QNGKYRKYF

SEQ ID NO: 306331 - protein, 9 aa, Homo Sapiens
AHSKDKTKP

SEQ ID NO: 306332 - protein, 9 aa, Homo Sapiens
KYSPGVFSK

SEQ ID NO: 306333 - protein, 9 aa, Homo Sapiens
VSPFNIEPS

SEQ ID NO: 306334 - protein, 9 aa, Homo Sapiens
NLSKLQSGP

SEQ ID NO: 306335 - protein, 9 aa, Homo Sapiens
SKWWPTEFK

SEQ ID NO: 306336 - protein, 9 aa, Homo Sapiens
EYDPAKIIT

SEQ ID NO: 306337 - protein, 9 aa, Homo Sapiens
ARRIEFRNK

SEQ ID NO: 306338 - protein, 9 aa, Homo Sapiens
NTRIQLVFG

SEQ ID NO: 306339 - protein, 9 aa, Homo Sapiens
FQSAEAGLF

SEQ ID NO: 306340 - protein, 9 aa, Homo Sapiens
YCKGCYANN

SEQ ID NO: 306341 - protein, 9 aa, Homo Sapiens
SLLEDPNIK

SEQ ID NO: 306342 - protein, 9 aa, Homo Sapiens
GMDKGISSI

SEQ ID NO: 306343 - protein, 9 aa, Homo Sapiens
ILRINWNQY

SEQ ID NO: 306344 - protein, 9 aa, Homo Sapiens
AIKYASRSW

SEQ ID NO: 306345 - protein, 9 aa, Homo Sapiens
EKTTKGPSR

SEQ ID NO: 306346 - protein, 9 aa, Homo Sapiens
DFLPDPALV

SEQ ID NO: 306347 - protein, 9 aa, Homo Sapiens
FPKGYYTCC

SEQ ID NO: 306348 - protein, 9 aa, Homo Sapiens
KGGPLTNKQ

SEQ ID NO: 306349 - protein, 9 aa, Homo Sapiens
VIIDKVHLF

SEQ ID NO: 306350 - protein, 9 aa, Homo Sapiens
TMLESSLAD

SEQ ID NO: 306351 - protein, 9 aa, Homo Sapiens
LGDKPYRSS

SEQ ID NO: 306352 - protein, 9 aa, Homo Sapiens
RGNLLRSLV

SEQ ID NO: 306353 - protein, 9 aa, Homo Sapiens
ANKDATAEI

SEQ ID NO: 306354 - protein, 9 aa, Homo Sapiens
WVIYKIIRH

SEQ ID NO: 306355 - protein, 9 aa, Homo Sapiens
DVIGDRSIP

SEQ ID NO: 306356 - protein, 9 aa, Homo Sapiens
KDTWYDLEE

SEQ ID NO: 306357 - protein, 9 aa, Homo Sapiens
LVPESLNKD

SEQ ID NO: 306358 - protein, 9 aa, Homo Sapiens
YTIEFLWHL

SEQ ID NO: 306359 - protein, 9 aa, Homo Sapiens
GNTSFACTE

SEQ ID NO: 306360 - protein, 9 aa, Homo Sapiens
TTAMTTTLL

SEQ ID NO: 306361 - protein, 9 aa, Homo Sapiens
VFNTLNKLE

SEQ ID NO: 306362 - protein, 9 aa, Homo Sapiens
QRTHTGDKP

SEQ ID NO: 306363 - protein, 9 aa, Homo Sapiens
MQHFKITGT

SEQ ID NO: 306364 - protein, 9 aa, Homo Sapiens
YIINSDQTT

SEQ ID NO: 306365 - protein, 9 aa, Homo Sapiens
EGDQAHKEQ

SEQ ID NO: 306366 - protein, 9 aa, Homo Sapiens
HVRQQCKDI

SEQ ID NO: 306367 - protein, 9 aa, Homo Sapiens
ATSFAIKLF

SEQ ID NO: 306368 - protein, 9 aa, Homo Sapiens
MKCLGKCRG

SEQ ID NO: 306369 - protein, 9 aa, Homo Sapiens
ISDLHNCFL

SEQ ID NO: 306370 - protein, 9 aa, Homo Sapiens
DQAIKTSIL

SEQ ID NO: 306371 - protein, 9 aa, Homo Sapiens
YFVVMNPHI

SEQ ID NO: 306372 - protein, 9 aa, Homo Sapiens
LKAVEELNN

SEQ ID NO: 306373 - protein, 9 aa, Homo Sapiens
MAASLLPLV

SEQ ID NO: 306374 - protein, 9 aa, Homo Sapiens
NEEHEGFEH

SEQ ID NO: 306375 - protein, 9 aa, Homo Sapiens
ENTFCDVTV

SEQ ID NO: 306376 - protein, 9 aa, Homo Sapiens
LLAPHLQGE

SEQ ID NO: 306377 - protein, 9 aa, Homo Sapiens
LLDLFMVSI

SEQ ID NO: 306378 - protein, 9 aa, Homo Sapiens
MNKNRERFC

SEQ ID NO: 306379 - protein, 9 aa, Homo Sapiens
CTLFDMGNN

SEQ ID NO: 306380 - protein, 9 aa, Homo Sapiens
QTITIFRNS

SEQ ID NO: 306381 - protein, 9 aa, Homo Sapiens
IYRPHSPPE

SEQ ID NO: 306382 - protein, 9 aa, Homo Sapiens
QIASADGRK

SEQ ID NO: 306383 - protein, 9 aa, Homo Sapiens
SSKERQGVL

SEQ ID NO: 306384 - protein, 9 aa, Homo Sapiens
TLKGSFSLF

SEQ ID NO: 306385 - protein, 9 aa, Homo Sapiens
VHQQFQNFL

SEQ ID NO: 306386 - protein, 9 aa, Homo Sapiens
VRVIQTFNH

SEQ ID NO: 306387 - protein, 9 aa, Homo Sapiens
TLGTGAFSK

SEQ ID NO: 306388 - protein, 9 aa, Homo Sapiens
IAEKKLFTV

SEQ ID NO: 306389 - protein, 9 aa, Homo Sapiens
HEGFEHNTQ

SEQ ID NO: 306390 - protein, 9 aa, Homo Sapiens
NGFNTPWGI

SEQ ID NO: 306391 - protein, 9 aa, Homo Sapiens
QFGGQEQVR

SEQ ID NO: 306392 - protein, 9 aa, Homo Sapiens
LARHHILHA

SEQ ID NO: 306393 - protein, 9 aa, Homo Sapiens
DLKHANVVT

SEQ ID NO: 306394 - protein, 9 aa, Homo Sapiens
QALVSEEGE

SEQ ID NO: 306395 - protein, 9 aa, Homo Sapiens
CLQEAKILK

SEQ ID NO: 306396 - protein, 9 aa, Homo Sapiens
ELARHQSIH

SEQ ID NO: 306397 - protein, 9 aa, Homo Sapiens
ADDHRYKLC

SEQ ID NO: 306398 - protein, 9 aa, Homo Sapiens
MLIIRTNRT

SEQ ID NO: 306399 - protein, 9 aa, Homo Sapiens
PVKISRMEE

SEQ ID NO: 306400 - protein, 9 aa, Homo Sapiens
LEKILTMLT

SEQ ID NO: 306401 - protein, 9 aa, Homo Sapiens
EKRKGKCRH

SEQ ID NO: 306402 - protein, 9 aa, Homo Sapiens
VNTRARHHV

SEQ ID NO: 306403 - protein, 9 aa, Homo Sapiens
LINQTVMSK

SEQ ID NO: 306404 - protein, 9 aa, Homo Sapiens
VQMRGKRRP

SEQ ID NO: 306405 - protein, 9 aa, Homo Sapiens
LLRHQRTHA

SEQ ID NO: 306406 - protein, 9 aa, Homo Sapiens
CNNTYNETN

SEQ ID NO: 306407 - protein, 9 aa, Homo Sapiens
NMMRPGVFA

SEQ ID NO: 306408 - protein, 9 aa, Homo Sapiens
TALIEEIIN

SEQ ID NO: 306409 - protein, 9 aa, Homo Sapiens
PDFIILGLF

SEQ ID NO: 306410 - protein, 9 aa, Homo Sapiens
AQSLSRALF

SEQ ID NO: 306411 - protein, 9 aa, Homo Sapiens
VQMGMGAVF

SEQ ID NO: 306412 - protein, 9 aa, Homo Sapiens
EYFKSSCYF

SEQ ID NO: 306413 - protein, 9 aa, Homo Sapiens
LSSPGVNQV

SEQ ID NO: 306414 - protein, 9 aa, Homo Sapiens
RQKQKQMKY

SEQ ID NO: 306415 - protein, 9 aa, Homo Sapiens
WPATQPLPG

SEQ ID NO: 306416 - protein, 9 aa, Homo Sapiens
ECNEILEWV

SEQ ID NO: 306417 - protein, 9 aa, Homo Sapiens
VHAGTRRMK

SEQ ID NO: 306418 - protein, 9 aa, Homo Sapiens
YKEQKLRFA

SEQ ID NO: 306419 - protein, 9 aa, Homo Sapiens
AESLQQVWQ

SEQ ID NO: 306420 - protein, 9 aa, Homo Sapiens
STYTEKEKL

SEQ ID NO: 306421 - protein, 9 aa, Homo Sapiens
PMCREFLSE

SEQ ID NO: 306422 - protein, 9 aa, Homo Sapiens
GRDWNIGPQ

SEQ ID NO: 306423 - protein, 9 aa, Homo Sapiens
YVDGSEGIG

SEQ ID NO: 306424 - protein, 9 aa, Homo Sapiens
GMLLSEDEN

SEQ ID NO: 306425 - protein, 9 aa, Homo Sapiens
RLFGGNCAH

SEQ ID NO: 306426 - protein, 9 aa, Homo Sapiens
VHFHPIYRG

SEQ ID NO: 306427 - protein, 9 aa, Homo Sapiens
QHCRDIFGK

SEQ ID NO: 306428 - protein, 9 aa, Homo Sapiens
SECDAAKHR

SEQ ID NO: 306429 - protein, 9 aa, Homo Sapiens
LEGDQVSRR

SEQ ID NO: 306430 - protein, 9 aa, Homo Sapiens
GFYCGGKMA

SEQ ID NO: 306431 - protein, 9 aa, Homo Sapiens
KLPAGSQCS

SEQ ID NO: 306432 - protein, 9 aa, Homo Sapiens
SDDNVDSDS

SEQ ID NO: 306433 - protein, 9 aa, Homo Sapiens
DCLVILLRE

SEQ ID NO: 306434 - protein, 9 aa, Homo Sapiens
EREQEQQRH

SEQ ID NO: 306435 - protein, 9 aa, Homo Sapiens
GGHVKFRFD

SEQ ID NO: 306436 - protein, 9 aa, Homo Sapiens
NRLSSYTRL

SEQ ID NO: 306437 - protein, 9 aa, Homo Sapiens
PESIHKWRE

SEQ ID NO: 306438 - protein, 9 aa, Homo Sapiens
RAAIQELQH

SEQ ID NO: 306439 - protein, 9 aa, Homo Sapiens
LLAEPQELW

SEQ ID NO: 306440 - protein, 9 aa, Homo Sapiens
CMLLKEFLR

SEQ ID NO: 306441 - protein, 9 aa, Homo Sapiens
SGIVSIIYS

SEQ ID NO: 306442 - protein, 9 aa, Homo Sapiens
GSLSSKMLS

SEQ ID NO: 306443 - protein, 9 aa, Homo Sapiens
ETIYSAERF

SEQ ID NO: 306444 - protein, 9 aa, Homo Sapiens
FMADPCLSL

SEQ ID NO: 306445 - protein, 9 aa, Homo Sapiens
DMETLVREK

SEQ ID NO: 306446 - protein, 9 aa, Homo Sapiens
LIYWLQNLR

SEQ ID NO: 306447 - protein, 9 aa, Homo Sapiens
RKQNVLELE

SEQ ID NO: 306448 - protein, 9 aa, Homo Sapiens
PNEHNNQIE

SEQ ID NO: 306449 - protein, 9 aa, Homo Sapiens
KKHKAISFW

SEQ ID NO: 306450 - protein, 9 aa, Homo Sapiens
YKDADYRLR

SEQ ID NO: 306451 - protein, 9 aa, Homo Sapiens
QQCETFIPY

SEQ ID NO: 306452 - protein, 9 aa, Homo Sapiens
IHLLEGNEC

SEQ ID NO: 306453 - protein, 9 aa, Homo Sapiens
DLRTSPDKR

SEQ ID NO: 306454 - protein, 9 aa, Homo Sapiens
QTPAGLMVS

SEQ ID NO: 306455 - protein, 9 aa, Homo Sapiens
SFHGCMGQL

SEQ ID NO: 306456 - protein, 9 aa, Homo Sapiens
RINNTNVPD

SEQ ID NO: 306457 - protein, 9 aa, Homo Sapiens
QTLVEDVQL

SEQ ID NO: 306458 - protein, 9 aa, Homo Sapiens
MKSGSLAAE

SEQ ID NO: 306459 - protein, 9 aa, Homo Sapiens
NYLPKPKLP

SEQ ID NO: 306460 - protein, 9 aa, Homo Sapiens
VKAIDFGSA

SEQ ID NO: 306461 - protein, 9 aa, Homo Sapiens
DSCILECKV

SEQ ID NO: 306462 - protein, 9 aa, Homo Sapiens
YVFSDSAAI

SEQ ID NO: 306463 - protein, 9 aa, Homo Sapiens
QRQKVVEKE

SEQ ID NO: 306464 - protein, 9 aa, Homo Sapiens
FTLSAHLIT

SEQ ID NO: 306465 - protein, 9 aa, Homo Sapiens
FYMAYERGR

SEQ ID NO: 306466 - protein, 9 aa, Homo Sapiens
TLVKCECAQ

SEQ ID NO: 306467 - protein, 9 aa, Homo Sapiens
RSLGIYTFG

SEQ ID NO: 306468 - protein, 9 aa, Homo Sapiens
QTSLDSNEN

SEQ ID NO: 306469 - protein, 9 aa, Homo Sapiens
QILCLIEQI

SEQ ID NO: 306470 - protein, 9 aa, Homo Sapiens
GRQGEDQEH

SEQ ID NO: 306471 - protein, 9 aa, Homo Sapiens
SSTQIIVQG

SEQ ID NO: 306472 - protein, 9 aa, Homo Sapiens
YEDEKLIPS

SEQ ID NO: 306473 - protein, 9 aa, Homo Sapiens
KDEDATSLG

SEQ ID NO: 306474 - protein, 9 aa, Homo Sapiens
LLFCPSNKW

SEQ ID NO: 306475 - protein, 9 aa, Homo Sapiens
SDSILGNKP

SEQ ID NO: 306476 - protein, 9 aa, Homo Sapiens
CDISYVLAT

SEQ ID NO: 306477 - protein, 9 aa, Homo Sapiens
YEQFMSGKV

SEQ ID NO: 306478 - protein, 9 aa, Homo Sapiens
RKYFVLNFN

SEQ ID NO: 306479 - protein, 9 aa, Homo Sapiens
QLLELHQQC

SEQ ID NO: 306480 - protein, 9 aa, Homo Sapiens
QCHQPSDLH

SEQ ID NO: 306481 - protein, 9 aa, Homo Sapiens
QSALAIVQN

SEQ ID NO: 306482 - protein, 9 aa, Homo Sapiens
MYFINQILF

SEQ ID NO: 306483 - protein, 9 aa, Homo Sapiens
FPEVQIMPS

SEQ ID NO: 306484 - protein, 9 aa, Homo Sapiens
IYSGIALFP

SEQ ID NO: 306485 - protein, 9 aa, Homo Sapiens
TNTPSLDQQ

SEQ ID NO: 306486 - protein, 9 aa, Homo Sapiens
LVRHQITHT

SEQ ID NO: 306487 - protein, 9 aa, Homo Sapiens
PLLKKFLKN

SEQ ID NO: 306488 - protein, 9 aa, Homo Sapiens
EKKLLASDS

SEQ ID NO: 306489 - protein, 9 aa, Homo Sapiens
KCLQILLKG

SEQ ID NO: 306490 - protein, 9 aa, Homo Sapiens
KQNQARLYD

SEQ ID NO: 306491 - protein, 9 aa, Homo Sapiens
HSSGCCSQP

SEQ ID NO: 306492 - protein, 9 aa, Homo Sapiens
IQPIKCLIK

SEQ ID NO: 306493 - protein, 9 aa, Homo Sapiens
SISKTITML

SEQ ID NO: 306494 - protein, 9 aa, Homo Sapiens
SPACLAASF

SEQ ID NO: 306495 - protein, 9 aa, Homo Sapiens
PVTDIEVET

SEQ ID NO: 306496 - protein, 9 aa, Homo Sapiens
RQNSNIVNH

SEQ ID NO: 306497 - protein, 9 aa, Homo Sapiens
LYGLFKNGK

SEQ ID NO: 306498 - protein, 9 aa, Homo Sapiens
KCHKLLFAI

SEQ ID NO: 306499 - protein, 9 aa, Homo Sapiens
GLKKDNVIF

SEQ ID NO: 306500 - protein, 9 aa, Homo Sapiens
IILAIIQGL

SEQ ID NO: 306501 - protein, 9 aa, Homo Sapiens
QYYLYRSKS

SEQ ID NO: 306502 - protein, 9 aa, Homo Sapiens
VIQVNYWVG

SEQ ID NO: 306503 - protein, 9 aa, Homo Sapiens
LQQPTDKVL

SEQ ID NO: 306504 - protein, 9 aa, Homo Sapiens
DQVSRRGAL

SEQ ID NO: 306505 - protein, 9 aa, Homo Sapiens
EPPNDVFDE

SEQ ID NO: 306506 - protein, 9 aa, Homo Sapiens
QNYLKERGD

SEQ ID NO: 306507 - protein, 9 aa, Homo Sapiens
ETIIKEKKT

SEQ ID NO: 306508 - protein, 9 aa, Homo Sapiens
DVNSEKLTT

SEQ ID NO: 306509 - protein, 9 aa, Homo Sapiens
YYSCLDNKK

SEQ ID NO: 306510 - protein, 9 aa, Homo Sapiens
EKRSWQESN

SEQ ID NO: 306511 - protein, 9 aa, Homo Sapiens
DFLYGLFKN

SEQ ID NO: 306512 - protein, 9 aa, Homo Sapiens
ELQKRMNKQ

SEQ ID NO: 306513 - protein, 9 aa, Homo Sapiens
LLINQTVMS

SEQ ID NO: 306514 - protein, 9 aa, Homo Sapiens
QTFLKRHDK

SEQ ID NO: 306515 - protein, 9 aa, Homo Sapiens
AVDTATTSD

SEQ ID NO: 306516 - protein, 9 aa, Homo Sapiens
RCKQGYIIN

SEQ ID NO: 306517 - protein, 9 aa, Homo Sapiens
HLKVLEICD

SEQ ID NO: 306518 - protein, 9 aa, Homo Sapiens
FTQHIFVKI

SEQ ID NO: 306519 - protein, 9 aa, Homo Sapiens
KNPFLVSFF

SEQ ID NO: 306520 - protein, 9 aa, Homo Sapiens
IEVPQSFCS

SEQ ID NO: 306521 - protein, 9 aa, Homo Sapiens
IVGLDQMVK

SEQ ID NO: 306522 - protein, 9 aa, Homo Sapiens
QTLLDDATK

SEQ ID NO: 306523 - protein, 9 aa, Homo Sapiens
MILSDMNTV

SEQ ID NO: 306524 - protein, 9 aa, Homo Sapiens
NIYDLCNKL

SEQ ID NO: 306525 - protein, 9 aa, Homo Sapiens
KITRIEGKE

SEQ ID NO: 306526 - protein, 9 aa, Homo Sapiens
LPEEEDGLR

SEQ ID NO: 306527 - protein, 9 aa, Homo Sapiens
NCGIWQPKY

SEQ ID NO: 306528 - protein, 9 aa, Homo Sapiens
REEQLRDLI

SEQ ID NO: 306529 - protein, 9 aa, Homo Sapiens
TADVKGGSF

SEQ ID NO: 306530 - protein, 9 aa, Homo Sapiens
ATTPAPRVR

SEQ ID NO: 306531 - protein, 9 aa, Homo Sapiens
RCPVKLYEF

SEQ ID NO: 306532 - protein, 9 aa, Homo Sapiens
DLSAHCSIQ

SEQ ID NO: 306533 - protein, 9 aa, Homo Sapiens
PVCPDKQDV

SEQ ID NO: 306534 - protein, 9 aa, Homo Sapiens
LELARSYPR

SEQ ID NO: 306535 - protein, 9 aa, Homo Sapiens
SDLAQPDPE

SEQ ID NO: 306536 - protein, 9 aa, Homo Sapiens
KIKCLQEAK

SEQ ID NO: 306537 - protein, 9 aa, Homo Sapiens
DPANAKCYE

SEQ ID NO: 306538 - protein, 9 aa, Homo Sapiens
TPELLSPVC

SEQ ID NO: 306539 - protein, 9 aa, Homo Sapiens
MLVSVSHGS

SEQ ID NO: 306540 - protein, 9 aa, Homo Sapiens
QNLRYYFKL

SEQ ID NO: 306541 - protein, 9 aa, Homo Sapiens
AQECLFHRE

SEQ ID NO: 306542 - protein, 9 aa, Homo Sapiens
RNLGDSLHQ

SEQ ID NO: 306543 - protein, 9 aa, Homo Sapiens
LEIANNLVL

SEQ ID NO: 306544 - protein, 9 aa, Homo Sapiens
QINRDQLQK

SEQ ID NO: 306545 - protein, 9 aa, Homo Sapiens
GDKIFGDLS

SEQ ID NO: 306546 - protein, 9 aa, Homo Sapiens
TLPSVELLF

SEQ ID NO: 306547 - protein, 9 aa, Homo Sapiens
LPFHTFALE

SEQ ID NO: 306548 - protein, 9 aa, Homo Sapiens
KASTYLPGE

SEQ ID NO: 306549 - protein, 9 aa, Homo Sapiens
VFRQNSNIV

SEQ ID NO: 306550 - protein, 9 aa, Homo Sapiens
HPGDVSFGD

SEQ ID NO: 306551 - protein, 9 aa, Homo Sapiens
WTTLYGEID

SEQ ID NO: 306552 - protein, 9 aa, Homo Sapiens
CTSSGNRDN

SEQ ID NO: 306553 - protein, 9 aa, Homo Sapiens
NCSSDIIVH

SEQ ID NO: 306554 - protein, 9 aa, Homo Sapiens
AEVLPRNIA

SEQ ID NO: 306555 - protein, 9 aa, Homo Sapiens
PEVQHVDLE

SEQ ID NO: 306556 - protein, 9 aa, Homo Sapiens
LYWAVLSEY

SEQ ID NO: 306557 - protein, 9 aa, Homo Sapiens
EGGLFGFYR

SEQ ID NO: 306558 - protein, 9 aa, Homo Sapiens
KAAKVQELS

SEQ ID NO: 306559 - protein, 9 aa, Homo Sapiens
IFNPPADAW

SEQ ID NO: 306560 - protein, 9 aa, Homo Sapiens
NLLFTAKVL

SEQ ID NO: 306561 - protein, 9 aa, Homo Sapiens
FVAPLILLV

SEQ ID NO: 306562 - protein, 9 aa, Homo Sapiens
DNQASWIHC

SEQ ID NO: 306563 - protein, 9 aa, Homo Sapiens
LRSLFVCLM

SEQ ID NO: 306564 - protein, 9 aa, Homo Sapiens
QSASSSSDE

SEQ ID NO: 306565 - protein, 9 aa, Homo Sapiens
IVRVKEDEN

SEQ ID NO: 306566 - protein, 9 aa, Homo Sapiens
RSRKISDGK

SEQ ID NO: 306567 - protein, 9 aa, Homo Sapiens
NYNDTFTVK

SEQ ID NO: 306568 - protein, 9 aa, Homo Sapiens
QNTDDMGLK

SEQ ID NO: 306569 - protein, 9 aa, Homo Sapiens
AVFMQFCAN

SEQ ID NO: 306570 - protein, 9 aa, Homo Sapiens
DDSWDTNYA

SEQ ID NO: 306571 - protein, 9 aa, Homo Sapiens
RAASHKLTV

SEQ ID NO: 306572 - protein, 9 aa, Homo Sapiens
IPTSGLSGD

SEQ ID NO: 306573 - protein, 9 aa, Homo Sapiens
SCGTEGFWN

SEQ ID NO: 306574 - protein, 9 aa, Homo Sapiens
YLHTLTSEY

SEQ ID NO: 306575 - protein, 9 aa, Homo Sapiens
KNGDQYTNG

SEQ ID NO: 306576 - protein, 9 aa, Homo Sapiens
NGASTLSQL

SEQ ID NO: 306577 - protein, 9 aa, Homo Sapiens
PNCDGPLKF

SEQ ID NO: 306578 - protein, 9 aa, Homo Sapiens
NGVREELEV

SEQ ID NO: 306579 - protein, 9 aa, Homo Sapiens
IQMDLHLHT

SEQ ID NO: 306580 - protein, 9 aa, Homo Sapiens
PDPEVRRAA

SEQ ID NO: 306581 - protein, 9 aa, Homo Sapiens
HIQDQLGLS

SEQ ID NO: 306582 - protein, 9 aa, Homo Sapiens
CPSECTCYR

SEQ ID NO: 306583 - protein, 9 aa, Homo Sapiens
SQHQISEDV

SEQ ID NO: 306584 - protein, 9 aa, Homo Sapiens
RLFPSSFTE

SEQ ID NO: 306585 - protein, 9 aa, Homo Sapiens
LRHGHVRLL

SEQ ID NO: 306586 - protein, 9 aa, Homo Sapiens
NDVFDELFK

SEQ ID NO: 306587 - protein, 9 aa, Homo Sapiens
AASFLKKRG

SEQ ID NO: 306588 - protein, 9 aa, Homo Sapiens
KKVDRYIEE

SEQ ID NO: 306589 - protein, 9 aa, Homo Sapiens
EQPESLQAQ

SEQ ID NO: 306590 - protein, 9 aa, Homo Sapiens
EDICQMALN

SEQ ID NO: 306591 - protein, 9 aa, Homo Sapiens
LELHQQCET

SEQ ID NO: 306592 - protein, 9 aa, Homo Sapiens
YYLQYKHVR

SEQ ID NO: 306593 - protein, 9 aa, Homo Sapiens
IILDAQHES

SEQ ID NO: 306594 - protein, 9 aa, Homo Sapiens
GNFTTRYIT

SEQ ID NO: 306595 - protein, 9 aa, Homo Sapiens
PGFKRLSCL

SEQ ID NO: 306596 - protein, 9 aa, Homo Sapiens
FHSTTAVSD

SEQ ID NO: 306597 - protein, 9 aa, Homo Sapiens
FLIMLGCFQ

SEQ ID NO: 306598 - protein, 9 aa, Homo Sapiens
SVTGVHMNI

SEQ ID NO: 306599 - protein, 9 aa, Homo Sapiens
YESSSIYIL

SEQ ID NO: 306600 - protein, 9 aa, Homo Sapiens
APFAMINVY

SEQ ID NO: 306601 - protein, 9 aa, Homo Sapiens
YVVSTRLPC

SEQ ID NO: 306602 - protein, 9 aa, Homo Sapiens
LEWLAQEEA

SEQ ID NO: 306603 - protein, 9 aa, Homo Sapiens
EVQRLAKKI

SEQ ID NO: 306604 - protein, 9 aa, Homo Sapiens
HEAFIQSIL

SEQ ID NO: 306605 - protein, 9 aa, Homo Sapiens
TFNEVQSQN

SEQ ID NO: 306606 - protein, 9 aa, Homo Sapiens
DKANKFTID

SEQ ID NO: 306607 - protein, 9 aa, Homo Sapiens
SHSIHNFTE

SEQ ID NO: 306608 - protein, 9 aa, Homo Sapiens
NTQKSVTAK

SEQ ID NO: 306609 - protein, 9 aa, Homo Sapiens
KIITLREAL

SEQ ID NO: 306610 - protein, 9 aa, Homo Sapiens
SCQEGKTKD

SEQ ID NO: 306611 - protein, 9 aa, Homo Sapiens
ATSLPVHNS

SEQ ID NO: 306612 - protein, 9 aa, Homo Sapiens
ESLCPAFPR

SEQ ID NO: 306613 - protein, 9 aa, Homo Sapiens
CAVATEYMT

SEQ ID NO: 306614 - protein, 9 aa, Homo Sapiens
PDPTRLIVV

SEQ ID NO: 306615 - protein, 9 aa, Homo Sapiens
TQTSLDSNE

SEQ ID NO: 306616 - protein, 9 aa, Homo Sapiens
YKTKFSETA

SEQ ID NO: 306617 - protein, 9 aa, Homo Sapiens
HKMMNEKAW

SEQ ID NO: 306618 - protein, 9 aa, Homo Sapiens
KCIYVVQAY

SEQ ID NO: 306619 - protein, 9 aa, Homo Sapiens
NVSGKLFEY

SEQ ID NO: 306620 - protein, 9 aa, Homo Sapiens
DKIKANGGL

SEQ ID NO: 306621 - protein, 9 aa, Homo Sapiens
EAKKADNSS

SEQ ID NO: 306622 - protein, 9 aa, Homo Sapiens
WEEYKTGIN

SEQ ID NO: 306623 - protein, 9 aa, Homo Sapiens
KVTKLNNVK

SEQ ID NO: 306624 - protein, 9 aa, Homo Sapiens
GVKRTELLP

SEQ ID NO: 306625 - protein, 9 aa, Homo Sapiens
YPLYKQDSS

SEQ ID NO: 306626 - protein, 9 aa, Homo Sapiens
AVATEYMTF

SEQ ID NO: 306627 - protein, 9 aa, Homo Sapiens
EEKLYKIEC

SEQ ID NO: 306628 - protein, 9 aa, Homo Sapiens
VKCECAQSE

SEQ ID NO: 306629 - protein, 9 aa, Homo Sapiens
SFELIQKEK

SEQ ID NO: 306630 - protein, 9 aa, Homo Sapiens
FNITEDRAA

SEQ ID NO: 306631 - protein, 9 aa, Homo Sapiens
DINIMLVKT

SEQ ID NO: 306632 - protein, 9 aa, Homo Sapiens
VCAKCSKPL

SEQ ID NO: 306633 - protein, 9 aa, Homo Sapiens
GNIQMNAPS

SEQ ID NO: 306634 - protein, 9 aa, Homo Sapiens
GLNQYLTST

SEQ ID NO: 306635 - protein, 9 aa, Homo Sapiens
FNHTHLYVC

SEQ ID NO: 306636 - protein, 9 aa, Homo Sapiens
KGRISWAGD

SEQ ID NO: 306637 - protein, 9 aa, Homo Sapiens
LRCPVKLYE

SEQ ID NO: 306638 - protein, 9 aa, Homo Sapiens
RTSYDTTLD

SEQ ID NO: 306639 - protein, 9 aa, Homo Sapiens
ASLNKSADD

SEQ ID NO: 306640 - protein, 9 aa, Homo Sapiens
NVQHLSDPD

SEQ ID NO: 306641 - protein, 9 aa, Homo Sapiens
EDAITNFRA

SEQ ID NO: 306642 - protein, 9 aa, Homo Sapiens
GHCECGHCH

SEQ ID NO: 306643 - protein, 9 aa, Homo Sapiens
PGVAVMQLN

SEQ ID NO: 306644 - protein, 9 aa, Homo Sapiens
FKNFYSISA

SEQ ID NO: 306645 - protein, 9 aa, Homo Sapiens
LKLSFTPPF

SEQ ID NO: 306646 - protein, 9 aa, Homo Sapiens
AQMVMAHLV

SEQ ID NO: 306647 - protein, 9 aa, Homo Sapiens
QRRFQQPQR

SEQ ID NO: 306648 - protein, 9 aa, Homo Sapiens
LSTKSCRVS

SEQ ID NO: 306649 - protein, 9 aa, Homo Sapiens
MKIFNPPAD

SEQ ID NO: 306650 - protein, 9 aa, Homo Sapiens
SSLVITTTL

SEQ ID NO: 306651 - protein, 9 aa, Homo Sapiens
RDHSKNVTS

SEQ ID NO: 306652 - protein, 9 aa, Homo Sapiens
FTELIVTDN

SEQ ID NO: 306653 - protein, 9 aa, Homo Sapiens
ILQIASADG

SEQ ID NO: 306654 - protein, 9 aa, Homo Sapiens
GEGETKFNK

SEQ ID NO: 306655 - protein, 9 aa, Homo Sapiens
SLFYGTLLF

SEQ ID NO: 306656 - protein, 9 aa, Homo Sapiens
PLGLDNGNI

SEQ ID NO: 306657 - protein, 9 aa, Homo Sapiens
IAQPVRSFI

SEQ ID NO: 306658 - protein, 9 aa, Homo Sapiens
LSRDGNALE

SEQ ID NO: 306659 - protein, 9 aa, Homo Sapiens
VYLAKKQDV

SEQ ID NO: 306660 - protein, 9 aa, Homo Sapiens
HCRDIFGKD

SEQ ID NO: 306661 - protein, 9 aa, Homo Sapiens
AKVIHETWK

SEQ ID NO: 306662 - protein, 9 aa, Homo Sapiens
KQEDSKIKY

SEQ ID NO: 306663 - protein, 9 aa, Homo Sapiens
VVPNLGVAV

SEQ ID NO: 306664 - protein, 9 aa, Homo Sapiens
MPINTLSGI

SEQ ID NO: 306665 - protein, 9 aa, Homo Sapiens
RSTQTRLST

SEQ ID NO: 306666 - protein, 9 aa, Homo Sapiens
CETFIPYSQ

SEQ ID NO: 306667 - protein, 9 aa, Homo Sapiens
CEANKLVIL

SEQ ID NO: 306668 - protein, 9 aa, Homo Sapiens
TCTRVENCY

SEQ ID NO: 306669 - protein, 9 aa, Homo Sapiens
MSQGNISKA

SEQ ID NO: 306670 - protein, 9 aa, Homo Sapiens
WCVCKLQWC

SEQ ID NO: 306671 - protein, 9 aa, Homo Sapiens
KRDPALKIK

SEQ ID NO: 306672 - protein, 9 aa, Homo Sapiens
WWSSDDNVD

SEQ ID NO: 306673 - protein, 9 aa, Homo Sapiens
NIKFYSAPV

SEQ ID NO: 306674 - protein, 9 aa, Homo Sapiens
ITIEPSIYI

SEQ ID NO: 306675 - protein, 9 aa, Homo Sapiens
QDKTGSFQI

SEQ ID NO: 306676 - protein, 9 aa, Homo Sapiens
QTSISELYV

SEQ ID NO: 306677 - protein, 9 aa, Homo Sapiens
PLLPYDPAK

SEQ ID NO: 306678 - protein, 9 aa, Homo Sapiens
HCEHQSPVQ

SEQ ID NO: 306679 - protein, 9 aa, Homo Sapiens
DETLFGVQW

SEQ ID NO: 306680 - protein, 9 aa, Homo Sapiens
SSQHEAFIQ

SEQ ID NO: 306681 - protein, 9 aa, Homo Sapiens
YINDNPPTC

SEQ ID NO: 306682 - protein, 9 aa, Homo Sapiens
KMAFFYCKA

SEQ ID NO: 306683 - protein, 9 aa, Homo Sapiens
LSLKLKLGL

SEQ ID NO: 306684 - protein, 9 aa, Homo Sapiens
SAPLNFIPR

SEQ ID NO: 306685 - protein, 9 aa, Homo Sapiens
SLAKKESFG

SEQ ID NO: 306686 - protein, 9 aa, Homo Sapiens
KKQRTKDIS

SEQ ID NO: 306687 - protein, 9 aa, Homo Sapiens
MNNFNIKEN

SEQ ID NO: 306688 - protein, 9 aa, Homo Sapiens
LRRGLSISG

SEQ ID NO: 306689 - protein, 9 aa, Homo Sapiens
EYRKKLPHE

SEQ ID NO: 306690 - protein, 9 aa, Homo Sapiens
DCDECHSNP

SEQ ID NO: 306691 - protein, 9 aa, Homo Sapiens
ADKQLLYSE

SEQ ID NO: 306692 - protein, 9 aa, Homo Sapiens
YVAGFAETV

SEQ ID NO: 306693 - protein, 9 aa, Homo Sapiens
SAIDVDKVV

SEQ ID NO: 306694 - protein, 9 aa, Homo Sapiens
RNLLEKETT

SEQ ID NO: 306695 - protein, 9 aa, Homo Sapiens
LTFFLPLGA

SEQ ID NO: 306696 - protein, 9 aa, Homo Sapiens
RVRGRQCPW

SEQ ID NO: 306697 - protein, 9 aa, Homo Sapiens
KKYTVKAEI

SEQ ID NO: 306698 - protein, 9 aa, Homo Sapiens
VPKAKVLVP

SEQ ID NO: 306699 - protein, 9 aa, Homo Sapiens
SIALEILQN

SEQ ID NO: 306700 - protein, 9 aa, Homo Sapiens
NDHLRCEDL

SEQ ID NO: 306701 - protein, 9 aa, Homo Sapiens
RRIVHLVGI

SEQ ID NO: 306702 - protein, 9 aa, Homo Sapiens
GKQKVINTP

SEQ ID NO: 306703 - protein, 9 aa, Homo Sapiens
RRSTKKRRI

SEQ ID NO: 306704 - protein, 9 aa, Homo Sapiens
IITTILKFP

SEQ ID NO: 306705 - protein, 9 aa, Homo Sapiens
LIALFCITN

SEQ ID NO: 306706 - protein, 9 aa, Homo Sapiens
VISVLLNEL

SEQ ID NO: 306707 - protein, 9 aa, Homo Sapiens
REQEEKMQE

SEQ ID NO: 306708 - protein, 9 aa, Homo Sapiens
SPHKCLLKG

SEQ ID NO: 306709 - protein, 9 aa, Homo Sapiens
KEFSERKSS

SEQ ID NO: 306710 - protein, 9 aa, Homo Sapiens
YQNIFSCLP

SEQ ID NO: 306711 - protein, 9 aa, Homo Sapiens
REQHDALAF

SEQ ID NO: 306712 - protein, 9 aa, Homo Sapiens
DVIYRPHSP

SEQ ID NO: 306713 - protein, 9 aa, Homo Sapiens
INLESQIKC

SEQ ID NO: 306714 - protein, 9 aa, Homo Sapiens
TADFREQIV

SEQ ID NO: 306715 - protein, 9 aa, Homo Sapiens
SDEQKMAHK

SEQ ID NO: 306716 - protein, 9 aa, Homo Sapiens
NVGYVFLFT

SEQ ID NO: 306717 - protein, 9 aa, Homo Sapiens
KRTITQNVL

SEQ ID NO: 306718 - protein, 9 aa, Homo Sapiens
VKVLYVRTL

SEQ ID NO: 306719 - protein, 9 aa, Homo Sapiens
LRHQRTHAG

SEQ ID NO: 306720 - protein, 9 aa, Homo Sapiens
PIEAHFLPF

SEQ ID NO: 306721 - protein, 9 aa, Homo Sapiens
CSRKIALQD

SEQ ID NO: 306722 - protein, 9 aa, Homo Sapiens
EKCAKHKRF

SEQ ID NO: 306723 - protein, 9 aa, Homo Sapiens
FILHNFNLK

SEQ ID NO: 306724 - protein, 9 aa, Homo Sapiens
QNNEITTIK

SEQ ID NO: 306725 - protein, 9 aa, Homo Sapiens
NNLVGCIIG

SEQ ID NO: 306726 - protein, 9 aa, Homo Sapiens
MLDFQTSKF

SEQ ID NO: 306727 - protein, 9 aa, Homo Sapiens
AQYGFALFT

SEQ ID NO: 306728 - protein, 9 aa, Homo Sapiens
VKIIYKKIE

SEQ ID NO: 306729 - protein, 9 aa, Homo Sapiens
EEIGNRYIK

SEQ ID NO: 306730 - protein, 9 aa, Homo Sapiens
LYRNVMLES

SEQ ID NO: 306731 - protein, 9 aa, Homo Sapiens
IYTVPWINY

SEQ ID NO: 306732 - protein, 9 aa, Homo Sapiens
PVEDDSDAD

SEQ ID NO: 306733 - protein, 9 aa, Homo Sapiens
TITRKVDTG

SEQ ID NO: 306734 - protein, 9 aa, Homo Sapiens
CLSSVEGSK

SEQ ID NO: 306735 - protein, 9 aa, Homo Sapiens
LMEAIWGSS

SEQ ID NO: 306736 - protein, 9 aa, Homo Sapiens
VSSRGDNLV

SEQ ID NO: 306737 - protein, 9 aa, Homo Sapiens
IAHKLFGAE

SEQ ID NO: 306738 - protein, 9 aa, Homo Sapiens
GKMNDRLDP

SEQ ID NO: 306739 - protein, 9 aa, Homo Sapiens
TVVSDEDKA

SEQ ID NO: 306740 - protein, 9 aa, Homo Sapiens
DSDADTYGE

SEQ ID NO: 306741 - protein, 9 aa, Homo Sapiens
RYNVSVEEF

SEQ ID NO: 306742 - protein, 9 aa, Homo Sapiens
DDATKLWGI

SEQ ID NO: 306743 - protein, 9 aa, Homo Sapiens
TMDSVRSGL

SEQ ID NO: 306744 - protein, 9 aa, Homo Sapiens
QQWLLKNRL

SEQ ID NO: 306745 - protein, 9 aa, Homo Sapiens
ALSWTFLGR

SEQ ID NO: 306746 - protein, 9 aa, Homo Sapiens
EWLNTCFDI

SEQ ID NO: 306747 - protein, 9 aa, Homo Sapiens
TVPVTDIEV

SEQ ID NO: 306748 - protein, 9 aa, Homo Sapiens
AFVSHMGTS

SEQ ID NO: 306749 - protein, 9 aa, Homo Sapiens
EPVVAGEDF

SEQ ID NO: 306750 - protein, 9 aa, Homo Sapiens
AFICLQCWC

SEQ ID NO: 306751 - protein, 9 aa, Homo Sapiens
PRSDFYMAY

SEQ ID NO: 306752 - protein, 9 aa, Homo Sapiens
DLSSEFPDK

SEQ ID NO: 306753 - protein, 9 aa, Homo Sapiens
KTSGPTRGK

SEQ ID NO: 306754 - protein, 9 aa, Homo Sapiens
QEALQYAKN

SEQ ID NO: 306755 - protein, 9 aa, Homo Sapiens
QEARVLLKR

SEQ ID NO: 306756 - protein, 9 aa, Homo Sapiens
LLKRNNVSA

SEQ ID NO: 306757 - protein, 9 aa, Homo Sapiens
SVSSYFLFG

SEQ ID NO: 306758 - protein, 9 aa, Homo Sapiens
IDQICSLMA

SEQ ID NO: 306759 - protein, 9 aa, Homo Sapiens
FNFISYLKA

SEQ ID NO: 306760 - protein, 9 aa, Homo Sapiens
ALHSSEDPM

SEQ ID NO: 306761 - protein, 9 aa, Homo Sapiens
NLSLITLIG

SEQ ID NO: 306762 - protein, 9 aa, Homo Sapiens
GFCFVTYSC

SEQ ID NO: 306763 - protein, 9 aa, Homo Sapiens
AQHGGWTTK

SEQ ID NO: 306764 - protein, 9 aa, Homo Sapiens
SLSQQPEAA

SEQ ID NO: 306765 - protein, 9 aa, Homo Sapiens
GKPGYLNQP

SEQ ID NO: 306766 - protein, 9 aa, Homo Sapiens
NYYTFALFT

SEQ ID NO: 306767 - protein, 9 aa, Homo Sapiens
LQGKFNGNP

SEQ ID NO: 306768 - protein, 9 aa, Homo Sapiens
DLIVPAGDQ

SEQ ID NO: 306769 - protein, 9 aa, Homo Sapiens
HHHPDKSQS

SEQ ID NO: 306770 - protein, 9 aa, Homo Sapiens
LLLTLITAA

SEQ ID NO: 306771 - protein, 9 aa, Homo Sapiens
KDSILDLSK

SEQ ID NO: 306772 - protein, 9 aa, Homo Sapiens
IHILTIMWK

SEQ ID NO: 306773 - protein, 9 aa, Homo Sapiens
DIVSLVDVS

SEQ ID NO: 306774 - protein, 9 aa, Homo Sapiens
PQPQSLAKK

SEQ ID NO: 306775 - protein, 9 aa, Homo Sapiens
SNSRELNSG

SEQ ID NO: 306776 - protein, 9 aa, Homo Sapiens
QNITPQFFA

SEQ ID NO: 306777 - protein, 9 aa, Homo Sapiens
GLIPEELFQ

SEQ ID NO: 306778 - protein, 9 aa, Homo Sapiens
FEDNWYNTY

SEQ ID NO: 306779 - protein, 9 aa, Homo Sapiens
ALICSTLAC

SEQ ID NO: 306780 - protein, 9 aa, Homo Sapiens
KRSWQESNK

SEQ ID NO: 306781 - protein, 9 aa, Homo Sapiens
DLLSDLNKQ

SEQ ID NO: 306782 - protein, 9 aa, Homo Sapiens
ENNSSFTWS

SEQ ID NO: 306783 - protein, 9 aa, Homo Sapiens
KASRCRPAA

SEQ ID NO: 306784 - protein, 9 aa, Homo Sapiens
LNQIIYRKQ

SEQ ID NO: 306785 - protein, 9 aa, Homo Sapiens
LLLFYFIPS

SEQ ID NO: 306786 - protein, 9 aa, Homo Sapiens
TTSTQTSLD

SEQ ID NO: 306787 - protein, 9 aa, Homo Sapiens
EKMVSSTSS

SEQ ID NO: 306788 - protein, 9 aa, Homo Sapiens
NKEPDDIWK

SEQ ID NO: 306789 - protein, 9 aa, Homo Sapiens
CGEKGPDMF

SEQ ID NO: 306790 - protein, 9 aa, Homo Sapiens
YIQQLHSRT

SEQ ID NO: 306791 - protein, 9 aa, Homo Sapiens
LGVAVSKQY

SEQ ID NO: 306792 - protein, 9 aa, Homo Sapiens
ILGTNEHIF

SEQ ID NO: 306793 - protein, 9 aa, Homo Sapiens
LSGDKILEK

SEQ ID NO: 306794 - protein, 9 aa, Homo Sapiens
HLNKPLMKQ

SEQ ID NO: 306795 - protein, 9 aa, Homo Sapiens
REDSTAKKL

SEQ ID NO: 306796 - protein, 9 aa, Homo Sapiens
QSGERFNKS

SEQ ID NO: 306797 - protein, 9 aa, Homo Sapiens
IGRMVMMAD

SEQ ID NO: 306798 - protein, 9 aa, Homo Sapiens
PKLCETPKI

SEQ ID NO: 306799 - protein, 9 aa, Homo Sapiens
NKRIKYAPG

SEQ ID NO: 306800 - protein, 9 aa, Homo Sapiens
QLYLNPELI

SEQ ID NO: 306801 - protein, 9 aa, Homo Sapiens
YQLRHFSIY

SEQ ID NO: 306802 - protein, 9 aa, Homo Sapiens
MGKQGKKGK

SEQ ID NO: 306803 - protein, 9 aa, Homo Sapiens
KQRLCQQLV

SEQ ID NO: 306804 - protein, 9 aa, Homo Sapiens
ELDKAIKFL

SEQ ID NO: 306805 - protein, 9 aa, Homo Sapiens
QLYFFFSLG

SEQ ID NO: 306806 - protein, 9 aa, Homo Sapiens
ATINCLKNL

SEQ ID NO: 306807 - protein, 9 aa, Homo Sapiens
SDTERSFQD

SEQ ID NO: 306808 - protein, 9 aa, Homo Sapiens
LLQLDIKTD

SEQ ID NO: 306809 - protein, 9 aa, Homo Sapiens
KILRLPCTV

SEQ ID NO: 306810 - protein, 9 aa, Homo Sapiens
WDLEYLQDN

SEQ ID NO: 306811 - protein, 9 aa, Homo Sapiens
GGAKNIERV

SEQ ID NO: 306812 - protein, 9 aa, Homo Sapiens
IISHSNKVL

SEQ ID NO: 306813 - protein, 9 aa, Homo Sapiens
SRFGILDFI

SEQ ID NO: 306814 - protein, 9 aa, Homo Sapiens
KLYWAVLSE

SEQ ID NO: 306815 - protein, 9 aa, Homo Sapiens
LALLSAFLA

SEQ ID NO: 306816 - protein, 9 aa, Homo Sapiens
GNNGKKASE

SEQ ID NO: 306817 - protein, 9 aa, Homo Sapiens
WFSLEVSSR

SEQ ID NO: 306818 - protein, 9 aa, Homo Sapiens
NEPNNYQTM

SEQ ID NO: 306819 - protein, 9 aa, Homo Sapiens
QVWFSNQRA

SEQ ID NO: 306820 - protein, 9 aa, Homo Sapiens
PLEDDGEFM

SEQ ID NO: 306821 - protein, 9 aa, Homo Sapiens
GKQIEASIR

SEQ ID NO: 306822 - protein, 9 aa, Homo Sapiens
YFEIFKTKH

SEQ ID NO: 306823 - protein, 9 aa, Homo Sapiens
LHLDVKPDN

SEQ ID NO: 306824 - protein, 9 aa, Homo Sapiens
QAVSDGALQ

SEQ ID NO: 306825 - protein, 9 aa, Homo Sapiens
LMTHKLKHT

SEQ ID NO: 306826 - protein, 9 aa, Homo Sapiens
FQYLPDELS

SEQ ID NO: 306827 - protein, 9 aa, Homo Sapiens
SKGKSPHTE

SEQ ID NO: 306828 - protein, 9 aa, Homo Sapiens
QTRVDQIIG

SEQ ID NO: 306829 - protein, 9 aa, Homo Sapiens
GIPGSRGER

SEQ ID NO: 306830 - protein, 9 aa, Homo Sapiens
LKQLFRELP

SEQ ID NO: 306831 - protein, 9 aa, Homo Sapiens
YRFKTVTSS

SEQ ID NO: 306832 - protein, 9 aa, Homo Sapiens
NKLDLVAIP

SEQ ID NO: 306833 - protein, 9 aa, Homo Sapiens
NNRLWGPLE

SEQ ID NO: 306834 - protein, 9 aa, Homo Sapiens
LLSAFLGIV

SEQ ID NO: 306835 - protein, 9 aa, Homo Sapiens
PRWIILLVK

SEQ ID NO: 306836 - protein, 9 aa, Homo Sapiens
YLQEALFGK

SEQ ID NO: 306837 - protein, 9 aa, Homo Sapiens
HLNTLKELN

SEQ ID NO: 306838 - protein, 9 aa, Homo Sapiens
WSQWVIYLQ

SEQ ID NO: 306839 - protein, 9 aa, Homo Sapiens
SCLDNKKVE

SEQ ID NO: 306840 - protein, 9 aa, Homo Sapiens
TLGGNYASY

SEQ ID NO: 306841 - protein, 9 aa, Homo Sapiens
LSGEVHTAQ

SEQ ID NO: 306842 - protein, 9 aa, Homo Sapiens
NSDIVNHRR

SEQ ID NO: 306843 - protein, 9 aa, Homo Sapiens
AASHKLTVT

SEQ ID NO: 306844 - protein, 9 aa, Homo Sapiens
NTTDQKIEN

SEQ ID NO: 306845 - protein, 9 aa, Homo Sapiens
KHKVIHTEE

SEQ ID NO: 306846 - protein, 9 aa, Homo Sapiens
ECNGCGKAF

SEQ ID NO: 306847 - protein, 9 aa, Homo Sapiens
SPSPKISRS

SEQ ID NO: 306848 - protein, 9 aa, Homo Sapiens
QISAGTHVS

SEQ ID NO: 306849 - protein, 9 aa, Homo Sapiens
NQVNSRPMF

SEQ ID NO: 306850 - protein, 9 aa, Homo Sapiens
RKAMLNWAE

SEQ ID NO: 306851 - protein, 9 aa, Homo Sapiens
LPSFYAHLT

SEQ ID NO: 306852 - protein, 9 aa, Homo Sapiens
HQIVQLIQK

SEQ ID NO: 306853 - protein, 9 aa, Homo Sapiens
IPFLYSLQF

SEQ ID NO: 306854 - protein, 9 aa, Homo Sapiens
NYNNLVAVD

SEQ ID NO: 306855 - protein, 9 aa, Homo Sapiens
ILETAPTSD

SEQ ID NO: 306856 - protein, 9 aa, Homo Sapiens
ARLLSECDA

SEQ ID NO: 306857 - protein, 9 aa, Homo Sapiens
EHGLSIQGH

SEQ ID NO: 306858 - protein, 9 aa, Homo Sapiens
QAANTLGME

SEQ ID NO: 306859 - protein, 9 aa, Homo Sapiens
NYLQADTVG

SEQ ID NO: 306860 - protein, 9 aa, Homo Sapiens
AVLYDTFVC

SEQ ID NO: 306861 - protein, 9 aa, Homo Sapiens
PSFTAAVRS

SEQ ID NO: 306862 - protein, 9 aa, Homo Sapiens
KYFTDKMKV

SEQ ID NO: 306863 - protein, 9 aa, Homo Sapiens
APSQINLYR

SEQ ID NO: 306864 - protein, 9 aa, Homo Sapiens
SQLPLFRIN

SEQ ID NO: 306865 - protein, 9 aa, Homo Sapiens
SCECQKCHI

SEQ ID NO: 306866 - protein, 9 aa, Homo Sapiens
SKNNNSLSG

SEQ ID NO: 306867 - protein, 9 aa, Homo Sapiens
TAHKVAVSL

SEQ ID NO: 306868 - protein, 9 aa, Homo Sapiens
ELWVDNSTS

SEQ ID NO: 306869 - protein, 9 aa, Homo Sapiens
QMEIVLTSE

SEQ ID NO: 306870 - protein, 9 aa, Homo Sapiens
RRFAAYNEG

SEQ ID NO: 306871 - protein, 9 aa, Homo Sapiens
ILRCLLNVQ

SEQ ID NO: 306872 - protein, 9 aa, Homo Sapiens
DVKAPSDSN

SEQ ID NO: 306873 - protein, 9 aa, Homo Sapiens
SVLSVSCQE

SEQ ID NO: 306874 - protein, 9 aa, Homo Sapiens
CGKLFRRGS

SEQ ID NO: 306875 - protein, 9 aa, Homo Sapiens
NPSVRLKIA

SEQ ID NO: 306876 - protein, 9 aa, Homo Sapiens
HCFCRITHK

SEQ ID NO: 306877 - protein, 9 aa, Homo Sapiens
QFIYMAVQH

SEQ ID NO: 306878 - protein, 9 aa, Homo Sapiens
QDFLQCLAQ

SEQ ID NO: 306879 - protein, 9 aa, Homo Sapiens
EDGKEFELC

SEQ ID NO: 306880 - protein, 9 aa, Homo Sapiens
SISIETANV

SEQ ID NO: 306881 - protein, 9 aa, Homo Sapiens
LGPDAPPDA

SEQ ID NO: 306882 - protein, 9 aa, Homo Sapiens
AVLVALKEW

SEQ ID NO: 306883 - protein, 9 aa, Homo Sapiens
EFEMGGSKG

SEQ ID NO: 306884 - protein, 9 aa, Homo Sapiens
VRGGHKIIL

SEQ ID NO: 306885 - protein, 9 aa, Homo Sapiens
KVNKCRLSE

SEQ ID NO: 306886 - protein, 9 aa, Homo Sapiens
KIKHISELL

SEQ ID NO: 306887 - protein, 9 aa, Homo Sapiens
ASVIIAFYN

SEQ ID NO: 306888 - protein, 9 aa, Homo Sapiens
NSALLRYHT

SEQ ID NO: 306889 - protein, 9 aa, Homo Sapiens
ERERAALCV

SEQ ID NO: 306890 - protein, 9 aa, Homo Sapiens
VVFQGNKII

SEQ ID NO: 306891 - protein, 9 aa, Homo Sapiens
VLDPSFESE

SEQ ID NO: 306892 - protein, 9 aa, Homo Sapiens
LPYHLFSSP

SEQ ID NO: 306893 - protein, 9 aa, Homo Sapiens
AEHLSRHEL

SEQ ID NO: 306894 - protein, 9 aa, Homo Sapiens
RVENCYSSF

SEQ ID NO: 306895 - protein, 9 aa, Homo Sapiens
QLSVVKGIY

SEQ ID NO: 306896 - protein, 9 aa, Homo Sapiens
HYDSLEEKG

SEQ ID NO: 306897 - protein, 9 aa, Homo Sapiens
RRRCACDYC

SEQ ID NO: 306898 - protein, 9 aa, Homo Sapiens
GKKWEEHSV

SEQ ID NO: 306899 - protein, 9 aa, Homo Sapiens
KYFPNGNNG

SEQ ID NO: 306900 - protein, 9 aa, Homo Sapiens
NVTPLLKLS

SEQ ID NO: 306901 - protein, 9 aa, Homo Sapiens
RSGLFGQVF

SEQ ID NO: 306902 - protein, 9 aa, Homo Sapiens
FHVFVGGLS

SEQ ID NO: 306903 - protein, 9 aa, Homo Sapiens
LPGKKGHRG

SEQ ID NO: 306904 - protein, 9 aa, Homo Sapiens
GTPVKVWFQ

SEQ ID NO: 306905 - protein, 9 aa, Homo Sapiens
TIKCYESCM

SEQ ID NO: 306906 - protein, 9 aa, Homo Sapiens
HQQGIYSIY

SEQ ID NO: 306907 - protein, 9 aa, Homo Sapiens
KVEELNKKY

SEQ ID NO: 306908 - protein, 9 aa, Homo Sapiens
VGHKNKEPD

SEQ ID NO: 306909 - protein, 9 aa, Homo Sapiens
HWNSTITRK

SEQ ID NO: 306910 - protein, 9 aa, Homo Sapiens
DQTLRRDSL

SEQ ID NO: 306911 - protein, 9 aa, Homo Sapiens
FCKNYSLII

SEQ ID NO: 306912 - protein, 9 aa, Homo Sapiens
RLNTVNKCA

SEQ ID NO: 306913 - protein, 9 aa, Homo Sapiens
AGNKHIQDQ

SEQ ID NO: 306914 - protein, 9 aa, Homo Sapiens
ISNYMRLNS

SEQ ID NO: 306915 - protein, 9 aa, Homo Sapiens
DDMFEDMDK

SEQ ID NO: 306916 - protein, 9 aa, Homo Sapiens
YHDMEYTID

SEQ ID NO: 306917 - protein, 9 aa, Homo Sapiens
SLSCPEPAC

SEQ ID NO: 306918 - protein, 9 aa, Homo Sapiens
QRKEEHQAY

SEQ ID NO: 306919 - protein, 9 aa, Homo Sapiens
TLWCHRWHI

SEQ ID NO: 306920 - protein, 9 aa, Homo Sapiens
VLRAQKATV

SEQ ID NO: 306921 - protein, 9 aa, Homo Sapiens
SHSNIFEML

SEQ ID NO: 306922 - protein, 9 aa, Homo Sapiens
DKAVQMGMG

SEQ ID NO: 306923 - protein, 9 aa, Homo Sapiens
VGQPPPHSL

SEQ ID NO: 306924 - protein, 9 aa, Homo Sapiens
NKPAIKDSR

SEQ ID NO: 306925 - protein, 9 aa, Homo Sapiens
YQKPDEYDQ

SEQ ID NO: 306926 - protein, 9 aa, Homo Sapiens
LFANIHPIP

SEQ ID NO: 306927 - protein, 9 aa, Homo Sapiens
EIIQSSIPE

SEQ ID NO: 306928 - protein, 9 aa, Homo Sapiens
EVKHREQHH

SEQ ID NO: 306929 - protein, 9 aa, Homo Sapiens
LSTLENTKY

SEQ ID NO: 306930 - protein, 9 aa, Homo Sapiens
NSELAHEIL

SEQ ID NO: 306931 - protein, 9 aa, Homo Sapiens
VKTSRQLFE

SEQ ID NO: 306932 - protein, 9 aa, Homo Sapiens
CEQVSTESE

SEQ ID NO: 306933 - protein, 9 aa, Homo Sapiens
LRVLWVLRP

SEQ ID NO: 306934 - protein, 9 aa, Homo Sapiens
NEFVAPKKD

SEQ ID NO: 306935 - protein, 9 aa, Homo Sapiens
LATDSGLEF

SEQ ID NO: 306936 - protein, 9 aa, Homo Sapiens
KDHCEQITA

SEQ ID NO: 306937 - protein, 9 aa, Homo Sapiens
DMLVSVSHG

SEQ ID NO: 306938 - protein, 9 aa, Homo Sapiens
ETVDAVLQE

SEQ ID NO: 306939 - protein, 9 aa, Homo Sapiens
RILKGQKND

SEQ ID NO: 306940 - protein, 9 aa, Homo Sapiens
NLVKEYPQL

SEQ ID NO: 306941 - protein, 9 aa, Homo Sapiens
IYDLCNKLI

SEQ ID NO: 306942 - protein, 9 aa, Homo Sapiens
QAPIHRPPP

SEQ ID NO: 306943 - protein, 9 aa, Homo Sapiens
YFSDTFNHL

SEQ ID NO: 306944 - protein, 9 aa, Homo Sapiens
YLITFLSKL

SEQ ID NO: 306945 - protein, 9 aa, Homo Sapiens
PFVYTYIRP

SEQ ID NO: 306946 - protein, 9 aa, Homo Sapiens
LAKQGNPKM

SEQ ID NO: 306947 - protein, 9 aa, Homo Sapiens
DKQNEQLLK

SEQ ID NO: 306948 - protein, 9 aa, Homo Sapiens
FIESCQEDD

SEQ ID NO: 306949 - protein, 9 aa, Homo Sapiens
KDQNRDLEK

SEQ ID NO: 306950 - protein, 9 aa, Homo Sapiens
KNSYSSDVV

SEQ ID NO: 306951 - protein, 9 aa, Homo Sapiens
QEDPLPVPS

SEQ ID NO: 306952 - protein, 9 aa, Homo Sapiens
SGVICTQRR

SEQ ID NO: 306953 - protein, 9 aa, Homo Sapiens
NCWDPEVCI

SEQ ID NO: 306954 - protein, 9 aa, Homo Sapiens
QQKINTFAR

SEQ ID NO: 306955 - protein, 9 aa, Homo Sapiens
KGREALGKP

SEQ ID NO: 306956 - protein, 9 aa, Homo Sapiens
GLGFFMAEE

SEQ ID NO: 306957 - protein, 9 aa, Homo Sapiens
LCEIKDKTG

SEQ ID NO: 306958 - protein, 9 aa, Homo Sapiens
KLPHPFLPN

SEQ ID NO: 306959 - protein, 9 aa, Homo Sapiens
GSAAITEVL

SEQ ID NO: 306960 - protein, 9 aa, Homo Sapiens
ELICTGSRP

SEQ ID NO: 306961 - protein, 9 aa, Homo Sapiens
QCQALNIAE

SEQ ID NO: 306962 - protein, 9 aa, Homo Sapiens
PSNKWCEKL

SEQ ID NO: 306963 - protein, 9 aa, Homo Sapiens
DFHEGIRAV

SEQ ID NO: 306964 - protein, 9 aa, Homo Sapiens
FFLKHGKMH

SEQ ID NO: 306965 - protein, 9 aa, Homo Sapiens
LGTHTKEKP

SEQ ID NO: 306966 - protein, 9 aa, Homo Sapiens
VTDTVDIAP

SEQ ID NO: 306967 - protein, 9 aa, Homo Sapiens
LVINTLPTK

SEQ ID NO: 306968 - protein, 9 aa, Homo Sapiens
MQHIETVHP

SEQ ID NO: 306969 - protein, 9 aa, Homo Sapiens
IPLMLIGNI

SEQ ID NO: 306970 - protein, 9 aa, Homo Sapiens
VGKAFHASS

SEQ ID NO: 306971 - protein, 9 aa, Homo Sapiens
QLQGEPQAR

SEQ ID NO: 306972 - protein, 9 aa, Homo Sapiens
EDDLNNLNQ

SEQ ID NO: 306973 - protein, 9 aa, Homo Sapiens
LKRALQLFD

SEQ ID NO: 306974 - protein, 9 aa, Homo Sapiens
DHCSAGESG

SEQ ID NO: 306975 - protein, 9 aa, Homo Sapiens
DQHEMKCKN

SEQ ID NO: 306976 - protein, 9 aa, Homo Sapiens
VYVCNMLII

SEQ ID NO: 306977 - protein, 9 aa, Homo Sapiens
QYLKTIPES

SEQ ID NO: 306978 - protein, 9 aa, Homo Sapiens
DGGIAQLRV

SEQ ID NO: 306979 - protein, 9 aa, Homo Sapiens
MVQTKHYQV

SEQ ID NO: 306980 - protein, 9 aa, Homo Sapiens
VTDIEVETV

SEQ ID NO: 306981 - protein, 9 aa, Homo Sapiens
TEVLVIPKI

SEQ ID NO: 306982 - protein, 9 aa, Homo Sapiens
SSSDTTSTF

SEQ ID NO: 306983 - protein, 9 aa, Homo Sapiens
TSYLENKLS

SEQ ID NO: 306984 - protein, 9 aa, Homo Sapiens
PNELDNLYC

SEQ ID NO: 306985 - protein, 9 aa, Homo Sapiens
WILKDSLGG

SEQ ID NO: 306986 - protein, 9 aa, Homo Sapiens
VTELIIFAV

SEQ ID NO: 306987 - protein, 9 aa, Homo Sapiens
NPYFRDQTR

SEQ ID NO: 306988 - protein, 9 aa, Homo Sapiens
LNTVNKCAV

SEQ ID NO: 306989 - protein, 9 aa, Homo Sapiens
LNLVLIWRG

SEQ ID NO: 306990 - protein, 9 aa, Homo Sapiens
TVTKKGLTL

SEQ ID NO: 306991 - protein, 9 aa, Homo Sapiens
VGAETALLI

SEQ ID NO: 306992 - protein, 9 aa, Homo Sapiens
TLTFKECVI

SEQ ID NO: 306993 - protein, 9 aa, Homo Sapiens
AMASSIFRV

SEQ ID NO: 306994 - protein, 9 aa, Homo Sapiens
ILSTSLPLT

SEQ ID NO: 306995 - protein, 9 aa, Homo Sapiens
TANVREYAR

SEQ ID NO: 306996 - protein, 9 aa, Homo Sapiens
SLGSRSSTS

SEQ ID NO: 306997 - protein, 9 aa, Homo Sapiens
PKVEENISF

SEQ ID NO: 306998 - protein, 9 aa, Homo Sapiens
DVDKVVGAV

SEQ ID NO: 306999 - protein, 9 aa, Homo Sapiens
GAAAGQLKY

SEQ ID NO: 307000 - protein, 9 aa, Homo Sapiens
KIHTGKKPH

SEQ ID NO: 307001 - protein, 9 aa, Homo Sapiens
AQAVKHFCA

SEQ ID NO: 307002 - protein, 9 aa, Homo Sapiens
IGRSDADKQ

SEQ ID NO: 307003 - protein, 9 aa, Homo Sapiens
TEGKGQETY

SEQ ID NO: 307004 - protein, 9 aa, Homo Sapiens
HSLVQFIFI

SEQ ID NO: 307005 - protein, 9 aa, Homo Sapiens
PIFNEYIYL

SEQ ID NO: 307006 - protein, 9 aa, Homo Sapiens
GKYRVRRKC

SEQ ID NO: 307007 - protein, 9 aa, Homo Sapiens
KGINECKAF

SEQ ID NO: 307008 - protein, 9 aa, Homo Sapiens
SLFGIDMKD

SEQ ID NO: 307009 - protein, 9 aa, Homo Sapiens
LVQYKAAKE

SEQ ID NO: 307010 - protein, 9 aa, Homo Sapiens
GQEVRRTIH

SEQ ID NO: 307011 - protein, 9 aa, Homo Sapiens
IYPLVCALF

SEQ ID NO: 307012 - protein, 9 aa, Homo Sapiens
QKGLILNIY

SEQ ID NO: 307013 - protein, 9 aa, Homo Sapiens
GKAQTAQVQ

SEQ ID NO: 307014 - protein, 9 aa, Homo Sapiens
YLAQHWIIH

SEQ ID NO: 307015 - protein, 9 aa, Homo Sapiens
APDHMELTS

SEQ ID NO: 307016 - protein, 9 aa, Homo Sapiens
NKSPSEARQ

SEQ ID NO: 307017 - protein, 9 aa, Homo Sapiens
KDYENGFGH

SEQ ID NO: 307018 - protein, 9 aa, Homo Sapiens
GLTFFLPLG

SEQ ID NO: 307019 - protein, 9 aa, Homo Sapiens
EEVYFFSAN

SEQ ID NO: 307020 - protein, 9 aa, Homo Sapiens
VQTLSLSKK

SEQ ID NO: 307021 - protein, 9 aa, Homo Sapiens
MKCKNCVHL

SEQ ID NO: 307022 - protein, 9 aa, Homo Sapiens
FLEEWLNTC

SEQ ID NO: 307023 - protein, 9 aa, Homo Sapiens
HKWREEQRK

SEQ ID NO: 307024 - protein, 9 aa, Homo Sapiens
ILHQIIHSG

SEQ ID NO: 307025 - protein, 9 aa, Homo Sapiens
DMEKIILDA

SEQ ID NO: 307026 - protein, 9 aa, Homo Sapiens
RLFQALPGP

SEQ ID NO: 307027 - protein, 9 aa, Homo Sapiens
QSYTREHKE

SEQ ID NO: 307028 - protein, 9 aa, Homo Sapiens
GSNGLWRFC

SEQ ID NO: 307029 - protein, 9 aa, Homo Sapiens
QYLPDELSD

SEQ ID NO: 307030 - protein, 9 aa, Homo Sapiens
IQTRSNVAI

SEQ ID NO: 307031 - protein, 9 aa, Homo Sapiens
NLKKRPLLF

SEQ ID NO: 307032 - protein, 9 aa, Homo Sapiens
IRCSVLEET

SEQ ID NO: 307033 - protein, 9 aa, Homo Sapiens
CHDGYYLSY

SEQ ID NO: 307034 - protein, 9 aa, Homo Sapiens
VQRLAKKIR

SEQ ID NO: 307035 - protein, 9 aa, Homo Sapiens
INNTNVPDF

SEQ ID NO: 307036 - protein, 9 aa, Homo Sapiens
GERPHTCKI

SEQ ID NO: 307037 - protein, 9 aa, Homo Sapiens
DEEEENDQL

SEQ ID NO: 307038 - protein, 9 aa, Homo Sapiens
LGLCVKNPM

SEQ ID NO: 307039 - protein, 9 aa, Homo Sapiens
RLGGGPDYA

SEQ ID NO: 307040 - protein, 9 aa, Homo Sapiens
ASAHYDSLE

SEQ ID NO: 307041 - protein, 9 aa, Homo Sapiens
NAPDHMELT

SEQ ID NO: 307042 - protein, 9 aa, Homo Sapiens
KEGGPACEA

SEQ ID NO: 307043 - protein, 9 aa, Homo Sapiens
DLLQDMGQR

SEQ ID NO: 307044 - protein, 9 aa, Homo Sapiens
IKYASRSWK

SEQ ID NO: 307045 - protein, 9 aa, Homo Sapiens
HLWEAYCRV

SEQ ID NO: 307046 - protein, 9 aa, Homo Sapiens
VTFSRKGLY

SEQ ID NO: 307047 - protein, 9 aa, Homo Sapiens
INGYQIVYN

SEQ ID NO: 307048 - protein, 9 aa, Homo Sapiens
RKEKDKTPK

SEQ ID NO: 307049 - protein, 9 aa, Homo Sapiens
VTQQNVPIE

SEQ ID NO: 307050 - protein, 9 aa, Homo Sapiens
QGQALVSEE

SEQ ID NO: 307051 - protein, 9 aa, Homo Sapiens
HLVGIIREW

SEQ ID NO: 307052 - protein, 9 aa, Homo Sapiens
LQDLLSDLN

SEQ ID NO: 307053 - protein, 9 aa, Homo Sapiens
SDQDVAHFF

SEQ ID NO: 307054 - protein, 9 aa, Homo Sapiens
PTPDKEMML

SEQ ID NO: 307055 - protein, 9 aa, Homo Sapiens
NMKKDKRAS

SEQ ID NO: 307056 - protein, 9 aa, Homo Sapiens
SASQLQIHR

SEQ ID NO: 307057 - protein, 9 aa, Homo Sapiens
QSQQCFIIF

SEQ ID NO: 307058 - protein, 9 aa, Homo Sapiens
TFFLPLGAI

SEQ ID NO: 307059 - protein, 9 aa, Homo Sapiens
FHNISNICS

SEQ ID NO: 307060 - protein, 9 aa, Homo Sapiens
GTHTKEKPY

SEQ ID NO: 307061 - protein, 9 aa, Homo Sapiens
QMGMGAVFF

SEQ ID NO: 307062 - protein, 9 aa, Homo Sapiens
AEVTAHKVA

SEQ ID NO: 307063 - protein, 9 aa, Homo Sapiens
RPKNNSIPT

SEQ ID NO: 307064 - protein, 9 aa, Homo Sapiens
LGKFPFAKC

SEQ ID NO: 307065 - protein, 9 aa, Homo Sapiens
ETDISSKSF

SEQ ID NO: 307066 - protein, 9 aa, Homo Sapiens
AWAVWEETR

SEQ ID NO: 307067 - protein, 9 aa, Homo Sapiens
PRWTNANME

SEQ ID NO: 307068 - protein, 9 aa, Homo Sapiens
VIKTAILVG

SEQ ID NO: 307069 - protein, 9 aa, Homo Sapiens
LILRGFRVD

SEQ ID NO: 307070 - protein, 9 aa, Homo Sapiens
MLCETIGVL

SEQ ID NO: 307071 - protein, 9 aa, Homo Sapiens
KELLIHNNV

SEQ ID NO: 307072 - protein, 9 aa, Homo Sapiens
AEVKVVEMH

SEQ ID NO: 307073 - protein, 9 aa, Homo Sapiens
NPKYMNRTV

SEQ ID NO: 307074 - protein, 9 aa, Homo Sapiens
DLSLVLPLT

SEQ ID NO: 307075 - protein, 9 aa, Homo Sapiens
LGFYFFFKD

SEQ ID NO: 307076 - protein, 9 aa, Homo Sapiens
RQCPWGVAE

SEQ ID NO: 307077 - protein, 9 aa, Homo Sapiens
DKRIAVGPF

SEQ ID NO: 307078 - protein, 9 aa, Homo Sapiens
HIPTHGSWQ

SEQ ID NO: 307079 - protein, 9 aa, Homo Sapiens
IVDDALSWT

SEQ ID NO: 307080 - protein, 9 aa, Homo Sapiens
LNNTTDQKI

SEQ ID NO: 307081 - protein, 9 aa, Homo Sapiens
HETDPTFTL

SEQ ID NO: 307082 - protein, 9 aa, Homo Sapiens
PNWNFFIAL

SEQ ID NO: 307083 - protein, 9 aa, Homo Sapiens
ATHLKDKSS

SEQ ID NO: 307084 - protein, 9 aa, Homo Sapiens
PMYNFNPTE

SEQ ID NO: 307085 - protein, 9 aa, Homo Sapiens
TCYRASQVE

SEQ ID NO: 307086 - protein, 9 aa, Homo Sapiens
LQAITGKRK

SEQ ID NO: 307087 - protein, 9 aa, Homo Sapiens
DQKMEDEYK

SEQ ID NO: 307088 - protein, 9 aa, Homo Sapiens
NDAQHGGWT

SEQ ID NO: 307089 - protein, 9 aa, Homo Sapiens
CDNYIYFIP

SEQ ID NO: 307090 - protein, 9 aa, Homo Sapiens
LGNEYPTPQ

SEQ ID NO: 307091 - protein, 9 aa, Homo Sapiens
NKKKILFFN

SEQ ID NO: 307092 - protein, 9 aa, Homo Sapiens
RCCDSQDAD

SEQ ID NO: 307093 - protein, 9 aa, Homo Sapiens
AQIDNSAAV

SEQ ID NO: 307094 - protein, 9 aa, Homo Sapiens
FVVFQGNKI

SEQ ID NO: 307095 - protein, 9 aa, Homo Sapiens
VEAGKASEA

SEQ ID NO: 307096 - protein, 9 aa, Homo Sapiens
GTDYSENIF

SEQ ID NO: 307097 - protein, 9 aa, Homo Sapiens
LRRHMLERL

SEQ ID NO: 307098 - protein, 9 aa, Homo Sapiens
SKSRLPQLM

SEQ ID NO: 307099 - protein, 9 aa, Homo Sapiens
LLLLSYILT

SEQ ID NO: 307100 - protein, 9 aa, Homo Sapiens
KAFYRLSYL

SEQ ID NO: 307101 - protein, 9 aa, Homo Sapiens
AHLRDSGIL

SEQ ID NO: 307102 - protein, 9 aa, Homo Sapiens
VTYLQNGKY

SEQ ID NO: 307103 - protein, 9 aa, Homo Sapiens
STNMMPVSS

SEQ ID NO: 307104 - protein, 9 aa, Homo Sapiens
DRHKNPDAF

SEQ ID NO: 307105 - protein, 9 aa, Homo Sapiens
SPDKRIAVG

SEQ ID NO: 307106 - protein, 9 aa, Homo Sapiens
YPCEPALGQ

SEQ ID NO: 307107 - protein, 9 aa, Homo Sapiens
KLEREQEQQ

SEQ ID NO: 307108 - protein, 9 aa, Homo Sapiens
KEFINLLLD

SEQ ID NO: 307109 - protein, 9 aa, Homo Sapiens
QSRFLQSWN

SEQ ID NO: 307110 - protein, 9 aa, Homo Sapiens
LFDSHRRPG

SEQ ID NO: 307111 - protein, 9 aa, Homo Sapiens
IRMGIFSYR

SEQ ID NO: 307112 - protein, 9 aa, Homo Sapiens
SNIVNHQRI

SEQ ID NO: 307113 - protein, 9 aa, Homo Sapiens
HPKIKYYYC

SEQ ID NO: 307114 - protein, 9 aa, Homo Sapiens
ASIKNNKVI

SEQ ID NO: 307115 - protein, 9 aa, Homo Sapiens
GKTRQINHS

SEQ ID NO: 307116 - protein, 9 aa, Homo Sapiens
SIFGMAPML

SEQ ID NO: 307117 - protein, 9 aa, Homo Sapiens
REQSYKYNE

SEQ ID NO: 307118 - protein, 9 aa, Homo Sapiens
GNSLNNRIE

SEQ ID NO: 307119 - protein, 9 aa, Homo Sapiens
LKDLLKKNS

SEQ ID NO: 307120 - protein, 9 aa, Homo Sapiens
GDVKYMLSR

SEQ ID NO: 307121 - protein, 9 aa, Homo Sapiens
IRELYKFHN

SEQ ID NO: 307122 - protein, 9 aa, Homo Sapiens
VNGTLYYEE

SEQ ID NO: 307123 - protein, 9 aa, Homo Sapiens
MINQKATEG

SEQ ID NO: 307124 - protein, 9 aa, Homo Sapiens
PVMTMAASL

SEQ ID NO: 307125 - protein, 9 aa, Homo Sapiens
NQIIYRKQE

SEQ ID NO: 307126 - protein, 9 aa, Homo Sapiens
GKAFHASST

SEQ ID NO: 307127 - protein, 9 aa, Homo Sapiens
SSDDRRKAV

SEQ ID NO: 307128 - protein, 9 aa, Homo Sapiens
RSYLFDNPR

SEQ ID NO: 307129 - protein, 9 aa, Homo Sapiens
EAHDENTVL

SEQ ID NO: 307130 - protein, 9 aa, Homo Sapiens
GYNLDRLCL

SEQ ID NO: 307131 - protein, 9 aa, Homo Sapiens
RYKLDRHKN

SEQ ID NO: 307132 - protein, 9 aa, Homo Sapiens
VQCATARDT

SEQ ID NO: 307133 - protein, 9 aa, Homo Sapiens
IYFYPNGGL

SEQ ID NO: 307134 - protein, 9 aa, Homo Sapiens
QGAMSPLEK

SEQ ID NO: 307135 - protein, 9 aa, Homo Sapiens
YPVSLEMIN

SEQ ID NO: 307136 - protein, 9 aa, Homo Sapiens
KIQFEINFD

SEQ ID NO: 307137 - protein, 9 aa, Homo Sapiens
KTEQLHQKV

SEQ ID NO: 307138 - protein, 9 aa, Homo Sapiens
ELDNLYCDV

SEQ ID NO: 307139 - protein, 9 aa, Homo Sapiens
YNLLYLVIC

SEQ ID NO: 307140 - protein, 9 aa, Homo Sapiens
SRNLHPASL

SEQ ID NO: 307141 - protein, 9 aa, Homo Sapiens
RYFDLQIST

SEQ ID NO: 307142 - protein, 9 aa, Homo Sapiens
IINREALPA

SEQ ID NO: 307143 - protein, 9 aa, Homo Sapiens
GVSHLCPQP

SEQ ID NO: 307144 - protein, 9 aa, Homo Sapiens
VDLKTRCIS

SEQ ID NO: 307145 - protein, 9 aa, Homo Sapiens
IIHQIIHTG

SEQ ID NO: 307146 - protein, 9 aa, Homo Sapiens
VRALRRALC

SEQ ID NO: 307147 - protein, 9 aa, Homo Sapiens
KGGFDAIMQ

SEQ ID NO: 307148 - protein, 9 aa, Homo Sapiens
LARRVRSNP

SEQ ID NO: 307149 - protein, 9 aa, Homo Sapiens
QTPSQTHKE

SEQ ID NO: 307150 - protein, 9 aa, Homo Sapiens
ILKKVNDLD

SEQ ID NO: 307151 - protein, 9 aa, Homo Sapiens
ENYPTALQS

SEQ ID NO: 307152 - protein, 9 aa, Homo Sapiens
RNERKRKNM

SEQ ID NO: 307153 - protein, 9 aa, Homo Sapiens
DKNDVDLPG

SEQ ID NO: 307154 - protein, 9 aa, Homo Sapiens
GFFCKEEKY

SEQ ID NO: 307155 - protein, 9 aa, Homo Sapiens
GTSNFDPVD

SEQ ID NO: 307156 - protein, 9 aa, Homo Sapiens
IEKENYHDV

SEQ ID NO: 307157 - protein, 9 aa, Homo Sapiens
RKNKIFGYN

SEQ ID NO: 307158 - protein, 9 aa, Homo Sapiens
MTMTEKVEE

SEQ ID NO: 307159 - protein, 9 aa, Homo Sapiens
PKHQKTRQL

SEQ ID NO: 307160 - protein, 9 aa, Homo Sapiens
AAFIDTEGS

SEQ ID NO: 307161 - protein, 9 aa, Homo Sapiens
EVCIREMDQ

SEQ ID NO: 307162 - protein, 9 aa, Homo Sapiens
LICTGSRPG

SEQ ID NO: 307163 - protein, 9 aa, Homo Sapiens
RVGASAHYD

SEQ ID NO: 307164 - protein, 9 aa, Homo Sapiens
FTGLKFPSL

SEQ ID NO: 307165 - protein, 9 aa, Homo Sapiens
YSPGVFSKL

SEQ ID NO: 307166 - protein, 9 aa, Homo Sapiens
NTALVTQQN

SEQ ID NO: 307167 - protein, 9 aa, Homo Sapiens
IQYLKTIPE

SEQ ID NO: 307168 - protein, 9 aa, Homo Sapiens
HKCLLKGKK

SEQ ID NO: 307169 - protein, 9 aa, Homo Sapiens
CPGNAEGKG

SEQ ID NO: 307170 - protein, 9 aa, Homo Sapiens
CEAVNRMFQ

SEQ ID NO: 307171 - protein, 9 aa, Homo Sapiens
VSRFVPSFL

SEQ ID NO: 307172 - protein, 9 aa, Homo Sapiens
KFLCPLCMQ

SEQ ID NO: 307173 - protein, 9 aa, Homo Sapiens
AVAVAMYVA

SEQ ID NO: 307174 - protein, 9 aa, Homo Sapiens
ELVRHQIIH

SEQ ID NO: 307175 - protein, 9 aa, Homo Sapiens
CTSIYKCGR

SEQ ID NO: 307176 - protein, 9 aa, Homo Sapiens
ISVLKENYL

SEQ ID NO: 307177 - protein, 9 aa, Homo Sapiens
ILKELENLE

SEQ ID NO: 307178 - protein, 9 aa, Homo Sapiens
TTILTVICT

SEQ ID NO: 307179 - protein, 9 aa, Homo Sapiens
KQCGKAFVR

SEQ ID NO: 307180 - protein, 9 aa, Homo Sapiens
LELSQNPML

SEQ ID NO: 307181 - protein, 9 aa, Homo Sapiens
TITKMYETT

SEQ ID NO: 307182 - protein, 9 aa, Homo Sapiens
LEEKENIRN

SEQ ID NO: 307183 - protein, 9 aa, Homo Sapiens
DKYAPDNAW

SEQ ID NO: 307184 - protein, 9 aa, Homo Sapiens
DNKGTLAND

SEQ ID NO: 307185 - protein, 9 aa, Homo Sapiens
PPPGDRPEP

SEQ ID NO: 307186 - protein, 9 aa, Homo Sapiens
FTVRDSPAH

SEQ ID NO: 307187 - protein, 9 aa, Homo Sapiens
SSIIHESDS

SEQ ID NO: 307188 - protein, 9 aa, Homo Sapiens
YHKVTKLNN

SEQ ID NO: 307189 - protein, 9 aa, Homo Sapiens
SENPYSPYI

SEQ ID NO: 307190 - protein, 9 aa, Homo Sapiens
IFCDLRLDP

SEQ ID NO: 307191 - protein, 9 aa, Homo Sapiens
ESLNKDKDG

SEQ ID NO: 307192 - protein, 9 aa, Homo Sapiens
FSPLDLFNN

SEQ ID NO: 307193 - protein, 9 aa, Homo Sapiens
EDDRQMDTE

SEQ ID NO: 307194 - protein, 9 aa, Homo Sapiens
NDDLSSEFP

SEQ ID NO: 307195 - protein, 9 aa, Homo Sapiens
EDLFLHVKP

SEQ ID NO: 307196 - protein, 9 aa, Homo Sapiens
TSATINCLK

SEQ ID NO: 307197 - protein, 9 aa, Homo Sapiens
HYKTEGSRG

SEQ ID NO: 307198 - protein, 9 aa, Homo Sapiens
DMLFVFPKD

SEQ ID NO: 307199 - protein, 9 aa, Homo Sapiens
KITHTSEKP

SEQ ID NO: 307200 - protein, 9 aa, Homo Sapiens
DPQKSFALG

SEQ ID NO: 307201 - protein, 9 aa, Homo Sapiens
WCKNSYSSD

SEQ ID NO: 307202 - protein, 9 aa, Homo Sapiens
SGGLNGRLE

SEQ ID NO: 307203 - protein, 9 aa, Homo Sapiens
IIHNGEKLY

SEQ ID NO: 307204 - protein, 9 aa, Homo Sapiens
QKKDQNRDL

SEQ ID NO: 307205 - protein, 9 aa, Homo Sapiens
KEQIDGKAV

SEQ ID NO: 307206 - protein, 9 aa, Homo Sapiens
ISFPGITGV

SEQ ID NO: 307207 - protein, 9 aa, Homo Sapiens
GYAISTVCV

SEQ ID NO: 307208 - protein, 9 aa, Homo Sapiens
KQDIREHIW

SEQ ID NO: 307209 - protein, 9 aa, Homo Sapiens
YGIIQFIST

SEQ ID NO: 307210 - protein, 9 aa, Homo Sapiens
DPKVEHNPD

SEQ ID NO: 307211 - protein, 9 aa, Homo Sapiens
AKAPVYNWS

SEQ ID NO: 307212 - protein, 9 aa, Homo Sapiens
TMYQVLRRG

SEQ ID NO: 307213 - protein, 9 aa, Homo Sapiens
KKQFWYLLE

SEQ ID NO: 307214 - protein, 9 aa, Homo Sapiens
QPQPLSSPG

SEQ ID NO: 307215 - protein, 9 aa, Homo Sapiens
ATYTEEDDV

SEQ ID NO: 307216 - protein, 9 aa, Homo Sapiens
DGELYENHC

SEQ ID NO: 307217 - protein, 9 aa, Homo Sapiens
LLDTKYKSL

SEQ ID NO: 307218 - protein, 9 aa, Homo Sapiens
ILESNSIAD

SEQ ID NO: 307219 - protein, 9 aa, Homo Sapiens
FKKPSIKKD

SEQ ID NO: 307220 - protein, 9 aa, Homo Sapiens
YFKSVSLLS

SEQ ID NO: 307221 - protein, 9 aa, Homo Sapiens
TGVSHLCPQ

SEQ ID NO: 307222 - protein, 9 aa, Homo Sapiens
RETEPEGGS

SEQ ID NO: 307223 - protein, 9 aa, Homo Sapiens
TNFIVHAIR

SEQ ID NO: 307224 - protein, 9 aa, Homo Sapiens
GSFLGFYFF

SEQ ID NO: 307225 - protein, 9 aa, Homo Sapiens
GSRREPSIH

SEQ ID NO: 307226 - protein, 9 aa, Homo Sapiens
AMSPLEKEI

SEQ ID NO: 307227 - protein, 9 aa, Homo Sapiens
LASTSVDLT

SEQ ID NO: 307228 - protein, 9 aa, Homo Sapiens
DEITKKHIQ

SEQ ID NO: 307229 - protein, 9 aa, Homo Sapiens
AFQTFLKRH

SEQ ID NO: 307230 - protein, 9 aa, Homo Sapiens
GLKFPTYLH

SEQ ID NO: 307231 - protein, 9 aa, Homo Sapiens
SLVINKESE

SEQ ID NO: 307232 - protein, 9 aa, Homo Sapiens
QMVTALVSQ

SEQ ID NO: 307233 - protein, 9 aa, Homo Sapiens
FISKRSDPI

SEQ ID NO: 307234 - protein, 9 aa, Homo Sapiens
FHTGNTSFA

SEQ ID NO: 307235 - protein, 9 aa, Homo Sapiens
QGQVCCNDT

SEQ ID NO: 307236 - protein, 9 aa, Homo Sapiens
IVATMSNLV

SEQ ID NO: 307237 - protein, 9 aa, Homo Sapiens
AEEQPSTYT

SEQ ID NO: 307238 - protein, 9 aa, Homo Sapiens
VILFINLTL

SEQ ID NO: 307239 - protein, 9 aa, Homo Sapiens
NLELMVRLS

SEQ ID NO: 307240 - protein, 9 aa, Homo Sapiens
SKTVPVTDI

SEQ ID NO: 307241 - protein, 9 aa, Homo Sapiens
LSVRSRNRH

SEQ ID NO: 307242 - protein, 9 aa, Homo Sapiens
VTPNTLPND

SEQ ID NO: 307243 - protein, 9 aa, Homo Sapiens
ATKLSDYFL

SEQ ID NO: 307244 - protein, 9 aa, Homo Sapiens
DIIAENLSS

SEQ ID NO: 307245 - protein, 9 aa, Homo Sapiens
PGKFEKIIK

SEQ ID NO: 307246 - protein, 9 aa, Homo Sapiens
FYGYLMSMY

SEQ ID NO: 307247 - protein, 9 aa, Homo Sapiens
FIFISCDLL

SEQ ID NO: 307248 - protein, 9 aa, Homo Sapiens
LCPQPPKTQ

SEQ ID NO: 307249 - protein, 9 aa, Homo Sapiens
DGYKGTILH

SEQ ID NO: 307250 - protein, 9 aa, Homo Sapiens
FPKKKPRLE

SEQ ID NO: 307251 - protein, 9 aa, Homo Sapiens
QFTVEHTHL

SEQ ID NO: 307252 - protein, 9 aa, Homo Sapiens
ISELHNYQR

SEQ ID NO: 307253 - protein, 9 aa, Homo Sapiens
DVYISIHGE

SEQ ID NO: 307254 - protein, 9 aa, Homo Sapiens
SYVLTIYDI

SEQ ID NO: 307255 - protein, 9 aa, Homo Sapiens
PKDIVSLVD

SEQ ID NO: 307256 - protein, 9 aa, Homo Sapiens
IVTNKVIKI

SEQ ID NO: 307257 - protein, 9 aa, Homo Sapiens
LDRIIATLQ

SEQ ID NO: 307258 - protein, 9 aa, Homo Sapiens
RHCNLICHQ

SEQ ID NO: 307259 - protein, 9 aa, Homo Sapiens
DKYMQKSFQ

SEQ ID NO: 307260 - protein, 9 aa, Homo Sapiens
TDKGSFVVN

SEQ ID NO: 307261 - protein, 9 aa, Homo Sapiens
PYPDEFKNM

SEQ ID NO: 307262 - protein, 9 aa, Homo Sapiens
KKAFTKYCN

SEQ ID NO: 307263 - protein, 9 aa, Homo Sapiens
VALILGIEL

SEQ ID NO: 307264 - protein, 9 aa, Homo Sapiens
FMANQTSVM

SEQ ID NO: 307265 - protein, 9 aa, Homo Sapiens
SKLVRHQIT

SEQ ID NO: 307266 - protein, 9 aa, Homo Sapiens
DEFCFYYAI

SEQ ID NO: 307267 - protein, 9 aa, Homo Sapiens
VWSMEHLNH

SEQ ID NO: 307268 - protein, 9 aa, Homo Sapiens
RKNVLKEMK

SEQ ID NO: 307269 - protein, 9 aa, Homo Sapiens
VQHVDLEIL

SEQ ID NO: 307270 - protein, 9 aa, Homo Sapiens
HTFPELAYQ

SEQ ID NO: 307271 - protein, 9 aa, Homo Sapiens
QKLEGGKQL

SEQ ID NO: 307272 - protein, 9 aa, Homo Sapiens
GNLCDYDTH

SEQ ID NO: 307273 - protein, 9 aa, Homo Sapiens
LENAVCKLK

SEQ ID NO: 307274 - protein, 9 aa, Homo Sapiens
LCPLCMQSR

SEQ ID NO: 307275 - protein, 9 aa, Homo Sapiens
FAIKLFSAQ

SEQ ID NO: 307276 - protein, 9 aa, Homo Sapiens
KHKIIHAEE

SEQ ID NO: 307277 - protein, 9 aa, Homo Sapiens
YYSQHVVKQ

SEQ ID NO: 307278 - protein, 9 aa, Homo Sapiens
EKYFDNWCS

SEQ ID NO: 307279 - protein, 9 aa, Homo Sapiens
PQSLAKKES

SEQ ID NO: 307280 - protein, 9 aa, Homo Sapiens
LPVKTLLEY

SEQ ID NO: 307281 - protein, 9 aa, Homo Sapiens
IFREQFEDN

SEQ ID NO: 307282 - protein, 9 aa, Homo Sapiens
LPLHPVLGE

SEQ ID NO: 307283 - protein, 9 aa, Homo Sapiens
PNKEMLEES

SEQ ID NO: 307284 - protein, 9 aa, Homo Sapiens
GVAKTMLES

SEQ ID NO: 307285 - protein, 9 aa, Homo Sapiens
NEHNNQIEA

SEQ ID NO: 307286 - protein, 9 aa, Homo Sapiens
GSKVQTLSL

SEQ ID NO: 307287 - protein, 9 aa, Homo Sapiens
RLGLGILNN

SEQ ID NO: 307288 - protein, 9 aa, Homo Sapiens
YEWDHVRQQ

SEQ ID NO: 307289 - protein, 9 aa, Homo Sapiens
VLQIIIENL

SEQ ID NO: 307290 - protein, 9 aa, Homo Sapiens
LRWYKQYTG

SEQ ID NO: 307291 - protein, 9 aa, Homo Sapiens
DYRIILKEL

SEQ ID NO: 307292 - protein, 9 aa, Homo Sapiens
KKVMDVHKV

SEQ ID NO: 307293 - protein, 9 aa, Homo Sapiens
LETAPTSDN

SEQ ID NO: 307294 - protein, 9 aa, Homo Sapiens
VFVGRFKNQ

SEQ ID NO: 307295 - protein, 9 aa, Homo Sapiens
TKTYLSYLT

SEQ ID NO: 307296 - protein, 9 aa, Homo Sapiens
YTYQHGGLT

SEQ ID NO: 307297 - protein, 9 aa, Homo Sapiens
TSSGNRDNE

SEQ ID NO: 307298 - protein, 9 aa, Homo Sapiens
VMGFNTDHL

SEQ ID NO: 307299 - protein, 9 aa, Homo Sapiens
VNQLKDNSN

SEQ ID NO: 307300 - protein, 9 aa, Homo Sapiens
ICTGSRPGA

SEQ ID NO: 307301 - protein, 9 aa, Homo Sapiens
IIDEFIVKL

SEQ ID NO: 307302 - protein, 9 aa, Homo Sapiens
ALELSQNPM

SEQ ID NO: 307303 - protein, 9 aa, Homo Sapiens
EVILEVNII

SEQ ID NO: 307304 - protein, 9 aa, Homo Sapiens
LMEHKIIHT

SEQ ID NO: 307305 - protein, 9 aa, Homo Sapiens
IKDTENKDQ

SEQ ID NO: 307306 - protein, 9 aa, Homo Sapiens
PAGDQRTQT

SEQ ID NO: 307307 - protein, 9 aa, Homo Sapiens
DEDVGKEQC

SEQ ID NO: 307308 - protein, 9 aa, Homo Sapiens
TPLSSTFRV

SEQ ID NO: 307309 - protein, 9 aa, Homo Sapiens
FRQILCLIE

SEQ ID NO: 307310 - protein, 9 aa, Homo Sapiens
SSTNMMPVS

SEQ ID NO: 307311 - protein, 9 aa, Homo Sapiens
DKVVGAVDV

SEQ ID NO: 307312 - protein, 9 aa, Homo Sapiens
QHDALAFFN

SEQ ID NO: 307313 - protein, 9 aa, Homo Sapiens
QNYRFHTIS

SEQ ID NO: 307314 - protein, 9 aa, Homo Sapiens
TQHVIIHAA

SEQ ID NO: 307315 - protein, 9 aa, Homo Sapiens
HHEIIHTME

SEQ ID NO: 307316 - protein, 9 aa, Homo Sapiens
GLNITGFYR

SEQ ID NO: 307317 - protein, 9 aa, Homo Sapiens
RLEKLPDVC

SEQ ID NO: 307318 - protein, 9 aa, Homo Sapiens
SAMWVKKIT

SEQ ID NO: 307319 - protein, 9 aa, Homo Sapiens
PKKKPRLED

SEQ ID NO: 307320 - protein, 9 aa, Homo Sapiens
PEVLLRTPY

SEQ ID NO: 307321 - protein, 9 aa, Homo Sapiens
EQLHQTVTS

SEQ ID NO: 307322 - protein, 9 aa, Homo Sapiens
LDGDNKYDT

SEQ ID NO: 307323 - protein, 9 aa, Homo Sapiens
SRLQNRYAN

SEQ ID NO: 307324 - protein, 9 aa, Homo Sapiens
GREYKCDVS

SEQ ID NO: 307325 - protein, 9 aa, Homo Sapiens
TNACSKPIE

SEQ ID NO: 307326 - protein, 9 aa, Homo Sapiens
TYVTVGPQF

SEQ ID NO: 307327 - protein, 9 aa, Homo Sapiens
QSFKKIVDS

SEQ ID NO: 307328 - protein, 9 aa, Homo Sapiens
SSYFLFGSS

SEQ ID NO: 307329 - protein, 9 aa, Homo Sapiens
IIWVLCTVA

SEQ ID NO: 307330 - protein, 9 aa, Homo Sapiens
DPGKRAKPQ

SEQ ID NO: 307331 - protein, 9 aa, Homo Sapiens
ILHGMSDLL

SEQ ID NO: 307332 - protein, 9 aa, Homo Sapiens
RTFSLFAER

SEQ ID NO: 307333 - protein, 9 aa, Homo Sapiens
PTRLIVVFF

SEQ ID NO: 307334 - protein, 9 aa, Homo Sapiens
PKKNPFLVS

SEQ ID NO: 307335 - protein, 9 aa, Homo Sapiens
VPVKISRME

SEQ ID NO: 307336 - protein, 9 aa, Homo Sapiens
LLSERLLQL

SEQ ID NO: 307337 - protein, 9 aa, Homo Sapiens
EKDYFQASG

SEQ ID NO: 307338 - protein, 9 aa, Homo Sapiens
ALIKRGGCT

SEQ ID NO: 307339 - protein, 9 aa, Homo Sapiens
HHTLLDKTI

SEQ ID NO: 307340 - protein, 9 aa, Homo Sapiens
MKYMYRELW

SEQ ID NO: 307341 - protein, 9 aa, Homo Sapiens
RTEAMWDDF

SEQ ID NO: 307342 - protein, 9 aa, Homo Sapiens
SSSSNYQGS

SEQ ID NO: 307343 - protein, 9 aa, Homo Sapiens
RLNPKHVHQ

SEQ ID NO: 307344 - protein, 9 aa, Homo Sapiens
ASILTMTCI

SEQ ID NO: 307345 - protein, 9 aa, Homo Sapiens
KPVTRGVGA

SEQ ID NO: 307346 - protein, 9 aa, Homo Sapiens
ATLQSKEYS

SEQ ID NO: 307347 - protein, 9 aa, Homo Sapiens
SEAAPKCAL

SEQ ID NO: 307348 - protein, 9 aa, Homo Sapiens
DFDIIRNYN

SEQ ID NO: 307349 - protein, 9 aa, Homo Sapiens
DKPYRSSVE

SEQ ID NO: 307350 - protein, 9 aa, Homo Sapiens
DLLLDALEL

SEQ ID NO: 307351 - protein, 9 aa, Homo Sapiens
NLRLFVRKN

SEQ ID NO: 307352 - protein, 9 aa, Homo Sapiens
LLSNHFSTL

SEQ ID NO: 307353 - protein, 9 aa, Homo Sapiens
LHIYTCPRS

SEQ ID NO: 307354 - protein, 9 aa, Homo Sapiens
ELNFEVIPP

SEQ ID NO: 307355 - protein, 9 aa, Homo Sapiens
VYYAKKKQR

SEQ ID NO: 307356 - protein, 9 aa, Homo Sapiens
FPSLAGKPK

SEQ ID NO: 307357 - protein, 9 aa, Homo Sapiens
HPIYRGASA

SEQ ID NO: 307358 - protein, 9 aa, Homo Sapiens
NGVGRFFHL

SEQ ID NO: 307359 - protein, 9 aa, Homo Sapiens
STQKLINAE

SEQ ID NO: 307360 - protein, 9 aa, Homo Sapiens
AVLSEYVKT

SEQ ID NO: 307361 - protein, 9 aa, Homo Sapiens
ASQLQIHRR

SEQ ID NO: 307362 - protein, 9 aa, Homo Sapiens
QFMSGKVVG

SEQ ID NO: 307363 - protein, 9 aa, Homo Sapiens
DNQILKTSV

SEQ ID NO: 307364 - protein, 9 aa, Homo Sapiens
YATYYKENN

SEQ ID NO: 307365 - protein, 9 aa, Homo Sapiens
ENTKYLQTT

SEQ ID NO: 307366 - protein, 9 aa, Homo Sapiens
YTLQTKRKL

SEQ ID NO: 307367 - protein, 9 aa, Homo Sapiens
EIMGGAKNI

SEQ ID NO: 307368 - protein, 9 aa, Homo Sapiens
GSLSQRLKD

SEQ ID NO: 307369 - protein, 9 aa, Homo Sapiens
RPGFPFLDN

SEQ ID NO: 307370 - protein, 9 aa, Homo Sapiens
VKHFCAGRD

SEQ ID NO: 307371 - protein, 9 aa, Homo Sapiens
FYNEYFVFN

SEQ ID NO: 307372 - protein, 9 aa, Homo Sapiens
SSDVVNVSI

SEQ ID NO: 307373 - protein, 9 aa, Homo Sapiens
RAEEQPSTY

SEQ ID NO: 307374 - protein, 9 aa, Homo Sapiens
KLSLGSLGK

SEQ ID NO: 307375 - protein, 9 aa, Homo Sapiens
KMREKRKLQ

SEQ ID NO: 307376 - protein, 9 aa, Homo Sapiens
TSCGKKLAA

SEQ ID NO: 307377 - protein, 9 aa, Homo Sapiens
KVALDPELE

SEQ ID NO: 307378 - protein, 9 aa, Homo Sapiens
TRGSTVMFE

SEQ ID NO: 307379 - protein, 9 aa, Homo Sapiens
DFEACNEVP

SEQ ID NO: 307380 - protein, 9 aa, Homo Sapiens
GFIYESSSI

SEQ ID NO: 307381 - protein, 9 aa, Homo Sapiens
LSLENNGGP

SEQ ID NO: 307382 - protein, 9 aa, Homo Sapiens
LSKDIIYII

SEQ ID NO: 307383 - protein, 9 aa, Homo Sapiens
IQLVFGNQF

SEQ ID NO: 307384 - protein, 9 aa, Homo Sapiens
RSPPHPATF

SEQ ID NO: 307385 - protein, 9 aa, Homo Sapiens
TDLKSYASA

SEQ ID NO: 307386 - protein, 9 aa, Homo Sapiens
QRNFDKILT

SEQ ID NO: 307387 - protein, 9 aa, Homo Sapiens
KTYRCNKCG

SEQ ID NO: 307388 - protein, 9 aa, Homo Sapiens
KYFQRITIY

SEQ ID NO: 307389 - protein, 9 aa, Homo Sapiens
AQRLGLGIL

SEQ ID NO: 307390 - protein, 9 aa, Homo Sapiens
LILQNQIQQ

SEQ ID NO: 307391 - protein, 9 aa, Homo Sapiens
TYRLNFCGS

SEQ ID NO: 307392 - protein, 9 aa, Homo Sapiens
YIVPIIWLN

SEQ ID NO: 307393 - protein, 9 aa, Homo Sapiens
DVGGLICRT

SEQ ID NO: 307394 - protein, 9 aa, Homo Sapiens
EVRQIELLN

SEQ ID NO: 307395 - protein, 9 aa, Homo Sapiens
SHGSETIVI

SEQ ID NO: 307396 - protein, 9 aa, Homo Sapiens
CGLGLRVQA

SEQ ID NO: 307397 - protein, 9 aa, Homo Sapiens
LLSSVFWIC

SEQ ID NO: 307398 - protein, 9 aa, Homo Sapiens
QGNKIIHLI

SEQ ID NO: 307399 - protein, 9 aa, Homo Sapiens
NICSYADHS

SEQ ID NO: 307400 - protein, 9 aa, Homo Sapiens
YEYDCQQII

SEQ ID NO: 307401 - protein, 9 aa, Homo Sapiens
DTTATAGIM

SEQ ID NO: 307402 - protein, 9 aa, Homo Sapiens
LHQVLNIQF

SEQ ID NO: 307403 - protein, 9 aa, Homo Sapiens
TKDEGEDTL

SEQ ID NO: 307404 - protein, 9 aa, Homo Sapiens
ILSTPPKII

SEQ ID NO: 307405 - protein, 9 aa, Homo Sapiens
RALQLFDRK

SEQ ID NO: 307406 - protein, 9 aa, Homo Sapiens
AITNFRAKH

SEQ ID NO: 307407 - protein, 9 aa, Homo Sapiens
SSSIIHESD

SEQ ID NO: 307408 - protein, 9 aa, Homo Sapiens
FGPLGLLYE

SEQ ID NO: 307409 - protein, 9 aa, Homo Sapiens
NSCFPTSRH

SEQ ID NO: 307410 - protein, 9 aa, Homo Sapiens
DIFNKIKFG

SEQ ID NO: 307411 - protein, 9 aa, Homo Sapiens
SKKNRLSLT

SEQ ID NO: 307412 - protein, 9 aa, Homo Sapiens
RIQLCDNYI

SEQ ID NO: 307413 - protein, 9 aa, Homo Sapiens
LDIWYTTAT

SEQ ID NO: 307414 - protein, 9 aa, Homo Sapiens
YGTRLFHLL

SEQ ID NO: 307415 - protein, 9 aa, Homo Sapiens
SIKNNKVII

SEQ ID NO: 307416 - protein, 9 aa, Homo Sapiens
LWWTYASSI

SEQ ID NO: 307417 - protein, 9 aa, Homo Sapiens
QGQSYEIQM

SEQ ID NO: 307418 - protein, 9 aa, Homo Sapiens
SPQHMVQTK

SEQ ID NO: 307419 - protein, 9 aa, Homo Sapiens
PRVPKKAQE

SEQ ID NO: 307420 - protein, 9 aa, Homo Sapiens
ERFWDFIAQ

SEQ ID NO: 307421 - protein, 9 aa, Homo Sapiens
SRLPQLMDC

SEQ ID NO: 307422 - protein, 9 aa, Homo Sapiens
LLAESRAEN

SEQ ID NO: 307423 - protein, 9 aa, Homo Sapiens
SGGNSLNNR

SEQ ID NO: 307424 - protein, 9 aa, Homo Sapiens
WSNPTAFDY

SEQ ID NO: 307425 - protein, 9 aa, Homo Sapiens
RLEKKQDKT

SEQ ID NO: 307426 - protein, 9 aa, Homo Sapiens
AIGRSDADK

SEQ ID NO: 307427 - protein, 9 aa, Homo Sapiens
APTFLYDIY

SEQ ID NO: 307428 - protein, 9 aa, Homo Sapiens
FYMGSRKGS

SEQ ID NO: 307429 - protein, 9 aa, Homo Sapiens
FYEQFMSGK

SEQ ID NO: 307430 - protein, 9 aa, Homo Sapiens
IQDNVNLPP

SEQ ID NO: 307431 - protein, 9 aa, Homo Sapiens
MGFNTDHLA

SEQ ID NO: 307432 - protein, 9 aa, Homo Sapiens
GGKKSLGTT

SEQ ID NO: 307433 - protein, 9 aa, Homo Sapiens
LVFPVAIFI

SEQ ID NO: 307434 - protein, 9 aa, Homo Sapiens
LREYYDRTA

SEQ ID NO: 307435 - protein, 9 aa, Homo Sapiens
QSIIGLFVF

SEQ ID NO: 307436 - protein, 9 aa, Homo Sapiens
ISETWRRRR

SEQ ID NO: 307437 - protein, 9 aa, Homo Sapiens
LHINEYGIA

SEQ ID NO: 307438 - protein, 9 aa, Homo Sapiens
KILEAPDLY

SEQ ID NO: 307439 - protein, 9 aa, Homo Sapiens
PKMSFQETK

SEQ ID NO: 307440 - protein, 9 aa, Homo Sapiens
EKIVEGCTG

SEQ ID NO: 307441 - protein, 9 aa, Homo Sapiens
MPENRFLMR

SEQ ID NO: 307442 - protein, 9 aa, Homo Sapiens
TTGQSTPCA

SEQ ID NO: 307443 - protein, 9 aa, Homo Sapiens
RANNPKVNK

SEQ ID NO: 307444 - protein, 9 aa, Homo Sapiens
AFYRLSYLT

SEQ ID NO: 307445 - protein, 9 aa, Homo Sapiens
SRVQIWFQH

SEQ ID NO: 307446 - protein, 9 aa, Homo Sapiens
FVIVIILAI

SEQ ID NO: 307447 - protein, 9 aa, Homo Sapiens
EAMQNYLKE

SEQ ID NO: 307448 - protein, 9 aa, Homo Sapiens
FESENPYSP

SEQ ID NO: 307449 - protein, 9 aa, Homo Sapiens
LPSATPTTA

SEQ ID NO: 307450 - protein, 9 aa, Homo Sapiens
QRTKDISRV

SEQ ID NO: 307451 - protein, 9 aa, Homo Sapiens
DTATTSDVN

SEQ ID NO: 307452 - protein, 9 aa, Homo Sapiens
ILGSYSGTT

SEQ ID NO: 307453 - protein, 9 aa, Homo Sapiens
LYRALCIRD

SEQ ID NO: 307454 - protein, 9 aa, Homo Sapiens
ATTLSRYYK

SEQ ID NO: 307455 - protein, 9 aa, Homo Sapiens
MTPEQFQLC

SEQ ID NO: 307456 - protein, 9 aa, Homo Sapiens
LVGELELLD

SEQ ID NO: 307457 - protein, 9 aa, Homo Sapiens
KCGRIEVNM

SEQ ID NO: 307458 - protein, 9 aa, Homo Sapiens
ICSTLACIL

SEQ ID NO: 307459 - protein, 9 aa, Homo Sapiens
RYSESFCNA

SEQ ID NO: 307460 - protein, 9 aa, Homo Sapiens
VEFGTRIIK

SEQ ID NO: 307461 - protein, 9 aa, Homo Sapiens
FVRKNKIFG

SEQ ID NO: 307462 - protein, 9 aa, Homo Sapiens
PLHPVLGEY

SEQ ID NO: 307463 - protein, 9 aa, Homo Sapiens
TPSQTHKER

SEQ ID NO: 307464 - protein, 9 aa, Homo Sapiens
KELPVADPL

SEQ ID NO: 307465 - protein, 9 aa, Homo Sapiens
SLQIAALLQ

SEQ ID NO: 307466 - protein, 9 aa, Homo Sapiens
RDRLHIYTC

SEQ ID NO: 307467 - protein, 9 aa, Homo Sapiens
KNVPLKDEI

SEQ ID NO: 307468 - protein, 9 aa, Homo Sapiens
RKRSRANQK

SEQ ID NO: 307469 - protein, 9 aa, Homo Sapiens
TYKSLTSGI

SEQ ID NO: 307470 - protein, 9 aa, Homo Sapiens
LVQQYLAQA

SEQ ID NO: 307471 - protein, 9 aa, Homo Sapiens
CLQCWCVRC

SEQ ID NO: 307472 - protein, 9 aa, Homo Sapiens
AINRADYYL

SEQ ID NO: 307473 - protein, 9 aa, Homo Sapiens
MLFVFPKDK

SEQ ID NO: 307474 - protein, 9 aa, Homo Sapiens
PLLMPINTL

SEQ ID NO: 307475 - protein, 9 aa, Homo Sapiens
PDSEEDSEL

SEQ ID NO: 307476 - protein, 9 aa, Homo Sapiens
PVADPLMDQ

SEQ ID NO: 307477 - protein, 9 aa, Homo Sapiens
PPNDVFDEL

SEQ ID NO: 307478 - protein, 9 aa, Homo Sapiens
KDNKSPAIK

SEQ ID NO: 307479 - protein, 9 aa, Homo Sapiens
LSCTPLMWA

SEQ ID NO: 307480 - protein, 9 aa, Homo Sapiens
GLQSDTERS

SEQ ID NO: 307481 - protein, 9 aa, Homo Sapiens
GQAEKHRKL

SEQ ID NO: 307482 - protein, 9 aa, Homo Sapiens
EAQITTWSA

SEQ ID NO: 307483 - protein, 9 aa, Homo Sapiens
VFNAIETMP

SEQ ID NO: 307484 - protein, 9 aa, Homo Sapiens
INHYQNIFS

SEQ ID NO: 307485 - protein, 9 aa, Homo Sapiens
LKDIIGPPM

SEQ ID NO: 307486 - protein, 9 aa, Homo Sapiens
TNILSTSTI

SEQ ID NO: 307487 - protein, 9 aa, Homo Sapiens
VKNIVSLVR

SEQ ID NO: 307488 - protein, 9 aa, Homo Sapiens
HANSGGTAL

SEQ ID NO: 307489 - protein, 9 aa, Homo Sapiens
RIQEVTGSL

SEQ ID NO: 307490 - protein, 9 aa, Homo Sapiens
EKSEEIYLQ

SEQ ID NO: 307491 - protein, 9 aa, Homo Sapiens
STQIFQEKV

SEQ ID NO: 307492 - protein, 9 aa, Homo Sapiens
LNIYSGIAL

SEQ ID NO: 307493 - protein, 9 aa, Homo Sapiens
SLKSRSVDC

SEQ ID NO: 307494 - protein, 9 aa, Homo Sapiens
IIAVQYISL

SEQ ID NO: 307495 - protein, 9 aa, Homo Sapiens
GVTDVLCSA

SEQ ID NO: 307496 - protein, 9 aa, Homo Sapiens
GIWQPKYGD

SEQ ID NO: 307497 - protein, 9 aa, Homo Sapiens
VLQLFLSQT

SEQ ID NO: 307498 - protein, 9 aa, Homo Sapiens
VIIEKNPGL

SEQ ID NO: 307499 - protein, 9 aa, Homo Sapiens
NKLASFSFD

SEQ ID NO: 307500 - protein, 9 aa, Homo Sapiens
STPVCDRKY

SEQ ID NO: 307501 - protein, 9 aa, Homo Sapiens
DVEFLYNLL

SEQ ID NO: 307502 - protein, 9 aa, Homo Sapiens
VSSYFLFGS

SEQ ID NO: 307503 - protein, 9 aa, Homo Sapiens
EVENAMMIK

SEQ ID NO: 307504 - protein, 9 aa, Homo Sapiens
RLIVVFFVF

SEQ ID NO: 307505 - protein, 9 aa, Homo Sapiens
YLSYVKAQE

SEQ ID NO: 307506 - protein, 9 aa, Homo Sapiens
ESVESCDIS

SEQ ID NO: 307507 - protein, 9 aa, Homo Sapiens
LYNNDFDDD

SEQ ID NO: 307508 - protein, 9 aa, Homo Sapiens
IPKDTWYDL

SEQ ID NO: 307509 - protein, 9 aa, Homo Sapiens
HEFHSQDNL

SEQ ID NO: 307510 - protein, 9 aa, Homo Sapiens
TNNLSPKEN

SEQ ID NO: 307511 - protein, 9 aa, Homo Sapiens
PIIVEVKKP

SEQ ID NO: 307512 - protein, 9 aa, Homo Sapiens
CDVDNLFFL

SEQ ID NO: 307513 - protein, 9 aa, Homo Sapiens
PKINSHNFC

SEQ ID NO: 307514 - protein, 9 aa, Homo Sapiens
CLTQSFFAI

SEQ ID NO: 307515 - protein, 9 aa, Homo Sapiens
PAQYGFALF

SEQ ID NO: 307516 - protein, 9 aa, Homo Sapiens
HQVLNIQFG

SEQ ID NO: 307517 - protein, 9 aa, Homo Sapiens
NILEEDNHI

SEQ ID NO: 307518 - protein, 9 aa, Homo Sapiens
IKLLEKAGF

SEQ ID NO: 307519 - protein, 9 aa, Homo Sapiens
ATYDLPATI

SEQ ID NO: 307520 - protein, 9 aa, Homo Sapiens
ERQMRSQSE

SEQ ID NO: 307521 - protein, 9 aa, Homo Sapiens
AATLVKCEC

SEQ ID NO: 307522 - protein, 9 aa, Homo Sapiens
SIQCQALNI

SEQ ID NO: 307523 - protein, 9 aa, Homo Sapiens
TNKENLLNI

SEQ ID NO: 307524 - protein, 9 aa, Homo Sapiens
MYQVLRRGL

SEQ ID NO: 307525 - protein, 9 aa, Homo Sapiens
DRKQLVIYE

SEQ ID NO: 307526 - protein, 9 aa, Homo Sapiens
PGILGIPGS

SEQ ID NO: 307527 - protein, 9 aa, Homo Sapiens
EWKFAQTKL

SEQ ID NO: 307528 - protein, 9 aa, Homo Sapiens
LYVQMKWEF

SEQ ID NO: 307529 - protein, 9 aa, Homo Sapiens
ADSEDNLLE

SEQ ID NO: 307530 - protein, 9 aa, Homo Sapiens
EDFLYGLFK

SEQ ID NO: 307531 - protein, 9 aa, Homo Sapiens
AVEFSTSFL

SEQ ID NO: 307532 - protein, 9 aa, Homo Sapiens
YYSENETEK

SEQ ID NO: 307533 - protein, 9 aa, Homo Sapiens
TGIVLLPRL

SEQ ID NO: 307534 - protein, 9 aa, Homo Sapiens
DIVNHRRSH

SEQ ID NO: 307535 - protein, 9 aa, Homo Sapiens
AYNGNDVNL

SEQ ID NO: 307536 - protein, 9 aa, Homo Sapiens
ETLTLQAPP

SEQ ID NO: 307537 - protein, 9 aa, Homo Sapiens
DIIRNYNDT

SEQ ID NO: 307538 - protein, 9 aa, Homo Sapiens
CECGHCHCH

SEQ ID NO: 307539 - protein, 9 aa, Homo Sapiens
IPRARKIGV

SEQ ID NO: 307540 - protein, 9 aa, Homo Sapiens
CYSIPEEKG

SEQ ID NO: 307541 - protein, 9 aa, Homo Sapiens
VEQINLPWK

SEQ ID NO: 307542 - protein, 9 aa, Homo Sapiens
EGDCAPEDK

SEQ ID NO: 307543 - protein, 9 aa, Homo Sapiens
VAIFITSYA

SEQ ID NO: 307544 - protein, 9 aa, Homo Sapiens
LPYDPAKSP

SEQ ID NO: 307545 - protein, 9 aa, Homo Sapiens
FGVLAIFEI

SEQ ID NO: 307546 - protein, 9 aa, Homo Sapiens
EEWLNTCFD

SEQ ID NO: 307547 - protein, 9 aa, Homo Sapiens
DGVEQINLP

SEQ ID NO: 307548 - protein, 9 aa, Homo Sapiens
QREKERDFQ

SEQ ID NO: 307549 - protein, 9 aa, Homo Sapiens
FFFLQREGM

SEQ ID NO: 307550 - protein, 9 aa, Homo Sapiens
YNEYFVFNF

SEQ ID NO: 307551 - protein, 9 aa, Homo Sapiens
PRVKQGPNI

SEQ ID NO: 307552 - protein, 9 aa, Homo Sapiens
TVGLACEAV

SEQ ID NO: 307553 - protein, 9 aa, Homo Sapiens
PFPFDKPRG

SEQ ID NO: 307554 - protein, 9 aa, Homo Sapiens
KVEHNPDTL

SEQ ID NO: 307555 - protein, 9 aa, Homo Sapiens
YTGSDVIEG

SEQ ID NO: 307556 - protein, 9 aa, Homo Sapiens
EEVEISKAL

SEQ ID NO: 307557 - protein, 9 aa, Homo Sapiens
VRFIANHMR

SEQ ID NO: 307558 - protein, 9 aa, Homo Sapiens
LFGKELLDL

SEQ ID NO: 307559 - protein, 9 aa, Homo Sapiens
APERQMRSQ

SEQ ID NO: 307560 - protein, 9 aa, Homo Sapiens
DMIETVYNN

SEQ ID NO: 307561 - protein, 9 aa, Homo Sapiens
LTAQMVMAH

SEQ ID NO: 307562 - protein, 9 aa, Homo Sapiens
DITIFTESL

SEQ ID NO: 307563 - protein, 9 aa, Homo Sapiens
YTFICQEKE

SEQ ID NO: 307564 - protein, 9 aa, Homo Sapiens
FGGNLQKTM

SEQ ID NO: 307565 - protein, 9 aa, Homo Sapiens
MGKLHKKMG

SEQ ID NO: 307566 - protein, 9 aa, Homo Sapiens
ILKRHLSSV

SEQ ID NO: 307567 - protein, 9 aa, Homo Sapiens
RYLITFLSK

SEQ ID NO: 307568 - protein, 9 aa, Homo Sapiens
HSLAATPNL

SEQ ID NO: 307569 - protein, 9 aa, Homo Sapiens
WYSLVICED

SEQ ID NO: 307570 - protein, 9 aa, Homo Sapiens
KEWGLFRGI

SEQ ID NO: 307571 - protein, 9 aa, Homo Sapiens
CKLQWCIMH

SEQ ID NO: 307572 - protein, 9 aa, Homo Sapiens
RCQSALAIV

SEQ ID NO: 307573 - protein, 9 aa, Homo Sapiens
LKLAGWQCP

SEQ ID NO: 307574 - protein, 9 aa, Homo Sapiens
LQRCTAPGL

SEQ ID NO: 307575 - protein, 9 aa, Homo Sapiens
KDISRVFHS

SEQ ID NO: 307576 - protein, 9 aa, Homo Sapiens
KTGYNMKKL

SEQ ID NO: 307577 - protein, 9 aa, Homo Sapiens
KPSMITPLR

SEQ ID NO: 307578 - protein, 9 aa, Homo Sapiens
CWAQAGKEV

SEQ ID NO: 307579 - protein, 9 aa, Homo Sapiens
AIMQLGSIT

SEQ ID NO: 307580 - protein, 9 aa, Homo Sapiens
KVDPALGKF

SEQ ID NO: 307581 - protein, 9 aa, Homo Sapiens
PKLTPNMKK

SEQ ID NO: 307582 - protein, 9 aa, Homo Sapiens
RLTPSRINF

SEQ ID NO: 307583 - protein, 9 aa, Homo Sapiens
LDNKKVEKI

SEQ ID NO: 307584 - protein, 9 aa, Homo Sapiens
FIDIKSKFA

SEQ ID NO: 307585 - protein, 9 aa, Homo Sapiens
WIRHLFPKQ

SEQ ID NO: 307586 - protein, 9 aa, Homo Sapiens
ALFSATADA

SEQ ID NO: 307587 - protein, 9 aa, Homo Sapiens
SVESCDISL

SEQ ID NO: 307588 - protein, 9 aa, Homo Sapiens
WQPNQKTLP

SEQ ID NO: 307589 - protein, 9 aa, Homo Sapiens
RSDFYMAYE

SEQ ID NO: 307590 - protein, 9 aa, Homo Sapiens
AVDPIAGTL

SEQ ID NO: 307591 - protein, 9 aa, Homo Sapiens
LEVQNIISF

SEQ ID NO: 307592 - protein, 9 aa, Homo Sapiens
VSDKQNQAR

SEQ ID NO: 307593 - protein, 9 aa, Homo Sapiens
SHLQKKYVQ

SEQ ID NO: 307594 - protein, 9 aa, Homo Sapiens
IPWQRSAAE

SEQ ID NO: 307595 - protein, 9 aa, Homo Sapiens
LAHRFTVPA

SEQ ID NO: 307596 - protein, 9 aa, Homo Sapiens
LAHRFTVPG

SEQ ID NO: 307597 - protein, 9 aa, Homo Sapiens
SISELYVFL

SEQ ID NO: 307598 - protein, 9 aa, Homo Sapiens
ELLSNHFST

SEQ ID NO: 307599 - protein, 9 aa, Homo Sapiens
LSECDAAKH

SEQ ID NO: 307600 - protein, 9 aa, Homo Sapiens
RYQIIMTPR

SEQ ID NO: 307601 - protein, 9 aa, Homo Sapiens
PWRRKQMLD

SEQ ID NO: 307602 - protein, 9 aa, Homo Sapiens
QDFKNTADQ

SEQ ID NO: 307603 - protein, 9 aa, Homo Sapiens
INQILFLRL

SEQ ID NO: 307604 - protein, 9 aa, Homo Sapiens
SDNGTVKLW

SEQ ID NO: 307605 - protein, 9 aa, Homo Sapiens
EAKTPFPFD

SEQ ID NO: 307606 - protein, 9 aa, Homo Sapiens
PKKDVDAAY

SEQ ID NO: 307607 - protein, 9 aa, Homo Sapiens
KILLKNQAV

SEQ ID NO: 307608 - protein, 9 aa, Homo Sapiens
PFLSGPQRL

SEQ ID NO: 307609 - protein, 9 aa, Homo Sapiens
ALDPYTELQ

SEQ ID NO: 307610 - protein, 9 aa, Homo Sapiens
VRQEAHISW

SEQ ID NO: 307611 - protein, 9 aa, Homo Sapiens
IKSKKHQVE

SEQ ID NO: 307612 - protein, 9 aa, Homo Sapiens
GVTGNYPHL

SEQ ID NO: 307613 - protein, 9 aa, Homo Sapiens
LVNLCSFRK

SEQ ID NO: 307614 - protein, 9 aa, Homo Sapiens
VHLEDHVFC

SEQ ID NO: 307615 - protein, 9 aa, Homo Sapiens
LEIIQSSIP

SEQ ID NO: 307616 - protein, 9 aa, Homo Sapiens
NGLKFPTYL

SEQ ID NO: 307617 - protein, 9 aa, Homo Sapiens
KDKTPKLCE

SEQ ID NO: 307618 - protein, 9 aa, Homo Sapiens
KQKTYQKKS

SEQ ID NO: 307619 - protein, 9 aa, Homo Sapiens
LKNLFCIGV

SEQ ID NO: 307620 - protein, 9 aa, Homo Sapiens
TKHKKEKKK

SEQ ID NO: 307621 - protein, 9 aa, Homo Sapiens
DAKEVKMAF

SEQ ID NO: 307622 - protein, 9 aa, Homo Sapiens
PSKQKPLPP

SEQ ID NO: 307623 - protein, 9 aa, Homo Sapiens
GMCTRSLTA

SEQ ID NO: 307624 - protein, 9 aa, Homo Sapiens
KYSYKYPQL

SEQ ID NO: 307625 - protein, 9 aa, Homo Sapiens
NLQKHTVLV

SEQ ID NO: 307626 - protein, 9 aa, Homo Sapiens
ERGSQQSKT

SEQ ID NO: 307627 - protein, 9 aa, Homo Sapiens
YFQMSLEAK

SEQ ID NO: 307628 - protein, 9 aa, Homo Sapiens
YKYNECGKA

SEQ ID NO: 307629 - protein, 9 aa, Homo Sapiens
ISFWGCITQ

SEQ ID NO: 307630 - protein, 9 aa, Homo Sapiens
NKQQRARKL

SEQ ID NO: 307631 - protein, 9 aa, Homo Sapiens
ICLQSEGSP

SEQ ID NO: 307632 - protein, 9 aa, Homo Sapiens
AVVISLSHT

SEQ ID NO: 307633 - protein, 9 aa, Homo Sapiens
KNGVGRFFH

SEQ ID NO: 307634 - protein, 9 aa, Homo Sapiens
RSGFRRIVH

SEQ ID NO: 307635 - protein, 9 aa, Homo Sapiens
VLRRGLSIS

SEQ ID NO: 307636 - protein, 9 aa, Homo Sapiens
IMRLLIEHG

SEQ ID NO: 307637 - protein, 9 aa, Homo Sapiens
RGSKVQTLS

SEQ ID NO: 307638 - protein, 9 aa, Homo Sapiens
KRGSSWHLS

SEQ ID NO: 307639 - protein, 9 aa, Homo Sapiens
HIVHLEDHV

SEQ ID NO: 307640 - protein, 9 aa, Homo Sapiens
LDASTMYGS

SEQ ID NO: 307641 - protein, 9 aa, Homo Sapiens
SDEVILKGL

SEQ ID NO: 307642 - protein, 9 aa, Homo Sapiens
LYVVSTRLP

SEQ ID NO: 307643 - protein, 9 aa, Homo Sapiens
REIKLLEKA

SEQ ID NO: 307644 - protein, 9 aa, Homo Sapiens
PADKVPERK

SEQ ID NO: 307645 - protein, 9 aa, Homo Sapiens
DLRSLNDMH

SEQ ID NO: 307646 - protein, 9 aa, Homo Sapiens
HNINDPRKN

SEQ ID NO: 307647 - protein, 9 aa, Homo Sapiens
INAVALVGM

SEQ ID NO: 307648 - protein, 9 aa, Homo Sapiens
NTTSTQTSL

SEQ ID NO: 307649 - protein, 9 aa, Homo Sapiens
RFASVVYTV

SEQ ID NO: 307650 - protein, 9 aa, Homo Sapiens
HNRFLYVGG

SEQ ID NO: 307651 - protein, 9 aa, Homo Sapiens
GQSKCCKNV

SEQ ID NO: 307652 - protein, 9 aa, Homo Sapiens
AKVVTLTAG

SEQ ID NO: 307653 - protein, 9 aa, Homo Sapiens
CVQNKPFQK

SEQ ID NO: 307654 - protein, 9 aa, Homo Sapiens
HIQFTANEK

SEQ ID NO: 307655 - protein, 9 aa, Homo Sapiens
RFKQQTPSQ

SEQ ID NO: 307656 - protein, 9 aa, Homo Sapiens
WGCITQIFF

SEQ ID NO: 307657 - protein, 9 aa, Homo Sapiens
NQASWIHCM

SEQ ID NO: 307658 - protein, 9 aa, Homo Sapiens
HGQLVNGIH

SEQ ID NO: 307659 - protein, 9 aa, Homo Sapiens
QPPPQKVQI

SEQ ID NO: 307660 - protein, 9 aa, Homo Sapiens
WYKNSSILD

SEQ ID NO: 307661 - protein, 9 aa, Homo Sapiens
TCSENQVNS

SEQ ID NO: 307662 - protein, 9 aa, Homo Sapiens
CKYKKRFNS

SEQ ID NO: 307663 - protein, 9 aa, Homo Sapiens
NPNHDTLRY

SEQ ID NO: 307664 - protein, 9 aa, Homo Sapiens
FARKGNKGK

SEQ ID NO: 307665 - protein, 9 aa, Homo Sapiens
YEWLEALLI

SEQ ID NO: 307666 - protein, 9 aa, Homo Sapiens
ISSVLQAHL

SEQ ID NO: 307667 - protein, 9 aa, Homo Sapiens
MQLKCLMKG

SEQ ID NO: 307668 - protein, 9 aa, Homo Sapiens
RHGHVRLLS

SEQ ID NO: 307669 - protein, 9 aa, Homo Sapiens
PDPRPSPPH

SEQ ID NO: 307670 - protein, 9 aa, Homo Sapiens
TELIVTDNK

SEQ ID NO: 307671 - protein, 9 aa, Homo Sapiens
TFPEVQIMP

SEQ ID NO: 307672 - protein, 9 aa, Homo Sapiens
KEAFASTSR

SEQ ID NO: 307673 - protein, 9 aa, Homo Sapiens
HIQLKKEIQ

SEQ ID NO: 307674 - protein, 9 aa, Homo Sapiens
LFFVRLVDK

SEQ ID NO: 307675 - protein, 9 aa, Homo Sapiens
SSKDGDVKY

SEQ ID NO: 307676 - protein, 9 aa, Homo Sapiens
QSSCQPAGC

SEQ ID NO: 307677 - protein, 9 aa, Homo Sapiens
GYKGTILHF

SEQ ID NO: 307678 - protein, 9 aa, Homo Sapiens
YAKKKQRHQ

SEQ ID NO: 307679 - protein, 9 aa, Homo Sapiens
ITTMEMNIS

SEQ ID NO: 307680 - protein, 9 aa, Homo Sapiens
HGLNITGFY

SEQ ID NO: 307681 - protein, 9 aa, Homo Sapiens
PFGSFLGFY

SEQ ID NO: 307682 - protein, 9 aa, Homo Sapiens
EHGPQVSLS

SEQ ID NO: 307683 - protein, 9 aa, Homo Sapiens
WWPTEFKTV

SEQ ID NO: 307684 - protein, 9 aa, Homo Sapiens
QLLVGQFTL

SEQ ID NO: 307685 - protein, 9 aa, Homo Sapiens
DSTAKKLAG

SEQ ID NO: 307686 - protein, 9 aa, Homo Sapiens
SNPPDWSNN

SEQ ID NO: 307687 - protein, 9 aa, Homo Sapiens
YLTSSPTTT

SEQ ID NO: 307688 - protein, 9 aa, Homo Sapiens
GLLLFYFIP

SEQ ID NO: 307689 - protein, 9 aa, Homo Sapiens
LDEFIESCQ

SEQ ID NO: 307690 - protein, 9 aa, Homo Sapiens
AFLDKKKYH

SEQ ID NO: 307691 - protein, 9 aa, Homo Sapiens
PVCALQACM

SEQ ID NO: 307692 - protein, 9 aa, Homo Sapiens
GNPKCRALT

SEQ ID NO: 307693 - protein, 9 aa, Homo Sapiens
RNAPDHMEL

SEQ ID NO: 307694 - protein, 9 aa, Homo Sapiens
SGKRQSKFQ

SEQ ID NO: 307695 - protein, 9 aa, Homo Sapiens
IEDNIINED

SEQ ID NO: 307696 - protein, 9 aa, Homo Sapiens
EEEEEEQDY

SEQ ID NO: 307697 - protein, 9 aa, Homo Sapiens
EYLPLEETG

SEQ ID NO: 307698 - protein, 9 aa, Homo Sapiens
AGTPLSSTF

SEQ ID NO: 307699 - protein, 9 aa, Homo Sapiens
DQKIENIHI

SEQ ID NO: 307700 - protein, 9 aa, Homo Sapiens
LSLKKEGEQ

SEQ ID NO: 307701 - protein, 9 aa, Homo Sapiens
QFSVKGYKE

SEQ ID NO: 307702 - protein, 9 aa, Homo Sapiens
ALALLSAFL

SEQ ID NO: 307703 - protein, 9 aa, Homo Sapiens
PSGEVIETT

SEQ ID NO: 307704 - protein, 9 aa, Homo Sapiens
PNNIDPALR

SEQ ID NO: 307705 - protein, 9 aa, Homo Sapiens
LTFSSATDL

SEQ ID NO: 307706 - protein, 9 aa, Homo Sapiens
RRPLQTHYG

SEQ ID NO: 307707 - protein, 9 aa, Homo Sapiens
GNWQGFYCG

SEQ ID NO: 307708 - protein, 9 aa, Homo Sapiens
VCDRKYFVL

SEQ ID NO: 307709 - protein, 9 aa, Homo Sapiens
VKGGSFPLS

SEQ ID NO: 307710 - protein, 9 aa, Homo Sapiens
GVKGEKGDQ

SEQ ID NO: 307711 - protein, 9 aa, Homo Sapiens
IKEYVQQLS

SEQ ID NO: 307712 - protein, 9 aa, Homo Sapiens
ICYYSENET

SEQ ID NO: 307713 - protein, 9 aa, Homo Sapiens
NTSTSYIDN

SEQ ID NO: 307714 - protein, 9 aa, Homo Sapiens
DTNFSFYDC

SEQ ID NO: 307715 - protein, 9 aa, Homo Sapiens
KAKVLVPVA

SEQ ID NO: 307716 - protein, 9 aa, Homo Sapiens
SSGLSGTTD

SEQ ID NO: 307717 - protein, 9 aa, Homo Sapiens
LKVVSIPKD

SEQ ID NO: 307718 - protein, 9 aa, Homo Sapiens
PQHMVQTKH

SEQ ID NO: 307719 - protein, 9 aa, Homo Sapiens
QHTADVKGG

SEQ ID NO: 307720 - protein, 9 aa, Homo Sapiens
IQGCNNTYN

SEQ ID NO: 307721 - protein, 9 aa, Homo Sapiens
DEIKLRNRR

SEQ ID NO: 307722 - protein, 9 aa, Homo Sapiens
EKERDFQNL

SEQ ID NO: 307723 - protein, 9 aa, Homo Sapiens
PPKIIFCDL

SEQ ID NO: 307724 - protein, 9 aa, Homo Sapiens
DGKAVLLLT

SEQ ID NO: 307725 - protein, 9 aa, Homo Sapiens
LSGGKPMII

SEQ ID NO: 307726 - protein, 9 aa, Homo Sapiens
LGPNGINTM

SEQ ID NO: 307727 - protein, 9 aa, Homo Sapiens
IFEKRSTQT

SEQ ID NO: 307728 - protein, 9 aa, Homo Sapiens
LARHQSIHT

SEQ ID NO: 307729 - protein, 9 aa, Homo Sapiens
HKSLGLWTT

SEQ ID NO: 307730 - protein, 9 aa, Homo Sapiens
ENEFVAPKK

SEQ ID NO: 307731 - protein, 9 aa, Homo Sapiens
PALSKNNPG

SEQ ID NO: 307732 - protein, 9 aa, Homo Sapiens
VMQEDLSRD

SEQ ID NO: 307733 - protein, 9 aa, Homo Sapiens
EKSNVYRYH

SEQ ID NO: 307734 - protein, 9 aa, Homo Sapiens
KNWATLAQR

SEQ ID NO: 307735 - protein, 9 aa, Homo Sapiens
ALAQIDNSA

SEQ ID NO: 307736 - protein, 9 aa, Homo Sapiens
LWKLHVRGA

SEQ ID NO: 307737 - protein, 9 aa, Homo Sapiens
ERGSRESAS

SEQ ID NO: 307738 - protein, 9 aa, Homo Sapiens
VEEKSEEIY

SEQ ID NO: 307739 - protein, 9 aa, Homo Sapiens
DGVLPVKTL

SEQ ID NO: 307740 - protein, 9 aa, Homo Sapiens
FTANEKTLI

SEQ ID NO: 307741 - protein, 9 aa, Homo Sapiens
PSQINLYRD

SEQ ID NO: 307742 - protein, 9 aa, Homo Sapiens
TASATLNVL

SEQ ID NO: 307743 - protein, 9 aa, Homo Sapiens
MLNHILYSL

SEQ ID NO: 307744 - protein, 9 aa, Homo Sapiens
VQTCGFDFG

SEQ ID NO: 307745 - protein, 9 aa, Homo Sapiens
KRTELLPGD

SEQ ID NO: 307746 - protein, 9 aa, Homo Sapiens
TNQLNYLNQ

SEQ ID NO: 307747 - protein, 9 aa, Homo Sapiens
GPACEAGLC

SEQ ID NO: 307748 - protein, 9 aa, Homo Sapiens
GCFDAMGSL

SEQ ID NO: 307749 - protein, 9 aa, Homo Sapiens
DLKDFLHPH

SEQ ID NO: 307750 - protein, 9 aa, Homo Sapiens
PDNKAWPAH

SEQ ID NO: 307751 - protein, 9 aa, Homo Sapiens
IPRWTNANM

SEQ ID NO: 307752 - protein, 9 aa, Homo Sapiens
LMFYGYLMS

SEQ ID NO: 307753 - protein, 9 aa, Homo Sapiens
KSSCYFFST

SEQ ID NO: 307754 - protein, 9 aa, Homo Sapiens
SPKIGFFRE

SEQ ID NO: 307755 - protein, 9 aa, Homo Sapiens
HKKMGQLIV

SEQ ID NO: 307756 - protein, 9 aa, Homo Sapiens
TGYELEGNR

SEQ ID NO: 307757 - protein, 9 aa, Homo Sapiens
KQLDAQHMN

SEQ ID NO: 307758 - protein, 9 aa, Homo Sapiens
SLERHRIIH

SEQ ID NO: 307759 - protein, 9 aa, Homo Sapiens
YGQKIIKNN

SEQ ID NO: 307760 - protein, 9 aa, Homo Sapiens
PRLSNNECL

SEQ ID NO: 307761 - protein, 9 aa, Homo Sapiens
TNFRAKHHC

SEQ ID NO: 307762 - protein, 9 aa, Homo Sapiens
NKHGPTYKE

SEQ ID NO: 307763 - protein, 9 aa, Homo Sapiens
SLLVMALDR

SEQ ID NO: 307764 - protein, 9 aa, Homo Sapiens
GMKYMYREL

SEQ ID NO: 307765 - protein, 9 aa, Homo Sapiens
MTCGSPVIG

SEQ ID NO: 307766 - protein, 9 aa, Homo Sapiens
SETLSQINR

SEQ ID NO: 307767 - protein, 9 aa, Homo Sapiens
ENHFLICVK

SEQ ID NO: 307768 - protein, 9 aa, Homo Sapiens
PSSGLSGTT

SEQ ID NO: 307769 - protein, 9 aa, Homo Sapiens
DKTPDLILQ

SEQ ID NO: 307770 - protein, 9 aa, Homo Sapiens
ILSDMNTVS

SEQ ID NO: 307771 - protein, 9 aa, Homo Sapiens
KICCTDKLY

SEQ ID NO: 307772 - protein, 9 aa, Homo Sapiens
LLSERYVAK

SEQ ID NO: 307773 - protein, 9 aa, Homo Sapiens
PNEVNHLYC

SEQ ID NO: 307774 - protein, 9 aa, Homo Sapiens
SSIDEYKNR

SEQ ID NO: 307775 - protein, 9 aa, Homo Sapiens
RACTELGIH

SEQ ID NO: 307776 - protein, 9 aa, Homo Sapiens
TDTLLIQDN

SEQ ID NO: 307777 - protein, 9 aa, Homo Sapiens
GLLKQLFRE

SEQ ID NO: 307778 - protein, 9 aa, Homo Sapiens
RKEEKVALD

SEQ ID NO: 307779 - protein, 9 aa, Homo Sapiens
CVGEGMEEG

SEQ ID NO: 307780 - protein, 9 aa, Homo Sapiens
KNVVGQILV

SEQ ID NO: 307781 - protein, 9 aa, Homo Sapiens
KQLEDKMVQ

SEQ ID NO: 307782 - protein, 9 aa, Homo Sapiens
KEQGKEQAM

SEQ ID NO: 307783 - protein, 9 aa, Homo Sapiens
ICESLIYTV

SEQ ID NO: 307784 - protein, 9 aa, Homo Sapiens
GLHQVLNIQ

SEQ ID NO: 307785 - protein, 9 aa, Homo Sapiens
SRDVSHQPE

SEQ ID NO: 307786 - protein, 9 aa, Homo Sapiens
DPDSIEIVA

SEQ ID NO: 307787 - protein, 9 aa, Homo Sapiens
QAPSEGACD

SEQ ID NO: 307788 - protein, 9 aa, Homo Sapiens
QIWFQNWRA

SEQ ID NO: 307789 - protein, 9 aa, Homo Sapiens
ADNSCNKQQ

SEQ ID NO: 307790 - protein, 9 aa, Homo Sapiens
QFDTTATAG

SEQ ID NO: 307791 - protein, 9 aa, Homo Sapiens
LLSLKLKLG

SEQ ID NO: 307792 - protein, 9 aa, Homo Sapiens
SELSGDVDS

SEQ ID NO: 307793 - protein, 9 aa, Homo Sapiens
MQMLNMDRV

SEQ ID NO: 307794 - protein, 9 aa, Homo Sapiens
KSQSDEDKM

SEQ ID NO: 307795 - protein, 9 aa, Homo Sapiens
KRRGSQDKQ

SEQ ID NO: 307796 - protein, 9 aa, Homo Sapiens
DAPIIKKIV

SEQ ID NO: 307797 - protein, 9 aa, Homo Sapiens
QRSLASWNY

SEQ ID NO: 307798 - protein, 9 aa, Homo Sapiens
DHRYKLCDN

SEQ ID NO: 307799 - protein, 9 aa, Homo Sapiens
LIKTEDEYD

SEQ ID NO: 307800 - protein, 9 aa, Homo Sapiens
IYGEQSENT

SEQ ID NO: 307801 - protein, 9 aa, Homo Sapiens
GEYIRPLPP

SEQ ID NO: 307802 - protein, 9 aa, Homo Sapiens
KVRERLRVY

SEQ ID NO: 307803 - protein, 9 aa, Homo Sapiens
QRQQFLEKQ

SEQ ID NO: 307804 - protein, 9 aa, Homo Sapiens
GMYMFRHVD

SEQ ID NO: 307805 - protein, 9 aa, Homo Sapiens
ESNKACLRG

SEQ ID NO: 307806 - protein, 9 aa, Homo Sapiens
AHAGLFVED

SEQ ID NO: 307807 - protein, 9 aa, Homo Sapiens
TDKLYEEDD

SEQ ID NO: 307808 - protein, 9 aa, Homo Sapiens
HEKDDVHHL

SEQ ID NO: 307809 - protein, 9 aa, Homo Sapiens
VEDCLMVGL

SEQ ID NO: 307810 - protein, 9 aa, Homo Sapiens
LPMLLKNFL

SEQ ID NO: 307811 - protein, 9 aa, Homo Sapiens
CKSGSIFGS

SEQ ID NO: 307812 - protein, 9 aa, Homo Sapiens
LTLITAALY

SEQ ID NO: 307813 - protein, 9 aa, Homo Sapiens
VEISKALQR

SEQ ID NO: 307814 - protein, 9 aa, Homo Sapiens
LFNMCLIDR

SEQ ID NO: 307815 - protein, 9 aa, Homo Sapiens
RLQTLQDLS

SEQ ID NO: 307816 - protein, 9 aa, Homo Sapiens
IQSILSKPF

SEQ ID NO: 307817 - protein, 9 aa, Homo Sapiens
KLLASDSNS

SEQ ID NO: 307818 - protein, 9 aa, Homo Sapiens
GYVFLFTNL

SEQ ID NO: 307819 - protein, 9 aa, Homo Sapiens
EDQEHLVIA

SEQ ID NO: 307820 - protein, 9 aa, Homo Sapiens
GKDFTQNSN

SEQ ID NO: 307821 - protein, 9 aa, Homo Sapiens
MKPGRPQIK

SEQ ID NO: 307822 - protein, 9 aa, Homo Sapiens
STEWADENS

SEQ ID NO: 307823 - protein, 9 aa, Homo Sapiens
GGLSNSREL

SEQ ID NO: 307824 - protein, 9 aa, Homo Sapiens
GQDGIIGVV

SEQ ID NO: 307825 - protein, 9 aa, Homo Sapiens
LCDNKWMVA

SEQ ID NO: 307826 - protein, 9 aa, Homo Sapiens
NVGRTYKNV

SEQ ID NO: 307827 - protein, 9 aa, Homo Sapiens
CQQEAELAR

SEQ ID NO: 307828 - protein, 9 aa, Homo Sapiens
KDKANKFTI

SEQ ID NO: 307829 - protein, 9 aa, Homo Sapiens
FQNLRKMEL

SEQ ID NO: 307830 - protein, 9 aa, Homo Sapiens
DGIPGVQGI

SEQ ID NO: 307831 - protein, 9 aa, Homo Sapiens
QNPMLLELM

SEQ ID NO: 307832 - protein, 9 aa, Homo Sapiens
IVRKEVVKE

SEQ ID NO: 307833 - protein, 9 aa, Homo Sapiens
MFLLDPSDL

SEQ ID NO: 307834 - protein, 9 aa, Homo Sapiens
LEAKKAAKI

SEQ ID NO: 307835 - protein, 9 aa, Homo Sapiens
WVLCTVAAT

SEQ ID NO: 307836 - protein, 9 aa, Homo Sapiens
SPVNKERIK

SEQ ID NO: 307837 - protein, 9 aa, Homo Sapiens
EATNSMNNN

SEQ ID NO: 307838 - protein, 9 aa, Homo Sapiens
WVRRKAGYN

SEQ ID NO: 307839 - protein, 9 aa, Homo Sapiens
NLQDTSDES

SEQ ID NO: 307840 - protein, 9 aa, Homo Sapiens
KMQLKCLMK

SEQ ID NO: 307841 - protein, 9 aa, Homo Sapiens
QPIKCLIKH

SEQ ID NO: 307842 - protein, 9 aa, Homo Sapiens
NRTEAMWDD

SEQ ID NO: 307843 - protein, 9 aa, Homo Sapiens
ANAKCYETK

SEQ ID NO: 307844 - protein, 9 aa, Homo Sapiens
QAITGKRKI

SEQ ID NO: 307845 - protein, 9 aa, Homo Sapiens
ARISAQGLI

SEQ ID NO: 307846 - protein, 9 aa, Homo Sapiens
MLEYDPAKI

SEQ ID NO: 307847 - protein, 9 aa, Homo Sapiens
GHCHCHQQS

SEQ ID NO: 307848 - protein, 9 aa, Homo Sapiens
YECSECGQS

SEQ ID NO: 307849 - protein, 9 aa, Homo Sapiens
TDGFQNYVI

SEQ ID NO: 307850 - protein, 9 aa, Homo Sapiens
DEYKNRARS

SEQ ID NO: 307851 - protein, 9 aa, Homo Sapiens
KWILSTSDT

SEQ ID NO: 307852 - protein, 9 aa, Homo Sapiens
CLDNKKVEK

SEQ ID NO: 307853 - protein, 9 aa, Homo Sapiens
VAKSANKVK

SEQ ID NO: 307854 - protein, 9 aa, Homo Sapiens
LPCFGLGQM

SEQ ID NO: 307855 - protein, 9 aa, Homo Sapiens
WVKLEIIQF

SEQ ID NO: 307856 - protein, 9 aa, Homo Sapiens
NWSPQIQGI

SEQ ID NO: 307857 - protein, 9 aa, Homo Sapiens
LFRARWKHE

SEQ ID NO: 307858 - protein, 9 aa, Homo Sapiens
ELIHALYPE

SEQ ID NO: 307859 - protein, 9 aa, Homo Sapiens
FISYLKAIC

SEQ ID NO: 307860 - protein, 9 aa, Homo Sapiens
IKPPSKMLS

SEQ ID NO: 307861 - protein, 9 aa, Homo Sapiens
EKPQSSSTE

SEQ ID NO: 307862 - protein, 9 aa, Homo Sapiens
VKIYPYTSS

SEQ ID NO: 307863 - protein, 9 aa, Homo Sapiens
KNSCFPTSR

SEQ ID NO: 307864 - protein, 9 aa, Homo Sapiens
DYTPSTTSL

SEQ ID NO: 307865 - protein, 9 aa, Homo Sapiens
HILYSLRNK

SEQ ID NO: 307866 - protein, 9 aa, Homo Sapiens
LSAFLATQA

SEQ ID NO: 307867 - protein, 9 aa, Homo Sapiens
SGLSGDNLI

SEQ ID NO: 307868 - protein, 9 aa, Homo Sapiens
KFMEKSNNQ

SEQ ID NO: 307869 - protein, 9 aa, Homo Sapiens
YSFTGGSQE

SEQ ID NO: 307870 - protein, 9 aa, Homo Sapiens
PAPRVRTDY

SEQ ID NO: 307871 - protein, 9 aa, Homo Sapiens
HQISLNELT

SEQ ID NO: 307872 - protein, 9 aa, Homo Sapiens
FVTRKQGST

SEQ ID NO: 307873 - protein, 9 aa, Homo Sapiens
ESSLNKRLQ

SEQ ID NO: 307874 - protein, 9 aa, Homo Sapiens
GWLTRFKQW

SEQ ID NO: 307875 - protein, 9 aa, Homo Sapiens
IKTEDEYDQ

SEQ ID NO: 307876 - protein, 9 aa, Homo Sapiens
FSPHLYNSV

SEQ ID NO: 307877 - protein, 9 aa, Homo Sapiens
EPFTIPEDD

SEQ ID NO: 307878 - protein, 9 aa, Homo Sapiens
NKLEVELLK

SEQ ID NO: 307879 - protein, 9 aa, Homo Sapiens
LHLNLPKRI

SEQ ID NO: 307880 - protein, 9 aa, Homo Sapiens
DEQKMAHKI

SEQ ID NO: 307881 - protein, 9 aa, Homo Sapiens
TPIRALQKV

SEQ ID NO: 307882 - protein, 9 aa, Homo Sapiens
DGDNKYDTG

SEQ ID NO: 307883 - protein, 9 aa, Homo Sapiens
KEVIYLEKL

SEQ ID NO: 307884 - protein, 9 aa, Homo Sapiens
ILYWFYNED

SEQ ID NO: 307885 - protein, 9 aa, Homo Sapiens
TLFTWKANT

SEQ ID NO: 307886 - protein, 9 aa, Homo Sapiens
RRPSFRDYI

SEQ ID NO: 307887 - protein, 9 aa, Homo Sapiens
DMGNNKYCF

SEQ ID NO: 307888 - protein, 9 aa, Homo Sapiens
QIRPWINKK

SEQ ID NO: 307889 - protein, 9 aa, Homo Sapiens
FSVKGYKEQ

SEQ ID NO: 307890 - protein, 9 aa, Homo Sapiens
LPHPFLPNV

SEQ ID NO: 307891 - protein, 9 aa, Homo Sapiens
RYRPTKTYL

SEQ ID NO: 307892 - protein, 9 aa, Homo Sapiens
QSYCGHGIH

SEQ ID NO: 307893 - protein, 9 aa, Homo Sapiens
RHTFPEVQI

SEQ ID NO: 307894 - protein, 9 aa, Homo Sapiens
QNHYLNVTP

SEQ ID NO: 307895 - protein, 9 aa, Homo Sapiens
QPNEHNNQI

SEQ ID NO: 307896 - protein, 9 aa, Homo Sapiens
AHRHLVEDN

SEQ ID NO: 307897 - protein, 9 aa, Homo Sapiens
IETETAPLQ

SEQ ID NO: 307898 - protein, 9 aa, Homo Sapiens
HCLLQPHWS

SEQ ID NO: 307899 - protein, 9 aa, Homo Sapiens
TRFKQWHSI

SEQ ID NO: 307900 - protein, 9 aa, Homo Sapiens
KKVFAESKE

SEQ ID NO: 307901 - protein, 9 aa, Homo Sapiens
RHWKSHKDV

SEQ ID NO: 307902 - protein, 9 aa, Homo Sapiens
TQCALSTSP

SEQ ID NO: 307903 - protein, 9 aa, Homo Sapiens
LESLAKDHC

SEQ ID NO: 307904 - protein, 9 aa, Homo Sapiens
EGTQEVSVQ

SEQ ID NO: 307905 - protein, 9 aa, Homo Sapiens
DTLLKEGFR

SEQ ID NO: 307906 - protein, 9 aa, Homo Sapiens
RQQEVLRAQ

SEQ ID NO: 307907 - protein, 9 aa, Homo Sapiens
CGQSFTCKS

SEQ ID NO: 307908 - protein, 9 aa, Homo Sapiens
ECERFRQLL

SEQ ID NO: 307909 - protein, 9 aa, Homo Sapiens
ITKVDLQAK

SEQ ID NO: 307910 - protein, 9 aa, Homo Sapiens
TCPAGYTLW

SEQ ID NO: 307911 - protein, 9 aa, Homo Sapiens
WGRFLSHVV

SEQ ID NO: 307912 - protein, 9 aa, Homo Sapiens
HSCGDLLTF

SEQ ID NO: 307913 - protein, 9 aa, Homo Sapiens
PMGLVSRVM

SEQ ID NO: 307914 - protein, 9 aa, Homo Sapiens
FNQMETIIK

SEQ ID NO: 307915 - protein, 9 aa, Homo Sapiens
ANCTYFKLF

SEQ ID NO: 307916 - protein, 9 aa, Homo Sapiens
LKEKVNLQK

SEQ ID NO: 307917 - protein, 9 aa, Homo Sapiens
SAHAGLFVE

SEQ ID NO: 307918 - protein, 9 aa, Homo Sapiens
KNYPKNMET

SEQ ID NO: 307919 - protein, 9 aa, Homo Sapiens
IWFQHRRSR

SEQ ID NO: 307920 - protein, 9 aa, Homo Sapiens
EAQYQFIYM

SEQ ID NO: 307921 - protein, 9 aa, Homo Sapiens
SFINSTLTP

SEQ ID NO: 307922 - protein, 9 aa, Homo Sapiens
LIFLMMLHK

SEQ ID NO: 307923 - protein, 9 aa, Homo Sapiens
FILAAHQPA

SEQ ID NO: 307924 - protein, 9 aa, Homo Sapiens
LDKITARLC

SEQ ID NO: 307925 - protein, 9 aa, Homo Sapiens
DASTENTLG

SEQ ID NO: 307926 - protein, 9 aa, Homo Sapiens
CGSHSGGGP

SEQ ID NO: 307927 - protein, 9 aa, Homo Sapiens
LKDITIVKE

SEQ ID NO: 307928 - protein, 9 aa, Homo Sapiens
RKENETPQR

SEQ ID NO: 307929 - protein, 9 aa, Homo Sapiens
NYFLIFKES

SEQ ID NO: 307930 - protein, 9 aa, Homo Sapiens
LRPSWGLLG

SEQ ID NO: 307931 - protein, 9 aa, Homo Sapiens
GVSSQKIYL

SEQ ID NO: 307932 - protein, 9 aa, Homo Sapiens
ASNITNKMD

SEQ ID NO: 307933 - protein, 9 aa, Homo Sapiens
ILMQHIETV

SEQ ID NO: 307934 - protein, 9 aa, Homo Sapiens
VQVIVEFTK

SEQ ID NO: 307935 - protein, 9 aa, Homo Sapiens
DRRKNGMMD

SEQ ID NO: 307936 - protein, 9 aa, Homo Sapiens
ETHDLKESI

SEQ ID NO: 307937 - protein, 9 aa, Homo Sapiens
VQEGQWYKM

SEQ ID NO: 307938 - protein, 9 aa, Homo Sapiens
LAYHQIIHT

SEQ ID NO: 307939 - protein, 9 aa, Homo Sapiens
HNQNGSELD

SEQ ID NO: 307940 - protein, 9 aa, Homo Sapiens
HNYLQNHLY

SEQ ID NO: 307941 - protein, 9 aa, Homo Sapiens
TYRKKWLQE

SEQ ID NO: 307942 - protein, 9 aa, Homo Sapiens
QLGLCLAEK

SEQ ID NO: 307943 - protein, 9 aa, Homo Sapiens
ISTVCVGLA

SEQ ID NO: 307944 - protein, 9 aa, Homo Sapiens
IVSLVDVSG

SEQ ID NO: 307945 - protein, 9 aa, Homo Sapiens
SIHNFTETH

SEQ ID NO: 307946 - protein, 9 aa, Homo Sapiens
RGDHPAAHN

SEQ ID NO: 307947 - protein, 9 aa, Homo Sapiens
ADLGYKQIN

SEQ ID NO: 307948 - protein, 9 aa, Homo Sapiens
TPAPRVRTD

SEQ ID NO: 307949 - protein, 9 aa, Homo Sapiens
YRIILKELE

SEQ ID NO: 307950 - protein, 9 aa, Homo Sapiens
DKTDMTPST

SEQ ID NO: 307951 - protein, 9 aa, Homo Sapiens
MLTFSSATD

SEQ ID NO: 307952 - protein, 9 aa, Homo Sapiens
KQICGAHRQ

SEQ ID NO: 307953 - protein, 9 aa, Homo Sapiens
ELYQKLGSD

SEQ ID NO: 307954 - protein, 9 aa, Homo Sapiens
AQITTWSAG

SEQ ID NO: 307955 - protein, 9 aa, Homo Sapiens
KSNSKVKIY

SEQ ID NO: 307956 - protein, 9 aa, Homo Sapiens
KLHLVNCVE

SEQ ID NO: 307957 - protein, 9 aa, Homo Sapiens
CTTTGTWAE

SEQ ID NO: 307958 - protein, 9 aa, Homo Sapiens
FYFFFKDSW

SEQ ID NO: 307959 - protein, 9 aa, Homo Sapiens
SYKNKTKSS

SEQ ID NO: 307960 - protein, 9 aa, Homo Sapiens
CMKTTWQIN

SEQ ID NO: 307961 - protein, 9 aa, Homo Sapiens
MIDDMLLRL

SEQ ID NO: 307962 - protein, 9 aa, Homo Sapiens
PPEMDDRES

SEQ ID NO: 307963 - protein, 9 aa, Homo Sapiens
SLILIYETF

SEQ ID NO: 307964 - protein, 9 aa, Homo Sapiens
PDNFSPLSG

SEQ ID NO: 307965 - protein, 9 aa, Homo Sapiens
QLGSITEHC

SEQ ID NO: 307966 - protein, 9 aa, Homo Sapiens
ILEAPDLYV

SEQ ID NO: 307967 - protein, 9 aa, Homo Sapiens
SDPENVQSE

SEQ ID NO: 307968 - protein, 9 aa, Homo Sapiens
TAVKFGNHM

SEQ ID NO: 307969 - protein, 9 aa, Homo Sapiens
SIYIPEDDK

SEQ ID NO: 307970 - protein, 9 aa, Homo Sapiens
NRADYYLEE

SEQ ID NO: 307971 - protein, 9 aa, Homo Sapiens
HIIYQMDDV

SEQ ID NO: 307972 - protein, 9 aa, Homo Sapiens
NYMRLNSWF

SEQ ID NO: 307973 - protein, 9 aa, Homo Sapiens
KSVSLLSNS

SEQ ID NO: 307974 - protein, 9 aa, Homo Sapiens
SQGYFPPRD

SEQ ID NO: 307975 - protein, 9 aa, Homo Sapiens
ICSMTLKLP

SEQ ID NO: 307976 - protein, 9 aa, Homo Sapiens
AQPLFLHPG

SEQ ID NO: 307977 - protein, 9 aa, Homo Sapiens
LQNAVEATR

SEQ ID NO: 307978 - protein, 9 aa, Homo Sapiens
LLEYPVLCA

SEQ ID NO: 307979 - protein, 9 aa, Homo Sapiens
IKWTKLTLD

SEQ ID NO: 307980 - protein, 9 aa, Homo Sapiens
HPMGTSNFD

SEQ ID NO: 307981 - protein, 9 aa, Homo Sapiens
VSLEMINED

SEQ ID NO: 307982 - protein, 9 aa, Homo Sapiens
KETVQKVTP

SEQ ID NO: 307983 - protein, 9 aa, Homo Sapiens
LQVWDLEPN

SEQ ID NO: 307984 - protein, 9 aa, Homo Sapiens
DHPAAHNRF

SEQ ID NO: 307985 - protein, 9 aa, Homo Sapiens
PNSQLRHIH

SEQ ID NO: 307986 - protein, 9 aa, Homo Sapiens
RCVSIYLID

SEQ ID NO: 307987 - protein, 9 aa, Homo Sapiens
VPILSADIA

SEQ ID NO: 307988 - protein, 9 aa, Homo Sapiens
ALVTQQNVP

SEQ ID NO: 307989 - protein, 9 aa, Homo Sapiens
IDPVCALQA

SEQ ID NO: 307990 - protein, 9 aa, Homo Sapiens
CLSCLLPWG

SEQ ID NO: 307991 - protein, 9 aa, Homo Sapiens
FDKPRGTLA

SEQ ID NO: 307992 - protein, 9 aa, Homo Sapiens
KIYPYTSSS

SEQ ID NO: 307993 - protein, 9 aa, Homo Sapiens
ARDLSSLRT

SEQ ID NO: 307994 - protein, 9 aa, Homo Sapiens
VVGNLLISM

SEQ ID NO: 307995 - protein, 9 aa, Homo Sapiens
TGQAGSPGD

SEQ ID NO: 307996 - protein, 9 aa, Homo Sapiens
LHQTEEGSS

SEQ ID NO: 307997 - protein, 9 aa, Homo Sapiens
LNSLHLSFA

SEQ ID NO: 307998 - protein, 9 aa, Homo Sapiens
LQVLLTQIK

SEQ ID NO: 307999 - protein, 9 aa, Homo Sapiens
MKQMNDAQH

SEQ ID NO: 308000 - protein, 9 aa, Homo Sapiens
GRCVPPALE

SEQ ID NO: 308001 - protein, 9 aa, Homo Sapiens
LAEELIFQY

SEQ ID NO: 308002 - protein, 9 aa, Homo Sapiens
WLNTCFDIE

SEQ ID NO: 308003 - protein, 9 aa, Homo Sapiens
PRNAPPCKL

SEQ ID NO: 308004 - protein, 9 aa, Homo Sapiens
DATYVNNPE

SEQ ID NO: 308005 - protein, 9 aa, Homo Sapiens
RSQAPIHRP

SEQ ID NO: 308006 - protein, 9 aa, Homo Sapiens
KYDTGEHGL

SEQ ID NO: 308007 - protein, 9 aa, Homo Sapiens
ADPDSIEIV

SEQ ID NO: 308008 - protein, 9 aa, Homo Sapiens
TRKQTVPLL

SEQ ID NO: 308009 - protein, 9 aa, Homo Sapiens
IPVINNSIK

SEQ ID NO: 308010 - protein, 9 aa, Homo Sapiens
AAPSQSILF

SEQ ID NO: 308011 - protein, 9 aa, Homo Sapiens
TQQNVPIER

SEQ ID NO: 308012 - protein, 9 aa, Homo Sapiens
QPDPEVRRA

SEQ ID NO: 308013 - protein, 9 aa, Homo Sapiens
ERLFDSHRR

SEQ ID NO: 308014 - protein, 9 aa, Homo Sapiens
HSFHVHFED

SEQ ID NO: 308015 - protein, 9 aa, Homo Sapiens
LMDKLKGRT

SEQ ID NO: 308016 - protein, 9 aa, Homo Sapiens
LFKTEKMLT

SEQ ID NO: 308017 - protein, 9 aa, Homo Sapiens
YLKVIKFKD

SEQ ID NO: 308018 - protein, 9 aa, Homo Sapiens
LPKRIDTEM

SEQ ID NO: 308019 - protein, 9 aa, Homo Sapiens
HNLPRAVDD

SEQ ID NO: 308020 - protein, 9 aa, Homo Sapiens
LHGRDGRKH

SEQ ID NO: 308021 - protein, 9 aa, Homo Sapiens
YDKGLKVGE

SEQ ID NO: 308022 - protein, 9 aa, Homo Sapiens
TMSVEDFLY

SEQ ID NO: 308023 - protein, 9 aa, Homo Sapiens
LAKKQDVDE

SEQ ID NO: 308024 - protein, 9 aa, Homo Sapiens
DLSSLRTSD

SEQ ID NO: 308025 - protein, 9 aa, Homo Sapiens
HFTRDLMDK

SEQ ID NO: 308026 - protein, 9 aa, Homo Sapiens
IQLQIASFS

SEQ ID NO: 308027 - protein, 9 aa, Homo Sapiens
IKTLCALAV

SEQ ID NO: 308028 - protein, 9 aa, Homo Sapiens
ITRKVDTGG

SEQ ID NO: 308029 - protein, 9 aa, Homo Sapiens
ELLARDFEN

SEQ ID NO: 308030 - protein, 9 aa, Homo Sapiens
TNKQTDDLG

SEQ ID NO: 308031 - protein, 9 aa, Homo Sapiens
FGILDFISI

SEQ ID NO: 308032 - protein, 9 aa, Homo Sapiens
INLAGGHVK

SEQ ID NO: 308033 - protein, 9 aa, Homo Sapiens
RVYLERVSA

SEQ ID NO: 308034 - protein, 9 aa, Homo Sapiens
FLKQNTFSP

SEQ ID NO: 308035 - protein, 9 aa, Homo Sapiens
EEEEELNFE

SEQ ID NO: 308036 - protein, 9 aa, Homo Sapiens
LPNDQSSSS

SEQ ID NO: 308037 - protein, 9 aa, Homo Sapiens
AKPSLLKTF

SEQ ID NO: 308038 - protein, 9 aa, Homo Sapiens
RPSYVLTIY

SEQ ID NO: 308039 - protein, 9 aa, Homo Sapiens
IFPQYVLLF

SEQ ID NO: 308040 - protein, 9 aa, Homo Sapiens
LYTTERDLC

SEQ ID NO: 308041 - protein, 9 aa, Homo Sapiens
TSQVILHLG

SEQ ID NO: 308042 - protein, 9 aa, Homo Sapiens
LAEPEAEPH

SEQ ID NO: 308043 - protein, 9 aa, Homo Sapiens
NLDSDKPIF

SEQ ID NO: 308044 - protein, 9 aa, Homo Sapiens
QASWIHCMI

SEQ ID NO: 308045 - protein, 9 aa, Homo Sapiens
PFVVNVAPQ

SEQ ID NO: 308046 - protein, 9 aa, Homo Sapiens
LELCRGRED

SEQ ID NO: 308047 - protein, 9 aa, Homo Sapiens
LSEKNYPKN

SEQ ID NO: 308048 - protein, 9 aa, Homo Sapiens
IQYPLNKLD

SEQ ID NO: 308049 - protein, 9 aa, Homo Sapiens
IILMECMNK

SEQ ID NO: 308050 - protein, 9 aa, Homo Sapiens
VFGNQFGLE

SEQ ID NO: 308051 - protein, 9 aa, Homo Sapiens
IQLGSSIVG

SEQ ID NO: 308052 - protein, 9 aa, Homo Sapiens
VFSSVMKPD

SEQ ID NO: 308053 - protein, 9 aa, Homo Sapiens
MPRPTLSVT

SEQ ID NO: 308054 - protein, 9 aa, Homo Sapiens
KNVPKYQCP

SEQ ID NO: 308055 - protein, 9 aa, Homo Sapiens
VPDQSDRSG

SEQ ID NO: 308056 - protein, 9 aa, Homo Sapiens
HAHRHLVED

SEQ ID NO: 308057 - protein, 9 aa, Homo Sapiens
IASPTFQRL

SEQ ID NO: 308058 - protein, 9 aa, Homo Sapiens
NLTKMKSTL

SEQ ID NO: 308059 - protein, 9 aa, Homo Sapiens
GSTEWADEN

SEQ ID NO: 308060 - protein, 9 aa, Homo Sapiens
KKNEKSIKA

SEQ ID NO: 308061 - protein, 9 aa, Homo Sapiens
REEQIIHQE

SEQ ID NO: 308062 - protein, 9 aa, Homo Sapiens
APKKDVDAA

SEQ ID NO: 308063 - protein, 9 aa, Homo Sapiens
AKAVITTTD

SEQ ID NO: 308064 - protein, 9 aa, Homo Sapiens
KAFSKSSYL

SEQ ID NO: 308065 - protein, 9 aa, Homo Sapiens
NAKCYETKG

SEQ ID NO: 308066 - protein, 9 aa, Homo Sapiens
SADMAKSHR

SEQ ID NO: 308067 - protein, 9 aa, Homo Sapiens
EIEYTTLKK

SEQ ID NO: 308068 - protein, 9 aa, Homo Sapiens
FHIQTRSNV

SEQ ID NO: 308069 - protein, 9 aa, Homo Sapiens
TTTNANAIL

SEQ ID NO: 308070 - protein, 9 aa, Homo Sapiens
LGSTKFDIS

SEQ ID NO: 308071 - protein, 9 aa, Homo Sapiens
FLLQFTVEH

SEQ ID NO: 308072 - protein, 9 aa, Homo Sapiens
FVQALIKKD

SEQ ID NO: 308073 - protein, 9 aa, Homo Sapiens
NAMMIKTIK

SEQ ID NO: 308074 - protein, 9 aa, Homo Sapiens
INRAAPWGT

SEQ ID NO: 308075 - protein, 9 aa, Homo Sapiens
PRLSPDQCC

SEQ ID NO: 308076 - protein, 9 aa, Homo Sapiens
SDSSDSSDN

SEQ ID NO: 308077 - protein, 9 aa, Homo Sapiens
RVQAEGQSC

SEQ ID NO: 308078 - protein, 9 aa, Homo Sapiens
WFQNWRAKL

SEQ ID NO: 308079 - protein, 9 aa, Homo Sapiens
KFLLLAVMS

SEQ ID NO: 308080 - protein, 9 aa, Homo Sapiens
SWHLSNRST

SEQ ID NO: 308081 - protein, 9 aa, Homo Sapiens
AVEMLKMFM

SEQ ID NO: 308082 - protein, 9 aa, Homo Sapiens
SLIQDSIVN

SEQ ID NO: 308083 - protein, 9 aa, Homo Sapiens
VESCNSPNV

SEQ ID NO: 308084 - protein, 9 aa, Homo Sapiens
KALFYSASF

SEQ ID NO: 308085 - protein, 9 aa, Homo Sapiens
LMDYLINNG

SEQ ID NO: 308086 - protein, 9 aa, Homo Sapiens
ALKDIIGPP

SEQ ID NO: 308087 - protein, 9 aa, Homo Sapiens
EAERNKIED

SEQ ID NO: 308088 - protein, 9 aa, Homo Sapiens
ASGARPTSF

SEQ ID NO: 308089 - protein, 9 aa, Homo Sapiens
FLDILNYLS

SEQ ID NO: 308090 - protein, 9 aa, Homo Sapiens
YQPKFWCQQ

SEQ ID NO: 308091 - protein, 9 aa, Homo Sapiens
LTQSFFAIF

SEQ ID NO: 308092 - protein, 9 aa, Homo Sapiens
IHYWVLQFL

SEQ ID NO: 308093 - protein, 9 aa, Homo Sapiens
TQQIQDEII

SEQ ID NO: 308094 - protein, 9 aa, Homo Sapiens
FACELLSDN

SEQ ID NO: 308095 - protein, 9 aa, Homo Sapiens
FYFILGDHF

SEQ ID NO: 308096 - protein, 9 aa, Homo Sapiens
IDDIFNKIK

SEQ ID NO: 308097 - protein, 9 aa, Homo Sapiens
ETKSQSDED

SEQ ID NO: 308098 - protein, 9 aa, Homo Sapiens
QLEDKMVQQ

SEQ ID NO: 308099 - protein, 9 aa, Homo Sapiens
MGMKFFQIK

SEQ ID NO: 308100 - protein, 9 aa, Homo Sapiens
VIQSSETCL

SEQ ID NO: 308101 - protein, 9 aa, Homo Sapiens
PTSRHILEG

SEQ ID NO: 308102 - protein, 9 aa, Homo Sapiens
DEYDQLVWM

SEQ ID NO: 308103 - protein, 9 aa, Homo Sapiens
HLMSLSGGK

SEQ ID NO: 308104 - protein, 9 aa, Homo Sapiens
TGNITIITL

SEQ ID NO: 308105 - protein, 9 aa, Homo Sapiens
ILFTTVSIP

SEQ ID NO: 308106 - protein, 9 aa, Homo Sapiens
DTQMIDDML

SEQ ID NO: 308107 - protein, 9 aa, Homo Sapiens
TATSPLKED

SEQ ID NO: 308108 - protein, 9 aa, Homo Sapiens
NKGDFYQED

SEQ ID NO: 308109 - protein, 9 aa, Homo Sapiens
EFSDIFFVS

SEQ ID NO: 308110 - protein, 9 aa, Homo Sapiens
NSGYGSYGG

SEQ ID NO: 308111 - protein, 9 aa, Homo Sapiens
GILGIPGSR

SEQ ID NO: 308112 - protein, 9 aa, Homo Sapiens
NTKYLQTTL

SEQ ID NO: 308113 - protein, 9 aa, Homo Sapiens
QQQQKSIAL

SEQ ID NO: 308114 - protein, 9 aa, Homo Sapiens
VGARHSKHT

SEQ ID NO: 308115 - protein, 9 aa, Homo Sapiens
HYLPIEDPQ

SEQ ID NO: 308116 - protein, 9 aa, Homo Sapiens
ASMGAVVSL

SEQ ID NO: 308117 - protein, 9 aa, Homo Sapiens
EEERRLDSG

SEQ ID NO: 308118 - protein, 9 aa, Homo Sapiens
AKGPIAKFV

SEQ ID NO: 308119 - protein, 9 aa, Homo Sapiens
TQPLPGGLL

SEQ ID NO: 308120 - protein, 9 aa, Homo Sapiens
GDNNAPILG

SEQ ID NO: 308121 - protein, 9 aa, Homo Sapiens
WNDVDDCNW

SEQ ID NO: 308122 - protein, 9 aa, Homo Sapiens
HMHLIQHQK

SEQ ID NO: 308123 - protein, 9 aa, Homo Sapiens
FYFIPSQLC

SEQ ID NO: 308124 - protein, 9 aa, Homo Sapiens
HRYKLCDNK

SEQ ID NO: 308125 - protein, 9 aa, Homo Sapiens
YQLRLNGIK

SEQ ID NO: 308126 - protein, 9 aa, Homo Sapiens
AQMPVYSVG

SEQ ID NO: 308127 - protein, 9 aa, Homo Sapiens
DEDFKTAVK

SEQ ID NO: 308128 - protein, 9 aa, Homo Sapiens
VVMWVSASN

SEQ ID NO: 308129 - protein, 9 aa, Homo Sapiens
ESQGKNRES

SEQ ID NO: 308130 - protein, 9 aa, Homo Sapiens
TDKTGNVSR

SEQ ID NO: 308131 - protein, 9 aa, Homo Sapiens
KLFGFVTRK

SEQ ID NO: 308132 - protein, 9 aa, Homo Sapiens
YAIKNASLR

SEQ ID NO: 308133 - protein, 9 aa, Homo Sapiens
IDMKDKLLL

SEQ ID NO: 308134 - protein, 9 aa, Homo Sapiens
QQDMAQLIH

SEQ ID NO: 308135 - protein, 9 aa, Homo Sapiens
AGERSVVEC

SEQ ID NO: 308136 - protein, 9 aa, Homo Sapiens
ATHKGNKIR

SEQ ID NO: 308137 - protein, 9 aa, Homo Sapiens
VFVLIGFMI

SEQ ID NO: 308138 - protein, 9 aa, Homo Sapiens
KNTLFTWKA

SEQ ID NO: 308139 - protein, 9 aa, Homo Sapiens
VVSINERQH

SEQ ID NO: 308140 - protein, 9 aa, Homo Sapiens
IPCIVVANT

SEQ ID NO: 308141 - protein, 9 aa, Homo Sapiens
TQNMQRLLE

SEQ ID NO: 308142 - protein, 9 aa, Homo Sapiens
TLKDYRIIL

SEQ ID NO: 308143 - protein, 9 aa, Homo Sapiens
GDLLCKIFV

SEQ ID NO: 308144 - protein, 9 aa, Homo Sapiens
YNNLVAVDW

SEQ ID NO: 308145 - protein, 9 aa, Homo Sapiens
DEFKNMVKT

SEQ ID NO: 308146 - protein, 9 aa, Homo Sapiens
PSWPSTAIN

SEQ ID NO: 308147 - protein, 9 aa, Homo Sapiens
GHKQQLIKR

SEQ ID NO: 308148 - protein, 9 aa, Homo Sapiens
KNRLSSYTR

SEQ ID NO: 308149 - protein, 9 aa, Homo Sapiens
PGSVQSSSG

SEQ ID NO: 308150 - protein, 9 aa, Homo Sapiens
KCLMKGKGQ

SEQ ID NO: 308151 - protein, 9 aa, Homo Sapiens
GEVIETTAP

SEQ ID NO: 308152 - protein, 9 aa, Homo Sapiens
QLQLPMLLK

SEQ ID NO: 308153 - protein, 9 aa, Homo Sapiens
TLTAAFYLA

SEQ ID NO: 308154 - protein, 9 aa, Homo Sapiens
RSWQESNKA

SEQ ID NO: 308155 - protein, 9 aa, Homo Sapiens
TQTRLSTET

SEQ ID NO: 308156 - protein, 9 aa, Homo Sapiens
HLNMPKMSF

SEQ ID NO: 308157 - protein, 9 aa, Homo Sapiens
TYYGNLDSD

SEQ ID NO: 308158 - protein, 9 aa, Homo Sapiens
KRSVWNSEP

SEQ ID NO: 308159 - protein, 9 aa, Homo Sapiens
HALKDIIGP

SEQ ID NO: 308160 - protein, 9 aa, Homo Sapiens
PEIYQDTMY

SEQ ID NO: 308161 - protein, 9 aa, Homo Sapiens
DENSRLLQE

SEQ ID NO: 308162 - protein, 9 aa, Homo Sapiens
RMLLCQEYT

SEQ ID NO: 308163 - protein, 9 aa, Homo Sapiens
ARHSKHTVV

SEQ ID NO: 308164 - protein, 9 aa, Homo Sapiens
NFGESTLLS

SEQ ID NO: 308165 - protein, 9 aa, Homo Sapiens
MYTLAAMHR

SEQ ID NO: 308166 - protein, 9 aa, Homo Sapiens
LQENNCHTA

SEQ ID NO: 308167 - protein, 9 aa, Homo Sapiens
GREHAVVIS

SEQ ID NO: 308168 - protein, 9 aa, Homo Sapiens
IMELNNASL

SEQ ID NO: 308169 - protein, 9 aa, Homo Sapiens
KLVRHQITH

SEQ ID NO: 308170 - protein, 9 aa, Homo Sapiens
QWCVCKLQW

SEQ ID NO: 308171 - protein, 9 aa, Homo Sapiens
FPINQAFVV

SEQ ID NO: 308172 - protein, 9 aa, Homo Sapiens
SAILYVHRI

SEQ ID NO: 308173 - protein, 9 aa, Homo Sapiens
TFVETNVAT

SEQ ID NO: 308174 - protein, 9 aa, Homo Sapiens
HCDKIKANG

SEQ ID NO: 308175 - protein, 9 aa, Homo Sapiens
QLSCLILPS

SEQ ID NO: 308176 - protein, 9 aa, Homo Sapiens
EELTEALRD

SEQ ID NO: 308177 - protein, 9 aa, Homo Sapiens
QQEAPHPQR

SEQ ID NO: 308178 - protein, 9 aa, Homo Sapiens
DSPQWLPCH

SEQ ID NO: 308179 - protein, 9 aa, Homo Sapiens
SVKYGKQKT

SEQ ID NO: 308180 - protein, 9 aa, Homo Sapiens
HPVCRHFMM

SEQ ID NO: 308181 - protein, 9 aa, Homo Sapiens
KELIYLVED

SEQ ID NO: 308182 - protein, 9 aa, Homo Sapiens
LGPDKYDKS

SEQ ID NO: 308183 - protein, 9 aa, Homo Sapiens
LQVAQECLF

SEQ ID NO: 308184 - protein, 9 aa, Homo Sapiens
NHLIEMDKR

SEQ ID NO: 308185 - protein, 9 aa, Homo Sapiens
IHFLNKPAI

SEQ ID NO: 308186 - protein, 9 aa, Homo Sapiens
WITGCSRKI

SEQ ID NO: 308187 - protein, 9 aa, Homo Sapiens
RLLGSSYLP

SEQ ID NO: 308188 - protein, 9 aa, Homo Sapiens
TEENENKSK

SEQ ID NO: 308189 - protein, 9 aa, Homo Sapiens
LFTGSSQLE

SEQ ID NO: 308190 - protein, 9 aa, Homo Sapiens
AATEGLPNY

SEQ ID NO: 308191 - protein, 9 aa, Homo Sapiens
RENISETWR

SEQ ID NO: 308192 - protein, 9 aa, Homo Sapiens
ERHRIIHNG

SEQ ID NO: 308193 - protein, 9 aa, Homo Sapiens
PSDGCTRKG

SEQ ID NO: 308194 - protein, 9 aa, Homo Sapiens
ILHQRVNTG

SEQ ID NO: 308195 - protein, 9 aa, Homo Sapiens
IQWEKNITL

SEQ ID NO: 308196 - protein, 9 aa, Homo Sapiens
IGVLSPSSH

SEQ ID NO: 308197 - protein, 9 aa, Homo Sapiens
TEWADENSR

SEQ ID NO: 308198 - protein, 9 aa, Homo Sapiens
RKTPEGLFR

SEQ ID NO: 308199 - protein, 9 aa, Homo Sapiens
TGKPSMITP

SEQ ID NO: 308200 - protein, 9 aa, Homo Sapiens
EEVWNPQKA

SEQ ID NO: 308201 - protein, 9 aa, Homo Sapiens
DNDFFGTLG

SEQ ID NO: 308202 - protein, 9 aa, Homo Sapiens
YVLLFGLLV

SEQ ID NO: 308203 - protein, 9 aa, Homo Sapiens
YNNRGEIVK

SEQ ID NO: 308204 - protein, 9 aa, Homo Sapiens
GPSSKKRGR

SEQ ID NO: 308205 - protein, 9 aa, Homo Sapiens
PRPSPPHPD

SEQ ID NO: 308206 - protein, 9 aa, Homo Sapiens
MQEDLSRDG

SEQ ID NO: 308207 - protein, 9 aa, Homo Sapiens
IYLIERKYS

SEQ ID NO: 308208 - protein, 9 aa, Homo Sapiens
KLLILRGFR

SEQ ID NO: 308209 - protein, 9 aa, Homo Sapiens
LEELSEYIH

SEQ ID NO: 308210 - protein, 9 aa, Homo Sapiens
RNKIEDLEK

SEQ ID NO: 308211 - protein, 9 aa, Homo Sapiens
KLFCMSFFC

SEQ ID NO: 308212 - protein, 9 aa, Homo Sapiens
ASSLINATF

SEQ ID NO: 308213 - protein, 9 aa, Homo Sapiens
SYQEHSNFL

SEQ ID NO: 308214 - protein, 9 aa, Homo Sapiens
QNSDIVNHR

SEQ ID NO: 308215 - protein, 9 aa, Homo Sapiens
MQSRRPRLE

SEQ ID NO: 308216 - protein, 9 aa, Homo Sapiens
LSSKTESIN

SEQ ID NO: 308217 - protein, 9 aa, Homo Sapiens
LSYGFDGRG

SEQ ID NO: 308218 - protein, 9 aa, Homo Sapiens
KVSGQKIKL

SEQ ID NO: 308219 - protein, 9 aa, Homo Sapiens
QLGFIVFGS

SEQ ID NO: 308220 - protein, 9 aa, Homo Sapiens
TPQGDYQII

SEQ ID NO: 308221 - protein, 9 aa, Homo Sapiens
RNECTHLIV

SEQ ID NO: 308222 - protein, 9 aa, Homo Sapiens
KIQRKLSKI

SEQ ID NO: 308223 - protein, 9 aa, Homo Sapiens
PQELWVDNS

SEQ ID NO: 308224 - protein, 9 aa, Homo Sapiens
NVSLNLTFG

SEQ ID NO: 308225 - protein, 9 aa, Homo Sapiens
KENKSLTPA

SEQ ID NO: 308226 - protein, 9 aa, Homo Sapiens
TKKGLTLKS

SEQ ID NO: 308227 - protein, 9 aa, Homo Sapiens
TIVEVILEV

SEQ ID NO: 308228 - protein, 9 aa, Homo Sapiens
ETNLSKLQS

SEQ ID NO: 308229 - protein, 9 aa, Homo Sapiens
EMTSTLRYW

SEQ ID NO: 308230 - protein, 9 aa, Homo Sapiens
HVLAVSDSM

SEQ ID NO: 308231 - protein, 9 aa, Homo Sapiens
INKKQPCVC

SEQ ID NO: 308232 - protein, 9 aa, Homo Sapiens
TIFRNSIAL

SEQ ID NO: 308233 - protein, 9 aa, Homo Sapiens
LINSLEGAN

SEQ ID NO: 308234 - protein, 9 aa, Homo Sapiens
MSINLSMSC

SEQ ID NO: 308235 - protein, 9 aa, Homo Sapiens
AGIAEHLSR

SEQ ID NO: 308236 - protein, 9 aa, Homo Sapiens
SCYCGKIIS

SEQ ID NO: 308237 - protein, 9 aa, Homo Sapiens
RGPRTQDDI

SEQ ID NO: 308238 - protein, 9 aa, Homo Sapiens
IILTPQVML

SEQ ID NO: 308239 - protein, 9 aa, Homo Sapiens
AITGKRKIQ

SEQ ID NO: 308240 - protein, 9 aa, Homo Sapiens
PENLNLVLI

SEQ ID NO: 308241 - protein, 9 aa, Homo Sapiens
QRITCTCEV

SEQ ID NO: 308242 - protein, 9 aa, Homo Sapiens
SKDNKSPAI

SEQ ID NO: 308243 - protein, 9 aa, Homo Sapiens
FDEVFLFLV

SEQ ID NO: 308244 - protein, 9 aa, Homo Sapiens
NTEDKPYKC

SEQ ID NO: 308245 - protein, 9 aa, Homo Sapiens
FPPKSYSKD

SEQ ID NO: 308246 - protein, 9 aa, Homo Sapiens
EENYNANTL

SEQ ID NO: 308247 - protein, 9 aa, Homo Sapiens
SRNYLSGLR

SEQ ID NO: 308248 - protein, 9 aa, Homo Sapiens
KKVYVCNML

SEQ ID NO: 308249 - protein, 9 aa, Homo Sapiens
ERPSYVLTI

SEQ ID NO: 308250 - protein, 9 aa, Homo Sapiens
FEKRSTQTR

SEQ ID NO: 308251 - protein, 9 aa, Homo Sapiens
SKLQSGPRV

SEQ ID NO: 308252 - protein, 9 aa, Homo Sapiens
PGQNNVDSS

SEQ ID NO: 308253 - protein, 9 aa, Homo Sapiens
YCSMVHAQL

SEQ ID NO: 308254 - protein, 9 aa, Homo Sapiens
NEDNYILWC

SEQ ID NO: 308255 - protein, 9 aa, Homo Sapiens
TGGNLYWGS

SEQ ID NO: 308256 - protein, 9 aa, Homo Sapiens
IAPSSQTKV

SEQ ID NO: 308257 - protein, 9 aa, Homo Sapiens
LNHYISDTF

SEQ ID NO: 308258 - protein, 9 aa, Homo Sapiens
LVKCECAQS

SEQ ID NO: 308259 - protein, 9 aa, Homo Sapiens
SVILQEKEH

SEQ ID NO: 308260 - protein, 9 aa, Homo Sapiens
PLITRFVYH

SEQ ID NO: 308261 - protein, 9 aa, Homo Sapiens
LLFTVGACL

SEQ ID NO: 308262 - protein, 9 aa, Homo Sapiens
MFKEADDLF

SEQ ID NO: 308263 - protein, 9 aa, Homo Sapiens
KAQKCLVFQ

SEQ ID NO: 308264 - protein, 9 aa, Homo Sapiens
NTLPNDQSS

SEQ ID NO: 308265 - protein, 9 aa, Homo Sapiens
PTGLSAPLN

SEQ ID NO: 308266 - protein, 9 aa, Homo Sapiens
DFTQEILPL

SEQ ID NO: 308267 - protein, 9 aa, Homo Sapiens
GRRMFPLLS

SEQ ID NO: 308268 - protein, 9 aa, Homo Sapiens
DSMFSHSIH

SEQ ID NO: 308269 - protein, 9 aa, Homo Sapiens
IILYVYVLS

SEQ ID NO: 308270 - protein, 9 aa, Homo Sapiens
SAGYLTSSP

SEQ ID NO: 308271 - protein, 9 aa, Homo Sapiens
FLPVPTDVT

SEQ ID NO: 308272 - protein, 9 aa, Homo Sapiens
VLQAHLRDS

SEQ ID NO: 308273 - protein, 9 aa, Homo Sapiens
KEEDNAKQI

SEQ ID NO: 308274 - protein, 9 aa, Homo Sapiens
EKDKDKDRE

SEQ ID NO: 308275 - protein, 9 aa, Homo Sapiens
VYNIKLPAG

SEQ ID NO: 308276 - protein, 9 aa, Homo Sapiens
SKALWSWRQ

SEQ ID NO: 308277 - protein, 9 aa, Homo Sapiens
NTKGEVIDV

SEQ ID NO: 308278 - protein, 9 aa, Homo Sapiens
AGGRSCPGN

SEQ ID NO: 308279 - protein, 9 aa, Homo Sapiens
ENGFGHFVQ

SEQ ID NO: 308280 - protein, 9 aa, Homo Sapiens
LNNRVGKAF

SEQ ID NO: 308281 - protein, 9 aa, Homo Sapiens
LKLQEQNIT

SEQ ID NO: 308282 - protein, 9 aa, Homo Sapiens
PANAKCYET

SEQ ID NO: 308283 - protein, 9 aa, Homo Sapiens
EPSIHHFVK

SEQ ID NO: 308284 - protein, 9 aa, Homo Sapiens
GQIMTCGSP

SEQ ID NO: 308285 - protein, 9 aa, Homo Sapiens
ESYRNLVFL

SEQ ID NO: 308286 - protein, 9 aa, Homo Sapiens
LWTACKTKE

SEQ ID NO: 308287 - protein, 9 aa, Homo Sapiens
HEVRKLQNA

SEQ ID NO: 308288 - protein, 9 aa, Homo Sapiens
GGNCAHQAS

SEQ ID NO: 308289 - protein, 9 aa, Homo Sapiens
GTRRMKEKW

SEQ ID NO: 308290 - protein, 9 aa, Homo Sapiens
NIIMNIHTC

SEQ ID NO: 308291 - protein, 9 aa, Homo Sapiens
SALDKITAR

SEQ ID NO: 308292 - protein, 9 aa, Homo Sapiens
MIETVYNNR

SEQ ID NO: 308293 - protein, 9 aa, Homo Sapiens
AQLNLKITF

SEQ ID NO: 308294 - protein, 9 aa, Homo Sapiens
DWRKKKPTV

SEQ ID NO: 308295 - protein, 9 aa, Homo Sapiens
VWGRGITRL

SEQ ID NO: 308296 - protein, 9 aa, Homo Sapiens
DNCTGVQVA

SEQ ID NO: 308297 - protein, 9 aa, Homo Sapiens
FFFFVIVII

SEQ ID NO: 308298 - protein, 9 aa, Homo Sapiens
VLKDVVNNI

SEQ ID NO: 308299 - protein, 9 aa, Homo Sapiens
NSTTLSDAY

SEQ ID NO: 308300 - protein, 9 aa, Homo Sapiens
IRLVQCYIQ

SEQ ID NO: 308301 - protein, 9 aa, Homo Sapiens
MNILPFVAQ

SEQ ID NO: 308302 - protein, 9 aa, Homo Sapiens
LEQGDKPWR

SEQ ID NO: 308303 - protein, 9 aa, Homo Sapiens
TKASPYTRC

SEQ ID NO: 308304 - protein, 9 aa, Homo Sapiens
DNTVYRQKM

SEQ ID NO: 308305 - protein, 9 aa, Homo Sapiens
MEDGYKGTI

SEQ ID NO: 308306 - protein, 9 aa, Homo Sapiens
KPDEYDQLV

SEQ ID NO: 308307 - protein, 9 aa, Homo Sapiens
TQKKKVDRY

SEQ ID NO: 308308 - protein, 9 aa, Homo Sapiens
KMLSQQESE

SEQ ID NO: 308309 - protein, 9 aa, Homo Sapiens
DEPNPTSPA

SEQ ID NO: 308310 - protein, 9 aa, Homo Sapiens
RHSTQKNLN

SEQ ID NO: 308311 - protein, 9 aa, Homo Sapiens
CMQSRRPRL

SEQ ID NO: 308312 - protein, 9 aa, Homo Sapiens
SNLRWYKQY

SEQ ID NO: 308313 - protein, 9 aa, Homo Sapiens
KRSLRYLME

SEQ ID NO: 308314 - protein, 9 aa, Homo Sapiens
NRDLKPSNI

SEQ ID NO: 308315 - protein, 9 aa, Homo Sapiens
ASNADEAGS

SEQ ID NO: 308316 - protein, 9 aa, Homo Sapiens
RHCLIKKCL

SEQ ID NO: 308317 - protein, 9 aa, Homo Sapiens
EMFWAGHRT

SEQ ID NO: 308318 - protein, 9 aa, Homo Sapiens
FLKYPESLC

SEQ ID NO: 308319 - protein, 9 aa, Homo Sapiens
AEQFFQKLI

SEQ ID NO: 308320 - protein, 9 aa, Homo Sapiens
QIAYIMWGY

SEQ ID NO: 308321 - protein, 9 aa, Homo Sapiens
YTYTNFDNF

SEQ ID NO: 308322 - protein, 9 aa, Homo Sapiens
TYTEKEKLI

SEQ ID NO: 308323 - protein, 9 aa, Homo Sapiens
RPTSFMRAS

SEQ ID NO: 308324 - protein, 9 aa, Homo Sapiens
HTEAIQHSL

SEQ ID NO: 308325 - protein, 9 aa, Homo Sapiens
CIGNPDEEC

SEQ ID NO: 308326 - protein, 9 aa, Homo Sapiens
EELREEQII

SEQ ID NO: 308327 - protein, 9 aa, Homo Sapiens
QFSNLTDHN

SEQ ID NO: 308328 - protein, 9 aa, Homo Sapiens
NHFLCDISP

SEQ ID NO: 308329 - protein, 9 aa, Homo Sapiens
PMLNKSVAQ

SEQ ID NO: 308330 - protein, 9 aa, Homo Sapiens
EEEKSVSET

SEQ ID NO: 308331 - protein, 9 aa, Homo Sapiens
DKMVQQLQE

SEQ ID NO: 308332 - protein, 9 aa, Homo Sapiens
NNTSQTLKN

SEQ ID NO: 308333 - protein, 9 aa, Homo Sapiens
PLGECCAVC

SEQ ID NO: 308334 - protein, 9 aa, Homo Sapiens
RTGEQDPAS

SEQ ID NO: 308335 - protein, 9 aa, Homo Sapiens
QMELLNTNY

SEQ ID NO: 308336 - protein, 9 aa, Homo Sapiens
RKDLMAHKA

SEQ ID NO: 308337 - protein, 9 aa, Homo Sapiens
VVNVAPQLD

SEQ ID NO: 308338 - protein, 9 aa, Homo Sapiens
LKTNSAVQT

SEQ ID NO: 308339 - protein, 9 aa, Homo Sapiens
KKCLQILLK

SEQ ID NO: 308340 - protein, 9 aa, Homo Sapiens
DATDNVNKV

SEQ ID NO: 308341 - protein, 9 aa, Homo Sapiens
SFKSGCEPP

SEQ ID NO: 308342 - protein, 9 aa, Homo Sapiens
AKASDEVTQ

SEQ ID NO: 308343 - protein, 9 aa, Homo Sapiens
ASISGSSVS

SEQ ID NO: 308344 - protein, 9 aa, Homo Sapiens
YLKNQIGDK

SEQ ID NO: 308345 - protein, 9 aa, Homo Sapiens
PDEFKNMVK

SEQ ID NO: 308346 - protein, 9 aa, Homo Sapiens
KCTQDTSFE

SEQ ID NO: 308347 - protein, 9 aa, Homo Sapiens
IQSLDQVTN

SEQ ID NO: 308348 - protein, 9 aa, Homo Sapiens
LVITTTLYW

SEQ ID NO: 308349 - protein, 9 aa, Homo Sapiens
QKLFNPHQH

SEQ ID NO: 308350 - protein, 9 aa, Homo Sapiens
NKPLMKQAP

SEQ ID NO: 308351 - protein, 9 aa, Homo Sapiens
YDSPFPAST

SEQ ID NO: 308352 - protein, 9 aa, Homo Sapiens
EVTGSLIFR

SEQ ID NO: 308353 - protein, 9 aa, Homo Sapiens
ATEEEKSTL

SEQ ID NO: 308354 - protein, 9 aa, Homo Sapiens
RGMQDKLAR

SEQ ID NO: 308355 - protein, 9 aa, Homo Sapiens
WQTLLSVDY

SEQ ID NO: 308356 - protein, 9 aa, Homo Sapiens
NGDIWELSR

SEQ ID NO: 308357 - protein, 9 aa, Homo Sapiens
RREPSIHHF

SEQ ID NO: 308358 - protein, 9 aa, Homo Sapiens
DNSCNKQQR

SEQ ID NO: 308359 - protein, 9 aa, Homo Sapiens
FCFYYAIKD

SEQ ID NO: 308360 - protein, 9 aa, Homo Sapiens
RDWNIGPQK

SEQ ID NO: 308361 - protein, 9 aa, Homo Sapiens
DEFVGARHS

SEQ ID NO: 308362 - protein, 9 aa, Homo Sapiens
ESCDISLRP

SEQ ID NO: 308363 - protein, 9 aa, Homo Sapiens
YCVLCDNEF

SEQ ID NO: 308364 - protein, 9 aa, Homo Sapiens
IDLLTADFL

SEQ ID NO: 308365 - protein, 9 aa, Homo Sapiens
RMEKIVEGC

SEQ ID NO: 308366 - protein, 9 aa, Homo Sapiens
CYHKVTKLN

SEQ ID NO: 308367 - protein, 9 aa, Homo Sapiens
ISYTGSDVI

SEQ ID NO: 308368 - protein, 9 aa, Homo Sapiens
IDIQLQIAS

SEQ ID NO: 308369 - protein, 9 aa, Homo Sapiens
HWKSHKDVD

SEQ ID NO: 308370 - protein, 9 aa, Homo Sapiens
LHLLHHDGN

SEQ ID NO: 308371 - protein, 9 aa, Homo Sapiens
SGLTFFLPL

SEQ ID NO: 308372 - protein, 9 aa, Homo Sapiens
HDFSAGLIL

SEQ ID NO: 308373 - protein, 9 aa, Homo Sapiens
VQFDTFDSL

SEQ ID NO: 308374 - protein, 9 aa, Homo Sapiens
RPIFQTYVT

SEQ ID NO: 308375 - protein, 9 aa, Homo Sapiens
PPGDRPEPL

SEQ ID NO: 308376 - protein, 9 aa, Homo Sapiens
CLGGPEPWK

SEQ ID NO: 308377 - protein, 9 aa, Homo Sapiens
ESPHKCLLK

SEQ ID NO: 308378 - protein, 9 aa, Homo Sapiens
VCNVLLQLE

SEQ ID NO: 308379 - protein, 9 aa, Homo Sapiens
IGCWYCRRQ

SEQ ID NO: 308380 - protein, 9 aa, Homo Sapiens
KKDRDEHMK

SEQ ID NO: 308381 - protein, 9 aa, Homo Sapiens
SNNYGMSEW

SEQ ID NO: 308382 - protein, 9 aa, Homo Sapiens
YLKAVEELN

SEQ ID NO: 308383 - protein, 9 aa, Homo Sapiens
EFVAPKKDV

SEQ ID NO: 308384 - protein, 9 aa, Homo Sapiens
SADLAPNKK

SEQ ID NO: 308385 - protein, 9 aa, Homo Sapiens
ESWALKTIE

SEQ ID NO: 308386 - protein, 9 aa, Homo Sapiens
FNQDHGCFV

SEQ ID NO: 308387 - protein, 9 aa, Homo Sapiens
HIFCNVTPL

SEQ ID NO: 308388 - protein, 9 aa, Homo Sapiens
GPSGPPEPP

SEQ ID NO: 308389 - protein, 9 aa, Homo Sapiens
GVLPVKTLL

SEQ ID NO: 308390 - protein, 9 aa, Homo Sapiens
PDESWALKT

SEQ ID NO: 308391 - protein, 9 aa, Homo Sapiens
LFSLPPLHS

SEQ ID NO: 308392 - protein, 9 aa, Homo Sapiens
LTTYGQISN

SEQ ID NO: 308393 - protein, 9 aa, Homo Sapiens
KHGLSVETE

SEQ ID NO: 308394 - protein, 9 aa, Homo Sapiens
SEPNNSVLL

SEQ ID NO: 308395 - protein, 9 aa, Homo Sapiens
KRNKKWNLE

SEQ ID NO: 308396 - protein, 9 aa, Homo Sapiens
LPGSGLTAT

SEQ ID NO: 308397 - protein, 9 aa, Homo Sapiens
SFCNASSQE

SEQ ID NO: 308398 - protein, 9 aa, Homo Sapiens
KRPYECSEC

SEQ ID NO: 308399 - protein, 9 aa, Homo Sapiens
SGIKRKASI

SEQ ID NO: 308400 - protein, 9 aa, Homo Sapiens
HRMWRHHHH

SEQ ID NO: 308401 - protein, 9 aa, Homo Sapiens
GKQGKKGKF

SEQ ID NO: 308402 - protein, 9 aa, Homo Sapiens
EEQIIHQEE

SEQ ID NO: 308403 - protein, 9 aa, Homo Sapiens
DTPEICKYK

SEQ ID NO: 308404 - protein, 9 aa, Homo Sapiens
MNYFMDISN

SEQ ID NO: 308405 - protein, 9 aa, Homo Sapiens
LIQLPLCGN

SEQ ID NO: 308406 - protein, 9 aa, Homo Sapiens
KVLSFLLNA

SEQ ID NO: 308407 - protein, 9 aa, Homo Sapiens
KAAEMEDEA

SEQ ID NO: 308408 - protein, 9 aa, Homo Sapiens
IKNKFKKED

SEQ ID NO: 308409 - protein, 9 aa, Homo Sapiens
SFSLFVRDF

SEQ ID NO: 308410 - protein, 9 aa, Homo Sapiens
LAYQKEMVR

SEQ ID NO: 308411 - protein, 9 aa, Homo Sapiens
DPTSPLITR

SEQ ID NO: 308412 - protein, 9 aa, Homo Sapiens
KLNNVKNVA

SEQ ID NO: 308413 - protein, 9 aa, Homo Sapiens
PHSLAATPN

SEQ ID NO: 308414 - protein, 9 aa, Homo Sapiens
VRKEVVKEN

SEQ ID NO: 308415 - protein, 9 aa, Homo Sapiens
RSDSRNYLS

SEQ ID NO: 308416 - protein, 9 aa, Homo Sapiens
FWDGKIMLV

SEQ ID NO: 308417 - protein, 9 aa, Homo Sapiens
EEIMRLLIE

SEQ ID NO: 308418 - protein, 9 aa, Homo Sapiens
LEFSDIFFV

SEQ ID NO: 308419 - protein, 9 aa, Homo Sapiens
MYVFYQMVF

SEQ ID NO: 308420 - protein, 9 aa, Homo Sapiens
LPHSNSLGA

SEQ ID NO: 308421 - protein, 9 aa, Homo Sapiens
FYRLSYLTK

SEQ ID NO: 308422 - protein, 9 aa, Homo Sapiens
NGLWRFCIE

SEQ ID NO: 308423 - protein, 9 aa, Homo Sapiens
PGNDQFPGL

SEQ ID NO: 308424 - protein, 9 aa, Homo Sapiens
SPEEQEEYK

SEQ ID NO: 308425 - protein, 9 aa, Homo Sapiens
KERVNASTT

SEQ ID NO: 308426 - protein, 9 aa, Homo Sapiens
DVPDNKAWP

SEQ ID NO: 308427 - protein, 9 aa, Homo Sapiens
YQVLRRGLS

SEQ ID NO: 308428 - protein, 9 aa, Homo Sapiens
LRTFQSVLA

SEQ ID NO: 308429 - protein, 9 aa, Homo Sapiens
CIGVILVCF

SEQ ID NO: 308430 - protein, 9 aa, Homo Sapiens
QHSLVSTSN

SEQ ID NO: 308431 - protein, 9 aa, Homo Sapiens
KDIQPIKCL

SEQ ID NO: 308432 - protein, 9 aa, Homo Sapiens
VQNDLKMGK

SEQ ID NO: 308433 - protein, 9 aa, Homo Sapiens
PQKLPTSLK

SEQ ID NO: 308434 - protein, 9 aa, Homo Sapiens
KFNGNPMHV

SEQ ID NO: 308435 - protein, 9 aa, Homo Sapiens
VAPPKKRRI

SEQ ID NO: 308436 - protein, 9 aa, Homo Sapiens
ESLFLVRHF

SEQ ID NO: 308437 - protein, 9 aa, Homo Sapiens
QKSNSKVKI

SEQ ID NO: 308438 - protein, 9 aa, Homo Sapiens
SLILHQRVN

SEQ ID NO: 308439 - protein, 9 aa, Homo Sapiens
LTKSVSLKE

SEQ ID NO: 308440 - protein, 9 aa, Homo Sapiens
RLVDKTPIE

SEQ ID NO: 308441 - protein, 9 aa, Homo Sapiens
AASLLPLVP

SEQ ID NO: 308442 - protein, 9 aa, Homo Sapiens
NNLPFLLIP

SEQ ID NO: 308443 - protein, 9 aa, Homo Sapiens
SIYEDEKLI

SEQ ID NO: 308444 - protein, 9 aa, Homo Sapiens
FSQQFLTNI

SEQ ID NO: 308445 - protein, 9 aa, Homo Sapiens
TEAEELFVK

SEQ ID NO: 308446 - protein, 9 aa, Homo Sapiens
GIELHVNVE

SEQ ID NO: 308447 - protein, 9 aa, Homo Sapiens
PDILHIELV

SEQ ID NO: 308448 - protein, 9 aa, Homo Sapiens
LKYPESLCP

SEQ ID NO: 308449 - protein, 9 aa, Homo Sapiens
KAWKFICDV

SEQ ID NO: 308450 - protein, 9 aa, Homo Sapiens
LICVKSWNT

SEQ ID NO: 308451 - protein, 9 aa, Homo Sapiens
GIAEHLSRH

SEQ ID NO: 308452 - protein, 9 aa, Homo Sapiens
NYIVPIIWL

SEQ ID NO: 308453 - protein, 9 aa, Homo Sapiens
ELFSLPPLH

SEQ ID NO: 308454 - protein, 9 aa, Homo Sapiens
ETYRKKWLQ

SEQ ID NO: 308455 - protein, 9 aa, Homo Sapiens
IAFLQGEIK

SEQ ID NO: 308456 - protein, 9 aa, Homo Sapiens
LFGIDMKDK

SEQ ID NO: 308457 - protein, 9 aa, Homo Sapiens
ENKIILKLD

SEQ ID NO: 308458 - protein, 9 aa, Homo Sapiens
IYEKITACS

SEQ ID NO: 308459 - protein, 9 aa, Homo Sapiens
DYNSALRFH

SEQ ID NO: 308460 - protein, 9 aa, Homo Sapiens
NRKEEDNAK

SEQ ID NO: 308461 - protein, 9 aa, Homo Sapiens
SRLGEIHYS

SEQ ID NO: 308462 - protein, 9 aa, Homo Sapiens
PLGAICFTY

SEQ ID NO: 308463 - protein, 9 aa, Homo Sapiens
LASHIFVKA

SEQ ID NO: 308464 - protein, 9 aa, Homo Sapiens
KSMQNNAAV

SEQ ID NO: 308465 - protein, 9 aa, Homo Sapiens
YSFYRTGQL

SEQ ID NO: 308466 - protein, 9 aa, Homo Sapiens
PGQSPVLQI

SEQ ID NO: 308467 - protein, 9 aa, Homo Sapiens
GDSSIQKQW

SEQ ID NO: 308468 - protein, 9 aa, Homo Sapiens
INNDNPSPT

SEQ ID NO: 308469 - protein, 9 aa, Homo Sapiens
WKLILSTSL

SEQ ID NO: 308470 - protein, 9 aa, Homo Sapiens
ICPVDGAWM

SEQ ID NO: 308471 - protein, 9 aa, Homo Sapiens
AHKLFGAEN

SEQ ID NO: 308472 - protein, 9 aa, Homo Sapiens
TVRDSPAHF

SEQ ID NO: 308473 - protein, 9 aa, Homo Sapiens
PSSLVINKE

SEQ ID NO: 308474 - protein, 9 aa, Homo Sapiens
FLGIVNIIL

SEQ ID NO: 308475 - protein, 9 aa, Homo Sapiens
ISPIPGGVY

SEQ ID NO: 308476 - protein, 9 aa, Homo Sapiens
GESVPDNTE

SEQ ID NO: 308477 - protein, 9 aa, Homo Sapiens
HNCFLGIYL

SEQ ID NO: 308478 - protein, 9 aa, Homo Sapiens
VAQKVVALQ

SEQ ID NO: 308479 - protein, 9 aa, Homo Sapiens
LFFVFFFII

SEQ ID NO: 308480 - protein, 9 aa, Homo Sapiens
SLCPAFPRL

SEQ ID NO: 308481 - protein, 9 aa, Homo Sapiens
SSGRDNVSD

SEQ ID NO: 308482 - protein, 9 aa, Homo Sapiens
SNLTDHNKI

SEQ ID NO: 308483 - protein, 9 aa, Homo Sapiens
ATATYTEED

SEQ ID NO: 308484 - protein, 9 aa, Homo Sapiens
KDNVIFFQQ

SEQ ID NO: 308485 - protein, 9 aa, Homo Sapiens
PGIHILTIM

SEQ ID NO: 308486 - protein, 9 aa, Homo Sapiens
PINTLSGIV

SEQ ID NO: 308487 - protein, 9 aa, Homo Sapiens
NSAGYLTSS

SEQ ID NO: 308488 - protein, 9 aa, Homo Sapiens
KNNIGWAWW

SEQ ID NO: 308489 - protein, 9 aa, Homo Sapiens
QAVKHFCAG

SEQ ID NO: 308490 - protein, 9 aa, Homo Sapiens
DETSLINTA

SEQ ID NO: 308491 - protein, 9 aa, Homo Sapiens
NGLYTPQNF

SEQ ID NO: 308492 - protein, 9 aa, Homo Sapiens
TSPKDIVSL

SEQ ID NO: 308493 - protein, 9 aa, Homo Sapiens
GTVQESLYS

SEQ ID NO: 308494 - protein, 9 aa, Homo Sapiens
GSKDVKNDK

SEQ ID NO: 308495 - protein, 9 aa, Homo Sapiens
RENNQRLQK

SEQ ID NO: 308496 - protein, 9 aa, Homo Sapiens
FVFPPTPAL

SEQ ID NO: 308497 - protein, 9 aa, Homo Sapiens
GESLLQSQS

SEQ ID NO: 308498 - protein, 9 aa, Homo Sapiens
VPYGISAIK

SEQ ID NO: 308499 - protein, 9 aa, Homo Sapiens
LKDEIRHSR

SEQ ID NO: 308500 - protein, 9 aa, Homo Sapiens
ATLGGNYAS

SEQ ID NO: 308501 - protein, 9 aa, Homo Sapiens
AYITKVDLQ

SEQ ID NO: 308502 - protein, 9 aa, Homo Sapiens
KKWEEHSVK

SEQ ID NO: 308503 - protein, 9 aa, Homo Sapiens
LVWVQAANT

SEQ ID NO: 308504 - protein, 9 aa, Homo Sapiens
FNLKMLLEN

SEQ ID NO: 308505 - protein, 9 aa, Homo Sapiens
DLMVFTLRL

SEQ ID NO: 308506 - protein, 9 aa, Homo Sapiens
NVFCDVSIY

SEQ ID NO: 308507 - protein, 9 aa, Homo Sapiens
ILDVVEEEC

SEQ ID NO: 308508 - protein, 9 aa, Homo Sapiens
NFIVHAIRH

SEQ ID NO: 308509 - protein, 9 aa, Homo Sapiens
NKIKQVKDN

SEQ ID NO: 308510 - protein, 9 aa, Homo Sapiens
DNSSNEEET

SEQ ID NO: 308511 - protein, 9 aa, Homo Sapiens
DMDVVYALK

SEQ ID NO: 308512 - protein, 9 aa, Homo Sapiens
RLRRFEAEP

SEQ ID NO: 308513 - protein, 9 aa, Homo Sapiens
DALAFFNSL

SEQ ID NO: 308514 - protein, 9 aa, Homo Sapiens
CSTLACILE

SEQ ID NO: 308515 - protein, 9 aa, Homo Sapiens
SPKDIVSLV

SEQ ID NO: 308516 - protein, 9 aa, Homo Sapiens
LNFGIMPDR

SEQ ID NO: 308517 - protein, 9 aa, Homo Sapiens
SNPTAFDYL

SEQ ID NO: 308518 - protein, 9 aa, Homo Sapiens
LSLGSLGKS

SEQ ID NO: 308519 - protein, 9 aa, Homo Sapiens
DTENKDQSK

SEQ ID NO: 308520 - protein, 9 aa, Homo Sapiens
PPKSYSKDL

SEQ ID NO: 308521 - protein, 9 aa, Homo Sapiens
AIKRNARII

SEQ ID NO: 308522 - protein, 9 aa, Homo Sapiens
SPQLVNQQM

SEQ ID NO: 308523 - protein, 9 aa, Homo Sapiens
VTSKDMLQT

SEQ ID NO: 308524 - protein, 9 aa, Homo Sapiens
SAQGLIKHN

SEQ ID NO: 308525 - protein, 9 aa, Homo Sapiens
KVGTKTINS

SEQ ID NO: 308526 - protein, 9 aa, Homo Sapiens
QNSNLANHH

SEQ ID NO: 308527 - protein, 9 aa, Homo Sapiens
PAKLEWVTK

SEQ ID NO: 308528 - protein, 9 aa, Homo Sapiens
LQSDTERSF

SEQ ID NO: 308529 - protein, 9 aa, Homo Sapiens
LFDRYMATQ

SEQ ID NO: 308530 - protein, 9 aa, Homo Sapiens
MLYFIVKDS

SEQ ID NO: 308531 - protein, 9 aa, Homo Sapiens
ANPNITDVF

SEQ ID NO: 308532 - protein, 9 aa, Homo Sapiens
PAYLQEALF

SEQ ID NO: 308533 - protein, 9 aa, Homo Sapiens
FEKYFPNGN

SEQ ID NO: 308534 - protein, 9 aa, Homo Sapiens
KDVGDLMLY

SEQ ID NO: 308535 - protein, 9 aa, Homo Sapiens
VQRKCTQDT

SEQ ID NO: 308536 - protein, 9 aa, Homo Sapiens
CAQMEPNVL

SEQ ID NO: 308537 - protein, 9 aa, Homo Sapiens
FTRYFFSNT

SEQ ID NO: 308538 - protein, 9 aa, Homo Sapiens
PGFPNGYPY

SEQ ID NO: 308539 - protein, 9 aa, Homo Sapiens
SLFFVFPPT

SEQ ID NO: 308540 - protein, 9 aa, Homo Sapiens
SIKYDPDRE

SEQ ID NO: 308541 - protein, 9 aa, Homo Sapiens
WQFLIYVML

SEQ ID NO: 308542 - protein, 9 aa, Homo Sapiens
LESSLADFM

SEQ ID NO: 308543 - protein, 9 aa, Homo Sapiens
ICKPLHYKI

SEQ ID NO: 308544 - protein, 9 aa, Homo Sapiens
AHFFKGLNV

SEQ ID NO: 308545 - protein, 9 aa, Homo Sapiens
NRLNPKHVH

SEQ ID NO: 308546 - protein, 9 aa, Homo Sapiens
GITVSKLDL

SEQ ID NO: 308547 - protein, 9 aa, Homo Sapiens
WLAQEEAQH

SEQ ID NO: 308548 - protein, 9 aa, Homo Sapiens
NALPQRSSR

SEQ ID NO: 308549 - protein, 9 aa, Homo Sapiens
KQKITAEMY

SEQ ID NO: 308550 - protein, 9 aa, Homo Sapiens
VGCIIGRQG

SEQ ID NO: 308551 - protein, 9 aa, Homo Sapiens
GSCYCGKII

SEQ ID NO: 308552 - protein, 9 aa, Homo Sapiens
DWNIGPQKT

SEQ ID NO: 308553 - protein, 9 aa, Homo Sapiens
YNPEEVCAV

SEQ ID NO: 308554 - protein, 9 aa, Homo Sapiens
DLDGRFYPL

SEQ ID NO: 308555 - protein, 9 aa, Homo Sapiens
LNKDKDGKS

SEQ ID NO: 308556 - protein, 9 aa, Homo Sapiens
FITSYARVI

SEQ ID NO: 308557 - protein, 9 aa, Homo Sapiens
PYGPQTPSE

SEQ ID NO: 308558 - protein, 9 aa, Homo Sapiens
LLKKADTRD

SEQ ID NO: 308559 - protein, 9 aa, Homo Sapiens
PPHPDVCMA

SEQ ID NO: 308560 - protein, 9 aa, Homo Sapiens
WLLKNRLSS

SEQ ID NO: 308561 - protein, 9 aa, Homo Sapiens
LDNDFFGTL

SEQ ID NO: 308562 - protein, 9 aa, Homo Sapiens
VEECENYLS

SEQ ID NO: 308563 - protein, 9 aa, Homo Sapiens
KKLPDLERV

SEQ ID NO: 308564 - protein, 9 aa, Homo Sapiens
ARAASQNNL

SEQ ID NO: 308565 - protein, 9 aa, Homo Sapiens
LQTLPLEDY

SEQ ID NO: 308566 - protein, 9 aa, Homo Sapiens
GDYTLTPEM

SEQ ID NO: 308567 - protein, 9 aa, Homo Sapiens
GSDGELYEN

SEQ ID NO: 308568 - protein, 9 aa, Homo Sapiens
ASLRKEKKY

SEQ ID NO: 308569 - protein, 9 aa, Homo Sapiens
SKPKKPFLS

SEQ ID NO: 308570 - protein, 9 aa, Homo Sapiens
DKLKKELEE

SEQ ID NO: 308571 - protein, 9 aa, Homo Sapiens
NSQVEYLRT

SEQ ID NO: 308572 - protein, 9 aa, Homo Sapiens
MAGLVKLTV

SEQ ID NO: 308573 - protein, 9 aa, Homo Sapiens
IQKHPQHNI

SEQ ID NO: 308574 - protein, 9 aa, Homo Sapiens
IEIMGGAKN

SEQ ID NO: 308575 - protein, 9 aa, Homo Sapiens
WKFICDVSR

SEQ ID NO: 308576 - protein, 9 aa, Homo Sapiens
GDQCELDCD

SEQ ID NO: 308577 - protein, 9 aa, Homo Sapiens
YLLKCFNKR

SEQ ID NO: 308578 - protein, 9 aa, Homo Sapiens
VLKPEWFWG

SEQ ID NO: 308579 - protein, 9 aa, Homo Sapiens
IKYPGQITT

SEQ ID NO: 308580 - protein, 9 aa, Homo Sapiens
LLCFMNNIL

SEQ ID NO: 308581 - protein, 9 aa, Homo Sapiens
FYVVILVLS

SEQ ID NO: 308582 - protein, 9 aa, Homo Sapiens
FLVPYNDLE

SEQ ID NO: 308583 - protein, 9 aa, Homo Sapiens
KLQPNSNAI

SEQ ID NO: 308584 - protein, 9 aa, Homo Sapiens
KQIYKKKTE

SEQ ID NO: 308585 - protein, 9 aa, Homo Sapiens
LPFIRITSL

SEQ ID NO: 308586 - protein, 9 aa, Homo Sapiens
SDKTSGEKK

SEQ ID NO: 308587 - protein, 9 aa, Homo Sapiens
DSDQTLRRD

SEQ ID NO: 308588 - protein, 9 aa, Homo Sapiens
SQGLSFISF

SEQ ID NO: 308589 - protein, 9 aa, Homo Sapiens
PQTHVQAGT

SEQ ID NO: 308590 - protein, 9 aa, Homo Sapiens
NYFELDRAD

SEQ ID NO: 308591 - protein, 9 aa, Homo Sapiens
DIIYIINNV

SEQ ID NO: 308592 - protein, 9 aa, Homo Sapiens
NYMCWASLN

SEQ ID NO: 308593 - protein, 9 aa, Homo Sapiens
EALLINQTV

SEQ ID NO: 308594 - protein, 9 aa, Homo Sapiens
FEYRAASHK

SEQ ID NO: 308595 - protein, 9 aa, Homo Sapiens
VEAVINAKD

SEQ ID NO: 308596 - protein, 9 aa, Homo Sapiens
ADLLQDMGQ

SEQ ID NO: 308597 - protein, 9 aa, Homo Sapiens
VIDAYVCIR

SEQ ID NO: 308598 - protein, 9 aa, Homo Sapiens
HLENCVSED

SEQ ID NO: 308599 - protein, 9 aa, Homo Sapiens
ILQEKEHQR

SEQ ID NO: 308600 - protein, 9 aa, Homo Sapiens
MLLANYILF

SEQ ID NO: 308601 - protein, 9 aa, Homo Sapiens
CGTEGFWNA

SEQ ID NO: 308602 - protein, 9 aa, Homo Sapiens
KWYLKGLQD

SEQ ID NO: 308603 - protein, 9 aa, Homo Sapiens
VIIHAAEKP

SEQ ID NO: 308604 - protein, 9 aa, Homo Sapiens
EINTEDKPY

SEQ ID NO: 308605 - protein, 9 aa, Homo Sapiens
VSYFAFGLF

SEQ ID NO: 308606 - protein, 9 aa, Homo Sapiens
DTNEIAPLG

SEQ ID NO: 308607 - protein, 9 aa, Homo Sapiens
ERDLCEVFS

SEQ ID NO: 308608 - protein, 9 aa, Homo Sapiens
KSQGELDKA

SEQ ID NO: 308609 - protein, 9 aa, Homo Sapiens
NYLHNQNGS

SEQ ID NO: 308610 - protein, 9 aa, Homo Sapiens
SLINTAISD

SEQ ID NO: 308611 - protein, 9 aa, Homo Sapiens
GEQQCFLFS

SEQ ID NO: 308612 - protein, 9 aa, Homo Sapiens
GSGYNLDRL

SEQ ID NO: 308613 - protein, 9 aa, Homo Sapiens
FLLIPSVEN

SEQ ID NO: 308614 - protein, 9 aa, Homo Sapiens
KFPTYLHSR

SEQ ID NO: 308615 - protein, 9 aa, Homo Sapiens
LVVQNDLKM

SEQ ID NO: 308616 - protein, 9 aa, Homo Sapiens
LDGRFYPLY

SEQ ID NO: 308617 - protein, 9 aa, Homo Sapiens
YLEQCQSKA

SEQ ID NO: 308618 - protein, 9 aa, Homo Sapiens
LFPEHLINV

SEQ ID NO: 308619 - protein, 9 aa, Homo Sapiens
LNLRSQSSD

SEQ ID NO: 308620 - protein, 9 aa, Homo Sapiens
EINKPNLYN

SEQ ID NO: 308621 - protein, 9 aa, Homo Sapiens
KDPNCKLEY

SEQ ID NO: 308622 - protein, 9 aa, Homo Sapiens
NVPYIVHSQ

SEQ ID NO: 308623 - protein, 9 aa, Homo Sapiens
VTTCWRDGK

SEQ ID NO: 308624 - protein, 9 aa, Homo Sapiens
NIRNNSAFL

SEQ ID NO: 308625 - protein, 9 aa, Homo Sapiens
VAKTMLESS

SEQ ID NO: 308626 - protein, 9 aa, Homo Sapiens
LGHLSADMA

SEQ ID NO: 308627 - protein, 9 aa, Homo Sapiens
GDQVSRRGA

SEQ ID NO: 308628 - protein, 9 aa, Homo Sapiens
VSLAEPEAE

SEQ ID NO: 308629 - protein, 9 aa, Homo Sapiens
YLPIEDPQW

SEQ ID NO: 308630 - protein, 9 aa, Homo Sapiens
IKLFSAQTN

SEQ ID NO: 308631 - protein, 9 aa, Homo Sapiens
YVCENCKPL

SEQ ID NO: 308632 - protein, 9 aa, Homo Sapiens
IHSEGFISK

SEQ ID NO: 308633 - protein, 9 aa, Homo Sapiens
PLAMASSIF

SEQ ID NO: 308634 - protein, 9 aa, Homo Sapiens
TVPDQSDRS

SEQ ID NO: 308635 - protein, 9 aa, Homo Sapiens
TSTFKPMVA

SEQ ID NO: 308636 - protein, 9 aa, Homo Sapiens
GRTYKNVNR

SEQ ID NO: 308637 - protein, 9 aa, Homo Sapiens
MQIMSPDLP

SEQ ID NO: 308638 - protein, 9 aa, Homo Sapiens
DIRSGKHIG

SEQ ID NO: 308639 - protein, 9 aa, Homo Sapiens
QARWVELDK

SEQ ID NO: 308640 - protein, 9 aa, Homo Sapiens
LHISDRVSL

SEQ ID NO: 308641 - protein, 9 aa, Homo Sapiens
KLEQHIQKR

SEQ ID NO: 308642 - protein, 9 aa, Homo Sapiens
IFVMLFYTN

SEQ ID NO: 308643 - protein, 9 aa, Homo Sapiens
NFNIKENKS

SEQ ID NO: 308644 - protein, 9 aa, Homo Sapiens
ERVYELLSA

SEQ ID NO: 308645 - protein, 9 aa, Homo Sapiens
QLKRNECTH

SEQ ID NO: 308646 - protein, 9 aa, Homo Sapiens
QLDIKTDNL

SEQ ID NO: 308647 - protein, 9 aa, Homo Sapiens
PHLGLEKKE

SEQ ID NO: 308648 - protein, 9 aa, Homo Sapiens
KSNRSKLYL

SEQ ID NO: 308649 - protein, 9 aa, Homo Sapiens
GFKRLSCLS

SEQ ID NO: 308650 - protein, 9 aa, Homo Sapiens
PVSINEEHE

SEQ ID NO: 308651 - protein, 9 aa, Homo Sapiens
NYIYFIPRN

SEQ ID NO: 308652 - protein, 9 aa, Homo Sapiens
KCPMCREFL

SEQ ID NO: 308653 - protein, 9 aa, Homo Sapiens
DMLQTLAQA

SEQ ID NO: 308654 - protein, 9 aa, Homo Sapiens
FPSPNPVSP

SEQ ID NO: 308655 - protein, 9 aa, Homo Sapiens
EYKTGINKA

SEQ ID NO: 308656 - protein, 9 aa, Homo Sapiens
LVSVSHGSE

SEQ ID NO: 308657 - protein, 9 aa, Homo Sapiens
LVQPHNVPY

SEQ ID NO: 308658 - protein, 9 aa, Homo Sapiens
NKWCEKLAD

SEQ ID NO: 308659 - protein, 9 aa, Homo Sapiens
NDQFPGLNE

SEQ ID NO: 308660 - protein, 9 aa, Homo Sapiens
ESAAVWNDY

SEQ ID NO: 308661 - protein, 9 aa, Homo Sapiens
DLNNKILAN

SEQ ID NO: 308662 - protein, 9 aa, Homo Sapiens
NIKNTLHKF

SEQ ID NO: 308663 - protein, 9 aa, Homo Sapiens
KVHQDTYRQ

SEQ ID NO: 308664 - protein, 9 aa, Homo Sapiens
PTKENFLLC

SEQ ID NO: 308665 - protein, 9 aa, Homo Sapiens
FTGVACSYG

SEQ ID NO: 308666 - protein, 9 aa, Homo Sapiens
FKVQQPHVG

SEQ ID NO: 308667 - protein, 9 aa, Homo Sapiens
SLRYLMEEE

SEQ ID NO: 308668 - protein, 9 aa, Homo Sapiens
ICLIALFCI

SEQ ID NO: 308669 - protein, 9 aa, Homo Sapiens
HTVKKAIEY

SEQ ID NO: 308670 - protein, 9 aa, Homo Sapiens
ARIQLCDNY

SEQ ID NO: 308671 - protein, 9 aa, Homo Sapiens
VCLAIGNGI

SEQ ID NO: 308672 - protein, 9 aa, Homo Sapiens
DALDVANKS

SEQ ID NO: 308673 - protein, 9 aa, Homo Sapiens
QIFKKKQKN

SEQ ID NO: 308674 - protein, 9 aa, Homo Sapiens
LLIAAQRQK

SEQ ID NO: 308675 - protein, 9 aa, Homo Sapiens
SQSSDDRRK

SEQ ID NO: 308676 - protein, 9 aa, Homo Sapiens
CRGQAAAFL

SEQ ID NO: 308677 - protein, 9 aa, Homo Sapiens
LFLHPHCKI

SEQ ID NO: 308678 - protein, 9 aa, Homo Sapiens
KILRCLLNV

SEQ ID NO: 308679 - protein, 9 aa, Homo Sapiens
CCFLLLLLV

SEQ ID NO: 308680 - protein, 9 aa, Homo Sapiens
GKVWVEKEK

SEQ ID NO: 308681 - protein, 9 aa, Homo Sapiens
TTKPMGLVS

SEQ ID NO: 308682 - protein, 9 aa, Homo Sapiens
QIPQKGLWR

SEQ ID NO: 308683 - protein, 9 aa, Homo Sapiens
DKITARLCD

SEQ ID NO: 308684 - protein, 9 aa, Homo Sapiens
QALPLSEKM

SEQ ID NO: 308685 - protein, 9 aa, Homo Sapiens
SPTSWGCFD

SEQ ID NO: 308686 - protein, 9 aa, Homo Sapiens
IIFHPNEFC

SEQ ID NO: 308687 - protein, 9 aa, Homo Sapiens
LADKYAPDN

SEQ ID NO: 308688 - protein, 9 aa, Homo Sapiens
QKPLPPLPP

SEQ ID NO: 308689 - protein, 9 aa, Homo Sapiens
FATKLSDYF

SEQ ID NO: 308690 - protein, 9 aa, Homo Sapiens
TLYYEENKF

SEQ ID NO: 308691 - protein, 9 aa, Homo Sapiens
ALQDKINNL

SEQ ID NO: 308692 - protein, 9 aa, Homo Sapiens
PQNIKFYSA

SEQ ID NO: 308693 - protein, 9 aa, Homo Sapiens
GQIPNTLLP

SEQ ID NO: 308694 - protein, 9 aa, Homo Sapiens
AHLSEDCSD

SEQ ID NO: 308695 - protein, 9 aa, Homo Sapiens
PVINNSIKL

SEQ ID NO: 308696 - protein, 9 aa, Homo Sapiens
TKHKNIHTG

SEQ ID NO: 308697 - protein, 9 aa, Homo Sapiens
QEDSKIKYE

SEQ ID NO: 308698 - protein, 9 aa, Homo Sapiens
LGSIARLFT

SEQ ID NO: 308699 - protein, 9 aa, Homo Sapiens
GPESIINST

SEQ ID NO: 308700 - protein, 9 aa, Homo Sapiens
FHSQDNLVV

SEQ ID NO: 308701 - protein, 9 aa, Homo Sapiens
QKENHFLIC

SEQ ID NO: 308702 - protein, 9 aa, Homo Sapiens
VGYVFLFTN

SEQ ID NO: 308703 - protein, 9 aa, Homo Sapiens
ISGSSVSST

SEQ ID NO: 308704 - protein, 9 aa, Homo Sapiens
VKEYVLVYL

SEQ ID NO: 308705 - protein, 9 aa, Homo Sapiens
TITIVEVIL

SEQ ID NO: 308706 - protein, 9 aa, Homo Sapiens
AAAGQLKYS

SEQ ID NO: 308707 - protein, 9 aa, Homo Sapiens
RDFQNLRKM

SEQ ID NO: 308708 - protein, 9 aa, Homo Sapiens
YLTSTQSKI

SEQ ID NO: 308709 - protein, 9 aa, Homo Sapiens
VSVQPSVIQ

SEQ ID NO: 308710 - protein, 9 aa, Homo Sapiens
YGQISNGEH

SEQ ID NO: 308711 - protein, 9 aa, Homo Sapiens
VICTQRRLD

SEQ ID NO: 308712 - protein, 9 aa, Homo Sapiens
ANVVTLHDI

SEQ ID NO: 308713 - protein, 9 aa, Homo Sapiens
IGDIPQIPD

SEQ ID NO: 308714 - protein, 9 aa, Homo Sapiens
GNKHIQDQL

SEQ ID NO: 308715 - protein, 9 aa, Homo Sapiens
PSSLRASPA

SEQ ID NO: 308716 - protein, 9 aa, Homo Sapiens
SWPLRPTNS

SEQ ID NO: 308717 - protein, 9 aa, Homo Sapiens
KKFENKIIL

SEQ ID NO: 308718 - protein, 9 aa, Homo Sapiens
DFMGLINTT

SEQ ID NO: 308719 - protein, 9 aa, Homo Sapiens
KEIEYTTLK

SEQ ID NO: 308720 - protein, 9 aa, Homo Sapiens
AWFSLEVSS

SEQ ID NO: 308721 - protein, 9 aa, Homo Sapiens
TAMKSGSLA

SEQ ID NO: 308722 - protein, 9 aa, Homo Sapiens
LSCKKAGSK

SEQ ID NO: 308723 - protein, 9 aa, Homo Sapiens
GKVFTQNPH

SEQ ID NO: 308724 - protein, 9 aa, Homo Sapiens
VICTEPSVH

SEQ ID NO: 308725 - protein, 9 aa, Homo Sapiens
QTKLWMSYF

SEQ ID NO: 308726 - protein, 9 aa, Homo Sapiens
KWWPTEFKT

SEQ ID NO: 308727 - protein, 9 aa, Homo Sapiens
IWNIETATS

SEQ ID NO: 308728 - protein, 9 aa, Homo Sapiens
IINQKQFQW

SEQ ID NO: 308729 - protein, 9 aa, Homo Sapiens
TLEGDQVSR

SEQ ID NO: 308730 - protein, 9 aa, Homo Sapiens
AGWEMFWAG

SEQ ID NO: 308731 - protein, 9 aa, Homo Sapiens
QIIYTLQTK

SEQ ID NO: 308732 - protein, 9 aa, Homo Sapiens
QIAALLQEY

SEQ ID NO: 308733 - protein, 9 aa, Homo Sapiens
TFITSSHHS

SEQ ID NO: 308734 - protein, 9 aa, Homo Sapiens
AHIKKCSMN

SEQ ID NO: 308735 - protein, 9 aa, Homo Sapiens
GRIDLAEVE

SEQ ID NO: 308736 - protein, 9 aa, Homo Sapiens
NEALKELGR

SEQ ID NO: 308737 - protein, 9 aa, Homo Sapiens
LFDPKYQQR

SEQ ID NO: 308738 - protein, 9 aa, Homo Sapiens
TLYWGGKAE

SEQ ID NO: 308739 - protein, 9 aa, Homo Sapiens
SKKLKGELV

SEQ ID NO: 308740 - protein, 9 aa, Homo Sapiens
NGKDGIPGV

SEQ ID NO: 308741 - protein, 9 aa, Homo Sapiens
FNTPWGINP

SEQ ID NO: 308742 - protein, 9 aa, Homo Sapiens
SLVDVSGSM

SEQ ID NO: 308743 - protein, 9 aa, Homo Sapiens
SYEIQMLDN

SEQ ID NO: 308744 - protein, 9 aa, Homo Sapiens
EDDEDFKTA

SEQ ID NO: 308745 - protein, 9 aa, Homo Sapiens
HWCVGEGME

SEQ ID NO: 308746 - protein, 9 aa, Homo Sapiens
DVDADNQIL

SEQ ID NO: 308747 - protein, 9 aa, Homo Sapiens
TYQPSFTAA

SEQ ID NO: 308748 - protein, 9 aa, Homo Sapiens
SVQNENCEE

SEQ ID NO: 308749 - protein, 9 aa, Homo Sapiens
KKKQRHQQG

SEQ ID NO: 308750 - protein, 9 aa, Homo Sapiens
LYVLNQIIY

SEQ ID NO: 308751 - protein, 9 aa, Homo Sapiens
IHTGQKTYR

SEQ ID NO: 308752 - protein, 9 aa, Homo Sapiens
DNHLRNKSR

SEQ ID NO: 308753 - protein, 9 aa, Homo Sapiens
IGNPDEECE

SEQ ID NO: 308754 - protein, 9 aa, Homo Sapiens
KHVHQRPTV

SEQ ID NO: 308755 - protein, 9 aa, Homo Sapiens
KLVSTFNNY

SEQ ID NO: 308756 - protein, 9 aa, Homo Sapiens
ASGADKDGE

SEQ ID NO: 308757 - protein, 9 aa, Homo Sapiens
CHMGHEFIP

SEQ ID NO: 308758 - protein, 9 aa, Homo Sapiens
CDADWNEWT

SEQ ID NO: 308759 - protein, 9 aa, Homo Sapiens
IFEYRAASH

SEQ ID NO: 308760 - protein, 9 aa, Homo Sapiens
SLFTLLNKH

SEQ ID NO: 308761 - protein, 9 aa, Homo Sapiens
QRTGQEKEK

SEQ ID NO: 308762 - protein, 9 aa, Homo Sapiens
NSEKLTTLK

SEQ ID NO: 308763 - protein, 9 aa, Homo Sapiens
LSSVSTETF

SEQ ID NO: 308764 - protein, 9 aa, Homo Sapiens
CSIQKSIFT

SEQ ID NO: 308765 - protein, 9 aa, Homo Sapiens
ADTTATADA

SEQ ID NO: 308766 - protein, 9 aa, Homo Sapiens
AVKHFCAGR

SEQ ID NO: 308767 - protein, 9 aa, Homo Sapiens
RSLASWNYN

SEQ ID NO: 308768 - protein, 9 aa, Homo Sapiens
KAMLNWAEG

SEQ ID NO: 308769 - protein, 9 aa, Homo Sapiens
FEFEGMGVD

SEQ ID NO: 308770 - protein, 9 aa, Homo Sapiens
LHSAGIINR

SEQ ID NO: 308771 - protein, 9 aa, Homo Sapiens
IKDSRGIAD

SEQ ID NO: 308772 - protein, 9 aa, Homo Sapiens
IWSVDPASV

SEQ ID NO: 308773 - protein, 9 aa, Homo Sapiens
TTLDHLLHL

SEQ ID NO: 308774 - protein, 9 aa, Homo Sapiens
AQIPQKGLW

SEQ ID NO: 308775 - protein, 9 aa, Homo Sapiens
YVLLLIQTM

SEQ ID NO: 308776 - protein, 9 aa, Homo Sapiens
YWAVLSEYV

SEQ ID NO: 308777 - protein, 9 aa, Homo Sapiens
ETTVTKILR

SEQ ID NO: 308778 - protein, 9 aa, Homo Sapiens
EYSTEKHTK

SEQ ID NO: 308779 - protein, 9 aa, Homo Sapiens
VVGIAHKLF

SEQ ID NO: 308780 - protein, 9 aa, Homo Sapiens
DAQAVKHFC

SEQ ID NO: 308781 - protein, 9 aa, Homo Sapiens
RPQIKKDEK

SEQ ID NO: 308782 - protein, 9 aa, Homo Sapiens
GGGAANLQL

SEQ ID NO: 308783 - protein, 9 aa, Homo Sapiens
YSRKGGNDS

SEQ ID NO: 308784 - protein, 9 aa, Homo Sapiens
RGSTVMFEI

SEQ ID NO: 308785 - protein, 9 aa, Homo Sapiens
KGIVESIQI

SEQ ID NO: 308786 - protein, 9 aa, Homo Sapiens
NPIPVINNS

SEQ ID NO: 308787 - protein, 9 aa, Homo Sapiens
PINNLDALE

SEQ ID NO: 308788 - protein, 9 aa, Homo Sapiens
KALKTTLDE

SEQ ID NO: 308789 - protein, 9 aa, Homo Sapiens
FKTKKRRSG

SEQ ID NO: 308790 - protein, 9 aa, Homo Sapiens
RDQTRFPVL

SEQ ID NO: 308791 - protein, 9 aa, Homo Sapiens
IQVMQIMSP

SEQ ID NO: 308792 - protein, 9 aa, Homo Sapiens
AVIVFVLIG

SEQ ID NO: 308793 - protein, 9 aa, Homo Sapiens
LYNLLYLVI

SEQ ID NO: 308794 - protein, 9 aa, Homo Sapiens
NVKTSRQLF

SEQ ID NO: 308795 - protein, 9 aa, Homo Sapiens
RWLCEQQHR

SEQ ID NO: 308796 - protein, 9 aa, Homo Sapiens
SHLSRHHII

SEQ ID NO: 308797 - protein, 9 aa, Homo Sapiens
HVHTQTEKT

SEQ ID NO: 308798 - protein, 9 aa, Homo Sapiens
AKMIRELPK

SEQ ID NO: 308799 - protein, 9 aa, Homo Sapiens
QEGEFYPDA

SEQ ID NO: 308800 - protein, 9 aa, Homo Sapiens
PDDNKIIRR

SEQ ID NO: 308801 - protein, 9 aa, Homo Sapiens
RGASAVLFN

SEQ ID NO: 308802 - protein, 9 aa, Homo Sapiens
ARLLSERYV

SEQ ID NO: 308803 - protein, 9 aa, Homo Sapiens
STFDVGNFN

SEQ ID NO: 308804 - protein, 9 aa, Homo Sapiens
GVSVQNENC

SEQ ID NO: 308805 - protein, 9 aa, Homo Sapiens
IKCLIKHQQ

SEQ ID NO: 308806 - protein, 9 aa, Homo Sapiens
DLKSYASAF

SEQ ID NO: 308807 - protein, 9 aa, Homo Sapiens
VDHLSCTPL

SEQ ID NO: 308808 - protein, 9 aa, Homo Sapiens
QHLQNFFFI

SEQ ID NO: 308809 - protein, 9 aa, Homo Sapiens
VECLLERLT

SEQ ID NO: 308810 - protein, 9 aa, Homo Sapiens
TILDVVEEE

SEQ ID NO: 308811 - protein, 9 aa, Homo Sapiens
NQMQTDSLF

SEQ ID NO: 308812 - protein, 9 aa, Homo Sapiens
PSAKEEVNS

SEQ ID NO: 308813 - protein, 9 aa, Homo Sapiens
KYALKAVDT

SEQ ID NO: 308814 - protein, 9 aa, Homo Sapiens
PLTLQEARV

SEQ ID NO: 308815 - protein, 9 aa, Homo Sapiens
DVGSSAFKI

SEQ ID NO: 308816 - protein, 9 aa, Homo Sapiens
EGILNQNHR

SEQ ID NO: 308817 - protein, 9 aa, Homo Sapiens
LIGETVNNS

SEQ ID NO: 308818 - protein, 9 aa, Homo Sapiens
NSWNFKLPH

SEQ ID NO: 308819 - protein, 9 aa, Homo Sapiens
SIFTLKLLD

SEQ ID NO: 308820 - protein, 9 aa, Homo Sapiens
IIHTEDKFY

SEQ ID NO: 308821 - protein, 9 aa, Homo Sapiens
AIWGSSIKQ

SEQ ID NO: 308822 - protein, 9 aa, Homo Sapiens
GNVKTSRQL

SEQ ID NO: 308823 - protein, 9 aa, Homo Sapiens
TLQALGYQP

SEQ ID NO: 308824 - protein, 9 aa, Homo Sapiens
RLREYYDRT

SEQ ID NO: 308825 - protein, 9 aa, Homo Sapiens
LRVQAEGQS

SEQ ID NO: 308826 - protein, 9 aa, Homo Sapiens
NIQMNAPSK

SEQ ID NO: 308827 - protein, 9 aa, Homo Sapiens
PLVRRTVRS

SEQ ID NO: 308828 - protein, 9 aa, Homo Sapiens
RQNSDIVNH

SEQ ID NO: 308829 - protein, 9 aa, Homo Sapiens
SPTGKFYMG

SEQ ID NO: 308830 - protein, 9 aa, Homo Sapiens
GEPHAVTIH

SEQ ID NO: 308831 - protein, 9 aa, Homo Sapiens
GLCLAEKYK

SEQ ID NO: 308832 - protein, 9 aa, Homo Sapiens
WWHAPVVPA

SEQ ID NO: 308833 - protein, 9 aa, Homo Sapiens
IVNHQRIHT

SEQ ID NO: 308834 - protein, 9 aa, Homo Sapiens
LREQHDALA

SEQ ID NO: 308835 - protein, 9 aa, Homo Sapiens
LSQFSPHLY

SEQ ID NO: 308836 - protein, 9 aa, Homo Sapiens
SGKLDQIIY

SEQ ID NO: 308837 - protein, 9 aa, Homo Sapiens
LHYFILVSF

SEQ ID NO: 308838 - protein, 9 aa, Homo Sapiens
LKIQSLDQV

SEQ ID NO: 308839 - protein, 9 aa, Homo Sapiens
QWNRVYSNT

SEQ ID NO: 308840 - protein, 9 aa, Homo Sapiens
QTLVGHQQI

SEQ ID NO: 308841 - protein, 9 aa, Homo Sapiens
CRTCNLSLP

SEQ ID NO: 308842 - protein, 9 aa, Homo Sapiens
SASFPKKKP

SEQ ID NO: 308843 - protein, 9 aa, Homo Sapiens
SFCGQLQVY

SEQ ID NO: 308844 - protein, 9 aa, Homo Sapiens
KTIPESEPS

SEQ ID NO: 308845 - protein, 9 aa, Homo Sapiens
DITSWYNGV

SEQ ID NO: 308846 - protein, 9 aa, Homo Sapiens
SDKQYGRIT

SEQ ID NO: 308847 - protein, 9 aa, Homo Sapiens
QFFQKLINK

SEQ ID NO: 308848 - protein, 9 aa, Homo Sapiens
KAFHASSTS

SEQ ID NO: 308849 - protein, 9 aa, Homo Sapiens
GDIWELSRC

SEQ ID NO: 308850 - protein, 9 aa, Homo Sapiens
KQNTFSPLP

SEQ ID NO: 308851 - protein, 9 aa, Homo Sapiens
LGSITEHCI

SEQ ID NO: 308852 - protein, 9 aa, Homo Sapiens
CVEPVGLNY

SEQ ID NO: 308853 - protein, 9 aa, Homo Sapiens
ANSGGTALH

SEQ ID NO: 308854 - protein, 9 aa, Homo Sapiens
HSNIFEMLV

SEQ ID NO: 308855 - protein, 9 aa, Homo Sapiens
DVNLQDTSD

SEQ ID NO: 308856 - protein, 9 aa, Homo Sapiens
KNKEPDDIW

SEQ ID NO: 308857 - protein, 9 aa, Homo Sapiens
TDSWLDKEV

SEQ ID NO: 308858 - protein, 9 aa, Homo Sapiens
TRLIVVFFV

SEQ ID NO: 308859 - protein, 9 aa, Homo Sapiens
VTPLKLAGW

SEQ ID NO: 308860 - protein, 9 aa, Homo Sapiens
FQGAPDVLS

SEQ ID NO: 308861 - protein, 9 aa, Homo Sapiens
EQNKNKLLS

SEQ ID NO: 308862 - protein, 9 aa, Homo Sapiens
SQSKETCAP

SEQ ID NO: 308863 - protein, 9 aa, Homo Sapiens
KFPKGYYTC

SEQ ID NO: 308864 - protein, 9 aa, Homo Sapiens
PFTGVACSY

SEQ ID NO: 308865 - protein, 9 aa, Homo Sapiens
KEITGWDEK

SEQ ID NO: 308866 - protein, 9 aa, Homo Sapiens
CIICALLGI

SEQ ID NO: 308867 - protein, 9 aa, Homo Sapiens
QVAQARFLH

SEQ ID NO: 308868 - protein, 9 aa, Homo Sapiens
DKPHTVKKA

SEQ ID NO: 308869 - protein, 9 aa, Homo Sapiens
SSKKIARRG

SEQ ID NO: 308870 - protein, 9 aa, Homo Sapiens
FTIMIVYFI

SEQ ID NO: 308871 - protein, 9 aa, Homo Sapiens
LEHYYKENN

SEQ ID NO: 308872 - protein, 9 aa, Homo Sapiens
KYYYCEVPF

SEQ ID NO: 308873 - protein, 9 aa, Homo Sapiens
ILDLEKSRH

SEQ ID NO: 308874 - protein, 9 aa, Homo Sapiens
RAASQNNLV

SEQ ID NO: 308875 - protein, 9 aa, Homo Sapiens
TQADEGRTK

SEQ ID NO: 308876 - protein, 9 aa, Homo Sapiens
VLRNAFNTS

SEQ ID NO: 308877 - protein, 9 aa, Homo Sapiens
NNYTCVDGI

SEQ ID NO: 308878 - protein, 9 aa, Homo Sapiens
NNFGPKGFG

SEQ ID NO: 308879 - protein, 9 aa, Homo Sapiens
NNLELEVIN

SEQ ID NO: 308880 - protein, 9 aa, Homo Sapiens
LNDTLTFKE

SEQ ID NO: 308881 - protein, 9 aa, Homo Sapiens
LLLVSSVPV

SEQ ID NO: 308882 - protein, 9 aa, Homo Sapiens
GDEFYFMED

SEQ ID NO: 308883 - protein, 9 aa, Homo Sapiens
APMGVHPSL

SEQ ID NO: 308884 - protein, 9 aa, Homo Sapiens
QTGKPSMIT

SEQ ID NO: 308885 - protein, 9 aa, Homo Sapiens
DIASPTFQR

SEQ ID NO: 308886 - protein, 9 aa, Homo Sapiens
LTKEDNCCV

SEQ ID NO: 308887 - protein, 9 aa, Homo Sapiens
LGIINREAL

SEQ ID NO: 308888 - protein, 9 aa, Homo Sapiens
LQTLVEDVQ

SEQ ID NO: 308889 - protein, 9 aa, Homo Sapiens
EVPVKISRM

SEQ ID NO: 308890 - protein, 9 aa, Homo Sapiens
KCSECEITF

SEQ ID NO: 308891 - protein, 9 aa, Homo Sapiens
SNGLWRFCI

SEQ ID NO: 308892 - protein, 9 aa, Homo Sapiens
VGGEVSPHQ

SEQ ID NO: 308893 - protein, 9 aa, Homo Sapiens
NDSSKFDEV

SEQ ID NO: 308894 - protein, 9 aa, Homo Sapiens
MDAPERQPQ

SEQ ID NO: 308895 - protein, 9 aa, Homo Sapiens
EDIETILHT

SEQ ID NO: 308896 - protein, 9 aa, Homo Sapiens
RVVLYVLNQ

SEQ ID NO: 308897 - protein, 9 aa, Homo Sapiens
STTLSDAYQ

SEQ ID NO: 308898 - protein, 9 aa, Homo Sapiens
YKGINECKA

SEQ ID NO: 308899 - protein, 9 aa, Homo Sapiens
IEGNDCPFE

SEQ ID NO: 308900 - protein, 9 aa, Homo Sapiens
RRGSQDKQT

SEQ ID NO: 308901 - protein, 9 aa, Homo Sapiens
EFINLLLDR

SEQ ID NO: 308902 - protein, 9 aa, Homo Sapiens
SRCRPAAGR

SEQ ID NO: 308903 - protein, 9 aa, Homo Sapiens
VILELRIKL

SEQ ID NO: 308904 - protein, 9 aa, Homo Sapiens
GESEVQRLA

SEQ ID NO: 308905 - protein, 9 aa, Homo Sapiens
LVFGNQFGL

SEQ ID NO: 308906 - protein, 9 aa, Homo Sapiens
VETYRKKWL

SEQ ID NO: 308907 - protein, 9 aa, Homo Sapiens
FMEKSNNQL

SEQ ID NO: 308908 - protein, 9 aa, Homo Sapiens
TPATAAGSA

SEQ ID NO: 308909 - protein, 9 aa, Homo Sapiens
ATLTVRALR

SEQ ID NO: 308910 - protein, 9 aa, Homo Sapiens
GGLNGRLEK

SEQ ID NO: 308911 - protein, 9 aa, Homo Sapiens
NYRGPRTQD

SEQ ID NO: 308912 - protein, 9 aa, Homo Sapiens
LLCCLYQLC

SEQ ID NO: 308913 - protein, 9 aa, Homo Sapiens
YWVIYKIIR

SEQ ID NO: 308914 - protein, 9 aa, Homo Sapiens
PAIMREEVY

SEQ ID NO: 308915 - protein, 9 aa, Homo Sapiens
FINQILFLR

SEQ ID NO: 308916 - protein, 9 aa, Homo Sapiens
NKSVAQIGG

SEQ ID NO: 308917 - protein, 9 aa, Homo Sapiens
ATICSPDLL

SEQ ID NO: 308918 - protein, 9 aa, Homo Sapiens
SPLDLFNNI

SEQ ID NO: 308919 - protein, 9 aa, Homo Sapiens
KSLSSTSVL

SEQ ID NO: 308920 - protein, 9 aa, Homo Sapiens
TPVKVWFQE

SEQ ID NO: 308921 - protein, 9 aa, Homo Sapiens
LGTGAFSKV

SEQ ID NO: 308922 - protein, 9 aa, Homo Sapiens
QAGMIPRAR

SEQ ID NO: 308923 - protein, 9 aa, Homo Sapiens
TPTTRSAGV

SEQ ID NO: 308924 - protein, 9 aa, Homo Sapiens
QILDNYLQA

SEQ ID NO: 308925 - protein, 9 aa, Homo Sapiens
SSRNEGISA

SEQ ID NO: 308926 - protein, 9 aa, Homo Sapiens
RDAETDQIM

SEQ ID NO: 308927 - protein, 9 aa, Homo Sapiens
LHLVNCVEP

SEQ ID NO: 308928 - protein, 9 aa, Homo Sapiens
LTELVDGML

SEQ ID NO: 308929 - protein, 9 aa, Homo Sapiens
KIIIMELDM

SEQ ID NO: 308930 - protein, 9 aa, Homo Sapiens
VKDNTKRFL

SEQ ID NO: 308931 - protein, 9 aa, Homo Sapiens
CCLYQLCKK

SEQ ID NO: 308932 - protein, 9 aa, Homo Sapiens
VRLRKKNQM

SEQ ID NO: 308933 - protein, 9 aa, Homo Sapiens
YQLCKKSKP

SEQ ID NO: 308934 - protein, 9 aa, Homo Sapiens
WASPTRTAP

SEQ ID NO: 308935 - protein, 9 aa, Homo Sapiens
KHNHILKPE

SEQ ID NO: 308936 - protein, 9 aa, Homo Sapiens
PEELRQTLM

SEQ ID NO: 308937 - protein, 9 aa, Homo Sapiens
DSEDFNVQE

SEQ ID NO: 308938 - protein, 9 aa, Homo Sapiens
NNLLAFSQL

SEQ ID NO: 308939 - protein, 9 aa, Homo Sapiens
NTVNKCAVM

SEQ ID NO: 308940 - protein, 9 aa, Homo Sapiens
RGVFGTDYS

SEQ ID NO: 308941 - protein, 9 aa, Homo Sapiens
QFDTFDSLS

SEQ ID NO: 308942 - protein, 9 aa, Homo Sapiens
DPSWPSTAI

SEQ ID NO: 308943 - protein, 9 aa, Homo Sapiens
LAQIPQKGL

SEQ ID NO: 308944 - protein, 9 aa, Homo Sapiens
LLVLGLLFM

SEQ ID NO: 308945 - protein, 9 aa, Homo Sapiens
LLDCRPSLA

SEQ ID NO: 308946 - protein, 9 aa, Homo Sapiens
CFNKRKTYF

SEQ ID NO: 308947 - protein, 9 aa, Homo Sapiens
ARERLTARL

SEQ ID NO: 308948 - protein, 9 aa, Homo Sapiens
IFVKICMEE

SEQ ID NO: 308949 - protein, 9 aa, Homo Sapiens
YPTPQSYTR

SEQ ID NO: 308950 - protein, 9 aa, Homo Sapiens
IISFLYDCL

SEQ ID NO: 308951 - protein, 9 aa, Homo Sapiens
FEHIIYQMD

SEQ ID NO: 308952 - protein, 9 aa, Homo Sapiens
FRQNSDIVN

SEQ ID NO: 308953 - protein, 9 aa, Homo Sapiens
GSCNSILED

SEQ ID NO: 308954 - protein, 9 aa, Homo Sapiens
SGAKWEKEK

SEQ ID NO: 308955 - protein, 9 aa, Homo Sapiens
LDVRTRGST

SEQ ID NO: 308956 - protein, 9 aa, Homo Sapiens
PRINATRQG

SEQ ID NO: 308957 - protein, 9 aa, Homo Sapiens
NQNGSELDL

SEQ ID NO: 308958 - protein, 9 aa, Homo Sapiens
LEILFTTVS

SEQ ID NO: 308959 - protein, 9 aa, Homo Sapiens
NFLTEISKL

SEQ ID NO: 308960 - protein, 9 aa, Homo Sapiens
NCDADWNEW

SEQ ID NO: 308961 - protein, 9 aa, Homo Sapiens
QCETFIPYS

SEQ ID NO: 308962 - protein, 9 aa, Homo Sapiens
INGRHNTLR

SEQ ID NO: 308963 - protein, 9 aa, Homo Sapiens
HLCSLSSSL

SEQ ID NO: 308964 - protein, 9 aa, Homo Sapiens
HLEGMKYMY

SEQ ID NO: 308965 - protein, 9 aa, Homo Sapiens
HVAQDIWPE

SEQ ID NO: 308966 - protein, 9 aa, Homo Sapiens
LSDLNKQVL

SEQ ID NO: 308967 - protein, 9 aa, Homo Sapiens
LRQQNVFCD

SEQ ID NO: 308968 - protein, 9 aa, Homo Sapiens
VDELCPLVV

SEQ ID NO: 308969 - protein, 9 aa, Homo Sapiens
PMYFLIFNL

SEQ ID NO: 308970 - protein, 9 aa, Homo Sapiens
IEPQFQRYF

SEQ ID NO: 308971 - protein, 9 aa, Homo Sapiens
LMECMNKKE

SEQ ID NO: 308972 - protein, 9 aa, Homo Sapiens
SLSKRSLRY

SEQ ID NO: 308973 - protein, 9 aa, Homo Sapiens
MAQLIHLFS

SEQ ID NO: 308974 - protein, 9 aa, Homo Sapiens
RDVGSSAFK

SEQ ID NO: 308975 - protein, 9 aa, Homo Sapiens
LCGTLFITF

SEQ ID NO: 308976 - protein, 9 aa, Homo Sapiens
PTPQSYTRE

SEQ ID NO: 308977 - protein, 9 aa, Homo Sapiens
YIYYSCLDN

SEQ ID NO: 308978 - protein, 9 aa, Homo Sapiens
RTAGSQSSH

SEQ ID NO: 308979 - protein, 9 aa, Homo Sapiens
LEVSSRLLL

SEQ ID NO: 308980 - protein, 9 aa, Homo Sapiens
LHSSEDPMD

SEQ ID NO: 308981 - protein, 9 aa, Homo Sapiens
ISESFLLDL

SEQ ID NO: 308982 - protein, 9 aa, Homo Sapiens
PSHLSTDDH

SEQ ID NO: 308983 - protein, 9 aa, Homo Sapiens
IMYPGAKDQ

SEQ ID NO: 308984 - protein, 9 aa, Homo Sapiens
SCNKQQRAR

SEQ ID NO: 308985 - protein, 9 aa, Homo Sapiens
LLENITFSN

SEQ ID NO: 308986 - protein, 9 aa, Homo Sapiens
FSMSASKRD

SEQ ID NO: 308987 - protein, 9 aa, Homo Sapiens
ILFVNRPNK

SEQ ID NO: 308988 - protein, 9 aa, Homo Sapiens
LALIKRGGC

SEQ ID NO: 308989 - protein, 9 aa, Homo Sapiens
SLSASGRHM

SEQ ID NO: 308990 - protein, 9 aa, Homo Sapiens
SDYNSALRF

SEQ ID NO: 308991 - protein, 9 aa, Homo Sapiens
RRHPQINFI

SEQ ID NO: 308992 - protein, 9 aa, Homo Sapiens
YQPYKCDQC

SEQ ID NO: 308993 - protein, 9 aa, Homo Sapiens
GLLPKPKKN

SEQ ID NO: 308994 - protein, 9 aa, Homo Sapiens
CPMCREFLS

SEQ ID NO: 308995 - protein, 9 aa, Homo Sapiens
HTCKICGKA

SEQ ID NO: 308996 - protein, 9 aa, Homo Sapiens
VLQGKFNGN

SEQ ID NO: 308997 - protein, 9 aa, Homo Sapiens
YQKLKKFMN

SEQ ID NO: 308998 - protein, 9 aa, Homo Sapiens
WFQEAEERP

SEQ ID NO: 308999 - protein, 9 aa, Homo Sapiens
QCAKCSLAT

SEQ ID NO: 309000 - protein, 9 aa, Homo Sapiens
LMPSVSSYF

SEQ ID NO: 309001 - protein, 9 aa, Homo Sapiens
ASKRDLSTS

SEQ ID NO: 309002 - protein, 9 aa, Homo Sapiens
DKMFLLDPS

SEQ ID NO: 309003 - protein, 9 aa, Homo Sapiens
MAMAQETGG

SEQ ID NO: 309004 - protein, 9 aa, Homo Sapiens
KLTTNYVDF

SEQ ID NO: 309005 - protein, 9 aa, Homo Sapiens
IILAGRYLM

SEQ ID NO: 309006 - protein, 9 aa, Homo Sapiens
TGLQSDTER

SEQ ID NO: 309007 - protein, 9 aa, Homo Sapiens
QIEEATEEA

SEQ ID NO: 309008 - protein, 9 aa, Homo Sapiens
NDSNKKKKE

SEQ ID NO: 309009 - protein, 9 aa, Homo Sapiens
HLEELLTAL

SEQ ID NO: 309010 - protein, 9 aa, Homo Sapiens
KDYFQASGY

SEQ ID NO: 309011 - protein, 9 aa, Homo Sapiens
ILSTSDTVL

SEQ ID NO: 309012 - protein, 9 aa, Homo Sapiens
SNKYSSEDD

SEQ ID NO: 309013 - protein, 9 aa, Homo Sapiens
LSFTPPFNG

SEQ ID NO: 309014 - protein, 9 aa, Homo Sapiens
IIYTLQTKR

SEQ ID NO: 309015 - protein, 9 aa, Homo Sapiens
QHVIIHAAE

SEQ ID NO: 309016 - protein, 9 aa, Homo Sapiens
LFQSAEAGL

SEQ ID NO: 309017 - protein, 9 aa, Homo Sapiens
IVNSFIVSS

SEQ ID NO: 309018 - protein, 9 aa, Homo Sapiens
NNPSVRLKI

SEQ ID NO: 309019 - protein, 9 aa, Homo Sapiens
DVVTKVVDV

SEQ ID NO: 309020 - protein, 9 aa, Homo Sapiens
QLKRVPQTG

SEQ ID NO: 309021 - protein, 9 aa, Homo Sapiens
RGTHIMNST

SEQ ID NO: 309022 - protein, 9 aa, Homo Sapiens
GRPKGSKSK

SEQ ID NO: 309023 - protein, 9 aa, Homo Sapiens
THGIRNGIN

SEQ ID NO: 309024 - protein, 9 aa, Homo Sapiens
QLCKKSKPI

SEQ ID NO: 309025 - protein, 9 aa, Homo Sapiens
KSMDEFILK

SEQ ID NO: 309026 - protein, 9 aa, Homo Sapiens
GLNTDGQLG

SEQ ID NO: 309027 - protein, 9 aa, Homo Sapiens
NQIQRHHTF

SEQ ID NO: 309028 - protein, 9 aa, Homo Sapiens
PWTQEAVGR

SEQ ID NO: 309029 - protein, 9 aa, Homo Sapiens
NPTEEQDEL

SEQ ID NO: 309030 - protein, 9 aa, Homo Sapiens
LSCPECNLQ

SEQ ID NO: 309031 - protein, 9 aa, Homo Sapiens
RTLWLFPFS

SEQ ID NO: 309032 - protein, 9 aa, Homo Sapiens
SKQKPLPPL

SEQ ID NO: 309033 - protein, 9 aa, Homo Sapiens
HLWGHEKIH

SEQ ID NO: 309034 - protein, 9 aa, Homo Sapiens
KITFLEAGI

SEQ ID NO: 309035 - protein, 9 aa, Homo Sapiens
VVILANREN

SEQ ID NO: 309036 - protein, 9 aa, Homo Sapiens
KRRIKIHRM

SEQ ID NO: 309037 - protein, 9 aa, Homo Sapiens
HQTVTSPQP

SEQ ID NO: 309038 - protein, 9 aa, Homo Sapiens
EEVCAVLEK

SEQ ID NO: 309039 - protein, 9 aa, Homo Sapiens
ANLAYHQII

SEQ ID NO: 309040 - protein, 9 aa, Homo Sapiens
TNIGLGVTL

SEQ ID NO: 309041 - protein, 9 aa, Homo Sapiens
ARFYFLFHQ

SEQ ID NO: 309042 - protein, 9 aa, Homo Sapiens
NKNVSVIGR

SEQ ID NO: 309043 - protein, 9 aa, Homo Sapiens
NFTTRYITE

SEQ ID NO: 309044 - protein, 9 aa, Homo Sapiens
KYFSLDHMN

SEQ ID NO: 309045 - protein, 9 aa, Homo Sapiens
IKLRNRRII

SEQ ID NO: 309046 - protein, 9 aa, Homo Sapiens
KHFCAGRDS

SEQ ID NO: 309047 - protein, 9 aa, Homo Sapiens
RIIHNGEKL

SEQ ID NO: 309048 - protein, 9 aa, Homo Sapiens
CFDDSLPNP

SEQ ID NO: 309049 - protein, 9 aa, Homo Sapiens
KKKLLGQLY

SEQ ID NO: 309050 - protein, 9 aa, Homo Sapiens
KVNKTSGPT

SEQ ID NO: 309051 - protein, 9 aa, Homo Sapiens
ACISTGPYP

SEQ ID NO: 309052 - protein, 9 aa, Homo Sapiens
LFPCNECTK

SEQ ID NO: 309053 - protein, 9 aa, Homo Sapiens
DELSYGFDG

SEQ ID NO: 309054 - protein, 9 aa, Homo Sapiens
PSKGSHKRA

SEQ ID NO: 309055 - protein, 9 aa, Homo Sapiens
LCSFISAIA

SEQ ID NO: 309056 - protein, 9 aa, Homo Sapiens
FLVRHFCIL

SEQ ID NO: 309057 - protein, 9 aa, Homo Sapiens
SPKLTPNMK

SEQ ID NO: 309058 - protein, 9 aa, Homo Sapiens
LLFLYTGDS

SEQ ID NO: 309059 - protein, 9 aa, Homo Sapiens
ILVGELELL

SEQ ID NO: 309060 - protein, 9 aa, Homo Sapiens
ASFSPTDNT

SEQ ID NO: 309061 - protein, 9 aa, Homo Sapiens
GQIEENYNA

SEQ ID NO: 309062 - protein, 9 aa, Homo Sapiens
EYPQLEQRY

SEQ ID NO: 309063 - protein, 9 aa, Homo Sapiens
GWWSSDDNV

SEQ ID NO: 309064 - protein, 9 aa, Homo Sapiens
SSTGLERRV

SEQ ID NO: 309065 - protein, 9 aa, Homo Sapiens
SACHHSISV

SEQ ID NO: 309066 - protein, 9 aa, Homo Sapiens
LSQKVLQSP

SEQ ID NO: 309067 - protein, 9 aa, Homo Sapiens
CIATSSTGL

SEQ ID NO: 309068 - protein, 9 aa, Homo Sapiens
ANNYILMQA

SEQ ID NO: 309069 - protein, 9 aa, Homo Sapiens
QQAADLLQD

SEQ ID NO: 309070 - protein, 9 aa, Homo Sapiens
DKQPRKDYT

SEQ ID NO: 309071 - protein, 9 aa, Homo Sapiens
DQDSYRESI

SEQ ID NO: 309072 - protein, 9 aa, Homo Sapiens
HFNNVHGDI

SEQ ID NO: 309073 - protein, 9 aa, Homo Sapiens
QSSIPEGVR

SEQ ID NO: 309074 - protein, 9 aa, Homo Sapiens
QLIYPPLAQ

SEQ ID NO: 309075 - protein, 9 aa, Homo Sapiens
LNWEYFKSS

SEQ ID NO: 309076 - protein, 9 aa, Homo Sapiens
PVIQVNYWV

SEQ ID NO: 309077 - protein, 9 aa, Homo Sapiens
SERGSQQSK

SEQ ID NO: 309078 - protein, 9 aa, Homo Sapiens
AFLINKETQ

SEQ ID NO: 309079 - protein, 9 aa, Homo Sapiens
QGKFNGNPM

SEQ ID NO: 309080 - protein, 9 aa, Homo Sapiens
LYNSVNTSG

SEQ ID NO: 309081 - protein, 9 aa, Homo Sapiens
NIKNYYKRK

SEQ ID NO: 309082 - protein, 9 aa, Homo Sapiens
GMTPVREDS

SEQ ID NO: 309083 - protein, 9 aa, Homo Sapiens
NGYPYYTHC

SEQ ID NO: 309084 - protein, 9 aa, Homo Sapiens
KILTPGICL

SEQ ID NO: 309085 - protein, 9 aa, Homo Sapiens
KNRMIQLHP

SEQ ID NO: 309086 - protein, 9 aa, Homo Sapiens
SLHNMISGL

SEQ ID NO: 309087 - protein, 9 aa, Homo Sapiens
SNVYRYHSE

SEQ ID NO: 309088 - protein, 9 aa, Homo Sapiens
RETLEEGHF

SEQ ID NO: 309089 - protein, 9 aa, Homo Sapiens
SGICAIAGV

SEQ ID NO: 309090 - protein, 9 aa, Homo Sapiens
ITIFTESLQ

SEQ ID NO: 309091 - protein, 9 aa, Homo Sapiens
TGINKAPIQ

SEQ ID NO: 309092 - protein, 9 aa, Homo Sapiens
QIIMTPRLC

SEQ ID NO: 309093 - protein, 9 aa, Homo Sapiens
YGPGIIQSH

SEQ ID NO: 309094 - protein, 9 aa, Homo Sapiens
AFNRSYHLI

SEQ ID NO: 309095 - protein, 9 aa, Homo Sapiens
LWRSQLEQK

SEQ ID NO: 309096 - protein, 9 aa, Homo Sapiens
PSLLEDPNI

SEQ ID NO: 309097 - protein, 9 aa, Homo Sapiens
DCKIRIFIG

SEQ ID NO: 309098 - protein, 9 aa, Homo Sapiens
NIGWAWWLT

SEQ ID NO: 309099 - protein, 9 aa, Homo Sapiens
VERVLGTHK

SEQ ID NO: 309100 - protein, 9 aa, Homo Sapiens
GVAVSKQYP

SEQ ID NO: 309101 - protein, 9 aa, Homo Sapiens
GSGPKPENP

SEQ ID NO: 309102 - protein, 9 aa, Homo Sapiens
LIAAQRQKV

SEQ ID NO: 309103 - protein, 9 aa, Homo Sapiens
VRHWKSHKD

SEQ ID NO: 309104 - protein, 9 aa, Homo Sapiens
GRVYVSVDL

SEQ ID NO: 309105 - protein, 9 aa, Homo Sapiens
LHYAKNVII

SEQ ID NO: 309106 - protein, 9 aa, Homo Sapiens
VVDESSFLT

SEQ ID NO: 309107 - protein, 9 aa, Homo Sapiens
LPLQKELNE

SEQ ID NO: 309108 - protein, 9 aa, Homo Sapiens
PYLTTYGQI

SEQ ID NO: 309109 - protein, 9 aa, Homo Sapiens
FNEISILES

SEQ ID NO: 309110 - protein, 9 aa, Homo Sapiens
PYGISAIKR

SEQ ID NO: 309111 - protein, 9 aa, Homo Sapiens
GAQPLCISF

SEQ ID NO: 309112 - protein, 9 aa, Homo Sapiens
EQSLVVRKK

SEQ ID NO: 309113 - protein, 9 aa, Homo Sapiens
RYHSESSSR

SEQ ID NO: 309114 - protein, 9 aa, Homo Sapiens
STSSSSDTT

SEQ ID NO: 309115 - protein, 9 aa, Homo Sapiens
KPKLVINVT

SEQ ID NO: 309116 - protein, 9 aa, Homo Sapiens
LGIAKPSLL

SEQ ID NO: 309117 - protein, 9 aa, Homo Sapiens
RLDLNPHGF

SEQ ID NO: 309118 - protein, 9 aa, Homo Sapiens
AYIMWGYLI

SEQ ID NO: 309119 - protein, 9 aa, Homo Sapiens
YLEEEQRAR

SEQ ID NO: 309120 - protein, 9 aa, Homo Sapiens
VFKTKKRRS

SEQ ID NO: 309121 - protein, 9 aa, Homo Sapiens
ATNIKNYYK

SEQ ID NO: 309122 - protein, 9 aa, Homo Sapiens
LLENVKVDF

SEQ ID NO: 309123 - protein, 9 aa, Homo Sapiens
INSIQAAQD

SEQ ID NO: 309124 - protein, 9 aa, Homo Sapiens
MGEQEEKMR

SEQ ID NO: 309125 - protein, 9 aa, Homo Sapiens
LSRAEAITA

SEQ ID NO: 309126 - protein, 9 aa, Homo Sapiens
KKQLQQKQL

SEQ ID NO: 309127 - protein, 9 aa, Homo Sapiens
SQNGFDKVS

SEQ ID NO: 309128 - protein, 9 aa, Homo Sapiens
LYCDSLPLL

SEQ ID NO: 309129 - protein, 9 aa, Homo Sapiens
GLVPIKYSE

SEQ ID NO: 309130 - protein, 9 aa, Homo Sapiens
ASLLGKKWE

SEQ ID NO: 309131 - protein, 9 aa, Homo Sapiens
IKIFPSRRN

SEQ ID NO: 309132 - protein, 9 aa, Homo Sapiens
GTLFFTDYG

SEQ ID NO: 309133 - protein, 9 aa, Homo Sapiens
FELFEEADF

SEQ ID NO: 309134 - protein, 9 aa, Homo Sapiens
QMYNPTTTL

SEQ ID NO: 309135 - protein, 9 aa, Homo Sapiens
AVKLYNNHD

SEQ ID NO: 309136 - protein, 9 aa, Homo Sapiens
GYYTCCDLV

SEQ ID NO: 309137 - protein, 9 aa, Homo Sapiens
SVSCQEGKT

SEQ ID NO: 309138 - protein, 9 aa, Homo Sapiens
EEETHIQNE

SEQ ID NO: 309139 - protein, 9 aa, Homo Sapiens
CFMNNILSY

SEQ ID NO: 309140 - protein, 9 aa, Homo Sapiens
HLTHQILHS

SEQ ID NO: 309141 - protein, 9 aa, Homo Sapiens
TMAQLKMSQ

SEQ ID NO: 309142 - protein, 9 aa, Homo Sapiens
SQDIVTCTR

SEQ ID NO: 309143 - protein, 9 aa, Homo Sapiens
DADTYGEEN

SEQ ID NO: 309144 - protein, 9 aa, Homo Sapiens
DPVCLHEGK

SEQ ID NO: 309145 - protein, 9 aa, Homo Sapiens
AILSQGRFG

SEQ ID NO: 309146 - protein, 9 aa, Homo Sapiens
NLRSQSSDD

SEQ ID NO: 309147 - protein, 9 aa, Homo Sapiens
KICSNVYVD

SEQ ID NO: 309148 - protein, 9 aa, Homo Sapiens
RLVVDESSF

SEQ ID NO: 309149 - protein, 9 aa, Homo Sapiens
ETFYLAQDL

SEQ ID NO: 309150 - protein, 9 aa, Homo Sapiens
GLTLKSSMD

SEQ ID NO: 309151 - protein, 9 aa, Homo Sapiens
IILQLIKEC

SEQ ID NO: 309152 - protein, 9 aa, Homo Sapiens
ARFIEDMIN

SEQ ID NO: 309153 - protein, 9 aa, Homo Sapiens
LTTHQISHT

SEQ ID NO: 309154 - protein, 9 aa, Homo Sapiens
IMPSQISLR

SEQ ID NO: 309155 - protein, 9 aa, Homo Sapiens
ETGYELEGN

SEQ ID NO: 309156 - protein, 9 aa, Homo Sapiens
ENKSLTPAV

SEQ ID NO: 309157 - protein, 9 aa, Homo Sapiens
FEIQYPLNK

SEQ ID NO: 309158 - protein, 9 aa, Homo Sapiens
KLPLKFRDA

SEQ ID NO: 309159 - protein, 9 aa, Homo Sapiens
AKIKTNKGL

SEQ ID NO: 309160 - protein, 9 aa, Homo Sapiens
PAFLALPNK

SEQ ID NO: 309161 - protein, 9 aa, Homo Sapiens
MATNHVQVI

SEQ ID NO: 309162 - protein, 9 aa, Homo Sapiens
LIFSRNLHP

SEQ ID NO: 309163 - protein, 9 aa, Homo Sapiens
ANFDLRTFQ

SEQ ID NO: 309164 - protein, 9 aa, Homo Sapiens
TTAGSSSTR

SEQ ID NO: 309165 - protein, 9 aa, Homo Sapiens
AQPDDSDQT

SEQ ID NO: 309166 - protein, 9 aa, Homo Sapiens
YFDNWCSLV

SEQ ID NO: 309167 - protein, 9 aa, Homo Sapiens
ATLLLANNY

SEQ ID NO: 309168 - protein, 9 aa, Homo Sapiens
RKIQCVQNK

SEQ ID NO: 309169 - protein, 9 aa, Homo Sapiens
FQSHMIMHT

SEQ ID NO: 309170 - protein, 9 aa, Homo Sapiens
YHYLGGRCV

SEQ ID NO: 309171 - protein, 9 aa, Homo Sapiens
IGNIVLRKR

SEQ ID NO: 309172 - protein, 9 aa, Homo Sapiens
KMGQLIVQS

SEQ ID NO: 309173 - protein, 9 aa, Homo Sapiens
LLDLNNKIL

SEQ ID NO: 309174 - protein, 9 aa, Homo Sapiens
VYVSVDLCQ

SEQ ID NO: 309175 - protein, 9 aa, Homo Sapiens
TKKRRIRGR

SEQ ID NO: 309176 - protein, 9 aa, Homo Sapiens
IKLPAGSQC

SEQ ID NO: 309177 - protein, 9 aa, Homo Sapiens
GDISFPGIT

SEQ ID NO: 309178 - protein, 9 aa, Homo Sapiens
KLLIPNASQ

SEQ ID NO: 309179 - protein, 9 aa, Homo Sapiens
APLQMYNPT

SEQ ID NO: 309180 - protein, 9 aa, Homo Sapiens
PAHLMSLSG

SEQ ID NO: 309181 - protein, 9 aa, Homo Sapiens
PKFTIKNEK

SEQ ID NO: 309182 - protein, 9 aa, Homo Sapiens
LEDPNIKEI

SEQ ID NO: 309183 - protein, 9 aa, Homo Sapiens
SLGIYTFGL

SEQ ID NO: 309184 - protein, 9 aa, Homo Sapiens
NNHDQHCRD

SEQ ID NO: 309185 - protein, 9 aa, Homo Sapiens
PQSLELLNE

SEQ ID NO: 309186 - protein, 9 aa, Homo Sapiens
SICSWNPGR

SEQ ID NO: 309187 - protein, 9 aa, Homo Sapiens
RLAKKIREK

SEQ ID NO: 309188 - protein, 9 aa, Homo Sapiens
PFFHSVLAQ

SEQ ID NO: 309189 - protein, 9 aa, Homo Sapiens
KLNETQPID

SEQ ID NO: 309190 - protein, 9 aa, Homo Sapiens
SILFSPVSI

SEQ ID NO: 309191 - protein, 9 aa, Homo Sapiens
SRPIGDIPQ

SEQ ID NO: 309192 - protein, 9 aa, Homo Sapiens
LVPIKYSEV

SEQ ID NO: 309193 - protein, 9 aa, Homo Sapiens
LFSRRTSTQ

SEQ ID NO: 309194 - protein, 9 aa, Homo Sapiens
AFIDTEGSF

SEQ ID NO: 309195 - protein, 9 aa, Homo Sapiens
CLQILLKGY

SEQ ID NO: 309196 - protein, 9 aa, Homo Sapiens
LFRELPEPI

SEQ ID NO: 309197 - protein, 9 aa, Homo Sapiens
PIIWLNETG

SEQ ID NO: 309198 - protein, 9 aa, Homo Sapiens
NLVRHQQTH

SEQ ID NO: 309199 - protein, 9 aa, Homo Sapiens
VGHSFHVHF

SEQ ID NO: 309200 - protein, 9 aa, Homo Sapiens
LRINWNQYK

SEQ ID NO: 309201 - protein, 9 aa, Homo Sapiens
KDNIFMYGC

SEQ ID NO: 309202 - protein, 9 aa, Homo Sapiens
NGQIDSPTG

SEQ ID NO: 309203 - protein, 9 aa, Homo Sapiens
LTVESLEAG

SEQ ID NO: 309204 - protein, 9 aa, Homo Sapiens
DIVFQTAQN

SEQ ID NO: 309205 - protein, 9 aa, Homo Sapiens
GPRTSRQAQ

SEQ ID NO: 309206 - protein, 9 aa, Homo Sapiens
FDLQISTKP

SEQ ID NO: 309207 - protein, 9 aa, Homo Sapiens
SKSSPKIGF

SEQ ID NO: 309208 - protein, 9 aa, Homo Sapiens
VEFSTSFLS

SEQ ID NO: 309209 - protein, 9 aa, Homo Sapiens
YAIGKPGYL

SEQ ID NO: 309210 - protein, 9 aa, Homo Sapiens
CWVDDKVNF

SEQ ID NO: 309211 - protein, 9 aa, Homo Sapiens
SFIHLFIHL

SEQ ID NO: 309212 - protein, 9 aa, Homo Sapiens
YIMNNSFYK

SEQ ID NO: 309213 - protein, 9 aa, Homo Sapiens
PQKSFALGI

SEQ ID NO: 309214 - protein, 9 aa, Homo Sapiens
AVCSQDAGE

SEQ ID NO: 309215 - protein, 9 aa, Homo Sapiens
RRKNGMMDH

SEQ ID NO: 309216 - protein, 9 aa, Homo Sapiens
VLKENYLPK

SEQ ID NO: 309217 - protein, 9 aa, Homo Sapiens
IVHLEDHVF

SEQ ID NO: 309218 - protein, 9 aa, Homo Sapiens
TPDKTDMTP

SEQ ID NO: 309219 - protein, 9 aa, Homo Sapiens
VIEEERRLD

SEQ ID NO: 309220 - protein, 9 aa, Homo Sapiens
LERKRALLS

SEQ ID NO: 309221 - protein, 9 aa, Homo Sapiens
MFTTALLLV

SEQ ID NO: 309222 - protein, 9 aa, Homo Sapiens
FAHEVGHNC

SEQ ID NO: 309223 - protein, 9 aa, Homo Sapiens
LTSDASTEN

SEQ ID NO: 309224 - protein, 9 aa, Homo Sapiens
DMFCKLVEH

SEQ ID NO: 309225 - protein, 9 aa, Homo Sapiens
PSTTSLALS

SEQ ID NO: 309226 - protein, 9 aa, Homo Sapiens
DIKANVTDM

SEQ ID NO: 309227 - protein, 9 aa, Homo Sapiens
IKKNYRYKQ

SEQ ID NO: 309228 - protein, 9 aa, Homo Sapiens
EPCLSNPCT

SEQ ID NO: 309229 - protein, 9 aa, Homo Sapiens
GQGTCFYLG

SEQ ID NO: 309230 - protein, 9 aa, Homo Sapiens
MGGSKGIVE

SEQ ID NO: 309231 - protein, 9 aa, Homo Sapiens
KKIIETMTM

SEQ ID NO: 309232 - protein, 9 aa, Homo Sapiens
VRHQQTHEE

SEQ ID NO: 309233 - protein, 9 aa, Homo Sapiens
TERFDSQPC

SEQ ID NO: 309234 - protein, 9 aa, Homo Sapiens
NNSEVKGAL

SEQ ID NO: 309235 - protein, 9 aa, Homo Sapiens
AQLPVIDNK

SEQ ID NO: 309236 - protein, 9 aa, Homo Sapiens
FQVPHASSQ

SEQ ID NO: 309237 - protein, 9 aa, Homo Sapiens
GAPDVLSPR

SEQ ID NO: 309238 - protein, 9 aa, Homo Sapiens
RSHCHRPHS

SEQ ID NO: 309239 - protein, 9 aa, Homo Sapiens
TITSSLEKL

SEQ ID NO: 309240 - protein, 9 aa, Homo Sapiens
QEEKPNKKK

SEQ ID NO: 309241 - protein, 9 aa, Homo Sapiens
FQEDTLKAK

SEQ ID NO: 309242 - protein, 9 aa, Homo Sapiens
DKPYECAEC

SEQ ID NO: 309243 - protein, 9 aa, Homo Sapiens
KLNENSTPD

SEQ ID NO: 309244 - protein, 9 aa, Homo Sapiens
AEPQELWVD

SEQ ID NO: 309245 - protein, 9 aa, Homo Sapiens
IEALQDKIN

SEQ ID NO: 309246 - protein, 9 aa, Homo Sapiens
WEQSKKLSL

SEQ ID NO: 309247 - protein, 9 aa, Homo Sapiens
TRRMKEKWE

SEQ ID NO: 309248 - protein, 9 aa, Homo Sapiens
IDAVPHVTQ

SEQ ID NO: 309249 - protein, 9 aa, Homo Sapiens
VCYDELFPV

SEQ ID NO: 309250 - protein, 9 aa, Homo Sapiens
SQQSKTVDD

SEQ ID NO: 309251 - protein, 9 aa, Homo Sapiens
LLTLITAAL

SEQ ID NO: 309252 - protein, 9 aa, Homo Sapiens
CETIGVLSP

SEQ ID NO: 309253 - protein, 9 aa, Homo Sapiens
DSHYRENLT

SEQ ID NO: 309254 - protein, 9 aa, Homo Sapiens
VCALFVALL

SEQ ID NO: 309255 - protein, 9 aa, Homo Sapiens
EGNDCPFEI

SEQ ID NO: 309256 - protein, 9 aa, Homo Sapiens
ISVQTSKHL

SEQ ID NO: 309257 - protein, 9 aa, Homo Sapiens
VSGPQLDFD

SEQ ID NO: 309258 - protein, 9 aa, Homo Sapiens
FELFSLPPL

SEQ ID NO: 309259 - protein, 9 aa, Homo Sapiens
YECNKCEKI

SEQ ID NO: 309260 - protein, 9 aa, Homo Sapiens
NNIGWAWWL

SEQ ID NO: 309261 - protein, 9 aa, Homo Sapiens
IGPPMYEME

SEQ ID NO: 309262 - protein, 9 aa, Homo Sapiens
LLKNRLSSY

SEQ ID NO: 309263 - protein, 9 aa, Homo Sapiens
SKPLVDLIY

SEQ ID NO: 309264 - protein, 9 aa, Homo Sapiens
IKALKTIKL

SEQ ID NO: 309265 - protein, 9 aa, Homo Sapiens
KWEKEKHED

SEQ ID NO: 309266 - protein, 9 aa, Homo Sapiens
LHIMKDKWW

SEQ ID NO: 309267 - protein, 9 aa, Homo Sapiens
EILQKAITT

SEQ ID NO: 309268 - protein, 9 aa, Homo Sapiens
TTWQINLKT

SEQ ID NO: 309269 - protein, 9 aa, Homo Sapiens
HSRKDNIFM

SEQ ID NO: 309270 - protein, 9 aa, Homo Sapiens
CELDCDECH

SEQ ID NO: 309271 - protein, 9 aa, Homo Sapiens
ISNGEHHYI

SEQ ID NO: 309272 - protein, 9 aa, Homo Sapiens
GPKPENPAC

SEQ ID NO: 309273 - protein, 9 aa, Homo Sapiens
AENEFVAPK

SEQ ID NO: 309274 - protein, 9 aa, Homo Sapiens
SYGLILSTV

SEQ ID NO: 309275 - protein, 9 aa, Homo Sapiens
KLLNKLDKT

SEQ ID NO: 309276 - protein, 9 aa, Homo Sapiens
HLGTHTKEK

SEQ ID NO: 309277 - protein, 9 aa, Homo Sapiens
CKIRIFIGG

SEQ ID NO: 309278 - protein, 9 aa, Homo Sapiens
GGDDSTCCL

SEQ ID NO: 309279 - protein, 9 aa, Homo Sapiens
AQTFLSEIQ

SEQ ID NO: 309280 - protein, 9 aa, Homo Sapiens
VVTLTAGLG

SEQ ID NO: 309281 - protein, 9 aa, Homo Sapiens
ESFCNASSQ

SEQ ID NO: 309282 - protein, 9 aa, Homo Sapiens
LSNPKIHIK

SEQ ID NO: 309283 - protein, 9 aa, Homo Sapiens
DAYVCIRTT

SEQ ID NO: 309284 - protein, 9 aa, Homo Sapiens
PNKKKILFF

SEQ ID NO: 309285 - protein, 9 aa, Homo Sapiens
LSCPEPACG

SEQ ID NO: 309286 - protein, 9 aa, Homo Sapiens
YSEMDYLEN

SEQ ID NO: 309287 - protein, 9 aa, Homo Sapiens
LNSPEKLYP

SEQ ID NO: 309288 - protein, 9 aa, Homo Sapiens
KLKSIDEHY

SEQ ID NO: 309289 - protein, 9 aa, Homo Sapiens
ARKRLVIRD

SEQ ID NO: 309290 - protein, 9 aa, Homo Sapiens
GCPFSTEDR

SEQ ID NO: 309291 - protein, 9 aa, Homo Sapiens
RIKIHRMDH

SEQ ID NO: 309292 - protein, 9 aa, Homo Sapiens
SLFLINGRH

SEQ ID NO: 309293 - protein, 9 aa, Homo Sapiens
PNSSSLKSR

SEQ ID NO: 309294 - protein, 9 aa, Homo Sapiens
LMAQHLIDT

SEQ ID NO: 309295 - protein, 9 aa, Homo Sapiens
FMPAERCLP

SEQ ID NO: 309296 - protein, 9 aa, Homo Sapiens
QNVLELEIK

SEQ ID NO: 309297 - protein, 9 aa, Homo Sapiens
IGADDKKEE

SEQ ID NO: 309298 - protein, 9 aa, Homo Sapiens
LMLYFIVKD

SEQ ID NO: 309299 - protein, 9 aa, Homo Sapiens
EIQVMQIMS

SEQ ID NO: 309300 - protein, 9 aa, Homo Sapiens
TTHQISHTG

SEQ ID NO: 309301 - protein, 9 aa, Homo Sapiens
HQEAKKADN

SEQ ID NO: 309302 - protein, 9 aa, Homo Sapiens
EVLPRNIAL

SEQ ID NO: 309303 - protein, 9 aa, Homo Sapiens
VFQGNKIIH

SEQ ID NO: 309304 - protein, 9 aa, Homo Sapiens
PDLERVTSL

SEQ ID NO: 309305 - protein, 9 aa, Homo Sapiens
VSLNKGDFY

SEQ ID NO: 309306 - protein, 9 aa, Homo Sapiens
KGSHKRAIS

SEQ ID NO: 309307 - protein, 9 aa, Homo Sapiens
TNHVQVIVE

SEQ ID NO: 309308 - protein, 9 aa, Homo Sapiens
PSTRYSRRT

SEQ ID NO: 309309 - protein, 9 aa, Homo Sapiens
RNMAGLVKL

SEQ ID NO: 309310 - protein, 9 aa, Homo Sapiens
RRAPERQMR

SEQ ID NO: 309311 - protein, 9 aa, Homo Sapiens
ILWQTLQAL

SEQ ID NO: 309312 - protein, 9 aa, Homo Sapiens
SKEIQKLAE

SEQ ID NO: 309313 - protein, 9 aa, Homo Sapiens
RLYPSGTYD

SEQ ID NO: 309314 - protein, 9 aa, Homo Sapiens
REEVYFFSA

SEQ ID NO: 309315 - protein, 9 aa, Homo Sapiens
KGPSSKKRG

SEQ ID NO: 309316 - protein, 9 aa, Homo Sapiens
RFHTGNTSF

SEQ ID NO: 309317 - protein, 9 aa, Homo Sapiens
KAFLDKKKY

SEQ ID NO: 309318 - protein, 9 aa, Homo Sapiens
GHFYLQSSQ

SEQ ID NO: 309319 - protein, 9 aa, Homo Sapiens
VLAPDKVDS

SEQ ID NO: 309320 - protein, 9 aa, Homo Sapiens
EAGKASEAR

SEQ ID NO: 309321 - protein, 9 aa, Homo Sapiens
NDALVYTFR

SEQ ID NO: 309322 - protein, 9 aa, Homo Sapiens
SQENHLGKQ

SEQ ID NO: 309323 - protein, 9 aa, Homo Sapiens
CATSPTGAS

SEQ ID NO: 309324 - protein, 9 aa, Homo Sapiens
TGGQPHHPE

SEQ ID NO: 309325 - protein, 9 aa, Homo Sapiens
ERKRKNMPA

SEQ ID NO: 309326 - protein, 9 aa, Homo Sapiens
DFPYHLQGK

SEQ ID NO: 309327 - protein, 9 aa, Homo Sapiens
HIQNEQVRQ

SEQ ID NO: 309328 - protein, 9 aa, Homo Sapiens
LPNYSIKNQ

SEQ ID NO: 309329 - protein, 9 aa, Homo Sapiens
MLESSLADF

SEQ ID NO: 309330 - protein, 9 aa, Homo Sapiens
KTGNVSRAV

SEQ ID NO: 309331 - protein, 9 aa, Homo Sapiens
EVSIMYPGA

SEQ ID NO: 309332 - protein, 9 aa, Homo Sapiens
VQNENCEEI

SEQ ID NO: 309333 - protein, 9 aa, Homo Sapiens
RQPYRVKAI

SEQ ID NO: 309334 - protein, 9 aa, Homo Sapiens
NLKMLLENV

SEQ ID NO: 309335 - protein, 9 aa, Homo Sapiens
YLRAQIAQI

SEQ ID NO: 309336 - protein, 9 aa, Homo Sapiens
PEEVCAVLE

SEQ ID NO: 309337 - protein, 9 aa, Homo Sapiens
PEIIGKMSF

SEQ ID NO: 309338 - protein, 9 aa, Homo Sapiens
HYKIILTPQ

SEQ ID NO: 309339 - protein, 9 aa, Homo Sapiens
LLFKDAIRR

SEQ ID NO: 309340 - protein, 9 aa, Homo Sapiens
EKENLRSKL

SEQ ID NO: 309341 - protein, 9 aa, Homo Sapiens
MRLSQKVLQ

SEQ ID NO: 309342 - protein, 9 aa, Homo Sapiens
AKDHCMKLM

SEQ ID NO: 309343 - protein, 9 aa, Homo Sapiens
VCPDKQDVR

SEQ ID NO: 309344 - protein, 9 aa, Homo Sapiens
NCILLSIFA

SEQ ID NO: 309345 - protein, 9 aa, Homo Sapiens
SSGYCIDQL

SEQ ID NO: 309346 - protein, 9 aa, Homo Sapiens
TIIKEKKTS

SEQ ID NO: 309347 - protein, 9 aa, Homo Sapiens
SPQMNNFNI

SEQ ID NO: 309348 - protein, 9 aa, Homo Sapiens
VKMTESSLP

SEQ ID NO: 309349 - protein, 9 aa, Homo Sapiens
SHNQFLRCY

SEQ ID NO: 309350 - protein, 9 aa, Homo Sapiens
QHEAFIQSI

SEQ ID NO: 309351 - protein, 9 aa, Homo Sapiens
ALGKFPFAK

SEQ ID NO: 309352 - protein, 9 aa, Homo Sapiens
ETVYNNRGE

SEQ ID NO: 309353 - protein, 9 aa, Homo Sapiens
EDATYVNNP

SEQ ID NO: 309354 - protein, 9 aa, Homo Sapiens
NTFCDVTVL

SEQ ID NO: 309355 - protein, 9 aa, Homo Sapiens
SSGNNLERF

SEQ ID NO: 309356 - protein, 9 aa, Homo Sapiens
VSQPSHPLK

SEQ ID NO: 309357 - protein, 9 aa, Homo Sapiens
YKTEDGEAL

SEQ ID NO: 309358 - protein, 9 aa, Homo Sapiens
FIYESSSIY

SEQ ID NO: 309359 - protein, 9 aa, Homo Sapiens
VDGAWMEWS

SEQ ID NO: 309360 - protein, 9 aa, Homo Sapiens
TEKALKTTL

SEQ ID NO: 309361 - protein, 9 aa, Homo Sapiens
RTQDDIIEF

SEQ ID NO: 309362 - protein, 9 aa, Homo Sapiens
RVYVSVDLC

SEQ ID NO: 309363 - protein, 9 aa, Homo Sapiens
YTEEDDVNN

SEQ ID NO: 309364 - protein, 9 aa, Homo Sapiens
EQSVPFKYV

SEQ ID NO: 309365 - protein, 9 aa, Homo Sapiens
QGFINYLDE

SEQ ID NO: 309366 - protein, 9 aa, Homo Sapiens
EHEKTNDTL

SEQ ID NO: 309367 - protein, 9 aa, Homo Sapiens
RAVEFSTSF

SEQ ID NO: 309368 - protein, 9 aa, Homo Sapiens
TTPVLPEEA

SEQ ID NO: 309369 - protein, 9 aa, Homo Sapiens
KLSFTPPFN

SEQ ID NO: 309370 - protein, 9 aa, Homo Sapiens
RTLPTASVI

SEQ ID NO: 309371 - protein, 9 aa, Homo Sapiens
ECGKAFYRL

SEQ ID NO: 309372 - protein, 9 aa, Homo Sapiens
GGNYAVKLV

SEQ ID NO: 309373 - protein, 9 aa, Homo Sapiens
ILVRNVSLN

SEQ ID NO: 309374 - protein, 9 aa, Homo Sapiens
GFIVFGSQV

SEQ ID NO: 309375 - protein, 9 aa, Homo Sapiens
QQKEVEHNS

SEQ ID NO: 309376 - protein, 9 aa, Homo Sapiens
GCAVATEYM

SEQ ID NO: 309377 - protein, 9 aa, Homo Sapiens
LHGLCTSQH

SEQ ID NO: 309378 - protein, 9 aa, Homo Sapiens
STVMFEIMK

SEQ ID NO: 309379 - protein, 9 aa, Homo Sapiens
MLLKEFLRA

SEQ ID NO: 309380 - protein, 9 aa, Homo Sapiens
PLPLHPVLG

SEQ ID NO: 309381 - protein, 9 aa, Homo Sapiens
EHIIYQMDD

SEQ ID NO: 309382 - protein, 9 aa, Homo Sapiens
GSSSEIILP

SEQ ID NO: 309383 - protein, 9 aa, Homo Sapiens
RRSPQKLPT

SEQ ID NO: 309384 - protein, 9 aa, Homo Sapiens
GGLMTWAAK

SEQ ID NO: 309385 - protein, 9 aa, Homo Sapiens
IKECYYLTC

SEQ ID NO: 309386 - protein, 9 aa, Homo Sapiens
MFDSDWNPQ

SEQ ID NO: 309387 - protein, 9 aa, Homo Sapiens
DGRQLFSSV

SEQ ID NO: 309388 - protein, 9 aa, Homo Sapiens
PGVQGIMGK

SEQ ID NO: 309389 - protein, 9 aa, Homo Sapiens
PRNSRLLEE

SEQ ID NO: 309390 - protein, 9 aa, Homo Sapiens
FICDVSRQE

SEQ ID NO: 309391 - protein, 9 aa, Homo Sapiens
TWLKLNTKV

SEQ ID NO: 309392 - protein, 9 aa, Homo Sapiens
FSDTFNHLI

SEQ ID NO: 309393 - protein, 9 aa, Homo Sapiens
PWKLILSTS

SEQ ID NO: 309394 - protein, 9 aa, Homo Sapiens
DQPIIVEVK

SEQ ID NO: 309395 - protein, 9 aa, Homo Sapiens
MDYHVTIRK

SEQ ID NO: 309396 - protein, 9 aa, Homo Sapiens
IGLLLNKSL

SEQ ID NO: 309397 - protein, 9 aa, Homo Sapiens
RNKRVFKTK

SEQ ID NO: 309398 - protein, 9 aa, Homo Sapiens
VIKSILWQT

SEQ ID NO: 309399 - protein, 9 aa, Homo Sapiens
TEKENLRSK

SEQ ID NO: 309400 - protein, 9 aa, Homo Sapiens
AQISAGTHV

SEQ ID NO: 309401 - protein, 9 aa, Homo Sapiens
SSNVSNKYS

SEQ ID NO: 309402 - protein, 9 aa, Homo Sapiens
RTETSLTET

SEQ ID NO: 309403 - protein, 9 aa, Homo Sapiens
KEYPQLEQR

SEQ ID NO: 309404 - protein, 9 aa, Homo Sapiens
PFKGRISWA

SEQ ID NO: 309405 - protein, 9 aa, Homo Sapiens
RFAFFAGPS

SEQ ID NO: 309406 - protein, 9 aa, Homo Sapiens
FKTAVKKLN

SEQ ID NO: 309407 - protein, 9 aa, Homo Sapiens
VQLHVDQLS

SEQ ID NO: 309408 - protein, 9 aa, Homo Sapiens
DGYYLSYVK

SEQ ID NO: 309409 - protein, 9 aa, Homo Sapiens
ALDAIFKPE

SEQ ID NO: 309410 - protein, 9 aa, Homo Sapiens
HGSETIVIT

SEQ ID NO: 309411 - protein, 9 aa, Homo Sapiens
CRGREDYSP

SEQ ID NO: 309412 - protein, 9 aa, Homo Sapiens
FVCDKHKII

SEQ ID NO: 309413 - protein, 9 aa, Homo Sapiens
HFSFTAEQY

SEQ ID NO: 309414 - protein, 9 aa, Homo Sapiens
EPNVLPFRG

SEQ ID NO: 309415 - protein, 9 aa, Homo Sapiens
PSQTCRPDQ

SEQ ID NO: 309416 - protein, 9 aa, Homo Sapiens
PMVPFKTKY

SEQ ID NO: 309417 - protein, 9 aa, Homo Sapiens
KSNNQLNKF

SEQ ID NO: 309418 - protein, 9 aa, Homo Sapiens
KNFYSISAA

SEQ ID NO: 309419 - protein, 9 aa, Homo Sapiens
VEKLVKEQG

SEQ ID NO: 309420 - protein, 9 aa, Homo Sapiens
SADDEELTD

SEQ ID NO: 309421 - protein, 9 aa, Homo Sapiens
IVVDWNRGA

SEQ ID NO: 309422 - protein, 9 aa, Homo Sapiens
DSGRYWASP

SEQ ID NO: 309423 - protein, 9 aa, Homo Sapiens
QIAQISAGT

SEQ ID NO: 309424 - protein, 9 aa, Homo Sapiens
FTLLNKHGP

SEQ ID NO: 309425 - protein, 9 aa, Homo Sapiens
PDLLLDALE

SEQ ID NO: 309426 - protein, 9 aa, Homo Sapiens
SNKACLRGG

SEQ ID NO: 309427 - protein, 9 aa, Homo Sapiens
SIPKDTWYD

SEQ ID NO: 309428 - protein, 9 aa, Homo Sapiens
PYIQLGSSI

SEQ ID NO: 309429 - protein, 9 aa, Homo Sapiens
YLRLKRAVA

SEQ ID NO: 309430 - protein, 9 aa, Homo Sapiens
GAKNIERVY

SEQ ID NO: 309431 - protein, 9 aa, Homo Sapiens
HQIPALLGN

SEQ ID NO: 309432 - protein, 9 aa, Homo Sapiens
RNLHPASLT

SEQ ID NO: 309433 - protein, 9 aa, Homo Sapiens
LSIPCVLGW

SEQ ID NO: 309434 - protein, 9 aa, Homo Sapiens
REKERDFQN

SEQ ID NO: 309435 - protein, 9 aa, Homo Sapiens
RRQGEDFML

SEQ ID NO: 309436 - protein, 9 aa, Homo Sapiens
PCCTHYLPI

SEQ ID NO: 309437 - protein, 9 aa, Homo Sapiens
KQCSRMYGA

SEQ ID NO: 309438 - protein, 9 aa, Homo Sapiens
LTVVKKRDR

SEQ ID NO: 309439 - protein, 9 aa, Homo Sapiens
FLYSLQFSV

SEQ ID NO: 309440 - protein, 9 aa, Homo Sapiens
CDTQMIDDM

SEQ ID NO: 309441 - protein, 9 aa, Homo Sapiens
LRVPTAGPE

SEQ ID NO: 309442 - protein, 9 aa, Homo Sapiens
IILKEVEYC

SEQ ID NO: 309443 - protein, 9 aa, Homo Sapiens
TIFTESLQP

SEQ ID NO: 309444 - protein, 9 aa, Homo Sapiens
QPLSSPGVN

SEQ ID NO: 309445 - protein, 9 aa, Homo Sapiens
KMKEKWENY

SEQ ID NO: 309446 - protein, 9 aa, Homo Sapiens
SAIKRNARI

SEQ ID NO: 309447 - protein, 9 aa, Homo Sapiens
SKIATTYSS

SEQ ID NO: 309448 - protein, 9 aa, Homo Sapiens
ISFCGYHPN

SEQ ID NO: 309449 - protein, 9 aa, Homo Sapiens
SPFTTEAEL

SEQ ID NO: 309450 - protein, 9 aa, Homo Sapiens
NKKKKAQED

SEQ ID NO: 309451 - protein, 9 aa, Homo Sapiens
THIMNSTCA

SEQ ID NO: 309452 - protein, 9 aa, Homo Sapiens
DNMNKLQTF

SEQ ID NO: 309453 - protein, 9 aa, Homo Sapiens
EGPTQKLLL

SEQ ID NO: 309454 - protein, 9 aa, Homo Sapiens
KIIFCDLRL

SEQ ID NO: 309455 - protein, 9 aa, Homo Sapiens
LSLFVRDGT

SEQ ID NO: 309456 - protein, 9 aa, Homo Sapiens
PVLPEEAQE

SEQ ID NO: 309457 - protein, 9 aa, Homo Sapiens
VKDSLIKLK

SEQ ID NO: 309458 - protein, 9 aa, Homo Sapiens
YSNTVQGQL

SEQ ID NO: 309459 - protein, 9 aa, Homo Sapiens
LGNNRISKT

SEQ ID NO: 309460 - protein, 9 aa, Homo Sapiens
NAAVFRVGS

SEQ ID NO: 309461 - protein, 9 aa, Homo Sapiens
EVGYIVSVI

SEQ ID NO: 309462 - protein, 9 aa, Homo Sapiens
SVDCRVSSP

SEQ ID NO: 309463 - protein, 9 aa, Homo Sapiens
GASKFLLLA

SEQ ID NO: 309464 - protein, 9 aa, Homo Sapiens
GVAKMDPII

SEQ ID NO: 309465 - protein, 9 aa, Homo Sapiens
SGPGGIALE

SEQ ID NO: 309466 - protein, 9 aa, Homo Sapiens
TVDAVLQEK

SEQ ID NO: 309467 - protein, 9 aa, Homo Sapiens
ETMLDFQTS

SEQ ID NO: 309468 - protein, 9 aa, Homo Sapiens
FGESTLLSL

SEQ ID NO: 309469 - protein, 9 aa, Homo Sapiens
GYNVISHLY

SEQ ID NO: 309470 - protein, 9 aa, Homo Sapiens
PKVIGSVVM

SEQ ID NO: 309471 - protein, 9 aa, Homo Sapiens
LVYLHTLTS

SEQ ID NO: 309472 - protein, 9 aa, Homo Sapiens
DYFQASGYS

SEQ ID NO: 309473 - protein, 9 aa, Homo Sapiens
TVYHLHPSG

SEQ ID NO: 309474 - protein, 9 aa, Homo Sapiens
NKTDKTKKI

SEQ ID NO: 309475 - protein, 9 aa, Homo Sapiens
VCKLQWCIM

SEQ ID NO: 309476 - protein, 9 aa, Homo Sapiens
LTIMAYDHY

SEQ ID NO: 309477 - protein, 9 aa, Homo Sapiens
FGKHILQNT

SEQ ID NO: 309478 - protein, 9 aa, Homo Sapiens
PLLPGFKRL

SEQ ID NO: 309479 - protein, 9 aa, Homo Sapiens
FYKEFMADL

SEQ ID NO: 309480 - protein, 9 aa, Homo Sapiens
KVAVSLPSV

SEQ ID NO: 309481 - protein, 9 aa, Homo Sapiens
LSQERVAEL

SEQ ID NO: 309482 - protein, 9 aa, Homo Sapiens
ALAQIPQKG

SEQ ID NO: 309483 - protein, 9 aa, Homo Sapiens
ENQVNSRPM

SEQ ID NO: 309484 - protein, 9 aa, Homo Sapiens
LGKSTPLKP

SEQ ID NO: 309485 - protein, 9 aa, Homo Sapiens
KLTLDYLKE

SEQ ID NO: 309486 - protein, 9 aa, Homo Sapiens
NNFSEIVVV

SEQ ID NO: 309487 - protein, 9 aa, Homo Sapiens
TVSFGTKLN

SEQ ID NO: 309488 - protein, 9 aa, Homo Sapiens
ASRSWKLIL

SEQ ID NO: 309489 - protein, 9 aa, Homo Sapiens
AKIQEDDLN

SEQ ID NO: 309490 - protein, 9 aa, Homo Sapiens
GECNNTVGS

SEQ ID NO: 309491 - protein, 9 aa, Homo Sapiens
RTKHKKHFK

SEQ ID NO: 309492 - protein, 9 aa, Homo Sapiens
HVKVKYIND

SEQ ID NO: 309493 - protein, 9 aa, Homo Sapiens
HLITHQRIH

SEQ ID NO: 309494 - protein, 9 aa, Homo Sapiens
ISWLYRILP

SEQ ID NO: 309495 - protein, 9 aa, Homo Sapiens
IIHRGEKPY

SEQ ID NO: 309496 - protein, 9 aa, Homo Sapiens
VKIHLKVLE

SEQ ID NO: 309497 - protein, 9 aa, Homo Sapiens
FYSAPVPPN

SEQ ID NO: 309498 - protein, 9 aa, Homo Sapiens
DVAVEIIAV

SEQ ID NO: 309499 - protein, 9 aa, Homo Sapiens
KVMDVHKVN

SEQ ID NO: 309500 - protein, 9 aa, Homo Sapiens
EFWDGKIML

SEQ ID NO: 309501 - protein, 9 aa, Homo Sapiens
ILLQRIEDF

SEQ ID NO: 309502 - protein, 9 aa, Homo Sapiens
MSVEDFLYG

SEQ ID NO: 309503 - protein, 9 aa, Homo Sapiens
MGRNRYWGT

SEQ ID NO: 309504 - protein, 9 aa, Homo Sapiens
KGLTLKSSM

SEQ ID NO: 309505 - protein, 9 aa, Homo Sapiens
TQWEPPVRA

SEQ ID NO: 309506 - protein, 9 aa, Homo Sapiens
SHSNKVLHF

SEQ ID NO: 309507 - protein, 9 aa, Homo Sapiens
RDPALKIKT

SEQ ID NO: 309508 - protein, 9 aa, Homo Sapiens
YFLSSLLGT

SEQ ID NO: 309509 - protein, 9 aa, Homo Sapiens
EIKTKKKLL

SEQ ID NO: 309510 - protein, 9 aa, Homo Sapiens
YSSQLEDII

SEQ ID NO: 309511 - protein, 9 aa, Homo Sapiens
KLVILELRI

SEQ ID NO: 309512 - protein, 9 aa, Homo Sapiens
RSKNNNSLS

SEQ ID NO: 309513 - protein, 9 aa, Homo Sapiens
ADVKGGSFP

SEQ ID NO: 309514 - protein, 9 aa, Homo Sapiens
SIFDFPYHL

SEQ ID NO: 309515 - protein, 9 aa, Homo Sapiens
VPNYFSPQT

SEQ ID NO: 309516 - protein, 9 aa, Homo Sapiens
FVKLFDPKY

SEQ ID NO: 309517 - protein, 9 aa, Homo Sapiens
SNYQGSIHK

SEQ ID NO: 309518 - protein, 9 aa, Homo Sapiens
FAGQIEENY

SEQ ID NO: 309519 - protein, 9 aa, Homo Sapiens
HLMKAFLDK

SEQ ID NO: 309520 - protein, 9 aa, Homo Sapiens
PSQNVPRES

SEQ ID NO: 309521 - protein, 9 aa, Homo Sapiens
RQMEEVVGS

SEQ ID NO: 309522 - protein, 9 aa, Homo Sapiens
HAWTHILRE

SEQ ID NO: 309523 - protein, 9 aa, Homo Sapiens
ALPHGQLVN

SEQ ID NO: 309524 - protein, 9 aa, Homo Sapiens
SGLSGTTDF

SEQ ID NO: 309525 - protein, 9 aa, Homo Sapiens
EHQRITDHY

SEQ ID NO: 309526 - protein, 9 aa, Homo Sapiens
QVMLSLASH

SEQ ID NO: 309527 - protein, 9 aa, Homo Sapiens
DVLCSAAKF

SEQ ID NO: 309528 - protein, 9 aa, Homo Sapiens
SITEHCIKQ

SEQ ID NO: 309529 - protein, 9 aa, Homo Sapiens
ANYILFRAR

SEQ ID NO: 309530 - protein, 9 aa, Homo Sapiens
EWYSSIFAF

SEQ ID NO: 309531 - protein, 9 aa, Homo Sapiens
PINQAFVVN

SEQ ID NO: 309532 - protein, 9 aa, Homo Sapiens
DAQFGTVIT

SEQ ID NO: 309533 - protein, 9 aa, Homo Sapiens
LLFTAKVLY

SEQ ID NO: 309534 - protein, 9 aa, Homo Sapiens
KALFEVLAH

SEQ ID NO: 309535 - protein, 9 aa, Homo Sapiens
SDSEAQSHS

SEQ ID NO: 309536 - protein, 9 aa, Homo Sapiens
DGYEWDHVR

SEQ ID NO: 309537 - protein, 9 aa, Homo Sapiens
LYFASLNKS

SEQ ID NO: 309538 - protein, 9 aa, Homo Sapiens
LVCKSGSIF

SEQ ID NO: 309539 - protein, 9 aa, Homo Sapiens
NLSALLYLL

SEQ ID NO: 309540 - protein, 9 aa, Homo Sapiens
RLRVYLERV

SEQ ID NO: 309541 - protein, 9 aa, Homo Sapiens
KKKMTEGSV

SEQ ID NO: 309542 - protein, 9 aa, Homo Sapiens
QWRVFAGAV

SEQ ID NO: 309543 - protein, 9 aa, Homo Sapiens
PYGPGIIQS

SEQ ID NO: 309544 - protein, 9 aa, Homo Sapiens
SSSGRDNVS

SEQ ID NO: 309545 - protein, 9 aa, Homo Sapiens
NYRYKQDEL

SEQ ID NO: 309546 - protein, 9 aa, Homo Sapiens
LNGQEVRRT

SEQ ID NO: 309547 - protein, 9 aa, Homo Sapiens
VSVSHGSET

SEQ ID NO: 309548 - protein, 9 aa, Homo Sapiens
NNSVSYEYG

SEQ ID NO: 309549 - protein, 9 aa, Homo Sapiens
QLVNQQMVM

SEQ ID NO: 309550 - protein, 9 aa, Homo Sapiens
QYIMNNSFY

SEQ ID NO: 309551 - protein, 9 aa, Homo Sapiens
FKKLHLVNC

SEQ ID NO: 309552 - protein, 9 aa, Homo Sapiens
GYEWDHVRQ

SEQ ID NO: 309553 - protein, 9 aa, Homo Sapiens
EELIFQYLP

SEQ ID NO: 309554 - protein, 9 aa, Homo Sapiens
PTSWGCFDA

SEQ ID NO: 309555 - protein, 9 aa, Homo Sapiens
RLPCTVARL

SEQ ID NO: 309556 - protein, 9 aa, Homo Sapiens
AASENEDNY

SEQ ID NO: 309557 - protein, 9 aa, Homo Sapiens
TTALLLVFF

SEQ ID NO: 309558 - protein, 9 aa, Homo Sapiens
NYPKNMETS

SEQ ID NO: 309559 - protein, 9 aa, Homo Sapiens
VMTMAASLL

SEQ ID NO: 309560 - protein, 9 aa, Homo Sapiens
MKTNYIFCN

SEQ ID NO: 309561 - protein, 9 aa, Homo Sapiens
ECTCYRASQ

SEQ ID NO: 309562 - protein, 9 aa, Homo Sapiens
NHMRSEDDD

SEQ ID NO: 309563 - protein, 9 aa, Homo Sapiens
VKKAIEYLE

SEQ ID NO: 309564 - protein, 9 aa, Homo Sapiens
PGCTLNKNI

SEQ ID NO: 309565 - protein, 9 aa, Homo Sapiens
KHREQHHPE

SEQ ID NO: 309566 - protein, 9 aa, Homo Sapiens
TALLNVCMD

SEQ ID NO: 309567 - protein, 9 aa, Homo Sapiens
NNNLQEALI

SEQ ID NO: 309568 - protein, 9 aa, Homo Sapiens
LLPFATGKH

SEQ ID NO: 309569 - protein, 9 aa, Homo Sapiens
AKMDPIISK

SEQ ID NO: 309570 - protein, 9 aa, Homo Sapiens
KEFELCIYV

SEQ ID NO: 309571 - protein, 9 aa, Homo Sapiens
VKLTVTISV

SEQ ID NO: 309572 - protein, 9 aa, Homo Sapiens
RVLGTHKLT

SEQ ID NO: 309573 - protein, 9 aa, Homo Sapiens
SRRVSEDGQ

SEQ ID NO: 309574 - protein, 9 aa, Homo Sapiens
SAFKIFLKY

SEQ ID NO: 309575 - protein, 9 aa, Homo Sapiens
MLVNLCSFR

SEQ ID NO: 309576 - protein, 9 aa, Homo Sapiens
GIRAVLIDK

SEQ ID NO: 309577 - protein, 9 aa, Homo Sapiens
PPWKLILST

SEQ ID NO: 309578 - protein, 9 aa, Homo Sapiens
LFTVSPENG

SEQ ID NO: 309579 - protein, 9 aa, Homo Sapiens
GCNTMFLSV

SEQ ID NO: 309580 - protein, 9 aa, Homo Sapiens
GGSKGIVES

SEQ ID NO: 309581 - protein, 9 aa, Homo Sapiens
ELFLPVPTD

SEQ ID NO: 309582 - protein, 9 aa, Homo Sapiens
FEIPLMLIG

SEQ ID NO: 309583 - protein, 9 aa, Homo Sapiens
GQDMLFVFP

SEQ ID NO: 309584 - protein, 9 aa, Homo Sapiens
KHRGRNLRR

SEQ ID NO: 309585 - protein, 9 aa, Homo Sapiens
ASSIFFRII

SEQ ID NO: 309586 - protein, 9 aa, Homo Sapiens
DLDIGTDGE

SEQ ID NO: 309587 - protein, 9 aa, Homo Sapiens
SQKQKEVLL

SEQ ID NO: 309588 - protein, 9 aa, Homo Sapiens
VKFRFDCGS

SEQ ID NO: 309589 - protein, 9 aa, Homo Sapiens
AAKFVDIID

SEQ ID NO: 309590 - protein, 9 aa, Homo Sapiens
DILIMELNN

SEQ ID NO: 309591 - protein, 9 aa, Homo Sapiens
YDPAKIITL

SEQ ID NO: 309592 - protein, 9 aa, Homo Sapiens
LQADMLIIR

SEQ ID NO: 309593 - protein, 9 aa, Homo Sapiens
MPRVFVFCA

SEQ ID NO: 309594 - protein, 9 aa, Homo Sapiens
PVIDNKVCN

SEQ ID NO: 309595 - protein, 9 aa, Homo Sapiens
LKLDYLEPR

SEQ ID NO: 309596 - protein, 9 aa, Homo Sapiens
WEFWKLPSS

SEQ ID NO: 309597 - protein, 9 aa, Homo Sapiens
GCSRKIALQ

SEQ ID NO: 309598 - protein, 9 aa, Homo Sapiens
KGLILNIYS

SEQ ID NO: 309599 - protein, 9 aa, Homo Sapiens
VKYGKQKTY

SEQ ID NO: 309600 - protein, 9 aa, Homo Sapiens
IRFTCSENQ

SEQ ID NO: 309601 - protein, 9 aa, Homo Sapiens
TKEREKEGR

SEQ ID NO: 309602 - protein, 9 aa, Homo Sapiens
TPVCDRKYF

SEQ ID NO: 309603 - protein, 9 aa, Homo Sapiens
SHPQQTQTL

SEQ ID NO: 309604 - protein, 9 aa, Homo Sapiens
VLNIQFGLV

SEQ ID NO: 309605 - protein, 9 aa, Homo Sapiens
RMFPLLSFN

SEQ ID NO: 309606 - protein, 9 aa, Homo Sapiens
IETTAPGVD

SEQ ID NO: 309607 - protein, 9 aa, Homo Sapiens
WENYKVVAM

SEQ ID NO: 309608 - protein, 9 aa, Homo Sapiens
ELLIHNNVL

SEQ ID NO: 309609 - protein, 9 aa, Homo Sapiens
QKSLQIAAL

SEQ ID NO: 309610 - protein, 9 aa, Homo Sapiens
EFHRTMLTF

SEQ ID NO: 309611 - protein, 9 aa, Homo Sapiens
CCVGKIPED

SEQ ID NO: 309612 - protein, 9 aa, Homo Sapiens
DVTFSRKGL

SEQ ID NO: 309613 - protein, 9 aa, Homo Sapiens
KVKKEMILA

SEQ ID NO: 309614 - protein, 9 aa, Homo Sapiens
DGGDNNAPI

SEQ ID NO: 309615 - protein, 9 aa, Homo Sapiens
ISRSPSGSP

SEQ ID NO: 309616 - protein, 9 aa, Homo Sapiens
KKDTSRPYK

SEQ ID NO: 309617 - protein, 9 aa, Homo Sapiens
RYFISLLPK

SEQ ID NO: 309618 - protein, 9 aa, Homo Sapiens
AAAAYYPCE

SEQ ID NO: 309619 - protein, 9 aa, Homo Sapiens
ELREEQIIH

SEQ ID NO: 309620 - protein, 9 aa, Homo Sapiens
TLIQHKITH

SEQ ID NO: 309621 - protein, 9 aa, Homo Sapiens
CMQESMAQY

SEQ ID NO: 309622 - protein, 9 aa, Homo Sapiens
FLHSLVQFI

SEQ ID NO: 309623 - protein, 9 aa, Homo Sapiens
KINKRNKSL

SEQ ID NO: 309624 - protein, 9 aa, Homo Sapiens
TKKNKKAKK

SEQ ID NO: 309625 - protein, 9 aa, Homo Sapiens
SVDYLVEKL

SEQ ID NO: 309626 - protein, 9 aa, Homo Sapiens
CYQFGGQEQ

SEQ ID NO: 309627 - protein, 9 aa, Homo Sapiens
LEESTEKAV

SEQ ID NO: 309628 - protein, 9 aa, Homo Sapiens
HYGVKRTEL

SEQ ID NO: 309629 - protein, 9 aa, Homo Sapiens
KQTQKGNSN

SEQ ID NO: 309630 - protein, 9 aa, Homo Sapiens
EDFNVQEEA

SEQ ID NO: 309631 - protein, 9 aa, Homo Sapiens
RESICHLTL

SEQ ID NO: 309632 - protein, 9 aa, Homo Sapiens
GDKPYRSSV

SEQ ID NO: 309633 - protein, 9 aa, Homo Sapiens
KKVLSFLLN

SEQ ID NO: 309634 - protein, 9 aa, Homo Sapiens
IEFYQEEWT

SEQ ID NO: 309635 - protein, 9 aa, Homo Sapiens
FICQEKEQE

SEQ ID NO: 309636 - protein, 9 aa, Homo Sapiens
YGYLQVKKV

SEQ ID NO: 309637 - protein, 9 aa, Homo Sapiens
LAQSPHVSD

SEQ ID NO: 309638 - protein, 9 aa, Homo Sapiens
AVSHKAPTF

SEQ ID NO: 309639 - protein, 9 aa, Homo Sapiens
DKEFPQVVH

SEQ ID NO: 309640 - protein, 9 aa, Homo Sapiens
MNKLAEERR

SEQ ID NO: 309641 - protein, 9 aa, Homo Sapiens
GQLKYSVPE

SEQ ID NO: 309642 - protein, 9 aa, Homo Sapiens
IEDIKDKAN

SEQ ID NO: 309643 - protein, 9 aa, Homo Sapiens
KGPIAKFVD

SEQ ID NO: 309644 - protein, 9 aa, Homo Sapiens
NYSEMDYLE

SEQ ID NO: 309645 - protein, 9 aa, Homo Sapiens
TEKVGSVCL

SEQ ID NO: 309646 - protein, 9 aa, Homo Sapiens
QEIIRREKE

SEQ ID NO: 309647 - protein, 9 aa, Homo Sapiens
TVVKFNPQI

SEQ ID NO: 309648 - protein, 9 aa, Homo Sapiens
TSKKGVKRK

SEQ ID NO: 309649 - protein, 9 aa, Homo Sapiens
EIDILIIGS

SEQ ID NO: 309650 - protein, 9 aa, Homo Sapiens
GQNNVDSSP

SEQ ID NO: 309651 - protein, 9 aa, Homo Sapiens
RNAPPCKLF

SEQ ID NO: 309652 - protein, 9 aa, Homo Sapiens
SADGRKKTF

SEQ ID NO: 309653 - protein, 9 aa, Homo Sapiens
VGFMVYKLL

SEQ ID NO: 309654 - protein, 9 aa, Homo Sapiens
LNFEVIPPP

SEQ ID NO: 309655 - protein, 9 aa, Homo Sapiens
SERVWTITS

SEQ ID NO: 309656 - protein, 9 aa, Homo Sapiens
HLGSSDPST

SEQ ID NO: 309657 - protein, 9 aa, Homo Sapiens
VKQRFEDKC

SEQ ID NO: 309658 - protein, 9 aa, Homo Sapiens
ERYVAKHRL

SEQ ID NO: 309659 - protein, 9 aa, Homo Sapiens
VSHGSETIV

SEQ ID NO: 309660 - protein, 9 aa, Homo Sapiens
LLSVDYLVE

SEQ ID NO: 309661 - protein, 9 aa, Homo Sapiens
EKITACSSS

SEQ ID NO: 309662 - protein, 9 aa, Homo Sapiens
EELRQTLMP

SEQ ID NO: 309663 - protein, 9 aa, Homo Sapiens
EEKYFDNWC

SEQ ID NO: 309664 - protein, 9 aa, Homo Sapiens
TTIIKKNGD

SEQ ID NO: 309665 - protein, 9 aa, Homo Sapiens
PANPIPVIN

SEQ ID NO: 309666 - protein, 9 aa, Homo Sapiens
TCCLVSGNL

SEQ ID NO: 309667 - protein, 9 aa, Homo Sapiens
DPSFFQRDA

SEQ ID NO: 309668 - protein, 9 aa, Homo Sapiens
GMMDHEDFR

SEQ ID NO: 309669 - protein, 9 aa, Homo Sapiens
NKIKFGEYV

SEQ ID NO: 309670 - protein, 9 aa, Homo Sapiens
VEDSLASGY

SEQ ID NO: 309671 - protein, 9 aa, Homo Sapiens
ETVNNSRST

SEQ ID NO: 309672 - protein, 9 aa, Homo Sapiens
NKNIRNAQL

SEQ ID NO: 309673 - protein, 9 aa, Homo Sapiens
YCNKWQDED

SEQ ID NO: 309674 - protein, 9 aa, Homo Sapiens
VEQVRQLAV

SEQ ID NO: 309675 - protein, 9 aa, Homo Sapiens
LRLILQQSQ

SEQ ID NO: 309676 - protein, 9 aa, Homo Sapiens
SLGTKKNKK

SEQ ID NO: 309677 - protein, 9 aa, Homo Sapiens
QFLTNIGLG

SEQ ID NO: 309678 - protein, 9 aa, Homo Sapiens
KIILDAQHE

SEQ ID NO: 309679 - protein, 9 aa, Homo Sapiens
ETIECNEIL

SEQ ID NO: 309680 - protein, 9 aa, Homo Sapiens
LGCDRQSKE

SEQ ID NO: 309681 - protein, 9 aa, Homo Sapiens
SVKQTETAE

SEQ ID NO: 309682 - protein, 9 aa, Homo Sapiens
ESTQENKSI

SEQ ID NO: 309683 - protein, 9 aa, Homo Sapiens
NRKENETPQ

SEQ ID NO: 309684 - protein, 9 aa, Homo Sapiens
EKRKLQPNS

SEQ ID NO: 309685 - protein, 9 aa, Homo Sapiens
VGSSKKIAR

SEQ ID NO: 309686 - protein, 9 aa, Homo Sapiens
NSTALSRLF

SEQ ID NO: 309687 - protein, 9 aa, Homo Sapiens
NIFSIENGT

SEQ ID NO: 309688 - protein, 9 aa, Homo Sapiens
SKSRALSTS

SEQ ID NO: 309689 - protein, 9 aa, Homo Sapiens
QISNGEHHY

SEQ ID NO: 309690 - protein, 9 aa, Homo Sapiens
HESTFDVGN

SEQ ID NO: 309691 - protein, 9 aa, Homo Sapiens
KCLIEAQNQ

SEQ ID NO: 309692 - protein, 9 aa, Homo Sapiens
APPEPVEDI

SEQ ID NO: 309693 - protein, 9 aa, Homo Sapiens
NRDSVCSIQ

SEQ ID NO: 309694 - protein, 9 aa, Homo Sapiens
GWKPEIYQD

SEQ ID NO: 309695 - protein, 9 aa, Homo Sapiens
NFFIALSYF

SEQ ID NO: 309696 - protein, 9 aa, Homo Sapiens
MVTALVSQL

SEQ ID NO: 309697 - protein, 9 aa, Homo Sapiens
TPCAFNVGS

SEQ ID NO: 309698 - protein, 9 aa, Homo Sapiens
PNYATHLKD

SEQ ID NO: 309699 - protein, 9 aa, Homo Sapiens
SRSSTSTSE

SEQ ID NO: 309700 - protein, 9 aa, Homo Sapiens
LVQCYIQIG

SEQ ID NO: 309701 - protein, 9 aa, Homo Sapiens
EPAFQNCMQ

SEQ ID NO: 309702 - protein, 9 aa, Homo Sapiens
KFQVPHASS

SEQ ID NO: 309703 - protein, 9 aa, Homo Sapiens
EKETDKSQS

SEQ ID NO: 309704 - protein, 9 aa, Homo Sapiens
GAMSPLEKE

SEQ ID NO: 309705 - protein, 9 aa, Homo Sapiens
TIVLFSLAA

SEQ ID NO: 309706 - protein, 9 aa, Homo Sapiens
TLLLANNYI

SEQ ID NO: 309707 - protein, 9 aa, Homo Sapiens
KDKTKPQRD

SEQ ID NO: 309708 - protein, 9 aa, Homo Sapiens
TDQKIENIH

SEQ ID NO: 309709 - protein, 9 aa, Homo Sapiens
TDKVLADTK

SEQ ID NO: 309710 - protein, 9 aa, Homo Sapiens
ESLQAQYGT

SEQ ID NO: 309711 - protein, 9 aa, Homo Sapiens
IQGWLKAEQ

SEQ ID NO: 309712 - protein, 9 aa, Homo Sapiens
SKQDIREHI

SEQ ID NO: 309713 - protein, 9 aa, Homo Sapiens
SNEERCTGF

SEQ ID NO: 309714 - protein, 9 aa, Homo Sapiens
NHDQHCRDI

SEQ ID NO: 309715 - protein, 9 aa, Homo Sapiens
TTQWEPPVR

SEQ ID NO: 309716 - protein, 9 aa, Homo Sapiens
QIELSNNYG

SEQ ID NO: 309717 - protein, 9 aa, Homo Sapiens
QKLLLKRNN

SEQ ID NO: 309718 - protein, 9 aa, Homo Sapiens
PHTTRSRQD

SEQ ID NO: 309719 - protein, 9 aa, Homo Sapiens
VQKLFNPHQ

SEQ ID NO: 309720 - protein, 9 aa, Homo Sapiens
RKNIYQELN

SEQ ID NO: 309721 - protein, 9 aa, Homo Sapiens
MRLVVDESS

SEQ ID NO: 309722 - protein, 9 aa, Homo Sapiens
IQKEKPAIH

SEQ ID NO: 309723 - protein, 9 aa, Homo Sapiens
IFTLKLLDR

SEQ ID NO: 309724 - protein, 9 aa, Homo Sapiens
ISSVLSDYN

SEQ ID NO: 309725 - protein, 9 aa, Homo Sapiens
KGSKSKEKD

SEQ ID NO: 309726 - protein, 9 aa, Homo Sapiens
KANLNALDI

SEQ ID NO: 309727 - protein, 9 aa, Homo Sapiens
TVHYCYQFG

SEQ ID NO: 309728 - protein, 9 aa, Homo Sapiens
NQQPQTIPL

SEQ ID NO: 309729 - protein, 9 aa, Homo Sapiens
ANPIPVINN

SEQ ID NO: 309730 - protein, 9 aa, Homo Sapiens
GANLAYHQI

SEQ ID NO: 309731 - protein, 9 aa, Homo Sapiens
KDSLIKLKE

SEQ ID NO: 309732 - protein, 9 aa, Homo Sapiens
SGDNLITRS

SEQ ID NO: 309733 - protein, 9 aa, Homo Sapiens
AQDRTALLN

SEQ ID NO: 309734 - protein, 9 aa, Homo Sapiens
EQFCVIIEK

SEQ ID NO: 309735 - protein, 9 aa, Homo Sapiens
RHRISHTEE

SEQ ID NO: 309736 - protein, 9 aa, Homo Sapiens
WYLLESKGK

SEQ ID NO: 309737 - protein, 9 aa, Homo Sapiens
TKHKIIHAE

SEQ ID NO: 309738 - protein, 9 aa, Homo Sapiens
SSSLTKHKN

SEQ ID NO: 309739 - protein, 9 aa, Homo Sapiens
AWTHILRER

SEQ ID NO: 309740 - protein, 9 aa, Homo Sapiens
MNPHICLKM

SEQ ID NO: 309741 - protein, 9 aa, Homo Sapiens
RFQQPQRHL

SEQ ID NO: 309742 - protein, 9 aa, Homo Sapiens
SHKLLQIET

SEQ ID NO: 309743 - protein, 9 aa, Homo Sapiens
VLVIPKINS

SEQ ID NO: 309744 - protein, 9 aa, Homo Sapiens
LESYRNLVF

SEQ ID NO: 309745 - protein, 9 aa, Homo Sapiens
TAGPQECAK

SEQ ID NO: 309746 - protein, 9 aa, Homo Sapiens
EIKLLEKAG

SEQ ID NO: 309747 - protein, 9 aa, Homo Sapiens
LPNYLMASL

SEQ ID NO: 309748 - protein, 9 aa, Homo Sapiens
GSQQSKTVD

SEQ ID NO: 309749 - protein, 9 aa, Homo Sapiens
LKMQLKCLM

SEQ ID NO: 309750 - protein, 9 aa, Homo Sapiens
QGLGIAKPS

SEQ ID NO: 309751 - protein, 9 aa, Homo Sapiens
YSGNISLYC

SEQ ID NO: 309752 - protein, 9 aa, Homo Sapiens
SGHNKLSNP

SEQ ID NO: 309753 - protein, 9 aa, Homo Sapiens
VQFIFIYQL

SEQ ID NO: 309754 - protein, 9 aa, Homo Sapiens
HISDRVSLI

SEQ ID NO: 309755 - protein, 9 aa, Homo Sapiens
ERQQEVLRA

SEQ ID NO: 309756 - protein, 9 aa, Homo Sapiens
QSKCCKNVY

SEQ ID NO: 309757 - protein, 9 aa, Homo Sapiens
SFTAEQYQQ

SEQ ID NO: 309758 - protein, 9 aa, Homo Sapiens
SLRVLWVLR

SEQ ID NO: 309759 - protein, 9 aa, Homo Sapiens
APSSPRTHS

SEQ ID NO: 309760 - protein, 9 aa, Homo Sapiens
SSDQDVAHF

SEQ ID NO: 309761 - protein, 9 aa, Homo Sapiens
YFEIQYPLN

SEQ ID NO: 309762 - protein, 9 aa, Homo Sapiens
THYLPIEDP

SEQ ID NO: 309763 - protein, 9 aa, Homo Sapiens
QCATARDTS

SEQ ID NO: 309764 - protein, 9 aa, Homo Sapiens
YRTLPTASV

SEQ ID NO: 309765 - protein, 9 aa, Homo Sapiens
RYYKWNGFG

SEQ ID NO: 309766 - protein, 9 aa, Homo Sapiens
CYIQIGSKT

SEQ ID NO: 309767 - protein, 9 aa, Homo Sapiens
VTYKSLTSG

SEQ ID NO: 309768 - protein, 9 aa, Homo Sapiens
ENSTFLNSF

SEQ ID NO: 309769 - protein, 9 aa, Homo Sapiens
TPVLPEEAQ

SEQ ID NO: 309770 - protein, 9 aa, Homo Sapiens
ENNPSVRLK

SEQ ID NO: 309771 - protein, 9 aa, Homo Sapiens
TRLFHLLMV

SEQ ID NO: 309772 - protein, 9 aa, Homo Sapiens
VKNLLFTAK

SEQ ID NO: 309773 - protein, 9 aa, Homo Sapiens
HIQTRSNVA

SEQ ID NO: 309774 - protein, 9 aa, Homo Sapiens
VIETTAPGV

SEQ ID NO: 309775 - protein, 9 aa, Homo Sapiens
VQLQNGDIW

SEQ ID NO: 309776 - protein, 9 aa, Homo Sapiens
IKLMEVPVI

SEQ ID NO: 309777 - protein, 9 aa, Homo Sapiens
EGLPNYSIK

SEQ ID NO: 309778 - protein, 9 aa, Homo Sapiens
VTISEQLQK

SEQ ID NO: 309779 - protein, 9 aa, Homo Sapiens
NNSRSTKYE

SEQ ID NO: 309780 - protein, 9 aa, Homo Sapiens
HVNEPPVIQ

SEQ ID NO: 309781 - protein, 9 aa, Homo Sapiens
ETIKIVIKE

SEQ ID NO: 309782 - protein, 9 aa, Homo Sapiens
LAQIDNSAA

SEQ ID NO: 309783 - protein, 9 aa, Homo Sapiens
LGMYMFRHV

SEQ ID NO: 309784 - protein, 9 aa, Homo Sapiens
LKGALNKVV

SEQ ID NO: 309785 - protein, 9 aa, Homo Sapiens
FLLIFIIIH

SEQ ID NO: 309786 - protein, 9 aa, Homo Sapiens
LDNHRESDN

SEQ ID NO: 309787 - protein, 9 aa, Homo Sapiens
TPQFFAFRW

SEQ ID NO: 309788 - protein, 9 aa, Homo Sapiens
LLINRKEED

SEQ ID NO: 309789 - protein, 9 aa, Homo Sapiens
SKNTSQGYT

SEQ ID NO: 309790 - protein, 9 aa, Homo Sapiens
LANTVDLSF

SEQ ID NO: 309791 - protein, 9 aa, Homo Sapiens
NCPSQTCRP

SEQ ID NO: 309792 - protein, 9 aa, Homo Sapiens
GVGLSFLFV

SEQ ID NO: 309793 - protein, 9 aa, Homo Sapiens
RQTKRIRKP

SEQ ID NO: 309794 - protein, 9 aa, Homo Sapiens
VHTQTEKTT

SEQ ID NO: 309795 - protein, 9 aa, Homo Sapiens
QVASVLRGL

SEQ ID NO: 309796 - protein, 9 aa, Homo Sapiens
PRELIEIKT

SEQ ID NO: 309797 - protein, 9 aa, Homo Sapiens
IPNTLLPEG

SEQ ID NO: 309798 - protein, 9 aa, Homo Sapiens
FIVFGSQVD

SEQ ID NO: 309799 - protein, 9 aa, Homo Sapiens
RDVIKSIIK

SEQ ID NO: 309800 - protein, 9 aa, Homo Sapiens
LLESVERQL

SEQ ID NO: 309801 - protein, 9 aa, Homo Sapiens
RLQAITGKR

SEQ ID NO: 309802 - protein, 9 aa, Homo Sapiens
PGFPGVKGE

SEQ ID NO: 309803 - protein, 9 aa, Homo Sapiens
GDNHLRNKS

SEQ ID NO: 309804 - protein, 9 aa, Homo Sapiens
FCFDDSLPN

SEQ ID NO: 309805 - protein, 9 aa, Homo Sapiens
YLSGLRRKP

SEQ ID NO: 309806 - protein, 9 aa, Homo Sapiens
KPGYLNQPY

SEQ ID NO: 309807 - protein, 9 aa, Homo Sapiens
QIVQLIQKH

SEQ ID NO: 309808 - protein, 9 aa, Homo Sapiens
CREMIPAFQ

SEQ ID NO: 309809 - protein, 9 aa, Homo Sapiens
FAVIKEAFA

SEQ ID NO: 309810 - protein, 9 aa, Homo Sapiens
TSDFLGLGN

SEQ ID NO: 309811 - protein, 9 aa, Homo Sapiens
LTIMWKWIG

SEQ ID NO: 309812 - protein, 9 aa, Homo Sapiens
KLDQIIYHI

SEQ ID NO: 309813 - protein, 9 aa, Homo Sapiens
DVVILANRE

SEQ ID NO: 309814 - protein, 9 aa, Homo Sapiens
GRPQIKKDE

SEQ ID NO: 309815 - protein, 9 aa, Homo Sapiens
VANTIDADI

SEQ ID NO: 309816 - protein, 9 aa, Homo Sapiens
NQAVQGQWE

SEQ ID NO: 309817 - protein, 9 aa, Homo Sapiens
DIHDERQYR

SEQ ID NO: 309818 - protein, 9 aa, Homo Sapiens
TDGYEWDHV

SEQ ID NO: 309819 - protein, 9 aa, Homo Sapiens
PEEAQEEDA

SEQ ID NO: 309820 - protein, 9 aa, Homo Sapiens
VSVQNENCE

SEQ ID NO: 309821 - protein, 9 aa, Homo Sapiens
KNIERVYFE

SEQ ID NO: 309822 - protein, 9 aa, Homo Sapiens
CAKCSLATD

SEQ ID NO: 309823 - protein, 9 aa, Homo Sapiens
FTLENTYGN

SEQ ID NO: 309824 - protein, 9 aa, Homo Sapiens
PAWGQRRNM

SEQ ID NO: 309825 - protein, 9 aa, Homo Sapiens
CLLQTLSLC

SEQ ID NO: 309826 - protein, 9 aa, Homo Sapiens
DVGNFNAFK

SEQ ID NO: 309827 - protein, 9 aa, Homo Sapiens
MLSPTFVMW

SEQ ID NO: 309828 - protein, 9 aa, Homo Sapiens
GRETNNLSP

SEQ ID NO: 309829 - protein, 9 aa, Homo Sapiens
TLPTASVII

SEQ ID NO: 309830 - protein, 9 aa, Homo Sapiens
SVMKHLSGP

SEQ ID NO: 309831 - protein, 9 aa, Homo Sapiens
TAAGSAMKW

SEQ ID NO: 309832 - protein, 9 aa, Homo Sapiens
WWTYASSIF

SEQ ID NO: 309833 - protein, 9 aa, Homo Sapiens
TALLLVFFT

SEQ ID NO: 309834 - protein, 9 aa, Homo Sapiens
QIETAYDFI

SEQ ID NO: 309835 - protein, 9 aa, Homo Sapiens
KLYKIECDK

SEQ ID NO: 309836 - protein, 9 aa, Homo Sapiens
DVYSTFQNH

SEQ ID NO: 309837 - protein, 9 aa, Homo Sapiens
PDKEMMLQN

SEQ ID NO: 309838 - protein, 9 aa, Homo Sapiens
ADVSHKLLQ

SEQ ID NO: 309839 - protein, 9 aa, Homo Sapiens
LSCKMLTPR

SEQ ID NO: 309840 - protein, 9 aa, Homo Sapiens
IETMTMTEK

SEQ ID NO: 309841 - protein, 9 aa, Homo Sapiens
EKKLFTVSP

SEQ ID NO: 309842 - protein, 9 aa, Homo Sapiens
QYGLKLTTN

SEQ ID NO: 309843 - protein, 9 aa, Homo Sapiens
ENGFNTPWG

SEQ ID NO: 309844 - protein, 9 aa, Homo Sapiens
HGHVRLLSE

SEQ ID NO: 309845 - protein, 9 aa, Homo Sapiens
EAAFIDTEG

SEQ ID NO: 309846 - protein, 9 aa, Homo Sapiens
TLMDYLINN

SEQ ID NO: 309847 - protein, 9 aa, Homo Sapiens
KECVILDIE

SEQ ID NO: 309848 - protein, 9 aa, Homo Sapiens
TQYPVSLEM

SEQ ID NO: 309849 - protein, 9 aa, Homo Sapiens
LSSLQVHQR

SEQ ID NO: 309850 - protein, 9 aa, Homo Sapiens
TSIYKCGRI

SEQ ID NO: 309851 - protein, 9 aa, Homo Sapiens
NGIHLYEQP

SEQ ID NO: 309852 - protein, 9 aa, Homo Sapiens
DNFQLKGCR

SEQ ID NO: 309853 - protein, 9 aa, Homo Sapiens
SFLFVAPLI

SEQ ID NO: 309854 - protein, 9 aa, Homo Sapiens
WAKTIVKFS

SEQ ID NO: 309855 - protein, 9 aa, Homo Sapiens
LGLGNFTTR

SEQ ID NO: 309856 - protein, 9 aa, Homo Sapiens
GKVFYPTEK

SEQ ID NO: 309857 - protein, 9 aa, Homo Sapiens
WLKAEQQEE

SEQ ID NO: 309858 - protein, 9 aa, Homo Sapiens
NGALLVLGL

SEQ ID NO: 309859 - protein, 9 aa, Homo Sapiens
HNCGSPHDS

SEQ ID NO: 309860 - protein, 9 aa, Homo Sapiens
EIRPWTRKG

SEQ ID NO: 309861 - protein, 9 aa, Homo Sapiens
LSIGVEQIF

SEQ ID NO: 309862 - protein, 9 aa, Homo Sapiens
SPEKLYPKF

SEQ ID NO: 309863 - protein, 9 aa, Homo Sapiens
CGAAAGQLK

SEQ ID NO: 309864 - protein, 9 aa, Homo Sapiens
SPGMTYCEN

SEQ ID NO: 309865 - protein, 9 aa, Homo Sapiens
SALAIVQNA

SEQ ID NO: 309866 - protein, 9 aa, Homo Sapiens
KPIEPCLSN

SEQ ID NO: 309867 - protein, 9 aa, Homo Sapiens
IHGQHSPKI

SEQ ID NO: 309868 - protein, 9 aa, Homo Sapiens
QKSLSIRAP

SEQ ID NO: 309869 - protein, 9 aa, Homo Sapiens
LSCLILPSS

SEQ ID NO: 309870 - protein, 9 aa, Homo Sapiens
VEDDSDADT

SEQ ID NO: 309871 - protein, 9 aa, Homo Sapiens
VWWHAPVVP

SEQ ID NO: 309872 - protein, 9 aa, Homo Sapiens
KVSNFFVCS

SEQ ID NO: 309873 - protein, 9 aa, Homo Sapiens
TSLTETEVD

SEQ ID NO: 309874 - protein, 9 aa, Homo Sapiens
ELIGSMPNP

SEQ ID NO: 309875 - protein, 9 aa, Homo Sapiens
VKKRSVWNS

SEQ ID NO: 309876 - protein, 9 aa, Homo Sapiens
IFRVPEPPS

SEQ ID NO: 309877 - protein, 9 aa, Homo Sapiens
KSEEIYLQQ

SEQ ID NO: 309878 - protein, 9 aa, Homo Sapiens
EACTLDTVG

SEQ ID NO: 309879 - protein, 9 aa, Homo Sapiens
DIEWKFAQT

SEQ ID NO: 309880 - protein, 9 aa, Homo Sapiens
RLYDTAMKL

SEQ ID NO: 309881 - protein, 9 aa, Homo Sapiens
NKSEGSPPP

SEQ ID NO: 309882 - protein, 9 aa, Homo Sapiens
ALKTIKLME

SEQ ID NO: 309883 - protein, 9 aa, Homo Sapiens
EVCKVKTIV

SEQ ID NO: 309884 - protein, 9 aa, Homo Sapiens
IMREEVYFF

SEQ ID NO: 309885 - protein, 9 aa, Homo Sapiens
LHKKMGQLI

SEQ ID NO: 309886 - protein, 9 aa, Homo Sapiens
KTKEREKEG

SEQ ID NO: 309887 - protein, 9 aa, Homo Sapiens
VCGSDGELY

SEQ ID NO: 309888 - protein, 9 aa, Homo Sapiens
EGPEGKLTG

SEQ ID NO: 309889 - protein, 9 aa, Homo Sapiens
AEEAVAGGL

SEQ ID NO: 309890 - protein, 9 aa, Homo Sapiens
AFDIVHKND

SEQ ID NO: 309891 - protein, 9 aa, Homo Sapiens
YIAMSSIDE

SEQ ID NO: 309892 - protein, 9 aa, Homo Sapiens
VSRVMNTGS

SEQ ID NO: 309893 - protein, 9 aa, Homo Sapiens
VLFFLTPAN

SEQ ID NO: 309894 - protein, 9 aa, Homo Sapiens
AMKNTQKSV

SEQ ID NO: 309895 - protein, 9 aa, Homo Sapiens
HDTFTNTYQ

SEQ ID NO: 309896 - protein, 9 aa, Homo Sapiens
IVNHRRSHT

SEQ ID NO: 309897 - protein, 9 aa, Homo Sapiens
EHEGFEHNT

SEQ ID NO: 309898 - protein, 9 aa, Homo Sapiens
NNSVNHVIH

SEQ ID NO: 309899 - protein, 9 aa, Homo Sapiens
KCDVSSELL

SEQ ID NO: 309900 - protein, 9 aa, Homo Sapiens
KETDKSQSS

SEQ ID NO: 309901 - protein, 9 aa, Homo Sapiens
DLKTRCISP

SEQ ID NO: 309902 - protein, 9 aa, Homo Sapiens
DLFLHVKPR

SEQ ID NO: 309903 - protein, 9 aa, Homo Sapiens
KEQGSHSKF

SEQ ID NO: 309904 - protein, 9 aa, Homo Sapiens
IEELFGDLN

SEQ ID NO: 309905 - protein, 9 aa, Homo Sapiens
RRREIKLLE

SEQ ID NO: 309906 - protein, 9 aa, Homo Sapiens
RDFIDIKSK

SEQ ID NO: 309907 - protein, 9 aa, Homo Sapiens
RSSQNGSLK

SEQ ID NO: 309908 - protein, 9 aa, Homo Sapiens
PNCKLEYKT

SEQ ID NO: 309909 - protein, 9 aa, Homo Sapiens
LPKPKKNPF

SEQ ID NO: 309910 - protein, 9 aa, Homo Sapiens
HCHRPHSSG

SEQ ID NO: 309911 - protein, 9 aa, Homo Sapiens
NAKVNTGDK

SEQ ID NO: 309912 - protein, 9 aa, Homo Sapiens
TDMDVVYAL

SEQ ID NO: 309913 - protein, 9 aa, Homo Sapiens
EQDPASAPR

SEQ ID NO: 309914 - protein, 9 aa, Homo Sapiens
PCYHEIMTP

SEQ ID NO: 309915 - protein, 9 aa, Homo Sapiens
TQWCVCKLQ

SEQ ID NO: 309916 - protein, 9 aa, Homo Sapiens
ETIVATMSN

SEQ ID NO: 309917 - protein, 9 aa, Homo Sapiens
KVQEGQWYK

SEQ ID NO: 309918 - protein, 9 aa, Homo Sapiens
NTLHKFCGP

SEQ ID NO: 309919 - protein, 9 aa, Homo Sapiens
SMSVFPSQS

SEQ ID NO: 309920 - protein, 9 aa, Homo Sapiens
TRNIRLVQC

SEQ ID NO: 309921 - protein, 9 aa, Homo Sapiens
HFEDNDNRS

SEQ ID NO: 309922 - protein, 9 aa, Homo Sapiens
LRLVDSDGE

SEQ ID NO: 309923 - protein, 9 aa, Homo Sapiens
HYTVIMSQT

SEQ ID NO: 309924 - protein, 9 aa, Homo Sapiens
DKVSNDITS

SEQ ID NO: 309925 - protein, 9 aa, Homo Sapiens
VINPVFYFI

SEQ ID NO: 309926 - protein, 9 aa, Homo Sapiens
KEVEHNSGP

SEQ ID NO: 309927 - protein, 9 aa, Homo Sapiens
TLLIQDNVN

SEQ ID NO: 309928 - protein, 9 aa, Homo Sapiens
RPSFRDYID

SEQ ID NO: 309929 - protein, 9 aa, Homo Sapiens
TYSRKGGND

SEQ ID NO: 309930 - protein, 9 aa, Homo Sapiens
PSELNLKGG

SEQ ID NO: 309931 - protein, 9 aa, Homo Sapiens
AIILKLMAQ

SEQ ID NO: 309932 - protein, 9 aa, Homo Sapiens
DKTLPNSQE

SEQ ID NO: 309933 - protein, 9 aa, Homo Sapiens
TFSSATDLL

SEQ ID NO: 309934 - protein, 9 aa, Homo Sapiens
IIHAEEKPF

SEQ ID NO: 309935 - protein, 9 aa, Homo Sapiens
EGNECISPQ

SEQ ID NO: 309936 - protein, 9 aa, Homo Sapiens
PILSLPLVG

SEQ ID NO: 309937 - protein, 9 aa, Homo Sapiens
EFGFFYLFT

SEQ ID NO: 309938 - protein, 9 aa, Homo Sapiens
MRQEHQNRV

SEQ ID NO: 309939 - protein, 9 aa, Homo Sapiens
LQKRMNKQH

SEQ ID NO: 309940 - protein, 9 aa, Homo Sapiens
TIVESCNSP

SEQ ID NO: 309941 - protein, 9 aa, Homo Sapiens
SDATTPAPR

SEQ ID NO: 309942 - protein, 9 aa, Homo Sapiens
QIPLWSQWV

SEQ ID NO: 309943 - protein, 9 aa, Homo Sapiens
INKLRAKDK

SEQ ID NO: 309944 - protein, 9 aa, Homo Sapiens
VSHKLLQIE

SEQ ID NO: 309945 - protein, 9 aa, Homo Sapiens
GYLQVKKVY

SEQ ID NO: 309946 - protein, 9 aa, Homo Sapiens
ILPHLKDIP

SEQ ID NO: 309947 - protein, 9 aa, Homo Sapiens
SALNSLHLS

SEQ ID NO: 309948 - protein, 9 aa, Homo Sapiens
AIIRHKALL

SEQ ID NO: 309949 - protein, 9 aa, Homo Sapiens
DIKNKFKKE

SEQ ID NO: 309950 - protein, 9 aa, Homo Sapiens
MRLFGGNCA

SEQ ID NO: 309951 - protein, 9 aa, Homo Sapiens
VILEVNIIQ

SEQ ID NO: 309952 - protein, 9 aa, Homo Sapiens
LSIQGHKQQ

SEQ ID NO: 309953 - protein, 9 aa, Homo Sapiens
QVLINSLEG

SEQ ID NO: 309954 - protein, 9 aa, Homo Sapiens
QYCVLCDNE

SEQ ID NO: 309955 - protein, 9 aa, Homo Sapiens
DPCPHMGQI

SEQ ID NO: 309956 - protein, 9 aa, Homo Sapiens
CENCKPLRQ

SEQ ID NO: 309957 - protein, 9 aa, Homo Sapiens
NIRYLITFL

SEQ ID NO: 309958 - protein, 9 aa, Homo Sapiens
DCIGNPDEE

SEQ ID NO: 309959 - protein, 9 aa, Homo Sapiens
DHGEKKQKL

SEQ ID NO: 309960 - protein, 9 aa, Homo Sapiens
PPPGHLVGP

SEQ ID NO: 309961 - protein, 9 aa, Homo Sapiens
QISILYLSE

SEQ ID NO: 309962 - protein, 9 aa, Homo Sapiens
ISSQPKEFS

SEQ ID NO: 309963 - protein, 9 aa, Homo Sapiens
GLQDGIGQR

SEQ ID NO: 309964 - protein, 9 aa, Homo Sapiens
NKLYWAVLS

SEQ ID NO: 309965 - protein, 9 aa, Homo Sapiens
PQKLKEVIY

SEQ ID NO: 309966 - protein, 9 aa, Homo Sapiens
ALVYTFRAK

SEQ ID NO: 309967 - protein, 9 aa, Homo Sapiens
TLKIQSLDQ

SEQ ID NO: 309968 - protein, 9 aa, Homo Sapiens
GNYASYTFV

SEQ ID NO: 309969 - protein, 9 aa, Homo Sapiens
CGIWQPKYG

SEQ ID NO: 309970 - protein, 9 aa, Homo Sapiens
DTDGEEEER

SEQ ID NO: 309971 - protein, 9 aa, Homo Sapiens
MMWYKNSSI

SEQ ID NO: 309972 - protein, 9 aa, Homo Sapiens
QVAKMINMM

SEQ ID NO: 309973 - protein, 9 aa, Homo Sapiens
PSHLRCHSW

SEQ ID NO: 309974 - protein, 9 aa, Homo Sapiens
QRKANRAEN

SEQ ID NO: 309975 - protein, 9 aa, Homo Sapiens
YLPGEPEVE

SEQ ID NO: 309976 - protein, 9 aa, Homo Sapiens
LQDKRKRNV

SEQ ID NO: 309977 - protein, 9 aa, Homo Sapiens
QTKRSRGFC

SEQ ID NO: 309978 - protein, 9 aa, Homo Sapiens
QNIKFYSAP

SEQ ID NO: 309979 - protein, 9 aa, Homo Sapiens
NNPGVVAYQ

SEQ ID NO: 309980 - protein, 9 aa, Homo Sapiens
GEAIPWQRS

SEQ ID NO: 309981 - protein, 9 aa, Homo Sapiens
AVKELSWQK

SEQ ID NO: 309982 - protein, 9 aa, Homo Sapiens
IWASLLGKK

SEQ ID NO: 309983 - protein, 9 aa, Homo Sapiens
KTKKKLLIT

SEQ ID NO: 309984 - protein, 9 aa, Homo Sapiens
SFPGITGVT

SEQ ID NO: 309985 - protein, 9 aa, Homo Sapiens
RHAGNKHIQ

SEQ ID NO: 309986 - protein, 9 aa, Homo Sapiens
IRGDKITRI

SEQ ID NO: 309987 - protein, 9 aa, Homo Sapiens
AIDFGSASH

SEQ ID NO: 309988 - protein, 9 aa, Homo Sapiens
YKYVYTRYR

SEQ ID NO: 309989 - protein, 9 aa, Homo Sapiens
TAFDYLNPN

SEQ ID NO: 309990 - protein, 9 aa, Homo Sapiens
KEYVLVYLH

SEQ ID NO: 309991 - protein, 9 aa, Homo Sapiens
KIATTYSSL

SEQ ID NO: 309992 - protein, 9 aa, Homo Sapiens
NVPIERIPN

SEQ ID NO: 309993 - protein, 9 aa, Homo Sapiens
YHPNNNKYF

SEQ ID NO: 309994 - protein, 9 aa, Homo Sapiens
AGVPLDLLR

SEQ ID NO: 309995 - protein, 9 aa, Homo Sapiens
QKPINLPVV

SEQ ID NO: 309996 - protein, 9 aa, Homo Sapiens
ESMCEYQQA

SEQ ID NO: 309997 - protein, 9 aa, Homo Sapiens
VWVQAANTL

SEQ ID NO: 309998 - protein, 9 aa, Homo Sapiens
RNNYGLKVH

SEQ ID NO: 309999 - protein, 9 aa, Homo Sapiens
NSEPNNSVL

SEQ ID NO: 310000 - protein, 9 aa, Homo Sapiens
QNVLQKLDV

SEQ ID NO: 310001 - protein, 9 aa, Homo Sapiens
LNNLTVIFA

SEQ ID NO: 310002 - protein, 9 aa, Homo Sapiens
KQMNDAQHG

SEQ ID NO: 310003 - protein, 9 aa, Homo Sapiens
QGNTFLRAF

SEQ ID NO: 310004 - protein, 9 aa, Homo Sapiens
PATFFCIFS

SEQ ID NO: 310005 - protein, 9 aa, Homo Sapiens
EFLYNLLYL

SEQ ID NO: 310006 - protein, 9 aa, Homo Sapiens
KAFTKYCNK

SEQ ID NO: 310007 - protein, 9 aa, Homo Sapiens
ELIPLTAQM

SEQ ID NO: 310008 - protein, 9 aa, Homo Sapiens
QQNVFCDVS

SEQ ID NO: 310009 - protein, 9 aa, Homo Sapiens
SDMWSSKER

SEQ ID NO: 310010 - protein, 9 aa, Homo Sapiens
VDSFKSGCE

SEQ ID NO: 310011 - protein, 9 aa, Homo Sapiens
TDAPVMTMA

SEQ ID NO: 310012 - protein, 9 aa, Homo Sapiens
PSLDQQCDP

SEQ ID NO: 310013 - protein, 9 aa, Homo Sapiens
TSWYNGVRE

SEQ ID NO: 310014 - protein, 9 aa, Homo Sapiens
NDTRVFVQK

SEQ ID NO: 310015 - protein, 9 aa, Homo Sapiens
KEGVAKMDP

SEQ ID NO: 310016 - protein, 9 aa, Homo Sapiens
LEKLLIPNA

SEQ ID NO: 310017 - protein, 9 aa, Homo Sapiens
IRPRNLRSP

SEQ ID NO: 310018 - protein, 9 aa, Homo Sapiens
LCLHNLPRA

SEQ ID NO: 310019 - protein, 9 aa, Homo Sapiens
ANKVKTPQP

SEQ ID NO: 310020 - protein, 9 aa, Homo Sapiens
VPWTCEQGT

SEQ ID NO: 310021 - protein, 9 aa, Homo Sapiens
GRTKKGVLE

SEQ ID NO: 310022 - protein, 9 aa, Homo Sapiens
IIVHQRIHM

SEQ ID NO: 310023 - protein, 9 aa, Homo Sapiens
SFCGYHPNN

SEQ ID NO: 310024 - protein, 9 aa, Homo Sapiens
PGGEDESIN

SEQ ID NO: 310025 - protein, 9 aa, Homo Sapiens
YPTEKALKT

SEQ ID NO: 310026 - protein, 9 aa, Homo Sapiens
RTSTQQVYF

SEQ ID NO: 310027 - protein, 9 aa, Homo Sapiens
KREINITKL

SEQ ID NO: 310028 - protein, 9 aa, Homo Sapiens
YLVEKYIEE

SEQ ID NO: 310029 - protein, 9 aa, Homo Sapiens
SFLWKLHVR

SEQ ID NO: 310030 - protein, 9 aa, Homo Sapiens
HDVLTELLS

SEQ ID NO: 310031 - protein, 9 aa, Homo Sapiens
PSGCLLDCF

SEQ ID NO: 310032 - protein, 9 aa, Homo Sapiens
CQNNVVLYW

SEQ ID NO: 310033 - protein, 9 aa, Homo Sapiens
FPYHLQGKR

SEQ ID NO: 310034 - protein, 9 aa, Homo Sapiens
PELAYQKEM

SEQ ID NO: 310035 - protein, 9 aa, Homo Sapiens
PGICLVSGL

SEQ ID NO: 310036 - protein, 9 aa, Homo Sapiens
NGLNQYLTS

SEQ ID NO: 310037 - protein, 9 aa, Homo Sapiens
FQMSLEAKE

SEQ ID NO: 310038 - protein, 9 aa, Homo Sapiens
AFYLALRPV

SEQ ID NO: 310039 - protein, 9 aa, Homo Sapiens
YAPFVYTYI

SEQ ID NO: 310040 - protein, 9 aa, Homo Sapiens
PQRITCTCE

SEQ ID NO: 310041 - protein, 9 aa, Homo Sapiens
NGKYRKYFH

SEQ ID NO: 310042 - protein, 9 aa, Homo Sapiens
VLLEELSEY

SEQ ID NO: 310043 - protein, 9 aa, Homo Sapiens
PPEWLFNLL

SEQ ID NO: 310044 - protein, 9 aa, Homo Sapiens
FDFMGLINT

SEQ ID NO: 310045 - protein, 9 aa, Homo Sapiens
GNISGSFTL

SEQ ID NO: 310046 - protein, 9 aa, Homo Sapiens
FLVCISVRQ

SEQ ID NO: 310047 - protein, 9 aa, Homo Sapiens
ITSLSQQPE

SEQ ID NO: 310048 - protein, 9 aa, Homo Sapiens
GGSGYNLDR

SEQ ID NO: 310049 - protein, 9 aa, Homo Sapiens
ELHKHSVKQ

SEQ ID NO: 310050 - protein, 9 aa, Homo Sapiens
RGAPWIPGQ

SEQ ID NO: 310051 - protein, 9 aa, Homo Sapiens
KQKKDQNRD

SEQ ID NO: 310052 - protein, 9 aa, Homo Sapiens
GLINTTEIV

SEQ ID NO: 310053 - protein, 9 aa, Homo Sapiens
GLILNIYSG

SEQ ID NO: 310054 - protein, 9 aa, Homo Sapiens
LGLEKKEEE

SEQ ID NO: 310055 - protein, 9 aa, Homo Sapiens
FYAHLTELT

SEQ ID NO: 310056 - protein, 9 aa, Homo Sapiens
NEITTIKWN

SEQ ID NO: 310057 - protein, 9 aa, Homo Sapiens
KELSWQKRT

SEQ ID NO: 310058 - protein, 9 aa, Homo Sapiens
SSIFRVPEP

SEQ ID NO: 310059 - protein, 9 aa, Homo Sapiens
VSKQSWGLE

SEQ ID NO: 310060 - protein, 9 aa, Homo Sapiens
TGEHGLQEA

SEQ ID NO: 310061 - protein, 9 aa, Homo Sapiens
IGLCSLSYL

SEQ ID NO: 310062 - protein, 9 aa, Homo Sapiens
CVTASIKTL

SEQ ID NO: 310063 - protein, 9 aa, Homo Sapiens
IYFCAHTPL

SEQ ID NO: 310064 - protein, 9 aa, Homo Sapiens
FMVYKLLLT

SEQ ID NO: 310065 - protein, 9 aa, Homo Sapiens
IMALLSANS

SEQ ID NO: 310066 - protein, 9 aa, Homo Sapiens
PTSPLITRF

SEQ ID NO: 310067 - protein, 9 aa, Homo Sapiens
KELFVDDFE

SEQ ID NO: 310068 - protein, 9 aa, Homo Sapiens
SDASTENTL

SEQ ID NO: 310069 - protein, 9 aa, Homo Sapiens
FIEKENYHD

SEQ ID NO: 310070 - protein, 9 aa, Homo Sapiens
GPDMFCKLV

SEQ ID NO: 310071 - protein, 9 aa, Homo Sapiens
VAQMPVYSV

SEQ ID NO: 310072 - protein, 9 aa, Homo Sapiens
KHYQVSGYP

SEQ ID NO: 310073 - protein, 9 aa, Homo Sapiens
SLRNMASLY

SEQ ID NO: 310074 - protein, 9 aa, Homo Sapiens
SSVSSTSST

SEQ ID NO: 310075 - protein, 9 aa, Homo Sapiens
LSGPINHYQ

SEQ ID NO: 310076 - protein, 9 aa, Homo Sapiens
LGAGIAEHL

SEQ ID NO: 310077 - protein, 9 aa, Homo Sapiens
INTTEIVTT

SEQ ID NO: 310078 - protein, 9 aa, Homo Sapiens
INQAFVVNQ

SEQ ID NO: 310079 - protein, 9 aa, Homo Sapiens
LPLSEKMQY

SEQ ID NO: 310080 - protein, 9 aa, Homo Sapiens
SFELFEEAD

SEQ ID NO: 310081 - protein, 9 aa, Homo Sapiens
SIKGSKNYS

SEQ ID NO: 310082 - protein, 9 aa, Homo Sapiens
MLLSEDENF

SEQ ID NO: 310083 - protein, 9 aa, Homo Sapiens
DQNRDLEKR

SEQ ID NO: 310084 - protein, 9 aa, Homo Sapiens
WVFIFKLLI

SEQ ID NO: 310085 - protein, 9 aa, Homo Sapiens
GDISGGDTS

SEQ ID NO: 310086 - protein, 9 aa, Homo Sapiens
QLSLGLKSG

SEQ ID NO: 310087 - protein, 9 aa, Homo Sapiens
SMCMIMMEM

SEQ ID NO: 310088 - protein, 9 aa, Homo Sapiens
KKLFTVSPE

SEQ ID NO: 310089 - protein, 9 aa, Homo Sapiens
LFLPVPTDV

SEQ ID NO: 310090 - protein, 9 aa, Homo Sapiens
TLHVNEPPV

SEQ ID NO: 310091 - protein, 9 aa, Homo Sapiens
DYAKEIMRH

SEQ ID NO: 310092 - protein, 9 aa, Homo Sapiens
KQIISHSNK

SEQ ID NO: 310093 - protein, 9 aa, Homo Sapiens
RVYELLSAW

SEQ ID NO: 310094 - protein, 9 aa, Homo Sapiens
RGLVARIDY

SEQ ID NO: 310095 - protein, 9 aa, Homo Sapiens
YGPQTPSEC

SEQ ID NO: 310096 - protein, 9 aa, Homo Sapiens
CTTDKQPRK

SEQ ID NO: 310097 - protein, 9 aa, Homo Sapiens
RTKQKKDQN

SEQ ID NO: 310098 - protein, 9 aa, Homo Sapiens
MFSHSIHNF

SEQ ID NO: 310099 - protein, 9 aa, Homo Sapiens
SSDATTPAP

SEQ ID NO: 310100 - protein, 9 aa, Homo Sapiens
YLKTTGKQI

SEQ ID NO: 310101 - protein, 9 aa, Homo Sapiens
NNLVLAGIK

SEQ ID NO: 310102 - protein, 9 aa, Homo Sapiens
EQEEYKNYL

SEQ ID NO: 310103 - protein, 9 aa, Homo Sapiens
STGILMYTI

SEQ ID NO: 310104 - protein, 9 aa, Homo Sapiens
HSANKSRVQ

SEQ ID NO: 310105 - protein, 9 aa, Homo Sapiens
IIKISKSSI

SEQ ID NO: 310106 - protein, 9 aa, Homo Sapiens
KYVYTRYRA

SEQ ID NO: 310107 - protein, 9 aa, Homo Sapiens
KEKDLMNAY

SEQ ID NO: 310108 - protein, 9 aa, Homo Sapiens
SSTFRVEKA

SEQ ID NO: 310109 - protein, 9 aa, Homo Sapiens
WQLLQKQEQ

SEQ ID NO: 310110 - protein, 9 aa, Homo Sapiens
TIYAKEGGL

SEQ ID NO: 310111 - protein, 9 aa, Homo Sapiens
YNSALRFHK

SEQ ID NO: 310112 - protein, 9 aa, Homo Sapiens
HHKITHSKE

SEQ ID NO: 310113 - protein, 9 aa, Homo Sapiens
GKIISSDSP

SEQ ID NO: 310114 - protein, 9 aa, Homo Sapiens
LQEARVLLK

SEQ ID NO: 310115 - protein, 9 aa, Homo Sapiens
GKPSMITPL

SEQ ID NO: 310116 - protein, 9 aa, Homo Sapiens
CVGDNRVIL

SEQ ID NO: 310117 - protein, 9 aa, Homo Sapiens
SIQGHKQQL

SEQ ID NO: 310118 - protein, 9 aa, Homo Sapiens
KSSPKIGFF

SEQ ID NO: 310119 - protein, 9 aa, Homo Sapiens
PKYQQRLPI

SEQ ID NO: 310120 - protein, 9 aa, Homo Sapiens
VCKSGSIFG

SEQ ID NO: 310121 - protein, 9 aa, Homo Sapiens
SQTVYQYQY

SEQ ID NO: 310122 - protein, 9 aa, Homo Sapiens
YFIFWAPYN

SEQ ID NO: 310123 - protein, 9 aa, Homo Sapiens
TETSLTETE

SEQ ID NO: 310124 - protein, 9 aa, Homo Sapiens
NWYSLVICE

SEQ ID NO: 310125 - protein, 9 aa, Homo Sapiens
CVCSSLLQF

SEQ ID NO: 310126 - protein, 9 aa, Homo Sapiens
LRQMFCSRS

SEQ ID NO: 310127 - protein, 9 aa, Homo Sapiens
NRTLKKIIV

SEQ ID NO: 310128 - protein, 9 aa, Homo Sapiens
HLPSFYAHL

SEQ ID NO: 310129 - protein, 9 aa, Homo Sapiens
KKWLQEWKA

SEQ ID NO: 310130 - protein, 9 aa, Homo Sapiens
QAGSPGDKG

SEQ ID NO: 310131 - protein, 9 aa, Homo Sapiens
KVTLHMLPM

SEQ ID NO: 310132 - protein, 9 aa, Homo Sapiens
DSEVSCFTS

SEQ ID NO: 310133 - protein, 9 aa, Homo Sapiens
GLPNYSIKN

SEQ ID NO: 310134 - protein, 9 aa, Homo Sapiens
PEDVSPFNI

SEQ ID NO: 310135 - protein, 9 aa, Homo Sapiens
NSFSMSASK

SEQ ID NO: 310136 - protein, 9 aa, Homo Sapiens
RVIQTFNHT

SEQ ID NO: 310137 - protein, 9 aa, Homo Sapiens
SKKKGPHTP

SEQ ID NO: 310138 - protein, 9 aa, Homo Sapiens
DNCCVGKIP

SEQ ID NO: 310139 - protein, 9 aa, Homo Sapiens
ALLQEYLEG

SEQ ID NO: 310140 - protein, 9 aa, Homo Sapiens
LLVKNIVSL

SEQ ID NO: 310141 - protein, 9 aa, Homo Sapiens
GYNKKLWKK

SEQ ID NO: 310142 - protein, 9 aa, Homo Sapiens
SAGRYVCEN

SEQ ID NO: 310143 - protein, 9 aa, Homo Sapiens
SLWVEEAYY

SEQ ID NO: 310144 - protein, 9 aa, Homo Sapiens
TTDGFQNYV

SEQ ID NO: 310145 - protein, 9 aa, Homo Sapiens
WRKKKPTVV

SEQ ID NO: 310146 - protein, 9 aa, Homo Sapiens
YWASPTRTA

SEQ ID NO: 310147 - protein, 9 aa, Homo Sapiens
YTIASAICE

SEQ ID NO: 310148 - protein, 9 aa, Homo Sapiens
LDKTIKAEL

SEQ ID NO: 310149 - protein, 9 aa, Homo Sapiens
VNGIHLYEQ

SEQ ID NO: 310150 - protein, 9 aa, Homo Sapiens
NDMHSEELL

SEQ ID NO: 310151 - protein, 9 aa, Homo Sapiens
NKCEKIFKQ

SEQ ID NO: 310152 - protein, 9 aa, Homo Sapiens
QIILAVQKK

SEQ ID NO: 310153 - protein, 9 aa, Homo Sapiens
SLEMINEDG

SEQ ID NO: 310154 - protein, 9 aa, Homo Sapiens
QRRSHSPSP

SEQ ID NO: 310155 - protein, 9 aa, Homo Sapiens
DNEDATDNV

SEQ ID NO: 310156 - protein, 9 aa, Homo Sapiens
GKKSKNTKK

SEQ ID NO: 310157 - protein, 9 aa, Homo Sapiens
SDCSEDGTG

SEQ ID NO: 310158 - protein, 9 aa, Homo Sapiens
RERAALCVR

SEQ ID NO: 310159 - protein, 9 aa, Homo Sapiens
LKYIIRQKD

SEQ ID NO: 310160 - protein, 9 aa, Homo Sapiens
CLSAYRFKT

SEQ ID NO: 310161 - protein, 9 aa, Homo Sapiens
LVESVAHNK

SEQ ID NO: 310162 - protein, 9 aa, Homo Sapiens
SFVLPCFGL

SEQ ID NO: 310163 - protein, 9 aa, Homo Sapiens
LSEDCSDVP

SEQ ID NO: 310164 - protein, 9 aa, Homo Sapiens
EIQMLDNRK

SEQ ID NO: 310165 - protein, 9 aa, Homo Sapiens
IPEGVRLSV

SEQ ID NO: 310166 - protein, 9 aa, Homo Sapiens
RKGNKGKRD

SEQ ID NO: 310167 - protein, 9 aa, Homo Sapiens
NSFKKPKII

SEQ ID NO: 310168 - protein, 9 aa, Homo Sapiens
QHWIIHTGE

SEQ ID NO: 310169 - protein, 9 aa, Homo Sapiens
FREQIVRVK

SEQ ID NO: 310170 - protein, 9 aa, Homo Sapiens
IATTYSSLS

SEQ ID NO: 310171 - protein, 9 aa, Homo Sapiens
SSIKGSKNY

SEQ ID NO: 310172 - protein, 9 aa, Homo Sapiens
QFVVYRDLK

SEQ ID NO: 310173 - protein, 9 aa, Homo Sapiens
TRLQLQGEP

SEQ ID NO: 310174 - protein, 9 aa, Homo Sapiens
TESLQPSET

SEQ ID NO: 310175 - protein, 9 aa, Homo Sapiens
ACECTESPH

SEQ ID NO: 310176 - protein, 9 aa, Homo Sapiens
TLIEWWREN

SEQ ID NO: 310177 - protein, 9 aa, Homo Sapiens
FEDKCYGEI

SEQ ID NO: 310178 - protein, 9 aa, Homo Sapiens
VLCELIHAL

SEQ ID NO: 310179 - protein, 9 aa, Homo Sapiens
EKSYMTFLK

SEQ ID NO: 310180 - protein, 9 aa, Homo Sapiens
GSRSSTSTS

SEQ ID NO: 310181 - protein, 9 aa, Homo Sapiens
LYNNHDIRS

SEQ ID NO: 310182 - protein, 9 aa, Homo Sapiens
QSQNLLVKG

SEQ ID NO: 310183 - protein, 9 aa, Homo Sapiens
DYSDLKILR

SEQ ID NO: 310184 - protein, 9 aa, Homo Sapiens
FWGCITQIF

SEQ ID NO: 310185 - protein, 9 aa, Homo Sapiens
TKDQSHDIG

SEQ ID NO: 310186 - protein, 9 aa, Homo Sapiens
TIPHIFCNV

SEQ ID NO: 310187 - protein, 9 aa, Homo Sapiens
GSSLHVRCA

SEQ ID NO: 310188 - protein, 9 aa, Homo Sapiens
YPLKAGETI

SEQ ID NO: 310189 - protein, 9 aa, Homo Sapiens
PLMLIGNIV

SEQ ID NO: 310190 - protein, 9 aa, Homo Sapiens
PTSFMRASV

SEQ ID NO: 310191 - protein, 9 aa, Homo Sapiens
SRIIHQRTH

SEQ ID NO: 310192 - protein, 9 aa, Homo Sapiens
ACKTKEREK

SEQ ID NO: 310193 - protein, 9 aa, Homo Sapiens
TFARNTSRI

SEQ ID NO: 310194 - protein, 9 aa, Homo Sapiens
ANYLLQPEL

SEQ ID NO: 310195 - protein, 9 aa, Homo Sapiens
RDKFHSNSD

SEQ ID NO: 310196 - protein, 9 aa, Homo Sapiens
GKRIEDSLI

SEQ ID NO: 310197 - protein, 9 aa, Homo Sapiens
AGCLTQSFF

SEQ ID NO: 310198 - protein, 9 aa, Homo Sapiens
LTIPNNLVG

SEQ ID NO: 310199 - protein, 9 aa, Homo Sapiens
AVLFNITED

SEQ ID NO: 310200 - protein, 9 aa, Homo Sapiens
DVPLYKKIC

SEQ ID NO: 310201 - protein, 9 aa, Homo Sapiens
TLYGEIDKL

SEQ ID NO: 310202 - protein, 9 aa, Homo Sapiens
ECGKSFSVH

SEQ ID NO: 310203 - protein, 9 aa, Homo Sapiens
KCYGEISQE

SEQ ID NO: 310204 - protein, 9 aa, Homo Sapiens
SSLQIHVRT

SEQ ID NO: 310205 - protein, 9 aa, Homo Sapiens
QLILNLEQQ

SEQ ID NO: 310206 - protein, 9 aa, Homo Sapiens
MIFEKRSTQ

SEQ ID NO: 310207 - protein, 9 aa, Homo Sapiens
SGESLLQSQ

SEQ ID NO: 310208 - protein, 9 aa, Homo Sapiens
TTSSPEPEQ

SEQ ID NO: 310209 - protein, 9 aa, Homo Sapiens
ENMTDDPQS

SEQ ID NO: 310210 - protein, 9 aa, Homo Sapiens
HLLMVLEKI

SEQ ID NO: 310211 - protein, 9 aa, Homo Sapiens
TLNSSLLRP

SEQ ID NO: 310212 - protein, 9 aa, Homo Sapiens
SYIITTILK

SEQ ID NO: 310213 - protein, 9 aa, Homo Sapiens
YVNQLKDNS

SEQ ID NO: 310214 - protein, 9 aa, Homo Sapiens
ISSKSFINS

SEQ ID NO: 310215 - protein, 9 aa, Homo Sapiens
PADSGRYWA

SEQ ID NO: 310216 - protein, 9 aa, Homo Sapiens
EYKNYLRKT

SEQ ID NO: 310217 - protein, 9 aa, Homo Sapiens
GLPRDWLWG

SEQ ID NO: 310218 - protein, 9 aa, Homo Sapiens
HETWKESVM

SEQ ID NO: 310219 - protein, 9 aa, Homo Sapiens
LGFFMAEEV

SEQ ID NO: 310220 - protein, 9 aa, Homo Sapiens
NFGKMLDNI

SEQ ID NO: 310221 - protein, 9 aa, Homo Sapiens
SGLASSLIN

SEQ ID NO: 310222 - protein, 9 aa, Homo Sapiens
YPESLCPAF

SEQ ID NO: 310223 - protein, 9 aa, Homo Sapiens
HTADVKGGS

SEQ ID NO: 310224 - protein, 9 aa, Homo Sapiens
NHLDLRQEG

SEQ ID NO: 310225 - protein, 9 aa, Homo Sapiens
SVLSVYTHG

SEQ ID NO: 310226 - protein, 9 aa, Homo Sapiens
TKKKLLITG

SEQ ID NO: 310227 - protein, 9 aa, Homo Sapiens
PTDNTFATC

SEQ ID NO: 310228 - protein, 9 aa, Homo Sapiens
NITPQFFAF

SEQ ID NO: 310229 - protein, 9 aa, Homo Sapiens
GCLVHLMTL

SEQ ID NO: 310230 - protein, 9 aa, Homo Sapiens
ITKKHIQLK

SEQ ID NO: 310231 - protein, 9 aa, Homo Sapiens
ISDFTQEIL

SEQ ID NO: 310232 - protein, 9 aa, Homo Sapiens
INQQLPVAT

SEQ ID NO: 310233 - protein, 9 aa, Homo Sapiens
LNTNYRFLH

SEQ ID NO: 310234 - protein, 9 aa, Homo Sapiens
YANMYASIL

SEQ ID NO: 310235 - protein, 9 aa, Homo Sapiens
TRYSRRTLQ

SEQ ID NO: 310236 - protein, 9 aa, Homo Sapiens
ALFCITNIL

SEQ ID NO: 310237 - protein, 9 aa, Homo Sapiens
CDAAKHRLV

SEQ ID NO: 310238 - protein, 9 aa, Homo Sapiens
IASAICEEI

SEQ ID NO: 310239 - protein, 9 aa, Homo Sapiens
AMKSGSLAA

SEQ ID NO: 310240 - protein, 9 aa, Homo Sapiens
IINRDLKPS

SEQ ID NO: 310241 - protein, 9 aa, Homo Sapiens
NKGYRHIPL

SEQ ID NO: 310242 - protein, 9 aa, Homo Sapiens
VQIWFQHRR

SEQ ID NO: 310243 - protein, 9 aa, Homo Sapiens
RTQNQVLIN

SEQ ID NO: 310244 - protein, 9 aa, Homo Sapiens
FSIYFLSSL

SEQ ID NO: 310245 - protein, 9 aa, Homo Sapiens
LKRGKEACT

SEQ ID NO: 310246 - protein, 9 aa, Homo Sapiens
TIGVLSPSS

SEQ ID NO: 310247 - protein, 9 aa, Homo Sapiens
GICLQSEGS

SEQ ID NO: 310248 - protein, 9 aa, Homo Sapiens
VEQAFRAIN

SEQ ID NO: 310249 - protein, 9 aa, Homo Sapiens
IFAKEHLQH

SEQ ID NO: 310250 - protein, 9 aa, Homo Sapiens
NLWDAPPAW

SEQ ID NO: 310251 - protein, 9 aa, Homo Sapiens
YPHLLEAIP

SEQ ID NO: 310252 - protein, 9 aa, Homo Sapiens
PQSQQCFII

SEQ ID NO: 310253 - protein, 9 aa, Homo Sapiens
ENVNDVDYD

SEQ ID NO: 310254 - protein, 9 aa, Homo Sapiens
SIPFVVDEQ

SEQ ID NO: 310255 - protein, 9 aa, Homo Sapiens
IHLENNENK

SEQ ID NO: 310256 - protein, 9 aa, Homo Sapiens
TYRCNKCGK

SEQ ID NO: 310257 - protein, 9 aa, Homo Sapiens
FLAPCMRDL

SEQ ID NO: 310258 - protein, 9 aa, Homo Sapiens
LFTLLNKHG

SEQ ID NO: 310259 - protein, 9 aa, Homo Sapiens
EERIMECSA

SEQ ID NO: 310260 - protein, 9 aa, Homo Sapiens
LRYQKPDEY

SEQ ID NO: 310261 - protein, 9 aa, Homo Sapiens
SLVDYSSSS

SEQ ID NO: 310262 - protein, 9 aa, Homo Sapiens
EAAPKCALY

SEQ ID NO: 310263 - protein, 9 aa, Homo Sapiens
HHDTFTNTY

SEQ ID NO: 310264 - protein, 9 aa, Homo Sapiens
IDSLAPLDK

SEQ ID NO: 310265 - protein, 9 aa, Homo Sapiens
CKLEYKTED

SEQ ID NO: 310266 - protein, 9 aa, Homo Sapiens
GALLVLGLL

SEQ ID NO: 310267 - protein, 9 aa, Homo Sapiens
RIRKPFFHS

SEQ ID NO: 310268 - protein, 9 aa, Homo Sapiens
ALYGNAVLI

SEQ ID NO: 310269 - protein, 9 aa, Homo Sapiens
AEINQQLPV

SEQ ID NO: 310270 - protein, 9 aa, Homo Sapiens
RKFKETNKQ

SEQ ID NO: 310271 - protein, 9 aa, Homo Sapiens
TSPPNALPQ

SEQ ID NO: 310272 - protein, 9 aa, Homo Sapiens
RHFSIYFLS

SEQ ID NO: 310273 - protein, 9 aa, Homo Sapiens
KISWLYRIL

SEQ ID NO: 310274 - protein, 9 aa, Homo Sapiens
VFFVFVLFF

SEQ ID NO: 310275 - protein, 9 aa, Homo Sapiens
LQMYNPTTT

SEQ ID NO: 310276 - protein, 9 aa, Homo Sapiens
EENKGGPPG

SEQ ID NO: 310277 - protein, 9 aa, Homo Sapiens
PQTIPLNGQ

SEQ ID NO: 310278 - protein, 9 aa, Homo Sapiens
FYAAPMTLL

SEQ ID NO: 310279 - protein, 9 aa, Homo Sapiens
SMSRLHLCD

SEQ ID NO: 310280 - protein, 9 aa, Homo Sapiens
WLFNLLKTG

SEQ ID NO: 310281 - protein, 9 aa, Homo Sapiens
FSLLVMALD

SEQ ID NO: 310282 - protein, 9 aa, Homo Sapiens
GLVSLCLMN

SEQ ID NO: 310283 - protein, 9 aa, Homo Sapiens
THQILHSRE

SEQ ID NO: 310284 - protein, 9 aa, Homo Sapiens
GNYPPFKGR

SEQ ID NO: 310285 - protein, 9 aa, Homo Sapiens
EYYDRTAQM

SEQ ID NO: 310286 - protein, 9 aa, Homo Sapiens
SVQGRQKSL

SEQ ID NO: 310287 - protein, 9 aa, Homo Sapiens
GVSEDVIYR

SEQ ID NO: 310288 - protein, 9 aa, Homo Sapiens
IIETMTMTE

SEQ ID NO: 310289 - protein, 9 aa, Homo Sapiens
NRSYHLIGH

SEQ ID NO: 310290 - protein, 9 aa, Homo Sapiens
YIDLNATFD

SEQ ID NO: 310291 - protein, 9 aa, Homo Sapiens
TGKRPYECS

SEQ ID NO: 310292 - protein, 9 aa, Homo Sapiens
GQCWVDDKV

SEQ ID NO: 310293 - protein, 9 aa, Homo Sapiens
KTISFHGCM

SEQ ID NO: 310294 - protein, 9 aa, Homo Sapiens
CALSTSPLV

SEQ ID NO: 310295 - protein, 9 aa, Homo Sapiens
FYLFTGSSQ

SEQ ID NO: 310296 - protein, 9 aa, Homo Sapiens
SVIGRMVMM

SEQ ID NO: 310297 - protein, 9 aa, Homo Sapiens
NIAKLMPLL

SEQ ID NO: 310298 - protein, 9 aa, Homo Sapiens
VNYCILRVN

SEQ ID NO: 310299 - protein, 9 aa, Homo Sapiens
ATSLGSQKG

SEQ ID NO: 310300 - protein, 9 aa, Homo Sapiens
KFAQTKLWM

SEQ ID NO: 310301 - protein, 9 aa, Homo Sapiens
YSENIFTSA

SEQ ID NO: 310302 - protein, 9 aa, Homo Sapiens
EAAKFVDII

SEQ ID NO: 310303 - protein, 9 aa, Homo Sapiens
ELCPLVVPN

SEQ ID NO: 310304 - protein, 9 aa, Homo Sapiens
KQQTPSQTH

SEQ ID NO: 310305 - protein, 9 aa, Homo Sapiens
DGRKFDFEA

SEQ ID NO: 310306 - protein, 9 aa, Homo Sapiens
KRSRGFCFV

SEQ ID NO: 310307 - protein, 9 aa, Homo Sapiens
RARRELAPK

SEQ ID NO: 310308 - protein, 9 aa, Homo Sapiens
QVSRRGALT

SEQ ID NO: 310309 - protein, 9 aa, Homo Sapiens
MAVGQIMTC

SEQ ID NO: 310310 - protein, 9 aa, Homo Sapiens
IKQVKDNLL

SEQ ID NO: 310311 - protein, 9 aa, Homo Sapiens
ELFPVSHVR

SEQ ID NO: 310312 - protein, 9 aa, Homo Sapiens
REEEEEELN

SEQ ID NO: 310313 - protein, 9 aa, Homo Sapiens
SSIPEGVRL

SEQ ID NO: 310314 - protein, 9 aa, Homo Sapiens
ESCNSPNVT

SEQ ID NO: 310315 - protein, 9 aa, Homo Sapiens
RYLMEEEAV

SEQ ID NO: 310316 - protein, 9 aa, Homo Sapiens
YPFVTSQLY

SEQ ID NO: 310317 - protein, 9 aa, Homo Sapiens
QEHQNRVFH

SEQ ID NO: 310318 - protein, 9 aa, Homo Sapiens
EDSKIKYED

SEQ ID NO: 310319 - protein, 9 aa, Homo Sapiens
DYEQEKVIL

SEQ ID NO: 310320 - protein, 9 aa, Homo Sapiens
GPSTFYFVP

SEQ ID NO: 310321 - protein, 9 aa, Homo Sapiens
LIHNNVLES

SEQ ID NO: 310322 - protein, 9 aa, Homo Sapiens
PGETITKMY

SEQ ID NO: 310323 - protein, 9 aa, Homo Sapiens
SYFLFGSSA

SEQ ID NO: 310324 - protein, 9 aa, Homo Sapiens
SNELASGFF

SEQ ID NO: 310325 - protein, 9 aa, Homo Sapiens
EIESLKKQL

SEQ ID NO: 310326 - protein, 9 aa, Homo Sapiens
KTITMLEMK

SEQ ID NO: 310327 - protein, 9 aa, Homo Sapiens
SPPNALPQR

SEQ ID NO: 310328 - protein, 9 aa, Homo Sapiens
ELSSKTESI

SEQ ID NO: 310329 - protein, 9 aa, Homo Sapiens
DLWAKTIVK

SEQ ID NO: 310330 - protein, 9 aa, Homo Sapiens
AGEDFPPPS

SEQ ID NO: 310331 - protein, 9 aa, Homo Sapiens
YTPSTTSLV

SEQ ID NO: 310332 - protein, 9 aa, Homo Sapiens
TKLLIAAQR

SEQ ID NO: 310333 - protein, 9 aa, Homo Sapiens
YTPSTTSLA

SEQ ID NO: 310334 - protein, 9 aa, Homo Sapiens
VENCEQVST

SEQ ID NO: 310335 - protein, 9 aa, Homo Sapiens
ALNRVCWAQ

SEQ ID NO: 310336 - protein, 9 aa, Homo Sapiens
FLRSLWDTV

SEQ ID NO: 310337 - protein, 9 aa, Homo Sapiens
LHYDVGMKP

SEQ ID NO: 310338 - protein, 9 aa, Homo Sapiens
DSDLSHAFQ

SEQ ID NO: 310339 - protein, 9 aa, Homo Sapiens
DALSWTFLG

SEQ ID NO: 310340 - protein, 9 aa, Homo Sapiens
MDPIISKYR

SEQ ID NO: 310341 - protein, 9 aa, Homo Sapiens
FIFKLLILQ

SEQ ID NO: 310342 - protein, 9 aa, Homo Sapiens
FQYQDNINN

SEQ ID NO: 310343 - protein, 9 aa, Homo Sapiens
IFDFPYHLQ

SEQ ID NO: 310344 - protein, 9 aa, Homo Sapiens
ICTEPSVHQ

SEQ ID NO: 310345 - protein, 9 aa, Homo Sapiens
IRVPGNRSL

SEQ ID NO: 310346 - protein, 9 aa, Homo Sapiens
GHKNKEPDD

SEQ ID NO: 310347 - protein, 9 aa, Homo Sapiens
AVKLVNDSL

SEQ ID NO: 310348 - protein, 9 aa, Homo Sapiens
AKPVTRGVG

SEQ ID NO: 310349 - protein, 9 aa, Homo Sapiens
LFTTVSIPK

SEQ ID NO: 310350 - protein, 9 aa, Homo Sapiens
GEVTRQMGD

SEQ ID NO: 310351 - protein, 9 aa, Homo Sapiens
SQVGLGPRT

SEQ ID NO: 310352 - protein, 9 aa, Homo Sapiens
EESDGKRIE

SEQ ID NO: 310353 - protein, 9 aa, Homo Sapiens
GYADNSCNK

SEQ ID NO: 310354 - protein, 9 aa, Homo Sapiens
REFVFNAIE

SEQ ID NO: 310355 - protein, 9 aa, Homo Sapiens
DNCEAVPHR

SEQ ID NO: 310356 - protein, 9 aa, Homo Sapiens
KMYETTTTR

SEQ ID NO: 310357 - protein, 9 aa, Homo Sapiens
SNLIQHQII

SEQ ID NO: 310358 - protein, 9 aa, Homo Sapiens
HRRPGDCFL

SEQ ID NO: 310359 - protein, 9 aa, Homo Sapiens
SSLTKHKNI

SEQ ID NO: 310360 - protein, 9 aa, Homo Sapiens
CLIEKLDRL

SEQ ID NO: 310361 - protein, 9 aa, Homo Sapiens
FSYRGEKIL

SEQ ID NO: 310362 - protein, 9 aa, Homo Sapiens
LGGITEEYL

SEQ ID NO: 310363 - protein, 9 aa, Homo Sapiens
VSAMEELVK

SEQ ID NO: 310364 - protein, 9 aa, Homo Sapiens
HPNNNKYFG

SEQ ID NO: 310365 - protein, 9 aa, Homo Sapiens
CNPLRYQII

SEQ ID NO: 310366 - protein, 9 aa, Homo Sapiens
SLSLFFVFP

SEQ ID NO: 310367 - protein, 9 aa, Homo Sapiens
EEDDEDFKT

SEQ ID NO: 310368 - protein, 9 aa, Homo Sapiens
QIFVYVSLL

SEQ ID NO: 310369 - protein, 9 aa, Homo Sapiens
PMGVHPSLA

SEQ ID NO: 310370 - protein, 9 aa, Homo Sapiens
HLVGPRGPH

SEQ ID NO: 310371 - protein, 9 aa, Homo Sapiens
RTNQYWEKI

SEQ ID NO: 310372 - protein, 9 aa, Homo Sapiens
IIGVVGGCQ

SEQ ID NO: 310373 - protein, 9 aa, Homo Sapiens
VFKEEDPSH

SEQ ID NO: 310374 - protein, 9 aa, Homo Sapiens
KKTKKNHKM

SEQ ID NO: 310375 - protein, 9 aa, Homo Sapiens
SFAIKLFSA

SEQ ID NO: 310376 - protein, 9 aa, Homo Sapiens
KFVKTLKWG

SEQ ID NO: 310377 - protein, 9 aa, Homo Sapiens
VDNTVYRQK

SEQ ID NO: 310378 - protein, 9 aa, Homo Sapiens
MAHKIMKMI

SEQ ID NO: 310379 - protein, 9 aa, Homo Sapiens
NKNKLLSSQ

SEQ ID NO: 310380 - protein, 9 aa, Homo Sapiens
CLHNLPRAV

SEQ ID NO: 310381 - protein, 9 aa, Homo Sapiens
IYKIIRHED

SEQ ID NO: 310382 - protein, 9 aa, Homo Sapiens
VGNWQGFYC

SEQ ID NO: 310383 - protein, 9 aa, Homo Sapiens
VHSIVSYFA

SEQ ID NO: 310384 - protein, 9 aa, Homo Sapiens
GDYQIIQYI

SEQ ID NO: 310385 - protein, 9 aa, Homo Sapiens
SSVYRNGTY

SEQ ID NO: 310386 - protein, 9 aa, Homo Sapiens
FYNMRDRLH

SEQ ID NO: 310387 - protein, 9 aa, Homo Sapiens
DKLARLNLE

SEQ ID NO: 310388 - protein, 9 aa, Homo Sapiens
KGEENSTFL

SEQ ID NO: 310389 - protein, 9 aa, Homo Sapiens
YNFRYATYY

SEQ ID NO: 310390 - protein, 9 aa, Homo Sapiens
EAYIHRASL

SEQ ID NO: 310391 - protein, 9 aa, Homo Sapiens
MKKLFRRVA

SEQ ID NO: 310392 - protein, 9 aa, Homo Sapiens
SLNDMHSEE

SEQ ID NO: 310393 - protein, 9 aa, Homo Sapiens
DISVAKIDS

SEQ ID NO: 310394 - protein, 9 aa, Homo Sapiens
QLCDNYIYF

SEQ ID NO: 310395 - protein, 9 aa, Homo Sapiens
SLKRVTVVE

SEQ ID NO: 310396 - protein, 9 aa, Homo Sapiens
LRKKRVSQP

SEQ ID NO: 310397 - protein, 9 aa, Homo Sapiens
NIREKTYAH

SEQ ID NO: 310398 - protein, 9 aa, Homo Sapiens
QQAKCRDPT

SEQ ID NO: 310399 - protein, 9 aa, Homo Sapiens
TMLTGHSLM

SEQ ID NO: 310400 - protein, 9 aa, Homo Sapiens
EKDLMNAYL

SEQ ID NO: 310401 - protein, 9 aa, Homo Sapiens
SFKQCSRMY

SEQ ID NO: 310402 - protein, 9 aa, Homo Sapiens
SPLVACAKV

SEQ ID NO: 310403 - protein, 9 aa, Homo Sapiens
CRVSSPVMV

SEQ ID NO: 310404 - protein, 9 aa, Homo Sapiens
PLWPELIES

SEQ ID NO: 310405 - protein, 9 aa, Homo Sapiens
SKRERVKII

SEQ ID NO: 310406 - protein, 9 aa, Homo Sapiens
VIGRMVMMA

SEQ ID NO: 310407 - protein, 9 aa, Homo Sapiens
KSTLESGLT

SEQ ID NO: 310408 - protein, 9 aa, Homo Sapiens
QLVMQQQRQ

SEQ ID NO: 310409 - protein, 9 aa, Homo Sapiens
SPEDICQMA

SEQ ID NO: 310410 - protein, 9 aa, Homo Sapiens
HSIVSYFAF

SEQ ID NO: 310411 - protein, 9 aa, Homo Sapiens
AVSDKKILL

SEQ ID NO: 310412 - protein, 9 aa, Homo Sapiens
HGSWQWEDG

SEQ ID NO: 310413 - protein, 9 aa, Homo Sapiens
CTHYLPIED

SEQ ID NO: 310414 - protein, 9 aa, Homo Sapiens
NYLDESTQE

SEQ ID NO: 310415 - protein, 9 aa, Homo Sapiens
QKEMVRADL

SEQ ID NO: 310416 - protein, 9 aa, Homo Sapiens
NLGDSLHQQ

SEQ ID NO: 310417 - protein, 9 aa, Homo Sapiens
SGCFLQLYF

SEQ ID NO: 310418 - protein, 9 aa, Homo Sapiens
RITIYLIER

SEQ ID NO: 310419 - protein, 9 aa, Homo Sapiens
YEFAVQLHV

SEQ ID NO: 310420 - protein, 9 aa, Homo Sapiens
YGEQSENTS

SEQ ID NO: 310421 - protein, 9 aa, Homo Sapiens
LIHALYPEG

SEQ ID NO: 310422 - protein, 9 aa, Homo Sapiens
NLEETIECN

SEQ ID NO: 310423 - protein, 9 aa, Homo Sapiens
KAFTTFLSL

SEQ ID NO: 310424 - protein, 9 aa, Homo Sapiens
TVGSSSEII

SEQ ID NO: 310425 - protein, 9 aa, Homo Sapiens
YNIKLPAGS

SEQ ID NO: 310426 - protein, 9 aa, Homo Sapiens
GMQKIETLL

SEQ ID NO: 310427 - protein, 9 aa, Homo Sapiens
SREQSYKYN

SEQ ID NO: 310428 - protein, 9 aa, Homo Sapiens
ALNSLHLSF

SEQ ID NO: 310429 - protein, 9 aa, Homo Sapiens
LWAVRASSI

SEQ ID NO: 310430 - protein, 9 aa, Homo Sapiens
DKKILLEAL

SEQ ID NO: 310431 - protein, 9 aa, Homo Sapiens
VAVSKQYPV

SEQ ID NO: 310432 - protein, 9 aa, Homo Sapiens
PQLVNQQMV

SEQ ID NO: 310433 - protein, 9 aa, Homo Sapiens
VSIEELFGD

SEQ ID NO: 310434 - protein, 9 aa, Homo Sapiens
CTNQNAISS

SEQ ID NO: 310435 - protein, 9 aa, Homo Sapiens
CECAQSELQ

SEQ ID NO: 310436 - protein, 9 aa, Homo Sapiens
ASVECLLER

SEQ ID NO: 310437 - protein, 9 aa, Homo Sapiens
MEQSVPFKY

SEQ ID NO: 310438 - protein, 9 aa, Homo Sapiens
NPLIYSVNN

SEQ ID NO: 310439 - protein, 9 aa, Homo Sapiens
PEKHLNYLG

SEQ ID NO: 310440 - protein, 9 aa, Homo Sapiens
NTYGNYYRL

SEQ ID NO: 310441 - protein, 9 aa, Homo Sapiens
RSTNKISWL

SEQ ID NO: 310442 - protein, 9 aa, Homo Sapiens
ACQKCHKLL

SEQ ID NO: 310443 - protein, 9 aa, Homo Sapiens
HTSCGKKLA

SEQ ID NO: 310444 - protein, 9 aa, Homo Sapiens
ITILRVKFK

SEQ ID NO: 310445 - protein, 9 aa, Homo Sapiens
RLSLGPQTH

SEQ ID NO: 310446 - protein, 9 aa, Homo Sapiens
QCELDCDEC

SEQ ID NO: 310447 - protein, 9 aa, Homo Sapiens
QIIIENLFY

SEQ ID NO: 310448 - protein, 9 aa, Homo Sapiens
IDTINGKLE

SEQ ID NO: 310449 - protein, 9 aa, Homo Sapiens
EAEVFSTDL

SEQ ID NO: 310450 - protein, 9 aa, Homo Sapiens
ADWNEWTND

SEQ ID NO: 310451 - protein, 9 aa, Homo Sapiens
RAWQASLEG

SEQ ID NO: 310452 - protein, 9 aa, Homo Sapiens
LKCLMKGKG

SEQ ID NO: 310453 - protein, 9 aa, Homo Sapiens
QKPDEYDQL

SEQ ID NO: 310454 - protein, 9 aa, Homo Sapiens
SIHKWREEQ

SEQ ID NO: 310455 - protein, 9 aa, Homo Sapiens
LQSEGHFYL

SEQ ID NO: 310456 - protein, 9 aa, Homo Sapiens
TNRPNNIDP

SEQ ID NO: 310457 - protein, 9 aa, Homo Sapiens
VEPLGLDNG

SEQ ID NO: 310458 - protein, 9 aa, Homo Sapiens
TVSSFFLKH

SEQ ID NO: 310459 - protein, 9 aa, Homo Sapiens
RLSLISTFR

SEQ ID NO: 310460 - protein, 9 aa, Homo Sapiens
NANAILQID

SEQ ID NO: 310461 - protein, 9 aa, Homo Sapiens
LSFRVFYNK

SEQ ID NO: 310462 - protein, 9 aa, Homo Sapiens
DQSHDIGLH

SEQ ID NO: 310463 - protein, 9 aa, Homo Sapiens
KVAKSANKV

SEQ ID NO: 310464 - protein, 9 aa, Homo Sapiens
AIFEITIGL

SEQ ID NO: 310465 - protein, 9 aa, Homo Sapiens
DICQMALNQ

SEQ ID NO: 310466 - protein, 9 aa, Homo Sapiens
WNIETATSF

SEQ ID NO: 310467 - protein, 9 aa, Homo Sapiens
KRVQIWKAP

SEQ ID NO: 310468 - protein, 9 aa, Homo Sapiens
AGRKWKTFF

SEQ ID NO: 310469 - protein, 9 aa, Homo Sapiens
DEFTNWSII

SEQ ID NO: 310470 - protein, 9 aa, Homo Sapiens
ENCILLSIF

SEQ ID NO: 310471 - protein, 9 aa, Homo Sapiens
EKILTMLTG

SEQ ID NO: 310472 - protein, 9 aa, Homo Sapiens
IQHSLVSTS

SEQ ID NO: 310473 - protein, 9 aa, Homo Sapiens
GNKIIHLIK

SEQ ID NO: 310474 - protein, 9 aa, Homo Sapiens
RQGEDQEHL

SEQ ID NO: 310475 - protein, 9 aa, Homo Sapiens
YQRLFQALP

SEQ ID NO: 310476 - protein, 9 aa, Homo Sapiens
QQYSQEHAL

SEQ ID NO: 310477 - protein, 9 aa, Homo Sapiens
SRKIIYIED

SEQ ID NO: 310478 - protein, 9 aa, Homo Sapiens
PNNNKYFGF

SEQ ID NO: 310479 - protein, 9 aa, Homo Sapiens
KRFCFDDSL

SEQ ID NO: 310480 - protein, 9 aa, Homo Sapiens
QESNDSHYR

SEQ ID NO: 310481 - protein, 9 aa, Homo Sapiens
VGTFLLLSV

SEQ ID NO: 310482 - protein, 9 aa, Homo Sapiens
QLSNEFHID

SEQ ID NO: 310483 - protein, 9 aa, Homo Sapiens
GLSQERVAE

SEQ ID NO: 310484 - protein, 9 aa, Homo Sapiens
VKLYEFYLS

SEQ ID NO: 310485 - protein, 9 aa, Homo Sapiens
QINLYRDVM

SEQ ID NO: 310486 - protein, 9 aa, Homo Sapiens
LGLVPIKYS

SEQ ID NO: 310487 - protein, 9 aa, Homo Sapiens
DMRSIVIRV

SEQ ID NO: 310488 - protein, 9 aa, Homo Sapiens
RKIIYMFLP

SEQ ID NO: 310489 - protein, 9 aa, Homo Sapiens
SLNNRIELK

SEQ ID NO: 310490 - protein, 9 aa, Homo Sapiens
SFGPVSYHD

SEQ ID NO: 310491 - protein, 9 aa, Homo Sapiens
WVFKEEDPS

SEQ ID NO: 310492 - protein, 9 aa, Homo Sapiens
FVRDFDPVH

SEQ ID NO: 310493 - protein, 9 aa, Homo Sapiens
KNNLEYAAT

SEQ ID NO: 310494 - protein, 9 aa, Homo Sapiens
NDTTELQVW

SEQ ID NO: 310495 - protein, 9 aa, Homo Sapiens
GILMYTIAS

SEQ ID NO: 310496 - protein, 9 aa, Homo Sapiens
RDPCPHMGQ

SEQ ID NO: 310497 - protein, 9 aa, Homo Sapiens
IPLWSQWVI

SEQ ID NO: 310498 - protein, 9 aa, Homo Sapiens
DFLQCLAQL

SEQ ID NO: 310499 - protein, 9 aa, Homo Sapiens
GQIITSTGQ

SEQ ID NO: 310500 - protein, 9 aa, Homo Sapiens
EKGFCYKGS

SEQ ID NO: 310501 - protein, 9 aa, Homo Sapiens
IYHILIKNN

SEQ ID NO: 310502 - protein, 9 aa, Homo Sapiens
AQLRVFGTG

SEQ ID NO: 310503 - protein, 9 aa, Homo Sapiens
KQPCVCSSL

SEQ ID NO: 310504 - protein, 9 aa, Homo Sapiens
AGMTPVRED

SEQ ID NO: 310505 - protein, 9 aa, Homo Sapiens
GEFWLGLKN

SEQ ID NO: 310506 - protein, 9 aa, Homo Sapiens
GNQFRANYL

SEQ ID NO: 310507 - protein, 9 aa, Homo Sapiens
QGHQIPALL

SEQ ID NO: 310508 - protein, 9 aa, Homo Sapiens
TSGHNEIQL

SEQ ID NO: 310509 - protein, 9 aa, Homo Sapiens
IQSSETCLS

SEQ ID NO: 310510 - protein, 9 aa, Homo Sapiens
IHRPPPPGH

SEQ ID NO: 310511 - protein, 9 aa, Homo Sapiens
RQLFESENF

SEQ ID NO: 310512 - protein, 9 aa, Homo Sapiens
GNNTMNISI

SEQ ID NO: 310513 - protein, 9 aa, Homo Sapiens
YQPDGLSDI

SEQ ID NO: 310514 - protein, 9 aa, Homo Sapiens
THAGEKPYV

SEQ ID NO: 310515 - protein, 9 aa, Homo Sapiens
TISEQLQKD

SEQ ID NO: 310516 - protein, 9 aa, Homo Sapiens
VLVQQYLAQ

SEQ ID NO: 310517 - protein, 9 aa, Homo Sapiens
KMNYFMDIS

SEQ ID NO: 310518 - protein, 9 aa, Homo Sapiens
ELPVADPLM

SEQ ID NO: 310519 - protein, 9 aa, Homo Sapiens
LSAYRFKTV

SEQ ID NO: 310520 - protein, 9 aa, Homo Sapiens
GSPRINATR

SEQ ID NO: 310521 - protein, 9 aa, Homo Sapiens
LAKKESFGG

SEQ ID NO: 310522 - protein, 9 aa, Homo Sapiens
SSSSVSWKI

SEQ ID NO: 310523 - protein, 9 aa, Homo Sapiens
GYWKKHFTV

SEQ ID NO: 310524 - protein, 9 aa, Homo Sapiens
SSDDNVDSD

SEQ ID NO: 310525 - protein, 9 aa, Homo Sapiens
SPSKIDGRA

SEQ ID NO: 310526 - protein, 9 aa, Homo Sapiens
KVQELSKNE

SEQ ID NO: 310527 - protein, 9 aa, Homo Sapiens
KTKYSPGVF

SEQ ID NO: 310528 - protein, 9 aa, Homo Sapiens
GKYQLFAFV

SEQ ID NO: 310529 - protein, 9 aa, Homo Sapiens
EPRTAVKNC

SEQ ID NO: 310530 - protein, 9 aa, Homo Sapiens
CGGKMAETN

SEQ ID NO: 310531 - protein, 9 aa, Homo Sapiens
LPRKICCTD

SEQ ID NO: 310532 - protein, 9 aa, Homo Sapiens
QTHWEKFVS

SEQ ID NO: 310533 - protein, 9 aa, Homo Sapiens
EMIPAFQTF

SEQ ID NO: 310534 - protein, 9 aa, Homo Sapiens
LRDRKQLVI

SEQ ID NO: 310535 - protein, 9 aa, Homo Sapiens
SHQRIHTGD

SEQ ID NO: 310536 - protein, 9 aa, Homo Sapiens
LPLKFRDAE

SEQ ID NO: 310537 - protein, 9 aa, Homo Sapiens
HLFIHLFAN

SEQ ID NO: 310538 - protein, 9 aa, Homo Sapiens
PYDPAKSPS

SEQ ID NO: 310539 - protein, 9 aa, Homo Sapiens
ETDKSQSSK

SEQ ID NO: 310540 - protein, 9 aa, Homo Sapiens
KIETLLYAM

SEQ ID NO: 310541 - protein, 9 aa, Homo Sapiens
HSNFLFLSK

SEQ ID NO: 310542 - protein, 9 aa, Homo Sapiens
AEFWDGKIM

SEQ ID NO: 310543 - protein, 9 aa, Homo Sapiens
QSLFTLLNK

SEQ ID NO: 310544 - protein, 9 aa, Homo Sapiens
FSKSSYLII

SEQ ID NO: 310545 - protein, 9 aa, Homo Sapiens
LLQPELMPS

SEQ ID NO: 310546 - protein, 9 aa, Homo Sapiens
DEIRHSRKK

SEQ ID NO: 310547 - protein, 9 aa, Homo Sapiens
RSKSRQLLQ

SEQ ID NO: 310548 - protein, 9 aa, Homo Sapiens
NLTELVDGM

SEQ ID NO: 310549 - protein, 9 aa, Homo Sapiens
MGTRDDVPK

SEQ ID NO: 310550 - protein, 9 aa, Homo Sapiens
DNKVCNRYE

SEQ ID NO: 310551 - protein, 9 aa, Homo Sapiens
CSEAGMSTV

SEQ ID NO: 310552 - protein, 9 aa, Homo Sapiens
VYTHGRVSG

SEQ ID NO: 310553 - protein, 9 aa, Homo Sapiens
KQMKYSAVH

SEQ ID NO: 310554 - protein, 9 aa, Homo Sapiens
AAVWNDYSL

SEQ ID NO: 310555 - protein, 9 aa, Homo Sapiens
WPTEFKTVK

SEQ ID NO: 310556 - protein, 9 aa, Homo Sapiens
SEIILPMLL

SEQ ID NO: 310557 - protein, 9 aa, Homo Sapiens
GYYLSYVKA

SEQ ID NO: 310558 - protein, 9 aa, Homo Sapiens
CSVLEETES

SEQ ID NO: 310559 - protein, 9 aa, Homo Sapiens
SDLPRTFKF

SEQ ID NO: 310560 - protein, 9 aa, Homo Sapiens
LAVKRQKEN

SEQ ID NO: 310561 - protein, 9 aa, Homo Sapiens
SKARSSPKL

SEQ ID NO: 310562 - protein, 9 aa, Homo Sapiens
DKNEYLPLY

SEQ ID NO: 310563 - protein, 9 aa, Homo Sapiens
SMSCLDSIA

SEQ ID NO: 310564 - protein, 9 aa, Homo Sapiens
GGVRGNLLR

SEQ ID NO: 310565 - protein, 9 aa, Homo Sapiens
MYTIASAIC

SEQ ID NO: 310566 - protein, 9 aa, Homo Sapiens
KTMDSHIAE

SEQ ID NO: 310567 - protein, 9 aa, Homo Sapiens
FASIKNNKV

SEQ ID NO: 310568 - protein, 9 aa, Homo Sapiens
MEDEYKNPR

SEQ ID NO: 310569 - protein, 9 aa, Homo Sapiens
YSYIITTIL

SEQ ID NO: 310570 - protein, 9 aa, Homo Sapiens
IYLVEKYIE

SEQ ID NO: 310571 - protein, 9 aa, Homo Sapiens
CGKSLSSTS

SEQ ID NO: 310572 - protein, 9 aa, Homo Sapiens
ELSGDKILE

SEQ ID NO: 310573 - protein, 9 aa, Homo Sapiens
EQFMADPCL

SEQ ID NO: 310574 - protein, 9 aa, Homo Sapiens
ESRTLHINE

SEQ ID NO: 310575 - protein, 9 aa, Homo Sapiens
LLGPNGINT

SEQ ID NO: 310576 - protein, 9 aa, Homo Sapiens
KEKWKSSGN

SEQ ID NO: 310577 - protein, 9 aa, Homo Sapiens
RLDSGNKDS

SEQ ID NO: 310578 - protein, 9 aa, Homo Sapiens
GWQPNQKTL

SEQ ID NO: 310579 - protein, 9 aa, Homo Sapiens
ILTPGICLV

SEQ ID NO: 310580 - protein, 9 aa, Homo Sapiens
MQVGMATNI

SEQ ID NO: 310581 - protein, 9 aa, Homo Sapiens
GDSLGAGIA

SEQ ID NO: 310582 - protein, 9 aa, Homo Sapiens
LQLIQALLD

SEQ ID NO: 310583 - protein, 9 aa, Homo Sapiens
SGERFNKSI

SEQ ID NO: 310584 - protein, 9 aa, Homo Sapiens
WKSSGNNLE

SEQ ID NO: 310585 - protein, 9 aa, Homo Sapiens
YVCIRTTKD

SEQ ID NO: 310586 - protein, 9 aa, Homo Sapiens
ASHLPIVTL

SEQ ID NO: 310587 - protein, 9 aa, Homo Sapiens
TRVDQIIGK

SEQ ID NO: 310588 - protein, 9 aa, Homo Sapiens
YTCVDGINN

SEQ ID NO: 310589 - protein, 9 aa, Homo Sapiens
SDCLVILLR

SEQ ID NO: 310590 - protein, 9 aa, Homo Sapiens
SNYICHMGH

SEQ ID NO: 310591 - protein, 9 aa, Homo Sapiens
EDGRKFDFE

SEQ ID NO: 310592 - protein, 9 aa, Homo Sapiens
SYKRQAAPG

SEQ ID NO: 310593 - protein, 9 aa, Homo Sapiens
LIRYRNQIF

SEQ ID NO: 310594 - protein, 9 aa, Homo Sapiens
IETILHTLI

SEQ ID NO: 310595 - protein, 9 aa, Homo Sapiens
LSKNNPGVV

SEQ ID NO: 310596 - protein, 9 aa, Homo Sapiens
YPLPLQKEL

SEQ ID NO: 310597 - protein, 9 aa, Homo Sapiens
RSQSSDDRR

SEQ ID NO: 310598 - protein, 9 aa, Homo Sapiens
LKITFLEAG

SEQ ID NO: 310599 - protein, 9 aa, Homo Sapiens
REQHHPELE

SEQ ID NO: 310600 - protein, 9 aa, Homo Sapiens
EESQGLSFI

SEQ ID NO: 310601 - protein, 9 aa, Homo Sapiens
ITRIEGKEP

SEQ ID NO: 310602 - protein, 9 aa, Homo Sapiens
NIYSGIALF

SEQ ID NO: 310603 - protein, 9 aa, Homo Sapiens
KTYLSYLTA

SEQ ID NO: 310604 - protein, 9 aa, Homo Sapiens
RKYFQRITI

SEQ ID NO: 310605 - protein, 9 aa, Homo Sapiens
CLCGAACGV

SEQ ID NO: 310606 - protein, 9 aa, Homo Sapiens
YELEESTEK

SEQ ID NO: 310607 - protein, 9 aa, Homo Sapiens
MAVEMLKMF

SEQ ID NO: 310608 - protein, 9 aa, Homo Sapiens
SVQKLFNPH

SEQ ID NO: 310609 - protein, 9 aa, Homo Sapiens
KSDKTSGEK

SEQ ID NO: 310610 - protein, 9 aa, Homo Sapiens
TGVHMNILP

SEQ ID NO: 310611 - protein, 9 aa, Homo Sapiens
ELAHEILCL

SEQ ID NO: 310612 - protein, 9 aa, Homo Sapiens
FTIKNEKRE

SEQ ID NO: 310613 - protein, 9 aa, Homo Sapiens
VLLTQLGPQ

SEQ ID NO: 310614 - protein, 9 aa, Homo Sapiens
ITSESKDNC

SEQ ID NO: 310615 - protein, 9 aa, Homo Sapiens
RPSTRYSRR

SEQ ID NO: 310616 - protein, 9 aa, Homo Sapiens
VEVDMRSIV

SEQ ID NO: 310617 - protein, 9 aa, Homo Sapiens
QKQWKELSK

SEQ ID NO: 310618 - protein, 9 aa, Homo Sapiens
SPSLQNHYL

SEQ ID NO: 310619 - protein, 9 aa, Homo Sapiens
KDAIRRFAA

SEQ ID NO: 310620 - protein, 9 aa, Homo Sapiens
HWAAVKAFW

SEQ ID NO: 310621 - protein, 9 aa, Homo Sapiens
FSGTPGSVQ

SEQ ID NO: 310622 - protein, 9 aa, Homo Sapiens
NSEAVKLLL

SEQ ID NO: 310623 - protein, 9 aa, Homo Sapiens
YLVTIQENN

SEQ ID NO: 310624 - protein, 9 aa, Homo Sapiens
HFDKLPING

SEQ ID NO: 310625 - protein, 9 aa, Homo Sapiens
TEYMTFTLI

SEQ ID NO: 310626 - protein, 9 aa, Homo Sapiens
WTITSSLEK

SEQ ID NO: 310627 - protein, 9 aa, Homo Sapiens
KEAQLPVID

SEQ ID NO: 310628 - protein, 9 aa, Homo Sapiens
IAYIGLQFI

SEQ ID NO: 310629 - protein, 9 aa, Homo Sapiens
RRRNFDNSY

SEQ ID NO: 310630 - protein, 9 aa, Homo Sapiens
CRLREYYDR

SEQ ID NO: 310631 - protein, 9 aa, Homo Sapiens
KSMCMIMME

SEQ ID NO: 310632 - protein, 9 aa, Homo Sapiens
PKFWCQQTS

SEQ ID NO: 310633 - protein, 9 aa, Homo Sapiens
PLTAQMVMA

SEQ ID NO: 310634 - protein, 9 aa, Homo Sapiens
QLPVIDNKV

SEQ ID NO: 310635 - protein, 9 aa, Homo Sapiens
NGFGHFVQK

SEQ ID NO: 310636 - protein, 9 aa, Homo Sapiens
YFNQMETII

SEQ ID NO: 310637 - protein, 9 aa, Homo Sapiens
LNPELIFKH

SEQ ID NO: 310638 - protein, 9 aa, Homo Sapiens
NKKVLKDVV

SEQ ID NO: 310639 - protein, 9 aa, Homo Sapiens
KLNTKVTQQ

SEQ ID NO: 310640 - protein, 9 aa, Homo Sapiens
AQIGGRLLM

SEQ ID NO: 310641 - protein, 9 aa, Homo Sapiens
DDDNKTDKT

SEQ ID NO: 310642 - protein, 9 aa, Homo Sapiens
SGVFRKSVS

SEQ ID NO: 310643 - protein, 9 aa, Homo Sapiens
RRTETSLTE

SEQ ID NO: 310644 - protein, 9 aa, Homo Sapiens
QMETIIKEK

SEQ ID NO: 310645 - protein, 9 aa, Homo Sapiens
NLYNNDFDD

SEQ ID NO: 310646 - protein, 9 aa, Homo Sapiens
FTVSSFFLK

SEQ ID NO: 310647 - protein, 9 aa, Homo Sapiens
SLEAKERVN

SEQ ID NO: 310648 - protein, 9 aa, Homo Sapiens
KQINAVALV

SEQ ID NO: 310649 - protein, 9 aa, Homo Sapiens
VRPEEIPPM

SEQ ID NO: 310650 - protein, 9 aa, Homo Sapiens
LDKVPEKRD

SEQ ID NO: 310651 - protein, 9 aa, Homo Sapiens
CKKVMDVHK

SEQ ID NO: 310652 - protein, 9 aa, Homo Sapiens
SCDISLRPL

SEQ ID NO: 310653 - protein, 9 aa, Homo Sapiens
EDSLASGYQ

SEQ ID NO: 310654 - protein, 9 aa, Homo Sapiens
DGSEGIGSD

SEQ ID NO: 310655 - protein, 9 aa, Homo Sapiens
LCELIHALY

SEQ ID NO: 310656 - protein, 9 aa, Homo Sapiens
KHTKHKKEK

SEQ ID NO: 310657 - protein, 9 aa, Homo Sapiens
NIFHKDPNV

SEQ ID NO: 310658 - protein, 9 aa, Homo Sapiens
EQEKVVSML

SEQ ID NO: 310659 - protein, 9 aa, Homo Sapiens
VRKNKIFGY

SEQ ID NO: 310660 - protein, 9 aa, Homo Sapiens
INFILGSLK

SEQ ID NO: 310661 - protein, 9 aa, Homo Sapiens
QKHTVLVIA

SEQ ID NO: 310662 - protein, 9 aa, Homo Sapiens
DEVILKGLE

SEQ ID NO: 310663 - protein, 9 aa, Homo Sapiens
FSGLEMSIV

SEQ ID NO: 310664 - protein, 9 aa, Homo Sapiens
PNGPDRPFK

SEQ ID NO: 310665 - protein, 9 aa, Homo Sapiens
SPPLGLCVK

SEQ ID NO: 310666 - protein, 9 aa, Homo Sapiens
SPPKSPQTT

SEQ ID NO: 310667 - protein, 9 aa, Homo Sapiens
ISHIHYWVL

SEQ ID NO: 310668 - protein, 9 aa, Homo Sapiens
EHNNQIEAQ

SEQ ID NO: 310669 - protein, 9 aa, Homo Sapiens
IVEQPFPIN

SEQ ID NO: 310670 - protein, 9 aa, Homo Sapiens
NDCPFEITG

SEQ ID NO: 310671 - protein, 9 aa, Homo Sapiens
GTMSVEDFL

SEQ ID NO: 310672 - protein, 9 aa, Homo Sapiens
EDPSHLRCH

SEQ ID NO: 310673 - protein, 9 aa, Homo Sapiens
CGPNELDNL

SEQ ID NO: 310674 - protein, 9 aa, Homo Sapiens
VRKDLMAHK

SEQ ID NO: 310675 - protein, 9 aa, Homo Sapiens
LVSRVMNTG

SEQ ID NO: 310676 - protein, 9 aa, Homo Sapiens
PEKCAKHKR

SEQ ID NO: 310677 - protein, 9 aa, Homo Sapiens
PPVQKKKPT

SEQ ID NO: 310678 - protein, 9 aa, Homo Sapiens
IDLRHKLKL

SEQ ID NO: 310679 - protein, 9 aa, Homo Sapiens
NSPNSTAEA

SEQ ID NO: 310680 - protein, 9 aa, Homo Sapiens
QHMNFLPST

SEQ ID NO: 310681 - protein, 9 aa, Homo Sapiens
NCSQDFKNT

SEQ ID NO: 310682 - protein, 9 aa, Homo Sapiens
VNLQKCDIL

SEQ ID NO: 310683 - protein, 9 aa, Homo Sapiens
NNPEDNNSS

SEQ ID NO: 310684 - protein, 9 aa, Homo Sapiens
DSIQPQPLS

SEQ ID NO: 310685 - protein, 9 aa, Homo Sapiens
LRQTLMPTL

SEQ ID NO: 310686 - protein, 9 aa, Homo Sapiens
EQLLAPHLQ

SEQ ID NO: 310687 - protein, 9 aa, Homo Sapiens
TGQRSSYDS

SEQ ID NO: 310688 - protein, 9 aa, Homo Sapiens
SVQPSVIQK

SEQ ID NO: 310689 - protein, 9 aa, Homo Sapiens
TFFCIFSRD

SEQ ID NO: 310690 - protein, 9 aa, Homo Sapiens
KEAIVTSVE

SEQ ID NO: 310691 - protein, 9 aa, Homo Sapiens
TKVFKSYSG

SEQ ID NO: 310692 - protein, 9 aa, Homo Sapiens
LALERKRAL

SEQ ID NO: 310693 - protein, 9 aa, Homo Sapiens
LLPQGSACL

SEQ ID NO: 310694 - protein, 9 aa, Homo Sapiens
TAKDMCKIR

SEQ ID NO: 310695 - protein, 9 aa, Homo Sapiens
FGDNMNKLQ

SEQ ID NO: 310696 - protein, 9 aa, Homo Sapiens
PTFLYDIYL

SEQ ID NO: 310697 - protein, 9 aa, Homo Sapiens
SDLSHAFQK

SEQ ID NO: 310698 - protein, 9 aa, Homo Sapiens
TRQGVTIFY

SEQ ID NO: 310699 - protein, 9 aa, Homo Sapiens
VKRTITQNV

SEQ ID NO: 310700 - protein, 9 aa, Homo Sapiens
KRTACQSES

SEQ ID NO: 310701 - protein, 9 aa, Homo Sapiens
KLYLDLHPD

SEQ ID NO: 310702 - protein, 9 aa, Homo Sapiens
ESNDSHYRE

SEQ ID NO: 310703 - protein, 9 aa, Homo Sapiens
PPFKGRISW

SEQ ID NO: 310704 - protein, 9 aa, Homo Sapiens
KVPKLLSNH

SEQ ID NO: 310705 - protein, 9 aa, Homo Sapiens
TCEQGTPPM

SEQ ID NO: 310706 - protein, 9 aa, Homo Sapiens
FLFHQPLRL

SEQ ID NO: 310707 - protein, 9 aa, Homo Sapiens
LHVVAVTLD

SEQ ID NO: 310708 - protein, 9 aa, Homo Sapiens
STLLLYWQL

SEQ ID NO: 310709 - protein, 9 aa, Homo Sapiens
ELVNYEQVK

SEQ ID NO: 310710 - protein, 9 aa, Homo Sapiens
QVWDLEPNT

SEQ ID NO: 310711 - protein, 9 aa, Homo Sapiens
LFNITEDRA

SEQ ID NO: 310712 - protein, 9 aa, Homo Sapiens
HSKHGLSVE

SEQ ID NO: 310713 - protein, 9 aa, Homo Sapiens
EERCTGFDA

SEQ ID NO: 310714 - protein, 9 aa, Homo Sapiens
FNDIAKYFS

SEQ ID NO: 310715 - protein, 9 aa, Homo Sapiens
WSCHDGYYL

SEQ ID NO: 310716 - protein, 9 aa, Homo Sapiens
PGKWILSTS

SEQ ID NO: 310717 - protein, 9 aa, Homo Sapiens
DQYFNQMET

SEQ ID NO: 310718 - protein, 9 aa, Homo Sapiens
ICPSSPIIE

SEQ ID NO: 310719 - protein, 9 aa, Homo Sapiens
LLTIMAYDH

SEQ ID NO: 310720 - protein, 9 aa, Homo Sapiens
EECGKSFSV

SEQ ID NO: 310721 - protein, 9 aa, Homo Sapiens
VIYLEKLNV

SEQ ID NO: 310722 - protein, 9 aa, Homo Sapiens
NQFRANYLL

SEQ ID NO: 310723 - protein, 9 aa, Homo Sapiens
FSLIQDSIV

SEQ ID NO: 310724 - protein, 9 aa, Homo Sapiens
FGNIRELYK

SEQ ID NO: 310725 - protein, 9 aa, Homo Sapiens
DPDLVLELN

SEQ ID NO: 310726 - protein, 9 aa, Homo Sapiens
TILQLNLRK

SEQ ID NO: 310727 - protein, 9 aa, Homo Sapiens
SCTNQNAIS

SEQ ID NO: 310728 - protein, 9 aa, Homo Sapiens
QLIIHQITH

SEQ ID NO: 310729 - protein, 9 aa, Homo Sapiens
GTGTIYSTM

SEQ ID NO: 310730 - protein, 9 aa, Homo Sapiens
KGCDTQMID

SEQ ID NO: 310731 - protein, 9 aa, Homo Sapiens
LHNFNLKSL

SEQ ID NO: 310732 - protein, 9 aa, Homo Sapiens
PELEKESRI

SEQ ID NO: 310733 - protein, 9 aa, Homo Sapiens
NKSRVQMRG

SEQ ID NO: 310734 - protein, 9 aa, Homo Sapiens
RQIELLNET

SEQ ID NO: 310735 - protein, 9 aa, Homo Sapiens
VIQPISSPL

SEQ ID NO: 310736 - protein, 9 aa, Homo Sapiens
KVVSMLYTL

SEQ ID NO: 310737 - protein, 9 aa, Homo Sapiens
HDDADIVHH

SEQ ID NO: 310738 - protein, 9 aa, Homo Sapiens
IPALLGNTR

SEQ ID NO: 310739 - protein, 9 aa, Homo Sapiens
PEICKYKKR

SEQ ID NO: 310740 - protein, 9 aa, Homo Sapiens
FNRKQNVLE

SEQ ID NO: 310741 - protein, 9 aa, Homo Sapiens
DDPQSFKKI

SEQ ID NO: 310742 - protein, 9 aa, Homo Sapiens
SPCRVWWHA

SEQ ID NO: 310743 - protein, 9 aa, Homo Sapiens
GWLCIEKLS

SEQ ID NO: 310744 - protein, 9 aa, Homo Sapiens
RLSGNISGS

SEQ ID NO: 310745 - protein, 9 aa, Homo Sapiens
DITKAWKFI

SEQ ID NO: 310746 - protein, 9 aa, Homo Sapiens
LSTVGHKNK

SEQ ID NO: 310747 - protein, 9 aa, Homo Sapiens
VKNCMASEL

SEQ ID NO: 310748 - protein, 9 aa, Homo Sapiens
TICSPDLLL

SEQ ID NO: 310749 - protein, 9 aa, Homo Sapiens
LTDKTGNVS

SEQ ID NO: 310750 - protein, 9 aa, Homo Sapiens
PKEGLKYVD

SEQ ID NO: 310751 - protein, 9 aa, Homo Sapiens
KLKNSHGWQ

SEQ ID NO: 310752 - protein, 9 aa, Homo Sapiens
GPQLDFDPD

SEQ ID NO: 310753 - protein, 9 aa, Homo Sapiens
TLLLYWQLQ

SEQ ID NO: 310754 - protein, 9 aa, Homo Sapiens
AELADKYAP

SEQ ID NO: 310755 - protein, 9 aa, Homo Sapiens
LILQQSQAY

SEQ ID NO: 310756 - protein, 9 aa, Homo Sapiens
IFPDGGIAQ

SEQ ID NO: 310757 - protein, 9 aa, Homo Sapiens
QSSSGSSVQ

SEQ ID NO: 310758 - protein, 9 aa, Homo Sapiens
GELYENHCE

SEQ ID NO: 310759 - protein, 9 aa, Homo Sapiens
IFITSYARV

SEQ ID NO: 310760 - protein, 9 aa, Homo Sapiens
RKHVVPCVL

SEQ ID NO: 310761 - protein, 9 aa, Homo Sapiens
GIAKPSLLK

SEQ ID NO: 310762 - protein, 9 aa, Homo Sapiens
RVQPSKQKP

SEQ ID NO: 310763 - protein, 9 aa, Homo Sapiens
PDYAKEIMR

SEQ ID NO: 310764 - protein, 9 aa, Homo Sapiens
ACELLSDNM

SEQ ID NO: 310765 - protein, 9 aa, Homo Sapiens
QPKFWCQQT

SEQ ID NO: 310766 - protein, 9 aa, Homo Sapiens
VGSLPVDDP

SEQ ID NO: 310767 - protein, 9 aa, Homo Sapiens
LVEDVQLKN

SEQ ID NO: 310768 - protein, 9 aa, Homo Sapiens
QPACKIPDD

SEQ ID NO: 310769 - protein, 9 aa, Homo Sapiens
QRRDFIDIK

SEQ ID NO: 310770 - protein, 9 aa, Homo Sapiens
RDYEQEKVI

SEQ ID NO: 310771 - protein, 9 aa, Homo Sapiens
ICALLGIPL

SEQ ID NO: 310772 - protein, 9 aa, Homo Sapiens
VTQEQDIEA

SEQ ID NO: 310773 - protein, 9 aa, Homo Sapiens
QYGAGVTLE

SEQ ID NO: 310774 - protein, 9 aa, Homo Sapiens
SHRSRKISD

SEQ ID NO: 310775 - protein, 9 aa, Homo Sapiens
SPSGGLSNS

SEQ ID NO: 310776 - protein, 9 aa, Homo Sapiens
CGTLFITFG

SEQ ID NO: 310777 - protein, 9 aa, Homo Sapiens
STFRFNFLA

SEQ ID NO: 310778 - protein, 9 aa, Homo Sapiens
PYHLFSSPS

SEQ ID NO: 310779 - protein, 9 aa, Homo Sapiens
NGKPQFYAA

SEQ ID NO: 310780 - protein, 9 aa, Homo Sapiens
VTLVDPAAI

SEQ ID NO: 310781 - protein, 9 aa, Homo Sapiens
PSTTSLVSM

SEQ ID NO: 310782 - protein, 9 aa, Homo Sapiens
ESRKTAKDM

SEQ ID NO: 310783 - protein, 9 aa, Homo Sapiens
SQSDEDKMK

SEQ ID NO: 310784 - protein, 9 aa, Homo Sapiens
WSGGSPTND

SEQ ID NO: 310785 - protein, 9 aa, Homo Sapiens
ITLLRHYWN

SEQ ID NO: 310786 - protein, 9 aa, Homo Sapiens
NTVPHLAAV

SEQ ID NO: 310787 - protein, 9 aa, Homo Sapiens
RDRKQLVIY

SEQ ID NO: 310788 - protein, 9 aa, Homo Sapiens
TDIPWRRKQ

SEQ ID NO: 310789 - protein, 9 aa, Homo Sapiens
DFNVQEEAN

SEQ ID NO: 310790 - protein, 9 aa, Homo Sapiens
ADCEKTAVK

SEQ ID NO: 310791 - protein, 9 aa, Homo Sapiens
MRTNSRDPL

SEQ ID NO: 310792 - protein, 9 aa, Homo Sapiens
TVLSSSSIK

SEQ ID NO: 310793 - protein, 9 aa, Homo Sapiens
YLQVKKVYV

SEQ ID NO: 310794 - protein, 9 aa, Homo Sapiens
YFVIVFVLI

SEQ ID NO: 310795 - protein, 9 aa, Homo Sapiens
CYANNFGPK

SEQ ID NO: 310796 - protein, 9 aa, Homo Sapiens
RINFKKKHV

SEQ ID NO: 310797 - protein, 9 aa, Homo Sapiens
SGNGSIFTL

SEQ ID NO: 310798 - protein, 9 aa, Homo Sapiens
IEQLSVVKG

SEQ ID NO: 310799 - protein, 9 aa, Homo Sapiens
FASDRFLYV

SEQ ID NO: 310800 - protein, 9 aa, Homo Sapiens
AHTEVFPGQ

SEQ ID NO: 310801 - protein, 9 aa, Homo Sapiens
RVFYNKLLE

SEQ ID NO: 310802 - protein, 9 aa, Homo Sapiens
PSQSILFSP

SEQ ID NO: 310803 - protein, 9 aa, Homo Sapiens
YYYRYNVSV

SEQ ID NO: 310804 - protein, 9 aa, Homo Sapiens
LNTLREKLE

SEQ ID NO: 310805 - protein, 9 aa, Homo Sapiens
QKKKVDRYI

SEQ ID NO: 310806 - protein, 9 aa, Homo Sapiens
GNCAHQASV

SEQ ID NO: 310807 - protein, 9 aa, Homo Sapiens
QTLEEIKEN

SEQ ID NO: 310808 - protein, 9 aa, Homo Sapiens
KKQNPGLKI

SEQ ID NO: 310809 - protein, 9 aa, Homo Sapiens
METTKTGDN

SEQ ID NO: 310810 - protein, 9 aa, Homo Sapiens
RVPKKAQED

SEQ ID NO: 310811 - protein, 9 aa, Homo Sapiens
SFGIKETVQ

SEQ ID NO: 310812 - protein, 9 aa, Homo Sapiens
CEQQHRRWR

SEQ ID NO: 310813 - protein, 9 aa, Homo Sapiens
GGNYASYTF

SEQ ID NO: 310814 - protein, 9 aa, Homo Sapiens
QMKQQALTE

SEQ ID NO: 310815 - protein, 9 aa, Homo Sapiens
LSQVADIVF

SEQ ID NO: 310816 - protein, 9 aa, Homo Sapiens
DSELYENDS

SEQ ID NO: 310817 - protein, 9 aa, Homo Sapiens
LCSLSYLEE

SEQ ID NO: 310818 - protein, 9 aa, Homo Sapiens
DATHKGNKI

SEQ ID NO: 310819 - protein, 9 aa, Homo Sapiens
EDNDCENNY

SEQ ID NO: 310820 - protein, 9 aa, Homo Sapiens
DCKTSSSSS

SEQ ID NO: 310821 - protein, 9 aa, Homo Sapiens
LAQPDPEVR

SEQ ID NO: 310822 - protein, 9 aa, Homo Sapiens
FPGSRKLRN

SEQ ID NO: 310823 - protein, 9 aa, Homo Sapiens
VSLGTKKNK

SEQ ID NO: 310824 - protein, 9 aa, Homo Sapiens
PVAQQLLNQ

SEQ ID NO: 310825 - protein, 9 aa, Homo Sapiens
QNLVKEYPQ

SEQ ID NO: 310826 - protein, 9 aa, Homo Sapiens
SKRKSAKDK

SEQ ID NO: 310827 - protein, 9 aa, Homo Sapiens
LDNLYCDVP

SEQ ID NO: 310828 - protein, 9 aa, Homo Sapiens
GGVAKTMLE

SEQ ID NO: 310829 - protein, 9 aa, Homo Sapiens
NVYRYHSES

SEQ ID NO: 310830 - protein, 9 aa, Homo Sapiens
HVRCAGFLH

SEQ ID NO: 310831 - protein, 9 aa, Homo Sapiens
PRGPITPPG

SEQ ID NO: 310832 - protein, 9 aa, Homo Sapiens
NRFNSELAH

SEQ ID NO: 310833 - protein, 9 aa, Homo Sapiens
LKNRLSSYT

SEQ ID NO: 310834 - protein, 9 aa, Homo Sapiens
HPDVCMADP

SEQ ID NO: 310835 - protein, 9 aa, Homo Sapiens
KFVDMPQSP

SEQ ID NO: 310836 - protein, 9 aa, Homo Sapiens
LQLIKECYY

SEQ ID NO: 310837 - protein, 9 aa, Homo Sapiens
KIALGCNLP

SEQ ID NO: 310838 - protein, 9 aa, Homo Sapiens
SEQQEEDGL

SEQ ID NO: 310839 - protein, 9 aa, Homo Sapiens
PTLLQHIED

SEQ ID NO: 310840 - protein, 9 aa, Homo Sapiens
ANFNWAKSW

SEQ ID NO: 310841 - protein, 9 aa, Homo Sapiens
IKKIQDVKS

SEQ ID NO: 310842 - protein, 9 aa, Homo Sapiens
GHQRQTTPE

SEQ ID NO: 310843 - protein, 9 aa, Homo Sapiens
LDNIFLPLF

SEQ ID NO: 310844 - protein, 9 aa, Homo Sapiens
KGCYANNFG

SEQ ID NO: 310845 - protein, 9 aa, Homo Sapiens
RYKQDELFK

SEQ ID NO: 310846 - protein, 9 aa, Homo Sapiens
ICTQRRLDR

SEQ ID NO: 310847 - protein, 9 aa, Homo Sapiens
LVYKVACNM

SEQ ID NO: 310848 - protein, 9 aa, Homo Sapiens
AVARFTVIK

SEQ ID NO: 310849 - protein, 9 aa, Homo Sapiens
KWLQEWKAL

SEQ ID NO: 310850 - protein, 9 aa, Homo Sapiens
AGNHELTFY

SEQ ID NO: 310851 - protein, 9 aa, Homo Sapiens
PRSYLFDNP

SEQ ID NO: 310852 - protein, 9 aa, Homo Sapiens
EVAKMIREL

SEQ ID NO: 310853 - protein, 9 aa, Homo Sapiens
PACAVPGGP

SEQ ID NO: 310854 - protein, 9 aa, Homo Sapiens
AIQELQHKR

SEQ ID NO: 310855 - protein, 9 aa, Homo Sapiens
PSKSVGRNE

SEQ ID NO: 310856 - protein, 9 aa, Homo Sapiens
RSQPSLRAW

SEQ ID NO: 310857 - protein, 9 aa, Homo Sapiens
KNIREKTYA

SEQ ID NO: 310858 - protein, 9 aa, Homo Sapiens
VNKTLVVNP

SEQ ID NO: 310859 - protein, 9 aa, Homo Sapiens
HIKKCSMNQ

SEQ ID NO: 310860 - protein, 9 aa, Homo Sapiens
AGKAKSQQV

SEQ ID NO: 310861 - protein, 9 aa, Homo Sapiens
APGIIWKLG

SEQ ID NO: 310862 - protein, 9 aa, Homo Sapiens
PTEGSIILK

SEQ ID NO: 310863 - protein, 9 aa, Homo Sapiens
KKTDIPWRR

SEQ ID NO: 310864 - protein, 9 aa, Homo Sapiens
IQHQKFHTG

SEQ ID NO: 310865 - protein, 9 aa, Homo Sapiens
RSPFAAGPQ

SEQ ID NO: 310866 - protein, 9 aa, Homo Sapiens
LRITAEVKV

SEQ ID NO: 310867 - protein, 9 aa, Homo Sapiens
LICPMCMNY

SEQ ID NO: 310868 - protein, 9 aa, Homo Sapiens
ILHAGEKPY

SEQ ID NO: 310869 - protein, 9 aa, Homo Sapiens
ICKYKKRFN

SEQ ID NO: 310870 - protein, 9 aa, Homo Sapiens
TSFELSGAL

SEQ ID NO: 310871 - protein, 9 aa, Homo Sapiens
KDEDFVSST

SEQ ID NO: 310872 - protein, 9 aa, Homo Sapiens
RNVSLNLTF

SEQ ID NO: 310873 - protein, 9 aa, Homo Sapiens
VKGREALGK

SEQ ID NO: 310874 - protein, 9 aa, Homo Sapiens
HANVVTLHD

SEQ ID NO: 310875 - protein, 9 aa, Homo Sapiens
NMRDRLHIY

SEQ ID NO: 310876 - protein, 9 aa, Homo Sapiens
EKDDVHHLS

SEQ ID NO: 310877 - protein, 9 aa, Homo Sapiens
AGATFKCNI

SEQ ID NO: 310878 - protein, 9 aa, Homo Sapiens
SAGVLSGAC

SEQ ID NO: 310879 - protein, 9 aa, Homo Sapiens
TNHKEINTE

SEQ ID NO: 310880 - protein, 9 aa, Homo Sapiens
RFLDSLWLR

SEQ ID NO: 310881 - protein, 9 aa, Homo Sapiens
MMKNHRIAS

SEQ ID NO: 310882 - protein, 9 aa, Homo Sapiens
LWVEEAYYK

SEQ ID NO: 310883 - protein, 9 aa, Homo Sapiens
PYNEAENKI

SEQ ID NO: 310884 - protein, 9 aa, Homo Sapiens
NRGEIVKTK

SEQ ID NO: 310885 - protein, 9 aa, Homo Sapiens
YSETFILPH

SEQ ID NO: 310886 - protein, 9 aa, Homo Sapiens
NMQVNNIKK

SEQ ID NO: 310887 - protein, 9 aa, Homo Sapiens
ELGIHTVAI

SEQ ID NO: 310888 - protein, 9 aa, Homo Sapiens
DTLELAKQV

SEQ ID NO: 310889 - protein, 9 aa, Homo Sapiens
TEAMWDDFI

SEQ ID NO: 310890 - protein, 9 aa, Homo Sapiens
KYSSEDDIS

SEQ ID NO: 310891 - protein, 9 aa, Homo Sapiens
ADNQILKTS

SEQ ID NO: 310892 - protein, 9 aa, Homo Sapiens
VKDLRTSPD

SEQ ID NO: 310893 - protein, 9 aa, Homo Sapiens
QTLLSVDYL

SEQ ID NO: 310894 - protein, 9 aa, Homo Sapiens
NYQSQAEAH

SEQ ID NO: 310895 - protein, 9 aa, Homo Sapiens
NAGTVADVY

SEQ ID NO: 310896 - protein, 9 aa, Homo Sapiens
TSFEGTDYG

SEQ ID NO: 310897 - protein, 9 aa, Homo Sapiens
GAPGFPGVK

SEQ ID NO: 310898 - protein, 9 aa, Homo Sapiens
TKLKVEEET

SEQ ID NO: 310899 - protein, 9 aa, Homo Sapiens
LTHLDLSVN

SEQ ID NO: 310900 - protein, 9 aa, Homo Sapiens
ASSIFRVPE

SEQ ID NO: 310901 - protein, 9 aa, Homo Sapiens
SRKISDGKN

SEQ ID NO: 310902 - protein, 9 aa, Homo Sapiens
NDKIQEYKQ

SEQ ID NO: 310903 - protein, 9 aa, Homo Sapiens
AKQGPSQNV

SEQ ID NO: 310904 - protein, 9 aa, Homo Sapiens
RVSEDGQPK

SEQ ID NO: 310905 - protein, 9 aa, Homo Sapiens
QIFYIVEQR

SEQ ID NO: 310906 - protein, 9 aa, Homo Sapiens
IKNEKREDV

SEQ ID NO: 310907 - protein, 9 aa, Homo Sapiens
SKLTCPEIN

SEQ ID NO: 310908 - protein, 9 aa, Homo Sapiens
EPPGICPHV

SEQ ID NO: 310909 - protein, 9 aa, Homo Sapiens
KQGYIINSD

SEQ ID NO: 310910 - protein, 9 aa, Homo Sapiens
HSRTIVHTL

SEQ ID NO: 310911 - protein, 9 aa, Homo Sapiens
PRRVTEVCA

SEQ ID NO: 310912 - protein, 9 aa, Homo Sapiens
VCIPLPVSN

SEQ ID NO: 310913 - protein, 9 aa, Homo Sapiens
YLKRALQLF

SEQ ID NO: 310914 - protein, 9 aa, Homo Sapiens
VKLRYQKPD

SEQ ID NO: 310915 - protein, 9 aa, Homo Sapiens
MSIKYDPDR

SEQ ID NO: 310916 - protein, 9 aa, Homo Sapiens
TRSELKQRL

SEQ ID NO: 310917 - protein, 9 aa, Homo Sapiens
TEYVNQLKD

SEQ ID NO: 310918 - protein, 9 aa, Homo Sapiens
KPKKPFLSG

SEQ ID NO: 310919 - protein, 9 aa, Homo Sapiens
SFQGAPDVL

SEQ ID NO: 310920 - protein, 9 aa, Homo Sapiens
GPRSDFYMA

SEQ ID NO: 310921 - protein, 9 aa, Homo Sapiens
KQLSFRVFY

SEQ ID NO: 310922 - protein, 9 aa, Homo Sapiens
NLVGCIIGR

SEQ ID NO: 310923 - protein, 9 aa, Homo Sapiens
GEDAITNFR

SEQ ID NO: 310924 - protein, 9 aa, Homo Sapiens
ADDEELTDD

SEQ ID NO: 310925 - protein, 9 aa, Homo Sapiens
SSVMKHLSG

SEQ ID NO: 310926 - protein, 9 aa, Homo Sapiens
ITVSKLDLI

SEQ ID NO: 310927 - protein, 9 aa, Homo Sapiens
DNKTPTQSL

SEQ ID NO: 310928 - protein, 9 aa, Homo Sapiens
FNYRTLPTA

SEQ ID NO: 310929 - protein, 9 aa, Homo Sapiens
QIRFNYQSQ

SEQ ID NO: 310930 - protein, 9 aa, Homo Sapiens
SVFPSQSMD

SEQ ID NO: 310931 - protein, 9 aa, Homo Sapiens
DLFVCGLNT

SEQ ID NO: 310932 - protein, 9 aa, Homo Sapiens
VDQIIGKGQ

SEQ ID NO: 310933 - protein, 9 aa, Homo Sapiens
LNNSQMCQK

SEQ ID NO: 310934 - protein, 9 aa, Homo Sapiens
FVSSTRNTN

SEQ ID NO: 310935 - protein, 9 aa, Homo Sapiens
PHTERENFR

SEQ ID NO: 310936 - protein, 9 aa, Homo Sapiens
GNRYIKIFP

SEQ ID NO: 310937 - protein, 9 aa, Homo Sapiens
KIGNIENGH

SEQ ID NO: 310938 - protein, 9 aa, Homo Sapiens
MEKNGDQYT

SEQ ID NO: 310939 - protein, 9 aa, Homo Sapiens
RLESAWANR

SEQ ID NO: 310940 - protein, 9 aa, Homo Sapiens
KGRPKNNSI

SEQ ID NO: 310941 - protein, 9 aa, Homo Sapiens
DPNIKEIAA

SEQ ID NO: 310942 - protein, 9 aa, Homo Sapiens
LHHHTNLLI

SEQ ID NO: 310943 - protein, 9 aa, Homo Sapiens
AFRNNYGLK

SEQ ID NO: 310944 - protein, 9 aa, Homo Sapiens
LTSDERGTH

SEQ ID NO: 310945 - protein, 9 aa, Homo Sapiens
GSKGIVESI

SEQ ID NO: 310946 - protein, 9 aa, Homo Sapiens
ATYVNNPED

SEQ ID NO: 310947 - protein, 9 aa, Homo Sapiens
EEEDDEDFK

SEQ ID NO: 310948 - protein, 9 aa, Homo Sapiens
LIIFSPVML

SEQ ID NO: 310949 - protein, 9 aa, Homo Sapiens
VVGGLMTWA

SEQ ID NO: 310950 - protein, 9 aa, Homo Sapiens
QSDTPEICK

SEQ ID NO: 310951 - protein, 9 aa, Homo Sapiens
VTLNSSLLR

SEQ ID NO: 310952 - protein, 9 aa, Homo Sapiens
SIALQSGLQ

SEQ ID NO: 310953 - protein, 9 aa, Homo Sapiens
TGRVQPSKQ

SEQ ID NO: 310954 - protein, 9 aa, Homo Sapiens
SLSNCGIWQ

SEQ ID NO: 310955 - protein, 9 aa, Homo Sapiens
TGETNILST

SEQ ID NO: 310956 - protein, 9 aa, Homo Sapiens
NKGKETIYS

SEQ ID NO: 310957 - protein, 9 aa, Homo Sapiens
TRCISPREH

SEQ ID NO: 310958 - protein, 9 aa, Homo Sapiens
RDLCEVFSR

SEQ ID NO: 310959 - protein, 9 aa, Homo Sapiens
WFLSWFNHG

SEQ ID NO: 310960 - protein, 9 aa, Homo Sapiens
ISFLQSVAL

SEQ ID NO: 310961 - protein, 9 aa, Homo Sapiens
IKENIFPQE

SEQ ID NO: 310962 - protein, 9 aa, Homo Sapiens
ACTLDTVGW

SEQ ID NO: 310963 - protein, 9 aa, Homo Sapiens
VLHCLLQPH

SEQ ID NO: 310964 - protein, 9 aa, Homo Sapiens
VADTNFSFY

SEQ ID NO: 310965 - protein, 9 aa, Homo Sapiens
RDASCVNHW

SEQ ID NO: 310966 - protein, 9 aa, Homo Sapiens
AQARMQQQT

SEQ ID NO: 310967 - protein, 9 aa, Homo Sapiens
QEDDLNNLN

SEQ ID NO: 310968 - protein, 9 aa, Homo Sapiens
KEHQRITDH

SEQ ID NO: 310969 - protein, 9 aa, Homo Sapiens
CGTQIFVYV

SEQ ID NO: 310970 - protein, 9 aa, Homo Sapiens
TLNKNIRNA

SEQ ID NO: 310971 - protein, 9 aa, Homo Sapiens
RITAEVKVV

SEQ ID NO: 310972 - protein, 9 aa, Homo Sapiens
YSENETEKE

SEQ ID NO: 310973 - protein, 9 aa, Homo Sapiens
HGHSRKDNI

SEQ ID NO: 310974 - protein, 9 aa, Homo Sapiens
AQKVVALQK

SEQ ID NO: 310975 - protein, 9 aa, Homo Sapiens
VSMSIVKAT

SEQ ID NO: 310976 - protein, 9 aa, Homo Sapiens
NLGEDAITN

SEQ ID NO: 310977 - protein, 9 aa, Homo Sapiens
IIGLFVFTL

SEQ ID NO: 310978 - protein, 9 aa, Homo Sapiens
YLQSSQGSS

SEQ ID NO: 310979 - protein, 9 aa, Homo Sapiens
PYIVHSQVY

SEQ ID NO: 310980 - protein, 9 aa, Homo Sapiens
TLSQLPTPT

SEQ ID NO: 310981 - protein, 9 aa, Homo Sapiens
LSLVLPLTF

SEQ ID NO: 310982 - protein, 9 aa, Homo Sapiens
INMMRPGVF

SEQ ID NO: 310983 - protein, 9 aa, Homo Sapiens
KLVINVTSE

SEQ ID NO: 310984 - protein, 9 aa, Homo Sapiens
CASHLPIVT

SEQ ID NO: 310985 - protein, 9 aa, Homo Sapiens
IPPMPENRF

SEQ ID NO: 310986 - protein, 9 aa, Homo Sapiens
IIQTLSRVE

SEQ ID NO: 310987 - protein, 9 aa, Homo Sapiens
LEVGDYTLT

SEQ ID NO: 310988 - protein, 9 aa, Homo Sapiens
GINKAPIQT

SEQ ID NO: 310989 - protein, 9 aa, Homo Sapiens
TNLNFVLLV

SEQ ID NO: 310990 - protein, 9 aa, Homo Sapiens
VGQFTLLFN

SEQ ID NO: 310991 - protein, 9 aa, Homo Sapiens
PEVCIREMD

SEQ ID NO: 310992 - protein, 9 aa, Homo Sapiens
TFRAKVRGK

SEQ ID NO: 310993 - protein, 9 aa, Homo Sapiens
KLQSGPRVP

SEQ ID NO: 310994 - protein, 9 aa, Homo Sapiens
KQLNTRSSQ

SEQ ID NO: 310995 - protein, 9 aa, Homo Sapiens
NILESERFD

SEQ ID NO: 310996 - protein, 9 aa, Homo Sapiens
ENKDQSKTE

SEQ ID NO: 310997 - protein, 9 aa, Homo Sapiens
TPTTAGSSS

SEQ ID NO: 310998 - protein, 9 aa, Homo Sapiens
NVSRAVNWQ

SEQ ID NO: 310999 - protein, 9 aa, Homo Sapiens
DPCQGNTFL

SEQ ID NO: 311000 - protein, 9 aa, Homo Sapiens
KLQTTQAPY

SEQ ID NO: 311001 - protein, 9 aa, Homo Sapiens
PIILAGRYL

SEQ ID NO: 311002 - protein, 9 aa, Homo Sapiens
TLSVTSFCH

SEQ ID NO: 311003 - protein, 9 aa, Homo Sapiens
VYKVACNMM

SEQ ID NO: 311004 - protein, 9 aa, Homo Sapiens
TEAIQHSLV

SEQ ID NO: 311005 - protein, 9 aa, Homo Sapiens
FDSHRRPGD

SEQ ID NO: 311006 - protein, 9 aa, Homo Sapiens
PNDQSSSST

SEQ ID NO: 311007 - protein, 9 aa, Homo Sapiens
VAVVWAVFQ

SEQ ID NO: 311008 - protein, 9 aa, Homo Sapiens
SQQFLTNIG

SEQ ID NO: 311009 - protein, 9 aa, Homo Sapiens
KPKGRPKNN

SEQ ID NO: 311010 - protein, 9 aa, Homo Sapiens
LRYWGTMWK

SEQ ID NO: 311011 - protein, 9 aa, Homo Sapiens
LSSTLNTHK

SEQ ID NO: 311012 - protein, 9 aa, Homo Sapiens
INRKEEDNA

SEQ ID NO: 311013 - protein, 9 aa, Homo Sapiens
HDVTLKNLS

SEQ ID NO: 311014 - protein, 9 aa, Homo Sapiens
WNKRIKYAP

SEQ ID NO: 311015 - protein, 9 aa, Homo Sapiens
YPLWPELIE

SEQ ID NO: 311016 - protein, 9 aa, Homo Sapiens
LGCNLPRWH

SEQ ID NO: 311017 - protein, 9 aa, Homo Sapiens
MALLSANSI

SEQ ID NO: 311018 - protein, 9 aa, Homo Sapiens
MGRINNTNV

SEQ ID NO: 311019 - protein, 9 aa, Homo Sapiens
ATAKGLYWT

SEQ ID NO: 311020 - protein, 9 aa, Homo Sapiens
KYMLREELQ

SEQ ID NO: 311021 - protein, 9 aa, Homo Sapiens
SQRIMPVRN

SEQ ID NO: 311022 - protein, 9 aa, Homo Sapiens
RVLKPEWFW

SEQ ID NO: 311023 - protein, 9 aa, Homo Sapiens
PEFILVGYV

SEQ ID NO: 311024 - protein, 9 aa, Homo Sapiens
EKHRKLQKK

SEQ ID NO: 311025 - protein, 9 aa, Homo Sapiens
QKLPTSLKK

SEQ ID NO: 311026 - protein, 9 aa, Homo Sapiens
VEEAYYKEK

SEQ ID NO: 311027 - protein, 9 aa, Homo Sapiens
INTEDKPYK

SEQ ID NO: 311028 - protein, 9 aa, Homo Sapiens
PLYRALLKL

SEQ ID NO: 311029 - protein, 9 aa, Homo Sapiens
TPYPDEFKN

SEQ ID NO: 311030 - protein, 9 aa, Homo Sapiens
DSIEIVATR

SEQ ID NO: 311031 - protein, 9 aa, Homo Sapiens
KQGKTLAST

SEQ ID NO: 311032 - protein, 9 aa, Homo Sapiens
TSEDKVIAV

SEQ ID NO: 311033 - protein, 9 aa, Homo Sapiens
PHSSGCCSQ

SEQ ID NO: 311034 - protein, 9 aa, Homo Sapiens
ALLINQTVM

SEQ ID NO: 311035 - protein, 9 aa, Homo Sapiens
SKRKQEKEQ

SEQ ID NO: 311036 - protein, 9 aa, Homo Sapiens
QINFILGSL

SEQ ID NO: 311037 - protein, 9 aa, Homo Sapiens
SMDEFILKK

SEQ ID NO: 311038 - protein, 9 aa, Homo Sapiens
SDEQPIFLA

SEQ ID NO: 311039 - protein, 9 aa, Homo Sapiens
HQHFRPKSG

SEQ ID NO: 311040 - protein, 9 aa, Homo Sapiens
EANKLVILE

SEQ ID NO: 311041 - protein, 9 aa, Homo Sapiens
CNAITGITI

SEQ ID NO: 311042 - protein, 9 aa, Homo Sapiens
KGYRHIPLF

SEQ ID NO: 311043 - protein, 9 aa, Homo Sapiens
SPIPGGVYS

SEQ ID NO: 311044 - protein, 9 aa, Homo Sapiens
RKLAPSQIN

SEQ ID NO: 311045 - protein, 9 aa, Homo Sapiens
INKRNKSLI

SEQ ID NO: 311046 - protein, 9 aa, Homo Sapiens
ESKLKELLN

SEQ ID NO: 311047 - protein, 9 aa, Homo Sapiens
LQNELRETV

SEQ ID NO: 311048 - protein, 9 aa, Homo Sapiens
QMFCSRSIE

SEQ ID NO: 311049 - protein, 9 aa, Homo Sapiens
RYTFSFTVR

SEQ ID NO: 311050 - protein, 9 aa, Homo Sapiens
QQQDMAQLI

SEQ ID NO: 311051 - protein, 9 aa, Homo Sapiens
QSDEDKMKE

SEQ ID NO: 311052 - protein, 9 aa, Homo Sapiens
IRHLFPKQK

SEQ ID NO: 311053 - protein, 9 aa, Homo Sapiens
ITTIKWNDV

SEQ ID NO: 311054 - protein, 9 aa, Homo Sapiens
TKDISRVFH

SEQ ID NO: 311055 - protein, 9 aa, Homo Sapiens
GQNSSVWGR

SEQ ID NO: 311056 - protein, 9 aa, Homo Sapiens
IHGLKEPKR

SEQ ID NO: 311057 - protein, 9 aa, Homo Sapiens
DLLLDLNNK

SEQ ID NO: 311058 - protein, 9 aa, Homo Sapiens
FILPHLKDI

SEQ ID NO: 311059 - protein, 9 aa, Homo Sapiens
DKWWRGSGC

SEQ ID NO: 311060 - protein, 9 aa, Homo Sapiens
HETLWCHRW

SEQ ID NO: 311061 - protein, 9 aa, Homo Sapiens
AVSKAGPYT

SEQ ID NO: 311062 - protein, 9 aa, Homo Sapiens
GSSWHLSNR

SEQ ID NO: 311063 - protein, 9 aa, Homo Sapiens
FTAAVRSNT

SEQ ID NO: 311064 - protein, 9 aa, Homo Sapiens
KNKPAAAKK

SEQ ID NO: 311065 - protein, 9 aa, Homo Sapiens
KEACTLDTV

SEQ ID NO: 311066 - protein, 9 aa, Homo Sapiens
YKKKTEQLH

SEQ ID NO: 311067 - protein, 9 aa, Homo Sapiens
VTLTAGLGS

SEQ ID NO: 311068 - protein, 9 aa, Homo Sapiens
TRTMAPESV

SEQ ID NO: 311069 - protein, 9 aa, Homo Sapiens
DVDGAYITK

SEQ ID NO: 311070 - protein, 9 aa, Homo Sapiens
SEDVIYRPH

SEQ ID NO: 311071 - protein, 9 aa, Homo Sapiens
PCLPKFTIK

SEQ ID NO: 311072 - protein, 9 aa, Homo Sapiens
PQEQDVKDN

SEQ ID NO: 311073 - protein, 9 aa, Homo Sapiens
PSSSNGHKS

SEQ ID NO: 311074 - protein, 9 aa, Homo Sapiens
GSAMKWGLL

SEQ ID NO: 311075 - protein, 9 aa, Homo Sapiens
KENETPQRR

SEQ ID NO: 311076 - protein, 9 aa, Homo Sapiens
RKTAKDMCK

SEQ ID NO: 311077 - protein, 9 aa, Homo Sapiens
KASEARGEA

SEQ ID NO: 311078 - protein, 9 aa, Homo Sapiens
LAPKVIGSV

SEQ ID NO: 311079 - protein, 9 aa, Homo Sapiens
SKDISALTD

SEQ ID NO: 311080 - protein, 9 aa, Homo Sapiens
IIQELQKRM

SEQ ID NO: 311081 - protein, 9 aa, Homo Sapiens
GICPHVAQD

SEQ ID NO: 311082 - protein, 9 aa, Homo Sapiens
GVKVPRNSR

SEQ ID NO: 311083 - protein, 9 aa, Homo Sapiens
YSVGTTPLV

SEQ ID NO: 311084 - protein, 9 aa, Homo Sapiens
LQGFINYLD

SEQ ID NO: 311085 - protein, 9 aa, Homo Sapiens
RQQFLEKQK

SEQ ID NO: 311086 - protein, 9 aa, Homo Sapiens
QASSFTNST

SEQ ID NO: 311087 - protein, 9 aa, Homo Sapiens
DNVSLNKGD

SEQ ID NO: 311088 - protein, 9 aa, Homo Sapiens
ICVKSWNTE

SEQ ID NO: 311089 - protein, 9 aa, Homo Sapiens
ILGNPLLGM

SEQ ID NO: 311090 - protein, 9 aa, Homo Sapiens
KIEFKELIY

SEQ ID NO: 311091 - protein, 9 aa, Homo Sapiens
EGYYYRYNV

SEQ ID NO: 311092 - protein, 9 aa, Homo Sapiens
AIFRLEMPE

SEQ ID NO: 311093 - protein, 9 aa, Homo Sapiens
QESSCSHSS

SEQ ID NO: 311094 - protein, 9 aa, Homo Sapiens
LFSSPSLSF

SEQ ID NO: 311095 - protein, 9 aa, Homo Sapiens
IPEMICILC

SEQ ID NO: 311096 - protein, 9 aa, Homo Sapiens
SFYNMRDRL

SEQ ID NO: 311097 - protein, 9 aa, Homo Sapiens
GRRWLCEQQ

SEQ ID NO: 311098 - protein, 9 aa, Homo Sapiens
DIYGRTVLI

SEQ ID NO: 311099 - protein, 9 aa, Homo Sapiens
FKEGVFELI

SEQ ID NO: 311100 - protein, 9 aa, Homo Sapiens
KLFTIERLY

SEQ ID NO: 311101 - protein, 9 aa, Homo Sapiens
RVLYVFTKN

SEQ ID NO: 311102 - protein, 9 aa, Homo Sapiens
EENSTFLNS

SEQ ID NO: 311103 - protein, 9 aa, Homo Sapiens
YTHGRVSGL

SEQ ID NO: 311104 - protein, 9 aa, Homo Sapiens
LVINKESEV

SEQ ID NO: 311105 - protein, 9 aa, Homo Sapiens
QVGLGPRTS

SEQ ID NO: 311106 - protein, 9 aa, Homo Sapiens
IEEIINLWC

SEQ ID NO: 311107 - protein, 9 aa, Homo Sapiens
KEEAARICL

SEQ ID NO: 311108 - protein, 9 aa, Homo Sapiens
LILHQIIHS

SEQ ID NO: 311109 - protein, 9 aa, Homo Sapiens
SANKVKTPQ

SEQ ID NO: 311110 - protein, 9 aa, Homo Sapiens
WTRKGRTLF

SEQ ID NO: 311111 - protein, 9 aa, Homo Sapiens
HFIADHYMF

SEQ ID NO: 311112 - protein, 9 aa, Homo Sapiens
ITEIHGLKE

SEQ ID NO: 311113 - protein, 9 aa, Homo Sapiens
DVLSYTYQH

SEQ ID NO: 311114 - protein, 9 aa, Homo Sapiens
ALMPSVSSY

SEQ ID NO: 311115 - protein, 9 aa, Homo Sapiens
KQIEASIRG

SEQ ID NO: 311116 - protein, 9 aa, Homo Sapiens
LQKLELSDN

SEQ ID NO: 311117 - protein, 9 aa, Homo Sapiens
RQDMPETSQ

SEQ ID NO: 311118 - protein, 9 aa, Homo Sapiens
RIQLVFGNQ

SEQ ID NO: 311119 - protein, 9 aa, Homo Sapiens
QIWKAPQAV

SEQ ID NO: 311120 - protein, 9 aa, Homo Sapiens
GTKLNPPLM

SEQ ID NO: 311121 - protein, 9 aa, Homo Sapiens
TVRGQPARI

SEQ ID NO: 311122 - protein, 9 aa, Homo Sapiens
HNVPYIVHS

SEQ ID NO: 311123 - protein, 9 aa, Homo Sapiens
KEKTGKCSE

SEQ ID NO: 311124 - protein, 9 aa, Homo Sapiens
VAQEGQCWV

SEQ ID NO: 311125 - protein, 9 aa, Homo Sapiens
SVPGKMKGI

SEQ ID NO: 311126 - protein, 9 aa, Homo Sapiens
SQIKCGIWT

SEQ ID NO: 311127 - protein, 9 aa, Homo Sapiens
KISVSRGRP

SEQ ID NO: 311128 - protein, 9 aa, Homo Sapiens
FDRRKNGMM

SEQ ID NO: 311129 - protein, 9 aa, Homo Sapiens
KDNCTGVQV

SEQ ID NO: 311130 - protein, 9 aa, Homo Sapiens
HAVRIDQIC

SEQ ID NO: 311131 - protein, 9 aa, Homo Sapiens
PASYGRNDR

SEQ ID NO: 311132 - protein, 9 aa, Homo Sapiens
FDDMFEDMD

SEQ ID NO: 311133 - protein, 9 aa, Homo Sapiens
RKDVSFQNI

SEQ ID NO: 311134 - protein, 9 aa, Homo Sapiens
VQQPHVGGE

SEQ ID NO: 311135 - protein, 9 aa, Homo Sapiens
WGSSLHVRC

SEQ ID NO: 311136 - protein, 9 aa, Homo Sapiens
GDARKKQFW

SEQ ID NO: 311137 - protein, 9 aa, Homo Sapiens
VDSILMERQ

SEQ ID NO: 311138 - protein, 9 aa, Homo Sapiens
SDKYNVPIL

SEQ ID NO: 311139 - protein, 9 aa, Homo Sapiens
KVTSPSQYV

SEQ ID NO: 311140 - protein, 9 aa, Homo Sapiens
YLKQKKEQL

SEQ ID NO: 311141 - protein, 9 aa, Homo Sapiens
ADNSSNEEE

SEQ ID NO: 311142 - protein, 9 aa, Homo Sapiens
NNRLYRRDD

SEQ ID NO: 311143 - protein, 9 aa, Homo Sapiens
CECTESPHK

SEQ ID NO: 311144 - protein, 9 aa, Homo Sapiens
KNGQIILWD

SEQ ID NO: 311145 - protein, 9 aa, Homo Sapiens
LKFPSLAGK

SEQ ID NO: 311146 - protein, 9 aa, Homo Sapiens
SATLNVLAV

SEQ ID NO: 311147 - protein, 9 aa, Homo Sapiens
LGKPSHLRG

SEQ ID NO: 311148 - protein, 9 aa, Homo Sapiens
IGSMPNPNH

SEQ ID NO: 311149 - protein, 9 aa, Homo Sapiens
NTSAGRYVC

SEQ ID NO: 311150 - protein, 9 aa, Homo Sapiens
AHQPACKIP

SEQ ID NO: 311151 - protein, 9 aa, Homo Sapiens
VEDFLYGLF

SEQ ID NO: 311152 - protein, 9 aa, Homo Sapiens
RASPTAGPQ

SEQ ID NO: 311153 - protein, 9 aa, Homo Sapiens
SDTYGDINI

SEQ ID NO: 311154 - protein, 9 aa, Homo Sapiens
EAIETIVAT

SEQ ID NO: 311155 - protein, 9 aa, Homo Sapiens
DTPYCETDL

SEQ ID NO: 311156 - protein, 9 aa, Homo Sapiens
ASSSFVLPC

SEQ ID NO: 311157 - protein, 9 aa, Homo Sapiens
PASVGSSPQ

SEQ ID NO: 311158 - protein, 9 aa, Homo Sapiens
GQLSEKNYP

SEQ ID NO: 311159 - protein, 9 aa, Homo Sapiens
NNSYIAYIE

SEQ ID NO: 311160 - protein, 9 aa, Homo Sapiens
ALVSQLIQC

SEQ ID NO: 311161 - protein, 9 aa, Homo Sapiens
ARKKQFWYL

SEQ ID NO: 311162 - protein, 9 aa, Homo Sapiens
GQISNGEHH

SEQ ID NO: 311163 - protein, 9 aa, Homo Sapiens
SDLMTIHLL

SEQ ID NO: 311164 - protein, 9 aa, Homo Sapiens
RPHTCKICG

SEQ ID NO: 311165 - protein, 9 aa, Homo Sapiens
LYGGLASSA

SEQ ID NO: 311166 - protein, 9 aa, Homo Sapiens
DVARRYPEA

SEQ ID NO: 311167 - protein, 9 aa, Homo Sapiens
EYIYLVEKY

SEQ ID NO: 311168 - protein, 9 aa, Homo Sapiens
DHCEQITAK

SEQ ID NO: 311169 - protein, 9 aa, Homo Sapiens
VFCQNNVVL

SEQ ID NO: 311170 - protein, 9 aa, Homo Sapiens
QKVLQSPAT

SEQ ID NO: 311171 - protein, 9 aa, Homo Sapiens
VRGQPARIS

SEQ ID NO: 311172 - protein, 9 aa, Homo Sapiens
LFGLLVESQ

SEQ ID NO: 311173 - protein, 9 aa, Homo Sapiens
PALQVLRDM

SEQ ID NO: 311174 - protein, 9 aa, Homo Sapiens
TRGVGAGGR

SEQ ID NO: 311175 - protein, 9 aa, Homo Sapiens
KKAGSKKKS

SEQ ID NO: 311176 - protein, 9 aa, Homo Sapiens
EKFVMQEDL

SEQ ID NO: 311177 - protein, 9 aa, Homo Sapiens
HSSCATSPT

SEQ ID NO: 311178 - protein, 9 aa, Homo Sapiens
RFWDFIAQL

SEQ ID NO: 311179 - protein, 9 aa, Homo Sapiens
SLSQRLKDT

SEQ ID NO: 311180 - protein, 9 aa, Homo Sapiens
EELLTALFS

SEQ ID NO: 311181 - protein, 9 aa, Homo Sapiens
SPLEKEIQE

SEQ ID NO: 311182 - protein, 9 aa, Homo Sapiens
YNEAENKIS

SEQ ID NO: 311183 - protein, 9 aa, Homo Sapiens
LFLINGRHN

SEQ ID NO: 311184 - protein, 9 aa, Homo Sapiens
GQIDSPTGS

SEQ ID NO: 311185 - protein, 9 aa, Homo Sapiens
RHQISHSGD

SEQ ID NO: 311186 - protein, 9 aa, Homo Sapiens
TSRLNRRTS

SEQ ID NO: 311187 - protein, 9 aa, Homo Sapiens
RDLMDKLKG

SEQ ID NO: 311188 - protein, 9 aa, Homo Sapiens
NGTYIIYNY

SEQ ID NO: 311189 - protein, 9 aa, Homo Sapiens
KVLESRGSG

SEQ ID NO: 311190 - protein, 9 aa, Homo Sapiens
NVVTLHDIV

SEQ ID NO: 311191 - protein, 9 aa, Homo Sapiens
QQPQTIPLN

SEQ ID NO: 311192 - protein, 9 aa, Homo Sapiens
QARSRSRLQ

SEQ ID NO: 311193 - protein, 9 aa, Homo Sapiens
TCAPSSPRT

SEQ ID NO: 311194 - protein, 9 aa, Homo Sapiens
YYDSRNDKV

SEQ ID NO: 311195 - protein, 9 aa, Homo Sapiens
CMTWFILFF

SEQ ID NO: 311196 - protein, 9 aa, Homo Sapiens
RLHIYTCPR

SEQ ID NO: 311197 - protein, 9 aa, Homo Sapiens
QKMAHKIMK

SEQ ID NO: 311198 - protein, 9 aa, Homo Sapiens
MKTTWQINL

SEQ ID NO: 311199 - protein, 9 aa, Homo Sapiens
DYILYSKTH

SEQ ID NO: 311200 - protein, 9 aa, Homo Sapiens
DSGNKDSVM

SEQ ID NO: 311201 - protein, 9 aa, Homo Sapiens
TLEEGHFRL

SEQ ID NO: 311202 - protein, 9 aa, Homo Sapiens
PSFRDYIDL

SEQ ID NO: 311203 - protein, 9 aa, Homo Sapiens
FAMINVYPP

SEQ ID NO: 311204 - protein, 9 aa, Homo Sapiens
GTLYYEENK

SEQ ID NO: 311205 - protein, 9 aa, Homo Sapiens
KKADNSSNE

SEQ ID NO: 311206 - protein, 9 aa, Homo Sapiens
NTERFDSQP

SEQ ID NO: 311207 - protein, 9 aa, Homo Sapiens
LFVLIYKMY

SEQ ID NO: 311208 - protein, 9 aa, Homo Sapiens
VVSDEDKAA

SEQ ID NO: 311209 - protein, 9 aa, Homo Sapiens
LTFKECVIL

SEQ ID NO: 311210 - protein, 9 aa, Homo Sapiens
QKSIALQSG

SEQ ID NO: 311211 - protein, 9 aa, Homo Sapiens
TSTQTSLDS

SEQ ID NO: 311212 - protein, 9 aa, Homo Sapiens
KDVEDCLMV

SEQ ID NO: 311213 - protein, 9 aa, Homo Sapiens
NETPQRRSH

SEQ ID NO: 311214 - protein, 9 aa, Homo Sapiens
NYDEMKDVI

SEQ ID NO: 311215 - protein, 9 aa, Homo Sapiens
LHQQEIQVV

SEQ ID NO: 311216 - protein, 9 aa, Homo Sapiens
PLQTHYGYI

SEQ ID NO: 311217 - protein, 9 aa, Homo Sapiens
FLLEHHTRS

SEQ ID NO: 311218 - protein, 9 aa, Homo Sapiens
GAPWIPGQP

SEQ ID NO: 311219 - protein, 9 aa, Homo Sapiens
AEEVGKTIG

SEQ ID NO: 311220 - protein, 9 aa, Homo Sapiens
AGEQSRQSA

SEQ ID NO: 311221 - protein, 9 aa, Homo Sapiens
IKETVQKVT

SEQ ID NO: 311222 - protein, 9 aa, Homo Sapiens
RHLFPKQKC

SEQ ID NO: 311223 - protein, 9 aa, Homo Sapiens
PIHRPPPPG

SEQ ID NO: 311224 - protein, 9 aa, Homo Sapiens
HTGNTSFAC

SEQ ID NO: 311225 - protein, 9 aa, Homo Sapiens
GCIKSKDNK

SEQ ID NO: 311226 - protein, 9 aa, Homo Sapiens
YLWETIVLF

SEQ ID NO: 311227 - protein, 9 aa, Homo Sapiens
KLKGKEGKE

SEQ ID NO: 311228 - protein, 9 aa, Homo Sapiens
FFNVFFPLL

SEQ ID NO: 311229 - protein, 9 aa, Homo Sapiens
ECGKAFSKS

SEQ ID NO: 311230 - protein, 9 aa, Homo Sapiens
VTVKNRMIQ

SEQ ID NO: 311231 - protein, 9 aa, Homo Sapiens
YTTPSKGSH

SEQ ID NO: 311232 - protein, 9 aa, Homo Sapiens
EINGNSVNV

SEQ ID NO: 311233 - protein, 9 aa, Homo Sapiens
VFCDVSIYI

SEQ ID NO: 311234 - protein, 9 aa, Homo Sapiens
CLRQMFCSR

SEQ ID NO: 311235 - protein, 9 aa, Homo Sapiens
YPVLCALAK

SEQ ID NO: 311236 - protein, 9 aa, Homo Sapiens
VNKCAVMKL

SEQ ID NO: 311237 - protein, 9 aa, Homo Sapiens
LSLGSRSST

SEQ ID NO: 311238 - protein, 9 aa, Homo Sapiens
PLELDFLLQ

SEQ ID NO: 311239 - protein, 9 aa, Homo Sapiens
DSEAQSHSS

SEQ ID NO: 311240 - protein, 9 aa, Homo Sapiens
KAAKETKVK

SEQ ID NO: 311241 - protein, 9 aa, Homo Sapiens
SVLQAHLRD

SEQ ID NO: 311242 - protein, 9 aa, Homo Sapiens
NLQLIQALL

SEQ ID NO: 311243 - protein, 9 aa, Homo Sapiens
KRKQEKEQR

SEQ ID NO: 311244 - protein, 9 aa, Homo Sapiens
QTQKGNSNK

SEQ ID NO: 311245 - protein, 9 aa, Homo Sapiens
QLIQALLDS

SEQ ID NO: 311246 - protein, 9 aa, Homo Sapiens
KEGGLFGFY

SEQ ID NO: 311247 - protein, 9 aa, Homo Sapiens
NLLEKETTV

SEQ ID NO: 311248 - protein, 9 aa, Homo Sapiens
VMLEILIFC

SEQ ID NO: 311249 - protein, 9 aa, Homo Sapiens
ISYLKAICT

SEQ ID NO: 311250 - protein, 9 aa, Homo Sapiens
KGGQDIAPG

SEQ ID NO: 311251 - protein, 9 aa, Homo Sapiens
LVVKARQPQ

SEQ ID NO: 311252 - protein, 9 aa, Homo Sapiens
STDLSNPSI

SEQ ID NO: 311253 - protein, 9 aa, Homo Sapiens
KSAKDKKSS

SEQ ID NO: 311254 - protein, 9 aa, Homo Sapiens
KDKLLLVLG

SEQ ID NO: 311255 - protein, 9 aa, Homo Sapiens
LEVFMANQT

SEQ ID NO: 311256 - protein, 9 aa, Homo Sapiens
AGLILGGKD

SEQ ID NO: 311257 - protein, 9 aa, Homo Sapiens
GTLPSVELL

SEQ ID NO: 311258 - protein, 9 aa, Homo Sapiens
EELFDAHEG

SEQ ID NO: 311259 - protein, 9 aa, Homo Sapiens
QAKCRDPTL

SEQ ID NO: 311260 - protein, 9 aa, Homo Sapiens
PEEPVHFHP

SEQ ID NO: 311261 - protein, 9 aa, Homo Sapiens
FYCGGKMAE

SEQ ID NO: 311262 - protein, 9 aa, Homo Sapiens
DSSKFDEVF

SEQ ID NO: 311263 - protein, 9 aa, Homo Sapiens
KRKDVSFQN

SEQ ID NO: 311264 - protein, 9 aa, Homo Sapiens
VWTITSSLE

SEQ ID NO: 311265 - protein, 9 aa, Homo Sapiens
FSEGGKVNY

SEQ ID NO: 311266 - protein, 9 aa, Homo Sapiens
GRDNVSDLT

SEQ ID NO: 311267 - protein, 9 aa, Homo Sapiens
KEKTSFELS

SEQ ID NO: 311268 - protein, 9 aa, Homo Sapiens
ANAILQIDN

SEQ ID NO: 311269 - protein, 9 aa, Homo Sapiens
GTPLSSTFR

SEQ ID NO: 311270 - protein, 9 aa, Homo Sapiens
NFLFDIPNI

SEQ ID NO: 311271 - protein, 9 aa, Homo Sapiens
NGAVLTKSV

SEQ ID NO: 311272 - protein, 9 aa, Homo Sapiens
ENAMMIKTI

SEQ ID NO: 311273 - protein, 9 aa, Homo Sapiens
KVQTLSLSK

SEQ ID NO: 311274 - protein, 9 aa, Homo Sapiens
IIENNFKEG

SEQ ID NO: 311275 - protein, 9 aa, Homo Sapiens
CKDLIKYML

SEQ ID NO: 311276 - protein, 9 aa, Homo Sapiens
NLPKRIDTE

SEQ ID NO: 311277 - protein, 9 aa, Homo Sapiens
TKDDEQLCK

SEQ ID NO: 311278 - protein, 9 aa, Homo Sapiens
GTRIIKVSG

SEQ ID NO: 311279 - protein, 9 aa, Homo Sapiens
FQEILNTLR

SEQ ID NO: 311280 - protein, 9 aa, Homo Sapiens
RRTSTQQVY

SEQ ID NO: 311281 - protein, 9 aa, Homo Sapiens
GCRSVDECK

SEQ ID NO: 311282 - protein, 9 aa, Homo Sapiens
GDPCQGNTF

SEQ ID NO: 311283 - protein, 9 aa, Homo Sapiens
IMDRTPDKL

SEQ ID NO: 311284 - protein, 9 aa, Homo Sapiens
DNIKNTLHK

SEQ ID NO: 311285 - protein, 9 aa, Homo Sapiens
EGGSGWTKT

SEQ ID NO: 311286 - protein, 9 aa, Homo Sapiens
KSYASAFSE

SEQ ID NO: 311287 - protein, 9 aa, Homo Sapiens
LVSTFNNYY

SEQ ID NO: 311288 - protein, 9 aa, Homo Sapiens
GHDQKNKYV

SEQ ID NO: 311289 - protein, 9 aa, Homo Sapiens
GVICTQRRL

SEQ ID NO: 311290 - protein, 9 aa, Homo Sapiens
NTLPTKLRD

SEQ ID NO: 311291 - protein, 9 aa, Homo Sapiens
SNRKDLVKA

SEQ ID NO: 311292 - protein, 9 aa, Homo Sapiens
IFSQQFLTN

SEQ ID NO: 311293 - protein, 9 aa, Homo Sapiens
LVKEQGSHS

SEQ ID NO: 311294 - protein, 9 aa, Homo Sapiens
KTYECNKCE

SEQ ID NO: 311295 - protein, 9 aa, Homo Sapiens
RELIEIKTK

SEQ ID NO: 311296 - protein, 9 aa, Homo Sapiens
VLCDNEFLG

SEQ ID NO: 311297 - protein, 9 aa, Homo Sapiens
KKFNEISIL

SEQ ID NO: 311298 - protein, 9 aa, Homo Sapiens
KVERQQEVL

SEQ ID NO: 311299 - protein, 9 aa, Homo Sapiens
DIFGKDAKS

SEQ ID NO: 311300 - protein, 9 aa, Homo Sapiens
VVQPSSGLS

SEQ ID NO: 311301 - protein, 9 aa, Homo Sapiens
VTVADTNFS

SEQ ID NO: 311302 - protein, 9 aa, Homo Sapiens
GRIDYLLRA

SEQ ID NO: 311303 - protein, 9 aa, Homo Sapiens
LQNTAPAQL

SEQ ID NO: 311304 - protein, 9 aa, Homo Sapiens
SQLEQKKER

SEQ ID NO: 311305 - protein, 9 aa, Homo Sapiens
FRQNSNIVN

SEQ ID NO: 311306 - protein, 9 aa, Homo Sapiens
ESIHKWREE

SEQ ID NO: 311307 - protein, 9 aa, Homo Sapiens
TLKNLSRQI

SEQ ID NO: 311308 - protein, 9 aa, Homo Sapiens
AKVHTAKES

SEQ ID NO: 311309 - protein, 9 aa, Homo Sapiens
KCYETKGER

SEQ ID NO: 311310 - protein, 9 aa, Homo Sapiens
KVHYSDCLV

SEQ ID NO: 311311 - protein, 9 aa, Homo Sapiens
TALVAWVMS

SEQ ID NO: 311312 - protein, 9 aa, Homo Sapiens
QFNKTMDAK

SEQ ID NO: 311313 - protein, 9 aa, Homo Sapiens
LKCFNKRKT

SEQ ID NO: 311314 - protein, 9 aa, Homo Sapiens
GTRDDVPKA

SEQ ID NO: 311315 - protein, 9 aa, Homo Sapiens
IVKAQKCLV

SEQ ID NO: 311316 - protein, 9 aa, Homo Sapiens
RRYPEATSL

SEQ ID NO: 311317 - protein, 9 aa, Homo Sapiens
AFFNSLVDS

SEQ ID NO: 311318 - protein, 9 aa, Homo Sapiens
AFNTSPGVP

SEQ ID NO: 311319 - protein, 9 aa, Homo Sapiens
GITEEYLKQ

SEQ ID NO: 311320 - protein, 9 aa, Homo Sapiens
APSKSVGRN

SEQ ID NO: 311321 - protein, 9 aa, Homo Sapiens
LSAQVCEYK

SEQ ID NO: 311322 - protein, 9 aa, Homo Sapiens
PREWIRHLF

SEQ ID NO: 311323 - protein, 9 aa, Homo Sapiens
QWLLKNRLS

SEQ ID NO: 311324 - protein, 9 aa, Homo Sapiens
ESLLQSQSG

SEQ ID NO: 311325 - protein, 9 aa, Homo Sapiens
NTHTGDKPY

SEQ ID NO: 311326 - protein, 9 aa, Homo Sapiens
AEFEAEQEI

SEQ ID NO: 311327 - protein, 9 aa, Homo Sapiens
VVTRTGEQD

SEQ ID NO: 311328 - protein, 9 aa, Homo Sapiens
IIKVSGQKI

SEQ ID NO: 311329 - protein, 9 aa, Homo Sapiens
NRLYRRDDM

SEQ ID NO: 311330 - protein, 9 aa, Homo Sapiens
NNNVTEDIK

SEQ ID NO: 311331 - protein, 9 aa, Homo Sapiens
IKKCLSSVE

SEQ ID NO: 311332 - protein, 9 aa, Homo Sapiens
YNLEVQNII

SEQ ID NO: 311333 - protein, 9 aa, Homo Sapiens
LRANNPKVN

SEQ ID NO: 311334 - protein, 9 aa, Homo Sapiens
RRDNKTPTQ

SEQ ID NO: 311335 - protein, 9 aa, Homo Sapiens
VQPSSGLSG

SEQ ID NO: 311336 - protein, 9 aa, Homo Sapiens
MSRLHLCDS

SEQ ID NO: 311337 - protein, 9 aa, Homo Sapiens
HNPDTLLVL

SEQ ID NO: 311338 - protein, 9 aa, Homo Sapiens
ENVCYSIPE

SEQ ID NO: 311339 - protein, 9 aa, Homo Sapiens
KMSFQETKD

SEQ ID NO: 311340 - protein, 9 aa, Homo Sapiens
HQQTHEEKS

SEQ ID NO: 311341 - protein, 9 aa, Homo Sapiens
AFNRKQNVL

SEQ ID NO: 311342 - protein, 9 aa, Homo Sapiens
LEDHVFCQY

SEQ ID NO: 311343 - protein, 9 aa, Homo Sapiens
MEKIVEGCT

SEQ ID NO: 311344 - protein, 9 aa, Homo Sapiens
KVIGSVVML

SEQ ID NO: 311345 - protein, 9 aa, Homo Sapiens
HYCYQFGGQ

SEQ ID NO: 311346 - protein, 9 aa, Homo Sapiens
REGYPLWPE

SEQ ID NO: 311347 - protein, 9 aa, Homo Sapiens
QFLLFTEHF

SEQ ID NO: 311348 - protein, 9 aa, Homo Sapiens
LTEALRDLK

SEQ ID NO: 311349 - protein, 9 aa, Homo Sapiens
FQTSKFVLR

SEQ ID NO: 311350 - protein, 9 aa, Homo Sapiens
CFDAMGSLG

SEQ ID NO: 311351 - protein, 9 aa, Homo Sapiens
RGKFKQFCL

SEQ ID NO: 311352 - protein, 9 aa, Homo Sapiens
LRDLIRNYE

SEQ ID NO: 311353 - protein, 9 aa, Homo Sapiens
IIVQGRETA

SEQ ID NO: 311354 - protein, 9 aa, Homo Sapiens
TMSNLVPPV

SEQ ID NO: 311355 - protein, 9 aa, Homo Sapiens
SLTGVDPDH

SEQ ID NO: 311356 - protein, 9 aa, Homo Sapiens
LSVPGQNNV

SEQ ID NO: 311357 - protein, 9 aa, Homo Sapiens
SATINCLKN

SEQ ID NO: 311358 - protein, 9 aa, Homo Sapiens
WNRGATTFI

SEQ ID NO: 311359 - protein, 9 aa, Homo Sapiens
ALRNTEYVN

SEQ ID NO: 311360 - protein, 9 aa, Homo Sapiens
PKIIPPGRS

SEQ ID NO: 311361 - protein, 9 aa, Homo Sapiens
ECDAAKHRL

SEQ ID NO: 311362 - protein, 9 aa, Homo Sapiens
YKEFMADLV

SEQ ID NO: 311363 - protein, 9 aa, Homo Sapiens
LKLKLGLIS

SEQ ID NO: 311364 - protein, 9 aa, Homo Sapiens
MQRLLETEM

SEQ ID NO: 311365 - protein, 9 aa, Homo Sapiens
YLALHHHTN

SEQ ID NO: 311366 - protein, 9 aa, Homo Sapiens
KIISFLYDC

SEQ ID NO: 311367 - protein, 9 aa, Homo Sapiens
PDKLKKELE

SEQ ID NO: 311368 - protein, 9 aa, Homo Sapiens
CLLLDCRPS

SEQ ID NO: 311369 - protein, 9 aa, Homo Sapiens
RDGRKHVVP

SEQ ID NO: 311370 - protein, 9 aa, Homo Sapiens
IHNIFSKFG

SEQ ID NO: 311371 - protein, 9 aa, Homo Sapiens
QINGYQIVY

SEQ ID NO: 311372 - protein, 9 aa, Homo Sapiens
KDIIGPPMY

SEQ ID NO: 311373 - protein, 9 aa, Homo Sapiens
MNIHTCNFV

SEQ ID NO: 311374 - protein, 9 aa, Homo Sapiens
SLKKEGEQQ

SEQ ID NO: 311375 - protein, 9 aa, Homo Sapiens
KAESPIEVP

SEQ ID NO: 311376 - protein, 9 aa, Homo Sapiens
LIYETFYKL

SEQ ID NO: 311377 - protein, 9 aa, Homo Sapiens
KVLYVRTLM

SEQ ID NO: 311378 - protein, 9 aa, Homo Sapiens
MMGKTRQIN

SEQ ID NO: 311379 - protein, 9 aa, Homo Sapiens
FSYSSSFQI

SEQ ID NO: 311380 - protein, 9 aa, Homo Sapiens
SYHLIGHQR

SEQ ID NO: 311381 - protein, 9 aa, Homo Sapiens
AKVSKQSWG

SEQ ID NO: 311382 - protein, 9 aa, Homo Sapiens
DISFPGITG

SEQ ID NO: 311383 - protein, 9 aa, Homo Sapiens
VELRRNSRV

SEQ ID NO: 311384 - protein, 9 aa, Homo Sapiens
LDQHTADVK

SEQ ID NO: 311385 - protein, 9 aa, Homo Sapiens
NRVILLDPK

SEQ ID NO: 311386 - protein, 9 aa, Homo Sapiens
DVPKLQPHL

SEQ ID NO: 311387 - protein, 9 aa, Homo Sapiens
GDNRVILLD

SEQ ID NO: 311388 - protein, 9 aa, Homo Sapiens
RTSPDKRIA

SEQ ID NO: 311389 - protein, 9 aa, Homo Sapiens
GAAQPLFLH

SEQ ID NO: 311390 - protein, 9 aa, Homo Sapiens
GDPPGATAK

SEQ ID NO: 311391 - protein, 9 aa, Homo Sapiens
IFQQKMNYF

SEQ ID NO: 311392 - protein, 9 aa, Homo Sapiens
ESKEIQKLA

SEQ ID NO: 311393 - protein, 9 aa, Homo Sapiens
LSKIATTYS

SEQ ID NO: 311394 - protein, 9 aa, Homo Sapiens
IQLQGTNEY

SEQ ID NO: 311395 - protein, 9 aa, Homo Sapiens
VRIDQICSL

SEQ ID NO: 311396 - protein, 9 aa, Homo Sapiens
IGAKCKQLR

SEQ ID NO: 311397 - protein, 9 aa, Homo Sapiens
HINDVRHAN

SEQ ID NO: 311398 - protein, 9 aa, Homo Sapiens
VGPNNSYIA

SEQ ID NO: 311399 - protein, 9 aa, Homo Sapiens
GKAFSKSSY

SEQ ID NO: 311400 - protein, 9 aa, Homo Sapiens
YNLCSEIAY

SEQ ID NO: 311401 - protein, 9 aa, Homo Sapiens
IWKAPQAVS

SEQ ID NO: 311402 - protein, 9 aa, Homo Sapiens
HGLSVETEA

SEQ ID NO: 311403 - protein, 9 aa, Homo Sapiens
PPPVIQNGA

SEQ ID NO: 311404 - protein, 9 aa, Homo Sapiens
QICLIALFC

SEQ ID NO: 311405 - protein, 9 aa, Homo Sapiens
ATAGIMTRL

SEQ ID NO: 311406 - protein, 9 aa, Homo Sapiens
LHKHSVKQT

SEQ ID NO: 311407 - protein, 9 aa, Homo Sapiens
IGLHVLSCR

SEQ ID NO: 311408 - protein, 9 aa, Homo Sapiens
TSSCTNQNA

SEQ ID NO: 311409 - protein, 9 aa, Homo Sapiens
ALHHHTNLL

SEQ ID NO: 311410 - protein, 9 aa, Homo Sapiens
RCAQMEPNV

SEQ ID NO: 311411 - protein, 9 aa, Homo Sapiens
FLWAVRASS

SEQ ID NO: 311412 - protein, 9 aa, Homo Sapiens
GKAFHNNSS

SEQ ID NO: 311413 - protein, 9 aa, Homo Sapiens
TRTGEQDPA

SEQ ID NO: 311414 - protein, 9 aa, Homo Sapiens
CPSNKWCEK

SEQ ID NO: 311415 - protein, 9 aa, Homo Sapiens
HVQGNSSGV

SEQ ID NO: 311416 - protein, 9 aa, Homo Sapiens
GVVTPMLNH

SEQ ID NO: 311417 - protein, 9 aa, Homo Sapiens
INIMLVKTE

SEQ ID NO: 311418 - protein, 9 aa, Homo Sapiens
SESVLSVSC

SEQ ID NO: 311419 - protein, 9 aa, Homo Sapiens
WDPEVCIRE

SEQ ID NO: 311420 - protein, 9 aa, Homo Sapiens
ENIVQPPGK

SEQ ID NO: 311421 - protein, 9 aa, Homo Sapiens
TNANMEIAT

SEQ ID NO: 311422 - protein, 9 aa, Homo Sapiens
LESVERQLQ

SEQ ID NO: 311423 - protein, 9 aa, Homo Sapiens
EDWASEKDL

SEQ ID NO: 311424 - protein, 9 aa, Homo Sapiens
SRAVNWQER

SEQ ID NO: 311425 - protein, 9 aa, Homo Sapiens
AVLHCLLQP

SEQ ID NO: 311426 - protein, 9 aa, Homo Sapiens
YQEEWTCLD

SEQ ID NO: 311427 - protein, 9 aa, Homo Sapiens
LSAHLITHQ

SEQ ID NO: 311428 - protein, 9 aa, Homo Sapiens
LKELFVDDF

SEQ ID NO: 311429 - protein, 9 aa, Homo Sapiens
YSSSSPSRM

SEQ ID NO: 311430 - protein, 9 aa, Homo Sapiens
DFYMAYERG

SEQ ID NO: 311431 - protein, 9 aa, Homo Sapiens
FKECVILDI

SEQ ID NO: 311432 - protein, 9 aa, Homo Sapiens
CHRWHIFYL

SEQ ID NO: 311433 - protein, 9 aa, Homo Sapiens
RNLKTSDVS

SEQ ID NO: 311434 - protein, 9 aa, Homo Sapiens
AIQHSLVST

SEQ ID NO: 311435 - protein, 9 aa, Homo Sapiens
LFGAENSVN

SEQ ID NO: 311436 - protein, 9 aa, Homo Sapiens
EGEDTLELA

SEQ ID NO: 311437 - protein, 9 aa, Homo Sapiens
PLVCALFVA

SEQ ID NO: 311438 - protein, 9 aa, Homo Sapiens
SKHGLSVET

SEQ ID NO: 311439 - protein, 9 aa, Homo Sapiens
LSERADLFM

SEQ ID NO: 311440 - protein, 9 aa, Homo Sapiens
ALSTSPLVA

SEQ ID NO: 311441 - protein, 9 aa, Homo Sapiens
LHNLPRAVD

SEQ ID NO: 311442 - protein, 9 aa, Homo Sapiens
VYPANLLST

SEQ ID NO: 311443 - protein, 9 aa, Homo Sapiens
LLGLFPQSI

SEQ ID NO: 311444 - protein, 9 aa, Homo Sapiens
IVSYFAFGL

SEQ ID NO: 311445 - protein, 9 aa, Homo Sapiens
RVQIWKAPQ

SEQ ID NO: 311446 - protein, 9 aa, Homo Sapiens
KSLRVLWVL

SEQ ID NO: 311447 - protein, 9 aa, Homo Sapiens
EADNNTSQT

SEQ ID NO: 311448 - protein, 9 aa, Homo Sapiens
DNEAGKEEQ

SEQ ID NO: 311449 - protein, 9 aa, Homo Sapiens
ELQAQQILE

SEQ ID NO: 311450 - protein, 9 aa, Homo Sapiens
SLQFSVGYT

SEQ ID NO: 311451 - protein, 9 aa, Homo Sapiens
MSGIKRKAS

SEQ ID NO: 311452 - protein, 9 aa, Homo Sapiens
SPVLLEYPV

SEQ ID NO: 311453 - protein, 9 aa, Homo Sapiens
SLGSLGKST

SEQ ID NO: 311454 - protein, 9 aa, Homo Sapiens
KENYSEMDY

SEQ ID NO: 311455 - protein, 9 aa, Homo Sapiens
NPEVQHVDL

SEQ ID NO: 311456 - protein, 9 aa, Homo Sapiens
QAILRINWN

SEQ ID NO: 311457 - protein, 9 aa, Homo Sapiens
LLKCFNKRK

SEQ ID NO: 311458 - protein, 9 aa, Homo Sapiens
MPKMSFQET

SEQ ID NO: 311459 - protein, 9 aa, Homo Sapiens
DLNKQVLEH

SEQ ID NO: 311460 - protein, 9 aa, Homo Sapiens
MHETQRELR

SEQ ID NO: 311461 - protein, 9 aa, Homo Sapiens
VINGKPQFY

SEQ ID NO: 311462 - protein, 9 aa, Homo Sapiens
LGSSIVGGN

SEQ ID NO: 311463 - protein, 9 aa, Homo Sapiens
DVFCQNNVV

SEQ ID NO: 311464 - protein, 9 aa, Homo Sapiens
NSKGPSSKK

SEQ ID NO: 311465 - protein, 9 aa, Homo Sapiens
QKIIKNNLC

SEQ ID NO: 311466 - protein, 9 aa, Homo Sapiens
GPLKFIPCR

SEQ ID NO: 311467 - protein, 9 aa, Homo Sapiens
DMDKMFSFS

SEQ ID NO: 311468 - protein, 9 aa, Homo Sapiens
MCLTQVTVK

SEQ ID NO: 311469 - protein, 9 aa, Homo Sapiens
RSLFTLTEI

SEQ ID NO: 311470 - protein, 9 aa, Homo Sapiens
ALFYSASFR

SEQ ID NO: 311471 - protein, 9 aa, Homo Sapiens
TESPHKCLL

SEQ ID NO: 311472 - protein, 9 aa, Homo Sapiens
EFGTRIIKV

SEQ ID NO: 311473 - protein, 9 aa, Homo Sapiens
NFQEDTLKA

SEQ ID NO: 311474 - protein, 9 aa, Homo Sapiens
EAMWDDFIT

SEQ ID NO: 311475 - protein, 9 aa, Homo Sapiens
NIPFLYSLQ

SEQ ID NO: 311476 - protein, 9 aa, Homo Sapiens
LTLDYLKEV

SEQ ID NO: 311477 - protein, 9 aa, Homo Sapiens
QECLFHREK

SEQ ID NO: 311478 - protein, 9 aa, Homo Sapiens
LSPTFVMWE

SEQ ID NO: 311479 - protein, 9 aa, Homo Sapiens
LSPEEQEEY

SEQ ID NO: 311480 - protein, 9 aa, Homo Sapiens
NRYSTSLAD

SEQ ID NO: 311481 - protein, 9 aa, Homo Sapiens
LSLTKHKVI

SEQ ID NO: 311482 - protein, 9 aa, Homo Sapiens
QEERHNALP

SEQ ID NO: 311483 - protein, 9 aa, Homo Sapiens
TFEDVPDNK

SEQ ID NO: 311484 - protein, 9 aa, Homo Sapiens
KIMLVLPHD

SEQ ID NO: 311485 - protein, 9 aa, Homo Sapiens
VNRTPMYMT

SEQ ID NO: 311486 - protein, 9 aa, Homo Sapiens
LEDEIEHLQ

SEQ ID NO: 311487 - protein, 9 aa, Homo Sapiens
GSSDPSTSA

SEQ ID NO: 311488 - protein, 9 aa, Homo Sapiens
NNECLCTFR

SEQ ID NO: 311489 - protein, 9 aa, Homo Sapiens
VFAESKEIQ

SEQ ID NO: 311490 - protein, 9 aa, Homo Sapiens
HQRQTTPEG

SEQ ID NO: 311491 - protein, 9 aa, Homo Sapiens
SSFWSRKIA

SEQ ID NO: 311492 - protein, 9 aa, Homo Sapiens
TDTFIESSF

SEQ ID NO: 311493 - protein, 9 aa, Homo Sapiens
IAKPSLLKT

SEQ ID NO: 311494 - protein, 9 aa, Homo Sapiens
ILVSYGLIL

SEQ ID NO: 311495 - protein, 9 aa, Homo Sapiens
IRKPFFHSV

SEQ ID NO: 311496 - protein, 9 aa, Homo Sapiens
LVFPFTGVA

SEQ ID NO: 311497 - protein, 9 aa, Homo Sapiens
LMDCDKVKS

SEQ ID NO: 311498 - protein, 9 aa, Homo Sapiens
QSDTERSFQ

SEQ ID NO: 311499 - protein, 9 aa, Homo Sapiens
MVGMITAIA

SEQ ID NO: 311500 - protein, 9 aa, Homo Sapiens
LNKKCLQIL

SEQ ID NO: 311501 - protein, 9 aa, Homo Sapiens
IVEFTKKLP

SEQ ID NO: 311502 - protein, 9 aa, Homo Sapiens
NNESDLIEK

SEQ ID NO: 311503 - protein, 9 aa, Homo Sapiens
FREVGPNNS

SEQ ID NO: 311504 - protein, 9 aa, Homo Sapiens
TFILPHLKD

SEQ ID NO: 311505 - protein, 9 aa, Homo Sapiens
VGAGGRQRG

SEQ ID NO: 311506 - protein, 9 aa, Homo Sapiens
MDICRGLRS

SEQ ID NO: 311507 - protein, 9 aa, Homo Sapiens
NYIKQRKPK

SEQ ID NO: 311508 - protein, 9 aa, Homo Sapiens
CCTHYLPIE

SEQ ID NO: 311509 - protein, 9 aa, Homo Sapiens
EPSADLAPN

SEQ ID NO: 311510 - protein, 9 aa, Homo Sapiens
LPLLDEVLH

SEQ ID NO: 311511 - protein, 9 aa, Homo Sapiens
KKELNNLLA

SEQ ID NO: 311512 - protein, 9 aa, Homo Sapiens
EVQVGERLM

SEQ ID NO: 311513 - protein, 9 aa, Homo Sapiens
VGYIVSVID

SEQ ID NO: 311514 - protein, 9 aa, Homo Sapiens
HSCERGAPW

SEQ ID NO: 311515 - protein, 9 aa, Homo Sapiens
ESPTSWGCF

SEQ ID NO: 311516 - protein, 9 aa, Homo Sapiens
KAEKYRKNV

SEQ ID NO: 311517 - protein, 9 aa, Homo Sapiens
DPLMDQGDI

SEQ ID NO: 311518 - protein, 9 aa, Homo Sapiens
ELSKNEVLM

SEQ ID NO: 311519 - protein, 9 aa, Homo Sapiens
RSLWDTVKD

SEQ ID NO: 311520 - protein, 9 aa, Homo Sapiens
LAKVIHETW

SEQ ID NO: 311521 - protein, 9 aa, Homo Sapiens
TVDIAPNQR

SEQ ID NO: 311522 - protein, 9 aa, Homo Sapiens
QNGSLKTWN

SEQ ID NO: 311523 - protein, 9 aa, Homo Sapiens
QTTQAPYLQ

SEQ ID NO: 311524 - protein, 9 aa, Homo Sapiens
PHGQLVNGI

SEQ ID NO: 311525 - protein, 9 aa, Homo Sapiens
MRNKRVFKT

SEQ ID NO: 311526 - protein, 9 aa, Homo Sapiens
TVSKLDLIT

SEQ ID NO: 311527 - protein, 9 aa, Homo Sapiens
INKQNLILQ

SEQ ID NO: 311528 - protein, 9 aa, Homo Sapiens
LFQFLYPKT

SEQ ID NO: 311529 - protein, 9 aa, Homo Sapiens
LNALDIYGR

SEQ ID NO: 311530 - protein, 9 aa, Homo Sapiens
YSTFQNHEP

SEQ ID NO: 311531 - protein, 9 aa, Homo Sapiens
LQSQSGHLE

SEQ ID NO: 311532 - protein, 9 aa, Homo Sapiens
GPNEVNHLY

SEQ ID NO: 311533 - protein, 9 aa, Homo Sapiens
LAVTILYGT

SEQ ID NO: 311534 - protein, 9 aa, Homo Sapiens
FNQNDEQFL

SEQ ID NO: 311535 - protein, 9 aa, Homo Sapiens
CPIMAHGFT

SEQ ID NO: 311536 - protein, 9 aa, Homo Sapiens
HKIIFCQTP

SEQ ID NO: 311537 - protein, 9 aa, Homo Sapiens
VFVLIFFSR

SEQ ID NO: 311538 - protein, 9 aa, Homo Sapiens
NTSQGYTVN

SEQ ID NO: 311539 - protein, 9 aa, Homo Sapiens
ILYVYVLSL

SEQ ID NO: 311540 - protein, 9 aa, Homo Sapiens
LVLIWRGST

SEQ ID NO: 311541 - protein, 9 aa, Homo Sapiens
DPSIAPSSQ

SEQ ID NO: 311542 - protein, 9 aa, Homo Sapiens
CLGVSLAEP

SEQ ID NO: 311543 - protein, 9 aa, Homo Sapiens
SRYYKWNGF

SEQ ID NO: 311544 - protein, 9 aa, Homo Sapiens
SFFAIFLGA

SEQ ID NO: 311545 - protein, 9 aa, Homo Sapiens
ELFVKYKNY

SEQ ID NO: 311546 - protein, 9 aa, Homo Sapiens
QTAQRSALL

SEQ ID NO: 311547 - protein, 9 aa, Homo Sapiens
QLRHFSIYF

SEQ ID NO: 311548 - protein, 9 aa, Homo Sapiens
NLSMSCLDS

SEQ ID NO: 311549 - protein, 9 aa, Homo Sapiens
TKLNPPLMK

SEQ ID NO: 311550 - protein, 9 aa, Homo Sapiens
EKLYPKFAS

SEQ ID NO: 311551 - protein, 9 aa, Homo Sapiens
TTVTKILRA

SEQ ID NO: 311552 - protein, 9 aa, Homo Sapiens
SCERGAPWI

SEQ ID NO: 311553 - protein, 9 aa, Homo Sapiens
QMLHRLTAD

SEQ ID NO: 311554 - protein, 9 aa, Homo Sapiens
FLYGLFKNG

SEQ ID NO: 311555 - protein, 9 aa, Homo Sapiens
LYVGRENKL

SEQ ID NO: 311556 - protein, 9 aa, Homo Sapiens
KLPINGETQ

SEQ ID NO: 311557 - protein, 9 aa, Homo Sapiens
DVGFMVYKL

SEQ ID NO: 311558 - protein, 9 aa, Homo Sapiens
EQFEDNWYN

SEQ ID NO: 311559 - protein, 9 aa, Homo Sapiens
AVQLHVDQL

SEQ ID NO: 311560 - protein, 9 aa, Homo Sapiens
GVAYGHFPE

SEQ ID NO: 311561 - protein, 9 aa, Homo Sapiens
GNECISPQS

SEQ ID NO: 311562 - protein, 9 aa, Homo Sapiens
SFLHIRFHE

SEQ ID NO: 311563 - protein, 9 aa, Homo Sapiens
LTMVMVTTV

SEQ ID NO: 311564 - protein, 9 aa, Homo Sapiens
EKKKKDSIL

SEQ ID NO: 311565 - protein, 9 aa, Homo Sapiens
IVESVESCD

SEQ ID NO: 311566 - protein, 9 aa, Homo Sapiens
NTTLYHTKR

SEQ ID NO: 311567 - protein, 9 aa, Homo Sapiens
TQIAYIGLQ

SEQ ID NO: 311568 - protein, 9 aa, Homo Sapiens
MIGAKCKQL

SEQ ID NO: 311569 - protein, 9 aa, Homo Sapiens
SAGITDIKL

SEQ ID NO: 311570 - protein, 9 aa, Homo Sapiens
TQKSVTAKD

SEQ ID NO: 311571 - protein, 9 aa, Homo Sapiens
ILVGYVDSH

SEQ ID NO: 311572 - protein, 9 aa, Homo Sapiens
ASTNINAMA

SEQ ID NO: 311573 - protein, 9 aa, Homo Sapiens
LGTQIAYIG

SEQ ID NO: 311574 - protein, 9 aa, Homo Sapiens
FDNIVNSFI

SEQ ID NO: 311575 - protein, 9 aa, Homo Sapiens
LVILELRIK

SEQ ID NO: 311576 - protein, 9 aa, Homo Sapiens
DNGNIANSQ

SEQ ID NO: 311577 - protein, 9 aa, Homo Sapiens
LHAVRIDQI

SEQ ID NO: 311578 - protein, 9 aa, Homo Sapiens
GDKPYECAE

SEQ ID NO: 311579 - protein, 9 aa, Homo Sapiens
KNGPESIIN

SEQ ID NO: 311580 - protein, 9 aa, Homo Sapiens
KIWEQSKKL

SEQ ID NO: 311581 - protein, 9 aa, Homo Sapiens
RVTGMDKGI

SEQ ID NO: 311582 - protein, 9 aa, Homo Sapiens
APQVYWLKG

SEQ ID NO: 311583 - protein, 9 aa, Homo Sapiens
GRWCLSLEL

SEQ ID NO: 311584 - protein, 9 aa, Homo Sapiens
SCGDLLTFL

SEQ ID NO: 311585 - protein, 9 aa, Homo Sapiens
LRNQQVKDV

SEQ ID NO: 311586 - protein, 9 aa, Homo Sapiens
CKNCVHLLK

SEQ ID NO: 311587 - protein, 9 aa, Homo Sapiens
MTSTLRYWG

SEQ ID NO: 311588 - protein, 9 aa, Homo Sapiens
VEIMVPNYF

SEQ ID NO: 311589 - protein, 9 aa, Homo Sapiens
IVVPICTIK

SEQ ID NO: 311590 - protein, 9 aa, Homo Sapiens
TVNIQLQGT

SEQ ID NO: 311591 - protein, 9 aa, Homo Sapiens
SFERRPSTR

SEQ ID NO: 311592 - protein, 9 aa, Homo Sapiens
MLLCQEYTD

SEQ ID NO: 311593 - protein, 9 aa, Homo Sapiens
NHLYCDLPQ

SEQ ID NO: 311594 - protein, 9 aa, Homo Sapiens
NHEASSWAD

SEQ ID NO: 311595 - protein, 9 aa, Homo Sapiens
LVGYVDSHP

SEQ ID NO: 311596 - protein, 9 aa, Homo Sapiens
PTWRSLNFG

SEQ ID NO: 311597 - protein, 9 aa, Homo Sapiens
WHPRNAPPC

SEQ ID NO: 311598 - protein, 9 aa, Homo Sapiens
NEKSIKAEK

SEQ ID NO: 311599 - protein, 9 aa, Homo Sapiens
EAFQFALHS

SEQ ID NO: 311600 - protein, 9 aa, Homo Sapiens
SSMVSKRFC

SEQ ID NO: 311601 - protein, 9 aa, Homo Sapiens
KKVRSKNNN

SEQ ID NO: 311602 - protein, 9 aa, Homo Sapiens
MKYFTDKMK

SEQ ID NO: 311603 - protein, 9 aa, Homo Sapiens
INTFARNTS

SEQ ID NO: 311604 - protein, 9 aa, Homo Sapiens
LYPKDLRLY

SEQ ID NO: 311605 - protein, 9 aa, Homo Sapiens
AESQKQKEV

SEQ ID NO: 311606 - protein, 9 aa, Homo Sapiens
SGGVAKTML

SEQ ID NO: 311607 - protein, 9 aa, Homo Sapiens
DLIRNYEQH

SEQ ID NO: 311608 - protein, 9 aa, Homo Sapiens
QPKIGKWDR

SEQ ID NO: 311609 - protein, 9 aa, Homo Sapiens
RTLKKIIVE

SEQ ID NO: 311610 - protein, 9 aa, Homo Sapiens
LGLKSGQGQ

SEQ ID NO: 311611 - protein, 9 aa, Homo Sapiens
SPDILHIEL

SEQ ID NO: 311612 - protein, 9 aa, Homo Sapiens
KPKHNHILK

SEQ ID NO: 311613 - protein, 9 aa, Homo Sapiens
TLFITFGIL

SEQ ID NO: 311614 - protein, 9 aa, Homo Sapiens
ELNNRVGKA

SEQ ID NO: 311615 - protein, 9 aa, Homo Sapiens
IRGRKEGEE

SEQ ID NO: 311616 - protein, 9 aa, Homo Sapiens
VISLSHTSC

SEQ ID NO: 311617 - protein, 9 aa, Homo Sapiens
VSNEDPSSL

SEQ ID NO: 311618 - protein, 9 aa, Homo Sapiens
INLYRDVML

SEQ ID NO: 311619 - protein, 9 aa, Homo Sapiens
VSMSVFPSQ

SEQ ID NO: 311620 - protein, 9 aa, Homo Sapiens
RQMFCSRSI

SEQ ID NO: 311621 - protein, 9 aa, Homo Sapiens
KRRIRGRKE

SEQ ID NO: 311622 - protein, 9 aa, Homo Sapiens
PPADKVPER

SEQ ID NO: 311623 - protein, 9 aa, Homo Sapiens
RKCPLPRTI

SEQ ID NO: 311624 - protein, 9 aa, Homo Sapiens
IKYDPDREK

SEQ ID NO: 311625 - protein, 9 aa, Homo Sapiens
VWNSEPNNS

SEQ ID NO: 311626 - protein, 9 aa, Homo Sapiens
RAEVRKVLA

SEQ ID NO: 311627 - protein, 9 aa, Homo Sapiens
VWFQEAEER

SEQ ID NO: 311628 - protein, 9 aa, Homo Sapiens
KLFTTGENA

SEQ ID NO: 311629 - protein, 9 aa, Homo Sapiens
ALNYPRLAK

SEQ ID NO: 311630 - protein, 9 aa, Homo Sapiens
YRVKAIDFG

SEQ ID NO: 311631 - protein, 9 aa, Homo Sapiens
LQAQYGTEM

SEQ ID NO: 311632 - protein, 9 aa, Homo Sapiens
KLKNVIHNI

SEQ ID NO: 311633 - protein, 9 aa, Homo Sapiens
PGAPMGVHP

SEQ ID NO: 311634 - protein, 9 aa, Homo Sapiens
FKPEELRQT

SEQ ID NO: 311635 - protein, 9 aa, Homo Sapiens
VLAMDLMVF

SEQ ID NO: 311636 - protein, 9 aa, Homo Sapiens
ITIITLTLL

SEQ ID NO: 311637 - protein, 9 aa, Homo Sapiens
TKGCTTTNY

SEQ ID NO: 311638 - protein, 9 aa, Homo Sapiens
EEEEERQII

SEQ ID NO: 311639 - protein, 9 aa, Homo Sapiens
NKHIQDQLG

SEQ ID NO: 311640 - protein, 9 aa, Homo Sapiens
PTIEDIKDK

SEQ ID NO: 311641 - protein, 9 aa, Homo Sapiens
LINKHEFTI

SEQ ID NO: 311642 - protein, 9 aa, Homo Sapiens
PTSFHVIQA

SEQ ID NO: 311643 - protein, 9 aa, Homo Sapiens
RQKVVEKEA

SEQ ID NO: 311644 - protein, 9 aa, Homo Sapiens
KNYSEISSE

SEQ ID NO: 311645 - protein, 9 aa, Homo Sapiens
AMLLFKKSE

SEQ ID NO: 311646 - protein, 9 aa, Homo Sapiens
KGTLTAAFY

SEQ ID NO: 311647 - protein, 9 aa, Homo Sapiens
EKFMSLQEI

SEQ ID NO: 311648 - protein, 9 aa, Homo Sapiens
IRPLPPPGD

SEQ ID NO: 311649 - protein, 9 aa, Homo Sapiens
FPELAYQKE

SEQ ID NO: 311650 - protein, 9 aa, Homo Sapiens
VDGVRFIAN

SEQ ID NO: 311651 - protein, 9 aa, Homo Sapiens
RSFQDLKLP

SEQ ID NO: 311652 - protein, 9 aa, Homo Sapiens
ILGIELHVN

SEQ ID NO: 311653 - protein, 9 aa, Homo Sapiens
MEKTLRQME

SEQ ID NO: 311654 - protein, 9 aa, Homo Sapiens
KMYQYGAGV

SEQ ID NO: 311655 - protein, 9 aa, Homo Sapiens
LYYSQHVVK

SEQ ID NO: 311656 - protein, 9 aa, Homo Sapiens
IGWAWWLTP

SEQ ID NO: 311657 - protein, 9 aa, Homo Sapiens
RRLNTVNKC

SEQ ID NO: 311658 - protein, 9 aa, Homo Sapiens
EQSKKLSLF

SEQ ID NO: 311659 - protein, 9 aa, Homo Sapiens
YFLWAVRAS

SEQ ID NO: 311660 - protein, 9 aa, Homo Sapiens
HAEINQQLP

SEQ ID NO: 311661 - protein, 9 aa, Homo Sapiens
TLNNTTDQK

SEQ ID NO: 311662 - protein, 9 aa, Homo Sapiens
LVARIDYKV

SEQ ID NO: 311663 - protein, 9 aa, Homo Sapiens
PKVKADMET

SEQ ID NO: 311664 - protein, 9 aa, Homo Sapiens
PAEFTQHIF

SEQ ID NO: 311665 - protein, 9 aa, Homo Sapiens
KSIDEHYHI

SEQ ID NO: 311666 - protein, 9 aa, Homo Sapiens
IPGSRGERG

SEQ ID NO: 311667 - protein, 9 aa, Homo Sapiens
EAIVTSVEL

SEQ ID NO: 311668 - protein, 9 aa, Homo Sapiens
YRHCLIKKC

SEQ ID NO: 311669 - protein, 9 aa, Homo Sapiens
DYENGFGHF

SEQ ID NO: 311670 - protein, 9 aa, Homo Sapiens
HMNILPFVA

SEQ ID NO: 311671 - protein, 9 aa, Homo Sapiens
PLKDEIRHS

SEQ ID NO: 311672 - protein, 9 aa, Homo Sapiens
QNSSVWGRG

SEQ ID NO: 311673 - protein, 9 aa, Homo Sapiens
IIKKNGDIL

SEQ ID NO: 311674 - protein, 9 aa, Homo Sapiens
DIAGLLKQL

SEQ ID NO: 311675 - protein, 9 aa, Homo Sapiens
EEKSEEIYL

SEQ ID NO: 311676 - protein, 9 aa, Homo Sapiens
VPSSAHAGL

SEQ ID NO: 311677 - protein, 9 aa, Homo Sapiens
TVTSPQPPP

SEQ ID NO: 311678 - protein, 9 aa, Homo Sapiens
KTTAYSKLN

SEQ ID NO: 311679 - protein, 9 aa, Homo Sapiens
AITTMEMNI

SEQ ID NO: 311680 - protein, 9 aa, Homo Sapiens
KIINTVPHL

SEQ ID NO: 311681 - protein, 9 aa, Homo Sapiens
QINAVALVG

SEQ ID NO: 311682 - protein, 9 aa, Homo Sapiens
QALGYQPDL

SEQ ID NO: 311683 - protein, 9 aa, Homo Sapiens
KTRCISPRE

SEQ ID NO: 311684 - protein, 9 aa, Homo Sapiens
DQHTADVKG

SEQ ID NO: 311685 - protein, 9 aa, Homo Sapiens
YSSGLSRMG

SEQ ID NO: 311686 - protein, 9 aa, Homo Sapiens
RNDSNKKKK

SEQ ID NO: 311687 - protein, 9 aa, Homo Sapiens
LGLYDLWAK

SEQ ID NO: 311688 - protein, 9 aa, Homo Sapiens
VPMSEKSIY

SEQ ID NO: 311689 - protein, 9 aa, Homo Sapiens
THLKDKSSL

SEQ ID NO: 311690 - protein, 9 aa, Homo Sapiens
LIHLFSKFY

SEQ ID NO: 311691 - protein, 9 aa, Homo Sapiens
LGSRSSTST

SEQ ID NO: 311692 - protein, 9 aa, Homo Sapiens
GNLYWGSVT

SEQ ID NO: 311693 - protein, 9 aa, Homo Sapiens
ELAQILPTK

SEQ ID NO: 311694 - protein, 9 aa, Homo Sapiens
SLVILFINL

SEQ ID NO: 311695 - protein, 9 aa, Homo Sapiens
QNVPIERIP

SEQ ID NO: 311696 - protein, 9 aa, Homo Sapiens
ANSGYGSYG

SEQ ID NO: 311697 - protein, 9 aa, Homo Sapiens
LDKQNEQLL

SEQ ID NO: 311698 - protein, 9 aa, Homo Sapiens
FVEKLVKEQ

SEQ ID NO: 311699 - protein, 9 aa, Homo Sapiens
PKLMLCRSE

SEQ ID NO: 311700 - protein, 9 aa, Homo Sapiens
IPLTAQMVM

SEQ ID NO: 311701 - protein, 9 aa, Homo Sapiens
SNYLQKYHN

SEQ ID NO: 311702 - protein, 9 aa, Homo Sapiens
DRKENTMAD

SEQ ID NO: 311703 - protein, 9 aa, Homo Sapiens
PKVIMRIYE

SEQ ID NO: 311704 - protein, 9 aa, Homo Sapiens
VVLYVLNQI

SEQ ID NO: 311705 - protein, 9 aa, Homo Sapiens
GIPPEWLFN

SEQ ID NO: 311706 - protein, 9 aa, Homo Sapiens
PAGCTSSPC

SEQ ID NO: 311707 - protein, 9 aa, Homo Sapiens
EKMQYASES

SEQ ID NO: 311708 - protein, 9 aa, Homo Sapiens
EKALKTTLD

SEQ ID NO: 311709 - protein, 9 aa, Homo Sapiens
KGYYTCCDL

SEQ ID NO: 311710 - protein, 9 aa, Homo Sapiens
QRLFQALPG

SEQ ID NO: 311711 - protein, 9 aa, Homo Sapiens
ELNNASLQD

SEQ ID NO: 311712 - protein, 9 aa, Homo Sapiens
MRHQIIHTG

SEQ ID NO: 311713 - protein, 9 aa, Homo Sapiens
LSPDQCCIV

SEQ ID NO: 311714 - protein, 9 aa, Homo Sapiens
HNSPGSTDT

SEQ ID NO: 311715 - protein, 9 aa, Homo Sapiens
WALPALPSL

SEQ ID NO: 311716 - protein, 9 aa, Homo Sapiens
IIHWAAVKA

SEQ ID NO: 311717 - protein, 9 aa, Homo Sapiens
ELYAIKNAS

SEQ ID NO: 311718 - protein, 9 aa, Homo Sapiens
VCGMENGFR

SEQ ID NO: 311719 - protein, 9 aa, Homo Sapiens
NSCYPKEIV

SEQ ID NO: 311720 - protein, 9 aa, Homo Sapiens
WIILLVKAG

SEQ ID NO: 311721 - protein, 9 aa, Homo Sapiens
ITWILKDSL

SEQ ID NO: 311722 - protein, 9 aa, Homo Sapiens
QPPHHQFFQ

SEQ ID NO: 311723 - protein, 9 aa, Homo Sapiens
EKVALDPEL

SEQ ID NO: 311724 - protein, 9 aa, Homo Sapiens
HVNSDRIDS

SEQ ID NO: 311725 - protein, 9 aa, Homo Sapiens
FHQPLRLLN

SEQ ID NO: 311726 - protein, 9 aa, Homo Sapiens
GKFNGNPMH

SEQ ID NO: 311727 - protein, 9 aa, Homo Sapiens
RTFQSVLAM

SEQ ID NO: 311728 - protein, 9 aa, Homo Sapiens
RQITGSLKI

SEQ ID NO: 311729 - protein, 9 aa, Homo Sapiens
AFFAGPSLR

SEQ ID NO: 311730 - protein, 9 aa, Homo Sapiens
APQFAVLYD

SEQ ID NO: 311731 - protein, 9 aa, Homo Sapiens
VCADTGGLG

SEQ ID NO: 311732 - protein, 9 aa, Homo Sapiens
CMHETQREL

SEQ ID NO: 311733 - protein, 9 aa, Homo Sapiens
SEHLIQHQI

SEQ ID NO: 311734 - protein, 9 aa, Homo Sapiens
VCDISYVLA

SEQ ID NO: 311735 - protein, 9 aa, Homo Sapiens
KENHIFLFV

SEQ ID NO: 311736 - protein, 9 aa, Homo Sapiens
GLDQMVKMT

SEQ ID NO: 311737 - protein, 9 aa, Homo Sapiens
KTEGSRGAV

SEQ ID NO: 311738 - protein, 9 aa, Homo Sapiens
AVAGGLLVT

SEQ ID NO: 311739 - protein, 9 aa, Homo Sapiens
LDNSPGHGK

SEQ ID NO: 311740 - protein, 9 aa, Homo Sapiens
LEMINEDGR

SEQ ID NO: 311741 - protein, 9 aa, Homo Sapiens
MKLSDLAQP

SEQ ID NO: 311742 - protein, 9 aa, Homo Sapiens
LLMPINTLS

SEQ ID NO: 311743 - protein, 9 aa, Homo Sapiens
QDHGCFVCG

SEQ ID NO: 311744 - protein, 9 aa, Homo Sapiens
TYCEGDNHL

SEQ ID NO: 311745 - protein, 9 aa, Homo Sapiens
TFREVRHWK

SEQ ID NO: 311746 - protein, 9 aa, Homo Sapiens
QEGGIHKDI

SEQ ID NO: 311747 - protein, 9 aa, Homo Sapiens
QGKLQLQKW

SEQ ID NO: 311748 - protein, 9 aa, Homo Sapiens
NLNSPEKLY

SEQ ID NO: 311749 - protein, 9 aa, Homo Sapiens
KIYNIKSAN

SEQ ID NO: 311750 - protein, 9 aa, Homo Sapiens
FTNLKYKRV

SEQ ID NO: 311751 - protein, 9 aa, Homo Sapiens
DVQLKNQAM

SEQ ID NO: 311752 - protein, 9 aa, Homo Sapiens
YFVPPSKAS

SEQ ID NO: 311753 - protein, 9 aa, Homo Sapiens
ASKKYTVKA

SEQ ID NO: 311754 - protein, 9 aa, Homo Sapiens
KIILTPQVM

SEQ ID NO: 311755 - protein, 9 aa, Homo Sapiens
IMSQTVCIR

SEQ ID NO: 311756 - protein, 9 aa, Homo Sapiens
CKQGYIINS

SEQ ID NO: 311757 - protein, 9 aa, Homo Sapiens
DIPQIPDST

SEQ ID NO: 311758 - protein, 9 aa, Homo Sapiens
LGYQPDLSY

SEQ ID NO: 311759 - protein, 9 aa, Homo Sapiens
MTDTPNALL

SEQ ID NO: 311760 - protein, 9 aa, Homo Sapiens
TGTLPSVEL

SEQ ID NO: 311761 - protein, 9 aa, Homo Sapiens
SHFNNVHGD

SEQ ID NO: 311762 - protein, 9 aa, Homo Sapiens
PFTCNECGR

SEQ ID NO: 311763 - protein, 9 aa, Homo Sapiens
PCNECTKLI

SEQ ID NO: 311764 - protein, 9 aa, Homo Sapiens
GATATYTEE

SEQ ID NO: 311765 - protein, 9 aa, Homo Sapiens
RYGLIPEEL

SEQ ID NO: 311766 - protein, 9 aa, Homo Sapiens
VSDKSEGPC

SEQ ID NO: 311767 - protein, 9 aa, Homo Sapiens
NVLRRELAL

SEQ ID NO: 311768 - protein, 9 aa, Homo Sapiens
QIVDNTVYR

SEQ ID NO: 311769 - protein, 9 aa, Homo Sapiens
GPEGKLTGP

SEQ ID NO: 311770 - protein, 9 aa, Homo Sapiens
ASPTAGPQE

SEQ ID NO: 311771 - protein, 9 aa, Homo Sapiens
FYFDNIVNS

SEQ ID NO: 311772 - protein, 9 aa, Homo Sapiens
EKENYHDVT

SEQ ID NO: 311773 - protein, 9 aa, Homo Sapiens
IQNGARDAP

SEQ ID NO: 311774 - protein, 9 aa, Homo Sapiens
VQGLSNFIN

SEQ ID NO: 311775 - protein, 9 aa, Homo Sapiens
VGSSAFKIF

SEQ ID NO: 311776 - protein, 9 aa, Homo Sapiens
SSWHLSNRS

SEQ ID NO: 311777 - protein, 9 aa, Homo Sapiens
TSLNKAFLI

SEQ ID NO: 311778 - protein, 9 aa, Homo Sapiens
SSKLMEHKI

SEQ ID NO: 311779 - protein, 9 aa, Homo Sapiens
QIPNTLLPE

SEQ ID NO: 311780 - protein, 9 aa, Homo Sapiens
STLTSDAST

SEQ ID NO: 311781 - protein, 9 aa, Homo Sapiens
KTDNLLLYE

SEQ ID NO: 311782 - protein, 9 aa, Homo Sapiens
RELESFRTR

SEQ ID NO: 311783 - protein, 9 aa, Homo Sapiens
NNVEYTFTG

SEQ ID NO: 311784 - protein, 9 aa, Homo Sapiens
WTNANMEIA

SEQ ID NO: 311785 - protein, 9 aa, Homo Sapiens
AYIGLQFIS

SEQ ID NO: 311786 - protein, 9 aa, Homo Sapiens
SNADEAGSD

SEQ ID NO: 311787 - protein, 9 aa, Homo Sapiens
TKAWKFICD

SEQ ID NO: 311788 - protein, 9 aa, Homo Sapiens
GCYANNFGP

SEQ ID NO: 311789 - protein, 9 aa, Homo Sapiens
IFKINNSRL

SEQ ID NO: 311790 - protein, 9 aa, Homo Sapiens
FREVRHWKS

SEQ ID NO: 311791 - protein, 9 aa, Homo Sapiens
VHIKSAGYK

SEQ ID NO: 311792 - protein, 9 aa, Homo Sapiens
HALVINTLP

SEQ ID NO: 311793 - protein, 9 aa, Homo Sapiens
KQQASKNTS

SEQ ID NO: 311794 - protein, 9 aa, Homo Sapiens
ILRKELEEI

SEQ ID NO: 311795 - protein, 9 aa, Homo Sapiens
KLEAKKAAK

SEQ ID NO: 311796 - protein, 9 aa, Homo Sapiens
ENGREYKCD

SEQ ID NO: 311797 - protein, 9 aa, Homo Sapiens
TPYTSAVDM

SEQ ID NO: 311798 - protein, 9 aa, Homo Sapiens
RPNNIDPAL

SEQ ID NO: 311799 - protein, 9 aa, Homo Sapiens
NKLLSSQLE

SEQ ID NO: 311800 - protein, 9 aa, Homo Sapiens
ENNFRQILC

SEQ ID NO: 311801 - protein, 9 aa, Homo Sapiens
VGAVDVLTL

SEQ ID NO: 311802 - protein, 9 aa, Homo Sapiens
GPNIINHFL

SEQ ID NO: 311803 - protein, 9 aa, Homo Sapiens
DGRKHVVPC

SEQ ID NO: 311804 - protein, 9 aa, Homo Sapiens
QLEHLEFLD

SEQ ID NO: 311805 - protein, 9 aa, Homo Sapiens
LYQKLGSDV

SEQ ID NO: 311806 - protein, 9 aa, Homo Sapiens
GDQVTGTLP

SEQ ID NO: 311807 - protein, 9 aa, Homo Sapiens
LYKCHPDIF

SEQ ID NO: 311808 - protein, 9 aa, Homo Sapiens
ENKKHKKKR

SEQ ID NO: 311809 - protein, 9 aa, Homo Sapiens
NWIVNKHRM

SEQ ID NO: 311810 - protein, 9 aa, Homo Sapiens
IPLTVFPFT

SEQ ID NO: 311811 - protein, 9 aa, Homo Sapiens
ENLARHHIL

SEQ ID NO: 311812 - protein, 9 aa, Homo Sapiens
GFFMAEEVG

SEQ ID NO: 311813 - protein, 9 aa, Homo Sapiens
DATAEIIDE

SEQ ID NO: 311814 - protein, 9 aa, Homo Sapiens
DNTLSKLLS

SEQ ID NO: 311815 - protein, 9 aa, Homo Sapiens
DICSMTLKL

SEQ ID NO: 311816 - protein, 9 aa, Homo Sapiens
PDFHPKIKY

SEQ ID NO: 311817 - protein, 9 aa, Homo Sapiens
VQSYCGHGI

SEQ ID NO: 311818 - protein, 9 aa, Homo Sapiens
IGFKNFYSI

SEQ ID NO: 311819 - protein, 9 aa, Homo Sapiens
TQSFFAIFL

SEQ ID NO: 311820 - protein, 9 aa, Homo Sapiens
QDQAIKTSI

SEQ ID NO: 311821 - protein, 9 aa, Homo Sapiens
RGHCECGHC

SEQ ID NO: 311822 - protein, 9 aa, Homo Sapiens
VYFFSANTK

SEQ ID NO: 311823 - protein, 9 aa, Homo Sapiens
SEEKKASDQ

SEQ ID NO: 311824 - protein, 9 aa, Homo Sapiens
QSYKYNECG

SEQ ID NO: 311825 - protein, 9 aa, Homo Sapiens
SVNKTLVVN

SEQ ID NO: 311826 - protein, 9 aa, Homo Sapiens
AGLCYHYCF

SEQ ID NO: 311827 - protein, 9 aa, Homo Sapiens
SMPNPNHDT

SEQ ID NO: 311828 - protein, 9 aa, Homo Sapiens
KLAGWQCPE

SEQ ID NO: 311829 - protein, 9 aa, Homo Sapiens
LNCCRDAVF

SEQ ID NO: 311830 - protein, 9 aa, Homo Sapiens
KCKNCVHLL

SEQ ID NO: 311831 - protein, 9 aa, Homo Sapiens
EGLPGMCTR

SEQ ID NO: 311832 - protein, 9 aa, Homo Sapiens
VSPSGPGVA

SEQ ID NO: 311833 - protein, 9 aa, Homo Sapiens
TMLDFQTSK

SEQ ID NO: 311834 - protein, 9 aa, Homo Sapiens
MNVIVVDWN

SEQ ID NO: 311835 - protein, 9 aa, Homo Sapiens
TPDKLKKEL

SEQ ID NO: 311836 - protein, 9 aa, Homo Sapiens
SFSSSLQIH

SEQ ID NO: 311837 - protein, 9 aa, Homo Sapiens
NKDKDGKSP

SEQ ID NO: 311838 - protein, 9 aa, Homo Sapiens
TQDDIIEFA

SEQ ID NO: 311839 - protein, 9 aa, Homo Sapiens
LILHQRVNT

SEQ ID NO: 311840 - protein, 9 aa, Homo Sapiens
GFINYLDES

SEQ ID NO: 311841 - protein, 9 aa, Homo Sapiens
PYECSECGQ

SEQ ID NO: 311842 - protein, 9 aa, Homo Sapiens
PGCSLMYHL

SEQ ID NO: 311843 - protein, 9 aa, Homo Sapiens
HITVRGQPA

SEQ ID NO: 311844 - protein, 9 aa, Homo Sapiens
ITKMYETTT

SEQ ID NO: 311845 - protein, 9 aa, Homo Sapiens
FVQKTHLIA

SEQ ID NO: 311846 - protein, 9 aa, Homo Sapiens
NEVQSQNLL

SEQ ID NO: 311847 - protein, 9 aa, Homo Sapiens
KENFLLCFR

SEQ ID NO: 311848 - protein, 9 aa, Homo Sapiens
DPASVGSSP

SEQ ID NO: 311849 - protein, 9 aa, Homo Sapiens
RPKGSKSKE

SEQ ID NO: 311850 - protein, 9 aa, Homo Sapiens
HTATTQCQI

SEQ ID NO: 311851 - protein, 9 aa, Homo Sapiens
KQLYLFYNF

SEQ ID NO: 311852 - protein, 9 aa, Homo Sapiens
NAYLFKGNI

SEQ ID NO: 311853 - protein, 9 aa, Homo Sapiens
STVHITNKR

SEQ ID NO: 311854 - protein, 9 aa, Homo Sapiens
YNEDVTLGS

SEQ ID NO: 311855 - protein, 9 aa, Homo Sapiens
RKLKNSHGW

SEQ ID NO: 311856 - protein, 9 aa, Homo Sapiens
KLTGPKFKM

SEQ ID NO: 311857 - protein, 9 aa, Homo Sapiens
SSHFNNVHG

SEQ ID NO: 311858 - protein, 9 aa, Homo Sapiens
DSDVVENNL

SEQ ID NO: 311859 - protein, 9 aa, Homo Sapiens
ISVGTFLLL

SEQ ID NO: 311860 - protein, 9 aa, Homo Sapiens
GIDMKDKLL

SEQ ID NO: 311861 - protein, 9 aa, Homo Sapiens
VSETDVQEE

SEQ ID NO: 311862 - protein, 9 aa, Homo Sapiens
KCHILSGTS

SEQ ID NO: 311863 - protein, 9 aa, Homo Sapiens
FEDGKEFEL

SEQ ID NO: 311864 - protein, 9 aa, Homo Sapiens
RVTAPHPAV

SEQ ID NO: 311865 - protein, 9 aa, Homo Sapiens
ARHHVGRVA

SEQ ID NO: 311866 - protein, 9 aa, Homo Sapiens
PNYSIKNQT

SEQ ID NO: 311867 - protein, 9 aa, Homo Sapiens
KVVGMVGSL

SEQ ID NO: 311868 - protein, 9 aa, Homo Sapiens
YTHGLNITG

SEQ ID NO: 311869 - protein, 9 aa, Homo Sapiens
TLMISTTEE

SEQ ID NO: 311870 - protein, 9 aa, Homo Sapiens
AFSQLSSLQ

SEQ ID NO: 311871 - protein, 9 aa, Homo Sapiens
LCFMNNILS

SEQ ID NO: 311872 - protein, 9 aa, Homo Sapiens
ECTESPHKC

SEQ ID NO: 311873 - protein, 9 aa, Homo Sapiens
HYCPRKCVV

SEQ ID NO: 311874 - protein, 9 aa, Homo Sapiens
ETAPTSDND

SEQ ID NO: 311875 - protein, 9 aa, Homo Sapiens
CDNEFLGHR

SEQ ID NO: 311876 - protein, 9 aa, Homo Sapiens
DPPGATAKG

SEQ ID NO: 311877 - protein, 9 aa, Homo Sapiens
FVCLMFLTQ

SEQ ID NO: 311878 - protein, 9 aa, Homo Sapiens
STFYFVPPS

SEQ ID NO: 311879 - protein, 9 aa, Homo Sapiens
AHGHQHFRP

SEQ ID NO: 311880 - protein, 9 aa, Homo Sapiens
PARFIEDMI

SEQ ID NO: 311881 - protein, 9 aa, Homo Sapiens
KVIKKFPAP

SEQ ID NO: 311882 - protein, 9 aa, Homo Sapiens
YWVGINSND

SEQ ID NO: 311883 - protein, 9 aa, Homo Sapiens
VPHLAAVPG

SEQ ID NO: 311884 - protein, 9 aa, Homo Sapiens
EQDNQNLRM

SEQ ID NO: 311885 - protein, 9 aa, Homo Sapiens
KGLQDGIGQ

SEQ ID NO: 311886 - protein, 9 aa, Homo Sapiens
IDSPTGSKD

SEQ ID NO: 311887 - protein, 9 aa, Homo Sapiens
LIVTDNKGT

SEQ ID NO: 311888 - protein, 9 aa, Homo Sapiens
AGTVADVYI

SEQ ID NO: 311889 - protein, 9 aa, Homo Sapiens
QQCFLFSKH

SEQ ID NO: 311890 - protein, 9 aa, Homo Sapiens
VIVIQLMYT

SEQ ID NO: 311891 - protein, 9 aa, Homo Sapiens
RSQLEQKKE

SEQ ID NO: 311892 - protein, 9 aa, Homo Sapiens
HNSNSGPNE

SEQ ID NO: 311893 - protein, 9 aa, Homo Sapiens
QLNLRKFNL

SEQ ID NO: 311894 - protein, 9 aa, Homo Sapiens
FFMAEEVGK

SEQ ID NO: 311895 - protein, 9 aa, Homo Sapiens
AFLQGEIKG

SEQ ID NO: 311896 - protein, 9 aa, Homo Sapiens
FQKLLILRG

SEQ ID NO: 311897 - protein, 9 aa, Homo Sapiens
IFVVCQGVL

SEQ ID NO: 311898 - protein, 9 aa, Homo Sapiens
HNHEASSWA

SEQ ID NO: 311899 - protein, 9 aa, Homo Sapiens
KRIKLHIWD

SEQ ID NO: 311900 - protein, 9 aa, Homo Sapiens
QPNSSSLKS

SEQ ID NO: 311901 - protein, 9 aa, Homo Sapiens
LCTIVESCN

SEQ ID NO: 311902 - protein, 9 aa, Homo Sapiens
LLNQIQRHH

SEQ ID NO: 311903 - protein, 9 aa, Homo Sapiens
IVESCNSPN

SEQ ID NO: 311904 - protein, 9 aa, Homo Sapiens
DLMDKLKGR

SEQ ID NO: 311905 - protein, 9 aa, Homo Sapiens
EKVTSPSQY

SEQ ID NO: 311906 - protein, 9 aa, Homo Sapiens
MERQIRPWI

SEQ ID NO: 311907 - protein, 9 aa, Homo Sapiens
ARICLGGPE

SEQ ID NO: 311908 - protein, 9 aa, Homo Sapiens
AHRFTVPAP

SEQ ID NO: 311909 - protein, 9 aa, Homo Sapiens
IQKRLIQRR

SEQ ID NO: 311910 - protein, 9 aa, Homo Sapiens
LMLIGNIVL

SEQ ID NO: 311911 - protein, 9 aa, Homo Sapiens
VPTPLPIQL

SEQ ID NO: 311912 - protein, 9 aa, Homo Sapiens
WNPWKAAYH

SEQ ID NO: 311913 - protein, 9 aa, Homo Sapiens
LKRRMVLVQ

SEQ ID NO: 311914 - protein, 9 aa, Homo Sapiens
HLELARSYP

SEQ ID NO: 311915 - protein, 9 aa, Homo Sapiens
NVIIDKVHL

SEQ ID NO: 311916 - protein, 9 aa, Homo Sapiens
QGEDFMLHK

SEQ ID NO: 311917 - protein, 9 aa, Homo Sapiens
EIHGLKEPK

SEQ ID NO: 311918 - protein, 9 aa, Homo Sapiens
GLYNPYGPQ

SEQ ID NO: 311919 - protein, 9 aa, Homo Sapiens
HFIASSDLP

SEQ ID NO: 311920 - protein, 9 aa, Homo Sapiens
TVQYIMNNS

SEQ ID NO: 311921 - protein, 9 aa, Homo Sapiens
EKVNLQKCD

SEQ ID NO: 311922 - protein, 9 aa, Homo Sapiens
IHTCNFVVL

SEQ ID NO: 311923 - protein, 9 aa, Homo Sapiens
NKERIKYSR

SEQ ID NO: 311924 - protein, 9 aa, Homo Sapiens
CFGLGQMYI

SEQ ID NO: 311925 - protein, 9 aa, Homo Sapiens
KDLSLVLPL

SEQ ID NO: 311926 - protein, 9 aa, Homo Sapiens
EIQWEKNIT

SEQ ID NO: 311927 - protein, 9 aa, Homo Sapiens
HREQHHPEL

SEQ ID NO: 311928 - protein, 9 aa, Homo Sapiens
FFAIILKLM

SEQ ID NO: 311929 - protein, 9 aa, Homo Sapiens
SPSFSTDSW

SEQ ID NO: 311930 - protein, 9 aa, Homo Sapiens
ALRVDQIRG

SEQ ID NO: 311931 - protein, 9 aa, Homo Sapiens
AAPAHRRLW

SEQ ID NO: 311932 - protein, 9 aa, Homo Sapiens
RNKKVLKDV

SEQ ID NO: 311933 - protein, 9 aa, Homo Sapiens
DKQLLYSEN

SEQ ID NO: 311934 - protein, 9 aa, Homo Sapiens
MDPSFFQRD

SEQ ID NO: 311935 - protein, 9 aa, Homo Sapiens
PDLYVQMKW

SEQ ID NO: 311936 - protein, 9 aa, Homo Sapiens
PHPESYSTG

SEQ ID NO: 311937 - protein, 9 aa, Homo Sapiens
QTTDNIFFW

SEQ ID NO: 311938 - protein, 9 aa, Homo Sapiens
VHTRYQPYK

SEQ ID NO: 311939 - protein, 9 aa, Homo Sapiens
GTTGQSTPC

SEQ ID NO: 311940 - protein, 9 aa, Homo Sapiens
TPQGKQKVI

SEQ ID NO: 311941 - protein, 9 aa, Homo Sapiens
KNQLWALPA

SEQ ID NO: 311942 - protein, 9 aa, Homo Sapiens
HIEDNIINE

SEQ ID NO: 311943 - protein, 9 aa, Homo Sapiens
VSLFYGTLL

SEQ ID NO: 311944 - protein, 9 aa, Homo Sapiens
HRASLLQNE

SEQ ID NO: 311945 - protein, 9 aa, Homo Sapiens
ATYNVDRSG

SEQ ID NO: 311946 - protein, 9 aa, Homo Sapiens
CQGVLAPDK

SEQ ID NO: 311947 - protein, 9 aa, Homo Sapiens
KQMMFTTAL

SEQ ID NO: 311948 - protein, 9 aa, Homo Sapiens
NWRAKLKRS

SEQ ID NO: 311949 - protein, 9 aa, Homo Sapiens
QSHSSADDA

SEQ ID NO: 311950 - protein, 9 aa, Homo Sapiens
LARDFENNY

SEQ ID NO: 311951 - protein, 9 aa, Homo Sapiens
HLAHHEIIH

SEQ ID NO: 311952 - protein, 9 aa, Homo Sapiens
PEQFCVIIE

SEQ ID NO: 311953 - protein, 9 aa, Homo Sapiens
EVYGHNIND

SEQ ID NO: 311954 - protein, 9 aa, Homo Sapiens
LQQEAPHPQ

SEQ ID NO: 311955 - protein, 9 aa, Homo Sapiens
SGKRTIIER

SEQ ID NO: 311956 - protein, 9 aa, Homo Sapiens
SMVSKRFCF

SEQ ID NO: 311957 - protein, 9 aa, Homo Sapiens
DITIVKETN

SEQ ID NO: 311958 - protein, 9 aa, Homo Sapiens
QGNPKMKIH

SEQ ID NO: 311959 - protein, 9 aa, Homo Sapiens
RAKAMQTKE

SEQ ID NO: 311960 - protein, 9 aa, Homo Sapiens
KTFVEKLVK

SEQ ID NO: 311961 - protein, 9 aa, Homo Sapiens
AAYYPCEPA

SEQ ID NO: 311962 - protein, 9 aa, Homo Sapiens
IMLGCFQLQ

SEQ ID NO: 311963 - protein, 9 aa, Homo Sapiens
SELKQRLSV

SEQ ID NO: 311964 - protein, 9 aa, Homo Sapiens
THDVLTELL

SEQ ID NO: 311965 - protein, 9 aa, Homo Sapiens
HRWHIFYLQ

SEQ ID NO: 311966 - protein, 9 aa, Homo Sapiens
GCCSEQQEE

SEQ ID NO: 311967 - protein, 9 aa, Homo Sapiens
MSQTVCIRL

SEQ ID NO: 311968 - protein, 9 aa, Homo Sapiens
LVCRKEKTT

SEQ ID NO: 311969 - protein, 9 aa, Homo Sapiens
NYAVKLVND

SEQ ID NO: 311970 - protein, 9 aa, Homo Sapiens
TNEIAPLGP

SEQ ID NO: 311971 - protein, 9 aa, Homo Sapiens
HVRPDYLKA

SEQ ID NO: 311972 - protein, 9 aa, Homo Sapiens
IPQIEDADI

SEQ ID NO: 311973 - protein, 9 aa, Homo Sapiens
SLGKSTPLK

SEQ ID NO: 311974 - protein, 9 aa, Homo Sapiens
KIDGRALEK

SEQ ID NO: 311975 - protein, 9 aa, Homo Sapiens
LHGMSDLLF

SEQ ID NO: 311976 - protein, 9 aa, Homo Sapiens
PKRAKAMQT

SEQ ID NO: 311977 - protein, 9 aa, Homo Sapiens
VASKEPNKK

SEQ ID NO: 311978 - protein, 9 aa, Homo Sapiens
VKTLKEDWA

SEQ ID NO: 311979 - protein, 9 aa, Homo Sapiens
FGGVAGEAA

SEQ ID NO: 311980 - protein, 9 aa, Homo Sapiens
HVRIQAVLA

SEQ ID NO: 311981 - protein, 9 aa, Homo Sapiens
KDMCKIRCL

SEQ ID NO: 311982 - protein, 9 aa, Homo Sapiens
PAKIITLRE

SEQ ID NO: 311983 - protein, 9 aa, Homo Sapiens
ILEDTEEEE

SEQ ID NO: 311984 - protein, 9 aa, Homo Sapiens
KLSNPKIHI

SEQ ID NO: 311985 - protein, 9 aa, Homo Sapiens
KITGTGTPV

SEQ ID NO: 311986 - protein, 9 aa, Homo Sapiens
LDQMVKMTE

SEQ ID NO: 311987 - protein, 9 aa, Homo Sapiens
TPLPIQLGS

SEQ ID NO: 311988 - protein, 9 aa, Homo Sapiens
YEKDEDFVS

SEQ ID NO: 311989 - protein, 9 aa, Homo Sapiens
CLQENNCHT

SEQ ID NO: 311990 - protein, 9 aa, Homo Sapiens
IKLKESSAK

SEQ ID NO: 311991 - protein, 9 aa, Homo Sapiens
SVLNNSGKR

SEQ ID NO: 311992 - protein, 9 aa, Homo Sapiens
TSWPKLITE

SEQ ID NO: 311993 - protein, 9 aa, Homo Sapiens
LSVYTHGRV

SEQ ID NO: 311994 - protein, 9 aa, Homo Sapiens
GKRQSKFQV

SEQ ID NO: 311995 - protein, 9 aa, Homo Sapiens
QKIREKRDK

SEQ ID NO: 311996 - protein, 9 aa, Homo Sapiens
HSYPFVTSQ

SEQ ID NO: 311997 - protein, 9 aa, Homo Sapiens
TFLSLTKHK

SEQ ID NO: 311998 - protein, 9 aa, Homo Sapiens
KYMYRELWE

SEQ ID NO: 311999 - protein, 9 aa, Homo Sapiens
KHTVLVIAH

SEQ ID NO: 312000 - protein, 9 aa, Homo Sapiens
SQNVPRESC

SEQ ID NO: 312001 - protein, 9 aa, Homo Sapiens
EFYEQFMSG

SEQ ID NO: 312002 - protein, 9 aa, Homo Sapiens
VAKVVTLTA

SEQ ID NO: 312003 - protein, 9 aa, Homo Sapiens
SILESNSIA

SEQ ID NO: 312004 - protein, 9 aa, Homo Sapiens
YCPRKCVVL

SEQ ID NO: 312005 - protein, 9 aa, Homo Sapiens
VQVLMHDVA

SEQ ID NO: 312006 - protein, 9 aa, Homo Sapiens
GITILRVKF

SEQ ID NO: 312007 - protein, 9 aa, Homo Sapiens
KKNKKAKKA

SEQ ID NO: 312008 - protein, 9 aa, Homo Sapiens
ENYSEMDYL

SEQ ID NO: 312009 - protein, 9 aa, Homo Sapiens
ELNNLTVIF

SEQ ID NO: 312010 - protein, 9 aa, Homo Sapiens
DPHFSPAKL

SEQ ID NO: 312011 - protein, 9 aa, Homo Sapiens
PGLGNLKLS

SEQ ID NO: 312012 - protein, 9 aa, Homo Sapiens
KTDIPWRRK

SEQ ID NO: 312013 - protein, 9 aa, Homo Sapiens
NYILFRARW

SEQ ID NO: 312014 - protein, 9 aa, Homo Sapiens
GLEMSIVFG

SEQ ID NO: 312015 - protein, 9 aa, Homo Sapiens
QRHETTHTG

SEQ ID NO: 312016 - protein, 9 aa, Homo Sapiens
KNIVSLVRS

SEQ ID NO: 312017 - protein, 9 aa, Homo Sapiens
RKIIYIEDN

SEQ ID NO: 312018 - protein, 9 aa, Homo Sapiens
VSDLMTIHL

SEQ ID NO: 312019 - protein, 9 aa, Homo Sapiens
RVWWHAPVV

SEQ ID NO: 312020 - protein, 9 aa, Homo Sapiens
MSDEQKMAH

SEQ ID NO: 312021 - protein, 9 aa, Homo Sapiens
DISWAKNVL

SEQ ID NO: 312022 - protein, 9 aa, Homo Sapiens
DDNRTFSLF

SEQ ID NO: 312023 - protein, 9 aa, Homo Sapiens
LQTHYGYIN

SEQ ID NO: 312024 - protein, 9 aa, Homo Sapiens
FTIPEDDGN

SEQ ID NO: 312025 - protein, 9 aa, Homo Sapiens
KIILKLDHE

SEQ ID NO: 312026 - protein, 9 aa, Homo Sapiens
AELVRHQII

SEQ ID NO: 312027 - protein, 9 aa, Homo Sapiens
EFSEHALLQ

SEQ ID NO: 312028 - protein, 9 aa, Homo Sapiens
ASWIHCMIM

SEQ ID NO: 312029 - protein, 9 aa, Homo Sapiens
YSIYEDEKL

SEQ ID NO: 312030 - protein, 9 aa, Homo Sapiens
RAHYKTEGS

SEQ ID NO: 312031 - protein, 9 aa, Homo Sapiens
KLYNNHDIR

SEQ ID NO: 312032 - protein, 9 aa, Homo Sapiens
CRRQNGYRA

SEQ ID NO: 312033 - protein, 9 aa, Homo Sapiens
EWLAQEEAQ

SEQ ID NO: 312034 - protein, 9 aa, Homo Sapiens
QNLILQNQI

SEQ ID NO: 312035 - protein, 9 aa, Homo Sapiens
PNKEFKDKP

SEQ ID NO: 312036 - protein, 9 aa, Homo Sapiens
LYDTFVCEN

SEQ ID NO: 312037 - protein, 9 aa, Homo Sapiens
CEELYQKLG

SEQ ID NO: 312038 - protein, 9 aa, Homo Sapiens
GTDTLLIQD

SEQ ID NO: 312039 - protein, 9 aa, Homo Sapiens
IYQCETGYE

SEQ ID NO: 312040 - protein, 9 aa, Homo Sapiens
RQQNVFCDV

SEQ ID NO: 312041 - protein, 9 aa, Homo Sapiens
QEKVILRKE

SEQ ID NO: 312042 - protein, 9 aa, Homo Sapiens
VYVTEIDPV

SEQ ID NO: 312043 - protein, 9 aa, Homo Sapiens
EFSELPKCL

SEQ ID NO: 312044 - protein, 9 aa, Homo Sapiens
GRGHCECGH

SEQ ID NO: 312045 - protein, 9 aa, Homo Sapiens
QQKRVQTMF

SEQ ID NO: 312046 - protein, 9 aa, Homo Sapiens
DPNCKLEYK

SEQ ID NO: 312047 - protein, 9 aa, Homo Sapiens
ILTVICTEP

SEQ ID NO: 312048 - protein, 9 aa, Homo Sapiens
IFIYQLPFC

SEQ ID NO: 312049 - protein, 9 aa, Homo Sapiens
TVLFIYTIY

SEQ ID NO: 312050 - protein, 9 aa, Homo Sapiens
NNYGLKVHK

SEQ ID NO: 312051 - protein, 9 aa, Homo Sapiens
IVHHCIKKG

SEQ ID NO: 312052 - protein, 9 aa, Homo Sapiens
ESRIILCSK

SEQ ID NO: 312053 - protein, 9 aa, Homo Sapiens
CAGFLHPWN

SEQ ID NO: 312054 - protein, 9 aa, Homo Sapiens
VYGHNINDP

SEQ ID NO: 312055 - protein, 9 aa, Homo Sapiens
SDDETPLDD

SEQ ID NO: 312056 - protein, 9 aa, Homo Sapiens
SNKENYSEM

SEQ ID NO: 312057 - protein, 9 aa, Homo Sapiens
DFALRVPTA

SEQ ID NO: 312058 - protein, 9 aa, Homo Sapiens
NPLHYDVGM

SEQ ID NO: 312059 - protein, 9 aa, Homo Sapiens
WEFGRETNN

SEQ ID NO: 312060 - protein, 9 aa, Homo Sapiens
IPGIHILTI

SEQ ID NO: 312061 - protein, 9 aa, Homo Sapiens
SVQSSSGSS

SEQ ID NO: 312062 - protein, 9 aa, Homo Sapiens
CSQSVSENY

SEQ ID NO: 312063 - protein, 9 aa, Homo Sapiens
HGLPNTSTN

SEQ ID NO: 312064 - protein, 9 aa, Homo Sapiens
TLSLSKKEL

SEQ ID NO: 312065 - protein, 9 aa, Homo Sapiens
LNSSLLRPR

SEQ ID NO: 312066 - protein, 9 aa, Homo Sapiens
SRKGLYDDT

SEQ ID NO: 312067 - protein, 9 aa, Homo Sapiens
CLIALFCIT

SEQ ID NO: 312068 - protein, 9 aa, Homo Sapiens
LIIHQITHT

SEQ ID NO: 312069 - protein, 9 aa, Homo Sapiens
ICMTWFILF

SEQ ID NO: 312070 - protein, 9 aa, Homo Sapiens
ENGFIYESS

SEQ ID NO: 312071 - protein, 9 aa, Homo Sapiens
LFFLTPANN

SEQ ID NO: 312072 - protein, 9 aa, Homo Sapiens
AATICSPDL

SEQ ID NO: 312073 - protein, 9 aa, Homo Sapiens
AMTALDAIF

SEQ ID NO: 312074 - protein, 9 aa, Homo Sapiens
QEKSYMTFL

SEQ ID NO: 312075 - protein, 9 aa, Homo Sapiens
MFDPIRNKY

SEQ ID NO: 312076 - protein, 9 aa, Homo Sapiens
IFQYLPDEL

SEQ ID NO: 312077 - protein, 9 aa, Homo Sapiens
CRPAAGRPT

SEQ ID NO: 312078 - protein, 9 aa, Homo Sapiens
TAINRAAPW

SEQ ID NO: 312079 - protein, 9 aa, Homo Sapiens
SFAGCLTQS

SEQ ID NO: 312080 - protein, 9 aa, Homo Sapiens
PSEGACDVD

SEQ ID NO: 312081 - protein, 9 aa, Homo Sapiens
KWFFQRAEM

SEQ ID NO: 312082 - protein, 9 aa, Homo Sapiens
EITTIKWND

SEQ ID NO: 312083 - protein, 9 aa, Homo Sapiens
DIKVTELEI

SEQ ID NO: 312084 - protein, 9 aa, Homo Sapiens
TGKFYMGSR

SEQ ID NO: 312085 - protein, 9 aa, Homo Sapiens
GFHAIYEKI

SEQ ID NO: 312086 - protein, 9 aa, Homo Sapiens
RRTTKLKVE

SEQ ID NO: 312087 - protein, 9 aa, Homo Sapiens
NPHLANHQR

SEQ ID NO: 312088 - protein, 9 aa, Homo Sapiens
MGIFSYRGE

SEQ ID NO: 312089 - protein, 9 aa, Homo Sapiens
GALRNTEYV

SEQ ID NO: 312090 - protein, 9 aa, Homo Sapiens
LYKKICSNV

SEQ ID NO: 312091 - protein, 9 aa, Homo Sapiens
SVTEETDKG

SEQ ID NO: 312092 - protein, 9 aa, Homo Sapiens
FVKTLKWGL

SEQ ID NO: 312093 - protein, 9 aa, Homo Sapiens
KSLTSGIVA

SEQ ID NO: 312094 - protein, 9 aa, Homo Sapiens
QVYWLKGGQ

SEQ ID NO: 312095 - protein, 9 aa, Homo Sapiens
QRAKWRREE

SEQ ID NO: 312096 - protein, 9 aa, Homo Sapiens
PHVRIQAVL

SEQ ID NO: 312097 - protein, 9 aa, Homo Sapiens
KRGHYGVKR

SEQ ID NO: 312098 - protein, 9 aa, Homo Sapiens
GRNDRDGER

SEQ ID NO: 312099 - protein, 9 aa, Homo Sapiens
FYLAQDLFD

SEQ ID NO: 312100 - protein, 9 aa, Homo Sapiens
KGLWRFDGN

SEQ ID NO: 312101 - protein, 9 aa, Homo Sapiens
FFVFPPTPA

SEQ ID NO: 312102 - protein, 9 aa, Homo Sapiens
RMGQLCECV

SEQ ID NO: 312103 - protein, 9 aa, Homo Sapiens
EKRSISDSN

SEQ ID NO: 312104 - protein, 9 aa, Homo Sapiens
LNKRLQTLQ

SEQ ID NO: 312105 - protein, 9 aa, Homo Sapiens
LAKDHCMKL

SEQ ID NO: 312106 - protein, 9 aa, Homo Sapiens
QKLLIQLSN

SEQ ID NO: 312107 - protein, 9 aa, Homo Sapiens
TQLGPQPGL

SEQ ID NO: 312108 - protein, 9 aa, Homo Sapiens
AVQLGLCLA

SEQ ID NO: 312109 - protein, 9 aa, Homo Sapiens
THTATTQCQ

SEQ ID NO: 312110 - protein, 9 aa, Homo Sapiens
ISETLSQIN

SEQ ID NO: 312111 - protein, 9 aa, Homo Sapiens
YQKRGSSWH

SEQ ID NO: 312112 - protein, 9 aa, Homo Sapiens
NTIDINNCD

SEQ ID NO: 312113 - protein, 9 aa, Homo Sapiens
INAVNIFGL

SEQ ID NO: 312114 - protein, 9 aa, Homo Sapiens
FRTREVMTT

SEQ ID NO: 312115 - protein, 9 aa, Homo Sapiens
TAAVRSNTG

SEQ ID NO: 312116 - protein, 9 aa, Homo Sapiens
VYLKALLRM

SEQ ID NO: 312117 - protein, 9 aa, Homo Sapiens
LAVSDSMFV

SEQ ID NO: 312118 - protein, 9 aa, Homo Sapiens
KHVNEIFQD

SEQ ID NO: 312119 - protein, 9 aa, Homo Sapiens
YNIIMNIHT

SEQ ID NO: 312120 - protein, 9 aa, Homo Sapiens
KHKGQDGII

SEQ ID NO: 312121 - protein, 9 aa, Homo Sapiens
IFSIENGTG

SEQ ID NO: 312122 - protein, 9 aa, Homo Sapiens
ADGRMRLSQ

SEQ ID NO: 312123 - protein, 9 aa, Homo Sapiens
MVTMYQKLR

SEQ ID NO: 312124 - protein, 9 aa, Homo Sapiens
QFISTLLLY

SEQ ID NO: 312125 - protein, 9 aa, Homo Sapiens
EILFTTVSI

SEQ ID NO: 312126 - protein, 9 aa, Homo Sapiens
VYWLKGGQD

SEQ ID NO: 312127 - protein, 9 aa, Homo Sapiens
INRDLKPSN

SEQ ID NO: 312128 - protein, 9 aa, Homo Sapiens
FLFLVPYND

SEQ ID NO: 312129 - protein, 9 aa, Homo Sapiens
GGLFGFYRG

SEQ ID NO: 312130 - protein, 9 aa, Homo Sapiens
IASLIRNKC

SEQ ID NO: 312131 - protein, 9 aa, Homo Sapiens
AGEAAFIDT

SEQ ID NO: 312132 - protein, 9 aa, Homo Sapiens
YNYRGPRTQ

SEQ ID NO: 312133 - protein, 9 aa, Homo Sapiens
FALRCSVCK

SEQ ID NO: 312134 - protein, 9 aa, Homo Sapiens
NDCGNFFRY

SEQ ID NO: 312135 - protein, 9 aa, Homo Sapiens
LNNSGKRTI

SEQ ID NO: 312136 - protein, 9 aa, Homo Sapiens
EPFMPAERC

SEQ ID NO: 312137 - protein, 9 aa, Homo Sapiens
HNSNIINKL

SEQ ID NO: 312138 - protein, 9 aa, Homo Sapiens
HSPFSSKSR

SEQ ID NO: 312139 - protein, 9 aa, Homo Sapiens
NYLGNLAKS

SEQ ID NO: 312140 - protein, 9 aa, Homo Sapiens
CRSETVVER

SEQ ID NO: 312141 - protein, 9 aa, Homo Sapiens
EQKMAHKIM

SEQ ID NO: 312142 - protein, 9 aa, Homo Sapiens
NHVQVIVEF

SEQ ID NO: 312143 - protein, 9 aa, Homo Sapiens
TINCLKNLS

SEQ ID NO: 312144 - protein, 9 aa, Homo Sapiens
LCSAAKFYR

SEQ ID NO: 312145 - protein, 9 aa, Homo Sapiens
GRKRTKHKK

SEQ ID NO: 312146 - protein, 9 aa, Homo Sapiens
KRIEDSLIQ

SEQ ID NO: 312147 - protein, 9 aa, Homo Sapiens
GRMVMMADD

SEQ ID NO: 312148 - protein, 9 aa, Homo Sapiens
AIYISDEEW

SEQ ID NO: 312149 - protein, 9 aa, Homo Sapiens
QQRQQFLEK

SEQ ID NO: 312150 - protein, 9 aa, Homo Sapiens
VLQPDVDSF

SEQ ID NO: 312151 - protein, 9 aa, Homo Sapiens
AWGPDSKKV

SEQ ID NO: 312152 - protein, 9 aa, Homo Sapiens
AAFYHQPWT

SEQ ID NO: 312153 - protein, 9 aa, Homo Sapiens
GATRASPTA

SEQ ID NO: 312154 - protein, 9 aa, Homo Sapiens
LQISTKPRD

SEQ ID NO: 312155 - protein, 9 aa, Homo Sapiens
QLRVFGTGQ

SEQ ID NO: 312156 - protein, 9 aa, Homo Sapiens
LPSGCLLDC

SEQ ID NO: 312157 - protein, 9 aa, Homo Sapiens
GSFAFNRKQ

SEQ ID NO: 312158 - protein, 9 aa, Homo Sapiens
FWSNPTAFD

SEQ ID NO: 312159 - protein, 9 aa, Homo Sapiens
VESLFLVRH

SEQ ID NO: 312160 - protein, 9 aa, Homo Sapiens
GADFALRVP

SEQ ID NO: 312161 - protein, 9 aa, Homo Sapiens
EECENYLSK

SEQ ID NO: 312162 - protein, 9 aa, Homo Sapiens
VQIENAAEE

SEQ ID NO: 312163 - protein, 9 aa, Homo Sapiens
GKAFRNNYG

SEQ ID NO: 312164 - protein, 9 aa, Homo Sapiens
AHDENTVLQ

SEQ ID NO: 312165 - protein, 9 aa, Homo Sapiens
SRAEAITAR

SEQ ID NO: 312166 - protein, 9 aa, Homo Sapiens
AGCGTQIFV

SEQ ID NO: 312167 - protein, 9 aa, Homo Sapiens
IEINGNSVN

SEQ ID NO: 312168 - protein, 9 aa, Homo Sapiens
KLLIAAQRQ

SEQ ID NO: 312169 - protein, 9 aa, Homo Sapiens
HTGEKPFWC

SEQ ID NO: 312170 - protein, 9 aa, Homo Sapiens
IAHLVRHQN

SEQ ID NO: 312171 - protein, 9 aa, Homo Sapiens
PHVSDKSEG

SEQ ID NO: 312172 - protein, 9 aa, Homo Sapiens
CQIMYVFYQ

SEQ ID NO: 312173 - protein, 9 aa, Homo Sapiens
TVKMLPPLK

SEQ ID NO: 312174 - protein, 9 aa, Homo Sapiens
QDSTGQDML

SEQ ID NO: 312175 - protein, 9 aa, Homo Sapiens
LSGPQRLSS

SEQ ID NO: 312176 - protein, 9 aa, Homo Sapiens
CVKSWNTEA

SEQ ID NO: 312177 - protein, 9 aa, Homo Sapiens
MTMAASLLP

SEQ ID NO: 312178 - protein, 9 aa, Homo Sapiens
DCRPSLAHS

SEQ ID NO: 312179 - protein, 9 aa, Homo Sapiens
DSGMSGIKR

SEQ ID NO: 312180 - protein, 9 aa, Homo Sapiens
LCIQNVLSE

SEQ ID NO: 312181 - protein, 9 aa, Homo Sapiens
TLIKRDPAL

SEQ ID NO: 312182 - protein, 9 aa, Homo Sapiens
KKLKRLMLH

SEQ ID NO: 312183 - protein, 9 aa, Homo Sapiens
IEQLEQGDK

SEQ ID NO: 312184 - protein, 9 aa, Homo Sapiens
LQPHLGLEK

SEQ ID NO: 312185 - protein, 9 aa, Homo Sapiens
YTLWEDGAM

SEQ ID NO: 312186 - protein, 9 aa, Homo Sapiens
KLQTPQGKQ

SEQ ID NO: 312187 - protein, 9 aa, Homo Sapiens
FNNYYSLVL

SEQ ID NO: 312188 - protein, 9 aa, Homo Sapiens
FTIVTVLNY

SEQ ID NO: 312189 - protein, 9 aa, Homo Sapiens
HTVAIYSEQ

SEQ ID NO: 312190 - protein, 9 aa, Homo Sapiens
WKFARKGNK

SEQ ID NO: 312191 - protein, 9 aa, Homo Sapiens
KIISSDSPP

SEQ ID NO: 312192 - protein, 9 aa, Homo Sapiens
QDMPETSQE

SEQ ID NO: 312193 - protein, 9 aa, Homo Sapiens
LEETIECNE

SEQ ID NO: 312194 - protein, 9 aa, Homo Sapiens
GVGTYVIQV

SEQ ID NO: 312195 - protein, 9 aa, Homo Sapiens
VAGGLLVTG

SEQ ID NO: 312196 - protein, 9 aa, Homo Sapiens
AGIRYFDLQ

SEQ ID NO: 312197 - protein, 9 aa, Homo Sapiens
PTASVIIAF

SEQ ID NO: 312198 - protein, 9 aa, Homo Sapiens
LSEKFMSLQ

SEQ ID NO: 312199 - protein, 9 aa, Homo Sapiens
APKVKADME

SEQ ID NO: 312200 - protein, 9 aa, Homo Sapiens
FPQYVLLFG

SEQ ID NO: 312201 - protein, 9 aa, Homo Sapiens
DLAPNKKPR

SEQ ID NO: 312202 - protein, 9 aa, Homo Sapiens
TMFGASQGY

SEQ ID NO: 312203 - protein, 9 aa, Homo Sapiens
TLTLVSFSF

SEQ ID NO: 312204 - protein, 9 aa, Homo Sapiens
VKEGGPACE

SEQ ID NO: 312205 - protein, 9 aa, Homo Sapiens
TTNQQEALQ

SEQ ID NO: 312206 - protein, 9 aa, Homo Sapiens
NKKAKKASE

SEQ ID NO: 312207 - protein, 9 aa, Homo Sapiens
CLVRGGHKI

SEQ ID NO: 312208 - protein, 9 aa, Homo Sapiens
ESLAKDHCM

SEQ ID NO: 312209 - protein, 9 aa, Homo Sapiens
RQWQLGVAF

SEQ ID NO: 312210 - protein, 9 aa, Homo Sapiens
MAQETGGNL

SEQ ID NO: 312211 - protein, 9 aa, Homo Sapiens
PPHSLAATP

SEQ ID NO: 312212 - protein, 9 aa, Homo Sapiens
LKFIPCRGH

SEQ ID NO: 312213 - protein, 9 aa, Homo Sapiens
TSQGLGIAK

SEQ ID NO: 312214 - protein, 9 aa, Homo Sapiens
SFKVQQPHV

SEQ ID NO: 312215 - protein, 9 aa, Homo Sapiens
ETMAPDIHD

SEQ ID NO: 312216 - protein, 9 aa, Homo Sapiens
EHQSPVQFD

SEQ ID NO: 312217 - protein, 9 aa, Homo Sapiens
RMLLQNILH

SEQ ID NO: 312218 - protein, 9 aa, Homo Sapiens
QNGLEFNCK

SEQ ID NO: 312219 - protein, 9 aa, Homo Sapiens
NQNDEQFLE

SEQ ID NO: 312220 - protein, 9 aa, Homo Sapiens
NKKWNLEIS

SEQ ID NO: 312221 - protein, 9 aa, Homo Sapiens
NPFDHCSAG

SEQ ID NO: 312222 - protein, 9 aa, Homo Sapiens
KPHLCSLSS

SEQ ID NO: 312223 - protein, 9 aa, Homo Sapiens
LDYLEPRLQ

SEQ ID NO: 312224 - protein, 9 aa, Homo Sapiens
NSRSTKYEM

SEQ ID NO: 312225 - protein, 9 aa, Homo Sapiens
VIGWNKSEG

SEQ ID NO: 312226 - protein, 9 aa, Homo Sapiens
VVWAVFQNE

SEQ ID NO: 312227 - protein, 9 aa, Homo Sapiens
KKYVQVLMH

SEQ ID NO: 312228 - protein, 9 aa, Homo Sapiens
QNRYANRLG

SEQ ID NO: 312229 - protein, 9 aa, Homo Sapiens
YSPASWPLR

SEQ ID NO: 312230 - protein, 9 aa, Homo Sapiens
LYEYLETVT

SEQ ID NO: 312231 - protein, 9 aa, Homo Sapiens
INNCSETQY

SEQ ID NO: 312232 - protein, 9 aa, Homo Sapiens
SECTCYRAS

SEQ ID NO: 312233 - protein, 9 aa, Homo Sapiens
FDPANAKCY

SEQ ID NO: 312234 - protein, 9 aa, Homo Sapiens
TTWSAGVPL

SEQ ID NO: 312235 - protein, 9 aa, Homo Sapiens
FSETAFAGS

SEQ ID NO: 312236 - protein, 9 aa, Homo Sapiens
DADWNEWTN

SEQ ID NO: 312237 - protein, 9 aa, Homo Sapiens
ADKSYTVQS

SEQ ID NO: 312238 - protein, 9 aa, Homo Sapiens
INTMPPKIH

SEQ ID NO: 312239 - protein, 9 aa, Homo Sapiens
LIYPPLAQA

SEQ ID NO: 312240 - protein, 9 aa, Homo Sapiens
NTRARHHVG

SEQ ID NO: 312241 - protein, 9 aa, Homo Sapiens
HSSIDEEGC

SEQ ID NO: 312242 - protein, 9 aa, Homo Sapiens
GQNGLEFNC

SEQ ID NO: 312243 - protein, 9 aa, Homo Sapiens
RSYPRLSTP

SEQ ID NO: 312244 - protein, 9 aa, Homo Sapiens
GVFTSAQAT

SEQ ID NO: 312245 - protein, 9 aa, Homo Sapiens
HYYKENNPS

SEQ ID NO: 312246 - protein, 9 aa, Homo Sapiens
IPATLGGNY

SEQ ID NO: 312247 - protein, 9 aa, Homo Sapiens
LPQRSSRLF

SEQ ID NO: 312248 - protein, 9 aa, Homo Sapiens
LQNLRYYFK

SEQ ID NO: 312249 - protein, 9 aa, Homo Sapiens
IIFCQTPKV

SEQ ID NO: 312250 - protein, 9 aa, Homo Sapiens
DMFEDMDKM

SEQ ID NO: 312251 - protein, 9 aa, Homo Sapiens
SGRQCWMTD

SEQ ID NO: 312252 - protein, 9 aa, Homo Sapiens
FAAGPQPPH

SEQ ID NO: 312253 - protein, 9 aa, Homo Sapiens
CAHQASVAR

SEQ ID NO: 312254 - protein, 9 aa, Homo Sapiens
VAPEVLGPD

SEQ ID NO: 312255 - protein, 9 aa, Homo Sapiens
ESCECQKCH

SEQ ID NO: 312256 - protein, 9 aa, Homo Sapiens
GDSFLHIRF

SEQ ID NO: 312257 - protein, 9 aa, Homo Sapiens
FILVGYVDS

SEQ ID NO: 312258 - protein, 9 aa, Homo Sapiens
LGAICFTYC

SEQ ID NO: 312259 - protein, 9 aa, Homo Sapiens
NIVQPPGKM

SEQ ID NO: 312260 - protein, 9 aa, Homo Sapiens
RKVNYMCWA

SEQ ID NO: 312261 - protein, 9 aa, Homo Sapiens
PQKLLIQLS

SEQ ID NO: 312262 - protein, 9 aa, Homo Sapiens
GNYPHLLEA

SEQ ID NO: 312263 - protein, 9 aa, Homo Sapiens
SPKHQKTRQ

SEQ ID NO: 312264 - protein, 9 aa, Homo Sapiens
LQKSYKTLA

SEQ ID NO: 312265 - protein, 9 aa, Homo Sapiens
IPRDHSKNV

SEQ ID NO: 312266 - protein, 9 aa, Homo Sapiens
DRDYMDTIP

SEQ ID NO: 312267 - protein, 9 aa, Homo Sapiens
RKYALKAVD

SEQ ID NO: 312268 - protein, 9 aa, Homo Sapiens
RKISDGKNF

SEQ ID NO: 312269 - protein, 9 aa, Homo Sapiens
IPKVFAPEK

SEQ ID NO: 312270 - protein, 9 aa, Homo Sapiens
VQGIMGKPG

SEQ ID NO: 312271 - protein, 9 aa, Homo Sapiens
RRVNTRARH

SEQ ID NO: 312272 - protein, 9 aa, Homo Sapiens
GPASPQRKY

SEQ ID NO: 312273 - protein, 9 aa, Homo Sapiens
RPSLAHSAG

SEQ ID NO: 312274 - protein, 9 aa, Homo Sapiens
HKVTKLNNV

SEQ ID NO: 312275 - protein, 9 aa, Homo Sapiens
MEHLNHYIS

SEQ ID NO: 312276 - protein, 9 aa, Homo Sapiens
KHFTRDLMD

SEQ ID NO: 312277 - protein, 9 aa, Homo Sapiens
VGRFFHLDH

SEQ ID NO: 312278 - protein, 9 aa, Homo Sapiens
GSIFGSSRV

SEQ ID NO: 312279 - protein, 9 aa, Homo Sapiens
KEYVQQLSG

SEQ ID NO: 312280 - protein, 9 aa, Homo Sapiens
CDRKYFVLN

SEQ ID NO: 312281 - protein, 9 aa, Homo Sapiens
GQGPGDRKA

SEQ ID NO: 312282 - protein, 9 aa, Homo Sapiens
SIFRVPEPP

SEQ ID NO: 312283 - protein, 9 aa, Homo Sapiens
KNWYSLVIC

SEQ ID NO: 312284 - protein, 9 aa, Homo Sapiens
YHAKNRISK

SEQ ID NO: 312285 - protein, 9 aa, Homo Sapiens
CISTGPYPC

SEQ ID NO: 312286 - protein, 9 aa, Homo Sapiens
CLIEQIDVL

SEQ ID NO: 312287 - protein, 9 aa, Homo Sapiens
LCVTASIKT

SEQ ID NO: 312288 - protein, 9 aa, Homo Sapiens
YTIGKEFIN

SEQ ID NO: 312289 - protein, 9 aa, Homo Sapiens
WRENNGSFC

SEQ ID NO: 312290 - protein, 9 aa, Homo Sapiens
LRAQIAQIS

SEQ ID NO: 312291 - protein, 9 aa, Homo Sapiens
LLNNFSEIV

SEQ ID NO: 312292 - protein, 9 aa, Homo Sapiens
GDMSNHPVC

SEQ ID NO: 312293 - protein, 9 aa, Homo Sapiens
VNTSVLSFQ

SEQ ID NO: 312294 - protein, 9 aa, Homo Sapiens
EVFLFLVPY

SEQ ID NO: 312295 - protein, 9 aa, Homo Sapiens
SLLQSQSGH

SEQ ID NO: 312296 - protein, 9 aa, Homo Sapiens
ITTDQRARE

SEQ ID NO: 312297 - protein, 8 aa, Homo Sapiens
ITDVQLAI

SEQ ID NO: 312298 - protein, 9 aa, Homo Sapiens
SVAWGPDSK

SEQ ID NO: 312299 - protein, 9 aa, Homo Sapiens
GLSIQGHKQ

SEQ ID NO: 312300 - protein, 9 aa, Homo Sapiens
VARERLTAR

SEQ ID NO: 312301 - protein, 9 aa, Homo Sapiens
GICAIAGVS

SEQ ID NO: 312302 - protein, 9 aa, Homo Sapiens
LRCVRDPQK

SEQ ID NO: 312303 - protein, 9 aa, Homo Sapiens
FDISWIMSF

SEQ ID NO: 312304 - protein, 9 aa, Homo Sapiens
GSIARLFTN

SEQ ID NO: 312305 - protein, 9 aa, Homo Sapiens
EKVVGMVGS

SEQ ID NO: 312306 - protein, 9 aa, Homo Sapiens
VTSPSQYVP

SEQ ID NO: 312307 - protein, 9 aa, Homo Sapiens
RELAPKVIG

SEQ ID NO: 312308 - protein, 9 aa, Homo Sapiens
LHPASLTPQ

SEQ ID NO: 312309 - protein, 9 aa, Homo Sapiens
KVERMVEDS

SEQ ID NO: 312310 - protein, 9 aa, Homo Sapiens
QWTALICST

SEQ ID NO: 312311 - protein, 9 aa, Homo Sapiens
PKAETTKGH

SEQ ID NO: 312312 - protein, 9 aa, Homo Sapiens
QELSKNEVL

SEQ ID NO: 312313 - protein, 9 aa, Homo Sapiens
RQVDVAVEI

SEQ ID NO: 312314 - protein, 9 aa, Homo Sapiens
SPYTIEFLW

SEQ ID NO: 312315 - protein, 9 aa, Homo Sapiens
LSAFLGIVN

SEQ ID NO: 312316 - protein, 9 aa, Homo Sapiens
SGSRSSSKN

SEQ ID NO: 312317 - protein, 9 aa, Homo Sapiens
CENYLSKTL

SEQ ID NO: 312318 - protein, 9 aa, Homo Sapiens
KYLQTTLNI

SEQ ID NO: 312319 - protein, 9 aa, Homo Sapiens
GLFGFYRGL

SEQ ID NO: 312320 - protein, 9 aa, Homo Sapiens
ILELCRGRE

SEQ ID NO: 312321 - protein, 9 aa, Homo Sapiens
GYIVDDALS

SEQ ID NO: 312322 - protein, 9 aa, Homo Sapiens
YMAYERGRI

SEQ ID NO: 312323 - protein, 9 aa, Homo Sapiens
NQDTSHLYT

SEQ ID NO: 312324 - protein, 9 aa, Homo Sapiens
CGRIEVNMF

SEQ ID NO: 312325 - protein, 9 aa, Homo Sapiens
MINMMRPGV

SEQ ID NO: 312326 - protein, 9 aa, Homo Sapiens
YKLPNKEML

SEQ ID NO: 312327 - protein, 9 aa, Homo Sapiens
CLHEGKTPA

SEQ ID NO: 312328 - protein, 9 aa, Homo Sapiens
LSEINKPNL

SEQ ID NO: 312329 - protein, 9 aa, Homo Sapiens
QLMDCDKVK

SEQ ID NO: 312330 - protein, 9 aa, Homo Sapiens
MQYASESRN

SEQ ID NO: 312331 - protein, 9 aa, Homo Sapiens
SPSLSLFFV

SEQ ID NO: 312332 - protein, 9 aa, Homo Sapiens
NMPKMSFQE

SEQ ID NO: 312333 - protein, 9 aa, Homo Sapiens
VLIKTGADI

SEQ ID NO: 312334 - protein, 9 aa, Homo Sapiens
CVKAYLALH

SEQ ID NO: 312335 - protein, 9 aa, Homo Sapiens
EPNNSVLLD

SEQ ID NO: 312336 - protein, 9 aa, Homo Sapiens
HDNHCGSHS

SEQ ID NO: 312337 - protein, 9 aa, Homo Sapiens
VNACLNKAL

SEQ ID NO: 312338 - protein, 9 aa, Homo Sapiens
LAQDAIFRL

SEQ ID NO: 312339 - protein, 9 aa, Homo Sapiens
VIKSIIKIP

SEQ ID NO: 312340 - protein, 9 aa, Homo Sapiens
GRFKNQKDR

SEQ ID NO: 312341 - protein, 9 aa, Homo Sapiens
FTESLQPSE

SEQ ID NO: 312342 - protein, 9 aa, Homo Sapiens
LCCLYQLCK

SEQ ID NO: 312343 - protein, 9 aa, Homo Sapiens
KLFTVSPEN

SEQ ID NO: 312344 - protein, 9 aa, Homo Sapiens
LSASATFEY

SEQ ID NO: 312345 - protein, 9 aa, Homo Sapiens
KHKKFRQKQ

SEQ ID NO: 312346 - protein, 9 aa, Homo Sapiens
HMLAVTILY

SEQ ID NO: 312347 - protein, 9 aa, Homo Sapiens
GAKCKQLRT

SEQ ID NO: 312348 - protein, 9 aa, Homo Sapiens
FPFLDNDFF

SEQ ID NO: 312349 - protein, 9 aa, Homo Sapiens
IQPPKPLSS

SEQ ID NO: 312350 - protein, 9 aa, Homo Sapiens
MVSSTSSEN

SEQ ID NO: 312351 - protein, 9 aa, Homo Sapiens
RKTAEKKDR

SEQ ID NO: 312352 - protein, 9 aa, Homo Sapiens
NAHGHQHFR

SEQ ID NO: 312353 - protein, 9 aa, Homo Sapiens
KPECGSRDV

SEQ ID NO: 312354 - protein, 9 aa, Homo Sapiens
IKEAFASTS

SEQ ID NO: 312355 - protein, 9 aa, Homo Sapiens
FVYVSLLGA

SEQ ID NO: 312356 - protein, 9 aa, Homo Sapiens
RVSLISLHE

SEQ ID NO: 312357 - protein, 9 aa, Homo Sapiens
VSVIGRMVM

SEQ ID NO: 312358 - protein, 9 aa, Homo Sapiens
EKIILDAQH

SEQ ID NO: 312359 - protein, 9 aa, Homo Sapiens
HNIAKLMPL

SEQ ID NO: 312360 - protein, 9 aa, Homo Sapiens
YCILRVNEV

SEQ ID NO: 312361 - protein, 9 aa, Homo Sapiens
QRHLTLSII

SEQ ID NO: 312362 - protein, 9 aa, Homo Sapiens
IKDVEDCLM

SEQ ID NO: 312363 - protein, 9 aa, Homo Sapiens
QRLSGNISG

SEQ ID NO: 312364 - protein, 9 aa, Homo Sapiens
AGRPKGSKS

SEQ ID NO: 312365 - protein, 9 aa, Homo Sapiens
THTAMKSGS

SEQ ID NO: 312366 - protein, 9 aa, Homo Sapiens
ISRVFHSYS

SEQ ID NO: 312367 - protein, 9 aa, Homo Sapiens
KRGKEACTL

SEQ ID NO: 312368 - protein, 9 aa, Homo Sapiens
GKMKGIKAR

SEQ ID NO: 312369 - protein, 9 aa, Homo Sapiens
GLFGQVFRP

SEQ ID NO: 312370 - protein, 9 aa, Homo Sapiens
PQKTSATIN

SEQ ID NO: 312371 - protein, 9 aa, Homo Sapiens
INATRQGVT

SEQ ID NO: 312372 - protein, 9 aa, Homo Sapiens
LGLRVQAEG

SEQ ID NO: 312373 - protein, 9 aa, Homo Sapiens
NSVNVWPVK

SEQ ID NO: 312374 - protein, 9 aa, Homo Sapiens
QIMSPDLPI

SEQ ID NO: 312375 - protein, 9 aa, Homo Sapiens
GCGKAFSQR

SEQ ID NO: 312376 - protein, 9 aa, Homo Sapiens
ANVTDMLAG

SEQ ID NO: 312377 - protein, 9 aa, Homo Sapiens
SWPKLITEK

SEQ ID NO: 312378 - protein, 9 aa, Homo Sapiens
AKKSAEKPQ

SEQ ID NO: 312379 - protein, 9 aa, Homo Sapiens
ALRDLNVRI

SEQ ID NO: 312380 - protein, 9 aa, Homo Sapiens
IYQRNAPDH

SEQ ID NO: 312381 - protein, 9 aa, Homo Sapiens
HEVGHNCGS

SEQ ID NO: 312382 - protein, 9 aa, Homo Sapiens
EAARICLGG

SEQ ID NO: 312383 - protein, 9 aa, Homo Sapiens
NKISYHLCD

SEQ ID NO: 312384 - protein, 9 aa, Homo Sapiens
HKGGEEKSH

SEQ ID NO: 312385 - protein, 9 aa, Homo Sapiens
VFVGGLSPE

SEQ ID NO: 312386 - protein, 9 aa, Homo Sapiens
VFRKSVSPS

SEQ ID NO: 312387 - protein, 9 aa, Homo Sapiens
VDDALSWTF

SEQ ID NO: 312388 - protein, 9 aa, Homo Sapiens
YKMILVVQN

SEQ ID NO: 312389 - protein, 9 aa, Homo Sapiens
SRNEGISAQ

SEQ ID NO: 312390 - protein, 9 aa, Homo Sapiens
SRGDNLVHQ

SEQ ID NO: 312391 - protein, 9 aa, Homo Sapiens
RIDSLQQTN

SEQ ID NO: 312392 - protein, 9 aa, Homo Sapiens
YCGKIISSD

SEQ ID NO: 312393 - protein, 9 aa, Homo Sapiens
PKQMMFTTA

SEQ ID NO: 312394 - protein, 9 aa, Homo Sapiens
QKHPQHNIK

SEQ ID NO: 312395 - protein, 9 aa, Homo Sapiens
VVYTVVIPM

SEQ ID NO: 312396 - protein, 9 aa, Homo Sapiens
ENHIFLFVC

SEQ ID NO: 312397 - protein, 9 aa, Homo Sapiens
FLGFYFFFK

SEQ ID NO: 312398 - protein, 9 aa, Homo Sapiens
QADVFVELF

SEQ ID NO: 312399 - protein, 9 aa, Homo Sapiens
VFGTDYSEN

SEQ ID NO: 312400 - protein, 9 aa, Homo Sapiens
ITQETVDAV

SEQ ID NO: 312401 - protein, 9 aa, Homo Sapiens
QTHKERSTS

SEQ ID NO: 312402 - protein, 9 aa, Homo Sapiens
CPLPRTIWD

SEQ ID NO: 312403 - protein, 9 aa, Homo Sapiens
RAKPQMQQT

SEQ ID NO: 312404 - protein, 9 aa, Homo Sapiens
ESRAENNRL

SEQ ID NO: 312405 - protein, 9 aa, Homo Sapiens
GQLKRNECT

SEQ ID NO: 312406 - protein, 9 aa, Homo Sapiens
KRNLEQDNQ

SEQ ID NO: 312407 - protein, 9 aa, Homo Sapiens
SKGPSSKKR

SEQ ID NO: 312408 - protein, 9 aa, Homo Sapiens
LSLIFLAKL

SEQ ID NO: 312409 - protein, 9 aa, Homo Sapiens
SAVDTATTS

SEQ ID NO: 312410 - protein, 9 aa, Homo Sapiens
STAAKVSKQ

SEQ ID NO: 312411 - protein, 9 aa, Homo Sapiens
QTSDPENVQ

SEQ ID NO: 312412 - protein, 9 aa, Homo Sapiens
IKPGRKRTK

SEQ ID NO: 312413 - protein, 9 aa, Homo Sapiens
ERGMKNGVG

SEQ ID NO: 312414 - protein, 9 aa, Homo Sapiens
AHNKRKMAL

SEQ ID NO: 312415 - protein, 9 aa, Homo Sapiens
PHMGQILGE

SEQ ID NO: 312416 - protein, 9 aa, Homo Sapiens
LTLVSFSFL

SEQ ID NO: 312417 - protein, 9 aa, Homo Sapiens
NEKTLISSS

SEQ ID NO: 312418 - protein, 9 aa, Homo Sapiens
NLCSEIAYD

SEQ ID NO: 312419 - protein, 9 aa, Homo Sapiens
VMMVFGLGY

SEQ ID NO: 312420 - protein, 9 aa, Homo Sapiens
WNSEPNNSV

SEQ ID NO: 312421 - protein, 9 aa, Homo Sapiens
ENYNANTLV

SEQ ID NO: 312422 - protein, 9 aa, Homo Sapiens
VISHLYCDS

SEQ ID NO: 312423 - protein, 9 aa, Homo Sapiens
VVCQGVLAP

SEQ ID NO: 312424 - protein, 9 aa, Homo Sapiens
RVNACLNKA

SEQ ID NO: 312425 - protein, 9 aa, Homo Sapiens
TARLCDLKS

SEQ ID NO: 312426 - protein, 9 aa, Homo Sapiens
IMQPNYISQ

SEQ ID NO: 312427 - protein, 9 aa, Homo Sapiens
FFAGPSLRN

SEQ ID NO: 312428 - protein, 9 aa, Homo Sapiens
WESSKALWS

SEQ ID NO: 312429 - protein, 9 aa, Homo Sapiens
VVTELIIFA

SEQ ID NO: 312430 - protein, 9 aa, Homo Sapiens
LSSSIIHES

SEQ ID NO: 312431 - protein, 9 aa, Homo Sapiens
HHCQSKMKP

SEQ ID NO: 312432 - protein, 9 aa, Homo Sapiens
EDDSDADTY

SEQ ID NO: 312433 - protein, 9 aa, Homo Sapiens
HTERENFRS

SEQ ID NO: 312434 - protein, 9 aa, Homo Sapiens
DEMATYDLP

SEQ ID NO: 312435 - protein, 9 aa, Homo Sapiens
LNPLIYSVN

SEQ ID NO: 312436 - protein, 9 aa, Homo Sapiens
YTALIEEII

SEQ ID NO: 312437 - protein, 9 aa, Homo Sapiens
LSLLGICLQ

SEQ ID NO: 312438 - protein, 9 aa, Homo Sapiens
RFKWFFQRA

SEQ ID NO: 312439 - protein, 9 aa, Homo Sapiens
HYPKPAHLS

SEQ ID NO: 312440 - protein, 9 aa, Homo Sapiens
VINTLPTKL

SEQ ID NO: 312441 - protein, 9 aa, Homo Sapiens
LINKETQPG

SEQ ID NO: 312442 - protein, 9 aa, Homo Sapiens
AYQKEMVRA

SEQ ID NO: 312443 - protein, 9 aa, Homo Sapiens
CPHMGQILG

SEQ ID NO: 312444 - protein, 9 aa, Homo Sapiens
KDIVSLVDV

SEQ ID NO: 312445 - protein, 9 aa, Homo Sapiens
SKQKITAEM

SEQ ID NO: 312446 - protein, 9 aa, Homo Sapiens
LYCDLPQLF

SEQ ID NO: 312447 - protein, 9 aa, Homo Sapiens
SSDEGYLER

SEQ ID NO: 312448 - protein, 9 aa, Homo Sapiens
PTISHPMGT

SEQ ID NO: 312449 - protein, 9 aa, Homo Sapiens
SDKSEGPCV

SEQ ID NO: 312450 - protein, 9 aa, Homo Sapiens
IPLPRLLTM

SEQ ID NO: 312451 - protein, 9 aa, Homo Sapiens
CRPSLAHSA

SEQ ID NO: 312452 - protein, 9 aa, Homo Sapiens
CTDKLYEED

SEQ ID NO: 312453 - protein, 9 aa, Homo Sapiens
DKAEIDILI

SEQ ID NO: 312454 - protein, 9 aa, Homo Sapiens
FKQQTPSQT

SEQ ID NO: 312455 - protein, 9 aa, Homo Sapiens
NPPDWSNNV

SEQ ID NO: 312456 - protein, 9 aa, Homo Sapiens
KLLQIETAY

SEQ ID NO: 312457 - protein, 9 aa, Homo Sapiens
KQRHQQGQG

SEQ ID NO: 312458 - protein, 9 aa, Homo Sapiens
LLPKPKKNP

SEQ ID NO: 312459 - protein, 9 aa, Homo Sapiens
IFHKDPNVN

SEQ ID NO: 312460 - protein, 9 aa, Homo Sapiens
KKKDSILDL

SEQ ID NO: 312461 - protein, 9 aa, Homo Sapiens
QSENTSPSE

SEQ ID NO: 312462 - protein, 9 aa, Homo Sapiens
QVLLTQIKS

SEQ ID NO: 312463 - protein, 9 aa, Homo Sapiens
LGGGPDYAK

SEQ ID NO: 312464 - protein, 9 aa, Homo Sapiens
QMMFTTALL

SEQ ID NO: 312465 - protein, 9 aa, Homo Sapiens
GDPVCLHEG

SEQ ID NO: 312466 - protein, 9 aa, Homo Sapiens
EFYQEEWTC

SEQ ID NO: 312467 - protein, 9 aa, Homo Sapiens
SSQRCCDSQ

SEQ ID NO: 312468 - protein, 9 aa, Homo Sapiens
VQPHNVPYI

SEQ ID NO: 312469 - protein, 9 aa, Homo Sapiens
AIFDEWMKI

SEQ ID NO: 312470 - protein, 9 aa, Homo Sapiens
EPVEDIRRV

SEQ ID NO: 312471 - protein, 9 aa, Homo Sapiens
FKYVDSDKY

SEQ ID NO: 312472 - protein, 9 aa, Homo Sapiens
GDIHKYVQH

SEQ ID NO: 312473 - protein, 9 aa, Homo Sapiens
DVEDCLMVG

SEQ ID NO: 312474 - protein, 9 aa, Homo Sapiens
TTRSAGVLS

SEQ ID NO: 312475 - protein, 9 aa, Homo Sapiens
LMEVPVIKI

SEQ ID NO: 312476 - protein, 9 aa, Homo Sapiens
LKQRLCQQL

SEQ ID NO: 312477 - protein, 9 aa, Homo Sapiens
HIHYWVLQF

SEQ ID NO: 312478 - protein, 9 aa, Homo Sapiens
ESFGPLGLL

SEQ ID NO: 312479 - protein, 9 aa, Homo Sapiens
ELKYIIRQK

SEQ ID NO: 312480 - protein, 9 aa, Homo Sapiens
LDYLKEVDV

SEQ ID NO: 312481 - protein, 9 aa, Homo Sapiens
SQDKQTKKA

SEQ ID NO: 312482 - protein, 9 aa, Homo Sapiens
IAKFVDMPQ

SEQ ID NO: 312483 - protein, 9 aa, Homo Sapiens
LLHVKGLFD

SEQ ID NO: 312484 - protein, 9 aa, Homo Sapiens
RCLIEKLDR

SEQ ID NO: 312485 - protein, 9 aa, Homo Sapiens
GCPLAVKRQ

SEQ ID NO: 312486 - protein, 9 aa, Homo Sapiens
IKRHRGDGP

SEQ ID NO: 312487 - protein, 9 aa, Homo Sapiens
VQTKHYQVS

SEQ ID NO: 312488 - protein, 9 aa, Homo Sapiens
ATYYKENNV

SEQ ID NO: 312489 - protein, 9 aa, Homo Sapiens
GEKPFECNG

SEQ ID NO: 312490 - protein, 9 aa, Homo Sapiens
TASSYNSLV

SEQ ID NO: 312491 - protein, 9 aa, Homo Sapiens
NLHPASLTP

SEQ ID NO: 312492 - protein, 9 aa, Homo Sapiens
PGDKKKENK

SEQ ID NO: 312493 - protein, 9 aa, Homo Sapiens
LLANNYILM

SEQ ID NO: 312494 - protein, 9 aa, Homo Sapiens
SSQLEDIIA

SEQ ID NO: 312495 - protein, 9 aa, Homo Sapiens
GPGLLSRAN

SEQ ID NO: 312496 - protein, 9 aa, Homo Sapiens
SVAQANRAQ

SEQ ID NO: 312497 - protein, 9 aa, Homo Sapiens
WLALIKRGG

SEQ ID NO: 312498 - protein, 9 aa, Homo Sapiens
QVLGDVVRR

SEQ ID NO: 312499 - protein, 9 aa, Homo Sapiens
KKDHCEQIT

SEQ ID NO: 312500 - protein, 9 aa, Homo Sapiens
TERSFQDLK

SEQ ID NO: 312501 - protein, 9 aa, Homo Sapiens
GEATCPHFL

SEQ ID NO: 312502 - protein, 9 aa, Homo Sapiens
VKQGPNIYS

SEQ ID NO: 312503 - protein, 9 aa, Homo Sapiens
LILGIELHV

SEQ ID NO: 312504 - protein, 9 aa, Homo Sapiens
ALLRKHILI

SEQ ID NO: 312505 - protein, 9 aa, Homo Sapiens
KEYEGEAIP

SEQ ID NO: 312506 - protein, 9 aa, Homo Sapiens
HSLKNKLIM

SEQ ID NO: 312507 - protein, 9 aa, Homo Sapiens
VMWVSASNA

SEQ ID NO: 312508 - protein, 9 aa, Homo Sapiens
LVKAKLGWP

SEQ ID NO: 312509 - protein, 9 aa, Homo Sapiens
LTEWKQKYE

SEQ ID NO: 312510 - protein, 9 aa, Homo Sapiens
LENYNNLVA

SEQ ID NO: 312511 - protein, 9 aa, Homo Sapiens
NPHICLKMI

SEQ ID NO: 312512 - protein, 9 aa, Homo Sapiens
ALPVWVYLK

SEQ ID NO: 312513 - protein, 9 aa, Homo Sapiens
QQVWQQLKK

SEQ ID NO: 312514 - protein, 9 aa, Homo Sapiens
GDLHYRTFD

SEQ ID NO: 312515 - protein, 9 aa, Homo Sapiens
ELCRGREDY

SEQ ID NO: 312516 - protein, 9 aa, Homo Sapiens
ALHHLSCKM

SEQ ID NO: 312517 - protein, 9 aa, Homo Sapiens
HMNFLPSTW

SEQ ID NO: 312518 - protein, 9 aa, Homo Sapiens
KQCHQPSDL

SEQ ID NO: 312519 - protein, 9 aa, Homo Sapiens
EEIKKLLVP

SEQ ID NO: 312520 - protein, 9 aa, Homo Sapiens
RVNYCILRV

SEQ ID NO: 312521 - protein, 9 aa, Homo Sapiens
ESVPDNTER

SEQ ID NO: 312522 - protein, 9 aa, Homo Sapiens
EPRVKQGPN

SEQ ID NO: 312523 - protein, 9 aa, Homo Sapiens
TRQLEKHHV

SEQ ID NO: 312524 - protein, 9 aa, Homo Sapiens
CMIMALVSD

SEQ ID NO: 312525 - protein, 9 aa, Homo Sapiens
NKEMLEESY

SEQ ID NO: 312526 - protein, 9 aa, Homo Sapiens
KMQHFKITG

SEQ ID NO: 312527 - protein, 9 aa, Homo Sapiens
YEGEAIPWQ

SEQ ID NO: 312528 - protein, 9 aa, Homo Sapiens
ALPLSEKMQ

SEQ ID NO: 312529 - protein, 9 aa, Homo Sapiens
AMSSIDEYK

SEQ ID NO: 312530 - protein, 9 aa, Homo Sapiens
HFLNKPAIK

SEQ ID NO: 312531 - protein, 9 aa, Homo Sapiens
AVQTCGFDF

SEQ ID NO: 312532 - protein, 9 aa, Homo Sapiens
EHQNTHTGD

SEQ ID NO: 312533 - protein, 9 aa, Homo Sapiens
YENGFGHFV

SEQ ID NO: 312534 - protein, 9 aa, Homo Sapiens
TAEYFLWAV

SEQ ID NO: 312535 - protein, 9 aa, Homo Sapiens
EVGHNCGSP

SEQ ID NO: 312536 - protein, 9 aa, Homo Sapiens
FSKVVLAEE

SEQ ID NO: 312537 - protein, 9 aa, Homo Sapiens
SDSRNYLSG

SEQ ID NO: 312538 - protein, 9 aa, Homo Sapiens
LNGFVKLGI

SEQ ID NO: 312539 - protein, 9 aa, Homo Sapiens
HPVLGEYSL

SEQ ID NO: 312540 - protein, 9 aa, Homo Sapiens
HKVAVSLPS

SEQ ID NO: 312541 - protein, 9 aa, Homo Sapiens
KYVQVLMHD

SEQ ID NO: 312542 - protein, 9 aa, Homo Sapiens
NPHALVINT

SEQ ID NO: 312543 - protein, 9 aa, Homo Sapiens
NLIQHQIIH

SEQ ID NO: 312544 - protein, 9 aa, Homo Sapiens
LMVSMSIVK

SEQ ID NO: 312545 - protein, 9 aa, Homo Sapiens
VVALQKKQQ

SEQ ID NO: 312546 - protein, 9 aa, Homo Sapiens
GLVSRVMNT

SEQ ID NO: 312547 - protein, 9 aa, Homo Sapiens
YRRRCACDY

SEQ ID NO: 312548 - protein, 9 aa, Homo Sapiens
WQPKYGDRK

SEQ ID NO: 312549 - protein, 9 aa, Homo Sapiens
KEVPAKEKT

SEQ ID NO: 312550 - protein, 9 aa, Homo Sapiens
VFYFILGDH

SEQ ID NO: 312551 - protein, 9 aa, Homo Sapiens
MAFFYCKAC

SEQ ID NO: 312552 - protein, 9 aa, Homo Sapiens
SNSRPCKRT

SEQ ID NO: 312553 - protein, 9 aa, Homo Sapiens
MKKLQESIF

SEQ ID NO: 312554 - protein, 9 aa, Homo Sapiens
LQQSQAYFK

SEQ ID NO: 312555 - protein, 9 aa, Homo Sapiens
QALEEFREN

SEQ ID NO: 312556 - protein, 9 aa, Homo Sapiens
SHLYCDSLP

SEQ ID NO: 312557 - protein, 9 aa, Homo Sapiens
RAVCNICKI

SEQ ID NO: 312558 - protein, 9 aa, Homo Sapiens
TKLNNVKNV

SEQ ID NO: 312559 - protein, 9 aa, Homo Sapiens
KKRRIRGRK

SEQ ID NO: 312560 - protein, 9 aa, Homo Sapiens
LPAFLALPN

SEQ ID NO: 312561 - protein, 9 aa, Homo Sapiens
ILQLIKECY

SEQ ID NO: 312562 - protein, 9 aa, Homo Sapiens
AHTEGILNQ

SEQ ID NO: 312563 - protein, 9 aa, Homo Sapiens
SSNLTNHKN

SEQ ID NO: 312564 - protein, 9 aa, Homo Sapiens
RMWRHHHHH

SEQ ID NO: 312565 - protein, 9 aa, Homo Sapiens
RLCTIVESC

SEQ ID NO: 312566 - protein, 9 aa, Homo Sapiens
KIFGDLSYR

SEQ ID NO: 312567 - protein, 9 aa, Homo Sapiens
EIIDEFIVK

SEQ ID NO: 312568 - protein, 9 aa, Homo Sapiens
KVFRQNSNI

SEQ ID NO: 312569 - protein, 9 aa, Homo Sapiens
LSLHNMISG

SEQ ID NO: 312570 - protein, 9 aa, Homo Sapiens
VQVGERLMV

SEQ ID NO: 312571 - protein, 9 aa, Homo Sapiens
SYHITVRGQ

SEQ ID NO: 312572 - protein, 9 aa, Homo Sapiens
QVQWEINIF

SEQ ID NO: 312573 - protein, 9 aa, Homo Sapiens
DSAGLEWLA

SEQ ID NO: 312574 - protein, 9 aa, Homo Sapiens
KDKDRERER

SEQ ID NO: 312575 - protein, 9 aa, Homo Sapiens
KKGPHTPSP

SEQ ID NO: 312576 - protein, 9 aa, Homo Sapiens
IDEHYHIRV

SEQ ID NO: 312577 - protein, 9 aa, Homo Sapiens
KIFNPPADA

SEQ ID NO: 312578 - protein, 9 aa, Homo Sapiens
MEELVKSKM

SEQ ID NO: 312579 - protein, 9 aa, Homo Sapiens
EDADIHNKT

SEQ ID NO: 312580 - protein, 9 aa, Homo Sapiens
SVGTFLLLS

SEQ ID NO: 312581 - protein, 9 aa, Homo Sapiens
KSTLISASQ

SEQ ID NO: 312582 - protein, 9 aa, Homo Sapiens
DILHIELVS

SEQ ID NO: 312583 - protein, 9 aa, Homo Sapiens
LKSMDEFIL

SEQ ID NO: 312584 - protein, 9 aa, Homo Sapiens
NAPPCKLFP

SEQ ID NO: 312585 - protein, 9 aa, Homo Sapiens
SPVCEELSP

SEQ ID NO: 312586 - protein, 9 aa, Homo Sapiens
KPISWRHCI

SEQ ID NO: 312587 - protein, 9 aa, Homo Sapiens
WVDLAHLCL

SEQ ID NO: 312588 - protein, 9 aa, Homo Sapiens
LLDDATKLW

SEQ ID NO: 312589 - protein, 9 aa, Homo Sapiens
LDRLCLPYI

SEQ ID NO: 312590 - protein, 9 aa, Homo Sapiens
GHNCGSPHD

SEQ ID NO: 312591 - protein, 9 aa, Homo Sapiens
KGEKGDQGE

SEQ ID NO: 312592 - protein, 9 aa, Homo Sapiens
KKASDQASE

SEQ ID NO: 312593 - protein, 9 aa, Homo Sapiens
EKSIKAEKR

SEQ ID NO: 312594 - protein, 9 aa, Homo Sapiens
YQYGAGVTL

SEQ ID NO: 312595 - protein, 9 aa, Homo Sapiens
LSGTTDFIH

SEQ ID NO: 312596 - protein, 9 aa, Homo Sapiens
YLHYCPRKC

SEQ ID NO: 312597 - protein, 9 aa, Homo Sapiens
LLLDCRPSL

SEQ ID NO: 312598 - protein, 9 aa, Homo Sapiens
RSYLTTHQI

SEQ ID NO: 312599 - protein, 9 aa, Homo Sapiens
ALLCGNRTY

SEQ ID NO: 312600 - protein, 9 aa, Homo Sapiens
FQNWRAKLK

SEQ ID NO: 312601 - protein, 9 aa, Homo Sapiens
EKTSFELSG

SEQ ID NO: 312602 - protein, 9 aa, Homo Sapiens
SSFQSHMIM

SEQ ID NO: 312603 - protein, 9 aa, Homo Sapiens
VRHFCILYY

SEQ ID NO: 312604 - protein, 9 aa, Homo Sapiens
KWTVVHAGT

SEQ ID NO: 312605 - protein, 9 aa, Homo Sapiens
RQDDCMLLK

SEQ ID NO: 312606 - protein, 9 aa, Homo Sapiens
NNFNIKENK

SEQ ID NO: 312607 - protein, 9 aa, Homo Sapiens
ASALNRVCW

SEQ ID NO: 312608 - protein, 9 aa, Homo Sapiens
KCSIAGVAY

SEQ ID NO: 312609 - protein, 9 aa, Homo Sapiens
EEDDDYVKL

SEQ ID NO: 312610 - protein, 9 aa, Homo Sapiens
NINAMAAVT

SEQ ID NO: 312611 - protein, 9 aa, Homo Sapiens
RTLMISTTE

SEQ ID NO: 312612 - protein, 9 aa, Homo Sapiens
DMCPGEKQK

SEQ ID NO: 312613 - protein, 9 aa, Homo Sapiens
LEYPVLCAL

SEQ ID NO: 312614 - protein, 9 aa, Homo Sapiens
YWFYNEDVT

SEQ ID NO: 312615 - protein, 9 aa, Homo Sapiens
DCPFEITGN

SEQ ID NO: 312616 - protein, 9 aa, Homo Sapiens
KGKETIYSA

SEQ ID NO: 312617 - protein, 9 aa, Homo Sapiens
ANDPWVQQL

SEQ ID NO: 312618 - protein, 9 aa, Homo Sapiens
LLSKCLCGA

SEQ ID NO: 312619 - protein, 9 aa, Homo Sapiens
TIPLTVFPF

SEQ ID NO: 312620 - protein, 9 aa, Homo Sapiens
AGKGKQLED

SEQ ID NO: 312621 - protein, 9 aa, Homo Sapiens
YRESICHLT

SEQ ID NO: 312622 - protein, 9 aa, Homo Sapiens
ELPSATPTT

SEQ ID NO: 312623 - protein, 9 aa, Homo Sapiens
VMPPLEDDG

SEQ ID NO: 312624 - protein, 9 aa, Homo Sapiens
TRARHHVGR

SEQ ID NO: 312625 - protein, 9 aa, Homo Sapiens
FQRYFISLL

SEQ ID NO: 312626 - protein, 9 aa, Homo Sapiens
THLDLSVND

SEQ ID NO: 312627 - protein, 9 aa, Homo Sapiens
LYHADRAIA

SEQ ID NO: 312628 - protein, 9 aa, Homo Sapiens
KHLSGPQQQ

SEQ ID NO: 312629 - protein, 9 aa, Homo Sapiens
YKNKTKSSK

SEQ ID NO: 312630 - protein, 9 aa, Homo Sapiens
LNLINGALL

SEQ ID NO: 312631 - protein, 9 aa, Homo Sapiens
ESAVDTATT

SEQ ID NO: 312632 - protein, 9 aa, Homo Sapiens
HTQLADTST

SEQ ID NO: 312633 - protein, 9 aa, Homo Sapiens
LTCSVPWTC

SEQ ID NO: 312634 - protein, 9 aa, Homo Sapiens
SDADTYGEE

SEQ ID NO: 312635 - protein, 9 aa, Homo Sapiens
NSVSYEYGD

SEQ ID NO: 312636 - protein, 9 aa, Homo Sapiens
VFPFTGVAC

SEQ ID NO: 312637 - protein, 9 aa, Homo Sapiens
ICVGSSKKI

SEQ ID NO: 312638 - protein, 9 aa, Homo Sapiens
APEVLGPDK

SEQ ID NO: 312639 - protein, 9 aa, Homo Sapiens
WYNGVREEL

SEQ ID NO: 312640 - protein, 9 aa, Homo Sapiens
DPNVNMLHV

SEQ ID NO: 312641 - protein, 9 aa, Homo Sapiens
QKKYVQVLM

SEQ ID NO: 312642 - protein, 9 aa, Homo Sapiens
ELLDRTVVA

SEQ ID NO: 312643 - protein, 9 aa, Homo Sapiens
IKIVGLANS

SEQ ID NO: 312644 - protein, 9 aa, Homo Sapiens
ADPCLSLWR

SEQ ID NO: 312645 - protein, 9 aa, Homo Sapiens
LAIEVYGHN

SEQ ID NO: 312646 - protein, 9 aa, Homo Sapiens
LEAFQFALH

SEQ ID NO: 312647 - protein, 9 aa, Homo Sapiens
KGSGAKWEK

SEQ ID NO: 312648 - protein, 9 aa, Homo Sapiens
SESSQLIYP

SEQ ID NO: 312649 - protein, 9 aa, Homo Sapiens
LGFTNFIVH

SEQ ID NO: 312650 - protein, 9 aa, Homo Sapiens
HYDVGMKPR

SEQ ID NO: 312651 - protein, 9 aa, Homo Sapiens
VADGVIKSI

SEQ ID NO: 312652 - protein, 9 aa, Homo Sapiens
LQHIEDNII

SEQ ID NO: 312653 - protein, 9 aa, Homo Sapiens
SGTPGSVQS

SEQ ID NO: 312654 - protein, 9 aa, Homo Sapiens
IAQLSINTF

SEQ ID NO: 312655 - protein, 9 aa, Homo Sapiens
KEGHKILSR

SEQ ID NO: 312656 - protein, 9 aa, Homo Sapiens
PWLLSPKSL

SEQ ID NO: 312657 - protein, 9 aa, Homo Sapiens
EAQSLSRAL

SEQ ID NO: 312658 - protein, 9 aa, Homo Sapiens
CLYVVSTRL

SEQ ID NO: 312659 - protein, 9 aa, Homo Sapiens
INDDLSSEF

SEQ ID NO: 312660 - protein, 9 aa, Homo Sapiens
VDPASVGSS

SEQ ID NO: 312661 - protein, 9 aa, Homo Sapiens
GHKIILAAF

SEQ ID NO: 312662 - protein, 9 aa, Homo Sapiens
NDALGYVAR

SEQ ID NO: 312663 - protein, 9 aa, Homo Sapiens
VCNQIVSHL

SEQ ID NO: 312664 - protein, 9 aa, Homo Sapiens
LTQHQITHT

SEQ ID NO: 312665 - protein, 9 aa, Homo Sapiens
ETNVATWKS

SEQ ID NO: 312666 - protein, 9 aa, Homo Sapiens
LENTYGNYY

SEQ ID NO: 312667 - protein, 9 aa, Homo Sapiens
DADYRLRRF

SEQ ID NO: 312668 - protein, 9 aa, Homo Sapiens
CGKAFYRLS

SEQ ID NO: 312669 - protein, 9 aa, Homo Sapiens
VPNIIKISK

SEQ ID NO: 312670 - protein, 9 aa, Homo Sapiens
HTRSIPKDT

SEQ ID NO: 312671 - protein, 9 aa, Homo Sapiens
DVANKSGII

SEQ ID NO: 312672 - protein, 9 aa, Homo Sapiens
FSPVMLLLQ

SEQ ID NO: 312673 - protein, 9 aa, Homo Sapiens
TAADTCIMF

SEQ ID NO: 312674 - protein, 9 aa, Homo Sapiens
YCSGGTSTG

SEQ ID NO: 312675 - protein, 9 aa, Homo Sapiens
EGLFRGLRG

SEQ ID NO: 312676 - protein, 9 aa, Homo Sapiens
VKKRDREKE

SEQ ID NO: 312677 - protein, 9 aa, Homo Sapiens
HSKHTVVAY

SEQ ID NO: 312678 - protein, 9 aa, Homo Sapiens
YFYPNGGLD

SEQ ID NO: 312679 - protein, 9 aa, Homo Sapiens
MPQKLLIQL

SEQ ID NO: 312680 - protein, 9 aa, Homo Sapiens
DISSKSFIN

SEQ ID NO: 312681 - protein, 9 aa, Homo Sapiens
NVLAVDPVA

SEQ ID NO: 312682 - protein, 9 aa, Homo Sapiens
EVCAVLEKL

SEQ ID NO: 312683 - protein, 9 aa, Homo Sapiens
AVTTQKKKV

SEQ ID NO: 312684 - protein, 9 aa, Homo Sapiens
QASKNTSQG

SEQ ID NO: 312685 - protein, 9 aa, Homo Sapiens
MITPLRELT

SEQ ID NO: 312686 - protein, 9 aa, Homo Sapiens
NHPVCRHFM

SEQ ID NO: 312687 - protein, 9 aa, Homo Sapiens
ADKEKKKKD

SEQ ID NO: 312688 - protein, 9 aa, Homo Sapiens
RDKYMQKSF

SEQ ID NO: 312689 - protein, 9 aa, Homo Sapiens
PFECNGCGK

SEQ ID NO: 312690 - protein, 9 aa, Homo Sapiens
FLIYVMLEI

SEQ ID NO: 312691 - protein, 9 aa, Homo Sapiens
KDISALTDF

SEQ ID NO: 312692 - protein, 9 aa, Homo Sapiens
CSKQTRTMA

SEQ ID NO: 312693 - protein, 9 aa, Homo Sapiens
IAPLGPDAP

SEQ ID NO: 312694 - protein, 9 aa, Homo Sapiens
CVAQAILSQ

SEQ ID NO: 312695 - protein, 9 aa, Homo Sapiens
RKDEKRKGK

SEQ ID NO: 312696 - protein, 9 aa, Homo Sapiens
QNLINDKQF

SEQ ID NO: 312697 - protein, 9 aa, Homo Sapiens
SSTFNRDFL

SEQ ID NO: 312698 - protein, 9 aa, Homo Sapiens
ISTGPYPCG

SEQ ID NO: 312699 - protein, 9 aa, Homo Sapiens
GDLIKTEDE

SEQ ID NO: 312700 - protein, 9 aa, Homo Sapiens
EDILMQHIE

SEQ ID NO: 312701 - protein, 9 aa, Homo Sapiens
LGELPLSLA

SEQ ID NO: 312702 - protein, 9 aa, Homo Sapiens
QLDRIIATL

SEQ ID NO: 312703 - protein, 9 aa, Homo Sapiens
TSSSSSFCI

SEQ ID NO: 312704 - protein, 9 aa, Homo Sapiens
RQSGERFNK

SEQ ID NO: 312705 - protein, 9 aa, Homo Sapiens
ELQVWDLEP

SEQ ID NO: 312706 - protein, 9 aa, Homo Sapiens
YCENTLNTL

SEQ ID NO: 312707 - protein, 9 aa, Homo Sapiens
EGDLIKTED

SEQ ID NO: 312708 - protein, 9 aa, Homo Sapiens
FHALKDIIG

SEQ ID NO: 312709 - protein, 9 aa, Homo Sapiens
QHIFVKICM

SEQ ID NO: 312710 - protein, 9 aa, Homo Sapiens
NSNKVVQME

SEQ ID NO: 312711 - protein, 9 aa, Homo Sapiens
YWLKGGQDI

SEQ ID NO: 312712 - protein, 9 aa, Homo Sapiens
STGLERRVV

SEQ ID NO: 312713 - protein, 9 aa, Homo Sapiens
IKKNGDILT

SEQ ID NO: 312714 - protein, 9 aa, Homo Sapiens
PDNMIVPIK

SEQ ID NO: 312715 - protein, 9 aa, Homo Sapiens
LDLSVNDFT

SEQ ID NO: 312716 - protein, 9 aa, Homo Sapiens
HWIIHTGEK

SEQ ID NO: 312717 - protein, 9 aa, Homo Sapiens
RVYLAKKQD

SEQ ID NO: 312718 - protein, 9 aa, Homo Sapiens
GEDESINAF

SEQ ID NO: 312719 - protein, 9 aa, Homo Sapiens
KKENKSLTP

SEQ ID NO: 312720 - protein, 9 aa, Homo Sapiens
IGVFSPSLQ

SEQ ID NO: 312721 - protein, 9 aa, Homo Sapiens
NISVSFKQC

SEQ ID NO: 312722 - protein, 9 aa, Homo Sapiens
LSIFAKEHL

SEQ ID NO: 312723 - protein, 9 aa, Homo Sapiens
DSPSLCQRH

SEQ ID NO: 312724 - protein, 9 aa, Homo Sapiens
EGNQIIYTL

SEQ ID NO: 312725 - protein, 9 aa, Homo Sapiens
GNPLLGMYM

SEQ ID NO: 312726 - protein, 9 aa, Homo Sapiens
GAGEQSRQS

SEQ ID NO: 312727 - protein, 9 aa, Homo Sapiens
LFYSASFRA

SEQ ID NO: 312728 - protein, 9 aa, Homo Sapiens
QRITIYLIE

SEQ ID NO: 312729 - protein, 9 aa, Homo Sapiens
FTVTKKGLT

SEQ ID NO: 312730 - protein, 9 aa, Homo Sapiens
PFLDNDFFG

SEQ ID NO: 312731 - protein, 9 aa, Homo Sapiens
PVYSVGTTP

SEQ ID NO: 312732 - protein, 9 aa, Homo Sapiens
TFNLFSTKS

SEQ ID NO: 312733 - protein, 9 aa, Homo Sapiens
NFGIMPDRL

SEQ ID NO: 312734 - protein, 9 aa, Homo Sapiens
CKIALFNLS

SEQ ID NO: 312735 - protein, 9 aa, Homo Sapiens
FAFNRKQNV

SEQ ID NO: 312736 - protein, 9 aa, Homo Sapiens
ELSGDVDSL

SEQ ID NO: 312737 - protein, 9 aa, Homo Sapiens
VYRNGTYII

SEQ ID NO: 312738 - protein, 9 aa, Homo Sapiens
VDPIAGTLF

SEQ ID NO: 312739 - protein, 9 aa, Homo Sapiens
EIKGQENLK

SEQ ID NO: 312740 - protein, 9 aa, Homo Sapiens
NKFACVASE

SEQ ID NO: 312741 - protein, 9 aa, Homo Sapiens
EPSIYIPED

SEQ ID NO: 312742 - protein, 9 aa, Homo Sapiens
EIAPLGPDA

SEQ ID NO: 312743 - protein, 9 aa, Homo Sapiens
CVQGILLPQ

SEQ ID NO: 312744 - protein, 9 aa, Homo Sapiens
SAKNTLFTW

SEQ ID NO: 312745 - protein, 9 aa, Homo Sapiens
VKLEIIQFV

SEQ ID NO: 312746 - protein, 9 aa, Homo Sapiens
DQTWVKLEI

SEQ ID NO: 312747 - protein, 9 aa, Homo Sapiens
RHANSGGTA

SEQ ID NO: 312748 - protein, 9 aa, Homo Sapiens
DKEKKKKDS

SEQ ID NO: 312749 - protein, 9 aa, Homo Sapiens
IPRTNQYWE

SEQ ID NO: 312750 - protein, 9 aa, Homo Sapiens
NSGGTALHV

SEQ ID NO: 312751 - protein, 9 aa, Homo Sapiens
TGAFSKVVL

SEQ ID NO: 312752 - protein, 9 aa, Homo Sapiens
FAFFAGPSL

SEQ ID NO: 312753 - protein, 9 aa, Homo Sapiens
RDVCNVLLQ

SEQ ID NO: 312754 - protein, 9 aa, Homo Sapiens
SRHHIIHTG

SEQ ID NO: 312755 - protein, 9 aa, Homo Sapiens
TTERDLCEV

SEQ ID NO: 312756 - protein, 9 aa, Homo Sapiens
SFFQRDASC

SEQ ID NO: 312757 - protein, 9 aa, Homo Sapiens
KLKELLNNF

SEQ ID NO: 312758 - protein, 9 aa, Homo Sapiens
YKENNPSVR

SEQ ID NO: 312759 - protein, 9 aa, Homo Sapiens
LSKTLLDRK

SEQ ID NO: 312760 - protein, 9 aa, Homo Sapiens
RSRQDQEVA

SEQ ID NO: 312761 - protein, 9 aa, Homo Sapiens
ALAYGLDTS

SEQ ID NO: 312762 - protein, 9 aa, Homo Sapiens
QEVKIIIME

SEQ ID NO: 312763 - protein, 9 aa, Homo Sapiens
KKCSIAGVA

SEQ ID NO: 312764 - protein, 9 aa, Homo Sapiens
LGGRCVPPA

SEQ ID NO: 312765 - protein, 9 aa, Homo Sapiens
FPNGYPYYT

SEQ ID NO: 312766 - protein, 9 aa, Homo Sapiens
DLHNCFLGI

SEQ ID NO: 312767 - protein, 9 aa, Homo Sapiens
VDVGFMVYK

SEQ ID NO: 312768 - protein, 9 aa, Homo Sapiens
RIIKVSGQK

SEQ ID NO: 312769 - protein, 9 aa, Homo Sapiens
TSLINTAIS

SEQ ID NO: 312770 - protein, 9 aa, Homo Sapiens
SGTYDAFPL

SEQ ID NO: 312771 - protein, 9 aa, Homo Sapiens
HAKRKTVTD

SEQ ID NO: 312772 - protein, 9 aa, Homo Sapiens
DSVRSGLFG

SEQ ID NO: 312773 - protein, 9 aa, Homo Sapiens
PPGCSLMYH

SEQ ID NO: 312774 - protein, 9 aa, Homo Sapiens
MFIVSGICA

SEQ ID NO: 312775 - protein, 9 aa, Homo Sapiens
NTIPHIFCN

SEQ ID NO: 312776 - protein, 9 aa, Homo Sapiens
LNITGFYRH

SEQ ID NO: 312777 - protein, 9 aa, Homo Sapiens
DFSNEERCT

SEQ ID NO: 312778 - protein, 9 aa, Homo Sapiens
GSSVSSTSS

SEQ ID NO: 312779 - protein, 9 aa, Homo Sapiens
NPKMKIHGV

SEQ ID NO: 312780 - protein, 9 aa, Homo Sapiens
SNNQLNKFL

SEQ ID NO: 312781 - protein, 9 aa, Homo Sapiens
KYLEEEQRA

SEQ ID NO: 312782 - protein, 9 aa, Homo Sapiens
PYTIEFLWH

SEQ ID NO: 312783 - protein, 9 aa, Homo Sapiens
SDFSNEERC

SEQ ID NO: 312784 - protein, 9 aa, Homo Sapiens
LGITVSKLD

SEQ ID NO: 312785 - protein, 9 aa, Homo Sapiens
NSNEGKQTK

SEQ ID NO: 312786 - protein, 9 aa, Homo Sapiens
TTLYGEIDK

SEQ ID NO: 312787 - protein, 9 aa, Homo Sapiens
RSSYLIQHK

SEQ ID NO: 312788 - protein, 9 aa, Homo Sapiens
KKDNVIFFQ

SEQ ID NO: 312789 - protein, 9 aa, Homo Sapiens
HFHPIYRGA

SEQ ID NO: 312790 - protein, 9 aa, Homo Sapiens
VTVVEDFFD

SEQ ID NO: 312791 - protein, 9 aa, Homo Sapiens
VDVAVEIIA

SEQ ID NO: 312792 - protein, 9 aa, Homo Sapiens
LPVPTDVTA

SEQ ID NO: 312793 - protein, 9 aa, Homo Sapiens
PQPFEDNEF

SEQ ID NO: 312794 - protein, 9 aa, Homo Sapiens
HLYTDGSHT

SEQ ID NO: 312795 - protein, 9 aa, Homo Sapiens
NATFTLQLP

SEQ ID NO: 312796 - protein, 9 aa, Homo Sapiens
SSDKQYGRI

SEQ ID NO: 312797 - protein, 9 aa, Homo Sapiens
TIEDIKDKA

SEQ ID NO: 312798 - protein, 9 aa, Homo Sapiens
LLRKLKNSH

SEQ ID NO: 312799 - protein, 9 aa, Homo Sapiens
SLWWTYASS

SEQ ID NO: 312800 - protein, 9 aa, Homo Sapiens
AQIRHWFIE

SEQ ID NO: 312801 - protein, 9 aa, Homo Sapiens
NPEDNNSSC

SEQ ID NO: 312802 - protein, 9 aa, Homo Sapiens
VLLEYPVLC

SEQ ID NO: 312803 - protein, 9 aa, Homo Sapiens
MKNGVGRFF

SEQ ID NO: 312804 - protein, 9 aa, Homo Sapiens
DNEFIDASR

SEQ ID NO: 312805 - protein, 9 aa, Homo Sapiens
NTVYRQKMD

SEQ ID NO: 312806 - protein, 9 aa, Homo Sapiens
RRSHRMWRH

SEQ ID NO: 312807 - protein, 9 aa, Homo Sapiens
VFLKLFCMS

SEQ ID NO: 312808 - protein, 9 aa, Homo Sapiens
LNTLKELNV

SEQ ID NO: 312809 - protein, 9 aa, Homo Sapiens
LEHLEFLDK

SEQ ID NO: 312810 - protein, 9 aa, Homo Sapiens
FNRHCNLIC

SEQ ID NO: 312811 - protein, 9 aa, Homo Sapiens
VYRQKMDCK

SEQ ID NO: 312812 - protein, 9 aa, Homo Sapiens
VEENISFSD

SEQ ID NO: 312813 - protein, 9 aa, Homo Sapiens
NRPNKKKIL

SEQ ID NO: 312814 - protein, 9 aa, Homo Sapiens
RKAFNDIAK

SEQ ID NO: 312815 - protein, 9 aa, Homo Sapiens
VFSNTTSTQ

SEQ ID NO: 312816 - protein, 9 aa, Homo Sapiens
NGHKSLGLW

SEQ ID NO: 312817 - protein, 9 aa, Homo Sapiens
EDVVTKVVD

SEQ ID NO: 312818 - protein, 9 aa, Homo Sapiens
LAIFEITIG

SEQ ID NO: 312819 - protein, 9 aa, Homo Sapiens
HKIIHAEEK

SEQ ID NO: 312820 - protein, 9 aa, Homo Sapiens
DKTPKLCET

SEQ ID NO: 312821 - protein, 9 aa, Homo Sapiens
AEYFLWAVR

SEQ ID NO: 312822 - protein, 9 aa, Homo Sapiens
NYANVVCRQ

SEQ ID NO: 312823 - protein, 9 aa, Homo Sapiens
LTDHNKIHT

SEQ ID NO: 312824 - protein, 9 aa, Homo Sapiens
TTDQKIENI

SEQ ID NO: 312825 - protein, 9 aa, Homo Sapiens
TYHDVTLKN

SEQ ID NO: 312826 - protein, 9 aa, Homo Sapiens
LSTDDHSNW

SEQ ID NO: 312827 - protein, 9 aa, Homo Sapiens
KKIQDVKSI

SEQ ID NO: 312828 - protein, 9 aa, Homo Sapiens
KYAKEVNSD

SEQ ID NO: 312829 - protein, 9 aa, Homo Sapiens
ELSSDKQYG

SEQ ID NO: 312830 - protein, 9 aa, Homo Sapiens
YGIQNYRFH

SEQ ID NO: 312831 - protein, 9 aa, Homo Sapiens
NVLPFRGIY

SEQ ID NO: 312832 - protein, 9 aa, Homo Sapiens
SGEKPFTCE

SEQ ID NO: 312833 - protein, 9 aa, Homo Sapiens
GLCTSQHLQ

SEQ ID NO: 312834 - protein, 9 aa, Homo Sapiens
SVCGRKALT

SEQ ID NO: 312835 - protein, 9 aa, Homo Sapiens
RFNYQSQAE

SEQ ID NO: 312836 - protein, 9 aa, Homo Sapiens
LVDSDGELA

SEQ ID NO: 312837 - protein, 9 aa, Homo Sapiens
YFFNVFFPL

SEQ ID NO: 312838 - protein, 9 aa, Homo Sapiens
TRRYRPTKT

SEQ ID NO: 312839 - protein, 9 aa, Homo Sapiens
YFVLNFNGI

SEQ ID NO: 312840 - protein, 9 aa, Homo Sapiens
LVINVTSEL

SEQ ID NO: 312841 - protein, 9 aa, Homo Sapiens
IPEEVCEHV

SEQ ID NO: 312842 - protein, 9 aa, Homo Sapiens
DEVFLFLVP

SEQ ID NO: 312843 - protein, 9 aa, Homo Sapiens
ELFGDLNNF

SEQ ID NO: 312844 - protein, 9 aa, Homo Sapiens
NNQRLQKLW

SEQ ID NO: 312845 - protein, 9 aa, Homo Sapiens
AKQGNPKMK

SEQ ID NO: 312846 - protein, 9 aa, Homo Sapiens
STGQRSSYD

SEQ ID NO: 312847 - protein, 9 aa, Homo Sapiens
EIRHSRKKR

SEQ ID NO: 312848 - protein, 9 aa, Homo Sapiens
LGDLDTDIS

SEQ ID NO: 312849 - protein, 9 aa, Homo Sapiens
VKMLPPLKT

SEQ ID NO: 312850 - protein, 9 aa, Homo Sapiens
NPKLMLCRS

SEQ ID NO: 312851 - protein, 9 aa, Homo Sapiens
LPVHNSNSG

SEQ ID NO: 312852 - protein, 9 aa, Homo Sapiens
VSKHKSDKT

SEQ ID NO: 312853 - protein, 9 aa, Homo Sapiens
PILGSYSGT

SEQ ID NO: 312854 - protein, 9 aa, Homo Sapiens
WAGHRTPLS

SEQ ID NO: 312855 - protein, 9 aa, Homo Sapiens
HGFTQQPLP

SEQ ID NO: 312856 - protein, 9 aa, Homo Sapiens
EQVRQLAVF

SEQ ID NO: 312857 - protein, 9 aa, Homo Sapiens
NQKDREAEL

SEQ ID NO: 312858 - protein, 9 aa, Homo Sapiens
LADTSTFLV

SEQ ID NO: 312859 - protein, 9 aa, Homo Sapiens
WLCIEKLSG

SEQ ID NO: 312860 - protein, 9 aa, Homo Sapiens
LKKDNVIFF

SEQ ID NO: 312861 - protein, 9 aa, Homo Sapiens
KNEPFTIPE

SEQ ID NO: 312862 - protein, 9 aa, Homo Sapiens
EFNDTGHCF

SEQ ID NO: 312863 - protein, 9 aa, Homo Sapiens
IVGQGPGDR

SEQ ID NO: 312864 - protein, 9 aa, Homo Sapiens
LHPHPESYS

SEQ ID NO: 312865 - protein, 9 aa, Homo Sapiens
FSHHQSLSV

SEQ ID NO: 312866 - protein, 9 aa, Homo Sapiens
NTKKHGKSF

SEQ ID NO: 312867 - protein, 9 aa, Homo Sapiens
SKYAMFYPI

SEQ ID NO: 312868 - protein, 9 aa, Homo Sapiens
YQQRLPIFK

SEQ ID NO: 312869 - protein, 9 aa, Homo Sapiens
ELLYPKDLR

SEQ ID NO: 312870 - protein, 9 aa, Homo Sapiens
VLLKRRRPR

SEQ ID NO: 312871 - protein, 9 aa, Homo Sapiens
IMAHGFTQQ

SEQ ID NO: 312872 - protein, 9 aa, Homo Sapiens
QAEVYVFLS

SEQ ID NO: 312873 - protein, 9 aa, Homo Sapiens
ELLSLKLKL

SEQ ID NO: 312874 - protein, 9 aa, Homo Sapiens
RQDEFFTKL

SEQ ID NO: 312875 - protein, 9 aa, Homo Sapiens
PVSDNSSRR

SEQ ID NO: 312876 - protein, 9 aa, Homo Sapiens
LSNNECLCT

SEQ ID NO: 312877 - protein, 9 aa, Homo Sapiens
KRDKFHSNS

SEQ ID NO: 312878 - protein, 9 aa, Homo Sapiens
KKRVSQPSH

SEQ ID NO: 312879 - protein, 9 aa, Homo Sapiens
ILNTLREKL

SEQ ID NO: 312880 - protein, 9 aa, Homo Sapiens
FLSLGSRSS

SEQ ID NO: 312881 - protein, 9 aa, Homo Sapiens
PKEIVRYYS

SEQ ID NO: 312882 - protein, 9 aa, Homo Sapiens
TTFQKKNCK

SEQ ID NO: 312883 - protein, 9 aa, Homo Sapiens
VAQAILSQG

SEQ ID NO: 312884 - protein, 9 aa, Homo Sapiens
YPVVKQMLH

SEQ ID NO: 312885 - protein, 9 aa, Homo Sapiens
QKLINAEEL

SEQ ID NO: 312886 - protein, 9 aa, Homo Sapiens
LHQQCETFI

SEQ ID NO: 312887 - protein, 9 aa, Homo Sapiens
VFSPSLQNH

SEQ ID NO: 312888 - protein, 9 aa, Homo Sapiens
GVHIKSAGY

SEQ ID NO: 312889 - protein, 9 aa, Homo Sapiens
IGRVNACLN

SEQ ID NO: 312890 - protein, 9 aa, Homo Sapiens
KKAQEDPLP

SEQ ID NO: 312891 - protein, 9 aa, Homo Sapiens
KNKLLSSQL

SEQ ID NO: 312892 - protein, 9 aa, Homo Sapiens
ASRCRPAAG

SEQ ID NO: 312893 - protein, 9 aa, Homo Sapiens
LLQHIEDNI

SEQ ID NO: 312894 - protein, 9 aa, Homo Sapiens
QPQTIPLNG

SEQ ID NO: 312895 - protein, 9 aa, Homo Sapiens
FSSSLQIHV

SEQ ID NO: 312896 - protein, 9 aa, Homo Sapiens
TEVFPGQRV

SEQ ID NO: 312897 - protein, 9 aa, Homo Sapiens
GECVELSSD

SEQ ID NO: 312898 - protein, 9 aa, Homo Sapiens
RYFFSNTFG

SEQ ID NO: 312899 - protein, 9 aa, Homo Sapiens
PSIAPSSQT

SEQ ID NO: 312900 - protein, 9 aa, Homo Sapiens
VLIWRGSTP

SEQ ID NO: 312901 - protein, 9 aa, Homo Sapiens
GQSFTCKSY

SEQ ID NO: 312902 - protein, 9 aa, Homo Sapiens
CIKSKDNKS

SEQ ID NO: 312903 - protein, 9 aa, Homo Sapiens
GSEVLCIQN

SEQ ID NO: 312904 - protein, 9 aa, Homo Sapiens
VIVFVLIFF

SEQ ID NO: 312905 - protein, 9 aa, Homo Sapiens
NVEAVINAK

SEQ ID NO: 312906 - protein, 9 aa, Homo Sapiens
LPLGAICFT

SEQ ID NO: 312907 - protein, 9 aa, Homo Sapiens
LLQRIEDFD

SEQ ID NO: 312908 - protein, 9 aa, Homo Sapiens
TLLQHIEDN

SEQ ID NO: 312909 - protein, 9 aa, Homo Sapiens
DDMGLKTYD

SEQ ID NO: 312910 - protein, 9 aa, Homo Sapiens
LQDKINNLR

SEQ ID NO: 312911 - protein, 9 aa, Homo Sapiens
IQRKLSKIK

SEQ ID NO: 312912 - protein, 9 aa, Homo Sapiens
WWTVLFIYT

SEQ ID NO: 312913 - protein, 9 aa, Homo Sapiens
EEERQIILA

SEQ ID NO: 312914 - protein, 9 aa, Homo Sapiens
QCDKKKVLS

SEQ ID NO: 312915 - protein, 9 aa, Homo Sapiens
GTKKNKKAK

SEQ ID NO: 312916 - protein, 9 aa, Homo Sapiens
FVKLPEIIG

SEQ ID NO: 312917 - protein, 9 aa, Homo Sapiens
FTNFIVHAI

SEQ ID NO: 312918 - protein, 9 aa, Homo Sapiens
GKSPHTERE

SEQ ID NO: 312919 - protein, 9 aa, Homo Sapiens
ILIMELNNA

SEQ ID NO: 312920 - protein, 9 aa, Homo Sapiens
RIVGLDQMV

SEQ ID NO: 312921 - protein, 9 aa, Homo Sapiens
TVSIEELFG

SEQ ID NO: 312922 - protein, 9 aa, Homo Sapiens
ASWPLRPTN

SEQ ID NO: 312923 - protein, 9 aa, Homo Sapiens
GVQLCGTTS

SEQ ID NO: 312924 - protein, 9 aa, Homo Sapiens
SFHVIQASS

SEQ ID NO: 312925 - protein, 9 aa, Homo Sapiens
NFRLHRKVH

SEQ ID NO: 312926 - protein, 9 aa, Homo Sapiens
LGARMSIKY

SEQ ID NO: 312927 - protein, 9 aa, Homo Sapiens
VQQYLAQAS

SEQ ID NO: 312928 - protein, 9 aa, Homo Sapiens
MCMNYFIDP

SEQ ID NO: 312929 - protein, 9 aa, Homo Sapiens
RFLYVNRTP

SEQ ID NO: 312930 - protein, 9 aa, Homo Sapiens
GKLQLQKWY

SEQ ID NO: 312931 - protein, 9 aa, Homo Sapiens
KEENKGGPP

SEQ ID NO: 312932 - protein, 9 aa, Homo Sapiens
VYTFRAKVR

SEQ ID NO: 312933 - protein, 9 aa, Homo Sapiens
YRHIPLFSR

SEQ ID NO: 312934 - protein, 9 aa, Homo Sapiens
RSNVAILYN

SEQ ID NO: 312935 - protein, 9 aa, Homo Sapiens
VIAEKKLFT

SEQ ID NO: 312936 - protein, 9 aa, Homo Sapiens
EGFWNAKKG

SEQ ID NO: 312937 - protein, 9 aa, Homo Sapiens
AHLAHHEII

SEQ ID NO: 312938 - protein, 9 aa, Homo Sapiens
PFHTFALEE

SEQ ID NO: 312939 - protein, 9 aa, Homo Sapiens
LKRNKKWNL

SEQ ID NO: 312940 - protein, 9 aa, Homo Sapiens
NHIFLFVCL

SEQ ID NO: 312941 - protein, 9 aa, Homo Sapiens
MWDDFITCL

SEQ ID NO: 312942 - protein, 9 aa, Homo Sapiens
CSLATDSGL

SEQ ID NO: 312943 - protein, 9 aa, Homo Sapiens
QTCRPDQFE

SEQ ID NO: 312944 - protein, 9 aa, Homo Sapiens
EICPWFTPQ

SEQ ID NO: 312945 - protein, 9 aa, Homo Sapiens
ADKVPERKC

SEQ ID NO: 312946 - protein, 9 aa, Homo Sapiens
GEFMETKRN

SEQ ID NO: 312947 - protein, 9 aa, Homo Sapiens
FSERKSSEL

SEQ ID NO: 312948 - protein, 9 aa, Homo Sapiens
NEYFVFNFI

SEQ ID NO: 312949 - protein, 9 aa, Homo Sapiens
VDLEIKFQG

SEQ ID NO: 312950 - protein, 9 aa, Homo Sapiens
LSAHCSIQV

SEQ ID NO: 312951 - protein, 9 aa, Homo Sapiens
YQEHSNFLF

SEQ ID NO: 312952 - protein, 9 aa, Homo Sapiens
LENRKSGVF

SEQ ID NO: 312953 - protein, 9 aa, Homo Sapiens
QKILEAPDL

SEQ ID NO: 312954 - protein, 9 aa, Homo Sapiens
VRLVDKTPI

SEQ ID NO: 312955 - protein, 9 aa, Homo Sapiens
YSLQFSVGY

SEQ ID NO: 312956 - protein, 9 aa, Homo Sapiens
AVTILYGTL

SEQ ID NO: 312957 - protein, 9 aa, Homo Sapiens
FSHRSRKIS

SEQ ID NO: 312958 - protein, 9 aa, Homo Sapiens
CQEKEQEPE

SEQ ID NO: 312959 - protein, 9 aa, Homo Sapiens
KSIIKIPHL

SEQ ID NO: 312960 - protein, 9 aa, Homo Sapiens
SSLNKRLQT

SEQ ID NO: 312961 - protein, 9 aa, Homo Sapiens
PHPATFFCI

SEQ ID NO: 312962 - protein, 9 aa, Homo Sapiens
DSFLHIRFH

SEQ ID NO: 312963 - protein, 9 aa, Homo Sapiens
QQQKSIALQ

SEQ ID NO: 312964 - protein, 9 aa, Homo Sapiens
VRVPSVTLV

SEQ ID NO: 312965 - protein, 9 aa, Homo Sapiens
LSSLENAVC

SEQ ID NO: 312966 - protein, 9 aa, Homo Sapiens
HEGKTPAGR

SEQ ID NO: 312967 - protein, 9 aa, Homo Sapiens
TSTLRYWGT

SEQ ID NO: 312968 - protein, 9 aa, Homo Sapiens
TMGYKDTDG

SEQ ID NO: 312969 - protein, 9 aa, Homo Sapiens
ARSSPKLFP

SEQ ID NO: 312970 - protein, 9 aa, Homo Sapiens
KIKYYYCEV

SEQ ID NO: 312971 - protein, 9 aa, Homo Sapiens
PDQPIIVEV

SEQ ID NO: 312972 - protein, 9 aa, Homo Sapiens
KIALQDRTQ

SEQ ID NO: 312973 - protein, 9 aa, Homo Sapiens
SKQSSFCSE

SEQ ID NO: 312974 - protein, 9 aa, Homo Sapiens
FSETGADEE

SEQ ID NO: 312975 - protein, 9 aa, Homo Sapiens
WSSKERQGV

SEQ ID NO: 312976 - protein, 9 aa, Homo Sapiens
CVVLLQTAT

SEQ ID NO: 312977 - protein, 9 aa, Homo Sapiens
VEATNSMNN

SEQ ID NO: 312978 - protein, 9 aa, Homo Sapiens
SKAGPYTFP

SEQ ID NO: 312979 - protein, 9 aa, Homo Sapiens
PSGTYDAFP

SEQ ID NO: 312980 - protein, 9 aa, Homo Sapiens
KYLKDITIV

SEQ ID NO: 312981 - protein, 9 aa, Homo Sapiens
HRALPLLDE

SEQ ID NO: 312982 - protein, 9 aa, Homo Sapiens
MNNILSYRI

SEQ ID NO: 312983 - protein, 9 aa, Homo Sapiens
YKVVAMSFH

SEQ ID NO: 312984 - protein, 9 aa, Homo Sapiens
MGCIKSKDN

SEQ ID NO: 312985 - protein, 9 aa, Homo Sapiens
MALYYSQHV

SEQ ID NO: 312986 - protein, 9 aa, Homo Sapiens
GGNLYWGSV

SEQ ID NO: 312987 - protein, 9 aa, Homo Sapiens
SINAVNIFG

SEQ ID NO: 312988 - protein, 9 aa, Homo Sapiens
LCETIGVLS

SEQ ID NO: 312989 - protein, 9 aa, Homo Sapiens
EHQEAKKAD

SEQ ID NO: 312990 - protein, 9 aa, Homo Sapiens
SDLNKQVLE

SEQ ID NO: 312991 - protein, 9 aa, Homo Sapiens
SHPMGTSNF

SEQ ID NO: 312992 - protein, 9 aa, Homo Sapiens
SLCLGVSLA

SEQ ID NO: 312993 - protein, 9 aa, Homo Sapiens
QLFEMHDKL

SEQ ID NO: 312994 - protein, 9 aa, Homo Sapiens
TQHIFVKIC

SEQ ID NO: 312995 - protein, 9 aa, Homo Sapiens
DRTALLNVC

SEQ ID NO: 312996 - protein, 9 aa, Homo Sapiens
KKRNPEVQH

SEQ ID NO: 312997 - protein, 9 aa, Homo Sapiens
TASIKTLCA

SEQ ID NO: 312998 - protein, 9 aa, Homo Sapiens
RETNNLSPK

SEQ ID NO: 312999 - protein, 9 aa, Homo Sapiens
LTVECTYSV

SEQ ID NO: 313000 - protein, 9 aa, Homo Sapiens
AAHNRFLYV

SEQ ID NO: 313001 - protein, 9 aa, Homo Sapiens
DHLAWTRNK

SEQ ID NO: 313002 - protein, 9 aa, Homo Sapiens
TSPANSQAA

SEQ ID NO: 313003 - protein, 9 aa, Homo Sapiens
FMLHKSIDV

SEQ ID NO: 313004 - protein, 9 aa, Homo Sapiens
EEGKQKIIP

SEQ ID NO: 313005 - protein, 9 aa, Homo Sapiens
PEEIPPMPE

SEQ ID NO: 313006 - protein, 9 aa, Homo Sapiens
LLLLLVSSV

SEQ ID NO: 313007 - protein, 9 aa, Homo Sapiens
FISALSFLD

SEQ ID NO: 313008 - protein, 9 aa, Homo Sapiens
QEFHRTMLT

SEQ ID NO: 313009 - protein, 9 aa, Homo Sapiens
TTTNYPSTP

SEQ ID NO: 313010 - protein, 9 aa, Homo Sapiens
ERCTGFDAH

SEQ ID NO: 313011 - protein, 9 aa, Homo Sapiens
LYTGDSFLH

SEQ ID NO: 313012 - protein, 9 aa, Homo Sapiens
QIQDEIILL

SEQ ID NO: 313013 - protein, 9 aa, Homo Sapiens
GHFIADHYM

SEQ ID NO: 313014 - protein, 9 aa, Homo Sapiens
APRKEITGW

SEQ ID NO: 313015 - protein, 9 aa, Homo Sapiens
NASLRKEKK

SEQ ID NO: 313016 - protein, 9 aa, Homo Sapiens
NIVHKRDKF

SEQ ID NO: 313017 - protein, 9 aa, Homo Sapiens
RFGQSKCCK

SEQ ID NO: 313018 - protein, 9 aa, Homo Sapiens
LDDATKLWG

SEQ ID NO: 313019 - protein, 9 aa, Homo Sapiens
QNQYLGDKP

SEQ ID NO: 313020 - protein, 9 aa, Homo Sapiens
WFSNQRAKW

SEQ ID NO: 313021 - protein, 9 aa, Homo Sapiens
TQLADTSTF

SEQ ID NO: 313022 - protein, 9 aa, Homo Sapiens
AWANRVRYM

SEQ ID NO: 313023 - protein, 9 aa, Homo Sapiens
NVTKEDLEK

SEQ ID NO: 313024 - protein, 9 aa, Homo Sapiens
LNPPLMKRN

SEQ ID NO: 313025 - protein, 9 aa, Homo Sapiens
LFLVRHFCI

SEQ ID NO: 313026 - protein, 9 aa, Homo Sapiens
QPSKQKPLP

SEQ ID NO: 313027 - protein, 9 aa, Homo Sapiens
TSFERRPST

SEQ ID NO: 313028 - protein, 9 aa, Homo Sapiens
DVAIEFYQE

SEQ ID NO: 313029 - protein, 9 aa, Homo Sapiens
VLLLTQTDI

SEQ ID NO: 313030 - protein, 9 aa, Homo Sapiens
TEMTSTLRY

SEQ ID NO: 313031 - protein, 9 aa, Homo Sapiens
TKSQSDEDK

SEQ ID NO: 313032 - protein, 9 aa, Homo Sapiens
TNYTFICQE

SEQ ID NO: 313033 - protein, 9 aa, Homo Sapiens
EEPFMPAER

SEQ ID NO: 313034 - protein, 9 aa, Homo Sapiens
SSKTESIND

SEQ ID NO: 313035 - protein, 9 aa, Homo Sapiens
GRAEAHTEV

SEQ ID NO: 313036 - protein, 9 aa, Homo Sapiens
VVFFVFVLF

SEQ ID NO: 313037 - protein, 9 aa, Homo Sapiens
YDLWAKTIV

SEQ ID NO: 313038 - protein, 9 aa, Homo Sapiens
PSLRAWQAS

SEQ ID NO: 313039 - protein, 9 aa, Homo Sapiens
QSEGSPLVV

SEQ ID NO: 313040 - protein, 9 aa, Homo Sapiens
HLSSVSTET

SEQ ID NO: 313041 - protein, 9 aa, Homo Sapiens
QYPLNKLDL

SEQ ID NO: 313042 - protein, 9 aa, Homo Sapiens
ENKISYHLC

SEQ ID NO: 313043 - protein, 9 aa, Homo Sapiens
SEGLPGMCT

SEQ ID NO: 313044 - protein, 9 aa, Homo Sapiens
NGFIYESSS

SEQ ID NO: 313045 - protein, 9 aa, Homo Sapiens
THNIAKLMP

SEQ ID NO: 313046 - protein, 9 aa, Homo Sapiens
KNDKLGPET

SEQ ID NO: 313047 - protein, 9 aa, Homo Sapiens
DDSLSTKSC

SEQ ID NO: 313048 - protein, 9 aa, Homo Sapiens
PDFKRKYYS

SEQ ID NO: 313049 - protein, 9 aa, Homo Sapiens
TTAQRCFCQ

SEQ ID NO: 313050 - protein, 9 aa, Homo Sapiens
LAGMLLSED

SEQ ID NO: 313051 - protein, 9 aa, Homo Sapiens
KQVATMKAD

SEQ ID NO: 313052 - protein, 9 aa, Homo Sapiens
SLIDKPAIY

SEQ ID NO: 313053 - protein, 9 aa, Homo Sapiens
KSPQMNNFN

SEQ ID NO: 313054 - protein, 9 aa, Homo Sapiens
KNLSRQIDN

SEQ ID NO: 313055 - protein, 9 aa, Homo Sapiens
GGQDIAPGS

SEQ ID NO: 313056 - protein, 9 aa, Homo Sapiens
TFNLKMLLE

SEQ ID NO: 313057 - protein, 9 aa, Homo Sapiens
GASTLSQLP

SEQ ID NO: 313058 - protein, 9 aa, Homo Sapiens
YEKITACSS

SEQ ID NO: 313059 - protein, 9 aa, Homo Sapiens
EELNKKYGI

SEQ ID NO: 313060 - protein, 9 aa, Homo Sapiens
CDYDTHNIL

SEQ ID NO: 313061 - protein, 9 aa, Homo Sapiens
EYQDKLKAI

SEQ ID NO: 313062 - protein, 9 aa, Homo Sapiens
VLKMIRHTT

SEQ ID NO: 313063 - protein, 9 aa, Homo Sapiens
SCRHEKKIH

SEQ ID NO: 313064 - protein, 9 aa, Homo Sapiens
RVKKKMTEG

SEQ ID NO: 313065 - protein, 9 aa, Homo Sapiens
DQSDRSGTD

SEQ ID NO: 313066 - protein, 9 aa, Homo Sapiens
VLRGLVSLC

SEQ ID NO: 313067 - protein, 9 aa, Homo Sapiens
VAPITDLKS

SEQ ID NO: 313068 - protein, 9 aa, Homo Sapiens
IYFLSSLLG

SEQ ID NO: 313069 - protein, 9 aa, Homo Sapiens
LEYQDKLKA

SEQ ID NO: 313070 - protein, 9 aa, Homo Sapiens
QTFNHTHLY

SEQ ID NO: 313071 - protein, 9 aa, Homo Sapiens
SSIDEEGCI

SEQ ID NO: 313072 - protein, 9 aa, Homo Sapiens
LPAALNYPR

SEQ ID NO: 313073 - protein, 9 aa, Homo Sapiens
DNKKMKKYL

SEQ ID NO: 313074 - protein, 9 aa, Homo Sapiens
FYPLYKQDS

SEQ ID NO: 313075 - protein, 9 aa, Homo Sapiens
EVIETTAPG

SEQ ID NO: 313076 - protein, 9 aa, Homo Sapiens
FAVLYDTFV

SEQ ID NO: 313077 - protein, 9 aa, Homo Sapiens
DAQHGGWTT

SEQ ID NO: 313078 - protein, 9 aa, Homo Sapiens
YVTEIDPVC

SEQ ID NO: 313079 - protein, 9 aa, Homo Sapiens
ITHTGERPF

SEQ ID NO: 313080 - protein, 9 aa, Homo Sapiens
LMTWAAKID

SEQ ID NO: 313081 - protein, 9 aa, Homo Sapiens
PFSSKSRAL

SEQ ID NO: 313082 - protein, 9 aa, Homo Sapiens
KVIHETWKE

SEQ ID NO: 313083 - protein, 9 aa, Homo Sapiens
STHLTHQIL

SEQ ID NO: 313084 - protein, 9 aa, Homo Sapiens
VLSLLEKLL

SEQ ID NO: 313085 - protein, 9 aa, Homo Sapiens
WEMFWAGHR

SEQ ID NO: 313086 - protein, 9 aa, Homo Sapiens
EKYRKNVLK

SEQ ID NO: 313087 - protein, 9 aa, Homo Sapiens
GNPFDHCSA

SEQ ID NO: 313088 - protein, 9 aa, Homo Sapiens
SLQNHYLNV

SEQ ID NO: 313089 - protein, 9 aa, Homo Sapiens
LMERQIRPW

SEQ ID NO: 313090 - protein, 9 aa, Homo Sapiens
FCYKGSCFH

SEQ ID NO: 313091 - protein, 9 aa, Homo Sapiens
EVFSTDLSN

SEQ ID NO: 313092 - protein, 9 aa, Homo Sapiens
LRCYNKKVF

SEQ ID NO: 313093 - protein, 9 aa, Homo Sapiens
LCNNKLYQP

SEQ ID NO: 313094 - protein, 9 aa, Homo Sapiens
EKELQAQQI

SEQ ID NO: 313095 - protein, 9 aa, Homo Sapiens
DMAQLIHLF

SEQ ID NO: 313096 - protein, 9 aa, Homo Sapiens
LFCIGVILV

SEQ ID NO: 313097 - protein, 9 aa, Homo Sapiens
RIDLAEVEM

SEQ ID NO: 313098 - protein, 9 aa, Homo Sapiens
SKNNPGVVA

SEQ ID NO: 313099 - protein, 9 aa, Homo Sapiens
IYWLQNLRY

SEQ ID NO: 313100 - protein, 9 aa, Homo Sapiens
TDRVTGMDK

SEQ ID NO: 313101 - protein, 9 aa, Homo Sapiens
LVRHQQTHE

SEQ ID NO: 313102 - protein, 9 aa, Homo Sapiens
GKASEARGE

SEQ ID NO: 313103 - protein, 9 aa, Homo Sapiens
GNITIITLT

SEQ ID NO: 313104 - protein, 9 aa, Homo Sapiens
FSKWWPTEF

SEQ ID NO: 313105 - protein, 9 aa, Homo Sapiens
VLINSLEGA

SEQ ID NO: 313106 - protein, 9 aa, Homo Sapiens
EEQDYYLGG

SEQ ID NO: 313107 - protein, 9 aa, Homo Sapiens
LGICLQSEG

SEQ ID NO: 313108 - protein, 9 aa, Homo Sapiens
LYSLQFSVG

SEQ ID NO: 313109 - protein, 9 aa, Homo Sapiens
PEVQIMPSQ

SEQ ID NO: 313110 - protein, 9 aa, Homo Sapiens
YKCSECEIT

SEQ ID NO: 313111 - protein, 9 aa, Homo Sapiens
EERRLDSGN

SEQ ID NO: 313112 - protein, 9 aa, Homo Sapiens
LNQIQRHHT

SEQ ID NO: 313113 - protein, 9 aa, Homo Sapiens
SQSKGKKQN

SEQ ID NO: 313114 - protein, 9 aa, Homo Sapiens
HSQDNLVVH

SEQ ID NO: 313115 - protein, 9 aa, Homo Sapiens
RSKLYLDLH

SEQ ID NO: 313116 - protein, 9 aa, Homo Sapiens
LPQGSACLQ

SEQ ID NO: 313117 - protein, 9 aa, Homo Sapiens
IQQLHSRTI

SEQ ID NO: 313118 - protein, 9 aa, Homo Sapiens
KKNPFLVSF

SEQ ID NO: 313119 - protein, 9 aa, Homo Sapiens
NETMLDFQT

SEQ ID NO: 313120 - protein, 9 aa, Homo Sapiens
NGESEVQRL

SEQ ID NO: 313121 - protein, 9 aa, Homo Sapiens
PIKCLIKHQ

SEQ ID NO: 313122 - protein, 9 aa, Homo Sapiens
LQNRRHPQI

SEQ ID NO: 313123 - protein, 9 aa, Homo Sapiens
FILGDHFRD

SEQ ID NO: 313124 - protein, 9 aa, Homo Sapiens
GPVSYHDME

SEQ ID NO: 313125 - protein, 9 aa, Homo Sapiens
GSPGDKGEA

SEQ ID NO: 313126 - protein, 9 aa, Homo Sapiens
LWKADNTLS

SEQ ID NO: 313127 - protein, 9 aa, Homo Sapiens
MDQEKMTMN

SEQ ID NO: 313128 - protein, 9 aa, Homo Sapiens
TPVREDSTA

SEQ ID NO: 313129 - protein, 9 aa, Homo Sapiens
SQLYSLIDH

SEQ ID NO: 313130 - protein, 9 aa, Homo Sapiens
EIIAVLRQR

SEQ ID NO: 313131 - protein, 9 aa, Homo Sapiens
WHHRDELLR

SEQ ID NO: 313132 - protein, 9 aa, Homo Sapiens
VNIILILAI

SEQ ID NO: 313133 - protein, 9 aa, Homo Sapiens
KFALLRKHI

SEQ ID NO: 313134 - protein, 9 aa, Homo Sapiens
SVPGQNNVD

SEQ ID NO: 313135 - protein, 9 aa, Homo Sapiens
RAKPRADTT

SEQ ID NO: 313136 - protein, 9 aa, Homo Sapiens
NLINDKQFA

SEQ ID NO: 313137 - protein, 9 aa, Homo Sapiens
NTRSSQNGS

SEQ ID NO: 313138 - protein, 9 aa, Homo Sapiens
STEAQSLSR

SEQ ID NO: 313139 - protein, 9 aa, Homo Sapiens
LKVHYSDCL

SEQ ID NO: 313140 - protein, 9 aa, Homo Sapiens
KSRLPQLMD

SEQ ID NO: 313141 - protein, 9 aa, Homo Sapiens
EFRENNQRL

SEQ ID NO: 313142 - protein, 9 aa, Homo Sapiens
KLFDPKYQQ

SEQ ID NO: 313143 - protein, 9 aa, Homo Sapiens
SFLCGESDI

SEQ ID NO: 313144 - protein, 9 aa, Homo Sapiens
VNHLYCDLP

SEQ ID NO: 313145 - protein, 9 aa, Homo Sapiens
RFCFDDSLP

SEQ ID NO: 313146 - protein, 9 aa, Homo Sapiens
LELDFLLQF

SEQ ID NO: 313147 - protein, 9 aa, Homo Sapiens
MELLNTNYR

SEQ ID NO: 313148 - protein, 9 aa, Homo Sapiens
QDRTALLNV

SEQ ID NO: 313149 - protein, 9 aa, Homo Sapiens
LMKHVNEIF

SEQ ID NO: 313150 - protein, 9 aa, Homo Sapiens
ELHDIIKDV

SEQ ID NO: 313151 - protein, 9 aa, Homo Sapiens
TKGHDGSKR

SEQ ID NO: 313152 - protein, 9 aa, Homo Sapiens
RKLQPNSNA

SEQ ID NO: 313153 - protein, 9 aa, Homo Sapiens
VVKARQPQP

SEQ ID NO: 313154 - protein, 9 aa, Homo Sapiens
TNHKNIHTG

SEQ ID NO: 313155 - protein, 9 aa, Homo Sapiens
LSEKMVSST

SEQ ID NO: 313156 - protein, 9 aa, Homo Sapiens
HHLSCKMLT

SEQ ID NO: 313157 - protein, 9 aa, Homo Sapiens
YLSEKAYLW

SEQ ID NO: 313158 - protein, 9 aa, Homo Sapiens
YCRRQNGYR

SEQ ID NO: 313159 - protein, 9 aa, Homo Sapiens
KERQGVLRQ

SEQ ID NO: 313160 - protein, 9 aa, Homo Sapiens
RQSKEQMKN

SEQ ID NO: 313161 - protein, 9 aa, Homo Sapiens
LLDCFLLDS

SEQ ID NO: 313162 - protein, 9 aa, Homo Sapiens
HDQHCRDIF

SEQ ID NO: 313163 - protein, 9 aa, Homo Sapiens
FIVSGICAI

SEQ ID NO: 313164 - protein, 9 aa, Homo Sapiens
ATLAQRLGL

SEQ ID NO: 313165 - protein, 9 aa, Homo Sapiens
NYISQEPAF

SEQ ID NO: 313166 - protein, 9 aa, Homo Sapiens
CFLLLLLVS

SEQ ID NO: 313167 - protein, 9 aa, Homo Sapiens
NIQLQGTNE

SEQ ID NO: 313168 - protein, 9 aa, Homo Sapiens
IAMSSIDEY

SEQ ID NO: 313169 - protein, 9 aa, Homo Sapiens
GFCYKGSCF

SEQ ID NO: 313170 - protein, 9 aa, Homo Sapiens
KQKVINTPE

SEQ ID NO: 313171 - protein, 9 aa, Homo Sapiens
TLSDAYQDK

SEQ ID NO: 313172 - protein, 9 aa, Homo Sapiens
QPPETTAQR

SEQ ID NO: 313173 - protein, 9 aa, Homo Sapiens
GKHILQNTA

SEQ ID NO: 313174 - protein, 9 aa, Homo Sapiens
CSEIAYDPK

SEQ ID NO: 313175 - protein, 9 aa, Homo Sapiens
EDSTAKKLA

SEQ ID NO: 313176 - protein, 9 aa, Homo Sapiens
FNSELAHEI

SEQ ID NO: 313177 - protein, 9 aa, Homo Sapiens
YLVEKLVKR

SEQ ID NO: 313178 - protein, 9 aa, Homo Sapiens
ALGYQPDLS

SEQ ID NO: 313179 - protein, 9 aa, Homo Sapiens
FYFVPPSKA

SEQ ID NO: 313180 - protein, 9 aa, Homo Sapiens
FLAKLLKKA

SEQ ID NO: 313181 - protein, 9 aa, Homo Sapiens
PNYISQEPA

SEQ ID NO: 313182 - protein, 9 aa, Homo Sapiens
TDPTFTLSV

SEQ ID NO: 313183 - protein, 9 aa, Homo Sapiens
ERRPSTRYS

SEQ ID NO: 313184 - protein, 9 aa, Homo Sapiens
PIIENALVG

SEQ ID NO: 313185 - protein, 9 aa, Homo Sapiens
LFGQVFRPD

SEQ ID NO: 313186 - protein, 9 aa, Homo Sapiens
DYCSLSHIL

SEQ ID NO: 313187 - protein, 9 aa, Homo Sapiens
VGTDDNNSV

SEQ ID NO: 313188 - protein, 9 aa, Homo Sapiens
KLKKPRWII

SEQ ID NO: 313189 - protein, 9 aa, Homo Sapiens
IEIMSSTNM

SEQ ID NO: 313190 - protein, 9 aa, Homo Sapiens
VCLVRGGHK

SEQ ID NO: 313191 - protein, 9 aa, Homo Sapiens
QIPALLGNT

SEQ ID NO: 313192 - protein, 9 aa, Homo Sapiens
DKLGPETPL

SEQ ID NO: 313193 - protein, 9 aa, Homo Sapiens
TEIGSKANY

SEQ ID NO: 313194 - protein, 9 aa, Homo Sapiens
TPIFNEYIY

SEQ ID NO: 313195 - protein, 9 aa, Homo Sapiens
KISLSCKKA

SEQ ID NO: 313196 - protein, 9 aa, Homo Sapiens
DSILMERQI

SEQ ID NO: 313197 - protein, 9 aa, Homo Sapiens
SENSSEEEL

SEQ ID NO: 313198 - protein, 9 aa, Homo Sapiens
SLADTYNRL

SEQ ID NO: 313199 - protein, 9 aa, Homo Sapiens
GCGTQIFVY

SEQ ID NO: 313200 - protein, 9 aa, Homo Sapiens
RIDQICSLM

SEQ ID NO: 313201 - protein, 9 aa, Homo Sapiens
YPKPAHLSA

SEQ ID NO: 313202 - protein, 9 aa, Homo Sapiens
GESAPVLMI

SEQ ID NO: 313203 - protein, 9 aa, Homo Sapiens
NIRNAQLAQ

SEQ ID NO: 313204 - protein, 9 aa, Homo Sapiens
IIYKYSPFT

SEQ ID NO: 313205 - protein, 9 aa, Homo Sapiens
RTALLNVCM

SEQ ID NO: 313206 - protein, 9 aa, Homo Sapiens
GDNLVHQIQ

SEQ ID NO: 313207 - protein, 9 aa, Homo Sapiens
GGSQENHLG

SEQ ID NO: 313208 - protein, 9 aa, Homo Sapiens
NQYLGDKPY

SEQ ID NO: 313209 - protein, 9 aa, Homo Sapiens
PPPLYGDEL

SEQ ID NO: 313210 - protein, 9 aa, Homo Sapiens
FYHQPWTQE

SEQ ID NO: 313211 - protein, 9 aa, Homo Sapiens
YYCNCDADW

SEQ ID NO: 313212 - protein, 9 aa, Homo Sapiens
IISSDSPPS

SEQ ID NO: 313213 - protein, 9 aa, Homo Sapiens
RTIHYENGF

SEQ ID NO: 313214 - protein, 9 aa, Homo Sapiens
DTTSTFKPM

SEQ ID NO: 313215 - protein, 9 aa, Homo Sapiens
EEENKKHKK

SEQ ID NO: 313216 - protein, 9 aa, Homo Sapiens
IFKPDVISS

SEQ ID NO: 313217 - protein, 8 aa, Homo Sapiens
KLERTNLE

SEQ ID NO: 313218 - protein, 9 aa, Homo Sapiens
LSLTFFQKK

SEQ ID NO: 313219 - protein, 9 aa, Homo Sapiens
ATHTATTQC

SEQ ID NO: 313220 - protein, 9 aa, Homo Sapiens
FFVFFFIIY

SEQ ID NO: 313221 - protein, 9 aa, Homo Sapiens
VNDVDYDDV

SEQ ID NO: 313222 - protein, 9 aa, Homo Sapiens
MDIQGNPKC

SEQ ID NO: 313223 - protein, 9 aa, Homo Sapiens
LNQYLTSTQ

SEQ ID NO: 313224 - protein, 9 aa, Homo Sapiens
HYRENLTQS

SEQ ID NO: 313225 - protein, 9 aa, Homo Sapiens
RRCACDYCS

SEQ ID NO: 313226 - protein, 9 aa, Homo Sapiens
RKVKCIYVV

SEQ ID NO: 313227 - protein, 9 aa, Homo Sapiens
SIDEYKNRA

SEQ ID NO: 313228 - protein, 9 aa, Homo Sapiens
LLRKHILIF

SEQ ID NO: 313229 - protein, 9 aa, Homo Sapiens
IFCNVTPLL

SEQ ID NO: 313230 - protein, 9 aa, Homo Sapiens
FLLLLLVSS

SEQ ID NO: 313231 - protein, 9 aa, Homo Sapiens
GLGPRTSRQ

SEQ ID NO: 313232 - protein, 9 aa, Homo Sapiens
AEDFYLLEN

SEQ ID NO: 313233 - protein, 9 aa, Homo Sapiens
VFESRKEIV

SEQ ID NO: 313234 - protein, 9 aa, Homo Sapiens
TAQRCFCQV

SEQ ID NO: 313235 - protein, 9 aa, Homo Sapiens
AFSTVHITN

SEQ ID NO: 313236 - protein, 9 aa, Homo Sapiens
NNLSDKTSK

SEQ ID NO: 313237 - protein, 9 aa, Homo Sapiens
FGKMLDNIF

SEQ ID NO: 313238 - protein, 9 aa, Homo Sapiens
VKIIIMELD

SEQ ID NO: 313239 - protein, 9 aa, Homo Sapiens
MYFLIFNLS

SEQ ID NO: 313240 - protein, 9 aa, Homo Sapiens
AIETIVATM

SEQ ID NO: 313241 - protein, 9 aa, Homo Sapiens
FTKYCNKWQ

SEQ ID NO: 313242 - protein, 9 aa, Homo Sapiens
VESLEAGDS

SEQ ID NO: 313243 - protein, 9 aa, Homo Sapiens
VRQIELLNE

SEQ ID NO: 313244 - protein, 9 aa, Homo Sapiens
LRTHVQGLS

SEQ ID NO: 313245 - protein, 9 aa, Homo Sapiens
HKITHTSEK

SEQ ID NO: 313246 - protein, 9 aa, Homo Sapiens
DQKNKYVFQ

SEQ ID NO: 313247 - protein, 9 aa, Homo Sapiens
VGNLSLITL

SEQ ID NO: 313248 - protein, 9 aa, Homo Sapiens
MDKGISSIP

SEQ ID NO: 313249 - protein, 9 aa, Homo Sapiens
HLVNCVEPV

SEQ ID NO: 313250 - protein, 9 aa, Homo Sapiens
DKGISSIPI

SEQ ID NO: 313251 - protein, 9 aa, Homo Sapiens
VISFLELWY

SEQ ID NO: 313252 - protein, 9 aa, Homo Sapiens
GNRDNEKPT

SEQ ID NO: 313253 - protein, 9 aa, Homo Sapiens
AQSPHVSDK

SEQ ID NO: 313254 - protein, 9 aa, Homo Sapiens
LRNTEYVNQ

SEQ ID NO: 313255 - protein, 9 aa, Homo Sapiens
WNRVYSNTV

SEQ ID NO: 313256 - protein, 9 aa, Homo Sapiens
VGDISGGDT

SEQ ID NO: 313257 - protein, 9 aa, Homo Sapiens
LQKVFDEHK

SEQ ID NO: 313258 - protein, 9 aa, Homo Sapiens
DNHIKDALS

SEQ ID NO: 313259 - protein, 9 aa, Homo Sapiens
VDADSSYFE

SEQ ID NO: 313260 - protein, 9 aa, Homo Sapiens
MATNIKNYY

SEQ ID NO: 313261 - protein, 9 aa, Homo Sapiens
TTQKKKVDR

SEQ ID NO: 313262 - protein, 9 aa, Homo Sapiens
TISPGMTYC

SEQ ID NO: 313263 - protein, 9 aa, Homo Sapiens
EDIDLFEAE

SEQ ID NO: 313264 - protein, 9 aa, Homo Sapiens
MVGDIHKYV

SEQ ID NO: 313265 - protein, 9 aa, Homo Sapiens
SDLHNCFLG

SEQ ID NO: 313266 - protein, 9 aa, Homo Sapiens
DNIGNGDFS

SEQ ID NO: 313267 - protein, 9 aa, Homo Sapiens
TFPELAYQK

SEQ ID NO: 313268 - protein, 9 aa, Homo Sapiens
SLVGLLPTQ

SEQ ID NO: 313269 - protein, 9 aa, Homo Sapiens
LAMDLMVFT

SEQ ID NO: 313270 - protein, 9 aa, Homo Sapiens
REGKEENKG

SEQ ID NO: 313271 - protein, 9 aa, Homo Sapiens
ALPQRSSRL

SEQ ID NO: 313272 - protein, 9 aa, Homo Sapiens
GRTVLAMDL

SEQ ID NO: 313273 - protein, 9 aa, Homo Sapiens
NREVSIMYP

SEQ ID NO: 313274 - protein, 9 aa, Homo Sapiens
PERQMRSQS

SEQ ID NO: 313275 - protein, 9 aa, Homo Sapiens
RKGKCRHHS

SEQ ID NO: 313276 - protein, 9 aa, Homo Sapiens
SMQKSMQNN

SEQ ID NO: 313277 - protein, 9 aa, Homo Sapiens
RWWGLITLA

SEQ ID NO: 313278 - protein, 9 aa, Homo Sapiens
NSSILDLEK

SEQ ID NO: 313279 - protein, 9 aa, Homo Sapiens
QEQDVKDNT

SEQ ID NO: 313280 - protein, 9 aa, Homo Sapiens
RLQNRYANR

SEQ ID NO: 313281 - protein, 9 aa, Homo Sapiens
RCGKAFSQL

SEQ ID NO: 313282 - protein, 9 aa, Homo Sapiens
IETIVATMS

SEQ ID NO: 313283 - protein, 9 aa, Homo Sapiens
GLFYLVTIQ

SEQ ID NO: 313284 - protein, 9 aa, Homo Sapiens
DHEIALANG

SEQ ID NO: 313285 - protein, 9 aa, Homo Sapiens
KYPESLCPA

SEQ ID NO: 313286 - protein, 9 aa, Homo Sapiens
QYSASSRAH

SEQ ID NO: 313287 - protein, 9 aa, Homo Sapiens
VARFTVIKT

SEQ ID NO: 313288 - protein, 9 aa, Homo Sapiens
QLKCLMKGK

SEQ ID NO: 313289 - protein, 9 aa, Homo Sapiens
GMIPRARKI

SEQ ID NO: 313290 - protein, 9 aa, Homo Sapiens
QIIIHTHKC

SEQ ID NO: 313291 - protein, 9 aa, Homo Sapiens
DNSPGHGKS

SEQ ID NO: 313292 - protein, 9 aa, Homo Sapiens
GVFSPSLQN

SEQ ID NO: 313293 - protein, 9 aa, Homo Sapiens
TFTLGNNRI

SEQ ID NO: 313294 - protein, 9 aa, Homo Sapiens
AQPVRSFIQ

SEQ ID NO: 313295 - protein, 9 aa, Homo Sapiens
YLQADTVGA

SEQ ID NO: 313296 - protein, 9 aa, Homo Sapiens
NIYSFNSTN

SEQ ID NO: 313297 - protein, 9 aa, Homo Sapiens
HKRALRAQK

SEQ ID NO: 313298 - protein, 9 aa, Homo Sapiens
CLSGEPGQT

SEQ ID NO: 313299 - protein, 9 aa, Homo Sapiens
QNKNKLLSS

SEQ ID NO: 313300 - protein, 9 aa, Homo Sapiens
NLPAALNYP

SEQ ID NO: 313301 - protein, 9 aa, Homo Sapiens
MIVAVEKDY

SEQ ID NO: 313302 - protein, 9 aa, Homo Sapiens
WTCEQGTPP

SEQ ID NO: 313303 - protein, 9 aa, Homo Sapiens
EHLEFLDKQ

SEQ ID NO: 313304 - protein, 9 aa, Homo Sapiens
SGRYWASPT

SEQ ID NO: 313305 - protein, 9 aa, Homo Sapiens
GSSIVGGNE

SEQ ID NO: 313306 - protein, 9 aa, Homo Sapiens
DKLFSGYDS

SEQ ID NO: 313307 - protein, 9 aa, Homo Sapiens
TVQVQWEIN

SEQ ID NO: 313308 - protein, 9 aa, Homo Sapiens
CTEPSVHQR

SEQ ID NO: 313309 - protein, 9 aa, Homo Sapiens
YTTERDLCE

SEQ ID NO: 313310 - protein, 9 aa, Homo Sapiens
TRPEEVKHR

SEQ ID NO: 313311 - protein, 9 aa, Homo Sapiens
KQWHSIREI

SEQ ID NO: 313312 - protein, 9 aa, Homo Sapiens
LKNQAVQGQ

SEQ ID NO: 313313 - protein, 9 aa, Homo Sapiens
LEACVLQPD

SEQ ID NO: 313314 - protein, 9 aa, Homo Sapiens
FPCNECTKL

SEQ ID NO: 313315 - protein, 9 aa, Homo Sapiens
GLPGMCTRS

SEQ ID NO: 313316 - protein, 9 aa, Homo Sapiens
YPKNMETSE

SEQ ID NO: 313317 - protein, 9 aa, Homo Sapiens
KDATAEIID

SEQ ID NO: 313318 - protein, 9 aa, Homo Sapiens
EGKLLVKNI

SEQ ID NO: 313319 - protein, 9 aa, Homo Sapiens
VINKFACVA

SEQ ID NO: 313320 - protein, 9 aa, Homo Sapiens
NHKEINTED

SEQ ID NO: 313321 - protein, 9 aa, Homo Sapiens
SALIIHQII

SEQ ID NO: 313322 - protein, 9 aa, Homo Sapiens
LEKETTVTK

SEQ ID NO: 313323 - protein, 9 aa, Homo Sapiens
ENTMADNEA

SEQ ID NO: 313324 - protein, 9 aa, Homo Sapiens
NTMADNEAG

SEQ ID NO: 313325 - protein, 9 aa, Homo Sapiens
VPLIKASRC

SEQ ID NO: 313326 - protein, 9 aa, Homo Sapiens
FLHPHPESY

SEQ ID NO: 313327 - protein, 9 aa, Homo Sapiens
IQLCDNYIY

SEQ ID NO: 313328 - protein, 9 aa, Homo Sapiens
SIMYPGAKD

SEQ ID NO: 313329 - protein, 9 aa, Homo Sapiens
IYSIYEDEK

SEQ ID NO: 313330 - protein, 9 aa, Homo Sapiens
YAHFVDVIK

SEQ ID NO: 313331 - protein, 9 aa, Homo Sapiens
ITHTSEKPY

SEQ ID NO: 313332 - protein, 9 aa, Homo Sapiens
SHLRCHSWK

SEQ ID NO: 313333 - protein, 9 aa, Homo Sapiens
SSTTTNANA

SEQ ID NO: 313334 - protein, 9 aa, Homo Sapiens
SDGELYENH

SEQ ID NO: 313335 - protein, 9 aa, Homo Sapiens
DPSFESENP

SEQ ID NO: 313336 - protein, 9 aa, Homo Sapiens
HCMIMALVS

SEQ ID NO: 313337 - protein, 9 aa, Homo Sapiens
QKSYKTLAD

SEQ ID NO: 313338 - protein, 9 aa, Homo Sapiens
EISKALQRK

SEQ ID NO: 313339 - protein, 9 aa, Homo Sapiens
ECGKSLSST

SEQ ID NO: 313340 - protein, 9 aa, Homo Sapiens
HCEQITAKM

SEQ ID NO: 313341 - protein, 9 aa, Homo Sapiens
AQSHSSADD

SEQ ID NO: 313342 - protein, 9 aa, Homo Sapiens
SINLSMSCL

SEQ ID NO: 313343 - protein, 9 aa, Homo Sapiens
VIQTFNHTH

SEQ ID NO: 313344 - protein, 9 aa, Homo Sapiens
EKDKTPKLC

SEQ ID NO: 313345 - protein, 9 aa, Homo Sapiens
PQSFKKIVD

SEQ ID NO: 313346 - protein, 9 aa, Homo Sapiens
DKILEKFRI

SEQ ID NO: 313347 - protein, 9 aa, Homo Sapiens
SDSPQWLPC

SEQ ID NO: 313348 - protein, 9 aa, Homo Sapiens
AVFLHYFIL

SEQ ID NO: 313349 - protein, 9 aa, Homo Sapiens
DAIRRFAAY

SEQ ID NO: 313350 - protein, 9 aa, Homo Sapiens
PSFSTDSWL

SEQ ID NO: 313351 - protein, 9 aa, Homo Sapiens
DEELREEQI

SEQ ID NO: 313352 - protein, 9 aa, Homo Sapiens
DDVHHLSVV

SEQ ID NO: 313353 - protein, 9 aa, Homo Sapiens
INYFELDRA

SEQ ID NO: 313354 - protein, 9 aa, Homo Sapiens
HSLGKAQTA

SEQ ID NO: 313355 - protein, 9 aa, Homo Sapiens
QKKQQLAIG

SEQ ID NO: 313356 - protein, 9 aa, Homo Sapiens
ATSPLKEDS

SEQ ID NO: 313357 - protein, 9 aa, Homo Sapiens
LLEDPNIKE

SEQ ID NO: 313358 - protein, 9 aa, Homo Sapiens
LNSRRSKLH

SEQ ID NO: 313359 - protein, 9 aa, Homo Sapiens
GIHKDILRV

SEQ ID NO: 313360 - protein, 9 aa, Homo Sapiens
EIENCLANT

SEQ ID NO: 313361 - protein, 9 aa, Homo Sapiens
VCAVLEKLH

SEQ ID NO: 313362 - protein, 9 aa, Homo Sapiens
FLNLINGAL

SEQ ID NO: 313363 - protein, 9 aa, Homo Sapiens
RYLMACAQT

SEQ ID NO: 313364 - protein, 9 aa, Homo Sapiens
AVMQLNVPN

SEQ ID NO: 313365 - protein, 9 aa, Homo Sapiens
TFATCSDDG

SEQ ID NO: 313366 - protein, 9 aa, Homo Sapiens
DIKPGRKRT

SEQ ID NO: 313367 - protein, 9 aa, Homo Sapiens
YTQPGPGYQ

SEQ ID NO: 313368 - protein, 9 aa, Homo Sapiens
DHIQMKQQA

SEQ ID NO: 313369 - protein, 9 aa, Homo Sapiens
PLLPYHLFS

SEQ ID NO: 313370 - protein, 9 aa, Homo Sapiens
QKHGKNVPK

SEQ ID NO: 313371 - protein, 9 aa, Homo Sapiens
KDKWWRGSG

SEQ ID NO: 313372 - protein, 9 aa, Homo Sapiens
YFISLLPKE

SEQ ID NO: 313373 - protein, 9 aa, Homo Sapiens
DTWVVEMLC

SEQ ID NO: 313374 - protein, 9 aa, Homo Sapiens
TCEECGKSF

SEQ ID NO: 313375 - protein, 9 aa, Homo Sapiens
AFYANMYAS

SEQ ID NO: 313376 - protein, 9 aa, Homo Sapiens
DSFKSGCEP

SEQ ID NO: 313377 - protein, 9 aa, Homo Sapiens
DGLNKKCLQ

SEQ ID NO: 313378 - protein, 9 aa, Homo Sapiens
AITEVLLNA

SEQ ID NO: 313379 - protein, 9 aa, Homo Sapiens
RTARLLSEC

SEQ ID NO: 313380 - protein, 9 aa, Homo Sapiens
LCQQLVGPF

SEQ ID NO: 313381 - protein, 9 aa, Homo Sapiens
YIYFIPRNV

SEQ ID NO: 313382 - protein, 9 aa, Homo Sapiens
IYEDEKLIP

SEQ ID NO: 313383 - protein, 9 aa, Homo Sapiens
RKEITGWDE

SEQ ID NO: 313384 - protein, 9 aa, Homo Sapiens
LQKHTVLVI

SEQ ID NO: 313385 - protein, 9 aa, Homo Sapiens
VAKMIRELP

SEQ ID NO: 313386 - protein, 9 aa, Homo Sapiens
KKNYRYKQD

SEQ ID NO: 313387 - protein, 9 aa, Homo Sapiens
AVWNDYSLT

SEQ ID NO: 313388 - protein, 9 aa, Homo Sapiens
LVDKTPIET

SEQ ID NO: 313389 - protein, 9 aa, Homo Sapiens
YPYDVKAPS

SEQ ID NO: 313390 - protein, 9 aa, Homo Sapiens
AYHQIIHTG

SEQ ID NO: 313391 - protein, 9 aa, Homo Sapiens
NTPSLDQQC

SEQ ID NO: 313392 - protein, 9 aa, Homo Sapiens
QKIENIHIG

SEQ ID NO: 313393 - protein, 9 aa, Homo Sapiens
ELIQKEKPA

SEQ ID NO: 313394 - protein, 9 aa, Homo Sapiens
INWNQYKIQ

SEQ ID NO: 313395 - protein, 9 aa, Homo Sapiens
QRYFISLLP

SEQ ID NO: 313396 - protein, 9 aa, Homo Sapiens
MGGQIPNTL

SEQ ID NO: 313397 - protein, 9 aa, Homo Sapiens
SYSGNISLY

SEQ ID NO: 313398 - protein, 9 aa, Homo Sapiens
FPLWESSKA

SEQ ID NO: 313399 - protein, 9 aa, Homo Sapiens
IVLAKSMCM

SEQ ID NO: 313400 - protein, 9 aa, Homo Sapiens
SSVFWICMT

SEQ ID NO: 313401 - protein, 9 aa, Homo Sapiens
VAWGPDSKK

SEQ ID NO: 313402 - protein, 9 aa, Homo Sapiens
KEFSSHFNN

SEQ ID NO: 313403 - protein, 9 aa, Homo Sapiens
SENNSSFTW

SEQ ID NO: 313404 - protein, 9 aa, Homo Sapiens
NLSDKTSKQ

SEQ ID NO: 313405 - protein, 9 aa, Homo Sapiens
KSKDNKSPA

SEQ ID NO: 313406 - protein, 9 aa, Homo Sapiens
KNAKKTTFQ

SEQ ID NO: 313407 - protein, 9 aa, Homo Sapiens
AHTGEKPFK

SEQ ID NO: 313408 - protein, 9 aa, Homo Sapiens
NNSNPVMCP

SEQ ID NO: 313409 - protein, 9 aa, Homo Sapiens
APDVLSPRY

SEQ ID NO: 313410 - protein, 9 aa, Homo Sapiens
KFICDVSRQ

SEQ ID NO: 313411 - protein, 9 aa, Homo Sapiens
LVGQFTLLF

SEQ ID NO: 313412 - protein, 9 aa, Homo Sapiens
DNSAAVQKA

SEQ ID NO: 313413 - protein, 9 aa, Homo Sapiens
GSRHSGSHN

SEQ ID NO: 313414 - protein, 9 aa, Homo Sapiens
CVRLRKKNQ

SEQ ID NO: 313415 - protein, 9 aa, Homo Sapiens
LIKECYYLT

SEQ ID NO: 313416 - protein, 9 aa, Homo Sapiens
EDGSIQIEE

SEQ ID NO: 313417 - protein, 9 aa, Homo Sapiens
VPQPFEDNE

SEQ ID NO: 313418 - protein, 9 aa, Homo Sapiens
VNDFTTIPL

SEQ ID NO: 313419 - protein, 9 aa, Homo Sapiens
VSNFFVCST

SEQ ID NO: 313420 - protein, 9 aa, Homo Sapiens
VSHNQFLRC

SEQ ID NO: 313421 - protein, 9 aa, Homo Sapiens
DYGTRLFHL

SEQ ID NO: 313422 - protein, 9 aa, Homo Sapiens
KYQLRLNGI

SEQ ID NO: 313423 - protein, 9 aa, Homo Sapiens
TEQFMADPC

SEQ ID NO: 313424 - protein, 9 aa, Homo Sapiens
GEDELSYGF

SEQ ID NO: 313425 - protein, 9 aa, Homo Sapiens
KLSDYFLLI

SEQ ID NO: 313426 - protein, 9 aa, Homo Sapiens
HDENTVLQK

SEQ ID NO: 313427 - protein, 9 aa, Homo Sapiens
SLHLSFAGL

SEQ ID NO: 313428 - protein, 9 aa, Homo Sapiens
RLYVGRENK

SEQ ID NO: 313429 - protein, 9 aa, Homo Sapiens
KRRDVGSSA

SEQ ID NO: 313430 - protein, 9 aa, Homo Sapiens
AQARFLHET

SEQ ID NO: 313431 - protein, 9 aa, Homo Sapiens
GKWILSTSD

SEQ ID NO: 313432 - protein, 9 aa, Homo Sapiens
SLALERKRA

SEQ ID NO: 313433 - protein, 9 aa, Homo Sapiens
TGDSFLHIR

SEQ ID NO: 313434 - protein, 9 aa, Homo Sapiens
IDVDKVVGA

SEQ ID NO: 313435 - protein, 9 aa, Homo Sapiens
LLQKHPAPP

SEQ ID NO: 313436 - protein, 9 aa, Homo Sapiens
KMSLYSEAN

SEQ ID NO: 313437 - protein, 9 aa, Homo Sapiens
CYETKGERD

SEQ ID NO: 313438 - protein, 9 aa, Homo Sapiens
FSSPACLAA

SEQ ID NO: 313439 - protein, 9 aa, Homo Sapiens
DHVRQQCKD

SEQ ID NO: 313440 - protein, 9 aa, Homo Sapiens
LRLLGSSYL

SEQ ID NO: 313441 - protein, 9 aa, Homo Sapiens
ARMSIKYDP

SEQ ID NO: 313442 - protein, 9 aa, Homo Sapiens
ESRGSGPKP

SEQ ID NO: 313443 - protein, 9 aa, Homo Sapiens
AGLMVSMSI

SEQ ID NO: 313444 - protein, 9 aa, Homo Sapiens
WIIHTGEKL

SEQ ID NO: 313445 - protein, 9 aa, Homo Sapiens
YISLGIPKG

SEQ ID NO: 313446 - protein, 9 aa, Homo Sapiens
LNLTELVDG

SEQ ID NO: 313447 - protein, 9 aa, Homo Sapiens
GQSYEIQML

SEQ ID NO: 313448 - protein, 9 aa, Homo Sapiens
YDICSMTLK

SEQ ID NO: 313449 - protein, 9 aa, Homo Sapiens
WSMEHLNHY

SEQ ID NO: 313450 - protein, 9 aa, Homo Sapiens
VQYISLGIP

SEQ ID NO: 313451 - protein, 9 aa, Homo Sapiens
EPLGLDNGN

SEQ ID NO: 313452 - protein, 9 aa, Homo Sapiens
SQEELQTSI

SEQ ID NO: 313453 - protein, 9 aa, Homo Sapiens
SQLFEMHDK

SEQ ID NO: 313454 - protein, 9 aa, Homo Sapiens
SNQQPQTIP

SEQ ID NO: 313455 - protein, 9 aa, Homo Sapiens
AKNTLFTWK

SEQ ID NO: 313456 - protein, 9 aa, Homo Sapiens
KKKFVQIEN

SEQ ID NO: 313457 - protein, 9 aa, Homo Sapiens
GTTNQQEAL

SEQ ID NO: 313458 - protein, 9 aa, Homo Sapiens
TRNERKRKN

SEQ ID NO: 313459 - protein, 9 aa, Homo Sapiens
ATTSDVNSS

SEQ ID NO: 313460 - protein, 9 aa, Homo Sapiens
IWGSSIKQL

SEQ ID NO: 313461 - protein, 9 aa, Homo Sapiens
TVLPIGLCS

SEQ ID NO: 313462 - protein, 9 aa, Homo Sapiens
CPFSTEDRD

SEQ ID NO: 313463 - protein, 9 aa, Homo Sapiens
FLNTKENVN

SEQ ID NO: 313464 - protein, 9 aa, Homo Sapiens
ISHSGDKPF

SEQ ID NO: 313465 - protein, 9 aa, Homo Sapiens
DHVFCQYLF

SEQ ID NO: 313466 - protein, 9 aa, Homo Sapiens
RITYLHTQK

SEQ ID NO: 313467 - protein, 9 aa, Homo Sapiens
NYKVVAMSF

SEQ ID NO: 313468 - protein, 9 aa, Homo Sapiens
NCEEIINLP

SEQ ID NO: 313469 - protein, 9 aa, Homo Sapiens
FIFKPDVIS

SEQ ID NO: 313470 - protein, 9 aa, Homo Sapiens
KEDWASEKD

SEQ ID NO: 313471 - protein, 9 aa, Homo Sapiens
AGTRRMKEK

SEQ ID NO: 313472 - protein, 9 aa, Homo Sapiens
YLMACAQTG

SEQ ID NO: 313473 - protein, 9 aa, Homo Sapiens
DLSIQCQAL

SEQ ID NO: 313474 - protein, 9 aa, Homo Sapiens
HLSTDDHSN

SEQ ID NO: 313475 - protein, 9 aa, Homo Sapiens
KEMEKTLRQ

SEQ ID NO: 313476 - protein, 9 aa, Homo Sapiens
KQNPGLKIP

SEQ ID NO: 313477 - protein, 9 aa, Homo Sapiens
KDVFWDVLQ

SEQ ID NO: 313478 - protein, 9 aa, Homo Sapiens
KLEVELLKF

SEQ ID NO: 313479 - protein, 9 aa, Homo Sapiens
WNFFIALSY

SEQ ID NO: 313480 - protein, 9 aa, Homo Sapiens
TEIHGLKEP

SEQ ID NO: 313481 - protein, 9 aa, Homo Sapiens
KTLKWGLYI

SEQ ID NO: 313482 - protein, 9 aa, Homo Sapiens
PNIFHKDPN

SEQ ID NO: 313483 - protein, 9 aa, Homo Sapiens
IKSIIKIPH

SEQ ID NO: 313484 - protein, 9 aa, Homo Sapiens
KAFCKNYSL

SEQ ID NO: 313485 - protein, 9 aa, Homo Sapiens
RVDQIRGNM

SEQ ID NO: 313486 - protein, 9 aa, Homo Sapiens
RQDQEVAGR

SEQ ID NO: 313487 - protein, 9 aa, Homo Sapiens
LGPRETEPE

SEQ ID NO: 313488 - protein, 9 aa, Homo Sapiens
QLVNGIHLY

SEQ ID NO: 313489 - protein, 9 aa, Homo Sapiens
VRTRGSTVM

SEQ ID NO: 313490 - protein, 9 aa, Homo Sapiens
NKQNISQLE

SEQ ID NO: 313491 - protein, 9 aa, Homo Sapiens
QKEVEHNSG

SEQ ID NO: 313492 - protein, 9 aa, Homo Sapiens
LNKGDFYQE

SEQ ID NO: 313493 - protein, 9 aa, Homo Sapiens
DSWLALIKR

SEQ ID NO: 313494 - protein, 9 aa, Homo Sapiens
YEAHDENTV

SEQ ID NO: 313495 - protein, 9 aa, Homo Sapiens
CALYESVFG

SEQ ID NO: 313496 - protein, 9 aa, Homo Sapiens
CLNDDQRDV

SEQ ID NO: 313497 - protein, 9 aa, Homo Sapiens
DDQRDVYRD

SEQ ID NO: 313498 - protein, 9 aa, Homo Sapiens
YNGFFECER

SEQ ID NO: 313499 - protein, 9 aa, Homo Sapiens
QNRRHPQIN

SEQ ID NO: 313500 - protein, 9 aa, Homo Sapiens
LIKVTLHML

SEQ ID NO: 313501 - protein, 9 aa, Homo Sapiens
QTFLSEIQW

SEQ ID NO: 313502 - protein, 9 aa, Homo Sapiens
LFCITNILL

SEQ ID NO: 313503 - protein, 9 aa, Homo Sapiens
KLTMAQLKM

SEQ ID NO: 313504 - protein, 9 aa, Homo Sapiens
QKTSATINC

SEQ ID NO: 313505 - protein, 9 aa, Homo Sapiens
LQFSVGYTF

SEQ ID NO: 313506 - protein, 9 aa, Homo Sapiens
VNEPPVIQP

SEQ ID NO: 313507 - protein, 9 aa, Homo Sapiens
ESQIKCGIW

SEQ ID NO: 313508 - protein, 9 aa, Homo Sapiens
VIDQDTANI

SEQ ID NO: 313509 - protein, 9 aa, Homo Sapiens
EEEDDDYVK

SEQ ID NO: 313510 - protein, 9 aa, Homo Sapiens
TPEGLFRGL

SEQ ID NO: 313511 - protein, 9 aa, Homo Sapiens
EQSRQSAHC

SEQ ID NO: 313512 - protein, 9 aa, Homo Sapiens
PGFGEHFIA

SEQ ID NO: 313513 - protein, 9 aa, Homo Sapiens
DVKYMLSRD

SEQ ID NO: 313514 - protein, 9 aa, Homo Sapiens
GFACELLSD

SEQ ID NO: 313515 - protein, 9 aa, Homo Sapiens
MGVSSQKIY

SEQ ID NO: 313516 - protein, 9 aa, Homo Sapiens
IILLLSTSI

SEQ ID NO: 313517 - protein, 9 aa, Homo Sapiens
HVIQASSFT

SEQ ID NO: 313518 - protein, 9 aa, Homo Sapiens
SNLTNHKNI

SEQ ID NO: 313519 - protein, 9 aa, Homo Sapiens
CETHDLKES

SEQ ID NO: 313520 - protein, 9 aa, Homo Sapiens
TGESAPVLM

SEQ ID NO: 313521 - protein, 9 aa, Homo Sapiens
WKFAQTKLW

SEQ ID NO: 313522 - protein, 9 aa, Homo Sapiens
GKNVPKYQC

SEQ ID NO: 313523 - protein, 9 aa, Homo Sapiens
ANKINYFEL

SEQ ID NO: 313524 - protein, 9 aa, Homo Sapiens
LMTIHLLGK

SEQ ID NO: 313525 - protein, 9 aa, Homo Sapiens
PPKKRRIKI

SEQ ID NO: 313526 - protein, 9 aa, Homo Sapiens
MPSVSSYFL

SEQ ID NO: 313527 - protein, 9 aa, Homo Sapiens
GDKPWREEN

SEQ ID NO: 313528 - protein, 9 aa, Homo Sapiens
LLISMLLVK

SEQ ID NO: 313529 - protein, 9 aa, Homo Sapiens
MQTKEPVKK

SEQ ID NO: 313530 - protein, 9 aa, Homo Sapiens
QKTRQLEKH

SEQ ID NO: 313531 - protein, 9 aa, Homo Sapiens
QNYVILEKL

SEQ ID NO: 313532 - protein, 9 aa, Homo Sapiens
SLSAGPAII

SEQ ID NO: 313533 - protein, 9 aa, Homo Sapiens
TKKHIQLKK

SEQ ID NO: 313534 - protein, 9 aa, Homo Sapiens
RGDKITRIE

SEQ ID NO: 313535 - protein, 9 aa, Homo Sapiens
KECGKAFHN

SEQ ID NO: 313536 - protein, 9 aa, Homo Sapiens
VSDNSSRRV

SEQ ID NO: 313537 - protein, 9 aa, Homo Sapiens
HDAVTDTVD

SEQ ID NO: 313538 - protein, 9 aa, Homo Sapiens
HPQINFILG

SEQ ID NO: 313539 - protein, 9 aa, Homo Sapiens
LLWTACKTK

SEQ ID NO: 313540 - protein, 9 aa, Homo Sapiens
AHRAEVRKV

SEQ ID NO: 313541 - protein, 9 aa, Homo Sapiens
QLFRELPEP

SEQ ID NO: 313542 - protein, 9 aa, Homo Sapiens
PNPNHDTLR

SEQ ID NO: 313543 - protein, 9 aa, Homo Sapiens
TGMRKPAQY

SEQ ID NO: 313544 - protein, 9 aa, Homo Sapiens
LCEQQHRRW

SEQ ID NO: 313545 - protein, 9 aa, Homo Sapiens
MSVTGVHMN

SEQ ID NO: 313546 - protein, 9 aa, Homo Sapiens
IAALLQEYL

SEQ ID NO: 313547 - protein, 9 aa, Homo Sapiens
LMYTIASAI

SEQ ID NO: 313548 - protein, 9 aa, Homo Sapiens
TVNKCAVMK

SEQ ID NO: 313549 - protein, 9 aa, Homo Sapiens
FFSHHKITH

SEQ ID NO: 313550 - protein, 9 aa, Homo Sapiens
MLKMFMSLL

SEQ ID NO: 313551 - protein, 9 aa, Homo Sapiens
ATAAGSAMK

SEQ ID NO: 313552 - protein, 9 aa, Homo Sapiens
PNSPVLLEY

SEQ ID NO: 313553 - protein, 9 aa, Homo Sapiens
AIYEKITAC

SEQ ID NO: 313554 - protein, 9 aa, Homo Sapiens
ENKLSCKIS

SEQ ID NO: 313555 - protein, 9 aa, Homo Sapiens
YMCWASLNH

SEQ ID NO: 313556 - protein, 9 aa, Homo Sapiens
QEPCYHEIM

SEQ ID NO: 313557 - protein, 9 aa, Homo Sapiens
STTAVSDKK

SEQ ID NO: 313558 - protein, 9 aa, Homo Sapiens
NIREGHYPK

SEQ ID NO: 313559 - protein, 9 aa, Homo Sapiens
LCQEYTDLQ

SEQ ID NO: 313560 - protein, 9 aa, Homo Sapiens
QTLSLSKKE

SEQ ID NO: 313561 - protein, 9 aa, Homo Sapiens
SHLSEKMVS

SEQ ID NO: 313562 - protein, 9 aa, Homo Sapiens
AYLALHHHT

SEQ ID NO: 313563 - protein, 9 aa, Homo Sapiens
GGECNNTVG

SEQ ID NO: 313564 - protein, 9 aa, Homo Sapiens
PTFVMWEVG

SEQ ID NO: 313565 - protein, 9 aa, Homo Sapiens
QMRSQSESC

SEQ ID NO: 313566 - protein, 9 aa, Homo Sapiens
VKKVYVCNM

SEQ ID NO: 313567 - protein, 9 aa, Homo Sapiens
ADRAIAFSI

SEQ ID NO: 313568 - protein, 9 aa, Homo Sapiens
TAKLCLSCL

SEQ ID NO: 313569 - protein, 9 aa, Homo Sapiens
MLRDIERGS

SEQ ID NO: 313570 - protein, 9 aa, Homo Sapiens
TALFSATAD

SEQ ID NO: 313571 - protein, 9 aa, Homo Sapiens
SENYFLIFK

SEQ ID NO: 313572 - protein, 9 aa, Homo Sapiens
EFFTKLFEK

SEQ ID NO: 313573 - protein, 9 aa, Homo Sapiens
LSHAFQKEL

SEQ ID NO: 313574 - protein, 9 aa, Homo Sapiens
RVLWVLRPL

SEQ ID NO: 313575 - protein, 9 aa, Homo Sapiens
NFHNISNIC

SEQ ID NO: 313576 - protein, 9 aa, Homo Sapiens
QVLMHDVAY

SEQ ID NO: 313577 - protein, 9 aa, Homo Sapiens
FLINKETQP

SEQ ID NO: 313578 - protein, 9 aa, Homo Sapiens
VTGTLPSVE

SEQ ID NO: 313579 - protein, 9 aa, Homo Sapiens
ILRLPCTVA

SEQ ID NO: 313580 - protein, 9 aa, Homo Sapiens
YVAKHRLVV

SEQ ID NO: 313581 - protein, 9 aa, Homo Sapiens
IQGHKQQLI

SEQ ID NO: 313582 - protein, 9 aa, Homo Sapiens
MDVHKVNIT

SEQ ID NO: 313583 - protein, 9 aa, Homo Sapiens
NNGGPSIIP

SEQ ID NO: 313584 - protein, 9 aa, Homo Sapiens
GNYDEMKDV

SEQ ID NO: 313585 - protein, 9 aa, Homo Sapiens
QLFSLNSKS

SEQ ID NO: 313586 - protein, 9 aa, Homo Sapiens
QCALSTSPL

SEQ ID NO: 313587 - protein, 9 aa, Homo Sapiens
PHTPSPPPP

SEQ ID NO: 313588 - protein, 9 aa, Homo Sapiens
GSVKYGKQK

SEQ ID NO: 313589 - protein, 9 aa, Homo Sapiens
HELTFYKEF

SEQ ID NO: 313590 - protein, 9 aa, Homo Sapiens
HITNKRNGG

SEQ ID NO: 313591 - protein, 9 aa, Homo Sapiens
FQIELSNNY

SEQ ID NO: 313592 - protein, 9 aa, Homo Sapiens
LKTIEALSG

SEQ ID NO: 313593 - protein, 9 aa, Homo Sapiens
DARTMYQVL

SEQ ID NO: 313594 - protein, 9 aa, Homo Sapiens
LNNRIELKT

SEQ ID NO: 313595 - protein, 9 aa, Homo Sapiens
DVRTRGSTV

SEQ ID NO: 313596 - protein, 9 aa, Homo Sapiens
TLEVGDYTL

SEQ ID NO: 313597 - protein, 9 aa, Homo Sapiens
PAAHNRFLY

SEQ ID NO: 313598 - protein, 9 aa, Homo Sapiens
PQIKKDEKQ

SEQ ID NO: 313599 - protein, 9 aa, Homo Sapiens
EEERLQNQE

SEQ ID NO: 313600 - protein, 9 aa, Homo Sapiens
NTCFDIEKL

SEQ ID NO: 313601 - protein, 9 aa, Homo Sapiens
VSLGCFIFK

SEQ ID NO: 313602 - protein, 9 aa, Homo Sapiens
EVGDYTLTP

SEQ ID NO: 313603 - protein, 9 aa, Homo Sapiens
SSCQPAGCT

SEQ ID NO: 313604 - protein, 9 aa, Homo Sapiens
KIIVEAQVN

SEQ ID NO: 313605 - protein, 9 aa, Homo Sapiens
QSLVLAENS

SEQ ID NO: 313606 - protein, 9 aa, Homo Sapiens
EEQPSTYTE

SEQ ID NO: 313607 - protein, 9 aa, Homo Sapiens
SDVIEGGLL

SEQ ID NO: 313608 - protein, 9 aa, Homo Sapiens
GEDFPPPSP

SEQ ID NO: 313609 - protein, 9 aa, Homo Sapiens
ESTASHNSP

SEQ ID NO: 313610 - protein, 9 aa, Homo Sapiens
LLDPSDLDV

SEQ ID NO: 313611 - protein, 9 aa, Homo Sapiens
GKKNEKSIK

SEQ ID NO: 313612 - protein, 9 aa, Homo Sapiens
EHVRGMQDK

SEQ ID NO: 313613 - protein, 9 aa, Homo Sapiens
SVKGYKEQK

SEQ ID NO: 313614 - protein, 9 aa, Homo Sapiens
FCFVTYSCV

SEQ ID NO: 313615 - protein, 9 aa, Homo Sapiens
YIVSVIDMP

SEQ ID NO: 313616 - protein, 9 aa, Homo Sapiens
KNRISKKKT

SEQ ID NO: 313617 - protein, 9 aa, Homo Sapiens
FVHWCVGEG

SEQ ID NO: 313618 - protein, 9 aa, Homo Sapiens
IKYSEVQIK

SEQ ID NO: 313619 - protein, 9 aa, Homo Sapiens
TEMPTDTFI

SEQ ID NO: 313620 - protein, 9 aa, Homo Sapiens
RHQSIHTGK

SEQ ID NO: 313621 - protein, 9 aa, Homo Sapiens
PTYNIRRII

SEQ ID NO: 313622 - protein, 9 aa, Homo Sapiens
LHYLAKSLC

SEQ ID NO: 313623 - protein, 9 aa, Homo Sapiens
ASDRFLYVN

SEQ ID NO: 313624 - protein, 9 aa, Homo Sapiens
AELVSAMEE

SEQ ID NO: 313625 - protein, 9 aa, Homo Sapiens
EEQEEYKNY

SEQ ID NO: 313626 - protein, 9 aa, Homo Sapiens
ERVLEACVL

SEQ ID NO: 313627 - protein, 9 aa, Homo Sapiens
PHSIYKTKF

SEQ ID NO: 313628 - protein, 9 aa, Homo Sapiens
WRKLAPSQI

SEQ ID NO: 313629 - protein, 9 aa, Homo Sapiens
AVSSRGDNL

SEQ ID NO: 313630 - protein, 9 aa, Homo Sapiens
GIVTLDEFI

SEQ ID NO: 313631 - protein, 9 aa, Homo Sapiens
CRVTAPHPA

SEQ ID NO: 313632 - protein, 9 aa, Homo Sapiens
EATCPHFLK

SEQ ID NO: 313633 - protein, 9 aa, Homo Sapiens
QIKKDEKQN

SEQ ID NO: 313634 - protein, 9 aa, Homo Sapiens
PQLQMASPE

SEQ ID NO: 313635 - protein, 9 aa, Homo Sapiens
HTKHKKEKK

SEQ ID NO: 313636 - protein, 9 aa, Homo Sapiens
SHRRPGDCF

SEQ ID NO: 313637 - protein, 9 aa, Homo Sapiens
SYHDMEYTI

SEQ ID NO: 313638 - protein, 9 aa, Homo Sapiens
LEGNECISP

SEQ ID NO: 313639 - protein, 9 aa, Homo Sapiens
PGSEVLCIQ

SEQ ID NO: 313640 - protein, 9 aa, Homo Sapiens
MLSEKFMSL

SEQ ID NO: 313641 - protein, 9 aa, Homo Sapiens
NKKHKKKRL

SEQ ID NO: 313642 - protein, 9 aa, Homo Sapiens
GGQAEKHRK

SEQ ID NO: 313643 - protein, 9 aa, Homo Sapiens
NKRNGGGSL

SEQ ID NO: 313644 - protein, 9 aa, Homo Sapiens
SQAKAVITT

SEQ ID NO: 313645 - protein, 9 aa, Homo Sapiens
IMAYDHYLA

SEQ ID NO: 313646 - protein, 9 aa, Homo Sapiens
HTELLPQGS

SEQ ID NO: 313647 - protein, 9 aa, Homo Sapiens
IFWGEHFEL

SEQ ID NO: 313648 - protein, 9 aa, Homo Sapiens
EIRNKVKKE

SEQ ID NO: 313649 - protein, 9 aa, Homo Sapiens
YAVSKAGPY

SEQ ID NO: 313650 - protein, 9 aa, Homo Sapiens
CDLSSFELF

SEQ ID NO: 313651 - protein, 9 aa, Homo Sapiens
WELDGRQLF

SEQ ID NO: 313652 - protein, 9 aa, Homo Sapiens
DKKSSSKDS

SEQ ID NO: 313653 - protein, 9 aa, Homo Sapiens
QDTSFEGTD

SEQ ID NO: 313654 - protein, 9 aa, Homo Sapiens
RTREVMTTE

SEQ ID NO: 313655 - protein, 9 aa, Homo Sapiens
NVNDVDYDD

SEQ ID NO: 313656 - protein, 9 aa, Homo Sapiens
KQFQWLRAL

SEQ ID NO: 313657 - protein, 9 aa, Homo Sapiens
ENNLTLLNS

SEQ ID NO: 313658 - protein, 9 aa, Homo Sapiens
FVKEKNVVG

SEQ ID NO: 313659 - protein, 9 aa, Homo Sapiens
QHIQKRLIQ

SEQ ID NO: 313660 - protein, 9 aa, Homo Sapiens
STFNNYYSL

SEQ ID NO: 313661 - protein, 9 aa, Homo Sapiens
MHDLDHFDK

SEQ ID NO: 313662 - protein, 9 aa, Homo Sapiens
STDKDEPPN

SEQ ID NO: 313663 - protein, 9 aa, Homo Sapiens
CYDELFPVS

SEQ ID NO: 313664 - protein, 9 aa, Homo Sapiens
VGDYTLTPE

SEQ ID NO: 313665 - protein, 9 aa, Homo Sapiens
DVTLKNLSR

SEQ ID NO: 313666 - protein, 9 aa, Homo Sapiens
LLEKLLIPN

SEQ ID NO: 313667 - protein, 9 aa, Homo Sapiens
DNNAPILGS

SEQ ID NO: 313668 - protein, 9 aa, Homo Sapiens
DIQGNPKCR

SEQ ID NO: 313669 - protein, 9 aa, Homo Sapiens
TVSRFVPSF

SEQ ID NO: 313670 - protein, 9 aa, Homo Sapiens
ILELRIKLA

SEQ ID NO: 313671 - protein, 9 aa, Homo Sapiens
SSNLVRHQQ

SEQ ID NO: 313672 - protein, 9 aa, Homo Sapiens
DKVHQDTYR

SEQ ID NO: 313673 - protein, 9 aa, Homo Sapiens
LKNLSRQID

SEQ ID NO: 313674 - protein, 9 aa, Homo Sapiens
VIEGGLLAS

SEQ ID NO: 313675 - protein, 9 aa, Homo Sapiens
DFDETSLIN

SEQ ID NO: 313676 - protein, 9 aa, Homo Sapiens
WSNNVEYTF

SEQ ID NO: 313677 - protein, 9 aa, Homo Sapiens
LLQNENGID

SEQ ID NO: 313678 - protein, 9 aa, Homo Sapiens
RTYKNVNRT

SEQ ID NO: 313679 - protein, 9 aa, Homo Sapiens
LFMYVQTKV

SEQ ID NO: 313680 - protein, 9 aa, Homo Sapiens
SLEKILTML

SEQ ID NO: 313681 - protein, 9 aa, Homo Sapiens
LSNPSIAQA

SEQ ID NO: 313682 - protein, 9 aa, Homo Sapiens
CSAMWVKKI

SEQ ID NO: 313683 - protein, 9 aa, Homo Sapiens
IQNYRFHTI

SEQ ID NO: 313684 - protein, 9 aa, Homo Sapiens
DARLMSWLQ

SEQ ID NO: 313685 - protein, 9 aa, Homo Sapiens
SLAPLDKVC

SEQ ID NO: 313686 - protein, 9 aa, Homo Sapiens
AMGKLHKKM

SEQ ID NO: 313687 - protein, 9 aa, Homo Sapiens
HQAYLTNEY

SEQ ID NO: 313688 - protein, 9 aa, Homo Sapiens
ELTDDSLTL

SEQ ID NO: 313689 - protein, 9 aa, Homo Sapiens
NKINYFELD

SEQ ID NO: 313690 - protein, 9 aa, Homo Sapiens
ELKKDHCEQ

SEQ ID NO: 313691 - protein, 9 aa, Homo Sapiens
ADMLIIRTN

SEQ ID NO: 313692 - protein, 9 aa, Homo Sapiens
VSASNADEA

SEQ ID NO: 313693 - protein, 9 aa, Homo Sapiens
HVSDLMTIH

SEQ ID NO: 313694 - protein, 9 aa, Homo Sapiens
PPILSLPLV

SEQ ID NO: 313695 - protein, 9 aa, Homo Sapiens
YNNLSDKTS

SEQ ID NO: 313696 - protein, 9 aa, Homo Sapiens
KVKYINDNP

SEQ ID NO: 313697 - protein, 9 aa, Homo Sapiens
PLYKKICSN

SEQ ID NO: 313698 - protein, 9 aa, Homo Sapiens
QKKLIGAKE

SEQ ID NO: 313699 - protein, 9 aa, Homo Sapiens
IRKIIYMFL

SEQ ID NO: 313700 - protein, 9 aa, Homo Sapiens
TLFFVFFFI

SEQ ID NO: 313701 - protein, 9 aa, Homo Sapiens
KSKILRLPC

SEQ ID NO: 313702 - protein, 9 aa, Homo Sapiens
KDTDGEEEE

SEQ ID NO: 313703 - protein, 9 aa, Homo Sapiens
HVSDKSEGP

SEQ ID NO: 313704 - protein, 9 aa, Homo Sapiens
DFLKQNTFS

SEQ ID NO: 313705 - protein, 9 aa, Homo Sapiens
TSDKPHTVK

SEQ ID NO: 313706 - protein, 9 aa, Homo Sapiens
LCSSDSPQW

SEQ ID NO: 313707 - protein, 9 aa, Homo Sapiens
FLSNPDSST

SEQ ID NO: 313708 - protein, 9 aa, Homo Sapiens
MMRPGVFAD

SEQ ID NO: 313709 - protein, 9 aa, Homo Sapiens
RQIILAVQK

SEQ ID NO: 313710 - protein, 9 aa, Homo Sapiens
MTNKRIAVI

SEQ ID NO: 313711 - protein, 9 aa, Homo Sapiens
DLFYQRSLA

SEQ ID NO: 313712 - protein, 9 aa, Homo Sapiens
ESNFIQINT

SEQ ID NO: 313713 - protein, 9 aa, Homo Sapiens
QIIYRKQEM

SEQ ID NO: 313714 - protein, 9 aa, Homo Sapiens
SIAGVAYGH

SEQ ID NO: 313715 - protein, 9 aa, Homo Sapiens
YQFIYMAVQ

SEQ ID NO: 313716 - protein, 9 aa, Homo Sapiens
KCLCGAACG

SEQ ID NO: 313717 - protein, 9 aa, Homo Sapiens
FKEGHKILS

SEQ ID NO: 313718 - protein, 9 aa, Homo Sapiens
QTGIWVFIF

SEQ ID NO: 313719 - protein, 9 aa, Homo Sapiens
AQAGWEMFW

SEQ ID NO: 313720 - protein, 9 aa, Homo Sapiens
DAPERQPQP

SEQ ID NO: 313721 - protein, 9 aa, Homo Sapiens
GYDKTPDLI

SEQ ID NO: 313722 - protein, 9 aa, Homo Sapiens
NRDFLAEKL

SEQ ID NO: 313723 - protein, 9 aa, Homo Sapiens
FHVQEIEVS

SEQ ID NO: 313724 - protein, 9 aa, Homo Sapiens
GQLKRVPQT

SEQ ID NO: 313725 - protein, 9 aa, Homo Sapiens
KRRMVLVQQ

SEQ ID NO: 313726 - protein, 9 aa, Homo Sapiens
IYQDTMYLQ

SEQ ID NO: 313727 - protein, 9 aa, Homo Sapiens
GDLQIMKQT

SEQ ID NO: 313728 - protein, 9 aa, Homo Sapiens
NTSTNKLLD

SEQ ID NO: 313729 - protein, 9 aa, Homo Sapiens
VTILYGTLI

SEQ ID NO: 313730 - protein, 9 aa, Homo Sapiens
GVRMEKIVE

SEQ ID NO: 313731 - protein, 9 aa, Homo Sapiens
TYLHSRQLV

SEQ ID NO: 313732 - protein, 9 aa, Homo Sapiens
QDPASAPRN

SEQ ID NO: 313733 - protein, 9 aa, Homo Sapiens
DEFFTKLFE

SEQ ID NO: 313734 - protein, 9 aa, Homo Sapiens
KEINTEDKP

SEQ ID NO: 313735 - protein, 9 aa, Homo Sapiens
NYICHMGHE

SEQ ID NO: 313736 - protein, 9 aa, Homo Sapiens
FECKECGKL

SEQ ID NO: 313737 - protein, 9 aa, Homo Sapiens
LNKLDKTIK

SEQ ID NO: 313738 - protein, 9 aa, Homo Sapiens
QQRHTAYIS

SEQ ID NO: 313739 - protein, 9 aa, Homo Sapiens
SYMTFLKKI

SEQ ID NO: 313740 - protein, 9 aa, Homo Sapiens
DTLTFKECV

SEQ ID NO: 313741 - protein, 9 aa, Homo Sapiens
KMFLLDPSD

SEQ ID NO: 313742 - protein, 9 aa, Homo Sapiens
NILTEPERK

SEQ ID NO: 313743 - protein, 9 aa, Homo Sapiens
RQINGYQIV

SEQ ID NO: 313744 - protein, 9 aa, Homo Sapiens
HTGKKSKNT

SEQ ID NO: 313745 - protein, 9 aa, Homo Sapiens
QGPNIYSFN

SEQ ID NO: 313746 - protein, 9 aa, Homo Sapiens
PDAHVIKRH

SEQ ID NO: 313747 - protein, 9 aa, Homo Sapiens
LYYEENKFY

SEQ ID NO: 313748 - protein, 9 aa, Homo Sapiens
IITSTGQPI

SEQ ID NO: 313749 - protein, 9 aa, Homo Sapiens
FLSERADLF

SEQ ID NO: 313750 - protein, 9 aa, Homo Sapiens
HQIIHTEDK

SEQ ID NO: 313751 - protein, 9 aa, Homo Sapiens
YHEIMTPEQ

SEQ ID NO: 313752 - protein, 9 aa, Homo Sapiens
ECKIEYDDL

SEQ ID NO: 313753 - protein, 9 aa, Homo Sapiens
WCPIMAHGF

SEQ ID NO: 313754 - protein, 9 aa, Homo Sapiens
CEGRDLNDK

SEQ ID NO: 313755 - protein, 9 aa, Homo Sapiens
ERNRVLSQW

SEQ ID NO: 313756 - protein, 9 aa, Homo Sapiens
YYAIKDGGL

SEQ ID NO: 313757 - protein, 9 aa, Homo Sapiens
PEMDDRESI

SEQ ID NO: 313758 - protein, 9 aa, Homo Sapiens
LPNKEMLEE

SEQ ID NO: 313759 - protein, 9 aa, Homo Sapiens
SQVATLSKI

SEQ ID NO: 313760 - protein, 9 aa, Homo Sapiens
HTPSPPPPI

SEQ ID NO: 313761 - protein, 9 aa, Homo Sapiens
LGLGSTKFD

SEQ ID NO: 313762 - protein, 9 aa, Homo Sapiens
NYGLKVHKR

SEQ ID NO: 313763 - protein, 9 aa, Homo Sapiens
LHSLGKAQT

SEQ ID NO: 313764 - protein, 9 aa, Homo Sapiens
AENNRLWGP

SEQ ID NO: 313765 - protein, 9 aa, Homo Sapiens
YIKQRKPKL

SEQ ID NO: 313766 - protein, 9 aa, Homo Sapiens
AVEIIAVLR

SEQ ID NO: 313767 - protein, 9 aa, Homo Sapiens
RIIQELQKR

SEQ ID NO: 313768 - protein, 9 aa, Homo Sapiens
ADFALRVPT

SEQ ID NO: 313769 - protein, 9 aa, Homo Sapiens
PVTRGVGAG

SEQ ID NO: 313770 - protein, 9 aa, Homo Sapiens
MSEKSIYNG

SEQ ID NO: 313771 - protein, 9 aa, Homo Sapiens
ASANGNSEA

SEQ ID NO: 313772 - protein, 9 aa, Homo Sapiens
YESCMSGAD

SEQ ID NO: 313773 - protein, 9 aa, Homo Sapiens
FVQIENAAE

SEQ ID NO: 313774 - protein, 9 aa, Homo Sapiens
SDLKKDKNE

SEQ ID NO: 313775 - protein, 9 aa, Homo Sapiens
SDLARDLSS

SEQ ID NO: 313776 - protein, 9 aa, Homo Sapiens
LIRNYEQHR

SEQ ID NO: 313777 - protein, 9 aa, Homo Sapiens
VSLLVLLTQ

SEQ ID NO: 313778 - protein, 9 aa, Homo Sapiens
VTTQKKKVD

SEQ ID NO: 313779 - protein, 9 aa, Homo Sapiens
PPDWSNNVE

SEQ ID NO: 313780 - protein, 9 aa, Homo Sapiens
SRQSAHCVQ

SEQ ID NO: 313781 - protein, 9 aa, Homo Sapiens
KIQDVKSIY

SEQ ID NO: 313782 - protein, 9 aa, Homo Sapiens
KAGETINDA

SEQ ID NO: 313783 - protein, 9 aa, Homo Sapiens
GLASSLINA

SEQ ID NO: 313784 - protein, 9 aa, Homo Sapiens
TLSRYYKWN

SEQ ID NO: 313785 - protein, 9 aa, Homo Sapiens
VITIEPSIY

SEQ ID NO: 313786 - protein, 9 aa, Homo Sapiens
NFSPLSGDI

SEQ ID NO: 313787 - protein, 9 aa, Homo Sapiens
PWVQQLILN

SEQ ID NO: 313788 - protein, 9 aa, Homo Sapiens
YSGIALFPW

SEQ ID NO: 313789 - protein, 9 aa, Homo Sapiens
SPFNIEPSS

SEQ ID NO: 313790 - protein, 9 aa, Homo Sapiens
EQSLKLDYL

SEQ ID NO: 313791 - protein, 9 aa, Homo Sapiens
DMHSEELLA

SEQ ID NO: 313792 - protein, 9 aa, Homo Sapiens
FENNEKTGI

SEQ ID NO: 313793 - protein, 9 aa, Homo Sapiens
DEMLTHNIA

SEQ ID NO: 313794 - protein, 9 aa, Homo Sapiens
NPTAFDYLN

SEQ ID NO: 313795 - protein, 9 aa, Homo Sapiens
DYTLTPEMC

SEQ ID NO: 313796 - protein, 9 aa, Homo Sapiens
QQQQQSPVN

SEQ ID NO: 313797 - protein, 9 aa, Homo Sapiens
QVMQIMSPD

SEQ ID NO: 313798 - protein, 9 aa, Homo Sapiens
VAGEDFPPP

SEQ ID NO: 313799 - protein, 9 aa, Homo Sapiens
KVHTAKESP

SEQ ID NO: 313800 - protein, 9 aa, Homo Sapiens
SVKIHLKVL

SEQ ID NO: 313801 - protein, 9 aa, Homo Sapiens
SINSCYPKE

SEQ ID NO: 313802 - protein, 9 aa, Homo Sapiens
QVATLSKIA

SEQ ID NO: 313803 - protein, 9 aa, Homo Sapiens
NPFLVSFFI

SEQ ID NO: 313804 - protein, 9 aa, Homo Sapiens
LEEDNHIKD

SEQ ID NO: 313805 - protein, 9 aa, Homo Sapiens
SSGKRQSKF

SEQ ID NO: 313806 - protein, 9 aa, Homo Sapiens
TKHKGQDGI

SEQ ID NO: 313807 - protein, 9 aa, Homo Sapiens
YPPLAQAIR

SEQ ID NO: 313808 - protein, 9 aa, Homo Sapiens
PSYQEHSNF

SEQ ID NO: 313809 - protein, 9 aa, Homo Sapiens
DKMKVNWCH

SEQ ID NO: 313810 - protein, 9 aa, Homo Sapiens
MITAIAVKV

SEQ ID NO: 313811 - protein, 9 aa, Homo Sapiens
LEAPEFPLS

SEQ ID NO: 313812 - protein, 9 aa, Homo Sapiens
KGKISQRIM

SEQ ID NO: 313813 - protein, 9 aa, Homo Sapiens
IRYFDLQIS

SEQ ID NO: 313814 - protein, 9 aa, Homo Sapiens
DLSVNDFTT

SEQ ID NO: 313815 - protein, 9 aa, Homo Sapiens
EEFGFFYLF

SEQ ID NO: 313816 - protein, 9 aa, Homo Sapiens
GYKDADYRL

SEQ ID NO: 313817 - protein, 9 aa, Homo Sapiens
FKTHGIRNG

SEQ ID NO: 313818 - protein, 9 aa, Homo Sapiens
LKALLRMKQ

SEQ ID NO: 313819 - protein, 9 aa, Homo Sapiens
NKDATAEII

SEQ ID NO: 313820 - protein, 9 aa, Homo Sapiens
SHDIGLHVL

SEQ ID NO: 313821 - protein, 9 aa, Homo Sapiens
SEPVIQVNY

SEQ ID NO: 313822 - protein, 9 aa, Homo Sapiens
MDLMVFTLR

SEQ ID NO: 313823 - protein, 9 aa, Homo Sapiens
LGLCLAEKY

SEQ ID NO: 313824 - protein, 9 aa, Homo Sapiens
RGFCFVTYS

SEQ ID NO: 313825 - protein, 9 aa, Homo Sapiens
LFRRGSNLN

SEQ ID NO: 313826 - protein, 9 aa, Homo Sapiens
QCNMCGKCF

SEQ ID NO: 313827 - protein, 9 aa, Homo Sapiens
MPVYSVGTT

SEQ ID NO: 313828 - protein, 9 aa, Homo Sapiens
DTSVKIHLK

SEQ ID NO: 313829 - protein, 9 aa, Homo Sapiens
PPACAVPGG

SEQ ID NO: 313830 - protein, 9 aa, Homo Sapiens
KEIVRYYSP

SEQ ID NO: 313831 - protein, 9 aa, Homo Sapiens
KATSILDFY

SEQ ID NO: 313832 - protein, 9 aa, Homo Sapiens
KHHDTFTNT

SEQ ID NO: 313833 - protein, 9 aa, Homo Sapiens
LTNIGLGVT

SEQ ID NO: 313834 - protein, 9 aa, Homo Sapiens
TERENFRST

SEQ ID NO: 313835 - protein, 9 aa, Homo Sapiens
RLRVNYCIL

SEQ ID NO: 313836 - protein, 9 aa, Homo Sapiens
MLLKNFLQY

SEQ ID NO: 313837 - protein, 9 aa, Homo Sapiens
ISFHGCMGQ

SEQ ID NO: 313838 - protein, 9 aa, Homo Sapiens
YNWSPQIQG

SEQ ID NO: 313839 - protein, 9 aa, Homo Sapiens
PGPGPSTFY

SEQ ID NO: 313840 - protein, 9 aa, Homo Sapiens
QFPLWESSK

SEQ ID NO: 313841 - protein, 9 aa, Homo Sapiens
FRDYIDLNA

SEQ ID NO: 313842 - protein, 9 aa, Homo Sapiens
HAIFISNYM

SEQ ID NO: 313843 - protein, 9 aa, Homo Sapiens
ILEILFTTV

SEQ ID NO: 313844 - protein, 9 aa, Homo Sapiens
EIYQDTMYL

SEQ ID NO: 313845 - protein, 9 aa, Homo Sapiens
VQPPGKMND

SEQ ID NO: 313846 - protein, 9 aa, Homo Sapiens
QGNSSGVFR

SEQ ID NO: 313847 - protein, 9 aa, Homo Sapiens
NCDGKSLLD

SEQ ID NO: 313848 - protein, 9 aa, Homo Sapiens
GLLVRQEAH

SEQ ID NO: 313849 - protein, 9 aa, Homo Sapiens
QFCLLLNVQ

SEQ ID NO: 313850 - protein, 9 aa, Homo Sapiens
TIYSAERFL

SEQ ID NO: 313851 - protein, 9 aa, Homo Sapiens
DSKITWILK

SEQ ID NO: 313852 - protein, 9 aa, Homo Sapiens
AVCKLKNAM

SEQ ID NO: 313853 - protein, 9 aa, Homo Sapiens
LAHEILCLE

SEQ ID NO: 313854 - protein, 9 aa, Homo Sapiens
IMWGYLIIH

SEQ ID NO: 313855 - protein, 9 aa, Homo Sapiens
GFTNFIVHA

SEQ ID NO: 313856 - protein, 9 aa, Homo Sapiens
SIEIVATRV

SEQ ID NO: 313857 - protein, 9 aa, Homo Sapiens
SPQRKYALK

SEQ ID NO: 313858 - protein, 9 aa, Homo Sapiens
EKEHQRITD

SEQ ID NO: 313859 - protein, 9 aa, Homo Sapiens
LYNPYGPQT

SEQ ID NO: 313860 - protein, 9 aa, Homo Sapiens
WPELIESAM

SEQ ID NO: 313861 - protein, 9 aa, Homo Sapiens
LVTPDQPII

SEQ ID NO: 313862 - protein, 9 aa, Homo Sapiens
EEYKTGINK

SEQ ID NO: 313863 - protein, 9 aa, Homo Sapiens
YRQQAADLL

SEQ ID NO: 313864 - protein, 9 aa, Homo Sapiens
YCIDQLPIK

SEQ ID NO: 313865 - protein, 9 aa, Homo Sapiens
YAYYLKNQI

SEQ ID NO: 313866 - protein, 9 aa, Homo Sapiens
CPRKCVVLL

SEQ ID NO: 313867 - protein, 9 aa, Homo Sapiens
KSSSAAWDE

SEQ ID NO: 313868 - protein, 9 aa, Homo Sapiens
PNPEIPLGE

SEQ ID NO: 313869 - protein, 9 aa, Homo Sapiens
GADPDSIEI

SEQ ID NO: 313870 - protein, 9 aa, Homo Sapiens
DQPNSSSLK

SEQ ID NO: 313871 - protein, 9 aa, Homo Sapiens
SQSSHGGGW

SEQ ID NO: 313872 - protein, 9 aa, Homo Sapiens
SLIKKIQDV

SEQ ID NO: 313873 - protein, 9 aa, Homo Sapiens
PHPQRITCT

SEQ ID NO: 313874 - protein, 9 aa, Homo Sapiens
VDKTPIETL

SEQ ID NO: 313875 - protein, 9 aa, Homo Sapiens
EKLLIPNAS

SEQ ID NO: 313876 - protein, 9 aa, Homo Sapiens
EHFHFYKRY

SEQ ID NO: 313877 - protein, 9 aa, Homo Sapiens
DRDGERGPP

SEQ ID NO: 313878 - protein, 9 aa, Homo Sapiens
KAFTLSSTL

SEQ ID NO: 313879 - protein, 9 aa, Homo Sapiens
VGLGPRTSR

SEQ ID NO: 313880 - protein, 9 aa, Homo Sapiens
VFTFEQLLA

SEQ ID NO: 313881 - protein, 9 aa, Homo Sapiens
MVHAQLCFH

SEQ ID NO: 313882 - protein, 9 aa, Homo Sapiens
DNKIIRRVR

SEQ ID NO: 313883 - protein, 9 aa, Homo Sapiens
TFFTSQVKQ

SEQ ID NO: 313884 - protein, 9 aa, Homo Sapiens
LGKCRGQAA

SEQ ID NO: 313885 - protein, 9 aa, Homo Sapiens
SKLKKPRWI

SEQ ID NO: 313886 - protein, 9 aa, Homo Sapiens
YMNRTVTTK

SEQ ID NO: 313887 - protein, 9 aa, Homo Sapiens
AISFWGCIT

SEQ ID NO: 313888 - protein, 9 aa, Homo Sapiens
RGMKNGVGR

SEQ ID NO: 313889 - protein, 9 aa, Homo Sapiens
KLPDLERVT

SEQ ID NO: 313890 - protein, 9 aa, Homo Sapiens
RIPQIEDAD

SEQ ID NO: 313891 - protein, 9 aa, Homo Sapiens
FVRLVDKTP

SEQ ID NO: 313892 - protein, 9 aa, Homo Sapiens
PCKRTACQS

SEQ ID NO: 313893 - protein, 9 aa, Homo Sapiens
PKLQPHLGL

SEQ ID NO: 313894 - protein, 9 aa, Homo Sapiens
EHAVVISLS

SEQ ID NO: 313895 - protein, 9 aa, Homo Sapiens
EACNEVPPA

SEQ ID NO: 313896 - protein, 9 aa, Homo Sapiens
KIGGIGALE

SEQ ID NO: 313897 - protein, 9 aa, Homo Sapiens
VPDNTERFD

SEQ ID NO: 313898 - protein, 9 aa, Homo Sapiens
NYTFICQEK

SEQ ID NO: 313899 - protein, 9 aa, Homo Sapiens
EGKQKIIPQ

SEQ ID NO: 313900 - protein, 9 aa, Homo Sapiens
GGLICRTCN

SEQ ID NO: 313901 - protein, 9 aa, Homo Sapiens
LETLKRENN

SEQ ID NO: 313902 - protein, 9 aa, Homo Sapiens
HHVGRVALH

SEQ ID NO: 313903 - protein, 9 aa, Homo Sapiens
DLCNKLIAY

SEQ ID NO: 313904 - protein, 9 aa, Homo Sapiens
KNTGGVLGD

SEQ ID NO: 313905 - protein, 9 aa, Homo Sapiens
AEAYIHRAS

SEQ ID NO: 313906 - protein, 9 aa, Homo Sapiens
HSKHLKTHS

SEQ ID NO: 313907 - protein, 9 aa, Homo Sapiens
TTSTFKPMV

SEQ ID NO: 313908 - protein, 9 aa, Homo Sapiens
VVKNLLFTA

SEQ ID NO: 313909 - protein, 9 aa, Homo Sapiens
QSSETCLSQ

SEQ ID NO: 313910 - protein, 9 aa, Homo Sapiens
DTIPPTVGD

SEQ ID NO: 313911 - protein, 9 aa, Homo Sapiens
MALNTTKTQ

SEQ ID NO: 313912 - protein, 9 aa, Homo Sapiens
ATKLWGIRV

SEQ ID NO: 313913 - protein, 9 aa, Homo Sapiens
KLDRHKNPD

SEQ ID NO: 313914 - protein, 9 aa, Homo Sapiens
GDKILEKFR

SEQ ID NO: 313915 - protein, 9 aa, Homo Sapiens
FLEIIQSSI

SEQ ID NO: 313916 - protein, 9 aa, Homo Sapiens
WTACKTKER

SEQ ID NO: 313917 - protein, 9 aa, Homo Sapiens
EGRLRDKLF

SEQ ID NO: 313918 - protein, 9 aa, Homo Sapiens
NGQIILWDP

SEQ ID NO: 313919 - protein, 9 aa, Homo Sapiens
RPEDVSPFN

SEQ ID NO: 313920 - protein, 9 aa, Homo Sapiens
DKEAIVTSV

SEQ ID NO: 313921 - protein, 9 aa, Homo Sapiens
QYGFALFTD

SEQ ID NO: 313922 - protein, 9 aa, Homo Sapiens
TYADARWWG

SEQ ID NO: 313923 - protein, 9 aa, Homo Sapiens
HKQKSLQFN

SEQ ID NO: 313924 - protein, 9 aa, Homo Sapiens
ASTSVDLTN

SEQ ID NO: 313925 - protein, 9 aa, Homo Sapiens
RRDVIKSII

SEQ ID NO: 313926 - protein, 9 aa, Homo Sapiens
IEVINKFAC

SEQ ID NO: 313927 - protein, 9 aa, Homo Sapiens
KMKKYLEEE

SEQ ID NO: 313928 - protein, 9 aa, Homo Sapiens
LVTPQDHEI

SEQ ID NO: 313929 - protein, 9 aa, Homo Sapiens
TQHQITHTG

SEQ ID NO: 313930 - protein, 9 aa, Homo Sapiens
PTPTTRSAG

SEQ ID NO: 313931 - protein, 9 aa, Homo Sapiens
ILTEWKQKY

SEQ ID NO: 313932 - protein, 9 aa, Homo Sapiens
ECKDLIKYM

SEQ ID NO: 313933 - protein, 9 aa, Homo Sapiens
RVNTRARHH

SEQ ID NO: 313934 - protein, 9 aa, Homo Sapiens
TELQVWDLE

SEQ ID NO: 313935 - protein, 9 aa, Homo Sapiens
HLSADMAKS

SEQ ID NO: 313936 - protein, 9 aa, Homo Sapiens
ILRLLGSSY

SEQ ID NO: 313937 - protein, 9 aa, Homo Sapiens
MEDGSIQIE

SEQ ID NO: 313938 - protein, 9 aa, Homo Sapiens
FLICVKSWN

SEQ ID NO: 313939 - protein, 9 aa, Homo Sapiens
ITSWYNGVR

SEQ ID NO: 313940 - protein, 9 aa, Homo Sapiens
EETIECNEI

SEQ ID NO: 313941 - protein, 9 aa, Homo Sapiens
LKHANVVTL

SEQ ID NO: 313942 - protein, 9 aa, Homo Sapiens
SPSLCQRHE

SEQ ID NO: 313943 - protein, 9 aa, Homo Sapiens
PIAGTLFFT

SEQ ID NO: 313944 - protein, 9 aa, Homo Sapiens
EKSNNQLNK

SEQ ID NO: 313945 - protein, 9 aa, Homo Sapiens
WGQRRNMPL

SEQ ID NO: 313946 - protein, 9 aa, Homo Sapiens
STQKNLNNS

SEQ ID NO: 313947 - protein, 9 aa, Homo Sapiens
ARGEAGGSQ

SEQ ID NO: 313948 - protein, 9 aa, Homo Sapiens
FVLPCFGLG

SEQ ID NO: 313949 - protein, 9 aa, Homo Sapiens
LQELICTGS

SEQ ID NO: 313950 - protein, 9 aa, Homo Sapiens
DVFWDVLQK

SEQ ID NO: 313951 - protein, 9 aa, Homo Sapiens
YRLSYLTKH

SEQ ID NO: 313952 - protein, 9 aa, Homo Sapiens
VRVNGTLYY

SEQ ID NO: 313953 - protein, 9 aa, Homo Sapiens
NRYWGTLGS

SEQ ID NO: 313954 - protein, 9 aa, Homo Sapiens
QTIPLNGQL

SEQ ID NO: 313955 - protein, 9 aa, Homo Sapiens
FIIIHWAAV

SEQ ID NO: 313956 - protein, 9 aa, Homo Sapiens
HGHQHFRPK

SEQ ID NO: 313957 - protein, 9 aa, Homo Sapiens
DMQQMEIVL

SEQ ID NO: 313958 - protein, 9 aa, Homo Sapiens
ENENKSKKL

SEQ ID NO: 313959 - protein, 9 aa, Homo Sapiens
ADSSYFEIF

SEQ ID NO: 313960 - protein, 9 aa, Homo Sapiens
INYLDESTQ

SEQ ID NO: 313961 - protein, 9 aa, Homo Sapiens
QDGTSYQRL

SEQ ID NO: 313962 - protein, 9 aa, Homo Sapiens
RTRGSTVMF

SEQ ID NO: 313963 - protein, 9 aa, Homo Sapiens
RQEHQNRVF

SEQ ID NO: 313964 - protein, 9 aa, Homo Sapiens
IILKSSEKK

SEQ ID NO: 313965 - protein, 9 aa, Homo Sapiens
FEAEQEIIR

SEQ ID NO: 313966 - protein, 9 aa, Homo Sapiens
LRDKLFSGY

SEQ ID NO: 313967 - protein, 9 aa, Homo Sapiens
NYATHLKDK

SEQ ID NO: 313968 - protein, 9 aa, Homo Sapiens
VPLAMASSI

SEQ ID NO: 313969 - protein, 9 aa, Homo Sapiens
TDTPNALLW

SEQ ID NO: 313970 - protein, 9 aa, Homo Sapiens
PLNKLDLVA

SEQ ID NO: 313971 - protein, 9 aa, Homo Sapiens
DKDRERERE

SEQ ID NO: 313972 - protein, 9 aa, Homo Sapiens
ICKEIMRPV

SEQ ID NO: 313973 - protein, 9 aa, Homo Sapiens
SPTFVMWEV

SEQ ID NO: 313974 - protein, 9 aa, Homo Sapiens
IAVTPLKLA

SEQ ID NO: 313975 - protein, 9 aa, Homo Sapiens
LKKRNPEVQ

SEQ ID NO: 313976 - protein, 9 aa, Homo Sapiens
QPPGKMNDR

SEQ ID NO: 313977 - protein, 9 aa, Homo Sapiens
KGALNKVVG

SEQ ID NO: 313978 - protein, 9 aa, Homo Sapiens
PETSQETRL

SEQ ID NO: 313979 - protein, 9 aa, Homo Sapiens
MWGYLIIHM

SEQ ID NO: 313980 - protein, 9 aa, Homo Sapiens
SSQLEEIKL

SEQ ID NO: 313981 - protein, 9 aa, Homo Sapiens
NGLEFNCKT

SEQ ID NO: 313982 - protein, 9 aa, Homo Sapiens
RELEEREEN

SEQ ID NO: 313983 - protein, 9 aa, Homo Sapiens
IIKKIVQKK

SEQ ID NO: 313984 - protein, 9 aa, Homo Sapiens
ETEPEGGSG

SEQ ID NO: 313985 - protein, 9 aa, Homo Sapiens
RYQKPDEYD

SEQ ID NO: 313986 - protein, 9 aa, Homo Sapiens
QMIDDMLLR

SEQ ID NO: 313987 - protein, 9 aa, Homo Sapiens
LDQIIYHIL

SEQ ID NO: 313988 - protein, 9 aa, Homo Sapiens
HVKGLFDEK

SEQ ID NO: 313989 - protein, 9 aa, Homo Sapiens
YVLTIYDIG

SEQ ID NO: 313990 - protein, 9 aa, Homo Sapiens
REGHYPKPA

SEQ ID NO: 313991 - protein, 9 aa, Homo Sapiens
NHKMMNEKA

SEQ ID NO: 313992 - protein, 9 aa, Homo Sapiens
TLQSKEYSQ

SEQ ID NO: 313993 - protein, 9 aa, Homo Sapiens
NMKKLFRRV

SEQ ID NO: 313994 - protein, 9 aa, Homo Sapiens
GPLGLLYEY

SEQ ID NO: 313995 - protein, 9 aa, Homo Sapiens
HTVRRTTKL

SEQ ID NO: 313996 - protein, 9 aa, Homo Sapiens
SINEEHEGF

SEQ ID NO: 313997 - protein, 9 aa, Homo Sapiens
NNAPILGSY

SEQ ID NO: 313998 - protein, 9 aa, Homo Sapiens
ECVELSSDK

SEQ ID NO: 313999 - protein, 9 aa, Homo Sapiens
ETTAQRCFC

SEQ ID NO: 314000 - protein, 9 aa, Homo Sapiens
ILPLHVLNV

SEQ ID NO: 314001 - protein, 9 aa, Homo Sapiens
PLTVECTYS

SEQ ID NO: 314002 - protein, 9 aa, Homo Sapiens
TATAGIMTR

SEQ ID NO: 314003 - protein, 9 aa, Homo Sapiens
ISDSNELAS

SEQ ID NO: 314004 - protein, 9 aa, Homo Sapiens
LSTPPKIIF

SEQ ID NO: 314005 - protein, 9 aa, Homo Sapiens
NIFFWNQSL

SEQ ID NO: 314006 - protein, 9 aa, Homo Sapiens
RPLQTHYGY

SEQ ID NO: 314007 - protein, 9 aa, Homo Sapiens
GSHKRAIST

SEQ ID NO: 314008 - protein, 9 aa, Homo Sapiens
WNLNCIALC

SEQ ID NO: 314009 - protein, 9 aa, Homo Sapiens
PCVCSSLLQ

SEQ ID NO: 314010 - protein, 9 aa, Homo Sapiens
SELAHEILC

SEQ ID NO: 314011 - protein, 9 aa, Homo Sapiens
TLISVNDLD

SEQ ID NO: 314012 - protein, 9 aa, Homo Sapiens
KASDEVTQL

SEQ ID NO: 314013 - protein, 9 aa, Homo Sapiens
NSDSSDSSD

SEQ ID NO: 314014 - protein, 9 aa, Homo Sapiens
LKEVIYLEK

SEQ ID NO: 314015 - protein, 9 aa, Homo Sapiens
APIHRPPPP

SEQ ID NO: 314016 - protein, 9 aa, Homo Sapiens
ETIVLFSLA

SEQ ID NO: 314017 - protein, 9 aa, Homo Sapiens
KEKTTKGPS

SEQ ID NO: 314018 - protein, 9 aa, Homo Sapiens
EQFFQKLIN

SEQ ID NO: 314019 - protein, 9 aa, Homo Sapiens
RELRKLVHE

SEQ ID NO: 314020 - protein, 9 aa, Homo Sapiens
SSDPSTSAS

SEQ ID NO: 314021 - protein, 9 aa, Homo Sapiens
IHDERQYRC

SEQ ID NO: 314022 - protein, 9 aa, Homo Sapiens
ISHTGERPY

SEQ ID NO: 314023 - protein, 9 aa, Homo Sapiens
NCCRDAVFM

SEQ ID NO: 314024 - protein, 9 aa, Homo Sapiens
LGGKDLKHE

SEQ ID NO: 314025 - protein, 9 aa, Homo Sapiens
GTMFGASQG

SEQ ID NO: 314026 - protein, 9 aa, Homo Sapiens
AKCKQLRTL

SEQ ID NO: 314027 - protein, 9 aa, Homo Sapiens
VQKTHLIAH

SEQ ID NO: 314028 - protein, 9 aa, Homo Sapiens
DNVSDLTLG

SEQ ID NO: 314029 - protein, 9 aa, Homo Sapiens
PQKVQINLQ

SEQ ID NO: 314030 - protein, 9 aa, Homo Sapiens
APGILGIPG

SEQ ID NO: 314031 - protein, 9 aa, Homo Sapiens
MEIRPWTRK

SEQ ID NO: 314032 - protein, 9 aa, Homo Sapiens
AERNKIEDL

SEQ ID NO: 314033 - protein, 9 aa, Homo Sapiens
CSFLWKLHV

SEQ ID NO: 314034 - protein, 9 aa, Homo Sapiens
FGPLGAAQP

SEQ ID NO: 314035 - protein, 9 aa, Homo Sapiens
FTVIKTAIL

SEQ ID NO: 314036 - protein, 9 aa, Homo Sapiens
LKTTGKQIE

SEQ ID NO: 314037 - protein, 9 aa, Homo Sapiens
EEAQEEDAK

SEQ ID NO: 314038 - protein, 9 aa, Homo Sapiens
IYIINNVFQ

SEQ ID NO: 314039 - protein, 9 aa, Homo Sapiens
KINNSRLMD

SEQ ID NO: 314040 - protein, 9 aa, Homo Sapiens
NENKSKKLK

SEQ ID NO: 314041 - protein, 9 aa, Homo Sapiens
GMSGIKRKA

SEQ ID NO: 314042 - protein, 9 aa, Homo Sapiens
VGHNCGSPH

SEQ ID NO: 314043 - protein, 9 aa, Homo Sapiens
QPNYISQEP

SEQ ID NO: 314044 - protein, 9 aa, Homo Sapiens
LAATPNLGP

SEQ ID NO: 314045 - protein, 9 aa, Homo Sapiens
AKIITLREA

SEQ ID NO: 314046 - protein, 9 aa, Homo Sapiens
EKTAVKFGN

SEQ ID NO: 314047 - protein, 9 aa, Homo Sapiens
RKKSPQMNN

SEQ ID NO: 314048 - protein, 9 aa, Homo Sapiens
AEKHRKLQK

SEQ ID NO: 314049 - protein, 9 aa, Homo Sapiens
LDPGKRAKP

SEQ ID NO: 314050 - protein, 9 aa, Homo Sapiens
ETSQETRLQ

SEQ ID NO: 314051 - protein, 9 aa, Homo Sapiens
TLLDGVEQI

SEQ ID NO: 314052 - protein, 9 aa, Homo Sapiens
IKTGADISL

SEQ ID NO: 314053 - protein, 9 aa, Homo Sapiens
VRCAGFLHP

SEQ ID NO: 314054 - protein, 9 aa, Homo Sapiens
WDTNYANVV

SEQ ID NO: 314055 - protein, 9 aa, Homo Sapiens
ISPCRVWWH

SEQ ID NO: 314056 - protein, 9 aa, Homo Sapiens
SSYDSPFPA

SEQ ID NO: 314057 - protein, 9 aa, Homo Sapiens
PLQPQAPRK

SEQ ID NO: 314058 - protein, 9 aa, Homo Sapiens
VLQADMLII

SEQ ID NO: 314059 - protein, 9 aa, Homo Sapiens
KEDIDLFEA

SEQ ID NO: 314060 - protein, 9 aa, Homo Sapiens
KMLTNVNWT

SEQ ID NO: 314061 - protein, 9 aa, Homo Sapiens
YGNLDSDKP

SEQ ID NO: 314062 - protein, 9 aa, Homo Sapiens
LRYNIIMNI

SEQ ID NO: 314063 - protein, 9 aa, Homo Sapiens
AFIQSILSK

SEQ ID NO: 314064 - protein, 9 aa, Homo Sapiens
PWTPSPSEN

SEQ ID NO: 314065 - protein, 9 aa, Homo Sapiens
FHAIYEKIT

SEQ ID NO: 314066 - protein, 9 aa, Homo Sapiens
RKGTLKEYE

SEQ ID NO: 314067 - protein, 9 aa, Homo Sapiens
FVCGMENGF

SEQ ID NO: 314068 - protein, 9 aa, Homo Sapiens
NTKVTQQDV

SEQ ID NO: 314069 - protein, 9 aa, Homo Sapiens
LLEKETTVT

SEQ ID NO: 314070 - protein, 9 aa, Homo Sapiens
TRASPTAGP

SEQ ID NO: 314071 - protein, 9 aa, Homo Sapiens
HRSRKISDG

SEQ ID NO: 314072 - protein, 9 aa, Homo Sapiens
KTFFTSQVK

SEQ ID NO: 314073 - protein, 9 aa, Homo Sapiens
PKKPFLSGP

SEQ ID NO: 314074 - protein, 9 aa, Homo Sapiens
TCFDIEKLK

SEQ ID NO: 314075 - protein, 9 aa, Homo Sapiens
NCLSAYRFK

SEQ ID NO: 314076 - protein, 9 aa, Homo Sapiens
QNGDIWELS

SEQ ID NO: 314077 - protein, 9 aa, Homo Sapiens
EEKSTLESG

SEQ ID NO: 314078 - protein, 9 aa, Homo Sapiens
LFTIERLYL

SEQ ID NO: 314079 - protein, 9 aa, Homo Sapiens
LHLSFAGLE

SEQ ID NO: 314080 - protein, 9 aa, Homo Sapiens
CPLAVKRQK

SEQ ID NO: 314081 - protein, 9 aa, Homo Sapiens
DLKKDKNEY

SEQ ID NO: 314082 - protein, 9 aa, Homo Sapiens
ENISFSDDF

SEQ ID NO: 314083 - protein, 9 aa, Homo Sapiens
RDLNVRINH

SEQ ID NO: 314084 - protein, 9 aa, Homo Sapiens
FLPFKKPSI

SEQ ID NO: 314085 - protein, 9 aa, Homo Sapiens
PYFRDQTRF

SEQ ID NO: 314086 - protein, 9 aa, Homo Sapiens
YTINAMQKA

SEQ ID NO: 314087 - protein, 9 aa, Homo Sapiens
PNIIKISKS

SEQ ID NO: 314088 - protein, 9 aa, Homo Sapiens
GIAQLRVFG

SEQ ID NO: 314089 - protein, 9 aa, Homo Sapiens
VQGILLPQP

SEQ ID NO: 314090 - protein, 9 aa, Homo Sapiens
SLSCKKAGS

SEQ ID NO: 314091 - protein, 9 aa, Homo Sapiens
TPNMKKDKR

SEQ ID NO: 314092 - protein, 9 aa, Homo Sapiens
LQIAALLQE

SEQ ID NO: 314093 - protein, 9 aa, Homo Sapiens
LHSGEKPFT

SEQ ID NO: 314094 - protein, 9 aa, Homo Sapiens
YPVGHPGDV

SEQ ID NO: 314095 - protein, 9 aa, Homo Sapiens
LFRINISQC

SEQ ID NO: 314096 - protein, 9 aa, Homo Sapiens
QQEQEQSLV

SEQ ID NO: 314097 - protein, 9 aa, Homo Sapiens
LVILFINLT

SEQ ID NO: 314098 - protein, 9 aa, Homo Sapiens
DKMQHFKIT

SEQ ID NO: 314099 - protein, 9 aa, Homo Sapiens
KLINRKLSS

SEQ ID NO: 314100 - protein, 9 aa, Homo Sapiens
LIDLRHKLK

SEQ ID NO: 314101 - protein, 9 aa, Homo Sapiens
YTFRAKVRG

SEQ ID NO: 314102 - protein, 9 aa, Homo Sapiens
HHNYLQNHL

SEQ ID NO: 314103 - protein, 9 aa, Homo Sapiens
TTGEEVWNP

SEQ ID NO: 314104 - protein, 9 aa, Homo Sapiens
ETNKENLLN

SEQ ID NO: 314105 - protein, 9 aa, Homo Sapiens
TEWKQKYEE

SEQ ID NO: 314106 - protein, 9 aa, Homo Sapiens
VDPEQLEME

SEQ ID NO: 314107 - protein, 9 aa, Homo Sapiens
SPAKLEWVT

SEQ ID NO: 314108 - protein, 9 aa, Homo Sapiens
DKQNQARLY

SEQ ID NO: 314109 - protein, 9 aa, Homo Sapiens
VNSNKGVSV

SEQ ID NO: 314110 - protein, 9 aa, Homo Sapiens
NYPRLAKRE

SEQ ID NO: 314111 - protein, 9 aa, Homo Sapiens
LQKKYVQVL

SEQ ID NO: 314112 - protein, 9 aa, Homo Sapiens
LESRGSGPK

SEQ ID NO: 314113 - protein, 9 aa, Homo Sapiens
VKVVEMHES

SEQ ID NO: 314114 - protein, 9 aa, Homo Sapiens
GTYIIYNYH

SEQ ID NO: 314115 - protein, 9 aa, Homo Sapiens
KTPIRALQK

SEQ ID NO: 314116 - protein, 9 aa, Homo Sapiens
SVDLKTRCI

SEQ ID NO: 314117 - protein, 9 aa, Homo Sapiens
MKELAGMLL

SEQ ID NO: 314118 - protein, 9 aa, Homo Sapiens
PVWVYLKVI

SEQ ID NO: 314119 - protein, 9 aa, Homo Sapiens
RVLEACVLQ

SEQ ID NO: 314120 - protein, 9 aa, Homo Sapiens
QSEGHFYLQ

SEQ ID NO: 314121 - protein, 9 aa, Homo Sapiens
STLIQHKIT

SEQ ID NO: 314122 - protein, 9 aa, Homo Sapiens
VCQPQRITY

SEQ ID NO: 314123 - protein, 9 aa, Homo Sapiens
VAESQKQKE

SEQ ID NO: 314124 - protein, 9 aa, Homo Sapiens
RICLGGPEP

SEQ ID NO: 314125 - protein, 9 aa, Homo Sapiens
DGKIMLVLP

SEQ ID NO: 314126 - protein, 9 aa, Homo Sapiens
KTKKNHKMM

SEQ ID NO: 314127 - protein, 9 aa, Homo Sapiens
HCQSKMKPS

SEQ ID NO: 314128 - protein, 9 aa, Homo Sapiens
NPKCRALTH

SEQ ID NO: 314129 - protein, 9 aa, Homo Sapiens
HEFLRYTIN

SEQ ID NO: 314130 - protein, 9 aa, Homo Sapiens
KIFPSRRNE

SEQ ID NO: 314131 - protein, 9 aa, Homo Sapiens
TVLVCSKDI

SEQ ID NO: 314132 - protein, 9 aa, Homo Sapiens
SAEAGLFVL

SEQ ID NO: 314133 - protein, 9 aa, Homo Sapiens
FYWVIYKII

SEQ ID NO: 314134 - protein, 9 aa, Homo Sapiens
VFDEVFLFL

SEQ ID NO: 314135 - protein, 9 aa, Homo Sapiens
VLPRNIALP

SEQ ID NO: 314136 - protein, 9 aa, Homo Sapiens
CESLIYTVP

SEQ ID NO: 314137 - protein, 9 aa, Homo Sapiens
GVQLLPSNK

SEQ ID NO: 314138 - protein, 9 aa, Homo Sapiens
IVHKRDKFH

SEQ ID NO: 314139 - protein, 9 aa, Homo Sapiens
NIIWVLCTV

SEQ ID NO: 314140 - protein, 9 aa, Homo Sapiens
RDYMDTIPP

SEQ ID NO: 314141 - protein, 9 aa, Homo Sapiens
KNPKLMLCR

SEQ ID NO: 314142 - protein, 9 aa, Homo Sapiens
KTGADISLL

SEQ ID NO: 314143 - protein, 9 aa, Homo Sapiens
VACQKCHKL

SEQ ID NO: 314144 - protein, 9 aa, Homo Sapiens
NDVDDCNWL

SEQ ID NO: 314145 - protein, 9 aa, Homo Sapiens
SISCVQGIL

SEQ ID NO: 314146 - protein, 9 aa, Homo Sapiens
EIKEIEYTT

SEQ ID NO: 314147 - protein, 9 aa, Homo Sapiens
IFRLEMPES

SEQ ID NO: 314148 - protein, 9 aa, Homo Sapiens
LLQTLSLCL

SEQ ID NO: 314149 - protein, 9 aa, Homo Sapiens
CLAIGNGIR

SEQ ID NO: 314150 - protein, 9 aa, Homo Sapiens
PEEEDGLRL

SEQ ID NO: 314151 - protein, 9 aa, Homo Sapiens
NLGRDWNIG

SEQ ID NO: 314152 - protein, 9 aa, Homo Sapiens
EGHFYLQSS

SEQ ID NO: 314153 - protein, 9 aa, Homo Sapiens
HEIIHTMES

SEQ ID NO: 314154 - protein, 9 aa, Homo Sapiens
SRLTPSRIN

SEQ ID NO: 314155 - protein, 9 aa, Homo Sapiens
SVRNDSNKK

SEQ ID NO: 314156 - protein, 9 aa, Homo Sapiens
ILGGKDLKH

SEQ ID NO: 314157 - protein, 9 aa, Homo Sapiens
LFTWKANTT

SEQ ID NO: 314158 - protein, 9 aa, Homo Sapiens
KKEGEQQCF

SEQ ID NO: 314159 - protein, 9 aa, Homo Sapiens
NYTALIEEI

SEQ ID NO: 314160 - protein, 9 aa, Homo Sapiens
KVSKQSWGL

SEQ ID NO: 314161 - protein, 9 aa, Homo Sapiens
DSLGAGIAE

SEQ ID NO: 314162 - protein, 9 aa, Homo Sapiens
SLETKSGGG

SEQ ID NO: 314163 - protein, 9 aa, Homo Sapiens
FLDKQNEQL

SEQ ID NO: 314164 - protein, 9 aa, Homo Sapiens
SPPHPATFF

SEQ ID NO: 314165 - protein, 9 aa, Homo Sapiens
YYGNLDSDK

SEQ ID NO: 314166 - protein, 9 aa, Homo Sapiens
THGSWQWED

SEQ ID NO: 314167 - protein, 9 aa, Homo Sapiens
SNLKLEAKK

SEQ ID NO: 314168 - protein, 9 aa, Homo Sapiens
SFLDIWYTT

SEQ ID NO: 314169 - protein, 9 aa, Homo Sapiens
IMFIVSGIC

SEQ ID NO: 314170 - protein, 9 aa, Homo Sapiens
AKTGYNMKK

SEQ ID NO: 314171 - protein, 9 aa, Homo Sapiens
LDIKTDNLL

SEQ ID NO: 314172 - protein, 9 aa, Homo Sapiens
ILKGQKNDK

SEQ ID NO: 314173 - protein, 9 aa, Homo Sapiens
PGSPVCRAG

SEQ ID NO: 314174 - protein, 9 aa, Homo Sapiens
IHWAAVKAF

SEQ ID NO: 314175 - protein, 9 aa, Homo Sapiens
GPLTNKQTD

SEQ ID NO: 314176 - protein, 9 aa, Homo Sapiens
LQKICDLIA

SEQ ID NO: 314177 - protein, 9 aa, Homo Sapiens
PDIHDERQY

SEQ ID NO: 314178 - protein, 9 aa, Homo Sapiens
SRRAPERQM

SEQ ID NO: 314179 - protein, 9 aa, Homo Sapiens
PISHIHYWV

SEQ ID NO: 314180 - protein, 9 aa, Homo Sapiens
NIYQELNME

SEQ ID NO: 314181 - protein, 9 aa, Homo Sapiens
MGQLCECVL

SEQ ID NO: 314182 - protein, 9 aa, Homo Sapiens
DGFHAIYEK

SEQ ID NO: 314183 - protein, 9 aa, Homo Sapiens
FCQNNVVLY

SEQ ID NO: 314184 - protein, 9 aa, Homo Sapiens
IRNKYFSLD

SEQ ID NO: 314185 - protein, 9 aa, Homo Sapiens
YIDIQLQIA

SEQ ID NO: 314186 - protein, 9 aa, Homo Sapiens
QCDQAFSCL

SEQ ID NO: 314187 - protein, 9 aa, Homo Sapiens
SPEPINNDN

SEQ ID NO: 314188 - protein, 9 aa, Homo Sapiens
RGREDYSPL

SEQ ID NO: 314189 - protein, 9 aa, Homo Sapiens
EIVATRVLE

SEQ ID NO: 314190 - protein, 9 aa, Homo Sapiens
IKGSKNYSE

SEQ ID NO: 314191 - protein, 9 aa, Homo Sapiens
KSIKAEKRD

SEQ ID NO: 314192 - protein, 9 aa, Homo Sapiens
FYNKLLEKA

SEQ ID NO: 314193 - protein, 9 aa, Homo Sapiens
QESTASHNS

SEQ ID NO: 314194 - protein, 9 aa, Homo Sapiens
VLCSAAKFY

SEQ ID NO: 314195 - protein, 9 aa, Homo Sapiens
FALLRKHIL

SEQ ID NO: 314196 - protein, 9 aa, Homo Sapiens
TGEDLFLHV

SEQ ID NO: 314197 - protein, 9 aa, Homo Sapiens
EENGREYKC

SEQ ID NO: 314198 - protein, 9 aa, Homo Sapiens
FFFIIYILT

SEQ ID NO: 314199 - protein, 9 aa, Homo Sapiens
KELNEYQAH

SEQ ID NO: 314200 - protein, 9 aa, Homo Sapiens
SSLERHRII

SEQ ID NO: 314201 - protein, 9 aa, Homo Sapiens
PLRCPVKLY

SEQ ID NO: 314202 - protein, 9 aa, Homo Sapiens
PFEDGKEFE

SEQ ID NO: 314203 - protein, 9 aa, Homo Sapiens
LNKALPVNV

SEQ ID NO: 314204 - protein, 9 aa, Homo Sapiens
CNHTSCGKK

SEQ ID NO: 314205 - protein, 9 aa, Homo Sapiens
DLARDLSSL

SEQ ID NO: 314206 - protein, 9 aa, Homo Sapiens
LDKAIKFLE

SEQ ID NO: 314207 - protein, 9 aa, Homo Sapiens
GPQTHVQAG

SEQ ID NO: 314208 - protein, 9 aa, Homo Sapiens
KAISFWGCI

SEQ ID NO: 314209 - protein, 9 aa, Homo Sapiens
SLLDNYLIN

SEQ ID NO: 314210 - protein, 9 aa, Homo Sapiens
SEGFISKRS

SEQ ID NO: 314211 - protein, 9 aa, Homo Sapiens
RTQAGMIPR

SEQ ID NO: 314212 - protein, 9 aa, Homo Sapiens
LVDLEIKFQ

SEQ ID NO: 314213 - protein, 9 aa, Homo Sapiens
QLHPDGTVL

SEQ ID NO: 314214 - protein, 9 aa, Homo Sapiens
LSYHQGCPF

SEQ ID NO: 314215 - protein, 9 aa, Homo Sapiens
KTAKDMCKI

SEQ ID NO: 314216 - protein, 9 aa, Homo Sapiens
MQPNYISQE

SEQ ID NO: 314217 - protein, 9 aa, Homo Sapiens
NTKKETRFK

SEQ ID NO: 314218 - protein, 9 aa, Homo Sapiens
KFFQIKMYP

SEQ ID NO: 314219 - protein, 9 aa, Homo Sapiens
STRYSRRTL

SEQ ID NO: 314220 - protein, 9 aa, Homo Sapiens
DADIHNKTY

SEQ ID NO: 314221 - protein, 9 aa, Homo Sapiens
PVEDIRRVR

SEQ ID NO: 314222 - protein, 9 aa, Homo Sapiens
WHSIREINI

SEQ ID NO: 314223 - protein, 9 aa, Homo Sapiens
DLLTADFLL

SEQ ID NO: 314224 - protein, 9 aa, Homo Sapiens
YVHRIIHTG

SEQ ID NO: 314225 - protein, 9 aa, Homo Sapiens
LFQEILNTL

SEQ ID NO: 314226 - protein, 9 aa, Homo Sapiens
CRSVDECKL

SEQ ID NO: 314227 - protein, 9 aa, Homo Sapiens
YAKEVNSDA

SEQ ID NO: 314228 - protein, 9 aa, Homo Sapiens
PRADTTATA

SEQ ID NO: 314229 - protein, 9 aa, Homo Sapiens
NGINTMSEQ

SEQ ID NO: 314230 - protein, 9 aa, Homo Sapiens
DSILDLSKY

SEQ ID NO: 314231 - protein, 9 aa, Homo Sapiens
VPWINYFQL

SEQ ID NO: 314232 - protein, 9 aa, Homo Sapiens
DKLSCMANS

SEQ ID NO: 314233 - protein, 9 aa, Homo Sapiens
LGVSLAEPE

SEQ ID NO: 314234 - protein, 9 aa, Homo Sapiens
STFQNHEPE

SEQ ID NO: 314235 - protein, 9 aa, Homo Sapiens
AVKRQKENP

SEQ ID NO: 314236 - protein, 9 aa, Homo Sapiens
KDLNSQVEY

SEQ ID NO: 314237 - protein, 9 aa, Homo Sapiens
NFRTQAGMI

SEQ ID NO: 314238 - protein, 9 aa, Homo Sapiens
YENGFNTPW

SEQ ID NO: 314239 - protein, 9 aa, Homo Sapiens
FFHYSELSG

SEQ ID NO: 314240 - protein, 9 aa, Homo Sapiens
DYMDTIPPT

SEQ ID NO: 314241 - protein, 9 aa, Homo Sapiens
PILSADIAQ

SEQ ID NO: 314242 - protein, 9 aa, Homo Sapiens
VLCEIKDKT

SEQ ID NO: 314243 - protein, 9 aa, Homo Sapiens
QEEANAAAE

SEQ ID NO: 314244 - protein, 9 aa, Homo Sapiens
THVQGLSNF

SEQ ID NO: 314245 - protein, 9 aa, Homo Sapiens
LTLEKADLN

SEQ ID NO: 314246 - protein, 9 aa, Homo Sapiens
HPATFFCIF

SEQ ID NO: 314247 - protein, 9 aa, Homo Sapiens
YITKVDLQA

SEQ ID NO: 314248 - protein, 9 aa, Homo Sapiens
EKGKVWVEK

SEQ ID NO: 314249 - protein, 9 aa, Homo Sapiens
VTSGTVIIP

SEQ ID NO: 314250 - protein, 9 aa, Homo Sapiens
KALEAMKNT

SEQ ID NO: 314251 - protein, 9 aa, Homo Sapiens
QFQYSASSR

SEQ ID NO: 314252 - protein, 9 aa, Homo Sapiens
FAESKEIQK

SEQ ID NO: 314253 - protein, 9 aa, Homo Sapiens
TDGEISYAF

SEQ ID NO: 314254 - protein, 9 aa, Homo Sapiens
CKRTACQSE

SEQ ID NO: 314255 - protein, 9 aa, Homo Sapiens
GNQFGLEEA

SEQ ID NO: 314256 - protein, 9 aa, Homo Sapiens
DIRRVRAIL

SEQ ID NO: 314257 - protein, 9 aa, Homo Sapiens
AHRQTKKMF

SEQ ID NO: 314258 - protein, 9 aa, Homo Sapiens
PFDKPRGTL

SEQ ID NO: 314259 - protein, 9 aa, Homo Sapiens
NNSGKRTII

SEQ ID NO: 314260 - protein, 9 aa, Homo Sapiens
VCILKAHGE

SEQ ID NO: 314261 - protein, 9 aa, Homo Sapiens
VNYWVGINS

SEQ ID NO: 314262 - protein, 9 aa, Homo Sapiens
VENNLTLLN

SEQ ID NO: 314263 - protein, 9 aa, Homo Sapiens
CSENQVNSR

SEQ ID NO: 314264 - protein, 9 aa, Homo Sapiens
VCYSIPEEK

SEQ ID NO: 314265 - protein, 9 aa, Homo Sapiens
ETVQKVTPN

SEQ ID NO: 314266 - protein, 9 aa, Homo Sapiens
SRQGKLQLQ

SEQ ID NO: 314267 - protein, 9 aa, Homo Sapiens
ATPSSSNGH

SEQ ID NO: 314268 - protein, 9 aa, Homo Sapiens
PPPGWQPNQ

SEQ ID NO: 314269 - protein, 9 aa, Homo Sapiens
FLHYFILVS

SEQ ID NO: 314270 - protein, 9 aa, Homo Sapiens
EGNPFDHCS

SEQ ID NO: 314271 - protein, 9 aa, Homo Sapiens
GLCKGSLTQ

SEQ ID NO: 314272 - protein, 9 aa, Homo Sapiens
QTLSLCLTA

SEQ ID NO: 314273 - protein, 9 aa, Homo Sapiens
LLVRQEAHI

SEQ ID NO: 314274 - protein, 9 aa, Homo Sapiens
RVRDINEAL

SEQ ID NO: 314275 - protein, 9 aa, Homo Sapiens
CKSRLLESV

SEQ ID NO: 314276 - protein, 9 aa, Homo Sapiens
IPQNIKFYS

SEQ ID NO: 314277 - protein, 9 aa, Homo Sapiens
LVNGIHLYE

SEQ ID NO: 314278 - protein, 9 aa, Homo Sapiens
IQDIRRREI

SEQ ID NO: 314279 - protein, 9 aa, Homo Sapiens
CGETFSLIQ

SEQ ID NO: 314280 - protein, 9 aa, Homo Sapiens
NRVLSQWRV

SEQ ID NO: 314281 - protein, 9 aa, Homo Sapiens
IRAIQYLKT

SEQ ID NO: 314282 - protein, 9 aa, Homo Sapiens
TLFGVQWVR

SEQ ID NO: 314283 - protein, 9 aa, Homo Sapiens
FTWKANTTS

SEQ ID NO: 314284 - protein, 9 aa, Homo Sapiens
ASINAVNIF

SEQ ID NO: 314285 - protein, 9 aa, Homo Sapiens
GKETIYSAE

SEQ ID NO: 314286 - protein, 9 aa, Homo Sapiens
LEFHVQEIE

SEQ ID NO: 314287 - protein, 9 aa, Homo Sapiens
FVTSQLYSL

SEQ ID NO: 314288 - protein, 9 aa, Homo Sapiens
NEAENKISY

SEQ ID NO: 314289 - protein, 9 aa, Homo Sapiens
YICHMGHEF

SEQ ID NO: 314290 - protein, 9 aa, Homo Sapiens
EIPKVFAPE

SEQ ID NO: 314291 - protein, 9 aa, Homo Sapiens
HLVEDNCEA

SEQ ID NO: 314292 - protein, 9 aa, Homo Sapiens
DLRQEGEFY

SEQ ID NO: 314293 - protein, 9 aa, Homo Sapiens
SDKMQHFKI

SEQ ID NO: 314294 - protein, 9 aa, Homo Sapiens
QTEAQYQFI

SEQ ID NO: 314295 - protein, 9 aa, Homo Sapiens
ALEEIKKLL

SEQ ID NO: 314296 - protein, 9 aa, Homo Sapiens
PAAAAYYPC

SEQ ID NO: 314297 - protein, 9 aa, Homo Sapiens
EYKCDVSSE

SEQ ID NO: 314298 - protein, 9 aa, Homo Sapiens
YPANLLSTK

SEQ ID NO: 314299 - protein, 9 aa, Homo Sapiens
FASLNKSAD

SEQ ID NO: 314300 - protein, 9 aa, Homo Sapiens
IKYMLREEL

SEQ ID NO: 314301 - protein, 9 aa, Homo Sapiens
YAGQCPEGY

SEQ ID NO: 314302 - protein, 9 aa, Homo Sapiens
RCQQEAELA

SEQ ID NO: 314303 - protein, 9 aa, Homo Sapiens
IQHKIIHTG

SEQ ID NO: 314304 - protein, 9 aa, Homo Sapiens
IVQPPGKMN

SEQ ID NO: 314305 - protein, 9 aa, Homo Sapiens
SGPINHYQN

SEQ ID NO: 314306 - protein, 9 aa, Homo Sapiens
KHVVPCVLS

SEQ ID NO: 314307 - protein, 9 aa, Homo Sapiens
LLGKKWEEH

SEQ ID NO: 314308 - protein, 9 aa, Homo Sapiens
SDAYQDKEG

SEQ ID NO: 314309 - protein, 9 aa, Homo Sapiens
QATITIVEV

SEQ ID NO: 314310 - protein, 9 aa, Homo Sapiens
VHTEEKLYK

SEQ ID NO: 314311 - protein, 9 aa, Homo Sapiens
HQNQYLGDK

SEQ ID NO: 314312 - protein, 9 aa, Homo Sapiens
GKIAELADK

SEQ ID NO: 314313 - protein, 9 aa, Homo Sapiens
FVGRFKNQK

SEQ ID NO: 314314 - protein, 9 aa, Homo Sapiens
QVLNIQFGL

SEQ ID NO: 314315 - protein, 9 aa, Homo Sapiens
SGCLLDCFL

SEQ ID NO: 314316 - protein, 9 aa, Homo Sapiens
DGKWQRDVC

SEQ ID NO: 314317 - protein, 9 aa, Homo Sapiens
DIEQLSVVK

SEQ ID NO: 314318 - protein, 9 aa, Homo Sapiens
LWETIVLFS

SEQ ID NO: 314319 - protein, 9 aa, Homo Sapiens
FGLGYVAHM

SEQ ID NO: 314320 - protein, 9 aa, Homo Sapiens
CNKQQRARK

SEQ ID NO: 314321 - protein, 9 aa, Homo Sapiens
LFIYTIYTL

SEQ ID NO: 314322 - protein, 9 aa, Homo Sapiens
RQEGEFYPD

SEQ ID NO: 314323 - protein, 9 aa, Homo Sapiens
KPKIIPPGR

SEQ ID NO: 314324 - protein, 9 aa, Homo Sapiens
VPHVTQEQD

SEQ ID NO: 314325 - protein, 9 aa, Homo Sapiens
TWQINLKTN

SEQ ID NO: 314326 - protein, 9 aa, Homo Sapiens
QLQIHRRIH

SEQ ID NO: 314327 - protein, 9 aa, Homo Sapiens
DWASEKDLC

SEQ ID NO: 314328 - protein, 9 aa, Homo Sapiens
ISGSFTLMR

SEQ ID NO: 314329 - protein, 9 aa, Homo Sapiens
ENISETWRR

SEQ ID NO: 314330 - protein, 9 aa, Homo Sapiens
SSFQIHERA

SEQ ID NO: 314331 - protein, 9 aa, Homo Sapiens
SEAQVMLSL

SEQ ID NO: 314332 - protein, 9 aa, Homo Sapiens
RDIKNKFKK

SEQ ID NO: 314333 - protein, 9 aa, Homo Sapiens
SEAEGRLRD

SEQ ID NO: 314334 - protein, 9 aa, Homo Sapiens
FDPRTLHYL

SEQ ID NO: 314335 - protein, 9 aa, Homo Sapiens
VPQTGWVYR

SEQ ID NO: 314336 - protein, 9 aa, Homo Sapiens
QEAHISWFG

SEQ ID NO: 314337 - protein, 9 aa, Homo Sapiens
QIIHTEDKF

SEQ ID NO: 314338 - protein, 9 aa, Homo Sapiens
FNHLIEMDK

SEQ ID NO: 314339 - protein, 9 aa, Homo Sapiens
YGFALFTDD

SEQ ID NO: 314340 - protein, 9 aa, Homo Sapiens
FVVCQGVLA

SEQ ID NO: 314341 - protein, 9 aa, Homo Sapiens
SEGDGNRMT

SEQ ID NO: 314342 - protein, 9 aa, Homo Sapiens
TTPAGASLE

SEQ ID NO: 314343 - protein, 9 aa, Homo Sapiens
EFHSQDNLV

SEQ ID NO: 314344 - protein, 9 aa, Homo Sapiens
HYLGGRCVP

SEQ ID NO: 314345 - protein, 9 aa, Homo Sapiens
HDIGLHVLS

SEQ ID NO: 314346 - protein, 9 aa, Homo Sapiens
GLEWLAQEE

SEQ ID NO: 314347 - protein, 9 aa, Homo Sapiens
NDIAKYFSK

SEQ ID NO: 314348 - protein, 9 aa, Homo Sapiens
QCNHTSCGK

SEQ ID NO: 314349 - protein, 9 aa, Homo Sapiens
VECTYSVSG

SEQ ID NO: 314350 - protein, 9 aa, Homo Sapiens
QFAVLYDTF

SEQ ID NO: 314351 - protein, 9 aa, Homo Sapiens
LIAYSTVFE

SEQ ID NO: 314352 - protein, 9 aa, Homo Sapiens
GGPACEAGL

SEQ ID NO: 314353 - protein, 9 aa, Homo Sapiens
VLLRTPYTS

SEQ ID NO: 314354 - protein, 9 aa, Homo Sapiens
NGLHQVLNI

SEQ ID NO: 314355 - protein, 9 aa, Homo Sapiens
FLHVKPRLD

SEQ ID NO: 314356 - protein, 9 aa, Homo Sapiens
KCFSEGGKV

SEQ ID NO: 314357 - protein, 9 aa, Homo Sapiens
LDFTAHQII

SEQ ID NO: 314358 - protein, 9 aa, Homo Sapiens
QLNLKITFL

SEQ ID NO: 314359 - protein, 9 aa, Homo Sapiens
IESKFPKGY

SEQ ID NO: 314360 - protein, 9 aa, Homo Sapiens
CDECHSNPC

SEQ ID NO: 314361 - protein, 9 aa, Homo Sapiens
QTYVTVGPQ

SEQ ID NO: 314362 - protein, 9 aa, Homo Sapiens
RELKKDHCE

SEQ ID NO: 314363 - protein, 9 aa, Homo Sapiens
IERGSRESA

SEQ ID NO: 314364 - protein, 9 aa, Homo Sapiens
LSKLQSGPR

SEQ ID NO: 314365 - protein, 9 aa, Homo Sapiens
ESGHDQKNK

SEQ ID NO: 314366 - protein, 9 aa, Homo Sapiens
YELNNRVGK

SEQ ID NO: 314367 - protein, 9 aa, Homo Sapiens
YPFPVHPGT

SEQ ID NO: 314368 - protein, 9 aa, Homo Sapiens
NDFVVDATH

SEQ ID NO: 314369 - protein, 9 aa, Homo Sapiens
DKKAAKVQE

SEQ ID NO: 314370 - protein, 9 aa, Homo Sapiens
PVLMIPPSV

SEQ ID NO: 314371 - protein, 9 aa, Homo Sapiens
YAKEIMRHS

SEQ ID NO: 314372 - protein, 9 aa, Homo Sapiens
STCCLVSGN

SEQ ID NO: 314373 - protein, 9 aa, Homo Sapiens
NYPPFKGRI

SEQ ID NO: 314374 - protein, 9 aa, Homo Sapiens
PAIYKRAEH

SEQ ID NO: 314375 - protein, 9 aa, Homo Sapiens
PTTAGSSST

SEQ ID NO: 314376 - protein, 9 aa, Homo Sapiens
LFYLVTIQE

SEQ ID NO: 314377 - protein, 9 aa, Homo Sapiens
KSKKLKGEL

SEQ ID NO: 314378 - protein, 9 aa, Homo Sapiens
STQTRLSTE

SEQ ID NO: 314379 - protein, 9 aa, Homo Sapiens
AYYPCEPAL

SEQ ID NO: 314380 - protein, 9 aa, Homo Sapiens
CMASELDDN

SEQ ID NO: 314381 - protein, 9 aa, Homo Sapiens
KHGKNVPKY

SEQ ID NO: 314382 - protein, 9 aa, Homo Sapiens
CYESCMSGA

SEQ ID NO: 314383 - protein, 9 aa, Homo Sapiens
QQVKDVFWD

SEQ ID NO: 314384 - protein, 9 aa, Homo Sapiens
LANYILFRA

SEQ ID NO: 314385 - protein, 9 aa, Homo Sapiens
MHKRTQQIQ

SEQ ID NO: 314386 - protein, 9 aa, Homo Sapiens
RGKEACTLD

SEQ ID NO: 314387 - protein, 9 aa, Homo Sapiens
ITEHCIKQN

SEQ ID NO: 314388 - protein, 9 aa, Homo Sapiens
FGGNCAHQA

SEQ ID NO: 314389 - protein, 9 aa, Homo Sapiens
KYMNRTVTT

SEQ ID NO: 314390 - protein, 9 aa, Homo Sapiens
MQKQQASKN

SEQ ID NO: 314391 - protein, 9 aa, Homo Sapiens
KQWKELSKE

SEQ ID NO: 314392 - protein, 9 aa, Homo Sapiens
FGDLSYRSA

SEQ ID NO: 314393 - protein, 9 aa, Homo Sapiens
LIKASRCRP

SEQ ID NO: 314394 - protein, 9 aa, Homo Sapiens
KLKVEGSPT

SEQ ID NO: 314395 - protein, 9 aa, Homo Sapiens
NLCSFRKVI

SEQ ID NO: 314396 - protein, 9 aa, Homo Sapiens
GVDVDPEQL

SEQ ID NO: 314397 - protein, 9 aa, Homo Sapiens
NYWVGINSN

SEQ ID NO: 314398 - protein, 9 aa, Homo Sapiens
NTLLPEGFQ

SEQ ID NO: 314399 - protein, 9 aa, Homo Sapiens
LSRKIIYIE

SEQ ID NO: 314400 - protein, 9 aa, Homo Sapiens
KSGSIFGSS

SEQ ID NO: 314401 - protein, 9 aa, Homo Sapiens
NVNTSVLSF

SEQ ID NO: 314402 - protein, 9 aa, Homo Sapiens
KGNSTALSR

SEQ ID NO: 314403 - protein, 9 aa, Homo Sapiens
PDKYDKSCD

SEQ ID NO: 314404 - protein, 9 aa, Homo Sapiens
LEAAKFVDI

SEQ ID NO: 314405 - protein, 9 aa, Homo Sapiens
KLHKKMGQL

SEQ ID NO: 314406 - protein, 9 aa, Homo Sapiens
DCSDVPALH

SEQ ID NO: 314407 - protein, 9 aa, Homo Sapiens
TSISELYVF

SEQ ID NO: 314408 - protein, 9 aa, Homo Sapiens
EIIGKMSFT

SEQ ID NO: 314409 - protein, 9 aa, Homo Sapiens
RYRNQIFLS

SEQ ID NO: 314410 - protein, 9 aa, Homo Sapiens
TQSKSSPKI

SEQ ID NO: 314411 - protein, 9 aa, Homo Sapiens
LFVCLMFLT

SEQ ID NO: 314412 - protein, 9 aa, Homo Sapiens
YQQAKCRDP

SEQ ID NO: 314413 - protein, 9 aa, Homo Sapiens
IMIVYFIFW

SEQ ID NO: 314414 - protein, 9 aa, Homo Sapiens
HVVPCVLSV

SEQ ID NO: 314415 - protein, 9 aa, Homo Sapiens
VKLPEIIGK

SEQ ID NO: 314416 - protein, 9 aa, Homo Sapiens
QRQTTPEGL

SEQ ID NO: 314417 - protein, 9 aa, Homo Sapiens
PAEVLPRNI

SEQ ID NO: 314418 - protein, 9 aa, Homo Sapiens
LKRAGERSV

SEQ ID NO: 314419 - protein, 9 aa, Homo Sapiens
DDLNNLNQL

SEQ ID NO: 314420 - protein, 9 aa, Homo Sapiens
YQSQAEAHY

SEQ ID NO: 314421 - protein, 9 aa, Homo Sapiens
KQIDDNRTF

SEQ ID NO: 314422 - protein, 9 aa, Homo Sapiens
ACEAGLCTG

SEQ ID NO: 314423 - protein, 9 aa, Homo Sapiens
SDIFFVSIC

SEQ ID NO: 314424 - protein, 9 aa, Homo Sapiens
AGQLKYSVP

SEQ ID NO: 314425 - protein, 9 aa, Homo Sapiens
FRIIFRTLN

SEQ ID NO: 314426 - protein, 9 aa, Homo Sapiens
DTSHLYTDG

SEQ ID NO: 314427 - protein, 9 aa, Homo Sapiens
LILGGKDLK

SEQ ID NO: 314428 - protein, 9 aa, Homo Sapiens
LFFSLAFII

SEQ ID NO: 314429 - protein, 9 aa, Homo Sapiens
QPESLQAQY

SEQ ID NO: 314430 - protein, 9 aa, Homo Sapiens
PPYGPGIIQ

SEQ ID NO: 314431 - protein, 9 aa, Homo Sapiens
TLLKEGFRL

SEQ ID NO: 314432 - protein, 9 aa, Homo Sapiens
SRREPSIHH

SEQ ID NO: 314433 - protein, 9 aa, Homo Sapiens
KTYLEEKLD

SEQ ID NO: 314434 - protein, 9 aa, Homo Sapiens
AILYVHRII

SEQ ID NO: 314435 - protein, 9 aa, Homo Sapiens
KSILWQTLQ

SEQ ID NO: 314436 - protein, 9 aa, Homo Sapiens
FEDMDKMFS

SEQ ID NO: 314437 - protein, 9 aa, Homo Sapiens
NRKDLVKAK

SEQ ID NO: 314438 - protein, 9 aa, Homo Sapiens
ETQNMQRLL

SEQ ID NO: 314439 - protein, 9 aa, Homo Sapiens
CSPDLLLDA

SEQ ID NO: 314440 - protein, 9 aa, Homo Sapiens
TNSRDPLAI

SEQ ID NO: 314441 - protein, 9 aa, Homo Sapiens
VKGLFDEKK

SEQ ID NO: 314442 - protein, 9 aa, Homo Sapiens
NNSIPTSEQ

SEQ ID NO: 314443 - protein, 9 aa, Homo Sapiens
LPLFRINIS

SEQ ID NO: 314444 - protein, 9 aa, Homo Sapiens
AVINAKDER

SEQ ID NO: 314445 - protein, 9 aa, Homo Sapiens
YQTMHGRAV

SEQ ID NO: 314446 - protein, 9 aa, Homo Sapiens
TNANAILQI

SEQ ID NO: 314447 - protein, 9 aa, Homo Sapiens
KIIFCQTPK

SEQ ID NO: 314448 - protein, 9 aa, Homo Sapiens
LLLNVQPDF

SEQ ID NO: 314449 - protein, 9 aa, Homo Sapiens
GEKGFCYKG

SEQ ID NO: 314450 - protein, 9 aa, Homo Sapiens
FIEDMINQK

SEQ ID NO: 314451 - protein, 9 aa, Homo Sapiens
TLHINEYGI

SEQ ID NO: 314452 - protein, 9 aa, Homo Sapiens
SKPGVFSFI

SEQ ID NO: 314453 - protein, 9 aa, Homo Sapiens
FDKILTEWK

SEQ ID NO: 314454 - protein, 9 aa, Homo Sapiens
VNYMCWASL

SEQ ID NO: 314455 - protein, 9 aa, Homo Sapiens
ENNLPFLLI

SEQ ID NO: 314456 - protein, 9 aa, Homo Sapiens
KYRVRRKCP

SEQ ID NO: 314457 - protein, 9 aa, Homo Sapiens
QIRYASVEC

SEQ ID NO: 314458 - protein, 9 aa, Homo Sapiens
AVEVLIKTG

SEQ ID NO: 314459 - protein, 9 aa, Homo Sapiens
GSRDVSHQP

SEQ ID NO: 314460 - protein, 9 aa, Homo Sapiens
LLLGATLTV

SEQ ID NO: 314461 - protein, 9 aa, Homo Sapiens
FGVLRQITG

SEQ ID NO: 314462 - protein, 9 aa, Homo Sapiens
ADIEWKFAQ

SEQ ID NO: 314463 - protein, 9 aa, Homo Sapiens
QAEGQSCES

SEQ ID NO: 314464 - protein, 9 aa, Homo Sapiens
RIIATLQSK

SEQ ID NO: 314465 - protein, 9 aa, Homo Sapiens
AVETYRKKW

SEQ ID NO: 314466 - protein, 9 aa, Homo Sapiens
GDKKKENKS

SEQ ID NO: 314467 - protein, 9 aa, Homo Sapiens
GSLSASGRH

SEQ ID NO: 314468 - protein, 9 aa, Homo Sapiens
TPSRINFKK

SEQ ID NO: 314469 - protein, 9 aa, Homo Sapiens
FSKPKHNHI

SEQ ID NO: 314470 - protein, 9 aa, Homo Sapiens
DLKILRCLL

SEQ ID NO: 314471 - protein, 9 aa, Homo Sapiens
YLPGSGLTA

SEQ ID NO: 314472 - protein, 9 aa, Homo Sapiens
FNTYRNDLI

SEQ ID NO: 314473 - protein, 9 aa, Homo Sapiens
QEAAVPKIR

SEQ ID NO: 314474 - protein, 9 aa, Homo Sapiens
VYSPKFYAG

SEQ ID NO: 314475 - protein, 9 aa, Homo Sapiens
HYSELSGDV

SEQ ID NO: 314476 - protein, 9 aa, Homo Sapiens
EEFKKVLGE

SEQ ID NO: 314477 - protein, 9 aa, Homo Sapiens
KLHVRGAPA

SEQ ID NO: 314478 - protein, 9 aa, Homo Sapiens
KKLYTCEEC

SEQ ID NO: 314479 - protein, 9 aa, Homo Sapiens
FRNLFTKIG

SEQ ID NO: 314480 - protein, 9 aa, Homo Sapiens
YISQEPAFE

SEQ ID NO: 314481 - protein, 9 aa, Homo Sapiens
SKMKPSWAD

SEQ ID NO: 314482 - protein, 9 aa, Homo Sapiens
VPYIVHSQV

SEQ ID NO: 314483 - protein, 9 aa, Homo Sapiens
EHQLSVAGN

SEQ ID NO: 314484 - protein, 9 aa, Homo Sapiens
FSVVVIYKK

SEQ ID NO: 314485 - protein, 9 aa, Homo Sapiens
KECGKLFRR

SEQ ID NO: 314486 - protein, 9 aa, Homo Sapiens
DQRDVYRDV

SEQ ID NO: 314487 - protein, 9 aa, Homo Sapiens
YFQIRPHAL

SEQ ID NO: 314488 - protein, 9 aa, Homo Sapiens
SMIGAKCKQ

SEQ ID NO: 314489 - protein, 9 aa, Homo Sapiens
MSVCGRKAL

SEQ ID NO: 314490 - protein, 9 aa, Homo Sapiens
NCMVNNNLS

SEQ ID NO: 314491 - protein, 9 aa, Homo Sapiens
GLYDLWAKT

SEQ ID NO: 314492 - protein, 9 aa, Homo Sapiens
TSDASTENT

SEQ ID NO: 314493 - protein, 9 aa, Homo Sapiens
DDNVDSDSG

SEQ ID NO: 314494 - protein, 9 aa, Homo Sapiens
IQLPFHTFA

SEQ ID NO: 314495 - protein, 9 aa, Homo Sapiens
KLQCDKKKV

SEQ ID NO: 314496 - protein, 9 aa, Homo Sapiens
LSVAGNIKK

SEQ ID NO: 314497 - protein, 9 aa, Homo Sapiens
FVMLFYTNM

SEQ ID NO: 314498 - protein, 9 aa, Homo Sapiens
TNLIRHRKT

SEQ ID NO: 314499 - protein, 9 aa, Homo Sapiens
KSSVDLKTR

SEQ ID NO: 314500 - protein, 9 aa, Homo Sapiens
NKDLNSQVE

SEQ ID NO: 314501 - protein, 9 aa, Homo Sapiens
GAWMEWSKW

SEQ ID NO: 314502 - protein, 9 aa, Homo Sapiens
TPQNFIDNR

SEQ ID NO: 314503 - protein, 9 aa, Homo Sapiens
EENTFCDVT

SEQ ID NO: 314504 - protein, 9 aa, Homo Sapiens
RDVYRDVML

SEQ ID NO: 314505 - protein, 9 aa, Homo Sapiens
KDVSFQNIG

SEQ ID NO: 314506 - protein, 9 aa, Homo Sapiens
EECERFRQL

SEQ ID NO: 314507 - protein, 9 aa, Homo Sapiens
PLRTHVQGL

SEQ ID NO: 314508 - protein, 9 aa, Homo Sapiens
QLKYSVPEE

SEQ ID NO: 314509 - protein, 9 aa, Homo Sapiens
TRKGRTLFR

SEQ ID NO: 314510 - protein, 9 aa, Homo Sapiens
LYSEANSGY

SEQ ID NO: 314511 - protein, 9 aa, Homo Sapiens
FVGGLSPEI

SEQ ID NO: 314512 - protein, 9 aa, Homo Sapiens
LYRSKSRQL

SEQ ID NO: 314513 - protein, 9 aa, Homo Sapiens
PYTRCKGSI

SEQ ID NO: 314514 - protein, 9 aa, Homo Sapiens
VQGRQKSLS

SEQ ID NO: 314515 - protein, 9 aa, Homo Sapiens
ASDQASEEI

SEQ ID NO: 314516 - protein, 9 aa, Homo Sapiens
RRHMLERLY

SEQ ID NO: 314517 - protein, 9 aa, Homo Sapiens
FSTKDFLPD

SEQ ID NO: 314518 - protein, 9 aa, Homo Sapiens
TYRRPLQTH

SEQ ID NO: 314519 - protein, 9 aa, Homo Sapiens
KMKPGRPQI

SEQ ID NO: 314520 - protein, 9 aa, Homo Sapiens
GNLSLVDYS

SEQ ID NO: 314521 - protein, 9 aa, Homo Sapiens
IQSSIPEGV

SEQ ID NO: 314522 - protein, 9 aa, Homo Sapiens
NNDNPSPTQ

SEQ ID NO: 314523 - protein, 9 aa, Homo Sapiens
VHHQPPADK

SEQ ID NO: 314524 - protein, 9 aa, Homo Sapiens
KRAKAMQTK

SEQ ID NO: 314525 - protein, 9 aa, Homo Sapiens
PFKTKYSPG

SEQ ID NO: 314526 - protein, 9 aa, Homo Sapiens
CSFRKVISY

SEQ ID NO: 314527 - protein, 9 aa, Homo Sapiens
AQLIHLFSK

SEQ ID NO: 314528 - protein, 9 aa, Homo Sapiens
LENKLSCKI

SEQ ID NO: 314529 - protein, 9 aa, Homo Sapiens
QTLMPTLEA

SEQ ID NO: 314530 - protein, 9 aa, Homo Sapiens
LPDLRSLND

SEQ ID NO: 314531 - protein, 9 aa, Homo Sapiens
LIIRTNRTT

SEQ ID NO: 314532 - protein, 9 aa, Homo Sapiens
DHSKNVTSG

SEQ ID NO: 314533 - protein, 9 aa, Homo Sapiens
HSREQSYKY

SEQ ID NO: 314534 - protein, 9 aa, Homo Sapiens
ATEYMTFTL

SEQ ID NO: 314535 - protein, 9 aa, Homo Sapiens
SRKIALQDR

SEQ ID NO: 314536 - protein, 9 aa, Homo Sapiens
LGASKFLLL

SEQ ID NO: 314537 - protein, 9 aa, Homo Sapiens
YRYNVSVEE

SEQ ID NO: 314538 - protein, 9 aa, Homo Sapiens
IHNNVLESY

SEQ ID NO: 314539 - protein, 9 aa, Homo Sapiens
CIVVANTID

SEQ ID NO: 314540 - protein, 9 aa, Homo Sapiens
LPPGFKQLS

SEQ ID NO: 314541 - protein, 9 aa, Homo Sapiens
TAMTTTLLQ

SEQ ID NO: 314542 - protein, 9 aa, Homo Sapiens
VKKITDLTG

SEQ ID NO: 314543 - protein, 9 aa, Homo Sapiens
EHMHNQFVV

SEQ ID NO: 314544 - protein, 9 aa, Homo Sapiens
FYQRSLASW

SEQ ID NO: 314545 - protein, 9 aa, Homo Sapiens
QNIGIITHY

SEQ ID NO: 314546 - protein, 9 aa, Homo Sapiens
HDGYYLSYV

SEQ ID NO: 314547 - protein, 9 aa, Homo Sapiens
CNVTPLLKL

SEQ ID NO: 314548 - protein, 9 aa, Homo Sapiens
EMMHKRTQQ

SEQ ID NO: 314549 - protein, 9 aa, Homo Sapiens
GKRFLDSLW

SEQ ID NO: 314550 - protein, 9 aa, Homo Sapiens
ITFLEAGIY

SEQ ID NO: 314551 - protein, 9 aa, Homo Sapiens
IQNAEVRQI

SEQ ID NO: 314552 - protein, 9 aa, Homo Sapiens
ARWWGLITL

SEQ ID NO: 314553 - protein, 9 aa, Homo Sapiens
ENETEKEVK

SEQ ID NO: 314554 - protein, 9 aa, Homo Sapiens
IKRKASISL

SEQ ID NO: 314555 - protein, 9 aa, Homo Sapiens
RKGLYDDTT

SEQ ID NO: 314556 - protein, 9 aa, Homo Sapiens
IMSSTNMMP

SEQ ID NO: 314557 - protein, 9 aa, Homo Sapiens
VRKVLANCK

SEQ ID NO: 314558 - protein, 9 aa, Homo Sapiens
VAELMTRTS

SEQ ID NO: 314559 - protein, 9 aa, Homo Sapiens
LQNRYANRL

SEQ ID NO: 314560 - protein, 9 aa, Homo Sapiens
LQHPYLKLA

SEQ ID NO: 314561 - protein, 9 aa, Homo Sapiens
SFATKLSDY

SEQ ID NO: 314562 - protein, 9 aa, Homo Sapiens
SKRVCIPLP

SEQ ID NO: 314563 - protein, 9 aa, Homo Sapiens
SMCEYQQAK

SEQ ID NO: 314564 - protein, 9 aa, Homo Sapiens
QQEKISELH

SEQ ID NO: 314565 - protein, 9 aa, Homo Sapiens
YYKWNGFGR

SEQ ID NO: 314566 - protein, 9 aa, Homo Sapiens
CIGADDKKE

SEQ ID NO: 314567 - protein, 9 aa, Homo Sapiens
TVDLSFSPA

SEQ ID NO: 314568 - protein, 9 aa, Homo Sapiens
YSFASIKNN

SEQ ID NO: 314569 - protein, 9 aa, Homo Sapiens
MYGSSPALE

SEQ ID NO: 314570 - protein, 9 aa, Homo Sapiens
FHGCMGQLF

SEQ ID NO: 314571 - protein, 9 aa, Homo Sapiens
AYLQEALFG

SEQ ID NO: 314572 - protein, 9 aa, Homo Sapiens
NAIKRVGYC

SEQ ID NO: 314573 - protein, 9 aa, Homo Sapiens
TRIEGKEPG

SEQ ID NO: 314574 - protein, 9 aa, Homo Sapiens
SNILPKENH

SEQ ID NO: 314575 - protein, 9 aa, Homo Sapiens
DRFASVVYT

SEQ ID NO: 314576 - protein, 9 aa, Homo Sapiens
DDYVKLKVE

SEQ ID NO: 314577 - protein, 9 aa, Homo Sapiens
NGNSEAVKL

SEQ ID NO: 314578 - protein, 9 aa, Homo Sapiens
VVTKVVDVY

SEQ ID NO: 314579 - protein, 9 aa, Homo Sapiens
QIIHQEEKA

SEQ ID NO: 314580 - protein, 9 aa, Homo Sapiens
ISQVISEGD

SEQ ID NO: 314581 - protein, 9 aa, Homo Sapiens
LDIPVLFKI

SEQ ID NO: 314582 - protein, 9 aa, Homo Sapiens
FIPEMICIL

SEQ ID NO: 314583 - protein, 9 aa, Homo Sapiens
SNIINKLRA

SEQ ID NO: 314584 - protein, 9 aa, Homo Sapiens
NLFVGTDDN

SEQ ID NO: 314585 - protein, 9 aa, Homo Sapiens
FISTLLLYW

SEQ ID NO: 314586 - protein, 9 aa, Homo Sapiens
MSVFPSQSM

SEQ ID NO: 314587 - protein, 9 aa, Homo Sapiens
ANNLVLAGI

SEQ ID NO: 314588 - protein, 9 aa, Homo Sapiens
KKIIVEAQV

SEQ ID NO: 314589 - protein, 9 aa, Homo Sapiens
LCGNRTYAG

SEQ ID NO: 314590 - protein, 9 aa, Homo Sapiens
RVGGKKSLG

SEQ ID NO: 314591 - protein, 9 aa, Homo Sapiens
RWLDHSKHG

SEQ ID NO: 314592 - protein, 9 aa, Homo Sapiens
NFSILEILF

SEQ ID NO: 314593 - protein, 9 aa, Homo Sapiens
LLGSTEWAD

SEQ ID NO: 314594 - protein, 9 aa, Homo Sapiens
YQKEMVRAD

SEQ ID NO: 314595 - protein, 9 aa, Homo Sapiens
VVGNLSLIT

SEQ ID NO: 314596 - protein, 9 aa, Homo Sapiens
LQVNYDKGL

SEQ ID NO: 314597 - protein, 9 aa, Homo Sapiens
MNDAQHGGW

SEQ ID NO: 314598 - protein, 9 aa, Homo Sapiens
QVNNIKKNE

SEQ ID NO: 314599 - protein, 9 aa, Homo Sapiens
SKGKKQNPG

SEQ ID NO: 314600 - protein, 9 aa, Homo Sapiens
LFTKIGNIE

SEQ ID NO: 314601 - protein, 9 aa, Homo Sapiens
LQIETAYDF

SEQ ID NO: 314602 - protein, 9 aa, Homo Sapiens
LCTSQHLQN

SEQ ID NO: 314603 - protein, 9 aa, Homo Sapiens
GVRKDLMAH

SEQ ID NO: 314604 - protein, 9 aa, Homo Sapiens
LRLSLGPQT

SEQ ID NO: 314605 - protein, 9 aa, Homo Sapiens
LQALGYQPD

SEQ ID NO: 314606 - protein, 9 aa, Homo Sapiens
RIQLPFHTF

SEQ ID NO: 314607 - protein, 9 aa, Homo Sapiens
EVQIMPSQI

SEQ ID NO: 314608 - protein, 9 aa, Homo Sapiens
FSNTTSTQT

SEQ ID NO: 314609 - protein, 9 aa, Homo Sapiens
GYKFSNPNI

SEQ ID NO: 314610 - protein, 9 aa, Homo Sapiens
TKVRNYVLL

SEQ ID NO: 314611 - protein, 9 aa, Homo Sapiens
IIYQMDDVY

SEQ ID NO: 314612 - protein, 9 aa, Homo Sapiens
TPLKLAGWQ

SEQ ID NO: 314613 - protein, 9 aa, Homo Sapiens
NNCSETQYE

SEQ ID NO: 314614 - protein, 9 aa, Homo Sapiens
THGLNITGF

SEQ ID NO: 314615 - protein, 9 aa, Homo Sapiens
KGKQLEDKM

SEQ ID NO: 314616 - protein, 9 aa, Homo Sapiens
LGIELHVNV

SEQ ID NO: 314617 - protein, 9 aa, Homo Sapiens
LYQLCKKSK

SEQ ID NO: 314618 - protein, 9 aa, Homo Sapiens
GLICRTCNL

SEQ ID NO: 314619 - protein, 9 aa, Homo Sapiens
TAAFYLALR

SEQ ID NO: 314620 - protein, 9 aa, Homo Sapiens
AVLALAQID

SEQ ID NO: 314621 - protein, 9 aa, Homo Sapiens
SVQTSKHLF

SEQ ID NO: 314622 - protein, 9 aa, Homo Sapiens
GAKWEKEKH

SEQ ID NO: 314623 - protein, 9 aa, Homo Sapiens
TLPNSQEVQ

SEQ ID NO: 314624 - protein, 9 aa, Homo Sapiens
EKSNYICHM

SEQ ID NO: 314625 - protein, 9 aa, Homo Sapiens
RNKIKQVKD

SEQ ID NO: 314626 - protein, 9 aa, Homo Sapiens
NIFPQEEQR

SEQ ID NO: 314627 - protein, 9 aa, Homo Sapiens
GYFHLWKAD

SEQ ID NO: 314628 - protein, 9 aa, Homo Sapiens
QEGQCWVDD

SEQ ID NO: 314629 - protein, 9 aa, Homo Sapiens
AITSESKDN

SEQ ID NO: 314630 - protein, 9 aa, Homo Sapiens
LVVDESSFL

SEQ ID NO: 314631 - protein, 9 aa, Homo Sapiens
VLNYYTFAL

SEQ ID NO: 314632 - protein, 9 aa, Homo Sapiens
DRVAKVHTA

SEQ ID NO: 314633 - protein, 9 aa, Homo Sapiens
AGFHKVTYK

SEQ ID NO: 314634 - protein, 9 aa, Homo Sapiens
QAHKEQGKE

SEQ ID NO: 314635 - protein, 9 aa, Homo Sapiens
FQRLFGAKA

SEQ ID NO: 314636 - protein, 9 aa, Homo Sapiens
ICLDPDAPI

SEQ ID NO: 314637 - protein, 9 aa, Homo Sapiens
PNPTSPANS

SEQ ID NO: 314638 - protein, 9 aa, Homo Sapiens
GLCSLSYLE

SEQ ID NO: 314639 - protein, 9 aa, Homo Sapiens
QRIEDFDLA

SEQ ID NO: 314640 - protein, 9 aa, Homo Sapiens
IRNYNDTFT

SEQ ID NO: 314641 - protein, 9 aa, Homo Sapiens
YTVLAKVQI

SEQ ID NO: 314642 - protein, 9 aa, Homo Sapiens
MLQKEDNEV

SEQ ID NO: 314643 - protein, 9 aa, Homo Sapiens
QRGLVARID

SEQ ID NO: 314644 - protein, 9 aa, Homo Sapiens
CKTSSSSSF

SEQ ID NO: 314645 - protein, 9 aa, Homo Sapiens
RIDYLLRAN

SEQ ID NO: 314646 - protein, 9 aa, Homo Sapiens
MVMAQLLNQ

SEQ ID NO: 314647 - protein, 9 aa, Homo Sapiens
INAKDERVR

SEQ ID NO: 314648 - protein, 9 aa, Homo Sapiens
FFVETQNMQ

SEQ ID NO: 314649 - protein, 9 aa, Homo Sapiens
AFSKSSYLI

SEQ ID NO: 314650 - protein, 9 aa, Homo Sapiens
KREGYPLWP

SEQ ID NO: 314651 - protein, 9 aa, Homo Sapiens
VGGLLLLTL

SEQ ID NO: 314652 - protein, 9 aa, Homo Sapiens
FEDVPDNKA

SEQ ID NO: 314653 - protein, 9 aa, Homo Sapiens
KHKIIFCQT

SEQ ID NO: 314654 - protein, 9 aa, Homo Sapiens
VMQIMSPDL

SEQ ID NO: 314655 - protein, 9 aa, Homo Sapiens
KHVRPDYLK

SEQ ID NO: 314656 - protein, 9 aa, Homo Sapiens
KRKLQPNSN

SEQ ID NO: 314657 - protein, 9 aa, Homo Sapiens
IPQIPDSTH

SEQ ID NO: 314658 - protein, 9 aa, Homo Sapiens
NELASGFFV

SEQ ID NO: 314659 - protein, 9 aa, Homo Sapiens
IRKELKRNK

SEQ ID NO: 314660 - protein, 9 aa, Homo Sapiens
IIQYIPVSQ

SEQ ID NO: 314661 - protein, 9 aa, Homo Sapiens
LLIQALSTQ

SEQ ID NO: 314662 - protein, 9 aa, Homo Sapiens
TIDINNCDG

SEQ ID NO: 314663 - protein, 9 aa, Homo Sapiens
LEEKLDKWA

SEQ ID NO: 314664 - protein, 9 aa, Homo Sapiens
LQGEIKGQE

SEQ ID NO: 314665 - protein, 9 aa, Homo Sapiens
RHLVEDNCE

SEQ ID NO: 314666 - protein, 9 aa, Homo Sapiens
SAKDKKSSS

SEQ ID NO: 314667 - protein, 9 aa, Homo Sapiens
TRNRDLLSK

SEQ ID NO: 314668 - protein, 9 aa, Homo Sapiens
WKAAPAHRR

SEQ ID NO: 314669 - protein, 9 aa, Homo Sapiens
MQYCVLCDN

SEQ ID NO: 314670 - protein, 9 aa, Homo Sapiens
SQLPTPTSS

SEQ ID NO: 314671 - protein, 9 aa, Homo Sapiens
IYTLQTKRK

SEQ ID NO: 314672 - protein, 9 aa, Homo Sapiens
TVTLNSSLL

SEQ ID NO: 314673 - protein, 9 aa, Homo Sapiens
FPCPEKCAK

SEQ ID NO: 314674 - protein, 9 aa, Homo Sapiens
YIVHSQVYR

SEQ ID NO: 314675 - protein, 9 aa, Homo Sapiens
RTLHINEYG

SEQ ID NO: 314676 - protein, 9 aa, Homo Sapiens
CHHSISVQT

SEQ ID NO: 314677 - protein, 9 aa, Homo Sapiens
QLLQKQEQQ

SEQ ID NO: 314678 - protein, 9 aa, Homo Sapiens
LDNGNIANS

SEQ ID NO: 314679 - protein, 9 aa, Homo Sapiens
SLLSNSATS

SEQ ID NO: 314680 - protein, 9 aa, Homo Sapiens
YNGNDVNLQ

SEQ ID NO: 314681 - protein, 9 aa, Homo Sapiens
YIMWGYLII

SEQ ID NO: 314682 - protein, 9 aa, Homo Sapiens
RLSYLTKHK

SEQ ID NO: 314683 - protein, 9 aa, Homo Sapiens
LDAIFKPEL

SEQ ID NO: 314684 - protein, 9 aa, Homo Sapiens
RTYAGQCPE

SEQ ID NO: 314685 - protein, 9 aa, Homo Sapiens
RQRKVKCIY

SEQ ID NO: 314686 - protein, 9 aa, Homo Sapiens
PASKKYTVK

SEQ ID NO: 314687 - protein, 9 aa, Homo Sapiens
LGLFPQSII

SEQ ID NO: 314688 - protein, 9 aa, Homo Sapiens
DALGALLQR

SEQ ID NO: 314689 - protein, 9 aa, Homo Sapiens
VNHVNSDRI

SEQ ID NO: 314690 - protein, 9 aa, Homo Sapiens
FHDKNAKKT

SEQ ID NO: 314691 - protein, 9 aa, Homo Sapiens
DCSEDGTGG

SEQ ID NO: 314692 - protein, 9 aa, Homo Sapiens
LESMDSAFT

SEQ ID NO: 314693 - protein, 9 aa, Homo Sapiens
LLFYFDNIV

SEQ ID NO: 314694 - protein, 9 aa, Homo Sapiens
HAKNRISKK

SEQ ID NO: 314695 - protein, 9 aa, Homo Sapiens
MDRTPDKLK

SEQ ID NO: 314696 - protein, 9 aa, Homo Sapiens
ESKDNCTGV

SEQ ID NO: 314697 - protein, 9 aa, Homo Sapiens
VSKAGPYTF

SEQ ID NO: 314698 - protein, 9 aa, Homo Sapiens
TELQKQPLR

SEQ ID NO: 314699 - protein, 9 aa, Homo Sapiens
EEEQDYYLG

SEQ ID NO: 314700 - protein, 9 aa, Homo Sapiens
LYFIVKDSP

SEQ ID NO: 314701 - protein, 9 aa, Homo Sapiens
VQLIQKHPQ

SEQ ID NO: 314702 - protein, 9 aa, Homo Sapiens
PVCRAGKAK

SEQ ID NO: 314703 - protein, 9 aa, Homo Sapiens
ASDSNSFME

SEQ ID NO: 314704 - protein, 9 aa, Homo Sapiens
SLNEYKALT

SEQ ID NO: 314705 - protein, 9 aa, Homo Sapiens
SLPGYIMKI

SEQ ID NO: 314706 - protein, 9 aa, Homo Sapiens
PKLLNKLDK

SEQ ID NO: 314707 - protein, 9 aa, Homo Sapiens
NFIPRHFRP

SEQ ID NO: 314708 - protein, 9 aa, Homo Sapiens
FLQSWNLNC

SEQ ID NO: 314709 - protein, 9 aa, Homo Sapiens
IKRDPALKI

SEQ ID NO: 314710 - protein, 9 aa, Homo Sapiens
LRKLKNSHG

SEQ ID NO: 314711 - protein, 9 aa, Homo Sapiens
PWLLFTVGA

SEQ ID NO: 314712 - protein, 9 aa, Homo Sapiens
TKEDNCCVG

SEQ ID NO: 314713 - protein, 9 aa, Homo Sapiens
DKKKENKSL

SEQ ID NO: 314714 - protein, 9 aa, Homo Sapiens
REAMQNYLK

SEQ ID NO: 314715 - protein, 9 aa, Homo Sapiens
CLNKALPVN

SEQ ID NO: 314716 - protein, 9 aa, Homo Sapiens
NDNPSPTQQ

SEQ ID NO: 314717 - protein, 9 aa, Homo Sapiens
YKQYTGRGP

SEQ ID NO: 314718 - protein, 9 aa, Homo Sapiens
LEREQEQQR

SEQ ID NO: 314719 - protein, 9 aa, Homo Sapiens
PSAVELRRN

SEQ ID NO: 314720 - protein, 9 aa, Homo Sapiens
LFYFIPSQL

SEQ ID NO: 314721 - protein, 9 aa, Homo Sapiens
YIHRASLLQ

SEQ ID NO: 314722 - protein, 9 aa, Homo Sapiens
PGVFSFIDP

SEQ ID NO: 314723 - protein, 9 aa, Homo Sapiens
QAADLLQDM

SEQ ID NO: 314724 - protein, 9 aa, Homo Sapiens
LKSRSVDCR

SEQ ID NO: 314725 - protein, 9 aa, Homo Sapiens
SYLAQHWII

SEQ ID NO: 314726 - protein, 9 aa, Homo Sapiens
QQQRQQFLE

SEQ ID NO: 314727 - protein, 9 aa, Homo Sapiens
HGMSDLLFL

SEQ ID NO: 314728 - protein, 9 aa, Homo Sapiens
IQDSIVNNS

SEQ ID NO: 314729 - protein, 9 aa, Homo Sapiens
LCQRHETTH

SEQ ID NO: 314730 - protein, 9 aa, Homo Sapiens
CSAPLPLEN

SEQ ID NO: 314731 - protein, 9 aa, Homo Sapiens
GSLWWTYAS

SEQ ID NO: 314732 - protein, 9 aa, Homo Sapiens
ERIQEVTGS

SEQ ID NO: 314733 - protein, 9 aa, Homo Sapiens
NNHDIRSGK

SEQ ID NO: 314734 - protein, 9 aa, Homo Sapiens
MTKPTTIIK

SEQ ID NO: 314735 - protein, 9 aa, Homo Sapiens
NQSKKKGPH

SEQ ID NO: 314736 - protein, 9 aa, Homo Sapiens
LYLGCNKLA

SEQ ID NO: 314737 - protein, 9 aa, Homo Sapiens
QCCPVCPDK

SEQ ID NO: 314738 - protein, 9 aa, Homo Sapiens
EQLEQGDKP

SEQ ID NO: 314739 - protein, 9 aa, Homo Sapiens
VPKLQPHLG

SEQ ID NO: 314740 - protein, 9 aa, Homo Sapiens
PQLPPACAV

SEQ ID NO: 314741 - protein, 9 aa, Homo Sapiens
SRVKGREAL

SEQ ID NO: 314742 - protein, 9 aa, Homo Sapiens
SRGKNSFCG

SEQ ID NO: 314743 - protein, 9 aa, Homo Sapiens
ISILYLSEK

SEQ ID NO: 314744 - protein, 9 aa, Homo Sapiens
AALLQEYLE

SEQ ID NO: 314745 - protein, 9 aa, Homo Sapiens
TTKGHDGSK

SEQ ID NO: 314746 - protein, 9 aa, Homo Sapiens
IVFGSQVDD

SEQ ID NO: 314747 - protein, 9 aa, Homo Sapiens
VAKMDPIIS

SEQ ID NO: 314748 - protein, 9 aa, Homo Sapiens
IEIKTKKKL

SEQ ID NO: 314749 - protein, 9 aa, Homo Sapiens
NLAGGHVKF

SEQ ID NO: 314750 - protein, 9 aa, Homo Sapiens
DEFVCQIMY

SEQ ID NO: 314751 - protein, 9 aa, Homo Sapiens
NNGSFCSRL

SEQ ID NO: 314752 - protein, 9 aa, Homo Sapiens
IIRNYNDTF

SEQ ID NO: 314753 - protein, 9 aa, Homo Sapiens
CEDLARLII

SEQ ID NO: 314754 - protein, 9 aa, Homo Sapiens
RTQQIQDEI

SEQ ID NO: 314755 - protein, 9 aa, Homo Sapiens
GGKVNYEKF

SEQ ID NO: 314756 - protein, 9 aa, Homo Sapiens
AGPAIIRHK

SEQ ID NO: 314757 - protein, 9 aa, Homo Sapiens
VNLPAALNY

SEQ ID NO: 314758 - protein, 9 aa, Homo Sapiens
VKCIYVVQA

SEQ ID NO: 314759 - protein, 9 aa, Homo Sapiens
QPWTQEAVG

SEQ ID NO: 314760 - protein, 9 aa, Homo Sapiens
PAPFAMINV

SEQ ID NO: 314761 - protein, 9 aa, Homo Sapiens
GVDPDHFYV

SEQ ID NO: 314762 - protein, 9 aa, Homo Sapiens
PSATPTTAG

SEQ ID NO: 314763 - protein, 9 aa, Homo Sapiens
KYNGAVLTK

SEQ ID NO: 314764 - protein, 9 aa, Homo Sapiens
ASTHLTHQI

SEQ ID NO: 314765 - protein, 9 aa, Homo Sapiens
SSEIILPML

SEQ ID NO: 314766 - protein, 9 aa, Homo Sapiens
GEVLLEELS

SEQ ID NO: 314767 - protein, 9 aa, Homo Sapiens
NNLREVRGH

SEQ ID NO: 314768 - protein, 9 aa, Homo Sapiens
KFMKGHKHT

SEQ ID NO: 314769 - protein, 9 aa, Homo Sapiens
QKIHSEGFI

SEQ ID NO: 314770 - protein, 9 aa, Homo Sapiens
SYLREQGQA

SEQ ID NO: 314771 - protein, 9 aa, Homo Sapiens
VPFKTKYSP

SEQ ID NO: 314772 - protein, 9 aa, Homo Sapiens
TLPPLLPYD

SEQ ID NO: 314773 - protein, 9 aa, Homo Sapiens
ATTQCQITN

SEQ ID NO: 314774 - protein, 9 aa, Homo Sapiens
DDDKILPLN

SEQ ID NO: 314775 - protein, 9 aa, Homo Sapiens
HHHTNLLII

SEQ ID NO: 314776 - protein, 9 aa, Homo Sapiens
YFFGLDTNS

SEQ ID NO: 314777 - protein, 9 aa, Homo Sapiens
WKLHVRGAP

SEQ ID NO: 314778 - protein, 9 aa, Homo Sapiens
GPPQPQSLA

SEQ ID NO: 314779 - protein, 9 aa, Homo Sapiens
IVHSIVSYF

SEQ ID NO: 314780 - protein, 9 aa, Homo Sapiens
TQKNLNNSQ

SEQ ID NO: 314781 - protein, 9 aa, Homo Sapiens
EKENIRNNS

SEQ ID NO: 314782 - protein, 9 aa, Homo Sapiens
QFEINFDRQ

SEQ ID NO: 314783 - protein, 9 aa, Homo Sapiens
LPKFTIKNE

SEQ ID NO: 314784 - protein, 9 aa, Homo Sapiens
VLWVLRPLK

SEQ ID NO: 314785 - protein, 9 aa, Homo Sapiens
ERNKIEDLE

SEQ ID NO: 314786 - protein, 9 aa, Homo Sapiens
NYQTMHGRA

SEQ ID NO: 314787 - protein, 9 aa, Homo Sapiens
RLLSERLLQ

SEQ ID NO: 314788 - protein, 9 aa, Homo Sapiens
DKPIFFESV

SEQ ID NO: 314789 - protein, 9 aa, Homo Sapiens
GTKVFKSYS

SEQ ID NO: 314790 - protein, 9 aa, Homo Sapiens
EEKNNNLQE

SEQ ID NO: 314791 - protein, 9 aa, Homo Sapiens
AYIDIQLQI

SEQ ID NO: 314792 - protein, 9 aa, Homo Sapiens
VSGKLFEYT

SEQ ID NO: 314793 - protein, 9 aa, Homo Sapiens
STLESGLTN

SEQ ID NO: 314794 - protein, 9 aa, Homo Sapiens
LHNYQRINH

SEQ ID NO: 314795 - protein, 9 aa, Homo Sapiens
TELVDGMLS

SEQ ID NO: 314796 - protein, 9 aa, Homo Sapiens
SIPCVLGWN

SEQ ID NO: 314797 - protein, 9 aa, Homo Sapiens
HIPQNIKFY

SEQ ID NO: 314798 - protein, 9 aa, Homo Sapiens
QPVIKLYII

SEQ ID NO: 314799 - protein, 9 aa, Homo Sapiens
HLNLPKRID

SEQ ID NO: 314800 - protein, 9 aa, Homo Sapiens
KDVVNNITA

SEQ ID NO: 314801 - protein, 9 aa, Homo Sapiens
VKAKLGWPA

SEQ ID NO: 314802 - protein, 9 aa, Homo Sapiens
AGITDIKLS

SEQ ID NO: 314803 - protein, 9 aa, Homo Sapiens
DGVRFIANH

SEQ ID NO: 314804 - protein, 9 aa, Homo Sapiens
DLSHAFQKE

SEQ ID NO: 314805 - protein, 9 aa, Homo Sapiens
SASGARPTS

SEQ ID NO: 314806 - protein, 9 aa, Homo Sapiens
LIQKHPQHN

SEQ ID NO: 314807 - protein, 9 aa, Homo Sapiens
TFTLSVVAS

SEQ ID NO: 314808 - protein, 9 aa, Homo Sapiens
GTKTINSIQ

SEQ ID NO: 314809 - protein, 9 aa, Homo Sapiens
CEKAFCKNY

SEQ ID NO: 314810 - protein, 9 aa, Homo Sapiens
ENSTPDKTD

SEQ ID NO: 314811 - protein, 9 aa, Homo Sapiens
MSSIDEYKN

SEQ ID NO: 314812 - protein, 9 aa, Homo Sapiens
LHYRTFDGL

SEQ ID NO: 314813 - protein, 9 aa, Homo Sapiens
KASPYTRCK

SEQ ID NO: 314814 - protein, 9 aa, Homo Sapiens
SAFTGKTEP

SEQ ID NO: 314815 - protein, 9 aa, Homo Sapiens
MVSMSIVKA

SEQ ID NO: 314816 - protein, 9 aa, Homo Sapiens
VGDLMLYFI

SEQ ID NO: 314817 - protein, 9 aa, Homo Sapiens
QIIGKGQIT

SEQ ID NO: 314818 - protein, 9 aa, Homo Sapiens
LWDAPPAWG

SEQ ID NO: 314819 - protein, 9 aa, Homo Sapiens
ALLQKHPAP

SEQ ID NO: 314820 - protein, 9 aa, Homo Sapiens
VIILAIIQG

SEQ ID NO: 314821 - protein, 9 aa, Homo Sapiens
TKYEFAVQL

SEQ ID NO: 314822 - protein, 9 aa, Homo Sapiens
QNEQVRQRA

SEQ ID NO: 314823 - protein, 9 aa, Homo Sapiens
KHMTQLKEA

SEQ ID NO: 314824 - protein, 9 aa, Homo Sapiens
VGVGKSALT

SEQ ID NO: 314825 - protein, 9 aa, Homo Sapiens
EMCVSPDQS

SEQ ID NO: 314826 - protein, 9 aa, Homo Sapiens
PFLKSDHPL

SEQ ID NO: 314827 - protein, 9 aa, Homo Sapiens
GQQLTSQPM

SEQ ID NO: 314828 - protein, 9 aa, Homo Sapiens
TSKRPPLRG

SEQ ID NO: 314829 - protein, 9 aa, Homo Sapiens
CFCNWRDHI

SEQ ID NO: 314830 - protein, 9 aa, Homo Sapiens
TNELLKAAK

SEQ ID NO: 314831 - protein, 9 aa, Homo Sapiens
YNYYGWQAE

SEQ ID NO: 314832 - protein, 9 aa, Homo Sapiens
IVCRCNMEG

SEQ ID NO: 314833 - protein, 9 aa, Homo Sapiens
LPGQAGDAP

SEQ ID NO: 314834 - protein, 9 aa, Homo Sapiens
TTNMDNPER

SEQ ID NO: 314835 - protein, 9 aa, Homo Sapiens
GNWNLTIRR

SEQ ID NO: 314836 - protein, 9 aa, Homo Sapiens
NQHIPGDDS

SEQ ID NO: 314837 - protein, 9 aa, Homo Sapiens
RPVIQINAS

SEQ ID NO: 314838 - protein, 9 aa, Homo Sapiens
KGIYVMGFN

SEQ ID NO: 314839 - protein, 9 aa, Homo Sapiens
KPTDIHPKT

SEQ ID NO: 314840 - protein, 9 aa, Homo Sapiens
SFIHSIIQV

SEQ ID NO: 314841 - protein, 9 aa, Homo Sapiens
GSFIHSIIQ

SEQ ID NO: 314842 - protein, 9 aa, Homo Sapiens
IHCVLQMYI

SEQ ID NO: 314843 - protein, 9 aa, Homo Sapiens
AIFLCNSSV

SEQ ID NO: 314844 - protein, 9 aa, Homo Sapiens
TPLSPGYIS

SEQ ID NO: 314845 - protein, 9 aa, Homo Sapiens
QQLLQDYIE

SEQ ID NO: 314846 - protein, 9 aa, Homo Sapiens
RQTAHSPAS

SEQ ID NO: 314847 - protein, 9 aa, Homo Sapiens
PSRPLNGPL

SEQ ID NO: 314848 - protein, 9 aa, Homo Sapiens
EDVSLAVFR

SEQ ID NO: 314849 - protein, 9 aa, Homo Sapiens
AKEGETNEL

SEQ ID NO: 314850 - protein, 9 aa, Homo Sapiens
VRGWLAHTH

SEQ ID NO: 314851 - protein, 9 aa, Homo Sapiens
HVCACPGRD

SEQ ID NO: 314852 - protein, 9 aa, Homo Sapiens
TDSLQTTQS

SEQ ID NO: 314853 - protein, 9 aa, Homo Sapiens
WVKADCFCN

SEQ ID NO: 314854 - protein, 9 aa, Homo Sapiens
TVGHQSRSR

SEQ ID NO: 314855 - protein, 9 aa, Homo Sapiens
VVGAVGVGK

SEQ ID NO: 314856 - protein, 9 aa, Homo Sapiens
EEYNYYGWQ

SEQ ID NO: 314857 - protein, 9 aa, Homo Sapiens
INEIPAAFE

SEQ ID NO: 314858 - protein, 9 aa, Homo Sapiens
GFKFHLGTL

SEQ ID NO: 314859 - protein, 9 aa, Homo Sapiens
IYVMGFNRP

SEQ ID NO: 314860 - protein, 9 aa, Homo Sapiens
PLPNLRMVR

SEQ ID NO: 314861 - protein, 9 aa, Homo Sapiens
TVISGMPTV

SEQ ID NO: 314862 - protein, 9 aa, Homo Sapiens
TKGRAGLVP

SEQ ID NO: 314863 - protein, 9 aa, Homo Sapiens
QTRAVACTC

SEQ ID NO: 314864 - protein, 9 aa, Homo Sapiens
GQAGDAPDH

SEQ ID NO: 314865 - protein, 9 aa, Homo Sapiens
YKSICSRGC

SEQ ID NO: 314866 - protein, 9 aa, Homo Sapiens
GRSPMLARM

SEQ ID NO: 314867 - protein, 9 aa, Homo Sapiens
WEAVGPLPK

SEQ ID NO: 314868 - protein, 9 aa, Homo Sapiens
ITNQWEAVG

SEQ ID NO: 314869 - protein, 9 aa, Homo Sapiens
CYFSQLLRR

SEQ ID NO: 314870 - protein, 9 aa, Homo Sapiens
LGLSAGTSP

SEQ ID NO: 314871 - protein, 9 aa, Homo Sapiens
IVDGQIIIY

SEQ ID NO: 314872 - protein, 9 aa, Homo Sapiens
RCFLTVVKV

SEQ ID NO: 314873 - protein, 9 aa, Homo Sapiens
YFKGIIQDV

SEQ ID NO: 314874 - protein, 9 aa, Homo Sapiens
LTSQPMCIV

SEQ ID NO: 314875 - protein, 9 aa, Homo Sapiens
RHSSTYGEE

SEQ ID NO: 314876 - protein, 9 aa, Homo Sapiens
EAVGPLPKA

SEQ ID NO: 314877 - protein, 9 aa, Homo Sapiens
GINMTGFRL

SEQ ID NO: 314878 - protein, 9 aa, Homo Sapiens
SFWPGGYPA

SEQ ID NO: 314879 - protein, 9 aa, Homo Sapiens
KFLVYTYNE

SEQ ID NO: 314880 - protein, 9 aa, Homo Sapiens
ANYLEDRKK

SEQ ID NO: 314881 - protein, 9 aa, Homo Sapiens
QRYDQGGKF

SEQ ID NO: 314882 - protein, 9 aa, Homo Sapiens
LPYSFFVPR

SEQ ID NO: 314883 - protein, 9 aa, Homo Sapiens
EQKTVISGM

SEQ ID NO: 314884 - protein, 9 aa, Homo Sapiens
RQHRQTAHS

SEQ ID NO: 314885 - protein, 9 aa, Homo Sapiens
ADRGVNAEF

SEQ ID NO: 314886 - protein, 9 aa, Homo Sapiens
TEGLTPDDI

SEQ ID NO: 314887 - protein, 9 aa, Homo Sapiens
AQYLLPEEV

SEQ ID NO: 314888 - protein, 9 aa, Homo Sapiens
QQVILRCSP

SEQ ID NO: 314889 - protein, 9 aa, Homo Sapiens
DYIEACSLP

SEQ ID NO: 314890 - protein, 9 aa, Homo Sapiens
EEFNIEKGC

SEQ ID NO: 314891 - protein, 9 aa, Homo Sapiens
CEEYNYYGW

SEQ ID NO: 314892 - protein, 9 aa, Homo Sapiens
MRKELCTLQ

SEQ ID NO: 314893 - protein, 9 aa, Homo Sapiens
LGTHVLSLV

SEQ ID NO: 314894 - protein, 9 aa, Homo Sapiens
TLPLPNLRM

SEQ ID NO: 314895 - protein, 9 aa, Homo Sapiens
KSDHPLGHI

SEQ ID NO: 314896 - protein, 9 aa, Homo Sapiens
SSTYGEESN

SEQ ID NO: 314897 - protein, 9 aa, Homo Sapiens
FSLKKIIYA

SEQ ID NO: 314898 - protein, 9 aa, Homo Sapiens
EWKVKFPEL

SEQ ID NO: 314899 - protein, 9 aa, Homo Sapiens
VKVHFQFLT

SEQ ID NO: 314900 - protein, 9 aa, Homo Sapiens
ISTKGLNIP

SEQ ID NO: 314901 - protein, 9 aa, Homo Sapiens
GGYPAYSKD

SEQ ID NO: 314902 - protein, 9 aa, Homo Sapiens
LGHISGPEV

SEQ ID NO: 314903 - protein, 9 aa, Homo Sapiens
DSIYVTKII

SEQ ID NO: 314904 - protein, 9 aa, Homo Sapiens
TGDAPSAFW

SEQ ID NO: 314905 - protein, 9 aa, Homo Sapiens
AAATASGGG

SEQ ID NO: 314906 - protein, 9 aa, Homo Sapiens
IDAVYENRD

SEQ ID NO: 314907 - protein, 9 aa, Homo Sapiens
SFNLNNTSK

SEQ ID NO: 314908 - protein, 9 aa, Homo Sapiens
KLVVVGAVG

SEQ ID NO: 314909 - protein, 9 aa, Homo Sapiens
HLGNAGLLA

SEQ ID NO: 314910 - protein, 9 aa, Homo Sapiens
YRYSGINMT

SEQ ID NO: 314911 - protein, 9 aa, Homo Sapiens
DLPGQAGDA

SEQ ID NO: 314912 - protein, 9 aa, Homo Sapiens
TSVVQVTVT

SEQ ID NO: 314913 - protein, 9 aa, Homo Sapiens
HIPGDDSIY

SEQ ID NO: 314914 - protein, 9 aa, Homo Sapiens
AAQYLLPEE

SEQ ID NO: 314915 - protein, 9 aa, Homo Sapiens
VSPDQSDTA

SEQ ID NO: 314916 - protein, 9 aa, Homo Sapiens
YLFFHFGIS

SEQ ID NO: 314917 - protein, 9 aa, Homo Sapiens
ELLCVWVSS

SEQ ID NO: 314918 - protein, 9 aa, Homo Sapiens
QRFLKLLSC

SEQ ID NO: 314919 - protein, 9 aa, Homo Sapiens
TMEPGTEAM

SEQ ID NO: 314920 - protein, 9 aa, Homo Sapiens
EKGQMATME

SEQ ID NO: 314921 - protein, 9 aa, Homo Sapiens
EPADCSQES

SEQ ID NO: 314922 - protein, 9 aa, Homo Sapiens
NSFEVHVCA

SEQ ID NO: 314923 - protein, 9 aa, Homo Sapiens
SGMPTVIPP

SEQ ID NO: 314924 - protein, 9 aa, Homo Sapiens
GEEAEPADC

SEQ ID NO: 314925 - protein, 9 aa, Homo Sapiens
TVVLKVRLG

SEQ ID NO: 314926 - protein, 9 aa, Homo Sapiens
NYLEDRKKW

SEQ ID NO: 314927 - protein, 9 aa, Homo Sapiens
EVHISTVEE

SEQ ID NO: 314928 - protein, 9 aa, Homo Sapiens
KLNAIMSEH

SEQ ID NO: 314929 - protein, 9 aa, Homo Sapiens
QPLINHLSH

SEQ ID NO: 314930 - protein, 9 aa, Homo Sapiens
TRAEDLPGQ

SEQ ID NO: 314931 - protein, 9 aa, Homo Sapiens
RQSVKRTID

SEQ ID NO: 314932 - protein, 9 aa, Homo Sapiens
RLYVCSVRN

SEQ ID NO: 314933 - protein, 9 aa, Homo Sapiens
SWIHCVLQM

SEQ ID NO: 314934 - protein, 9 aa, Homo Sapiens
YIVDGQIII

SEQ ID NO: 314935 - protein, 9 aa, Homo Sapiens
GGLGFSVVV

SEQ ID NO: 314936 - protein, 9 aa, Homo Sapiens
RKRHSSTYG

SEQ ID NO: 314937 - protein, 9 aa, Homo Sapiens
TRGQQVILR

SEQ ID NO: 314938 - protein, 9 aa, Homo Sapiens
MDAAQYLLP

SEQ ID NO: 314939 - protein, 9 aa, Homo Sapiens
VTDADDPTY

SEQ ID NO: 314940 - protein, 9 aa, Homo Sapiens
GRKRHSSTY

SEQ ID NO: 314941 - protein, 9 aa, Homo Sapiens
TNMDNPERT

SEQ ID NO: 314942 - protein, 9 aa, Homo Sapiens
PARCEEYNY

SEQ ID NO: 314943 - protein, 9 aa, Homo Sapiens
ATMEPGTEA

SEQ ID NO: 314944 - protein, 9 aa, Homo Sapiens
LSAQQTEQQ

SEQ ID NO: 314945 - protein, 9 aa, Homo Sapiens
VLNDSSSQE

SEQ ID NO: 314946 - protein, 9 aa, Homo Sapiens
RCEEYNYYG

SEQ ID NO: 314947 - protein, 9 aa, Homo Sapiens
SLNHLDLRG

SEQ ID NO: 314948 - protein, 9 aa, Homo Sapiens
FHFGISQSV

SEQ ID NO: 314949 - protein, 9 aa, Homo Sapiens
RKHFVGEKR

SEQ ID NO: 314950 - protein, 9 aa, Homo Sapiens
SLLFFFSPQ

SEQ ID NO: 314951 - protein, 9 aa, Homo Sapiens
RFSLLFFFS

SEQ ID NO: 314952 - protein, 9 aa, Homo Sapiens
DRKKWVKAD

SEQ ID NO: 314953 - protein, 9 aa, Homo Sapiens
VHISTVEER

SEQ ID NO: 314954 - protein, 9 aa, Homo Sapiens
DAQRVHIKA

SEQ ID NO: 314955 - protein, 9 aa, Homo Sapiens
PGRRQDRGG

SEQ ID NO: 314956 - protein, 9 aa, Homo Sapiens
IHPKTTGLS

SEQ ID NO: 314957 - protein, 9 aa, Homo Sapiens
KFSDSRIAL

SEQ ID NO: 314958 - protein, 9 aa, Homo Sapiens
TVLLQEVAA

SEQ ID NO: 314959 - protein, 9 aa, Homo Sapiens
KKIKIFFCT

SEQ ID NO: 314960 - protein, 9 aa, Homo Sapiens
RSLGLSAGT

SEQ ID NO: 314961 - protein, 9 aa, Homo Sapiens
KGNVSKDVR

SEQ ID NO: 314962 - protein, 9 aa, Homo Sapiens
FLPQKFLVY

SEQ ID NO: 314963 - protein, 9 aa, Homo Sapiens
WNLTIRRVR

SEQ ID NO: 314964 - protein, 9 aa, Homo Sapiens
VSKDVRSEG

SEQ ID NO: 314965 - protein, 9 aa, Homo Sapiens
PSRHGKSES

SEQ ID NO: 314966 - protein, 9 aa, Homo Sapiens
FKLAKSWPM

SEQ ID NO: 314967 - protein, 9 aa, Homo Sapiens
VSMSANPAP

SEQ ID NO: 314968 - protein, 9 aa, Homo Sapiens
SAQDAVRGC

SEQ ID NO: 314969 - protein, 9 aa, Homo Sapiens
WSRPVIQIN

SEQ ID NO: 314970 - protein, 9 aa, Homo Sapiens
QVEHLEEEH

SEQ ID NO: 314971 - protein, 9 aa, Homo Sapiens
DLSSSINEI

SEQ ID NO: 314972 - protein, 9 aa, Homo Sapiens
FFHFGISQS

SEQ ID NO: 314973 - protein, 9 aa, Homo Sapiens
MRQSVKRTI

SEQ ID NO: 314974 - protein, 9 aa, Homo Sapiens
QRVHIKALE

SEQ ID NO: 314975 - protein, 9 aa, Homo Sapiens
YGEESNRHR

SEQ ID NO: 314976 - protein, 9 aa, Homo Sapiens
REWKVKFPE

SEQ ID NO: 314977 - protein, 9 aa, Homo Sapiens
KRTIDSEDT

SEQ ID NO: 314978 - protein, 9 aa, Homo Sapiens
VAAIFLCNS

SEQ ID NO: 314979 - protein, 9 aa, Homo Sapiens
DIHPKTTGL

SEQ ID NO: 314980 - protein, 9 aa, Homo Sapiens
KFTSEMIIH

SEQ ID NO: 314981 - protein, 9 aa, Homo Sapiens
RFLADCFVE

SEQ ID NO: 314982 - protein, 9 aa, Homo Sapiens
NAADDKLWQ

SEQ ID NO: 314983 - protein, 9 aa, Homo Sapiens
NHLGNAGLL

SEQ ID NO: 314984 - protein, 9 aa, Homo Sapiens
FETVGHQSR

SEQ ID NO: 314985 - protein, 9 aa, Homo Sapiens
DAAQYLLPE

SEQ ID NO: 314986 - protein, 9 aa, Homo Sapiens
KRYPKDRVL

SEQ ID NO: 314987 - protein, 9 aa, Homo Sapiens
WGYDDRDYY

SEQ ID NO: 314988 - protein, 9 aa, Homo Sapiens
ITSYIVDGQ

SEQ ID NO: 314989 - protein, 9 aa, Homo Sapiens
LEEWKCLDT

SEQ ID NO: 314990 - protein, 9 aa, Homo Sapiens
RSWIHCVLQ

SEQ ID NO: 314991 - protein, 9 aa, Homo Sapiens
PDDIPALAD

SEQ ID NO: 314992 - protein, 9 aa, Homo Sapiens
MCVSPDQSD

SEQ ID NO: 314993 - protein, 9 aa, Homo Sapiens
LLCVWVSSI

SEQ ID NO: 314994 - protein, 9 aa, Homo Sapiens
PGQAGDAPD

SEQ ID NO: 314995 - protein, 9 aa, Homo Sapiens
VRSWIHCVL

SEQ ID NO: 314996 - protein, 9 aa, Homo Sapiens
LLVLCCQAW

SEQ ID NO: 314997 - protein, 9 aa, Homo Sapiens
AVKFSDSRI

SEQ ID NO: 314998 - protein, 9 aa, Homo Sapiens
RGMGFIRFD

SEQ ID NO: 314999 - protein, 9 aa, Homo Sapiens
RVRGWLAHT

SEQ ID NO: 315000 - protein, 9 aa, Homo Sapiens
LLTTNMDNP

SEQ ID NO: 315001 - protein, 9 aa, Homo Sapiens
VPTSKRPPL

SEQ ID NO: 315002 - protein, 9 aa, Homo Sapiens
QVILRCSPK

SEQ ID NO: 315003 - protein, 9 aa, Homo Sapiens
CSQESSTLE

SEQ ID NO: 315004 - protein, 9 aa, Homo Sapiens
AADDKLWQS

SEQ ID NO: 315005 - protein, 9 aa, Homo Sapiens
LICDIDGYQ

SEQ ID NO: 315006 - protein, 9 aa, Homo Sapiens
VRDEMDHMV

SEQ ID NO: 315007 - protein, 9 aa, Homo Sapiens
RPLPTCVTE

SEQ ID NO: 315008 - protein, 9 aa, Homo Sapiens
YDHSWVLLS

SEQ ID NO: 315009 - protein, 9 aa, Homo Sapiens
NVSEYAYRC

SEQ ID NO: 315010 - protein, 9 aa, Homo Sapiens
RLFHDRKHF

SEQ ID NO: 315011 - protein, 9 aa, Homo Sapiens
KHSRLYVCS

SEQ ID NO: 315012 - protein, 9 aa, Homo Sapiens
APTSTQPGS

SEQ ID NO: 315013 - protein, 9 aa, Homo Sapiens
MEQKTVISG

SEQ ID NO: 315014 - protein, 9 aa, Homo Sapiens
PPALLTTNM

SEQ ID NO: 315015 - protein, 9 aa, Homo Sapiens
IIQDVQLLV

SEQ ID NO: 315016 - protein, 9 aa, Homo Sapiens
IPALADRVR

SEQ ID NO: 315017 - protein, 9 aa, Homo Sapiens
TRGTARASK

SEQ ID NO: 315018 - protein, 9 aa, Homo Sapiens
LVALSWRGS

SEQ ID NO: 315019 - protein, 9 aa, Homo Sapiens
LAVLALLSF

SEQ ID NO: 315020 - protein, 9 aa, Homo Sapiens
TSQPMCIVP

SEQ ID NO: 315021 - protein, 9 aa, Homo Sapiens
NSAITGGVI

SEQ ID NO: 315022 - protein, 9 aa, Homo Sapiens
EMEQVGQVE

SEQ ID NO: 315023 - protein, 9 aa, Homo Sapiens
PNLRMVRGT

SEQ ID NO: 315024 - protein, 9 aa, Homo Sapiens
PPPSSSLSA

SEQ ID NO: 315025 - protein, 9 aa, Homo Sapiens
ATRRKEEAF

SEQ ID NO: 315026 - protein, 9 aa, Homo Sapiens
VAATRAEDL

SEQ ID NO: 315027 - protein, 9 aa, Homo Sapiens
VNGVASKVK

SEQ ID NO: 315028 - protein, 9 aa, Homo Sapiens
TLPSRHGKS

SEQ ID NO: 315029 - protein, 9 aa, Homo Sapiens
GIIQDVQLL

SEQ ID NO: 315030 - protein, 9 aa, Homo Sapiens
KTTGLSLTS

SEQ ID NO: 315031 - protein, 9 aa, Homo Sapiens
QVEQDLANE

SEQ ID NO: 315032 - protein, 9 aa, Homo Sapiens
ENRDGNFVF

SEQ ID NO: 315033 - protein, 9 aa, Homo Sapiens
DRGEIVKFL

SEQ ID NO: 315034 - protein, 9 aa, Homo Sapiens
RKKWVKADC

SEQ ID NO: 315035 - protein, 9 aa, Homo Sapiens
EQYMVNGIM

SEQ ID NO: 315036 - protein, 9 aa, Homo Sapiens
YDWGYDDRD

SEQ ID NO: 315037 - protein, 9 aa, Homo Sapiens
EDMQTTSIM

SEQ ID NO: 315038 - protein, 9 aa, Homo Sapiens
RGYDWGYDD

SEQ ID NO: 315039 - protein, 9 aa, Homo Sapiens
EKGCLVQTQ

SEQ ID NO: 315040 - protein, 9 aa, Homo Sapiens
NLFKAVSLN

SEQ ID NO: 315041 - protein, 9 aa, Homo Sapiens
WPMLNMLIK

SEQ ID NO: 315042 - protein, 9 aa, Homo Sapiens
TSSSREWKV

SEQ ID NO: 315043 - protein, 9 aa, Homo Sapiens
EAPPSFSGT

SEQ ID NO: 315044 - protein, 9 aa, Homo Sapiens
SLGLSAGTS

SEQ ID NO: 315045 - protein, 9 aa, Homo Sapiens
LSAGTSPPS

SEQ ID NO: 315046 - protein, 9 aa, Homo Sapiens
QEVAATRAE

SEQ ID NO: 315047 - protein, 9 aa, Homo Sapiens
MEQVGQVEH

SEQ ID NO: 315048 - protein, 9 aa, Homo Sapiens
KRHSSTYGE

SEQ ID NO: 315049 - protein, 9 aa, Homo Sapiens
AYRCLMSPE

SEQ ID NO: 315050 - protein, 9 aa, Homo Sapiens
VFRILKSFN

SEQ ID NO: 315051 - protein, 9 aa, Homo Sapiens
IEKGCLVQT

SEQ ID NO: 315052 - protein, 9 aa, Homo Sapiens
EVDRGEIVK

SEQ ID NO: 315053 - protein, 9 aa, Homo Sapiens
QHIPGDDSI

SEQ ID NO: 315054 - protein, 9 aa, Homo Sapiens
CDIDGYQGP

SEQ ID NO: 315055 - protein, 9 aa, Homo Sapiens
DHPLGHISG

SEQ ID NO: 315056 - protein, 9 aa, Homo Sapiens
AAVVATGDK

SEQ ID NO: 315057 - protein, 9 aa, Homo Sapiens
AGRSLGLSA

SEQ ID NO: 315058 - protein, 9 aa, Homo Sapiens
HCKLPQFCA

SEQ ID NO: 315059 - protein, 9 aa, Homo Sapiens
AATASGGGG

SEQ ID NO: 315060 - protein, 9 aa, Homo Sapiens
KALHSTHEA

SEQ ID NO: 315061 - protein, 9 aa, Homo Sapiens
RKPFPQLRP

SEQ ID NO: 315062 - protein, 9 aa, Homo Sapiens
TGGVIAVVI

SEQ ID NO: 315063 - protein, 9 aa, Homo Sapiens
QKIHTGEWP

SEQ ID NO: 315064 - protein, 9 aa, Homo Sapiens
RQFPEPMTV

SEQ ID NO: 315065 - protein, 9 aa, Homo Sapiens
QNDNAPKIL

SEQ ID NO: 315066 - protein, 9 aa, Homo Sapiens
NRRQKGKRI

SEQ ID NO: 315067 - protein, 9 aa, Homo Sapiens
QVALQVLHC

SEQ ID NO: 315068 - protein, 9 aa, Homo Sapiens
EVHVCACPG

SEQ ID NO: 315069 - protein, 9 aa, Homo Sapiens
VVAEVHIST

SEQ ID NO: 315070 - protein, 9 aa, Homo Sapiens
LGFSVVVLR

SEQ ID NO: 315071 - protein, 9 aa, Homo Sapiens
QLLRRHRLR

SEQ ID NO: 315072 - protein, 9 aa, Homo Sapiens
LEDGFKFHL

SEQ ID NO: 315073 - protein, 9 aa, Homo Sapiens
LNDSSSQEN

SEQ ID NO: 315074 - protein, 9 aa, Homo Sapiens
WTWALLLPL

SEQ ID NO: 315075 - protein, 9 aa, Homo Sapiens
VASKVKLII

SEQ ID NO: 315076 - protein, 9 aa, Homo Sapiens
ASKPTTKSQ

SEQ ID NO: 315077 - protein, 9 aa, Homo Sapiens
EAKEGETNE

SEQ ID NO: 315078 - protein, 9 aa, Homo Sapiens
IFLCNSSVT

SEQ ID NO: 315079 - protein, 9 aa, Homo Sapiens
KWVKADCFC

SEQ ID NO: 315080 - protein, 9 aa, Homo Sapiens
DGNWNLTIR

SEQ ID NO: 315081 - protein, 9 aa, Homo Sapiens
HPLGHISGP

SEQ ID NO: 315082 - protein, 9 aa, Homo Sapiens
MEGPYEVLN

SEQ ID NO: 315083 - protein, 9 aa, Homo Sapiens
FLDLLKYAG

SEQ ID NO: 315084 - protein, 9 aa, Homo Sapiens
QKGKRINPP

SEQ ID NO: 315085 - protein, 9 aa, Homo Sapiens
KLQKKKNKE

SEQ ID NO: 315086 - protein, 9 aa, Homo Sapiens
PTAEKREWT

SEQ ID NO: 315087 - protein, 9 aa, Homo Sapiens
AQVRDEMDH

SEQ ID NO: 315088 - protein, 9 aa, Homo Sapiens
PTSKRPPLR

SEQ ID NO: 315089 - protein, 9 aa, Homo Sapiens
LGRNSFEVH

SEQ ID NO: 315090 - protein, 9 aa, Homo Sapiens
AMNITNFWK

SEQ ID NO: 315091 - protein, 9 aa, Homo Sapiens
KADCFCNWR

SEQ ID NO: 315092 - protein, 9 aa, Homo Sapiens
GRRQDRGGH

SEQ ID NO: 315093 - protein, 9 aa, Homo Sapiens
YIEACSLPE

SEQ ID NO: 315094 - protein, 9 aa, Homo Sapiens
LRKHMTQLK

SEQ ID NO: 315095 - protein, 9 aa, Homo Sapiens
TKDDKHEQY

SEQ ID NO: 315096 - protein, 9 aa, Homo Sapiens
EGETNELLK

SEQ ID NO: 315097 - protein, 9 aa, Homo Sapiens
VHIKALEDD

SEQ ID NO: 315098 - protein, 9 aa, Homo Sapiens
NRDGNFVFF

SEQ ID NO: 315099 - protein, 9 aa, Homo Sapiens
GARRQHRQT

SEQ ID NO: 315100 - protein, 9 aa, Homo Sapiens
NLRMVRGTQ

SEQ ID NO: 315101 - protein, 9 aa, Homo Sapiens
WLAHTHYKR

SEQ ID NO: 315102 - protein, 9 aa, Homo Sapiens
LVPPPPKNP

SEQ ID NO: 315103 - protein, 9 aa, Homo Sapiens
INVSEYAYR

SEQ ID NO: 315104 - protein, 9 aa, Homo Sapiens
AKKIHFRMP

SEQ ID NO: 315105 - protein, 9 aa, Homo Sapiens
ILWSRPVIQ

SEQ ID NO: 315106 - protein, 9 aa, Homo Sapiens
CFVEGVCPF

SEQ ID NO: 315107 - protein, 9 aa, Homo Sapiens
FSQLLRRHR

SEQ ID NO: 315108 - protein, 9 aa, Homo Sapiens
PTCVTECGG

SEQ ID NO: 315109 - protein, 9 aa, Homo Sapiens
PSFSGTQLD

SEQ ID NO: 315110 - protein, 9 aa, Homo Sapiens
RRQHRQTAH

SEQ ID NO: 315111 - protein, 9 aa, Homo Sapiens
YVMGFNRPS

SEQ ID NO: 315112 - protein, 9 aa, Homo Sapiens
RDEMDHMVY

SEQ ID NO: 315113 - protein, 9 aa, Homo Sapiens
VGAVGVGKS

SEQ ID NO: 315114 - protein, 9 aa, Homo Sapiens
REYPVPTSK

SEQ ID NO: 315115 - protein, 9 aa, Homo Sapiens
TTNQKKVLK

SEQ ID NO: 315116 - protein, 9 aa, Homo Sapiens
NITNFWKED

SEQ ID NO: 315117 - protein, 9 aa, Homo Sapiens
TTGLSLTSS

SEQ ID NO: 315118 - protein, 9 aa, Homo Sapiens
VVATGDKWK

SEQ ID NO: 315119 - protein, 9 aa, Homo Sapiens
SRLYVCSVR

SEQ ID NO: 315120 - protein, 9 aa, Homo Sapiens
TLEDGFKFH

SEQ ID NO: 315121 - protein, 9 aa, Homo Sapiens
APTAEKREW

SEQ ID NO: 315122 - protein, 9 aa, Homo Sapiens
LNGPLRLGL

SEQ ID NO: 315123 - protein, 9 aa, Homo Sapiens
FCNWRDHIL

SEQ ID NO: 315124 - protein, 9 aa, Homo Sapiens
LPQKFLVYT

SEQ ID NO: 315125 - protein, 9 aa, Homo Sapiens
LPLPTLANA

SEQ ID NO: 315126 - protein, 9 aa, Homo Sapiens
TLAMNITNF

SEQ ID NO: 315127 - protein, 9 aa, Homo Sapiens
ADCFVEGVC

SEQ ID NO: 315128 - protein, 9 aa, Homo Sapiens
MLNMLIKII

SEQ ID NO: 315129 - protein, 9 aa, Homo Sapiens
PGGYPAYSK

SEQ ID NO: 315130 - protein, 9 aa, Homo Sapiens
TSTQPGSGC

SEQ ID NO: 315131 - protein, 9 aa, Homo Sapiens
GASPDYFPA

SEQ ID NO: 315132 - protein, 9 aa, Homo Sapiens
QDLANELIT

SEQ ID NO: 315133 - protein, 9 aa, Homo Sapiens
TMEQKTVIS

SEQ ID NO: 315134 - protein, 9 aa, Homo Sapiens
SRDPEVLRK

SEQ ID NO: 315135 - protein, 9 aa, Homo Sapiens
GCLVQTQRL

SEQ ID NO: 315136 - protein, 9 aa, Homo Sapiens
QVGQVEHLE

SEQ ID NO: 315137 - protein, 9 aa, Homo Sapiens
LALLSFWPG

SEQ ID NO: 315138 - protein, 9 aa, Homo Sapiens
YENRDGNFV

SEQ ID NO: 315139 - protein, 9 aa, Homo Sapiens
AEGEDMQTT

SEQ ID NO: 315140 - protein, 9 aa, Homo Sapiens
DKLWQSLRR

SEQ ID NO: 315141 - protein, 9 aa, Homo Sapiens
QSVKRTIDS

SEQ ID NO: 315142 - protein, 9 aa, Homo Sapiens
AEPADCSQE

SEQ ID NO: 315143 - protein, 9 aa, Homo Sapiens
AAIFLCNSS

SEQ ID NO: 315144 - protein, 9 aa, Homo Sapiens
YDRGYDWGY

SEQ ID NO: 315145 - protein, 9 aa, Homo Sapiens
VEHLEEEHD

SEQ ID NO: 315146 - protein, 9 aa, Homo Sapiens
PLGHISGPE

SEQ ID NO: 315147 - protein, 9 aa, Homo Sapiens
PLSPGYISL

SEQ ID NO: 315148 - protein, 9 aa, Homo Sapiens
AKKIKIFFC

SEQ ID NO: 315149 - protein, 9 aa, Homo Sapiens
DMQTTSIMD

SEQ ID NO: 315150 - protein, 9 aa, Homo Sapiens
TAVKFSDSR

SEQ ID NO: 315151 - protein, 9 aa, Homo Sapiens
GFSVVVLRS

SEQ ID NO: 315152 - protein, 9 aa, Homo Sapiens
HRYNEFKLN

SEQ ID NO: 315153 - protein, 9 aa, Homo Sapiens
EDPNEDPSS

SEQ ID NO: 315154 - protein, 9 aa, Homo Sapiens
EPGRRQDRG

SEQ ID NO: 315155 - protein, 9 aa, Homo Sapiens
PPPPKNPHN

SEQ ID NO: 315156 - protein, 9 aa, Homo Sapiens
RYSGINMTG

SEQ ID NO: 315157 - protein, 9 aa, Homo Sapiens
EIPAAFECS

SEQ ID NO: 315158 - protein, 9 aa, Homo Sapiens
EQVGQVEHL

SEQ ID NO: 315159 - protein, 9 aa, Homo Sapiens
SQPMCIVPP

SEQ ID NO: 315160 - protein, 9 aa, Homo Sapiens
PDHVEPGRR

SEQ ID NO: 315161 - protein, 9 aa, Homo Sapiens
RTPDELDDS

SEQ ID NO: 315162 - protein, 9 aa, Homo Sapiens
IPGDDSIYV

SEQ ID NO: 315163 - protein, 9 aa, Homo Sapiens
INHLSHSYT

SEQ ID NO: 315164 - protein, 9 aa, Homo Sapiens
GYQGPPGPQ

SEQ ID NO: 315165 - protein, 9 aa, Homo Sapiens
MNITNFWKE

SEQ ID NO: 315166 - protein, 9 aa, Homo Sapiens
LNHLDLRGN

SEQ ID NO: 315167 - protein, 9 aa, Homo Sapiens
EDRKKWVKA

SEQ ID NO: 315168 - protein, 9 aa, Homo Sapiens
ISLYSKNGM

SEQ ID NO: 315169 - protein, 9 aa, Homo Sapiens
TGDKWKPPQ

SEQ ID NO: 315170 - protein, 9 aa, Homo Sapiens
SKDVRSEGK

SEQ ID NO: 315171 - protein, 9 aa, Homo Sapiens
GLLTSSSRE

SEQ ID NO: 315172 - protein, 9 aa, Homo Sapiens
TVTDADDPT

SEQ ID NO: 315173 - protein, 9 aa, Homo Sapiens
KDDKHEQYM

SEQ ID NO: 315174 - protein, 9 aa, Homo Sapiens
NAIMSEHKK

SEQ ID NO: 315175 - protein, 9 aa, Homo Sapiens
ALQVLHCKL

SEQ ID NO: 315176 - protein, 9 aa, Homo Sapiens
SRGGLGAAG

SEQ ID NO: 315177 - protein, 9 aa, Homo Sapiens
GRAGLVPPP

SEQ ID NO: 315178 - protein, 9 aa, Homo Sapiens
TRAVACTCR

SEQ ID NO: 315179 - protein, 9 aa, Homo Sapiens
DQGGKFTSE

SEQ ID NO: 315180 - protein, 9 aa, Homo Sapiens
RGWLAHTHY

SEQ ID NO: 315181 - protein, 9 aa, Homo Sapiens
YSKDSGLLT

SEQ ID NO: 315182 - protein, 9 aa, Homo Sapiens
MEGQCMRKV

SEQ ID NO: 315183 - protein, 9 aa, Homo Sapiens
TVRSWIHCV

SEQ ID NO: 315184 - protein, 9 aa, Homo Sapiens
RQKGKRINP

SEQ ID NO: 315185 - protein, 9 aa, Homo Sapiens
HTGEWPYKC

SEQ ID NO: 315186 - protein, 9 aa, Homo Sapiens
RFLKLLSCC

SEQ ID NO: 315187 - protein, 9 aa, Homo Sapiens
LTTNMDNPE

SEQ ID NO: 315188 - protein, 9 aa, Homo Sapiens
GEWPYKCGE

SEQ ID NO: 315189 - protein, 9 aa, Homo Sapiens
LTVVKVHFQ

SEQ ID NO: 315190 - protein, 9 aa, Homo Sapiens
KHSKRKRCE

SEQ ID NO: 315191 - protein, 9 aa, Homo Sapiens
NIPRKSSIV

SEQ ID NO: 315192 - protein, 9 aa, Homo Sapiens
VAACYFSQL

SEQ ID NO: 315193 - protein, 9 aa, Homo Sapiens
GTQLDSSPS

SEQ ID NO: 315194 - protein, 9 aa, Homo Sapiens
PELVLECSL

SEQ ID NO: 315195 - protein, 9 aa, Homo Sapiens
RAAWTWALL

SEQ ID NO: 315196 - protein, 9 aa, Homo Sapiens
SSREWKVKF

SEQ ID NO: 315197 - protein, 9 aa, Homo Sapiens
FFCTGSSCH

SEQ ID NO: 315198 - protein, 9 aa, Homo Sapiens
AYDHSWVLL

SEQ ID NO: 315199 - protein, 9 aa, Homo Sapiens
ARFLADCFV

SEQ ID NO: 315200 - protein, 9 aa, Homo Sapiens
GKFTSEMII

SEQ ID NO: 315201 - protein, 9 aa, Homo Sapiens
YSGINMTGF

SEQ ID NO: 315202 - protein, 9 aa, Homo Sapiens
HSTHEAREA

SEQ ID NO: 315203 - protein, 9 aa, Homo Sapiens
MSANPAPEA

SEQ ID NO: 315204 - protein, 9 aa, Homo Sapiens
GKRINPPSS

SEQ ID NO: 315205 - protein, 9 aa, Homo Sapiens
SFETVGHQS

SEQ ID NO: 315206 - protein, 9 aa, Homo Sapiens
MQTTSIMDA

SEQ ID NO: 315207 - protein, 9 aa, Homo Sapiens
CARFLADCF

SEQ ID NO: 315208 - protein, 9 aa, Homo Sapiens
TGHALNEAH

SEQ ID NO: 315209 - protein, 9 aa, Homo Sapiens
FSLLFFFSP

SEQ ID NO: 315210 - protein, 9 aa, Homo Sapiens
ETVGHQSRS

SEQ ID NO: 315211 - protein, 9 aa, Homo Sapiens
RPLNGPLRL

SEQ ID NO: 315212 - protein, 9 aa, Homo Sapiens
VALQVLHCK

SEQ ID NO: 315213 - protein, 9 aa, Homo Sapiens
QVTGVSRGM

SEQ ID NO: 315214 - protein, 9 aa, Homo Sapiens
RCNMEGQCM

SEQ ID NO: 315215 - protein, 9 aa, Homo Sapiens
RGSFIHSII

SEQ ID NO: 315216 - protein, 9 aa, Homo Sapiens
WVLLSAIEG

SEQ ID NO: 315217 - protein, 9 aa, Homo Sapiens
YNEFKLNAI

SEQ ID NO: 315218 - protein, 9 aa, Homo Sapiens
ICSRGCDLP

SEQ ID NO: 315219 - protein, 9 aa, Homo Sapiens
EAEPADCSQ

SEQ ID NO: 315220 - protein, 9 aa, Homo Sapiens
VLALLSFWP

SEQ ID NO: 315221 - protein, 9 aa, Homo Sapiens
DRKHFVGEK

SEQ ID NO: 315222 - protein, 9 aa, Homo Sapiens
KLWQSLRRF

SEQ ID NO: 315223 - protein, 9 aa, Homo Sapiens
KNAADDKLW

SEQ ID NO: 315224 - protein, 9 aa, Homo Sapiens
PMLNMLIKI

SEQ ID NO: 315225 - protein, 9 aa, Homo Sapiens
KEVQSSLRI

SEQ ID NO: 315226 - protein, 9 aa, Homo Sapiens
LTPDDIPAL

SEQ ID NO: 315227 - protein, 9 aa, Homo Sapiens
FWPGGYPAY

SEQ ID NO: 315228 - protein, 9 aa, Homo Sapiens
HGKSESTTP

SEQ ID NO: 315229 - protein, 9 aa, Homo Sapiens
LQEVAATRA

SEQ ID NO: 315230 - protein, 9 aa, Homo Sapiens
LRMVRGTQV

SEQ ID NO: 315231 - protein, 9 aa, Homo Sapiens
GMLGTHVLS

SEQ ID NO: 315232 - protein, 9 aa, Homo Sapiens
TECGGTVRG

SEQ ID NO: 315233 - protein, 9 aa, Homo Sapiens
EVGTVMTVL

SEQ ID NO: 315234 - protein, 9 aa, Homo Sapiens
SKVKLIILE

SEQ ID NO: 315235 - protein, 9 aa, Homo Sapiens
VLRKHMTQL

SEQ ID NO: 315236 - protein, 9 aa, Homo Sapiens
LARMRKELC

SEQ ID NO: 315237 - protein, 9 aa, Homo Sapiens
FHDRKHFVG

SEQ ID NO: 315238 - protein, 9 aa, Homo Sapiens
HVEPGRRQD

SEQ ID NO: 315239 - protein, 9 aa, Homo Sapiens
CFLTVVKVH

SEQ ID NO: 315240 - protein, 9 aa, Homo Sapiens
NWFATRRKE

SEQ ID NO: 315241 - protein, 9 aa, Homo Sapiens
PQLRPSHTA

SEQ ID NO: 315242 - protein, 9 aa, Homo Sapiens
DIPALADRV

SEQ ID NO: 315243 - protein, 9 aa, Homo Sapiens
GNVSKDVRS

SEQ ID NO: 315244 - protein, 9 aa, Homo Sapiens
PELLCVWVS

SEQ ID NO: 315245 - protein, 9 aa, Homo Sapiens
VILRCSPKS

SEQ ID NO: 315246 - protein, 9 aa, Homo Sapiens
MEMTLEGAV

SEQ ID NO: 315247 - protein, 9 aa, Homo Sapiens
EQDLANELI

SEQ ID NO: 315248 - protein, 9 aa, Homo Sapiens
DRGVNAEFH

SEQ ID NO: 315249 - protein, 9 aa, Homo Sapiens
VALSWRGSF

SEQ ID NO: 315250 - protein, 9 aa, Homo Sapiens
TSAETKHSK

SEQ ID NO: 315251 - protein, 9 aa, Homo Sapiens
LLSCCGPQA

SEQ ID NO: 315252 - protein, 9 aa, Homo Sapiens
RLPGNHLGN

SEQ ID NO: 315253 - protein, 9 aa, Homo Sapiens
YPELVLECS

SEQ ID NO: 315254 - protein, 9 aa, Homo Sapiens
ILRCSPKSG

SEQ ID NO: 315255 - protein, 9 aa, Homo Sapiens
RSPMLARMR

SEQ ID NO: 315256 - protein, 9 aa, Homo Sapiens
YPVPTSKRP

SEQ ID NO: 315257 - protein, 9 aa, Homo Sapiens
DQVEQDLAN

SEQ ID NO: 315258 - protein, 9 aa, Homo Sapiens
SHTTNKRYP

SEQ ID NO: 315259 - protein, 9 aa, Homo Sapiens
ARQGSRGGL

SEQ ID NO: 315260 - protein, 9 aa, Homo Sapiens
YYDRGYDWG

SEQ ID NO: 315261 - protein, 9 aa, Homo Sapiens
LLKYAGLGQ

SEQ ID NO: 315262 - protein, 9 aa, Homo Sapiens
LPVSMSANP

SEQ ID NO: 315263 - protein, 9 aa, Homo Sapiens
YPPALLTTN

SEQ ID NO: 315264 - protein, 9 aa, Homo Sapiens
AETKHSKRK

SEQ ID NO: 315265 - protein, 9 aa, Homo Sapiens
PSAFWPLRD

SEQ ID NO: 315266 - protein, 9 aa, Homo Sapiens
ARCEEYNYY

SEQ ID NO: 315267 - protein, 9 aa, Homo Sapiens
HQKEVQSSL

SEQ ID NO: 315268 - protein, 9 aa, Homo Sapiens
EVLNDSSSQ

SEQ ID NO: 315269 - protein, 9 aa, Homo Sapiens
GDLLVLCCQ

SEQ ID NO: 315270 - protein, 9 aa, Homo Sapiens
IQIHQKEVQ

SEQ ID NO: 315271 - protein, 9 aa, Homo Sapiens
SGLLTSSSR

SEQ ID NO: 315272 - protein, 9 aa, Homo Sapiens
PVIQINASL

SEQ ID NO: 315273 - protein, 9 aa, Homo Sapiens
RKIQIHQKE

SEQ ID NO: 315274 - protein, 9 aa, Homo Sapiens
RIRAAWTWA

SEQ ID NO: 315275 - protein, 9 aa, Homo Sapiens
YDQGGKFTS

SEQ ID NO: 315276 - protein, 9 aa, Homo Sapiens
ALSWRGSFI

SEQ ID NO: 315277 - protein, 9 aa, Homo Sapiens
IFFCTGSSC

SEQ ID NO: 315278 - protein, 9 aa, Homo Sapiens
AHTRLKTQL

SEQ ID NO: 315279 - protein, 9 aa, Homo Sapiens
HCVLQMYIK

SEQ ID NO: 315280 - protein, 9 aa, Homo Sapiens
LQTTQSIQG

SEQ ID NO: 315281 - protein, 9 aa, Homo Sapiens
EQLKALHST

SEQ ID NO: 315282 - protein, 9 aa, Homo Sapiens
LYSKNGMAC

SEQ ID NO: 315283 - protein, 9 aa, Homo Sapiens
SDHPLGHIS

SEQ ID NO: 315284 - protein, 9 aa, Homo Sapiens
KYPELVLEC

SEQ ID NO: 315285 - protein, 9 aa, Homo Sapiens
SFSGTQLDS

SEQ ID NO: 315286 - protein, 9 aa, Homo Sapiens
GYFKGIIQD

SEQ ID NO: 315287 - protein, 9 aa, Homo Sapiens
INMTGFRLL

SEQ ID NO: 315288 - protein, 9 aa, Homo Sapiens
VKLIILENT

SEQ ID NO: 315289 - protein, 9 aa, Homo Sapiens
ACTCRRLTA

SEQ ID NO: 315290 - protein, 9 aa, Homo Sapiens
ARASKPTTK

SEQ ID NO: 315291 - protein, 9 aa, Homo Sapiens
VQVTVTDAD

SEQ ID NO: 315292 - protein, 9 aa, Homo Sapiens
LLPVSMSAN

SEQ ID NO: 315293 - protein, 9 aa, Homo Sapiens
RKHMTQLKE

SEQ ID NO: 315294 - protein, 9 aa, Homo Sapiens
VFSLKKIIY

SEQ ID NO: 315295 - protein, 9 aa, Homo Sapiens
RNSAITGGV

SEQ ID NO: 315296 - protein, 9 aa, Homo Sapiens
HSRLYVCSV

SEQ ID NO: 315297 - protein, 9 aa, Homo Sapiens
CVSPDQSDT

SEQ ID NO: 315298 - protein, 9 aa, Homo Sapiens
QYMVNGIML

SEQ ID NO: 315299 - protein, 9 aa, Homo Sapiens
RSFETVGHQ

SEQ ID NO: 315300 - protein, 9 aa, Homo Sapiens
LAVFRILKS

SEQ ID NO: 315301 - protein, 9 aa, Homo Sapiens
PSHTTNKRY

SEQ ID NO: 315302 - protein, 9 aa, Homo Sapiens
RGTARASKP

SEQ ID NO: 315303 - protein, 9 aa, Homo Sapiens
PMNPFQPIA

SEQ ID NO: 315304 - protein, 9 aa, Homo Sapiens
RSEGKHVRP

SEQ ID NO: 315305 - protein, 9 aa, Homo Sapiens
HITTKHSRL

SEQ ID NO: 315306 - protein, 9 aa, Homo Sapiens
ALNEAHQIS

SEQ ID NO: 315307 - protein, 9 aa, Homo Sapiens
MTVVLKVRL

SEQ ID NO: 315308 - protein, 9 aa, Homo Sapiens
EVVAEVHIS

SEQ ID NO: 315309 - protein, 9 aa, Homo Sapiens
AAAAPTSTQ

SEQ ID NO: 315310 - protein, 9 aa, Homo Sapiens
FEVHVCACP

SEQ ID NO: 315311 - protein, 9 aa, Homo Sapiens
AHTHYKRSM

SEQ ID NO: 315312 - protein, 9 aa, Homo Sapiens
KDVRSEGKH

SEQ ID NO: 315313 - protein, 9 aa, Homo Sapiens
IRKIQIHQK

SEQ ID NO: 315314 - protein, 9 aa, Homo Sapiens
GQVEHLEEE

SEQ ID NO: 315315 - protein, 9 aa, Homo Sapiens
CRCNMEGQC

SEQ ID NO: 315316 - protein, 9 aa, Homo Sapiens
EGDLLVLCC

SEQ ID NO: 315317 - protein, 9 aa, Homo Sapiens
ALLPVSMSA

SEQ ID NO: 315318 - protein, 9 aa, Homo Sapiens
LDLLKYAGL

SEQ ID NO: 315319 - protein, 9 aa, Homo Sapiens
CVWVSSIRH

SEQ ID NO: 315320 - protein, 9 aa, Homo Sapiens
ADCFCNWRD

SEQ ID NO: 315321 - protein, 9 aa, Homo Sapiens
GLGAAGSQA

SEQ ID NO: 315322 - protein, 9 aa, Homo Sapiens
YQGPPGPQG

SEQ ID NO: 315323 - protein, 9 aa, Homo Sapiens
LVFSLKKII

SEQ ID NO: 315324 - protein, 9 aa, Homo Sapiens
SVVQVTVTD

SEQ ID NO: 315325 - protein, 9 aa, Homo Sapiens
DAVRGCRGP

SEQ ID NO: 315326 - protein, 9 aa, Homo Sapiens
SLKKIIYAL

SEQ ID NO: 315327 - protein, 9 aa, Homo Sapiens
YHYITSYIV

SEQ ID NO: 315328 - protein, 9 aa, Homo Sapiens
KLAKSWPML

SEQ ID NO: 315329 - protein, 9 aa, Homo Sapiens
AVVATGDKW

SEQ ID NO: 315330 - protein, 9 aa, Homo Sapiens
TWALLLPLL

SEQ ID NO: 315331 - protein, 9 aa, Homo Sapiens
FLTVVKVHF

SEQ ID NO: 315332 - protein, 9 aa, Homo Sapiens
WKVKFPELL

SEQ ID NO: 315333 - protein, 9 aa, Homo Sapiens
KLLSCCGPQ

SEQ ID NO: 315334 - protein, 9 aa, Homo Sapiens
STYGEESNR

SEQ ID NO: 315335 - protein, 9 aa, Homo Sapiens
GSRGGLGAA

SEQ ID NO: 315336 - protein, 9 aa, Homo Sapiens
YLLPEEVDV

SEQ ID NO: 315337 - protein, 9 aa, Homo Sapiens
ADMEMTLEG

SEQ ID NO: 315338 - protein, 9 aa, Homo Sapiens
LAKSWPMLN

SEQ ID NO: 315339 - protein, 9 aa, Homo Sapiens
GPLRLGLPG

SEQ ID NO: 315340 - protein, 9 aa, Homo Sapiens
YYAEMCVSP

SEQ ID NO: 315341 - protein, 9 aa, Homo Sapiens
VEQDLANEL

SEQ ID NO: 315342 - protein, 9 aa, Homo Sapiens
GHALNEAHQ

SEQ ID NO: 315343 - protein, 9 aa, Homo Sapiens
QLLQDYIEA

SEQ ID NO: 315344 - protein, 9 aa, Homo Sapiens
SPDYFPARD

SEQ ID NO: 315345 - protein, 9 aa, Homo Sapiens
VIAYDHSWV

SEQ ID NO: 315346 - protein, 9 aa, Homo Sapiens
DEMDHMVYR

SEQ ID NO: 315347 - protein, 9 aa, Homo Sapiens
NAEFHYSLL

SEQ ID NO: 315348 - protein, 9 aa, Homo Sapiens
SRIRAAWTW

SEQ ID NO: 315349 - protein, 9 aa, Homo Sapiens
TSYIVDGQI

SEQ ID NO: 315350 - protein, 9 aa, Homo Sapiens
QIHQKEVQS

SEQ ID NO: 315351 - protein, 9 aa, Homo Sapiens
ALLSFWPGG

SEQ ID NO: 315352 - protein, 9 aa, Homo Sapiens
SFEVHVCAC

SEQ ID NO: 315353 - protein, 9 aa, Homo Sapiens
LLQEVAATR

SEQ ID NO: 315354 - protein, 9 aa, Homo Sapiens
MATMEPGTE

SEQ ID NO: 315355 - protein, 9 aa, Homo Sapiens
AQTLAMNIT

SEQ ID NO: 315356 - protein, 9 aa, Homo Sapiens
NELITPQGH

SEQ ID NO: 315357 - protein, 9 aa, Homo Sapiens
SCCGPQALP

SEQ ID NO: 315358 - protein, 9 aa, Homo Sapiens
NPQDTRLPY

SEQ ID NO: 315359 - protein, 9 aa, Homo Sapiens
TVMTVLLQE

SEQ ID NO: 315360 - protein, 9 aa, Homo Sapiens
SRPLNGPLR

SEQ ID NO: 315361 - protein, 9 aa, Homo Sapiens
LAVRKPFPQ

SEQ ID NO: 315362 - protein, 9 aa, Homo Sapiens
EGEDMQTTS

SEQ ID NO: 315363 - protein, 9 aa, Homo Sapiens
KTVISGMPT

SEQ ID NO: 315364 - protein, 9 aa, Homo Sapiens
EPMNPFQPI

SEQ ID NO: 315365 - protein, 9 aa, Homo Sapiens
TDTICISTM

SEQ ID NO: 315366 - protein, 9 aa, Homo Sapiens
EALLPVSMS

SEQ ID NO: 315367 - protein, 9 aa, Homo Sapiens
TPDDIPALA

SEQ ID NO: 315368 - protein, 9 aa, Homo Sapiens
QWEAVGPLP

SEQ ID NO: 315369 - protein, 9 aa, Homo Sapiens
VMTVLLQEV

SEQ ID NO: 315370 - protein, 9 aa, Homo Sapiens
QTAHSPASA

SEQ ID NO: 315371 - protein, 9 aa, Homo Sapiens
RYDQGGKFT

SEQ ID NO: 315372 - protein, 9 aa, Homo Sapiens
LKGIYVMGF

SEQ ID NO: 315373 - protein, 9 aa, Homo Sapiens
NEDVSLAVF

SEQ ID NO: 315374 - protein, 9 aa, Homo Sapiens
VKRTIDSED

SEQ ID NO: 315375 - protein, 9 aa, Homo Sapiens
PADCSQESS

SEQ ID NO: 315376 - protein, 9 aa, Homo Sapiens
KGIIQDVQL

SEQ ID NO: 315377 - protein, 9 aa, Homo Sapiens
KDSGLLTSS

SEQ ID NO: 315378 - protein, 9 aa, Homo Sapiens
NGPLRLGLP

SEQ ID NO: 315379 - protein, 9 aa, Homo Sapiens
AQRVHIKAL

SEQ ID NO: 315380 - protein, 9 aa, Homo Sapiens
LTVRSWIHC

SEQ ID NO: 315381 - protein, 9 aa, Homo Sapiens
IPRKSSIVK

SEQ ID NO: 315382 - protein, 9 aa, Homo Sapiens
HFGISQSVV

SEQ ID NO: 315383 - protein, 9 aa, Homo Sapiens
VMGFNRPSK

SEQ ID NO: 315384 - protein, 9 aa, Homo Sapiens
GDAPDHVEP

SEQ ID NO: 315385 - protein, 9 aa, Homo Sapiens
DTRLPYSFF

SEQ ID NO: 315386 - protein, 9 aa, Homo Sapiens
DGYQGPPGP

SEQ ID NO: 315387 - protein, 9 aa, Homo Sapiens
KNGMACYLT

SEQ ID NO: 315388 - protein, 9 aa, Homo Sapiens
ELDPEPMNP

SEQ ID NO: 315389 - protein, 9 aa, Homo Sapiens
PALLTTNMD

SEQ ID NO: 315390 - protein, 9 aa, Homo Sapiens
QKTVISGMP

SEQ ID NO: 315391 - protein, 9 aa, Homo Sapiens
VSLAVFRIL

SEQ ID NO: 315392 - protein, 9 aa, Homo Sapiens
IVLKDGNWN

SEQ ID NO: 315393 - protein, 9 aa, Homo Sapiens
TTKHSRLYV

SEQ ID NO: 315394 - protein, 9 aa, Homo Sapiens
GDAPSAFWP

SEQ ID NO: 315395 - protein, 9 aa, Homo Sapiens
SVVVLRSEN

SEQ ID NO: 315396 - protein, 9 aa, Homo Sapiens
GLSAGTSPP

SEQ ID NO: 315397 - protein, 9 aa, Homo Sapiens
KYYAEMCVS

SEQ ID NO: 315398 - protein, 9 aa, Homo Sapiens
QSIQGPSLS

SEQ ID NO: 315399 - protein, 9 aa, Homo Sapiens
VGHQSRSRT

SEQ ID NO: 315400 - protein, 9 aa, Homo Sapiens
VLLQEVAAT

SEQ ID NO: 315401 - protein, 9 aa, Homo Sapiens
KIQIHQKEV

SEQ ID NO: 315402 - protein, 9 aa, Homo Sapiens
EPMTVVLKV

SEQ ID NO: 315403 - protein, 9 aa, Homo Sapiens
CRRLTAVPD

SEQ ID NO: 315404 - protein, 9 aa, Homo Sapiens
GTARASKPT

SEQ ID NO: 315405 - protein, 9 aa, Homo Sapiens
TDIHPKTTG

SEQ ID NO: 315406 - protein, 9 aa, Homo Sapiens
DMEMTLEGA

SEQ ID NO: 315407 - protein, 9 aa, Homo Sapiens
TVVKVHFQF

SEQ ID NO: 315408 - protein, 9 aa, Homo Sapiens
KIHTGEWPY

SEQ ID NO: 315409 - protein, 9 aa, Homo Sapiens
EVLRKHMTQ

SEQ ID NO: 315410 - protein, 9 aa, Homo Sapiens
KDGNWNLTI

SEQ ID NO: 315411 - protein, 9 aa, Homo Sapiens
ARMRKELCT

SEQ ID NO: 315412 - protein, 9 aa, Homo Sapiens
PPSFSGTQL

SEQ ID NO: 315413 - protein, 9 aa, Homo Sapiens
LFFFSPQHL

SEQ ID NO: 315414 - protein, 9 aa, Homo Sapiens
FNIEKGCLV

SEQ ID NO: 315415 - protein, 9 aa, Homo Sapiens
YPAYSKDSG

SEQ ID NO: 315416 - protein, 9 aa, Homo Sapiens
LLKGIYVMG

SEQ ID NO: 315417 - protein, 9 aa, Homo Sapiens
CMTTNQKKV

SEQ ID NO: 315418 - protein, 9 aa, Homo Sapiens
GVNAEFHYS

SEQ ID NO: 315419 - protein, 9 aa, Homo Sapiens
TQSIQGPSL

SEQ ID NO: 315420 - protein, 9 aa, Homo Sapiens
LEDRKKWVK

SEQ ID NO: 315421 - protein, 9 aa, Homo Sapiens
RHGKSESTT

SEQ ID NO: 315422 - protein, 9 aa, Homo Sapiens
TKGLNIPRK

SEQ ID NO: 315423 - protein, 9 aa, Homo Sapiens
MCIVPPQDV

SEQ ID NO: 315424 - protein, 9 aa, Homo Sapiens
GAVGVGKSA

SEQ ID NO: 315425 - protein, 9 aa, Homo Sapiens
YITSYIVDG

SEQ ID NO: 315426 - protein, 9 aa, Homo Sapiens
KMTDTICIS

SEQ ID NO: 315427 - protein, 9 aa, Homo Sapiens
HVLSLVLFY

SEQ ID NO: 315428 - protein, 9 aa, Homo Sapiens
WIHCVLQMY

SEQ ID NO: 315429 - protein, 9 aa, Homo Sapiens
GLGFSVVVL

SEQ ID NO: 315430 - protein, 9 aa, Homo Sapiens
VVAACYFSQ

SEQ ID NO: 315431 - protein, 9 aa, Homo Sapiens
TRLPYSFFV

SEQ ID NO: 315432 - protein, 9 aa, Homo Sapiens
QHRQTAHSP

SEQ ID NO: 315433 - protein, 9 aa, Homo Sapiens
NVIAYDHSW

SEQ ID NO: 315434 - protein, 9 aa, Homo Sapiens
SINEIPAAF

SEQ ID NO: 315435 - protein, 9 aa, Homo Sapiens
LNYRLFHDR

SEQ ID NO: 315436 - protein, 9 aa, Homo Sapiens
IPAAFECSD

SEQ ID NO: 315437 - protein, 9 aa, Homo Sapiens
TRRKEEAFR

SEQ ID NO: 315438 - protein, 9 aa, Homo Sapiens
LKLLSCCGP

SEQ ID NO: 315439 - protein, 9 aa, Homo Sapiens
AVRGCRGPP

SEQ ID NO: 315440 - protein, 9 aa, Homo Sapiens
SFLPQKFLV

SEQ ID NO: 315441 - protein, 9 aa, Homo Sapiens
EPTLPLPTL

SEQ ID NO: 315442 - protein, 9 aa, Homo Sapiens
KEKGQMATM

SEQ ID NO: 315443 - protein, 9 aa, Homo Sapiens
HTHYKRSMH

SEQ ID NO: 315444 - protein, 9 aa, Homo Sapiens
MLARMRKEL

SEQ ID NO: 315445 - protein, 9 aa, Homo Sapiens
PMTVVLKVR

SEQ ID NO: 315446 - protein, 9 aa, Homo Sapiens
GETNELLKA

SEQ ID NO: 315447 - protein, 9 aa, Homo Sapiens
WKCLDTAQQ

SEQ ID NO: 315448 - protein, 9 aa, Homo Sapiens
PLPTCVTEC

SEQ ID NO: 315449 - protein, 9 aa, Homo Sapiens
WALLLPLLL

SEQ ID NO: 315450 - protein, 9 aa, Homo Sapiens
AAAAAAAPT

SEQ ID NO: 315451 - protein, 9 aa, Homo Sapiens
KQRFLKLLS

SEQ ID NO: 315452 - protein, 9 aa, Homo Sapiens
APPSFSGTQ

SEQ ID NO: 315453 - protein, 9 aa, Homo Sapiens
PTDIHPKTT

SEQ ID NO: 315454 - protein, 9 aa, Homo Sapiens
NVSKDVRSE

SEQ ID NO: 315455 - protein, 9 aa, Homo Sapiens
LSYKSICSR

SEQ ID NO: 315456 - protein, 9 aa, Homo Sapiens
ADCSQESST

SEQ ID NO: 315457 - protein, 9 aa, Homo Sapiens
GPLPKAVHS

SEQ ID NO: 315458 - protein, 9 aa, Homo Sapiens
SFHLYLFFH

SEQ ID NO: 315459 - protein, 9 aa, Homo Sapiens
NYYGWQAEP

SEQ ID NO: 315460 - protein, 9 aa, Homo Sapiens
GRNSFEVHV

SEQ ID NO: 315461 - protein, 9 aa, Homo Sapiens
LVVVGAVGV

SEQ ID NO: 315462 - protein, 9 aa, Homo Sapiens
AATRAEDLP

SEQ ID NO: 315463 - protein, 9 aa, Homo Sapiens
VVVLRSENR

SEQ ID NO: 315464 - protein, 9 aa, Homo Sapiens
SVKRTIDSE

SEQ ID NO: 315465 - protein, 9 aa, Homo Sapiens
KFHLGTLPP

SEQ ID NO: 315466 - protein, 9 aa, Homo Sapiens
VTECGGTVR

SEQ ID NO: 315467 - protein, 9 aa, Homo Sapiens
KGRAGLVPP

SEQ ID NO: 315468 - protein, 9 aa, Homo Sapiens
ATSAETKHS

SEQ ID NO: 315469 - protein, 9 aa, Homo Sapiens
RPEDPNEDP

SEQ ID NO: 315470 - protein, 9 aa, Homo Sapiens
VNRNSAITG

SEQ ID NO: 315471 - protein, 9 aa, Homo Sapiens
SSVTLSLCR

SEQ ID NO: 315472 - protein, 9 aa, Homo Sapiens
EMDHMVYRV

SEQ ID NO: 315473 - protein, 9 aa, Homo Sapiens
DPSHTTNKR

SEQ ID NO: 315474 - protein, 9 aa, Homo Sapiens
GAVSMLEAD

SEQ ID NO: 315475 - protein, 9 aa, Homo Sapiens
KLMEVDRGE

SEQ ID NO: 315476 - protein, 9 aa, Homo Sapiens
AATRGTARA

SEQ ID NO: 315477 - protein, 9 aa, Homo Sapiens
SVNGVASKV

SEQ ID NO: 315478 - protein, 9 aa, Homo Sapiens
LAMNITNFW

SEQ ID NO: 315479 - protein, 9 aa, Homo Sapiens
SPGYISLVE

SEQ ID NO: 315480 - protein, 9 aa, Homo Sapiens
VTVTDADDP

SEQ ID NO: 315481 - protein, 9 aa, Homo Sapiens
SAQQTEQQN

SEQ ID NO: 315482 - protein, 9 aa, Homo Sapiens
LADCFVEGV

SEQ ID NO: 315483 - protein, 9 aa, Homo Sapiens
GQMATMEPG

SEQ ID NO: 315484 - protein, 9 aa, Homo Sapiens
SAETKHSKR

SEQ ID NO: 315485 - protein, 9 aa, Homo Sapiens
CNMEGQCMR

SEQ ID NO: 315486 - protein, 9 aa, Homo Sapiens
SRGCDLPQT

SEQ ID NO: 315487 - protein, 9 aa, Homo Sapiens
LSSSINEIP

SEQ ID NO: 315488 - protein, 9 aa, Homo Sapiens
GTVMTVLLQ

SEQ ID NO: 315489 - protein, 9 aa, Homo Sapiens
DERLQPLIN

SEQ ID NO: 315490 - protein, 9 aa, Homo Sapiens
SKDSGLLTS

SEQ ID NO: 315491 - protein, 9 aa, Homo Sapiens
QQLTSQPMC

SEQ ID NO: 315492 - protein, 9 aa, Homo Sapiens
PPSSSLSAQ

SEQ ID NO: 315493 - protein, 9 aa, Homo Sapiens
RGVNAEFHY

SEQ ID NO: 315494 - protein, 9 aa, Homo Sapiens
TGVSRGMGF

SEQ ID NO: 315495 - protein, 9 aa, Homo Sapiens
CRGPPASAP

SEQ ID NO: 315496 - protein, 9 aa, Homo Sapiens
VISGMPTVI

SEQ ID NO: 315497 - protein, 9 aa, Homo Sapiens
FHLYLFFHF

SEQ ID NO: 315498 - protein, 9 aa, Homo Sapiens
PVPTSKRPP

SEQ ID NO: 315499 - protein, 9 aa, Homo Sapiens
GVNRNSAIT

SEQ ID NO: 315500 - protein, 9 aa, Homo Sapiens
DLANELITP

SEQ ID NO: 315501 - protein, 9 aa, Homo Sapiens
FPEPMTVVL

SEQ ID NO: 315502 - protein, 9 aa, Homo Sapiens
GLTPDDIPA

SEQ ID NO: 315503 - protein, 9 aa, Homo Sapiens
WPLRDNGGL

SEQ ID NO: 315504 - protein, 9 aa, Homo Sapiens
GPYEVLNDS

SEQ ID NO: 315505 - protein, 9 aa, Homo Sapiens
EWPYKCGEC

SEQ ID NO: 315506 - protein, 9 aa, Homo Sapiens
GTDSLQTTQ

SEQ ID NO: 315507 - protein, 9 aa, Homo Sapiens
WPGGYPAYS

SEQ ID NO: 315508 - protein, 9 aa, Homo Sapiens
RYPKDRVLD

SEQ ID NO: 315509 - protein, 9 aa, Homo Sapiens
YEVLNDSSS

SEQ ID NO: 315510 - protein, 9 aa, Homo Sapiens
ELLKGIYVM

SEQ ID NO: 315511 - protein, 9 aa, Homo Sapiens
ISGMPTVIP

SEQ ID NO: 315512 - protein, 9 aa, Homo Sapiens
PQDTRLPYS

SEQ ID NO: 315513 - protein, 9 aa, Homo Sapiens
PLRLGLPGD

SEQ ID NO: 315514 - protein, 9 aa, Homo Sapiens
KIIYALKAP

SEQ ID NO: 315515 - protein, 9 aa, Homo Sapiens
FKGIIQDVQ

SEQ ID NO: 315516 - protein, 9 aa, Homo Sapiens
LLFFFSPQH

SEQ ID NO: 315517 - protein, 9 aa, Homo Sapiens
GSGTLPSRH

SEQ ID NO: 315518 - protein, 9 aa, Homo Sapiens
CKKLQKKKN

SEQ ID NO: 315519 - protein, 9 aa, Homo Sapiens
VLKDGNWNL

SEQ ID NO: 315520 - protein, 9 aa, Homo Sapiens
KIHFRMPPL

SEQ ID NO: 315521 - protein, 9 aa, Homo Sapiens
KKMTDTICI

SEQ ID NO: 315522 - protein, 9 aa, Homo Sapiens
AAWTWALLL

SEQ ID NO: 315523 - protein, 9 aa, Homo Sapiens
KVKFPELLC

SEQ ID NO: 315524 - protein, 9 aa, Homo Sapiens
AAAAVVATG

SEQ ID NO: 315525 - protein, 9 aa, Homo Sapiens
LQREYPVPT

SEQ ID NO: 315526 - protein, 9 aa, Homo Sapiens
PEPMTVVLK

SEQ ID NO: 315527 - protein, 9 aa, Homo Sapiens
HSSTYGEES

SEQ ID NO: 315528 - protein, 9 aa, Homo Sapiens
RMVRGTQVY

SEQ ID NO: 315529 - protein, 9 aa, Homo Sapiens
HTTNKRYPK

SEQ ID NO: 315530 - protein, 9 aa, Homo Sapiens
LCVWVSSIR

SEQ ID NO: 315531 - protein, 9 aa, Homo Sapiens
IRAAWTWAL

SEQ ID NO: 315532 - protein, 9 aa, Homo Sapiens
FKAVSLNHL

SEQ ID NO: 315533 - protein, 9 aa, Homo Sapiens
QKKKNKEEE

SEQ ID NO: 315534 - protein, 9 aa, Homo Sapiens
EEAEPADCS

SEQ ID NO: 315535 - protein, 9 aa, Homo Sapiens
PEPMNPFQP

SEQ ID NO: 315536 - protein, 9 aa, Homo Sapiens
PEQFTAVKF

SEQ ID NO: 315537 - protein, 9 aa, Homo Sapiens
NQWEAVGPL

SEQ ID NO: 315538 - protein, 9 aa, Homo Sapiens
PGNHLGNAG

SEQ ID NO: 315539 - protein, 9 aa, Homo Sapiens
AVYENRDGN

SEQ ID NO: 315540 - protein, 9 aa, Homo Sapiens
NDSSSQENM

SEQ ID NO: 315541 - protein, 9 aa, Homo Sapiens
KIFFCTGSS

SEQ ID NO: 315542 - protein, 9 aa, Homo Sapiens
NAPKILYPA

SEQ ID NO: 315543 - protein, 9 aa, Homo Sapiens
ANELITPQG

SEQ ID NO: 315544 - protein, 9 aa, Homo Sapiens
VISTKGLNI

SEQ ID NO: 315545 - protein, 9 aa, Homo Sapiens
GKINVSEYA

SEQ ID NO: 315546 - protein, 9 aa, Homo Sapiens
NMDNPERTG

SEQ ID NO: 315547 - protein, 9 aa, Homo Sapiens
CSRGCDLPQ

SEQ ID NO: 315548 - protein, 9 aa, Homo Sapiens
RGCRGPPAS

SEQ ID NO: 315549 - protein, 9 aa, Homo Sapiens
QDYIEACSL

SEQ ID NO: 315550 - protein, 9 aa, Homo Sapiens
AYSKDSGLL

SEQ ID NO: 315551 - protein, 9 aa, Homo Sapiens
RGQQVILRC

SEQ ID NO: 315552 - protein, 9 aa, Homo Sapiens
ALLTTNMDN

SEQ ID NO: 315553 - protein, 9 aa, Homo Sapiens
RSTPLSPGY

SEQ ID NO: 315554 - protein, 9 aa, Homo Sapiens
KRVRGWLAH

SEQ ID NO: 315555 - protein, 9 aa, Homo Sapiens
REQLKALHS

SEQ ID NO: 315556 - protein, 9 aa, Homo Sapiens
DKHEQYMVN

SEQ ID NO: 315557 - protein, 9 aa, Homo Sapiens
CLVQTQRLK

SEQ ID NO: 315558 - protein, 9 aa, Homo Sapiens
DQNDNAPKI

SEQ ID NO: 315559 - protein, 9 aa, Homo Sapiens
AGARRQHRQ

SEQ ID NO: 315560 - protein, 9 aa, Homo Sapiens
SQQLLQDYI

SEQ ID NO: 315561 - protein, 9 aa, Homo Sapiens
EEWKCLDTA

SEQ ID NO: 315562 - protein, 9 aa, Homo Sapiens
SYIVDGQII

SEQ ID NO: 315563 - protein, 9 aa, Homo Sapiens
DYFPARDVP

SEQ ID NO: 315564 - protein, 9 aa, Homo Sapiens
VLMIRTPDE

SEQ ID NO: 315565 - protein, 9 aa, Homo Sapiens
VATGDKWKP

SEQ ID NO: 315566 - protein, 9 aa, Homo Sapiens
ASKVKLIIL

SEQ ID NO: 315567 - protein, 9 aa, Homo Sapiens
AQQTEQQNK

SEQ ID NO: 315568 - protein, 9 aa, Homo Sapiens
DSLQTTQSI

SEQ ID NO: 315569 - protein, 9 aa, Homo Sapiens
KGLRLPGNH

SEQ ID NO: 315570 - protein, 9 aa, Homo Sapiens
DAVYENRDG

SEQ ID NO: 315571 - protein, 9 aa, Homo Sapiens
KQSFLPQKF

SEQ ID NO: 315572 - protein, 9 aa, Homo Sapiens
GHQSRSRTF

SEQ ID NO: 315573 - protein, 9 aa, Homo Sapiens
ALHSTHEAR

SEQ ID NO: 315574 - protein, 9 aa, Homo Sapiens
GRCFLTVVK

SEQ ID NO: 315575 - protein, 9 aa, Homo Sapiens
NLNNTSKVS

SEQ ID NO: 315576 - protein, 9 aa, Homo Sapiens
DDSIYVTKI

SEQ ID NO: 315577 - protein, 9 aa, Homo Sapiens
RHITTKHSR

SEQ ID NO: 315578 - protein, 9 aa, Homo Sapiens
IDGYQGPPG

SEQ ID NO: 315579 - protein, 9 aa, Homo Sapiens
PNEDPSSEA

SEQ ID NO: 315580 - protein, 9 aa, Homo Sapiens
SRHGKSEST

SEQ ID NO: 315581 - protein, 9 aa, Homo Sapiens
KCLDTAQQN

SEQ ID NO: 315582 - protein, 9 aa, Homo Sapiens
RAVACTCRR

SEQ ID NO: 315583 - protein, 9 aa, Homo Sapiens
QTLAMNITN

SEQ ID NO: 315584 - protein, 9 aa, Homo Sapiens
PLINHLSHS

SEQ ID NO: 315585 - protein, 9 aa, Homo Sapiens
KGCLVQTQR

SEQ ID NO: 315586 - protein, 9 aa, Homo Sapiens
VSEYAYRCL

SEQ ID NO: 315587 - protein, 9 aa, Homo Sapiens
GEALLPVSM

SEQ ID NO: 315588 - protein, 9 aa, Homo Sapiens
LPTLANASA

SEQ ID NO: 315589 - protein, 9 aa, Homo Sapiens
DCFCNWRDH

SEQ ID NO: 315590 - protein, 9 aa, Homo Sapiens
CEAKEGETN

SEQ ID NO: 315591 - protein, 9 aa, Homo Sapiens
GKRPEDPNE

SEQ ID NO: 315592 - protein, 9 aa, Homo Sapiens
DCSQESSTL

SEQ ID NO: 315593 - protein, 9 aa, Homo Sapiens
AEFHYSLLK

SEQ ID NO: 315594 - protein, 9 aa, Homo Sapiens
VSLNHLDLR

SEQ ID NO: 315595 - protein, 9 aa, Homo Sapiens
IHQKEVQSS

SEQ ID NO: 315596 - protein, 9 aa, Homo Sapiens
LTSSSREWK

SEQ ID NO: 315597 - protein, 9 aa, Homo Sapiens
AKSWPMLNM

SEQ ID NO: 315598 - protein, 9 aa, Homo Sapiens
DELDDSDFE

SEQ ID NO: 315599 - protein, 9 aa, Homo Sapiens
IAYDHSWVL

SEQ ID NO: 315600 - protein, 9 aa, Homo Sapiens
AFLDLLKYA

SEQ ID NO: 315601 - protein, 9 aa, Homo Sapiens
EEMEQVGQV

SEQ ID NO: 315602 - protein, 9 aa, Homo Sapiens
DGFKFHLGT

SEQ ID NO: 315603 - protein, 9 aa, Homo Sapiens
ASGGGGARR

SEQ ID NO: 315604 - protein, 9 aa, Homo Sapiens
WRMGMLGTH

SEQ ID NO: 315605 - protein, 9 aa, Homo Sapiens
LLPAAEAHT

SEQ ID NO: 315606 - protein, 9 aa, Homo Sapiens
PVSMSANPA

SEQ ID NO: 315607 - protein, 9 aa, Homo Sapiens
MGFIRFDKR

SEQ ID NO: 315608 - protein, 9 aa, Homo Sapiens
PTSTQPGSG

SEQ ID NO: 315609 - protein, 9 aa, Homo Sapiens
TKHSRLYVC

SEQ ID NO: 315610 - protein, 9 aa, Homo Sapiens
VLRSENRGE

SEQ ID NO: 315611 - protein, 9 aa, Homo Sapiens
HQSRSRTFI

SEQ ID NO: 315612 - protein, 9 aa, Homo Sapiens
VRVYNWFAT

SEQ ID NO: 315613 - protein, 9 aa, Homo Sapiens
LNAIMSEHK

SEQ ID NO: 315614 - protein, 9 aa, Homo Sapiens
SIDAVYENR

SEQ ID NO: 315615 - protein, 9 aa, Homo Sapiens
TQLDSSPSG

SEQ ID NO: 315616 - protein, 9 aa, Homo Sapiens
SPQHLNSQL

SEQ ID NO: 315617 - protein, 9 aa, Homo Sapiens
KKIIYALKA

SEQ ID NO: 315618 - protein, 9 aa, Homo Sapiens
FCTGSSCHS

SEQ ID NO: 315619 - protein, 9 aa, Homo Sapiens
RVIVCRCNM

SEQ ID NO: 315620 - protein, 9 aa, Homo Sapiens
HLGTLPPSP

SEQ ID NO: 315621 - protein, 9 aa, Homo Sapiens
VVKVHFQFL

SEQ ID NO: 315622 - protein, 9 aa, Homo Sapiens
SEYAYRCLM

SEQ ID NO: 315623 - protein, 9 aa, Homo Sapiens
LHSTHEARE

SEQ ID NO: 315624 - protein, 9 aa, Homo Sapiens
VKADCFCNW

SEQ ID NO: 315625 - protein, 9 aa, Homo Sapiens
KVSLHRSET

SEQ ID NO: 315626 - protein, 9 aa, Homo Sapiens
YAEMCVSPD

SEQ ID NO: 315627 - protein, 9 aa, Homo Sapiens
PKTTGLSLT

SEQ ID NO: 315628 - protein, 9 aa, Homo Sapiens
EYNYYGWQA

SEQ ID NO: 315629 - protein, 9 aa, Homo Sapiens
QFPEPMTVV

SEQ ID NO: 315630 - protein, 9 aa, Homo Sapiens
VCRCNMEGQ

SEQ ID NO: 315631 - protein, 9 aa, Homo Sapiens
VLKVEHTSR

SEQ ID NO: 315632 - protein, 9 aa, Homo Sapiens
MEVDRGEIV

SEQ ID NO: 315633 - protein, 9 aa, Homo Sapiens
NHLDLRGNR

SEQ ID NO: 315634 - protein, 9 aa, Homo Sapiens
TLEGAVSML

SEQ ID NO: 315635 - protein, 9 aa, Homo Sapiens
DVRSEGKHV

SEQ ID NO: 315636 - protein, 9 aa, Homo Sapiens
VVLRSENRG

SEQ ID NO: 315637 - protein, 9 aa, Homo Sapiens
AVGVGKSAL

SEQ ID NO: 315638 - protein, 9 aa, Homo Sapiens
AHGYFKGII

SEQ ID NO: 315639 - protein, 9 aa, Homo Sapiens
YMDAAQYLL

SEQ ID NO: 315640 - protein, 9 aa, Homo Sapiens
AAAAAAPTS

SEQ ID NO: 315641 - protein, 9 aa, Homo Sapiens
RAQTLAMNI

SEQ ID NO: 315642 - protein, 9 aa, Homo Sapiens
DDIPALADR

SEQ ID NO: 315643 - protein, 9 aa, Homo Sapiens
TTQSIQGPS

SEQ ID NO: 315644 - protein, 9 aa, Homo Sapiens
VIVCRCNME

SEQ ID NO: 315645 - protein, 9 aa, Homo Sapiens
FSQQLLQDY

SEQ ID NO: 315646 - protein, 9 aa, Homo Sapiens
KVHFQFLTH

SEQ ID NO: 315647 - protein, 9 aa, Homo Sapiens
PEVLRKHMT

SEQ ID NO: 315648 - protein, 9 aa, Homo Sapiens
VVQVTVTDA

SEQ ID NO: 315649 - protein, 9 aa, Homo Sapiens
AAAAAVVAT

SEQ ID NO: 315650 - protein, 9 aa, Homo Sapiens
LREQLKALH

SEQ ID NO: 315651 - protein, 9 aa, Homo Sapiens
LQVLHCKLP

SEQ ID NO: 315652 - protein, 9 aa, Homo Sapiens
NWNLTIRRV

SEQ ID NO: 315653 - protein, 9 aa, Homo Sapiens
LLSFWPGGY

SEQ ID NO: 315654 - protein, 9 aa, Homo Sapiens
TYGEESNRH

SEQ ID NO: 315655 - protein, 9 aa, Homo Sapiens
QTTQSIQGP

SEQ ID NO: 315656 - protein, 9 aa, Homo Sapiens
VKFPELLCV

SEQ ID NO: 315657 - protein, 9 aa, Homo Sapiens
KINVSEYAY

SEQ ID NO: 315658 - protein, 9 aa, Homo Sapiens
HTRLKTQLP

SEQ ID NO: 315659 - protein, 9 aa, Homo Sapiens
EFHYSLLKG

SEQ ID NO: 315660 - protein, 9 aa, Homo Sapiens
LCNSSVTLS

SEQ ID NO: 315661 - protein, 9 aa, Homo Sapiens
RGGLGAAGS

SEQ ID NO: 315662 - protein, 9 aa, Homo Sapiens
LANASAYTA

SEQ ID NO: 315663 - protein, 9 aa, Homo Sapiens
DAPDHVEPG

SEQ ID NO: 315664 - protein, 9 aa, Homo Sapiens
GGLGAAGSQ

SEQ ID NO: 315665 - protein, 9 aa, Homo Sapiens
PAYSKDSGL

SEQ ID NO: 315666 - protein, 9 aa, Homo Sapiens
LMEVDRGEI

SEQ ID NO: 315667 - protein, 9 aa, Homo Sapiens
LPAAEAHTR

SEQ ID NO: 315668 - protein, 9 aa, Homo Sapiens
FFSPQHLNS

SEQ ID NO: 315669 - protein, 9 aa, Homo Sapiens
RYNEFKLNA

SEQ ID NO: 315670 - protein, 9 aa, Homo Sapiens
FPQLRPSHT

SEQ ID NO: 315671 - protein, 9 aa, Homo Sapiens
GYISLVEEE

SEQ ID NO: 315672 - protein, 9 aa, Homo Sapiens
AEMCVSPDQ

SEQ ID NO: 315673 - protein, 9 aa, Homo Sapiens
AAAAAPTST

SEQ ID NO: 315674 - protein, 9 aa, Homo Sapiens
TLANASAYT

SEQ ID NO: 315675 - protein, 9 aa, Homo Sapiens
VMRQSVKRT

SEQ ID NO: 315676 - protein, 9 aa, Homo Sapiens
LLPEEVDVL

SEQ ID NO: 315677 - protein, 9 aa, Homo Sapiens
PTLANASAY

SEQ ID NO: 315678 - protein, 9 aa, Homo Sapiens
PGDDSIYVT

SEQ ID NO: 315679 - protein, 9 aa, Homo Sapiens
AVRKPFPQL

SEQ ID NO: 315680 - protein, 9 aa, Homo Sapiens
SGTLPSRHG

SEQ ID NO: 315681 - protein, 9 aa, Homo Sapiens
LQKKKNKEE

SEQ ID NO: 315682 - protein, 9 aa, Homo Sapiens
SSINEIPAA

SEQ ID NO: 315683 - protein, 9 aa, Homo Sapiens
NDNAPKILY

SEQ ID NO: 315684 - protein, 9 aa, Homo Sapiens
KSWPMLNML

SEQ ID NO: 315685 - protein, 9 aa, Homo Sapiens
FLKLLSCCG

SEQ ID NO: 315686 - protein, 9 aa, Homo Sapiens
KGKRINPPS

SEQ ID NO: 315687 - protein, 9 aa, Homo Sapiens
QKEVQSSLR

SEQ ID NO: 315688 - protein, 9 aa, Homo Sapiens
ETKHSKRKR

SEQ ID NO: 315689 - protein, 9 aa, Homo Sapiens
TRLKTQLPQ

SEQ ID NO: 315690 - protein, 9 aa, Homo Sapiens
FFFSPQHLN

SEQ ID NO: 315691 - protein, 9 aa, Homo Sapiens
IQINASLHF

SEQ ID NO: 315692 - protein, 9 aa, Homo Sapiens
LELYRYSGI

SEQ ID NO: 315693 - protein, 9 aa, Homo Sapiens
AELDPEPMN

SEQ ID NO: 315694 - protein, 9 aa, Homo Sapiens
PDELDDSDF

SEQ ID NO: 315695 - protein, 9 aa, Homo Sapiens
SREWKVKFP

SEQ ID NO: 315696 - protein, 9 aa, Homo Sapiens
LFKAVSLNH

SEQ ID NO: 315697 - protein, 9 aa, Homo Sapiens
PLNGPLRLG

SEQ ID NO: 315698 - protein, 9 aa, Homo Sapiens
TNQKKVLKV

SEQ ID NO: 315699 - protein, 9 aa, Homo Sapiens
VDRGEIVKF

SEQ ID NO: 315700 - protein, 9 aa, Homo Sapiens
LYHYITSYI

SEQ ID NO: 315701 - protein, 9 aa, Homo Sapiens
EGLTPDDIP

SEQ ID NO: 315702 - protein, 9 aa, Homo Sapiens
LEVGTVMTV

SEQ ID NO: 315703 - protein, 9 aa, Homo Sapiens
VRKPFPQLR

SEQ ID NO: 315704 - protein, 9 aa, Homo Sapiens
NNTSKVSLH

SEQ ID NO: 315705 - protein, 9 aa, Homo Sapiens
PKILYPALP

SEQ ID NO: 315706 - protein, 9 aa, Homo Sapiens
KSICSRGCD

SEQ ID NO: 315707 - protein, 9 aa, Homo Sapiens
NGVASKVKL

SEQ ID NO: 315708 - protein, 9 aa, Homo Sapiens
TTSIMDALV

SEQ ID NO: 315709 - protein, 9 aa, Homo Sapiens
VLHCKLPQF

SEQ ID NO: 315710 - protein, 9 aa, Homo Sapiens
ELYRYSGIN

SEQ ID NO: 315711 - protein, 9 aa, Homo Sapiens
HISTVEERT

SEQ ID NO: 315712 - protein, 9 aa, Homo Sapiens
MNPFQPIAS

SEQ ID NO: 315713 - protein, 9 aa, Homo Sapiens
QAGDAPDHV

SEQ ID NO: 315714 - protein, 9 aa, Homo Sapiens
RTIDSEDTV

SEQ ID NO: 315715 - protein, 9 aa, Homo Sapiens
RDPEVLRKH

SEQ ID NO: 315716 - protein, 9 aa, Homo Sapiens
EATSAETKH

SEQ ID NO: 315717 - protein, 9 aa, Homo Sapiens
MDHMVYRVL

SEQ ID NO: 315718 - protein, 9 aa, Homo Sapiens
VILWSRPVI

SEQ ID NO: 315719 - protein, 9 aa, Homo Sapiens
LDPEPMNPF

SEQ ID NO: 315720 - protein, 9 aa, Homo Sapiens
MTDTICIST

SEQ ID NO: 315721 - protein, 9 aa, Homo Sapiens
SWRGSFIHS

SEQ ID NO: 315722 - protein, 9 aa, Homo Sapiens
LSCCGPQAL

SEQ ID NO: 315723 - protein, 9 aa, Homo Sapiens
PRAGRSLGL

SEQ ID NO: 315724 - protein, 9 aa, Homo Sapiens
LSWRGSFIH

SEQ ID NO: 315725 - protein, 9 aa, Homo Sapiens
AVFRILKSF

SEQ ID NO: 315726 - protein, 9 aa, Homo Sapiens
VPPPPKNPH

SEQ ID NO: 315727 - protein, 9 aa, Homo Sapiens
GTSVVQVTV

SEQ ID NO: 315728 - protein, 9 aa, Homo Sapiens
QGSRGGLGA

SEQ ID NO: 315729 - protein, 9 aa, Homo Sapiens
TLPLPTLAN

SEQ ID NO: 315730 - protein, 9 aa, Homo Sapiens
KEGETNELL

SEQ ID NO: 315731 - protein, 9 aa, Homo Sapiens
EYAYRCLMS

SEQ ID NO: 315732 - protein, 9 aa, Homo Sapiens
AAEAHTRLK

SEQ ID NO: 315733 - protein, 9 aa, Homo Sapiens
AEDLPGQAG

SEQ ID NO: 315734 - protein, 9 aa, Homo Sapiens
NTSKVSLHR

SEQ ID NO: 315735 - protein, 9 aa, Homo Sapiens
AAPTSTQPG

SEQ ID NO: 315736 - protein, 9 aa, Homo Sapiens
DHMVYRVLV

SEQ ID NO: 315737 - protein, 9 aa, Homo Sapiens
ACYFSQLLR

SEQ ID NO: 315738 - protein, 9 aa, Homo Sapiens
VEPGRRQDR

SEQ ID NO: 315739 - protein, 9 aa, Homo Sapiens
LCCQAWQDW

SEQ ID NO: 315740 - protein, 9 aa, Homo Sapiens
QLTSQPMCI

SEQ ID NO: 315741 - protein, 9 aa, Homo Sapiens
KPFPQLRPS

SEQ ID NO: 315742 - protein, 9 aa, Homo Sapiens
GRAAATASG

SEQ ID NO: 315743 - protein, 9 aa, Homo Sapiens
KVLKVEHTS

SEQ ID NO: 315744 - protein, 9 aa, Homo Sapiens
CTCRRLTAV

SEQ ID NO: 315745 - protein, 9 aa, Homo Sapiens
PARDVPGPP

SEQ ID NO: 315746 - protein, 9 aa, Homo Sapiens
NQKKVLKVE

SEQ ID NO: 315747 - protein, 9 aa, Homo Sapiens
KKWVKADCF

SEQ ID NO: 315748 - protein, 9 aa, Homo Sapiens
FLCNSSVTL

SEQ ID NO: 315749 - protein, 9 aa, Homo Sapiens
FATRRKEEA

SEQ ID NO: 315750 - protein, 9 aa, Homo Sapiens
HEQYMVNGI

SEQ ID NO: 315751 - protein, 9 aa, Homo Sapiens
WPYKCGECG

SEQ ID NO: 315752 - protein, 9 aa, Homo Sapiens
KRPEDPNED

SEQ ID NO: 315753 - protein, 9 aa, Homo Sapiens
TPDELDDSD

SEQ ID NO: 315754 - protein, 9 aa, Homo Sapiens
EQFTAVKFS

SEQ ID NO: 315755 - protein, 9 aa, Homo Sapiens
LQPLINHLS

SEQ ID NO: 315756 - protein, 9 aa, Homo Sapiens
SPSRPLNGP

SEQ ID NO: 315757 - protein, 9 aa, Homo Sapiens
THVLSLVLF

SEQ ID NO: 315758 - protein, 9 aa, Homo Sapiens
EFNIEKGCL

SEQ ID NO: 315759 - protein, 9 aa, Homo Sapiens
VHVCACPGR

SEQ ID NO: 315760 - protein, 9 aa, Homo Sapiens
SLSAQQTEQ

SEQ ID NO: 315761 - protein, 9 aa, Homo Sapiens
KKKNKEEER

SEQ ID NO: 315762 - protein, 9 aa, Homo Sapiens
APDHVEPGR

SEQ ID NO: 315763 - protein, 9 aa, Homo Sapiens
HYITSYIVD

SEQ ID NO: 315764 - protein, 9 aa, Homo Sapiens
EDGFKFHLG

SEQ ID NO: 315765 - protein, 9 aa, Homo Sapiens
QGGKFTSEM

SEQ ID NO: 315766 - protein, 9 aa, Homo Sapiens
CSLDREEEA

SEQ ID NO: 315767 - protein, 9 aa, Homo Sapiens
VNAEFHYSL

SEQ ID NO: 315768 - protein, 9 aa, Homo Sapiens
CVTECGGTV

SEQ ID NO: 315769 - protein, 9 aa, Homo Sapiens
AVGPLPKAV

SEQ ID NO: 315770 - protein, 9 aa, Homo Sapiens
NIEKGCLVQ

SEQ ID NO: 315771 - protein, 9 aa, Homo Sapiens
KTRGQQVIL

SEQ ID NO: 315772 - protein, 9 aa, Homo Sapiens
VRSEGKHVR

SEQ ID NO: 315773 - protein, 9 aa, Homo Sapiens
LEFSLEEWK

SEQ ID NO: 315774 - protein, 9 aa, Homo Sapiens
SWPMLNMLI

SEQ ID NO: 315775 - protein, 9 aa, Homo Sapiens
VYENRDGNF

SEQ ID NO: 315776 - protein, 9 aa, Homo Sapiens
VKFSDSRIA

SEQ ID NO: 315777 - protein, 9 aa, Homo Sapiens
NEIPAAFEC

SEQ ID NO: 315778 - protein, 9 aa, Homo Sapiens
LYRYSGINM

SEQ ID NO: 315779 - protein, 9 aa, Homo Sapiens
LANELITPQ

SEQ ID NO: 315780 - protein, 9 aa, Homo Sapiens
FKFHLGTLP

SEQ ID NO: 315781 - protein, 9 aa, Homo Sapiens
SYMDAAQYL

SEQ ID NO: 315782 - protein, 9 aa, Homo Sapiens
HRQTAHSPA

SEQ ID NO: 315783 - protein, 9 aa, Homo Sapiens
IKIFFCTGS

SEQ ID NO: 315784 - protein, 9 aa, Homo Sapiens
GVSRGMGFI

SEQ ID NO: 315785 - protein, 9 aa, Homo Sapiens
QPMCIVPPQ

SEQ ID NO: 315786 - protein, 9 aa, Homo Sapiens
SAITGGVIA

SEQ ID NO: 315787 - protein, 9 aa, Homo Sapiens
LPNLRMVRG

SEQ ID NO: 315788 - protein, 9 aa, Homo Sapiens
VTGVSRGMG

SEQ ID NO: 315789 - protein, 9 aa, Homo Sapiens
SRPVIQINA

SEQ ID NO: 315790 - protein, 9 aa, Homo Sapiens
SQLLRRHRL

SEQ ID NO: 315791 - protein, 9 aa, Homo Sapiens
AVSLNHLDL

SEQ ID NO: 315792 - protein, 9 aa, Homo Sapiens
RDGNFVFFK

SEQ ID NO: 315793 - protein, 9 aa, Homo Sapiens
LGAAGSQAA

SEQ ID NO: 315794 - protein, 9 aa, Homo Sapiens
CNSSVTLSL

SEQ ID NO: 315795 - protein, 9 aa, Homo Sapiens
CKLPQFCAH

SEQ ID NO: 315796 - protein, 9 aa, Homo Sapiens
NMEGQCMRK

SEQ ID NO: 315797 - protein, 9 aa, Homo Sapiens
SSSLSAQQT

SEQ ID NO: 315798 - protein, 9 aa, Homo Sapiens
SDERLQPLI

SEQ ID NO: 315799 - protein, 9 aa, Homo Sapiens
ADDKLWQSL

SEQ ID NO: 315800 - protein, 9 aa, Homo Sapiens
RLPYSFFVP

SEQ ID NO: 315801 - protein, 9 aa, Homo Sapiens
SRSTPLSPG

SEQ ID NO: 315802 - protein, 9 aa, Homo Sapiens
RGEIVKFLQ

SEQ ID NO: 315803 - protein, 9 aa, Homo Sapiens
ALTVRSWIH

SEQ ID NO: 315804 - protein, 9 aa, Homo Sapiens
GRSLGLSAG

SEQ ID NO: 315805 - protein, 9 aa, Homo Sapiens
FLKSDHPLG

SEQ ID NO: 315806 - protein, 9 aa, Homo Sapiens
KKIHFRMPP

SEQ ID NO: 315807 - protein, 9 aa, Homo Sapiens
ERLQPLINH

SEQ ID NO: 315808 - protein, 9 aa, Homo Sapiens
PMCIVPPQD

SEQ ID NO: 315809 - protein, 9 aa, Homo Sapiens
GWLAHTHYK

SEQ ID NO: 315810 - protein, 9 aa, Homo Sapiens
QMATMEPGT

SEQ ID NO: 315811 - protein, 9 aa, Homo Sapiens
LNNTSKVSL

SEQ ID NO: 315812 - protein, 9 aa, Homo Sapiens
LKKIIYALK

SEQ ID NO: 315813 - protein, 9 aa, Homo Sapiens
EDPSSEAKA

SEQ ID NO: 315814 - protein, 9 aa, Homo Sapiens
KKLMEVDRG

SEQ ID NO: 315815 - protein, 9 aa, Homo Sapiens
RLQPLINHL

SEQ ID NO: 315816 - protein, 9 aa, Homo Sapiens
KHEQYMVNG

SEQ ID NO: 315817 - protein, 9 aa, Homo Sapiens
DSTGHALNE

SEQ ID NO: 315818 - protein, 9 aa, Homo Sapiens
GLNIPRKSS

SEQ ID NO: 315819 - protein, 9 aa, Homo Sapiens
AEDAQRVHI

SEQ ID NO: 315820 - protein, 9 aa, Homo Sapiens
TASGGGGAR

SEQ ID NO: 315821 - protein, 9 aa, Homo Sapiens
WRGSFIHSI

SEQ ID NO: 315822 - protein, 9 aa, Homo Sapiens
LKSDHPLGH

SEQ ID NO: 315823 - protein, 9 aa, Homo Sapiens
DCFVEGVCP

SEQ ID NO: 315824 - protein, 9 aa, Homo Sapiens
LECSLDREE

SEQ ID NO: 315825 - protein, 9 aa, Homo Sapiens
GNPQDTRLP

SEQ ID NO: 315826 - protein, 9 aa, Homo Sapiens
LLQDYIEAC

SEQ ID NO: 315827 - protein, 9 aa, Homo Sapiens
RVHIKALED

SEQ ID NO: 315828 - protein, 9 aa, Homo Sapiens
SLYSKNGMA

SEQ ID NO: 315829 - protein, 9 aa, Homo Sapiens
DWGYDDRDY

SEQ ID NO: 315830 - protein, 9 aa, Homo Sapiens
QDAVRGCRG

SEQ ID NO: 315831 - protein, 9 aa, Homo Sapiens
SGTQLDSSP

SEQ ID NO: 315832 - protein, 9 aa, Homo Sapiens
QFTAVKFSD

SEQ ID NO: 315833 - protein, 9 aa, Homo Sapiens
GNQHIPGDD

SEQ ID NO: 315834 - protein, 9 aa, Homo Sapiens
AWTWALLLP

SEQ ID NO: 315835 - protein, 9 aa, Homo Sapiens
ITGGVIAVV

SEQ ID NO: 315836 - protein, 9 aa, Homo Sapiens
RMRKELCTL

SEQ ID NO: 315837 - protein, 9 aa, Homo Sapiens
VLECSLDRE

SEQ ID NO: 315838 - protein, 9 aa, Homo Sapiens
EEVVAEVHI

SEQ ID NO: 315839 - protein, 9 aa, Homo Sapiens
HDRKHFVGE

SEQ ID NO: 315840 - protein, 9 aa, Homo Sapiens
LKYAGLGQL

SEQ ID NO: 315841 - protein, 9 aa, Homo Sapiens
EGAVSMLEA

SEQ ID NO: 315842 - protein, 9 aa, Homo Sapiens
SKVSLHRSE

SEQ ID NO: 315843 - protein, 9 aa, Homo Sapiens
VLCCQAWQD

SEQ ID NO: 315844 - protein, 9 aa, Homo Sapiens
PSSSLSAQQ

SEQ ID NO: 315845 - protein, 9 aa, Homo Sapiens
QTTSIMDAL

SEQ ID NO: 315846 - protein, 9 aa, Homo Sapiens
APARCEEYN

SEQ ID NO: 315847 - protein, 9 aa, Homo Sapiens
PLPTLANAS

SEQ ID NO: 315848 - protein, 9 aa, Homo Sapiens
GEDMQTTSI

SEQ ID NO: 315849 - protein, 9 aa, Homo Sapiens
FSPQHLNSQ

SEQ ID NO: 315850 - protein, 9 aa, Homo Sapiens
WDSTGHALN

SEQ ID NO: 315851 - protein, 9 aa, Homo Sapiens
ICDIDGYQG

SEQ ID NO: 315852 - protein, 9 aa, Homo Sapiens
SPMLARMRK

SEQ ID NO: 315853 - protein, 9 aa, Homo Sapiens
LLTSSSREW

SEQ ID NO: 315854 - protein, 9 aa, Homo Sapiens
NELLKAAKK

SEQ ID NO: 315855 - protein, 9 aa, Homo Sapiens
VACTCRRLT

SEQ ID NO: 315856 - protein, 9 aa, Homo Sapiens
LVLECSLDR

SEQ ID NO: 315857 - protein, 9 aa, Homo Sapiens
RMGMLGTHV

SEQ ID NO: 315858 - protein, 9 aa, Homo Sapiens
VVVGAVGVG

SEQ ID NO: 315859 - protein, 9 aa, Homo Sapiens
KAVSLNHLD

SEQ ID NO: 315860 - protein, 9 aa, Homo Sapiens
FSVVVLRSE

SEQ ID NO: 315861 - protein, 9 aa, Homo Sapiens
GYDWGYDDR

SEQ ID NO: 315862 - protein, 9 aa, Homo Sapiens
KGLNIPRKS

SEQ ID NO: 315863 - protein, 9 aa, Homo Sapiens
ETNELLKAA

SEQ ID NO: 315864 - protein, 9 aa, Homo Sapiens
DLLKYAGLG

SEQ ID NO: 315865 - protein, 9 aa, Homo Sapiens
GTLPSRHGK

SEQ ID NO: 315866 - protein, 9 aa, Homo Sapiens
MIRTPDELD

SEQ ID NO: 315867 - protein, 9 aa, Homo Sapiens
AEAHTRLKT

SEQ ID NO: 315868 - protein, 9 aa, Homo Sapiens
FTAVKFSDS

SEQ ID NO: 315869 - protein, 9 aa, Homo Sapiens
ACKKLQKKK

SEQ ID NO: 315870 - protein, 9 aa, Homo Sapiens
VGTVMTVLL

SEQ ID NO: 315871 - protein, 9 aa, Homo Sapiens
QREYPVPTS

SEQ ID NO: 315872 - protein, 9 aa, Homo Sapiens
IRTPDELDD

SEQ ID NO: 315873 - protein, 9 aa, Homo Sapiens
GTHVLSLVL

SEQ ID NO: 315874 - protein, 9 aa, Homo Sapiens
LQDYIEACS

SEQ ID NO: 315875 - protein, 9 aa, Homo Sapiens
SWVLLSAIE

SEQ ID NO: 315876 - protein, 9 aa, Homo Sapiens
DDKLWQSLR

SEQ ID NO: 315877 - protein, 9 aa, Homo Sapiens
HAFLDLLKY

SEQ ID NO: 315878 - protein, 9 aa, Homo Sapiens
NRNSAITGG

SEQ ID NO: 315879 - protein, 9 aa, Homo Sapiens
PDYFPARDV

SEQ ID NO: 315880 - protein, 9 aa, Homo Sapiens
EVAATRAED

SEQ ID NO: 315881 - protein, 9 aa, Homo Sapiens
FKLNAIMSE

SEQ ID NO: 315882 - protein, 9 aa, Homo Sapiens
ISTVEERTE

SEQ ID NO: 315883 - protein, 9 aa, Homo Sapiens
RNSFEVHVC

SEQ ID NO: 315884 - protein, 9 aa, Homo Sapiens
QLKALHSTH

SEQ ID NO: 315885 - protein, 9 aa, Homo Sapiens
DPEPMNPFQ

SEQ ID NO: 315886 - protein, 9 aa, Homo Sapiens
TNQWEAVGP

SEQ ID NO: 315887 - protein, 9 aa, Homo Sapiens
RVYNWFATR

SEQ ID NO: 315888 - protein, 9 aa, Homo Sapiens
HLYLFFHFG

SEQ ID NO: 315889 - protein, 9 aa, Homo Sapiens
RAGRSLGLS

SEQ ID NO: 315890 - protein, 9 aa, Homo Sapiens
DAPSAFWPL

SEQ ID NO: 315891 - protein, 9 aa, Homo Sapiens
IKTRGQQVI

SEQ ID NO: 315892 - protein, 9 aa, Homo Sapiens
LRLPGNHLG

SEQ ID NO: 315893 - protein, 9 aa, Homo Sapiens
FHYSLLKGN

SEQ ID NO: 315894 - protein, 9 aa, Homo Sapiens
FSDSRIALK

SEQ ID NO: 315895 - protein, 9 aa, Homo Sapiens
DPEVLRKHM

SEQ ID NO: 315896 - protein, 9 aa, Homo Sapiens
FNLNNTSKV

SEQ ID NO: 315897 - protein, 9 aa, Homo Sapiens
HALNEAHQI

SEQ ID NO: 315898 - protein, 9 aa, Homo Sapiens
AITGGVIAV

SEQ ID NO: 315899 - protein, 9 aa, Homo Sapiens
HSKRKRCEV

SEQ ID NO: 315900 - protein, 9 aa, Homo Sapiens
ITTKHSRLY

SEQ ID NO: 315901 - protein, 9 aa, Homo Sapiens
DHVEPGRRQ

SEQ ID NO: 315902 - protein, 9 aa, Homo Sapiens
LHCKLPQFC

SEQ ID NO: 315903 - protein, 9 aa, Homo Sapiens
RGCDLPQTH

SEQ ID NO: 315904 - protein, 9 aa, Homo Sapiens
RAGLVPPPP

SEQ ID NO: 315905 - protein, 9 aa, Homo Sapiens
ECSLDREEE

SEQ ID NO: 315906 - protein, 9 aa, Homo Sapiens
DIDGYQGPP

SEQ ID NO: 315907 - protein, 9 aa, Homo Sapiens
KWDSTGHAL

SEQ ID NO: 315908 - protein, 9 aa, Homo Sapiens
GIVLKDGNW

SEQ ID NO: 315909 - protein, 9 aa, Homo Sapiens
QKFLVYTYN

SEQ ID NO: 315910 - protein, 9 aa, Homo Sapiens
VRGCRGPPA

SEQ ID NO: 315911 - protein, 9 aa, Homo Sapiens
HSWVLLSAI

SEQ ID NO: 315912 - protein, 9 aa, Homo Sapiens
ARRQHRQTA

SEQ ID NO: 315913 - protein, 9 aa, Homo Sapiens
AGLVPPPPK

SEQ ID NO: 315914 - protein, 9 aa, Homo Sapiens
HQKIHTGEW

SEQ ID NO: 315915 - protein, 9 aa, Homo Sapiens
MTTNQKKVL

SEQ ID NO: 315916 - protein, 9 aa, Homo Sapiens
PGYISLVEE

SEQ ID NO: 315917 - protein, 9 aa, Homo Sapiens
HGYFKGIIQ

SEQ ID NO: 315918 - protein, 9 aa, Homo Sapiens
MTVLLQEVA

SEQ ID NO: 315919 - protein, 9 aa, Homo Sapiens
RRQKGKRIN

SEQ ID NO: 315920 - protein, 9 aa, Homo Sapiens
KKVLKVEHT

SEQ ID NO: 315921 - protein, 9 aa, Homo Sapiens
VGQVEHLEE

SEQ ID NO: 315922 - protein, 9 aa, Homo Sapiens
SRGMGFIRF

SEQ ID NO: 315923 - protein, 9 aa, Homo Sapiens
LEGAVSMLE

SEQ ID NO: 315924 - protein, 9 aa, Homo Sapiens
STGHALNEA

SEQ ID NO: 315925 - protein, 9 aa, Homo Sapiens
GLRLPGNHL

SEQ ID NO: 315926 - protein, 9 aa, Homo Sapiens
TAKKIHFRM

SEQ ID NO: 315927 - protein, 9 aa, Homo Sapiens
APSAFWPLR

SEQ ID NO: 315928 - protein, 9 aa, Homo Sapiens
GIYVMGFNR

SEQ ID NO: 315929 - protein, 9 aa, Homo Sapiens
DDKHEQYMV

SEQ ID NO: 315930 - protein, 9 aa, Homo Sapiens
NYRLFHDRK

SEQ ID NO: 315931 - protein, 9 aa, Homo Sapiens
TTNKRYPKD

SEQ ID NO: 315932 - protein, 9 aa, Homo Sapiens
LYLFFHFGI

SEQ ID NO: 315933 - protein, 9 aa, Homo Sapiens
PTLPLPTLA

SEQ ID NO: 315934 - protein, 9 aa, Homo Sapiens
YNWFATRRK

SEQ ID NO: 315935 - protein, 9 aa, Homo Sapiens
VSRGMGFIR

SEQ ID NO: 315936 - protein, 9 aa, Homo Sapiens
SMSANPAPE

SEQ ID NO: 315937 - protein, 9 aa, Homo Sapiens
FLADCFVEG

SEQ ID NO: 315938 - protein, 9 aa, Homo Sapiens
QLRPSHTAP

SEQ ID NO: 315939 - protein, 9 aa, Homo Sapiens
YRLFHDRKH

SEQ ID NO: 315940 - protein, 9 aa, Homo Sapiens
SGGGGARRW

SEQ ID NO: 315941 - protein, 9 aa, Homo Sapiens
EELLKGIYV

SEQ ID NO: 315942 - protein, 9 aa, Homo Sapiens
TCVTECGGT

SEQ ID NO: 315943 - protein, 9 aa, Homo Sapiens
RAAATASGG

SEQ ID NO: 315944 - protein, 9 aa, Homo Sapiens
GQQVILRCS

SEQ ID NO: 315945 - protein, 9 aa, Homo Sapiens
STPLSPGYI

SEQ ID NO: 315946 - protein, 9 aa, Homo Sapiens
GCRGPPASA

SEQ ID NO: 315947 - protein, 9 aa, Homo Sapiens
ARDVPGPPR

SEQ ID NO: 315948 - protein, 9 aa, Homo Sapiens
RAEDLPGQA

SEQ ID NO: 315949 - protein, 9 aa, Homo Sapiens
GVASKVKLI

SEQ ID NO: 315950 - protein, 9 aa, Homo Sapiens
DRPLPTCVT

SEQ ID NO: 315951 - protein, 9 aa, Homo Sapiens
GRSFETVGH

SEQ ID NO: 315952 - protein, 9 aa, Homo Sapiens
DRGYDWGYD

SEQ ID NO: 315953 - protein, 9 aa, Homo Sapiens
NEDPSSEAK

SEQ ID NO: 315954 - protein, 9 aa, Homo Sapiens
QKKVLKVEH

SEQ ID NO: 315955 - protein, 9 aa, Homo Sapiens
AVLMIRTPD

SEQ ID NO: 315956 - protein, 9 aa, Homo Sapiens
KIKIFFCTG

SEQ ID NO: 315957 - protein, 9 aa, Homo Sapiens
SLAVFRILK

SEQ ID NO: 315958 - protein, 9 aa, Homo Sapiens
APKILYPAL

SEQ ID NO: 315959 - protein, 9 aa, Homo Sapiens
GMGFIRFDK

SEQ ID NO: 315960 - protein, 9 aa, Homo Sapiens
NSSVTLSLC

SEQ ID NO: 315961 - protein, 9 aa, Homo Sapiens
KVKLIILEN

SEQ ID NO: 315962 - protein, 9 aa, Homo Sapiens
NKRYPKDRV

SEQ ID NO: 315963 - protein, 9 aa, Homo Sapiens
QVRDEMDHM

SEQ ID NO: 315964 - protein, 9 aa, Homo Sapiens
AAAPTSTQP

SEQ ID NO: 315965 - protein, 9 aa, Homo Sapiens
NEFKLNAIM

SEQ ID NO: 315966 - protein, 9 aa, Homo Sapiens
LINHLSHSY

SEQ ID NO: 315967 - protein, 9 aa, Homo Sapiens
QVTVTDADD

SEQ ID NO: 315968 - protein, 9 aa, Homo Sapiens
SYKSICSRG

SEQ ID NO: 315969 - protein, 9 aa, Homo Sapiens
IHTGEWPYK

SEQ ID NO: 315970 - protein, 9 aa, Homo Sapiens
YFPARDVPG

SEQ ID NO: 315971 - protein, 9 aa, Homo Sapiens
TSKVSLHRS

SEQ ID NO: 315972 - protein, 9 aa, Homo Sapiens
HIKALEDDE

SEQ ID NO: 315973 - protein, 9 aa, Homo Sapiens
GKQSFLPQK

SEQ ID NO: 315974 - protein, 9 aa, Homo Sapiens
LDQNDNAPK

SEQ ID NO: 315975 - protein, 9 aa, Homo Sapiens
LKKLMEVDR

SEQ ID NO: 315976 - protein, 9 aa, Homo Sapiens
QSFLPQKFL

SEQ ID NO: 315977 - protein, 9 aa, Homo Sapiens
EYPVPTSKR

SEQ ID NO: 315978 - protein, 9 aa, Homo Sapiens
LPTCVTECG

SEQ ID NO: 315979 - protein, 9 aa, Homo Sapiens
FPELLCVWV

SEQ ID NO: 315980 - protein, 9 aa, Homo Sapiens
KYAGLGQLA

SEQ ID NO: 315981 - protein, 9 aa, Homo Sapiens
VGPLPKAVH

SEQ ID NO: 315982 - protein, 9 aa, Homo Sapiens
LPSRHGKSE

SEQ ID NO: 315983 - protein, 9 aa, Homo Sapiens
GLVPPPPKN

SEQ ID NO: 315984 - protein, 9 aa, Homo Sapiens
DSGLLTSSS

SEQ ID NO: 315985 - protein, 9 aa, Homo Sapiens
MGMLGTHVL

SEQ ID NO: 315986 - protein, 9 aa, Homo Sapiens
STKGLNIPR

SEQ ID NO: 315987 - protein, 9 aa, Homo Sapiens
TIDSEDTVW

SEQ ID NO: 315988 - protein, 9 aa, Homo Sapiens
FRILKSFNY

SEQ ID NO: 315989 - protein, 9 aa, Homo Sapiens
EFKLNAIMS

SEQ ID NO: 315990 - protein, 9 aa, Homo Sapiens
HMVYRVLVQ

SEQ ID NO: 315991 - protein, 9 aa, Homo Sapiens
AVLALLSFW

SEQ ID NO: 315992 - protein, 9 aa, Homo Sapiens
LSFWPGGYP

SEQ ID NO: 315993 - protein, 9 aa, Homo Sapiens
HPKTTGLSL

SEQ ID NO: 315994 - protein, 9 aa, Homo Sapiens
QYLLPEEVD

SEQ ID NO: 315995 - protein, 9 aa, Homo Sapiens
MLGTHVLSL

SEQ ID NO: 315996 - protein, 9 aa, Homo Sapiens
ELVLECSLD

SEQ ID NO: 315997 - protein, 9 aa, Homo Sapiens
PAAEAHTRL

SEQ ID NO: 315998 - protein, 9 aa, Homo Sapiens
LKALHSTHE

SEQ ID NO: 315999 - protein, 9 aa, Homo Sapiens
ARQFPEPMT

SEQ ID NO: 316000 - protein, 9 aa, Homo Sapiens
QVLHCKLPQ

SEQ ID NO: 316001 - protein, 9 aa, Homo Sapiens
SSSREWKVK

SEQ ID NO: 316002 - protein, 9 aa, Homo Sapiens
YFSQLLRRH

SEQ ID NO: 316003 - protein, 9 aa, Homo Sapiens
EGPYEVLND

SEQ ID NO: 316004 - protein, 9 aa, Homo Sapiens
AQDAVRGCR

SEQ ID NO: 316005 - protein, 9 aa, Homo Sapiens
DVSLAVFRI

SEQ ID NO: 316006 - protein, 9 aa, Homo Sapiens
YAYRCLMSP

SEQ ID NO: 316007 - protein, 9 aa, Homo Sapiens
SKNGMACYL

SEQ ID NO: 316008 - protein, 9 aa, Homo Sapiens
KKLQKKKNK

SEQ ID NO: 316009 - protein, 9 aa, Homo Sapiens
GDDSIYVTK

SEQ ID NO: 316010 - protein, 9 aa, Homo Sapiens
PKWDSTGHA

SEQ ID NO: 316011 - protein, 9 aa, Homo Sapiens
VIQINASLH

SEQ ID NO: 316012 - protein, 9 aa, Homo Sapiens
RQGSRGGLG

SEQ ID NO: 316013 - protein, 9 aa, Homo Sapiens
GYPAYSKDS

SEQ ID NO: 316014 - protein, 9 aa, Homo Sapiens
AVACTCRRL

SEQ ID NO: 316015 - protein, 9 aa, Homo Sapiens
YLEDRKKWV

SEQ ID NO: 316016 - protein, 9 aa, Homo Sapiens
DLLVLCCQA

SEQ ID NO: 316017 - protein, 9 aa, Homo Sapiens
PFPQLRPSH

SEQ ID NO: 316018 - protein, 9 aa, Homo Sapiens
DHSWVLLSA

SEQ ID NO: 316019 - protein, 9 aa, Homo Sapiens
TKHSKRKRC

SEQ ID NO: 316020 - protein, 9 aa, Homo Sapiens
HCARFLADC

SEQ ID NO: 316021 - protein, 9 aa, Homo Sapiens
RASKPTTKS

SEQ ID NO: 316022 - protein, 9 aa, Homo Sapiens
PEDPNEDPS

SEQ ID NO: 316023 - protein, 9 aa, Homo Sapiens
EDAQRVHIK

SEQ ID NO: 316024 - protein, 9 aa, Homo Sapiens
SLQTTQSIQ

SEQ ID NO: 316025 - protein, 9 aa, Homo Sapiens
FHLGTLPPS

SEQ ID NO: 316026 - protein, 9 aa, Homo Sapiens
LNIPRKSSI

SEQ ID NO: 316027 - protein, 9 aa, Homo Sapiens
SICSRGCDL

SEQ ID NO: 316028 - protein, 9 aa, Homo Sapiens
WQSLRRFAN

SEQ ID NO: 316029 - protein, 9 aa, Homo Sapiens
TNKRYPKDR

SEQ ID NO: 316030 - protein, 9 aa, Homo Sapiens
SQRYDQGGK

SEQ ID NO: 316031 - protein, 9 aa, Homo Sapiens
SSLSAQQTE

SEQ ID NO: 316032 - protein, 9 aa, Homo Sapiens
MAEDAQRVH

SEQ ID NO: 316033 - protein, 9 aa, Homo Sapiens
KGQMATMEP

SEQ ID NO: 316034 - protein, 9 aa, Homo Sapiens
LSPGYISLV

SEQ ID NO: 316035 - protein, 9 aa, Homo Sapiens
SGINMTGFR

SEQ ID NO: 316036 - protein, 9 aa, Homo Sapiens
AAAVVATGD

SEQ ID NO: 316037 - protein, 9 aa, Homo Sapiens
QDTRLPYSF

SEQ ID NO: 316038 - protein, 9 aa, Homo Sapiens
ATGDKWKPP

SEQ ID NO: 316039 - protein, 9 aa, Homo Sapiens
CCQAWQDWP

SEQ ID NO: 316040 - protein, 9 aa, Homo Sapiens
GMACYLTNH

SEQ ID NO: 316041 - protein, 9 aa, Homo Sapiens
TARASKPTT

SEQ ID NO: 316042 - protein, 9 aa, Homo Sapiens
YAGLGQLAT

SEQ ID NO: 316043 - protein, 9 aa, Homo Sapiens
ITNFWKEDA

SEQ ID NO: 316044 - protein, 9 aa, Homo Sapiens
VYNWFATRR

SEQ ID NO: 316045 - protein, 9 aa, Homo Sapiens
ATRAEDLPG

SEQ ID NO: 316046 - protein, 9 aa, Homo Sapiens
WFATRRKEE

SEQ ID NO: 316047 - protein, 9 aa, Homo Sapiens
DPNEDPSSE

SEQ ID NO: 316048 - protein, 9 aa, Homo Sapiens
YMVNGIMLS

SEQ ID NO: 316049 - protein, 9 aa, Homo Sapiens
DYYDRGYDW

SEQ ID NO: 316050 - protein, 9 aa, Homo Sapiens
LFHDRKHFV

SEQ ID NO: 316051 - protein, 9 aa, Homo Sapiens
LPGNHLGNA

SEQ ID NO: 316052 - protein, 9 aa, Homo Sapiens
MACYLTNHG

SEQ ID NO: 316053 - protein, 9 aa, Homo Sapiens
KILYPALPT

SEQ ID NO: 316054 - protein, 9 aa, Homo Sapiens
FSGTQLDSS

SEQ ID NO: 316055 - protein, 9 aa, Homo Sapiens
LWSRPVIQI

SEQ ID NO: 316056 - protein, 9 aa, Homo Sapiens
MGRAAATAS

SEQ ID NO: 316057 - protein, 9 aa, Homo Sapiens
YKLVVVGAV

SEQ ID NO: 316058 - protein, 9 aa, Homo Sapiens
PQKFLVYTY

SEQ ID NO: 316059 - protein, 9 aa, Homo Sapiens
LWQSLRRFA

SEQ ID NO: 316060 - protein, 9 aa, Homo Sapiens
IKYYAEMCV

SEQ ID NO: 316061 - protein, 9 aa, Homo Sapiens
EAHTRLKTQ

SEQ ID NO: 316062 - protein, 9 aa, Homo Sapiens
LVLCCQAWQ

SEQ ID NO: 316063 - protein, 9 aa, Homo Sapiens
PYSFFVPRP

SEQ ID NO: 316064 - protein, 9 aa, Homo Sapiens
IIYALKAPK

SEQ ID NO: 316065 - protein, 9 aa, Homo Sapiens
FPARDVPGP

SEQ ID NO: 316066 - protein, 9 aa, Homo Sapiens
AEVHISTVE

SEQ ID NO: 316067 - protein, 9 aa, Homo Sapiens
EWKCLDTAQ

SEQ ID NO: 316068 - protein, 9 aa, Homo Sapiens
LPLPNLRMV

SEQ ID NO: 316069 - protein, 9 aa, Homo Sapiens
TCRRLTAVP

SEQ ID NO: 316070 - protein, 9 aa, Homo Sapiens
IQDVQLLVM

SEQ ID NO: 316071 - protein, 9 aa, Homo Sapiens
NGMACYLTN

SEQ ID NO: 316072 - protein, 9 aa, Homo Sapiens
EMTLEGAVS

SEQ ID NO: 316073 - protein, 9 aa, Homo Sapiens
GGKFTSEMI

SEQ ID NO: 316074 - protein, 9 aa, Homo Sapiens
PYEVLNDSS

SEQ ID NO: 316075 - protein, 9 aa, Homo Sapiens
SSSINEIPA

SEQ ID NO: 316076 - protein, 9 aa, Homo Sapiens
LAELDPEPM

SEQ ID NO: 316077 - protein, 9 aa, Homo Sapiens
KKEKGQMAT

SEQ ID NO: 316078 - protein, 9 aa, Homo Sapiens
TGEWPYKCG

SEQ ID NO: 316079 - protein, 9 aa, Homo Sapiens
ATASGGGGA

SEQ ID NO: 316080 - protein, 9 aa, Homo Sapiens
LFFHFGISQ

SEQ ID NO: 316081 - protein, 9 aa, Homo Sapiens
FLVFSLKKI

SEQ ID NO: 316082 - protein, 9 aa, Homo Sapiens
LMIRTPDEL

SEQ ID NO: 316083 - protein, 9 aa, Homo Sapiens
MVRGTQVYD

SEQ ID NO: 316084 - protein, 9 aa, Homo Sapiens
FEGDLLVLC

SEQ ID NO: 316085 - protein, 9 aa, Homo Sapiens
DNAPKILYP

SEQ ID NO: 316086 - protein, 9 aa, Homo Sapiens
KFPELLCVW

SEQ ID NO: 316087 - protein, 9 aa, Homo Sapiens
ASPDYFPAR

SEQ ID NO: 316088 - protein, 9 aa, Homo Sapiens
EDLPGQAGD

SEQ ID NO: 316089 - protein, 9 aa, Homo Sapiens
LAHTHYKRS

SEQ ID NO: 316090 - protein, 9 aa, Homo Sapiens
AACYFSQLL

SEQ ID NO: 316091 - protein, 9 aa, Homo Sapiens
GNHLGNAGL

SEQ ID NO: 316092 - protein, 9 aa, Homo Sapiens
MTLEGAVSM

SEQ ID NO: 316093 - protein, 9 aa, Homo Sapiens
ATRGTARAS

SEQ ID NO: 316094 - protein, 9 aa, Homo Sapiens
YSKNGMACY

SEQ ID NO: 316095 - protein, 9 aa, Homo Sapiens
LKDGNWNLT

SEQ ID NO: 316096 - protein, 9 aa, Homo Sapiens
PMLARMRKE

SEQ ID NO: 316097 - protein, 9 aa, Homo Sapiens
VAEVHISTV

SEQ ID NO: 316098 - protein, 9 aa, Homo Sapiens
AGDAPDHVE

SEQ ID NO: 316099 - protein, 9 aa, Homo Sapiens
DALIDNSVK

SEQ ID NO: 316100 - protein, 9 aa, Homo Sapiens
PKQAQASGP

SEQ ID NO: 316101 - protein, 9 aa, Homo Sapiens
KNIAQLQHD

SEQ ID NO: 316102 - protein, 9 aa, Homo Sapiens
WAYVASKES

SEQ ID NO: 316103 - protein, 9 aa, Homo Sapiens
VPPPPKRKS

SEQ ID NO: 316104 - protein, 9 aa, Homo Sapiens
MKEPPTPIA

SEQ ID NO: 316105 - protein, 9 aa, Homo Sapiens
YVASKESHA

SEQ ID NO: 316106 - protein, 9 aa, Homo Sapiens
RKGNQERAV

SEQ ID NO: 316107 - protein, 9 aa, Homo Sapiens
SFAGLPSLQ

SEQ ID NO: 316108 - protein, 9 aa, Homo Sapiens
TLLVSVCEQ

SEQ ID NO: 316109 - protein, 9 aa, Homo Sapiens
NTLATRLLF

SEQ ID NO: 316110 - protein, 9 aa, Homo Sapiens
LIGQWSWDD

SEQ ID NO: 316111 - protein, 9 aa, Homo Sapiens
ESNLNQKRK

SEQ ID NO: 316112 - protein, 9 aa, Homo Sapiens
QSRGQEPQV

SEQ ID NO: 316113 - protein, 9 aa, Homo Sapiens
DYLVQWLLI

SEQ ID NO: 316114 - protein, 9 aa, Homo Sapiens
HVCRGSIIT

SEQ ID NO: 316115 - protein, 9 aa, Homo Sapiens
ELPELDERP

SEQ ID NO: 316116 - protein, 9 aa, Homo Sapiens
YKCMASNAA

SEQ ID NO: 316117 - protein, 9 aa, Homo Sapiens
MEGGYLCGC

SEQ ID NO: 316118 - protein, 9 aa, Homo Sapiens
NRLLWSHGQ

SEQ ID NO: 316119 - protein, 9 aa, Homo Sapiens
SHSSSDIHK

SEQ ID NO: 316120 - protein, 9 aa, Homo Sapiens
KLSTQDYVQ

SEQ ID NO: 316121 - protein, 9 aa, Homo Sapiens
AQSEEGASS

SEQ ID NO: 316122 - protein, 9 aa, Homo Sapiens
ASKATLLNM

SEQ ID NO: 316123 - protein, 9 aa, Homo Sapiens
WCYRLKHLS

SEQ ID NO: 316124 - protein, 9 aa, Homo Sapiens
VFPGMTTRT

SEQ ID NO: 316125 - protein, 9 aa, Homo Sapiens
SESNWVCSQ

SEQ ID NO: 316126 - protein, 9 aa, Homo Sapiens
TGDKVGASK

SEQ ID NO: 316127 - protein, 9 aa, Homo Sapiens
NDQYIGENA

SEQ ID NO: 316128 - protein, 9 aa, Homo Sapiens
PVPPPPKRK

SEQ ID NO: 316129 - protein, 9 aa, Homo Sapiens
KATKEAAGA

SEQ ID NO: 316130 - protein, 9 aa, Homo Sapiens
MLVHFINPE

SEQ ID NO: 316131 - protein, 9 aa, Homo Sapiens
LLNRGLVVH

SEQ ID NO: 316132 - protein, 9 aa, Homo Sapiens
EPKPFLYIV

SEQ ID NO: 316133 - protein, 9 aa, Homo Sapiens
PHMLHHFLT

SEQ ID NO: 316134 - protein, 9 aa, Homo Sapiens
MEVIPNALY

SEQ ID NO: 316135 - protein, 9 aa, Homo Sapiens
ESQDWAYVA

SEQ ID NO: 316136 - protein, 9 aa, Homo Sapiens
LSWRHRGQG

SEQ ID NO: 316137 - protein, 9 aa, Homo Sapiens
IAVDHLGCN

SEQ ID NO: 316138 - protein, 9 aa, Homo Sapiens
IVGRKKMMD

SEQ ID NO: 316139 - protein, 9 aa, Homo Sapiens
RGRSPNAHS

SEQ ID NO: 316140 - protein, 9 aa, Homo Sapiens
PVPPADGKK

SEQ ID NO: 316141 - protein, 9 aa, Homo Sapiens
TPRAQSEEG

SEQ ID NO: 316142 - protein, 9 aa, Homo Sapiens
EVGSAHAIV

SEQ ID NO: 316143 - protein, 9 aa, Homo Sapiens
QTVGFMPPP

SEQ ID NO: 316144 - protein, 9 aa, Homo Sapiens
VTMPFMFAG

SEQ ID NO: 316145 - protein, 9 aa, Homo Sapiens
AQRAQQAQQ

SEQ ID NO: 316146 - protein, 9 aa, Homo Sapiens
EPQVPSSSK

SEQ ID NO: 316147 - protein, 9 aa, Homo Sapiens
CRWCYRLKH

SEQ ID NO: 316148 - protein, 9 aa, Homo Sapiens
FLNTLATRL

SEQ ID NO: 316149 - protein, 9 aa, Homo Sapiens
AVGSGTCIM

SEQ ID NO: 316150 - protein, 9 aa, Homo Sapiens
AIVQLRTSR

SEQ ID NO: 316151 - protein, 9 aa, Homo Sapiens
HKEPPASSS

SEQ ID NO: 316152 - protein, 9 aa, Homo Sapiens
TFPPLLPPT

SEQ ID NO: 316153 - protein, 9 aa, Homo Sapiens
KVDFFAMEL

SEQ ID NO: 316154 - protein, 9 aa, Homo Sapiens
CVYVCVSVG

SEQ ID NO: 316155 - protein, 9 aa, Homo Sapiens
YSAQAHPHK

SEQ ID NO: 316156 - protein, 9 aa, Homo Sapiens
HRMNSATGH

SEQ ID NO: 316157 - protein, 9 aa, Homo Sapiens
QLQHDMEAH

SEQ ID NO: 316158 - protein, 9 aa, Homo Sapiens
EKQLTHSRR

SEQ ID NO: 316159 - protein, 9 aa, Homo Sapiens
KHSRHKKKE

SEQ ID NO: 316160 - protein, 9 aa, Homo Sapiens
RNRSRGRRS

SEQ ID NO: 316161 - protein, 9 aa, Homo Sapiens
GTTDQEGPH

SEQ ID NO: 316162 - protein, 9 aa, Homo Sapiens
NMRQTGYCP

SEQ ID NO: 316163 - protein, 9 aa, Homo Sapiens
GEFLCRWCY

SEQ ID NO: 316164 - protein, 9 aa, Homo Sapiens
IMQVGQQLF

SEQ ID NO: 316165 - protein, 9 aa, Homo Sapiens
PLQDNELPE

SEQ ID NO: 316166 - protein, 9 aa, Homo Sapiens
ADGKKLPTS

SEQ ID NO: 316167 - protein, 9 aa, Homo Sapiens
HAPRNLTFP

SEQ ID NO: 316168 - protein, 9 aa, Homo Sapiens
RWAAASKLG

SEQ ID NO: 316169 - protein, 9 aa, Homo Sapiens
QLTHSRRGS

SEQ ID NO: 316170 - protein, 9 aa, Homo Sapiens
PGMTTRTFC

SEQ ID NO: 316171 - protein, 9 aa, Homo Sapiens
TMPFMFAGL

SEQ ID NO: 316172 - protein, 9 aa, Homo Sapiens
ARSQYSLTV

SEQ ID NO: 316173 - protein, 9 aa, Homo Sapiens
QAGCNHVLN

SEQ ID NO: 316174 - protein, 9 aa, Homo Sapiens
IASMVQAGG

SEQ ID NO: 316175 - protein, 9 aa, Homo Sapiens
KENVFPGMT

SEQ ID NO: 316176 - protein, 9 aa, Homo Sapiens
PRAQSEEGA

SEQ ID NO: 316177 - protein, 9 aa, Homo Sapiens
VDFFAMELL

SEQ ID NO: 316178 - protein, 9 aa, Homo Sapiens
VGFMPPPVS

SEQ ID NO: 316179 - protein, 9 aa, Homo Sapiens
YEWPLYMWP

SEQ ID NO: 316180 - protein, 9 aa, Homo Sapiens
PYLWLPEAA

SEQ ID NO: 316181 - protein, 9 aa, Homo Sapiens
NHQVHLRRY

SEQ ID NO: 316182 - protein, 9 aa, Homo Sapiens
VFNRLLWSH

SEQ ID NO: 316183 - protein, 9 aa, Homo Sapiens
HSDLSRELE

SEQ ID NO: 316184 - protein, 9 aa, Homo Sapiens
KGLQTVGFM

SEQ ID NO: 316185 - protein, 9 aa, Homo Sapiens
TIENVQPIL

SEQ ID NO: 316186 - protein, 9 aa, Homo Sapiens
ARAKVEKLH

SEQ ID NO: 316187 - protein, 9 aa, Homo Sapiens
HSSSDIHKV

SEQ ID NO: 316188 - protein, 9 aa, Homo Sapiens
VHLCVCVYV

SEQ ID NO: 316189 - protein, 9 aa, Homo Sapiens
FAMELLDGN

SEQ ID NO: 316190 - protein, 9 aa, Homo Sapiens
TGRSIVYSY

SEQ ID NO: 316191 - protein, 9 aa, Homo Sapiens
LLRHGANLS

SEQ ID NO: 316192 - protein, 9 aa, Homo Sapiens
EGPHLMDLQ

SEQ ID NO: 316193 - protein, 9 aa, Homo Sapiens
LQMTRMLQQ

SEQ ID NO: 316194 - protein, 9 aa, Homo Sapiens
GDTLDAIFT

SEQ ID NO: 316195 - protein, 9 aa, Homo Sapiens
DILKLCEQE

SEQ ID NO: 316196 - protein, 9 aa, Homo Sapiens
SEECEKAVN

SEQ ID NO: 316197 - protein, 9 aa, Homo Sapiens
QKKYYNTMK

SEQ ID NO: 316198 - protein, 9 aa, Homo Sapiens
NEVGSAHAI

SEQ ID NO: 316199 - protein, 9 aa, Homo Sapiens
PVSCSLQDK

SEQ ID NO: 316200 - protein, 9 aa, Homo Sapiens
GANLSFEDP

SEQ ID NO: 316201 - protein, 9 aa, Homo Sapiens
YTKVNFCKS

SEQ ID NO: 316202 - protein, 9 aa, Homo Sapiens
KQRGRFRAM

SEQ ID NO: 316203 - protein, 9 aa, Homo Sapiens
RSKHVSLVD

SEQ ID NO: 316204 - protein, 9 aa, Homo Sapiens
GLQTVGFMP

SEQ ID NO: 316205 - protein, 9 aa, Homo Sapiens
FFAMELLDG

SEQ ID NO: 316206 - protein, 9 aa, Homo Sapiens
IGRCNEVVI

SEQ ID NO: 316207 - protein, 9 aa, Homo Sapiens
RMKHKKQLW

SEQ ID NO: 316208 - protein, 9 aa, Homo Sapiens
STMNPVIYT

SEQ ID NO: 316209 - protein, 9 aa, Homo Sapiens
KCMASNAAG

SEQ ID NO: 316210 - protein, 9 aa, Homo Sapiens
MKHKKQLWK

SEQ ID NO: 316211 - protein, 9 aa, Homo Sapiens
CNIFWTDSN

SEQ ID NO: 316212 - protein, 9 aa, Homo Sapiens
SKHVSLVDM

SEQ ID NO: 316213 - protein, 9 aa, Homo Sapiens
TFKNFFVEA

SEQ ID NO: 316214 - protein, 9 aa, Homo Sapiens
FQPHCGEAG

SEQ ID NO: 316215 - protein, 9 aa, Homo Sapiens
DEDEGLPAS

SEQ ID NO: 316216 - protein, 9 aa, Homo Sapiens
GFMPPPVSS

SEQ ID NO: 316217 - protein, 9 aa, Homo Sapiens
QESNLNQKR

SEQ ID NO: 316218 - protein, 9 aa, Homo Sapiens
TDKDYLVQW

SEQ ID NO: 316219 - protein, 9 aa, Homo Sapiens
KQMHGQLAG

SEQ ID NO: 316220 - protein, 9 aa, Homo Sapiens
TQDYVQVVL

SEQ ID NO: 316221 - protein, 9 aa, Homo Sapiens
CNEVVITEN

SEQ ID NO: 316222 - protein, 9 aa, Homo Sapiens
LSNSIERKG

SEQ ID NO: 316223 - protein, 9 aa, Homo Sapiens
FNDKKIVIK

SEQ ID NO: 316224 - protein, 9 aa, Homo Sapiens
TVGFMPPPV

SEQ ID NO: 316225 - protein, 9 aa, Homo Sapiens
GMTTRTFCG

SEQ ID NO: 316226 - protein, 9 aa, Homo Sapiens
LVFLNTLAT

SEQ ID NO: 316227 - protein, 9 aa, Homo Sapiens
YGCSNMEGG

SEQ ID NO: 316228 - protein, 9 aa, Homo Sapiens
LRTLLVSVC

SEQ ID NO: 316229 - protein, 9 aa, Homo Sapiens
VQRKEKQLT

SEQ ID NO: 316230 - protein, 9 aa, Homo Sapiens
IMQNLSSVQ

SEQ ID NO: 316231 - protein, 9 aa, Homo Sapiens
LPENEYMFS

SEQ ID NO: 316232 - protein, 9 aa, Homo Sapiens
QLPLLPGHP

SEQ ID NO: 316233 - protein, 9 aa, Homo Sapiens
VDILKLCEQ

SEQ ID NO: 316234 - protein, 9 aa, Homo Sapiens
KPFLYIVGR

SEQ ID NO: 316235 - protein, 9 aa, Homo Sapiens
GASKATLLN

SEQ ID NO: 316236 - protein, 9 aa, Homo Sapiens
HAIVQLRTS

SEQ ID NO: 316237 - protein, 9 aa, Homo Sapiens
LWMTCCLLG

SEQ ID NO: 316238 - protein, 9 aa, Homo Sapiens
LVVHHSGIL

SEQ ID NO: 316239 - protein, 9 aa, Homo Sapiens
LYIVGRKKM

SEQ ID NO: 316240 - protein, 9 aa, Homo Sapiens
IVQLRTSRP

SEQ ID NO: 316241 - protein, 9 aa, Homo Sapiens
MNSATGHRK

SEQ ID NO: 316242 - protein, 9 aa, Homo Sapiens
LKLCEQEDL

SEQ ID NO: 316243 - protein, 9 aa, Homo Sapiens
LWSHGQGLW

SEQ ID NO: 316244 - protein, 9 aa, Homo Sapiens
VSVCEQLAV

SEQ ID NO: 316245 - protein, 9 aa, Homo Sapiens
LIHRMNSAT

SEQ ID NO: 316246 - protein, 9 aa, Homo Sapiens
FAKDITSGM

SEQ ID NO: 316247 - protein, 9 aa, Homo Sapiens
LCRWCYRLK

SEQ ID NO: 316248 - protein, 9 aa, Homo Sapiens
HMLHHFLTS

SEQ ID NO: 316249 - protein, 9 aa, Homo Sapiens
CSQVKEIES

SEQ ID NO: 316250 - protein, 9 aa, Homo Sapiens
KCNNMRQTG

SEQ ID NO: 316251 - protein, 9 aa, Homo Sapiens
SIERKGNQE

SEQ ID NO: 316252 - protein, 9 aa, Homo Sapiens
QAQQLLQLQ

SEQ ID NO: 316253 - protein, 9 aa, Homo Sapiens
ATIENVQPI

SEQ ID NO: 316254 - protein, 9 aa, Homo Sapiens
RSKMGKLCR

SEQ ID NO: 316255 - protein, 9 aa, Homo Sapiens
LFQPHCGEA

SEQ ID NO: 316256 - protein, 9 aa, Homo Sapiens
CNHVLNSKA

SEQ ID NO: 316257 - protein, 9 aa, Homo Sapiens
WVIQKNRPA

SEQ ID NO: 316258 - protein, 9 aa, Homo Sapiens
RAQQAQQLL

SEQ ID NO: 316259 - protein, 9 aa, Homo Sapiens
VHWVRGGQP

SEQ ID NO: 316260 - protein, 9 aa, Homo Sapiens
QYIGENAQS

SEQ ID NO: 316261 - protein, 9 aa, Homo Sapiens
KECGELFIW

SEQ ID NO: 316262 - protein, 9 aa, Homo Sapiens
KNIASMVQA

SEQ ID NO: 316263 - protein, 9 aa, Homo Sapiens
GDEALIGQW

SEQ ID NO: 316264 - protein, 9 aa, Homo Sapiens
CVDILKLCE

SEQ ID NO: 316265 - protein, 9 aa, Homo Sapiens
YFGGMEVIP

SEQ ID NO: 316266 - protein, 9 aa, Homo Sapiens
YKSTKCNNM

SEQ ID NO: 316267 - protein, 9 aa, Homo Sapiens
PVTESNLSR

SEQ ID NO: 316268 - protein, 9 aa, Homo Sapiens
RRWVIQKNR

SEQ ID NO: 316269 - protein, 9 aa, Homo Sapiens
LQAKDCVRL

SEQ ID NO: 316270 - protein, 9 aa, Homo Sapiens
DFEARSQYS

SEQ ID NO: 316271 - protein, 9 aa, Homo Sapiens
VYKCMASNA

SEQ ID NO: 316272 - protein, 9 aa, Homo Sapiens
PFLYIVGRK

SEQ ID NO: 316273 - protein, 9 aa, Homo Sapiens
RRRSRNRSR

SEQ ID NO: 316274 - protein, 9 aa, Homo Sapiens
EDPVPPADG

SEQ ID NO: 316275 - protein, 9 aa, Homo Sapiens
YLVQWLLIY

SEQ ID NO: 316276 - protein, 9 aa, Homo Sapiens
PPADGKKLP

SEQ ID NO: 316277 - protein, 9 aa, Homo Sapiens
NAHSGGRNS

SEQ ID NO: 316278 - protein, 9 aa, Homo Sapiens
LRSKMGKLC

SEQ ID NO: 316279 - protein, 9 aa, Homo Sapiens
KEKQLTHSR

SEQ ID NO: 316280 - protein, 9 aa, Homo Sapiens
LLSLLQKDR

SEQ ID NO: 316281 - protein, 9 aa, Homo Sapiens
SRDRRRSRN

SEQ ID NO: 316282 - protein, 9 aa, Homo Sapiens
QVHLRRYSY

SEQ ID NO: 316283 - protein, 9 aa, Homo Sapiens
AKVEKLHSD

SEQ ID NO: 316284 - protein, 9 aa, Homo Sapiens
EVSRTCLLM

SEQ ID NO: 316285 - protein, 9 aa, Homo Sapiens
QFQVTACDA

SEQ ID NO: 316286 - protein, 9 aa, Homo Sapiens
GTCIMQVGQ

SEQ ID NO: 316287 - protein, 9 aa, Homo Sapiens
SRNRSRGRR

SEQ ID NO: 316288 - protein, 9 aa, Homo Sapiens
RAQSEEGAS

SEQ ID NO: 316289 - protein, 9 aa, Homo Sapiens
LDFEARSQY

SEQ ID NO: 316290 - protein, 9 aa, Homo Sapiens
DDDEDEGLP

SEQ ID NO: 316291 - protein, 9 aa, Homo Sapiens
RGLVVHHSG

SEQ ID NO: 316292 - protein, 9 aa, Homo Sapiens
NQKRKKEQP

SEQ ID NO: 316293 - protein, 9 aa, Homo Sapiens
FQVTACDAG

SEQ ID NO: 316294 - protein, 9 aa, Homo Sapiens
CRQAGCNHV

SEQ ID NO: 316295 - protein, 9 aa, Homo Sapiens
TRMLQQMDV

SEQ ID NO: 316296 - protein, 9 aa, Homo Sapiens
EEVARRWVI

SEQ ID NO: 316297 - protein, 9 aa, Homo Sapiens
YMAPKVLES

SEQ ID NO: 316298 - protein, 9 aa, Homo Sapiens
LNTLATRLL

SEQ ID NO: 316299 - protein, 9 aa, Homo Sapiens
GLVFLNTLA

SEQ ID NO: 316300 - protein, 9 aa, Homo Sapiens
QQLPLLPGH

SEQ ID NO: 316301 - protein, 9 aa, Homo Sapiens
QRAQQAQQL

SEQ ID NO: 316302 - protein, 9 aa, Homo Sapiens
KNGSQPLWM

SEQ ID NO: 316303 - protein, 9 aa, Homo Sapiens
IQLPPKQAQ

SEQ ID NO: 316304 - protein, 9 aa, Homo Sapiens
MKREADEAI

SEQ ID NO: 316305 - protein, 9 aa, Homo Sapiens
EKEGLPKAE

SEQ ID NO: 316306 - protein, 9 aa, Homo Sapiens
LPKAEATRK

SEQ ID NO: 316307 - protein, 9 aa, Homo Sapiens
IHKVTSVKP

SEQ ID NO: 316308 - protein, 9 aa, Homo Sapiens
GCNHVLNSK

SEQ ID NO: 316309 - protein, 9 aa, Homo Sapiens
DCTLDCGSG

SEQ ID NO: 316310 - protein, 9 aa, Homo Sapiens
TPVTESNLS

SEQ ID NO: 316311 - protein, 9 aa, Homo Sapiens
VIQKNRPAM

SEQ ID NO: 316312 - protein, 9 aa, Homo Sapiens
FNRLLWSHG

SEQ ID NO: 316313 - protein, 9 aa, Homo Sapiens
IESQDWAYV

SEQ ID NO: 316314 - protein, 9 aa, Homo Sapiens
DEAINYNSH

SEQ ID NO: 316315 - protein, 9 aa, Homo Sapiens
MDLQKNGSQ

SEQ ID NO: 316316 - protein, 9 aa, Homo Sapiens
RRPHMLHHF

SEQ ID NO: 316317 - protein, 9 aa, Homo Sapiens
YYGKAFGTQ

SEQ ID NO: 316318 - protein, 9 aa, Homo Sapiens
KYYGKAFGT

SEQ ID NO: 316319 - protein, 9 aa, Homo Sapiens
QTLGIRQPP

SEQ ID NO: 316320 - protein, 9 aa, Homo Sapiens
GTWIGEDTF

SEQ ID NO: 316321 - protein, 9 aa, Homo Sapiens
VASKESHAT

SEQ ID NO: 316322 - protein, 9 aa, Homo Sapiens
PEEVARRWV

SEQ ID NO: 316323 - protein, 9 aa, Homo Sapiens
DLTGDTLDA

SEQ ID NO: 316324 - protein, 9 aa, Homo Sapiens
CLLMVRVLQ

SEQ ID NO: 316325 - protein, 9 aa, Homo Sapiens
VYVCVSVGL

SEQ ID NO: 316326 - protein, 9 aa, Homo Sapiens
SRGQEPQVP

SEQ ID NO: 316327 - protein, 9 aa, Homo Sapiens
GLPSLQELY

SEQ ID NO: 316328 - protein, 9 aa, Homo Sapiens
KNFFVEASM

SEQ ID NO: 316329 - protein, 9 aa, Homo Sapiens
VELWQGKKL

SEQ ID NO: 316330 - protein, 9 aa, Homo Sapiens
LQHDMEAHY

SEQ ID NO: 316331 - protein, 9 aa, Homo Sapiens
MLEQIHLIR

SEQ ID NO: 316332 - protein, 9 aa, Homo Sapiens
LMVRVLQAH

SEQ ID NO: 316333 - protein, 9 aa, Homo Sapiens
RTCLLMVRV

SEQ ID NO: 316334 - protein, 9 aa, Homo Sapiens
IGLQVTMPF

SEQ ID NO: 316335 - protein, 9 aa, Homo Sapiens
MLHHFLTSF

SEQ ID NO: 316336 - protein, 9 aa, Homo Sapiens
ALIGQWSWD

SEQ ID NO: 316337 - protein, 9 aa, Homo Sapiens
HLSNSIERK

SEQ ID NO: 316338 - protein, 9 aa, Homo Sapiens
VDHLGCNIF

SEQ ID NO: 316339 - protein, 9 aa, Homo Sapiens
VSCSLQDKR

SEQ ID NO: 316340 - protein, 9 aa, Homo Sapiens
GFSQPYLWL

SEQ ID NO: 316341 - protein, 9 aa, Homo Sapiens
MVQAGGLLV

SEQ ID NO: 316342 - protein, 9 aa, Homo Sapiens
HKKQLWKSQ

SEQ ID NO: 316343 - protein, 9 aa, Homo Sapiens
LEKEGLPKA

SEQ ID NO: 316344 - protein, 9 aa, Homo Sapiens
DTLDAIFTE

SEQ ID NO: 316345 - protein, 9 aa, Homo Sapiens
EEQKKYYNT

SEQ ID NO: 316346 - protein, 9 aa, Homo Sapiens
RAKVEKLHS

SEQ ID NO: 316347 - protein, 9 aa, Homo Sapiens
QQAQQLLQL

SEQ ID NO: 316348 - protein, 9 aa, Homo Sapiens
NCRRELKQM

SEQ ID NO: 316349 - protein, 9 aa, Homo Sapiens
KVGASKATL

SEQ ID NO: 316350 - protein, 9 aa, Homo Sapiens
SNEPWDNLD

SEQ ID NO: 316351 - protein, 9 aa, Homo Sapiens
GLVVHHSGI

SEQ ID NO: 316352 - protein, 9 aa, Homo Sapiens
SFNDKKIVI

SEQ ID NO: 316353 - protein, 9 aa, Homo Sapiens
YVVLYKIDV

SEQ ID NO: 316354 - protein, 9 aa, Homo Sapiens
AEKSPKQRG

SEQ ID NO: 316355 - protein, 9 aa, Homo Sapiens
AVVQRKEKQ

SEQ ID NO: 316356 - protein, 9 aa, Homo Sapiens
GKLCRHCFP

SEQ ID NO: 316357 - protein, 9 aa, Homo Sapiens
EIKGSCLQE

SEQ ID NO: 316358 - protein, 9 aa, Homo Sapiens
FSQPYLWLP

SEQ ID NO: 316359 - protein, 9 aa, Homo Sapiens
ISFNDKKIV

SEQ ID NO: 316360 - protein, 9 aa, Homo Sapiens
WRHRGQGQE

SEQ ID NO: 316361 - protein, 9 aa, Homo Sapiens
AGAVHWVRG

SEQ ID NO: 316362 - protein, 9 aa, Homo Sapiens
KSPKQRGRF

SEQ ID NO: 316363 - protein, 9 aa, Homo Sapiens
PENEYMFSP

SEQ ID NO: 316364 - protein, 9 aa, Homo Sapiens
QNLSSVQAL

SEQ ID NO: 316365 - protein, 9 aa, Homo Sapiens
QIVSQINHQ

SEQ ID NO: 316366 - protein, 9 aa, Homo Sapiens
FAPSNEPWD

SEQ ID NO: 316367 - protein, 9 aa, Homo Sapiens
IVLAVLNST

SEQ ID NO: 316368 - protein, 9 aa, Homo Sapiens
EADEAINYN

SEQ ID NO: 316369 - protein, 9 aa, Homo Sapiens
WPQESNLNQ

SEQ ID NO: 316370 - protein, 9 aa, Homo Sapiens
WIGEDTFPP

SEQ ID NO: 316371 - protein, 9 aa, Homo Sapiens
KQLWKSQDE

SEQ ID NO: 316372 - protein, 9 aa, Homo Sapiens
IYKSTKCNN

SEQ ID NO: 316373 - protein, 9 aa, Homo Sapiens
KCKYYGKAF

SEQ ID NO: 316374 - protein, 9 aa, Homo Sapiens
LLVSVCEQL

SEQ ID NO: 316375 - protein, 9 aa, Homo Sapiens
KHKKQLWKS

SEQ ID NO: 316376 - protein, 9 aa, Homo Sapiens
RGQEPQVPS

SEQ ID NO: 316377 - protein, 9 aa, Homo Sapiens
PEIKGSCLQ

SEQ ID NO: 316378 - protein, 9 aa, Homo Sapiens
GRAGTDCTL

SEQ ID NO: 316379 - protein, 9 aa, Homo Sapiens
EKLHSDLSR

SEQ ID NO: 316380 - protein, 9 aa, Homo Sapiens
VVQRKEKQL

SEQ ID NO: 316381 - protein, 9 aa, Homo Sapiens
MQVGQQLFQ

SEQ ID NO: 316382 - protein, 9 aa, Homo Sapiens
DRRRSRNRS

SEQ ID NO: 316383 - protein, 9 aa, Homo Sapiens
EGRDMANWI

SEQ ID NO: 316384 - protein, 9 aa, Homo Sapiens
WQGKKLVAA

SEQ ID NO: 316385 - protein, 9 aa, Homo Sapiens
SKMGKLCRH

SEQ ID NO: 316386 - protein, 9 aa, Homo Sapiens
YFAPSNEPW

SEQ ID NO: 316387 - protein, 9 aa, Homo Sapiens
DVHGFKAPG

SEQ ID NO: 316388 - protein, 9 aa, Homo Sapiens
SNMEGGYLC

SEQ ID NO: 316389 - protein, 9 aa, Homo Sapiens
QVPSSSKHR

SEQ ID NO: 316390 - protein, 9 aa, Homo Sapiens
VSRTCLLMV

SEQ ID NO: 316391 - protein, 9 aa, Homo Sapiens
CDAGVPPLG

SEQ ID NO: 316392 - protein, 9 aa, Homo Sapiens
RLWTSLMCF

SEQ ID NO: 316393 - protein, 9 aa, Homo Sapiens
FLYIVGRKK

SEQ ID NO: 316394 - protein, 9 aa, Homo Sapiens
ACDAGVPPL

SEQ ID NO: 316395 - protein, 9 aa, Homo Sapiens
AKDCVRLSL

SEQ ID NO: 316396 - protein, 9 aa, Homo Sapiens
TLATRLLFL

SEQ ID NO: 316397 - protein, 9 aa, Homo Sapiens
NLSFEDPVT

SEQ ID NO: 316398 - protein, 9 aa, Homo Sapiens
SNSIERKGN

SEQ ID NO: 316399 - protein, 9 aa, Homo Sapiens
TKVNFCKSE

SEQ ID NO: 316400 - protein, 9 aa, Homo Sapiens
DLRTLLVSV

SEQ ID NO: 316401 - protein, 9 aa, Homo Sapiens
SDYETFKNF

SEQ ID NO: 316402 - protein, 9 aa, Homo Sapiens
RYMAPKVLE

SEQ ID NO: 316403 - protein, 9 aa, Homo Sapiens
FMPPPVSSA

SEQ ID NO: 316404 - protein, 9 aa, Homo Sapiens
SQVKEIESC

SEQ ID NO: 316405 - protein, 9 aa, Homo Sapiens
AQQLPLLPG

SEQ ID NO: 316406 - protein, 9 aa, Homo Sapiens
GCNIFWTDS

SEQ ID NO: 316407 - protein, 9 aa, Homo Sapiens
WSHGQGLWN

SEQ ID NO: 316408 - protein, 9 aa, Homo Sapiens
NEYMFSPSE

SEQ ID NO: 316409 - protein, 9 aa, Homo Sapiens
DTPVTESNL

SEQ ID NO: 316410 - protein, 9 aa, Homo Sapiens
SDRGVYKCM

SEQ ID NO: 316411 - protein, 9 aa, Homo Sapiens
AQQAQQLLQ

SEQ ID NO: 316412 - protein, 9 aa, Homo Sapiens
CRRELKQMH

SEQ ID NO: 316413 - protein, 9 aa, Homo Sapiens
GRDMANWIS

SEQ ID NO: 316414 - protein, 9 aa, Homo Sapiens
TLRSKMGKL

SEQ ID NO: 316415 - protein, 9 aa, Homo Sapiens
NHAFKCKYY

SEQ ID NO: 316416 - protein, 9 aa, Homo Sapiens
AINYNSHNS

SEQ ID NO: 316417 - protein, 9 aa, Homo Sapiens
DDEDEGLPA

SEQ ID NO: 316418 - protein, 9 aa, Homo Sapiens
SYVVLYKID

SEQ ID NO: 316419 - protein, 9 aa, Homo Sapiens
YMFSPSELD

SEQ ID NO: 316420 - protein, 9 aa, Homo Sapiens
CAEKSPKQR

SEQ ID NO: 316421 - protein, 9 aa, Homo Sapiens
YETFKNFFV

SEQ ID NO: 316422 - protein, 9 aa, Homo Sapiens
QAQRAQQAQ

SEQ ID NO: 316423 - protein, 9 aa, Homo Sapiens
IIIGRCNEV

SEQ ID NO: 316424 - protein, 9 aa, Homo Sapiens
PKVLESRMN

SEQ ID NO: 316425 - protein, 9 aa, Homo Sapiens
ILDLTGDTL

SEQ ID NO: 316426 - protein, 9 aa, Homo Sapiens
APSNEPWDN

SEQ ID NO: 316427 - protein, 9 aa, Homo Sapiens
QNVHVCRGS

SEQ ID NO: 316428 - protein, 9 aa, Homo Sapiens
SEDVHGFKA

SEQ ID NO: 316429 - protein, 9 aa, Homo Sapiens
RCVDILKLC

SEQ ID NO: 316430 - protein, 9 aa, Homo Sapiens
SIVYSYEWP

SEQ ID NO: 316431 - protein, 9 aa, Homo Sapiens
AVRSKHVSL

SEQ ID NO: 316432 - protein, 9 aa, Homo Sapiens
HSRHKKKEA

SEQ ID NO: 316433 - protein, 9 aa, Homo Sapiens
KDKLSTQDY

SEQ ID NO: 316434 - protein, 9 aa, Homo Sapiens
IVYSYEWPL

SEQ ID NO: 316435 - protein, 9 aa, Homo Sapiens
YSYEWPLYM

SEQ ID NO: 316436 - protein, 9 aa, Homo Sapiens
SGTCIMQVG

SEQ ID NO: 316437 - protein, 9 aa, Homo Sapiens
VGDCTGTLL

SEQ ID NO: 316438 - protein, 9 aa, Homo Sapiens
CSLQDKRSA

SEQ ID NO: 316439 - protein, 9 aa, Homo Sapiens
VLAVLNSTM

SEQ ID NO: 316440 - protein, 9 aa, Homo Sapiens
SMVQAGGLL

SEQ ID NO: 316441 - protein, 9 aa, Homo Sapiens
RHGANLSFE

SEQ ID NO: 316442 - protein, 9 aa, Homo Sapiens
LEQIHLIRK

SEQ ID NO: 316443 - protein, 9 aa, Homo Sapiens
TGDTLDAIF

SEQ ID NO: 316444 - protein, 9 aa, Homo Sapiens
PIIIGRCNE

SEQ ID NO: 316445 - protein, 9 aa, Homo Sapiens
DKVGASKAT

SEQ ID NO: 316446 - protein, 9 aa, Homo Sapiens
SQDWAYVAS

SEQ ID NO: 316447 - protein, 9 aa, Homo Sapiens
AVAVRSKHV

SEQ ID NO: 316448 - protein, 9 aa, Homo Sapiens
NTMKKLGSK

SEQ ID NO: 316449 - protein, 9 aa, Homo Sapiens
FLSLIHAPR

SEQ ID NO: 316450 - protein, 9 aa, Homo Sapiens
HLCVCVYVC

SEQ ID NO: 316451 - protein, 9 aa, Homo Sapiens
ELPENEYMF

SEQ ID NO: 316452 - protein, 9 aa, Homo Sapiens
LSTQDYVQV

SEQ ID NO: 316453 - protein, 9 aa, Homo Sapiens
LIGFIALDH

SEQ ID NO: 316454 - protein, 9 aa, Homo Sapiens
IGQWSWDDI

SEQ ID NO: 316455 - protein, 9 aa, Homo Sapiens
HLGCNIFWT

SEQ ID NO: 316456 - protein, 9 aa, Homo Sapiens
KPSPRLWTS

SEQ ID NO: 316457 - protein, 9 aa, Homo Sapiens
ASAVELWQG

SEQ ID NO: 316458 - protein, 9 aa, Homo Sapiens
EGLPKAEAT

SEQ ID NO: 316459 - protein, 9 aa, Homo Sapiens
RDRRRSRNR

SEQ ID NO: 316460 - protein, 9 aa, Homo Sapiens
MANWISAFG

SEQ ID NO: 316461 - protein, 9 aa, Homo Sapiens
QLWKSQDEP

SEQ ID NO: 316462 - protein, 9 aa, Homo Sapiens
NRCVDILKL

SEQ ID NO: 316463 - protein, 9 aa, Homo Sapiens
SATGHRKAL

SEQ ID NO: 316464 - protein, 9 aa, Homo Sapiens
VQPILQIDN

SEQ ID NO: 316465 - protein, 9 aa, Homo Sapiens
MTTRTFCGT

SEQ ID NO: 316466 - protein, 9 aa, Homo Sapiens
SDLRTLLVS

SEQ ID NO: 316467 - protein, 9 aa, Homo Sapiens
GSAHAIVQL

SEQ ID NO: 316468 - protein, 9 aa, Homo Sapiens
CIMQVGQQL

SEQ ID NO: 316469 - protein, 9 aa, Homo Sapiens
CAQQLPLLP

SEQ ID NO: 316470 - protein, 9 aa, Homo Sapiens
GMNTFLFQP

SEQ ID NO: 316471 - protein, 9 aa, Homo Sapiens
IMKEPPTPI

SEQ ID NO: 316472 - protein, 9 aa, Homo Sapiens
QYLQAKDCV

SEQ ID NO: 316473 - protein, 9 aa, Homo Sapiens
MELLDGNLY

SEQ ID NO: 316474 - protein, 9 aa, Homo Sapiens
IIQYLQAKD

SEQ ID NO: 316475 - protein, 9 aa, Homo Sapiens
LWTSLMCFC

SEQ ID NO: 316476 - protein, 9 aa, Homo Sapiens
MNKHRRPHM

SEQ ID NO: 316477 - protein, 9 aa, Homo Sapiens
LQKNGSQPL

SEQ ID NO: 316478 - protein, 9 aa, Homo Sapiens
AKDITSGMA

SEQ ID NO: 316479 - protein, 9 aa, Homo Sapiens
QEPQVPSSS

SEQ ID NO: 316480 - protein, 9 aa, Homo Sapiens
SSDIHKVTS

SEQ ID NO: 316481 - protein, 9 aa, Homo Sapiens
HAIVQMLVH

SEQ ID NO: 316482 - protein, 9 aa, Homo Sapiens
ENVQPILQI

SEQ ID NO: 316483 - protein, 9 aa, Homo Sapiens
AKKKATKEA

SEQ ID NO: 316484 - protein, 9 aa, Homo Sapiens
RWVIQKNRP

SEQ ID NO: 316485 - protein, 9 aa, Homo Sapiens
ITSGMAYLH

SEQ ID NO: 316486 - protein, 9 aa, Homo Sapiens
EDTFPPLLP

SEQ ID NO: 316487 - protein, 9 aa, Homo Sapiens
DWAYVASKE

SEQ ID NO: 316488 - protein, 9 aa, Homo Sapiens
TYFAPSNEP

SEQ ID NO: 316489 - protein, 9 aa, Homo Sapiens
PQVPSSSKH

SEQ ID NO: 316490 - protein, 9 aa, Homo Sapiens
LQQMDVLAK

SEQ ID NO: 316491 - protein, 9 aa, Homo Sapiens
SSDLRTLLV

SEQ ID NO: 316492 - protein, 9 aa, Homo Sapiens
ANDQYIGEN

SEQ ID NO: 316493 - protein, 9 aa, Homo Sapiens
DIHKVTSVK

SEQ ID NO: 316494 - protein, 9 aa, Homo Sapiens
PPKRKSCEI

SEQ ID NO: 316495 - protein, 9 aa, Homo Sapiens
FKCKYYGKA

SEQ ID NO: 316496 - protein, 9 aa, Homo Sapiens
HGFKAPGAS

SEQ ID NO: 316497 - protein, 9 aa, Homo Sapiens
PRLWTSLMC

SEQ ID NO: 316498 - protein, 9 aa, Homo Sapiens
PASTSMALI

SEQ ID NO: 316499 - protein, 9 aa, Homo Sapiens
LLQKDRCLA

SEQ ID NO: 316500 - protein, 9 aa, Homo Sapiens
KQAQASGPQ

SEQ ID NO: 316501 - protein, 9 aa, Homo Sapiens
HVQNVHVCR

SEQ ID NO: 316502 - protein, 9 aa, Homo Sapiens
LQKDRCLAR

SEQ ID NO: 316503 - protein, 9 aa, Homo Sapiens
QLCAQQLPL

SEQ ID NO: 316504 - protein, 9 aa, Homo Sapiens
HRRPHMLHH

SEQ ID NO: 316505 - protein, 9 aa, Homo Sapiens
GDKVGASKA

SEQ ID NO: 316506 - protein, 9 aa, Homo Sapiens
AGASYVVLY

SEQ ID NO: 316507 - protein, 9 aa, Homo Sapiens
VCVSVGLCV

SEQ ID NO: 316508 - protein, 9 aa, Homo Sapiens
TCIMQVGQQ

SEQ ID NO: 316509 - protein, 9 aa, Homo Sapiens
QEGPHLMDL

SEQ ID NO: 316510 - protein, 9 aa, Homo Sapiens
RVGAAGAVH

SEQ ID NO: 316511 - protein, 9 aa, Homo Sapiens
QMTRMLQQM

SEQ ID NO: 316512 - protein, 9 aa, Homo Sapiens
QQYHSKIDA

SEQ ID NO: 316513 - protein, 9 aa, Homo Sapiens
SPCAEKSPK

SEQ ID NO: 316514 - protein, 9 aa, Homo Sapiens
RWCYRLKHL

SEQ ID NO: 316515 - protein, 9 aa, Homo Sapiens
QPHCGEAGA

SEQ ID NO: 316516 - protein, 9 aa, Homo Sapiens
TPMVRWAAA

SEQ ID NO: 316517 - protein, 9 aa, Homo Sapiens
ENEYMFSPS

SEQ ID NO: 316518 - protein, 9 aa, Homo Sapiens
KSTKCNNMR

SEQ ID NO: 316519 - protein, 9 aa, Homo Sapiens
ESSPYLSWR

SEQ ID NO: 316520 - protein, 9 aa, Homo Sapiens
IALDHCICV

SEQ ID NO: 316521 - protein, 9 aa, Homo Sapiens
KDRCLARPQ

SEQ ID NO: 316522 - protein, 9 aa, Homo Sapiens
LVQWLLIYF

SEQ ID NO: 316523 - protein, 9 aa, Homo Sapiens
KDCVRLSLQ

SEQ ID NO: 316524 - protein, 9 aa, Homo Sapiens
VQAGGLLVI

SEQ ID NO: 316525 - protein, 9 aa, Homo Sapiens
DQEGPHLMD

SEQ ID NO: 316526 - protein, 9 aa, Homo Sapiens
PCNYGCSNM

SEQ ID NO: 316527 - protein, 9 aa, Homo Sapiens
EARSQYSLT

SEQ ID NO: 316528 - protein, 9 aa, Homo Sapiens
HQVHLRRYS

SEQ ID NO: 316529 - protein, 9 aa, Homo Sapiens
EALIGQWSW

SEQ ID NO: 316530 - protein, 9 aa, Homo Sapiens
GAALLQTLG

SEQ ID NO: 316531 - protein, 9 aa, Homo Sapiens
QPLWMTCCL

SEQ ID NO: 316532 - protein, 9 aa, Homo Sapiens
VGASKATLL

SEQ ID NO: 316533 - protein, 9 aa, Homo Sapiens
AGCNHVLNS

SEQ ID NO: 316534 - protein, 9 aa, Homo Sapiens
EEYRGRSPN

SEQ ID NO: 316535 - protein, 9 aa, Homo Sapiens
KVLESRMNL

SEQ ID NO: 316536 - protein, 9 aa, Homo Sapiens
QGTWIGEDT

SEQ ID NO: 316537 - protein, 9 aa, Homo Sapiens
ATKEAAGAG

SEQ ID NO: 316538 - protein, 9 aa, Homo Sapiens
WARRPMLEQ

SEQ ID NO: 316539 - protein, 9 aa, Homo Sapiens
PSPRLWTSL

SEQ ID NO: 316540 - protein, 9 aa, Homo Sapiens
LCVCVYVCV

SEQ ID NO: 316541 - protein, 9 aa, Homo Sapiens
RPMLEQIHL

SEQ ID NO: 316542 - protein, 9 aa, Homo Sapiens
CNYGCSNME

SEQ ID NO: 316543 - protein, 9 aa, Homo Sapiens
DKKIVIKPI

SEQ ID NO: 316544 - protein, 9 aa, Homo Sapiens
NFFLSLIHA

SEQ ID NO: 316545 - protein, 9 aa, Homo Sapiens
LVSVCEQLA

SEQ ID NO: 316546 - protein, 9 aa, Homo Sapiens
EDHSFAGLP

SEQ ID NO: 316547 - protein, 9 aa, Homo Sapiens
RVKANDQYI

SEQ ID NO: 316548 - protein, 9 aa, Homo Sapiens
EEGRDMANW

SEQ ID NO: 316549 - protein, 9 aa, Homo Sapiens
CSNMEGGYL

SEQ ID NO: 316550 - protein, 9 aa, Homo Sapiens
PLWMTCCLL

SEQ ID NO: 316551 - protein, 9 aa, Homo Sapiens
QEDPVPPAD

SEQ ID NO: 316552 - protein, 9 aa, Homo Sapiens
SHGQGLWNC

SEQ ID NO: 316553 - protein, 9 aa, Homo Sapiens
QVTMPFMFA

SEQ ID NO: 316554 - protein, 9 aa, Homo Sapiens
YLSWRHRGQ

SEQ ID NO: 316555 - protein, 9 aa, Homo Sapiens
SYEWPLYMW

SEQ ID NO: 316556 - protein, 9 aa, Homo Sapiens
VSFAKDITS

SEQ ID NO: 316557 - protein, 9 aa, Homo Sapiens
KHRRPHMLH

SEQ ID NO: 316558 - protein, 9 aa, Homo Sapiens
MVRWAAASK

SEQ ID NO: 316559 - protein, 9 aa, Homo Sapiens
ELLNRGLVV

SEQ ID NO: 316560 - protein, 9 aa, Homo Sapiens
EQKKYYNTM

SEQ ID NO: 316561 - protein, 9 aa, Homo Sapiens
RRSRNRSRG

SEQ ID NO: 316562 - protein, 9 aa, Homo Sapiens
PYLSWRHRG

SEQ ID NO: 316563 - protein, 9 aa, Homo Sapiens
RSPNAHSGG

SEQ ID NO: 316564 - protein, 9 aa, Homo Sapiens
LQDNELPEL

SEQ ID NO: 316565 - protein, 9 aa, Homo Sapiens
LLADWKHGG

SEQ ID NO: 316566 - protein, 9 aa, Homo Sapiens
VRSKHVSLV

SEQ ID NO: 316567 - protein, 9 aa, Homo Sapiens
DMANWISAF

SEQ ID NO: 316568 - protein, 9 aa, Homo Sapiens
IGDEALIGQ

SEQ ID NO: 316569 - protein, 9 aa, Homo Sapiens
HAFKCKYYG

SEQ ID NO: 316570 - protein, 9 aa, Homo Sapiens
EYRGRSPNA

SEQ ID NO: 316571 - protein, 9 aa, Homo Sapiens
STQDYVQVV

SEQ ID NO: 316572 - protein, 9 aa, Homo Sapiens
HCICVLHPV

SEQ ID NO: 316573 - protein, 9 aa, Homo Sapiens
SELLNRGLV

SEQ ID NO: 316574 - protein, 9 aa, Homo Sapiens
CMASNAAGA

SEQ ID NO: 316575 - protein, 9 aa, Homo Sapiens
HSFAGLPSL

SEQ ID NO: 316576 - protein, 9 aa, Homo Sapiens
KIVIKPIDK

SEQ ID NO: 316577 - protein, 9 aa, Homo Sapiens
IGEDTFPPL

SEQ ID NO: 316578 - protein, 9 aa, Homo Sapiens
SFEDPVTYY

SEQ ID NO: 316579 - protein, 9 aa, Homo Sapiens
LTGDTLDAI

SEQ ID NO: 316580 - protein, 9 aa, Homo Sapiens
FLCRWCYRL

SEQ ID NO: 316581 - protein, 9 aa, Homo Sapiens
READEAINY

SEQ ID NO: 316582 - protein, 9 aa, Homo Sapiens
KSEECEKAV

SEQ ID NO: 316583 - protein, 9 aa, Homo Sapiens
RSRNRSRGR

SEQ ID NO: 316584 - protein, 9 aa, Homo Sapiens
LSFEDPVTY

SEQ ID NO: 316585 - protein, 9 aa, Homo Sapiens
GRVKANDQY

SEQ ID NO: 316586 - protein, 9 aa, Homo Sapiens
YLQAKDCVR

SEQ ID NO: 316587 - protein, 9 aa, Homo Sapiens
VKAAGASYV

SEQ ID NO: 316588 - protein, 9 aa, Homo Sapiens
QAHPHKEPP

SEQ ID NO: 316589 - protein, 9 aa, Homo Sapiens
LIHAPRNLT

SEQ ID NO: 316590 - protein, 9 aa, Homo Sapiens
KANDQYIGE

SEQ ID NO: 316591 - protein, 9 aa, Homo Sapiens
NKHRRPHML

SEQ ID NO: 316592 - protein, 9 aa, Homo Sapiens
VEKLHSDLS

SEQ ID NO: 316593 - protein, 9 aa, Homo Sapiens
DTPMVRWAA

SEQ ID NO: 316594 - protein, 9 aa, Homo Sapiens
VQALEGSRE

SEQ ID NO: 316595 - protein, 9 aa, Homo Sapiens
QAKDCVRLS

SEQ ID NO: 316596 - protein, 9 aa, Homo Sapiens
QAGGLLVID

SEQ ID NO: 316597 - protein, 9 aa, Homo Sapiens
VTESNLSRA

SEQ ID NO: 316598 - protein, 9 aa, Homo Sapiens
SPAAPVSCS

SEQ ID NO: 316599 - protein, 9 aa, Homo Sapiens
ECKECGELF

SEQ ID NO: 316600 - protein, 9 aa, Homo Sapiens
DLQKNGSQP

SEQ ID NO: 316601 - protein, 9 aa, Homo Sapiens
NVKAAGASY

SEQ ID NO: 316602 - protein, 9 aa, Homo Sapiens
NYFGGMEVI

SEQ ID NO: 316603 - protein, 9 aa, Homo Sapiens
LPEIKGSCL

SEQ ID NO: 316604 - protein, 9 aa, Homo Sapiens
SIGLQVTMP

SEQ ID NO: 316605 - protein, 9 aa, Homo Sapiens
LLQTLGIRQ

SEQ ID NO: 316606 - protein, 9 aa, Homo Sapiens
ALAVAVRSK

SEQ ID NO: 316607 - protein, 9 aa, Homo Sapiens
AVDHLGCNI

SEQ ID NO: 316608 - protein, 9 aa, Homo Sapiens
CRGSIITPE

SEQ ID NO: 316609 - protein, 9 aa, Homo Sapiens
PMVRWAAAS

SEQ ID NO: 316610 - protein, 9 aa, Homo Sapiens
VCVYVCVSV

SEQ ID NO: 316611 - protein, 9 aa, Homo Sapiens
RRELKQMHG

SEQ ID NO: 316612 - protein, 9 aa, Homo Sapiens
PPKQAQASG

SEQ ID NO: 316613 - protein, 9 aa, Homo Sapiens
ALLQTLGIR

SEQ ID NO: 316614 - protein, 9 aa, Homo Sapiens
WLPEAAPDQ

SEQ ID NO: 316615 - protein, 9 aa, Homo Sapiens
KMGKLCRHC

SEQ ID NO: 316616 - protein, 9 aa, Homo Sapiens
ANWISAFGY

SEQ ID NO: 316617 - protein, 9 aa, Homo Sapiens
NYAELIMKE

SEQ ID NO: 316618 - protein, 9 aa, Homo Sapiens
SNYAELIMK

SEQ ID NO: 316619 - protein, 9 aa, Homo Sapiens
SVQALEGSR

SEQ ID NO: 316620 - protein, 9 aa, Homo Sapiens
VHVCRGSII

SEQ ID NO: 316621 - protein, 9 aa, Homo Sapiens
HSKIDALID

SEQ ID NO: 316622 - protein, 9 aa, Homo Sapiens
IVQMLVHFI

SEQ ID NO: 316623 - protein, 9 aa, Homo Sapiens
NLSRAPIKM

SEQ ID NO: 316624 - protein, 9 aa, Homo Sapiens
VPPADGKKL

SEQ ID NO: 316625 - protein, 9 aa, Homo Sapiens
VFLNTLATR

SEQ ID NO: 316626 - protein, 9 aa, Homo Sapiens
DITSGMAYL

SEQ ID NO: 316627 - protein, 9 aa, Homo Sapiens
MGKLCRHCF

SEQ ID NO: 316628 - protein, 9 aa, Homo Sapiens
LWQGKKLVA

SEQ ID NO: 316629 - protein, 9 aa, Homo Sapiens
LSSVQALEG

SEQ ID NO: 316630 - protein, 9 aa, Homo Sapiens
YLWLPEAAP

SEQ ID NO: 316631 - protein, 9 aa, Homo Sapiens
RELKQMHGQ

SEQ ID NO: 316632 - protein, 9 aa, Homo Sapiens
GRSIVYSYE

SEQ ID NO: 316633 - protein, 9 aa, Homo Sapiens
NNMRQTGYC

SEQ ID NO: 316634 - protein, 9 aa, Homo Sapiens
LPPKQAQAS

SEQ ID NO: 316635 - protein, 9 aa, Homo Sapiens
RKTDKDYLV

SEQ ID NO: 316636 - protein, 9 aa, Homo Sapiens
TKVDFFAME

SEQ ID NO: 316637 - protein, 9 aa, Homo Sapiens
SKATLLNML

SEQ ID NO: 316638 - protein, 9 aa, Homo Sapiens
NRSRGRRSR

SEQ ID NO: 316639 - protein, 9 aa, Homo Sapiens
VNFCKSEEC

SEQ ID NO: 316640 - protein, 9 aa, Homo Sapiens
LSPAAPVSC

SEQ ID NO: 316641 - protein, 9 aa, Homo Sapiens
VAVRSKHVS

SEQ ID NO: 316642 - protein, 9 aa, Homo Sapiens
DNELPELDE

SEQ ID NO: 316643 - protein, 9 aa, Homo Sapiens
ADEAINYNS

SEQ ID NO: 316644 - protein, 9 aa, Homo Sapiens
PQESNLNQK

SEQ ID NO: 316645 - protein, 9 aa, Homo Sapiens
RSQYSLTVQ

SEQ ID NO: 316646 - protein, 9 aa, Homo Sapiens
PNAHSGGRN

SEQ ID NO: 316647 - protein, 9 aa, Homo Sapiens
SIIQYLQAK

SEQ ID NO: 316648 - protein, 9 aa, Homo Sapiens
MEGLVFLNT

SEQ ID NO: 316649 - protein, 9 aa, Homo Sapiens
ELWQGKKLV

SEQ ID NO: 316650 - protein, 9 aa, Homo Sapiens
KFRKKKKFC

SEQ ID NO: 316651 - protein, 9 aa, Homo Sapiens
VCSQVKEIE

SEQ ID NO: 316652 - protein, 9 aa, Homo Sapiens
HGANLSFED

SEQ ID NO: 316653 - protein, 9 aa, Homo Sapiens
RGMNTFLFQ

SEQ ID NO: 316654 - protein, 9 aa, Homo Sapiens
KQLTHSRRG

SEQ ID NO: 316655 - protein, 9 aa, Homo Sapiens
IAATIENVQ

SEQ ID NO: 316656 - protein, 9 aa, Homo Sapiens
DRGVYKCMA

SEQ ID NO: 316657 - protein, 9 aa, Homo Sapiens
MTRMLQQMD

SEQ ID NO: 316658 - protein, 9 aa, Homo Sapiens
PPPKRKSCE

SEQ ID NO: 316659 - protein, 9 aa, Homo Sapiens
TGHRKALAT

SEQ ID NO: 316660 - protein, 9 aa, Homo Sapiens
YVCVSVGLC

SEQ ID NO: 316661 - protein, 9 aa, Homo Sapiens
SPKQRGRFR

SEQ ID NO: 316662 - protein, 9 aa, Homo Sapiens
IERKGNQER

SEQ ID NO: 316663 - protein, 9 aa, Homo Sapiens
GLQVTMPFM

SEQ ID NO: 316664 - protein, 9 aa, Homo Sapiens
DEGLPASYH

SEQ ID NO: 316665 - protein, 9 aa, Homo Sapiens
FAGLPSLQE

SEQ ID NO: 316666 - protein, 9 aa, Homo Sapiens
PGRAGTDCT

SEQ ID NO: 316667 - protein, 9 aa, Homo Sapiens
SFAKDITSG

SEQ ID NO: 316668 - protein, 9 aa, Homo Sapiens
IPNALYTHC

SEQ ID NO: 316669 - protein, 9 aa, Homo Sapiens
EPWDNLDSD

SEQ ID NO: 316670 - protein, 9 aa, Homo Sapiens
IVSQINHQV

SEQ ID NO: 316671 - protein, 9 aa, Homo Sapiens
PELDERPPR

SEQ ID NO: 316672 - protein, 9 aa, Homo Sapiens
VRKDKLSTQ

SEQ ID NO: 316673 - protein, 9 aa, Homo Sapiens
YNTMKKLGS

SEQ ID NO: 316674 - protein, 9 aa, Homo Sapiens
STKCNNMRQ

SEQ ID NO: 316675 - protein, 9 aa, Homo Sapiens
TDQEGPHLM

SEQ ID NO: 316676 - protein, 9 aa, Homo Sapiens
QQLCAQQLP

SEQ ID NO: 316677 - protein, 9 aa, Homo Sapiens
GRLTPRAQS

SEQ ID NO: 316678 - protein, 9 aa, Homo Sapiens
AVHWVRGGQ

SEQ ID NO: 316679 - protein, 9 aa, Homo Sapiens
RTLLVSVCE

SEQ ID NO: 316680 - protein, 9 aa, Homo Sapiens
QQMDVLAKK

SEQ ID NO: 316681 - protein, 9 aa, Homo Sapiens
VCRGSIITP

SEQ ID NO: 316682 - protein, 9 aa, Homo Sapiens
TLDAIFTEL

SEQ ID NO: 316683 - protein, 9 aa, Homo Sapiens
NTFLFQPHC

SEQ ID NO: 316684 - protein, 9 aa, Homo Sapiens
ATNHAIVQM

SEQ ID NO: 316685 - protein, 9 aa, Homo Sapiens
ELFIWRTAF

SEQ ID NO: 316686 - protein, 9 aa, Homo Sapiens
AVLNSTMNP

SEQ ID NO: 316687 - protein, 9 aa, Homo Sapiens
PAAPVSCSL

SEQ ID NO: 316688 - protein, 9 aa, Homo Sapiens
YAELIMKEP

SEQ ID NO: 316689 - protein, 9 aa, Homo Sapiens
VSHSSSDIH

SEQ ID NO: 316690 - protein, 9 aa, Homo Sapiens
TMKKLGSKK

SEQ ID NO: 316691 - protein, 9 aa, Homo Sapiens
LPASYHTVS

SEQ ID NO: 316692 - protein, 9 aa, Homo Sapiens
PESSPYLSW

SEQ ID NO: 316693 - protein, 9 aa, Homo Sapiens
QKRKKEQPK

SEQ ID NO: 316694 - protein, 9 aa, Homo Sapiens
PLDFEARSQ

SEQ ID NO: 316695 - protein, 9 aa, Homo Sapiens
DTFPPLLPP

SEQ ID NO: 316696 - protein, 9 aa, Homo Sapiens
MTCCLLGLA

SEQ ID NO: 316697 - protein, 9 aa, Homo Sapiens
FFVEASMSV

SEQ ID NO: 316698 - protein, 9 aa, Homo Sapiens
EQNCRRELK

SEQ ID NO: 316699 - protein, 9 aa, Homo Sapiens
YIGENAQSS

SEQ ID NO: 316700 - protein, 9 aa, Homo Sapiens
HWVRGGQPL

SEQ ID NO: 316701 - protein, 9 aa, Homo Sapiens
KKYYNTMKK

SEQ ID NO: 316702 - protein, 9 aa, Homo Sapiens
GVYKCMASN

SEQ ID NO: 316703 - protein, 9 aa, Homo Sapiens
LAVLNSTMN

SEQ ID NO: 316704 - protein, 9 aa, Homo Sapiens
FEARSQYSL

SEQ ID NO: 316705 - protein, 9 aa, Homo Sapiens
ARYMAPKVL

SEQ ID NO: 316706 - protein, 9 aa, Homo Sapiens
AVELWQGKK

SEQ ID NO: 316707 - protein, 9 aa, Homo Sapiens
IHRMNSATG

SEQ ID NO: 316708 - protein, 9 aa, Homo Sapiens
KLCEQEDLM

SEQ ID NO: 316709 - protein, 9 aa, Homo Sapiens
RRPMLEQIH

SEQ ID NO: 316710 - protein, 9 aa, Homo Sapiens
KRKSCEIPC

SEQ ID NO: 316711 - protein, 9 aa, Homo Sapiens
INYNSHNSQ

SEQ ID NO: 316712 - protein, 9 aa, Homo Sapiens
EKSPKQRGR

SEQ ID NO: 316713 - protein, 9 aa, Homo Sapiens
KEGLPKAEA

SEQ ID NO: 316714 - protein, 9 aa, Homo Sapiens
RKDKLSTQD

SEQ ID NO: 316715 - protein, 9 aa, Homo Sapiens
QNCRRELKQ

SEQ ID NO: 316716 - protein, 9 aa, Homo Sapiens
LWLPEAAPD

SEQ ID NO: 316717 - protein, 9 aa, Homo Sapiens
DKDYLVQWL

SEQ ID NO: 316718 - protein, 9 aa, Homo Sapiens
MAPKVLESR

SEQ ID NO: 316719 - protein, 9 aa, Homo Sapiens
AQAQRAQQA

SEQ ID NO: 316720 - protein, 9 aa, Homo Sapiens
LNSTMNPVI

SEQ ID NO: 316721 - protein, 9 aa, Homo Sapiens
IGFIALDHC

SEQ ID NO: 316722 - protein, 9 aa, Homo Sapiens
PKPFLYIVG

SEQ ID NO: 316723 - protein, 9 aa, Homo Sapiens
TKPSPRLWT

SEQ ID NO: 316724 - protein, 9 aa, Homo Sapiens
AYVASKESH

SEQ ID NO: 316725 - protein, 9 aa, Homo Sapiens
KAAGASYVV

SEQ ID NO: 316726 - protein, 9 aa, Homo Sapiens
WMTCCLLGL

SEQ ID NO: 316727 - protein, 9 aa, Homo Sapiens
MASNAAGAD

SEQ ID NO: 316728 - protein, 9 aa, Homo Sapiens
EAINYNSHN

SEQ ID NO: 316729 - protein, 9 aa, Homo Sapiens
SAHAIVQLR

SEQ ID NO: 316730 - protein, 9 aa, Homo Sapiens
NEPWDNLDS

SEQ ID NO: 316731 - protein, 9 aa, Homo Sapiens
PWDNLDSDI

SEQ ID NO: 316732 - protein, 9 aa, Homo Sapiens
TNHAIVQML

SEQ ID NO: 316733 - protein, 9 aa, Homo Sapiens
CTLDCGSGI

SEQ ID NO: 316734 - protein, 9 aa, Homo Sapiens
PCAEKSPKQ

SEQ ID NO: 316735 - protein, 9 aa, Homo Sapiens
PADGKKLPT

SEQ ID NO: 316736 - protein, 9 aa, Homo Sapiens
WSIGLQVTM

SEQ ID NO: 316737 - protein, 9 aa, Homo Sapiens
VQNVHVCRG

SEQ ID NO: 316738 - protein, 9 aa, Homo Sapiens
FQQLCAQQL

SEQ ID NO: 316739 - protein, 9 aa, Homo Sapiens
QDWAYVASK

SEQ ID NO: 316740 - protein, 9 aa, Homo Sapiens
EGLVFLNTL

SEQ ID NO: 316741 - protein, 9 aa, Homo Sapiens
CKENVFPGM

SEQ ID NO: 316742 - protein, 9 aa, Homo Sapiens
SCLQEINDV

SEQ ID NO: 316743 - protein, 9 aa, Homo Sapiens
AAGAVHWVR

SEQ ID NO: 316744 - protein, 9 aa, Homo Sapiens
DHSFAGLPS

SEQ ID NO: 316745 - protein, 9 aa, Homo Sapiens
CNNMRQTGY

SEQ ID NO: 316746 - protein, 9 aa, Homo Sapiens
ELDERPPRA

SEQ ID NO: 316747 - protein, 9 aa, Homo Sapiens
RLTPRAQSE

SEQ ID NO: 316748 - protein, 9 aa, Homo Sapiens
VIPNALYTH

SEQ ID NO: 316749 - protein, 9 aa, Homo Sapiens
YECKECGEL

SEQ ID NO: 316750 - protein, 9 aa, Homo Sapiens
KATLLNMLN

SEQ ID NO: 316751 - protein, 9 aa, Homo Sapiens
RKEKQLTHS

SEQ ID NO: 316752 - protein, 9 aa, Homo Sapiens
IIAATIENV

SEQ ID NO: 316753 - protein, 9 aa, Homo Sapiens
EDEGLPASY

SEQ ID NO: 316754 - protein, 9 aa, Homo Sapiens
FELPENEYM

SEQ ID NO: 316755 - protein, 9 aa, Homo Sapiens
PHLMDLQKN

SEQ ID NO: 316756 - protein, 9 aa, Homo Sapiens
KKIVIKPID

SEQ ID NO: 316757 - protein, 9 aa, Homo Sapiens
FFLSLIHAP

SEQ ID NO: 316758 - protein, 9 aa, Homo Sapiens
TESNLSRAP

SEQ ID NO: 316759 - protein, 9 aa, Homo Sapiens
LLMVRVLQA

SEQ ID NO: 316760 - protein, 9 aa, Homo Sapiens
LSLLQKDRC

SEQ ID NO: 316761 - protein, 9 aa, Homo Sapiens
VFELPENEY

SEQ ID NO: 316762 - protein, 9 aa, Homo Sapiens
ALIDNSVKE

SEQ ID NO: 316763 - protein, 9 aa, Homo Sapiens
AATIENVQP

SEQ ID NO: 316764 - protein, 9 aa, Homo Sapiens
AFKCKYYGK

SEQ ID NO: 316765 - protein, 9 aa, Homo Sapiens
SNLNQKRKK

SEQ ID NO: 316766 - protein, 9 aa, Homo Sapiens
PLLSLLQKD

SEQ ID NO: 316767 - protein, 9 aa, Homo Sapiens
RMLQQMDVL

SEQ ID NO: 316768 - protein, 9 aa, Homo Sapiens
SPYLSWRHR

SEQ ID NO: 316769 - protein, 9 aa, Homo Sapiens
ERKGNQERA

SEQ ID NO: 316770 - protein, 9 aa, Homo Sapiens
VQMLVHFIN

SEQ ID NO: 316771 - protein, 9 aa, Homo Sapiens
GSQPLWMTC

SEQ ID NO: 316772 - protein, 9 aa, Homo Sapiens
TCCLLGLAP

SEQ ID NO: 316773 - protein, 9 aa, Homo Sapiens
DFFAMELLD

SEQ ID NO: 316774 - protein, 9 aa, Homo Sapiens
APVSCSLQD

SEQ ID NO: 316775 - protein, 9 aa, Homo Sapiens
TWIGEDTFP

SEQ ID NO: 316776 - protein, 9 aa, Homo Sapiens
ARRWVIQKN

SEQ ID NO: 316777 - protein, 9 aa, Homo Sapiens
VLNSTMNPV

SEQ ID NO: 316778 - protein, 9 aa, Homo Sapiens
PPPPKRKSC

SEQ ID NO: 316779 - protein, 9 aa, Homo Sapiens
NSATGHRKA

SEQ ID NO: 316780 - protein, 9 aa, Homo Sapiens
IQYLQAKDC

SEQ ID NO: 316781 - protein, 9 aa, Homo Sapiens
SCSLQDKRS

SEQ ID NO: 316782 - protein, 9 aa, Homo Sapiens
GGRLTPRAQ

SEQ ID NO: 316783 - protein, 9 aa, Homo Sapiens
FIALDHCIC

SEQ ID NO: 316784 - protein, 9 aa, Homo Sapiens
KKQLWKSQD

SEQ ID NO: 316785 - protein, 9 aa, Homo Sapiens
ILKLCEQED

SEQ ID NO: 316786 - protein, 9 aa, Homo Sapiens
AQLQHDMEA

SEQ ID NO: 316787 - protein, 9 aa, Homo Sapiens
QKNGSQPLW

SEQ ID NO: 316788 - protein, 9 aa, Homo Sapiens
RCNEVVITE

SEQ ID NO: 316789 - protein, 9 aa, Homo Sapiens
FRKKKKFCN

SEQ ID NO: 316790 - protein, 9 aa, Homo Sapiens
LGEFLCRWC

SEQ ID NO: 316791 - protein, 9 aa, Homo Sapiens
NLNQKRKKE

SEQ ID NO: 316792 - protein, 9 aa, Homo Sapiens
GHRGAALLQ

SEQ ID NO: 316793 - protein, 9 aa, Homo Sapiens
NSIERKGNQ

SEQ ID NO: 316794 - protein, 9 aa, Homo Sapiens
RSIVYSYEW

SEQ ID NO: 316795 - protein, 9 aa, Homo Sapiens
EVIPNALYT

SEQ ID NO: 316796 - protein, 9 aa, Homo Sapiens
EFQQLCAQQ

SEQ ID NO: 316797 - protein, 9 aa, Homo Sapiens
KLCRHCFPW

SEQ ID NO: 316798 - protein, 9 aa, Homo Sapiens
SSVQALEGS

SEQ ID NO: 316799 - protein, 9 aa, Homo Sapiens
AGLPSLQEL

SEQ ID NO: 316800 - protein, 9 aa, Homo Sapiens
MVRVLQAHR

SEQ ID NO: 316801 - protein, 9 aa, Homo Sapiens
TILDLTGDT

SEQ ID NO: 316802 - protein, 9 aa, Homo Sapiens
IIGRCNEVV

SEQ ID NO: 316803 - protein, 9 aa, Homo Sapiens
TKEAAGAGA

SEQ ID NO: 316804 - protein, 9 aa, Homo Sapiens
PQPIIIGRC

SEQ ID NO: 316805 - protein, 9 aa, Homo Sapiens
HLMDLQKNG

SEQ ID NO: 316806 - protein, 9 aa, Homo Sapiens
SSPYLSWRH

SEQ ID NO: 316807 - protein, 9 aa, Homo Sapiens
NSTMNPVIY

SEQ ID NO: 316808 - protein, 9 aa, Homo Sapiens
CLGEFLCRW

SEQ ID NO: 316809 - protein, 9 aa, Homo Sapiens
GLPKAEATR

SEQ ID NO: 316810 - protein, 9 aa, Homo Sapiens
QPIIIGRCN

SEQ ID NO: 316811 - protein, 9 aa, Homo Sapiens
TLLADWKHG

SEQ ID NO: 316812 - protein, 9 aa, Homo Sapiens
GSCLQEIND

SEQ ID NO: 316813 - protein, 9 aa, Homo Sapiens
RGVYKCMAS

SEQ ID NO: 316814 - protein, 9 aa, Homo Sapiens
LLQFQVTAC

SEQ ID NO: 316815 - protein, 9 aa, Homo Sapiens
KGSCLQEIN

SEQ ID NO: 316816 - protein, 9 aa, Homo Sapiens
TARYMAPKV

SEQ ID NO: 316817 - protein, 9 aa, Homo Sapiens
TGTLLADWK

SEQ ID NO: 316818 - protein, 9 aa, Homo Sapiens
DEALIGQWS

SEQ ID NO: 316819 - protein, 9 aa, Homo Sapiens
PKQRGRFRA

SEQ ID NO: 316820 - protein, 9 aa, Homo Sapiens
VQWLLIYFG

SEQ ID NO: 316821 - protein, 9 aa, Homo Sapiens
KEAAGAGAA

SEQ ID NO: 316822 - protein, 9 aa, Homo Sapiens
TTDQEGPHL

SEQ ID NO: 316823 - protein, 9 aa, Homo Sapiens
FCKSEECEK

SEQ ID NO: 316824 - protein, 9 aa, Homo Sapiens
AHPHKEPPA

SEQ ID NO: 316825 - protein, 9 aa, Homo Sapiens
VVHHSGILP

SEQ ID NO: 316826 - protein, 9 aa, Homo Sapiens
RGSIITPEW

SEQ ID NO: 316827 - protein, 9 aa, Homo Sapiens
LLWSHGQGL

SEQ ID NO: 316828 - protein, 9 aa, Homo Sapiens
LQTLGIRQP

SEQ ID NO: 316829 - protein, 9 aa, Homo Sapiens
RAGTDCTLD

SEQ ID NO: 316830 - protein, 9 aa, Homo Sapiens
ESNWVCSQV

SEQ ID NO: 316831 - protein, 9 aa, Homo Sapiens
EQIHLIRKD

SEQ ID NO: 316832 - protein, 9 aa, Homo Sapiens
EGLPASYHT

SEQ ID NO: 316833 - protein, 9 aa, Homo Sapiens
PAKKKATKE

SEQ ID NO: 316834 - protein, 9 aa, Homo Sapiens
RPHMLHHFL

SEQ ID NO: 316835 - protein, 9 aa, Homo Sapiens
RQAGCNHVL

SEQ ID NO: 316836 - protein, 9 aa, Homo Sapiens
FPGMTTRTF

SEQ ID NO: 316837 - protein, 9 aa, Homo Sapiens
CKECGELFI

SEQ ID NO: 316838 - protein, 9 aa, Homo Sapiens
LWKSQDEPK

SEQ ID NO: 316839 - protein, 9 aa, Homo Sapiens
KVNFCKSEE

SEQ ID NO: 316840 - protein, 9 aa, Homo Sapiens
LQVTMPFMF

SEQ ID NO: 316841 - protein, 9 aa, Homo Sapiens
LADWKHGGY

SEQ ID NO: 316842 - protein, 9 aa, Homo Sapiens
DDTPMVRWA

SEQ ID NO: 316843 - protein, 9 aa, Homo Sapiens
AAGASYVVL

SEQ ID NO: 316844 - protein, 9 aa, Homo Sapiens
VRWAAASKL

SEQ ID NO: 316845 - protein, 9 aa, Homo Sapiens
EVARRWVIQ

SEQ ID NO: 316846 - protein, 9 aa, Homo Sapiens
ECGELFIWR

SEQ ID NO: 316847 - protein, 9 aa, Homo Sapiens
QIHLIRKDV

SEQ ID NO: 316848 - protein, 9 aa, Homo Sapiens
SAVELWQGK

SEQ ID NO: 316849 - protein, 9 aa, Homo Sapiens
VGSAHAIVQ

SEQ ID NO: 316850 - protein, 9 aa, Homo Sapiens
QVKEIESCK

SEQ ID NO: 316851 - protein, 9 aa, Homo Sapiens
KDITSGMAY

SEQ ID NO: 316852 - protein, 9 aa, Homo Sapiens
GTLLADWKH

SEQ ID NO: 316853 - protein, 9 aa, Homo Sapiens
LQFQVTACD

SEQ ID NO: 316854 - protein, 9 aa, Homo Sapiens
KVEKLHSDL

SEQ ID NO: 316855 - protein, 9 aa, Homo Sapiens
ANLSFEDPV

SEQ ID NO: 316856 - protein, 9 aa, Homo Sapiens
SAQAHPHKE

SEQ ID NO: 316857 - protein, 9 aa, Homo Sapiens
LKQMHGQLA

SEQ ID NO: 316858 - protein, 9 aa, Homo Sapiens
LCAQQLPLL

SEQ ID NO: 316859 - protein, 9 aa, Homo Sapiens
ASYVVLYKI

SEQ ID NO: 316860 - protein, 9 aa, Homo Sapiens
ANFFLSLIH

SEQ ID NO: 316861 - protein, 9 aa, Homo Sapiens
PHKEPPASS

SEQ ID NO: 316862 - protein, 9 aa, Homo Sapiens
NIASMVQAG

SEQ ID NO: 316863 - protein, 9 aa, Homo Sapiens
VYSYEWPLY

SEQ ID NO: 316864 - protein, 9 aa, Homo Sapiens
RKNIAQLQH

SEQ ID NO: 316865 - protein, 9 aa, Homo Sapiens
TCLLMVRVL

SEQ ID NO: 316866 - protein, 9 aa, Homo Sapiens
FGGMEVIPN

SEQ ID NO: 316867 - protein, 9 aa, Homo Sapiens
SPNAHSGGR

SEQ ID NO: 316868 - protein, 9 aa, Homo Sapiens
EPLLSLLQK

SEQ ID NO: 316869 - protein, 9 aa, Homo Sapiens
GGMEVIPNA

SEQ ID NO: 316870 - protein, 9 aa, Homo Sapiens
KREADEAIN

SEQ ID NO: 316871 - protein, 9 aa, Homo Sapiens
CPVPPPPKR

SEQ ID NO: 316872 - protein, 9 aa, Homo Sapiens
DQYIGENAQ

SEQ ID NO: 316873 - protein, 9 aa, Homo Sapiens
NFCKSEECE

SEQ ID NO: 316874 - protein, 9 aa, Homo Sapiens
HKVTSVKPL

SEQ ID NO: 316875 - protein, 9 aa, Homo Sapiens
LIMKEPPTP

SEQ ID NO: 316876 - protein, 9 aa, Homo Sapiens
MPFMFAGLG

SEQ ID NO: 316877 - protein, 9 aa, Homo Sapiens
CLQEINDVC

SEQ ID NO: 316878 - protein, 9 aa, Homo Sapiens
TDCTLDCGS

SEQ ID NO: 316879 - protein, 9 aa, Homo Sapiens
KHVSLVDMI

SEQ ID NO: 316880 - protein, 9 aa, Homo Sapiens
DPVPPADGK

SEQ ID NO: 316881 - protein, 9 aa, Homo Sapiens
GCSNMEGGY

SEQ ID NO: 316882 - protein, 9 aa, Homo Sapiens
QVTACDAGV

SEQ ID NO: 316883 - protein, 9 aa, Homo Sapiens
INHQVHLRR

SEQ ID NO: 316884 - protein, 9 aa, Homo Sapiens
EYMFSPSEL

SEQ ID NO: 316885 - protein, 9 aa, Homo Sapiens
KKATKEAAG

SEQ ID NO: 316886 - protein, 9 aa, Homo Sapiens
SDDDEDEGL

SEQ ID NO: 316887 - protein, 9 aa, Homo Sapiens
QIQLPPKQA

SEQ ID NO: 316888 - protein, 9 aa, Homo Sapiens
DHLGCNIFW

SEQ ID NO: 316889 - protein, 9 aa, Homo Sapiens
DHCICVLHP

SEQ ID NO: 316890 - protein, 9 aa, Homo Sapiens
SDDTPMVRW

SEQ ID NO: 316891 - protein, 9 aa, Homo Sapiens
TSEDVHGFK

SEQ ID NO: 316892 - protein, 9 aa, Homo Sapiens
KKKATKEAA

SEQ ID NO: 316893 - protein, 9 aa, Homo Sapiens
VPSSSKHRR

SEQ ID NO: 316894 - protein, 9 aa, Homo Sapiens
TFLFQPHCG

SEQ ID NO: 316895 - protein, 9 aa, Homo Sapiens
TMNPVIYTL

SEQ ID NO: 316896 - protein, 9 aa, Homo Sapiens
DGKKLPTSP

SEQ ID NO: 316897 - protein, 9 aa, Homo Sapiens
HGQGLWNCF

SEQ ID NO: 316898 - protein, 9 aa, Homo Sapiens
LPSLQELYL

SEQ ID NO: 316899 - protein, 9 aa, Homo Sapiens
ELKQMHGQL

SEQ ID NO: 316900 - protein, 9 aa, Homo Sapiens
LDHCICVLH

SEQ ID NO: 316901 - protein, 9 aa, Homo Sapiens
AQAHPHKEP

SEQ ID NO: 316902 - protein, 9 aa, Homo Sapiens
PMLEQIHLI

SEQ ID NO: 316903 - protein, 9 aa, Homo Sapiens
GIAVDHLGC

SEQ ID NO: 316904 - protein, 9 aa, Homo Sapiens
ELIMKEPPT

SEQ ID NO: 316905 - protein, 9 aa, Homo Sapiens
IVIKPIDKK

SEQ ID NO: 316906 - protein, 9 aa, Homo Sapiens
YGKAFGTQI

SEQ ID NO: 316907 - protein, 9 aa, Homo Sapiens
SKIDALIDN

SEQ ID NO: 316908 - protein, 9 aa, Homo Sapiens
NVFPGMTTR

SEQ ID NO: 316909 - protein, 9 aa, Homo Sapiens
RGAALLQTL

SEQ ID NO: 316910 - protein, 9 aa, Homo Sapiens
GPHLMDLQK

SEQ ID NO: 316911 - protein, 9 aa, Homo Sapiens
LTPRAQSEE

SEQ ID NO: 316912 - protein, 9 aa, Homo Sapiens
ETFKNFFVE

SEQ ID NO: 316913 - protein, 9 aa, Homo Sapiens
QINHQVHLR

SEQ ID NO: 316914 - protein, 9 aa, Homo Sapiens
AIVQMLVHF

SEQ ID NO: 316915 - protein, 9 aa, Homo Sapiens
YRGRSPNAH

SEQ ID NO: 316916 - protein, 9 aa, Homo Sapiens
CKYYGKAFG

SEQ ID NO: 316917 - protein, 9 aa, Homo Sapiens
VARRWVIQK

SEQ ID NO: 316918 - protein, 9 aa, Homo Sapiens
LGCNIFWTD

SEQ ID NO: 316919 - protein, 9 aa, Homo Sapiens
NHAIVQMLV

SEQ ID NO: 316920 - protein, 9 aa, Homo Sapiens
ENRCVDILK

SEQ ID NO: 316921 - protein, 9 aa, Homo Sapiens
DYETFKNFF

SEQ ID NO: 316922 - protein, 9 aa, Homo Sapiens
KDYLVQWLL

SEQ ID NO: 316923 - protein, 9 aa, Homo Sapiens
ARRPMLEQI

SEQ ID NO: 316924 - protein, 9 aa, Homo Sapiens
GSGTCIMQV

SEQ ID NO: 316925 - protein, 9 aa, Homo Sapiens
SQPYLWLPE

SEQ ID NO: 316926 - protein, 9 aa, Homo Sapiens
SSSDIHKVT

SEQ ID NO: 316927 - protein, 9 aa, Homo Sapiens
EAAGAGAAK

SEQ ID NO: 316928 - protein, 9 aa, Homo Sapiens
LCRQAGCNH

SEQ ID NO: 316929 - protein, 9 aa, Homo Sapiens
NELPELDER

SEQ ID NO: 316930 - protein, 9 aa, Homo Sapiens
HRGAALLQT

SEQ ID NO: 316931 - protein, 9 aa, Homo Sapiens
VGAAGAVHW

SEQ ID NO: 316932 - protein, 9 aa, Homo Sapiens
SDIHKVTSV

SEQ ID NO: 316933 - protein, 9 aa, Homo Sapiens
VGSGTCIMQ

SEQ ID NO: 316934 - protein, 9 aa, Homo Sapiens
NISFNDKKI

SEQ ID NO: 316935 - protein, 9 aa, Homo Sapiens
RDMANWISA

SEQ ID NO: 316936 - protein, 9 aa, Homo Sapiens
GQWSWDDIQ

SEQ ID NO: 316937 - protein, 9 aa, Homo Sapiens
SNLSRAPIK

SEQ ID NO: 316938 - protein, 9 aa, Homo Sapiens
NWISAFGYL

SEQ ID NO: 316939 - protein, 9 aa, Homo Sapiens
AMELLDGNL

SEQ ID NO: 316940 - protein, 9 aa, Homo Sapiens
NIAQLQHDM

SEQ ID NO: 316941 - protein, 9 aa, Homo Sapiens
GMEVIPNAL

SEQ ID NO: 316942 - protein, 9 aa, Homo Sapiens
WKSQDEPKA

SEQ ID NO: 316943 - protein, 9 aa, Homo Sapiens
PSLQELYLN

SEQ ID NO: 316944 - protein, 9 aa, Homo Sapiens
NVQPILQID

SEQ ID NO: 316945 - protein, 9 aa, Homo Sapiens
SLIHAPRNL

SEQ ID NO: 316946 - protein, 9 aa, Homo Sapiens
LNQKRKKEQ

SEQ ID NO: 316947 - protein, 9 aa, Homo Sapiens
LKNIASMVQ

SEQ ID NO: 316948 - protein, 9 aa, Homo Sapiens
VSNYAELIM

SEQ ID NO: 316949 - protein, 9 aa, Homo Sapiens
WISAFGYLE

SEQ ID NO: 316950 - protein, 9 aa, Homo Sapiens
QDNELPELD

SEQ ID NO: 316951 - protein, 9 aa, Homo Sapiens
SRTCLLMVR

SEQ ID NO: 316952 - protein, 9 aa, Homo Sapiens
ESNLSRAPI

SEQ ID NO: 316953 - protein, 9 aa, Homo Sapiens
DKLSTQDYV

SEQ ID NO: 316954 - protein, 9 aa, Homo Sapiens
QLPPKQAQA

SEQ ID NO: 316955 - protein, 9 aa, Homo Sapiens
GASYVVLYK

SEQ ID NO: 316956 - protein, 9 aa, Homo Sapiens
QGKKLVAAA

SEQ ID NO: 316957 - protein, 9 aa, Homo Sapiens
GLCRQAGCN

SEQ ID NO: 316958 - protein, 9 aa, Homo Sapiens
QHDMEAHYP

SEQ ID NO: 316959 - protein, 9 aa, Homo Sapiens
LCPVPPPPK

SEQ ID NO: 316960 - protein, 9 aa, Homo Sapiens
TACDAGVPP

SEQ ID NO: 316961 - protein, 9 aa, Homo Sapiens
NMEGGYLCG

SEQ ID NO: 316962 - protein, 9 aa, Homo Sapiens
KYYNTMKKL

SEQ ID NO: 316963 - protein, 9 aa, Homo Sapiens
RVSFAKDIT

SEQ ID NO: 316964 - protein, 9 aa, Homo Sapiens
VTACDAGVP

SEQ ID NO: 316965 - protein, 9 aa, Homo Sapiens
SWRHRGQGQ

SEQ ID NO: 316966 - protein, 9 aa, Homo Sapiens
AELIMKEPP

SEQ ID NO: 316967 - protein, 9 aa, Homo Sapiens
LKGLQTVGF

SEQ ID NO: 316968 - protein, 9 aa, Homo Sapiens
LMDLQKNGS

SEQ ID NO: 316969 - protein, 9 aa, Homo Sapiens
NWVCSQVKE

SEQ ID NO: 316970 - protein, 9 aa, Homo Sapiens
SQYSLTVQA

SEQ ID NO: 316971 - protein, 9 aa, Homo Sapiens
AVQIQLPPK

SEQ ID NO: 316972 - protein, 9 aa, Homo Sapiens
IKGSCLQEI

SEQ ID NO: 316973 - protein, 9 aa, Homo Sapiens
GELFIWRTA

SEQ ID NO: 316974 - protein, 9 aa, Homo Sapiens
AALLQTLGI

SEQ ID NO: 316975 - protein, 9 aa, Homo Sapiens
PKRKSCEIP

SEQ ID NO: 316976 - protein, 9 aa, Homo Sapiens
MQNLSSVQA

SEQ ID NO: 316977 - protein, 9 aa, Homo Sapiens
APKVLESRM

SEQ ID NO: 316978 - protein, 9 aa, Homo Sapiens
NYGCSNMEG

SEQ ID NO: 316979 - protein, 9 aa, Homo Sapiens
EDVHGFKAP

SEQ ID NO: 316980 - protein, 9 aa, Homo Sapiens
HDMEAHYPG

SEQ ID NO: 316981 - protein, 9 aa, Homo Sapiens
CKSEECEKA

SEQ ID NO: 316982 - protein, 9 aa, Homo Sapiens
HPHKEPPAS

SEQ ID NO: 316983 - protein, 9 aa, Homo Sapiens
DGFSQPYLW

SEQ ID NO: 316984 - protein, 9 aa, Homo Sapiens
AGTDCTLDC

SEQ ID NO: 316985 - protein, 9 aa, Homo Sapiens
KGNQERAVQ

SEQ ID NO: 316986 - protein, 9 aa, Homo Sapiens
ATGHRKALA

SEQ ID NO: 316987 - protein, 9 aa, Homo Sapiens
ENVFPGMTT

SEQ ID NO: 316988 - protein, 9 aa, Homo Sapiens
GDCTGTLLA

SEQ ID NO: 316989 - protein, 9 aa, Homo Sapiens
NFFVEASMS

SEQ ID NO: 316990 - protein, 9 aa, Homo Sapiens
MLQQMDVLA

SEQ ID NO: 316991 - protein, 9 aa, Homo Sapiens
SLLQKDRCL

SEQ ID NO: 316992 - protein, 9 aa, Homo Sapiens
YHSKIDALI

SEQ ID NO: 316993 - protein, 9 aa, Homo Sapiens
GQEPQVPSS

SEQ ID NO: 316994 - protein, 9 aa, Homo Sapiens
LCRHCFPWC

SEQ ID NO: 316995 - protein, 9 aa, Homo Sapiens
YYNTMKKLG

SEQ ID NO: 316996 - protein, 9 aa, Homo Sapiens
RLLWSHGQG

SEQ ID NO: 316997 - protein, 9 aa, Homo Sapiens
NDKKIVIKP

SEQ ID NO: 316998 - protein, 9 aa, Homo Sapiens
SQPLWMTCC

SEQ ID NO: 316999 - protein, 9 aa, Homo Sapiens
LSLIHAPRN

SEQ ID NO: 317000 - protein, 9 aa, Homo Sapiens
QRKEKQLTH

SEQ ID NO: 317001 - protein, 9 aa, Homo Sapiens
IAQLQHDME

SEQ ID NO: 317002 - protein, 9 aa, Homo Sapiens
IHAPRNLTF

SEQ ID NO: 317003 - protein, 9 aa, Homo Sapiens
TKCNNMRQT

SEQ ID NO: 317004 - protein, 9 aa, Homo Sapiens
TSGMAYLHS

SEQ ID NO: 317005 - protein, 9 aa, Homo Sapiens
QPYLWLPEA

SEQ ID NO: 317006 - protein, 9 aa, Homo Sapiens
GRSPNAHSG

SEQ ID NO: 317007 - protein, 9 aa, Homo Sapiens
FKNFFVEAS

SEQ ID NO: 317008 - protein, 9 aa, Homo Sapiens
ASMVQAGGL

SEQ ID NO: 317009 - protein, 9 aa, Homo Sapiens
DDTPVTESN

SEQ ID NO: 317010 - protein, 9 aa, Homo Sapiens
GAAGAVHWV

SEQ ID NO: 317011 - protein, 9 aa, Homo Sapiens
NVHVCRGSI

SEQ ID NO: 317012 - protein, 9 aa, Homo Sapiens
CGELFIWRT

SEQ ID NO: 317013 - protein, 9 aa, Homo Sapiens
GLPASYHTV

SEQ ID NO: 317014 - protein, 9 aa, Homo Sapiens
NTKVDFFAM

SEQ ID NO: 317015 - protein, 9 aa, Homo Sapiens
AAPVSCSLQ

SEQ ID NO: 317016 - protein, 9 aa, Homo Sapiens
AYSAQAHPH

SEQ ID NO: 317017 - protein, 9 aa, Homo Sapiens
FLFQPHCGE

SEQ ID NO: 317018 - protein, 9 aa, Homo Sapiens
GAVHWVRGG

SEQ ID NO: 317019 - protein, 9 aa, Homo Sapiens
IDALIDNSV

SEQ ID NO: 317020 - protein, 9 aa, Homo Sapiens
IEPKPFLYI

SEQ ID NO: 317021 - protein, 9 aa, Homo Sapiens
QKDRCLARP

SEQ ID NO: 317022 - protein, 9 aa, Homo Sapiens
LRHGANLSF

SEQ ID NO: 317023 - protein, 9 aa, Homo Sapiens
VSQINHQVH

SEQ ID NO: 317024 - protein, 9 aa, Homo Sapiens
VQIQLPPKQ

SEQ ID NO: 317025 - protein, 9 aa, Homo Sapiens
NHVLNSKAR

SEQ ID NO: 317026 - protein, 9 aa, Homo Sapiens
LAVAVRSKH

SEQ ID NO: 317027 - protein, 9 aa, Homo Sapiens
NGSQPLWMT

SEQ ID NO: 317028 - protein, 9 aa, Homo Sapiens
VKANDQYIG

SEQ ID NO: 317029 - protein, 9 aa, Homo Sapiens
NRGLVVHHS

SEQ ID NO: 317030 - protein, 9 aa, Homo Sapiens
GEDTFPPLL

SEQ ID NO: 317031 - protein, 9 aa, Homo Sapiens
GRCNEVVIT

SEQ ID NO: 317032 - protein, 9 aa, Homo Sapiens
RMNSATGHR

SEQ ID NO: 317033 - protein, 9 aa, Homo Sapiens
GTARYMAPK

SEQ ID NO: 317034 - protein, 9 aa, Homo Sapiens
YIVGRKKMM

SEQ ID NO: 317035 - protein, 9 aa, Homo Sapiens
WAAASKLGE

SEQ ID NO: 317036 - protein, 9 aa, Homo Sapiens
SLPEIKGSC

SEQ ID NO: 317037 - protein, 9 aa, Homo Sapiens
AHAIVQLRT

SEQ ID NO: 317038 - protein, 9 aa, Homo Sapiens
LNRGLVVHH

SEQ ID NO: 317039 - protein, 9 aa, Homo Sapiens
EFLCRWCYR

SEQ ID NO: 317040 - protein, 9 aa, Homo Sapiens
CTGTLLADW

SEQ ID NO: 317041 - protein, 9 aa, Homo Sapiens
QWSWDDIQV

SEQ ID NO: 317042 - protein, 9 aa, Homo Sapiens
KLHSDLSRE

SEQ ID NO: 317043 - protein, 9 aa, Homo Sapiens
VHGFKAPGA

SEQ ID NO: 317044 - protein, 9 aa, Homo Sapiens
KIDALIDNS

SEQ ID NO: 317045 - protein, 9 aa, Homo Sapiens
LDLTGDTLD

SEQ ID NO: 317046 - protein, 9 aa, Homo Sapiens
EPLDFEARS

SEQ ID NO: 317047 - protein, 9 aa, Homo Sapiens
SNWVCSQVK

SEQ ID NO: 317048 - protein, 9 aa, Homo Sapiens
WVCSQVKEI

SEQ ID NO: 317049 - protein, 9 aa, Homo Sapiens
GTDCTLDCG

SEQ ID NO: 317050 - protein, 9 aa, Homo Sapiens
ALDHCICVL

SEQ ID NO: 317051 - protein, 9 aa, Homo Sapiens
LPELDERPP

SEQ ID NO: 317052 - protein, 9 aa, Homo Sapiens
IENVQPILQ

SEQ ID NO: 317053 - protein, 9 aa, Homo Sapiens
KTDKDYLVQ

SEQ ID NO: 317054 - protein, 9 aa, Homo Sapiens
LQTVGFMPP

SEQ ID NO: 317055 - protein, 9 aa, Homo Sapiens
SPRLWTSLM

SEQ ID NO: 317056 - protein, 9 aa, Homo Sapiens
FVRKDKLST

SEQ ID NO: 317057 - protein, 9 aa, Homo Sapiens
SQINHQVHL

SEQ ID NO: 317058 - protein, 9 aa, Homo Sapiens
TLDCGSGIG

SEQ ID NO: 317059 - protein, 9 aa, Homo Sapiens
QMLVHFINP

SEQ ID NO: 317060 - protein, 9 aa, Homo Sapiens
QMDVLAKKA

SEQ ID NO: 317061 - protein, 9 aa, Homo Sapiens
LASAVELWQ

SEQ ID NO: 317062 - protein, 9 aa, Homo Sapiens
EIMQNLSSV

SEQ ID NO: 317063 - protein, 9 aa, Homo Sapiens
NLSSVQALE

SEQ ID NO: 317064 - protein, 9 aa, Homo Sapiens
QSEEGASSD

SEQ ID NO: 317065 - protein, 9 aa, Homo Sapiens
LHSDLSREL

SEQ ID NO: 317066 - protein, 9 aa, Homo Sapiens
MNTFLFQPH

SEQ ID NO: 317067 - protein, 9 aa, Homo Sapiens
DCTGTLLAD

SEQ ID NO: 317068 - protein, 9 aa, Homo Sapiens
AAQAQRAQQ

SEQ ID NO: 317069 - protein, 9 aa, Homo Sapiens
CVCVYVCVS

SEQ ID NO: 317070 - protein, 9 aa, Homo Sapiens
QYHSKIDAL

SEQ ID NO: 317071 - protein, 9 aa, Homo Sapiens
PSNEPWDNL

SEQ ID NO: 317072 - protein, 9 aa, Homo Sapiens
GFIALDHCI

SEQ ID NO: 317073 - protein, 9 aa, Homo Sapiens
SWKSEHSKP

SEQ ID NO: 317074 - protein, 9 aa, Homo Sapiens
QLRLMLPSS

SEQ ID NO: 317075 - protein, 9 aa, Homo Sapiens
FSRQSSLLR

SEQ ID NO: 317076 - protein, 9 aa, Homo Sapiens
HTGQKFSLC

SEQ ID NO: 317077 - protein, 9 aa, Homo Sapiens
LGSGRYKQI

SEQ ID NO: 317078 - protein, 9 aa, Homo Sapiens
CLYLLGRVM

SEQ ID NO: 317079 - protein, 9 aa, Homo Sapiens
LPNASSNPD

SEQ ID NO: 317080 - protein, 9 aa, Homo Sapiens
IELKVIQHY

SEQ ID NO: 317081 - protein, 9 aa, Homo Sapiens
QSEWHGWMV

SEQ ID NO: 317082 - protein, 9 aa, Homo Sapiens
DEDSRHSSR

SEQ ID NO: 317083 - protein, 9 aa, Homo Sapiens
LSALIIAQV

SEQ ID NO: 317084 - protein, 9 aa, Homo Sapiens
GARPHRRIQ

SEQ ID NO: 317085 - protein, 9 aa, Homo Sapiens
YMKQPAGVS

SEQ ID NO: 317086 - protein, 9 aa, Homo Sapiens
DAWRFWRKR

SEQ ID NO: 317087 - protein, 9 aa, Homo Sapiens
VRPMPWQRV

SEQ ID NO: 317088 - protein, 9 aa, Homo Sapiens
EQSDCPVIV

SEQ ID NO: 317089 - protein, 9 aa, Homo Sapiens
HGRPNAEGD

SEQ ID NO: 317090 - protein, 9 aa, Homo Sapiens
DTSQLASSL

SEQ ID NO: 317091 - protein, 9 aa, Homo Sapiens
CASLRCPEC

SEQ ID NO: 317092 - protein, 9 aa, Homo Sapiens
GPQKLVCIV

SEQ ID NO: 317093 - protein, 9 aa, Homo Sapiens
PGASEHGRP

SEQ ID NO: 317094 - protein, 9 aa, Homo Sapiens
FSPHYEFGS

SEQ ID NO: 317095 - protein, 9 aa, Homo Sapiens
YIQRGLHRN

SEQ ID NO: 317096 - protein, 9 aa, Homo Sapiens
EQLHLRIGI

SEQ ID NO: 317097 - protein, 9 aa, Homo Sapiens
ILCLSWKGH

SEQ ID NO: 317098 - protein, 9 aa, Homo Sapiens
KYQDAAYSQ

SEQ ID NO: 317099 - protein, 9 aa, Homo Sapiens
NSGACIDKI

SEQ ID NO: 317100 - protein, 9 aa, Homo Sapiens
HGLNYCGVH

SEQ ID NO: 317101 - protein, 9 aa, Homo Sapiens
HSPGCPRLY

SEQ ID NO: 317102 - protein, 9 aa, Homo Sapiens
SWWGFLVTG

SEQ ID NO: 317103 - protein, 9 aa, Homo Sapiens
FKGPRKMSM

SEQ ID NO: 317104 - protein, 9 aa, Homo Sapiens
SPAWCSGKR

SEQ ID NO: 317105 - protein, 9 aa, Homo Sapiens
TNAGLKMLV

SEQ ID NO: 317106 - protein, 9 aa, Homo Sapiens
SPWVRRHRQ

SEQ ID NO: 317107 - protein, 9 aa, Homo Sapiens
LRNWTAATS

SEQ ID NO: 317108 - protein, 9 aa, Homo Sapiens
SDQPNIYIR

SEQ ID NO: 317109 - protein, 9 aa, Homo Sapiens
KSKQADSVE

SEQ ID NO: 317110 - protein, 9 aa, Homo Sapiens
QAEKAGIIC

SEQ ID NO: 317111 - protein, 9 aa, Homo Sapiens
PIHVRNLTI

SEQ ID NO: 317112 - protein, 9 aa, Homo Sapiens
APEEICDAR

SEQ ID NO: 317113 - protein, 9 aa, Homo Sapiens
PGYPEIYPP

SEQ ID NO: 317114 - protein, 9 aa, Homo Sapiens
VEGGLWARK

SEQ ID NO: 317115 - protein, 9 aa, Homo Sapiens
PAPSPDTSQ

SEQ ID NO: 317116 - protein, 9 aa, Homo Sapiens
LSTNSPATL

SEQ ID NO: 317117 - protein, 9 aa, Homo Sapiens
LRLMLPSSA

SEQ ID NO: 317118 - protein, 9 aa, Homo Sapiens
SVHPPGACQ

SEQ ID NO: 317119 - protein, 9 aa, Homo Sapiens
AWYRGTAPP

SEQ ID NO: 317120 - protein, 9 aa, Homo Sapiens
WQEVVAASE

SEQ ID NO: 317121 - protein, 9 aa, Homo Sapiens
DLKTKNLLL

SEQ ID NO: 317122 - protein, 9 aa, Homo Sapiens
SSTSTSIII

SEQ ID NO: 317123 - protein, 9 aa, Homo Sapiens
APWRTPEFY

SEQ ID NO: 317124 - protein, 9 aa, Homo Sapiens
TQFWIILGD

SEQ ID NO: 317125 - protein, 9 aa, Homo Sapiens
SPQIAWQKD

SEQ ID NO: 317126 - protein, 9 aa, Homo Sapiens
LTARIHRLR

SEQ ID NO: 317127 - protein, 9 aa, Homo Sapiens
KYVFENIGK

SEQ ID NO: 317128 - protein, 9 aa, Homo Sapiens
RWHSTTIAD

SEQ ID NO: 317129 - protein, 9 aa, Homo Sapiens
AVPLGPART

SEQ ID NO: 317130 - protein, 9 aa, Homo Sapiens
CTVRPDASV

SEQ ID NO: 317131 - protein, 9 aa, Homo Sapiens
VIDNGTDDW

SEQ ID NO: 317132 - protein, 9 aa, Homo Sapiens
TLQETQESL

SEQ ID NO: 317133 - protein, 9 aa, Homo Sapiens
WRQEEKMHN

SEQ ID NO: 317134 - protein, 9 aa, Homo Sapiens
LGSNPQKKT

SEQ ID NO: 317135 - protein, 9 aa, Homo Sapiens
QPGKLDKDP

SEQ ID NO: 317136 - protein, 9 aa, Homo Sapiens
GDKYLGHAV

SEQ ID NO: 317137 - protein, 9 aa, Homo Sapiens
TSGNYSGKA

SEQ ID NO: 317138 - protein, 9 aa, Homo Sapiens
LVLDCGYCL

SEQ ID NO: 317139 - protein, 9 aa, Homo Sapiens
SWHTGRCRP

SEQ ID NO: 317140 - protein, 9 aa, Homo Sapiens
KAPEQGSHF

SEQ ID NO: 317141 - protein, 9 aa, Homo Sapiens
QTRLPLCSP

SEQ ID NO: 317142 - protein, 9 aa, Homo Sapiens
MNVLELIEF

SEQ ID NO: 317143 - protein, 9 aa, Homo Sapiens
ADFLKMRLS

SEQ ID NO: 317144 - protein, 9 aa, Homo Sapiens
LAKKNRSSG

SEQ ID NO: 317145 - protein, 9 aa, Homo Sapiens
GRLYGPFLP

SEQ ID NO: 317146 - protein, 9 aa, Homo Sapiens
DMIGYRPCP

SEQ ID NO: 317147 - protein, 9 aa, Homo Sapiens
DEMCVNYNG

SEQ ID NO: 317148 - protein, 9 aa, Homo Sapiens
EPRVTLPMD

SEQ ID NO: 317149 - protein, 9 aa, Homo Sapiens
HGCSFPPPV

SEQ ID NO: 317150 - protein, 9 aa, Homo Sapiens
NSCTEMEGR

SEQ ID NO: 317151 - protein, 9 aa, Homo Sapiens
RAKETKGGV

SEQ ID NO: 317152 - protein, 9 aa, Homo Sapiens
IFVRNQEKI

SEQ ID NO: 317153 - protein, 9 aa, Homo Sapiens
MPWHSCRLA

SEQ ID NO: 317154 - protein, 9 aa, Homo Sapiens
QLVLVRDIR

SEQ ID NO: 317155 - protein, 9 aa, Homo Sapiens
SICVFLVRR

SEQ ID NO: 317156 - protein, 9 aa, Homo Sapiens
WSGDVPVSC

SEQ ID NO: 317157 - protein, 9 aa, Homo Sapiens
SHVNKLRAK

SEQ ID NO: 317158 - protein, 9 aa, Homo Sapiens
HYDGNLQCA

SEQ ID NO: 317159 - protein, 9 aa, Homo Sapiens
AWLTLAGLG

SEQ ID NO: 317160 - protein, 9 aa, Homo Sapiens
TGFSPPVNV

SEQ ID NO: 317161 - protein, 9 aa, Homo Sapiens
AIGVLTSSG

SEQ ID NO: 317162 - protein, 9 aa, Homo Sapiens
EFEVRSSWP

SEQ ID NO: 317163 - protein, 9 aa, Homo Sapiens
RSFTCTQSE

SEQ ID NO: 317164 - protein, 9 aa, Homo Sapiens
EKMHNQEEK

SEQ ID NO: 317165 - protein, 9 aa, Homo Sapiens
LFIEWMVGG

SEQ ID NO: 317166 - protein, 9 aa, Homo Sapiens
VTQPTGEEQ

SEQ ID NO: 317167 - protein, 9 aa, Homo Sapiens
FQWGESPWQ

SEQ ID NO: 317168 - protein, 9 aa, Homo Sapiens
NSDGVVQHE

SEQ ID NO: 317169 - protein, 9 aa, Homo Sapiens
AEDDCEKLE

SEQ ID NO: 317170 - protein, 9 aa, Homo Sapiens
IYPTSTQLD

SEQ ID NO: 317171 - protein, 9 aa, Homo Sapiens
YQITGWMDD

SEQ ID NO: 317172 - protein, 9 aa, Homo Sapiens
PSSSLSPDH

SEQ ID NO: 317173 - protein, 9 aa, Homo Sapiens
QLRNSADCV

SEQ ID NO: 317174 - protein, 9 aa, Homo Sapiens
YEKTSGSKM

SEQ ID NO: 317175 - protein, 9 aa, Homo Sapiens
RNYDIELAV

SEQ ID NO: 317176 - protein, 9 aa, Homo Sapiens
EKTSKRGSK

SEQ ID NO: 317177 - protein, 9 aa, Homo Sapiens
MFAKGQSVA

SEQ ID NO: 317178 - protein, 9 aa, Homo Sapiens
ISDLDWVVF

SEQ ID NO: 317179 - protein, 9 aa, Homo Sapiens
KTLVGLARS

SEQ ID NO: 317180 - protein, 9 aa, Homo Sapiens
CSCCYGPLE

SEQ ID NO: 317181 - protein, 9 aa, Homo Sapiens
CRPYKVLLA

SEQ ID NO: 317182 - protein, 9 aa, Homo Sapiens
MVSPAVQEP

SEQ ID NO: 317183 - protein, 9 aa, Homo Sapiens
EGTTPCTSS

SEQ ID NO: 317184 - protein, 9 aa, Homo Sapiens
EEGKWSLEL

SEQ ID NO: 317185 - protein, 9 aa, Homo Sapiens
QRLSHPGHF

SEQ ID NO: 317186 - protein, 9 aa, Homo Sapiens
IAKIRSYNH

SEQ ID NO: 317187 - protein, 9 aa, Homo Sapiens
GTDDWRIAM

SEQ ID NO: 317188 - protein, 9 aa, Homo Sapiens
LDQRASDYN

SEQ ID NO: 317189 - protein, 9 aa, Homo Sapiens
YRPDGNGFS

SEQ ID NO: 317190 - protein, 9 aa, Homo Sapiens
WKGVQLLLS

SEQ ID NO: 317191 - protein, 9 aa, Homo Sapiens
IVEKVQVQV

SEQ ID NO: 317192 - protein, 9 aa, Homo Sapiens
ITSVPKDSF

SEQ ID NO: 317193 - protein, 9 aa, Homo Sapiens
PATTLAQAQ

SEQ ID NO: 317194 - protein, 9 aa, Homo Sapiens
VTVPLVDEG

SEQ ID NO: 317195 - protein, 9 aa, Homo Sapiens
HFLSPETFA

SEQ ID NO: 317196 - protein, 9 aa, Homo Sapiens
HHHWILPFV

SEQ ID NO: 317197 - protein, 9 aa, Homo Sapiens
AMRVRGAQV

SEQ ID NO: 317198 - protein, 9 aa, Homo Sapiens
QSSGSWASL

SEQ ID NO: 317199 - protein, 9 aa, Homo Sapiens
YLTAKISSP

SEQ ID NO: 317200 - protein, 9 aa, Homo Sapiens
SRDFLLHFG

SEQ ID NO: 317201 - protein, 9 aa, Homo Sapiens
MWPASSSWW

SEQ ID NO: 317202 - protein, 9 aa, Homo Sapiens
MSPLFEKGP

SEQ ID NO: 317203 - protein, 9 aa, Homo Sapiens
EKELDRNPE

SEQ ID NO: 317204 - protein, 9 aa, Homo Sapiens
VYRNLQITK

SEQ ID NO: 317205 - protein, 9 aa, Homo Sapiens
DGKPFRKGP

SEQ ID NO: 317206 - protein, 9 aa, Homo Sapiens
SDPIIFQMT

SEQ ID NO: 317207 - protein, 9 aa, Homo Sapiens
PPTMVQGPA

SEQ ID NO: 317208 - protein, 9 aa, Homo Sapiens
PHWIASPAH

SEQ ID NO: 317209 - protein, 9 aa, Homo Sapiens
RQVTCLCTQ

SEQ ID NO: 317210 - protein, 9 aa, Homo Sapiens
PLAFASSTS

SEQ ID NO: 317211 - protein, 9 aa, Homo Sapiens
FWLVLWLLF

SEQ ID NO: 317212 - protein, 9 aa, Homo Sapiens
RERLHVRDI

SEQ ID NO: 317213 - protein, 9 aa, Homo Sapiens
RCSPVKNEE

SEQ ID NO: 317214 - protein, 9 aa, Homo Sapiens
CAGICACTN

SEQ ID NO: 317215 - protein, 9 aa, Homo Sapiens
LEQLLLQPE

SEQ ID NO: 317216 - protein, 9 aa, Homo Sapiens
RKTTWLEGS

SEQ ID NO: 317217 - protein, 9 aa, Homo Sapiens
DIHISQFCF

SEQ ID NO: 317218 - protein, 9 aa, Homo Sapiens
SRLIHMSIM

SEQ ID NO: 317219 - protein, 9 aa, Homo Sapiens
TSWYDGIRE

SEQ ID NO: 317220 - protein, 9 aa, Homo Sapiens
SVCQDNESE

SEQ ID NO: 317221 - protein, 9 aa, Homo Sapiens
PACVLCNKD

SEQ ID NO: 317222 - protein, 9 aa, Homo Sapiens
RLTISGLFP

SEQ ID NO: 317223 - protein, 9 aa, Homo Sapiens
QRKHLHNAA

SEQ ID NO: 317224 - protein, 9 aa, Homo Sapiens
MVVCRNVAG

SEQ ID NO: 317225 - protein, 9 aa, Homo Sapiens
KVRRVSLKP

SEQ ID NO: 317226 - protein, 9 aa, Homo Sapiens
LKTKNLLLD

SEQ ID NO: 317227 - protein, 9 aa, Homo Sapiens
PPAGRQSRT

SEQ ID NO: 317228 - protein, 9 aa, Homo Sapiens
GSALSALMP

SEQ ID NO: 317229 - protein, 9 aa, Homo Sapiens
KNLESGMNW

SEQ ID NO: 317230 - protein, 9 aa, Homo Sapiens
PLHALATGF

SEQ ID NO: 317231 - protein, 9 aa, Homo Sapiens
TGFAVIHDV

SEQ ID NO: 317232 - protein, 9 aa, Homo Sapiens
GPMLPGNAR

SEQ ID NO: 317233 - protein, 9 aa, Homo Sapiens
NDMNSPTDR

SEQ ID NO: 317234 - protein, 9 aa, Homo Sapiens
KPPHPTCTK

SEQ ID NO: 317235 - protein, 9 aa, Homo Sapiens
DSDPFAKLI

SEQ ID NO: 317236 - protein, 9 aa, Homo Sapiens
WKGHVPKSE

SEQ ID NO: 317237 - protein, 9 aa, Homo Sapiens
ATTISHQAI

SEQ ID NO: 317238 - protein, 9 aa, Homo Sapiens
CQKSIIDAH

SEQ ID NO: 317239 - protein, 9 aa, Homo Sapiens
YWLDEKWDF

SEQ ID NO: 317240 - protein, 9 aa, Homo Sapiens
VLNLNCILI

SEQ ID NO: 317241 - protein, 9 aa, Homo Sapiens
RFTRLSMTT

SEQ ID NO: 317242 - protein, 9 aa, Homo Sapiens
EALAARDAL

SEQ ID NO: 317243 - protein, 9 aa, Homo Sapiens
NLSLTMLEN

SEQ ID NO: 317244 - protein, 9 aa, Homo Sapiens
IFTQFWIIL

SEQ ID NO: 317245 - protein, 9 aa, Homo Sapiens
KLSMREAQE

SEQ ID NO: 317246 - protein, 9 aa, Homo Sapiens
MLLGYTAAI

SEQ ID NO: 317247 - protein, 9 aa, Homo Sapiens
PSGHGCSFP

SEQ ID NO: 317248 - protein, 9 aa, Homo Sapiens
RKHLHNAAS

SEQ ID NO: 317249 - protein, 9 aa, Homo Sapiens
FHMWPASSS

SEQ ID NO: 317250 - protein, 9 aa, Homo Sapiens
ITDSKLYIP

SEQ ID NO: 317251 - protein, 9 aa, Homo Sapiens
GLAQSKLMR

SEQ ID NO: 317252 - protein, 9 aa, Homo Sapiens
EEITKQSPM

SEQ ID NO: 317253 - protein, 9 aa, Homo Sapiens
RRPRPACHE

SEQ ID NO: 317254 - protein, 9 aa, Homo Sapiens
YIIKRFKLS

SEQ ID NO: 317255 - protein, 9 aa, Homo Sapiens
TQAGTQIPI

SEQ ID NO: 317256 - protein, 9 aa, Homo Sapiens
HLKMMHIAT

SEQ ID NO: 317257 - protein, 9 aa, Homo Sapiens
KGAIMRSLR

SEQ ID NO: 317258 - protein, 9 aa, Homo Sapiens
TEDKSSSND

SEQ ID NO: 317259 - protein, 9 aa, Homo Sapiens
RTVMETIAV

SEQ ID NO: 317260 - protein, 9 aa, Homo Sapiens
EEPWQMLAC

SEQ ID NO: 317261 - protein, 9 aa, Homo Sapiens
EGHTGQKFS

SEQ ID NO: 317262 - protein, 9 aa, Homo Sapiens
SLWNELDSL

SEQ ID NO: 317263 - protein, 9 aa, Homo Sapiens
AVVVDISGR

SEQ ID NO: 317264 - protein, 9 aa, Homo Sapiens
LDFMWHQPY

SEQ ID NO: 317265 - protein, 9 aa, Homo Sapiens
IMKSCWHWR

SEQ ID NO: 317266 - protein, 9 aa, Homo Sapiens
YSGAPPRAR

SEQ ID NO: 317267 - protein, 9 aa, Homo Sapiens
TSPGASEHG

SEQ ID NO: 317268 - protein, 9 aa, Homo Sapiens
LVSGNMELI

SEQ ID NO: 317269 - protein, 9 aa, Homo Sapiens
TRVHTDIQN

SEQ ID NO: 317270 - protein, 9 aa, Homo Sapiens
PVVYYLHHS

SEQ ID NO: 317271 - protein, 9 aa, Homo Sapiens
LLMPPMLNP

SEQ ID NO: 317272 - protein, 9 aa, Homo Sapiens
EHIDPFTHE

SEQ ID NO: 317273 - protein, 9 aa, Homo Sapiens
QQLGGEVGD

SEQ ID NO: 317274 - protein, 9 aa, Homo Sapiens
YQDAAYSQC

SEQ ID NO: 317275 - protein, 9 aa, Homo Sapiens
ILKWALKVK

SEQ ID NO: 317276 - protein, 9 aa, Homo Sapiens
VAFVKVAEA

SEQ ID NO: 317277 - protein, 9 aa, Homo Sapiens
IAGVVIHMR

SEQ ID NO: 317278 - protein, 9 aa, Homo Sapiens
WSQPNPATA

SEQ ID NO: 317279 - protein, 9 aa, Homo Sapiens
PATLKVGKQ

SEQ ID NO: 317280 - protein, 9 aa, Homo Sapiens
MSVHRGEAP

SEQ ID NO: 317281 - protein, 9 aa, Homo Sapiens
YLKDENSTK

SEQ ID NO: 317282 - protein, 9 aa, Homo Sapiens
PPRARPGTC

SEQ ID NO: 317283 - protein, 9 aa, Homo Sapiens
TYLQINFYC

SEQ ID NO: 317284 - protein, 9 aa, Homo Sapiens
YVRDLHSIV

SEQ ID NO: 317285 - protein, 9 aa, Homo Sapiens
KMVVCRNVA

SEQ ID NO: 317286 - protein, 9 aa, Homo Sapiens
EILAADCGM

SEQ ID NO: 317287 - protein, 9 aa, Homo Sapiens
PRRKGPQWH

SEQ ID NO: 317288 - protein, 9 aa, Homo Sapiens
FCCFGNFIW

SEQ ID NO: 317289 - protein, 9 aa, Homo Sapiens
SCLNVGFLF

SEQ ID NO: 317290 - protein, 9 aa, Homo Sapiens
RSVCQDNES

SEQ ID NO: 317291 - protein, 9 aa, Homo Sapiens
RGVIAIKQF

SEQ ID NO: 317292 - protein, 9 aa, Homo Sapiens
TPPTNMPTP

SEQ ID NO: 317293 - protein, 9 aa, Homo Sapiens
AMDAYVKLF

SEQ ID NO: 317294 - protein, 9 aa, Homo Sapiens
QQSHISSSN

SEQ ID NO: 317295 - protein, 9 aa, Homo Sapiens
HLISIMILG

SEQ ID NO: 317296 - protein, 9 aa, Homo Sapiens
TFNVMPSPK

SEQ ID NO: 317297 - protein, 9 aa, Homo Sapiens
AVCKPLEAV

SEQ ID NO: 317298 - protein, 9 aa, Homo Sapiens
RCDGHVEVS

SEQ ID NO: 317299 - protein, 9 aa, Homo Sapiens
VLWKKGLSL

SEQ ID NO: 317300 - protein, 9 aa, Homo Sapiens
QWEKLRGLM

SEQ ID NO: 317301 - protein, 9 aa, Homo Sapiens
ISRFTRLSM

SEQ ID NO: 317302 - protein, 9 aa, Homo Sapiens
SVGSIPALK

SEQ ID NO: 317303 - protein, 9 aa, Homo Sapiens
VTLLVESLS

SEQ ID NO: 317304 - protein, 9 aa, Homo Sapiens
AAGYGLISF

SEQ ID NO: 317305 - protein, 9 aa, Homo Sapiens
CKACITHWW

SEQ ID NO: 317306 - protein, 9 aa, Homo Sapiens
NSQDQVLEV

SEQ ID NO: 317307 - protein, 9 aa, Homo Sapiens
GDMRLANGG

SEQ ID NO: 317308 - protein, 9 aa, Homo Sapiens
PGSAAWGRA

SEQ ID NO: 317309 - protein, 9 aa, Homo Sapiens
DTTMVCCAP

SEQ ID NO: 317310 - protein, 9 aa, Homo Sapiens
KEAGEANKS

SEQ ID NO: 317311 - protein, 9 aa, Homo Sapiens
IRHGRPRAD

SEQ ID NO: 317312 - protein, 9 aa, Homo Sapiens
YCSQCHCSS

SEQ ID NO: 317313 - protein, 9 aa, Homo Sapiens
EITSSTISH

SEQ ID NO: 317314 - protein, 9 aa, Homo Sapiens
SDCPVIVSV

SEQ ID NO: 317315 - protein, 9 aa, Homo Sapiens
AECYRLHLE

SEQ ID NO: 317316 - protein, 9 aa, Homo Sapiens
LQTQQSHIS

SEQ ID NO: 317317 - protein, 9 aa, Homo Sapiens
LHVRDINEA

SEQ ID NO: 317318 - protein, 9 aa, Homo Sapiens
TQPMPNPVV

SEQ ID NO: 317319 - protein, 9 aa, Homo Sapiens
FLDNKVMLS

SEQ ID NO: 317320 - protein, 9 aa, Homo Sapiens
KPYKCNECC

SEQ ID NO: 317321 - protein, 9 aa, Homo Sapiens
MGRGRHWGT

SEQ ID NO: 317322 - protein, 9 aa, Homo Sapiens
PVAGAQEPG

SEQ ID NO: 317323 - protein, 9 aa, Homo Sapiens
PEYPADASR

SEQ ID NO: 317324 - protein, 9 aa, Homo Sapiens
EDRESRFLA

SEQ ID NO: 317325 - protein, 9 aa, Homo Sapiens
RAGSPHGSP

SEQ ID NO: 317326 - protein, 9 aa, Homo Sapiens
GEKSCAVKN

SEQ ID NO: 317327 - protein, 9 aa, Homo Sapiens
SSSAQIVCV

SEQ ID NO: 317328 - protein, 9 aa, Homo Sapiens
GSDPFPYPE

SEQ ID NO: 317329 - protein, 9 aa, Homo Sapiens
LASLLLWGL

SEQ ID NO: 317330 - protein, 9 aa, Homo Sapiens
HGQRGAPEL

SEQ ID NO: 317331 - protein, 9 aa, Homo Sapiens
PLGQRQPHR

SEQ ID NO: 317332 - protein, 9 aa, Homo Sapiens
TATDAKARE

SEQ ID NO: 317333 - protein, 9 aa, Homo Sapiens
GGRRGPGGQ

SEQ ID NO: 317334 - protein, 9 aa, Homo Sapiens
RCRDAASKL

SEQ ID NO: 317335 - protein, 9 aa, Homo Sapiens
VFENIGKKR

SEQ ID NO: 317336 - protein, 9 aa, Homo Sapiens
ETTGAISYT

SEQ ID NO: 317337 - protein, 9 aa, Homo Sapiens
SKMTAQPGW

SEQ ID NO: 317338 - protein, 9 aa, Homo Sapiens
NSRDFLLHF

SEQ ID NO: 317339 - protein, 9 aa, Homo Sapiens
QVYFEEALG

SEQ ID NO: 317340 - protein, 9 aa, Homo Sapiens
QLCSEIQML

SEQ ID NO: 317341 - protein, 9 aa, Homo Sapiens
SLLNSQRKH

SEQ ID NO: 317342 - protein, 9 aa, Homo Sapiens
CNECCKVFR

SEQ ID NO: 317343 - protein, 9 aa, Homo Sapiens
YPQGPLVPS

SEQ ID NO: 317344 - protein, 9 aa, Homo Sapiens
EHTARWIQS

SEQ ID NO: 317345 - protein, 9 aa, Homo Sapiens
KLLGKPNSG

SEQ ID NO: 317346 - protein, 9 aa, Homo Sapiens
KQMTRWFSA

SEQ ID NO: 317347 - protein, 9 aa, Homo Sapiens
LLDIDALKQ

SEQ ID NO: 317348 - protein, 9 aa, Homo Sapiens
AGSTQPEPQ

SEQ ID NO: 317349 - protein, 9 aa, Homo Sapiens
CMGNVLSSE

SEQ ID NO: 317350 - protein, 9 aa, Homo Sapiens
SALVRWGKY

SEQ ID NO: 317351 - protein, 9 aa, Homo Sapiens
QCQGHMNVL

SEQ ID NO: 317352 - protein, 9 aa, Homo Sapiens
KNTPLHCAA

SEQ ID NO: 317353 - protein, 9 aa, Homo Sapiens
LLPGVKTHS

SEQ ID NO: 317354 - protein, 9 aa, Homo Sapiens
WASLPKVSY

SEQ ID NO: 317355 - protein, 9 aa, Homo Sapiens
EEDDDEDSR

SEQ ID NO: 317356 - protein, 9 aa, Homo Sapiens
IAVYHCSAS

SEQ ID NO: 317357 - protein, 9 aa, Homo Sapiens
RNFLDKEAC

SEQ ID NO: 317358 - protein, 9 aa, Homo Sapiens
VEFEVRSSW

SEQ ID NO: 317359 - protein, 9 aa, Homo Sapiens
KEEQEQDLL

SEQ ID NO: 317360 - protein, 9 aa, Homo Sapiens
GKPAPVPPP

SEQ ID NO: 317361 - protein, 9 aa, Homo Sapiens
HCPANGAGW

SEQ ID NO: 317362 - protein, 9 aa, Homo Sapiens
QDTLTWNNE

SEQ ID NO: 317363 - protein, 9 aa, Homo Sapiens
PPAPAPWLP

SEQ ID NO: 317364 - protein, 9 aa, Homo Sapiens
AVNEPLKTH

SEQ ID NO: 317365 - protein, 9 aa, Homo Sapiens
IKTSQANFN

SEQ ID NO: 317366 - protein, 9 aa, Homo Sapiens
EEAWLTLAG

SEQ ID NO: 317367 - protein, 9 aa, Homo Sapiens
NPGACVTLV

SEQ ID NO: 317368 - protein, 9 aa, Homo Sapiens
KIIFTLTWV

SEQ ID NO: 317369 - protein, 9 aa, Homo Sapiens
TQPTGEEQA

SEQ ID NO: 317370 - protein, 9 aa, Homo Sapiens
WELDKIKGL

SEQ ID NO: 317371 - protein, 9 aa, Homo Sapiens
RVHTAENCQ

SEQ ID NO: 317372 - protein, 9 aa, Homo Sapiens
VGLSQANFT

SEQ ID NO: 317373 - protein, 9 aa, Homo Sapiens
LYLKKKQEP

SEQ ID NO: 317374 - protein, 9 aa, Homo Sapiens
PGTKRKRPL

SEQ ID NO: 317375 - protein, 9 aa, Homo Sapiens
SHGRCVDGR

SEQ ID NO: 317376 - protein, 9 aa, Homo Sapiens
PTNTWDGDH

SEQ ID NO: 317377 - protein, 9 aa, Homo Sapiens
MPLIHSRMR

SEQ ID NO: 317378 - protein, 9 aa, Homo Sapiens
VSGSHLDPC

SEQ ID NO: 317379 - protein, 9 aa, Homo Sapiens
RFLNRVAAT

SEQ ID NO: 317380 - protein, 9 aa, Homo Sapiens
HPTGHEWRY

SEQ ID NO: 317381 - protein, 9 aa, Homo Sapiens
KKDHPDYKC

SEQ ID NO: 317382 - protein, 9 aa, Homo Sapiens
EGHNGYYNG

SEQ ID NO: 317383 - protein, 9 aa, Homo Sapiens
ILGLGDRRV

SEQ ID NO: 317384 - protein, 9 aa, Homo Sapiens
ASHTLPVCL

SEQ ID NO: 317385 - protein, 9 aa, Homo Sapiens
EAGASGSPS

SEQ ID NO: 317386 - protein, 9 aa, Homo Sapiens
PTQPRLLLS

SEQ ID NO: 317387 - protein, 9 aa, Homo Sapiens
SSSTGSMGS

SEQ ID NO: 317388 - protein, 9 aa, Homo Sapiens
QTVKMTFVI

SEQ ID NO: 317389 - protein, 9 aa, Homo Sapiens
EVVLDKSVC

SEQ ID NO: 317390 - protein, 9 aa, Homo Sapiens
CWHWREADR

SEQ ID NO: 317391 - protein, 9 aa, Homo Sapiens
KNQSEAGTL

SEQ ID NO: 317392 - protein, 9 aa, Homo Sapiens
VRACGANSY

SEQ ID NO: 317393 - protein, 9 aa, Homo Sapiens
GYREEIVQY

SEQ ID NO: 317394 - protein, 9 aa, Homo Sapiens
RQDRPVCEG

SEQ ID NO: 317395 - protein, 9 aa, Homo Sapiens
ALEDVKMVV

SEQ ID NO: 317396 - protein, 9 aa, Homo Sapiens
QKKLHTEVI

SEQ ID NO: 317397 - protein, 9 aa, Homo Sapiens
ASKLKELEK

SEQ ID NO: 317398 - protein, 9 aa, Homo Sapiens
LLHCTERPF

SEQ ID NO: 317399 - protein, 9 aa, Homo Sapiens
HICAAVCTR

SEQ ID NO: 317400 - protein, 9 aa, Homo Sapiens
LCCGRASRD

SEQ ID NO: 317401 - protein, 9 aa, Homo Sapiens
ICPPGSLPP

SEQ ID NO: 317402 - protein, 9 aa, Homo Sapiens
IFTLSMAYL

SEQ ID NO: 317403 - protein, 9 aa, Homo Sapiens
KVLLCCEAS

SEQ ID NO: 317404 - protein, 9 aa, Homo Sapiens
PKFKSKFLF

SEQ ID NO: 317405 - protein, 9 aa, Homo Sapiens
RLRPMCPPP

SEQ ID NO: 317406 - protein, 9 aa, Homo Sapiens
PTLLALQHP

SEQ ID NO: 317407 - protein, 9 aa, Homo Sapiens
GLNYCGVHA

SEQ ID NO: 317408 - protein, 9 aa, Homo Sapiens
RKHMKVHGH

SEQ ID NO: 317409 - protein, 9 aa, Homo Sapiens
PPDMYECLH

SEQ ID NO: 317410 - protein, 9 aa, Homo Sapiens
SPDGLILWT

SEQ ID NO: 317411 - protein, 9 aa, Homo Sapiens
GRPLHQHSP

SEQ ID NO: 317412 - protein, 9 aa, Homo Sapiens
HEPQSFIHR

SEQ ID NO: 317413 - protein, 9 aa, Homo Sapiens
THPLLSKWC

SEQ ID NO: 317414 - protein, 9 aa, Homo Sapiens
KAFSLASSL

SEQ ID NO: 317415 - protein, 9 aa, Homo Sapiens
FVTVCWLGL

SEQ ID NO: 317416 - protein, 9 aa, Homo Sapiens
MLRRCARDP

SEQ ID NO: 317417 - protein, 9 aa, Homo Sapiens
IMHHISTPL

SEQ ID NO: 317418 - protein, 9 aa, Homo Sapiens
EWLCLACRS

SEQ ID NO: 317419 - protein, 9 aa, Homo Sapiens
VDKRKLREL

SEQ ID NO: 317420 - protein, 9 aa, Homo Sapiens
WHLALLAGL

SEQ ID NO: 317421 - protein, 9 aa, Homo Sapiens
GGWQEVVAA

SEQ ID NO: 317422 - protein, 9 aa, Homo Sapiens
TTMITAILQ

SEQ ID NO: 317423 - protein, 9 aa, Homo Sapiens
LREESSRME

SEQ ID NO: 317424 - protein, 9 aa, Homo Sapiens
EDTDCPCMV

SEQ ID NO: 317425 - protein, 9 aa, Homo Sapiens
IGYRPCPLI

SEQ ID NO: 317426 - protein, 9 aa, Homo Sapiens
SERGQLLNR

SEQ ID NO: 317427 - protein, 9 aa, Homo Sapiens
TRWFSADEQ

SEQ ID NO: 317428 - protein, 9 aa, Homo Sapiens
RVVKKTTLL

SEQ ID NO: 317429 - protein, 9 aa, Homo Sapiens
EAVKDSVWD

SEQ ID NO: 317430 - protein, 9 aa, Homo Sapiens
LFLVTWRGV

SEQ ID NO: 317431 - protein, 9 aa, Homo Sapiens
QGHYDGNLQ

SEQ ID NO: 317432 - protein, 9 aa, Homo Sapiens
LQSTPTPMA

SEQ ID NO: 317433 - protein, 9 aa, Homo Sapiens
PLPRSWFAH

SEQ ID NO: 317434 - protein, 9 aa, Homo Sapiens
TTLKGKVIP

SEQ ID NO: 317435 - protein, 9 aa, Homo Sapiens
WGESPWQVM

SEQ ID NO: 317436 - protein, 9 aa, Homo Sapiens
KLPPAPAPW

SEQ ID NO: 317437 - protein, 9 aa, Homo Sapiens
TASQLFTSR

SEQ ID NO: 317438 - protein, 9 aa, Homo Sapiens
DLKIKLAVQ

SEQ ID NO: 317439 - protein, 9 aa, Homo Sapiens
RLPGRPAHW

SEQ ID NO: 317440 - protein, 9 aa, Homo Sapiens
RNAARTTIW

SEQ ID NO: 317441 - protein, 9 aa, Homo Sapiens
PHGPKGEPG

SEQ ID NO: 317442 - protein, 9 aa, Homo Sapiens
GYMPLIHSR

SEQ ID NO: 317443 - protein, 9 aa, Homo Sapiens
PLNIQIVLV

SEQ ID NO: 317444 - protein, 9 aa, Homo Sapiens
QVVTIKQVP

SEQ ID NO: 317445 - protein, 9 aa, Homo Sapiens
TFSVGWWSF

SEQ ID NO: 317446 - protein, 9 aa, Homo Sapiens
EITAVAMQG

SEQ ID NO: 317447 - protein, 9 aa, Homo Sapiens
VAFCMVKII

SEQ ID NO: 317448 - protein, 9 aa, Homo Sapiens
SCVQFLHGE

SEQ ID NO: 317449 - protein, 9 aa, Homo Sapiens
GEGSTGIIC

SEQ ID NO: 317450 - protein, 9 aa, Homo Sapiens
AYFMRGRLY

SEQ ID NO: 317451 - protein, 9 aa, Homo Sapiens
NNARERLHV

SEQ ID NO: 317452 - protein, 9 aa, Homo Sapiens
FWPLRKWSS

SEQ ID NO: 317453 - protein, 9 aa, Homo Sapiens
SGRLDSDTK

SEQ ID NO: 317454 - protein, 9 aa, Homo Sapiens
GNVQITVVG

SEQ ID NO: 317455 - protein, 9 aa, Homo Sapiens
VPLSALIIA

SEQ ID NO: 317456 - protein, 9 aa, Homo Sapiens
PSWAALSNS

SEQ ID NO: 317457 - protein, 9 aa, Homo Sapiens
KLLSQEPNN

SEQ ID NO: 317458 - protein, 9 aa, Homo Sapiens
NVEIGTCKE

SEQ ID NO: 317459 - protein, 9 aa, Homo Sapiens
QDLDLSDPM

SEQ ID NO: 317460 - protein, 9 aa, Homo Sapiens
SGFLWSLQQ

SEQ ID NO: 317461 - protein, 9 aa, Homo Sapiens
TVPVATTLS

SEQ ID NO: 317462 - protein, 9 aa, Homo Sapiens
SDSSPSCRQ

SEQ ID NO: 317463 - protein, 9 aa, Homo Sapiens
TAVVIFLHG

SEQ ID NO: 317464 - protein, 9 aa, Homo Sapiens
QVQSRETLL

SEQ ID NO: 317465 - protein, 9 aa, Homo Sapiens
QHQEGKRLW

SEQ ID NO: 317466 - protein, 9 aa, Homo Sapiens
RKEMAPVQL

SEQ ID NO: 317467 - protein, 9 aa, Homo Sapiens
TKMVLRMFI

SEQ ID NO: 317468 - protein, 9 aa, Homo Sapiens
SPRLRLLAA

SEQ ID NO: 317469 - protein, 9 aa, Homo Sapiens
YDGIREELE

SEQ ID NO: 317470 - protein, 9 aa, Homo Sapiens
TFTTVEVSA

SEQ ID NO: 317471 - protein, 9 aa, Homo Sapiens
QRQICVGDR

SEQ ID NO: 317472 - protein, 9 aa, Homo Sapiens
IFHDLMDCV

SEQ ID NO: 317473 - protein, 9 aa, Homo Sapiens
PGFPPHVPP

SEQ ID NO: 317474 - protein, 9 aa, Homo Sapiens
SPERRCCSV

SEQ ID NO: 317475 - protein, 9 aa, Homo Sapiens
VEFNQVVMA

SEQ ID NO: 317476 - protein, 9 aa, Homo Sapiens
KISAEAVVV

SEQ ID NO: 317477 - protein, 9 aa, Homo Sapiens
VQIDELKLQ

SEQ ID NO: 317478 - protein, 9 aa, Homo Sapiens
KQEPPCTRL

SEQ ID NO: 317479 - protein, 9 aa, Homo Sapiens
LANLTQGKD

SEQ ID NO: 317480 - protein, 9 aa, Homo Sapiens
LGKPNSGVG

SEQ ID NO: 317481 - protein, 9 aa, Homo Sapiens
LSSNLRWLL

SEQ ID NO: 317482 - protein, 9 aa, Homo Sapiens
CKSYPMLKL

SEQ ID NO: 317483 - protein, 9 aa, Homo Sapiens
SLATPLCAG

SEQ ID NO: 317484 - protein, 9 aa, Homo Sapiens
TMPVNTNRW

SEQ ID NO: 317485 - protein, 9 aa, Homo Sapiens
WMDDVINIS

SEQ ID NO: 317486 - protein, 9 aa, Homo Sapiens
LCSNKKKKP

SEQ ID NO: 317487 - protein, 9 aa, Homo Sapiens
NGWGQGELS

SEQ ID NO: 317488 - protein, 9 aa, Homo Sapiens
SKASQQKAM

SEQ ID NO: 317489 - protein, 9 aa, Homo Sapiens
GPAGLPLAM

SEQ ID NO: 317490 - protein, 9 aa, Homo Sapiens
EYYTITEFQ

SEQ ID NO: 317491 - protein, 9 aa, Homo Sapiens
EDRKLCERL

SEQ ID NO: 317492 - protein, 9 aa, Homo Sapiens
SEGLLATVT

SEQ ID NO: 317493 - protein, 9 aa, Homo Sapiens
KKENTLVQM

SEQ ID NO: 317494 - protein, 9 aa, Homo Sapiens
KASQQKAMN

SEQ ID NO: 317495 - protein, 9 aa, Homo Sapiens
SSNGWQWKP

SEQ ID NO: 317496 - protein, 9 aa, Homo Sapiens
ILKKSVPSV

SEQ ID NO: 317497 - protein, 9 aa, Homo Sapiens
DLDWVVFEP

SEQ ID NO: 317498 - protein, 9 aa, Homo Sapiens
VGQPQWKLD

SEQ ID NO: 317499 - protein, 9 aa, Homo Sapiens
EELMTTLIT

SEQ ID NO: 317500 - protein, 9 aa, Homo Sapiens
ACVLWKKGL

SEQ ID NO: 317501 - protein, 9 aa, Homo Sapiens
GLVLRHLLF

SEQ ID NO: 317502 - protein, 9 aa, Homo Sapiens
MGTQFGQWD

SEQ ID NO: 317503 - protein, 9 aa, Homo Sapiens
DWEKSSNGW

SEQ ID NO: 317504 - protein, 9 aa, Homo Sapiens
FCFPASPGP

SEQ ID NO: 317505 - protein, 9 aa, Homo Sapiens
MQLVDWHQI

SEQ ID NO: 317506 - protein, 9 aa, Homo Sapiens
VALLRAERV

SEQ ID NO: 317507 - protein, 9 aa, Homo Sapiens
AVKAKPSPW

SEQ ID NO: 317508 - protein, 9 aa, Homo Sapiens
TGKKYRVAK

SEQ ID NO: 317509 - protein, 9 aa, Homo Sapiens
KKPFKCYKC

SEQ ID NO: 317510 - protein, 9 aa, Homo Sapiens
SSAQIVCVF

SEQ ID NO: 317511 - protein, 9 aa, Homo Sapiens
VQINLSLTM

SEQ ID NO: 317512 - protein, 9 aa, Homo Sapiens
HVHARIIGA

SEQ ID NO: 317513 - protein, 9 aa, Homo Sapiens
IVKVDVTEQ

SEQ ID NO: 317514 - protein, 9 aa, Homo Sapiens
QSVGEVVPN

SEQ ID NO: 317515 - protein, 9 aa, Homo Sapiens
KSSSNDMNS

SEQ ID NO: 317516 - protein, 9 aa, Homo Sapiens
HILLLAGKS

SEQ ID NO: 317517 - protein, 9 aa, Homo Sapiens
TKNLLLDGN

SEQ ID NO: 317518 - protein, 9 aa, Homo Sapiens
NEEGLTTNA

SEQ ID NO: 317519 - protein, 9 aa, Homo Sapiens
EFGFGFGFS

SEQ ID NO: 317520 - protein, 9 aa, Homo Sapiens
GFPPHVPPG

SEQ ID NO: 317521 - protein, 9 aa, Homo Sapiens
LRLAVHEDG

SEQ ID NO: 317522 - protein, 9 aa, Homo Sapiens
GQSVAPYNT

SEQ ID NO: 317523 - protein, 9 aa, Homo Sapiens
KISSIRSIV

SEQ ID NO: 317524 - protein, 9 aa, Homo Sapiens
GGLVAFVKV

SEQ ID NO: 317525 - protein, 9 aa, Homo Sapiens
IKAPDVSLE

SEQ ID NO: 317526 - protein, 9 aa, Homo Sapiens
QIQHWLFKM

SEQ ID NO: 317527 - protein, 9 aa, Homo Sapiens
DVDACIAVC

SEQ ID NO: 317528 - protein, 9 aa, Homo Sapiens
RWANLPGPS

SEQ ID NO: 317529 - protein, 9 aa, Homo Sapiens
LRMFISSRW

SEQ ID NO: 317530 - protein, 9 aa, Homo Sapiens
EPEAAGWGS

SEQ ID NO: 317531 - protein, 9 aa, Homo Sapiens
TMVQGPAGL

SEQ ID NO: 317532 - protein, 9 aa, Homo Sapiens
MQVQEAVSR

SEQ ID NO: 317533 - protein, 9 aa, Homo Sapiens
PAPHLAWEF

SEQ ID NO: 317534 - protein, 9 aa, Homo Sapiens
KAPPKAKMP

SEQ ID NO: 317535 - protein, 9 aa, Homo Sapiens
LVLTIIVFI

SEQ ID NO: 317536 - protein, 9 aa, Homo Sapiens
VAHENNRVL

SEQ ID NO: 317537 - protein, 9 aa, Homo Sapiens
DNHGWHGGR

SEQ ID NO: 317538 - protein, 9 aa, Homo Sapiens
LIHSRMRLD

SEQ ID NO: 317539 - protein, 9 aa, Homo Sapiens
CAWDSTYRK

SEQ ID NO: 317540 - protein, 9 aa, Homo Sapiens
FTAGADEDF

SEQ ID NO: 317541 - protein, 9 aa, Homo Sapiens
ALIIAQVQV

SEQ ID NO: 317542 - protein, 9 aa, Homo Sapiens
QNRTCSFGH

SEQ ID NO: 317543 - protein, 9 aa, Homo Sapiens
QFYTSTAEE

SEQ ID NO: 317544 - protein, 9 aa, Homo Sapiens
KLYTCASCL

SEQ ID NO: 317545 - protein, 9 aa, Homo Sapiens
PKGEPKHYL

SEQ ID NO: 317546 - protein, 9 aa, Homo Sapiens
SRWANLPGP

SEQ ID NO: 317547 - protein, 9 aa, Homo Sapiens
VLCCVVAGM

SEQ ID NO: 317548 - protein, 9 aa, Homo Sapiens
QMDKPQNMK

SEQ ID NO: 317549 - protein, 9 aa, Homo Sapiens
YGSQKHLRT

SEQ ID NO: 317550 - protein, 9 aa, Homo Sapiens
TINQHLRKN

SEQ ID NO: 317551 - protein, 9 aa, Homo Sapiens
LRRTCSPHL

SEQ ID NO: 317552 - protein, 9 aa, Homo Sapiens
EKTSGSKMA

SEQ ID NO: 317553 - protein, 9 aa, Homo Sapiens
LVCIVSMDK

SEQ ID NO: 317554 - protein, 9 aa, Homo Sapiens
KFKIHGCVG

SEQ ID NO: 317555 - protein, 9 aa, Homo Sapiens
KELCMYDEK

SEQ ID NO: 317556 - protein, 9 aa, Homo Sapiens
VPPTCEEAC

SEQ ID NO: 317557 - protein, 9 aa, Homo Sapiens
EDGEEGGCA

SEQ ID NO: 317558 - protein, 9 aa, Homo Sapiens
AASPRPMAL

SEQ ID NO: 317559 - protein, 9 aa, Homo Sapiens
SSSQLSMSS

SEQ ID NO: 317560 - protein, 9 aa, Homo Sapiens
QFWIILGDF

SEQ ID NO: 317561 - protein, 9 aa, Homo Sapiens
LETAAKSKN

SEQ ID NO: 317562 - protein, 9 aa, Homo Sapiens
PMEHILVHL

SEQ ID NO: 317563 - protein, 9 aa, Homo Sapiens
SLRRFIYQP

SEQ ID NO: 317564 - protein, 9 aa, Homo Sapiens
FQMRRTLRI

SEQ ID NO: 317565 - protein, 9 aa, Homo Sapiens
SNFNDMVKQ

SEQ ID NO: 317566 - protein, 9 aa, Homo Sapiens
MGTLVGVYL

SEQ ID NO: 317567 - protein, 9 aa, Homo Sapiens
PLSPLKPPW

SEQ ID NO: 317568 - protein, 9 aa, Homo Sapiens
HQHTDDKFF

SEQ ID NO: 317569 - protein, 9 aa, Homo Sapiens
RRFIYQPPD

SEQ ID NO: 317570 - protein, 9 aa, Homo Sapiens
CSMAEGTGD

SEQ ID NO: 317571 - protein, 9 aa, Homo Sapiens
QETQESLSL

SEQ ID NO: 317572 - protein, 9 aa, Homo Sapiens
KKAYFQMRR

SEQ ID NO: 317573 - protein, 9 aa, Homo Sapiens
LEDGEEGGC

SEQ ID NO: 317574 - protein, 9 aa, Homo Sapiens
QIPDSYIPD

SEQ ID NO: 317575 - protein, 9 aa, Homo Sapiens
SKGSGAGSR

SEQ ID NO: 317576 - protein, 9 aa, Homo Sapiens
LNASTCYLF

SEQ ID NO: 317577 - protein, 9 aa, Homo Sapiens
GTGTGGRQG

SEQ ID NO: 317578 - protein, 9 aa, Homo Sapiens
EAPELPEEM

SEQ ID NO: 317579 - protein, 9 aa, Homo Sapiens
TNMGTPMMP

SEQ ID NO: 317580 - protein, 9 aa, Homo Sapiens
RWLDLGSCL

SEQ ID NO: 317581 - protein, 9 aa, Homo Sapiens
SLSSCSKNQ

SEQ ID NO: 317582 - protein, 9 aa, Homo Sapiens
EKYWDSWFR

SEQ ID NO: 317583 - protein, 9 aa, Homo Sapiens
IIRHTSMRG

SEQ ID NO: 317584 - protein, 9 aa, Homo Sapiens
ARVHTAENC

SEQ ID NO: 317585 - protein, 9 aa, Homo Sapiens
SLTHSMKSE

SEQ ID NO: 317586 - protein, 9 aa, Homo Sapiens
HILWAPADI

SEQ ID NO: 317587 - protein, 9 aa, Homo Sapiens
VAYTYSTMV

SEQ ID NO: 317588 - protein, 9 aa, Homo Sapiens
EITKQSPML

SEQ ID NO: 317589 - protein, 9 aa, Homo Sapiens
VRSSWPLYL

SEQ ID NO: 317590 - protein, 9 aa, Homo Sapiens
RSISLTFTE

SEQ ID NO: 317591 - protein, 9 aa, Homo Sapiens
EEKDLWSSN

SEQ ID NO: 317592 - protein, 9 aa, Homo Sapiens
SDYNQALGT

SEQ ID NO: 317593 - protein, 9 aa, Homo Sapiens
VGRSHSHRR

SEQ ID NO: 317594 - protein, 9 aa, Homo Sapiens
TVSFLQKNN

SEQ ID NO: 317595 - protein, 9 aa, Homo Sapiens
SSSNDMNSP

SEQ ID NO: 317596 - protein, 9 aa, Homo Sapiens
KAPPQGRNL

SEQ ID NO: 317597 - protein, 9 aa, Homo Sapiens
SPIWKRSAW

SEQ ID NO: 317598 - protein, 9 aa, Homo Sapiens
GGGSPSRSA

SEQ ID NO: 317599 - protein, 9 aa, Homo Sapiens
DLKIGLSLP

SEQ ID NO: 317600 - protein, 9 aa, Homo Sapiens
DPSNFLKTT

SEQ ID NO: 317601 - protein, 9 aa, Homo Sapiens
EICRLCECV

SEQ ID NO: 317602 - protein, 9 aa, Homo Sapiens
QEGKRLWRV

SEQ ID NO: 317603 - protein, 9 aa, Homo Sapiens
KESITRTSW

SEQ ID NO: 317604 - protein, 9 aa, Homo Sapiens
SNPQKKTVC

SEQ ID NO: 317605 - protein, 9 aa, Homo Sapiens
PRSVGVGHV

SEQ ID NO: 317606 - protein, 9 aa, Homo Sapiens
LNKEWQFHF

SEQ ID NO: 317607 - protein, 9 aa, Homo Sapiens
GCLGKCSAR

SEQ ID NO: 317608 - protein, 9 aa, Homo Sapiens
PPAHHAAAN

SEQ ID NO: 317609 - protein, 9 aa, Homo Sapiens
ETMYTGGNG

SEQ ID NO: 317610 - protein, 9 aa, Homo Sapiens
PIRRLVFLK

SEQ ID NO: 317611 - protein, 9 aa, Homo Sapiens
WISKPPGMA

SEQ ID NO: 317612 - protein, 9 aa, Homo Sapiens
LKLSQAQVY

SEQ ID NO: 317613 - protein, 9 aa, Homo Sapiens
SAQPPAGRQ

SEQ ID NO: 317614 - protein, 9 aa, Homo Sapiens
WEGCEWHFA

SEQ ID NO: 317615 - protein, 9 aa, Homo Sapiens
CTQRTLHVP

SEQ ID NO: 317616 - protein, 9 aa, Homo Sapiens
RFTSFINKV

SEQ ID NO: 317617 - protein, 9 aa, Homo Sapiens
TSIIISMVS

SEQ ID NO: 317618 - protein, 9 aa, Homo Sapiens
TVPHHEPPF

SEQ ID NO: 317619 - protein, 9 aa, Homo Sapiens
IDALQPHCL

SEQ ID NO: 317620 - protein, 9 aa, Homo Sapiens
QMRRTLRIC

SEQ ID NO: 317621 - protein, 9 aa, Homo Sapiens
PSRGKSRWR

SEQ ID NO: 317622 - protein, 9 aa, Homo Sapiens
LLSVFSQHF

SEQ ID NO: 317623 - protein, 9 aa, Homo Sapiens
GRGVIAIKQ

SEQ ID NO: 317624 - protein, 9 aa, Homo Sapiens
ECQYRRPAK

SEQ ID NO: 317625 - protein, 9 aa, Homo Sapiens
MAQVVLSRG

SEQ ID NO: 317626 - protein, 9 aa, Homo Sapiens
ERADIAESH

SEQ ID NO: 317627 - protein, 9 aa, Homo Sapiens
TCQLNGSAP

SEQ ID NO: 317628 - protein, 9 aa, Homo Sapiens
EEVLRKQFE

SEQ ID NO: 317629 - protein, 9 aa, Homo Sapiens
FITLDFVNQ

SEQ ID NO: 317630 - protein, 9 aa, Homo Sapiens
VPVIVLAAG

SEQ ID NO: 317631 - protein, 9 aa, Homo Sapiens
AAYSQCATT

SEQ ID NO: 317632 - protein, 9 aa, Homo Sapiens
TESQLVLVR

SEQ ID NO: 317633 - protein, 9 aa, Homo Sapiens
YFMRGRLYW

SEQ ID NO: 317634 - protein, 9 aa, Homo Sapiens
RTGLLPGEA

SEQ ID NO: 317635 - protein, 9 aa, Homo Sapiens
DHHRDHQQS

SEQ ID NO: 317636 - protein, 9 aa, Homo Sapiens
MECADAARG

SEQ ID NO: 317637 - protein, 9 aa, Homo Sapiens
KEVLMDIFA

SEQ ID NO: 317638 - protein, 9 aa, Homo Sapiens
MCVNYNGQH

SEQ ID NO: 317639 - protein, 9 aa, Homo Sapiens
VDGSQDYYV

SEQ ID NO: 317640 - protein, 9 aa, Homo Sapiens
LQGAIAFAL

SEQ ID NO: 317641 - protein, 9 aa, Homo Sapiens
CVPPLQPKG

SEQ ID NO: 317642 - protein, 9 aa, Homo Sapiens
WPLRGKCEA

SEQ ID NO: 317643 - protein, 9 aa, Homo Sapiens
ITSWYDGIR

SEQ ID NO: 317644 - protein, 9 aa, Homo Sapiens
DVQDMSPVF

SEQ ID NO: 317645 - protein, 9 aa, Homo Sapiens
MQTHPWRQV

SEQ ID NO: 317646 - protein, 9 aa, Homo Sapiens
EIIHKCEPS

SEQ ID NO: 317647 - protein, 9 aa, Homo Sapiens
VWEWPHSEF

SEQ ID NO: 317648 - protein, 9 aa, Homo Sapiens
ISKPPGMAL

SEQ ID NO: 317649 - protein, 9 aa, Homo Sapiens
KWFDGQRAT

SEQ ID NO: 317650 - protein, 9 aa, Homo Sapiens
HCSSITKNC

SEQ ID NO: 317651 - protein, 9 aa, Homo Sapiens
TVMVALASV

SEQ ID NO: 317652 - protein, 9 aa, Homo Sapiens
TWAQRGGGG

SEQ ID NO: 317653 - protein, 9 aa, Homo Sapiens
APHLAWEFM

SEQ ID NO: 317654 - protein, 9 aa, Homo Sapiens
QQGHMGIVL

SEQ ID NO: 317655 - protein, 9 aa, Homo Sapiens
SVETKPCAS

SEQ ID NO: 317656 - protein, 9 aa, Homo Sapiens
FLRQRGSDI

SEQ ID NO: 317657 - protein, 9 aa, Homo Sapiens
VFVTKPNSA

SEQ ID NO: 317658 - protein, 9 aa, Homo Sapiens
IVTVQIEGS

SEQ ID NO: 317659 - protein, 9 aa, Homo Sapiens
TQISVRVLD

SEQ ID NO: 317660 - protein, 9 aa, Homo Sapiens
PRLRPMCPP

SEQ ID NO: 317661 - protein, 9 aa, Homo Sapiens
SKLKELEKD

SEQ ID NO: 317662 - protein, 9 aa, Homo Sapiens
LHNYLSLTT

SEQ ID NO: 317663 - protein, 9 aa, Homo Sapiens
IFTLTWVLH

SEQ ID NO: 317664 - protein, 9 aa, Homo Sapiens
KELGPMLPG

SEQ ID NO: 317665 - protein, 9 aa, Homo Sapiens
SSRLRSLHT

SEQ ID NO: 317666 - protein, 9 aa, Homo Sapiens
ALGYHCDWS

SEQ ID NO: 317667 - protein, 9 aa, Homo Sapiens
CGMKLYGSS

SEQ ID NO: 317668 - protein, 9 aa, Homo Sapiens
PGTVVQTST

SEQ ID NO: 317669 - protein, 9 aa, Homo Sapiens
TCEEACCKS

SEQ ID NO: 317670 - protein, 9 aa, Homo Sapiens
MGPEGATNM

SEQ ID NO: 317671 - protein, 9 aa, Homo Sapiens
QITVVGNER

SEQ ID NO: 317672 - protein, 9 aa, Homo Sapiens
PRQDRPVCE

SEQ ID NO: 317673 - protein, 9 aa, Homo Sapiens
WNMQLLPVG

SEQ ID NO: 317674 - protein, 9 aa, Homo Sapiens
GACIDKISP

SEQ ID NO: 317675 - protein, 9 aa, Homo Sapiens
TQHRSPKCL

SEQ ID NO: 317676 - protein, 9 aa, Homo Sapiens
VPIAIWAGG

SEQ ID NO: 317677 - protein, 9 aa, Homo Sapiens
YQPPDRSAP

SEQ ID NO: 317678 - protein, 9 aa, Homo Sapiens
PSGELSIEE

SEQ ID NO: 317679 - protein, 9 aa, Homo Sapiens
FVKVAEALI

SEQ ID NO: 317680 - protein, 9 aa, Homo Sapiens
WQVMASLTG

SEQ ID NO: 317681 - protein, 9 aa, Homo Sapiens
CSYPRWHST

SEQ ID NO: 317682 - protein, 9 aa, Homo Sapiens
VLAAGYGLI

SEQ ID NO: 317683 - protein, 9 aa, Homo Sapiens
QVESKAKDD

SEQ ID NO: 317684 - protein, 9 aa, Homo Sapiens
TFSSLTSIS

SEQ ID NO: 317685 - protein, 9 aa, Homo Sapiens
DCPDMKHFC

SEQ ID NO: 317686 - protein, 9 aa, Homo Sapiens
TIQCEKAKG

SEQ ID NO: 317687 - protein, 9 aa, Homo Sapiens
TKVSCYLDW

SEQ ID NO: 317688 - protein, 9 aa, Homo Sapiens
IKKTLKATT

SEQ ID NO: 317689 - protein, 9 aa, Homo Sapiens
RINAMAEDS

SEQ ID NO: 317690 - protein, 9 aa, Homo Sapiens
NIGKKRILT

SEQ ID NO: 317691 - protein, 9 aa, Homo Sapiens
ACLQLGHLK

SEQ ID NO: 317692 - protein, 9 aa, Homo Sapiens
HLGNVQITV

SEQ ID NO: 317693 - protein, 9 aa, Homo Sapiens
AVLYLKKKQ

SEQ ID NO: 317694 - protein, 9 aa, Homo Sapiens
SSLAHHVLP

SEQ ID NO: 317695 - protein, 9 aa, Homo Sapiens
KKLISVEMD

SEQ ID NO: 317696 - protein, 9 aa, Homo Sapiens
KKTLKATTS

SEQ ID NO: 317697 - protein, 9 aa, Homo Sapiens
LVSSCRSCP

SEQ ID NO: 317698 - protein, 9 aa, Homo Sapiens
PSRLGSRMF

SEQ ID NO: 317699 - protein, 9 aa, Homo Sapiens
TSMKDMHKV

SEQ ID NO: 317700 - protein, 9 aa, Homo Sapiens
SCPSQHQGL

SEQ ID NO: 317701 - protein, 9 aa, Homo Sapiens
ELEGLGFRS

SEQ ID NO: 317702 - protein, 9 aa, Homo Sapiens
MPEEKDLWS

SEQ ID NO: 317703 - protein, 9 aa, Homo Sapiens
DKRKLRELT

SEQ ID NO: 317704 - protein, 9 aa, Homo Sapiens
MHKVLRTLQ

SEQ ID NO: 317705 - protein, 9 aa, Homo Sapiens
LGFSLWNFK

SEQ ID NO: 317706 - protein, 9 aa, Homo Sapiens
LNNVWDFLK

SEQ ID NO: 317707 - protein, 9 aa, Homo Sapiens
ANSIGSTNA

SEQ ID NO: 317708 - protein, 9 aa, Homo Sapiens
PSSQAVSNV

SEQ ID NO: 317709 - protein, 9 aa, Homo Sapiens
EMRRGRVVF

SEQ ID NO: 317710 - protein, 9 aa, Homo Sapiens
QVVKRLAGI

SEQ ID NO: 317711 - protein, 9 aa, Homo Sapiens
MYRMQLMSC

SEQ ID NO: 317712 - protein, 9 aa, Homo Sapiens
CMRFQPSAK

SEQ ID NO: 317713 - protein, 9 aa, Homo Sapiens
GRHWGTPWG

SEQ ID NO: 317714 - protein, 9 aa, Homo Sapiens
VCDFWLLSD

SEQ ID NO: 317715 - protein, 9 aa, Homo Sapiens
DQSCLKECS

SEQ ID NO: 317716 - protein, 9 aa, Homo Sapiens
NNRVLFHAA

SEQ ID NO: 317717 - protein, 9 aa, Homo Sapiens
TAQNTQMGN

SEQ ID NO: 317718 - protein, 9 aa, Homo Sapiens
VGTITGIVI

SEQ ID NO: 317719 - protein, 9 aa, Homo Sapiens
CLIQSHPES

SEQ ID NO: 317720 - protein, 9 aa, Homo Sapiens
YTAVGGMKD

SEQ ID NO: 317721 - protein, 9 aa, Homo Sapiens
LKMMHIATT

SEQ ID NO: 317722 - protein, 9 aa, Homo Sapiens
TPCTSSILQ

SEQ ID NO: 317723 - protein, 9 aa, Homo Sapiens
EYLMWAHFG

SEQ ID NO: 317724 - protein, 9 aa, Homo Sapiens
DDVALCDIE

SEQ ID NO: 317725 - protein, 9 aa, Homo Sapiens
CCKVFRQNS

SEQ ID NO: 317726 - protein, 9 aa, Homo Sapiens
LWLQYPQTQ

SEQ ID NO: 317727 - protein, 9 aa, Homo Sapiens
TGKTTKIPC

SEQ ID NO: 317728 - protein, 9 aa, Homo Sapiens
ELESQWEKL

SEQ ID NO: 317729 - protein, 9 aa, Homo Sapiens
ALAARDALV

SEQ ID NO: 317730 - protein, 9 aa, Homo Sapiens
LEWARTEDY

SEQ ID NO: 317731 - protein, 9 aa, Homo Sapiens
AVGGMKDVV

SEQ ID NO: 317732 - protein, 9 aa, Homo Sapiens
LARCRDAAS

SEQ ID NO: 317733 - protein, 9 aa, Homo Sapiens
LLQDQQKPV

SEQ ID NO: 317734 - protein, 9 aa, Homo Sapiens
LDHHVHARI

SEQ ID NO: 317735 - protein, 9 aa, Homo Sapiens
AKGQSVGEV

SEQ ID NO: 317736 - protein, 9 aa, Homo Sapiens
LSSFMTSPT

SEQ ID NO: 317737 - protein, 9 aa, Homo Sapiens
QAGFEKLCR

SEQ ID NO: 317738 - protein, 9 aa, Homo Sapiens
KHLHLSLNE

SEQ ID NO: 317739 - protein, 9 aa, Homo Sapiens
FRINLPIPL

SEQ ID NO: 317740 - protein, 9 aa, Homo Sapiens
QVALCDQDN

SEQ ID NO: 317741 - protein, 9 aa, Homo Sapiens
GEQNRTSVQ

SEQ ID NO: 317742 - protein, 9 aa, Homo Sapiens
GKGKKRRRR

SEQ ID NO: 317743 - protein, 9 aa, Homo Sapiens
ILDWRGMPY

SEQ ID NO: 317744 - protein, 9 aa, Homo Sapiens
KHLRGGGGS

SEQ ID NO: 317745 - protein, 9 aa, Homo Sapiens
PPKAKMPAK

SEQ ID NO: 317746 - protein, 9 aa, Homo Sapiens
GVKTHSEVR

SEQ ID NO: 317747 - protein, 9 aa, Homo Sapiens
RRSLEWART

SEQ ID NO: 317748 - protein, 9 aa, Homo Sapiens
EIKKWMGPG

SEQ ID NO: 317749 - protein, 9 aa, Homo Sapiens
WLHIEDIKK

SEQ ID NO: 317750 - protein, 9 aa, Homo Sapiens
KDSFSKRQE

SEQ ID NO: 317751 - protein, 9 aa, Homo Sapiens
LLSIAAQTL

SEQ ID NO: 317752 - protein, 9 aa, Homo Sapiens
GETVALKHV

SEQ ID NO: 317753 - protein, 9 aa, Homo Sapiens
GAYGMVSLA

SEQ ID NO: 317754 - protein, 9 aa, Homo Sapiens
SDIITRIVC

SEQ ID NO: 317755 - protein, 9 aa, Homo Sapiens
QRNPSYPWL

SEQ ID NO: 317756 - protein, 9 aa, Homo Sapiens
RYHVLFLRT

SEQ ID NO: 317757 - protein, 9 aa, Homo Sapiens
KLMSASGFL

SEQ ID NO: 317758 - protein, 9 aa, Homo Sapiens
LRKGGHCNS

SEQ ID NO: 317759 - protein, 9 aa, Homo Sapiens
YEEIAQSSK

SEQ ID NO: 317760 - protein, 9 aa, Homo Sapiens
SGDCGLGTQ

SEQ ID NO: 317761 - protein, 9 aa, Homo Sapiens
NNRQVALCD

SEQ ID NO: 317762 - protein, 9 aa, Homo Sapiens
VVDSIMDVI

SEQ ID NO: 317763 - protein, 9 aa, Homo Sapiens
CSNKKKKPK

SEQ ID NO: 317764 - protein, 9 aa, Homo Sapiens
NRSSGPLSL

SEQ ID NO: 317765 - protein, 9 aa, Homo Sapiens
QKKLVIVGD

SEQ ID NO: 317766 - protein, 9 aa, Homo Sapiens
RRHGRWRGH

SEQ ID NO: 317767 - protein, 9 aa, Homo Sapiens
HCAFHNLLL

SEQ ID NO: 317768 - protein, 9 aa, Homo Sapiens
RRLVFLKAG

SEQ ID NO: 317769 - protein, 9 aa, Homo Sapiens
TMAAEIKKW

SEQ ID NO: 317770 - protein, 9 aa, Homo Sapiens
DGLPAMALG

SEQ ID NO: 317771 - protein, 9 aa, Homo Sapiens
GTGWPLAGQ

SEQ ID NO: 317772 - protein, 9 aa, Homo Sapiens
RPDESLTIS

SEQ ID NO: 317773 - protein, 9 aa, Homo Sapiens
FKIHGCVGD

SEQ ID NO: 317774 - protein, 9 aa, Homo Sapiens
KLPFLCELS

SEQ ID NO: 317775 - protein, 9 aa, Homo Sapiens
HRPQQQGHM

SEQ ID NO: 317776 - protein, 9 aa, Homo Sapiens
EKGFRYSSQ

SEQ ID NO: 317777 - protein, 9 aa, Homo Sapiens
RSTMPVNTN

SEQ ID NO: 317778 - protein, 9 aa, Homo Sapiens
TVMLLFFPV

SEQ ID NO: 317779 - protein, 9 aa, Homo Sapiens
QRLHWETPL

SEQ ID NO: 317780 - protein, 9 aa, Homo Sapiens
EDEFLVVLC

SEQ ID NO: 317781 - protein, 9 aa, Homo Sapiens
GAVTVASAS

SEQ ID NO: 317782 - protein, 9 aa, Homo Sapiens
SFAHTNCTL

SEQ ID NO: 317783 - protein, 9 aa, Homo Sapiens
MAQVNQTFE

SEQ ID NO: 317784 - protein, 9 aa, Homo Sapiens
LYHSMEWRP

SEQ ID NO: 317785 - protein, 9 aa, Homo Sapiens
ALSHKLCRK

SEQ ID NO: 317786 - protein, 9 aa, Homo Sapiens
CNVISSSSF

SEQ ID NO: 317787 - protein, 9 aa, Homo Sapiens
PKSPWHMHL

SEQ ID NO: 317788 - protein, 9 aa, Homo Sapiens
STTVTLTVA

SEQ ID NO: 317789 - protein, 9 aa, Homo Sapiens
EQITSEAED

SEQ ID NO: 317790 - protein, 9 aa, Homo Sapiens
PLPPPPASS

SEQ ID NO: 317791 - protein, 9 aa, Homo Sapiens
LTGEGLDGS

SEQ ID NO: 317792 - protein, 9 aa, Homo Sapiens
NSIGSTNAS

SEQ ID NO: 317793 - protein, 9 aa, Homo Sapiens
GSGTYSHRE

SEQ ID NO: 317794 - protein, 9 aa, Homo Sapiens
LVSLQLLIS

SEQ ID NO: 317795 - protein, 9 aa, Homo Sapiens
EESSRMEIR

SEQ ID NO: 317796 - protein, 9 aa, Homo Sapiens
DTAQFNQMT

SEQ ID NO: 317797 - protein, 9 aa, Homo Sapiens
GPPIAAAFV

SEQ ID NO: 317798 - protein, 9 aa, Homo Sapiens
ECRVLGHSV

SEQ ID NO: 317799 - protein, 9 aa, Homo Sapiens
GPELQQTGR

SEQ ID NO: 317800 - protein, 9 aa, Homo Sapiens
NLPIPLAYV

SEQ ID NO: 317801 - protein, 9 aa, Homo Sapiens
LLGKPNSGV

SEQ ID NO: 317802 - protein, 9 aa, Homo Sapiens
MQAGKPNLY

SEQ ID NO: 317803 - protein, 9 aa, Homo Sapiens
RPELLYHTD

SEQ ID NO: 317804 - protein, 9 aa, Homo Sapiens
LIKELGPML

SEQ ID NO: 317805 - protein, 9 aa, Homo Sapiens
ITQFQVDME

SEQ ID NO: 317806 - protein, 9 aa, Homo Sapiens
TWEKIYAIC

SEQ ID NO: 317807 - protein, 9 aa, Homo Sapiens
GASGSPSTW

SEQ ID NO: 317808 - protein, 9 aa, Homo Sapiens
ARTGLLPGE

SEQ ID NO: 317809 - protein, 9 aa, Homo Sapiens
FPFFTHPLL

SEQ ID NO: 317810 - protein, 9 aa, Homo Sapiens
GPSMPTLIA

SEQ ID NO: 317811 - protein, 9 aa, Homo Sapiens
SPLNGALHF

SEQ ID NO: 317812 - protein, 9 aa, Homo Sapiens
AKSEHRNFL

SEQ ID NO: 317813 - protein, 9 aa, Homo Sapiens
HKCEPSKEG

SEQ ID NO: 317814 - protein, 9 aa, Homo Sapiens
NLLIIGTTS

SEQ ID NO: 317815 - protein, 9 aa, Homo Sapiens
DTKLEKPQE

SEQ ID NO: 317816 - protein, 9 aa, Homo Sapiens
ENKARAEKR

SEQ ID NO: 317817 - protein, 9 aa, Homo Sapiens
CLYILDWRG

SEQ ID NO: 317818 - protein, 9 aa, Homo Sapiens
SGGPFGPVK

SEQ ID NO: 317819 - protein, 9 aa, Homo Sapiens
GGKEYLMWA

SEQ ID NO: 317820 - protein, 9 aa, Homo Sapiens
GRQPDSPTT

SEQ ID NO: 317821 - protein, 9 aa, Homo Sapiens
IFISFFFMY

SEQ ID NO: 317822 - protein, 9 aa, Homo Sapiens
DDDDDDKGD

SEQ ID NO: 317823 - protein, 9 aa, Homo Sapiens
LGPLTSPAV

SEQ ID NO: 317824 - protein, 9 aa, Homo Sapiens
VSSQNRTCS

SEQ ID NO: 317825 - protein, 9 aa, Homo Sapiens
KNRSPGSDP

SEQ ID NO: 317826 - protein, 9 aa, Homo Sapiens
DDIQEEDKG

SEQ ID NO: 317827 - protein, 9 aa, Homo Sapiens
MIVKCQGQQ

SEQ ID NO: 317828 - protein, 9 aa, Homo Sapiens
ASEGKHPSE

SEQ ID NO: 317829 - protein, 9 aa, Homo Sapiens
AGDVGKSAL

SEQ ID NO: 317830 - protein, 9 aa, Homo Sapiens
SMKDMHKVL

SEQ ID NO: 317831 - protein, 9 aa, Homo Sapiens
IAQSSKAEA

SEQ ID NO: 317832 - protein, 9 aa, Homo Sapiens
VVLDKSVCV

SEQ ID NO: 317833 - protein, 9 aa, Homo Sapiens
RRPPWLPAP

SEQ ID NO: 317834 - protein, 9 aa, Homo Sapiens
VYYLHHSPW

SEQ ID NO: 317835 - protein, 9 aa, Homo Sapiens
PAVPPQPQR

SEQ ID NO: 317836 - protein, 9 aa, Homo Sapiens
RNRLQADHI

SEQ ID NO: 317837 - protein, 9 aa, Homo Sapiens
WQMLACCME

SEQ ID NO: 317838 - protein, 9 aa, Homo Sapiens
PCRSLGCKR

SEQ ID NO: 317839 - protein, 9 aa, Homo Sapiens
ATENHQGTL

SEQ ID NO: 317840 - protein, 9 aa, Homo Sapiens
RKHMDRMMV

SEQ ID NO: 317841 - protein, 9 aa, Homo Sapiens
KHYGKVPYP

SEQ ID NO: 317842 - protein, 9 aa, Homo Sapiens
DVALCDIEM

SEQ ID NO: 317843 - protein, 9 aa, Homo Sapiens
IICLAREKH

SEQ ID NO: 317844 - protein, 9 aa, Homo Sapiens
ARDAALILD

SEQ ID NO: 317845 - protein, 9 aa, Homo Sapiens
RIREPQTNH

SEQ ID NO: 317846 - protein, 9 aa, Homo Sapiens
EKLCRTRGE

SEQ ID NO: 317847 - protein, 9 aa, Homo Sapiens
VNRCTLATL

SEQ ID NO: 317848 - protein, 9 aa, Homo Sapiens
SESQEKIEN

SEQ ID NO: 317849 - protein, 9 aa, Homo Sapiens
CAPSVANPV

SEQ ID NO: 317850 - protein, 9 aa, Homo Sapiens
KKRCTSSQS

SEQ ID NO: 317851 - protein, 9 aa, Homo Sapiens
LNDLMKKYE

SEQ ID NO: 317852 - protein, 9 aa, Homo Sapiens
LHERAHIEK

SEQ ID NO: 317853 - protein, 9 aa, Homo Sapiens
KSRWRKEDG

SEQ ID NO: 317854 - protein, 9 aa, Homo Sapiens
EAHMSPLFE

SEQ ID NO: 317855 - protein, 9 aa, Homo Sapiens
NKARAEKRL

SEQ ID NO: 317856 - protein, 9 aa, Homo Sapiens
LVKTWTQFR

SEQ ID NO: 317857 - protein, 9 aa, Homo Sapiens
TCLCTQVLE

SEQ ID NO: 317858 - protein, 9 aa, Homo Sapiens
KNDTIKYFK

SEQ ID NO: 317859 - protein, 9 aa, Homo Sapiens
PLKPSISPP

SEQ ID NO: 317860 - protein, 9 aa, Homo Sapiens
LKENWLLQE

SEQ ID NO: 317861 - protein, 9 aa, Homo Sapiens
GMFNLPGSL

SEQ ID NO: 317862 - protein, 9 aa, Homo Sapiens
FLKTTLFLY

SEQ ID NO: 317863 - protein, 9 aa, Homo Sapiens
EWLGRAIFI

SEQ ID NO: 317864 - protein, 9 aa, Homo Sapiens
KSQNLLVLQ

SEQ ID NO: 317865 - protein, 9 aa, Homo Sapiens
EEEWEFTAR

SEQ ID NO: 317866 - protein, 9 aa, Homo Sapiens
RLGSNPQKK

SEQ ID NO: 317867 - protein, 9 aa, Homo Sapiens
QKLLMRKAD

SEQ ID NO: 317868 - protein, 9 aa, Homo Sapiens
CEQGFPVPA

SEQ ID NO: 317869 - protein, 9 aa, Homo Sapiens
ALELKLSMR

SEQ ID NO: 317870 - protein, 9 aa, Homo Sapiens
SCCLLLELL

SEQ ID NO: 317871 - protein, 9 aa, Homo Sapiens
VETKPCASK

SEQ ID NO: 317872 - protein, 9 aa, Homo Sapiens
DDPQPSRGD

SEQ ID NO: 317873 - protein, 9 aa, Homo Sapiens
HFASVHSIS

SEQ ID NO: 317874 - protein, 9 aa, Homo Sapiens
HISRFTRLS

SEQ ID NO: 317875 - protein, 9 aa, Homo Sapiens
MQPSGSFKI

SEQ ID NO: 317876 - protein, 9 aa, Homo Sapiens
PRLDRKKCT

SEQ ID NO: 317877 - protein, 9 aa, Homo Sapiens
KNIRMMQVQ

SEQ ID NO: 317878 - protein, 9 aa, Homo Sapiens
GDVLLNIDG

SEQ ID NO: 317879 - protein, 9 aa, Homo Sapiens
GRAELILEL

SEQ ID NO: 317880 - protein, 9 aa, Homo Sapiens
IGEIATGPP

SEQ ID NO: 317881 - protein, 9 aa, Homo Sapiens
SPTPLSSPL

SEQ ID NO: 317882 - protein, 9 aa, Homo Sapiens
GVLVSLPQL

SEQ ID NO: 317883 - protein, 9 aa, Homo Sapiens
RWGPSPRGR

SEQ ID NO: 317884 - protein, 9 aa, Homo Sapiens
ANHITSVPK

SEQ ID NO: 317885 - protein, 9 aa, Homo Sapiens
AVFNPSILH

SEQ ID NO: 317886 - protein, 9 aa, Homo Sapiens
NGWQWKPQL

SEQ ID NO: 317887 - protein, 9 aa, Homo Sapiens
RLVAEHPKP

SEQ ID NO: 317888 - protein, 9 aa, Homo Sapiens
ESKADWHGL

SEQ ID NO: 317889 - protein, 9 aa, Homo Sapiens
REQAASEDV

SEQ ID NO: 317890 - protein, 9 aa, Homo Sapiens
LKCENMQPS

SEQ ID NO: 317891 - protein, 9 aa, Homo Sapiens
VGGGQKLLM

SEQ ID NO: 317892 - protein, 9 aa, Homo Sapiens
PDACKLCSC

SEQ ID NO: 317893 - protein, 9 aa, Homo Sapiens
LKRHRLLHC

SEQ ID NO: 317894 - protein, 9 aa, Homo Sapiens
QFYPLRPLQ

SEQ ID NO: 317895 - protein, 9 aa, Homo Sapiens
RLYAARKLT

SEQ ID NO: 317896 - protein, 9 aa, Homo Sapiens
LPQLRKINC

SEQ ID NO: 317897 - protein, 9 aa, Homo Sapiens
GCGGAMAEH

SEQ ID NO: 317898 - protein, 9 aa, Homo Sapiens
LALHNYLSL

SEQ ID NO: 317899 - protein, 9 aa, Homo Sapiens
LMDIFAKVL

SEQ ID NO: 317900 - protein, 9 aa, Homo Sapiens
GTQEGTRTG

SEQ ID NO: 317901 - protein, 9 aa, Homo Sapiens
ASFLRTYQT

SEQ ID NO: 317902 - protein, 9 aa, Homo Sapiens
TQQSHISSS

SEQ ID NO: 317903 - protein, 9 aa, Homo Sapiens
VKKSFETDT

SEQ ID NO: 317904 - protein, 9 aa, Homo Sapiens
GGWPEEEKL

SEQ ID NO: 317905 - protein, 9 aa, Homo Sapiens
KRAYWNTSD

SEQ ID NO: 317906 - protein, 9 aa, Homo Sapiens
IRLGSCFRF

SEQ ID NO: 317907 - protein, 9 aa, Homo Sapiens
RHGALPTSP

SEQ ID NO: 317908 - protein, 9 aa, Homo Sapiens
VCWLGLEDC

SEQ ID NO: 317909 - protein, 9 aa, Homo Sapiens
DRGRILAHQ

SEQ ID NO: 317910 - protein, 9 aa, Homo Sapiens
SWLNNFQGH

SEQ ID NO: 317911 - protein, 9 aa, Homo Sapiens
VMSVKAAMV

SEQ ID NO: 317912 - protein, 9 aa, Homo Sapiens
YGVWNTAIQ

SEQ ID NO: 317913 - protein, 9 aa, Homo Sapiens
PEQDMSLRL

SEQ ID NO: 317914 - protein, 9 aa, Homo Sapiens
SFMVSWPSR

SEQ ID NO: 317915 - protein, 9 aa, Homo Sapiens
SLTTELFNA

SEQ ID NO: 317916 - protein, 9 aa, Homo Sapiens
IETLQREAE

SEQ ID NO: 317917 - protein, 9 aa, Homo Sapiens
HTKLQKSSR

SEQ ID NO: 317918 - protein, 9 aa, Homo Sapiens
GLRNWTAAT

SEQ ID NO: 317919 - protein, 9 aa, Homo Sapiens
RGSVGCSCS

SEQ ID NO: 317920 - protein, 9 aa, Homo Sapiens
MKDMYGQVL

SEQ ID NO: 317921 - protein, 9 aa, Homo Sapiens
MAKGNPIHA

SEQ ID NO: 317922 - protein, 9 aa, Homo Sapiens
YQLLRSCSF

SEQ ID NO: 317923 - protein, 9 aa, Homo Sapiens
KKAPPQGRN

SEQ ID NO: 317924 - protein, 9 aa, Homo Sapiens
NINSDGVVQ

SEQ ID NO: 317925 - protein, 9 aa, Homo Sapiens
LSLQEIHFK

SEQ ID NO: 317926 - protein, 9 aa, Homo Sapiens
RSSGPLSLQ

SEQ ID NO: 317927 - protein, 9 aa, Homo Sapiens
YLDHNKVIE

SEQ ID NO: 317928 - protein, 9 aa, Homo Sapiens
FVVSGRLDS

SEQ ID NO: 317929 - protein, 9 aa, Homo Sapiens
LVQEGTAQI

SEQ ID NO: 317930 - protein, 9 aa, Homo Sapiens
NGALHFDET

SEQ ID NO: 317931 - protein, 9 aa, Homo Sapiens
FRQNSHLVR

SEQ ID NO: 317932 - protein, 9 aa, Homo Sapiens
DITSWYDGI

SEQ ID NO: 317933 - protein, 9 aa, Homo Sapiens
QQKPNINTV

SEQ ID NO: 317934 - protein, 9 aa, Homo Sapiens
ILHYQQALT

SEQ ID NO: 317935 - protein, 9 aa, Homo Sapiens
CHPQVCDTS

SEQ ID NO: 317936 - protein, 9 aa, Homo Sapiens
APGHRPRQD

SEQ ID NO: 317937 - protein, 9 aa, Homo Sapiens
ESGMNWQQY

SEQ ID NO: 317938 - protein, 9 aa, Homo Sapiens
PLKGCLLCT

SEQ ID NO: 317939 - protein, 9 aa, Homo Sapiens
QMSKLRLLL

SEQ ID NO: 317940 - protein, 9 aa, Homo Sapiens
GQTINDQDF

SEQ ID NO: 317941 - protein, 9 aa, Homo Sapiens
GKKLVKISE

SEQ ID NO: 317942 - protein, 9 aa, Homo Sapiens
GHTVWRVVF

SEQ ID NO: 317943 - protein, 9 aa, Homo Sapiens
DGTTLYEAL

SEQ ID NO: 317944 - protein, 9 aa, Homo Sapiens
YPEGDGNWT

SEQ ID NO: 317945 - protein, 9 aa, Homo Sapiens
SWNMVDMDL

SEQ ID NO: 317946 - protein, 9 aa, Homo Sapiens
EPYIRTGYH

SEQ ID NO: 317947 - protein, 9 aa, Homo Sapiens
GGPFGPVKL

SEQ ID NO: 317948 - protein, 9 aa, Homo Sapiens
RKEPSLLVL

SEQ ID NO: 317949 - protein, 9 aa, Homo Sapiens
SPAMEQAVQ

SEQ ID NO: 317950 - protein, 9 aa, Homo Sapiens
WMEEESQSQ

SEQ ID NO: 317951 - protein, 9 aa, Homo Sapiens
SLQKDPRNA

SEQ ID NO: 317952 - protein, 9 aa, Homo Sapiens
KPSISPPKT

SEQ ID NO: 317953 - protein, 9 aa, Homo Sapiens
ALCPDRAVD

SEQ ID NO: 317954 - protein, 9 aa, Homo Sapiens
TGYHPTGHE

SEQ ID NO: 317955 - protein, 9 aa, Homo Sapiens
RTEPRCCSG

SEQ ID NO: 317956 - protein, 9 aa, Homo Sapiens
IINFVWITI

SEQ ID NO: 317957 - protein, 9 aa, Homo Sapiens
GTAPPKQEF

SEQ ID NO: 317958 - protein, 9 aa, Homo Sapiens
TLDFVNQRT

SEQ ID NO: 317959 - protein, 9 aa, Homo Sapiens
KELDRNPED

SEQ ID NO: 317960 - protein, 9 aa, Homo Sapiens
AQKARLAEP

SEQ ID NO: 317961 - protein, 9 aa, Homo Sapiens
LTERAKKRC

SEQ ID NO: 317962 - protein, 9 aa, Homo Sapiens
AGKPNLYSY

SEQ ID NO: 317963 - protein, 9 aa, Homo Sapiens
WNMVDMDLP

SEQ ID NO: 317964 - protein, 9 aa, Homo Sapiens
LFKNFMLNQ

SEQ ID NO: 317965 - protein, 9 aa, Homo Sapiens
AYWNTSDLR

SEQ ID NO: 317966 - protein, 9 aa, Homo Sapiens
ADNCPRIPN

SEQ ID NO: 317967 - protein, 9 aa, Homo Sapiens
NFSRQSSLL

SEQ ID NO: 317968 - protein, 9 aa, Homo Sapiens
IDALKQSLV

SEQ ID NO: 317969 - protein, 9 aa, Homo Sapiens
QIPHGCILV

SEQ ID NO: 317970 - protein, 9 aa, Homo Sapiens
CYIYWTCEA

SEQ ID NO: 317971 - protein, 9 aa, Homo Sapiens
PGWQQPALA

SEQ ID NO: 317972 - protein, 9 aa, Homo Sapiens
WRQGFAVLA

SEQ ID NO: 317973 - protein, 9 aa, Homo Sapiens
GPPSPMGPP

SEQ ID NO: 317974 - protein, 9 aa, Homo Sapiens
IPCHSPGCP

SEQ ID NO: 317975 - protein, 9 aa, Homo Sapiens
GLGFRSKYS

SEQ ID NO: 317976 - protein, 9 aa, Homo Sapiens
LWRWHATPT

SEQ ID NO: 317977 - protein, 9 aa, Homo Sapiens
MELIPKEFP

SEQ ID NO: 317978 - protein, 9 aa, Homo Sapiens
SPSRSAACG

SEQ ID NO: 317979 - protein, 9 aa, Homo Sapiens
CAATGHPSP

SEQ ID NO: 317980 - protein, 9 aa, Homo Sapiens
VHRDLKTKN

SEQ ID NO: 317981 - protein, 9 aa, Homo Sapiens
DHGQPPLST

SEQ ID NO: 317982 - protein, 9 aa, Homo Sapiens
SQMGQVGEK

SEQ ID NO: 317983 - protein, 9 aa, Homo Sapiens
EKSLRKYFW

SEQ ID NO: 317984 - protein, 9 aa, Homo Sapiens
GSRPWIKNM

SEQ ID NO: 317985 - protein, 9 aa, Homo Sapiens
SHSPQEDGQ

SEQ ID NO: 317986 - protein, 9 aa, Homo Sapiens
LGCSQLQLF

SEQ ID NO: 317987 - protein, 9 aa, Homo Sapiens
VPVLRSLAF

SEQ ID NO: 317988 - protein, 9 aa, Homo Sapiens
GDCGLGTQE

SEQ ID NO: 317989 - protein, 9 aa, Homo Sapiens
ECDCHPQVC

SEQ ID NO: 317990 - protein, 9 aa, Homo Sapiens
LWTHLPNIK

SEQ ID NO: 317991 - protein, 9 aa, Homo Sapiens
PSSWLQDSC

SEQ ID NO: 317992 - protein, 9 aa, Homo Sapiens
TPEGTTPPP

SEQ ID NO: 317993 - protein, 9 aa, Homo Sapiens
LLMLFGGIP

SEQ ID NO: 317994 - protein, 9 aa, Homo Sapiens
SEHSKPPLK

SEQ ID NO: 317995 - protein, 9 aa, Homo Sapiens
LMTTLITET

SEQ ID NO: 317996 - protein, 9 aa, Homo Sapiens
TVMSSCSRR

SEQ ID NO: 317997 - protein, 9 aa, Homo Sapiens
PQSPVSLVQ

SEQ ID NO: 317998 - protein, 9 aa, Homo Sapiens
SGYALLHFL

SEQ ID NO: 317999 - protein, 9 aa, Homo Sapiens
QTGAKSEHR

SEQ ID NO: 318000 - protein, 9 aa, Homo Sapiens
PKFYFENIS

SEQ ID NO: 318001 - protein, 9 aa, Homo Sapiens
IAAAFVLAI

SEQ ID NO: 318002 - protein, 9 aa, Homo Sapiens
EPSLLVLLP

SEQ ID NO: 318003 - protein, 9 aa, Homo Sapiens
VVGAGDVGK

SEQ ID NO: 318004 - protein, 9 aa, Homo Sapiens
ASGGPFGPV

SEQ ID NO: 318005 - protein, 9 aa, Homo Sapiens
DSSESTVSR

SEQ ID NO: 318006 - protein, 9 aa, Homo Sapiens
SNGPALLCG

SEQ ID NO: 318007 - protein, 9 aa, Homo Sapiens
CRPRRGPLP

SEQ ID NO: 318008 - protein, 9 aa, Homo Sapiens
SEGADTTVS

SEQ ID NO: 318009 - protein, 9 aa, Homo Sapiens
VDMDLPPNK

SEQ ID NO: 318010 - protein, 9 aa, Homo Sapiens
QMIREELGR

SEQ ID NO: 318011 - protein, 9 aa, Homo Sapiens
CAEQCNIMR

SEQ ID NO: 318012 - protein, 9 aa, Homo Sapiens
GGESMLVVQ

SEQ ID NO: 318013 - protein, 9 aa, Homo Sapiens
QRPEQKIKD

SEQ ID NO: 318014 - protein, 9 aa, Homo Sapiens
KHLSAPELR

SEQ ID NO: 318015 - protein, 9 aa, Homo Sapiens
VAGSTTLHA

SEQ ID NO: 318016 - protein, 9 aa, Homo Sapiens
LLHHRRSHQ

SEQ ID NO: 318017 - protein, 9 aa, Homo Sapiens
APLPPPPAS

SEQ ID NO: 318018 - protein, 9 aa, Homo Sapiens
TEELVATGK

SEQ ID NO: 318019 - protein, 9 aa, Homo Sapiens
NFNKTELER

SEQ ID NO: 318020 - protein, 9 aa, Homo Sapiens
CVMGDIPME

SEQ ID NO: 318021 - protein, 9 aa, Homo Sapiens
DTSIKGMYT

SEQ ID NO: 318022 - protein, 9 aa, Homo Sapiens
PTFSSLTSI

SEQ ID NO: 318023 - protein, 9 aa, Homo Sapiens
LFASGGPFG

SEQ ID NO: 318024 - protein, 9 aa, Homo Sapiens
LSGCLAEDV

SEQ ID NO: 318025 - protein, 9 aa, Homo Sapiens
FYQGSVYPS

SEQ ID NO: 318026 - protein, 9 aa, Homo Sapiens
YLHTSETSY

SEQ ID NO: 318027 - protein, 9 aa, Homo Sapiens
SEMKQMTRW

SEQ ID NO: 318028 - protein, 9 aa, Homo Sapiens
TSLNSTFGA

SEQ ID NO: 318029 - protein, 9 aa, Homo Sapiens
EVESGPQGC

SEQ ID NO: 318030 - protein, 9 aa, Homo Sapiens
PVDYMVRNA

SEQ ID NO: 318031 - protein, 9 aa, Homo Sapiens
FLPFVAMAC

SEQ ID NO: 318032 - protein, 9 aa, Homo Sapiens
NAMAEDSDP

SEQ ID NO: 318033 - protein, 9 aa, Homo Sapiens
MHKQRGKAF

SEQ ID NO: 318034 - protein, 9 aa, Homo Sapiens
PPGTEAYIP

SEQ ID NO: 318035 - protein, 9 aa, Homo Sapiens
FWIILGDFD

SEQ ID NO: 318036 - protein, 9 aa, Homo Sapiens
HGVPPDILQ

SEQ ID NO: 318037 - protein, 9 aa, Homo Sapiens
LARFQDRMY

SEQ ID NO: 318038 - protein, 9 aa, Homo Sapiens
HATASQLFT

SEQ ID NO: 318039 - protein, 9 aa, Homo Sapiens
PEWIHMDSR

SEQ ID NO: 318040 - protein, 9 aa, Homo Sapiens
TRLSMTTIS

SEQ ID NO: 318041 - protein, 9 aa, Homo Sapiens
NKKENTLVQ

SEQ ID NO: 318042 - protein, 9 aa, Homo Sapiens
TYSTMVSPA

SEQ ID NO: 318043 - protein, 9 aa, Homo Sapiens
ESYSGAGQL

SEQ ID NO: 318044 - protein, 9 aa, Homo Sapiens
TDGLPAMAL

SEQ ID NO: 318045 - protein, 9 aa, Homo Sapiens
IYVFTTHLA

SEQ ID NO: 318046 - protein, 9 aa, Homo Sapiens
SRWRKEDGE

SEQ ID NO: 318047 - protein, 9 aa, Homo Sapiens
KNHPLGSGR

SEQ ID NO: 318048 - protein, 9 aa, Homo Sapiens
RRIAEAKGQ

SEQ ID NO: 318049 - protein, 9 aa, Homo Sapiens
VQHICAAVC

SEQ ID NO: 318050 - protein, 9 aa, Homo Sapiens
TRGEESSSN

SEQ ID NO: 318051 - protein, 9 aa, Homo Sapiens
HPPGACQAN

SEQ ID NO: 318052 - protein, 9 aa, Homo Sapiens
IVCVFQGLT

SEQ ID NO: 318053 - protein, 9 aa, Homo Sapiens
QSGHTSFFD

SEQ ID NO: 318054 - protein, 9 aa, Homo Sapiens
EDMETEVVN

SEQ ID NO: 318055 - protein, 9 aa, Homo Sapiens
PMRPVQPVV

SEQ ID NO: 318056 - protein, 9 aa, Homo Sapiens
SIPCHSPGC

SEQ ID NO: 318057 - protein, 9 aa, Homo Sapiens
ETEKDIRLS

SEQ ID NO: 318058 - protein, 9 aa, Homo Sapiens
HASSNSDPF

SEQ ID NO: 318059 - protein, 9 aa, Homo Sapiens
WNKDDRPLQ

SEQ ID NO: 318060 - protein, 9 aa, Homo Sapiens
TVNFLTTVT

SEQ ID NO: 318061 - protein, 9 aa, Homo Sapiens
TEEEWEFTA

SEQ ID NO: 318062 - protein, 9 aa, Homo Sapiens
PDSYIPDCL

SEQ ID NO: 318063 - protein, 9 aa, Homo Sapiens
HCTERPFPC

SEQ ID NO: 318064 - protein, 9 aa, Homo Sapiens
QLARRPHQQ

SEQ ID NO: 318065 - protein, 9 aa, Homo Sapiens
SLEIIHKCE

SEQ ID NO: 318066 - protein, 9 aa, Homo Sapiens
AGLETMYTG

SEQ ID NO: 318067 - protein, 9 aa, Homo Sapiens
EGGLWARKL

SEQ ID NO: 318068 - protein, 9 aa, Homo Sapiens
KLVPRSVGV

SEQ ID NO: 318069 - protein, 9 aa, Homo Sapiens
LYNDLGLGC

SEQ ID NO: 318070 - protein, 9 aa, Homo Sapiens
AELILELRP

SEQ ID NO: 318071 - protein, 9 aa, Homo Sapiens
VMLSFGKAF

SEQ ID NO: 318072 - protein, 9 aa, Homo Sapiens
AWRKTTWLE

SEQ ID NO: 318073 - protein, 9 aa, Homo Sapiens
VLVCSMAEG

SEQ ID NO: 318074 - protein, 9 aa, Homo Sapiens
RAVMGVMKP

SEQ ID NO: 318075 - protein, 9 aa, Homo Sapiens
VIQHYIGQD

SEQ ID NO: 318076 - protein, 9 aa, Homo Sapiens
YVAMVGDKV

SEQ ID NO: 318077 - protein, 9 aa, Homo Sapiens
TYSHREQSQ

SEQ ID NO: 318078 - protein, 9 aa, Homo Sapiens
PSSSAQIVC

SEQ ID NO: 318079 - protein, 9 aa, Homo Sapiens
TLSDMYPHE

SEQ ID NO: 318080 - protein, 9 aa, Homo Sapiens
GAAQFQGGG

SEQ ID NO: 318081 - protein, 9 aa, Homo Sapiens
SARVCYYQS

SEQ ID NO: 318082 - protein, 9 aa, Homo Sapiens
LEVGLVLRH

SEQ ID NO: 318083 - protein, 9 aa, Homo Sapiens
NGTKFSQSG

SEQ ID NO: 318084 - protein, 9 aa, Homo Sapiens
AQSKLMRLP

SEQ ID NO: 318085 - protein, 9 aa, Homo Sapiens
MSVYEQRIE

SEQ ID NO: 318086 - protein, 9 aa, Homo Sapiens
NHTCSYPRW

SEQ ID NO: 318087 - protein, 9 aa, Homo Sapiens
QAVCKPLEA

SEQ ID NO: 318088 - protein, 9 aa, Homo Sapiens
ASRSWKLIL

SEQ ID NO: 318089 - protein, 9 aa, Homo Sapiens
SCSPRTTTP

SEQ ID NO: 318090 - protein, 9 aa, Homo Sapiens
AQALDTQPR

SEQ ID NO: 318091 - protein, 9 aa, Homo Sapiens
KSHHHRHHR

SEQ ID NO: 318092 - protein, 9 aa, Homo Sapiens
MKVHGHSPP

SEQ ID NO: 318093 - protein, 9 aa, Homo Sapiens
GSFLVCFIS

SEQ ID NO: 318094 - protein, 9 aa, Homo Sapiens
TATTGQGKS

SEQ ID NO: 318095 - protein, 9 aa, Homo Sapiens
HSCRLAGMG

SEQ ID NO: 318096 - protein, 9 aa, Homo Sapiens
DPTSYAPDA

SEQ ID NO: 318097 - protein, 9 aa, Homo Sapiens
SQSVVLHHH

SEQ ID NO: 318098 - protein, 9 aa, Homo Sapiens
LIIAQVQVS

SEQ ID NO: 318099 - protein, 9 aa, Homo Sapiens
GSHASSNSD

SEQ ID NO: 318100 - protein, 9 aa, Homo Sapiens
DPCVITRKP

SEQ ID NO: 318101 - protein, 9 aa, Homo Sapiens
EEMLMEREH

SEQ ID NO: 318102 - protein, 9 aa, Homo Sapiens
FLKMRLSKS

SEQ ID NO: 318103 - protein, 9 aa, Homo Sapiens
PMLPGNARK

SEQ ID NO: 318104 - protein, 9 aa, Homo Sapiens
HSISAEGTV

SEQ ID NO: 318105 - protein, 9 aa, Homo Sapiens
AGDWFVCLE

SEQ ID NO: 318106 - protein, 9 aa, Homo Sapiens
PRTLPCRPY

SEQ ID NO: 318107 - protein, 9 aa, Homo Sapiens
IKCIFTQFW

SEQ ID NO: 318108 - protein, 9 aa, Homo Sapiens
WAWILQDVL

SEQ ID NO: 318109 - protein, 9 aa, Homo Sapiens
GNGQDAYAS

SEQ ID NO: 318110 - protein, 9 aa, Homo Sapiens
APKKTLLKC

SEQ ID NO: 318111 - protein, 9 aa, Homo Sapiens
TPTGVIVFE

SEQ ID NO: 318112 - protein, 9 aa, Homo Sapiens
QGQQEITNR

SEQ ID NO: 318113 - protein, 9 aa, Homo Sapiens
GGIVGAVTV

SEQ ID NO: 318114 - protein, 9 aa, Homo Sapiens
QTVRLMEAP

SEQ ID NO: 318115 - protein, 9 aa, Homo Sapiens
TRNILNPFK

SEQ ID NO: 318116 - protein, 9 aa, Homo Sapiens
EFEEWMEEE

SEQ ID NO: 318117 - protein, 9 aa, Homo Sapiens
VGAVTVASA

SEQ ID NO: 318118 - protein, 9 aa, Homo Sapiens
RIAQASRRE

SEQ ID NO: 318119 - protein, 9 aa, Homo Sapiens
QKHLRTHQV

SEQ ID NO: 318120 - protein, 9 aa, Homo Sapiens
ASQQKAMNT

SEQ ID NO: 318121 - protein, 9 aa, Homo Sapiens
DKKGKDRYC

SEQ ID NO: 318122 - protein, 9 aa, Homo Sapiens
VSVAPSADT

SEQ ID NO: 318123 - protein, 9 aa, Homo Sapiens
PGSLYVTSQ

SEQ ID NO: 318124 - protein, 9 aa, Homo Sapiens
MVKQGYVKI

SEQ ID NO: 318125 - protein, 9 aa, Homo Sapiens
GGLPQFYPL

SEQ ID NO: 318126 - protein, 9 aa, Homo Sapiens
EMLLGYTAA

SEQ ID NO: 318127 - protein, 9 aa, Homo Sapiens
LMLFSNVPI

SEQ ID NO: 318128 - protein, 9 aa, Homo Sapiens
SAEAVVVDI

SEQ ID NO: 318129 - protein, 9 aa, Homo Sapiens
YHSMEWRPA

SEQ ID NO: 318130 - protein, 9 aa, Homo Sapiens
KGEPKHYLH

SEQ ID NO: 318131 - protein, 9 aa, Homo Sapiens
SRETLLHQL

SEQ ID NO: 318132 - protein, 9 aa, Homo Sapiens
YNSKLSWHQ

SEQ ID NO: 318133 - protein, 9 aa, Homo Sapiens
LVSLNLGFK

SEQ ID NO: 318134 - protein, 9 aa, Homo Sapiens
DDERYWPAG

SEQ ID NO: 318135 - protein, 9 aa, Homo Sapiens
TPRRRWAPW

SEQ ID NO: 318136 - protein, 9 aa, Homo Sapiens
KYVKALFRC

SEQ ID NO: 318137 - protein, 9 aa, Homo Sapiens
RTCSFGHFP

SEQ ID NO: 318138 - protein, 9 aa, Homo Sapiens
IIPSYVSWF

SEQ ID NO: 318139 - protein, 9 aa, Homo Sapiens
RRFWQACDM

SEQ ID NO: 318140 - protein, 9 aa, Homo Sapiens
YCMSLTSST

SEQ ID NO: 318141 - protein, 9 aa, Homo Sapiens
EKFHMWPAS

SEQ ID NO: 318142 - protein, 9 aa, Homo Sapiens
FLNRVAATF

SEQ ID NO: 318143 - protein, 9 aa, Homo Sapiens
VGCSCSMVV

SEQ ID NO: 318144 - protein, 9 aa, Homo Sapiens
SPLQLPPMS

SEQ ID NO: 318145 - protein, 9 aa, Homo Sapiens
MSQACAEQC

SEQ ID NO: 318146 - protein, 9 aa, Homo Sapiens
SVARYNFAA

SEQ ID NO: 318147 - protein, 9 aa, Homo Sapiens
VKKTTLLTL

SEQ ID NO: 318148 - protein, 9 aa, Homo Sapiens
KHSIQNRIV

SEQ ID NO: 318149 - protein, 9 aa, Homo Sapiens
IIINFVWIT

SEQ ID NO: 318150 - protein, 9 aa, Homo Sapiens
LEGGLPQFY

SEQ ID NO: 318151 - protein, 9 aa, Homo Sapiens
GHRPRQDSE

SEQ ID NO: 318152 - protein, 9 aa, Homo Sapiens
IQAPACSST

SEQ ID NO: 318153 - protein, 9 aa, Homo Sapiens
QLPGRQPQV

SEQ ID NO: 318154 - protein, 9 aa, Homo Sapiens
TVIISDLRS

SEQ ID NO: 318155 - protein, 9 aa, Homo Sapiens
YKIGPSSHF

SEQ ID NO: 318156 - protein, 9 aa, Homo Sapiens
FSAPDACKL

SEQ ID NO: 318157 - protein, 9 aa, Homo Sapiens
LKSITMLRN

SEQ ID NO: 318158 - protein, 9 aa, Homo Sapiens
WFVCLEKTL

SEQ ID NO: 318159 - protein, 9 aa, Homo Sapiens
PCPVCGHVY

SEQ ID NO: 318160 - protein, 9 aa, Homo Sapiens
SRPRKSHHH

SEQ ID NO: 318161 - protein, 9 aa, Homo Sapiens
TQSSGSWAS

SEQ ID NO: 318162 - protein, 9 aa, Homo Sapiens
YGGHLCLPR

SEQ ID NO: 318163 - protein, 9 aa, Homo Sapiens
GQQQLQVQH

SEQ ID NO: 318164 - protein, 9 aa, Homo Sapiens
ACTNNGTCN

SEQ ID NO: 318165 - protein, 9 aa, Homo Sapiens
PEEICDARH

SEQ ID NO: 318166 - protein, 9 aa, Homo Sapiens
CGHLHMVNP

SEQ ID NO: 318167 - protein, 9 aa, Homo Sapiens
QACDPKTLV

SEQ ID NO: 318168 - protein, 9 aa, Homo Sapiens
DAYSPAWCS

SEQ ID NO: 318169 - protein, 9 aa, Homo Sapiens
RVAQADLKL

SEQ ID NO: 318170 - protein, 9 aa, Homo Sapiens
YIETLQREA

SEQ ID NO: 318171 - protein, 9 aa, Homo Sapiens
CCSATEIMA

SEQ ID NO: 318172 - protein, 9 aa, Homo Sapiens
HLATHVEPG

SEQ ID NO: 318173 - protein, 9 aa, Homo Sapiens
SELLSIAAQ

SEQ ID NO: 318174 - protein, 9 aa, Homo Sapiens
LTIIVFIFA

SEQ ID NO: 318175 - protein, 9 aa, Homo Sapiens
CVHLCACVC

SEQ ID NO: 318176 - protein, 9 aa, Homo Sapiens
CSLYGKKLV

SEQ ID NO: 318177 - protein, 9 aa, Homo Sapiens
SSPGGRVLM

SEQ ID NO: 318178 - protein, 9 aa, Homo Sapiens
MWAHFGLPS

SEQ ID NO: 318179 - protein, 9 aa, Homo Sapiens
TPGMFNLPG

SEQ ID NO: 318180 - protein, 9 aa, Homo Sapiens
RRKYRYGMG

SEQ ID NO: 318181 - protein, 9 aa, Homo Sapiens
YGSENGEED

SEQ ID NO: 318182 - protein, 9 aa, Homo Sapiens
TNQIEEGER

SEQ ID NO: 318183 - protein, 9 aa, Homo Sapiens
QQLQVQHLS

SEQ ID NO: 318184 - protein, 9 aa, Homo Sapiens
AQVQSNPDP

SEQ ID NO: 318185 - protein, 9 aa, Homo Sapiens
RKPTTISID

SEQ ID NO: 318186 - protein, 9 aa, Homo Sapiens
GWGSQATGP

SEQ ID NO: 318187 - protein, 9 aa, Homo Sapiens
MAVNEPLKT

SEQ ID NO: 318188 - protein, 9 aa, Homo Sapiens
QAQIIWECA

SEQ ID NO: 318189 - protein, 9 aa, Homo Sapiens
CFACNKFGT

SEQ ID NO: 318190 - protein, 9 aa, Homo Sapiens
EKFNKRAEM

SEQ ID NO: 318191 - protein, 9 aa, Homo Sapiens
AQLKERRQE

SEQ ID NO: 318192 - protein, 9 aa, Homo Sapiens
KDLWSSNED

SEQ ID NO: 318193 - protein, 9 aa, Homo Sapiens
PQVCDTSTH

SEQ ID NO: 318194 - protein, 9 aa, Homo Sapiens
QAVSNVIQQ

SEQ ID NO: 318195 - protein, 9 aa, Homo Sapiens
LGSWQEQLA

SEQ ID NO: 318196 - protein, 9 aa, Homo Sapiens
KHRSPMPGS

SEQ ID NO: 318197 - protein, 9 aa, Homo Sapiens
HWGTPWGRQ

SEQ ID NO: 318198 - protein, 9 aa, Homo Sapiens
PKFRPGPQW

SEQ ID NO: 318199 - protein, 9 aa, Homo Sapiens
KGFSNRAQK

SEQ ID NO: 318200 - protein, 9 aa, Homo Sapiens
RGLKSKEQM

SEQ ID NO: 318201 - protein, 9 aa, Homo Sapiens
YKGRVALRD

SEQ ID NO: 318202 - protein, 9 aa, Homo Sapiens
GFEKLCRTR

SEQ ID NO: 318203 - protein, 9 aa, Homo Sapiens
IKRNQLLPG

SEQ ID NO: 318204 - protein, 9 aa, Homo Sapiens
NRRATATTG

SEQ ID NO: 318205 - protein, 9 aa, Homo Sapiens
ETIYFIASV

SEQ ID NO: 318206 - protein, 9 aa, Homo Sapiens
KVSCYLDWI

SEQ ID NO: 318207 - protein, 9 aa, Homo Sapiens
DLSGLSPRL

SEQ ID NO: 318208 - protein, 9 aa, Homo Sapiens
PVCEGTRVA

SEQ ID NO: 318209 - protein, 9 aa, Homo Sapiens
VAWAMTNYI

SEQ ID NO: 318210 - protein, 9 aa, Homo Sapiens
LVCSMAEGT

SEQ ID NO: 318211 - protein, 9 aa, Homo Sapiens
AEDSDPFAK

SEQ ID NO: 318212 - protein, 9 aa, Homo Sapiens
CQGHMNVLE

SEQ ID NO: 318213 - protein, 9 aa, Homo Sapiens
PNKARDRSQ

SEQ ID NO: 318214 - protein, 9 aa, Homo Sapiens
AGSPHGSPL

SEQ ID NO: 318215 - protein, 9 aa, Homo Sapiens
NCSNNKITD

SEQ ID NO: 318216 - protein, 9 aa, Homo Sapiens
VWPPGDEEE

SEQ ID NO: 318217 - protein, 9 aa, Homo Sapiens
KAPKKTLLK

SEQ ID NO: 318218 - protein, 9 aa, Homo Sapiens
ATATMKFLS

SEQ ID NO: 318219 - protein, 9 aa, Homo Sapiens
VIISDLRSR

SEQ ID NO: 318220 - protein, 9 aa, Homo Sapiens
MKSCWHWRE

SEQ ID NO: 318221 - protein, 9 aa, Homo Sapiens
DEKWDFIAS

SEQ ID NO: 318222 - protein, 9 aa, Homo Sapiens
IYERLTWTT

SEQ ID NO: 318223 - protein, 9 aa, Homo Sapiens
AWDLELSEE

SEQ ID NO: 318224 - protein, 9 aa, Homo Sapiens
APPSGHGCS

SEQ ID NO: 318225 - protein, 9 aa, Homo Sapiens
GVVYGDVPD

SEQ ID NO: 318226 - protein, 9 aa, Homo Sapiens
HLHLSLNEE

SEQ ID NO: 318227 - protein, 9 aa, Homo Sapiens
HEDTDCPCM

SEQ ID NO: 318228 - protein, 9 aa, Homo Sapiens
ASSSCRQQS

SEQ ID NO: 318229 - protein, 9 aa, Homo Sapiens
WRVYHLISI

SEQ ID NO: 318230 - protein, 9 aa, Homo Sapiens
AEGNEIYED

SEQ ID NO: 318231 - protein, 9 aa, Homo Sapiens
GAKPPIAPA

SEQ ID NO: 318232 - protein, 9 aa, Homo Sapiens
VSPGMLSIG

SEQ ID NO: 318233 - protein, 9 aa, Homo Sapiens
AQPDLRQWL

SEQ ID NO: 318234 - protein, 9 aa, Homo Sapiens
KDVVWTDVF

SEQ ID NO: 318235 - protein, 9 aa, Homo Sapiens
FRMVLQKLS

SEQ ID NO: 318236 - protein, 9 aa, Homo Sapiens
PKAPIHVRN

SEQ ID NO: 318237 - protein, 9 aa, Homo Sapiens
YIAPEVIFH

SEQ ID NO: 318238 - protein, 9 aa, Homo Sapiens
SVQYFLIDA

SEQ ID NO: 318239 - protein, 9 aa, Homo Sapiens
IKESVCGQD

SEQ ID NO: 318240 - protein, 9 aa, Homo Sapiens
FVTVKNDTI

SEQ ID NO: 318241 - protein, 9 aa, Homo Sapiens
LLTKGKAKS

SEQ ID NO: 318242 - protein, 9 aa, Homo Sapiens
HIQQFDDDE

SEQ ID NO: 318243 - protein, 9 aa, Homo Sapiens
KRAEMQMPW

SEQ ID NO: 318244 - protein, 9 aa, Homo Sapiens
DNAGIYKCV

SEQ ID NO: 318245 - protein, 9 aa, Homo Sapiens
QPPLSTTVT

SEQ ID NO: 318246 - protein, 9 aa, Homo Sapiens
DYTYLQINF

SEQ ID NO: 318247 - protein, 9 aa, Homo Sapiens
SSLWNELDS

SEQ ID NO: 318248 - protein, 9 aa, Homo Sapiens
VLIPQIARV

SEQ ID NO: 318249 - protein, 9 aa, Homo Sapiens
CVQFLHGEA

SEQ ID NO: 318250 - protein, 9 aa, Homo Sapiens
YQTRLPLCS

SEQ ID NO: 318251 - protein, 9 aa, Homo Sapiens
ENTVMVALA

SEQ ID NO: 318252 - protein, 9 aa, Homo Sapiens
AVGAALREW

SEQ ID NO: 318253 - protein, 9 aa, Homo Sapiens
YRRYKHVDW

SEQ ID NO: 318254 - protein, 9 aa, Homo Sapiens
VVIVPAQRI

SEQ ID NO: 318255 - protein, 9 aa, Homo Sapiens
QFSHPGPQS

SEQ ID NO: 318256 - protein, 9 aa, Homo Sapiens
DAKRLCVMG

SEQ ID NO: 318257 - protein, 9 aa, Homo Sapiens
PEHIDPFTH

SEQ ID NO: 318258 - protein, 9 aa, Homo Sapiens
ANFNKTELE

SEQ ID NO: 318259 - protein, 9 aa, Homo Sapiens
PMLQRNALY

SEQ ID NO: 318260 - protein, 9 aa, Homo Sapiens
DLTNFLVRC

SEQ ID NO: 318261 - protein, 9 aa, Homo Sapiens
TYKSCRRSY

SEQ ID NO: 318262 - protein, 9 aa, Homo Sapiens
AHANGWVQY

SEQ ID NO: 318263 - protein, 9 aa, Homo Sapiens
RIKTSQANF

SEQ ID NO: 318264 - protein, 9 aa, Homo Sapiens
LIPQIARVC

SEQ ID NO: 318265 - protein, 9 aa, Homo Sapiens
LTMLENVKK

SEQ ID NO: 318266 - protein, 9 aa, Homo Sapiens
CSLNCVDGS

SEQ ID NO: 318267 - protein, 9 aa, Homo Sapiens
LQNLMAAEV

SEQ ID NO: 318268 - protein, 9 aa, Homo Sapiens
LSHDSAATS

SEQ ID NO: 318269 - protein, 9 aa, Homo Sapiens
KMDYFSQFG

SEQ ID NO: 318270 - protein, 9 aa, Homo Sapiens
MRGRLYWKF

SEQ ID NO: 318271 - protein, 9 aa, Homo Sapiens
PLQADLHAQ

SEQ ID NO: 318272 - protein, 9 aa, Homo Sapiens
LKELARFQD

SEQ ID NO: 318273 - protein, 9 aa, Homo Sapiens
LQPERPGDT

SEQ ID NO: 318274 - protein, 9 aa, Homo Sapiens
RRGAGAAHL

SEQ ID NO: 318275 - protein, 9 aa, Homo Sapiens
EEWMEEESQ

SEQ ID NO: 318276 - protein, 9 aa, Homo Sapiens
SHASSNSDP

SEQ ID NO: 318277 - protein, 9 aa, Homo Sapiens
PASEPAAQA

SEQ ID NO: 318278 - protein, 9 aa, Homo Sapiens
LLATVTVPL

SEQ ID NO: 318279 - protein, 9 aa, Homo Sapiens
IMLFKNFML

SEQ ID NO: 318280 - protein, 9 aa, Homo Sapiens
KKTKMVLRM

SEQ ID NO: 318281 - protein, 9 aa, Homo Sapiens
QDMSPVFVG

SEQ ID NO: 318282 - protein, 9 aa, Homo Sapiens
RTVPVATTL

SEQ ID NO: 318283 - protein, 9 aa, Homo Sapiens
EAQTLFREQ

SEQ ID NO: 318284 - protein, 9 aa, Homo Sapiens
GPPIFTLNI

SEQ ID NO: 318285 - protein, 9 aa, Homo Sapiens
MTPEQIVWL

SEQ ID NO: 318286 - protein, 9 aa, Homo Sapiens
HMSIMISVF

SEQ ID NO: 318287 - protein, 9 aa, Homo Sapiens
SPSSSTGSM

SEQ ID NO: 318288 - protein, 9 aa, Homo Sapiens
EVGWGDVPI

SEQ ID NO: 318289 - protein, 9 aa, Homo Sapiens
SLQLLISCC

SEQ ID NO: 318290 - protein, 9 aa, Homo Sapiens
EMSSILCHC

SEQ ID NO: 318291 - protein, 9 aa, Homo Sapiens
IFTFPKAPF

SEQ ID NO: 318292 - protein, 9 aa, Homo Sapiens
ADRLGSSKV

SEQ ID NO: 318293 - protein, 9 aa, Homo Sapiens
IFQMTLIAA

SEQ ID NO: 318294 - protein, 9 aa, Homo Sapiens
RYQLQHGVV

SEQ ID NO: 318295 - protein, 9 aa, Homo Sapiens
HTSTVHCMH

SEQ ID NO: 318296 - protein, 9 aa, Homo Sapiens
SRMRLDPVL

SEQ ID NO: 318297 - protein, 9 aa, Homo Sapiens
SQIPEKMQT

SEQ ID NO: 318298 - protein, 9 aa, Homo Sapiens
ITLDFVNQR

SEQ ID NO: 318299 - protein, 9 aa, Homo Sapiens
EGDNLQKST

SEQ ID NO: 318300 - protein, 9 aa, Homo Sapiens
VCVHLCACV

SEQ ID NO: 318301 - protein, 9 aa, Homo Sapiens
SVGCSCSMV

SEQ ID NO: 318302 - protein, 9 aa, Homo Sapiens
DKSESQEKI

SEQ ID NO: 318303 - protein, 9 aa, Homo Sapiens
INGSRASPD

SEQ ID NO: 318304 - protein, 9 aa, Homo Sapiens
VANYEPEEE

SEQ ID NO: 318305 - protein, 9 aa, Homo Sapiens
RARPGTCAA

SEQ ID NO: 318306 - protein, 9 aa, Homo Sapiens
NVLFLVTWR

SEQ ID NO: 318307 - protein, 9 aa, Homo Sapiens
CDSHSPQED

SEQ ID NO: 318308 - protein, 9 aa, Homo Sapiens
GLLTLWAKP

SEQ ID NO: 318309 - protein, 9 aa, Homo Sapiens
AYFQMRRTL

SEQ ID NO: 318310 - protein, 9 aa, Homo Sapiens
GAFTKVITK

SEQ ID NO: 318311 - protein, 9 aa, Homo Sapiens
SKTRNILNP

SEQ ID NO: 318312 - protein, 9 aa, Homo Sapiens
LLRELCITQ

SEQ ID NO: 318313 - protein, 9 aa, Homo Sapiens
FLGRAGSPH

SEQ ID NO: 318314 - protein, 9 aa, Homo Sapiens
ESCTVRPDA

SEQ ID NO: 318315 - protein, 9 aa, Homo Sapiens
KSESQEKIE

SEQ ID NO: 318316 - protein, 9 aa, Homo Sapiens
LTSPAVSVL

SEQ ID NO: 318317 - protein, 9 aa, Homo Sapiens
NSLCVNGFT

SEQ ID NO: 318318 - protein, 9 aa, Homo Sapiens
GMALPTVSP

SEQ ID NO: 318319 - protein, 9 aa, Homo Sapiens
AACGGRERR

SEQ ID NO: 318320 - protein, 9 aa, Homo Sapiens
GCILVMGNI

SEQ ID NO: 318321 - protein, 9 aa, Homo Sapiens
HRDLKTKNL

SEQ ID NO: 318322 - protein, 9 aa, Homo Sapiens
LSAASGLAY

SEQ ID NO: 318323 - protein, 9 aa, Homo Sapiens
VNSWPNESP

SEQ ID NO: 318324 - protein, 9 aa, Homo Sapiens
LQHQDSEIL

SEQ ID NO: 318325 - protein, 9 aa, Homo Sapiens
CPRIPNSDQ

SEQ ID NO: 318326 - protein, 9 aa, Homo Sapiens
ITLGNVFVI

SEQ ID NO: 318327 - protein, 9 aa, Homo Sapiens
RPDGNGFSL

SEQ ID NO: 318328 - protein, 9 aa, Homo Sapiens
KEELQVFQG

SEQ ID NO: 318329 - protein, 9 aa, Homo Sapiens
QSSCHILWA

SEQ ID NO: 318330 - protein, 9 aa, Homo Sapiens
AIDLHEAVS

SEQ ID NO: 318331 - protein, 9 aa, Homo Sapiens
SLTISSPFA

SEQ ID NO: 318332 - protein, 9 aa, Homo Sapiens
NQVVMANSD

SEQ ID NO: 318333 - protein, 9 aa, Homo Sapiens
NVPDFILMG

SEQ ID NO: 318334 - protein, 9 aa, Homo Sapiens
WPEEEKLLG

SEQ ID NO: 318335 - protein, 9 aa, Homo Sapiens
DGSVDKRKL

SEQ ID NO: 318336 - protein, 9 aa, Homo Sapiens
GKGYGSENG

SEQ ID NO: 318337 - protein, 9 aa, Homo Sapiens
LEDLWRRHR

SEQ ID NO: 318338 - protein, 9 aa, Homo Sapiens
RCRPRRGPL

SEQ ID NO: 318339 - protein, 9 aa, Homo Sapiens
VQTSTIPEE

SEQ ID NO: 318340 - protein, 9 aa, Homo Sapiens
AWLVVDSIM

SEQ ID NO: 318341 - protein, 9 aa, Homo Sapiens
YLGHAVLMQ

SEQ ID NO: 318342 - protein, 9 aa, Homo Sapiens
AGWGSQATG

SEQ ID NO: 318343 - protein, 9 aa, Homo Sapiens
YQDQNKYKE

SEQ ID NO: 318344 - protein, 9 aa, Homo Sapiens
VAELLQDQQ

SEQ ID NO: 318345 - protein, 9 aa, Homo Sapiens
RLQGLLEML

SEQ ID NO: 318346 - protein, 9 aa, Homo Sapiens
VPAQRIPRQ

SEQ ID NO: 318347 - protein, 9 aa, Homo Sapiens
KPDIMHHIS

SEQ ID NO: 318348 - protein, 9 aa, Homo Sapiens
CTEEGKWSL

SEQ ID NO: 318349 - protein, 9 aa, Homo Sapiens
SLCEWQPIG

SEQ ID NO: 318350 - protein, 9 aa, Homo Sapiens
WPASTCPLP

SEQ ID NO: 318351 - protein, 9 aa, Homo Sapiens
FFTHPLLSK

SEQ ID NO: 318352 - protein, 9 aa, Homo Sapiens
LVRWGKYGA

SEQ ID NO: 318353 - protein, 9 aa, Homo Sapiens
KHWIFISFF

SEQ ID NO: 318354 - protein, 9 aa, Homo Sapiens
DGVGPLLTK

SEQ ID NO: 318355 - protein, 9 aa, Homo Sapiens
WRPLGSWQE

SEQ ID NO: 318356 - protein, 9 aa, Homo Sapiens
GDLLQGVLD

SEQ ID NO: 318357 - protein, 9 aa, Homo Sapiens
CQATGPTDI

SEQ ID NO: 318358 - protein, 9 aa, Homo Sapiens
PDPPQGLWV

SEQ ID NO: 318359 - protein, 9 aa, Homo Sapiens
STNSPATLK

SEQ ID NO: 318360 - protein, 9 aa, Homo Sapiens
GLQKKLHTE

SEQ ID NO: 318361 - protein, 9 aa, Homo Sapiens
PIMLSASPR

SEQ ID NO: 318362 - protein, 9 aa, Homo Sapiens
FYTSTAEES

SEQ ID NO: 318363 - protein, 9 aa, Homo Sapiens
DYYSSYFGI

SEQ ID NO: 318364 - protein, 9 aa, Homo Sapiens
HITSVPKDS

SEQ ID NO: 318365 - protein, 9 aa, Homo Sapiens
MVKVVIIPP

SEQ ID NO: 318366 - protein, 9 aa, Homo Sapiens
HQMGQSKQS

SEQ ID NO: 318367 - protein, 9 aa, Homo Sapiens
RGGAPGTKR

SEQ ID NO: 318368 - protein, 9 aa, Homo Sapiens
LRELCITQF

SEQ ID NO: 318369 - protein, 9 aa, Homo Sapiens
RPSGGRPGG

SEQ ID NO: 318370 - protein, 9 aa, Homo Sapiens
WQACDMVHH

SEQ ID NO: 318371 - protein, 9 aa, Homo Sapiens
VFDILSPLE

SEQ ID NO: 318372 - protein, 9 aa, Homo Sapiens
GRERRDRRP

SEQ ID NO: 318373 - protein, 9 aa, Homo Sapiens
WAPRGRVAN

SEQ ID NO: 318374 - protein, 9 aa, Homo Sapiens
WRRHREQER

SEQ ID NO: 318375 - protein, 9 aa, Homo Sapiens
AYGMVSLAY

SEQ ID NO: 318376 - protein, 9 aa, Homo Sapiens
HDDTRVHTD

SEQ ID NO: 318377 - protein, 9 aa, Homo Sapiens
RHWGTPWGR

SEQ ID NO: 318378 - protein, 9 aa, Homo Sapiens
PRRDYHSLR

SEQ ID NO: 318379 - protein, 9 aa, Homo Sapiens
TVEFNQVVM

SEQ ID NO: 318380 - protein, 9 aa, Homo Sapiens
PVPWSQPNP

SEQ ID NO: 318381 - protein, 9 aa, Homo Sapiens
LSKFDLHEE

SEQ ID NO: 318382 - protein, 9 aa, Homo Sapiens
KAQTGLSLH

SEQ ID NO: 318383 - protein, 9 aa, Homo Sapiens
WRKTTWLEG

SEQ ID NO: 318384 - protein, 9 aa, Homo Sapiens
GRQVTYHVI

SEQ ID NO: 318385 - protein, 9 aa, Homo Sapiens
QALDTQPRP

SEQ ID NO: 318386 - protein, 9 aa, Homo Sapiens
QRPQSPQRL

SEQ ID NO: 318387 - protein, 9 aa, Homo Sapiens
KPNPENTGS

SEQ ID NO: 318388 - protein, 9 aa, Homo Sapiens
SFLVCFISR

SEQ ID NO: 318389 - protein, 9 aa, Homo Sapiens
FQQDTLTWN

SEQ ID NO: 318390 - protein, 9 aa, Homo Sapiens
HVANEVTLN

SEQ ID NO: 318391 - protein, 9 aa, Homo Sapiens
KDKFRFYDE

SEQ ID NO: 318392 - protein, 9 aa, Homo Sapiens
KVIQHYIGQ

SEQ ID NO: 318393 - protein, 9 aa, Homo Sapiens
QPLPPSSWL

SEQ ID NO: 318394 - protein, 9 aa, Homo Sapiens
AAECYRLHL

SEQ ID NO: 318395 - protein, 9 aa, Homo Sapiens
RKWMGTQFG

SEQ ID NO: 318396 - protein, 9 aa, Homo Sapiens
WYAPVPCGS

SEQ ID NO: 318397 - protein, 9 aa, Homo Sapiens
THRVMRANK

SEQ ID NO: 318398 - protein, 9 aa, Homo Sapiens
RGRQDPTSY

SEQ ID NO: 318399 - protein, 9 aa, Homo Sapiens
QRELSRISR

SEQ ID NO: 318400 - protein, 9 aa, Homo Sapiens
SDDTPMVRW

SEQ ID NO: 318401 - protein, 9 aa, Homo Sapiens
NFQGHYDGN

SEQ ID NO: 318402 - protein, 9 aa, Homo Sapiens
IIISMVSSG

SEQ ID NO: 318403 - protein, 9 aa, Homo Sapiens
SRGDDLGAQ

SEQ ID NO: 318404 - protein, 9 aa, Homo Sapiens
LSLTTELFN

SEQ ID NO: 318405 - protein, 9 aa, Homo Sapiens
GEATATDAK

SEQ ID NO: 318406 - protein, 9 aa, Homo Sapiens
HASYSIFQK

SEQ ID NO: 318407 - protein, 9 aa, Homo Sapiens
SLGKYIFTS

SEQ ID NO: 318408 - protein, 9 aa, Homo Sapiens
SSVNEVNVD

SEQ ID NO: 318409 - protein, 9 aa, Homo Sapiens
DLKDRQPLR

SEQ ID NO: 318410 - protein, 9 aa, Homo Sapiens
HTKGPKFYF

SEQ ID NO: 318411 - protein, 9 aa, Homo Sapiens
FRSKYSFIP

SEQ ID NO: 318412 - protein, 9 aa, Homo Sapiens
VQCAMADPY

SEQ ID NO: 318413 - protein, 9 aa, Homo Sapiens
KESYSMYVY

SEQ ID NO: 318414 - protein, 9 aa, Homo Sapiens
SAACGGRER

SEQ ID NO: 318415 - protein, 9 aa, Homo Sapiens
DGSLDMQPK

SEQ ID NO: 318416 - protein, 9 aa, Homo Sapiens
LSPTLRYTF

SEQ ID NO: 318417 - protein, 9 aa, Homo Sapiens
SCRQRLEEA

SEQ ID NO: 318418 - protein, 9 aa, Homo Sapiens
KVRRSLLTY

SEQ ID NO: 318419 - protein, 9 aa, Homo Sapiens
LHEVPHEVR

SEQ ID NO: 318420 - protein, 9 aa, Homo Sapiens
HGPKGEPGR

SEQ ID NO: 318421 - protein, 9 aa, Homo Sapiens
DPRDLKRCN

SEQ ID NO: 318422 - protein, 9 aa, Homo Sapiens
NIHLYAEAA

SEQ ID NO: 318423 - protein, 9 aa, Homo Sapiens
SLGFTLRWS

SEQ ID NO: 318424 - protein, 9 aa, Homo Sapiens
WKKGLSLSY

SEQ ID NO: 318425 - protein, 9 aa, Homo Sapiens
SPIGMPLSS

SEQ ID NO: 318426 - protein, 9 aa, Homo Sapiens
IIAKAFGLQ

SEQ ID NO: 318427 - protein, 9 aa, Homo Sapiens
LVTWRGVEG

SEQ ID NO: 318428 - protein, 9 aa, Homo Sapiens
YKHVDWLYN

SEQ ID NO: 318429 - protein, 9 aa, Homo Sapiens
LMTCSNVRC

SEQ ID NO: 318430 - protein, 9 aa, Homo Sapiens
HSAQDAAQI

SEQ ID NO: 318431 - protein, 9 aa, Homo Sapiens
HQAGFEKLC

SEQ ID NO: 318432 - protein, 9 aa, Homo Sapiens
RSHSHRRQG

SEQ ID NO: 318433 - protein, 9 aa, Homo Sapiens
ALCDQDNLS

SEQ ID NO: 318434 - protein, 9 aa, Homo Sapiens
RPGPAGHLT

SEQ ID NO: 318435 - protein, 9 aa, Homo Sapiens
ACPSETEKD

SEQ ID NO: 318436 - protein, 9 aa, Homo Sapiens
GGTCEVRAA

SEQ ID NO: 318437 - protein, 9 aa, Homo Sapiens
VCIVSMDKA

SEQ ID NO: 318438 - protein, 9 aa, Homo Sapiens
ERAYVRDLH

SEQ ID NO: 318439 - protein, 9 aa, Homo Sapiens
MNVAAKYHM

SEQ ID NO: 318440 - protein, 9 aa, Homo Sapiens
RHKVQDARD

SEQ ID NO: 318441 - protein, 9 aa, Homo Sapiens
DLWRRHREQ

SEQ ID NO: 318442 - protein, 9 aa, Homo Sapiens
VPSCCLLLE

SEQ ID NO: 318443 - protein, 9 aa, Homo Sapiens
AMADPYVVI

SEQ ID NO: 318444 - protein, 9 aa, Homo Sapiens
RSRKESYSM

SEQ ID NO: 318445 - protein, 9 aa, Homo Sapiens
KATDLLTLT

SEQ ID NO: 318446 - protein, 9 aa, Homo Sapiens
AGEMVPAFF

SEQ ID NO: 318447 - protein, 9 aa, Homo Sapiens
HGRWRGHAE

SEQ ID NO: 318448 - protein, 9 aa, Homo Sapiens
TLVPGGAVA

SEQ ID NO: 318449 - protein, 9 aa, Homo Sapiens
IAIWAGGHD

SEQ ID NO: 318450 - protein, 9 aa, Homo Sapiens
LHKLFSYNL

SEQ ID NO: 318451 - protein, 9 aa, Homo Sapiens
SHDSAATSL

SEQ ID NO: 318452 - protein, 9 aa, Homo Sapiens
RDDSCLRSL

SEQ ID NO: 318453 - protein, 9 aa, Homo Sapiens
ILTIVGTIT

SEQ ID NO: 318454 - protein, 9 aa, Homo Sapiens
TFTAHTAPA

SEQ ID NO: 318455 - protein, 9 aa, Homo Sapiens
HRYKWNGHW

SEQ ID NO: 318456 - protein, 9 aa, Homo Sapiens
AVQMDKPQN

SEQ ID NO: 318457 - protein, 9 aa, Homo Sapiens
RGALTLLFL

SEQ ID NO: 318458 - protein, 9 aa, Homo Sapiens
PVTLTCQLN

SEQ ID NO: 318459 - protein, 9 aa, Homo Sapiens
SIMISVFIC

SEQ ID NO: 318460 - protein, 9 aa, Homo Sapiens
RDAHANGWV

SEQ ID NO: 318461 - protein, 9 aa, Homo Sapiens
RRFLDNKVM

SEQ ID NO: 318462 - protein, 9 aa, Homo Sapiens
AMKVPIAIW

SEQ ID NO: 318463 - protein, 9 aa, Homo Sapiens
LQEAVWQHV

SEQ ID NO: 318464 - protein, 9 aa, Homo Sapiens
TTMVCCAPS

SEQ ID NO: 318465 - protein, 9 aa, Homo Sapiens
EAEEERRGG

SEQ ID NO: 318466 - protein, 9 aa, Homo Sapiens
PGGFLGQRG

SEQ ID NO: 318467 - protein, 9 aa, Homo Sapiens
SRHHHRHRR

SEQ ID NO: 318468 - protein, 9 aa, Homo Sapiens
AQPPGLPNA

SEQ ID NO: 318469 - protein, 9 aa, Homo Sapiens
SKYVFENIG

SEQ ID NO: 318470 - protein, 9 aa, Homo Sapiens
QHVQKLYTC

SEQ ID NO: 318471 - protein, 9 aa, Homo Sapiens
KKHQDFLVE

SEQ ID NO: 318472 - protein, 9 aa, Homo Sapiens
RHETSLGLL

SEQ ID NO: 318473 - protein, 9 aa, Homo Sapiens
RCINMTDTG

SEQ ID NO: 318474 - protein, 9 aa, Homo Sapiens
VMGVMKPGV

SEQ ID NO: 318475 - protein, 9 aa, Homo Sapiens
TEENPYKCD

SEQ ID NO: 318476 - protein, 9 aa, Homo Sapiens
WGQGELSSE

SEQ ID NO: 318477 - protein, 9 aa, Homo Sapiens
MEVPVRASS

SEQ ID NO: 318478 - protein, 9 aa, Homo Sapiens
EYPADASRN

SEQ ID NO: 318479 - protein, 9 aa, Homo Sapiens
AMACCYTII

SEQ ID NO: 318480 - protein, 9 aa, Homo Sapiens
YNWWRKALR

SEQ ID NO: 318481 - protein, 9 aa, Homo Sapiens
RANSIGSTN

SEQ ID NO: 318482 - protein, 9 aa, Homo Sapiens
SASRRPPWL

SEQ ID NO: 318483 - protein, 9 aa, Homo Sapiens
SPETFALSA

SEQ ID NO: 318484 - protein, 9 aa, Homo Sapiens
AQFQGGGLA

SEQ ID NO: 318485 - protein, 9 aa, Homo Sapiens
LYDETIRHF

SEQ ID NO: 318486 - protein, 9 aa, Homo Sapiens
VAEALIERG

SEQ ID NO: 318487 - protein, 9 aa, Homo Sapiens
GIKFKIHGC

SEQ ID NO: 318488 - protein, 9 aa, Homo Sapiens
HCYRYCKNK

SEQ ID NO: 318489 - protein, 9 aa, Homo Sapiens
RLKLSQAQV

SEQ ID NO: 318490 - protein, 9 aa, Homo Sapiens
VPPLQPKGG

SEQ ID NO: 318491 - protein, 9 aa, Homo Sapiens
AVSWMSLHL

SEQ ID NO: 318492 - protein, 9 aa, Homo Sapiens
ALEGGLPQF

SEQ ID NO: 318493 - protein, 9 aa, Homo Sapiens
VESKAKDDQ

SEQ ID NO: 318494 - protein, 9 aa, Homo Sapiens
CRCFLFTVT

SEQ ID NO: 318495 - protein, 9 aa, Homo Sapiens
RVQNHHTWD

SEQ ID NO: 318496 - protein, 9 aa, Homo Sapiens
LIMDRTEHL

SEQ ID NO: 318497 - protein, 9 aa, Homo Sapiens
SSWSSSNGP

SEQ ID NO: 318498 - protein, 9 aa, Homo Sapiens
CLEKTLLHD

SEQ ID NO: 318499 - protein, 9 aa, Homo Sapiens
MAFVKAKER

SEQ ID NO: 318500 - protein, 9 aa, Homo Sapiens
DGASRSALH

SEQ ID NO: 318501 - protein, 9 aa, Homo Sapiens
KCHGLGAVI

SEQ ID NO: 318502 - protein, 9 aa, Homo Sapiens
NSWNMVDMD

SEQ ID NO: 318503 - protein, 9 aa, Homo Sapiens
CKNGGHYMR

SEQ ID NO: 318504 - protein, 9 aa, Homo Sapiens
SLRLCHLLV

SEQ ID NO: 318505 - protein, 9 aa, Homo Sapiens
DTGRHWLTW

SEQ ID NO: 318506 - protein, 9 aa, Homo Sapiens
EPQTNHCKR

SEQ ID NO: 318507 - protein, 9 aa, Homo Sapiens
QPSRGKSRW

SEQ ID NO: 318508 - protein, 9 aa, Homo Sapiens
NTMGLVVER

SEQ ID NO: 318509 - protein, 9 aa, Homo Sapiens
TDDKFFKIH

SEQ ID NO: 318510 - protein, 9 aa, Homo Sapiens
PFANITHGN

SEQ ID NO: 318511 - protein, 9 aa, Homo Sapiens
LAPPEPPHN

SEQ ID NO: 318512 - protein, 9 aa, Homo Sapiens
SCAWYRGTA

SEQ ID NO: 318513 - protein, 9 aa, Homo Sapiens
IREPQTNHC

SEQ ID NO: 318514 - protein, 9 aa, Homo Sapiens
SFCKDGGGE

SEQ ID NO: 318515 - protein, 9 aa, Homo Sapiens
VSWEYGGEG

SEQ ID NO: 318516 - protein, 9 aa, Homo Sapiens
GMKDMYGQV

SEQ ID NO: 318517 - protein, 9 aa, Homo Sapiens
ETIRHFSTM

SEQ ID NO: 318518 - protein, 9 aa, Homo Sapiens
CQGQQEITN

SEQ ID NO: 318519 - protein, 9 aa, Homo Sapiens
ALLHPDIRS

SEQ ID NO: 318520 - protein, 9 aa, Homo Sapiens
FSNVPIMLS

SEQ ID NO: 318521 - protein, 9 aa, Homo Sapiens
QDNIHLYAE

SEQ ID NO: 318522 - protein, 9 aa, Homo Sapiens
HSPLVAPPV

SEQ ID NO: 318523 - protein, 9 aa, Homo Sapiens
LETMYTGGN

SEQ ID NO: 318524 - protein, 9 aa, Homo Sapiens
SVQLRNSAD

SEQ ID NO: 318525 - protein, 9 aa, Homo Sapiens
GIEWNLSTV

SEQ ID NO: 318526 - protein, 9 aa, Homo Sapiens
QASEDTPKS

SEQ ID NO: 318527 - protein, 9 aa, Homo Sapiens
SALTPPTNM

SEQ ID NO: 318528 - protein, 9 aa, Homo Sapiens
WCCSRIMHM

SEQ ID NO: 318529 - protein, 9 aa, Homo Sapiens
PEADDPQPS

SEQ ID NO: 318530 - protein, 9 aa, Homo Sapiens
TDIQNDEKG

SEQ ID NO: 318531 - protein, 9 aa, Homo Sapiens
YSCYIYWTC

SEQ ID NO: 318532 - protein, 9 aa, Homo Sapiens
IHISQFCFA

SEQ ID NO: 318533 - protein, 9 aa, Homo Sapiens
KFSQSGHTS

SEQ ID NO: 318534 - protein, 9 aa, Homo Sapiens
SILEEEVEL

SEQ ID NO: 318535 - protein, 9 aa, Homo Sapiens
LLPLPRSWF

SEQ ID NO: 318536 - protein, 9 aa, Homo Sapiens
HASERLAEI

SEQ ID NO: 318537 - protein, 9 aa, Homo Sapiens
KMQTHPWRQ

SEQ ID NO: 318538 - protein, 9 aa, Homo Sapiens
MRRGRVVFL

SEQ ID NO: 318539 - protein, 9 aa, Homo Sapiens
RTGPCRQRT

SEQ ID NO: 318540 - protein, 9 aa, Homo Sapiens
PDIMHHIST

SEQ ID NO: 318541 - protein, 9 aa, Homo Sapiens
EEQEQDLLE

SEQ ID NO: 318542 - protein, 9 aa, Homo Sapiens
ITHWWEDLE

SEQ ID NO: 318543 - protein, 9 aa, Homo Sapiens
ILFNKKENT

SEQ ID NO: 318544 - protein, 9 aa, Homo Sapiens
FVLIMSDIH

SEQ ID NO: 318545 - protein, 9 aa, Homo Sapiens
THSMKSEEL

SEQ ID NO: 318546 - protein, 9 aa, Homo Sapiens
LQALLKENW

SEQ ID NO: 318547 - protein, 9 aa, Homo Sapiens
KRLPYLTAK

SEQ ID NO: 318548 - protein, 9 aa, Homo Sapiens
MLVLVCSMA

SEQ ID NO: 318549 - protein, 9 aa, Homo Sapiens
LSKGISKKE

SEQ ID NO: 318550 - protein, 9 aa, Homo Sapiens
HSIVEDYLG

SEQ ID NO: 318551 - protein, 9 aa, Homo Sapiens
PYECYKCGK

SEQ ID NO: 318552 - protein, 9 aa, Homo Sapiens
ARPHRRIQP

SEQ ID NO: 318553 - protein, 9 aa, Homo Sapiens
CGMNQVLDV

SEQ ID NO: 318554 - protein, 9 aa, Homo Sapiens
DGEEGGCAS

SEQ ID NO: 318555 - protein, 9 aa, Homo Sapiens
ASERGQLLN

SEQ ID NO: 318556 - protein, 9 aa, Homo Sapiens
TMVCCAPSV

SEQ ID NO: 318557 - protein, 9 aa, Homo Sapiens
LITIHKAHL

SEQ ID NO: 318558 - protein, 9 aa, Homo Sapiens
WFANPGGSD

SEQ ID NO: 318559 - protein, 9 aa, Homo Sapiens
TANSQVKKT

SEQ ID NO: 318560 - protein, 9 aa, Homo Sapiens
EVVSMYYTL

SEQ ID NO: 318561 - protein, 9 aa, Homo Sapiens
YKWVPVMEP

SEQ ID NO: 318562 - protein, 9 aa, Homo Sapiens
HDENDNSPC

SEQ ID NO: 318563 - protein, 9 aa, Homo Sapiens
RPHRRIQPV

SEQ ID NO: 318564 - protein, 9 aa, Homo Sapiens
HFFRQIISA

SEQ ID NO: 318565 - protein, 9 aa, Homo Sapiens
VQIVEAILS

SEQ ID NO: 318566 - protein, 9 aa, Homo Sapiens
GWPEEEKLL

SEQ ID NO: 318567 - protein, 9 aa, Homo Sapiens
VPVSCSLSR

SEQ ID NO: 318568 - protein, 9 aa, Homo Sapiens
RILAHQGAQ

SEQ ID NO: 318569 - protein, 9 aa, Homo Sapiens
PINNERTQL

SEQ ID NO: 318570 - protein, 9 aa, Homo Sapiens
VMAKKHQDF

SEQ ID NO: 318571 - protein, 9 aa, Homo Sapiens
SSCRQQSSC

SEQ ID NO: 318572 - protein, 9 aa, Homo Sapiens
DSVFDLVIV

SEQ ID NO: 318573 - protein, 9 aa, Homo Sapiens
QPYNSAVYS

SEQ ID NO: 318574 - protein, 9 aa, Homo Sapiens
DVPSLCVAE

SEQ ID NO: 318575 - protein, 9 aa, Homo Sapiens
SWEGCEWHF

SEQ ID NO: 318576 - protein, 9 aa, Homo Sapiens
ACKLCSCHP

SEQ ID NO: 318577 - protein, 9 aa, Homo Sapiens
QPDSPTTLY

SEQ ID NO: 318578 - protein, 9 aa, Homo Sapiens
HFQASEDTP

SEQ ID NO: 318579 - protein, 9 aa, Homo Sapiens
PCVPPLQPK

SEQ ID NO: 318580 - protein, 9 aa, Homo Sapiens
EAIAIYKVL

SEQ ID NO: 318581 - protein, 9 aa, Homo Sapiens
RWHATPTQL

SEQ ID NO: 318582 - protein, 9 aa, Homo Sapiens
SIFGVVSNL

SEQ ID NO: 318583 - protein, 9 aa, Homo Sapiens
GISCLAGVA

SEQ ID NO: 318584 - protein, 9 aa, Homo Sapiens
DRVAGRLVL

SEQ ID NO: 318585 - protein, 9 aa, Homo Sapiens
VPARGSCSQ

SEQ ID NO: 318586 - protein, 9 aa, Homo Sapiens
RSLGIAVYH

SEQ ID NO: 318587 - protein, 9 aa, Homo Sapiens
CWTPYHMFS

SEQ ID NO: 318588 - protein, 9 aa, Homo Sapiens
AAIRNYDIE

SEQ ID NO: 318589 - protein, 9 aa, Homo Sapiens
CKVFRQNSA

SEQ ID NO: 318590 - protein, 9 aa, Homo Sapiens
TWPSGELSI

SEQ ID NO: 318591 - protein, 9 aa, Homo Sapiens
LPKLNQRLS

SEQ ID NO: 318592 - protein, 9 aa, Homo Sapiens
RVLAPILLD

SEQ ID NO: 318593 - protein, 9 aa, Homo Sapiens
SGSSWSSSN

SEQ ID NO: 318594 - protein, 9 aa, Homo Sapiens
YMYCGSCAA

SEQ ID NO: 318595 - protein, 9 aa, Homo Sapiens
MVMEQAIPL

SEQ ID NO: 318596 - protein, 9 aa, Homo Sapiens
FFPMSHVRL

SEQ ID NO: 318597 - protein, 9 aa, Homo Sapiens
GDVPIIAME

SEQ ID NO: 318598 - protein, 9 aa, Homo Sapiens
HMAKERTHS

SEQ ID NO: 318599 - protein, 9 aa, Homo Sapiens
VVKWNKDDR

SEQ ID NO: 318600 - protein, 9 aa, Homo Sapiens
STKFQQIVC

SEQ ID NO: 318601 - protein, 9 aa, Homo Sapiens
YRMQLMSCI

SEQ ID NO: 318602 - protein, 9 aa, Homo Sapiens
KEGIQTQNR

SEQ ID NO: 318603 - protein, 9 aa, Homo Sapiens
WTYEYTWGE

SEQ ID NO: 318604 - protein, 9 aa, Homo Sapiens
EPSFMWYKD

SEQ ID NO: 318605 - protein, 9 aa, Homo Sapiens
WGSAFSISF

SEQ ID NO: 318606 - protein, 9 aa, Homo Sapiens
NRTSVQSVA

SEQ ID NO: 318607 - protein, 9 aa, Homo Sapiens
ARRGPLRVT

SEQ ID NO: 318608 - protein, 9 aa, Homo Sapiens
LKDENSTKI

SEQ ID NO: 318609 - protein, 9 aa, Homo Sapiens
QGFPVPARG

SEQ ID NO: 318610 - protein, 9 aa, Homo Sapiens
LCRQHMAMK

SEQ ID NO: 318611 - protein, 9 aa, Homo Sapiens
GGRPGGFLG

SEQ ID NO: 318612 - protein, 9 aa, Homo Sapiens
VPFDEIMGS

SEQ ID NO: 318613 - protein, 9 aa, Homo Sapiens
SGSPWVRRH

SEQ ID NO: 318614 - protein, 9 aa, Homo Sapiens
RMGNLPANM

SEQ ID NO: 318615 - protein, 9 aa, Homo Sapiens
CPMEHILVH

SEQ ID NO: 318616 - protein, 9 aa, Homo Sapiens
LCSPRSEVM

SEQ ID NO: 318617 - protein, 9 aa, Homo Sapiens
PTCVDVHIS

SEQ ID NO: 318618 - protein, 9 aa, Homo Sapiens
SPPLKPSIS

SEQ ID NO: 318619 - protein, 9 aa, Homo Sapiens
NKVMLSFGK

SEQ ID NO: 318620 - protein, 9 aa, Homo Sapiens
LCITQFQVD

SEQ ID NO: 318621 - protein, 9 aa, Homo Sapiens
ENVKISATW

SEQ ID NO: 318622 - protein, 9 aa, Homo Sapiens
IMSQACAEQ

SEQ ID NO: 318623 - protein, 9 aa, Homo Sapiens
DLPFWLVLW

SEQ ID NO: 318624 - protein, 9 aa, Homo Sapiens
IHDENDNSP

SEQ ID NO: 318625 - protein, 9 aa, Homo Sapiens
TLLHQLYSA

SEQ ID NO: 318626 - protein, 9 aa, Homo Sapiens
LFREQSKGR

SEQ ID NO: 318627 - protein, 9 aa, Homo Sapiens
RLAVQKGTS

SEQ ID NO: 318628 - protein, 9 aa, Homo Sapiens
HQEGKRLWR

SEQ ID NO: 318629 - protein, 9 aa, Homo Sapiens
HKRTHTGEN

SEQ ID NO: 318630 - protein, 9 aa, Homo Sapiens
LVKKSFETD

SEQ ID NO: 318631 - protein, 9 aa, Homo Sapiens
ATNLTGLFF

SEQ ID NO: 318632 - protein, 9 aa, Homo Sapiens
PRLPAVPPQ

SEQ ID NO: 318633 - protein, 9 aa, Homo Sapiens
LESPSSSTG

SEQ ID NO: 318634 - protein, 9 aa, Homo Sapiens
LVPGYWHVY

SEQ ID NO: 318635 - protein, 9 aa, Homo Sapiens
SKSITTLKG

SEQ ID NO: 318636 - protein, 9 aa, Homo Sapiens
VLRTMLRRC

SEQ ID NO: 318637 - protein, 9 aa, Homo Sapiens
KAHKEASLQ

SEQ ID NO: 318638 - protein, 9 aa, Homo Sapiens
KGKGKKRRR

SEQ ID NO: 318639 - protein, 9 aa, Homo Sapiens
VAQVQSNPD

SEQ ID NO: 318640 - protein, 9 aa, Homo Sapiens
EVDTDAADA

SEQ ID NO: 318641 - protein, 9 aa, Homo Sapiens
LSMREAQEQ

SEQ ID NO: 318642 - protein, 9 aa, Homo Sapiens
RGLKGHIIS

SEQ ID NO: 318643 - protein, 9 aa, Homo Sapiens
TPVESDEMC

SEQ ID NO: 318644 - protein, 9 aa, Homo Sapiens
GDGNWTNYN

SEQ ID NO: 318645 - protein, 9 aa, Homo Sapiens
RTARALLDI

SEQ ID NO: 318646 - protein, 9 aa, Homo Sapiens
GASEHGRPN

SEQ ID NO: 318647 - protein, 9 aa, Homo Sapiens
RGRCGKKGA

SEQ ID NO: 318648 - protein, 9 aa, Homo Sapiens
CSPHLSVLQ

SEQ ID NO: 318649 - protein, 9 aa, Homo Sapiens
NAEGDASSW

SEQ ID NO: 318650 - protein, 9 aa, Homo Sapiens
SHMGNLRSL

SEQ ID NO: 318651 - protein, 9 aa, Homo Sapiens
HHGGQLIVP

SEQ ID NO: 318652 - protein, 9 aa, Homo Sapiens
QSCLNVGFL

SEQ ID NO: 318653 - protein, 9 aa, Homo Sapiens
IHLNRLHSC

SEQ ID NO: 318654 - protein, 9 aa, Homo Sapiens
AAALRRWLD

SEQ ID NO: 318655 - protein, 9 aa, Homo Sapiens
FEALAARDA

SEQ ID NO: 318656 - protein, 9 aa, Homo Sapiens
NSWPNESPR

SEQ ID NO: 318657 - protein, 9 aa, Homo Sapiens
RYEEIAQSS

SEQ ID NO: 318658 - protein, 9 aa, Homo Sapiens
CPLPAQIQE

SEQ ID NO: 318659 - protein, 9 aa, Homo Sapiens
ITDPETGLA

SEQ ID NO: 318660 - protein, 9 aa, Homo Sapiens
QWPSRFFMT

SEQ ID NO: 318661 - protein, 9 aa, Homo Sapiens
GPSVDTRHK

SEQ ID NO: 318662 - protein, 9 aa, Homo Sapiens
GKEHDLSIS

SEQ ID NO: 318663 - protein, 9 aa, Homo Sapiens
DPVQCSHDV

SEQ ID NO: 318664 - protein, 9 aa, Homo Sapiens
RPNRRATAT

SEQ ID NO: 318665 - protein, 9 aa, Homo Sapiens
NIDGIDLTN

SEQ ID NO: 318666 - protein, 9 aa, Homo Sapiens
RTWGRALVN

SEQ ID NO: 318667 - protein, 9 aa, Homo Sapiens
FFINPGEDD

SEQ ID NO: 318668 - protein, 9 aa, Homo Sapiens
NGCITNFDN

SEQ ID NO: 318669 - protein, 9 aa, Homo Sapiens
LILDQLRAC

SEQ ID NO: 318670 - protein, 9 aa, Homo Sapiens
MVSAITLWQ

SEQ ID NO: 318671 - protein, 9 aa, Homo Sapiens
DACIAVCSA

SEQ ID NO: 318672 - protein, 9 aa, Homo Sapiens
EGGSGGSGL

SEQ ID NO: 318673 - protein, 9 aa, Homo Sapiens
ITEFQTTIP

SEQ ID NO: 318674 - protein, 9 aa, Homo Sapiens
GEAVDTSIK

SEQ ID NO: 318675 - protein, 9 aa, Homo Sapiens
MGKQNSKLQ

SEQ ID NO: 318676 - protein, 9 aa, Homo Sapiens
GLPNASSNP

SEQ ID NO: 318677 - protein, 9 aa, Homo Sapiens
SDGPAGRED

SEQ ID NO: 318678 - protein, 9 aa, Homo Sapiens
RAEEGGSSP

SEQ ID NO: 318679 - protein, 9 aa, Homo Sapiens
KVQEGVCNI

SEQ ID NO: 318680 - protein, 9 aa, Homo Sapiens
VSPEVRDVW

SEQ ID NO: 318681 - protein, 9 aa, Homo Sapiens
MLSIGSALT

SEQ ID NO: 318682 - protein, 9 aa, Homo Sapiens
EQRRSLEWA

SEQ ID NO: 318683 - protein, 9 aa, Homo Sapiens
ANQQVTYHI

SEQ ID NO: 318684 - protein, 9 aa, Homo Sapiens
IPMFLCLYL

SEQ ID NO: 318685 - protein, 9 aa, Homo Sapiens
KMVFPLADV

SEQ ID NO: 318686 - protein, 9 aa, Homo Sapiens
AFEGSFLVC

SEQ ID NO: 318687 - protein, 9 aa, Homo Sapiens
YRPCPLIKY

SEQ ID NO: 318688 - protein, 9 aa, Homo Sapiens
DGSQDYYVG

SEQ ID NO: 318689 - protein, 9 aa, Homo Sapiens
RLCVMGDIP

SEQ ID NO: 318690 - protein, 9 aa, Homo Sapiens
PDENKNTAF

SEQ ID NO: 318691 - protein, 9 aa, Homo Sapiens
HNYLSLTTE

SEQ ID NO: 318692 - protein, 9 aa, Homo Sapiens
LYFVTTSAH

SEQ ID NO: 318693 - protein, 9 aa, Homo Sapiens
RVPMMNVSM

SEQ ID NO: 318694 - protein, 9 aa, Homo Sapiens
SPHLSVLQM

SEQ ID NO: 318695 - protein, 9 aa, Homo Sapiens
ALLWHIVKE

SEQ ID NO: 318696 - protein, 9 aa, Homo Sapiens
KVIELPRGL

SEQ ID NO: 318697 - protein, 9 aa, Homo Sapiens
WRGMPYGGR

SEQ ID NO: 318698 - protein, 9 aa, Homo Sapiens
SLVPGYWHV

SEQ ID NO: 318699 - protein, 9 aa, Homo Sapiens
LHLTTQHRS

SEQ ID NO: 318700 - protein, 9 aa, Homo Sapiens
GSSCTQRTL

SEQ ID NO: 318701 - protein, 9 aa, Homo Sapiens
RTCSPHLSV

SEQ ID NO: 318702 - protein, 9 aa, Homo Sapiens
PPTTAKDSS

SEQ ID NO: 318703 - protein, 9 aa, Homo Sapiens
VVGNSIVEK

SEQ ID NO: 318704 - protein, 9 aa, Homo Sapiens
QIARVCKGD

SEQ ID NO: 318705 - protein, 9 aa, Homo Sapiens
THWWEDLER

SEQ ID NO: 318706 - protein, 9 aa, Homo Sapiens
FRPGPQWCA

SEQ ID NO: 318707 - protein, 9 aa, Homo Sapiens
YCQFDFKRL

SEQ ID NO: 318708 - protein, 9 aa, Homo Sapiens
TSILGHVIH

SEQ ID NO: 318709 - protein, 9 aa, Homo Sapiens
DWRGMPYGG

SEQ ID NO: 318710 - protein, 9 aa, Homo Sapiens
VPHEVRDFA

SEQ ID NO: 318711 - protein, 9 aa, Homo Sapiens
RLLHCTERP

SEQ ID NO: 318712 - protein, 9 aa, Homo Sapiens
GAPELWRWH

SEQ ID NO: 318713 - protein, 9 aa, Homo Sapiens
FACHEEGSQ

SEQ ID NO: 318714 - protein, 9 aa, Homo Sapiens
LSSIQVDTF

SEQ ID NO: 318715 - protein, 9 aa, Homo Sapiens
MTYMKHFDA

SEQ ID NO: 318716 - protein, 9 aa, Homo Sapiens
EPEGEPPAM

SEQ ID NO: 318717 - protein, 9 aa, Homo Sapiens
GFKHIGDEG

SEQ ID NO: 318718 - protein, 9 aa, Homo Sapiens
LNFRINLPI

SEQ ID NO: 318719 - protein, 9 aa, Homo Sapiens
SSASPEVES

SEQ ID NO: 318720 - protein, 9 aa, Homo Sapiens
DCGMKLYGS

SEQ ID NO: 318721 - protein, 9 aa, Homo Sapiens
FWMGLSQRN

SEQ ID NO: 318722 - protein, 9 aa, Homo Sapiens
MRMGNLPAN

SEQ ID NO: 318723 - protein, 9 aa, Homo Sapiens
QDHAAFLLS

SEQ ID NO: 318724 - protein, 9 aa, Homo Sapiens
IGIEWNLST

SEQ ID NO: 318725 - protein, 9 aa, Homo Sapiens
FLANNREKQ

SEQ ID NO: 318726 - protein, 9 aa, Homo Sapiens
EDSDPFAKL

SEQ ID NO: 318727 - protein, 9 aa, Homo Sapiens
GCGKDFSHS

SEQ ID NO: 318728 - protein, 9 aa, Homo Sapiens
LLKHQEELE

SEQ ID NO: 318729 - protein, 9 aa, Homo Sapiens
VVRSVCQDN

SEQ ID NO: 318730 - protein, 9 aa, Homo Sapiens
WEWVLQCFG

SEQ ID NO: 318731 - protein, 9 aa, Homo Sapiens
MESVYGYFH

SEQ ID NO: 318732 - protein, 9 aa, Homo Sapiens
LRPRCINMT

SEQ ID NO: 318733 - protein, 9 aa, Homo Sapiens
KPKWLLLQR

SEQ ID NO: 318734 - protein, 9 aa, Homo Sapiens
ERYAKWKGL

SEQ ID NO: 318735 - protein, 9 aa, Homo Sapiens
HPSPQIAWQ

SEQ ID NO: 318736 - protein, 9 aa, Homo Sapiens
CVDGSQDYY

SEQ ID NO: 318737 - protein, 9 aa, Homo Sapiens
INSDGVVQH

SEQ ID NO: 318738 - protein, 9 aa, Homo Sapiens
SWVLSQLDA

SEQ ID NO: 318739 - protein, 9 aa, Homo Sapiens
WVRRHRQAE

SEQ ID NO: 318740 - protein, 9 aa, Homo Sapiens
PRKSHHHRH

SEQ ID NO: 318741 - protein, 9 aa, Homo Sapiens
CVCVCVRLS

SEQ ID NO: 318742 - protein, 9 aa, Homo Sapiens
ISGLGKWLV

SEQ ID NO: 318743 - protein, 9 aa, Homo Sapiens
PAMALGFNP

SEQ ID NO: 318744 - protein, 9 aa, Homo Sapiens
QGSVYPSQP

SEQ ID NO: 318745 - protein, 9 aa, Homo Sapiens
LGFRSKYSF

SEQ ID NO: 318746 - protein, 9 aa, Homo Sapiens
RDRALEPGL

SEQ ID NO: 318747 - protein, 9 aa, Homo Sapiens
RRPHQQDPH

SEQ ID NO: 318748 - protein, 9 aa, Homo Sapiens
ACHEHGPRS

SEQ ID NO: 318749 - protein, 9 aa, Homo Sapiens
NVAAKYHMA

SEQ ID NO: 318750 - protein, 9 aa, Homo Sapiens
ISLEIIHKC

SEQ ID NO: 318751 - protein, 9 aa, Homo Sapiens
EPPAMSGTQ

SEQ ID NO: 318752 - protein, 9 aa, Homo Sapiens
HDLMDCVTM

SEQ ID NO: 318753 - protein, 9 aa, Homo Sapiens
RHTSMRGLK

SEQ ID NO: 318754 - protein, 9 aa, Homo Sapiens
YSIMKSCWH

SEQ ID NO: 318755 - protein, 9 aa, Homo Sapiens
SQSRSPSKE

SEQ ID NO: 318756 - protein, 9 aa, Homo Sapiens
EERRGGEER

SEQ ID NO: 318757 - protein, 9 aa, Homo Sapiens
PGLSFHKVE

SEQ ID NO: 318758 - protein, 9 aa, Homo Sapiens
LNCILILLP

SEQ ID NO: 318759 - protein, 9 aa, Homo Sapiens
STVHCMHLH

SEQ ID NO: 318760 - protein, 9 aa, Homo Sapiens
HFDWDHSGT

SEQ ID NO: 318761 - protein, 9 aa, Homo Sapiens
RKGAQLGGT

SEQ ID NO: 318762 - protein, 9 aa, Homo Sapiens
QACQLARHI

SEQ ID NO: 318763 - protein, 9 aa, Homo Sapiens
HPLLHQWVA

SEQ ID NO: 318764 - protein, 9 aa, Homo Sapiens
RDRGRILAH

SEQ ID NO: 318765 - protein, 9 aa, Homo Sapiens
SCARGALTL

SEQ ID NO: 318766 - protein, 9 aa, Homo Sapiens
EGGLPRHIG

SEQ ID NO: 318767 - protein, 9 aa, Homo Sapiens
PFWMGLSQR

SEQ ID NO: 318768 - protein, 9 aa, Homo Sapiens
FPLVVGNPD

SEQ ID NO: 318769 - protein, 9 aa, Homo Sapiens
HDLSKSPGM

SEQ ID NO: 318770 - protein, 9 aa, Homo Sapiens
CYAIGVGHA

SEQ ID NO: 318771 - protein, 9 aa, Homo Sapiens
RIFTYLIGQ

SEQ ID NO: 318772 - protein, 9 aa, Homo Sapiens
IQHRVHSSQ

SEQ ID NO: 318773 - protein, 9 aa, Homo Sapiens
VIAPWRTPE

SEQ ID NO: 318774 - protein, 9 aa, Homo Sapiens
RCTSSQSIG

SEQ ID NO: 318775 - protein, 9 aa, Homo Sapiens
PARDKHALK

SEQ ID NO: 318776 - protein, 9 aa, Homo Sapiens
FPMWGRGGF

SEQ ID NO: 318777 - protein, 9 aa, Homo Sapiens
CDIEMSKEP

SEQ ID NO: 318778 - protein, 9 aa, Homo Sapiens
ADEEEAELW

SEQ ID NO: 318779 - protein, 9 aa, Homo Sapiens
AFRQRTSLI

SEQ ID NO: 318780 - protein, 9 aa, Homo Sapiens
VRCSPVKNE

SEQ ID NO: 318781 - protein, 9 aa, Homo Sapiens
QSCQMSKLR

SEQ ID NO: 318782 - protein, 9 aa, Homo Sapiens
TLPVCLLRP

SEQ ID NO: 318783 - protein, 9 aa, Homo Sapiens
LPDLGQPYN

SEQ ID NO: 318784 - protein, 9 aa, Homo Sapiens
CIDKISPNG

SEQ ID NO: 318785 - protein, 9 aa, Homo Sapiens
MLYQCQGHM

SEQ ID NO: 318786 - protein, 9 aa, Homo Sapiens
EICDARHPH

SEQ ID NO: 318787 - protein, 9 aa, Homo Sapiens
PHYEFGSLR

SEQ ID NO: 318788 - protein, 9 aa, Homo Sapiens
RRDRRPGPS

SEQ ID NO: 318789 - protein, 9 aa, Homo Sapiens
ARFQDRMYQ

SEQ ID NO: 318790 - protein, 9 aa, Homo Sapiens
WYGLCVPIM

SEQ ID NO: 318791 - protein, 9 aa, Homo Sapiens
SRPELLYHT

SEQ ID NO: 318792 - protein, 9 aa, Homo Sapiens
PCTPNIVTT

SEQ ID NO: 318793 - protein, 9 aa, Homo Sapiens
VLIKELGPM

SEQ ID NO: 318794 - protein, 9 aa, Homo Sapiens
DDRPLQVEK

SEQ ID NO: 318795 - protein, 9 aa, Homo Sapiens
DQIAELQVQ

SEQ ID NO: 318796 - protein, 9 aa, Homo Sapiens
YFGGVSSLT

SEQ ID NO: 318797 - protein, 9 aa, Homo Sapiens
FDPMAFVKA

SEQ ID NO: 318798 - protein, 9 aa, Homo Sapiens
ASLRCPECS

SEQ ID NO: 318799 - protein, 9 aa, Homo Sapiens
EDDCEKLER

SEQ ID NO: 318800 - protein, 9 aa, Homo Sapiens
ASILQKRLS

SEQ ID NO: 318801 - protein, 9 aa, Homo Sapiens
DCYSKKKYV

SEQ ID NO: 318802 - protein, 9 aa, Homo Sapiens
TDKYDFTTY

SEQ ID NO: 318803 - protein, 9 aa, Homo Sapiens
DIASFLRTY

SEQ ID NO: 318804 - protein, 9 aa, Homo Sapiens
QGLHGQRAH

SEQ ID NO: 318805 - protein, 9 aa, Homo Sapiens
FHKVEMLKP

SEQ ID NO: 318806 - protein, 9 aa, Homo Sapiens
DTLQETQES

SEQ ID NO: 318807 - protein, 9 aa, Homo Sapiens
PAETFCFPA

SEQ ID NO: 318808 - protein, 9 aa, Homo Sapiens
GPDPKIYCQ

SEQ ID NO: 318809 - protein, 9 aa, Homo Sapiens
LSKTRNILN

SEQ ID NO: 318810 - protein, 9 aa, Homo Sapiens
MSLRLCHLL

SEQ ID NO: 318811 - protein, 9 aa, Homo Sapiens
PAGILCVDD

SEQ ID NO: 318812 - protein, 9 aa, Homo Sapiens
CGQDIFIIQ

SEQ ID NO: 318813 - protein, 9 aa, Homo Sapiens
SLRYSINIG

SEQ ID NO: 318814 - protein, 9 aa, Homo Sapiens
SLRSNLPTS

SEQ ID NO: 318815 - protein, 9 aa, Homo Sapiens
SFIGMESTG

SEQ ID NO: 318816 - protein, 9 aa, Homo Sapiens
RSWVLSQLD

SEQ ID NO: 318817 - protein, 9 aa, Homo Sapiens
LISVEMDIV

SEQ ID NO: 318818 - protein, 9 aa, Homo Sapiens
KSCCVPTRL

SEQ ID NO: 318819 - protein, 9 aa, Homo Sapiens
PGYWHVYLE

SEQ ID NO: 318820 - protein, 9 aa, Homo Sapiens
NNRRLQVES

SEQ ID NO: 318821 - protein, 9 aa, Homo Sapiens
TGRGEQSDC

SEQ ID NO: 318822 - protein, 9 aa, Homo Sapiens
FSPNVPSCC

SEQ ID NO: 318823 - protein, 9 aa, Homo Sapiens
LVLVRDIRR

SEQ ID NO: 318824 - protein, 9 aa, Homo Sapiens
DGPPSPMGP

SEQ ID NO: 318825 - protein, 9 aa, Homo Sapiens
GPCGPPPTM

SEQ ID NO: 318826 - protein, 9 aa, Homo Sapiens
TVDDWLSTI

SEQ ID NO: 318827 - protein, 9 aa, Homo Sapiens
QSMQTLSAS

SEQ ID NO: 318828 - protein, 9 aa, Homo Sapiens
NLLEQNLIQ

SEQ ID NO: 318829 - protein, 9 aa, Homo Sapiens
VIVPAQRIP

SEQ ID NO: 318830 - protein, 9 aa, Homo Sapiens
VIHDVARAG

SEQ ID NO: 318831 - protein, 9 aa, Homo Sapiens
DLWSSNEDS

SEQ ID NO: 318832 - protein, 9 aa, Homo Sapiens
RWDSKKLPG

SEQ ID NO: 318833 - protein, 9 aa, Homo Sapiens
CAPLPPPPA

SEQ ID NO: 318834 - protein, 9 aa, Homo Sapiens
NFCQILAVT

SEQ ID NO: 318835 - protein, 9 aa, Homo Sapiens
DNGTDDWRI

SEQ ID NO: 318836 - protein, 9 aa, Homo Sapiens
IKSSHPLRV

SEQ ID NO: 318837 - protein, 9 aa, Homo Sapiens
VSDHQQLEA

SEQ ID NO: 318838 - protein, 9 aa, Homo Sapiens
TVEVSATVR

SEQ ID NO: 318839 - protein, 9 aa, Homo Sapiens
VPFRLTEKM

SEQ ID NO: 318840 - protein, 9 aa, Homo Sapiens
KRCTSSQSI

SEQ ID NO: 318841 - protein, 9 aa, Homo Sapiens
LQETQESLS

SEQ ID NO: 318842 - protein, 9 aa, Homo Sapiens
AVEAELEYQ

SEQ ID NO: 318843 - protein, 9 aa, Homo Sapiens
MLMEREHTD

SEQ ID NO: 318844 - protein, 9 aa, Homo Sapiens
GMSSRRRRR

SEQ ID NO: 318845 - protein, 9 aa, Homo Sapiens
EICYKDHIQ

SEQ ID NO: 318846 - protein, 9 aa, Homo Sapiens
GSSHCDSHS

SEQ ID NO: 318847 - protein, 9 aa, Homo Sapiens
GNSIVEKVQ

SEQ ID NO: 318848 - protein, 9 aa, Homo Sapiens
GTSTIVRTV

SEQ ID NO: 318849 - protein, 9 aa, Homo Sapiens
TSTGPSLFE

SEQ ID NO: 318850 - protein, 9 aa, Homo Sapiens
LCTYVLHIL

SEQ ID NO: 318851 - protein, 9 aa, Homo Sapiens
KNTLAAQKN

SEQ ID NO: 318852 - protein, 9 aa, Homo Sapiens
ASGFLWSLQ

SEQ ID NO: 318853 - protein, 9 aa, Homo Sapiens
GPQWCAVQG

SEQ ID NO: 318854 - protein, 9 aa, Homo Sapiens
GQSRCDGHV

SEQ ID NO: 318855 - protein, 9 aa, Homo Sapiens
ADRPCASLR

SEQ ID NO: 318856 - protein, 9 aa, Homo Sapiens
YALLHFLVM

SEQ ID NO: 318857 - protein, 9 aa, Homo Sapiens
YWNTSDLRY

SEQ ID NO: 318858 - protein, 9 aa, Homo Sapiens
LLEICYKDH

SEQ ID NO: 318859 - protein, 9 aa, Homo Sapiens
AIKLWLHIE

SEQ ID NO: 318860 - protein, 9 aa, Homo Sapiens
LRTWGRALV

SEQ ID NO: 318861 - protein, 9 aa, Homo Sapiens
RWKPGWRTG

SEQ ID NO: 318862 - protein, 9 aa, Homo Sapiens
ILLDNFSTP

SEQ ID NO: 318863 - protein, 9 aa, Homo Sapiens
IRVPLHRLK

SEQ ID NO: 318864 - protein, 9 aa, Homo Sapiens
NMPTPTTDK

SEQ ID NO: 318865 - protein, 9 aa, Homo Sapiens
EVLTNMCFR

SEQ ID NO: 318866 - protein, 9 aa, Homo Sapiens
KTCGKAFRQ

SEQ ID NO: 318867 - protein, 9 aa, Homo Sapiens
TMVSPAVQE

SEQ ID NO: 318868 - protein, 9 aa, Homo Sapiens
SVLNLNCIL

SEQ ID NO: 318869 - protein, 9 aa, Homo Sapiens
KSIIDAHAN

SEQ ID NO: 318870 - protein, 9 aa, Homo Sapiens
GLTPTGVIV

SEQ ID NO: 318871 - protein, 9 aa, Homo Sapiens
AKTEKYWDS

SEQ ID NO: 318872 - protein, 9 aa, Homo Sapiens
WGTPWGRQG

SEQ ID NO: 318873 - protein, 9 aa, Homo Sapiens
YNLVQGQGP

SEQ ID NO: 318874 - protein, 9 aa, Homo Sapiens
RLANGGATN

SEQ ID NO: 318875 - protein, 9 aa, Homo Sapiens
FFVAIFTGE

SEQ ID NO: 318876 - protein, 9 aa, Homo Sapiens
LMSASGFLW

SEQ ID NO: 318877 - protein, 9 aa, Homo Sapiens
SEHPCIEEN

SEQ ID NO: 318878 - protein, 9 aa, Homo Sapiens
NDAAIRNYD

SEQ ID NO: 318879 - protein, 9 aa, Homo Sapiens
AKIRSYNHI

SEQ ID NO: 318880 - protein, 9 aa, Homo Sapiens
FSLASSLRR

SEQ ID NO: 318881 - protein, 9 aa, Homo Sapiens
IKLWLHIED

SEQ ID NO: 318882 - protein, 9 aa, Homo Sapiens
KPAPVPPPK

SEQ ID NO: 318883 - protein, 9 aa, Homo Sapiens
KSCWHWREA

SEQ ID NO: 318884 - protein, 9 aa, Homo Sapiens
MCPCWFQLD

SEQ ID NO: 318885 - protein, 9 aa, Homo Sapiens
ADGKEIHSL

SEQ ID NO: 318886 - protein, 9 aa, Homo Sapiens
ATVAFCDTQ

SEQ ID NO: 318887 - protein, 9 aa, Homo Sapiens
ELRFNTLTK

SEQ ID NO: 318888 - protein, 9 aa, Homo Sapiens
CRVLGHSVQ

SEQ ID NO: 318889 - protein, 9 aa, Homo Sapiens
LYAWDNGRQ

SEQ ID NO: 318890 - protein, 9 aa, Homo Sapiens
KDDRPLQVE

SEQ ID NO: 318891 - protein, 9 aa, Homo Sapiens
RWQDECQYR

SEQ ID NO: 318892 - protein, 9 aa, Homo Sapiens
KLTAKEEEA

SEQ ID NO: 318893 - protein, 9 aa, Homo Sapiens
SWSSSNGPH

SEQ ID NO: 318894 - protein, 9 aa, Homo Sapiens
IHFLVCAWD

SEQ ID NO: 318895 - protein, 9 aa, Homo Sapiens
WIYQAFLMS

SEQ ID NO: 318896 - protein, 9 aa, Homo Sapiens
MGRRPAHCY

SEQ ID NO: 318897 - protein, 9 aa, Homo Sapiens
IARLTISGL

SEQ ID NO: 318898 - protein, 9 aa, Homo Sapiens
AARTTIWLL

SEQ ID NO: 318899 - protein, 9 aa, Homo Sapiens
REKQGLALD

SEQ ID NO: 318900 - protein, 9 aa, Homo Sapiens
TEVVNEILE

SEQ ID NO: 318901 - protein, 9 aa, Homo Sapiens
RPGTCAARS

SEQ ID NO: 318902 - protein, 9 aa, Homo Sapiens
GSSWSSSNG

SEQ ID NO: 318903 - protein, 9 aa, Homo Sapiens
NSAQLDIDK

SEQ ID NO: 318904 - protein, 9 aa, Homo Sapiens
GFGFSPGGG

SEQ ID NO: 318905 - protein, 9 aa, Homo Sapiens
PPWRHGALP

SEQ ID NO: 318906 - protein, 9 aa, Homo Sapiens
RKESYSMYV

SEQ ID NO: 318907 - protein, 9 aa, Homo Sapiens
VDKYRHMCR

SEQ ID NO: 318908 - protein, 9 aa, Homo Sapiens
EGEPPAMSG

SEQ ID NO: 318909 - protein, 9 aa, Homo Sapiens
SYNGWGQGE

SEQ ID NO: 318910 - protein, 9 aa, Homo Sapiens
LLFSDVVTD

SEQ ID NO: 318911 - protein, 9 aa, Homo Sapiens
YWATFARTR

SEQ ID NO: 318912 - protein, 9 aa, Homo Sapiens
QDLLEKTRL

SEQ ID NO: 318913 - protein, 9 aa, Homo Sapiens
LYQCQGHMN

SEQ ID NO: 318914 - protein, 9 aa, Homo Sapiens
PLVAPPVAL

SEQ ID NO: 318915 - protein, 9 aa, Homo Sapiens
DKLGDQTTM

SEQ ID NO: 318916 - protein, 9 aa, Homo Sapiens
LDFVNQRTR

SEQ ID NO: 318917 - protein, 9 aa, Homo Sapiens
RRPHVRVEA

SEQ ID NO: 318918 - protein, 9 aa, Homo Sapiens
GGSDSMPSR

SEQ ID NO: 318919 - protein, 9 aa, Homo Sapiens
ENSESWEPH

SEQ ID NO: 318920 - protein, 9 aa, Homo Sapiens
HLSPMAHVL

SEQ ID NO: 318921 - protein, 9 aa, Homo Sapiens
CQGPCAPLP

SEQ ID NO: 318922 - protein, 9 aa, Homo Sapiens
LDMQPCIDL

SEQ ID NO: 318923 - protein, 9 aa, Homo Sapiens
GQDPCVITR

SEQ ID NO: 318924 - protein, 9 aa, Homo Sapiens
PLLESCTVR

SEQ ID NO: 318925 - protein, 9 aa, Homo Sapiens
RGGARPGGR

SEQ ID NO: 318926 - protein, 9 aa, Homo Sapiens
GRQPQVGLS

SEQ ID NO: 318927 - protein, 9 aa, Homo Sapiens
CVFLVRRFC

SEQ ID NO: 318928 - protein, 9 aa, Homo Sapiens
GAGQLPALR

SEQ ID NO: 318929 - protein, 9 aa, Homo Sapiens
RDYQQVVKR

SEQ ID NO: 318930 - protein, 9 aa, Homo Sapiens
IFHQGYGKP

SEQ ID NO: 318931 - protein, 9 aa, Homo Sapiens
EIIINFVWI

SEQ ID NO: 318932 - protein, 9 aa, Homo Sapiens
LILELRPAL

SEQ ID NO: 318933 - protein, 9 aa, Homo Sapiens
VPLHTQKDR

SEQ ID NO: 318934 - protein, 9 aa, Homo Sapiens
SITMLRNKI

SEQ ID NO: 318935 - protein, 9 aa, Homo Sapiens
KPKADMTGA

SEQ ID NO: 318936 - protein, 9 aa, Homo Sapiens
RLVFLKAGR

SEQ ID NO: 318937 - protein, 9 aa, Homo Sapiens
SYMKQPAGV

SEQ ID NO: 318938 - protein, 9 aa, Homo Sapiens
DAYASSCNS

SEQ ID NO: 318939 - protein, 9 aa, Homo Sapiens
MGQSKQSPL

SEQ ID NO: 318940 - protein, 9 aa, Homo Sapiens
PSVAVIGAP

SEQ ID NO: 318941 - protein, 9 aa, Homo Sapiens
SCHVWPPGD

SEQ ID NO: 318942 - protein, 9 aa, Homo Sapiens
LDNKVMLSF

SEQ ID NO: 318943 - protein, 9 aa, Homo Sapiens
AKGGPGPHG

SEQ ID NO: 318944 - protein, 9 aa, Homo Sapiens
CCAICRNRE

SEQ ID NO: 318945 - protein, 9 aa, Homo Sapiens
PPHVPPGTP

SEQ ID NO: 318946 - protein, 9 aa, Homo Sapiens
DIVTVQIEG

SEQ ID NO: 318947 - protein, 9 aa, Homo Sapiens
ATFPGDVDR

SEQ ID NO: 318948 - protein, 9 aa, Homo Sapiens
YSMYVYKVL

SEQ ID NO: 318949 - protein, 9 aa, Homo Sapiens
SGGPQKLVC

SEQ ID NO: 318950 - protein, 9 aa, Homo Sapiens
GEGPEATNV

SEQ ID NO: 318951 - protein, 9 aa, Homo Sapiens
APILKWALK

SEQ ID NO: 318952 - protein, 9 aa, Homo Sapiens
ICDARHPHV

SEQ ID NO: 318953 - protein, 9 aa, Homo Sapiens
KEGLLKVAQ

SEQ ID NO: 318954 - protein, 9 aa, Homo Sapiens
MGLVVERRR

SEQ ID NO: 318955 - protein, 9 aa, Homo Sapiens
AMHRNAYKC

SEQ ID NO: 318956 - protein, 9 aa, Homo Sapiens
DLKRCNRPC

SEQ ID NO: 318957 - protein, 9 aa, Homo Sapiens
TFQSWPNPK

SEQ ID NO: 318958 - protein, 9 aa, Homo Sapiens
EWARTEDYL

SEQ ID NO: 318959 - protein, 9 aa, Homo Sapiens
REPQTNHCK

SEQ ID NO: 318960 - protein, 9 aa, Homo Sapiens
GICRCLSEW

SEQ ID NO: 318961 - protein, 9 aa, Homo Sapiens
PGKPPSQFI

SEQ ID NO: 318962 - protein, 9 aa, Homo Sapiens
WVEVKDKGE

SEQ ID NO: 318963 - protein, 9 aa, Homo Sapiens
WHGQRGAPE

SEQ ID NO: 318964 - protein, 9 aa, Homo Sapiens
VQCWMPPLP

SEQ ID NO: 318965 - protein, 9 aa, Homo Sapiens
RLPPPRPLQ

SEQ ID NO: 318966 - protein, 9 aa, Homo Sapiens
DTALAHLES

SEQ ID NO: 318967 - protein, 9 aa, Homo Sapiens
SHFLAQLKE

SEQ ID NO: 318968 - protein, 9 aa, Homo Sapiens
PQTNHCKRA

SEQ ID NO: 318969 - protein, 9 aa, Homo Sapiens
EGEYQCFAC

SEQ ID NO: 318970 - protein, 9 aa, Homo Sapiens
NNQLFTQLL

SEQ ID NO: 318971 - protein, 9 aa, Homo Sapiens
GRLTYHLAV

SEQ ID NO: 318972 - protein, 9 aa, Homo Sapiens
DSWFRGLSN

SEQ ID NO: 318973 - protein, 9 aa, Homo Sapiens
PNTKKNWVS

SEQ ID NO: 318974 - protein, 9 aa, Homo Sapiens
LDRSYALAG

SEQ ID NO: 318975 - protein, 9 aa, Homo Sapiens
RRPCWSFPM

SEQ ID NO: 318976 - protein, 9 aa, Homo Sapiens
AASGSFFAW

SEQ ID NO: 318977 - protein, 9 aa, Homo Sapiens
SRQVTCLCT

SEQ ID NO: 318978 - protein, 9 aa, Homo Sapiens
RLDQAHPAS

SEQ ID NO: 318979 - protein, 9 aa, Homo Sapiens
GSWQEQLAR

SEQ ID NO: 318980 - protein, 9 aa, Homo Sapiens
DIAESHVNK

SEQ ID NO: 318981 - protein, 9 aa, Homo Sapiens
ISFNRVLGV

SEQ ID NO: 318982 - protein, 9 aa, Homo Sapiens
KEEELCKGG

SEQ ID NO: 318983 - protein, 9 aa, Homo Sapiens
TSLGKYIFT

SEQ ID NO: 318984 - protein, 9 aa, Homo Sapiens
LFVNSPEEH

SEQ ID NO: 318985 - protein, 9 aa, Homo Sapiens
PKAPGQFGH

SEQ ID NO: 318986 - protein, 9 aa, Homo Sapiens
CGGAMAEHG

SEQ ID NO: 318987 - protein, 9 aa, Homo Sapiens
LSFSVRLTY

SEQ ID NO: 318988 - protein, 9 aa, Homo Sapiens
PLRAGVRAA

SEQ ID NO: 318989 - protein, 9 aa, Homo Sapiens
LCSEIQMLN

SEQ ID NO: 318990 - protein, 9 aa, Homo Sapiens
RHWLTWVLL

SEQ ID NO: 318991 - protein, 9 aa, Homo Sapiens
VEIKESVCG

SEQ ID NO: 318992 - protein, 9 aa, Homo Sapiens
EEERRGGEE

SEQ ID NO: 318993 - protein, 9 aa, Homo Sapiens
YCKVAVLIH

SEQ ID NO: 318994 - protein, 9 aa, Homo Sapiens
SDPFPYPEE

SEQ ID NO: 318995 - protein, 9 aa, Homo Sapiens
HNLPSITLG

SEQ ID NO: 318996 - protein, 9 aa, Homo Sapiens
VDTRHKKME

SEQ ID NO: 318997 - protein, 9 aa, Homo Sapiens
MSALTPPTN

SEQ ID NO: 318998 - protein, 9 aa, Homo Sapiens
GQEFHSNTD

SEQ ID NO: 318999 - protein, 9 aa, Homo Sapiens
HLFSSFGQD

SEQ ID NO: 319000 - protein, 9 aa, Homo Sapiens
LLGDSNIHG

SEQ ID NO: 319001 - protein, 9 aa, Homo Sapiens
MEFAFRKRL

SEQ ID NO: 319002 - protein, 9 aa, Homo Sapiens
SVGRDSSLQ

SEQ ID NO: 319003 - protein, 9 aa, Homo Sapiens
SPVSPIRSP

SEQ ID NO: 319004 - protein, 9 aa, Homo Sapiens
YVYIKRKTN

SEQ ID NO: 319005 - protein, 9 aa, Homo Sapiens
TFLRLAVHE

SEQ ID NO: 319006 - protein, 9 aa, Homo Sapiens
LGPQVSSQV

SEQ ID NO: 319007 - protein, 9 aa, Homo Sapiens
LPPPRPLQR

SEQ ID NO: 319008 - protein, 9 aa, Homo Sapiens
LKALVKTWT

SEQ ID NO: 319009 - protein, 9 aa, Homo Sapiens
PVTLYGSSG

SEQ ID NO: 319010 - protein, 9 aa, Homo Sapiens
TSPAVSVLV

SEQ ID NO: 319011 - protein, 9 aa, Homo Sapiens
DRRGGARPG

SEQ ID NO: 319012 - protein, 9 aa, Homo Sapiens
AEGDASSWH

SEQ ID NO: 319013 - protein, 9 aa, Homo Sapiens
AQPPAGRQS

SEQ ID NO: 319014 - protein, 9 aa, Homo Sapiens
ATWAQRGGG

SEQ ID NO: 319015 - protein, 9 aa, Homo Sapiens
PLRGSDPVT

SEQ ID NO: 319016 - protein, 9 aa, Homo Sapiens
IGGVYQQAR

SEQ ID NO: 319017 - protein, 9 aa, Homo Sapiens
TYNKTDVAT

SEQ ID NO: 319018 - protein, 9 aa, Homo Sapiens
TIDDLEECL

SEQ ID NO: 319019 - protein, 9 aa, Homo Sapiens
PACSSTSFM

SEQ ID NO: 319020 - protein, 9 aa, Homo Sapiens
CFRFSGRTE

SEQ ID NO: 319021 - protein, 9 aa, Homo Sapiens
VLMDIFAKV

SEQ ID NO: 319022 - protein, 9 aa, Homo Sapiens
ITQNSTPIL

SEQ ID NO: 319023 - protein, 9 aa, Homo Sapiens
FREQSKGRI

SEQ ID NO: 319024 - protein, 9 aa, Homo Sapiens
RWSYNELGL

SEQ ID NO: 319025 - protein, 9 aa, Homo Sapiens
DYPQNSETG

SEQ ID NO: 319026 - protein, 9 aa, Homo Sapiens
SFHKVEMLK

SEQ ID NO: 319027 - protein, 9 aa, Homo Sapiens
PDRVDFRLS

SEQ ID NO: 319028 - protein, 9 aa, Homo Sapiens
REPDPARGS

SEQ ID NO: 319029 - protein, 9 aa, Homo Sapiens
EENTVMVAL

SEQ ID NO: 319030 - protein, 9 aa, Homo Sapiens
PAVPLGPAR

SEQ ID NO: 319031 - protein, 9 aa, Homo Sapiens
EIAAKHKKN

SEQ ID NO: 319032 - protein, 9 aa, Homo Sapiens
ARTRTLTGT

SEQ ID NO: 319033 - protein, 9 aa, Homo Sapiens
KKKQEPPCT

SEQ ID NO: 319034 - protein, 9 aa, Homo Sapiens
LNGALHFDE

SEQ ID NO: 319035 - protein, 9 aa, Homo Sapiens
PVFLKCENM

SEQ ID NO: 319036 - protein, 9 aa, Homo Sapiens
IPEKMQTHP

SEQ ID NO: 319037 - protein, 9 aa, Homo Sapiens
HEVPHEVRD

SEQ ID NO: 319038 - protein, 9 aa, Homo Sapiens
TTPPPPAAP

SEQ ID NO: 319039 - protein, 9 aa, Homo Sapiens
TEEVKKEAK

SEQ ID NO: 319040 - protein, 9 aa, Homo Sapiens
ALKCHGLGA

SEQ ID NO: 319041 - protein, 9 aa, Homo Sapiens
RVAATFPGD

SEQ ID NO: 319042 - protein, 9 aa, Homo Sapiens
TVEKHYGKV

SEQ ID NO: 319043 - protein, 9 aa, Homo Sapiens
PPFYHLSEI

SEQ ID NO: 319044 - protein, 9 aa, Homo Sapiens
EVRDFAILV

SEQ ID NO: 319045 - protein, 9 aa, Homo Sapiens
GTQPVAGAQ

SEQ ID NO: 319046 - protein, 9 aa, Homo Sapiens
LDWSSTIAS

SEQ ID NO: 319047 - protein, 9 aa, Homo Sapiens
RKGPQWHID

SEQ ID NO: 319048 - protein, 9 aa, Homo Sapiens
GGLPRHIGN

SEQ ID NO: 319049 - protein, 9 aa, Homo Sapiens
VMFGCGSMA

SEQ ID NO: 319050 - protein, 9 aa, Homo Sapiens
DASERGQLL

SEQ ID NO: 319051 - protein, 9 aa, Homo Sapiens
QVQIDELKL

SEQ ID NO: 319052 - protein, 9 aa, Homo Sapiens
GSQDYYVGK

SEQ ID NO: 319053 - protein, 9 aa, Homo Sapiens
SPRTLPCRP

SEQ ID NO: 319054 - protein, 9 aa, Homo Sapiens
SSHCDSHSP

SEQ ID NO: 319055 - protein, 9 aa, Homo Sapiens
LDMQPKKVR

SEQ ID NO: 319056 - protein, 9 aa, Homo Sapiens
MADPYVVIM

SEQ ID NO: 319057 - protein, 9 aa, Homo Sapiens
VIVSVQYFL

SEQ ID NO: 319058 - protein, 9 aa, Homo Sapiens
RCESKADWH

SEQ ID NO: 319059 - protein, 9 aa, Homo Sapiens
QQLMADAVV

SEQ ID NO: 319060 - protein, 9 aa, Homo Sapiens
YPSPSPPAA

SEQ ID NO: 319061 - protein, 9 aa, Homo Sapiens
LSQVAIDLH

SEQ ID NO: 319062 - protein, 9 aa, Homo Sapiens
MDCIRMQDL

SEQ ID NO: 319063 - protein, 9 aa, Homo Sapiens
LTLSDMYPH

SEQ ID NO: 319064 - protein, 9 aa, Homo Sapiens
QASIDTAII

SEQ ID NO: 319065 - protein, 9 aa, Homo Sapiens
KKNTPLHCA

SEQ ID NO: 319066 - protein, 9 aa, Homo Sapiens
GQHGSGSSW

SEQ ID NO: 319067 - protein, 9 aa, Homo Sapiens
KNTKAPGKP

SEQ ID NO: 319068 - protein, 9 aa, Homo Sapiens
SRSTYYNWW

SEQ ID NO: 319069 - protein, 9 aa, Homo Sapiens
ELLLVVPED

SEQ ID NO: 319070 - protein, 9 aa, Homo Sapiens
QPMLEAPGH

SEQ ID NO: 319071 - protein, 9 aa, Homo Sapiens
ASIPCHSPG

SEQ ID NO: 319072 - protein, 9 aa, Homo Sapiens
LGFKHIGDE

SEQ ID NO: 319073 - protein, 9 aa, Homo Sapiens
LKHRSPMPG

SEQ ID NO: 319074 - protein, 9 aa, Homo Sapiens
STFGATNLT

SEQ ID NO: 319075 - protein, 9 aa, Homo Sapiens
SASGFLWSL

SEQ ID NO: 319076 - protein, 9 aa, Homo Sapiens
NERTQLLSR

SEQ ID NO: 319077 - protein, 9 aa, Homo Sapiens
HQHSPNFLQ

SEQ ID NO: 319078 - protein, 9 aa, Homo Sapiens
LDWRGMPYG

SEQ ID NO: 319079 - protein, 9 aa, Homo Sapiens
VDSIMDVIF

SEQ ID NO: 319080 - protein, 9 aa, Homo Sapiens
LTIFTAHLY

SEQ ID NO: 319081 - protein, 9 aa, Homo Sapiens
QFETTAVNT

SEQ ID NO: 319082 - protein, 9 aa, Homo Sapiens
GRGRHWGTP

SEQ ID NO: 319083 - protein, 9 aa, Homo Sapiens
EMFAKGQSV

SEQ ID NO: 319084 - protein, 9 aa, Homo Sapiens
RPSLYWQLC

SEQ ID NO: 319085 - protein, 9 aa, Homo Sapiens
QIPEKMQTH

SEQ ID NO: 319086 - protein, 9 aa, Homo Sapiens
VTLGVDVNN

SEQ ID NO: 319087 - protein, 9 aa, Homo Sapiens
AASGLAYLH

SEQ ID NO: 319088 - protein, 9 aa, Homo Sapiens
PPLTPRCTL

SEQ ID NO: 319089 - protein, 9 aa, Homo Sapiens
LLVLQILVV

SEQ ID NO: 319090 - protein, 9 aa, Homo Sapiens
VLTLSLVLD

SEQ ID NO: 319091 - protein, 9 aa, Homo Sapiens
KDALSGAVQ

SEQ ID NO: 319092 - protein, 9 aa, Homo Sapiens
EHPCIEENP

SEQ ID NO: 319093 - protein, 9 aa, Homo Sapiens
QPPGLPNAS

SEQ ID NO: 319094 - protein, 9 aa, Homo Sapiens
LKEELQVFQ

SEQ ID NO: 319095 - protein, 9 aa, Homo Sapiens
HTLPVCLLR

SEQ ID NO: 319096 - protein, 9 aa, Homo Sapiens
GCSQLQLFP

SEQ ID NO: 319097 - protein, 9 aa, Homo Sapiens
GAQVESKAK

SEQ ID NO: 319098 - protein, 9 aa, Homo Sapiens
MDCLQTALL

SEQ ID NO: 319099 - protein, 9 aa, Homo Sapiens
HATPTQLPR

SEQ ID NO: 319100 - protein, 9 aa, Homo Sapiens
IWEKFNTPA

SEQ ID NO: 319101 - protein, 9 aa, Homo Sapiens
RARCESKAD

SEQ ID NO: 319102 - protein, 9 aa, Homo Sapiens
LKVIQHYIG

SEQ ID NO: 319103 - protein, 9 aa, Homo Sapiens
SCSFTKHKV

SEQ ID NO: 319104 - protein, 9 aa, Homo Sapiens
FRHLADGKK

SEQ ID NO: 319105 - protein, 9 aa, Homo Sapiens
YKCDVCEKG

SEQ ID NO: 319106 - protein, 9 aa, Homo Sapiens
EDSRHSSRR

SEQ ID NO: 319107 - protein, 9 aa, Homo Sapiens
TPLHCAAAS

SEQ ID NO: 319108 - protein, 9 aa, Homo Sapiens
DSAATSLQI

SEQ ID NO: 319109 - protein, 9 aa, Homo Sapiens
PPPTMVQGP

SEQ ID NO: 319110 - protein, 9 aa, Homo Sapiens
DFILMGLSD

SEQ ID NO: 319111 - protein, 9 aa, Homo Sapiens
PDVDACIAV

SEQ ID NO: 319112 - protein, 9 aa, Homo Sapiens
ISATWAQRG

SEQ ID NO: 319113 - protein, 9 aa, Homo Sapiens
IFPDSKDSP

SEQ ID NO: 319114 - protein, 9 aa, Homo Sapiens
ESASRRPPW

SEQ ID NO: 319115 - protein, 9 aa, Homo Sapiens
QLLLQPERP

SEQ ID NO: 319116 - protein, 9 aa, Homo Sapiens
PFVVSGRLD

SEQ ID NO: 319117 - protein, 9 aa, Homo Sapiens
LVYRNLQIT

SEQ ID NO: 319118 - protein, 9 aa, Homo Sapiens
YNDTTMVCC

SEQ ID NO: 319119 - protein, 9 aa, Homo Sapiens
AVFSLDRSY

SEQ ID NO: 319120 - protein, 9 aa, Homo Sapiens
GGARPGGRT

SEQ ID NO: 319121 - protein, 9 aa, Homo Sapiens
NENAKRRGR

SEQ ID NO: 319122 - protein, 9 aa, Homo Sapiens
AGYGVWNTA

SEQ ID NO: 319123 - protein, 9 aa, Homo Sapiens
CDYDVYARR

SEQ ID NO: 319124 - protein, 9 aa, Homo Sapiens
GKLQKVLLC

SEQ ID NO: 319125 - protein, 9 aa, Homo Sapiens
TQSEWHGWM

SEQ ID NO: 319126 - protein, 9 aa, Homo Sapiens
LALDRRGGA

SEQ ID NO: 319127 - protein, 9 aa, Homo Sapiens
PLLLCTAQP

SEQ ID NO: 319128 - protein, 9 aa, Homo Sapiens
ILFTFTARV

SEQ ID NO: 319129 - protein, 9 aa, Homo Sapiens
QTGRIFGGL

SEQ ID NO: 319130 - protein, 9 aa, Homo Sapiens
GMTHMDPYC

SEQ ID NO: 319131 - protein, 9 aa, Homo Sapiens
CICARDKEV

SEQ ID NO: 319132 - protein, 9 aa, Homo Sapiens
AAGRKRHTL

SEQ ID NO: 319133 - protein, 9 aa, Homo Sapiens
LPEETFISG

SEQ ID NO: 319134 - protein, 9 aa, Homo Sapiens
LLELVSSSM

SEQ ID NO: 319135 - protein, 9 aa, Homo Sapiens
LKCCGNGVV

SEQ ID NO: 319136 - protein, 9 aa, Homo Sapiens
LDAVLAWSD

SEQ ID NO: 319137 - protein, 9 aa, Homo Sapiens
KARDRSQSR

SEQ ID NO: 319138 - protein, 9 aa, Homo Sapiens
FRAPTFSYR

SEQ ID NO: 319139 - protein, 9 aa, Homo Sapiens
INLPIPLAY

SEQ ID NO: 319140 - protein, 9 aa, Homo Sapiens
ALCITDPET

SEQ ID NO: 319141 - protein, 9 aa, Homo Sapiens
MHSLTHSMK

SEQ ID NO: 319142 - protein, 9 aa, Homo Sapiens
RCICPPGSL

SEQ ID NO: 319143 - protein, 9 aa, Homo Sapiens
DLVMHARGV

SEQ ID NO: 319144 - protein, 9 aa, Homo Sapiens
GRSSWKSEH

SEQ ID NO: 319145 - protein, 9 aa, Homo Sapiens
VPLVDEGAP

SEQ ID NO: 319146 - protein, 9 aa, Homo Sapiens
PYKCNECCK

SEQ ID NO: 319147 - protein, 9 aa, Homo Sapiens
QVCALEKAR

SEQ ID NO: 319148 - protein, 9 aa, Homo Sapiens
RLRPMSMLY

SEQ ID NO: 319149 - protein, 9 aa, Homo Sapiens
EVDNELCIC

SEQ ID NO: 319150 - protein, 9 aa, Homo Sapiens
ATFTAHTAP

SEQ ID NO: 319151 - protein, 9 aa, Homo Sapiens
IGSELTRHE

SEQ ID NO: 319152 - protein, 9 aa, Homo Sapiens
HKFNLMYAK

SEQ ID NO: 319153 - protein, 9 aa, Homo Sapiens
HAESPGVPV

SEQ ID NO: 319154 - protein, 9 aa, Homo Sapiens
LMRKADSSS

SEQ ID NO: 319155 - protein, 9 aa, Homo Sapiens
QPVVLRSTM

SEQ ID NO: 319156 - protein, 9 aa, Homo Sapiens
MQVRLAAKK

SEQ ID NO: 319157 - protein, 9 aa, Homo Sapiens
FDWDHSGTL

SEQ ID NO: 319158 - protein, 9 aa, Homo Sapiens
RHAVRTPPC

SEQ ID NO: 319159 - protein, 9 aa, Homo Sapiens
SPLVAPPVA

SEQ ID NO: 319160 - protein, 9 aa, Homo Sapiens
SLNSTFGAT

SEQ ID NO: 319161 - protein, 9 aa, Homo Sapiens
KQTNVYSMA

SEQ ID NO: 319162 - protein, 9 aa, Homo Sapiens
DVGKSALTI

SEQ ID NO: 319163 - protein, 9 aa, Homo Sapiens
DGPPVFGEG

SEQ ID NO: 319164 - protein, 9 aa, Homo Sapiens
LWSSQREEG

SEQ ID NO: 319165 - protein, 9 aa, Homo Sapiens
AHTNCTLII

SEQ ID NO: 319166 - protein, 9 aa, Homo Sapiens
AKPESSESP

SEQ ID NO: 319167 - protein, 9 aa, Homo Sapiens
SWYDGIREE

SEQ ID NO: 319168 - protein, 9 aa, Homo Sapiens
ISRGYEPKQ

SEQ ID NO: 319169 - protein, 9 aa, Homo Sapiens
RPDPPQGLW

SEQ ID NO: 319170 - protein, 9 aa, Homo Sapiens
WQQFRHLAD

SEQ ID NO: 319171 - protein, 9 aa, Homo Sapiens
RAGVRAADP

SEQ ID NO: 319172 - protein, 9 aa, Homo Sapiens
FVTTSAHGG

SEQ ID NO: 319173 - protein, 9 aa, Homo Sapiens
FMRGRLYWK

SEQ ID NO: 319174 - protein, 9 aa, Homo Sapiens
MSCIALSLA

SEQ ID NO: 319175 - protein, 9 aa, Homo Sapiens
CCSGLGAGT

SEQ ID NO: 319176 - protein, 9 aa, Homo Sapiens
FDEIMGSQQ

SEQ ID NO: 319177 - protein, 9 aa, Homo Sapiens
GGAVFEMLE

SEQ ID NO: 319178 - protein, 9 aa, Homo Sapiens
HPLLSKWCP

SEQ ID NO: 319179 - protein, 9 aa, Homo Sapiens
ALLRELCIT

SEQ ID NO: 319180 - protein, 9 aa, Homo Sapiens
PVALPSDGR

SEQ ID NO: 319181 - protein, 9 aa, Homo Sapiens
QPSRGDDLG

SEQ ID NO: 319182 - protein, 9 aa, Homo Sapiens
HLPWIYQAF

SEQ ID NO: 319183 - protein, 9 aa, Homo Sapiens
PGPQWCAVQ

SEQ ID NO: 319184 - protein, 9 aa, Homo Sapiens
HLQIQHWLF

SEQ ID NO: 319185 - protein, 9 aa, Homo Sapiens
VSQQLQDDL

SEQ ID NO: 319186 - protein, 9 aa, Homo Sapiens
TGVMKDGVN

SEQ ID NO: 319187 - protein, 9 aa, Homo Sapiens
PAAAEDGPP

SEQ ID NO: 319188 - protein, 9 aa, Homo Sapiens
FRQIISAVH

SEQ ID NO: 319189 - protein, 9 aa, Homo Sapiens
SEDTPKSVP

SEQ ID NO: 319190 - protein, 9 aa, Homo Sapiens
KSSGASVTM

SEQ ID NO: 319191 - protein, 9 aa, Homo Sapiens
EQQIWNERD

SEQ ID NO: 319192 - protein, 9 aa, Homo Sapiens
SDSSESTVS

SEQ ID NO: 319193 - protein, 9 aa, Homo Sapiens
SSLGTLESQ

SEQ ID NO: 319194 - protein, 9 aa, Homo Sapiens
MTFAGAEVL

SEQ ID NO: 319195 - protein, 9 aa, Homo Sapiens
KEPQGVVYG

SEQ ID NO: 319196 - protein, 9 aa, Homo Sapiens
KIMSLRLCH

SEQ ID NO: 319197 - protein, 9 aa, Homo Sapiens
DGIREELEV

SEQ ID NO: 319198 - protein, 9 aa, Homo Sapiens
QEPPCTRLH

SEQ ID NO: 319199 - protein, 9 aa, Homo Sapiens
VSKELCMYD

SEQ ID NO: 319200 - protein, 9 aa, Homo Sapiens
NKARDRSQS

SEQ ID NO: 319201 - protein, 9 aa, Homo Sapiens
QSVAPYNTT

SEQ ID NO: 319202 - protein, 9 aa, Homo Sapiens
DAPHGVVWD

SEQ ID NO: 319203 - protein, 9 aa, Homo Sapiens
QKPNINTVA

SEQ ID NO: 319204 - protein, 9 aa, Homo Sapiens
IYQPPDRSA

SEQ ID NO: 319205 - protein, 9 aa, Homo Sapiens
RLVFQQGLV

SEQ ID NO: 319206 - protein, 9 aa, Homo Sapiens
RGSKIIVGD

SEQ ID NO: 319207 - protein, 9 aa, Homo Sapiens
HVQKLYTCA

SEQ ID NO: 319208 - protein, 9 aa, Homo Sapiens
CTQVLEDSE

SEQ ID NO: 319209 - protein, 9 aa, Homo Sapiens
PWRHGALPT

SEQ ID NO: 319210 - protein, 9 aa, Homo Sapiens
KRKHMDRMM

SEQ ID NO: 319211 - protein, 9 aa, Homo Sapiens
LLIPRQLHR

SEQ ID NO: 319212 - protein, 9 aa, Homo Sapiens
AWVRVSNIT

SEQ ID NO: 319213 - protein, 9 aa, Homo Sapiens
PQHKASPGW

SEQ ID NO: 319214 - protein, 9 aa, Homo Sapiens
PGGKEYLMW

SEQ ID NO: 319215 - protein, 9 aa, Homo Sapiens
STKILKTIK

SEQ ID NO: 319216 - protein, 9 aa, Homo Sapiens
SPLEESSCE

SEQ ID NO: 319217 - protein, 9 aa, Homo Sapiens
PHHYELSSI

SEQ ID NO: 319218 - protein, 9 aa, Homo Sapiens
MTCQVERFI

SEQ ID NO: 319219 - protein, 9 aa, Homo Sapiens
NITHGNSSI

SEQ ID NO: 319220 - protein, 9 aa, Homo Sapiens
GLALLHHSH

SEQ ID NO: 319221 - protein, 9 aa, Homo Sapiens
SLGIDQDHA

SEQ ID NO: 319222 - protein, 9 aa, Homo Sapiens
WTKAVFSLD

SEQ ID NO: 319223 - protein, 9 aa, Homo Sapiens
TASSGIMIP

SEQ ID NO: 319224 - protein, 9 aa, Homo Sapiens
CHGLGAVIP

SEQ ID NO: 319225 - protein, 9 aa, Homo Sapiens
LAAQDLVMH

SEQ ID NO: 319226 - protein, 9 aa, Homo Sapiens
IIFTLTWVL

SEQ ID NO: 319227 - protein, 9 aa, Homo Sapiens
HATATMKFL

SEQ ID NO: 319228 - protein, 9 aa, Homo Sapiens
MAFDRYVVI

SEQ ID NO: 319229 - protein, 9 aa, Homo Sapiens
SSDAKEVME

SEQ ID NO: 319230 - protein, 9 aa, Homo Sapiens
LVDTGCPIP

SEQ ID NO: 319231 - protein, 9 aa, Homo Sapiens
ACMRFQPSA

SEQ ID NO: 319232 - protein, 9 aa, Homo Sapiens
NEWATIEGL

SEQ ID NO: 319233 - protein, 9 aa, Homo Sapiens
HHAAANGLM

SEQ ID NO: 319234 - protein, 9 aa, Homo Sapiens
LTLLSARLP

SEQ ID NO: 319235 - protein, 9 aa, Homo Sapiens
PCASLRCPE

SEQ ID NO: 319236 - protein, 9 aa, Homo Sapiens
RQEFEEWME

SEQ ID NO: 319237 - protein, 9 aa, Homo Sapiens
CSWEGCEWH

SEQ ID NO: 319238 - protein, 9 aa, Homo Sapiens
RHRPQEQLH

SEQ ID NO: 319239 - protein, 9 aa, Homo Sapiens
IAEAKGQSV

SEQ ID NO: 319240 - protein, 9 aa, Homo Sapiens
LGSCFRFSG

SEQ ID NO: 319241 - protein, 9 aa, Homo Sapiens
SLTPDQYLK

SEQ ID NO: 319242 - protein, 9 aa, Homo Sapiens
EALEEEVKE

SEQ ID NO: 319243 - protein, 9 aa, Homo Sapiens
VKIKTFYDL

SEQ ID NO: 319244 - protein, 9 aa, Homo Sapiens
NVPSCCLLL

SEQ ID NO: 319245 - protein, 9 aa, Homo Sapiens
LEENNGMDK

SEQ ID NO: 319246 - protein, 9 aa, Homo Sapiens
IRGSVGCSC

SEQ ID NO: 319247 - protein, 9 aa, Homo Sapiens
YPQTQLRLE

SEQ ID NO: 319248 - protein, 9 aa, Homo Sapiens
AQALDGSPI

SEQ ID NO: 319249 - protein, 9 aa, Homo Sapiens
EGKRLWRVA

SEQ ID NO: 319250 - protein, 9 aa, Homo Sapiens
DMVQDLESR

SEQ ID NO: 319251 - protein, 9 aa, Homo Sapiens
SATWAQRGG

SEQ ID NO: 319252 - protein, 9 aa, Homo Sapiens
MVKIILTDE

SEQ ID NO: 319253 - protein, 9 aa, Homo Sapiens
NGVKPDIMH

SEQ ID NO: 319254 - protein, 9 aa, Homo Sapiens
PTRETDITQ

SEQ ID NO: 319255 - protein, 9 aa, Homo Sapiens
GHTGQKFSL

SEQ ID NO: 319256 - protein, 9 aa, Homo Sapiens
VTSPDPGEI

SEQ ID NO: 319257 - protein, 9 aa, Homo Sapiens
KNSMYIHKA

SEQ ID NO: 319258 - protein, 9 aa, Homo Sapiens
VCDYDVYAR

SEQ ID NO: 319259 - protein, 9 aa, Homo Sapiens
EEQAQIIWE

SEQ ID NO: 319260 - protein, 9 aa, Homo Sapiens
RPIKEVLMD

SEQ ID NO: 319261 - protein, 9 aa, Homo Sapiens
GLLPGEAAP

SEQ ID NO: 319262 - protein, 9 aa, Homo Sapiens
IPTMHLSVW

SEQ ID NO: 319263 - protein, 9 aa, Homo Sapiens
LAGQQPGSC

SEQ ID NO: 319264 - protein, 9 aa, Homo Sapiens
GATTEAQES

SEQ ID NO: 319265 - protein, 9 aa, Homo Sapiens
LKWALKVKQ

SEQ ID NO: 319266 - protein, 9 aa, Homo Sapiens
CSNIDKHWL

SEQ ID NO: 319267 - protein, 9 aa, Homo Sapiens
PMWCCSRIM

SEQ ID NO: 319268 - protein, 9 aa, Homo Sapiens
PPPVLTLSL

SEQ ID NO: 319269 - protein, 9 aa, Homo Sapiens
FGLDMQPCI

SEQ ID NO: 319270 - protein, 9 aa, Homo Sapiens
PGITGSSCT

SEQ ID NO: 319271 - protein, 9 aa, Homo Sapiens
DRQPLRSGP

SEQ ID NO: 319272 - protein, 9 aa, Homo Sapiens
KMVLRMFIS

SEQ ID NO: 319273 - protein, 9 aa, Homo Sapiens
NHITSVPKD

SEQ ID NO: 319274 - protein, 9 aa, Homo Sapiens
DLHGENPTL

SEQ ID NO: 319275 - protein, 9 aa, Homo Sapiens
TVPLVDEGA

SEQ ID NO: 319276 - protein, 9 aa, Homo Sapiens
WFDGQRATE

SEQ ID NO: 319277 - protein, 9 aa, Homo Sapiens
RQAVYDINR

SEQ ID NO: 319278 - protein, 9 aa, Homo Sapiens
EVKEILLWK

SEQ ID NO: 319279 - protein, 9 aa, Homo Sapiens
PLVVGNPDL

SEQ ID NO: 319280 - protein, 9 aa, Homo Sapiens
LIVHFQASE

SEQ ID NO: 319281 - protein, 9 aa, Homo Sapiens
TSSSAQEME

SEQ ID NO: 319282 - protein, 9 aa, Homo Sapiens
HTARWIQSK

SEQ ID NO: 319283 - protein, 9 aa, Homo Sapiens
WKRSAWRKT

SEQ ID NO: 319284 - protein, 9 aa, Homo Sapiens
DSHSPQEDG

SEQ ID NO: 319285 - protein, 9 aa, Homo Sapiens
RIKKLHKLF

SEQ ID NO: 319286 - protein, 9 aa, Homo Sapiens
SMYVYKVLK

SEQ ID NO: 319287 - protein, 9 aa, Homo Sapiens
IIKRFKLSL

SEQ ID NO: 319288 - protein, 9 aa, Homo Sapiens
HFEVFCVAL

SEQ ID NO: 319289 - protein, 9 aa, Homo Sapiens
LQQKPNINT

SEQ ID NO: 319290 - protein, 9 aa, Homo Sapiens
VCEKGFRYS

SEQ ID NO: 319291 - protein, 9 aa, Homo Sapiens
GLVPFDEIM

SEQ ID NO: 319292 - protein, 9 aa, Homo Sapiens
FGKHLSPMA

SEQ ID NO: 319293 - protein, 9 aa, Homo Sapiens
STGSMGSAG

SEQ ID NO: 319294 - protein, 9 aa, Homo Sapiens
LGLGCSQLQ

SEQ ID NO: 319295 - protein, 9 aa, Homo Sapiens
APDGSHASS

SEQ ID NO: 319296 - protein, 9 aa, Homo Sapiens
TSAHGGRVT

SEQ ID NO: 319297 - protein, 9 aa, Homo Sapiens
TAMDAYVKL

SEQ ID NO: 319298 - protein, 9 aa, Homo Sapiens
TAQFNQMTV

SEQ ID NO: 319299 - protein, 9 aa, Homo Sapiens
YRNLQITKN

SEQ ID NO: 319300 - protein, 9 aa, Homo Sapiens
LSCIDTCEN

SEQ ID NO: 319301 - protein, 9 aa, Homo Sapiens
RLRSLHTIA

SEQ ID NO: 319302 - protein, 9 aa, Homo Sapiens
GEQSDCPVI

SEQ ID NO: 319303 - protein, 9 aa, Homo Sapiens
PFVLIMSDI

SEQ ID NO: 319304 - protein, 9 aa, Homo Sapiens
SLETAAKSK

SEQ ID NO: 319305 - protein, 9 aa, Homo Sapiens
GRYVSAQPP

SEQ ID NO: 319306 - protein, 9 aa, Homo Sapiens
GQKTRDVKC

SEQ ID NO: 319307 - protein, 9 aa, Homo Sapiens
PAHPADAES

SEQ ID NO: 319308 - protein, 9 aa, Homo Sapiens
SKLQPEMLQ

SEQ ID NO: 319309 - protein, 9 aa, Homo Sapiens
QDVPVTVAL

SEQ ID NO: 319310 - protein, 9 aa, Homo Sapiens
RFNLYEDCK

SEQ ID NO: 319311 - protein, 9 aa, Homo Sapiens
TENHQGTLT

SEQ ID NO: 319312 - protein, 9 aa, Homo Sapiens
GQRPSLYWQ

SEQ ID NO: 319313 - protein, 9 aa, Homo Sapiens
VPHVGKNQS

SEQ ID NO: 319314 - protein, 9 aa, Homo Sapiens
FILMGLSDS

SEQ ID NO: 319315 - protein, 9 aa, Homo Sapiens
HNLSPLNGA

SEQ ID NO: 319316 - protein, 9 aa, Homo Sapiens
VNPGYCMSL

SEQ ID NO: 319317 - protein, 9 aa, Homo Sapiens
LAHHVLPTT

SEQ ID NO: 319318 - protein, 9 aa, Homo Sapiens
HCFMTSGIQ

SEQ ID NO: 319319 - protein, 9 aa, Homo Sapiens
QVTVDSIMP

SEQ ID NO: 319320 - protein, 9 aa, Homo Sapiens
GQFGHPVVV

SEQ ID NO: 319321 - protein, 9 aa, Homo Sapiens
WSFLGGWQE

SEQ ID NO: 319322 - protein, 9 aa, Homo Sapiens
SLHVNLDMG

SEQ ID NO: 319323 - protein, 9 aa, Homo Sapiens
GQRGAPELW

SEQ ID NO: 319324 - protein, 9 aa, Homo Sapiens
VAMVGDKVQ

SEQ ID NO: 319325 - protein, 9 aa, Homo Sapiens
QPGWPFGST

SEQ ID NO: 319326 - protein, 9 aa, Homo Sapiens
ELQNLMAAE

SEQ ID NO: 319327 - protein, 9 aa, Homo Sapiens
LPMRSLGEP

SEQ ID NO: 319328 - protein, 9 aa, Homo Sapiens
VKAKPSPWL

SEQ ID NO: 319329 - protein, 9 aa, Homo Sapiens
DRRVQNILI

SEQ ID NO: 319330 - protein, 9 aa, Homo Sapiens
RHRLLHCTE

SEQ ID NO: 319331 - protein, 9 aa, Homo Sapiens
GAVRRQRQA

SEQ ID NO: 319332 - protein, 9 aa, Homo Sapiens
GVGAPGGAP

SEQ ID NO: 319333 - protein, 9 aa, Homo Sapiens
LALASLLLW

SEQ ID NO: 319334 - protein, 9 aa, Homo Sapiens
LQEWLCLAC

SEQ ID NO: 319335 - protein, 9 aa, Homo Sapiens
SSTGSMGSA

SEQ ID NO: 319336 - protein, 9 aa, Homo Sapiens
GHYMRNNVC

SEQ ID NO: 319337 - protein, 9 aa, Homo Sapiens
GSASAPPSG

SEQ ID NO: 319338 - protein, 9 aa, Homo Sapiens
PRKEGTGST

SEQ ID NO: 319339 - protein, 9 aa, Homo Sapiens
CFGKKTSAF

SEQ ID NO: 319340 - protein, 9 aa, Homo Sapiens
DMQPKKVRK

SEQ ID NO: 319341 - protein, 9 aa, Homo Sapiens
VTALPRGPP

SEQ ID NO: 319342 - protein, 9 aa, Homo Sapiens
FTLTWVLHQ

SEQ ID NO: 319343 - protein, 9 aa, Homo Sapiens
LKVRRVSLK

SEQ ID NO: 319344 - protein, 9 aa, Homo Sapiens
SNIYTGLFL

SEQ ID NO: 319345 - protein, 9 aa, Homo Sapiens
RDAALILDQ

SEQ ID NO: 319346 - protein, 9 aa, Homo Sapiens
PRPRRLQSP

SEQ ID NO: 319347 - protein, 9 aa, Homo Sapiens
MGLSDSEEV

SEQ ID NO: 319348 - protein, 9 aa, Homo Sapiens
LSRISRELE

SEQ ID NO: 319349 - protein, 9 aa, Homo Sapiens
DMYGQVLKF

SEQ ID NO: 319350 - protein, 9 aa, Homo Sapiens
YPLTESQLV

SEQ ID NO: 319351 - protein, 9 aa, Homo Sapiens
KKVRSISLT

SEQ ID NO: 319352 - protein, 9 aa, Homo Sapiens
KQEEAWLTL

SEQ ID NO: 319353 - protein, 9 aa, Homo Sapiens
EFHSNTDHL

SEQ ID NO: 319354 - protein, 9 aa, Homo Sapiens
GEIATGPPV

SEQ ID NO: 319355 - protein, 9 aa, Homo Sapiens
DDKFFKIHT

SEQ ID NO: 319356 - protein, 9 aa, Homo Sapiens
GQLVRTGSA

SEQ ID NO: 319357 - protein, 9 aa, Homo Sapiens
GLGCSQLQL

SEQ ID NO: 319358 - protein, 9 aa, Homo Sapiens
SLPASSLAH

SEQ ID NO: 319359 - protein, 9 aa, Homo Sapiens
GWNMQLLPV

SEQ ID NO: 319360 - protein, 9 aa, Homo Sapiens
QPAAPSLMR

SEQ ID NO: 319361 - protein, 9 aa, Homo Sapiens
FPCQSSTHN

SEQ ID NO: 319362 - protein, 9 aa, Homo Sapiens
LLQPERPGD

SEQ ID NO: 319363 - protein, 9 aa, Homo Sapiens
VVTIKQVPV

SEQ ID NO: 319364 - protein, 9 aa, Homo Sapiens
QEEAWLTLA

SEQ ID NO: 319365 - protein, 9 aa, Homo Sapiens
VRSVCQDNE

SEQ ID NO: 319366 - protein, 9 aa, Homo Sapiens
GETIYFIAS

SEQ ID NO: 319367 - protein, 9 aa, Homo Sapiens
HHVHARIIG

SEQ ID NO: 319368 - protein, 9 aa, Homo Sapiens
EVEVEVYRW

SEQ ID NO: 319369 - protein, 9 aa, Homo Sapiens
YGKKLVKIS

SEQ ID NO: 319370 - protein, 9 aa, Homo Sapiens
RSSSHCSCG

SEQ ID NO: 319371 - protein, 9 aa, Homo Sapiens
SALHVTALP

SEQ ID NO: 319372 - protein, 9 aa, Homo Sapiens
AHLYYFQYP

SEQ ID NO: 319373 - protein, 9 aa, Homo Sapiens
MSSQASTGS

SEQ ID NO: 319374 - protein, 9 aa, Homo Sapiens
ARPDSANSA

SEQ ID NO: 319375 - protein, 9 aa, Homo Sapiens
ECSCMKGGT

SEQ ID NO: 319376 - protein, 9 aa, Homo Sapiens
NCPRIPNSD

SEQ ID NO: 319377 - protein, 9 aa, Homo Sapiens
DEDMETEVV

SEQ ID NO: 319378 - protein, 9 aa, Homo Sapiens
RRTEPRCCS

SEQ ID NO: 319379 - protein, 9 aa, Homo Sapiens
WNGDKYLGH

SEQ ID NO: 319380 - protein, 9 aa, Homo Sapiens
YQCQGHMNV

SEQ ID NO: 319381 - protein, 9 aa, Homo Sapiens
AHHAAANGL

SEQ ID NO: 319382 - protein, 9 aa, Homo Sapiens
QIQADSFIQ

SEQ ID NO: 319383 - protein, 9 aa, Homo Sapiens
VHPATFTAH

SEQ ID NO: 319384 - protein, 9 aa, Homo Sapiens
APKRFRDEP

SEQ ID NO: 319385 - protein, 9 aa, Homo Sapiens
LARWGPSPR

SEQ ID NO: 319386 - protein, 9 aa, Homo Sapiens
NEKFHMWPA

SEQ ID NO: 319387 - protein, 9 aa, Homo Sapiens
IMRSLRVLN

SEQ ID NO: 319388 - protein, 9 aa, Homo Sapiens
CYKCGKSFR

SEQ ID NO: 319389 - protein, 9 aa, Homo Sapiens
NKDDRPLQV

SEQ ID NO: 319390 - protein, 9 aa, Homo Sapiens
SGDQLAEEQ

SEQ ID NO: 319391 - protein, 9 aa, Homo Sapiens
MQPDPRPNG

SEQ ID NO: 319392 - protein, 9 aa, Homo Sapiens
VPLDHHVHA

SEQ ID NO: 319393 - protein, 9 aa, Homo Sapiens
ECADAARGL

SEQ ID NO: 319394 - protein, 9 aa, Homo Sapiens
ASPAHDPQW

SEQ ID NO: 319395 - protein, 9 aa, Homo Sapiens
TLLSARLPP

SEQ ID NO: 319396 - protein, 9 aa, Homo Sapiens
GKFIHTKLQ

SEQ ID NO: 319397 - protein, 9 aa, Homo Sapiens
DEEEAELWG

SEQ ID NO: 319398 - protein, 9 aa, Homo Sapiens
KPESSESPS

SEQ ID NO: 319399 - protein, 9 aa, Homo Sapiens
RSRGAGSTQ

SEQ ID NO: 319400 - protein, 9 aa, Homo Sapiens
DSDEPWMLG

SEQ ID NO: 319401 - protein, 9 aa, Homo Sapiens
LLTEHQLDL

SEQ ID NO: 319402 - protein, 9 aa, Homo Sapiens
GKKRRRRRS

SEQ ID NO: 319403 - protein, 9 aa, Homo Sapiens
ARRPHQQDP

SEQ ID NO: 319404 - protein, 9 aa, Homo Sapiens
TLRWSYNEL

SEQ ID NO: 319405 - protein, 9 aa, Homo Sapiens
CDVCEKGFR

SEQ ID NO: 319406 - protein, 9 aa, Homo Sapiens
NRNSQMIRE

SEQ ID NO: 319407 - protein, 9 aa, Homo Sapiens
SVWSSRCSD

SEQ ID NO: 319408 - protein, 9 aa, Homo Sapiens
LVRVPLHTQ

SEQ ID NO: 319409 - protein, 9 aa, Homo Sapiens
VLRYRDYQQ

SEQ ID NO: 319410 - protein, 9 aa, Homo Sapiens
ERTQLLSRD

SEQ ID NO: 319411 - protein, 9 aa, Homo Sapiens
VKCQGQQEI

SEQ ID NO: 319412 - protein, 9 aa, Homo Sapiens
GTTQISVRV

SEQ ID NO: 319413 - protein, 9 aa, Homo Sapiens
EYPKMCQYL

SEQ ID NO: 319414 - protein, 9 aa, Homo Sapiens
DWEKLEHKE

SEQ ID NO: 319415 - protein, 9 aa, Homo Sapiens
LVCAWDSTY

SEQ ID NO: 319416 - protein, 9 aa, Homo Sapiens
YHCSASTRL

SEQ ID NO: 319417 - protein, 9 aa, Homo Sapiens
LTDEEGGEG

SEQ ID NO: 319418 - protein, 9 aa, Homo Sapiens
LAAQKNKVK

SEQ ID NO: 319419 - protein, 9 aa, Homo Sapiens
LCECVGGDL

SEQ ID NO: 319420 - protein, 9 aa, Homo Sapiens
GKRLWRVAC

SEQ ID NO: 319421 - protein, 9 aa, Homo Sapiens
PEDIVTVQI

SEQ ID NO: 319422 - protein, 9 aa, Homo Sapiens
DVWPYIVGA

SEQ ID NO: 319423 - protein, 9 aa, Homo Sapiens
RTHDVTEKV

SEQ ID NO: 319424 - protein, 9 aa, Homo Sapiens
GGKGYGSEN

SEQ ID NO: 319425 - protein, 9 aa, Homo Sapiens
VPLKGCLLC

SEQ ID NO: 319426 - protein, 9 aa, Homo Sapiens
YLLWDGGLK

SEQ ID NO: 319427 - protein, 9 aa, Homo Sapiens
CIEENPGKF

SEQ ID NO: 319428 - protein, 9 aa, Homo Sapiens
SAAECYRLH

SEQ ID NO: 319429 - protein, 9 aa, Homo Sapiens
ARPGGRTRR

SEQ ID NO: 319430 - protein, 9 aa, Homo Sapiens
NQTFEELTL

SEQ ID NO: 319431 - protein, 9 aa, Homo Sapiens
PEPSFMWYK

SEQ ID NO: 319432 - protein, 9 aa, Homo Sapiens
SVWKRKHMD

SEQ ID NO: 319433 - protein, 9 aa, Homo Sapiens
LCTAQPDLR

SEQ ID NO: 319434 - protein, 9 aa, Homo Sapiens
ILDQLRACQ

SEQ ID NO: 319435 - protein, 9 aa, Homo Sapiens
MIDTKLEKP

SEQ ID NO: 319436 - protein, 9 aa, Homo Sapiens
RRGPLRVTS

SEQ ID NO: 319437 - protein, 9 aa, Homo Sapiens
VNYNGQHPN

SEQ ID NO: 319438 - protein, 9 aa, Homo Sapiens
MVIIRQHEI

SEQ ID NO: 319439 - protein, 9 aa, Homo Sapiens
FSYCMGNVL

SEQ ID NO: 319440 - protein, 9 aa, Homo Sapiens
IGKKRILTI

SEQ ID NO: 319441 - protein, 9 aa, Homo Sapiens
GALHFDETE

SEQ ID NO: 319442 - protein, 9 aa, Homo Sapiens
ATTSSSAQE

SEQ ID NO: 319443 - protein, 9 aa, Homo Sapiens
DSKFFMTVP

SEQ ID NO: 319444 - protein, 9 aa, Homo Sapiens
LRPSQRRPH

SEQ ID NO: 319445 - protein, 9 aa, Homo Sapiens
LFESIATAP

SEQ ID NO: 319446 - protein, 9 aa, Homo Sapiens
KKLQKKKNK

SEQ ID NO: 319447 - protein, 9 aa, Homo Sapiens
AAGWGSQAT

SEQ ID NO: 319448 - protein, 9 aa, Homo Sapiens
RRRPHVRVE

SEQ ID NO: 319449 - protein, 9 aa, Homo Sapiens
ANGAGWPCP

SEQ ID NO: 319450 - protein, 9 aa, Homo Sapiens
GAPEPEGKD

SEQ ID NO: 319451 - protein, 9 aa, Homo Sapiens
PQTQLRLEE

SEQ ID NO: 319452 - protein, 9 aa, Homo Sapiens
AEHSRLRIE

SEQ ID NO: 319453 - protein, 9 aa, Homo Sapiens
GLPQFYPLR

SEQ ID NO: 319454 - protein, 9 aa, Homo Sapiens
KISPNGNDT

SEQ ID NO: 319455 - protein, 9 aa, Homo Sapiens
QTLFREQSK

SEQ ID NO: 319456 - protein, 9 aa, Homo Sapiens
WKPGWRTGL

SEQ ID NO: 319457 - protein, 9 aa, Homo Sapiens
KDLCGKIVA

SEQ ID NO: 319458 - protein, 9 aa, Homo Sapiens
AFGIGSELT

SEQ ID NO: 319459 - protein, 9 aa, Homo Sapiens
IRSLIQRFP

SEQ ID NO: 319460 - protein, 9 aa, Homo Sapiens
HSRLRIEEE

SEQ ID NO: 319461 - protein, 9 aa, Homo Sapiens
EFGGAMGLC

SEQ ID NO: 319462 - protein, 9 aa, Homo Sapiens
TCAARSQLP

SEQ ID NO: 319463 - protein, 9 aa, Homo Sapiens
GPQLITIHK

SEQ ID NO: 319464 - protein, 9 aa, Homo Sapiens
APSMGTLVG

SEQ ID NO: 319465 - protein, 9 aa, Homo Sapiens
EKKRVVKKT

SEQ ID NO: 319466 - protein, 9 aa, Homo Sapiens
DAKVVVLGE

SEQ ID NO: 319467 - protein, 9 aa, Homo Sapiens
PFKVVKKKA

SEQ ID NO: 319468 - protein, 9 aa, Homo Sapiens
LLCCEASDK

SEQ ID NO: 319469 - protein, 9 aa, Homo Sapiens
QLLNNLRVH

SEQ ID NO: 319470 - protein, 9 aa, Homo Sapiens
NLSPLNGAL

SEQ ID NO: 319471 - protein, 9 aa, Homo Sapiens
LRDVWLEEE

SEQ ID NO: 319472 - protein, 9 aa, Homo Sapiens
KSKFLFLVS

SEQ ID NO: 319473 - protein, 9 aa, Homo Sapiens
DFLVETCEN

SEQ ID NO: 319474 - protein, 9 aa, Homo Sapiens
TNYNTFGSA

SEQ ID NO: 319475 - protein, 9 aa, Homo Sapiens
CRTKFCACC

SEQ ID NO: 319476 - protein, 9 aa, Homo Sapiens
KLFVTVCWL

SEQ ID NO: 319477 - protein, 9 aa, Homo Sapiens
KGTKLDDDF

SEQ ID NO: 319478 - protein, 9 aa, Homo Sapiens
QTHPRIDPD

SEQ ID NO: 319479 - protein, 9 aa, Homo Sapiens
LLLLPLPRS

SEQ ID NO: 319480 - protein, 9 aa, Homo Sapiens
GALPTSPGA

SEQ ID NO: 319481 - protein, 9 aa, Homo Sapiens
ASVASRHGT

SEQ ID NO: 319482 - protein, 9 aa, Homo Sapiens
RLANLTQGK

SEQ ID NO: 319483 - protein, 9 aa, Homo Sapiens
ADHCAFHNL

SEQ ID NO: 319484 - protein, 9 aa, Homo Sapiens
HSLSRMVTE

SEQ ID NO: 319485 - protein, 9 aa, Homo Sapiens
AKERTHSTA

SEQ ID NO: 319486 - protein, 9 aa, Homo Sapiens
SLYGKKLVK

SEQ ID NO: 319487 - protein, 9 aa, Homo Sapiens
SCCSATEIM

SEQ ID NO: 319488 - protein, 9 aa, Homo Sapiens
ITGSSCTQR

SEQ ID NO: 319489 - protein, 9 aa, Homo Sapiens
RKALQSPVS

SEQ ID NO: 319490 - protein, 9 aa, Homo Sapiens
DNLSPQPEV

SEQ ID NO: 319491 - protein, 9 aa, Homo Sapiens
RHRRLHLPQ

SEQ ID NO: 319492 - protein, 9 aa, Homo Sapiens
RHGRPRADT

SEQ ID NO: 319493 - protein, 9 aa, Homo Sapiens
NLLVLQILV

SEQ ID NO: 319494 - protein, 9 aa, Homo Sapiens
TSFMVSWPS

SEQ ID NO: 319495 - protein, 9 aa, Homo Sapiens
YGAKPPIAP

SEQ ID NO: 319496 - protein, 9 aa, Homo Sapiens
NTISRAKIQ

SEQ ID NO: 319497 - protein, 9 aa, Homo Sapiens
LYLDHNKVI

SEQ ID NO: 319498 - protein, 9 aa, Homo Sapiens
SHDVVICPD

SEQ ID NO: 319499 - protein, 9 aa, Homo Sapiens
IHDVARAGF

SEQ ID NO: 319500 - protein, 9 aa, Homo Sapiens
SFNRVLGVS

SEQ ID NO: 319501 - protein, 9 aa, Homo Sapiens
SQHQGLPGR

SEQ ID NO: 319502 - protein, 9 aa, Homo Sapiens
YTCEAGASG

SEQ ID NO: 319503 - protein, 9 aa, Homo Sapiens
AMVGDKVQL

SEQ ID NO: 319504 - protein, 9 aa, Homo Sapiens
GLVFLSLVL

SEQ ID NO: 319505 - protein, 9 aa, Homo Sapiens
DQRASDYNQ

SEQ ID NO: 319506 - protein, 9 aa, Homo Sapiens
ESSRMEIRN

SEQ ID NO: 319507 - protein, 9 aa, Homo Sapiens
GSTLEWDNY

SEQ ID NO: 319508 - protein, 9 aa, Homo Sapiens
TIWLLESLI

SEQ ID NO: 319509 - protein, 9 aa, Homo Sapiens
WVLQCFGKK

SEQ ID NO: 319510 - protein, 9 aa, Homo Sapiens
CITHWWEDL

SEQ ID NO: 319511 - protein, 9 aa, Homo Sapiens
VGARVHTAE

SEQ ID NO: 319512 - protein, 9 aa, Homo Sapiens
VHASERLAE

SEQ ID NO: 319513 - protein, 9 aa, Homo Sapiens
SAPCVPPLQ

SEQ ID NO: 319514 - protein, 9 aa, Homo Sapiens
DKKVLKVAR

SEQ ID NO: 319515 - protein, 9 aa, Homo Sapiens
WLPMRSLGE

SEQ ID NO: 319516 - protein, 9 aa, Homo Sapiens
EDDEPDCCD

SEQ ID NO: 319517 - protein, 9 aa, Homo Sapiens
LFQGIEFHY

SEQ ID NO: 319518 - protein, 9 aa, Homo Sapiens
SQAKVQWIL

SEQ ID NO: 319519 - protein, 9 aa, Homo Sapiens
HFLVCAWDS

SEQ ID NO: 319520 - protein, 9 aa, Homo Sapiens
KQRLGGGSS

SEQ ID NO: 319521 - protein, 9 aa, Homo Sapiens
ASRRPPWLP

SEQ ID NO: 319522 - protein, 9 aa, Homo Sapiens
GRARCESKA

SEQ ID NO: 319523 - protein, 9 aa, Homo Sapiens
LPVTLTCQL

SEQ ID NO: 319524 - protein, 9 aa, Homo Sapiens
VRVSNITDQ

SEQ ID NO: 319525 - protein, 9 aa, Homo Sapiens
VARGCLTYY

SEQ ID NO: 319526 - protein, 9 aa, Homo Sapiens
CVLCNKDPF

SEQ ID NO: 319527 - protein, 9 aa, Homo Sapiens
GRNLLIIGT

SEQ ID NO: 319528 - protein, 9 aa, Homo Sapiens
RIRRDSIGV

SEQ ID NO: 319529 - protein, 9 aa, Homo Sapiens
VLFHAAKAY

SEQ ID NO: 319530 - protein, 9 aa, Homo Sapiens
EPDPARGSC

SEQ ID NO: 319531 - protein, 9 aa, Homo Sapiens
WAAVDVLCR

SEQ ID NO: 319532 - protein, 9 aa, Homo Sapiens
PLSTTVTLT

SEQ ID NO: 319533 - protein, 9 aa, Homo Sapiens
RVLLPLLLC

SEQ ID NO: 319534 - protein, 9 aa, Homo Sapiens
VVIHMRSVE

SEQ ID NO: 319535 - protein, 9 aa, Homo Sapiens
LPTSPGASE

SEQ ID NO: 319536 - protein, 9 aa, Homo Sapiens
IAMLEMWWN

SEQ ID NO: 319537 - protein, 9 aa, Homo Sapiens
AGAAHLEHL

SEQ ID NO: 319538 - protein, 9 aa, Homo Sapiens
VSSLTPDQY

SEQ ID NO: 319539 - protein, 9 aa, Homo Sapiens
IHYPDITTG

SEQ ID NO: 319540 - protein, 9 aa, Homo Sapiens
VIFFYIKSP

SEQ ID NO: 319541 - protein, 9 aa, Homo Sapiens
SGGRPGGFL

SEQ ID NO: 319542 - protein, 9 aa, Homo Sapiens
PALRPLQHE

SEQ ID NO: 319543 - protein, 9 aa, Homo Sapiens
STLLHHRRS

SEQ ID NO: 319544 - protein, 9 aa, Homo Sapiens
LSHLGRAEL

SEQ ID NO: 319545 - protein, 9 aa, Homo Sapiens
ALPTSPGAS

SEQ ID NO: 319546 - protein, 9 aa, Homo Sapiens
ESWLFDLHG

SEQ ID NO: 319547 - protein, 9 aa, Homo Sapiens
SGMNWQQYW

SEQ ID NO: 319548 - protein, 9 aa, Homo Sapiens
PQPLPPSSW

SEQ ID NO: 319549 - protein, 9 aa, Homo Sapiens
PVSLVQEGT

SEQ ID NO: 319550 - protein, 9 aa, Homo Sapiens
WPIQMVKGG

SEQ ID NO: 319551 - protein, 9 aa, Homo Sapiens
ADGYAYFMR

SEQ ID NO: 319552 - protein, 9 aa, Homo Sapiens
WLVVDSIMD

SEQ ID NO: 319553 - protein, 9 aa, Homo Sapiens
LLHPPQLHL

SEQ ID NO: 319554 - protein, 9 aa, Homo Sapiens
RHVLVYSCR

SEQ ID NO: 319555 - protein, 9 aa, Homo Sapiens
WKVDQGLFV

SEQ ID NO: 319556 - protein, 9 aa, Homo Sapiens
RRITNEGQI

SEQ ID NO: 319557 - protein, 9 aa, Homo Sapiens
TSQANFNKT

SEQ ID NO: 319558 - protein, 9 aa, Homo Sapiens
QGSASAPPS

SEQ ID NO: 319559 - protein, 9 aa, Homo Sapiens
EPTWTTLAP

SEQ ID NO: 319560 - protein, 9 aa, Homo Sapiens
YRIREPQTN

SEQ ID NO: 319561 - protein, 9 aa, Homo Sapiens
QEFEEWMEE

SEQ ID NO: 319562 - protein, 9 aa, Homo Sapiens
IDPFTHEAC

SEQ ID NO: 319563 - protein, 9 aa, Homo Sapiens
SSHRNQSER

SEQ ID NO: 319564 - protein, 9 aa, Homo Sapiens
TMYTGGNGF

SEQ ID NO: 319565 - protein, 9 aa, Homo Sapiens
QEDQHRLLK

SEQ ID NO: 319566 - protein, 9 aa, Homo Sapiens
EAVVVDISG

SEQ ID NO: 319567 - protein, 9 aa, Homo Sapiens
AYTYSTMVS

SEQ ID NO: 319568 - protein, 9 aa, Homo Sapiens
MYECLHVAN

SEQ ID NO: 319569 - protein, 9 aa, Homo Sapiens
SPPCTLVWY

SEQ ID NO: 319570 - protein, 9 aa, Homo Sapiens
VGWKPTMKW

SEQ ID NO: 319571 - protein, 9 aa, Homo Sapiens
KALHRGLVD

SEQ ID NO: 319572 - protein, 9 aa, Homo Sapiens
GDYTYLQIN

SEQ ID NO: 319573 - protein, 9 aa, Homo Sapiens
HQDSEILSD

SEQ ID NO: 319574 - protein, 9 aa, Homo Sapiens
HANGWVQYT

SEQ ID NO: 319575 - protein, 9 aa, Homo Sapiens
NPGPKCAQG

SEQ ID NO: 319576 - protein, 9 aa, Homo Sapiens
LPSSARPWG

SEQ ID NO: 319577 - protein, 9 aa, Homo Sapiens
GAVQQREAD

SEQ ID NO: 319578 - protein, 9 aa, Homo Sapiens
PWLPAPPPW

SEQ ID NO: 319579 - protein, 9 aa, Homo Sapiens
GEGCLGKCS

SEQ ID NO: 319580 - protein, 9 aa, Homo Sapiens
PYHRHPVLR

SEQ ID NO: 319581 - protein, 9 aa, Homo Sapiens
RPSDWPPRA

SEQ ID NO: 319582 - protein, 9 aa, Homo Sapiens
PSPDTSQLA

SEQ ID NO: 319583 - protein, 9 aa, Homo Sapiens
MSIPLLLLL

SEQ ID NO: 319584 - protein, 9 aa, Homo Sapiens
NDPHPLLHQ

SEQ ID NO: 319585 - protein, 9 aa, Homo Sapiens
NHPSFDAIL

SEQ ID NO: 319586 - protein, 9 aa, Homo Sapiens
WEKPPHPTC

SEQ ID NO: 319587 - protein, 9 aa, Homo Sapiens
YYDVGARVH

SEQ ID NO: 319588 - protein, 9 aa, Homo Sapiens
LGKYIFTSI

SEQ ID NO: 319589 - protein, 9 aa, Homo Sapiens
GPSSHFRVL

SEQ ID NO: 319590 - protein, 9 aa, Homo Sapiens
AYKCMSQIQ

SEQ ID NO: 319591 - protein, 9 aa, Homo Sapiens
GTKPKTMAI

SEQ ID NO: 319592 - protein, 9 aa, Homo Sapiens
SREWKKITD

SEQ ID NO: 319593 - protein, 9 aa, Homo Sapiens
EQERILYQF

SEQ ID NO: 319594 - protein, 9 aa, Homo Sapiens
SVFIPEEEV

SEQ ID NO: 319595 - protein, 9 aa, Homo Sapiens
AMKSLFNRA

SEQ ID NO: 319596 - protein, 9 aa, Homo Sapiens
LAMTAISFH

SEQ ID NO: 319597 - protein, 9 aa, Homo Sapiens
QRELERLHA

SEQ ID NO: 319598 - protein, 9 aa, Homo Sapiens
KERRPCWSF

SEQ ID NO: 319599 - protein, 9 aa, Homo Sapiens
SGASVTMQP

SEQ ID NO: 319600 - protein, 9 aa, Homo Sapiens
FINPLVFFT

SEQ ID NO: 319601 - protein, 9 aa, Homo Sapiens
PVGFPMWGR

SEQ ID NO: 319602 - protein, 9 aa, Homo Sapiens
MMPRSSSHC

SEQ ID NO: 319603 - protein, 9 aa, Homo Sapiens
LVVPEDVEA

SEQ ID NO: 319604 - protein, 9 aa, Homo Sapiens
LAPNECLWT

SEQ ID NO: 319605 - protein, 9 aa, Homo Sapiens
GAIMIPPIP

SEQ ID NO: 319606 - protein, 9 aa, Homo Sapiens
DRIMNTFNV

SEQ ID NO: 319607 - protein, 9 aa, Homo Sapiens
NNAENAAHK

SEQ ID NO: 319608 - protein, 9 aa, Homo Sapiens
ALREWLGRA

SEQ ID NO: 319609 - protein, 9 aa, Homo Sapiens
DDILILTVL

SEQ ID NO: 319610 - protein, 9 aa, Homo Sapiens
FDLHEEPSA

SEQ ID NO: 319611 - protein, 9 aa, Homo Sapiens
PLLTKGKAK

SEQ ID NO: 319612 - protein, 9 aa, Homo Sapiens
KDRYCSNID

SEQ ID NO: 319613 - protein, 9 aa, Homo Sapiens
GLCSNKKKK

SEQ ID NO: 319614 - protein, 9 aa, Homo Sapiens
WPSRLGSRM

SEQ ID NO: 319615 - protein, 9 aa, Homo Sapiens
GIRHGRPRA

SEQ ID NO: 319616 - protein, 9 aa, Homo Sapiens
NPVVTNQIE

SEQ ID NO: 319617 - protein, 9 aa, Homo Sapiens
GAGAAHLEH

SEQ ID NO: 319618 - protein, 9 aa, Homo Sapiens
CLAEDVQRA

SEQ ID NO: 319619 - protein, 9 aa, Homo Sapiens
SLGEAVDTS

SEQ ID NO: 319620 - protein, 9 aa, Homo Sapiens
TNPTSVQTL

SEQ ID NO: 319621 - protein, 9 aa, Homo Sapiens
CSSLHSAHQ

SEQ ID NO: 319622 - protein, 9 aa, Homo Sapiens
FNDMVKQGY

SEQ ID NO: 319623 - protein, 9 aa, Homo Sapiens
ITVMLLFFP

SEQ ID NO: 319624 - protein, 9 aa, Homo Sapiens
PGVGAPGGA

SEQ ID NO: 319625 - protein, 9 aa, Homo Sapiens
MSSILCHCC

SEQ ID NO: 319626 - protein, 9 aa, Homo Sapiens
QRLCAPDLE

SEQ ID NO: 319627 - protein, 9 aa, Homo Sapiens
SINFWYGLC

SEQ ID NO: 319628 - protein, 9 aa, Homo Sapiens
SPVEEFYTR

SEQ ID NO: 319629 - protein, 9 aa, Homo Sapiens
SRRELAHLE

SEQ ID NO: 319630 - protein, 9 aa, Homo Sapiens
AEEMAGSAQ

SEQ ID NO: 319631 - protein, 9 aa, Homo Sapiens
HCSASTRLW

SEQ ID NO: 319632 - protein, 9 aa, Homo Sapiens
LVPDQEDAF

SEQ ID NO: 319633 - protein, 9 aa, Homo Sapiens
LVAEHPKPD

SEQ ID NO: 319634 - protein, 9 aa, Homo Sapiens
SLHSAHQGR

SEQ ID NO: 319635 - protein, 9 aa, Homo Sapiens
HTAENCQSC

SEQ ID NO: 319636 - protein, 9 aa, Homo Sapiens
SATLSSYSL

SEQ ID NO: 319637 - protein, 9 aa, Homo Sapiens
LRGELESQW

SEQ ID NO: 319638 - protein, 9 aa, Homo Sapiens
IFTAHLYYF

SEQ ID NO: 319639 - protein, 9 aa, Homo Sapiens
NGRQVTYHV

SEQ ID NO: 319640 - protein, 9 aa, Homo Sapiens
PGWRTGLAF

SEQ ID NO: 319641 - protein, 9 aa, Homo Sapiens
ISFHQVDFT

SEQ ID NO: 319642 - protein, 9 aa, Homo Sapiens
DIITRIVCD

SEQ ID NO: 319643 - protein, 9 aa, Homo Sapiens
EPVFSRDDS

SEQ ID NO: 319644 - protein, 9 aa, Homo Sapiens
DLHEEPSAE

SEQ ID NO: 319645 - protein, 9 aa, Homo Sapiens
LALVCLPGV

SEQ ID NO: 319646 - protein, 9 aa, Homo Sapiens
LLQHQDSEI

SEQ ID NO: 319647 - protein, 9 aa, Homo Sapiens
FGGAMGLCF

SEQ ID NO: 319648 - protein, 9 aa, Homo Sapiens
YTKVSCYLD

SEQ ID NO: 319649 - protein, 9 aa, Homo Sapiens
VRQEESQWP

SEQ ID NO: 319650 - protein, 9 aa, Homo Sapiens
EIATGPPVS

SEQ ID NO: 319651 - protein, 9 aa, Homo Sapiens
YAYFMRGRL

SEQ ID NO: 319652 - protein, 9 aa, Homo Sapiens
GLLEMLLGY

SEQ ID NO: 319653 - protein, 9 aa, Homo Sapiens
SFKQTNVYS

SEQ ID NO: 319654 - protein, 9 aa, Homo Sapiens
HGGRVTCHD

SEQ ID NO: 319655 - protein, 9 aa, Homo Sapiens
QVWDVGMCK

SEQ ID NO: 319656 - protein, 9 aa, Homo Sapiens
KLKKMKSQM

SEQ ID NO: 319657 - protein, 9 aa, Homo Sapiens
CSRDRALEP

SEQ ID NO: 319658 - protein, 9 aa, Homo Sapiens
CSVELDLNQ

SEQ ID NO: 319659 - protein, 9 aa, Homo Sapiens
HVDSAAECY

SEQ ID NO: 319660 - protein, 9 aa, Homo Sapiens
SSCSKNQSE

SEQ ID NO: 319661 - protein, 9 aa, Homo Sapiens
SISCPNAVV

SEQ ID NO: 319662 - protein, 9 aa, Homo Sapiens
GAYLIHRGM

SEQ ID NO: 319663 - protein, 9 aa, Homo Sapiens
RPWIKNMER

SEQ ID NO: 319664 - protein, 9 aa, Homo Sapiens
LTLSLVLDC

SEQ ID NO: 319665 - protein, 9 aa, Homo Sapiens
TCQVERFIE

SEQ ID NO: 319666 - protein, 9 aa, Homo Sapiens
LCENPYYDS

SEQ ID NO: 319667 - protein, 9 aa, Homo Sapiens
QSWPNPKDT

SEQ ID NO: 319668 - protein, 9 aa, Homo Sapiens
ESTVSRQGG

SEQ ID NO: 319669 - protein, 9 aa, Homo Sapiens
TKEVIEQEA

SEQ ID NO: 319670 - protein, 9 aa, Homo Sapiens
RYYNQVGWK

SEQ ID NO: 319671 - protein, 9 aa, Homo Sapiens
ITYMLFFIN

SEQ ID NO: 319672 - protein, 9 aa, Homo Sapiens
PRWHSTTIA

SEQ ID NO: 319673 - protein, 9 aa, Homo Sapiens
GYPTLVQAL

SEQ ID NO: 319674 - protein, 9 aa, Homo Sapiens
GRSLDVDAH

SEQ ID NO: 319675 - protein, 9 aa, Homo Sapiens
SPEPTWTTL

SEQ ID NO: 319676 - protein, 9 aa, Homo Sapiens
HSEATLDIN

SEQ ID NO: 319677 - protein, 9 aa, Homo Sapiens
FLAPTFSSL

SEQ ID NO: 319678 - protein, 9 aa, Homo Sapiens
PTDIRFVWE

SEQ ID NO: 319679 - protein, 9 aa, Homo Sapiens
LAPLLLVFV

SEQ ID NO: 319680 - protein, 9 aa, Homo Sapiens
LLEPVDYMV

SEQ ID NO: 319681 - protein, 9 aa, Homo Sapiens
PECINFCKF

SEQ ID NO: 319682 - protein, 9 aa, Homo Sapiens
PAQPPGLPN

SEQ ID NO: 319683 - protein, 9 aa, Homo Sapiens
ARIDIEIYL

SEQ ID NO: 319684 - protein, 9 aa, Homo Sapiens
RSKLVNEYV

SEQ ID NO: 319685 - protein, 9 aa, Homo Sapiens
IAQVQVSSS

SEQ ID NO: 319686 - protein, 9 aa, Homo Sapiens
LERLHAALR

SEQ ID NO: 319687 - protein, 9 aa, Homo Sapiens
SATVRQFTA

SEQ ID NO: 319688 - protein, 9 aa, Homo Sapiens
NSTKILKTI

SEQ ID NO: 319689 - protein, 9 aa, Homo Sapiens
DSIMPLHAA

SEQ ID NO: 319690 - protein, 9 aa, Homo Sapiens
LFTFTARVL

SEQ ID NO: 319691 - protein, 9 aa, Homo Sapiens
NDIASFLRT

SEQ ID NO: 319692 - protein, 9 aa, Homo Sapiens
TTSSSAQEM

SEQ ID NO: 319693 - protein, 9 aa, Homo Sapiens
VALASVSQS

SEQ ID NO: 319694 - protein, 9 aa, Homo Sapiens
GMNWQQYWK

SEQ ID NO: 319695 - protein, 9 aa, Homo Sapiens
HVGPGKPKA

SEQ ID NO: 319696 - protein, 9 aa, Homo Sapiens
AWARAALAM

SEQ ID NO: 319697 - protein, 9 aa, Homo Sapiens
DPRSFYEWG

SEQ ID NO: 319698 - protein, 9 aa, Homo Sapiens
TSVPKDSFE

SEQ ID NO: 319699 - protein, 9 aa, Homo Sapiens
EWLQVQTIQ

SEQ ID NO: 319700 - protein, 9 aa, Homo Sapiens
QLVGGREQR

SEQ ID NO: 319701 - protein, 9 aa, Homo Sapiens
GVSSELLSI

SEQ ID NO: 319702 - protein, 9 aa, Homo Sapiens
RPPSQVPLI

SEQ ID NO: 319703 - protein, 9 aa, Homo Sapiens
PYLTAKISS

SEQ ID NO: 319704 - protein, 9 aa, Homo Sapiens
GIHYPDITT

SEQ ID NO: 319705 - protein, 9 aa, Homo Sapiens
LDRNPEDVP

SEQ ID NO: 319706 - protein, 9 aa, Homo Sapiens
SSVHPPGAC

SEQ ID NO: 319707 - protein, 9 aa, Homo Sapiens
QSHISSSNE

SEQ ID NO: 319708 - protein, 9 aa, Homo Sapiens
GDVGKSALT

SEQ ID NO: 319709 - protein, 9 aa, Homo Sapiens
GTRGTGWPL

SEQ ID NO: 319710 - protein, 9 aa, Homo Sapiens
NSFLRDYNV

SEQ ID NO: 319711 - protein, 9 aa, Homo Sapiens
KGQSVGEVV

SEQ ID NO: 319712 - protein, 9 aa, Homo Sapiens
AELEIHLVM

SEQ ID NO: 319713 - protein, 9 aa, Homo Sapiens
LEVEPQFSL

SEQ ID NO: 319714 - protein, 9 aa, Homo Sapiens
PMGRGRHWG

SEQ ID NO: 319715 - protein, 9 aa, Homo Sapiens
ERTHSTASH

SEQ ID NO: 319716 - protein, 9 aa, Homo Sapiens
LLSDGPAGR

SEQ ID NO: 319717 - protein, 9 aa, Homo Sapiens
LGPLRWCAC

SEQ ID NO: 319718 - protein, 9 aa, Homo Sapiens
KFKSKFLFL

SEQ ID NO: 319719 - protein, 9 aa, Homo Sapiens
EWELDKIKG

SEQ ID NO: 319720 - protein, 9 aa, Homo Sapiens
KAPFSDTLR

SEQ ID NO: 319721 - protein, 9 aa, Homo Sapiens
MKHFDAHGR

SEQ ID NO: 319722 - protein, 9 aa, Homo Sapiens
EEHGEAHMS

SEQ ID NO: 319723 - protein, 9 aa, Homo Sapiens
CDARHPHVT

SEQ ID NO: 319724 - protein, 9 aa, Homo Sapiens
QQPGSCPSQ

SEQ ID NO: 319725 - protein, 9 aa, Homo Sapiens
IKKLPFLCE

SEQ ID NO: 319726 - protein, 9 aa, Homo Sapiens
MAIQGISEK

SEQ ID NO: 319727 - protein, 9 aa, Homo Sapiens
PRATGVSFM

SEQ ID NO: 319728 - protein, 9 aa, Homo Sapiens
VDWLYNRLL

SEQ ID NO: 319729 - protein, 9 aa, Homo Sapiens
DVDKGPKEP

SEQ ID NO: 319730 - protein, 9 aa, Homo Sapiens
VAATFPGDV

SEQ ID NO: 319731 - protein, 9 aa, Homo Sapiens
SISLTFTEI

SEQ ID NO: 319732 - protein, 9 aa, Homo Sapiens
CRDAASKLK

SEQ ID NO: 319733 - protein, 9 aa, Homo Sapiens
QLPPMSVAA

SEQ ID NO: 319734 - protein, 9 aa, Homo Sapiens
ELEAQRVAM

SEQ ID NO: 319735 - protein, 9 aa, Homo Sapiens
PPSPMGPPG

SEQ ID NO: 319736 - protein, 9 aa, Homo Sapiens
EPEKRPPFY

SEQ ID NO: 319737 - protein, 9 aa, Homo Sapiens
GMVSLAYDH

SEQ ID NO: 319738 - protein, 9 aa, Homo Sapiens
GKVSPGMLS

SEQ ID NO: 319739 - protein, 9 aa, Homo Sapiens
VLLTLRPRC

SEQ ID NO: 319740 - protein, 9 aa, Homo Sapiens
LKSCCVPTR

SEQ ID NO: 319741 - protein, 9 aa, Homo Sapiens
RQQWESREW

SEQ ID NO: 319742 - protein, 9 aa, Homo Sapiens
PQFPGFPPH

SEQ ID NO: 319743 - protein, 9 aa, Homo Sapiens
MALWHLALL

SEQ ID NO: 319744 - protein, 9 aa, Homo Sapiens
AMAQVTHPL

SEQ ID NO: 319745 - protein, 9 aa, Homo Sapiens
LSGLSPRLR

SEQ ID NO: 319746 - protein, 9 aa, Homo Sapiens
PGSDPFPYP

SEQ ID NO: 319747 - protein, 9 aa, Homo Sapiens
IFTVSVTLH

SEQ ID NO: 319748 - protein, 9 aa, Homo Sapiens
FPVPARGSC

SEQ ID NO: 319749 - protein, 9 aa, Homo Sapiens
RLPLCSPRS

SEQ ID NO: 319750 - protein, 9 aa, Homo Sapiens
GAQLGGTRG

SEQ ID NO: 319751 - protein, 9 aa, Homo Sapiens
QQARKKHYI

SEQ ID NO: 319752 - protein, 9 aa, Homo Sapiens
QGPLVPSSS

SEQ ID NO: 319753 - protein, 9 aa, Homo Sapiens
GPEATNVVT

SEQ ID NO: 319754 - protein, 9 aa, Homo Sapiens
HMGIVLNSD

SEQ ID NO: 319755 - protein, 9 aa, Homo Sapiens
QVERFIEIG

SEQ ID NO: 319756 - protein, 9 aa, Homo Sapiens
SPGYPEIYP

SEQ ID NO: 319757 - protein, 9 aa, Homo Sapiens
QRARQLQRD

SEQ ID NO: 319758 - protein, 9 aa, Homo Sapiens
QALDGSPIW

SEQ ID NO: 319759 - protein, 9 aa, Homo Sapiens
YLSPLGPVT

SEQ ID NO: 319760 - protein, 9 aa, Homo Sapiens
SPLGPVTSP

SEQ ID NO: 319761 - protein, 9 aa, Homo Sapiens
ITWQKGECI

SEQ ID NO: 319762 - protein, 9 aa, Homo Sapiens
LGRAELILE

SEQ ID NO: 319763 - protein, 9 aa, Homo Sapiens
HFRNRNSQM

SEQ ID NO: 319764 - protein, 9 aa, Homo Sapiens
ECAATGHPS

SEQ ID NO: 319765 - protein, 9 aa, Homo Sapiens
WCVLVDTGC

SEQ ID NO: 319766 - protein, 9 aa, Homo Sapiens
GYIETLQRE

SEQ ID NO: 319767 - protein, 9 aa, Homo Sapiens
VDDWLSTIK

SEQ ID NO: 319768 - protein, 9 aa, Homo Sapiens
ELLQDQQKP

SEQ ID NO: 319769 - protein, 9 aa, Homo Sapiens
KEQRLCAPD

SEQ ID NO: 319770 - protein, 9 aa, Homo Sapiens
LHGENPTLF

SEQ ID NO: 319771 - protein, 9 aa, Homo Sapiens
SVPKDSFEG

SEQ ID NO: 319772 - protein, 9 aa, Homo Sapiens
EPQPPPHMC

SEQ ID NO: 319773 - protein, 9 aa, Homo Sapiens
ILNPFKVVK

SEQ ID NO: 319774 - protein, 9 aa, Homo Sapiens
SKFDLHEEP

SEQ ID NO: 319775 - protein, 9 aa, Homo Sapiens
EYQCFACNK

SEQ ID NO: 319776 - protein, 9 aa, Homo Sapiens
LQVQHLSHA

SEQ ID NO: 319777 - protein, 9 aa, Homo Sapiens
MVQDLESRW

SEQ ID NO: 319778 - protein, 9 aa, Homo Sapiens
SKGQTHPRI

SEQ ID NO: 319779 - protein, 9 aa, Homo Sapiens
LGPEFGGAM

SEQ ID NO: 319780 - protein, 9 aa, Homo Sapiens
QRSFTCTQS

SEQ ID NO: 319781 - protein, 9 aa, Homo Sapiens
EMLVLVCSM

SEQ ID NO: 319782 - protein, 9 aa, Homo Sapiens
IEQEAPGMA

SEQ ID NO: 319783 - protein, 9 aa, Homo Sapiens
DGPGRGWAP

SEQ ID NO: 319784 - protein, 9 aa, Homo Sapiens
LPSNIYTGL

SEQ ID NO: 319785 - protein, 9 aa, Homo Sapiens
QSHHEFKEW

SEQ ID NO: 319786 - protein, 9 aa, Homo Sapiens
THVRPGSTM

SEQ ID NO: 319787 - protein, 9 aa, Homo Sapiens
RWAPWNTHH

SEQ ID NO: 319788 - protein, 9 aa, Homo Sapiens
QKKKNKEEE

SEQ ID NO: 319789 - protein, 9 aa, Homo Sapiens
AETFCFPAS

SEQ ID NO: 319790 - protein, 9 aa, Homo Sapiens
NQRELSRIS

SEQ ID NO: 319791 - protein, 9 aa, Homo Sapiens
SSWKSEHSK

SEQ ID NO: 319792 - protein, 9 aa, Homo Sapiens
TWDGDHITH

SEQ ID NO: 319793 - protein, 9 aa, Homo Sapiens
PPAWPSSSQ

SEQ ID NO: 319794 - protein, 9 aa, Homo Sapiens
STGIHETTY

SEQ ID NO: 319795 - protein, 9 aa, Homo Sapiens
APAGCKVGL

SEQ ID NO: 319796 - protein, 9 aa, Homo Sapiens
EWMEEESQS

SEQ ID NO: 319797 - protein, 9 aa, Homo Sapiens
QIWNERDEY

SEQ ID NO: 319798 - protein, 9 aa, Homo Sapiens
PAWVRVSNI

SEQ ID NO: 319799 - protein, 9 aa, Homo Sapiens
NSLFPQNSN

SEQ ID NO: 319800 - protein, 9 aa, Homo Sapiens
ACCKSLGRF

SEQ ID NO: 319801 - protein, 9 aa, Homo Sapiens
KTSMLVKYA

SEQ ID NO: 319802 - protein, 9 aa, Homo Sapiens
CLYQLVKKY

SEQ ID NO: 319803 - protein, 9 aa, Homo Sapiens
SDWPPRAGL

SEQ ID NO: 319804 - protein, 9 aa, Homo Sapiens
HTTPFSVFD

SEQ ID NO: 319805 - protein, 9 aa, Homo Sapiens
QNRKMSNKS

SEQ ID NO: 319806 - protein, 9 aa, Homo Sapiens
RAPPESCVS

SEQ ID NO: 319807 - protein, 9 aa, Homo Sapiens
SSELLSIAA

SEQ ID NO: 319808 - protein, 9 aa, Homo Sapiens
EEELCKGGD

SEQ ID NO: 319809 - protein, 9 aa, Homo Sapiens
DRLVPDQED

SEQ ID NO: 319810 - protein, 9 aa, Homo Sapiens
PAMGPEGAT

SEQ ID NO: 319811 - protein, 9 aa, Homo Sapiens
SNVRCRRTE

SEQ ID NO: 319812 - protein, 9 aa, Homo Sapiens
VKVAEALIE

SEQ ID NO: 319813 - protein, 9 aa, Homo Sapiens
MVLRMFISS

SEQ ID NO: 319814 - protein, 9 aa, Homo Sapiens
RRPHRPPTV

SEQ ID NO: 319815 - protein, 9 aa, Homo Sapiens
KDISNKVDA

SEQ ID NO: 319816 - protein, 9 aa, Homo Sapiens
MNEFSWGKN

SEQ ID NO: 319817 - protein, 9 aa, Homo Sapiens
QHEQRVLLP

SEQ ID NO: 319818 - protein, 9 aa, Homo Sapiens
LEETRKEMA

SEQ ID NO: 319819 - protein, 9 aa, Homo Sapiens
FYEWGVAVL

SEQ ID NO: 319820 - protein, 9 aa, Homo Sapiens
CERPEWIHM

SEQ ID NO: 319821 - protein, 9 aa, Homo Sapiens
INQHLRKNH

SEQ ID NO: 319822 - protein, 9 aa, Homo Sapiens
PIWKRSAWR

SEQ ID NO: 319823 - protein, 9 aa, Homo Sapiens
RRKPYNLDV

SEQ ID NO: 319824 - protein, 9 aa, Homo Sapiens
PPSQVPLII

SEQ ID NO: 319825 - protein, 9 aa, Homo Sapiens
LDEKWDFIA

SEQ ID NO: 319826 - protein, 9 aa, Homo Sapiens
TSWAPSVAT

SEQ ID NO: 319827 - protein, 9 aa, Homo Sapiens
SVFDLVIVA

SEQ ID NO: 319828 - protein, 9 aa, Homo Sapiens
GGEEEEEEN

SEQ ID NO: 319829 - protein, 9 aa, Homo Sapiens
CPVTHTWEK

SEQ ID NO: 319830 - protein, 9 aa, Homo Sapiens
SPHGSPLAE

SEQ ID NO: 319831 - protein, 9 aa, Homo Sapiens
GPALLCGTY

SEQ ID NO: 319832 - protein, 9 aa, Homo Sapiens
GYHPTGHEW

SEQ ID NO: 319833 - protein, 9 aa, Homo Sapiens
PELQQTGRI

SEQ ID NO: 319834 - protein, 9 aa, Homo Sapiens
GGIPKTTGE

SEQ ID NO: 319835 - protein, 9 aa, Homo Sapiens
MMQVQEAVS

SEQ ID NO: 319836 - protein, 9 aa, Homo Sapiens
SALIIAQVQ

SEQ ID NO: 319837 - protein, 9 aa, Homo Sapiens
ADGNLRFVV

SEQ ID NO: 319838 - protein, 9 aa, Homo Sapiens
WKSEHSKPP

SEQ ID NO: 319839 - protein, 9 aa, Homo Sapiens
GVIAIKQFS

SEQ ID NO: 319840 - protein, 9 aa, Homo Sapiens
REDMIDTKL

SEQ ID NO: 319841 - protein, 9 aa, Homo Sapiens
MSHVRLWAL

SEQ ID NO: 319842 - protein, 9 aa, Homo Sapiens
EVIINLATQ

SEQ ID NO: 319843 - protein, 9 aa, Homo Sapiens
MTLKALVKT

SEQ ID NO: 319844 - protein, 9 aa, Homo Sapiens
SHRVAQADL

SEQ ID NO: 319845 - protein, 9 aa, Homo Sapiens
KEDRESRFL

SEQ ID NO: 319846 - protein, 9 aa, Homo Sapiens
LLKKCSLYG

SEQ ID NO: 319847 - protein, 9 aa, Homo Sapiens
LERGRQDPT

SEQ ID NO: 319848 - protein, 9 aa, Homo Sapiens
TLFLYSWDF

SEQ ID NO: 319849 - protein, 9 aa, Homo Sapiens
KIKDISNKV

SEQ ID NO: 319850 - protein, 9 aa, Homo Sapiens
LVYQDQNKY

SEQ ID NO: 319851 - protein, 9 aa, Homo Sapiens
CRRKYRYGM

SEQ ID NO: 319852 - protein, 9 aa, Homo Sapiens
EPNNGISSD

SEQ ID NO: 319853 - protein, 9 aa, Homo Sapiens
WEYGGEGTD

SEQ ID NO: 319854 - protein, 9 aa, Homo Sapiens
SDIFEYNSA

SEQ ID NO: 319855 - protein, 9 aa, Homo Sapiens
AATFPGDVD

SEQ ID NO: 319856 - protein, 9 aa, Homo Sapiens
SLRRPDVLL

SEQ ID NO: 319857 - protein, 9 aa, Homo Sapiens
QINLSLTML

SEQ ID NO: 319858 - protein, 9 aa, Homo Sapiens
KEVLTNMCF

SEQ ID NO: 319859 - protein, 9 aa, Homo Sapiens
ILDFDYPQN

SEQ ID NO: 319860 - protein, 9 aa, Homo Sapiens
SLTSISTFL

SEQ ID NO: 319861 - protein, 9 aa, Homo Sapiens
PGHRPRQDS

SEQ ID NO: 319862 - protein, 9 aa, Homo Sapiens
TQGVPRALV

SEQ ID NO: 319863 - protein, 9 aa, Homo Sapiens
NMDGTTLYE

SEQ ID NO: 319864 - protein, 9 aa, Homo Sapiens
KLHKLFSYN

SEQ ID NO: 319865 - protein, 9 aa, Homo Sapiens
ALPEETFIS

SEQ ID NO: 319866 - protein, 9 aa, Homo Sapiens
FCACCGGRV

SEQ ID NO: 319867 - protein, 9 aa, Homo Sapiens
FANLYLLMP

SEQ ID NO: 319868 - protein, 9 aa, Homo Sapiens
LFFVLVNLE

SEQ ID NO: 319869 - protein, 9 aa, Homo Sapiens
VPPDILQLL

SEQ ID NO: 319870 - protein, 9 aa, Homo Sapiens
LNTSGNYSG

SEQ ID NO: 319871 - protein, 9 aa, Homo Sapiens
RNEALEEEV

SEQ ID NO: 319872 - protein, 9 aa, Homo Sapiens
LDLRDDSCL

SEQ ID NO: 319873 - protein, 9 aa, Homo Sapiens
SVPLPPWST

SEQ ID NO: 319874 - protein, 9 aa, Homo Sapiens
VPTRLRPMS

SEQ ID NO: 319875 - protein, 9 aa, Homo Sapiens
RHHHRHRRL

SEQ ID NO: 319876 - protein, 9 aa, Homo Sapiens
AGQTINDQD

SEQ ID NO: 319877 - protein, 9 aa, Homo Sapiens
WKPTMKWST

SEQ ID NO: 319878 - protein, 9 aa, Homo Sapiens
SFSKRQEDQ

SEQ ID NO: 319879 - protein, 9 aa, Homo Sapiens
ALLRAERVL

SEQ ID NO: 319880 - protein, 9 aa, Homo Sapiens
TAQPDLRQW

SEQ ID NO: 319881 - protein, 9 aa, Homo Sapiens
WRWHATPTQ

SEQ ID NO: 319882 - protein, 9 aa, Homo Sapiens
FQSCLNVGF

SEQ ID NO: 319883 - protein, 9 aa, Homo Sapiens
SCRGARAPQ

SEQ ID NO: 319884 - protein, 9 aa, Homo Sapiens
GLRDPLVPT

SEQ ID NO: 319885 - protein, 9 aa, Homo Sapiens
GAEVLLLTS

SEQ ID NO: 319886 - protein, 9 aa, Homo Sapiens
TGKNLELQF

SEQ ID NO: 319887 - protein, 9 aa, Homo Sapiens
DNGRQVTYH

SEQ ID NO: 319888 - protein, 9 aa, Homo Sapiens
HACLQLGHL

SEQ ID NO: 319889 - protein, 9 aa, Homo Sapiens
TWVLLPSSH

SEQ ID NO: 319890 - protein, 9 aa, Homo Sapiens
ITRTSWAPS

SEQ ID NO: 319891 - protein, 9 aa, Homo Sapiens
VMANSDGSE

SEQ ID NO: 319892 - protein, 9 aa, Homo Sapiens
LTCQLNGSA

SEQ ID NO: 319893 - protein, 9 aa, Homo Sapiens
EIKESVCGQ

SEQ ID NO: 319894 - protein, 9 aa, Homo Sapiens
GPDGPPSPM

SEQ ID NO: 319895 - protein, 9 aa, Homo Sapiens
LPWPASTCP

SEQ ID NO: 319896 - protein, 9 aa, Homo Sapiens
MSLTSSTGF

SEQ ID NO: 319897 - protein, 9 aa, Homo Sapiens
CTILAPNEC

SEQ ID NO: 319898 - protein, 9 aa, Homo Sapiens
NAGIYKCVV

SEQ ID NO: 319899 - protein, 9 aa, Homo Sapiens
PPAMSGTQS

SEQ ID NO: 319900 - protein, 9 aa, Homo Sapiens
FLALHNYLS

SEQ ID NO: 319901 - protein, 9 aa, Homo Sapiens
VGQRIRRDS

SEQ ID NO: 319902 - protein, 9 aa, Homo Sapiens
FYFKAARID

SEQ ID NO: 319903 - protein, 9 aa, Homo Sapiens
FSPLQLPPM

SEQ ID NO: 319904 - protein, 9 aa, Homo Sapiens
WEKFNTPAL

SEQ ID NO: 319905 - protein, 9 aa, Homo Sapiens
RWAWILQDV

SEQ ID NO: 319906 - protein, 9 aa, Homo Sapiens
TKSKASQQK

SEQ ID NO: 319907 - protein, 9 aa, Homo Sapiens
CPIPGTSTR

SEQ ID NO: 319908 - protein, 9 aa, Homo Sapiens
WLPAPPPWR

SEQ ID NO: 319909 - protein, 9 aa, Homo Sapiens
CDLLERPGP

SEQ ID NO: 319910 - protein, 9 aa, Homo Sapiens
DLTAMKVPI

SEQ ID NO: 319911 - protein, 9 aa, Homo Sapiens
QLYQDFGNH

SEQ ID NO: 319912 - protein, 9 aa, Homo Sapiens
SNPDPVAIS

SEQ ID NO: 319913 - protein, 9 aa, Homo Sapiens
FSGGYIIKR

SEQ ID NO: 319914 - protein, 9 aa, Homo Sapiens
LRDYNVTLP

SEQ ID NO: 319915 - protein, 9 aa, Homo Sapiens
AGVPWHDLG

SEQ ID NO: 319916 - protein, 9 aa, Homo Sapiens
VGWWSFGVL

SEQ ID NO: 319917 - protein, 9 aa, Homo Sapiens
THQVSLHLK

SEQ ID NO: 319918 - protein, 9 aa, Homo Sapiens
AKIIFTLTW

SEQ ID NO: 319919 - protein, 9 aa, Homo Sapiens
TRVQELEEC

SEQ ID NO: 319920 - protein, 9 aa, Homo Sapiens
RLEDLWRRH

SEQ ID NO: 319921 - protein, 9 aa, Homo Sapiens
CENDSRSTK

SEQ ID NO: 319922 - protein, 9 aa, Homo Sapiens
ERKNIDLTV

SEQ ID NO: 319923 - protein, 9 aa, Homo Sapiens
LNVGFLFGS

SEQ ID NO: 319924 - protein, 9 aa, Homo Sapiens
AQVLHVDSS

SEQ ID NO: 319925 - protein, 9 aa, Homo Sapiens
AQVTHPLVH

SEQ ID NO: 319926 - protein, 9 aa, Homo Sapiens
PGPCGPPPT

SEQ ID NO: 319927 - protein, 9 aa, Homo Sapiens
SSFMTSPTD

SEQ ID NO: 319928 - protein, 9 aa, Homo Sapiens
SQSMQTLSA

SEQ ID NO: 319929 - protein, 9 aa, Homo Sapiens
LVATGKTTK

SEQ ID NO: 319930 - protein, 9 aa, Homo Sapiens
MHDPRATAL

SEQ ID NO: 319931 - protein, 9 aa, Homo Sapiens
SAATSLQIL

SEQ ID NO: 319932 - protein, 9 aa, Homo Sapiens
VHADDEKCE

SEQ ID NO: 319933 - protein, 9 aa, Homo Sapiens
PTNPTSVQT

SEQ ID NO: 319934 - protein, 9 aa, Homo Sapiens
EQDLLEKTR

SEQ ID NO: 319935 - protein, 9 aa, Homo Sapiens
PQGLHGQRA

SEQ ID NO: 319936 - protein, 9 aa, Homo Sapiens
WPHSEFALG

SEQ ID NO: 319937 - protein, 9 aa, Homo Sapiens
GGILASIYF

SEQ ID NO: 319938 - protein, 9 aa, Homo Sapiens
ILVMGNIID

SEQ ID NO: 319939 - protein, 9 aa, Homo Sapiens
TISSPFAAA

SEQ ID NO: 319940 - protein, 9 aa, Homo Sapiens
HRTKEEGDR

SEQ ID NO: 319941 - protein, 9 aa, Homo Sapiens
EWKKITDSI

SEQ ID NO: 319942 - protein, 9 aa, Homo Sapiens
RQNSHLVRH

SEQ ID NO: 319943 - protein, 9 aa, Homo Sapiens
AVDTSIKGM

SEQ ID NO: 319944 - protein, 9 aa, Homo Sapiens
IKQFSRGDF

SEQ ID NO: 319945 - protein, 9 aa, Homo Sapiens
LPLAMAQVT

SEQ ID NO: 319946 - protein, 9 aa, Homo Sapiens
RAFACHEEG

SEQ ID NO: 319947 - protein, 9 aa, Homo Sapiens
RKMSMIVPG

SEQ ID NO: 319948 - protein, 9 aa, Homo Sapiens
LGVDVNNRT

SEQ ID NO: 319949 - protein, 9 aa, Homo Sapiens
SQEPNNGIS

SEQ ID NO: 319950 - protein, 9 aa, Homo Sapiens
FCMVKIILT

SEQ ID NO: 319951 - protein, 9 aa, Homo Sapiens
IFVSMSKNN

SEQ ID NO: 319952 - protein, 9 aa, Homo Sapiens
QILAVTISE

SEQ ID NO: 319953 - protein, 9 aa, Homo Sapiens
SHRNQSERG

SEQ ID NO: 319954 - protein, 9 aa, Homo Sapiens
RNSADCVSE

SEQ ID NO: 319955 - protein, 9 aa, Homo Sapiens
SMIDLLEPV

SEQ ID NO: 319956 - protein, 9 aa, Homo Sapiens
LPYGRLTYH

SEQ ID NO: 319957 - protein, 9 aa, Homo Sapiens
LYYCSQCHC

SEQ ID NO: 319958 - protein, 9 aa, Homo Sapiens
CEVRAAHRC

SEQ ID NO: 319959 - protein, 9 aa, Homo Sapiens
YRWQDECQY

SEQ ID NO: 319960 - protein, 9 aa, Homo Sapiens
EERLAQAMD

SEQ ID NO: 319961 - protein, 9 aa, Homo Sapiens
EQALSNLGL

SEQ ID NO: 319962 - protein, 9 aa, Homo Sapiens
CQIHAKDNE

SEQ ID NO: 319963 - protein, 9 aa, Homo Sapiens
IAFGAAIFA

SEQ ID NO: 319964 - protein, 9 aa, Homo Sapiens
WESREWKKI

SEQ ID NO: 319965 - protein, 9 aa, Homo Sapiens
HRPQEQLHL

SEQ ID NO: 319966 - protein, 9 aa, Homo Sapiens
WDSWFRGLS

SEQ ID NO: 319967 - protein, 9 aa, Homo Sapiens
SKMALSTGD

SEQ ID NO: 319968 - protein, 9 aa, Homo Sapiens
SSQNRTCSF

SEQ ID NO: 319969 - protein, 9 aa, Homo Sapiens
HMIDKRSPL

SEQ ID NO: 319970 - protein, 9 aa, Homo Sapiens
NKSIQDHLL

SEQ ID NO: 319971 - protein, 9 aa, Homo Sapiens
GTSLFQGIE

SEQ ID NO: 319972 - protein, 9 aa, Homo Sapiens
MQLLPVGLA

SEQ ID NO: 319973 - protein, 9 aa, Homo Sapiens
GLSFSVRLT

SEQ ID NO: 319974 - protein, 9 aa, Homo Sapiens
TVTPDRVDF

SEQ ID NO: 319975 - protein, 9 aa, Homo Sapiens
IICYAIGVG

SEQ ID NO: 319976 - protein, 9 aa, Homo Sapiens
EACCKSLGR

SEQ ID NO: 319977 - protein, 9 aa, Homo Sapiens
VTMHDPRAT

SEQ ID NO: 319978 - protein, 9 aa, Homo Sapiens
HVRDINEAF

SEQ ID NO: 319979 - protein, 9 aa, Homo Sapiens
PTTAKDSSS

SEQ ID NO: 319980 - protein, 9 aa, Homo Sapiens
SAAWGRAEP

SEQ ID NO: 319981 - protein, 9 aa, Homo Sapiens
PASTCPLPQ

SEQ ID NO: 319982 - protein, 9 aa, Homo Sapiens
NQFFVAIFT

SEQ ID NO: 319983 - protein, 9 aa, Homo Sapiens
LTITGIYIA

SEQ ID NO: 319984 - protein, 9 aa, Homo Sapiens
SQLCSEIQM

SEQ ID NO: 319985 - protein, 9 aa, Homo Sapiens
SRFLASKMG

SEQ ID NO: 319986 - protein, 9 aa, Homo Sapiens
EQIVWLKLQ

SEQ ID NO: 319987 - protein, 9 aa, Homo Sapiens
QNYKIGPSS

SEQ ID NO: 319988 - protein, 9 aa, Homo Sapiens
FYDLETGKY

SEQ ID NO: 319989 - protein, 9 aa, Homo Sapiens
ISMVSSGLL

SEQ ID NO: 319990 - protein, 9 aa, Homo Sapiens
HLETDSRPV

SEQ ID NO: 319991 - protein, 9 aa, Homo Sapiens
CICHVCGIH

SEQ ID NO: 319992 - protein, 9 aa, Homo Sapiens
LVCFISRYT

SEQ ID NO: 319993 - protein, 9 aa, Homo Sapiens
MSKNNYEKF

SEQ ID NO: 319994 - protein, 9 aa, Homo Sapiens
LEVNIVKVD

SEQ ID NO: 319995 - protein, 9 aa, Homo Sapiens
PGGIRMVII

SEQ ID NO: 319996 - protein, 9 aa, Homo Sapiens
AGWGPEREV

SEQ ID NO: 319997 - protein, 9 aa, Homo Sapiens
ILSDACWAL

SEQ ID NO: 319998 - protein, 9 aa, Homo Sapiens
ATSPSAVFA

SEQ ID NO: 319999 - protein, 9 aa, Homo Sapiens
MHIATTLIQ

SEQ ID NO: 320000 - protein, 9 aa, Homo Sapiens
TIKSQNLLV

SEQ ID NO: 320001 - protein, 9 aa, Homo Sapiens
ASATLSSYS

SEQ ID NO: 320002 - protein, 9 aa, Homo Sapiens
RPVQPVVQH

SEQ ID NO: 320003 - protein, 9 aa, Homo Sapiens
GLPRHIGNK

SEQ ID NO: 320004 - protein, 9 aa, Homo Sapiens
FEVFCVALR

SEQ ID NO: 320005 - protein, 9 aa, Homo Sapiens
HRPPTVFRL

SEQ ID NO: 320006 - protein, 9 aa, Homo Sapiens
ADDEKCEAA

SEQ ID NO: 320007 - protein, 9 aa, Homo Sapiens
PGVHPATFT

SEQ ID NO: 320008 - protein, 9 aa, Homo Sapiens
HGRTGTGTG

SEQ ID NO: 320009 - protein, 9 aa, Homo Sapiens
VLQCFGKKT

SEQ ID NO: 320010 - protein, 9 aa, Homo Sapiens
SQVKKTKMV

SEQ ID NO: 320011 - protein, 9 aa, Homo Sapiens
GSENGEEDF

SEQ ID NO: 320012 - protein, 9 aa, Homo Sapiens
VFSFIALNM

SEQ ID NO: 320013 - protein, 9 aa, Homo Sapiens
KCVMDSVGS

SEQ ID NO: 320014 - protein, 9 aa, Homo Sapiens
ATTLIQRRF

SEQ ID NO: 320015 - protein, 9 aa, Homo Sapiens
GKSKGQTHP

SEQ ID NO: 320016 - protein, 9 aa, Homo Sapiens
DRNSLCVNG

SEQ ID NO: 320017 - protein, 9 aa, Homo Sapiens
LEQQIWNER

SEQ ID NO: 320018 - protein, 9 aa, Homo Sapiens
TAAALRRWL

SEQ ID NO: 320019 - protein, 9 aa, Homo Sapiens
AWAADAQVL

SEQ ID NO: 320020 - protein, 9 aa, Homo Sapiens
LTLSKTRNI

SEQ ID NO: 320021 - protein, 9 aa, Homo Sapiens
VAMQGRYGS

SEQ ID NO: 320022 - protein, 9 aa, Homo Sapiens
NTGKNLELQ

SEQ ID NO: 320023 - protein, 9 aa, Homo Sapiens
QKKVRSISL

SEQ ID NO: 320024 - protein, 9 aa, Homo Sapiens
SCTFIQTTS

SEQ ID NO: 320025 - protein, 9 aa, Homo Sapiens
YTWGELLVL

SEQ ID NO: 320026 - protein, 9 aa, Homo Sapiens
ETLQREAEC

SEQ ID NO: 320027 - protein, 9 aa, Homo Sapiens
LFLLVCFLF

SEQ ID NO: 320028 - protein, 9 aa, Homo Sapiens
PAQSIQDNI

SEQ ID NO: 320029 - protein, 9 aa, Homo Sapiens
PKWLLLQRL

SEQ ID NO: 320030 - protein, 9 aa, Homo Sapiens
NKEQRLCAP

SEQ ID NO: 320031 - protein, 9 aa, Homo Sapiens
EKVQEGVCN

SEQ ID NO: 320032 - protein, 9 aa, Homo Sapiens
SSLRRHEAT

SEQ ID NO: 320033 - protein, 9 aa, Homo Sapiens
QTHPWRQVC

SEQ ID NO: 320034 - protein, 9 aa, Homo Sapiens
RSVIFFYIK

SEQ ID NO: 320035 - protein, 9 aa, Homo Sapiens
PHPLLHQWV

SEQ ID NO: 320036 - protein, 9 aa, Homo Sapiens
VTVASASLE

SEQ ID NO: 320037 - protein, 9 aa, Homo Sapiens
HSAQVIHHD

SEQ ID NO: 320038 - protein, 9 aa, Homo Sapiens
FAVSWMSLH

SEQ ID NO: 320039 - protein, 9 aa, Homo Sapiens
SVDTRHKKM

SEQ ID NO: 320040 - protein, 9 aa, Homo Sapiens
SSWPLYLSA

SEQ ID NO: 320041 - protein, 9 aa, Homo Sapiens
FYVTLLVES

SEQ ID NO: 320042 - protein, 9 aa, Homo Sapiens
LHLSHMGNL

SEQ ID NO: 320043 - protein, 9 aa, Homo Sapiens
QVVCDFWLL

SEQ ID NO: 320044 - protein, 9 aa, Homo Sapiens
TGETIYFIA

SEQ ID NO: 320045 - protein, 9 aa, Homo Sapiens
QRLGGGSSD

SEQ ID NO: 320046 - protein, 9 aa, Homo Sapiens
SFISRHFYM

SEQ ID NO: 320047 - protein, 9 aa, Homo Sapiens
FTGKLYPTE

SEQ ID NO: 320048 - protein, 9 aa, Homo Sapiens
STSTSIIIS

SEQ ID NO: 320049 - protein, 9 aa, Homo Sapiens
ARLHGFLVR

SEQ ID NO: 320050 - protein, 9 aa, Homo Sapiens
ETNTERVKS

SEQ ID NO: 320051 - protein, 9 aa, Homo Sapiens
VPVRASSLN

SEQ ID NO: 320052 - protein, 9 aa, Homo Sapiens
MVPAFFGSL

SEQ ID NO: 320053 - protein, 9 aa, Homo Sapiens
KKDIDECSE

SEQ ID NO: 320054 - protein, 9 aa, Homo Sapiens
RGPKPKWLL

SEQ ID NO: 320055 - protein, 9 aa, Homo Sapiens
TSTAEESEP

SEQ ID NO: 320056 - protein, 9 aa, Homo Sapiens
KTRAQGSCS

SEQ ID NO: 320057 - protein, 9 aa, Homo Sapiens
HQIQADSFI

SEQ ID NO: 320058 - protein, 9 aa, Homo Sapiens
LSDSSESTV

SEQ ID NO: 320059 - protein, 9 aa, Homo Sapiens
SVYEQRIEP

SEQ ID NO: 320060 - protein, 9 aa, Homo Sapiens
YNQVGWKPT

SEQ ID NO: 320061 - protein, 9 aa, Homo Sapiens
YHLISIMIL

SEQ ID NO: 320062 - protein, 9 aa, Homo Sapiens
VIALHMTTT

SEQ ID NO: 320063 - protein, 9 aa, Homo Sapiens
WKRGLLVAA

SEQ ID NO: 320064 - protein, 9 aa, Homo Sapiens
WKLDPLLLL

SEQ ID NO: 320065 - protein, 9 aa, Homo Sapiens
IQLQARLHG

SEQ ID NO: 320066 - protein, 9 aa, Homo Sapiens
QLNGSAPIQ

SEQ ID NO: 320067 - protein, 9 aa, Homo Sapiens
RSFYEWGVA

SEQ ID NO: 320068 - protein, 9 aa, Homo Sapiens
GAMAEHGPA

SEQ ID NO: 320069 - protein, 9 aa, Homo Sapiens
KGEWDFYWC

SEQ ID NO: 320070 - protein, 9 aa, Homo Sapiens
PAWCSGKRT

SEQ ID NO: 320071 - protein, 9 aa, Homo Sapiens
TCSFGHFPG

SEQ ID NO: 320072 - protein, 9 aa, Homo Sapiens
CVSQGKSEK

SEQ ID NO: 320073 - protein, 9 aa, Homo Sapiens
DDEPDCCDD

SEQ ID NO: 320074 - protein, 9 aa, Homo Sapiens
QEESQWPIQ

SEQ ID NO: 320075 - protein, 9 aa, Homo Sapiens
TEWLTLGLN

SEQ ID NO: 320076 - protein, 9 aa, Homo Sapiens
KHYLHLNSS

SEQ ID NO: 320077 - protein, 9 aa, Homo Sapiens
TAAKSKNCS

SEQ ID NO: 320078 - protein, 9 aa, Homo Sapiens
WGDWFTAMD

SEQ ID NO: 320079 - protein, 9 aa, Homo Sapiens
RGRILAHQG

SEQ ID NO: 320080 - protein, 9 aa, Homo Sapiens
PKDSFEGLV

SEQ ID NO: 320081 - protein, 9 aa, Homo Sapiens
AAPRSLEFL

SEQ ID NO: 320082 - protein, 9 aa, Homo Sapiens
PTPLSSPLP

SEQ ID NO: 320083 - protein, 9 aa, Homo Sapiens
NWTAATSPS

SEQ ID NO: 320084 - protein, 9 aa, Homo Sapiens
RSCSFTKHK

SEQ ID NO: 320085 - protein, 9 aa, Homo Sapiens
SPWLTIFDE

SEQ ID NO: 320086 - protein, 9 aa, Homo Sapiens
SSEGLLATV

SEQ ID NO: 320087 - protein, 9 aa, Homo Sapiens
GKEEQEQDL

SEQ ID NO: 320088 - protein, 9 aa, Homo Sapiens
KALQSPVSP

SEQ ID NO: 320089 - protein, 9 aa, Homo Sapiens
QFVSSLRRQ

SEQ ID NO: 320090 - protein, 9 aa, Homo Sapiens
ASIYFGALI

SEQ ID NO: 320091 - protein, 9 aa, Homo Sapiens
VCGQDIFII

SEQ ID NO: 320092 - protein, 9 aa, Homo Sapiens
KLSWHQKIH

SEQ ID NO: 320093 - protein, 9 aa, Homo Sapiens
MIGYRPCPL

SEQ ID NO: 320094 - protein, 9 aa, Homo Sapiens
ASSLAHHVL

SEQ ID NO: 320095 - protein, 9 aa, Homo Sapiens
KCENMQPSG

SEQ ID NO: 320096 - protein, 9 aa, Homo Sapiens
VIEQEAPGM

SEQ ID NO: 320097 - protein, 9 aa, Homo Sapiens
SQRKHLHNA

SEQ ID NO: 320098 - protein, 9 aa, Homo Sapiens
NYEKFKNNP

SEQ ID NO: 320099 - protein, 9 aa, Homo Sapiens
VKVDVTEQP

SEQ ID NO: 320100 - protein, 9 aa, Homo Sapiens
DSHMAKERT

SEQ ID NO: 320101 - protein, 9 aa, Homo Sapiens
IHIVECRDD

SEQ ID NO: 320102 - protein, 9 aa, Homo Sapiens
KEGGLPRHI

SEQ ID NO: 320103 - protein, 9 aa, Homo Sapiens
DNQAVSTKG

SEQ ID NO: 320104 - protein, 9 aa, Homo Sapiens
MTTQSSGSW

SEQ ID NO: 320105 - protein, 9 aa, Homo Sapiens
QWPIQMVKG

SEQ ID NO: 320106 - protein, 9 aa, Homo Sapiens
FMMPRSSSH

SEQ ID NO: 320107 - protein, 9 aa, Homo Sapiens
EHGRPNAEG

SEQ ID NO: 320108 - protein, 9 aa, Homo Sapiens
PTWTTLAPG

SEQ ID NO: 320109 - protein, 9 aa, Homo Sapiens
WMDTAPVVA

SEQ ID NO: 320110 - protein, 9 aa, Homo Sapiens
STNASSVPN

SEQ ID NO: 320111 - protein, 9 aa, Homo Sapiens
YTPAMESVY

SEQ ID NO: 320112 - protein, 9 aa, Homo Sapiens
ILTCLLLPW

SEQ ID NO: 320113 - protein, 9 aa, Homo Sapiens
ELCKGGDPK

SEQ ID NO: 320114 - protein, 9 aa, Homo Sapiens
AVAHENNRV

SEQ ID NO: 320115 - protein, 9 aa, Homo Sapiens
QDVWEWPHS

SEQ ID NO: 320116 - protein, 9 aa, Homo Sapiens
LGAVRRQRQ

SEQ ID NO: 320117 - protein, 9 aa, Homo Sapiens
PGMQGSHQL

SEQ ID NO: 320118 - protein, 9 aa, Homo Sapiens
TKPCASKVA

SEQ ID NO: 320119 - protein, 9 aa, Homo Sapiens
CVSHGAGIL

SEQ ID NO: 320120 - protein, 9 aa, Homo Sapiens
STPAPSPDT

SEQ ID NO: 320121 - protein, 9 aa, Homo Sapiens
CRRNFSRQS

SEQ ID NO: 320122 - protein, 9 aa, Homo Sapiens
SLAHHVLPT

SEQ ID NO: 320123 - protein, 9 aa, Homo Sapiens
QVFQGHKKE

SEQ ID NO: 320124 - protein, 9 aa, Homo Sapiens
VSLHLKPKN

SEQ ID NO: 320125 - protein, 9 aa, Homo Sapiens
ICRLCECVG

SEQ ID NO: 320126 - protein, 9 aa, Homo Sapiens
KDPVQCSHD

SEQ ID NO: 320127 - protein, 9 aa, Homo Sapiens
IASPAHDPQ

SEQ ID NO: 320128 - protein, 9 aa, Homo Sapiens
YGMTHMDPY

SEQ ID NO: 320129 - protein, 9 aa, Homo Sapiens
IGTCKETKD

SEQ ID NO: 320130 - protein, 9 aa, Homo Sapiens
GPLSLQEIH

SEQ ID NO: 320131 - protein, 9 aa, Homo Sapiens
QWAPTCVDV

SEQ ID NO: 320132 - protein, 9 aa, Homo Sapiens
KRTHTGENP

SEQ ID NO: 320133 - protein, 9 aa, Homo Sapiens
SRQSSLLRH

SEQ ID NO: 320134 - protein, 9 aa, Homo Sapiens
HDVARAGFL

SEQ ID NO: 320135 - protein, 9 aa, Homo Sapiens
DEQRARQLQ

SEQ ID NO: 320136 - protein, 9 aa, Homo Sapiens
PSACLTPAQ

SEQ ID NO: 320137 - protein, 9 aa, Homo Sapiens
SQEICRLCE

SEQ ID NO: 320138 - protein, 9 aa, Homo Sapiens
LHQHSPNFL

SEQ ID NO: 320139 - protein, 9 aa, Homo Sapiens
CYYQSLQAH

SEQ ID NO: 320140 - protein, 9 aa, Homo Sapiens
QAGKPNLYS

SEQ ID NO: 320141 - protein, 9 aa, Homo Sapiens
CLHERAHIE

SEQ ID NO: 320142 - protein, 9 aa, Homo Sapiens
GRCRPRRGP

SEQ ID NO: 320143 - protein, 9 aa, Homo Sapiens
WEPHVPEAS

SEQ ID NO: 320144 - protein, 9 aa, Homo Sapiens
SCWHWREAD

SEQ ID NO: 320145 - protein, 9 aa, Homo Sapiens
DTDRLVPDQ

SEQ ID NO: 320146 - protein, 9 aa, Homo Sapiens
KLYWLDEKW

SEQ ID NO: 320147 - protein, 9 aa, Homo Sapiens
CPVIVSVQY

SEQ ID NO: 320148 - protein, 9 aa, Homo Sapiens
MPPMLNPII

SEQ ID NO: 320149 - protein, 9 aa, Homo Sapiens
HGAGILTCL

SEQ ID NO: 320150 - protein, 9 aa, Homo Sapiens
TWTQFRNYP

SEQ ID NO: 320151 - protein, 9 aa, Homo Sapiens
NNGMDKRVT

SEQ ID NO: 320152 - protein, 9 aa, Homo Sapiens
GFAVIHDVA

SEQ ID NO: 320153 - protein, 9 aa, Homo Sapiens
ERIGRHMKR

SEQ ID NO: 320154 - protein, 9 aa, Homo Sapiens
CVMDSVGSI

SEQ ID NO: 320155 - protein, 9 aa, Homo Sapiens
FEELMTTLI

SEQ ID NO: 320156 - protein, 9 aa, Homo Sapiens
LLTNVLFLV

SEQ ID NO: 320157 - protein, 9 aa, Homo Sapiens
LIMWRRGHE

SEQ ID NO: 320158 - protein, 9 aa, Homo Sapiens
IGQQQLQVQ

SEQ ID NO: 320159 - protein, 9 aa, Homo Sapiens
GKYIFTSIL

SEQ ID NO: 320160 - protein, 9 aa, Homo Sapiens
KRGDKKGKD

SEQ ID NO: 320161 - protein, 9 aa, Homo Sapiens
EVKDKGEWD

SEQ ID NO: 320162 - protein, 9 aa, Homo Sapiens
MTGAQRSFT

SEQ ID NO: 320163 - protein, 9 aa, Homo Sapiens
SQFGTKCAR

SEQ ID NO: 320164 - protein, 9 aa, Homo Sapiens
LSQSVVLHH

SEQ ID NO: 320165 - protein, 9 aa, Homo Sapiens
HAAFSAMRV

SEQ ID NO: 320166 - protein, 9 aa, Homo Sapiens
INSLFPQNS

SEQ ID NO: 320167 - protein, 9 aa, Homo Sapiens
IDLHEAVSM

SEQ ID NO: 320168 - protein, 9 aa, Homo Sapiens
TGVIVFEGD

SEQ ID NO: 320169 - protein, 9 aa, Homo Sapiens
NLSTVGRVT

SEQ ID NO: 320170 - protein, 9 aa, Homo Sapiens
EVYLDIKAP

SEQ ID NO: 320171 - protein, 9 aa, Homo Sapiens
DFGLDMQPC

SEQ ID NO: 320172 - protein, 9 aa, Homo Sapiens
EHTRSVGRD

SEQ ID NO: 320173 - protein, 9 aa, Homo Sapiens
VWYAPVPCG

SEQ ID NO: 320174 - protein, 9 aa, Homo Sapiens
VYRRYKHVD

SEQ ID NO: 320175 - protein, 9 aa, Homo Sapiens
STIVRTVPV

SEQ ID NO: 320176 - protein, 9 aa, Homo Sapiens
GPVTSPDPG

SEQ ID NO: 320177 - protein, 9 aa, Homo Sapiens
WAPTCVDVH

SEQ ID NO: 320178 - protein, 9 aa, Homo Sapiens
VGVCRRLVE

SEQ ID NO: 320179 - protein, 9 aa, Homo Sapiens
INAMAEDSD

SEQ ID NO: 320180 - protein, 9 aa, Homo Sapiens
VVTDLASHP

SEQ ID NO: 320181 - protein, 9 aa, Homo Sapiens
LRVTSQDPG

SEQ ID NO: 320182 - protein, 9 aa, Homo Sapiens
PQQPVPYVV

SEQ ID NO: 320183 - protein, 9 aa, Homo Sapiens
ITQGVPRAL

SEQ ID NO: 320184 - protein, 9 aa, Homo Sapiens
DVTVPLVDE

SEQ ID NO: 320185 - protein, 9 aa, Homo Sapiens
CTLVWYAPV

SEQ ID NO: 320186 - protein, 9 aa, Homo Sapiens
LATVTVPLD

SEQ ID NO: 320187 - protein, 9 aa, Homo Sapiens
PPSEHHGVR

SEQ ID NO: 320188 - protein, 9 aa, Homo Sapiens
HHRHHRCPS

SEQ ID NO: 320189 - protein, 9 aa, Homo Sapiens
RASPDNLSP

SEQ ID NO: 320190 - protein, 9 aa, Homo Sapiens
SRRPPWLPA

SEQ ID NO: 320191 - protein, 9 aa, Homo Sapiens
SPGSDPFPY

SEQ ID NO: 320192 - protein, 9 aa, Homo Sapiens
GGEVGDDGD

SEQ ID NO: 320193 - protein, 9 aa, Homo Sapiens
QVQTIQCEK

SEQ ID NO: 320194 - protein, 9 aa, Homo Sapiens
DIFPDSKDS

SEQ ID NO: 320195 - protein, 9 aa, Homo Sapiens
KMKSQMGQV

SEQ ID NO: 320196 - protein, 9 aa, Homo Sapiens
AQVIHHDLK

SEQ ID NO: 320197 - protein, 9 aa, Homo Sapiens
LQPTVNFLT

SEQ ID NO: 320198 - protein, 9 aa, Homo Sapiens
QELQCNVIS

SEQ ID NO: 320199 - protein, 9 aa, Homo Sapiens
EGSCVSVWS

SEQ ID NO: 320200 - protein, 9 aa, Homo Sapiens
QALEARIWQ

SEQ ID NO: 320201 - protein, 9 aa, Homo Sapiens
AGWPCPAVP

SEQ ID NO: 320202 - protein, 9 aa, Homo Sapiens
CLLCTYVLH

SEQ ID NO: 320203 - protein, 9 aa, Homo Sapiens
DVCEKGFRY

SEQ ID NO: 320204 - protein, 9 aa, Homo Sapiens
PPPRATGVS

SEQ ID NO: 320205 - protein, 9 aa, Homo Sapiens
VRHHTGKKP

SEQ ID NO: 320206 - protein, 9 aa, Homo Sapiens
SFCVAFPLV

SEQ ID NO: 320207 - protein, 9 aa, Homo Sapiens
TNTERVKSK

SEQ ID NO: 320208 - protein, 9 aa, Homo Sapiens
KTKMVLRMF

SEQ ID NO: 320209 - protein, 9 aa, Homo Sapiens
PDMHKQRGK

SEQ ID NO: 320210 - protein, 9 aa, Homo Sapiens
WHGWMVSSR

SEQ ID NO: 320211 - protein, 9 aa, Homo Sapiens
RQEEARPPS

SEQ ID NO: 320212 - protein, 9 aa, Homo Sapiens
SWFRGLSNL

SEQ ID NO: 320213 - protein, 9 aa, Homo Sapiens
SEKKISSIR

SEQ ID NO: 320214 - protein, 9 aa, Homo Sapiens
NSPATLKVG

SEQ ID NO: 320215 - protein, 9 aa, Homo Sapiens
KPPSQFIYV

SEQ ID NO: 320216 - protein, 9 aa, Homo Sapiens
EKMVFPLAD

SEQ ID NO: 320217 - protein, 9 aa, Homo Sapiens
GEQEGACER

SEQ ID NO: 320218 - protein, 9 aa, Homo Sapiens
LHMTTTGKT

SEQ ID NO: 320219 - protein, 9 aa, Homo Sapiens
VMHARGVLK

SEQ ID NO: 320220 - protein, 9 aa, Homo Sapiens
VLKQAVCKP

SEQ ID NO: 320221 - protein, 9 aa, Homo Sapiens
QVAYTYSTM

SEQ ID NO: 320222 - protein, 9 aa, Homo Sapiens
HRRKKRRMC

SEQ ID NO: 320223 - protein, 9 aa, Homo Sapiens
AGQQPGSCP

SEQ ID NO: 320224 - protein, 9 aa, Homo Sapiens
RMFWYSMPW

SEQ ID NO: 320225 - protein, 9 aa, Homo Sapiens
RSQSRSPSK

SEQ ID NO: 320226 - protein, 9 aa, Homo Sapiens
EGATNMGTP

SEQ ID NO: 320227 - protein, 9 aa, Homo Sapiens
ARQLQRDRE

SEQ ID NO: 320228 - protein, 9 aa, Homo Sapiens
QPPAGRQSR

SEQ ID NO: 320229 - protein, 9 aa, Homo Sapiens
ANIDNAGIY

SEQ ID NO: 320230 - protein, 9 aa, Homo Sapiens
SFSVRLTYH

SEQ ID NO: 320231 - protein, 9 aa, Homo Sapiens
VQQREADLL

SEQ ID NO: 320232 - protein, 9 aa, Homo Sapiens
KEFTAGADE

SEQ ID NO: 320233 - protein, 9 aa, Homo Sapiens
ICYKDHIQQ

SEQ ID NO: 320234 - protein, 9 aa, Homo Sapiens
SPDNLSPQP

SEQ ID NO: 320235 - protein, 9 aa, Homo Sapiens
ALHNYLSLT

SEQ ID NO: 320236 - protein, 9 aa, Homo Sapiens
QSLGFTLRW

SEQ ID NO: 320237 - protein, 9 aa, Homo Sapiens
VTKLYWLDE

SEQ ID NO: 320238 - protein, 9 aa, Homo Sapiens
EEGLTTNAG

SEQ ID NO: 320239 - protein, 9 aa, Homo Sapiens
EGDAKVVVL

SEQ ID NO: 320240 - protein, 9 aa, Homo Sapiens
TIGVILCRS

SEQ ID NO: 320241 - protein, 9 aa, Homo Sapiens
LGIDQDHAA

SEQ ID NO: 320242 - protein, 9 aa, Homo Sapiens
ACHEEGSQL

SEQ ID NO: 320243 - protein, 9 aa, Homo Sapiens
VEVSATVRQ

SEQ ID NO: 320244 - protein, 9 aa, Homo Sapiens
CSKLDAAPR

SEQ ID NO: 320245 - protein, 9 aa, Homo Sapiens
PVQPVVQHR

SEQ ID NO: 320246 - protein, 9 aa, Homo Sapiens
GQKLLMRKA

SEQ ID NO: 320247 - protein, 9 aa, Homo Sapiens
LGQHHLPVW

SEQ ID NO: 320248 - protein, 9 aa, Homo Sapiens
LLWKGVQLL

SEQ ID NO: 320249 - protein, 9 aa, Homo Sapiens
IWLLESLIR

SEQ ID NO: 320250 - protein, 9 aa, Homo Sapiens
HPQVCDTST

SEQ ID NO: 320251 - protein, 9 aa, Homo Sapiens
LDNFSTPTG

SEQ ID NO: 320252 - protein, 9 aa, Homo Sapiens
VSWSFQSEG

SEQ ID NO: 320253 - protein, 9 aa, Homo Sapiens
VALCDQDNL

SEQ ID NO: 320254 - protein, 9 aa, Homo Sapiens
HGRPRADTV

SEQ ID NO: 320255 - protein, 9 aa, Homo Sapiens
NLMYAKRAF

SEQ ID NO: 320256 - protein, 9 aa, Homo Sapiens
CADAARGLK

SEQ ID NO: 320257 - protein, 9 aa, Homo Sapiens
NLQKSTDSR

SEQ ID NO: 320258 - protein, 9 aa, Homo Sapiens
ERHHILFRY

SEQ ID NO: 320259 - protein, 9 aa, Homo Sapiens
GKLDKDPLL

SEQ ID NO: 320260 - protein, 9 aa, Homo Sapiens
LHSTDKVAC

SEQ ID NO: 320261 - protein, 9 aa, Homo Sapiens
QAPKSPWHM

SEQ ID NO: 320262 - protein, 9 aa, Homo Sapiens
GLLATVTVP

SEQ ID NO: 320263 - protein, 9 aa, Homo Sapiens
FDYPQNSET

SEQ ID NO: 320264 - protein, 9 aa, Homo Sapiens
HQVSLHLKP

SEQ ID NO: 320265 - protein, 9 aa, Homo Sapiens
INENAKRRG

SEQ ID NO: 320266 - protein, 9 aa, Homo Sapiens
GVYTKVSCY

SEQ ID NO: 320267 - protein, 9 aa, Homo Sapiens
LLQDWGRSL

SEQ ID NO: 320268 - protein, 9 aa, Homo Sapiens
NKVSEHPCI

SEQ ID NO: 320269 - protein, 9 aa, Homo Sapiens
VQDMSPVFV

SEQ ID NO: 320270 - protein, 9 aa, Homo Sapiens
AQPAAPSLM

SEQ ID NO: 320271 - protein, 9 aa, Homo Sapiens
FTIEAGVPW

SEQ ID NO: 320272 - protein, 9 aa, Homo Sapiens
QVTKLYWLD

SEQ ID NO: 320273 - protein, 9 aa, Homo Sapiens
HTCSYPRWH

SEQ ID NO: 320274 - protein, 9 aa, Homo Sapiens
RAVTEIVET

SEQ ID NO: 320275 - protein, 9 aa, Homo Sapiens
KDEKSGPCS

SEQ ID NO: 320276 - protein, 9 aa, Homo Sapiens
AWAMTNYIH

SEQ ID NO: 320277 - protein, 9 aa, Homo Sapiens
IRMMQVQEA

SEQ ID NO: 320278 - protein, 9 aa, Homo Sapiens
SLSSFMTSP

SEQ ID NO: 320279 - protein, 9 aa, Homo Sapiens
CQASEGKHP

SEQ ID NO: 320280 - protein, 9 aa, Homo Sapiens
YLMLFSNVP

SEQ ID NO: 320281 - protein, 9 aa, Homo Sapiens
QEAAFADNL

SEQ ID NO: 320282 - protein, 9 aa, Homo Sapiens
WHIVKEFKR

SEQ ID NO: 320283 - protein, 9 aa, Homo Sapiens
EKEISSLWN

SEQ ID NO: 320284 - protein, 9 aa, Homo Sapiens
VPDQEDAFA

SEQ ID NO: 320285 - protein, 9 aa, Homo Sapiens
PARTGLLPG

SEQ ID NO: 320286 - protein, 9 aa, Homo Sapiens
PRVNRCTLA

SEQ ID NO: 320287 - protein, 9 aa, Homo Sapiens
FNLYEDCKD

SEQ ID NO: 320288 - protein, 9 aa, Homo Sapiens
LPTSFTLVP

SEQ ID NO: 320289 - protein, 9 aa, Homo Sapiens
LPLDKSESQ

SEQ ID NO: 320290 - protein, 9 aa, Homo Sapiens
SQRRGIYPT

SEQ ID NO: 320291 - protein, 9 aa, Homo Sapiens
KKNRSSGPL

SEQ ID NO: 320292 - protein, 9 aa, Homo Sapiens
VGRDSSLQV

SEQ ID NO: 320293 - protein, 9 aa, Homo Sapiens
RRDAPAGCK

SEQ ID NO: 320294 - protein, 9 aa, Homo Sapiens
CVAFPLVVG

SEQ ID NO: 320295 - protein, 9 aa, Homo Sapiens
LRGKCEAML

SEQ ID NO: 320296 - protein, 9 aa, Homo Sapiens
CARDPDNNE

SEQ ID NO: 320297 - protein, 9 aa, Homo Sapiens
SPLGDLLQG

SEQ ID NO: 320298 - protein, 9 aa, Homo Sapiens
PGLVGHQGA

SEQ ID NO: 320299 - protein, 9 aa, Homo Sapiens
GGRVAFCMV

SEQ ID NO: 320300 - protein, 9 aa, Homo Sapiens
HMNVLELIE

SEQ ID NO: 320301 - protein, 9 aa, Homo Sapiens
SAPDACKLC

SEQ ID NO: 320302 - protein, 9 aa, Homo Sapiens
RCLFASGGP

SEQ ID NO: 320303 - protein, 9 aa, Homo Sapiens
LSIEEAQDP

SEQ ID NO: 320304 - protein, 9 aa, Homo Sapiens
GSGSSWSSS

SEQ ID NO: 320305 - protein, 9 aa, Homo Sapiens
SGGAPVPWS

SEQ ID NO: 320306 - protein, 9 aa, Homo Sapiens
HRPRQDSEG

SEQ ID NO: 320307 - protein, 9 aa, Homo Sapiens
LGRAGSPHG

SEQ ID NO: 320308 - protein, 9 aa, Homo Sapiens
RVSDHQQLE

SEQ ID NO: 320309 - protein, 9 aa, Homo Sapiens
QVSSQVVMP

SEQ ID NO: 320310 - protein, 9 aa, Homo Sapiens
FRKGPGKQE

SEQ ID NO: 320311 - protein, 9 aa, Homo Sapiens
GVWNTAIQS

SEQ ID NO: 320312 - protein, 9 aa, Homo Sapiens
ISAEYPKMC

SEQ ID NO: 320313 - protein, 9 aa, Homo Sapiens
ERRCCSVEL

SEQ ID NO: 320314 - protein, 9 aa, Homo Sapiens
SLLSVFSQH

SEQ ID NO: 320315 - protein, 9 aa, Homo Sapiens
GKAFRQRTS

SEQ ID NO: 320316 - protein, 9 aa, Homo Sapiens
NIQIVLVGV

SEQ ID NO: 320317 - protein, 9 aa, Homo Sapiens
DITQGVPRA

SEQ ID NO: 320318 - protein, 9 aa, Homo Sapiens
QPHWIASPA

SEQ ID NO: 320319 - protein, 9 aa, Homo Sapiens
RDGSAFYQG

SEQ ID NO: 320320 - protein, 9 aa, Homo Sapiens
VNFLRTWGR

SEQ ID NO: 320321 - protein, 9 aa, Homo Sapiens
PMAFVKAKE

SEQ ID NO: 320322 - protein, 9 aa, Homo Sapiens
HRHRRLHLP

SEQ ID NO: 320323 - protein, 9 aa, Homo Sapiens
LQEVQGQAG

SEQ ID NO: 320324 - protein, 9 aa, Homo Sapiens
HQGEGTTPC

SEQ ID NO: 320325 - protein, 9 aa, Homo Sapiens
ELQQTGRIF

SEQ ID NO: 320326 - protein, 9 aa, Homo Sapiens
LWKVDQGLF

SEQ ID NO: 320327 - protein, 9 aa, Homo Sapiens
PEEMLMERE

SEQ ID NO: 320328 - protein, 9 aa, Homo Sapiens
LRSTMPVNT

SEQ ID NO: 320329 - protein, 9 aa, Homo Sapiens
EEGGCASGT

SEQ ID NO: 320330 - protein, 9 aa, Homo Sapiens
GYGLISFKI

SEQ ID NO: 320331 - protein, 9 aa, Homo Sapiens
RATGVSFMN

SEQ ID NO: 320332 - protein, 9 aa, Homo Sapiens
HQQSRANGV

SEQ ID NO: 320333 - protein, 9 aa, Homo Sapiens
EDLEVNIVK

SEQ ID NO: 320334 - protein, 9 aa, Homo Sapiens
QQKPVVCTC

SEQ ID NO: 320335 - protein, 9 aa, Homo Sapiens
VQHELQHPI

SEQ ID NO: 320336 - protein, 9 aa, Homo Sapiens
KARRGPLRV

SEQ ID NO: 320337 - protein, 9 aa, Homo Sapiens
QIEEGERPD

SEQ ID NO: 320338 - protein, 9 aa, Homo Sapiens
EEPVFSRDD

SEQ ID NO: 320339 - protein, 9 aa, Homo Sapiens
IEAGVPWHD

SEQ ID NO: 320340 - protein, 9 aa, Homo Sapiens
PQLFAAVPR

SEQ ID NO: 320341 - protein, 9 aa, Homo Sapiens
RYCSNIDKH

SEQ ID NO: 320342 - protein, 9 aa, Homo Sapiens
CGHVYPMQK

SEQ ID NO: 320343 - protein, 9 aa, Homo Sapiens
FFAWDNTAN

SEQ ID NO: 320344 - protein, 9 aa, Homo Sapiens
IVSVQYFLI

SEQ ID NO: 320345 - protein, 9 aa, Homo Sapiens
ARTRNPNGN

SEQ ID NO: 320346 - protein, 9 aa, Homo Sapiens
DMDLPPNKD

SEQ ID NO: 320347 - protein, 9 aa, Homo Sapiens
EEKMHNQEE

SEQ ID NO: 320348 - protein, 9 aa, Homo Sapiens
SKRQEDQHR

SEQ ID NO: 320349 - protein, 9 aa, Homo Sapiens
EVRSSWPLY

SEQ ID NO: 320350 - protein, 9 aa, Homo Sapiens
LSDITCCTA

SEQ ID NO: 320351 - protein, 9 aa, Homo Sapiens
IPISLHVNL

SEQ ID NO: 320352 - protein, 9 aa, Homo Sapiens
ATVPHHEPP

SEQ ID NO: 320353 - protein, 9 aa, Homo Sapiens
VKWNKDDRP

SEQ ID NO: 320354 - protein, 9 aa, Homo Sapiens
STTSSCRGA

SEQ ID NO: 320355 - protein, 9 aa, Homo Sapiens
RLGGGSSDA

SEQ ID NO: 320356 - protein, 9 aa, Homo Sapiens
PSQRRPHRP

SEQ ID NO: 320357 - protein, 9 aa, Homo Sapiens
RQVTYHVIF

SEQ ID NO: 320358 - protein, 9 aa, Homo Sapiens
HSRVPMMNV

SEQ ID NO: 320359 - protein, 9 aa, Homo Sapiens
KSRNVEIGT

SEQ ID NO: 320360 - protein, 9 aa, Homo Sapiens
VALKHVGPG

SEQ ID NO: 320361 - protein, 9 aa, Homo Sapiens
LAISKGYVQ

SEQ ID NO: 320362 - protein, 9 aa, Homo Sapiens
DKSVCVLVS

SEQ ID NO: 320363 - protein, 9 aa, Homo Sapiens
PGPDGPPSP

SEQ ID NO: 320364 - protein, 9 aa, Homo Sapiens
GKYGALTKD

SEQ ID NO: 320365 - protein, 9 aa, Homo Sapiens
QQRPQSPQR

SEQ ID NO: 320366 - protein, 9 aa, Homo Sapiens
LTIVGTITG

SEQ ID NO: 320367 - protein, 9 aa, Homo Sapiens
GPARTGLLP

SEQ ID NO: 320368 - protein, 9 aa, Homo Sapiens
LSALMPGGH

SEQ ID NO: 320369 - protein, 9 aa, Homo Sapiens
ALEARIWQK

SEQ ID NO: 320370 - protein, 9 aa, Homo Sapiens
EEYYTITEF

SEQ ID NO: 320371 - protein, 9 aa, Homo Sapiens
VCSMAEGTG

SEQ ID NO: 320372 - protein, 9 aa, Homo Sapiens
MTNYIHVPP

SEQ ID NO: 320373 - protein, 9 aa, Homo Sapiens
KFNKRAEMQ

SEQ ID NO: 320374 - protein, 9 aa, Homo Sapiens
NLESGMNWQ

SEQ ID NO: 320375 - protein, 9 aa, Homo Sapiens
IYQLLRSCS

SEQ ID NO: 320376 - protein, 9 aa, Homo Sapiens
VQNYKIGPS

SEQ ID NO: 320377 - protein, 9 aa, Homo Sapiens
WARTEDYLK

SEQ ID NO: 320378 - protein, 9 aa, Homo Sapiens
AKDSSSTES

SEQ ID NO: 320379 - protein, 9 aa, Homo Sapiens
DWLSTIKMV

SEQ ID NO: 320380 - protein, 9 aa, Homo Sapiens
LQVESESAA

SEQ ID NO: 320381 - protein, 9 aa, Homo Sapiens
QPQVGLSQA

SEQ ID NO: 320382 - protein, 9 aa, Homo Sapiens
YTFYLSCKE

SEQ ID NO: 320383 - protein, 9 aa, Homo Sapiens
SIYFGALID

SEQ ID NO: 320384 - protein, 9 aa, Homo Sapiens
TGEKSCAVK

SEQ ID NO: 320385 - protein, 9 aa, Homo Sapiens
AALSATVPH

SEQ ID NO: 320386 - protein, 9 aa, Homo Sapiens
PSLMRPFLA

SEQ ID NO: 320387 - protein, 9 aa, Homo Sapiens
LPGRPAHWA

SEQ ID NO: 320388 - protein, 9 aa, Homo Sapiens
PRGEDGKPF

SEQ ID NO: 320389 - protein, 9 aa, Homo Sapiens
MTTLITETP

SEQ ID NO: 320390 - protein, 9 aa, Homo Sapiens
PRAGARPHR

SEQ ID NO: 320391 - protein, 9 aa, Homo Sapiens
ISAEAVVVD

SEQ ID NO: 320392 - protein, 9 aa, Homo Sapiens
ICHMIDKRS

SEQ ID NO: 320393 - protein, 9 aa, Homo Sapiens
KKAELAKKN

SEQ ID NO: 320394 - protein, 9 aa, Homo Sapiens
PSRHETSLG

SEQ ID NO: 320395 - protein, 9 aa, Homo Sapiens
QYLRSVQLP

SEQ ID NO: 320396 - protein, 9 aa, Homo Sapiens
SEDVDKGPK

SEQ ID NO: 320397 - protein, 9 aa, Homo Sapiens
WGPSPRGRT

SEQ ID NO: 320398 - protein, 9 aa, Homo Sapiens
HRFMSVYEQ

SEQ ID NO: 320399 - protein, 9 aa, Homo Sapiens
LHLSLNEEG

SEQ ID NO: 320400 - protein, 9 aa, Homo Sapiens
VMECADAAR

SEQ ID NO: 320401 - protein, 9 aa, Homo Sapiens
ETVALKHVG

SEQ ID NO: 320402 - protein, 9 aa, Homo Sapiens
DSAAECYRL

SEQ ID NO: 320403 - protein, 9 aa, Homo Sapiens
RRWAPWNTH

SEQ ID NO: 320404 - protein, 9 aa, Homo Sapiens
AAHLEHLLQ

SEQ ID NO: 320405 - protein, 9 aa, Homo Sapiens
SLHSQRLHW

SEQ ID NO: 320406 - protein, 9 aa, Homo Sapiens
SRSAACGGR

SEQ ID NO: 320407 - protein, 9 aa, Homo Sapiens
QTTMITAIL

SEQ ID NO: 320408 - protein, 9 aa, Homo Sapiens
SGCLAEDVQ

SEQ ID NO: 320409 - protein, 9 aa, Homo Sapiens
NVEDVQDMS

SEQ ID NO: 320410 - protein, 9 aa, Homo Sapiens
VMKPGVWWP

SEQ ID NO: 320411 - protein, 9 aa, Homo Sapiens
TNGLCIWLL

SEQ ID NO: 320412 - protein, 9 aa, Homo Sapiens
APSPDTSQL

SEQ ID NO: 320413 - protein, 9 aa, Homo Sapiens
LELKLSMRE

SEQ ID NO: 320414 - protein, 9 aa, Homo Sapiens
NKFEALAAR

SEQ ID NO: 320415 - protein, 9 aa, Homo Sapiens
LEKLPKLNQ

SEQ ID NO: 320416 - protein, 9 aa, Homo Sapiens
APHGVVWDS

SEQ ID NO: 320417 - protein, 9 aa, Homo Sapiens
PTMVQGPAG

SEQ ID NO: 320418 - protein, 9 aa, Homo Sapiens
GKPPSQFIY

SEQ ID NO: 320419 - protein, 9 aa, Homo Sapiens
SRMEIRNES

SEQ ID NO: 320420 - protein, 9 aa, Homo Sapiens
KKYRVAKAL

SEQ ID NO: 320421 - protein, 9 aa, Homo Sapiens
DDRVFFFIP

SEQ ID NO: 320422 - protein, 9 aa, Homo Sapiens
LQITKNSYN

SEQ ID NO: 320423 - protein, 9 aa, Homo Sapiens
CRGARAPQK

SEQ ID NO: 320424 - protein, 9 aa, Homo Sapiens
NECCKVFRQ

SEQ ID NO: 320425 - protein, 9 aa, Homo Sapiens
HLPVWAVTQ

SEQ ID NO: 320426 - protein, 9 aa, Homo Sapiens
FYDEYCSNH

SEQ ID NO: 320427 - protein, 9 aa, Homo Sapiens
VIGTSVARY

SEQ ID NO: 320428 - protein, 9 aa, Homo Sapiens
DILILTVLL

SEQ ID NO: 320429 - protein, 9 aa, Homo Sapiens
DLLEPVDYM

SEQ ID NO: 320430 - protein, 9 aa, Homo Sapiens
QFRAEKERR

SEQ ID NO: 320431 - protein, 9 aa, Homo Sapiens
LLYAWDNGR

SEQ ID NO: 320432 - protein, 9 aa, Homo Sapiens
KKLSLKHRS

SEQ ID NO: 320433 - protein, 9 aa, Homo Sapiens
IGNKTECAL

SEQ ID NO: 320434 - protein, 9 aa, Homo Sapiens
TERVKSKDA

SEQ ID NO: 320435 - protein, 9 aa, Homo Sapiens
IQTQNRKMS

SEQ ID NO: 320436 - protein, 9 aa, Homo Sapiens
VSQEPVLFT

SEQ ID NO: 320437 - protein, 9 aa, Homo Sapiens
SAGAYLIHR

SEQ ID NO: 320438 - protein, 9 aa, Homo Sapiens
VIDVGVCRR

SEQ ID NO: 320439 - protein, 9 aa, Homo Sapiens
QGHMNVLEL

SEQ ID NO: 320440 - protein, 9 aa, Homo Sapiens
SLHLASRCS

SEQ ID NO: 320441 - protein, 9 aa, Homo Sapiens
FSVFDILSP

SEQ ID NO: 320442 - protein, 9 aa, Homo Sapiens
VSVWSSRCS

SEQ ID NO: 320443 - protein, 9 aa, Homo Sapiens
RYNSKLSWH

SEQ ID NO: 320444 - protein, 9 aa, Homo Sapiens
TYHRFGNNT

SEQ ID NO: 320445 - protein, 9 aa, Homo Sapiens
AVKDSVWDC

SEQ ID NO: 320446 - protein, 9 aa, Homo Sapiens
RTRTLTGTP

SEQ ID NO: 320447 - protein, 9 aa, Homo Sapiens
LKGRLVISW

SEQ ID NO: 320448 - protein, 9 aa, Homo Sapiens
DDDEDSRHS

SEQ ID NO: 320449 - protein, 9 aa, Homo Sapiens
WLDEKWDFI

SEQ ID NO: 320450 - protein, 9 aa, Homo Sapiens
GARVHTAEN

SEQ ID NO: 320451 - protein, 9 aa, Homo Sapiens
QEQLHLRIG

SEQ ID NO: 320452 - protein, 9 aa, Homo Sapiens
FTGSHCKKD

SEQ ID NO: 320453 - protein, 9 aa, Homo Sapiens
ASGLCSNKK

SEQ ID NO: 320454 - protein, 9 aa, Homo Sapiens
EWLNKHSIQ

SEQ ID NO: 320455 - protein, 9 aa, Homo Sapiens
VQLTARIHR

SEQ ID NO: 320456 - protein, 9 aa, Homo Sapiens
GPEREVIIN

SEQ ID NO: 320457 - protein, 9 aa, Homo Sapiens
EEVLNLATE

SEQ ID NO: 320458 - protein, 9 aa, Homo Sapiens
GYMIVKCQG

SEQ ID NO: 320459 - protein, 9 aa, Homo Sapiens
RRATATTGQ

SEQ ID NO: 320460 - protein, 9 aa, Homo Sapiens
CSNNKITDI

SEQ ID NO: 320461 - protein, 9 aa, Homo Sapiens
LMAQVNQTF

SEQ ID NO: 320462 - protein, 9 aa, Homo Sapiens
EYTSDGMNV

SEQ ID NO: 320463 - protein, 9 aa, Homo Sapiens
SHCDSHSPQ

SEQ ID NO: 320464 - protein, 9 aa, Homo Sapiens
GPLLTKGKA

SEQ ID NO: 320465 - protein, 9 aa, Homo Sapiens
ETDEQRARQ

SEQ ID NO: 320466 - protein, 9 aa, Homo Sapiens
SRVPMMNVS

SEQ ID NO: 320467 - protein, 9 aa, Homo Sapiens
RNLQITKNS

SEQ ID NO: 320468 - protein, 9 aa, Homo Sapiens
WISDDVALC

SEQ ID NO: 320469 - protein, 9 aa, Homo Sapiens
SSKATDLLT

SEQ ID NO: 320470 - protein, 9 aa, Homo Sapiens
RLKKAYFQM

SEQ ID NO: 320471 - protein, 9 aa, Homo Sapiens
SSRQTGAKS

SEQ ID NO: 320472 - protein, 9 aa, Homo Sapiens
RQRTSLILH

SEQ ID NO: 320473 - protein, 9 aa, Homo Sapiens
GPCAPLPPP

SEQ ID NO: 320474 - protein, 9 aa, Homo Sapiens
DASPQYPAI

SEQ ID NO: 320475 - protein, 9 aa, Homo Sapiens
KRSAWRKTT

SEQ ID NO: 320476 - protein, 9 aa, Homo Sapiens
LGGSGTYSH

SEQ ID NO: 320477 - protein, 9 aa, Homo Sapiens
NYDIELAVS

SEQ ID NO: 320478 - protein, 9 aa, Homo Sapiens
IGVLTSSGD

SEQ ID NO: 320479 - protein, 9 aa, Homo Sapiens
DGDRKLTAK

SEQ ID NO: 320480 - protein, 9 aa, Homo Sapiens
TNCTLIISY

SEQ ID NO: 320481 - protein, 9 aa, Homo Sapiens
RVLTITGIY

SEQ ID NO: 320482 - protein, 9 aa, Homo Sapiens
GPSLFESIA

SEQ ID NO: 320483 - protein, 9 aa, Homo Sapiens
GHVPKSEKE

SEQ ID NO: 320484 - protein, 9 aa, Homo Sapiens
KPNSGVGAE

SEQ ID NO: 320485 - protein, 9 aa, Homo Sapiens
RSVGRDSSL

SEQ ID NO: 320486 - protein, 9 aa, Homo Sapiens
STAEESEPE

SEQ ID NO: 320487 - protein, 9 aa, Homo Sapiens
KYEYKKPEE

SEQ ID NO: 320488 - protein, 9 aa, Homo Sapiens
NFLDKEACE

SEQ ID NO: 320489 - protein, 9 aa, Homo Sapiens
QAQQLGGEV

SEQ ID NO: 320490 - protein, 9 aa, Homo Sapiens
YIDNQAVST

SEQ ID NO: 320491 - protein, 9 aa, Homo Sapiens
KGRLVISWR

SEQ ID NO: 320492 - protein, 9 aa, Homo Sapiens
VCGHVYPMQ

SEQ ID NO: 320493 - protein, 9 aa, Homo Sapiens
EKRLPYLTA

SEQ ID NO: 320494 - protein, 9 aa, Homo Sapiens
ALDRRGGAR

SEQ ID NO: 320495 - protein, 9 aa, Homo Sapiens
SMREAQEQA

SEQ ID NO: 320496 - protein, 9 aa, Homo Sapiens
LSGLSPMEG

SEQ ID NO: 320497 - protein, 9 aa, Homo Sapiens
KSSHPLRVF

SEQ ID NO: 320498 - protein, 9 aa, Homo Sapiens
MKVPIAIWA

SEQ ID NO: 320499 - protein, 9 aa, Homo Sapiens
AAVDVLCRT

SEQ ID NO: 320500 - protein, 9 aa, Homo Sapiens
LVKKYEYKK

SEQ ID NO: 320501 - protein, 9 aa, Homo Sapiens
KMMHIATTL

SEQ ID NO: 320502 - protein, 9 aa, Homo Sapiens
IMKNSMYIH

SEQ ID NO: 320503 - protein, 9 aa, Homo Sapiens
PSRAHCPAN

SEQ ID NO: 320504 - protein, 9 aa, Homo Sapiens
TSVSWSFQS

SEQ ID NO: 320505 - protein, 9 aa, Homo Sapiens
PGMLSIGSA

SEQ ID NO: 320506 - protein, 9 aa, Homo Sapiens
LTEHQLDLG

SEQ ID NO: 320507 - protein, 9 aa, Homo Sapiens
KHAIRSLIQ

SEQ ID NO: 320508 - protein, 9 aa, Homo Sapiens
IIFQMTLIA

SEQ ID NO: 320509 - protein, 9 aa, Homo Sapiens
LAQSKLMRL

SEQ ID NO: 320510 - protein, 9 aa, Homo Sapiens
NTKSALKCH

SEQ ID NO: 320511 - protein, 9 aa, Homo Sapiens
DLNHIQNKP

SEQ ID NO: 320512 - protein, 9 aa, Homo Sapiens
FDILSPLEE

SEQ ID NO: 320513 - protein, 9 aa, Homo Sapiens
PCSPPLKPS

SEQ ID NO: 320514 - protein, 9 aa, Homo Sapiens
ANGSSHRNQ

SEQ ID NO: 320515 - protein, 9 aa, Homo Sapiens
CLNNRFTSF

SEQ ID NO: 320516 - protein, 9 aa, Homo Sapiens
LLALCITDP

SEQ ID NO: 320517 - protein, 9 aa, Homo Sapiens
ETQEQERIL

SEQ ID NO: 320518 - protein, 9 aa, Homo Sapiens
VIQLQARLH

SEQ ID NO: 320519 - protein, 9 aa, Homo Sapiens
QAMDTALAH

SEQ ID NO: 320520 - protein, 9 aa, Homo Sapiens
RPGGFLGQR

SEQ ID NO: 320521 - protein, 9 aa, Homo Sapiens
RLGSCFRFS

SEQ ID NO: 320522 - protein, 9 aa, Homo Sapiens
CLNSFLRDY

SEQ ID NO: 320523 - protein, 9 aa, Homo Sapiens
FSDVVTDLA

SEQ ID NO: 320524 - protein, 9 aa, Homo Sapiens
ASIDTAIIQ

SEQ ID NO: 320525 - protein, 9 aa, Homo Sapiens
RIWQKDEED

SEQ ID NO: 320526 - protein, 9 aa, Homo Sapiens
PQRPHDGAS

SEQ ID NO: 320527 - protein, 9 aa, Homo Sapiens
VRMAALESL

SEQ ID NO: 320528 - protein, 9 aa, Homo Sapiens
TKNEKFHMW

SEQ ID NO: 320529 - protein, 9 aa, Homo Sapiens
LLSSVHPPG

SEQ ID NO: 320530 - protein, 9 aa, Homo Sapiens
LLSFAHTNC

SEQ ID NO: 320531 - protein, 9 aa, Homo Sapiens
VNNAENAAH

SEQ ID NO: 320532 - protein, 9 aa, Homo Sapiens
GRHWLTWVL

SEQ ID NO: 320533 - protein, 9 aa, Homo Sapiens
QKTRDVKCV

SEQ ID NO: 320534 - protein, 9 aa, Homo Sapiens
LITQNSTPI

SEQ ID NO: 320535 - protein, 9 aa, Homo Sapiens
PPPGTEAYI

SEQ ID NO: 320536 - protein, 9 aa, Homo Sapiens
KCINHYGGH

SEQ ID NO: 320537 - protein, 9 aa, Homo Sapiens
FLCENPYYD

SEQ ID NO: 320538 - protein, 9 aa, Homo Sapiens
ESGQVVTIK

SEQ ID NO: 320539 - protein, 9 aa, Homo Sapiens
DTEDDPLLR

SEQ ID NO: 320540 - protein, 9 aa, Homo Sapiens
TAEEMAGSA

SEQ ID NO: 320541 - protein, 9 aa, Homo Sapiens
SRSALHVTA

SEQ ID NO: 320542 - protein, 9 aa, Homo Sapiens
LQHGVVVLA

SEQ ID NO: 320543 - protein, 9 aa, Homo Sapiens
GNEIYEDLM

SEQ ID NO: 320544 - protein, 9 aa, Homo Sapiens
VTLPMDINN

SEQ ID NO: 320545 - protein, 9 aa, Homo Sapiens
LCLYLLGRV

SEQ ID NO: 320546 - protein, 9 aa, Homo Sapiens
THTGEKSCA

SEQ ID NO: 320547 - protein, 9 aa, Homo Sapiens
WDFLKLYQV

SEQ ID NO: 320548 - protein, 9 aa, Homo Sapiens
LGHLKDQDK

SEQ ID NO: 320549 - protein, 9 aa, Homo Sapiens
VGFPMWGRG

SEQ ID NO: 320550 - protein, 9 aa, Homo Sapiens
REEEVDTDA

SEQ ID NO: 320551 - protein, 9 aa, Homo Sapiens
LPLQVRSPV

SEQ ID NO: 320552 - protein, 9 aa, Homo Sapiens
FIPTMHLSV

SEQ ID NO: 320553 - protein, 9 aa, Homo Sapiens
FSISFNRVL

SEQ ID NO: 320554 - protein, 9 aa, Homo Sapiens
RHSSRRRGS

SEQ ID NO: 320555 - protein, 9 aa, Homo Sapiens
GSGGSGLSC

SEQ ID NO: 320556 - protein, 9 aa, Homo Sapiens
SENSCTEME

SEQ ID NO: 320557 - protein, 9 aa, Homo Sapiens
LTAKEEEAR

SEQ ID NO: 320558 - protein, 9 aa, Homo Sapiens
ALSNSGQGQ

SEQ ID NO: 320559 - protein, 9 aa, Homo Sapiens
SGWHCFMTS

SEQ ID NO: 320560 - protein, 9 aa, Homo Sapiens
RTVHCPCAV

SEQ ID NO: 320561 - protein, 9 aa, Homo Sapiens
DIEIYLKLH

SEQ ID NO: 320562 - protein, 9 aa, Homo Sapiens
EWIHMDSRP

SEQ ID NO: 320563 - protein, 9 aa, Homo Sapiens
SSCGEGFVN

SEQ ID NO: 320564 - protein, 9 aa, Homo Sapiens
KKRRRRRSK

SEQ ID NO: 320565 - protein, 9 aa, Homo Sapiens
CTARLVSLQ

SEQ ID NO: 320566 - protein, 9 aa, Homo Sapiens
PSGGRPGGF

SEQ ID NO: 320567 - protein, 9 aa, Homo Sapiens
VQKLYTCAS

SEQ ID NO: 320568 - protein, 9 aa, Homo Sapiens
HFLAQLKER

SEQ ID NO: 320569 - protein, 9 aa, Homo Sapiens
WLGRAIFID

SEQ ID NO: 320570 - protein, 9 aa, Homo Sapiens
SYPPTTAKD

SEQ ID NO: 320571 - protein, 9 aa, Homo Sapiens
ETEVVNEIL

SEQ ID NO: 320572 - protein, 9 aa, Homo Sapiens
VTHPLVHIT

SEQ ID NO: 320573 - protein, 9 aa, Homo Sapiens
AASEDVDKG

SEQ ID NO: 320574 - protein, 9 aa, Homo Sapiens
GEGFVNTYG

SEQ ID NO: 320575 - protein, 9 aa, Homo Sapiens
KPTTISIDV

SEQ ID NO: 320576 - protein, 9 aa, Homo Sapiens
EPQSFIHRN

SEQ ID NO: 320577 - protein, 9 aa, Homo Sapiens
WAALSNSGQ

SEQ ID NO: 320578 - protein, 9 aa, Homo Sapiens
KRHRLLHCT

SEQ ID NO: 320579 - protein, 9 aa, Homo Sapiens
CEEACCKSL

SEQ ID NO: 320580 - protein, 9 aa, Homo Sapiens
PIIEIHIVE

SEQ ID NO: 320581 - protein, 9 aa, Homo Sapiens
ARWGPSPRG

SEQ ID NO: 320582 - protein, 9 aa, Homo Sapiens
FQKLNVPMA

SEQ ID NO: 320583 - protein, 9 aa, Homo Sapiens
LRWVLEGMK

SEQ ID NO: 320584 - protein, 9 aa, Homo Sapiens
DEPWMLGNA

SEQ ID NO: 320585 - protein, 9 aa, Homo Sapiens
LRKQFETTA

SEQ ID NO: 320586 - protein, 9 aa, Homo Sapiens
EYLLRLASM

SEQ ID NO: 320587 - protein, 9 aa, Homo Sapiens
HVGTVIGSN

SEQ ID NO: 320588 - protein, 9 aa, Homo Sapiens
VRCRRTETM

SEQ ID NO: 320589 - protein, 9 aa, Homo Sapiens
SLLTYGVGV

SEQ ID NO: 320590 - protein, 9 aa, Homo Sapiens
KFSPHYEFG

SEQ ID NO: 320591 - protein, 9 aa, Homo Sapiens
DIQEEDKGN

SEQ ID NO: 320592 - protein, 9 aa, Homo Sapiens
GQSKQSPLE

SEQ ID NO: 320593 - protein, 9 aa, Homo Sapiens
AHIEKAYAQ

SEQ ID NO: 320594 - protein, 9 aa, Homo Sapiens
DFRMVLQKL

SEQ ID NO: 320595 - protein, 9 aa, Homo Sapiens
IRSIVPALE

SEQ ID NO: 320596 - protein, 9 aa, Homo Sapiens
GKHPSENLG

SEQ ID NO: 320597 - protein, 9 aa, Homo Sapiens
KKRRMCSMV

SEQ ID NO: 320598 - protein, 9 aa, Homo Sapiens
SPVFVGTPY

SEQ ID NO: 320599 - protein, 9 aa, Homo Sapiens
DIKCHRTKE

SEQ ID NO: 320600 - protein, 9 aa, Homo Sapiens
TTCELYLED

SEQ ID NO: 320601 - protein, 9 aa, Homo Sapiens
APCVPPLQP

SEQ ID NO: 320602 - protein, 9 aa, Homo Sapiens
EKDIRLSTS

SEQ ID NO: 320603 - protein, 9 aa, Homo Sapiens
KKSPKGKGR

SEQ ID NO: 320604 - protein, 9 aa, Homo Sapiens
GSLESPSSS

SEQ ID NO: 320605 - protein, 9 aa, Homo Sapiens
WGFLVTGLM

SEQ ID NO: 320606 - protein, 9 aa, Homo Sapiens
KTSKRGSKI

SEQ ID NO: 320607 - protein, 9 aa, Homo Sapiens
PKADMTGAQ

SEQ ID NO: 320608 - protein, 9 aa, Homo Sapiens
VCEGTRVAS

SEQ ID NO: 320609 - protein, 9 aa, Homo Sapiens
KRLWTHLPN

SEQ ID NO: 320610 - protein, 9 aa, Homo Sapiens
QCNVISSSS

SEQ ID NO: 320611 - protein, 9 aa, Homo Sapiens
NDSRSTKGF

SEQ ID NO: 320612 - protein, 9 aa, Homo Sapiens
SCDPRDLKR

SEQ ID NO: 320613 - protein, 9 aa, Homo Sapiens
KETKGGVPE

SEQ ID NO: 320614 - protein, 9 aa, Homo Sapiens
NILALVYQD

SEQ ID NO: 320615 - protein, 9 aa, Homo Sapiens
HMFSIWELT

SEQ ID NO: 320616 - protein, 9 aa, Homo Sapiens
SHGAGILTC

SEQ ID NO: 320617 - protein, 9 aa, Homo Sapiens
NNREKQGLA

SEQ ID NO: 320618 - protein, 9 aa, Homo Sapiens
LVQHICAAV

SEQ ID NO: 320619 - protein, 9 aa, Homo Sapiens
DKFYVHSEA

SEQ ID NO: 320620 - protein, 9 aa, Homo Sapiens
FQQGLVFLS

SEQ ID NO: 320621 - protein, 9 aa, Homo Sapiens
SCFIAMLEM

SEQ ID NO: 320622 - protein, 9 aa, Homo Sapiens
GSSPIPLPF

SEQ ID NO: 320623 - protein, 9 aa, Homo Sapiens
SRHSSRRRG

SEQ ID NO: 320624 - protein, 9 aa, Homo Sapiens
AMEFAFRKR

SEQ ID NO: 320625 - protein, 9 aa, Homo Sapiens
DMETEVVNE

SEQ ID NO: 320626 - protein, 9 aa, Homo Sapiens
YSDAPEEIC

SEQ ID NO: 320627 - protein, 9 aa, Homo Sapiens
KVQDARDQN

SEQ ID NO: 320628 - protein, 9 aa, Homo Sapiens
LRGLLHPPQ

SEQ ID NO: 320629 - protein, 9 aa, Homo Sapiens
GSALLHPDI

SEQ ID NO: 320630 - protein, 9 aa, Homo Sapiens
HTDIQNDEK

SEQ ID NO: 320631 - protein, 9 aa, Homo Sapiens
VRLTYHRFG

SEQ ID NO: 320632 - protein, 9 aa, Homo Sapiens
KVRLAVQKG

SEQ ID NO: 320633 - protein, 9 aa, Homo Sapiens
NALGYHCDW

SEQ ID NO: 320634 - protein, 9 aa, Homo Sapiens
YQQARKKHY

SEQ ID NO: 320635 - protein, 9 aa, Homo Sapiens
TAATSPSAV

SEQ ID NO: 320636 - protein, 9 aa, Homo Sapiens
GYCMSLTSS

SEQ ID NO: 320637 - protein, 9 aa, Homo Sapiens
TVAFCDTQS

SEQ ID NO: 320638 - protein, 9 aa, Homo Sapiens
VGGMKDVVW

SEQ ID NO: 320639 - protein, 9 aa, Homo Sapiens
RGKTGLRLW

SEQ ID NO: 320640 - protein, 9 aa, Homo Sapiens
DGDLDVMFA

SEQ ID NO: 320641 - protein, 9 aa, Homo Sapiens
SVCVLVSDI

SEQ ID NO: 320642 - protein, 9 aa, Homo Sapiens
IVQYLRSVQ

SEQ ID NO: 320643 - protein, 9 aa, Homo Sapiens
VVEGGLWAR

SEQ ID NO: 320644 - protein, 9 aa, Homo Sapiens
SVNLFPTVS

SEQ ID NO: 320645 - protein, 9 aa, Homo Sapiens
RENSMRSCR

SEQ ID NO: 320646 - protein, 9 aa, Homo Sapiens
RAAEDKPWA

SEQ ID NO: 320647 - protein, 9 aa, Homo Sapiens
YECLHVANE

SEQ ID NO: 320648 - protein, 9 aa, Homo Sapiens
YRYYNQVGW

SEQ ID NO: 320649 - protein, 9 aa, Homo Sapiens
WHQIQADSF

SEQ ID NO: 320650 - protein, 9 aa, Homo Sapiens
GRVAFCMVK

SEQ ID NO: 320651 - protein, 9 aa, Homo Sapiens
LMLCENDSR

SEQ ID NO: 320652 - protein, 9 aa, Homo Sapiens
LFQSCLNVG

SEQ ID NO: 320653 - protein, 9 aa, Homo Sapiens
QRPSLYWQL

SEQ ID NO: 320654 - protein, 9 aa, Homo Sapiens
AEDVTVPLV

SEQ ID NO: 320655 - protein, 9 aa, Homo Sapiens
NPQIHFLVC

SEQ ID NO: 320656 - protein, 9 aa, Homo Sapiens
QPQRPHDGA

SEQ ID NO: 320657 - protein, 9 aa, Homo Sapiens
EMESGELVP

SEQ ID NO: 320658 - protein, 9 aa, Homo Sapiens
VVMGSKAAG

SEQ ID NO: 320659 - protein, 9 aa, Homo Sapiens
KEFTMTCQV

SEQ ID NO: 320660 - protein, 9 aa, Homo Sapiens
CEPSKEGQE

SEQ ID NO: 320661 - protein, 9 aa, Homo Sapiens
KSRRLSVLN

SEQ ID NO: 320662 - protein, 9 aa, Homo Sapiens
LQTVRLMEA

SEQ ID NO: 320663 - protein, 9 aa, Homo Sapiens
GNYSGKAAD

SEQ ID NO: 320664 - protein, 9 aa, Homo Sapiens
LLRYQIIHT

SEQ ID NO: 320665 - protein, 9 aa, Homo Sapiens
MVGGSVAHL

SEQ ID NO: 320666 - protein, 9 aa, Homo Sapiens
RGSDPVTLY

SEQ ID NO: 320667 - protein, 9 aa, Homo Sapiens
PGPKCAQGF

SEQ ID NO: 320668 - protein, 9 aa, Homo Sapiens
LKPPWMDTA

SEQ ID NO: 320669 - protein, 9 aa, Homo Sapiens
IPARSGTTQ

SEQ ID NO: 320670 - protein, 9 aa, Homo Sapiens
CSQPRENSM

SEQ ID NO: 320671 - protein, 9 aa, Homo Sapiens
DLLICSHLQ

SEQ ID NO: 320672 - protein, 9 aa, Homo Sapiens
CTVNREELL

SEQ ID NO: 320673 - protein, 9 aa, Homo Sapiens
RGWAPRGRV

SEQ ID NO: 320674 - protein, 9 aa, Homo Sapiens
PTSYAPDAK

SEQ ID NO: 320675 - protein, 9 aa, Homo Sapiens
VVEFEVRSS

SEQ ID NO: 320676 - protein, 9 aa, Homo Sapiens
EVRAAHRCC

SEQ ID NO: 320677 - protein, 9 aa, Homo Sapiens
DAAQILMCH

SEQ ID NO: 320678 - protein, 9 aa, Homo Sapiens
YKCMSQIQA

SEQ ID NO: 320679 - protein, 9 aa, Homo Sapiens
LPKFKSKFL

SEQ ID NO: 320680 - protein, 9 aa, Homo Sapiens
VDSIMPLHA

SEQ ID NO: 320681 - protein, 9 aa, Homo Sapiens
GRALRFDPM

SEQ ID NO: 320682 - protein, 9 aa, Homo Sapiens
ERETAVVIF

SEQ ID NO: 320683 - protein, 9 aa, Homo Sapiens
RRCLQRSSW

SEQ ID NO: 320684 - protein, 9 aa, Homo Sapiens
EAQAAEEGG

SEQ ID NO: 320685 - protein, 9 aa, Homo Sapiens
SAFYQGSVY

SEQ ID NO: 320686 - protein, 9 aa, Homo Sapiens
GSAFSISFN

SEQ ID NO: 320687 - protein, 9 aa, Homo Sapiens
GAGILTCLL

SEQ ID NO: 320688 - protein, 9 aa, Homo Sapiens
FKSAPILKW

SEQ ID NO: 320689 - protein, 9 aa, Homo Sapiens
DLVIVAEYF

SEQ ID NO: 320690 - protein, 9 aa, Homo Sapiens
GAGWPCPAV

SEQ ID NO: 320691 - protein, 9 aa, Homo Sapiens
RAYWNTSDL

SEQ ID NO: 320692 - protein, 9 aa, Homo Sapiens
CYLDWIHGH

SEQ ID NO: 320693 - protein, 9 aa, Homo Sapiens
VRDFAILVQ

SEQ ID NO: 320694 - protein, 9 aa, Homo Sapiens
AEAAEHSRL

SEQ ID NO: 320695 - protein, 9 aa, Homo Sapiens
QEICRLCEC

SEQ ID NO: 320696 - protein, 9 aa, Homo Sapiens
KRPIKEVLM

SEQ ID NO: 320697 - protein, 9 aa, Homo Sapiens
GPPPTMVQG

SEQ ID NO: 320698 - protein, 9 aa, Homo Sapiens
LNRVAATFP

SEQ ID NO: 320699 - protein, 9 aa, Homo Sapiens
GYYQITGWM

SEQ ID NO: 320700 - protein, 9 aa, Homo Sapiens
TQPVAGAQE

SEQ ID NO: 320701 - protein, 9 aa, Homo Sapiens
DVAHFELRL

SEQ ID NO: 320702 - protein, 9 aa, Homo Sapiens
PRSFYEWGV

SEQ ID NO: 320703 - protein, 9 aa, Homo Sapiens
FGLYGLLYI

SEQ ID NO: 320704 - protein, 9 aa, Homo Sapiens
TSVMVKVVI

SEQ ID NO: 320705 - protein, 9 aa, Homo Sapiens
TVSRQGGAP

SEQ ID NO: 320706 - protein, 9 aa, Homo Sapiens
MEILAADCG

SEQ ID NO: 320707 - protein, 9 aa, Homo Sapiens
NEGQILEQP

SEQ ID NO: 320708 - protein, 9 aa, Homo Sapiens
AAVPRGCCT

SEQ ID NO: 320709 - protein, 9 aa, Homo Sapiens
LAQLKERRQ

SEQ ID NO: 320710 - protein, 9 aa, Homo Sapiens
GRLVISWRM

SEQ ID NO: 320711 - protein, 9 aa, Homo Sapiens
AVKSLYHSM

SEQ ID NO: 320712 - protein, 9 aa, Homo Sapiens
TGLSLHDRR

SEQ ID NO: 320713 - protein, 9 aa, Homo Sapiens
LLGQCQVPA

SEQ ID NO: 320714 - protein, 9 aa, Homo Sapiens
LCTQVLEDS

SEQ ID NO: 320715 - protein, 9 aa, Homo Sapiens
DRALEPGLA

SEQ ID NO: 320716 - protein, 9 aa, Homo Sapiens
AVPRGCCTS

SEQ ID NO: 320717 - protein, 9 aa, Homo Sapiens
GVILCRSVS

SEQ ID NO: 320718 - protein, 9 aa, Homo Sapiens
LQVILTPSE

SEQ ID NO: 320719 - protein, 9 aa, Homo Sapiens
RLEEHLECT

SEQ ID NO: 320720 - protein, 9 aa, Homo Sapiens
IKEARRWKD

SEQ ID NO: 320721 - protein, 9 aa, Homo Sapiens
NLQITKNSY

SEQ ID NO: 320722 - protein, 9 aa, Homo Sapiens
CASKVATKT

SEQ ID NO: 320723 - protein, 9 aa, Homo Sapiens
RPMPWQRVD

SEQ ID NO: 320724 - protein, 9 aa, Homo Sapiens
TLTWVLHQD

SEQ ID NO: 320725 - protein, 9 aa, Homo Sapiens
TSAVFNPSI

SEQ ID NO: 320726 - protein, 9 aa, Homo Sapiens
MLEGNTIEI

SEQ ID NO: 320727 - protein, 9 aa, Homo Sapiens
HLSVLQMDI

SEQ ID NO: 320728 - protein, 9 aa, Homo Sapiens
KHQDFLVET

SEQ ID NO: 320729 - protein, 9 aa, Homo Sapiens
SLRNLNKEW

SEQ ID NO: 320730 - protein, 9 aa, Homo Sapiens
HLSAPELRL

SEQ ID NO: 320731 - protein, 9 aa, Homo Sapiens
NHIQNKPYT

SEQ ID NO: 320732 - protein, 9 aa, Homo Sapiens
FVIDNGTDD

SEQ ID NO: 320733 - protein, 9 aa, Homo Sapiens
PHGSPLAEG

SEQ ID NO: 320734 - protein, 9 aa, Homo Sapiens
LKDFSYSLH

SEQ ID NO: 320735 - protein, 9 aa, Homo Sapiens
QLRKINCSN

SEQ ID NO: 320736 - protein, 9 aa, Homo Sapiens
KDAVIHTLQ

SEQ ID NO: 320737 - protein, 9 aa, Homo Sapiens
RLHARMEEM

SEQ ID NO: 320738 - protein, 9 aa, Homo Sapiens
FLVCFISRY

SEQ ID NO: 320739 - protein, 9 aa, Homo Sapiens
WSLELPVCA

SEQ ID NO: 320740 - protein, 9 aa, Homo Sapiens
NIDLTVIIS

SEQ ID NO: 320741 - protein, 9 aa, Homo Sapiens
GSVDKRKLR

SEQ ID NO: 320742 - protein, 9 aa, Homo Sapiens
PCHSPGCPR

SEQ ID NO: 320743 - protein, 9 aa, Homo Sapiens
ILMGLSDSE

SEQ ID NO: 320744 - protein, 9 aa, Homo Sapiens
LEMLLGYTA

SEQ ID NO: 320745 - protein, 9 aa, Homo Sapiens
RADIAESHV

SEQ ID NO: 320746 - protein, 9 aa, Homo Sapiens
RSQLKKIFW

SEQ ID NO: 320747 - protein, 9 aa, Homo Sapiens
KADWHGLCG

SEQ ID NO: 320748 - protein, 9 aa, Homo Sapiens
QMMEPDNLE

SEQ ID NO: 320749 - protein, 9 aa, Homo Sapiens
YMIVKCQGQ

SEQ ID NO: 320750 - protein, 9 aa, Homo Sapiens
AAGRATQLV

SEQ ID NO: 320751 - protein, 9 aa, Homo Sapiens
EDLWRRHRE

SEQ ID NO: 320752 - protein, 9 aa, Homo Sapiens
EASETRKWM

SEQ ID NO: 320753 - protein, 9 aa, Homo Sapiens
QMGQVGEKQ

SEQ ID NO: 320754 - protein, 9 aa, Homo Sapiens
MLEAPGHRP

SEQ ID NO: 320755 - protein, 9 aa, Homo Sapiens
VQGQGPERL

SEQ ID NO: 320756 - protein, 9 aa, Homo Sapiens
LPLLLCTAQ

SEQ ID NO: 320757 - protein, 9 aa, Homo Sapiens
YGVYTKVSC

SEQ ID NO: 320758 - protein, 9 aa, Homo Sapiens
CLGKCSARV

SEQ ID NO: 320759 - protein, 9 aa, Homo Sapiens
YYCSQCHCS

SEQ ID NO: 320760 - protein, 9 aa, Homo Sapiens
RVLIPQIAR

SEQ ID NO: 320761 - protein, 9 aa, Homo Sapiens
LWRLWYGTR

SEQ ID NO: 320762 - protein, 9 aa, Homo Sapiens
KIRSYNHIR

SEQ ID NO: 320763 - protein, 9 aa, Homo Sapiens
SYSIFQKLN

SEQ ID NO: 320764 - protein, 9 aa, Homo Sapiens
EMVPAFFGS

SEQ ID NO: 320765 - protein, 9 aa, Homo Sapiens
GEDLEVNIV

SEQ ID NO: 320766 - protein, 9 aa, Homo Sapiens
AGLPLAMAQ

SEQ ID NO: 320767 - protein, 9 aa, Homo Sapiens
LNLGFKHIG

SEQ ID NO: 320768 - protein, 9 aa, Homo Sapiens
CKKDIDECS

SEQ ID NO: 320769 - protein, 9 aa, Homo Sapiens
AMALGFNPP

SEQ ID NO: 320770 - protein, 9 aa, Homo Sapiens
QPTVNFLTT

SEQ ID NO: 320771 - protein, 9 aa, Homo Sapiens
QKLYTCASC

SEQ ID NO: 320772 - protein, 9 aa, Homo Sapiens
TEKDIRLST

SEQ ID NO: 320773 - protein, 9 aa, Homo Sapiens
EFTAGADED

SEQ ID NO: 320774 - protein, 9 aa, Homo Sapiens
LRNLNKEWQ

SEQ ID NO: 320775 - protein, 9 aa, Homo Sapiens
QHHLPVWAV

SEQ ID NO: 320776 - protein, 9 aa, Homo Sapiens
SGACIDKIS

SEQ ID NO: 320777 - protein, 9 aa, Homo Sapiens
HTWLLSDGP

SEQ ID NO: 320778 - protein, 9 aa, Homo Sapiens
AEAWGIILE

SEQ ID NO: 320779 - protein, 9 aa, Homo Sapiens
GDDRVFFFI

SEQ ID NO: 320780 - protein, 9 aa, Homo Sapiens
SGAGSRPWI

SEQ ID NO: 320781 - protein, 9 aa, Homo Sapiens
PLTSPAVSV

SEQ ID NO: 320782 - protein, 9 aa, Homo Sapiens
NIDNAGIYK

SEQ ID NO: 320783 - protein, 9 aa, Homo Sapiens
LLKENWLLQ

SEQ ID NO: 320784 - protein, 9 aa, Homo Sapiens
CEESGRHVL

SEQ ID NO: 320785 - protein, 9 aa, Homo Sapiens
GTKRKRPLE

SEQ ID NO: 320786 - protein, 9 aa, Homo Sapiens
TWGRALVNT

SEQ ID NO: 320787 - protein, 9 aa, Homo Sapiens
GAGDVGKSA

SEQ ID NO: 320788 - protein, 9 aa, Homo Sapiens
HMIKSSHPL

SEQ ID NO: 320789 - protein, 9 aa, Homo Sapiens
GHSVQCWMP

SEQ ID NO: 320790 - protein, 9 aa, Homo Sapiens
SVNPGYCMS

SEQ ID NO: 320791 - protein, 9 aa, Homo Sapiens
NKRAEMQMP

SEQ ID NO: 320792 - protein, 9 aa, Homo Sapiens
TGQEFHSNT

SEQ ID NO: 320793 - protein, 9 aa, Homo Sapiens
RGELESQWE

SEQ ID NO: 320794 - protein, 9 aa, Homo Sapiens
TTLAPGKTQ

SEQ ID NO: 320795 - protein, 9 aa, Homo Sapiens
LLLVFVTKP

SEQ ID NO: 320796 - protein, 9 aa, Homo Sapiens
EDMIGYRPC

SEQ ID NO: 320797 - protein, 9 aa, Homo Sapiens
LEKLNEHTA

SEQ ID NO: 320798 - protein, 9 aa, Homo Sapiens
LFGGIPKTT

SEQ ID NO: 320799 - protein, 9 aa, Homo Sapiens
IGTSVARYN

SEQ ID NO: 320800 - protein, 9 aa, Homo Sapiens
VSWMSLHLF

SEQ ID NO: 320801 - protein, 9 aa, Homo Sapiens
RVPVLRSLA

SEQ ID NO: 320802 - protein, 9 aa, Homo Sapiens
SIDTAIIQL

SEQ ID NO: 320803 - protein, 9 aa, Homo Sapiens
IYIRRRPHV

SEQ ID NO: 320804 - protein, 9 aa, Homo Sapiens
KSVCVLVSD

SEQ ID NO: 320805 - protein, 9 aa, Homo Sapiens
SQWAPTCVD

SEQ ID NO: 320806 - protein, 9 aa, Homo Sapiens
NLTQGKDQY

SEQ ID NO: 320807 - protein, 9 aa, Homo Sapiens
GSQKHLRTH

SEQ ID NO: 320808 - protein, 9 aa, Homo Sapiens
KKGKDRYCS

SEQ ID NO: 320809 - protein, 9 aa, Homo Sapiens
CMDILFTFT

SEQ ID NO: 320810 - protein, 9 aa, Homo Sapiens
PELWRWHAT

SEQ ID NO: 320811 - protein, 9 aa, Homo Sapiens
NCCPLPAQI

SEQ ID NO: 320812 - protein, 9 aa, Homo Sapiens
VLEVEPQFS

SEQ ID NO: 320813 - protein, 9 aa, Homo Sapiens
SSVNPGYCM

SEQ ID NO: 320814 - protein, 9 aa, Homo Sapiens
PTCTKDWEA

SEQ ID NO: 320815 - protein, 9 aa, Homo Sapiens
ACDPKTLVG

SEQ ID NO: 320816 - protein, 9 aa, Homo Sapiens
SSPSCRQRL

SEQ ID NO: 320817 - protein, 9 aa, Homo Sapiens
QYFLIDALQ

SEQ ID NO: 320818 - protein, 9 aa, Homo Sapiens
RMHISRFTR

SEQ ID NO: 320819 - protein, 9 aa, Homo Sapiens
ECILASGSV

SEQ ID NO: 320820 - protein, 9 aa, Homo Sapiens
SGGYIIKRF

SEQ ID NO: 320821 - protein, 9 aa, Homo Sapiens
CLGQLGLVV

SEQ ID NO: 320822 - protein, 9 aa, Homo Sapiens
WEKSSNGWQ

SEQ ID NO: 320823 - protein, 9 aa, Homo Sapiens
YSLINHWRV

SEQ ID NO: 320824 - protein, 9 aa, Homo Sapiens
VYHLISIMI

SEQ ID NO: 320825 - protein, 9 aa, Homo Sapiens
NDMVKQGYV

SEQ ID NO: 320826 - protein, 9 aa, Homo Sapiens
RLGSRMFWY

SEQ ID NO: 320827 - protein, 9 aa, Homo Sapiens
INIGQLNGP

SEQ ID NO: 320828 - protein, 9 aa, Homo Sapiens
FSGLQGAIA

SEQ ID NO: 320829 - protein, 9 aa, Homo Sapiens
FKEAVKDSV

SEQ ID NO: 320830 - protein, 9 aa, Homo Sapiens
HGPAFCGLY

SEQ ID NO: 320831 - protein, 9 aa, Homo Sapiens
NMQPSGSFK

SEQ ID NO: 320832 - protein, 9 aa, Homo Sapiens
MLVKYAEKW

SEQ ID NO: 320833 - protein, 9 aa, Homo Sapiens
GYYNGHTKC

SEQ ID NO: 320834 - protein, 9 aa, Homo Sapiens
ARAEKRLPY

SEQ ID NO: 320835 - protein, 9 aa, Homo Sapiens
YTPLEKKTR

SEQ ID NO: 320836 - protein, 9 aa, Homo Sapiens
LTTNAGLKM

SEQ ID NO: 320837 - protein, 9 aa, Homo Sapiens
CQSSTHNSH

SEQ ID NO: 320838 - protein, 9 aa, Homo Sapiens
GSCVQFLHG

SEQ ID NO: 320839 - protein, 9 aa, Homo Sapiens
PRHIGNKTE

SEQ ID NO: 320840 - protein, 9 aa, Homo Sapiens
ACLYILDWR

SEQ ID NO: 320841 - protein, 9 aa, Homo Sapiens
RELLGQCQV

SEQ ID NO: 320842 - protein, 9 aa, Homo Sapiens
KFHCASKAN

SEQ ID NO: 320843 - protein, 9 aa, Homo Sapiens
AASKLKELE

SEQ ID NO: 320844 - protein, 9 aa, Homo Sapiens
AAIIAIIAL

SEQ ID NO: 320845 - protein, 9 aa, Homo Sapiens
CQLNGSAPI

SEQ ID NO: 320846 - protein, 9 aa, Homo Sapiens
QSPSKKELE

SEQ ID NO: 320847 - protein, 9 aa, Homo Sapiens
VSRQGGAPP

SEQ ID NO: 320848 - protein, 9 aa, Homo Sapiens
STPTPMAQF

SEQ ID NO: 320849 - protein, 9 aa, Homo Sapiens
IVPHVGKNQ

SEQ ID NO: 320850 - protein, 9 aa, Homo Sapiens
EKRPPFYHL

SEQ ID NO: 320851 - protein, 9 aa, Homo Sapiens
AVIHTLQTS

SEQ ID NO: 320852 - protein, 9 aa, Homo Sapiens
NDTIKYFKK

SEQ ID NO: 320853 - protein, 9 aa, Homo Sapiens
HSNTDHLDS

SEQ ID NO: 320854 - protein, 9 aa, Homo Sapiens
SLSQSVVLH

SEQ ID NO: 320855 - protein, 9 aa, Homo Sapiens
SLQEIHFKT

SEQ ID NO: 320856 - protein, 9 aa, Homo Sapiens
LHRTPRRRW

SEQ ID NO: 320857 - protein, 9 aa, Homo Sapiens
LLTIFTLSM

SEQ ID NO: 320858 - protein, 9 aa, Homo Sapiens
AQTLFREQS

SEQ ID NO: 320859 - protein, 9 aa, Homo Sapiens
CMVVSCPHK

SEQ ID NO: 320860 - protein, 9 aa, Homo Sapiens
NCVDGSQDY

SEQ ID NO: 320861 - protein, 9 aa, Homo Sapiens
RSIVPALEI

SEQ ID NO: 320862 - protein, 9 aa, Homo Sapiens
KHLSPMAHV

SEQ ID NO: 320863 - protein, 9 aa, Homo Sapiens
VESESAATR

SEQ ID NO: 320864 - protein, 9 aa, Homo Sapiens
LARRPHQQD

SEQ ID NO: 320865 - protein, 9 aa, Homo Sapiens
QYPLVGPGP

SEQ ID NO: 320866 - protein, 9 aa, Homo Sapiens
RVEITAVAM

SEQ ID NO: 320867 - protein, 9 aa, Homo Sapiens
QKAMNTCGS

SEQ ID NO: 320868 - protein, 9 aa, Homo Sapiens
EYRWQDECQ

SEQ ID NO: 320869 - protein, 9 aa, Homo Sapiens
ENQKNLESG

SEQ ID NO: 320870 - protein, 9 aa, Homo Sapiens
VGNSIVEKV

SEQ ID NO: 320871 - protein, 9 aa, Homo Sapiens
VELVQHICA

SEQ ID NO: 320872 - protein, 9 aa, Homo Sapiens
SRGYPTLVQ

SEQ ID NO: 320873 - protein, 9 aa, Homo Sapiens
MGRLVQEET

SEQ ID NO: 320874 - protein, 9 aa, Homo Sapiens
CLAMTAISF

SEQ ID NO: 320875 - protein, 9 aa, Homo Sapiens
GLVGHQGAP

SEQ ID NO: 320876 - protein, 9 aa, Homo Sapiens
ALILDQLRA

SEQ ID NO: 320877 - protein, 9 aa, Homo Sapiens
RAELILELR

SEQ ID NO: 320878 - protein, 9 aa, Homo Sapiens
HCLGQLGLV

SEQ ID NO: 320879 - protein, 9 aa, Homo Sapiens
PHVGKNQSK

SEQ ID NO: 320880 - protein, 9 aa, Homo Sapiens
RMFISSRWQ

SEQ ID NO: 320881 - protein, 9 aa, Homo Sapiens
FRGMSISCP

SEQ ID NO: 320882 - protein, 9 aa, Homo Sapiens
CSPPLKPSI

SEQ ID NO: 320883 - protein, 9 aa, Homo Sapiens
HVLVYSCRH

SEQ ID NO: 320884 - protein, 9 aa, Homo Sapiens
VGSIPALKF

SEQ ID NO: 320885 - protein, 9 aa, Homo Sapiens
TRIVCDYDV

SEQ ID NO: 320886 - protein, 9 aa, Homo Sapiens
MGGAVFEML

SEQ ID NO: 320887 - protein, 9 aa, Homo Sapiens
LFSDVVTDL

SEQ ID NO: 320888 - protein, 9 aa, Homo Sapiens
SRPPTGLGP

SEQ ID NO: 320889 - protein, 9 aa, Homo Sapiens
DQTTMITAI

SEQ ID NO: 320890 - protein, 9 aa, Homo Sapiens
FESIATAPT

SEQ ID NO: 320891 - protein, 9 aa, Homo Sapiens
KLDSLETAA

SEQ ID NO: 320892 - protein, 9 aa, Homo Sapiens
QQLIRWCMS

SEQ ID NO: 320893 - protein, 9 aa, Homo Sapiens
LFIIVFGEL

SEQ ID NO: 320894 - protein, 9 aa, Homo Sapiens
RPIPVIFKQ

SEQ ID NO: 320895 - protein, 9 aa, Homo Sapiens
RDLKRCNRP

SEQ ID NO: 320896 - protein, 9 aa, Homo Sapiens
LVVLCCVVA

SEQ ID NO: 320897 - protein, 9 aa, Homo Sapiens
HMTTTGKTN

SEQ ID NO: 320898 - protein, 9 aa, Homo Sapiens
LCITDPETG

SEQ ID NO: 320899 - protein, 9 aa, Homo Sapiens
GFKEAVKDS

SEQ ID NO: 320900 - protein, 9 aa, Homo Sapiens
GYWHVYLEG

SEQ ID NO: 320901 - protein, 9 aa, Homo Sapiens
GRLGSNPQK

SEQ ID NO: 320902 - protein, 9 aa, Homo Sapiens
ALLHHSHLQ

SEQ ID NO: 320903 - protein, 9 aa, Homo Sapiens
ISAVHYCHK

SEQ ID NO: 320904 - protein, 9 aa, Homo Sapiens
KSPAMEQAV

SEQ ID NO: 320905 - protein, 9 aa, Homo Sapiens
FQGGGLALS

SEQ ID NO: 320906 - protein, 9 aa, Homo Sapiens
MMLLSDTHQ

SEQ ID NO: 320907 - protein, 9 aa, Homo Sapiens
QRRPHRPPT

SEQ ID NO: 320908 - protein, 9 aa, Homo Sapiens
HTIAVVLTV

SEQ ID NO: 320909 - protein, 9 aa, Homo Sapiens
DPVSAPCVP

SEQ ID NO: 320910 - protein, 9 aa, Homo Sapiens
AYVRDLHSI

SEQ ID NO: 320911 - protein, 9 aa, Homo Sapiens
GHVEVSLDG

SEQ ID NO: 320912 - protein, 9 aa, Homo Sapiens
PAVRPMPWQ

SEQ ID NO: 320913 - protein, 9 aa, Homo Sapiens
SWAPSVATV

SEQ ID NO: 320914 - protein, 9 aa, Homo Sapiens
YHMASLYVG

SEQ ID NO: 320915 - protein, 9 aa, Homo Sapiens
PWRTPEFYN

SEQ ID NO: 320916 - protein, 9 aa, Homo Sapiens
ELCICARDK

SEQ ID NO: 320917 - protein, 9 aa, Homo Sapiens
HMDRMMVEH

SEQ ID NO: 320918 - protein, 9 aa, Homo Sapiens
GTCAARSQL

SEQ ID NO: 320919 - protein, 9 aa, Homo Sapiens
DKYRHMCRH

SEQ ID NO: 320920 - protein, 9 aa, Homo Sapiens
AEPRVTLPM

SEQ ID NO: 320921 - protein, 9 aa, Homo Sapiens
FFQQDTLTW

SEQ ID NO: 320922 - protein, 9 aa, Homo Sapiens
SSTHNSHLP

SEQ ID NO: 320923 - protein, 9 aa, Homo Sapiens
VLRSTMPVN

SEQ ID NO: 320924 - protein, 9 aa, Homo Sapiens
RSNLPTSSD

SEQ ID NO: 320925 - protein, 9 aa, Homo Sapiens
VPTQPRLLL

SEQ ID NO: 320926 - protein, 9 aa, Homo Sapiens
FLSPETFAL

SEQ ID NO: 320927 - protein, 9 aa, Homo Sapiens
DIKAPEQGS

SEQ ID NO: 320928 - protein, 9 aa, Homo Sapiens
PGRLPPPRP

SEQ ID NO: 320929 - protein, 9 aa, Homo Sapiens
PWSQPNPAT

SEQ ID NO: 320930 - protein, 9 aa, Homo Sapiens
SPSTWMFQS

SEQ ID NO: 320931 - protein, 9 aa, Homo Sapiens
KPGWRTGLA

SEQ ID NO: 320932 - protein, 9 aa, Homo Sapiens
IRTGYHPTG

SEQ ID NO: 320933 - protein, 9 aa, Homo Sapiens
IASFLRTYQ

SEQ ID NO: 320934 - protein, 9 aa, Homo Sapiens
KLLGAETSA

SEQ ID NO: 320935 - protein, 9 aa, Homo Sapiens
ISYTVELKR

SEQ ID NO: 320936 - protein, 9 aa, Homo Sapiens
GPSICVFLV

SEQ ID NO: 320937 - protein, 9 aa, Homo Sapiens
GCLPRVNRC

SEQ ID NO: 320938 - protein, 9 aa, Homo Sapiens
AVDVLCRTA

SEQ ID NO: 320939 - protein, 9 aa, Homo Sapiens
EDVEAHQSW

SEQ ID NO: 320940 - protein, 9 aa, Homo Sapiens
PVSAPCVPP

SEQ ID NO: 320941 - protein, 9 aa, Homo Sapiens
CPSQHQGLP

SEQ ID NO: 320942 - protein, 9 aa, Homo Sapiens
DLLQLYQDF

SEQ ID NO: 320943 - protein, 9 aa, Homo Sapiens
HRDHQQSRA

SEQ ID NO: 320944 - protein, 9 aa, Homo Sapiens
IRWCMSLRP

SEQ ID NO: 320945 - protein, 9 aa, Homo Sapiens
GPGPLQADL

SEQ ID NO: 320946 - protein, 9 aa, Homo Sapiens
HGFLVRQKF

SEQ ID NO: 320947 - protein, 9 aa, Homo Sapiens
TVLEKLNEH

SEQ ID NO: 320948 - protein, 9 aa, Homo Sapiens
LLHNACANG

SEQ ID NO: 320949 - protein, 9 aa, Homo Sapiens
DSYIPDCLP

SEQ ID NO: 320950 - protein, 9 aa, Homo Sapiens
LVLIAAIIA

SEQ ID NO: 320951 - protein, 9 aa, Homo Sapiens
AEAQAAEEG

SEQ ID NO: 320952 - protein, 9 aa, Homo Sapiens
SALHFEVFC

SEQ ID NO: 320953 - protein, 9 aa, Homo Sapiens
TGWMDDVIN

SEQ ID NO: 320954 - protein, 9 aa, Homo Sapiens
GLRLWKVDQ

SEQ ID NO: 320955 - protein, 9 aa, Homo Sapiens
LGSRMFWYS

SEQ ID NO: 320956 - protein, 9 aa, Homo Sapiens
IKFKIHGCV

SEQ ID NO: 320957 - protein, 9 aa, Homo Sapiens
LDEILDFDY

SEQ ID NO: 320958 - protein, 9 aa, Homo Sapiens
SVGQRIRRD

SEQ ID NO: 320959 - protein, 9 aa, Homo Sapiens
AVGQYPLVG

SEQ ID NO: 320960 - protein, 9 aa, Homo Sapiens
QSPVSLVQE

SEQ ID NO: 320961 - protein, 9 aa, Homo Sapiens
RREELLKKC

SEQ ID NO: 320962 - protein, 9 aa, Homo Sapiens
WSFQSEGAD

SEQ ID NO: 320963 - protein, 9 aa, Homo Sapiens
RHHTGKKPF

SEQ ID NO: 320964 - protein, 9 aa, Homo Sapiens
AMAFDRYVV

SEQ ID NO: 320965 - protein, 9 aa, Homo Sapiens
PMTPNKPVV

SEQ ID NO: 320966 - protein, 9 aa, Homo Sapiens
ALLDIDALK

SEQ ID NO: 320967 - protein, 9 aa, Homo Sapiens
AFDHAVDSN

SEQ ID NO: 320968 - protein, 9 aa, Homo Sapiens
SGIQAPACS

SEQ ID NO: 320969 - protein, 9 aa, Homo Sapiens
HHVLPTTSL

SEQ ID NO: 320970 - protein, 9 aa, Homo Sapiens
EHGPAFCGL

SEQ ID NO: 320971 - protein, 9 aa, Homo Sapiens
LELVSSSMK

SEQ ID NO: 320972 - protein, 9 aa, Homo Sapiens
WGRSLDVDA

SEQ ID NO: 320973 - protein, 9 aa, Homo Sapiens
LNEDKVAIK

SEQ ID NO: 320974 - protein, 9 aa, Homo Sapiens
LMSCIALSL

SEQ ID NO: 320975 - protein, 9 aa, Homo Sapiens
LRRWLDLGS

SEQ ID NO: 320976 - protein, 9 aa, Homo Sapiens
AKRRGRLID

SEQ ID NO: 320977 - protein, 9 aa, Homo Sapiens
TIYFIASVV

SEQ ID NO: 320978 - protein, 9 aa, Homo Sapiens
YMRNNVCVC

SEQ ID NO: 320979 - protein, 9 aa, Homo Sapiens
GIYIALLVV

SEQ ID NO: 320980 - protein, 9 aa, Homo Sapiens
SMILCCAIC

SEQ ID NO: 320981 - protein, 9 aa, Homo Sapiens
DRVFFFIPT

SEQ ID NO: 320982 - protein, 9 aa, Homo Sapiens
SFQSEGADT

SEQ ID NO: 320983 - protein, 9 aa, Homo Sapiens
HGRARCESK

SEQ ID NO: 320984 - protein, 9 aa, Homo Sapiens
YGPFLPGNL

SEQ ID NO: 320985 - protein, 9 aa, Homo Sapiens
VLRHLLFLL

SEQ ID NO: 320986 - protein, 9 aa, Homo Sapiens
VQNHHTWDQ

SEQ ID NO: 320987 - protein, 9 aa, Homo Sapiens
CSSITKNCL

SEQ ID NO: 320988 - protein, 9 aa, Homo Sapiens
HAAANGLMQ

SEQ ID NO: 320989 - protein, 9 aa, Homo Sapiens
WTPYHMFSI

SEQ ID NO: 320990 - protein, 9 aa, Homo Sapiens
SWHGQRGAP

SEQ ID NO: 320991 - protein, 9 aa, Homo Sapiens
EQNLIQVIE

SEQ ID NO: 320992 - protein, 9 aa, Homo Sapiens
HGWHGGRRL

SEQ ID NO: 320993 - protein, 9 aa, Homo Sapiens
DGRRFWQAC

SEQ ID NO: 320994 - protein, 9 aa, Homo Sapiens
LSDTHQCRR

SEQ ID NO: 320995 - protein, 9 aa, Homo Sapiens
FCNIALCPD

SEQ ID NO: 320996 - protein, 9 aa, Homo Sapiens
CPAVPLGPA

SEQ ID NO: 320997 - protein, 9 aa, Homo Sapiens
HLGRAELIL

SEQ ID NO: 320998 - protein, 9 aa, Homo Sapiens
EPWQMLACC

SEQ ID NO: 320999 - protein, 9 aa, Homo Sapiens
WNGHWWEPS

SEQ ID NO: 321000 - protein, 9 aa, Homo Sapiens
GSFFAWDNT

SEQ ID NO: 321001 - protein, 9 aa, Homo Sapiens
KTEKYWDSW

SEQ ID NO: 321002 - protein, 9 aa, Homo Sapiens
AISYTVELK

SEQ ID NO: 321003 - protein, 9 aa, Homo Sapiens
LFLVSLPLN

SEQ ID NO: 321004 - protein, 9 aa, Homo Sapiens
MLNNVWDFL

SEQ ID NO: 321005 - protein, 9 aa, Homo Sapiens
RSYNHIRPG

SEQ ID NO: 321006 - protein, 9 aa, Homo Sapiens
VELEAIAIY

SEQ ID NO: 321007 - protein, 9 aa, Homo Sapiens
SEHHGVRPH

SEQ ID NO: 321008 - protein, 9 aa, Homo Sapiens
WRKVDEQWY

SEQ ID NO: 321009 - protein, 9 aa, Homo Sapiens
RYRVQSTQS

SEQ ID NO: 321010 - protein, 9 aa, Homo Sapiens
LVISWRMPG

SEQ ID NO: 321011 - protein, 9 aa, Homo Sapiens
ELAKKNRSS

SEQ ID NO: 321012 - protein, 9 aa, Homo Sapiens
IVGTITGIV

SEQ ID NO: 321013 - protein, 9 aa, Homo Sapiens
LGLTLSDMY

SEQ ID NO: 321014 - protein, 9 aa, Homo Sapiens
RNWTAATSP

SEQ ID NO: 321015 - protein, 9 aa, Homo Sapiens
EEICDARHP

SEQ ID NO: 321016 - protein, 9 aa, Homo Sapiens
WLTIFDEEV

SEQ ID NO: 321017 - protein, 9 aa, Homo Sapiens
GGTATQQNN

SEQ ID NO: 321018 - protein, 9 aa, Homo Sapiens
PGPHGPKGE

SEQ ID NO: 321019 - protein, 9 aa, Homo Sapiens
SFLGGWQEV

SEQ ID NO: 321020 - protein, 9 aa, Homo Sapiens
RRSLLTYGV

SEQ ID NO: 321021 - protein, 9 aa, Homo Sapiens
PRARPGTCA

SEQ ID NO: 321022 - protein, 9 aa, Homo Sapiens
SCQMSKLRL

SEQ ID NO: 321023 - protein, 9 aa, Homo Sapiens
SDSLCCGRA

SEQ ID NO: 321024 - protein, 9 aa, Homo Sapiens
SQWEKLRGL

SEQ ID NO: 321025 - protein, 9 aa, Homo Sapiens
SHMAKERTH

SEQ ID NO: 321026 - protein, 9 aa, Homo Sapiens
EIARLTISG

SEQ ID NO: 321027 - protein, 9 aa, Homo Sapiens
LNEHTARWI

SEQ ID NO: 321028 - protein, 9 aa, Homo Sapiens
HVPPGTPMI

SEQ ID NO: 321029 - protein, 9 aa, Homo Sapiens
FDFVINENA

SEQ ID NO: 321030 - protein, 9 aa, Homo Sapiens
GRRPAHCYR

SEQ ID NO: 321031 - protein, 9 aa, Homo Sapiens
HAGPFANIT

SEQ ID NO: 321032 - protein, 9 aa, Homo Sapiens
DVARAGFLD

SEQ ID NO: 321033 - protein, 9 aa, Homo Sapiens
WHFARSDEL

SEQ ID NO: 321034 - protein, 9 aa, Homo Sapiens
YGKVPYPPS

SEQ ID NO: 321035 - protein, 9 aa, Homo Sapiens
TVRPDASVS

SEQ ID NO: 321036 - protein, 9 aa, Homo Sapiens
KDGQLVRTG

SEQ ID NO: 321037 - protein, 9 aa, Homo Sapiens
WKPLQTVRL

SEQ ID NO: 321038 - protein, 9 aa, Homo Sapiens
TKGGVPEEA

SEQ ID NO: 321039 - protein, 9 aa, Homo Sapiens
DMTGAQRSF

SEQ ID NO: 321040 - protein, 9 aa, Homo Sapiens
ARLDQAHPA

SEQ ID NO: 321041 - protein, 9 aa, Homo Sapiens
LEICYKDHI

SEQ ID NO: 321042 - protein, 9 aa, Homo Sapiens
PPVSTELGH

SEQ ID NO: 321043 - protein, 9 aa, Homo Sapiens
RTPRRRWAP

SEQ ID NO: 321044 - protein, 9 aa, Homo Sapiens
VLRSVIFFY

SEQ ID NO: 321045 - protein, 9 aa, Homo Sapiens
VPKYQDAAY

SEQ ID NO: 321046 - protein, 9 aa, Homo Sapiens
PTQLPRRPR

SEQ ID NO: 321047 - protein, 9 aa, Homo Sapiens
SRMFWYSMP

SEQ ID NO: 321048 - protein, 9 aa, Homo Sapiens
VEKEPALAP

SEQ ID NO: 321049 - protein, 9 aa, Homo Sapiens
DMTTSSLHF

SEQ ID NO: 321050 - protein, 9 aa, Homo Sapiens
ACLLDKGLD

SEQ ID NO: 321051 - protein, 9 aa, Homo Sapiens
RPHQQDPHL

SEQ ID NO: 321052 - protein, 9 aa, Homo Sapiens
AIIFTVSVT

SEQ ID NO: 321053 - protein, 9 aa, Homo Sapiens
LVTGLMFLC

SEQ ID NO: 321054 - protein, 9 aa, Homo Sapiens
RATATTGQG

SEQ ID NO: 321055 - protein, 9 aa, Homo Sapiens
CVGDSPIPG

SEQ ID NO: 321056 - protein, 9 aa, Homo Sapiens
KCDGCGKDF

SEQ ID NO: 321057 - protein, 9 aa, Homo Sapiens
ALRYQLQHG

SEQ ID NO: 321058 - protein, 9 aa, Homo Sapiens
CFISRYTQE

SEQ ID NO: 321059 - protein, 9 aa, Homo Sapiens
VWDVGMCKE

SEQ ID NO: 321060 - protein, 9 aa, Homo Sapiens
RRTCSPHLS

SEQ ID NO: 321061 - protein, 9 aa, Homo Sapiens
FRVLIPQIA

SEQ ID NO: 321062 - protein, 9 aa, Homo Sapiens
TVCGYGSQE

SEQ ID NO: 321063 - protein, 9 aa, Homo Sapiens
TDIRFVWEK

SEQ ID NO: 321064 - protein, 9 aa, Homo Sapiens
KVMLSFGKA

SEQ ID NO: 321065 - protein, 9 aa, Homo Sapiens
DCILKHATA

SEQ ID NO: 321066 - protein, 9 aa, Homo Sapiens
GVLQGLSGC

SEQ ID NO: 321067 - protein, 9 aa, Homo Sapiens
FANTMGLVV

SEQ ID NO: 321068 - protein, 9 aa, Homo Sapiens
FGFGFGFSP

SEQ ID NO: 321069 - protein, 9 aa, Homo Sapiens
LSTTVTLTV

SEQ ID NO: 321070 - protein, 9 aa, Homo Sapiens
ITMLRNKIV

SEQ ID NO: 321071 - protein, 9 aa, Homo Sapiens
TPPAHHAAA

SEQ ID NO: 321072 - protein, 9 aa, Homo Sapiens
LYVAMVGDK

SEQ ID NO: 321073 - protein, 9 aa, Homo Sapiens
PEDVEAHQS

SEQ ID NO: 321074 - protein, 9 aa, Homo Sapiens
CLHWDPSAC

SEQ ID NO: 321075 - protein, 9 aa, Homo Sapiens
AMTAISFHQ

SEQ ID NO: 321076 - protein, 9 aa, Homo Sapiens
LTISSPFAA

SEQ ID NO: 321077 - protein, 9 aa, Homo Sapiens
LLDASPQYP

SEQ ID NO: 321078 - protein, 9 aa, Homo Sapiens
HCDSHSPQE

SEQ ID NO: 321079 - protein, 9 aa, Homo Sapiens
GEPPAMSGT

SEQ ID NO: 321080 - protein, 9 aa, Homo Sapiens
HAALRQTEA

SEQ ID NO: 321081 - protein, 9 aa, Homo Sapiens
SSILCHCCD

SEQ ID NO: 321082 - protein, 9 aa, Homo Sapiens
LHQWVAICL

SEQ ID NO: 321083 - protein, 9 aa, Homo Sapiens
RGAGSTQPE

SEQ ID NO: 321084 - protein, 9 aa, Homo Sapiens
ALEQLADGN

SEQ ID NO: 321085 - protein, 9 aa, Homo Sapiens
EEFGFGFGF

SEQ ID NO: 321086 - protein, 9 aa, Homo Sapiens
YPLVGPGPM

SEQ ID NO: 321087 - protein, 9 aa, Homo Sapiens
PHVRVEALQ

SEQ ID NO: 321088 - protein, 9 aa, Homo Sapiens
SHLDPCDVH

SEQ ID NO: 321089 - protein, 9 aa, Homo Sapiens
MDILFTFTA

SEQ ID NO: 321090 - protein, 9 aa, Homo Sapiens
KLRMVANYE

SEQ ID NO: 321091 - protein, 9 aa, Homo Sapiens
TNVVTFDAD

SEQ ID NO: 321092 - protein, 9 aa, Homo Sapiens
EFGEIIINF

SEQ ID NO: 321093 - protein, 9 aa, Homo Sapiens
WQPIGRLLF

SEQ ID NO: 321094 - protein, 9 aa, Homo Sapiens
QHKASPGWQ

SEQ ID NO: 321095 - protein, 9 aa, Homo Sapiens
SGNYSGKAA

SEQ ID NO: 321096 - protein, 9 aa, Homo Sapiens
SLCVNGFTH

SEQ ID NO: 321097 - protein, 9 aa, Homo Sapiens
LESGMNWQQ

SEQ ID NO: 321098 - protein, 9 aa, Homo Sapiens
IFSLATPLC

SEQ ID NO: 321099 - protein, 9 aa, Homo Sapiens
SALMPGGHC

SEQ ID NO: 321100 - protein, 9 aa, Homo Sapiens
TREPDPARG

SEQ ID NO: 321101 - protein, 9 aa, Homo Sapiens
TLQTQQSHI

SEQ ID NO: 321102 - protein, 9 aa, Homo Sapiens
NREKQGLAL

SEQ ID NO: 321103 - protein, 9 aa, Homo Sapiens
TDIFPDSKD

SEQ ID NO: 321104 - protein, 9 aa, Homo Sapiens
RGARAPQKK

SEQ ID NO: 321105 - protein, 9 aa, Homo Sapiens
AEMQMPWSS

SEQ ID NO: 321106 - protein, 9 aa, Homo Sapiens
LAKVNNAEN

SEQ ID NO: 321107 - protein, 9 aa, Homo Sapiens
LPPPPASSP

SEQ ID NO: 321108 - protein, 9 aa, Homo Sapiens
PSNIYTGLF

SEQ ID NO: 321109 - protein, 9 aa, Homo Sapiens
AGASGSPST

SEQ ID NO: 321110 - protein, 9 aa, Homo Sapiens
PTLIAPEDS

SEQ ID NO: 321111 - protein, 9 aa, Homo Sapiens
ARALLDIDA

SEQ ID NO: 321112 - protein, 9 aa, Homo Sapiens
DMQPCIDLI

SEQ ID NO: 321113 - protein, 9 aa, Homo Sapiens
CFLLKVRVT

SEQ ID NO: 321114 - protein, 9 aa, Homo Sapiens
LMLEANEWA

SEQ ID NO: 321115 - protein, 9 aa, Homo Sapiens
IQAVIDVGV

SEQ ID NO: 321116 - protein, 9 aa, Homo Sapiens
TYYNWWRKA

SEQ ID NO: 321117 - protein, 9 aa, Homo Sapiens
AWCSGKRTA

SEQ ID NO: 321118 - protein, 9 aa, Homo Sapiens
NTRTMEVPV

SEQ ID NO: 321119 - protein, 9 aa, Homo Sapiens
IWQKDEEDK

SEQ ID NO: 321120 - protein, 9 aa, Homo Sapiens
TCSRSQLKK

SEQ ID NO: 321121 - protein, 9 aa, Homo Sapiens
FIDFGLDMQ

SEQ ID NO: 321122 - protein, 9 aa, Homo Sapiens
VVLCCVVAG

SEQ ID NO: 321123 - protein, 9 aa, Homo Sapiens
SSYFGIFLL

SEQ ID NO: 321124 - protein, 9 aa, Homo Sapiens
CHCQERFEA

SEQ ID NO: 321125 - protein, 9 aa, Homo Sapiens
PDTSQLASS

SEQ ID NO: 321126 - protein, 9 aa, Homo Sapiens
SPGPDGPPS

SEQ ID NO: 321127 - protein, 9 aa, Homo Sapiens
GSGAGSRPW

SEQ ID NO: 321128 - protein, 9 aa, Homo Sapiens
CENMQPSGS

SEQ ID NO: 321129 - protein, 9 aa, Homo Sapiens
LLDPIWEKF

SEQ ID NO: 321130 - protein, 9 aa, Homo Sapiens
VIIAKAFGL

SEQ ID NO: 321131 - protein, 9 aa, Homo Sapiens
SLSQVAIDL

SEQ ID NO: 321132 - protein, 9 aa, Homo Sapiens
ELMTTLITE

SEQ ID NO: 321133 - protein, 9 aa, Homo Sapiens
ISVLEPLQE

SEQ ID NO: 321134 - protein, 9 aa, Homo Sapiens
QPDLRQWLP

SEQ ID NO: 321135 - protein, 9 aa, Homo Sapiens
VVSKELCMY

SEQ ID NO: 321136 - protein, 9 aa, Homo Sapiens
GRQDPTSYA

SEQ ID NO: 321137 - protein, 9 aa, Homo Sapiens
EGGLPQFYP

SEQ ID NO: 321138 - protein, 9 aa, Homo Sapiens
GPSIFGVVS

SEQ ID NO: 321139 - protein, 9 aa, Homo Sapiens
MQLMSCIAL

SEQ ID NO: 321140 - protein, 9 aa, Homo Sapiens
KNIDLTVII

SEQ ID NO: 321141 - protein, 9 aa, Homo Sapiens
AMTNYIHVP

SEQ ID NO: 321142 - protein, 9 aa, Homo Sapiens
AESASRRPP

SEQ ID NO: 321143 - protein, 9 aa, Homo Sapiens
IKEVLMDIF

SEQ ID NO: 321144 - protein, 9 aa, Homo Sapiens
AARIDIEIY

SEQ ID NO: 321145 - protein, 9 aa, Homo Sapiens
SNVVNFASW

SEQ ID NO: 321146 - protein, 9 aa, Homo Sapiens
LECTCATTS

SEQ ID NO: 321147 - protein, 9 aa, Homo Sapiens
AGPTHQDAL

SEQ ID NO: 321148 - protein, 9 aa, Homo Sapiens
ATPFGGFKQ

SEQ ID NO: 321149 - protein, 9 aa, Homo Sapiens
ATPPAHHAA

SEQ ID NO: 321150 - protein, 9 aa, Homo Sapiens
SLKHRSPMP

SEQ ID NO: 321151 - protein, 9 aa, Homo Sapiens
LFHNLPSIT

SEQ ID NO: 321152 - protein, 9 aa, Homo Sapiens
VLQKLSKKD

SEQ ID NO: 321153 - protein, 9 aa, Homo Sapiens
LKLLGKPNS

SEQ ID NO: 321154 - protein, 9 aa, Homo Sapiens
MSSRRRRRL

SEQ ID NO: 321155 - protein, 9 aa, Homo Sapiens
STCYLFRMR

SEQ ID NO: 321156 - protein, 9 aa, Homo Sapiens
QSKGRIQRQ

SEQ ID NO: 321157 - protein, 9 aa, Homo Sapiens
GFRRFNLYE

SEQ ID NO: 321158 - protein, 9 aa, Homo Sapiens
APVPWSQPN

SEQ ID NO: 321159 - protein, 9 aa, Homo Sapiens
VGQGMSSRR

SEQ ID NO: 321160 - protein, 9 aa, Homo Sapiens
QVCDTSTHC

SEQ ID NO: 321161 - protein, 9 aa, Homo Sapiens
VLSAQGEPT

SEQ ID NO: 321162 - protein, 9 aa, Homo Sapiens
QARLHGFLV

SEQ ID NO: 321163 - protein, 9 aa, Homo Sapiens
VLDKSVCVL

SEQ ID NO: 321164 - protein, 9 aa, Homo Sapiens
GRHVLVYSC

SEQ ID NO: 321165 - protein, 9 aa, Homo Sapiens
PHAGYMYCG

SEQ ID NO: 321166 - protein, 9 aa, Homo Sapiens
PELLRWVLE

SEQ ID NO: 321167 - protein, 9 aa, Homo Sapiens
PRVTLPMDI

SEQ ID NO: 321168 - protein, 9 aa, Homo Sapiens
PFPYPEECD

SEQ ID NO: 321169 - protein, 9 aa, Homo Sapiens
LPYARKEPS

SEQ ID NO: 321170 - protein, 9 aa, Homo Sapiens
SSSLGTLES

SEQ ID NO: 321171 - protein, 9 aa, Homo Sapiens
SPRPMALRP

SEQ ID NO: 321172 - protein, 9 aa, Homo Sapiens
LALLHHSHL

SEQ ID NO: 321173 - protein, 9 aa, Homo Sapiens
NTLTKCPHC

SEQ ID NO: 321174 - protein, 9 aa, Homo Sapiens
FRCAKAHEK

SEQ ID NO: 321175 - protein, 9 aa, Homo Sapiens
LPPRRGSLP

SEQ ID NO: 321176 - protein, 9 aa, Homo Sapiens
CGPPPTMVQ

SEQ ID NO: 321177 - protein, 9 aa, Homo Sapiens
LVHLETDSR

SEQ ID NO: 321178 - protein, 9 aa, Homo Sapiens
LPDMVQDLE

SEQ ID NO: 321179 - protein, 9 aa, Homo Sapiens
GADEDFQVT

SEQ ID NO: 321180 - protein, 9 aa, Homo Sapiens
PEEHSLSRM

SEQ ID NO: 321181 - protein, 9 aa, Homo Sapiens
SPMGPPGLP

SEQ ID NO: 321182 - protein, 9 aa, Homo Sapiens
TCTQSEWHG

SEQ ID NO: 321183 - protein, 9 aa, Homo Sapiens
CIDTCENSV

SEQ ID NO: 321184 - protein, 9 aa, Homo Sapiens
LTWVLHQDP

SEQ ID NO: 321185 - protein, 9 aa, Homo Sapiens
YQQVVKRLA

SEQ ID NO: 321186 - protein, 9 aa, Homo Sapiens
QSDIKCHRT

SEQ ID NO: 321187 - protein, 9 aa, Homo Sapiens
HGSGSSWSS

SEQ ID NO: 321188 - protein, 9 aa, Homo Sapiens
WHTGRCRPR

SEQ ID NO: 321189 - protein, 9 aa, Homo Sapiens
CDDERYWPA

SEQ ID NO: 321190 - protein, 9 aa, Homo Sapiens
RDLHSIVED

SEQ ID NO: 321191 - protein, 9 aa, Homo Sapiens
HKAHLLSRL

SEQ ID NO: 321192 - protein, 9 aa, Homo Sapiens
DVTEKVTQV

SEQ ID NO: 321193 - protein, 9 aa, Homo Sapiens
LEECLYSQL

SEQ ID NO: 321194 - protein, 9 aa, Homo Sapiens
GIVGAVTVA

SEQ ID NO: 321195 - protein, 9 aa, Homo Sapiens
LTGRPLHQH

SEQ ID NO: 321196 - protein, 9 aa, Homo Sapiens
ERHCSPTNP

SEQ ID NO: 321197 - protein, 9 aa, Homo Sapiens
DKFFKIHTH

SEQ ID NO: 321198 - protein, 9 aa, Homo Sapiens
PTSPMTPNK

SEQ ID NO: 321199 - protein, 9 aa, Homo Sapiens
PGIPELLRW

SEQ ID NO: 321200 - protein, 9 aa, Homo Sapiens
CKDGGGEEE

SEQ ID NO: 321201 - protein, 9 aa, Homo Sapiens
QAQQNQTQT

SEQ ID NO: 321202 - protein, 9 aa, Homo Sapiens
HKESGQVVT

SEQ ID NO: 321203 - protein, 9 aa, Homo Sapiens
VYGDVPDDT

SEQ ID NO: 321204 - protein, 9 aa, Homo Sapiens
NPSRAFACH

SEQ ID NO: 321205 - protein, 9 aa, Homo Sapiens
ASYSIFQKL

SEQ ID NO: 321206 - protein, 9 aa, Homo Sapiens
VIFAISLGS

SEQ ID NO: 321207 - protein, 9 aa, Homo Sapiens
PPPMRPVQP

SEQ ID NO: 321208 - protein, 9 aa, Homo Sapiens
PFVAMACCY

SEQ ID NO: 321209 - protein, 9 aa, Homo Sapiens
LDVPSLCVA

SEQ ID NO: 321210 - protein, 9 aa, Homo Sapiens
THDVTEKVT

SEQ ID NO: 321211 - protein, 9 aa, Homo Sapiens
DAVVTFLQL

SEQ ID NO: 321212 - protein, 9 aa, Homo Sapiens
DGDMRLANG

SEQ ID NO: 321213 - protein, 9 aa, Homo Sapiens
GHLKDQDKA

SEQ ID NO: 321214 - protein, 9 aa, Homo Sapiens
PRQDVWEWP

SEQ ID NO: 321215 - protein, 9 aa, Homo Sapiens
IELPRGLLS

SEQ ID NO: 321216 - protein, 9 aa, Homo Sapiens
KTIKSQNLL

SEQ ID NO: 321217 - protein, 9 aa, Homo Sapiens
TARLDQAHP

SEQ ID NO: 321218 - protein, 9 aa, Homo Sapiens
LVSLPQLRT

SEQ ID NO: 321219 - protein, 9 aa, Homo Sapiens
DVLDKRCGR

SEQ ID NO: 321220 - protein, 9 aa, Homo Sapiens
CDGHVEVSL

SEQ ID NO: 321221 - protein, 9 aa, Homo Sapiens
CICPPGSLP

SEQ ID NO: 321222 - protein, 9 aa, Homo Sapiens
VLTSSGDAQ

SEQ ID NO: 321223 - protein, 9 aa, Homo Sapiens
EESGRHVLV

SEQ ID NO: 321224 - protein, 9 aa, Homo Sapiens
AIKQFSRGD

SEQ ID NO: 321225 - protein, 9 aa, Homo Sapiens
RGAGAAHLE

SEQ ID NO: 321226 - protein, 9 aa, Homo Sapiens
RKRGPKPKW

SEQ ID NO: 321227 - protein, 9 aa, Homo Sapiens
FPFQGTINQ

SEQ ID NO: 321228 - protein, 9 aa, Homo Sapiens
LVERERPPS

SEQ ID NO: 321229 - protein, 9 aa, Homo Sapiens
RCCSVELDL

SEQ ID NO: 321230 - protein, 9 aa, Homo Sapiens
SGETQEQER

SEQ ID NO: 321231 - protein, 9 aa, Homo Sapiens
SGAVQQREA

SEQ ID NO: 321232 - protein, 9 aa, Homo Sapiens
RFANTMGLV

SEQ ID NO: 321233 - protein, 9 aa, Homo Sapiens
DSANSAQSN

SEQ ID NO: 321234 - protein, 9 aa, Homo Sapiens
AKISSPHQK

SEQ ID NO: 321235 - protein, 9 aa, Homo Sapiens
TGKTNQKLE

SEQ ID NO: 321236 - protein, 9 aa, Homo Sapiens
PIAIWAGGH

SEQ ID NO: 321237 - protein, 9 aa, Homo Sapiens
FMTSGIQAP

SEQ ID NO: 321238 - protein, 9 aa, Homo Sapiens
SAHGGRVTC

SEQ ID NO: 321239 - protein, 9 aa, Homo Sapiens
RAQKARLAE

SEQ ID NO: 321240 - protein, 9 aa, Homo Sapiens
KYLGHAVLM

SEQ ID NO: 321241 - protein, 9 aa, Homo Sapiens
KNKNDGLKS

SEQ ID NO: 321242 - protein, 9 aa, Homo Sapiens
QRATENHQG

SEQ ID NO: 321243 - protein, 9 aa, Homo Sapiens
PLVLKQAVC

SEQ ID NO: 321244 - protein, 9 aa, Homo Sapiens
LICSHLQDL

SEQ ID NO: 321245 - protein, 9 aa, Homo Sapiens
PLIHSRMRL

SEQ ID NO: 321246 - protein, 9 aa, Homo Sapiens
WQEQLARAF

SEQ ID NO: 321247 - protein, 9 aa, Homo Sapiens
KMHNQEEKI

SEQ ID NO: 321248 - protein, 9 aa, Homo Sapiens
LLHQWVAIC

SEQ ID NO: 321249 - protein, 9 aa, Homo Sapiens
PYTPLEKKT

SEQ ID NO: 321250 - protein, 9 aa, Homo Sapiens
QGEGTTPCT

SEQ ID NO: 321251 - protein, 9 aa, Homo Sapiens
LEQNLIQVI

SEQ ID NO: 321252 - protein, 9 aa, Homo Sapiens
AIRSLIQRF

SEQ ID NO: 321253 - protein, 9 aa, Homo Sapiens
IFTSILGHV

SEQ ID NO: 321254 - protein, 9 aa, Homo Sapiens
DKAKEEELC

SEQ ID NO: 321255 - protein, 9 aa, Homo Sapiens
KAPDVSLEG

SEQ ID NO: 321256 - protein, 9 aa, Homo Sapiens
FLVCAWDST

SEQ ID NO: 321257 - protein, 9 aa, Homo Sapiens
RSSRAVMGV

SEQ ID NO: 321258 - protein, 9 aa, Homo Sapiens
VHSINLKEI

SEQ ID NO: 321259 - protein, 9 aa, Homo Sapiens
VGMCKESVN

SEQ ID NO: 321260 - protein, 9 aa, Homo Sapiens
KPKTMAIQG

SEQ ID NO: 321261 - protein, 9 aa, Homo Sapiens
GAAIFALPH

SEQ ID NO: 321262 - protein, 9 aa, Homo Sapiens
TVLQEWLCL

SEQ ID NO: 321263 - protein, 9 aa, Homo Sapiens
AVWQHVAQI

SEQ ID NO: 321264 - protein, 9 aa, Homo Sapiens
GPLRGSDPV

SEQ ID NO: 321265 - protein, 9 aa, Homo Sapiens
AAASVASRH

SEQ ID NO: 321266 - protein, 9 aa, Homo Sapiens
FGLFSYCMG

SEQ ID NO: 321267 - protein, 9 aa, Homo Sapiens
DLEVNIVKV

SEQ ID NO: 321268 - protein, 9 aa, Homo Sapiens
LDIDKDGIG

SEQ ID NO: 321269 - protein, 9 aa, Homo Sapiens
REELLKKCS

SEQ ID NO: 321270 - protein, 9 aa, Homo Sapiens
APATTLAQA

SEQ ID NO: 321271 - protein, 9 aa, Homo Sapiens
KPKNHPLGS

SEQ ID NO: 321272 - protein, 9 aa, Homo Sapiens
VERERPPSQ

SEQ ID NO: 321273 - protein, 9 aa, Homo Sapiens
PVQCSHDVV

SEQ ID NO: 321274 - protein, 9 aa, Homo Sapiens
SVQCWMPPL

SEQ ID NO: 321275 - protein, 9 aa, Homo Sapiens
TEEGKWSLE

SEQ ID NO: 321276 - protein, 9 aa, Homo Sapiens
TRSGGDLVL

SEQ ID NO: 321277 - protein, 9 aa, Homo Sapiens
PADRPCASL

SEQ ID NO: 321278 - protein, 9 aa, Homo Sapiens
EGNEIYEDL

SEQ ID NO: 321279 - protein, 9 aa, Homo Sapiens
AIRNYDIEL

SEQ ID NO: 321280 - protein, 9 aa, Homo Sapiens
RKHLSAPEL

SEQ ID NO: 321281 - protein, 9 aa, Homo Sapiens
LKSRNVEIG

SEQ ID NO: 321282 - protein, 9 aa, Homo Sapiens
AIFALPHFI

SEQ ID NO: 321283 - protein, 9 aa, Homo Sapiens
AAVLDPLGL

SEQ ID NO: 321284 - protein, 9 aa, Homo Sapiens
SSGSWASLP

SEQ ID NO: 321285 - protein, 9 aa, Homo Sapiens
MVSSRSSRQ

SEQ ID NO: 321286 - protein, 9 aa, Homo Sapiens
QAIPLTRWK

SEQ ID NO: 321287 - protein, 9 aa, Homo Sapiens
GLTTNAGLK

SEQ ID NO: 321288 - protein, 9 aa, Homo Sapiens
ARSSPGGRV

SEQ ID NO: 321289 - protein, 9 aa, Homo Sapiens
KSRSKRKKQ

SEQ ID NO: 321290 - protein, 9 aa, Homo Sapiens
ATTLAQAQQ

SEQ ID NO: 321291 - protein, 9 aa, Homo Sapiens
TGHPSPQIA

SEQ ID NO: 321292 - protein, 9 aa, Homo Sapiens
TSPTDVSSN

SEQ ID NO: 321293 - protein, 9 aa, Homo Sapiens
GRLVLSSLP

SEQ ID NO: 321294 - protein, 9 aa, Homo Sapiens
GSMAQVVLS

SEQ ID NO: 321295 - protein, 9 aa, Homo Sapiens
SSCHILWAP

SEQ ID NO: 321296 - protein, 9 aa, Homo Sapiens
EDKPWAQLP

SEQ ID NO: 321297 - protein, 9 aa, Homo Sapiens
LEHKEIQPP

SEQ ID NO: 321298 - protein, 9 aa, Homo Sapiens
LHSTSPVEE

SEQ ID NO: 321299 - protein, 9 aa, Homo Sapiens
LSHMGNLRS

SEQ ID NO: 321300 - protein, 9 aa, Homo Sapiens
DGHVEVSLD

SEQ ID NO: 321301 - protein, 9 aa, Homo Sapiens
VAEHPKPDV

SEQ ID NO: 321302 - protein, 9 aa, Homo Sapiens
EGKEHDLSI

SEQ ID NO: 321303 - protein, 9 aa, Homo Sapiens
KNDGLKSKQ

SEQ ID NO: 321304 - protein, 9 aa, Homo Sapiens
SLLLRYQII

SEQ ID NO: 321305 - protein, 9 aa, Homo Sapiens
CVYLFTGKL

SEQ ID NO: 321306 - protein, 9 aa, Homo Sapiens
FHDLMDCVT

SEQ ID NO: 321307 - protein, 9 aa, Homo Sapiens
TSGSKMALS

SEQ ID NO: 321308 - protein, 9 aa, Homo Sapiens
GIKALDFMW

SEQ ID NO: 321309 - protein, 9 aa, Homo Sapiens
TWTTLAPGK

SEQ ID NO: 321310 - protein, 9 aa, Homo Sapiens
PYIRTGYHP

SEQ ID NO: 321311 - protein, 9 aa, Homo Sapiens
TAGADEDFQ

SEQ ID NO: 321312 - protein, 9 aa, Homo Sapiens
HLREESSRM

SEQ ID NO: 321313 - protein, 9 aa, Homo Sapiens
WRGHAESPG

SEQ ID NO: 321314 - protein, 9 aa, Homo Sapiens
RGSSHCDSH

SEQ ID NO: 321315 - protein, 9 aa, Homo Sapiens
IADQVSWEY

SEQ ID NO: 321316 - protein, 9 aa, Homo Sapiens
FNVMPSPKV

SEQ ID NO: 321317 - protein, 9 aa, Homo Sapiens
TAEDVTVPL

SEQ ID NO: 321318 - protein, 9 aa, Homo Sapiens
AREEEEAEE

SEQ ID NO: 321319 - protein, 9 aa, Homo Sapiens
SDSKSITTL

SEQ ID NO: 321320 - protein, 9 aa, Homo Sapiens
TGSSCTQRT

SEQ ID NO: 321321 - protein, 9 aa, Homo Sapiens
GRLPPPRPL

SEQ ID NO: 321322 - protein, 9 aa, Homo Sapiens
CDALLITQN

SEQ ID NO: 321323 - protein, 9 aa, Homo Sapiens
RYNSLLLRY

SEQ ID NO: 321324 - protein, 9 aa, Homo Sapiens
ARDGSAFYQ

SEQ ID NO: 321325 - protein, 9 aa, Homo Sapiens
PPEGLAQSK

SEQ ID NO: 321326 - protein, 9 aa, Homo Sapiens
LESQWEKLR

SEQ ID NO: 321327 - protein, 9 aa, Homo Sapiens
DTGCPIPGT

SEQ ID NO: 321328 - protein, 9 aa, Homo Sapiens
EVLRKQFET

SEQ ID NO: 321329 - protein, 9 aa, Homo Sapiens
KLSLKHRSP

SEQ ID NO: 321330 - protein, 9 aa, Homo Sapiens
LTWVLLPSS

SEQ ID NO: 321331 - protein, 9 aa, Homo Sapiens
IWRQQWLLG

SEQ ID NO: 321332 - protein, 9 aa, Homo Sapiens
SWRVLISGT

SEQ ID NO: 321333 - protein, 9 aa, Homo Sapiens
CGVHASERL

SEQ ID NO: 321334 - protein, 9 aa, Homo Sapiens
LGQPLPDMV

SEQ ID NO: 321335 - protein, 9 aa, Homo Sapiens
VKRHLKCPV

SEQ ID NO: 321336 - protein, 9 aa, Homo Sapiens
EMLMEREHT

SEQ ID NO: 321337 - protein, 9 aa, Homo Sapiens
KCQGQQEIT

SEQ ID NO: 321338 - protein, 9 aa, Homo Sapiens
IISMVSSGL

SEQ ID NO: 321339 - protein, 9 aa, Homo Sapiens
EHQLDLGTL

SEQ ID NO: 321340 - protein, 9 aa, Homo Sapiens
NTDHLDSMQ

SEQ ID NO: 321341 - protein, 9 aa, Homo Sapiens
GAMGLCFYL

SEQ ID NO: 321342 - protein, 9 aa, Homo Sapiens
AEEGGSSPI

SEQ ID NO: 321343 - protein, 9 aa, Homo Sapiens
HMASLYVGD

SEQ ID NO: 321344 - protein, 9 aa, Homo Sapiens
HHRHRRLHL

SEQ ID NO: 321345 - protein, 9 aa, Homo Sapiens
TSFINKVRF

SEQ ID NO: 321346 - protein, 9 aa, Homo Sapiens
VTSWWTFRC

SEQ ID NO: 321347 - protein, 9 aa, Homo Sapiens
PGPSRAHCP

SEQ ID NO: 321348 - protein, 9 aa, Homo Sapiens
QSSLLRHQK

SEQ ID NO: 321349 - protein, 9 aa, Homo Sapiens
FGGVSSLTP

SEQ ID NO: 321350 - protein, 9 aa, Homo Sapiens
KRLCVMGDI

SEQ ID NO: 321351 - protein, 9 aa, Homo Sapiens
DPHPLLHQW

SEQ ID NO: 321352 - protein, 9 aa, Homo Sapiens
EEIAQSSKA

SEQ ID NO: 321353 - protein, 9 aa, Homo Sapiens
TSTQLDRNS

SEQ ID NO: 321354 - protein, 9 aa, Homo Sapiens
GFPVPARGS

SEQ ID NO: 321355 - protein, 9 aa, Homo Sapiens
AATGHPSPQ

SEQ ID NO: 321356 - protein, 9 aa, Homo Sapiens
GCSCSMVVS

SEQ ID NO: 321357 - protein, 9 aa, Homo Sapiens
LLLLPPSLP

SEQ ID NO: 321358 - protein, 9 aa, Homo Sapiens
TDLLKELAR

SEQ ID NO: 321359 - protein, 9 aa, Homo Sapiens
ELKSEWELD

SEQ ID NO: 321360 - protein, 9 aa, Homo Sapiens
LYIYERLTW

SEQ ID NO: 321361 - protein, 9 aa, Homo Sapiens
INLSLTMLE

SEQ ID NO: 321362 - protein, 9 aa, Homo Sapiens
VVPEDVEAH

SEQ ID NO: 321363 - protein, 9 aa, Homo Sapiens
TEEARLRHK

SEQ ID NO: 321364 - protein, 9 aa, Homo Sapiens
ISLGIDQDH

SEQ ID NO: 321365 - protein, 9 aa, Homo Sapiens
LGDKGLKKM

SEQ ID NO: 321366 - protein, 9 aa, Homo Sapiens
RARGGAPGT

SEQ ID NO: 321367 - protein, 9 aa, Homo Sapiens
KTMAIQGIS

SEQ ID NO: 321368 - protein, 9 aa, Homo Sapiens
WGRGGFDRM

SEQ ID NO: 321369 - protein, 9 aa, Homo Sapiens
LMPPMLNPI

SEQ ID NO: 321370 - protein, 9 aa, Homo Sapiens
SEWELDKIK

SEQ ID NO: 321371 - protein, 9 aa, Homo Sapiens
IIFTVSVTL

SEQ ID NO: 321372 - protein, 9 aa, Homo Sapiens
YARKEPSLL

SEQ ID NO: 321373 - protein, 9 aa, Homo Sapiens
WIFRSWGHV

SEQ ID NO: 321374 - protein, 9 aa, Homo Sapiens
KAFRQRTSL

SEQ ID NO: 321375 - protein, 9 aa, Homo Sapiens
GDSQAKVQW

SEQ ID NO: 321376 - protein, 9 aa, Homo Sapiens
VFLWDLGSG

SEQ ID NO: 321377 - protein, 9 aa, Homo Sapiens
EGLLTLWAK

SEQ ID NO: 321378 - protein, 9 aa, Homo Sapiens
NLIVHFQAS

SEQ ID NO: 321379 - protein, 9 aa, Homo Sapiens
NLVQGQGPE

SEQ ID NO: 321380 - protein, 9 aa, Homo Sapiens
QIVLVGVEV

SEQ ID NO: 321381 - protein, 9 aa, Homo Sapiens
HISSSNEVH

SEQ ID NO: 321382 - protein, 9 aa, Homo Sapiens
WSQFPVLHM

SEQ ID NO: 321383 - protein, 9 aa, Homo Sapiens
SMYIHKAAT

SEQ ID NO: 321384 - protein, 9 aa, Homo Sapiens
VAHFELRLH

SEQ ID NO: 321385 - protein, 9 aa, Homo Sapiens
TGSHCKKDI

SEQ ID NO: 321386 - protein, 9 aa, Homo Sapiens
PEKMQTHPW

SEQ ID NO: 321387 - protein, 9 aa, Homo Sapiens
ELRRKWPVV

SEQ ID NO: 321388 - protein, 9 aa, Homo Sapiens
ECLYSQLER

SEQ ID NO: 321389 - protein, 9 aa, Homo Sapiens
QTVASIKND

SEQ ID NO: 321390 - protein, 9 aa, Homo Sapiens
SMPDLRRFA

SEQ ID NO: 321391 - protein, 9 aa, Homo Sapiens
SPIRRLVFL

SEQ ID NO: 321392 - protein, 9 aa, Homo Sapiens
PIAAAFVLA

SEQ ID NO: 321393 - protein, 9 aa, Homo Sapiens
FNLPGSLYV

SEQ ID NO: 321394 - protein, 9 aa, Homo Sapiens
CEKAFGIGS

SEQ ID NO: 321395 - protein, 9 aa, Homo Sapiens
CGVGQKTRD

SEQ ID NO: 321396 - protein, 9 aa, Homo Sapiens
FSQFGTKCA

SEQ ID NO: 321397 - protein, 9 aa, Homo Sapiens
PWAQLPDCA

SEQ ID NO: 321398 - protein, 9 aa, Homo Sapiens
RRCSRDRAL

SEQ ID NO: 321399 - protein, 9 aa, Homo Sapiens
ARDRSQSRS

SEQ ID NO: 321400 - protein, 9 aa, Homo Sapiens
KRQEDQHRL

SEQ ID NO: 321401 - protein, 9 aa, Homo Sapiens
IIEIHIVEC

SEQ ID NO: 321402 - protein, 9 aa, Homo Sapiens
SITRTSWAP

SEQ ID NO: 321403 - protein, 9 aa, Homo Sapiens
CVITRKPGV

SEQ ID NO: 321404 - protein, 9 aa, Homo Sapiens
EIFMLKCCG

SEQ ID NO: 321405 - protein, 9 aa, Homo Sapiens
ENAKRRGRL

SEQ ID NO: 321406 - protein, 9 aa, Homo Sapiens
KEILLWKGV

SEQ ID NO: 321407 - protein, 9 aa, Homo Sapiens
NHRWQQFRH

SEQ ID NO: 321408 - protein, 9 aa, Homo Sapiens
ASLQKDPRN

SEQ ID NO: 321409 - protein, 9 aa, Homo Sapiens
WVLLPSSHL

SEQ ID NO: 321410 - protein, 9 aa, Homo Sapiens
MAHVLIGNI

SEQ ID NO: 321411 - protein, 9 aa, Homo Sapiens
MSVVEGGLW

SEQ ID NO: 321412 - protein, 9 aa, Homo Sapiens
LGGGSSDAK

SEQ ID NO: 321413 - protein, 9 aa, Homo Sapiens
VHLGYWLNE

SEQ ID NO: 321414 - protein, 9 aa, Homo Sapiens
KEAKKSPKG

SEQ ID NO: 321415 - protein, 9 aa, Homo Sapiens
WQKGECILA

SEQ ID NO: 321416 - protein, 9 aa, Homo Sapiens
SVIFFYIKS

SEQ ID NO: 321417 - protein, 9 aa, Homo Sapiens
EEAEGNEIY

SEQ ID NO: 321418 - protein, 9 aa, Homo Sapiens
RVYHLISIM

SEQ ID NO: 321419 - protein, 9 aa, Homo Sapiens
YRPLNIQIV

SEQ ID NO: 321420 - protein, 9 aa, Homo Sapiens
KPYECYKCG

SEQ ID NO: 321421 - protein, 9 aa, Homo Sapiens
TPDRVDFRL

SEQ ID NO: 321422 - protein, 9 aa, Homo Sapiens
LCVMGDIPM

SEQ ID NO: 321423 - protein, 9 aa, Homo Sapiens
HGAPEPEGK

SEQ ID NO: 321424 - protein, 9 aa, Homo Sapiens
YLIHRGMDS

SEQ ID NO: 321425 - protein, 9 aa, Homo Sapiens
NEIYEDLMR

SEQ ID NO: 321426 - protein, 9 aa, Homo Sapiens
EKAFGIGSE

SEQ ID NO: 321427 - protein, 9 aa, Homo Sapiens
FEVRSSWPL

SEQ ID NO: 321428 - protein, 9 aa, Homo Sapiens
QEQLARAFV

SEQ ID NO: 321429 - protein, 9 aa, Homo Sapiens
AGAEVLLLT

SEQ ID NO: 321430 - protein, 9 aa, Homo Sapiens
SLKLMSASG

SEQ ID NO: 321431 - protein, 9 aa, Homo Sapiens
NHPLGSGRY

SEQ ID NO: 321432 - protein, 9 aa, Homo Sapiens
YSGAGQLPA

SEQ ID NO: 321433 - protein, 9 aa, Homo Sapiens
TSGAFQDSI

SEQ ID NO: 321434 - protein, 9 aa, Homo Sapiens
VQTIQCEKA

SEQ ID NO: 321435 - protein, 9 aa, Homo Sapiens
LRAVTEIVE

SEQ ID NO: 321436 - protein, 9 aa, Homo Sapiens
TRWKPLQTV

SEQ ID NO: 321437 - protein, 9 aa, Homo Sapiens
CPINNERTQ

SEQ ID NO: 321438 - protein, 9 aa, Homo Sapiens
MLSGLSPME

SEQ ID NO: 321439 - protein, 9 aa, Homo Sapiens
KTLKATTSS

SEQ ID NO: 321440 - protein, 9 aa, Homo Sapiens
GPLRVTSQD

SEQ ID NO: 321441 - protein, 9 aa, Homo Sapiens
KADGVGPLL

SEQ ID NO: 321442 - protein, 9 aa, Homo Sapiens
VWRDNHGWH

SEQ ID NO: 321443 - protein, 9 aa, Homo Sapiens
GLSVVMGSK

SEQ ID NO: 321444 - protein, 9 aa, Homo Sapiens
GQPQWKLDP

SEQ ID NO: 321445 - protein, 9 aa, Homo Sapiens
VFSLDRSYA

SEQ ID NO: 321446 - protein, 9 aa, Homo Sapiens
LNIDGIDLT

SEQ ID NO: 321447 - protein, 9 aa, Homo Sapiens
RMMQVQEAV

SEQ ID NO: 321448 - protein, 9 aa, Homo Sapiens
NSLLLRYQI

SEQ ID NO: 321449 - protein, 9 aa, Homo Sapiens
IRSYNHIRP

SEQ ID NO: 321450 - protein, 9 aa, Homo Sapiens
IRATAPMWC

SEQ ID NO: 321451 - protein, 9 aa, Homo Sapiens
TKRSPQQPV

SEQ ID NO: 321452 - protein, 9 aa, Homo Sapiens
DLSKSPGMQ

SEQ ID NO: 321453 - protein, 9 aa, Homo Sapiens
YGGHLGFSL

SEQ ID NO: 321454 - protein, 9 aa, Homo Sapiens
SVGWWSFGV

SEQ ID NO: 321455 - protein, 9 aa, Homo Sapiens
SGGDLVLVG

SEQ ID NO: 321456 - protein, 9 aa, Homo Sapiens
PTRLRPMSM

SEQ ID NO: 321457 - protein, 9 aa, Homo Sapiens
SCAVKNEGK

SEQ ID NO: 321458 - protein, 9 aa, Homo Sapiens
LRWSSVETV

SEQ ID NO: 321459 - protein, 9 aa, Homo Sapiens
CGRDPEMGG

SEQ ID NO: 321460 - protein, 9 aa, Homo Sapiens
WSTSLAWLN

SEQ ID NO: 321461 - protein, 9 aa, Homo Sapiens
QRPHDGASR

SEQ ID NO: 321462 - protein, 9 aa, Homo Sapiens
RRRWAPWNT

SEQ ID NO: 321463 - protein, 9 aa, Homo Sapiens
GANSYEMEE

SEQ ID NO: 321464 - protein, 9 aa, Homo Sapiens
LRRHLATHV

SEQ ID NO: 321465 - protein, 9 aa, Homo Sapiens
QASLLGDSN

SEQ ID NO: 321466 - protein, 9 aa, Homo Sapiens
CESKADWHG

SEQ ID NO: 321467 - protein, 9 aa, Homo Sapiens
LPFLCELSI

SEQ ID NO: 321468 - protein, 9 aa, Homo Sapiens
LVRQEESQW

SEQ ID NO: 321469 - protein, 9 aa, Homo Sapiens
TLTWNNEIH

SEQ ID NO: 321470 - protein, 9 aa, Homo Sapiens
LLCTARLVS

SEQ ID NO: 321471 - protein, 9 aa, Homo Sapiens
SNSRDFLLH

SEQ ID NO: 321472 - protein, 9 aa, Homo Sapiens
GSSHRNQSE

SEQ ID NO: 321473 - protein, 9 aa, Homo Sapiens
GRPNAEGDA

SEQ ID NO: 321474 - protein, 9 aa, Homo Sapiens
KGHVPKSEK

SEQ ID NO: 321475 - protein, 9 aa, Homo Sapiens
KAAMVNGST

SEQ ID NO: 321476 - protein, 9 aa, Homo Sapiens
ALTLLFLLG

SEQ ID NO: 321477 - protein, 9 aa, Homo Sapiens
GSHLDPCDV

SEQ ID NO: 321478 - protein, 9 aa, Homo Sapiens
LLSPRTLPC

SEQ ID NO: 321479 - protein, 9 aa, Homo Sapiens
RPHRPPTVF

SEQ ID NO: 321480 - protein, 9 aa, Homo Sapiens
ERVKSKDAG

SEQ ID NO: 321481 - protein, 9 aa, Homo Sapiens
VCGIHLNRL

SEQ ID NO: 321482 - protein, 9 aa, Homo Sapiens
AKEEEARRI

SEQ ID NO: 321483 - protein, 9 aa, Homo Sapiens
GEKPDMHKQ

SEQ ID NO: 321484 - protein, 9 aa, Homo Sapiens
SNLPTSSDS

SEQ ID NO: 321485 - protein, 9 aa, Homo Sapiens
QKSTDSRCY

SEQ ID NO: 321486 - protein, 9 aa, Homo Sapiens
EIDAYSPAW

SEQ ID NO: 321487 - protein, 9 aa, Homo Sapiens
GGHCNSLLG

SEQ ID NO: 321488 - protein, 9 aa, Homo Sapiens
RSLEFLRTP

SEQ ID NO: 321489 - protein, 9 aa, Homo Sapiens
RVLFHAAKA

SEQ ID NO: 321490 - protein, 9 aa, Homo Sapiens
GSHRVAQAD

SEQ ID NO: 321491 - protein, 9 aa, Homo Sapiens
DDQCHGLRE

SEQ ID NO: 321492 - protein, 9 aa, Homo Sapiens
SHTLPVCLL

SEQ ID NO: 321493 - protein, 9 aa, Homo Sapiens
LHEEPSAED

SEQ ID NO: 321494 - protein, 9 aa, Homo Sapiens
SLASSLRRH

SEQ ID NO: 321495 - protein, 9 aa, Homo Sapiens
TPSEAPNLK

SEQ ID NO: 321496 - protein, 9 aa, Homo Sapiens
DLELLLWSS

SEQ ID NO: 321497 - protein, 9 aa, Homo Sapiens
LDSDTKEVS

SEQ ID NO: 321498 - protein, 9 aa, Homo Sapiens
NHGWHGGRR

SEQ ID NO: 321499 - protein, 9 aa, Homo Sapiens
DLLQGVLDV

SEQ ID NO: 321500 - protein, 9 aa, Homo Sapiens
TSLGLLTTK

SEQ ID NO: 321501 - protein, 9 aa, Homo Sapiens
GLHGQRAHL

SEQ ID NO: 321502 - protein, 9 aa, Homo Sapiens
QGVLDVPAC

SEQ ID NO: 321503 - protein, 9 aa, Homo Sapiens
SVNEVNVDI

SEQ ID NO: 321504 - protein, 9 aa, Homo Sapiens
DGENGFRCI

SEQ ID NO: 321505 - protein, 9 aa, Homo Sapiens
REQGAEAQA

SEQ ID NO: 321506 - protein, 9 aa, Homo Sapiens
VEEEYYTIT

SEQ ID NO: 321507 - protein, 9 aa, Homo Sapiens
LADLIITDS

SEQ ID NO: 321508 - protein, 9 aa, Homo Sapiens
DTRHKKMEK

SEQ ID NO: 321509 - protein, 9 aa, Homo Sapiens
EFNQVVMAN

SEQ ID NO: 321510 - protein, 9 aa, Homo Sapiens
SWPNPKDTT

SEQ ID NO: 321511 - protein, 9 aa, Homo Sapiens
MNNRELLGQ

SEQ ID NO: 321512 - protein, 9 aa, Homo Sapiens
AALGGTATQ

SEQ ID NO: 321513 - protein, 9 aa, Homo Sapiens
GGVSSLTPD

SEQ ID NO: 321514 - protein, 9 aa, Homo Sapiens
ADVAHFELR

SEQ ID NO: 321515 - protein, 9 aa, Homo Sapiens
QEGVCNISN

SEQ ID NO: 321516 - protein, 9 aa, Homo Sapiens
GVVQHELQH

SEQ ID NO: 321517 - protein, 9 aa, Homo Sapiens
HSRAEEGGS

SEQ ID NO: 321518 - protein, 9 aa, Homo Sapiens
LHPPQLHLL

SEQ ID NO: 321519 - protein, 9 aa, Homo Sapiens
TFALSAQLC

SEQ ID NO: 321520 - protein, 9 aa, Homo Sapiens
LTESQLVLV

SEQ ID NO: 321521 - protein, 9 aa, Homo Sapiens
DSNIHGHTE

SEQ ID NO: 321522 - protein, 9 aa, Homo Sapiens
QEAPDGSHA

SEQ ID NO: 321523 - protein, 9 aa, Homo Sapiens
SWSFQSEGA

SEQ ID NO: 321524 - protein, 9 aa, Homo Sapiens
TARLVSLQL

SEQ ID NO: 321525 - protein, 9 aa, Homo Sapiens
PVVLRSTMP

SEQ ID NO: 321526 - protein, 9 aa, Homo Sapiens
ALHFEVFCV

SEQ ID NO: 321527 - protein, 9 aa, Homo Sapiens
VPQGLHGQR

SEQ ID NO: 321528 - protein, 9 aa, Homo Sapiens
HSPPPSSGY

SEQ ID NO: 321529 - protein, 9 aa, Homo Sapiens
SLGIAVYHC

SEQ ID NO: 321530 - protein, 9 aa, Homo Sapiens
SCVRACGAN

SEQ ID NO: 321531 - protein, 9 aa, Homo Sapiens
FQPGKLDKD

SEQ ID NO: 321532 - protein, 9 aa, Homo Sapiens
SRQTGAKSE

SEQ ID NO: 321533 - protein, 9 aa, Homo Sapiens
SAQVIHHDL

SEQ ID NO: 321534 - protein, 9 aa, Homo Sapiens
RYIDNQAVS

SEQ ID NO: 321535 - protein, 9 aa, Homo Sapiens
DPRRTEPRC

SEQ ID NO: 321536 - protein, 9 aa, Homo Sapiens
NIVKVDVTE

SEQ ID NO: 321537 - protein, 9 aa, Homo Sapiens
EADDPQPSR

SEQ ID NO: 321538 - protein, 9 aa, Homo Sapiens
LLPLLESCT

SEQ ID NO: 321539 - protein, 9 aa, Homo Sapiens
IISAVHYCH

SEQ ID NO: 321540 - protein, 9 aa, Homo Sapiens
YSPAWCSGK

SEQ ID NO: 321541 - protein, 9 aa, Homo Sapiens
APRLRPMCP

SEQ ID NO: 321542 - protein, 9 aa, Homo Sapiens
DHIQQFDDD

SEQ ID NO: 321543 - protein, 9 aa, Homo Sapiens
RHHILFRYA

SEQ ID NO: 321544 - protein, 9 aa, Homo Sapiens
SCVSQGKSE

SEQ ID NO: 321545 - protein, 9 aa, Homo Sapiens
KDGIRHGRP

SEQ ID NO: 321546 - protein, 9 aa, Homo Sapiens
EWVLQCFGK

SEQ ID NO: 321547 - protein, 9 aa, Homo Sapiens
IEMTAEKEP

SEQ ID NO: 321548 - protein, 9 aa, Homo Sapiens
MSSVNEVNV

SEQ ID NO: 321549 - protein, 9 aa, Homo Sapiens
VITDSADFR

SEQ ID NO: 321550 - protein, 9 aa, Homo Sapiens
DECGKTFSR

SEQ ID NO: 321551 - protein, 9 aa, Homo Sapiens
RSIMAKEGL

SEQ ID NO: 321552 - protein, 9 aa, Homo Sapiens
CQLLNNLRV

SEQ ID NO: 321553 - protein, 9 aa, Homo Sapiens
GGHTVWRVV

SEQ ID NO: 321554 - protein, 9 aa, Homo Sapiens
LLHQLYSAA

SEQ ID NO: 321555 - protein, 9 aa, Homo Sapiens
KLCSCHPVG

SEQ ID NO: 321556 - protein, 9 aa, Homo Sapiens
SAVEKEPAL

SEQ ID NO: 321557 - protein, 9 aa, Homo Sapiens
KHGEPACVL

SEQ ID NO: 321558 - protein, 9 aa, Homo Sapiens
LAILPFYVT

SEQ ID NO: 321559 - protein, 9 aa, Homo Sapiens
LLLWSSQRE

SEQ ID NO: 321560 - protein, 9 aa, Homo Sapiens
ECVGGDLRE

SEQ ID NO: 321561 - protein, 9 aa, Homo Sapiens
AKETKGGVP

SEQ ID NO: 321562 - protein, 9 aa, Homo Sapiens
VSRQVTCLC

SEQ ID NO: 321563 - protein, 9 aa, Homo Sapiens
VCYDEFFPM

SEQ ID NO: 321564 - protein, 9 aa, Homo Sapiens
FISGLGKWL

SEQ ID NO: 321565 - protein, 9 aa, Homo Sapiens
SEWHGWMVS

SEQ ID NO: 321566 - protein, 9 aa, Homo Sapiens
FSFCLTGEG

SEQ ID NO: 321567 - protein, 9 aa, Homo Sapiens
HQHQHQQQQ

SEQ ID NO: 321568 - protein, 9 aa, Homo Sapiens
DASSWHGQR

SEQ ID NO: 321569 - protein, 9 aa, Homo Sapiens
LDIDALKQS

SEQ ID NO: 321570 - protein, 9 aa, Homo Sapiens
QLVKKYEYK

SEQ ID NO: 321571 - protein, 9 aa, Homo Sapiens
NFNDMVKQG

SEQ ID NO: 321572 - protein, 9 aa, Homo Sapiens
QNLMAAEVV

SEQ ID NO: 321573 - protein, 9 aa, Homo Sapiens
RPPWLPAPP

SEQ ID NO: 321574 - protein, 9 aa, Homo Sapiens
VTLYGSSGV

SEQ ID NO: 321575 - protein, 9 aa, Homo Sapiens
HRVMRANKW

SEQ ID NO: 321576 - protein, 9 aa, Homo Sapiens
EILNTSGNY

SEQ ID NO: 321577 - protein, 9 aa, Homo Sapiens
WPAQSIQDN

SEQ ID NO: 321578 - protein, 9 aa, Homo Sapiens
VHLETDSRP

SEQ ID NO: 321579 - protein, 9 aa, Homo Sapiens
SSHSDMTTS

SEQ ID NO: 321580 - protein, 9 aa, Homo Sapiens
NGPALLCGT

SEQ ID NO: 321581 - protein, 9 aa, Homo Sapiens
AAPSLMRPF

SEQ ID NO: 321582 - protein, 9 aa, Homo Sapiens
GHGCSFPPP

SEQ ID NO: 321583 - protein, 9 aa, Homo Sapiens
MMEPDNLEL

SEQ ID NO: 321584 - protein, 9 aa, Homo Sapiens
THVEPGQEQ

SEQ ID NO: 321585 - protein, 9 aa, Homo Sapiens
HADDEKCEA

SEQ ID NO: 321586 - protein, 9 aa, Homo Sapiens
EHKEIQPPY

SEQ ID NO: 321587 - protein, 9 aa, Homo Sapiens
FGSYDPQRQ

SEQ ID NO: 321588 - protein, 9 aa, Homo Sapiens
PLTPRCTLD

SEQ ID NO: 321589 - protein, 9 aa, Homo Sapiens
ATLKVGKQQ

SEQ ID NO: 321590 - protein, 9 aa, Homo Sapiens
YIDWEKLEH

SEQ ID NO: 321591 - protein, 9 aa, Homo Sapiens
VSNLVAIVV

SEQ ID NO: 321592 - protein, 9 aa, Homo Sapiens
SMRGLKRQS

SEQ ID NO: 321593 - protein, 9 aa, Homo Sapiens
FLFLLVCFL

SEQ ID NO: 321594 - protein, 9 aa, Homo Sapiens
KFFKIHTHC

SEQ ID NO: 321595 - protein, 9 aa, Homo Sapiens
FHNLPSITL

SEQ ID NO: 321596 - protein, 9 aa, Homo Sapiens
PTTISIDVI

SEQ ID NO: 321597 - protein, 9 aa, Homo Sapiens
VCRVLELLG

SEQ ID NO: 321598 - protein, 9 aa, Homo Sapiens
GVRAADPDL

SEQ ID NO: 321599 - protein, 9 aa, Homo Sapiens
GSDPVTLYG

SEQ ID NO: 321600 - protein, 9 aa, Homo Sapiens
GPMGRGRHW

SEQ ID NO: 321601 - protein, 9 aa, Homo Sapiens
PDPVAISDV

SEQ ID NO: 321602 - protein, 9 aa, Homo Sapiens
TFGATNLTG

SEQ ID NO: 321603 - protein, 9 aa, Homo Sapiens
RCLQRSSWH

SEQ ID NO: 321604 - protein, 9 aa, Homo Sapiens
YTLQTQQSH

SEQ ID NO: 321605 - protein, 9 aa, Homo Sapiens
LNILALVYQ

SEQ ID NO: 321606 - protein, 9 aa, Homo Sapiens
LWHIVKEFK

SEQ ID NO: 321607 - protein, 9 aa, Homo Sapiens
RKLTRERMM

SEQ ID NO: 321608 - protein, 9 aa, Homo Sapiens
QRVLLPLLL

SEQ ID NO: 321609 - protein, 9 aa, Homo Sapiens
KRGPKPKWL

SEQ ID NO: 321610 - protein, 9 aa, Homo Sapiens
QQVTYHISG

SEQ ID NO: 321611 - protein, 9 aa, Homo Sapiens
PNMKSKACE

SEQ ID NO: 321612 - protein, 9 aa, Homo Sapiens
AAFSAMRVR

SEQ ID NO: 321613 - protein, 9 aa, Homo Sapiens
DRTEHLARD

SEQ ID NO: 321614 - protein, 9 aa, Homo Sapiens
ESPSGNLKQ

SEQ ID NO: 321615 - protein, 9 aa, Homo Sapiens
GGGGGSSST

SEQ ID NO: 321616 - protein, 9 aa, Homo Sapiens
SMPTLIAPE

SEQ ID NO: 321617 - protein, 9 aa, Homo Sapiens
RAPTFSYRP

SEQ ID NO: 321618 - protein, 9 aa, Homo Sapiens
EEHLECTCA

SEQ ID NO: 321619 - protein, 9 aa, Homo Sapiens
KHTWLLSDG

SEQ ID NO: 321620 - protein, 9 aa, Homo Sapiens
HRNFLVSGW

SEQ ID NO: 321621 - protein, 9 aa, Homo Sapiens
CEAALRGEP

SEQ ID NO: 321622 - protein, 9 aa, Homo Sapiens
AELLQDQQK

SEQ ID NO: 321623 - protein, 9 aa, Homo Sapiens
VAASEGDAK

SEQ ID NO: 321624 - protein, 9 aa, Homo Sapiens
QQIWNERDE

SEQ ID NO: 321625 - protein, 9 aa, Homo Sapiens
QLPRRPRPA

SEQ ID NO: 321626 - protein, 9 aa, Homo Sapiens
DALQPHCLG

SEQ ID NO: 321627 - protein, 9 aa, Homo Sapiens
ECLHVANEV

SEQ ID NO: 321628 - protein, 9 aa, Homo Sapiens
LAQAELLKH

SEQ ID NO: 321629 - protein, 9 aa, Homo Sapiens
HCMDILFTF

SEQ ID NO: 321630 - protein, 9 aa, Homo Sapiens
TIVGTITGI

SEQ ID NO: 321631 - protein, 9 aa, Homo Sapiens
FRNFLDKEA

SEQ ID NO: 321632 - protein, 9 aa, Homo Sapiens
PKAKMPAKK

SEQ ID NO: 321633 - protein, 9 aa, Homo Sapiens
DLSIDIYSC

SEQ ID NO: 321634 - protein, 9 aa, Homo Sapiens
LILADLIIT

SEQ ID NO: 321635 - protein, 9 aa, Homo Sapiens
VYVVSSNHS

SEQ ID NO: 321636 - protein, 9 aa, Homo Sapiens
KGLKKMTLK

SEQ ID NO: 321637 - protein, 9 aa, Homo Sapiens
YLKKKQEPP

SEQ ID NO: 321638 - protein, 9 aa, Homo Sapiens
AKGQSVAPY

SEQ ID NO: 321639 - protein, 9 aa, Homo Sapiens
DTQSTQEIH

SEQ ID NO: 321640 - protein, 9 aa, Homo Sapiens
IYATRSGGD

SEQ ID NO: 321641 - protein, 9 aa, Homo Sapiens
PSSSTGSMG

SEQ ID NO: 321642 - protein, 9 aa, Homo Sapiens
VSCYLDWIH

SEQ ID NO: 321643 - protein, 9 aa, Homo Sapiens
RFNTLTKCP

SEQ ID NO: 321644 - protein, 9 aa, Homo Sapiens
KTSQANFNK

SEQ ID NO: 321645 - protein, 9 aa, Homo Sapiens
ISGPQYQHT

SEQ ID NO: 321646 - protein, 9 aa, Homo Sapiens
RLDSDTKEV

SEQ ID NO: 321647 - protein, 9 aa, Homo Sapiens
LQLYQDFGN

SEQ ID NO: 321648 - protein, 9 aa, Homo Sapiens
TSGPGGIRM

SEQ ID NO: 321649 - protein, 9 aa, Homo Sapiens
LRGGGGSPS

SEQ ID NO: 321650 - protein, 9 aa, Homo Sapiens
SGSKMALST

SEQ ID NO: 321651 - protein, 9 aa, Homo Sapiens
WRDNHGWHG

SEQ ID NO: 321652 - protein, 9 aa, Homo Sapiens
RGTGWPLAG

SEQ ID NO: 321653 - protein, 9 aa, Homo Sapiens
NVQITVVGN

SEQ ID NO: 321654 - protein, 9 aa, Homo Sapiens
DGLKSKQAD

SEQ ID NO: 321655 - protein, 9 aa, Homo Sapiens
TFPGDVDRL

SEQ ID NO: 321656 - protein, 9 aa, Homo Sapiens
GPLVPSSSL

SEQ ID NO: 321657 - protein, 9 aa, Homo Sapiens
SAHQGRDCR

SEQ ID NO: 321658 - protein, 9 aa, Homo Sapiens
LDPLLLLIP

SEQ ID NO: 321659 - protein, 9 aa, Homo Sapiens
KAFGIGSEL

SEQ ID NO: 321660 - protein, 9 aa, Homo Sapiens
SRSLSQVAI

SEQ ID NO: 321661 - protein, 9 aa, Homo Sapiens
SKEQMAFVG

SEQ ID NO: 321662 - protein, 9 aa, Homo Sapiens
TKFCACCGG

SEQ ID NO: 321663 - protein, 9 aa, Homo Sapiens
SASAPPSGH

SEQ ID NO: 321664 - protein, 9 aa, Homo Sapiens
TIKYFKKIM

SEQ ID NO: 321665 - protein, 9 aa, Homo Sapiens
GVGPLLTKG

SEQ ID NO: 321666 - protein, 9 aa, Homo Sapiens
HEQRVLLPL

SEQ ID NO: 321667 - protein, 9 aa, Homo Sapiens
GEGLLTLWA

SEQ ID NO: 321668 - protein, 9 aa, Homo Sapiens
GYIIKRFKL

SEQ ID NO: 321669 - protein, 9 aa, Homo Sapiens
GLSPMEGTN

SEQ ID NO: 321670 - protein, 9 aa, Homo Sapiens
PFYHLSEIV

SEQ ID NO: 321671 - protein, 9 aa, Homo Sapiens
VESFKQTNV

SEQ ID NO: 321672 - protein, 9 aa, Homo Sapiens
DVVDGEGHT

SEQ ID NO: 321673 - protein, 9 aa, Homo Sapiens
EYDVLDKRC

SEQ ID NO: 321674 - protein, 9 aa, Homo Sapiens
EPEGKDEKS

SEQ ID NO: 321675 - protein, 9 aa, Homo Sapiens
TPFGGFKQS

SEQ ID NO: 321676 - protein, 9 aa, Homo Sapiens
WRTPEFYNR

SEQ ID NO: 321677 - protein, 9 aa, Homo Sapiens
HYGGHLCLP

SEQ ID NO: 321678 - protein, 9 aa, Homo Sapiens
EVIEQEAPG

SEQ ID NO: 321679 - protein, 9 aa, Homo Sapiens
IPRQLHRTP

SEQ ID NO: 321680 - protein, 9 aa, Homo Sapiens
FCVAFPLVV

SEQ ID NO: 321681 - protein, 9 aa, Homo Sapiens
LLRCSDAWR

SEQ ID NO: 321682 - protein, 9 aa, Homo Sapiens
QSRCDGHVE

SEQ ID NO: 321683 - protein, 9 aa, Homo Sapiens
GRLVQEETL

SEQ ID NO: 321684 - protein, 9 aa, Homo Sapiens
GSCSPRTTT

SEQ ID NO: 321685 - protein, 9 aa, Homo Sapiens
QRLVAEHPK

SEQ ID NO: 321686 - protein, 9 aa, Homo Sapiens
SFMWYKDSR

SEQ ID NO: 321687 - protein, 9 aa, Homo Sapiens
DDSCLRSLD

SEQ ID NO: 321688 - protein, 9 aa, Homo Sapiens
KKNTLAAQK

SEQ ID NO: 321689 - protein, 9 aa, Homo Sapiens
LPPWSTSLA

SEQ ID NO: 321690 - protein, 9 aa, Homo Sapiens
TEHQLDLGT

SEQ ID NO: 321691 - protein, 9 aa, Homo Sapiens
VIMKNSMYI

SEQ ID NO: 321692 - protein, 9 aa, Homo Sapiens
GKNCAGICA

SEQ ID NO: 321693 - protein, 9 aa, Homo Sapiens
QAAEEGGAN

SEQ ID NO: 321694 - protein, 9 aa, Homo Sapiens
LMRPFLAEA

SEQ ID NO: 321695 - protein, 9 aa, Homo Sapiens
AQQLGGEVG

SEQ ID NO: 321696 - protein, 9 aa, Homo Sapiens
NFLVSGWHC

SEQ ID NO: 321697 - protein, 9 aa, Homo Sapiens
GKPNLYSYF

SEQ ID NO: 321698 - protein, 9 aa, Homo Sapiens
PHRPPTVFR

SEQ ID NO: 321699 - protein, 9 aa, Homo Sapiens
GLCIWLLIL

SEQ ID NO: 321700 - protein, 9 aa, Homo Sapiens
RQEILAVAW

SEQ ID NO: 321701 - protein, 9 aa, Homo Sapiens
FSYSLHLAS

SEQ ID NO: 321702 - protein, 9 aa, Homo Sapiens
TKGPKFYFE

SEQ ID NO: 321703 - protein, 9 aa, Homo Sapiens
LYGLLYIYE

SEQ ID NO: 321704 - protein, 9 aa, Homo Sapiens
GASTPEGTT

SEQ ID NO: 321705 - protein, 9 aa, Homo Sapiens
WTQFRNYPR

SEQ ID NO: 321706 - protein, 9 aa, Homo Sapiens
SMPWHSCRL

SEQ ID NO: 321707 - protein, 9 aa, Homo Sapiens
VVFEPDLLV

SEQ ID NO: 321708 - protein, 9 aa, Homo Sapiens
RLHAALRQT

SEQ ID NO: 321709 - protein, 9 aa, Homo Sapiens
FFCQKSIID

SEQ ID NO: 321710 - protein, 9 aa, Homo Sapiens
PQLHLLSRQ

SEQ ID NO: 321711 - protein, 9 aa, Homo Sapiens
VSGPKVDIK

SEQ ID NO: 321712 - protein, 9 aa, Homo Sapiens
CMNEFSWGK

SEQ ID NO: 321713 - protein, 9 aa, Homo Sapiens
FTQLLAQSV

SEQ ID NO: 321714 - protein, 9 aa, Homo Sapiens
FHNPGACVT

SEQ ID NO: 321715 - protein, 9 aa, Homo Sapiens
HALPSSLPV

SEQ ID NO: 321716 - protein, 9 aa, Homo Sapiens
HNGYYNGHT

SEQ ID NO: 321717 - protein, 9 aa, Homo Sapiens
TKFSQSGHT

SEQ ID NO: 321718 - protein, 9 aa, Homo Sapiens
INKVSKLQC

SEQ ID NO: 321719 - protein, 9 aa, Homo Sapiens
NIIPISLHV

SEQ ID NO: 321720 - protein, 9 aa, Homo Sapiens
GLSLPPRRG

SEQ ID NO: 321721 - protein, 9 aa, Homo Sapiens
ETKGGVPEE

SEQ ID NO: 321722 - protein, 9 aa, Homo Sapiens
EWHFARSDE

SEQ ID NO: 321723 - protein, 9 aa, Homo Sapiens
QSPMLQRNA

SEQ ID NO: 321724 - protein, 9 aa, Homo Sapiens
PVMEPKVDD

SEQ ID NO: 321725 - protein, 9 aa, Homo Sapiens
HGTHGGLVT

SEQ ID NO: 321726 - protein, 9 aa, Homo Sapiens
VEKTSKRGS

SEQ ID NO: 321727 - protein, 9 aa, Homo Sapiens
RAALAMVDS

SEQ ID NO: 321728 - protein, 9 aa, Homo Sapiens
HRRQGLAPG

SEQ ID NO: 321729 - protein, 9 aa, Homo Sapiens
TDHLQIQHW

SEQ ID NO: 321730 - protein, 9 aa, Homo Sapiens
DGIRHGRPR

SEQ ID NO: 321731 - protein, 9 aa, Homo Sapiens
HERAHIEKA

SEQ ID NO: 321732 - protein, 9 aa, Homo Sapiens
GAKGTKLDD

SEQ ID NO: 321733 - protein, 9 aa, Homo Sapiens
LSNSGQGQK

SEQ ID NO: 321734 - protein, 9 aa, Homo Sapiens
LGGILASIY

SEQ ID NO: 321735 - protein, 9 aa, Homo Sapiens
AVAWDLELS

SEQ ID NO: 321736 - protein, 9 aa, Homo Sapiens
CCGGRVSLR

SEQ ID NO: 321737 - protein, 9 aa, Homo Sapiens
NGEEDFAAF

SEQ ID NO: 321738 - protein, 9 aa, Homo Sapiens
QGGLVYLLW

SEQ ID NO: 321739 - protein, 9 aa, Homo Sapiens
GGAMGLCFY

SEQ ID NO: 321740 - protein, 9 aa, Homo Sapiens
RSSWPLYLS

SEQ ID NO: 321741 - protein, 9 aa, Homo Sapiens
DIRSHPRSL

SEQ ID NO: 321742 - protein, 9 aa, Homo Sapiens
LLMRKADSS

SEQ ID NO: 321743 - protein, 9 aa, Homo Sapiens
IHASYSIFQ

SEQ ID NO: 321744 - protein, 9 aa, Homo Sapiens
WTGRGEQSD

SEQ ID NO: 321745 - protein, 9 aa, Homo Sapiens
LSFAHTNCT

SEQ ID NO: 321746 - protein, 9 aa, Homo Sapiens
GAPIVQCAM

SEQ ID NO: 321747 - protein, 9 aa, Homo Sapiens
KQRPEQKIK

SEQ ID NO: 321748 - protein, 9 aa, Homo Sapiens
HCKKDIDEC

SEQ ID NO: 321749 - protein, 9 aa, Homo Sapiens
CHCCDLIGI

SEQ ID NO: 321750 - protein, 9 aa, Homo Sapiens
GACSSHGRC

SEQ ID NO: 321751 - protein, 9 aa, Homo Sapiens
MFGCGSMAQ

SEQ ID NO: 321752 - protein, 9 aa, Homo Sapiens
EHEKVLHIL

SEQ ID NO: 321753 - protein, 9 aa, Homo Sapiens
QAVIDVGVC

SEQ ID NO: 321754 - protein, 9 aa, Homo Sapiens
AQGEPTEPE

SEQ ID NO: 321755 - protein, 9 aa, Homo Sapiens
SGPGGIRMV

SEQ ID NO: 321756 - protein, 9 aa, Homo Sapiens
SIEEAQDPF

SEQ ID NO: 321757 - protein, 9 aa, Homo Sapiens
RPLPARDKH

SEQ ID NO: 321758 - protein, 9 aa, Homo Sapiens
VTIKQVPVE

SEQ ID NO: 321759 - protein, 9 aa, Homo Sapiens
RKLKNKASI

SEQ ID NO: 321760 - protein, 9 aa, Homo Sapiens
NSKLQPEML

SEQ ID NO: 321761 - protein, 9 aa, Homo Sapiens
CARGALTLL

SEQ ID NO: 321762 - protein, 9 aa, Homo Sapiens
AVGGQLGKE

SEQ ID NO: 321763 - protein, 9 aa, Homo Sapiens
LEQQVCALE

SEQ ID NO: 321764 - protein, 9 aa, Homo Sapiens
VIHTLQTSQ

SEQ ID NO: 321765 - protein, 9 aa, Homo Sapiens
YCSNIDKHW

SEQ ID NO: 321766 - protein, 9 aa, Homo Sapiens
KCEPSKEGQ

SEQ ID NO: 321767 - protein, 9 aa, Homo Sapiens
DRNPEDVPP

SEQ ID NO: 321768 - protein, 9 aa, Homo Sapiens
DQAHPASQE

SEQ ID NO: 321769 - protein, 9 aa, Homo Sapiens
LVLWLLFRL

SEQ ID NO: 321770 - protein, 9 aa, Homo Sapiens
LWSSNEDSH

SEQ ID NO: 321771 - protein, 9 aa, Homo Sapiens
LLQFYTSTA

SEQ ID NO: 321772 - protein, 9 aa, Homo Sapiens
TLWKRGLLV

SEQ ID NO: 321773 - protein, 9 aa, Homo Sapiens
EIRVPLHRL

SEQ ID NO: 321774 - protein, 9 aa, Homo Sapiens
PPKAPIHVR

SEQ ID NO: 321775 - protein, 9 aa, Homo Sapiens
HKLFSYNLP

SEQ ID NO: 321776 - protein, 9 aa, Homo Sapiens
LPIPLAYVE

SEQ ID NO: 321777 - protein, 9 aa, Homo Sapiens
RLAQAMDTA

SEQ ID NO: 321778 - protein, 9 aa, Homo Sapiens
AHPADAESA

SEQ ID NO: 321779 - protein, 9 aa, Homo Sapiens
FIAMLEMWW

SEQ ID NO: 321780 - protein, 9 aa, Homo Sapiens
APGKPAPVP

SEQ ID NO: 321781 - protein, 9 aa, Homo Sapiens
HRGMDSTRH

SEQ ID NO: 321782 - protein, 9 aa, Homo Sapiens
LFFCQKSII

SEQ ID NO: 321783 - protein, 9 aa, Homo Sapiens
ENKNTAFQG

SEQ ID NO: 321784 - protein, 9 aa, Homo Sapiens
LGQCQVPAV

SEQ ID NO: 321785 - protein, 9 aa, Homo Sapiens
HMAMKSLFN

SEQ ID NO: 321786 - protein, 9 aa, Homo Sapiens
HRRIQPVPY

SEQ ID NO: 321787 - protein, 9 aa, Homo Sapiens
EKPDMHKQR

SEQ ID NO: 321788 - protein, 9 aa, Homo Sapiens
HSQRLHWET

SEQ ID NO: 321789 - protein, 9 aa, Homo Sapiens
GCHCQERFE

SEQ ID NO: 321790 - protein, 9 aa, Homo Sapiens
HNNRRLQVE

SEQ ID NO: 321791 - protein, 9 aa, Homo Sapiens
LQFYTSTAE

SEQ ID NO: 321792 - protein, 9 aa, Homo Sapiens
RDYHSLRRP

SEQ ID NO: 321793 - protein, 9 aa, Homo Sapiens
AVTVASASL

SEQ ID NO: 321794 - protein, 9 aa, Homo Sapiens
WPFGSTKDY

SEQ ID NO: 321795 - protein, 9 aa, Homo Sapiens
EWGVAVLCT

SEQ ID NO: 321796 - protein, 9 aa, Homo Sapiens
LGRLGSNPQ

SEQ ID NO: 321797 - protein, 9 aa, Homo Sapiens
TFLDMLHRL

SEQ ID NO: 321798 - protein, 9 aa, Homo Sapiens
SESPSGNLK

SEQ ID NO: 321799 - protein, 9 aa, Homo Sapiens
NAHGLRDPL

SEQ ID NO: 321800 - protein, 9 aa, Homo Sapiens
PVYRRYKHV

SEQ ID NO: 321801 - protein, 9 aa, Homo Sapiens
LEARIWQKD

SEQ ID NO: 321802 - protein, 9 aa, Homo Sapiens
TNQSDTDIF

SEQ ID NO: 321803 - protein, 9 aa, Homo Sapiens
PCRPYKVLL

SEQ ID NO: 321804 - protein, 9 aa, Homo Sapiens
DSCHVWPPG

SEQ ID NO: 321805 - protein, 9 aa, Homo Sapiens
FSAMRVRGA

SEQ ID NO: 321806 - protein, 9 aa, Homo Sapiens
GWGQGELSS

SEQ ID NO: 321807 - protein, 9 aa, Homo Sapiens
TVHCPCAVP

SEQ ID NO: 321808 - protein, 9 aa, Homo Sapiens
IYSCYIYWT

SEQ ID NO: 321809 - protein, 9 aa, Homo Sapiens
RPEWIHMDS

SEQ ID NO: 321810 - protein, 9 aa, Homo Sapiens
RLDHKFNLM

SEQ ID NO: 321811 - protein, 9 aa, Homo Sapiens
SCPNAVVGR

SEQ ID NO: 321812 - protein, 9 aa, Homo Sapiens
IMISVFICI

SEQ ID NO: 321813 - protein, 9 aa, Homo Sapiens
HTSETSYLN

SEQ ID NO: 321814 - protein, 9 aa, Homo Sapiens
GKHLSPMAH

SEQ ID NO: 321815 - protein, 9 aa, Homo Sapiens
MVALASVSQ

SEQ ID NO: 321816 - protein, 9 aa, Homo Sapiens
HGALPTSPG

SEQ ID NO: 321817 - protein, 9 aa, Homo Sapiens
HPSFDAILY

SEQ ID NO: 321818 - protein, 9 aa, Homo Sapiens
LIQIFGCKS

SEQ ID NO: 321819 - protein, 9 aa, Homo Sapiens
NRELLGQCQ

SEQ ID NO: 321820 - protein, 9 aa, Homo Sapiens
KKMKAYEPK

SEQ ID NO: 321821 - protein, 9 aa, Homo Sapiens
NAYKCMSQI

SEQ ID NO: 321822 - protein, 9 aa, Homo Sapiens
SENGEEDFA

SEQ ID NO: 321823 - protein, 9 aa, Homo Sapiens
CPGACSSHG

SEQ ID NO: 321824 - protein, 9 aa, Homo Sapiens
GTVVQTSTI

SEQ ID NO: 321825 - protein, 9 aa, Homo Sapiens
LTHNTKHAI

SEQ ID NO: 321826 - protein, 9 aa, Homo Sapiens
NPLVFFTIS

SEQ ID NO: 321827 - protein, 9 aa, Homo Sapiens
ELLKHQEEL

SEQ ID NO: 321828 - protein, 9 aa, Homo Sapiens
QEEALSLDW

SEQ ID NO: 321829 - protein, 9 aa, Homo Sapiens
NVARGCLTY

SEQ ID NO: 321830 - protein, 9 aa, Homo Sapiens
ADHLFSSFG

SEQ ID NO: 321831 - protein, 9 aa, Homo Sapiens
HVLFLRTDR

SEQ ID NO: 321832 - protein, 9 aa, Homo Sapiens
ASQLFTSRE

SEQ ID NO: 321833 - protein, 9 aa, Homo Sapiens
MEIRNESRN

SEQ ID NO: 321834 - protein, 9 aa, Homo Sapiens
VGQYPLVGP

SEQ ID NO: 321835 - protein, 9 aa, Homo Sapiens
NNNPERFLC

SEQ ID NO: 321836 - protein, 9 aa, Homo Sapiens
SGDAQGMNA

SEQ ID NO: 321837 - protein, 9 aa, Homo Sapiens
AELQVQIDE

SEQ ID NO: 321838 - protein, 9 aa, Homo Sapiens
FQASEDTPK

SEQ ID NO: 321839 - protein, 9 aa, Homo Sapiens
TFITLDFVN

SEQ ID NO: 321840 - protein, 9 aa, Homo Sapiens
ELQVQIDEL

SEQ ID NO: 321841 - protein, 9 aa, Homo Sapiens
MRKADSSSS

SEQ ID NO: 321842 - protein, 9 aa, Homo Sapiens
LPWIYQAFL

SEQ ID NO: 321843 - protein, 9 aa, Homo Sapiens
PLLHQWVAI

SEQ ID NO: 321844 - protein, 9 aa, Homo Sapiens
LSYPPTTAK

SEQ ID NO: 321845 - protein, 9 aa, Homo Sapiens
TTSTQYTAA

SEQ ID NO: 321846 - protein, 9 aa, Homo Sapiens
HKASPGWQQ

SEQ ID NO: 321847 - protein, 9 aa, Homo Sapiens
NGERIEKSG

SEQ ID NO: 321848 - protein, 9 aa, Homo Sapiens
KAVFSLDRS

SEQ ID NO: 321849 - protein, 9 aa, Homo Sapiens
RYQFSHPGP

SEQ ID NO: 321850 - protein, 9 aa, Homo Sapiens
QADFLKMRL

SEQ ID NO: 321851 - protein, 9 aa, Homo Sapiens
DLSKFDLHE

SEQ ID NO: 321852 - protein, 9 aa, Homo Sapiens
VCFISRYTQ

SEQ ID NO: 321853 - protein, 9 aa, Homo Sapiens
MYCGSCAAH

SEQ ID NO: 321854 - protein, 9 aa, Homo Sapiens
QVESESAAT

SEQ ID NO: 321855 - protein, 9 aa, Homo Sapiens
LTQGKDQYY

SEQ ID NO: 321856 - protein, 9 aa, Homo Sapiens
YPTSTQLDR

SEQ ID NO: 321857 - protein, 9 aa, Homo Sapiens
PIIAMETFG

SEQ ID NO: 321858 - protein, 9 aa, Homo Sapiens
RHMKRQDQI

SEQ ID NO: 321859 - protein, 9 aa, Homo Sapiens
FHSNVHSRV

SEQ ID NO: 321860 - protein, 9 aa, Homo Sapiens
EVNIVKVDV

SEQ ID NO: 321861 - protein, 9 aa, Homo Sapiens
ISDDVALCD

SEQ ID NO: 321862 - protein, 9 aa, Homo Sapiens
PLPARDKHA

SEQ ID NO: 321863 - protein, 9 aa, Homo Sapiens
TLHLFSIDE

SEQ ID NO: 321864 - protein, 9 aa, Homo Sapiens
QLANFCQIL

SEQ ID NO: 321865 - protein, 9 aa, Homo Sapiens
EWPHSEFAL

SEQ ID NO: 321866 - protein, 9 aa, Homo Sapiens
QRGAPELWR

SEQ ID NO: 321867 - protein, 9 aa, Homo Sapiens
KHATATMKF

SEQ ID NO: 321868 - protein, 9 aa, Homo Sapiens
KRLHFSVRQ

SEQ ID NO: 321869 - protein, 9 aa, Homo Sapiens
RDKHALKQF

SEQ ID NO: 321870 - protein, 9 aa, Homo Sapiens
AERSWVLSQ

SEQ ID NO: 321871 - protein, 9 aa, Homo Sapiens
PPWSTSLAW

SEQ ID NO: 321872 - protein, 9 aa, Homo Sapiens
PCRQRTVME

SEQ ID NO: 321873 - protein, 9 aa, Homo Sapiens
KHVGPGKPK

SEQ ID NO: 321874 - protein, 9 aa, Homo Sapiens
FSVGWWSFG

SEQ ID NO: 321875 - protein, 9 aa, Homo Sapiens
RWQQFRHLA

SEQ ID NO: 321876 - protein, 9 aa, Homo Sapiens
QLLNRLADL

SEQ ID NO: 321877 - protein, 9 aa, Homo Sapiens
RSPQQPVPY

SEQ ID NO: 321878 - protein, 9 aa, Homo Sapiens
SQEPVLFTR

SEQ ID NO: 321879 - protein, 9 aa, Homo Sapiens
LNPFKVVKK

SEQ ID NO: 321880 - protein, 9 aa, Homo Sapiens
GSCVSVWSS

SEQ ID NO: 321881 - protein, 9 aa, Homo Sapiens
ERERPPSQV

SEQ ID NO: 321882 - protein, 9 aa, Homo Sapiens
CLACRSDAH

SEQ ID NO: 321883 - protein, 9 aa, Homo Sapiens
ASTVEKHYG

SEQ ID NO: 321884 - protein, 9 aa, Homo Sapiens
AEARSSPGG

SEQ ID NO: 321885 - protein, 9 aa, Homo Sapiens
RQTGAKSEH

SEQ ID NO: 321886 - protein, 9 aa, Homo Sapiens
WQHVAQIRQ

SEQ ID NO: 321887 - protein, 9 aa, Homo Sapiens
QPERPGDTQ

SEQ ID NO: 321888 - protein, 9 aa, Homo Sapiens
LIDALQPHC

SEQ ID NO: 321889 - protein, 9 aa, Homo Sapiens
LTYHRFGNN

SEQ ID NO: 321890 - protein, 9 aa, Homo Sapiens
GKPNSGVGA

SEQ ID NO: 321891 - protein, 9 aa, Homo Sapiens
QMGNQQEPS

SEQ ID NO: 321892 - protein, 9 aa, Homo Sapiens
ADGSLDMQP

SEQ ID NO: 321893 - protein, 9 aa, Homo Sapiens
RPQQQGHMG

SEQ ID NO: 321894 - protein, 9 aa, Homo Sapiens
PCPAVPLGP

SEQ ID NO: 321895 - protein, 9 aa, Homo Sapiens
FTLRWSYNE

SEQ ID NO: 321896 - protein, 9 aa, Homo Sapiens
KLRLLLLGK

SEQ ID NO: 321897 - protein, 9 aa, Homo Sapiens
HMDPYCRLR

SEQ ID NO: 321898 - protein, 9 aa, Homo Sapiens
YAARKLTRE

SEQ ID NO: 321899 - protein, 9 aa, Homo Sapiens
TFRNFLDKE

SEQ ID NO: 321900 - protein, 9 aa, Homo Sapiens
IRNYDIELA

SEQ ID NO: 321901 - protein, 9 aa, Homo Sapiens
LGGTRGTGW

SEQ ID NO: 321902 - protein, 9 aa, Homo Sapiens
YDHHRDHQQ

SEQ ID NO: 321903 - protein, 9 aa, Homo Sapiens
CVALRPRPG

SEQ ID NO: 321904 - protein, 9 aa, Homo Sapiens
KGYMIVKCQ

SEQ ID NO: 321905 - protein, 9 aa, Homo Sapiens
FGGIPKTTG

SEQ ID NO: 321906 - protein, 9 aa, Homo Sapiens
MLQRNALYI

SEQ ID NO: 321907 - protein, 9 aa, Homo Sapiens
EHDLSISSD

SEQ ID NO: 321908 - protein, 9 aa, Homo Sapiens
LERPGPAGH

SEQ ID NO: 321909 - protein, 9 aa, Homo Sapiens
CAPDLEYLF

SEQ ID NO: 321910 - protein, 9 aa, Homo Sapiens
DMSPVFVGT

SEQ ID NO: 321911 - protein, 9 aa, Homo Sapiens
LREVLKKIW

SEQ ID NO: 321912 - protein, 9 aa, Homo Sapiens
ESMLVVQLE

SEQ ID NO: 321913 - protein, 9 aa, Homo Sapiens
IANGSSHRN

SEQ ID NO: 321914 - protein, 9 aa, Homo Sapiens
VILTPSEAP

SEQ ID NO: 321915 - protein, 9 aa, Homo Sapiens
SPMLQRNAL

SEQ ID NO: 321916 - protein, 9 aa, Homo Sapiens
LVSGSHLDP

SEQ ID NO: 321917 - protein, 9 aa, Homo Sapiens
TAMKVPIAI

SEQ ID NO: 321918 - protein, 9 aa, Homo Sapiens
TSPMTPNKP

SEQ ID NO: 321919 - protein, 9 aa, Homo Sapiens
FTRSITDNI

SEQ ID NO: 321920 - protein, 9 aa, Homo Sapiens
THQCRRLYE

SEQ ID NO: 321921 - protein, 9 aa, Homo Sapiens
FDKRLHFSV

SEQ ID NO: 321922 - protein, 9 aa, Homo Sapiens
EEHSLSRMV

SEQ ID NO: 321923 - protein, 9 aa, Homo Sapiens
KDENSTKIL

SEQ ID NO: 321924 - protein, 9 aa, Homo Sapiens
VSSRSSRQT

SEQ ID NO: 321925 - protein, 9 aa, Homo Sapiens
LSKSPGMQG

SEQ ID NO: 321926 - protein, 9 aa, Homo Sapiens
TATMKFLSS

SEQ ID NO: 321927 - protein, 9 aa, Homo Sapiens
LGGLEHLAV

SEQ ID NO: 321928 - protein, 9 aa, Homo Sapiens
STGPSLFES

SEQ ID NO: 321929 - protein, 9 aa, Homo Sapiens
DRESRFLAS

SEQ ID NO: 321930 - protein, 9 aa, Homo Sapiens
PEPEGKDEK

SEQ ID NO: 321931 - protein, 9 aa, Homo Sapiens
LWGDWFTAM

SEQ ID NO: 321932 - protein, 9 aa, Homo Sapiens
VPVMEPKVD

SEQ ID NO: 321933 - protein, 9 aa, Homo Sapiens
QLAEEQAQI

SEQ ID NO: 321934 - protein, 9 aa, Homo Sapiens
GPRELMLQA

SEQ ID NO: 321935 - protein, 9 aa, Homo Sapiens
RDPLVPTGG

SEQ ID NO: 321936 - protein, 9 aa, Homo Sapiens
MGAAGRATQ

SEQ ID NO: 321937 - protein, 9 aa, Homo Sapiens
DGKEIHSLM

SEQ ID NO: 321938 - protein, 9 aa, Homo Sapiens
FCLLGSNDS

SEQ ID NO: 321939 - protein, 9 aa, Homo Sapiens
SRAEEGGSS

SEQ ID NO: 321940 - protein, 9 aa, Homo Sapiens
ENEEAEGNE

SEQ ID NO: 321941 - protein, 9 aa, Homo Sapiens
EEEAELWGE

SEQ ID NO: 321942 - protein, 9 aa, Homo Sapiens
ESRFLASKM

SEQ ID NO: 321943 - protein, 9 aa, Homo Sapiens
IHKAHLLSR

SEQ ID NO: 321944 - protein, 9 aa, Homo Sapiens
CSDAWRDLE

SEQ ID NO: 321945 - protein, 9 aa, Homo Sapiens
VHPPGACQA

SEQ ID NO: 321946 - protein, 9 aa, Homo Sapiens
PQWHIDLQP

SEQ ID NO: 321947 - protein, 9 aa, Homo Sapiens
KGGHCNSLL

SEQ ID NO: 321948 - protein, 9 aa, Homo Sapiens
LQQTGRIFG

SEQ ID NO: 321949 - protein, 9 aa, Homo Sapiens
PRLLLSSSG

SEQ ID NO: 321950 - protein, 9 aa, Homo Sapiens
DMYECLHVA

SEQ ID NO: 321951 - protein, 9 aa, Homo Sapiens
TRTSWAPSV

SEQ ID NO: 321952 - protein, 9 aa, Homo Sapiens
YIRRRPHVR

SEQ ID NO: 321953 - protein, 9 aa, Homo Sapiens
VPAFFGSLT

SEQ ID NO: 321954 - protein, 9 aa, Homo Sapiens
GATNLTGLF

SEQ ID NO: 321955 - protein, 9 aa, Homo Sapiens
VSSQVVMPP

SEQ ID NO: 321956 - protein, 9 aa, Homo Sapiens
ITHGNSSII

SEQ ID NO: 321957 - protein, 9 aa, Homo Sapiens
WANLPGPSM

SEQ ID NO: 321958 - protein, 9 aa, Homo Sapiens
QLQVQHLSH

SEQ ID NO: 321959 - protein, 9 aa, Homo Sapiens
DVGARVHTA

SEQ ID NO: 321960 - protein, 9 aa, Homo Sapiens
ILILTVLLA

SEQ ID NO: 321961 - protein, 9 aa, Homo Sapiens
VMEQAIPLT

SEQ ID NO: 321962 - protein, 9 aa, Homo Sapiens
PRPNGAGAC

SEQ ID NO: 321963 - protein, 9 aa, Homo Sapiens
VLRKQFETT

SEQ ID NO: 321964 - protein, 9 aa, Homo Sapiens
HIQNKPYTE

SEQ ID NO: 321965 - protein, 9 aa, Homo Sapiens
RGMSISCPN

SEQ ID NO: 321966 - protein, 9 aa, Homo Sapiens
VTVQIEGSS

SEQ ID NO: 321967 - protein, 9 aa, Homo Sapiens
WTAATSPSA

SEQ ID NO: 321968 - protein, 9 aa, Homo Sapiens
LVSGWHCFM

SEQ ID NO: 321969 - protein, 9 aa, Homo Sapiens
LLIQIFGCK

SEQ ID NO: 321970 - protein, 9 aa, Homo Sapiens
LALPEETFI

SEQ ID NO: 321971 - protein, 9 aa, Homo Sapiens
WRQQWLLGL

SEQ ID NO: 321972 - protein, 9 aa, Homo Sapiens
INFVWITII

SEQ ID NO: 321973 - protein, 9 aa, Homo Sapiens
LRYTFYLSC

SEQ ID NO: 321974 - protein, 9 aa, Homo Sapiens
VFLVRRFCC

SEQ ID NO: 321975 - protein, 9 aa, Homo Sapiens
DYQTRLPLC

SEQ ID NO: 321976 - protein, 9 aa, Homo Sapiens
VPCGVGQKT

SEQ ID NO: 321977 - protein, 9 aa, Homo Sapiens
LSQRNPSYP

SEQ ID NO: 321978 - protein, 9 aa, Homo Sapiens
LQPHCLGQL

SEQ ID NO: 321979 - protein, 9 aa, Homo Sapiens
QNHTCSYPR

SEQ ID NO: 321980 - protein, 9 aa, Homo Sapiens
ALHMTTTGK

SEQ ID NO: 321981 - protein, 9 aa, Homo Sapiens
CTQSEWHGW

SEQ ID NO: 321982 - protein, 9 aa, Homo Sapiens
PPMSVAASQ

SEQ ID NO: 321983 - protein, 9 aa, Homo Sapiens
LSMSSQAST

SEQ ID NO: 321984 - protein, 9 aa, Homo Sapiens
ISWRMPGDR

SEQ ID NO: 321985 - protein, 9 aa, Homo Sapiens
GQCQVPAVG

SEQ ID NO: 321986 - protein, 9 aa, Homo Sapiens
WQRSDSLCC

SEQ ID NO: 321987 - protein, 9 aa, Homo Sapiens
KHMKVHGHS

SEQ ID NO: 321988 - protein, 9 aa, Homo Sapiens
LSSVHPPGA

SEQ ID NO: 321989 - protein, 9 aa, Homo Sapiens
SYDPQRQIC

SEQ ID NO: 321990 - protein, 9 aa, Homo Sapiens
YFLIDALQP

SEQ ID NO: 321991 - protein, 9 aa, Homo Sapiens
VESYSGAGQ

SEQ ID NO: 321992 - protein, 9 aa, Homo Sapiens
TTQHRSPKC

SEQ ID NO: 321993 - protein, 9 aa, Homo Sapiens
DNGKEEQEQ

SEQ ID NO: 321994 - protein, 9 aa, Homo Sapiens
DALSGAVQQ

SEQ ID NO: 321995 - protein, 9 aa, Homo Sapiens
VRRVSLKPP

SEQ ID NO: 321996 - protein, 9 aa, Homo Sapiens
SQRNPSYPW

SEQ ID NO: 321997 - protein, 9 aa, Homo Sapiens
HSNEKKNTL

SEQ ID NO: 321998 - protein, 9 aa, Homo Sapiens
YMHSLTHSM

SEQ ID NO: 321999 - protein, 9 aa, Homo Sapiens
EAPKRFRDE

SEQ ID NO: 322000 - protein, 9 aa, Homo Sapiens
RQAEAAEHS

SEQ ID NO: 322001 - protein, 9 aa, Homo Sapiens
NLIQVIEPF

SEQ ID NO: 322002 - protein, 9 aa, Homo Sapiens
GPRPIPVIF

SEQ ID NO: 322003 - protein, 9 aa, Homo Sapiens
HIFTFPKAP

SEQ ID NO: 322004 - protein, 9 aa, Homo Sapiens
HDLKPSNLL

SEQ ID NO: 322005 - protein, 9 aa, Homo Sapiens
LLVFVTKPN

SEQ ID NO: 322006 - protein, 9 aa, Homo Sapiens
ALATGFSPP

SEQ ID NO: 322007 - protein, 9 aa, Homo Sapiens
ADAESASRR

SEQ ID NO: 322008 - protein, 9 aa, Homo Sapiens
SCRQQSSCQ

SEQ ID NO: 322009 - protein, 9 aa, Homo Sapiens
HGVVWDSKK

SEQ ID NO: 322010 - protein, 9 aa, Homo Sapiens
YPRWHSTTI

SEQ ID NO: 322011 - protein, 9 aa, Homo Sapiens
AGRATQLVG

SEQ ID NO: 322012 - protein, 9 aa, Homo Sapiens
VDKGPKEPL

SEQ ID NO: 322013 - protein, 9 aa, Homo Sapiens
IKDISNKVD

SEQ ID NO: 322014 - protein, 9 aa, Homo Sapiens
GEAHMSPLF

SEQ ID NO: 322015 - protein, 9 aa, Homo Sapiens
WHAGQTIND

SEQ ID NO: 322016 - protein, 9 aa, Homo Sapiens
WYGTRRKPY

SEQ ID NO: 322017 - protein, 9 aa, Homo Sapiens
VACMRFQPS

SEQ ID NO: 322018 - protein, 9 aa, Homo Sapiens
PLQVILTPS

SEQ ID NO: 322019 - protein, 9 aa, Homo Sapiens
KARQEFEEW

SEQ ID NO: 322020 - protein, 9 aa, Homo Sapiens
FWYGLCVPI

SEQ ID NO: 322021 - protein, 9 aa, Homo Sapiens
NVATGDLIY

SEQ ID NO: 322022 - protein, 9 aa, Homo Sapiens
KRIAQASRR

SEQ ID NO: 322023 - protein, 9 aa, Homo Sapiens
IVLWRKVDE

SEQ ID NO: 322024 - protein, 9 aa, Homo Sapiens
HCMNEFSWG

SEQ ID NO: 322025 - protein, 9 aa, Homo Sapiens
VQHLSHATH

SEQ ID NO: 322026 - protein, 9 aa, Homo Sapiens
PEATNVVTF

SEQ ID NO: 322027 - protein, 9 aa, Homo Sapiens
HIDPFTHEA

SEQ ID NO: 322028 - protein, 9 aa, Homo Sapiens
FVNQRTRKV

SEQ ID NO: 322029 - protein, 9 aa, Homo Sapiens
GMKDAVIHT

SEQ ID NO: 322030 - protein, 9 aa, Homo Sapiens
RKFPFFTHP

SEQ ID NO: 322031 - protein, 9 aa, Homo Sapiens
TFYDLETGK

SEQ ID NO: 322032 - protein, 9 aa, Homo Sapiens
IVPAQRIPR

SEQ ID NO: 322033 - protein, 9 aa, Homo Sapiens
LQPEMLQDL

SEQ ID NO: 322034 - protein, 9 aa, Homo Sapiens
TARALLDID

SEQ ID NO: 322035 - protein, 9 aa, Homo Sapiens
WLCLACRSD

SEQ ID NO: 322036 - protein, 9 aa, Homo Sapiens
YNMLEVADH

SEQ ID NO: 322037 - protein, 9 aa, Homo Sapiens
PSICVFLVR

SEQ ID NO: 322038 - protein, 9 aa, Homo Sapiens
MIEMTAEKE

SEQ ID NO: 322039 - protein, 9 aa, Homo Sapiens
WHGGRRLPE

SEQ ID NO: 322040 - protein, 9 aa, Homo Sapiens
FTSILGHVI

SEQ ID NO: 322041 - protein, 9 aa, Homo Sapiens
AVVESYSGA

SEQ ID NO: 322042 - protein, 9 aa, Homo Sapiens
CRSLGCKRK

SEQ ID NO: 322043 - protein, 9 aa, Homo Sapiens
MNTFNVMPS

SEQ ID NO: 322044 - protein, 9 aa, Homo Sapiens
CVPTRLRPM

SEQ ID NO: 322045 - protein, 9 aa, Homo Sapiens
HFPPGLSFH

SEQ ID NO: 322046 - protein, 9 aa, Homo Sapiens
QAGDGERAR

SEQ ID NO: 322047 - protein, 9 aa, Homo Sapiens
NHIRPGQLD

SEQ ID NO: 322048 - protein, 9 aa, Homo Sapiens
MPAKKTRPS

SEQ ID NO: 322049 - protein, 9 aa, Homo Sapiens
RGGGGSPSR

SEQ ID NO: 322050 - protein, 9 aa, Homo Sapiens
NKNTAFQGS

SEQ ID NO: 322051 - protein, 9 aa, Homo Sapiens
GSNPQKKTV

SEQ ID NO: 322052 - protein, 9 aa, Homo Sapiens
NPTSVQTLL

SEQ ID NO: 322053 - protein, 9 aa, Homo Sapiens
FTPPEDDEI

SEQ ID NO: 322054 - protein, 9 aa, Homo Sapiens
RPCWSFPMG

SEQ ID NO: 322055 - protein, 9 aa, Homo Sapiens
PGTCAARSQ

SEQ ID NO: 322056 - protein, 9 aa, Homo Sapiens
LAFASSTSP

SEQ ID NO: 322057 - protein, 9 aa, Homo Sapiens
QGPPRLPAV

SEQ ID NO: 322058 - protein, 9 aa, Homo Sapiens
LFKKSKEVS

SEQ ID NO: 322059 - protein, 9 aa, Homo Sapiens
LGGEVGDDG

SEQ ID NO: 322060 - protein, 9 aa, Homo Sapiens
LGKWLVGTV

SEQ ID NO: 322061 - protein, 9 aa, Homo Sapiens
MQKSLGAIM

SEQ ID NO: 322062 - protein, 9 aa, Homo Sapiens
GCKSYPMLK

SEQ ID NO: 322063 - protein, 9 aa, Homo Sapiens
ELPYARKEP

SEQ ID NO: 322064 - protein, 9 aa, Homo Sapiens
SPDTSQLAS

SEQ ID NO: 322065 - protein, 9 aa, Homo Sapiens
DTDCPCMVV

SEQ ID NO: 322066 - protein, 9 aa, Homo Sapiens
EGQSRCDGH

SEQ ID NO: 322067 - protein, 9 aa, Homo Sapiens
ELMLQAMAD

SEQ ID NO: 322068 - protein, 9 aa, Homo Sapiens
GHVYPMQKR

SEQ ID NO: 322069 - protein, 9 aa, Homo Sapiens
LQSSCHILW

SEQ ID NO: 322070 - protein, 9 aa, Homo Sapiens
PHVPEASSE

SEQ ID NO: 322071 - protein, 9 aa, Homo Sapiens
VITKQEPGE

SEQ ID NO: 322072 - protein, 9 aa, Homo Sapiens
FQGIEFHYV

SEQ ID NO: 322073 - protein, 9 aa, Homo Sapiens
LSRYNLVQG

SEQ ID NO: 322074 - protein, 9 aa, Homo Sapiens
CSEIQMLNN

SEQ ID NO: 322075 - protein, 9 aa, Homo Sapiens
EVSQQLQDD

SEQ ID NO: 322076 - protein, 9 aa, Homo Sapiens
NLDGNGQDA

SEQ ID NO: 322077 - protein, 9 aa, Homo Sapiens
DVGMCKESV

SEQ ID NO: 322078 - protein, 9 aa, Homo Sapiens
PFWLVLWLL

SEQ ID NO: 322079 - protein, 9 aa, Homo Sapiens
GDVAAVLDP

SEQ ID NO: 322080 - protein, 9 aa, Homo Sapiens
KERTHSTAS

SEQ ID NO: 322081 - protein, 9 aa, Homo Sapiens
VVDGEGHTG

SEQ ID NO: 322082 - protein, 9 aa, Homo Sapiens
PQVSSQVVM

SEQ ID NO: 322083 - protein, 9 aa, Homo Sapiens
VLVSLPQLR

SEQ ID NO: 322084 - protein, 9 aa, Homo Sapiens
MSVKAAMVN

SEQ ID NO: 322085 - protein, 9 aa, Homo Sapiens
GSCPSQHQG

SEQ ID NO: 322086 - protein, 9 aa, Homo Sapiens
EVPHEVRDF

SEQ ID NO: 322087 - protein, 9 aa, Homo Sapiens
SIIDAHANE

SEQ ID NO: 322088 - protein, 9 aa, Homo Sapiens
NSLGPRPIP

SEQ ID NO: 322089 - protein, 9 aa, Homo Sapiens
WWGFLVTGL

SEQ ID NO: 322090 - protein, 9 aa, Homo Sapiens
RQELQCNVI

SEQ ID NO: 322091 - protein, 9 aa, Homo Sapiens
EDLPFWLVL

SEQ ID NO: 322092 - protein, 9 aa, Homo Sapiens
AAVAAAGPP

SEQ ID NO: 322093 - protein, 9 aa, Homo Sapiens
FLKAGRRAA

SEQ ID NO: 322094 - protein, 9 aa, Homo Sapiens
KWNGHWWEP

SEQ ID NO: 322095 - protein, 9 aa, Homo Sapiens
VLCRTASIM

SEQ ID NO: 322096 - protein, 9 aa, Homo Sapiens
FWYSMPWHS

SEQ ID NO: 322097 - protein, 9 aa, Homo Sapiens
SVRLTYHRF

SEQ ID NO: 322098 - protein, 9 aa, Homo Sapiens
EETFISGPQ

SEQ ID NO: 322099 - protein, 9 aa, Homo Sapiens
NTGSTLEWD

SEQ ID NO: 322100 - protein, 9 aa, Homo Sapiens
GPAGEMVPA

SEQ ID NO: 322101 - protein, 9 aa, Homo Sapiens
LDASPQYPA

SEQ ID NO: 322102 - protein, 9 aa, Homo Sapiens
AILVSLPTL

SEQ ID NO: 322103 - protein, 9 aa, Homo Sapiens
PNPENTGST

SEQ ID NO: 322104 - protein, 9 aa, Homo Sapiens
GAPGTKRKR

SEQ ID NO: 322105 - protein, 9 aa, Homo Sapiens
AGIICYAIG

SEQ ID NO: 322106 - protein, 9 aa, Homo Sapiens
VVVLGETVA

SEQ ID NO: 322107 - protein, 9 aa, Homo Sapiens
VPWSQPNPA

SEQ ID NO: 322108 - protein, 9 aa, Homo Sapiens
VQMDKPQNM

SEQ ID NO: 322109 - protein, 9 aa, Homo Sapiens
GFSPGGGIR

SEQ ID NO: 322110 - protein, 9 aa, Homo Sapiens
LLRVPVLRS

SEQ ID NO: 322111 - protein, 9 aa, Homo Sapiens
GQPLPDMVQ

SEQ ID NO: 322112 - protein, 9 aa, Homo Sapiens
REQITSEAE

SEQ ID NO: 322113 - protein, 9 aa, Homo Sapiens
KVEQVQLVV

SEQ ID NO: 322114 - protein, 9 aa, Homo Sapiens
TVDGPRELM

SEQ ID NO: 322115 - protein, 9 aa, Homo Sapiens
DPQRQICVG

SEQ ID NO: 322116 - protein, 9 aa, Homo Sapiens
QLKERRQES

SEQ ID NO: 322117 - protein, 9 aa, Homo Sapiens
LKKCSLYGK

SEQ ID NO: 322118 - protein, 9 aa, Homo Sapiens
FRPMQMALY

SEQ ID NO: 322119 - protein, 9 aa, Homo Sapiens
SCRRSYHSS

SEQ ID NO: 322120 - protein, 9 aa, Homo Sapiens
WGEHTLTEK

SEQ ID NO: 322121 - protein, 9 aa, Homo Sapiens
KPNINTVAT

SEQ ID NO: 322122 - protein, 9 aa, Homo Sapiens
SAVAWAMTN

SEQ ID NO: 322123 - protein, 9 aa, Homo Sapiens
SSHGRCVDG

SEQ ID NO: 322124 - protein, 9 aa, Homo Sapiens
KEKQKKMKA

SEQ ID NO: 322125 - protein, 9 aa, Homo Sapiens
HGCVGDSPI

SEQ ID NO: 322126 - protein, 9 aa, Homo Sapiens
LCRTRGEEK

SEQ ID NO: 322127 - protein, 9 aa, Homo Sapiens
MKQMTRWFS

SEQ ID NO: 322128 - protein, 9 aa, Homo Sapiens
KSEHRNFLV

SEQ ID NO: 322129 - protein, 9 aa, Homo Sapiens
KALFRCAKA

SEQ ID NO: 322130 - protein, 9 aa, Homo Sapiens
KLQPEMLQD

SEQ ID NO: 322131 - protein, 9 aa, Homo Sapiens
PMPNPVVYY

SEQ ID NO: 322132 - protein, 9 aa, Homo Sapiens
TDVVDGEGH

SEQ ID NO: 322133 - protein, 9 aa, Homo Sapiens
CTAQPDLRQ

SEQ ID NO: 322134 - protein, 9 aa, Homo Sapiens
WAADAQVLH

SEQ ID NO: 322135 - protein, 9 aa, Homo Sapiens
AASEGDAKV

SEQ ID NO: 322136 - protein, 9 aa, Homo Sapiens
LMLPSSARP

SEQ ID NO: 322137 - protein, 9 aa, Homo Sapiens
HSAHQGRDC

SEQ ID NO: 322138 - protein, 9 aa, Homo Sapiens
PQLRKINCS

SEQ ID NO: 322139 - protein, 9 aa, Homo Sapiens
VTASSGIMI

SEQ ID NO: 322140 - protein, 9 aa, Homo Sapiens
VSAVAWAMT

SEQ ID NO: 322141 - protein, 9 aa, Homo Sapiens
RWRKEDGER

SEQ ID NO: 322142 - protein, 9 aa, Homo Sapiens
VWKRKHMDR

SEQ ID NO: 322143 - protein, 9 aa, Homo Sapiens
GHLKDGIRH

SEQ ID NO: 322144 - protein, 9 aa, Homo Sapiens
FRYNSKLSW

SEQ ID NO: 322145 - protein, 9 aa, Homo Sapiens
EPLQEHRIC

SEQ ID NO: 322146 - protein, 9 aa, Homo Sapiens
MAKERTHST

SEQ ID NO: 322147 - protein, 9 aa, Homo Sapiens
PESCVSQGK

SEQ ID NO: 322148 - protein, 9 aa, Homo Sapiens
RVTSQDPGV

SEQ ID NO: 322149 - protein, 9 aa, Homo Sapiens
LFTVTLEQA

SEQ ID NO: 322150 - protein, 9 aa, Homo Sapiens
FNVGFKEAV

SEQ ID NO: 322151 - protein, 9 aa, Homo Sapiens
ATKEVIEQE

SEQ ID NO: 322152 - protein, 9 aa, Homo Sapiens
VYGYFHRSH

SEQ ID NO: 322153 - protein, 9 aa, Homo Sapiens
WARLDHKFN

SEQ ID NO: 322154 - protein, 9 aa, Homo Sapiens
GASIPCHSP

SEQ ID NO: 322155 - protein, 9 aa, Homo Sapiens
PWPASTCPL

SEQ ID NO: 322156 - protein, 9 aa, Homo Sapiens
LRSVIFFYI

SEQ ID NO: 322157 - protein, 9 aa, Homo Sapiens
VCALEKARS

SEQ ID NO: 322158 - protein, 9 aa, Homo Sapiens
RNEGGESML

SEQ ID NO: 322159 - protein, 9 aa, Homo Sapiens
YTITEFQTT

SEQ ID NO: 322160 - protein, 9 aa, Homo Sapiens
KFNLMYAKR

SEQ ID NO: 322161 - protein, 9 aa, Homo Sapiens
AFASSTSPT

SEQ ID NO: 322162 - protein, 9 aa, Homo Sapiens
AAIFALPHF

SEQ ID NO: 322163 - protein, 9 aa, Homo Sapiens
VPASEPAAQ

SEQ ID NO: 322164 - protein, 9 aa, Homo Sapiens
CQLARHILL

SEQ ID NO: 322165 - protein, 9 aa, Homo Sapiens
VCYYQSLQA

SEQ ID NO: 322166 - protein, 9 aa, Homo Sapiens
HALATGFSP

SEQ ID NO: 322167 - protein, 9 aa, Homo Sapiens
QDGDLDVMF

SEQ ID NO: 322168 - protein, 9 aa, Homo Sapiens
KTGLRLWKV

SEQ ID NO: 322169 - protein, 9 aa, Homo Sapiens
QRVAMEFAF

SEQ ID NO: 322170 - protein, 9 aa, Homo Sapiens
TNTWDGDHI

SEQ ID NO: 322171 - protein, 9 aa, Homo Sapiens
SKEVSQQLQ

SEQ ID NO: 322172 - protein, 9 aa, Homo Sapiens
VDACIAVCS

SEQ ID NO: 322173 - protein, 9 aa, Homo Sapiens
EEMAGSAQG

SEQ ID NO: 322174 - protein, 9 aa, Homo Sapiens
KRKKQKKNS

SEQ ID NO: 322175 - protein, 9 aa, Homo Sapiens
EATPPAHHA

SEQ ID NO: 322176 - protein, 9 aa, Homo Sapiens
NFIDFGLDM

SEQ ID NO: 322177 - protein, 9 aa, Homo Sapiens
EPAAQALDT

SEQ ID NO: 322178 - protein, 9 aa, Homo Sapiens
CKVAVLIHD

SEQ ID NO: 322179 - protein, 9 aa, Homo Sapiens
AQIVCVFQG

SEQ ID NO: 322180 - protein, 9 aa, Homo Sapiens
RSKYSFIPD

SEQ ID NO: 322181 - protein, 9 aa, Homo Sapiens
DLLKELARF

SEQ ID NO: 322182 - protein, 9 aa, Homo Sapiens
ACITHWWED

SEQ ID NO: 322183 - protein, 9 aa, Homo Sapiens
QPGSCPSQH

SEQ ID NO: 322184 - protein, 9 aa, Homo Sapiens
AELAKKNRS

SEQ ID NO: 322185 - protein, 9 aa, Homo Sapiens
CDQDNLSVP

SEQ ID NO: 322186 - protein, 9 aa, Homo Sapiens
PLGSGRYKQ

SEQ ID NO: 322187 - protein, 9 aa, Homo Sapiens
AQVESKAKD

SEQ ID NO: 322188 - protein, 9 aa, Homo Sapiens
PEGKDEKSG

SEQ ID NO: 322189 - protein, 9 aa, Homo Sapiens
KGRGVIAIK

SEQ ID NO: 322190 - protein, 9 aa, Homo Sapiens
PSEHHGVRP

SEQ ID NO: 322191 - protein, 9 aa, Homo Sapiens
SQVPLIIQK

SEQ ID NO: 322192 - protein, 9 aa, Homo Sapiens
DGGGEEEEE

SEQ ID NO: 322193 - protein, 9 aa, Homo Sapiens
ESSSNTNKS

SEQ ID NO: 322194 - protein, 9 aa, Homo Sapiens
RNSLCVNGF

SEQ ID NO: 322195 - protein, 9 aa, Homo Sapiens
REQSKGRIQ

SEQ ID NO: 322196 - protein, 9 aa, Homo Sapiens
DEFFPMSHV

SEQ ID NO: 322197 - protein, 9 aa, Homo Sapiens
DRKKCTVNR

SEQ ID NO: 322198 - protein, 9 aa, Homo Sapiens
RMAIWKWHR

SEQ ID NO: 322199 - protein, 9 aa, Homo Sapiens
ELLGQCQVP

SEQ ID NO: 322200 - protein, 9 aa, Homo Sapiens
VLRMFISSR

SEQ ID NO: 322201 - protein, 9 aa, Homo Sapiens
WVSTSKHAV

SEQ ID NO: 322202 - protein, 9 aa, Homo Sapiens
WEWPHSEFA

SEQ ID NO: 322203 - protein, 9 aa, Homo Sapiens
LLHHSHLQQ

SEQ ID NO: 322204 - protein, 9 aa, Homo Sapiens
QFLHGEACP

SEQ ID NO: 322205 - protein, 9 aa, Homo Sapiens
DHHVHARII

SEQ ID NO: 322206 - protein, 9 aa, Homo Sapiens
LQDVLGIAF

SEQ ID NO: 322207 - protein, 9 aa, Homo Sapiens
DVLLNIDGI

SEQ ID NO: 322208 - protein, 9 aa, Homo Sapiens
ISTAVMTYM

SEQ ID NO: 322209 - protein, 9 aa, Homo Sapiens
GHEPQSFIH

SEQ ID NO: 322210 - protein, 9 aa, Homo Sapiens
IPEEEVRMA

SEQ ID NO: 322211 - protein, 9 aa, Homo Sapiens
LCDIEMSKE

SEQ ID NO: 322212 - protein, 9 aa, Homo Sapiens
FQSEGADTT

SEQ ID NO: 322213 - protein, 9 aa, Homo Sapiens
YQPEHIDPF

SEQ ID NO: 322214 - protein, 9 aa, Homo Sapiens
DPKTLVGLA

SEQ ID NO: 322215 - protein, 9 aa, Homo Sapiens
RAKKRCTSS

SEQ ID NO: 322216 - protein, 9 aa, Homo Sapiens
KAIGVLTSS

SEQ ID NO: 322217 - protein, 9 aa, Homo Sapiens
DPRPNGAGA

SEQ ID NO: 322218 - protein, 9 aa, Homo Sapiens
MPVIMKNSM

SEQ ID NO: 322219 - protein, 9 aa, Homo Sapiens
RRSLSSCSK

SEQ ID NO: 322220 - protein, 9 aa, Homo Sapiens
WMVSSRSSR

SEQ ID NO: 322221 - protein, 9 aa, Homo Sapiens
CTYVLHILT

SEQ ID NO: 322222 - protein, 9 aa, Homo Sapiens
HLEHLLQAK

SEQ ID NO: 322223 - protein, 9 aa, Homo Sapiens
IKLAVQMDK

SEQ ID NO: 322224 - protein, 9 aa, Homo Sapiens
DCIRMQDLD

SEQ ID NO: 322225 - protein, 9 aa, Homo Sapiens
FIWLPSNIY

SEQ ID NO: 322226 - protein, 9 aa, Homo Sapiens
ETFISGPQY

SEQ ID NO: 322227 - protein, 9 aa, Homo Sapiens
FRHKVNPNM

SEQ ID NO: 322228 - protein, 9 aa, Homo Sapiens
SFYGGHLGF

SEQ ID NO: 322229 - protein, 9 aa, Homo Sapiens
HSTDKVACL

SEQ ID NO: 322230 - protein, 9 aa, Homo Sapiens
PFDEIMGSQ

SEQ ID NO: 322231 - protein, 9 aa, Homo Sapiens
WATFARTRN

SEQ ID NO: 322232 - protein, 9 aa, Homo Sapiens
QNLLVLQIL

SEQ ID NO: 322233 - protein, 9 aa, Homo Sapiens
ASPRPMALR

SEQ ID NO: 322234 - protein, 9 aa, Homo Sapiens
WLLGLWQGV

SEQ ID NO: 322235 - protein, 9 aa, Homo Sapiens
AAEDKPWAQ

SEQ ID NO: 322236 - protein, 9 aa, Homo Sapiens
LLQLYQDFG

SEQ ID NO: 322237 - protein, 9 aa, Homo Sapiens
ASTPEGTTP

SEQ ID NO: 322238 - protein, 9 aa, Homo Sapiens
DKRLHFSVR

SEQ ID NO: 322239 - protein, 9 aa, Homo Sapiens
IYCQFDFKR

SEQ ID NO: 322240 - protein, 9 aa, Homo Sapiens
PVVTNQIEE

SEQ ID NO: 322241 - protein, 9 aa, Homo Sapiens
HQWVAICLG

SEQ ID NO: 322242 - protein, 9 aa, Homo Sapiens
GSPSRSAAC

SEQ ID NO: 322243 - protein, 9 aa, Homo Sapiens
ALSATVPHH

SEQ ID NO: 322244 - protein, 9 aa, Homo Sapiens
WQLCWKLVS

SEQ ID NO: 322245 - protein, 9 aa, Homo Sapiens
TFCFPASPG

SEQ ID NO: 322246 - protein, 9 aa, Homo Sapiens
YQLVKKYEY

SEQ ID NO: 322247 - protein, 9 aa, Homo Sapiens
SSLRRFIYQ

SEQ ID NO: 322248 - protein, 9 aa, Homo Sapiens
LRWCACPRG

SEQ ID NO: 322249 - protein, 9 aa, Homo Sapiens
PVTSPDPGE

SEQ ID NO: 322250 - protein, 9 aa, Homo Sapiens
KALELKLSM

SEQ ID NO: 322251 - protein, 9 aa, Homo Sapiens
KAKEEELCK

SEQ ID NO: 322252 - protein, 9 aa, Homo Sapiens
QEQCQAWAR

SEQ ID NO: 322253 - protein, 9 aa, Homo Sapiens
PVIVSVQYF

SEQ ID NO: 322254 - protein, 9 aa, Homo Sapiens
VSTSKHAVT

SEQ ID NO: 322255 - protein, 9 aa, Homo Sapiens
AAEDGPPVF

SEQ ID NO: 322256 - protein, 9 aa, Homo Sapiens
IPKFRPGPQ

SEQ ID NO: 322257 - protein, 9 aa, Homo Sapiens
QHKRLEDLW

SEQ ID NO: 322258 - protein, 9 aa, Homo Sapiens
QDAAQILMC

SEQ ID NO: 322259 - protein, 9 aa, Homo Sapiens
DEFLVVLCC

SEQ ID NO: 322260 - protein, 9 aa, Homo Sapiens
CQVERFIEI

SEQ ID NO: 322261 - protein, 9 aa, Homo Sapiens
GEEGGCASG

SEQ ID NO: 322262 - protein, 9 aa, Homo Sapiens
LHAALRQTE

SEQ ID NO: 322263 - protein, 9 aa, Homo Sapiens
HGSPLAEGP

SEQ ID NO: 322264 - protein, 9 aa, Homo Sapiens
ASVHSISAE

SEQ ID NO: 322265 - protein, 9 aa, Homo Sapiens
NARERLHVR

SEQ ID NO: 322266 - protein, 9 aa, Homo Sapiens
QDPCVITRK

SEQ ID NO: 322267 - protein, 9 aa, Homo Sapiens
PDESLTISS

SEQ ID NO: 322268 - protein, 9 aa, Homo Sapiens
TPIPSSSPT

SEQ ID NO: 322269 - protein, 9 aa, Homo Sapiens
WRAGFQWGE

SEQ ID NO: 322270 - protein, 9 aa, Homo Sapiens
ESQWGVQGS

SEQ ID NO: 322271 - protein, 9 aa, Homo Sapiens
EKLLGAETS

SEQ ID NO: 322272 - protein, 9 aa, Homo Sapiens
ACGGRERRD

SEQ ID NO: 322273 - protein, 9 aa, Homo Sapiens
PEGTTPPPP

SEQ ID NO: 322274 - protein, 9 aa, Homo Sapiens
STMVSPAVQ

SEQ ID NO: 322275 - protein, 9 aa, Homo Sapiens
CGEKPDMHK

SEQ ID NO: 322276 - protein, 9 aa, Homo Sapiens
PHGVVWDSK

SEQ ID NO: 322277 - protein, 9 aa, Homo Sapiens
YGFIAGVVI

SEQ ID NO: 322278 - protein, 9 aa, Homo Sapiens
DPRATALRW

SEQ ID NO: 322279 - protein, 9 aa, Homo Sapiens
KTDVATPFG

SEQ ID NO: 322280 - protein, 9 aa, Homo Sapiens
SGEEVLRKQ

SEQ ID NO: 322281 - protein, 9 aa, Homo Sapiens
AFQDSILEE

SEQ ID NO: 322282 - protein, 9 aa, Homo Sapiens
AAWGRAEPP

SEQ ID NO: 322283 - protein, 9 aa, Homo Sapiens
KVHGHSPPP

SEQ ID NO: 322284 - protein, 9 aa, Homo Sapiens
SMQTLSASL

SEQ ID NO: 322285 - protein, 9 aa, Homo Sapiens
TTVTVPGYC

SEQ ID NO: 322286 - protein, 9 aa, Homo Sapiens
YVIFAISLG

SEQ ID NO: 322287 - protein, 9 aa, Homo Sapiens
EAGATTEAQ

SEQ ID NO: 322288 - protein, 9 aa, Homo Sapiens
SQLFTSREE

SEQ ID NO: 322289 - protein, 9 aa, Homo Sapiens
NNRELLGQC

SEQ ID NO: 322290 - protein, 9 aa, Homo Sapiens
KYSLINHWR

SEQ ID NO: 322291 - protein, 9 aa, Homo Sapiens
YASRSWKLI

SEQ ID NO: 322292 - protein, 9 aa, Homo Sapiens
FCVMFLCAT

SEQ ID NO: 322293 - protein, 9 aa, Homo Sapiens
LRWLLEAGS

SEQ ID NO: 322294 - protein, 9 aa, Homo Sapiens
SKQSPLEES

SEQ ID NO: 322295 - protein, 9 aa, Homo Sapiens
FLDMLHRLG

SEQ ID NO: 322296 - protein, 9 aa, Homo Sapiens
NIPGTVVQT

SEQ ID NO: 322297 - protein, 9 aa, Homo Sapiens
LHARMEEMG

SEQ ID NO: 322298 - protein, 9 aa, Homo Sapiens
LHLKPKNHP

SEQ ID NO: 322299 - protein, 9 aa, Homo Sapiens
RLSVLNASY

SEQ ID NO: 322300 - protein, 9 aa, Homo Sapiens
DILFTFTAR

SEQ ID NO: 322301 - protein, 9 aa, Homo Sapiens
TALRWNTTY

SEQ ID NO: 322302 - protein, 9 aa, Homo Sapiens
YGLLYIYER

SEQ ID NO: 322303 - protein, 9 aa, Homo Sapiens
FLKCENMQP

SEQ ID NO: 322304 - protein, 9 aa, Homo Sapiens
WDPSACLTP

SEQ ID NO: 322305 - protein, 9 aa, Homo Sapiens
IAAKHKKNR

SEQ ID NO: 322306 - protein, 9 aa, Homo Sapiens
VQSRETLLH

SEQ ID NO: 322307 - protein, 9 aa, Homo Sapiens
AQDAAQILM

SEQ ID NO: 322308 - protein, 9 aa, Homo Sapiens
KVIAPWRTP

SEQ ID NO: 322309 - protein, 9 aa, Homo Sapiens
TFARTRNPN

SEQ ID NO: 322310 - protein, 9 aa, Homo Sapiens
YYQITGWMD

SEQ ID NO: 322311 - protein, 9 aa, Homo Sapiens
LAPTFSSLT

SEQ ID NO: 322312 - protein, 9 aa, Homo Sapiens
SLPTLAVYS

SEQ ID NO: 322313 - protein, 9 aa, Homo Sapiens
NMELIPKEF

SEQ ID NO: 322314 - protein, 9 aa, Homo Sapiens
GFFLPFVAM

SEQ ID NO: 322315 - protein, 9 aa, Homo Sapiens
PSPMGPPGL

SEQ ID NO: 322316 - protein, 9 aa, Homo Sapiens
HEVRDFAIL

SEQ ID NO: 322317 - protein, 9 aa, Homo Sapiens
LSSYSLDEP

SEQ ID NO: 322318 - protein, 9 aa, Homo Sapiens
RYKHVDWLY

SEQ ID NO: 322319 - protein, 9 aa, Homo Sapiens
PLLRDLLIC

SEQ ID NO: 322320 - protein, 9 aa, Homo Sapiens
EAATTISHQ

SEQ ID NO: 322321 - protein, 9 aa, Homo Sapiens
LSIDIYSCY

SEQ ID NO: 322322 - protein, 9 aa, Homo Sapiens
LRPLQHEQR

SEQ ID NO: 322323 - protein, 9 aa, Homo Sapiens
PRKLTVMSS

SEQ ID NO: 322324 - protein, 9 aa, Homo Sapiens
ARKEPSLLV

SEQ ID NO: 322325 - protein, 9 aa, Homo Sapiens
PTKGRFPIR

SEQ ID NO: 322326 - protein, 9 aa, Homo Sapiens
TQQNNWPPL

SEQ ID NO: 322327 - protein, 9 aa, Homo Sapiens
DTPMVRWAA

SEQ ID NO: 322328 - protein, 9 aa, Homo Sapiens
RGKCEAMLE

SEQ ID NO: 322329 - protein, 9 aa, Homo Sapiens
CGPDPKIYC

SEQ ID NO: 322330 - protein, 9 aa, Homo Sapiens
ENSMRSCRS

SEQ ID NO: 322331 - protein, 9 aa, Homo Sapiens
ALVKTWTQF

SEQ ID NO: 322332 - protein, 9 aa, Homo Sapiens
VRRGRCGKK

SEQ ID NO: 322333 - protein, 9 aa, Homo Sapiens
AQPGWPFGS

SEQ ID NO: 322334 - protein, 9 aa, Homo Sapiens
LSLDWSSTI

SEQ ID NO: 322335 - protein, 9 aa, Homo Sapiens
TPLSSPLPE

SEQ ID NO: 322336 - protein, 9 aa, Homo Sapiens
LVPRSVGVG

SEQ ID NO: 322337 - protein, 9 aa, Homo Sapiens
LLICSHLQD

SEQ ID NO: 322338 - protein, 9 aa, Homo Sapiens
MVQGPAGLP

SEQ ID NO: 322339 - protein, 9 aa, Homo Sapiens
EFSWGKNGK

SEQ ID NO: 322340 - protein, 9 aa, Homo Sapiens
RTYQTQGLL

SEQ ID NO: 322341 - protein, 9 aa, Homo Sapiens
ILAPNECLW

SEQ ID NO: 322342 - protein, 9 aa, Homo Sapiens
RNPNGNDLS

SEQ ID NO: 322343 - protein, 9 aa, Homo Sapiens
CLEENNGMD

SEQ ID NO: 322344 - protein, 9 aa, Homo Sapiens
QSTPTPMAQ

SEQ ID NO: 322345 - protein, 9 aa, Homo Sapiens
LCEWQPIGR

SEQ ID NO: 322346 - protein, 9 aa, Homo Sapiens
CQAWARAAL

SEQ ID NO: 322347 - protein, 9 aa, Homo Sapiens
SAMRVRGAQ

SEQ ID NO: 322348 - protein, 9 aa, Homo Sapiens
GQVLKFGAY

SEQ ID NO: 322349 - protein, 9 aa, Homo Sapiens
QPTGEEQAL

SEQ ID NO: 322350 - protein, 9 aa, Homo Sapiens
GGTRGTGWP

SEQ ID NO: 322351 - protein, 9 aa, Homo Sapiens
CDCHPQVCD

SEQ ID NO: 322352 - protein, 9 aa, Homo Sapiens
FQSHHEFKE

SEQ ID NO: 322353 - protein, 9 aa, Homo Sapiens
ERPPSQVPL

SEQ ID NO: 322354 - protein, 9 aa, Homo Sapiens
ERLHAALRQ

SEQ ID NO: 322355 - protein, 9 aa, Homo Sapiens
WGIILETVA

SEQ ID NO: 322356 - protein, 9 aa, Homo Sapiens
LTSSGDAQG

SEQ ID NO: 322357 - protein, 9 aa, Homo Sapiens
RLHGVPPDI

SEQ ID NO: 322358 - protein, 9 aa, Homo Sapiens
RAADGSLDM

SEQ ID NO: 322359 - protein, 9 aa, Homo Sapiens
LRLWKVDQG

SEQ ID NO: 322360 - protein, 9 aa, Homo Sapiens
SRYRVQSTQ

SEQ ID NO: 322361 - protein, 9 aa, Homo Sapiens
TRTLTGTPG

SEQ ID NO: 322362 - protein, 9 aa, Homo Sapiens
DVNSRGYPT

SEQ ID NO: 322363 - protein, 9 aa, Homo Sapiens
EECLYSQLE

SEQ ID NO: 322364 - protein, 9 aa, Homo Sapiens
FVFRVLIPQ

SEQ ID NO: 322365 - protein, 9 aa, Homo Sapiens
ACVCVCVRL

SEQ ID NO: 322366 - protein, 9 aa, Homo Sapiens
LLPTGETIY

SEQ ID NO: 322367 - protein, 9 aa, Homo Sapiens
HPLGSGRYK

SEQ ID NO: 322368 - protein, 9 aa, Homo Sapiens
GHNGYYNGH

SEQ ID NO: 322369 - protein, 9 aa, Homo Sapiens
ECLARQKEV

SEQ ID NO: 322370 - protein, 9 aa, Homo Sapiens
KRWQRSSCS

SEQ ID NO: 322371 - protein, 9 aa, Homo Sapiens
SGYIETLQR

SEQ ID NO: 322372 - protein, 9 aa, Homo Sapiens
LKDGIRHGR

SEQ ID NO: 322373 - protein, 9 aa, Homo Sapiens
GKFYSHKYS

SEQ ID NO: 322374 - protein, 9 aa, Homo Sapiens
NTWDGDHIT

SEQ ID NO: 322375 - protein, 9 aa, Homo Sapiens
VLAWSDSAQ

SEQ ID NO: 322376 - protein, 9 aa, Homo Sapiens
VSPIRSPVV

SEQ ID NO: 322377 - protein, 9 aa, Homo Sapiens
AFRLVFQQG

SEQ ID NO: 322378 - protein, 9 aa, Homo Sapiens
FFVLVNLEV

SEQ ID NO: 322379 - protein, 9 aa, Homo Sapiens
LVLVCSMAE

SEQ ID NO: 322380 - protein, 9 aa, Homo Sapiens
QEVVAASEG

SEQ ID NO: 322381 - protein, 9 aa, Homo Sapiens
ETSLGLLTT

SEQ ID NO: 322382 - protein, 9 aa, Homo Sapiens
LLTLRPRCI

SEQ ID NO: 322383 - protein, 9 aa, Homo Sapiens
GLHEDLNHI

SEQ ID NO: 322384 - protein, 9 aa, Homo Sapiens
GRPRRKGPQ

SEQ ID NO: 322385 - protein, 9 aa, Homo Sapiens
EMLEGNTIE

SEQ ID NO: 322386 - protein, 9 aa, Homo Sapiens
TQLLAQSVH

SEQ ID NO: 322387 - protein, 9 aa, Homo Sapiens
QTVLQSTPT

SEQ ID NO: 322388 - protein, 9 aa, Homo Sapiens
MDAYVKLFF

SEQ ID NO: 322389 - protein, 9 aa, Homo Sapiens
QAERSWVLS

SEQ ID NO: 322390 - protein, 9 aa, Homo Sapiens
LFTFLFLLV

SEQ ID NO: 322391 - protein, 9 aa, Homo Sapiens
CSQCHCSSI

SEQ ID NO: 322392 - protein, 9 aa, Homo Sapiens
HALKQFEER

SEQ ID NO: 322393 - protein, 9 aa, Homo Sapiens
LTKCPHCKK

SEQ ID NO: 322394 - protein, 9 aa, Homo Sapiens
RTPEFYNRF

SEQ ID NO: 322395 - protein, 9 aa, Homo Sapiens
KNGGHYMRN

SEQ ID NO: 322396 - protein, 9 aa, Homo Sapiens
NVWDFLKLY

SEQ ID NO: 322397 - protein, 9 aa, Homo Sapiens
NFCLLGSND

SEQ ID NO: 322398 - protein, 9 aa, Homo Sapiens
RRVQNILIN

SEQ ID NO: 322399 - protein, 9 aa, Homo Sapiens
GLFSYCMGN

SEQ ID NO: 322400 - protein, 9 aa, Homo Sapiens
EGKDEKSGP

SEQ ID NO: 322401 - protein, 9 aa, Homo Sapiens
LELPVCAPI

SEQ ID NO: 322402 - protein, 9 aa, Homo Sapiens
VEDVQDMSP

SEQ ID NO: 322403 - protein, 9 aa, Homo Sapiens
DVNSWPNES

SEQ ID NO: 322404 - protein, 9 aa, Homo Sapiens
GKLYPTEIR

SEQ ID NO: 322405 - protein, 9 aa, Homo Sapiens
RPVCEGTRV

SEQ ID NO: 322406 - protein, 9 aa, Homo Sapiens
AKHKKNRSP

SEQ ID NO: 322407 - protein, 9 aa, Homo Sapiens
SPGMQGSHQ

SEQ ID NO: 322408 - protein, 9 aa, Homo Sapiens
WSCPVTHTW

SEQ ID NO: 322409 - protein, 9 aa, Homo Sapiens
TKDPGRLPG

SEQ ID NO: 322410 - protein, 9 aa, Homo Sapiens
AKRLCVMGD

SEQ ID NO: 322411 - protein, 9 aa, Homo Sapiens
VRWAAASKL

SEQ ID NO: 322412 - protein, 9 aa, Homo Sapiens
VEGDYTYLQ

SEQ ID NO: 322413 - protein, 9 aa, Homo Sapiens
HRNQSERGP

SEQ ID NO: 322414 - protein, 9 aa, Homo Sapiens
GQDAYASSC

SEQ ID NO: 322415 - protein, 9 aa, Homo Sapiens
QRFANTMGL

SEQ ID NO: 322416 - protein, 9 aa, Homo Sapiens
LRRPDVLLH

SEQ ID NO: 322417 - protein, 9 aa, Homo Sapiens
AASATLSSY

SEQ ID NO: 322418 - protein, 9 aa, Homo Sapiens
ARGGAPGTK

SEQ ID NO: 322419 - protein, 9 aa, Homo Sapiens
YILDWRGMP

SEQ ID NO: 322420 - protein, 9 aa, Homo Sapiens
EDKSSSNDM

SEQ ID NO: 322421 - protein, 9 aa, Homo Sapiens
QQNNWPPLP

SEQ ID NO: 322422 - protein, 9 aa, Homo Sapiens
VVWGKLDDG

SEQ ID NO: 322423 - protein, 9 aa, Homo Sapiens
NEDKVAIKT

SEQ ID NO: 322424 - protein, 9 aa, Homo Sapiens
FHCASKANK

SEQ ID NO: 322425 - protein, 9 aa, Homo Sapiens
SEAPNLKSE

SEQ ID NO: 322426 - protein, 9 aa, Homo Sapiens
DWHQIQADS

SEQ ID NO: 322427 - protein, 9 aa, Homo Sapiens
LPPAPAPWL

SEQ ID NO: 322428 - protein, 9 aa, Homo Sapiens
LQEGEGCLG

SEQ ID NO: 322429 - protein, 9 aa, Homo Sapiens
WILRLISGG

SEQ ID NO: 322430 - protein, 9 aa, Homo Sapiens
EIQMLNNPE

SEQ ID NO: 322431 - protein, 9 aa, Homo Sapiens
VKRGDKKGK

SEQ ID NO: 322432 - protein, 9 aa, Homo Sapiens
WEFTARGGL

SEQ ID NO: 322433 - protein, 9 aa, Homo Sapiens
FSQHFYCGS

SEQ ID NO: 322434 - protein, 9 aa, Homo Sapiens
LTTVTVPGY

SEQ ID NO: 322435 - protein, 9 aa, Homo Sapiens
QLSMSSQAS

SEQ ID NO: 322436 - protein, 9 aa, Homo Sapiens
FGVVSNLVA

SEQ ID NO: 322437 - protein, 9 aa, Homo Sapiens
PCQSSTHNS

SEQ ID NO: 322438 - protein, 9 aa, Homo Sapiens
RNSQMIREE

SEQ ID NO: 322439 - protein, 9 aa, Homo Sapiens
RKQFETTAV

SEQ ID NO: 322440 - protein, 9 aa, Homo Sapiens
VRWGKYGAL

SEQ ID NO: 322441 - protein, 9 aa, Homo Sapiens
QQQQQQRPQ

SEQ ID NO: 322442 - protein, 9 aa, Homo Sapiens
EHHGPSMPT

SEQ ID NO: 322443 - protein, 9 aa, Homo Sapiens
MLEGFRRFN

SEQ ID NO: 322444 - protein, 9 aa, Homo Sapiens
GPPAQPPGL

SEQ ID NO: 322445 - protein, 9 aa, Homo Sapiens
FALSAQLCH

SEQ ID NO: 322446 - protein, 9 aa, Homo Sapiens
PPQGRNLLI

SEQ ID NO: 322447 - protein, 9 aa, Homo Sapiens
ERRDRRPGP

SEQ ID NO: 322448 - protein, 9 aa, Homo Sapiens
KPNLYSYFR

SEQ ID NO: 322449 - protein, 9 aa, Homo Sapiens
VAQADLKLL

SEQ ID NO: 322450 - protein, 9 aa, Homo Sapiens
HLGYWLNED

SEQ ID NO: 322451 - protein, 9 aa, Homo Sapiens
VYWPLRGKC

SEQ ID NO: 322452 - protein, 9 aa, Homo Sapiens
HHYELSSIQ

SEQ ID NO: 322453 - protein, 9 aa, Homo Sapiens
RGYPTLVQA

SEQ ID NO: 322454 - protein, 9 aa, Homo Sapiens
ALDFMWHQP

SEQ ID NO: 322455 - protein, 9 aa, Homo Sapiens
LWTRFCKEN

SEQ ID NO: 322456 - protein, 9 aa, Homo Sapiens
LDKLGDQTT

SEQ ID NO: 322457 - protein, 9 aa, Homo Sapiens
RPPFYHLSE

SEQ ID NO: 322458 - protein, 9 aa, Homo Sapiens
SIRSIVPAL

SEQ ID NO: 322459 - protein, 9 aa, Homo Sapiens
VVWDSKKHT

SEQ ID NO: 322460 - protein, 9 aa, Homo Sapiens
SYSGAGQLP

SEQ ID NO: 322461 - protein, 9 aa, Homo Sapiens
RPRKSHHHR

SEQ ID NO: 322462 - protein, 9 aa, Homo Sapiens
MVGDKVQLY

SEQ ID NO: 322463 - protein, 9 aa, Homo Sapiens
GRRYHSVTG

SEQ ID NO: 322464 - protein, 9 aa, Homo Sapiens
SDGVVQHEL

SEQ ID NO: 322465 - protein, 9 aa, Homo Sapiens
LSPETFALS

SEQ ID NO: 322466 - protein, 9 aa, Homo Sapiens
YSLDEPSHT

SEQ ID NO: 322467 - protein, 9 aa, Homo Sapiens
PGWPFGSTK

SEQ ID NO: 322468 - protein, 9 aa, Homo Sapiens
CSSTSFMVS

SEQ ID NO: 322469 - protein, 9 aa, Homo Sapiens
KAREAALRK

SEQ ID NO: 322470 - protein, 9 aa, Homo Sapiens
TAEESEPES

SEQ ID NO: 322471 - protein, 9 aa, Homo Sapiens
IHKCEPSKE

SEQ ID NO: 322472 - protein, 9 aa, Homo Sapiens
EKLNEHTAR

SEQ ID NO: 322473 - protein, 9 aa, Homo Sapiens
VAGAQEPGE

SEQ ID NO: 322474 - protein, 9 aa, Homo Sapiens
NMLEVADHL

SEQ ID NO: 322475 - protein, 9 aa, Homo Sapiens
HDGASRSAL

SEQ ID NO: 322476 - protein, 9 aa, Homo Sapiens
GAAHLEHLL

SEQ ID NO: 322477 - protein, 9 aa, Homo Sapiens
LDRRGGARP

SEQ ID NO: 322478 - protein, 9 aa, Homo Sapiens
LARTRTLTG

SEQ ID NO: 322479 - protein, 9 aa, Homo Sapiens
NFCKACITH

SEQ ID NO: 322480 - protein, 9 aa, Homo Sapiens
IKKWMGPGA

SEQ ID NO: 322481 - protein, 9 aa, Homo Sapiens
TAKDSSSTE

SEQ ID NO: 322482 - protein, 9 aa, Homo Sapiens
HMKVHGHSP

SEQ ID NO: 322483 - protein, 9 aa, Homo Sapiens
KVSEHPCIE

SEQ ID NO: 322484 - protein, 9 aa, Homo Sapiens
TTQISVRVL

SEQ ID NO: 322485 - protein, 9 aa, Homo Sapiens
AARKLTRER

SEQ ID NO: 322486 - protein, 9 aa, Homo Sapiens
VVKKKAYGS

SEQ ID NO: 322487 - protein, 9 aa, Homo Sapiens
RELEQQIWN

SEQ ID NO: 322488 - protein, 9 aa, Homo Sapiens
KKTTLLTLS

SEQ ID NO: 322489 - protein, 9 aa, Homo Sapiens
DAPAGCKVG

SEQ ID NO: 322490 - protein, 9 aa, Homo Sapiens
YPEECDCHP

SEQ ID NO: 322491 - protein, 9 aa, Homo Sapiens
MLFSNVPIM

SEQ ID NO: 322492 - protein, 9 aa, Homo Sapiens
HREQSQIIV

SEQ ID NO: 322493 - protein, 9 aa, Homo Sapiens
MPNPVVYYL

SEQ ID NO: 322494 - protein, 9 aa, Homo Sapiens
ICDALLITQ

SEQ ID NO: 322495 - protein, 9 aa, Homo Sapiens
VNKIVKNRQ

SEQ ID NO: 322496 - protein, 9 aa, Homo Sapiens
VPVATTLSS

SEQ ID NO: 322497 - protein, 9 aa, Homo Sapiens
LCSCHPVGS

SEQ ID NO: 322498 - protein, 9 aa, Homo Sapiens
NTAFQGSAS

SEQ ID NO: 322499 - protein, 9 aa, Homo Sapiens
MAEHGPAFC

SEQ ID NO: 322500 - protein, 9 aa, Homo Sapiens
VDIKAPDVS

SEQ ID NO: 322501 - protein, 9 aa, Homo Sapiens
GRATQLVGG

SEQ ID NO: 322502 - protein, 9 aa, Homo Sapiens
DLSISSDST

SEQ ID NO: 322503 - protein, 9 aa, Homo Sapiens
KRNEALEEE

SEQ ID NO: 322504 - protein, 9 aa, Homo Sapiens
ILKTIKSQN

SEQ ID NO: 322505 - protein, 9 aa, Homo Sapiens
AEAKGQSVG

SEQ ID NO: 322506 - protein, 9 aa, Homo Sapiens
DFLLAKVNN

SEQ ID NO: 322507 - protein, 9 aa, Homo Sapiens
AVAAAGPPG

SEQ ID NO: 322508 - protein, 9 aa, Homo Sapiens
WGSQATGPP

SEQ ID NO: 322509 - protein, 9 aa, Homo Sapiens
ASSKATDLL

SEQ ID NO: 322510 - protein, 9 aa, Homo Sapiens
NQSDTDIFP

SEQ ID NO: 322511 - protein, 9 aa, Homo Sapiens
HPGPQSVPL

SEQ ID NO: 322512 - protein, 9 aa, Homo Sapiens
LKIGLSLPP

SEQ ID NO: 322513 - protein, 9 aa, Homo Sapiens
HFPSWEMAV

SEQ ID NO: 322514 - protein, 9 aa, Homo Sapiens
PQWCAVQGQ

SEQ ID NO: 322515 - protein, 9 aa, Homo Sapiens
KMSMIVPGM

SEQ ID NO: 322516 - protein, 9 aa, Homo Sapiens
IHVRNLTIR

SEQ ID NO: 322517 - protein, 9 aa, Homo Sapiens
SFLRDYNVT

SEQ ID NO: 322518 - protein, 9 aa, Homo Sapiens
FLLVCFLFF

SEQ ID NO: 322519 - protein, 9 aa, Homo Sapiens
PPCTRLHGN

SEQ ID NO: 322520 - protein, 9 aa, Homo Sapiens
QTQQSHISS

SEQ ID NO: 322521 - protein, 9 aa, Homo Sapiens
TTPCTSSIL

SEQ ID NO: 322522 - protein, 9 aa, Homo Sapiens
RYTFYLSCK

SEQ ID NO: 322523 - protein, 9 aa, Homo Sapiens
HNLLLVRPL

SEQ ID NO: 322524 - protein, 9 aa, Homo Sapiens
LRSNLPTSS

SEQ ID NO: 322525 - protein, 9 aa, Homo Sapiens
KKPYECYKC

SEQ ID NO: 322526 - protein, 9 aa, Homo Sapiens
PSETEKDIR

SEQ ID NO: 322527 - protein, 9 aa, Homo Sapiens
GLILWTRFC

SEQ ID NO: 322528 - protein, 9 aa, Homo Sapiens
ATHVEPGQE

SEQ ID NO: 322529 - protein, 9 aa, Homo Sapiens
NQVGWKPTM

SEQ ID NO: 322530 - protein, 9 aa, Homo Sapiens
DVELVQHIC

SEQ ID NO: 322531 - protein, 9 aa, Homo Sapiens
CFPASPGPQ

SEQ ID NO: 322532 - protein, 9 aa, Homo Sapiens
PRRTEPRCC

SEQ ID NO: 322533 - protein, 9 aa, Homo Sapiens
TYMLFFINP

SEQ ID NO: 322534 - protein, 9 aa, Homo Sapiens
EQAIPLTRW

SEQ ID NO: 322535 - protein, 9 aa, Homo Sapiens
LDMKDFWPL

SEQ ID NO: 322536 - protein, 9 aa, Homo Sapiens
QLLRSCSFT

SEQ ID NO: 322537 - protein, 9 aa, Homo Sapiens
ASPQYPAIG

SEQ ID NO: 322538 - protein, 9 aa, Homo Sapiens
DVPVTVALL

SEQ ID NO: 322539 - protein, 9 aa, Homo Sapiens
EREQGAEAQ

SEQ ID NO: 322540 - protein, 9 aa, Homo Sapiens
NTVMDQKKF

SEQ ID NO: 322541 - protein, 9 aa, Homo Sapiens
PDPKIYCQF

SEQ ID NO: 322542 - protein, 9 aa, Homo Sapiens
VLYVVRSVC

SEQ ID NO: 322543 - protein, 9 aa, Homo Sapiens
CFRPMQMAL

SEQ ID NO: 322544 - protein, 9 aa, Homo Sapiens
LATHVEPGQ

SEQ ID NO: 322545 - protein, 9 aa, Homo Sapiens
TCENSVLEV

SEQ ID NO: 322546 - protein, 9 aa, Homo Sapiens
GICACTNNG

SEQ ID NO: 322547 - protein, 9 aa, Homo Sapiens
APDACKLCS

SEQ ID NO: 322548 - protein, 9 aa, Homo Sapiens
TNYIHVPPG

SEQ ID NO: 322549 - protein, 9 aa, Homo Sapiens
CLSHDSAAT

SEQ ID NO: 322550 - protein, 9 aa, Homo Sapiens
CQDNESETG

SEQ ID NO: 322551 - protein, 9 aa, Homo Sapiens
LFEELMTTL

SEQ ID NO: 322552 - protein, 9 aa, Homo Sapiens
LFFINPGED

SEQ ID NO: 322553 - protein, 9 aa, Homo Sapiens
ASSSQLSMS

SEQ ID NO: 322554 - protein, 9 aa, Homo Sapiens
GGGLALSAF

SEQ ID NO: 322555 - protein, 9 aa, Homo Sapiens
SCMKGGTDM

SEQ ID NO: 322556 - protein, 9 aa, Homo Sapiens
GDKGLKKMT

SEQ ID NO: 322557 - protein, 9 aa, Homo Sapiens
DSLETAAKS

SEQ ID NO: 322558 - protein, 9 aa, Homo Sapiens
YHSVTGLVV

SEQ ID NO: 322559 - protein, 9 aa, Homo Sapiens
WCMSLRPSE

SEQ ID NO: 322560 - protein, 9 aa, Homo Sapiens
SRFTRLSMT

SEQ ID NO: 322561 - protein, 9 aa, Homo Sapiens
PPPHMCCES

SEQ ID NO: 322562 - protein, 9 aa, Homo Sapiens
WAHFGLPSV

SEQ ID NO: 322563 - protein, 9 aa, Homo Sapiens
PMPWQRVDR

SEQ ID NO: 322564 - protein, 9 aa, Homo Sapiens
PKIYCQFDF

SEQ ID NO: 322565 - protein, 9 aa, Homo Sapiens
PEGDGNWTN

SEQ ID NO: 322566 - protein, 9 aa, Homo Sapiens
TVCWLGLED

SEQ ID NO: 322567 - protein, 9 aa, Homo Sapiens
SEDSYNGWG

SEQ ID NO: 322568 - protein, 9 aa, Homo Sapiens
LSPRTLPCR

SEQ ID NO: 322569 - protein, 9 aa, Homo Sapiens
AILPFYVTL

SEQ ID NO: 322570 - protein, 9 aa, Homo Sapiens
QLMSCIALS

SEQ ID NO: 322571 - protein, 9 aa, Homo Sapiens
EPALAPPEP

SEQ ID NO: 322572 - protein, 9 aa, Homo Sapiens
CLRSLDIRC

SEQ ID NO: 322573 - protein, 9 aa, Homo Sapiens
CQQLIRWCM

SEQ ID NO: 322574 - protein, 9 aa, Homo Sapiens
FGNFIWLPS

SEQ ID NO: 322575 - protein, 9 aa, Homo Sapiens
PLLRCSDAW

SEQ ID NO: 322576 - protein, 9 aa, Homo Sapiens
KISVLEPLQ

SEQ ID NO: 322577 - protein, 9 aa, Homo Sapiens
SSHCSCGDG

SEQ ID NO: 322578 - protein, 9 aa, Homo Sapiens
WPPGDEEEG

SEQ ID NO: 322579 - protein, 9 aa, Homo Sapiens
GEESSSNTN

SEQ ID NO: 322580 - protein, 9 aa, Homo Sapiens
PGRLPGRPA

SEQ ID NO: 322581 - protein, 9 aa, Homo Sapiens
SALSSAAAS

SEQ ID NO: 322582 - protein, 9 aa, Homo Sapiens
VTHTWEKIY

SEQ ID NO: 322583 - protein, 9 aa, Homo Sapiens
NRLQADHIC

SEQ ID NO: 322584 - protein, 9 aa, Homo Sapiens
NLPSITLGN

SEQ ID NO: 322585 - protein, 9 aa, Homo Sapiens
CHEHGPRSS

SEQ ID NO: 322586 - protein, 9 aa, Homo Sapiens
FYGAKPPIA

SEQ ID NO: 322587 - protein, 9 aa, Homo Sapiens
GKAAQMARV

SEQ ID NO: 322588 - protein, 9 aa, Homo Sapiens
VFVLEYLRL

SEQ ID NO: 322589 - protein, 9 aa, Homo Sapiens
VQSNPDPVA

SEQ ID NO: 322590 - protein, 9 aa, Homo Sapiens
MKSLFNRAE

SEQ ID NO: 322591 - protein, 9 aa, Homo Sapiens
TPPAWPSSS

SEQ ID NO: 322592 - protein, 9 aa, Homo Sapiens
KVPKYQDAA

SEQ ID NO: 322593 - protein, 9 aa, Homo Sapiens
LNHIQNKPY

SEQ ID NO: 322594 - protein, 9 aa, Homo Sapiens
MMHIATTLI

SEQ ID NO: 322595 - protein, 9 aa, Homo Sapiens
MQGRYGSSD

SEQ ID NO: 322596 - protein, 9 aa, Homo Sapiens
DVLCRTASI

SEQ ID NO: 322597 - protein, 9 aa, Homo Sapiens
MVSWPSRLG

SEQ ID NO: 322598 - protein, 9 aa, Homo Sapiens
GGGQKLLMR

SEQ ID NO: 322599 - protein, 9 aa, Homo Sapiens
LGGTATQQN

SEQ ID NO: 322600 - protein, 9 aa, Homo Sapiens
NWLLQEENR

SEQ ID NO: 322601 - protein, 9 aa, Homo Sapiens
AGILCVDDQ

SEQ ID NO: 322602 - protein, 9 aa, Homo Sapiens
AISKGYVQI

SEQ ID NO: 322603 - protein, 9 aa, Homo Sapiens
AFVKVAEAL

SEQ ID NO: 322604 - protein, 9 aa, Homo Sapiens
FKHIGDEGA

SEQ ID NO: 322605 - protein, 9 aa, Homo Sapiens
MLVVQLEVL

SEQ ID NO: 322606 - protein, 9 aa, Homo Sapiens
CASKANKKP

SEQ ID NO: 322607 - protein, 9 aa, Homo Sapiens
GPQVSSQVV

SEQ ID NO: 322608 - protein, 9 aa, Homo Sapiens
LAPGKTQFI

SEQ ID NO: 322609 - protein, 9 aa, Homo Sapiens
VWQHVAQIR

SEQ ID NO: 322610 - protein, 9 aa, Homo Sapiens
RQEESQWPI

SEQ ID NO: 322611 - protein, 9 aa, Homo Sapiens
QPEHIDPFT

SEQ ID NO: 322612 - protein, 9 aa, Homo Sapiens
NAWHKVFIN

SEQ ID NO: 322613 - protein, 9 aa, Homo Sapiens
TTGAISYTV

SEQ ID NO: 322614 - protein, 9 aa, Homo Sapiens
FCVALRPRP

SEQ ID NO: 322615 - protein, 9 aa, Homo Sapiens
WPFVVSGRL

SEQ ID NO: 322616 - protein, 9 aa, Homo Sapiens
WGDVPIIAM

SEQ ID NO: 322617 - protein, 9 aa, Homo Sapiens
HRLLHCTER

SEQ ID NO: 322618 - protein, 9 aa, Homo Sapiens
LKPSISPPK

SEQ ID NO: 322619 - protein, 9 aa, Homo Sapiens
LLRTSVMVK

SEQ ID NO: 322620 - protein, 9 aa, Homo Sapiens
AGFEKLCRT

SEQ ID NO: 322621 - protein, 9 aa, Homo Sapiens
SLHTIAVVL

SEQ ID NO: 322622 - protein, 9 aa, Homo Sapiens
AQAAEEGGA

SEQ ID NO: 322623 - protein, 9 aa, Homo Sapiens
AIAKIRSYN

SEQ ID NO: 322624 - protein, 9 aa, Homo Sapiens
IMPLHAASL

SEQ ID NO: 322625 - protein, 9 aa, Homo Sapiens
GGHLCLPRS

SEQ ID NO: 322626 - protein, 9 aa, Homo Sapiens
TKRKRPLEE

SEQ ID NO: 322627 - protein, 9 aa, Homo Sapiens
ISSLWNELD

SEQ ID NO: 322628 - protein, 9 aa, Homo Sapiens
WILQDVLGI

SEQ ID NO: 322629 - protein, 9 aa, Homo Sapiens
QGRDCRCGE

SEQ ID NO: 322630 - protein, 9 aa, Homo Sapiens
HSVQCWMPP

SEQ ID NO: 322631 - protein, 9 aa, Homo Sapiens
ITTLKGKVI

SEQ ID NO: 322632 - protein, 9 aa, Homo Sapiens
DFSFCLTGE

SEQ ID NO: 322633 - protein, 9 aa, Homo Sapiens
LQLQEVQGQ

SEQ ID NO: 322634 - protein, 9 aa, Homo Sapiens
MIREELGRN

SEQ ID NO: 322635 - protein, 9 aa, Homo Sapiens
GSPGSAAWG

SEQ ID NO: 322636 - protein, 9 aa, Homo Sapiens
GGVYQQARK

SEQ ID NO: 322637 - protein, 9 aa, Homo Sapiens
ACVTLVSVR

SEQ ID NO: 322638 - protein, 9 aa, Homo Sapiens
THTWEKIYA

SEQ ID NO: 322639 - protein, 9 aa, Homo Sapiens
GLYGLLYIY

SEQ ID NO: 322640 - protein, 9 aa, Homo Sapiens
LFNKKENTL

SEQ ID NO: 322641 - protein, 9 aa, Homo Sapiens
YWIFRSWGH

SEQ ID NO: 322642 - protein, 9 aa, Homo Sapiens
TYEYTWGEL

SEQ ID NO: 322643 - protein, 9 aa, Homo Sapiens
ERGRQDPTS

SEQ ID NO: 322644 - protein, 9 aa, Homo Sapiens
HGDVNSRGY

SEQ ID NO: 322645 - protein, 9 aa, Homo Sapiens
PSMGTLVGV

SEQ ID NO: 322646 - protein, 9 aa, Homo Sapiens
PLGGHTVWR

SEQ ID NO: 322647 - protein, 9 aa, Homo Sapiens
VLGETVALK

SEQ ID NO: 322648 - protein, 9 aa, Homo Sapiens
KAYFQMRRT

SEQ ID NO: 322649 - protein, 9 aa, Homo Sapiens
KVVVLGETV

SEQ ID NO: 322650 - protein, 9 aa, Homo Sapiens
RRNFSRQSS

SEQ ID NO: 322651 - protein, 9 aa, Homo Sapiens
TAIIQLKTN

SEQ ID NO: 322652 - protein, 9 aa, Homo Sapiens
NTPLHCAAA

SEQ ID NO: 322653 - protein, 9 aa, Homo Sapiens
KNGERIEKS

SEQ ID NO: 322654 - protein, 9 aa, Homo Sapiens
KGGPGPHGP

SEQ ID NO: 322655 - protein, 9 aa, Homo Sapiens
QQQLQVQHL

SEQ ID NO: 322656 - protein, 9 aa, Homo Sapiens
LSSQTPGHS

SEQ ID NO: 322657 - protein, 9 aa, Homo Sapiens
QTLSASLSG

SEQ ID NO: 322658 - protein, 9 aa, Homo Sapiens
RITADVAHF

SEQ ID NO: 322659 - protein, 9 aa, Homo Sapiens
SDPVTLYGS

SEQ ID NO: 322660 - protein, 9 aa, Homo Sapiens
QHMAMKSLF

SEQ ID NO: 322661 - protein, 9 aa, Homo Sapiens
AEHPKPDVA

SEQ ID NO: 322662 - protein, 9 aa, Homo Sapiens
KISRGYEPK

SEQ ID NO: 322663 - protein, 9 aa, Homo Sapiens
SESSTLLHH

SEQ ID NO: 322664 - protein, 9 aa, Homo Sapiens
TQEQERILY

SEQ ID NO: 322665 - protein, 9 aa, Homo Sapiens
LCAGEEGSH

SEQ ID NO: 322666 - protein, 9 aa, Homo Sapiens
GRYHVLFLR

SEQ ID NO: 322667 - protein, 9 aa, Homo Sapiens
MGKPEVGRL

SEQ ID NO: 322668 - protein, 9 aa, Homo Sapiens
LGDLLQGVL

SEQ ID NO: 322669 - protein, 9 aa, Homo Sapiens
IVKCQGQQE

SEQ ID NO: 322670 - protein, 9 aa, Homo Sapiens
GSTGIICLA

SEQ ID NO: 322671 - protein, 9 aa, Homo Sapiens
GKIVALDFF

SEQ ID NO: 322672 - protein, 9 aa, Homo Sapiens
KENMRMGNL

SEQ ID NO: 322673 - protein, 9 aa, Homo Sapiens
TVLQSTPTP

SEQ ID NO: 322674 - protein, 9 aa, Homo Sapiens
YHCDWSLLS

SEQ ID NO: 322675 - protein, 9 aa, Homo Sapiens
DAWRDLELA

SEQ ID NO: 322676 - protein, 9 aa, Homo Sapiens
CGKAFSLAS

SEQ ID NO: 322677 - protein, 9 aa, Homo Sapiens
ADAVVTFLQ

SEQ ID NO: 322678 - protein, 9 aa, Homo Sapiens
QAWHAGQTI

SEQ ID NO: 322679 - protein, 9 aa, Homo Sapiens
VLLLTSMAY

SEQ ID NO: 322680 - protein, 9 aa, Homo Sapiens
KIGEIATGP

SEQ ID NO: 322681 - protein, 9 aa, Homo Sapiens
ASEDTPKSV

SEQ ID NO: 322682 - protein, 9 aa, Homo Sapiens
SHCKKDIDE

SEQ ID NO: 322683 - protein, 9 aa, Homo Sapiens
FSSLTSIST

SEQ ID NO: 322684 - protein, 9 aa, Homo Sapiens
TCYLFRMRA

SEQ ID NO: 322685 - protein, 9 aa, Homo Sapiens
KVTSWWTFR

SEQ ID NO: 322686 - protein, 9 aa, Homo Sapiens
SSENSCTEM

SEQ ID NO: 322687 - protein, 9 aa, Homo Sapiens
KGKDRYCSN

SEQ ID NO: 322688 - protein, 9 aa, Homo Sapiens
AFCDTQSTQ

SEQ ID NO: 322689 - protein, 9 aa, Homo Sapiens
KGCLLCTYV

SEQ ID NO: 322690 - protein, 9 aa, Homo Sapiens
NRCTLATLI

SEQ ID NO: 322691 - protein, 9 aa, Homo Sapiens
TCSPHLSVL

SEQ ID NO: 322692 - protein, 9 aa, Homo Sapiens
TMLRNKIVH

SEQ ID NO: 322693 - protein, 9 aa, Homo Sapiens
DFDYPQNSE

SEQ ID NO: 322694 - protein, 9 aa, Homo Sapiens
MGLCFYLGT

SEQ ID NO: 322695 - protein, 9 aa, Homo Sapiens
RFYDEYCSN

SEQ ID NO: 322696 - protein, 9 aa, Homo Sapiens
GAVFEMLEG

SEQ ID NO: 322697 - protein, 9 aa, Homo Sapiens
NKKNTPLHC

SEQ ID NO: 322698 - protein, 9 aa, Homo Sapiens
RLVLSSLPV

SEQ ID NO: 322699 - protein, 9 aa, Homo Sapiens
CALEKARSS

SEQ ID NO: 322700 - protein, 9 aa, Homo Sapiens
EHLARDVMK

SEQ ID NO: 322701 - protein, 9 aa, Homo Sapiens
APPRARPGT

SEQ ID NO: 322702 - protein, 9 aa, Homo Sapiens
LTAMKVPIA

SEQ ID NO: 322703 - protein, 9 aa, Homo Sapiens
GLPVTLTCQ

SEQ ID NO: 322704 - protein, 9 aa, Homo Sapiens
INQFFVAIF

SEQ ID NO: 322705 - protein, 9 aa, Homo Sapiens
GETQEQERI

SEQ ID NO: 322706 - protein, 9 aa, Homo Sapiens
FTVTPDRVD

SEQ ID NO: 322707 - protein, 9 aa, Homo Sapiens
PPRATGVSF

SEQ ID NO: 322708 - protein, 9 aa, Homo Sapiens
HKKNRSPGS

SEQ ID NO: 322709 - protein, 9 aa, Homo Sapiens
FIIVFGELL

SEQ ID NO: 322710 - protein, 9 aa, Homo Sapiens
ERAHIEKAY

SEQ ID NO: 322711 - protein, 9 aa, Homo Sapiens
GGPQKLVCI

SEQ ID NO: 322712 - protein, 9 aa, Homo Sapiens
WRVACTCPN

SEQ ID NO: 322713 - protein, 9 aa, Homo Sapiens
SQSGHTSFF

SEQ ID NO: 322714 - protein, 9 aa, Homo Sapiens
FTFTARVLG

SEQ ID NO: 322715 - protein, 9 aa, Homo Sapiens
VNQTFEELT

SEQ ID NO: 322716 - protein, 9 aa, Homo Sapiens
EHGEAHMSP

SEQ ID NO: 322717 - protein, 9 aa, Homo Sapiens
LRTDRGTVQ

SEQ ID NO: 322718 - protein, 9 aa, Homo Sapiens
IWLLILSYV

SEQ ID NO: 322719 - protein, 9 aa, Homo Sapiens
HQQLEAVYK

SEQ ID NO: 322720 - protein, 9 aa, Homo Sapiens
EPDVDACIA

SEQ ID NO: 322721 - protein, 9 aa, Homo Sapiens
NLGFKHIGD

SEQ ID NO: 322722 - protein, 9 aa, Homo Sapiens
VALPSDGRD

SEQ ID NO: 322723 - protein, 9 aa, Homo Sapiens
KLVVVGAGD

SEQ ID NO: 322724 - protein, 9 aa, Homo Sapiens
GKRIAQASR

SEQ ID NO: 322725 - protein, 9 aa, Homo Sapiens
DPLLRDVWL

SEQ ID NO: 322726 - protein, 9 aa, Homo Sapiens
PILLDNFST

SEQ ID NO: 322727 - protein, 9 aa, Homo Sapiens
PQPQRPHDG

SEQ ID NO: 322728 - protein, 9 aa, Homo Sapiens
VNEPLKTHR

SEQ ID NO: 322729 - protein, 9 aa, Homo Sapiens
ENSTKILKT

SEQ ID NO: 322730 - protein, 9 aa, Homo Sapiens
PPRPLQRVR

SEQ ID NO: 322731 - protein, 9 aa, Homo Sapiens
DKRCGRDPE

SEQ ID NO: 322732 - protein, 9 aa, Homo Sapiens
QCFGKKTSA

SEQ ID NO: 322733 - protein, 9 aa, Homo Sapiens
MDCVTMDNL

SEQ ID NO: 322734 - protein, 9 aa, Homo Sapiens
QEWLNKHSI

SEQ ID NO: 322735 - protein, 9 aa, Homo Sapiens
WGHVGTVIG

SEQ ID NO: 322736 - protein, 9 aa, Homo Sapiens
RCECLGPLR

SEQ ID NO: 322737 - protein, 9 aa, Homo Sapiens
WSSTIASDH

SEQ ID NO: 322738 - protein, 9 aa, Homo Sapiens
CYLFRMRAS

SEQ ID NO: 322739 - protein, 9 aa, Homo Sapiens
MPRSSSHCS

SEQ ID NO: 322740 - protein, 9 aa, Homo Sapiens
KTTWLEGSC

SEQ ID NO: 322741 - protein, 9 aa, Homo Sapiens
EDIVTVQIE

SEQ ID NO: 322742 - protein, 9 aa, Homo Sapiens
SQRLHWETP

SEQ ID NO: 322743 - protein, 9 aa, Homo Sapiens
EVQGQAGDG

SEQ ID NO: 322744 - protein, 9 aa, Homo Sapiens
QWKLDPLLL

SEQ ID NO: 322745 - protein, 9 aa, Homo Sapiens
MIKSSHPLR

SEQ ID NO: 322746 - protein, 9 aa, Homo Sapiens
VFNPSILHY

SEQ ID NO: 322747 - protein, 9 aa, Homo Sapiens
GTASGLCSN

SEQ ID NO: 322748 - protein, 9 aa, Homo Sapiens
GEVGDDGDS

SEQ ID NO: 322749 - protein, 9 aa, Homo Sapiens
LALVYQDQN

SEQ ID NO: 322750 - protein, 9 aa, Homo Sapiens
KPLQTVRLM

SEQ ID NO: 322751 - protein, 9 aa, Homo Sapiens
PGKLDKDPL

SEQ ID NO: 322752 - protein, 9 aa, Homo Sapiens
KLQKVLLCC

SEQ ID NO: 322753 - protein, 9 aa, Homo Sapiens
HWDPSACLT

SEQ ID NO: 322754 - protein, 9 aa, Homo Sapiens
RFDPMAFVK

SEQ ID NO: 322755 - protein, 9 aa, Homo Sapiens
CYSKKKYVC

SEQ ID NO: 322756 - protein, 9 aa, Homo Sapiens
TLSASLSGS

SEQ ID NO: 322757 - protein, 9 aa, Homo Sapiens
SIPLLLLLP

SEQ ID NO: 322758 - protein, 9 aa, Homo Sapiens
VVYYLHHSP

SEQ ID NO: 322759 - protein, 9 aa, Homo Sapiens
FIPEEEVRM

SEQ ID NO: 322760 - protein, 9 aa, Homo Sapiens
RLVPDQEDA

SEQ ID NO: 322761 - protein, 9 aa, Homo Sapiens
SPGMLSIGS

SEQ ID NO: 322762 - protein, 9 aa, Homo Sapiens
DWDHSGTLG

SEQ ID NO: 322763 - protein, 9 aa, Homo Sapiens
LRPMCPPPP

SEQ ID NO: 322764 - protein, 9 aa, Homo Sapiens
EQCNIMRLV

SEQ ID NO: 322765 - protein, 9 aa, Homo Sapiens
QHGSGSSWS

SEQ ID NO: 322766 - protein, 9 aa, Homo Sapiens
TVPCTILAP

SEQ ID NO: 322767 - protein, 9 aa, Homo Sapiens
NSIVEKVQV

SEQ ID NO: 322768 - protein, 9 aa, Homo Sapiens
RHPVLRAEF

SEQ ID NO: 322769 - protein, 9 aa, Homo Sapiens
TTLITETPD

SEQ ID NO: 322770 - protein, 9 aa, Homo Sapiens
RHLKCPVWI

SEQ ID NO: 322771 - protein, 9 aa, Homo Sapiens
RRASSKATD

SEQ ID NO: 322772 - protein, 9 aa, Homo Sapiens
GVVIHMRSV

SEQ ID NO: 322773 - protein, 9 aa, Homo Sapiens
KKLHTEVIQ

SEQ ID NO: 322774 - protein, 9 aa, Homo Sapiens
PLLLVFVTK

SEQ ID NO: 322775 - protein, 9 aa, Homo Sapiens
CDFWLLSDI

SEQ ID NO: 322776 - protein, 9 aa, Homo Sapiens
GNELKSEWE

SEQ ID NO: 322777 - protein, 9 aa, Homo Sapiens
ERRPCWSFP

SEQ ID NO: 322778 - protein, 9 aa, Homo Sapiens
NMVDMDLPP

SEQ ID NO: 322779 - protein, 9 aa, Homo Sapiens
AFGAAIFAL

SEQ ID NO: 322780 - protein, 9 aa, Homo Sapiens
SSGASVTMQ

SEQ ID NO: 322781 - protein, 9 aa, Homo Sapiens
RRELAHLED

SEQ ID NO: 322782 - protein, 9 aa, Homo Sapiens
SQMTHVRPG

SEQ ID NO: 322783 - protein, 9 aa, Homo Sapiens
VQITVVGNE

SEQ ID NO: 322784 - protein, 9 aa, Homo Sapiens
HVAWAADAQ

SEQ ID NO: 322785 - protein, 9 aa, Homo Sapiens
RRWKDSWKQ

SEQ ID NO: 322786 - protein, 9 aa, Homo Sapiens
ALARDAALI

SEQ ID NO: 322787 - protein, 9 aa, Homo Sapiens
ADCVSEDDT

SEQ ID NO: 322788 - protein, 9 aa, Homo Sapiens
FIALNMVHK

SEQ ID NO: 322789 - protein, 9 aa, Homo Sapiens
SWPSRLGSR

SEQ ID NO: 322790 - protein, 9 aa, Homo Sapiens
LQVFQGHKK

SEQ ID NO: 322791 - protein, 9 aa, Homo Sapiens
ECYKCGKSF

SEQ ID NO: 322792 - protein, 9 aa, Homo Sapiens
GLKKMTLKA

SEQ ID NO: 322793 - protein, 9 aa, Homo Sapiens
MKNSMYIHK

SEQ ID NO: 322794 - protein, 9 aa, Homo Sapiens
YQIIHTGAK

SEQ ID NO: 322795 - protein, 9 aa, Homo Sapiens
FNKRAEMQM

SEQ ID NO: 322796 - protein, 9 aa, Homo Sapiens
RKAQTGLSL

SEQ ID NO: 322797 - protein, 9 aa, Homo Sapiens
SSKPTNGTK

SEQ ID NO: 322798 - protein, 9 aa, Homo Sapiens
GNPVVTNQI

SEQ ID NO: 322799 - protein, 9 aa, Homo Sapiens
QGQAGDGER

SEQ ID NO: 322800 - protein, 9 aa, Homo Sapiens
EDVNSWPNE

SEQ ID NO: 322801 - protein, 9 aa, Homo Sapiens
ECLIQSHPE

SEQ ID NO: 322802 - protein, 9 aa, Homo Sapiens
EISSLWNEL

SEQ ID NO: 322803 - protein, 9 aa, Homo Sapiens
NTERVKSKD

SEQ ID NO: 322804 - protein, 9 aa, Homo Sapiens
GHPLEVGLV

SEQ ID NO: 322805 - protein, 9 aa, Homo Sapiens
ESYSMYVYK

SEQ ID NO: 322806 - protein, 9 aa, Homo Sapiens
QADLKLLGS

SEQ ID NO: 322807 - protein, 9 aa, Homo Sapiens
ENNGMDKRV

SEQ ID NO: 322808 - protein, 9 aa, Homo Sapiens
EEAEEERRG

SEQ ID NO: 322809 - protein, 9 aa, Homo Sapiens
AKSRSKRKK

SEQ ID NO: 322810 - protein, 9 aa, Homo Sapiens
LSNSRDFLL

SEQ ID NO: 322811 - protein, 9 aa, Homo Sapiens
EAVDTSIKG

SEQ ID NO: 322812 - protein, 9 aa, Homo Sapiens
SHHAAVGVL

SEQ ID NO: 322813 - protein, 9 aa, Homo Sapiens
LLAILPFYV

SEQ ID NO: 322814 - protein, 9 aa, Homo Sapiens
RKRAEFDIH

SEQ ID NO: 322815 - protein, 9 aa, Homo Sapiens
VYLRIYVYI

SEQ ID NO: 322816 - protein, 9 aa, Homo Sapiens
HLRGGGGSP

SEQ ID NO: 322817 - protein, 9 aa, Homo Sapiens
EWHGWMVSS

SEQ ID NO: 322818 - protein, 9 aa, Homo Sapiens
LESCTVRPD

SEQ ID NO: 322819 - protein, 9 aa, Homo Sapiens
QLFTSREEV

SEQ ID NO: 322820 - protein, 9 aa, Homo Sapiens
VIHHDLKPS

SEQ ID NO: 322821 - protein, 9 aa, Homo Sapiens
PGPLQADLH

SEQ ID NO: 322822 - protein, 9 aa, Homo Sapiens
RVVFLWDLG

SEQ ID NO: 322823 - protein, 9 aa, Homo Sapiens
CCGNGVVER

SEQ ID NO: 322824 - protein, 9 aa, Homo Sapiens
LGPAVRPMP

SEQ ID NO: 322825 - protein, 9 aa, Homo Sapiens
RIFGSYDPQ

SEQ ID NO: 322826 - protein, 9 aa, Homo Sapiens
HSLCEWQPI

SEQ ID NO: 322827 - protein, 9 aa, Homo Sapiens
IGVILCRSV

SEQ ID NO: 322828 - protein, 9 aa, Homo Sapiens
KKKDDIQEE

SEQ ID NO: 322829 - protein, 9 aa, Homo Sapiens
TMQPTEFKI

SEQ ID NO: 322830 - protein, 9 aa, Homo Sapiens
IKVIAPWRT

SEQ ID NO: 322831 - protein, 9 aa, Homo Sapiens
APELWRWHA

SEQ ID NO: 322832 - protein, 9 aa, Homo Sapiens
VSLKPPATP

SEQ ID NO: 322833 - protein, 9 aa, Homo Sapiens
RPNGAGACC

SEQ ID NO: 322834 - protein, 9 aa, Homo Sapiens
ILETVATAG

SEQ ID NO: 322835 - protein, 9 aa, Homo Sapiens
QFQGGGLAL

SEQ ID NO: 322836 - protein, 9 aa, Homo Sapiens
ASSRPPTGL

SEQ ID NO: 322837 - protein, 9 aa, Homo Sapiens
ATFARTRNP

SEQ ID NO: 322838 - protein, 9 aa, Homo Sapiens
QPHRSFFES

SEQ ID NO: 322839 - protein, 9 aa, Homo Sapiens
LALQHPQRL

SEQ ID NO: 322840 - protein, 9 aa, Homo Sapiens
KVNNAENAA

SEQ ID NO: 322841 - protein, 9 aa, Homo Sapiens
CNIALCPDR

SEQ ID NO: 322842 - protein, 9 aa, Homo Sapiens
SRHGTHGGL

SEQ ID NO: 322843 - protein, 9 aa, Homo Sapiens
HRHPVLRAE

SEQ ID NO: 322844 - protein, 9 aa, Homo Sapiens
NVQNYKIGP

SEQ ID NO: 322845 - protein, 9 aa, Homo Sapiens
FLCATEWLT

SEQ ID NO: 322846 - protein, 9 aa, Homo Sapiens
NCILILLPM

SEQ ID NO: 322847 - protein, 9 aa, Homo Sapiens
KNGFDFVIN

SEQ ID NO: 322848 - protein, 9 aa, Homo Sapiens
GHTSTVHCM

SEQ ID NO: 322849 - protein, 9 aa, Homo Sapiens
RKELSNLTD

SEQ ID NO: 322850 - protein, 9 aa, Homo Sapiens
LLCTAQPDL

SEQ ID NO: 322851 - protein, 9 aa, Homo Sapiens
VVSNLVAIV

SEQ ID NO: 322852 - protein, 9 aa, Homo Sapiens
SQNRTCSFG

SEQ ID NO: 322853 - protein, 9 aa, Homo Sapiens
FMWHQPYQL

SEQ ID NO: 322854 - protein, 9 aa, Homo Sapiens
GGAKGTKLD

SEQ ID NO: 322855 - protein, 9 aa, Homo Sapiens
VPSSSLSPD

SEQ ID NO: 322856 - protein, 9 aa, Homo Sapiens
SARLPPGLR

SEQ ID NO: 322857 - protein, 9 aa, Homo Sapiens
VSVLVSGQA

SEQ ID NO: 322858 - protein, 9 aa, Homo Sapiens
FAGTGKTSM

SEQ ID NO: 322859 - protein, 9 aa, Homo Sapiens
SATEIMAVL

SEQ ID NO: 322860 - protein, 9 aa, Homo Sapiens
MLRNKIVHF

SEQ ID NO: 322861 - protein, 9 aa, Homo Sapiens
AKGTKLDDD

SEQ ID NO: 322862 - protein, 9 aa, Homo Sapiens
SRISRELEP

SEQ ID NO: 322863 - protein, 9 aa, Homo Sapiens
DGKVSPGML

SEQ ID NO: 322864 - protein, 9 aa, Homo Sapiens
WMFQSPRRC

SEQ ID NO: 322865 - protein, 9 aa, Homo Sapiens
EPRCCSGLG

SEQ ID NO: 322866 - protein, 9 aa, Homo Sapiens
AALREWLGR

SEQ ID NO: 322867 - protein, 9 aa, Homo Sapiens
LLERPGPAG

SEQ ID NO: 322868 - protein, 9 aa, Homo Sapiens
EDVKMVVCR

SEQ ID NO: 322869 - protein, 9 aa, Homo Sapiens
SFYEWGVAV

SEQ ID NO: 322870 - protein, 9 aa, Homo Sapiens
IHLVMIQLL

SEQ ID NO: 322871 - protein, 9 aa, Homo Sapiens
VCLLRPSDD

SEQ ID NO: 322872 - protein, 9 aa, Homo Sapiens
FWQACDMVH

SEQ ID NO: 322873 - protein, 9 aa, Homo Sapiens
IKDKCSCCY

SEQ ID NO: 322874 - protein, 9 aa, Homo Sapiens
ATKNEKFHM

SEQ ID NO: 322875 - protein, 9 aa, Homo Sapiens
FLAQLKERR

SEQ ID NO: 322876 - protein, 9 aa, Homo Sapiens
LQKVLLCCE

SEQ ID NO: 322877 - protein, 9 aa, Homo Sapiens
FLTTVTVPG

SEQ ID NO: 322878 - protein, 9 aa, Homo Sapiens
RELERLHAA

SEQ ID NO: 322879 - protein, 9 aa, Homo Sapiens
DRYVVICHP

SEQ ID NO: 322880 - protein, 9 aa, Homo Sapiens
CATEWLTLG

SEQ ID NO: 322881 - protein, 9 aa, Homo Sapiens
HWTYEYTWG

SEQ ID NO: 322882 - protein, 9 aa, Homo Sapiens
RKLMAQVNQ

SEQ ID NO: 322883 - protein, 9 aa, Homo Sapiens
RLWRVACTC

SEQ ID NO: 322884 - protein, 9 aa, Homo Sapiens
QVQEAVSRV

SEQ ID NO: 322885 - protein, 9 aa, Homo Sapiens
RRGPGGQLR

SEQ ID NO: 322886 - protein, 9 aa, Homo Sapiens
PRKMSMIVP

SEQ ID NO: 322887 - protein, 9 aa, Homo Sapiens
YYNQVGWKP

SEQ ID NO: 322888 - protein, 9 aa, Homo Sapiens
MKKYEKSLR

SEQ ID NO: 322889 - protein, 9 aa, Homo Sapiens
ERLLASSPP

SEQ ID NO: 322890 - protein, 9 aa, Homo Sapiens
ERFLCENPY

SEQ ID NO: 322891 - protein, 9 aa, Homo Sapiens
NVRCRRTET

SEQ ID NO: 322892 - protein, 9 aa, Homo Sapiens
IDKDGIGDE

SEQ ID NO: 322893 - protein, 9 aa, Homo Sapiens
GQVVTIKQV

SEQ ID NO: 322894 - protein, 9 aa, Homo Sapiens
LVPTGGCKE

SEQ ID NO: 322895 - protein, 9 aa, Homo Sapiens
LTLRPRCIN

SEQ ID NO: 322896 - protein, 9 aa, Homo Sapiens
RGAPELWRW

SEQ ID NO: 322897 - protein, 9 aa, Homo Sapiens
PYPAETFCF

SEQ ID NO: 322898 - protein, 9 aa, Homo Sapiens
QGLWVESVP

SEQ ID NO: 322899 - protein, 9 aa, Homo Sapiens
GASVTMQPT

SEQ ID NO: 322900 - protein, 9 aa, Homo Sapiens
LKHATATMK

SEQ ID NO: 322901 - protein, 9 aa, Homo Sapiens
TGNPVVTNQ

SEQ ID NO: 322902 - protein, 9 aa, Homo Sapiens
TGPPVSTEL

SEQ ID NO: 322903 - protein, 9 aa, Homo Sapiens
LGDSNIHGH

SEQ ID NO: 322904 - protein, 9 aa, Homo Sapiens
TRKAQTGLS

SEQ ID NO: 322905 - protein, 9 aa, Homo Sapiens
KNCAGICAC

SEQ ID NO: 322906 - protein, 9 aa, Homo Sapiens
IGQLNGPNC

SEQ ID NO: 322907 - protein, 9 aa, Homo Sapiens
PPWLPAPPP

SEQ ID NO: 322908 - protein, 9 aa, Homo Sapiens
ERLHVRDIN

SEQ ID NO: 322909 - protein, 9 aa, Homo Sapiens
LWRVACTCP

SEQ ID NO: 322910 - protein, 9 aa, Homo Sapiens
IVAEYFDES

SEQ ID NO: 322911 - protein, 9 aa, Homo Sapiens
LPRHIGNKT

SEQ ID NO: 322912 - protein, 9 aa, Homo Sapiens
LCCEASDKS

SEQ ID NO: 322913 - protein, 9 aa, Homo Sapiens
PVPPSEHHG

SEQ ID NO: 322914 - protein, 9 aa, Homo Sapiens
NLPGPSMRE

SEQ ID NO: 322915 - protein, 9 aa, Homo Sapiens
GFLRQRGSD

SEQ ID NO: 322916 - protein, 9 aa, Homo Sapiens
VQGQAGDGE

SEQ ID NO: 322917 - protein, 9 aa, Homo Sapiens
SPMTPNKPV

SEQ ID NO: 322918 - protein, 9 aa, Homo Sapiens
SILKKSVPS

SEQ ID NO: 322919 - protein, 9 aa, Homo Sapiens
PALLLSSVH

SEQ ID NO: 322920 - protein, 9 aa, Homo Sapiens
LVGTASGLC

SEQ ID NO: 322921 - protein, 9 aa, Homo Sapiens
PPWMDTAPV

SEQ ID NO: 322922 - protein, 9 aa, Homo Sapiens
GDVPDDTED

SEQ ID NO: 322923 - protein, 9 aa, Homo Sapiens
HNPGACVTL

SEQ ID NO: 322924 - protein, 9 aa, Homo Sapiens
ASTAEEMAG

SEQ ID NO: 322925 - protein, 9 aa, Homo Sapiens
VPLHRLKPS

SEQ ID NO: 322926 - protein, 9 aa, Homo Sapiens
LYARQKIVI

SEQ ID NO: 322927 - protein, 9 aa, Homo Sapiens
ERQEEARPP

SEQ ID NO: 322928 - protein, 9 aa, Homo Sapiens
KGPQWHIDL

SEQ ID NO: 322929 - protein, 9 aa, Homo Sapiens
NGDKYLGHA

SEQ ID NO: 322930 - protein, 9 aa, Homo Sapiens
SWASLPKVS

SEQ ID NO: 322931 - protein, 9 aa, Homo Sapiens
NNVQNYKIG

SEQ ID NO: 322932 - protein, 9 aa, Homo Sapiens
LLEQNLIQV

SEQ ID NO: 322933 - protein, 9 aa, Homo Sapiens
VVSGRLDSD

SEQ ID NO: 322934 - protein, 9 aa, Homo Sapiens
INNERTQLL

SEQ ID NO: 322935 - protein, 9 aa, Homo Sapiens
WGKNGKDLG

SEQ ID NO: 322936 - protein, 9 aa, Homo Sapiens
VLIMSDIHI

SEQ ID NO: 322937 - protein, 9 aa, Homo Sapiens
KVGGAKGTK

SEQ ID NO: 322938 - protein, 9 aa, Homo Sapiens
SNLTDEEGG

SEQ ID NO: 322939 - protein, 9 aa, Homo Sapiens
SSARPWGPD

SEQ ID NO: 322940 - protein, 9 aa, Homo Sapiens
GPPRLPAVP

SEQ ID NO: 322941 - protein, 9 aa, Homo Sapiens
HAGYMYCGS

SEQ ID NO: 322942 - protein, 9 aa, Homo Sapiens
EAGIHYPDI

SEQ ID NO: 322943 - protein, 9 aa, Homo Sapiens
HWREADRPS

SEQ ID NO: 322944 - protein, 9 aa, Homo Sapiens
YAEAEEMQV

SEQ ID NO: 322945 - protein, 9 aa, Homo Sapiens
ASSLRRHEA

SEQ ID NO: 322946 - protein, 9 aa, Homo Sapiens
MTPNKPVVP

SEQ ID NO: 322947 - protein, 9 aa, Homo Sapiens
SQHFYCGSS

SEQ ID NO: 322948 - protein, 9 aa, Homo Sapiens
TLPMDINNY

SEQ ID NO: 322949 - protein, 9 aa, Homo Sapiens
NVMPSPKVS

SEQ ID NO: 322950 - protein, 9 aa, Homo Sapiens
DESLTISSP

SEQ ID NO: 322951 - protein, 9 aa, Homo Sapiens
VDDQCHGLR

SEQ ID NO: 322952 - protein, 9 aa, Homo Sapiens
RHFFRQIIS

SEQ ID NO: 322953 - protein, 9 aa, Homo Sapiens
TGWPLAGQQ

SEQ ID NO: 322954 - protein, 9 aa, Homo Sapiens
YYLHTSETS

SEQ ID NO: 322955 - protein, 9 aa, Homo Sapiens
LQRSSWHTG

SEQ ID NO: 322956 - protein, 9 aa, Homo Sapiens
IHCMNEFSW

SEQ ID NO: 322957 - protein, 9 aa, Homo Sapiens
TLILADLII

SEQ ID NO: 322958 - protein, 9 aa, Homo Sapiens
RICFLLKVR

SEQ ID NO: 322959 - protein, 9 aa, Homo Sapiens
HLADGKKAA

SEQ ID NO: 322960 - protein, 9 aa, Homo Sapiens
AFFGSLTQS

SEQ ID NO: 322961 - protein, 9 aa, Homo Sapiens
KRNQLLPGV

SEQ ID NO: 322962 - protein, 9 aa, Homo Sapiens
PARPDSANS

SEQ ID NO: 322963 - protein, 9 aa, Homo Sapiens
PMGRLVQEE

SEQ ID NO: 322964 - protein, 9 aa, Homo Sapiens
RKLTAKEEE

SEQ ID NO: 322965 - protein, 9 aa, Homo Sapiens
LLNSQRKHL

SEQ ID NO: 322966 - protein, 9 aa, Homo Sapiens
RRYKHVDWL

SEQ ID NO: 322967 - protein, 9 aa, Homo Sapiens
ITGIYIALL

SEQ ID NO: 322968 - protein, 9 aa, Homo Sapiens
FADMERHHI

SEQ ID NO: 322969 - protein, 9 aa, Homo Sapiens
LIICHMIDK

SEQ ID NO: 322970 - protein, 9 aa, Homo Sapiens
FNNQLFTQL

SEQ ID NO: 322971 - protein, 9 aa, Homo Sapiens
QQREADLLA

SEQ ID NO: 322972 - protein, 9 aa, Homo Sapiens
STSKHAVTV

SEQ ID NO: 322973 - protein, 9 aa, Homo Sapiens
RSGTTQISV

SEQ ID NO: 322974 - protein, 9 aa, Homo Sapiens
NVTVLDANG

SEQ ID NO: 322975 - protein, 9 aa, Homo Sapiens
GQPPLSTTV

SEQ ID NO: 322976 - protein, 9 aa, Homo Sapiens
WHSCRLAGM

SEQ ID NO: 322977 - protein, 9 aa, Homo Sapiens
RAEPDVDAC

SEQ ID NO: 322978 - protein, 9 aa, Homo Sapiens
HSHFLAQLK

SEQ ID NO: 322979 - protein, 9 aa, Homo Sapiens
PRCINMTDT

SEQ ID NO: 322980 - protein, 9 aa, Homo Sapiens
GQSVGEVVP

SEQ ID NO: 322981 - protein, 9 aa, Homo Sapiens
WLLESLIRL

SEQ ID NO: 322982 - protein, 9 aa, Homo Sapiens
TLGVDVNNR

SEQ ID NO: 322983 - protein, 9 aa, Homo Sapiens
RQDVWEWPH

SEQ ID NO: 322984 - protein, 9 aa, Homo Sapiens
GLLHPPQLH

SEQ ID NO: 322985 - protein, 9 aa, Homo Sapiens
WPGVGAPGG

SEQ ID NO: 322986 - protein, 9 aa, Homo Sapiens
SFLKDLKDR

SEQ ID NO: 322987 - protein, 9 aa, Homo Sapiens
LCCVVAGMN

SEQ ID NO: 322988 - protein, 9 aa, Homo Sapiens
SPHYEFGSL

SEQ ID NO: 322989 - protein, 9 aa, Homo Sapiens
MKENMRMGN

SEQ ID NO: 322990 - protein, 9 aa, Homo Sapiens
RLRHKVQDA

SEQ ID NO: 322991 - protein, 9 aa, Homo Sapiens
AGYMYCGSC

SEQ ID NO: 322992 - protein, 9 aa, Homo Sapiens
SLTMLENVK

SEQ ID NO: 322993 - protein, 9 aa, Homo Sapiens
MLSFGKAFE

SEQ ID NO: 322994 - protein, 9 aa, Homo Sapiens
YLQINFYCP

SEQ ID NO: 322995 - protein, 9 aa, Homo Sapiens
RRTLRICFL

SEQ ID NO: 322996 - protein, 9 aa, Homo Sapiens
NENAPVTER

SEQ ID NO: 322997 - protein, 9 aa, Homo Sapiens
FTQFWIILG

SEQ ID NO: 322998 - protein, 9 aa, Homo Sapiens
HCNSLLGPA

SEQ ID NO: 322999 - protein, 9 aa, Homo Sapiens
ASEGDAKVV

SEQ ID NO: 323000 - protein, 9 aa, Homo Sapiens
ATAMQILGG

SEQ ID NO: 323001 - protein, 9 aa, Homo Sapiens
YMKHFDAHG

SEQ ID NO: 323002 - protein, 9 aa, Homo Sapiens
KGYGSENGE

SEQ ID NO: 323003 - protein, 9 aa, Homo Sapiens
RHKKMEKEP

SEQ ID NO: 323004 - protein, 9 aa, Homo Sapiens
KHLHNAASK

SEQ ID NO: 323005 - protein, 9 aa, Homo Sapiens
VLRSLAFPA

SEQ ID NO: 323006 - protein, 9 aa, Homo Sapiens
ARGALTLLF

SEQ ID NO: 323007 - protein, 9 aa, Homo Sapiens
FDRQELQCN

SEQ ID NO: 323008 - protein, 9 aa, Homo Sapiens
ALLSFAHTN

SEQ ID NO: 323009 - protein, 9 aa, Homo Sapiens
RVAFCMVKI

SEQ ID NO: 323010 - protein, 9 aa, Homo Sapiens
HNTKHAIRS

SEQ ID NO: 323011 - protein, 9 aa, Homo Sapiens
QVLEVEPQF

SEQ ID NO: 323012 - protein, 9 aa, Homo Sapiens
FSKRQEDQH

SEQ ID NO: 323013 - protein, 9 aa, Homo Sapiens
GPGRGWAPR

SEQ ID NO: 323014 - protein, 9 aa, Homo Sapiens
EVKKEAKKS

SEQ ID NO: 323015 - protein, 9 aa, Homo Sapiens
IIPISLHVN

SEQ ID NO: 323016 - protein, 9 aa, Homo Sapiens
SHCSCGDGK

SEQ ID NO: 323017 - protein, 9 aa, Homo Sapiens
DCPVIVSVQ

SEQ ID NO: 323018 - protein, 9 aa, Homo Sapiens
ANSYEMEED

SEQ ID NO: 323019 - protein, 9 aa, Homo Sapiens
HVWPPGDEE

SEQ ID NO: 323020 - protein, 9 aa, Homo Sapiens
DAQVLHVDS

SEQ ID NO: 323021 - protein, 9 aa, Homo Sapiens
VMIQLLQHF

SEQ ID NO: 323022 - protein, 9 aa, Homo Sapiens
SVPSVAVIG

SEQ ID NO: 323023 - protein, 9 aa, Homo Sapiens
SNSGQGQKE

SEQ ID NO: 323024 - protein, 9 aa, Homo Sapiens
EESSSNTNK

SEQ ID NO: 323025 - protein, 9 aa, Homo Sapiens
HYGVHTCEG

SEQ ID NO: 323026 - protein, 9 aa, Homo Sapiens
DQVLEVEPQ

SEQ ID NO: 323027 - protein, 9 aa, Homo Sapiens
KVITKQEPG

SEQ ID NO: 323028 - protein, 9 aa, Homo Sapiens
DRYCSNIDK

SEQ ID NO: 323029 - protein, 9 aa, Homo Sapiens
VVLGETVAL

SEQ ID NO: 323030 - protein, 9 aa, Homo Sapiens
AEKVQEGVC

SEQ ID NO: 323031 - protein, 9 aa, Homo Sapiens
KSIQDHLLE

SEQ ID NO: 323032 - protein, 9 aa, Homo Sapiens
ICSHLQDLK

SEQ ID NO: 323033 - protein, 9 aa, Homo Sapiens
TSSGDAQGM

SEQ ID NO: 323034 - protein, 9 aa, Homo Sapiens
WLTLAGLGT

SEQ ID NO: 323035 - protein, 9 aa, Homo Sapiens
QGRNLLIIG

SEQ ID NO: 323036 - protein, 9 aa, Homo Sapiens
LPLLESCTV

SEQ ID NO: 323037 - protein, 9 aa, Homo Sapiens
WLLFSDVVT

SEQ ID NO: 323038 - protein, 9 aa, Homo Sapiens
GSPHGSPLA

SEQ ID NO: 323039 - protein, 9 aa, Homo Sapiens
MQMPWSSPR

SEQ ID NO: 323040 - protein, 9 aa, Homo Sapiens
RSLHTIAVV

SEQ ID NO: 323041 - protein, 9 aa, Homo Sapiens
AYLHMEIVG

SEQ ID NO: 323042 - protein, 9 aa, Homo Sapiens
PAGVSPSTL

SEQ ID NO: 323043 - protein, 9 aa, Homo Sapiens
APERQEEAR

SEQ ID NO: 323044 - protein, 9 aa, Homo Sapiens
IDLLRTSVM

SEQ ID NO: 323045 - protein, 9 aa, Homo Sapiens
WYRGTAPPK

SEQ ID NO: 323046 - protein, 9 aa, Homo Sapiens
VESGPQGCA

SEQ ID NO: 323047 - protein, 9 aa, Homo Sapiens
LISIMILGR

SEQ ID NO: 323048 - protein, 9 aa, Homo Sapiens
ILASIYFGA

SEQ ID NO: 323049 - protein, 9 aa, Homo Sapiens
SGRHVLVYS

SEQ ID NO: 323050 - protein, 9 aa, Homo Sapiens
TAEKEPFLV

SEQ ID NO: 323051 - protein, 9 aa, Homo Sapiens
DACLYILDW

SEQ ID NO: 323052 - protein, 9 aa, Homo Sapiens
RLSMTTISH

SEQ ID NO: 323053 - protein, 9 aa, Homo Sapiens
PSPPAAGSR

SEQ ID NO: 323054 - protein, 9 aa, Homo Sapiens
GWHGGRRLP

SEQ ID NO: 323055 - protein, 9 aa, Homo Sapiens
GQGMSSRRR

SEQ ID NO: 323056 - protein, 9 aa, Homo Sapiens
ARPPSEDAS

SEQ ID NO: 323057 - protein, 9 aa, Homo Sapiens
PFSVFDILS

SEQ ID NO: 323058 - protein, 9 aa, Homo Sapiens
MGNVLSSEL

SEQ ID NO: 323059 - protein, 9 aa, Homo Sapiens
LSQLCSEIQ

SEQ ID NO: 323060 - protein, 9 aa, Homo Sapiens
SFNHFDWDH

SEQ ID NO: 323061 - protein, 9 aa, Homo Sapiens
ISLHVNLDM

SEQ ID NO: 323062 - protein, 9 aa, Homo Sapiens
STVEKHYGK

SEQ ID NO: 323063 - protein, 9 aa, Homo Sapiens
FISFFFMYM

SEQ ID NO: 323064 - protein, 9 aa, Homo Sapiens
LKSKQADSV

SEQ ID NO: 323065 - protein, 9 aa, Homo Sapiens
FFKIHTHCN

SEQ ID NO: 323066 - protein, 9 aa, Homo Sapiens
TDLLMIALG

SEQ ID NO: 323067 - protein, 9 aa, Homo Sapiens
VFLAPTFSS

SEQ ID NO: 323068 - protein, 9 aa, Homo Sapiens
CEWQPIGRL

SEQ ID NO: 323069 - protein, 9 aa, Homo Sapiens
DVMFASSSK

SEQ ID NO: 323070 - protein, 9 aa, Homo Sapiens
KTTLFLYSW

SEQ ID NO: 323071 - protein, 9 aa, Homo Sapiens
PEVIFHQGY

SEQ ID NO: 323072 - protein, 9 aa, Homo Sapiens
CKPLEAVLR

SEQ ID NO: 323073 - protein, 9 aa, Homo Sapiens
PYKCDGCGK

SEQ ID NO: 323074 - protein, 9 aa, Homo Sapiens
GLSQRNPSY

SEQ ID NO: 323075 - protein, 9 aa, Homo Sapiens
FQQIVCGMN

SEQ ID NO: 323076 - protein, 9 aa, Homo Sapiens
GPAVRPMPW

SEQ ID NO: 323077 - protein, 9 aa, Homo Sapiens
ASRNGIRLD

SEQ ID NO: 323078 - protein, 9 aa, Homo Sapiens
DKVRLAVQK

SEQ ID NO: 323079 - protein, 9 aa, Homo Sapiens
EELGGPPPK

SEQ ID NO: 323080 - protein, 9 aa, Homo Sapiens
AQASRRELA

SEQ ID NO: 323081 - protein, 9 aa, Homo Sapiens
AKMPAKKTR

SEQ ID NO: 323082 - protein, 9 aa, Homo Sapiens
LVMSVKAAM

SEQ ID NO: 323083 - protein, 9 aa, Homo Sapiens
QCHCSSITK

SEQ ID NO: 323084 - protein, 9 aa, Homo Sapiens
VSYGFIAGV

SEQ ID NO: 323085 - protein, 9 aa, Homo Sapiens
GFHYGVHTC

SEQ ID NO: 323086 - protein, 9 aa, Homo Sapiens
FSQSGHTSF

SEQ ID NO: 323087 - protein, 9 aa, Homo Sapiens
NGSSHRNQS

SEQ ID NO: 323088 - protein, 9 aa, Homo Sapiens
YGTRRKPYN

SEQ ID NO: 323089 - protein, 9 aa, Homo Sapiens
CKVGLIAAR

SEQ ID NO: 323090 - protein, 9 aa, Homo Sapiens
PSLFESIAT

SEQ ID NO: 323091 - protein, 9 aa, Homo Sapiens
ELLLNDAVT

SEQ ID NO: 323092 - protein, 9 aa, Homo Sapiens
QGLLEMLLG

SEQ ID NO: 323093 - protein, 9 aa, Homo Sapiens
AELWGEHTL

SEQ ID NO: 323094 - protein, 9 aa, Homo Sapiens
LGPMLPGNA

SEQ ID NO: 323095 - protein, 9 aa, Homo Sapiens
EVIFHQGYG

SEQ ID NO: 323096 - protein, 9 aa, Homo Sapiens
FQGPPRLPA

SEQ ID NO: 323097 - protein, 9 aa, Homo Sapiens
SIKDKCSCC

SEQ ID NO: 323098 - protein, 9 aa, Homo Sapiens
LCVNGFTHW

SEQ ID NO: 323099 - protein, 9 aa, Homo Sapiens
ILILLPMCR

SEQ ID NO: 323100 - protein, 9 aa, Homo Sapiens
PEPTWTTLA

SEQ ID NO: 323101 - protein, 9 aa, Homo Sapiens
SGGMKDMYG

SEQ ID NO: 323102 - protein, 9 aa, Homo Sapiens
LCVPIMTVI

SEQ ID NO: 323103 - protein, 9 aa, Homo Sapiens
DIFRRAKET

SEQ ID NO: 323104 - protein, 9 aa, Homo Sapiens
PSDSVDGPK

SEQ ID NO: 323105 - protein, 9 aa, Homo Sapiens
TPRVIGTSV

SEQ ID NO: 323106 - protein, 9 aa, Homo Sapiens
LGQLGLVVI

SEQ ID NO: 323107 - protein, 9 aa, Homo Sapiens
LSGETQEQE

SEQ ID NO: 323108 - protein, 9 aa, Homo Sapiens
LQVQIDELK

SEQ ID NO: 323109 - protein, 9 aa, Homo Sapiens
LSLVLDCGY

SEQ ID NO: 323110 - protein, 9 aa, Homo Sapiens
VVKKTTLLT

SEQ ID NO: 323111 - protein, 9 aa, Homo Sapiens
VAELVKTYC

SEQ ID NO: 323112 - protein, 9 aa, Homo Sapiens
MRVSDHQQL

SEQ ID NO: 323113 - protein, 9 aa, Homo Sapiens
AVLDPLGLQ

SEQ ID NO: 323114 - protein, 9 aa, Homo Sapiens
TRAQGSCSP

SEQ ID NO: 323115 - protein, 9 aa, Homo Sapiens
SAPILKWAL

SEQ ID NO: 323116 - protein, 9 aa, Homo Sapiens
VLFLVTWRG

SEQ ID NO: 323117 - protein, 9 aa, Homo Sapiens
DLFQSCLNV

SEQ ID NO: 323118 - protein, 9 aa, Homo Sapiens
LNSQRKHLH

SEQ ID NO: 323119 - protein, 9 aa, Homo Sapiens
PRPACHEHG

SEQ ID NO: 323120 - protein, 9 aa, Homo Sapiens
PERQEEARP

SEQ ID NO: 323121 - protein, 9 aa, Homo Sapiens
TSFTLVPGG

SEQ ID NO: 323122 - protein, 9 aa, Homo Sapiens
VLDQRASDY

SEQ ID NO: 323123 - protein, 9 aa, Homo Sapiens
RPLHALATG

SEQ ID NO: 323124 - protein, 9 aa, Homo Sapiens
ARHILLLAG

SEQ ID NO: 323125 - protein, 9 aa, Homo Sapiens
PTCEEACCK

SEQ ID NO: 323126 - protein, 9 aa, Homo Sapiens
RWRGHAESP

SEQ ID NO: 323127 - protein, 9 aa, Homo Sapiens
NGYYNGHTK

SEQ ID NO: 323128 - protein, 9 aa, Homo Sapiens
DTCENSVLE

SEQ ID NO: 323129 - protein, 9 aa, Homo Sapiens
SKGYVQIVE

SEQ ID NO: 323130 - protein, 9 aa, Homo Sapiens
LLRSCSFTK

SEQ ID NO: 323131 - protein, 9 aa, Homo Sapiens
NRTCSFGHF

SEQ ID NO: 323132 - protein, 9 aa, Homo Sapiens
PLHRLKPSQ

SEQ ID NO: 323133 - protein, 9 aa, Homo Sapiens
RAEKRLPYL

SEQ ID NO: 323134 - protein, 9 aa, Homo Sapiens
APWLPMRSL

SEQ ID NO: 323135 - protein, 9 aa, Homo Sapiens
PRIPNSDQK

SEQ ID NO: 323136 - protein, 9 aa, Homo Sapiens
RGTAPPKQE

SEQ ID NO: 323137 - protein, 9 aa, Homo Sapiens
HQGYGKPVD

SEQ ID NO: 323138 - protein, 9 aa, Homo Sapiens
FSLDRSYAL

SEQ ID NO: 323139 - protein, 9 aa, Homo Sapiens
SHLGRAELI

SEQ ID NO: 323140 - protein, 9 aa, Homo Sapiens
SKRGSKIIV

SEQ ID NO: 323141 - protein, 9 aa, Homo Sapiens
PPHPTCTKD

SEQ ID NO: 323142 - protein, 9 aa, Homo Sapiens
VIELPRGLL

SEQ ID NO: 323143 - protein, 9 aa, Homo Sapiens
RMVLQKLSK

SEQ ID NO: 323144 - protein, 9 aa, Homo Sapiens
LGETAECLI

SEQ ID NO: 323145 - protein, 9 aa, Homo Sapiens
EVEVYRWDS

SEQ ID NO: 323146 - protein, 9 aa, Homo Sapiens
HWWEDLERD

SEQ ID NO: 323147 - protein, 9 aa, Homo Sapiens
SYIPDCLPA

SEQ ID NO: 323148 - protein, 9 aa, Homo Sapiens
ADRGLKSKE

SEQ ID NO: 323149 - protein, 9 aa, Homo Sapiens
AMEQAVQTA

SEQ ID NO: 323150 - protein, 9 aa, Homo Sapiens
AFSISFNRV

SEQ ID NO: 323151 - protein, 9 aa, Homo Sapiens
WFTAMDAYV

SEQ ID NO: 323152 - protein, 9 aa, Homo Sapiens
GEEVLRKQF

SEQ ID NO: 323153 - protein, 9 aa, Homo Sapiens
GSTFLRLAV

SEQ ID NO: 323154 - protein, 9 aa, Homo Sapiens
TVLQASIDT

SEQ ID NO: 323155 - protein, 9 aa, Homo Sapiens
HSLDAVLAW

SEQ ID NO: 323156 - protein, 9 aa, Homo Sapiens
RVSLKPPAT

SEQ ID NO: 323157 - protein, 9 aa, Homo Sapiens
SIDIYSCYI

SEQ ID NO: 323158 - protein, 9 aa, Homo Sapiens
RPNAEGDAS

SEQ ID NO: 323159 - protein, 9 aa, Homo Sapiens
KFYFENISL

SEQ ID NO: 323160 - protein, 9 aa, Homo Sapiens
GGTQPVAGA

SEQ ID NO: 323161 - protein, 9 aa, Homo Sapiens
DSVDGPKST

SEQ ID NO: 323162 - protein, 9 aa, Homo Sapiens
QPNIYIREY

SEQ ID NO: 323163 - protein, 9 aa, Homo Sapiens
KEMAPVQLP

SEQ ID NO: 323164 - protein, 9 aa, Homo Sapiens
MKSKACEKV

SEQ ID NO: 323165 - protein, 9 aa, Homo Sapiens
RSSWPVGQP

SEQ ID NO: 323166 - protein, 9 aa, Homo Sapiens
TLRKGGHCN

SEQ ID NO: 323167 - protein, 9 aa, Homo Sapiens
LRVHSINLK

SEQ ID NO: 323168 - protein, 9 aa, Homo Sapiens
QWLLGLWQG

SEQ ID NO: 323169 - protein, 9 aa, Homo Sapiens
DVVEFEVRS

SEQ ID NO: 323170 - protein, 9 aa, Homo Sapiens
DKSSSNDMN

SEQ ID NO: 323171 - protein, 9 aa, Homo Sapiens
KVSKLQCQI

SEQ ID NO: 323172 - protein, 9 aa, Homo Sapiens
KARAEKRLP

SEQ ID NO: 323173 - protein, 9 aa, Homo Sapiens
YHSLCEWQP

SEQ ID NO: 323174 - protein, 9 aa, Homo Sapiens
LRTSVMVKV

SEQ ID NO: 323175 - protein, 9 aa, Homo Sapiens
QDPTSYAPD

SEQ ID NO: 323176 - protein, 9 aa, Homo Sapiens
NWWRKALRR

SEQ ID NO: 323177 - protein, 9 aa, Homo Sapiens
GERKLTGVM

SEQ ID NO: 323178 - protein, 9 aa, Homo Sapiens
SLCCGRASR

SEQ ID NO: 323179 - protein, 9 aa, Homo Sapiens
VPGYWHVYL

SEQ ID NO: 323180 - protein, 9 aa, Homo Sapiens
ATSLQILQD

SEQ ID NO: 323181 - protein, 9 aa, Homo Sapiens
NNRFTSFIN

SEQ ID NO: 323182 - protein, 9 aa, Homo Sapiens
LREWLGRAI

SEQ ID NO: 323183 - protein, 9 aa, Homo Sapiens
VHTCEGCKG

SEQ ID NO: 323184 - protein, 9 aa, Homo Sapiens
TRETDITQG

SEQ ID NO: 323185 - protein, 9 aa, Homo Sapiens
RWFSADEQF

SEQ ID NO: 323186 - protein, 9 aa, Homo Sapiens
FYMAKGNPI

SEQ ID NO: 323187 - protein, 9 aa, Homo Sapiens
VRAAHRCCN

SEQ ID NO: 323188 - protein, 9 aa, Homo Sapiens
HQKQRLKKA

SEQ ID NO: 323189 - protein, 9 aa, Homo Sapiens
TAVMTYMKH

SEQ ID NO: 323190 - protein, 9 aa, Homo Sapiens
FSVRLTYHR

SEQ ID NO: 323191 - protein, 9 aa, Homo Sapiens
TILPGDVRT

SEQ ID NO: 323192 - protein, 9 aa, Homo Sapiens
QMLACCMEV

SEQ ID NO: 323193 - protein, 9 aa, Homo Sapiens
LQDGDLDVM

SEQ ID NO: 323194 - protein, 9 aa, Homo Sapiens
FYSHKYSLI

SEQ ID NO: 323195 - protein, 9 aa, Homo Sapiens
HHLPVWAVT

SEQ ID NO: 323196 - protein, 9 aa, Homo Sapiens
RVGRSHSHR

SEQ ID NO: 323197 - protein, 9 aa, Homo Sapiens
QADNCPRIP

SEQ ID NO: 323198 - protein, 9 aa, Homo Sapiens
DWFTAMDAY

SEQ ID NO: 323199 - protein, 9 aa, Homo Sapiens
PTSTQLDRN

SEQ ID NO: 323200 - protein, 9 aa, Homo Sapiens
PVVWGKLDD

SEQ ID NO: 323201 - protein, 9 aa, Homo Sapiens
PGPAGHLTL

SEQ ID NO: 323202 - protein, 9 aa, Homo Sapiens
QLIRWCMSL

SEQ ID NO: 323203 - protein, 9 aa, Homo Sapiens
SSENTYKSC

SEQ ID NO: 323204 - protein, 9 aa, Homo Sapiens
KVFINPLVF

SEQ ID NO: 323205 - protein, 9 aa, Homo Sapiens
IHFKTCYQI

SEQ ID NO: 323206 - protein, 9 aa, Homo Sapiens
NPGGSDSMP

SEQ ID NO: 323207 - protein, 9 aa, Homo Sapiens
AKAREAALR

SEQ ID NO: 323208 - protein, 9 aa, Homo Sapiens
RKWPVVWGK

SEQ ID NO: 323209 - protein, 9 aa, Homo Sapiens
LCHLLVGAL

SEQ ID NO: 323210 - protein, 9 aa, Homo Sapiens
LLKVRRVSL

SEQ ID NO: 323211 - protein, 9 aa, Homo Sapiens
LVYLLWDGG

SEQ ID NO: 323212 - protein, 9 aa, Homo Sapiens
RCGKKGAAT

SEQ ID NO: 323213 - protein, 9 aa, Homo Sapiens
LCAPDLEYL

SEQ ID NO: 323214 - protein, 9 aa, Homo Sapiens
AQADLKLLG

SEQ ID NO: 323215 - protein, 9 aa, Homo Sapiens
RTHSTASHS

SEQ ID NO: 323216 - protein, 9 aa, Homo Sapiens
CECLGPLRW

SEQ ID NO: 323217 - protein, 9 aa, Homo Sapiens
NEHTARWIQ

SEQ ID NO: 323218 - protein, 9 aa, Homo Sapiens
LPFYVTLLV

SEQ ID NO: 323219 - protein, 9 aa, Homo Sapiens
IQIFGCKSY

SEQ ID NO: 323220 - protein, 9 aa, Homo Sapiens
FANPGGSDS

SEQ ID NO: 323221 - protein, 9 aa, Homo Sapiens
DRAVDGNWN

SEQ ID NO: 323222 - protein, 9 aa, Homo Sapiens
KIVKNRQTV

SEQ ID NO: 323223 - protein, 9 aa, Homo Sapiens
EQKIKDISN

SEQ ID NO: 323224 - protein, 9 aa, Homo Sapiens
RNLLIIGTT

SEQ ID NO: 323225 - protein, 9 aa, Homo Sapiens
SIQDHLLEV

SEQ ID NO: 323226 - protein, 9 aa, Homo Sapiens
RRGLRAVEA

SEQ ID NO: 323227 - protein, 9 aa, Homo Sapiens
GLDMQPCID

SEQ ID NO: 323228 - protein, 9 aa, Homo Sapiens
QPSSQAVSN

SEQ ID NO: 323229 - protein, 9 aa, Homo Sapiens
PEVRDVWPY

SEQ ID NO: 323230 - protein, 9 aa, Homo Sapiens
KWSLELPVC

SEQ ID NO: 323231 - protein, 9 aa, Homo Sapiens
AAQDLVMHA

SEQ ID NO: 323232 - protein, 9 aa, Homo Sapiens
DGMNVAPGD

SEQ ID NO: 323233 - protein, 9 aa, Homo Sapiens
CQPRRRKSV

SEQ ID NO: 323234 - protein, 9 aa, Homo Sapiens
TSTIVRTVP

SEQ ID NO: 323235 - protein, 9 aa, Homo Sapiens
CHLLVGALW

SEQ ID NO: 323236 - protein, 9 aa, Homo Sapiens
CKFSSRSDV

SEQ ID NO: 323237 - protein, 9 aa, Homo Sapiens
QGTINQHLR

SEQ ID NO: 323238 - protein, 9 aa, Homo Sapiens
KENWLLQEE

SEQ ID NO: 323239 - protein, 9 aa, Homo Sapiens
KRRGRLIDF

SEQ ID NO: 323240 - protein, 9 aa, Homo Sapiens
TMTCQVERF

SEQ ID NO: 323241 - protein, 9 aa, Homo Sapiens
QIISAVHYC

SEQ ID NO: 323242 - protein, 9 aa, Homo Sapiens
VLGLTLSDM

SEQ ID NO: 323243 - protein, 9 aa, Homo Sapiens
NMQLLPVGL

SEQ ID NO: 323244 - protein, 9 aa, Homo Sapiens
RQTVASIKN

SEQ ID NO: 323245 - protein, 9 aa, Homo Sapiens
LNSFLRDYN

SEQ ID NO: 323246 - protein, 9 aa, Homo Sapiens
YIGRLYGPF

SEQ ID NO: 323247 - protein, 9 aa, Homo Sapiens
VCGMNQVLD

SEQ ID NO: 323248 - protein, 9 aa, Homo Sapiens
PEQRTVTLG

SEQ ID NO: 323249 - protein, 9 aa, Homo Sapiens
TADHCAFHN

SEQ ID NO: 323250 - protein, 9 aa, Homo Sapiens
ARVEHEETL

SEQ ID NO: 323251 - protein, 9 aa, Homo Sapiens
AHMSPLFEK

SEQ ID NO: 323252 - protein, 9 aa, Homo Sapiens
FISGPQYQH

SEQ ID NO: 323253 - protein, 9 aa, Homo Sapiens
HQAKEDMTR

SEQ ID NO: 323254 - protein, 9 aa, Homo Sapiens
LYQLVKKYE

SEQ ID NO: 323255 - protein, 9 aa, Homo Sapiens
LHTIAVVLT

SEQ ID NO: 323256 - protein, 9 aa, Homo Sapiens
QEVVLDKSV

SEQ ID NO: 323257 - protein, 9 aa, Homo Sapiens
YMLFFINPG

SEQ ID NO: 323258 - protein, 9 aa, Homo Sapiens
GLGDRRVQN

SEQ ID NO: 323259 - protein, 9 aa, Homo Sapiens
INSAQLDID

SEQ ID NO: 323260 - protein, 9 aa, Homo Sapiens
LQKSSRGFG

SEQ ID NO: 323261 - protein, 9 aa, Homo Sapiens
SSSGGGGGS

SEQ ID NO: 323262 - protein, 9 aa, Homo Sapiens
QHICAAVCT

SEQ ID NO: 323263 - protein, 9 aa, Homo Sapiens
CLLGSNDSS

SEQ ID NO: 323264 - protein, 9 aa, Homo Sapiens
WLQYPQTQL

SEQ ID NO: 323265 - protein, 9 aa, Homo Sapiens
WKKITDSIE

SEQ ID NO: 323266 - protein, 9 aa, Homo Sapiens
RPMRKHLSA

SEQ ID NO: 323267 - protein, 9 aa, Homo Sapiens
PKTMAIQGI

SEQ ID NO: 323268 - protein, 9 aa, Homo Sapiens
GKWLVGTVT

SEQ ID NO: 323269 - protein, 9 aa, Homo Sapiens
ALDCYSKKK

SEQ ID NO: 323270 - protein, 9 aa, Homo Sapiens
RPLQHEQRV

SEQ ID NO: 323271 - protein, 9 aa, Homo Sapiens
VWGSAFSIS

SEQ ID NO: 323272 - protein, 9 aa, Homo Sapiens
DGVACMRFQ

SEQ ID NO: 323273 - protein, 9 aa, Homo Sapiens
NAVVESYSG

SEQ ID NO: 323274 - protein, 9 aa, Homo Sapiens
TLLHHRRSH

SEQ ID NO: 323275 - protein, 9 aa, Homo Sapiens
CILILLPMC

SEQ ID NO: 323276 - protein, 9 aa, Homo Sapiens
WTLHSTSPV

SEQ ID NO: 323277 - protein, 9 aa, Homo Sapiens
ANITHGNSS

SEQ ID NO: 323278 - protein, 9 aa, Homo Sapiens
QRRGAGAAH

SEQ ID NO: 323279 - protein, 9 aa, Homo Sapiens
IDTCENSVL

SEQ ID NO: 323280 - protein, 9 aa, Homo Sapiens
CINHYGGHL

SEQ ID NO: 323281 - protein, 9 aa, Homo Sapiens
NVERNIADG

SEQ ID NO: 323282 - protein, 9 aa, Homo Sapiens
EMQMPWSSP

SEQ ID NO: 323283 - protein, 9 aa, Homo Sapiens
SRASPDNLS

SEQ ID NO: 323284 - protein, 9 aa, Homo Sapiens
RGEESSSNT

SEQ ID NO: 323285 - protein, 9 aa, Homo Sapiens
PTGEEQALS

SEQ ID NO: 323286 - protein, 9 aa, Homo Sapiens
GLNASTCYL

SEQ ID NO: 323287 - protein, 9 aa, Homo Sapiens
VKDRTHDVT

SEQ ID NO: 323288 - protein, 9 aa, Homo Sapiens
PQPPPHMCC

SEQ ID NO: 323289 - protein, 9 aa, Homo Sapiens
VIFHQGYGK

SEQ ID NO: 323290 - protein, 9 aa, Homo Sapiens
PIKEVLMDI

SEQ ID NO: 323291 - protein, 9 aa, Homo Sapiens
GEIFMLKCC

SEQ ID NO: 323292 - protein, 9 aa, Homo Sapiens
QKADGVGPL

SEQ ID NO: 323293 - protein, 9 aa, Homo Sapiens
KESVCGQDI

SEQ ID NO: 323294 - protein, 9 aa, Homo Sapiens
AAEHSRLRI

SEQ ID NO: 323295 - protein, 9 aa, Homo Sapiens
SNIIPISLH

SEQ ID NO: 323296 - protein, 9 aa, Homo Sapiens
YHEMLNNVW

SEQ ID NO: 323297 - protein, 9 aa, Homo Sapiens
RTKSKASQQ

SEQ ID NO: 323298 - protein, 9 aa, Homo Sapiens
KEARRWKDS

SEQ ID NO: 323299 - protein, 9 aa, Homo Sapiens
EKSSNGWQW

SEQ ID NO: 323300 - protein, 9 aa, Homo Sapiens
LGEAVDTSI

SEQ ID NO: 323301 - protein, 9 aa, Homo Sapiens
VVTFDADDD

SEQ ID NO: 323302 - protein, 9 aa, Homo Sapiens
QEQDLLEKT

SEQ ID NO: 323303 - protein, 9 aa, Homo Sapiens
TFSYRPDGN

SEQ ID NO: 323304 - protein, 9 aa, Homo Sapiens
HRQAVYDIN

SEQ ID NO: 323305 - protein, 9 aa, Homo Sapiens
LEDVKMVVC

SEQ ID NO: 323306 - protein, 9 aa, Homo Sapiens
MGNLRSLNL

SEQ ID NO: 323307 - protein, 9 aa, Homo Sapiens
MLQAMADGV

SEQ ID NO: 323308 - protein, 9 aa, Homo Sapiens
FDLVIVAEY

SEQ ID NO: 323309 - protein, 9 aa, Homo Sapiens
QSNPDPVAI

SEQ ID NO: 323310 - protein, 9 aa, Homo Sapiens
QVGLSQANF

SEQ ID NO: 323311 - protein, 9 aa, Homo Sapiens
GDQLAEEQA

SEQ ID NO: 323312 - protein, 9 aa, Homo Sapiens
QLMADAVVT

SEQ ID NO: 323313 - protein, 9 aa, Homo Sapiens
RLLASSPPR

SEQ ID NO: 323314 - protein, 9 aa, Homo Sapiens
EGKHPSENL

SEQ ID NO: 323315 - protein, 9 aa, Homo Sapiens
SATREPDPA

SEQ ID NO: 323316 - protein, 9 aa, Homo Sapiens
HILFRYAGP

SEQ ID NO: 323317 - protein, 9 aa, Homo Sapiens
STVQLTARI

SEQ ID NO: 323318 - protein, 9 aa, Homo Sapiens
LRYRDYQQV

SEQ ID NO: 323319 - protein, 9 aa, Homo Sapiens
KAESSENSC

SEQ ID NO: 323320 - protein, 9 aa, Homo Sapiens
WHKVFINPL

SEQ ID NO: 323321 - protein, 9 aa, Homo Sapiens
GCVSHGAGI

SEQ ID NO: 323322 - protein, 9 aa, Homo Sapiens
LFVTVCWLG

SEQ ID NO: 323323 - protein, 9 aa, Homo Sapiens
DDSKFFMTV

SEQ ID NO: 323324 - protein, 9 aa, Homo Sapiens
IEFGEIIIN

SEQ ID NO: 323325 - protein, 9 aa, Homo Sapiens
PSNFLKTTL

SEQ ID NO: 323326 - protein, 9 aa, Homo Sapiens
VLDKRCGRD

SEQ ID NO: 323327 - protein, 9 aa, Homo Sapiens
LLCTYVLHI

SEQ ID NO: 323328 - protein, 9 aa, Homo Sapiens
GGHYMRNNV

SEQ ID NO: 323329 - protein, 9 aa, Homo Sapiens
NSGSESDQP

SEQ ID NO: 323330 - protein, 9 aa, Homo Sapiens
FYPLRPLQE

SEQ ID NO: 323331 - protein, 9 aa, Homo Sapiens
RWTEYSIQM

SEQ ID NO: 323332 - protein, 9 aa, Homo Sapiens
TRSVGRDSS

SEQ ID NO: 323333 - protein, 9 aa, Homo Sapiens
PKLNQRLSH

SEQ ID NO: 323334 - protein, 9 aa, Homo Sapiens
VTVCWLGLE

SEQ ID NO: 323335 - protein, 9 aa, Homo Sapiens
GAGSRPWIK

SEQ ID NO: 323336 - protein, 9 aa, Homo Sapiens
KGDIIVLWR

SEQ ID NO: 323337 - protein, 9 aa, Homo Sapiens
HVNLDMGKI

SEQ ID NO: 323338 - protein, 9 aa, Homo Sapiens
IITRIVCDY

SEQ ID NO: 323339 - protein, 9 aa, Homo Sapiens
AVFSFIALN

SEQ ID NO: 323340 - protein, 9 aa, Homo Sapiens
KPPGMALPT

SEQ ID NO: 323341 - protein, 9 aa, Homo Sapiens
GQLRLMLPS

SEQ ID NO: 323342 - protein, 9 aa, Homo Sapiens
GPPVSTELG

SEQ ID NO: 323343 - protein, 9 aa, Homo Sapiens
GEGTTPCTS

SEQ ID NO: 323344 - protein, 9 aa, Homo Sapiens
GAQRSFTCT

SEQ ID NO: 323345 - protein, 9 aa, Homo Sapiens
GWPLAGQQP

SEQ ID NO: 323346 - protein, 9 aa, Homo Sapiens
VVQTSTIPE

SEQ ID NO: 323347 - protein, 9 aa, Homo Sapiens
TTLMLCEND

SEQ ID NO: 323348 - protein, 9 aa, Homo Sapiens
LYLLMPPML

SEQ ID NO: 323349 - protein, 9 aa, Homo Sapiens
SNIDKHWLN

SEQ ID NO: 323350 - protein, 9 aa, Homo Sapiens
VINSAQLDI

SEQ ID NO: 323351 - protein, 9 aa, Homo Sapiens
CHILWAPAD

SEQ ID NO: 323352 - protein, 9 aa, Homo Sapiens
LALTLLSAR

SEQ ID NO: 323353 - protein, 9 aa, Homo Sapiens
MALPTVSPP

SEQ ID NO: 323354 - protein, 9 aa, Homo Sapiens
LVVIVPAQR

SEQ ID NO: 323355 - protein, 9 aa, Homo Sapiens
GNNEITSST

SEQ ID NO: 323356 - protein, 9 aa, Homo Sapiens
TKKKDDIQE

SEQ ID NO: 323357 - protein, 9 aa, Homo Sapiens
PPIAPATPA

SEQ ID NO: 323358 - protein, 9 aa, Homo Sapiens
VATVAFCDT

SEQ ID NO: 323359 - protein, 9 aa, Homo Sapiens
ELDRNPEDV

SEQ ID NO: 323360 - protein, 9 aa, Homo Sapiens
PPRAGLGGQ

SEQ ID NO: 323361 - protein, 9 aa, Homo Sapiens
ATNVVTFDA

SEQ ID NO: 323362 - protein, 9 aa, Homo Sapiens
PVIVLAAGY

SEQ ID NO: 323363 - protein, 9 aa, Homo Sapiens
DRTHDVTEK

SEQ ID NO: 323364 - protein, 9 aa, Homo Sapiens
PSQFIYVFT

SEQ ID NO: 323365 - protein, 9 aa, Homo Sapiens
VSLNLGFKH

SEQ ID NO: 323366 - protein, 9 aa, Homo Sapiens
SWAAGYGVW

SEQ ID NO: 323367 - protein, 9 aa, Homo Sapiens
AGEANKSIQ

SEQ ID NO: 323368 - protein, 9 aa, Homo Sapiens
AFPLVVGNP

SEQ ID NO: 323369 - protein, 9 aa, Homo Sapiens
MLCENDSRS

SEQ ID NO: 323370 - protein, 9 aa, Homo Sapiens
LLHPDIRSH

SEQ ID NO: 323371 - protein, 9 aa, Homo Sapiens
RNRITADVA

SEQ ID NO: 323372 - protein, 9 aa, Homo Sapiens
GDKVRLAVQ

SEQ ID NO: 323373 - protein, 9 aa, Homo Sapiens
IMSLRLCHL

SEQ ID NO: 323374 - protein, 9 aa, Homo Sapiens
HRLIEVDKD

SEQ ID NO: 323375 - protein, 9 aa, Homo Sapiens
VFFFIPTMH

SEQ ID NO: 323376 - protein, 9 aa, Homo Sapiens
CSPLVSGSH

SEQ ID NO: 323377 - protein, 9 aa, Homo Sapiens
SISSDSTHV

SEQ ID NO: 323378 - protein, 9 aa, Homo Sapiens
GFGFGFSPG

SEQ ID NO: 323379 - protein, 9 aa, Homo Sapiens
VMTYMKHFD

SEQ ID NO: 323380 - protein, 9 aa, Homo Sapiens
FSFLKDLKD

SEQ ID NO: 323381 - protein, 9 aa, Homo Sapiens
LFTRSITDN

SEQ ID NO: 323382 - protein, 9 aa, Homo Sapiens
QGQGPERLV

SEQ ID NO: 323383 - protein, 9 aa, Homo Sapiens
TPTPMAQFS

SEQ ID NO: 323384 - protein, 9 aa, Homo Sapiens
ILQDVLGIA

SEQ ID NO: 323385 - protein, 9 aa, Homo Sapiens
PRHRFMSVY

SEQ ID NO: 323386 - protein, 9 aa, Homo Sapiens
VTDGLPAMA

SEQ ID NO: 323387 - protein, 9 aa, Homo Sapiens
PMVRWAAAS

SEQ ID NO: 323388 - protein, 9 aa, Homo Sapiens
SVFDILSPL

SEQ ID NO: 323389 - protein, 9 aa, Homo Sapiens
NWVSTSKHA

SEQ ID NO: 323390 - protein, 9 aa, Homo Sapiens
NYEPEEEEI

SEQ ID NO: 323391 - protein, 9 aa, Homo Sapiens
GPAGREDWR

SEQ ID NO: 323392 - protein, 9 aa, Homo Sapiens
NTSWRVLIS

SEQ ID NO: 323393 - protein, 9 aa, Homo Sapiens
ILKHATATM

SEQ ID NO: 323394 - protein, 9 aa, Homo Sapiens
CRTRGEEKE

SEQ ID NO: 323395 - protein, 9 aa, Homo Sapiens
VQEGVCNIS

SEQ ID NO: 323396 - protein, 9 aa, Homo Sapiens
EHSRLRIEE

SEQ ID NO: 323397 - protein, 9 aa, Homo Sapiens
EYTWGELLV

SEQ ID NO: 323398 - protein, 9 aa, Homo Sapiens
LKTIGGVYQ

SEQ ID NO: 323399 - protein, 9 aa, Homo Sapiens
GLIMDRTEH

SEQ ID NO: 323400 - protein, 9 aa, Homo Sapiens
SYGFIAGVV

SEQ ID NO: 323401 - protein, 9 aa, Homo Sapiens
RPGPQWCAV

SEQ ID NO: 323402 - protein, 9 aa, Homo Sapiens
WIILGDFDY

SEQ ID NO: 323403 - protein, 9 aa, Homo Sapiens
RNLNKEWQF

SEQ ID NO: 323404 - protein, 9 aa, Homo Sapiens
RCAKAHEKL

SEQ ID NO: 323405 - protein, 9 aa, Homo Sapiens
PCGVGQKTR

SEQ ID NO: 323406 - protein, 9 aa, Homo Sapiens
ITRIVCDYD

SEQ ID NO: 323407 - protein, 9 aa, Homo Sapiens
DIQIVSTTC

SEQ ID NO: 323408 - protein, 9 aa, Homo Sapiens
LSSAAASPR

SEQ ID NO: 323409 - protein, 9 aa, Homo Sapiens
DDTRVHTDI

SEQ ID NO: 323410 - protein, 9 aa, Homo Sapiens
SQADFLKMR

SEQ ID NO: 323411 - protein, 9 aa, Homo Sapiens
YVFENIGKK

SEQ ID NO: 323412 - protein, 9 aa, Homo Sapiens
AWPSSSQHG

SEQ ID NO: 323413 - protein, 9 aa, Homo Sapiens
VKPDIMHHI

SEQ ID NO: 323414 - protein, 9 aa, Homo Sapiens
ESWEPHVPE

SEQ ID NO: 323415 - protein, 9 aa, Homo Sapiens
GPGGIRMVI

SEQ ID NO: 323416 - protein, 9 aa, Homo Sapiens
HVEPGQEQA

SEQ ID NO: 323417 - protein, 9 aa, Homo Sapiens
GGMKDMYGQ

SEQ ID NO: 323418 - protein, 9 aa, Homo Sapiens
TYMKHFDAH

SEQ ID NO: 323419 - protein, 9 aa, Homo Sapiens
HSPQEDGQI

SEQ ID NO: 323420 - protein, 9 aa, Homo Sapiens
LYATEEGFT

SEQ ID NO: 323421 - protein, 9 aa, Homo Sapiens
MGNLPANMK

SEQ ID NO: 323422 - protein, 9 aa, Homo Sapiens
GHALPSSLP

SEQ ID NO: 323423 - protein, 9 aa, Homo Sapiens
DKDGQLVRT

SEQ ID NO: 323424 - protein, 9 aa, Homo Sapiens
QVIHHDLKP

SEQ ID NO: 323425 - protein, 9 aa, Homo Sapiens
AFQPGKLDK

SEQ ID NO: 323426 - protein, 9 aa, Homo Sapiens
LVMAKKHQD

SEQ ID NO: 323427 - protein, 9 aa, Homo Sapiens
FLHGEACPK

SEQ ID NO: 323428 - protein, 9 aa, Homo Sapiens
IVWLKLQQE

SEQ ID NO: 323429 - protein, 9 aa, Homo Sapiens
GPKFYFENI

SEQ ID NO: 323430 - protein, 9 aa, Homo Sapiens
NSGVGAEVL

SEQ ID NO: 323431 - protein, 9 aa, Homo Sapiens
TIIRHTSMR

SEQ ID NO: 323432 - protein, 9 aa, Homo Sapiens
IAQASRREL

SEQ ID NO: 323433 - protein, 9 aa, Homo Sapiens
TTLYHFNAS

SEQ ID NO: 323434 - protein, 9 aa, Homo Sapiens
LWSFLGGWQ

SEQ ID NO: 323435 - protein, 9 aa, Homo Sapiens
HKYSLINHW

SEQ ID NO: 323436 - protein, 9 aa, Homo Sapiens
RGEDGKPFR

SEQ ID NO: 323437 - protein, 9 aa, Homo Sapiens
LPGRLPPPR

SEQ ID NO: 323438 - protein, 9 aa, Homo Sapiens
VPPSEHHGV

SEQ ID NO: 323439 - protein, 9 aa, Homo Sapiens
QFTVTPDRV

SEQ ID NO: 323440 - protein, 9 aa, Homo Sapiens
SLLGDSNIH

SEQ ID NO: 323441 - protein, 9 aa, Homo Sapiens
ADCGMKLYG

SEQ ID NO: 323442 - protein, 9 aa, Homo Sapiens
LHWDPSACL

SEQ ID NO: 323443 - protein, 9 aa, Homo Sapiens
SRPWIKNME

SEQ ID NO: 323444 - protein, 9 aa, Homo Sapiens
YDFTTYIQR

SEQ ID NO: 323445 - protein, 9 aa, Homo Sapiens
ECYRLHLEG

SEQ ID NO: 323446 - protein, 9 aa, Homo Sapiens
LQALEARIW

SEQ ID NO: 323447 - protein, 9 aa, Homo Sapiens
VAMEFAFRK

SEQ ID NO: 323448 - protein, 9 aa, Homo Sapiens
ELWGEHTLT

SEQ ID NO: 323449 - protein, 9 aa, Homo Sapiens
RKGGHCNSL

SEQ ID NO: 323450 - protein, 9 aa, Homo Sapiens
EQRARQLQR

SEQ ID NO: 323451 - protein, 9 aa, Homo Sapiens
GLLYIYERL

SEQ ID NO: 323452 - protein, 9 aa, Homo Sapiens
KFDLHEEPS

SEQ ID NO: 323453 - protein, 9 aa, Homo Sapiens
LPAAAEDGP

SEQ ID NO: 323454 - protein, 9 aa, Homo Sapiens
RDDSKFFMT

SEQ ID NO: 323455 - protein, 9 aa, Homo Sapiens
AQLGGTRGT

SEQ ID NO: 323456 - protein, 9 aa, Homo Sapiens
NSRGYPTLV

SEQ ID NO: 323457 - protein, 9 aa, Homo Sapiens
TRNPNGNDL

SEQ ID NO: 323458 - protein, 9 aa, Homo Sapiens
RQRGSDIFE

SEQ ID NO: 323459 - protein, 9 aa, Homo Sapiens
QPDPRPNGA

SEQ ID NO: 323460 - protein, 9 aa, Homo Sapiens
CENSVLEVI

SEQ ID NO: 323461 - protein, 9 aa, Homo Sapiens
PKPKWLLLQ

SEQ ID NO: 323462 - protein, 9 aa, Homo Sapiens
HRSFFESFI

SEQ ID NO: 323463 - protein, 9 aa, Homo Sapiens
AVQQREADL

SEQ ID NO: 323464 - protein, 9 aa, Homo Sapiens
SAFSISFNR

SEQ ID NO: 323465 - protein, 9 aa, Homo Sapiens
DITTGDGKP

SEQ ID NO: 323466 - protein, 9 aa, Homo Sapiens
GSAAWGRAE

SEQ ID NO: 323467 - protein, 9 aa, Homo Sapiens
NVGFLFGSL

SEQ ID NO: 323468 - protein, 9 aa, Homo Sapiens
APELPEEML

SEQ ID NO: 323469 - protein, 9 aa, Homo Sapiens
NTLAAQKNK

SEQ ID NO: 323470 - protein, 9 aa, Homo Sapiens
GSHCKKDID

SEQ ID NO: 323471 - protein, 9 aa, Homo Sapiens
SEAATTISH

SEQ ID NO: 323472 - protein, 9 aa, Homo Sapiens
GTKFSQSGH

SEQ ID NO: 323473 - protein, 9 aa, Homo Sapiens
IFGSYDPQR

SEQ ID NO: 323474 - protein, 9 aa, Homo Sapiens
RKRHTLLHN

SEQ ID NO: 323475 - protein, 9 aa, Homo Sapiens
RNPEDVPPE

SEQ ID NO: 323476 - protein, 9 aa, Homo Sapiens
PLQHEQRVL

SEQ ID NO: 323477 - protein, 9 aa, Homo Sapiens
PALSRWANL

SEQ ID NO: 323478 - protein, 9 aa, Homo Sapiens
PLSALIIAQ

SEQ ID NO: 323479 - protein, 9 aa, Homo Sapiens
RNGIRLDGK

SEQ ID NO: 323480 - protein, 9 aa, Homo Sapiens
PNLYSYFRS

SEQ ID NO: 323481 - protein, 9 aa, Homo Sapiens
DSLNTSWRV

SEQ ID NO: 323482 - protein, 9 aa, Homo Sapiens
TIGGVYQQA

SEQ ID NO: 323483 - protein, 9 aa, Homo Sapiens
ISKGYVQIV

SEQ ID NO: 323484 - protein, 9 aa, Homo Sapiens
GDASSWHGQ

SEQ ID NO: 323485 - protein, 9 aa, Homo Sapiens
EEVDTDAAD

SEQ ID NO: 323486 - protein, 9 aa, Homo Sapiens
GTEAYIPQR

SEQ ID NO: 323487 - protein, 9 aa, Homo Sapiens
NGSRASPDN

SEQ ID NO: 323488 - protein, 9 aa, Homo Sapiens
VQLRNSADC

SEQ ID NO: 323489 - protein, 9 aa, Homo Sapiens
QKSSRGFGF

SEQ ID NO: 323490 - protein, 9 aa, Homo Sapiens
VHTDIQNDE

SEQ ID NO: 323491 - protein, 9 aa, Homo Sapiens
AVQINLSLT

SEQ ID NO: 323492 - protein, 9 aa, Homo Sapiens
VSHGAGILT

SEQ ID NO: 323493 - protein, 9 aa, Homo Sapiens
RMQDLDLSD

SEQ ID NO: 323494 - protein, 9 aa, Homo Sapiens
FRCICPPGS

SEQ ID NO: 323495 - protein, 9 aa, Homo Sapiens
DGPAGREDW

SEQ ID NO: 323496 - protein, 9 aa, Homo Sapiens
GKCVMDSVG

SEQ ID NO: 323497 - protein, 9 aa, Homo Sapiens
RLWTHLPNI

SEQ ID NO: 323498 - protein, 9 aa, Homo Sapiens
QVLHVDSSR

SEQ ID NO: 323499 - protein, 9 aa, Homo Sapiens
FSNRAQKAR

SEQ ID NO: 323500 - protein, 9 aa, Homo Sapiens
EQDMSLRLN

SEQ ID NO: 323501 - protein, 9 aa, Homo Sapiens
GAKSEHRNF

SEQ ID NO: 323502 - protein, 9 aa, Homo Sapiens
AEVLLLTSM

SEQ ID NO: 323503 - protein, 9 aa, Homo Sapiens
AVRTPPCTP

SEQ ID NO: 323504 - protein, 9 aa, Homo Sapiens
WEKLEHKEI

SEQ ID NO: 323505 - protein, 9 aa, Homo Sapiens
SQNLLVLQI

SEQ ID NO: 323506 - protein, 9 aa, Homo Sapiens
RKYRYGMGK

SEQ ID NO: 323507 - protein, 9 aa, Homo Sapiens
KNEKFHMWP

SEQ ID NO: 323508 - protein, 9 aa, Homo Sapiens
FIRLGSCFR

SEQ ID NO: 323509 - protein, 9 aa, Homo Sapiens
MNKHLRGGG

SEQ ID NO: 323510 - protein, 9 aa, Homo Sapiens
VSKLQCQIH

SEQ ID NO: 323511 - protein, 9 aa, Homo Sapiens
TMRVSDHQQ

SEQ ID NO: 323512 - protein, 9 aa, Homo Sapiens
EAQRVAMEF

SEQ ID NO: 323513 - protein, 9 aa, Homo Sapiens
SPLFEKGPE

SEQ ID NO: 323514 - protein, 9 aa, Homo Sapiens
RKLCERLLA

SEQ ID NO: 323515 - protein, 9 aa, Homo Sapiens
VHCEESGRH

SEQ ID NO: 323516 - protein, 9 aa, Homo Sapiens
KPTNGTKVV

SEQ ID NO: 323517 - protein, 9 aa, Homo Sapiens
LEQQQQQQR

SEQ ID NO: 323518 - protein, 9 aa, Homo Sapiens
EGFVNTYGL

SEQ ID NO: 323519 - protein, 9 aa, Homo Sapiens
YEPKQFKND

SEQ ID NO: 323520 - protein, 9 aa, Homo Sapiens
VVCWTPYHM

SEQ ID NO: 323521 - protein, 9 aa, Homo Sapiens
KVFNNQLFT

SEQ ID NO: 323522 - protein, 9 aa, Homo Sapiens
KNWVSTSKH

SEQ ID NO: 323523 - protein, 9 aa, Homo Sapiens
QSRANGVPT

SEQ ID NO: 323524 - protein, 9 aa, Homo Sapiens
MSASGFLWS

SEQ ID NO: 323525 - protein, 9 aa, Homo Sapiens
ELGLQKKLH

SEQ ID NO: 323526 - protein, 9 aa, Homo Sapiens
LKPKNHPLG

SEQ ID NO: 323527 - protein, 9 aa, Homo Sapiens
MIDKRSPLY

SEQ ID NO: 323528 - protein, 9 aa, Homo Sapiens
LQLPPMSVA

SEQ ID NO: 323529 - protein, 9 aa, Homo Sapiens
KCHRTKEEG

SEQ ID NO: 323530 - protein, 9 aa, Homo Sapiens
EEKLLGAET

SEQ ID NO: 323531 - protein, 9 aa, Homo Sapiens
RGPGGQLRL

SEQ ID NO: 323532 - protein, 9 aa, Homo Sapiens
VNQRTRKVL

SEQ ID NO: 323533 - protein, 9 aa, Homo Sapiens
VHGHSPPPS

SEQ ID NO: 323534 - protein, 9 aa, Homo Sapiens
CLNVGFLFG

SEQ ID NO: 323535 - protein, 9 aa, Homo Sapiens
NPENTGSTL

SEQ ID NO: 323536 - protein, 9 aa, Homo Sapiens
IMIPPIPKA

SEQ ID NO: 323537 - protein, 9 aa, Homo Sapiens
IQKKLVIVG

SEQ ID NO: 323538 - protein, 9 aa, Homo Sapiens
ECGEKPDMH

SEQ ID NO: 323539 - protein, 9 aa, Homo Sapiens
FHSNTDHLD

SEQ ID NO: 323540 - protein, 9 aa, Homo Sapiens
ASRPELLYH

SEQ ID NO: 323541 - protein, 9 aa, Homo Sapiens
GNGTKFSQS

SEQ ID NO: 323542 - protein, 9 aa, Homo Sapiens
FGHPVVVPH

SEQ ID NO: 323543 - protein, 9 aa, Homo Sapiens
GTERIGRHM

SEQ ID NO: 323544 - protein, 9 aa, Homo Sapiens
ATATDAKAR

SEQ ID NO: 323545 - protein, 9 aa, Homo Sapiens
SGAFQDSIL

SEQ ID NO: 323546 - protein, 9 aa, Homo Sapiens
PADAESASR

SEQ ID NO: 323547 - protein, 9 aa, Homo Sapiens
VAVGQYPLV

SEQ ID NO: 323548 - protein, 9 aa, Homo Sapiens
QAQVYFEEA

SEQ ID NO: 323549 - protein, 9 aa, Homo Sapiens
QITSEAEDL

SEQ ID NO: 323550 - protein, 9 aa, Homo Sapiens
DHNKVIELP

SEQ ID NO: 323551 - protein, 9 aa, Homo Sapiens
CCAPSVANP

SEQ ID NO: 323552 - protein, 9 aa, Homo Sapiens
GIDQDHAAF

SEQ ID NO: 323553 - protein, 9 aa, Homo Sapiens
GTCEVRAAH

SEQ ID NO: 323554 - protein, 9 aa, Homo Sapiens
KIPKTDLLM

SEQ ID NO: 323555 - protein, 9 aa, Homo Sapiens
VQSTQSQFR

SEQ ID NO: 323556 - protein, 9 aa, Homo Sapiens
AALALTLLS

SEQ ID NO: 323557 - protein, 9 aa, Homo Sapiens
NAKRRGRLI

SEQ ID NO: 323558 - protein, 9 aa, Homo Sapiens
IPNSDQKDS

SEQ ID NO: 323559 - protein, 9 aa, Homo Sapiens
HVDWLYNRL

SEQ ID NO: 323560 - protein, 9 aa, Homo Sapiens
RSLRRPPPR

SEQ ID NO: 323561 - protein, 9 aa, Homo Sapiens
LCPDRAVDG

SEQ ID NO: 323562 - protein, 9 aa, Homo Sapiens
HSHRRQGLA

SEQ ID NO: 323563 - protein, 9 aa, Homo Sapiens
QVILTPSEA

SEQ ID NO: 323564 - protein, 9 aa, Homo Sapiens
VWGKLDDGS

SEQ ID NO: 323565 - protein, 9 aa, Homo Sapiens
DDEKCEAAL

SEQ ID NO: 323566 - protein, 9 aa, Homo Sapiens
ANNREKQGL

SEQ ID NO: 323567 - protein, 9 aa, Homo Sapiens
PADASRNGI

SEQ ID NO: 323568 - protein, 9 aa, Homo Sapiens
SNRAQKARL

SEQ ID NO: 323569 - protein, 9 aa, Homo Sapiens
HVTALPRGP

SEQ ID NO: 323570 - protein, 9 aa, Homo Sapiens
EKMQTHPWR

SEQ ID NO: 323571 - protein, 9 aa, Homo Sapiens
LGDRRVQNI

SEQ ID NO: 323572 - protein, 9 aa, Homo Sapiens
YEEILLELV

SEQ ID NO: 323573 - protein, 9 aa, Homo Sapiens
ILALVYQDQ

SEQ ID NO: 323574 - protein, 9 aa, Homo Sapiens
DRVDFRLSR

SEQ ID NO: 323575 - protein, 9 aa, Homo Sapiens
PGACSSHGR

SEQ ID NO: 323576 - protein, 9 aa, Homo Sapiens
TGTGGRQGS

SEQ ID NO: 323577 - protein, 9 aa, Homo Sapiens
HGLGAVIPG

SEQ ID NO: 323578 - protein, 9 aa, Homo Sapiens
RQEEKMHNQ

SEQ ID NO: 323579 - protein, 9 aa, Homo Sapiens
VAVLIILLP

SEQ ID NO: 323580 - protein, 9 aa, Homo Sapiens
RNVEIGTCK

SEQ ID NO: 323581 - protein, 9 aa, Homo Sapiens
NELQNLMAA

SEQ ID NO: 323582 - protein, 9 aa, Homo Sapiens
ALSRYNLVQ

SEQ ID NO: 323583 - protein, 9 aa, Homo Sapiens
KKEGIQTQN

SEQ ID NO: 323584 - protein, 9 aa, Homo Sapiens
VVESYSGAG

SEQ ID NO: 323585 - protein, 9 aa, Homo Sapiens
SKAAGAARI

SEQ ID NO: 323586 - protein, 9 aa, Homo Sapiens
SVFSQHFYC

SEQ ID NO: 323587 - protein, 9 aa, Homo Sapiens
VAMACCYTI

SEQ ID NO: 323588 - protein, 9 aa, Homo Sapiens
VDGPRELML

SEQ ID NO: 323589 - protein, 9 aa, Homo Sapiens
FRRAPPESC

SEQ ID NO: 323590 - protein, 9 aa, Homo Sapiens
FRQRTSLIL

SEQ ID NO: 323591 - protein, 9 aa, Homo Sapiens
VTGQEFHSN

SEQ ID NO: 323592 - protein, 9 aa, Homo Sapiens
VFSQMTHVR

SEQ ID NO: 323593 - protein, 9 aa, Homo Sapiens
VVLRSTMPV

SEQ ID NO: 323594 - protein, 9 aa, Homo Sapiens
SVHRGEAPC

SEQ ID NO: 323595 - protein, 9 aa, Homo Sapiens
WAPSVATVG

SEQ ID NO: 323596 - protein, 9 aa, Homo Sapiens
RLQVESESA

SEQ ID NO: 323597 - protein, 9 aa, Homo Sapiens
LGETVALKH

SEQ ID NO: 323598 - protein, 9 aa, Homo Sapiens
TVNMDGTTL

SEQ ID NO: 323599 - protein, 9 aa, Homo Sapiens
SMSKNNYEK

SEQ ID NO: 323600 - protein, 9 aa, Homo Sapiens
AKPPIAPAT

SEQ ID NO: 323601 - protein, 9 aa, Homo Sapiens
PQRFANTMG

SEQ ID NO: 323602 - protein, 9 aa, Homo Sapiens
DKCSCCYGP

SEQ ID NO: 323603 - protein, 9 aa, Homo Sapiens
CAQGFIGSP

SEQ ID NO: 323604 - protein, 9 aa, Homo Sapiens
TGTGTGGRQ

SEQ ID NO: 323605 - protein, 9 aa, Homo Sapiens
LIGQEAAFA

SEQ ID NO: 323606 - protein, 9 aa, Homo Sapiens
TLAQAQQNQ

SEQ ID NO: 323607 - protein, 9 aa, Homo Sapiens
QYPQTQLRL

SEQ ID NO: 323608 - protein, 9 aa, Homo Sapiens
EHGEQNRTS

SEQ ID NO: 323609 - protein, 9 aa, Homo Sapiens
LWHLALLAG

SEQ ID NO: 323610 - protein, 9 aa, Homo Sapiens
SQQLQDDLM

SEQ ID NO: 323611 - protein, 9 aa, Homo Sapiens
HWLFKMDSE

SEQ ID NO: 323612 - protein, 9 aa, Homo Sapiens
MLDIFMRFG

SEQ ID NO: 323613 - protein, 9 aa, Homo Sapiens
LQCFFQQDT

SEQ ID NO: 323614 - protein, 9 aa, Homo Sapiens
PTVNFLTTV

SEQ ID NO: 323615 - protein, 9 aa, Homo Sapiens
SETEKDIRL

SEQ ID NO: 323616 - protein, 9 aa, Homo Sapiens
QQQLANFCQ

SEQ ID NO: 323617 - protein, 9 aa, Homo Sapiens
LEKLFVTVC

SEQ ID NO: 323618 - protein, 9 aa, Homo Sapiens
FFDRNHPSF

SEQ ID NO: 323619 - protein, 9 aa, Homo Sapiens
APQKKVRSI

SEQ ID NO: 323620 - protein, 9 aa, Homo Sapiens
NLDLRDDSC

SEQ ID NO: 323621 - protein, 9 aa, Homo Sapiens
TSGIQAPAC

SEQ ID NO: 323622 - protein, 9 aa, Homo Sapiens
TIIVFIFAV

SEQ ID NO: 323623 - protein, 9 aa, Homo Sapiens
TVVKWNKDD

SEQ ID NO: 323624 - protein, 9 aa, Homo Sapiens
PDLRQWLPL

SEQ ID NO: 323625 - protein, 9 aa, Homo Sapiens
AGPFANITH

SEQ ID NO: 323626 - protein, 9 aa, Homo Sapiens
SSVETVCGY

SEQ ID NO: 323627 - protein, 9 aa, Homo Sapiens
SPYPAETFC

SEQ ID NO: 323628 - protein, 9 aa, Homo Sapiens
FHYGVHTCE

SEQ ID NO: 323629 - protein, 9 aa, Homo Sapiens
TGLAFCPGS

SEQ ID NO: 323630 - protein, 9 aa, Homo Sapiens
KRFKLSLVG

SEQ ID NO: 323631 - protein, 9 aa, Homo Sapiens
HSKPPLKDL

SEQ ID NO: 323632 - protein, 9 aa, Homo Sapiens
LELLECIHR

SEQ ID NO: 323633 - protein, 9 aa, Homo Sapiens
YLDIKAPEQ

SEQ ID NO: 323634 - protein, 9 aa, Homo Sapiens
ALAPLLLVF

SEQ ID NO: 323635 - protein, 9 aa, Homo Sapiens
NSKLSWHQK

SEQ ID NO: 323636 - protein, 9 aa, Homo Sapiens
EECLARQKE

SEQ ID NO: 323637 - protein, 9 aa, Homo Sapiens
VAKALHRGL

SEQ ID NO: 323638 - protein, 9 aa, Homo Sapiens
NGFDFVINE

SEQ ID NO: 323639 - protein, 9 aa, Homo Sapiens
LMLFGGIPK

SEQ ID NO: 323640 - protein, 9 aa, Homo Sapiens
LPFWLVLWL

SEQ ID NO: 323641 - protein, 9 aa, Homo Sapiens
EVADHLFSS

SEQ ID NO: 323642 - protein, 9 aa, Homo Sapiens
RYNLVQGQG

SEQ ID NO: 323643 - protein, 9 aa, Homo Sapiens
EASLQKDPR

SEQ ID NO: 323644 - protein, 9 aa, Homo Sapiens
GCLLCTYVL

SEQ ID NO: 323645 - protein, 9 aa, Homo Sapiens
LWKVSDPII

SEQ ID NO: 323646 - protein, 9 aa, Homo Sapiens
VRRHRQAEM

SEQ ID NO: 323647 - protein, 9 aa, Homo Sapiens
FSALVRWGK

SEQ ID NO: 323648 - protein, 9 aa, Homo Sapiens
KGRVALRDI

SEQ ID NO: 323649 - protein, 9 aa, Homo Sapiens
APLLLVFVT

SEQ ID NO: 323650 - protein, 9 aa, Homo Sapiens
DLDVMFASS

SEQ ID NO: 323651 - protein, 9 aa, Homo Sapiens
KRCGRDPEM

SEQ ID NO: 323652 - protein, 9 aa, Homo Sapiens
HPKPDVATV

SEQ ID NO: 323653 - protein, 9 aa, Homo Sapiens
PEKRPPFYH

SEQ ID NO: 323654 - protein, 9 aa, Homo Sapiens
HFSVRQTES

SEQ ID NO: 323655 - protein, 9 aa, Homo Sapiens
LRDDSCLRS

SEQ ID NO: 323656 - protein, 9 aa, Homo Sapiens
RTLPCRPYK

SEQ ID NO: 323657 - protein, 9 aa, Homo Sapiens
HQQDPHLTH

SEQ ID NO: 323658 - protein, 9 aa, Homo Sapiens
STDKVACLL

SEQ ID NO: 323659 - protein, 9 aa, Homo Sapiens
TTEAQESGI

SEQ ID NO: 323660 - protein, 9 aa, Homo Sapiens
SLHLFHVVT

SEQ ID NO: 323661 - protein, 9 aa, Homo Sapiens
VTLVSVRVF

SEQ ID NO: 323662 - protein, 9 aa, Homo Sapiens
SLLCHLPWI

SEQ ID NO: 323663 - protein, 9 aa, Homo Sapiens
AGILTCLLL

SEQ ID NO: 323664 - protein, 9 aa, Homo Sapiens
VDTSIKGMY

SEQ ID NO: 323665 - protein, 9 aa, Homo Sapiens
KTKNLLLDG

SEQ ID NO: 323666 - protein, 9 aa, Homo Sapiens
MALGFNPPD

SEQ ID NO: 323667 - protein, 9 aa, Homo Sapiens
GWTETNTER

SEQ ID NO: 323668 - protein, 9 aa, Homo Sapiens
KDSFEGLVQ
